United States Patent 7,655,785 (BIOINFORMATICALLY DETECTABLE GROUP OF NOVEL REGULATORY OLIGONUCLEOTIDES AND USES THEREOF) - sequence listing, part 29

SEQ ID NO: 1182580 - RNA, 16 nt, Homo sapiens
guacuguaugccuuca

SEQ ID NO: 1182581 - RNA, 15 nt, Homo sapiens
guacuguuacugugu

SEQ ID NO: 1182582 - RNA, 13 nt, Homo sapiens
guacuuacaucag

SEQ ID NO: 1182583 - RNA, 14 nt, Homo sapiens
guacuuacaucagg

SEQ ID NO: 1182584 - RNA, 22 nt, Homo sapiens
guacuuggaagcauucacaaag

SEQ ID NO: 1182585 - RNA, 16 nt, Homo sapiens
guacuuuuuacauaca

SEQ ID NO: 1182586 - RNA, 18 nt, Homo sapiens
guagaaaaugcaccaaau

SEQ ID NO: 1182587 - RNA, 22 nt, Homo sapiens
guagaaaauuuguuauuuugca

SEQ ID NO: 1182588 - RNA, 15 nt, Homo sapiens
guagaacugauuuua

SEQ ID NO: 1182589 - RNA, 17 nt, Homo sapiens
guagaagccacuauuac

SEQ ID NO: 1182590 - RNA, 15 nt, Homo sapiens
guagaauugcauuga

SEQ ID NO: 1182591 - RNA, 18 nt, Homo sapiens
guagacugaaaagccaug

SEQ ID NO: 1182592 - RNA, 20 nt, Homo sapiens
guagagacgguguuuugcca

SEQ ID NO: 1182593 - RNA, 20 nt, Homo sapiens
guagagauggagucuugcua

SEQ ID NO: 1182594 - RNA, 13 nt, Homo sapiens
guagauaaggaaa

SEQ ID NO: 1182595 - RNA, 12 nt, Homo sapiens
guagaugugcug

SEQ ID NO: 1182596 - RNA, 16 nt, Homo sapiens
guagauucacauacag

SEQ ID NO: 1182597 - RNA, 16 nt, Homo sapiens
guagcagguuucacua

SEQ ID NO: 1182598 - RNA, 12 nt, Homo sapiens
guagcauuuuau

SEQ ID NO: 1182599 - RNA, 18 nt, Homo sapiens
guagccuaacacacucca

SEQ ID NO: 1182600 - RNA, 16 nt, Homo sapiens
guagccugugcaugua

SEQ ID NO: 1182601 - RNA, 16 nt, Homo sapiens
guagcuaaagugcaag

SEQ ID NO: 1182602 - RNA, 19 nt, Homo sapiens
guaggaaucugccuuccag

SEQ ID NO: 1182603 - RNA, 20 nt, Homo sapiens
guaggaggaacagauuugag

SEQ ID NO: 1182604 - RNA, 23 nt, Homo sapiens
guaggauauuuucccuaccuaag

SEQ ID NO: 1182605 - RNA, 14 nt, Homo sapiens
guaggaucaccuga

SEQ ID NO: 1182606 - RNA, 17 nt, Homo sapiens
guaggauuggggaccau

SEQ ID NO: 1182607 - RNA, 13 nt, Homo sapiens
guaggugucucau

SEQ ID NO: 1182608 - RNA, 22 nt, Homo sapiens
guagguuaaaaaaauggcagug

SEQ ID NO: 1182609 - RNA, 20 nt, Homo sapiens
guagucccagcuacuuggga

SEQ ID NO: 1182610 - RNA, 14 nt, Homo sapiens
guagugucacucaa

SEQ ID NO: 1182611 - RNA, 21 nt, Homo sapiens
guagugucacucaaggcggug

SEQ ID NO: 1182612 - RNA, 20 nt, Homo sapiens
guaguuuuguuuaugcauuu

SEQ ID NO: 1182613 - RNA, 15 nt, Homo sapiens
guauaaaaauagaua

SEQ ID NO: 1182614 - RNA, 16 nt, Homo sapiens
guauaaauuuacuuuu

SEQ ID NO: 1182615 - RNA, 21 nt, Homo sapiens
guauauaaauuuucccaaaac

SEQ ID NO: 1182616 - RNA, 20 nt, Homo sapiens
guauaugauucucugugguu

SEQ ID NO: 1182617 - RNA, 16 nt, Homo sapiens
guauaugucauuuacu

SEQ ID NO: 1182618 - RNA, 22 nt, Homo sapiens
guauauuuaugaccagagcaaa

SEQ ID NO: 1182619 - RNA, 17 nt, Homo sapiens
guauauuugguacugua

SEQ ID NO: 1182620 - RNA, 21 nt, Homo sapiens
guauauuuugacgucacugau

SEQ ID NO: 1182621 - RNA, 14 nt, Homo sapiens
guaucaaaugugac

SEQ ID NO: 1182622 - RNA, 15 nt, Homo sapiens
guaucaaaugugaca

SEQ ID NO: 1182623 - RNA, 15 nt, Homo sapiens
guaucaggacccaga

SEQ ID NO: 1182624 - RNA, 17 nt, Homo sapiens
guaucaugcccugugca

SEQ ID NO: 1182625 - RNA, 18 nt, Homo sapiens
guaucaugcccugugcaa

SEQ ID NO: 1182626 - RNA, 12 nt, Homo sapiens
guaucauuacau

SEQ ID NO: 1182627 - RNA, 12 nt, Homo sapiens
guaucauucaac

SEQ ID NO: 1182628 - RNA, 19 nt, Homo sapiens
guauccauuaucaugugua

SEQ ID NO: 1182629 - RNA, 13 nt, Homo sapiens
guaucgcugagac

SEQ ID NO: 1182630 - RNA, 16 nt, Homo sapiens
guaucguauagcugua

SEQ ID NO: 1182631 - RNA, 20 nt, Homo sapiens
guaucugacaaugcugaggu

SEQ ID NO: 1182632 - RNA, 19 nt, Homo sapiens
guaucuugccuaaggugcg

SEQ ID NO: 1182633 - RNA, 16 nt, Homo sapiens
guaugaaacaaacuac

SEQ ID NO: 1182634 - RNA, 22 nt, Homo sapiens
guaugaaacaaacuacuguguc

SEQ ID NO: 1182635 - RNA, 13 nt, Homo sapiens
guaugcaugugaa

SEQ ID NO: 1182636 - RNA, 12 nt, Homo sapiens
guaugccaagug

SEQ ID NO: 1182637 - RNA, 21 nt, Homo sapiens
guaugcuugcucuaagucaaa

SEQ ID NO: 1182638 - RNA, 22 nt, Homo sapiens
guauggucuuggcagcaccugu

SEQ ID NO: 1182639 - RNA, 19 nt, Homo sapiens
guauguauuuaaggagaac

SEQ ID NO: 1182640 - RNA, 17 nt, Homo sapiens
guauuaaaccuuuccau

SEQ ID NO: 1182641 - RNA, 20 nt, Homo sapiens
guauuaauaguucaguguau

SEQ ID NO: 1182642 - RNA, 13 nt, Homo sapiens
guauuacugcugc

SEQ ID NO: 1182643 - RNA, 17 nt, Homo sapiens
guauuauauaauucaag

SEQ ID NO: 1182644 - RNA, 21 nt, Homo sapiens
guauucucuaaaagcuuuaaa

SEQ ID NO: 1182645 - RNA, 12 nt, Homo sapiens
guauucuguucu

SEQ ID NO: 1182646 - RNA, 21 nt, Homo sapiens
guauucuuuuuccaucccuag

SEQ ID NO: 1182647 - RNA, 18 nt, Homo sapiens
guauugauaaacuuugaa

SEQ ID NO: 1182648 - RNA, 23 nt, Homo sapiens
guauuuuaauaguacauaaucuu

SEQ ID NO: 1182649 - RNA, 23 nt, Homo sapiens
guauuuuauuacaucuuucacau

SEQ ID NO: 1182650 - RNA, 22 nt, Homo sapiens
guauuuugugaugaaucuacau

SEQ ID NO: 1182651 - RNA, 16 nt, Homo sapiens
guauuuuuaguagaga

SEQ ID NO: 1182652 - RNA, 19 nt, Homo sapiens
guauuuuucaaaacauaca

SEQ ID NO: 1182653 - RNA, 13 nt, Homo sapiens
gucaaacuguaga

SEQ ID NO: 1182654 - RNA, 12 nt, Homo sapiens
gucaacauugug

SEQ ID NO: 1182655 - RNA, 19 nt, Homo sapiens
gucaagccugugcaaaaaa

SEQ ID NO: 1182656 - RNA, 22 nt, Homo sapiens
gucacaacaaaaggaagacugg

SEQ ID NO: 1182657 - RNA, 19 nt, Homo sapiens
gucacaccuuagugcuaua

SEQ ID NO: 1182658 - RNA, 19 nt, Homo sapiens
gucacagauucuuuucuau

SEQ ID NO: 1182659 - RNA, 11 nt, Homo sapiens
gucacagggac

SEQ ID NO: 1182660 - RNA, 21 nt, Homo sapiens
gucacauggaaucuacaugug

SEQ ID NO: 1182661 - RNA, 18 nt, Homo sapiens
gucacauggccuaugcac

SEQ ID NO: 1182662 - RNA, 14 nt, Homo sapiens
gucacgcaccuggg

SEQ ID NO: 1182663 - RNA, 23 nt, Homo sapiens
gucacgcuuucaugaauucuguc

SEQ ID NO: 1182664 - RNA, 16 nt, Homo sapiens
uaaaguugugccaaac

SEQ ID NO: 1182665 - RNA, 21 nt, Homo sapiens
uaaaguuuuaggguacaguuu

SEQ ID NO: 1182666 - RNA, 14 nt, Homo sapiens
uaaauaacuauaua

SEQ ID NO: 1182667 - RNA, 17 nt, Homo sapiens
uaaauaaucuuacucua

SEQ ID NO: 1182668 - RNA, 15 nt, Homo sapiens
uaaauacagucuucc

SEQ ID NO: 1182669 - RNA, 22 nt, Homo sapiens
uaaauaucauaaucugaugaua

SEQ ID NO: 1182670 - RNA, 23 nt, Homo sapiens
uaaauauuaggagacacagggaa

SEQ ID NO: 1182671 - RNA, 17 nt, Homo sapiens
uaaauauucuagguuag

SEQ ID NO: 1182672 - RNA, 14 nt, Homo sapiens
uaaaucaugaugcu

SEQ ID NO: 1182673 - RNA, 20 nt, Homo sapiens
uaaaucguccucccaggcca

SEQ ID NO: 1182674 - RNA, 16 nt, Homo sapiens
uaaaucuuuucaauua

SEQ ID NO: 1182675 - RNA, 22 nt, Homo sapiens
uaaaugagagggaaucgacugu

SEQ ID NO: 1182676 - RNA, 14 nt, Homo sapiens
uaaaugcaauauuc

SEQ ID NO: 1182677 - RNA, 13 nt, Homo sapiens
uaaaugcuacuga

SEQ ID NO: 1182678 - RNA, 22 nt, Homo sapiens
uaaaugcuacugaaacuuaccu

SEQ ID NO: 1182679 - RNA, 19 nt, Homo sapiens
uaaaugcuauuauacuguu

SEQ ID NO: 1182680 - RNA, 23 nt, Homo sapiens
uaaaugcuuuuauuaaagcaauc

SEQ ID NO: 1182681 - RNA, 16 nt, Homo sapiens
uaaauggcaugacaua

SEQ ID NO: 1182682 - RNA, 18 nt, Homo sapiens
uaaauggcuggggggcca

SEQ ID NO: 1182683 - RNA, 20 nt, Homo sapiens
uaaaugggaacugauguaga

SEQ ID NO: 1182684 - RNA, 16 nt, Homo sapiens
uaaauguauuggcaca

SEQ ID NO: 1182685 - RNA, 15 nt, Homo sapiens
uaaauguucuaauaa

SEQ ID NO: 1182686 - RNA, 12 nt, Homo sapiens
uaaauguugcuu

SEQ ID NO: 1182687 - RNA, 17 nt, Homo sapiens
uaaauuauacacuauga

SEQ ID NO: 1182688 - RNA, 20 nt, Homo sapiens
uaaauucuauaggaacauau

SEQ ID NO: 1182689 - RNA, 18 nt, Homo sapiens
uaaauucucuccuaauga

SEQ ID NO: 1182690 - RNA, 22 nt, Homo sapiens
uaaauucucucuaacauaacaa

SEQ ID NO: 1182691 - RNA, 13 nt, Homo sapiens
uaaauucuggaac

SEQ ID NO: 1182692 - RNA, 23 nt, Homo sapiens
uaaauuuuuuuuuuaauugcacu

SEQ ID NO: 1182693 - RNA, 18 nt, Homo sapiens
uaacaagucgaugaacua

SEQ ID NO: 1182694 - RNA, 15 nt, Homo sapiens
uaacaauaaaagaca

SEQ ID NO: 1182695 - RNA, 20 nt, Homo sapiens
uaacaaugacauuuauauca

SEQ ID NO: 1182696 - RNA, 12 nt, Homo sapiens
uaacacacucca

SEQ ID NO: 1182697 - RNA, 21 nt, Homo sapiens
uaacacagccguguguucaaa

SEQ ID NO: 1182698 - RNA, 23 nt, Homo sapiens
uaacaccagacagacaacacugg

SEQ ID NO: 1182699 - RNA, 20 nt, Homo sapiens
uaacagaguaucagaucuau

SEQ ID NO: 1182700 - RNA, 20 nt, Homo sapiens
uaacagaugcaaugugcuac

SEQ ID NO: 1182701 - RNA, 16 nt, Homo sapiens
uaacaggugccuuccc

SEQ ID NO: 1182702 - RNA, 17 nt, Homo sapiens
uaacaguaguccuuuga

SEQ ID NO: 1182703 - RNA, 17 nt, Homo sapiens
uaacagucuagugcaaa

SEQ ID NO: 1182704 - RNA, 23 nt, Homo sapiens
uaacauaccguuuauaaugccau

SEQ ID NO: 1182705 - RNA, 22 nt, Homo sapiens
uaacaugauaaaagacacuccc

SEQ ID NO: 1182706 - RNA, 17 nt, Homo sapiens
uaacaugcaauuuugca

SEQ ID NO: 1182707 - RNA, 23 nt, Homo sapiens
uaacauuuguguaauaugaaaua

SEQ ID NO: 1182708 - RNA, 19 nt, Homo sapiens
uaaccacaaagcacaguuu

SEQ ID NO: 1182709 - RNA, 21 nt, Homo sapiens
uaaccaggcugggcucagcuc

SEQ ID NO: 1182710 - RNA, 19 nt, Homo sapiens
uaaccaugaaaauagccaa

SEQ ID NO: 1182711 - RNA, 22 nt, Homo sapiens
uaacccaaaaggccuuacaaau

SEQ ID NO: 1182712 - RNA, 23 nt, Homo sapiens
uaaccccagauucaugcacugua

SEQ ID NO: 1182713 - RNA, 22 nt, Homo sapiens
uaacccucccuguucaucccau

SEQ ID NO: 1182714 - RNA, 12 nt, Homo sapiens
uaaccucuuguu

SEQ ID NO: 1182715 - RNA, 23 nt, Homo sapiens
uaaccugacagaggugucaucca

SEQ ID NO: 1182716 - RNA, 22 nt, Homo sapiens
uaaccugcaaaaucuguucuaa

SEQ ID NO: 1182717 - RNA, 15 nt, Homo sapiens
uaacgauaaaagaca

SEQ ID NO: 1182718 - RNA, 14 nt, Homo sapiens
uaacgucaugugca

SEQ ID NO: 1182719 - RNA, 17 nt, Homo sapiens
uaacuaaccacauuuua

SEQ ID NO: 1182720 - RNA, 22 nt, Homo sapiens
uaacuagacaccaaaguucuaa

SEQ ID NO: 1182721 - RNA, 22 nt, Homo sapiens
uaacuaguccuuuacuaaucca

SEQ ID NO: 1182722 - RNA, 13 nt, Homo sapiens
uaacuauaccucu

SEQ ID NO: 1182723 - RNA, 23 nt, Homo sapiens
uaacuaugaucaucuugaugucu

SEQ ID NO: 1182724 - RNA, 15 nt, Homo sapiens
uaacucagacacaaa

SEQ ID NO: 1182725 - RNA, 17 nt, Homo sapiens
uaacucagacacaaaua

SEQ ID NO: 1182726 - RNA, 15 nt, Homo sapiens
uaacugaaccaaauu

SEQ ID NO: 1182727 - RNA, 14 nt, Homo sapiens
uaacugaagcucua

SEQ ID NO: 1182728 - RNA, 16 nt, Homo sapiens
uaacugacaacuugaa

SEQ ID NO: 1182729 - RNA, 14 nt, Homo sapiens
uaacugcauugaga

SEQ ID NO: 1182730 - RNA, 13 nt, Homo sapiens
uaacugugaauaa

SEQ ID NO: 1182731 - RNA, 16 nt, Homo sapiens
uaacuuaagauuugcu

SEQ ID NO: 1182732 - RNA, 13 nt, Homo sapiens
uaacuuagaagga

SEQ ID NO: 1182733 - RNA, 15 nt, Homo sapiens
uaacuuagcacuacu

SEQ ID NO: 1182734 - RNA, 22 nt, Homo sapiens
uaacuuguuugguaguuagcca

SEQ ID NO: 1182735 - RNA, 21 nt, Homo sapiens
uaacuuuaugaagugcuacag

SEQ ID NO: 1182736 - RNA, 22 nt, Homo sapiens
uaacuuugcccuucacuguugc

SEQ ID NO: 1182737 - RNA, 22 nt, Homo sapiens
uaacuuugcuggaaaaucugua

SEQ ID NO: 1182738 - RNA, 16 nt, Homo sapiens
uaacuuuuugcacuau

SEQ ID NO: 1182739 - RNA, 14 nt, Homo sapiens
uaacuuuuugccaa

SEQ ID NO: 1182740 - RNA, 17 nt, Homo sapiens
uaagaaaaaugagcaua

SEQ ID NO: 1182741 - RNA, 17 nt, Homo sapiens
uaagaaaacaucacuga

SEQ ID NO: 1182742 - RNA, 18 nt, Homo sapiens
uaagaaaacaucacugaa

SEQ ID NO: 1182743 - RNA, 15 nt, Homo sapiens
uaagaaacacacuga

SEQ ID NO: 1182744 - RNA, 13 nt, Homo sapiens
uaagaacagcuca

SEQ ID NO: 1182745 - RNA, 22 nt, Homo sapiens
uaagaaccacucauaauucuuc

SEQ ID NO: 1182746 - RNA, 19 nt, Homo sapiens
uaagaauguuuugcacuga

SEQ ID NO: 1182747 - RNA, 16 nt, Homo sapiens
uaagaauuauuuugau

SEQ ID NO: 1182748 - RNA, 12 nt, Homo sapiens
uaagaauuucac

SEQ ID NO: 1182749 - RNA, 13 nt, Homo sapiens
uaagaauuucaca

SEQ ID NO: 1182750 - RNA, 17 nt, Homo sapiens
uaagaauuucccaguga

SEQ ID NO: 1182751 - RNA, 18 nt, Homo sapiens
uaagagaaucaacauuuc

SEQ ID NO: 1182752 - RNA, 14 nt, Homo sapiens
uaagagacuaucau

SEQ ID NO: 1182753 - RNA, 15 nt, Homo sapiens
uaagaguagcugucu

SEQ ID NO: 1182754 - RNA, 21 nt, Homo sapiens
uaagaucugaguugagaccuu

SEQ ID NO: 1182755 - RNA, 21 nt, Homo sapiens
uaagaugugauauucuaagac

SEQ ID NO: 1182756 - RNA, 17 nt, Homo sapiens
uaagauuauagauucua

SEQ ID NO: 1182757 - RNA, 23 nt, Homo sapiens
uaagauuauagauucuaaagauu

SEQ ID NO: 1182758 - RNA, 17 nt, Homo sapiens
uaagcaacuugcuucua

SEQ ID NO: 1182759 - RNA, 20 nt, Homo sapiens
uaagcagguaacuagcugag

SEQ ID NO: 1182760 - RNA, 20 nt, Homo sapiens
uaagcauaagcuuaugcuua

SEQ ID NO: 1182761 - RNA, 14 nt, Homo sapiens
uaagcaugcuucua

SEQ ID NO: 1182762 - RNA, 22 nt, Homo sapiens
uaagcauuuugguuggauuucu

SEQ ID NO: 1182763 - RNA, 18 nt, Homo sapiens
uaagccaguuuuacacua

SEQ ID NO: 1182764 - RNA, 19 nt, Homo sapiens
uaagcccccucaacuacca

SEQ ID NO: 1182765 - RNA, 15 nt, Homo sapiens
uaagcuagcaaauag

SEQ ID NO: 1182766 - RNA, 14 nt, Homo sapiens
uaagcugauuaccu

SEQ ID NO: 1182767 - RNA, 15 nt, Homo sapiens
uaagcugugcaauua

SEQ ID NO: 1182768 - RNA, 15 nt, Homo sapiens
uaagcuuaugcuuaa

SEQ ID NO: 1182769 - RNA, 21 nt, Homo sapiens
uaagcuuaugcuuaaauucaa

SEQ ID NO: 1182770 - RNA, 20 nt, Homo sapiens
uaagcuuuggacccaaggaa

SEQ ID NO: 1182771 - RNA, 19 nt, Homo sapiens
uaaggaacauguacuguua

SEQ ID NO: 1182772 - RNA, 21 nt, Homo sapiens
uaaggaacauguacuguuacu

SEQ ID NO: 1182773 - RNA, 12 nt, Homo sapiens
uaaggaacugga

SEQ ID NO: 1182774 - RNA, 16 nt, Homo sapiens
uaaggaaguaucagca

SEQ ID NO: 1182775 - RNA, 18 nt, Homo sapiens
uaaggacaaagugccaaa

SEQ ID NO: 1182776 - RNA, 20 nt, Homo sapiens
uaaggacaaagugccaaaga

SEQ ID NO: 1182777 - RNA, 18 nt, Homo sapiens
uaaggacaugaugcuuuu

SEQ ID NO: 1182778 - RNA, 17 nt, Homo sapiens
uaaggacggacucacuu

SEQ ID NO: 1182779 - RNA, 19 nt, Homo sapiens
uaaggaguaaucuguguac

SEQ ID NO: 1182780 - RNA, 20 nt, Homo sapiens
uaaggaguaaucuguguaca

SEQ ID NO: 1182781 - RNA, 17 nt, Homo sapiens
uaagggaguuacaucuu

SEQ ID NO: 1182782 - RNA, 18 nt, Homo sapiens
uaagggucgaaagcucua

SEQ ID NO: 1182783 - RNA, 16 nt, Homo sapiens
uaagguguagccacac

SEQ ID NO: 1182784 - RNA, 21 nt, Homo sapiens
uaagguuguuccccuaguucu

SEQ ID NO: 1182785 - RNA, 21 nt, Homo sapiens
uaaguacaagcacauuuggcu

SEQ ID NO: 1182786 - RNA, 21 nt, Homo sapiens
uaaguaccucagcauuuaauc

SEQ ID NO: 1182787 - RNA, 23 nt, Homo sapiens
uaaguaccuuauucuacaucauu

SEQ ID NO: 1182788 - RNA, 24 nt, Homo sapiens
uaagugaaaaucuuacaacaggcu

SEQ ID NO: 1182789 - RNA, 19 nt, Homo sapiens
uaagugauuuguaugucua

SEQ ID NO: 1182790 - RNA, 18 nt, Homo sapiens
uaagugggcauuuugaca

SEQ ID NO: 1182791 - RNA, 15 nt, Homo sapiens
uaagugucugugaug

SEQ ID NO: 1182792 - RNA, 18 nt, Homo sapiens
uaaguuacaucuacaaac

SEQ ID NO: 1182793 - RNA, 20 nt, Homo sapiens
uaaguuacaucuacaaacag

SEQ ID NO: 1182794 - RNA, 17 nt, Homo sapiens
uaaguucauucaugcca

SEQ ID NO: 1182795 - RNA, 22 nt, Homo sapiens
uaaguuuaagggaaaaguuauu

SEQ ID NO: 1182796 - RNA, 19 nt, Homo sapiens
uaaguuugugaaugugacu

SEQ ID NO: 1182797 - RNA, 18 nt, Homo sapiens
uaaguuuuguguguauau

SEQ ID NO: 1182798 - RNA, 21 nt, Homo sapiens
uaauaauccgccccccaauga

SEQ ID NO: 1182799 - RNA, 18 nt, Homo sapiens
uaauaauggaagccaaag

SEQ ID NO: 1182800 - RNA, 15 nt, Homo sapiens
uaauaauguuuaaua

SEQ ID NO: 1182801 - RNA, 22 nt, Homo sapiens
uaauaauuuacagguucuuagg

SEQ ID NO: 1182802 - RNA, 19 nt, Homo sapiens
uaauacacaaugcaucaua

SEQ ID NO: 1182803 - RNA, 15 nt, Homo sapiens
uaauacaucaaagag

SEQ ID NO: 1182804 - RNA, 16 nt, Homo sapiens
uaauagacacugggga

SEQ ID NO: 1182805 - RNA, 12 nt, Homo sapiens
uaauaggccaug

SEQ ID NO: 1182806 - RNA, 16 nt, Homo sapiens
uaauaggccauguuua

SEQ ID NO: 1182807 - RNA, 16 nt, Homo sapiens
uaauaguaaacacagg

SEQ ID NO: 1182808 - RNA, 20 nt, Homo sapiens
uaauaguacauaaucuuuau

SEQ ID NO: 1182809 - RNA, 22 nt, Homo sapiens
uaauauaaaaagcuuccaugau

SEQ ID NO: 1182810 - RNA, 21 nt, Homo sapiens
uaauauaaaccgugugucaug

SEQ ID NO: 1182811 - RNA, 19 nt, Homo sapiens
uaauaucaaaugcaguaua

SEQ ID NO: 1182812 - RNA, 23 nt, Homo sapiens
uaauaucagcaagucucuuuaua

SEQ ID NO: 1182813 - RNA, 14 nt, Homo sapiens
uaauauccauauag

SEQ ID NO: 1182814 - RNA, 13 nt, Homo sapiens
uaauauguugacu

SEQ ID NO: 1182815 - RNA, 15 nt, Homo sapiens
uaauauuauuacugu

SEQ ID NO: 1182816 - RNA, 16 nt, Homo sapiens
uaauauucugcuauug

SEQ ID NO: 1182817 - RNA, 21 nt, Homo sapiens
uaauauucuguuuccauagca

SEQ ID NO: 1182818 - RNA, 20 nt, Homo sapiens
uaaucacucagugauugcaa

SEQ ID NO: 1182819 - RNA, 21 nt, Homo sapiens
uaaucagcaagaauuugaucg

SEQ ID NO: 1182820 - RNA, 18 nt, Homo sapiens
uaaucagcauuaacaugg

SEQ ID NO: 1182821 - RNA, 20 nt, Homo sapiens
uaaucagccucgcucuuguc

SEQ ID NO: 1182822 - RNA, 12 nt, Homo sapiens
uaaucagcuguu

SEQ ID NO: 1182823 - RNA, 23 nt, Homo sapiens
uaaucaugagccuguuuauugcc

SEQ ID NO: 1182824 - RNA, 22 nt, Homo sapiens
uaauccacugugacuuugccca

SEQ ID NO: 1182825 - RNA, 18 nt, Homo sapiens
uaauccaguaaaauaaua

SEQ ID NO: 1182826 - RNA, 21 nt, Homo sapiens
uaaucguguccugaaaauccu

SEQ ID NO: 1182827 - RNA, 14 nt, Homo sapiens
uaaugaaaagcaca

SEQ ID NO: 1182828 - RNA, 23 nt, Homo sapiens
uaaugaaacuuggauuugcucag

SEQ ID NO: 1182829 - RNA, 13 nt, Homo sapiens
uaaugaaauucca

SEQ ID NO: 1182830 - RNA, 16 nt, Homo sapiens
uaaugaaauuccagau

SEQ ID NO: 1182831 - RNA, 23 nt, Homo sapiens
uaaugaauaaacauuuguagcau

SEQ ID NO: 1182832 - RNA, 14 nt, Homo sapiens
uaaugaauaugcca

SEQ ID NO: 1182833 - RNA, 19 nt, Homo sapiens
uaaugagaauuccuuagca

SEQ ID NO: 1182834 - RNA, 23 nt, Homo sapiens
uaaugccuuucaucuugaaguua

SEQ ID NO: 1182835 - RNA, 14 nt, Homo sapiens
uaaugcuaaaugug

SEQ ID NO: 1182836 - RNA, 15 nt, Homo sapiens
uaaugcucugauaug

SEQ ID NO: 1182837 - RNA, 15 nt, Homo sapiens
uaaugcugucuuugu

SEQ ID NO: 1182838 - RNA, 19 nt, Homo sapiens
uaauggaagcaucuagcau

SEQ ID NO: 1182839 - RNA, 16 nt, Homo sapiens
uaauggccggcuggaa

SEQ ID NO: 1182840 - RNA, 18 nt, Homo sapiens
uaaugguuuuuaacaccu

SEQ ID NO: 1182841 - RNA, 22 nt, Homo sapiens
uaauguaauaauggaagccaaa

SEQ ID NO: 1182842 - RNA, 15 nt, Homo sapiens
uaauguaauuguaau

SEQ ID NO: 1182843 - RNA, 23 nt, Homo sapiens
uaaugucuuuaaaaguauccaga

SEQ ID NO: 1182844 - RNA, 11 nt, Homo sapiens
uaauguuacua

SEQ ID NO: 1182845 - RNA, 18 nt, Homo sapiens
uaauguuguuuacaauau

SEQ ID NO: 1182846 - RNA, 18 nt, Homo sapiens
uaauuaaaggagaagauu

SEQ ID NO: 1182847 - RNA, 14 nt, Homo sapiens
uaauuacuucacua

SEQ ID NO: 1182848 - RNA, 21 nt, Homo sapiens
uaauuaggaaaaaaacuauua

SEQ ID NO: 1182849 - RNA, 19 nt, Homo sapiens
uaauuaguaagcuagcaaa

SEQ ID NO: 1182850 - RNA, 22 nt, Homo sapiens
uaauuagugaaaauuuuacaca

SEQ ID NO: 1182851 - RNA, 24 nt, Homo sapiens
uaauucaggggcugacacuucaag

SEQ ID NO: 1182852 - RNA, 20 nt, Homo sapiens
uaauucauaaaucacaaaua

SEQ ID NO: 1182853 - RNA, 16 nt, Homo sapiens
uaauuccuucuaccuu

SEQ ID NO: 1182854 - RNA, 14 nt, Homo sapiens
uaauucuauacugu

SEQ ID NO: 1182855 - RNA, 15 nt, Homo sapiens
uaauucucuguggaa

SEQ ID NO: 1182856 - RNA, 19 nt, Homo sapiens
uaauucucuguggaaugaa

SEQ ID NO: 1182857 - RNA, 13 nt, Homo sapiens
uaauucugaugcu

SEQ ID NO: 1182858 - RNA, 22 nt, Homo sapiens
uaauucuuagauacacuaaaaa

SEQ ID NO: 1182859 - RNA, 17 nt, Homo sapiens
uaauugaagaaugggaa

SEQ ID NO: 1182860 - RNA, 17 nt, Homo sapiens
uaauugguuaguuaaca

SEQ ID NO: 1182861 - RNA, 14 nt, Homo sapiens
uaauuguacaauac

SEQ ID NO: 1182862 - RNA, 16 nt, Homo sapiens
uaauuuacagcuuuca

SEQ ID NO: 1182863 - RNA, 17 nt, Homo sapiens
uaauuuuguauuuucca

SEQ ID NO: 1182864 - RNA, 15 nt, Homo sapiens
uaauuuuuacaugga

SEQ ID NO: 1182865 - RNA, 16 nt, Homo sapiens
uacaaaaaaguaaccu

SEQ ID NO: 1182866 - RNA, 20 nt, Homo sapiens
uacaaaaaucagccagacau

SEQ ID NO: 1182867 - RNA, 12 nt, Homo sapiens
uacaaacauaag

SEQ ID NO: 1182868 - RNA, 16 nt, Homo sapiens
uacaaacuucaaagag

SEQ ID NO: 1182869 - RNA, 16 nt, Homo sapiens
uacaaauagaauuuga

SEQ ID NO: 1182870 - RNA, 14 nt, Homo sapiens
uacaaauggacaua

SEQ ID NO: 1182871 - RNA, 15 nt, Homo sapiens
uacaaauucuucuaa

SEQ ID NO: 1182872 - RNA, 15 nt, Homo sapiens
uacaacaaacacugu

SEQ ID NO: 1182873 - RNA, 18 nt, Homo sapiens
uacaacugccucgaaaca

SEQ ID NO: 1182874 - RNA, 18 nt, Homo sapiens
uacaagacuuaguggaau

SEQ ID NO: 1182875 - RNA, 16 nt, Homo sapiens
uacaagagacauauaa

SEQ ID NO: 1182876 - RNA, 17 nt, Homo sapiens
uacaagagacauauaau

SEQ ID NO: 1182877 - RNA, 15 nt, Homo sapiens
uacaagaguuucaaa

SEQ ID NO: 1182878 - RNA, 19 nt, Homo sapiens
uacaagauucucugauacc

SEQ ID NO: 1182879 - RNA, 14 nt, Homo sapiens
uacaagcaaugccu

SEQ ID NO: 1182880 - RNA, 18 nt, Homo sapiens
uacaaggacuuuccaaau

SEQ ID NO: 1182881 - RNA, 17 nt, Homo sapiens
uacaaguaaagcccaga

SEQ ID NO: 1182882 - RNA, 18 nt, Homo sapiens
uacaauaaagucuuaccu

SEQ ID NO: 1182883 - RNA, 17 nt, Homo sapiens
uacaauucccaaaggca

SEQ ID NO: 1182884 - RNA, 17 nt, Homo sapiens
uacaauugaaaugacua

SEQ ID NO: 1182885 - RNA, 20 nt, Homo sapiens
uacacacacacacacagcca

SEQ ID NO: 1182886 - RNA, 22 nt, Homo sapiens
uacacacacacacacagccaca

SEQ ID NO: 1182887 - RNA, 20 nt, Homo sapiens
uacacacauauauauuacaa

SEQ ID NO: 1182888 - RNA, 14 nt, Homo sapiens
uacacagcugagca

SEQ ID NO: 1182889 - RNA, 19 nt, Homo sapiens
uacacaguaagucauuuaa

SEQ ID NO: 1182890 - RNA, 16 nt, Homo sapiens
uacacauagcauguaa

SEQ ID NO: 1182891 - RNA, 11 nt, Homo sapiens
uacacaugaca

SEQ ID NO: 1182892 - RNA, 15 nt, Homo sapiens
uacaccacacacaac

SEQ ID NO: 1182893 - RNA, 19 nt, Homo sapiens
uacaccacacacaacagcc

SEQ ID NO: 1182894 - RNA, 13 nt, Homo sapiens
uacacgacucagu

SEQ ID NO: 1182895 - RNA, 15 nt, Homo sapiens
uacacgucacaaaga

SEQ ID NO: 1182896 - RNA, 21 nt, Homo sapiens
uacacuccagcgguugccuuu

SEQ ID NO: 1182897 - RNA, 23 nt, Homo sapiens
uacacucuuauagaaaguucaaa

SEQ ID NO: 1182898 - RNA, 23 nt, Homo sapiens
uacacucuuuuauacaagagugu

SEQ ID NO: 1182899 - RNA, 11 nt, Homo sapiens
uacacuggguu

SEQ ID NO: 1182900 - RNA, 17 nt, Homo sapiens
uacacuggguucugcua

SEQ ID NO: 1182901 - RNA, 22 nt, Homo sapiens
uacagaaagcacaaagaauuga

SEQ ID NO: 1182902 - RNA, 19 nt, Homo sapiens
uacagaaucaaaugcaauu

SEQ ID NO: 1182903 - RNA, 15 nt, Homo sapiens
uacagacgucucaag

SEQ ID NO: 1182904 - RNA, 20 nt, Homo sapiens
uacagacgucucaagacuga

SEQ ID NO: 1182905 - RNA, 14 nt, Homo sapiens
uacagauacuguga

SEQ ID NO: 1182906 - RNA, 15 nt, Homo sapiens
uacagauacugugag

SEQ ID NO: 1182907 - RNA, 18 nt, Homo sapiens
uacagcacacacuuccau

SEQ ID NO: 1182908 - RNA, 12 nt, Homo sapiens
uacagcuguaua

SEQ ID NO: 1182909 - RNA, 22 nt, Homo sapiens
uacagcuugugaggaagugagc

SEQ ID NO: 1182910 - RNA, 14 nt, Homo sapiens
uacaggcacccacc

SEQ ID NO: 1182911 - RNA, 20 nt, Homo sapiens
uacaggcgugauccaccaca

SEQ ID NO: 1182912 - RNA, 15 nt, Homo sapiens
uacagggaguguagu

SEQ ID NO: 1182913 - RNA, 23 nt, Homo sapiens
uacaggggagaaggaaaugcagg

SEQ ID NO: 1182914 - RNA, 15 nt, Homo sapiens
uacaguacacagaua

SEQ ID NO: 1182915 - RNA, 17 nt, Homo sapiens
uacaguaugaucucagu

SEQ ID NO: 1182916 - RNA, 11 nt, Homo sapiens
uacaguaugcu

SEQ ID NO: 1182917 - RNA, 23 nt, Homo sapiens
uacagugaagaguaaguuuuccc

SEQ ID NO: 1182918 - RNA, 15 nt, Homo sapiens
uacagugcuaaagau

SEQ ID NO: 1182919 - RNA, 16 nt, Homo sapiens
uacaguuauccugcaa

SEQ ID NO: 1182920 - RNA, 22 nt, Homo sapiens
uacaguuauccugcaagggaca

SEQ ID NO: 1182921 - RNA, 14 nt, Homo sapiens
uacaguuauguggu

SEQ ID NO: 1182922 - RNA, 18 nt, Homo sapiens
uacaguuuaacagaguuu

SEQ ID NO: 1182923 - RNA, 18 nt, Homo sapiens
uacaguuuauaaagccaa

SEQ ID NO: 1182924 - RNA, 14 nt, Homo sapiens
uacauaaucuguac

SEQ ID NO: 1182925 - RNA, 22 nt, Homo sapiens
uacauauguauuauauaaacuu

SEQ ID NO: 1182926 - RNA, 21 nt, Homo sapiens
uacauauguuaauaaacugca

SEQ ID NO: 1182927 - RNA, 13 nt, Homo sapiens
uacauccaaagca

SEQ ID NO: 1182928 - RNA, 21 nt, Homo sapiens
uacaucugcaauaugaauuca

SEQ ID NO: 1182929 - RNA, 13 nt, Homo sapiens
uacaugacauuua

SEQ ID NO: 1182930 - RNA, 11 nt, Homo sapiens
uacaugcaucu

SEQ ID NO: 1182931 - RNA, 13 nt, Homo sapiens
uacauuaaaucac

SEQ ID NO: 1182932 - RNA, 12 nt, Homo sapiens
uuagacaguaug

SEQ ID NO: 1182933 - RNA, 19 nt, Homo sapiens
uuagaccccauacaaguuu

SEQ ID NO: 1182934 - RNA, 16 nt, Homo sapiens
uuagaccucauuaaau

SEQ ID NO: 1182935 - RNA, 14 nt, Homo sapiens
uuagacuacauuua

SEQ ID NO: 1182936 - RNA, 17 nt, Homo sapiens
uuagagugucuuuccac

SEQ ID NO: 1182937 - RNA, 22 nt, Homo sapiens
uuagaugcacuaccauugcugu

SEQ ID NO: 1182938 - RNA, 16 nt, Homo sapiens
uuagauuccuuuccug

SEQ ID NO: 1182939 - RNA, 19 nt, Homo sapiens
uuagccaaucuuucuagau

SEQ ID NO: 1182940 - RNA, 16 nt, Homo sapiens
uuagccagauuugucu

SEQ ID NO: 1182941 - RNA, 22 nt, Homo sapiens
uuagccaggaccugccaaugau

SEQ ID NO: 1182942 - RNA, 17 nt, Homo sapiens
uuagccagguaauguga

SEQ ID NO: 1182943 - RNA, 18 nt, Homo sapiens
uuagccugggccucuacc

SEQ ID NO: 1182944 - RNA, 14 nt, Homo sapiens
uuagccuugcugua

SEQ ID NO: 1182945 - RNA, 22 nt, Homo sapiens
uuagcuccuugaagacauauca

SEQ ID NO: 1182946 - RNA, 13 nt, Homo sapiens
uuagcuuucugaa

SEQ ID NO: 1182947 - RNA, 17 nt, Homo sapiens
uuaggaaaaaaacuauu

SEQ ID NO: 1182948 - RNA, 19 nt, Homo sapiens
uuaggaaaaaaacuauuaa

SEQ ID NO: 1182949 - RNA, 21 nt, Homo sapiens
uuaggaauaaucuccuguuaa

SEQ ID NO: 1182950 - RNA, 15 nt, Homo sapiens
uuaggaugguuccca

SEQ ID NO: 1182951 - RNA, 18 nt, Homo sapiens
uuaggauuuucacauucu

SEQ ID NO: 1182952 - RNA, 15 nt, Homo sapiens
uuaggcuauucacaa

SEQ ID NO: 1182953 - RNA, 16 nt, Homo sapiens
uuagggaaaccuuugc

SEQ ID NO: 1182954 - RNA, 22 nt, Homo sapiens
uuaguaaauacaucacuguaua

SEQ ID NO: 1182955 - RNA, 17 nt, Homo sapiens
uuaguaacauagacaaa

SEQ ID NO: 1182956 - RNA, 15 nt, Homo sapiens
uuaguauaauauuuc

SEQ ID NO: 1182957 - RNA, 17 nt, Homo sapiens
uuaguauugcagccaaa

SEQ ID NO: 1182958 - RNA, 22 nt, Homo sapiens
uuagucauucaauaaauuguaa

SEQ ID NO: 1182959 - RNA, 19 nt, Homo sapiens
uuagugaaaauuuuacaca

SEQ ID NO: 1182960 - RNA, 22 nt, Homo sapiens
uuagugaccccugccuacuucc

SEQ ID NO: 1182961 - RNA, 18 nt, Homo sapiens
uuaguggucucuacugug

SEQ ID NO: 1182962 - RNA, 17 nt, Homo sapiens
uuaguuaauaaaauaau

SEQ ID NO: 1182963 - RNA, 20 nt, Homo sapiens
uuaguugguuugugugauca

SEQ ID NO: 1182964 - RNA, 22 nt, Homo sapiens
uuaguugguuugugugaucaua

SEQ ID NO: 1182965 - RNA, 21 nt, Homo sapiens
uuaguuuuucuuacuugcauu

SEQ ID NO: 1182966 - RNA, 14 nt, Homo sapiens
uuauaaacagcagg

SEQ ID NO: 1182967 - RNA, 12 nt, Homo sapiens
uuauaacccaaa

SEQ ID NO: 1182968 - RNA, 15 nt, Homo sapiens
uuauaacccagugag

SEQ ID NO: 1182969 - RNA, 16 nt, Homo sapiens
uuauaacuuccauuuu

SEQ ID NO: 1182970 - RNA, 21 nt, Homo sapiens
uuauaagaagagaaccagcca

SEQ ID NO: 1182971 - RNA, 23 nt, Homo sapiens
uuauaagagggcauauacaguga

SEQ ID NO: 1182972 - RNA, 14 nt, Homo sapiens
uuauaauauccaua

SEQ ID NO: 1182973 - RNA, 13 nt, Homo sapiens
uuauacccaugaa

SEQ ID NO: 1182974 - RNA, 16 nt, Homo sapiens
uuauacgcuggcaaca

SEQ ID NO: 1182975 - RNA, 13 nt, Homo sapiens
uuauacuguacaa

SEQ ID NO: 1182976 - RNA, 16 nt, Homo sapiens
uuauagaaagauagau

SEQ ID NO: 1182977 - RNA, 12 nt, Homo sapiens
uuauagauucua

SEQ ID NO: 1182978 - RNA, 13 nt, Homo sapiens
uuauagauucuaa

SEQ ID NO: 1182979 - RNA, 17 nt, Homo sapiens
uuauagcacaaaaucag

SEQ ID NO: 1182980 - RNA, 15 nt, Homo sapiens
uuauauacaucucaa

SEQ ID NO: 1182981 - RNA, 13 nt, Homo sapiens
uuauauguucaca

SEQ ID NO: 1182982 - RNA, 18 nt, Homo sapiens
uuauauuaaaacacuuag

SEQ ID NO: 1182983 - RNA, 19 nt, Homo sapiens
uuauauuuuccucuuagau

SEQ ID NO: 1182984 - RNA, 13 nt, Homo sapiens
uuaucaaaaguga

SEQ ID NO: 1182985 - RNA, 17 nt, Homo sapiens
uuaucaacugcugcuuc

SEQ ID NO: 1182986 - RNA, 23 nt, Homo sapiens
uuaucaacuggggggaccaaaua

SEQ ID NO: 1182987 - RNA, 18 nt, Homo sapiens
uuaucaauaaagcacuau

SEQ ID NO: 1182988 - RNA, 20 nt, Homo sapiens
uuaucaauguucuaguucug

SEQ ID NO: 1182989 - RNA, 22 nt, Homo sapiens
uuaucaccgugggcucccugac

SEQ ID NO: 1182990 - RNA, 14 nt, Homo sapiens
uuaucagcaaaaaa

SEQ ID NO: 1182991 - RNA, 22 nt, Homo sapiens
uuaucagcaaaaaaguccaauu

SEQ ID NO: 1182992 - RNA, 14 nt, Homo sapiens
uuaucagugccaug

SEQ ID NO: 1182993 - RNA, 18 nt, Homo sapiens
uuaucauggagaacagca

SEQ ID NO: 1182994 - RNA, 20 nt, Homo sapiens
uuaucauggagaacagcaug

SEQ ID NO: 1182995 - RNA, 13 nt, Homo sapiens
uuaucauugcuaa

SEQ ID NO: 1182996 - RNA, 23 nt, Homo sapiens
uuauccuagauuauaucaaagua

SEQ ID NO: 1182997 - RNA, 16 nt, Homo sapiens
uuauccuucuacuugu

SEQ ID NO: 1182998 - RNA, 22 nt, Homo sapiens
uuaucgaacacauucagugaua

SEQ ID NO: 1182999 - RNA, 15 nt, Homo sapiens
uuaucuaagaauaca

SEQ ID NO: 1183000 - RNA, 17 nt, Homo sapiens
uuaucuguaaguuuuga

SEQ ID NO: 1183001 - RNA, 18 nt, Homo sapiens
uuaucuguuaaccaaaua

SEQ ID NO: 1183002 - RNA, 17 nt, Homo sapiens
uuaucuguuuccugaca

SEQ ID NO: 1183003 - RNA, 16 nt, Homo sapiens
uuaugacagugaacau

SEQ ID NO: 1183004 - RNA, 15 nt, Homo sapiens
uuaugagaaacugca

SEQ ID NO: 1183005 - RNA, 20 nt, Homo sapiens
uuaugagaugccugaagcca

SEQ ID NO: 1183006 - RNA, 16 nt, Homo sapiens
uuaugaguggcuuuaa

SEQ ID NO: 1183007 - RNA, 23 nt, Homo sapiens
uuaugaucaaggugaaauaaaca

SEQ ID NO: 1183008 - RNA, 13 nt, Homo sapiens
uuaugaucuaugu

SEQ ID NO: 1183009 - RNA, 23 nt, Homo sapiens
uuaugcuccaucccauucacuuc

SEQ ID NO: 1183010 - RNA, 14 nt, Homo sapiens
uuauggcugcugaa

SEQ ID NO: 1183011 - RNA, 23 nt, Homo sapiens
uuauguggaaaacagaacaucau

SEQ ID NO: 1183012 - RNA, 17 nt, Homo sapiens
uuauguuuugugauuca

SEQ ID NO: 1183013 - RNA, 16 nt, Homo sapiens
uuauuaaauaaucucu

SEQ ID NO: 1183014 - RNA, 13 nt, Homo sapiens
uuauuacauguaa

SEQ ID NO: 1183015 - RNA, 16 nt, Homo sapiens
uuauuaucgcauacag

SEQ ID NO: 1183016 - RNA, 17 nt, Homo sapiens
uuauucaccaucaugua

SEQ ID NO: 1183017 - RNA, 19 nt, Homo sapiens
uuauucuaaacagacucau

SEQ ID NO: 1183018 - RNA, 20 nt, Homo sapiens
uuauucuacaucauuaacca

SEQ ID NO: 1183019 - RNA, 13 nt, Homo sapiens
uuauucucuagau

SEQ ID NO: 1183020 - RNA, 15 nt, Homo sapiens
uuauucugaugauag

SEQ ID NO: 1183021 - RNA, 15 nt, Homo sapiens
uuauugaguaugagu

SEQ ID NO: 1183022 - RNA, 22 nt, Homo sapiens
uuauugcaugagaagccauaca

SEQ ID NO: 1183023 - RNA, 16 nt, Homo sapiens
uuauuuagcuggccau

SEQ ID NO: 1183024 - RNA, 17 nt, Homo sapiens
uuauuucauucauaucc

SEQ ID NO: 1183025 - RNA, 21 nt, Homo sapiens
uuauuuccacuuauaaaggaa

SEQ ID NO: 1183026 - RNA, 22 nt, Homo sapiens
uuauuucggagcgcaaugccau

SEQ ID NO: 1183027 - RNA, 21 nt, Homo sapiens
uuauuugcacuaugagccuau

SEQ ID NO: 1183028 - RNA, 17 nt, Homo sapiens
uuauuuuuguucauaua

SEQ ID NO: 1183029 - RNA, 15 nt, Homo sapiens
uucaaaacauacaag

SEQ ID NO: 1183030 - RNA, 14 nt, Homo sapiens
uucaaaaccuugca

SEQ ID NO: 1183031 - RNA, 13 nt, Homo sapiens
uucaaaaguucca

SEQ ID NO: 1183032 - RNA, 12 nt, Homo sapiens
uucaaacauaua

SEQ ID NO: 1183033 - RNA, 17 nt, Homo sapiens
uucaaacuucuguguac

SEQ ID NO: 1183034 - RNA, 16 nt, Homo sapiens
uucaaagaugauaauu

SEQ ID NO: 1183035 - RNA, 22 nt, Homo sapiens
uucaaagcacuguuucucucac

SEQ ID NO: 1183036 - RNA, 14 nt, Homo sapiens
uucaacaucacuga

SEQ ID NO: 1183037 - RNA, 17 nt, Homo sapiens
uucaacauguaccucac

SEQ ID NO: 1183038 - RNA, 13 nt, Homo sapiens
uucaacauuguau

SEQ ID NO: 1183039 - RNA, 18 nt, Homo sapiens
uucaaccagcacauucgu

SEQ ID NO: 1183040 - RNA, 18 nt, Homo sapiens
uucaacccagccaugcaa

SEQ ID NO: 1183041 - RNA, 23 nt, Homo sapiens
uucaacuuggaucauuaggcuua

SEQ ID NO: 1183042 - RNA, 15 nt, Homo sapiens
uucaacuugugccug

SEQ ID NO: 1183043 - RNA, 12 nt, Homo sapiens
uucaagacagau

SEQ ID NO: 1183044 - RNA, 12 nt, Homo sapiens
uucaagacuuga

SEQ ID NO: 1183045 - RNA, 22 nt, Homo sapiens
uucaagauaaaucaaaguaaua

SEQ ID NO: 1183046 - RNA, 21 nt, Homo sapiens
uucaagcaauccuccuaccuc

SEQ ID NO: 1183047 - RNA, 15 nt, Homo sapiens
uucaaggaucuccug

SEQ ID NO: 1183048 - RNA, 22 nt, Homo sapiens
uucaaggccccugacagcuguc

SEQ ID NO: 1183049 - RNA, 16 nt, Homo sapiens
uucaaguuuaguuuga

SEQ ID NO: 1183050 - RNA, 11 nt, Homo sapiens
uucaauuccau

SEQ ID NO: 1183051 - RNA, 20 nt, Homo sapiens
uucacaaaguagcaccaaau

SEQ ID NO: 1183052 - RNA, 10 nt, Homo sapiens
uucacaagcu

SEQ ID NO: 1183053 - RNA, 17 nt, Homo sapiens
uucacaaucuugaacau

SEQ ID NO: 1183054 - RNA, 13 nt, Homo sapiens
uucacacuaugga

SEQ ID NO: 1183055 - RNA, 11 nt, Homo sapiens
uucacacugca

SEQ ID NO: 1183056 - RNA, 21 nt, Homo sapiens
uucacagagauggaugcaugu

SEQ ID NO: 1183057 - RNA, 15 nt, Homo sapiens
uucacauugaaucau

SEQ ID NO: 1183058 - RNA, 15 nt, Homo sapiens
uucaccucacugaaa

SEQ ID NO: 1183059 - RNA, 19 nt, Homo sapiens
uucacgaaguguugcaugg

SEQ ID NO: 1183060 - RNA, 20 nt, Homo sapiens
uucacgaaguguugcaugga

SEQ ID NO: 1183061 - RNA, 22 nt, Homo sapiens
uucacgaguguuccugugcuua

SEQ ID NO: 1183062 - RNA, 15 nt, Homo sapiens
uucacggcaggacaa

SEQ ID NO: 1183063 - RNA, 17 nt, Homo sapiens
uucacucacaacacuua

SEQ ID NO: 1183064 - RNA, 13 nt, Homo sapiens
uacauuaguacac

SEQ ID NO: 1183065 - RNA, 14 nt, Homo sapiens
uacauuauguugcu

SEQ ID NO: 1183066 - RNA, 21 nt, Homo sapiens
uacauuauuuucauagauuaa

SEQ ID NO: 1183067 - RNA, 13 nt, Homo sapiens
uacauucaaggag

SEQ ID NO: 1183068 - RNA, 19 nt, Homo sapiens
uacauugauucaugucuca

SEQ ID NO: 1183069 - RNA, 21 nt, Homo sapiens
uacauugggcacauaucuccu

SEQ ID NO: 1183070 - RNA, 18 nt, Homo sapiens
uacauuuccaaauucaca

SEQ ID NO: 1183071 - RNA, 19 nt, Homo sapiens
uacauuuccaaauucacaa

SEQ ID NO: 1183072 - RNA, 14 nt, Homo sapiens
uacauuucucauac

SEQ ID NO: 1183073 - RNA, 18 nt, Homo sapiens
uacauuucuuagacuaca

SEQ ID NO: 1183074 - RNA, 16 nt, Homo sapiens
uaccaagcauguuuca

SEQ ID NO: 1183075 - RNA, 13 nt, Homo sapiens
uaccaaggcaaaa

SEQ ID NO: 1183076 - RNA, 22 nt, Homo sapiens
uaccaauaucuugccaguuuug

SEQ ID NO: 1183077 - RNA, 13 nt, Homo sapiens
uaccacagaguuu

SEQ ID NO: 1183078 - RNA, 18 nt, Homo sapiens
uaccacaucacaccacuu

SEQ ID NO: 1183079 - RNA, 19 nt, Homo sapiens
uaccacugauuuggagaua

SEQ ID NO: 1183080 - RNA, 22 nt, Homo sapiens
uaccacuguggaagucccucag

SEQ ID NO: 1183081 - RNA, 18 nt, Homo sapiens
uaccacuuuucauugcaa

SEQ ID NO: 1183082 - RNA, 16 nt, Homo sapiens
uaccagcaacuugaac

SEQ ID NO: 1183083 - RNA, 15 nt, Homo sapiens
uaccagcucagggga

SEQ ID NO: 1183084 - RNA, 20 nt, Homo sapiens
uaccaggcacgucugcagaa

SEQ ID NO: 1183085 - RNA, 18 nt, Homo sapiens
uaccagguccauuuugcc

SEQ ID NO: 1183086 - RNA, 22 nt, Homo sapiens
uaccauuaauaaguuaucuugu

SEQ ID NO: 1183087 - RNA, 16 nt, Homo sapiens
uaccauugcuguucua

SEQ ID NO: 1183088 - RNA, 14 nt, Homo sapiens
uacccaacucugua

SEQ ID NO: 1183089 - RNA, 20 nt, Homo sapiens
uacccaggguggagugcagu

SEQ ID NO: 1183090 - RNA, 17 nt, Homo sapiens
uacccaguagaugccac

SEQ ID NO: 1183091 - RNA, 19 nt, Homo sapiens
uacccaguauuacugcugc

SEQ ID NO: 1183092 - RNA, 13 nt, Homo sapiens
uacccagugccua

SEQ ID NO: 1183093 - RNA, 13 nt, Homo sapiens
uacccaugaccug

SEQ ID NO: 1183094 - RNA, 13 nt, Homo sapiens
uaccccaccacga

SEQ ID NO: 1183095 - RNA, 14 nt, Homo sapiens
uaccccagguacau

SEQ ID NO: 1183096 - RNA, 17 nt, Homo sapiens
uacccccucauccccca

SEQ ID NO: 1183097 - RNA, 13 nt, Homo sapiens
uacccuauauguc

SEQ ID NO: 1183098 - RNA, 18 nt, Homo sapiens
uacccuguaacaugcaau

SEQ ID NO: 1183099 - RNA, 17 nt, Homo sapiens
uacccugugcuaagcac

SEQ ID NO: 1183100 - RNA, 18 nt, Homo sapiens
uacccuuuagacuguagc

SEQ ID NO: 1183101 - RNA, 17 nt, Homo sapiens
uaccgcugugugcauuc

SEQ ID NO: 1183102 - RNA, 13 nt, Homo sapiens
uaccgcuuaucag

SEQ ID NO: 1183103 - RNA, 13 nt, Homo sapiens
uaccuacaaaaug

SEQ ID NO: 1183104 - RNA, 13 nt, Homo sapiens
uaccuacauucaa

SEQ ID NO: 1183105 - RNA, 14 nt, Homo sapiens
uaccuacugcugag

SEQ ID NO: 1183106 - RNA, 12 nt, Homo sapiens
uaccuacuggug

SEQ ID NO: 1183107 - RNA, 20 nt, Homo sapiens
uaccuauaauuauaacuaua

SEQ ID NO: 1183108 - RNA, 23 nt, Homo sapiens
uaccuauaggaaagucugucagg

SEQ ID NO: 1183109 - RNA, 17 nt, Homo sapiens
uaccuauauugauuuaa

SEQ ID NO: 1183110 - RNA, 20 nt, Homo sapiens
uaccucaaccaaugccaaaa

SEQ ID NO: 1183111 - RNA, 21 nt, Homo sapiens
uaccucaaccaaugccaaaaa

SEQ ID NO: 1183112 - RNA, 17 nt, Homo sapiens
uaccuccacucucugcc

SEQ ID NO: 1183113 - RNA, 14 nt, Homo sapiens
uaccuccugagaaa

SEQ ID NO: 1183114 - RNA, 12 nt, Homo sapiens
uaccucuuaccu

SEQ ID NO: 1183115 - RNA, 17 nt, Homo sapiens
uaccugaaagcacugua

SEQ ID NO: 1183116 - RNA, 21 nt, Homo sapiens
uaccuggcagcaaacugcugc

SEQ ID NO: 1183117 - RNA, 21 nt, Homo sapiens
uaccuuaagauuuuucuuuuc

SEQ ID NO: 1183118 - RNA, 22 nt, Homo sapiens
uaccuuauucuacaucauuaac

SEQ ID NO: 1183119 - RNA, 22 nt, Homo sapiens
uaccuucaggcagccaguguga

SEQ ID NO: 1183120 - RNA, 22 nt, Homo sapiens
uaccuuccccacaucugagaga

SEQ ID NO: 1183121 - RNA, 17 nt, Homo sapiens
uaccuuguuuugccagu

SEQ ID NO: 1183122 - RNA, 19 nt, Homo sapiens
uaccuuuuguuaccacaga

SEQ ID NO: 1183123 - RNA, 15 nt, Homo sapiens
uacgaucaggcacag

SEQ ID NO: 1183124 - RNA, 13 nt, Homo sapiens
uacgcaguuacug

SEQ ID NO: 1183125 - RNA, 17 nt, Homo sapiens
uacgcaguuacugaaau

SEQ ID NO: 1183126 - RNA, 22 nt, Homo sapiens
uacgucccagcggccucagggu

SEQ ID NO: 1183127 - RNA, 12 nt, Homo sapiens
uacgucugggag

SEQ ID NO: 1183128 - RNA, 17 nt, Homo sapiens
uacgucuuucacaguuu

SEQ ID NO: 1183129 - RNA, 19 nt, Homo sapiens
uacgugauuuggcugcacu

SEQ ID NO: 1183130 - RNA, 17 nt, Homo sapiens
uacguuaaaauuacuuu

SEQ ID NO: 1183131 - RNA, 18 nt, Homo sapiens
uacguuaaaauuacuuug

SEQ ID NO: 1183132 - RNA, 20 nt, Homo sapiens
uacguuaaaauuacuuugaa

SEQ ID NO: 1183133 - RNA, 13 nt, Homo sapiens
uacuaaagccaaa

SEQ ID NO: 1183134 - RNA, 21 nt, Homo sapiens
uacuaagaguaugugccagga

SEQ ID NO: 1183135 - RNA, 13 nt, Homo sapiens
uacuaaucuuucu

SEQ ID NO: 1183136 - RNA, 19 nt, Homo sapiens
uacuacaaacuucaaagag

SEQ ID NO: 1183137 - RNA, 16 nt, Homo sapiens
uacuauuuuuacuaau

SEQ ID NO: 1183138 - RNA, 21 nt, Homo sapiens
uacuauuuuuacuaaucuuuc

SEQ ID NO: 1183139 - RNA, 21 nt, Homo sapiens
uacucaauguuacuaucugcu

SEQ ID NO: 1183140 - RNA, 13 nt, Homo sapiens
uacucagcauuug

SEQ ID NO: 1183141 - RNA, 14 nt, Homo sapiens
uacucagcauuuga

SEQ ID NO: 1183142 - RNA, 16 nt, Homo sapiens
uacuccaguaacugcu

SEQ ID NO: 1183143 - RNA, 16 nt, Homo sapiens
uacuccuuccaucaaa

SEQ ID NO: 1183144 - RNA, 19 nt, Homo sapiens
uacucgagcccacccagca

SEQ ID NO: 1183145 - RNA, 14 nt, Homo sapiens
uacucuccaaccug

SEQ ID NO: 1183146 - RNA, 16 nt, Homo sapiens
uacucucugaguacau

SEQ ID NO: 1183147 - RNA, 22 nt, Homo sapiens
uacucucugaguacauugugcc

SEQ ID NO: 1183148 - RNA, 18 nt, Homo sapiens
uacucuguuccuucacau

SEQ ID NO: 1183149 - RNA, 19 nt, Homo sapiens
uacucuucuuacuggugcu

SEQ ID NO: 1183150 - RNA, 21 nt, Homo sapiens
uacugaaaaggaggggucugg

SEQ ID NO: 1183151 - RNA, 14 nt, Homo sapiens
uacugagacaaugu

SEQ ID NO: 1183152 - RNA, 16 nt, Homo sapiens
uacugauaauuuugcu

SEQ ID NO: 1183153 - RNA, 21 nt, Homo sapiens
uacugaucaucugcugugacu

SEQ ID NO: 1183154 - RNA, 17 nt, Homo sapiens
uacugaucuuuguauau

SEQ ID NO: 1183155 - RNA, 19 nt, Homo sapiens
uacugauggaagcacacaa

SEQ ID NO: 1183156 - RNA, 22 nt, Homo sapiens
uacugcaagguucaacuuauua

SEQ ID NO: 1183157 - RNA, 22 nt, Homo sapiens
uacugcaauaaauuauggcucu

SEQ ID NO: 1183158 - RNA, 16 nt, Homo sapiens
uacugcaaucacugug

SEQ ID NO: 1183159 - RNA, 23 nt, Homo sapiens
uacugcacagagucaggaucuca

SEQ ID NO: 1183160 - RNA, 17 nt, Homo sapiens
uacugcacuuacaaucc

SEQ ID NO: 1183161 - RNA, 19 nt, Homo sapiens
uacugcaguugaaagggca

SEQ ID NO: 1183162 - RNA, 20 nt, Homo sapiens
uacuggcaaggagaagagca

SEQ ID NO: 1183163 - RNA, 14 nt, Homo sapiens
uacuggcaauuugu

SEQ ID NO: 1183164 - RNA, 21 nt, Homo sapiens
uacugggacugugcucagaga

SEQ ID NO: 1183165 - RNA, 21 nt, Homo sapiens
uacugggguuuuucuaagaaa

SEQ ID NO: 1183166 - RNA, 14 nt, Homo sapiens
uagcugcuaccuuc

SEQ ID NO: 1183167 - RNA, 18 nt, Homo sapiens
uagcuggccauucaggua

SEQ ID NO: 1183168 - RNA, 23 nt, Homo sapiens
uagcuuauaagagggcauauaca

SEQ ID NO: 1183169 - RNA, 21 nt, Homo sapiens
uagcuuuccuuuacagcuguu

SEQ ID NO: 1183170 - RNA, 17 nt, Homo sapiens
uagcuuugacaguucuu

SEQ ID NO: 1183171 - RNA, 20 nt, Homo sapiens
uaggaaauaaaauuaaugaa

SEQ ID NO: 1183172 - RNA, 13 nt, Homo sapiens
uaggaacuuuaug

SEQ ID NO: 1183173 - RNA, 16 nt, Homo sapiens
uaggaagaucucugca

SEQ ID NO: 1183174 - RNA, 21 nt, Homo sapiens
uaggaaggcagcauuccauga

SEQ ID NO: 1183175 - RNA, 15 nt, Homo sapiens
uaggacuaaguucuc

SEQ ID NO: 1183176 - RNA, 12 nt, Homo sapiens
uaggacuccauu

SEQ ID NO: 1183177 - RNA, 15 nt, Homo sapiens
uaggacuguggcaaa

SEQ ID NO: 1183178 - RNA, 16 nt, Homo sapiens
uaggagacacagggaa

SEQ ID NO: 1183179 - RNA, 20 nt, Homo sapiens
uaggaggggaacuagguuac

SEQ ID NO: 1183180 - RNA, 20 nt, Homo sapiens
uaggauaauguccaacuaaa

SEQ ID NO: 1183181 - RNA, 17 nt, Homo sapiens
uaggauaccacuuuuca

SEQ ID NO: 1183182 - RNA, 23 nt, Homo sapiens
uaggauaccacuuuucauugcaa

SEQ ID NO: 1183183 - RNA, 14 nt, Homo sapiens
uaggauuucagcca

SEQ ID NO: 1183184 - RNA, 14 nt, Homo sapiens
uaggauuugaacac

SEQ ID NO: 1183185 - RNA, 17 nt, Homo sapiens
uaggcauguagcuacag

SEQ ID NO: 1183186 - RNA, 16 nt, Homo sapiens
uaggcauucuaaguca

SEQ ID NO: 1183187 - RNA, 10 nt, Homo sapiens
uaggcccaag

SEQ ID NO: 1183188 - RNA, 14 nt, Homo sapiens
uaggccccacaagg

SEQ ID NO: 1183189 - RNA, 11 nt, Homo sapiens
uaggcucucag

SEQ ID NO: 1183190 - RNA, 23 nt, Homo sapiens
uaggcuggaaaugguuucacuug

SEQ ID NO: 1183191 - RNA, 14 nt, Homo sapiens
uagggaagcucagg

SEQ ID NO: 1183192 - RNA, 24 nt, Homo sapiens
uagggagaccauuaacuaguuuau

SEQ ID NO: 1183193 - RNA, 23 nt, Homo sapiens
uagggggagcaaaucgugccuug

SEQ ID NO: 1183194 - RNA, 14 nt, Homo sapiens
uaggguacuuuuau

SEQ ID NO: 1183195 - RNA, 22 nt, Homo sapiens
uaggguuacagagaccuaugua

SEQ ID NO: 1183196 - RNA, 20 nt, Homo sapiens
uaggucauuacuaaccauag

SEQ ID NO: 1183197 - RNA, 15 nt, Homo sapiens
uaggugaaaguuaau

SEQ ID NO: 1183198 - RNA, 22 nt, Homo sapiens
uaggugaaaguuaauccacugu

SEQ ID NO: 1183199 - RNA, 19 nt, Homo sapiens
uaggugcccagaaugaggc

SEQ ID NO: 1183200 - RNA, 15 nt, Homo sapiens
uagguguucuaauca

SEQ ID NO: 1183201 - RNA, 21 nt, Homo sapiens
uagguucuaaaguucuaagau

SEQ ID NO: 1183202 - RNA, 16 nt, Homo sapiens
uaguaaacacagggaa

SEQ ID NO: 1183203 - RNA, 21 nt, Homo sapiens
uaucuacccagucauguacug

SEQ ID NO: 1183204 - RNA, 18 nt, Homo sapiens
uaucuagacccaucuucu

SEQ ID NO: 1183205 - RNA, 16 nt, Homo sapiens
uaucucaaacuacugg

SEQ ID NO: 1183206 - RNA, 23 nt, Homo sapiens
uaucucaaacuacuggcaauuug

SEQ ID NO: 1183207 - RNA, 12 nt, Homo sapiens
uaucucagagau

SEQ ID NO: 1183208 - RNA, 13 nt, Homo sapiens
uaucuccaagugg

SEQ ID NO: 1183209 - RNA, 12 nt, Homo sapiens
uaucucuaauaa

SEQ ID NO: 1183210 - RNA, 14 nt, Homo sapiens
uaucugcuacuuug

SEQ ID NO: 1183211 - RNA, 16 nt, Homo sapiens
uaucugggugccuuaa

SEQ ID NO: 1183212 - RNA, 18 nt, Homo sapiens
uaucuggucaaccuccug

SEQ ID NO: 1183213 - RNA, 17 nt, Homo sapiens
uaucuguuaaccaaaua

SEQ ID NO: 1183214 - RNA, 17 nt, Homo sapiens
uaucuucucaaguucua

SEQ ID NO: 1183215 - RNA, 21 nt, Homo sapiens
uaucuucuguuucauaaugca

SEQ ID NO: 1183216 - RNA, 15 nt, Homo sapiens
uaucuugauaaacua

SEQ ID NO: 1183217 - RNA, 16 nt, Homo sapiens
uaucuugauaaacuag

SEQ ID NO: 1183218 - RNA, 14 nt, Homo sapiens
uaucuuucgugaua

SEQ ID NO: 1183219 - RNA, 21 nt, Homo sapiens
uaugaaaaugcuguuuucaac

SEQ ID NO: 1183220 - RNA, 19 nt, Homo sapiens
uaugaaacuugaaaccgcc

SEQ ID NO: 1183221 - RNA, 17 nt, Homo sapiens
uaugaaauuauaaucug

SEQ ID NO: 1183222 - RNA, 13 nt, Homo sapiens
uaugaacuuuaua

SEQ ID NO: 1183223 - RNA, 12 nt, Homo sapiens
uaugaaguacuu

SEQ ID NO: 1183224 - RNA, 13 nt, Homo sapiens
uaugaaguacuuu

SEQ ID NO: 1183225 - RNA, 17 nt, Homo sapiens
uaugaaguuacuuucuu

SEQ ID NO: 1183226 - RNA, 15 nt, Homo sapiens
uaugaauaauugcau

SEQ ID NO: 1183227 - RNA, 16 nt, Homo sapiens
uaugaauugcugucua

SEQ ID NO: 1183228 - RNA, 20 nt, Homo sapiens
uaugaccuuccaaguuugac

SEQ ID NO: 1183229 - RNA, 13 nt, Homo sapiens
uaugacucagaga

SEQ ID NO: 1183230 - RNA, 18 nt, Homo sapiens
uaugacucagagaaccag

SEQ ID NO: 1183231 - RNA, 16 nt, Homo sapiens
uaugagcaaguuuaua

SEQ ID NO: 1183232 - RNA, 21 nt, Homo sapiens
uaugagguuucuuugacuuca

SEQ ID NO: 1183233 - RNA, 20 nt, Homo sapiens
uaugaguaauacaucaaaga

SEQ ID NO: 1183234 - RNA, 19 nt, Homo sapiens
uaugaguggaaaaagccaa

SEQ ID NO: 1183235 - RNA, 18 nt, Homo sapiens
uaugauuccagguggcau

SEQ ID NO: 1183236 - RNA, 19 nt, Homo sapiens
uaugauuuaaaacauguaa

SEQ ID NO: 1183237 - RNA, 15 nt, Homo sapiens
uaugcaaaagguuua

SEQ ID NO: 1183238 - RNA, 23 nt, Homo sapiens
uaugcaauauaucuaaauugaau

SEQ ID NO: 1183239 - RNA, 17 nt, Homo sapiens
uaugcaauucaguguuc

SEQ ID NO: 1183240 - RNA, 14 nt, Homo sapiens
uaugcacauaugga

SEQ ID NO: 1183241 - RNA, 15 nt, Homo sapiens
uaugcaccaaaucau

SEQ ID NO: 1183242 - RNA, 19 nt, Homo sapiens
uaugcaccaaaucaucucu

SEQ ID NO: 1183243 - RNA, 21 nt, Homo sapiens
uaugcaccuugugucuguaca

SEQ ID NO: 1183244 - RNA, 12 nt, Homo sapiens
uaugcauaucag

SEQ ID NO: 1183245 - RNA, 16 nt, Homo sapiens
uaugcaucugcuacug

SEQ ID NO: 1183246 - RNA, 19 nt, Homo sapiens
uaugcccauucuuuucacu

SEQ ID NO: 1183247 - RNA, 17 nt, Homo sapiens
uaugccugccucaaagg

SEQ ID NO: 1183248 - RNA, 15 nt, Homo sapiens
uaugcuuaaauucaa

SEQ ID NO: 1183249 - RNA, 21 nt, Homo sapiens
uaugcuugcucuaagucaaau

SEQ ID NO: 1183250 - RNA, 20 nt, Homo sapiens
uauggacaguaaguccagua

SEQ ID NO: 1183251 - RNA, 15 nt, Homo sapiens
uauggacucugcaca

SEQ ID NO: 1183252 - RNA, 16 nt, Homo sapiens
uauggacuuacccuaa

SEQ ID NO: 1183253 - RNA, 18 nt, Homo sapiens
uauggcaaaaguaggcau

SEQ ID NO: 1183254 - RNA, 16 nt, Homo sapiens
uauggccucaagauca

SEQ ID NO: 1183255 - RNA, 13 nt, Homo sapiens
uauggcugcugaa

SEQ ID NO: 1183256 - RNA, 16 nt, Homo sapiens
uauggcuuaaugacac

SEQ ID NO: 1183257 - RNA, 15 nt, Homo sapiens
uaugggaaagacaug

SEQ ID NO: 1183258 - RNA, 14 nt, Homo sapiens
uaugggaacacugg

SEQ ID NO: 1183259 - RNA, 23 nt, Homo sapiens
uaugggcuggauauucgguaaua

SEQ ID NO: 1183260 - RNA, 20 nt, Homo sapiens
uaugguacaagcaaugccug

SEQ ID NO: 1183261 - RNA, 18 nt, Homo sapiens
uauggugucauaggcucu

SEQ ID NO: 1183262 - RNA, 23 nt, Homo sapiens
uaugguguggaugggaaacugcu

SEQ ID NO: 1183263 - RNA, 18 nt, Homo sapiens
uauguaacaaaccugcac

SEQ ID NO: 1183264 - RNA, 16 nt, Homo sapiens
uauguacaacauuuau

SEQ ID NO: 1183265 - RNA, 13 nt, Homo sapiens
uauguacuuuuau

SEQ ID NO: 1183266 - RNA, 12 nt, Homo sapiens
uauguauacaca

SEQ ID NO: 1183267 - RNA, 16 nt, Homo sapiens
uauguauuugcaguuc

SEQ ID NO: 1183268 - RNA, 23 nt, Homo sapiens
uaugucgagagcuggccaaagag

SEQ ID NO: 1183269 - RNA, 18 nt, Homo sapiens
uaugucuugaaacauguu

SEQ ID NO: 1183270 - RNA, 20 nt, Homo sapiens
uaugucuuggacacuguaca

SEQ ID NO: 1183271 - RNA, 14 nt, Homo sapiens
uaugugaagcccag

SEQ ID NO: 1183272 - RNA, 16 nt, Homo sapiens
uaugugcuugugcuca

SEQ ID NO: 1183273 - RNA, 22 nt, Homo sapiens
uauguggauugaguaaugggau

SEQ ID NO: 1183274 - RNA, 20 nt, Homo sapiens
uauguguggaugaugcugcc

SEQ ID NO: 1183275 - RNA, 17 nt, Homo sapiens
uauguuaauaaacugca

SEQ ID NO: 1183276 - RNA, 18 nt, Homo sapiens
uauguuuacguccuuugg

SEQ ID NO: 1183277 - RNA, 18 nt, Homo sapiens
uauguuuacuauugcucu

SEQ ID NO: 1183278 - RNA, 13 nt, Homo sapiens
uauuaaaagacag

SEQ ID NO: 1183279 - RNA, 16 nt, Homo sapiens
uauuaaaccuuuccau

SEQ ID NO: 1183280 - RNA, 21 nt, Homo sapiens
uauuaaaguggagaagcacac

SEQ ID NO: 1183281 - RNA, 15 nt, Homo sapiens
uauuaagccacuuaa

SEQ ID NO: 1183282 - RNA, 21 nt, Homo sapiens
uauuaaggcagaucuuugaug

SEQ ID NO: 1183283 - RNA, 20 nt, Homo sapiens
uauuaauaguucaguguaug

SEQ ID NO: 1183284 - RNA, 20 nt, Homo sapiens
uauuaauuauaaaaugcaau

SEQ ID NO: 1183285 - RNA, 12 nt, Homo sapiens
uauuaauuuugc

SEQ ID NO: 1183286 - RNA, 23 nt, Homo sapiens
uauuaauuuuuaaggauguugcc

SEQ ID NO: 1183287 - RNA, 24 nt, Homo sapiens
uauuaauuuuuaaggauguugcca

SEQ ID NO: 1183288 - RNA, 20 nt, Homo sapiens
uauuaccagguccauuuugc

SEQ ID NO: 1183289 - RNA, 14 nt, Homo sapiens
uauuacuugcucca

SEQ ID NO: 1183290 - RNA, 15 nt, Homo sapiens
uauuagaugugauuu

SEQ ID NO: 1183291 - RNA, 22 nt, Homo sapiens
uauuagcaagacagcaugccuu

SEQ ID NO: 1183292 - RNA, 15 nt, Homo sapiens
uauuaguacugcucu

SEQ ID NO: 1183293 - RNA, 22 nt, Homo sapiens
uauuagugccguuaucauggag

SEQ ID NO: 1183294 - RNA, 14 nt, Homo sapiens
uauuauauuugaca

SEQ ID NO: 1183295 - RNA, 18 nt, Homo sapiens
uauuauccuucuacuugu

SEQ ID NO: 1183296 - RNA, 21 nt, Homo sapiens
uauucacaaccacucauucaa

SEQ ID NO: 1183297 - RNA, 16 nt, Homo sapiens
uauucacuaaggacuu

SEQ ID NO: 1183298 - RNA, 17 nt, Homo sapiens
uauucacuaaggacuua

SEQ ID NO: 1183299 - RNA, 17 nt, Homo sapiens
uauucauccggggagga

SEQ ID NO: 1183300 - RNA, 19 nt, Homo sapiens
uauucauguucaugugauu

SEQ ID NO: 1183301 - RNA, 20 nt, Homo sapiens
uauuccaaacucuccagcca

SEQ ID NO: 1183302 - RNA, 23 nt, Homo sapiens
uauuccccccacuuaagacugug

SEQ ID NO: 1183303 - RNA, 19 nt, Homo sapiens
uauucccucuuguccuuua

SEQ ID NO: 1183304 - RNA, 23 nt, Homo sapiens
uauuccugauagagguauggaaa

SEQ ID NO: 1183305 - RNA, 17 nt, Homo sapiens
uauucgguaauaucauu

SEQ ID NO: 1183306 - RNA, 20 nt, Homo sapiens
uauucgguaauaucauuaau

SEQ ID NO: 1183307 - RNA, 21 nt, Homo sapiens
uauucgugcauuuuuggauca

SEQ ID NO: 1183308 - RNA, 12 nt, Homo sapiens
uauucucaagaa

SEQ ID NO: 1183309 - RNA, 19 nt, Homo sapiens
uauucucuaaaagcuuuaa

SEQ ID NO: 1183310 - RNA, 16 nt, Homo sapiens
uauucucucuaugcaa

SEQ ID NO: 1183311 - RNA, 21 nt, Homo sapiens
uauucucucuaugcaaaaugu

SEQ ID NO: 1183312 - RNA, 17 nt, Homo sapiens
uauucugauuggucugg

SEQ ID NO: 1183313 - RNA, 16 nt, Homo sapiens
uauucuguuuccauag

SEQ ID NO: 1183314 - RNA, 16 nt, Homo sapiens
uauucuuugccuuagc

SEQ ID NO: 1183315 - RNA, 21 nt, Homo sapiens
uauugacuaaucuuugcugaa

SEQ ID NO: 1183316 - RNA, 22 nt, Homo sapiens
uauugauuauagcaaugugauu

SEQ ID NO: 1183317 - RNA, 16 nt, Homo sapiens
uauugcaagaguuuaa

SEQ ID NO: 1183318 - RNA, 15 nt, Homo sapiens
uauugcagcuuauau

SEQ ID NO: 1183319 - RNA, 19 nt, Homo sapiens
uauuggaaagugauuuuau

SEQ ID NO: 1183320 - RNA, 14 nt, Homo sapiens
uauuggaaugcaca

SEQ ID NO: 1183321 - RNA, 13 nt, Homo sapiens
uauuggacagucu

SEQ ID NO: 1183322 - RNA, 15 nt, Homo sapiens
uauuggacagucuca

SEQ ID NO: 1183323 - RNA, 20 nt, Homo sapiens
uauuggcaguuggaggacac

SEQ ID NO: 1183324 - RNA, 23 nt, Homo sapiens
uauugggacguagagcacagccu

SEQ ID NO: 1183325 - RNA, 15 nt, Homo sapiens
uauuguauugcugcu

SEQ ID NO: 1183326 - RNA, 23 nt, Homo sapiens
uauugucauaggauuaagcaguu

SEQ ID NO: 1183327 - RNA, 22 nt, Homo sapiens
uauuguccccuaaaccaaaaac

SEQ ID NO: 1183328 - RNA, 19 nt, Homo sapiens
uauuguuuuugcaccagac

SEQ ID NO: 1183329 - RNA, 14 nt, Homo sapiens
uauuuaacucuuaa

SEQ ID NO: 1183330 - RNA, 15 nt, Homo sapiens
uauuuaacuggugca

SEQ ID NO: 1183331 - RNA, 20 nt, Homo sapiens
uauuuaauuuuaacugccaa

SEQ ID NO: 1183332 - RNA, 18 nt, Homo sapiens
uauuuacaagacugcuga

SEQ ID NO: 1183333 - RNA, 22 nt, Homo sapiens
uauuuagacacuacaacauaug

SEQ ID NO: 1183334 - RNA, 12 nt, Homo sapiens
uauuuauagucg

SEQ ID NO: 1183335 - RNA, 15 nt, Homo sapiens
uauuuauauguacug

SEQ ID NO: 1183336 - RNA, 19 nt, Homo sapiens
uauuucaaccagcacauuc

SEQ ID NO: 1183337 - RNA, 18 nt, Homo sapiens
ucaagcugguggccucug

SEQ ID NO: 1183338 - RNA, 19 nt, Homo sapiens
ucaaggaaaggccugaaag

SEQ ID NO: 1183339 - RNA, 18 nt, Homo sapiens
ucaaggacuuucugaagc

SEQ ID NO: 1183340 - RNA, 14 nt, Homo sapiens
ucaaggaugacucc

SEQ ID NO: 1183341 - RNA, 19 nt, Homo sapiens
ucaagggacaaguauuaau

SEQ ID NO: 1183342 - RNA, 15 nt, Homo sapiens
ucaaggguauuuuaa

SEQ ID NO: 1183343 - RNA, 22 nt, Homo sapiens
ucaaggugaaauaaacagucua

SEQ ID NO: 1183344 - RNA, 11 nt, Homo sapiens
ucaaguaauaa

SEQ ID NO: 1183345 - RNA, 13 nt, Homo sapiens
ucaaguaauccac

SEQ ID NO: 1183346 - RNA, 23 nt, Homo sapiens
ucaaguagaacaaaaacuauuau

SEQ ID NO: 1183347 - RNA, 15 nt, Homo sapiens
ucaagugagccagga

SEQ ID NO: 1183348 - RNA, 21 nt, Homo sapiens
ucaagugauucuccugccuca

SEQ ID NO: 1183349 - RNA, 17 nt, Homo sapiens
ucaaguuccagugcaga

SEQ ID NO: 1183350 - RNA, 17 nt, Homo sapiens
ucaauaauuguccauga

SEQ ID NO: 1183351 - RNA, 21 nt, Homo sapiens
ucaauaccugcugagaguacu

SEQ ID NO: 1183352 - RNA, 18 nt, Homo sapiens
ucaauaucugggucaauc

SEQ ID NO: 1183353 - RNA, 17 nt, Homo sapiens
ucaaucaacacuaccag

SEQ ID NO: 1183354 - RNA, 11 nt, Homo sapiens
ucaaucacugu

SEQ ID NO: 1183355 - RNA, 21 nt, Homo sapiens
ucaaucucguuuagugccaau

SEQ ID NO: 1183356 - RNA, 22 nt, Homo sapiens
ucaaucucguuuagugccaaug

SEQ ID NO: 1183357 - RNA, 12 nt, Homo sapiens
ucaaugccauug

SEQ ID NO: 1183358 - RNA, 22 nt, Homo sapiens
ucaauuaacagcagaaucucag

SEQ ID NO: 1183359 - RNA, 23 nt, Homo sapiens
ucaauuuaaacccauuuuaguca

SEQ ID NO: 1183360 - RNA, 19 nt, Homo sapiens
ucacaaagaccuugcugau

SEQ ID NO: 1183361 - RNA, 17 nt, Homo sapiens
ucacaaauaaaagccaa

SEQ ID NO: 1183362 - RNA, 22 nt, Homo sapiens
ucacaacaaaaggaagacugga

SEQ ID NO: 1183363 - RNA, 15 nt, Homo sapiens
ucacaacuccuucca

SEQ ID NO: 1183364 - RNA, 19 nt, Homo sapiens
ucacaacuccuuccauccu

SEQ ID NO: 1183365 - RNA, 20 nt, Homo sapiens
ucacaauaaaugccacuuca

SEQ ID NO: 1183366 - RNA, 21 nt, Homo sapiens
ucacaauaggccaggggaguu

SEQ ID NO: 1183367 - RNA, 21 nt, Homo sapiens
ucacaaucaucaucauucuca

SEQ ID NO: 1183368 - RNA, 19 nt, Homo sapiens
ucacaaugaguuugggcau

SEQ ID NO: 1183369 - RNA, 19 nt, Homo sapiens
ucacaauuuacgaaaccaa

SEQ ID NO: 1183370 - RNA, 20 nt, Homo sapiens
ucacaauuuacgaaaccaaa

SEQ ID NO: 1183371 - RNA, 13 nt, Homo sapiens
ucacacacaugga

SEQ ID NO: 1183372 - RNA, 13 nt, Homo sapiens
ucacacagcuuaa

SEQ ID NO: 1183373 - RNA, 12 nt, Homo sapiens
ucacacauucca

SEQ ID NO: 1183374 - RNA, 18 nt, Homo sapiens
ucacacuuacuguaagac

SEQ ID NO: 1183375 - RNA, 22 nt, Homo sapiens
ucacagcacagagaagacaaaa

SEQ ID NO: 1183376 - RNA, 20 nt, Homo sapiens
ucacagccaccccugagauc

SEQ ID NO: 1183377 - RNA, 20 nt, Homo sapiens
ucacagccuuucugaacuga

SEQ ID NO: 1183378 - RNA, 24 nt, Homo sapiens
ucacagccuuucugaacugacuga

SEQ ID NO: 1183379 - RNA, 17 nt, Homo sapiens
ucacaggugucagccau

SEQ ID NO: 1183380 - RNA, 22 nt, Homo sapiens
ucacagugugaguggucugugu

SEQ ID NO: 1183381 - RNA, 15 nt, Homo sapiens
ucacaguuucuucca

SEQ ID NO: 1183382 - RNA, 17 nt, Homo sapiens
ucacaucagaacagaca

SEQ ID NO: 1183383 - RNA, 18 nt, Homo sapiens
ucacauccauucuucccu

SEQ ID NO: 1183384 - RNA, 13 nt, Homo sapiens
ucacaugccuugc

SEQ ID NO: 1183385 - RNA, 18 nt, Homo sapiens
ucacaugccuugcaaugg

SEQ ID NO: 1183386 - RNA, 21 nt, Homo sapiens
ucacauggaaucuacaugugu

SEQ ID NO: 1183387 - RNA, 17 nt, Homo sapiens
ucacauggccuaugcac

SEQ ID NO: 1183388 - RNA, 18 nt, Homo sapiens
ucucaucugaggcaucca

SEQ ID NO: 1183389 - RNA, 15 nt, Homo sapiens
ucucaugagugccaa

SEQ ID NO: 1183390 - RNA, 17 nt, Homo sapiens
ucucaugggaaggggag

SEQ ID NO: 1183391 - RNA, 18 nt, Homo sapiens
ucucauguuuuccauugu

SEQ ID NO: 1183392 - RNA, 18 nt, Homo sapiens
ucucauucccuccccaga

SEQ ID NO: 1183393 - RNA, 20 nt, Homo sapiens
ucucauuuggacuugcugaa

SEQ ID NO: 1183394 - RNA, 22 nt, Homo sapiens
ucucauuuguauuuucaguuug

SEQ ID NO: 1183395 - RNA, 19 nt, Homo sapiens
ucucauuuuguccaugucc

SEQ ID NO: 1183396 - RNA, 17 nt, Homo sapiens
ucuccaacggcaaggga

SEQ ID NO: 1183397 - RNA, 15 nt, Homo sapiens
ucuccaaggcuuuua

SEQ ID NO: 1183398 - RNA, 19 nt, Homo sapiens
ucuccagaugagaguacac

SEQ ID NO: 1183399 - RNA, 21 nt, Homo sapiens
ucuccagcucuggcuuccugc

SEQ ID NO: 1183400 - RNA, 13 nt, Homo sapiens
ucuccauacuuug

SEQ ID NO: 1183401 - RNA, 12 nt, Homo sapiens
ucuccauguugg

SEQ ID NO: 1183402 - RNA, 14 nt, Homo sapiens
ucucccacacaaga

SEQ ID NO: 1183403 - RNA, 12 nt, Homo sapiens
ucucccaccagc

SEQ ID NO: 1183404 - RNA, 21 nt, Homo sapiens
ucucccaccuuucgggccaug

SEQ ID NO: 1183405 - RNA, 12 nt, Homo sapiens
ucuccccaauga

SEQ ID NO: 1183406 - RNA, 17 nt, Homo sapiens
ucuccccagcccagaga

SEQ ID NO: 1183407 - RNA, 18 nt, Homo sapiens
ucuccccagcccagagac

SEQ ID NO: 1183408 - RNA, 18 nt, Homo sapiens
ucucccgggacuaccugg

SEQ ID NO: 1183409 - RNA, 12 nt, Homo sapiens
ucucccgucucg

SEQ ID NO: 1183410 - RNA, 22 nt, Homo sapiens
ucucccuggggaugugcuuugu

SEQ ID NO: 1183411 - RNA, 16 nt, Homo sapiens
ucuccucgcugacccu

SEQ ID NO: 1183412 - RNA, 15 nt, Homo sapiens
ucuccugcccaugau

SEQ ID NO: 1183413 - RNA, 13 nt, Homo sapiens
ucuccugccucag

SEQ ID NO: 1183414 - RNA, 16 nt, Homo sapiens
ucuccuggaguugcau

SEQ ID NO: 1183415 - RNA, 18 nt, Homo sapiens
ucuccugggccguuacau

SEQ ID NO: 1183416 - RNA, 17 nt, Homo sapiens
ucuccugugaacacugg

SEQ ID NO: 1183417 - RNA, 13 nt, Homo sapiens
ucuccuguggucu

SEQ ID NO: 1183418 - RNA, 17 nt, Homo sapiens
ucuccuuugcaguuccu

SEQ ID NO: 1183419 - RNA, 19 nt, Homo sapiens
ucucgaacuccugaccuca

SEQ ID NO: 1183420 - RNA, 20 nt, Homo sapiens
ucucgaacuccuggccucaa

SEQ ID NO: 1183421 - RNA, 15 nt, Homo sapiens
ucucgacaguaucca

SEQ ID NO: 1183422 - RNA, 18 nt, Homo sapiens
ucucgccacugcacucca

SEQ ID NO: 1183423 - RNA, 17 nt, Homo sapiens
ucucggcucagugcaac

SEQ ID NO: 1183424 - RNA, 13 nt, Homo sapiens
ucucguugcccua

SEQ ID NO: 1183425 - RNA, 17 nt, Homo sapiens
ucucguugccucugauu

SEQ ID NO: 1183426 - RNA, 16 nt, Homo sapiens
ucucuaaaucagggug

SEQ ID NO: 1183427 - RNA, 16 nt, Homo sapiens
ucucuaacucagaaac

SEQ ID NO: 1183428 - RNA, 15 nt, Homo sapiens
ucucuaauaaaaaca

SEQ ID NO: 1183429 - RNA, 16 nt, Homo sapiens
ucucuacccaguagau

SEQ ID NO: 1183430 - RNA, 12 nt, Homo sapiens
ucucuacugugg

SEQ ID NO: 1183431 - RNA, 18 nt, Homo sapiens
ucucuacuuuucccugua

SEQ ID NO: 1183432 - RNA, 11 nt, Homo sapiens
ucucucaggag

SEQ ID NO: 1183433 - RNA, 14 nt, Homo sapiens
ucucuccagccuga

SEQ ID NO: 1183434 - RNA, 15 nt, Homo sapiens
ucucuccagccugac

SEQ ID NO: 1183435 - RNA, 21 nt, Homo sapiens
ucucucccugcuuugcuguga

SEQ ID NO: 1183436 - RNA, 10 nt, Homo sapiens
ucucucugcc

SEQ ID NO: 1183437 - RNA, 12 nt, Homo sapiens
ucucucugggcu

SEQ ID NO: 1183438 - RNA, 23 nt, Homo sapiens
ucucugauagguagcauuuucca

SEQ ID NO: 1183439 - RNA, 14 nt, Homo sapiens
ucucugcaccggac

SEQ ID NO: 1183440 - RNA, 17 nt, Homo sapiens
ucucugcagacuuccca

SEQ ID NO: 1183441 - RNA, 17 nt, Homo sapiens
ucucugcuuaguucuau

SEQ ID NO: 1183442 - RNA, 20 nt, Homo sapiens
ucucugggauuuaugcucau

SEQ ID NO: 1183443 - RNA, 17 nt, Homo sapiens
ucucuggguagugcuuu

SEQ ID NO: 1183444 - RNA, 16 nt, Homo sapiens
ucucugggucccgggg

SEQ ID NO: 1183445 - RNA, 15 nt, Homo sapiens
ucucuggguuuacaa

SEQ ID NO: 1183446 - RNA, 17 nt, Homo sapiens
ucucugugucugagagc

SEQ ID NO: 1183447 - RNA, 15 nt, Homo sapiens
ucucuguucuucauc

SEQ ID NO: 1183448 - RNA, 22 nt, Homo sapiens
ucucuuaaaccacagcacuauu

SEQ ID NO: 1183449 - RNA, 19 nt, Homo sapiens
ucucuuuaaaaccauauca

SEQ ID NO: 1183450 - RNA, 21 nt, Homo sapiens
ucucuuuggcuggaauuacaa

SEQ ID NO: 1183451 - RNA, 13 nt, Homo sapiens
ucucuuuguccug

SEQ ID NO: 1183452 - RNA, 22 nt, Homo sapiens
ucugaaacucccuuguguuccu

SEQ ID NO: 1183453 - RNA, 16 nt, Homo sapiens
ucugaaacugcauaag

SEQ ID NO: 1183454 - RNA, 23 nt, Homo sapiens
ucugaaacugcauaagugaaaau

SEQ ID NO: 1183455 - RNA, 13 nt, Homo sapiens
ucugaaaggguuu

SEQ ID NO: 1183456 - RNA, 19 nt, Homo sapiens
ucugaaaggguuuuuaauc

SEQ ID NO: 1183457 - RNA, 22 nt, Homo sapiens
ucugaaaggguuuuuaaucucc

SEQ ID NO: 1183458 - RNA, 22 nt, Homo sapiens
ucugaaagucaugcacauaccu

SEQ ID NO: 1183459 - RNA, 21 nt, Homo sapiens
ucugaagcagaugcaaagagg

SEQ ID NO: 1183460 - RNA, 23 nt, Homo sapiens
ucugaagcccucccagguguuaa

SEQ ID NO: 1183461 - RNA, 15 nt, Homo sapiens
ucugaagugugucca

SEQ ID NO: 1183462 - RNA, 15 nt, Homo sapiens
ucugaauuugcaaag

SEQ ID NO: 1183463 - RNA, 18 nt, Homo sapiens
ucugacaaugcugagguu

SEQ ID NO: 1183464 - RNA, 19 nt, Homo sapiens
ucugacagcagccugugag

SEQ ID NO: 1183465 - RNA, 19 nt, Homo sapiens
ucugaccaucugugacuau

SEQ ID NO: 1183466 - RNA, 15 nt, Homo sapiens
ucugacccugggcuu

SEQ ID NO: 1183467 - RNA, 19 nt, Homo sapiens
ucugagagaugacagggaa

SEQ ID NO: 1183468 - RNA, 16 nt, Homo sapiens
ucugaggacauuccaa

SEQ ID NO: 1183469 - RNA, 14 nt, Homo sapiens
ucugaguaacauca

SEQ ID NO: 1183470 - RNA, 14 nt, Homo sapiens
ucugauaaugcuca

SEQ ID NO: 1183471 - RNA, 14 nt, Homo sapiens
ucugauggauucaa

SEQ ID NO: 1183472 - RNA, 21 nt, Homo sapiens
ucugauucgaaugacacuguu

SEQ ID NO: 1183473 - RNA, 19 nt, Homo sapiens
ucugauuugcaggauuuuu

SEQ ID NO: 1183474 - RNA, 13 nt, Homo sapiens
ucugcaaacauua

SEQ ID NO: 1183475 - RNA, 14 nt, Homo sapiens
ucugcaaugacugu

SEQ ID NO: 1183476 - RNA, 19 nt, Homo sapiens
ucugcagucacccagggcg

SEQ ID NO: 1183477 - RNA, 16 nt, Homo sapiens
ucugcauacuaaccua

SEQ ID NO: 1183478 - RNA, 14 nt, Homo sapiens
ucugcaucauccuc

SEQ ID NO: 1183479 - RNA, 14 nt, Homo sapiens
ucugcaucucuggu

SEQ ID NO: 1183480 - RNA, 21 nt, Homo sapiens
ucugcauuucgguggcuaguc

SEQ ID NO: 1183481 - RNA, 23 nt, Homo sapiens
ucugcauuucgguggcuagucaa

SEQ ID NO: 1183482 - RNA, 15 nt, Homo sapiens
ucugccaaccccagg

SEQ ID NO: 1183483 - RNA, 18 nt, Homo sapiens
ucugccaaucuguacaaa

SEQ ID NO: 1183484 - RNA, 13 nt, Homo sapiens
ucugcccaccuac

SEQ ID NO: 1183485 - RNA, 22 nt, Homo sapiens
ucugccccaguugguguucaaa

SEQ ID NO: 1183486 - RNA, 17 nt, Homo sapiens
ucugcccgggagcucag

SEQ ID NO: 1183487 - RNA, 21 nt, Homo sapiens
ucugcccugugggaccccagg

SEQ ID NO: 1183488 - RNA, 20 nt, Homo sapiens
ucugccggcccuggggcuag

SEQ ID NO: 1183489 - RNA, 22 nt, Homo sapiens
ucugccugauaggacccauauu

SEQ ID NO: 1183490 - RNA, 19 nt, Homo sapiens
ucugcgaucaucgucauuu

SEQ ID NO: 1183491 - RNA, 22 nt, Homo sapiens
ucugcuaacucuguuauucuuc

SEQ ID NO: 1183492 - RNA, 12 nt, Homo sapiens
ucugcuagggaa

SEQ ID NO: 1183493 - RNA, 13 nt, Homo sapiens
ucugcucaggaau

SEQ ID NO: 1183494 - RNA, 14 nt, Homo sapiens
ucugcucaucauuc

SEQ ID NO: 1183495 - RNA, 23 nt, Homo sapiens
ucugcuccaaaggaaauccaaaa

SEQ ID NO: 1183496 - RNA, 20 nt, Homo sapiens
ucugcucuaccauguuuaaa

SEQ ID NO: 1183497 - RNA, 16 nt, Homo sapiens
ucugcugagacugagc

SEQ ID NO: 1183498 - RNA, 21 nt, Homo sapiens
ucugcugcgauccggcagccu

SEQ ID NO: 1183499 - RNA, 17 nt, Homo sapiens
ucugcugggccaccagc

SEQ ID NO: 1183500 - RNA, 19 nt, Homo sapiens
ucugcugggccaccagcca

SEQ ID NO: 1183501 - RNA, 14 nt, Homo sapiens
ucugcuuaccacau

SEQ ID NO: 1183502 - RNA, 19 nt, Homo sapiens
ucugcuuuugaaaucugua

SEQ ID NO: 1183503 - RNA, 16 nt, Homo sapiens
ucuggaacccagaaga

SEQ ID NO: 1183504 - RNA, 18 nt, Homo sapiens
ucuggaacccagacucag

SEQ ID NO: 1183505 - RNA, 21 nt, Homo sapiens
ucuggaagucaucucauucca

SEQ ID NO: 1183506 - RNA, 13 nt, Homo sapiens
ucuggacugcaca

SEQ ID NO: 1183507 - RNA, 22 nt, Homo sapiens
ucuggagcaaccuacugucuaa

SEQ ID NO: 1183508 - RNA, 20 nt, Homo sapiens
ucuggauuucacggagacag

SEQ ID NO: 1183509 - RNA, 19 nt, Homo sapiens
ucuggcaaacaugugcaac

SEQ ID NO: 1183510 - RNA, 19 nt, Homo sapiens
ucuggcaggaaucuaucca

SEQ ID NO: 1183511 - RNA, 19 nt, Homo sapiens
ucuggcauuuguuuccuca

SEQ ID NO: 1183512 - RNA, 21 nt, Homo sapiens
ucuggccuguacccaguagau

SEQ ID NO: 1183513 - RNA, 14 nt, Homo sapiens
ucuggcucuugucc

SEQ ID NO: 1183514 - RNA, 13 nt, Homo sapiens
ucuggcugcagag

SEQ ID NO: 1183515 - RNA, 22 nt, Homo sapiens
ucugggaagacuguugugcucc

SEQ ID NO: 1183516 - RNA, 17 nt, Homo sapiens
ucugggagucacacagu

SEQ ID NO: 1183517 - RNA, 20 nt, Homo sapiens
ucuggggggacccagugcag

SEQ ID NO: 1183518 - RNA, 18 nt, Homo sapiens
ucuggguacuucuugaag

SEQ ID NO: 1183519 - RNA, 18 nt, Homo sapiens
ucuggguccauacaccag

SEQ ID NO: 1183520 - RNA, 19 nt, Homo sapiens
ucugggugaaagggauacu

SEQ ID NO: 1183521 - RNA, 22 nt, Homo sapiens
ucugguccaggcccuguggcag

SEQ ID NO: 1183522 - RNA, 14 nt, Homo sapiens
ucugguccuaccca

SEQ ID NO: 1183523 - RNA, 16 nt, Homo sapiens
ucuuagaccaugcuaa

SEQ ID NO: 1183524 - RNA, 16 nt, Homo sapiens
ucuuagauauucacua

SEQ ID NO: 1183525 - RNA, 13 nt, Homo sapiens
ucuuagauucucu

SEQ ID NO: 1183526 - RNA, 15 nt, Homo sapiens
ucuuaggaggcauuu

SEQ ID NO: 1183527 - RNA, 13 nt, Homo sapiens
ucuuagucuuacc

SEQ ID NO: 1183528 - RNA, 18 nt, Homo sapiens
ucuuauacgucuagccua

SEQ ID NO: 1183529 - RNA, 17 nt, Homo sapiens
ucuuauagaaaguucaa

SEQ ID NO: 1183530 - RNA, 21 nt, Homo sapiens
ucuuauccuagcacaugcuuc

SEQ ID NO: 1183531 - RNA, 17 nt, Homo sapiens
ucuuaugauuacuauca

SEQ ID NO: 1183532 - RNA, 19 nt, Homo sapiens
ucuuauucuuuuguaauau

SEQ ID NO: 1183533 - RNA, 20 nt, Homo sapiens
ucuuauugaaaugcagauug

SEQ ID NO: 1183534 - RNA, 18 nt, Homo sapiens
ucuucaaagcaaagcucu

SEQ ID NO: 1183535 - RNA, 22 nt, Homo sapiens
ucuucaaaugccugacuaggga

SEQ ID NO: 1183536 - RNA, 14 nt, Homo sapiens
ucuucaagacucug

SEQ ID NO: 1183537 - RNA, 22 nt, Homo sapiens
ucuucaccccacacccaugugu

SEQ ID NO: 1183538 - RNA, 22 nt, Homo sapiens
ucuucaccuuaggaauaaucuc

SEQ ID NO: 1183539 - RNA, 15 nt, Homo sapiens
ucuucagcugccagu

SEQ ID NO: 1183540 - RNA, 19 nt, Homo sapiens
ucuucaguguaaugugacu

SEQ ID NO: 1183541 - RNA, 23 nt, Homo sapiens
ucuucauuccuugcugcucacau

SEQ ID NO: 1183542 - RNA, 12 nt, Homo sapiens
ucuuccaaacag

SEQ ID NO: 1183543 - RNA, 15 nt, Homo sapiens
ucuucccacauacau

SEQ ID NO: 1183544 - RNA, 20 nt, Homo sapiens
ucuucccgcacaaauuccac

SEQ ID NO: 1183545 - RNA, 21 nt, Homo sapiens
ucuucccgcacaaauuccaca

SEQ ID NO: 1183546 - RNA, 22 nt, Homo sapiens
ucuucccucucugcagacuucc

SEQ ID NO: 1183547 - RNA, 19 nt, Homo sapiens
ucuucccuuuuacauacug

SEQ ID NO: 1183548 - RNA, 16 nt, Homo sapiens
ucuuccugcacccaca

SEQ ID NO: 1183549 - RNA, 20 nt, Homo sapiens
ucuuccugcccuuuccuucc

SEQ ID NO: 1183550 - RNA, 12 nt, Homo sapiens
ucuuccugucuc

SEQ ID NO: 1183551 - RNA, 14 nt, Homo sapiens
ucuucuacugcuau

SEQ ID NO: 1183552 - RNA, 16 nt, Homo sapiens
ucuucucaaguucuaa

SEQ ID NO: 1183553 - RNA, 18 nt, Homo sapiens
ucuucuccuggaguugca

SEQ ID NO: 1183554 - RNA, 17 nt, Homo sapiens
ucuucugacauuuauca

SEQ ID NO: 1183555 - RNA, 15 nt, Homo sapiens
ucuucuuagcaccac

SEQ ID NO: 1183556 - RNA, 16 nt, Homo sapiens
ucuucuucaagacucu

SEQ ID NO: 1183557 - RNA, 13 nt, Homo sapiens
ucuucuuccugaa

SEQ ID NO: 1183558 - RNA, 21 nt, Homo sapiens
ucuucuuggggcccagugcau

SEQ ID NO: 1183559 - RNA, 18 nt, Homo sapiens
ucuucuuucagacuugcc

SEQ ID NO: 1183560 - RNA, 14 nt, Homo sapiens
ucuucuuugcugca

SEQ ID NO: 1183561 - RNA, 23 nt, Homo sapiens
ucuugaaaauagaacaacuugca

SEQ ID NO: 1183562 - RNA, 21 nt, Homo sapiens
ucuugaaauuaagaaggcaaa

SEQ ID NO: 1183563 - RNA, 14 nt, Homo sapiens
ucuugaacuccuga

SEQ ID NO: 1183564 - RNA, 13 nt, Homo sapiens
ucuugaagcagua

SEQ ID NO: 1183565 - RNA, 14 nt, Homo sapiens
ucuugaaggugcug

SEQ ID NO: 1183566 - RNA, 20 nt, Homo sapiens
ucuugaaucucugaauuuga

SEQ ID NO: 1183567 - RNA, 14 nt, Homo sapiens
ucuugaauucaugu

SEQ ID NO: 1183568 - RNA, 23 nt, Homo sapiens
ucuugaccuaguauaucagugac

SEQ ID NO: 1183569 - RNA, 15 nt, Homo sapiens
ucuugacuagugcaa

SEQ ID NO: 1183570 - RNA, 20 nt, Homo sapiens
ucuugaguguuaugugaauu

SEQ ID NO: 1183571 - RNA, 17 nt, Homo sapiens
ucuugccccuccagaga

SEQ ID NO: 1183572 - RNA, 18 nt, Homo sapiens
ucuugcuguugacauauu

SEQ ID NO: 1183573 - RNA, 15 nt, Homo sapiens
ucuuggagaauauca

SEQ ID NO: 1183574 - RNA, 22 nt, Homo sapiens
ucuuggagccugcagagcugcg

SEQ ID NO: 1183575 - RNA, 17 nt, Homo sapiens
ucuuggccuaaaccuca

SEQ ID NO: 1183576 - RNA, 12 nt, Homo sapiens
ucuuggugcugu

SEQ ID NO: 1183577 - RNA, 20 nt, Homo sapiens
ucuugguuccagccugccac

SEQ ID NO: 1183578 - RNA, 15 nt, Homo sapiens
ucuuguauugcucca

SEQ ID NO: 1183579 - RNA, 19 nt, Homo sapiens
ucuugugaaggccaugaua

SEQ ID NO: 1183580 - RNA, 16 nt, Homo sapiens
ucuuguguuaccugaa

SEQ ID NO: 1183581 - RNA, 15 nt, Homo sapiens
ucuuguucacugcag

SEQ ID NO: 1183582 - RNA, 18 nt, Homo sapiens
ucuuguugcuuuguugca

SEQ ID NO: 1183583 - RNA, 16 nt, Homo sapiens
ucuuguuguuauugau

SEQ ID NO: 1183584 - RNA, 17 nt, Homo sapiens
ucuuguuuuaagcaaau

SEQ ID NO: 1183585 - RNA, 22 nt, Homo sapiens
ucuuuaaacacucuucagagaa

SEQ ID NO: 1183586 - RNA, 20 nt, Homo sapiens
ucuuuaaaggcaucuacaca

SEQ ID NO: 1183587 - RNA, 20 nt, Homo sapiens
ucuuuacaaaacuacaugag

SEQ ID NO: 1183588 - RNA, 21 nt, Homo sapiens
ucuuuacaaaacuacaugaga

SEQ ID NO: 1183589 - RNA, 17 nt, Homo sapiens
ucuuuacaauaaacaua

SEQ ID NO: 1183590 - RNA, 14 nt, Homo sapiens
ucuuuacuccauga

SEQ ID NO: 1183591 - RNA, 15 nt, Homo sapiens
ucuuuagaacaggga

SEQ ID NO: 1183592 - RNA, 15 nt, Homo sapiens
ucuuuagaacagugc

SEQ ID NO: 1183593 - RNA, 15 nt, Homo sapiens
ucuuuagcaguuuug

SEQ ID NO: 1183594 - RNA, 18 nt, Homo sapiens
ucuuuauacuuaaacagc

SEQ ID NO: 1183595 - RNA, 21 nt, Homo sapiens
ucuuuauauaaggucauagau

SEQ ID NO: 1183596 - RNA, 19 nt, Homo sapiens
ucuuucaacuggguuuuca

SEQ ID NO: 1183597 - RNA, 16 nt, Homo sapiens
ucuuucagacuugcca

SEQ ID NO: 1183598 - RNA, 17 nt, Homo sapiens
ucuuucaugugugccaa

SEQ ID NO: 1183599 - RNA, 12 nt, Homo sapiens
ucuuuccacuuu

SEQ ID NO: 1183600 - RNA, 17 nt, Homo sapiens
ucuuucccaauucacau

SEQ ID NO: 1183601 - RNA, 16 nt, Homo sapiens
ucuuuccuucuuucau

SEQ ID NO: 1183602 - RNA, 16 nt, Homo sapiens
ucuuucuacucuccua

SEQ ID NO: 1183603 - RNA, 19 nt, Homo sapiens
ucuuucuuacacaagagcu

SEQ ID NO: 1183604 - RNA, 21 nt, Homo sapiens
ucuuugagauaauacauuccg

SEQ ID NO: 1183605 - RNA, 20 nt, Homo sapiens
ucuuugauucaaagcacugu

SEQ ID NO: 1183606 - RNA, 24 nt, Homo sapiens
ucuuugccacugauuagcaguauu

SEQ ID NO: 1183607 - RNA, 17 nt, Homo sapiens
ugcacuuauucucaaga

SEQ ID NO: 1183608 - RNA, 21 nt, Homo sapiens
ugcacuucuuguaaagaguga

SEQ ID NO: 1183609 - RNA, 22 nt, Homo sapiens
ugcacuuuggguuuuuaacuca

SEQ ID NO: 1183610 - RNA, 15 nt, Homo sapiens
ugcagaaacagugca

SEQ ID NO: 1183611 - RNA, 18 nt, Homo sapiens
ugcagaaauacaguauga

SEQ ID NO: 1183612 - RNA, 18 nt, Homo sapiens
ugcagaagguuacuaccu

SEQ ID NO: 1183613 - RNA, 20 nt, Homo sapiens
ugcagagaaagaaagggaaa

SEQ ID NO: 1183614 - RNA, 23 nt, Homo sapiens
ugcagagauccuacuucucugag

SEQ ID NO: 1183615 - RNA, 21 nt, Homo sapiens
ugcagaggaggagaaaaguga

SEQ ID NO: 1183616 - RNA, 15 nt, Homo sapiens
ugcagaguaaguauu

SEQ ID NO: 1183617 - RNA, 21 nt, Homo sapiens
ugcagaguauaugaggcuuga

SEQ ID NO: 1183618 - RNA, 16 nt, Homo sapiens
ugcagaguccauuucc

SEQ ID NO: 1183619 - RNA, 16 nt, Homo sapiens
ugcagauagaaagcau

SEQ ID NO: 1183620 - RNA, 17 nt, Homo sapiens
ugcagaugaucagggau

SEQ ID NO: 1183621 - RNA, 16 nt, Homo sapiens
ugcagauucgagucac

SEQ ID NO: 1183622 - RNA, 15 nt, Homo sapiens
ugcagcaggugcaag

SEQ ID NO: 1183623 - RNA, 22 nt, Homo sapiens
ugcagccacacucuucuaugac

SEQ ID NO: 1183624 - RNA, 20 nt, Homo sapiens
ugcagccaggagaaggucag

SEQ ID NO: 1183625 - RNA, 19 nt, Homo sapiens
ugcagccaggccucgccug

SEQ ID NO: 1183626 - RNA, 20 nt, Homo sapiens
ugcagcggcaggaccgccau

SEQ ID NO: 1183627 - RNA, 22 nt, Homo sapiens
ugcagcugcuuguugucaagua

SEQ ID NO: 1183628 - RNA, 19 nt, Homo sapiens
ugcagcuuauauucaucca

SEQ ID NO: 1183629 - RNA, 20 nt, Homo sapiens
ugcaggacuugagaagaccu

SEQ ID NO: 1183630 - RNA, 15 nt, Homo sapiens
ugcaggagcgugaag

SEQ ID NO: 1183631 - RNA, 13 nt, Homo sapiens
ugcaggauuugaa

SEQ ID NO: 1183632 - RNA, 23 nt, Homo sapiens
ugcaggcuguuuauauguucaca

SEQ ID NO: 1183633 - RNA, 16 nt, Homo sapiens
ugcagguccagugcag

SEQ ID NO: 1183634 - RNA, 22 nt, Homo sapiens
ugcagguuccgauguuauuaga

SEQ ID NO: 1183635 - RNA, 17 nt, Homo sapiens
ugcagguuugaccagga

SEQ ID NO: 1183636 - RNA, 15 nt, Homo sapiens
ugcaguccauuuccu

SEQ ID NO: 1183637 - RNA, 16 nt, Homo sapiens
ugcagucgcuugccaa

SEQ ID NO: 1183638 - RNA, 17 nt, Homo sapiens
ugcagucgcuugccaaa

SEQ ID NO: 1183639 - RNA, 15 nt, Homo sapiens
ugcagucugggugcu

SEQ ID NO: 1183640 - RNA, 15 nt, Homo sapiens
ugccucccaucucaa

SEQ ID NO: 1183641 - RNA, 21 nt, Homo sapiens
ugccuccgcaccugaccgcug

SEQ ID NO: 1183642 - RNA, 19 nt, Homo sapiens
ugccuccucccuggcugca

SEQ ID NO: 1183643 - RNA, 18 nt, Homo sapiens
ugccuccuucccucgggg

SEQ ID NO: 1183644 - RNA, 16 nt, Homo sapiens
ugccucgaaaguguca

SEQ ID NO: 1183645 - RNA, 23 nt, Homo sapiens
ugccucugacagcagccugugag

SEQ ID NO: 1183646 - RNA, 14 nt, Homo sapiens
ugccucuguccuua

SEQ ID NO: 1183647 - RNA, 15 nt, Homo sapiens
ugccugagaacacca

SEQ ID NO: 1183648 - RNA, 19 nt, Homo sapiens
ugccugaggacuaugccau

SEQ ID NO: 1183649 - RNA, 20 nt, Homo sapiens
ugccugaucugcacauuuca

SEQ ID NO: 1183650 - RNA, 15 nt, Homo sapiens
ugccugccacccugc

SEQ ID NO: 1183651 - RNA, 16 nt, Homo sapiens
ugccugccugugcuau

SEQ ID NO: 1183652 - RNA, 11 nt, Homo sapiens
ugccuggucua

SEQ ID NO: 1183653 - RNA, 21 nt, Homo sapiens
ugccuguacuaaggagcauga

SEQ ID NO: 1183654 - RNA, 20 nt, Homo sapiens
ugccuguagagccagccuug

SEQ ID NO: 1183655 - RNA, 15 nt, Homo sapiens
ugccuguagucucag

SEQ ID NO: 1183656 - RNA, 19 nt, Homo sapiens
ugccugucuguuacacugg

SEQ ID NO: 1183657 - RNA, 14 nt, Homo sapiens
ugccuucaaaucaa

SEQ ID NO: 1183658 - RNA, 15 nt, Homo sapiens
ugccuucaccuccuc

SEQ ID NO: 1183659 - RNA, 18 nt, Homo sapiens
ugccuucacugugcucca

SEQ ID NO: 1183660 - RNA, 18 nt, Homo sapiens
ugccuuccuaagccugug

SEQ ID NO: 1183661 - RNA, 17 nt, Homo sapiens
ugccuucucccugggaa

SEQ ID NO: 1183662 - RNA, 21 nt, Homo sapiens
ugcgacccugggggcacagga

SEQ ID NO: 1183663 - RNA, 22 nt, Homo sapiens
ugcgaguccauuguggagccaa

SEQ ID NO: 1183664 - RNA, 20 nt, Homo sapiens
ugcgaucucggcucagugca

SEQ ID NO: 1183665 - RNA, 22 nt, Homo sapiens
ugcgauuuuguuaacccagcga

SEQ ID NO: 1183666 - RNA, 13 nt, Homo sapiens
ugcgcacaccgcc

SEQ ID NO: 1183667 - RNA, 17 nt, Homo sapiens
ugcgccccgccugaccu

SEQ ID NO: 1183668 - RNA, 23 nt, Homo sapiens
ugcgccugacauucacacagaga

SEQ ID NO: 1183669 - RNA, 22 nt, Homo sapiens
ugcuucgggaagaaggggacaa

SEQ ID NO: 1183670 - RNA, 17 nt, Homo sapiens
ugcuugacaacaucuga

SEQ ID NO: 1183671 - RNA, 18 nt, Homo sapiens
ugcuugcaauguagucaa

SEQ ID NO: 1183672 - RNA, 16 nt, Homo sapiens
ugcuugcucuaaguca

SEQ ID NO: 1183673 - RNA, 22 nt, Homo sapiens
ugcuuggguggagaagccauug

SEQ ID NO: 1183674 - RNA, 20 nt, Homo sapiens
ugcuuguaaaauuucacuua

SEQ ID NO: 1183675 - RNA, 15 nt, Homo sapiens
ugcuuguacuaagcc

SEQ ID NO: 1183676 - RNA, 18 nt, Homo sapiens
ugcuuguggccaaugcau

SEQ ID NO: 1183677 - RNA, 15 nt, Homo sapiens
ugcuuuaacagucaa

SEQ ID NO: 1183678 - RNA, 20 nt, Homo sapiens
ugcuuuauaccccauuugau

SEQ ID NO: 1183679 - RNA, 15 nt, Homo sapiens
ugcuuuaucagggga

SEQ ID NO: 1183680 - RNA, 17 nt, Homo sapiens
ugcuuuaucuacuuuag

SEQ ID NO: 1183681 - RNA, 17 nt, Homo sapiens
ugcuuucuauuaucuau

SEQ ID NO: 1183682 - RNA, 18 nt, Homo sapiens
ugcuuugccuauggagua

SEQ ID NO: 1183683 - RNA, 22 nt, Homo sapiens
ugcuuugccucgaaagugucau

SEQ ID NO: 1183684 - RNA, 19 nt, Homo sapiens
ugcuuuguugcacugaaau

SEQ ID NO: 1183685 - RNA, 17 nt, Homo sapiens
ugcuuuugaaaucugua

SEQ ID NO: 1183686 - RNA, 17 nt, Homo sapiens
uggaaaaagccugugaa

SEQ ID NO: 1183687 - RNA, 11 nt, Homo sapiens
uggaaaaagcg

SEQ ID NO: 1183688 - RNA, 18 nt, Homo sapiens
uggaaaagggucuuggga

SEQ ID NO: 1183689 - RNA, 22 nt, Homo sapiens
uggaaaaguaaagaaaaacccu

SEQ ID NO: 1183690 - RNA, 17 nt, Homo sapiens
uggaaacacauacuccu

SEQ ID NO: 1183691 - RNA, 23 nt, Homo sapiens
uggaaacaugggaaggugccacu

SEQ ID NO: 1183692 - RNA, 18 nt, Homo sapiens
uggaaacccauaggccca

SEQ ID NO: 1183693 - RNA, 19 nt, Homo sapiens
uuaaaacuggaccuguaua

SEQ ID NO: 1183694 - RNA, 22 nt, Homo sapiens
uuaaaagguuaaauauugucau

SEQ ID NO: 1183695 - RNA, 21 nt, Homo sapiens
uuaaaaguguauuuuauucag

SEQ ID NO: 1183696 - RNA, 17 nt, Homo sapiens
uuaaaauaaauucucuc

SEQ ID NO: 1183697 - RNA, 14 nt, Homo sapiens
uuaaaauaagaaca

SEQ ID NO: 1183698 - RNA, 20 nt, Homo sapiens
uuaaaauaugcucuaaacau

SEQ ID NO: 1183699 - RNA, 14 nt, Homo sapiens
uuaaaaucaguauu

SEQ ID NO: 1183700 - RNA, 23 nt, Homo sapiens
uuaaaaugcaaaauaaugucuua

SEQ ID NO: 1183701 - RNA, 18 nt, Homo sapiens
uuaaaauggcuacacuca

SEQ ID NO: 1183702 - RNA, 18 nt, Homo sapiens
uuaaaauguauaccaagg

SEQ ID NO: 1183703 - RNA, 15 nt, Homo sapiens
uuaaaauguuuacug

SEQ ID NO: 1183704 - RNA, 19 nt, Homo sapiens
uuaaacauaggaaagaaga

SEQ ID NO: 1183705 - RNA, 19 nt, Homo sapiens
uuaaacgauuagugauguc

SEQ ID NO: 1183706 - RNA, 13 nt, Homo sapiens
uuaaacucgagau

SEQ ID NO: 1183707 - RNA, 11 nt, Homo sapiens
uuaaacucugu

SEQ ID NO: 1183708 - RNA, 20 nt, Homo sapiens
uuaaagaaauauaaacacaa

SEQ ID NO: 1183709 - RNA, 15 nt, Homo sapiens
uuaaagaauaugacu

SEQ ID NO: 1183710 - RNA, 13 nt, Homo sapiens
uuaaagaauucuc

SEQ ID NO: 1183711 - RNA, 15 nt, Homo sapiens
uuaaagaauucucuu

SEQ ID NO: 1183712 - RNA, 17 nt, Homo sapiens
uuaaagaguaaagcagc

SEQ ID NO: 1183713 - RNA, 20 nt, Homo sapiens
uuaaagauauuuuuauucaa

SEQ ID NO: 1183714 - RNA, 17 nt, Homo sapiens
uuaaaggaaaagcacaa

SEQ ID NO: 1183715 - RNA, 18 nt, Homo sapiens
uuaaaggacaaacaguga

SEQ ID NO: 1183716 - RNA, 18 nt, Homo sapiens
uuaaagggaaaacccuca

SEQ ID NO: 1183717 - RNA, 20 nt, Homo sapiens
uuaaagucaggaguccaaga

SEQ ID NO: 1183718 - RNA, 17 nt, Homo sapiens
uuaaaguuugcaguauu

SEQ ID NO: 1183719 - RNA, 15 nt, Homo sapiens
uuaaauauuucuuaa

SEQ ID NO: 1183720 - RNA, 21 nt, Homo sapiens
uuaaaucaacgaguacuucaa

SEQ ID NO: 1183721 - RNA, 14 nt, Homo sapiens
uuaaaucaagauua

SEQ ID NO: 1183722 - RNA, 20 nt, Homo sapiens
uuaaaugaaaguauuggcau

SEQ ID NO: 1183723 - RNA, 15 nt, Homo sapiens
uuaaaugacuuagaa

SEQ ID NO: 1183724 - RNA, 14 nt, Homo sapiens
uuaaaugcuacuga

SEQ ID NO: 1183725 - RNA, 18 nt, Homo sapiens
uuaaauggcauaccaaaa

SEQ ID NO: 1183726 - RNA, 20 nt, Homo sapiens
uuaaauggugauuucuugcu

SEQ ID NO: 1183727 - RNA, 16 nt, Homo sapiens
uuaaaugugacauucu

SEQ ID NO: 1183728 - RNA, 23 nt, Homo sapiens
uuaaauguuauauacaucucaag

SEQ ID NO: 1183729 - RNA, 21 nt, Homo sapiens
uuaaauuuauuugaaaaugca

SEQ ID NO: 1183730 - RNA, 15 nt, Homo sapiens
uuaaauuucaucuca

SEQ ID NO: 1183731 - RNA, 20 nt, Homo sapiens
uuaacagagcaaauuugaau

SEQ ID NO: 1183732 - RNA, 22 nt, Homo sapiens
uuaacagcgugucaacuuucau

SEQ ID NO: 1183733 - RNA, 20 nt, Homo sapiens
uuaacaugacauuuaccagc

SEQ ID NO: 1183734 - RNA, 13 nt, Homo sapiens
uuaacauguauuc

SEQ ID NO: 1183735 - RNA, 15 nt, Homo sapiens
uuaaccacaauacca

SEQ ID NO: 1183736 - RNA, 17 nt, Homo sapiens
uuaacccauuugucucu

SEQ ID NO: 1183737 - RNA, 10 nt, Homo sapiens
uuaacuauug

SEQ ID NO: 1183738 - RNA, 14 nt, Homo sapiens
uuaacucgcugaug

SEQ ID NO: 1183739 - RNA, 16 nt, Homo sapiens
uuaacugaagcucuaa

SEQ ID NO: 1183740 - RNA, 15 nt, Homo sapiens
uuaacuggugcacuu

SEQ ID NO: 1183741 - RNA, 23 nt, Homo sapiens
uuaacuuuuugccaaauaaaaua

SEQ ID NO: 1183742 - RNA, 14 nt, Homo sapiens
uuaagaauuucaca

SEQ ID NO: 1183743 - RNA, 18 nt, Homo sapiens
uuaagaauuuuuuccuaa

SEQ ID NO: 1183744 - RNA, 23 nt, Homo sapiens
uuaagaggacauaaugggguccu

SEQ ID NO: 1183745 - RNA, 13 nt, Homo sapiens
uuaagauguguag

SEQ ID NO: 1183746 - RNA, 16 nt, Homo sapiens
uuaagauguguagacc

SEQ ID NO: 1183747 - RNA, 22 nt, Homo sapiens
uuaagauuuggucacacucuca

SEQ ID NO: 1183748 - RNA, 15 nt, Homo sapiens
uuaagcaugcuucua

SEQ ID NO: 1183749 - RNA, 18 nt, Homo sapiens
uuaagcuccagacauaca

SEQ ID NO: 1183750 - RNA, 20 nt, Homo sapiens
uuaaggggaacuccauguau

SEQ ID NO: 1183751 - RNA, 19 nt, Homo sapiens
uuaagguaugguacaagca

SEQ ID NO: 1183752 - RNA, 17 nt, Homo sapiens
uuaagguucaagacaga

SEQ ID NO: 1183753 - RNA, 18 nt, Homo sapiens
uuaagguucaagacagau

SEQ ID NO: 1183754 - RNA, 20 nt, Homo sapiens
uuaagucaagaauauaauau

SEQ ID NO: 1183755 - RNA, 20 nt, Homo sapiens
uuaagugcauaaagaauagu

SEQ ID NO: 1183756 - RNA, 13 nt, Homo sapiens
uuaaguggcagaa

SEQ ID NO: 1183757 - RNA, 18 nt, Homo sapiens
uuaaguuaauaaguugau

SEQ ID NO: 1183758 - RNA, 13 nt, Homo sapiens
uuaauaaugugua

SEQ ID NO: 1183759 - RNA, 18 nt, Homo sapiens
uuaauagcuuuugauuag

SEQ ID NO: 1183760 - RNA, 23 nt, Homo sapiens
uuaauauaguugguacacaacua

SEQ ID NO: 1183761 - RNA, 15 nt, Homo sapiens
uuaauaugauucuag

SEQ ID NO: 1183762 - RNA, 20 nt, Homo sapiens
uuaaucacaggaucccacga

SEQ ID NO: 1183763 - RNA, 13 nt, Homo sapiens
uuaaucagcauua

SEQ ID NO: 1183764 - RNA, 13 nt, Homo sapiens
uuaaucaugagcc

SEQ ID NO: 1183765 - RNA, 20 nt, Homo sapiens
uuaaucuccucagacaguaa

SEQ ID NO: 1183766 - RNA, 18 nt, Homo sapiens
uuaaugaagaaaguggaa

SEQ ID NO: 1183767 - RNA, 19 nt, Homo sapiens
uuaaugaaugagucuguug

SEQ ID NO: 1183768 - RNA, 18 nt, Homo sapiens
uuaaugugaccuagcaau

SEQ ID NO: 1183769 - RNA, 12 nt, Homo sapiens
uuaauucuuaag

SEQ ID NO: 1183770 - RNA, 12 nt, Homo sapiens
uuaauucuuaga

SEQ ID NO: 1183771 - RNA, 16 nt, Homo sapiens
uuaauugcugcaagga

SEQ ID NO: 1183772 - RNA, 15 nt, Homo sapiens
uuaauuuucuaugug

SEQ ID NO: 1183773 - RNA, 13 nt, Homo sapiens
uuacaacaaacac

SEQ ID NO: 1183774 - RNA, 12 nt, Homo sapiens
uuacaacuaagu

SEQ ID NO: 1183775 - RNA, 21 nt, Homo sapiens
uuacaagauguauuuguugua

SEQ ID NO: 1183776 - RNA, 11 nt, Homo sapiens
uuacaagcccc

SEQ ID NO: 1183777 - RNA, 22 nt, Homo sapiens
uuacaagcugaguaaaauuccu

SEQ ID NO: 1183778 - RNA, 22 nt, Homo sapiens
uuacaaggcaggccuuuccuac

SEQ ID NO: 1183779 - RNA, 21 nt, Homo sapiens
uuacacuggaagaagagcccc

SEQ ID NO: 1183780 - RNA, 19 nt, Homo sapiens
uuacaggaaagaugcauuu

SEQ ID NO: 1183781 - RNA, 14 nt, Homo sapiens
uuacaggcaugugc

SEQ ID NO: 1183782 - RNA, 17 nt, Homo sapiens
uuacaggcgugagccac

SEQ ID NO: 1183783 - RNA, 15 nt, Homo sapiens
uuacaguaacuguaa

SEQ ID NO: 1183784 - RNA, 12 nt, Homo sapiens
uuacaguuuaca

SEQ ID NO: 1183785 - RNA, 15 nt, Homo sapiens
uuacauacagugaua

SEQ ID NO: 1183786 - RNA, 18 nt, Homo sapiens
uuacauacaugcuuugaa

SEQ ID NO: 1183787 - RNA, 22 nt, Homo sapiens
uuacauauguuaauaaacugca

SEQ ID NO: 1183788 - RNA, 21 nt, Homo sapiens
uuacaucccagacacauucac

SEQ ID NO: 1183789 - RNA, 22 nt, Homo sapiens
uuacauuaaaauaaaccaaaua

SEQ ID NO: 1183790 - RNA, 10 nt, Homo sapiens
uuacauuguu

SEQ ID NO: 1183791 - RNA, 20 nt, Homo sapiens
uuacauuuuaggacacugcg

SEQ ID NO: 1183792 - RNA, 17 nt, Homo sapiens
uuaccaaacagcaaacc

SEQ ID NO: 1183793 - RNA, 17 nt, Homo sapiens
uuaccagaagcuuccau

SEQ ID NO: 1183794 - RNA, 21 nt, Homo sapiens
uuaccagcaacuugaacuuca

SEQ ID NO: 1183795 - RNA, 20 nt, Homo sapiens
uuaccagguccauuuugccu

SEQ ID NO: 1183796 - RNA, 20 nt, Homo sapiens
uuaccauacacgcaacuaua

SEQ ID NO: 1183797 - RNA, 17 nt, Homo sapiens
uuacccuaguucucuua

SEQ ID NO: 1183798 - RNA, 16 nt, Homo sapiens
uuaccuauguaacaaa

SEQ ID NO: 1183799 - RNA, 22 nt, Homo sapiens
uuaccuucauggugcuguugcc

SEQ ID NO: 1183800 - RNA, 21 nt, Homo sapiens
uuaccuuguuauuuaacccau

SEQ ID NO: 1183801 - RNA, 22 nt, Homo sapiens
uuaccuuguuauuuaacccauu

SEQ ID NO: 1183802 - RNA, 22 nt, Homo sapiens
uuaccuuuuauuuuaauguuuc

SEQ ID NO: 1183803 - RNA, 16 nt, Homo sapiens
uuacgcucaucaccua

SEQ ID NO: 1183804 - RNA, 21 nt, Homo sapiens
uuacuaaauaucauaaucuga

SEQ ID NO: 1183805 - RNA, 16 nt, Homo sapiens
uuacuauucccacuuu

SEQ ID NO: 1183806 - RNA, 14 nt, Homo sapiens
uuacuauugcucuu

SEQ ID NO: 1183807 - RNA, 22 nt, Homo sapiens
uuacuauugcucuuacuugaaa

SEQ ID NO: 1183808 - RNA, 11 nt, Homo sapiens
uuacucugaag

SEQ ID NO: 1183809 - RNA, 14 nt, Homo sapiens
uuacugaacugugu

SEQ ID NO: 1183810 - RNA, 13 nt, Homo sapiens
uuacugagacaau

SEQ ID NO: 1183811 - RNA, 13 nt, Homo sapiens
uuacugucucucu

SEQ ID NO: 1183812 - RNA, 16 nt, Homo sapiens
uuacuguggcugucug

SEQ ID NO: 1183813 - RNA, 21 nt, Homo sapiens
uuacuuauaaaauacaucuca

SEQ ID NO: 1183814 - RNA, 14 nt, Homo sapiens
uuacuugcauuuau

SEQ ID NO: 1183815 - RNA, 23 nt, Homo sapiens
uuacuuuaaugauuauaaucaua

SEQ ID NO: 1183816 - RNA, 19 nt, Homo sapiens
uuacuuuagaagcacagua

SEQ ID NO: 1183817 - RNA, 21 nt, Homo sapiens
uuacuuuagguggagaaucca

SEQ ID NO: 1183818 - RNA, 23 nt, Homo sapiens
uuacuuuuuccuggcucaucucu

SEQ ID NO: 1183819 - RNA, 19 nt, Homo sapiens
uuagaaacucaaaaacuga

SEQ ID NO: 1183820 - RNA, 18 nt, Homo sapiens
uuagaaguagaauugaca

SEQ ID NO: 1183821 - RNA, 16 nt, Homo sapiens
uuagaauaucuagcau

SEQ ID NO: 1183822 - RNA, 15 nt, Homo sapiens
uuagaaugcaucuca

SEQ ID NO: 1183823 - RNA, 15 nt, Homo sapiens
uuagaauuauaucac

SEQ ID NO: 1183824 - RNA, 14 nt, Homo sapiens
uugaugcaugcacu

SEQ ID NO: 1183825 - RNA, 14 nt, Homo sapiens
uugaugcgacugua

SEQ ID NO: 1183826 - RNA, 15 nt, Homo sapiens
uugauguauuuagcu

SEQ ID NO: 1183827 - RNA, 21 nt, Homo sapiens
uugauuucccugggagcuguu

SEQ ID NO: 1183828 - RNA, 19 nt, Homo sapiens
uugauuuuaauccuguaua

SEQ ID NO: 1183829 - RNA, 14 nt, Homo sapiens
uugauuuuugccca

SEQ ID NO: 1183830 - RNA, 16 nt, Homo sapiens
uugauuuuuugcccag

SEQ ID NO: 1183831 - RNA, 15 nt, Homo sapiens
uugcaaaguacugua

SEQ ID NO: 1183832 - RNA, 16 nt, Homo sapiens
uugcaaauaagacucu

SEQ ID NO: 1183833 - RNA, 24 nt, Homo sapiens
uugcaaccuaccuguugagcauca

SEQ ID NO: 1183834 - RNA, 18 nt, Homo sapiens
uugcaauaguuaccucaa

SEQ ID NO: 1183835 - RNA, 17 nt, Homo sapiens
uuguaagugagugugcu

SEQ ID NO: 1183836 - RNA, 15 nt, Homo sapiens
uuguaaugaauuccu

SEQ ID NO: 1183837 - RNA, 16 nt, Homo sapiens
uuguaaugucaccacc

SEQ ID NO: 1183838 - RNA, 13 nt, Homo sapiens
uuguacauuucac

SEQ ID NO: 1183839 - RNA, 22 nt, Homo sapiens
uuguaccuuccacaagacucag

SEQ ID NO: 1183840 - RNA, 19 nt, Homo sapiens
uuguagaguggugcugcuu

SEQ ID NO: 1183841 - RNA, 19 nt, Homo sapiens
uuguagccacaagccugaa

SEQ ID NO: 1183842 - RNA, 11 nt, Homo sapiens
uuguagcuuuu

SEQ ID NO: 1183843 - RNA, 18 nt, Homo sapiens
uuguaggagaaacuccca

SEQ ID NO: 1183844 - RNA, 22 nt, Homo sapiens
uuguaguauuuugggagcaaaa

SEQ ID NO: 1183845 - RNA, 20 nt, Homo sapiens
uuguaguuuuggcuaguccu

SEQ ID NO: 1183846 - RNA, 14 nt, Homo sapiens
uuguauccuugaug

SEQ ID NO: 1183847 - RNA, 21 nt, Homo sapiens
uuguauguuuucuguaaggaa

SEQ ID NO: 1183848 - RNA, 21 nt, Homo sapiens
uugucaagccugugcaaaaaa

SEQ ID NO: 1183849 - RNA, 15 nt, Homo sapiens
uugucagcaguuccc

SEQ ID NO: 1183850 - RNA, 15 nt, Homo sapiens
uugucagcaucugac

SEQ ID NO: 1183851 - RNA, 16 nt, Homo sapiens
uugucagccaccuccc

SEQ ID NO: 1183852 - RNA, 14 nt, Homo sapiens
uugucauccuuuga

SEQ ID NO: 1183853 - RNA, 14 nt, Homo sapiens
uugucccucugccc

SEQ ID NO: 1183854 - RNA, 23 nt, Homo sapiens
uugucuacauuaaaucacuugaa

SEQ ID NO: 1183855 - RNA, 17 nt, Homo sapiens
uugucugagucuugggu

SEQ ID NO: 1183856 - RNA, 20 nt, Homo sapiens
uugucuguuaucgaacacau

SEQ ID NO: 1183857 - RNA, 16 nt, Homo sapiens
uugucuuuacuccaug

SEQ ID NO: 1183858 - RNA, 17 nt, Homo sapiens
uugugauguuugcucag

SEQ ID NO: 1183859 - RNA, 12 nt, Homo sapiens
uugugauugccu

SEQ ID NO: 1183860 - RNA, 16 nt, Homo sapiens
uugugccgacacuguu

SEQ ID NO: 1183861 - RNA, 17 nt, Homo sapiens
uuguguaauaugaaaua

SEQ ID NO: 1183862 - RNA, 16 nt, Homo sapiens
uugugucaguuucaga

SEQ ID NO: 1183863 - RNA, 16 nt, Homo sapiens
uugugugguggcaccu

SEQ ID NO: 1183864 - RNA, 22 nt, Homo sapiens
uuguguuuguagucuugucuua

SEQ ID NO: 1183865 - RNA, 22 nt, Homo sapiens
uuguuaauaacuaauaacugga

SEQ ID NO: 1183866 - RNA, 16 nt, Homo sapiens
uuguuaaugagauaaa

SEQ ID NO: 1183867 - RNA, 12 nt, Homo sapiens
uuguuacuuuga

SEQ ID NO: 1183868 - RNA, 21 nt, Homo sapiens
uuguucccauuggaugcauuu

SEQ ID NO: 1183869 - RNA, 21 nt, Homo sapiens
uuguucguauuuagaauggga

SEQ ID NO: 1183870 - RNA, 22 nt, Homo sapiens
uuguucugacuuuuuguuucuu

SEQ ID NO: 1183871 - RNA, 12 nt, Homo sapiens
uuguucuuguug

SEQ ID NO: 1183872 - RNA, 20 nt, Homo sapiens
uuguucuuuggaaauacaca

SEQ ID NO: 1183873 - RNA, 18 nt, Homo sapiens
uuguugccuucaucuuca

SEQ ID NO: 1183874 - RNA, 15 nt, Homo sapiens
uuguuuagaaagaau

SEQ ID NO: 1183875 - RNA, 21 nt, Homo sapiens
uuguuuuaaaauuaaagcuaa

SEQ ID NO: 1183876 - RNA, 18 nt, Homo sapiens
uuguuuuaacagaugcca

SEQ ID NO: 1183877 - RNA, 22 nt, Homo sapiens
uuuaaaaaaaacaauuccacac

SEQ ID NO: 1183878 - RNA, 19 nt, Homo sapiens
uuuaaaaaauauuuucucu

SEQ ID NO: 1183879 - RNA, 15 nt, Homo sapiens
uuuaaaaacauuuuc

SEQ ID NO: 1183880 - RNA, 13 nt, Homo sapiens
uuuaaaaagcagg

SEQ ID NO: 1183881 - RNA, 18 nt, Homo sapiens
uuuaaaaauaguugcugu

SEQ ID NO: 1183882 - RNA, 15 nt, Homo sapiens
uuuaaaacaugcugu

SEQ ID NO: 1183883 - RNA, 12 nt, Homo sapiens
uuuaaaaccacu

SEQ ID NO: 1183884 - RNA, 15 nt, Homo sapiens
uuuaaaaccacuaug

SEQ ID NO: 1183885 - RNA, 17 nt, Homo sapiens
uuuaaaagacuuugaug

SEQ ID NO: 1183886 - RNA, 15 nt, Homo sapiens
uuuaaaagcuucuca

SEQ ID NO: 1183887 - RNA, 14 nt, Homo sapiens
uuuaaaauaucugu

SEQ ID NO: 1183888 - RNA, 15 nt, Homo sapiens
uuuaaaauaugcucu

SEQ ID NO: 1183889 - RNA, 14 nt, Homo sapiens
uuuaaaaucuguca

SEQ ID NO: 1183890 - RNA, 16 nt, Homo sapiens
uuuaaaauuacauucu

SEQ ID NO: 1183891 - RNA, 16 nt, Homo sapiens
uuuaaacaaaagugua

SEQ ID NO: 1183892 - RNA, 23 nt, Homo sapiens
uuuaaagaaaaugugucugcaac

SEQ ID NO: 1183893 - RNA, 19 nt, Homo sapiens
uuuaaagaauucucuugcu

SEQ ID NO: 1183894 - RNA, 17 nt, Homo sapiens
uuuaaagacaaagacau

SEQ ID NO: 1183895 - RNA, 22 nt, Homo sapiens
uuuaaagacaaagacauuauuu

SEQ ID NO: 1183896 - RNA, 16 nt, Homo sapiens
uuuaaaguuguuugcu

SEQ ID NO: 1183897 - RNA, 18 nt, Homo sapiens
uuuaaauauaugcuaagu

SEQ ID NO: 1183898 - RNA, 15 nt, Homo sapiens
uuuaaauccuuccau

SEQ ID NO: 1183899 - RNA, 12 nt, Homo sapiens
uuuaaaucugag

SEQ ID NO: 1183900 - RNA, 15 nt, Homo sapiens
uuuaaauugauagca

SEQ ID NO: 1183901 - RNA, 18 nt, Homo sapiens
uuuaaauugauagcagau

SEQ ID NO: 1183902 - RNA, 18 nt, Homo sapiens
uuuaacuggcuucagccu

SEQ ID NO: 1183903 - RNA, 23 nt, Homo sapiens
uuuaagaaauaaauuuauuucaa

SEQ ID NO: 1183904 - RNA, 16 nt, Homo sapiens
uuuaagauaaacagaa

SEQ ID NO: 1183905 - RNA, 16 nt, Homo sapiens
uuuaagauaccuugau

SEQ ID NO: 1183906 - RNA, 17 nt, Homo sapiens
uuuaagccgaagggcaa

SEQ ID NO: 1183907 - RNA, 23 nt, Homo sapiens
uuuaagccgaagggcaauaucua

SEQ ID NO: 1183908 - RNA, 18 nt, Homo sapiens
uuuaagccugcauucuua

SEQ ID NO: 1183909 - RNA, 15 nt, Homo sapiens
uuuaagcgauucucu

SEQ ID NO: 1183910 - RNA, 23 nt, Homo sapiens
uuuaaggcagcaacaagaaaaga

SEQ ID NO: 1183911 - RNA, 12 nt, Homo sapiens
uuuaaggcuaaa

SEQ ID NO: 1183912 - RNA, 13 nt, Homo sapiens
uuuaaguaggaau

SEQ ID NO: 1183913 - RNA, 21 nt, Homo sapiens
uuuaagugaaaaaagcaaaua

SEQ ID NO: 1183914 - RNA, 16 nt, Homo sapiens
uuuaaguuguuugcau

SEQ ID NO: 1183915 - RNA, 21 nt, Homo sapiens
uuuaauagggaauauaucucu

SEQ ID NO: 1183916 - RNA, 21 nt, Homo sapiens
uuuaauaggugcagucuuuga

SEQ ID NO: 1183917 - RNA, 19 nt, Homo sapiens
uuuaauggcccccaaaauc

SEQ ID NO: 1183918 - RNA, 16 nt, Homo sapiens
uuuaauguuuccuuua

SEQ ID NO: 1183919 - RNA, 17 nt, Homo sapiens
uuuaauguuuccuuuaa

SEQ ID NO: 1183920 - RNA, 23 nt, Homo sapiens
uuuaauguuuucagcccaucucc

SEQ ID NO: 1183921 - RNA, 14 nt, Homo sapiens
uuuaauuaugccuu

SEQ ID NO: 1183922 - RNA, 15 nt, Homo sapiens
uuuaauuaugccuuu

SEQ ID NO: 1183923 - RNA, 14 nt, Homo sapiens
uuuaauuuugagau

SEQ ID NO: 1183924 - RNA, 13 nt, Homo sapiens
uuuacaaaggggg

SEQ ID NO: 1183925 - RNA, 14 nt, Homo sapiens
uuuacagaauuuua

SEQ ID NO: 1183926 - RNA, 14 nt, Homo sapiens
uuuacagcuuuguu

SEQ ID NO: 1183927 - RNA, 14 nt, Homo sapiens
uuuacaggcaaaga

SEQ ID NO: 1183928 - RNA, 16 nt, Homo sapiens
uuuacaggcacccacc

SEQ ID NO: 1183929 - RNA, 21 nt, Homo sapiens
uuuacauacugcugucuaugu

SEQ ID NO: 1183930 - RNA, 23 nt, Homo sapiens
uuuacaugggccucugauggaag

SEQ ID NO: 1183931 - RNA, 15 nt, Homo sapiens
uuuaccaacauguau

SEQ ID NO: 1183932 - RNA, 17 nt, Homo sapiens
uuuaccuuauguuuaau

SEQ ID NO: 1183933 - RNA, 20 nt, Homo sapiens
uuuacgaucuguuuccaaau

SEQ ID NO: 1183934 - RNA, 20 nt, Homo sapiens
uuuacuaauccaacccauga

SEQ ID NO: 1183935 - RNA, 22 nt, Homo sapiens
uuuacuuauaaaauacaucuca

SEQ ID NO: 1183936 - RNA, 18 nt, Homo sapiens
uuuagaaaucacaacaaa

SEQ ID NO: 1183937 - RNA, 17 nt, Homo sapiens
uuuagacuguagauuau

SEQ ID NO: 1183938 - RNA, 17 nt, Homo sapiens
uuuagcaauguguuucu

SEQ ID NO: 1183939 - RNA, 13 nt, Homo sapiens
uuuagugauuuga

SEQ ID NO: 1183940 - RNA, 19 nt, Homo sapiens
uuuauaaaucuuaugcucu

SEQ ID NO: 1183941 - RNA, 17 nt, Homo sapiens
uuuauaaccugaugcca

SEQ ID NO: 1183942 - RNA, 18 nt, Homo sapiens
uuuauacuaggacuccuu

SEQ ID NO: 1183943 - RNA, 15 nt, Homo sapiens
uuuauacuguuuacu

SEQ ID NO: 1183944 - RNA, 23 nt, Homo sapiens
uuuauaguacuaguuuugcuuua

SEQ ID NO: 1183945 - RNA, 16 nt, Homo sapiens
uuuauaucacaauuua

SEQ ID NO: 1183946 - RNA, 17 nt, Homo sapiens
uuuauauguacaugaga

SEQ ID NO: 1183947 - RNA, 16 nt, Homo sapiens
uuuauauuugugugag

SEQ ID NO: 1183948 - RNA, 18 nt, Homo sapiens
uuuaucaccucauucuga

SEQ ID NO: 1183949 - RNA, 16 nt, Homo sapiens
uuuaucauuaccauua

SEQ ID NO: 1183950 - RNA, 14 nt, Homo sapiens
uuuaucccauggaa

SEQ ID NO: 1183951 - RNA, 18 nt, Homo sapiens
uuuaucuguuuccugaca

SEQ ID NO: 1183952 - RNA, 19 nt, Homo sapiens
uuuaugagaacugguucuu

SEQ ID NO: 1183953 - RNA, 14 nt, Homo sapiens
uuuaugagguugau

SEQ ID NO: 1183954 - RNA, 23 nt, Homo sapiens
uuuaugaugcuaugguuugccau

SEQ ID NO: 1183955 - RNA, 20 nt, Homo sapiens
uuuauguaacauaguccaga

SEQ ID NO: 1183956 - RNA, 15 nt, Homo sapiens
uuuauucaaacuacc

SEQ ID NO: 1183957 - RNA, 15 nt, Homo sapiens
uuuauucaccaucau

SEQ ID NO: 1183958 - RNA, 14 nt, Homo sapiens
uuuauuccuguaug

SEQ ID NO: 1183959 - RNA, 21 nt, Homo sapiens
uuuauucuaugugcacacuua

SEQ ID NO: 1183960 - RNA, 15 nt, Homo sapiens
uuuauuucugaucua

SEQ ID NO: 1183961 - RNA, 14 nt, Homo sapiens
uuuauuuuugacug

SEQ ID NO: 1183962 - RNA, 11 nt, Homo sapiens
uuucaaaacau

SEQ ID NO: 1183963 - RNA, 14 nt, Homo sapiens
uuucaaaacauaca

SEQ ID NO: 1183964 - RNA, 13 nt, Homo sapiens
uuucaaacacaaa

SEQ ID NO: 1183965 - RNA, 21 nt, Homo sapiens
uuucaaaugugucaaauacaa

SEQ ID NO: 1183966 - RNA, 18 nt, Homo sapiens
uuucaaauuggagcuuca

SEQ ID NO: 1183967 - RNA, 13 nt, Homo sapiens
uuucaaauuuacu

SEQ ID NO: 1183968 - RNA, 13 nt, Homo sapiens
uuucaacuugcau

SEQ ID NO: 1183969 - RNA, 12 nt, Homo sapiens
uuucaauugcau

SEQ ID NO: 1183970 - RNA, 11 nt, Homo sapiens
uuucacaagcu

SEQ ID NO: 1183971 - RNA, 14 nt, Homo sapiens
uuucacugcugcuc

SEQ ID NO: 1183972 - RNA, 19 nt, Homo sapiens
uuucacuuaauaaugugua

SEQ ID NO: 1183973 - RNA, 17 nt, Homo sapiens
uuucagaaaauucccau

SEQ ID NO: 1183974 - RNA, 19 nt, Homo sapiens
uuucagaugugaaccauua

SEQ ID NO: 1183975 - RNA, 19 nt, Homo sapiens
uuucagcaaaacuuuccaa

SEQ ID NO: 1183976 - RNA, 16 nt, Homo sapiens
uuucaggcaagcuuau

SEQ ID NO: 1183977 - RNA, 23 nt, Homo sapiens
uuucaggggcgggugcauuguag

SEQ ID NO: 1183978 - RNA, 15 nt, Homo sapiens
uuucaguuuauuuga

SEQ ID NO: 1183979 - RNA, 18 nt, Homo sapiens
uuucauaaagucuugccu

SEQ ID NO: 1183980 - RNA, 18 nt, Homo sapiens
uuucauaaugcagaagua

SEQ ID NO: 1183981 - RNA, 12 nt, Homo sapiens
uuucauaguuuc

SEQ ID NO: 1183982 - RNA, 20 nt, Homo sapiens
uuucaucugggaaagacauc

SEQ ID NO: 1183983 - RNA, 16 nt, Homo sapiens
uuucaucuuuguggau

SEQ ID NO: 1183984 - RNA, 17 nt, Homo sapiens
uuucaugcccuugccua

SEQ ID NO: 1183985 - RNA, 18 nt, Homo sapiens
uuucaugugcuauagaca

SEQ ID NO: 1183986 - RNA, 14 nt, Homo sapiens
uuucauuacaagua

SEQ ID NO: 1183987 - RNA, 21 nt, Homo sapiens
uuuggauuuacgacugaagaa

SEQ ID NO: 1183988 - RNA, 21 nt, Homo sapiens
uuuggcaaacucuccaccaca

SEQ ID NO: 1183989 - RNA, 23 nt, Homo sapiens
uuuggccaguagcuaaagugcaa

SEQ ID NO: 1183990 - RNA, 23 nt, Homo sapiens
uuuggcgaccuccuuucaucaca

SEQ ID NO: 1183991 - RNA, 18 nt, Homo sapiens
uuuggcuagguaucauuc

SEQ ID NO: 1183992 - RNA, 19 nt, Homo sapiens
uuugggggaaaauggcacu

SEQ ID NO: 1183993 - RNA, 21 nt, Homo sapiens
uuuggucaaguaguuugacuc

SEQ ID NO: 1183994 - RNA, 16 nt, Homo sapiens
uuuggucauagcauuc

SEQ ID NO: 1183995 - RNA, 13 nt, Homo sapiens
uuuggugacuuca

SEQ ID NO: 1183996 - RNA, 14 nt, Homo sapiens
uuuggugacuucac

SEQ ID NO: 1183997 - RNA, 11 nt, Homo sapiens
uuugguuuugc

SEQ ID NO: 1183998 - RNA, 19 nt, Homo sapiens
uuuguaaaagcuugaugaa

SEQ ID NO: 1183999 - RNA, 16 nt, Homo sapiens
uuuguaaaggauauca

SEQ ID NO: 1184000 - RNA, 10 nt, Homo sapiens
uuuguacugg

SEQ ID NO: 1184001 - RNA, 21 nt, Homo sapiens
uuuguagaaugaaccacugcc

SEQ ID NO: 1184002 - RNA, 19 nt, Homo sapiens
uuuguauaccaugaugcau

SEQ ID NO: 1184003 - RNA, 23 nt, Homo sapiens
uuugucagaggcacaaaaggguu

SEQ ID NO: 1184004 - RNA, 20 nt, Homo sapiens
uuugucagcaucugaccauc

SEQ ID NO: 1184005 - RNA, 15 nt, Homo sapiens
uuugugcucuacugu

SEQ ID NO: 1184006 - RNA, 14 nt, Homo sapiens
uuuguuguauggaa

SEQ ID NO: 1184007 - RNA, 22 nt, Homo sapiens
uuuuaaaaaaagaaaacuuuaa

SEQ ID NO: 1184008 - RNA, 22 nt, Homo sapiens
uuuuaaaaagcaaaucuuucug

SEQ ID NO: 1184009 - RNA, 13 nt, Homo sapiens
uuuuaaacauucu

SEQ ID NO: 1184010 - RNA, 21 nt, Homo sapiens
uuuuaaagaaaaugugucugc

SEQ ID NO: 1184011 - RNA, 14 nt, Homo sapiens
uuuuaaauucuuac

SEQ ID NO: 1184012 - RNA, 13 nt, Homo sapiens
uuuuaacauguau

SEQ ID NO: 1184013 - RNA, 15 nt, Homo sapiens
acgccgcccuaaaag

SEQ ID NO: 1184014 - RNA, 21 nt, Homo sapiens
acgccuguaaucccagcacuu

SEQ ID NO: 1184015 - RNA, 22 nt, Homo sapiens
acgcgcagaugugcagcagauu

SEQ ID NO: 1184016 - RNA, 19 nt, Homo sapiens
acgcugccucaacacugaa

SEQ ID NO: 1184017 - RNA, 14 nt, Homo sapiens
acgcuuucaugaau

SEQ ID NO: 1184018 - RNA, 19 nt, Homo sapiens
acgcuuuucuuuguuauac

SEQ ID NO: 1184019 - RNA, 14 nt, Homo sapiens
acggacauggucug

SEQ ID NO: 1184020 - RNA, 19 nt, Homo sapiens
acggacuuacaaccuuguc

SEQ ID NO: 1184021 - RNA, 22 nt, Homo sapiens
acggagccacuccucugacuca

SEQ ID NO: 1184022 - RNA, 12 nt, Homo sapiens
acggagggauug

SEQ ID NO: 1184023 - RNA, 12 nt, Homo sapiens
acggccaugaga

SEQ ID NO: 1184024 - RNA, 23 nt, Homo sapiens
acgggagugacccagcuacugaa

SEQ ID NO: 1184025 - RNA, 21 nt, Homo sapiens
acgggggccgcguggugccau

SEQ ID NO: 1184026 - RNA, 18 nt, Homo sapiens
acggucagggucagggcc

SEQ ID NO: 1184027 - RNA, 20 nt, Homo sapiens
acggugucuuguucugucac

SEQ ID NO: 1184028 - RNA, 21 nt, Homo sapiens
acgguuaagaaagcacuuaaa

SEQ ID NO: 1184029 - RNA, 20 nt, Homo sapiens
acgguuucgaagucauuaaa

SEQ ID NO: 1184030 - RNA, 14 nt, Homo sapiens
acguaagcacuguu

SEQ ID NO: 1184031 - RNA, 15 nt, Homo sapiens
acguaagcacuguuu

SEQ ID NO: 1184032 - RNA, 20 nt, Homo sapiens
acgucaaagaggcuccagaa

SEQ ID NO: 1184033 - RNA, 14 nt, Homo sapiens
acgucacaaagacc

SEQ ID NO: 1184034 - RNA, 14 nt, Homo sapiens
acgucacugcacuc

SEQ ID NO: 1184035 - RNA, 14 nt, Homo sapiens
acgucacuucaugc

SEQ ID NO: 1184036 - RNA, 21 nt, Homo sapiens
acgucacuucaugcaggugaa

SEQ ID NO: 1184037 - RNA, 18 nt, Homo sapiens
acgucagcugggacaccc

SEQ ID NO: 1184038 - RNA, 16 nt, Homo sapiens
acgucauuacaagcug

SEQ ID NO: 1184039 - RNA, 20 nt, Homo sapiens
acguccacgcggccaccuca

SEQ ID NO: 1184040 - RNA, 18 nt, Homo sapiens
acguccagcucguucucu

SEQ ID NO: 1184041 - RNA, 15 nt, Homo sapiens
acgucucaagacuga

SEQ ID NO: 1184042 - RNA, 19 nt, Homo sapiens
acgucuccuagccaaucag

SEQ ID NO: 1184043 - RNA, 23 nt, Homo sapiens
acgugaaauacuucgaugaugau

SEQ ID NO: 1184044 - RNA, 18 nt, Homo sapiens
acguggaugaagcagaga

SEQ ID NO: 1184045 - RNA, 15 nt, Homo sapiens
acguggguugcacug

SEQ ID NO: 1184046 - RNA, 16 nt, Homo sapiens
acgugugcaguuguag

SEQ ID NO: 1184047 - RNA, 18 nt, Homo sapiens
acguucugcaaaacauuu

SEQ ID NO: 1184048 - RNA, 13 nt, Homo sapiens
acguuuaacacaa

SEQ ID NO: 1184049 - RNA, 14 nt, Homo sapiens
acuaaaaacaaacc

SEQ ID NO: 1184050 - RNA, 18 nt, Homo sapiens
acuaaacacgugacacaa

SEQ ID NO: 1184051 - RNA, 16 nt, Homo sapiens
acuaaaggcuccugga

SEQ ID NO: 1184052 - RNA, 12 nt, Homo sapiens
acuaaaugagac

SEQ ID NO: 1184053 - RNA, 12 nt, Homo sapiens
acuaagccagga

SEQ ID NO: 1184054 - RNA, 22 nt, Homo sapiens
acuaaggaguaaucuguguaca

SEQ ID NO: 1184055 - RNA, 15 nt, Homo sapiens
acuaaggugcuaaau

SEQ ID NO: 1184056 - RNA, 19 nt, Homo sapiens
acuaaggugcuaaaucugc

SEQ ID NO: 1184057 - RNA, 15 nt, Homo sapiens
acuaaguuauuguua

SEQ ID NO: 1184058 - RNA, 21 nt, Homo sapiens
acuaaguucucauuguucaaa

SEQ ID NO: 1184059 - RNA, 16 nt, Homo sapiens
acuaauccucucugca

SEQ ID NO: 1184060 - RNA, 17 nt, Homo sapiens
acuaauccucucugcaa

SEQ ID NO: 1184061 - RNA, 12 nt, Homo sapiens
acuaauccuuac

SEQ ID NO: 1184062 - RNA, 23 nt, Homo sapiens
acuaauguuagaauugauuucca

SEQ ID NO: 1184063 - RNA, 13 nt, Homo sapiens
acuacaacauaug

SEQ ID NO: 1184064 - RNA, 18 nt, Homo sapiens
acuacaagugauccucag

SEQ ID NO: 1184065 - RNA, 15 nt, Homo sapiens
acuacagcuaugaag

SEQ ID NO: 1184066 - RNA, 20 nt, Homo sapiens
acuacauaccucaucucuug

SEQ ID NO: 1184067 - RNA, 19 nt, Homo sapiens
acuaccagugggcauguau

SEQ ID NO: 1184068 - RNA, 23 nt, Homo sapiens
acuaccauuccuucuuuaaacac

SEQ ID NO: 1184069 - RNA, 18 nt, Homo sapiens
acuaccauugcuguucua

SEQ ID NO: 1184070 - RNA, 21 nt, Homo sapiens
acuaccauugcuguucuacuu

SEQ ID NO: 1184071 - RNA, 20 nt, Homo sapiens
acuaccucgcaucauugcag

SEQ ID NO: 1184072 - RNA, 23 nt, Homo sapiens
acuaccuugguucccccacugau

SEQ ID NO: 1184073 - RNA, 17 nt, Homo sapiens
acuacuaaugacuuugu

SEQ ID NO: 1184074 - RNA, 14 nt, Homo sapiens
acuacuauauugau

SEQ ID NO: 1184075 - RNA, 15 nt, Homo sapiens
acuacuuaauuacuu

SEQ ID NO: 1184076 - RNA, 14 nt, Homo sapiens
acuacuuagcacug

SEQ ID NO: 1184077 - RNA, 19 nt, Homo sapiens
acuagagugcucugacccu

SEQ ID NO: 1184078 - RNA, 15 nt, Homo sapiens
acuagaugaccucau

SEQ ID NO: 1184079 - RNA, 15 nt, Homo sapiens
acuagggagccaugu

SEQ ID NO: 1184080 - RNA, 16 nt, Homo sapiens
acuagggagccauuug

SEQ ID NO: 1184081 - RNA, 15 nt, Homo sapiens
acuagggaucccuca

SEQ ID NO: 1184082 - RNA, 18 nt, Homo sapiens
acuagggcacaucuggau

SEQ ID NO: 1184083 - RNA, 15 nt, Homo sapiens
acuaggggagggggu

SEQ ID NO: 1184084 - RNA, 16 nt, Homo sapiens
acuaguaaacaugugg

SEQ ID NO: 1184085 - RNA, 20 nt, Homo sapiens
acuaguauggccagcagaca

SEQ ID NO: 1184086 - RNA, 17 nt, Homo sapiens
acuaucaaaauugccuu

SEQ ID NO: 1184087 - RNA, 12 nt, Homo sapiens
acuaugacaaau

SEQ ID NO: 1184088 - RNA, 15 nt, Homo sapiens
acuauguaacaugua

SEQ ID NO: 1184089 - RNA, 20 nt, Homo sapiens
acuauugagugaaacauuga

SEQ ID NO: 1184090 - RNA, 14 nt, Homo sapiens
acuauuuuugcaca

SEQ ID NO: 1184091 - RNA, 21 nt, Homo sapiens
acucaaaugcucagaccagcu

SEQ ID NO: 1184092 - RNA, 17 nt, Homo sapiens
acucaaauggggccaga

SEQ ID NO: 1184093 - RNA, 19 nt, Homo sapiens
acucaaauggggccagauc

SEQ ID NO: 1184094 - RNA, 15 nt, Homo sapiens
acucaacaccagacc

SEQ ID NO: 1184095 - RNA, 12 nt, Homo sapiens
acucaaccaaau

SEQ ID NO: 1184096 - RNA, 19 nt, Homo sapiens
acucaagccaagcagccaa

SEQ ID NO: 1184097 - RNA, 18 nt, Homo sapiens
acucaaguuuuuacaaaa

SEQ ID NO: 1184098 - RNA, 21 nt, Homo sapiens
acucaaguuuuuacaaaauac

SEQ ID NO: 1184099 - RNA, 23 nt, Homo sapiens
acucacaacacuuaacagggaac

SEQ ID NO: 1184100 - RNA, 12 nt, Homo sapiens
acucacccaagc

SEQ ID NO: 1184101 - RNA, 20 nt, Homo sapiens
acucacccuuccuggcccag

SEQ ID NO: 1184102 - RNA, 12 nt, Homo sapiens
acucaccuugug

SEQ ID NO: 1184103 - RNA, 23 nt, Homo sapiens
acucacugaggguaucugacaau

SEQ ID NO: 1184104 - RNA, 11 nt, Homo sapiens
acucacuucau

SEQ ID NO: 1184105 - RNA, 17 nt, Homo sapiens
acucacuucucuuuuua

SEQ ID NO: 1184106 - RNA, 21 nt, Homo sapiens
acucagagaaaagagauugag

SEQ ID NO: 1184107 - RNA, 15 nt, Homo sapiens
acucagagacuucac

SEQ ID NO: 1184108 - RNA, 18 nt, Homo sapiens
acucagaggcagugacag

SEQ ID NO: 1184109 - RNA, 18 nt, Homo sapiens
acucagauggaaccgcag

SEQ ID NO: 1184110 - RNA, 20 nt, Homo sapiens
acucagccgcagacaaguaa

SEQ ID NO: 1184111 - RNA, 20 nt, Homo sapiens
aaacaagaaaccaagugggc

SEQ ID NO: 1184112 - RNA, 21 nt, Homo sapiens
aaacaagacuccucaucauga

SEQ ID NO: 1184113 - RNA, 15 nt, Homo sapiens
aaacaauaugcuccu

SEQ ID NO: 1184114 - RNA, 12 nt, Homo sapiens
aaacaauuccac

SEQ ID NO: 1184115 - RNA, 22 nt, Homo sapiens
aaacaauuugacuuuuguucca

SEQ ID NO: 1184116 - RNA, 16 nt, Homo sapiens
aaacacagacauucug

SEQ ID NO: 1184117 - RNA, 19 nt, Homo sapiens
aaacacagacauucugcca

SEQ ID NO: 1184118 - RNA, 12 nt, Homo sapiens
aaacacugccuu

SEQ ID NO: 1184119 - RNA, 22 nt, Homo sapiens
aaacagaaaaaaaaauggaagc

SEQ ID NO: 1184120 - RNA, 20 nt, Homo sapiens
aaacagauauuacagcuuau

SEQ ID NO: 1184121 - RNA, 19 nt, Homo sapiens
aaacagccuuugggaaaug

SEQ ID NO: 1184122 - RNA, 21 nt, Homo sapiens
aaacagcgagagggagaccca

SEQ ID NO: 1184123 - RNA, 18 nt, Homo sapiens
aaacagcugccaccauca

SEQ ID NO: 1184124 - RNA, 13 nt, Homo sapiens
aaacagcugccuu

SEQ ID NO: 1184125 - RNA, 21 nt, Homo sapiens
aaacauaccaacauguuuaaa

SEQ ID NO: 1184126 - RNA, 21 nt, Homo sapiens
aaacauagacugaagauuuau

SEQ ID NO: 1184127 - RNA, 14 nt, Homo sapiens
aaacauauuuuaca

SEQ ID NO: 1184128 - RNA, 12 nt, Homo sapiens
aaacaucacuug

SEQ ID NO: 1184129 - RNA, 13 nt, Homo sapiens
aaacaucacuugu

SEQ ID NO: 1184130 - RNA, 15 nt, Homo sapiens
aaacaucauuggaua

SEQ ID NO: 1184131 - RNA, 16 nt, Homo sapiens
aaacauccagauacac

SEQ ID NO: 1184132 - RNA, 16 nt, Homo sapiens
aaacaugaaaacauug

SEQ ID NO: 1184133 - RNA, 16 nt, Homo sapiens
aaacaugcacuuccuu

SEQ ID NO: 1184134 - RNA, 17 nt, Homo sapiens
aaacauuaaauguccau

SEQ ID NO: 1184135 - RNA, 21 nt, Homo sapiens
aaacauugaaguaaugaauuu

SEQ ID NO: 1184136 - RNA, 19 nt, Homo sapiens
aaacauugugccaugucaa

SEQ ID NO: 1184137 - RNA, 21 nt, Homo sapiens
aaaccagagaagauccagcuu

SEQ ID NO: 1184138 - RNA, 11 nt, Homo sapiens
aaaccaucaca

SEQ ID NO: 1184139 - RNA, 15 nt, Homo sapiens
aaaccaucacaugac

SEQ ID NO: 1184140 - RNA, 13 nt, Homo sapiens
aaaccaugugacu

SEQ ID NO: 1184141 - RNA, 17 nt, Homo sapiens
aaacccaauucagucuc

SEQ ID NO: 1184142 - RNA, 19 nt, Homo sapiens
aaacccaccaaaaccaaga

SEQ ID NO: 1184143 - RNA, 19 nt, Homo sapiens
aaacccauucccucuccag

SEQ ID NO: 1184144 - RNA, 14 nt, Homo sapiens
aaacccauuuacuu

SEQ ID NO: 1184145 - RNA, 15 nt, Homo sapiens
aaaccccaaacuguu

SEQ ID NO: 1184146 - RNA, 13 nt, Homo sapiens
aaaccccaucucu

SEQ ID NO: 1184147 - RNA, 19 nt, Homo sapiens
aaaccccaucuuuacuaaa

SEQ ID NO: 1184148 - RNA, 13 nt, Homo sapiens
aaacccccagugu

SEQ ID NO: 1184149 - RNA, 17 nt, Homo sapiens
aaaccccuucucuguga

SEQ ID NO: 1184150 - RNA, 15 nt, Homo sapiens
aaacccuaucuguga

SEQ ID NO: 1184151 - RNA, 19 nt, Homo sapiens
aaacccuuuuuauggcuca

SEQ ID NO: 1184152 - RNA, 12 nt, Homo sapiens
aaaccucugggu

SEQ ID NO: 1184153 - RNA, 22 nt, Homo sapiens
aaaccuguauaacccuguuaca

SEQ ID NO: 1184154 - RNA, 22 nt, Homo sapiens
aaaccuucaucauuuugugauu

SEQ ID NO: 1184155 - RNA, 14 nt, Homo sapiens
aaaccuuguagaua

SEQ ID NO: 1184156 - RNA, 13 nt, Homo sapiens
aaacgcuaccucu

SEQ ID NO: 1184157 - RNA, 16 nt, Homo sapiens
aaacggauuccaaaga

SEQ ID NO: 1184158 - RNA, 13 nt, Homo sapiens
aaacgguucaguu

SEQ ID NO: 1184159 - RNA, 16 nt, Homo sapiens
aaacguccuacuguau

SEQ ID NO: 1184160 - RNA, 18 nt, Homo sapiens
aaacgugaggacucagga

SEQ ID NO: 1184161 - RNA, 17 nt, Homo sapiens
aaacuaaggaacccugg

SEQ ID NO: 1184162 - RNA, 17 nt, Homo sapiens
aaacuaccuguauuuaa

SEQ ID NO: 1184163 - RNA, 17 nt, Homo sapiens
aaacuagaugaccucau

SEQ ID NO: 1184164 - RNA, 18 nt, Homo sapiens
aaacuauguaacauguag

SEQ ID NO: 1184165 - RNA, 12 nt, Homo sapiens
aaacuccauuga

SEQ ID NO: 1184166 - RNA, 19 nt, Homo sapiens
aaacucuaucggagaacau

SEQ ID NO: 1184167 - RNA, 15 nt, Homo sapiens
aaacucuccagacau

SEQ ID NO: 1184168 - RNA, 13 nt, Homo sapiens
aaacucucugaac

SEQ ID NO: 1184169 - RNA, 23 nt, Homo sapiens
aaacugauacccuuugaaaaagu

SEQ ID NO: 1184170 - RNA, 14 nt, Homo sapiens
aaacugaugacuua

SEQ ID NO: 1184171 - RNA, 13 nt, Homo sapiens
aaacugaugccaa

SEQ ID NO: 1184172 - RNA, 13 nt, Homo sapiens
aaacugauuuauc

SEQ ID NO: 1184173 - RNA, 14 nt, Homo sapiens
aaacugggaugaaa

SEQ ID NO: 1184174 - RNA, 18 nt, Homo sapiens
aaacugguuuuagacaaa

SEQ ID NO: 1184175 - RNA, 21 nt, Homo sapiens
aaacugugugcaacagacaaa

SEQ ID NO: 1184176 - RNA, 18 nt, Homo sapiens
aaacuuaccuacugggga

SEQ ID NO: 1184177 - RNA, 19 nt, Homo sapiens
aaacuuagaucaucaguca

SEQ ID NO: 1184178 - RNA, 21 nt, Homo sapiens
aaacuuaucucugauauacaa

SEQ ID NO: 1184179 - RNA, 13 nt, Homo sapiens
aaacuucaaagag

SEQ ID NO: 1184180 - RNA, 17 nt, Homo sapiens
aaacuucccaacuuccc

SEQ ID NO: 1184181 - RNA, 10 nt, Homo sapiens
aaacuucuca

SEQ ID NO: 1184182 - RNA, 22 nt, Homo sapiens
aaacuucuuuaguacuuacauc

SEQ ID NO: 1184183 - RNA, 22 nt, Homo sapiens
aaacuuuauauuguucuuguaa

SEQ ID NO: 1184184 - RNA, 14 nt, Homo sapiens
aaacuuucacugaa

SEQ ID NO: 1184185 - RNA, 17 nt, Homo sapiens
aaacuuuuaaacuacag

SEQ ID NO: 1184186 - RNA, 18 nt, Homo sapiens
aaagaaaaagaccuauga

SEQ ID NO: 1184187 - RNA, 22 nt, Homo sapiens
aaagaaaccacuucuggucaau

SEQ ID NO: 1184188 - RNA, 21 nt, Homo sapiens
aaagaaacuauaaaguuuuau

SEQ ID NO: 1184189 - RNA, 14 nt, Homo sapiens
aaagaaauuaucuu

SEQ ID NO: 1184190 - RNA, 18 nt, Homo sapiens
aaagaaauuguauuauca

SEQ ID NO: 1184191 - RNA, 22 nt, Homo sapiens
aaagaagguuggugaauuucac

SEQ ID NO: 1184192 - RNA, 14 nt, Homo sapiens
aaagaaguucacau

SEQ ID NO: 1184193 - RNA, 18 nt, Homo sapiens
aaagaaguucacaucaga

SEQ ID NO: 1184194 - RNA, 15 nt, Homo sapiens
aaagaauucucuugc

SEQ ID NO: 1184195 - RNA, 17 nt, Homo sapiens
aaagaauucucuugcug

SEQ ID NO: 1184196 - RNA, 16 nt, Homo sapiens
aaagacaagugcucaa

SEQ ID NO: 1184197 - RNA, 16 nt, Homo sapiens
acugcaaccucugccu

SEQ ID NO: 1184198 - RNA, 14 nt, Homo sapiens
acugcacacagggu

SEQ ID NO: 1184199 - RNA, 13 nt, Homo sapiens
acugcacccagga

SEQ ID NO: 1184200 - RNA, 19 nt, Homo sapiens
acugcagagagacaacaga

SEQ ID NO: 1184201 - RNA, 22 nt, Homo sapiens
acugcaguugaaagggcaauau

SEQ ID NO: 1184202 - RNA, 14 nt, Homo sapiens
acugcauaaauaac

SEQ ID NO: 1184203 - RNA, 20 nt, Homo sapiens
acugcauaccaaccugggca

SEQ ID NO: 1184204 - RNA, 19 nt, Homo sapiens
acugcauguuugcuguucc

SEQ ID NO: 1184205 - RNA, 21 nt, Homo sapiens
acugccaagccauacuuauua

SEQ ID NO: 1184206 - RNA, 13 nt, Homo sapiens
acugccaucuuag

SEQ ID NO: 1184207 - RNA, 15 nt, Homo sapiens
acugcccauggacag

SEQ ID NO: 1184208 - RNA, 19 nt, Homo sapiens
acugccccagacacagugc

SEQ ID NO: 1184209 - RNA, 17 nt, Homo sapiens
acugcccccuccacugg

SEQ ID NO: 1184210 - RNA, 13 nt, Homo sapiens
acugcccugggca

SEQ ID NO: 1184211 - RNA, 21 nt, Homo sapiens
acugccuccucccuggcugca

SEQ ID NO: 1184212 - RNA, 23 nt, Homo sapiens
acugccuccucccuggcugcagc

SEQ ID NO: 1184213 - RNA, 19 nt, Homo sapiens
acugccucgaaacacagaa

SEQ ID NO: 1184214 - RNA, 16 nt, Homo sapiens
acugccuggauuccau

SEQ ID NO: 1184215 - RNA, 22 nt, Homo sapiens
acugccuuugucuuacuggcaa

SEQ ID NO: 1184216 - RNA, 19 nt, Homo sapiens
acugcgccgaccccgccac

SEQ ID NO: 1184217 - RNA, 19 nt, Homo sapiens
acugcggugaacauuuccu

SEQ ID NO: 1184218 - RNA, 13 nt, Homo sapiens
acugcguaggcaa

SEQ ID NO: 1184219 - RNA, 17 nt, Homo sapiens
acugcuacacuucugau

SEQ ID NO: 1184220 - RNA, 23 nt, Homo sapiens
acugcucuugugauguuugcuca

SEQ ID NO: 1184221 - RNA, 17 nt, Homo sapiens
acugcugccucagcuca

SEQ ID NO: 1184222 - RNA, 15 nt, Homo sapiens
acugcugcuccccac

SEQ ID NO: 1184223 - RNA, 16 nt, Homo sapiens
acugcuuaagugccua

SEQ ID NO: 1184224 - RNA, 14 nt, Homo sapiens
acugcuuaauucaa

SEQ ID NO: 1184225 - RNA, 15 nt, Homo sapiens
acugcuuaauucaaa

SEQ ID NO: 1184226 - RNA, 15 nt, Homo sapiens
acuggaacaauguuu

SEQ ID NO: 1184227 - RNA, 21 nt, Homo sapiens
acuggaguuuuggacuggaua

SEQ ID NO: 1184228 - RNA, 18 nt, Homo sapiens
acuggcauaaaucugaag

SEQ ID NO: 1184229 - RNA, 19 nt, Homo sapiens
acuggcauuuuuagcuccu

SEQ ID NO: 1184230 - RNA, 20 nt, Homo sapiens
acuggcauuuuuagcuccuu

SEQ ID NO: 1184231 - RNA, 17 nt, Homo sapiens
acuggccauuugccaau

SEQ ID NO: 1184232 - RNA, 20 nt, Homo sapiens
acuggcuacaguaccaugcc

SEQ ID NO: 1184233 - RNA, 21 nt, Homo sapiens
acuggcuggccagucuggguc

SEQ ID NO: 1184234 - RNA, 17 nt, Homo sapiens
acuggcuucucuugagu

SEQ ID NO: 1184235 - RNA, 16 nt, Homo sapiens
acugggacagcccagg

SEQ ID NO: 1184236 - RNA, 19 nt, Homo sapiens
acugggccuccaaccaugu

SEQ ID NO: 1184237 - RNA, 16 nt, Homo sapiens
acugggcgucugacuc

SEQ ID NO: 1184238 - RNA, 17 nt, Homo sapiens
acugggcgucugacucc

SEQ ID NO: 1184239 - RNA, 18 nt, Homo sapiens
acugggcuggguuugcug

SEQ ID NO: 1184240 - RNA, 17 nt, Homo sapiens
acuggggcugggagcag

SEQ ID NO: 1184241 - RNA, 17 nt, Homo sapiens
acuggggggaccaaaua

SEQ ID NO: 1184242 - RNA, 20 nt, Homo sapiens
acugggugaaucuggcagga

SEQ ID NO: 1184243 - RNA, 18 nt, Homo sapiens
acuggguucggauuguga

SEQ ID NO: 1184244 - RNA, 17 nt, Homo sapiens
acuggguuuucagcaua

SEQ ID NO: 1184245 - RNA, 22 nt, Homo sapiens
acugguauguguggaugaugcu

SEQ ID NO: 1184246 - RNA, 20 nt, Homo sapiens
acuggucccaagguguaaag

SEQ ID NO: 1184247 - RNA, 13 nt, Homo sapiens
acugguugcacuu

SEQ ID NO: 1184248 - RNA, 22 nt, Homo sapiens
acugguuuguaugauguauuag

SEQ ID NO: 1184249 - RNA, 17 nt, Homo sapiens
acugguuuuagacaaaa

SEQ ID NO: 1184250 - RNA, 18 nt, Homo sapiens
acuguaagucucaauuaa

SEQ ID NO: 1184251 - RNA, 23 nt, Homo sapiens
acuguagaaaugaugauguggaa

SEQ ID NO: 1184252 - RNA, 20 nt, Homo sapiens
acuguaugugcuguaauuua

SEQ ID NO: 1184253 - RNA, 21 nt, Homo sapiens
acugucacugccgacaucccu

SEQ ID NO: 1184254 - RNA, 22 nt, Homo sapiens
acugucucucuugucacaugga

SEQ ID NO: 1184255 - RNA, 10 nt, Homo sapiens
acugucuucc

SEQ ID NO: 1184256 - RNA, 16 nt, Homo sapiens
acugugaagaucucac

SEQ ID NO: 1184257 - RNA, 22 nt, Homo sapiens
acugugacaaugacuaagccaa

SEQ ID NO: 1184258 - RNA, 14 nt, Homo sapiens
acugugacugauau

SEQ ID NO: 1184259 - RNA, 14 nt, Homo sapiens
acugugagacugua

SEQ ID NO: 1184260 - RNA, 11 nt, Homo sapiens
acugugcuccc

SEQ ID NO: 1184261 - RNA, 21 nt, Homo sapiens
acugugucaggaaacauauuu

SEQ ID NO: 1184262 - RNA, 18 nt, Homo sapiens
acugugucucuaugugaa

SEQ ID NO: 1184263 - RNA, 13 nt, Homo sapiens
acuguucacacac

SEQ ID NO: 1184264 - RNA, 22 nt, Homo sapiens
acuguucacacacacaguuuga

SEQ ID NO: 1184265 - RNA, 23 nt, Homo sapiens
acuguugagaccuuguggucucg

SEQ ID NO: 1184266 - RNA, 18 nt, Homo sapiens
acuguugauaauucuuau

SEQ ID NO: 1184267 - RNA, 22 nt, Homo sapiens
acuguugguauuauauaauuca

SEQ ID NO: 1184268 - RNA, 13 nt, Homo sapiens
acuguugugcucc

SEQ ID NO: 1184269 - RNA, 13 nt, Homo sapiens
acuguuuuaucug

SEQ ID NO: 1184270 - RNA, 20 nt, Homo sapiens
acuguuuuauuaugauucau

SEQ ID NO: 1184271 - RNA, 15 nt, Homo sapiens
acuuaaaaugugcag

SEQ ID NO: 1184272 - RNA, 15 nt, Homo sapiens
acuuaaaauugcuaa

SEQ ID NO: 1184273 - RNA, 13 nt, Homo sapiens
acuuaacacuucu

SEQ ID NO: 1184274 - RNA, 16 nt, Homo sapiens
agacuuuaggcuuuca

SEQ ID NO: 1184275 - RNA, 15 nt, Homo sapiens
agagaaaagaaacca

SEQ ID NO: 1184276 - RNA, 17 nt, Homo sapiens
agagaaaauuaauuccu

SEQ ID NO: 1184277 - RNA, 17 nt, Homo sapiens
agagaaauauaauuccu

SEQ ID NO: 1184278 - RNA, 16 nt, Homo sapiens
agagaacaacauggga

SEQ ID NO: 1184279 - RNA, 22 nt, Homo sapiens
agagaacaaugugcuaugugaa

SEQ ID NO: 1184280 - RNA, 20 nt, Homo sapiens
agagaaccucacgcaccucc

SEQ ID NO: 1184281 - RNA, 12 nt, Homo sapiens
agagaagacaaa

SEQ ID NO: 1184282 - RNA, 13 nt, Homo sapiens
agagaagcugaug

SEQ ID NO: 1184283 - RNA, 16 nt, Homo sapiens
agagaauauaacauga

SEQ ID NO: 1184284 - RNA, 15 nt, Homo sapiens
agagaauaugucugc

SEQ ID NO: 1184285 - RNA, 18 nt, Homo sapiens
agagaauuuacuuuucaa

SEQ ID NO: 1184286 - RNA, 21 nt, Homo sapiens
agagacaacagauuuacaucc

SEQ ID NO: 1184287 - RNA, 23 nt, Homo sapiens
agagacaacagauuuacauccca

SEQ ID NO: 1184288 - RNA, 12 nt, Homo sapiens
agagacccaagg

SEQ ID NO: 1184289 - RNA, 14 nt, Homo sapiens
agagaccuauguaa

SEQ ID NO: 1184290 - RNA, 22 nt, Homo sapiens
agagacugguuucuccauguug

SEQ ID NO: 1184291 - RNA, 13 nt, Homo sapiens
agagagcugccau

SEQ ID NO: 1184292 - RNA, 22 nt, Homo sapiens
agagaggcacgugccugucuca

SEQ ID NO: 1184293 - RNA, 16 nt, Homo sapiens
agagaggccuuguccc

SEQ ID NO: 1184294 - RNA, 13 nt, Homo sapiens
agagagggagaag

SEQ ID NO: 1184295 - RNA, 13 nt, Homo sapiens
agagagggagcag

SEQ ID NO: 1184296 - RNA, 16 nt, Homo sapiens
agagaguacacugugu

SEQ ID NO: 1184297 - RNA, 14 nt, Homo sapiens
agagaguccagcua

SEQ ID NO: 1184298 - RNA, 15 nt, Homo sapiens
agagauccaaagacu

SEQ ID NO: 1184299 - RNA, 22 nt, Homo sapiens
agagauccuuuagugcacccag

SEQ ID NO: 1184300 - RNA, 15 nt, Homo sapiens
agagaugaaccacau

SEQ ID NO: 1184301 - RNA, 19 nt, Homo sapiens
agagcaaaacuccgucuca

SEQ ID NO: 1184302 - RNA, 16 nt, Homo sapiens
agagcaaaggagacaa

SEQ ID NO: 1184303 - RNA, 19 nt, Homo sapiens
agagcaaggguucccucaa

SEQ ID NO: 1184304 - RNA, 22 nt, Homo sapiens
agagcaagguuucguggcagca

SEQ ID NO: 1184305 - RNA, 17 nt, Homo sapiens
agagcagagaauauaac

SEQ ID NO: 1184306 - RNA, 22 nt, Homo sapiens
agagcagcugccauugcagauu

SEQ ID NO: 1184307 - RNA, 14 nt, Homo sapiens
agagcaggacucca

SEQ ID NO: 1184308 - RNA, 18 nt, Homo sapiens
agagcaggccagcccgga

SEQ ID NO: 1184309 - RNA, 18 nt, Homo sapiens
agagcagugcacaucuga

SEQ ID NO: 1184310 - RNA, 20 nt, Homo sapiens
agagccaauuagacuugaaa

SEQ ID NO: 1184311 - RNA, 17 nt, Homo sapiens
agagccccuccuuccuu

SEQ ID NO: 1184312 - RNA, 13 nt, Homo sapiens
agagccuuuccaa

SEQ ID NO: 1184313 - RNA, 20 nt, Homo sapiens
agagcgagauuccgucucaa

SEQ ID NO: 1184314 - RNA, 16 nt, Homo sapiens
agagcgauaauacacu

SEQ ID NO: 1184315 - RNA, 16 nt, Homo sapiens
agagcgcggcuggcuc

SEQ ID NO: 1184316 - RNA, 17 nt, Homo sapiens
agagcggcggagacaag

SEQ ID NO: 1184317 - RNA, 14 nt, Homo sapiens
agagcuacauggug

SEQ ID NO: 1184318 - RNA, 19 nt, Homo sapiens
agagcuacaugguggagca

SEQ ID NO: 1184319 - RNA, 17 nt, Homo sapiens
agagcucuggugauaag

SEQ ID NO: 1184320 - RNA, 18 nt, Homo sapiens
agagcugccaucgcugug

SEQ ID NO: 1184321 - RNA, 16 nt, Homo sapiens
agagcugguggaccca

SEQ ID NO: 1184322 - RNA, 14 nt, Homo sapiens
agagcuucccugac

SEQ ID NO: 1184323 - RNA, 15 nt, Homo sapiens
agagcuuuuugcaug

SEQ ID NO: 1184324 - RNA, 15 nt, Homo sapiens
agaggaaaaggcugg

SEQ ID NO: 1184325 - RNA, 14 nt, Homo sapiens
agaggaacaagcuu

SEQ ID NO: 1184326 - RNA, 17 nt, Homo sapiens
agaggaagacgagacag

SEQ ID NO: 1184327 - RNA, 12 nt, Homo sapiens
agaggaauuugg

SEQ ID NO: 1184328 - RNA, 12 nt, Homo sapiens
agaggagcauga

SEQ ID NO: 1184329 - RNA, 13 nt, Homo sapiens
agaggaguucuuu

SEQ ID NO: 1184330 - RNA, 21 nt, Homo sapiens
agaggaugcucuuucccagga

SEQ ID NO: 1184331 - RNA, 16 nt, Homo sapiens
agaggcagacaggugu

SEQ ID NO: 1184332 - RNA, 23 nt, Homo sapiens
accguuuuucaagaaaacuggaa

SEQ ID NO: 1184333 - RNA, 16 nt, Homo sapiens
accuacccaugaccug

SEQ ID NO: 1184334 - RNA, 17 nt, Homo sapiens
accuacccuccacaggc

SEQ ID NO: 1184335 - RNA, 13 nt, Homo sapiens
accuacucugcaa

SEQ ID NO: 1184336 - RNA, 17 nt, Homo sapiens
accuacuucagcaaugg

SEQ ID NO: 1184337 - RNA, 22 nt, Homo sapiens
accuagaagggcaggaguuccu

SEQ ID NO: 1184338 - RNA, 16 nt, Homo sapiens
accuagugccccagac

SEQ ID NO: 1184339 - RNA, 14 nt, Homo sapiens
accuauauuccuug

SEQ ID NO: 1184340 - RNA, 16 nt, Homo sapiens
accuauauugauuuaa

SEQ ID NO: 1184341 - RNA, 15 nt, Homo sapiens
accuauguacuuaau

SEQ ID NO: 1184342 - RNA, 13 nt, Homo sapiens
accuauuugacuu

SEQ ID NO: 1184343 - RNA, 17 nt, Homo sapiens
accuauuugacuuacca

SEQ ID NO: 1184344 - RNA, 13 nt, Homo sapiens
accuauuuuccuc

SEQ ID NO: 1184345 - RNA, 18 nt, Homo sapiens
accucaaacuuccaguca

SEQ ID NO: 1184346 - RNA, 17 nt, Homo sapiens
accucaaggccuacuga

SEQ ID NO: 1184347 - RNA, 20 nt, Homo sapiens
accucacaggccccaggaaa

SEQ ID NO: 1184348 - RNA, 19 nt, Homo sapiens
accucacccuggggccaga

SEQ ID NO: 1184349 - RNA, 15 nt, Homo sapiens
accucacgcaccucc

SEQ ID NO: 1184350 - RNA, 13 nt, Homo sapiens
accucagggacaa

SEQ ID NO: 1184351 - RNA, 21 nt, Homo sapiens
accucaggugauccaccugcc

SEQ ID NO: 1184352 - RNA, 20 nt, Homo sapiens
accuccauuaaauuugguac

SEQ ID NO: 1184353 - RNA, 19 nt, Homo sapiens
accucccugccuccaggaa

SEQ ID NO: 1184354 - RNA, 20 nt, Homo sapiens
accuccgggaaaagauucua

SEQ ID NO: 1184355 - RNA, 17 nt, Homo sapiens
accuccuucaauuccau

SEQ ID NO: 1184356 - RNA, 14 nt, Homo sapiens
accuccuuuaccag

SEQ ID NO: 1184357 - RNA, 23 nt, Homo sapiens
accuccuuuuuugaggucagggg

SEQ ID NO: 1184358 - RNA, 21 nt, Homo sapiens
accucgugauccgccuaccuc

SEQ ID NO: 1184359 - RNA, 19 nt, Homo sapiens
accucugggucaucucuca

SEQ ID NO: 1184360 - RNA, 15 nt, Homo sapiens
accucuuaccuguaa

SEQ ID NO: 1184361 - RNA, 15 nt, Homo sapiens
accucuugaaaauag

SEQ ID NO: 1184362 - RNA, 21 nt, Homo sapiens
accucuugaaaauagaacaac

SEQ ID NO: 1184363 - RNA, 20 nt, Homo sapiens
accugaaaacacugugcaca

SEQ ID NO: 1184364 - RNA, 22 nt, Homo sapiens
accugaaauaaaauucauuagu

SEQ ID NO: 1184365 - RNA, 17 nt, Homo sapiens
accugaaauuaacucag

SEQ ID NO: 1184366 - RNA, 22 nt, Homo sapiens
accugaaauuccaaagucucua

SEQ ID NO: 1184367 - RNA, 19 nt, Homo sapiens
accugaacucugcaacuga

SEQ ID NO: 1184368 - RNA, 13 nt, Homo sapiens
accugacucuugc

SEQ ID NO: 1184369 - RNA, 13 nt, Homo sapiens
accugacuugccu

SEQ ID NO: 1184370 - RNA, 18 nt, Homo sapiens
accugaguacccauggga

SEQ ID NO: 1184371 - RNA, 20 nt, Homo sapiens
accugaucaaugacagagcc

SEQ ID NO: 1184372 - RNA, 17 nt, Homo sapiens
accugauuaacugaggc

SEQ ID NO: 1184373 - RNA, 16 nt, Homo sapiens
accugauuuauugaaa

SEQ ID NO: 1184374 - RNA, 12 nt, Homo sapiens
accugcaaaaaa

SEQ ID NO: 1184375 - RNA, 14 nt, Homo sapiens
accugcaagcagaa

SEQ ID NO: 1184376 - RNA, 17 nt, Homo sapiens
accugcaagccuucuaa

SEQ ID NO: 1184377 - RNA, 18 nt, Homo sapiens
accugcacuuaaggcacu

SEQ ID NO: 1184378 - RNA, 21 nt, Homo sapiens
accugcacuuauacccaugaa

SEQ ID NO: 1184379 - RNA, 15 nt, Homo sapiens
accugcccucagcuu

SEQ ID NO: 1184380 - RNA, 17 nt, Homo sapiens
accugccucccauucua

SEQ ID NO: 1184381 - RNA, 16 nt, Homo sapiens
accugcgggagcugca

SEQ ID NO: 1184382 - RNA, 22 nt, Homo sapiens
accuggacgaagagcaggccag

SEQ ID NO: 1184383 - RNA, 23 nt, Homo sapiens
accuggacggugcgcacaccgcc

SEQ ID NO: 1184384 - RNA, 14 nt, Homo sapiens
accuggagaacuuc

SEQ ID NO: 1184385 - RNA, 23 nt, Homo sapiens
accuggccgggucacccugugac

SEQ ID NO: 1184386 - RNA, 19 nt, Homo sapiens
accuggccuuccugccagg

SEQ ID NO: 1184387 - RNA, 15 nt, Homo sapiens
accugggcaaagccu

SEQ ID NO: 1184388 - RNA, 20 nt, Homo sapiens
accuggucccugcucucagu

SEQ ID NO: 1184389 - RNA, 23 nt, Homo sapiens
accuggucuguuuucugugcacu

SEQ ID NO: 1184390 - RNA, 20 nt, Homo sapiens
accuguaaucccagcacuuu

SEQ ID NO: 1184391 - RNA, 18 nt, Homo sapiens
accuguagauagugauau

SEQ ID NO: 1184392 - RNA, 16 nt, Homo sapiens
accuguagucccagcu

SEQ ID NO: 1184393 - RNA, 14 nt, Homo sapiens
accuguccucuuug

SEQ ID NO: 1184394 - RNA, 21 nt, Homo sapiens
accugugccucggcuuuucuc

SEQ ID NO: 1184395 - RNA, 21 nt, Homo sapiens
accuguguccccgaugcugac

SEQ ID NO: 1184396 - RNA, 13 nt, Homo sapiens
accuguugaaaug

SEQ ID NO: 1184397 - RNA, 23 nt, Homo sapiens
accuuaaacuuucaauaucuuua

SEQ ID NO: 1184398 - RNA, 13 nt, Homo sapiens
accuuagauuuag

SEQ ID NO: 1184399 - RNA, 16 nt, Homo sapiens
accuuaggcagggaag

SEQ ID NO: 1184400 - RNA, 16 nt, Homo sapiens
accuuauucuacauca

SEQ ID NO: 1184401 - RNA, 19 nt, Homo sapiens
accuucagauuuguguuau

SEQ ID NO: 1184402 - RNA, 21 nt, Homo sapiens
accuucaggcagccaguguga

SEQ ID NO: 1184403 - RNA, 15 nt, Homo sapiens
accuucauuuaauau

SEQ ID NO: 1184404 - RNA, 21 nt, Homo sapiens
accuucggagaguaaugccac

SEQ ID NO: 1184405 - RNA, 14 nt, Homo sapiens
accuucugugcuca

SEQ ID NO: 1184406 - RNA, 12 nt, Homo sapiens
accuugagcaaa

SEQ ID NO: 1184407 - RNA, 17 nt, Homo sapiens
accuugagcaucaggaa

SEQ ID NO: 1184408 - RNA, 21 nt, Homo sapiens
accuugaugguaggugugaca

SEQ ID NO: 1184409 - RNA, 13 nt, Homo sapiens
accuugcauguaa

SEQ ID NO: 1184410 - RNA, 17 nt, Homo sapiens
acuuaagauuugcucau

SEQ ID NO: 1184411 - RNA, 19 nt, Homo sapiens
acuuacaggccuugcucac

SEQ ID NO: 1184412 - RNA, 15 nt, Homo sapiens
acuuacuauugguca

SEQ ID NO: 1184413 - RNA, 13 nt, Homo sapiens
acuuagacaguau

SEQ ID NO: 1184414 - RNA, 14 nt, Homo sapiens
acuuagacaguaug

SEQ ID NO: 1184415 - RNA, 22 nt, Homo sapiens
acuuagucucuaaagaguuuau

SEQ ID NO: 1184416 - RNA, 20 nt, Homo sapiens
acuuaguuauuucugccuau

SEQ ID NO: 1184417 - RNA, 13 nt, Homo sapiens
acuuaugauuuca

SEQ ID NO: 1184418 - RNA, 19 nt, Homo sapiens
acuuauggaacagggaugg

SEQ ID NO: 1184419 - RNA, 22 nt, Homo sapiens
acuuauggccacagcccaucca

SEQ ID NO: 1184420 - RNA, 13 nt, Homo sapiens
acuuauguggaac

SEQ ID NO: 1184421 - RNA, 11 nt, Homo sapiens
acuucaaagag

SEQ ID NO: 1184422 - RNA, 13 nt, Homo sapiens
acuucaagcucuc

SEQ ID NO: 1184423 - RNA, 15 nt, Homo sapiens
acuucacacuaugga

SEQ ID NO: 1184424 - RNA, 17 nt, Homo sapiens
acuucagaguacaucca

SEQ ID NO: 1184425 - RNA, 17 nt, Homo sapiens
acuucagcuuuguguau

SEQ ID NO: 1184426 - RNA, 23 nt, Homo sapiens
acuucagguggagagcacuagaa

SEQ ID NO: 1184427 - RNA, 16 nt, Homo sapiens
acuucaugcaggugaa

SEQ ID NO: 1184428 - RNA, 13 nt, Homo sapiens
acuuccacuuugu

SEQ ID NO: 1184429 - RNA, 14 nt, Homo sapiens
acuucccacggcuc

SEQ ID NO: 1184430 - RNA, 16 nt, Homo sapiens
acuucccacggcuccu

SEQ ID NO: 1184431 - RNA, 13 nt, Homo sapiens
acuuccccuaugg

SEQ ID NO: 1184432 - RNA, 20 nt, Homo sapiens
acuucccucaggccuaugca

SEQ ID NO: 1184433 - RNA, 16 nt, Homo sapiens
acuuccgucacccuug

SEQ ID NO: 1184434 - RNA, 17 nt, Homo sapiens
acuuccucuaaaacccu

SEQ ID NO: 1184435 - RNA, 15 nt, Homo sapiens
acuuccugugccuuu

SEQ ID NO: 1184436 - RNA, 21 nt, Homo sapiens
acuuccuugcccccauuucac

SEQ ID NO: 1184437 - RNA, 23 nt, Homo sapiens
acuucuagacucaccuguucuca

SEQ ID NO: 1184438 - RNA, 20 nt, Homo sapiens
acuucucaucacacacaugg

SEQ ID NO: 1184439 - RNA, 19 nt, Homo sapiens
acuucucccgugagccagg

SEQ ID NO: 1184440 - RNA, 21 nt, Homo sapiens
acuucucccgugagccaggca

SEQ ID NO: 1184441 - RNA, 18 nt, Homo sapiens
acuucucuauuaucucaa

SEQ ID NO: 1184442 - RNA, 13 nt, Homo sapiens
acuucugaacuug

SEQ ID NO: 1184443 - RNA, 17 nt, Homo sapiens
acuucugcuuugcucuu

SEQ ID NO: 1184444 - RNA, 14 nt, Homo sapiens
acuucuguuuccau

SEQ ID NO: 1184445 - RNA, 23 nt, Homo sapiens
acuucuuauggaauugauuugca

SEQ ID NO: 1184446 - RNA, 19 nt, Homo sapiens
acuucuucaguguccuuca

SEQ ID NO: 1184447 - RNA, 11 nt, Homo sapiens
acuucuuggcu

SEQ ID NO: 1184448 - RNA, 18 nt, Homo sapiens
acuucuuuaguacuuaca

SEQ ID NO: 1184449 - RNA, 23 nt, Homo sapiens
acuugaaaaauacuuuuccuuac

SEQ ID NO: 1184450 - RNA, 18 nt, Homo sapiens
acuugaagggccagagcc

SEQ ID NO: 1184451 - RNA, 12 nt, Homo sapiens
acuugacagugg

SEQ ID NO: 1184452 - RNA, 18 nt, Homo sapiens
acuugaccuaaacuucua

SEQ ID NO: 1184453 - RNA, 20 nt, Homo sapiens
acuugcauuuauuuaagaca

SEQ ID NO: 1184454 - RNA, 17 nt, Homo sapiens
acuuggagguagcuuug

SEQ ID NO: 1184455 - RNA, 22 nt, Homo sapiens
acuugggaauaaaucauagcaa

SEQ ID NO: 1184456 - RNA, 23 nt, Homo sapiens
acuuggggaguuaagaccuggca

SEQ ID NO: 1184457 - RNA, 17 nt, Homo sapiens
acuugguccaacugcaa

SEQ ID NO: 1184458 - RNA, 15 nt, Homo sapiens
acuugucacuugcau

SEQ ID NO: 1184459 - RNA, 21 nt, Homo sapiens
acuugucccacuaucugggug

SEQ ID NO: 1184460 - RNA, 13 nt, Homo sapiens
acuuguguuacuu

SEQ ID NO: 1184461 - RNA, 23 nt, Homo sapiens
acuuguguuuuuuaaucagcauu

SEQ ID NO: 1184462 - RNA, 19 nt, Homo sapiens
acuuuacugagacaaugua

SEQ ID NO: 1184463 - RNA, 17 nt, Homo sapiens
acuuuacugccugaaua

SEQ ID NO: 1184464 - RNA, 15 nt, Homo sapiens
acuuuagaagcacag

SEQ ID NO: 1184465 - RNA, 20 nt, Homo sapiens
acuuuagugauugcuuuuau

SEQ ID NO: 1184466 - RNA, 18 nt, Homo sapiens
acuuuaguggucuaauca

SEQ ID NO: 1184467 - RNA, 14 nt, Homo sapiens
acuuuaucaaagau

SEQ ID NO: 1184468 - RNA, 13 nt, Homo sapiens
agcgguccauggg

SEQ ID NO: 1184469 - RNA, 22 nt, Homo sapiens
agcggugccccuauacaaaaca

SEQ ID NO: 1184470 - RNA, 15 nt, Homo sapiens
agcguccucuuggcu

SEQ ID NO: 1184471 - RNA, 13 nt, Homo sapiens
agcgugugugaac

SEQ ID NO: 1184472 - RNA, 19 nt, Homo sapiens
agcguuuaaaguacugagc

SEQ ID NO: 1184473 - RNA, 11 nt, Homo sapiens
agcguuugcac

SEQ ID NO: 1184474 - RNA, 14 nt, Homo sapiens
agcuaaaaaugaac

SEQ ID NO: 1184475 - RNA, 21 nt, Homo sapiens
agcuaaaagaggccuguucau

SEQ ID NO: 1184476 - RNA, 22 nt, Homo sapiens
agcuaaauuuucugaaacugca

SEQ ID NO: 1184477 - RNA, 15 nt, Homo sapiens
agcuaccucaaccaa

SEQ ID NO: 1184478 - RNA, 17 nt, Homo sapiens
agcuaccucaaccaaug

SEQ ID NO: 1184479 - RNA, 23 nt, Homo sapiens
agcuaccucaaccaaugccaaaa

SEQ ID NO: 1184480 - RNA, 16 nt, Homo sapiens
agcuacguggcacuau

SEQ ID NO: 1184481 - RNA, 19 nt, Homo sapiens
agcuacucacuuaucugau

SEQ ID NO: 1184482 - RNA, 14 nt, Homo sapiens
agcuacucucccca

SEQ ID NO: 1184483 - RNA, 11 nt, Homo sapiens
agcuacuuagc

SEQ ID NO: 1184484 - RNA, 13 nt, Homo sapiens
cacuucacuccag

SEQ ID NO: 1184485 - RNA, 12 nt, Homo sapiens
cacuucauaucu

SEQ ID NO: 1184486 - RNA, 22 nt, Homo sapiens
cacuucccaggaucugcuccaa

SEQ ID NO: 1184487 - RNA, 22 nt, Homo sapiens
cacuuccuugcccccauuucac

SEQ ID NO: 1184488 - RNA, 12 nt, Homo sapiens
cacuucuuucag

SEQ ID NO: 1184489 - RNA, 13 nt, Homo sapiens
cacuuggccaguu

SEQ ID NO: 1184490 - RNA, 13 nt, Homo sapiens
cacuugugccagc

SEQ ID NO: 1184491 - RNA, 15 nt, Homo sapiens
cacuuuaaaccuguu

SEQ ID NO: 1184492 - RNA, 19 nt, Homo sapiens
cacuuuauauuuuccucuu

SEQ ID NO: 1184493 - RNA, 21 nt, Homo sapiens
cacuuuauauuuuccucuuag

SEQ ID NO: 1184494 - RNA, 21 nt, Homo sapiens
cacuuuggguuuuuaacucau

SEQ ID NO: 1184495 - RNA, 18 nt, Homo sapiens
cacuuuuuaaaaucucaa

SEQ ID NO: 1184496 - RNA, 22 nt, Homo sapiens
cagaaaaaaauaaauguucuaa

SEQ ID NO: 1184497 - RNA, 13 nt, Homo sapiens
cagaaaacauguu

SEQ ID NO: 1184498 - RNA, 16 nt, Homo sapiens
cagaaaagcaccugcc

SEQ ID NO: 1184499 - RNA, 20 nt, Homo sapiens
cagaaaauaaucugguguuc

SEQ ID NO: 1184500 - RNA, 16 nt, Homo sapiens
cagaaacugaugccaa

SEQ ID NO: 1184501 - RNA, 22 nt, Homo sapiens
cagaaacugaugccaaggggcu

SEQ ID NO: 1184502 - RNA, 14 nt, Homo sapiens
cagaaaggcuuuuu

SEQ ID NO: 1184503 - RNA, 17 nt, Homo sapiens
cagaaagguuaguauca

SEQ ID NO: 1184504 - RNA, 16 nt, Homo sapiens
cagaaaguaagcauuu

SEQ ID NO: 1184505 - RNA, 14 nt, Homo sapiens
cagaaauacaguau

SEQ ID NO: 1184506 - RNA, 16 nt, Homo sapiens
cagaaauacaguauga

SEQ ID NO: 1184507 - RNA, 19 nt, Homo sapiens
cagaaauuuggcauugauc

SEQ ID NO: 1184508 - RNA, 12 nt, Homo sapiens
cagaacacacuc

SEQ ID NO: 1184509 - RNA, 14 nt, Homo sapiens
cagaacacacucca

SEQ ID NO: 1184510 - RNA, 19 nt, Homo sapiens
cagaacacacuccaucagc

SEQ ID NO: 1184511 - RNA, 15 nt, Homo sapiens
cagaacacacugaga

SEQ ID NO: 1184512 - RNA, 20 nt, Homo sapiens
cagaacagaugcugagccau

SEQ ID NO: 1184513 - RNA, 22 nt, Homo sapiens
cagaacagugguggcaacauuc

SEQ ID NO: 1184514 - RNA, 14 nt, Homo sapiens
cagaagaaaggaac

SEQ ID NO: 1184515 - RNA, 13 nt, Homo sapiens
cagaagaagacag

SEQ ID NO: 1184516 - RNA, 20 nt, Homo sapiens
cagaagaccccugacucauc

SEQ ID NO: 1184517 - RNA, 22 nt, Homo sapiens
cagaagaggagacaguuuacca

SEQ ID NO: 1184518 - RNA, 12 nt, Homo sapiens
cagaagcacugg

SEQ ID NO: 1184519 - RNA, 17 nt, Homo sapiens
cagaagcugcccucagc

SEQ ID NO: 1184520 - RNA, 16 nt, Homo sapiens
cagaaggcaaacccau

SEQ ID NO: 1184521 - RNA, 19 nt, Homo sapiens
cagaaguaacucccacucc

SEQ ID NO: 1184522 - RNA, 19 nt, Homo sapiens
cagaaguccccucuacuuu

SEQ ID NO: 1184523 - RNA, 14 nt, Homo sapiens
cagaaguuccucaa

SEQ ID NO: 1184524 - RNA, 17 nt, Homo sapiens
cagaaucaaaugcaauu

SEQ ID NO: 1184525 - RNA, 16 nt, Homo sapiens
cagaaucccguaacac

SEQ ID NO: 1184526 - RNA, 12 nt, Homo sapiens
cagaaugaauuc

SEQ ID NO: 1184527 - RNA, 22 nt, Homo sapiens
cagaaugcugcaggacuugaga

SEQ ID NO: 1184528 - RNA, 21 nt, Homo sapiens
cagaaugggggcuuucgggga

SEQ ID NO: 1184529 - RNA, 15 nt, Homo sapiens
cagaauugagaguga

SEQ ID NO: 1184530 - RNA, 21 nt, Homo sapiens
cagaauuuguguaaaagugaa

SEQ ID NO: 1184531 - RNA, 15 nt, Homo sapiens
cagacacaacccaau

SEQ ID NO: 1184532 - RNA, 15 nt, Homo sapiens
cagacacacccagug

SEQ ID NO: 1184533 - RNA, 17 nt, Homo sapiens
cagacacacugaucuga

SEQ ID NO: 1184534 - RNA, 21 nt, Homo sapiens
cagacagagggucacaguguu

SEQ ID NO: 1184535 - RNA, 22 nt, Homo sapiens
cagacaggcuggaguugcugaa

SEQ ID NO: 1184536 - RNA, 10 nt, Homo sapiens
cagacauauu

SEQ ID NO: 1184537 - RNA, 18 nt, Homo sapiens
cagacauccucuaugcca

SEQ ID NO: 1184538 - RNA, 17 nt, Homo sapiens
cagacaugccacaagga

SEQ ID NO: 1184539 - RNA, 22 nt, Homo sapiens
cagacaugguggcaugcaccug

SEQ ID NO: 1184540 - RNA, 14 nt, Homo sapiens
cagacccccagugu

SEQ ID NO: 1184541 - RNA, 19 nt, Homo sapiens
cagacccuggaacuggaga

SEQ ID NO: 1184542 - RNA, 14 nt, Homo sapiens
cagacgccauuuaa

SEQ ID NO: 1184543 - RNA, 18 nt, Homo sapiens
cagacgucucaagacuga

SEQ ID NO: 1184544 - RNA, 21 nt, Homo sapiens
cagacugaacuuacacuguau

SEQ ID NO: 1184545 - RNA, 20 nt, Homo sapiens
cagacugaucaggaccucca

SEQ ID NO: 1184546 - RNA, 19 nt, Homo sapiens
cagacugcggugaacauuu

SEQ ID NO: 1184547 - RNA, 16 nt, Homo sapiens
cagacuguaggauuug

SEQ ID NO: 1184548 - RNA, 16 nt, Homo sapiens
cagacuucccacggcu

SEQ ID NO: 1184549 - RNA, 20 nt, Homo sapiens
cagacuucucccgugagcca

SEQ ID NO: 1184550 - RNA, 23 nt, Homo sapiens
cagacuugccaugugacucuggc

SEQ ID NO: 1184551 - RNA, 19 nt, Homo sapiens
cagacuuuggaaaaugcau

SEQ ID NO: 1184552 - RNA, 18 nt, Homo sapiens
cagagaaagaaagggaaa

SEQ ID NO: 1184553 - RNA, 17 nt, Homo sapiens
cagagaaagggacaaug

SEQ ID NO: 1184554 - RNA, 16 nt, Homo sapiens
cagagaaccagugcag

SEQ ID NO: 1184555 - RNA, 21 nt, Homo sapiens
cagagaaggaaaagacugaau

SEQ ID NO: 1184556 - RNA, 16 nt, Homo sapiens
cagagaauauaacaug

SEQ ID NO: 1184557 - RNA, 17 nt, Homo sapiens
cagagacauacuugaag

SEQ ID NO: 1184558 - RNA, 18 nt, Homo sapiens
cagagacccucucagccc

SEQ ID NO: 1184559 - RNA, 19 nt, Homo sapiens
cagagagacccgggaagga

SEQ ID NO: 1184560 - RNA, 17 nt, Homo sapiens
cagagauaucuaugaaa

SEQ ID NO: 1184561 - RNA, 16 nt, Homo sapiens
cagagcccagcuccaa

SEQ ID NO: 1184562 - RNA, 20 nt, Homo sapiens
cagagcugccuccccaaucc

SEQ ID NO: 1184563 - RNA, 13 nt, Homo sapiens
cagagcugggaaa

SEQ ID NO: 1184564 - RNA, 16 nt, Homo sapiens
cagagcuucuuccagg

SEQ ID NO: 1184565 - RNA, 17 nt, Homo sapiens
cagaggaaugaugggcu

SEQ ID NO: 1184566 - RNA, 19 nt, Homo sapiens
cagaggcagcauuuuugca

SEQ ID NO: 1184567 - RNA, 19 nt, Homo sapiens
cagaggcaguaaccaugcc

SEQ ID NO: 1184568 - RNA, 19 nt, Homo sapiens
cagaggcguuugaaucaga

SEQ ID NO: 1184569 - RNA, 20 nt, Homo sapiens
cagaggcuaauucaguguca

SEQ ID NO: 1184570 - RNA, 17 nt, Homo sapiens
cagaggggcucagguca

SEQ ID NO: 1184571 - RNA, 13 nt, Homo sapiens
cagagguaaaaaa

SEQ ID NO: 1184572 - RNA, 13 nt, Homo sapiens
cagaggucuccca

SEQ ID NO: 1184573 - RNA, 15 nt, Homo sapiens
cagaggucucccaaa

SEQ ID NO: 1184574 - RNA, 22 nt, Homo sapiens
cagaguagaaccacuuguggau

SEQ ID NO: 1184575 - RNA, 21 nt, Homo sapiens
cagagucucgcucuguugccc

SEQ ID NO: 1184576 - RNA, 12 nt, Homo sapiens
cagagucugccc

SEQ ID NO: 1184577 - RNA, 22 nt, Homo sapiens
cagagugagacccagcccucau

SEQ ID NO: 1184578 - RNA, 23 nt, Homo sapiens
cagagugagacccagcccucauc

SEQ ID NO: 1184579 - RNA, 11 nt, Homo sapiens
cagagugcaag

SEQ ID NO: 1184580 - RNA, 21 nt, Homo sapiens
auuuuaagaauuucacaagcu

SEQ ID NO: 1184581 - RNA, 22 nt, Homo sapiens
auuuuacacguaucucuuggua

SEQ ID NO: 1184582 - RNA, 20 nt, Homo sapiens
auuuuaggagcuaaggcucu

SEQ ID NO: 1184583 - RNA, 17 nt, Homo sapiens
auuuuauacugcacuuu

SEQ ID NO: 1184584 - RNA, 15 nt, Homo sapiens
auuuuauagcuacua

SEQ ID NO: 1184585 - RNA, 18 nt, Homo sapiens
auuuuauuacaucuuuca

SEQ ID NO: 1184586 - RNA, 19 nt, Homo sapiens
auuuuauucaagaaugcca

SEQ ID NO: 1184587 - RNA, 19 nt, Homo sapiens
auuuuauucccaagcucua

SEQ ID NO: 1184588 - RNA, 15 nt, Homo sapiens
auuuuauuguacaag

SEQ ID NO: 1184589 - RNA, 14 nt, Homo sapiens
auuuucaagacuuu

SEQ ID NO: 1184590 - RNA, 19 nt, Homo sapiens
auuuucacuuuuaaacuac

SEQ ID NO: 1184591 - RNA, 15 nt, Homo sapiens
auuuucagccaaagg

SEQ ID NO: 1184592 - RNA, 12 nt, Homo sapiens
auuuucauuccu

SEQ ID NO: 1184593 - RNA, 16 nt, Homo sapiens
auuuucuacuagccau

SEQ ID NO: 1184594 - RNA, 12 nt, Homo sapiens
auuuucugaugg

SEQ ID NO: 1184595 - RNA, 16 nt, Homo sapiens
auuuugacacaugugu

SEQ ID NO: 1184596 - RNA, 20 nt, Homo sapiens
auuuugcaaacacugugauu

SEQ ID NO: 1184597 - RNA, 12 nt, Homo sapiens
auuuugcacagu

SEQ ID NO: 1184598 - RNA, 15 nt, Homo sapiens
auuuugcccuugaca

SEQ ID NO: 1184599 - RNA, 15 nt, Homo sapiens
auuuugccugcaaca

SEQ ID NO: 1184600 - RNA, 15 nt, Homo sapiens
auuuugcucugugaa

SEQ ID NO: 1184601 - RNA, 16 nt, Homo sapiens
auuuugcucugugaac

SEQ ID NO: 1184602 - RNA, 17 nt, Homo sapiens
auuuuguaaccuuccaa

SEQ ID NO: 1184603 - RNA, 16 nt, Homo sapiens
auuuuguauuuuccaa

SEQ ID NO: 1184604 - RNA, 20 nt, Homo sapiens
auuuugugaugaaucuacau

SEQ ID NO: 1184605 - RNA, 12 nt, Homo sapiens
cucuuuuacuaa

SEQ ID NO: 1184606 - RNA, 17 nt, Homo sapiens
cucuuuuucuccagggu

SEQ ID NO: 1184607 - RNA, 19 nt, Homo sapiens
cugaaaacacugugcacau

SEQ ID NO: 1184608 - RNA, 23 nt, Homo sapiens
cugaaacucccagccacagcauu

SEQ ID NO: 1184609 - RNA, 13 nt, Homo sapiens
cugaaacuuaccu

SEQ ID NO: 1184610 - RNA, 16 nt, Homo sapiens
cugaaacuuaccugag

SEQ ID NO: 1184611 - RNA, 12 nt, Homo sapiens
cugaaacuugaa

SEQ ID NO: 1184612 - RNA, 23 nt, Homo sapiens
cugaaaggauguagaaacaauau

SEQ ID NO: 1184613 - RNA, 21 nt, Homo sapiens
cugaacauugcacugauauca

SEQ ID NO: 1184614 - RNA, 16 nt, Homo sapiens
cugaaccaaauugcac

SEQ ID NO: 1184615 - RNA, 13 nt, Homo sapiens
cugaagaaaccuu

SEQ ID NO: 1184616 - RNA, 20 nt, Homo sapiens
cugaagagugacggacuucu

SEQ ID NO: 1184617 - RNA, 14 nt, Homo sapiens
cugaagauggcauc

SEQ ID NO: 1184618 - RNA, 19 nt, Homo sapiens
cugaagaugggagccuuua

SEQ ID NO: 1184619 - RNA, 13 nt, Homo sapiens
cugaagccaggca

SEQ ID NO: 1184620 - RNA, 21 nt, Homo sapiens
cugaagcccucccagguguua

SEQ ID NO: 1184621 - RNA, 19 nt, Homo sapiens
cugaagcuacuuucuuaaa

SEQ ID NO: 1184622 - RNA, 14 nt, Homo sapiens
cugaaggaaccaaa

SEQ ID NO: 1184623 - RNA, 12 nt, Homo sapiens
cugaaggcuuug

SEQ ID NO: 1184624 - RNA, 16 nt, Homo sapiens
cugaagggaaggcaaa

SEQ ID NO: 1184625 - RNA, 17 nt, Homo sapiens
cugaagggcaucaugca

SEQ ID NO: 1184626 - RNA, 18 nt, Homo sapiens
cugaagucuuacuacaga

SEQ ID NO: 1184627 - RNA, 17 nt, Homo sapiens
cugaaucaucauaucua

SEQ ID NO: 1184628 - RNA, 20 nt, Homo sapiens
cugaaucaucauaucuacua

SEQ ID NO: 1184629 - RNA, 23 nt, Homo sapiens
cugaaucuuccuuuguugcacaa

SEQ ID NO: 1184630 - RNA, 18 nt, Homo sapiens
cugaaugauuuccaaaga

SEQ ID NO: 1184631 - RNA, 19 nt, Homo sapiens
cugaauggcuuugucuuga

SEQ ID NO: 1184632 - RNA, 24 nt, Homo sapiens
cugaauucucugcucagugauuaa

SEQ ID NO: 1184633 - RNA, 13 nt, Homo sapiens
cugaauuucucag

SEQ ID NO: 1184634 - RNA, 22 nt, Homo sapiens
cugacaagggacuagugaguca

SEQ ID NO: 1184635 - RNA, 13 nt, Homo sapiens
cugacaagugaag

SEQ ID NO: 1184636 - RNA, 20 nt, Homo sapiens
cugacaaguuauuacugucu

SEQ ID NO: 1184637 - RNA, 22 nt, Homo sapiens
cugacagggacaugcccugugu

SEQ ID NO: 1184638 - RNA, 13 nt, Homo sapiens
cugacaguagccu

SEQ ID NO: 1184639 - RNA, 16 nt, Homo sapiens
cugacaguuuguggca

SEQ ID NO: 1184640 - RNA, 21 nt, Homo sapiens
cugacauuagauugaugugca

SEQ ID NO: 1184641 - RNA, 14 nt, Homo sapiens
cugacauuuaucag

SEQ ID NO: 1184642 - RNA, 17 nt, Homo sapiens
cugacauuuaucaggca

SEQ ID NO: 1184643 - RNA, 23 nt, Homo sapiens
cugaccaaacagccaacuagccc

SEQ ID NO: 1184644 - RNA, 19 nt, Homo sapiens
cugaccagcagcgccuuuc

SEQ ID NO: 1184645 - RNA, 19 nt, Homo sapiens
cugacccaccaaggucuca

SEQ ID NO: 1184646 - RNA, 22 nt, Homo sapiens
cugacccucaucuuucuuccaa

SEQ ID NO: 1184647 - RNA, 14 nt, Homo sapiens
cugaccuacauacg

SEQ ID NO: 1184648 - RNA, 19 nt, Homo sapiens
cugaccucaggugauccgc

SEQ ID NO: 1184649 - RNA, 17 nt, Homo sapiens
cugaccucaugauccac

SEQ ID NO: 1184650 - RNA, 18 nt, Homo sapiens
cugaccugcggguccuca

SEQ ID NO: 1184651 - RNA, 14 nt, Homo sapiens
cugaccugguccac

SEQ ID NO: 1184652 - RNA, 17 nt, Homo sapiens
cugacucuucaagugcc

SEQ ID NO: 1184653 - RNA, 21 nt, Homo sapiens
cugacuuaugaaacuugaaac

SEQ ID NO: 1184654 - RNA, 13 nt, Homo sapiens
cugacuugaacuc

SEQ ID NO: 1184655 - RNA, 21 nt, Homo sapiens
cugacuuggaucccaaagcaa

SEQ ID NO: 1184656 - RNA, 16 nt, Homo sapiens
cugacuuuuaauguca

SEQ ID NO: 1184657 - RNA, 17 nt, Homo sapiens
cugacuuuuaaugucau

SEQ ID NO: 1184658 - RNA, 19 nt, Homo sapiens
cugacuuuuaaugucauuu

SEQ ID NO: 1184659 - RNA, 13 nt, Homo sapiens
cugagaaaccucg

SEQ ID NO: 1184660 - RNA, 20 nt, Homo sapiens
cugagacuugaaucaaguca

SEQ ID NO: 1184661 - RNA, 14 nt, Homo sapiens
cugagagaggccau

SEQ ID NO: 1184662 - RNA, 20 nt, Homo sapiens
cugagagcauguuuuaucau

SEQ ID NO: 1184663 - RNA, 12 nt, Homo sapiens
cugagagucuag

SEQ ID NO: 1184664 - RNA, 19 nt, Homo sapiens
cugagaguugcuuccaguc

SEQ ID NO: 1184665 - RNA, 14 nt, Homo sapiens
cugagauaccagcg

SEQ ID NO: 1184666 - RNA, 21 nt, Homo sapiens
cugagauagcagaggggcucc

SEQ ID NO: 1184667 - RNA, 13 nt, Homo sapiens
cugagcaguauua

SEQ ID NO: 1184668 - RNA, 20 nt, Homo sapiens
cugagcaucuccagcauucu

SEQ ID NO: 1184669 - RNA, 19 nt, Homo sapiens
cugagcgggcuugugauau

SEQ ID NO: 1184670 - RNA, 19 nt, Homo sapiens
cugagcguuuaaaguacug

SEQ ID NO: 1184671 - RNA, 22 nt, Homo sapiens
cugagcucuccaggccaggugg

SEQ ID NO: 1184672 - RNA, 17 nt, Homo sapiens
cugaggacuaugccaug

SEQ ID NO: 1184673 - RNA, 14 nt, Homo sapiens
cugaggacucugca

SEQ ID NO: 1184674 - RNA, 20 nt, Homo sapiens
cugaggccucacuacucgag

SEQ ID NO: 1184675 - RNA, 15 nt, Homo sapiens
cugagggagcuccaa

SEQ ID NO: 1184676 - RNA, 17 nt, Homo sapiens
cugaggguguuucuucc

SEQ ID NO: 1184677 - RNA, 22 nt, Homo sapiens
cugaggugggaaaaucacuuga

SEQ ID NO: 1184678 - RNA, 16 nt, Homo sapiens
cugaguacauugugcc

SEQ ID NO: 1184679 - RNA, 19 nt, Homo sapiens
cugaguagcuggauuacag

SEQ ID NO: 1184680 - RNA, 21 nt, Homo sapiens
cugaguccgccugcgccucca

SEQ ID NO: 1184681 - RNA, 21 nt, Homo sapiens
cugagugacgacgugguggag

SEQ ID NO: 1184682 - RNA, 11 nt, Homo sapiens
cugaguggagu

SEQ ID NO: 1184683 - RNA, 21 nt, Homo sapiens
cugaguuagaagcaaggcaca

SEQ ID NO: 1184684 - RNA, 17 nt, Homo sapiens
cugaguuaggaaacaaa

SEQ ID NO: 1184685 - RNA, 20 nt, Homo sapiens
cugaguuuuccauggcagga

SEQ ID NO: 1184686 - RNA, 15 nt, Homo sapiens
cugauaaaacucaaa

SEQ ID NO: 1184687 - RNA, 16 nt, Homo sapiens
cugauaagacaugaaa

SEQ ID NO: 1184688 - RNA, 15 nt, Homo sapiens
cugauaaugcucacu

SEQ ID NO: 1184689 - RNA, 16 nt, Homo sapiens
cugauaauguauugca

SEQ ID NO: 1184690 - RNA, 21 nt, Homo sapiens
cugauaauuauuuuaaagggg

SEQ ID NO: 1184691 - RNA, 16 nt, Homo sapiens
cugauacccuuugaaa

SEQ ID NO: 1184692 - RNA, 22 nt, Homo sapiens
cugauagcuauaauugggucau

SEQ ID NO: 1184693 - RNA, 14 nt, Homo sapiens
cugauauggcuuuu

SEQ ID NO: 1184694 - RNA, 19 nt, Homo sapiens
cugaucccuggccacugaa

SEQ ID NO: 1184695 - RNA, 17 nt, Homo sapiens
cugaucgagcgcugucu

SEQ ID NO: 1184696 - RNA, 17 nt, Homo sapiens
cugaucugcacauuuca

SEQ ID NO: 1184697 - RNA, 17 nt, Homo sapiens
cugaucuggcagacuca

SEQ ID NO: 1184698 - RNA, 14 nt, Homo sapiens
cugaugccauguaa

SEQ ID NO: 1184699 - RNA, 12 nt, Homo sapiens
cugaugcugaca

SEQ ID NO: 1184700 - RNA, 15 nt, Homo sapiens
cugaugcugccccuc

SEQ ID NO: 1184701 - RNA, 14 nt, Homo sapiens
cugauuaguauuca

SEQ ID NO: 1184702 - RNA, 20 nt, Homo sapiens
cugauucuuaugauuacuau

SEQ ID NO: 1184703 - RNA, 13 nt, Homo sapiens
cugauuuaccucu

SEQ ID NO: 1184704 - RNA, 22 nt, Homo sapiens
cugauuuaggagaagccaggaa

SEQ ID NO: 1184705 - RNA, 16 nt, Homo sapiens
cugauuuauugaaauu

SEQ ID NO: 1184706 - RNA, 15 nt, Homo sapiens
cugauuucugagcau

SEQ ID NO: 1184707 - RNA, 15 nt, Homo sapiens
cugcaaacgcugccu

SEQ ID NO: 1184708 - RNA, 20 nt, Homo sapiens
cugcaaagaucuguccucag

SEQ ID NO: 1184709 - RNA, 23 nt, Homo sapiens
cugcaaauauuagcaaagaagcu

SEQ ID NO: 1184710 - RNA, 16 nt, Homo sapiens
cugcaaaugugcaguu

SEQ ID NO: 1184711 - RNA, 21 nt, Homo sapiens
cugcaaccuccuucggcuuug

SEQ ID NO: 1184712 - RNA, 16 nt, Homo sapiens
cugcaaguaaguauga

SEQ ID NO: 1184713 - RNA, 16 nt, Homo sapiens
cugcaaucuuugccaa

SEQ ID NO: 1184714 - RNA, 17 nt, Homo sapiens
cugcacagagucaggau

SEQ ID NO: 1184715 - RNA, 14 nt, Homo sapiens
cugcacaggucucu

SEQ ID NO: 1184716 - RNA, 17 nt, Homo sapiens
cugcacaugucuuguac

SEQ ID NO: 1184717 - RNA, 19 nt, Homo sapiens
cugcacaugucuuguacau

SEQ ID NO: 1184718 - RNA, 12 nt, Homo sapiens
cugcacauuuca

SEQ ID NO: 1184719 - RNA, 15 nt, Homo sapiens
cugcaccuguaggau

SEQ ID NO: 1184720 - RNA, 18 nt, Homo sapiens
cugcacuuauacccauga

SEQ ID NO: 1184721 - RNA, 15 nt, Homo sapiens
cugcacuucauaucu

SEQ ID NO: 1184722 - RNA, 18 nt, Homo sapiens
cugcagagagacaacaga

SEQ ID NO: 1184723 - RNA, 19 nt, Homo sapiens
cugcagaugaucagggauc

SEQ ID NO: 1184724 - RNA, 14 nt, Homo sapiens
cugcauacuaaccu

SEQ ID NO: 1184725 - RNA, 17 nt, Homo sapiens
cugcaucaccaccucag

SEQ ID NO: 1184726 - RNA, 16 nt, Homo sapiens
cugcaucccccaaagc

SEQ ID NO: 1184727 - RNA, 23 nt, Homo sapiens
cugcaucuaagcccaugggacaa

SEQ ID NO: 1184728 - RNA, 17 nt, Homo sapiens
cugcaucuuggggacau

SEQ ID NO: 1184729 - RNA, 21 nt, Homo sapiens
cugcauucaccuuagugcaac

SEQ ID NO: 1184730 - RNA, 18 nt, Homo sapiens
cugcauugggagcaucca

SEQ ID NO: 1184731 - RNA, 21 nt, Homo sapiens
cugcauuuauccuauaucauu

SEQ ID NO: 1184732 - RNA, 15 nt, Homo sapiens
cugccaaaaugcucu

SEQ ID NO: 1184733 - RNA, 22 nt, Homo sapiens
cugccagaugcugauguucagu

SEQ ID NO: 1184734 - RNA, 19 nt, Homo sapiens
cugccagcaguuacuguga

SEQ ID NO: 1184735 - RNA, 16 nt, Homo sapiens
cugccagcauuucccu

SEQ ID NO: 1184736 - RNA, 15 nt, Homo sapiens
cugccaucaugccug

SEQ ID NO: 1184737 - RNA, 17 nt, Homo sapiens
cugccauccaugugcua

SEQ ID NO: 1184738 - RNA, 16 nt, Homo sapiens
cugccaugcauacaug

SEQ ID NO: 1184739 - RNA, 17 nt, Homo sapiens
cugcccaaccugacuuu

SEQ ID NO: 1184740 - RNA, 13 nt, Homo sapiens
aauucuugccaaa

SEQ ID NO: 1184741 - RNA, 16 nt, Homo sapiens
aauucuuuacaauaaa

SEQ ID NO: 1184742 - RNA, 17 nt, Homo sapiens
aauugaaaggcauucuc

SEQ ID NO: 1184743 - RNA, 19 nt, Homo sapiens
aauugaagauguaaggaau

SEQ ID NO: 1184744 - RNA, 21 nt, Homo sapiens
aauugaauucuggaaacuccu

SEQ ID NO: 1184745 - RNA, 18 nt, Homo sapiens
aauugacagucacucagc

SEQ ID NO: 1184746 - RNA, 15 nt, Homo sapiens
aauugacgacuucac

SEQ ID NO: 1184747 - RNA, 15 nt, Homo sapiens
aauugagacagugca

SEQ ID NO: 1184748 - RNA, 18 nt, Homo sapiens
aauugagauccaguuuuu

SEQ ID NO: 1184749 - RNA, 13 nt, Homo sapiens
aauugaugaacug

SEQ ID NO: 1184750 - RNA, 15 nt, Homo sapiens
aauugauucaaguga

SEQ ID NO: 1184751 - RNA, 16 nt, Homo sapiens
aauugcaaaucuugaa

SEQ ID NO: 1184752 - RNA, 14 nt, Homo sapiens
aauugcacuucuug

SEQ ID NO: 1184753 - RNA, 14 nt, Homo sapiens
aauugcucagagaa

SEQ ID NO: 1184754 - RNA, 18 nt, Homo sapiens
aauugcuguugaaagcaa

SEQ ID NO: 1184755 - RNA, 21 nt, Homo sapiens
aauugcuguugaaagcaaaaa

SEQ ID NO: 1184756 - RNA, 15 nt, Homo sapiens
aauuggcacuaaaga

SEQ ID NO: 1184757 - RNA, 17 nt, Homo sapiens
aauuggcuaaagugcau

SEQ ID NO: 1184758 - RNA, 23 nt, Homo sapiens
aauuggcuacuaguuuaagcaaa

SEQ ID NO: 1184759 - RNA, 21 nt, Homo sapiens
aauugguuaguuaacacugaa

SEQ ID NO: 1184760 - RNA, 16 nt, Homo sapiens
aauugguuguauauaa

SEQ ID NO: 1184761 - RNA, 20 nt, Homo sapiens
aauuguaaauacauguacag

SEQ ID NO: 1184762 - RNA, 16 nt, Homo sapiens
aauuguacuaaagcca

SEQ ID NO: 1184763 - RNA, 19 nt, Homo sapiens
aauuguauuacaaauccaa

SEQ ID NO: 1184764 - RNA, 22 nt, Homo sapiens
aauuguuaauaaaauagucacu

SEQ ID NO: 1184765 - RNA, 13 nt, Homo sapiens
aauuuaaaacuuu

SEQ ID NO: 1184766 - RNA, 16 nt, Homo sapiens
aauuuacgaaaccaaa

SEQ ID NO: 1184767 - RNA, 21 nt, Homo sapiens
aauuuacuuuucaagcuauaa

SEQ ID NO: 1184768 - RNA, 21 nt, Homo sapiens
aauuuacuuuuuaaacagugu

SEQ ID NO: 1184769 - RNA, 22 nt, Homo sapiens
aauuuacuuuuuaaacaguguu

SEQ ID NO: 1184770 - RNA, 13 nt, Homo sapiens
aauuuaucaccua

SEQ ID NO: 1184771 - RNA, 15 nt, Homo sapiens
aauuuauugaguuuu

SEQ ID NO: 1184772 - RNA, 20 nt, Homo sapiens
aauuuauugaguuuuuacaa

SEQ ID NO: 1184773 - RNA, 19 nt, Homo sapiens
aauuuauuugaaaaugcau

SEQ ID NO: 1184774 - RNA, 22 nt, Homo sapiens
aauuucaagaaguguaguucaa

SEQ ID NO: 1184775 - RNA, 13 nt, Homo sapiens
aauuuccaugugu

SEQ ID NO: 1184776 - RNA, 17 nt, Homo sapiens
aauuucuaacaguacca

SEQ ID NO: 1184777 - RNA, 21 nt, Homo sapiens
aauuucuacuucuggaaguca

SEQ ID NO: 1184778 - RNA, 14 nt, Homo sapiens
aauuucuacuuuga

SEQ ID NO: 1184779 - RNA, 19 nt, Homo sapiens
aauuucucuuuaaaaccau

SEQ ID NO: 1184780 - RNA, 23 nt, Homo sapiens
aauuucugaacaccauagguaga

SEQ ID NO: 1184781 - RNA, 23 nt, Homo sapiens
aauuucuucauaguuuauuuuca

SEQ ID NO: 1184782 - RNA, 12 nt, Homo sapiens
aauuugaacuuu

SEQ ID NO: 1184783 - RNA, 13 nt, Homo sapiens
aauuugggggaaa

SEQ ID NO: 1184784 - RNA, 19 nt, Homo sapiens
aauuugggggaaaauggca

SEQ ID NO: 1184785 - RNA, 20 nt, Homo sapiens
aauuugggggaaaauggcac

SEQ ID NO: 1184786 - RNA, 19 nt, Homo sapiens
aauuuguaacuuuuaucca

SEQ ID NO: 1184787 - RNA, 20 nt, Homo sapiens
aauuugucuucagauuauua

SEQ ID NO: 1184788 - RNA, 24 nt, Homo sapiens
aauuugugguccacugagcuauaa

SEQ ID NO: 1184789 - RNA, 12 nt, Homo sapiens
aauuuuacccuu

SEQ ID NO: 1184790 - RNA, 21 nt, Homo sapiens
aauuuuauuuuuacaaaaauu

SEQ ID NO: 1184791 - RNA, 13 nt, Homo sapiens
aauuuucauucau

SEQ ID NO: 1184792 - RNA, 20 nt, Homo sapiens
aauuuucugaaacugcauaa

SEQ ID NO: 1184793 - RNA, 22 nt, Homo sapiens
aauuuugagauuaagaaugcca

SEQ ID NO: 1184794 - RNA, 12 nt, Homo sapiens
aauuuugccaaa

SEQ ID NO: 1184795 - RNA, 21 nt, Homo sapiens
aauuuugggggaaaaaaucca

SEQ ID NO: 1184796 - RNA, 20 nt, Homo sapiens
aauuuuggucauagcauuca

SEQ ID NO: 1184797 - RNA, 20 nt, Homo sapiens
aauuuuuaaaagacuuugau

SEQ ID NO: 1184798 - RNA, 12 nt, Homo sapiens
aauuuuugcaaa

SEQ ID NO: 1184799 - RNA, 15 nt, Homo sapiens
aauuuuugcaauaau

SEQ ID NO: 1184800 - RNA, 19 nt, Homo sapiens
aauuuuuuaaauaaaugga

SEQ ID NO: 1184801 - RNA, 21 nt, Homo sapiens
aauuuuuuguucuucagagau

SEQ ID NO: 1184802 - RNA, 23 nt, Homo sapiens
acaaaaaaaguuuguuacuuuga

SEQ ID NO: 1184803 - RNA, 20 nt, Homo sapiens
acaaaaacucuuauuacugu

SEQ ID NO: 1184804 - RNA, 16 nt, Homo sapiens
acaaaaagccauuguu

SEQ ID NO: 1184805 - RNA, 23 nt, Homo sapiens
acaaaaauguaauuguucaucuu

SEQ ID NO: 1184806 - RNA, 16 nt, Homo sapiens
acaaaaauuacaaaga

SEQ ID NO: 1184807 - RNA, 23 nt, Homo sapiens
acaaaaccgcauucagugcaccu

SEQ ID NO: 1184808 - RNA, 16 nt, Homo sapiens
acaaaaggaagacugg

SEQ ID NO: 1184809 - RNA, 17 nt, Homo sapiens
acaaaagggccaggugc

SEQ ID NO: 1184810 - RNA, 18 nt, Homo sapiens
acaaaagugaucucuggu

SEQ ID NO: 1184811 - RNA, 20 nt, Homo sapiens
acaaaauaaccaauccugga

SEQ ID NO: 1184812 - RNA, 22 nt, Homo sapiens
acaaaauaacucuccaguaaca

SEQ ID NO: 1184813 - RNA, 19 nt, Homo sapiens
acaaaaucuuguaggucau

SEQ ID NO: 1184814 - RNA, 11 nt, Homo sapiens
acaaacaguga

SEQ ID NO: 1184815 - RNA, 13 nt, Homo sapiens
acaaaccaugacu

SEQ ID NO: 1184816 - RNA, 11 nt, Homo sapiens
acaaacccagg

SEQ ID NO: 1184817 - RNA, 20 nt, Homo sapiens
acaaacccccacuccagcuc

SEQ ID NO: 1184818 - RNA, 17 nt, Homo sapiens
acaaaccucaagccagc

SEQ ID NO: 1184819 - RNA, 18 nt, Homo sapiens
acaaaccugcacuuauac

SEQ ID NO: 1184820 - RNA, 23 nt, Homo sapiens
acaaacuacugugucacugucca

SEQ ID NO: 1184821 - RNA, 14 nt, Homo sapiens
acaaacuacuugau

SEQ ID NO: 1184822 - RNA, 23 nt, Homo sapiens
acaaacuccugaaaugccaagug

SEQ ID NO: 1184823 - RNA, 18 nt, Homo sapiens
acaaacuucaaagaggaa

SEQ ID NO: 1184824 - RNA, 18 nt, Homo sapiens
acaaacuucccugacucu

SEQ ID NO: 1184825 - RNA, 17 nt, Homo sapiens
acaaagcacaguuugaa

SEQ ID NO: 1184826 - RNA, 19 nt, Homo sapiens
acaaagcaguuacuaauau

SEQ ID NO: 1184827 - RNA, 16 nt, Homo sapiens
acaaaggaaguucucc

SEQ ID NO: 1184828 - RNA, 21 nt, Homo sapiens
acaaagugaggagaaugaaau

SEQ ID NO: 1184829 - RNA, 14 nt, Homo sapiens
acaaagugccaaag

SEQ ID NO: 1184830 - RNA, 18 nt, Homo sapiens
acaaauacucauguguau

SEQ ID NO: 1184831 - RNA, 22 nt, Homo sapiens
acaaauacuuagacaguaugca

SEQ ID NO: 1184832 - RNA, 12 nt, Homo sapiens
acaaaugcaggg

SEQ ID NO: 1184833 - RNA, 18 nt, Homo sapiens
acaaauuaagauguucag

SEQ ID NO: 1184834 - RNA, 16 nt, Homo sapiens
acaaauuaauauuugu

SEQ ID NO: 1184835 - RNA, 17 nt, Homo sapiens
acaaauuagcuaggcau

SEQ ID NO: 1184836 - RNA, 19 nt, Homo sapiens
acaaauucuuugacacuca

SEQ ID NO: 1184837 - RNA, 14 nt, Homo sapiens
acaaauugagacag

SEQ ID NO: 1184838 - RNA, 22 nt, Homo sapiens
acaacaaaggauuaauugcugc

SEQ ID NO: 1184839 - RNA, 13 nt, Homo sapiens
acaacacugggaa

SEQ ID NO: 1184840 - RNA, 12 nt, Homo sapiens
acaacacugugu

SEQ ID NO: 1184841 - RNA, 18 nt, Homo sapiens
acaacagaaaccaaaacu

SEQ ID NO: 1184842 - RNA, 20 nt, Homo sapiens
acaacagugugaucauuggu

SEQ ID NO: 1184843 - RNA, 17 nt, Homo sapiens
acaacauguauguggau

SEQ ID NO: 1184844 - RNA, 20 nt, Homo sapiens
acaaccaaaagucuucauca

SEQ ID NO: 1184845 - RNA, 15 nt, Homo sapiens
acaacgucucuucaa

SEQ ID NO: 1184846 - RNA, 23 nt, Homo sapiens
acaacugccggggguucaggguu

SEQ ID NO: 1184847 - RNA, 22 nt, Homo sapiens
acaacuuuuaaccaaacaauua

SEQ ID NO: 1184848 - RNA, 23 nt, Homo sapiens
acaagaaaaguugaagaagauau

SEQ ID NO: 1184849 - RNA, 11 nt, Homo sapiens
acaagaagcug

SEQ ID NO: 1184850 - RNA, 12 nt, Homo sapiens
acaagaaucacu

SEQ ID NO: 1184851 - RNA, 20 nt, Homo sapiens
acaagaccaccaacgugucc

SEQ ID NO: 1184852 - RNA, 22 nt, Homo sapiens
acaagacccaaguagcugcuac

SEQ ID NO: 1184853 - RNA, 18 nt, Homo sapiens
acaagacccccagcacuu

SEQ ID NO: 1184854 - RNA, 19 nt, Homo sapiens
acaagacccccagcacuug

SEQ ID NO: 1184855 - RNA, 17 nt, Homo sapiens
acaagacccucucaggc

SEQ ID NO: 1184856 - RNA, 14 nt, Homo sapiens
agcuaacacacuuu

SEQ ID NO: 1184857 - RNA, 14 nt, Homo sapiens
agcuaagaaccugg

SEQ ID NO: 1184858 - RNA, 12 nt, Homo sapiens
agcuacaacagc

SEQ ID NO: 1184859 - RNA, 13 nt, Homo sapiens
agcuacaacagcc

SEQ ID NO: 1184860 - RNA, 21 nt, Homo sapiens
agcuacaguuguccagaucac

SEQ ID NO: 1184861 - RNA, 16 nt, Homo sapiens
agcuaccucaaacuuc

SEQ ID NO: 1184862 - RNA, 21 nt, Homo sapiens
agcuaccucaaacuuccaguc

SEQ ID NO: 1184863 - RNA, 22 nt, Homo sapiens
agcuacucaggaggcugagaca

SEQ ID NO: 1184864 - RNA, 23 nt, Homo sapiens
agcuacugugugugugaaugaac

SEQ ID NO: 1184865 - RNA, 21 nt, Homo sapiens
agcuagaagugggccaggaca

SEQ ID NO: 1184866 - RNA, 20 nt, Homo sapiens
agcuaggaagagcaggacuc

SEQ ID NO: 1184867 - RNA, 17 nt, Homo sapiens
agcuaucaagaggcuga

SEQ ID NO: 1184868 - RNA, 17 nt, Homo sapiens
agcuaucaucaacacaa

SEQ ID NO: 1184869 - RNA, 20 nt, Homo sapiens
agcuaugauaagauugaaau

SEQ ID NO: 1184870 - RNA, 15 nt, Homo sapiens
agcuauucacagugc

SEQ ID NO: 1184871 - RNA, 22 nt, Homo sapiens
agcuauucuccauguacuggca

SEQ ID NO: 1184872 - RNA, 24 nt, Homo sapiens
agcuauuuaaaaaaaaaagaggaa

SEQ ID NO: 1184873 - RNA, 16 nt, Homo sapiens
agcuauuuaucuguag

SEQ ID NO: 1184874 - RNA, 14 nt, Homo sapiens
agcucacccacccc

SEQ ID NO: 1184875 - RNA, 15 nt, Homo sapiens
agcucagaguugaga

SEQ ID NO: 1184876 - RNA, 16 nt, Homo sapiens
agcucagcauuuccac

SEQ ID NO: 1184877 - RNA, 19 nt, Homo sapiens
agcucagcauuuccacacc

SEQ ID NO: 1184878 - RNA, 11 nt, Homo sapiens
agcuccaaagc

SEQ ID NO: 1184879 - RNA, 15 nt, Homo sapiens
agcuccaaccugcaa

SEQ ID NO: 1184880 - RNA, 13 nt, Homo sapiens
agcuccacagggc

SEQ ID NO: 1184881 - RNA, 17 nt, Homo sapiens
agcuccagcgauggugc

SEQ ID NO: 1184882 - RNA, 14 nt, Homo sapiens
agcucccagaguuu

SEQ ID NO: 1184883 - RNA, 16 nt, Homo sapiens
agcucccucgucuuca

SEQ ID NO: 1184884 - RNA, 15 nt, Homo sapiens
agcuccggccugucc

SEQ ID NO: 1184885 - RNA, 21 nt, Homo sapiens
agcuccgugaacuugugagaa

SEQ ID NO: 1184886 - RNA, 15 nt, Homo sapiens
agcuccuuaaggcuc

SEQ ID NO: 1184887 - RNA, 17 nt, Homo sapiens
agcucggcgaauucuca

SEQ ID NO: 1184888 - RNA, 20 nt, Homo sapiens
agcucgggcccucugugaga

SEQ ID NO: 1184889 - RNA, 23 nt, Homo sapiens
agcucguucucugggccuucuca

SEQ ID NO: 1184890 - RNA, 18 nt, Homo sapiens
agcucuacacaacaugua

SEQ ID NO: 1184891 - RNA, 15 nt, Homo sapiens
agcucuccccucaga

SEQ ID NO: 1184892 - RNA, 22 nt, Homo sapiens
agcucuccccucagagugcaag

SEQ ID NO: 1184893 - RNA, 16 nt, Homo sapiens
agcucuccugacuuuu

SEQ ID NO: 1184894 - RNA, 22 nt, Homo sapiens
agcucugacccacagccuccaa

SEQ ID NO: 1184895 - RNA, 19 nt, Homo sapiens
agcucuguaguggaauaug

SEQ ID NO: 1184896 - RNA, 16 nt, Homo sapiens
agcucuucaucugccc

SEQ ID NO: 1184897 - RNA, 14 nt, Homo sapiens
agcucuugugucau

SEQ ID NO: 1184898 - RNA, 23 nt, Homo sapiens
agcugaaagggaaggacagcugu

SEQ ID NO: 1184899 - RNA, 17 nt, Homo sapiens
agcugaagaguugcccc

SEQ ID NO: 1184900 - RNA, 22 nt, Homo sapiens
agcugacacagaaaaaggaugu

SEQ ID NO: 1184901 - RNA, 22 nt, Homo sapiens
agcugagacuacaagugugugc

SEQ ID NO: 1184902 - RNA, 18 nt, Homo sapiens
agcugagaucgugccacu

SEQ ID NO: 1184903 - RNA, 21 nt, Homo sapiens
agcugagaucgugccacugca

SEQ ID NO: 1184904 - RNA, 20 nt, Homo sapiens
agcugagauugcaccacugc

SEQ ID NO: 1184905 - RNA, 15 nt, Homo sapiens
agcugagccaggcua

SEQ ID NO: 1184906 - RNA, 14 nt, Homo sapiens
agcugagccugcag

SEQ ID NO: 1184907 - RNA, 14 nt, Homo sapiens
agcugagcugugac

SEQ ID NO: 1184908 - RNA, 21 nt, Homo sapiens
agcugagggagggagccaugg

SEQ ID NO: 1184909 - RNA, 11 nt, Homo sapiens
agcugaucagu

SEQ ID NO: 1184910 - RNA, 14 nt, Homo sapiens
agcugcacuacagc

SEQ ID NO: 1184911 - RNA, 19 nt, Homo sapiens
agcugcacugaugcugccc

SEQ ID NO: 1184912 - RNA, 19 nt, Homo sapiens
agcugcauuucacaugccu

SEQ ID NO: 1184913 - RNA, 13 nt, Homo sapiens
agcugcauuucag

SEQ ID NO: 1184914 - RNA, 22 nt, Homo sapiens
agcugccaagccccauccugcc

SEQ ID NO: 1184915 - RNA, 15 nt, Homo sapiens
agcugccaccaucac

SEQ ID NO: 1184916 - RNA, 18 nt, Homo sapiens
agcugccccacaggugug

SEQ ID NO: 1184917 - RNA, 14 nt, Homo sapiens
agcugccccgggga

SEQ ID NO: 1184918 - RNA, 16 nt, Homo sapiens
agcugccuuagcuuca

SEQ ID NO: 1184919 - RNA, 11 nt, Homo sapiens
agcugcucagg

SEQ ID NO: 1184920 - RNA, 15 nt, Homo sapiens
agcugcugacugcca

SEQ ID NO: 1184921 - RNA, 21 nt, Homo sapiens
agcugcuuugaggcaguucca

SEQ ID NO: 1184922 - RNA, 14 nt, Homo sapiens
agcuggaaaaccuc

SEQ ID NO: 1184923 - RNA, 17 nt, Homo sapiens
agcuggaaaagggucuu

SEQ ID NO: 1184924 - RNA, 15 nt, Homo sapiens
agcuggagugcugcu

SEQ ID NO: 1184925 - RNA, 15 nt, Homo sapiens
agcuggaugaugguc

SEQ ID NO: 1184926 - RNA, 15 nt, Homo sapiens
agcuggauucacuug

SEQ ID NO: 1184927 - RNA, 20 nt, Homo sapiens
agcugggucaggcagggugc

SEQ ID NO: 1184928 - RNA, 20 nt, Homo sapiens
agcugucgggggccacugug

SEQ ID NO: 1184929 - RNA, 20 nt, Homo sapiens
agcugugcugggugagcucu

SEQ ID NO: 1184930 - RNA, 22 nt, Homo sapiens
auugaccgcgacuaauuucaaa

SEQ ID NO: 1184931 - RNA, 21 nt, Homo sapiens
auugacucaaaaaugagguac

SEQ ID NO: 1184932 - RNA, 17 nt, Homo sapiens
auugagccaguggugcu

SEQ ID NO: 1184933 - RNA, 23 nt, Homo sapiens
auugauauacacggaugacuuaa

SEQ ID NO: 1184934 - RNA, 22 nt, Homo sapiens
auugaugaaugaggaacaauca

SEQ ID NO: 1184935 - RNA, 18 nt, Homo sapiens
auugauucaagugagcca

SEQ ID NO: 1184936 - RNA, 16 nt, Homo sapiens
auugauucaugucuca

SEQ ID NO: 1184937 - RNA, 20 nt, Homo sapiens
auugcaccuaucucagccau

SEQ ID NO: 1184938 - RNA, 19 nt, Homo sapiens
auugcagaaauacaguaug

SEQ ID NO: 1184939 - RNA, 20 nt, Homo sapiens
auugcagaaauacaguauga

SEQ ID NO: 1184940 - RNA, 16 nt, Homo sapiens
auugcagcagguggua

SEQ ID NO: 1184941 - RNA, 18 nt, Homo sapiens
auugcagcaggugguaau

SEQ ID NO: 1184942 - RNA, 18 nt, Homo sapiens
auugcaugugacucugaa

SEQ ID NO: 1184943 - RNA, 23 nt, Homo sapiens
auugcauuuaaaaauauauagcu

SEQ ID NO: 1184944 - RNA, 20 nt, Homo sapiens
auugccucugccuugccccu

SEQ ID NO: 1184945 - RNA, 18 nt, Homo sapiens
auugcucuauauguaaua

SEQ ID NO: 1184946 - RNA, 19 nt, Homo sapiens
auugcucucccagcccuug

SEQ ID NO: 1184947 - RNA, 23 nt, Homo sapiens
auugcugcaccaaugcacugagu

SEQ ID NO: 1184948 - RNA, 22 nt, Homo sapiens
auugcugccccaucagugcucc

SEQ ID NO: 1184949 - RNA, 20 nt, Homo sapiens
auugcuggcaucugugcuaa

SEQ ID NO: 1184950 - RNA, 11 nt, Homo sapiens
auugcuucaau

SEQ ID NO: 1184951 - RNA, 15 nt, Homo sapiens
auugcuuuauccaaa

SEQ ID NO: 1184952 - RNA, 14 nt, Homo sapiens
auuggaagagcaca

SEQ ID NO: 1184953 - RNA, 18 nt, Homo sapiens
auuggagugcagcuaaca

SEQ ID NO: 1184954 - RNA, 20 nt, Homo sapiens
auuggauaaaauaaaugcaa

SEQ ID NO: 1184955 - RNA, 20 nt, Homo sapiens
auuggaugcauuucuaucaa

SEQ ID NO: 1184956 - RNA, 18 nt, Homo sapiens
auuggcuacugacuguau

SEQ ID NO: 1184957 - RNA, 13 nt, Homo sapiens
auugguccaagau

SEQ ID NO: 1184958 - RNA, 13 nt, Homo sapiens
caugucuaaccug

SEQ ID NO: 1184959 - RNA, 20 nt, Homo sapiens
caugugacacauaugcaccu

SEQ ID NO: 1184960 - RNA, 18 nt, Homo sapiens
caugugacucugaagcug

SEQ ID NO: 1184961 - RNA, 18 nt, Homo sapiens
caugugacuuuuaucugu

SEQ ID NO: 1184962 - RNA, 17 nt, Homo sapiens
caugugccagggcaaug

SEQ ID NO: 1184963 - RNA, 21 nt, Homo sapiens
caugugcguccauauuuaaca

SEQ ID NO: 1184964 - RNA, 13 nt, Homo sapiens
caugugcugcaaa

SEQ ID NO: 1184965 - RNA, 18 nt, Homo sapiens
cauguguagccugugcau

SEQ ID NO: 1184966 - RNA, 14 nt, Homo sapiens
cauguguauauaug

SEQ ID NO: 1184967 - RNA, 21 nt, Homo sapiens
cauguguugcaccguucucug

SEQ ID NO: 1184968 - RNA, 15 nt, Homo sapiens
cauguuaacaugaca

SEQ ID NO: 1184969 - RNA, 16 nt, Homo sapiens
cauguuaacaugacau

SEQ ID NO: 1184970 - RNA, 16 nt, Homo sapiens
cauguucaugugauua

SEQ ID NO: 1184971 - RNA, 20 nt, Homo sapiens
cauguuuuaacaaaaaccaa

SEQ ID NO: 1184972 - RNA, 18 nt, Homo sapiens
cauguuuucuagccuuag

SEQ ID NO: 1184973 - RNA, 19 nt, Homo sapiens
cauguuuuuucugcaauga

SEQ ID NO: 1184974 - RNA, 19 nt, Homo sapiens
cauuaaaauaaaccaaaua

SEQ ID NO: 1184975 - RNA, 23 nt, Homo sapiens
cauuaaaauaaaccaaauauguu

SEQ ID NO: 1184976 - RNA, 20 nt, Homo sapiens
cauuaaauauaauaugcaca

SEQ ID NO: 1184977 - RNA, 20 nt, Homo sapiens
cauuaauaauaguuauuucu

SEQ ID NO: 1184978 - RNA, 17 nt, Homo sapiens
cauuacugcauaaaaua

SEQ ID NO: 1184979 - RNA, 12 nt, Homo sapiens
cauuacuuugag

SEQ ID NO: 1184980 - RNA, 20 nt, Homo sapiens
cauuagauuccuuuccugug

SEQ ID NO: 1184981 - RNA, 22 nt, Homo sapiens
cauuauaaauaaauaccaaaaa

SEQ ID NO: 1184982 - RNA, 18 nt, Homo sapiens
cauuauaacugaaggaga

SEQ ID NO: 1184983 - RNA, 14 nt, Homo sapiens
cauuauaugcacua

SEQ ID NO: 1184984 - RNA, 16 nt, Homo sapiens
cauuaucauguguaau

SEQ ID NO: 1184985 - RNA, 13 nt, Homo sapiens
cauuauccuugcu

SEQ ID NO: 1184986 - RNA, 19 nt, Homo sapiens
cauuauugacgaacuggcu

SEQ ID NO: 1184987 - RNA, 16 nt, Homo sapiens
cauuauuugauaacau

SEQ ID NO: 1184988 - RNA, 19 nt, Homo sapiens
cauuauuuuucacugcccc

SEQ ID NO: 1184989 - RNA, 17 nt, Homo sapiens
cauucagcaucagagag

SEQ ID NO: 1184990 - RNA, 15 nt, Homo sapiens
cauucaggucuuucu

SEQ ID NO: 1184991 - RNA, 9 nt, Homo sapiens
cauucaguc

SEQ ID NO: 1184992 - RNA, 19 nt, Homo sapiens
cauucaugugggcauuucu

SEQ ID NO: 1184993 - RNA, 16 nt, Homo sapiens
cauucauugacuucag

SEQ ID NO: 1184994 - RNA, 15 nt, Homo sapiens
cauuccaacucguau

SEQ ID NO: 1184995 - RNA, 13 nt, Homo sapiens
cauuccaagacag

SEQ ID NO: 1184996 - RNA, 14 nt, Homo sapiens
cauucccaaagggc

SEQ ID NO: 1184997 - RNA, 14 nt, Homo sapiens
cauucccacauucc

SEQ ID NO: 1184998 - RNA, 21 nt, Homo sapiens
cauucccugagucaccaggaa

SEQ ID NO: 1184999 - RNA, 14 nt, Homo sapiens
cauucuaagucaca

SEQ ID NO: 1185000 - RNA, 13 nt, Homo sapiens
cauucuacucaaa

SEQ ID NO: 1185001 - RNA, 14 nt, Homo sapiens
cauucuacugaaaa

SEQ ID NO: 1185002 - RNA, 19 nt, Homo sapiens
cauucuaggccuccuggcc

SEQ ID NO: 1185003 - RNA, 21 nt, Homo sapiens
cauucugcucuuugauucaaa

SEQ ID NO: 1185004 - RNA, 11 nt, Homo sapiens
cauucuucccg

SEQ ID NO: 1185005 - RNA, 21 nt, Homo sapiens
cauucuuucccaacaccucuu

SEQ ID NO: 1185006 - RNA, 14 nt, Homo sapiens
cauucuuugcaaua

SEQ ID NO: 1185007 - RNA, 23 nt, Homo sapiens
cauugaccgcgacuaauuucaaa

SEQ ID NO: 1185008 - RNA, 19 nt, Homo sapiens
cauugacucuguggcuuug

SEQ ID NO: 1185009 - RNA, 19 nt, Homo sapiens
cauugagccaguggugcua

SEQ ID NO: 1185010 - RNA, 19 nt, Homo sapiens
cauugaucugcauccaagg

SEQ ID NO: 1185011 - RNA, 16 nt, Homo sapiens
cauugauggggaagga

SEQ ID NO: 1185012 - RNA, 19 nt, Homo sapiens
cauugauucaguauuacaa

SEQ ID NO: 1185013 - RNA, 16 nt, Homo sapiens
cauugauucaugucuc

SEQ ID NO: 1185014 - RNA, 22 nt, Homo sapiens
cauugcaauuuugcauagcuuu

SEQ ID NO: 1185015 - RNA, 18 nt, Homo sapiens
cauugcagauucgaguca

SEQ ID NO: 1185016 - RNA, 15 nt, Homo sapiens
cauugcaguuuaaga

SEQ ID NO: 1185017 - RNA, 21 nt, Homo sapiens
cauugcuaaacugaugacuua

SEQ ID NO: 1185018 - RNA, 19 nt, Homo sapiens
cauugcucagaaaugucau

SEQ ID NO: 1185019 - RNA, 22 nt, Homo sapiens
cauugcucagaaaugucaugug

SEQ ID NO: 1185020 - RNA, 17 nt, Homo sapiens
cauugcuuuccacugag

SEQ ID NO: 1185021 - RNA, 14 nt, Homo sapiens
cauuggaugcauuu

SEQ ID NO: 1185022 - RNA, 21 nt, Homo sapiens
cauuggaugcauuucuaucaa

SEQ ID NO: 1185023 - RNA, 23 nt, Homo sapiens
cauuggcaaguguaaaaagauga

SEQ ID NO: 1185024 - RNA, 20 nt, Homo sapiens
cauuggccggcuucccaugc

SEQ ID NO: 1185025 - RNA, 23 nt, Homo sapiens
cauuguaaauaaauuuugugcaa

SEQ ID NO: 1185026 - RNA, 13 nt, Homo sapiens
cauugucugcaau

SEQ ID NO: 1185027 - RNA, 14 nt, Homo sapiens
cauugucugcaaug

SEQ ID NO: 1185028 - RNA, 15 nt, Homo sapiens
cauugugauguauau

SEQ ID NO: 1185029 - RNA, 13 nt, Homo sapiens
cauuguucaggaa

SEQ ID NO: 1185030 - RNA, 17 nt, Homo sapiens
cauuguuggaguguaaa

SEQ ID NO: 1185031 - RNA, 23 nt, Homo sapiens
cauuuaagucuguccauuaucua

SEQ ID NO: 1185032 - RNA, 20 nt, Homo sapiens
cauuuacaagugcugcaagu

SEQ ID NO: 1185033 - RNA, 20 nt, Homo sapiens
cauuuacagcccucagcaau

SEQ ID NO: 1185034 - RNA, 19 nt, Homo sapiens
cauuuagaugcacuaccau

SEQ ID NO: 1185035 - RNA, 22 nt, Homo sapiens
cauuuaguuugauuauucagug

SEQ ID NO: 1185036 - RNA, 14 nt, Homo sapiens
cauuuaucccucaa

SEQ ID NO: 1185037 - RNA, 19 nt, Homo sapiens
cauuuauuuaagacacugu

SEQ ID NO: 1185038 - RNA, 20 nt, Homo sapiens
cauuuauuuaagacacuguu

SEQ ID NO: 1185039 - RNA, 23 nt, Homo sapiens
cauuuauuuaagacacuguuaca

SEQ ID NO: 1185040 - RNA, 18 nt, Homo sapiens
cauuucauauucuuucaa

SEQ ID NO: 1185041 - RNA, 17 nt, Homo sapiens
cauuuccaaauucacaa

SEQ ID NO: 1185042 - RNA, 12 nt, Homo sapiens
cauuuccaugca

SEQ ID NO: 1185043 - RNA, 16 nt, Homo sapiens
cauuucccacccucca

SEQ ID NO: 1185044 - RNA, 15 nt, Homo sapiens
cauuuccucuguucu

SEQ ID NO: 1185045 - RNA, 17 nt, Homo sapiens
cauuucuacaaugcaca

SEQ ID NO: 1185046 - RNA, 23 nt, Homo sapiens
cauuucucauaccuuccccacau

SEQ ID NO: 1185047 - RNA, 20 nt, Homo sapiens
cauuugaauuggcauuuccc

SEQ ID NO: 1185048 - RNA, 22 nt, Homo sapiens
cauuugccaauuuuccuacucu

SEQ ID NO: 1185049 - RNA, 16 nt, Homo sapiens
cauuuggcaaugccau

SEQ ID NO: 1185050 - RNA, 18 nt, Homo sapiens
cauuuggccuugugcggu

SEQ ID NO: 1185051 - RNA, 12 nt, Homo sapiens
cauuuggcuuac

SEQ ID NO: 1185052 - RNA, 16 nt, Homo sapiens
cauuuguaccucgagu

SEQ ID NO: 1185053 - RNA, 16 nt, Homo sapiens
cauuuguuaaaauaca

SEQ ID NO: 1185054 - RNA, 14 nt, Homo sapiens
cauuuguugcugcu

SEQ ID NO: 1185055 - RNA, 21 nt, Homo sapiens
cauuuuaggcaaauguuuaaa

SEQ ID NO: 1185056 - RNA, 15 nt, Homo sapiens
cauuuuaucccaugg

SEQ ID NO: 1185057 - RNA, 18 nt, Homo sapiens
cauuuuaugauagauuug

SEQ ID NO: 1185058 - RNA, 20 nt, Homo sapiens
cauuuuauuuuuucuugcaa

SEQ ID NO: 1185059 - RNA, 21 nt, Homo sapiens
cauuuuauuuuuucuugcaaa

SEQ ID NO: 1185060 - RNA, 17 nt, Homo sapiens
cauuuucugccacccaa

SEQ ID NO: 1185061 - RNA, 12 nt, Homo sapiens
cauuuuggcaac

SEQ ID NO: 1185062 - RNA, 21 nt, Homo sapiens
cauuuuuauaaaaaugagugc

SEQ ID NO: 1185063 - RNA, 13 nt, Homo sapiens
cauuuuuaucccu

SEQ ID NO: 1185064 - RNA, 13 nt, Homo sapiens
cauuuuuccauga

SEQ ID NO: 1185065 - RNA, 19 nt, Homo sapiens
cauuuuucccuauuuuccu

SEQ ID NO: 1185066 - RNA, 14 nt, Homo sapiens
cauuuuugugagcc

SEQ ID NO: 1185067 - RNA, 21 nt, Homo sapiens
ccaaaaaaaaaaaagaguccu

SEQ ID NO: 1185068 - RNA, 20 nt, Homo sapiens
ccaaaaagacaagugcucaa

SEQ ID NO: 1185069 - RNA, 20 nt, Homo sapiens
ccaaaaagagcagcacagga

SEQ ID NO: 1185070 - RNA, 14 nt, Homo sapiens
ccaaaacaaaccca

SEQ ID NO: 1185071 - RNA, 18 nt, Homo sapiens
ccaaaaggccuuuggaaa

SEQ ID NO: 1185072 - RNA, 13 nt, Homo sapiens
ccaaacaauuuaa

SEQ ID NO: 1185073 - RNA, 21 nt, Homo sapiens
ccaaagagccuuuccaaagag

SEQ ID NO: 1185074 - RNA, 19 nt, Homo sapiens
ccaaagauguggguggcaa

SEQ ID NO: 1185075 - RNA, 19 nt, Homo sapiens
ccaaagcagacagcuccac

SEQ ID NO: 1185076 - RNA, 23 nt, Homo sapiens
ccaugcacccucauacacagaaa

SEQ ID NO: 1185077 - RNA, 19 nt, Homo sapiens
ccaugcauacguacauucc

SEQ ID NO: 1185078 - RNA, 11 nt, Homo sapiens
ccaugccugug

SEQ ID NO: 1185079 - RNA, 14 nt, Homo sapiens
ccauggacaggcug

SEQ ID NO: 1185080 - RNA, 18 nt, Homo sapiens
ccaugguagaaaaugcac

SEQ ID NO: 1185081 - RNA, 23 nt, Homo sapiens
ccaugguagaaaaugcaccaaau

SEQ ID NO: 1185082 - RNA, 21 nt, Homo sapiens
ccauguacuucccucuugaaa

SEQ ID NO: 1185083 - RNA, 20 nt, Homo sapiens
ccaugugcuagucacuggca

SEQ ID NO: 1185084 - RNA, 14 nt, Homo sapiens
ccauuagccggacu

SEQ ID NO: 1185085 - RNA, 21 nt, Homo sapiens
ccauucaggucuuucuuuccg

SEQ ID NO: 1185086 - RNA, 15 nt, Homo sapiens
ccauucccuuugcau

SEQ ID NO: 1185087 - RNA, 20 nt, Homo sapiens
ccauuccuauaguacuuuau

SEQ ID NO: 1185088 - RNA, 15 nt, Homo sapiens
ccauuggcuacugac

SEQ ID NO: 1185089 - RNA, 17 nt, Homo sapiens
ccauugggcuacuguag

SEQ ID NO: 1185090 - RNA, 16 nt, Homo sapiens
ccauugucagcucaau

SEQ ID NO: 1185091 - RNA, 20 nt, Homo sapiens
ccauuguuugaaacaaagaa

SEQ ID NO: 1185092 - RNA, 15 nt, Homo sapiens
ccauuuaaaaaacau

SEQ ID NO: 1185093 - RNA, 15 nt, Homo sapiens
ccauuucauugcuca

SEQ ID NO: 1185094 - RNA, 20 nt, Homo sapiens
ccauuucuacaaugcacauu

SEQ ID NO: 1185095 - RNA, 21 nt, Homo sapiens
cccaaaccggcaggugcgauu

SEQ ID NO: 1185096 - RNA, 18 nt, Homo sapiens
ugucaccccucacuguga

SEQ ID NO: 1185097 - RNA, 17 nt, Homo sapiens
ugucacuguacaguuuu

SEQ ID NO: 1185098 - RNA, 14 nt, Homo sapiens
ugucagagcccagg

SEQ ID NO: 1185099 - RNA, 14 nt, Homo sapiens
ugucagcaguuccc

SEQ ID NO: 1185100 - RNA, 22 nt, Homo sapiens
ugucagccaccucccucugcca

SEQ ID NO: 1185101 - RNA, 18 nt, Homo sapiens
ugucagccauugcaccca

SEQ ID NO: 1185102 - RNA, 16 nt, Homo sapiens
ugucaggaaacauuca

SEQ ID NO: 1185103 - RNA, 21 nt, Homo sapiens
ugucagguggacccuguaaau

SEQ ID NO: 1185104 - RNA, 18 nt, Homo sapiens
ugucaguaguuucuuauu

SEQ ID NO: 1185105 - RNA, 23 nt, Homo sapiens
ugucauaggauuaagcaguuuaa

SEQ ID NO: 1185106 - RNA, 15 nt, Homo sapiens
ugucaucaacauucu

SEQ ID NO: 1185107 - RNA, 20 nt, Homo sapiens
ugucaucagccaccauccua

SEQ ID NO: 1185108 - RNA, 19 nt, Homo sapiens
ugucaucauuaaaagcaag

SEQ ID NO: 1185109 - RNA, 15 nt, Homo sapiens
ugucaucugcugcga

SEQ ID NO: 1185110 - RNA, 15 nt, Homo sapiens
ugucaucugugcacu

SEQ ID NO: 1185111 - RNA, 15 nt, Homo sapiens
ugucaugcaugaagg

SEQ ID NO: 1185112 - RNA, 15 nt, Homo sapiens
ugucauuaaccaucu

SEQ ID NO: 1185113 - RNA, 16 nt, Homo sapiens
ugucauuaaccaucuu

SEQ ID NO: 1185114 - RNA, 20 nt, Homo sapiens
ugucauuaucaaaagugauc

SEQ ID NO: 1185115 - RNA, 19 nt, Homo sapiens
ugucauuauuccaucuucu

SEQ ID NO: 1185116 - RNA, 14 nt, Homo sapiens
uguccaacauggug

SEQ ID NO: 1185117 - RNA, 16 nt, Homo sapiens
uguccaacuaaaaaca

SEQ ID NO: 1185118 - RNA, 13 nt, Homo sapiens
uguccagcaccuu

SEQ ID NO: 1185119 - RNA, 15 nt, Homo sapiens
uguccaguugcagcu

SEQ ID NO: 1185120 - RNA, 18 nt, Homo sapiens
uguccaguuugugcucua

SEQ ID NO: 1185121 - RNA, 11 nt, Homo sapiens
uguccaugugu

SEQ ID NO: 1185122 - RNA, 13 nt, Homo sapiens
ugucccaagguga

SEQ ID NO: 1185123 - RNA, 16 nt, Homo sapiens
ugucccaggacucacc

SEQ ID NO: 1185124 - RNA, 15 nt, Homo sapiens
uguccccgccuuccc

SEQ ID NO: 1185125 - RNA, 19 nt, Homo sapiens
uguccccuaaaccaaaaac

SEQ ID NO: 1185126 - RNA, 17 nt, Homo sapiens
ugucccuugcuugccug

SEQ ID NO: 1185127 - RNA, 15 nt, Homo sapiens
uguccgaugcuggag

SEQ ID NO: 1185128 - RNA, 20 nt, Homo sapiens
uguccggaaugccacccaca

SEQ ID NO: 1185129 - RNA, 16 nt, Homo sapiens
uguccuaaaaagacac

SEQ ID NO: 1185130 - RNA, 20 nt, Homo sapiens
uguccuaacucuccucgcug

SEQ ID NO: 1185131 - RNA, 19 nt, Homo sapiens
uguccuagaaguucuuuga

SEQ ID NO: 1185132 - RNA, 18 nt, Homo sapiens
uguccucacugcugauua

SEQ ID NO: 1185133 - RNA, 18 nt, Homo sapiens
uguccuuuuucaggagaa

SEQ ID NO: 1185134 - RNA, 15 nt, Homo sapiens
ugucggcggcuugau

SEQ ID NO: 1185135 - RNA, 23 nt, Homo sapiens
ugucgguuugcuuugauuucccu

SEQ ID NO: 1185136 - RNA, 17 nt, Homo sapiens
ugucuaaacaaugcuga

SEQ ID NO: 1185137 - RNA, 18 nt, Homo sapiens
ugucuacauuaaaucacu

SEQ ID NO: 1185138 - RNA, 22 nt, Homo sapiens
ugucuauuguauauauaaucua

SEQ ID NO: 1185139 - RNA, 19 nt, Homo sapiens
ugucucaccuacccaugac

SEQ ID NO: 1185140 - RNA, 16 nt, Homo sapiens
ugucucagaccacuau

SEQ ID NO: 1185141 - RNA, 17 nt, Homo sapiens
ugucucagaccacuauu

SEQ ID NO: 1185142 - RNA, 19 nt, Homo sapiens
ugucuccaaaaggccuuug

SEQ ID NO: 1185143 - RNA, 22 nt, Homo sapiens
ugucuccacuucacuccagcau

SEQ ID NO: 1185144 - RNA, 21 nt, Homo sapiens
ugucuccaugugcguccauau

SEQ ID NO: 1185145 - RNA, 18 nt, Homo sapiens
ugucuccugaccugaaau

SEQ ID NO: 1185146 - RNA, 23 nt, Homo sapiens
ugucuccuuugaaguagacucau

SEQ ID NO: 1185147 - RNA, 21 nt, Homo sapiens
ugucucgaugcaaugaacacu

SEQ ID NO: 1185148 - RNA, 20 nt, Homo sapiens
ugucucuaaaggaagaaaua

SEQ ID NO: 1185149 - RNA, 23 nt, Homo sapiens
ugucucuacuuuucccuguacuu

SEQ ID NO: 1185150 - RNA, 21 nt, Homo sapiens
ugucucuuaacuuaccauucc

SEQ ID NO: 1185151 - RNA, 19 nt, Homo sapiens
ugucugcaauggugacuga

SEQ ID NO: 1185152 - RNA, 18 nt, Homo sapiens
ugucugcuaucauuauuc

SEQ ID NO: 1185153 - RNA, 11 nt, Homo sapiens
ugucuguaaaa

SEQ ID NO: 1185154 - RNA, 16 nt, Homo sapiens
ugucuguacuaaaaau

SEQ ID NO: 1185155 - RNA, 21 nt, Homo sapiens
ugucuguguuucuuuuugcca

SEQ ID NO: 1185156 - RNA, 16 nt, Homo sapiens
ugucuguuuguuguau

SEQ ID NO: 1185157 - RNA, 13 nt, Homo sapiens
ugucuucaccuga

SEQ ID NO: 1185158 - RNA, 13 nt, Homo sapiens
ugucuucuguaua

SEQ ID NO: 1185159 - RNA, 15 nt, Homo sapiens
ugucuugguugccag

SEQ ID NO: 1185160 - RNA, 16 nt, Homo sapiens
ugucuugguugccagu

SEQ ID NO: 1185161 - RNA, 16 nt, Homo sapiens
ugucuuuacuccauga

SEQ ID NO: 1185162 - RNA, 20 nt, Homo sapiens
ugucuuuggcagucugucau

SEQ ID NO: 1185163 - RNA, 18 nt, Homo sapiens
ugugaaacucuacccuga

SEQ ID NO: 1185164 - RNA, 16 nt, Homo sapiens
ugugaagcaaggagcu

SEQ ID NO: 1185165 - RNA, 18 nt, Homo sapiens
ugugaagggagaaaggga

SEQ ID NO: 1185166 - RNA, 22 nt, Homo sapiens
ugugaaucucuucucccuuuga

SEQ ID NO: 1185167 - RNA, 18 nt, Homo sapiens
ugugaaugugacuacuua

SEQ ID NO: 1185168 - RNA, 20 nt, Homo sapiens
ugugacacacuacaccacac

SEQ ID NO: 1185169 - RNA, 14 nt, Homo sapiens
ugugacacauaugc

SEQ ID NO: 1185170 - RNA, 21 nt, Homo sapiens
ugugaccaaaaguuacauguu

SEQ ID NO: 1185171 - RNA, 23 nt, Homo sapiens
ugugaccacugaagcaccacagg

SEQ ID NO: 1185172 - RNA, 17 nt, Homo sapiens
ugugacccuccaugcca

SEQ ID NO: 1185173 - RNA, 19 nt, Homo sapiens
ugugacccucucacuuugg

SEQ ID NO: 1185174 - RNA, 23 nt, Homo sapiens
ugugacuaaaaaugcaucuggcu

SEQ ID NO: 1185175 - RNA, 21 nt, Homo sapiens
ugugacuauaaagcuguuauu

SEQ ID NO: 1185176 - RNA, 15 nt, Homo sapiens
ugugagagacggugu

SEQ ID NO: 1185177 - RNA, 18 nt, Homo sapiens
ugugagccucuuuguaau

SEQ ID NO: 1185178 - RNA, 13 nt, Homo sapiens
ugugagugcucug

SEQ ID NO: 1185179 - RNA, 19 nt, Homo sapiens
ugugauaacuacucccagc

SEQ ID NO: 1185180 - RNA, 22 nt, Homo sapiens
ugugauaagaaaagccagucaa

SEQ ID NO: 1185181 - RNA, 17 nt, Homo sapiens
ugugaugggcuguuuaa

SEQ ID NO: 1185182 - RNA, 23 nt, Homo sapiens
ugugauuacugcaaucacugugc

SEQ ID NO: 1185183 - RNA, 13 nt, Homo sapiens
ugugauuagucaa

SEQ ID NO: 1185184 - RNA, 14 nt, Homo sapiens
ugugauuagugucu

SEQ ID NO: 1185185 - RNA, 14 nt, Homo sapiens
ugugauucuuugag

SEQ ID NO: 1185186 - RNA, 16 nt, Homo sapiens
ugugauuuaaaauacu

SEQ ID NO: 1185187 - RNA, 11 nt, Homo sapiens
ugugcacauuu

SEQ ID NO: 1185188 - RNA, 13 nt, Homo sapiens
ugugcacugcauu

SEQ ID NO: 1185189 - RNA, 18 nt, Homo sapiens
ugugcagcucccauuugg

SEQ ID NO: 1185190 - RNA, 17 nt, Homo sapiens
ugugcauguaugucuug

SEQ ID NO: 1185191 - RNA, 14 nt, Homo sapiens
ugugcccaucaucu

SEQ ID NO: 1185192 - RNA, 22 nt, Homo sapiens
ugugcccaucaucucugccuuu

SEQ ID NO: 1185193 - RNA, 20 nt, Homo sapiens
ugugccccagcagugccuug

SEQ ID NO: 1185194 - RNA, 13 nt, Homo sapiens
ugugcccugacca

SEQ ID NO: 1185195 - RNA, 15 nt, Homo sapiens
ugugcccuguucaaa

SEQ ID NO: 1185196 - RNA, 20 nt, Homo sapiens
ugugccuggcucugauucuu

SEQ ID NO: 1185197 - RNA, 19 nt, Homo sapiens
ugugccuuaggaaaagcau

SEQ ID NO: 1185198 - RNA, 16 nt, Homo sapiens
ugugccuuguucaagg

SEQ ID NO: 1185199 - RNA, 13 nt, Homo sapiens
ugugcgcacacau

SEQ ID NO: 1185200 - RNA, 22 nt, Homo sapiens
ugugcgcucuguggaugccagg

SEQ ID NO: 1185201 - RNA, 23 nt, Homo sapiens
ugugcguccauauuuaacaugua

SEQ ID NO: 1185202 - RNA, 19 nt, Homo sapiens
ugugcguggaaguguuccu

SEQ ID NO: 1185203 - RNA, 17 nt, Homo sapiens
ugugcuacgugugaaau

SEQ ID NO: 1185204 - RNA, 17 nt, Homo sapiens
ugugcuagucacuggca

SEQ ID NO: 1185205 - RNA, 17 nt, Homo sapiens
ugugcucuacuguuacu

SEQ ID NO: 1185206 - RNA, 21 nt, Homo sapiens
ugugcugguucuguuuucuaa

SEQ ID NO: 1185207 - RNA, 21 nt, Homo sapiens
ugugcuguagauucacauaca

SEQ ID NO: 1185208 - RNA, 14 nt, Homo sapiens
ugugcuucagugcc

SEQ ID NO: 1185209 - RNA, 15 nt, Homo sapiens
uguggacaccacuga

SEQ ID NO: 1185210 - RNA, 16 nt, Homo sapiens
uguggaccgaggaaca

SEQ ID NO: 1185211 - RNA, 12 nt, Homo sapiens
uguggaccugga

SEQ ID NO: 1185212 - RNA, 13 nt, Homo sapiens
uguggaguuuaca

SEQ ID NO: 1185213 - RNA, 19 nt, Homo sapiens
uguggauacagucauuauu

SEQ ID NO: 1185214 - RNA, 18 nt, Homo sapiens
uguggaucagguuuacua

SEQ ID NO: 1185215 - RNA, 15 nt, Homo sapiens
uguggcagcucuccc

SEQ ID NO: 1185216 - RNA, 15 nt, Homo sapiens
uguggcaucuugcca

SEQ ID NO: 1185217 - RNA, 19 nt, Homo sapiens
uguggccacuucuguccau

SEQ ID NO: 1185218 - RNA, 22 nt, Homo sapiens
uguggccacuuuccagggugga

SEQ ID NO: 1185219 - RNA, 14 nt, Homo sapiens
gauucugugucaga

SEQ ID NO: 1185220 - RNA, 16 nt, Homo sapiens
gauugaaauuccaguu

SEQ ID NO: 1185221 - RNA, 14 nt, Homo sapiens
gauugaacacugcg

SEQ ID NO: 1185222 - RNA, 20 nt, Homo sapiens
gauugagauguaagucucaa

SEQ ID NO: 1185223 - RNA, 15 nt, Homo sapiens
gauugcaauuugcac

SEQ ID NO: 1185224 - RNA, 23 nt, Homo sapiens
gauugccucugaagccuauguau

SEQ ID NO: 1185225 - RNA, 11 nt, Homo sapiens
gauugcuaaau

SEQ ID NO: 1185226 - RNA, 14 nt, Homo sapiens
gauugggauuucca

SEQ ID NO: 1185227 - RNA, 15 nt, Homo sapiens
gauugggauuuccau

SEQ ID NO: 1185228 - RNA, 21 nt, Homo sapiens
gauuggucuggguggauguga

SEQ ID NO: 1185229 - RNA, 17 nt, Homo sapiens
gauuguaaaguagcugu

SEQ ID NO: 1185230 - RNA, 18 nt, Homo sapiens
gauuguaaaguagcugua

SEQ ID NO: 1185231 - RNA, 20 nt, Homo sapiens
gauugugccacugcucucca

SEQ ID NO: 1185232 - RNA, 15 nt, Homo sapiens
gauuguuguuugcca

SEQ ID NO: 1185233 - RNA, 12 nt, Homo sapiens
gauuuaccucuu

SEQ ID NO: 1185234 - RNA, 18 nt, Homo sapiens
gauuuauuaaauaaucuc

SEQ ID NO: 1185235 - RNA, 22 nt, Homo sapiens
gauuuauuuccccucucaaagg

SEQ ID NO: 1185236 - RNA, 19 nt, Homo sapiens
gauuucccacugcacucca

SEQ ID NO: 1185237 - RNA, 21 nt, Homo sapiens
gauuucccacugcacuccagc

SEQ ID NO: 1185238 - RNA, 13 nt, Homo sapiens
gauuuccuugaau

SEQ ID NO: 1185239 - RNA, 14 nt, Homo sapiens
gauuucuugcuaag

SEQ ID NO: 1185240 - RNA, 23 nt, Homo sapiens
gauuuggaagggaaacuuucaaa

SEQ ID NO: 1185241 - RNA, 15 nt, Homo sapiens
gauuuggcugcacuu

SEQ ID NO: 1185242 - RNA, 18 nt, Homo sapiens
gauuuggucacacucuca

SEQ ID NO: 1185243 - RNA, 13 nt, Homo sapiens
gauuuggugacca

SEQ ID NO: 1185244 - RNA, 13 nt, Homo sapiens
gauuuuagucaaa

SEQ ID NO: 1185245 - RNA, 21 nt, Homo sapiens
gauuuuaucuguuaaccaaau

SEQ ID NO: 1185246 - RNA, 23 nt, Homo sapiens
gauuuuauuaauuauaaaaugca

SEQ ID NO: 1185247 - RNA, 23 nt, Homo sapiens
gauuuuuagaaaucagcuaccca

SEQ ID NO: 1185248 - RNA, 14 nt, Homo sapiens
gcaaaaaugcuaau

SEQ ID NO: 1185249 - RNA, 20 nt, Homo sapiens
gcaaaagaaagcaaauuauu

SEQ ID NO: 1185250 - RNA, 15 nt, Homo sapiens
gcaaaagagcuacuc

SEQ ID NO: 1185251 - RNA, 12 nt, Homo sapiens
gcaaaagguuua

SEQ ID NO: 1185252 - RNA, 21 nt, Homo sapiens
gcaaacacaagaaaucaaaau

SEQ ID NO: 1185253 - RNA, 22 nt, Homo sapiens
gcaaacaguggggugaucugca

SEQ ID NO: 1185254 - RNA, 14 nt, Homo sapiens
gcaaacugcugccu

SEQ ID NO: 1185255 - RNA, 17 nt, Homo sapiens
gcaaagcucuguggcca

SEQ ID NO: 1185256 - RNA, 20 nt, Homo sapiens
gcaaagcucuguggccacau

SEQ ID NO: 1185257 - RNA, 21 nt, Homo sapiens
gcaaaggaagcauacuuguga

SEQ ID NO: 1185258 - RNA, 17 nt, Homo sapiens
gcaaauaguaaucugua

SEQ ID NO: 1185259 - RNA, 15 nt, Homo sapiens
gcaaauccuauguga

SEQ ID NO: 1185260 - RNA, 15 nt, Homo sapiens
gcaaaucgugccuug

SEQ ID NO: 1185261 - RNA, 16 nt, Homo sapiens
gcaaaucgugccuugu

SEQ ID NO: 1185262 - RNA, 22 nt, Homo sapiens
gcaaaugacuaguaaacaugug

SEQ ID NO: 1185263 - RNA, 12 nt, Homo sapiens
gcaaaugcauuc

SEQ ID NO: 1185264 - RNA, 23 nt, Homo sapiens
gcaaaugcuguauucuucuuugg

SEQ ID NO: 1185265 - RNA, 19 nt, Homo sapiens
gcaaauggcagaaccaaag

SEQ ID NO: 1185266 - RNA, 16 nt, Homo sapiens
gcaaauuaguugguuu

SEQ ID NO: 1185267 - RNA, 15 nt, Homo sapiens
gucuuggacacugua

SEQ ID NO: 1185268 - RNA, 18 nt, Homo sapiens
gucuuggacacuguacaa

SEQ ID NO: 1185269 - RNA, 13 nt, Homo sapiens
gucuuuacuccuc

SEQ ID NO: 1185270 - RNA, 18 nt, Homo sapiens
gucuuugcagggcacaga

SEQ ID NO: 1185271 - RNA, 13 nt, Homo sapiens
gucuuuguggacu

SEQ ID NO: 1185272 - RNA, 21 nt, Homo sapiens
guguccccgcugcugugcaac

SEQ ID NO: 1185273 - RNA, 21 nt, Homo sapiens
gugucccuggcgcugugcuag

SEQ ID NO: 1185274 - RNA, 17 nt, Homo sapiens
gugucugagagcaaagu

SEQ ID NO: 1185275 - RNA, 13 nt, Homo sapiens
gugucuggcugca

SEQ ID NO: 1185276 - RNA, 18 nt, Homo sapiens
gugugagccaccacuccc

SEQ ID NO: 1185277 - RNA, 14 nt, Homo sapiens
gugugagugcucug

SEQ ID NO: 1185278 - RNA, 16 nt, Homo sapiens
gugugcguguuugcac

SEQ ID NO: 1185279 - RNA, 14 nt, Homo sapiens
guguggcauuugga

SEQ ID NO: 1185280 - RNA, 23 nt, Homo sapiens
gugugguguccccuccuuucuau

SEQ ID NO: 1185281 - RNA, 16 nt, Homo sapiens
ucagguauguugccuu

SEQ ID NO: 1185282 - RNA, 14 nt, Homo sapiens
ucagguccaauuug

SEQ ID NO: 1185283 - RNA, 19 nt, Homo sapiens
ucagguccuagggccucug

SEQ ID NO: 1185284 - RNA, 12 nt, Homo sapiens
ucagguggaccc

SEQ ID NO: 1185285 - RNA, 13 nt, Homo sapiens
ucaggugugacuc

SEQ ID NO: 1185286 - RNA, 19 nt, Homo sapiens
ucaguaauaaaaccgguca

SEQ ID NO: 1185287 - RNA, 22 nt, Homo sapiens
ucaguauuacaaauauauagca

SEQ ID NO: 1185288 - RNA, 19 nt, Homo sapiens
ucagucucugagcagugaa

SEQ ID NO: 1185289 - RNA, 12 nt, Homo sapiens
ucagucuugcug

SEQ ID NO: 1185290 - RNA, 19 nt, Homo sapiens
ucagugaauaugccuguaa

SEQ ID NO: 1185291 - RNA, 17 nt, Homo sapiens
ucaguguaccauuugcc

SEQ ID NO: 1185292 - RNA, 15 nt, Homo sapiens
ucaguuauuacaugu

SEQ ID NO: 1185293 - RNA, 16 nt, Homo sapiens
ucaguucucaaaugug

SEQ ID NO: 1185294 - RNA, 15 nt, Homo sapiens
ucauaaaacaaaucc

SEQ ID NO: 1185295 - RNA, 16 nt, Homo sapiens
ucauaaagucuugccu

SEQ ID NO: 1185296 - RNA, 15 nt, Homo sapiens
ucauaagaggaucaa

SEQ ID NO: 1185297 - RNA, 17 nt, Homo sapiens
ucauaagcgaucacuuc

SEQ ID NO: 1185298 - RNA, 17 nt, Homo sapiens
ucauaaucuuugcuuua

SEQ ID NO: 1185299 - RNA, 24 nt, Homo sapiens
ucauaccguguaccucaguucccu

SEQ ID NO: 1185300 - RNA, 22 nt, Homo sapiens
ucauacuccuuuuaagcaguga

SEQ ID NO: 1185301 - RNA, 11 nt, Homo sapiens
ucauaggcacu

SEQ ID NO: 1185302 - RNA, 22 nt, Homo sapiens
ucauagggaggccuuuagcuua

SEQ ID NO: 1185303 - RNA, 14 nt, Homo sapiens
ucauaguaacuucu

SEQ ID NO: 1185304 - RNA, 23 nt, Homo sapiens
ucauaguaagugcgaagacugag

SEQ ID NO: 1185305 - RNA, 20 nt, Homo sapiens
ucauagugccuuuuuccuua

SEQ ID NO: 1185306 - RNA, 14 nt, Homo sapiens
ucauauaagcuaua

SEQ ID NO: 1185307 - RNA, 20 nt, Homo sapiens
ucauaugcaaagcauauuaa

SEQ ID NO: 1185308 - RNA, 14 nt, Homo sapiens
ucauaugugcagua

SEQ ID NO: 1185309 - RNA, 14 nt, Homo sapiens
ucauauuagauuac

SEQ ID NO: 1185310 - RNA, 21 nt, Homo sapiens
ucauauuagauuacuaaguca

SEQ ID NO: 1185311 - RNA, 15 nt, Homo sapiens
ucauauuauuauuaa

SEQ ID NO: 1185312 - RNA, 23 nt, Homo sapiens
ucauauucacuauagaaugauau

SEQ ID NO: 1185313 - RNA, 18 nt, Homo sapiens
ucauauuguaaucuaugu

SEQ ID NO: 1185314 - RNA, 15 nt, Homo sapiens
ucaucacacacaugg

SEQ ID NO: 1185315 - RNA, 13 nt, Homo sapiens
ucaucacuaaaag

SEQ ID NO: 1185316 - RNA, 14 nt, Homo sapiens
ucaucauccaggag

SEQ ID NO: 1185317 - RNA, 16 nt, Homo sapiens
ucaucaugugugucca

SEQ ID NO: 1185318 - RNA, 12 nt, Homo sapiens
ucaucauucccu

SEQ ID NO: 1185319 - RNA, 18 nt, Homo sapiens
ucauccaaugcucaagaa

SEQ ID NO: 1185320 - RNA, 13 nt, Homo sapiens
ucauccugaacag

SEQ ID NO: 1185321 - RNA, 21 nt, Homo sapiens
ucauccugcuucucuuuuccu

SEQ ID NO: 1185322 - RNA, 12 nt, Homo sapiens
ucaucgucuuuu

SEQ ID NO: 1185323 - RNA, 15 nt, Homo sapiens
ucaucuaacgugcau

SEQ ID NO: 1185324 - RNA, 15 nt, Homo sapiens
ucaucuagcgcaauu

SEQ ID NO: 1185325 - RNA, 17 nt, Homo sapiens
ucaucuauaacaugcau

SEQ ID NO: 1185326 - RNA, 20 nt, Homo sapiens
ucaucucaggccucccucaa

SEQ ID NO: 1185327 - RNA, 20 nt, Homo sapiens
ucaucucucacacauuccag

SEQ ID NO: 1185328 - RNA, 16 nt, Homo sapiens
ucaucucucugcccaa

SEQ ID NO: 1185329 - RNA, 16 nt, Homo sapiens
ucaucucugccuuuga

SEQ ID NO: 1185330 - RNA, 20 nt, Homo sapiens
ucaucugccaacuguccuac

SEQ ID NO: 1185331 - RNA, 12 nt, Homo sapiens
ucaucuggcugc

SEQ ID NO: 1185332 - RNA, 15 nt, Homo sapiens
ucaucuucacugcaa

SEQ ID NO: 1185333 - RNA, 21 nt, Homo sapiens
ucaucuucccugccccugugc

SEQ ID NO: 1185334 - RNA, 23 nt, Homo sapiens
ucaucuuuauccuaaaaaucugg

SEQ ID NO: 1185335 - RNA, 10 nt, Homo sapiens
ucaugaaauu

SEQ ID NO: 1185336 - RNA, 18 nt, Homo sapiens
ucaugaagaaaagaccuu

SEQ ID NO: 1185337 - RNA, 12 nt, Homo sapiens
ucaugaugcuag

SEQ ID NO: 1185338 - RNA, 16 nt, Homo sapiens
ucaugaugcuucucag

SEQ ID NO: 1185339 - RNA, 16 nt, Homo sapiens
ucaugcaaaugcugua

SEQ ID NO: 1185340 - RNA, 20 nt, Homo sapiens
ucaugcacaguaaauucugc

SEQ ID NO: 1185341 - RNA, 11 nt, Homo sapiens
ucaugcacugu

SEQ ID NO: 1185342 - RNA, 19 nt, Homo sapiens
ucaugcagcaggugcaagg

SEQ ID NO: 1185343 - RNA, 20 nt, Homo sapiens
ucaugccaaguaucuuucca

SEQ ID NO: 1185344 - RNA, 13 nt, Homo sapiens
ucaugcccugugc

SEQ ID NO: 1185345 - RNA, 13 nt, Homo sapiens
ucaugccucugag

SEQ ID NO: 1185346 - RNA, 22 nt, Homo sapiens
ucaugcuggaaccugcaaaaaa

SEQ ID NO: 1185347 - RNA, 13 nt, Homo sapiens
ucauggacauuca

SEQ ID NO: 1185348 - RNA, 20 nt, Homo sapiens
ucauggaugggggaacucag

SEQ ID NO: 1185349 - RNA, 11 nt, Homo sapiens
ucauggcauau

SEQ ID NO: 1185350 - RNA, 16 nt, Homo sapiens
ucauggccacacugug

SEQ ID NO: 1185351 - RNA, 11 nt, Homo sapiens
ucaugggaccu

SEQ ID NO: 1185352 - RNA, 19 nt, Homo sapiens
ucaugggccccccaugcau

SEQ ID NO: 1185353 - RNA, 16 nt, Homo sapiens
ucauggugcuguugcc

SEQ ID NO: 1185354 - RNA, 16 nt, Homo sapiens
ucauguaaauacuguu

SEQ ID NO: 1185355 - RNA, 19 nt, Homo sapiens
ucauguagccccagucaga

SEQ ID NO: 1185356 - RNA, 21 nt, Homo sapiens
ucaugucucacgucucccuaa

SEQ ID NO: 1185357 - RNA, 19 nt, Homo sapiens
ucaugugccucuguccuua

SEQ ID NO: 1185358 - RNA, 22 nt, Homo sapiens
ucauguggguucaugcacagua

SEQ ID NO: 1185359 - RNA, 14 nt, Homo sapiens
ucauguuacuuccc

SEQ ID NO: 1185360 - RNA, 23 nt, Homo sapiens
ucauguucaucaauaccugcuga

SEQ ID NO: 1185361 - RNA, 19 nt, Homo sapiens
ucauguuuuuucugcaaug

SEQ ID NO: 1185362 - RNA, 13 nt, Homo sapiens
ucauuaaccaucu

SEQ ID NO: 1185363 - RNA, 18 nt, Homo sapiens
ucauuacuaaccauaguu

SEQ ID NO: 1185364 - RNA, 20 nt, Homo sapiens
ucauuagaacuucaagcucu

SEQ ID NO: 1185365 - RNA, 16 nt, Homo sapiens
ucauuaguauuucaca

SEQ ID NO: 1185366 - RNA, 18 nt, Homo sapiens
ucauucaacucuccaaug

SEQ ID NO: 1185367 - RNA, 14 nt, Homo sapiens
ucauucauucacuc

SEQ ID NO: 1185368 - RNA, 15 nt, Homo sapiens
ucauucucauucuca

SEQ ID NO: 1185369 - RNA, 21 nt, Homo sapiens
ucauucucugucucauccauc

SEQ ID NO: 1185370 - RNA, 23 nt, Homo sapiens
ucauugaagaccagcuuucucau

SEQ ID NO: 1185371 - RNA, 22 nt, Homo sapiens
ucauugcaccuaucucagccau

SEQ ID NO: 1185372 - RNA, 21 nt, Homo sapiens
ucauugcuaaacugaugacuu

SEQ ID NO: 1185373 - RNA, 20 nt, Homo sapiens
ucauugcuggugacucaugc

SEQ ID NO: 1185374 - RNA, 20 nt, Homo sapiens
ucauuggcauucuuugcaau

SEQ ID NO: 1185375 - RNA, 23 nt, Homo sapiens
ucauuguuggaguguaaaccaaa

SEQ ID NO: 1185376 - RNA, 21 nt, Homo sapiens
ucauuuauagaugucaggaaa

SEQ ID NO: 1185377 - RNA, 13 nt, Homo sapiens
ucauuucagccaa

SEQ ID NO: 1185378 - RNA, 14 nt, Homo sapiens
ucauuucauguaua

SEQ ID NO: 1185379 - RNA, 15 nt, Homo sapiens
ucauuucauguauag

SEQ ID NO: 1185380 - RNA, 18 nt, Homo sapiens
ucauuuucauauuguaau

SEQ ID NO: 1185381 - RNA, 18 nt, Homo sapiens
ucauuuuuguaucuacau

SEQ ID NO: 1185382 - RNA, 10 nt, Homo sapiens
uccaaaaaga

SEQ ID NO: 1185383 - RNA, 21 nt, Homo sapiens
uccaaaaagacaagugcucaa

SEQ ID NO: 1185384 - RNA, 24 nt, Homo sapiens
uccaaacagggguucuuagucuca

SEQ ID NO: 1185385 - RNA, 18 nt, Homo sapiens
uccaaacccaaccuuuca

SEQ ID NO: 1185386 - RNA, 16 nt, Homo sapiens
uccaaaccuccacugc

SEQ ID NO: 1185387 - RNA, 19 nt, Homo sapiens
uccaaaccuccacugcugc

SEQ ID NO: 1185388 - RNA, 23 nt, Homo sapiens
uccaaagaguagaauugcauuga

SEQ ID NO: 1185389 - RNA, 18 nt, Homo sapiens
uccaaaggaaauccaaaa

SEQ ID NO: 1185390 - RNA, 14 nt, Homo sapiens
uccaaaucuguccu

SEQ ID NO: 1185391 - RNA, 17 nt, Homo sapiens
uccaaaugcugugcaaa

SEQ ID NO: 1185392 - RNA, 22 nt, Homo sapiens
uccaaaugggaaggacaguuga

SEQ ID NO: 1185393 - RNA, 13 nt, Homo sapiens
uccaaauucacaa

SEQ ID NO: 1185394 - RNA, 17 nt, Homo sapiens
uccaacaccaagcacag

SEQ ID NO: 1185395 - RNA, 21 nt, Homo sapiens
uccaacaccaagcacagcagc

SEQ ID NO: 1185396 - RNA, 23 nt, Homo sapiens
uccaacagaccuggugcucuaau

SEQ ID NO: 1185397 - RNA, 18 nt, Homo sapiens
uccaacucuugguauuac

SEQ ID NO: 1185398 - RNA, 17 nt, Homo sapiens
uccaacugcaacucauc

SEQ ID NO: 1185399 - RNA, 18 nt, Homo sapiens
uccaacugcaacucauca

SEQ ID NO: 1185400 - RNA, 15 nt, Homo sapiens
uccaagaccagacuc

SEQ ID NO: 1185401 - RNA, 13 nt, Homo sapiens
uccaagcuguguu

SEQ ID NO: 1185402 - RNA, 18 nt, Homo sapiens
uccaaggcacacuguuaa

SEQ ID NO: 1185403 - RNA, 19 nt, Homo sapiens
uccaaggccgcggcccaga

SEQ ID NO: 1185404 - RNA, 17 nt, Homo sapiens
uccaaguuugacuugua

SEQ ID NO: 1185405 - RNA, 12 nt, Homo sapiens
uccaauacucag

SEQ ID NO: 1185406 - RNA, 12 nt, Homo sapiens
uccaaucagaac

SEQ ID NO: 1185407 - RNA, 16 nt, Homo sapiens
uccaaucuugagauug

SEQ ID NO: 1185408 - RNA, 16 nt, Homo sapiens
uccaaugaaaucucag

SEQ ID NO: 1185409 - RNA, 11 nt, Homo sapiens
uccaaugucaa

SEQ ID NO: 1185410 - RNA, 17 nt, Homo sapiens
uccaauuccugaucacc

SEQ ID NO: 1185411 - RNA, 17 nt, Homo sapiens
uccaauuccuugcacau

SEQ ID NO: 1185412 - RNA, 17 nt, Homo sapiens
uccaauuuuaauuuagu

SEQ ID NO: 1185413 - RNA, 12 nt, Homo sapiens
uccacaccaagc

SEQ ID NO: 1185414 - RNA, 17 nt, Homo sapiens
uccacaccuuuuauuga

SEQ ID NO: 1185415 - RNA, 12 nt, Homo sapiens
uccacacuguug

SEQ ID NO: 1185416 - RNA, 10 nt, Homo sapiens
uccacagcaa

SEQ ID NO: 1185417 - RNA, 17 nt, Homo sapiens
guguguauuuagugaaa

SEQ ID NO: 1185418 - RNA, 13 nt, Homo sapiens
gugugucauguca

SEQ ID NO: 1185419 - RNA, 14 nt, Homo sapiens
gugugugcacaucc

SEQ ID NO: 1185420 - RNA, 13 nt, Homo sapiens
gugugugccucau

SEQ ID NO: 1185421 - RNA, 13 nt, Homo sapiens
guguuagccagga

SEQ ID NO: 1185422 - RNA, 19 nt, Homo sapiens
guguucauccagcuacuua

SEQ ID NO: 1185423 - RNA, 20 nt, Homo sapiens
guguucucuggcucuugucc

SEQ ID NO: 1185424 - RNA, 12 nt, Homo sapiens
guguugacugcu

SEQ ID NO: 1185425 - RNA, 16 nt, Homo sapiens
guguugagaugauauu

SEQ ID NO: 1185426 - RNA, 21 nt, Homo sapiens
guguugcaaaucacucugcaa

SEQ ID NO: 1185427 - RNA, 13 nt, Homo sapiens
guguugcauaaac

SEQ ID NO: 1185428 - RNA, 15 nt, Homo sapiens
guguugggauuacag

SEQ ID NO: 1185429 - RNA, 13 nt, Homo sapiens
guguuuccuucag

SEQ ID NO: 1185430 - RNA, 18 nt, Homo sapiens
guguuuguagucuugucu

SEQ ID NO: 1185431 - RNA, 21 nt, Homo sapiens
guguuuguuucgccauggcuu

SEQ ID NO: 1185432 - RNA, 14 nt, Homo sapiens
guguuuucagcaaa

SEQ ID NO: 1185433 - RNA, 19 nt, Homo sapiens
guuaaaauguuuacuguaa

SEQ ID NO: 1185434 - RNA, 19 nt, Homo sapiens
guuaaacagccuauuccug

SEQ ID NO: 1185435 - RNA, 14 nt, Homo sapiens
guuaaauauuguca

SEQ ID NO: 1185436 - RNA, 17 nt, Homo sapiens
guuaauaaacugcaaau

SEQ ID NO: 1185437 - RNA, 14 nt, Homo sapiens
guuaaucacaggau

SEQ ID NO: 1185438 - RNA, 14 nt, Homo sapiens
guuaaucuccucag

SEQ ID NO: 1185439 - RNA, 20 nt, Homo sapiens
guuaaugaaggugugcuaca

SEQ ID NO: 1185440 - RNA, 21 nt, Homo sapiens
guuacaauaaaacuaaaugug

SEQ ID NO: 1185441 - RNA, 15 nt, Homo sapiens
guuacaugcauacuu

SEQ ID NO: 1185442 - RNA, 18 nt, Homo sapiens
guuacauguuugcaccuu

SEQ ID NO: 1185443 - RNA, 12 nt, Homo sapiens
guuaccaagaag

SEQ ID NO: 1185444 - RNA, 17 nt, Homo sapiens
guuaccacauuacucug

SEQ ID NO: 1185445 - RNA, 20 nt, Homo sapiens
guuaccucaaggccuacuga

SEQ ID NO: 1185446 - RNA, 13 nt, Homo sapiens
guuaccugcacac

SEQ ID NO: 1185447 - RNA, 13 nt, Homo sapiens
guuaccuuuucau

SEQ ID NO: 1185448 - RNA, 20 nt, Homo sapiens
guuacucuguaaaugaaaaa

SEQ ID NO: 1185449 - RNA, 24 nt, Homo sapiens
guuacuggcuucucuugagucaca

SEQ ID NO: 1185450 - RNA, 21 nt, Homo sapiens
guuacuguguuuaucuugaua

SEQ ID NO: 1185451 - RNA, 14 nt, Homo sapiens
guuagcaucuggcu

SEQ ID NO: 1185452 - RNA, 15 nt, Homo sapiens
guuaguaucaucaga

SEQ ID NO: 1185453 - RNA, 22 nt, Homo sapiens
guuagucuacucuuaagccauc

SEQ ID NO: 1185454 - RNA, 15 nt, Homo sapiens
guuagugacauuuaa

SEQ ID NO: 1185455 - RNA, 16 nt, Homo sapiens
guuauaguaacaucaa

SEQ ID NO: 1185456 - RNA, 21 nt, Homo sapiens
guuauuucaaccagcacauuc

SEQ ID NO: 1185457 - RNA, 14 nt, Homo sapiens
guuauuuuccauuu

SEQ ID NO: 1185458 - RNA, 17 nt, Homo sapiens
guucaaaaaacuuguaa

SEQ ID NO: 1185459 - RNA, 12 nt, Homo sapiens
guucaaagccag

SEQ ID NO: 1185460 - RNA, 19 nt, Homo sapiens
guucaacauguaccucacc

SEQ ID NO: 1185461 - RNA, 16 nt, Homo sapiens
guucaagugcucuuca

SEQ ID NO: 1185462 - RNA, 12 nt, Homo sapiens
guucagccuuug

SEQ ID NO: 1185463 - RNA, 21 nt, Homo sapiens
guucaggguugguagcaggga

SEQ ID NO: 1185464 - RNA, 21 nt, Homo sapiens
guucaguuugucucuuugcaa

SEQ ID NO: 1185465 - RNA, 14 nt, Homo sapiens
guucauauucacua

SEQ ID NO: 1185466 - RNA, 21 nt, Homo sapiens
guucaucaauaccugcugaga

SEQ ID NO: 1185467 - RNA, 17 nt, Homo sapiens
guucauuuguggugaua

SEQ ID NO: 1185468 - RNA, 14 nt, Homo sapiens
guucccccugugca

SEQ ID NO: 1185469 - RNA, 21 nt, Homo sapiens
guuccgaagaagaugcuccag

SEQ ID NO: 1185470 - RNA, 18 nt, Homo sapiens
guuccucucccuucccuu

SEQ ID NO: 1185471 - RNA, 22 nt, Homo sapiens
guuccuuaugacuuuucaugca

SEQ ID NO: 1185472 - RNA, 16 nt, Homo sapiens
guucgagaccaaccug

SEQ ID NO: 1185473 - RNA, 18 nt, Homo sapiens
guucgcgcaccagguguc

SEQ ID NO: 1185474 - RNA, 23 nt, Homo sapiens
guucggagcucuucugugcccug

SEQ ID NO: 1185475 - RNA, 23 nt, Homo sapiens
guucuaaggggaccuacagacag

SEQ ID NO: 1185476 - RNA, 13 nt, Homo sapiens
guucuacuugaua

SEQ ID NO: 1185477 - RNA, 14 nt, Homo sapiens
guucuaguuugcau

SEQ ID NO: 1185478 - RNA, 14 nt, Homo sapiens
guucucauaacucu

SEQ ID NO: 1185479 - RNA, 22 nt, Homo sapiens
guucucggggaugcauagauuc

SEQ ID NO: 1185480 - RNA, 18 nt, Homo sapiens
guucucggggcucaggag

SEQ ID NO: 1185481 - RNA, 13 nt, Homo sapiens
guucucucucauu

SEQ ID NO: 1185482 - RNA, 21 nt, Homo sapiens
guucucucuuaguaacauaga

SEQ ID NO: 1185483 - RNA, 19 nt, Homo sapiens
guucugcugagacugagca

SEQ ID NO: 1185484 - RNA, 19 nt, Homo sapiens
guucuggggggacccagug

SEQ ID NO: 1185485 - RNA, 19 nt, Homo sapiens
guucuggguguugaccacu

SEQ ID NO: 1185486 - RNA, 16 nt, Homo sapiens
guucuguagagccaau

SEQ ID NO: 1185487 - RNA, 20 nt, Homo sapiens
guucugugauacagaacucu

SEQ ID NO: 1185488 - RNA, 12 nt, Homo sapiens
guucuucagaga

SEQ ID NO: 1185489 - RNA, 23 nt, Homo sapiens
guucuucccuuuuacauacugcu

SEQ ID NO: 1185490 - RNA, 15 nt, Homo sapiens
guucuucuuccugaa

SEQ ID NO: 1185491 - RNA, 18 nt, Homo sapiens
guucuuuaaaggcaucua

SEQ ID NO: 1185492 - RNA, 21 nt, Homo sapiens
guucuuucuuacacaagagcu

SEQ ID NO: 1185493 - RNA, 14 nt, Homo sapiens
guucuuugggccag

SEQ ID NO: 1185494 - RNA, 16 nt, Homo sapiens
guugaccacuccagag

SEQ ID NO: 1185495 - RNA, 19 nt, Homo sapiens
guugaccaggcuggucuca

SEQ ID NO: 1185496 - RNA, 14 nt, Homo sapiens
guugacugcugcuc

SEQ ID NO: 1185497 - RNA, 22 nt, Homo sapiens
guugagaccuuugauuuuugcc

SEQ ID NO: 1185498 - RNA, 16 nt, Homo sapiens
guugagcuauugcugu

SEQ ID NO: 1185499 - RNA, 16 nt, Homo sapiens
guugauaauucuuauu

SEQ ID NO: 1185500 - RNA, 10 nt, Homo sapiens
guugaugacu

SEQ ID NO: 1185501 - RNA, 14 nt, Homo sapiens
guugaugccagaca

SEQ ID NO: 1185502 - RNA, 17 nt, Homo sapiens
guugauuagacuuuuga

SEQ ID NO: 1185503 - RNA, 20 nt, Homo sapiens
guugcaaaucacucugcaau

SEQ ID NO: 1185504 - RNA, 22 nt, Homo sapiens
guugcaaaucacucugcaaugg

SEQ ID NO: 1185505 - RNA, 16 nt, Homo sapiens
guugcagucuaaccca

SEQ ID NO: 1185506 - RNA, 15 nt, Homo sapiens
guugcaucaacaaag

SEQ ID NO: 1185507 - RNA, 23 nt, Homo sapiens
guugcccaggcuagagugcaaug

SEQ ID NO: 1185508 - RNA, 15 nt, Homo sapiens
guugccucucuuuga

SEQ ID NO: 1185509 - RNA, 18 nt, Homo sapiens
guugcuagucuaguuucc

SEQ ID NO: 1185510 - RNA, 12 nt, Homo sapiens
guugcuauaaua

SEQ ID NO: 1185511 - RNA, 17 nt, Homo sapiens
guugcuuuuaagucuuc

SEQ ID NO: 1185512 - RNA, 13 nt, Homo sapiens
guuggaacauccu

SEQ ID NO: 1185513 - RNA, 13 nt, Homo sapiens
guuggaagcuugu

SEQ ID NO: 1185514 - RNA, 14 nt, Homo sapiens
guuggaagcuuguu

SEQ ID NO: 1185515 - RNA, 15 nt, Homo sapiens
guuggaauuccacgc

SEQ ID NO: 1185516 - RNA, 16 nt, Homo sapiens
guuggaccuauugcca

SEQ ID NO: 1185517 - RNA, 21 nt, Homo sapiens
guuggaggcaugcuaagaaua

SEQ ID NO: 1185518 - RNA, 15 nt, Homo sapiens
guuggcagcauucca

SEQ ID NO: 1185519 - RNA, 18 nt, Homo sapiens
guuggccucagggccagg

SEQ ID NO: 1185520 - RNA, 21 nt, Homo sapiens
guuggccucagggccaggaag

SEQ ID NO: 1185521 - RNA, 22 nt, Homo sapiens
guuggucaggcuggucucaaac

SEQ ID NO: 1185522 - RNA, 13 nt, Homo sapiens
guuggugacaauu

SEQ ID NO: 1185523 - RNA, 15 nt, Homo sapiens
guugguuuaaugcaa

SEQ ID NO: 1185524 - RNA, 12 nt, Homo sapiens
guugguuugugu

SEQ ID NO: 1185525 - RNA, 16 nt, Homo sapiens
guuguauaaagcaaaa

SEQ ID NO: 1185526 - RNA, 16 nt, Homo sapiens
guugucacuaagucag

SEQ ID NO: 1185527 - RNA, 21 nt, Homo sapiens
guugucucauagaacugccug

SEQ ID NO: 1185528 - RNA, 15 nt, Homo sapiens
guuuaaaacagaagc

SEQ ID NO: 1185529 - RNA, 16 nt, Homo sapiens
guuuaaacaucacuug

SEQ ID NO: 1185530 - RNA, 17 nt, Homo sapiens
guuuaaaguacugagca

SEQ ID NO: 1185531 - RNA, 19 nt, Homo sapiens
guuuaaaguacugagcagu

SEQ ID NO: 1185532 - RNA, 14 nt, Homo sapiens
guuuaacugugcau

SEQ ID NO: 1185533 - RNA, 17 nt, Homo sapiens
guuuaaucccagcacuu

SEQ ID NO: 1185534 - RNA, 21 nt, Homo sapiens
guuuaauucuguuaacugaag

SEQ ID NO: 1185535 - RNA, 18 nt, Homo sapiens
guuuacuuccccuaugga

SEQ ID NO: 1185536 - RNA, 14 nt, Homo sapiens
guuuacuuugccaa

SEQ ID NO: 1185537 - RNA, 15 nt, Homo sapiens
guuuagauaaaggaa

SEQ ID NO: 1185538 - RNA, 17 nt, Homo sapiens
guuuagugcaucuuugc

SEQ ID NO: 1185539 - RNA, 18 nt, Homo sapiens
uccaccagagcaggggcu

SEQ ID NO: 1185540 - RNA, 14 nt, Homo sapiens
uccaccccauguca

SEQ ID NO: 1185541 - RNA, 19 nt, Homo sapiens
uccaccccgacugcucagu

SEQ ID NO: 1185542 - RNA, 22 nt, Homo sapiens
uccaccccuccccaucuggacc

SEQ ID NO: 1185543 - RNA, 19 nt, Homo sapiens
uccaccccuuguuccaucu

SEQ ID NO: 1185544 - RNA, 20 nt, Homo sapiens
uccaccccuuguuuagcaua

SEQ ID NO: 1185545 - RNA, 22 nt, Homo sapiens
uccaccccuuguuuagcauaua

SEQ ID NO: 1185546 - RNA, 19 nt, Homo sapiens
uccaccuucuacgcaauug

SEQ ID NO: 1185547 - RNA, 22 nt, Homo sapiens
uccaccuuucagcccacgucac

SEQ ID NO: 1185548 - RNA, 13 nt, Homo sapiens
uccacuacugcua

SEQ ID NO: 1185549 - RNA, 15 nt, Homo sapiens
uccacuauggaaaag

SEQ ID NO: 1185550 - RNA, 13 nt, Homo sapiens
uccacucaguugc

SEQ ID NO: 1185551 - RNA, 23 nt, Homo sapiens
uccacucaugugacucuuuccaa

SEQ ID NO: 1185552 - RNA, 17 nt, Homo sapiens
uccacucccacugccag

SEQ ID NO: 1185553 - RNA, 21 nt, Homo sapiens
uccacugaaguagugugcagu

SEQ ID NO: 1185554 - RNA, 22 nt, Homo sapiens
uccacuuaccuagauucuacau

SEQ ID NO: 1185555 - RNA, 14 nt, Homo sapiens
uccacuucacucca

SEQ ID NO: 1185556 - RNA, 21 nt, Homo sapiens
uccacuucacuccagcaucaa

SEQ ID NO: 1185557 - RNA, 18 nt, Homo sapiens
uccacuuggaaauggcau

SEQ ID NO: 1185558 - RNA, 16 nt, Homo sapiens
uccacuuguucagggc

SEQ ID NO: 1185559 - RNA, 18 nt, Homo sapiens
uccacuuuaugugcaucu

SEQ ID NO: 1185560 - RNA, 19 nt, Homo sapiens
uccagaaauguuugcugag

SEQ ID NO: 1185561 - RNA, 23 nt, Homo sapiens
uccagaagcaaaaacaaaccaug

SEQ ID NO: 1185562 - RNA, 14 nt, Homo sapiens
uccagaagcugccc

SEQ ID NO: 1185563 - RNA, 19 nt, Homo sapiens
uccagaagcuguacuuuua

SEQ ID NO: 1185564 - RNA, 12 nt, Homo sapiens
uccagacagucg

SEQ ID NO: 1185565 - RNA, 20 nt, Homo sapiens
uccagacuuccuugagacac

SEQ ID NO: 1185566 - RNA, 14 nt, Homo sapiens
uccagagcugcuuc

SEQ ID NO: 1185567 - RNA, 13 nt, Homo sapiens
uccagauauacuu

SEQ ID NO: 1185568 - RNA, 17 nt, Homo sapiens
uccagaugagaguacac

SEQ ID NO: 1185569 - RNA, 20 nt, Homo sapiens
uccagaugagaguacacccc

SEQ ID NO: 1185570 - RNA, 15 nt, Homo sapiens
uccagcauggaugaa

SEQ ID NO: 1185571 - RNA, 16 nt, Homo sapiens
uccagcauuuagcugg

SEQ ID NO: 1185572 - RNA, 17 nt, Homo sapiens
uccagccccuuuccaaa

SEQ ID NO: 1185573 - RNA, 21 nt, Homo sapiens
uccagcccgaguggucuccuc

SEQ ID NO: 1185574 - RNA, 17 nt, Homo sapiens
uccagccucauaaagua

SEQ ID NO: 1185575 - RNA, 11 nt, Homo sapiens
uccagccuuug

SEQ ID NO: 1185576 - RNA, 18 nt, Homo sapiens
uccagcuaacauacuaua

SEQ ID NO: 1185577 - RNA, 20 nt, Homo sapiens
uccagcuaacauacuauaua

SEQ ID NO: 1185578 - RNA, 18 nt, Homo sapiens
uccagcuccaaccugcaa

SEQ ID NO: 1185579 - RNA, 14 nt, Homo sapiens
uccagcucuaaguc

SEQ ID NO: 1185580 - RNA, 16 nt, Homo sapiens
uccagcuguacuguag

SEQ ID NO: 1185581 - RNA, 21 nt, Homo sapiens
uccagcuuagaaugcaucuca

SEQ ID NO: 1185582 - RNA, 17 nt, Homo sapiens
uccagcuugccagaugc

SEQ ID NO: 1185583 - RNA, 20 nt, Homo sapiens
uccagcuugggcaacagagc

SEQ ID NO: 1185584 - RNA, 20 nt, Homo sapiens
uccaggacagggaagggagc

SEQ ID NO: 1185585 - RNA, 16 nt, Homo sapiens
uccaggacugugccag

SEQ ID NO: 1185586 - RNA, 17 nt, Homo sapiens
uccaggcuggagugcaa

SEQ ID NO: 1185587 - RNA, 19 nt, Homo sapiens
uccaggcuggagugcaaug

SEQ ID NO: 1185588 - RNA, 16 nt, Homo sapiens
uccagggcaaggccau

SEQ ID NO: 1185589 - RNA, 12 nt, Homo sapiens
uccagggcuccc

SEQ ID NO: 1185590 - RNA, 17 nt, Homo sapiens
uccagguaacuuugaag

SEQ ID NO: 1185591 - RNA, 12 nt, Homo sapiens
uccaggugcaga

SEQ ID NO: 1185592 - RNA, 15 nt, Homo sapiens
uccagucagugugca

SEQ ID NO: 1185593 - RNA, 16 nt, Homo sapiens
uccagucccaugaccu

SEQ ID NO: 1185594 - RNA, 13 nt, Homo sapiens
uccagucucucca

SEQ ID NO: 1185595 - RNA, 17 nt, Homo sapiens
uccaguucauaaacaac

SEQ ID NO: 1185596 - RNA, 18 nt, Homo sapiens
uccaguucauaaacaaca

SEQ ID NO: 1185597 - RNA, 18 nt, Homo sapiens
uccauaaguuuaacuuua

SEQ ID NO: 1185598 - RNA, 14 nt, Homo sapiens
uccauacuuuggau

SEQ ID NO: 1185599 - RNA, 19 nt, Homo sapiens
uccauagagcagugcacau

SEQ ID NO: 1185600 - RNA, 19 nt, Homo sapiens
uccauagcaccauuccuca

SEQ ID NO: 1185601 - RNA, 18 nt, Homo sapiens
uccauaucagaagugcca

SEQ ID NO: 1185602 - RNA, 17 nt, Homo sapiens
uccauaugucauugcua

SEQ ID NO: 1185603 - RNA, 17 nt, Homo sapiens
uccauauuuaacaugua

SEQ ID NO: 1185604 - RNA, 18 nt, Homo sapiens
uccaucaaaccuuugcca

SEQ ID NO: 1185605 - RNA, 19 nt, Homo sapiens
uccaucaaaccuuugccaa

SEQ ID NO: 1185606 - RNA, 21 nt, Homo sapiens
uccaucacugccgucccaaau

SEQ ID NO: 1185607 - RNA, 16 nt, Homo sapiens
uccaucagcacaaaga

SEQ ID NO: 1185608 - RNA, 13 nt, Homo sapiens
uccaucagcuaaa

SEQ ID NO: 1185609 - RNA, 13 nt, Homo sapiens
uccauccauguac

SEQ ID NO: 1185610 - RNA, 22 nt, Homo sapiens
uccauccuccucuccaugcaag

SEQ ID NO: 1185611 - RNA, 17 nt, Homo sapiens
uccauccugcucaggaa

SEQ ID NO: 1185612 - RNA, 23 nt, Homo sapiens
uccauccugcucaggaaaccaca

SEQ ID NO: 1185613 - RNA, 13 nt, Homo sapiens
uccauccuugacu

SEQ ID NO: 1185614 - RNA, 13 nt, Homo sapiens
uccaucucucauc

SEQ ID NO: 1185615 - RNA, 19 nt, Homo sapiens
uccaucugacaaauucaaa

SEQ ID NO: 1185616 - RNA, 12 nt, Homo sapiens
uccaucugucca

SEQ ID NO: 1185617 - RNA, 17 nt, Homo sapiens
uccaucuguccguccag

SEQ ID NO: 1185618 - RNA, 21 nt, Homo sapiens
uccaucuucagaccuuuggac

SEQ ID NO: 1185619 - RNA, 15 nt, Homo sapiens
uccaugaacaccaua

SEQ ID NO: 1185620 - RNA, 13 nt, Homo sapiens
uccaugcuuucac

SEQ ID NO: 1185621 - RNA, 23 nt, Homo sapiens
uccaugguccugucuguccuucu

SEQ ID NO: 1185622 - RNA, 19 nt, Homo sapiens
uccauucuggaaacaccug

SEQ ID NO: 1185623 - RNA, 19 nt, Homo sapiens
uccauugguuuaccuguga

SEQ ID NO: 1185624 - RNA, 20 nt, Homo sapiens
uccauuuauucuuugaucuu

SEQ ID NO: 1185625 - RNA, 19 nt, Homo sapiens
uccauuucccacaucuuuc

SEQ ID NO: 1185626 - RNA, 20 nt, Homo sapiens
uccauuucguuuagcugaau

SEQ ID NO: 1185627 - RNA, 19 nt, Homo sapiens
uccauuucuacaaugcaca

SEQ ID NO: 1185628 - RNA, 14 nt, Homo sapiens
uccauuuugccuga

SEQ ID NO: 1185629 - RNA, 20 nt, Homo sapiens
ucccaaagugcugagauuac

SEQ ID NO: 1185630 - RNA, 17 nt, Homo sapiens
ucccaacguuuuacaua

SEQ ID NO: 1185631 - RNA, 22 nt, Homo sapiens
ucccaagagcuuccagagcucu

SEQ ID NO: 1185632 - RNA, 22 nt, Homo sapiens
ucccaaugguguuuuucuugua

SEQ ID NO: 1185633 - RNA, 17 nt, Homo sapiens
ucccacacuugugccag

SEQ ID NO: 1185634 - RNA, 18 nt, Homo sapiens
ucccaccuuggagcauuu

SEQ ID NO: 1185635 - RNA, 11 nt, Homo sapiens
ucccacuaaug

SEQ ID NO: 1185636 - RNA, 13 nt, Homo sapiens
ucccacuaucugg

SEQ ID NO: 1185637 - RNA, 20 nt, Homo sapiens
ucccacugcucccccaacac

SEQ ID NO: 1185638 - RNA, 17 nt, Homo sapiens
ucccagacacauucaca

SEQ ID NO: 1185639 - RNA, 13 nt, Homo sapiens
ucccagagcugca

SEQ ID NO: 1185640 - RNA, 17 nt, Homo sapiens
ucccagagugcugggau

SEQ ID NO: 1185641 - RNA, 23 nt, Homo sapiens
ucccagauuuaggguacuuuuau

SEQ ID NO: 1185642 - RNA, 15 nt, Homo sapiens
ucccagcuacuagag

SEQ ID NO: 1185643 - RNA, 15 nt, Homo sapiens
ucccagcuacucggg

SEQ ID NO: 1185644 - RNA, 23 nt, Homo sapiens
ucccaggaguacaccccaacagc

SEQ ID NO: 1185645 - RNA, 13 nt, Homo sapiens
ucccagugccuuc

SEQ ID NO: 1185646 - RNA, 16 nt, Homo sapiens
ucccaucugugguuuu

SEQ ID NO: 1185647 - RNA, 17 nt, Homo sapiens
ucccauuggaugcauuu

SEQ ID NO: 1185648 - RNA, 18 nt, Homo sapiens
ucccauuugggcaguaua

SEQ ID NO: 1185649 - RNA, 18 nt, Homo sapiens
uccccaaagccacuggaa

SEQ ID NO: 1185650 - RNA, 13 nt, Homo sapiens
uccccacccaaga

SEQ ID NO: 1185651 - RNA, 16 nt, Homo sapiens
uccccagcagggucuu

SEQ ID NO: 1185652 - RNA, 18 nt, Homo sapiens
uccccagggcugucaucu

SEQ ID NO: 1185653 - RNA, 13 nt, Homo sapiens
uccccagggggca

SEQ ID NO: 1185654 - RNA, 15 nt, Homo sapiens
ucccccaaacauguu

SEQ ID NO: 1185655 - RNA, 14 nt, Homo sapiens
ucccccaaccaagg

SEQ ID NO: 1185656 - RNA, 16 nt, Homo sapiens
ucccccacgucucucu

SEQ ID NO: 1185657 - RNA, 17 nt, Homo sapiens
ucccccaguauguccuu

SEQ ID NO: 1185658 - RNA, 14 nt, Homo sapiens
uccccggcaugaga

SEQ ID NO: 1185659 - RNA, 20 nt, Homo sapiens
uccccgggucucucacuguu

SEQ ID NO: 1185660 - RNA, 22 nt, Homo sapiens
uccccgggucucucacuguugc

SEQ ID NO: 1185661 - RNA, 13 nt, Homo sapiens
uccccguccacag

SEQ ID NO: 1185662 - RNA, 16 nt, Homo sapiens
uccccuaaaccaaaaa

SEQ ID NO: 1185663 - RNA, 16 nt, Homo sapiens
uccccuauuaggcagg

SEQ ID NO: 1185664 - RNA, 19 nt, Homo sapiens
uccccucagcgggggccuu

SEQ ID NO: 1185665 - RNA, 19 nt, Homo sapiens
uccccucgcccaucagugc

SEQ ID NO: 1185666 - RNA, 19 nt, Homo sapiens
uccccugaagaauccccca

SEQ ID NO: 1185667 - RNA, 15 nt, Homo sapiens
uccccugaccuguga

SEQ ID NO: 1185668 - RNA, 16 nt, Homo sapiens
uccccugaccugugag

SEQ ID NO: 1185669 - RNA, 21 nt, Homo sapiens
uccccuguuucaaucacuguc

SEQ ID NO: 1185670 - RNA, 15 nt, Homo sapiens
uccccuuccacugag

SEQ ID NO: 1185671 - RNA, 22 nt, Homo sapiens
uccccuugggcucucaccacuu

SEQ ID NO: 1185672 - RNA, 19 nt, Homo sapiens
uccccuuugguuuuacuac

SEQ ID NO: 1185673 - RNA, 19 nt, Homo sapiens
uccccuuuugccaaucuca

SEQ ID NO: 1185674 - RNA, 14 nt, Homo sapiens
uggaaagacuugaa

SEQ ID NO: 1185675 - RNA, 17 nt, Homo sapiens
uggaaagaggcugcugg

SEQ ID NO: 1185676 - RNA, 23 nt, Homo sapiens
uggaaagguucuaaggggaccua

SEQ ID NO: 1185677 - RNA, 20 nt, Homo sapiens
uggaaaguggugcaugguca

SEQ ID NO: 1185678 - RNA, 17 nt, Homo sapiens
uggaacaagcacagaug

SEQ ID NO: 1185679 - RNA, 23 nt, Homo sapiens
uggaacaggaugauggcacugag

SEQ ID NO: 1185680 - RNA, 20 nt, Homo sapiens
uggaacaugcuuuuacuuua

SEQ ID NO: 1185681 - RNA, 22 nt, Homo sapiens
uggaacuguacaaauugugaug

SEQ ID NO: 1185682 - RNA, 18 nt, Homo sapiens
uggaacuugaacugauuc

SEQ ID NO: 1185683 - RNA, 22 nt, Homo sapiens
uggaagaaaauuaggccucaaa

SEQ ID NO: 1185684 - RNA, 20 nt, Homo sapiens
uggaagaggugggugguggg

SEQ ID NO: 1185685 - RNA, 20 nt, Homo sapiens
uggaaguaaaggcauuccac

SEQ ID NO: 1185686 - RNA, 15 nt, Homo sapiens
uggaagucaucucau

SEQ ID NO: 1185687 - RNA, 20 nt, Homo sapiens
uggaagucaucucauuccac

SEQ ID NO: 1185688 - RNA, 13 nt, Homo sapiens
uggaagucucaaa

SEQ ID NO: 1185689 - RNA, 21 nt, Homo sapiens
uggaauauaaggaaagcaaua

SEQ ID NO: 1185690 - RNA, 15 nt, Homo sapiens
uggaaucccacugua

SEQ ID NO: 1185691 - RNA, 18 nt, Homo sapiens
uggaaugucaguguucag

SEQ ID NO: 1185692 - RNA, 17 nt, Homo sapiens
uggaauugcagcuguac

SEQ ID NO: 1185693 - RNA, 21 nt, Homo sapiens
uggaauugcagcuguacugag

SEQ ID NO: 1185694 - RNA, 14 nt, Homo sapiens
uggacacagaggaa

SEQ ID NO: 1185695 - RNA, 20 nt, Homo sapiens
uggacacccucaccacccaa

SEQ ID NO: 1185696 - RNA, 18 nt, Homo sapiens
uggacacugugcuacuga

SEQ ID NO: 1185697 - RNA, 16 nt, Homo sapiens
uggacacugugguuau

SEQ ID NO: 1185698 - RNA, 15 nt, Homo sapiens
uggacagaagcagcu

SEQ ID NO: 1185699 - RNA, 17 nt, Homo sapiens
uggacagcuuuucccaa

SEQ ID NO: 1185700 - RNA, 17 nt, Homo sapiens
uggacaugcgugaccag

SEQ ID NO: 1185701 - RNA, 22 nt, Homo sapiens
uggacaugcuucagugcugcuc

SEQ ID NO: 1185702 - RNA, 23 nt, Homo sapiens
uggaccacaggaggugugauaga

SEQ ID NO: 1185703 - RNA, 21 nt, Homo sapiens
uggaccacuccugaaugagac

SEQ ID NO: 1185704 - RNA, 17 nt, Homo sapiens
uggaccagccucuccac

SEQ ID NO: 1185705 - RNA, 19 nt, Homo sapiens
uggacccagggaacagcca

SEQ ID NO: 1185706 - RNA, 15 nt, Homo sapiens
uggaccuugagcauc

SEQ ID NO: 1185707 - RNA, 12 nt, Homo sapiens
uggacucagaga

SEQ ID NO: 1185708 - RNA, 17 nt, Homo sapiens
uggacucugcacauguc

SEQ ID NO: 1185709 - RNA, 14 nt, Homo sapiens
uggacugugccugg

SEQ ID NO: 1185710 - RNA, 19 nt, Homo sapiens
uggacuguggcacuugccu

SEQ ID NO: 1185711 - RNA, 15 nt, Homo sapiens
uggacuuaccgagca

SEQ ID NO: 1185712 - RNA, 21 nt, Homo sapiens
uggacuuguccucagcagcug

SEQ ID NO: 1185713 - RNA, 19 nt, Homo sapiens
uggagaaagggcagaggaa

SEQ ID NO: 1185714 - RNA, 22 nt, Homo sapiens
uggagaaauuccuugauucaca

SEQ ID NO: 1185715 - RNA, 22 nt, Homo sapiens
uggagaacuaaagguggccaca

SEQ ID NO: 1185716 - RNA, 14 nt, Homo sapiens
uggagaacuucaua

SEQ ID NO: 1185717 - RNA, 23 nt, Homo sapiens
uggagaagcucaucagaaacuca

SEQ ID NO: 1185718 - RNA, 22 nt, Homo sapiens
uggagagauuuaaagaauucuc

SEQ ID NO: 1185719 - RNA, 22 nt, Homo sapiens
uggagauggacaacucaaugaa

SEQ ID NO: 1185720 - RNA, 19 nt, Homo sapiens
uggagcagaaauucaccuc

SEQ ID NO: 1185721 - RNA, 17 nt, Homo sapiens
uggagcauggacagugu

SEQ ID NO: 1185722 - RNA, 23 nt, Homo sapiens
uggagcccgugcccuaccacaca

SEQ ID NO: 1185723 - RNA, 22 nt, Homo sapiens
uggagccgagcggggagccagg

SEQ ID NO: 1185724 - RNA, 23 nt, Homo sapiens
uggaggacagugggaacuggagg

SEQ ID NO: 1185725 - RNA, 22 nt, Homo sapiens
uggaggaccgccccacccugga

SEQ ID NO: 1185726 - RNA, 21 nt, Homo sapiens
uggaggagaggagaaaugucc

SEQ ID NO: 1185727 - RNA, 20 nt, Homo sapiens
uggaggcagugucauuugcu

SEQ ID NO: 1185728 - RNA, 14 nt, Homo sapiens
uggaguacaguggu

SEQ ID NO: 1185729 - RNA, 18 nt, Homo sapiens
uggaguacagugguguga

SEQ ID NO: 1185730 - RNA, 14 nt, Homo sapiens
uggagucaccaaaa

SEQ ID NO: 1185731 - RNA, 18 nt, Homo sapiens
uggagucaccaaaaccag

SEQ ID NO: 1185732 - RNA, 17 nt, Homo sapiens
uggagucaccuguaaau

SEQ ID NO: 1185733 - RNA, 13 nt, Homo sapiens
uggaguccagcuc

SEQ ID NO: 1185734 - RNA, 20 nt, Homo sapiens
uggagucuugcaagacccag

SEQ ID NO: 1185735 - RNA, 17 nt, Homo sapiens
uggagugagacccagga

SEQ ID NO: 1185736 - RNA, 17 nt, Homo sapiens
uggagugagaugaagga

SEQ ID NO: 1185737 - RNA, 18 nt, Homo sapiens
uggagugcaguggugcga

SEQ ID NO: 1185738 - RNA, 14 nt, Homo sapiens
uggaguuaacauca

SEQ ID NO: 1185739 - RNA, 19 nt, Homo sapiens
uggauaagugcuaccuuaa

SEQ ID NO: 1185740 - RNA, 21 nt, Homo sapiens
uggauauaaauuaauugugcc

SEQ ID NO: 1185741 - RNA, 18 nt, Homo sapiens
uggauauuauucuuguag

SEQ ID NO: 1185742 - RNA, 20 nt, Homo sapiens
uggauauucgguaauaucau

SEQ ID NO: 1185743 - RNA, 16 nt, Homo sapiens
uggauauuuguacugu

SEQ ID NO: 1185744 - RNA, 19 nt, Homo sapiens
uggauauuuguacuguuua

SEQ ID NO: 1185745 - RNA, 20 nt, Homo sapiens
uggaucaguccuuugaucag

SEQ ID NO: 1185746 - RNA, 14 nt, Homo sapiens
uggaucuaccagca

SEQ ID NO: 1185747 - RNA, 17 nt, Homo sapiens
uggaucucauccaucca

SEQ ID NO: 1185748 - RNA, 15 nt, Homo sapiens
uggaugaagcagaga

SEQ ID NO: 1185749 - RNA, 14 nt, Homo sapiens
uggaugcauguucu

SEQ ID NO: 1185750 - RNA, 18 nt, Homo sapiens
uggaugcauuucuaucaa

SEQ ID NO: 1185751 - RNA, 13 nt, Homo sapiens
uggaugcuccuuc

SEQ ID NO: 1185752 - RNA, 14 nt, Homo sapiens
uggauggauucauc

SEQ ID NO: 1185753 - RNA, 23 nt, Homo sapiens
uggaugggggaacucagauccag

SEQ ID NO: 1185754 - RNA, 23 nt, Homo sapiens
uggauucaauucgacuucuuucc

SEQ ID NO: 1185755 - RNA, 18 nt, Homo sapiens
uggauuucacggagacag

SEQ ID NO: 1185756 - RNA, 17 nt, Homo sapiens
uggcaagaccccaccuc

SEQ ID NO: 1185757 - RNA, 12 nt, Homo sapiens
uggcaagccaca

SEQ ID NO: 1185758 - RNA, 18 nt, Homo sapiens
uggcaaggagccagggaa

SEQ ID NO: 1185759 - RNA, 13 nt, Homo sapiens
uggcaagucacag

SEQ ID NO: 1185760 - RNA, 15 nt, Homo sapiens
uggcaaugaaacaaa

SEQ ID NO: 1185761 - RNA, 20 nt, Homo sapiens
uggcacauuuuucucuuguu

SEQ ID NO: 1185762 - RNA, 14 nt, Homo sapiens
uggcacuauccaga

SEQ ID NO: 1185763 - RNA, 13 nt, Homo sapiens
uggcacugcauac

SEQ ID NO: 1185764 - RNA, 17 nt, Homo sapiens
uggcacuguuugccauu

SEQ ID NO: 1185765 - RNA, 21 nt, Homo sapiens
uggcagaagggaauugcucag

SEQ ID NO: 1185766 - RNA, 20 nt, Homo sapiens
uggcagaaucccccaaagaa

SEQ ID NO: 1185767 - RNA, 13 nt, Homo sapiens
uggcagacugugu

SEQ ID NO: 1185768 - RNA, 13 nt, Homo sapiens
uggcagcacggcc

SEQ ID NO: 1185769 - RNA, 20 nt, Homo sapiens
uggcaggccccagcccugca

SEQ ID NO: 1185770 - RNA, 15 nt, Homo sapiens
uggcauaaaucugaa

SEQ ID NO: 1185771 - RNA, 19 nt, Homo sapiens
uggcauccagggcugccag

SEQ ID NO: 1185772 - RNA, 14 nt, Homo sapiens
uggcaucuugccaa

SEQ ID NO: 1185773 - RNA, 17 nt, Homo sapiens
uggcaugagaaauacaa

SEQ ID NO: 1185774 - RNA, 19 nt, Homo sapiens
uggcaugauccaagcaaga

SEQ ID NO: 1185775 - RNA, 20 nt, Homo sapiens
uggcauguggguugugauau

SEQ ID NO: 1185776 - RNA, 15 nt, Homo sapiens
uggcauugaucuuaa

SEQ ID NO: 1185777 - RNA, 19 nt, Homo sapiens
uggccaagaaaauugccuu

SEQ ID NO: 1185778 - RNA, 18 nt, Homo sapiens
uggccaaggagcugcuau

SEQ ID NO: 1185779 - RNA, 16 nt, Homo sapiens
uggccaaugcauccaa

SEQ ID NO: 1185780 - RNA, 16 nt, Homo sapiens
uggccacagacagcuu

SEQ ID NO: 1185781 - RNA, 16 nt, Homo sapiens
uggccacugaaaagcu

SEQ ID NO: 1185782 - RNA, 19 nt, Homo sapiens
uggccacuuuccagggugg

SEQ ID NO: 1185783 - RNA, 17 nt, Homo sapiens
uggucuggguggaugug

SEQ ID NO: 1185784 - RNA, 16 nt, Homo sapiens
uggucuugaacuccug

SEQ ID NO: 1185785 - RNA, 20 nt, Homo sapiens
uggugaaaccguaucucuaa

SEQ ID NO: 1185786 - RNA, 23 nt, Homo sapiens
uggugaaagaaaauucuuggaau

SEQ ID NO: 1185787 - RNA, 12 nt, Homo sapiens
uggugacuccag

SEQ ID NO: 1185788 - RNA, 20 nt, Homo sapiens
uggugacuucacagugaagu

SEQ ID NO: 1185789 - RNA, 19 nt, Homo sapiens
uggugagaugcagcuggaa

SEQ ID NO: 1185790 - RNA, 21 nt, Homo sapiens
uggugcaugccuguagucuca

SEQ ID NO: 1185791 - RNA, 22 nt, Homo sapiens
uggugccccaggaccagcucag

SEQ ID NO: 1185792 - RNA, 16 nt, Homo sapiens
uggugcgggcaccugu

SEQ ID NO: 1185793 - RNA, 14 nt, Homo sapiens
uggugcugcucaua

SEQ ID NO: 1185794 - RNA, 12 nt, Homo sapiens
uggugcugcuuu

SEQ ID NO: 1185795 - RNA, 20 nt, Homo sapiens
ugguggagagaagugagaau

SEQ ID NO: 1185796 - RNA, 15 nt, Homo sapiens
ugguggagcagagug

SEQ ID NO: 1185797 - RNA, 20 nt, Homo sapiens
ugguggcaacauucauugcc

SEQ ID NO: 1185798 - RNA, 17 nt, Homo sapiens
ugguggcacacaccagu

SEQ ID NO: 1185799 - RNA, 24 nt, Homo sapiens
ugguggcacaggaguguccucuuc

SEQ ID NO: 1185800 - RNA, 17 nt, Homo sapiens
ugguggcucacaccugu

SEQ ID NO: 1185801 - RNA, 21 nt, Homo sapiens
ugguggcucacaccuguaauc

SEQ ID NO: 1185802 - RNA, 22 nt, Homo sapiens
ugguggggcccauggaggagac

SEQ ID NO: 1185803 - RNA, 17 nt, Homo sapiens
uggugucuccuuuacua

SEQ ID NO: 1185804 - RNA, 13 nt, Homo sapiens
uggugugaucucg

SEQ ID NO: 1185805 - RNA, 23 nt, Homo sapiens
uggugugaucucggcucacugca

SEQ ID NO: 1185806 - RNA, 16 nt, Homo sapiens
uggugugugccuguag

SEQ ID NO: 1185807 - RNA, 21 nt, Homo sapiens
ugguguuauguuuauguaaca

SEQ ID NO: 1185808 - RNA, 18 nt, Homo sapiens
ugguuaccaccagccuuu

SEQ ID NO: 1185809 - RNA, 17 nt, Homo sapiens
ugguuaguuaacacuga

SEQ ID NO: 1185810 - RNA, 17 nt, Homo sapiens
ugguuauccugugcuac

SEQ ID NO: 1185811 - RNA, 13 nt, Homo sapiens
ugguuaugaacuu

SEQ ID NO: 1185812 - RNA, 22 nt, Homo sapiens
ugguucauccaucaucugcugc

SEQ ID NO: 1185813 - RNA, 13 nt, Homo sapiens
ugguucauguguu

SEQ ID NO: 1185814 - RNA, 17 nt, Homo sapiens
ugguucccagccccgcg

SEQ ID NO: 1185815 - RNA, 19 nt, Homo sapiens
ugguucccccacugaucac

SEQ ID NO: 1185816 - RNA, 18 nt, Homo sapiens
ugguucguucuguacugu

SEQ ID NO: 1185817 - RNA, 21 nt, Homo sapiens
ugguucucacugccuccuaca

SEQ ID NO: 1185818 - RNA, 18 nt, Homo sapiens
ugguuggcaacaggccaa

SEQ ID NO: 1185819 - RNA, 17 nt, Homo sapiens
ugguuguauaaagcaaa

SEQ ID NO: 1185820 - RNA, 14 nt, Homo sapiens
ugguuuaaagcaaa

SEQ ID NO: 1185821 - RNA, 13 nt, Homo sapiens
ugguuuuuacuca

SEQ ID NO: 1185822 - RNA, 20 nt, Homo sapiens
ugguuuuuacucaaccaaau

SEQ ID NO: 1185823 - RNA, 13 nt, Homo sapiens
uguaaaagaugca

SEQ ID NO: 1185824 - RNA, 15 nt, Homo sapiens
uguaaaaggccuuca

SEQ ID NO: 1185825 - RNA, 14 nt, Homo sapiens
uguaaaaucuugca

SEQ ID NO: 1185826 - RNA, 22 nt, Homo sapiens
uguaaaauguuuuagcaauuua

SEQ ID NO: 1185827 - RNA, 13 nt, Homo sapiens
uguaaaccaaaua

SEQ ID NO: 1185828 - RNA, 15 nt, Homo sapiens
uguaaacugugcacc

SEQ ID NO: 1185829 - RNA, 14 nt, Homo sapiens
uguaaagaucuaca

SEQ ID NO: 1185830 - RNA, 13 nt, Homo sapiens
uguaaagauguca

SEQ ID NO: 1185831 - RNA, 14 nt, Homo sapiens
uguaaaguagcugu

SEQ ID NO: 1185832 - RNA, 20 nt, Homo sapiens
uguaaauaugaaucugcuca

SEQ ID NO: 1185833 - RNA, 16 nt, Homo sapiens
uguaaaucuugccuuu

SEQ ID NO: 1185834 - RNA, 19 nt, Homo sapiens
uguaaaugaagggucauuu

SEQ ID NO: 1185835 - RNA, 15 nt, Homo sapiens
uguaaaugcuauuau

SEQ ID NO: 1185836 - RNA, 15 nt, Homo sapiens
uguaaauuucucaaa

SEQ ID NO: 1185837 - RNA, 20 nt, Homo sapiens
uguaaauuuuucagcuauuu

SEQ ID NO: 1185838 - RNA, 15 nt, Homo sapiens
uguaacaagccagau

SEQ ID NO: 1185839 - RNA, 19 nt, Homo sapiens
uguaacacccuuccucuga

SEQ ID NO: 1185840 - RNA, 21 nt, Homo sapiens
uguaacauccggcaaaacuga

SEQ ID NO: 1185841 - RNA, 19 nt, Homo sapiens
uguaacaugcaauuuugca

SEQ ID NO: 1185842 - RNA, 16 nt, Homo sapiens
uguaaccaccucucug

SEQ ID NO: 1185843 - RNA, 18 nt, Homo sapiens
uguaaccuaccuuaucau

SEQ ID NO: 1185844 - RNA, 22 nt, Homo sapiens
uguaacuuuguugcauuuuggc

SEQ ID NO: 1185845 - RNA, 22 nt, Homo sapiens
uguaagaauuucccagugaaau

SEQ ID NO: 1185846 - RNA, 22 nt, Homo sapiens
uguaaguuuaccuauguaacaa

SEQ ID NO: 1185847 - RNA, 23 nt, Homo sapiens
uguaauaauggaagccaaaguau

SEQ ID NO: 1185848 - RNA, 17 nt, Homo sapiens
uguaaucccagcacuuu

SEQ ID NO: 1185849 - RNA, 17 nt, Homo sapiens
uguaauguuauuuccac

SEQ ID NO: 1185850 - RNA, 18 nt, Homo sapiens
uguaauuuggcuccuuac

SEQ ID NO: 1185851 - RNA, 14 nt, Homo sapiens
uguacaaagaaaua

SEQ ID NO: 1185852 - RNA, 21 nt, Homo sapiens
uguacaaauugugauguggcu

SEQ ID NO: 1185853 - RNA, 13 nt, Homo sapiens
uguacaacacugg

SEQ ID NO: 1185854 - RNA, 14 nt, Homo sapiens
uguacaacacuggu

SEQ ID NO: 1185855 - RNA, 23 nt, Homo sapiens
uguacaauaaaaacauugccuuu

SEQ ID NO: 1185856 - RNA, 15 nt, Homo sapiens
uguacagacauauuu

SEQ ID NO: 1185857 - RNA, 21 nt, Homo sapiens
uguacaugguauuaacacuua

SEQ ID NO: 1185858 - RNA, 18 nt, Homo sapiens
uguacauguaacauuaaa

SEQ ID NO: 1185859 - RNA, 14 nt, Homo sapiens
uguaccauuugccu

SEQ ID NO: 1185860 - RNA, 21 nt, Homo sapiens
uguacccuggcuacaacuuca

SEQ ID NO: 1185861 - RNA, 22 nt, Homo sapiens
uguaccugaaguacaguauauu

SEQ ID NO: 1185862 - RNA, 21 nt, Homo sapiens
uguaccuguuuccuacagaca

SEQ ID NO: 1185863 - RNA, 18 nt, Homo sapiens
uguacugaguauugauaa

SEQ ID NO: 1185864 - RNA, 19 nt, Homo sapiens
uguacugguaauuguacaa

SEQ ID NO: 1185865 - RNA, 16 nt, Homo sapiens
uguacuguaugugaug

SEQ ID NO: 1185866 - RNA, 15 nt, Homo sapiens
uguacuguuacugug

SEQ ID NO: 1185867 - RNA, 15 nt, Homo sapiens
uguacuuaauccuuu

SEQ ID NO: 1185868 - RNA, 15 nt, Homo sapiens
uguacuugccuuauu

SEQ ID NO: 1185869 - RNA, 18 nt, Homo sapiens
uguacuuuucccauuugu

SEQ ID NO: 1185870 - RNA, 14 nt, Homo sapiens
uguagaccuugaug

SEQ ID NO: 1185871 - RNA, 23 nt, Homo sapiens
uguagagauuuggggugguugau

SEQ ID NO: 1185872 - RNA, 22 nt, Homo sapiens
uguagagccaauuagacuugaa

SEQ ID NO: 1185873 - RNA, 17 nt, Homo sapiens
uguagauaacagcaaga

SEQ ID NO: 1185874 - RNA, 16 nt, Homo sapiens
uguagauuaccaaaac

SEQ ID NO: 1185875 - RNA, 15 nt, Homo sapiens
uguagcaucugcauu

SEQ ID NO: 1185876 - RNA, 16 nt, Homo sapiens
uguagccaguuaagga

SEQ ID NO: 1185877 - RNA, 16 nt, Homo sapiens
uguagcccauccuucc

SEQ ID NO: 1185878 - RNA, 14 nt, Homo sapiens
uguagccccaguga

SEQ ID NO: 1185879 - RNA, 13 nt, Homo sapiens
uguagcccggggu

SEQ ID NO: 1185880 - RNA, 16 nt, Homo sapiens
uguaguccgugcugac

SEQ ID NO: 1185881 - RNA, 18 nt, Homo sapiens
uguaguccuagcuaucaa

SEQ ID NO: 1185882 - RNA, 13 nt, Homo sapiens
uguagucucagcu

SEQ ID NO: 1185883 - RNA, 11 nt, Homo sapiens
uguagugaaau

SEQ ID NO: 1185884 - RNA, 13 nt, Homo sapiens
uguagugagccaa

SEQ ID NO: 1185885 - RNA, 19 nt, Homo sapiens
uguauaaauaaaugaucua

SEQ ID NO: 1185886 - RNA, 15 nt, Homo sapiens
uguauaacuaggcug

SEQ ID NO: 1185887 - RNA, 17 nt, Homo sapiens
uguauagaaaaaccaaa

SEQ ID NO: 1185888 - RNA, 15 nt, Homo sapiens
uguauauacauauau

SEQ ID NO: 1185889 - RNA, 12 nt, Homo sapiens
uguauauuacau

SEQ ID NO: 1185890 - RNA, 17 nt, Homo sapiens
uguaucauagcgauauu

SEQ ID NO: 1185891 - RNA, 14 nt, Homo sapiens
uguauccauuauca

SEQ ID NO: 1185892 - RNA, 21 nt, Homo sapiens
uguauccucugaccuacauac

SEQ ID NO: 1185893 - RNA, 17 nt, Homo sapiens
uguaucuuaaaaaucua

SEQ ID NO: 1185894 - RNA, 14 nt, Homo sapiens
uguaucuugccuaa

SEQ ID NO: 1185895 - RNA, 12 nt, Homo sapiens
uguaugagacag

SEQ ID NO: 1185896 - RNA, 22 nt, Homo sapiens
uguauggaaucccacuguauga

SEQ ID NO: 1185897 - RNA, 11 nt, Homo sapiens
uguauggacaa

SEQ ID NO: 1185898 - RNA, 11 nt, Homo sapiens
uguauguauag

SEQ ID NO: 1185899 - RNA, 17 nt, Homo sapiens
uguauguaugagacaga

SEQ ID NO: 1185900 - RNA, 9 nt, Homo sapiens
uguaugugu

SEQ ID NO: 1185901 - RNA, 17 nt, Homo sapiens
uguauuaauaucuccau

SEQ ID NO: 1185902 - RNA, 15 nt, Homo sapiens
uguauucuauuuugc

SEQ ID NO: 1185903 - RNA, 13 nt, Homo sapiens
uauguauauacau

SEQ ID NO: 1185904 - RNA, 18 nt, Homo sapiens
uaugucuaaaauccugcu

SEQ ID NO: 1185905 - RNA, 15 nt, Homo sapiens
uaugucucagaccac

SEQ ID NO: 1185906 - RNA, 16 nt, Homo sapiens
uaugucuucuguauaa

SEQ ID NO: 1185907 - RNA, 20 nt, Homo sapiens
uaugugagugaaaguacuuc

SEQ ID NO: 1185908 - RNA, 17 nt, Homo sapiens
uaugugucaguggggcu

SEQ ID NO: 1185909 - RNA, 11 nt, Homo sapiens
uauguguccuu

SEQ ID NO: 1185910 - RNA, 17 nt, Homo sapiens
uauguguguuguuucca

SEQ ID NO: 1185911 - RNA, 14 nt, Homo sapiens
uauguuccaagugc

SEQ ID NO: 1185912 - RNA, 23 nt, Homo sapiens
uauuaaagugcuaagguucuaag

SEQ ID NO: 1185913 - RNA, 12 nt, Homo sapiens
uauuaagauaug

SEQ ID NO: 1185914 - RNA, 13 nt, Homo sapiens
uauuaaucaccuc

SEQ ID NO: 1185915 - RNA, 16 nt, Homo sapiens
uauuacaucuuucaca

SEQ ID NO: 1185916 - RNA, 17 nt, Homo sapiens
uauuacaugguuaacau

SEQ ID NO: 1185917 - RNA, 14 nt, Homo sapiens
uauuacccuccuaa

SEQ ID NO: 1185918 - RNA, 12 nt, Homo sapiens
uauuacugcugc

SEQ ID NO: 1185919 - RNA, 20 nt, Homo sapiens
uauuacugggacugugcuca

SEQ ID NO: 1185920 - RNA, 16 nt, Homo sapiens
uauuacuuuucaucua

SEQ ID NO: 1185921 - RNA, 20 nt, Homo sapiens
uauuagaugaauuauccuau

SEQ ID NO: 1185922 - RNA, 16 nt, Homo sapiens
uauuagauuacuaagu

SEQ ID NO: 1185923 - RNA, 17 nt, Homo sapiens
uauuauacgcuggcaac

SEQ ID NO: 1185924 - RNA, 14 nt, Homo sapiens
uauuauuguagucu

SEQ ID NO: 1185925 - RNA, 21 nt, Homo sapiens
uauucaaacuaccuauauucc

SEQ ID NO: 1185926 - RNA, 17 nt, Homo sapiens
uauucacaaaacauuaa

SEQ ID NO: 1185927 - RNA, 15 nt, Homo sapiens
uauucaggcacugag

SEQ ID NO: 1185928 - RNA, 19 nt, Homo sapiens
uauucauacugacauuaga

SEQ ID NO: 1185929 - RNA, 12 nt, Homo sapiens
uauuccuaucug

SEQ ID NO: 1185930 - RNA, 15 nt, Homo sapiens
uauuccugaacuaua

SEQ ID NO: 1185931 - RNA, 18 nt, Homo sapiens
uauucuaaacagacucau

SEQ ID NO: 1185932 - RNA, 18 nt, Homo sapiens
uauucuaauuuuagguuc

SEQ ID NO: 1185933 - RNA, 16 nt, Homo sapiens
uauucuuaacuauuca

SEQ ID NO: 1185934 - RNA, 14 nt, Homo sapiens
uauucuuccuugau

SEQ ID NO: 1185935 - RNA, 15 nt, Homo sapiens
uauucuuguaaauac

SEQ ID NO: 1185936 - RNA, 16 nt, Homo sapiens
uauugaauaagccauu

SEQ ID NO: 1185937 - RNA, 15 nt, Homo sapiens
uauugacuucaauga

SEQ ID NO: 1185938 - RNA, 14 nt, Homo sapiens
uauugaucuuugcc

SEQ ID NO: 1185939 - RNA, 16 nt, Homo sapiens
uauugaucuuugccca

SEQ ID NO: 1185940 - RNA, 17 nt, Homo sapiens
uauugcuugaguuauau

SEQ ID NO: 1185941 - RNA, 17 nt, Homo sapiens
uauuggauuuguccaaa

SEQ ID NO: 1185942 - RNA, 22 nt, Homo sapiens
uauugguccagcuugcucuuca

SEQ ID NO: 1185943 - RNA, 21 nt, Homo sapiens
uauuguauauauaaucuauau

SEQ ID NO: 1185944 - RNA, 21 nt, Homo sapiens
agcacaagguaaauauucauu

SEQ ID NO: 1185945 - RNA, 14 nt, Homo sapiens
agcacagauguucc

SEQ ID NO: 1185946 - RNA, 21 nt, Homo sapiens
agcacagauguucccccaucu

SEQ ID NO: 1185947 - RNA, 20 nt, Homo sapiens
agcaccaaaauuaugguguu

SEQ ID NO: 1185948 - RNA, 23 nt, Homo sapiens
agcaccagcgguccaacgccgcc

SEQ ID NO: 1185949 - RNA, 13 nt, Homo sapiens
agcaccucugagc

SEQ ID NO: 1185950 - RNA, 23 nt, Homo sapiens
agcacuaauucaacauauaccuu

SEQ ID NO: 1185951 - RNA, 24 nt, Homo sapiens
agcacuaguauuucauguugcaca

SEQ ID NO: 1185952 - RNA, 15 nt, Homo sapiens
agcacugcugccuca

SEQ ID NO: 1185953 - RNA, 21 nt, Homo sapiens
agcacuguguucacacuuuuc

SEQ ID NO: 1185954 - RNA, 20 nt, Homo sapiens
agcagaagagaaaauguugu

SEQ ID NO: 1185955 - RNA, 16 nt, Homo sapiens
agcagaggcagcauuu

SEQ ID NO: 1185956 - RNA, 19 nt, Homo sapiens
agcagaugcaaagaggcaa

SEQ ID NO: 1185957 - RNA, 17 nt, Homo sapiens
agcagauggacuugaaa

SEQ ID NO: 1185958 - RNA, 20 nt, Homo sapiens
agcagauugcagaaauacag

SEQ ID NO: 1185959 - RNA, 15 nt, Homo sapiens
agcagauuuuugcaa

SEQ ID NO: 1185960 - RNA, 15 nt, Homo sapiens
agcagcaacuguguc

SEQ ID NO: 1185961 - RNA, 12 nt, Homo sapiens
agcagcacugga

SEQ ID NO: 1185962 - RNA, 14 nt, Homo sapiens
agcagcaucuuuaa

SEQ ID NO: 1185963 - RNA, 17 nt, Homo sapiens
agcagccaauugggaag

SEQ ID NO: 1185964 - RNA, 13 nt, Homo sapiens
agcagccacgagg

SEQ ID NO: 1185965 - RNA, 14 nt, Homo sapiens
agcagccucgcaca

SEQ ID NO: 1185966 - RNA, 21 nt, Homo sapiens
agcagcgccccucccaagagg

SEQ ID NO: 1185967 - RNA, 13 nt, Homo sapiens
agcagcugccaga

SEQ ID NO: 1185968 - RNA, 13 nt, Homo sapiens
agcagcuguaauu

SEQ ID NO: 1185969 - RNA, 13 nt, Homo sapiens
agcaggaaauacc

SEQ ID NO: 1185970 - RNA, 19 nt, Homo sapiens
agcaggagaggagagccag

SEQ ID NO: 1185971 - RNA, 18 nt, Homo sapiens
agcaggagauuugcuuga

SEQ ID NO: 1185972 - RNA, 20 nt, Homo sapiens
agcaggccauuggcuacuga

SEQ ID NO: 1185973 - RNA, 21 nt, Homo sapiens
agcaggcggugggcacccacc

SEQ ID NO: 1185974 - RNA, 18 nt, Homo sapiens
agcagggaguacccagug

SEQ ID NO: 1185975 - RNA, 16 nt, Homo sapiens
agcaggggcauugcug

SEQ ID NO: 1185976 - RNA, 22 nt, Homo sapiens
agcagggucuuuucaucuggga

SEQ ID NO: 1185977 - RNA, 16 nt, Homo sapiens
agcaggguugccuuuu

SEQ ID NO: 1185978 - RNA, 19 nt, Homo sapiens
agcagguuucuugcuucug

SEQ ID NO: 1185979 - RNA, 14 nt, Homo sapiens
agcagucauaagcu

SEQ ID NO: 1185980 - RNA, 19 nt, Homo sapiens
agcagucucugccuugccu

SEQ ID NO: 1185981 - RNA, 12 nt, Homo sapiens
agcagugccuug

SEQ ID NO: 1185982 - RNA, 21 nt, Homo sapiens
agcaguuacugugaauguucc

SEQ ID NO: 1185983 - RNA, 19 nt, Homo sapiens
agcauaaaugggaacugau

SEQ ID NO: 1185984 - RNA, 21 nt, Homo sapiens
agcauacgguaugauauugca

SEQ ID NO: 1185985 - RNA, 12 nt, Homo sapiens
agcauacuuugu

SEQ ID NO: 1185986 - RNA, 15 nt, Homo sapiens
agcauaggaacaaua

SEQ ID NO: 1185987 - RNA, 21 nt, Homo sapiens
agcaucaauuccaucagcaca

SEQ ID NO: 1185988 - RNA, 19 nt, Homo sapiens
agcaucauuaaugcacauc

SEQ ID NO: 1185989 - RNA, 21 nt, Homo sapiens
agcaucccuagucucuaccca

SEQ ID NO: 1185990 - RNA, 18 nt, Homo sapiens
agcaucggucaugugugu

SEQ ID NO: 1185991 - RNA, 23 nt, Homo sapiens
agcaucucuucuucccugucagc

SEQ ID NO: 1185992 - RNA, 20 nt, Homo sapiens
agcaucugaccaucugugac

SEQ ID NO: 1185993 - RNA, 17 nt, Homo sapiens
agcaucuuauacgagua

SEQ ID NO: 1185994 - RNA, 14 nt, Homo sapiens
agcaugaaagugga

SEQ ID NO: 1185995 - RNA, 15 nt, Homo sapiens
agcaugacauacuuu

SEQ ID NO: 1185996 - RNA, 21 nt, Homo sapiens
agcaugcugugauugugccua

SEQ ID NO: 1185997 - RNA, 18 nt, Homo sapiens
agcauggaaucugaugaa

SEQ ID NO: 1185998 - RNA, 18 nt, Homo sapiens
agcauguaaggccuuuca

SEQ ID NO: 1185999 - RNA, 15 nt, Homo sapiens
agcauguagccaguu

SEQ ID NO: 1186000 - RNA, 21 nt, Homo sapiens
agcaugucgucaaagcugaaa

SEQ ID NO: 1186001 - RNA, 13 nt, Homo sapiens
agcaugugucaug

SEQ ID NO: 1186002 - RNA, 18 nt, Homo sapiens
agcauguugcaucucugc

SEQ ID NO: 1186003 - RNA, 17 nt, Homo sapiens
agcauuacuuuauagcu

SEQ ID NO: 1186004 - RNA, 21 nt, Homo sapiens
agcauugacucuguggcuuug

SEQ ID NO: 1186005 - RNA, 20 nt, Homo sapiens
agcauuuaagagugaaguca

SEQ ID NO: 1186006 - RNA, 20 nt, Homo sapiens
agcauuuauguagacauugu

SEQ ID NO: 1186007 - RNA, 17 nt, Homo sapiens
agcauuuccacaccaag

SEQ ID NO: 1186008 - RNA, 19 nt, Homo sapiens
agcauuugauuaacauuug

SEQ ID NO: 1186009 - RNA, 14 nt, Homo sapiens
agccaaucugcaau

SEQ ID NO: 1186010 - RNA, 18 nt, Homo sapiens
agccaauucagacaggca

SEQ ID NO: 1186011 - RNA, 15 nt, Homo sapiens
agccacaacugcagu

SEQ ID NO: 1186012 - RNA, 19 nt, Homo sapiens
agccacaagccugaauuuc

SEQ ID NO: 1186013 - RNA, 23 nt, Homo sapiens
agccacacugcgcgcggggcccg

SEQ ID NO: 1186014 - RNA, 14 nt, Homo sapiens
agccacaggugccu

SEQ ID NO: 1186015 - RNA, 21 nt, Homo sapiens
agccacugcauaccaaccugg

SEQ ID NO: 1186016 - RNA, 21 nt, Homo sapiens
agccacuuaccaauugcuaag

SEQ ID NO: 1186017 - RNA, 17 nt, Homo sapiens
agccagacaugguggca

SEQ ID NO: 1186018 - RNA, 22 nt, Homo sapiens
agccagagagugagagacauua

SEQ ID NO: 1186019 - RNA, 17 nt, Homo sapiens
agccagaggacugugau

SEQ ID NO: 1186020 - RNA, 22 nt, Homo sapiens
agccagcacucacaccacuaac

SEQ ID NO: 1186021 - RNA, 17 nt, Homo sapiens
agccaggaaagcagcaa

SEQ ID NO: 1186022 - RNA, 19 nt, Homo sapiens
agccaggcaccguggcuca

SEQ ID NO: 1186023 - RNA, 18 nt, Homo sapiens
agccaggccccaagccca

SEQ ID NO: 1186024 - RNA, 19 nt, Homo sapiens
agccaggugugguggugca

SEQ ID NO: 1186025 - RNA, 14 nt, Homo sapiens
agccagugggagau

SEQ ID NO: 1186026 - RNA, 22 nt, Homo sapiens
agccaguguggucaguauucca

SEQ ID NO: 1186027 - RNA, 17 nt, Homo sapiens
agccauaugaaugucag

SEQ ID NO: 1186028 - RNA, 20 nt, Homo sapiens
agccaucaagagacugaguc

SEQ ID NO: 1186029 - RNA, 14 nt, Homo sapiens
agccaucucagguu

SEQ ID NO: 1186030 - RNA, 15 nt, Homo sapiens
agccaucuugaauau

SEQ ID NO: 1186031 - RNA, 21 nt, Homo sapiens
agccaugaguggaguuuccaa

SEQ ID NO: 1186032 - RNA, 15 nt, Homo sapiens
agccauucuauauuc

SEQ ID NO: 1186033 - RNA, 14 nt, Homo sapiens
agcccaaagccaag

SEQ ID NO: 1186034 - RNA, 20 nt, Homo sapiens
agcccaaauggcucugugaa

SEQ ID NO: 1186035 - RNA, 19 nt, Homo sapiens
agcccacauauuucaauag

SEQ ID NO: 1186036 - RNA, 15 nt, Homo sapiens
agcccaccccugugc

SEQ ID NO: 1186037 - RNA, 22 nt, Homo sapiens
agcccacccugcugcuggugca

SEQ ID NO: 1186038 - RNA, 17 nt, Homo sapiens
agcccacuuuguucgca

SEQ ID NO: 1186039 - RNA, 12 nt, Homo sapiens
agcccagcauuu

SEQ ID NO: 1186040 - RNA, 16 nt, Homo sapiens
agcccagccacauuuc

SEQ ID NO: 1186041 - RNA, 17 nt, Homo sapiens
agcccagccacauuuca

SEQ ID NO: 1186042 - RNA, 19 nt, Homo sapiens
agcccagcugggucaggca

SEQ ID NO: 1186043 - RNA, 19 nt, Homo sapiens
agcccauuucuccagaacc

SEQ ID NO: 1186044 - RNA, 20 nt, Homo sapiens
agcccauuucuccauacgca

SEQ ID NO: 1186045 - RNA, 17 nt, Homo sapiens
agccccagugacagcua

SEQ ID NO: 1186046 - RNA, 15 nt, Homo sapiens
agccccaucugucua

SEQ ID NO: 1186047 - RNA, 20 nt, Homo sapiens
agcccccaaguugauauuuc

SEQ ID NO: 1186048 - RNA, 14 nt, Homo sapiens
agcccccacccggu

SEQ ID NO: 1186049 - RNA, 17 nt, Homo sapiens
agccccgucuggugcca

SEQ ID NO: 1186050 - RNA, 11 nt, Homo sapiens
agccccugaaa

SEQ ID NO: 1186051 - RNA, 19 nt, Homo sapiens
agcccgugcccuaccacac

SEQ ID NO: 1186052 - RNA, 21 nt, Homo sapiens
agcccuaaauguacucuugaa

SEQ ID NO: 1186053 - RNA, 13 nt, Homo sapiens
agcccucagcaau

SEQ ID NO: 1186054 - RNA, 13 nt, Homo sapiens
agcccucaucccg

SEQ ID NO: 1186055 - RNA, 13 nt, Homo sapiens
agcccuccauucc

SEQ ID NO: 1186056 - RNA, 15 nt, Homo sapiens
agcccuccucuccca

SEQ ID NO: 1186057 - RNA, 19 nt, Homo sapiens
agcccuccucucccaguga

SEQ ID NO: 1186058 - RNA, 16 nt, Homo sapiens
agcccugccaugucac

SEQ ID NO: 1186059 - RNA, 21 nt, Homo sapiens
agcccugggccccaccaccua

SEQ ID NO: 1186060 - RNA, 20 nt, Homo sapiens
agcccuggggacaccugccc

SEQ ID NO: 1186061 - RNA, 12 nt, Homo sapiens
agcccuguaaca

SEQ ID NO: 1186062 - RNA, 23 nt, Homo sapiens
agcccuguggaugagcccucaga

SEQ ID NO: 1186063 - RNA, 15 nt, Homo sapiens
agcccuguugacaca

SEQ ID NO: 1186064 - RNA, 19 nt, Homo sapiens
agccgaagggcaauaucua

SEQ ID NO: 1186065 - RNA, 20 nt, Homo sapiens
agccgacaccuuuuuucaac

SEQ ID NO: 1186066 - RNA, 19 nt, Homo sapiens
agccgagaucgugccauug

SEQ ID NO: 1186067 - RNA, 19 nt, Homo sapiens
agccgagcggggagccagg

SEQ ID NO: 1186068 - RNA, 17 nt, Homo sapiens
agccgcucuccugccac

SEQ ID NO: 1186069 - RNA, 19 nt, Homo sapiens
agccgcucuccugccacau

SEQ ID NO: 1186070 - RNA, 19 nt, Homo sapiens
agccggacacuucucagga

SEQ ID NO: 1186071 - RNA, 11 nt, Homo sapiens
agccggagccu

SEQ ID NO: 1186072 - RNA, 19 nt, Homo sapiens
agccgggaaagaagagccg

SEQ ID NO: 1186073 - RNA, 18 nt, Homo sapiens
agccgggacccucaggug

SEQ ID NO: 1186074 - RNA, 19 nt, Homo sapiens
agccgggugugguggcaca

SEQ ID NO: 1186075 - RNA, 15 nt, Homo sapiens
agccguguguucaaa

SEQ ID NO: 1186076 - RNA, 23 nt, Homo sapiens
agccguuugagaagaaaacaucu

SEQ ID NO: 1186077 - RNA, 16 nt, Homo sapiens
cucauugcuuggaauu

SEQ ID NO: 1186078 - RNA, 11 nt, Homo sapiens
cucauuuacuu

SEQ ID NO: 1186079 - RNA, 17 nt, Homo sapiens
cucauuuauagauguca

SEQ ID NO: 1186080 - RNA, 18 nt, Homo sapiens
cucauuucuuauaucaua

SEQ ID NO: 1186081 - RNA, 17 nt, Homo sapiens
cucauuuggacuugcug

SEQ ID NO: 1186082 - RNA, 23 nt, Homo sapiens
cucauuuguuuuucucacuccuu

SEQ ID NO: 1186083 - RNA, 13 nt, Homo sapiens
cuccaaaaagaca

SEQ ID NO: 1186084 - RNA, 16 nt, Homo sapiens
cuccaaaaggccuuug

SEQ ID NO: 1186085 - RNA, 18 nt, Homo sapiens
cuccaaacccaaccuuuc

SEQ ID NO: 1186086 - RNA, 19 nt, Homo sapiens
cuccaagcuccucugugaa

SEQ ID NO: 1186087 - RNA, 21 nt, Homo sapiens
cuccaauauccguuauuuucc

SEQ ID NO: 1186088 - RNA, 16 nt, Homo sapiens
cuccacaggcacaggu

SEQ ID NO: 1186089 - RNA, 18 nt, Homo sapiens
cuccaccaacccaucaga

SEQ ID NO: 1186090 - RNA, 11 nt, Homo sapiens
cuccacuaaua

SEQ ID NO: 1186091 - RNA, 17 nt, Homo sapiens
cuccacucaguugcaac

SEQ ID NO: 1186092 - RNA, 18 nt, Homo sapiens
cuccacucaguugcaacu

SEQ ID NO: 1186093 - RNA, 12 nt, Homo sapiens
cuccacugcugc

SEQ ID NO: 1186094 - RNA, 21 nt, Homo sapiens
cuccacuggaggggucuccuc

SEQ ID NO: 1186095 - RNA, 17 nt, Homo sapiens
cuccagaacccauuuga

SEQ ID NO: 1186096 - RNA, 16 nt, Homo sapiens
cuccagaagggcagcu

SEQ ID NO: 1186097 - RNA, 17 nt, Homo sapiens
cuccagaccugauccug

SEQ ID NO: 1186098 - RNA, 15 nt, Homo sapiens
cuccagaugagagua

SEQ ID NO: 1186099 - RNA, 15 nt, Homo sapiens
cuccagcaacacagc

SEQ ID NO: 1186100 - RNA, 17 nt, Homo sapiens
cuccagcccugcagcua

SEQ ID NO: 1186101 - RNA, 15 nt, Homo sapiens
cuccagccuggguca

SEQ ID NO: 1186102 - RNA, 17 nt, Homo sapiens
cuccagcucuggcuucc

SEQ ID NO: 1186103 - RNA, 21 nt, Homo sapiens
cuccagcuuuuccucagggug

SEQ ID NO: 1186104 - RNA, 18 nt, Homo sapiens
cuccaggcccgucugucc

SEQ ID NO: 1186105 - RNA, 12 nt, Homo sapiens
cuccaggcuuuc

SEQ ID NO: 1186106 - RNA, 17 nt, Homo sapiens
cuccagucuguucucac

SEQ ID NO: 1186107 - RNA, 14 nt, Homo sapiens
cuccauaucagaag

SEQ ID NO: 1186108 - RNA, 20 nt, Homo sapiens
cuccauaugcuguacaugac

SEQ ID NO: 1186109 - RNA, 16 nt, Homo sapiens
cuccaucuaccccuuc

SEQ ID NO: 1186110 - RNA, 10 nt, Homo sapiens
cuccaucucc

SEQ ID NO: 1186111 - RNA, 20 nt, Homo sapiens
cuccaucugacaaauucaaa

SEQ ID NO: 1186112 - RNA, 19 nt, Homo sapiens
cuccauguagaagccacua

SEQ ID NO: 1186113 - RNA, 18 nt, Homo sapiens
cuccauuucuacaaugca

SEQ ID NO: 1186114 - RNA, 17 nt, Homo sapiens
cuccauuucuuucuucc

SEQ ID NO: 1186115 - RNA, 19 nt, Homo sapiens
cucccaaguagcugggauu

SEQ ID NO: 1186116 - RNA, 19 nt, Homo sapiens
cucccacacuugugccagc

SEQ ID NO: 1186117 - RNA, 17 nt, Homo sapiens
cucccacaucccacugg

SEQ ID NO: 1186118 - RNA, 14 nt, Homo sapiens
cucccacaugaugu

SEQ ID NO: 1186119 - RNA, 23 nt, Homo sapiens
cucccacugggguccagggagca

SEQ ID NO: 1186120 - RNA, 19 nt, Homo sapiens
cucccagaacacacuccau

SEQ ID NO: 1186121 - RNA, 20 nt, Homo sapiens
cucccagaacacacuccauc

SEQ ID NO: 1186122 - RNA, 15 nt, Homo sapiens
cucccagacuaccug

SEQ ID NO: 1186123 - RNA, 16 nt, Homo sapiens
cucccaggccaggcuc

SEQ ID NO: 1186124 - RNA, 19 nt, Homo sapiens
cucccagguucaagugauu

SEQ ID NO: 1186125 - RNA, 14 nt, Homo sapiens
cucccagugccuuc

SEQ ID NO: 1186126 - RNA, 15 nt, Homo sapiens
cucccauaccuuuaa

SEQ ID NO: 1186127 - RNA, 16 nt, Homo sapiens
cuccccagcccagaga

SEQ ID NO: 1186128 - RNA, 13 nt, Homo sapiens
cuccccucagagc

SEQ ID NO: 1186129 - RNA, 18 nt, Homo sapiens
cuccccucagagugcaag

SEQ ID NO: 1186130 - RNA, 22 nt, Homo sapiens
cucccgcgcccccaccccagac

SEQ ID NO: 1186131 - RNA, 14 nt, Homo sapiens
cucccuaaccacua

SEQ ID NO: 1186132 - RNA, 13 nt, Homo sapiens
cucccuaccaccu

SEQ ID NO: 1186133 - RNA, 21 nt, Homo sapiens
cucccuaccuaccaagauaua

SEQ ID NO: 1186134 - RNA, 16 nt, Homo sapiens
cucccuccagcacaaa

SEQ ID NO: 1186135 - RNA, 19 nt, Homo sapiens
cucccucccaggacucuga

SEQ ID NO: 1186136 - RNA, 16 nt, Homo sapiens
cucccucucacugucu

SEQ ID NO: 1186137 - RNA, 17 nt, Homo sapiens
cucccucuuucuagccu

SEQ ID NO: 1186138 - RNA, 16 nt, Homo sapiens
cucccugaagccuuug

SEQ ID NO: 1186139 - RNA, 22 nt, Homo sapiens
cucccugagugguccccaccuu

SEQ ID NO: 1186140 - RNA, 20 nt, Homo sapiens
cucccugcaucugaccagca

SEQ ID NO: 1186141 - RNA, 15 nt, Homo sapiens
cucccugccaucccc

SEQ ID NO: 1186142 - RNA, 21 nt, Homo sapiens
cucccugcgaggaggggagaa

SEQ ID NO: 1186143 - RNA, 18 nt, Homo sapiens
cucccuguuuuaauucaa

SEQ ID NO: 1186144 - RNA, 17 nt, Homo sapiens
cucccuuaaucugccag

SEQ ID NO: 1186145 - RNA, 16 nt, Homo sapiens
cucccuucccaguggg

SEQ ID NO: 1186146 - RNA, 15 nt, Homo sapiens
cuccgcaggcccacu

SEQ ID NO: 1186147 - RNA, 15 nt, Homo sapiens
cuccgccuccugggu

SEQ ID NO: 1186148 - RNA, 14 nt, Homo sapiens
cuccgcuacuucca

SEQ ID NO: 1186149 - RNA, 21 nt, Homo sapiens
cuccgugaggcugcugccauc

SEQ ID NO: 1186150 - RNA, 16 nt, Homo sapiens
cuccucaggcacacag

SEQ ID NO: 1186151 - RNA, 21 nt, Homo sapiens
cuccucaggcacacagcuacu

SEQ ID NO: 1186152 - RNA, 13 nt, Homo sapiens
cuccuccacgugc

SEQ ID NO: 1186153 - RNA, 16 nt, Homo sapiens
cuccuccccauguacc

SEQ ID NO: 1186154 - RNA, 14 nt, Homo sapiens
cuccuccuagccac

SEQ ID NO: 1186155 - RNA, 20 nt, Homo sapiens
cuccuccugcccaccuguca

SEQ ID NO: 1186156 - RNA, 17 nt, Homo sapiens
cuccucgagaucccaac

SEQ ID NO: 1186157 - RNA, 13 nt, Homo sapiens
cuccucgcaagcu

SEQ ID NO: 1186158 - RNA, 15 nt, Homo sapiens
cuccucuccaugcaa

SEQ ID NO: 1186159 - RNA, 17 nt, Homo sapiens
cuccucugaaacagcug

SEQ ID NO: 1186160 - RNA, 18 nt, Homo sapiens
cuccucugugaagcauuc

SEQ ID NO: 1186161 - RNA, 23 nt, Homo sapiens
cuccugaagggaaggcaaaggca

SEQ ID NO: 1186162 - RNA, 16 nt, Homo sapiens
cuccugacaugucuca

SEQ ID NO: 1186163 - RNA, 16 nt, Homo sapiens
cugaaauuaacucaga

SEQ ID NO: 1186164 - RNA, 21 nt, Homo sapiens
cugaaauucuucaacuuggaa

SEQ ID NO: 1186165 - RNA, 23 nt, Homo sapiens
cugaacaucuggcccaagugaag

SEQ ID NO: 1186166 - RNA, 16 nt, Homo sapiens
cugaaccuugagcaaa

SEQ ID NO: 1186167 - RNA, 13 nt, Homo sapiens
cugaacucugcaa

SEQ ID NO: 1186168 - RNA, 21 nt, Homo sapiens
cugaagaaaccuucagauuug

SEQ ID NO: 1186169 - RNA, 19 nt, Homo sapiens
cugaagaagcaaacaugac

SEQ ID NO: 1186170 - RNA, 22 nt, Homo sapiens
cugaagagcuauuauauaaaaa

SEQ ID NO: 1186171 - RNA, 13 nt, Homo sapiens
cugaagcagguuc

SEQ ID NO: 1186172 - RNA, 16 nt, Homo sapiens
cugaagccucacuuau

SEQ ID NO: 1186173 - RNA, 14 nt, Homo sapiens
cugaagcugagcua

SEQ ID NO: 1186174 - RNA, 19 nt, Homo sapiens
cugaaggagccccauuccu

SEQ ID NO: 1186175 - RNA, 14 nt, Homo sapiens
cugaaggggaaccc

SEQ ID NO: 1186176 - RNA, 18 nt, Homo sapiens
cugaaguagugugcaguu

SEQ ID NO: 1186177 - RNA, 20 nt, Homo sapiens
cugaagucaguuucuaucau

SEQ ID NO: 1186178 - RNA, 20 nt, Homo sapiens
cugaagucuuacuacagaaa

SEQ ID NO: 1186179 - RNA, 13 nt, Homo sapiens
cugaagugguuca

SEQ ID NO: 1186180 - RNA, 21 nt, Homo sapiens
cugaagugguucagucuagaa

SEQ ID NO: 1186181 - RNA, 20 nt, Homo sapiens
cugaaguuuuugaaauaccu

SEQ ID NO: 1186182 - RNA, 13 nt, Homo sapiens
cugaauacauucu

SEQ ID NO: 1186183 - RNA, 16 nt, Homo sapiens
cugaaucaucauaucu

SEQ ID NO: 1186184 - RNA, 16 nt, Homo sapiens
cugaaugaaaauaacu

SEQ ID NO: 1186185 - RNA, 15 nt, Homo sapiens
cugaaugagacuuaa

SEQ ID NO: 1186186 - RNA, 14 nt, Homo sapiens
cugaaugauuuaga

SEQ ID NO: 1186187 - RNA, 22 nt, Homo sapiens
cugaauuuguaagcaacuugcu

SEQ ID NO: 1186188 - RNA, 16 nt, Homo sapiens
cugacacagacauccu

SEQ ID NO: 1186189 - RNA, 14 nt, Homo sapiens
cugacaccuuucau

SEQ ID NO: 1186190 - RNA, 15 nt, Homo sapiens
cugacagcacuccuc

SEQ ID NO: 1186191 - RNA, 19 nt, Homo sapiens
cugacagcacuccucggca

SEQ ID NO: 1186192 - RNA, 17 nt, Homo sapiens
cugacagcugucccugc

SEQ ID NO: 1186193 - RNA, 22 nt, Homo sapiens
cugacaggaagaaaauagaaca

SEQ ID NO: 1186194 - RNA, 18 nt, Homo sapiens
cugacauucacacagaga

SEQ ID NO: 1186195 - RNA, 19 nt, Homo sapiens
cugaccacagcacagccaa

SEQ ID NO: 1186196 - RNA, 20 nt, Homo sapiens
cugaccagccgugagcaugu

SEQ ID NO: 1186197 - RNA, 11 nt, Homo sapiens
cugacccaggg

SEQ ID NO: 1186198 - RNA, 17 nt, Homo sapiens
cugacccagugccccca

SEQ ID NO: 1186199 - RNA, 19 nt, Homo sapiens
cugaccucaggugauccac

SEQ ID NO: 1186200 - RNA, 15 nt, Homo sapiens
cugaccuccacagcu

SEQ ID NO: 1186201 - RNA, 23 nt, Homo sapiens
cugacuaauuuuuguauuuuuag

SEQ ID NO: 1186202 - RNA, 13 nt, Homo sapiens
cugacucuugcag

SEQ ID NO: 1186203 - RNA, 15 nt, Homo sapiens
cugacugaugacaaa

SEQ ID NO: 1186204 - RNA, 15 nt, Homo sapiens
cugacugucagggag

SEQ ID NO: 1186205 - RNA, 11 nt, Homo sapiens
cugacuuagau

SEQ ID NO: 1186206 - RNA, 13 nt, Homo sapiens
cugagaaagccaa

SEQ ID NO: 1186207 - RNA, 14 nt, Homo sapiens
cugagaagaucuga

SEQ ID NO: 1186208 - RNA, 17 nt, Homo sapiens
cugagaccaaaguagau

SEQ ID NO: 1186209 - RNA, 16 nt, Homo sapiens
cugagagacccaagga

SEQ ID NO: 1186210 - RNA, 13 nt, Homo sapiens
cugagagaugaca

SEQ ID NO: 1186211 - RNA, 16 nt, Homo sapiens
cugagaggaagccuga

SEQ ID NO: 1186212 - RNA, 21 nt, Homo sapiens
cugagaguuuaguuguagcag

SEQ ID NO: 1186213 - RNA, 14 nt, Homo sapiens
cugagauacauaca

SEQ ID NO: 1186214 - RNA, 13 nt, Homo sapiens
cugccagggccag

SEQ ID NO: 1186215 - RNA, 18 nt, Homo sapiens
cugccagggccagucuug

SEQ ID NO: 1186216 - RNA, 16 nt, Homo sapiens
cugccauaacauacca

SEQ ID NO: 1186217 - RNA, 17 nt, Homo sapiens
cugccauuuuagugucu

SEQ ID NO: 1186218 - RNA, 20 nt, Homo sapiens
cugcccaacccuucccucac

SEQ ID NO: 1186219 - RNA, 14 nt, Homo sapiens
cugcccaccucucu

SEQ ID NO: 1186220 - RNA, 18 nt, Homo sapiens
cugcccaggcacugcaaa

SEQ ID NO: 1186221 - RNA, 15 nt, Homo sapiens
cugcccauggcaugu

SEQ ID NO: 1186222 - RNA, 16 nt, Homo sapiens
cugccccagccuccuc

SEQ ID NO: 1186223 - RNA, 16 nt, Homo sapiens
cugcccccaauccaug

SEQ ID NO: 1186224 - RNA, 21 nt, Homo sapiens
cugccccuggcucugaccgaa

SEQ ID NO: 1186225 - RNA, 17 nt, Homo sapiens
cugcccgcagaccucug

SEQ ID NO: 1186226 - RNA, 18 nt, Homo sapiens
cugcccgggagggcuucc

SEQ ID NO: 1186227 - RNA, 20 nt, Homo sapiens
cugcccugcccccucggggg

SEQ ID NO: 1186228 - RNA, 13 nt, Homo sapiens
cugcccugcuauu

SEQ ID NO: 1186229 - RNA, 21 nt, Homo sapiens
cugcccuuuuaauacagggac

SEQ ID NO: 1186230 - RNA, 14 nt, Homo sapiens
cugccgagagucca

SEQ ID NO: 1186231 - RNA, 18 nt, Homo sapiens
cugccggggguucagggu

SEQ ID NO: 1186232 - RNA, 20 nt, Homo sapiens
cugccggggguucaggguug

SEQ ID NO: 1186233 - RNA, 16 nt, Homo sapiens
cugccuaaaaugaauu

SEQ ID NO: 1186234 - RNA, 15 nt, Homo sapiens
cugccucaacacuga

SEQ ID NO: 1186235 - RNA, 15 nt, Homo sapiens
cugccucacaucucc

SEQ ID NO: 1186236 - RNA, 14 nt, Homo sapiens
cugccucagccucc

SEQ ID NO: 1186237 - RNA, 15 nt, Homo sapiens
cugccucccaucuca

SEQ ID NO: 1186238 - RNA, 16 nt, Homo sapiens
cugccucccaucucaa

SEQ ID NO: 1186239 - RNA, 21 nt, Homo sapiens
cugccucggccucccaaagug

SEQ ID NO: 1186240 - RNA, 18 nt, Homo sapiens
cugccuggaacaccagca

SEQ ID NO: 1186241 - RNA, 15 nt, Homo sapiens
cugccuguugcguga

SEQ ID NO: 1186242 - RNA, 14 nt, Homo sapiens
cugccuucucaggg

SEQ ID NO: 1186243 - RNA, 13 nt, Homo sapiens
cugccuugcaccu

SEQ ID NO: 1186244 - RNA, 14 nt, Homo sapiens
cugccuuugaucac

SEQ ID NO: 1186245 - RNA, 20 nt, Homo sapiens
cugcgaacccaagcaauggg

SEQ ID NO: 1186246 - RNA, 18 nt, Homo sapiens
cugcgaaugggauccuga

SEQ ID NO: 1186247 - RNA, 21 nt, Homo sapiens
cugcgcccagcuauacuguau

SEQ ID NO: 1186248 - RNA, 20 nt, Homo sapiens
cugcgcuuugaacgugccag

SEQ ID NO: 1186249 - RNA, 17 nt, Homo sapiens
cugcggcacugugccua

SEQ ID NO: 1186250 - RNA, 18 nt, Homo sapiens
cugcggguccucagcugc

SEQ ID NO: 1186251 - RNA, 23 nt, Homo sapiens
cugcuagcaaauggcagaaccaa

SEQ ID NO: 1186252 - RNA, 17 nt, Homo sapiens
cugcuagggaauaucaa

SEQ ID NO: 1186253 - RNA, 23 nt, Homo sapiens
cugcuauaauucuauacuguuga

SEQ ID NO: 1186254 - RNA, 20 nt, Homo sapiens
cugcuauuugaaguguaauu

SEQ ID NO: 1186255 - RNA, 13 nt, Homo sapiens
cugcucacuuuaa

SEQ ID NO: 1186256 - RNA, 22 nt, Homo sapiens
cugcucccacacuugugccagc

SEQ ID NO: 1186257 - RNA, 14 nt, Homo sapiens
cugcucccacagaa

SEQ ID NO: 1186258 - RNA, 19 nt, Homo sapiens
cugcucgccuuagcacuac

SEQ ID NO: 1186259 - RNA, 17 nt, Homo sapiens
cugcucucccuugugga

SEQ ID NO: 1186260 - RNA, 14 nt, Homo sapiens
cugcucuuccucag

SEQ ID NO: 1186261 - RNA, 21 nt, Homo sapiens
cugcugaauguaguauuuggc

SEQ ID NO: 1186262 - RNA, 18 nt, Homo sapiens
cugcugaccauuugguca

SEQ ID NO: 1186263 - RNA, 22 nt, Homo sapiens
cugcugagagacagagcuauuc

SEQ ID NO: 1186264 - RNA, 22 nt, Homo sapiens
cugcugagagggcugcugacca

SEQ ID NO: 1186265 - RNA, 23 nt, Homo sapiens
cugcugagagggcugcugaccau

SEQ ID NO: 1186266 - RNA, 13 nt, Homo sapiens
caugucuaauuca

SEQ ID NO: 1186267 - RNA, 13 nt, Homo sapiens
caugucucacaga

SEQ ID NO: 1186268 - RNA, 13 nt, Homo sapiens
caugucugugcug

SEQ ID NO: 1186269 - RNA, 22 nt, Homo sapiens
caugugaaacucuacccugaag

SEQ ID NO: 1186270 - RNA, 15 nt, Homo sapiens
caugugacaugucug

SEQ ID NO: 1186271 - RNA, 19 nt, Homo sapiens
caugugacuccugaaggga

SEQ ID NO: 1186272 - RNA, 14 nt, Homo sapiens
caugugacucugaa

SEQ ID NO: 1186273 - RNA, 21 nt, Homo sapiens
caugugcggggaucaucugcc

SEQ ID NO: 1186274 - RNA, 16 nt, Homo sapiens
caugugcuggguggua

SEQ ID NO: 1186275 - RNA, 22 nt, Homo sapiens
cauguggccugcccagccucaa

SEQ ID NO: 1186276 - RNA, 18 nt, Homo sapiens
cauguguugcaccguucu

SEQ ID NO: 1186277 - RNA, 22 nt, Homo sapiens
cauguuauuaaacguaugcaug

SEQ ID NO: 1186278 - RNA, 15 nt, Homo sapiens
cauguucccaaaaca

SEQ ID NO: 1186279 - RNA, 16 nt, Homo sapiens
cauguugaccaugucu

SEQ ID NO: 1186280 - RNA, 16 nt, Homo sapiens
cauguugagccaugag

SEQ ID NO: 1186281 - RNA, 21 nt, Homo sapiens
cauguuguacauuagaccucu

SEQ ID NO: 1186282 - RNA, 16 nt, Homo sapiens
cauguuguacauuuca

SEQ ID NO: 1186283 - RNA, 21 nt, Homo sapiens
cauguuuagcagaaauaggca

SEQ ID NO: 1186284 - RNA, 17 nt, Homo sapiens
cauguuuccaccaaaug

SEQ ID NO: 1186285 - RNA, 19 nt, Homo sapiens
cauguuuuaacaaaaacca

SEQ ID NO: 1186286 - RNA, 21 nt, Homo sapiens
cauguuuuccgugaaaacgga

SEQ ID NO: 1186287 - RNA, 14 nt, Homo sapiens
cauguuuucuagcc

SEQ ID NO: 1186288 - RNA, 17 nt, Homo sapiens
cauguuuucuagccuua

SEQ ID NO: 1186289 - RNA, 19 nt, Homo sapiens
cauguuuuuaaagggcuau

SEQ ID NO: 1186290 - RNA, 14 nt, Homo sapiens
cauguuuuugccaa

SEQ ID NO: 1186291 - RNA, 15 nt, Homo sapiens
cauguuuuugccaaa

SEQ ID NO: 1186292 - RNA, 13 nt, Homo sapiens
cauuaaaaagccu

SEQ ID NO: 1186293 - RNA, 22 nt, Homo sapiens
cauuaaaagaacauaaguuauc

SEQ ID NO: 1186294 - RNA, 23 nt, Homo sapiens
cauuaaaagcaaggcucaaggga

SEQ ID NO: 1186295 - RNA, 18 nt, Homo sapiens
cauuaaaauaaaccaaau

SEQ ID NO: 1186296 - RNA, 21 nt, Homo sapiens
cauuaaauauuugacaucuac

SEQ ID NO: 1186297 - RNA, 18 nt, Homo sapiens
cauuaaauucacaaacuu

SEQ ID NO: 1186298 - RNA, 21 nt, Homo sapiens
cauuaaggucauuacucucaa

SEQ ID NO: 1186299 - RNA, 18 nt, Homo sapiens
cauuaaugcacaucugca

SEQ ID NO: 1186300 - RNA, 13 nt, Homo sapiens
cauuaaugccaca

SEQ ID NO: 1186301 - RNA, 18 nt, Homo sapiens
cauuaauuggagugcagc

SEQ ID NO: 1186302 - RNA, 12 nt, Homo sapiens
cauuacugcaua

SEQ ID NO: 1186303 - RNA, 17 nt, Homo sapiens
cauuagaacaaaggaca

SEQ ID NO: 1186304 - RNA, 15 nt, Homo sapiens
cauuagcuuccugcu

SEQ ID NO: 1186305 - RNA, 18 nt, Homo sapiens
cauuaguauuucacaaga

SEQ ID NO: 1186306 - RNA, 20 nt, Homo sapiens
cauuauaugcacuagcaaua

SEQ ID NO: 1186307 - RNA, 17 nt, Homo sapiens
cauuauuugaguuugac

SEQ ID NO: 1186308 - RNA, 21 nt, Homo sapiens
cauucaaagggacggucaguu

SEQ ID NO: 1186309 - RNA, 21 nt, Homo sapiens
cauucacacugggccaagagc

SEQ ID NO: 1186310 - RNA, 22 nt, Homo sapiens
cauucacaguucuuugggccag

SEQ ID NO: 1186311 - RNA, 18 nt, Homo sapiens
cauucagauuuaccauaa

SEQ ID NO: 1186312 - RNA, 14 nt, Homo sapiens
cauucagcaucaga

SEQ ID NO: 1186313 - RNA, 18 nt, Homo sapiens
cauucaggcagcacugac

SEQ ID NO: 1186314 - RNA, 18 nt, Homo sapiens
cauucauaaaaguuugca

SEQ ID NO: 1186315 - RNA, 17 nt, Homo sapiens
cauucaugugggcauuu

SEQ ID NO: 1186316 - RNA, 18 nt, Homo sapiens
cauuccaagacucuagag

SEQ ID NO: 1186317 - RNA, 13 nt, Homo sapiens
cauucccaugagc

SEQ ID NO: 1186318 - RNA, 13 nt, Homo sapiens
cauuccugcucuc

SEQ ID NO: 1186319 - RNA, 17 nt, Homo sapiens
cauucuaagucacagga

SEQ ID NO: 1186320 - RNA, 15 nt, Homo sapiens
cauucuauauuccuu

SEQ ID NO: 1186321 - RNA, 14 nt, Homo sapiens
cauucugaaucaga

SEQ ID NO: 1186322 - RNA, 15 nt, Homo sapiens
cauucugcccugugg

SEQ ID NO: 1186323 - RNA, 16 nt, Homo sapiens
cauucuuaacaaacuc

SEQ ID NO: 1186324 - RNA, 18 nt, Homo sapiens
cauucuuaacaaacucuu

SEQ ID NO: 1186325 - RNA, 18 nt, Homo sapiens
cauugaaauguaauuuca

SEQ ID NO: 1186326 - RNA, 18 nt, Homo sapiens
cauugaaauuuacuguga

SEQ ID NO: 1186327 - RNA, 18 nt, Homo sapiens
cauugaaguaaugaauuu

SEQ ID NO: 1186328 - RNA, 18 nt, Homo sapiens
cauugaggaccucaucca

SEQ ID NO: 1186329 - RNA, 21 nt, Homo sapiens
cauugauguaauuuaaaacuu

SEQ ID NO: 1186330 - RNA, 15 nt, Homo sapiens
cauugcaauuuugca

SEQ ID NO: 1186331 - RNA, 18 nt, Homo sapiens
cauugcccagucuuucau

SEQ ID NO: 1186332 - RNA, 24 nt, Homo sapiens
cauugccuagagcgcugcacauug

SEQ ID NO: 1186333 - RNA, 22 nt, Homo sapiens
cauuggagagaaaaaacuuaag

SEQ ID NO: 1186334 - RNA, 17 nt, Homo sapiens
cauugggcacauaucuc

SEQ ID NO: 1186335 - RNA, 18 nt, Homo sapiens
cauugggcuacuguagau

SEQ ID NO: 1186336 - RNA, 16 nt, Homo sapiens
cauugguccaagauuc

SEQ ID NO: 1186337 - RNA, 22 nt, Homo sapiens
cauugguuaauuuuuacaugga

SEQ ID NO: 1186338 - RNA, 15 nt, Homo sapiens
cauuguaggauguug

SEQ ID NO: 1186339 - RNA, 17 nt, Homo sapiens
cauugucguuucauuca

SEQ ID NO: 1186340 - RNA, 16 nt, Homo sapiens
cauugugauuguggaa

SEQ ID NO: 1186341 - RNA, 14 nt, Homo sapiens
cauuguuauuuuca

SEQ ID NO: 1186342 - RNA, 22 nt, Homo sapiens
cauuguuggaguguaaaccaaa

SEQ ID NO: 1186343 - RNA, 22 nt, Homo sapiens
cauuguuuaucgcaauuacuug

SEQ ID NO: 1186344 - RNA, 18 nt, Homo sapiens
cauuuaaauuuuacccuu

SEQ ID NO: 1186345 - RNA, 21 nt, Homo sapiens
cauuuaauacagauaaguguu

SEQ ID NO: 1186346 - RNA, 14 nt, Homo sapiens
cauuuaauauggau

SEQ ID NO: 1186347 - RNA, 19 nt, Homo sapiens
cauuuaauuuuuauuaaac

SEQ ID NO: 1186348 - RNA, 14 nt, Homo sapiens
cauuuacccaacuc

SEQ ID NO: 1186349 - RNA, 14 nt, Homo sapiens
cauuuaugacaagc

SEQ ID NO: 1186350 - RNA, 22 nt, Homo sapiens
cauuuaugucucagaccacuau

SEQ ID NO: 1186351 - RNA, 17 nt, Homo sapiens
cauuuauuuaagacacu

SEQ ID NO: 1186352 - RNA, 17 nt, Homo sapiens
cauuuauuuacauaaau

SEQ ID NO: 1186353 - RNA, 17 nt, Homo sapiens
cauuuauuuuuauaucu

SEQ ID NO: 1186354 - RNA, 18 nt, Homo sapiens
cauuucacaaaacagccu

SEQ ID NO: 1186355 - RNA, 15 nt, Homo sapiens
cauuucauauucuuu

SEQ ID NO: 1186356 - RNA, 16 nt, Homo sapiens
cauuuccaaauucaca

SEQ ID NO: 1186357 - RNA, 15 nt, Homo sapiens
cauuuccaugcauaa

SEQ ID NO: 1186358 - RNA, 20 nt, Homo sapiens
cauuuccucuguucuuuuca

SEQ ID NO: 1186359 - RNA, 21 nt, Homo sapiens
cagugcaguuucuaagcaugu

SEQ ID NO: 1186360 - RNA, 22 nt, Homo sapiens
cagugcauuuuguuucuguaua

SEQ ID NO: 1186361 - RNA, 18 nt, Homo sapiens
cagugccauggauuucca

SEQ ID NO: 1186362 - RNA, 21 nt, Homo sapiens
cagugcccaccaacaucccau

SEQ ID NO: 1186363 - RNA, 16 nt, Homo sapiens
cagugcccccacugac

SEQ ID NO: 1186364 - RNA, 10 nt, Homo sapiens
cagugccuuc

SEQ ID NO: 1186365 - RNA, 21 nt, Homo sapiens
cagugcuggggaacaaccaga

SEQ ID NO: 1186366 - RNA, 17 nt, Homo sapiens
caguggaauuggugauu

SEQ ID NO: 1186367 - RNA, 15 nt, Homo sapiens
cagugguccuuuuca

SEQ ID NO: 1186368 - RNA, 19 nt, Homo sapiens
caguguauagaaaaaccaa

SEQ ID NO: 1186369 - RNA, 21 nt, Homo sapiens
caguguggccaggcugccugg

SEQ ID NO: 1186370 - RNA, 17 nt, Homo sapiens
caguguuacagugcuaa

SEQ ID NO: 1186371 - RNA, 19 nt, Homo sapiens
caguguuacuguguuuauc

SEQ ID NO: 1186372 - RNA, 21 nt, Homo sapiens
caguuacucccuacacugaug

SEQ ID NO: 1186373 - RNA, 17 nt, Homo sapiens
caguuaucuaaguuaau

SEQ ID NO: 1186374 - RNA, 14 nt, Homo sapiens
caguucugucauau

SEQ ID NO: 1186375 - RNA, 20 nt, Homo sapiens
caguugacucagagugcaag

SEQ ID NO: 1186376 - RNA, 20 nt, Homo sapiens
caguugauuguacguagcca

SEQ ID NO: 1186377 - RNA, 19 nt, Homo sapiens
caguugcaauucauaacua

SEQ ID NO: 1186378 - RNA, 18 nt, Homo sapiens
caguugcagcccuuguga

SEQ ID NO: 1186379 - RNA, 19 nt, Homo sapiens
caguuguccagaucacuga

SEQ ID NO: 1186380 - RNA, 17 nt, Homo sapiens
caguuguggugugagua

SEQ ID NO: 1186381 - RNA, 13 nt, Homo sapiens
caguuguuugugu

SEQ ID NO: 1186382 - RNA, 14 nt, Homo sapiens
caguuuaaucuuuu

SEQ ID NO: 1186383 - RNA, 17 nt, Homo sapiens
caguuuaccauccucaa

SEQ ID NO: 1186384 - RNA, 16 nt, Homo sapiens
caguuuagaacagagg

SEQ ID NO: 1186385 - RNA, 15 nt, Homo sapiens
caguuuauaaagcca

SEQ ID NO: 1186386 - RNA, 23 nt, Homo sapiens
caguuucuaucccuuaccugcuu

SEQ ID NO: 1186387 - RNA, 14 nt, Homo sapiens
caguuugugcucua

SEQ ID NO: 1186388 - RNA, 20 nt, Homo sapiens
caguuugugcucuacuguua

SEQ ID NO: 1186389 - RNA, 17 nt, Homo sapiens
cauaaaaagcagaauuu

SEQ ID NO: 1186390 - RNA, 13 nt, Homo sapiens
cauaaaacaaauc

SEQ ID NO: 1186391 - RNA, 18 nt, Homo sapiens
cauaaaauagagugcauu

SEQ ID NO: 1186392 - RNA, 23 nt, Homo sapiens
cauaaaauuuacauuuaauacag

SEQ ID NO: 1186393 - RNA, 21 nt, Homo sapiens
cauaaacuuuccucuuccugc

SEQ ID NO: 1186394 - RNA, 18 nt, Homo sapiens
cauaaagaagcaauaaag

SEQ ID NO: 1186395 - RNA, 22 nt, Homo sapiens
cauaaagaggcguugcuuucac

SEQ ID NO: 1186396 - RNA, 12 nt, Homo sapiens
cauaaaucacaa

SEQ ID NO: 1186397 - RNA, 16 nt, Homo sapiens
cauaaaugcagcccau

SEQ ID NO: 1186398 - RNA, 23 nt, Homo sapiens
cauaacgguuaagaaagcacuua

SEQ ID NO: 1186399 - RNA, 16 nt, Homo sapiens
cauaacuucuuacuag

SEQ ID NO: 1186400 - RNA, 21 nt, Homo sapiens
cauaacuuuguaaauauuacc

SEQ ID NO: 1186401 - RNA, 20 nt, Homo sapiens
cauaagacaaacuccugaaa

SEQ ID NO: 1186402 - RNA, 20 nt, Homo sapiens
cauaagaggaguaggcccug

SEQ ID NO: 1186403 - RNA, 13 nt, Homo sapiens
cauaagauucuau

SEQ ID NO: 1186404 - RNA, 17 nt, Homo sapiens
cauaagcauuacuuuau

SEQ ID NO: 1186405 - RNA, 11 nt, Homo sapiens
cauaagccuac

SEQ ID NO: 1186406 - RNA, 16 nt, Homo sapiens
cauaaggcuucaaaau

SEQ ID NO: 1186407 - RNA, 21 nt, Homo sapiens
cauaagugaaaaucuuacaac

SEQ ID NO: 1186408 - RNA, 15 nt, Homo sapiens
cauaauacaaaaggc

SEQ ID NO: 1186409 - RNA, 22 nt, Homo sapiens
cauaauagucaauuucuacuuc

SEQ ID NO: 1186410 - RNA, 12 nt, Homo sapiens
cauaaucuguac

SEQ ID NO: 1186411 - RNA, 15 nt, Homo sapiens
cauaaucuguacaau

SEQ ID NO: 1186412 - RNA, 16 nt, Homo sapiens
cauaauuaaaaagagc

SEQ ID NO: 1186413 - RNA, 22 nt, Homo sapiens
cauaauuaauguaguaguaaua

SEQ ID NO: 1186414 - RNA, 14 nt, Homo sapiens
cauaauuuaauucc

SEQ ID NO: 1186415 - RNA, 18 nt, Homo sapiens
cauaauuuacaugcaaua

SEQ ID NO: 1186416 - RNA, 18 nt, Homo sapiens
cauacaagagacauauaa

SEQ ID NO: 1186417 - RNA, 23 nt, Homo sapiens
cauacaauuauuuuuacaguucu

SEQ ID NO: 1186418 - RNA, 15 nt, Homo sapiens
cauacacaugagaua

SEQ ID NO: 1186419 - RNA, 13 nt, Homo sapiens
cauacaccagcau

SEQ ID NO: 1186420 - RNA, 13 nt, Homo sapiens
cauacacuugcau

SEQ ID NO: 1186421 - RNA, 12 nt, Homo sapiens
cauacagaauua

SEQ ID NO: 1186422 - RNA, 13 nt, Homo sapiens
cauacaugcugcg

SEQ ID NO: 1186423 - RNA, 21 nt, Homo sapiens
cauacauugauucaugucuca

SEQ ID NO: 1186424 - RNA, 20 nt, Homo sapiens
cauaccguuuauaaugccau

SEQ ID NO: 1186425 - RNA, 17 nt, Homo sapiens
cauaccuacauucaagg

SEQ ID NO: 1186426 - RNA, 22 nt, Homo sapiens
cauacgguaugauauugcagcu

SEQ ID NO: 1186427 - RNA, 22 nt, Homo sapiens
cauacuccaacugaaauguuaa

SEQ ID NO: 1186428 - RNA, 23 nt, Homo sapiens
cauacuccgugaggcugcugcca

SEQ ID NO: 1186429 - RNA, 16 nt, Homo sapiens
cauacuccuuccauca

SEQ ID NO: 1186430 - RNA, 16 nt, Homo sapiens
cauacugacauaagau

SEQ ID NO: 1186431 - RNA, 11 nt, Homo sapiens
cauacugguga

SEQ ID NO: 1186432 - RNA, 17 nt, Homo sapiens
cauacuucuguuuccau

SEQ ID NO: 1186433 - RNA, 18 nt, Homo sapiens
cauagaguauagcucugu

SEQ ID NO: 1186434 - RNA, 15 nt, Homo sapiens
cauagcagcugcuac

SEQ ID NO: 1186435 - RNA, 19 nt, Homo sapiens
cauagccugcagccucauc

SEQ ID NO: 1186436 - RNA, 20 nt, Homo sapiens
cauagcuacguggcacuaua

SEQ ID NO: 1186437 - RNA, 14 nt, Homo sapiens
cauagguaugcuua

SEQ ID NO: 1186438 - RNA, 16 nt, Homo sapiens
cauagguuuaauaauu

SEQ ID NO: 1186439 - RNA, 18 nt, Homo sapiens
cauaguuucaaaucugua

SEQ ID NO: 1186440 - RNA, 17 nt, Homo sapiens
cauauaaagcacuauac

SEQ ID NO: 1186441 - RNA, 14 nt, Homo sapiens
cauauaagcuauau

SEQ ID NO: 1186442 - RNA, 18 nt, Homo sapiens
cauauaagcuauaucaua

SEQ ID NO: 1186443 - RNA, 14 nt, Homo sapiens
cauauaaguuugaa

SEQ ID NO: 1186444 - RNA, 13 nt, Homo sapiens
cauauaccagcaa

SEQ ID NO: 1186445 - RNA, 16 nt, Homo sapiens
cauauaccagcaauau

SEQ ID NO: 1186446 - RNA, 18 nt, Homo sapiens
cauauaccaguugugaua

SEQ ID NO: 1186447 - RNA, 20 nt, Homo sapiens
cauauagaaaucuagaauuu

SEQ ID NO: 1186448 - RNA, 19 nt, Homo sapiens
cauauauauauauaacaua

SEQ ID NO: 1186449 - RNA, 16 nt, Homo sapiens
cauauauauuaauacu

SEQ ID NO: 1186450 - RNA, 13 nt, Homo sapiens
cauauauggaaga

SEQ ID NO: 1186451 - RNA, 23 nt, Homo sapiens
cauauauuugaaguggagccaua

SEQ ID NO: 1186452 - RNA, 18 nt, Homo sapiens
cauaucaguugagcuuca

SEQ ID NO: 1186453 - RNA, 19 nt, Homo sapiens
cauaucaugugugagauaa

SEQ ID NO: 1186454 - RNA, 17 nt, Homo sapiens
augugaucaucuuugcu

SEQ ID NO: 1186455 - RNA, 21 nt, Homo sapiens
augugauuuaauaguguuaau

SEQ ID NO: 1186456 - RNA, 17 nt, Homo sapiens
augugcacugcauuaga

SEQ ID NO: 1186457 - RNA, 21 nt, Homo sapiens
augugccgauccuugucaaaa

SEQ ID NO: 1186458 - RNA, 18 nt, Homo sapiens
augugcggggaucaucug

SEQ ID NO: 1186459 - RNA, 15 nt, Homo sapiens
auguggaaaagccaa

SEQ ID NO: 1186460 - RNA, 21 nt, Homo sapiens
auguggaagaacuuaggcauc

SEQ ID NO: 1186461 - RNA, 17 nt, Homo sapiens
auguggagccaggcgug

SEQ ID NO: 1186462 - RNA, 13 nt, Homo sapiens
augugggacaccu

SEQ ID NO: 1186463 - RNA, 20 nt, Homo sapiens
auguggguggcuucuaguuu

SEQ ID NO: 1186464 - RNA, 14 nt, Homo sapiens
augugguagccuca

SEQ ID NO: 1186465 - RNA, 16 nt, Homo sapiens
augugguuuuuugcca

SEQ ID NO: 1186466 - RNA, 12 nt, Homo sapiens
auguguauauau

SEQ ID NO: 1186467 - RNA, 16 nt, Homo sapiens
augugucaugcaugaa

SEQ ID NO: 1186468 - RNA, 15 nt, Homo sapiens
augugucuggaagaa

SEQ ID NO: 1186469 - RNA, 20 nt, Homo sapiens
augugugagaauaaacuaga

SEQ ID NO: 1186470 - RNA, 17 nt, Homo sapiens
augugugccuuguucaa

SEQ ID NO: 1186471 - RNA, 19 nt, Homo sapiens
auguguuucuccugagcua

SEQ ID NO: 1186472 - RNA, 21 nt, Homo sapiens
auguuaaagaugcacagaaua

SEQ ID NO: 1186473 - RNA, 16 nt, Homo sapiens
auguuaaccaauguau

SEQ ID NO: 1186474 - RNA, 18 nt, Homo sapiens
auguuaauguuauaucau

SEQ ID NO: 1186475 - RNA, 22 nt, Homo sapiens
auguuaauuuuuugguacaaaa

SEQ ID NO: 1186476 - RNA, 22 nt, Homo sapiens
auguuacuagagaagaagccuu

SEQ ID NO: 1186477 - RNA, 23 nt, Homo sapiens
auguuaguuuuucuuacuugcau

SEQ ID NO: 1186478 - RNA, 13 nt, Homo sapiens
auguuaugcauaa

SEQ ID NO: 1186479 - RNA, 13 nt, Homo sapiens
auguuauuaccua

SEQ ID NO: 1186480 - RNA, 17 nt, Homo sapiens
auguuauugccuaauca

SEQ ID NO: 1186481 - RNA, 14 nt, Homo sapiens
auguucaugugauu

SEQ ID NO: 1186482 - RNA, 15 nt, Homo sapiens
auguucaugugauua

SEQ ID NO: 1186483 - RNA, 9 nt, Homo sapiens
auguugaau

SEQ ID NO: 1186484 - RNA, 19 nt, Homo sapiens
auguugacauaccuuuuau

SEQ ID NO: 1186485 - RNA, 22 nt, Homo sapiens
auguugacuuuauuucugagca

SEQ ID NO: 1186486 - RNA, 22 nt, Homo sapiens
auguugcacacccacucagcuc

SEQ ID NO: 1186487 - RNA, 20 nt, Homo sapiens
aucuuuauacuuaaacagcu

SEQ ID NO: 1186488 - RNA, 23 nt, Homo sapiens
aucuuuggacagaagcagcucuu

SEQ ID NO: 1186489 - RNA, 12 nt, Homo sapiens
aucuuuguauau

SEQ ID NO: 1186490 - RNA, 15 nt, Homo sapiens
augaaaaaagcuuua

SEQ ID NO: 1186491 - RNA, 13 nt, Homo sapiens
augaaaacaauuc

SEQ ID NO: 1186492 - RNA, 18 nt, Homo sapiens
augaaaauagccaaccag

SEQ ID NO: 1186493 - RNA, 13 nt, Homo sapiens
augaaacuugaaa

SEQ ID NO: 1186494 - RNA, 18 nt, Homo sapiens
augaaagaugauuugcaa

SEQ ID NO: 1186495 - RNA, 20 nt, Homo sapiens
augaaauuauaaucugugga

SEQ ID NO: 1186496 - RNA, 16 nt, Homo sapiens
augaacaccauaccuu

SEQ ID NO: 1186497 - RNA, 13 nt, Homo sapiens
augaacacuuaau

SEQ ID NO: 1186498 - RNA, 16 nt, Homo sapiens
augaacaugguguuca

SEQ ID NO: 1186499 - RNA, 14 nt, Homo sapiens
augaaccacugcac

SEQ ID NO: 1186500 - RNA, 22 nt, Homo sapiens
augaaccuggcaagucacagga

SEQ ID NO: 1186501 - RNA, 23 nt, Homo sapiens
augaaccuggcaagucacaggac

SEQ ID NO: 1186502 - RNA, 22 nt, Homo sapiens
augaacgaauuaauuaccuggc

SEQ ID NO: 1186503 - RNA, 22 nt, Homo sapiens
augaacugucuuuuaaugugua

SEQ ID NO: 1186504 - RNA, 20 nt, Homo sapiens
augaacuucagaagugccau

SEQ ID NO: 1186505 - RNA, 19 nt, Homo sapiens
augaagcagagaggcacgu

SEQ ID NO: 1186506 - RNA, 22 nt, Homo sapiens
augaagccacagcccaggccuc

SEQ ID NO: 1186507 - RNA, 16 nt, Homo sapiens
augaaggaaggacuau

SEQ ID NO: 1186508 - RNA, 17 nt, Homo sapiens
augaaggaaggacuaug

SEQ ID NO: 1186509 - RNA, 19 nt, Homo sapiens
augaaggaaggacuaugac

SEQ ID NO: 1186510 - RNA, 20 nt, Homo sapiens
augaaggaaggacuaugaca

SEQ ID NO: 1186511 - RNA, 19 nt, Homo sapiens
augaaggcucauuuacuug

SEQ ID NO: 1186512 - RNA, 18 nt, Homo sapiens
augaagguggaacaagca

SEQ ID NO: 1186513 - RNA, 22 nt, Homo sapiens
augaagguggagggucucuagu

SEQ ID NO: 1186514 - RNA, 14 nt, Homo sapiens
augaaggugugcua

SEQ ID NO: 1186515 - RNA, 12 nt, Homo sapiens
augaagugaauu

SEQ ID NO: 1186516 - RNA, 15 nt, Homo sapiens
uuucagaaauauuca

SEQ ID NO: 1186517 - RNA, 11 nt, Homo sapiens
uuucagaacac

SEQ ID NO: 1186518 - RNA, 14 nt, Homo sapiens
uuucagaacacaag

SEQ ID NO: 1186519 - RNA, 14 nt, Homo sapiens
uuucagagugacac

SEQ ID NO: 1186520 - RNA, 20 nt, Homo sapiens
uuucagauauaaauacugac

SEQ ID NO: 1186521 - RNA, 17 nt, Homo sapiens
uuucagauuuauuuccc

SEQ ID NO: 1186522 - RNA, 13 nt, Homo sapiens
uuucagcauaaau

SEQ ID NO: 1186523 - RNA, 18 nt, Homo sapiens
uuucagguuccaaucaga

SEQ ID NO: 1186524 - RNA, 19 nt, Homo sapiens
uuucaguauuaaacucucc

SEQ ID NO: 1186525 - RNA, 16 nt, Homo sapiens
uuucauaucuacagau

SEQ ID NO: 1186526 - RNA, 21 nt, Homo sapiens
uuucaucccagaaacuccaga

SEQ ID NO: 1186527 - RNA, 18 nt, Homo sapiens
uuucaucuaacgugcauu

SEQ ID NO: 1186528 - RNA, 19 nt, Homo sapiens
uuucaucuaacgugcauua

SEQ ID NO: 1186529 - RNA, 12 nt, Homo sapiens
uuucauggaaaa

SEQ ID NO: 1186530 - RNA, 19 nt, Homo sapiens
uuucauggucugcugagua

SEQ ID NO: 1186531 - RNA, 13 nt, Homo sapiens
uuucauguaaucc

SEQ ID NO: 1186532 - RNA, 23 nt, Homo sapiens
uuucauuuuugauuagaggaacu

SEQ ID NO: 1186533 - RNA, 20 nt, Homo sapiens
uuuccaaauauuuugcuuua

SEQ ID NO: 1186534 - RNA, 15 nt, Homo sapiens
uuuccaaauucacaa

SEQ ID NO: 1186535 - RNA, 16 nt, Homo sapiens
uuuccaauuagcuccu

SEQ ID NO: 1186536 - RNA, 15 nt, Homo sapiens
uuuccacuccauugu

SEQ ID NO: 1186537 - RNA, 20 nt, Homo sapiens
uuuccacucccacugccagg

SEQ ID NO: 1186538 - RNA, 19 nt, Homo sapiens
uuuccagacuuccuugaga

SEQ ID NO: 1186539 - RNA, 16 nt, Homo sapiens
uuuccauaaucacuca

SEQ ID NO: 1186540 - RNA, 15 nt, Homo sapiens
uuuccauagcucuuc

SEQ ID NO: 1186541 - RNA, 15 nt, Homo sapiens
uuuccaucccuagcc

SEQ ID NO: 1186542 - RNA, 22 nt, Homo sapiens
uuuccaugcacccucauacaca

SEQ ID NO: 1186543 - RNA, 23 nt, Homo sapiens
uuuccaugggaccacaacuauuu

SEQ ID NO: 1186544 - RNA, 20 nt, Homo sapiens
uuucccacaucuuuccucaa

SEQ ID NO: 1186545 - RNA, 12 nt, Homo sapiens
uuucccaggacg

SEQ ID NO: 1186546 - RNA, 14 nt, Homo sapiens
uuucccucuacuaa

SEQ ID NO: 1186547 - RNA, 23 nt, Homo sapiens
uuucccuucccugggaggcuaga

SEQ ID NO: 1186548 - RNA, 14 nt, Homo sapiens
uuuccguuuugccu

SEQ ID NO: 1186549 - RNA, 17 nt, Homo sapiens
uuuccuaaggccacugu

SEQ ID NO: 1186550 - RNA, 17 nt, Homo sapiens
uuuccuacuucauucca

SEQ ID NO: 1186551 - RNA, 16 nt, Homo sapiens
uuuccucagugcauuu

SEQ ID NO: 1186552 - RNA, 19 nt, Homo sapiens
uuuccucauaaacauuuga

SEQ ID NO: 1186553 - RNA, 18 nt, Homo sapiens
uuuccucccuucugcuac

SEQ ID NO: 1186554 - RNA, 15 nt, Homo sapiens
uuuccuccucaggca

SEQ ID NO: 1186555 - RNA, 22 nt, Homo sapiens
uuuccuccucccagugccuucu

SEQ ID NO: 1186556 - RNA, 14 nt, Homo sapiens
uuuccucucucucc

SEQ ID NO: 1186557 - RNA, 14 nt, Homo sapiens
uuucuaagauucua

SEQ ID NO: 1186558 - RNA, 17 nt, Homo sapiens
uuucuagaugucucuga

SEQ ID NO: 1186559 - RNA, 12 nt, Homo sapiens
uuucuaucauuc

SEQ ID NO: 1186560 - RNA, 14 nt, Homo sapiens
uuucuaugugacaa

SEQ ID NO: 1186561 - RNA, 16 nt, Homo sapiens
uuucucagacuuugga

SEQ ID NO: 1186562 - RNA, 17 nt, Homo sapiens
uuucucccuauuaggga

SEQ ID NO: 1186563 - RNA, 15 nt, Homo sapiens
uuucucuugugcaau

SEQ ID NO: 1186564 - RNA, 15 nt, Homo sapiens
uuucugaaucucugg

SEQ ID NO: 1186565 - RNA, 13 nt, Homo sapiens
uuucugaguucuu

SEQ ID NO: 1186566 - RNA, 21 nt, Homo sapiens
uuucugggagacagaaaacau

SEQ ID NO: 1186567 - RNA, 14 nt, Homo sapiens
uuucuguaguguga

SEQ ID NO: 1186568 - RNA, 15 nt, Homo sapiens
uuucuguagugugaa

SEQ ID NO: 1186569 - RNA, 16 nt, Homo sapiens
uuucugucaagcauau

SEQ ID NO: 1186570 - RNA, 20 nt, Homo sapiens
uuucuuaaagcaaagucacu

SEQ ID NO: 1186571 - RNA, 16 nt, Homo sapiens
uggccagaggugucac

SEQ ID NO: 1186572 - RNA, 17 nt, Homo sapiens
uggccagaggugucacc

SEQ ID NO: 1186573 - RNA, 17 nt, Homo sapiens
uggccagauuuccucac

SEQ ID NO: 1186574 - RNA, 23 nt, Homo sapiens
uggccagauuuccucacuaccug

SEQ ID NO: 1186575 - RNA, 17 nt, Homo sapiens
ugcuguggcaggcagau

SEQ ID NO: 1186576 - RNA, 18 nt, Homo sapiens
ugcuguguaacagaacac

SEQ ID NO: 1186577 - RNA, 20 nt, Homo sapiens
ugcuguguuuaaucagggga

SEQ ID NO: 1186578 - RNA, 15 nt, Homo sapiens
ugcuguucguucaaa

SEQ ID NO: 1186579 - RNA, 13 nt, Homo sapiens
ugcuuaaauucaa

SEQ ID NO: 1186580 - RNA, 15 nt, Homo sapiens
ugcuuaacauugaca

SEQ ID NO: 1186581 - RNA, 14 nt, Homo sapiens
ugcuuaaucuugcu

SEQ ID NO: 1186582 - RNA, 23 nt, Homo sapiens
ugcuucaccagacuuuucucuag

SEQ ID NO: 1186583 - RNA, 14 nt, Homo sapiens
ugcuucaucauucc

SEQ ID NO: 1186584 - RNA, 22 nt, Homo sapiens
ugcuucccagguucaagcgauu

SEQ ID NO: 1186585 - RNA, 21 nt, Homo sapiens
ugcccccucaaacacuaaagg

SEQ ID NO: 1186586 - RNA, 19 nt, Homo sapiens
ugccccuauagaaacacca

SEQ ID NO: 1186587 - RNA, 12 nt, Homo sapiens
ugccccuaugcc

SEQ ID NO: 1186588 - RNA, 14 nt, Homo sapiens
ugccccucucuggg

SEQ ID NO: 1186589 - RNA, 21 nt, Homo sapiens
ugcccguaaacacgccugcaa

SEQ ID NO: 1186590 - RNA, 16 nt, Homo sapiens
ugcccuaggugagaac

SEQ ID NO: 1186591 - RNA, 19 nt, Homo sapiens
ugcccuucacuguugcuua

SEQ ID NO: 1186592 - RNA, 17 nt, Homo sapiens
ugcccuuuuaauacagg

SEQ ID NO: 1186593 - RNA, 13 nt, Homo sapiens
ugcccuuuuccag

SEQ ID NO: 1186594 - RNA, 13 nt, Homo sapiens
ugccgcuaccucc

SEQ ID NO: 1186595 - RNA, 16 nt, Homo sapiens
ugccgucccaaauaca

SEQ ID NO: 1186596 - RNA, 17 nt, Homo sapiens
ugccuaagacauguaac

SEQ ID NO: 1186597 - RNA, 22 nt, Homo sapiens
ugccuacgaauagccacugcau

SEQ ID NO: 1186598 - RNA, 23 nt, Homo sapiens
ugccuaucaaagaguauguugua

SEQ ID NO: 1186599 - RNA, 17 nt, Homo sapiens
ugccuauggaguagcca

SEQ ID NO: 1186600 - RNA, 20 nt, Homo sapiens
ugccucacaucucccuucca

SEQ ID NO: 1186601 - RNA, 14 nt, Homo sapiens
ugccucagccuccc

SEQ ID NO: 1186602 - RNA, 21 nt, Homo sapiens
ugccuccagugcaguccauuu

SEQ ID NO: 1186603 - RNA, 19 nt, Homo sapiens
ugccucccagguuccagca

SEQ ID NO: 1186604 - RNA, 15 nt, Homo sapiens
ugccuccgcaccuga

SEQ ID NO: 1186605 - RNA, 17 nt, Homo sapiens
ugccucgaaagugucau

SEQ ID NO: 1186606 - RNA, 23 nt, Homo sapiens
ugccucgguugauugugcaugga

SEQ ID NO: 1186607 - RNA, 13 nt, Homo sapiens
ugccucuacuuug

SEQ ID NO: 1186608 - RNA, 22 nt, Homo sapiens
ugccucuacuuugauucugaua

SEQ ID NO: 1186609 - RNA, 22 nt, Homo sapiens
ugccucucgguugaaaccugua

SEQ ID NO: 1186610 - RNA, 21 nt, Homo sapiens
ugccucugacagcagccugug

SEQ ID NO: 1186611 - RNA, 22 nt, Homo sapiens
ugccucugucuagcaugccaac

SEQ ID NO: 1186612 - RNA, 22 nt, Homo sapiens
ugccugaagaccccagauguga

SEQ ID NO: 1186613 - RNA, 13 nt, Homo sapiens
ugccugacauuug

SEQ ID NO: 1186614 - RNA, 15 nt, Homo sapiens
ugccugcagcacaug

SEQ ID NO: 1186615 - RNA, 20 nt, Homo sapiens
ugccuggaaaguccuccuau

SEQ ID NO: 1186616 - RNA, 18 nt, Homo sapiens
ugccuggccuccgaugcc

SEQ ID NO: 1186617 - RNA, 16 nt, Homo sapiens
ugccuggccuggcaca

SEQ ID NO: 1186618 - RNA, 17 nt, Homo sapiens
ugccuguaacagccacc

SEQ ID NO: 1186619 - RNA, 14 nt, Homo sapiens
ugccugucugucca

SEQ ID NO: 1186620 - RNA, 20 nt, Homo sapiens
ugccugugcuauuuuacuug

SEQ ID NO: 1186621 - RNA, 15 nt, Homo sapiens
ugccuuagcauguga

SEQ ID NO: 1186622 - RNA, 23 nt, Homo sapiens
ugccuuaucuaaaucaccagaga

SEQ ID NO: 1186623 - RNA, 13 nt, Homo sapiens
ugccuuccuaaau

SEQ ID NO: 1186624 - RNA, 17 nt, Homo sapiens
ugccuucucaccagcug

SEQ ID NO: 1186625 - RNA, 17 nt, Homo sapiens
ugccuuuggacuugucc

SEQ ID NO: 1186626 - RNA, 19 nt, Homo sapiens
ugcgaaacgggggaaggga

SEQ ID NO: 1186627 - RNA, 21 nt, Homo sapiens
ugcgaaacgggggaagggagc

SEQ ID NO: 1186628 - RNA, 17 nt, Homo sapiens
ugcgaguauguguuugu

SEQ ID NO: 1186629 - RNA, 15 nt, Homo sapiens
ugcgccgagccucag

SEQ ID NO: 1186630 - RNA, 17 nt, Homo sapiens
ugcgcugggcacuuccc

SEQ ID NO: 1186631 - RNA, 21 nt, Homo sapiens
ugcgggcauuuugaaugugau

SEQ ID NO: 1186632 - RNA, 18 nt, Homo sapiens
ugcggggggcaccagagg

SEQ ID NO: 1186633 - RNA, 18 nt, Homo sapiens
ugcggguccucagcugcu

SEQ ID NO: 1186634 - RNA, 21 nt, Homo sapiens
ugcgugacacucuccuugcag

SEQ ID NO: 1186635 - RNA, 22 nt, Homo sapiens
ugcgugacacucuccuugcagu

SEQ ID NO: 1186636 - RNA, 15 nt, Homo sapiens
ugcguggacucugca

SEQ ID NO: 1186637 - RNA, 16 nt, Homo sapiens
ugcguggacucugcac

SEQ ID NO: 1186638 - RNA, 14 nt, Homo sapiens
ugcguggcucuccu

SEQ ID NO: 1186639 - RNA, 17 nt, Homo sapiens
ugcguugaugacuuuuu

SEQ ID NO: 1186640 - RNA, 21 nt, Homo sapiens
ugcuaaaugcuacauacucca

SEQ ID NO: 1186641 - RNA, 23 nt, Homo sapiens
ugcuaacucuguuauucuucaaa

SEQ ID NO: 1186642 - RNA, 12 nt, Homo sapiens
ugcuacacugcu

SEQ ID NO: 1186643 - RNA, 17 nt, Homo sapiens
ugcuacagaaagcacaa

SEQ ID NO: 1186644 - RNA, 17 nt, Homo sapiens
ugcuacaugguuuagau

SEQ ID NO: 1186645 - RNA, 15 nt, Homo sapiens
ugcuacuagcucuuu

SEQ ID NO: 1186646 - RNA, 24 nt, Homo sapiens
ugcuacugauuguuucauugcgaa

SEQ ID NO: 1186647 - RNA, 19 nt, Homo sapiens
ugcuacuuucagaggcguu

SEQ ID NO: 1186648 - RNA, 18 nt, Homo sapiens
ugcuagaaaaauguucuu

SEQ ID NO: 1186649 - RNA, 22 nt, Homo sapiens
ugcuagcaaauggcagaaccaa

SEQ ID NO: 1186650 - RNA, 13 nt, Homo sapiens
ugcuagucacugg

SEQ ID NO: 1186651 - RNA, 20 nt, Homo sapiens
ugcuauaacuaugaccaugc

SEQ ID NO: 1186652 - RNA, 12 nt, Homo sapiens
ugcuauaaucau

SEQ ID NO: 1186653 - RNA, 16 nt, Homo sapiens
ugcuauaguauuugau

SEQ ID NO: 1186654 - RNA, 22 nt, Homo sapiens
ugcucaaagauguaauguaguu

SEQ ID NO: 1186655 - RNA, 20 nt, Homo sapiens
ugcucagagaaggaaaagac

SEQ ID NO: 1186656 - RNA, 18 nt, Homo sapiens
ugcucagauagaaugaca

SEQ ID NO: 1186657 - RNA, 11 nt, Homo sapiens
ugcucaggaaa

SEQ ID NO: 1186658 - RNA, 19 nt, Homo sapiens
ugcucaguaccuguguuga

SEQ ID NO: 1186659 - RNA, 16 nt, Homo sapiens
ugcucaguagcuuaag

SEQ ID NO: 1186660 - RNA, 16 nt, Homo sapiens
ugcuccaagauucuag

SEQ ID NO: 1186661 - RNA, 16 nt, Homo sapiens
ugcuccaaguugagac

SEQ ID NO: 1186662 - RNA, 22 nt, Homo sapiens
ugcuccauagagcagugcacau

SEQ ID NO: 1186663 - RNA, 13 nt, Homo sapiens
ugcucccacacuu

SEQ ID NO: 1186664 - RNA, 14 nt, Homo sapiens
ugcucccacagaac

SEQ ID NO: 1186665 - RNA, 15 nt, Homo sapiens
ugcuccccucugcac

SEQ ID NO: 1186666 - RNA, 12 nt, Homo sapiens
ugcuccggccug

SEQ ID NO: 1186667 - RNA, 18 nt, Homo sapiens
ugcuccguggacugcagu

SEQ ID NO: 1186668 - RNA, 16 nt, Homo sapiens
ugcuccuaaggguaga

SEQ ID NO: 1186669 - RNA, 21 nt, Homo sapiens
ugcuccuagagggaggggccu

SEQ ID NO: 1186670 - RNA, 17 nt, Homo sapiens
ugcuccugaagcccuau

SEQ ID NO: 1186671 - RNA, 15 nt, Homo sapiens
ugcucgcccaggaag

SEQ ID NO: 1186672 - RNA, 17 nt, Homo sapiens
ugcucuaaaaaccuuca

SEQ ID NO: 1186673 - RNA, 16 nt, Homo sapiens
ugcucuaaugccaagu

SEQ ID NO: 1186674 - RNA, 17 nt, Homo sapiens
ugcucuaggaagacauu

SEQ ID NO: 1186675 - RNA, 21 nt, Homo sapiens
ugcucuccggcgcagacaggc

SEQ ID NO: 1186676 - RNA, 21 nt, Homo sapiens
ugcucucuugugacgugcacu

SEQ ID NO: 1186677 - RNA, 18 nt, Homo sapiens
ugcucugccuaauuacga

SEQ ID NO: 1186678 - RNA, 13 nt, Homo sapiens
ugcucugccucua

SEQ ID NO: 1186679 - RNA, 20 nt, Homo sapiens
ugcucugcuugacaacaucu

SEQ ID NO: 1186680 - RNA, 20 nt, Homo sapiens
ugcucuuaucuuucuugacu

SEQ ID NO: 1186681 - RNA, 22 nt, Homo sapiens
ugcucuuguuucuaacaaggac

SEQ ID NO: 1186682 - RNA, 18 nt, Homo sapiens
ugcugaaacucagugcaa

SEQ ID NO: 1186683 - RNA, 17 nt, Homo sapiens
ugcugaagcugagcuag

SEQ ID NO: 1186684 - RNA, 20 nt, Homo sapiens
ugcugaccuuuuuaucuuga

SEQ ID NO: 1186685 - RNA, 21 nt, Homo sapiens
ugcugagugagugaugaauca

SEQ ID NO: 1186686 - RNA, 15 nt, Homo sapiens
ugcugauuuggugac

SEQ ID NO: 1186687 - RNA, 18 nt, Homo sapiens
ugcugcaccaaugcacug

SEQ ID NO: 1186688 - RNA, 15 nt, Homo sapiens
ugcugcagucaucua

SEQ ID NO: 1186689 - RNA, 22 nt, Homo sapiens
ugcugccccucccugccuccac

SEQ ID NO: 1186690 - RNA, 13 nt, Homo sapiens
ugcugcugcucau

SEQ ID NO: 1186691 - RNA, 15 nt, Homo sapiens
ugcuggaaaaucugu

SEQ ID NO: 1186692 - RNA, 15 nt, Homo sapiens
ugcuggaaaccaagu

SEQ ID NO: 1186693 - RNA, 14 nt, Homo sapiens
ugcuggaaagggag

SEQ ID NO: 1186694 - RNA, 16 nt, Homo sapiens
ugcuggccugcucuua

SEQ ID NO: 1186695 - RNA, 19 nt, Homo sapiens
ugcuggcgacacucagggc

SEQ ID NO: 1186696 - RNA, 20 nt, Homo sapiens
ugcuggcgacacucagggca

SEQ ID NO: 1186697 - RNA, 22 nt, Homo sapiens
ugcuggcucugcuguccuugcc

SEQ ID NO: 1186698 - RNA, 23 nt, Homo sapiens
ugcugggauuacaggcgugaucc

SEQ ID NO: 1186699 - RNA, 21 nt, Homo sapiens
ugcugggcugacggugcaguc

SEQ ID NO: 1186700 - RNA, 18 nt, Homo sapiens
ugcugggggcaacuggcc

SEQ ID NO: 1186701 - RNA, 18 nt, Homo sapiens
ugcugguagcugagggga

SEQ ID NO: 1186702 - RNA, 14 nt, Homo sapiens
ugcuggugaaccag

SEQ ID NO: 1186703 - RNA, 13 nt, Homo sapiens
ugcugugcugugu

SEQ ID NO: 1186704 - RNA, 16 nt, Homo sapiens
ucacugcaagcuccaa

SEQ ID NO: 1186705 - RNA, 13 nt, Homo sapiens
ucacugccguccc

SEQ ID NO: 1186706 - RNA, 12 nt, Homo sapiens
ucacugcugauu

SEQ ID NO: 1186707 - RNA, 21 nt, Homo sapiens
ucacugggccuccaaccaugu

SEQ ID NO: 1186708 - RNA, 15 nt, Homo sapiens
ucacugggucugcug

SEQ ID NO: 1186709 - RNA, 14 nt, Homo sapiens
ucacugguugcacu

SEQ ID NO: 1186710 - RNA, 20 nt, Homo sapiens
ucacuguccaccaccaccug

SEQ ID NO: 1186711 - RNA, 20 nt, Homo sapiens
ucacuguccagguaggaaac

SEQ ID NO: 1186712 - RNA, 23 nt, Homo sapiens
ucacuguccuccacacaagggaa

SEQ ID NO: 1186713 - RNA, 11 nt, Homo sapiens
ucacugugcuc

SEQ ID NO: 1186714 - RNA, 15 nt, Homo sapiens
ucacuguguguuuua

SEQ ID NO: 1186715 - RNA, 13 nt, Homo sapiens
ucacuguugcuua

SEQ ID NO: 1186716 - RNA, 23 nt, Homo sapiens
ucacuguugcuuaauugugaaca

SEQ ID NO: 1186717 - RNA, 17 nt, Homo sapiens
ucacuuaaagucaggag

SEQ ID NO: 1186718 - RNA, 12 nt, Homo sapiens
ucacuucaugca

SEQ ID NO: 1186719 - RNA, 13 nt, Homo sapiens
ucacuucuuuucu

SEQ ID NO: 1186720 - RNA, 17 nt, Homo sapiens
ucacuuuuuuuuuccaa

SEQ ID NO: 1186721 - RNA, 23 nt, Homo sapiens
ucagaaaccaaagcuuuauuuca

SEQ ID NO: 1186722 - RNA, 19 nt, Homo sapiens
ucagaagaccccugacuca

SEQ ID NO: 1186723 - RNA, 22 nt, Homo sapiens
ucagaaggcuucaucaccaaga

SEQ ID NO: 1186724 - RNA, 17 nt, Homo sapiens
ucagaauugaaacacuu

SEQ ID NO: 1186725 - RNA, 17 nt, Homo sapiens
ucagacaccuguucaca

SEQ ID NO: 1186726 - RNA, 14 nt, Homo sapiens
ucagacagcuugaa

SEQ ID NO: 1186727 - RNA, 16 nt, Homo sapiens
ucagacauuggcaccu

SEQ ID NO: 1186728 - RNA, 16 nt, Homo sapiens
ucagacugcacccagg

SEQ ID NO: 1186729 - RNA, 16 nt, Homo sapiens
ucagagaaaacacuuu

SEQ ID NO: 1186730 - RNA, 22 nt, Homo sapiens
ucagagcauuuuguugccucag

SEQ ID NO: 1186731 - RNA, 14 nt, Homo sapiens
ucagagcugggaaa

SEQ ID NO: 1186732 - RNA, 17 nt, Homo sapiens
ucagaggcgcacuguga

SEQ ID NO: 1186733 - RNA, 22 nt, Homo sapiens
ucagaggcguuugaaucagagu

SEQ ID NO: 1186734 - RNA, 18 nt, Homo sapiens
ucagagggcguguuguuu

SEQ ID NO: 1186735 - RNA, 17 nt, Homo sapiens
ucagaggucucugcuag

SEQ ID NO: 1186736 - RNA, 14 nt, Homo sapiens
ucagaguagaacca

SEQ ID NO: 1186737 - RNA, 14 nt, Homo sapiens
ucagagugacucca

SEQ ID NO: 1186738 - RNA, 19 nt, Homo sapiens
ucagaguuucagcuuucuu

SEQ ID NO: 1186739 - RNA, 21 nt, Homo sapiens
ucagaguuucgucagugaaca

SEQ ID NO: 1186740 - RNA, 19 nt, Homo sapiens
ucagaguuugguuaaucag

SEQ ID NO: 1186741 - RNA, 16 nt, Homo sapiens
ucagauaucaaaauuc

SEQ ID NO: 1186742 - RNA, 19 nt, Homo sapiens
ucagaucuaucuugucaau

SEQ ID NO: 1186743 - RNA, 23 nt, Homo sapiens
ucagaugaauuguuaauuaucua

SEQ ID NO: 1186744 - RNA, 20 nt, Homo sapiens
ucagaugcuccaagauucua

SEQ ID NO: 1186745 - RNA, 12 nt, Homo sapiens
ucagauguggag

SEQ ID NO: 1186746 - RNA, 22 nt, Homo sapiens
ucagauguggcaauucagggcg

SEQ ID NO: 1186747 - RNA, 16 nt, Homo sapiens
ucagauugcaugugac

SEQ ID NO: 1186748 - RNA, 11 nt, Homo sapiens
ucagauuuauu

SEQ ID NO: 1186749 - RNA, 15 nt, Homo sapiens
ucagcacucagagac

SEQ ID NO: 1186750 - RNA, 17 nt, Homo sapiens
ucagcacugucuugucu

SEQ ID NO: 1186751 - RNA, 15 nt, Homo sapiens
ucagcagcccuccuc

SEQ ID NO: 1186752 - RNA, 17 nt, Homo sapiens
ucagcaggaaugcucug

SEQ ID NO: 1186753 - RNA, 20 nt, Homo sapiens
ucagcauaaaugggaacuga

SEQ ID NO: 1186754 - RNA, 21 nt, Homo sapiens
ucagcaucugaccaucuguga

SEQ ID NO: 1186755 - RNA, 15 nt, Homo sapiens
ucagcauuuaaucca

SEQ ID NO: 1186756 - RNA, 19 nt, Homo sapiens
ucagcauuuccacaccaag

SEQ ID NO: 1186757 - RNA, 18 nt, Homo sapiens
ucaaauuauuaccaguga

SEQ ID NO: 1186758 - RNA, 16 nt, Homo sapiens
ucaaauuggagcuuca

SEQ ID NO: 1186759 - RNA, 19 nt, Homo sapiens
ucaaauuuagaaacuaauu

SEQ ID NO: 1186760 - RNA, 17 nt, Homo sapiens
ucaacaauaaagacuga

SEQ ID NO: 1186761 - RNA, 23 nt, Homo sapiens
ucaacacugaaaaaauacuaccu

SEQ ID NO: 1186762 - RNA, 16 nt, Homo sapiens
ucaacagauaaaugac

SEQ ID NO: 1186763 - RNA, 14 nt, Homo sapiens
ucaacaugagucaa

SEQ ID NO: 1186764 - RNA, 14 nt, Homo sapiens
ucaacauuuccaaa

SEQ ID NO: 1186765 - RNA, 13 nt, Homo sapiens
ucaacauuucuca

SEQ ID NO: 1186766 - RNA, 22 nt, Homo sapiens
ucaaccaccuaggcaaugaaga

SEQ ID NO: 1186767 - RNA, 16 nt, Homo sapiens
ucaacccccuaccccg

SEQ ID NO: 1186768 - RNA, 22 nt, Homo sapiens
ucaaccuucuagguuucucuug

SEQ ID NO: 1186769 - RNA, 20 nt, Homo sapiens
ucaacguuuuuggacacugu

SEQ ID NO: 1186770 - RNA, 21 nt, Homo sapiens
ucaacuagaaacaguacauug

SEQ ID NO: 1186771 - RNA, 23 nt, Homo sapiens
ucaacucuccaauguucuauuaa

SEQ ID NO: 1186772 - RNA, 21 nt, Homo sapiens
ucaacugcucuuuuauacugu

SEQ ID NO: 1186773 - RNA, 18 nt, Homo sapiens
ucaacugggaaccuucau

SEQ ID NO: 1186774 - RNA, 16 nt, Homo sapiens
ucaacuugcuuaucaa

SEQ ID NO: 1186775 - RNA, 18 nt, Homo sapiens
ucaagaacaauaucgacu

SEQ ID NO: 1186776 - RNA, 14 nt, Homo sapiens
ucaagaacacagcc

SEQ ID NO: 1186777 - RNA, 12 nt, Homo sapiens
ucaagacuugau

SEQ ID NO: 1186778 - RNA, 21 nt, Homo sapiens
ucaagacuugauacugcaaua

SEQ ID NO: 1186779 - RNA, 14 nt, Homo sapiens
ucaagagacacugc

SEQ ID NO: 1186780 - RNA, 15 nt, Homo sapiens
ucaagagacacugcu

SEQ ID NO: 1186781 - RNA, 14 nt, Homo sapiens
ucaagaggaaugaa

SEQ ID NO: 1186782 - RNA, 16 nt, Homo sapiens
ucaagaggcugagaca

SEQ ID NO: 1186783 - RNA, 17 nt, Homo sapiens
ucaagaggcugagacag

SEQ ID NO: 1186784 - RNA, 18 nt, Homo sapiens
ucaagaguaguuauauaa

SEQ ID NO: 1186785 - RNA, 14 nt, Homo sapiens
ucaagagucucucc

SEQ ID NO: 1186786 - RNA, 19 nt, Homo sapiens
ucaagauaaaucaaaguaa

SEQ ID NO: 1186787 - RNA, 13 nt, Homo sapiens
ucaagcaauccuc

SEQ ID NO: 1186788 - RNA, 22 nt, Homo sapiens
ucaagcagacauagaagagcca

SEQ ID NO: 1186789 - RNA, 13 nt, Homo sapiens
ucaagcagguuuc

SEQ ID NO: 1186790 - RNA, 14 nt, Homo sapiens
ucaagcauauugga

SEQ ID NO: 1186791 - RNA, 15 nt, Homo sapiens
ucaagcauauuggaa

SEQ ID NO: 1186792 - RNA, 22 nt, Homo sapiens
ucaagcgauucuccugccucag

SEQ ID NO: 1186793 - RNA, 22 nt, Homo sapiens
ucaagcuuuuaaaaacuagagc

SEQ ID NO: 1186794 - RNA, 20 nt, Homo sapiens
ucaaggaaagggcaguggac

SEQ ID NO: 1186795 - RNA, 14 nt, Homo sapiens
ucaaggcacucuag

SEQ ID NO: 1186796 - RNA, 15 nt, Homo sapiens
ucaaggccuacugac

SEQ ID NO: 1186797 - RNA, 14 nt, Homo sapiens
ucaaggugcucaau

SEQ ID NO: 1186798 - RNA, 17 nt, Homo sapiens
ucaagguucuaacccua

SEQ ID NO: 1186799 - RNA, 21 nt, Homo sapiens
ucaaguaauccaccugccucg

SEQ ID NO: 1186800 - RNA, 16 nt, Homo sapiens
ucaagucccccaagac

SEQ ID NO: 1186801 - RNA, 22 nt, Homo sapiens
ucaagugauucuccugccucag

SEQ ID NO: 1186802 - RNA, 14 nt, Homo sapiens
ucaaguuccagugc

SEQ ID NO: 1186803 - RNA, 17 nt, Homo sapiens
guaauuaauaaacgaag

SEQ ID NO: 1186804 - RNA, 18 nt, Homo sapiens
guaauuauguuuugugau

SEQ ID NO: 1186805 - RNA, 20 nt, Homo sapiens
guaauugcagauaacuuuga

SEQ ID NO: 1186806 - RNA, 15 nt, Homo sapiens
guaauuuggcuccuu

SEQ ID NO: 1186807 - RNA, 22 nt, Homo sapiens
guacaaaaccacucgccagagc

SEQ ID NO: 1186808 - RNA, 19 nt, Homo sapiens
guacaaaagagaagcaaaa

SEQ ID NO: 1186809 - RNA, 13 nt, Homo sapiens
guacaaaggggaa

SEQ ID NO: 1186810 - RNA, 12 nt, Homo sapiens
guacaacacugg

SEQ ID NO: 1186811 - RNA, 16 nt, Homo sapiens
guacacagcaccagaa

SEQ ID NO: 1186812 - RNA, 20 nt, Homo sapiens
guacacugugucucuaugug

SEQ ID NO: 1186813 - RNA, 14 nt, Homo sapiens
guacagacagagaa

SEQ ID NO: 1186814 - RNA, 15 nt, Homo sapiens
guacagacgucucaa

SEQ ID NO: 1186815 - RNA, 15 nt, Homo sapiens
guacagauacuguga

SEQ ID NO: 1186816 - RNA, 12 nt, Homo sapiens
guacagguguau

SEQ ID NO: 1186817 - RNA, 16 nt, Homo sapiens
guacaguauuucugga

SEQ ID NO: 1186818 - RNA, 12 nt, Homo sapiens
guacauaaucuu

SEQ ID NO: 1186819 - RNA, 15 nt, Homo sapiens
guacaucuguuugua

SEQ ID NO: 1186820 - RNA, 11 nt, Homo sapiens
guacaugagaa

SEQ ID NO: 1186821 - RNA, 21 nt, Homo sapiens
guacaugggacugauucuguu

SEQ ID NO: 1186822 - RNA, 18 nt, Homo sapiens
guacauuagucauucaau

SEQ ID NO: 1186823 - RNA, 20 nt, Homo sapiens
guacauuuuucaacuuugaa

SEQ ID NO: 1186824 - RNA, 14 nt, Homo sapiens
guaccaagcauuua

SEQ ID NO: 1186825 - RNA, 21 nt, Homo sapiens
gugagucugguggaggagcug

SEQ ID NO: 1186826 - RNA, 16 nt, Homo sapiens
gugagugugcugcugu

SEQ ID NO: 1186827 - RNA, 19 nt, Homo sapiens
gugauagagcuaacccuua

SEQ ID NO: 1186828 - RNA, 16 nt, Homo sapiens
gugauauucuaagacu

SEQ ID NO: 1186829 - RNA, 15 nt, Homo sapiens
gugaucaucuuugcu

SEQ ID NO: 1186830 - RNA, 16 nt, Homo sapiens
gugauccgccuaccuc

SEQ ID NO: 1186831 - RNA, 14 nt, Homo sapiens
gugaugucauuuga

SEQ ID NO: 1186832 - RNA, 20 nt, Homo sapiens
gugauuacauaaucuguaca

SEQ ID NO: 1186833 - RNA, 16 nt, Homo sapiens
gugauuacucuuugcu

SEQ ID NO: 1186834 - RNA, 14 nt, Homo sapiens
gugauuacugcaau

SEQ ID NO: 1186835 - RNA, 21 nt, Homo sapiens
gugauuacugcaaucacugug

SEQ ID NO: 1186836 - RNA, 20 nt, Homo sapiens
gugauucaaacuucugugua

SEQ ID NO: 1186837 - RNA, 23 nt, Homo sapiens
gugauugacagcuuugcugcuga

SEQ ID NO: 1186838 - RNA, 22 nt, Homo sapiens
gugauugggaauaaauaugccu

SEQ ID NO: 1186839 - RNA, 13 nt, Homo sapiens
gugauuucuugcu

SEQ ID NO: 1186840 - RNA, 13 nt, Homo sapiens
gugcacaucugac

SEQ ID NO: 1186841 - RNA, 13 nt, Homo sapiens
gugcacguugcuu

SEQ ID NO: 1186842 - RNA, 20 nt, Homo sapiens
gugcagaggcagacaggugu

SEQ ID NO: 1186843 - RNA, 11 nt, Homo sapiens
gugcagaucac

SEQ ID NO: 1186844 - RNA, 14 nt, Homo sapiens
gugcagauugcagu

SEQ ID NO: 1186845 - RNA, 23 nt, Homo sapiens
gugcaguaucaugcccugugcaa

SEQ ID NO: 1186846 - RNA, 13 nt, Homo sapiens
gugcagucuuuga

SEQ ID NO: 1186847 - RNA, 19 nt, Homo sapiens
gugcaguggcgcauucuag

SEQ ID NO: 1186848 - RNA, 20 nt, Homo sapiens
gugcaguuguaggcauguag

SEQ ID NO: 1186849 - RNA, 17 nt, Homo sapiens
gugcauauagaaaacaa

SEQ ID NO: 1186850 - RNA, 20 nt, Homo sapiens
gugcaugcgccuacucgcuu

SEQ ID NO: 1186851 - RNA, 21 nt, Homo sapiens
gugccaauguuguguguugca

SEQ ID NO: 1186852 - RNA, 12 nt, Homo sapiens
gugccacuggua

SEQ ID NO: 1186853 - RNA, 15 nt, Homo sapiens
gugccagcagcccuu

SEQ ID NO: 1186854 - RNA, 16 nt, Homo sapiens
gugccaugagggcaga

SEQ ID NO: 1186855 - RNA, 18 nt, Homo sapiens
gugccauuguacuccagc

SEQ ID NO: 1186856 - RNA, 15 nt, Homo sapiens
gugcccaccaacauc

SEQ ID NO: 1186857 - RNA, 21 nt, Homo sapiens
gugcccagggcucuaaugugu

SEQ ID NO: 1186858 - RNA, 22 nt, Homo sapiens
gugccgaggacaugcaugacac

SEQ ID NO: 1186859 - RNA, 22 nt, Homo sapiens
gugccugaucugcacauuucau

SEQ ID NO: 1186860 - RNA, 23 nt, Homo sapiens
gugccuucuaaauggcaugacau

SEQ ID NO: 1186861 - RNA, 20 nt, Homo sapiens
gugcgugcgcaucuugccuc

SEQ ID NO: 1186862 - RNA, 21 nt, Homo sapiens
gugcuaaagccaaccagccuu

SEQ ID NO: 1186863 - RNA, 16 nt, Homo sapiens
gugcucaggacucaga

SEQ ID NO: 1186864 - RNA, 13 nt, Homo sapiens
gugcuccaucucc

SEQ ID NO: 1186865 - RNA, 20 nt, Homo sapiens
gugcuccuccuuggugccug

SEQ ID NO: 1186866 - RNA, 18 nt, Homo sapiens
gugcucugucuacuugcu

SEQ ID NO: 1186867 - RNA, 20 nt, Homo sapiens
gugcugauguagugaccaag

SEQ ID NO: 1186868 - RNA, 19 nt, Homo sapiens
gugcugggauuacagggau

SEQ ID NO: 1186869 - RNA, 19 nt, Homo sapiens
gugcugggugggcaucuca

SEQ ID NO: 1186870 - RNA, 19 nt, Homo sapiens
gugcuguagauucacauac

SEQ ID NO: 1186871 - RNA, 21 nt, Homo sapiens
gugcuuuaaccucacauaccc

SEQ ID NO: 1186872 - RNA, 21 nt, Homo sapiens
gugcuuuccguggcacugcau

SEQ ID NO: 1186873 - RNA, 22 nt, Homo sapiens
gugcuuucuuuagaaacacaag

SEQ ID NO: 1186874 - RNA, 18 nt, Homo sapiens
guggaaaaaacauuuuaa

SEQ ID NO: 1186875 - RNA, 13 nt, Homo sapiens
guggaaaagccaa

SEQ ID NO: 1186876 - RNA, 17 nt, Homo sapiens
guggaaaguggugcaug

SEQ ID NO: 1186877 - RNA, 17 nt, Homo sapiens
guggaacaaccugcugg

SEQ ID NO: 1186878 - RNA, 15 nt, Homo sapiens
guggaacaagcacag

SEQ ID NO: 1186879 - RNA, 20 nt, Homo sapiens
guggaacagcccaugcugag

SEQ ID NO: 1186880 - RNA, 18 nt, Homo sapiens
guggaccgcccuuuuccc

SEQ ID NO: 1186881 - RNA, 20 nt, Homo sapiens
guggacguggguugcacugg

SEQ ID NO: 1186882 - RNA, 19 nt, Homo sapiens
guggacugcagucggcaug

SEQ ID NO: 1186883 - RNA, 12 nt, Homo sapiens
guggagaacucc

SEQ ID NO: 1186884 - RNA, 14 nt, Homo sapiens
guggagacuggcag

SEQ ID NO: 1186885 - RNA, 13 nt, Homo sapiens
guggagagaccag

SEQ ID NO: 1186886 - RNA, 16 nt, Homo sapiens
guggagccaaagccga

SEQ ID NO: 1186887 - RNA, 13 nt, Homo sapiens
guggagguugcua

SEQ ID NO: 1186888 - RNA, 23 nt, Homo sapiens
guggagucugauuaaggauuuau

SEQ ID NO: 1186889 - RNA, 19 nt, Homo sapiens
guggagugcaguggugcga

SEQ ID NO: 1186890 - RNA, 16 nt, Homo sapiens
guggcacacaccagua

SEQ ID NO: 1186891 - RNA, 13 nt, Homo sapiens
guggcauccagag

SEQ ID NO: 1186892 - RNA, 20 nt, Homo sapiens
guggcauguggguugugaua

SEQ ID NO: 1186893 - RNA, 19 nt, Homo sapiens
guggccaaggagcugcuau

SEQ ID NO: 1186894 - RNA, 14 nt, Homo sapiens
guggccacuaagca

SEQ ID NO: 1186895 - RNA, 19 nt, Homo sapiens
guggccaugguccccaaga

SEQ ID NO: 1186896 - RNA, 22 nt, Homo sapiens
guggccuccuugcuuguuacau

SEQ ID NO: 1186897 - RNA, 22 nt, Homo sapiens
guggcgagaaauaaaguuugcu

SEQ ID NO: 1186898 - RNA, 16 nt, Homo sapiens
guggcggcagggccag

SEQ ID NO: 1186899 - RNA, 17 nt, Homo sapiens
guggcggcagggccagg

SEQ ID NO: 1186900 - RNA, 22 nt, Homo sapiens
guggcucacaccuguaauccca

SEQ ID NO: 1186901 - RNA, 20 nt, Homo sapiens
guggcucuggguaccugcaa

SEQ ID NO: 1186902 - RNA, 16 nt, Homo sapiens
guggcuuagcugccau

SEQ ID NO: 1186903 - RNA, 14 nt, Homo sapiens
gugggaacggcuga

SEQ ID NO: 1186904 - RNA, 21 nt, Homo sapiens
gugggaauaaaauuucuacua

SEQ ID NO: 1186905 - RNA, 13 nt, Homo sapiens
gugggaccccagg

SEQ ID NO: 1186906 - RNA, 19 nt, Homo sapiens
gugggacccccguggggca

SEQ ID NO: 1186907 - RNA, 17 nt, Homo sapiens
gugggagcaccugccag

SEQ ID NO: 1186908 - RNA, 15 nt, Homo sapiens
gugggagguugugca

SEQ ID NO: 1186909 - RNA, 18 nt, Homo sapiens
gugggcggaucacuugag

SEQ ID NO: 1186910 - RNA, 20 nt, Homo sapiens
guggguguucauaacugcua

SEQ ID NO: 1186911 - RNA, 17 nt, Homo sapiens
guggguucaauuugcca

SEQ ID NO: 1186912 - RNA, 13 nt, Homo sapiens
gugguauucuguc

SEQ ID NO: 1186913 - RNA, 18 nt, Homo sapiens
gugguccaauggguguga

SEQ ID NO: 1186914 - RNA, 14 nt, Homo sapiens
gugguucauuccac

SEQ ID NO: 1186915 - RNA, 14 nt, Homo sapiens
gugguuuuuugcca

SEQ ID NO: 1186916 - RNA, 17 nt, Homo sapiens
guguaaauucagucuuu

SEQ ID NO: 1186917 - RNA, 16 nt, Homo sapiens
guguacacgugacaga

SEQ ID NO: 1186918 - RNA, 17 nt, Homo sapiens
guguacacgugacagag

SEQ ID NO: 1186919 - RNA, 14 nt, Homo sapiens
guguacauucuucc

SEQ ID NO: 1186920 - RNA, 23 nt, Homo sapiens
guguaccucaguucccucuugcu

SEQ ID NO: 1186921 - RNA, 22 nt, Homo sapiens
guguauggguuaaaucaaagau

SEQ ID NO: 1186922 - RNA, 19 nt, Homo sapiens
guguauuaaaccuuuccau

SEQ ID NO: 1186923 - RNA, 16 nt, Homo sapiens
guguauucauucucau

SEQ ID NO: 1186924 - RNA, 22 nt, Homo sapiens
guguauuuucgauauuucagga

SEQ ID NO: 1186925 - RNA, 13 nt, Homo sapiens
gugucaucaggag

SEQ ID NO: 1186926 - RNA, 17 nt, Homo sapiens
gugucauuaaccaucuu

SEQ ID NO: 1186927 - RNA, 18 nt, Homo sapiens
guguccccgaugcugacc

SEQ ID NO: 1186928 - RNA, 21 nt, Homo sapiens
guguccccgaugcugaccuca

SEQ ID NO: 1186929 - RNA, 20 nt, Homo sapiens
guguccccugaccuguccag

SEQ ID NO: 1186930 - RNA, 23 nt, Homo sapiens
gugucuccuuaugguacacucca

SEQ ID NO: 1186931 - RNA, 11 nt, Homo sapiens
gugucugcaac

SEQ ID NO: 1186932 - RNA, 20 nt, Homo sapiens
gugucuguacacguguccug

SEQ ID NO: 1186933 - RNA, 14 nt, Homo sapiens
gugugaaaauucag

SEQ ID NO: 1186934 - RNA, 18 nt, Homo sapiens
gugugaagcuuugcacac

SEQ ID NO: 1186935 - RNA, 16 nt, Homo sapiens
gugugccacucagaga

SEQ ID NO: 1186936 - RNA, 19 nt, Homo sapiens
gugugccugucuguuacac

SEQ ID NO: 1186937 - RNA, 22 nt, Homo sapiens
guguggaccaaggagcuuccau

SEQ ID NO: 1186938 - RNA, 20 nt, Homo sapiens
guguggccacuucuguccau

SEQ ID NO: 1186939 - RNA, 14 nt, Homo sapiens
gugugguggugcac

SEQ ID NO: 1186940 - RNA, 21 nt, Homo sapiens
gugugguucauccaucaucug

SEQ ID NO: 1186941 - RNA, 13 nt, Homo sapiens
guguguacaacac

SEQ ID NO: 1186942 - RNA, 21 nt, Homo sapiens
gugugucaggcccucugccug

SEQ ID NO: 1186943 - RNA, 17 nt, Homo sapiens
guguuaauuuaugcacu

SEQ ID NO: 1186944 - RNA, 19 nt, Homo sapiens
guguuacccacugccaugc

SEQ ID NO: 1186945 - RNA, 16 nt, Homo sapiens
guguuagcuuguauau

SEQ ID NO: 1186946 - RNA, 18 nt, Homo sapiens
guguucaaacacaaccua

SEQ ID NO: 1186947 - RNA, 22 nt, Homo sapiens
guguucaccaucccaaagccaa

SEQ ID NO: 1186948 - RNA, 15 nt, Homo sapiens
guguucauacauuug

SEQ ID NO: 1186949 - RNA, 13 nt, Homo sapiens
guguucccugggg

SEQ ID NO: 1186950 - RNA, 24 nt, Homo sapiens
gguagaggugugugccuagugaug

SEQ ID NO: 1186951 - RNA, 11 nt, Homo sapiens
gguagccagca

SEQ ID NO: 1186952 - RNA, 19 nt, Homo sapiens
gguagccaucaagcacuuc

SEQ ID NO: 1186953 - RNA, 13 nt, Homo sapiens
gguagcugagggg

SEQ ID NO: 1186954 - RNA, 23 nt, Homo sapiens
gguaggcucacuucucuuucccu

SEQ ID NO: 1186955 - RNA, 15 nt, Homo sapiens
gguagguagugauua

SEQ ID NO: 1186956 - RNA, 16 nt, Homo sapiens
gguaguuuaaguuucc

SEQ ID NO: 1186957 - RNA, 17 nt, Homo sapiens
gguauccugggggaccc

SEQ ID NO: 1186958 - RNA, 22 nt, Homo sapiens
gguauugugugagugcaugugu

SEQ ID NO: 1186959 - RNA, 18 nt, Homo sapiens
gguauuuuaagugauguc

SEQ ID NO: 1186960 - RNA, 17 nt, Homo sapiens
ggucaauggugcaaagg

SEQ ID NO: 1186961 - RNA, 13 nt, Homo sapiens
ggucaccaaacag

SEQ ID NO: 1186962 - RNA, 19 nt, Homo sapiens
ggucaccgcggacgugcug

SEQ ID NO: 1186963 - RNA, 12 nt, Homo sapiens
ggucacuugcaa

SEQ ID NO: 1186964 - RNA, 12 nt, Homo sapiens
ggucagcaguau

SEQ ID NO: 1186965 - RNA, 18 nt, Homo sapiens
ggucaggcagggugcagu

SEQ ID NO: 1186966 - RNA, 17 nt, Homo sapiens
ggucaggggugacacag

SEQ ID NO: 1186967 - RNA, 15 nt, Homo sapiens
ggucagugguccaca

SEQ ID NO: 1186968 - RNA, 14 nt, Homo sapiens
ggucauagcauuca

SEQ ID NO: 1186969 - RNA, 18 nt, Homo sapiens
ggucauggccacacugug

SEQ ID NO: 1186970 - RNA, 15 nt, Homo sapiens
ggucccccugcagcu

SEQ ID NO: 1186971 - RNA, 13 nt, Homo sapiens
ggucccggggcca

SEQ ID NO: 1186972 - RNA, 14 nt, Homo sapiens
ggucccugguccuu

SEQ ID NO: 1186973 - RNA, 17 nt, Homo sapiens
gguccgggucgcaggac

SEQ ID NO: 1186974 - RNA, 14 nt, Homo sapiens
gguccugcacagau

SEQ ID NO: 1186975 - RNA, 23 nt, Homo sapiens
gguccugggaggcugcagccagg

SEQ ID NO: 1186976 - RNA, 20 nt, Homo sapiens
ggucgaagcaaucagcaaac

SEQ ID NO: 1186977 - RNA, 20 nt, Homo sapiens
ggucuagaaacauuucuauu

SEQ ID NO: 1186978 - RNA, 16 nt, Homo sapiens
ggucucaaacuccuga

SEQ ID NO: 1186979 - RNA, 15 nt, Homo sapiens
ggucucccaauacag

SEQ ID NO: 1186980 - RNA, 18 nt, Homo sapiens
ggucuccgcacuuggaaa

SEQ ID NO: 1186981 - RNA, 22 nt, Homo sapiens
ggucugaaauuugugauggaau

SEQ ID NO: 1186982 - RNA, 23 nt, Homo sapiens
ggucuguuuucugugcacuguag

SEQ ID NO: 1186983 - RNA, 21 nt, Homo sapiens
ggucuugcaggcaucugucuu

SEQ ID NO: 1186984 - RNA, 15 nt, Homo sapiens
ggucuugccaugugc

SEQ ID NO: 1186985 - RNA, 15 nt, Homo sapiens
ggucuuuucuagucu

SEQ ID NO: 1186986 - RNA, 16 nt, Homo sapiens
ggugaacaagcaaacc

SEQ ID NO: 1186987 - RNA, 15 nt, Homo sapiens
ggugaauuucacaag

SEQ ID NO: 1186988 - RNA, 22 nt, Homo sapiens
ggugacagaaggaccagcccuu

SEQ ID NO: 1186989 - RNA, 19 nt, Homo sapiens
ggugagagcacccacugaa

SEQ ID NO: 1186990 - RNA, 23 nt, Homo sapiens
ggugaugaaaauguaacuugaaa

SEQ ID NO: 1186991 - RNA, 14 nt, Homo sapiens
ggugcacaccugug

SEQ ID NO: 1186992 - RNA, 10 nt, Homo sapiens
ggugcacagc

SEQ ID NO: 1186993 - RNA, 13 nt, Homo sapiens
ggugcauagcaga

SEQ ID NO: 1186994 - RNA, 11 nt, Homo sapiens
ggugcaucugc

SEQ ID NO: 1186995 - RNA, 24 nt, Homo sapiens
ggugccccuauacaaaacaccaga

SEQ ID NO: 1186996 - RNA, 14 nt, Homo sapiens
ggugcuccaucucc

SEQ ID NO: 1186997 - RNA, 15 nt, Homo sapiens
gguggagaagccauu

SEQ ID NO: 1186998 - RNA, 20 nt, Homo sapiens
gguggagugcaguggugcga

SEQ ID NO: 1186999 - RNA, 15 nt, Homo sapiens
gguggcaugcaccug

SEQ ID NO: 1187000 - RNA, 13 nt, Homo sapiens
gguggccacagcg

SEQ ID NO: 1187001 - RNA, 23 nt, Homo sapiens
gguggccuccuugcuuguuacau

SEQ ID NO: 1187002 - RNA, 18 nt, Homo sapiens
gguggcggcagggccagg

SEQ ID NO: 1187003 - RNA, 18 nt, Homo sapiens
gguggcuaagggggacca

SEQ ID NO: 1187004 - RNA, 14 nt, Homo sapiens
gguggcucaugccu

SEQ ID NO: 1187005 - RNA, 22 nt, Homo sapiens
gguggcugccucauuuagagag

SEQ ID NO: 1187006 - RNA, 19 nt, Homo sapiens
ggugggaaaaucacuugaa

SEQ ID NO: 1187007 - RNA, 13 nt, Homo sapiens
ggugggaauaaaa

SEQ ID NO: 1187008 - RNA, 14 nt, Homo sapiens
ggugggaggggcca

SEQ ID NO: 1187009 - RNA, 20 nt, Homo sapiens
ggugggcacccacccuggga

SEQ ID NO: 1187010 - RNA, 12 nt, Homo sapiens
ggugguggcaca

SEQ ID NO: 1187011 - RNA, 13 nt, Homo sapiens
ggugguggcacau

SEQ ID NO: 1187012 - RNA, 16 nt, Homo sapiens
ggugguuuuugcucuc

SEQ ID NO: 1187013 - RNA, 23 nt, Homo sapiens
gguguaccugcuggcacuaucca

SEQ ID NO: 1187014 - RNA, 16 nt, Homo sapiens
gguguucaaacacaac

SEQ ID NO: 1187015 - RNA, 14 nt, Homo sapiens
gguuaauccagcuu

SEQ ID NO: 1187016 - RNA, 13 nt, Homo sapiens
gguuaucuuguua

SEQ ID NO: 1187017 - RNA, 17 nt, Homo sapiens
gguuauuuuauauuuga

SEQ ID NO: 1187018 - RNA, 12 nt, Homo sapiens
gguucaagugac

SEQ ID NO: 1187019 - RNA, 20 nt, Homo sapiens
gguucagacaccuguucaca

SEQ ID NO: 1187020 - RNA, 14 nt, Homo sapiens
gguucagugccacg

SEQ ID NO: 1187021 - RNA, 15 nt, Homo sapiens
gguucccaucauuuc

SEQ ID NO: 1187022 - RNA, 15 nt, Homo sapiens
gguuccccaauccau

SEQ ID NO: 1187023 - RNA, 19 nt, Homo sapiens
gguuccuacgccuugucau

SEQ ID NO: 1187024 - RNA, 20 nt, Homo sapiens
gguuccuacgccuugucauu

SEQ ID NO: 1187025 - RNA, 19 nt, Homo sapiens
gguuccugagcucacugaa

SEQ ID NO: 1187026 - RNA, 16 nt, Homo sapiens
gguucuaaggggaccu

SEQ ID NO: 1187027 - RNA, 12 nt, Homo sapiens
gguucucuccac

SEQ ID NO: 1187028 - RNA, 17 nt, Homo sapiens
gguucugcuacucccca

SEQ ID NO: 1187029 - RNA, 16 nt, Homo sapiens
gguucuggaacagcuu

SEQ ID NO: 1187030 - RNA, 21 nt, Homo sapiens
gguugaacucugguggcacag

SEQ ID NO: 1187031 - RNA, 17 nt, Homo sapiens
gguugagcucuucuuaa

SEQ ID NO: 1187032 - RNA, 20 nt, Homo sapiens
gguugauuaaggcaguacaa

SEQ ID NO: 1187033 - RNA, 19 nt, Homo sapiens
gguugcacuggccacccaa

SEQ ID NO: 1187034 - RNA, 13 nt, Homo sapiens
gguugcagugagc

SEQ ID NO: 1187035 - RNA, 14 nt, Homo sapiens
gguugccacccaag

SEQ ID NO: 1187036 - RNA, 14 nt, Homo sapiens
gguuggcagcauuc

SEQ ID NO: 1187037 - RNA, 15 nt, Homo sapiens
gguuggccugaguua

SEQ ID NO: 1187038 - RNA, 16 nt, Homo sapiens
gguugguagcagggag

SEQ ID NO: 1187039 - RNA, 17 nt, Homo sapiens
gguugguuuaaugcaau

SEQ ID NO: 1187040 - RNA, 20 nt, Homo sapiens
gguuucaucauguugaccag

SEQ ID NO: 1187041 - RNA, 13 nt, Homo sapiens
gguuucuugcaag

SEQ ID NO: 1187042 - RNA, 23 nt, Homo sapiens
gguuuguguugagcguuugcacg

SEQ ID NO: 1187043 - RNA, 19 nt, Homo sapiens
gguuuucgucaucuucccu

SEQ ID NO: 1187044 - RNA, 20 nt, Homo sapiens
gguuuugcuuuagagugcaa

SEQ ID NO: 1187045 - RNA, 20 nt, Homo sapiens
gguuuuuaugauagugcaag

SEQ ID NO: 1187046 - RNA, 18 nt, Homo sapiens
guaaaaaauguaugcuau

SEQ ID NO: 1187047 - RNA, 14 nt, Homo sapiens
guaaaaauccaaaa

SEQ ID NO: 1187048 - RNA, 12 nt, Homo sapiens
guaaaacuuaac

SEQ ID NO: 1187049 - RNA, 21 nt, Homo sapiens
guaaaagcaucacaugaacuu

SEQ ID NO: 1187050 - RNA, 16 nt, Homo sapiens
guaaaaggccaaaccu

SEQ ID NO: 1187051 - RNA, 14 nt, Homo sapiens
guaaaauauacuua

SEQ ID NO: 1187052 - RNA, 11 nt, Homo sapiens
guaaaauaugu

SEQ ID NO: 1187053 - RNA, 15 nt, Homo sapiens
guaaaauguucucuu

SEQ ID NO: 1187054 - RNA, 13 nt, Homo sapiens
guaaacacaggga

SEQ ID NO: 1187055 - RNA, 12 nt, Homo sapiens
guaaagccaugc

SEQ ID NO: 1187056 - RNA, 15 nt, Homo sapiens
guaaaggaaccaguc

SEQ ID NO: 1187057 - RNA, 15 nt, Homo sapiens
guaaaggccuuuaau

SEQ ID NO: 1187058 - RNA, 17 nt, Homo sapiens
guaaauauucauuugcu

SEQ ID NO: 1187059 - RNA, 22 nt, Homo sapiens
guaaaucagggugggcaauuca

SEQ ID NO: 1187060 - RNA, 15 nt, Homo sapiens
guaaauguccauuua

SEQ ID NO: 1187061 - RNA, 19 nt, Homo sapiens
guaaauuauauuugugcua

SEQ ID NO: 1187062 - RNA, 15 nt, Homo sapiens
guaaauugauucaag

SEQ ID NO: 1187063 - RNA, 16 nt, Homo sapiens
guaacaaucacuguuc

SEQ ID NO: 1187064 - RNA, 22 nt, Homo sapiens
guaacagccaccuggagaacuu

SEQ ID NO: 1187065 - RNA, 14 nt, Homo sapiens
guaacauagacaaa

SEQ ID NO: 1187066 - RNA, 18 nt, Homo sapiens
guaacauaguccagagaa

SEQ ID NO: 1187067 - RNA, 18 nt, Homo sapiens
guaacaugcaauuuugca

SEQ ID NO: 1187068 - RNA, 21 nt, Homo sapiens
guaaccaguagucaccucugg

SEQ ID NO: 1187069 - RNA, 20 nt, Homo sapiens
guaacgggucguaaugacuu

SEQ ID NO: 1187070 - RNA, 15 nt, Homo sapiens
guaacuagcugagca

SEQ ID NO: 1187071 - RNA, 14 nt, Homo sapiens
guaacuauaccucu

SEQ ID NO: 1187072 - RNA, 22 nt, Homo sapiens
guaacugugccaguucuuucca

SEQ ID NO: 1187073 - RNA, 22 nt, Homo sapiens
guaacuuuguugcauuuuggca

SEQ ID NO: 1187074 - RNA, 20 nt, Homo sapiens
guaagaaaccuacugcccag

SEQ ID NO: 1187075 - RNA, 21 nt, Homo sapiens
guaaggacggacucacuucuc

SEQ ID NO: 1187076 - RNA, 15 nt, Homo sapiens
guaaggccuuucaau

SEQ ID NO: 1187077 - RNA, 19 nt, Homo sapiens
guaaggccuuucaauauua

SEQ ID NO: 1187078 - RNA, 14 nt, Homo sapiens
guaaggcucuagau

SEQ ID NO: 1187079 - RNA, 18 nt, Homo sapiens
guaauaauggaagccaaa

SEQ ID NO: 1187080 - RNA, 16 nt, Homo sapiens
guaauacaucaaagag

SEQ ID NO: 1187081 - RNA, 13 nt, Homo sapiens
guaaucacuguug

SEQ ID NO: 1187082 - RNA, 18 nt, Homo sapiens
guaaucccagcuacucag

SEQ ID NO: 1187083 - RNA, 18 nt, Homo sapiens
guaaucuguguacaaaga

SEQ ID NO: 1187084 - RNA, 15 nt, Homo sapiens
guaaugaaacuugga

SEQ ID NO: 1187085 - RNA, 22 nt, Homo sapiens
guaaugauguaggggccaagca

SEQ ID NO: 1187086 - RNA, 22 nt, Homo sapiens
aauuauuuuuggggaucauagc

SEQ ID NO: 1187087 - RNA, 12 nt, Homo sapiens
aauucaaaaaca

SEQ ID NO: 1187088 - RNA, 14 nt, Homo sapiens
aauucaaacugggg

SEQ ID NO: 1187089 - RNA, 16 nt, Homo sapiens
aauucaccuucacuua

SEQ ID NO: 1187090 - RNA, 20 nt, Homo sapiens
aauucacuuuauuguagaaa

SEQ ID NO: 1187091 - RNA, 22 nt, Homo sapiens
aauucagaagaccccugacuca

SEQ ID NO: 1187092 - RNA, 22 nt, Homo sapiens
aauucagacaagcugcauuuca

SEQ ID NO: 1187093 - RNA, 22 nt, Homo sapiens
aauucagucuuuucucugaaaa

SEQ ID NO: 1187094 - RNA, 18 nt, Homo sapiens
aauucaucuuugugccaa

SEQ ID NO: 1187095 - RNA, 14 nt, Homo sapiens
aauuccauagugga

SEQ ID NO: 1187096 - RNA, 17 nt, Homo sapiens
aauucccuuuuaaucaa

SEQ ID NO: 1187097 - RNA, 21 nt, Homo sapiens
aauuccuacaacuuaauggaa

SEQ ID NO: 1187098 - RNA, 16 nt, Homo sapiens
aauuccucauccucag

SEQ ID NO: 1187099 - RNA, 15 nt, Homo sapiens
aauucgcugcaaccu

SEQ ID NO: 1187100 - RNA, 17 nt, Homo sapiens
aauucuauacuguugau

SEQ ID NO: 1187101 - RNA, 19 nt, Homo sapiens
aauucuccugccucagccu

SEQ ID NO: 1187102 - RNA, 13 nt, Homo sapiens
aauucucuugcug

SEQ ID NO: 1187103 - RNA, 15 nt, Homo sapiens
aauucucuuugguca

SEQ ID NO: 1187104 - RNA, 19 nt, Homo sapiens
aauucucuuuggucauuga

SEQ ID NO: 1187105 - RNA, 13 nt, Homo sapiens
aauucugaugcua

SEQ ID NO: 1187106 - RNA, 15 nt, Homo sapiens
aauucugguccuguu

SEQ ID NO: 1187107 - RNA, 17 nt, Homo sapiens
aauucuuaagaugugua

SEQ ID NO: 1187108 - RNA, 17 nt, Homo sapiens
aauucuuacauguuuuc

SEQ ID NO: 1187109 - RNA, 18 nt, Homo sapiens
aauucuuauggcugcuga

SEQ ID NO: 1187110 - RNA, 19 nt, Homo sapiens
aauucuuauggcugcugaa

SEQ ID NO: 1187111 - RNA, 18 nt, Homo sapiens
aauucuuuuccugaagaa

SEQ ID NO: 1187112 - RNA, 16 nt, Homo sapiens
aauucuuuugccaagg

SEQ ID NO: 1187113 - RNA, 18 nt, Homo sapiens
aauugaauuuacauauag

SEQ ID NO: 1187114 - RNA, 23 nt, Homo sapiens
aauugacagaucaagcugugaga

SEQ ID NO: 1187115 - RNA, 13 nt, Homo sapiens
aauugacaugugc

SEQ ID NO: 1187116 - RNA, 15 nt, Homo sapiens
aauugagaaagcuua

SEQ ID NO: 1187117 - RNA, 16 nt, Homo sapiens
aauugagaaagcuuaa

SEQ ID NO: 1187118 - RNA, 21 nt, Homo sapiens
aauugagacagugcacaugaa

SEQ ID NO: 1187119 - RNA, 15 nt, Homo sapiens
aauugaucauucaua

SEQ ID NO: 1187120 - RNA, 20 nt, Homo sapiens
aauugcugcaccaaugcacu

SEQ ID NO: 1187121 - RNA, 19 nt, Homo sapiens
aauugcuuauaacaagcau

SEQ ID NO: 1187122 - RNA, 13 nt, Homo sapiens
aauuggucauucc

SEQ ID NO: 1187123 - RNA, 17 nt, Homo sapiens
aauugguguauaucaug

SEQ ID NO: 1187124 - RNA, 17 nt, Homo sapiens
aauuguacuaaagccaa

SEQ ID NO: 1187125 - RNA, 16 nt, Homo sapiens
aauugucacaucaagc

SEQ ID NO: 1187126 - RNA, 17 nt, Homo sapiens
aauugucacaucaagca

SEQ ID NO: 1187127 - RNA, 20 nt, Homo sapiens
aauugucacaucaagcauca

SEQ ID NO: 1187128 - RNA, 13 nt, Homo sapiens
aauuguccguguu

SEQ ID NO: 1187129 - RNA, 17 nt, Homo sapiens
aauuguuagauggcaau

SEQ ID NO: 1187130 - RNA, 21 nt, Homo sapiens
aauuguugacaguucugaaga

SEQ ID NO: 1187131 - RNA, 21 nt, Homo sapiens
aauuuaaaaaagcaaauggaa

SEQ ID NO: 1187132 - RNA, 14 nt, Homo sapiens
aauuuaaaaauccu

SEQ ID NO: 1187133 - RNA, 17 nt, Homo sapiens
aauuuaaaauaugcucu

SEQ ID NO: 1187134 - RNA, 19 nt, Homo sapiens
aauuuaaacuuguuuacaa

SEQ ID NO: 1187135 - RNA, 14 nt, Homo sapiens
aauuuaauuccucu

SEQ ID NO: 1187136 - RNA, 18 nt, Homo sapiens
aauuuacagucaaucuau

SEQ ID NO: 1187137 - RNA, 15 nt, Homo sapiens
aauuuagucccuuaa

SEQ ID NO: 1187138 - RNA, 22 nt, Homo sapiens
aauuuaguuucccuuagacuuu

SEQ ID NO: 1187139 - RNA, 13 nt, Homo sapiens
acaguuguuuucc

SEQ ID NO: 1187140 - RNA, 21 nt, Homo sapiens
acaguuuaacagaguuuucug

SEQ ID NO: 1187141 - RNA, 14 nt, Homo sapiens
acaguuucuuccau

SEQ ID NO: 1187142 - RNA, 22 nt, Homo sapiens
acaguuuugaccuaacauaccg

SEQ ID NO: 1187143 - RNA, 18 nt, Homo sapiens
acauaaaaaagaagcacu

SEQ ID NO: 1187144 - RNA, 21 nt, Homo sapiens
acauaaaauaagagauccuuu

SEQ ID NO: 1187145 - RNA, 13 nt, Homo sapiens
acauaaacccagu

SEQ ID NO: 1187146 - RNA, 15 nt, Homo sapiens
acauaaauuaugaga

SEQ ID NO: 1187147 - RNA, 15 nt, Homo sapiens
acauaaguucauuca

SEQ ID NO: 1187148 - RNA, 21 nt, Homo sapiens
acauaaucuguacaaugaacc

SEQ ID NO: 1187149 - RNA, 14 nt, Homo sapiens
acauaauucacucu

SEQ ID NO: 1187150 - RNA, 19 nt, Homo sapiens
acauaauugugaccaauac

SEQ ID NO: 1187151 - RNA, 21 nt, Homo sapiens
acauaauuuaauuccuucuac

SEQ ID NO: 1187152 - RNA, 19 nt, Homo sapiens
acauacaagagacauauaa

SEQ ID NO: 1187153 - RNA, 17 nt, Homo sapiens
acauacccucacuuaaa

SEQ ID NO: 1187154 - RNA, 17 nt, Homo sapiens
acauaccuggcccaacc

SEQ ID NO: 1187155 - RNA, 14 nt, Homo sapiens
acauacuccaacug

SEQ ID NO: 1187156 - RNA, 19 nt, Homo sapiens
acauacuccuuccaucaaa

SEQ ID NO: 1187157 - RNA, 20 nt, Homo sapiens
acauagaaaguucauggaac

SEQ ID NO: 1187158 - RNA, 21 nt, Homo sapiens
acauagaggccuucccaucca

SEQ ID NO: 1187159 - RNA, 13 nt, Homo sapiens
acauagcauccaa

SEQ ID NO: 1187160 - RNA, 14 nt, Homo sapiens
acauagcaugacau

SEQ ID NO: 1187161 - RNA, 13 nt, Homo sapiens
acauagccaacuc

SEQ ID NO: 1187162 - RNA, 22 nt, Homo sapiens
acauagggacauaaguucauuc

SEQ ID NO: 1187163 - RNA, 22 nt, Homo sapiens
acauaguccagagaacugacau

SEQ ID NO: 1187164 - RNA, 13 nt, Homo sapiens
acauauacacaca

SEQ ID NO: 1187165 - RNA, 16 nt, Homo sapiens
acauauauaacaccuu

SEQ ID NO: 1187166 - RNA, 18 nt, Homo sapiens
acauauauauacuauuaa

SEQ ID NO: 1187167 - RNA, 12 nt, Homo sapiens
acauaucaugug

SEQ ID NO: 1187168 - RNA, 16 nt, Homo sapiens
acauauggacucugca

SEQ ID NO: 1187169 - RNA, 23 nt, Homo sapiens
acauauucuuuaaauuucaucuc

SEQ ID NO: 1187170 - RNA, 15 nt, Homo sapiens
acaucacacaguaua

SEQ ID NO: 1187171 - RNA, 12 nt, Homo sapiens
acaucagcacuu

SEQ ID NO: 1187172 - RNA, 16 nt, Homo sapiens
acaucaguuacucuga

SEQ ID NO: 1187173 - RNA, 15 nt, Homo sapiens
acauccauguuccga

SEQ ID NO: 1187174 - RNA, 19 nt, Homo sapiens
acaucccagacacauucac

SEQ ID NO: 1187175 - RNA, 16 nt, Homo sapiens
acaucccauugcccug

SEQ ID NO: 1187176 - RNA, 16 nt, Homo sapiens
acauccccuucugcaa

SEQ ID NO: 1187177 - RNA, 17 nt, Homo sapiens
acauccccuucugcaau

SEQ ID NO: 1187178 - RNA, 21 nt, Homo sapiens
acaucccgggacgcagcagga

SEQ ID NO: 1187179 - RNA, 22 nt, Homo sapiens
acaucuauuuuggauuguauau

SEQ ID NO: 1187180 - RNA, 18 nt, Homo sapiens
acaucucccuuccaccuc

SEQ ID NO: 1187181 - RNA, 17 nt, Homo sapiens
acaucucuuugauguca

SEQ ID NO: 1187182 - RNA, 13 nt, Homo sapiens
acaucugcaauau

SEQ ID NO: 1187183 - RNA, 22 nt, Homo sapiens
acaucuuccgagaaacaggcga

SEQ ID NO: 1187184 - RNA, 11 nt, Homo sapiens
acaucuuucac

SEQ ID NO: 1187185 - RNA, 14 nt, Homo sapiens
acaucuuucacauu

SEQ ID NO: 1187186 - RNA, 18 nt, Homo sapiens
acaugaaucccacccaca

SEQ ID NO: 1187187 - RNA, 16 nt, Homo sapiens
acaugaccacauagca

SEQ ID NO: 1187188 - RNA, 11 nt, Homo sapiens
acaugacuguu

SEQ ID NO: 1187189 - RNA, 19 nt, Homo sapiens
acaugagaacaaacagauc

SEQ ID NO: 1187190 - RNA, 23 nt, Homo sapiens
acaugagggcugguguucauuaa

SEQ ID NO: 1187191 - RNA, 20 nt, Homo sapiens
acaugauguuuuaagcugcu

SEQ ID NO: 1187192 - RNA, 16 nt, Homo sapiens
acaugcauugagcucu

SEQ ID NO: 1187193 - RNA, 17 nt, Homo sapiens
acaugcauugagcucuc

SEQ ID NO: 1187194 - RNA, 19 nt, Homo sapiens
acaugcuucagugcugcuc

SEQ ID NO: 1187195 - RNA, 15 nt, Homo sapiens
acauggacagaauuu

SEQ ID NO: 1187196 - RNA, 14 nt, Homo sapiens
acauggccuaugca

SEQ ID NO: 1187197 - RNA, 17 nt, Homo sapiens
acauggccuaugcacau

SEQ ID NO: 1187198 - RNA, 17 nt, Homo sapiens
acauggcggggcuuucc

SEQ ID NO: 1187199 - RNA, 17 nt, Homo sapiens
acauggucuguccugac

SEQ ID NO: 1187200 - RNA, 20 nt, Homo sapiens
acauguaaaagggugaaagu

SEQ ID NO: 1187201 - RNA, 15 nt, Homo sapiens
acauguaacauuaaa

SEQ ID NO: 1187202 - RNA, 15 nt, Homo sapiens
acauguaauuugaug

SEQ ID NO: 1187203 - RNA, 23 nt, Homo sapiens
acauguauaguauacucuugccu

SEQ ID NO: 1187204 - RNA, 18 nt, Homo sapiens
acauguaugugcauuuca

SEQ ID NO: 1187205 - RNA, 19 nt, Homo sapiens
acaugucuuguacaugugu

SEQ ID NO: 1187206 - RNA, 15 nt, Homo sapiens
acaugugacacauau

SEQ ID NO: 1187207 - RNA, 18 nt, Homo sapiens
acaugugacacauaugca

SEQ ID NO: 1187208 - RNA, 23 nt, Homo sapiens
acauguuaagagaaugcuuugaa

SEQ ID NO: 1187209 - RNA, 23 nt, Homo sapiens
acauguuaggaagguacugucau

SEQ ID NO: 1187210 - RNA, 20 nt, Homo sapiens
acauuacuguauauacuuug

SEQ ID NO: 1187211 - RNA, 21 nt, Homo sapiens
acauuacuucaaacugagauc

SEQ ID NO: 1187212 - RNA, 14 nt, Homo sapiens
acauuaguauacgu

SEQ ID NO: 1187213 - RNA, 15 nt, Homo sapiens
acauuagucauucaa

SEQ ID NO: 1187214 - RNA, 15 nt, Homo sapiens
acauucacacagaga

SEQ ID NO: 1187215 - RNA, 19 nt, Homo sapiens
acauucagauuuaccauaa

SEQ ID NO: 1187216 - RNA, 14 nt, Homo sapiens
acauucagcacacu

SEQ ID NO: 1187217 - RNA, 19 nt, Homo sapiens
acauucagcacacugugaa

SEQ ID NO: 1187218 - RNA, 13 nt, Homo sapiens
acauucagugaaa

SEQ ID NO: 1187219 - RNA, 15 nt, Homo sapiens
acauucaugcucagu

SEQ ID NO: 1187220 - RNA, 14 nt, Homo sapiens
cacugcauaccaac

SEQ ID NO: 1187221 - RNA, 21 nt, Homo sapiens
cacugcccauggcaugucuuu

SEQ ID NO: 1187222 - RNA, 22 nt, Homo sapiens
cacugcccauggcaugucuuug

SEQ ID NO: 1187223 - RNA, 22 nt, Homo sapiens
cacugccccaggacugucauuu

SEQ ID NO: 1187224 - RNA, 18 nt, Homo sapiens
cacugcccccuccacugg

SEQ ID NO: 1187225 - RNA, 19 nt, Homo sapiens
cacugccgucccaaauaca

SEQ ID NO: 1187226 - RNA, 23 nt, Homo sapiens
cacugcgcccagcuauacuguau

SEQ ID NO: 1187227 - RNA, 18 nt, Homo sapiens
cacugcugauuauucacu

SEQ ID NO: 1187228 - RNA, 15 nt, Homo sapiens
cacugcuugaggaaa

SEQ ID NO: 1187229 - RNA, 12 nt, Homo sapiens
cacugcuuuaaa

SEQ ID NO: 1187230 - RNA, 19 nt, Homo sapiens
cacuggaaggagcacauac

SEQ ID NO: 1187231 - RNA, 19 nt, Homo sapiens
cacuggaucccaucaaaga

SEQ ID NO: 1187232 - RNA, 23 nt, Homo sapiens
cacuggccaagaaaauugccuuu

SEQ ID NO: 1187233 - RNA, 17 nt, Homo sapiens
cacuggccccugagauc

SEQ ID NO: 1187234 - RNA, 17 nt, Homo sapiens
cacuggcguuacugcuu

SEQ ID NO: 1187235 - RNA, 17 nt, Homo sapiens
cacugggaagcuggagu

SEQ ID NO: 1187236 - RNA, 14 nt, Homo sapiens
cacugggaucacag

SEQ ID NO: 1187237 - RNA, 16 nt, Homo sapiens
cacuggguucugcuac

SEQ ID NO: 1187238 - RNA, 23 nt, Homo sapiens
cacuguaaauaugaaucugcuca

SEQ ID NO: 1187239 - RNA, 11 nt, Homo sapiens
cacuguacaag

SEQ ID NO: 1187240 - RNA, 23 nt, Homo sapiens
cacugugacacacuacaccacac

SEQ ID NO: 1187241 - RNA, 13 nt, Homo sapiens
cacugugagcucc

SEQ ID NO: 1187242 - RNA, 23 nt, Homo sapiens
cacugugggaaggccagcugccc

SEQ ID NO: 1187243 - RNA, 18 nt, Homo sapiens
cacuguucuuguauugua

SEQ ID NO: 1187244 - RNA, 18 nt, Homo sapiens
cacuguuugccauucucu

SEQ ID NO: 1187245 - RNA, 15 nt, Homo sapiens
cacuguuugucucac

SEQ ID NO: 1187246 - RNA, 13 nt, Homo sapiens
cacuuaaaagcug

SEQ ID NO: 1187247 - RNA, 17 nt, Homo sapiens
cacuuaagacuguguau

SEQ ID NO: 1187248 - RNA, 22 nt, Homo sapiens
cacuuauaagaaagaucaaaga

SEQ ID NO: 1187249 - RNA, 23 nt, Homo sapiens
cacuuauaagaaagaucaaagac

SEQ ID NO: 1187250 - RNA, 22 nt, Homo sapiens
cacuuaucaguguauugauguu

SEQ ID NO: 1187251 - RNA, 23 nt, Homo sapiens
cacuuaugagaugccugaagcca

SEQ ID NO: 1187252 - RNA, 17 nt, Homo sapiens
cacuucaaggugacaga

SEQ ID NO: 1187253 - RNA, 22 nt, Homo sapiens
cacuucaccaaggaagucucag

SEQ ID NO: 1187254 - RNA, 12 nt, Homo sapiens
aaagcagccacg

SEQ ID NO: 1187255 - RNA, 18 nt, Homo sapiens
aaagcagggacugugaac

SEQ ID NO: 1187256 - RNA, 17 nt, Homo sapiens
aaagcagucuguucuga

SEQ ID NO: 1187257 - RNA, 16 nt, Homo sapiens
aaagcaugugucaugc

SEQ ID NO: 1187258 - RNA, 21 nt, Homo sapiens
aaagcaugugucaugcaugaa

SEQ ID NO: 1187259 - RNA, 12 nt, Homo sapiens
aaagcauuugau

SEQ ID NO: 1187260 - RNA, 12 nt, Homo sapiens
aaagccaaaaac

SEQ ID NO: 1187261 - RNA, 21 nt, Homo sapiens
aaagccauauggacacuguga

SEQ ID NO: 1187262 - RNA, 14 nt, Homo sapiens
aaagcccaugcccu

SEQ ID NO: 1187263 - RNA, 15 nt, Homo sapiens
aaagccucagugaaa

SEQ ID NO: 1187264 - RNA, 13 nt, Homo sapiens
aaagccuguccca

SEQ ID NO: 1187265 - RNA, 17 nt, Homo sapiens
aaagcuaguguaccucc

SEQ ID NO: 1187266 - RNA, 22 nt, Homo sapiens
aaagcuaguguaccuccucuca

SEQ ID NO: 1187267 - RNA, 12 nt, Homo sapiens
aaagcucugugg

SEQ ID NO: 1187268 - RNA, 18 nt, Homo sapiens
aaagcugacaucuguaaa

SEQ ID NO: 1187269 - RNA, 14 nt, Homo sapiens
aaagcugcucaggg

SEQ ID NO: 1187270 - RNA, 13 nt, Homo sapiens
aaagcuguucuca

SEQ ID NO: 1187271 - RNA, 14 nt, Homo sapiens
aaagcuucaaaaac

SEQ ID NO: 1187272 - RNA, 21 nt, Homo sapiens
aaagcuucucagccuuccuag

SEQ ID NO: 1187273 - RNA, 15 nt, Homo sapiens
aaagcuugaggccau

SEQ ID NO: 1187274 - RNA, 14 nt, Homo sapiens
aaaggaaaugauug

SEQ ID NO: 1187275 - RNA, 18 nt, Homo sapiens
aaaggaagacuggagaaa

SEQ ID NO: 1187276 - RNA, 17 nt, Homo sapiens
aaaggacaaacagugaa

SEQ ID NO: 1187277 - RNA, 21 nt, Homo sapiens
aaaggauaaugaauacuuuau

SEQ ID NO: 1187278 - RNA, 15 nt, Homo sapiens
aaagggcacauuucu

SEQ ID NO: 1187279 - RNA, 19 nt, Homo sapiens
aaaggucaagaacacagug

SEQ ID NO: 1187280 - RNA, 22 nt, Homo sapiens
aaaggucaagaacacagugauu

SEQ ID NO: 1187281 - RNA, 18 nt, Homo sapiens
aaaggugguguuucugua

SEQ ID NO: 1187282 - RNA, 14 nt, Homo sapiens
aaagguugacucaa

SEQ ID NO: 1187283 - RNA, 14 nt, Homo sapiens
aaagguugccugaa

SEQ ID NO: 1187284 - RNA, 19 nt, Homo sapiens
aaagguuggccuuacuguu

SEQ ID NO: 1187285 - RNA, 17 nt, Homo sapiens
aaagguuucaagacuug

SEQ ID NO: 1187286 - RNA, 22 nt, Homo sapiens
aaagguuugagauuccuguaaa

SEQ ID NO: 1187287 - RNA, 17 nt, Homo sapiens
aaaguaagcauuuccag

SEQ ID NO: 1187288 - RNA, 13 nt, Homo sapiens
aaaguaaugccac

SEQ ID NO: 1187289 - RNA, 12 nt, Homo sapiens
aaaguauuguaa

SEQ ID NO: 1187290 - RNA, 23 nt, Homo sapiens
aaagucagugcccaacuguuaua

SEQ ID NO: 1187291 - RNA, 13 nt, Homo sapiens
aaagucauguauu

SEQ ID NO: 1187292 - RNA, 12 nt, Homo sapiens
aaagucuugccu

SEQ ID NO: 1187293 - RNA, 15 nt, Homo sapiens
aaagucuugccuugc

SEQ ID NO: 1187294 - RNA, 18 nt, Homo sapiens
aaagugcauauuuaucca

SEQ ID NO: 1187295 - RNA, 13 nt, Homo sapiens
aaagugccaaaga

SEQ ID NO: 1187296 - RNA, 18 nt, Homo sapiens
aaagugcuaagguucuaa

SEQ ID NO: 1187297 - RNA, 16 nt, Homo sapiens
aaaguggacaaggagu

SEQ ID NO: 1187298 - RNA, 14 nt, Homo sapiens
aaagugggcuugau

SEQ ID NO: 1187299 - RNA, 21 nt, Homo sapiens
aaagugguucucaugaugcuu

SEQ ID NO: 1187300 - RNA, 20 nt, Homo sapiens
aaaguguuugaaagcuuuau

SEQ ID NO: 1187301 - RNA, 17 nt, Homo sapiens
aaaguuauuuaugcuau

SEQ ID NO: 1187302 - RNA, 14 nt, Homo sapiens
aaaguucuagugac

SEQ ID NO: 1187303 - RNA, 18 nt, Homo sapiens
aaaguucuuuuugcucua

SEQ ID NO: 1187304 - RNA, 24 nt, Homo sapiens
aaaguuugaauaccagcuuucuau

SEQ ID NO: 1187305 - RNA, 15 nt, Homo sapiens
aaauaaaaaccaaga

SEQ ID NO: 1187306 - RNA, 16 nt, Homo sapiens
aaauaaaaaucucuuu

SEQ ID NO: 1187307 - RNA, 13 nt, Homo sapiens
aaauaaaccaaau

SEQ ID NO: 1187308 - RNA, 12 nt, Homo sapiens
aaauaaacugua

SEQ ID NO: 1187309 - RNA, 15 nt, Homo sapiens
aaauaaauaacuuug

SEQ ID NO: 1187310 - RNA, 14 nt, Homo sapiens
aaauaaccacugca

SEQ ID NO: 1187311 - RNA, 20 nt, Homo sapiens
aaauaaguuacaucuacaaa

SEQ ID NO: 1187312 - RNA, 19 nt, Homo sapiens
aaauaauaaacaguggaau

SEQ ID NO: 1187313 - RNA, 19 nt, Homo sapiens
aaauaauaauauccagguc

SEQ ID NO: 1187314 - RNA, 14 nt, Homo sapiens
aaauaaucucuuag

SEQ ID NO: 1187315 - RNA, 16 nt, Homo sapiens
aaauaauuuuaucucu

SEQ ID NO: 1187316 - RNA, 20 nt, Homo sapiens
aaauacauaaaacaaaagca

SEQ ID NO: 1187317 - RNA, 12 nt, Homo sapiens
aaauacaucacu

SEQ ID NO: 1187318 - RNA, 20 nt, Homo sapiens
aaauacauccuuuuucugcu

SEQ ID NO: 1187319 - RNA, 19 nt, Homo sapiens
aaauacuguugguggucuu

SEQ ID NO: 1187320 - RNA, 19 nt, Homo sapiens
aaauacuuagacaguaugc

SEQ ID NO: 1187321 - RNA, 21 nt, Homo sapiens
aaauacuuagacaguaugcau

SEQ ID NO: 1187322 - RNA, 17 nt, Homo sapiens
aaauagaaccacuauga

SEQ ID NO: 1187323 - RNA, 23 nt, Homo sapiens
aaauagagcuuuuaaaaaugucc

SEQ ID NO: 1187324 - RNA, 21 nt, Homo sapiens
aaauagauuuccugugaguaa

SEQ ID NO: 1187325 - RNA, 15 nt, Homo sapiens
aaauaggauccugga

SEQ ID NO: 1187326 - RNA, 21 nt, Homo sapiens
aaauaguaccuucaauacuua

SEQ ID NO: 1187327 - RNA, 14 nt, Homo sapiens
aaauagucuaucaa

SEQ ID NO: 1187328 - RNA, 16 nt, Homo sapiens
aaauagucuuccacaa

SEQ ID NO: 1187329 - RNA, 17 nt, Homo sapiens
aaauagucuuccacaaa

SEQ ID NO: 1187330 - RNA, 13 nt, Homo sapiens
aaauauaaauauc

SEQ ID NO: 1187331 - RNA, 15 nt, Homo sapiens
aaauauaauaugcac

SEQ ID NO: 1187332 - RNA, 14 nt, Homo sapiens
aaauauacauucaa

SEQ ID NO: 1187333 - RNA, 14 nt, Homo sapiens
aaauauauuugaua

SEQ ID NO: 1187334 - RNA, 16 nt, Homo sapiens
aaauaucugaaaugug

SEQ ID NO: 1187335 - RNA, 14 nt, Homo sapiens
aaauaucuggucuc

SEQ ID NO: 1187336 - RNA, 16 nt, Homo sapiens
aaauaucuguuuuuaa

SEQ ID NO: 1187337 - RNA, 21 nt, Homo sapiens
aaauaugaugagauucacuua

SEQ ID NO: 1187338 - RNA, 16 nt, Homo sapiens
aaauaugcauaaucag

SEQ ID NO: 1187339 - RNA, 22 nt, Homo sapiens
aaauauuaggagacacagggaa

SEQ ID NO: 1187340 - RNA, 20 nt, Homo sapiens
aaauauuaucuuuguucucc

SEQ ID NO: 1187341 - RNA, 13 nt, Homo sapiens
aaauauuaugaga

SEQ ID NO: 1187342 - RNA, 12 nt, Homo sapiens
aaauauugucau

SEQ ID NO: 1187343 - RNA, 14 nt, Homo sapiens
aaauauuuacagua

SEQ ID NO: 1187344 - RNA, 16 nt, Homo sapiens
aaauauuuuaaaggua

SEQ ID NO: 1187345 - RNA, 16 nt, Homo sapiens
aaauauuuuucccucc

SEQ ID NO: 1187346 - RNA, 11 nt, Homo sapiens
aaaucaaagau

SEQ ID NO: 1187347 - RNA, 14 nt, Homo sapiens
aaaucaaagauuug

SEQ ID NO: 1187348 - RNA, 12 nt, Homo sapiens
aaaucaaagcag

SEQ ID NO: 1187349 - RNA, 19 nt, Homo sapiens
aaaucaaucaagacugcaa

SEQ ID NO: 1187350 - RNA, 23 nt, Homo sapiens
aaaucacacaugcuuuucuuccu

SEQ ID NO: 1187351 - RNA, 19 nt, Homo sapiens
aaaucacgaccacugauag

SEQ ID NO: 1187352 - RNA, 22 nt, Homo sapiens
aaaucagccagacaugguggca

SEQ ID NO: 1187353 - RNA, 13 nt, Homo sapiens
aaaucaucucuca

SEQ ID NO: 1187354 - RNA, 21 nt, Homo sapiens
aaauccaaaaagaaaugaugu

SEQ ID NO: 1187355 - RNA, 22 nt, Homo sapiens
aaauccaaaaagaaaugauguu

SEQ ID NO: 1187356 - RNA, 21 nt, Homo sapiens
aaaucccauggaauauuucca

SEQ ID NO: 1187357 - RNA, 15 nt, Homo sapiens
aaaucccaugugccc

SEQ ID NO: 1187358 - RNA, 21 nt, Homo sapiens
aaauccgaaccuccucuguga

SEQ ID NO: 1187359 - RNA, 13 nt, Homo sapiens
aaauccuauguga

SEQ ID NO: 1187360 - RNA, 21 nt, Homo sapiens
aaauccuuagaucuggcaugu

SEQ ID NO: 1187361 - RNA, 13 nt, Homo sapiens
aaaucguccuccc

SEQ ID NO: 1187362 - RNA, 21 nt, Homo sapiens
aaaucguccucccaggccagg

SEQ ID NO: 1187363 - RNA, 13 nt, Homo sapiens
aaaucuaccuguu

SEQ ID NO: 1187364 - RNA, 17 nt, Homo sapiens
aaaucucccaugugcau

SEQ ID NO: 1187365 - RNA, 19 nt, Homo sapiens
aaaucucccaugugcauaa

SEQ ID NO: 1187366 - RNA, 22 nt, Homo sapiens
aaaucugaagugguucagucua

SEQ ID NO: 1187367 - RNA, 20 nt, Homo sapiens
aaaucugagaaacucuacau

SEQ ID NO: 1187368 - RNA, 20 nt, Homo sapiens
aaaucugagggagcugagua

SEQ ID NO: 1187369 - RNA, 18 nt, Homo sapiens
aaaucugcagcacauuga

SEQ ID NO: 1187370 - RNA, 22 nt, Homo sapiens
aaaucugccugauaggacccau

SEQ ID NO: 1187371 - RNA, 20 nt, Homo sapiens
aaaucugucauaagcauuac

SEQ ID NO: 1187372 - RNA, 13 nt, Homo sapiens
aaaucugugccug

SEQ ID NO: 1187373 - RNA, 13 nt, Homo sapiens
aaaugaauuauua

SEQ ID NO: 1187374 - RNA, 14 nt, Homo sapiens
aaaugacauggaca

SEQ ID NO: 1187375 - RNA, 15 nt, Homo sapiens
aaaugagccaugaga

SEQ ID NO: 1187376 - RNA, 16 nt, Homo sapiens
aaaugauaaguacuac

SEQ ID NO: 1187377 - RNA, 16 nt, Homo sapiens
aaaugauagauuugac

SEQ ID NO: 1187378 - RNA, 13 nt, Homo sapiens
aaaugauccugcc

SEQ ID NO: 1187379 - RNA, 12 nt, Homo sapiens
aaaugcaaaaua

SEQ ID NO: 1187380 - RNA, 21 nt, Homo sapiens
aaaugcagcagggaugcccug

SEQ ID NO: 1187381 - RNA, 20 nt, Homo sapiens
aaaugcccaaggaugccuua

SEQ ID NO: 1187382 - RNA, 12 nt, Homo sapiens
aaaugcuacuga

SEQ ID NO: 1187383 - RNA, 13 nt, Homo sapiens
aaaugcugugcaa

SEQ ID NO: 1187384 - RNA, 13 nt, Homo sapiens
aaaugcuuacuuc

SEQ ID NO: 1187385 - RNA, 22 nt, Homo sapiens
aaauggaacuaucuccaaauuu

SEQ ID NO: 1187386 - RNA, 20 nt, Homo sapiens
aaauggauaugggcuggaua

SEQ ID NO: 1187387 - RNA, 12 nt, Homo sapiens
aaauggcacugc

SEQ ID NO: 1187388 - RNA, 17 nt, Homo sapiens
aagaguuggagugagau

SEQ ID NO: 1187389 - RNA, 17 nt, Homo sapiens
aagauacugcugaugcu

SEQ ID NO: 1187390 - RNA, 14 nt, Homo sapiens
aagauagaauucaa

SEQ ID NO: 1187391 - RNA, 20 nt, Homo sapiens
aagauaggaauucacugaua

SEQ ID NO: 1187392 - RNA, 16 nt, Homo sapiens
aagauauuuuuauuca

SEQ ID NO: 1187393 - RNA, 18 nt, Homo sapiens
aagaucauuuaauaucuu

SEQ ID NO: 1187394 - RNA, 14 nt, Homo sapiens
aagauccucucuug

SEQ ID NO: 1187395 - RNA, 22 nt, Homo sapiens
aagauccugugaggagccccau

SEQ ID NO: 1187396 - RNA, 20 nt, Homo sapiens
aagaucgccuggcucaguca

SEQ ID NO: 1187397 - RNA, 15 nt, Homo sapiens
aagaucuacaugaau

SEQ ID NO: 1187398 - RNA, 16 nt, Homo sapiens
aagaucuucuguacuu

SEQ ID NO: 1187399 - RNA, 22 nt, Homo sapiens
aagaugacucguucccauagau

SEQ ID NO: 1187400 - RNA, 21 nt, Homo sapiens
aagaugcagaguaaguauuau

SEQ ID NO: 1187401 - RNA, 23 nt, Homo sapiens
aagaugcauuuuguguacaguaa

SEQ ID NO: 1187402 - RNA, 20 nt, Homo sapiens
aagaugggagcccaguuuca

SEQ ID NO: 1187403 - RNA, 20 nt, Homo sapiens
aagauggguggaucacuuga

SEQ ID NO: 1187404 - RNA, 21 nt, Homo sapiens
aagaugguuagaaccagcaga

SEQ ID NO: 1187405 - RNA, 15 nt, Homo sapiens
aagaugguugccaag

SEQ ID NO: 1187406 - RNA, 22 nt, Homo sapiens
aagauguugauuuuuacugugu

SEQ ID NO: 1187407 - RNA, 23 nt, Homo sapiens
aagauuauuuuauuaugcggaaa

SEQ ID NO: 1187408 - RNA, 14 nt, Homo sapiens
aagauucaguuuuc

SEQ ID NO: 1187409 - RNA, 23 nt, Homo sapiens
aagauuccuaauaaucauuggau

SEQ ID NO: 1187410 - RNA, 15 nt, Homo sapiens
aagauucugucuuau

SEQ ID NO: 1187411 - RNA, 14 nt, Homo sapiens
aagauucuguguca

SEQ ID NO: 1187412 - RNA, 20 nt, Homo sapiens
aagauuguuucagacuuuug

SEQ ID NO: 1187413 - RNA, 15 nt, Homo sapiens
aagcaaaaaugcuaa

SEQ ID NO: 1187414 - RNA, 20 nt, Homo sapiens
aagcaacaucuagcaaaugu

SEQ ID NO: 1187415 - RNA, 20 nt, Homo sapiens
aagcaacccaguccccaacc

SEQ ID NO: 1187416 - RNA, 19 nt, Homo sapiens
aagcaacuuuacugagaca

SEQ ID NO: 1187417 - RNA, 22 nt, Homo sapiens
aagcaacuuuacugagacaaug

SEQ ID NO: 1187418 - RNA, 16 nt, Homo sapiens
aagcaaggugucccug

SEQ ID NO: 1187419 - RNA, 13 nt, Homo sapiens
aagcaauccuccu

SEQ ID NO: 1187420 - RNA, 22 nt, Homo sapiens
aagcaauucuaguguaaaucau

SEQ ID NO: 1187421 - RNA, 11 nt, Homo sapiens
aagcacacuca

SEQ ID NO: 1187422 - RNA, 19 nt, Homo sapiens
aagcacagauguucuucaa

SEQ ID NO: 1187423 - RNA, 15 nt, Homo sapiens
aagcacaguuugaac

SEQ ID NO: 1187424 - RNA, 17 nt, Homo sapiens
aagcaccugccgaccuc

SEQ ID NO: 1187425 - RNA, 11 nt, Homo sapiens
aagcacugccu

SEQ ID NO: 1187426 - RNA, 17 nt, Homo sapiens
aagcacuuccagaacuu

SEQ ID NO: 1187427 - RNA, 13 nt, Homo sapiens
aagcacuuuguua

SEQ ID NO: 1187428 - RNA, 21 nt, Homo sapiens
aagcagaauuuaaguugguaa

SEQ ID NO: 1187429 - RNA, 23 nt, Homo sapiens
aagcagaggcuaauucaguguca

SEQ ID NO: 1187430 - RNA, 21 nt, Homo sapiens
aagcagaugcaaagaggcaag

SEQ ID NO: 1187431 - RNA, 16 nt, Homo sapiens
aagcagccaagcuccu

SEQ ID NO: 1187432 - RNA, 12 nt, Homo sapiens
aagcagcccuuc

SEQ ID NO: 1187433 - RNA, 17 nt, Homo sapiens
aagcagggacugugaac

SEQ ID NO: 1187434 - RNA, 18 nt, Homo sapiens
aagcagggacugugaaca

SEQ ID NO: 1187435 - RNA, 16 nt, Homo sapiens
aagcagucuugcucug

SEQ ID NO: 1187436 - RNA, 15 nt, Homo sapiens
aagcagugcacauuu

SEQ ID NO: 1187437 - RNA, 15 nt, Homo sapiens
aagcaugaguggccu

SEQ ID NO: 1187438 - RNA, 20 nt, Homo sapiens
aagcaugcauucuagcacaa

SEQ ID NO: 1187439 - RNA, 14 nt, Homo sapiens
aagcaugcuucuau

SEQ ID NO: 1187440 - RNA, 13 nt, Homo sapiens
aagcauguagcca

SEQ ID NO: 1187441 - RNA, 15 nt, Homo sapiens
aagcauguagccagu

SEQ ID NO: 1187442 - RNA, 16 nt, Homo sapiens
aagcauguagccaguu

SEQ ID NO: 1187443 - RNA, 16 nt, Homo sapiens
aagcaugugucaugca

SEQ ID NO: 1187444 - RNA, 14 nt, Homo sapiens
aagcauuacuuuau

SEQ ID NO: 1187445 - RNA, 15 nt, Homo sapiens
aagcauuucaccuuu

SEQ ID NO: 1187446 - RNA, 21 nt, Homo sapiens
aagccaauucagacaggcaaa

SEQ ID NO: 1187447 - RNA, 17 nt, Homo sapiens
aagccagaagcugagca

SEQ ID NO: 1187448 - RNA, 20 nt, Homo sapiens
aagccaggcaccguggcuca

SEQ ID NO: 1187449 - RNA, 23 nt, Homo sapiens
aagccauggagugagacccagga

SEQ ID NO: 1187450 - RNA, 18 nt, Homo sapiens
aagccauucgguugucuc

SEQ ID NO: 1187451 - RNA, 19 nt, Homo sapiens
aagccauuuuuuauuucag

SEQ ID NO: 1187452 - RNA, 15 nt, Homo sapiens
aagcccaccugggcu

SEQ ID NO: 1187453 - RNA, 18 nt, Homo sapiens
aagcccacuuuguucgca

SEQ ID NO: 1187454 - RNA, 21 nt, Homo sapiens
aagcccagaucucugcaucuc

SEQ ID NO: 1187455 - RNA, 20 nt, Homo sapiens
aagcccgcggggacauuggg

SEQ ID NO: 1187456 - RNA, 23 nt, Homo sapiens
aagccggggaagagauccaaaga

SEQ ID NO: 1187457 - RNA, 13 nt, Homo sapiens
aagccucuggguu

SEQ ID NO: 1187458 - RNA, 16 nt, Homo sapiens
aagccugacccuguaa

SEQ ID NO: 1187459 - RNA, 19 nt, Homo sapiens
aagccugucccaggacuca

SEQ ID NO: 1187460 - RNA, 12 nt, Homo sapiens
aagccugugaaa

SEQ ID NO: 1187461 - RNA, 14 nt, Homo sapiens
aagccugugaaagg

SEQ ID NO: 1187462 - RNA, 15 nt, Homo sapiens
aagccugugcaaugc

SEQ ID NO: 1187463 - RNA, 21 nt, Homo sapiens
aagccuuuacugacccugggg

SEQ ID NO: 1187464 - RNA, 15 nt, Homo sapiens
aagcgaacaucuuca

SEQ ID NO: 1187465 - RNA, 21 nt, Homo sapiens
aagcgaauuugucuucagauu

SEQ ID NO: 1187466 - RNA, 15 nt, Homo sapiens
aagcgauccuccugc

SEQ ID NO: 1187467 - RNA, 17 nt, Homo sapiens
aagcgauucuccugccu

SEQ ID NO: 1187468 - RNA, 19 nt, Homo sapiens
aagcgauucuccugccuca

SEQ ID NO: 1187469 - RNA, 18 nt, Homo sapiens
aagcgucugugcauuuau

SEQ ID NO: 1187470 - RNA, 14 nt, Homo sapiens
aagcuaaaagcaug

SEQ ID NO: 1187471 - RNA, 16 nt, Homo sapiens
aagcuagaacuggaag

SEQ ID NO: 1187472 - RNA, 16 nt, Homo sapiens
aagcuauccaggauuu

SEQ ID NO: 1187473 - RNA, 21 nt, Homo sapiens
aagcucaccuguugcuuacaa

SEQ ID NO: 1187474 - RNA, 21 nt, Homo sapiens
aagcucagaggcgcacuguga

SEQ ID NO: 1187475 - RNA, 16 nt, Homo sapiens
aagcuccuuuggcaga

SEQ ID NO: 1187476 - RNA, 21 nt, Homo sapiens
aagcucggcgaauucucagga

SEQ ID NO: 1187477 - RNA, 13 nt, Homo sapiens
aagcucuaaugga

SEQ ID NO: 1187478 - RNA, 15 nt, Homo sapiens
aagcucuaucugcaa

SEQ ID NO: 1187479 - RNA, 22 nt, Homo sapiens
aagcucuguggccacauuuuca

SEQ ID NO: 1187480 - RNA, 15 nt, Homo sapiens
aagcugacauugcca

SEQ ID NO: 1187481 - RNA, 20 nt, Homo sapiens
aagcugagcaccaggggaug

SEQ ID NO: 1187482 - RNA, 23 nt, Homo sapiens
aagcugagucucccuaaggcaug

SEQ ID NO: 1187483 - RNA, 15 nt, Homo sapiens
aagcugauuaccuga

SEQ ID NO: 1187484 - RNA, 14 nt, Homo sapiens
aagcugcauccaga

SEQ ID NO: 1187485 - RNA, 18 nt, Homo sapiens
aagcugcccucagccaga

SEQ ID NO: 1187486 - RNA, 17 nt, Homo sapiens
aagcugccgguucuuaa

SEQ ID NO: 1187487 - RNA, 14 nt, Homo sapiens
aagcugcucaggga

SEQ ID NO: 1187488 - RNA, 14 nt, Homo sapiens
aagcuggagugcug

SEQ ID NO: 1187489 - RNA, 19 nt, Homo sapiens
aagcuguauuuauguaaua

SEQ ID NO: 1187490 - RNA, 13 nt, Homo sapiens
aagcuguguucau

SEQ ID NO: 1187491 - RNA, 21 nt, Homo sapiens
aagcuguuauucuuguuauac

SEQ ID NO: 1187492 - RNA, 18 nt, Homo sapiens
aagcuguucucauuccug

SEQ ID NO: 1187493 - RNA, 23 nt, Homo sapiens
aagcuguuugucguaacuugaaa

SEQ ID NO: 1187494 - RNA, 16 nt, Homo sapiens
aagcuuaacacuugac

SEQ ID NO: 1187495 - RNA, 20 nt, Homo sapiens
aagcuugagucucaagggug

SEQ ID NO: 1187496 - RNA, 22 nt, Homo sapiens
aagcuuucauguaaacugugca

SEQ ID NO: 1187497 - RNA, 13 nt, Homo sapiens
aaggaaaaauaau

SEQ ID NO: 1187498 - RNA, 14 nt, Homo sapiens
aaggaaaacugcca

SEQ ID NO: 1187499 - RNA, 19 nt, Homo sapiens
aaggaaacccccaguguaa

SEQ ID NO: 1187500 - RNA, 12 nt, Homo sapiens
aaggaaagugau

SEQ ID NO: 1187501 - RNA, 22 nt, Homo sapiens
aaggaaaugcaagcucuggaaa

SEQ ID NO: 1187502 - RNA, 12 nt, Homo sapiens
aaggaaaugcag

SEQ ID NO: 1187503 - RNA, 15 nt, Homo sapiens
aaggaaccaaagcga

SEQ ID NO: 1187504 - RNA, 19 nt, Homo sapiens
aaggaagaggcugacaaua

SEQ ID NO: 1187505 - RNA, 15 nt, Homo sapiens
aaggaagauggagcu

SEQ ID NO: 1187506 - RNA, 19 nt, Homo sapiens
aaggacaaagugccaaaga

SEQ ID NO: 1187507 - RNA, 20 nt, Homo sapiens
aaggacaaagugccaaagaa

SEQ ID NO: 1187508 - RNA, 13 nt, Homo sapiens
aaggacagcugaa

SEQ ID NO: 1187509 - RNA, 18 nt, Homo sapiens
aaggacaggucucugaga

SEQ ID NO: 1187510 - RNA, 21 nt, Homo sapiens
aaggaccugaaauuccaaagu

SEQ ID NO: 1187511 - RNA, 23 nt, Homo sapiens
aaggagacucaccucugccucaa

SEQ ID NO: 1187512 - RNA, 18 nt, Homo sapiens
aaggagaggcaacaucca

SEQ ID NO: 1187513 - RNA, 20 nt, Homo sapiens
aaggagaggggaccaugcaa

SEQ ID NO: 1187514 - RNA, 21 nt, Homo sapiens
aaggagccagacuuguucuca

SEQ ID NO: 1187515 - RNA, 14 nt, Homo sapiens
aaggagccagggaa

SEQ ID NO: 1187516 - RNA, 16 nt, Homo sapiens
aaggagccccauuccu

SEQ ID NO: 1187517 - RNA, 19 nt, Homo sapiens
aaggagggagcuacucuca

SEQ ID NO: 1187518 - RNA, 20 nt, Homo sapiens
aaggaguaaucuguguacaa

SEQ ID NO: 1187519 - RNA, 21 nt, Homo sapiens
aaggaguaaucuguguacaaa

SEQ ID NO: 1187520 - RNA, 21 nt, Homo sapiens
aauugacagaucaagcuguga

SEQ ID NO: 1187521 - RNA, 20 nt, Homo sapiens
aauugagacagugcacauga

SEQ ID NO: 1187522 - RNA, 12 nt, Homo sapiens
aauugauucaug

SEQ ID NO: 1187523 - RNA, 20 nt, Homo sapiens
aauugauuucuuuucuuccu

SEQ ID NO: 1187524 - RNA, 13 nt, Homo sapiens
aauugauuugcau

SEQ ID NO: 1187525 - RNA, 16 nt, Homo sapiens
aauugauuugcauuga

SEQ ID NO: 1187526 - RNA, 12 nt, Homo sapiens
aauugcaauaca

SEQ ID NO: 1187527 - RNA, 18 nt, Homo sapiens
aauugcagcuguacugag

SEQ ID NO: 1187528 - RNA, 12 nt, Homo sapiens
aauugcauuuaa

SEQ ID NO: 1187529 - RNA, 21 nt, Homo sapiens
aauugcugcaccaaugcacug

SEQ ID NO: 1187530 - RNA, 21 nt, Homo sapiens
aauuggguggggggcuucaua

SEQ ID NO: 1187531 - RNA, 13 nt, Homo sapiens
aauugguguauau

SEQ ID NO: 1187532 - RNA, 18 nt, Homo sapiens
aauuguaucaaaugugac

SEQ ID NO: 1187533 - RNA, 15 nt, Homo sapiens
aauugucacaucaag

SEQ ID NO: 1187534 - RNA, 13 nt, Homo sapiens
aauuguccaugag

SEQ ID NO: 1187535 - RNA, 15 nt, Homo sapiens
aauugugaacagcca

SEQ ID NO: 1187536 - RNA, 23 nt, Homo sapiens
aauuguguaccugaaguacagua

SEQ ID NO: 1187537 - RNA, 23 nt, Homo sapiens
aauugugugugaugugaagccaa

SEQ ID NO: 1187538 - RNA, 20 nt, Homo sapiens
aauuguuagauggcaauagu

SEQ ID NO: 1187539 - RNA, 15 nt, Homo sapiens
aauuuaaacagucuc

SEQ ID NO: 1187540 - RNA, 22 nt, Homo sapiens
aauuuaauuccuucuaccuuaa

SEQ ID NO: 1187541 - RNA, 13 nt, Homo sapiens
aauuuacauauag

SEQ ID NO: 1187542 - RNA, 20 nt, Homo sapiens
aauuuacauuuaauacagau

SEQ ID NO: 1187543 - RNA, 12 nt, Homo sapiens
aauuuacuugau

SEQ ID NO: 1187544 - RNA, 18 nt, Homo sapiens
aauuuagaccccauacaa

SEQ ID NO: 1187545 - RNA, 14 nt, Homo sapiens
aauuuagcugccuu

SEQ ID NO: 1187546 - RNA, 22 nt, Homo sapiens
aauuuauauagcaagugcuauu

SEQ ID NO: 1187547 - RNA, 20 nt, Homo sapiens
aauuuauauuuuggguuuau

SEQ ID NO: 1187548 - RNA, 14 nt, Homo sapiens
aauuucgcucugga

SEQ ID NO: 1187549 - RNA, 23 nt, Homo sapiens
aauuucuucuccuggaguugcau

SEQ ID NO: 1187550 - RNA, 24 nt, Homo sapiens
aauuucuuugauuuaacugacuua

SEQ ID NO: 1187551 - RNA, 22 nt, Homo sapiens
aauuugacugguucaccugugu

SEQ ID NO: 1187552 - RNA, 17 nt, Homo sapiens
aauuugcaaaguacugu

SEQ ID NO: 1187553 - RNA, 15 nt, Homo sapiens
aauuugcuuuaucug

SEQ ID NO: 1187554 - RNA, 16 nt, Homo sapiens
aauuuggcauugaucu

SEQ ID NO: 1187555 - RNA, 17 nt, Homo sapiens
aauuuggcugcuucuac

SEQ ID NO: 1187556 - RNA, 14 nt, Homo sapiens
aauuuggugcuuau

SEQ ID NO: 1187557 - RNA, 19 nt, Homo sapiens
aauuuguaacuuuguugca

SEQ ID NO: 1187558 - RNA, 20 nt, Homo sapiens
aauuuguauaugacugcauu

SEQ ID NO: 1187559 - RNA, 16 nt, Homo sapiens
aauuuuagcgugcuca

SEQ ID NO: 1187560 - RNA, 15 nt, Homo sapiens
aauuuucacugcugc

SEQ ID NO: 1187561 - RNA, 20 nt, Homo sapiens
aauuuucauuaaacuugaag

SEQ ID NO: 1187562 - RNA, 19 nt, Homo sapiens
aauuuuuaaggauguugcc

SEQ ID NO: 1187563 - RNA, 16 nt, Homo sapiens
aauuuuuugguacaaa

SEQ ID NO: 1187564 - RNA, 13 nt, Homo sapiens
acaaaaaauacuu

SEQ ID NO: 1187565 - RNA, 13 nt, Homo sapiens
acaaaaaucagcc

SEQ ID NO: 1187566 - RNA, 13 nt, Homo sapiens
acaaaacccacug

SEQ ID NO: 1187567 - RNA, 14 nt, Homo sapiens
acaaaacccuuucu

SEQ ID NO: 1187568 - RNA, 11 nt, Homo sapiens
acaaaacuaca

SEQ ID NO: 1187569 - RNA, 16 nt, Homo sapiens
acaaaacuacaugaga

SEQ ID NO: 1187570 - RNA, 13 nt, Homo sapiens
acaaaaggcuuug

SEQ ID NO: 1187571 - RNA, 21 nt, Homo sapiens
acaaaaguuaaugaauaugcc

SEQ ID NO: 1187572 - RNA, 19 nt, Homo sapiens
acaaaauaaagcuguucuc

SEQ ID NO: 1187573 - RNA, 14 nt, Homo sapiens
acaaaaucacauuc

SEQ ID NO: 1187574 - RNA, 12 nt, Homo sapiens
acaaaaucagcc

SEQ ID NO: 1187575 - RNA, 20 nt, Homo sapiens
acaaaaugggccucauggaa

SEQ ID NO: 1187576 - RNA, 11 nt, Homo sapiens
acaaacaaaca

SEQ ID NO: 1187577 - RNA, 14 nt, Homo sapiens
acaaacacauuguu

SEQ ID NO: 1187578 - RNA, 22 nt, Homo sapiens
acaaacauaaggcacauugugu

SEQ ID NO: 1187579 - RNA, 15 nt, Homo sapiens
acaaaccauugaaac

SEQ ID NO: 1187580 - RNA, 14 nt, Homo sapiens
acaaacccaagggc

SEQ ID NO: 1187581 - RNA, 18 nt, Homo sapiens
acaaacggagccccugaa

SEQ ID NO: 1187582 - RNA, 14 nt, Homo sapiens
acaaacuucaaaga

SEQ ID NO: 1187583 - RNA, 13 nt, Homo sapiens
acaaagaagacau

SEQ ID NO: 1187584 - RNA, 21 nt, Homo sapiens
acaaagaagguuaccaagaag

SEQ ID NO: 1187585 - RNA, 20 nt, Homo sapiens
acaaagacaucccggcccaa

SEQ ID NO: 1187586 - RNA, 20 nt, Homo sapiens
acaaagaugaccauaaccac

SEQ ID NO: 1187587 - RNA, 16 nt, Homo sapiens
acaaagcacaguuuga

SEQ ID NO: 1187588 - RNA, 15 nt, Homo sapiens
acaaagugccaaaga

SEQ ID NO: 1187589 - RNA, 16 nt, Homo sapiens
acaaagugccaaagaa

SEQ ID NO: 1187590 - RNA, 23 nt, Homo sapiens
acaaaguuacugauucacugcau

SEQ ID NO: 1187591 - RNA, 16 nt, Homo sapiens
acaaauaaguuacauc

SEQ ID NO: 1187592 - RNA, 20 nt, Homo sapiens
acaaauacuuagacaguaug

SEQ ID NO: 1187593 - RNA, 16 nt, Homo sapiens
acaaauagucuaucaa

SEQ ID NO: 1187594 - RNA, 23 nt, Homo sapiens
acaaauagucuaucaaccccaga

SEQ ID NO: 1187595 - RNA, 14 nt, Homo sapiens
acaaauauuucaga

SEQ ID NO: 1187596 - RNA, 23 nt, Homo sapiens
acaaaucuuaccagguucacuua

SEQ ID NO: 1187597 - RNA, 19 nt, Homo sapiens
acaaaugauaaguacuaca

SEQ ID NO: 1187598 - RNA, 18 nt, Homo sapiens
acaaaugggaaaaccaga

SEQ ID NO: 1187599 - RNA, 13 nt, Homo sapiens
acaaauuccacau

SEQ ID NO: 1187600 - RNA, 12 nt, Homo sapiens
acaaauugagac

SEQ ID NO: 1187601 - RNA, 23 nt, Homo sapiens
acaaauugcacagaaguccugua

SEQ ID NO: 1187602 - RNA, 17 nt, Homo sapiens
acaacaaacacugugau

SEQ ID NO: 1187603 - RNA, 19 nt, Homo sapiens
acaacagauuuacauccca

SEQ ID NO: 1187604 - RNA, 12 nt, Homo sapiens
acaacagauuug

SEQ ID NO: 1187605 - RNA, 14 nt, Homo sapiens
acaacagugcuaaa

SEQ ID NO: 1187606 - RNA, 17 nt, Homo sapiens
acaacauagcaaauuaa

SEQ ID NO: 1187607 - RNA, 14 nt, Homo sapiens
acaaccagauuuga

SEQ ID NO: 1187608 - RNA, 18 nt, Homo sapiens
acaaccuuuucucuggac

SEQ ID NO: 1187609 - RNA, 18 nt, Homo sapiens
acaacgaggaagcccuaa

SEQ ID NO: 1187610 - RNA, 14 nt, Homo sapiens
acaacgugcaacug

SEQ ID NO: 1187611 - RNA, 17 nt, Homo sapiens
acaacgugcaacugaca

SEQ ID NO: 1187612 - RNA, 17 nt, Homo sapiens
acaacuaaauaacugua

SEQ ID NO: 1187613 - RNA, 14 nt, Homo sapiens
acaacuccuuccau

SEQ ID NO: 1187614 - RNA, 17 nt, Homo sapiens
acaacugacuaaccauu

SEQ ID NO: 1187615 - RNA, 16 nt, Homo sapiens
acaagaaucacuugaa

SEQ ID NO: 1187616 - RNA, 17 nt, Homo sapiens
acaagaaucacuugaac

SEQ ID NO: 1187617 - RNA, 20 nt, Homo sapiens
acaagacccaaguagcugcu

SEQ ID NO: 1187618 - RNA, 22 nt, Homo sapiens
acaagacuuuaccauacacgca

SEQ ID NO: 1187619 - RNA, 21 nt, Homo sapiens
acaagauacacgucacaaaga

SEQ ID NO: 1187620 - RNA, 12 nt, Homo sapiens
acaagauuagaa

SEQ ID NO: 1187621 - RNA, 15 nt, Homo sapiens
acaagcaaacccaga

SEQ ID NO: 1187622 - RNA, 20 nt, Homo sapiens
acaagcaccucuccugugag

SEQ ID NO: 1187623 - RNA, 12 nt, Homo sapiens
acaagcagauac

SEQ ID NO: 1187624 - RNA, 18 nt, Homo sapiens
acaagcccccccuuccac

SEQ ID NO: 1187625 - RNA, 15 nt, Homo sapiens
acaagcuuacaaaga

SEQ ID NO: 1187626 - RNA, 12 nt, Homo sapiens
acaaggccaucu

SEQ ID NO: 1187627 - RNA, 18 nt, Homo sapiens
acaaggcgagcuugaguu

SEQ ID NO: 1187628 - RNA, 19 nt, Homo sapiens
acaagggucacaauacugu

SEQ ID NO: 1187629 - RNA, 21 nt, Homo sapiens
acaaguaccacucuuggucag

SEQ ID NO: 1187630 - RNA, 13 nt, Homo sapiens
acaagugaccccc

SEQ ID NO: 1187631 - RNA, 17 nt, Homo sapiens
acaaguugaaauaugcu

SEQ ID NO: 1187632 - RNA, 19 nt, Homo sapiens
acaaguuggaugcggccau

SEQ ID NO: 1187633 - RNA, 23 nt, Homo sapiens
acaaguuggaugcggccauucaa

SEQ ID NO: 1187634 - RNA, 21 nt, Homo sapiens
acaauaaaacuaaauguguac

SEQ ID NO: 1187635 - RNA, 14 nt, Homo sapiens
acaauaaagacuga

SEQ ID NO: 1187636 - RNA, 15 nt, Homo sapiens
acaauaaaugccacu

SEQ ID NO: 1187637 - RNA, 16 nt, Homo sapiens
acaauauugacuuugu

SEQ ID NO: 1187638 - RNA, 13 nt, Homo sapiens
acaauccaaaaau

SEQ ID NO: 1187639 - RNA, 16 nt, Homo sapiens
acaaugauuaaucagc

SEQ ID NO: 1187640 - RNA, 15 nt, Homo sapiens
acaaugcugagguua

SEQ ID NO: 1187641 - RNA, 11 nt, Homo sapiens
acaaugcugau

SEQ ID NO: 1187642 - RNA, 23 nt, Homo sapiens
acaauguauuuuaauaacauauc

SEQ ID NO: 1187643 - RNA, 19 nt, Homo sapiens
acaauguucuuuauauaca

SEQ ID NO: 1187644 - RNA, 12 nt, Homo sapiens
acaauguugcac

SEQ ID NO: 1187645 - RNA, 23 nt, Homo sapiens
acaauguuguguuuggauuugua

SEQ ID NO: 1187646 - RNA, 15 nt, Homo sapiens
acacaacauguaugu

SEQ ID NO: 1187647 - RNA, 19 nt, Homo sapiens
acacaagaaaacucaaaga

SEQ ID NO: 1187648 - RNA, 20 nt, Homo sapiens
acacaaguggguagugucau

SEQ ID NO: 1187649 - RNA, 16 nt, Homo sapiens
acacacacacaccucu

SEQ ID NO: 1187650 - RNA, 11 nt, Homo sapiens
acacacacucc

SEQ ID NO: 1187651 - RNA, 16 nt, Homo sapiens
acacaccgcugucucu

SEQ ID NO: 1187652 - RNA, 16 nt, Homo sapiens
acacaccucuugaaac

SEQ ID NO: 1187653 - RNA, 15 nt, Homo sapiens
acccugucucaaaaa

SEQ ID NO: 1187654 - RNA, 11 nt, Homo sapiens
acccugugacc

SEQ ID NO: 1187655 - RNA, 17 nt, Homo sapiens
acccuucgagaucauca

SEQ ID NO: 1187656 - RNA, 21 nt, Homo sapiens
acccuugagcugugugccaca

SEQ ID NO: 1187657 - RNA, 22 nt, Homo sapiens
acccuuucauaaagucuugccu

SEQ ID NO: 1187658 - RNA, 23 nt, Homo sapiens
acccuuucauaaagucuugccuu

SEQ ID NO: 1187659 - RNA, 19 nt, Homo sapiens
accgaggcagggaaggauc

SEQ ID NO: 1187660 - RNA, 15 nt, Homo sapiens
accgaugcuuuacca

SEQ ID NO: 1187661 - RNA, 15 nt, Homo sapiens
accgccauggugcug

SEQ ID NO: 1187662 - RNA, 14 nt, Homo sapiens
accgccgggguccu

SEQ ID NO: 1187663 - RNA, 23 nt, Homo sapiens
accgcuucugccuuuucacugug

SEQ ID NO: 1187664 - RNA, 23 nt, Homo sapiens
accggaguuaugacaagcuuucc

SEQ ID NO: 1187665 - RNA, 20 nt, Homo sapiens
accgggcugcaggugcugcu

SEQ ID NO: 1187666 - RNA, 15 nt, Homo sapiens
accguaaauguccau

SEQ ID NO: 1187667 - RNA, 17 nt, Homo sapiens
accguaggacccaagca

SEQ ID NO: 1187668 - RNA, 16 nt, Homo sapiens
accgugugucauguca

SEQ ID NO: 1187669 - RNA, 23 nt, Homo sapiens
accguucauucaggcaacgcaca

SEQ ID NO: 1187670 - RNA, 15 nt, Homo sapiens
accguucugugcaca

SEQ ID NO: 1187671 - RNA, 16 nt, Homo sapiens
accuaacccucuguca

SEQ ID NO: 1187672 - RNA, 18 nt, Homo sapiens
accuaauccaggcagauc

SEQ ID NO: 1187673 - RNA, 19 nt, Homo sapiens
accuacacaagcaucaccu

SEQ ID NO: 1187674 - RNA, 17 nt, Homo sapiens
accuacauucaaggaga

SEQ ID NO: 1187675 - RNA, 22 nt, Homo sapiens
accuacuaauccucucugcaag

SEQ ID NO: 1187676 - RNA, 17 nt, Homo sapiens
accuacugacugaugac

SEQ ID NO: 1187677 - RNA, 20 nt, Homo sapiens
accuacuuuucuuuccucag

SEQ ID NO: 1187678 - RNA, 16 nt, Homo sapiens
accuagaguuuuauca

SEQ ID NO: 1187679 - RNA, 21 nt, Homo sapiens
accuauagaaauguauuuuga

SEQ ID NO: 1187680 - RNA, 14 nt, Homo sapiens
accuauauugauuu

SEQ ID NO: 1187681 - RNA, 11 nt, Homo sapiens
accuauugcca

SEQ ID NO: 1187682 - RNA, 18 nt, Homo sapiens
accucaaggccuacugac

SEQ ID NO: 1187683 - RNA, 13 nt, Homo sapiens
accucaagugauc

SEQ ID NO: 1187684 - RNA, 17 nt, Homo sapiens
accucacgcaccuccca

SEQ ID NO: 1187685 - RNA, 17 nt, Homo sapiens
accucagggcacaaaga

SEQ ID NO: 1187686 - RNA, 18 nt, Homo sapiens
accucaguuauuacaugu

SEQ ID NO: 1187687 - RNA, 20 nt, Homo sapiens
accucaguucccucuugcuc

SEQ ID NO: 1187688 - RNA, 15 nt, Homo sapiens
accucaucucuacua

SEQ ID NO: 1187689 - RNA, 20 nt, Homo sapiens
accucaugaggaccagggug

SEQ ID NO: 1187690 - RNA, 19 nt, Homo sapiens
accucauguccacucagua

SEQ ID NO: 1187691 - RNA, 15 nt, Homo sapiens
accuccacagcuucc

SEQ ID NO: 1187692 - RNA, 18 nt, Homo sapiens
accuccacgggcucuccu

SEQ ID NO: 1187693 - RNA, 23 nt, Homo sapiens
accuccaggcuuucccacuuccc

SEQ ID NO: 1187694 - RNA, 23 nt, Homo sapiens
accucccacugcccccuccacug

SEQ ID NO: 1187695 - RNA, 17 nt, Homo sapiens
accucccauccuaauca

SEQ ID NO: 1187696 - RNA, 17 nt, Homo sapiens
accucccuauacugcuu

SEQ ID NO: 1187697 - RNA, 17 nt, Homo sapiens
accucccucugccaguc

SEQ ID NO: 1187698 - RNA, 21 nt, Homo sapiens
accuccucccuaaugcucacc

SEQ ID NO: 1187699 - RNA, 17 nt, Homo sapiens
accucgcuggacucuca

SEQ ID NO: 1187700 - RNA, 20 nt, Homo sapiens
accucggccucccaaagugc

SEQ ID NO: 1187701 - RNA, 22 nt, Homo sapiens
accucgggaaacuuagaucauc

SEQ ID NO: 1187702 - RNA, 17 nt, Homo sapiens
accucuaccuguuccca

SEQ ID NO: 1187703 - RNA, 16 nt, Homo sapiens
accucuauauuugcuc

SEQ ID NO: 1187704 - RNA, 18 nt, Homo sapiens
accucugugccucugucu

SEQ ID NO: 1187705 - RNA, 17 nt, Homo sapiens
accucuuuuucuuacca

SEQ ID NO: 1187706 - RNA, 18 nt, Homo sapiens
accugaaaacacugugca

SEQ ID NO: 1187707 - RNA, 18 nt, Homo sapiens
accugaaauuaacucaga

SEQ ID NO: 1187708 - RNA, 14 nt, Homo sapiens
accugaacucugca

SEQ ID NO: 1187709 - RNA, 16 nt, Homo sapiens
accugaacucugcaac

SEQ ID NO: 1187710 - RNA, 13 nt, Homo sapiens
accugaagacacc

SEQ ID NO: 1187711 - RNA, 22 nt, Homo sapiens
accugaagguccccuggcagug

SEQ ID NO: 1187712 - RNA, 20 nt, Homo sapiens
accugaaguagaacuuaaga

SEQ ID NO: 1187713 - RNA, 11 nt, Homo sapiens
accugacaaug

SEQ ID NO: 1187714 - RNA, 13 nt, Homo sapiens
accugauccugga

SEQ ID NO: 1187715 - RNA, 21 nt, Homo sapiens
accugauuuaccucuuaccug

SEQ ID NO: 1187716 - RNA, 13 nt, Homo sapiens
accugcaacacaa

SEQ ID NO: 1187717 - RNA, 14 nt, Homo sapiens
accugcaaucccag

SEQ ID NO: 1187718 - RNA, 12 nt, Homo sapiens
accugcacuuca

SEQ ID NO: 1187719 - RNA, 20 nt, Homo sapiens
accugccuuauccuguucua

SEQ ID NO: 1187720 - RNA, 19 nt, Homo sapiens
accuggcagcucuggacag

SEQ ID NO: 1187721 - RNA, 22 nt, Homo sapiens
accuggcccccucagcucuguc

SEQ ID NO: 1187722 - RNA, 16 nt, Homo sapiens
accuggcccuugcaau

SEQ ID NO: 1187723 - RNA, 17 nt, Homo sapiens
accuggcuuggcuuuaa

SEQ ID NO: 1187724 - RNA, 20 nt, Homo sapiens
accugguugauguguauuca

SEQ ID NO: 1187725 - RNA, 19 nt, Homo sapiens
accuguauaacccuguuac

SEQ ID NO: 1187726 - RNA, 13 nt, Homo sapiens
accuguauuccca

SEQ ID NO: 1187727 - RNA, 22 nt, Homo sapiens
accugucgguggcugccuuuga

SEQ ID NO: 1187728 - RNA, 15 nt, Homo sapiens
accugugagcccagc

SEQ ID NO: 1187729 - RNA, 22 nt, Homo sapiens
accugugagcccagcuggguca

SEQ ID NO: 1187730 - RNA, 21 nt, Homo sapiens
accugugcacguuggaacuuu

SEQ ID NO: 1187731 - RNA, 11 nt, Homo sapiens
accuguugaag

SEQ ID NO: 1187732 - RNA, 21 nt, Homo sapiens
accuguuuuuuuuucauuuau

SEQ ID NO: 1187733 - RNA, 23 nt, Homo sapiens
accuuaaaaaugcgggcauuuaa

SEQ ID NO: 1187734 - RNA, 23 nt, Homo sapiens
accuuaaaugcuacugaaacuua

SEQ ID NO: 1187735 - RNA, 19 nt, Homo sapiens
accuuaauuuaacuuucca

SEQ ID NO: 1187736 - RNA, 13 nt, Homo sapiens
accuuagugcaac

SEQ ID NO: 1187737 - RNA, 13 nt, Homo sapiens
accuuauacauca

SEQ ID NO: 1187738 - RNA, 19 nt, Homo sapiens
accuuauacaucacuuccu

SEQ ID NO: 1187739 - RNA, 21 nt, Homo sapiens
accuucaaaugcgaacacuau

SEQ ID NO: 1187740 - RNA, 15 nt, Homo sapiens
accuucagagccagc

SEQ ID NO: 1187741 - RNA, 21 nt, Homo sapiens
accuucagauuuguguuauaa

SEQ ID NO: 1187742 - RNA, 13 nt, Homo sapiens
accuucaggaaau

SEQ ID NO: 1187743 - RNA, 16 nt, Homo sapiens
accuucaggaaauaua

SEQ ID NO: 1187744 - RNA, 16 nt, Homo sapiens
accuuccaauuccuga

SEQ ID NO: 1187745 - RNA, 15 nt, Homo sapiens
accuuggcuuguuau

SEQ ID NO: 1187746 - RNA, 22 nt, Homo sapiens
accuugucucccagcucagggc

SEQ ID NO: 1187747 - RNA, 12 nt, Homo sapiens
accuugugagag

SEQ ID NO: 1187748 - RNA, 14 nt, Homo sapiens
accuuguuuugcca

SEQ ID NO: 1187749 - RNA, 16 nt, Homo sapiens
accuuguuuugccagu

SEQ ID NO: 1187750 - RNA, 17 nt, Homo sapiens
accuuguuuugccaugu

SEQ ID NO: 1187751 - RNA, 20 nt, Homo sapiens
accuuuccauuuauucuuug

SEQ ID NO: 1187752 - RNA, 23 nt, Homo sapiens
accuuucuccuuuguacuuugug

SEQ ID NO: 1187753 - RNA, 18 nt, Homo sapiens
accuuugauuuuugccca

SEQ ID NO: 1187754 - RNA, 20 nt, Homo sapiens
accuuugcccacacacacuc

SEQ ID NO: 1187755 - RNA, 18 nt, Homo sapiens
accuuugcuuaccuuguu

SEQ ID NO: 1187756 - RNA, 19 nt, Homo sapiens
accuuuuccugcggcauca

SEQ ID NO: 1187757 - RNA, 12 nt, Homo sapiens
acgaaauccuaa

SEQ ID NO: 1187758 - RNA, 20 nt, Homo sapiens
acgaaguguugcauggaugu

SEQ ID NO: 1187759 - RNA, 17 nt, Homo sapiens
acgaauuccaucuugua

SEQ ID NO: 1187760 - RNA, 17 nt, Homo sapiens
acgagauacagaauuuu

SEQ ID NO: 1187761 - RNA, 13 nt, Homo sapiens
acgaggugcaaca

SEQ ID NO: 1187762 - RNA, 11 nt, Homo sapiens
acgaguguucc

SEQ ID NO: 1187763 - RNA, 17 nt, Homo sapiens
acgauaaaagacaguga

SEQ ID NO: 1187764 - RNA, 12 nt, Homo sapiens
acgaucucagcu

SEQ ID NO: 1187765 - RNA, 20 nt, Homo sapiens
acgaucucagcucacugcaa

SEQ ID NO: 1187766 - RNA, 19 nt, Homo sapiens
acgauugaccuguccucuu

SEQ ID NO: 1187767 - RNA, 23 nt, Homo sapiens
acgcagcagcccucuggcuccag

SEQ ID NO: 1187768 - RNA, 14 nt, Homo sapiens
acgcaguuacugaa

SEQ ID NO: 1187769 - RNA, 15 nt, Homo sapiens
acgcaguuacugaaa

SEQ ID NO: 1187770 - RNA, 15 nt, Homo sapiens
acgcaucacuggggc

SEQ ID NO: 1187771 - RNA, 15 nt, Homo sapiens
acgcauugcagccau

SEQ ID NO: 1187772 - RNA, 15 nt, Homo sapiens
acgccagacuuccca

SEQ ID NO: 1187773 - RNA, 23 nt, Homo sapiens
acgccgugcggcgggccagcugg

SEQ ID NO: 1187774 - RNA, 15 nt, Homo sapiens
acgcggccaccucac

SEQ ID NO: 1187775 - RNA, 15 nt, Homo sapiens
acgcugaagcgguca

SEQ ID NO: 1187776 - RNA, 18 nt, Homo sapiens
acgcugccucaacacuga

SEQ ID NO: 1187777 - RNA, 12 nt, Homo sapiens
acgcugugcugg

SEQ ID NO: 1187778 - RNA, 21 nt, Homo sapiens
acggagccccugaaagccuca

SEQ ID NO: 1187779 - RNA, 15 nt, Homo sapiens
acggaguuaauuuua

SEQ ID NO: 1187780 - RNA, 19 nt, Homo sapiens
acggaguuuugcucuugua

SEQ ID NO: 1187781 - RNA, 15 nt, Homo sapiens
acggcuuuucuugag

SEQ ID NO: 1187782 - RNA, 19 nt, Homo sapiens
acgggaauucagacaagcu

SEQ ID NO: 1187783 - RNA, 22 nt, Homo sapiens
acgggguucgcgcaccaggugu

SEQ ID NO: 1187784 - RNA, 15 nt, Homo sapiens
acgggugaugugauu

SEQ ID NO: 1187785 - RNA, 18 nt, Homo sapiens
agugcuauggugggagag

SEQ ID NO: 1187786 - RNA, 15 nt, Homo sapiens
agugcugaccagaca

SEQ ID NO: 1187787 - RNA, 16 nt, Homo sapiens
agugcugagggaccga

SEQ ID NO: 1187788 - RNA, 23 nt, Homo sapiens
agugcuugcagaucaucugggga

SEQ ID NO: 1187789 - RNA, 14 nt, Homo sapiens
agugcuuggcacau

SEQ ID NO: 1187790 - RNA, 15 nt, Homo sapiens
agugcuuggcugcug

SEQ ID NO: 1187791 - RNA, 21 nt, Homo sapiens
agugcuuuaagaaugaacaca

SEQ ID NO: 1187792 - RNA, 20 nt, Homo sapiens
aguggcacgaucucagcuca

SEQ ID NO: 1187793 - RNA, 18 nt, Homo sapiens
aguggcauaauucagggg

SEQ ID NO: 1187794 - RNA, 23 nt, Homo sapiens
aguggccccaucauagccugcag

SEQ ID NO: 1187795 - RNA, 19 nt, Homo sapiens
aguggccugugcuuuucag

SEQ ID NO: 1187796 - RNA, 18 nt, Homo sapiens
aguggcguuguucauaga

SEQ ID NO: 1187797 - RNA, 21 nt, Homo sapiens
aguggggacauacacuugcau

SEQ ID NO: 1187798 - RNA, 19 nt, Homo sapiens
aguggggagacuucuuggc

SEQ ID NO: 1187799 - RNA, 22 nt, Homo sapiens
aguggguaaaauuagaugcaug

SEQ ID NO: 1187800 - RNA, 22 nt, Homo sapiens
agugguagaggugugugccuag

SEQ ID NO: 1187801 - RNA, 16 nt, Homo sapiens
aguggucucuacugug

SEQ ID NO: 1187802 - RNA, 18 nt, Homo sapiens
aguggucucuacuguggc

SEQ ID NO: 1187803 - RNA, 19 nt, Homo sapiens
aguggucucuacuguggca

SEQ ID NO: 1187804 - RNA, 22 nt, Homo sapiens
aguggugcgaucucggcucagu

SEQ ID NO: 1187805 - RNA, 23 nt, Homo sapiens
aguggugggcccugaugcugcca

SEQ ID NO: 1187806 - RNA, 15 nt, Homo sapiens
aguggugugaucucg

SEQ ID NO: 1187807 - RNA, 20 nt, Homo sapiens
agugguguuccaugacuuca

SEQ ID NO: 1187808 - RNA, 21 nt, Homo sapiens
agugguucaauaccuguuuag

SEQ ID NO: 1187809 - RNA, 13 nt, Homo sapiens
agugguucagucu

SEQ ID NO: 1187810 - RNA, 14 nt, Homo sapiens
agugguucagucua

SEQ ID NO: 1187811 - RNA, 10 nt, Homo sapiens
aguguaagaa

SEQ ID NO: 1187812 - RNA, 12 nt, Homo sapiens
aguguaccuccu

SEQ ID NO: 1187813 - RNA, 16 nt, Homo sapiens
aguguauuuucuguca

SEQ ID NO: 1187814 - RNA, 23 nt, Homo sapiens
agugugaaacagcugcccugugu

SEQ ID NO: 1187815 - RNA, 14 nt, Homo sapiens
agugugaccacuga

SEQ ID NO: 1187816 - RNA, 16 nt, Homo sapiens
aguguguuuccuucag

SEQ ID NO: 1187817 - RNA, 18 nt, Homo sapiens
aguguuaugugaauuuga

SEQ ID NO: 1187818 - RNA, 16 nt, Homo sapiens
aguguucaacugugag

SEQ ID NO: 1187819 - RNA, 16 nt, Homo sapiens
aguguuccccuuccac

SEQ ID NO: 1187820 - RNA, 20 nt, Homo sapiens
aguguuccccuuccacugag

SEQ ID NO: 1187821 - RNA, 19 nt, Homo sapiens
aguguucuaaaaugaaaua

SEQ ID NO: 1187822 - RNA, 22 nt, Homo sapiens
aguguucucggggaugcauaga

SEQ ID NO: 1187823 - RNA, 18 nt, Homo sapiens
aguguucuucaguguaau

SEQ ID NO: 1187824 - RNA, 22 nt, Homo sapiens
aguguugauucuagaugaucaa

SEQ ID NO: 1187825 - RNA, 21 nt, Homo sapiens
aguguuuuggacuccaucucu

SEQ ID NO: 1187826 - RNA, 22 nt, Homo sapiens
aguguuuuuccuguguauuaaa

SEQ ID NO: 1187827 - RNA, 22 nt, Homo sapiens
aguuaaaaauaaaaaacauaua

SEQ ID NO: 1187828 - RNA, 20 nt, Homo sapiens
aguuaaugaaggugugcuac

SEQ ID NO: 1187829 - RNA, 21 nt, Homo sapiens
aguuaccucaaggccuacuga

SEQ ID NO: 1187830 - RNA, 21 nt, Homo sapiens
aguuacucccuacacugaugc

SEQ ID NO: 1187831 - RNA, 15 nt, Homo sapiens
aguuacugugaaugu

SEQ ID NO: 1187832 - RNA, 20 nt, Homo sapiens
aguuagcauaauacagaagu

SEQ ID NO: 1187833 - RNA, 12 nt, Homo sapiens
aguuagcaucca

SEQ ID NO: 1187834 - RNA, 17 nt, Homo sapiens
aguuaggucauuacuaa

SEQ ID NO: 1187835 - RNA, 23 nt, Homo sapiens
aguuaggucauuacuaaccauag

SEQ ID NO: 1187836 - RNA, 21 nt, Homo sapiens
aguuaguggauaaccacaggg

SEQ ID NO: 1187837 - RNA, 18 nt, Homo sapiens
aguuauacccaaccccag

SEQ ID NO: 1187838 - RNA, 14 nt, Homo sapiens
aguuaucaguauuu

SEQ ID NO: 1187839 - RNA, 17 nt, Homo sapiens
aguuauuacucaagugg

SEQ ID NO: 1187840 - RNA, 14 nt, Homo sapiens
aguuauuggaucag

SEQ ID NO: 1187841 - RNA, 19 nt, Homo sapiens
aguuauuggaucagugaaa

SEQ ID NO: 1187842 - RNA, 17 nt, Homo sapiens
aguucaagugcucuuca

SEQ ID NO: 1187843 - RNA, 21 nt, Homo sapiens
aguucacaucagaacagacaa

SEQ ID NO: 1187844 - RNA, 12 nt, Homo sapiens
aguucagaguuu

SEQ ID NO: 1187845 - RNA, 23 nt, Homo sapiens
aguucauucaugccaaguaucuu

SEQ ID NO: 1187846 - RNA, 13 nt, Homo sapiens
aguuccagcuuuu

SEQ ID NO: 1187847 - RNA, 20 nt, Homo sapiens
aguucccuuuuuauuugcag

SEQ ID NO: 1187848 - RNA, 21 nt, Homo sapiens
aguuccuucuggugucugcuu

SEQ ID NO: 1187849 - RNA, 17 nt, Homo sapiens
aguucggugagcuacaa

SEQ ID NO: 1187850 - RNA, 18 nt, Homo sapiens
aguucuaacaaaacaagu

SEQ ID NO: 1187851 - RNA, 15 nt, Homo sapiens
aguucuaguuugcau

SEQ ID NO: 1187852 - RNA, 18 nt, Homo sapiens
aguucuaguuugcauucc

SEQ ID NO: 1187853 - RNA, 23 nt, Homo sapiens
aguucugcuuucuccccaaugag

SEQ ID NO: 1187854 - RNA, 20 nt, Homo sapiens
aguucuuacugcuuaauuca

SEQ ID NO: 1187855 - RNA, 22 nt, Homo sapiens
aguucuuuaaaauguaaagcca

SEQ ID NO: 1187856 - RNA, 23 nt, Homo sapiens
aguucuuuaaaauguaaagccau

SEQ ID NO: 1187857 - RNA, 18 nt, Homo sapiens
aguugaagggaggggcug

SEQ ID NO: 1187858 - RNA, 17 nt, Homo sapiens
aguugagaacuggucag

SEQ ID NO: 1187859 - RNA, 23 nt, Homo sapiens
aguugagaccuuugauuuuugcc

SEQ ID NO: 1187860 - RNA, 21 nt, Homo sapiens
aguugaggggggggcauuagu

SEQ ID NO: 1187861 - RNA, 13 nt, Homo sapiens
aguugaucuggaa

SEQ ID NO: 1187862 - RNA, 13 nt, Homo sapiens
aguugcaccauuc

SEQ ID NO: 1187863 - RNA, 14 nt, Homo sapiens
aguugcacugugac

SEQ ID NO: 1187864 - RNA, 18 nt, Homo sapiens
aguugcguggacucugca

SEQ ID NO: 1187865 - RNA, 20 nt, Homo sapiens
aguugcuuccaguccugagc

SEQ ID NO: 1187866 - RNA, 20 nt, Homo sapiens
aguugcuuguaaaauuucac

SEQ ID NO: 1187867 - RNA, 14 nt, Homo sapiens
aguuggagugagau

SEQ ID NO: 1187868 - RNA, 18 nt, Homo sapiens
aguuggagugagaugaag

SEQ ID NO: 1187869 - RNA, 13 nt, Homo sapiens
aguuguauguggc

SEQ ID NO: 1187870 - RNA, 19 nt, Homo sapiens
aguuguccagaucacugaa

SEQ ID NO: 1187871 - RNA, 16 nt, Homo sapiens
aguuguggugugccau

SEQ ID NO: 1187872 - RNA, 14 nt, Homo sapiens
aguuuaacagaguu

SEQ ID NO: 1187873 - RNA, 19 nt, Homo sapiens
aguuuaccuauguaacaaa

SEQ ID NO: 1187874 - RNA, 12 nt, Homo sapiens
aguuuagugcau

SEQ ID NO: 1187875 - RNA, 19 nt, Homo sapiens
aguuuagugcccucaucca

SEQ ID NO: 1187876 - RNA, 14 nt, Homo sapiens
aguuuauaaagcca

SEQ ID NO: 1187877 - RNA, 15 nt, Homo sapiens
aguuuauaaagccaa

SEQ ID NO: 1187878 - RNA, 19 nt, Homo sapiens
aguuuauacuucucuauua

SEQ ID NO: 1187879 - RNA, 17 nt, Homo sapiens
aguuuauuuacucacuu

SEQ ID NO: 1187880 - RNA, 17 nt, Homo sapiens
aguuucaaaacauacaa

SEQ ID NO: 1187881 - RNA, 20 nt, Homo sapiens
aguuucagagaccauugcaa

SEQ ID NO: 1187882 - RNA, 15 nt, Homo sapiens
aguuucagauccuga

SEQ ID NO: 1187883 - RNA, 17 nt, Homo sapiens
aguuucauuaacuggug

SEQ ID NO: 1187884 - RNA, 20 nt, Homo sapiens
aguuuccuuccagcccagaa

SEQ ID NO: 1187885 - RNA, 16 nt, Homo sapiens
aguuucuaaccaaaga

SEQ ID NO: 1187886 - RNA, 12 nt, Homo sapiens
aguuucuaagca

SEQ ID NO: 1187887 - RNA, 19 nt, Homo sapiens
aguuucuaucccuuaccug

SEQ ID NO: 1187888 - RNA, 12 nt, Homo sapiens
aguuucuuccau

SEQ ID NO: 1187889 - RNA, 14 nt, Homo sapiens
aguuucuuccauuc

SEQ ID NO: 1187890 - RNA, 16 nt, Homo sapiens
aguuugagaccagccu

SEQ ID NO: 1187891 - RNA, 20 nt, Homo sapiens
aguuuguaaauucuagcuua

SEQ ID NO: 1187892 - RNA, 21 nt, Homo sapiens
aguuugugucaauaaagucau

SEQ ID NO: 1187893 - RNA, 14 nt, Homo sapiens
aguuuguuaugugu

SEQ ID NO: 1187894 - RNA, 23 nt, Homo sapiens
aguuuuccuucucaucugugauu

SEQ ID NO: 1187895 - RNA, 15 nt, Homo sapiens
aguuuugaccuaaca

SEQ ID NO: 1187896 - RNA, 18 nt, Homo sapiens
aguuuugaccuaacauac

SEQ ID NO: 1187897 - RNA, 21 nt, Homo sapiens
aguuuuguaaauguacuggua

SEQ ID NO: 1187898 - RNA, 21 nt, Homo sapiens
aguuuuuauuacaaauuuuca

SEQ ID NO: 1187899 - RNA, 21 nt, Homo sapiens
aguuuuuauucaaagcagcug

SEQ ID NO: 1187900 - RNA, 17 nt, Homo sapiens
auaaaaaacauauacaa

SEQ ID NO: 1187901 - RNA, 12 nt, Homo sapiens
auaaaaacccaa

SEQ ID NO: 1187902 - RNA, 17 nt, Homo sapiens
auaaaaacuuacacucu

SEQ ID NO: 1187903 - RNA, 15 nt, Homo sapiens
auaaaaaguaaaaac

SEQ ID NO: 1187904 - RNA, 20 nt, Homo sapiens
auaaaaauaaaucaguucau

SEQ ID NO: 1187905 - RNA, 14 nt, Homo sapiens
auaaaaaugagugc

SEQ ID NO: 1187906 - RNA, 18 nt, Homo sapiens
auaaaaauuguagcuuuu

SEQ ID NO: 1187907 - RNA, 20 nt, Homo sapiens
auaaaagcuauggugagaug

SEQ ID NO: 1187908 - RNA, 24 nt, Homo sapiens
auaaaaggagcaaucauacugaca

SEQ ID NO: 1187909 - RNA, 15 nt, Homo sapiens
auaaaaugcaaucaa

SEQ ID NO: 1187910 - RNA, 20 nt, Homo sapiens
auaaacacugguuguaguca

SEQ ID NO: 1187911 - RNA, 13 nt, Homo sapiens
auaaacaucacag

SEQ ID NO: 1187912 - RNA, 16 nt, Homo sapiens
auaaaccuggagauau

SEQ ID NO: 1187913 - RNA, 22 nt, Homo sapiens
auaaacugauuuaucuauuuaa

SEQ ID NO: 1187914 - RNA, 15 nt, Homo sapiens
auaaacugcagagag

SEQ ID NO: 1187915 - RNA, 16 nt, Homo sapiens
auaaacuuuccucuuc

SEQ ID NO: 1187916 - RNA, 19 nt, Homo sapiens
aucucgccacugcacucca

SEQ ID NO: 1187917 - RNA, 22 nt, Homo sapiens
aucucggcucacugcaaccucu

SEQ ID NO: 1187918 - RNA, 15 nt, Homo sapiens
aucucggcucagugc

SEQ ID NO: 1187919 - RNA, 18 nt, Homo sapiens
aucucggcucagugcaac

SEQ ID NO: 1187920 - RNA, 19 nt, Homo sapiens
aucucggcucagugcaacc

SEQ ID NO: 1187921 - RNA, 21 nt, Homo sapiens
aucucuaauaaaaauacaaaa

SEQ ID NO: 1187922 - RNA, 18 nt, Homo sapiens
aucucugaauuugagaua

SEQ ID NO: 1187923 - RNA, 16 nt, Homo sapiens
aucucugaggccucag

SEQ ID NO: 1187924 - RNA, 17 nt, Homo sapiens
aucucugaggccucaga

SEQ ID NO: 1187925 - RNA, 19 nt, Homo sapiens
aucucugcagggccgccag

SEQ ID NO: 1187926 - RNA, 13 nt, Homo sapiens
aucucugccauau

SEQ ID NO: 1187927 - RNA, 18 nt, Homo sapiens
aucucugcuuaguucuau

SEQ ID NO: 1187928 - RNA, 20 nt, Homo sapiens
aucucugguuuugcuuuguu

SEQ ID NO: 1187929 - RNA, 20 nt, Homo sapiens
aucucugucagugugaaaau

SEQ ID NO: 1187930 - RNA, 17 nt, Homo sapiens
aucucugugaaaccccu

SEQ ID NO: 1187931 - RNA, 22 nt, Homo sapiens
aucucuucuuugcugcagucau

SEQ ID NO: 1187932 - RNA, 16 nt, Homo sapiens
aucucuugcccuuccu

SEQ ID NO: 1187933 - RNA, 17 nt, Homo sapiens
aucucuugcccuuccua

SEQ ID NO: 1187934 - RNA, 12 nt, Homo sapiens
aucucuuucuac

SEQ ID NO: 1187935 - RNA, 15 nt, Homo sapiens
aucucuuucuacucu

SEQ ID NO: 1187936 - RNA, 16 nt, Homo sapiens
aucucuuugaugucau

SEQ ID NO: 1187937 - RNA, 14 nt, Homo sapiens
aucugaagugguuc

SEQ ID NO: 1187938 - RNA, 15 nt, Homo sapiens
aucugaagugguuca

SEQ ID NO: 1187939 - RNA, 19 nt, Homo sapiens
aucugaagugguucagucu

SEQ ID NO: 1187940 - RNA, 13 nt, Homo sapiens
aucugaccaucug

SEQ ID NO: 1187941 - RNA, 16 nt, Homo sapiens
aucugaccaucuguga

SEQ ID NO: 1187942 - RNA, 13 nt, Homo sapiens
aucugacccagug

SEQ ID NO: 1187943 - RNA, 19 nt, Homo sapiens
aucugagagaugacaggga

SEQ ID NO: 1187944 - RNA, 12 nt, Homo sapiens
aucugagcaaaa

SEQ ID NO: 1187945 - RNA, 18 nt, Homo sapiens
aucugauauuuuaaaaag

SEQ ID NO: 1187946 - RNA, 13 nt, Homo sapiens
aucugaugauaug

SEQ ID NO: 1187947 - RNA, 14 nt, Homo sapiens
aucugcaaacauua

SEQ ID NO: 1187948 - RNA, 16 nt, Homo sapiens
aucugcaccaccaugc

SEQ ID NO: 1187949 - RNA, 21 nt, Homo sapiens
aucugcagggguuugccaaac

SEQ ID NO: 1187950 - RNA, 15 nt, Homo sapiens
aucugcgugacaaua

SEQ ID NO: 1187951 - RNA, 19 nt, Homo sapiens
aucugcuuaccacaucaca

SEQ ID NO: 1187952 - RNA, 17 nt, Homo sapiens
aucugcuuuugguuaua

SEQ ID NO: 1187953 - RNA, 22 nt, Homo sapiens
aucugcuuuugguuauaaugug

SEQ ID NO: 1187954 - RNA, 15 nt, Homo sapiens
aucuggaaccucagc

SEQ ID NO: 1187955 - RNA, 15 nt, Homo sapiens
aucuggaagggccaa

SEQ ID NO: 1187956 - RNA, 19 nt, Homo sapiens
aucuggcagacucauugca

SEQ ID NO: 1187957 - RNA, 22 nt, Homo sapiens
aucuggcuacuuuuucauguau

SEQ ID NO: 1187958 - RNA, 18 nt, Homo sapiens
aucugggaaagacaucca

SEQ ID NO: 1187959 - RNA, 22 nt, Homo sapiens
aucugggcuaccccacccaagu

SEQ ID NO: 1187960 - RNA, 20 nt, Homo sapiens
aucuggguuaauucauuugg

SEQ ID NO: 1187961 - RNA, 19 nt, Homo sapiens
aucuguagcugugcuuuga

SEQ ID NO: 1187962 - RNA, 17 nt, Homo sapiens
aucugucauuaucaaaa

SEQ ID NO: 1187963 - RNA, 14 nt, Homo sapiens
aucuguccacaucc

SEQ ID NO: 1187964 - RNA, 21 nt, Homo sapiens
aucugugggucugggagucac

SEQ ID NO: 1187965 - RNA, 20 nt, Homo sapiens
aucugugugugugugcgugu

SEQ ID NO: 1187966 - RNA, 18 nt, Homo sapiens
aucuguuaaccaaauaaa

SEQ ID NO: 1187967 - RNA, 14 nt, Homo sapiens
aucuguucugggug

SEQ ID NO: 1187968 - RNA, 21 nt, Homo sapiens
aucuuaaaaaucuaugccuaa

SEQ ID NO: 1187969 - RNA, 14 nt, Homo sapiens
aucuuaacacugaa

SEQ ID NO: 1187970 - RNA, 15 nt, Homo sapiens
aucuuacagucagca

SEQ ID NO: 1187971 - RNA, 19 nt, Homo sapiens
aucuuacagucagcacaga

SEQ ID NO: 1187972 - RNA, 12 nt, Homo sapiens
aucuuacuguac

SEQ ID NO: 1187973 - RNA, 19 nt, Homo sapiens
aucuuaguucuguauauaa

SEQ ID NO: 1187974 - RNA, 15 nt, Homo sapiens
aucuuauaguucuag

SEQ ID NO: 1187975 - RNA, 21 nt, Homo sapiens
aucuucaacaugucacacugg

SEQ ID NO: 1187976 - RNA, 16 nt, Homo sapiens
aucuucacagcacauu

SEQ ID NO: 1187977 - RNA, 14 nt, Homo sapiens
aucuucagaccuuu

SEQ ID NO: 1187978 - RNA, 18 nt, Homo sapiens
aucuucagcuugugcaca

SEQ ID NO: 1187979 - RNA, 21 nt, Homo sapiens
aucuucagggaacugcauaga

SEQ ID NO: 1187980 - RNA, 19 nt, Homo sapiens
aucuuccagaagugugauu

SEQ ID NO: 1187981 - RNA, 22 nt, Homo sapiens
aucuucgggaccaggauuugca

SEQ ID NO: 1187982 - RNA, 20 nt, Homo sapiens
aucuucuaaacccaauccaa

SEQ ID NO: 1187983 - RNA, 12 nt, Homo sapiens
aucuucuacuuu

SEQ ID NO: 1187984 - RNA, 16 nt, Homo sapiens
aucuucucaaguucua

SEQ ID NO: 1187985 - RNA, 16 nt, Homo sapiens
aucuucuucaccauuu

SEQ ID NO: 1187986 - RNA, 19 nt, Homo sapiens
aucuuguaaauaaagacau

SEQ ID NO: 1187987 - RNA, 21 nt, Homo sapiens
aucuugugacccuccaugcca

SEQ ID NO: 1187988 - RNA, 23 nt, Homo sapiens
aucuuguuuuuccacuacugcua

SEQ ID NO: 1187989 - RNA, 21 nt, Homo sapiens
aucuuuacaaaacuacaugag

SEQ ID NO: 1187990 - RNA, 19 nt, Homo sapiens
aucuuuccuaggcagauca

SEQ ID NO: 1187991 - RNA, 21 nt, Homo sapiens
aucuuugcugaagcugagcua

SEQ ID NO: 1187992 - RNA, 22 nt, Homo sapiens
aucuuugcuuuauaaaagaaca

SEQ ID NO: 1187993 - RNA, 12 nt, Homo sapiens
aucuuuggacag

SEQ ID NO: 1187994 - RNA, 14 nt, Homo sapiens
aucuuuggacagaa

SEQ ID NO: 1187995 - RNA, 21 nt, Homo sapiens
aucuuuggacagaagcagcuc

SEQ ID NO: 1187996 - RNA, 18 nt, Homo sapiens
aucuuuguggccaaggag

SEQ ID NO: 1187997 - RNA, 19 nt, Homo sapiens
aucuuuguuguucuugaau

SEQ ID NO: 1187998 - RNA, 18 nt, Homo sapiens
aucuuuuaggccaaggaa

SEQ ID NO: 1187999 - RNA, 14 nt, Homo sapiens
aucuuuugugagau

SEQ ID NO: 1188000 - RNA, 24 nt, Homo sapiens
augaaaacacucaaaaugaugcaa

SEQ ID NO: 1188001 - RNA, 19 nt, Homo sapiens
augaaaaggauauuaucua

SEQ ID NO: 1188002 - RNA, 21 nt, Homo sapiens
augaaaauaacugaaccaaau

SEQ ID NO: 1188003 - RNA, 18 nt, Homo sapiens
augaaaauaagcauuugg

SEQ ID NO: 1188004 - RNA, 16 nt, Homo sapiens
augaaaaugaauagcu

SEQ ID NO: 1188005 - RNA, 15 nt, Homo sapiens
augaaacaaacugga

SEQ ID NO: 1188006 - RNA, 22 nt, Homo sapiens
augaaacauuguagguauauau

SEQ ID NO: 1188007 - RNA, 19 nt, Homo sapiens
augaaacccccacacacac

SEQ ID NO: 1188008 - RNA, 16 nt, Homo sapiens
augaaaguggacaagg

SEQ ID NO: 1188009 - RNA, 13 nt, Homo sapiens
augaaaucucagg

SEQ ID NO: 1188010 - RNA, 15 nt, Homo sapiens
augaaauggagucau

SEQ ID NO: 1188011 - RNA, 13 nt, Homo sapiens
augaaauuacuua

SEQ ID NO: 1188012 - RNA, 16 nt, Homo sapiens
augaaauuauuuguca

SEQ ID NO: 1188013 - RNA, 13 nt, Homo sapiens
augaaauuuugcc

SEQ ID NO: 1188014 - RNA, 15 nt, Homo sapiens
augaacccccaugau

SEQ ID NO: 1188015 - RNA, 20 nt, Homo sapiens
augaaccugcccugcuccca

SEQ ID NO: 1188016 - RNA, 19 nt, Homo sapiens
augaacuguauuauugcaa

SEQ ID NO: 1188017 - RNA, 17 nt, Homo sapiens
augaagaugggcuucau

SEQ ID NO: 1188018 - RNA, 20 nt, Homo sapiens
augaagcuaccucaaacuuc

SEQ ID NO: 1188019 - RNA, 21 nt, Homo sapiens
augaaggaaggacuaugacaa

SEQ ID NO: 1188020 - RNA, 19 nt, Homo sapiens
augaagucuuaaggacaaa

SEQ ID NO: 1188021 - RNA, 23 nt, Homo sapiens
augaagugcuacagaaagcacaa

SEQ ID NO: 1188022 - RNA, 18 nt, Homo sapiens
augaauaauccaccccuu

SEQ ID NO: 1188023 - RNA, 21 nt, Homo sapiens
augaauauauuuaagcaacau

SEQ ID NO: 1188024 - RNA, 22 nt, Homo sapiens
augaaucaaucaauucauaucu

SEQ ID NO: 1188025 - RNA, 22 nt, Homo sapiens
augaauccccaauaauugcaga

SEQ ID NO: 1188026 - RNA, 15 nt, Homo sapiens
augaauccuacauac

SEQ ID NO: 1188027 - RNA, 18 nt, Homo sapiens
augaauucaagaaaggaa

SEQ ID NO: 1188028 - RNA, 15 nt, Homo sapiens
augaauuugacuggu

SEQ ID NO: 1188029 - RNA, 18 nt, Homo sapiens
augaauuugacugguuca

SEQ ID NO: 1188030 - RNA, 21 nt, Homo sapiens
augacaagaugggacagcaac

SEQ ID NO: 1188031 - RNA, 17 nt, Homo sapiens
augacaccaucagacau

SEQ ID NO: 1188032 - RNA, 16 nt, Homo sapiens
augacacucuucugaa

SEQ ID NO: 1188033 - RNA, 16 nt, Homo sapiens
augacaguagcauuga

SEQ ID NO: 1188034 - RNA, 21 nt, Homo sapiens
augacaguauuauacgcuggc

SEQ ID NO: 1188035 - RNA, 21 nt, Homo sapiens
augacaugcacucagcucuug

SEQ ID NO: 1188036 - RNA, 15 nt, Homo sapiens
augacauugcuaaga

SEQ ID NO: 1188037 - RNA, 15 nt, Homo sapiens
augaccaugcugaua

SEQ ID NO: 1188038 - RNA, 22 nt, Homo sapiens
augaccucuuugauuugugcug

SEQ ID NO: 1188039 - RNA, 19 nt, Homo sapiens
augaccuugggguacaauu

SEQ ID NO: 1188040 - RNA, 15 nt, Homo sapiens
augacuauauauaca

SEQ ID NO: 1188041 - RNA, 17 nt, Homo sapiens
augacugcaccaacauc

SEQ ID NO: 1188042 - RNA, 22 nt, Homo sapiens
augacuguuuuucggacaguuu

SEQ ID NO: 1188043 - RNA, 21 nt, Homo sapiens
augacuugacuggcugcucuu

SEQ ID NO: 1188044 - RNA, 17 nt, Homo sapiens
augacuuuuuauacuuu

SEQ ID NO: 1188045 - RNA, 17 nt, Homo sapiens
augagaaaggacagagc

SEQ ID NO: 1188046 - RNA, 13 nt, Homo sapiens
augagaaagggag

SEQ ID NO: 1188047 - RNA, 19 nt, Homo sapiens
augagaacugguucuugcc

SEQ ID NO: 1188048 - RNA, 11 nt, Homo sapiens
auuucuuaggg

SEQ ID NO: 1188049 - RNA, 16 nt, Homo sapiens
auuucuuauagucaau

SEQ ID NO: 1188050 - RNA, 23 nt, Homo sapiens
auuucuucccgcacaaauuccac

SEQ ID NO: 1188051 - RNA, 15 nt, Homo sapiens
auuucuucuacugcu

SEQ ID NO: 1188052 - RNA, 16 nt, Homo sapiens
auuucuucuacugcua

SEQ ID NO: 1188053 - RNA, 19 nt, Homo sapiens
auuucuuuaaaugcuuuua

SEQ ID NO: 1188054 - RNA, 12 nt, Homo sapiens
auuucuuucauc

SEQ ID NO: 1188055 - RNA, 15 nt, Homo sapiens
auuucuuugauuuaa

SEQ ID NO: 1188056 - RNA, 22 nt, Homo sapiens
auuucuuugauuuaacugacuu

SEQ ID NO: 1188057 - RNA, 18 nt, Homo sapiens
auuugaaaugaauuccuc

SEQ ID NO: 1188058 - RNA, 15 nt, Homo sapiens
auuugaguugugauu

SEQ ID NO: 1188059 - RNA, 20 nt, Homo sapiens
auuugaugaaggugaauauu

SEQ ID NO: 1188060 - RNA, 17 nt, Homo sapiens
auuugcaaaguacugua

SEQ ID NO: 1188061 - RNA, 21 nt, Homo sapiens
auuugcaagggaaaagucucu

SEQ ID NO: 1188062 - RNA, 24 nt, Homo sapiens
auuugcacaaacuugugagcauca

SEQ ID NO: 1188063 - RNA, 17 nt, Homo sapiens
auuugcuuuaucuacuu

SEQ ID NO: 1188064 - RNA, 17 nt, Homo sapiens
auuuggacuugcugaau

SEQ ID NO: 1188065 - RNA, 19 nt, Homo sapiens
auuuggaucuauuuauuag

SEQ ID NO: 1188066 - RNA, 13 nt, Homo sapiens
auuuggcugcacu

SEQ ID NO: 1188067 - RNA, 17 nt, Homo sapiens
auuugggccugcuccag

SEQ ID NO: 1188068 - RNA, 20 nt, Homo sapiens
auuuggguucugccugccag

SEQ ID NO: 1188069 - RNA, 12 nt, Homo sapiens
auuugguguaca

SEQ ID NO: 1188070 - RNA, 17 nt, Homo sapiens
auuuguaaagcuauuua

SEQ ID NO: 1188071 - RNA, 20 nt, Homo sapiens
auuuguaccuuauugaucuu

SEQ ID NO: 1188072 - RNA, 17 nt, Homo sapiens
auuuguauuuugugaug

SEQ ID NO: 1188073 - RNA, 16 nt, Homo sapiens
auuuguccaaacaggu

SEQ ID NO: 1188074 - RNA, 20 nt, Homo sapiens
auuugucccuaugcauauca

SEQ ID NO: 1188075 - RNA, 17 nt, Homo sapiens
auuugugauauauguau

SEQ ID NO: 1188076 - RNA, 18 nt, Homo sapiens
auuugugccgacacuguu

SEQ ID NO: 1188077 - RNA, 20 nt, Homo sapiens
auuugugcuagaaauuuuca

SEQ ID NO: 1188078 - RNA, 20 nt, Homo sapiens
auuugugguccacugagcua

SEQ ID NO: 1188079 - RNA, 20 nt, Homo sapiens
auuuguugcugcugcugcuc

SEQ ID NO: 1188080 - RNA, 20 nt, Homo sapiens
auuuguuuugagaguucuuc

SEQ ID NO: 1188081 - RNA, 20 nt, Homo sapiens
auuuuaagccaguuuuacac

SEQ ID NO: 1188082 - RNA, 20 nt, Homo sapiens
auuuuaaguguucucgggga

SEQ ID NO: 1188083 - RNA, 23 nt, Homo sapiens
auuuuacuaaaauggcagcuuaa

SEQ ID NO: 1188084 - RNA, 22 nt, Homo sapiens
auuuuacuacuucucucuguau

SEQ ID NO: 1188085 - RNA, 21 nt, Homo sapiens
auuuuacuuuuuccuggcuca

SEQ ID NO: 1188086 - RNA, 18 nt, Homo sapiens
auuuuagcagagacuuua

SEQ ID NO: 1188087 - RNA, 18 nt, Homo sapiens
auuuuagugaacuugaaa

SEQ ID NO: 1188088 - RNA, 14 nt, Homo sapiens
auuuuauagcuacu

SEQ ID NO: 1188089 - RNA, 21 nt, Homo sapiens
auuuuaucaaacacacuucca

SEQ ID NO: 1188090 - RNA, 14 nt, Homo sapiens
auuuuaugauagau

SEQ ID NO: 1188091 - RNA, 15 nt, Homo sapiens
auuuuauuacuaaua

SEQ ID NO: 1188092 - RNA, 20 nt, Homo sapiens
auuuuauuacuaauagcuug

SEQ ID NO: 1188093 - RNA, 17 nt, Homo sapiens
auuuuauuggggggcaa

SEQ ID NO: 1188094 - RNA, 23 nt, Homo sapiens
auuuuauuguauaaaaaguuuca

SEQ ID NO: 1188095 - RNA, 18 nt, Homo sapiens
auuuucaagucuguguuc

SEQ ID NO: 1188096 - RNA, 16 nt, Homo sapiens
auuuucagcaucaaac

SEQ ID NO: 1188097 - RNA, 14 nt, Homo sapiens
auuuucagcauuaa

SEQ ID NO: 1188098 - RNA, 14 nt, Homo sapiens
auuuucaguuauua

SEQ ID NO: 1188099 - RNA, 15 nt, Homo sapiens
auuuucauucauuca

SEQ ID NO: 1188100 - RNA, 18 nt, Homo sapiens
auuuuccugcuucaucuu

SEQ ID NO: 1188101 - RNA, 15 nt, Homo sapiens
auuuucggaacacau

SEQ ID NO: 1188102 - RNA, 19 nt, Homo sapiens
auuuucugcccaacuuuca

SEQ ID NO: 1188103 - RNA, 20 nt, Homo sapiens
auuuucuucucugcacuuau

SEQ ID NO: 1188104 - RNA, 19 nt, Homo sapiens
auuuugaaaacugugcaau

SEQ ID NO: 1188105 - RNA, 23 nt, Homo sapiens
auuuugaaaugaaacaagcuuac

SEQ ID NO: 1188106 - RNA, 17 nt, Homo sapiens
auuuugaaaugaacuuu

SEQ ID NO: 1188107 - RNA, 14 nt, Homo sapiens
auuuugacgucacu

SEQ ID NO: 1188108 - RNA, 22 nt, Homo sapiens
auuuugcccuugacaaagucaa

SEQ ID NO: 1188109 - RNA, 21 nt, Homo sapiens
auuuugggguuguguugucac

SEQ ID NO: 1188110 - RNA, 21 nt, Homo sapiens
auuuuguagaauaaggaacaa

SEQ ID NO: 1188111 - RNA, 20 nt, Homo sapiens
auuuugucaccagaacacaa

SEQ ID NO: 1188112 - RNA, 17 nt, Homo sapiens
auuuuguggcauuugaa

SEQ ID NO: 1188113 - RNA, 19 nt, Homo sapiens
auuuuuaaaagacuuugau

SEQ ID NO: 1188114 - RNA, 16 nt, Homo sapiens
auuuuuagagcauuaa

SEQ ID NO: 1188115 - RNA, 17 nt, Homo sapiens
auuuuuagagcauuaaa

SEQ ID NO: 1188116 - RNA, 22 nt, Homo sapiens
auuuuuauucaaacuaccuaua

SEQ ID NO: 1188117 - RNA, 19 nt, Homo sapiens
auuuuuccucucugcaaau

SEQ ID NO: 1188118 - RNA, 15 nt, Homo sapiens
auuuuugaaggcaua

SEQ ID NO: 1188119 - RNA, 18 nt, Homo sapiens
auuuuugcacauucuaca

SEQ ID NO: 1188120 - RNA, 12 nt, Homo sapiens
auuuuugcccag

SEQ ID NO: 1188121 - RNA, 21 nt, Homo sapiens
auuuuugguaguuucuggguc

SEQ ID NO: 1188122 - RNA, 16 nt, Homo sapiens
auuuuuugagucuguu

SEQ ID NO: 1188123 - RNA, 18 nt, Homo sapiens
auuuuuugagucuguucu

SEQ ID NO: 1188124 - RNA, 13 nt, Homo sapiens
auuuuuugcccag

SEQ ID NO: 1188125 - RNA, 23 nt, Homo sapiens
auuuuuugcccagagaguccagc

SEQ ID NO: 1188126 - RNA, 16 nt, Homo sapiens
auuuuuuucuacauaa

SEQ ID NO: 1188127 - RNA, 16 nt, Homo sapiens
caaaaaaaucauauaa

SEQ ID NO: 1188128 - RNA, 21 nt, Homo sapiens
caaaaaaauuaaaauggaugc

SEQ ID NO: 1188129 - RNA, 20 nt, Homo sapiens
caaaaaaguccaauuuuaau

SEQ ID NO: 1188130 - RNA, 14 nt, Homo sapiens
caaaaacuacacau

SEQ ID NO: 1188131 - RNA, 19 nt, Homo sapiens
caaaaagagcagcacagga

SEQ ID NO: 1188132 - RNA, 22 nt, Homo sapiens
caaaaaugggaaaccaguucau

SEQ ID NO: 1188133 - RNA, 15 nt, Homo sapiens
caaaaauuacaaaga

SEQ ID NO: 1188134 - RNA, 22 nt, Homo sapiens
caaaaauuacaaagaaccaugc

SEQ ID NO: 1188135 - RNA, 19 nt, Homo sapiens
caaaaauuuuuuaaauuca

SEQ ID NO: 1188136 - RNA, 17 nt, Homo sapiens
caaaacaaguuggaugc

SEQ ID NO: 1188137 - RNA, 18 nt, Homo sapiens
caaaacagauuguuugca

SEQ ID NO: 1188138 - RNA, 19 nt, Homo sapiens
caaaacauuaaauguccau

SEQ ID NO: 1188139 - RNA, 14 nt, Homo sapiens
caaaacauugugcc

SEQ ID NO: 1188140 - RNA, 21 nt, Homo sapiens
caaaacauugugccaugucaa

SEQ ID NO: 1188141 - RNA, 13 nt, Homo sapiens
caaaacauuucau

SEQ ID NO: 1188142 - RNA, 16 nt, Homo sapiens
caaaaccccacuacac

SEQ ID NO: 1188143 - RNA, 20 nt, Homo sapiens
caaaacugauacccuuugaa

SEQ ID NO: 1188144 - RNA, 12 nt, Homo sapiens
caaaacugccuc

SEQ ID NO: 1188145 - RNA, 13 nt, Homo sapiens
caaaacugccuca

SEQ ID NO: 1188146 - RNA, 13 nt, Homo sapiens
caaaacuguacug

SEQ ID NO: 1188147 - RNA, 21 nt, Homo sapiens
caaaagacgagugaugccauu

SEQ ID NO: 1188148 - RNA, 21 nt, Homo sapiens
caaaagcuuuuugauguauaa

SEQ ID NO: 1188149 - RNA, 18 nt, Homo sapiens
caaaaggaagacuggaga

SEQ ID NO: 1188150 - RNA, 22 nt, Homo sapiens
caaaaggccuuuggaaagacuu

SEQ ID NO: 1188151 - RNA, 20 nt, Homo sapiens
caaaaguggggcuaaaugaa

SEQ ID NO: 1188152 - RNA, 17 nt, Homo sapiens
caaaaguguaccuguaa

SEQ ID NO: 1188153 - RNA, 14 nt, Homo sapiens
caaaaguuacaugu

SEQ ID NO: 1188154 - RNA, 20 nt, Homo sapiens
caaaauaaaaaccaagaaga

SEQ ID NO: 1188155 - RNA, 16 nt, Homo sapiens
caaaauaaacuccccu

SEQ ID NO: 1188156 - RNA, 19 nt, Homo sapiens
caaaauaaagcuguucuca

SEQ ID NO: 1188157 - RNA, 23 nt, Homo sapiens
caaaauccuuacuuccagcaaaa

SEQ ID NO: 1188158 - RNA, 17 nt, Homo sapiens
caaaaucugucacuaca

SEQ ID NO: 1188159 - RNA, 18 nt, Homo sapiens
caaaaugauacuuacuga

SEQ ID NO: 1188160 - RNA, 16 nt, Homo sapiens
caaaaugcucuugucc

SEQ ID NO: 1188161 - RNA, 23 nt, Homo sapiens
caaaaugggagaaaacgccagug

SEQ ID NO: 1188162 - RNA, 17 nt, Homo sapiens
caaaaugucuuguguau

SEQ ID NO: 1188163 - RNA, 19 nt, Homo sapiens
caaaauugcugcaccaaug

SEQ ID NO: 1188164 - RNA, 17 nt, Homo sapiens
caaaauuuguacuauua

SEQ ID NO: 1188165 - RNA, 14 nt, Homo sapiens
caaacaaaauggac

SEQ ID NO: 1188166 - RNA, 18 nt, Homo sapiens
caaacaaccuucagcuuu

SEQ ID NO: 1188167 - RNA, 15 nt, Homo sapiens
caaacaccuuauuug

SEQ ID NO: 1188168 - RNA, 17 nt, Homo sapiens
caaacagcccaaacugu

SEQ ID NO: 1188169 - RNA, 21 nt, Homo sapiens
caaacaggaaguggacauucu

SEQ ID NO: 1188170 - RNA, 15 nt, Homo sapiens
caaacaugaagugug

SEQ ID NO: 1188171 - RNA, 13 nt, Homo sapiens
caaacaugcaaga

SEQ ID NO: 1188172 - RNA, 21 nt, Homo sapiens
caaacauggguuuaguuuuca

SEQ ID NO: 1188173 - RNA, 11 nt, Homo sapiens
caaacaugugc

SEQ ID NO: 1188174 - RNA, 20 nt, Homo sapiens
caaacauguuccugggauca

SEQ ID NO: 1188175 - RNA, 14 nt, Homo sapiens
caaacccuuucaua

SEQ ID NO: 1188176 - RNA, 14 nt, Homo sapiens
caaaccuccacugc

SEQ ID NO: 1188177 - RNA, 20 nt, Homo sapiens
caaaccugccucccauucua

SEQ ID NO: 1188178 - RNA, 15 nt, Homo sapiens
caaacuccugaccuc

SEQ ID NO: 1188179 - RNA, 19 nt, Homo sapiens
ccagauucaugcacuguag

SEQ ID NO: 1188180 - RNA, 15 nt, Homo sapiens
ccagauugugccacu

SEQ ID NO: 1188181 - RNA, 14 nt, Homo sapiens
ccagcaacuugaac

SEQ ID NO: 1188182 - RNA, 13 nt, Homo sapiens
ccagcaagcaaac

SEQ ID NO: 1188183 - RNA, 14 nt, Homo sapiens
ccagcaagucccag

SEQ ID NO: 1188184 - RNA, 14 nt, Homo sapiens
ccagcacacagggc

SEQ ID NO: 1188185 - RNA, 12 nt, Homo sapiens
ccagcaccacac

SEQ ID NO: 1188186 - RNA, 15 nt, Homo sapiens
ccagcaccaccaggu

SEQ ID NO: 1188187 - RNA, 22 nt, Homo sapiens
ccagcaccggccccauuuaccc

SEQ ID NO: 1188188 - RNA, 13 nt, Homo sapiens
ccagcacuaccaa

SEQ ID NO: 1188189 - RNA, 17 nt, Homo sapiens
ccagcacucacaccacu

SEQ ID NO: 1188190 - RNA, 10 nt, Homo sapiens
ccagcacuuu

SEQ ID NO: 1188191 - RNA, 12 nt, Homo sapiens
ccagcacuuugg

SEQ ID NO: 1188192 - RNA, 18 nt, Homo sapiens
ccagcacuuugggagacc

SEQ ID NO: 1188193 - RNA, 13 nt, Homo sapiens
ccagcagaagcca

SEQ ID NO: 1188194 - RNA, 21 nt, Homo sapiens
ccagcagccugccagcaguua

SEQ ID NO: 1188195 - RNA, 19 nt, Homo sapiens
ccagcagggaaaaugcagc

SEQ ID NO: 1188196 - RNA, 18 nt, Homo sapiens
ccagcauauauaguauuu

SEQ ID NO: 1188197 - RNA, 21 nt, Homo sapiens
ccagcauucucaggcaccagu

SEQ ID NO: 1188198 - RNA, 10 nt, Homo sapiens
ccagccacag

SEQ ID NO: 1188199 - RNA, 17 nt, Homo sapiens
ccagccaugucugcauu

SEQ ID NO: 1188200 - RNA, 20 nt, Homo sapiens
ccagcccagaaagucucuca

SEQ ID NO: 1188201 - RNA, 23 nt, Homo sapiens
ccagcccuacagggacugggcaa

SEQ ID NO: 1188202 - RNA, 22 nt, Homo sapiens
ccagcccuccccaucucggggc

SEQ ID NO: 1188203 - RNA, 19 nt, Homo sapiens
ccagccgcucuccugccac

SEQ ID NO: 1188204 - RNA, 19 nt, Homo sapiens
ccagccuaaaaaccaccau

SEQ ID NO: 1188205 - RNA, 17 nt, Homo sapiens
ccagccugggcaacaaa

SEQ ID NO: 1188206 - RNA, 16 nt, Homo sapiens
ccagcgagcucucaaa

SEQ ID NO: 1188207 - RNA, 16 nt, Homo sapiens
ccagcggccucagggu

SEQ ID NO: 1188208 - RNA, 16 nt, Homo sapiens
ccagcuacaccuuucu

SEQ ID NO: 1188209 - RNA, 23 nt, Homo sapiens
ccagcucaggacagaugccacac

SEQ ID NO: 1188210 - RNA, 21 nt, Homo sapiens
ccagcuccaaccugcaaagau

SEQ ID NO: 1188211 - RNA, 17 nt, Homo sapiens
ccagcuccgaccucucu

SEQ ID NO: 1188212 - RNA, 18 nt, Homo sapiens
ccagcuccucacucaccu

SEQ ID NO: 1188213 - RNA, 13 nt, Homo sapiens
ccagcugcacuga

SEQ ID NO: 1188214 - RNA, 16 nt, Homo sapiens
ccagcugccaaggaaa

SEQ ID NO: 1188215 - RNA, 15 nt, Homo sapiens
ccagcuuuacugugg

SEQ ID NO: 1188216 - RNA, 23 nt, Homo sapiens
ccagcuuuuguagauggcacuuu

SEQ ID NO: 1188217 - RNA, 21 nt, Homo sapiens
ccaggaaaaaauaaaaggggg

SEQ ID NO: 1188218 - RNA, 23 nt, Homo sapiens
ccaggaaacaaggggucugagga

SEQ ID NO: 1188219 - RNA, 20 nt, Homo sapiens
ccaggaaacaugaagcauaa

SEQ ID NO: 1188220 - RNA, 17 nt, Homo sapiens
ccaggaaagaagaguug

SEQ ID NO: 1188221 - RNA, 17 nt, Homo sapiens
ccaggaagaauggugug

SEQ ID NO: 1188222 - RNA, 23 nt, Homo sapiens
ccaggaagcuuuggugagaaccu

SEQ ID NO: 1188223 - RNA, 13 nt, Homo sapiens
ccaggacagggaa

SEQ ID NO: 1188224 - RNA, 15 nt, Homo sapiens
ccaggaccucuuaag

SEQ ID NO: 1188225 - RNA, 17 nt, Homo sapiens
ccaggacuccuccccac

SEQ ID NO: 1188226 - RNA, 21 nt, Homo sapiens
ccaggaggaggauugugcuga

SEQ ID NO: 1188227 - RNA, 22 nt, Homo sapiens
ccaggaggcccugguccuggcc

SEQ ID NO: 1188228 - RNA, 22 nt, Homo sapiens
ccaggaggggaacacugcccuc

SEQ ID NO: 1188229 - RNA, 23 nt, Homo sapiens
ccaggaguacaccccaacagcac

SEQ ID NO: 1188230 - RNA, 22 nt, Homo sapiens
ccaggauauccucccuccagau

SEQ ID NO: 1188231 - RNA, 16 nt, Homo sapiens
ccaggaucugcuccaa

SEQ ID NO: 1188232 - RNA, 16 nt, Homo sapiens
ccaggauugugcaaua

SEQ ID NO: 1188233 - RNA, 13 nt, Homo sapiens
ccaggcauggugg

SEQ ID NO: 1188234 - RNA, 18 nt, Homo sapiens
ccaggccaacaguagcca

SEQ ID NO: 1188235 - RNA, 18 nt, Homo sapiens
ccaggcccacucaggggu

SEQ ID NO: 1188236 - RNA, 15 nt, Homo sapiens
ccaggccccaggaag

SEQ ID NO: 1188237 - RNA, 19 nt, Homo sapiens
ccaggcccgucuguccauc

SEQ ID NO: 1188238 - RNA, 14 nt, Homo sapiens
ccaggccuccagcu

SEQ ID NO: 1188239 - RNA, 18 nt, Homo sapiens
ccaggcuagagugcaaug

SEQ ID NO: 1188240 - RNA, 19 nt, Homo sapiens
ccaggcuagagugcaaugg

SEQ ID NO: 1188241 - RNA, 17 nt, Homo sapiens
ccaggcugcggugggca

SEQ ID NO: 1188242 - RNA, 17 nt, Homo sapiens
ccaggcuggaguacagu

SEQ ID NO: 1188243 - RNA, 17 nt, Homo sapiens
ccaggcuggagugcaau

SEQ ID NO: 1188244 - RNA, 20 nt, Homo sapiens
ccaggcuggagugcaaugac

SEQ ID NO: 1188245 - RNA, 20 nt, Homo sapiens
ccaggcuggagugcaauggc

SEQ ID NO: 1188246 - RNA, 15 nt, Homo sapiens
ccaggcugggcucag

SEQ ID NO: 1188247 - RNA, 14 nt, Homo sapiens
ccagggacccaaag

SEQ ID NO: 1188248 - RNA, 18 nt, Homo sapiens
ccagggagggugagcugg

SEQ ID NO: 1188249 - RNA, 18 nt, Homo sapiens
ccagggccgucaaggaaa

SEQ ID NO: 1188250 - RNA, 18 nt, Homo sapiens
ccagggcucuaauguguc

SEQ ID NO: 1188251 - RNA, 13 nt, Homo sapiens
ccagggcugccag

SEQ ID NO: 1188252 - RNA, 21 nt, Homo sapiens
ccagggggcugaaacuugaac

SEQ ID NO: 1188253 - RNA, 22 nt, Homo sapiens
ccaggguagagcaaaggagaca

SEQ ID NO: 1188254 - RNA, 20 nt, Homo sapiens
ccaggguauucuuuuuccau

SEQ ID NO: 1188255 - RNA, 13 nt, Homo sapiens
ccaggguggagug

SEQ ID NO: 1188256 - RNA, 23 nt, Homo sapiens
ccaggguggagugcaguggugcg

SEQ ID NO: 1188257 - RNA, 18 nt, Homo sapiens
ccagguaauggcaugaga

SEQ ID NO: 1188258 - RNA, 23 nt, Homo sapiens
ccagguagcugggauuacaggca

SEQ ID NO: 1188259 - RNA, 21 nt, Homo sapiens
ccaggucucccgggaagccac

SEQ ID NO: 1188260 - RNA, 17 nt, Homo sapiens
ccaggugugguggcuca

SEQ ID NO: 1188261 - RNA, 17 nt, Homo sapiens
ccagguuuaaacaucac

SEQ ID NO: 1188262 - RNA, 20 nt, Homo sapiens
ccaguaccugaaagcacugu

SEQ ID NO: 1188263 - RNA, 21 nt, Homo sapiens
ccaguauaaagggacuugaag

SEQ ID NO: 1188264 - RNA, 23 nt, Homo sapiens
ccaguauuacugcugcugugcuu

SEQ ID NO: 1188265 - RNA, 16 nt, Homo sapiens
ccaguccaugcuccag

SEQ ID NO: 1188266 - RNA, 16 nt, Homo sapiens
ccagucucugcuccac

SEQ ID NO: 1188267 - RNA, 20 nt, Homo sapiens
ccagugaagacgucaggggc

SEQ ID NO: 1188268 - RNA, 17 nt, Homo sapiens
ccagugcagacucaaga

SEQ ID NO: 1188269 - RNA, 11 nt, Homo sapiens
ccagugcaguc

SEQ ID NO: 1188270 - RNA, 16 nt, Homo sapiens
ccagugcaguccauuu

SEQ ID NO: 1188271 - RNA, 16 nt, Homo sapiens
ccagugccuacagggc

SEQ ID NO: 1188272 - RNA, 11 nt, Homo sapiens
ccagugccuuc

SEQ ID NO: 1188273 - RNA, 9 nt, Homo sapiens
ccaguggga

SEQ ID NO: 1188274 - RNA, 24 nt, Homo sapiens
ccaguguaauaauaaaucguccuc

SEQ ID NO: 1188275 - RNA, 15 nt, Homo sapiens
ccaguucacccugau

SEQ ID NO: 1188276 - RNA, 15 nt, Homo sapiens
ccaguuugugcucua

SEQ ID NO: 1188277 - RNA, 16 nt, Homo sapiens
ccaguuuugcugcuau

SEQ ID NO: 1188278 - RNA, 14 nt, Homo sapiens
ccauaacuuuauga

SEQ ID NO: 1188279 - RNA, 13 nt, Homo sapiens
ccauaaucacuca

SEQ ID NO: 1188280 - RNA, 17 nt, Homo sapiens
ccauaauguuccuuagu

SEQ ID NO: 1188281 - RNA, 14 nt, Homo sapiens
ccauacaccagcaa

SEQ ID NO: 1188282 - RNA, 21 nt, Homo sapiens
ccauacacccccucuucugag

SEQ ID NO: 1188283 - RNA, 19 nt, Homo sapiens
ccauacuuugucugaaaaa

SEQ ID NO: 1188284 - RNA, 23 nt, Homo sapiens
ccauagcugggaaacguggguuc

SEQ ID NO: 1188285 - RNA, 18 nt, Homo sapiens
ccauaggacuguggcaaa

SEQ ID NO: 1188286 - RNA, 20 nt, Homo sapiens
ccauagucaaauuuguaaau

SEQ ID NO: 1188287 - RNA, 15 nt, Homo sapiens
ccauauagacaccaa

SEQ ID NO: 1188288 - RNA, 19 nt, Homo sapiens
ccauauucccacagcacua

SEQ ID NO: 1188289 - RNA, 16 nt, Homo sapiens
ccauauuuaacaugua

SEQ ID NO: 1188290 - RNA, 14 nt, Homo sapiens
ccaucacugagcau

SEQ ID NO: 1188291 - RNA, 17 nt, Homo sapiens
ccaucacugguugcacu

SEQ ID NO: 1188292 - RNA, 24 nt, Homo sapiens
ccaucagacugaacuuacacugua

SEQ ID NO: 1188293 - RNA, 17 nt, Homo sapiens
ccaucagcacaaagaca

SEQ ID NO: 1188294 - RNA, 20 nt, Homo sapiens
ccauccaaagaauuaugcau

SEQ ID NO: 1188295 - RNA, 12 nt, Homo sapiens
ccaucccaaagc

SEQ ID NO: 1188296 - RNA, 17 nt, Homo sapiens
ccauccucccaaucuca

SEQ ID NO: 1188297 - RNA, 21 nt, Homo sapiens
ccauccucccaaucucaauac

SEQ ID NO: 1188298 - RNA, 20 nt, Homo sapiens
ccaucguuuucuucacuguc

SEQ ID NO: 1188299 - RNA, 11 nt, Homo sapiens
ccaucuacccc

SEQ ID NO: 1188300 - RNA, 13 nt, Homo sapiens
ccaucuacucuuu

SEQ ID NO: 1188301 - RNA, 16 nt, Homo sapiens
ccaucuccuaucuuuu

SEQ ID NO: 1188302 - RNA, 13 nt, Homo sapiens
ccaucugugguuu

SEQ ID NO: 1188303 - RNA, 19 nt, Homo sapiens
ccaucuguuuuggcaagac

SEQ ID NO: 1188304 - RNA, 20 nt, Homo sapiens
ccaucuucagaccuuuggac

SEQ ID NO: 1188305 - RNA, 22 nt, Homo sapiens
ccaucuucuaaacccaauccaa

SEQ ID NO: 1188306 - RNA, 21 nt, Homo sapiens
ccaucuuguaaaggauauuaa

SEQ ID NO: 1188307 - RNA, 15 nt, Homo sapiens
ccaucuuuugugaga

SEQ ID NO: 1188308 - RNA, 16 nt, Homo sapiens
ccaugaaaccagagac

SEQ ID NO: 1188309 - RNA, 12 nt, Homo sapiens
ccaugacauuuu

SEQ ID NO: 1188310 - RNA, 22 nt, Homo sapiens
ccaugauggcaacagaucugga

SEQ ID NO: 1188311 - RNA, 16 nt, Homo sapiens
ccuucagacacccuca

SEQ ID NO: 1188312 - RNA, 18 nt, Homo sapiens
ccuucagucuuaauacuu

SEQ ID NO: 1188313 - RNA, 22 nt, Homo sapiens
ccuucaugaucaucacaaucau

SEQ ID NO: 1188314 - RNA, 17 nt, Homo sapiens
ccuuccaagcuguguua

SEQ ID NO: 1188315 - RNA, 16 nt, Homo sapiens
ccuuccacgucuuccu

SEQ ID NO: 1188316 - RNA, 21 nt, Homo sapiens
ccuuccauagccuaaucccug

SEQ ID NO: 1188317 - RNA, 20 nt, Homo sapiens
ccuuccccacuucugugcca

SEQ ID NO: 1188318 - RNA, 20 nt, Homo sapiens
ccuuccccagacuugcacug

SEQ ID NO: 1188319 - RNA, 13 nt, Homo sapiens
ccuucuaggcaaa

SEQ ID NO: 1188320 - RNA, 16 nt, Homo sapiens
ccuucuaguuaccaca

SEQ ID NO: 1188321 - RNA, 14 nt, Homo sapiens
ccuucucaccagcu

SEQ ID NO: 1188322 - RNA, 16 nt, Homo sapiens
ccuucucugaaaacaa

SEQ ID NO: 1188323 - RNA, 23 nt, Homo sapiens
ccuucuuaggucgccauucccuu

SEQ ID NO: 1188324 - RNA, 23 nt, Homo sapiens
ccuucuuuugggggucaacaguu

SEQ ID NO: 1188325 - RNA, 23 nt, Homo sapiens
ccuugacugaagcgaacaucuuc

SEQ ID NO: 1188326 - RNA, 20 nt, Homo sapiens
ccuugcagaaccagugacaa

SEQ ID NO: 1188327 - RNA, 16 nt, Homo sapiens
ccuugcccccauuuca

SEQ ID NO: 1188328 - RNA, 21 nt, Homo sapiens
ccuugcuucuuggacuucuug

SEQ ID NO: 1188329 - RNA, 15 nt, Homo sapiens
ccuuggauuacuuug

SEQ ID NO: 1188330 - RNA, 17 nt, Homo sapiens
ccuuggcaccagacacc

SEQ ID NO: 1188331 - RNA, 22 nt, Homo sapiens
ccuuggccaagcugcugcuuug

SEQ ID NO: 1188332 - RNA, 23 nt, Homo sapiens
ccuuggccaagcugcugcuuuga

SEQ ID NO: 1188333 - RNA, 23 nt, Homo sapiens
ccuuggccucucuguacacugcc

SEQ ID NO: 1188334 - RNA, 22 nt, Homo sapiens
ccuugggcagggucucugcucc

SEQ ID NO: 1188335 - RNA, 22 nt, Homo sapiens
ccuugggcucucaccacuucag

SEQ ID NO: 1188336 - RNA, 23 nt, Homo sapiens
ccuuggggcaugacccagugaag

SEQ ID NO: 1188337 - RNA, 21 nt, Homo sapiens
ccuugguaggggacuaauuca

SEQ ID NO: 1188338 - RNA, 14 nt, Homo sapiens
ccuuguaaaagaca

SEQ ID NO: 1188339 - RNA, 23 nt, Homo sapiens
ccuuguaucuauuuguggugaau

SEQ ID NO: 1188340 - RNA, 14 nt, Homo sapiens
ccuuguccccauga

SEQ ID NO: 1188341 - RNA, 19 nt, Homo sapiens
ccuuguguguuuugagagu

SEQ ID NO: 1188342 - RNA, 13 nt, Homo sapiens
ccuuguguuccuu

SEQ ID NO: 1188343 - RNA, 13 nt, Homo sapiens
ccuuguuaaucca

SEQ ID NO: 1188344 - RNA, 16 nt, Homo sapiens
ccuuguuacccaugaa

SEQ ID NO: 1188345 - RNA, 23 nt, Homo sapiens
ccuuguuauuucucagacuuugg

SEQ ID NO: 1188346 - RNA, 13 nt, Homo sapiens
ccuuguuucucaa

SEQ ID NO: 1188347 - RNA, 15 nt, Homo sapiens
ccuuguuuguacugu

SEQ ID NO: 1188348 - RNA, 18 nt, Homo sapiens
ccuuguuuguacuguaug

SEQ ID NO: 1188349 - RNA, 13 nt, Homo sapiens
ccuuguuuugcca

SEQ ID NO: 1188350 - RNA, 20 nt, Homo sapiens
ccuuuaaagugaguacuguu

SEQ ID NO: 1188351 - RNA, 18 nt, Homo sapiens
ccuuuaagccugcauucu

SEQ ID NO: 1188352 - RNA, 19 nt, Homo sapiens
ccuuuagaguuccaugaac

SEQ ID NO: 1188353 - RNA, 17 nt, Homo sapiens
ccuuuaguaccugaaaa

SEQ ID NO: 1188354 - RNA, 19 nt, Homo sapiens
ccuuuauguggaaaacaga

SEQ ID NO: 1188355 - RNA, 14 nt, Homo sapiens
ccuuucagucccaa

SEQ ID NO: 1188356 - RNA, 17 nt, Homo sapiens
ccuuucaugucuuucca

SEQ ID NO: 1188357 - RNA, 17 nt, Homo sapiens
ccuuuccuuaugucucc

SEQ ID NO: 1188358 - RNA, 21 nt, Homo sapiens
ccuuugaaguagacucauucu

SEQ ID NO: 1188359 - RNA, 17 nt, Homo sapiens
ccuuugauuuuugccca

SEQ ID NO: 1188360 - RNA, 21 nt, Homo sapiens
ccuuugauuuuugcccagaaa

SEQ ID NO: 1188361 - RNA, 15 nt, Homo sapiens
ccuuugcuacuacua

SEQ ID NO: 1188362 - RNA, 19 nt, Homo sapiens
ccuuuguauauuauuucua

SEQ ID NO: 1188363 - RNA, 13 nt, Homo sapiens
ccuuuguucucuc

SEQ ID NO: 1188364 - RNA, 23 nt, Homo sapiens
ccuuuguuuuuacgucauuacaa

SEQ ID NO: 1188365 - RNA, 20 nt, Homo sapiens
ccuuuuauuaagaguuugua

SEQ ID NO: 1188366 - RNA, 20 nt, Homo sapiens
ccuuuucucuggacacuggg

SEQ ID NO: 1188367 - RNA, 16 nt, Homo sapiens
ccuuuugccaaucuca

SEQ ID NO: 1188368 - RNA, 19 nt, Homo sapiens
ccuuuuggccuccugcaaa

SEQ ID NO: 1188369 - RNA, 13 nt, Homo sapiens
ccuuuuuaaggaa

SEQ ID NO: 1188370 - RNA, 18 nt, Homo sapiens
ccuuuuucaacuuggaaa

SEQ ID NO: 1188371 - RNA, 17 nt, Homo sapiens
ccuuuuuuauuccauaa

SEQ ID NO: 1188372 - RNA, 14 nt, Homo sapiens
cgaaaaccaucaca

SEQ ID NO: 1188373 - RNA, 20 nt, Homo sapiens
cgaaacuccauugagucauu

SEQ ID NO: 1188374 - RNA, 22 nt, Homo sapiens
cgaacaaccuuuucucuggaca

SEQ ID NO: 1188375 - RNA, 16 nt, Homo sapiens
cgaacaauucauauau

SEQ ID NO: 1188376 - RNA, 21 nt, Homo sapiens
cgaacuagagaugugcaauug

SEQ ID NO: 1188377 - RNA, 19 nt, Homo sapiens
cgaagaaggaccagugaag

SEQ ID NO: 1188378 - RNA, 17 nt, Homo sapiens
cgaaucuacuaauucca

SEQ ID NO: 1188379 - RNA, 24 nt, Homo sapiens
cgacauggcuccggccucugccuu

SEQ ID NO: 1188380 - RNA, 19 nt, Homo sapiens
cgacucccccaaccaagga

SEQ ID NO: 1188381 - RNA, 15 nt, Homo sapiens
cgacucuaaacacac

SEQ ID NO: 1188382 - RNA, 22 nt, Homo sapiens
cgacugagcuuuagacagcaga

SEQ ID NO: 1188383 - RNA, 17 nt, Homo sapiens
cgacuuagccugaguca

SEQ ID NO: 1188384 - RNA, 15 nt, Homo sapiens
cgagacuccaucucu

SEQ ID NO: 1188385 - RNA, 21 nt, Homo sapiens
cgagaucucgccacugcacuc

SEQ ID NO: 1188386 - RNA, 14 nt, Homo sapiens
cgaggaaacucaga

SEQ ID NO: 1188387 - RNA, 16 nt, Homo sapiens
cgaggaacucgccuca

SEQ ID NO: 1188388 - RNA, 18 nt, Homo sapiens
cgaggugccuucuucagg

SEQ ID NO: 1188389 - RNA, 20 nt, Homo sapiens
cgaucucagcucacugcaag

SEQ ID NO: 1188390 - RNA, 12 nt, Homo sapiens
cgauguaugcag

SEQ ID NO: 1188391 - RNA, 17 nt, Homo sapiens
cgcaaacuuuaacaggu

SEQ ID NO: 1188392 - RNA, 10 nt, Homo sapiens
cgcaaagggc

SEQ ID NO: 1188393 - RNA, 11 nt, Homo sapiens
cgcaggaccau

SEQ ID NO: 1188394 - RNA, 22 nt, Homo sapiens
cgcaggggcugccgagugcugu

SEQ ID NO: 1188395 - RNA, 17 nt, Homo sapiens
cgcagugugcacuaagg

SEQ ID NO: 1188396 - RNA, 14 nt, Homo sapiens
cgcaucuugccucc

SEQ ID NO: 1188397 - RNA, 21 nt, Homo sapiens
cgccagcagcgcgcaggccug

SEQ ID NO: 1188398 - RNA, 17 nt, Homo sapiens
cgccaggagagucuccc

SEQ ID NO: 1188399 - RNA, 16 nt, Homo sapiens
cgccaggcugaccaca

SEQ ID NO: 1188400 - RNA, 18 nt, Homo sapiens
cgcccagcucucccacau

SEQ ID NO: 1188401 - RNA, 14 nt, Homo sapiens
cgcccaucagugcc

SEQ ID NO: 1188402 - RNA, 17 nt, Homo sapiens
cgcccaucagugccagc

SEQ ID NO: 1188403 - RNA, 23 nt, Homo sapiens
cgccccagcaggugcugacuuca

SEQ ID NO: 1188404 - RNA, 22 nt, Homo sapiens
cgcccccugccccaaucuccca

SEQ ID NO: 1188405 - RNA, 17 nt, Homo sapiens
cgcccgagguggcugcc

SEQ ID NO: 1188406 - RNA, 13 nt, Homo sapiens
cgcccuccacaaa

SEQ ID NO: 1188407 - RNA, 14 nt, Homo sapiens
cgccucaccugcuc

SEQ ID NO: 1188408 - RNA, 17 nt, Homo sapiens
cgccuccccaccuccag

SEQ ID NO: 1188409 - RNA, 17 nt, Homo sapiens
cgccuccgcuacuucca

SEQ ID NO: 1188410 - RNA, 21 nt, Homo sapiens
cgccuguaaucccagcacuuu

SEQ ID NO: 1188411 - RNA, 22 nt, Homo sapiens
cgccuguggacagccugaguca

SEQ ID NO: 1188412 - RNA, 13 nt, Homo sapiens
cgcggcucuccag

SEQ ID NO: 1188413 - RNA, 14 nt, Homo sapiens
cgcguacagaucuc

SEQ ID NO: 1188414 - RNA, 19 nt, Homo sapiens
cgcguagugucaguacuaa

SEQ ID NO: 1188415 - RNA, 23 nt, Homo sapiens
cgcgugaucaaagccacacucug

SEQ ID NO: 1188416 - RNA, 23 nt, Homo sapiens
cgcuacaaaauaaagcuguucuc

SEQ ID NO: 1188417 - RNA, 11 nt, Homo sapiens
cgcuacuucca

SEQ ID NO: 1188418 - RNA, 13 nt, Homo sapiens
cgcucaucaccua

SEQ ID NO: 1188419 - RNA, 17 nt, Homo sapiens
cgcuccaaugccuacug

SEQ ID NO: 1188420 - RNA, 17 nt, Homo sapiens
cgcucuguggaugccag

SEQ ID NO: 1188421 - RNA, 16 nt, Homo sapiens
cgcugagcucccagac

SEQ ID NO: 1188422 - RNA, 19 nt, Homo sapiens
cgcuucugccuuuucacug

SEQ ID NO: 1188423 - RNA, 21 nt, Homo sapiens
cggaaguacuucccucaggcc

SEQ ID NO: 1188424 - RNA, 21 nt, Homo sapiens
cggacaagacccccagcacuu

SEQ ID NO: 1188425 - RNA, 19 nt, Homo sapiens
cggacauggucuguccuga

SEQ ID NO: 1188426 - RNA, 14 nt, Homo sapiens
cggacucacuugau

SEQ ID NO: 1188427 - RNA, 20 nt, Homo sapiens
cggacuuacaaccuugucag

SEQ ID NO: 1188428 - RNA, 18 nt, Homo sapiens
cggagcagccuuuaucaa

SEQ ID NO: 1188429 - RNA, 21 nt, Homo sapiens
cggagcagccuuuaucaagag

SEQ ID NO: 1188430 - RNA, 17 nt, Homo sapiens
cggagcuauacauaugu

SEQ ID NO: 1188431 - RNA, 19 nt, Homo sapiens
cggagggauugaucuucag

SEQ ID NO: 1188432 - RNA, 14 nt, Homo sapiens
cggaucuuuggaca

SEQ ID NO: 1188433 - RNA, 19 nt, Homo sapiens
cggaucuuuggacagaagc

SEQ ID NO: 1188434 - RNA, 20 nt, Homo sapiens
cggaugggcccuaugucuca

SEQ ID NO: 1188435 - RNA, 17 nt, Homo sapiens
cggcaacaucaacccga

SEQ ID NO: 1188436 - RNA, 15 nt, Homo sapiens
cggcaggcauggcug

SEQ ID NO: 1188437 - RNA, 20 nt, Homo sapiens
cggcaguucugggugcuccc

SEQ ID NO: 1188438 - RNA, 18 nt, Homo sapiens
cggccccucccccugaga

SEQ ID NO: 1188439 - RNA, 13 nt, Homo sapiens
cggccuggagcuc

SEQ ID NO: 1188440 - RNA, 18 nt, Homo sapiens
cggcugccgacuccccca

SEQ ID NO: 1188441 - RNA, 14 nt, Homo sapiens
cggcugcucgccca

SEQ ID NO: 1188442 - RNA, 14 nt, Homo sapiens
cucccuaccuugcc

SEQ ID NO: 1188443 - RNA, 15 nt, Homo sapiens
cucccuccagauaua

SEQ ID NO: 1188444 - RNA, 21 nt, Homo sapiens
cucccuccagcacaaacacaa

SEQ ID NO: 1188445 - RNA, 18 nt, Homo sapiens
cucccuccucacucccua

SEQ ID NO: 1188446 - RNA, 16 nt, Homo sapiens
cucccugaaacacugc

SEQ ID NO: 1188447 - RNA, 18 nt, Homo sapiens
cucccugccucacaucuc

SEQ ID NO: 1188448 - RNA, 18 nt, Homo sapiens
cucccuggggaugugcuu

SEQ ID NO: 1188449 - RNA, 19 nt, Homo sapiens
cucccuggggaugugcuuu

SEQ ID NO: 1188450 - RNA, 22 nt, Homo sapiens
cucccuguucaaggccccugac

SEQ ID NO: 1188451 - RNA, 17 nt, Homo sapiens
cucccuguuccccagag

SEQ ID NO: 1188452 - RNA, 13 nt, Homo sapiens
cucccuucugucc

SEQ ID NO: 1188453 - RNA, 15 nt, Homo sapiens
cucccuuguguuccu

SEQ ID NO: 1188454 - RNA, 14 nt, Homo sapiens
cuccgaggccagua

SEQ ID NO: 1188455 - RNA, 13 nt, Homo sapiens
cuccguggcacau

SEQ ID NO: 1188456 - RNA, 19 nt, Homo sapiens
cuccguggcaucaccuuag

SEQ ID NO: 1188457 - RNA, 18 nt, Homo sapiens
cuccuaaaguaacaucag

SEQ ID NO: 1188458 - RNA, 22 nt, Homo sapiens
cuccuaaccucaagugauccuc

SEQ ID NO: 1188459 - RNA, 17 nt, Homo sapiens
cuccuaaugcucugaaa

SEQ ID NO: 1188460 - RNA, 13 nt, Homo sapiens
cuccuaauucugc

SEQ ID NO: 1188461 - RNA, 13 nt, Homo sapiens
cuccucaacuggg

SEQ ID NO: 1188462 - RNA, 18 nt, Homo sapiens
cuccucacucaccuucag

SEQ ID NO: 1188463 - RNA, 12 nt, Homo sapiens
cuccucacugug

SEQ ID NO: 1188464 - RNA, 15 nt, Homo sapiens
cuccucauagcauga

SEQ ID NO: 1188465 - RNA, 20 nt, Homo sapiens
cuccuccagggccacgugcc

SEQ ID NO: 1188466 - RNA, 22 nt, Homo sapiens
cuccucgagaucccaacacugc

SEQ ID NO: 1188467 - RNA, 19 nt, Homo sapiens
cuccucucccagugacaac

SEQ ID NO: 1188468 - RNA, 14 nt, Homo sapiens
cuccucugcagcuc

SEQ ID NO: 1188469 - RNA, 17 nt, Homo sapiens
cuccugaaugagacuua

SEQ ID NO: 1188470 - RNA, 20 nt, Homo sapiens
cuccugaccucaagugaucu

SEQ ID NO: 1188471 - RNA, 23 nt, Homo sapiens
cuccugaccucaagugaucuguc

SEQ ID NO: 1188472 - RNA, 20 nt, Homo sapiens
cuccugaccucaggugaucc

SEQ ID NO: 1188473 - RNA, 18 nt, Homo sapiens
cuccugacgucaagugau

SEQ ID NO: 1188474 - RNA, 14 nt, Homo sapiens
cuccugacuuuuaa

SEQ ID NO: 1188475 - RNA, 22 nt, Homo sapiens
cuccugccauaggguccugaau

SEQ ID NO: 1188476 - RNA, 14 nt, Homo sapiens
cuccugccuacuca

SEQ ID NO: 1188477 - RNA, 17 nt, Homo sapiens
cuccuggagcuauucac

SEQ ID NO: 1188478 - RNA, 19 nt, Homo sapiens
cuccuggcucaagcccuga

SEQ ID NO: 1188479 - RNA, 19 nt, Homo sapiens
cuccuggguucaagcaauc

SEQ ID NO: 1188480 - RNA, 16 nt, Homo sapiens
cuccugugcauuguag

SEQ ID NO: 1188481 - RNA, 23 nt, Homo sapiens
cuccuguuuuuuucaggcuccua

SEQ ID NO: 1188482 - RNA, 15 nt, Homo sapiens
cuccuuaccacugug

SEQ ID NO: 1188483 - RNA, 15 nt, Homo sapiens
cuccuucagacaccc

SEQ ID NO: 1188484 - RNA, 22 nt, Homo sapiens
cuccuuccuuguuacccaugaa

SEQ ID NO: 1188485 - RNA, 16 nt, Homo sapiens
cuccuugcuuguuaca

SEQ ID NO: 1188486 - RNA, 23 nt, Homo sapiens
cuccuuuucugugaagcccuuug

SEQ ID NO: 1188487 - RNA, 14 nt, Homo sapiens
cucgaaacacagaa

SEQ ID NO: 1188488 - RNA, 19 nt, Homo sapiens
cucgacugcucaaccucac

SEQ ID NO: 1188489 - RNA, 13 nt, Homo sapiens
cucgagaucccaa

SEQ ID NO: 1188490 - RNA, 16 nt, Homo sapiens
cucgagcuuggggcaa

SEQ ID NO: 1188491 - RNA, 13 nt, Homo sapiens
cucgaguacugug

SEQ ID NO: 1188492 - RNA, 22 nt, Homo sapiens
cucgaucuuccagaagcuguac

SEQ ID NO: 1188493 - RNA, 16 nt, Homo sapiens
cucgcucuguuaccca

SEQ ID NO: 1188494 - RNA, 13 nt, Homo sapiens
cucgcucuugucu

SEQ ID NO: 1188495 - RNA, 16 nt, Homo sapiens
cucggcucagugcaac

SEQ ID NO: 1188496 - RNA, 19 nt, Homo sapiens
cucgggguccagugcauuu

SEQ ID NO: 1188497 - RNA, 11 nt, Homo sapiens
cucguccuccc

SEQ ID NO: 1188498 - RNA, 15 nt, Homo sapiens
cucuaaaagaaaaag

SEQ ID NO: 1188499 - RNA, 18 nt, Homo sapiens
cucuaacaaugacauuua

SEQ ID NO: 1188500 - RNA, 13 nt, Homo sapiens
cucuaacaucucc

SEQ ID NO: 1188501 - RNA, 20 nt, Homo sapiens
cucuaacucagaaacaucag

SEQ ID NO: 1188502 - RNA, 19 nt, Homo sapiens
cucuaagcacaaagugauu

SEQ ID NO: 1188503 - RNA, 12 nt, Homo sapiens
cucuacauggac

SEQ ID NO: 1188504 - RNA, 12 nt, Homo sapiens
cucuacccagua

SEQ ID NO: 1188505 - RNA, 21 nt, Homo sapiens
cucuacccugugcuaagcacg

SEQ ID NO: 1188506 - RNA, 21 nt, Homo sapiens
cucuacuaaaaauaccaaaaa

SEQ ID NO: 1188507 - RNA, 12 nt, Homo sapiens
cucuaguauuua

SEQ ID NO: 1188508 - RNA, 17 nt, Homo sapiens
cucuauaaaguauggua

SEQ ID NO: 1188509 - RNA, 19 nt, Homo sapiens
cucucaccucugugccucu

SEQ ID NO: 1188510 - RNA, 17 nt, Homo sapiens
cucucacucagccuguu

SEQ ID NO: 1188511 - RNA, 18 nt, Homo sapiens
cucucauuuaaugcacac

SEQ ID NO: 1188512 - RNA, 17 nt, Homo sapiens
cucucccacccucaguc

SEQ ID NO: 1188513 - RNA, 16 nt, Homo sapiens
cucucccagugacaac

SEQ ID NO: 1188514 - RNA, 22 nt, Homo sapiens
cucucccagugacaaccaaaag

SEQ ID NO: 1188515 - RNA, 17 nt, Homo sapiens
cucucccugacccugua

SEQ ID NO: 1188516 - RNA, 21 nt, Homo sapiens
cucuccgaaagaagacacaga

SEQ ID NO: 1188517 - RNA, 17 nt, Homo sapiens
cucuccuccguggcaca

SEQ ID NO: 1188518 - RNA, 12 nt, Homo sapiens
cucuccugcaaa

SEQ ID NO: 1188519 - RNA, 15 nt, Homo sapiens
cucucgacaguaucc

SEQ ID NO: 1188520 - RNA, 19 nt, Homo sapiens
cucucuuuaaaaugcaaaa

SEQ ID NO: 1188521 - RNA, 14 nt, Homo sapiens
cucugaaaccagug

SEQ ID NO: 1188522 - RNA, 15 nt, Homo sapiens
cucugaaaccagugu

SEQ ID NO: 1188523 - RNA, 20 nt, Homo sapiens
cucugaaccccucccuccau

SEQ ID NO: 1188524 - RNA, 19 nt, Homo sapiens
cucugaauuugagauacaa

SEQ ID NO: 1188525 - RNA, 18 nt, Homo sapiens
cucugacucagggcuccu

SEQ ID NO: 1188526 - RNA, 21 nt, Homo sapiens
cucugagguuuccgaaaucag

SEQ ID NO: 1188527 - RNA, 23 nt, Homo sapiens
cucugaguaucuccucgcaagcu

SEQ ID NO: 1188528 - RNA, 16 nt, Homo sapiens
cucugauaaaacuggu

SEQ ID NO: 1188529 - RNA, 19 nt, Homo sapiens
cucugauauacaaagggau

SEQ ID NO: 1188530 - RNA, 13 nt, Homo sapiens
cucugaucccucu

SEQ ID NO: 1188531 - RNA, 13 nt, Homo sapiens
cucugcaccugua

SEQ ID NO: 1188532 - RNA, 17 nt, Homo sapiens
cucugccgcuaccuccc

SEQ ID NO: 1188533 - RNA, 18 nt, Homo sapiens
cucugccugggacacugc

SEQ ID NO: 1188534 - RNA, 11 nt, Homo sapiens
cucugcuccag

SEQ ID NO: 1188535 - RNA, 16 nt, Homo sapiens
cucuggacgugaaaua

SEQ ID NO: 1188536 - RNA, 15 nt, Homo sapiens
cucugggcuccagag

SEQ ID NO: 1188537 - RNA, 16 nt, Homo sapiens
cucuggucuccacaga

SEQ ID NO: 1188538 - RNA, 13 nt, Homo sapiens
cucugguggcaca

SEQ ID NO: 1188539 - RNA, 16 nt, Homo sapiens
cucuguaccccaugac

SEQ ID NO: 1188540 - RNA, 12 nt, Homo sapiens
cucugucaguca

SEQ ID NO: 1188541 - RNA, 16 nt, Homo sapiens
cucuguccuagacucc

SEQ ID NO: 1188542 - RNA, 19 nt, Homo sapiens
cucugucuagcaugccaac

SEQ ID NO: 1188543 - RNA, 21 nt, Homo sapiens
cucugucugcucaaugccauu

SEQ ID NO: 1188544 - RNA, 23 nt, Homo sapiens
cucugucuugggcguuugaacuc

SEQ ID NO: 1188545 - RNA, 19 nt, Homo sapiens
cucuguguauuuauauaaa

SEQ ID NO: 1188546 - RNA, 20 nt, Homo sapiens
cucuuaaaccacagcacuau

SEQ ID NO: 1188547 - RNA, 13 nt, Homo sapiens
cucuuaagccauc

SEQ ID NO: 1188548 - RNA, 22 nt, Homo sapiens
cucuuacuucccccacccuggg

SEQ ID NO: 1188549 - RNA, 18 nt, Homo sapiens
cucuuauagaaaguucaa

SEQ ID NO: 1188550 - RNA, 14 nt, Homo sapiens
cucuucaaaugccu

SEQ ID NO: 1188551 - RNA, 14 nt, Homo sapiens
cucuucaagcuuuu

SEQ ID NO: 1188552 - RNA, 14 nt, Homo sapiens
cucuucaaggacuu

SEQ ID NO: 1188553 - RNA, 12 nt, Homo sapiens
cucuucccacau

SEQ ID NO: 1188554 - RNA, 17 nt, Homo sapiens
cucuucccugaccuccc

SEQ ID NO: 1188555 - RNA, 17 nt, Homo sapiens
cucuucucaaagcuggg

SEQ ID NO: 1188556 - RNA, 23 nt, Homo sapiens
cucuucugacauuuaucaggcac

SEQ ID NO: 1188557 - RNA, 17 nt, Homo sapiens
cucuugagucacacugc

SEQ ID NO: 1188558 - RNA, 21 nt, Homo sapiens
cucuuggagcuuuuuugcaua

SEQ ID NO: 1188559 - RNA, 16 nt, Homo sapiens
cucuuggauaccagcu

SEQ ID NO: 1188560 - RNA, 15 nt, Homo sapiens
cucuuggccugauca

SEQ ID NO: 1188561 - RNA, 14 nt, Homo sapiens
cucuugucacaugg

SEQ ID NO: 1188562 - RNA, 22 nt, Homo sapiens
cucuugugacgugcacugugaa

SEQ ID NO: 1188563 - RNA, 20 nt, Homo sapiens
cucuuguuucuuuucacaua

SEQ ID NO: 1188564 - RNA, 17 nt, Homo sapiens
cucuuguuuucucucuc

SEQ ID NO: 1188565 - RNA, 15 nt, Homo sapiens
cucuuuccacuuugu

SEQ ID NO: 1188566 - RNA, 15 nt, Homo sapiens
cucuuucuagccugg

SEQ ID NO: 1188567 - RNA, 14 nt, Homo sapiens
cucuuucucuauua

SEQ ID NO: 1188568 - RNA, 18 nt, Homo sapiens
cucuuucuguauauacuu

SEQ ID NO: 1188569 - RNA, 15 nt, Homo sapiens
cucuuuggucauuga

SEQ ID NO: 1188570 - RNA, 23 nt, Homo sapiens
cucuuuuuuauguuuuagacugu

SEQ ID NO: 1188571 - RNA, 14 nt, Homo sapiens
cugaaaaccucucc

SEQ ID NO: 1188572 - RNA, 17 nt, Homo sapiens
cugaaaagauccuauua

SEQ ID NO: 1188573 - RNA, 16 nt, Homo sapiens
cugaaaauauaaccag

SEQ ID NO: 1188574 - RNA, 16 nt, Homo sapiens
cugaaacaacuuggaa

SEQ ID NO: 1188575 - RNA, 16 nt, Homo sapiens
cuuuaccuucauuuca

SEQ ID NO: 1188576 - RNA, 13 nt, Homo sapiens
cuuuacuccucac

SEQ ID NO: 1188577 - RNA, 17 nt, Homo sapiens
cuuuagaaacucaaaaa

SEQ ID NO: 1188578 - RNA, 14 nt, Homo sapiens
cuuuagaacagugc

SEQ ID NO: 1188579 - RNA, 15 nt, Homo sapiens
cuuuagaacagugcc

SEQ ID NO: 1188580 - RNA, 20 nt, Homo sapiens
cuuuagaguagaguuuggaa

SEQ ID NO: 1188581 - RNA, 15 nt, Homo sapiens
cuuuagagugcaagu

SEQ ID NO: 1188582 - RNA, 19 nt, Homo sapiens
cuuuagcaguuuugugaua

SEQ ID NO: 1188583 - RNA, 15 nt, Homo sapiens
cuuuauaacccaaaa

SEQ ID NO: 1188584 - RNA, 16 nt, Homo sapiens
cuuuauacaacagugc

SEQ ID NO: 1188585 - RNA, 22 nt, Homo sapiens
cuuuauauacaauaauggaaaa

SEQ ID NO: 1188586 - RNA, 19 nt, Homo sapiens
cuuuauauggccucaagau

SEQ ID NO: 1188587 - RNA, 14 nt, Homo sapiens
cuuuaucauugcua

SEQ ID NO: 1188588 - RNA, 22 nt, Homo sapiens
cuuuauccuaaagauuauuacc

SEQ ID NO: 1188589 - RNA, 13 nt, Homo sapiens
cuuuaucuacuuu

SEQ ID NO: 1188590 - RNA, 24 nt, Homo sapiens
cuuuaugaugcuaugguuugccau

SEQ ID NO: 1188591 - RNA, 13 nt, Homo sapiens
cuuuauguggaaa

SEQ ID NO: 1188592 - RNA, 20 nt, Homo sapiens
cuuuauuuaaaaagaaugga

SEQ ID NO: 1188593 - RNA, 14 nt, Homo sapiens
cuuucaaacauaua

SEQ ID NO: 1188594 - RNA, 13 nt, Homo sapiens
cuuucaaagucca

SEQ ID NO: 1188595 - RNA, 15 nt, Homo sapiens
cuuucaacuugcauc

SEQ ID NO: 1188596 - RNA, 17 nt, Homo sapiens
cuuucacgggccccauu

SEQ ID NO: 1188597 - RNA, 15 nt, Homo sapiens
cuuucagacuugcca

SEQ ID NO: 1188598 - RNA, 21 nt, Homo sapiens
cuuucagacuugccaugugac

SEQ ID NO: 1188599 - RNA, 19 nt, Homo sapiens
cuuucauaaagucuugccu

SEQ ID NO: 1188600 - RNA, 23 nt, Homo sapiens
cuuucaucccucgggugugcuau

SEQ ID NO: 1188601 - RNA, 22 nt, Homo sapiens
cuuucaucuugaaguuacacau

SEQ ID NO: 1188602 - RNA, 21 nt, Homo sapiens
cuuucauuauuaguacugcuc

SEQ ID NO: 1188603 - RNA, 14 nt, Homo sapiens
cuuuccaaagccaa

SEQ ID NO: 1188604 - RNA, 19 nt, Homo sapiens
cuuuccaaagccaauguga

SEQ ID NO: 1188605 - RNA, 22 nt, Homo sapiens
cuuucccacucaccuuucucca

SEQ ID NO: 1188606 - RNA, 20 nt, Homo sapiens
cuuucccauuucuaccuaag

SEQ ID NO: 1188607 - RNA, 16 nt, Homo sapiens
cuuuccucagaucauc

SEQ ID NO: 1188608 - RNA, 16 nt, Homo sapiens
cuuuccuucuuucauu

SEQ ID NO: 1188609 - RNA, 18 nt, Homo sapiens
cuuucugaacugacugaa

SEQ ID NO: 1188610 - RNA, 16 nt, Homo sapiens
cuuucuuaaugugacc

SEQ ID NO: 1188611 - RNA, 17 nt, Homo sapiens
cuuucuuacacaagagc

SEQ ID NO: 1188612 - RNA, 14 nt, Homo sapiens
cuuucuuauccaac

SEQ ID NO: 1188613 - RNA, 13 nt, Homo sapiens
cuuucuuccaaac

SEQ ID NO: 1188614 - RNA, 21 nt, Homo sapiens
cuuucuuccuuggccaagaga

SEQ ID NO: 1188615 - RNA, 16 nt, Homo sapiens
cuuucuucuucuucua

SEQ ID NO: 1188616 - RNA, 16 nt, Homo sapiens
cuuucuucuuuagcaa

SEQ ID NO: 1188617 - RNA, 15 nt, Homo sapiens
cuuucuuuacauacc

SEQ ID NO: 1188618 - RNA, 20 nt, Homo sapiens
cuuugaaaaaucacuugauu

SEQ ID NO: 1188619 - RNA, 23 nt, Homo sapiens
cuuugaagauaguaacuguagau

SEQ ID NO: 1188620 - RNA, 20 nt, Homo sapiens
cuuugaauaguccuaaaaag

SEQ ID NO: 1188621 - RNA, 23 nt, Homo sapiens
cuuugagguggaagagggcugca

SEQ ID NO: 1188622 - RNA, 14 nt, Homo sapiens
cuuugaguccagca

SEQ ID NO: 1188623 - RNA, 14 nt, Homo sapiens
cuuugauaugacug

SEQ ID NO: 1188624 - RNA, 23 nt, Homo sapiens
cuuugauauuauguggcuuuuau

SEQ ID NO: 1188625 - RNA, 22 nt, Homo sapiens
cuuugaucccugacaucuggaa

SEQ ID NO: 1188626 - RNA, 17 nt, Homo sapiens
cuuugaucuucagggaa

SEQ ID NO: 1188627 - RNA, 20 nt, Homo sapiens
cuuugcaaaggagacuuaau

SEQ ID NO: 1188628 - RNA, 15 nt, Homo sapiens
cuuugcaauugugga

SEQ ID NO: 1188629 - RNA, 18 nt, Homo sapiens
cuuugcagugagugcugc

SEQ ID NO: 1188630 - RNA, 17 nt, Homo sapiens
cuuugcauugaauuugg

SEQ ID NO: 1188631 - RNA, 14 nt, Homo sapiens
cuuugccagccauu

SEQ ID NO: 1188632 - RNA, 15 nt, Homo sapiens
cuuugcccacacaca

SEQ ID NO: 1188633 - RNA, 19 nt, Homo sapiens
cuuugcccacacacacucc

SEQ ID NO: 1188634 - RNA, 19 nt, Homo sapiens
cuuugcgccucuuggcucc

SEQ ID NO: 1188635 - RNA, 11 nt, Homo sapiens
cuuugcugcug

SEQ ID NO: 1188636 - RNA, 21 nt, Homo sapiens
cuuugcuuuaaguguaacugg

SEQ ID NO: 1188637 - RNA, 22 nt, Homo sapiens
cuuuggcaaauaaaccuccuaa

SEQ ID NO: 1188638 - RNA, 18 nt, Homo sapiens
cuuugggagcaggauuuu

SEQ ID NO: 1188639 - RNA, 19 nt, Homo sapiens
cuuugguuggcagcauucc

SEQ ID NO: 1188640 - RNA, 15 nt, Homo sapiens
cuuuguacuuugugc

SEQ ID NO: 1188641 - RNA, 16 nt, Homo sapiens
cuuuguauauuacaua

SEQ ID NO: 1188642 - RNA, 17 nt, Homo sapiens
cuuuguauuucaucucu

SEQ ID NO: 1188643 - RNA, 15 nt, Homo sapiens
cuuugugacuucaag

SEQ ID NO: 1188644 - RNA, 17 nt, Homo sapiens
cuuugugccaucacuga

SEQ ID NO: 1188645 - RNA, 16 nt, Homo sapiens
cuuuguggcacugggg

SEQ ID NO: 1188646 - RNA, 22 nt, Homo sapiens
cuuuguguuugcuuggugcugg

SEQ ID NO: 1188647 - RNA, 23 nt, Homo sapiens
cuuuguuaggucauuuucaguga

SEQ ID NO: 1188648 - RNA, 23 nt, Homo sapiens
cuuuguucuggggggacccagug

SEQ ID NO: 1188649 - RNA, 19 nt, Homo sapiens
cuuuuaaaaugcaauguaa

SEQ ID NO: 1188650 - RNA, 22 nt, Homo sapiens
cuuuuaaugucauuuguuaaaa

SEQ ID NO: 1188651 - RNA, 15 nt, Homo sapiens
cuuuuaggaacuuua

SEQ ID NO: 1188652 - RNA, 21 nt, Homo sapiens
cuuuuaggacugucugaaaau

SEQ ID NO: 1188653 - RNA, 21 nt, Homo sapiens
cuuuuaguauuuuagugaacu

SEQ ID NO: 1188654 - RNA, 15 nt, Homo sapiens
cuuuuauacugacaa

SEQ ID NO: 1188655 - RNA, 14 nt, Homo sapiens
cuuuuauacuguac

SEQ ID NO: 1188656 - RNA, 15 nt, Homo sapiens
cuuuuauuucauuca

SEQ ID NO: 1188657 - RNA, 20 nt, Homo sapiens
cuuuuauuucauucauaucc

SEQ ID NO: 1188658 - RNA, 20 nt, Homo sapiens
cuuuuauuuucuacuuacuu

SEQ ID NO: 1188659 - RNA, 19 nt, Homo sapiens
cuuuucauuaagaaaacaa

SEQ ID NO: 1188660 - RNA, 20 nt, Homo sapiens
cuuuuccaaaugcccaagga

SEQ ID NO: 1188661 - RNA, 22 nt, Homo sapiens
cuuuucuccccgccugcuccca

SEQ ID NO: 1188662 - RNA, 20 nt, Homo sapiens
cuuuucuggggaaagacacu

SEQ ID NO: 1188663 - RNA, 16 nt, Homo sapiens
cuuuucuuaauacuga

SEQ ID NO: 1188664 - RNA, 16 nt, Homo sapiens
cuuuugaacuugucac

SEQ ID NO: 1188665 - RNA, 11 nt, Homo sapiens
cuuuugguguc

SEQ ID NO: 1188666 - RNA, 15 nt, Homo sapiens
cuuuuguaagacauu

SEQ ID NO: 1188667 - RNA, 15 nt, Homo sapiens
cuuuuguaauuugua

SEQ ID NO: 1188668 - RNA, 14 nt, Homo sapiens
cuuuuguacugaaa

SEQ ID NO: 1188669 - RNA, 21 nt, Homo sapiens
cuuuugucuaauuaaaacacu

SEQ ID NO: 1188670 - RNA, 17 nt, Homo sapiens
cuuuuguuuuuccaguu

SEQ ID NO: 1188671 - RNA, 21 nt, Homo sapiens
cuuuuuaaaauaaacacaaaa

SEQ ID NO: 1188672 - RNA, 22 nt, Homo sapiens
cuuuuuaaagaagugcaugaaa

SEQ ID NO: 1188673 - RNA, 16 nt, Homo sapiens
cuuuuuacaauuaaaa

SEQ ID NO: 1188674 - RNA, 23 nt, Homo sapiens
cuuuuuauacuuuguaaagacaa

SEQ ID NO: 1188675 - RNA, 13 nt, Homo sapiens
cuuuuucacuccc

SEQ ID NO: 1188676 - RNA, 20 nt, Homo sapiens
cuuuuuccuggcucaucucu

SEQ ID NO: 1188677 - RNA, 17 nt, Homo sapiens
cuuuuucugaagcuacu

SEQ ID NO: 1188678 - RNA, 22 nt, Homo sapiens
cuuuuugaaaucagcauacuca

SEQ ID NO: 1188679 - RNA, 14 nt, Homo sapiens
gaaaaaaaaaccca

SEQ ID NO: 1188680 - RNA, 16 nt, Homo sapiens
gaaaaaaaaauggaag

SEQ ID NO: 1188681 - RNA, 15 nt, Homo sapiens
gaaaaaaaugcuucu

SEQ ID NO: 1188682 - RNA, 17 nt, Homo sapiens
gaaaaaauuaaaaccug

SEQ ID NO: 1188683 - RNA, 21 nt, Homo sapiens
gaaaaacaacaaauaauuuaa

SEQ ID NO: 1188684 - RNA, 14 nt, Homo sapiens
gaaaaacauuauuu

SEQ ID NO: 1188685 - RNA, 17 nt, Homo sapiens
gaaaaacccaaacugag

SEQ ID NO: 1188686 - RNA, 16 nt, Homo sapiens
gaaaaaccugcucccu

SEQ ID NO: 1188687 - RNA, 18 nt, Homo sapiens
gaaaaagacaauaguauu

SEQ ID NO: 1188688 - RNA, 20 nt, Homo sapiens
gaaaaagaccuaugagcaca

SEQ ID NO: 1188689 - RNA, 13 nt, Homo sapiens
gaaaaagcaccaa

SEQ ID NO: 1188690 - RNA, 22 nt, Homo sapiens
gaaaaagcggugccccuauaca

SEQ ID NO: 1188691 - RNA, 23 nt, Homo sapiens
gaaaaauagcaacuuguguuaca

SEQ ID NO: 1188692 - RNA, 23 nt, Homo sapiens
gaaaaauagguuuguagugaaau

SEQ ID NO: 1188693 - RNA, 23 nt, Homo sapiens
gaaaaauauuuugcacagauuua

SEQ ID NO: 1188694 - RNA, 23 nt, Homo sapiens
gaaaaaugaaagaugauuugcaa

SEQ ID NO: 1188695 - RNA, 19 nt, Homo sapiens
gaaaacacugugcacaucu

SEQ ID NO: 1188696 - RNA, 16 nt, Homo sapiens
gaaaacaucuauucuc

SEQ ID NO: 1188697 - RNA, 18 nt, Homo sapiens
gaaaacauuccagaugca

SEQ ID NO: 1188698 - RNA, 21 nt, Homo sapiens
gaaaaccacuuuauugcaaug

SEQ ID NO: 1188699 - RNA, 20 nt, Homo sapiens
gaaaaccccaucucuacuaa

SEQ ID NO: 1188700 - RNA, 20 nt, Homo sapiens
gaaaacucaugaauaaucca

SEQ ID NO: 1188701 - RNA, 19 nt, Homo sapiens
gaaaacuggaaaucuggau

SEQ ID NO: 1188702 - RNA, 15 nt, Homo sapiens
gaaaacugugcaaug

SEQ ID NO: 1188703 - RNA, 19 nt, Homo sapiens
gaaaacuucacugugcuca

SEQ ID NO: 1188704 - RNA, 21 nt, Homo sapiens
gaaaagaaaccagagucaaau

SEQ ID NO: 1188705 - RNA, 20 nt, Homo sapiens
gaaaagagaaggaaagugau

SEQ ID NO: 1188706 - RNA, 21 nt, Homo sapiens
gcugggguacacagugagagu

SEQ ID NO: 1188707 - RNA, 22 nt, Homo sapiens
gcugggucuucaaggaucuccu

SEQ ID NO: 1188708 - RNA, 12 nt, Homo sapiens
gcuggugccuga

SEQ ID NO: 1188709 - RNA, 14 nt, Homo sapiens
gcuguaaauuacau

SEQ ID NO: 1188710 - RNA, 16 nt, Homo sapiens
gcuguacuugaugaca

SEQ ID NO: 1188711 - RNA, 19 nt, Homo sapiens
gcuguacuuuuaccaguuu

SEQ ID NO: 1188712 - RNA, 14 nt, Homo sapiens
gcuguauagcuccu

SEQ ID NO: 1188713 - RNA, 16 nt, Homo sapiens
gcugugagacaguggg

SEQ ID NO: 1188714 - RNA, 19 nt, Homo sapiens
gcugugcaauuacugccug

SEQ ID NO: 1188715 - RNA, 20 nt, Homo sapiens
gcugugcuaucaugauggaa

SEQ ID NO: 1188716 - RNA, 12 nt, Homo sapiens
gcugugggacca

SEQ ID NO: 1188717 - RNA, 20 nt, Homo sapiens
gcuguggggcgggcaugggg

SEQ ID NO: 1188718 - RNA, 15 nt, Homo sapiens
gcugugucuuuagaa

SEQ ID NO: 1188719 - RNA, 20 nt, Homo sapiens
gcuguguguguuagcuugua

SEQ ID NO: 1188720 - RNA, 16 nt, Homo sapiens
gcuguguuacuugaag

SEQ ID NO: 1188721 - RNA, 16 nt, Homo sapiens
gcuguguuuccaucuc

SEQ ID NO: 1188722 - RNA, 18 nt, Homo sapiens
gcuguguuuccaucucaa

SEQ ID NO: 1188723 - RNA, 15 nt, Homo sapiens
gcuguuaaaauaaga

SEQ ID NO: 1188724 - RNA, 17 nt, Homo sapiens
gcuguucaacaucacug

SEQ ID NO: 1188725 - RNA, 14 nt, Homo sapiens
gcuguucucauucc

SEQ ID NO: 1188726 - RNA, 13 nt, Homo sapiens
gcuguugccucau

SEQ ID NO: 1188727 - RNA, 15 nt, Homo sapiens
gcuguuuccuugccu

SEQ ID NO: 1188728 - RNA, 22 nt, Homo sapiens
gcuguuuuccucccuucugcua

SEQ ID NO: 1188729 - RNA, 17 nt, Homo sapiens
gcuuaaaagaaacuaua

SEQ ID NO: 1188730 - RNA, 21 nt, Homo sapiens
gcuuaaacuugacccaggugg

SEQ ID NO: 1188731 - RNA, 14 nt, Homo sapiens
gcuuaagccaucuu

SEQ ID NO: 1188732 - RNA, 12 nt, Homo sapiens
gcuuacauugaa

SEQ ID NO: 1188733 - RNA, 21 nt, Homo sapiens
gcuuagacuaaggccauuauu

SEQ ID NO: 1188734 - RNA, 22 nt, Homo sapiens
gcuuagauucuguaugcgguga

SEQ ID NO: 1188735 - RNA, 17 nt, Homo sapiens
gcuuauauucagucugu

SEQ ID NO: 1188736 - RNA, 12 nt, Homo sapiens
gcuuauauucau

SEQ ID NO: 1188737 - RNA, 17 nt, Homo sapiens
gcuuaugccugccucuu

SEQ ID NO: 1188738 - RNA, 19 nt, Homo sapiens
gcuucaaagccauauggac

SEQ ID NO: 1188739 - RNA, 21 nt, Homo sapiens
gcuucaaagccauauggacac

SEQ ID NO: 1188740 - RNA, 22 nt, Homo sapiens
gcuucaagaguccuuacugaag

SEQ ID NO: 1188741 - RNA, 23 nt, Homo sapiens
gcuucacauucugggcugacuca

SEQ ID NO: 1188742 - RNA, 21 nt, Homo sapiens
gcuucaccagacuuuucucua

SEQ ID NO: 1188743 - RNA, 13 nt, Homo sapiens
gcuucagugccau

SEQ ID NO: 1188744 - RNA, 20 nt, Homo sapiens
gcuucauauaccagcaauau

SEQ ID NO: 1188745 - RNA, 11 nt, Homo sapiens
gcuucauaucu

SEQ ID NO: 1188746 - RNA, 17 nt, Homo sapiens
gcuucccagguucaagc

SEQ ID NO: 1188747 - RNA, 23 nt, Homo sapiens
gcuuccccuuuugccaaucucaa

SEQ ID NO: 1188748 - RNA, 15 nt, Homo sapiens
gcuucccugacucau

SEQ ID NO: 1188749 - RNA, 18 nt, Homo sapiens
gcuuccuaccacagauuc

SEQ ID NO: 1188750 - RNA, 14 nt, Homo sapiens
gcuuccugcugaau

SEQ ID NO: 1188751 - RNA, 18 nt, Homo sapiens
gcuucuacggccaugaga

SEQ ID NO: 1188752 - RNA, 17 nt, Homo sapiens
gcuucuauuagucaccu

SEQ ID NO: 1188753 - RNA, 15 nt, Homo sapiens
gcuucuccauggcca

SEQ ID NO: 1188754 - RNA, 22 nt, Homo sapiens
gcuucuccugugugauugacag

SEQ ID NO: 1188755 - RNA, 14 nt, Homo sapiens
gcuucugauaugca

SEQ ID NO: 1188756 - RNA, 16 nt, Homo sapiens
gcuucuggccaggaag

SEQ ID NO: 1188757 - RNA, 16 nt, Homo sapiens
gcuucuuauaguaaca

SEQ ID NO: 1188758 - RNA, 22 nt, Homo sapiens
gcuucuuauaguaacacuaaaa

SEQ ID NO: 1188759 - RNA, 14 nt, Homo sapiens
gcuugaaccuggga

SEQ ID NO: 1188760 - RNA, 13 nt, Homo sapiens
gcuugagccuuug

SEQ ID NO: 1188761 - RNA, 14 nt, Homo sapiens
gcuugagucucaag

SEQ ID NO: 1188762 - RNA, 18 nt, Homo sapiens
gcuugauagaaaugccaa

SEQ ID NO: 1188763 - RNA, 20 nt, Homo sapiens
gcuugaucaaaggcacacag

SEQ ID NO: 1188764 - RNA, 20 nt, Homo sapiens
gcuugcccagggugcagugu

SEQ ID NO: 1188765 - RNA, 24 nt, Homo sapiens
gcuugcccagggugcagugugagu

SEQ ID NO: 1188766 - RNA, 19 nt, Homo sapiens
gcuuggcugucucaucccc

SEQ ID NO: 1188767 - RNA, 14 nt, Homo sapiens
gcuugucugcaguc

SEQ ID NO: 1188768 - RNA, 18 nt, Homo sapiens
gcuugucugcagucaccc

SEQ ID NO: 1188769 - RNA, 20 nt, Homo sapiens
gcuuguggccaaugcaucca

SEQ ID NO: 1188770 - RNA, 16 nt, Homo sapiens
gcuuuaaacugcauuu

SEQ ID NO: 1188771 - RNA, 15 nt, Homo sapiens
gcuuuagagugcaag

SEQ ID NO: 1188772 - RNA, 17 nt, Homo sapiens
gcuuucaaagcauuuac

SEQ ID NO: 1188773 - RNA, 15 nt, Homo sapiens
gcuuucauccugugu

SEQ ID NO: 1188774 - RNA, 17 nt, Homo sapiens
gcuuucauguuauuaaa

SEQ ID NO: 1188775 - RNA, 19 nt, Homo sapiens
gcuuuccguggcacugcau

SEQ ID NO: 1188776 - RNA, 14 nt, Homo sapiens
gcuuuccucaaaaa

SEQ ID NO: 1188777 - RNA, 16 nt, Homo sapiens
gcuuucuguucaucuc

SEQ ID NO: 1188778 - RNA, 21 nt, Homo sapiens
gcuuugacuggaggguccauu

SEQ ID NO: 1188779 - RNA, 23 nt, Homo sapiens
gcuuugauggaggagguauugua

SEQ ID NO: 1188780 - RNA, 21 nt, Homo sapiens
gcuuugggauaauguuuauaa

SEQ ID NO: 1188781 - RNA, 18 nt, Homo sapiens
gcuuugggggcuuuacaa

SEQ ID NO: 1188782 - RNA, 21 nt, Homo sapiens
gcuuugguucuucagaugcuc

SEQ ID NO: 1188783 - RNA, 13 nt, Homo sapiens
gcuuuguugcacu

SEQ ID NO: 1188784 - RNA, 16 nt, Homo sapiens
gcuuuguuggcaagga

SEQ ID NO: 1188785 - RNA, 13 nt, Homo sapiens
gcuuuucuuccua

SEQ ID NO: 1188786 - RNA, 20 nt, Homo sapiens
gcuuuugccugccugugcua

SEQ ID NO: 1188787 - RNA, 18 nt, Homo sapiens
ggaaaaaauaacaaugaa

SEQ ID NO: 1188788 - RNA, 16 nt, Homo sapiens
ggaaaacagggugcua

SEQ ID NO: 1188789 - RNA, 14 nt, Homo sapiens
ggaaaacucaugaa

SEQ ID NO: 1188790 - RNA, 24 nt, Homo sapiens
ggaaaagaaaucuaugauuccagg

SEQ ID NO: 1188791 - RNA, 22 nt, Homo sapiens
ggaaaauaauacugcugagaua

SEQ ID NO: 1188792 - RNA, 16 nt, Homo sapiens
ggaaaaucacuugaac

SEQ ID NO: 1188793 - RNA, 19 nt, Homo sapiens
ggaaaaugcacacauuucu

SEQ ID NO: 1188794 - RNA, 17 nt, Homo sapiens
ggaaacacuccuugcau

SEQ ID NO: 1188795 - RNA, 11 nt, Homo sapiens
ggaaaccacaa

SEQ ID NO: 1188796 - RNA, 14 nt, Homo sapiens
ggaaacccccagug

SEQ ID NO: 1188797 - RNA, 18 nt, Homo sapiens
ggaaacccccaguguaau

SEQ ID NO: 1188798 - RNA, 17 nt, Homo sapiens
ggaaacugcuccagcuc

SEQ ID NO: 1188799 - RNA, 16 nt, Homo sapiens
ggaaagaaacuaccuu

SEQ ID NO: 1188800 - RNA, 23 nt, Homo sapiens
ggaaagaaccaugcagaggaaua

SEQ ID NO: 1188801 - RNA, 19 nt, Homo sapiens
ggaaagaagaguuggagug

SEQ ID NO: 1188802 - RNA, 23 nt, Homo sapiens
ggaaagaagaguuggagugagau

SEQ ID NO: 1188803 - RNA, 16 nt, Homo sapiens
ggaaagaaguucacau

SEQ ID NO: 1188804 - RNA, 20 nt, Homo sapiens
ggaaagacauccauaaagaa

SEQ ID NO: 1188805 - RNA, 14 nt, Homo sapiens
ggaaagacuugaau

SEQ ID NO: 1188806 - RNA, 15 nt, Homo sapiens
ggaaagcagcucaaa

SEQ ID NO: 1188807 - RNA, 17 nt, Homo sapiens
ggaaaggaauccacauc

SEQ ID NO: 1188808 - RNA, 15 nt, Homo sapiens
ggaaaggcagaugua

SEQ ID NO: 1188809 - RNA, 17 nt, Homo sapiens
ggaaaggugguguuucu

SEQ ID NO: 1188810 - RNA, 14 nt, Homo sapiens
ggaaauaaagggau

SEQ ID NO: 1188811 - RNA, 16 nt, Homo sapiens
ggaaauggcuguggag

SEQ ID NO: 1188812 - RNA, 22 nt, Homo sapiens
ggaaauucggagcuauacauau

SEQ ID NO: 1188813 - RNA, 14 nt, Homo sapiens
ggaacacggccaca

SEQ ID NO: 1188814 - RNA, 11 nt, Homo sapiens
ggaacagggau

SEQ ID NO: 1188815 - RNA, 22 nt, Homo sapiens
ggaacauguacuguuacugugu

SEQ ID NO: 1188816 - RNA, 23 nt, Homo sapiens
ggaacauguacuguuacuguguc

SEQ ID NO: 1188817 - RNA, 16 nt, Homo sapiens
ggaacccagacucaga

SEQ ID NO: 1188818 - RNA, 23 nt, Homo sapiens
ggaaccgcaggaagcugcuccgu

SEQ ID NO: 1188819 - RNA, 14 nt, Homo sapiens
ggaacucagaucca

SEQ ID NO: 1188820 - RNA, 16 nt, Homo sapiens
ggaacucagauccagg

SEQ ID NO: 1188821 - RNA, 16 nt, Homo sapiens
ggaacucuuaagcaau

SEQ ID NO: 1188822 - RNA, 15 nt, Homo sapiens
ggaacuuugucacau

SEQ ID NO: 1188823 - RNA, 14 nt, Homo sapiens
ggaagaaagcuaau

SEQ ID NO: 1188824 - RNA, 17 nt, Homo sapiens
ggaagaagauagaucca

SEQ ID NO: 1188825 - RNA, 20 nt, Homo sapiens
ggaagacuguugugcuccau

SEQ ID NO: 1188826 - RNA, 20 nt, Homo sapiens
ggaagcaaguuuucuuccau

SEQ ID NO: 1188827 - RNA, 20 nt, Homo sapiens
ggaagcuuguuuuccagucu

SEQ ID NO: 1188828 - RNA, 17 nt, Homo sapiens
ggaaggacauccauguu

SEQ ID NO: 1188829 - RNA, 13 nt, Homo sapiens
ggaaggacuauga

SEQ ID NO: 1188830 - RNA, 18 nt, Homo sapiens
ggaaggagcacauacuac

SEQ ID NO: 1188831 - RNA, 18 nt, Homo sapiens
ggaaguaaccauuugcac

SEQ ID NO: 1188832 - RNA, 23 nt, Homo sapiens
ggaagucugauagcgucucugca

SEQ ID NO: 1188833 - RNA, 23 nt, Homo sapiens
ggaagugagccagcaguggccuu

SEQ ID NO: 1188834 - RNA, 21 nt, Homo sapiens
ggaagugguagaaacuuuaaa

SEQ ID NO: 1188835 - RNA, 13 nt, Homo sapiens
ggaauaaauaugc

SEQ ID NO: 1188836 - RNA, 11 nt, Homo sapiens
ggaauaaucuc

SEQ ID NO: 1188837 - RNA, 14 nt, Homo sapiens
ggaauacuguuuua

SEQ ID NO: 1188838 - RNA, 14 nt, Homo sapiens
guagcaagaugagc

SEQ ID NO: 1188839 - RNA, 17 nt, Homo sapiens
guagcagggaguaccca

SEQ ID NO: 1188840 - RNA, 23 nt, Homo sapiens
guagcagguuaccacucuggcag

SEQ ID NO: 1188841 - RNA, 16 nt, Homo sapiens
guagcauccucuuuaa

SEQ ID NO: 1188842 - RNA, 16 nt, Homo sapiens
guagcccauccuuccc

SEQ ID NO: 1188843 - RNA, 16 nt, Homo sapiens
guagcucuccugacuu

SEQ ID NO: 1188844 - RNA, 18 nt, Homo sapiens
guaggaaucugccuucca

SEQ ID NO: 1188845 - RNA, 16 nt, Homo sapiens
guaggacccaagcaga

SEQ ID NO: 1188846 - RNA, 15 nt, Homo sapiens
guaggagcugccuug

SEQ ID NO: 1188847 - RNA, 16 nt, Homo sapiens
guagguggaucaccug

SEQ ID NO: 1188848 - RNA, 16 nt, Homo sapiens
guaguaaaacacagag

SEQ ID NO: 1188849 - RNA, 19 nt, Homo sapiens
guaguaaauucauauccau

SEQ ID NO: 1188850 - RNA, 21 nt, Homo sapiens
guaguguauucucuaaaagcu

SEQ ID NO: 1188851 - RNA, 16 nt, Homo sapiens
guaguuagccaucuaa

SEQ ID NO: 1188852 - RNA, 17 nt, Homo sapiens
guaguucaauagucuaa

SEQ ID NO: 1188853 - RNA, 13 nt, Homo sapiens
guaguuuugccaa

SEQ ID NO: 1188854 - RNA, 13 nt, Homo sapiens
guauaaacacucu

SEQ ID NO: 1188855 - RNA, 20 nt, Homo sapiens
guauaaagcucucaaaugug

SEQ ID NO: 1188856 - RNA, 17 nt, Homo sapiens
guauaacccuguuacaa

SEQ ID NO: 1188857 - RNA, 18 nt, Homo sapiens
guauaacuaggcuguuaa

SEQ ID NO: 1188858 - RNA, 18 nt, Homo sapiens
guauaccaaggcaaaaaa

SEQ ID NO: 1188859 - RNA, 21 nt, Homo sapiens
guauacuuuuagcuuguaguu

SEQ ID NO: 1188860 - RNA, 21 nt, Homo sapiens
guauaguaaaaccaaccagcu

SEQ ID NO: 1188861 - RNA, 14 nt, Homo sapiens
guauaugacugcau

SEQ ID NO: 1188862 - RNA, 17 nt, Homo sapiens
guauaugagacuuucaa

SEQ ID NO: 1188863 - RNA, 17 nt, Homo sapiens
guauaugucuuuuaccc

SEQ ID NO: 1188864 - RNA, 16 nt, Homo sapiens
guauauuuugcaauag

SEQ ID NO: 1188865 - RNA, 12 nt, Homo sapiens
guaucagaauug

SEQ ID NO: 1188866 - RNA, 22 nt, Homo sapiens
guaucagaucuaucuugucaau

SEQ ID NO: 1188867 - RNA, 12 nt, Homo sapiens
guaucaucagau

SEQ ID NO: 1188868 - RNA, 20 nt, Homo sapiens
guaucaugcccugugcaacc

SEQ ID NO: 1188869 - RNA, 23 nt, Homo sapiens
guauccagagauacuacaauauu

SEQ ID NO: 1188870 - RNA, 14 nt, Homo sapiens
guauccucuugcca

SEQ ID NO: 1188871 - RNA, 18 nt, Homo sapiens
guauccugggccucagca

SEQ ID NO: 1188872 - RNA, 14 nt, Homo sapiens
guaucgauguuaug

SEQ ID NO: 1188873 - RNA, 16 nt, Homo sapiens
guaucucucuguggug

SEQ ID NO: 1188874 - RNA, 23 nt, Homo sapiens
guaucuuaaaaaucuaugccuaa

SEQ ID NO: 1188875 - RNA, 21 nt, Homo sapiens
guaugaaacaaacuacugugu

SEQ ID NO: 1188876 - RNA, 18 nt, Homo sapiens
guaugaauaauugcauca

SEQ ID NO: 1188877 - RNA, 16 nt, Homo sapiens
guaugauaagcuuuau

SEQ ID NO: 1188878 - RNA, 18 nt, Homo sapiens
guauggaaaguucuuaua

SEQ ID NO: 1188879 - RNA, 12 nt, Homo sapiens
guaugugcucuu

SEQ ID NO: 1188880 - RNA, 17 nt, Homo sapiens
guauguguaagaucuga

SEQ ID NO: 1188881 - RNA, 14 nt, Homo sapiens
guauguugccuuua

SEQ ID NO: 1188882 - RNA, 21 nt, Homo sapiens
guauuaaaaaacaauuaacug

SEQ ID NO: 1188883 - RNA, 23 nt, Homo sapiens
guauuaacucuguaaaagugucu

SEQ ID NO: 1188884 - RNA, 15 nt, Homo sapiens
guauuaauaucucca

SEQ ID NO: 1188885 - RNA, 18 nt, Homo sapiens
guauuauauaaacuuaac

SEQ ID NO: 1188886 - RNA, 22 nt, Homo sapiens
guauucaggcacugagaaugau

SEQ ID NO: 1188887 - RNA, 16 nt, Homo sapiens
guauucucucuaugca

SEQ ID NO: 1188888 - RNA, 19 nt, Homo sapiens
guauucuuuuuccaucccu

SEQ ID NO: 1188889 - RNA, 18 nt, Homo sapiens
guauuguaagcuuuccau

SEQ ID NO: 1188890 - RNA, 18 nt, Homo sapiens
guauuguggaacacugaa

SEQ ID NO: 1188891 - RNA, 14 nt, Homo sapiens
guauugugugagug

SEQ ID NO: 1188892 - RNA, 15 nt, Homo sapiens
guauuuacagacaca

SEQ ID NO: 1188893 - RNA, 21 nt, Homo sapiens
guauuuauguaauauuuagaa

SEQ ID NO: 1188894 - RNA, 15 nt, Homo sapiens
guauuucacagagca

SEQ ID NO: 1188895 - RNA, 21 nt, Homo sapiens
guauuucauugcugugucaca

SEQ ID NO: 1188896 - RNA, 15 nt, Homo sapiens
guauuucucugugaa

SEQ ID NO: 1188897 - RNA, 19 nt, Homo sapiens
guauuugccuucuccacuu

SEQ ID NO: 1188898 - RNA, 18 nt, Homo sapiens
guauuuucaguuugcccu

SEQ ID NO: 1188899 - RNA, 22 nt, Homo sapiens
guauuuuccaacuuguucaaau

SEQ ID NO: 1188900 - RNA, 19 nt, Homo sapiens
guauuuucugucacuguag

SEQ ID NO: 1188901 - RNA, 16 nt, Homo sapiens
guauuuuuucuugcau

SEQ ID NO: 1188902 - RNA, 23 nt, Homo sapiens
gucaaaacagauuguuugcaaag

SEQ ID NO: 1188903 - RNA, 11 nt, Homo sapiens
gucaaacugua

SEQ ID NO: 1188904 - RNA, 19 nt, Homo sapiens
gucaaccugccugacauuu

SEQ ID NO: 1188905 - RNA, 14 nt, Homo sapiens
gucaauuuaugaau

SEQ ID NO: 1188906 - RNA, 12 nt, Homo sapiens
gucacacacuga

SEQ ID NO: 1188907 - RNA, 11 nt, Homo sapiens
gucacagauuc

SEQ ID NO: 1188908 - RNA, 13 nt, Homo sapiens
gucacagccaccc

SEQ ID NO: 1188909 - RNA, 17 nt, Homo sapiens
gucacauggccuaugca

SEQ ID NO: 1188910 - RNA, 23 nt, Homo sapiens
gucacauggccuaugcacauaug

SEQ ID NO: 1188911 - RNA, 19 nt, Homo sapiens
gucaccaggugaccagugg

SEQ ID NO: 1188912 - RNA, 21 nt, Homo sapiens
gucacccagggcgucccugac

SEQ ID NO: 1188913 - RNA, 13 nt, Homo sapiens
gucacgcaccugg

SEQ ID NO: 1188914 - RNA, 22 nt, Homo sapiens
gucacuggagucuccuccccau

SEQ ID NO: 1188915 - RNA, 16 nt, Homo sapiens
gucacuguccagguag

SEQ ID NO: 1188916 - RNA, 11 nt, Homo sapiens
gucacugugag

SEQ ID NO: 1188917 - RNA, 21 nt, Homo sapiens
gucagaggagagauagccugu

SEQ ID NO: 1188918 - RNA, 19 nt, Homo sapiens
gucagaguggcgugagcug

SEQ ID NO: 1188919 - RNA, 17 nt, Homo sapiens
gucagauacaauguauu

SEQ ID NO: 1188920 - RNA, 17 nt, Homo sapiens
gucagcaacagagcaaa

SEQ ID NO: 1188921 - RNA, 23 nt, Homo sapiens
gucagcacagaacacacugagac

SEQ ID NO: 1188922 - RNA, 13 nt, Homo sapiens
gucagcaucugac

SEQ ID NO: 1188923 - RNA, 14 nt, Homo sapiens
gucagcaucugacc

SEQ ID NO: 1188924 - RNA, 19 nt, Homo sapiens
gucagcaucugaccaucug

SEQ ID NO: 1188925 - RNA, 19 nt, Homo sapiens
gucagcugcuguugaacuu

SEQ ID NO: 1188926 - RNA, 16 nt, Homo sapiens
gucaggaaacauauuu

SEQ ID NO: 1188927 - RNA, 21 nt, Homo sapiens
gucaggaguccaagaccagac

SEQ ID NO: 1188928 - RNA, 20 nt, Homo sapiens
gucagggaccccugcccuug

SEQ ID NO: 1188929 - RNA, 16 nt, Homo sapiens
gucagggccauuucag

SEQ ID NO: 1188930 - RNA, 21 nt, Homo sapiens
gucaggggugacacagacuca

SEQ ID NO: 1188931 - RNA, 17 nt, Homo sapiens
gucaguggggcucucug

SEQ ID NO: 1188932 - RNA, 20 nt, Homo sapiens
gucauaaugguuuuuaacac

SEQ ID NO: 1188933 - RNA, 14 nt, Homo sapiens
gucauagcauucac

SEQ ID NO: 1188934 - RNA, 15 nt, Homo sapiens
gucauagcauucacu

SEQ ID NO: 1188935 - RNA, 18 nt, Homo sapiens
gucauaggggacugagga

SEQ ID NO: 1188936 - RNA, 14 nt, Homo sapiens
gucaucugccaacu

SEQ ID NO: 1188937 - RNA, 16 nt, Homo sapiens
gucaugaccuccaggg

SEQ ID NO: 1188938 - RNA, 18 nt, Homo sapiens
gucaugaccuccagggag

SEQ ID NO: 1188939 - RNA, 19 nt, Homo sapiens
gucauucagcuaauacaaa

SEQ ID NO: 1188940 - RNA, 14 nt, Homo sapiens
gucauucauucaag

SEQ ID NO: 1188941 - RNA, 15 nt, Homo sapiens
gucauugagggacca

SEQ ID NO: 1188942 - RNA, 14 nt, Homo sapiens
gucauuucaaagac

SEQ ID NO: 1188943 - RNA, 13 nt, Homo sapiens
guccaaaacugcc

SEQ ID NO: 1188944 - RNA, 20 nt, Homo sapiens
guccaaaacugccucaggag

SEQ ID NO: 1188945 - RNA, 20 nt, Homo sapiens
guccaacagacacaauuuau

SEQ ID NO: 1188946 - RNA, 12 nt, Homo sapiens
guccaacuaaaa

SEQ ID NO: 1188947 - RNA, 17 nt, Homo sapiens
guccacagggcaccugc

SEQ ID NO: 1188948 - RNA, 13 nt, Homo sapiens
guccacaggucua

SEQ ID NO: 1188949 - RNA, 14 nt, Homo sapiens
guccaccaccaccu

SEQ ID NO: 1188950 - RNA, 16 nt, Homo sapiens
guccaccccuuuccug

SEQ ID NO: 1188951 - RNA, 24 nt, Homo sapiens
guccacgagcuguuuacuagggau

SEQ ID NO: 1188952 - RNA, 21 nt, Homo sapiens
guccacggucuguucuugaag

SEQ ID NO: 1188953 - RNA, 20 nt, Homo sapiens
guccagaaggagacaggcag

SEQ ID NO: 1188954 - RNA, 15 nt, Homo sapiens
guccagcucguucuc

SEQ ID NO: 1188955 - RNA, 18 nt, Homo sapiens
guccagcuugcucuucag

SEQ ID NO: 1188956 - RNA, 17 nt, Homo sapiens
guccagcuuuacugugg

SEQ ID NO: 1188957 - RNA, 23 nt, Homo sapiens
guccaggacugggucugaccugg

SEQ ID NO: 1188958 - RNA, 16 nt, Homo sapiens
guccaggcacugagau

SEQ ID NO: 1188959 - RNA, 19 nt, Homo sapiens
guccaggcuggagugcaau

SEQ ID NO: 1188960 - RNA, 20 nt, Homo sapiens
guccaggcuggagugcaaug

SEQ ID NO: 1188961 - RNA, 21 nt, Homo sapiens
guccauccuccucuccaugca

SEQ ID NO: 1188962 - RNA, 23 nt, Homo sapiens
guccauuaagcugagagugcuau

SEQ ID NO: 1188963 - RNA, 15 nt, Homo sapiens
guccauuuuucuucc

SEQ ID NO: 1188964 - RNA, 21 nt, Homo sapiens
gucccaagauguugauuuuua

SEQ ID NO: 1188965 - RNA, 15 nt, Homo sapiens
gucccaggcagggag

SEQ ID NO: 1188966 - RNA, 22 nt, Homo sapiens
guccccagggcugucaucugaa

SEQ ID NO: 1188967 - RNA, 16 nt, Homo sapiens
gucccccuucaaucuc

SEQ ID NO: 1188968 - RNA, 19 nt, Homo sapiens
guccccgaugcugaccuca

SEQ ID NO: 1188969 - RNA, 15 nt, Homo sapiens
guccccucauaggau

SEQ ID NO: 1188970 - RNA, 14 nt, Homo sapiens
guuauucuucaaac

SEQ ID NO: 1188971 - RNA, 19 nt, Homo sapiens
guuauuuagggaacugcuu

SEQ ID NO: 1188972 - RNA, 14 nt, Homo sapiens
guuauuuaugcuau

SEQ ID NO: 1188973 - RNA, 21 nt, Homo sapiens
guuauuuuguaaccuuccaau

SEQ ID NO: 1188974 - RNA, 18 nt, Homo sapiens
guucaaaaccuugcacag

SEQ ID NO: 1188975 - RNA, 20 nt, Homo sapiens
guucaaaaccuugcacaggu

SEQ ID NO: 1188976 - RNA, 13 nt, Homo sapiens
guucaaacugcuc

SEQ ID NO: 1188977 - RNA, 20 nt, Homo sapiens
guucaagacagaugggcaua

SEQ ID NO: 1188978 - RNA, 14 nt, Homo sapiens
guucacacuccuau

SEQ ID NO: 1188979 - RNA, 20 nt, Homo sapiens
guucaccaucccaaagccaa

SEQ ID NO: 1188980 - RNA, 12 nt, Homo sapiens
guucagaccgac

SEQ ID NO: 1188981 - RNA, 14 nt, Homo sapiens
guucagcugcccca

SEQ ID NO: 1188982 - RNA, 23 nt, Homo sapiens
guucaguccucccagacuaccug

SEQ ID NO: 1188983 - RNA, 17 nt, Homo sapiens
guucauauuaugaugcc

SEQ ID NO: 1188984 - RNA, 19 nt, Homo sapiens
guuccaaugucaaugugaa

SEQ ID NO: 1188985 - RNA, 20 nt, Homo sapiens
guuccacagaguaagacauu

SEQ ID NO: 1188986 - RNA, 16 nt, Homo sapiens
guuccagaaccgcagg

SEQ ID NO: 1188987 - RNA, 21 nt, Homo sapiens
guuccagcaaacaaaauggac

SEQ ID NO: 1188988 - RNA, 21 nt, Homo sapiens
guuccauauagacaccaagga

SEQ ID NO: 1188989 - RNA, 18 nt, Homo sapiens
guucccauuggaugcauu

SEQ ID NO: 1188990 - RNA, 19 nt, Homo sapiens
guucccauuggaugcauuu

SEQ ID NO: 1188991 - RNA, 20 nt, Homo sapiens
guuccccuaguucuacauga

SEQ ID NO: 1188992 - RNA, 16 nt, Homo sapiens
guucccgacaccagaa

SEQ ID NO: 1188993 - RNA, 22 nt, Homo sapiens
guucccugacuccuccaaggaa

SEQ ID NO: 1188994 - RNA, 20 nt, Homo sapiens
guucccuuugcuugucuucu

SEQ ID NO: 1188995 - RNA, 18 nt, Homo sapiens
guuccuucacauccugug

SEQ ID NO: 1188996 - RNA, 23 nt, Homo sapiens
guuccuugguuguauaaagcaaa

SEQ ID NO: 1188997 - RNA, 20 nt, Homo sapiens
guucgcauggucacacacug

SEQ ID NO: 1188998 - RNA, 20 nt, Homo sapiens
guucguucuguacuguuacu

SEQ ID NO: 1188999 - RNA, 17 nt, Homo sapiens
guucuaaauaugaauga

SEQ ID NO: 1189000 - RNA, 15 nt, Homo sapiens
guucuauacuguaaa

SEQ ID NO: 1189001 - RNA, 13 nt, Homo sapiens
guucuccacuaau

SEQ ID NO: 1189002 - RNA, 19 nt, Homo sapiens
guucuccuaaugcucugaa

SEQ ID NO: 1189003 - RNA, 22 nt, Homo sapiens
guucugauauuggacaguaaaa

SEQ ID NO: 1189004 - RNA, 19 nt, Homo sapiens
guucuguaaaauauacuua

SEQ ID NO: 1189005 - RNA, 12 nt, Homo sapiens
guucugucauau

SEQ ID NO: 1189006 - RNA, 12 nt, Homo sapiens
guucugugcaca

SEQ ID NO: 1189007 - RNA, 19 nt, Homo sapiens
guucugugugagugcucug

SEQ ID NO: 1189008 - RNA, 19 nt, Homo sapiens
guucuuaugccauguuaau

SEQ ID NO: 1189009 - RNA, 19 nt, Homo sapiens
guucuucagagaucaugga

SEQ ID NO: 1189010 - RNA, 16 nt, Homo sapiens
guucuuugccagagac

SEQ ID NO: 1189011 - RNA, 16 nt, Homo sapiens
guucuuugggccagac

SEQ ID NO: 1189012 - RNA, 17 nt, Homo sapiens
guugaaacaagugcaag

SEQ ID NO: 1189013 - RNA, 23 nt, Homo sapiens
guugaauuucccacauacccucc

SEQ ID NO: 1189014 - RNA, 12 nt, Homo sapiens
guugacugcugc

SEQ ID NO: 1189015 - RNA, 22 nt, Homo sapiens
guugauugaauugugccuuuga

SEQ ID NO: 1189016 - RNA, 19 nt, Homo sapiens
guugcaaaucacucugcaa

SEQ ID NO: 1189017 - RNA, 23 nt, Homo sapiens
guugcagcccuugugaugugauu

SEQ ID NO: 1189018 - RNA, 19 nt, Homo sapiens
guugcauagaauucacaau

SEQ ID NO: 1189019 - RNA, 15 nt, Homo sapiens
guugcauuuuggcaa

SEQ ID NO: 1189020 - RNA, 15 nt, Homo sapiens
guugcugcugcugcu

SEQ ID NO: 1189021 - RNA, 19 nt, Homo sapiens
guuggaccuauugccagga

SEQ ID NO: 1189022 - RNA, 16 nt, Homo sapiens
guuggccuuacuguug

SEQ ID NO: 1189023 - RNA, 15 nt, Homo sapiens
guuggucacauggag

SEQ ID NO: 1189024 - RNA, 14 nt, Homo sapiens
guuggugaccaguu

SEQ ID NO: 1189025 - RNA, 13 nt, Homo sapiens
guuggugcugcuc

SEQ ID NO: 1189026 - RNA, 20 nt, Homo sapiens
guugguucguucuguacugu

SEQ ID NO: 1189027 - RNA, 15 nt, Homo sapiens
guuguacaugaaauu

SEQ ID NO: 1189028 - RNA, 18 nt, Homo sapiens
guuguagaaauuaacaaa

SEQ ID NO: 1189029 - RNA, 18 nt, Homo sapiens
guuguaggguuacagaga

SEQ ID NO: 1189030 - RNA, 14 nt, Homo sapiens
guuguccgugauaa

SEQ ID NO: 1189031 - RNA, 22 nt, Homo sapiens
guugucuacauuaaaucacuug

SEQ ID NO: 1189032 - RNA, 13 nt, Homo sapiens
guugugcgcacau

SEQ ID NO: 1189033 - RNA, 16 nt, Homo sapiens
guuguggugugccaug

SEQ ID NO: 1189034 - RNA, 15 nt, Homo sapiens
guuguguaaugucau

SEQ ID NO: 1189035 - RNA, 18 nt, Homo sapiens
guuguguugagaugauau

SEQ ID NO: 1189036 - RNA, 20 nt, Homo sapiens
guuuaaacauaggaaagaag

SEQ ID NO: 1189037 - RNA, 20 nt, Homo sapiens
guuuaaagaaacaauacaaa

SEQ ID NO: 1189038 - RNA, 14 nt, Homo sapiens
guuuaaagucccuu

SEQ ID NO: 1189039 - RNA, 13 nt, Homo sapiens
guuuaacugaaag

SEQ ID NO: 1189040 - RNA, 19 nt, Homo sapiens
guuuaagugugcagccaua

SEQ ID NO: 1189041 - RNA, 18 nt, Homo sapiens
guuuaaucccagcacuuu

SEQ ID NO: 1189042 - RNA, 15 nt, Homo sapiens
guuuaauugugauau

SEQ ID NO: 1189043 - RNA, 22 nt, Homo sapiens
guuuaauugugauauuugacag

SEQ ID NO: 1189044 - RNA, 14 nt, Homo sapiens
guuuacaaauggac

SEQ ID NO: 1189045 - RNA, 13 nt, Homo sapiens
guuuacagaauuu

SEQ ID NO: 1189046 - RNA, 21 nt, Homo sapiens
guuuacaggaaagaugcauuu

SEQ ID NO: 1189047 - RNA, 15 nt, Homo sapiens
guuuacguccuuugg

SEQ ID NO: 1189048 - RNA, 20 nt, Homo sapiens
guuuaguagccuuacuguga

SEQ ID NO: 1189049 - RNA, 18 nt, Homo sapiens
guuuaucgcaauuacuug

SEQ ID NO: 1189050 - RNA, 14 nt, Homo sapiens
guuuaugcuaccua

SEQ ID NO: 1189051 - RNA, 18 nt, Homo sapiens
guuuauuuacucacuuca

SEQ ID NO: 1189052 - RNA, 15 nt, Homo sapiens
guuuauuugcacuau

SEQ ID NO: 1189053 - RNA, 17 nt, Homo sapiens
guuucaucccauguaca

SEQ ID NO: 1189054 - RNA, 20 nt, Homo sapiens
guuucccccuucuacauuuc

SEQ ID NO: 1189055 - RNA, 23 nt, Homo sapiens
guuuccuaggaaaucacaggcuu

SEQ ID NO: 1189056 - RNA, 13 nt, Homo sapiens
guuuccucuguau

SEQ ID NO: 1189057 - RNA, 14 nt, Homo sapiens
guuuccucuguaua

SEQ ID NO: 1189058 - RNA, 16 nt, Homo sapiens
guuuccuuagcuuggu

SEQ ID NO: 1189059 - RNA, 21 nt, Homo sapiens
guuucuaagcauguagccagu

SEQ ID NO: 1189060 - RNA, 14 nt, Homo sapiens
guuucuauacaaau

SEQ ID NO: 1189061 - RNA, 18 nt, Homo sapiens
guuucucggugacuugga

SEQ ID NO: 1189062 - RNA, 12 nt, Homo sapiens
guuucuguguca

SEQ ID NO: 1189063 - RNA, 15 nt, Homo sapiens
guuugaacacaauuc

SEQ ID NO: 1189064 - RNA, 16 nt, Homo sapiens
guuugaacacaauucg

SEQ ID NO: 1189065 - RNA, 21 nt, Homo sapiens
guuugaacucuucuuugccag

SEQ ID NO: 1189066 - RNA, 10 nt, Homo sapiens
guuugacaac

SEQ ID NO: 1189067 - RNA, 22 nt, Homo sapiens
guuugacauuuaauaacuuugc

SEQ ID NO: 1189068 - RNA, 17 nt, Homo sapiens
guuugauuauucagugu

SEQ ID NO: 1189069 - RNA, 15 nt, Homo sapiens
guuugauuuucauau

SEQ ID NO: 1189070 - RNA, 16 nt, Homo sapiens
guuugccaaauaaaaa

SEQ ID NO: 1189071 - RNA, 22 nt, Homo sapiens
guuuggaaucccacuaaugcaa

SEQ ID NO: 1189072 - RNA, 17 nt, Homo sapiens
guuuggacccaugguca

SEQ ID NO: 1189073 - RNA, 19 nt, Homo sapiens
guuuggauuauuccucuac

SEQ ID NO: 1189074 - RNA, 22 nt, Homo sapiens
guuuggguauugugugagugca

SEQ ID NO: 1189075 - RNA, 19 nt, Homo sapiens
guuugugcucuacggguga

SEQ ID NO: 1189076 - RNA, 21 nt, Homo sapiens
guuuuaaacguuaaaagugua

SEQ ID NO: 1189077 - RNA, 14 nt, Homo sapiens
guuuuaaauugaua

SEQ ID NO: 1189078 - RNA, 12 nt, Homo sapiens
guuuuaacugua

SEQ ID NO: 1189079 - RNA, 16 nt, Homo sapiens
guuuuaagcugcuaag

SEQ ID NO: 1189080 - RNA, 20 nt, Homo sapiens
guuuuacauuguugagcuau

SEQ ID NO: 1189081 - RNA, 16 nt, Homo sapiens
guuuuacuacccaaau

SEQ ID NO: 1189082 - RNA, 23 nt, Homo sapiens
guuuuccagcauguguucuguua

SEQ ID NO: 1189083 - RNA, 19 nt, Homo sapiens
guuuuccuucucaucugug

SEQ ID NO: 1189084 - RNA, 23 nt, Homo sapiens
guuuucugugcacuguagccuua

SEQ ID NO: 1189085 - RNA, 21 nt, Homo sapiens
guuuucuucuaaucauaacau

SEQ ID NO: 1189086 - RNA, 13 nt, Homo sapiens
guuuugccaguga

SEQ ID NO: 1189087 - RNA, 14 nt, Homo sapiens
guuuugccagugau

SEQ ID NO: 1189088 - RNA, 22 nt, Homo sapiens
guuuuggacacacggucagggu

SEQ ID NO: 1189089 - RNA, 15 nt, Homo sapiens
guuuuguaccaacac

SEQ ID NO: 1189090 - RNA, 21 nt, Homo sapiens
guuuuguaggagacuugccag

SEQ ID NO: 1189091 - RNA, 15 nt, Homo sapiens
guuuuguauucucug

SEQ ID NO: 1189092 - RNA, 16 nt, Homo sapiens
guuuugucaaacugua

SEQ ID NO: 1189093 - RNA, 15 nt, Homo sapiens
guuuuguguguauau

SEQ ID NO: 1189094 - RNA, 16 nt, Homo sapiens
guuuuuaaaacccagu

SEQ ID NO: 1189095 - RNA, 14 nt, Homo sapiens
guuuuuaaucucca

SEQ ID NO: 1189096 - RNA, 15 nt, Homo sapiens
guuuuuaauucauau

SEQ ID NO: 1189097 - RNA, 19 nt, Homo sapiens
guuuuuaugauagugcaag

SEQ ID NO: 1189098 - RNA, 19 nt, Homo sapiens
guuuuuauuuugucucuga

SEQ ID NO: 1189099 - RNA, 17 nt, Homo sapiens
guuuuucuuuucauuua

SEQ ID NO: 1189100 - RNA, 16 nt, Homo sapiens
guuuuugaaauaccuu

SEQ ID NO: 1189101 - RNA, 12 nt, Homo sapiens
guuuuugccaaa

SEQ ID NO: 1189102 - RNA, 23 nt, Homo sapiens
uacaugaaugcaaaacauuucau

SEQ ID NO: 1189103 - RNA, 22 nt, Homo sapiens
uacaugacaucaaaaugaguca

SEQ ID NO: 1189104 - RNA, 15 nt, Homo sapiens
uacaugcauacuuca

SEQ ID NO: 1189105 - RNA, 16 nt, Homo sapiens
uacauguaauuugaug

SEQ ID NO: 1189106 - RNA, 20 nt, Homo sapiens
uacauuaaaauaaaccaaau

SEQ ID NO: 1189107 - RNA, 21 nt, Homo sapiens
uacauuaaaauaaaccaaaua

SEQ ID NO: 1189108 - RNA, 19 nt, Homo sapiens
uacauuagucauucaauaa

SEQ ID NO: 1189109 - RNA, 22 nt, Homo sapiens
uacauugugcccuugauuuuua

SEQ ID NO: 1189110 - RNA, 17 nt, Homo sapiens
uacauuuacugugagcu

SEQ ID NO: 1189111 - RNA, 13 nt, Homo sapiens
uacauuuccaaau

SEQ ID NO: 1189112 - RNA, 16 nt, Homo sapiens
uacauuuccaaauuca

SEQ ID NO: 1189113 - RNA, 20 nt, Homo sapiens
uacauuuguauuuugugaug

SEQ ID NO: 1189114 - RNA, 18 nt, Homo sapiens
uacauuugugaacaaaaa

SEQ ID NO: 1189115 - RNA, 21 nt, Homo sapiens
uacauuuuggauuucuuuaua

SEQ ID NO: 1189116 - RNA, 16 nt, Homo sapiens
uaccaaaacaagauua

SEQ ID NO: 1189117 - RNA, 23 nt, Homo sapiens
uaccaaaacaagauuaauuucau

SEQ ID NO: 1189118 - RNA, 13 nt, Homo sapiens
uaccaaagugucu

SEQ ID NO: 1189119 - RNA, 13 nt, Homo sapiens
uaccaaaugaggg

SEQ ID NO: 1189120 - RNA, 13 nt, Homo sapiens
uaccaagcauuua

SEQ ID NO: 1189121 - RNA, 16 nt, Homo sapiens
uaccaauuauggaaau

SEQ ID NO: 1189122 - RNA, 21 nt, Homo sapiens
uaccacaaggcuccugaucau

SEQ ID NO: 1189123 - RNA, 16 nt, Homo sapiens
uaccacaguggaugua

SEQ ID NO: 1189124 - RNA, 17 nt, Homo sapiens
uaccacaucacaccacu

SEQ ID NO: 1189125 - RNA, 15 nt, Homo sapiens
uaccacucagagaaa

SEQ ID NO: 1189126 - RNA, 23 nt, Homo sapiens
uaccacucgcguguuccccaagc

SEQ ID NO: 1189127 - RNA, 14 nt, Homo sapiens
uaccagaugcugac

SEQ ID NO: 1189128 - RNA, 14 nt, Homo sapiens
uaccagcucagggg

SEQ ID NO: 1189129 - RNA, 19 nt, Homo sapiens
uaccagggacccuggagua

SEQ ID NO: 1189130 - RNA, 16 nt, Homo sapiens
uaccagugggcaugua

SEQ ID NO: 1189131 - RNA, 23 nt, Homo sapiens
uaccaguguaaauucagucuuuu

SEQ ID NO: 1189132 - RNA, 16 nt, Homo sapiens
uaccaugaugcaugga

SEQ ID NO: 1189133 - RNA, 14 nt, Homo sapiens
uaccauuuccucag

SEQ ID NO: 1189134 - RNA, 23 nt, Homo sapiens
uaccauuuuaguaugaagcaaug

SEQ ID NO: 1189135 - RNA, 22 nt, Homo sapiens
uacccaagcaaaaucauggaau

SEQ ID NO: 1189136 - RNA, 17 nt, Homo sapiens
uacccagauuguaucau

SEQ ID NO: 1189137 - RNA, 15 nt, Homo sapiens
uacccagggccugca

SEQ ID NO: 1189138 - RNA, 12 nt, Homo sapiens
uaccccucauuu

SEQ ID NO: 1189139 - RNA, 17 nt, Homo sapiens
uacccuccucuauuucu

SEQ ID NO: 1189140 - RNA, 21 nt, Homo sapiens
uacccuuaagucacccuagcc

SEQ ID NO: 1189141 - RNA, 23 nt, Homo sapiens
uacccuugagcugugugccacag

SEQ ID NO: 1189142 - RNA, 19 nt, Homo sapiens
uacccuuuaagauauccau

SEQ ID NO: 1189143 - RNA, 13 nt, Homo sapiens
uaccguuuccuua

SEQ ID NO: 1189144 - RNA, 14 nt, Homo sapiens
uaccucagcauuua

SEQ ID NO: 1189145 - RNA, 23 nt, Homo sapiens
uaccuccccuuuucuauguugcu

SEQ ID NO: 1189146 - RNA, 18 nt, Homo sapiens
uaccuccugucuuuacaa

SEQ ID NO: 1189147 - RNA, 18 nt, Homo sapiens
uaccucggccucccaaag

SEQ ID NO: 1189148 - RNA, 16 nt, Homo sapiens
uaccucuaaauuucca

SEQ ID NO: 1189149 - RNA, 13 nt, Homo sapiens
uaccugagcauuc

SEQ ID NO: 1189150 - RNA, 19 nt, Homo sapiens
uaccugaugugcaguuuaa

SEQ ID NO: 1189151 - RNA, 21 nt, Homo sapiens
uaccugcccccaauccaugaa

SEQ ID NO: 1189152 - RNA, 22 nt, Homo sapiens
uaccuguaaccuaccuuaucau

SEQ ID NO: 1189153 - RNA, 18 nt, Homo sapiens
uaccuguuuccuacagac

SEQ ID NO: 1189154 - RNA, 20 nt, Homo sapiens
uaccuuccccagacuugcac

SEQ ID NO: 1189155 - RNA, 14 nt, Homo sapiens
uaccuuuaccccau

SEQ ID NO: 1189156 - RNA, 15 nt, Homo sapiens
uacgaaucgaauaca

SEQ ID NO: 1189157 - RNA, 19 nt, Homo sapiens
uacgcugccucaacacuga

SEQ ID NO: 1189158 - RNA, 20 nt, Homo sapiens
uacgcugccucaacacugaa

SEQ ID NO: 1189159 - RNA, 22 nt, Homo sapiens
uacgcuuuuauuggaaauguga

SEQ ID NO: 1189160 - RNA, 22 nt, Homo sapiens
uacggccaugagacugaucccu

SEQ ID NO: 1189161 - RNA, 15 nt, Homo sapiens
uacguaucugcuacu

SEQ ID NO: 1189162 - RNA, 13 nt, Homo sapiens
uacgucauuacaa

SEQ ID NO: 1189163 - RNA, 14 nt, Homo sapiens
uacguccuuuggac

SEQ ID NO: 1189164 - RNA, 20 nt, Homo sapiens
uacgugauccucucaccuca

SEQ ID NO: 1189165 - RNA, 21 nt, Homo sapiens
uacgugauuuggcugcacuug

SEQ ID NO: 1189166 - RNA, 12 nt, Homo sapiens
uacuaaagccaa

SEQ ID NO: 1189167 - RNA, 13 nt, Homo sapiens
uacuaaauaucau

SEQ ID NO: 1189168 - RNA, 18 nt, Homo sapiens
uacuaacugccaucaccu

SEQ ID NO: 1189169 - RNA, 14 nt, Homo sapiens
uacuaagcauuuca

SEQ ID NO: 1189170 - RNA, 15 nt, Homo sapiens
uacuaaggagcauga

SEQ ID NO: 1189171 - RNA, 20 nt, Homo sapiens
uacuaaggaguaaucugugu

SEQ ID NO: 1189172 - RNA, 20 nt, Homo sapiens
uacuaauaugccuagcacaa

SEQ ID NO: 1189173 - RNA, 20 nt, Homo sapiens
uacuagagcgacugaggcag

SEQ ID NO: 1189174 - RNA, 14 nt, Homo sapiens
uacuauugcucuua

SEQ ID NO: 1189175 - RNA, 17 nt, Homo sapiens
uacuauuugccauuuaa

SEQ ID NO: 1189176 - RNA, 15 nt, Homo sapiens
uacucaaagucaucc

SEQ ID NO: 1189177 - RNA, 23 nt, Homo sapiens
uacucagauaagguaaaaugcca

SEQ ID NO: 1189178 - RNA, 14 nt, Homo sapiens
uacuccagccuggg

SEQ ID NO: 1189179 - RNA, 13 nt, Homo sapiens
uacuccagugcca

SEQ ID NO: 1189180 - RNA, 14 nt, Homo sapiens
uacuccaugguucu

SEQ ID NO: 1189181 - RNA, 20 nt, Homo sapiens
uacucccugaucccaguuuc

SEQ ID NO: 1189182 - RNA, 17 nt, Homo sapiens
uacuccgugaggcugcu

SEQ ID NO: 1189183 - RNA, 20 nt, Homo sapiens
uacuccugguucagugccac

SEQ ID NO: 1189184 - RNA, 21 nt, Homo sapiens
uacuccugguucagugccacg

SEQ ID NO: 1189185 - RNA, 15 nt, Homo sapiens
uacucuagauaccua

SEQ ID NO: 1189186 - RNA, 15 nt, Homo sapiens
uacucucaugcugca

SEQ ID NO: 1189187 - RNA, 13 nt, Homo sapiens
uacucuguguaaa

SEQ ID NO: 1189188 - RNA, 15 nt, Homo sapiens
uacucuuaagccauc

SEQ ID NO: 1189189 - RNA, 20 nt, Homo sapiens
uacucuuaagccaucuuggu

SEQ ID NO: 1189190 - RNA, 17 nt, Homo sapiens
uacucuuccaggacucu

SEQ ID NO: 1189191 - RNA, 13 nt, Homo sapiens
uacucuugccuuc

SEQ ID NO: 1189192 - RNA, 14 nt, Homo sapiens
uacugauucacugc

SEQ ID NO: 1189193 - RNA, 14 nt, Homo sapiens
uacugcauguuugc

SEQ ID NO: 1189194 - RNA, 18 nt, Homo sapiens
uacugccaaaacauuuau

SEQ ID NO: 1189195 - RNA, 17 nt, Homo sapiens
uacugcugagauacaua

SEQ ID NO: 1189196 - RNA, 19 nt, Homo sapiens
uacugcugagauacauaca

SEQ ID NO: 1189197 - RNA, 15 nt, Homo sapiens
uacugcuuaauucaa

SEQ ID NO: 1189198 - RNA, 18 nt, Homo sapiens
uacugcuugaccaaagag

SEQ ID NO: 1189199 - RNA, 13 nt, Homo sapiens
uacuggaaguuga

SEQ ID NO: 1189200 - RNA, 22 nt, Homo sapiens
uacugguuuguaugauguauua

SEQ ID NO: 1189201 - RNA, 22 nt, Homo sapiens
uacuguaaauauuuuucacaua

SEQ ID NO: 1189202 - RNA, 13 nt, Homo sapiens
uacuguaauuccu

SEQ ID NO: 1189203 - RNA, 16 nt, Homo sapiens
uacuguauauacuuug

SEQ ID NO: 1189204 - RNA, 19 nt, Homo sapiens
uacugucucucuugucaca

SEQ ID NO: 1189205 - RNA, 14 nt, Homo sapiens
uacugugagacugu

SEQ ID NO: 1189206 - RNA, 12 nt, Homo sapiens
uacugugucagg

SEQ ID NO: 1189207 - RNA, 21 nt, Homo sapiens
uacugugucagggaacauauu

SEQ ID NO: 1189208 - RNA, 16 nt, Homo sapiens
uacuguugugaccuga

SEQ ID NO: 1189209 - RNA, 21 nt, Homo sapiens
uacuguuuucugggccaguga

SEQ ID NO: 1189210 - RNA, 16 nt, Homo sapiens
uacuuacugaacugug

SEQ ID NO: 1189211 - RNA, 15 nt, Homo sapiens
uacuucccacuguau

SEQ ID NO: 1189212 - RNA, 23 nt, Homo sapiens
uacuucccgcuguuccucgccac

SEQ ID NO: 1189213 - RNA, 17 nt, Homo sapiens
uacuugaaauguaaaaa

SEQ ID NO: 1189214 - RNA, 13 nt, Homo sapiens
uacuugcauuuau

SEQ ID NO: 1189215 - RNA, 16 nt, Homo sapiens
uacuuuaugaugcuau

SEQ ID NO: 1189216 - RNA, 19 nt, Homo sapiens
uacuuuuaugcaaccauaa

SEQ ID NO: 1189217 - RNA, 17 nt, Homo sapiens
uacuuuucuuuccucag

SEQ ID NO: 1189218 - RNA, 17 nt, Homo sapiens
uacuuuuuaaacagugu

SEQ ID NO: 1189219 - RNA, 14 nt, Homo sapiens
uacuuuuuacauac

SEQ ID NO: 1189220 - RNA, 18 nt, Homo sapiens
uagaaaaugcaccaaaua

SEQ ID NO: 1189221 - RNA, 14 nt, Homo sapiens
uagaaaauucauaa

SEQ ID NO: 1189222 - RNA, 12 nt, Homo sapiens
uagaaacauauc

SEQ ID NO: 1189223 - RNA, 21 nt, Homo sapiens
uagaaauaagcccaacagaca

SEQ ID NO: 1189224 - RNA, 20 nt, Homo sapiens
uagaaaucccugucuugcuu

SEQ ID NO: 1189225 - RNA, 19 nt, Homo sapiens
uagaaaugacugcauuuga

SEQ ID NO: 1189226 - RNA, 12 nt, Homo sapiens
uagaaccagcag

SEQ ID NO: 1189227 - RNA, 19 nt, Homo sapiens
uagaacucugaaaugaaga

SEQ ID NO: 1189228 - RNA, 14 nt, Homo sapiens
uagaacuguacugu

SEQ ID NO: 1189229 - RNA, 14 nt, Homo sapiens
uagaacuugagaac

SEQ ID NO: 1189230 - RNA, 24 nt, Homo sapiens
uagaaggauggcaucuccauguag

SEQ ID NO: 1189231 - RNA, 20 nt, Homo sapiens
uagaauaaucuugcucacag

SEQ ID NO: 1189232 - RNA, 14 nt, Homo sapiens
uagaauacuuuuaa

SEQ ID NO: 1189233 - RNA, 15 nt, Homo sapiens
uagaaugcaucucau

SEQ ID NO: 1189234 - RNA, 18 nt, Homo sapiens
uagaauuaucaagcuuuu

SEQ ID NO: 1189235 - RNA, 22 nt, Homo sapiens
ugagacaggagaaacacuugaa

SEQ ID NO: 1189236 - RNA, 15 nt, Homo sapiens
ugagacagucuugcu

SEQ ID NO: 1189237 - RNA, 23 nt, Homo sapiens
ugagaccaggggaccagagggau

SEQ ID NO: 1189238 - RNA, 23 nt, Homo sapiens
ugagaccuacugggcugcauucc

SEQ ID NO: 1189239 - RNA, 14 nt, Homo sapiens
ugagaccucuagag

SEQ ID NO: 1189240 - RNA, 22 nt, Homo sapiens
ugagacuccacucaggugcaca

SEQ ID NO: 1189241 - RNA, 15 nt, Homo sapiens
ugagacuccaucuca

SEQ ID NO: 1189242 - RNA, 14 nt, Homo sapiens
ugagacugguugca

SEQ ID NO: 1189243 - RNA, 12 nt, Homo sapiens
ugagacuugaau

SEQ ID NO: 1189244 - RNA, 14 nt, Homo sapiens
ugagacuugaauca

SEQ ID NO: 1189245 - RNA, 12 nt, Homo sapiens
ugagacuuucaa

SEQ ID NO: 1189246 - RNA, 22 nt, Homo sapiens
ugagagacaguaacacaauuaa

SEQ ID NO: 1189247 - RNA, 18 nt, Homo sapiens
ugagagcaaagugaccug

SEQ ID NO: 1189248 - RNA, 22 nt, Homo sapiens
ugagagcaauauuuaaauucuc

SEQ ID NO: 1189249 - RNA, 17 nt, Homo sapiens
ugagagcugugcaucag

SEQ ID NO: 1189250 - RNA, 20 nt, Homo sapiens
ugagaggaagggugggucug

SEQ ID NO: 1189251 - RNA, 20 nt, Homo sapiens
ugagaguacucacuuuucac

SEQ ID NO: 1189252 - RNA, 23 nt, Homo sapiens
ugagaguacucacuuuucacuug

SEQ ID NO: 1189253 - RNA, 12 nt, Homo sapiens
ugagagugcuag

SEQ ID NO: 1189254 - RNA, 16 nt, Homo sapiens
ugagauaauacauucc

SEQ ID NO: 1189255 - RNA, 18 nt, Homo sapiens
ugagauauacgcccucuu

SEQ ID NO: 1189256 - RNA, 21 nt, Homo sapiens
ugagaucacgccauuguacuc

SEQ ID NO: 1189257 - RNA, 14 nt, Homo sapiens
ugagaucccgacaa

SEQ ID NO: 1189258 - RNA, 23 nt, Homo sapiens
ugagaucgugccguuacucucca

SEQ ID NO: 1189259 - RNA, 13 nt, Homo sapiens
ugagaucuacugg

SEQ ID NO: 1189260 - RNA, 22 nt, Homo sapiens
ugagaugaaggaaggacuauga

SEQ ID NO: 1189261 - RNA, 17 nt, Homo sapiens
ugagaugauacauccaa

SEQ ID NO: 1189262 - RNA, 22 nt, Homo sapiens
ugagaugauacauccaaagcag

SEQ ID NO: 1189263 - RNA, 14 nt, Homo sapiens
ugagaugaucaaua

SEQ ID NO: 1189264 - RNA, 22 nt, Homo sapiens
ugagauguguggacuguggcac

SEQ ID NO: 1189265 - RNA, 21 nt, Homo sapiens
ugagauguuuggguggguuaa

SEQ ID NO: 1189266 - RNA, 20 nt, Homo sapiens
ugagauucagugaacuaauu

SEQ ID NO: 1189267 - RNA, 20 nt, Homo sapiens
ugagauuccuguaaauguga

SEQ ID NO: 1189268 - RNA, 16 nt, Homo sapiens
ugagauugcaccacug

SEQ ID NO: 1189269 - RNA, 19 nt, Homo sapiens
ugagauuguccucauuucu

SEQ ID NO: 1189270 - RNA, 16 nt, Homo sapiens
ugagcaacucuugauu

SEQ ID NO: 1189271 - RNA, 22 nt, Homo sapiens
ugagcaagucuuagacaucaua

SEQ ID NO: 1189272 - RNA, 19 nt, Homo sapiens
ugagcaccagccugaaugc

SEQ ID NO: 1189273 - RNA, 15 nt, Homo sapiens
ugagcccugccacuc

SEQ ID NO: 1189274 - RNA, 16 nt, Homo sapiens
ugagccuacgcugaag

SEQ ID NO: 1189275 - RNA, 15 nt, Homo sapiens
ugagccucuuuguaa

SEQ ID NO: 1189276 - RNA, 20 nt, Homo sapiens
ugagcgacaaagaugauuua

SEQ ID NO: 1189277 - RNA, 21 nt, Homo sapiens
ugagcuauugcuguucucuug

SEQ ID NO: 1189278 - RNA, 21 nt, Homo sapiens
ugagcucccaggugcagccag

SEQ ID NO: 1189279 - RNA, 18 nt, Homo sapiens
ugagcugagaucaugcca

SEQ ID NO: 1189280 - RNA, 19 nt, Homo sapiens
ugagcugcccccaaaucaa

SEQ ID NO: 1189281 - RNA, 22 nt, Homo sapiens
ugagcuggauggguacagcuua

SEQ ID NO: 1189282 - RNA, 18 nt, Homo sapiens
ugagcugggagcccggca

SEQ ID NO: 1189283 - RNA, 12 nt, Homo sapiens
ugagcugugcag

SEQ ID NO: 1189284 - RNA, 20 nt, Homo sapiens
ugagcuucauauaccagcaa

SEQ ID NO: 1189285 - RNA, 21 nt, Homo sapiens
ugaggaaaggccagcuggcag

SEQ ID NO: 1189286 - RNA, 15 nt, Homo sapiens
ugaggaacccuuaca

SEQ ID NO: 1189287 - RNA, 17 nt, Homo sapiens
ugaggaagucacuuuac

SEQ ID NO: 1189288 - RNA, 15 nt, Homo sapiens
ugaggacaaaaucac

SEQ ID NO: 1189289 - RNA, 13 nt, Homo sapiens
ugaggacuuuggu

SEQ ID NO: 1189290 - RNA, 22 nt, Homo sapiens
ugaggagcggacucacuugaug

SEQ ID NO: 1189291 - RNA, 17 nt, Homo sapiens
ugaggaggaacuguggc

SEQ ID NO: 1189292 - RNA, 16 nt, Homo sapiens
ugaggaggaugcuaaa

SEQ ID NO: 1189293 - RNA, 21 nt, Homo sapiens
ugaggcacaagaaucacuuga

SEQ ID NO: 1189294 - RNA, 22 nt, Homo sapiens
ugaggcagggauacucuguuuu

SEQ ID NO: 1189295 - RNA, 21 nt, Homo sapiens
ugaggcauccacuucuuucag

SEQ ID NO: 1189296 - RNA, 22 nt, Homo sapiens
ugaggcaugaguuacugugcau

SEQ ID NO: 1189297 - RNA, 19 nt, Homo sapiens
ugaggccucacuacucgag

SEQ ID NO: 1189298 - RNA, 18 nt, Homo sapiens
ugaggcuggcacaggaca

SEQ ID NO: 1189299 - RNA, 19 nt, Homo sapiens
ugagggaaugacaccauca

SEQ ID NO: 1189300 - RNA, 23 nt, Homo sapiens
ugaggggggggcauuagugcuga

SEQ ID NO: 1189301 - RNA, 21 nt, Homo sapiens
ugaggguccucaguccacugc

SEQ ID NO: 1189302 - RNA, 16 nt, Homo sapiens
ugaggguuugugcuac

SEQ ID NO: 1189303 - RNA, 12 nt, Homo sapiens
ugaggucagggg

SEQ ID NO: 1189304 - RNA, 21 nt, Homo sapiens
ugaggucagggggcacugucu

SEQ ID NO: 1189305 - RNA, 20 nt, Homo sapiens
ugagguggaagagggcugca

SEQ ID NO: 1189306 - RNA, 21 nt, Homo sapiens
ugagguggcuaagggggacca

SEQ ID NO: 1189307 - RNA, 22 nt, Homo sapiens
ugaggugguaguaaaacacaga

SEQ ID NO: 1189308 - RNA, 21 nt, Homo sapiens
ugagguugaccagcucugggg

SEQ ID NO: 1189309 - RNA, 21 nt, Homo sapiens
ugagguuucuuugacuucaau

SEQ ID NO: 1189310 - RNA, 18 nt, Homo sapiens
ugagguuuuuaacaugua

SEQ ID NO: 1189311 - RNA, 18 nt, Homo sapiens
ugaguaacaggugccuuc

SEQ ID NO: 1189312 - RNA, 16 nt, Homo sapiens
ugaguaaugguuacua

SEQ ID NO: 1189313 - RNA, 18 nt, Homo sapiens
ugaguaauuuucugaugg

SEQ ID NO: 1189314 - RNA, 23 nt, Homo sapiens
ugaguagcucuccugacuuuuaa

SEQ ID NO: 1189315 - RNA, 20 nt, Homo sapiens
ugaguagcuggauuacaggc

SEQ ID NO: 1189316 - RNA, 16 nt, Homo sapiens
ugaguauaaauuuacu

SEQ ID NO: 1189317 - RNA, 15 nt, Homo sapiens
ugagucagcaccuug

SEQ ID NO: 1189318 - RNA, 13 nt, Homo sapiens
ugagucuccugca

SEQ ID NO: 1189319 - RNA, 23 nt, Homo sapiens
ugagugcucuggggcacuguuga

SEQ ID NO: 1189320 - RNA, 17 nt, Homo sapiens
ugagugugugugcaugg

SEQ ID NO: 1189321 - RNA, 21 nt, Homo sapiens
ugaguuaacucacugagggua

SEQ ID NO: 1189322 - RNA, 17 nt, Homo sapiens
ugaguugcaccauucuu

SEQ ID NO: 1189323 - RNA, 19 nt, Homo sapiens
ugaguuuaaaucaagauua

SEQ ID NO: 1189324 - RNA, 22 nt, Homo sapiens
ugaguuucuuaacccuuuccag

SEQ ID NO: 1189325 - RNA, 19 nt, Homo sapiens
ugaguuuuuacaagaugua

SEQ ID NO: 1189326 - RNA, 22 nt, Homo sapiens
ugauaaaacugguuuuagacaa

SEQ ID NO: 1189327 - RNA, 14 nt, Homo sapiens
ugauaaacaguuuc

SEQ ID NO: 1189328 - RNA, 14 nt, Homo sapiens
ugauaaacuuugaa

SEQ ID NO: 1189329 - RNA, 21 nt, Homo sapiens
ugauaaagcuuaacacuugac

SEQ ID NO: 1189330 - RNA, 14 nt, Homo sapiens
ugauaacucaggaa

SEQ ID NO: 1189331 - RNA, 15 nt, Homo sapiens
ugauaagacaugaaa

SEQ ID NO: 1189332 - RNA, 14 nt, Homo sapiens
ugauaagauugaaa

SEQ ID NO: 1189333 - RNA, 16 nt, Homo sapiens
ugauaauagauucucu

SEQ ID NO: 1189334 - RNA, 13 nt, Homo sapiens
ugauaaugcucac

SEQ ID NO: 1189335 - RNA, 15 nt, Homo sapiens
ugauacauaugugaa

SEQ ID NO: 1189336 - RNA, 22 nt, Homo sapiens
ugauacauccaaagcagacagc

SEQ ID NO: 1189337 - RNA, 20 nt, Homo sapiens
ugauacuuacugaacugugu

SEQ ID NO: 1189338 - RNA, 17 nt, Homo sapiens
ugauagaacuguacugu

SEQ ID NO: 1189339 - RNA, 17 nt, Homo sapiens
ugauagauuugaccucc

SEQ ID NO: 1189340 - RNA, 20 nt, Homo sapiens
ugauaggacuaaguucucau

SEQ ID NO: 1189341 - RNA, 23 nt, Homo sapiens
ugauaguauuuucuacuagccau

SEQ ID NO: 1189342 - RNA, 13 nt, Homo sapiens
ugauaguuacuca

SEQ ID NO: 1189343 - RNA, 20 nt, Homo sapiens
ugauaguuggggaauuguga

SEQ ID NO: 1189344 - RNA, 21 nt, Homo sapiens
ugauauauaaaugugauugca

SEQ ID NO: 1189345 - RNA, 13 nt, Homo sapiens
ugauauugcagcu

SEQ ID NO: 1189346 - RNA, 15 nt, Homo sapiens
ugauauugcagcuua

SEQ ID NO: 1189347 - RNA, 15 nt, Homo sapiens
ugauauuguucucca

SEQ ID NO: 1189348 - RNA, 21 nt, Homo sapiens
ugauauuuccuucaccaccuc

SEQ ID NO: 1189349 - RNA, 18 nt, Homo sapiens
ugaucaaaggcacacagc

SEQ ID NO: 1189350 - RNA, 17 nt, Homo sapiens
ugaucaauuauaguuuc

SEQ ID NO: 1189351 - RNA, 17 nt, Homo sapiens
ugaucacucuuagacca

SEQ ID NO: 1189352 - RNA, 16 nt, Homo sapiens
ugaucagaaacagggu

SEQ ID NO: 1189353 - RNA, 20 nt, Homo sapiens
ugaucagacagcuugaauca

SEQ ID NO: 1189354 - RNA, 15 nt, Homo sapiens
ugaucaggcacagug

SEQ ID NO: 1189355 - RNA, 23 nt, Homo sapiens
ugaucaucugcugugacuguggc

SEQ ID NO: 1189356 - RNA, 22 nt, Homo sapiens
ugauccaagcaagacugagggg

SEQ ID NO: 1189357 - RNA, 22 nt, Homo sapiens
ugauccguguguaccaucuuug

SEQ ID NO: 1189358 - RNA, 13 nt, Homo sapiens
ugauccucagugc

SEQ ID NO: 1189359 - RNA, 13 nt, Homo sapiens
ugaucgaugauuc

SEQ ID NO: 1189360 - RNA, 13 nt, Homo sapiens
ugaucuauacaaa

SEQ ID NO: 1189361 - RNA, 16 nt, Homo sapiens
ugaucuauguuguuug

SEQ ID NO: 1189362 - RNA, 15 nt, Homo sapiens
ugaucuauuaaggga

SEQ ID NO: 1189363 - RNA, 20 nt, Homo sapiens
ugaucucaaguauaugucau

SEQ ID NO: 1189364 - RNA, 17 nt, Homo sapiens
ugaucuccugaccucau

SEQ ID NO: 1189365 - RNA, 22 nt, Homo sapiens
ugaucucgaacuccuaaccuca

SEQ ID NO: 1189366 - RNA, 17 nt, Homo sapiens
uggagcaaccuacuguc

SEQ ID NO: 1189367 - RNA, 12 nt, Homo sapiens
uggagcauuuau

SEQ ID NO: 1189368 - RNA, 23 nt, Homo sapiens
uggagccuuuuaacugugcaaua

SEQ ID NO: 1189369 - RNA, 15 nt, Homo sapiens
uggaggaacagggcu

SEQ ID NO: 1189370 - RNA, 21 nt, Homo sapiens
uggaggaacagggcuggaaag

SEQ ID NO: 1189371 - RNA, 19 nt, Homo sapiens
uggaggcacccaugccauc

SEQ ID NO: 1189372 - RNA, 19 nt, Homo sapiens
uggaggcaugcuaagaaua

SEQ ID NO: 1189373 - RNA, 22 nt, Homo sapiens
uggaggcccaguucacccugau

SEQ ID NO: 1189374 - RNA, 15 nt, Homo sapiens
uggaggccucaggga

SEQ ID NO: 1189375 - RNA, 21 nt, Homo sapiens
uggagggaccuugucucccag

SEQ ID NO: 1189376 - RNA, 23 nt, Homo sapiens
uggagggagaagcugucagggac

SEQ ID NO: 1189377 - RNA, 16 nt, Homo sapiens
uggagggcucagggca

SEQ ID NO: 1189378 - RNA, 15 nt, Homo sapiens
uggagggucucuagu

SEQ ID NO: 1189379 - RNA, 24 nt, Homo sapiens
uggagguauucaauauccuuugcc

SEQ ID NO: 1189380 - RNA, 13 nt, Homo sapiens
uggagguugcauu

SEQ ID NO: 1189381 - RNA, 14 nt, Homo sapiens
uggaguacacagcu

SEQ ID NO: 1189382 - RNA, 12 nt, Homo sapiens
uggagucuugca

SEQ ID NO: 1189383 - RNA, 12 nt, Homo sapiens
uggagugcaaug

SEQ ID NO: 1189384 - RNA, 18 nt, Homo sapiens
uggaguggggaagugugu

SEQ ID NO: 1189385 - RNA, 20 nt, Homo sapiens
uggaguggggaaguguguca

SEQ ID NO: 1189386 - RNA, 19 nt, Homo sapiens
uggaguguuauguauuucc

SEQ ID NO: 1189387 - RNA, 22 nt, Homo sapiens
uggauaaaaaagaaaacauucc

SEQ ID NO: 1189388 - RNA, 13 nt, Homo sapiens
uggauaacaaaga

SEQ ID NO: 1189389 - RNA, 17 nt, Homo sapiens
uggauaaccacagggcu

SEQ ID NO: 1189390 - RNA, 23 nt, Homo sapiens
uggauaaccacagggcugggcua

SEQ ID NO: 1189391 - RNA, 16 nt, Homo sapiens
uggauacugcugccaa

SEQ ID NO: 1189392 - RNA, 16 nt, Homo sapiens
uggauaucauacuucc

SEQ ID NO: 1189393 - RNA, 19 nt, Homo sapiens
uggaucaacuaauguuguu

SEQ ID NO: 1189394 - RNA, 22 nt, Homo sapiens
uggaucuaccagcauaaauauc

SEQ ID NO: 1189395 - RNA, 19 nt, Homo sapiens
uggaucuggggacugagug

SEQ ID NO: 1189396 - RNA, 13 nt, Homo sapiens
uggaugcggccau

SEQ ID NO: 1189397 - RNA, 14 nt, Homo sapiens
uggauggaaaggga

SEQ ID NO: 1189398 - RNA, 16 nt, Homo sapiens
uggaugggggaacuca

SEQ ID NO: 1189399 - RNA, 23 nt, Homo sapiens
uggauguauggggaaucuaagag

SEQ ID NO: 1189400 - RNA, 15 nt, Homo sapiens
uggauuccaccaaca

SEQ ID NO: 1189401 - RNA, 13 nt, Homo sapiens
uggcaaaagaaaa

SEQ ID NO: 1189402 - RNA, 17 nt, Homo sapiens
uggcaacagaaaacaau

SEQ ID NO: 1189403 - RNA, 23 nt, Homo sapiens
uggcaagacugucuuaccuggca

SEQ ID NO: 1189404 - RNA, 15 nt, Homo sapiens
uggcaaggagccagg

SEQ ID NO: 1189405 - RNA, 15 nt, Homo sapiens
uggcaaggugacauu

SEQ ID NO: 1189406 - RNA, 14 nt, Homo sapiens
uggcacacaccagu

SEQ ID NO: 1189407 - RNA, 21 nt, Homo sapiens
uggcacuaaagaauacauuua

SEQ ID NO: 1189408 - RNA, 15 nt, Homo sapiens
uggcacuauccagau

SEQ ID NO: 1189409 - RNA, 23 nt, Homo sapiens
uggcacuccucucgcauggugug

SEQ ID NO: 1189410 - RNA, 18 nt, Homo sapiens
uggcacugagaaagccaa

SEQ ID NO: 1189411 - RNA, 15 nt, Homo sapiens
uggcacugcagguga

SEQ ID NO: 1189412 - RNA, 12 nt, Homo sapiens
uggcagagccag

SEQ ID NO: 1189413 - RNA, 17 nt, Homo sapiens
uggcagcucagcuuccc

SEQ ID NO: 1189414 - RNA, 14 nt, Homo sapiens
uggcagcugcaaua

SEQ ID NO: 1189415 - RNA, 19 nt, Homo sapiens
uggcagcugccccuggcac

SEQ ID NO: 1189416 - RNA, 16 nt, Homo sapiens
uggcaggaugaugcug

SEQ ID NO: 1189417 - RNA, 17 nt, Homo sapiens
uggcagucccuuauaau

SEQ ID NO: 1189418 - RNA, 21 nt, Homo sapiens
uggcaguuuuuaaaauuggcc

SEQ ID NO: 1189419 - RNA, 16 nt, Homo sapiens
uggcaucuccauguag

SEQ ID NO: 1189420 - RNA, 16 nt, Homo sapiens
uggcaugcaccugcaa

SEQ ID NO: 1189421 - RNA, 19 nt, Homo sapiens
uggcaugcgccaccaugcc

SEQ ID NO: 1189422 - RNA, 21 nt, Homo sapiens
uggcauucuuugcaauacugc

SEQ ID NO: 1189423 - RNA, 11 nt, Homo sapiens
uggcauuucaa

SEQ ID NO: 1189424 - RNA, 14 nt, Homo sapiens
uggccaacauggug

SEQ ID NO: 1189425 - RNA, 20 nt, Homo sapiens
uggccaagaaaauugccuuu

SEQ ID NO: 1189426 - RNA, 23 nt, Homo sapiens
uggccaagaagauaggcucucag

SEQ ID NO: 1189427 - RNA, 17 nt, Homo sapiens
uggccaaggagcugcua

SEQ ID NO: 1189428 - RNA, 22 nt, Homo sapiens
uggccacaccugggucuuuaug

SEQ ID NO: 1189429 - RNA, 16 nt, Homo sapiens
uggccacacugugaca

SEQ ID NO: 1189430 - RNA, 21 nt, Homo sapiens
uggccacacugugacacacua

SEQ ID NO: 1189431 - RNA, 15 nt, Homo sapiens
uggccaggacauuug

SEQ ID NO: 1189432 - RNA, 15 nt, Homo sapiens
uggccagguaugcau

SEQ ID NO: 1189433 - RNA, 16 nt, Homo sapiens
uggccagugacguggu

SEQ ID NO: 1189434 - RNA, 12 nt, Homo sapiens
uggccauucuuu

SEQ ID NO: 1189435 - RNA, 13 nt, Homo sapiens
uggccauuuggcc

SEQ ID NO: 1189436 - RNA, 14 nt, Homo sapiens
uggcccaaccagac

SEQ ID NO: 1189437 - RNA, 12 nt, Homo sapiens
uggcccagguga

SEQ ID NO: 1189438 - RNA, 14 nt, Homo sapiens
uggccggcuggaaa

SEQ ID NO: 1189439 - RNA, 16 nt, Homo sapiens
uggccuagagcacucu

SEQ ID NO: 1189440 - RNA, 13 nt, Homo sapiens
uggccuaugcaca

SEQ ID NO: 1189441 - RNA, 18 nt, Homo sapiens
uggccuaugcacauaugg

SEQ ID NO: 1189442 - RNA, 22 nt, Homo sapiens
uggccuaugcacauauggacuc

SEQ ID NO: 1189443 - RNA, 17 nt, Homo sapiens
uggccucaagugagcca

SEQ ID NO: 1189444 - RNA, 24 nt, Homo sapiens
uggccucccacggugcugagacua

SEQ ID NO: 1189445 - RNA, 14 nt, Homo sapiens
uggccucccgccaa

SEQ ID NO: 1189446 - RNA, 17 nt, Homo sapiens
uggccugaacagaugua

SEQ ID NO: 1189447 - RNA, 11 nt, Homo sapiens
uggccugagag

SEQ ID NO: 1189448 - RNA, 14 nt, Homo sapiens
uggccugccagaca

SEQ ID NO: 1189449 - RNA, 19 nt, Homo sapiens
uggccugcugggcucucca

SEQ ID NO: 1189450 - RNA, 23 nt, Homo sapiens
uggccugcugggcucuccaccuc

SEQ ID NO: 1189451 - RNA, 18 nt, Homo sapiens
uggccuggcacacaucag

SEQ ID NO: 1189452 - RNA, 15 nt, Homo sapiens
uggccuggcaucugu

SEQ ID NO: 1189453 - RNA, 19 nt, Homo sapiens
uggccuugguaugugccag

SEQ ID NO: 1189454 - RNA, 20 nt, Homo sapiens
uggcgagugaaugccagugu

SEQ ID NO: 1189455 - RNA, 18 nt, Homo sapiens
uggcgggugccuguaauc

SEQ ID NO: 1189456 - RNA, 15 nt, Homo sapiens
uggcggguggcugca

SEQ ID NO: 1189457 - RNA, 19 nt, Homo sapiens
uggcggugaaaauuucaac

SEQ ID NO: 1189458 - RNA, 15 nt, Homo sapiens
uggcgugagcugccc

SEQ ID NO: 1189459 - RNA, 22 nt, Homo sapiens
uggcguuacugcuugaccaaag

SEQ ID NO: 1189460 - RNA, 23 nt, Homo sapiens
uggcguuacugcuugaccaaaga

SEQ ID NO: 1189461 - RNA, 16 nt, Homo sapiens
uggcuaagaguguccu

SEQ ID NO: 1189462 - RNA, 16 nt, Homo sapiens
uggcuaagggggacca

SEQ ID NO: 1189463 - RNA, 13 nt, Homo sapiens
uggcuaccuguaa

SEQ ID NO: 1189464 - RNA, 17 nt, Homo sapiens
uggcuagagggcccaaa

SEQ ID NO: 1189465 - RNA, 15 nt, Homo sapiens
uggcucacaccugua

SEQ ID NO: 1189466 - RNA, 16 nt, Homo sapiens
uggcucacaccuguaa

SEQ ID NO: 1189467 - RNA, 21 nt, Homo sapiens
uggcucagucagacauggcca

SEQ ID NO: 1189468 - RNA, 12 nt, Homo sapiens
uggcucaucucu

SEQ ID NO: 1189469 - RNA, 21 nt, Homo sapiens
uggcucaugccucuaaucuca

SEQ ID NO: 1189470 - RNA, 14 nt, Homo sapiens
uggcuccaaacccu

SEQ ID NO: 1189471 - RNA, 18 nt, Homo sapiens
uggcuccacccucuuuag

SEQ ID NO: 1189472 - RNA, 14 nt, Homo sapiens
uggcuccacuggga

SEQ ID NO: 1189473 - RNA, 15 nt, Homo sapiens
uggcucccaaauucc

SEQ ID NO: 1189474 - RNA, 20 nt, Homo sapiens
uggcucuacguuuaggcacc

SEQ ID NO: 1189475 - RNA, 14 nt, Homo sapiens
uggcucugaccgaa

SEQ ID NO: 1189476 - RNA, 16 nt, Homo sapiens
uggcucugcaccugua

SEQ ID NO: 1189477 - RNA, 12 nt, Homo sapiens
uggcucugggcc

SEQ ID NO: 1189478 - RNA, 24 nt, Homo sapiens
uggcuggauuuguauuacacacag

SEQ ID NO: 1189479 - RNA, 22 nt, Homo sapiens
uggcuguggaccacccuagcac

SEQ ID NO: 1189480 - RNA, 13 nt, Homo sapiens
uggcuucacauuc

SEQ ID NO: 1189481 - RNA, 16 nt, Homo sapiens
uggcuucuacacuggg

SEQ ID NO: 1189482 - RNA, 15 nt, Homo sapiens
uggcuucuuacugaa

SEQ ID NO: 1189483 - RNA, 15 nt, Homo sapiens
uggcuuggcaucugu

SEQ ID NO: 1189484 - RNA, 17 nt, Homo sapiens
uggcuuggcaucugugu

SEQ ID NO: 1189485 - RNA, 14 nt, Homo sapiens
uggcuuucauccaa

SEQ ID NO: 1189486 - RNA, 16 nt, Homo sapiens
uggcuuuucuuucuac

SEQ ID NO: 1189487 - RNA, 16 nt, Homo sapiens
ugggaaaagagucucu

SEQ ID NO: 1189488 - RNA, 15 nt, Homo sapiens
ugggaaaaugcacac

SEQ ID NO: 1189489 - RNA, 14 nt, Homo sapiens
ugggaaacugcucc

SEQ ID NO: 1189490 - RNA, 16 nt, Homo sapiens
ugggaaagauuacuuu

SEQ ID NO: 1189491 - RNA, 23 nt, Homo sapiens
ugggaaagggcgaacgaggauua

SEQ ID NO: 1189492 - RNA, 21 nt, Homo sapiens
ugggaaauauuuagcaaauaa

SEQ ID NO: 1189493 - RNA, 19 nt, Homo sapiens
ugggaaaugagcagggaug

SEQ ID NO: 1189494 - RNA, 18 nt, Homo sapiens
ugggaacugaaucaggaa

SEQ ID NO: 1189495 - RNA, 15 nt, Homo sapiens
ugggaagacuguugu

SEQ ID NO: 1189496 - RNA, 19 nt, Homo sapiens
ugggaaggugccacuggua

SEQ ID NO: 1189497 - RNA, 15 nt, Homo sapiens
ugggaauaaaucaua

SEQ ID NO: 1189498 - RNA, 22 nt, Homo sapiens
ugggaauaauagacacugggga

SEQ ID NO: 1189499 - RNA, 20 nt, Homo sapiens
uuauguauguauguauuuau

SEQ ID NO: 1189500 - RNA, 16 nt, Homo sapiens
uuaugucucagaccac

SEQ ID NO: 1189501 - RNA, 20 nt, Homo sapiens
uuaugugagagaaaguguga

SEQ ID NO: 1189502 - RNA, 23 nt, Homo sapiens
uuauguuaaaucaauaaagacca

SEQ ID NO: 1189503 - RNA, 13 nt, Homo sapiens
uuauuaaaauucu

SEQ ID NO: 1189504 - RNA, 15 nt, Homo sapiens
uuauuaucuucuuaa

SEQ ID NO: 1189505 - RNA, 17 nt, Homo sapiens
uuauuccuacaaguuua

SEQ ID NO: 1189506 - RNA, 15 nt, Homo sapiens
uuauucuacaucauu

SEQ ID NO: 1189507 - RNA, 14 nt, Homo sapiens
uuauucucaagaag

SEQ ID NO: 1189508 - RNA, 15 nt, Homo sapiens
uuauucugcuaaaga

SEQ ID NO: 1189509 - RNA, 21 nt, Homo sapiens
uuauucuuuccuucuuucauu

SEQ ID NO: 1189510 - RNA, 16 nt, Homo sapiens
uuauugacucauacac

SEQ ID NO: 1189511 - RNA, 12 nt, Homo sapiens
uuauugcaaugc

SEQ ID NO: 1189512 - RNA, 15 nt, Homo sapiens
uuauugcacauuguu

SEQ ID NO: 1189513 - RNA, 23 nt, Homo sapiens
uuauugccuggagugugaacugu

SEQ ID NO: 1189514 - RNA, 19 nt, Homo sapiens
uuauugugcuucagugcca

SEQ ID NO: 1189515 - RNA, 19 nt, Homo sapiens
uuauuguggauaacaaaga

SEQ ID NO: 1189516 - RNA, 15 nt, Homo sapiens
uuauuuaacuauuca

SEQ ID NO: 1189517 - RNA, 23 nt, Homo sapiens
uuauuuaccugaaauaaaauuca

SEQ ID NO: 1189518 - RNA, 18 nt, Homo sapiens
uuauuucaaccagcacau

SEQ ID NO: 1189519 - RNA, 12 nt, Homo sapiens
uuauuucauuca

SEQ ID NO: 1189520 - RNA, 14 nt, Homo sapiens
uuauuucugaucua

SEQ ID NO: 1189521 - RNA, 20 nt, Homo sapiens
uuauuucugaucuauacaaa

SEQ ID NO: 1189522 - RNA, 19 nt, Homo sapiens
uuauuuguauuuucaagac

SEQ ID NO: 1189523 - RNA, 17 nt, Homo sapiens
uucaaaaacacaguguu

SEQ ID NO: 1189524 - RNA, 14 nt, Homo sapiens
uucaaaaguggagu

SEQ ID NO: 1189525 - RNA, 12 nt, Homo sapiens
uucaaacuuaaa

SEQ ID NO: 1189526 - RNA, 17 nt, Homo sapiens
uucaaagcaaagcucuu

SEQ ID NO: 1189527 - RNA, 13 nt, Homo sapiens
uucaaagcucuaa

SEQ ID NO: 1189528 - RNA, 15 nt, Homo sapiens
uucaaaggugauuau

SEQ ID NO: 1189529 - RNA, 19 nt, Homo sapiens
uucaacaguuuuugcuaau

SEQ ID NO: 1189530 - RNA, 19 nt, Homo sapiens
uucaacauuuacauguauu

SEQ ID NO: 1189531 - RNA, 16 nt, Homo sapiens
uucaacuugcauccaa

SEQ ID NO: 1189532 - RNA, 21 nt, Homo sapiens
uucaacuuugaauaaagaaua

SEQ ID NO: 1189533 - RNA, 23 nt, Homo sapiens
uucaagcgauuuuccugcuucau

SEQ ID NO: 1189534 - RNA, 18 nt, Homo sapiens
uucaaggcaucaugcaga

SEQ ID NO: 1189535 - RNA, 16 nt, Homo sapiens
uucaaguaauugugaa

SEQ ID NO: 1189536 - RNA, 11 nt, Homo sapiens
uucaagugauu

SEQ ID NO: 1189537 - RNA, 14 nt, Homo sapiens
uucacaaaacauua

SEQ ID NO: 1189538 - RNA, 21 nt, Homo sapiens
uucacaaggucuuuaaaguga

SEQ ID NO: 1189539 - RNA, 15 nt, Homo sapiens
uucacaaugaaaugc

SEQ ID NO: 1189540 - RNA, 23 nt, Homo sapiens
uucacagugcuggggaacaacca

SEQ ID NO: 1189541 - RNA, 17 nt, Homo sapiens
uucacaucagaacagac

SEQ ID NO: 1189542 - RNA, 16 nt, Homo sapiens
uucacaucuaaccuca

SEQ ID NO: 1189543 - RNA, 17 nt, Homo sapiens
uucacauuagaagacaa

SEQ ID NO: 1189544 - RNA, 10 nt, Homo sapiens
uucacauucu

SEQ ID NO: 1189545 - RNA, 13 nt, Homo sapiens
uucaccaucaugu

SEQ ID NO: 1189546 - RNA, 16 nt, Homo sapiens
uucaccaucccaaagc

SEQ ID NO: 1189547 - RNA, 23 nt, Homo sapiens
uucaccuauuaccaguguucccu

SEQ ID NO: 1189548 - RNA, 16 nt, Homo sapiens
uucacucaacaaacau

SEQ ID NO: 1189549 - RNA, 22 nt, Homo sapiens
uucacugccccagacacagugc

SEQ ID NO: 1189550 - RNA, 22 nt, Homo sapiens
uucacugcuacaugugcuggaa

SEQ ID NO: 1189551 - RNA, 22 nt, Homo sapiens
uucacuuuucugaguucuugaa

SEQ ID NO: 1189552 - RNA, 15 nt, Homo sapiens
uucacuuuugacaaa

SEQ ID NO: 1189553 - RNA, 20 nt, Homo sapiens
uucagaacagaggcauuuaa

SEQ ID NO: 1189554 - RNA, 14 nt, Homo sapiens
uucagacaccuguu

SEQ ID NO: 1189555 - RNA, 21 nt, Homo sapiens
uucagaccacaaggggcucca

SEQ ID NO: 1189556 - RNA, 23 nt, Homo sapiens
uucagacucccauuccugaagaa

SEQ ID NO: 1189557 - RNA, 23 nt, Homo sapiens
uucagauaauugaauaaguaccu

SEQ ID NO: 1189558 - RNA, 18 nt, Homo sapiens
uucagcaccgauggccau

SEQ ID NO: 1189559 - RNA, 17 nt, Homo sapiens
uucagcagcagcucaca

SEQ ID NO: 1189560 - RNA, 22 nt, Homo sapiens
uucagcaugccccccucuucac

SEQ ID NO: 1189561 - RNA, 22 nt, Homo sapiens
uucagcuccagccccuuuccaa

SEQ ID NO: 1189562 - RNA, 19 nt, Homo sapiens
uucagcuuuucagugaaug

SEQ ID NO: 1189563 - RNA, 15 nt, Homo sapiens
uucagggaacugcau

SEQ ID NO: 1189564 - RNA, 16 nt, Homo sapiens
uucagggaaggaacuc

SEQ ID NO: 1189565 - RNA, 18 nt, Homo sapiens
uucagguccaggcugugu

SEQ ID NO: 1189566 - RNA, 19 nt, Homo sapiens
uucaggugugacucuagca

SEQ ID NO: 1189567 - RNA, 17 nt, Homo sapiens
uucagguuagugacauu

SEQ ID NO: 1189568 - RNA, 17 nt, Homo sapiens
uucaguaauguugacug

SEQ ID NO: 1189569 - RNA, 19 nt, Homo sapiens
uucagucuuuucucugaaa

SEQ ID NO: 1189570 - RNA, 19 nt, Homo sapiens
uucagugcaccugccucag

SEQ ID NO: 1189571 - RNA, 18 nt, Homo sapiens
uucagugcuguacuugau

SEQ ID NO: 1189572 - RNA, 15 nt, Homo sapiens
uucaguguaauguga

SEQ ID NO: 1189573 - RNA, 22 nt, Homo sapiens
uucaguuucuucugcgccucag

SEQ ID NO: 1189574 - RNA, 17 nt, Homo sapiens
uucauaaagucuugccu

SEQ ID NO: 1189575 - RNA, 21 nt, Homo sapiens
uucauaguuucaaaucuguaa

SEQ ID NO: 1189576 - RNA, 13 nt, Homo sapiens
uucauauaacguc

SEQ ID NO: 1189577 - RNA, 15 nt, Homo sapiens
uucauauccauagau

SEQ ID NO: 1189578 - RNA, 20 nt, Homo sapiens
uucauaucucucccuucuuu

SEQ ID NO: 1189579 - RNA, 13 nt, Homo sapiens
uucaucacacugg

SEQ ID NO: 1189580 - RNA, 22 nt, Homo sapiens
uucaucauugcuugcuugccuu

SEQ ID NO: 1189581 - RNA, 17 nt, Homo sapiens
uucauccagcuacuuag

SEQ ID NO: 1189582 - RNA, 20 nt, Homo sapiens
uucaucucaggccucccuca

SEQ ID NO: 1189583 - RNA, 17 nt, Homo sapiens
uucaucucuucaugaau

SEQ ID NO: 1189584 - RNA, 21 nt, Homo sapiens
uucaucugggaaagacaucca

SEQ ID NO: 1189585 - RNA, 15 nt, Homo sapiens
uucaucuucaccaga

SEQ ID NO: 1189586 - RNA, 15 nt, Homo sapiens
uucaugaucaucaca

SEQ ID NO: 1189587 - RNA, 12 nt, Homo sapiens
uucaugcacugu

SEQ ID NO: 1189588 - RNA, 19 nt, Homo sapiens
uucaugcaggugaaaccca

SEQ ID NO: 1189589 - RNA, 21 nt, Homo sapiens
uucauuaccuuuuuugauaaa

SEQ ID NO: 1189590 - RNA, 19 nt, Homo sapiens
uucauucacucaacaaaca

SEQ ID NO: 1189591 - RNA, 13 nt, Homo sapiens
uucauucaugcca

SEQ ID NO: 1189592 - RNA, 21 nt, Homo sapiens
uucauucccaagguuacugga

SEQ ID NO: 1189593 - RNA, 16 nt, Homo sapiens
uucauucuguauguga

SEQ ID NO: 1189594 - RNA, 14 nt, Homo sapiens
uucauuuacucacc

SEQ ID NO: 1189595 - RNA, 16 nt, Homo sapiens
uucauuuguggugaua

SEQ ID NO: 1189596 - RNA, 18 nt, Homo sapiens
uucauuuuaaauauuguc

SEQ ID NO: 1189597 - RNA, 18 nt, Homo sapiens
uucauuuuauauugaaaa

SEQ ID NO: 1189598 - RNA, 14 nt, Homo sapiens
uuccaaauucacaa

SEQ ID NO: 1189599 - RNA, 23 nt, Homo sapiens
uuccaagacucuagaguccaagg

SEQ ID NO: 1189600 - RNA, 20 nt, Homo sapiens
uuccacaccuagcaucucau

SEQ ID NO: 1189601 - RNA, 12 nt, Homo sapiens
uuccaccagagc

SEQ ID NO: 1189602 - RNA, 21 nt, Homo sapiens
uuccacccacguggagacagc

SEQ ID NO: 1189603 - RNA, 23 nt, Homo sapiens
uuccacccacguggagacagcuu

SEQ ID NO: 1189604 - RNA, 14 nt, Homo sapiens
uuccaccucaccuc

SEQ ID NO: 1189605 - RNA, 20 nt, Homo sapiens
uuccagaaaacaaaacugca

SEQ ID NO: 1189606 - RNA, 18 nt, Homo sapiens
uuccagcauguugcaucu

SEQ ID NO: 1189607 - RNA, 21 nt, Homo sapiens
uuccagcauguuucucccauu

SEQ ID NO: 1189608 - RNA, 16 nt, Homo sapiens
uuccagccuaucuaau

SEQ ID NO: 1189609 - RNA, 20 nt, Homo sapiens
uuccaggaccagaagcauuu

SEQ ID NO: 1189610 - RNA, 14 nt, Homo sapiens
uuccagguguuacu

SEQ ID NO: 1189611 - RNA, 14 nt, Homo sapiens
uuccaguaaucuga

SEQ ID NO: 1189612 - RNA, 17 nt, Homo sapiens
uuccagugcagagaucc

SEQ ID NO: 1189613 - RNA, 18 nt, Homo sapiens
uuccagugcugcaugcga

SEQ ID NO: 1189614 - RNA, 22 nt, Homo sapiens
uuccaguugcaauucauaacua

SEQ ID NO: 1189615 - RNA, 17 nt, Homo sapiens
uuccauaaugcuacugu

SEQ ID NO: 1189616 - RNA, 14 nt, Homo sapiens
uuccaucagcacaa

SEQ ID NO: 1189617 - RNA, 15 nt, Homo sapiens
uuccaucagcacaaa

SEQ ID NO: 1189618 - RNA, 13 nt, Homo sapiens
uuccaucuuguaa

SEQ ID NO: 1189619 - RNA, 12 nt, Homo sapiens
uuccauucuugg

SEQ ID NO: 1189620 - RNA, 15 nt, Homo sapiens
uuccauucuuggcau

SEQ ID NO: 1189621 - RNA, 16 nt, Homo sapiens
uuccauucuuucuucc

SEQ ID NO: 1189622 - RNA, 16 nt, Homo sapiens
uuccauuugcaaggga

SEQ ID NO: 1189623 - RNA, 23 nt, Homo sapiens
uuccauuuuuauuucaaaauaua

SEQ ID NO: 1189624 - RNA, 20 nt, Homo sapiens
uucccaagcucuagugggaa

SEQ ID NO: 1189625 - RNA, 20 nt, Homo sapiens
uucccaccugcuggagugaa

SEQ ID NO: 1189626 - RNA, 22 nt, Homo sapiens
uucccacucagcacucagagac

SEQ ID NO: 1189627 - RNA, 17 nt, Homo sapiens
uucccagcuacaccuuu

SEQ ID NO: 1189628 - RNA, 15 nt, Homo sapiens
uucccaggaguacac

SEQ ID NO: 1189629 - RNA, 14 nt, Homo sapiens
uucccauccagcuc

SEQ ID NO: 1189630 - RNA, 18 nt, Homo sapiens
uucccauuggaugcauuu

SEQ ID NO: 1189631 - RNA, 13 nt, Homo sapiens
caauaacauuccc

SEQ ID NO: 1189632 - RNA, 23 nt, Homo sapiens
caauacaaaaauaccuacugcug

SEQ ID NO: 1189633 - RNA, 20 nt, Homo sapiens
caauacaguuuauaaagcca

SEQ ID NO: 1189634 - RNA, 23 nt, Homo sapiens
caauacauuuguauuuugugaug

SEQ ID NO: 1189635 - RNA, 15 nt, Homo sapiens
caauaccugcugaga

SEQ ID NO: 1189636 - RNA, 14 nt, Homo sapiens
caauagauauuuac

SEQ ID NO: 1189637 - RNA, 14 nt, Homo sapiens
caauauaguauucu

SEQ ID NO: 1189638 - RNA, 14 nt, Homo sapiens
caauaucuugccag

SEQ ID NO: 1189639 - RNA, 16 nt, Homo sapiens
caauauuaacauaaga

SEQ ID NO: 1189640 - RNA, 16 nt, Homo sapiens
caauauuagcaagaca

SEQ ID NO: 1189641 - RNA, 22 nt, Homo sapiens
caauauuugcuaaacauuugcu

SEQ ID NO: 1189642 - RNA, 13 nt, Homo sapiens
caaucacugaaac

SEQ ID NO: 1189643 - RNA, 20 nt, Homo sapiens
caaucccaacguuuuacaua

SEQ ID NO: 1189644 - RNA, 10 nt, Homo sapiens
caaucccuca

SEQ ID NO: 1189645 - RNA, 15 nt, Homo sapiens
caauccuccuaccuc

SEQ ID NO: 1189646 - RNA, 20 nt, Homo sapiens
caaucucccacagggugcug

SEQ ID NO: 1189647 - RNA, 19 nt, Homo sapiens
caaucucguuuagugccaa

SEQ ID NO: 1189648 - RNA, 18 nt, Homo sapiens
caaucucugccauaucag

SEQ ID NO: 1189649 - RNA, 14 nt, Homo sapiens
caaucuucuacuuu

SEQ ID NO: 1189650 - RNA, 18 nt, Homo sapiens
caaugaaauauugcugua

SEQ ID NO: 1189651 - RNA, 20 nt, Homo sapiens
caaugaaauauugcuguaua

SEQ ID NO: 1189652 - RNA, 14 nt, Homo sapiens
caaugaacacuuaa

SEQ ID NO: 1189653 - RNA, 23 nt, Homo sapiens
caaugaagaauauaccauuucaa

SEQ ID NO: 1189654 - RNA, 21 nt, Homo sapiens
caaugacauuuauaucacaug

SEQ ID NO: 1189655 - RNA, 15 nt, Homo sapiens
caaugaccuggagca

SEQ ID NO: 1189656 - RNA, 14 nt, Homo sapiens
caaugauuccagac

SEQ ID NO: 1189657 - RNA, 14 nt, Homo sapiens
caaugcacauuuac

SEQ ID NO: 1189658 - RNA, 11 nt, Homo sapiens
caaugccaucu

SEQ ID NO: 1189659 - RNA, 11 nt, Homo sapiens
caaugccauug

SEQ ID NO: 1189660 - RNA, 23 nt, Homo sapiens
caaugccccuggaucuaccagca

SEQ ID NO: 1189661 - RNA, 14 nt, Homo sapiens
cagugauccugcaa

SEQ ID NO: 1189662 - RNA, 16 nt, Homo sapiens
cagugaugaugcaugg

SEQ ID NO: 1189663 - RNA, 23 nt, Homo sapiens
cagugaugcugugcuaugaauuu

SEQ ID NO: 1189664 - RNA, 18 nt, Homo sapiens
cagugcaaauacucuggu

SEQ ID NO: 1189665 - RNA, 13 nt, Homo sapiens
cagugcacaugaa

SEQ ID NO: 1189666 - RNA, 13 nt, Homo sapiens
cagugcagacuca

SEQ ID NO: 1189667 - RNA, 10 nt, Homo sapiens
cagugcaguc

SEQ ID NO: 1189668 - RNA, 21 nt, Homo sapiens
cagugcccagcugggggucaa

SEQ ID NO: 1189669 - RNA, 18 nt, Homo sapiens
cagugccuucucucagcu

SEQ ID NO: 1189670 - RNA, 12 nt, Homo sapiens
cagugcucccuc

SEQ ID NO: 1189671 - RNA, 15 nt, Homo sapiens
cagugcucugccucu

SEQ ID NO: 1189672 - RNA, 19 nt, Homo sapiens
cagugcugcccaugagcaa

SEQ ID NO: 1189673 - RNA, 19 nt, Homo sapiens
caguggauggauucaucau

SEQ ID NO: 1189674 - RNA, 13 nt, Homo sapiens
caguggauguaua

SEQ ID NO: 1189675 - RNA, 23 nt, Homo sapiens
caguggccccaucauagccugca

SEQ ID NO: 1189676 - RNA, 18 nt, Homo sapiens
caguggcuuagcugccau

SEQ ID NO: 1189677 - RNA, 22 nt, Homo sapiens
caguguaauaauaaaucguccu

SEQ ID NO: 1189678 - RNA, 20 nt, Homo sapiens
caguguauagaaaaaccaaa

SEQ ID NO: 1189679 - RNA, 15 nt, Homo sapiens
cagugugacacugcu

SEQ ID NO: 1189680 - RNA, 11 nt, Homo sapiens
cagugugaguu

SEQ ID NO: 1189681 - RNA, 21 nt, Homo sapiens
caguguucagccaaacaguau

SEQ ID NO: 1189682 - RNA, 20 nt, Homo sapiens
caguguugccucuugcaaug

SEQ ID NO: 1189683 - RNA, 18 nt, Homo sapiens
caguuaaaauguguuucu

SEQ ID NO: 1189684 - RNA, 19 nt, Homo sapiens
caguuacagaaaguggugc

SEQ ID NO: 1189685 - RNA, 20 nt, Homo sapiens
caguuacucccuacacugau

SEQ ID NO: 1189686 - RNA, 17 nt, Homo sapiens
caguucaccugcacuua

SEQ ID NO: 1189687 - RNA, 23 nt, Homo sapiens
caguucacuucuuugcagagccu

SEQ ID NO: 1189688 - RNA, 12 nt, Homo sapiens
caguucagauaa

SEQ ID NO: 1189689 - RNA, 13 nt, Homo sapiens
caguuccagcuuu

SEQ ID NO: 1189690 - RNA, 21 nt, Homo sapiens
caguucuaaaaagauguaaua

SEQ ID NO: 1189691 - RNA, 18 nt, Homo sapiens
caguucugccuuaucuaa

SEQ ID NO: 1189692 - RNA, 19 nt, Homo sapiens
caguucuuagauucagggg

SEQ ID NO: 1189693 - RNA, 15 nt, Homo sapiens
caguugauuuccaac

SEQ ID NO: 1189694 - RNA, 13 nt, Homo sapiens
caguugugacaau

SEQ ID NO: 1189695 - RNA, 18 nt, Homo sapiens
caguuguggugugccaug

SEQ ID NO: 1189696 - RNA, 22 nt, Homo sapiens
caguuguuuggagaacaacaag

SEQ ID NO: 1189697 - RNA, 15 nt, Homo sapiens
caguuuagcaagcaa

SEQ ID NO: 1189698 - RNA, 17 nt, Homo sapiens
caguuuauaaagccaag

SEQ ID NO: 1189699 - RNA, 14 nt, Homo sapiens
caguuuauaccuug

SEQ ID NO: 1189700 - RNA, 18 nt, Homo sapiens
caguuugagacuccaagc

SEQ ID NO: 1189701 - RNA, 21 nt, Homo sapiens
caguuugugcucuacuguuac

SEQ ID NO: 1189702 - RNA, 23 nt, Homo sapiens
caguuuuaaaaaaaacaauucca

SEQ ID NO: 1189703 - RNA, 15 nt, Homo sapiens
caguuuuucugccuu

SEQ ID NO: 1189704 - RNA, 17 nt, Homo sapiens
caguuuuuuguuguuau

SEQ ID NO: 1189705 - RNA, 19 nt, Homo sapiens
cauaaaaauuuuuccugag

SEQ ID NO: 1189706 - RNA, 19 nt, Homo sapiens
caugaaauggauacuuaua

SEQ ID NO: 1189707 - RNA, 15 nt, Homo sapiens
caugaacaccauacc

SEQ ID NO: 1189708 - RNA, 16 nt, Homo sapiens
caugaagggucccuga

SEQ ID NO: 1189709 - RNA, 12 nt, Homo sapiens
caugaagugaau

SEQ ID NO: 1189710 - RNA, 20 nt, Homo sapiens
caugaaguggaaaaaggaga

SEQ ID NO: 1189711 - RNA, 23 nt, Homo sapiens
caugaaucccacccacaugugac

SEQ ID NO: 1189712 - RNA, 12 nt, Homo sapiens
caugacauuuac

SEQ ID NO: 1189713 - RNA, 15 nt, Homo sapiens
caugagacucagugc

SEQ ID NO: 1189714 - RNA, 17 nt, Homo sapiens
caugagauaauaugcag

SEQ ID NO: 1189715 - RNA, 22 nt, Homo sapiens
caugagauuuauaagguuuuaa

SEQ ID NO: 1189716 - RNA, 17 nt, Homo sapiens
caugagcauuggauaca

SEQ ID NO: 1189717 - RNA, 15 nt, Homo sapiens
caugaggaccaggug

SEQ ID NO: 1189718 - RNA, 15 nt, Homo sapiens
caugaguaucaucag

SEQ ID NO: 1189719 - RNA, 16 nt, Homo sapiens
caugauaaaagacacu

SEQ ID NO: 1189720 - RNA, 14 nt, Homo sapiens
caugaucaucacaa

SEQ ID NO: 1189721 - RNA, 17 nt, Homo sapiens
caugaucaucacaauca

SEQ ID NO: 1189722 - RNA, 19 nt, Homo sapiens
caugauuucccacugcacu

SEQ ID NO: 1189723 - RNA, 17 nt, Homo sapiens
caugauuuccuugaaug

SEQ ID NO: 1189724 - RNA, 16 nt, Homo sapiens
caugcaaugccaaaua

SEQ ID NO: 1189725 - RNA, 21 nt, Homo sapiens
caugcagccagccaucaaaua

SEQ ID NO: 1189726 - RNA, 14 nt, Homo sapiens
caugcagcuaccca

SEQ ID NO: 1189727 - RNA, 18 nt, Homo sapiens
caugccaaguaucuuucc

SEQ ID NO: 1189728 - RNA, 16 nt, Homo sapiens
caugccacaaggacuu

SEQ ID NO: 1189729 - RNA, 15 nt, Homo sapiens
caugcccauucacac

SEQ ID NO: 1189730 - RNA, 16 nt, Homo sapiens
caugcccuguguggcu

SEQ ID NO: 1189731 - RNA, 16 nt, Homo sapiens
caugccugaugaaagc

SEQ ID NO: 1189732 - RNA, 21 nt, Homo sapiens
caugcuaagaauaaacaacua

SEQ ID NO: 1189733 - RNA, 22 nt, Homo sapiens
caugcuacccagccauuaccca

SEQ ID NO: 1189734 - RNA, 16 nt, Homo sapiens
caugcuaugugcacag

SEQ ID NO: 1189735 - RNA, 15 nt, Homo sapiens
caugcucuugaccuu

SEQ ID NO: 1189736 - RNA, 20 nt, Homo sapiens
caugcuuugugccaucacug

SEQ ID NO: 1189737 - RNA, 14 nt, Homo sapiens
cauggaaaccaaaa

SEQ ID NO: 1189738 - RNA, 16 nt, Homo sapiens
cauggaaucugaugaa

SEQ ID NO: 1189739 - RNA, 13 nt, Homo sapiens
cauggacagugug

SEQ ID NO: 1189740 - RNA, 23 nt, Homo sapiens
cauggacaugcuucagugcugcu

SEQ ID NO: 1189741 - RNA, 13 nt, Homo sapiens
cauggacauucau

SEQ ID NO: 1189742 - RNA, 15 nt, Homo sapiens
cauggagaaacccug

SEQ ID NO: 1189743 - RNA, 17 nt, Homo sapiens
cauggaguugggcguua

SEQ ID NO: 1189744 - RNA, 21 nt, Homo sapiens
cauggcacucccuccagcaca

SEQ ID NO: 1189745 - RNA, 21 nt, Homo sapiens
cauggcagaaggcaaacccau

SEQ ID NO: 1189746 - RNA, 14 nt, Homo sapiens
cauggcagagcagu

SEQ ID NO: 1189747 - RNA, 14 nt, Homo sapiens
cauggccuaugcac

SEQ ID NO: 1189748 - RNA, 17 nt, Homo sapiens
cauggccuaugcacaua

SEQ ID NO: 1189749 - RNA, 15 nt, Homo sapiens
cauggcuaaauacaa

SEQ ID NO: 1189750 - RNA, 15 nt, Homo sapiens
cauggcuggugccug

SEQ ID NO: 1189751 - RNA, 16 nt, Homo sapiens
cauggcuggugccuga

SEQ ID NO: 1189752 - RNA, 22 nt, Homo sapiens
cauggcuuuggcuuugcaaaau

SEQ ID NO: 1189753 - RNA, 19 nt, Homo sapiens
caugggcuaaugaagauca

SEQ ID NO: 1189754 - RNA, 14 nt, Homo sapiens
cauggguacagagg

SEQ ID NO: 1189755 - RNA, 21 nt, Homo sapiens
cauggugaaaaccccaucucu

SEQ ID NO: 1189756 - RNA, 14 nt, Homo sapiens
caugguggggccaa

SEQ ID NO: 1189757 - RNA, 20 nt, Homo sapiens
caugguggugugugccugua

SEQ ID NO: 1189758 - RNA, 22 nt, Homo sapiens
caugguuauugaugaguuucuu

SEQ ID NO: 1189759 - RNA, 16 nt, Homo sapiens
cauguaaacugugcac

SEQ ID NO: 1189760 - RNA, 17 nt, Homo sapiens
cauguaaacugugcacc

SEQ ID NO: 1189761 - RNA, 14 nt, Homo sapiens
cauguaaaugcuca

SEQ ID NO: 1189762 - RNA, 13 nt, Homo sapiens
cauguauacuuaa

SEQ ID NO: 1189763 - RNA, 22 nt, Homo sapiens
cauguaucugucuacuuucucu

SEQ ID NO: 1189764 - RNA, 20 nt, Homo sapiens
cauguauuagccagucauug

SEQ ID NO: 1189765 - RNA, 22 nt, Homo sapiens
cauguccuauccaaaggaauca

SEQ ID NO: 1189766 - RNA, 21 nt, Homo sapiens
cauguccugcugcuucugcaa

SEQ ID NO: 1189767 - RNA, 19 nt, Homo sapiens
caugucucacgucucccua

SEQ ID NO: 1189768 - RNA, 14 nt, Homo sapiens
caugucugcauuuc

SEQ ID NO: 1189769 - RNA, 18 nt, Homo sapiens
caugugacacauaugcac

SEQ ID NO: 1189770 - RNA, 18 nt, Homo sapiens
caugugcuagucacuggc

SEQ ID NO: 1189771 - RNA, 19 nt, Homo sapiens
cauguggcuaccuguaacu

SEQ ID NO: 1189772 - RNA, 22 nt, Homo sapiens
cauguuaggaagguacugucau

SEQ ID NO: 1189773 - RNA, 15 nt, Homo sapiens
cauguucaugugauu

SEQ ID NO: 1189774 - RNA, 17 nt, Homo sapiens
cauguugauuaaacucg

SEQ ID NO: 1189775 - RNA, 19 nt, Homo sapiens
cauguuucccuacaccucu

SEQ ID NO: 1189776 - RNA, 14 nt, Homo sapiens
cauguuuuuauaca

SEQ ID NO: 1189777 - RNA, 16 nt, Homo sapiens
cauuaaaagacaaaua

SEQ ID NO: 1189778 - RNA, 14 nt, Homo sapiens
cauuaaacuugaag

SEQ ID NO: 1189779 - RNA, 14 nt, Homo sapiens
cauuaaauaaugca

SEQ ID NO: 1189780 - RNA, 15 nt, Homo sapiens
cauuaaauaaugcau

SEQ ID NO: 1189781 - RNA, 14 nt, Homo sapiens
cauuaaaucacuug

SEQ ID NO: 1189782 - RNA, 16 nt, Homo sapiens
cauuaaaucacuugaa

SEQ ID NO: 1189783 - RNA, 22 nt, Homo sapiens
cauuaaauggugauuucuugcu

SEQ ID NO: 1189784 - RNA, 13 nt, Homo sapiens
cauuaaccaucuu

SEQ ID NO: 1189785 - RNA, 22 nt, Homo sapiens
cauuaacuggugaauggaguca

SEQ ID NO: 1189786 - RNA, 18 nt, Homo sapiens
cauuaaugacacuugucc

SEQ ID NO: 1189787 - RNA, 14 nt, Homo sapiens
cauuaaugcacauc

SEQ ID NO: 1189788 - RNA, 12 nt, Homo sapiens
cauuacaguauu

SEQ ID NO: 1189789 - RNA, 20 nt, Homo sapiens
cauuucaaaucuguagcaua

SEQ ID NO: 1189790 - RNA, 17 nt, Homo sapiens
cauuucagaaaugcugu

SEQ ID NO: 1189791 - RNA, 19 nt, Homo sapiens
cauuucccacccuccaucu

SEQ ID NO: 1189792 - RNA, 15 nt, Homo sapiens
cauuuccugugucag

SEQ ID NO: 1189793 - RNA, 15 nt, Homo sapiens
cauuucgccccucau

SEQ ID NO: 1189794 - RNA, 15 nt, Homo sapiens
cauuucuaaaccaga

SEQ ID NO: 1189795 - RNA, 20 nt, Homo sapiens
cauuucuaucaaaacucuau

SEQ ID NO: 1189796 - RNA, 14 nt, Homo sapiens
cauuugaaagaaag

SEQ ID NO: 1189797 - RNA, 19 nt, Homo sapiens
cauuugaggggaaaacacc

SEQ ID NO: 1189798 - RNA, 14 nt, Homo sapiens
cauuuggaaccaaa

SEQ ID NO: 1189799 - RNA, 19 nt, Homo sapiens
cauuuguauuuugugauga

SEQ ID NO: 1189800 - RNA, 16 nt, Homo sapiens
cauuugucucuacuuu

SEQ ID NO: 1189801 - RNA, 18 nt, Homo sapiens
cauuugugccgacacugu

SEQ ID NO: 1189802 - RNA, 19 nt, Homo sapiens
cauuugugccgacacuguu

SEQ ID NO: 1189803 - RNA, 20 nt, Homo sapiens
cauuuguggugauauagaau

SEQ ID NO: 1189804 - RNA, 19 nt, Homo sapiens
cauuuguuuccucaucuuu

SEQ ID NO: 1189805 - RNA, 19 nt, Homo sapiens
cauuuuaguaugaagcaau

SEQ ID NO: 1189806 - RNA, 17 nt, Homo sapiens
cauuuuccgacuaggag

SEQ ID NO: 1189807 - RNA, 22 nt, Homo sapiens
cauuuuccucucccgaaggaga

SEQ ID NO: 1189808 - RNA, 14 nt, Homo sapiens
cauuuugaauguga

SEQ ID NO: 1189809 - RNA, 19 nt, Homo sapiens
cauuuugaaugugaucauc

SEQ ID NO: 1189810 - RNA, 11 nt, Homo sapiens
cauuuugacaa

SEQ ID NO: 1189811 - RNA, 14 nt, Homo sapiens
cauuuugcucugug

SEQ ID NO: 1189812 - RNA, 18 nt, Homo sapiens
cauuuuggcaucugcaaa

SEQ ID NO: 1189813 - RNA, 14 nt, Homo sapiens
cauuuugguuuaaa

SEQ ID NO: 1189814 - RNA, 23 nt, Homo sapiens
cauuuuuaaaggacaaacaguga

SEQ ID NO: 1189815 - RNA, 15 nt, Homo sapiens
cauuuuucugcagaa

SEQ ID NO: 1189816 - RNA, 19 nt, Homo sapiens
cauuuuuucagucauauaa

SEQ ID NO: 1189817 - RNA, 17 nt, Homo sapiens
ccaaaaagagcagcaca

SEQ ID NO: 1189818 - RNA, 14 nt, Homo sapiens
ccaaaaagaguuac

SEQ ID NO: 1189819 - RNA, 16 nt, Homo sapiens
ccaaaagcugcucagg

SEQ ID NO: 1189820 - RNA, 19 nt, Homo sapiens
ccaaaagcugcucagggaa

SEQ ID NO: 1189821 - RNA, 13 nt, Homo sapiens
ccaaaauccgacu

SEQ ID NO: 1189822 - RNA, 12 nt, Homo sapiens
ccaaaaucucaa

SEQ ID NO: 1189823 - RNA, 22 nt, Homo sapiens
ccaaaaugggagaaaacgccag

SEQ ID NO: 1189824 - RNA, 15 nt, Homo sapiens
ccaaaauucauuucu

SEQ ID NO: 1189825 - RNA, 14 nt, Homo sapiens
ccaaacaguaugau

SEQ ID NO: 1189826 - RNA, 11 nt, Homo sapiens
ccaaacauguu

SEQ ID NO: 1189827 - RNA, 17 nt, Homo sapiens
ccaaaccuucaggaaau

SEQ ID NO: 1189828 - RNA, 15 nt, Homo sapiens
ccaaacugugaugaa

SEQ ID NO: 1189829 - RNA, 16 nt, Homo sapiens
ccaaacuugucuugca

SEQ ID NO: 1189830 - RNA, 14 nt, Homo sapiens
ccaaagaaccaggg

SEQ ID NO: 1189831 - RNA, 19 nt, Homo sapiens
ccaaagccacuggaaggag

SEQ ID NO: 1189832 - RNA, 11 nt, Homo sapiens
ccaaagccaga

SEQ ID NO: 1189833 - RNA, 19 nt, Homo sapiens
ccaaaggcauccaggccag

SEQ ID NO: 1189834 - RNA, 18 nt, Homo sapiens
ccaaagucucuaauucua

SEQ ID NO: 1189835 - RNA, 15 nt, Homo sapiens
ccaaagugcugggau

SEQ ID NO: 1189836 - RNA, 15 nt, Homo sapiens
ccaaauaaaugcuca

SEQ ID NO: 1189837 - RNA, 20 nt, Homo sapiens
ccaaaucuaaauagauacuu

SEQ ID NO: 1189838 - RNA, 16 nt, Homo sapiens
ccaaauuuguauuuaa

SEQ ID NO: 1189839 - RNA, 18 nt, Homo sapiens
ccaacacugccagcauuu

SEQ ID NO: 1189840 - RNA, 22 nt, Homo sapiens
ccaacaggagcugggauccuaa

SEQ ID NO: 1189841 - RNA, 11 nt, Homo sapiens
ccaacaugacu

SEQ ID NO: 1189842 - RNA, 14 nt, Homo sapiens
ccaacccaucagaa

SEQ ID NO: 1189843 - RNA, 19 nt, Homo sapiens
ccaacuccaaccucucggc

SEQ ID NO: 1189844 - RNA, 20 nt, Homo sapiens
ccaacugccuccuugccagc

SEQ ID NO: 1189845 - RNA, 19 nt, Homo sapiens
ccaacuguauauauuccca

SEQ ID NO: 1189846 - RNA, 15 nt, Homo sapiens
ccaacuuuuucauag

SEQ ID NO: 1189847 - RNA, 17 nt, Homo sapiens
ccaagaaaaaaaauaga

SEQ ID NO: 1189848 - RNA, 19 nt, Homo sapiens
ccaagaagucccaagaccu

SEQ ID NO: 1189849 - RNA, 22 nt, Homo sapiens
ccaagagaagggcuuacaggca

SEQ ID NO: 1189850 - RNA, 18 nt, Homo sapiens
ccaagagcagcugccauu

SEQ ID NO: 1189851 - RNA, 20 nt, Homo sapiens
ccaagagucacuucuaauaa

SEQ ID NO: 1189852 - RNA, 20 nt, Homo sapiens
ccaagauacuugaacacugu

SEQ ID NO: 1189853 - RNA, 19 nt, Homo sapiens
ccaagcaagacugaggggu

SEQ ID NO: 1189854 - RNA, 14 nt, Homo sapiens
ccaagcccaguuca

SEQ ID NO: 1189855 - RNA, 18 nt, Homo sapiens
ccaaggaaacccccagug

SEQ ID NO: 1189856 - RNA, 19 nt, Homo sapiens
ccaaggaaacgcuaccucu

SEQ ID NO: 1189857 - RNA, 23 nt, Homo sapiens
ccaaggagggcagaucacuucag

SEQ ID NO: 1189858 - RNA, 14 nt, Homo sapiens
ccaaggagggugag

SEQ ID NO: 1189859 - RNA, 21 nt, Homo sapiens
ccaaggccacggagcaguuca

SEQ ID NO: 1189860 - RNA, 18 nt, Homo sapiens
ccaagggcagaccuuucu

SEQ ID NO: 1189861 - RNA, 23 nt, Homo sapiens
ccaaggugggcggaucacuugag

SEQ ID NO: 1189862 - RNA, 13 nt, Homo sapiens
ccaaguaucuuuc

SEQ ID NO: 1189863 - RNA, 13 nt, Homo sapiens
ccaagugccugcu

SEQ ID NO: 1189864 - RNA, 14 nt, Homo sapiens
ccaaguggcaguuu

SEQ ID NO: 1189865 - RNA, 15 nt, Homo sapiens
ccaagugugaacaaa

SEQ ID NO: 1189866 - RNA, 22 nt, Homo sapiens
ccaaguuauacacgggacaguu

SEQ ID NO: 1189867 - RNA, 19 nt, Homo sapiens
ccaaguuuauauacaauua

SEQ ID NO: 1189868 - RNA, 21 nt, Homo sapiens
ccaaucaccuuuccuguucca

SEQ ID NO: 1189869 - RNA, 14 nt, Homo sapiens
ccauggaagggugg

SEQ ID NO: 1189870 - RNA, 19 nt, Homo sapiens
ccauggaagucucaaagau

SEQ ID NO: 1189871 - RNA, 20 nt, Homo sapiens
ccauggauccuggauugaga

SEQ ID NO: 1189872 - RNA, 16 nt, Homo sapiens
ccauggcucagggugg

SEQ ID NO: 1189873 - RNA, 19 nt, Homo sapiens
ccauggguuccuacgccuu

SEQ ID NO: 1189874 - RNA, 16 nt, Homo sapiens
ccauggugugaucguc

SEQ ID NO: 1189875 - RNA, 14 nt, Homo sapiens
ccauguauuuugua

SEQ ID NO: 1189876 - RNA, 20 nt, Homo sapiens
ccaugugacuaaaaaugcau

SEQ ID NO: 1189877 - RNA, 11 nt, Homo sapiens
ccaugugcaua

SEQ ID NO: 1189878 - RNA, 14 nt, Homo sapiens
ccaugugcuaagaa

SEQ ID NO: 1189879 - RNA, 18 nt, Homo sapiens
ccauguguguguacaaca

SEQ ID NO: 1189880 - RNA, 23 nt, Homo sapiens
ccauguguguguacaacacuggu

SEQ ID NO: 1189881 - RNA, 19 nt, Homo sapiens
ccauguguuuugcuuuuau

SEQ ID NO: 1189882 - RNA, 15 nt, Homo sapiens
ccauguuggccucca

SEQ ID NO: 1189883 - RNA, 13 nt, Homo sapiens
ccauguuucacaa

SEQ ID NO: 1189884 - RNA, 19 nt, Homo sapiens
ccauguuucauuaaucaag

SEQ ID NO: 1189885 - RNA, 17 nt, Homo sapiens
ccauuagaaugcuacaa

SEQ ID NO: 1189886 - RNA, 16 nt, Homo sapiens
ccauugagacuauuua

SEQ ID NO: 1189887 - RNA, 11 nt, Homo sapiens
ccauugcaaug

SEQ ID NO: 1189888 - RNA, 13 nt, Homo sapiens
ccauugcuguuca

SEQ ID NO: 1189889 - RNA, 20 nt, Homo sapiens
ccauuggcuacugacuguau

SEQ ID NO: 1189890 - RNA, 14 nt, Homo sapiens
ccauuuaaaaaaca

SEQ ID NO: 1189891 - RNA, 23 nt, Homo sapiens
ccauuuagaauaucuagcaugua

SEQ ID NO: 1189892 - RNA, 18 nt, Homo sapiens
ccauuucagcuugaccuc

SEQ ID NO: 1189893 - RNA, 18 nt, Homo sapiens
ccauuucguuuagcugaa

SEQ ID NO: 1189894 - RNA, 21 nt, Homo sapiens
ccauuuggcaaugccaucauc

SEQ ID NO: 1189895 - RNA, 14 nt, Homo sapiens
ccauuuuaaggaaa

SEQ ID NO: 1189896 - RNA, 14 nt, Homo sapiens
ccauuuuaucuuau

SEQ ID NO: 1189897 - RNA, 15 nt, Homo sapiens
cccaaaacaguucua

SEQ ID NO: 1189898 - RNA, 13 nt, Homo sapiens
cccaaaacugccg

SEQ ID NO: 1189899 - RNA, 18 nt, Homo sapiens
cccaaacucuccagacau

SEQ ID NO: 1189900 - RNA, 15 nt, Homo sapiens
cccaaauccaagcuu

SEQ ID NO: 1189901 - RNA, 23 nt, Homo sapiens
cccaaauccuuagaucuggcaug

SEQ ID NO: 1189902 - RNA, 14 nt, Homo sapiens
cccaacaaugagug

SEQ ID NO: 1189903 - RNA, 22 nt, Homo sapiens
cccaacacaaacccccacucca

SEQ ID NO: 1189904 - RNA, 13 nt, Homo sapiens
cccaacagcacuu

SEQ ID NO: 1189905 - RNA, 20 nt, Homo sapiens
cccaaccuguccuuacucag

SEQ ID NO: 1189906 - RNA, 17 nt, Homo sapiens
cccaaccuuucauuucc

SEQ ID NO: 1189907 - RNA, 16 nt, Homo sapiens
cccaacugcaggucca

SEQ ID NO: 1189908 - RNA, 13 nt, Homo sapiens
cccaagaccuaag

SEQ ID NO: 1189909 - RNA, 22 nt, Homo sapiens
cccaagagauuguuguuugcca

SEQ ID NO: 1189910 - RNA, 16 nt, Homo sapiens
cccaagcagagaagcu

SEQ ID NO: 1189911 - RNA, 16 nt, Homo sapiens
cccaagccugcaguca

SEQ ID NO: 1189912 - RNA, 18 nt, Homo sapiens
cccaaucaccuuuccugu

SEQ ID NO: 1189913 - RNA, 18 nt, Homo sapiens
cccacaacuugucaccca

SEQ ID NO: 1189914 - RNA, 19 nt, Homo sapiens
cccacaccccaacacuucc

SEQ ID NO: 1189915 - RNA, 21 nt, Homo sapiens
cccaccagcaccgugacaguu

SEQ ID NO: 1189916 - RNA, 22 nt, Homo sapiens
cccaccagcuaaggacauuucc

SEQ ID NO: 1189917 - RNA, 22 nt, Homo sapiens
cccaccaugcaccccugauguu

SEQ ID NO: 1189918 - RNA, 17 nt, Homo sapiens
cccacccacaugugaca

SEQ ID NO: 1189919 - RNA, 11 nt, Homo sapiens
cccacccaguc

SEQ ID NO: 1189920 - RNA, 20 nt, Homo sapiens
cccacccagucucugcucca

SEQ ID NO: 1189921 - RNA, 14 nt, Homo sapiens
cccacccugggacc

SEQ ID NO: 1189922 - RNA, 19 nt, Homo sapiens
cccaccugucaaacaaagc

SEQ ID NO: 1189923 - RNA, 17 nt, Homo sapiens
cccacgauggaauguaa

SEQ ID NO: 1189924 - RNA, 17 nt, Homo sapiens
cccacuggggugugugg

SEQ ID NO: 1189925 - RNA, 23 nt, Homo sapiens
cccacugggguuggaagugcaga

SEQ ID NO: 1189926 - RNA, 18 nt, Homo sapiens
cccacuguaucuaggcaa

SEQ ID NO: 1189927 - RNA, 17 nt, Homo sapiens
cccacuguaugauuuau

SEQ ID NO: 1189928 - RNA, 17 nt, Homo sapiens
cccacuucucaucacac

SEQ ID NO: 1189929 - RNA, 16 nt, Homo sapiens
cccagaaaguccagcu

SEQ ID NO: 1189930 - RNA, 20 nt, Homo sapiens
cccagaaugaggcugcuuuc

SEQ ID NO: 1189931 - RNA, 14 nt, Homo sapiens
cccagacacauuca

SEQ ID NO: 1189932 - RNA, 21 nt, Homo sapiens
cccagaccuguuagcagacag

SEQ ID NO: 1189933 - RNA, 13 nt, Homo sapiens
cccagacuccuga

SEQ ID NO: 1189934 - RNA, 19 nt, Homo sapiens
cccagagacauacuugaag

SEQ ID NO: 1189935 - RNA, 22 nt, Homo sapiens
cccagagacauacuugaagggc

SEQ ID NO: 1189936 - RNA, 13 nt, Homo sapiens
cccagagagucca

SEQ ID NO: 1189937 - RNA, 16 nt, Homo sapiens
cccagagaguccagcu

SEQ ID NO: 1189938 - RNA, 16 nt, Homo sapiens
cccagagccacacaug

SEQ ID NO: 1189939 - RNA, 18 nt, Homo sapiens
cccagagccacacauggg

SEQ ID NO: 1189940 - RNA, 11 nt, Homo sapiens
cccagcacugc

SEQ ID NO: 1189941 - RNA, 11 nt, Homo sapiens
cccagcacuuu

SEQ ID NO: 1189942 - RNA, 21 nt, Homo sapiens
cccagcacuuugggagaccaa

SEQ ID NO: 1189943 - RNA, 18 nt, Homo sapiens
cuccugcccaccugucaa

SEQ ID NO: 1189944 - RNA, 17 nt, Homo sapiens
cuccuggaguugcauug

SEQ ID NO: 1189945 - RNA, 20 nt, Homo sapiens
cuccuggcccaggugagucc

SEQ ID NO: 1189946 - RNA, 14 nt, Homo sapiens
cuccugggcuauau

SEQ ID NO: 1189947 - RNA, 19 nt, Homo sapiens
cuccuggugucaccccaga

SEQ ID NO: 1189948 - RNA, 18 nt, Homo sapiens
cuccugugaacacuggag

SEQ ID NO: 1189949 - RNA, 21 nt, Homo sapiens
cuccuguggucucugaccagg

SEQ ID NO: 1189950 - RNA, 22 nt, Homo sapiens
cuccugugugauugacagcuuu

SEQ ID NO: 1189951 - RNA, 21 nt, Homo sapiens
cuccuguuuuuuucaggcucc

SEQ ID NO: 1189952 - RNA, 15 nt, Homo sapiens
cuccuuaucugcuaa

SEQ ID NO: 1189953 - RNA, 19 nt, Homo sapiens
cuccuuccuucaagccaag

SEQ ID NO: 1189954 - RNA, 18 nt, Homo sapiens
cuccuucggcuuugcccc

SEQ ID NO: 1189955 - RNA, 14 nt, Homo sapiens
cuccuuggugccug

SEQ ID NO: 1189956 - RNA, 12 nt, Homo sapiens
cuccuuguuaau

SEQ ID NO: 1189957 - RNA, 19 nt, Homo sapiens
cuccuuugguauuucacug

SEQ ID NO: 1189958 - RNA, 20 nt, Homo sapiens
cuccuuugguauuucacuga

SEQ ID NO: 1189959 - RNA, 15 nt, Homo sapiens
cuccuuuucugugaa

SEQ ID NO: 1189960 - RNA, 16 nt, Homo sapiens
cuccuuuuuccuucca

SEQ ID NO: 1189961 - RNA, 17 nt, Homo sapiens
cucgaaaaccaucacau

SEQ ID NO: 1189962 - RNA, 16 nt, Homo sapiens
cucgaggcggaucuuu

SEQ ID NO: 1189963 - RNA, 15 nt, Homo sapiens
cucgccuaggauuuc

SEQ ID NO: 1189964 - RNA, 16 nt, Homo sapiens
cucguugcagucugua

SEQ ID NO: 1189965 - RNA, 15 nt, Homo sapiens
cucguuuagugccaa

SEQ ID NO: 1189966 - RNA, 16 nt, Homo sapiens
cucuaacaaugacauu

SEQ ID NO: 1189967 - RNA, 17 nt, Homo sapiens
cucuaagguaacauuua

SEQ ID NO: 1189968 - RNA, 16 nt, Homo sapiens
cucuaauacauuccaa

SEQ ID NO: 1189969 - RNA, 17 nt, Homo sapiens
cucuaaugugucucuca

SEQ ID NO: 1189970 - RNA, 18 nt, Homo sapiens
cucuaaugugucucucac

SEQ ID NO: 1189971 - RNA, 21 nt, Homo sapiens
cucuaauuccuauaaauacga

SEQ ID NO: 1189972 - RNA, 18 nt, Homo sapiens
cucuacagauugucauuu

SEQ ID NO: 1189973 - RNA, 19 nt, Homo sapiens
cucuacuaaaauucaaaaa

SEQ ID NO: 1189974 - RNA, 11 nt, Homo sapiens
cucuacugugg

SEQ ID NO: 1189975 - RNA, 23 nt, Homo sapiens
cucuagaaagcucuaaagaccau

SEQ ID NO: 1189976 - RNA, 23 nt, Homo sapiens
cucuagcugggggugggccaggc

SEQ ID NO: 1189977 - RNA, 19 nt, Homo sapiens
cucuagguaaccaguuuaa

SEQ ID NO: 1189978 - RNA, 22 nt, Homo sapiens
cucuaucggggucacuugcaau

SEQ ID NO: 1189979 - RNA, 12 nt, Homo sapiens
cucuaucugcaa

SEQ ID NO: 1189980 - RNA, 15 nt, Homo sapiens
cucuauuugagaaua

SEQ ID NO: 1189981 - RNA, 12 nt, Homo sapiens
cucucaccacuu

SEQ ID NO: 1189982 - RNA, 19 nt, Homo sapiens
cucucaccuuaucuggaag

SEQ ID NO: 1189983 - RNA, 19 nt, Homo sapiens
cucucagaacccacaccag

SEQ ID NO: 1189984 - RNA, 17 nt, Homo sapiens
cucucaggcugucccaa

SEQ ID NO: 1189985 - RNA, 10 nt, Homo sapiens
cucucagggg

SEQ ID NO: 1189986 - RNA, 21 nt, Homo sapiens
cucucagucucugagcaguga

SEQ ID NO: 1189987 - RNA, 15 nt, Homo sapiens
cucucagugccuucu

SEQ ID NO: 1189988 - RNA, 18 nt, Homo sapiens
cucucaguguguuugcua

SEQ ID NO: 1189989 - RNA, 22 nt, Homo sapiens
cucucauguuuucaacugccaa

SEQ ID NO: 1189990 - RNA, 11 nt, Homo sapiens
cucucauuucc

SEQ ID NO: 1189991 - RNA, 11 nt, Homo sapiens
cucuccaagcc

SEQ ID NO: 1189992 - RNA, 17 nt, Homo sapiens
cucuccaauacucaggu

SEQ ID NO: 1189993 - RNA, 16 nt, Homo sapiens
cucuccaccagguucu

SEQ ID NO: 1189994 - RNA, 14 nt, Homo sapiens
cucuccagacauca

SEQ ID NO: 1189995 - RNA, 20 nt, Homo sapiens
cucucccacgggaccugggg

SEQ ID NO: 1189996 - RNA, 12 nt, Homo sapiens
cucucccaguga

SEQ ID NO: 1189997 - RNA, 21 nt, Homo sapiens
cucucccagugacaaccaaaa

SEQ ID NO: 1189998 - RNA, 18 nt, Homo sapiens
cucuccccagcccagaga

SEQ ID NO: 1189999 - RNA, 14 nt, Homo sapiens
cucucccuaccuug

SEQ ID NO: 1190000 - RNA, 17 nt, Homo sapiens
cucucccucucuuaggg

SEQ ID NO: 1190001 - RNA, 16 nt, Homo sapiens
cucuccugacuuuuaa

SEQ ID NO: 1190002 - RNA, 22 nt, Homo sapiens
cucuccugcccaugauagugua

SEQ ID NO: 1190003 - RNA, 14 nt, Homo sapiens
cucuccuucuuagc

SEQ ID NO: 1190004 - RNA, 15 nt, Homo sapiens
cucuccuuguugccc

SEQ ID NO: 1190005 - RNA, 13 nt, Homo sapiens
cucucucuguggg

SEQ ID NO: 1190006 - RNA, 18 nt, Homo sapiens
cucucugaaauagccgaa

SEQ ID NO: 1190007 - RNA, 17 nt, Homo sapiens
cucucugaguacauugu

SEQ ID NO: 1190008 - RNA, 20 nt, Homo sapiens
cucucuugauuaagaucuca

SEQ ID NO: 1190009 - RNA, 17 nt, Homo sapiens
cucugaaaccaguguua

SEQ ID NO: 1190010 - RNA, 15 nt, Homo sapiens
cucugaacaauugcu

SEQ ID NO: 1190011 - RNA, 21 nt, Homo sapiens
cucugaauaaauacccauuga

SEQ ID NO: 1190012 - RNA, 20 nt, Homo sapiens
cucugacaaagugugucuca

SEQ ID NO: 1190013 - RNA, 15 nt, Homo sapiens
cucugagcugugcag

SEQ ID NO: 1190014 - RNA, 17 nt, Homo sapiens
cucugaguacauugugc

SEQ ID NO: 1190015 - RNA, 13 nt, Homo sapiens
cucugauauggcu

SEQ ID NO: 1190016 - RNA, 13 nt, Homo sapiens
cucugcacauguc

SEQ ID NO: 1190017 - RNA, 14 nt, Homo sapiens
cucugcacaugucu

SEQ ID NO: 1190018 - RNA, 20 nt, Homo sapiens
cucugcacaugucuuguaca

SEQ ID NO: 1190019 - RNA, 17 nt, Homo sapiens
cucugcagcucagggac

SEQ ID NO: 1190020 - RNA, 20 nt, Homo sapiens
cucugcaggccuaggugcag

SEQ ID NO: 1190021 - RNA, 23 nt, Homo sapiens
cucugcccagccgggcacagugg

SEQ ID NO: 1190022 - RNA, 18 nt, Homo sapiens
cucugcuccagcaagcaa

SEQ ID NO: 1190023 - RNA, 14 nt, Homo sapiens
cucuggaacccagg

SEQ ID NO: 1190024 - RNA, 13 nt, Homo sapiens
cucuggauugaga

SEQ ID NO: 1190025 - RNA, 15 nt, Homo sapiens
cucuggggguuuugu

SEQ ID NO: 1190026 - RNA, 18 nt, Homo sapiens
cucugguccaugaacuca

SEQ ID NO: 1190027 - RNA, 13 nt, Homo sapiens
cucuggucuccac

SEQ ID NO: 1190028 - RNA, 15 nt, Homo sapiens
cucuguacuuuucau

SEQ ID NO: 1190029 - RNA, 18 nt, Homo sapiens
cucuguauacaaaacccu

SEQ ID NO: 1190030 - RNA, 17 nt, Homo sapiens
cucugucgugagugucu

SEQ ID NO: 1190031 - RNA, 20 nt, Homo sapiens
cucugucugcucaaugccau

SEQ ID NO: 1190032 - RNA, 14 nt, Homo sapiens
cucugugaccaaug

SEQ ID NO: 1190033 - RNA, 14 nt, Homo sapiens
cucugugaucuugc

SEQ ID NO: 1190034 - RNA, 12 nt, Homo sapiens
cucugugccuug

SEQ ID NO: 1190035 - RNA, 21 nt, Homo sapiens
cucuguggaaugaauacacac

SEQ ID NO: 1190036 - RNA, 21 nt, Homo sapiens
cucuguggugguucauuccac

SEQ ID NO: 1190037 - RNA, 13 nt, Homo sapiens
cucuuaaguaauu

SEQ ID NO: 1190038 - RNA, 23 nt, Homo sapiens
cucuuaaguaauugguuaguuaa

SEQ ID NO: 1190039 - RNA, 23 nt, Homo sapiens
cucuuacaagacuuaguggaauu

SEQ ID NO: 1190040 - RNA, 13 nt, Homo sapiens
cucuuagggugag

SEQ ID NO: 1190041 - RNA, 19 nt, Homo sapiens
cucuuaucugggugccuua

SEQ ID NO: 1190042 - RNA, 13 nt, Homo sapiens
cucuucaauauaa

SEQ ID NO: 1190043 - RNA, 13 nt, Homo sapiens
cucuucacagucc

SEQ ID NO: 1190044 - RNA, 20 nt, Homo sapiens
cucuucagcacugucuuguc

SEQ ID NO: 1190045 - RNA, 23 nt, Homo sapiens
cucuucuggacugcacacuucca

SEQ ID NO: 1190046 - RNA, 15 nt, Homo sapiens
cucuucugugcccug

SEQ ID NO: 1190047 - RNA, 19 nt, Homo sapiens
cucuugaaaauagaacaac

SEQ ID NO: 1190048 - RNA, 13 nt, Homo sapiens
cucuugaaucucu

SEQ ID NO: 1190049 - RNA, 16 nt, Homo sapiens
cucuugcaaaguagcc

SEQ ID NO: 1190050 - RNA, 20 nt, Homo sapiens
cucuugccaaaucaaaagac

SEQ ID NO: 1190051 - RNA, 23 nt, Homo sapiens
cucuugccaaaucaaaagacuuu

SEQ ID NO: 1190052 - RNA, 12 nt, Homo sapiens
cucuuggcaguc

SEQ ID NO: 1190053 - RNA, 13 nt, Homo sapiens
cucuuggcaucga

SEQ ID NO: 1190054 - RNA, 22 nt, Homo sapiens
cucuuguaucccuagugcucca

SEQ ID NO: 1190055 - RNA, 23 nt, Homo sapiens
cucuugucacauggaaucuacau

SEQ ID NO: 1190056 - RNA, 13 nt, Homo sapiens
cucuugugcucag

SEQ ID NO: 1190057 - RNA, 15 nt, Homo sapiens
cucuuucaaugcagc

SEQ ID NO: 1190058 - RNA, 17 nt, Homo sapiens
cucuuugugauaauucu

SEQ ID NO: 1190059 - RNA, 14 nt, Homo sapiens
cucuuuuagcugau

SEQ ID NO: 1190060 - RNA, 21 nt, Homo sapiens
cucuuuuauacaagaguguau

SEQ ID NO: 1190061 - RNA, 14 nt, Homo sapiens
cucuuuuaugccaa

SEQ ID NO: 1190062 - RNA, 16 nt, Homo sapiens
cucuuuuuuucuuguc

SEQ ID NO: 1190063 - RNA, 12 nt, Homo sapiens
cugaaaagccau

SEQ ID NO: 1190064 - RNA, 16 nt, Homo sapiens
cugaaaagccaugugu

SEQ ID NO: 1190065 - RNA, 13 nt, Homo sapiens
cugaaacacuaaa

SEQ ID NO: 1190066 - RNA, 24 nt, Homo sapiens
cugaaaccucugggucaucucuca

SEQ ID NO: 1190067 - RNA, 18 nt, Homo sapiens
cugaaaccuuaguuucaa

SEQ ID NO: 1190068 - RNA, 13 nt, Homo sapiens
cugaaagccucac

SEQ ID NO: 1190069 - RNA, 12 nt, Homo sapiens
cugaaagguaau

SEQ ID NO: 1190070 - RNA, 22 nt, Homo sapiens
cugaaaguaacucauaaucuau

SEQ ID NO: 1190071 - RNA, 17 nt, Homo sapiens
cugaaagucaugcacau

SEQ ID NO: 1190072 - RNA, 17 nt, Homo sapiens
cugaaauaaaauucauu

SEQ ID NO: 1190073 - RNA, 17 nt, Homo sapiens
cugaaauagaggcuaaa

SEQ ID NO: 1190074 - RNA, 17 nt, Homo sapiens
cugaaauggaauuccca

SEQ ID NO: 1190075 - RNA, 21 nt, Homo sapiens
cugaaauggacuuuuguacau

SEQ ID NO: 1190076 - RNA, 17 nt, Homo sapiens
cugaacagugcucugcc

SEQ ID NO: 1190077 - RNA, 19 nt, Homo sapiens
cugaaccccugggguagcc

SEQ ID NO: 1190078 - RNA, 15 nt, Homo sapiens
cugaaccuugagcaa

SEQ ID NO: 1190079 - RNA, 21 nt, Homo sapiens
cugaacguagcauaagggcuu

SEQ ID NO: 1190080 - RNA, 15 nt, Homo sapiens
cugaacuacuaaagu

SEQ ID NO: 1190081 - RNA, 18 nt, Homo sapiens
cugaacuuacacuguaua

SEQ ID NO: 1190082 - RNA, 23 nt, Homo sapiens
cugaagaaaaauuuauauuucag

SEQ ID NO: 1190083 - RNA, 21 nt, Homo sapiens
cugaagauggcauccugugaa

SEQ ID NO: 1190084 - RNA, 22 nt, Homo sapiens
cugaagcaggagauuugcuuga

SEQ ID NO: 1190085 - RNA, 19 nt, Homo sapiens
cugaagcgaacaucuucau

SEQ ID NO: 1190086 - RNA, 13 nt, Homo sapiens
cugaaggaaccaa

SEQ ID NO: 1190087 - RNA, 17 nt, Homo sapiens
cugaagguguguccuca

SEQ ID NO: 1190088 - RNA, 23 nt, Homo sapiens
cugaauauuaagaaacaauuuaa

SEQ ID NO: 1190089 - RNA, 17 nt, Homo sapiens
cugaaucgagaugucca

SEQ ID NO: 1190090 - RNA, 16 nt, Homo sapiens
cugaauucucugcuca

SEQ ID NO: 1190091 - RNA, 20 nt, Homo sapiens
cugaauuugcaaaguacugu

SEQ ID NO: 1190092 - RNA, 15 nt, Homo sapiens
cugacaaaaguucca

SEQ ID NO: 1190093 - RNA, 17 nt, Homo sapiens
cugacaaauucaaaaga

SEQ ID NO: 1190094 - RNA, 13 nt, Homo sapiens
cugacaauugcaa

SEQ ID NO: 1190095 - RNA, 14 nt, Homo sapiens
cugacagagguaca

SEQ ID NO: 1190096 - RNA, 15 nt, Homo sapiens
cugacagcagccugu

SEQ ID NO: 1190097 - RNA, 21 nt, Homo sapiens
cugacauuaugugguuuuaga

SEQ ID NO: 1190098 - RNA, 11 nt, Homo sapiens
cugacauugcc

SEQ ID NO: 1190099 - RNA, 16 nt, Homo sapiens
cugaccaucugugacu

SEQ ID NO: 1190100 - RNA, 11 nt, Homo sapiens
cugacccaaau

SEQ ID NO: 1190101 - RNA, 19 nt, Homo sapiens
cugaccccagcauucucag

SEQ ID NO: 1190102 - RNA, 12 nt, Homo sapiens
cugacccugugc

SEQ ID NO: 1190103 - RNA, 14 nt, Homo sapiens
cugacggugcaguc

SEQ ID NO: 1190104 - RNA, 15 nt, Homo sapiens
cugacucaccccaaa

SEQ ID NO: 1190105 - RNA, 16 nt, Homo sapiens
cugacucauaggggag

SEQ ID NO: 1190106 - RNA, 18 nt, Homo sapiens
cugacugccaauaacauu

SEQ ID NO: 1190107 - RNA, 15 nt, Homo sapiens
cugacuuaacaacug

SEQ ID NO: 1190108 - RNA, 20 nt, Homo sapiens
cugacuuaugaaacuugaaa

SEQ ID NO: 1190109 - RNA, 17 nt, Homo sapiens
cugacuugaguguuccu

SEQ ID NO: 1190110 - RNA, 16 nt, Homo sapiens
cugacuuggugcaagg

SEQ ID NO: 1190111 - RNA, 21 nt, Homo sapiens
cugagacaggaggauugccug

SEQ ID NO: 1190112 - RNA, 17 nt, Homo sapiens
cugagacuaaguuguag

SEQ ID NO: 1190113 - RNA, 12 nt, Homo sapiens
cugagacuugaa

SEQ ID NO: 1190114 - RNA, 14 nt, Homo sapiens
cugagagaccaucu

SEQ ID NO: 1190115 - RNA, 22 nt, Homo sapiens
cugagagacccaaggaggaaaa

SEQ ID NO: 1190116 - RNA, 22 nt, Homo sapiens
cugagagaggccauucuuuccc

SEQ ID NO: 1190117 - RNA, 15 nt, Homo sapiens
cugagagaguagcag

SEQ ID NO: 1190118 - RNA, 20 nt, Homo sapiens
cugagagccacaggugccug

SEQ ID NO: 1190119 - RNA, 15 nt, Homo sapiens
cugagagcguggccu

SEQ ID NO: 1190120 - RNA, 22 nt, Homo sapiens
cugagaggaagccugagguuga

SEQ ID NO: 1190121 - RNA, 17 nt, Homo sapiens
cugagaucgugccacug

SEQ ID NO: 1190122 - RNA, 15 nt, Homo sapiens
cugagauuucuuaaa

SEQ ID NO: 1190123 - RNA, 17 nt, Homo sapiens
cugagcaaaaugugaac

SEQ ID NO: 1190124 - RNA, 17 nt, Homo sapiens
cugagcaacucuugauu

SEQ ID NO: 1190125 - RNA, 20 nt, Homo sapiens
cugagcaaucucuugcauuu

SEQ ID NO: 1190126 - RNA, 12 nt, Homo sapiens
cugagcacagau

SEQ ID NO: 1190127 - RNA, 17 nt, Homo sapiens
cugagcaucacuaguga

SEQ ID NO: 1190128 - RNA, 22 nt, Homo sapiens
cugagcaucacuagugacaagu

SEQ ID NO: 1190129 - RNA, 16 nt, Homo sapiens
cugagccaaagccaga

SEQ ID NO: 1190130 - RNA, 16 nt, Homo sapiens
cugagcgcaagccaca

SEQ ID NO: 1190131 - RNA, 20 nt, Homo sapiens
cugagcguuuaaaguacuga

SEQ ID NO: 1190132 - RNA, 13 nt, Homo sapiens
cugagcucacuga

SEQ ID NO: 1190133 - RNA, 15 nt, Homo sapiens
cugaggcaagccaug

SEQ ID NO: 1190134 - RNA, 23 nt, Homo sapiens
cugaggcacaagaaucacuugaa

SEQ ID NO: 1190135 - RNA, 15 nt, Homo sapiens
cugaggcacacagag

SEQ ID NO: 1190136 - RNA, 14 nt, Homo sapiens
cugaggcauccacu

SEQ ID NO: 1190137 - RNA, 17 nt, Homo sapiens
cugagggcccuguggag

SEQ ID NO: 1190138 - RNA, 18 nt, Homo sapiens
cugaggggauaccauaaa

SEQ ID NO: 1190139 - RNA, 11 nt, Homo sapiens
cugaggggugu

SEQ ID NO: 1190140 - RNA, 17 nt, Homo sapiens
cugaggguaucugacaa

SEQ ID NO: 1190141 - RNA, 15 nt, Homo sapiens
cugagggucugggaa

SEQ ID NO: 1190142 - RNA, 20 nt, Homo sapiens
cugaggucaauggugcaaag

SEQ ID NO: 1190143 - RNA, 15 nt, Homo sapiens
cugaggucaggaguu

SEQ ID NO: 1190144 - RNA, 23 nt, Homo sapiens
cugaggugggaaaaucacuugaa

SEQ ID NO: 1190145 - RNA, 19 nt, Homo sapiens
cugagguucccgacaccag

SEQ ID NO: 1190146 - RNA, 17 nt, Homo sapiens
cugagguugaccagcuc

SEQ ID NO: 1190147 - RNA, 14 nt, Homo sapiens
cugaguagcuuuca

SEQ ID NO: 1190148 - RNA, 18 nt, Homo sapiens
cugagucccuccaugcaa

SEQ ID NO: 1190149 - RNA, 17 nt, Homo sapiens
cugagucccuggcaaga

SEQ ID NO: 1190150 - RNA, 23 nt, Homo sapiens
cugagugcccagaccccauucca

SEQ ID NO: 1190151 - RNA, 13 nt, Homo sapiens
cugauaaugcuca

SEQ ID NO: 1190152 - RNA, 22 nt, Homo sapiens
cugauagcgucucugcacguga

SEQ ID NO: 1190153 - RNA, 16 nt, Homo sapiens
cugauaggacccauau

SEQ ID NO: 1190154 - RNA, 17 nt, Homo sapiens
cugauagguagcauuuu

SEQ ID NO: 1190155 - RNA, 20 nt, Homo sapiens
cugauccccuuugguuuuac

SEQ ID NO: 1190156 - RNA, 21 nt, Homo sapiens
cugauccuccaacagcuguca

SEQ ID NO: 1190157 - RNA, 20 nt, Homo sapiens
cugauccugacacauucuga

SEQ ID NO: 1190158 - RNA, 18 nt, Homo sapiens
cugaucgacguggugacg

SEQ ID NO: 1190159 - RNA, 15 nt, Homo sapiens
cugaugacaaaccca

SEQ ID NO: 1190160 - RNA, 16 nt, Homo sapiens
cugaugcagccgucca

SEQ ID NO: 1190161 - RNA, 14 nt, Homo sapiens
cugauggauuccaa

SEQ ID NO: 1190162 - RNA, 16 nt, Homo sapiens
cugauguuaaccaaug

SEQ ID NO: 1190163 - RNA, 20 nt, Homo sapiens
cugauuaacugaggcaucca

SEQ ID NO: 1190164 - RNA, 15 nt, Homo sapiens
cugauucacugcaug

SEQ ID NO: 1190165 - RNA, 18 nt, Homo sapiens
cugauucuguuguguuca

SEQ ID NO: 1190166 - RNA, 18 nt, Homo sapiens
cugauucuucauucugua

SEQ ID NO: 1190167 - RNA, 12 nt, Homo sapiens
cugauugggcac

SEQ ID NO: 1190168 - RNA, 23 nt, Homo sapiens
cugauuuuaaaagguugacucaa

SEQ ID NO: 1190169 - RNA, 13 nt, Homo sapiens
cugcaagcccacc

SEQ ID NO: 1190170 - RNA, 16 nt, Homo sapiens
cugcaaguauccagac

SEQ ID NO: 1190171 - RNA, 17 nt, Homo sapiens
cugcaaguauccagacc

SEQ ID NO: 1190172 - RNA, 18 nt, Homo sapiens
cugcaaguuagugaaaca

SEQ ID NO: 1190173 - RNA, 16 nt, Homo sapiens
cugcaaucacugugcu

SEQ ID NO: 1190174 - RNA, 20 nt, Homo sapiens
cugcaauccagccugggcaa

SEQ ID NO: 1190175 - RNA, 18 nt, Homo sapiens
cugcacaugucuuguaca

SEQ ID NO: 1190176 - RNA, 23 nt, Homo sapiens
cugcacaugucuuguacaugugu

SEQ ID NO: 1190177 - RNA, 17 nt, Homo sapiens
cugcacccaccuacuua

SEQ ID NO: 1190178 - RNA, 22 nt, Homo sapiens
cugcacuccagauaugugccaa

SEQ ID NO: 1190179 - RNA, 16 nt, Homo sapiens
cugcacuuauacccau

SEQ ID NO: 1190180 - RNA, 17 nt, Homo sapiens
cugcacuuauacccaug

SEQ ID NO: 1190181 - RNA, 11 nt, Homo sapiens
cugcacuuugc

SEQ ID NO: 1190182 - RNA, 15 nt, Homo sapiens
cugcagaaacagugc

SEQ ID NO: 1190183 - RNA, 21 nt, Homo sapiens
cugcaggcagccugccuuuaa

SEQ ID NO: 1190184 - RNA, 20 nt, Homo sapiens
cugcagucaucaacaaugau

SEQ ID NO: 1190185 - RNA, 20 nt, Homo sapiens
cugcagucaucuugaccaag

SEQ ID NO: 1190186 - RNA, 22 nt, Homo sapiens
cugcauacuuagaugaucuuca

SEQ ID NO: 1190187 - RNA, 18 nt, Homo sapiens
cugcaucccccaaagcca

SEQ ID NO: 1190188 - RNA, 14 nt, Homo sapiens
cugcaucugauaaa

SEQ ID NO: 1190189 - RNA, 20 nt, Homo sapiens
cugcaucuucccacaguggc

SEQ ID NO: 1190190 - RNA, 16 nt, Homo sapiens
cugcauguaaaaucuu

SEQ ID NO: 1190191 - RNA, 23 nt, Homo sapiens
cugcauuguucuuugccagagac

SEQ ID NO: 1190192 - RNA, 18 nt, Homo sapiens
cugccaaaacauuuauga

SEQ ID NO: 1190193 - RNA, 16 nt, Homo sapiens
cugccaagauacuuga

SEQ ID NO: 1190194 - RNA, 17 nt, Homo sapiens
cugccacucaggcccaa

SEQ ID NO: 1190195 - RNA, 14 nt, Homo sapiens
cugccagacacugc

SEQ ID NO: 1190196 - RNA, 21 nt, Homo sapiens
cugccagguuuaaacaucacu

SEQ ID NO: 1190197 - RNA, 12 nt, Homo sapiens
cugccauaacau

SEQ ID NO: 1190198 - RNA, 21 nt, Homo sapiens
cugccauccaugugcuaguca

SEQ ID NO: 1190199 - RNA, 18 nt, Homo sapiens
cugccaucgcugugaugc

SEQ ID NO: 1190200 - RNA, 15 nt, Homo sapiens
cugccauuuuagugu

SEQ ID NO: 1190201 - RNA, 14 nt, Homo sapiens
cugcccaccugccu

SEQ ID NO: 1190202 - RNA, 14 nt, Homo sapiens
cugcccaccuguca

SEQ ID NO: 1190203 - RNA, 20 nt, Homo sapiens
cugcccaccugucaaacaaa

SEQ ID NO: 1190204 - RNA, 22 nt, Homo sapiens
cugcccauggacaggcuggcuc

SEQ ID NO: 1190205 - RNA, 18 nt, Homo sapiens
cugccccaugaagccaca

SEQ ID NO: 1190206 - RNA, 22 nt, Homo sapiens
cugccccuggcccuccaugaca

SEQ ID NO: 1190207 - RNA, 12 nt, Homo sapiens
cugccccugugc

SEQ ID NO: 1190208 - RNA, 17 nt, Homo sapiens
cugcccuuggcacccaa

SEQ ID NO: 1190209 - RNA, 18 nt, Homo sapiens
cugccgugguggcagcug

SEQ ID NO: 1190210 - RNA, 13 nt, Homo sapiens
cugccuacuuccu

SEQ ID NO: 1190211 - RNA, 17 nt, Homo sapiens
cugccuauaaauuuacu

SEQ ID NO: 1190212 - RNA, 21 nt, Homo sapiens
cugccuauaaauuuacucugu

SEQ ID NO: 1190213 - RNA, 16 nt, Homo sapiens
cugccucaacacugaa

SEQ ID NO: 1190214 - RNA, 19 nt, Homo sapiens
cugccuggaaaguccuccu

SEQ ID NO: 1190215 - RNA, 18 nt, Homo sapiens
cugccuggccaggcccug

SEQ ID NO: 1190216 - RNA, 24 nt, Homo sapiens
cugccuggguaggccccacaaggc

SEQ ID NO: 1190217 - RNA, 17 nt, Homo sapiens
cugccuguaacagccac

SEQ ID NO: 1190218 - RNA, 14 nt, Homo sapiens
cugccuguagcccc

SEQ ID NO: 1190219 - RNA, 21 nt, Homo sapiens
cugccuuagccuaccauguga

SEQ ID NO: 1190220 - RNA, 21 nt, Homo sapiens
cugccuucaccuccucuuuca

SEQ ID NO: 1190221 - RNA, 12 nt, Homo sapiens
cugccuucucag

SEQ ID NO: 1190222 - RNA, 19 nt, Homo sapiens
cugccuuugcaccacggga

SEQ ID NO: 1190223 - RNA, 14 nt, Homo sapiens
cugccuuugccucc

SEQ ID NO: 1190224 - RNA, 21 nt, Homo sapiens
cugccuuugucuuacuggcaa

SEQ ID NO: 1190225 - RNA, 14 nt, Homo sapiens
cugcgacagaacuu

SEQ ID NO: 1190226 - RNA, 16 nt, Homo sapiens
cugcgccugacauuca

SEQ ID NO: 1190227 - RNA, 17 nt, Homo sapiens
cugcggcagcucuggua

SEQ ID NO: 1190228 - RNA, 17 nt, Homo sapiens
cugcggggccugaggca

SEQ ID NO: 1190229 - RNA, 18 nt, Homo sapiens
cugcuaaaugcacugacc

SEQ ID NO: 1190230 - RNA, 15 nt, Homo sapiens
cugcuaauaauaaau

SEQ ID NO: 1190231 - RNA, 21 nt, Homo sapiens
cugcuacuggcaaaaggaucu

SEQ ID NO: 1190232 - RNA, 12 nt, Homo sapiens
cugcuacugugu

SEQ ID NO: 1190233 - RNA, 16 nt, Homo sapiens
cugcuauaacuaugac

SEQ ID NO: 1190234 - RNA, 13 nt, Homo sapiens
cugcucaaguuga

SEQ ID NO: 1190235 - RNA, 16 nt, Homo sapiens
cugcucaaugccauug

SEQ ID NO: 1190236 - RNA, 18 nt, Homo sapiens
cugcucaggaaaccacaa

SEQ ID NO: 1190237 - RNA, 20 nt, Homo sapiens
cugcuccaaaggaaauccaa

SEQ ID NO: 1190238 - RNA, 21 nt, Homo sapiens
cugcuccagcaagcaaacagg

SEQ ID NO: 1190239 - RNA, 21 nt, Homo sapiens
cugcucccacacuugugccag

SEQ ID NO: 1190240 - RNA, 15 nt, Homo sapiens
cugcuccccacguca

SEQ ID NO: 1190241 - RNA, 22 nt, Homo sapiens
cugcuccccacgucagcuggga

SEQ ID NO: 1190242 - RNA, 16 nt, Homo sapiens
cugcuccccucugcac

SEQ ID NO: 1190243 - RNA, 23 nt, Homo sapiens
cugcuccgugcuuguuugcucac

SEQ ID NO: 1190244 - RNA, 21 nt, Homo sapiens
cugcucugcuccugaagcccu

SEQ ID NO: 1190245 - RNA, 23 nt, Homo sapiens
cugcucuuugauucaaagcacug

SEQ ID NO: 1190246 - RNA, 16 nt, Homo sapiens
cugcugaagacuugcc

SEQ ID NO: 1190247 - RNA, 17 nt, Homo sapiens
cugcugaagacuugccc

SEQ ID NO: 1190248 - RNA, 14 nt, Homo sapiens
cugcugaagcugcu

SEQ ID NO: 1190249 - RNA, 13 nt, Homo sapiens
cugcugaccucca

SEQ ID NO: 1190250 - RNA, 14 nt, Homo sapiens
cugcugacugccaa

SEQ ID NO: 1190251 - RNA, 13 nt, Homo sapiens
cugcugccaucca

SEQ ID NO: 1190252 - RNA, 14 nt, Homo sapiens
cugcugcugcucau

SEQ ID NO: 1190253 - RNA, 12 nt, Homo sapiens
cugcugcuggug

SEQ ID NO: 1190254 - RNA, 14 nt, Homo sapiens
cugcuguaucuuua

SEQ ID NO: 1190255 - RNA, 16 nt, Homo sapiens
cugcuguugaacuuuu

SEQ ID NO: 1190256 - RNA, 21 nt, Homo sapiens
cugcuguuuuuaugauucagg

SEQ ID NO: 1190257 - RNA, 13 nt, Homo sapiens
cugcuuaagugcc

SEQ ID NO: 1190258 - RNA, 13 nt, Homo sapiens
cugcuucauaucu

SEQ ID NO: 1190259 - RNA, 15 nt, Homo sapiens
cugcuuccucugaau

SEQ ID NO: 1190260 - RNA, 19 nt, Homo sapiens
cugcuucuacggccaugag

SEQ ID NO: 1190261 - RNA, 21 nt, Homo sapiens
cugcuuggguggagaagccau

SEQ ID NO: 1190262 - RNA, 13 nt, Homo sapiens
cugcuugguuaaa

SEQ ID NO: 1190263 - RNA, 17 nt, Homo sapiens
cugcuuuccaaagccaa

SEQ ID NO: 1190264 - RNA, 18 nt, Homo sapiens
cugcuuucccuuuuccau

SEQ ID NO: 1190265 - RNA, 20 nt, Homo sapiens
cugcuuucuccccaaugaga

SEQ ID NO: 1190266 - RNA, 19 nt, Homo sapiens
cugcuuugaggcaguucca

SEQ ID NO: 1190267 - RNA, 17 nt, Homo sapiens
cugcuuuuuaaguguua

SEQ ID NO: 1190268 - RNA, 22 nt, Homo sapiens
cuggaaaagggucuugggaaau

SEQ ID NO: 1190269 - RNA, 15 nt, Homo sapiens
cuggaaacauucagg

SEQ ID NO: 1190270 - RNA, 19 nt, Homo sapiens
cuggaaacauucaggagcu

SEQ ID NO: 1190271 - RNA, 22 nt, Homo sapiens
cuggaaaguccuccuauuccag

SEQ ID NO: 1190272 - RNA, 13 nt, Homo sapiens
cuggaaauacuga

SEQ ID NO: 1190273 - RNA, 20 nt, Homo sapiens
cuggaacacuagacaagcca

SEQ ID NO: 1190274 - RNA, 15 nt, Homo sapiens
cuggaacccagaaga

SEQ ID NO: 1190275 - RNA, 23 nt, Homo sapiens
cuggaacccagaagaggagacag

SEQ ID NO: 1190276 - RNA, 16 nt, Homo sapiens
cuggaagaggaaccag

SEQ ID NO: 1190277 - RNA, 16 nt, Homo sapiens
cuggaagauacauaaa

SEQ ID NO: 1190278 - RNA, 23 nt, Homo sapiens
cuggaagcucggcgaauucucag

SEQ ID NO: 1190279 - RNA, 15 nt, Homo sapiens
cuggaagggccaagg

SEQ ID NO: 1190280 - RNA, 18 nt, Homo sapiens
cuggaagucaucucauuc

SEQ ID NO: 1190281 - RNA, 17 nt, Homo sapiens
cuggaaucacauucuua

SEQ ID NO: 1190282 - RNA, 17 nt, Homo sapiens
cuggaaucuggagacca

SEQ ID NO: 1190283 - RNA, 16 nt, Homo sapiens
cuggaauggcacguug

SEQ ID NO: 1190284 - RNA, 22 nt, Homo sapiens
cuggaauuacaaaacucagaga

SEQ ID NO: 1190285 - RNA, 14 nt, Homo sapiens
cuggaauuccaguc

SEQ ID NO: 1190286 - RNA, 13 nt, Homo sapiens
cuggacaaccaga

SEQ ID NO: 1190287 - RNA, 19 nt, Homo sapiens
cuggacacccucaccaccc

SEQ ID NO: 1190288 - RNA, 15 nt, Homo sapiens
cuggaccagguccug

SEQ ID NO: 1190289 - RNA, 13 nt, Homo sapiens
cuggacucucagu

SEQ ID NO: 1190290 - RNA, 18 nt, Homo sapiens
cuggagaaagaguuucug

SEQ ID NO: 1190291 - RNA, 23 nt, Homo sapiens
cuggagaauguggagaacuaaag

SEQ ID NO: 1190292 - RNA, 21 nt, Homo sapiens
cuggagaccagggagccuuug

SEQ ID NO: 1190293 - RNA, 16 nt, Homo sapiens
cuggagccugggauuu

SEQ ID NO: 1190294 - RNA, 15 nt, Homo sapiens
cuggaggaacacuug

SEQ ID NO: 1190295 - RNA, 20 nt, Homo sapiens
cuggaguacaguggugugau

SEQ ID NO: 1190296 - RNA, 22 nt, Homo sapiens
cuggagugcagugagcuauuac

SEQ ID NO: 1190297 - RNA, 20 nt, Homo sapiens
cuggagugcaguggugcaau

SEQ ID NO: 1190298 - RNA, 16 nt, Homo sapiens
cuggagugcugugcug

SEQ ID NO: 1190299 - RNA, 22 nt, Homo sapiens
cuggaguugcauugauucagua

SEQ ID NO: 1190300 - RNA, 22 nt, Homo sapiens
cuggauauaaauuaauugugcc

SEQ ID NO: 1190301 - RNA, 18 nt, Homo sapiens
cuggauccucaguucuca

SEQ ID NO: 1190302 - RNA, 21 nt, Homo sapiens
cuggaucuaccagcauaaaua

SEQ ID NO: 1190303 - RNA, 19 nt, Homo sapiens
cuggaugauggucuucagc

SEQ ID NO: 1190304 - RNA, 16 nt, Homo sapiens
cuggauuauaaggaaa

SEQ ID NO: 1190305 - RNA, 14 nt, Homo sapiens
cuggauuugcagaa

SEQ ID NO: 1190306 - RNA, 16 nt, Homo sapiens
cuggauuugccugcag

SEQ ID NO: 1190307 - RNA, 14 nt, Homo sapiens
cuggcaacacagag

SEQ ID NO: 1190308 - RNA, 18 nt, Homo sapiens
cuggcaagauaaacacuu

SEQ ID NO: 1190309 - RNA, 18 nt, Homo sapiens
cuggcacauuuuucucuu

SEQ ID NO: 1190310 - RNA, 22 nt, Homo sapiens
cuggcaucucccacacaagacc

SEQ ID NO: 1190311 - RNA, 21 nt, Homo sapiens
cuggccagacucgauguguac

SEQ ID NO: 1190312 - RNA, 18 nt, Homo sapiens
cuggccagauuuccucac

SEQ ID NO: 1190313 - RNA, 21 nt, Homo sapiens
cuggcccaagugaagcauggc

SEQ ID NO: 1190314 - RNA, 23 nt, Homo sapiens
cuggcccagggggccuggagcau

SEQ ID NO: 1190315 - RNA, 14 nt, Homo sapiens
cuggcccaggugag

SEQ ID NO: 1190316 - RNA, 22 nt, Homo sapiens
cuggcccuggcggguggcugca

SEQ ID NO: 1190317 - RNA, 13 nt, Homo sapiens
cuggcccuugcaa

SEQ ID NO: 1190318 - RNA, 20 nt, Homo sapiens
cuggccuugguaugugccag

SEQ ID NO: 1190319 - RNA, 14 nt, Homo sapiens
cuggcgcugugcua

SEQ ID NO: 1190320 - RNA, 15 nt, Homo sapiens
cuggcgcugugcuag

SEQ ID NO: 1190321 - RNA, 16 nt, Homo sapiens
cuggcuccaaacccuc

SEQ ID NO: 1190322 - RNA, 21 nt, Homo sapiens
cuggcugcgcucggccugcuc

SEQ ID NO: 1190323 - RNA, 18 nt, Homo sapiens
cuggcuggggccuguuga

SEQ ID NO: 1190324 - RNA, 16 nt, Homo sapiens
cuggcuggugccugag

SEQ ID NO: 1190325 - RNA, 20 nt, Homo sapiens
cuggcugucaguaugacauu

SEQ ID NO: 1190326 - RNA, 13 nt, Homo sapiens
cuggcugugugac

SEQ ID NO: 1190327 - RNA, 18 nt, Homo sapiens
cuggcuucuacacugggu

SEQ ID NO: 1190328 - RNA, 14 nt, Homo sapiens
cuggcuugcuccua

SEQ ID NO: 1190329 - RNA, 13 nt, Homo sapiens
cugggaaacacuc

SEQ ID NO: 1190330 - RNA, 22 nt, Homo sapiens
cugggaacugguucaagagaca

SEQ ID NO: 1190331 - RNA, 17 nt, Homo sapiens
cugggacagcccaggaa

SEQ ID NO: 1190332 - RNA, 17 nt, Homo sapiens
cugggaccucccacugc

SEQ ID NO: 1190333 - RNA, 16 nt, Homo sapiens
cugggagcccucaggc

SEQ ID NO: 1190334 - RNA, 14 nt, Homo sapiens
cugggaggcacagc

SEQ ID NO: 1190335 - RNA, 19 nt, Homo sapiens
cugggaggcagagguugca

SEQ ID NO: 1190336 - RNA, 19 nt, Homo sapiens
cugggagguggagguugca

SEQ ID NO: 1190337 - RNA, 18 nt, Homo sapiens
cugggagucacacagugu

SEQ ID NO: 1190338 - RNA, 14 nt, Homo sapiens
cugggaugucuccg

SEQ ID NO: 1190339 - RNA, 22 nt, Homo sapiens
cugggauuacagggaugagcca

SEQ ID NO: 1190340 - RNA, 19 nt, Homo sapiens
cugggauuacaggugugca

SEQ ID NO: 1190341 - RNA, 23 nt, Homo sapiens
cugggauuauaggcaugagccac

SEQ ID NO: 1190342 - RNA, 13 nt, Homo sapiens
cugggcagguggg

SEQ ID NO: 1190343 - RNA, 18 nt, Homo sapiens
cugggccaccagccacuu

SEQ ID NO: 1190344 - RNA, 20 nt, Homo sapiens
cugggccauucuccacagca

SEQ ID NO: 1190345 - RNA, 16 nt, Homo sapiens
cugggccccaccaccu

SEQ ID NO: 1190346 - RNA, 22 nt, Homo sapiens
cugggcccucucugcucugcgu

SEQ ID NO: 1190347 - RNA, 14 nt, Homo sapiens
cugggccuucucac

SEQ ID NO: 1190348 - RNA, 15 nt, Homo sapiens
cugggccuucucacc

SEQ ID NO: 1190349 - RNA, 17 nt, Homo sapiens
cugggcuaaggaaguau

SEQ ID NO: 1190350 - RNA, 12 nt, Homo sapiens
cugggcuauauu

SEQ ID NO: 1190351 - RNA, 16 nt, Homo sapiens
cugggcucaagugauc

SEQ ID NO: 1190352 - RNA, 17 nt, Homo sapiens
cugggcuccuccagggu

SEQ ID NO: 1190353 - RNA, 21 nt, Homo sapiens
cuggggaggugagagugcaga

SEQ ID NO: 1190354 - RNA, 21 nt, Homo sapiens
cugggggcaggccagggcagu

SEQ ID NO: 1190355 - RNA, 19 nt, Homo sapiens
cuggggggacccagugcag

SEQ ID NO: 1190356 - RNA, 21 nt, Homo sapiens
cuggggggacccagugcagaa

SEQ ID NO: 1190357 - RNA, 20 nt, Homo sapiens
cugggggguggggacgccug

SEQ ID NO: 1190358 - RNA, 21 nt, Homo sapiens
cuggggguuuuguuuuugcuu

SEQ ID NO: 1190359 - RNA, 20 nt, Homo sapiens
cuggggucacccucuccagc

SEQ ID NO: 1190360 - RNA, 23 nt, Homo sapiens
cuggggucggggggauuauguca

SEQ ID NO: 1190361 - RNA, 21 nt, Homo sapiens
cuggggugaggggaggcaucu

SEQ ID NO: 1190362 - RNA, 21 nt, Homo sapiens
cugggguggggucaugcccuc

SEQ ID NO: 1190363 - RNA, 14 nt, Homo sapiens
cugggguuuccauc

SEQ ID NO: 1190364 - RNA, 11 nt, Homo sapiens
cuggguccuug

SEQ ID NO: 1190365 - RNA, 20 nt, Homo sapiens
cugggucuaccacucagaga

SEQ ID NO: 1190366 - RNA, 20 nt, Homo sapiens
cugggucuugccaugugcug

SEQ ID NO: 1190367 - RNA, 20 nt, Homo sapiens
cugggugggcaucucaguua

SEQ ID NO: 1190368 - RNA, 12 nt, Homo sapiens
cuggguggugcc

SEQ ID NO: 1190369 - RNA, 14 nt, Homo sapiens
cuggguucacauga

SEQ ID NO: 1190370 - RNA, 17 nt, Homo sapiens
cuggucagggcaaaccu

SEQ ID NO: 1190371 - RNA, 21 nt, Homo sapiens
cuggucccggggccagcacuu

SEQ ID NO: 1190372 - RNA, 22 nt, Homo sapiens
cuggucccggggccagcacuuc

SEQ ID NO: 1190373 - RNA, 15 nt, Homo sapiens
cuggucugcucagga

SEQ ID NO: 1190374 - RNA, 11 nt, Homo sapiens
cuggugcacag

SEQ ID NO: 1190375 - RNA, 18 nt, Homo sapiens
cuggugcccccagacagc

SEQ ID NO: 1190376 - RNA, 20 nt, Homo sapiens
cugguguaaucucaaugcaa

SEQ ID NO: 1190377 - RNA, 16 nt, Homo sapiens
cuggugugaagguccu

SEQ ID NO: 1190378 - RNA, 19 nt, Homo sapiens
cugguuauccugugcuaca

SEQ ID NO: 1190379 - RNA, 15 nt, Homo sapiens
cugguucagugccac

SEQ ID NO: 1190380 - RNA, 19 nt, Homo sapiens
cugguuguguacaucggcu

SEQ ID NO: 1190381 - RNA, 21 nt, Homo sapiens
cugguuuucagucuugcugag

SEQ ID NO: 1190382 - RNA, 15 nt, Homo sapiens
cuguaaaccccaaga

SEQ ID NO: 1190383 - RNA, 21 nt, Homo sapiens
cuguaaaugaagggucauuuc

SEQ ID NO: 1190384 - RNA, 21 nt, Homo sapiens
cuguaaauugauucaagugag

SEQ ID NO: 1190385 - RNA, 14 nt, Homo sapiens
cuguaaccaccucu

SEQ ID NO: 1190386 - RNA, 23 nt, Homo sapiens
cuguaagaauuucccagugaaau

SEQ ID NO: 1190387 - RNA, 17 nt, Homo sapiens
cuguaaggaacuggaac

SEQ ID NO: 1190388 - RNA, 16 nt, Homo sapiens
cuguaaggcauuuuca

SEQ ID NO: 1190389 - RNA, 16 nt, Homo sapiens
cuguaaggcucuagau

SEQ ID NO: 1190390 - RNA, 15 nt, Homo sapiens
cuguaaucagcaaua

SEQ ID NO: 1190391 - RNA, 18 nt, Homo sapiens
cuguaaucccagcauuuu

SEQ ID NO: 1190392 - RNA, 21 nt, Homo sapiens
cuguaauuuaauuuaggacac

SEQ ID NO: 1190393 - RNA, 12 nt, Homo sapiens
cuguacacugcc

SEQ ID NO: 1190394 - RNA, 16 nt, Homo sapiens
cuguaccugugcacgu

SEQ ID NO: 1190395 - RNA, 17 nt, Homo sapiens
cuguacucuuaucuggg

SEQ ID NO: 1190396 - RNA, 12 nt, Homo sapiens
cuguacugagga

SEQ ID NO: 1190397 - RNA, 15 nt, Homo sapiens
cuguacuuuuuccag

SEQ ID NO: 1190398 - RNA, 23 nt, Homo sapiens
cuguagaaaugaugauguggaag

SEQ ID NO: 1190399 - RNA, 22 nt, Homo sapiens
cuguagaagaagugaacacuua

SEQ ID NO: 1190400 - RNA, 17 nt, Homo sapiens
cuguagagccagccuug

SEQ ID NO: 1190401 - RNA, 19 nt, Homo sapiens
cuguagauuaccaaaacaa

SEQ ID NO: 1190402 - RNA, 14 nt, Homo sapiens
cuguaggaaccaau

SEQ ID NO: 1190403 - RNA, 21 nt, Homo sapiens
cuguagggaaaaaaaugcuuc

SEQ ID NO: 1190404 - RNA, 18 nt, Homo sapiens
cuguagugagauagcauu

SEQ ID NO: 1190405 - RNA, 21 nt, Homo sapiens
cuguagugagauagcauugug

SEQ ID NO: 1190406 - RNA, 12 nt, Homo sapiens
cuguaguggaau

SEQ ID NO: 1190407 - RNA, 21 nt, Homo sapiens
cuguauaguuuuuagucugug

SEQ ID NO: 1190408 - RNA, 23 nt, Homo sapiens
cuguaugggggagauugaacuuu

SEQ ID NO: 1190409 - RNA, 17 nt, Homo sapiens
cuguauuauugcaauuu

SEQ ID NO: 1190410 - RNA, 15 nt, Homo sapiens
cuguauuuauuuuag

SEQ ID NO: 1190411 - RNA, 17 nt, Homo sapiens
cuguauuucaagaccuc

SEQ ID NO: 1190412 - RNA, 17 nt, Homo sapiens
cuguauuucacucuuuc

SEQ ID NO: 1190413 - RNA, 13 nt, Homo sapiens
cuguauuuuccac

SEQ ID NO: 1190414 - RNA, 20 nt, Homo sapiens
cuguauuuuuuuuuuccauu

SEQ ID NO: 1190415 - RNA, 14 nt, Homo sapiens
cugucaacuuguau

SEQ ID NO: 1190416 - RNA, 13 nt, Homo sapiens
cugucaagcauau

SEQ ID NO: 1190417 - RNA, 14 nt, Homo sapiens
cugucaccacaucu

SEQ ID NO: 1190418 - RNA, 22 nt, Homo sapiens
cugucagcaagacugaagaugg

SEQ ID NO: 1190419 - RNA, 15 nt, Homo sapiens
cugucaucaacauuc

SEQ ID NO: 1190420 - RNA, 20 nt, Homo sapiens
cugucaugcuucaucauucc

SEQ ID NO: 1190421 - RNA, 19 nt, Homo sapiens
cugucauuaguauuucaca

SEQ ID NO: 1190422 - RNA, 15 nt, Homo sapiens
cugucauuaucaaaa

SEQ ID NO: 1190423 - RNA, 20 nt, Homo sapiens
cugucauuuuggcaucugca

SEQ ID NO: 1190424 - RNA, 22 nt, Homo sapiens
cuguccucagccuugccagaga

SEQ ID NO: 1190425 - RNA, 15 nt, Homo sapiens
cuguccucuguagua

SEQ ID NO: 1190426 - RNA, 17 nt, Homo sapiens
cugucuagagcaacuuu

SEQ ID NO: 1190427 - RNA, 13 nt, Homo sapiens
cugucucagggug

SEQ ID NO: 1190428 - RNA, 16 nt, Homo sapiens
cugucucgaugcaaug

SEQ ID NO: 1190429 - RNA, 13 nt, Homo sapiens
cugucucuaaaaa

SEQ ID NO: 1190430 - RNA, 14 nt, Homo sapiens
cugucugaagcaau

SEQ ID NO: 1190431 - RNA, 20 nt, Homo sapiens
cugucuguuuccucuguaua

SEQ ID NO: 1190432 - RNA, 22 nt, Homo sapiens
cugucuucggccgagcugguuu

SEQ ID NO: 1190433 - RNA, 18 nt, Homo sapiens
cugucuucuccuaauucu

SEQ ID NO: 1190434 - RNA, 14 nt, Homo sapiens
cugucuugucuccc

SEQ ID NO: 1190435 - RNA, 17 nt, Homo sapiens
cugugaaaccccuaugu

SEQ ID NO: 1190436 - RNA, 14 nt, Homo sapiens
cugugaacacugga

SEQ ID NO: 1190437 - RNA, 14 nt, Homo sapiens
cugugaagcccuuu

SEQ ID NO: 1190438 - RNA, 18 nt, Homo sapiens
cugugaagcccuuugccu

SEQ ID NO: 1190439 - RNA, 13 nt, Homo sapiens
cugugacacacua

SEQ ID NO: 1190440 - RNA, 24 nt, Homo sapiens
cugugacuggcagcauugacucug

SEQ ID NO: 1190441 - RNA, 17 nt, Homo sapiens
cugugagccuugcauga

SEQ ID NO: 1190442 - RNA, 18 nt, Homo sapiens
cugugagcuuacauugaa

SEQ ID NO: 1190443 - RNA, 22 nt, Homo sapiens
cugugcaaccucuuggccugau

SEQ ID NO: 1190444 - RNA, 19 nt, Homo sapiens
cugugcaacggucuccuga

SEQ ID NO: 1190445 - RNA, 17 nt, Homo sapiens
cugugcaguagccguuu

SEQ ID NO: 1190446 - RNA, 21 nt, Homo sapiens
cugugcaugguggcaccagcg

SEQ ID NO: 1190447 - RNA, 20 nt, Homo sapiens
cugugcccaccaugacccuc

SEQ ID NO: 1190448 - RNA, 15 nt, Homo sapiens
cugugcccaucaucu

SEQ ID NO: 1190449 - RNA, 23 nt, Homo sapiens
cugugcccaucaucucugccuuu

SEQ ID NO: 1190450 - RNA, 19 nt, Homo sapiens
cugugcuauggugcucugu

SEQ ID NO: 1190451 - RNA, 16 nt, Homo sapiens
cugugcucacuaccug

SEQ ID NO: 1190452 - RNA, 16 nt, Homo sapiens
cugugcugaaagucag

SEQ ID NO: 1190453 - RNA, 18 nt, Homo sapiens
cugugcugggugagcucu

SEQ ID NO: 1190454 - RNA, 17 nt, Homo sapiens
cuguggaccacccuagc

SEQ ID NO: 1190455 - RNA, 18 nt, Homo sapiens
cuguggaccacccuagca

SEQ ID NO: 1190456 - RNA, 17 nt, Homo sapiens
cuguggaccacugcaug

SEQ ID NO: 1190457 - RNA, 14 nt, Homo sapiens
cuguggacugaccu

SEQ ID NO: 1190458 - RNA, 23 nt, Homo sapiens
cuguggccacauuuucagccaaa

SEQ ID NO: 1190459 - RNA, 16 nt, Homo sapiens
cuguggcggugccugg

SEQ ID NO: 1190460 - RNA, 12 nt, Homo sapiens
cugugggaccag

SEQ ID NO: 1190461 - RNA, 21 nt, Homo sapiens
cuguggggcugaauugccagg

SEQ ID NO: 1190462 - RNA, 19 nt, Homo sapiens
cuguggugguucauuccac

SEQ ID NO: 1190463 - RNA, 23 nt, Homo sapiens
cuguggugugucccccucugucc

SEQ ID NO: 1190464 - RNA, 18 nt, Homo sapiens
cuguguacacgugacaga

SEQ ID NO: 1190465 - RNA, 15 nt, Homo sapiens
cuguguacuuuucaa

SEQ ID NO: 1190466 - RNA, 17 nt, Homo sapiens
cuguguaguuaauuuaa

SEQ ID NO: 1190467 - RNA, 15 nt, Homo sapiens
cuguguauucuaguu

SEQ ID NO: 1190468 - RNA, 15 nt, Homo sapiens
cugugucuaagauuc

SEQ ID NO: 1190469 - RNA, 16 nt, Homo sapiens
cugugugagugcucug

SEQ ID NO: 1190470 - RNA, 15 nt, Homo sapiens
cugugugcucuccaa

SEQ ID NO: 1190471 - RNA, 17 nt, Homo sapiens
cugugugcucuccaagc

SEQ ID NO: 1190472 - RNA, 14 nt, Homo sapiens
cuguguguccaaaa

SEQ ID NO: 1190473 - RNA, 15 nt, Homo sapiens
cugugugugugaaug

SEQ ID NO: 1190474 - RNA, 20 nt, Homo sapiens
cuguguguguguguguaugu

SEQ ID NO: 1190475 - RNA, 14 nt, Homo sapiens
cuguguucugcaca

SEQ ID NO: 1190476 - RNA, 15 nt, Homo sapiens
cuguguuuccaucuc

SEQ ID NO: 1190477 - RNA, 16 nt, Homo sapiens
cuguguuuugugaggu

SEQ ID NO: 1190478 - RNA, 16 nt, Homo sapiens
cuguuaaaauugcuca

SEQ ID NO: 1190479 - RNA, 17 nt, Homo sapiens
cuguuaaaauugcucau

SEQ ID NO: 1190480 - RNA, 19 nt, Homo sapiens
cuguuauuauauuugacau

SEQ ID NO: 1190481 - RNA, 13 nt, Homo sapiens
cuguuauucuugu

SEQ ID NO: 1190482 - RNA, 20 nt, Homo sapiens
cuguucaacauguaccucac

SEQ ID NO: 1190483 - RNA, 17 nt, Homo sapiens
cuguucaaggccccuga

SEQ ID NO: 1190484 - RNA, 12 nt, Homo sapiens
cuguucacagag

SEQ ID NO: 1190485 - RNA, 14 nt, Homo sapiens
cuguucagccuuug

SEQ ID NO: 1190486 - RNA, 21 nt, Homo sapiens
cuguuccuccccuccccgccg

SEQ ID NO: 1190487 - RNA, 14 nt, Homo sapiens
cuguuccuucacau

SEQ ID NO: 1190488 - RNA, 18 nt, Homo sapiens
cuguuccuucacauccug

SEQ ID NO: 1190489 - RNA, 16 nt, Homo sapiens
cuguucuaacauguaa

SEQ ID NO: 1190490 - RNA, 12 nt, Homo sapiens
cuguucugugac

SEQ ID NO: 1190491 - RNA, 20 nt, Homo sapiens
cuguucuuucuuacacaaga

SEQ ID NO: 1190492 - RNA, 18 nt, Homo sapiens
cuguugaauuucccacau

SEQ ID NO: 1190493 - RNA, 13 nt, Homo sapiens
cuguugacauauu

SEQ ID NO: 1190494 - RNA, 14 nt, Homo sapiens
cuguugacauauuu

SEQ ID NO: 1190495 - RNA, 15 nt, Homo sapiens
cuguugacuggcugu

SEQ ID NO: 1190496 - RNA, 16 nt, Homo sapiens
cuguugaggguccuca

SEQ ID NO: 1190497 - RNA, 15 nt, Homo sapiens
cuguuggaaauguga

SEQ ID NO: 1190498 - RNA, 22 nt, Homo sapiens
cuguugggacuugggauucuga

SEQ ID NO: 1190499 - RNA, 16 nt, Homo sapiens
cuguuguuuuggcuca

SEQ ID NO: 1190500 - RNA, 16 nt, Homo sapiens
cuguuuaaagugucac

SEQ ID NO: 1190501 - RNA, 22 nt, Homo sapiens
cuguuuacacucuuugccacug

SEQ ID NO: 1190502 - RNA, 13 nt, Homo sapiens
cuguuuacuuuag

SEQ ID NO: 1190503 - RNA, 14 nt, Homo sapiens
cuguuuacuuuagg

SEQ ID NO: 1190504 - RNA, 15 nt, Homo sapiens
cuguuuauugccauu

SEQ ID NO: 1190505 - RNA, 17 nt, Homo sapiens
cuguuuauuugcacuau

SEQ ID NO: 1190506 - RNA, 17 nt, Homo sapiens
cuguuugacaacauguu

SEQ ID NO: 1190507 - RNA, 22 nt, Homo sapiens
cuguuuguuuuuaaaaagcaaa

SEQ ID NO: 1190508 - RNA, 19 nt, Homo sapiens
cuguuuuacuguuacaaua

SEQ ID NO: 1190509 - RNA, 20 nt, Homo sapiens
cuguuuuacuguuacaauau

SEQ ID NO: 1190510 - RNA, 16 nt, Homo sapiens
cuguuuuauauucaac

SEQ ID NO: 1190511 - RNA, 19 nt, Homo sapiens
cuguuuucuuuugguaaag

SEQ ID NO: 1190512 - RNA, 19 nt, Homo sapiens
cuguuuuuuucaggcuccu

SEQ ID NO: 1190513 - RNA, 16 nt, Homo sapiens
cuuaaaaaacauauau

SEQ ID NO: 1190514 - RNA, 14 nt, Homo sapiens
cuuaaaaauaugcu

SEQ ID NO: 1190515 - RNA, 15 nt, Homo sapiens
cuuaaaaaugcacac

SEQ ID NO: 1190516 - RNA, 16 nt, Homo sapiens
cuuaaaaugugcagua

SEQ ID NO: 1190517 - RNA, 15 nt, Homo sapiens
cuuaaacacuugcaa

SEQ ID NO: 1190518 - RNA, 22 nt, Homo sapiens
cuuaaacuagguguucuaauca

SEQ ID NO: 1190519 - RNA, 14 nt, Homo sapiens
cuuaaagauuuauc

SEQ ID NO: 1190520 - RNA, 15 nt, Homo sapiens
cuuaaaucaguuuau

SEQ ID NO: 1190521 - RNA, 14 nt, Homo sapiens
cuuaaauccauccu

SEQ ID NO: 1190522 - RNA, 17 nt, Homo sapiens
cuuaaaugcuacugaaa

SEQ ID NO: 1190523 - RNA, 19 nt, Homo sapiens
cuuaacuuugaaccauaaa

SEQ ID NO: 1190524 - RNA, 15 nt, Homo sapiens
cuuaagaaagugucu

SEQ ID NO: 1190525 - RNA, 19 nt, Homo sapiens
cuuaagagaggggccaagu

SEQ ID NO: 1190526 - RNA, 16 nt, Homo sapiens
cuuaagccauaaaaua

SEQ ID NO: 1190527 - RNA, 18 nt, Homo sapiens
cuuaagcuuuggacccaa

SEQ ID NO: 1190528 - RNA, 22 nt, Homo sapiens
cuuaaggugaagugaggacaaa

SEQ ID NO: 1190529 - RNA, 17 nt, Homo sapiens
cuuaaguagauaaggaa

SEQ ID NO: 1190530 - RNA, 17 nt, Homo sapiens
cuuaauaauguguacau

SEQ ID NO: 1190531 - RNA, 18 nt, Homo sapiens
cuuaauacuaccuugaaa

SEQ ID NO: 1190532 - RNA, 22 nt, Homo sapiens
cuuaaugcagacaaacaaacau

SEQ ID NO: 1190533 - RNA, 19 nt, Homo sapiens
cuuaaugucuuuaaaagua

SEQ ID NO: 1190534 - RNA, 16 nt, Homo sapiens
cuuacaaauauuucag

SEQ ID NO: 1190535 - RNA, 22 nt, Homo sapiens
cuuacaagaaaggccugaaugg

SEQ ID NO: 1190536 - RNA, 12 nt, Homo sapiens
cuuacacuguau

SEQ ID NO: 1190537 - RNA, 15 nt, Homo sapiens
cuuacagaacaaaga

SEQ ID NO: 1190538 - RNA, 18 nt, Homo sapiens
cuuacaggccuugcucac

SEQ ID NO: 1190539 - RNA, 18 nt, Homo sapiens
cuuacagucagcacagaa

SEQ ID NO: 1190540 - RNA, 13 nt, Homo sapiens
cuuacaucaggaa

SEQ ID NO: 1190541 - RNA, 19 nt, Homo sapiens
cuuaccagguucacuuaaa

SEQ ID NO: 1190542 - RNA, 16 nt, Homo sapiens
cuuaccuguaaccuac

SEQ ID NO: 1190543 - RNA, 19 nt, Homo sapiens
cuuaccuucauaugcagua

SEQ ID NO: 1190544 - RNA, 19 nt, Homo sapiens
cuuaccuugacuguugaug

SEQ ID NO: 1190545 - RNA, 15 nt, Homo sapiens
cuuacuaaauaucau

SEQ ID NO: 1190546 - RNA, 16 nt, Homo sapiens
cuuacuagaccuguaa

SEQ ID NO: 1190547 - RNA, 18 nt, Homo sapiens
cuuacuagaccuguaacu

SEQ ID NO: 1190548 - RNA, 16 nt, Homo sapiens
cuuacucccuccuucu

SEQ ID NO: 1190549 - RNA, 20 nt, Homo sapiens
cuuacuccugguucagugcc

SEQ ID NO: 1190550 - RNA, 20 nt, Homo sapiens
cuuacucuaagaucuuagau

SEQ ID NO: 1190551 - RNA, 21 nt, Homo sapiens
cuuacuuccagcaaaauccaa

SEQ ID NO: 1190552 - RNA, 16 nt, Homo sapiens
cuuacuuuacugccug

SEQ ID NO: 1190553 - RNA, 19 nt, Homo sapiens
cuuacuuucuuuacauacc

SEQ ID NO: 1190554 - RNA, 21 nt, Homo sapiens
cuuagaacuguggccguuccu

SEQ ID NO: 1190555 - RNA, 23 nt, Homo sapiens
cuuagauauuaaaauuuggugcu

SEQ ID NO: 1190556 - RNA, 14 nt, Homo sapiens
cuuagauauuucau

SEQ ID NO: 1190557 - RNA, 15 nt, Homo sapiens
cuuagaugaucuuca

SEQ ID NO: 1190558 - RNA, 20 nt, Homo sapiens
cuuagauuuaguaguguaag

SEQ ID NO: 1190559 - RNA, 16 nt, Homo sapiens
cuuagcaccacaaaua

SEQ ID NO: 1190560 - RNA, 14 nt, Homo sapiens
cuuagcuucaggaa

SEQ ID NO: 1190561 - RNA, 23 nt, Homo sapiens
cuuaggaauacuguuuuaucucc

SEQ ID NO: 1190562 - RNA, 14 nt, Homo sapiens
cuuaggcagggaag

SEQ ID NO: 1190563 - RNA, 19 nt, Homo sapiens
cuuagggcagaagugaaug

SEQ ID NO: 1190564 - RNA, 23 nt, Homo sapiens
cuuaguccaauuccuugcacaua

SEQ ID NO: 1190565 - RNA, 14 nt, Homo sapiens
cuuagucucagcac

SEQ ID NO: 1190566 - RNA, 11 nt, Homo sapiens
cuuagugaauu

SEQ ID NO: 1190567 - RNA, 18 nt, Homo sapiens
cuuagugauaaaacuggg

SEQ ID NO: 1190568 - RNA, 23 nt, Homo sapiens
cuuaguguccuuuuuuauauaca

SEQ ID NO: 1190569 - RNA, 14 nt, Homo sapiens
cuuauaacaagcau

SEQ ID NO: 1190570 - RNA, 18 nt, Homo sapiens
cuuauaagaaagaucaaa

SEQ ID NO: 1190571 - RNA, 18 nt, Homo sapiens
cuuauaauuugcauacca

SEQ ID NO: 1190572 - RNA, 21 nt, Homo sapiens
cuuauacgaguaauaugccug

SEQ ID NO: 1190573 - RNA, 18 nt, Homo sapiens
cuuauacgucuagccuaa

SEQ ID NO: 1190574 - RNA, 16 nt, Homo sapiens
cuuauacuguacaaua

SEQ ID NO: 1190575 - RNA, 14 nt, Homo sapiens
cuuauauucaucca

SEQ ID NO: 1190576 - RNA, 18 nt, Homo sapiens
cuuauccuagcacaugcu

SEQ ID NO: 1190577 - RNA, 17 nt, Homo sapiens
cuuaugaucaccaugua

SEQ ID NO: 1190578 - RNA, 18 nt, Homo sapiens
cuuauggaauugauuugc

SEQ ID NO: 1190579 - RNA, 16 nt, Homo sapiens
cuuauggcugcugaaa

SEQ ID NO: 1190580 - RNA, 20 nt, Homo sapiens
cuuaugguaccagaugcagc

SEQ ID NO: 1190581 - RNA, 18 nt, Homo sapiens
cuuauguggaacuguaca

SEQ ID NO: 1190582 - RNA, 16 nt, Homo sapiens
cuuauugacucauaca

SEQ ID NO: 1190583 - RNA, 20 nt, Homo sapiens
cuuauuguggauaacaaaga

SEQ ID NO: 1190584 - RNA, 23 nt, Homo sapiens
cuuauuuaaugccgauauacucu

SEQ ID NO: 1190585 - RNA, 19 nt, Homo sapiens
cuuauuucucaucacauca

SEQ ID NO: 1190586 - RNA, 21 nt, Homo sapiens
cuuauuuggaauugacauucu

SEQ ID NO: 1190587 - RNA, 12 nt, Homo sapiens
cuuauuuuacac

SEQ ID NO: 1190588 - RNA, 17 nt, Homo sapiens
cuucaaagcaaagcucu

SEQ ID NO: 1190589 - RNA, 13 nt, Homo sapiens
cuucaaaucaauc

SEQ ID NO: 1190590 - RNA, 18 nt, Homo sapiens
cuucaaaucaaucuguaa

SEQ ID NO: 1190591 - RNA, 19 nt, Homo sapiens
cuucaaaucaaucuguaaa

SEQ ID NO: 1190592 - RNA, 18 nt, Homo sapiens
cuucaaaugccugacuag

SEQ ID NO: 1190593 - RNA, 14 nt, Homo sapiens
cuucaaaugcgaac

SEQ ID NO: 1190594 - RNA, 23 nt, Homo sapiens
cuucaacuccucgacaucacugu

SEQ ID NO: 1190595 - RNA, 20 nt, Homo sapiens
cuucaacuuggaaaugacac

SEQ ID NO: 1190596 - RNA, 18 nt, Homo sapiens
cuucacagugacacugga

SEQ ID NO: 1190597 - RNA, 19 nt, Homo sapiens
cuucacaucucccccauag

SEQ ID NO: 1190598 - RNA, 12 nt, Homo sapiens
cuucaccaccuc

SEQ ID NO: 1190599 - RNA, 15 nt, Homo sapiens
cuucaccucacugaa

SEQ ID NO: 1190600 - RNA, 18 nt, Homo sapiens
cuucacugcuacaugugc

SEQ ID NO: 1190601 - RNA, 19 nt, Homo sapiens
cuucacuguccuccaagcc

SEQ ID NO: 1190602 - RNA, 12 nt, Homo sapiens
cuucagacaccc

SEQ ID NO: 1190603 - RNA, 12 nt, Homo sapiens
cuucagagccag

SEQ ID NO: 1190604 - RNA, 16 nt, Homo sapiens
cuucagaguacaucca

SEQ ID NO: 1190605 - RNA, 14 nt, Homo sapiens
cuucagauguggag

SEQ ID NO: 1190606 - RNA, 22 nt, Homo sapiens
cuucaggaaccucgaguacugu

SEQ ID NO: 1190607 - RNA, 14 nt, Homo sapiens
cuucagguggaaaa

SEQ ID NO: 1190608 - RNA, 16 nt, Homo sapiens
cuucagugggagaaaa

SEQ ID NO: 1190609 - RNA, 17 nt, Homo sapiens
cuucaguuuauaccuug

SEQ ID NO: 1190610 - RNA, 14 nt, Homo sapiens
cuucauacacauga

SEQ ID NO: 1190611 - RNA, 17 nt, Homo sapiens
cuucauagaaaccucuc

SEQ ID NO: 1190612 - RNA, 16 nt, Homo sapiens
cuucaugucuaggaua

SEQ ID NO: 1190613 - RNA, 23 nt, Homo sapiens
cuucauguucgagcuuaccuacu

SEQ ID NO: 1190614 - RNA, 20 nt, Homo sapiens
cuucauuucauguauaguuu

SEQ ID NO: 1190615 - RNA, 15 nt, Homo sapiens
cuucauuuugagggg

SEQ ID NO: 1190616 - RNA, 22 nt, Homo sapiens
cuuccaagaccauuuguaguga

SEQ ID NO: 1190617 - RNA, 21 nt, Homo sapiens
cuuccaaugaaaucucaggaa

SEQ ID NO: 1190618 - RNA, 23 nt, Homo sapiens
cuuccacaccuagcaucucauga

SEQ ID NO: 1190619 - RNA, 14 nt, Homo sapiens
cuuccagaaaacaa

SEQ ID NO: 1190620 - RNA, 17 nt, Homo sapiens
cuuccagcaaaauccaa

SEQ ID NO: 1190621 - RNA, 20 nt, Homo sapiens
cuuccaggagccaccuugcc

SEQ ID NO: 1190622 - RNA, 15 nt, Homo sapiens
cuuccauaggacaaa

SEQ ID NO: 1190623 - RNA, 21 nt, Homo sapiens
cuucccaaggccuuaagcuuu

SEQ ID NO: 1190624 - RNA, 20 nt, Homo sapiens
cuucccacuagccuagguca

SEQ ID NO: 1190625 - RNA, 20 nt, Homo sapiens
cuucccaggaguacacccca

SEQ ID NO: 1190626 - RNA, 16 nt, Homo sapiens
cuuccccuucccugac

SEQ ID NO: 1190627 - RNA, 19 nt, Homo sapiens
cuucccgaaccccaaggag

SEQ ID NO: 1190628 - RNA, 15 nt, Homo sapiens
cuucccugacucuuc

SEQ ID NO: 1190629 - RNA, 22 nt, Homo sapiens
cuucccugucugccagggccag

SEQ ID NO: 1190630 - RNA, 21 nt, Homo sapiens
cuuccuaaauauuaugagaug

SEQ ID NO: 1190631 - RNA, 19 nt, Homo sapiens
cuuccuaagccuguggcug

SEQ ID NO: 1190632 - RNA, 18 nt, Homo sapiens
cuuccuaaguagcugggu

SEQ ID NO: 1190633 - RNA, 13 nt, Homo sapiens
cuuccuauuucua

SEQ ID NO: 1190634 - RNA, 18 nt, Homo sapiens
cuuccucaagucuugaca

SEQ ID NO: 1190635 - RNA, 15 nt, Homo sapiens
cuuccucuuagccuc

SEQ ID NO: 1190636 - RNA, 14 nt, Homo sapiens
cuuccuggugagaa

SEQ ID NO: 1190637 - RNA, 15 nt, Homo sapiens
cuuccuguacuugaa

SEQ ID NO: 1190638 - RNA, 12 nt, Homo sapiens
cuuccuucacau

SEQ ID NO: 1190639 - RNA, 20 nt, Homo sapiens
cuuccuuucccaagccuucg

SEQ ID NO: 1190640 - RNA, 18 nt, Homo sapiens
cuucgcaucaaaagacaa

SEQ ID NO: 1190641 - RNA, 14 nt, Homo sapiens
cuucggacaacuca

SEQ ID NO: 1190642 - RNA, 21 nt, Homo sapiens
cuucgggaagaaggggacaau

SEQ ID NO: 1190643 - RNA, 23 nt, Homo sapiens
cuucggggggggaggggguguua

SEQ ID NO: 1190644 - RNA, 19 nt, Homo sapiens
cuucuaauaaacagacugu

SEQ ID NO: 1190645 - RNA, 14 nt, Homo sapiens
cuucuacacugggu

SEQ ID NO: 1190646 - RNA, 15 nt, Homo sapiens
cuucuacggccauga

SEQ ID NO: 1190647 - RNA, 14 nt, Homo sapiens
cuucuacuuaucau

SEQ ID NO: 1190648 - RNA, 22 nt, Homo sapiens
cuucuaggucacuucucacaau

SEQ ID NO: 1190649 - RNA, 16 nt, Homo sapiens
cuucuaguucugccag

SEQ ID NO: 1190650 - RNA, 16 nt, Homo sapiens
cuucuauaaaugcaaa

SEQ ID NO: 1190651 - RNA, 20 nt, Homo sapiens
cuucuaugugaaacuugaaa

SEQ ID NO: 1190652 - RNA, 16 nt, Homo sapiens
cuucucaucacacaca

SEQ ID NO: 1190653 - RNA, 18 nt, Homo sapiens
cuucuccauccacauggg

SEQ ID NO: 1190654 - RNA, 19 nt, Homo sapiens
cuucucugagucagcugac

SEQ ID NO: 1190655 - RNA, 14 nt, Homo sapiens
cuucucuugacagu

SEQ ID NO: 1190656 - RNA, 14 nt, Homo sapiens
cuucugaacuugga

SEQ ID NO: 1190657 - RNA, 17 nt, Homo sapiens
cuucugaagugcugcuc

SEQ ID NO: 1190658 - RNA, 23 nt, Homo sapiens
cuucugagcacagcugcauuaaa

SEQ ID NO: 1190659 - RNA, 17 nt, Homo sapiens
cuucugaggacauucca

SEQ ID NO: 1190660 - RNA, 16 nt, Homo sapiens
cuucugcccuugccaa

SEQ ID NO: 1190661 - RNA, 12 nt, Homo sapiens
cuucugcuaaaa

SEQ ID NO: 1190662 - RNA, 17 nt, Homo sapiens
cuucugcuugucccaaa

SEQ ID NO: 1190663 - RNA, 14 nt, Homo sapiens
cuucuggccaggaa

SEQ ID NO: 1190664 - RNA, 20 nt, Homo sapiens
cuucugggaguuagugaacu

SEQ ID NO: 1190665 - RNA, 12 nt, Homo sapiens
cuucuggugacc

SEQ ID NO: 1190666 - RNA, 14 nt, Homo sapiens
cuucuguauaacua

SEQ ID NO: 1190667 - RNA, 21 nt, Homo sapiens
cuucugugucugucaccacau

SEQ ID NO: 1190668 - RNA, 17 nt, Homo sapiens
cuucuguuuccaucugc

SEQ ID NO: 1190669 - RNA, 12 nt, Homo sapiens
cuucuuacugau

SEQ ID NO: 1190670 - RNA, 18 nt, Homo sapiens
cuucuucaguguccuuca

SEQ ID NO: 1190671 - RNA, 19 nt, Homo sapiens
cuucuucaucuucaccaga

SEQ ID NO: 1190672 - RNA, 21 nt, Homo sapiens
cuucuugcccuggggaucaaa

SEQ ID NO: 1190673 - RNA, 20 nt, Homo sapiens
cuucuuggggcccagugcau

SEQ ID NO: 1190674 - RNA, 21 nt, Homo sapiens
cuucuuguaauauuucuucaa

SEQ ID NO: 1190675 - RNA, 17 nt, Homo sapiens
cuucuuuagcaagauau

SEQ ID NO: 1190676 - RNA, 19 nt, Homo sapiens
cuucuuuuauaacuagucc

SEQ ID NO: 1190677 - RNA, 21 nt, Homo sapiens
cuugaaaauaguaauaccuga

SEQ ID NO: 1190678 - RNA, 22 nt, Homo sapiens
cuugaaaauaguaauaccugag

SEQ ID NO: 1190679 - RNA, 14 nt, Homo sapiens
cuugaacacugugu

SEQ ID NO: 1190680 - RNA, 16 nt, Homo sapiens
cuugaacugggcucaa

SEQ ID NO: 1190681 - RNA, 21 nt, Homo sapiens
cuugaacuucaccugcaaagc

SEQ ID NO: 1190682 - RNA, 17 nt, Homo sapiens
cuugaaucaaguguaau

SEQ ID NO: 1190683 - RNA, 16 nt, Homo sapiens
cuugaauguggcuuga

SEQ ID NO: 1190684 - RNA, 15 nt, Homo sapiens
cuugacaacaucuga

SEQ ID NO: 1190685 - RNA, 15 nt, Homo sapiens
cuugaccuguuucuc

SEQ ID NO: 1190686 - RNA, 17 nt, Homo sapiens
cuugacgacaagaccac

SEQ ID NO: 1190687 - RNA, 19 nt, Homo sapiens
cuugagguggccuccuugc

SEQ ID NO: 1190688 - RNA, 22 nt, Homo sapiens
cuugauauuuccuucaccaccu

SEQ ID NO: 1190689 - RNA, 24 nt, Homo sapiens
cuugaugcgggucaacauuuccaa

SEQ ID NO: 1190690 - RNA, 20 nt, Homo sapiens
cuugauuaagaucucagugg

SEQ ID NO: 1190691 - RNA, 16 nt, Homo sapiens
cuugauucacaaugaa

SEQ ID NO: 1190692 - RNA, 17 nt, Homo sapiens
cuugauucugcaguaaa

SEQ ID NO: 1190693 - RNA, 13 nt, Homo sapiens
cuugauuguguag

SEQ ID NO: 1190694 - RNA, 18 nt, Homo sapiens
cuugauuguguagcuguc

SEQ ID NO: 1190695 - RNA, 16 nt, Homo sapiens
cuugauuuuuauaugu

SEQ ID NO: 1190696 - RNA, 15 nt, Homo sapiens
cuugauuuuuaucuc

SEQ ID NO: 1190697 - RNA, 11 nt, Homo sapiens
cuugcauugac

SEQ ID NO: 1190698 - RNA, 14 nt, Homo sapiens
cuugcauugacauu

SEQ ID NO: 1190699 - RNA, 23 nt, Homo sapiens
cuugccaagcagugcacauuuca

SEQ ID NO: 1190700 - RNA, 20 nt, Homo sapiens
cuugccaagggucccugugu

SEQ ID NO: 1190701 - RNA, 15 nt, Homo sapiens
cuugccaugugcugg

SEQ ID NO: 1190702 - RNA, 20 nt, Homo sapiens
cuugcccagagaugccucca

SEQ ID NO: 1190703 - RNA, 15 nt, Homo sapiens
cuugccuaucaaaga

SEQ ID NO: 1190704 - RNA, 18 nt, Homo sapiens
cuugccugaucaacaauu

SEQ ID NO: 1190705 - RNA, 15 nt, Homo sapiens
cuugcugaauucucu

SEQ ID NO: 1190706 - RNA, 21 nt, Homo sapiens
cuugcugaauucucugcucag

SEQ ID NO: 1190707 - RNA, 17 nt, Homo sapiens
cuugcuguugacauauu

SEQ ID NO: 1190708 - RNA, 17 nt, Homo sapiens
cuugcuuccaagaccau

SEQ ID NO: 1190709 - RNA, 21 nt, Homo sapiens
cuugcuuccccuuuugccaau

SEQ ID NO: 1190710 - RNA, 20 nt, Homo sapiens
cuugcuuguuacauaccugg

SEQ ID NO: 1190711 - RNA, 15 nt, Homo sapiens
cuuggaaagguuuca

SEQ ID NO: 1190712 - RNA, 21 nt, Homo sapiens
cuuggaaauuggaagagcaca

SEQ ID NO: 1190713 - RNA, 17 nt, Homo sapiens
cuuggaacacauaagaa

SEQ ID NO: 1190714 - RNA, 16 nt, Homo sapiens
cuuggaacucuugcua

SEQ ID NO: 1190715 - RNA, 15 nt, Homo sapiens
cuuggacucaugagg

SEQ ID NO: 1190716 - RNA, 18 nt, Homo sapiens
cuuggagaauacugccaa

SEQ ID NO: 1190717 - RNA, 16 nt, Homo sapiens
cuuggagaucuuugcu

SEQ ID NO: 1190718 - RNA, 21 nt, Homo sapiens
cuuggaggccagccagugacc

SEQ ID NO: 1190719 - RNA, 16 nt, Homo sapiens
cuuggaguuacaacag

SEQ ID NO: 1190720 - RNA, 23 nt, Homo sapiens
cuuggauaaccaggcugggcuca

SEQ ID NO: 1190721 - RNA, 16 nt, Homo sapiens
cuuggcaccagacacc

SEQ ID NO: 1190722 - RNA, 20 nt, Homo sapiens
cuuggcaccagacacccagg

SEQ ID NO: 1190723 - RNA, 20 nt, Homo sapiens
cuuggcacccaagaccucag

SEQ ID NO: 1190724 - RNA, 21 nt, Homo sapiens
cuuggcaggaugaugcuguca

SEQ ID NO: 1190725 - RNA, 22 nt, Homo sapiens
cuuggcaucgaccacaccagcc

SEQ ID NO: 1190726 - RNA, 17 nt, Homo sapiens
cuuggcccaggagcucu

SEQ ID NO: 1190727 - RNA, 15 nt, Homo sapiens
cuuggccuugcagcu

SEQ ID NO: 1190728 - RNA, 17 nt, Homo sapiens
cuuggcuccacugggau

SEQ ID NO: 1190729 - RNA, 22 nt, Homo sapiens
cuuggcugcaggaaucuuuaaa

SEQ ID NO: 1190730 - RNA, 17 nt, Homo sapiens
cuuggcugcuguaucuu

SEQ ID NO: 1190731 - RNA, 22 nt, Homo sapiens
cuugggaauaaaucauagcaau

SEQ ID NO: 1190732 - RNA, 22 nt, Homo sapiens
cuugggacuuagaacaccgccg

SEQ ID NO: 1190733 - RNA, 17 nt, Homo sapiens
cuugggagggugccauc

SEQ ID NO: 1190734 - RNA, 20 nt, Homo sapiens
cuuggggcaggcagugaugc

SEQ ID NO: 1190735 - RNA, 15 nt, Homo sapiens
cuuggggcaugaccc

SEQ ID NO: 1190736 - RNA, 16 nt, Homo sapiens
cuuggggccagggaag

SEQ ID NO: 1190737 - RNA, 17 nt, Homo sapiens
cuuggugcugggaaccu

SEQ ID NO: 1190738 - RNA, 13 nt, Homo sapiens
cuugguugccagu

SEQ ID NO: 1190739 - RNA, 18 nt, Homo sapiens
cuugguuguauaaagcaa

SEQ ID NO: 1190740 - RNA, 20 nt, Homo sapiens
cuugguuguauaaagcaaaa

SEQ ID NO: 1190741 - RNA, 21 nt, Homo sapiens
cuugguuguauaaagcaaaag

SEQ ID NO: 1190742 - RNA, 20 nt, Homo sapiens
cuugguuugaguuucucuca

SEQ ID NO: 1190743 - RNA, 17 nt, Homo sapiens
cuuguagaguggugcug

SEQ ID NO: 1190744 - RNA, 22 nt, Homo sapiens
cuuguagcggaugauucuucaa

SEQ ID NO: 1190745 - RNA, 23 nt, Homo sapiens
cuuguaguauuuugggagcaaaa

SEQ ID NO: 1190746 - RNA, 18 nt, Homo sapiens
cuuguaucccuagugcuc

SEQ ID NO: 1190747 - RNA, 19 nt, Homo sapiens
cuuguauuuaacugaauaa

SEQ ID NO: 1190748 - RNA, 23 nt, Homo sapiens
cuuguauuuaauacacaaugcau

SEQ ID NO: 1190749 - RNA, 21 nt, Homo sapiens
cuugucaagccugugcaaaaa

SEQ ID NO: 1190750 - RNA, 15 nt, Homo sapiens
cuuuuauuacugggg

SEQ ID NO: 1190751 - RNA, 14 nt, Homo sapiens
cuuuuauuucauuc

SEQ ID NO: 1190752 - RNA, 23 nt, Homo sapiens
cuuuuauuuuacacagaaacacu

SEQ ID NO: 1190753 - RNA, 19 nt, Homo sapiens
cuuuucaauguuagccaca

SEQ ID NO: 1190754 - RNA, 12 nt, Homo sapiens
cuuuucaguuug

SEQ ID NO: 1190755 - RNA, 18 nt, Homo sapiens
cuuuucauaucucuugcc

SEQ ID NO: 1190756 - RNA, 14 nt, Homo sapiens
cuuuuccaaggcaa

SEQ ID NO: 1190757 - RNA, 22 nt, Homo sapiens
cuuuuccaugcacccucauaca

SEQ ID NO: 1190758 - RNA, 13 nt, Homo sapiens
cuuuuccauuuga

SEQ ID NO: 1190759 - RNA, 22 nt, Homo sapiens
cuuuucccaggaggcuccagga

SEQ ID NO: 1190760 - RNA, 19 nt, Homo sapiens
cuuuucggucuuucccauu

SEQ ID NO: 1190761 - RNA, 22 nt, Homo sapiens
cuuuucuaguuuuauacaaaga

SEQ ID NO: 1190762 - RNA, 17 nt, Homo sapiens
cuuuucuauaaugugcc

SEQ ID NO: 1190763 - RNA, 13 nt, Homo sapiens
cuuuucucugaaa

SEQ ID NO: 1190764 - RNA, 17 nt, Homo sapiens
cuuuucugugaagcccu

SEQ ID NO: 1190765 - RNA, 21 nt, Homo sapiens
cuuuucuuacuagcuucagaa

SEQ ID NO: 1190766 - RNA, 11 nt, Homo sapiens
cuuuucuugcc

SEQ ID NO: 1190767 - RNA, 16 nt, Homo sapiens
cuuuucuuuuccuuga

SEQ ID NO: 1190768 - RNA, 15 nt, Homo sapiens
cuuuugaacuuguca

SEQ ID NO: 1190769 - RNA, 16 nt, Homo sapiens
cuuuuggagguauuca

SEQ ID NO: 1190770 - RNA, 14 nt, Homo sapiens
cuuuugucuaauua

SEQ ID NO: 1190771 - RNA, 18 nt, Homo sapiens
cuuuuguuaccacagagu

SEQ ID NO: 1190772 - RNA, 16 nt, Homo sapiens
cuuuuguucugagggg

SEQ ID NO: 1190773 - RNA, 17 nt, Homo sapiens
cuuuuguuuaccagaga

SEQ ID NO: 1190774 - RNA, 22 nt, Homo sapiens
cuuuuguuuugaagcuguugcu

SEQ ID NO: 1190775 - RNA, 21 nt, Homo sapiens
cuuuuuaaagaagugcaugaa

SEQ ID NO: 1190776 - RNA, 18 nt, Homo sapiens
cuuuuuaaccugcaaaau

SEQ ID NO: 1190777 - RNA, 15 nt, Homo sapiens
cuuuuuauacuauua

SEQ ID NO: 1190778 - RNA, 17 nt, Homo sapiens
cuugucacgaauuccau

SEQ ID NO: 1190779 - RNA, 22 nt, Homo sapiens
cuugucacuugcaugucccauc

SEQ ID NO: 1190780 - RNA, 16 nt, Homo sapiens
cuuguccucauucuug

SEQ ID NO: 1190781 - RNA, 19 nt, Homo sapiens
cuugucuucuugacugucu

SEQ ID NO: 1190782 - RNA, 20 nt, Homo sapiens
cuugugauguuugcucagag

SEQ ID NO: 1190783 - RNA, 11 nt, Homo sapiens
cuugugccaua

SEQ ID NO: 1190784 - RNA, 11 nt, Homo sapiens
cuugugccuug

SEQ ID NO: 1190785 - RNA, 20 nt, Homo sapiens
cuuguugagauccccguguu

SEQ ID NO: 1190786 - RNA, 22 nt, Homo sapiens
cuuguugaugcugucuaaggaa

SEQ ID NO: 1190787 - RNA, 20 nt, Homo sapiens
cuuguugcuuuguugcacug

SEQ ID NO: 1190788 - RNA, 17 nt, Homo sapiens
cuuguuguaaagcaaua

SEQ ID NO: 1190789 - RNA, 22 nt, Homo sapiens
cuuguuguugaacauggcuaaa

SEQ ID NO: 1190790 - RNA, 18 nt, Homo sapiens
cuuguuucuguuuagucc

SEQ ID NO: 1190791 - RNA, 20 nt, Homo sapiens
cuuguuugguaguuagccau

SEQ ID NO: 1190792 - RNA, 23 nt, Homo sapiens
cuuguuuguuuuauucaccauca

SEQ ID NO: 1190793 - RNA, 15 nt, Homo sapiens
cuuguuuuccagucu

SEQ ID NO: 1190794 - RNA, 14 nt, Homo sapiens
cuuguuuugccaug

SEQ ID NO: 1190795 - RNA, 21 nt, Homo sapiens
cuuuaaaaaagaaauuaucuu

SEQ ID NO: 1190796 - RNA, 19 nt, Homo sapiens
cuuuaaaaagaaaaucaag

SEQ ID NO: 1190797 - RNA, 20 nt, Homo sapiens
cuuuaaaaauaugcaccaaa

SEQ ID NO: 1190798 - RNA, 20 nt, Homo sapiens
cuuuaaaaccauaucagaga

SEQ ID NO: 1190799 - RNA, 18 nt, Homo sapiens
cuuuaaaauguaaagcca

SEQ ID NO: 1190800 - RNA, 22 nt, Homo sapiens
cuuuaaacacucuucagagaaa

SEQ ID NO: 1190801 - RNA, 15 nt, Homo sapiens
cuuuaaagaaaccau

SEQ ID NO: 1190802 - RNA, 21 nt, Homo sapiens
cuuuaaagcaggauuucucaa

SEQ ID NO: 1190803 - RNA, 15 nt, Homo sapiens
cuuuaaagugacuaa

SEQ ID NO: 1190804 - RNA, 17 nt, Homo sapiens
cuuuaacuuuuacaaaa

SEQ ID NO: 1190805 - RNA, 16 nt, Homo sapiens
cuuuaaggugcuaaac

SEQ ID NO: 1190806 - RNA, 19 nt, Homo sapiens
cuuuaauggcccccaaaau

SEQ ID NO: 1190807 - RNA, 18 nt, Homo sapiens
auaacuuuuuaaagugac

SEQ ID NO: 1190808 - RNA, 19 nt, Homo sapiens
auaagaaaaccaccccuua

SEQ ID NO: 1190809 - RNA, 17 nt, Homo sapiens
auaagccagugagacca

SEQ ID NO: 1190810 - RNA, 15 nt, Homo sapiens
auaaggaaagcaaua

SEQ ID NO: 1190811 - RNA, 18 nt, Homo sapiens
auaaguucauucaugcca

SEQ ID NO: 1190812 - RNA, 19 nt, Homo sapiens
auaaguucauucaugccaa

SEQ ID NO: 1190813 - RNA, 12 nt, Homo sapiens
auaauagucaau

SEQ ID NO: 1190814 - RNA, 21 nt, Homo sapiens
auaauaugugaucagcuuuca

SEQ ID NO: 1190815 - RNA, 17 nt, Homo sapiens
auaaucauaggcacuug

SEQ ID NO: 1190816 - RNA, 14 nt, Homo sapiens
auaaugacauguau

SEQ ID NO: 1190817 - RNA, 16 nt, Homo sapiens
auaaugauaguuauaa

SEQ ID NO: 1190818 - RNA, 14 nt, Homo sapiens
auaaugcaguaugg

SEQ ID NO: 1190819 - RNA, 17 nt, Homo sapiens
auaaugcuguugccuca

SEQ ID NO: 1190820 - RNA, 15 nt, Homo sapiens
auaauggaagccaaa

SEQ ID NO: 1190821 - RNA, 18 nt, Homo sapiens
auaauggggccuguuaca

SEQ ID NO: 1190822 - RNA, 19 nt, Homo sapiens
auaauguaaagguuuuuau

SEQ ID NO: 1190823 - RNA, 14 nt, Homo sapiens
auaauuagcaguau

SEQ ID NO: 1190824 - RNA, 21 nt, Homo sapiens
auaauucuuauggcugcugaa

SEQ ID NO: 1190825 - RNA, 13 nt, Homo sapiens
auaauugcauuca

SEQ ID NO: 1190826 - RNA, 20 nt, Homo sapiens
auaauuuucauucauucacu

SEQ ID NO: 1190827 - RNA, 20 nt, Homo sapiens
auacaaaaggcuccauauau

SEQ ID NO: 1190828 - RNA, 13 nt, Homo sapiens
auacaaagggaua

SEQ ID NO: 1190829 - RNA, 21 nt, Homo sapiens
auacaacuguaaagcaaauau

SEQ ID NO: 1190830 - RNA, 17 nt, Homo sapiens
ggcguggcccguggccu

SEQ ID NO: 1190831 - RNA, 13 nt, Homo sapiens
ggcguuacugcuu

SEQ ID NO: 1190832 - RNA, 13 nt, Homo sapiens
ggcuaaauacaau

SEQ ID NO: 1190833 - RNA, 22 nt, Homo sapiens
ggcuaacagucuagugcaaaag

SEQ ID NO: 1190834 - RNA, 16 nt, Homo sapiens
ggcuaagggggaccau

SEQ ID NO: 1190835 - RNA, 21 nt, Homo sapiens
ggcuaauaaacuuugugcuga

SEQ ID NO: 1190836 - RNA, 14 nt, Homo sapiens
ggcuagagugcaau

SEQ ID NO: 1190837 - RNA, 16 nt, Homo sapiens
ggcuagguaucauuca

SEQ ID NO: 1190838 - RNA, 22 nt, Homo sapiens
ggcuauuguccccuaaaccaaa

SEQ ID NO: 1190839 - RNA, 12 nt, Homo sapiens
ggcucacacagc

SEQ ID NO: 1190840 - RNA, 16 nt, Homo sapiens
ggcucacacagcuuaa

SEQ ID NO: 1190841 - RNA, 13 nt, Homo sapiens
ggcucacaguggg

SEQ ID NO: 1190842 - RNA, 14 nt, Homo sapiens
ggcuccacugggau

SEQ ID NO: 1190843 - RNA, 20 nt, Homo sapiens
ggcuccagcaccauccgcca

SEQ ID NO: 1190844 - RNA, 18 nt, Homo sapiens
ggcuccucugcuucucac

SEQ ID NO: 1190845 - RNA, 16 nt, Homo sapiens
ggcucucaacagggga

SEQ ID NO: 1190846 - RNA, 20 nt, Homo sapiens
ggcucucuugugcauuguag

SEQ ID NO: 1190847 - RNA, 11 nt, Homo sapiens
ggcucuugucc

SEQ ID NO: 1190848 - RNA, 14 nt, Homo sapiens
ggcugacaagggac

SEQ ID NO: 1190849 - RNA, 23 nt, Homo sapiens
ggcugaccccgguggcggcccca

SEQ ID NO: 1190850 - RNA, 19 nt, Homo sapiens
ggcugccagguguggaaca

SEQ ID NO: 1190851 - RNA, 18 nt, Homo sapiens
ggcugccuuugaucacag

SEQ ID NO: 1190852 - RNA, 20 nt, Homo sapiens
ggcugcugccauccaugugc

SEQ ID NO: 1190853 - RNA, 18 nt, Homo sapiens
ggcugcuggggccucaga

SEQ ID NO: 1190854 - RNA, 20 nt, Homo sapiens
ggcugcuuugccuauggagu

SEQ ID NO: 1190855 - RNA, 13 nt, Homo sapiens
ggcuggacuugga

SEQ ID NO: 1190856 - RNA, 16 nt, Homo sapiens
ggcuggagcccaggga

SEQ ID NO: 1190857 - RNA, 14 nt, Homo sapiens
ggcuggccucccaa

SEQ ID NO: 1190858 - RNA, 20 nt, Homo sapiens
ggcugguggcccaggaccau

SEQ ID NO: 1190859 - RNA, 17 nt, Homo sapiens
ggcugucaucugugcac

SEQ ID NO: 1190860 - RNA, 14 nt, Homo sapiens
ggcugugggaccag

SEQ ID NO: 1190861 - RNA, 16 nt, Homo sapiens
ggcuguguuuccaucu

SEQ ID NO: 1190862 - RNA, 19 nt, Homo sapiens
ggcuuaugaauauauuuaa

SEQ ID NO: 1190863 - RNA, 14 nt, Homo sapiens
ggcuucagcuccag

SEQ ID NO: 1190864 - RNA, 14 nt, Homo sapiens
ggcuuccugcugag

SEQ ID NO: 1190865 - RNA, 16 nt, Homo sapiens
ggcuucuaguuugcaa

SEQ ID NO: 1190866 - RNA, 19 nt, Homo sapiens
ggcuuucagggcagccccu

SEQ ID NO: 1190867 - RNA, 12 nt, Homo sapiens
ggcuuuggccag

SEQ ID NO: 1190868 - RNA, 21 nt, Homo sapiens
ggcuuuuacugaagccuuucu

SEQ ID NO: 1190869 - RNA, 14 nt, Homo sapiens
ggcuuuuccaaaag

SEQ ID NO: 1190870 - RNA, 19 nt, Homo sapiens
ggcuuuuccaaaagcaaac

SEQ ID NO: 1190871 - RNA, 14 nt, Homo sapiens
gggaaaaugcacac

SEQ ID NO: 1190872 - RNA, 23 nt, Homo sapiens
gggaaaucacauaacugguacaa

SEQ ID NO: 1190873 - RNA, 14 nt, Homo sapiens
gggaacauguccua

SEQ ID NO: 1190874 - RNA, 16 nt, Homo sapiens
gggaacggcagggcuc

SEQ ID NO: 1190875 - RNA, 17 nt, Homo sapiens
gggacacuuacccaagg

SEQ ID NO: 1190876 - RNA, 23 nt, Homo sapiens
gggacagacgaaggcaaccauuu

SEQ ID NO: 1190877 - RNA, 16 nt, Homo sapiens
gggacaucucuuugaa

SEQ ID NO: 1190878 - RNA, 20 nt, Homo sapiens
gggacauugggaaggggacc

SEQ ID NO: 1190879 - RNA, 14 nt, Homo sapiens
gggaccagagggau

SEQ ID NO: 1190880 - RNA, 15 nt, Homo sapiens
gggacccagugcaga

SEQ ID NO: 1190881 - RNA, 20 nt, Homo sapiens
gggacgcuccgcugccgugc

SEQ ID NO: 1190882 - RNA, 18 nt, Homo sapiens
gggacugaaaaccucucc

SEQ ID NO: 1190883 - RNA, 13 nt, Homo sapiens
gggacuuuuguaa

SEQ ID NO: 1190884 - RNA, 19 nt, Homo sapiens
gggagaaaaaaagggaucu

SEQ ID NO: 1190885 - RNA, 24 nt, Homo sapiens
gggagaaacaggcgcggggucuca

SEQ ID NO: 1190886 - RNA, 19 nt, Homo sapiens
gggagaagcuccucucccc

SEQ ID NO: 1190887 - RNA, 19 nt, Homo sapiens
gggagacugggcugaggga

SEQ ID NO: 1190888 - RNA, 19 nt, Homo sapiens
gggagaggggagugcauuu

SEQ ID NO: 1190889 - RNA, 18 nt, Homo sapiens
gggagauggaucaaucaa

SEQ ID NO: 1190890 - RNA, 21 nt, Homo sapiens
gggagauucaagggacccaug

SEQ ID NO: 1190891 - RNA, 19 nt, Homo sapiens
gggagcaaaucgugccuug

SEQ ID NO: 1190892 - RNA, 19 nt, Homo sapiens
gggagccaaaggcauccag

SEQ ID NO: 1190893 - RNA, 21 nt, Homo sapiens
gggagccauggaaggugccag

SEQ ID NO: 1190894 - RNA, 15 nt, Homo sapiens
gggagccauguuuca

SEQ ID NO: 1190895 - RNA, 22 nt, Homo sapiens
gggagcccacuguccugggccu

SEQ ID NO: 1190896 - RNA, 14 nt, Homo sapiens
gggagcccucaggc

SEQ ID NO: 1190897 - RNA, 18 nt, Homo sapiens
gggagccugacccucauc

SEQ ID NO: 1190898 - RNA, 15 nt, Homo sapiens
gggaggaacagggaa

SEQ ID NO: 1190899 - RNA, 20 nt, Homo sapiens
gggaggcagagguugcagug

SEQ ID NO: 1190900 - RNA, 21 nt, Homo sapiens
gggaggccccagggggucuca

SEQ ID NO: 1190901 - RNA, 17 nt, Homo sapiens
gggaggcugcacuggag

SEQ ID NO: 1190902 - RNA, 15 nt, Homo sapiens
gggaguuuagggugg

SEQ ID NO: 1190903 - RNA, 13 nt, Homo sapiens
gggauauguuaac

SEQ ID NO: 1190904 - RNA, 22 nt, Homo sapiens
gggauggaagcaggacagacac

SEQ ID NO: 1190905 - RNA, 23 nt, Homo sapiens
gggauggguggaccaaacccuua

SEQ ID NO: 1190906 - RNA, 22 nt, Homo sapiens
gggauuacccaagcaaaaucau

SEQ ID NO: 1190907 - RNA, 23 nt, Homo sapiens
gggauuauaggcaugagccacug

SEQ ID NO: 1190908 - RNA, 19 nt, Homo sapiens
gggcaagagggaaggugac

SEQ ID NO: 1190909 - RNA, 17 nt, Homo sapiens
gggcacaugaucuggcc

SEQ ID NO: 1190910 - RNA, 19 nt, Homo sapiens
gggcagauggcagggcuga

SEQ ID NO: 1190911 - RNA, 15 nt, Homo sapiens
gggcagguccuaguc

SEQ ID NO: 1190912 - RNA, 14 nt, Homo sapiens
gggcagucauuauc

SEQ ID NO: 1190913 - RNA, 19 nt, Homo sapiens
gggcagugcccaccaugca

SEQ ID NO: 1190914 - RNA, 17 nt, Homo sapiens
gggccaaggucugagca

SEQ ID NO: 1190915 - RNA, 21 nt, Homo sapiens
gggccagagccagggggguga

SEQ ID NO: 1190916 - RNA, 12 nt, Homo sapiens
gggccagcacuu

SEQ ID NO: 1190917 - RNA, 22 nt, Homo sapiens
gggcccaagggcagaccuuucu

SEQ ID NO: 1190918 - RNA, 22 nt, Homo sapiens
gggcccaaguaagggcacagau

SEQ ID NO: 1190919 - RNA, 13 nt, Homo sapiens
gggcccacaaagg

SEQ ID NO: 1190920 - RNA, 14 nt, Homo sapiens
gggcccagagccca

SEQ ID NO: 1190921 - RNA, 16 nt, Homo sapiens
gggcccccaccgccgg

SEQ ID NO: 1190922 - RNA, 23 nt, Homo sapiens
gggcccccaccgccgggguccug

SEQ ID NO: 1190923 - RNA, 15 nt, Homo sapiens
gggcccccaucucau

SEQ ID NO: 1190924 - RNA, 23 nt, Homo sapiens
gggccggguuggggguugcuaga

SEQ ID NO: 1190925 - RNA, 22 nt, Homo sapiens
guaaauucuagcuuagucuaca

SEQ ID NO: 1190926 - RNA, 19 nt, Homo sapiens
guaacaaaccugcacuuau

SEQ ID NO: 1190927 - RNA, 14 nt, Homo sapiens
guaacaagccagau

SEQ ID NO: 1190928 - RNA, 20 nt, Homo sapiens
guaacaaucacuguucuaua

SEQ ID NO: 1190929 - RNA, 22 nt, Homo sapiens
guaacaggcuugaaucaaagaa

SEQ ID NO: 1190930 - RNA, 13 nt, Homo sapiens
guaaccauuuuau

SEQ ID NO: 1190931 - RNA, 16 nt, Homo sapiens
guaacuccaccaaccc

SEQ ID NO: 1190932 - RNA, 11 nt, Homo sapiens
guaacugcugu

SEQ ID NO: 1190933 - RNA, 16 nt, Homo sapiens
guaacuggcaguuuuc

SEQ ID NO: 1190934 - RNA, 18 nt, Homo sapiens
guaacugguaguguucag

SEQ ID NO: 1190935 - RNA, 19 nt, Homo sapiens
guaacugugccaguucuuu

SEQ ID NO: 1190936 - RNA, 16 nt, Homo sapiens
guaagcacucaauaaa

SEQ ID NO: 1190937 - RNA, 22 nt, Homo sapiens
guaagcauuuccagccuaucua

SEQ ID NO: 1190938 - RNA, 18 nt, Homo sapiens
guaagcugauuaccugaa

SEQ ID NO: 1190939 - RNA, 14 nt, Homo sapiens
guaagucauuuaac

SEQ ID NO: 1190940 - RNA, 15 nt, Homo sapiens
guaaucaaccuucua

SEQ ID NO: 1190941 - RNA, 22 nt, Homo sapiens
guaaucagcaauaaaaauccua

SEQ ID NO: 1190942 - RNA, 15 nt, Homo sapiens
guaaucccaacacuu

SEQ ID NO: 1190943 - RNA, 19 nt, Homo sapiens
guaaucccagcuacucagg

SEQ ID NO: 1190944 - RNA, 13 nt, Homo sapiens
guaaucugagcag

SEQ ID NO: 1190945 - RNA, 13 nt, Homo sapiens
guaaucuguguac

SEQ ID NO: 1190946 - RNA, 19 nt, Homo sapiens
guaaucuguguacaaagaa

SEQ ID NO: 1190947 - RNA, 15 nt, Homo sapiens
guaaugauguugaua

SEQ ID NO: 1190948 - RNA, 23 nt, Homo sapiens
guaaugggauuugaaucaaugua

SEQ ID NO: 1190949 - RNA, 15 nt, Homo sapiens
guaaugucaccaccu

SEQ ID NO: 1190950 - RNA, 17 nt, Homo sapiens
guaauuauuuucuuccu

SEQ ID NO: 1190951 - RNA, 21 nt, Homo sapiens
guaauuguacuaaagccaaac

SEQ ID NO: 1190952 - RNA, 20 nt, Homo sapiens
guaauuuuaguagagacagg

SEQ ID NO: 1190953 - RNA, 12 nt, Homo sapiens
guacaaaaccac

SEQ ID NO: 1190954 - RNA, 20 nt, Homo sapiens
guacaaugaacccccaugau

SEQ ID NO: 1190955 - RNA, 14 nt, Homo sapiens
guacagacauauuu

SEQ ID NO: 1190956 - RNA, 16 nt, Homo sapiens
guacagauacugugag

SEQ ID NO: 1190957 - RNA, 18 nt, Homo sapiens
guacaggcagcacagaga

SEQ ID NO: 1190958 - RNA, 22 nt, Homo sapiens
guacaguggaaccguugccaac

SEQ ID NO: 1190959 - RNA, 15 nt, Homo sapiens
guacaucugcaauau

SEQ ID NO: 1190960 - RNA, 21 nt, Homo sapiens
guacauucccaucuacuaaaa

SEQ ID NO: 1190961 - RNA, 13 nt, Homo sapiens
guacauucuuccu

SEQ ID NO: 1190962 - RNA, 14 nt, Homo sapiens
guaccauauagcaa

SEQ ID NO: 1190963 - RNA, 14 nt, Homo sapiens
guacccaguguuac

SEQ ID NO: 1190964 - RNA, 16 nt, Homo sapiens
guacccccuuucccuu

SEQ ID NO: 1190965 - RNA, 18 nt, Homo sapiens
guaccuccucucaguguu

SEQ ID NO: 1190966 - RNA, 18 nt, Homo sapiens
guaccugcccccaaucca

SEQ ID NO: 1190967 - RNA, 15 nt, Homo sapiens
guaccuguuccuccc

SEQ ID NO: 1190968 - RNA, 17 nt, Homo sapiens
guaccuucccacuggcc

SEQ ID NO: 1190969 - RNA, 21 nt, Homo sapiens
guacgaaucgaauacaaauca

SEQ ID NO: 1190970 - RNA, 13 nt, Homo sapiens
guacuaaagccaa

SEQ ID NO: 1190971 - RNA, 13 nt, Homo sapiens
guacuacauaccu

SEQ ID NO: 1190972 - RNA, 18 nt, Homo sapiens
guacuauauuugugaaua

SEQ ID NO: 1190973 - RNA, 22 nt, Homo sapiens
guacucuuaucugggugccuua

SEQ ID NO: 1190974 - RNA, 21 nt, Homo sapiens
guacugaguauugauaaacuu

SEQ ID NO: 1190975 - RNA, 14 nt, Homo sapiens
guacugucccagga

SEQ ID NO: 1190976 - RNA, 16 nt, Homo sapiens
guacuguuacuguguc

SEQ ID NO: 1190977 - RNA, 12 nt, Homo sapiens
guacuguucaca

SEQ ID NO: 1190978 - RNA, 22 nt, Homo sapiens
guacuuauaaagaagguuggug

SEQ ID NO: 1190979 - RNA, 16 nt, Homo sapiens
guacuucucucuucca

SEQ ID NO: 1190980 - RNA, 12 nt, Homo sapiens
guacuucuugaa

SEQ ID NO: 1190981 - RNA, 20 nt, Homo sapiens
guacuuguagaguggugcug

SEQ ID NO: 1190982 - RNA, 14 nt, Homo sapiens
guacuuugugcuga

SEQ ID NO: 1190983 - RNA, 22 nt, Homo sapiens
guacuuuguuuuuccauguguu

SEQ ID NO: 1190984 - RNA, 15 nt, Homo sapiens
guacuuuuuccagac

SEQ ID NO: 1190985 - RNA, 14 nt, Homo sapiens
guagaaacauuuag

SEQ ID NO: 1190986 - RNA, 19 nt, Homo sapiens
guagacaagcguugagcca

SEQ ID NO: 1190987 - RNA, 20 nt, Homo sapiens
guagaccucuuuuucuuacc

SEQ ID NO: 1190988 - RNA, 17 nt, Homo sapiens
guagacucauucuucac

SEQ ID NO: 1190989 - RNA, 14 nt, Homo sapiens
guagagccagccuu

SEQ ID NO: 1190990 - RNA, 23 nt, Homo sapiens
guagauauuggacaaagaaccuu

SEQ ID NO: 1190991 - RNA, 18 nt, Homo sapiens
guagaucuucaauuugga

SEQ ID NO: 1190992 - RNA, 21 nt, Homo sapiens
guagaugccacccaguuguga

SEQ ID NO: 1190993 - RNA, 12 nt, Homo sapiens
guagaugggagg

SEQ ID NO: 1190994 - RNA, 16 nt, Homo sapiens
guagcauuuuccagca

SEQ ID NO: 1190995 - RNA, 19 nt, Homo sapiens
guagccauguuaacaugac

SEQ ID NO: 1190996 - RNA, 13 nt, Homo sapiens
guagcccauccuu

SEQ ID NO: 1190997 - RNA, 16 nt, Homo sapiens
guagcccuggaccugc

SEQ ID NO: 1190998 - RNA, 15 nt, Homo sapiens
guagccuccuaucca

SEQ ID NO: 1190999 - RNA, 16 nt, Homo sapiens
guagccuuacugugaa

SEQ ID NO: 1191000 - RNA, 16 nt, Homo sapiens
guagcuacaggacauu

SEQ ID NO: 1191001 - RNA, 14 nt, Homo sapiens
guagcugcuaccuu

SEQ ID NO: 1191002 - RNA, 12 nt, Homo sapiens
guagcugggauu

SEQ ID NO: 1191003 - RNA, 17 nt, Homo sapiens
guagcugggauuacaga

SEQ ID NO: 1191004 - RNA, 19 nt, Homo sapiens
guagcuguucaguugccac

SEQ ID NO: 1191005 - RNA, 14 nt, Homo sapiens
guagcuuaagggaa

SEQ ID NO: 1191006 - RNA, 21 nt, Homo sapiens
guagcuuaccagaagcuucca

SEQ ID NO: 1191007 - RNA, 13 nt, Homo sapiens
guaggacccaagc

SEQ ID NO: 1191008 - RNA, 15 nt, Homo sapiens
guaggagacuugcca

SEQ ID NO: 1191009 - RNA, 23 nt, Homo sapiens
guaggcccugguuccugcugucc

SEQ ID NO: 1191010 - RNA, 21 nt, Homo sapiens
guagguagugauuaacuguga

SEQ ID NO: 1191011 - RNA, 17 nt, Homo sapiens
guaggugugacauguua

SEQ ID NO: 1191012 - RNA, 16 nt, Homo sapiens
guaguauuuaguauau

SEQ ID NO: 1191013 - RNA, 18 nt, Homo sapiens
guagucaaggugcucaau

SEQ ID NO: 1191014 - RNA, 21 nt, Homo sapiens
guagucauacucccuggugua

SEQ ID NO: 1191015 - RNA, 21 nt, Homo sapiens
guagugauuaacugugaauaa

SEQ ID NO: 1191016 - RNA, 23 nt, Homo sapiens
guagugucacucaaggcggugcu

SEQ ID NO: 1191017 - RNA, 18 nt, Homo sapiens
guaguucaauagucuaau

SEQ ID NO: 1191018 - RNA, 12 nt, Homo sapiens
guaguuuugcca

SEQ ID NO: 1191019 - RNA, 15 nt, Homo sapiens
guauaaagcucucaa

SEQ ID NO: 1191020 - RNA, 17 nt, Homo sapiens
guauaaagggacuugaa

SEQ ID NO: 1191021 - RNA, 15 nt, Homo sapiens
guauaaucuuuucau

SEQ ID NO: 1191022 - RNA, 15 nt, Homo sapiens
guauaaugaacacuc

SEQ ID NO: 1191023 - RNA, 12 nt, Homo sapiens
guauaauggggc

SEQ ID NO: 1191024 - RNA, 12 nt, Homo sapiens
guauacaguccu

SEQ ID NO: 1191025 - RNA, 19 nt, Homo sapiens
guauacucuugaguguuua

SEQ ID NO: 1191026 - RNA, 18 nt, Homo sapiens
guucuuucuuacacaaga

SEQ ID NO: 1191027 - RNA, 15 nt, Homo sapiens
guucuuugggccaga

SEQ ID NO: 1191028 - RNA, 16 nt, Homo sapiens
guucuuuugacuuaau

SEQ ID NO: 1191029 - RNA, 21 nt, Homo sapiens
guucuuuugacuuaaucucau

SEQ ID NO: 1191030 - RNA, 14 nt, Homo sapiens
guugaagacuuugu

SEQ ID NO: 1191031 - RNA, 19 nt, Homo sapiens
guugacucagagugcaaga

SEQ ID NO: 1191032 - RNA, 20 nt, Homo sapiens
guugacuuuauuucugagca

SEQ ID NO: 1191033 - RNA, 23 nt, Homo sapiens
guugagaccuuugauuuuuugcc

SEQ ID NO: 1191034 - RNA, 22 nt, Homo sapiens
guugagcuucauauaccagcaa

SEQ ID NO: 1191035 - RNA, 19 nt, Homo sapiens
guugaucuggaacccagac

SEQ ID NO: 1191036 - RNA, 22 nt, Homo sapiens
guugaucuggaacccagacuca

SEQ ID NO: 1191037 - RNA, 16 nt, Homo sapiens
guugaugguaggcugu

SEQ ID NO: 1191038 - RNA, 17 nt, Homo sapiens
guugauguaaugaaauu

SEQ ID NO: 1191039 - RNA, 17 nt, Homo sapiens
guugauuacagugcagu

SEQ ID NO: 1191040 - RNA, 18 nt, Homo sapiens
guugauuacagugcagug

SEQ ID NO: 1191041 - RNA, 19 nt, Homo sapiens
guugcacacccacucagcu

SEQ ID NO: 1191042 - RNA, 13 nt, Homo sapiens
guugcacuggcca

SEQ ID NO: 1191043 - RNA, 22 nt, Homo sapiens
guugcagcccuugugaugugau

SEQ ID NO: 1191044 - RNA, 16 nt, Homo sapiens
guugcaggcagugucu

SEQ ID NO: 1191045 - RNA, 21 nt, Homo sapiens
guugcauauaccaguugugau

SEQ ID NO: 1191046 - RNA, 19 nt, Homo sapiens
guugcaugaaauuuugccu

SEQ ID NO: 1191047 - RNA, 17 nt, Homo sapiens
guugccucuugcaaugc

SEQ ID NO: 1191048 - RNA, 21 nt, Homo sapiens
guugccuuaauauucugcuau

SEQ ID NO: 1191049 - RNA, 17 nt, Homo sapiens
guugccuuuuuuuuauu

SEQ ID NO: 1191050 - RNA, 23 nt, Homo sapiens
guugcuaaugccuuucaucuuga

SEQ ID NO: 1191051 - RNA, 19 nt, Homo sapiens
uagagacaggguuucacca

SEQ ID NO: 1191052 - RNA, 12 nt, Homo sapiens
uagagacaguga

SEQ ID NO: 1191053 - RNA, 18 nt, Homo sapiens
uagagauuaccuccugag

SEQ ID NO: 1191054 - RNA, 21 nt, Homo sapiens
uagagauuugguguacaauuc

SEQ ID NO: 1191055 - RNA, 13 nt, Homo sapiens
uagagcagacagg

SEQ ID NO: 1191056 - RNA, 18 nt, Homo sapiens
uagagcagauucaguguu

SEQ ID NO: 1191057 - RNA, 16 nt, Homo sapiens
uagaggaacuucugaa

SEQ ID NO: 1191058 - RNA, 13 nt, Homo sapiens
uagaggaagacga

SEQ ID NO: 1191059 - RNA, 18 nt, Homo sapiens
uagaggcaaagaacaauu

SEQ ID NO: 1191060 - RNA, 13 nt, Homo sapiens
uagagggcccaaa

SEQ ID NO: 1191061 - RNA, 16 nt, Homo sapiens
uagagguuauuucugc

SEQ ID NO: 1191062 - RNA, 19 nt, Homo sapiens
uagagugcucugacccugg

SEQ ID NO: 1191063 - RNA, 18 nt, Homo sapiens
uagagugugguuaugaac

SEQ ID NO: 1191064 - RNA, 20 nt, Homo sapiens
uagaguuuacagcucugacu

SEQ ID NO: 1191065 - RNA, 20 nt, Homo sapiens
uagaguuuuaucaacuuugg

SEQ ID NO: 1191066 - RNA, 16 nt, Homo sapiens
uagauaaacucagaaa

SEQ ID NO: 1191067 - RNA, 21 nt, Homo sapiens
uagauacacuaaaaaucugag

SEQ ID NO: 1191068 - RNA, 21 nt, Homo sapiens
uagaugcuggcaucucugcag

SEQ ID NO: 1191069 - RNA, 16 nt, Homo sapiens
uagauuaccuagcuua

SEQ ID NO: 1191070 - RNA, 17 nt, Homo sapiens
uagauugcuaguuuauu

SEQ ID NO: 1191071 - RNA, 12 nt, Homo sapiens
uagauuugaccu

SEQ ID NO: 1191072 - RNA, 15 nt, Homo sapiens
uagcaaacuuuucac

SEQ ID NO: 1191073 - RNA, 19 nt, Homo sapiens
uagcaaagaagcuucaugc

SEQ ID NO: 1191074 - RNA, 21 nt, Homo sapiens
uagcaacuuguguuacaaaaa

SEQ ID NO: 1191075 - RNA, 16 nt, Homo sapiens
uagcacaugcuucaau

SEQ ID NO: 1191076 - RNA, 21 nt, Homo sapiens
uagcacccugcccucauggga

SEQ ID NO: 1191077 - RNA, 22 nt, Homo sapiens
uagcacggccaccucucagggc

SEQ ID NO: 1191078 - RNA, 17 nt, Homo sapiens
uagcagacuagaauucu

SEQ ID NO: 1191079 - RNA, 20 nt, Homo sapiens
uagcagaggagccauguccu

SEQ ID NO: 1191080 - RNA, 22 nt, Homo sapiens
uagcagcaccguucugugcaca

SEQ ID NO: 1191081 - RNA, 20 nt, Homo sapiens
uagcagcccacccugcugcu

SEQ ID NO: 1191082 - RNA, 15 nt, Homo sapiens
uagcagguuucacua

SEQ ID NO: 1191083 - RNA, 17 nt, Homo sapiens
uagcaguccccagugau

SEQ ID NO: 1191084 - RNA, 13 nt, Homo sapiens
uagcauaauacag

SEQ ID NO: 1191085 - RNA, 13 nt, Homo sapiens
uagcauacgguau

SEQ ID NO: 1191086 - RNA, 19 nt, Homo sapiens
uagcaugaggccacugcug

SEQ ID NO: 1191087 - RNA, 19 nt, Homo sapiens
uagcaugaguuuaaaucaa

SEQ ID NO: 1191088 - RNA, 14 nt, Homo sapiens
uagccaaccagcag

SEQ ID NO: 1191089 - RNA, 17 nt, Homo sapiens
uagccaacucucccaaa

SEQ ID NO: 1191090 - RNA, 22 nt, Homo sapiens
uagccaggauggacuccaucuc

SEQ ID NO: 1191091 - RNA, 16 nt, Homo sapiens
uagccaucuaaugcuu

SEQ ID NO: 1191092 - RNA, 15 nt, Homo sapiens
uagccggguguggca

SEQ ID NO: 1191093 - RNA, 22 nt, Homo sapiens
uagccuggauauuauucuugua

SEQ ID NO: 1191094 - RNA, 13 nt, Homo sapiens
uagcuacugcuaa

SEQ ID NO: 1191095 - RNA, 18 nt, Homo sapiens
uagcuacuguaugcaaag

SEQ ID NO: 1191096 - RNA, 17 nt, Homo sapiens
uagcuagaagugggcca

SEQ ID NO: 1191097 - RNA, 14 nt, Homo sapiens
uagcuccaaagcau

SEQ ID NO: 1191098 - RNA, 18 nt, Homo sapiens
uagcucuguaguggaaua

SEQ ID NO: 1191099 - RNA, 22 nt, Homo sapiens
uagcugacggcuggguguuuca

SEQ ID NO: 1191100 - RNA, 22 nt, Homo sapiens
uagcuugagcuggauucacuug

SEQ ID NO: 1191101 - RNA, 21 nt, Homo sapiens
uagcuuuccuggaagucaaau

SEQ ID NO: 1191102 - RNA, 23 nt, Homo sapiens
uagcuuugcagugagugcugcuc

SEQ ID NO: 1191103 - RNA, 23 nt, Homo sapiens
uaggaaaaggggaaaguauuuau

SEQ ID NO: 1191104 - RNA, 16 nt, Homo sapiens
uaggaacgguaaauuu

SEQ ID NO: 1191105 - RNA, 14 nt, Homo sapiens
uaggaagagacaca

SEQ ID NO: 1191106 - RNA, 17 nt, Homo sapiens
uaggaagaucucugcag

SEQ ID NO: 1191107 - RNA, 13 nt, Homo sapiens
uaggaaguaggaa

SEQ ID NO: 1191108 - RNA, 22 nt, Homo sapiens
uaggacacauuuagaugcacua

SEQ ID NO: 1191109 - RNA, 16 nt, Homo sapiens
uaggacuaaguucuca

SEQ ID NO: 1191110 - RNA, 15 nt, Homo sapiens
uaggagacacaggga

SEQ ID NO: 1191111 - RNA, 19 nt, Homo sapiens
uaggagcaacuucucugau

SEQ ID NO: 1191112 - RNA, 20 nt, Homo sapiens
uaggauuacuaggugcccag

SEQ ID NO: 1191113 - RNA, 20 nt, Homo sapiens
uaggcaaaagaaaagcucag

SEQ ID NO: 1191114 - RNA, 16 nt, Homo sapiens
uaggcaugguggacuc

SEQ ID NO: 1191115 - RNA, 19 nt, Homo sapiens
uaggcccacacacaggugg

SEQ ID NO: 1191116 - RNA, 21 nt, Homo sapiens
uaggccuccuggcccagguga

SEQ ID NO: 1191117 - RNA, 15 nt, Homo sapiens
uaggcucugccuucg

SEQ ID NO: 1191118 - RNA, 20 nt, Homo sapiens
uaggcuuacguacuacuugu

SEQ ID NO: 1191119 - RNA, 13 nt, Homo sapiens
uagggcugggaaa

SEQ ID NO: 1191120 - RNA, 22 nt, Homo sapiens
uaggggacuaauucacuggcga

SEQ ID NO: 1191121 - RNA, 19 nt, Homo sapiens
uaggggagccugugguggc

SEQ ID NO: 1191122 - RNA, 23 nt, Homo sapiens
uaggggauggggaggaagagaga

SEQ ID NO: 1191123 - RNA, 22 nt, Homo sapiens
uagggggagcaaaucgugccuu

SEQ ID NO: 1191124 - RNA, 20 nt, Homo sapiens
uagggugcugcgcagcaucc

SEQ ID NO: 1191125 - RNA, 19 nt, Homo sapiens
uaggguuuaaaauagggga

SEQ ID NO: 1191126 - RNA, 14 nt, Homo sapiens
uagguaaagcuaua

SEQ ID NO: 1191127 - RNA, 17 nt, Homo sapiens
uagguaucauucaacuc

SEQ ID NO: 1191128 - RNA, 19 nt, Homo sapiens
uaggugagguuuauagaaa

SEQ ID NO: 1191129 - RNA, 15 nt, Homo sapiens
uaggugcaguuugcu

SEQ ID NO: 1191130 - RNA, 24 nt, Homo sapiens
uagguuaguagcccuucagucuua

SEQ ID NO: 1191131 - RNA, 14 nt, Homo sapiens
uagguucuuuuuau

SEQ ID NO: 1191132 - RNA, 15 nt, Homo sapiens
uagguuggacuggaa

SEQ ID NO: 1191133 - RNA, 16 nt, Homo sapiens
uagguuuguagugaaa

SEQ ID NO: 1191134 - RNA, 17 nt, Homo sapiens
uaguaaaagaugccaua

SEQ ID NO: 1191135 - RNA, 15 nt, Homo sapiens
uaguaacaucaaaga

SEQ ID NO: 1191136 - RNA, 13 nt, Homo sapiens
uaguaacugcugu

SEQ ID NO: 1191137 - RNA, 23 nt, Homo sapiens
uaguauaguaaaaccaaccagcu

SEQ ID NO: 1191138 - RNA, 21 nt, Homo sapiens
uaguauugcagccaaagaaua

SEQ ID NO: 1191139 - RNA, 18 nt, Homo sapiens
uaguauuuggcauucucu

SEQ ID NO: 1191140 - RNA, 20 nt, Homo sapiens
uaguauuuucuacuagccau

SEQ ID NO: 1191141 - RNA, 17 nt, Homo sapiens
uagucaaggugcucaau

SEQ ID NO: 1191142 - RNA, 20 nt, Homo sapiens
uagucaauuucuacuucugg

SEQ ID NO: 1191143 - RNA, 21 nt, Homo sapiens
uagucacauggccuaugcaca

SEQ ID NO: 1191144 - RNA, 17 nt, Homo sapiens
uagucccagcuacuccg

SEQ ID NO: 1191145 - RNA, 17 nt, Homo sapiens
uagucgaacaauucaua

SEQ ID NO: 1191146 - RNA, 20 nt, Homo sapiens
uagucuacucuuaagccauc

SEQ ID NO: 1191147 - RNA, 15 nt, Homo sapiens
uagucucagcacuau

SEQ ID NO: 1191148 - RNA, 13 nt, Homo sapiens
uagucuccaugca

SEQ ID NO: 1191149 - RNA, 16 nt, Homo sapiens
uagucucuacccagua

SEQ ID NO: 1191150 - RNA, 23 nt, Homo sapiens
uagucucuacccaguagaugcca

SEQ ID NO: 1191151 - RNA, 15 nt, Homo sapiens
uagugaauggucucu

SEQ ID NO: 1191152 - RNA, 13 nt, Homo sapiens
uagugacauuuaa

SEQ ID NO: 1191153 - RNA, 17 nt, Homo sapiens
uagugaccccugccuac

SEQ ID NO: 1191154 - RNA, 14 nt, Homo sapiens
uagugauggagcuu

SEQ ID NO: 1191155 - RNA, 14 nt, Homo sapiens
uagugcaacuuaga

SEQ ID NO: 1191156 - RNA, 20 nt, Homo sapiens
uagugcacccagugacugac

SEQ ID NO: 1191157 - RNA, 15 nt, Homo sapiens
uagugccaccacagc

SEQ ID NO: 1191158 - RNA, 15 nt, Homo sapiens
uagugcccucaucca

SEQ ID NO: 1191159 - RNA, 11 nt, Homo sapiens
uagugcuucuu

SEQ ID NO: 1191160 - RNA, 16 nt, Homo sapiens
uaguggauaaccacag

SEQ ID NO: 1191161 - RNA, 21 nt, Homo sapiens
uaguggggagacuucuuggcu

SEQ ID NO: 1191162 - RNA, 13 nt, Homo sapiens
uaguguaccuccu

SEQ ID NO: 1191163 - RNA, 14 nt, Homo sapiens
uagugucaguacua

SEQ ID NO: 1191164 - RNA, 15 nt, Homo sapiens
uaguuaacauuucaa

SEQ ID NO: 1191165 - RNA, 17 nt, Homo sapiens
uaguuacuccagugcca

SEQ ID NO: 1191166 - RNA, 20 nt, Homo sapiens
uaguuagaauuauaucacuu

SEQ ID NO: 1191167 - RNA, 15 nt, Homo sapiens
uaguuauuuacuuga

SEQ ID NO: 1191168 - RNA, 17 nt, Homo sapiens
guggauacagucauuau

SEQ ID NO: 1191169 - RNA, 17 nt, Homo sapiens
guggaugccugcugcau

SEQ ID NO: 1191170 - RNA, 23 nt, Homo sapiens
guggcaaaaauaaugacauguag

SEQ ID NO: 1191171 - RNA, 16 nt, Homo sapiens
guggcagauuuaguga

SEQ ID NO: 1191172 - RNA, 20 nt, Homo sapiens
guggcagcggggcaagcaaa

SEQ ID NO: 1191173 - RNA, 14 nt, Homo sapiens
guggccacuuucca

SEQ ID NO: 1191174 - RNA, 15 nt, Homo sapiens
guggccuaccuugug

SEQ ID NO: 1191175 - RNA, 15 nt, Homo sapiens
guggcgugagcugcc

SEQ ID NO: 1191176 - RNA, 17 nt, Homo sapiens
guggcuaagggggacca

SEQ ID NO: 1191177 - RNA, 12 nt, Homo sapiens
guggcucuucag

SEQ ID NO: 1191178 - RNA, 15 nt, Homo sapiens
guggcuucacagacc

SEQ ID NO: 1191179 - RNA, 23 nt, Homo sapiens
gugggacuccaggccagcuccuu

SEQ ID NO: 1191180 - RNA, 20 nt, Homo sapiens
gugggagauguuagacucau

SEQ ID NO: 1191181 - RNA, 17 nt, Homo sapiens
gugggagguugugcaug

SEQ ID NO: 1191182 - RNA, 21 nt, Homo sapiens
gugggcaucucaguuaggaga

SEQ ID NO: 1191183 - RNA, 14 nt, Homo sapiens
guggggaaggggug

SEQ ID NO: 1191184 - RNA, 16 nt, Homo sapiens
guggggcugaggggug

SEQ ID NO: 1191185 - RNA, 14 nt, Homo sapiens
guggggugcacucg

SEQ ID NO: 1191186 - RNA, 14 nt, Homo sapiens
guggguugcacugg

SEQ ID NO: 1191187 - RNA, 16 nt, Homo sapiens
gugguaaaugccacac

SEQ ID NO: 1191188 - RNA, 14 nt, Homo sapiens
gugguccacugagc

SEQ ID NO: 1191189 - RNA, 17 nt, Homo sapiens
gugguccuuugggguga

SEQ ID NO: 1191190 - RNA, 18 nt, Homo sapiens
guggucucgaugcugcug

SEQ ID NO: 1191191 - RNA, 22 nt, Homo sapiens
gugguguccugaagcugcugga

SEQ ID NO: 1191192 - RNA, 19 nt, Homo sapiens
gugguguuaaucauuucau

SEQ ID NO: 1191193 - RNA, 16 nt, Homo sapiens
gugguguuucuguaag

SEQ ID NO: 1191194 - RNA, 19 nt, Homo sapiens
gugguugaagagcaaugug

SEQ ID NO: 1191195 - RNA, 19 nt, Homo sapiens
gugguuuaucagcaaaaaa

SEQ ID NO: 1191196 - RNA, 17 nt, Homo sapiens
uaguuauuucugccuau

SEQ ID NO: 1191197 - RNA, 22 nt, Homo sapiens
uaguucccugaaaacccagaga

SEQ ID NO: 1191198 - RNA, 16 nt, Homo sapiens
uaguucugccaggaga

SEQ ID NO: 1191199 - RNA, 21 nt, Homo sapiens
uaguugcaugaaauuuugccu

SEQ ID NO: 1191200 - RNA, 20 nt, Homo sapiens
uaguugcguggacucugcac

SEQ ID NO: 1191201 - RNA, 14 nt, Homo sapiens
uaguuuauuuacuc

SEQ ID NO: 1191202 - RNA, 19 nt, Homo sapiens
uaguuucacccugcacuac

SEQ ID NO: 1191203 - RNA, 19 nt, Homo sapiens
uaguuugacucaguauagg

SEQ ID NO: 1191204 - RNA, 22 nt, Homo sapiens
uaguuugcauuccugauaugau

SEQ ID NO: 1191205 - RNA, 20 nt, Homo sapiens
uaguuuguuaugugucugga

SEQ ID NO: 1191206 - RNA, 17 nt, Homo sapiens
uaguuuuuagucugugu

SEQ ID NO: 1191207 - RNA, 18 nt, Homo sapiens
uauaaaaagaugaucgcu

SEQ ID NO: 1191208 - RNA, 14 nt, Homo sapiens
uauaaaacuugaua

SEQ ID NO: 1191209 - RNA, 18 nt, Homo sapiens
uauaaaauuaacaugaua

SEQ ID NO: 1191210 - RNA, 15 nt, Homo sapiens
uauaaaccuuaugaa

SEQ ID NO: 1191211 - RNA, 18 nt, Homo sapiens
ucacucagccccuacccc

SEQ ID NO: 1191212 - RNA, 18 nt, Homo sapiens
ucacucccuaggcccaag

SEQ ID NO: 1191213 - RNA, 13 nt, Homo sapiens
ucacuccuacccc

SEQ ID NO: 1191214 - RNA, 21 nt, Homo sapiens
ucacuccugccuccucagcuu

SEQ ID NO: 1191215 - RNA, 19 nt, Homo sapiens
ucacucgcaggaccaaggg

SEQ ID NO: 1191216 - RNA, 16 nt, Homo sapiens
ucacucuauacaucuu

SEQ ID NO: 1191217 - RNA, 19 nt, Homo sapiens
ucacucuucaaaugccuga

SEQ ID NO: 1191218 - RNA, 12 nt, Homo sapiens
ucacucuuggag

SEQ ID NO: 1191219 - RNA, 23 nt, Homo sapiens
ucacugaugggaaaacugccaau

SEQ ID NO: 1191220 - RNA, 23 nt, Homo sapiens
ucacugccagagauaaacuaaug

SEQ ID NO: 1191221 - RNA, 18 nt, Homo sapiens
ucaucauucucugucuca

SEQ ID NO: 1191222 - RNA, 17 nt, Homo sapiens
ucaucauuucagccaaa

SEQ ID NO: 1191223 - RNA, 17 nt, Homo sapiens
ucauccaagcuuguauu

SEQ ID NO: 1191224 - RNA, 20 nt, Homo sapiens
ucauccacguccugucuguu

SEQ ID NO: 1191225 - RNA, 14 nt, Homo sapiens
ucaucccauguuag

SEQ ID NO: 1191226 - RNA, 16 nt, Homo sapiens
ucauccccuuacccuu

SEQ ID NO: 1191227 - RNA, 21 nt, Homo sapiens
ucaucccgagcaccuccacau

SEQ ID NO: 1191228 - RNA, 23 nt, Homo sapiens
ucaucccucccugccuaaggaag

SEQ ID NO: 1191229 - RNA, 18 nt, Homo sapiens
ucaucggaaauggcggua

SEQ ID NO: 1191230 - RNA, 14 nt, Homo sapiens
ucaucguggcuguu

SEQ ID NO: 1191231 - RNA, 18 nt, Homo sapiens
ucaucucccaccuagcag

SEQ ID NO: 1191232 - RNA, 16 nt, Homo sapiens
ucaucucucaucacuu

SEQ ID NO: 1191233 - RNA, 17 nt, Homo sapiens
ucaucucugccuuugag

SEQ ID NO: 1191234 - RNA, 21 nt, Homo sapiens
ucaucugaaggggcaaauucu

SEQ ID NO: 1191235 - RNA, 13 nt, Homo sapiens
ucaucugugcacu

SEQ ID NO: 1191236 - RNA, 14 nt, Homo sapiens
ucaucuucacugca

SEQ ID NO: 1191237 - RNA, 10 nt, Homo sapiens
ucaucuuccc

SEQ ID NO: 1191238 - RNA, 20 nt, Homo sapiens
ucaucuugaccaagcaggaa

SEQ ID NO: 1191239 - RNA, 18 nt, Homo sapiens
ucaucuuggucacauaca

SEQ ID NO: 1191240 - RNA, 19 nt, Homo sapiens
ucaucuuggucacauacaa

SEQ ID NO: 1191241 - RNA, 22 nt, Homo sapiens
ucaugaaauuacuuaucaucca

SEQ ID NO: 1191242 - RNA, 20 nt, Homo sapiens
ucaugaauaauccaccccuu

SEQ ID NO: 1191243 - RNA, 16 nt, Homo sapiens
ucaugaauugugagca

SEQ ID NO: 1191244 - RNA, 22 nt, Homo sapiens
ucaugagccuguuuauugccau

SEQ ID NO: 1191245 - RNA, 18 nt, Homo sapiens
ucaugaggccggaugaaa

SEQ ID NO: 1191246 - RNA, 14 nt, Homo sapiens
ucaugaucaucaca

SEQ ID NO: 1191247 - RNA, 22 nt, Homo sapiens
ucaugaugcuagccagcaaaga

SEQ ID NO: 1191248 - RNA, 17 nt, Homo sapiens
ucaugcagcaggugcaa

SEQ ID NO: 1191249 - RNA, 10 nt, Homo sapiens
ucaugcccuc

SEQ ID NO: 1191250 - RNA, 18 nt, Homo sapiens
ucaugcuuuugcuugcaa

SEQ ID NO: 1191251 - RNA, 20 nt, Homo sapiens
ucaugcuuuugcuugcaaug

SEQ ID NO: 1191252 - RNA, 20 nt, Homo sapiens
ucauggaaaagccuucuuau

SEQ ID NO: 1191253 - RNA, 19 nt, Homo sapiens
ucaugggaaggggaggacc

SEQ ID NO: 1191254 - RNA, 23 nt, Homo sapiens
ucauggguccagccuaaaaacca

SEQ ID NO: 1191255 - RNA, 14 nt, Homo sapiens
ucauguaaacauac

SEQ ID NO: 1191256 - RNA, 17 nt, Homo sapiens
ucauguaaacugugcac

SEQ ID NO: 1191257 - RNA, 19 nt, Homo sapiens
ucauguaaaugcucaaaga

SEQ ID NO: 1191258 - RNA, 17 nt, Homo sapiens
ucauguagccccaguca

SEQ ID NO: 1191259 - RNA, 17 nt, Homo sapiens
ucauguauaguuuuccc

SEQ ID NO: 1191260 - RNA, 17 nt, Homo sapiens
ucaugugacucuuucca

SEQ ID NO: 1191261 - RNA, 23 nt, Homo sapiens
ucauguguguccacgacugucuc

SEQ ID NO: 1191262 - RNA, 21 nt, Homo sapiens
ucauguuuuuucugcaaugac

SEQ ID NO: 1191263 - RNA, 17 nt, Homo sapiens
ucauuaaaguucuagug

SEQ ID NO: 1191264 - RNA, 21 nt, Homo sapiens
ucauuaaggucauuacucuca

SEQ ID NO: 1191265 - RNA, 14 nt, Homo sapiens
ucauuaaugcacau

SEQ ID NO: 1191266 - RNA, 13 nt, Homo sapiens
ucauuacagauuc

SEQ ID NO: 1191267 - RNA, 15 nt, Homo sapiens
ucauuacuaaccaua

SEQ ID NO: 1191268 - RNA, 18 nt, Homo sapiens
ucauuaggcuuacguacu

SEQ ID NO: 1191269 - RNA, 15 nt, Homo sapiens
ucauuauauucauau

SEQ ID NO: 1191270 - RNA, 14 nt, Homo sapiens
ucauuauuccaucu

SEQ ID NO: 1191271 - RNA, 19 nt, Homo sapiens
ucauuauuuuucacugccc

SEQ ID NO: 1191272 - RNA, 20 nt, Homo sapiens
ucauucaauaaauuguaauu

SEQ ID NO: 1191273 - RNA, 18 nt, Homo sapiens
ucauucauucaaguaaua

SEQ ID NO: 1191274 - RNA, 23 nt, Homo sapiens
ucauucgccucuggaucugcugc

SEQ ID NO: 1191275 - RNA, 13 nt, Homo sapiens
ucauucuacugaa

SEQ ID NO: 1191276 - RNA, 19 nt, Homo sapiens
ucauuggaaacacugccuu

SEQ ID NO: 1191277 - RNA, 15 nt, Homo sapiens
ucauuggcucuugaa

SEQ ID NO: 1191278 - RNA, 14 nt, Homo sapiens
ucauuguaaucacu

SEQ ID NO: 1191279 - RNA, 17 nt, Homo sapiens
ucauuucacccaaguau

SEQ ID NO: 1191280 - RNA, 14 nt, Homo sapiens
ucauuuucagugac

SEQ ID NO: 1191281 - RNA, 19 nt, Homo sapiens
ucauuuuuuccagucuucc

SEQ ID NO: 1191282 - RNA, 17 nt, Homo sapiens
uccaaaaaaauacugcc

SEQ ID NO: 1191283 - RNA, 20 nt, Homo sapiens
uccaaaaaaauacugccaga

SEQ ID NO: 1191284 - RNA, 23 nt, Homo sapiens
uccaaaaaugcacccaacuagcu

SEQ ID NO: 1191285 - RNA, 12 nt, Homo sapiens
uccaaaagcaaa

SEQ ID NO: 1191286 - RNA, 19 nt, Homo sapiens
uccaaaaguggaagugaca

SEQ ID NO: 1191287 - RNA, 22 nt, Homo sapiens
uccaaacaauuuaaaaaugagu

SEQ ID NO: 1191288 - RNA, 19 nt, Homo sapiens
uccaaauccagccuuugga

SEQ ID NO: 1191289 - RNA, 19 nt, Homo sapiens
uccaaauggcuuugcagaa

SEQ ID NO: 1191290 - RNA, 14 nt, Homo sapiens
uccaacaguagcau

SEQ ID NO: 1191291 - RNA, 23 nt, Homo sapiens
uccaaccugaagguccccuggca

SEQ ID NO: 1191292 - RNA, 23 nt, Homo sapiens
uccaacggcaagggaacaaguac

SEQ ID NO: 1191293 - RNA, 14 nt, Homo sapiens
uccaacuccaggau

SEQ ID NO: 1191294 - RNA, 15 nt, Homo sapiens
uccaacuccaggaua

SEQ ID NO: 1191295 - RNA, 21 nt, Homo sapiens
uccaacuccuuucagccacau

SEQ ID NO: 1191296 - RNA, 20 nt, Homo sapiens
uccaagacucuagaguccaa

SEQ ID NO: 1191297 - RNA, 15 nt, Homo sapiens
uccaagcccaguuca

SEQ ID NO: 1191298 - RNA, 22 nt, Homo sapiens
uccaaugaaaaaauuaaaaccu

SEQ ID NO: 1191299 - RNA, 13 nt, Homo sapiens
uccaaugcucaag

SEQ ID NO: 1191300 - RNA, 18 nt, Homo sapiens
uccaauuccuugcacaua

SEQ ID NO: 1191301 - RNA, 19 nt, Homo sapiens
uccaauuccuugcacauag

SEQ ID NO: 1191302 - RNA, 19 nt, Homo sapiens
uccaauuugacaaaaccca

SEQ ID NO: 1191303 - RNA, 23 nt, Homo sapiens
uccacaaaaacucuuauuacugu

SEQ ID NO: 1191304 - RNA, 14 nt, Homo sapiens
uccacaaagcaaag

SEQ ID NO: 1191305 - RNA, 20 nt, Homo sapiens
uccacaagauucccagagac

SEQ ID NO: 1191306 - RNA, 22 nt, Homo sapiens
uccacaaugaugaugauuucag

SEQ ID NO: 1191307 - RNA, 17 nt, Homo sapiens
uccacacccaauuccac

SEQ ID NO: 1191308 - RNA, 16 nt, Homo sapiens
uccacaggaucaucau

SEQ ID NO: 1191309 - RNA, 14 nt, Homo sapiens
uccaccaccaccug

SEQ ID NO: 1191310 - RNA, 15 nt, Homo sapiens
uccaccacugcuuaa

SEQ ID NO: 1191311 - RNA, 16 nt, Homo sapiens
uccaccacugcuuaag

SEQ ID NO: 1191312 - RNA, 21 nt, Homo sapiens
uccaccccagcaggacaguga

SEQ ID NO: 1191313 - RNA, 23 nt, Homo sapiens
uccacggagccacuccucugacu

SEQ ID NO: 1191314 - RNA, 15 nt, Homo sapiens
uccacgggcucuccu

SEQ ID NO: 1191315 - RNA, 18 nt, Homo sapiens
uccacguguaugcaagug

SEQ ID NO: 1191316 - RNA, 14 nt, Homo sapiens
uccacuacugcuac

SEQ ID NO: 1191317 - RNA, 14 nt, Homo sapiens
uccacucucuacca

SEQ ID NO: 1191318 - RNA, 20 nt, Homo sapiens
uccacugcugaggacacuca

SEQ ID NO: 1191319 - RNA, 16 nt, Homo sapiens
uccacuuauaaaggaa

SEQ ID NO: 1191320 - RNA, 23 nt, Homo sapiens
uccacuuggaaauggcaugcaaa

SEQ ID NO: 1191321 - RNA, 16 nt, Homo sapiens
uccacuugguucaggu

SEQ ID NO: 1191322 - RNA, 19 nt, Homo sapiens
uccagaaaacaaaacugca

SEQ ID NO: 1191323 - RNA, 20 nt, Homo sapiens
uccagaaccgacgcaugaag

SEQ ID NO: 1191324 - RNA, 18 nt, Homo sapiens
uccagaacuucaccucca

SEQ ID NO: 1191325 - RNA, 22 nt, Homo sapiens
uccagaagauagcuucacccca

SEQ ID NO: 1191326 - RNA, 14 nt, Homo sapiens
uccagaagcacugg

SEQ ID NO: 1191327 - RNA, 17 nt, Homo sapiens
uccagagacaggaaaga

SEQ ID NO: 1191328 - RNA, 16 nt, Homo sapiens
uccagauaugugccaa

SEQ ID NO: 1191329 - RNA, 19 nt, Homo sapiens
uccagcaaacaaaauggac

SEQ ID NO: 1191330 - RNA, 17 nt, Homo sapiens
uccagcaagaagggagu

SEQ ID NO: 1191331 - RNA, 13 nt, Homo sapiens
uccagcagcugcc

SEQ ID NO: 1191332 - RNA, 15 nt, Homo sapiens
uccagcaucaauucc

SEQ ID NO: 1191333 - RNA, 14 nt, Homo sapiens
uccagcauggauga

SEQ ID NO: 1191334 - RNA, 13 nt, Homo sapiens
uccagcauguugc

SEQ ID NO: 1191335 - RNA, 14 nt, Homo sapiens
uccagcauguugca

SEQ ID NO: 1191336 - RNA, 17 nt, Homo sapiens
uccagcccugcagcuau

SEQ ID NO: 1191337 - RNA, 17 nt, Homo sapiens
uccagcuacuuuugcca

SEQ ID NO: 1191338 - RNA, 19 nt, Homo sapiens
uccagcuacuuuugccaaa

SEQ ID NO: 1191339 - RNA, 17 nt, Homo sapiens
uccagcugccccgggga

SEQ ID NO: 1191340 - RNA, 16 nt, Homo sapiens
uccagcuuuacugugg

SEQ ID NO: 1191341 - RNA, 19 nt, Homo sapiens
uccagcuuuuccucagggu

SEQ ID NO: 1191342 - RNA, 21 nt, Homo sapiens
uccagcuuuugaaaacaguga

SEQ ID NO: 1191343 - RNA, 18 nt, Homo sapiens
uccaggaaccacaccaca

SEQ ID NO: 1191344 - RNA, 16 nt, Homo sapiens
uccaggacugggucug

SEQ ID NO: 1191345 - RNA, 22 nt, Homo sapiens
uccaggacugugccagcacaaa

SEQ ID NO: 1191346 - RNA, 19 nt, Homo sapiens
uccagggcccccaucucau

SEQ ID NO: 1191347 - RNA, 20 nt, Homo sapiens
uccagguaccuugaccuuug

SEQ ID NO: 1191348 - RNA, 22 nt, Homo sapiens
uccauuuccauguccccuccca

SEQ ID NO: 1191349 - RNA, 20 nt, Homo sapiens
uccauuucccacaucuuucc

SEQ ID NO: 1191350 - RNA, 18 nt, Homo sapiens
uccauuuccuaauguaua

SEQ ID NO: 1191351 - RNA, 22 nt, Homo sapiens
uccauuugagugaguucccuua

SEQ ID NO: 1191352 - RNA, 21 nt, Homo sapiens
uccauuuggcagaacugcugg

SEQ ID NO: 1191353 - RNA, 17 nt, Homo sapiens
uccauuuuuagugaaau

SEQ ID NO: 1191354 - RNA, 18 nt, Homo sapiens
ucccaaaccuucaggaaa

SEQ ID NO: 1191355 - RNA, 19 nt, Homo sapiens
ucccaaagggcacauuucu

SEQ ID NO: 1191356 - RNA, 19 nt, Homo sapiens
ucccaaaugagccaugaga

SEQ ID NO: 1191357 - RNA, 18 nt, Homo sapiens
ucccaacuccauucucuu

SEQ ID NO: 1191358 - RNA, 23 nt, Homo sapiens
ucccaacugcagguccagugcag

SEQ ID NO: 1191359 - RNA, 13 nt, Homo sapiens
ucccaagcucaga

SEQ ID NO: 1191360 - RNA, 19 nt, Homo sapiens
ucccaaggugaaaugaagc

SEQ ID NO: 1191361 - RNA, 18 nt, Homo sapiens
ucccaaguagaaucucag

SEQ ID NO: 1191362 - RNA, 20 nt, Homo sapiens
ucccaaguagcugggauuac

SEQ ID NO: 1191363 - RNA, 13 nt, Homo sapiens
ucccacacaagac

SEQ ID NO: 1191364 - RNA, 23 nt, Homo sapiens
ucccacacgcacugcacugccau

SEQ ID NO: 1191365 - RNA, 13 nt, Homo sapiens
ucccacaggacau

SEQ ID NO: 1191366 - RNA, 19 nt, Homo sapiens
ucccacccacaugugacac

SEQ ID NO: 1191367 - RNA, 21 nt, Homo sapiens
ucccacccacaugugacacau

SEQ ID NO: 1191368 - RNA, 14 nt, Homo sapiens
ucccacccagucuc

SEQ ID NO: 1191369 - RNA, 21 nt, Homo sapiens
ucccacggggaccacugggcc

SEQ ID NO: 1191370 - RNA, 17 nt, Homo sapiens
ucccacuauauugcaca

SEQ ID NO: 1191371 - RNA, 13 nt, Homo sapiens
ucccacucaagcc

SEQ ID NO: 1191372 - RNA, 15 nt, Homo sapiens
ucccacucaagccaa

SEQ ID NO: 1191373 - RNA, 20 nt, Homo sapiens
ucccacuuugcuguuccuua

SEQ ID NO: 1191374 - RNA, 16 nt, Homo sapiens
ucccagacacauucac

SEQ ID NO: 1191375 - RNA, 14 nt, Homo sapiens
ucccagagcugcac

SEQ ID NO: 1191376 - RNA, 13 nt, Homo sapiens
ucccagcacuuug

SEQ ID NO: 1191377 - RNA, 22 nt, Homo sapiens
ucccagcacuuugggaggccaa

SEQ ID NO: 1191378 - RNA, 16 nt, Homo sapiens
ucccagcgagccacag

SEQ ID NO: 1191379 - RNA, 16 nt, Homo sapiens
ucccagcuacucagga

SEQ ID NO: 1191380 - RNA, 15 nt, Homo sapiens
ucccagcuacuuggg

SEQ ID NO: 1191381 - RNA, 19 nt, Homo sapiens
ucccagcuauuccuacucu

SEQ ID NO: 1191382 - RNA, 13 nt, Homo sapiens
ucccagcucaggg

SEQ ID NO: 1191383 - RNA, 17 nt, Homo sapiens
ucccaggaagcagggag

SEQ ID NO: 1191384 - RNA, 18 nt, Homo sapiens
ucccaggacccugaaggg

SEQ ID NO: 1191385 - RNA, 14 nt, Homo sapiens
ucccaggacucuga

SEQ ID NO: 1191386 - RNA, 17 nt, Homo sapiens
ucccaggaguacacccc

SEQ ID NO: 1191387 - RNA, 20 nt, Homo sapiens
ucccaggccaacaguagcca

SEQ ID NO: 1191388 - RNA, 18 nt, Homo sapiens
ucccaggggcagccacac

SEQ ID NO: 1191389 - RNA, 21 nt, Homo sapiens
ucccaguauuacccuggauga

SEQ ID NO: 1191390 - RNA, 13 nt, Homo sapiens
ucccagugacaac

SEQ ID NO: 1191391 - RNA, 17 nt, Homo sapiens
ucccaucagcgugcauu

SEQ ID NO: 1191392 - RNA, 23 nt, Homo sapiens
ucccaugacauggagaccgugac

SEQ ID NO: 1191393 - RNA, 10 nt, Homo sapiens
ucccaugagc

SEQ ID NO: 1191394 - RNA, 22 nt, Homo sapiens
ucccaugugauuuaaacaaaca

SEQ ID NO: 1191395 - RNA, 21 nt, Homo sapiens
ucccauguuagcuccaaagca

SEQ ID NO: 1191396 - RNA, 18 nt, Homo sapiens
ucccauuaaaaacaaaac

SEQ ID NO: 1191397 - RNA, 20 nt, Homo sapiens
ucccauuuccugagaccaca

SEQ ID NO: 1191398 - RNA, 18 nt, Homo sapiens
uccccaaccccucagauu

SEQ ID NO: 1191399 - RNA, 16 nt, Homo sapiens
uccccaagaauguuuc

SEQ ID NO: 1191400 - RNA, 21 nt, Homo sapiens
uccccaccccuccuggucugu

SEQ ID NO: 1191401 - RNA, 19 nt, Homo sapiens
uccccaccuuccuuaccuc

SEQ ID NO: 1191402 - RNA, 23 nt, Homo sapiens
uccccacgagggcuggcuggccu

SEQ ID NO: 1191403 - RNA, 16 nt, Homo sapiens
uccccacuagcauuuu

SEQ ID NO: 1191404 - RNA, 14 nt, Homo sapiens
uccccagacucugc

SEQ ID NO: 1191405 - RNA, 16 nt, Homo sapiens
uccccagggcugucau

SEQ ID NO: 1191406 - RNA, 19 nt, Homo sapiens
uccccauuagcuuucaauu

SEQ ID NO: 1191407 - RNA, 12 nt, Homo sapiens
ucccccaaagaa

SEQ ID NO: 1191408 - RNA, 15 nt, Homo sapiens
ucccccaaagaacca

SEQ ID NO: 1191409 - RNA, 23 nt, Homo sapiens
ucccccaccagcuaaggacauuu

SEQ ID NO: 1191410 - RNA, 16 nt, Homo sapiens
ucccccugcccugugc

SEQ ID NO: 1191411 - RNA, 15 nt, Homo sapiens
ucccccuucacaaag

SEQ ID NO: 1191412 - RNA, 21 nt, Homo sapiens
uccccgcagugugcacuaagg

SEQ ID NO: 1191413 - RNA, 19 nt, Homo sapiens
uccccggggcccaggggag

SEQ ID NO: 1191414 - RNA, 16 nt, Homo sapiens
uccccguccacagggc

SEQ ID NO: 1191415 - RNA, 23 nt, Homo sapiens
uccccuaaaccaaaaacugaaag

SEQ ID NO: 1191416 - RNA, 17 nt, Homo sapiens
uccccucagagugcaag

SEQ ID NO: 1191417 - RNA, 20 nt, Homo sapiens
uccccuccacucucuaccag

SEQ ID NO: 1191418 - RNA, 14 nt, Homo sapiens
uccccucucaaagg

SEQ ID NO: 1191419 - RNA, 21 nt, Homo sapiens
uccccugaggaauaugucaua

SEQ ID NO: 1191420 - RNA, 20 nt, Homo sapiens
uccccuggggagucugggca

SEQ ID NO: 1191421 - RNA, 21 nt, Homo sapiens
uccccuggggagucugggcac

SEQ ID NO: 1191422 - RNA, 18 nt, Homo sapiens
uccccuggguucacagau

SEQ ID NO: 1191423 - RNA, 14 nt, Homo sapiens
uccccuucccugac

SEQ ID NO: 1191424 - RNA, 23 nt, Homo sapiens
uccccuucucugugcaguagcau

SEQ ID NO: 1191425 - RNA, 14 nt, Homo sapiens
uccccuucugcaau

SEQ ID NO: 1191426 - RNA, 12 nt, Homo sapiens
ucccgacaccag

SEQ ID NO: 1191427 - RNA, 23 nt, Homo sapiens
ucccgagcuuagauucuguaugc

SEQ ID NO: 1191428 - RNA, 14 nt, Homo sapiens
ucccgaggaacucg

SEQ ID NO: 1191429 - RNA, 14 nt, Homo sapiens
ucccgucucgccug

SEQ ID NO: 1191430 - RNA, 17 nt, Homo sapiens
ucccgugagccaggcaa

SEQ ID NO: 1191431 - RNA, 22 nt, Homo sapiens
ucccgugaguggauugugagaa

SEQ ID NO: 1191432 - RNA, 19 nt, Homo sapiens
ucccuaaauuugcaugaaa

SEQ ID NO: 1191433 - RNA, 16 nt, Homo sapiens
ucccuacuccuacccu

SEQ ID NO: 1191434 - RNA, 17 nt, Homo sapiens
ucccuacuuccccaaau

SEQ ID NO: 1191435 - RNA, 22 nt, Homo sapiens
ucccuagccagcacuuguauau

SEQ ID NO: 1191436 - RNA, 23 nt, Homo sapiens
ucccucaccuuggcaccagacac

SEQ ID NO: 1191437 - RNA, 17 nt, Homo sapiens
ucccuccaaucuugaga

SEQ ID NO: 1191438 - RNA, 18 nt, Homo sapiens
ucccucccaggacucuga

SEQ ID NO: 1191439 - RNA, 17 nt, Homo sapiens
ucccucccccccaugca

SEQ ID NO: 1191440 - RNA, 20 nt, Homo sapiens
ucccuccuggugucacccca

SEQ ID NO: 1191441 - RNA, 23 nt, Homo sapiens
ucccucuacugggagccuaccca

SEQ ID NO: 1191442 - RNA, 15 nt, Homo sapiens
ucccucuccaacugc

SEQ ID NO: 1191443 - RNA, 18 nt, Homo sapiens
ucccugccuucacugugc

SEQ ID NO: 1191444 - RNA, 19 nt, Homo sapiens
ucccuggccacugaaaagc

SEQ ID NO: 1191445 - RNA, 18 nt, Homo sapiens
ucccugggaacugguuca

SEQ ID NO: 1191446 - RNA, 14 nt, Homo sapiens
ucccugggccucag

SEQ ID NO: 1191447 - RNA, 24 nt, Homo sapiens
ucccuggggaaaacuugcagcuaa

SEQ ID NO: 1191448 - RNA, 16 nt, Homo sapiens
ucccuggggaugugcu

SEQ ID NO: 1191449 - RNA, 14 nt, Homo sapiens
ucccugguccuuca

SEQ ID NO: 1191450 - RNA, 12 nt, Homo sapiens
ucccugguuuuc

SEQ ID NO: 1191451 - RNA, 16 nt, Homo sapiens
ucccuuaaucugccag

SEQ ID NO: 1191452 - RNA, 18 nt, Homo sapiens
ucccuuccaagcuguguu

SEQ ID NO: 1191453 - RNA, 15 nt, Homo sapiens
ucccuugcuguaugc

SEQ ID NO: 1191454 - RNA, 15 nt, Homo sapiens
ucccuugcuugccug

SEQ ID NO: 1191455 - RNA, 15 nt, Homo sapiens
ucccuuggauaccua

SEQ ID NO: 1191456 - RNA, 20 nt, Homo sapiens
ucccuuggucuuuucuugcc

SEQ ID NO: 1191457 - RNA, 19 nt, Homo sapiens
ucccuuguguuccuucugu

SEQ ID NO: 1191458 - RNA, 22 nt, Homo sapiens
ucccuuuauaaagagugcuaca

SEQ ID NO: 1191459 - RNA, 12 nt, Homo sapiens
ucccuuugcaug

SEQ ID NO: 1191460 - RNA, 16 nt, Homo sapiens
ucccuuuggagaugcu

SEQ ID NO: 1191461 - RNA, 12 nt, Homo sapiens
ucccuuuuacau

SEQ ID NO: 1191462 - RNA, 22 nt, Homo sapiens
ucccuuuucuuuaaguuuuauu

SEQ ID NO: 1191463 - RNA, 13 nt, Homo sapiens
ucccuuuuucaca

SEQ ID NO: 1191464 - RNA, 14 nt, Homo sapiens
uccgaccucucuca

SEQ ID NO: 1191465 - RNA, 15 nt, Homo sapiens
uccgaggccaguacc

SEQ ID NO: 1191466 - RNA, 21 nt, Homo sapiens
uccgaggccccugucucaggg

SEQ ID NO: 1191467 - RNA, 16 nt, Homo sapiens
uccgaggcugaggcag

SEQ ID NO: 1191468 - RNA, 13 nt, Homo sapiens
uccgcacaccucu

SEQ ID NO: 1191469 - RNA, 18 nt, Homo sapiens
uccgcaggcccacugucc

SEQ ID NO: 1191470 - RNA, 15 nt, Homo sapiens
uccgcauccuagucu

SEQ ID NO: 1191471 - RNA, 13 nt, Homo sapiens
uccgcuacuucca

SEQ ID NO: 1191472 - RNA, 22 nt, Homo sapiens
uccgcugccuggaacaccagca

SEQ ID NO: 1191473 - RNA, 17 nt, Homo sapiens
uccggccugcgucucca

SEQ ID NO: 1191474 - RNA, 20 nt, Homo sapiens
uccgggcaggggagccaggg

SEQ ID NO: 1191475 - RNA, 19 nt, Homo sapiens
uccgucccccaaacauguu

SEQ ID NO: 1191476 - RNA, 14 nt, Homo sapiens
uccgucucuguccu

SEQ ID NO: 1191477 - RNA, 15 nt, Homo sapiens
uccgugcuaugacau

SEQ ID NO: 1191478 - RNA, 22 nt, Homo sapiens
uccgugcugacagcugcuccua

SEQ ID NO: 1191479 - RNA, 21 nt, Homo sapiens
uccguuuaccuucauggugcu

SEQ ID NO: 1191480 - RNA, 12 nt, Homo sapiens
ucuaaaagacuu

SEQ ID NO: 1191481 - RNA, 21 nt, Homo sapiens
ucuaaaaggggaggagcccuc

SEQ ID NO: 1191482 - RNA, 18 nt, Homo sapiens
ucuaaagauggaguuucu

SEQ ID NO: 1191483 - RNA, 14 nt, Homo sapiens
ucuaaagauucuau

SEQ ID NO: 1191484 - RNA, 18 nt, Homo sapiens
ucuaaagccaagcacuuu

SEQ ID NO: 1191485 - RNA, 20 nt, Homo sapiens
ucuaaagucaucaugaacug

SEQ ID NO: 1191486 - RNA, 20 nt, Homo sapiens
ucuaaauagauacuuuugau

SEQ ID NO: 1191487 - RNA, 23 nt, Homo sapiens
ucuaaaucaccagagaccaaaca

SEQ ID NO: 1191488 - RNA, 23 nt, Homo sapiens
ucuaaaugaagugcaaauuugau

SEQ ID NO: 1191489 - RNA, 16 nt, Homo sapiens
ucuaacaaaaacuaca

SEQ ID NO: 1191490 - RNA, 19 nt, Homo sapiens
ucuaacauaugauacugau

SEQ ID NO: 1191491 - RNA, 16 nt, Homo sapiens
ucuaacauguuaucaa

SEQ ID NO: 1191492 - RNA, 17 nt, Homo sapiens
ucuaaccugauuuaccu

SEQ ID NO: 1191493 - RNA, 17 nt, Homo sapiens
ucuaacuccagugaagu

SEQ ID NO: 1191494 - RNA, 23 nt, Homo sapiens
ucuaacucccuccucacacucca

SEQ ID NO: 1191495 - RNA, 21 nt, Homo sapiens
ucuaagacucaaauguucuaa

SEQ ID NO: 1191496 - RNA, 13 nt, Homo sapiens
ucuaagaugucag

SEQ ID NO: 1191497 - RNA, 22 nt, Homo sapiens
ucuaagucacaggaugagacag

SEQ ID NO: 1191498 - RNA, 13 nt, Homo sapiens
ucuaagucucaac

SEQ ID NO: 1191499 - RNA, 13 nt, Homo sapiens
ucuaauacauucc

SEQ ID NO: 1191500 - RNA, 17 nt, Homo sapiens
ucuaauauuuuguaaca

SEQ ID NO: 1191501 - RNA, 16 nt, Homo sapiens
ucuaaucccaacaagc

SEQ ID NO: 1191502 - RNA, 12 nt, Homo sapiens
ucuaaucucagc

SEQ ID NO: 1191503 - RNA, 17 nt, Homo sapiens
ucuaauuuauuaaucua

SEQ ID NO: 1191504 - RNA, 21 nt, Homo sapiens
ucuaauuuugugcucuuuccu

SEQ ID NO: 1191505 - RNA, 20 nt, Homo sapiens
ucuacaccuggaccauuuga

SEQ ID NO: 1191506 - RNA, 15 nt, Homo sapiens
ucuacaucacucuca

SEQ ID NO: 1191507 - RNA, 14 nt, Homo sapiens
ucuacaugaugcua

SEQ ID NO: 1191508 - RNA, 23 nt, Homo sapiens
ucuacauggacucagagaaaaga

SEQ ID NO: 1191509 - RNA, 13 nt, Homo sapiens
ucuacauguguuu

SEQ ID NO: 1191510 - RNA, 15 nt, Homo sapiens
ucuaccagcauaaau

SEQ ID NO: 1191511 - RNA, 16 nt, Homo sapiens
ucuaccaggcaaauuc

SEQ ID NO: 1191512 - RNA, 18 nt, Homo sapiens
ucuaccaugaacagaaaa

SEQ ID NO: 1191513 - RNA, 21 nt, Homo sapiens
ucuacgcugccucaacacuga

SEQ ID NO: 1191514 - RNA, 16 nt, Homo sapiens
ucuacguaucugcuac

SEQ ID NO: 1191515 - RNA, 14 nt, Homo sapiens
ucuacuagccauug

SEQ ID NO: 1191516 - RNA, 19 nt, Homo sapiens
ucuacuguggcaaaugcca

SEQ ID NO: 1191517 - RNA, 21 nt, Homo sapiens
ucuagaacauucagauuuacc

SEQ ID NO: 1191518 - RNA, 17 nt, Homo sapiens
ucuagaauccugcuuua

SEQ ID NO: 1191519 - RNA, 15 nt, Homo sapiens
ucuagagcucaucag

SEQ ID NO: 1191520 - RNA, 14 nt, Homo sapiens
ucuagaucucagcc

SEQ ID NO: 1191521 - RNA, 18 nt, Homo sapiens
ucuagaucuguuaccaau

SEQ ID NO: 1191522 - RNA, 14 nt, Homo sapiens
ucuagaugacauaa

SEQ ID NO: 1191523 - RNA, 21 nt, Homo sapiens
ucuagcaaauguuaugcauaa

SEQ ID NO: 1191524 - RNA, 21 nt, Homo sapiens
ucuaggauaacuugcuuucuu

SEQ ID NO: 1191525 - RNA, 16 nt, Homo sapiens
ucuaggucacuucuca

SEQ ID NO: 1191526 - RNA, 15 nt, Homo sapiens
ucuaggugcuuuaac

SEQ ID NO: 1191527 - RNA, 13 nt, Homo sapiens
ucuagugcaaaag

SEQ ID NO: 1191528 - RNA, 16 nt, Homo sapiens
ucuaguuaacauuuca

SEQ ID NO: 1191529 - RNA, 17 nt, Homo sapiens
ucuaguuaacauuucaa

SEQ ID NO: 1191530 - RNA, 21 nt, Homo sapiens
ucuaguuauuggaucagugaa

SEQ ID NO: 1191531 - RNA, 16 nt, Homo sapiens
ucuaguucagcugccc

SEQ ID NO: 1191532 - RNA, 23 nt, Homo sapiens
ucuaguuuccuuuuugagauacu

SEQ ID NO: 1191533 - RNA, 14 nt, Homo sapiens
ucuaguuugcaacu

SEQ ID NO: 1191534 - RNA, 15 nt, Homo sapiens
ucuaguuuugucaaa

SEQ ID NO: 1191535 - RNA, 13 nt, Homo sapiens
ucuauaaugugcc

SEQ ID NO: 1191536 - RNA, 13 nt, Homo sapiens
ucuauaccugugu

SEQ ID NO: 1191537 - RNA, 13 nt, Homo sapiens
ucuauacuguaaa

SEQ ID NO: 1191538 - RNA, 19 nt, Homo sapiens
ucuauauaugaagugaaaa

SEQ ID NO: 1191539 - RNA, 15 nt, Homo sapiens
ucuaucccuuaccug

SEQ ID NO: 1191540 - RNA, 13 nt, Homo sapiens
ucuauguauauuc

SEQ ID NO: 1191541 - RNA, 19 nt, Homo sapiens
ucuauguuguuugcccaau

SEQ ID NO: 1191542 - RNA, 13 nt, Homo sapiens
ucuauuaucucaa

SEQ ID NO: 1191543 - RNA, 21 nt, Homo sapiens
ucuauuauguuaucauccucc

SEQ ID NO: 1191544 - RNA, 17 nt, Homo sapiens
ucuauuccuaucugugg

SEQ ID NO: 1191545 - RNA, 22 nt, Homo sapiens
ucuauuucuuuaaaugcuuuua

SEQ ID NO: 1191546 - RNA, 23 nt, Homo sapiens
ucuauuucuuuaaaugcuuuuau

SEQ ID NO: 1191547 - RNA, 14 nt, Homo sapiens
ucuauuuugcaaac

SEQ ID NO: 1191548 - RNA, 20 nt, Homo sapiens
ucucaaacggcaacauuccu

SEQ ID NO: 1191549 - RNA, 20 nt, Homo sapiens
ucucaaacucccgaccucag

SEQ ID NO: 1191550 - RNA, 20 nt, Homo sapiens
ucucaaacuccugaccucaa

SEQ ID NO: 1191551 - RNA, 17 nt, Homo sapiens
ucucaaauuuguggucc

SEQ ID NO: 1191552 - RNA, 23 nt, Homo sapiens
ucucaagaagaacaucuuuaugg

SEQ ID NO: 1191553 - RNA, 14 nt, Homo sapiens
ucucaagacugaaa

SEQ ID NO: 1191554 - RNA, 19 nt, Homo sapiens
ucucaauaauuuccuccac

SEQ ID NO: 1191555 - RNA, 12 nt, Homo sapiens
ucucaauagcuc

SEQ ID NO: 1191556 - RNA, 16 nt, Homo sapiens
ucucaauguacauaga

SEQ ID NO: 1191557 - RNA, 17 nt, Homo sapiens
ucucacagaagggccug

SEQ ID NO: 1191558 - RNA, 16 nt, Homo sapiens
ucucacagauugcugc

SEQ ID NO: 1191559 - RNA, 13 nt, Homo sapiens
ucucaccacuuca

SEQ ID NO: 1191560 - RNA, 22 nt, Homo sapiens
ucucacuaguugucagcuucuc

SEQ ID NO: 1191561 - RNA, 11 nt, Homo sapiens
ucucacugcca

SEQ ID NO: 1191562 - RNA, 23 nt, Homo sapiens
ucucacuucguuggugaccaguu

SEQ ID NO: 1191563 - RNA, 18 nt, Homo sapiens
ucucagaugaacaauuau

SEQ ID NO: 1191564 - RNA, 20 nt, Homo sapiens
ucucagccauaggugcaguu

SEQ ID NO: 1191565 - RNA, 18 nt, Homo sapiens
ucucagcccccaccucag

SEQ ID NO: 1191566 - RNA, 16 nt, Homo sapiens
ucucagcucacugcaa

SEQ ID NO: 1191567 - RNA, 22 nt, Homo sapiens
ucucagcucacugcaagcucca

SEQ ID NO: 1191568 - RNA, 12 nt, Homo sapiens
ucucagcugcug

SEQ ID NO: 1191569 - RNA, 14 nt, Homo sapiens
ucucagcugcugaa

SEQ ID NO: 1191570 - RNA, 15 nt, Homo sapiens
ucucaggacagugau

SEQ ID NO: 1191571 - RNA, 14 nt, Homo sapiens
ucucaggagccauc

SEQ ID NO: 1191572 - RNA, 14 nt, Homo sapiens
ucucagguccagcu

SEQ ID NO: 1191573 - RNA, 18 nt, Homo sapiens
ucucauaacucugugauc

SEQ ID NO: 1191574 - RNA, 21 nt, Homo sapiens
ucucauaccuuccccacaucu

SEQ ID NO: 1191575 - RNA, 16 nt, Homo sapiens
ucucaucacacacaug

SEQ ID NO: 1191576 - RNA, 14 nt, Homo sapiens
ucucaucacuuuuc

SEQ ID NO: 1191577 - RNA, 21 nt, Homo sapiens
ucucaugagugccaagcaaaa

SEQ ID NO: 1191578 - RNA, 19 nt, Homo sapiens
ucucaugggaaggggagga

SEQ ID NO: 1191579 - RNA, 15 nt, Homo sapiens
ucucauugaggacaa

SEQ ID NO: 1191580 - RNA, 19 nt, Homo sapiens
ucuccaacagccagugugu

SEQ ID NO: 1191581 - RNA, 18 nt, Homo sapiens
ucuccacaaaaacucuua

SEQ ID NO: 1191582 - RNA, 20 nt, Homo sapiens
ucuccacaugguugugaguc

SEQ ID NO: 1191583 - RNA, 20 nt, Homo sapiens
ucuccacccacucacauucc

SEQ ID NO: 1191584 - RNA, 20 nt, Homo sapiens
ucuccacucaguugcaacuu

SEQ ID NO: 1191585 - RNA, 22 nt, Homo sapiens
ucuccacuucacuccagcauca

SEQ ID NO: 1191586 - RNA, 17 nt, Homo sapiens
ucuccacuuucucaaug

SEQ ID NO: 1191587 - RNA, 12 nt, Homo sapiens
ucuccagcauca

SEQ ID NO: 1191588 - RNA, 20 nt, Homo sapiens
ucuccagccugggaggcaca

SEQ ID NO: 1191589 - RNA, 18 nt, Homo sapiens
ucuccaugcaagauuucu

SEQ ID NO: 1191590 - RNA, 21 nt, Homo sapiens
ucucccccuccugauuaaaaa

SEQ ID NO: 1191591 - RNA, 15 nt, Homo sapiens
ucucccgucucgccu

SEQ ID NO: 1191592 - RNA, 15 nt, Homo sapiens
ucucccuaaccacua

SEQ ID NO: 1191593 - RNA, 21 nt, Homo sapiens
ucucccucuuuuucucuguau

SEQ ID NO: 1191594 - RNA, 22 nt, Homo sapiens
ucucccuucuuuaccuucauuu

SEQ ID NO: 1191595 - RNA, 22 nt, Homo sapiens
ucuccuaaaacuuuaaaacuug

SEQ ID NO: 1191596 - RNA, 19 nt, Homo sapiens
ucuccuaaugaugacuuga

SEQ ID NO: 1191597 - RNA, 12 nt, Homo sapiens
ucuuaccuggca

SEQ ID NO: 1191598 - RNA, 16 nt, Homo sapiens
ucuuacuuugugcaaa

SEQ ID NO: 1191599 - RNA, 20 nt, Homo sapiens
ucuuagcacaccuacaccuc

SEQ ID NO: 1191600 - RNA, 12 nt, Homo sapiens
ucuuaucuuucu

SEQ ID NO: 1191601 - RNA, 22 nt, Homo sapiens
ucuuauuaaaaaucuaacaaau

SEQ ID NO: 1191602 - RNA, 19 nt, Homo sapiens
ucuucaaagcaaagcucuu

SEQ ID NO: 1191603 - RNA, 18 nt, Homo sapiens
ucuucaaauuaaagugcu

SEQ ID NO: 1191604 - RNA, 22 nt, Homo sapiens
ucuucacacgauugaccugucc

SEQ ID NO: 1191605 - RNA, 14 nt, Homo sapiens
ucuucacagcacau

SEQ ID NO: 1191606 - RNA, 15 nt, Homo sapiens
ucuucacagcacauu

SEQ ID NO: 1191607 - RNA, 19 nt, Homo sapiens
ucuucaccaacacuguccc

SEQ ID NO: 1191608 - RNA, 23 nt, Homo sapiens
ucuucagaugcucuugggguuca

SEQ ID NO: 1191609 - RNA, 14 nt, Homo sapiens
ucuucagcacuguc

SEQ ID NO: 1191610 - RNA, 17 nt, Homo sapiens
ucuucagcugguggaug

SEQ ID NO: 1191611 - RNA, 21 nt, Homo sapiens
ucuucaguguccuucacggca

SEQ ID NO: 1191612 - RNA, 17 nt, Homo sapiens
ucuucaugccugaugaa

SEQ ID NO: 1191613 - RNA, 15 nt, Homo sapiens
ucuucauggccucag

SEQ ID NO: 1191614 - RNA, 19 nt, Homo sapiens
ucuuccacaaaaaauacuu

SEQ ID NO: 1191615 - RNA, 16 nt, Homo sapiens
ucuuccagaaguguga

SEQ ID NO: 1191616 - RNA, 17 nt, Homo sapiens
ucuuccauuugcaaggg

SEQ ID NO: 1191617 - RNA, 15 nt, Homo sapiens
ucuucccgcacaaau

SEQ ID NO: 1191618 - RNA, 15 nt, Homo sapiens
ucuucccucucugca

SEQ ID NO: 1191619 - RNA, 14 nt, Homo sapiens
ucuucccugaccuc

SEQ ID NO: 1191620 - RNA, 21 nt, Homo sapiens
ucuucccuggguuuucugccc

SEQ ID NO: 1191621 - RNA, 20 nt, Homo sapiens
ucuuccgggagcuggugaca

SEQ ID NO: 1191622 - RNA, 20 nt, Homo sapiens
ucuuccuccagucuguucuc

SEQ ID NO: 1191623 - RNA, 20 nt, Homo sapiens
ucuuccugucuccuuugaag

SEQ ID NO: 1191624 - RNA, 18 nt, Homo sapiens
ucuuccuuuucuuucucc

SEQ ID NO: 1191625 - RNA, 14 nt, Homo sapiens
ucuucuaaacuucc

SEQ ID NO: 1191626 - RNA, 14 nt, Homo sapiens
ucuucuaagcaaaa

SEQ ID NO: 1191627 - RNA, 21 nt, Homo sapiens
ucuucuaguuuugacauuuua

SEQ ID NO: 1191628 - RNA, 15 nt, Homo sapiens
ucuucucugcacuua

SEQ ID NO: 1191629 - RNA, 21 nt, Homo sapiens
ucuucugacauuuaucaggca

SEQ ID NO: 1191630 - RNA, 16 nt, Homo sapiens
ucuucugagcacagau

SEQ ID NO: 1191631 - RNA, 21 nt, Homo sapiens
ucuucuggacugcacacuucc

SEQ ID NO: 1191632 - RNA, 22 nt, Homo sapiens
ucuucuguacuucucucuucca

SEQ ID NO: 1191633 - RNA, 17 nt, Homo sapiens
ucuugauaccugggaua

SEQ ID NO: 1191634 - RNA, 17 nt, Homo sapiens
ucuugaugcaugcacug

SEQ ID NO: 1191635 - RNA, 23 nt, Homo sapiens
ucuugccuaaggugcguagucca

SEQ ID NO: 1191636 - RNA, 20 nt, Homo sapiens
ucuugcuguuaaaucaguuc

SEQ ID NO: 1191637 - RNA, 15 nt, Homo sapiens
ucuugcuuaccuuga

SEQ ID NO: 1191638 - RNA, 21 nt, Homo sapiens
ucuugcuuuggaggaccuuaa

SEQ ID NO: 1191639 - RNA, 14 nt, Homo sapiens
ucuuggaguuacaa

SEQ ID NO: 1191640 - RNA, 16 nt, Homo sapiens
ucuuggccuaaaccuc

SEQ ID NO: 1191641 - RNA, 19 nt, Homo sapiens
ucuuggcuuucagaguuug

SEQ ID NO: 1191642 - RNA, 20 nt, Homo sapiens
ucuugugacccuccaugcca

SEQ ID NO: 1191643 - RNA, 15 nt, Homo sapiens
ucuugugauguuugc

SEQ ID NO: 1191644 - RNA, 14 nt, Homo sapiens
ucuuguugcucaaa

SEQ ID NO: 1191645 - RNA, 14 nt, Homo sapiens
ucuuuaaaggcauc

SEQ ID NO: 1191646 - RNA, 20 nt, Homo sapiens
ucuuuaagagacucacuggu

SEQ ID NO: 1191647 - RNA, 17 nt, Homo sapiens
ucuuuaccuucauuuca

SEQ ID NO: 1191648 - RNA, 12 nt, Homo sapiens
ucuuuacuuucc

SEQ ID NO: 1191649 - RNA, 20 nt, Homo sapiens
ucuuuaugucuuuugaugaa

SEQ ID NO: 1191650 - RNA, 21 nt, Homo sapiens
ucuuucagacuugccauguga

SEQ ID NO: 1191651 - RNA, 14 nt, Homo sapiens
ucuuuccacuuugu

SEQ ID NO: 1191652 - RNA, 22 nt, Homo sapiens
ucuuuccaggcuucccugacuu

SEQ ID NO: 1191653 - RNA, 14 nt, Homo sapiens
ucuuucccaauuca

SEQ ID NO: 1191654 - RNA, 23 nt, Homo sapiens
ucuuuccccaaaaauugacuuag

SEQ ID NO: 1191655 - RNA, 20 nt, Homo sapiens
ucuuucguugguuguuucuc

SEQ ID NO: 1191656 - RNA, 22 nt, Homo sapiens
ucuuucuaacuccagugaagua

SEQ ID NO: 1191657 - RNA, 15 nt, Homo sapiens
ucuuucuaucaaaua

SEQ ID NO: 1191658 - RNA, 19 nt, Homo sapiens
ucuuucuguaaacagaaua

SEQ ID NO: 1191659 - RNA, 21 nt, Homo sapiens
ucuuucuuaaugaaccuuaga

SEQ ID NO: 1191660 - RNA, 14 nt, Homo sapiens
ucuuucuuacacaa

SEQ ID NO: 1191661 - RNA, 22 nt, Homo sapiens
ucuuucuuacacaagagcugga

SEQ ID NO: 1191662 - RNA, 17 nt, Homo sapiens
ucuuucuucuaugugaa

SEQ ID NO: 1191663 - RNA, 17 nt, Homo sapiens
ucuuucuuguuugucag

SEQ ID NO: 1191664 - RNA, 15 nt, Homo sapiens
ucuuucuuugcugcu

SEQ ID NO: 1191665 - RNA, 16 nt, Homo sapiens
ucuuugacaacgccaa

SEQ ID NO: 1191666 - RNA, 14 nt, Homo sapiens
ucuuugacacucaa

SEQ ID NO: 1191667 - RNA, 20 nt, Homo sapiens
ucuuugagauaauacauucc

SEQ ID NO: 1191668 - RNA, 18 nt, Homo sapiens
ucuuugcagagccuuuua

SEQ ID NO: 1191669 - RNA, 12 nt, Homo sapiens
ucuuugccaagu

SEQ ID NO: 1191670 - RNA, 23 nt, Homo sapiens
ucuuugccuuagcuuugcaguga

SEQ ID NO: 1191671 - RNA, 15 nt, Homo sapiens
ucuuugcugcaguca

SEQ ID NO: 1191672 - RNA, 13 nt, Homo sapiens
ucuuuggacagaa

SEQ ID NO: 1191673 - RNA, 20 nt, Homo sapiens
ucuuuggacagaagcagcuc

SEQ ID NO: 1191674 - RNA, 14 nt, Homo sapiens
ucuuugguggcaug

SEQ ID NO: 1191675 - RNA, 19 nt, Homo sapiens
ucuuuguaaugucaccacc

SEQ ID NO: 1191676 - RNA, 21 nt, Homo sapiens
ucuuuguuauaaaugagguca

SEQ ID NO: 1191677 - RNA, 19 nt, Homo sapiens
ucuuuguucuccuaaugcu

SEQ ID NO: 1191678 - RNA, 22 nt, Homo sapiens
ucuuuuaaagaaauaaccacug

SEQ ID NO: 1191679 - RNA, 23 nt, Homo sapiens
ucuuuuaaagaaauaaccacugc

SEQ ID NO: 1191680 - RNA, 15 nt, Homo sapiens
ucuuuuauacuguac

SEQ ID NO: 1191681 - RNA, 23 nt, Homo sapiens
ucuuuucuaaguggcgugugcau

SEQ ID NO: 1191682 - RNA, 16 nt, Homo sapiens
ucuuuugaacccagga

SEQ ID NO: 1191683 - RNA, 13 nt, Homo sapiens
ucuuuugaauuca

SEQ ID NO: 1191684 - RNA, 12 nt, Homo sapiens
ucuuuugcaauu

SEQ ID NO: 1191685 - RNA, 14 nt, Homo sapiens
ucuuuuugaaauca

SEQ ID NO: 1191686 - RNA, 13 nt, Homo sapiens
ucuuuuugcugcc

SEQ ID NO: 1191687 - RNA, 13 nt, Homo sapiens
ucuuuuugcuuca

SEQ ID NO: 1191688 - RNA, 15 nt, Homo sapiens
ugaaaaaacacuuua

SEQ ID NO: 1191689 - RNA, 16 nt, Homo sapiens
ugaaaaaauacuaccu

SEQ ID NO: 1191690 - RNA, 21 nt, Homo sapiens
ugaaaaacuggcaacauucca

SEQ ID NO: 1191691 - RNA, 19 nt, Homo sapiens
ugaaaaagucagcuacaaa

SEQ ID NO: 1191692 - RNA, 17 nt, Homo sapiens
ugaaaaauaucuuugca

SEQ ID NO: 1191693 - RNA, 24 nt, Homo sapiens
ugaaaacaauucuuauugacucau

SEQ ID NO: 1191694 - RNA, 16 nt, Homo sapiens
ugaaaaccucuccuca

SEQ ID NO: 1191695 - RNA, 15 nt, Homo sapiens
ugaaaaccugcauuu

SEQ ID NO: 1191696 - RNA, 22 nt, Homo sapiens
ugaaaacugugcaauguauuaa

SEQ ID NO: 1191697 - RNA, 22 nt, Homo sapiens
ugaaaaggauauuaucuaccug

SEQ ID NO: 1191698 - RNA, 22 nt, Homo sapiens
ugaaaagggaugaugugguuuu

SEQ ID NO: 1191699 - RNA, 22 nt, Homo sapiens
ugaaaauacaacuuaaauaaua

SEQ ID NO: 1191700 - RNA, 13 nt, Homo sapiens
ugaaaauagccaa

SEQ ID NO: 1191701 - RNA, 13 nt, Homo sapiens
ugaaaaucaaaua

SEQ ID NO: 1191702 - RNA, 16 nt, Homo sapiens
ugaaaaucaagcaguu

SEQ ID NO: 1191703 - RNA, 20 nt, Homo sapiens
ugaaaaugaagaaggaagcu

SEQ ID NO: 1191704 - RNA, 13 nt, Homo sapiens
ugaaaauuucaac

SEQ ID NO: 1191705 - RNA, 22 nt, Homo sapiens
ugaaacagcugccuuagcuuca

SEQ ID NO: 1191706 - RNA, 18 nt, Homo sapiens
ugaaacccauuuacuuag

SEQ ID NO: 1191707 - RNA, 19 nt, Homo sapiens
ugaaaccuacacacuguca

SEQ ID NO: 1191708 - RNA, 16 nt, Homo sapiens
ugaaacuaaagcaaua

SEQ ID NO: 1191709 - RNA, 21 nt, Homo sapiens
ugaaacucccagccacagcau

SEQ ID NO: 1191710 - RNA, 22 nt, Homo sapiens
ugaaacugcuugagcaucagga

SEQ ID NO: 1191711 - RNA, 12 nt, Homo sapiens
ugaaacuuuauc

SEQ ID NO: 1191712 - RNA, 15 nt, Homo sapiens
ugaaagaaaauaaca

SEQ ID NO: 1191713 - RNA, 14 nt, Homo sapiens
ugaaagaaccagag

SEQ ID NO: 1191714 - RNA, 15 nt, Homo sapiens
ugaaagaaccagaga

SEQ ID NO: 1191715 - RNA, 22 nt, Homo sapiens
ugaaagaagagaugagaaauga

SEQ ID NO: 1191716 - RNA, 14 nt, Homo sapiens
ugaaaggaaagugc

SEQ ID NO: 1191717 - RNA, 17 nt, Homo sapiens
uuaaaagacaaauaugu

SEQ ID NO: 1191718 - RNA, 23 nt, Homo sapiens
uuaaaagaccaucuccuguaaaa

SEQ ID NO: 1191719 - RNA, 21 nt, Homo sapiens
uuaaaauaaacacaaaaacac

SEQ ID NO: 1191720 - RNA, 15 nt, Homo sapiens
uuaaaauaaauuccu

SEQ ID NO: 1191721 - RNA, 20 nt, Homo sapiens
uuaaaauauucccacucagc

SEQ ID NO: 1191722 - RNA, 13 nt, Homo sapiens
uuaaaaucuguca

SEQ ID NO: 1191723 - RNA, 18 nt, Homo sapiens
uuaaaaucugucacguag

SEQ ID NO: 1191724 - RNA, 17 nt, Homo sapiens
uuaaaauguuuacugua

SEQ ID NO: 1191725 - RNA, 15 nt, Homo sapiens
uuaaaauuacauucu

SEQ ID NO: 1191726 - RNA, 16 nt, Homo sapiens
uuaaaauuauauagca

SEQ ID NO: 1191727 - RNA, 15 nt, Homo sapiens
uuaaacccuuaccaa

SEQ ID NO: 1191728 - RNA, 18 nt, Homo sapiens
uuaaacguaugcauguga

SEQ ID NO: 1191729 - RNA, 14 nt, Homo sapiens
uuaaacugauucau

SEQ ID NO: 1191730 - RNA, 19 nt, Homo sapiens
uuaaacuugacccaggugg

SEQ ID NO: 1191731 - RNA, 17 nt, Homo sapiens
uuaaagaaaauaugcau

SEQ ID NO: 1191732 - RNA, 18 nt, Homo sapiens
uuaaagaaacaauacaaa

SEQ ID NO: 1191733 - RNA, 18 nt, Homo sapiens
uuaaagaagagaacugcc

SEQ ID NO: 1191734 - RNA, 13 nt, Homo sapiens
uuaaagagucuag

SEQ ID NO: 1191735 - RNA, 16 nt, Homo sapiens
uuaaagaugcacagaa

SEQ ID NO: 1191736 - RNA, 11 nt, Homo sapiens
uuaaagcaaaa

SEQ ID NO: 1191737 - RNA, 22 nt, Homo sapiens
uuaaaggguauacuaagugaua

SEQ ID NO: 1191738 - RNA, 16 nt, Homo sapiens
uuaaagguaaaacaug

SEQ ID NO: 1191739 - RNA, 14 nt, Homo sapiens
uuaaaggugugcua

SEQ ID NO: 1191740 - RNA, 14 nt, Homo sapiens
uuaaauaaacugug

SEQ ID NO: 1191741 - RNA, 15 nt, Homo sapiens
uuaaauaaauggaau

SEQ ID NO: 1191742 - RNA, 17 nt, Homo sapiens
uuaaauaagguaauaca

SEQ ID NO: 1191743 - RNA, 23 nt, Homo sapiens
uuaaaucaauaaagaccacuuua

SEQ ID NO: 1191744 - RNA, 16 nt, Homo sapiens
uuaaaucacacaugcu

SEQ ID NO: 1191745 - RNA, 12 nt, Homo sapiens
uuaaaucacuug

SEQ ID NO: 1191746 - RNA, 15 nt, Homo sapiens
uuaaaucaguauucc

SEQ ID NO: 1191747 - RNA, 13 nt, Homo sapiens
uuaaaucugaauu

SEQ ID NO: 1191748 - RNA, 14 nt, Homo sapiens
uuaaaugaacauca

SEQ ID NO: 1191749 - RNA, 14 nt, Homo sapiens
uuaaaugcuuuuau

SEQ ID NO: 1191750 - RNA, 22 nt, Homo sapiens
uuaaauguuauauacaucucaa

SEQ ID NO: 1191751 - RNA, 15 nt, Homo sapiens
uuaaauuaagacuug

SEQ ID NO: 1191752 - RNA, 20 nt, Homo sapiens
uuaaauuaaugaacauaugu

SEQ ID NO: 1191753 - RNA, 19 nt, Homo sapiens
uuaaauuauuuuuguucau

SEQ ID NO: 1191754 - RNA, 19 nt, Homo sapiens
uuaaauuuugaaaacugug

SEQ ID NO: 1191755 - RNA, 13 nt, Homo sapiens
uuaacaaacucuu

SEQ ID NO: 1191756 - RNA, 17 nt, Homo sapiens
uuaacaaaugugcugcu

SEQ ID NO: 1191757 - RNA, 21 nt, Homo sapiens
uuaacagaugcaaugugcuac

SEQ ID NO: 1191758 - RNA, 21 nt, Homo sapiens
uuaacagcgugucaacuuuca

SEQ ID NO: 1191759 - RNA, 21 nt, Homo sapiens
uuaacaugacauuuaccagca

SEQ ID NO: 1191760 - RNA, 23 nt, Homo sapiens
uuaacaugauaaaagacacuccc

SEQ ID NO: 1191761 - RNA, 20 nt, Homo sapiens
uuaacauguauucuguucuu

SEQ ID NO: 1191762 - RNA, 11 nt, Homo sapiens
uuaaccaucuu

SEQ ID NO: 1191763 - RNA, 13 nt, Homo sapiens
uuaaccugcaaaa

SEQ ID NO: 1191764 - RNA, 16 nt, Homo sapiens
uuaaccuuugcuaugu

SEQ ID NO: 1191765 - RNA, 21 nt, Homo sapiens
uuaacguauauuaaaccuguu

SEQ ID NO: 1191766 - RNA, 19 nt, Homo sapiens
uuaacuaugaauucuuaag

SEQ ID NO: 1191767 - RNA, 18 nt, Homo sapiens
uuaacuuacacugaucaa

SEQ ID NO: 1191768 - RNA, 18 nt, Homo sapiens
uuaacuuuuaagguugaa

SEQ ID NO: 1191769 - RNA, 15 nt, Homo sapiens
uuaagaaagcacuua

SEQ ID NO: 1191770 - RNA, 13 nt, Homo sapiens
uuaagacagaguu

SEQ ID NO: 1191771 - RNA, 19 nt, Homo sapiens
uuaagaccuacuguucuaa

SEQ ID NO: 1191772 - RNA, 18 nt, Homo sapiens
uuaagaccuggcagcucu

SEQ ID NO: 1191773 - RNA, 21 nt, Homo sapiens
uuaagacuuaguuauuucugc

SEQ ID NO: 1191774 - RNA, 14 nt, Homo sapiens
uuaagagccauaua

SEQ ID NO: 1191775 - RNA, 17 nt, Homo sapiens
uuaagagugaagucaug

SEQ ID NO: 1191776 - RNA, 11 nt, Homo sapiens
uuaagcugcua

SEQ ID NO: 1191777 - RNA, 19 nt, Homo sapiens
uuaaggaagagagaauucu

SEQ ID NO: 1191778 - RNA, 17 nt, Homo sapiens
uuaaggaaggcacuaaa

SEQ ID NO: 1191779 - RNA, 23 nt, Homo sapiens
uuaaggaaucaaaucuuacaaaa

SEQ ID NO: 1191780 - RNA, 19 nt, Homo sapiens
uuaaggacaaagugccaaa

SEQ ID NO: 1191781 - RNA, 21 nt, Homo sapiens
uuaaggaggcugagagcccaa

SEQ ID NO: 1191782 - RNA, 22 nt, Homo sapiens
uuaaggagugaaaauagagugu

SEQ ID NO: 1191783 - RNA, 22 nt, Homo sapiens
uuaaguauguuauuuucuguug

SEQ ID NO: 1191784 - RNA, 13 nt, Homo sapiens
uuaagugauguca

SEQ ID NO: 1191785 - RNA, 22 nt, Homo sapiens
uuaaguggggugggaaggggag

SEQ ID NO: 1191786 - RNA, 23 nt, Homo sapiens
uuaaguguaacuggcaguuuucc

SEQ ID NO: 1191787 - RNA, 22 nt, Homo sapiens
uuaaguucccagauuggggcua

SEQ ID NO: 1191788 - RNA, 17 nt, Homo sapiens
uuaauaaacaaaguaac

SEQ ID NO: 1191789 - RNA, 16 nt, Homo sapiens
uuaauaagucauugaa

SEQ ID NO: 1191790 - RNA, 13 nt, Homo sapiens
uuaauacuguuua

SEQ ID NO: 1191791 - RNA, 21 nt, Homo sapiens
uuaauaggugcagucuuugag

SEQ ID NO: 1191792 - RNA, 14 nt, Homo sapiens
uuaauaucugaggu

SEQ ID NO: 1191793 - RNA, 17 nt, Homo sapiens
uuaauaugauucuagua

SEQ ID NO: 1191794 - RNA, 19 nt, Homo sapiens
uuaauauuuccaaugugaa

SEQ ID NO: 1191795 - RNA, 23 nt, Homo sapiens
uuaaucaaagauugaacacugcg

SEQ ID NO: 1191796 - RNA, 20 nt, Homo sapiens
uuaaugaacaaauggccuuu

SEQ ID NO: 1191797 - RNA, 14 nt, Homo sapiens
uuaaugaacauaug

SEQ ID NO: 1191798 - RNA, 17 nt, Homo sapiens
uuaaugcacuuucuauc

SEQ ID NO: 1191799 - RNA, 16 nt, Homo sapiens
uuaaugcagacaaaca

SEQ ID NO: 1191800 - RNA, 15 nt, Homo sapiens
uuaauguucugugau

SEQ ID NO: 1191801 - RNA, 23 nt, Homo sapiens
uuaauguuuuuuaaacuaguuua

SEQ ID NO: 1191802 - RNA, 12 nt, Homo sapiens
uuaauugcugca

SEQ ID NO: 1191803 - RNA, 15 nt, Homo sapiens
uuaauuuaauuugca

SEQ ID NO: 1191804 - RNA, 12 nt, Homo sapiens
uuaauuuugcca

SEQ ID NO: 1191805 - RNA, 17 nt, Homo sapiens
uuacaaaccucaagcca

SEQ ID NO: 1191806 - RNA, 18 nt, Homo sapiens
uuacaaauggacauagga

SEQ ID NO: 1191807 - RNA, 19 nt, Homo sapiens
uuacaacaaacacugugau

SEQ ID NO: 1191808 - RNA, 13 nt, Homo sapiens
uuacaacagaagc

SEQ ID NO: 1191809 - RNA, 15 nt, Homo sapiens
uuacaagacugcuga

SEQ ID NO: 1191810 - RNA, 19 nt, Homo sapiens
uuacaaggcccuuuccuuu

SEQ ID NO: 1191811 - RNA, 19 nt, Homo sapiens
uuacaauacugaaugggaa

SEQ ID NO: 1191812 - RNA, 11 nt, Homo sapiens
uuacacaagag

SEQ ID NO: 1191813 - RNA, 11 nt, Homo sapiens
uuacagaauuu

SEQ ID NO: 1191814 - RNA, 13 nt, Homo sapiens
uuacagcacacac

SEQ ID NO: 1191815 - RNA, 22 nt, Homo sapiens
uuacagcccucagcaaugugcc

SEQ ID NO: 1191816 - RNA, 14 nt, Homo sapiens
uuacaggaucaugu

SEQ ID NO: 1191817 - RNA, 22 nt, Homo sapiens
uuacaggcgugagccacugcgc

SEQ ID NO: 1191818 - RNA, 23 nt, Homo sapiens
uuacaguaggagcccagcucuga

SEQ ID NO: 1191819 - RNA, 15 nt, Homo sapiens
uuacaguauacauau

SEQ ID NO: 1191820 - RNA, 14 nt, Homo sapiens
uuacaguggcaaaa

SEQ ID NO: 1191821 - RNA, 23 nt, Homo sapiens
uuacaguuugugcucuacuguua

SEQ ID NO: 1191822 - RNA, 18 nt, Homo sapiens
uuacauaaucuguacaau

SEQ ID NO: 1191823 - RNA, 20 nt, Homo sapiens
uuacauacauugauucaugu

SEQ ID NO: 1191824 - RNA, 17 nt, Homo sapiens
uuacauauagcugauaa

SEQ ID NO: 1191825 - RNA, 15 nt, Homo sapiens
uuacaucccagacac

SEQ ID NO: 1191826 - RNA, 13 nt, Homo sapiens
uuacaucuuucac

SEQ ID NO: 1191827 - RNA, 17 nt, Homo sapiens
uuacauggacagaauuu

SEQ ID NO: 1191828 - RNA, 16 nt, Homo sapiens
uuacauguaauuugau

SEQ ID NO: 1191829 - RNA, 16 nt, Homo sapiens
uuacauguuguguaug

SEQ ID NO: 1191830 - RNA, 15 nt, Homo sapiens
uuaccaauugcuaag

SEQ ID NO: 1191831 - RNA, 16 nt, Homo sapiens
uuaccagagaaaaagg

SEQ ID NO: 1191832 - RNA, 20 nt, Homo sapiens
uuaccaucacugaguuuucc

SEQ ID NO: 1191833 - RNA, 19 nt, Homo sapiens
uuacccaacucuguacaaa

SEQ ID NO: 1191834 - RNA, 19 nt, Homo sapiens
uuacccacacacagauaaa

SEQ ID NO: 1191835 - RNA, 13 nt, Homo sapiens
uuacccacugcca

SEQ ID NO: 1191836 - RNA, 20 nt, Homo sapiens
uuacccaguauuacugcugc

SEQ ID NO: 1191837 - RNA, 13 nt, Homo sapiens
uuacccagugccg

SEQ ID NO: 1191838 - RNA, 14 nt, Homo sapiens
uuaccccugcacag

SEQ ID NO: 1191839 - RNA, 17 nt, Homo sapiens
uuaccucuuaccuguaa

SEQ ID NO: 1191840 - RNA, 23 nt, Homo sapiens
uuaccucuuuaaaaacaaaacaa

SEQ ID NO: 1191841 - RNA, 22 nt, Homo sapiens
uuaccugaaauaaaauucauua

SEQ ID NO: 1191842 - RNA, 21 nt, Homo sapiens
uuaccuuguuuugccagugau

SEQ ID NO: 1191843 - RNA, 16 nt, Homo sapiens
uuacuccucacacuua

SEQ ID NO: 1191844 - RNA, 20 nt, Homo sapiens
uuacuccugguucagugcca

SEQ ID NO: 1191845 - RNA, 10 nt, Homo sapiens
uuacuguaac

SEQ ID NO: 1191846 - RNA, 13 nt, Homo sapiens
uuacugugauuca

SEQ ID NO: 1191847 - RNA, 22 nt, Homo sapiens
uuacuguugugaccugaaguuc

SEQ ID NO: 1191848 - RNA, 19 nt, Homo sapiens
uuacuugaaguaacuauaa

SEQ ID NO: 1191849 - RNA, 21 nt, Homo sapiens
uuacuuggacgcaacauugca

SEQ ID NO: 1191850 - RNA, 19 nt, Homo sapiens
uuacuuuuuccuggcucau

SEQ ID NO: 1191851 - RNA, 21 nt, Homo sapiens
uuagaaaaagaacaugcaguu

SEQ ID NO: 1191852 - RNA, 18 nt, Homo sapiens
uuagaaacaacauagcaa

SEQ ID NO: 1191853 - RNA, 22 nt, Homo sapiens
uuagaaagcugacauugccaaa

SEQ ID NO: 1191854 - RNA, 17 nt, Homo sapiens
uuagaaguagaauuugc

SEQ ID NO: 1191855 - RNA, 17 nt, Homo sapiens
uuagaaguguuguaaaa

SEQ ID NO: 1191856 - RNA, 22 nt, Homo sapiens
uuagacaguaugcauacuggug

SEQ ID NO: 1191857 - RNA, 18 nt, Homo sapiens
uuagacucaucuuacugu

SEQ ID NO: 1191858 - RNA, 16 nt, Homo sapiens
uuagacuuauguggaa

SEQ ID NO: 1191859 - RNA, 11 nt, Homo sapiens
uuagagcauua

SEQ ID NO: 1191860 - RNA, 14 nt, Homo sapiens
uuagaggcaaagaa

SEQ ID NO: 1191861 - RNA, 22 nt, Homo sapiens
uuagauucucugugucuaagau

SEQ ID NO: 1191862 - RNA, 22 nt, Homo sapiens
uuagcaaacuuuguaugucauu

SEQ ID NO: 1191863 - RNA, 22 nt, Homo sapiens
uuagcacugcccuggugauuac

SEQ ID NO: 1191864 - RNA, 22 nt, Homo sapiens
uuagcaguuuugugauaaguuc

SEQ ID NO: 1191865 - RNA, 21 nt, Homo sapiens
uuagcauaaaauuuucuacuc

SEQ ID NO: 1191866 - RNA, 20 nt, Homo sapiens
uuagcauaaauuuaauguag

SEQ ID NO: 1191867 - RNA, 21 nt, Homo sapiens
uuagcaugaauccuacauaca

SEQ ID NO: 1191868 - RNA, 13 nt, Homo sapiens
uuagcuacugcua

SEQ ID NO: 1191869 - RNA, 20 nt, Homo sapiens
uuagcuaggcuaaaacaccu

SEQ ID NO: 1191870 - RNA, 15 nt, Homo sapiens
uuagcuggccaagga

SEQ ID NO: 1191871 - RNA, 20 nt, Homo sapiens
uuaggaacuuuauguucuaa

SEQ ID NO: 1191872 - RNA, 20 nt, Homo sapiens
uuaggaaggcagcauuccau

SEQ ID NO: 1191873 - RNA, 15 nt, Homo sapiens
uuaggaauacuguuu

SEQ ID NO: 1191874 - RNA, 21 nt, Homo sapiens
uuaggauaaccuugugccuug

SEQ ID NO: 1191875 - RNA, 20 nt, Homo sapiens
uuaggccuccggaugacugc

SEQ ID NO: 1191876 - RNA, 12 nt, Homo sapiens
uuaggcuuugua

SEQ ID NO: 1191877 - RNA, 19 nt, Homo sapiens
uuaguacacagcaccagaa

SEQ ID NO: 1191878 - RNA, 15 nt, Homo sapiens
uuaguacuuacauca

SEQ ID NO: 1191879 - RNA, 19 nt, Homo sapiens
uuaguauugcagccaaaga

SEQ ID NO: 1191880 - RNA, 16 nt, Homo sapiens
uuagucacugcugcua

SEQ ID NO: 1191881 - RNA, 17 nt, Homo sapiens
uuaguccaauuccuugc

SEQ ID NO: 1191882 - RNA, 23 nt, Homo sapiens
uuagugaccccugccuacuuccu

SEQ ID NO: 1191883 - RNA, 18 nt, Homo sapiens
uuaguggaauuugcuuua

SEQ ID NO: 1191884 - RNA, 18 nt, Homo sapiens
uuagugucucauguggaa

SEQ ID NO: 1191885 - RNA, 23 nt, Homo sapiens
uuauaaaauauuguuaaugccua

SEQ ID NO: 1191886 - RNA, 17 nt, Homo sapiens
uuauaaacuuucugagu

SEQ ID NO: 1191887 - RNA, 20 nt, Homo sapiens
uuauaaauuggagaugcaaa

SEQ ID NO: 1191888 - RNA, 13 nt, Homo sapiens
uuauaacuguugu

SEQ ID NO: 1191889 - RNA, 15 nt, Homo sapiens
uuauaagacaaugag

SEQ ID NO: 1191890 - RNA, 23 nt, Homo sapiens
uuauaagcagguguauacuuuua

SEQ ID NO: 1191891 - RNA, 14 nt, Homo sapiens
uuauacaagagugu

SEQ ID NO: 1191892 - RNA, 23 nt, Homo sapiens
uuauaccuugccuguaguccagu

SEQ ID NO: 1191893 - RNA, 14 nt, Homo sapiens
uuauacugcacuuu

SEQ ID NO: 1191894 - RNA, 16 nt, Homo sapiens
uuauagcgccuguaua

SEQ ID NO: 1191895 - RNA, 19 nt, Homo sapiens
uuauaguggugucccuaaa

SEQ ID NO: 1191896 - RNA, 17 nt, Homo sapiens
uuauauaucgacauaca

SEQ ID NO: 1191897 - RNA, 15 nt, Homo sapiens
uuauaucauauguau

SEQ ID NO: 1191898 - RNA, 22 nt, Homo sapiens
uuauaugaagcaagcuguguua

SEQ ID NO: 1191899 - RNA, 12 nt, Homo sapiens
uuauauguugcu

SEQ ID NO: 1191900 - RNA, 20 nt, Homo sapiens
uuauauuugaguugugauug

SEQ ID NO: 1191901 - RNA, 18 nt, Homo sapiens
uuauauuuugugcuauca

SEQ ID NO: 1191902 - RNA, 21 nt, Homo sapiens
uuaucaacuggggggaccaaa

SEQ ID NO: 1191903 - RNA, 12 nt, Homo sapiens
uuaucaccucau

SEQ ID NO: 1191904 - RNA, 18 nt, Homo sapiens
uuaucaccucauucugaa

SEQ ID NO: 1191905 - RNA, 19 nt, Homo sapiens
uuaucaugcaaaugcugua

SEQ ID NO: 1191906 - RNA, 21 nt, Homo sapiens
uuaucaugcaaaugcuguauu

SEQ ID NO: 1191907 - RNA, 21 nt, Homo sapiens
uuauccuaaagauuauuaccu

SEQ ID NO: 1191908 - RNA, 17 nt, Homo sapiens
uuauccuuguuuccuua

SEQ ID NO: 1191909 - RNA, 17 nt, Homo sapiens
uuaucuagaacauucag

SEQ ID NO: 1191910 - RNA, 16 nt, Homo sapiens
uuaucuauucugagaa

SEQ ID NO: 1191911 - RNA, 22 nt, Homo sapiens
uuaucucccugcuucauaucuc

SEQ ID NO: 1191912 - RNA, 18 nt, Homo sapiens
uuaucugagcugagccag

SEQ ID NO: 1191913 - RNA, 13 nt, Homo sapiens
uuaucugauacuu

SEQ ID NO: 1191914 - RNA, 14 nt, Homo sapiens
uuaucuuuguucuc

SEQ ID NO: 1191915 - RNA, 19 nt, Homo sapiens
uuaugaaaaugcuguuuuc

SEQ ID NO: 1191916 - RNA, 21 nt, Homo sapiens
uuaugaauauaaugaaugaga

SEQ ID NO: 1191917 - RNA, 19 nt, Homo sapiens
uuaugauagugguaugaca

SEQ ID NO: 1191918 - RNA, 23 nt, Homo sapiens
uuaugccaccugaauaaagaaug

SEQ ID NO: 1191919 - RNA, 13 nt, Homo sapiens
uuaugcggcauuu

SEQ ID NO: 1191920 - RNA, 21 nt, Homo sapiens
uuauggaaauaguacuaaagg

SEQ ID NO: 1191921 - RNA, 16 nt, Homo sapiens
uuauggaacagggaug

SEQ ID NO: 1191922 - RNA, 16 nt, Homo sapiens
uuaugguacacuccag

SEQ ID NO: 1191923 - RNA, 22 nt, Homo sapiens
uuauguaaagauaaauauucua

SEQ ID NO: 1191924 - RNA, 18 nt, Homo sapiens
uuauguaguaauugacau

SEQ ID NO: 1191925 - RNA, 13 nt, Homo sapiens
uuauuaaaaacug

SEQ ID NO: 1191926 - RNA, 21 nt, Homo sapiens
uuauuaaaauucuuuaauaau

SEQ ID NO: 1191927 - RNA, 21 nt, Homo sapiens
uuauuaaagcaaucuaauuau

SEQ ID NO: 1191928 - RNA, 18 nt, Homo sapiens
uuauuaaauauaaauauc

SEQ ID NO: 1191929 - RNA, 14 nt, Homo sapiens
uuauuacauguaau

SEQ ID NO: 1191930 - RNA, 19 nt, Homo sapiens
uuauuacauguaauuugau

SEQ ID NO: 1191931 - RNA, 19 nt, Homo sapiens
uuauuaggaaguaugguuu

SEQ ID NO: 1191932 - RNA, 18 nt, Homo sapiens
uuauucaaacuaccuaua

SEQ ID NO: 1191933 - RNA, 11 nt, Homo sapiens
uuauucacuuu

SEQ ID NO: 1191934 - RNA, 12 nt, Homo sapiens
uuauucucaaga

SEQ ID NO: 1191935 - RNA, 15 nt, Homo sapiens
uuauucuugguuuuc

SEQ ID NO: 1191936 - RNA, 18 nt, Homo sapiens
uuauugagauuguccuca

SEQ ID NO: 1191937 - RNA, 19 nt, Homo sapiens
uuauugccuaaucacucca

SEQ ID NO: 1191938 - RNA, 21 nt, Homo sapiens
uuauuggaaacauuacuuuga

SEQ ID NO: 1191939 - RNA, 22 nt, Homo sapiens
uuauugguuuuguucuugccua

SEQ ID NO: 1191940 - RNA, 19 nt, Homo sapiens
uuauuguacaaguugaaau

SEQ ID NO: 1191941 - RNA, 20 nt, Homo sapiens
uuauuuaaaaagaacucuga

SEQ ID NO: 1191942 - RNA, 23 nt, Homo sapiens
uuauuuaaagcaaugcugaugaa

SEQ ID NO: 1191943 - RNA, 13 nt, Homo sapiens
uuauuuaugcuau

SEQ ID NO: 1191944 - RNA, 13 nt, Homo sapiens
uuauuuccacuua

SEQ ID NO: 1191945 - RNA, 17 nt, Homo sapiens
uuauuuccccagccaca

SEQ ID NO: 1191946 - RNA, 22 nt, Homo sapiens
uuauuuccccagccacaggcca

SEQ ID NO: 1191947 - RNA, 14 nt, Homo sapiens
uuauuuccugcuua

SEQ ID NO: 1191948 - RNA, 17 nt, Homo sapiens
uuauuucggagcgcaau

SEQ ID NO: 1191949 - RNA, 19 nt, Homo sapiens
uuauuucugaucuauacaa

SEQ ID NO: 1191950 - RNA, 21 nt, Homo sapiens
uuauuuggauaucaaaagcaa

SEQ ID NO: 1191951 - RNA, 15 nt, Homo sapiens
uuauuuucuacuuac

SEQ ID NO: 1191952 - RNA, 16 nt, Homo sapiens
uuauuuuuacaguucu

SEQ ID NO: 1191953 - RNA, 17 nt, Homo sapiens
uuauuuuuguaucuuaa

SEQ ID NO: 1191954 - RNA, 17 nt, Homo sapiens
uucaaaaaaagcacaaa

SEQ ID NO: 1191955 - RNA, 19 nt, Homo sapiens
uucaaaaaacucucuccca

SEQ ID NO: 1191956 - RNA, 13 nt, Homo sapiens
uucaaaacauaca

SEQ ID NO: 1191957 - RNA, 12 nt, Homo sapiens
uucaaaacauuc

SEQ ID NO: 1191958 - RNA, 14 nt, Homo sapiens
uucaaaacauugug

SEQ ID NO: 1191959 - RNA, 18 nt, Homo sapiens
uucaaaaguaaugccucu

SEQ ID NO: 1191960 - RNA, 14 nt, Homo sapiens
uucaaaauccaaaa

SEQ ID NO: 1191961 - RNA, 16 nt, Homo sapiens
uucaaaauccaaaaag

SEQ ID NO: 1191962 - RNA, 12 nt, Homo sapiens
uucaaacacugc

SEQ ID NO: 1191963 - RNA, 13 nt, Homo sapiens
uucaaacauauau

SEQ ID NO: 1191964 - RNA, 14 nt, Homo sapiens
uucaaacugcugga

SEQ ID NO: 1191965 - RNA, 12 nt, Homo sapiens
uucaaguguaaa

SEQ ID NO: 1191966 - RNA, 22 nt, Homo sapiens
uucaauguccuaaaaagacacg

SEQ ID NO: 1191967 - RNA, 16 nt, Homo sapiens
uucaauucgacuucuu

SEQ ID NO: 1191968 - RNA, 16 nt, Homo sapiens
uucaauuugaacucag

SEQ ID NO: 1191969 - RNA, 18 nt, Homo sapiens
uucacaaaacagccuuug

SEQ ID NO: 1191970 - RNA, 11 nt, Homo sapiens
uucacaaucuu

SEQ ID NO: 1191971 - RNA, 18 nt, Homo sapiens
uucacacacacaguuuga

SEQ ID NO: 1191972 - RNA, 14 nt, Homo sapiens
uucacagcacauuu

SEQ ID NO: 1191973 - RNA, 15 nt, Homo sapiens
uucacagugaucgau

SEQ ID NO: 1191974 - RNA, 12 nt, Homo sapiens
uucaccuaagag

SEQ ID NO: 1191975 - RNA, 18 nt, Homo sapiens
uucaccuaccgaguucaa

SEQ ID NO: 1191976 - RNA, 20 nt, Homo sapiens
uucaccuccuucaauuccau

SEQ ID NO: 1191977 - RNA, 16 nt, Homo sapiens
uucaccuggaagcauu

SEQ ID NO: 1191978 - RNA, 14 nt, Homo sapiens
uucacggagacagc

SEQ ID NO: 1191979 - RNA, 18 nt, Homo sapiens
uucacuccuacccccaga

SEQ ID NO: 1191980 - RNA, 11 nt, Homo sapiens
uucacugcugc

SEQ ID NO: 1191981 - RNA, 21 nt, Homo sapiens
uucacuuaauaauguguacau

SEQ ID NO: 1191982 - RNA, 18 nt, Homo sapiens
uucagaaccauccauagu

SEQ ID NO: 1191983 - RNA, 16 nt, Homo sapiens
uucagaacucacauug

SEQ ID NO: 1191984 - RNA, 18 nt, Homo sapiens
uucagacaaauuacugau

SEQ ID NO: 1191985 - RNA, 22 nt, Homo sapiens
uucagagggcguguuguuuuac

SEQ ID NO: 1191986 - RNA, 20 nt, Homo sapiens
uucagaguagaaccacuugu

SEQ ID NO: 1191987 - RNA, 19 nt, Homo sapiens
uucagagugacacccaaga

SEQ ID NO: 1191988 - RNA, 14 nt, Homo sapiens
uucagaugucuuaa

SEQ ID NO: 1191989 - RNA, 17 nt, Homo sapiens
uucagauguggagccag

SEQ ID NO: 1191990 - RNA, 21 nt, Homo sapiens
uucagcauccgcaggugcugg

SEQ ID NO: 1191991 - RNA, 14 nt, Homo sapiens
uucagcauugccua

SEQ ID NO: 1191992 - RNA, 14 nt, Homo sapiens
uucagccaccucuc

SEQ ID NO: 1191993 - RNA, 15 nt, Homo sapiens
uucagcgaaagggac

SEQ ID NO: 1191994 - RNA, 16 nt, Homo sapiens
uucagcggcagugugu

SEQ ID NO: 1191995 - RNA, 21 nt, Homo sapiens
uucaggaacacccccaugaca

SEQ ID NO: 1191996 - RNA, 22 nt, Homo sapiens
uucaggcucugcccaggaacuc

SEQ ID NO: 1191997 - RNA, 20 nt, Homo sapiens
uucaggcugccuaagacaug

SEQ ID NO: 1191998 - RNA, 19 nt, Homo sapiens
uucaggcuuauaacaaaua

SEQ ID NO: 1191999 - RNA, 22 nt, Homo sapiens
uucaguauuaaauuagauaucu

SEQ ID NO: 1192000 - RNA, 22 nt, Homo sapiens
uucaguccucccagacuaccug

SEQ ID NO: 1192001 - RNA, 18 nt, Homo sapiens
uucagucuuuucucugaa

SEQ ID NO: 1192002 - RNA, 17 nt, Homo sapiens
uucagugcuguacuuga

SEQ ID NO: 1192003 - RNA, 15 nt, Homo sapiens
uucaguuaauucuua

SEQ ID NO: 1192004 - RNA, 21 nt, Homo sapiens
uucaguucagauaauuggcaa

SEQ ID NO: 1192005 - RNA, 19 nt, Homo sapiens
uucauaaagaugucucaca

SEQ ID NO: 1192006 - RNA, 16 nt, Homo sapiens
uucauacuccuuuuaa

SEQ ID NO: 1192007 - RNA, 15 nt, Homo sapiens
uucauagaaaccucu

SEQ ID NO: 1192008 - RNA, 16 nt, Homo sapiens
uucauagcaaugucuc

SEQ ID NO: 1192009 - RNA, 18 nt, Homo sapiens
uucauauccauagauagu

SEQ ID NO: 1192010 - RNA, 15 nt, Homo sapiens
uucauccccugugaa

SEQ ID NO: 1192011 - RNA, 21 nt, Homo sapiens
uucaucccucgggugugcuau

SEQ ID NO: 1192012 - RNA, 15 nt, Homo sapiens
uucaucuucaguaau

SEQ ID NO: 1192013 - RNA, 19 nt, Homo sapiens
uucaugauuagcaaguuac

SEQ ID NO: 1192014 - RNA, 11 nt, Homo sapiens
uucaugcacug

SEQ ID NO: 1192015 - RNA, 14 nt, Homo sapiens
uucaugcaggugaa

SEQ ID NO: 1192016 - RNA, 15 nt, Homo sapiens
uucaugccaaguauc

SEQ ID NO: 1192017 - RNA, 17 nt, Homo sapiens
uucauggccucaggaga

SEQ ID NO: 1192018 - RNA, 23 nt, Homo sapiens
uucaugggcccacaggguaccag

SEQ ID NO: 1192019 - RNA, 18 nt, Homo sapiens
uucauguggagucauuau

SEQ ID NO: 1192020 - RNA, 16 nt, Homo sapiens
uucauuaugaggucag

SEQ ID NO: 1192021 - RNA, 21 nt, Homo sapiens
uucauucaggcaacgcacaaa

SEQ ID NO: 1192022 - RNA, 20 nt, Homo sapiens
uucauuuaggaugcuuucau

SEQ ID NO: 1192023 - RNA, 14 nt, Homo sapiens
uucauuuauaucgc

SEQ ID NO: 1192024 - RNA, 18 nt, Homo sapiens
uucauuuauucauguuau

SEQ ID NO: 1192025 - RNA, 22 nt, Homo sapiens
uucauuuccuacuucauuccag

SEQ ID NO: 1192026 - RNA, 19 nt, Homo sapiens
uuccaaacaggcucagagg

SEQ ID NO: 1192027 - RNA, 15 nt, Homo sapiens
uuccaaccggcuuug

SEQ ID NO: 1192028 - RNA, 14 nt, Homo sapiens
uuccaagagucuaa

SEQ ID NO: 1192029 - RNA, 19 nt, Homo sapiens
uuccaagauuucaaagugg

SEQ ID NO: 1192030 - RNA, 16 nt, Homo sapiens
uuccaauuauuugacu

SEQ ID NO: 1192031 - RNA, 18 nt, Homo sapiens
uuccacaccuagcaucuc

SEQ ID NO: 1192032 - RNA, 16 nt, Homo sapiens
uuccacucccacugcc

SEQ ID NO: 1192033 - RNA, 17 nt, Homo sapiens
uuccacuccuccuagcc

SEQ ID NO: 1192034 - RNA, 10 nt, Homo sapiens
uuccacugag

SEQ ID NO: 1192035 - RNA, 19 nt, Homo sapiens
uuccagacuuccuugagac

SEQ ID NO: 1192036 - RNA, 14 nt, Homo sapiens
uuccagagcucuga

SEQ ID NO: 1192037 - RNA, 17 nt, Homo sapiens
uuccagaguccuccuuu

SEQ ID NO: 1192038 - RNA, 16 nt, Homo sapiens
uuccagcacuuugcaa

SEQ ID NO: 1192039 - RNA, 23 nt, Homo sapiens
uuccagcuuagaaugcaucucau

SEQ ID NO: 1192040 - RNA, 14 nt, Homo sapiens
uuccaggugcccag

SEQ ID NO: 1192041 - RNA, 18 nt, Homo sapiens
uuccagguguuacuguaa

SEQ ID NO: 1192042 - RNA, 21 nt, Homo sapiens
uuccaguucccuuugcuuguc

SEQ ID NO: 1192043 - RNA, 16 nt, Homo sapiens
uuccauaagaagucgu

SEQ ID NO: 1192044 - RNA, 14 nt, Homo sapiens
uuccauauauccuu

SEQ ID NO: 1192045 - RNA, 20 nt, Homo sapiens
uuccaucaaaccuuugccaa

SEQ ID NO: 1192046 - RNA, 19 nt, Homo sapiens
uuccaucagacugaacuua

SEQ ID NO: 1192047 - RNA, 20 nt, Homo sapiens
uuccaugaacaccauaccuu

SEQ ID NO: 1192048 - RNA, 12 nt, Homo sapiens
uuccaugauuaa

SEQ ID NO: 1192049 - RNA, 14 nt, Homo sapiens
uuccaugucuccuu

SEQ ID NO: 1192050 - RNA, 19 nt, Homo sapiens
uucccaagguacagcugua

SEQ ID NO: 1192051 - RNA, 18 nt, Homo sapiens
uucccaauauuugcuaaa

SEQ ID NO: 1192052 - RNA, 16 nt, Homo sapiens
uucccacaggacauuu

SEQ ID NO: 1192053 - RNA, 17 nt, Homo sapiens
uucccacaggacauuuc

SEQ ID NO: 1192054 - RNA, 15 nt, Homo sapiens
uucccacugcacucc

SEQ ID NO: 1192055 - RNA, 14 nt, Homo sapiens
uucccagcucuccc

SEQ ID NO: 1192056 - RNA, 17 nt, Homo sapiens
uuccccaccuuccuuac

SEQ ID NO: 1192057 - RNA, 11 nt, Homo sapiens
uuccccaguga

SEQ ID NO: 1192058 - RNA, 16 nt, Homo sapiens
uuccccaucuucuaaa

SEQ ID NO: 1192059 - RNA, 13 nt, Homo sapiens
uucccccacugau

SEQ ID NO: 1192060 - RNA, 13 nt, Homo sapiens
uucccuacuuccc

SEQ ID NO: 1192061 - RNA, 23 nt, Homo sapiens
uucccuccccagaauggaggcaa

SEQ ID NO: 1192062 - RNA, 19 nt, Homo sapiens
uucccucuucccugaccuc

SEQ ID NO: 1192063 - RNA, 15 nt, Homo sapiens
uucccucuugcucag

SEQ ID NO: 1192064 - RNA, 20 nt, Homo sapiens
uucccugaaggaaccaaagc

SEQ ID NO: 1192065 - RNA, 20 nt, Homo sapiens
uucccugucagccugacucu

SEQ ID NO: 1192066 - RNA, 15 nt, Homo sapiens
uucccuuagacuuua

SEQ ID NO: 1192067 - RNA, 18 nt, Homo sapiens
uucccuucccccuggccu

SEQ ID NO: 1192068 - RNA, 18 nt, Homo sapiens
uucccuuugcuugucuuc

SEQ ID NO: 1192069 - RNA, 20 nt, Homo sapiens
uucccuuuuaaucaacugua

SEQ ID NO: 1192070 - RNA, 17 nt, Homo sapiens
uuccggguucaagugac

SEQ ID NO: 1192071 - RNA, 21 nt, Homo sapiens
uuccgucaccacgacuggcca

SEQ ID NO: 1192072 - RNA, 17 nt, Homo sapiens
uuccguggcacugcaua

SEQ ID NO: 1192073 - RNA, 21 nt, Homo sapiens
uuccuaaauuaugacugcuga

SEQ ID NO: 1192074 - RNA, 20 nt, Homo sapiens
uuccuaagacugcugcugaa

SEQ ID NO: 1192075 - RNA, 19 nt, Homo sapiens
uuccuauacgugugucuuu

SEQ ID NO: 1192076 - RNA, 16 nt, Homo sapiens
uuccuauaugcacuua

SEQ ID NO: 1192077 - RNA, 23 nt, Homo sapiens
uuccuauaugcacuuauucucaa

SEQ ID NO: 1192078 - RNA, 16 nt, Homo sapiens
uuccuauguaacugca

SEQ ID NO: 1192079 - RNA, 14 nt, Homo sapiens
uuccucacuaccug

SEQ ID NO: 1192080 - RNA, 15 nt, Homo sapiens
uuccucagaaaccaa

SEQ ID NO: 1192081 - RNA, 16 nt, Homo sapiens
uuccucagcugugugg

SEQ ID NO: 1192082 - RNA, 20 nt, Homo sapiens
uuccucagggacagagacac

SEQ ID NO: 1192083 - RNA, 21 nt, Homo sapiens
uuccuccuuugggcccagcgg

SEQ ID NO: 1192084 - RNA, 21 nt, Homo sapiens
uuccucguuuugaaagcaguu

SEQ ID NO: 1192085 - RNA, 18 nt, Homo sapiens
uucuuuaccuucauuuca

SEQ ID NO: 1192086 - RNA, 14 nt, Homo sapiens
uucuuuaucaccug

SEQ ID NO: 1192087 - RNA, 10 nt, Homo sapiens
uucuuuccaa

SEQ ID NO: 1192088 - RNA, 14 nt, Homo sapiens
uucuuuccauaaua

SEQ ID NO: 1192089 - RNA, 18 nt, Homo sapiens
uucuuugacuuaaugucu

SEQ ID NO: 1192090 - RNA, 22 nt, Homo sapiens
uucuuugccuguucaguuacag

SEQ ID NO: 1192091 - RNA, 16 nt, Homo sapiens
uucuuuuggcuuccau

SEQ ID NO: 1192092 - RNA, 13 nt, Homo sapiens
uucuuuuuccaca

SEQ ID NO: 1192093 - RNA, 13 nt, Homo sapiens
uucuuuuugccag

SEQ ID NO: 1192094 - RNA, 15 nt, Homo sapiens
uucuuuuugccagcu

SEQ ID NO: 1192095 - RNA, 13 nt, Homo sapiens
uugaaaaaguaua

SEQ ID NO: 1192096 - RNA, 19 nt, Homo sapiens
uugaaaauauuuuguugcc

SEQ ID NO: 1192097 - RNA, 20 nt, Homo sapiens
uugaaaaugcaucacaugau

SEQ ID NO: 1192098 - RNA, 16 nt, Homo sapiens
uugaaacaaucugaau

SEQ ID NO: 1192099 - RNA, 20 nt, Homo sapiens
uugaaacauguucaucugga

SEQ ID NO: 1192100 - RNA, 15 nt, Homo sapiens
uugaaaccuuugaca

SEQ ID NO: 1192101 - RNA, 13 nt, Homo sapiens
uugcuugcaaugu

SEQ ID NO: 1192102 - RNA, 20 nt, Homo sapiens
uugcuugccuuccucccuuc

SEQ ID NO: 1192103 - RNA, 20 nt, Homo sapiens
uugcuuggugcugguuuauu

SEQ ID NO: 1192104 - RNA, 17 nt, Homo sapiens
uugcuuuauccaaaagu

SEQ ID NO: 1192105 - RNA, 15 nt, Homo sapiens
uugcuuuauuccaga

SEQ ID NO: 1192106 - RNA, 23 nt, Homo sapiens
uugcuuuguuggcaaggagccag

SEQ ID NO: 1192107 - RNA, 17 nt, Homo sapiens
uuggaaagagucuccag

SEQ ID NO: 1192108 - RNA, 14 nt, Homo sapiens
uuggaaagcagucc

SEQ ID NO: 1192109 - RNA, 16 nt, Homo sapiens
uuggaaagguuucaag

SEQ ID NO: 1192110 - RNA, 14 nt, Homo sapiens
uuggaacagugaau

SEQ ID NO: 1192111 - RNA, 21 nt, Homo sapiens
uuggaacuuuuauuacugggg

SEQ ID NO: 1192112 - RNA, 15 nt, Homo sapiens
uuggaagaugcagaa

SEQ ID NO: 1192113 - RNA, 14 nt, Homo sapiens
uuggaagugcagag

SEQ ID NO: 1192114 - RNA, 20 nt, Homo sapiens
uuggaauaacccaaaacugc

SEQ ID NO: 1192115 - RNA, 14 nt, Homo sapiens
uuggaauaaucacu

SEQ ID NO: 1192116 - RNA, 15 nt, Homo sapiens
uuggacacugugcua

SEQ ID NO: 1192117 - RNA, 17 nt, Homo sapiens
uuggacagaagcagcuc

SEQ ID NO: 1192118 - RNA, 15 nt, Homo sapiens
uuggacuaugcaugu

SEQ ID NO: 1192119 - RNA, 14 nt, Homo sapiens
uuggacuucuugaa

SEQ ID NO: 1192120 - RNA, 22 nt, Homo sapiens
uaugauuuauuaaauaaucucu

SEQ ID NO: 1192121 - RNA, 19 nt, Homo sapiens
uaugcaaccaguuuaucca

SEQ ID NO: 1192122 - RNA, 15 nt, Homo sapiens
uaugcaucugcuacu

SEQ ID NO: 1192123 - RNA, 19 nt, Homo sapiens
uaugcauggugccccagga

SEQ ID NO: 1192124 - RNA, 17 nt, Homo sapiens
uaugcauuuggaauuag

SEQ ID NO: 1192125 - RNA, 17 nt, Homo sapiens
uaugccuuuuuugauca

SEQ ID NO: 1192126 - RNA, 16 nt, Homo sapiens
uaugcuauccucuuau

SEQ ID NO: 1192127 - RNA, 14 nt, Homo sapiens
uaugcucuaaacau

SEQ ID NO: 1192128 - RNA, 14 nt, Homo sapiens
uaugcuugcucuaa

SEQ ID NO: 1192129 - RNA, 13 nt, Homo sapiens
uauggaaggugac

SEQ ID NO: 1192130 - RNA, 20 nt, Homo sapiens
uauggaauucaaagcucuaa

SEQ ID NO: 1192131 - RNA, 19 nt, Homo sapiens
uauggaauugauuugcauu

SEQ ID NO: 1192132 - RNA, 14 nt, Homo sapiens
uauggacucugcac

SEQ ID NO: 1192133 - RNA, 21 nt, Homo sapiens
uauggcaaaaguaggcaucua

SEQ ID NO: 1192134 - RNA, 14 nt, Homo sapiens
aacagaagcuucca

SEQ ID NO: 1192135 - RNA, 15 nt, Homo sapiens
aacagacuggcucca

SEQ ID NO: 1192136 - RNA, 23 nt, Homo sapiens
aacagacuggcuccaacacugca

SEQ ID NO: 1192137 - RNA, 14 nt, Homo sapiens
aacagagacugaau

SEQ ID NO: 1192138 - RNA, 15 nt, Homo sapiens
aacagauaagcaaga

SEQ ID NO: 1192139 - RNA, 13 nt, Homo sapiens
aacagauaauccc

SEQ ID NO: 1192140 - RNA, 23 nt, Homo sapiens
aacagauuugcuccuaaaccauu

SEQ ID NO: 1192141 - RNA, 13 nt, Homo sapiens
aacagcaaauaac

SEQ ID NO: 1192142 - RNA, 18 nt, Homo sapiens
aacagcacuggcucucuc

SEQ ID NO: 1192143 - RNA, 19 nt, Homo sapiens
aacagcagauuucagauca

SEQ ID NO: 1192144 - RNA, 15 nt, Homo sapiens
aacagcaucauguca

SEQ ID NO: 1192145 - RNA, 22 nt, Homo sapiens
aacagcauuacccuccucucuc

SEQ ID NO: 1192146 - RNA, 16 nt, Homo sapiens
aacagccaagugugac

SEQ ID NO: 1192147 - RNA, 18 nt, Homo sapiens
aacagcccuccucugcac

SEQ ID NO: 1192148 - RNA, 22 nt, Homo sapiens
aacagcgggagaccugugcuag

SEQ ID NO: 1192149 - RNA, 21 nt, Homo sapiens
aacagcguguaaacacauguu

SEQ ID NO: 1192150 - RNA, 14 nt, Homo sapiens
aacagcucucaccu

SEQ ID NO: 1192151 - RNA, 23 nt, Homo sapiens
aacagcugaggucucuugaggga

SEQ ID NO: 1192152 - RNA, 16 nt, Homo sapiens
aacagcugcauuagaa

SEQ ID NO: 1192153 - RNA, 15 nt, Homo sapiens
aacagcugucucuaa

SEQ ID NO: 1192154 - RNA, 12 nt, Homo sapiens
aacaggcaguug

SEQ ID NO: 1192155 - RNA, 20 nt, Homo sapiens
aacaggcuguucugcacuga

SEQ ID NO: 1192156 - RNA, 22 nt, Homo sapiens
aacaggugucagagcugaaauu

SEQ ID NO: 1192157 - RNA, 18 nt, Homo sapiens
aacagguuauaacagugu

SEQ ID NO: 1192158 - RNA, 22 nt, Homo sapiens
aacaguaaaagccuuauucuaa

SEQ ID NO: 1192159 - RNA, 23 nt, Homo sapiens
aacaguagcuuagcaucagaggu

SEQ ID NO: 1192160 - RNA, 13 nt, Homo sapiens
aacaguccaaacu

SEQ ID NO: 1192161 - RNA, 16 nt, Homo sapiens
aacagugagaaaccau

SEQ ID NO: 1192162 - RNA, 12 nt, Homo sapiens
aacagugccauu

SEQ ID NO: 1192163 - RNA, 19 nt, Homo sapiens
aacaguggaaacuaugugu

SEQ ID NO: 1192164 - RNA, 13 nt, Homo sapiens
aacaguugugaac

SEQ ID NO: 1192165 - RNA, 21 nt, Homo sapiens
aacauaaaaaauaaaguacca

SEQ ID NO: 1192166 - RNA, 16 nt, Homo sapiens
aacauaaaaaccaaac

SEQ ID NO: 1192167 - RNA, 17 nt, Homo sapiens
aacauaagguacuagca

SEQ ID NO: 1192168 - RNA, 19 nt, Homo sapiens
aacauaagguacuagcagu

SEQ ID NO: 1192169 - RNA, 18 nt, Homo sapiens
aacauaaucuaguuuaca

SEQ ID NO: 1192170 - RNA, 16 nt, Homo sapiens
aacauaauucucucac

SEQ ID NO: 1192171 - RNA, 21 nt, Homo sapiens
aacauacaugagauaacucaa

SEQ ID NO: 1192172 - RNA, 20 nt, Homo sapiens
aacauaggccugcucagccu

SEQ ID NO: 1192173 - RNA, 14 nt, Homo sapiens
aacauaugauuuca

SEQ ID NO: 1192174 - RNA, 15 nt, Homo sapiens
aacauauguuugcuu

SEQ ID NO: 1192175 - RNA, 23 nt, Homo sapiens
aacauauuggaauguacauguca

SEQ ID NO: 1192176 - RNA, 20 nt, Homo sapiens
aacaucauuacugccaucuu

SEQ ID NO: 1192177 - RNA, 20 nt, Homo sapiens
aacaucccuuauuaguuaca

SEQ ID NO: 1192178 - RNA, 15 nt, Homo sapiens
aacaucgauauguau

SEQ ID NO: 1192179 - RNA, 13 nt, Homo sapiens
aacaucgucuaaa

SEQ ID NO: 1192180 - RNA, 22 nt, Homo sapiens
aacaucgugaaaccccaucucu

SEQ ID NO: 1192181 - RNA, 19 nt, Homo sapiens
aacaucuuaagauccacaa

SEQ ID NO: 1192182 - RNA, 16 nt, Homo sapiens
aacaucuuuagugucu

SEQ ID NO: 1192183 - RNA, 14 nt, Homo sapiens
aacaugaguuauuc

SEQ ID NO: 1192184 - RNA, 16 nt, Homo sapiens
aacaugcauacuuuau

SEQ ID NO: 1192185 - RNA, 11 nt, Homo sapiens
aacaugcugcc

SEQ ID NO: 1192186 - RNA, 15 nt, Homo sapiens
aacauggacuuguau

SEQ ID NO: 1192187 - RNA, 13 nt, Homo sapiens
aacauguaugugc

SEQ ID NO: 1192188 - RNA, 21 nt, Homo sapiens
aacaugugaggcauucgggga

SEQ ID NO: 1192189 - RNA, 22 nt, Homo sapiens
aacauuauauugcaaugaagga

SEQ ID NO: 1192190 - RNA, 14 nt, Homo sapiens
aacauuaugccuua

SEQ ID NO: 1192191 - RNA, 17 nt, Homo sapiens
aacauuccaaugcauug

SEQ ID NO: 1192192 - RNA, 21 nt, Homo sapiens
aacauucugcccucaccucug

SEQ ID NO: 1192193 - RNA, 16 nt, Homo sapiens
aacauugacgauuccu

SEQ ID NO: 1192194 - RNA, 18 nt, Homo sapiens
aacauugauuauaagcau

SEQ ID NO: 1192195 - RNA, 18 nt, Homo sapiens
aacauuucuguaaauacc

SEQ ID NO: 1192196 - RNA, 10 nt, Homo sapiens
aacauuugcc

SEQ ID NO: 1192197 - RNA, 19 nt, Homo sapiens
aacauuugguugcuacugu

SEQ ID NO: 1192198 - RNA, 21 nt, Homo sapiens
aacauuugguugcuacugugu

SEQ ID NO: 1192199 - RNA, 21 nt, Homo sapiens
aacauuuuauuuuuaaaauau

SEQ ID NO: 1192200 - RNA, 20 nt, Homo sapiens
aacauuuuguucuuacacau

SEQ ID NO: 1192201 - RNA, 18 nt, Homo sapiens
aaccaaaagaauuugcac

SEQ ID NO: 1192202 - RNA, 16 nt, Homo sapiens
aaccaaauugcacuga

SEQ ID NO: 1192203 - RNA, 20 nt, Homo sapiens
aaccaagacaaaaagccaca

SEQ ID NO: 1192204 - RNA, 15 nt, Homo sapiens
aaccaagaucuauaa

SEQ ID NO: 1192205 - RNA, 19 nt, Homo sapiens
aaccaaguggcucccacac

SEQ ID NO: 1192206 - RNA, 15 nt, Homo sapiens
aaccaauagcuuuaa

SEQ ID NO: 1192207 - RNA, 22 nt, Homo sapiens
aaccacaaagcacaguuugaac

SEQ ID NO: 1192208 - RNA, 11 nt, Homo sapiens
aaccacaaagg

SEQ ID NO: 1192209 - RNA, 17 nt, Homo sapiens
aaccacacaaagacauu

SEQ ID NO: 1192210 - RNA, 12 nt, Homo sapiens
aaccacagagaa

SEQ ID NO: 1192211 - RNA, 14 nt, Homo sapiens
aaccacagcacuau

SEQ ID NO: 1192212 - RNA, 14 nt, Homo sapiens
aaccacaguccuca

SEQ ID NO: 1192213 - RNA, 16 nt, Homo sapiens
aaccacaguuucauua

SEQ ID NO: 1192214 - RNA, 15 nt, Homo sapiens
aaccacaugugcaac

SEQ ID NO: 1192215 - RNA, 13 nt, Homo sapiens
aaccacccaaaac

SEQ ID NO: 1192216 - RNA, 22 nt, Homo sapiens
aaccacuaagaauucaaacugg

SEQ ID NO: 1192217 - RNA, 22 nt, Homo sapiens
aaccacuaugaagcuaccucaa

SEQ ID NO: 1192218 - RNA, 14 nt, Homo sapiens
aaccacuguacaca

SEQ ID NO: 1192219 - RNA, 13 nt, Homo sapiens
aaccacuguacau

SEQ ID NO: 1192220 - RNA, 18 nt, Homo sapiens
aaccacuucauucuugaa

SEQ ID NO: 1192221 - RNA, 16 nt, Homo sapiens
aaccagaaaagcaaua

SEQ ID NO: 1192222 - RNA, 23 nt, Homo sapiens
aaccagaaaauaaagauaguuaa

SEQ ID NO: 1192223 - RNA, 13 nt, Homo sapiens
aaccagcaucucu

SEQ ID NO: 1192224 - RNA, 23 nt, Homo sapiens
aaccagcuucugauaaacacaau

SEQ ID NO: 1192225 - RNA, 19 nt, Homo sapiens
aaccagguuuagacaguau

SEQ ID NO: 1192226 - RNA, 12 nt, Homo sapiens
aaccagugcaga

SEQ ID NO: 1192227 - RNA, 12 nt, Homo sapiens
aaccagugccaa

SEQ ID NO: 1192228 - RNA, 16 nt, Homo sapiens
aaccaguuaugugaau

SEQ ID NO: 1192229 - RNA, 18 nt, Homo sapiens
aaccaguuaugugaauga

SEQ ID NO: 1192230 - RNA, 23 nt, Homo sapiens
aaccucauuuuaguugccuaagc

SEQ ID NO: 1192231 - RNA, 15 nt, Homo sapiens
aaccucccucuuguu

SEQ ID NO: 1192232 - RNA, 22 nt, Homo sapiens
aaccucuagagucacugauaca

SEQ ID NO: 1192233 - RNA, 16 nt, Homo sapiens
aaccucugccuuccag

SEQ ID NO: 1192234 - RNA, 16 nt, Homo sapiens
aaccucuucaugagcu

SEQ ID NO: 1192235 - RNA, 21 nt, Homo sapiens
aaccugcagccccucaugccu

SEQ ID NO: 1192236 - RNA, 22 nt, Homo sapiens
aaccuggauuuuuuaaaucaua

SEQ ID NO: 1192237 - RNA, 17 nt, Homo sapiens
aaccugguggcaccaga

SEQ ID NO: 1192238 - RNA, 17 nt, Homo sapiens
aaccuguugcuguguuu

SEQ ID NO: 1192239 - RNA, 14 nt, Homo sapiens
aaccuuacaugugu

SEQ ID NO: 1192240 - RNA, 22 nt, Homo sapiens
aaccuuacuaauuauacuacuu

SEQ ID NO: 1192241 - RNA, 11 nt, Homo sapiens
aaccuuucaaa

SEQ ID NO: 1192242 - RNA, 16 nt, Homo sapiens
aaccuuugcuauguaa

SEQ ID NO: 1192243 - RNA, 18 nt, Homo sapiens
aacgacaaagcaugguau

SEQ ID NO: 1192244 - RNA, 23 nt, Homo sapiens
aacgacaaagccaaacucugcca

SEQ ID NO: 1192245 - RNA, 14 nt, Homo sapiens
aacgacacauucag

SEQ ID NO: 1192246 - RNA, 12 nt, Homo sapiens
aacgaugugucu

SEQ ID NO: 1192247 - RNA, 21 nt, Homo sapiens
aacgcaggagaaucacugcag

SEQ ID NO: 1192248 - RNA, 15 nt, Homo sapiens
aacgcaucacugggg

SEQ ID NO: 1192249 - RNA, 24 nt, Homo sapiens
aacggcucagacaggcagauuuga

SEQ ID NO: 1192250 - RNA, 13 nt, Homo sapiens
aacgguccaugaa

SEQ ID NO: 1192251 - RNA, 19 nt, Homo sapiens
aacgucuaggaaaucuaga

SEQ ID NO: 1192252 - RNA, 15 nt, Homo sapiens
aacguugacaaguuu

SEQ ID NO: 1192253 - RNA, 17 nt, Homo sapiens
aacguuuugaacuaaua

SEQ ID NO: 1192254 - RNA, 23 nt, Homo sapiens
aacuaauuuccucugacauguaa

SEQ ID NO: 1192255 - RNA, 13 nt, Homo sapiens
aacuaauuugaau

SEQ ID NO: 1192256 - RNA, 12 nt, Homo sapiens
aacuacauguaa

SEQ ID NO: 1192257 - RNA, 23 nt, Homo sapiens
aacuacuaaagugccuaccccag

SEQ ID NO: 1192258 - RNA, 13 nt, Homo sapiens
aacuacugugauc

SEQ ID NO: 1192259 - RNA, 20 nt, Homo sapiens
aacuagacauuaccaaagug

SEQ ID NO: 1192260 - RNA, 17 nt, Homo sapiens
aacuagacauucugucg

SEQ ID NO: 1192261 - RNA, 21 nt, Homo sapiens
aacuagacuaagaagauuuag

SEQ ID NO: 1192262 - RNA, 18 nt, Homo sapiens
aacuagccaaaccaggac

SEQ ID NO: 1192263 - RNA, 20 nt, Homo sapiens
aacuagguuuuugcuucucc

SEQ ID NO: 1192264 - RNA, 19 nt, Homo sapiens
aacuauaaauauguacaau

SEQ ID NO: 1192265 - RNA, 17 nt, Homo sapiens
aacuauaggcuucuucc

SEQ ID NO: 1192266 - RNA, 13 nt, Homo sapiens
aacuauccaaaac

SEQ ID NO: 1192267 - RNA, 18 nt, Homo sapiens
aacuaugacagauauauu

SEQ ID NO: 1192268 - RNA, 16 nt, Homo sapiens
aacuauucuguuccac

SEQ ID NO: 1192269 - RNA, 16 nt, Homo sapiens
aacuauuuaaaggaaa

SEQ ID NO: 1192270 - RNA, 13 nt, Homo sapiens
aacucaagacaau

SEQ ID NO: 1192271 - RNA, 15 nt, Homo sapiens
aacucaagacaaugc

SEQ ID NO: 1192272 - RNA, 15 nt, Homo sapiens
aacucacucugggcu

SEQ ID NO: 1192273 - RNA, 16 nt, Homo sapiens
aacucacucugggcug

SEQ ID NO: 1192274 - RNA, 12 nt, Homo sapiens
aacucacuguga

SEQ ID NO: 1192275 - RNA, 13 nt, Homo sapiens
aacucacuuuccc

SEQ ID NO: 1192276 - RNA, 12 nt, Homo sapiens
aacucagggaca

SEQ ID NO: 1192277 - RNA, 16 nt, Homo sapiens
aacuccacaugcuggu

SEQ ID NO: 1192278 - RNA, 20 nt, Homo sapiens
aacuccaccgccuaucccaa

SEQ ID NO: 1192279 - RNA, 23 nt, Homo sapiens
aacuccacugcuuaccuacuuuc

SEQ ID NO: 1192280 - RNA, 15 nt, Homo sapiens
aacuccaucucaauu

SEQ ID NO: 1192281 - RNA, 22 nt, Homo sapiens
aacuccccucagggauacgaca

SEQ ID NO: 1192282 - RNA, 21 nt, Homo sapiens
aacuccugaccucaggugauu

SEQ ID NO: 1192283 - RNA, 14 nt, Homo sapiens
aacuccugccauuc

SEQ ID NO: 1192284 - RNA, 17 nt, Homo sapiens
aacucuacaucuagcaa

SEQ ID NO: 1192285 - RNA, 21 nt, Homo sapiens
aacucuacaucuagcaauuuc

SEQ ID NO: 1192286 - RNA, 15 nt, Homo sapiens
aacucuagaagacca

SEQ ID NO: 1192287 - RNA, 20 nt, Homo sapiens
aacucuccuggccuggccau

SEQ ID NO: 1192288 - RNA, 19 nt, Homo sapiens
aacucugguaaaugaucac

SEQ ID NO: 1192289 - RNA, 20 nt, Homo sapiens
aacucuguauuacagcuuuc

SEQ ID NO: 1192290 - RNA, 21 nt, Homo sapiens
aacugaaaguuuaacuauuua

SEQ ID NO: 1192291 - RNA, 13 nt, Homo sapiens
aacugaaccaaau

SEQ ID NO: 1192292 - RNA, 13 nt, Homo sapiens
aacugaaccacaa

SEQ ID NO: 1192293 - RNA, 18 nt, Homo sapiens
aacugaacgacaaagcau

SEQ ID NO: 1192294 - RNA, 19 nt, Homo sapiens
aacugaagauccacaaaag

SEQ ID NO: 1192295 - RNA, 13 nt, Homo sapiens
aacugacaguaaa

SEQ ID NO: 1192296 - RNA, 18 nt, Homo sapiens
aacugacugccuugcuaa

SEQ ID NO: 1192297 - RNA, 13 nt, Homo sapiens
aacugacuuucuc

SEQ ID NO: 1192298 - RNA, 19 nt, Homo sapiens
aacugaguguuauuugcac

SEQ ID NO: 1192299 - RNA, 16 nt, Homo sapiens
aacugaugacauucca

SEQ ID NO: 1192300 - RNA, 17 nt, Homo sapiens
aacugcaccugucauca

SEQ ID NO: 1192301 - RNA, 22 nt, Homo sapiens
aacugcaggcccuggccucccc

SEQ ID NO: 1192302 - RNA, 13 nt, Homo sapiens
aacugcauuuccu

SEQ ID NO: 1192303 - RNA, 17 nt, Homo sapiens
aacugccugaaagcaac

SEQ ID NO: 1192304 - RNA, 17 nt, Homo sapiens
aacugcugcugugcaca

SEQ ID NO: 1192305 - RNA, 21 nt, Homo sapiens
aacugcuucccuuacuuugcu

SEQ ID NO: 1192306 - RNA, 14 nt, Homo sapiens
aacuggaaggccuu

SEQ ID NO: 1192307 - RNA, 19 nt, Homo sapiens
aacuggaauaaguguuuau

SEQ ID NO: 1192308 - RNA, 18 nt, Homo sapiens
aacuggaauuaaaaggau

SEQ ID NO: 1192309 - RNA, 18 nt, Homo sapiens
aacuggacaagauuuccu

SEQ ID NO: 1192310 - RNA, 23 nt, Homo sapiens
aacuggacucauuaucacaguga

SEQ ID NO: 1192311 - RNA, 17 nt, Homo sapiens
aacuggaguuggcaaua

SEQ ID NO: 1192312 - RNA, 20 nt, Homo sapiens
aacuggauucuuaaccaaga

SEQ ID NO: 1192313 - RNA, 14 nt, Homo sapiens
aacuggcaucugac

SEQ ID NO: 1192314 - RNA, 15 nt, Homo sapiens
aacugguucaugaaa

SEQ ID NO: 1192315 - RNA, 21 nt, Homo sapiens
aacuguaacguuuucuuucac

SEQ ID NO: 1192316 - RNA, 19 nt, Homo sapiens
aacuguagcucaaguuuaa

SEQ ID NO: 1192317 - RNA, 16 nt, Homo sapiens
aacuguauauauuccc

SEQ ID NO: 1192318 - RNA, 15 nt, Homo sapiens
aacugugaaauacca

SEQ ID NO: 1192319 - RNA, 18 nt, Homo sapiens
aacugugaaauaccacaa

SEQ ID NO: 1192320 - RNA, 22 nt, Homo sapiens
aacugugaaguuuacauuguaa

SEQ ID NO: 1192321 - RNA, 12 nt, Homo sapiens
aacugugcucuu

SEQ ID NO: 1192322 - RNA, 20 nt, Homo sapiens
aacugugcugaaugcuuuag

SEQ ID NO: 1192323 - RNA, 14 nt, Homo sapiens
aacuguguuuacuc

SEQ ID NO: 1192324 - RNA, 14 nt, Homo sapiens
aagagacacuccaa

SEQ ID NO: 1192325 - RNA, 18 nt, Homo sapiens
aagagacauauacuaaga

SEQ ID NO: 1192326 - RNA, 18 nt, Homo sapiens
aagagaccaagacucuga

SEQ ID NO: 1192327 - RNA, 16 nt, Homo sapiens
aagagacuccgucuca

SEQ ID NO: 1192328 - RNA, 18 nt, Homo sapiens
aagagagggacaggcacu

SEQ ID NO: 1192329 - RNA, 19 nt, Homo sapiens
aagagccauauaaguuuga

SEQ ID NO: 1192330 - RNA, 21 nt, Homo sapiens
aagaggaauauucugguuuau

SEQ ID NO: 1192331 - RNA, 14 nt, Homo sapiens
aagaggacugagac

SEQ ID NO: 1192332 - RNA, 13 nt, Homo sapiens
aagaggagcugcu

SEQ ID NO: 1192333 - RNA, 14 nt, Homo sapiens
aagaggcagggucu

SEQ ID NO: 1192334 - RNA, 18 nt, Homo sapiens
aagaggcugccccucuca

SEQ ID NO: 1192335 - RNA, 17 nt, Homo sapiens
aagaggcugcugagaaa

SEQ ID NO: 1192336 - RNA, 19 nt, Homo sapiens
aagagggacaggcugaaga

SEQ ID NO: 1192337 - RNA, 16 nt, Homo sapiens
aagagggcccagccca

SEQ ID NO: 1192338 - RNA, 21 nt, Homo sapiens
aagagggcuuccucuagaagc

SEQ ID NO: 1192339 - RNA, 13 nt, Homo sapiens
aagaggugggagc

SEQ ID NO: 1192340 - RNA, 17 nt, Homo sapiens
aagaguaacuuuacucu

SEQ ID NO: 1192341 - RNA, 18 nt, Homo sapiens
aagagucauauugcccag

SEQ ID NO: 1192342 - RNA, 13 nt, Homo sapiens
aagagucuuccaa

SEQ ID NO: 1192343 - RNA, 21 nt, Homo sapiens
aagagucuuguuuuuuauuca

SEQ ID NO: 1192344 - RNA, 14 nt, Homo sapiens
aagaguggaaccaa

SEQ ID NO: 1192345 - RNA, 16 nt, Homo sapiens
aagaguguuucuucca

SEQ ID NO: 1192346 - RNA, 16 nt, Homo sapiens
aagaguuaauagcuau

SEQ ID NO: 1192347 - RNA, 21 nt, Homo sapiens
aagaguucuuaaggauuguga

SEQ ID NO: 1192348 - RNA, 19 nt, Homo sapiens
aagauaaaugugcugaaug

SEQ ID NO: 1192349 - RNA, 22 nt, Homo sapiens
aagauaaauucaugcacuuuua

SEQ ID NO: 1192350 - RNA, 16 nt, Homo sapiens
aagauaacuuacugua

SEQ ID NO: 1192351 - RNA, 16 nt, Homo sapiens
aagauaauuguugaaa

SEQ ID NO: 1192352 - RNA, 22 nt, Homo sapiens
aagauacagugucugacuauaa

SEQ ID NO: 1192353 - RNA, 19 nt, Homo sapiens
aagauagaugcacuuaugc

SEQ ID NO: 1192354 - RNA, 22 nt, Homo sapiens
aagauagaugcacuuaugcagu

SEQ ID NO: 1192355 - RNA, 19 nt, Homo sapiens
aagauagguuugagggcau

SEQ ID NO: 1192356 - RNA, 14 nt, Homo sapiens
aagauaguaacaau

SEQ ID NO: 1192357 - RNA, 18 nt, Homo sapiens
aagauaguuaaauccuaa

SEQ ID NO: 1192358 - RNA, 20 nt, Homo sapiens
aaagcaagacuguugcucaa

SEQ ID NO: 1192359 - RNA, 18 nt, Homo sapiens
aaagcaagggaccuucau

SEQ ID NO: 1192360 - RNA, 14 nt, Homo sapiens
aaagcaaguguuca

SEQ ID NO: 1192361 - RNA, 15 nt, Homo sapiens
aaagcaaguugccug

SEQ ID NO: 1192362 - RNA, 14 nt, Homo sapiens
aaagcaauaaccuc

SEQ ID NO: 1192363 - RNA, 20 nt, Homo sapiens
aaagcacagggacacaaaga

SEQ ID NO: 1192364 - RNA, 12 nt, Homo sapiens
aaagcacagugu

SEQ ID NO: 1192365 - RNA, 15 nt, Homo sapiens
aaagcacaguuugaa

SEQ ID NO: 1192366 - RNA, 13 nt, Homo sapiens
aaagcacauacau

SEQ ID NO: 1192367 - RNA, 21 nt, Homo sapiens
aaagcacccuguaucacagac

SEQ ID NO: 1192368 - RNA, 18 nt, Homo sapiens
aaagcagacccaccuccc

SEQ ID NO: 1192369 - RNA, 21 nt, Homo sapiens
aaagcagcucaagaacacaug

SEQ ID NO: 1192370 - RNA, 23 nt, Homo sapiens
aaagcagucgaccgcacuuaugg

SEQ ID NO: 1192371 - RNA, 21 nt, Homo sapiens
aaagcaucaauacaaccagcc

SEQ ID NO: 1192372 - RNA, 17 nt, Homo sapiens
aaagcaucuaucucauc

SEQ ID NO: 1192373 - RNA, 12 nt, Homo sapiens
aaagcaugugcu

SEQ ID NO: 1192374 - RNA, 12 nt, Homo sapiens
aaagcauuauua

SEQ ID NO: 1192375 - RNA, 15 nt, Homo sapiens
aaagcauucuuuaac

SEQ ID NO: 1192376 - RNA, 18 nt, Homo sapiens
aaagccaaacucugccag

SEQ ID NO: 1192377 - RNA, 17 nt, Homo sapiens
aaagccaccacauuuag

SEQ ID NO: 1192378 - RNA, 12 nt, Homo sapiens
aaagccagugaa

SEQ ID NO: 1192379 - RNA, 14 nt, Homo sapiens
aaagcccaaggugc

SEQ ID NO: 1192380 - RNA, 13 nt, Homo sapiens
aaagcccuuccau

SEQ ID NO: 1192381 - RNA, 16 nt, Homo sapiens
aaagccuuguguauau

SEQ ID NO: 1192382 - RNA, 17 nt, Homo sapiens
aaagccuuuuccagaag

SEQ ID NO: 1192383 - RNA, 23 nt, Homo sapiens
aaagccuuuuccagaagaucuga

SEQ ID NO: 1192384 - RNA, 23 nt, Homo sapiens
aaagcuacuauguacugccuuag

SEQ ID NO: 1192385 - RNA, 21 nt, Homo sapiens
aaagcuagaaaguguaugugu

SEQ ID NO: 1192386 - RNA, 23 nt, Homo sapiens
aaagcuaggaugguucugugacc

SEQ ID NO: 1192387 - RNA, 15 nt, Homo sapiens
aaagcucacuguagc

SEQ ID NO: 1192388 - RNA, 17 nt, Homo sapiens
aaagcugauuacuguca

SEQ ID NO: 1192389 - RNA, 13 nt, Homo sapiens
aaagcugccugua

SEQ ID NO: 1192390 - RNA, 16 nt, Homo sapiens
aaagcugcuaaaucuc

SEQ ID NO: 1192391 - RNA, 24 nt, Homo sapiens
aaagcuguuccuugguccuaguaa

SEQ ID NO: 1192392 - RNA, 20 nt, Homo sapiens
aaagcuuaccaaggggaaug

SEQ ID NO: 1192393 - RNA, 23 nt, Homo sapiens
aaagcuucaaauuaaaacagcug

SEQ ID NO: 1192394 - RNA, 12 nt, Homo sapiens
aaagcuucacag

SEQ ID NO: 1192395 - RNA, 16 nt, Homo sapiens
aaagcuucacaguacc

SEQ ID NO: 1192396 - RNA, 21 nt, Homo sapiens
aaagcuuuuagaaauacugca

SEQ ID NO: 1192397 - RNA, 16 nt, Homo sapiens
aaaggaaaacgugaac

SEQ ID NO: 1192398 - RNA, 15 nt, Homo sapiens
aaaggaaaagccaag

SEQ ID NO: 1192399 - RNA, 19 nt, Homo sapiens
aaaggaaaauaguaauguu

SEQ ID NO: 1192400 - RNA, 19 nt, Homo sapiens
aaaggaaagauuugccaau

SEQ ID NO: 1192401 - RNA, 13 nt, Homo sapiens
aaaggaacaaaua

SEQ ID NO: 1192402 - RNA, 22 nt, Homo sapiens
aaaggaacuauguucacaagaa

SEQ ID NO: 1192403 - RNA, 13 nt, Homo sapiens
aaaggaagacaga

SEQ ID NO: 1192404 - RNA, 19 nt, Homo sapiens
aaaggaagcuccacuguca

SEQ ID NO: 1192405 - RNA, 14 nt, Homo sapiens
aaaggaagucagua

SEQ ID NO: 1192406 - RNA, 16 nt, Homo sapiens
aaaggaagucaguaca

SEQ ID NO: 1192407 - RNA, 13 nt, Homo sapiens
aaaggaaucucca

SEQ ID NO: 1192408 - RNA, 22 nt, Homo sapiens
aaaggacaggccacaccacagc

SEQ ID NO: 1192409 - RNA, 13 nt, Homo sapiens
aaaggacucugcu

SEQ ID NO: 1192410 - RNA, 19 nt, Homo sapiens
aaaggacucugcuucaguc

SEQ ID NO: 1192411 - RNA, 21 nt, Homo sapiens
aaaggacucugcuucagucca

SEQ ID NO: 1192412 - RNA, 17 nt, Homo sapiens
aaaggagaacuauccaa

SEQ ID NO: 1192413 - RNA, 20 nt, Homo sapiens
aaaggagacaaguuccaugg

SEQ ID NO: 1192414 - RNA, 19 nt, Homo sapiens
aaaggagcauccuuaccuc

SEQ ID NO: 1192415 - RNA, 16 nt, Homo sapiens
aaaggaggcaugccuc

SEQ ID NO: 1192416 - RNA, 15 nt, Homo sapiens
aaaggauaugcagua

SEQ ID NO: 1192417 - RNA, 16 nt, Homo sapiens
aaaggaucagagauuc

SEQ ID NO: 1192418 - RNA, 21 nt, Homo sapiens
aaaggaucucuauaacagauc

SEQ ID NO: 1192419 - RNA, 15 nt, Homo sapiens
aaaggauugaucacu

SEQ ID NO: 1192420 - RNA, 15 nt, Homo sapiens
aaaggauuuuaccaa

SEQ ID NO: 1192421 - RNA, 20 nt, Homo sapiens
aaaggauuuuaccaaagcau

SEQ ID NO: 1192422 - RNA, 17 nt, Homo sapiens
aaaggcccccacuucuc

SEQ ID NO: 1192423 - RNA, 21 nt, Homo sapiens
aaaggccugcacacaagccca

SEQ ID NO: 1192424 - RNA, 21 nt, Homo sapiens
aaaggcuagguacacagcucu

SEQ ID NO: 1192425 - RNA, 15 nt, Homo sapiens
aaaggcucagucuca

SEQ ID NO: 1192426 - RNA, 20 nt, Homo sapiens
aaaggcugccgaggacccuc

SEQ ID NO: 1192427 - RNA, 18 nt, Homo sapiens
aaagggauaguccaaaga

SEQ ID NO: 1192428 - RNA, 9 nt, Homo sapiens
aaagggaug

SEQ ID NO: 1192429 - RNA, 12 nt, Homo sapiens
aaagggcacuua

SEQ ID NO: 1192430 - RNA, 18 nt, Homo sapiens
aaagggcccagagagggu

SEQ ID NO: 1192431 - RNA, 17 nt, Homo sapiens
aaagggccuugacauca

SEQ ID NO: 1192432 - RNA, 23 nt, Homo sapiens
aaagggccuugacaucaguuccu

SEQ ID NO: 1192433 - RNA, 13 nt, Homo sapiens
aaaggggcccaag

SEQ ID NO: 1192434 - RNA, 23 nt, Homo sapiens
aaagggggugggauggggguacu

SEQ ID NO: 1192435 - RNA, 21 nt, Homo sapiens
aaagggugacuuuucaucuga

SEQ ID NO: 1192436 - RNA, 23 nt, Homo sapiens
aaagguaaaacaugcuggugaac

SEQ ID NO: 1192437 - RNA, 23 nt, Homo sapiens
aaagguauuaaauugauguugcu

SEQ ID NO: 1192438 - RNA, 20 nt, Homo sapiens
aaagguauuuugaauaccau

SEQ ID NO: 1192439 - RNA, 16 nt, Homo sapiens
aaaggugugcugguca

SEQ ID NO: 1192440 - RNA, 16 nt, Homo sapiens
aaagguucacucucaa

SEQ ID NO: 1192441 - RNA, 14 nt, Homo sapiens
aaagguugcagugc

SEQ ID NO: 1192442 - RNA, 13 nt, Homo sapiens
aaagguuguguag

SEQ ID NO: 1192443 - RNA, 18 nt, Homo sapiens
aaagguuucauguucacu

SEQ ID NO: 1192444 - RNA, 21 nt, Homo sapiens
aaagguuucauguucacugug

SEQ ID NO: 1192445 - RNA, 19 nt, Homo sapiens
aaagguuuucuucauucau

SEQ ID NO: 1192446 - RNA, 15 nt, Homo sapiens
aaaguaaacgauaaa

SEQ ID NO: 1192447 - RNA, 17 nt, Homo sapiens
aaaguaaauucauguaa

SEQ ID NO: 1192448 - RNA, 13 nt, Homo sapiens
aaaguaacugaau

SEQ ID NO: 1192449 - RNA, 13 nt, Homo sapiens
aaaguaagccaug

SEQ ID NO: 1192450 - RNA, 19 nt, Homo sapiens
aaaguaaguuaauaaugua

SEQ ID NO: 1192451 - RNA, 20 nt, Homo sapiens
aaaguaaguuaauaauguau

SEQ ID NO: 1192452 - RNA, 14 nt, Homo sapiens
aaaguacaaaaauu

SEQ ID NO: 1192453 - RNA, 14 nt, Homo sapiens
aaaguacaaagcau

SEQ ID NO: 1192454 - RNA, 13 nt, Homo sapiens
aaaguacauguau

SEQ ID NO: 1192455 - RNA, 13 nt, Homo sapiens
aaaguaccacaca

SEQ ID NO: 1192456 - RNA, 17 nt, Homo sapiens
aaaguaccacacugagu

SEQ ID NO: 1192457 - RNA, 17 nt, Homo sapiens
aaaugaaguauuucuca

SEQ ID NO: 1192458 - RNA, 14 nt, Homo sapiens
aaaugacaaaaagc

SEQ ID NO: 1192459 - RNA, 22 nt, Homo sapiens
aaaugacaaccugaauuaucua

SEQ ID NO: 1192460 - RNA, 17 nt, Homo sapiens
aaaugacagauguugaa

SEQ ID NO: 1192461 - RNA, 14 nt, Homo sapiens
aaaugacaugcacu

SEQ ID NO: 1192462 - RNA, 20 nt, Homo sapiens
aaaugagaagucucacugau

SEQ ID NO: 1192463 - RNA, 13 nt, Homo sapiens
aaaugagugcuua

SEQ ID NO: 1192464 - RNA, 15 nt, Homo sapiens
aaaugagugcuuaaa

SEQ ID NO: 1192465 - RNA, 19 nt, Homo sapiens
aaaugauaaggcucugaaa

SEQ ID NO: 1192466 - RNA, 16 nt, Homo sapiens
aaaugaugccacuucc

SEQ ID NO: 1192467 - RNA, 12 nt, Homo sapiens
aaaugauggaau

SEQ ID NO: 1192468 - RNA, 18 nt, Homo sapiens
aaaugauguguacccaaa

SEQ ID NO: 1192469 - RNA, 17 nt, Homo sapiens
aaaugccauuuagcaau

SEQ ID NO: 1192470 - RNA, 22 nt, Homo sapiens
aaaugccuccaagccauucacu

SEQ ID NO: 1192471 - RNA, 16 nt, Homo sapiens
aaaugccuccauggca

SEQ ID NO: 1192472 - RNA, 21 nt, Homo sapiens
aaaugcgcgugugcacgugug

SEQ ID NO: 1192473 - RNA, 22 nt, Homo sapiens
aaaugcuacgcacguggagcug

SEQ ID NO: 1192474 - RNA, 15 nt, Homo sapiens
aaaugcugcuucucc

SEQ ID NO: 1192475 - RNA, 16 nt, Homo sapiens
aaauggaaaguaacuc

SEQ ID NO: 1192476 - RNA, 13 nt, Homo sapiens
aaauggaagcaau

SEQ ID NO: 1192477 - RNA, 14 nt, Homo sapiens
aaauggaagcaauu

SEQ ID NO: 1192478 - RNA, 16 nt, Homo sapiens
aaauggaggaauauga

SEQ ID NO: 1192479 - RNA, 15 nt, Homo sapiens
aaauggcagaaccaa

SEQ ID NO: 1192480 - RNA, 21 nt, Homo sapiens
aaauggcagggauacccagug

SEQ ID NO: 1192481 - RNA, 17 nt, Homo sapiens
aaaugggaaaaccagac

SEQ ID NO: 1192482 - RNA, 16 nt, Homo sapiens
aaauggguuggugcuu

SEQ ID NO: 1192483 - RNA, 18 nt, Homo sapiens
aaauggugccuggagcua

SEQ ID NO: 1192484 - RNA, 13 nt, Homo sapiens
aaauguaacugug

SEQ ID NO: 1192485 - RNA, 20 nt, Homo sapiens
aaauguaauacuccuaagac

SEQ ID NO: 1192486 - RNA, 15 nt, Homo sapiens
aaauguaauugaaua

SEQ ID NO: 1192487 - RNA, 13 nt, Homo sapiens
aagccccagggac

SEQ ID NO: 1192488 - RNA, 14 nt, Homo sapiens
aagcccuaagugac

SEQ ID NO: 1192489 - RNA, 15 nt, Homo sapiens
aagcccuacucggau

SEQ ID NO: 1192490 - RNA, 19 nt, Homo sapiens
aagcccuccaaaagcacuu

SEQ ID NO: 1192491 - RNA, 20 nt, Homo sapiens
aagcccuccaaaagcacuua

SEQ ID NO: 1192492 - RNA, 21 nt, Homo sapiens
aagcccugaaccccaagcgcu

SEQ ID NO: 1192493 - RNA, 20 nt, Homo sapiens
aagccucgggccacaugggu

SEQ ID NO: 1192494 - RNA, 13 nt, Homo sapiens
aagccugaggcug

SEQ ID NO: 1192495 - RNA, 21 nt, Homo sapiens
aagccugcccuugucugagau

SEQ ID NO: 1192496 - RNA, 16 nt, Homo sapiens
aagccugggugacauu

SEQ ID NO: 1192497 - RNA, 12 nt, Homo sapiens
aagccugucauu

SEQ ID NO: 1192498 - RNA, 18 nt, Homo sapiens
aagccugucugagacuca

SEQ ID NO: 1192499 - RNA, 12 nt, Homo sapiens
aagccugugaaa

SEQ ID NO: 1192500 - RNA, 14 nt, Homo sapiens
aagccugugaaagg

SEQ ID NO: 1192501 - RNA, 17 nt, Homo sapiens
aagccuuaauuugcaca

SEQ ID NO: 1192502 - RNA, 13 nt, Homo sapiens
aagccuucagcuc

SEQ ID NO: 1192503 - RNA, 12 nt, Homo sapiens
aagccuugcacu

SEQ ID NO: 1192504 - RNA, 15 nt, Homo sapiens
aagcgagagcagcug

SEQ ID NO: 1192505 - RNA, 20 nt, Homo sapiens
aagcgagaucccaucucuac

SEQ ID NO: 1192506 - RNA, 18 nt, Homo sapiens
aagcgagcagucagcauu

SEQ ID NO: 1192507 - RNA, 17 nt, Homo sapiens
aagcgauucuccugccu

SEQ ID NO: 1192508 - RNA, 19 nt, Homo sapiens
aagcggaaaguuagugcuu

SEQ ID NO: 1192509 - RNA, 15 nt, Homo sapiens
aagcguaauuuugcc

SEQ ID NO: 1192510 - RNA, 18 nt, Homo sapiens
aagcgugagccacugcac

SEQ ID NO: 1192511 - RNA, 18 nt, Homo sapiens
aagcguuggauguagcau

SEQ ID NO: 1192512 - RNA, 21 nt, Homo sapiens
aagcguuucuuuacuucucac

SEQ ID NO: 1192513 - RNA, 15 nt, Homo sapiens
aagcuaaaaugauuu

SEQ ID NO: 1192514 - RNA, 18 nt, Homo sapiens
aagcuaaaaugauuuuau

SEQ ID NO: 1192515 - RNA, 20 nt, Homo sapiens
aagcuaaaauuagaugaacu

SEQ ID NO: 1192516 - RNA, 22 nt, Homo sapiens
aagcuaaaauuagaugaacuca

SEQ ID NO: 1192517 - RNA, 22 nt, Homo sapiens
aagcuaaauccuuuacuguuag

SEQ ID NO: 1192518 - RNA, 16 nt, Homo sapiens
aagcuacuauguacug

SEQ ID NO: 1192519 - RNA, 22 nt, Homo sapiens
aagcuacuauguacugccuuag

SEQ ID NO: 1192520 - RNA, 14 nt, Homo sapiens
aagcuaucagcaau

SEQ ID NO: 1192521 - RNA, 22 nt, Homo sapiens
aagcuaucagcaauacucauca

SEQ ID NO: 1192522 - RNA, 17 nt, Homo sapiens
aagcuauucucaugccu

SEQ ID NO: 1192523 - RNA, 21 nt, Homo sapiens
agucuccucacucugucccug

SEQ ID NO: 1192524 - RNA, 17 nt, Homo sapiens
agucuccuuugcacuga

SEQ ID NO: 1192525 - RNA, 13 nt, Homo sapiens
agucucucaccac

SEQ ID NO: 1192526 - RNA, 19 nt, Homo sapiens
agucucuuguacagcguuu

SEQ ID NO: 1192527 - RNA, 13 nt, Homo sapiens
agucugaagcugg

SEQ ID NO: 1192528 - RNA, 18 nt, Homo sapiens
agucugaggccugaguga

SEQ ID NO: 1192529 - RNA, 16 nt, Homo sapiens
agucugcaacuuuaag

SEQ ID NO: 1192530 - RNA, 19 nt, Homo sapiens
agucugcaugugcacggug

SEQ ID NO: 1192531 - RNA, 15 nt, Homo sapiens
agucuggaaagugau

SEQ ID NO: 1192532 - RNA, 19 nt, Homo sapiens
agucuggaaagugauguca

SEQ ID NO: 1192533 - RNA, 13 nt, Homo sapiens
agucuggcucugu

SEQ ID NO: 1192534 - RNA, 21 nt, Homo sapiens
agucugggauguagaacuuca

SEQ ID NO: 1192535 - RNA, 15 nt, Homo sapiens
agucuguuucaggag

SEQ ID NO: 1192536 - RNA, 13 nt, Homo sapiens
agucuuccaugac

SEQ ID NO: 1192537 - RNA, 13 nt, Homo sapiens
agucuucccugau

SEQ ID NO: 1192538 - RNA, 22 nt, Homo sapiens
agucuuggaaaaaaaccacagc

SEQ ID NO: 1192539 - RNA, 23 nt, Homo sapiens
agucuuguuguuuucccaaagag

SEQ ID NO: 1192540 - RNA, 17 nt, Homo sapiens
agucuuguuuuuuauuc

SEQ ID NO: 1192541 - RNA, 19 nt, Homo sapiens
agucuuguuuuuuauucag

SEQ ID NO: 1192542 - RNA, 21 nt, Homo sapiens
agucuuguuuuuuauucagau

SEQ ID NO: 1192543 - RNA, 22 nt, Homo sapiens
agucuuuuguucgcauggucac

SEQ ID NO: 1192544 - RNA, 20 nt, Homo sapiens
agugaaaauuuuuacauuca

SEQ ID NO: 1192545 - RNA, 16 nt, Homo sapiens
agugaaacauugaacu

SEQ ID NO: 1192546 - RNA, 14 nt, Homo sapiens
agugaacuaugaag

SEQ ID NO: 1192547 - RNA, 20 nt, Homo sapiens
agugaagaacacuacugcua

SEQ ID NO: 1192548 - RNA, 16 nt, Homo sapiens
agugaagaugccagug

SEQ ID NO: 1192549 - RNA, 16 nt, Homo sapiens
agugaaggucaccugg

SEQ ID NO: 1192550 - RNA, 13 nt, Homo sapiens
agugaaucuguau

SEQ ID NO: 1192551 - RNA, 16 nt, Homo sapiens
agugaaugaacaaaug

SEQ ID NO: 1192552 - RNA, 15 nt, Homo sapiens
agugaaugugucugg

SEQ ID NO: 1192553 - RNA, 21 nt, Homo sapiens
agugaauuacagacaaccuau

SEQ ID NO: 1192554 - RNA, 13 nt, Homo sapiens
agugacacacaga

SEQ ID NO: 1192555 - RNA, 11 nt, Homo sapiens
agugacagagg

SEQ ID NO: 1192556 - RNA, 18 nt, Homo sapiens
agugacagcagucaggga

SEQ ID NO: 1192557 - RNA, 23 nt, Homo sapiens
agugaccccugaccucacuguga

SEQ ID NO: 1192558 - RNA, 16 nt, Homo sapiens
agugaccccuucccug

SEQ ID NO: 1192559 - RNA, 21 nt, Homo sapiens
agugaccgaaagguuauguua

SEQ ID NO: 1192560 - RNA, 16 nt, Homo sapiens
agugacuaguacaaau

SEQ ID NO: 1192561 - RNA, 22 nt, Homo sapiens
agugacuaugaacuucucucag

SEQ ID NO: 1192562 - RNA, 13 nt, Homo sapiens
agugacugacccc

SEQ ID NO: 1192563 - RNA, 17 nt, Homo sapiens
agugacuucacagagac

SEQ ID NO: 1192564 - RNA, 17 nt, Homo sapiens
agugagaaaaagcuccu

SEQ ID NO: 1192565 - RNA, 21 nt, Homo sapiens
agugagauauuugguaccaug

SEQ ID NO: 1192566 - RNA, 22 nt, Homo sapiens
agugagauauuugguaccaugg

SEQ ID NO: 1192567 - RNA, 22 nt, Homo sapiens
agugaggagcccauacucagcc

SEQ ID NO: 1192568 - RNA, 19 nt, Homo sapiens
agugagucgaggacaggga

SEQ ID NO: 1192569 - RNA, 21 nt, Homo sapiens
agugauaucccccagccucaa

SEQ ID NO: 1192570 - RNA, 22 nt, Homo sapiens
agugauaucccccagccucaag

SEQ ID NO: 1192571 - RNA, 16 nt, Homo sapiens
agugauaugcauuucc

SEQ ID NO: 1192572 - RNA, 19 nt, Homo sapiens
agugauccucccaccucag

SEQ ID NO: 1192573 - RNA, 16 nt, Homo sapiens
agugauucucuugacg

SEQ ID NO: 1192574 - RNA, 15 nt, Homo sapiens
agugauucucuugcc

SEQ ID NO: 1192575 - RNA, 17 nt, Homo sapiens
agugcaacagcacuggc

SEQ ID NO: 1192576 - RNA, 22 nt, Homo sapiens
agugcaacagcacuggcucucu

SEQ ID NO: 1192577 - RNA, 20 nt, Homo sapiens
agugcaaccucgcugagggc

SEQ ID NO: 1192578 - RNA, 12 nt, Homo sapiens
agugcacagcug

SEQ ID NO: 1192579 - RNA, 16 nt, Homo sapiens
agugcacagcugucca

SEQ ID NO: 1192580 - RNA, 20 nt, Homo sapiens
agugcacaggcgcaucccag

SEQ ID NO: 1192581 - RNA, 21 nt, Homo sapiens
agugcacauggcagcgguggg

SEQ ID NO: 1192582 - RNA, 12 nt, Homo sapiens
agugcaccacuu

SEQ ID NO: 1192583 - RNA, 19 nt, Homo sapiens
agugcacuuuaagaggugg

SEQ ID NO: 1192584 - RNA, 12 nt, Homo sapiens
agugcagccacu

SEQ ID NO: 1192585 - RNA, 23 nt, Homo sapiens
agugcaggcuuggggagcuuuaa

SEQ ID NO: 1192586 - RNA, 17 nt, Homo sapiens
aguguauuaucacuguc

SEQ ID NO: 1192587 - RNA, 21 nt, Homo sapiens
aguguauuuuauguguggccc

SEQ ID NO: 1192588 - RNA, 13 nt, Homo sapiens
agugucaacucuu

SEQ ID NO: 1192589 - RNA, 14 nt, Homo sapiens
agugucacaucucu

SEQ ID NO: 1192590 - RNA, 23 nt, Homo sapiens
agugucaggcgccgcacuuccuu

SEQ ID NO: 1192591 - RNA, 18 nt, Homo sapiens
aguguccucuugcucaaa

SEQ ID NO: 1192592 - RNA, 18 nt, Homo sapiens
agugucuccccguguccu

SEQ ID NO: 1192593 - RNA, 16 nt, Homo sapiens
agugucugugccaugg

SEQ ID NO: 1192594 - RNA, 19 nt, Homo sapiens
agugucugugccauggauu

SEQ ID NO: 1192595 - RNA, 17 nt, Homo sapiens
agugucuuagcauauuu

SEQ ID NO: 1192596 - RNA, 16 nt, Homo sapiens
agugugaacaaaagau

SEQ ID NO: 1192597 - RNA, 13 nt, Homo sapiens
agugugacagggc

SEQ ID NO: 1192598 - RNA, 17 nt, Homo sapiens
agugugacagggccagu

SEQ ID NO: 1192599 - RNA, 18 nt, Homo sapiens
agugugaccccacugcca

SEQ ID NO: 1192600 - RNA, 14 nt, Homo sapiens
agugugcaugauug

SEQ ID NO: 1192601 - RNA, 17 nt, Homo sapiens
agugugcuuaauccuga

SEQ ID NO: 1192602 - RNA, 19 nt, Homo sapiens
aguguggaaccacugacua

SEQ ID NO: 1192603 - RNA, 18 nt, Homo sapiens
aguguguacaagcauuca

SEQ ID NO: 1192604 - RNA, 18 nt, Homo sapiens
agugugugcuuacaguaa

SEQ ID NO: 1192605 - RNA, 20 nt, Homo sapiens
aguguuaagcguucagugau

SEQ ID NO: 1192606 - RNA, 17 nt, Homo sapiens
aguguuaucagucauaa

SEQ ID NO: 1192607 - RNA, 17 nt, Homo sapiens
aguguuauuugcacacu

SEQ ID NO: 1192608 - RNA, 20 nt, Homo sapiens
aguguuauuugcacacugca

SEQ ID NO: 1192609 - RNA, 23 nt, Homo sapiens
aguguuauuugcacacugcacug

SEQ ID NO: 1192610 - RNA, 13 nt, Homo sapiens
aguguucaagaaa

SEQ ID NO: 1192611 - RNA, 18 nt, Homo sapiens
aguguucacaacagugaa

SEQ ID NO: 1192612 - RNA, 12 nt, Homo sapiens
aguguugcccag

SEQ ID NO: 1192613 - RNA, 21 nt, Homo sapiens
aguguuucuaauaaacuugga

SEQ ID NO: 1192614 - RNA, 18 nt, Homo sapiens
aguguuucuuccacaaca

SEQ ID NO: 1192615 - RNA, 21 nt, Homo sapiens
aguguuuuggacuccaucucu

SEQ ID NO: 1192616 - RNA, 19 nt, Homo sapiens
aguuaaacauugaaguaau

SEQ ID NO: 1192617 - RNA, 20 nt, Homo sapiens
aguuaaagugaauaaccacu

SEQ ID NO: 1192618 - RNA, 12 nt, Homo sapiens
aguuaagacaug

SEQ ID NO: 1192619 - RNA, 12 nt, Homo sapiens
aguuaagcuuuu

SEQ ID NO: 1192620 - RNA, 19 nt, Homo sapiens
aguuaaggauuguuuuaaa

SEQ ID NO: 1192621 - RNA, 12 nt, Homo sapiens
aguuaaggguua

SEQ ID NO: 1192622 - RNA, 15 nt, Homo sapiens
aguuaauaacagcuc

SEQ ID NO: 1192623 - RNA, 16 nt, Homo sapiens
aguuaauaacagcucc

SEQ ID NO: 1192624 - RNA, 16 nt, Homo sapiens
aguuaaugagccauca

SEQ ID NO: 1192625 - RNA, 23 nt, Homo sapiens
aguuacaguucugugguuucaug

SEQ ID NO: 1192626 - RNA, 12 nt, Homo sapiens
aguuacauauua

SEQ ID NO: 1192627 - RNA, 23 nt, Homo sapiens
aguuacauuaaaauaaaccaaau

SEQ ID NO: 1192628 - RNA, 21 nt, Homo sapiens
aguuacucccuacacugaugc

SEQ ID NO: 1192629 - RNA, 22 nt, Homo sapiens
aguuacugaaggugauggaggu

SEQ ID NO: 1192630 - RNA, 19 nt, Homo sapiens
aguuacuguggucacuugu

SEQ ID NO: 1192631 - RNA, 12 nt, Homo sapiens
aguuacugugua

SEQ ID NO: 1192632 - RNA, 19 nt, Homo sapiens
aguuacuuuuuuacacuga

SEQ ID NO: 1192633 - RNA, 16 nt, Homo sapiens
aguuagguagcuuuag

SEQ ID NO: 1192634 - RNA, 22 nt, Homo sapiens
aguuaucuuagcuggauauaau

SEQ ID NO: 1192635 - RNA, 16 nt, Homo sapiens
aguuauggugaaccca

SEQ ID NO: 1192636 - RNA, 15 nt, Homo sapiens
aguuauuuaugcuau

SEQ ID NO: 1192637 - RNA, 22 nt, Homo sapiens
aguucaaauucuucugaacuca

SEQ ID NO: 1192638 - RNA, 14 nt, Homo sapiens
aguucaacuguaua

SEQ ID NO: 1192639 - RNA, 17 nt, Homo sapiens
aguucaagugucuguau

SEQ ID NO: 1192640 - RNA, 16 nt, Homo sapiens
aguucaauacagugaa

SEQ ID NO: 1192641 - RNA, 16 nt, Homo sapiens
aguucaccugcacuua

SEQ ID NO: 1192642 - RNA, 17 nt, Homo sapiens
aguucaccugcacuuaa

SEQ ID NO: 1192643 - RNA, 18 nt, Homo sapiens
aguucauaacagugccau

SEQ ID NO: 1192644 - RNA, 16 nt, Homo sapiens
aguucauaauguggug

SEQ ID NO: 1192645 - RNA, 18 nt, Homo sapiens
aguucauauguaccaugu

SEQ ID NO: 1192646 - RNA, 18 nt, Homo sapiens
aguuccaugggauacaac

SEQ ID NO: 1192647 - RNA, 15 nt, Homo sapiens
aucccauguauuuau

SEQ ID NO: 1192648 - RNA, 23 nt, Homo sapiens
auccccaacuaugcaugccaagg

SEQ ID NO: 1192649 - RNA, 22 nt, Homo sapiens
auccccaaguggugaaugacac

SEQ ID NO: 1192650 - RNA, 17 nt, Homo sapiens
auccccacccagucuca

SEQ ID NO: 1192651 - RNA, 21 nt, Homo sapiens
auccccaccccagcuguuacc

SEQ ID NO: 1192652 - RNA, 23 nt, Homo sapiens
auccccacuagguucuuuuccau

SEQ ID NO: 1192653 - RNA, 11 nt, Homo sapiens
auccccacugu

SEQ ID NO: 1192654 - RNA, 14 nt, Homo sapiens
auccccauccucca

SEQ ID NO: 1192655 - RNA, 20 nt, Homo sapiens
auccccggggcggcaggaag

SEQ ID NO: 1192656 - RNA, 12 nt, Homo sapiens
auccccugcuac

SEQ ID NO: 1192657 - RNA, 17 nt, Homo sapiens
auccccuuuacuaucau

SEQ ID NO: 1192658 - RNA, 22 nt, Homo sapiens
auccccuuuggcuaccugaugg

SEQ ID NO: 1192659 - RNA, 17 nt, Homo sapiens
auccccuuuguguagaa

SEQ ID NO: 1192660 - RNA, 22 nt, Homo sapiens
aucccgccucuucuucuucaga

SEQ ID NO: 1192661 - RNA, 22 nt, Homo sapiens
aucccguaccucuucccaugac

SEQ ID NO: 1192662 - RNA, 14 nt, Homo sapiens
aucccguguugcca

SEQ ID NO: 1192663 - RNA, 13 nt, Homo sapiens
aucccuacaugua

SEQ ID NO: 1192664 - RNA, 18 nt, Homo sapiens
aucccucgugguccccaa

SEQ ID NO: 1192665 - RNA, 24 nt, Homo sapiens
aucccucucacaagaaugugcaga

SEQ ID NO: 1192666 - RNA, 14 nt, Homo sapiens
aucccugcagcuca

SEQ ID NO: 1192667 - RNA, 16 nt, Homo sapiens
aucccugccuggucac

SEQ ID NO: 1192668 - RNA, 16 nt, Homo sapiens
aucccugccuguuaag

SEQ ID NO: 1192669 - RNA, 18 nt, Homo sapiens
aucccuucucacagcaca

SEQ ID NO: 1192670 - RNA, 15 nt, Homo sapiens
auccgccuaccucag

SEQ ID NO: 1192671 - RNA, 21 nt, Homo sapiens
auccgguccccugccuggaac

SEQ ID NO: 1192672 - RNA, 13 nt, Homo sapiens
auccuaagacaca

SEQ ID NO: 1192673 - RNA, 17 nt, Homo sapiens
auccuacauaauaccca

SEQ ID NO: 1192674 - RNA, 20 nt, Homo sapiens
auccuaccccuuugcacuug

SEQ ID NO: 1192675 - RNA, 15 nt, Homo sapiens
auccuagacuugaaa

SEQ ID NO: 1192676 - RNA, 15 nt, Homo sapiens
auccuagucauucuu

SEQ ID NO: 1192677 - RNA, 11 nt, Homo sapiens
auccuauuuau

SEQ ID NO: 1192678 - RNA, 17 nt, Homo sapiens
auccucacccagcaccc

SEQ ID NO: 1192679 - RNA, 22 nt, Homo sapiens
auccucaugaggcuucucagcc

SEQ ID NO: 1192680 - RNA, 18 nt, Homo sapiens
auccuccaagaauuugac

SEQ ID NO: 1192681 - RNA, 15 nt, Homo sapiens
auccuccaguaccuu

SEQ ID NO: 1192682 - RNA, 16 nt, Homo sapiens
auccucuacugugcau

SEQ ID NO: 1192683 - RNA, 22 nt, Homo sapiens
auccucugagugugaccaggca

SEQ ID NO: 1192684 - RNA, 23 nt, Homo sapiens
auccugagcagugccagcuuucu

SEQ ID NO: 1192685 - RNA, 22 nt, Homo sapiens
auccugccagccccacacagcu

SEQ ID NO: 1192686 - RNA, 16 nt, Homo sapiens
auccugcccaggccag

SEQ ID NO: 1192687 - RNA, 18 nt, Homo sapiens
auccuggagggguguugu

SEQ ID NO: 1192688 - RNA, 17 nt, Homo sapiens
auccuggggaaggugga

SEQ ID NO: 1192689 - RNA, 21 nt, Homo sapiens
auccuggguacugaaagccuu

SEQ ID NO: 1192690 - RNA, 20 nt, Homo sapiens
auccuguaccaaaucugaca

SEQ ID NO: 1192691 - RNA, 15 nt, Homo sapiens
auccuuccaaagaau

SEQ ID NO: 1192692 - RNA, 18 nt, Homo sapiens
auccuuccuaaacccaau

SEQ ID NO: 1192693 - RNA, 17 nt, Homo sapiens
auccuugucugaaugua

SEQ ID NO: 1192694 - RNA, 22 nt, Homo sapiens
auccuugucugaauguauuuau

SEQ ID NO: 1192695 - RNA, 14 nt, Homo sapiens
auccuuuacauuca

SEQ ID NO: 1192696 - RNA, 14 nt, Homo sapiens
auccuuuaccacuc

SEQ ID NO: 1192697 - RNA, 21 nt, Homo sapiens
auccuuuaccacucuaccaaa

SEQ ID NO: 1192698 - RNA, 14 nt, Homo sapiens
auccuuucaagaca

SEQ ID NO: 1192699 - RNA, 23 nt, Homo sapiens
auccuuugaguuauaguuugcuu

SEQ ID NO: 1192700 - RNA, 19 nt, Homo sapiens
aucgaaucuacuaauucca

SEQ ID NO: 1192701 - RNA, 13 nt, Homo sapiens
aucgagaccaucc

SEQ ID NO: 1192702 - RNA, 14 nt, Homo sapiens
aucgaucaugaugu

SEQ ID NO: 1192703 - RNA, 17 nt, Homo sapiens
aucgaugcagugcuucc

SEQ ID NO: 1192704 - RNA, 14 nt, Homo sapiens
aucgccaugcccau

SEQ ID NO: 1192705 - RNA, 16 nt, Homo sapiens
aucggaauucagccau

SEQ ID NO: 1192706 - RNA, 23 nt, Homo sapiens
aucggaucuggggcucugggaua

SEQ ID NO: 1192707 - RNA, 15 nt, Homo sapiens
aucggccuccaugac

SEQ ID NO: 1192708 - RNA, 16 nt, Homo sapiens
aucggccuccaugacc

SEQ ID NO: 1192709 - RNA, 22 nt, Homo sapiens
aucguccagcgaccuuccucau

SEQ ID NO: 1192710 - RNA, 16 nt, Homo sapiens
aucgucuaaacuuuag

SEQ ID NO: 1192711 - RNA, 18 nt, Homo sapiens
aucgugaaaccccaucuc

SEQ ID NO: 1192712 - RNA, 18 nt, Homo sapiens
aucgugccuugucauuuu

SEQ ID NO: 1192713 - RNA, 20 nt, Homo sapiens
aucguuccaguucccacuug

SEQ ID NO: 1192714 - RNA, 23 nt, Homo sapiens
aucuaaaagaauuuuaccauuca

SEQ ID NO: 1192715 - RNA, 13 nt, Homo sapiens
aucuaaaccauau

SEQ ID NO: 1192716 - RNA, 23 nt, Homo sapiens
aucuaacagcccugugcagcagc

SEQ ID NO: 1192717 - RNA, 16 nt, Homo sapiens
aucuaacuauauguac

SEQ ID NO: 1192718 - RNA, 21 nt, Homo sapiens
aucuaacuauauguacagcuc

SEQ ID NO: 1192719 - RNA, 17 nt, Homo sapiens
aucuaaggaugucacag

SEQ ID NO: 1192720 - RNA, 18 nt, Homo sapiens
aucuaaggaugucacagg

SEQ ID NO: 1192721 - RNA, 16 nt, Homo sapiens
aucuaaugugaaguag

SEQ ID NO: 1192722 - RNA, 17 nt, Homo sapiens
aucuacagcucaccucu

SEQ ID NO: 1192723 - RNA, 14 nt, Homo sapiens
aucuacuaauucca

SEQ ID NO: 1192724 - RNA, 23 nt, Homo sapiens
augacaccuccauuucucuccag

SEQ ID NO: 1192725 - RNA, 12 nt, Homo sapiens
augacagucaca

SEQ ID NO: 1192726 - RNA, 11 nt, Homo sapiens
augacagugaa

SEQ ID NO: 1192727 - RNA, 22 nt, Homo sapiens
augacagugaauauugcuuuua

SEQ ID NO: 1192728 - RNA, 13 nt, Homo sapiens
augacagugcuaa

SEQ ID NO: 1192729 - RNA, 15 nt, Homo sapiens
augacauaagugcua

SEQ ID NO: 1192730 - RNA, 18 nt, Homo sapiens
augacauaugacuugauc

SEQ ID NO: 1192731 - RNA, 13 nt, Homo sapiens
augacaugcacug

SEQ ID NO: 1192732 - RNA, 12 nt, Homo sapiens
augacauguuau

SEQ ID NO: 1192733 - RNA, 19 nt, Homo sapiens
augacauucccugcuaaua

SEQ ID NO: 1192734 - RNA, 17 nt, Homo sapiens
augacccacccaguguc

SEQ ID NO: 1192735 - RNA, 19 nt, Homo sapiens
augacccaccccugugcuc

SEQ ID NO: 1192736 - RNA, 14 nt, Homo sapiens
augacccacugucc

SEQ ID NO: 1192737 - RNA, 17 nt, Homo sapiens
augacccuuugccuguu

SEQ ID NO: 1192738 - RNA, 22 nt, Homo sapiens
augaccuuggacaaucaugaaa

SEQ ID NO: 1192739 - RNA, 15 nt, Homo sapiens
augaccuuugucuca

SEQ ID NO: 1192740 - RNA, 23 nt, Homo sapiens
augacuaaagagagaauguagau

SEQ ID NO: 1192741 - RNA, 21 nt, Homo sapiens
augacuaguaaacauguggga

SEQ ID NO: 1192742 - RNA, 20 nt, Homo sapiens
augacuauguuucuauucua

SEQ ID NO: 1192743 - RNA, 23 nt, Homo sapiens
augacuccaccuucucaccugcu

SEQ ID NO: 1192744 - RNA, 15 nt, Homo sapiens
augacugauuacuca

SEQ ID NO: 1192745 - RNA, 14 nt, Homo sapiens
augacuguaucuug

SEQ ID NO: 1192746 - RNA, 12 nt, Homo sapiens
augacugugcua

SEQ ID NO: 1192747 - RNA, 15 nt, Homo sapiens
augacugugcuacug

SEQ ID NO: 1192748 - RNA, 18 nt, Homo sapiens
augacuguuacagcuuuc

SEQ ID NO: 1192749 - RNA, 18 nt, Homo sapiens
augacuucccugcuccaa

SEQ ID NO: 1192750 - RNA, 16 nt, Homo sapiens
augacuuugagauuau

SEQ ID NO: 1192751 - RNA, 18 nt, Homo sapiens
augagaacaaagcuguua

SEQ ID NO: 1192752 - RNA, 13 nt, Homo sapiens
augagaagcagaa

SEQ ID NO: 1192753 - RNA, 15 nt, Homo sapiens
augagaaguacuugg

SEQ ID NO: 1192754 - RNA, 14 nt, Homo sapiens
augagaaucaugca

SEQ ID NO: 1192755 - RNA, 15 nt, Homo sapiens
augagauaacucaag

SEQ ID NO: 1192756 - RNA, 16 nt, Homo sapiens
augagauaauacucuu

SEQ ID NO: 1192757 - RNA, 22 nt, Homo sapiens
augagcaaauggugcugaauac

SEQ ID NO: 1192758 - RNA, 14 nt, Homo sapiens
augagccaaagaac

SEQ ID NO: 1192759 - RNA, 17 nt, Homo sapiens
augagccaucacuagaa

SEQ ID NO: 1192760 - RNA, 19 nt, Homo sapiens
augagccaucacuagaaga

SEQ ID NO: 1192761 - RNA, 16 nt, Homo sapiens
augagccgcugugagc

SEQ ID NO: 1192762 - RNA, 18 nt, Homo sapiens
augagccgugaacugugc

SEQ ID NO: 1192763 - RNA, 21 nt, Homo sapiens
augagccucagcauccuggca

SEQ ID NO: 1192764 - RNA, 18 nt, Homo sapiens
augagcugacaucucagu

SEQ ID NO: 1192765 - RNA, 19 nt, Homo sapiens
augaggaggucccacuugc

SEQ ID NO: 1192766 - RNA, 17 nt, Homo sapiens
augagggugacugucaa

SEQ ID NO: 1192767 - RNA, 14 nt, Homo sapiens
augaggguggcaug

SEQ ID NO: 1192768 - RNA, 15 nt, Homo sapiens
augagguacucuccu

SEQ ID NO: 1192769 - RNA, 20 nt, Homo sapiens
augagguacucuccuggaaa

SEQ ID NO: 1192770 - RNA, 16 nt, Homo sapiens
augaguaacaggaaaa

SEQ ID NO: 1192771 - RNA, 21 nt, Homo sapiens
augaguaauacaucaaagagu

SEQ ID NO: 1192772 - RNA, 16 nt, Homo sapiens
augaguaguguggaau

SEQ ID NO: 1192773 - RNA, 13 nt, Homo sapiens
augagucagucaa

SEQ ID NO: 1192774 - RNA, 13 nt, Homo sapiens
augagucccauuu

SEQ ID NO: 1192775 - RNA, 14 nt, Homo sapiens
augaguccuugaaa

SEQ ID NO: 1192776 - RNA, 22 nt, Homo sapiens
augagucggauacccuggagca

SEQ ID NO: 1192777 - RNA, 11 nt, Homo sapiens
augaguuaaau

SEQ ID NO: 1192778 - RNA, 13 nt, Homo sapiens
augaguugguucu

SEQ ID NO: 1192779 - RNA, 22 nt, Homo sapiens
augaguuuuugauagcuuuauu

SEQ ID NO: 1192780 - RNA, 19 nt, Homo sapiens
augauaaaccugccaagag

SEQ ID NO: 1192781 - RNA, 16 nt, Homo sapiens
augauagaugacaaau

SEQ ID NO: 1192782 - RNA, 18 nt, Homo sapiens
augaucagaagacuuuaa

SEQ ID NO: 1192783 - RNA, 18 nt, Homo sapiens
augaucagcaucugugau

SEQ ID NO: 1192784 - RNA, 19 nt, Homo sapiens
augaucagcaucugugaug

SEQ ID NO: 1192785 - RNA, 22 nt, Homo sapiens
augaucaguguuguugcucuag

SEQ ID NO: 1192786 - RNA, 14 nt, Homo sapiens
augaucauuugccc

SEQ ID NO: 1192787 - RNA, 17 nt, Homo sapiens
augauccucccuaucaa

SEQ ID NO: 1192788 - RNA, 23 nt, Homo sapiens
augauccuuuuuugucauuuuau

SEQ ID NO: 1192789 - RNA, 19 nt, Homo sapiens
augaucgagccacugcacu

SEQ ID NO: 1192790 - RNA, 21 nt, Homo sapiens
augaucuguuuuucaccacuu

SEQ ID NO: 1192791 - RNA, 21 nt, Homo sapiens
augaugaaaacuaaggauuuu

SEQ ID NO: 1192792 - RNA, 16 nt, Homo sapiens
augaugauaaugauga

SEQ ID NO: 1192793 - RNA, 13 nt, Homo sapiens
augaugcacuuau

SEQ ID NO: 1192794 - RNA, 14 nt, Homo sapiens
augauggaugccaa

SEQ ID NO: 1192795 - RNA, 20 nt, Homo sapiens
augauggcagccauagugca

SEQ ID NO: 1192796 - RNA, 23 nt, Homo sapiens
augauguagagugugguuaugaa

SEQ ID NO: 1192797 - RNA, 17 nt, Homo sapiens
augaugugcaaccagca

SEQ ID NO: 1192798 - RNA, 23 nt, Homo sapiens
augauguggguguccugcagaag

SEQ ID NO: 1192799 - RNA, 19 nt, Homo sapiens
augauuuagugaucaaauu

SEQ ID NO: 1192800 - RNA, 16 nt, Homo sapiens
augauuucaaaaucag

SEQ ID NO: 1192801 - RNA, 17 nt, Homo sapiens
augauuucagaauuuag

SEQ ID NO: 1192802 - RNA, 17 nt, Homo sapiens
augauuucagcagggau

SEQ ID NO: 1192803 - RNA, 16 nt, Homo sapiens
augauuuguaacauuc

SEQ ID NO: 1192804 - RNA, 21 nt, Homo sapiens
augauuuuguaaaaguggcau

SEQ ID NO: 1192805 - RNA, 9 nt, Homo sapiens
augcaaaac

SEQ ID NO: 1192806 - RNA, 16 nt, Homo sapiens
augcaaacaaaaucca

SEQ ID NO: 1192807 - RNA, 17 nt, Homo sapiens
augcaaacaaaauccaa

SEQ ID NO: 1192808 - RNA, 15 nt, Homo sapiens
auggccuggaaccca

SEQ ID NO: 1192809 - RNA, 18 nt, Homo sapiens
auggccuugcuaccuggg

SEQ ID NO: 1192810 - RNA, 17 nt, Homo sapiens
auggcucaaucuauccu

SEQ ID NO: 1192811 - RNA, 22 nt, Homo sapiens
auggcuggaagggguccagccu

SEQ ID NO: 1192812 - RNA, 18 nt, Homo sapiens
auggcuggccacugcaca

SEQ ID NO: 1192813 - RNA, 17 nt, Homo sapiens
auggcugugccucugcc

SEQ ID NO: 1192814 - RNA, 16 nt, Homo sapiens
auggcuguguuugcag

SEQ ID NO: 1192815 - RNA, 22 nt, Homo sapiens
auggcuuaauguuuauuccuga

SEQ ID NO: 1192816 - RNA, 15 nt, Homo sapiens
auggcuuugugauuc

SEQ ID NO: 1192817 - RNA, 19 nt, Homo sapiens
auggcuuugugauucaauc

SEQ ID NO: 1192818 - RNA, 18 nt, Homo sapiens
auggcuuuuuuugccuac

SEQ ID NO: 1192819 - RNA, 16 nt, Homo sapiens
augggacucaaugcac

SEQ ID NO: 1192820 - RNA, 23 nt, Homo sapiens
augggagggggcuugaagccaaa

SEQ ID NO: 1192821 - RNA, 18 nt, Homo sapiens
augggaucccaggccagg

SEQ ID NO: 1192822 - RNA, 17 nt, Homo sapiens
augggauucagugcuuc

SEQ ID NO: 1192823 - RNA, 16 nt, Homo sapiens
augggcacagcacagc

SEQ ID NO: 1192824 - RNA, 19 nt, Homo sapiens
augggccuuuaagaaccuu

SEQ ID NO: 1192825 - RNA, 18 nt, Homo sapiens
augggcuucacuguauaa

SEQ ID NO: 1192826 - RNA, 15 nt, Homo sapiens
auggggauagaggaa

SEQ ID NO: 1192827 - RNA, 14 nt, Homo sapiens
auggggcacccugg

SEQ ID NO: 1192828 - RNA, 15 nt, Homo sapiens
augggggcaagaaga

SEQ ID NO: 1192829 - RNA, 19 nt, Homo sapiens
auggggguacucaauggag

SEQ ID NO: 1192830 - RNA, 18 nt, Homo sapiens
auggguccauuuugcccu

SEQ ID NO: 1192831 - RNA, 14 nt, Homo sapiens
augggucuaggaca

SEQ ID NO: 1192832 - RNA, 16 nt, Homo sapiens
augggugggggcuccu

SEQ ID NO: 1192833 - RNA, 18 nt, Homo sapiens
auggguuauuuaugcuug

SEQ ID NO: 1192834 - RNA, 15 nt, Homo sapiens
auggguugcauuugg

SEQ ID NO: 1192835 - RNA, 18 nt, Homo sapiens
augguaaaaccccaucuc

SEQ ID NO: 1192836 - RNA, 15 nt, Homo sapiens
augguaagacuguaa

SEQ ID NO: 1192837 - RNA, 20 nt, Homo sapiens
augguaggauaucuuggcuu

SEQ ID NO: 1192838 - RNA, 11 nt, Homo sapiens
augguagucac

SEQ ID NO: 1192839 - RNA, 20 nt, Homo sapiens
augguccuggggcucugugc

SEQ ID NO: 1192840 - RNA, 21 nt, Homo sapiens
augguccuggggcucugugca

SEQ ID NO: 1192841 - RNA, 20 nt, Homo sapiens
auggucugcauuagucucau

SEQ ID NO: 1192842 - RNA, 12 nt, Homo sapiens
auggugagcucu

SEQ ID NO: 1192843 - RNA, 17 nt, Homo sapiens
auggugagcucugggaa

SEQ ID NO: 1192844 - RNA, 23 nt, Homo sapiens
auggugcaccgagugauuuccau

SEQ ID NO: 1192845 - RNA, 14 nt, Homo sapiens
augguggguacaaa

SEQ ID NO: 1192846 - RNA, 18 nt, Homo sapiens
augguggguacaaaaagu

SEQ ID NO: 1192847 - RNA, 18 nt, Homo sapiens
augguguaauaagacaua

SEQ ID NO: 1192848 - RNA, 23 nt, Homo sapiens
caaggcucugcuauacagucuau

SEQ ID NO: 1192849 - RNA, 19 nt, Homo sapiens
caaggcugcagugagccau

SEQ ID NO: 1192850 - RNA, 21 nt, Homo sapiens
caaggcuggccagcaaggcag

SEQ ID NO: 1192851 - RNA, 14 nt, Homo sapiens
caagggaaucugua

SEQ ID NO: 1192852 - RNA, 19 nt, Homo sapiens
caagggggacugucuuuca

SEQ ID NO: 1192853 - RNA, 20 nt, Homo sapiens
caaggguucuuggugaugcu

SEQ ID NO: 1192854 - RNA, 21 nt, Homo sapiens
caaggguucuuggugaugcug

SEQ ID NO: 1192855 - RNA, 15 nt, Homo sapiens
caaggucauuucuuc

SEQ ID NO: 1192856 - RNA, 13 nt, Homo sapiens
caagguccacucc

SEQ ID NO: 1192857 - RNA, 15 nt, Homo sapiens
caagguccacucccu

SEQ ID NO: 1192858 - RNA, 19 nt, Homo sapiens
caaggugggccuugcuacc

SEQ ID NO: 1192859 - RNA, 23 nt, Homo sapiens
caagguucugguuccauuuuucc

SEQ ID NO: 1192860 - RNA, 18 nt, Homo sapiens
caaguaaaacaaaaccac

SEQ ID NO: 1192861 - RNA, 14 nt, Homo sapiens
caaguaagggcaca

SEQ ID NO: 1192862 - RNA, 19 nt, Homo sapiens
caaguaauacguuuugaca

SEQ ID NO: 1192863 - RNA, 21 nt, Homo sapiens
caaguacaccagccaccucca

SEQ ID NO: 1192864 - RNA, 19 nt, Homo sapiens
caaguagcugggauuacag

SEQ ID NO: 1192865 - RNA, 13 nt, Homo sapiens
caaguagcuuucc

SEQ ID NO: 1192866 - RNA, 21 nt, Homo sapiens
caaguauacuagggagccauu

SEQ ID NO: 1192867 - RNA, 14 nt, Homo sapiens
caaguauaugugaa

SEQ ID NO: 1192868 - RNA, 18 nt, Homo sapiens
cacaaaauacagcacuuu

SEQ ID NO: 1192869 - RNA, 20 nt, Homo sapiens
cacaaaauacagcacuuuga

SEQ ID NO: 1192870 - RNA, 16 nt, Homo sapiens
cacaaaaucuguccaa

SEQ ID NO: 1192871 - RNA, 12 nt, Homo sapiens
cacaaacaauau

SEQ ID NO: 1192872 - RNA, 13 nt, Homo sapiens
cacaaacauauaa

SEQ ID NO: 1192873 - RNA, 13 nt, Homo sapiens
cacaaacccaagg

SEQ ID NO: 1192874 - RNA, 13 nt, Homo sapiens
cacaaacuccauc

SEQ ID NO: 1192875 - RNA, 12 nt, Homo sapiens
cacaaagccuua

SEQ ID NO: 1192876 - RNA, 19 nt, Homo sapiens
cacaaaguagaggaaucca

SEQ ID NO: 1192877 - RNA, 13 nt, Homo sapiens
cacaaaguguaua

SEQ ID NO: 1192878 - RNA, 23 nt, Homo sapiens
cacaaauugaaaacacacucaaa

SEQ ID NO: 1192879 - RNA, 18 nt, Homo sapiens
cacaaauuuguaaacuuu

SEQ ID NO: 1192880 - RNA, 17 nt, Homo sapiens
cacaacauuuacuuaac

SEQ ID NO: 1192881 - RNA, 12 nt, Homo sapiens
cacaaccaaaaa

SEQ ID NO: 1192882 - RNA, 14 nt, Homo sapiens
cacaacccaaaagg

SEQ ID NO: 1192883 - RNA, 14 nt, Homo sapiens
cacaacccaagaau

SEQ ID NO: 1192884 - RNA, 14 nt, Homo sapiens
cacaagaauugaau

SEQ ID NO: 1192885 - RNA, 14 nt, Homo sapiens
cacaagagugaauu

SEQ ID NO: 1192886 - RNA, 15 nt, Homo sapiens
cacaagcaacaaacc

SEQ ID NO: 1192887 - RNA, 20 nt, Homo sapiens
cacaagcagagugcacagcu

SEQ ID NO: 1192888 - RNA, 23 nt, Homo sapiens
cacaagccuccuguaccucagug

SEQ ID NO: 1192889 - RNA, 14 nt, Homo sapiens
cacaaggggcucca

SEQ ID NO: 1192890 - RNA, 15 nt, Homo sapiens
cacaaggggcuccac

SEQ ID NO: 1192891 - RNA, 15 nt, Homo sapiens
cacaaguccugugaa

SEQ ID NO: 1192892 - RNA, 16 nt, Homo sapiens
cacaaguggaccuuag

SEQ ID NO: 1192893 - RNA, 22 nt, Homo sapiens
cacaauaggucuuucucucagu

SEQ ID NO: 1192894 - RNA, 15 nt, Homo sapiens
cacaauauuaccuua

SEQ ID NO: 1192895 - RNA, 14 nt, Homo sapiens
cacaaugcugaaua

SEQ ID NO: 1192896 - RNA, 21 nt, Homo sapiens
cacaaugucaugucugugauu

SEQ ID NO: 1192897 - RNA, 15 nt, Homo sapiens
cacaauuauuccaaa

SEQ ID NO: 1192898 - RNA, 14 nt, Homo sapiens
cacacacacaugca

SEQ ID NO: 1192899 - RNA, 13 nt, Homo sapiens
cacacacauacac

SEQ ID NO: 1192900 - RNA, 13 nt, Homo sapiens
cacacacccagcu

SEQ ID NO: 1192901 - RNA, 17 nt, Homo sapiens
cacacacgaugcauuua

SEQ ID NO: 1192902 - RNA, 21 nt, Homo sapiens
cacacacgcuuucuuaugcaa

SEQ ID NO: 1192903 - RNA, 13 nt, Homo sapiens
cacacacuggccu

SEQ ID NO: 1192904 - RNA, 12 nt, Homo sapiens
cacacacuggcu

SEQ ID NO: 1192905 - RNA, 22 nt, Homo sapiens
cacacacuguucugaaagugac

SEQ ID NO: 1192906 - RNA, 19 nt, Homo sapiens
cacacagacuuucugugac

SEQ ID NO: 1192907 - RNA, 15 nt, Homo sapiens
cacacaggucucauu

SEQ ID NO: 1192908 - RNA, 15 nt, Homo sapiens
cacacaguauaugau

SEQ ID NO: 1192909 - RNA, 18 nt, Homo sapiens
cacacagucacauucgaa

SEQ ID NO: 1192910 - RNA, 11 nt, Homo sapiens
cacacagugaa

SEQ ID NO: 1192911 - RNA, 11 nt, Homo sapiens
cacacaguguu

SEQ ID NO: 1192912 - RNA, 14 nt, Homo sapiens
cacacauauugcac

SEQ ID NO: 1192913 - RNA, 15 nt, Homo sapiens
cacacaucuaugaua

SEQ ID NO: 1192914 - RNA, 14 nt, Homo sapiens
cacacaucucauuu

SEQ ID NO: 1192915 - RNA, 18 nt, Homo sapiens
cacaccaaguaccaguau

SEQ ID NO: 1192916 - RNA, 19 nt, Homo sapiens
cacaccacaaccaccuuca

SEQ ID NO: 1192917 - RNA, 13 nt, Homo sapiens
cacaccacccucc

SEQ ID NO: 1192918 - RNA, 13 nt, Homo sapiens
cacaccagucaca

SEQ ID NO: 1192919 - RNA, 12 nt, Homo sapiens
cacaccaucucc

SEQ ID NO: 1192920 - RNA, 19 nt, Homo sapiens
cacacccacagaaggacac

SEQ ID NO: 1192921 - RNA, 22 nt, Homo sapiens
cacacccagcccacuucugcca

SEQ ID NO: 1192922 - RNA, 20 nt, Homo sapiens
cacacccuggaggauuucau

SEQ ID NO: 1192923 - RNA, 19 nt, Homo sapiens
cacaccuacaccucuugaa

SEQ ID NO: 1192924 - RNA, 21 nt, Homo sapiens
cacaccucccacccccuguau

SEQ ID NO: 1192925 - RNA, 17 nt, Homo sapiens
cacaccugccgucuuca

SEQ ID NO: 1192926 - RNA, 14 nt, Homo sapiens
cacacgcgugcaca

SEQ ID NO: 1192927 - RNA, 14 nt, Homo sapiens
cacacucaaaagac

SEQ ID NO: 1192928 - RNA, 22 nt, Homo sapiens
cacacucaaaagacaaacaugc

SEQ ID NO: 1192929 - RNA, 19 nt, Homo sapiens
cacacucuccaaacaguca

SEQ ID NO: 1192930 - RNA, 13 nt, Homo sapiens
cacacucuucagu

SEQ ID NO: 1192931 - RNA, 17 nt, Homo sapiens
cacacugaaaccaaaac

SEQ ID NO: 1192932 - RNA, 16 nt, Homo sapiens
cacacugaagccacag

SEQ ID NO: 1192933 - RNA, 15 nt, Homo sapiens
cacacugccaaauaa

SEQ ID NO: 1192934 - RNA, 14 nt, Homo sapiens
cacacugcuagcaa

SEQ ID NO: 1192935 - RNA, 11 nt, Homo sapiens
cacacuggccu

SEQ ID NO: 1192936 - RNA, 16 nt, Homo sapiens
cacacuguaaauauga

SEQ ID NO: 1192937 - RNA, 23 nt, Homo sapiens
cacacuguauauaaacauaucaa

SEQ ID NO: 1192938 - RNA, 13 nt, Homo sapiens
cacacuguuaaaa

SEQ ID NO: 1192939 - RNA, 19 nt, Homo sapiens
cacacuguugucaaaaagu

SEQ ID NO: 1192940 - RNA, 18 nt, Homo sapiens
cacacuuaucaauggcac

SEQ ID NO: 1192941 - RNA, 21 nt, Homo sapiens
cacacuugaauuugggcagcu

SEQ ID NO: 1192942 - RNA, 21 nt, Homo sapiens
cacacuuuggucauuucucaa

SEQ ID NO: 1192943 - RNA, 18 nt, Homo sapiens
cacacuuuuccacauucc

SEQ ID NO: 1192944 - RNA, 19 nt, Homo sapiens
cacacuuuuccacauucca

SEQ ID NO: 1192945 - RNA, 16 nt, Homo sapiens
cacagaaauuuucaau

SEQ ID NO: 1192946 - RNA, 14 nt, Homo sapiens
cacagaagcucauc

SEQ ID NO: 1192947 - RNA, 12 nt, Homo sapiens
cacagaaguagc

SEQ ID NO: 1192948 - RNA, 22 nt, Homo sapiens
cacagaauuguuccaguacuau

SEQ ID NO: 1192949 - RNA, 20 nt, Homo sapiens
cacagaauuuguauguauuu

SEQ ID NO: 1192950 - RNA, 22 nt, Homo sapiens
cacagacacacacacgcacgca

SEQ ID NO: 1192951 - RNA, 14 nt, Homo sapiens
cacagacacuuaca

SEQ ID NO: 1192952 - RNA, 16 nt, Homo sapiens
cacagacugcgauuug

SEQ ID NO: 1192953 - RNA, 20 nt, Homo sapiens
cacagacuggcaauaaacuc

SEQ ID NO: 1192954 - RNA, 22 nt, Homo sapiens
cacagacuggcaauaaacuccu

SEQ ID NO: 1192955 - RNA, 20 nt, Homo sapiens
cacagagagucccacugccu

SEQ ID NO: 1192956 - RNA, 20 nt, Homo sapiens
cacagagcaggacugcacag

SEQ ID NO: 1192957 - RNA, 18 nt, Homo sapiens
cacagagcugaguccucu

SEQ ID NO: 1192958 - RNA, 16 nt, Homo sapiens
cacagaguagaaacuc

SEQ ID NO: 1192959 - RNA, 22 nt, Homo sapiens
cacagaugauuaaacagacuuu

SEQ ID NO: 1192960 - RNA, 22 nt, Homo sapiens
cacagauguuugaggcuuucag

SEQ ID NO: 1192961 - RNA, 17 nt, Homo sapiens
cacagcaacaaugacuu

SEQ ID NO: 1192962 - RNA, 14 nt, Homo sapiens
cacagcagcaauug

SEQ ID NO: 1192963 - RNA, 20 nt, Homo sapiens
cacagcaggcuuucaagaag

SEQ ID NO: 1192964 - RNA, 22 nt, Homo sapiens
cacagcagguccuccaucccaa

SEQ ID NO: 1192965 - RNA, 17 nt, Homo sapiens
cacagcaucgggagcac

SEQ ID NO: 1192966 - RNA, 17 nt, Homo sapiens
cacagccacuaagauaa

SEQ ID NO: 1192967 - RNA, 22 nt, Homo sapiens
cacagcccgugugacugcuaga

SEQ ID NO: 1192968 - RNA, 23 nt, Homo sapiens
cacagccgcagccucccucugac

SEQ ID NO: 1192969 - RNA, 15 nt, Homo sapiens
cacagccuccagggc

SEQ ID NO: 1192970 - RNA, 16 nt, Homo sapiens
cacagcgaacccaaug

SEQ ID NO: 1192971 - RNA, 21 nt, Homo sapiens
cacagcgcuggccccagcaug

SEQ ID NO: 1192972 - RNA, 19 nt, Homo sapiens
cacagcguccuguccacac

SEQ ID NO: 1192973 - RNA, 19 nt, Homo sapiens
cacagcugauugggcaccu

SEQ ID NO: 1192974 - RNA, 21 nt, Homo sapiens
cacagcugcagcugggcccca

SEQ ID NO: 1192975 - RNA, 22 nt, Homo sapiens
cacagcuguaguaccccaagaa

SEQ ID NO: 1192976 - RNA, 19 nt, Homo sapiens
cacaggaagccugcagucc

SEQ ID NO: 1192977 - RNA, 18 nt, Homo sapiens
cacaggcagguccagggu

SEQ ID NO: 1192978 - RNA, 14 nt, Homo sapiens
caccuccugcaaua

SEQ ID NO: 1192979 - RNA, 19 nt, Homo sapiens
caccucugguccacacuag

SEQ ID NO: 1192980 - RNA, 13 nt, Homo sapiens
caccucuguucau

SEQ ID NO: 1192981 - RNA, 15 nt, Homo sapiens
caccucuuaugcaca

SEQ ID NO: 1192982 - RNA, 14 nt, Homo sapiens
caccucuuccuuga

SEQ ID NO: 1192983 - RNA, 15 nt, Homo sapiens
caccucuuccuugau

SEQ ID NO: 1192984 - RNA, 18 nt, Homo sapiens
caccugacacaccaggcg

SEQ ID NO: 1192985 - RNA, 17 nt, Homo sapiens
caccugacagcuuuauc

SEQ ID NO: 1192986 - RNA, 22 nt, Homo sapiens
caccugagacaugcugaaauua

SEQ ID NO: 1192987 - RNA, 20 nt, Homo sapiens
caccugcagcccauggugag

SEQ ID NO: 1192988 - RNA, 12 nt, Homo sapiens
caccugcaucug

SEQ ID NO: 1192989 - RNA, 19 nt, Homo sapiens
caccugcaugaacacagug

SEQ ID NO: 1192990 - RNA, 16 nt, Homo sapiens
caccugccgucuucac

SEQ ID NO: 1192991 - RNA, 23 nt, Homo sapiens
cacuguaaauaugaaucugcuca

SEQ ID NO: 1192992 - RNA, 11 nt, Homo sapiens
cacuguacaag

SEQ ID NO: 1192993 - RNA, 22 nt, Homo sapiens
cacuguacauuauaaaccuuca

SEQ ID NO: 1192994 - RNA, 20 nt, Homo sapiens
cacuguacauuuuuauacag

SEQ ID NO: 1192995 - RNA, 20 nt, Homo sapiens
cacuguauauaaacauauca

SEQ ID NO: 1192996 - RNA, 15 nt, Homo sapiens
cacuguauguuuacu

SEQ ID NO: 1192997 - RNA, 22 nt, Homo sapiens
cacugucugagaauuuccaaaa

SEQ ID NO: 1192998 - RNA, 11 nt, Homo sapiens
cacugugcaaa

SEQ ID NO: 1192999 - RNA, 13 nt, Homo sapiens
cacugugcacugc

SEQ ID NO: 1193000 - RNA, 22 nt, Homo sapiens
cacugugucacccagacuggaa

SEQ ID NO: 1193001 - RNA, 23 nt, Homo sapiens
cacuguuacuuucguacauuggc

SEQ ID NO: 1193002 - RNA, 18 nt, Homo sapiens
cacuguuaucuucacuuu

SEQ ID NO: 1193003 - RNA, 13 nt, Homo sapiens
cacuguucaauac

SEQ ID NO: 1193004 - RNA, 14 nt, Homo sapiens
cacuguugcccagg

SEQ ID NO: 1193005 - RNA, 22 nt, Homo sapiens
cacuguuuuuuucccagguguu

SEQ ID NO: 1193006 - RNA, 18 nt, Homo sapiens
cacuuacacuuuaugcac

SEQ ID NO: 1193007 - RNA, 13 nt, Homo sapiens
cacuuacagaauu

SEQ ID NO: 1193008 - RNA, 14 nt, Homo sapiens
cacuuacagaauua

SEQ ID NO: 1193009 - RNA, 18 nt, Homo sapiens
cacuuagucuguacuuca

SEQ ID NO: 1193010 - RNA, 22 nt, Homo sapiens
cacuuauaagaaagaucaaaga

SEQ ID NO: 1193011 - RNA, 17 nt, Homo sapiens
cacuuaucccaagagaa

SEQ ID NO: 1193012 - RNA, 17 nt, Homo sapiens
cacuucaaggugacaga

SEQ ID NO: 1193013 - RNA, 18 nt, Homo sapiens
cacuucagaauuccauau

SEQ ID NO: 1193014 - RNA, 12 nt, Homo sapiens
cacuucaucuga

SEQ ID NO: 1193015 - RNA, 13 nt, Homo sapiens
cacuucaucugau

SEQ ID NO: 1193016 - RNA, 15 nt, Homo sapiens
cacuucccaagaagg

SEQ ID NO: 1193017 - RNA, 17 nt, Homo sapiens
cacuucccuacauggag

SEQ ID NO: 1193018 - RNA, 14 nt, Homo sapiens
cacuuccuccagga

SEQ ID NO: 1193019 - RNA, 16 nt, Homo sapiens
cacuucuaaaugcaua

SEQ ID NO: 1193020 - RNA, 18 nt, Homo sapiens
cacuucuaaaugcauauc

SEQ ID NO: 1193021 - RNA, 13 nt, Homo sapiens
cacuucuaugcaa

SEQ ID NO: 1193022 - RNA, 16 nt, Homo sapiens
cacuugaggccaguga

SEQ ID NO: 1193023 - RNA, 20 nt, Homo sapiens
cacuugauguuuguuugcau

SEQ ID NO: 1193024 - RNA, 21 nt, Homo sapiens
cacuugcagacucuacagagg

SEQ ID NO: 1193025 - RNA, 20 nt, Homo sapiens
cacuugccuucuucacccag

SEQ ID NO: 1193026 - RNA, 16 nt, Homo sapiens
cacuuggaugcagggu

SEQ ID NO: 1193027 - RNA, 14 nt, Homo sapiens
cacuuggucuguga

SEQ ID NO: 1193028 - RNA, 22 nt, Homo sapiens
cacuugguuuuuggcucuuuca

SEQ ID NO: 1193029 - RNA, 22 nt, Homo sapiens
cacuuguaagaaaaugagacaa

SEQ ID NO: 1193030 - RNA, 21 nt, Homo sapiens
cacuugucacugacacaaagg

SEQ ID NO: 1193031 - RNA, 20 nt, Homo sapiens
cacuugugugugggcuguga

SEQ ID NO: 1193032 - RNA, 16 nt, Homo sapiens
cacuuguuuggugcua

SEQ ID NO: 1193033 - RNA, 18 nt, Homo sapiens
cacuuuaaagcaauugca

SEQ ID NO: 1193034 - RNA, 15 nt, Homo sapiens
cacuuuagaaagcug

SEQ ID NO: 1193035 - RNA, 18 nt, Homo sapiens
cacuuugaaauaccucau

SEQ ID NO: 1193036 - RNA, 20 nt, Homo sapiens
cacuuugaaggggccucacc

SEQ ID NO: 1193037 - RNA, 17 nt, Homo sapiens
cacuuugagaagcugag

SEQ ID NO: 1193038 - RNA, 19 nt, Homo sapiens
cacuuugagauguguuccu

SEQ ID NO: 1193039 - RNA, 16 nt, Homo sapiens
cacuuugccuccugug

SEQ ID NO: 1193040 - RNA, 22 nt, Homo sapiens
cacuuuggacauggcucacaaa

SEQ ID NO: 1193041 - RNA, 19 nt, Homo sapiens
cacuuugggaggcugaggu

SEQ ID NO: 1193042 - RNA, 18 nt, Homo sapiens
cacuuugucuaacucaga

SEQ ID NO: 1193043 - RNA, 21 nt, Homo sapiens
cacuuuuaacagaacagacag

SEQ ID NO: 1193044 - RNA, 15 nt, Homo sapiens
cacuuuuguucugcu

SEQ ID NO: 1193045 - RNA, 15 nt, Homo sapiens
cacuuuuucauuugc

SEQ ID NO: 1193046 - RNA, 23 nt, Homo sapiens
cacuuuuuuuuuuuuuuugacag

SEQ ID NO: 1193047 - RNA, 18 nt, Homo sapiens
cagaaaaauaagucaaaa

SEQ ID NO: 1193048 - RNA, 13 nt, Homo sapiens
cagaaaaccuguu

SEQ ID NO: 1193049 - RNA, 13 nt, Homo sapiens
cagaaaagcauac

SEQ ID NO: 1193050 - RNA, 16 nt, Homo sapiens
cagaaaauguucuguu

SEQ ID NO: 1193051 - RNA, 23 nt, Homo sapiens
cagaaaauguugagaaucccaaa

SEQ ID NO: 1193052 - RNA, 13 nt, Homo sapiens
cagaaaauucugu

SEQ ID NO: 1193053 - RNA, 23 nt, Homo sapiens
cagaaacagugggagcccugacc

SEQ ID NO: 1193054 - RNA, 15 nt, Homo sapiens
cagaaacagugugca

SEQ ID NO: 1193055 - RNA, 22 nt, Homo sapiens
cagaaacccggcuuccugugcu

SEQ ID NO: 1193056 - RNA, 18 nt, Homo sapiens
cagaaacuacagacaaag

SEQ ID NO: 1193057 - RNA, 21 nt, Homo sapiens
cagaaacuagaaaugugaaug

SEQ ID NO: 1193058 - RNA, 15 nt, Homo sapiens
cagaaacugaugcca

SEQ ID NO: 1193059 - RNA, 14 nt, Homo sapiens
cagaaagauuuucc

SEQ ID NO: 1193060 - RNA, 13 nt, Homo sapiens
cagaaagccacaa

SEQ ID NO: 1193061 - RNA, 20 nt, Homo sapiens
cagaaagccugggugacauu

SEQ ID NO: 1193062 - RNA, 15 nt, Homo sapiens
cagaaauaaacauug

SEQ ID NO: 1193063 - RNA, 20 nt, Homo sapiens
cagaaaugaaauagcuuagc

SEQ ID NO: 1193064 - RNA, 13 nt, Homo sapiens
cagaacacacaga

SEQ ID NO: 1193065 - RNA, 19 nt, Homo sapiens
cagaacagcuucagguuau

SEQ ID NO: 1193066 - RNA, 11 nt, Homo sapiens
cagaaccacaa

SEQ ID NO: 1193067 - RNA, 12 nt, Homo sapiens
cagaaccacaaa

SEQ ID NO: 1193068 - RNA, 16 nt, Homo sapiens
cagaacccagggcucu

SEQ ID NO: 1193069 - RNA, 19 nt, Homo sapiens
cagaacccuuccugagacc

SEQ ID NO: 1193070 - RNA, 15 nt, Homo sapiens
cagaagaaaagcaaa

SEQ ID NO: 1193071 - RNA, 14 nt, Homo sapiens
cagaagaaaucaua

SEQ ID NO: 1193072 - RNA, 14 nt, Homo sapiens
cagaagaagcuggu

SEQ ID NO: 1193073 - RNA, 16 nt, Homo sapiens
cagaagacacugcaaa

SEQ ID NO: 1193074 - RNA, 23 nt, Homo sapiens
cagaagacuucuauggaccacaa

SEQ ID NO: 1193075 - RNA, 22 nt, Homo sapiens
cagaagcaucgcuccucuccag

SEQ ID NO: 1193076 - RNA, 18 nt, Homo sapiens
cagaagccccauguguac

SEQ ID NO: 1193077 - RNA, 15 nt, Homo sapiens
cagaagccuccaagc

SEQ ID NO: 1193078 - RNA, 17 nt, Homo sapiens
cagaagccuggacucug

SEQ ID NO: 1193079 - RNA, 15 nt, Homo sapiens
cagaagcucaucuca

SEQ ID NO: 1193080 - RNA, 17 nt, Homo sapiens
cagaaggaaucuucuca

SEQ ID NO: 1193081 - RNA, 18 nt, Homo sapiens
cagaagggcuacuuucca

SEQ ID NO: 1193082 - RNA, 21 nt, Homo sapiens
cagaagggcuacuuuccacau

SEQ ID NO: 1193083 - RNA, 14 nt, Homo sapiens
cagaauauacuaaa

SEQ ID NO: 1193084 - RNA, 19 nt, Homo sapiens
cagaauauugcuuugguca

SEQ ID NO: 1193085 - RNA, 12 nt, Homo sapiens
cagaauccagcu

SEQ ID NO: 1193086 - RNA, 15 nt, Homo sapiens
cagaaucucaaauaa

SEQ ID NO: 1193087 - RNA, 23 nt, Homo sapiens
cagaaucucauagguugccaaua

SEQ ID NO: 1193088 - RNA, 18 nt, Homo sapiens
cagaaugcugcaggacuu

SEQ ID NO: 1193089 - RNA, 15 nt, Homo sapiens
cagaauguacggaaa

SEQ ID NO: 1193090 - RNA, 17 nt, Homo sapiens
cagaauguaucugugaa

SEQ ID NO: 1193091 - RNA, 13 nt, Homo sapiens
cagaauucaucug

SEQ ID NO: 1193092 - RNA, 16 nt, Homo sapiens
cagaauugagagugau

SEQ ID NO: 1193093 - RNA, 19 nt, Homo sapiens
cagaauuugauucguauga

SEQ ID NO: 1193094 - RNA, 22 nt, Homo sapiens
cagaauuugauucguaugauca

SEQ ID NO: 1193095 - RNA, 18 nt, Homo sapiens
cagaauuuggaaauccua

SEQ ID NO: 1193096 - RNA, 15 nt, Homo sapiens
cagacaaagugacau

SEQ ID NO: 1193097 - RNA, 13 nt, Homo sapiens
cagacaaccaaaa

SEQ ID NO: 1193098 - RNA, 14 nt, Homo sapiens
cagacaaccaaaac

SEQ ID NO: 1193099 - RNA, 14 nt, Homo sapiens
cagacaaccuauca

SEQ ID NO: 1193100 - RNA, 14 nt, Homo sapiens
cagacaagcacuau

SEQ ID NO: 1193101 - RNA, 15 nt, Homo sapiens
cagacaaugauccag

SEQ ID NO: 1193102 - RNA, 13 nt, Homo sapiens
cagacaauuccau

SEQ ID NO: 1193103 - RNA, 22 nt, Homo sapiens
cagacacacacacgcacgcaca

SEQ ID NO: 1193104 - RNA, 14 nt, Homo sapiens
cagacacagacugg

SEQ ID NO: 1193105 - RNA, 16 nt, Homo sapiens
cagacacuaaguuaua

SEQ ID NO: 1193106 - RNA, 20 nt, Homo sapiens
cagacacucugacuaccucc

SEQ ID NO: 1193107 - RNA, 19 nt, Homo sapiens
cagacagaagucuccucaa

SEQ ID NO: 1193108 - RNA, 22 nt, Homo sapiens
cagacaggaggaaucaugucag

SEQ ID NO: 1193109 - RNA, 15 nt, Homo sapiens
augcaaaguagcaau

SEQ ID NO: 1193110 - RNA, 20 nt, Homo sapiens
augcaagagcaccuggccaa

SEQ ID NO: 1193111 - RNA, 18 nt, Homo sapiens
augcaagaguggacugaa

SEQ ID NO: 1193112 - RNA, 12 nt, Homo sapiens
augcaagcagcu

SEQ ID NO: 1193113 - RNA, 22 nt, Homo sapiens
augcaagugguuuccuggugcu

SEQ ID NO: 1193114 - RNA, 19 nt, Homo sapiens
augcaauguaagcauacuu

SEQ ID NO: 1193115 - RNA, 16 nt, Homo sapiens
augcaauuuuucaaga

SEQ ID NO: 1193116 - RNA, 20 nt, Homo sapiens
augcacacacacacaucuca

SEQ ID NO: 1193117 - RNA, 22 nt, Homo sapiens
augcacacgggaaagccuuaaa

SEQ ID NO: 1193118 - RNA, 14 nt, Homo sapiens
augcacauauggac

SEQ ID NO: 1193119 - RNA, 21 nt, Homo sapiens
augcacauauggacucugcac

SEQ ID NO: 1193120 - RNA, 19 nt, Homo sapiens
augcacauccauucccaag

SEQ ID NO: 1193121 - RNA, 13 nt, Homo sapiens
augcacaucucau

SEQ ID NO: 1193122 - RNA, 17 nt, Homo sapiens
augcacccucccuccug

SEQ ID NO: 1193123 - RNA, 18 nt, Homo sapiens
augcaccuagcugugcaa

SEQ ID NO: 1193124 - RNA, 18 nt, Homo sapiens
augcaccuugugucugua

SEQ ID NO: 1193125 - RNA, 21 nt, Homo sapiens
augcacuauauguuuacacaa

SEQ ID NO: 1193126 - RNA, 22 nt, Homo sapiens
augcagacaaccucaucagcug

SEQ ID NO: 1193127 - RNA, 13 nt, Homo sapiens
augcagacuuccu

SEQ ID NO: 1193128 - RNA, 17 nt, Homo sapiens
augcaguacguucucag

SEQ ID NO: 1193129 - RNA, 15 nt, Homo sapiens
augcagugcuuccaa

SEQ ID NO: 1193130 - RNA, 20 nt, Homo sapiens
augcaguuaaacucauuguc

SEQ ID NO: 1193131 - RNA, 13 nt, Homo sapiens
augcauaaacuau

SEQ ID NO: 1193132 - RNA, 18 nt, Homo sapiens
augcauauugcccuggag

SEQ ID NO: 1193133 - RNA, 13 nt, Homo sapiens
augcaucaauaug

SEQ ID NO: 1193134 - RNA, 13 nt, Homo sapiens
augcaucacuggg

SEQ ID NO: 1193135 - RNA, 13 nt, Homo sapiens
augcaucuuguuu

SEQ ID NO: 1193136 - RNA, 14 nt, Homo sapiens
augcaugauacuau

SEQ ID NO: 1193137 - RNA, 17 nt, Homo sapiens
augcaugauacuaucug

SEQ ID NO: 1193138 - RNA, 14 nt, Homo sapiens
augcauggugcauc

SEQ ID NO: 1193139 - RNA, 17 nt, Homo sapiens
augcauuauaucaaauc

SEQ ID NO: 1193140 - RNA, 12 nt, Homo sapiens
augcauuauuaa

SEQ ID NO: 1193141 - RNA, 15 nt, Homo sapiens
augcauuuaauaaag

SEQ ID NO: 1193142 - RNA, 18 nt, Homo sapiens
augccaaccggucaccca

SEQ ID NO: 1193143 - RNA, 20 nt, Homo sapiens
augccaaggccguggggcuc

SEQ ID NO: 1193144 - RNA, 21 nt, Homo sapiens
augccaccaacacugcucaca

SEQ ID NO: 1193145 - RNA, 15 nt, Homo sapiens
augccacguggucac

SEQ ID NO: 1193146 - RNA, 14 nt, Homo sapiens
augccagcuacuuc

SEQ ID NO: 1193147 - RNA, 19 nt, Homo sapiens
augccagggacugacaaaa

SEQ ID NO: 1193148 - RNA, 22 nt, Homo sapiens
augccaguaacgcgucuuccug

SEQ ID NO: 1193149 - RNA, 13 nt, Homo sapiens
augccauaugccu

SEQ ID NO: 1193150 - RNA, 16 nt, Homo sapiens
augccauaugccuugg

SEQ ID NO: 1193151 - RNA, 15 nt, Homo sapiens
cagggccacauagau

SEQ ID NO: 1193152 - RNA, 22 nt, Homo sapiens
cagggcccuggaugguccucuu

SEQ ID NO: 1193153 - RNA, 14 nt, Homo sapiens
cagggccucaaagu

SEQ ID NO: 1193154 - RNA, 18 nt, Homo sapiens
cagggccuggagccccau

SEQ ID NO: 1193155 - RNA, 22 nt, Homo sapiens
cagggccuggcaggccaguguc

SEQ ID NO: 1193156 - RNA, 13 nt, Homo sapiens
cagggcuagugac

SEQ ID NO: 1193157 - RNA, 21 nt, Homo sapiens
cagggcuccugccuucugucc

SEQ ID NO: 1193158 - RNA, 15 nt, Homo sapiens
cagggcuggaagcuu

SEQ ID NO: 1193159 - RNA, 14 nt, Homo sapiens
caggggacaaggga

SEQ ID NO: 1193160 - RNA, 14 nt, Homo sapiens
caggggccugcaga

SEQ ID NO: 1193161 - RNA, 20 nt, Homo sapiens
caggggcgugaggucccagg

SEQ ID NO: 1193162 - RNA, 23 nt, Homo sapiens
cagugcuaaaauucagaugcugu

SEQ ID NO: 1193163 - RNA, 23 nt, Homo sapiens
cagugcugcuguaaauacaggaa

SEQ ID NO: 1193164 - RNA, 18 nt, Homo sapiens
cagugcugggaccagagc

SEQ ID NO: 1193165 - RNA, 21 nt, Homo sapiens
cagugcuguggccugggcaag

SEQ ID NO: 1193166 - RNA, 19 nt, Homo sapiens
caguggaagcaguuucaga

SEQ ID NO: 1193167 - RNA, 16 nt, Homo sapiens
caguggacucuuccac

SEQ ID NO: 1193168 - RNA, 23 nt, Homo sapiens
caguggaucuucagaacugcccu

SEQ ID NO: 1193169 - RNA, 13 nt, Homo sapiens
caguggaugcugc

SEQ ID NO: 1193170 - RNA, 13 nt, Homo sapiens
cauauauguuaaa

SEQ ID NO: 1193171 - RNA, 19 nt, Homo sapiens
cauauauuuuuaccaucug

SEQ ID NO: 1193172 - RNA, 14 nt, Homo sapiens
cauaucaacuugag

SEQ ID NO: 1193173 - RNA, 15 nt, Homo sapiens
cauaucaacuugagg

SEQ ID NO: 1193174 - RNA, 22 nt, Homo sapiens
cauaucauuuuuuuaacacaua

SEQ ID NO: 1193175 - RNA, 13 nt, Homo sapiens
cauauccuuucaa

SEQ ID NO: 1193176 - RNA, 20 nt, Homo sapiens
cauaucuuaaagaaacagcu

SEQ ID NO: 1193177 - RNA, 13 nt, Homo sapiens
cauaucuugccuu

SEQ ID NO: 1193178 - RNA, 13 nt, Homo sapiens
cauaucuuuauua

SEQ ID NO: 1193179 - RNA, 18 nt, Homo sapiens
cauaugacugauuacuca

SEQ ID NO: 1193180 - RNA, 21 nt, Homo sapiens
cauaugaggaggaugucccug

SEQ ID NO: 1193181 - RNA, 22 nt, Homo sapiens
cauaugaggaggaugucccugg

SEQ ID NO: 1193182 - RNA, 23 nt, Homo sapiens
cauaugccuuggggaggacaaaa

SEQ ID NO: 1193183 - RNA, 20 nt, Homo sapiens
cauauggacucugcacauga

SEQ ID NO: 1193184 - RNA, 14 nt, Homo sapiens
cauauguacauaaa

SEQ ID NO: 1193185 - RNA, 19 nt, Homo sapiens
cauauguugcucagucucc

SEQ ID NO: 1193186 - RNA, 17 nt, Homo sapiens
cauauuaagcacuuuaa

SEQ ID NO: 1193187 - RNA, 13 nt, Homo sapiens
cauauuaucucau

SEQ ID NO: 1193188 - RNA, 14 nt, Homo sapiens
cauauucauaugca

SEQ ID NO: 1193189 - RNA, 16 nt, Homo sapiens
cauauucuguuggcca

SEQ ID NO: 1193190 - RNA, 21 nt, Homo sapiens
cauauugaucuuuuuaucaug

SEQ ID NO: 1193191 - RNA, 20 nt, Homo sapiens
cauauuggaauguacauguc

SEQ ID NO: 1193192 - RNA, 19 nt, Homo sapiens
cauauuguuugaucuacuu

SEQ ID NO: 1193193 - RNA, 16 nt, Homo sapiens
cauauuuauauguaug

SEQ ID NO: 1193194 - RNA, 21 nt, Homo sapiens
cauauuucuaccugagugaag

SEQ ID NO: 1193195 - RNA, 18 nt, Homo sapiens
cauauuugaaaaccauau

SEQ ID NO: 1193196 - RNA, 23 nt, Homo sapiens
cauauuuggaagaaaaaaaucuu

SEQ ID NO: 1193197 - RNA, 20 nt, Homo sapiens
cauauuuuccuuuagaucaa

SEQ ID NO: 1193198 - RNA, 18 nt, Homo sapiens
cauauuuuuugcacagcu

SEQ ID NO: 1193199 - RNA, 21 nt, Homo sapiens
caucaaaaaaacaaguuuaga

SEQ ID NO: 1193200 - RNA, 20 nt, Homo sapiens
caucaaacauuggauuuuuc

SEQ ID NO: 1193201 - RNA, 12 nt, Homo sapiens
caucaaagccuu

SEQ ID NO: 1193202 - RNA, 23 nt, Homo sapiens
caucaacaacacagcaaaaccau

SEQ ID NO: 1193203 - RNA, 16 nt, Homo sapiens
caucaacugaucucau

SEQ ID NO: 1193204 - RNA, 21 nt, Homo sapiens
caucaauaaauguugcaaugc

SEQ ID NO: 1193205 - RNA, 23 nt, Homo sapiens
caucaaucuaaagauacaguguc

SEQ ID NO: 1193206 - RNA, 17 nt, Homo sapiens
caucaauucccauugca

SEQ ID NO: 1193207 - RNA, 12 nt, Homo sapiens
caucacacuggg

SEQ ID NO: 1193208 - RNA, 16 nt, Homo sapiens
caucacagcagccucc

SEQ ID NO: 1193209 - RNA, 16 nt, Homo sapiens
caucacaggaugccag

SEQ ID NO: 1193210 - RNA, 23 nt, Homo sapiens
caucacccgggaacuuuuuuaga

SEQ ID NO: 1193211 - RNA, 21 nt, Homo sapiens
caucacccucuuccugugauc

SEQ ID NO: 1193212 - RNA, 15 nt, Homo sapiens
caucacguaccccac

SEQ ID NO: 1193213 - RNA, 20 nt, Homo sapiens
caucagagcagcuagcucuu

SEQ ID NO: 1193214 - RNA, 13 nt, Homo sapiens
caucagcuuuauu

SEQ ID NO: 1193215 - RNA, 18 nt, Homo sapiens
caucaggccgcauccuga

SEQ ID NO: 1193216 - RNA, 18 nt, Homo sapiens
caucaggccuaaucucau

SEQ ID NO: 1193217 - RNA, 18 nt, Homo sapiens
caucaguagcaucuguaa

SEQ ID NO: 1193218 - RNA, 15 nt, Homo sapiens
caucaguccauugcu

SEQ ID NO: 1193219 - RNA, 22 nt, Homo sapiens
caucagugaauccugaaacugg

SEQ ID NO: 1193220 - RNA, 21 nt, Homo sapiens
caucaguguccucuugcucaa

SEQ ID NO: 1193221 - RNA, 23 nt, Homo sapiens
caucaucccuuaauuaaauauca

SEQ ID NO: 1193222 - RNA, 21 nt, Homo sapiens
caucauggauucauuacagcu

SEQ ID NO: 1193223 - RNA, 14 nt, Homo sapiens
caucaugucuggcu

SEQ ID NO: 1193224 - RNA, 22 nt, Homo sapiens
caucauuacuguuccagauucc

SEQ ID NO: 1193225 - RNA, 19 nt, Homo sapiens
caucauugugcuagcugau

SEQ ID NO: 1193226 - RNA, 14 nt, Homo sapiens
caucauuucugucu

SEQ ID NO: 1193227 - RNA, 10 nt, Homo sapiens
cauccaaagu

SEQ ID NO: 1193228 - RNA, 18 nt, Homo sapiens
cauccagaguaagugaug

SEQ ID NO: 1193229 - RNA, 15 nt, Homo sapiens
cauccagguuuauga

SEQ ID NO: 1193230 - RNA, 14 nt, Homo sapiens
cauccagugacaaa

SEQ ID NO: 1193231 - RNA, 23 nt, Homo sapiens
cauccaugcugugcuguguuauu

SEQ ID NO: 1193232 - RNA, 19 nt, Homo sapiens
caucccagcaccugccucc

SEQ ID NO: 1193233 - RNA, 22 nt, Homo sapiens
caucccaggggagaacuacauu

SEQ ID NO: 1193234 - RNA, 14 nt, Homo sapiens
caucccauguauuu

SEQ ID NO: 1193235 - RNA, 17 nt, Homo sapiens
cauccccuggacuggga

SEQ ID NO: 1193236 - RNA, 20 nt, Homo sapiens
cauccccuuuggcuaccuga

SEQ ID NO: 1193237 - RNA, 19 nt, Homo sapiens
caucccucgggugugcuau

SEQ ID NO: 1193238 - RNA, 18 nt, Homo sapiens
caucccucguggucccca

SEQ ID NO: 1193239 - RNA, 19 nt, Homo sapiens
caucccuuauuaguuacaa

SEQ ID NO: 1193240 - RNA, 22 nt, Homo sapiens
caucccuuccuggaaacagcau

SEQ ID NO: 1193241 - RNA, 14 nt, Homo sapiens
cauccguaucuuuu

SEQ ID NO: 1193242 - RNA, 16 nt, Homo sapiens
cauccucaugcugcuc

SEQ ID NO: 1193243 - RNA, 18 nt, Homo sapiens
cauccuccagauagugua

SEQ ID NO: 1193244 - RNA, 20 nt, Homo sapiens
cauccuggcuaacacgugaa

SEQ ID NO: 1193245 - RNA, 12 nt, Homo sapiens
cauccuggguaa

SEQ ID NO: 1193246 - RNA, 12 nt, Homo sapiens
cauccuuccuau

SEQ ID NO: 1193247 - RNA, 18 nt, Homo sapiens
cauccuuuacaccaacuc

SEQ ID NO: 1193248 - RNA, 18 nt, Homo sapiens
caucgauauguauaucau

SEQ ID NO: 1193249 - RNA, 21 nt, Homo sapiens
caucgauuuucuauuauggaa

SEQ ID NO: 1193250 - RNA, 20 nt, Homo sapiens
caucgcaauaguuuuuuacu

SEQ ID NO: 1193251 - RNA, 22 nt, Homo sapiens
caucgcuuuauuggcugagaua

SEQ ID NO: 1193252 - RNA, 13 nt, Homo sapiens
caucuacaccagu

SEQ ID NO: 1193253 - RNA, 22 nt, Homo sapiens
caucuaugaggguguuuccucu

SEQ ID NO: 1193254 - RNA, 18 nt, Homo sapiens
caucuauuauaaaaccau

SEQ ID NO: 1193255 - RNA, 18 nt, Homo sapiens
caucuauucaagcacuua

SEQ ID NO: 1193256 - RNA, 22 nt, Homo sapiens
caucucaaaaauaaugcauaaa

SEQ ID NO: 1193257 - RNA, 21 nt, Homo sapiens
caucucaaagaaggcauuugc

SEQ ID NO: 1193258 - RNA, 21 nt, Homo sapiens
caucucagaaaacucugguaa

SEQ ID NO: 1193259 - RNA, 14 nt, Homo sapiens
caucucaggggcca

SEQ ID NO: 1193260 - RNA, 15 nt, Homo sapiens
caucucaggggccag

SEQ ID NO: 1193261 - RNA, 14 nt, Homo sapiens
caucucagugcagg

SEQ ID NO: 1193262 - RNA, 11 nt, Homo sapiens
caucucccacc

SEQ ID NO: 1193263 - RNA, 22 nt, Homo sapiens
caucucccacccuguaccucau

SEQ ID NO: 1193264 - RNA, 19 nt, Homo sapiens
caucucccagccaagucca

SEQ ID NO: 1193265 - RNA, 22 nt, Homo sapiens
caucuccuaauuuguuucuucu

SEQ ID NO: 1193266 - RNA, 19 nt, Homo sapiens
caucucuaaggagagcucu

SEQ ID NO: 1193267 - RNA, 13 nt, Homo sapiens
caucucuaauaau

SEQ ID NO: 1193268 - RNA, 12 nt, Homo sapiens
caucucuacuaa

SEQ ID NO: 1193269 - RNA, 18 nt, Homo sapiens
caucucuccccaacccua

SEQ ID NO: 1193270 - RNA, 23 nt, Homo sapiens
caucucucccuccccugccauuu

SEQ ID NO: 1193271 - RNA, 17 nt, Homo sapiens
caucugaaacccacaga

SEQ ID NO: 1193272 - RNA, 11 nt, Homo sapiens
caucugcaaua

SEQ ID NO: 1193273 - RNA, 23 nt, Homo sapiens
caucugcuauuaaccuugccuua

SEQ ID NO: 1193274 - RNA, 22 nt, Homo sapiens
caucugcuuuucccauugccau

SEQ ID NO: 1193275 - RNA, 15 nt, Homo sapiens
caucuggaaucugga

SEQ ID NO: 1193276 - RNA, 16 nt, Homo sapiens
caucuggaggagcucu

SEQ ID NO: 1193277 - RNA, 17 nt, Homo sapiens
caucuggauuuucacac

SEQ ID NO: 1193278 - RNA, 18 nt, Homo sapiens
caucuguaacagcauuaa

SEQ ID NO: 1193279 - RNA, 14 nt, Homo sapiens
caucugugccagag

SEQ ID NO: 1193280 - RNA, 18 nt, Homo sapiens
caucugugccuucucuau

SEQ ID NO: 1193281 - RNA, 18 nt, Homo sapiens
caucuuacuguaccuguu

SEQ ID NO: 1193282 - RNA, 14 nt, Homo sapiens
caucuuacuugagc

SEQ ID NO: 1193283 - RNA, 16 nt, Homo sapiens
caucuucauagaugaa

SEQ ID NO: 1193284 - RNA, 11 nt, Homo sapiens
caucuuccaag

SEQ ID NO: 1193285 - RNA, 16 nt, Homo sapiens
caucuucccacagugg

SEQ ID NO: 1193286 - RNA, 18 nt, Homo sapiens
caucuucccacaguggcu

SEQ ID NO: 1193287 - RNA, 22 nt, Homo sapiens
caucuuccgcgcaggugccaac

SEQ ID NO: 1193288 - RNA, 23 nt, Homo sapiens
caucuucgucuucacucuuaggc

SEQ ID NO: 1193289 - RNA, 13 nt, Homo sapiens
caucuucuagaau

SEQ ID NO: 1193290 - RNA, 14 nt, Homo sapiens
caucuugcuaccag

SEQ ID NO: 1193291 - RNA, 16 nt, Homo sapiens
caucuugcuaccagua

SEQ ID NO: 1193292 - RNA, 21 nt, Homo sapiens
caucuuuaucaugaagcacau

SEQ ID NO: 1193293 - RNA, 18 nt, Homo sapiens
caucuuucacuaucugua

SEQ ID NO: 1193294 - RNA, 15 nt, Homo sapiens
caucuuuucuacuuc

SEQ ID NO: 1193295 - RNA, 18 nt, Homo sapiens
caugaaaacacacauaca

SEQ ID NO: 1193296 - RNA, 21 nt, Homo sapiens
caugaaaaguuauuuaugcua

SEQ ID NO: 1193297 - RNA, 17 nt, Homo sapiens
cauuagaacaaaggaca

SEQ ID NO: 1193298 - RNA, 16 nt, Homo sapiens
cauuagucaauaacua

SEQ ID NO: 1193299 - RNA, 22 nt, Homo sapiens
cauuauaucauuggaacaacug

SEQ ID NO: 1193300 - RNA, 20 nt, Homo sapiens
cauuaucaguugacagugua

SEQ ID NO: 1193301 - RNA, 18 nt, Homo sapiens
cauuaucgggagcagugu

SEQ ID NO: 1193302 - RNA, 15 nt, Homo sapiens
cauuaucucacuuag

SEQ ID NO: 1193303 - RNA, 15 nt, Homo sapiens
cauuauuagcacuuc

SEQ ID NO: 1193304 - RNA, 19 nt, Homo sapiens
cauuauuuuucacugcccc

SEQ ID NO: 1193305 - RNA, 14 nt, Homo sapiens
cauucacaccagcu

SEQ ID NO: 1193306 - RNA, 22 nt, Homo sapiens
cauucagugauuacugucaagg

SEQ ID NO: 1193307 - RNA, 23 nt, Homo sapiens
cauucaguuaauucaaugugaac

SEQ ID NO: 1193308 - RNA, 17 nt, Homo sapiens
cauucaugugggcauuu

SEQ ID NO: 1193309 - RNA, 13 nt, Homo sapiens
cauuccaagaaag

SEQ ID NO: 1193310 - RNA, 18 nt, Homo sapiens
cauuccaagacucuagag

SEQ ID NO: 1193311 - RNA, 12 nt, Homo sapiens
cauuccaggaaa

SEQ ID NO: 1193312 - RNA, 15 nt, Homo sapiens
cauuccauuuuguga

SEQ ID NO: 1193313 - RNA, 23 nt, Homo sapiens
cauuccauuuugugaauugugac

SEQ ID NO: 1193314 - RNA, 13 nt, Homo sapiens
cauucccccaugu

SEQ ID NO: 1193315 - RNA, 14 nt, Homo sapiens
cauuccuucccacc

SEQ ID NO: 1193316 - RNA, 17 nt, Homo sapiens
cauuccuuugucuucaa

SEQ ID NO: 1193317 - RNA, 13 nt, Homo sapiens
cauucuagguagg

SEQ ID NO: 1193318 - RNA, 12 nt, Homo sapiens
cauucuccugcc

SEQ ID NO: 1193319 - RNA, 16 nt, Homo sapiens
cauucuccugccucag

SEQ ID NO: 1193320 - RNA, 11 nt, Homo sapiens
cauucugacca

SEQ ID NO: 1193321 - RNA, 16 nt, Homo sapiens
cauucugaugagcaac

SEQ ID NO: 1193322 - RNA, 14 nt, Homo sapiens
cauucugcuacuuc

SEQ ID NO: 1193323 - RNA, 17 nt, Homo sapiens
cauucuggacaccaggg

SEQ ID NO: 1193324 - RNA, 23 nt, Homo sapiens
cauucuuauuaauucuucaccug

SEQ ID NO: 1193325 - RNA, 23 nt, Homo sapiens
cauucuuguuuuaagugccuuua

SEQ ID NO: 1193326 - RNA, 12 nt, Homo sapiens
cauucuuuacau

SEQ ID NO: 1193327 - RNA, 20 nt, Homo sapiens
cauucuuuuccacuuguuaa

SEQ ID NO: 1193328 - RNA, 16 nt, Homo sapiens
cauugacgauuccuuc

SEQ ID NO: 1193329 - RNA, 17 nt, Homo sapiens
cauugacugucacauaa

SEQ ID NO: 1193330 - RNA, 15 nt, Homo sapiens
cauugcacauaagcu

SEQ ID NO: 1193331 - RNA, 16 nt, Homo sapiens
cauugcacuccagcug

SEQ ID NO: 1193332 - RNA, 15 nt, Homo sapiens
cauugcaguuuaaga

SEQ ID NO: 1193333 - RNA, 21 nt, Homo sapiens
cauugccuaacuacuaguuuu

SEQ ID NO: 1193334 - RNA, 17 nt, Homo sapiens
cauugcucuugagucuu

SEQ ID NO: 1193335 - RNA, 22 nt, Homo sapiens
cauugcuuuugggagacuggaa

SEQ ID NO: 1193336 - RNA, 19 nt, Homo sapiens
cauuggaccuguucaaaaa

SEQ ID NO: 1193337 - RNA, 20 nt, Homo sapiens
cauuggauucaucagcauuu

SEQ ID NO: 1193338 - RNA, 12 nt, Homo sapiens
cauuggcacugu

SEQ ID NO: 1193339 - RNA, 16 nt, Homo sapiens
cauuggccgacaucac

SEQ ID NO: 1193340 - RNA, 22 nt, Homo sapiens
cauugggaaauuuuucuuucua

SEQ ID NO: 1193341 - RNA, 16 nt, Homo sapiens
cauugggagucuguag

SEQ ID NO: 1193342 - RNA, 19 nt, Homo sapiens
cauugggcugacaccuacc

SEQ ID NO: 1193343 - RNA, 20 nt, Homo sapiens
cauugggguuccgcacuuuc

SEQ ID NO: 1193344 - RNA, 16 nt, Homo sapiens
cauugguccaagauuc

SEQ ID NO: 1193345 - RNA, 21 nt, Homo sapiens
cauuguaaaguuuaugucacc

SEQ ID NO: 1193346 - RNA, 13 nt, Homo sapiens
cauuguaguuaau

SEQ ID NO: 1193347 - RNA, 12 nt, Homo sapiens
cauuguauccuc

SEQ ID NO: 1193348 - RNA, 20 nt, Homo sapiens
cauugugauuuguuccugcc

SEQ ID NO: 1193349 - RNA, 22 nt, Homo sapiens
cauuguguucucuauugcugcu

SEQ ID NO: 1193350 - RNA, 20 nt, Homo sapiens
cauuguuaagaaaguauuug

SEQ ID NO: 1193351 - RNA, 18 nt, Homo sapiens
cauuguuuauuguauacu

SEQ ID NO: 1193352 - RNA, 19 nt, Homo sapiens
cauuguuuucuuuuacaga

SEQ ID NO: 1193353 - RNA, 21 nt, Homo sapiens
cauuguuuuguguaacauauu

SEQ ID NO: 1193354 - RNA, 23 nt, Homo sapiens
cauuuaaaaagcucacugcugau

SEQ ID NO: 1193355 - RNA, 14 nt, Homo sapiens
cauuuacacauauc

SEQ ID NO: 1193356 - RNA, 19 nt, Homo sapiens
cauuuacacauauccacaa

SEQ ID NO: 1193357 - RNA, 13 nt, Homo sapiens
cauuuacacuuuu

SEQ ID NO: 1193358 - RNA, 23 nt, Homo sapiens
cauuuacagucucuuucuuccuu

SEQ ID NO: 1193359 - RNA, 23 nt, Homo sapiens
cauuuacuuaacagaacagucac

SEQ ID NO: 1193360 - RNA, 22 nt, Homo sapiens
cauuuagaaaauagagcuuuua

SEQ ID NO: 1193361 - RNA, 18 nt, Homo sapiens
cauuuagaacuugcagcu

SEQ ID NO: 1193362 - RNA, 21 nt, Homo sapiens
cauuuagaacuugcagcugau

SEQ ID NO: 1193363 - RNA, 13 nt, Homo sapiens
cauuuagcacaaa

SEQ ID NO: 1193364 - RNA, 15 nt, Homo sapiens
cauuuauaaaaccau

SEQ ID NO: 1193365 - RNA, 12 nt, Homo sapiens
cauuuaugcaca

SEQ ID NO: 1193366 - RNA, 16 nt, Homo sapiens
cauuucaaucauugaa

SEQ ID NO: 1193367 - RNA, 13 nt, Homo sapiens
cauuucaaugugu

SEQ ID NO: 1193368 - RNA, 13 nt, Homo sapiens
cauuucaccaugu

SEQ ID NO: 1193369 - RNA, 14 nt, Homo sapiens
cauuucaccuguga

SEQ ID NO: 1193370 - RNA, 20 nt, Homo sapiens
cauuuccaacaccacagaca

SEQ ID NO: 1193371 - RNA, 16 nt, Homo sapiens
cauuucccaucugcac

SEQ ID NO: 1193372 - RNA, 20 nt, Homo sapiens
cauuucuagagagccccuga

SEQ ID NO: 1193373 - RNA, 13 nt, Homo sapiens
cauuucuauacuu

SEQ ID NO: 1193374 - RNA, 17 nt, Homo sapiens
cauuucugaugucucca

SEQ ID NO: 1193375 - RNA, 17 nt, Homo sapiens
cauuucuguaaauacca

SEQ ID NO: 1193376 - RNA, 14 nt, Homo sapiens
cauuucugucucca

SEQ ID NO: 1193377 - RNA, 20 nt, Homo sapiens
cauuucuguucucauuugau

SEQ ID NO: 1193378 - RNA, 11 nt, Homo sapiens
cauuucuuaga

SEQ ID NO: 1193379 - RNA, 13 nt, Homo sapiens
cauuucuugugau

SEQ ID NO: 1193380 - RNA, 18 nt, Homo sapiens
cauuugauaaaauccaaa

SEQ ID NO: 1193381 - RNA, 10 nt, Homo sapiens
cauuugauac

SEQ ID NO: 1193382 - RNA, 16 nt, Homo sapiens
cauuugcaccuaccuc

SEQ ID NO: 1193383 - RNA, 17 nt, Homo sapiens
cauuugccaacucgaac

SEQ ID NO: 1193384 - RNA, 14 nt, Homo sapiens
cauuugcucuuuca

SEQ ID NO: 1193385 - RNA, 19 nt, Homo sapiens
cauuugggagacaugugac

SEQ ID NO: 1193386 - RNA, 20 nt, Homo sapiens
cauuugggagacaugugaca

SEQ ID NO: 1193387 - RNA, 17 nt, Homo sapiens
cauuuguagcaauuuaa

SEQ ID NO: 1193388 - RNA, 23 nt, Homo sapiens
cauuugugggucuguguggcagg

SEQ ID NO: 1193389 - RNA, 12 nt, Homo sapiens
cauuugugucaa

SEQ ID NO: 1193390 - RNA, 20 nt, Homo sapiens
cauuuguguuuugaaagccc

SEQ ID NO: 1193391 - RNA, 21 nt, Homo sapiens
cauuuguuggaaugaauuaaa

SEQ ID NO: 1193392 - RNA, 19 nt, Homo sapiens
cauuuguuuccucaucuuu

SEQ ID NO: 1193393 - RNA, 14 nt, Homo sapiens
cauuuguuuugcuu

SEQ ID NO: 1193394 - RNA, 20 nt, Homo sapiens
cauuuuauaagcuacauguu

SEQ ID NO: 1193395 - RNA, 16 nt, Homo sapiens
cauuuuauucuuuaag

SEQ ID NO: 1193396 - RNA, 19 nt, Homo sapiens
cauuuucagucuuguagug

SEQ ID NO: 1193397 - RNA, 20 nt, Homo sapiens
cauuuucccccacuacugca

SEQ ID NO: 1193398 - RNA, 20 nt, Homo sapiens
cauuuugucaguuuuaucuu

SEQ ID NO: 1193399 - RNA, 21 nt, Homo sapiens
cauuuuguugcuuuugugaac

SEQ ID NO: 1193400 - RNA, 22 nt, Homo sapiens
cauuuuuagaaaucacaacaaa

SEQ ID NO: 1193401 - RNA, 16 nt, Homo sapiens
cauuuuugcucuaugg

SEQ ID NO: 1193402 - RNA, 15 nt, Homo sapiens
cauuuuuuguucugu

SEQ ID NO: 1193403 - RNA, 19 nt, Homo sapiens
cauuuuuuuuucaaucaac

SEQ ID NO: 1193404 - RNA, 18 nt, Homo sapiens
ccaaaacaaacaaacaga

SEQ ID NO: 1193405 - RNA, 12 nt, Homo sapiens
ccaaaacacagg

SEQ ID NO: 1193406 - RNA, 20 nt, Homo sapiens
ccaaaacauauucaaagcag

SEQ ID NO: 1193407 - RNA, 15 nt, Homo sapiens
ccaaaacuaauuucc

SEQ ID NO: 1193408 - RNA, 12 nt, Homo sapiens
ccaaaagcacag

SEQ ID NO: 1193409 - RNA, 12 nt, Homo sapiens
ccaaaagcacuu

SEQ ID NO: 1193410 - RNA, 11 nt, Homo sapiens
ccaaaagcuag

SEQ ID NO: 1193411 - RNA, 18 nt, Homo sapiens
ccaaaauaaaaccagcuc

SEQ ID NO: 1193412 - RNA, 21 nt, Homo sapiens
ccaaaaugccauuuagcaaua

SEQ ID NO: 1193413 - RNA, 23 nt, Homo sapiens
ccaaaccaauucaccaacacagu

SEQ ID NO: 1193414 - RNA, 15 nt, Homo sapiens
ccaaaccucaaguaa

SEQ ID NO: 1193415 - RNA, 20 nt, Homo sapiens
ccaaaccugucuuggggcca

SEQ ID NO: 1193416 - RNA, 22 nt, Homo sapiens
ccaaacggaagacuacagcaug

SEQ ID NO: 1193417 - RNA, 18 nt, Homo sapiens
ccaaacucauaacagucu

SEQ ID NO: 1193418 - RNA, 14 nt, Homo sapiens
ccaaacugacucaa

SEQ ID NO: 1193419 - RNA, 20 nt, Homo sapiens
ccaaagaaaugaacauucca

SEQ ID NO: 1193420 - RNA, 14 nt, Homo sapiens
ccaaagacaucagu

SEQ ID NO: 1193421 - RNA, 15 nt, Homo sapiens
ccaaagacauguuua

SEQ ID NO: 1193422 - RNA, 21 nt, Homo sapiens
ccaaagagaagggcacuguaa

SEQ ID NO: 1193423 - RNA, 22 nt, Homo sapiens
cccaagugaggagugccagcuc

SEQ ID NO: 1193424 - RNA, 15 nt, Homo sapiens
cccaauaaaggcagc

SEQ ID NO: 1193425 - RNA, 15 nt, Homo sapiens
cccaaucagcacuga

SEQ ID NO: 1193426 - RNA, 18 nt, Homo sapiens
cccaaucuuucuauauaa

SEQ ID NO: 1193427 - RNA, 21 nt, Homo sapiens
cccaauuacagggugacucac

SEQ ID NO: 1193428 - RNA, 22 nt, Homo sapiens
cccaauuucggauuuuuuccaa

SEQ ID NO: 1193429 - RNA, 16 nt, Homo sapiens
cccacaacgacuuuau

SEQ ID NO: 1193430 - RNA, 13 nt, Homo sapiens
cccacaacuuuaa

SEQ ID NO: 1193431 - RNA, 14 nt, Homo sapiens
cccacaagccagga

SEQ ID NO: 1193432 - RNA, 20 nt, Homo sapiens
cccacaagugccacugcccg

SEQ ID NO: 1193433 - RNA, 17 nt, Homo sapiens
cccacacacacuggccu

SEQ ID NO: 1193434 - RNA, 15 nt, Homo sapiens
cccacagacacuuac

SEQ ID NO: 1193435 - RNA, 23 nt, Homo sapiens
caugaaaaguuauuuaugcuaua

SEQ ID NO: 1193436 - RNA, 23 nt, Homo sapiens
caugaaagaacccaagacaucau

SEQ ID NO: 1193437 - RNA, 22 nt, Homo sapiens
caugaacaucuuuagugucuga

SEQ ID NO: 1193438 - RNA, 12 nt, Homo sapiens
caugaacuguac

SEQ ID NO: 1193439 - RNA, 18 nt, Homo sapiens
caugaagauaaacuguuc

SEQ ID NO: 1193440 - RNA, 14 nt, Homo sapiens
caugaagcacauca

SEQ ID NO: 1193441 - RNA, 12 nt, Homo sapiens
caugaagcccaa

SEQ ID NO: 1193442 - RNA, 18 nt, Homo sapiens
caugaauaaaacacucau

SEQ ID NO: 1193443 - RNA, 21 nt, Homo sapiens
caugaauauaaaugggaaauc

SEQ ID NO: 1193444 - RNA, 14 nt, Homo sapiens
caugaaucucucaa

SEQ ID NO: 1193445 - RNA, 13 nt, Homo sapiens
caugaauguauca

SEQ ID NO: 1193446 - RNA, 17 nt, Homo sapiens
caugaauguaucaggaa

SEQ ID NO: 1193447 - RNA, 15 nt, Homo sapiens
caugaauuccuuaaa

SEQ ID NO: 1193448 - RNA, 16 nt, Homo sapiens
caugaauuccuuaaaa

SEQ ID NO: 1193449 - RNA, 18 nt, Homo sapiens
caugaauucuuaugcuua

SEQ ID NO: 1193450 - RNA, 18 nt, Homo sapiens
caugacccaccccugugc

SEQ ID NO: 1193451 - RNA, 19 nt, Homo sapiens
caugagaccacuguuauca

SEQ ID NO: 1193452 - RNA, 21 nt, Homo sapiens
caugagccucagcauccuggc

SEQ ID NO: 1193453 - RNA, 22 nt, Homo sapiens
caugagcuauuuccauuccaga

SEQ ID NO: 1193454 - RNA, 17 nt, Homo sapiens
caugagguacagcagaa

SEQ ID NO: 1193455 - RNA, 15 nt, Homo sapiens
caugaguccuugaaa

SEQ ID NO: 1193456 - RNA, 18 nt, Homo sapiens
caugagugaauaaauguc

SEQ ID NO: 1193457 - RNA, 19 nt, Homo sapiens
caugauacuaucugugcca

SEQ ID NO: 1193458 - RNA, 16 nt, Homo sapiens
caugaugaacucaccu

SEQ ID NO: 1193459 - RNA, 14 nt, Homo sapiens
caugaugagaguuu

SEQ ID NO: 1193460 - RNA, 13 nt, Homo sapiens
caugaugcugccc

SEQ ID NO: 1193461 - RNA, 15 nt, Homo sapiens
caugauguagagugu

SEQ ID NO: 1193462 - RNA, 15 nt, Homo sapiens
caugaugucaacuca

SEQ ID NO: 1193463 - RNA, 19 nt, Homo sapiens
caugauguuaaccagaaua

SEQ ID NO: 1193464 - RNA, 15 nt, Homo sapiens
caugauuguuuacag

SEQ ID NO: 1193465 - RNA, 16 nt, Homo sapiens
caugauuucauuucaa

SEQ ID NO: 1193466 - RNA, 17 nt, Homo sapiens
caugauuuccuugaaug

SEQ ID NO: 1193467 - RNA, 22 nt, Homo sapiens
caugauuuuuuuuuuucagucc

SEQ ID NO: 1193468 - RNA, 14 nt, Homo sapiens
caugcaaaugagcu

SEQ ID NO: 1193469 - RNA, 13 nt, Homo sapiens
caugcaaugacau

SEQ ID NO: 1193470 - RNA, 12 nt, Homo sapiens
caugcacaaagu

SEQ ID NO: 1193471 - RNA, 14 nt, Homo sapiens
caugcacacacaca

SEQ ID NO: 1193472 - RNA, 13 nt, Homo sapiens
caugcacggugag

SEQ ID NO: 1193473 - RNA, 12 nt, Homo sapiens
caugcacugacc

SEQ ID NO: 1193474 - RNA, 22 nt, Homo sapiens
caugcagcaaggggacaucuua

SEQ ID NO: 1193475 - RNA, 23 nt, Homo sapiens
caugcaggaaggaaaacuaugua

SEQ ID NO: 1193476 - RNA, 23 nt, Homo sapiens
caugcaggcccuuugaagccuca

SEQ ID NO: 1193477 - RNA, 11 nt, Homo sapiens
caugcauuuga

SEQ ID NO: 1193478 - RNA, 21 nt, Homo sapiens
caugcauuuugcagcagugag

SEQ ID NO: 1193479 - RNA, 15 nt, Homo sapiens
caugccacugccagg

SEQ ID NO: 1193480 - RNA, 14 nt, Homo sapiens
caugccagaaggaa

SEQ ID NO: 1193481 - RNA, 14 nt, Homo sapiens
caugcccaugauga

SEQ ID NO: 1193482 - RNA, 20 nt, Homo sapiens
caugccugaggucuaccccu

SEQ ID NO: 1193483 - RNA, 15 nt, Homo sapiens
caugccuggagaaac

SEQ ID NO: 1193484 - RNA, 22 nt, Homo sapiens
caugccuguaaucucagcacuu

SEQ ID NO: 1193485 - RNA, 13 nt, Homo sapiens
caugcgcacucuc

SEQ ID NO: 1193486 - RNA, 17 nt, Homo sapiens
caugcgucgcaaacucu

SEQ ID NO: 1193487 - RNA, 21 nt, Homo sapiens
caugcgugccgccugcuccuc

SEQ ID NO: 1193488 - RNA, 23 nt, Homo sapiens
caugcuacuuuuuuuuaguucaa

SEQ ID NO: 1193489 - RNA, 21 nt, Homo sapiens
caugcucaggagccaccagca

SEQ ID NO: 1193490 - RNA, 11 nt, Homo sapiens
caugcucccuu

SEQ ID NO: 1193491 - RNA, 12 nt, Homo sapiens
caugcugcucaa

SEQ ID NO: 1193492 - RNA, 20 nt, Homo sapiens
caugcugcuuuuuggcacag

SEQ ID NO: 1193493 - RNA, 23 nt, Homo sapiens
caugcugcuuuuuguacuuggaa

SEQ ID NO: 1193494 - RNA, 17 nt, Homo sapiens
caugcugggauuuccaa

SEQ ID NO: 1193495 - RNA, 14 nt, Homo sapiens
caugcuggggcaag

SEQ ID NO: 1193496 - RNA, 21 nt, Homo sapiens
caugcuuuucugccacuccau

SEQ ID NO: 1193497 - RNA, 21 nt, Homo sapiens
cauggaaauguauuuuaguua

SEQ ID NO: 1193498 - RNA, 21 nt, Homo sapiens
cauggaacagcauuacccucc

SEQ ID NO: 1193499 - RNA, 15 nt, Homo sapiens
cauggaauauuucca

SEQ ID NO: 1193500 - RNA, 13 nt, Homo sapiens
cauggacacucca

SEQ ID NO: 1193501 - RNA, 20 nt, Homo sapiens
cauggagaaucugcugcaua

SEQ ID NO: 1193502 - RNA, 14 nt, Homo sapiens
cauggaggccagug

SEQ ID NO: 1193503 - RNA, 12 nt, Homo sapiens
cauggaugccaa

SEQ ID NO: 1193504 - RNA, 19 nt, Homo sapiens
cauggauucagcaugucca

SEQ ID NO: 1193505 - RNA, 13 nt, Homo sapiens
cauggcacugaca

SEQ ID NO: 1193506 - RNA, 17 nt, Homo sapiens
cauggcacugacaaugg

SEQ ID NO: 1193507 - RNA, 19 nt, Homo sapiens
cauggcacugacaaugggc

SEQ ID NO: 1193508 - RNA, 15 nt, Homo sapiens
cauggcagaagucaa

SEQ ID NO: 1193509 - RNA, 20 nt, Homo sapiens
cauggcagaagucaacgccu

SEQ ID NO: 1193510 - RNA, 20 nt, Homo sapiens
cauggccuugaaacaguucc

SEQ ID NO: 1193511 - RNA, 14 nt, Homo sapiens
cauggcucacaaac

SEQ ID NO: 1193512 - RNA, 20 nt, Homo sapiens
cauggcuccagaaaugucua

SEQ ID NO: 1193513 - RNA, 23 nt, Homo sapiens
cauggcucuggcacaguguaauc

SEQ ID NO: 1193514 - RNA, 21 nt, Homo sapiens
cauggcugaaggaaaccagug

SEQ ID NO: 1193515 - RNA, 20 nt, Homo sapiens
caugggacuaaaugaacuaa

SEQ ID NO: 1193516 - RNA, 23 nt, Homo sapiens
caugggagggggcuugaagccaa

SEQ ID NO: 1193517 - RNA, 17 nt, Homo sapiens
caugggggugaccccac

SEQ ID NO: 1193518 - RNA, 19 nt, Homo sapiens
cauggguggcacucagucu

SEQ ID NO: 1193519 - RNA, 16 nt, Homo sapiens
cauggugaaaauguac

SEQ ID NO: 1193520 - RNA, 20 nt, Homo sapiens
cauggugugaguccaaagaa

SEQ ID NO: 1193521 - RNA, 14 nt, Homo sapiens
cauguaaauugcaa

SEQ ID NO: 1193522 - RNA, 14 nt, Homo sapiens
cauguaacacgaca

SEQ ID NO: 1193523 - RNA, 16 nt, Homo sapiens
cauguacauacccugg

SEQ ID NO: 1193524 - RNA, 20 nt, Homo sapiens
cauguacucaaguaccacca

SEQ ID NO: 1193525 - RNA, 15 nt, Homo sapiens
cauguaucucaguac

SEQ ID NO: 1193526 - RNA, 20 nt, Homo sapiens
cauguaucuuuugaacuggc

SEQ ID NO: 1193527 - RNA, 23 nt, Homo sapiens
caugucaacuucuggcuccucaa

SEQ ID NO: 1193528 - RNA, 12 nt, Homo sapiens
caugucacugug

SEQ ID NO: 1193529 - RNA, 15 nt, Homo sapiens
caugucagacuguac

SEQ ID NO: 1193530 - RNA, 16 nt, Homo sapiens
caugucuacaugccau

SEQ ID NO: 1193531 - RNA, 15 nt, Homo sapiens
caugucucaauagua

SEQ ID NO: 1193532 - RNA, 12 nt, Homo sapiens
caugucuuuacu

SEQ ID NO: 1193533 - RNA, 15 nt, Homo sapiens
caugucuuuacugga

SEQ ID NO: 1193534 - RNA, 18 nt, Homo sapiens
caugugacacauaugcac

SEQ ID NO: 1193535 - RNA, 19 nt, Homo sapiens
caugugacacauaugcacc

SEQ ID NO: 1193536 - RNA, 15 nt, Homo sapiens
caugugcaaaugugc

SEQ ID NO: 1193537 - RNA, 17 nt, Homo sapiens
caugugcacaugcacgu

SEQ ID NO: 1193538 - RNA, 21 nt, Homo sapiens
caugugccaagauucuacucu

SEQ ID NO: 1193539 - RNA, 17 nt, Homo sapiens
caugugccagggcaaug

SEQ ID NO: 1193540 - RNA, 18 nt, Homo sapiens
caugugccgaaugugcag

SEQ ID NO: 1193541 - RNA, 14 nt, Homo sapiens
cauguguauguguc

SEQ ID NO: 1193542 - RNA, 21 nt, Homo sapiens
cauguguaugugucugcuaau

SEQ ID NO: 1193543 - RNA, 19 nt, Homo sapiens
cauguguuuuaauuccaau

SEQ ID NO: 1193544 - RNA, 15 nt, Homo sapiens
cauguuacccauuca

SEQ ID NO: 1193545 - RNA, 23 nt, Homo sapiens
cauguuacuaaauuacguaugca

SEQ ID NO: 1193546 - RNA, 15 nt, Homo sapiens
cauguucuggcagca

SEQ ID NO: 1193547 - RNA, 16 nt, Homo sapiens
cauguugaaggugccc

SEQ ID NO: 1193548 - RNA, 22 nt, Homo sapiens
cauguuggccaggcuggucuca

SEQ ID NO: 1193549 - RNA, 17 nt, Homo sapiens
cauguuguaaugcugca

SEQ ID NO: 1193550 - RNA, 16 nt, Homo sapiens
cauguuuccaucauuu

SEQ ID NO: 1193551 - RNA, 11 nt, Homo sapiens
cauguuugcag

SEQ ID NO: 1193552 - RNA, 18 nt, Homo sapiens
cauuaaaauaaaccaaau

SEQ ID NO: 1193553 - RNA, 17 nt, Homo sapiens
cauuaaaccugucucca

SEQ ID NO: 1193554 - RNA, 15 nt, Homo sapiens
cauuaaacuuaccug

SEQ ID NO: 1193555 - RNA, 18 nt, Homo sapiens
cauuaaauucacaaacuu

SEQ ID NO: 1193556 - RNA, 15 nt, Homo sapiens
cauuaacugcacaaa

SEQ ID NO: 1193557 - RNA, 23 nt, Homo sapiens
cauuaaggggaagaaugaaagcu

SEQ ID NO: 1193558 - RNA, 16 nt, Homo sapiens
cauuaaguaaucaaua

SEQ ID NO: 1193559 - RNA, 13 nt, Homo sapiens
cauuaaugcaaug

SEQ ID NO: 1193560 - RNA, 17 nt, Homo sapiens
cauuacaaaaaaacacg

SEQ ID NO: 1193561 - RNA, 23 nt, Homo sapiens
cauuacagagaggagaaacacau

SEQ ID NO: 1193562 - RNA, 18 nt, Homo sapiens
cauuacuauucacugaug

SEQ ID NO: 1193563 - RNA, 14 nt, Homo sapiens
cccacagacugguu

SEQ ID NO: 1193564 - RNA, 17 nt, Homo sapiens
cccacagcuaccugaga

SEQ ID NO: 1193565 - RNA, 13 nt, Homo sapiens
cccacaguaggca

SEQ ID NO: 1193566 - RNA, 14 nt, Homo sapiens
cccacauucugaug

SEQ ID NO: 1193567 - RNA, 11 nt, Homo sapiens
cccacccaguc

SEQ ID NO: 1193568 - RNA, 13 nt, Homo sapiens
cccacccagucuc

SEQ ID NO: 1193569 - RNA, 21 nt, Homo sapiens
cccacccuccuuucaccacau

SEQ ID NO: 1193570 - RNA, 17 nt, Homo sapiens
cccacccuugagaaggu

SEQ ID NO: 1193571 - RNA, 19 nt, Homo sapiens
cccaccuagugcuuccacu

SEQ ID NO: 1193572 - RNA, 13 nt, Homo sapiens
cccaccuccagcc

SEQ ID NO: 1193573 - RNA, 12 nt, Homo sapiens
cccaccucuggc

SEQ ID NO: 1193574 - RNA, 23 nt, Homo sapiens
cccacgugggccuuuugcucagu

SEQ ID NO: 1193575 - RNA, 13 nt, Homo sapiens
cccacucuaggag

SEQ ID NO: 1193576 - RNA, 15 nt, Homo sapiens
cccacuucugccaua

SEQ ID NO: 1193577 - RNA, 21 nt, Homo sapiens
cccagaaggaaccagccauga

SEQ ID NO: 1193578 - RNA, 13 nt, Homo sapiens
cccagacaaccaa

SEQ ID NO: 1193579 - RNA, 17 nt, Homo sapiens
cccagacaaccaaaaca

SEQ ID NO: 1193580 - RNA, 19 nt, Homo sapiens
cccagacaaccaaaacaua

SEQ ID NO: 1193581 - RNA, 15 nt, Homo sapiens
cccagacacagccca

SEQ ID NO: 1193582 - RNA, 18 nt, Homo sapiens
cccagagcaaaauaauuu

SEQ ID NO: 1193583 - RNA, 14 nt, Homo sapiens
cccagagcacuuua

SEQ ID NO: 1193584 - RNA, 12 nt, Homo sapiens
cccagagcagga

SEQ ID NO: 1193585 - RNA, 16 nt, Homo sapiens
cccagagucaucugau

SEQ ID NO: 1193586 - RNA, 22 nt, Homo sapiens
cccagagugcugggauuacaau

SEQ ID NO: 1193587 - RNA, 12 nt, Homo sapiens
cccagauugcaa

SEQ ID NO: 1193588 - RNA, 15 nt, Homo sapiens
cccagcagggccuca

SEQ ID NO: 1193589 - RNA, 20 nt, Homo sapiens
cccagcagugucacucugua

SEQ ID NO: 1193590 - RNA, 15 nt, Homo sapiens
cccagcauccagcug

SEQ ID NO: 1193591 - RNA, 19 nt, Homo sapiens
cccagcaucccuggagcag

SEQ ID NO: 1193592 - RNA, 15 nt, Homo sapiens
cccagccacacccag

SEQ ID NO: 1193593 - RNA, 16 nt, Homo sapiens
cccagcccacccugcu

SEQ ID NO: 1193594 - RNA, 20 nt, Homo sapiens
cccagcccacuucugccaua

SEQ ID NO: 1193595 - RNA, 17 nt, Homo sapiens
cccagcccuauggaugu

SEQ ID NO: 1193596 - RNA, 15 nt, Homo sapiens
cccagcccugcugca

SEQ ID NO: 1193597 - RNA, 22 nt, Homo sapiens
cccagccggcaggccuggacuu

SEQ ID NO: 1193598 - RNA, 18 nt, Homo sapiens
cccagccucccaaagugc

SEQ ID NO: 1193599 - RNA, 15 nt, Homo sapiens
cccagccuucacuga

SEQ ID NO: 1193600 - RNA, 22 nt, Homo sapiens
cccagccuucagucacaugcua

SEQ ID NO: 1193601 - RNA, 20 nt, Homo sapiens
cccagcguagucaagggugg

SEQ ID NO: 1193602 - RNA, 14 nt, Homo sapiens
cccagcuaccccuu

SEQ ID NO: 1193603 - RNA, 17 nt, Homo sapiens
cccagcugaaggcagug

SEQ ID NO: 1193604 - RNA, 19 nt, Homo sapiens
cccagcuuugcugccugag

SEQ ID NO: 1193605 - RNA, 22 nt, Homo sapiens
cccagcuuuuagaaaaugcagu

SEQ ID NO: 1193606 - RNA, 13 nt, Homo sapiens
cccaggaagccca

SEQ ID NO: 1193607 - RNA, 16 nt, Homo sapiens
cccaggaaguggccaa

SEQ ID NO: 1193608 - RNA, 17 nt, Homo sapiens
cccaggaaugcaagugg

SEQ ID NO: 1193609 - RNA, 19 nt, Homo sapiens
cccaggaauucaagguugg

SEQ ID NO: 1193610 - RNA, 15 nt, Homo sapiens
cccaggacagccaca

SEQ ID NO: 1193611 - RNA, 21 nt, Homo sapiens
cccaggagaaaagaagacauu

SEQ ID NO: 1193612 - RNA, 16 nt, Homo sapiens
cccaggaguguggcca

SEQ ID NO: 1193613 - RNA, 15 nt, Homo sapiens
cccaggauacuggca

SEQ ID NO: 1193614 - RNA, 18 nt, Homo sapiens
cccaggcuccagccacag

SEQ ID NO: 1193615 - RNA, 17 nt, Homo sapiens
cccaggcuggagugcaa

SEQ ID NO: 1193616 - RNA, 17 nt, Homo sapiens
cccaggcugugcagcgc

SEQ ID NO: 1193617 - RNA, 17 nt, Homo sapiens
cccagggaagccaaaag

SEQ ID NO: 1193618 - RNA, 21 nt, Homo sapiens
cccagggacugcaaguggcca

SEQ ID NO: 1193619 - RNA, 22 nt, Homo sapiens
cccagggacugcaaguggccau

SEQ ID NO: 1193620 - RNA, 19 nt, Homo sapiens
cccagggcuccugcacuua

SEQ ID NO: 1193621 - RNA, 15 nt, Homo sapiens
cccaggguccacuga

SEQ ID NO: 1193622 - RNA, 15 nt, Homo sapiens
cccagguguggcugu

SEQ ID NO: 1193623 - RNA, 15 nt, Homo sapiens
cccaguauaccucau

SEQ ID NO: 1193624 - RNA, 13 nt, Homo sapiens
cccaguauucuca

SEQ ID NO: 1193625 - RNA, 23 nt, Homo sapiens
cccaguuaaauuuucauuucaga

SEQ ID NO: 1193626 - RNA, 19 nt, Homo sapiens
cccaguucauugcacuuug

SEQ ID NO: 1193627 - RNA, 22 nt, Homo sapiens
cccaguucugaauaacuugaag

SEQ ID NO: 1193628 - RNA, 19 nt, Homo sapiens
cccaguuucuucuuacacu

SEQ ID NO: 1193629 - RNA, 13 nt, Homo sapiens
cccauacucagcc

SEQ ID NO: 1193630 - RNA, 20 nt, Homo sapiens
cccauacucuccuuuugacu

SEQ ID NO: 1193631 - RNA, 23 nt, Homo sapiens
cccauagguggcugagcaucgga

SEQ ID NO: 1193632 - RNA, 15 nt, Homo sapiens
cccauaucugugaaa

SEQ ID NO: 1193633 - RNA, 23 nt, Homo sapiens
cccauaucugugaaaugcuggca

SEQ ID NO: 1193634 - RNA, 19 nt, Homo sapiens
cccauccccuuuacuauca

SEQ ID NO: 1193635 - RNA, 15 nt, Homo sapiens
cccaucucuacugaa

SEQ ID NO: 1193636 - RNA, 22 nt, Homo sapiens
cccaucuuacuggaagagaguu

SEQ ID NO: 1193637 - RNA, 16 nt, Homo sapiens
cccaucuuaucaagga

SEQ ID NO: 1193638 - RNA, 23 nt, Homo sapiens
cccaucuuccaacccacuggccc

SEQ ID NO: 1193639 - RNA, 16 nt, Homo sapiens
cccaugaguccuugaa

SEQ ID NO: 1193640 - RNA, 16 nt, Homo sapiens
cccaugcaggcccuuu

SEQ ID NO: 1193641 - RNA, 20 nt, Homo sapiens
cccaugcccuggauccauca

SEQ ID NO: 1193642 - RNA, 23 nt, Homo sapiens
cccaugccuggucccaagacagu

SEQ ID NO: 1193643 - RNA, 21 nt, Homo sapiens
cccauggcuuuagcuaccuca

SEQ ID NO: 1193644 - RNA, 20 nt, Homo sapiens
cccauguugaucuuucucaa

SEQ ID NO: 1193645 - RNA, 12 nt, Homo sapiens
cccauucuugca

SEQ ID NO: 1193646 - RNA, 22 nt, Homo sapiens
cccauugaaacaaaacauugau

SEQ ID NO: 1193647 - RNA, 17 nt, Homo sapiens
cccauuggugaccugcg

SEQ ID NO: 1193648 - RNA, 14 nt, Homo sapiens
cccauuuacacuuu

SEQ ID NO: 1193649 - RNA, 20 nt, Homo sapiens
cccauuugugccagaggaau

SEQ ID NO: 1193650 - RNA, 21 nt, Homo sapiens
cccauuuucaacugcuuugaa

SEQ ID NO: 1193651 - RNA, 14 nt, Homo sapiens
ccccaacacuccag

SEQ ID NO: 1193652 - RNA, 14 nt, Homo sapiens
ccccaaccacagag

SEQ ID NO: 1193653 - RNA, 19 nt, Homo sapiens
ccccaagcagccagccagu

SEQ ID NO: 1193654 - RNA, 21 nt, Homo sapiens
ccccaaguccuggugucucca

SEQ ID NO: 1193655 - RNA, 18 nt, Homo sapiens
ccccaauuucggauuuuu

SEQ ID NO: 1193656 - RNA, 21 nt, Homo sapiens
ccccacaggcuggcgcucggc

SEQ ID NO: 1193657 - RNA, 12 nt, Homo sapiens
ccccaccacaaa

SEQ ID NO: 1193658 - RNA, 23 nt, Homo sapiens
ccccacccaacagccaccaagcc

SEQ ID NO: 1193659 - RNA, 16 nt, Homo sapiens
ccccaccucuggucca

SEQ ID NO: 1193660 - RNA, 23 nt, Homo sapiens
ccccaccugcagggcugcccuga

SEQ ID NO: 1193661 - RNA, 17 nt, Homo sapiens
ccccacucuaccuccuu

SEQ ID NO: 1193662 - RNA, 17 nt, Homo sapiens
ccccagagaugucauca

SEQ ID NO: 1193663 - RNA, 20 nt, Homo sapiens
ccccagaggcucagcacuuu

SEQ ID NO: 1193664 - RNA, 20 nt, Homo sapiens
ccccagauuuaaaaaaagaa

SEQ ID NO: 1193665 - RNA, 12 nt, Homo sapiens
ccccagcacuug

SEQ ID NO: 1193666 - RNA, 23 nt, Homo sapiens
ccccagccugcucccuagccaga

SEQ ID NO: 1193667 - RNA, 20 nt, Homo sapiens
ccccaggcaaggaugucuga

SEQ ID NO: 1193668 - RNA, 14 nt, Homo sapiens
ccccaggggcgagu

SEQ ID NO: 1193669 - RNA, 14 nt, Homo sapiens
ccccaguccaugcu

SEQ ID NO: 1193670 - RNA, 21 nt, Homo sapiens
ccccagugguauccugugaca

SEQ ID NO: 1193671 - RNA, 21 nt, Homo sapiens
ccccauagguggcugagcauc

SEQ ID NO: 1193672 - RNA, 18 nt, Homo sapiens
ccccaucauguggcccaa

SEQ ID NO: 1193673 - RNA, 15 nt, Homo sapiens
ccccaucuuccaacc

SEQ ID NO: 1193674 - RNA, 15 nt, Homo sapiens
ccccaucuuuacaaa

SEQ ID NO: 1193675 - RNA, 15 nt, Homo sapiens
ccccaugccugucca

SEQ ID NO: 1193676 - RNA, 20 nt, Homo sapiens
ccccauuuccccgauguccc

SEQ ID NO: 1193677 - RNA, 16 nt, Homo sapiens
cccccaaaucaagcag

SEQ ID NO: 1193678 - RNA, 16 nt, Homo sapiens
cccccacccaccucca

SEQ ID NO: 1193679 - RNA, 18 nt, Homo sapiens
cccccacgugacagugcc

SEQ ID NO: 1193680 - RNA, 19 nt, Homo sapiens
cccccaucuuuacaaagaa

SEQ ID NO: 1193681 - RNA, 18 nt, Homo sapiens
cccccauucacuuuguca

SEQ ID NO: 1193682 - RNA, 23 nt, Homo sapiens
cccccucaaaccuccucuucuga

SEQ ID NO: 1193683 - RNA, 17 nt, Homo sapiens
cccccucuguugcacau

SEQ ID NO: 1193684 - RNA, 16 nt, Homo sapiens
cccccuguucuaaggg

SEQ ID NO: 1193685 - RNA, 19 nt, Homo sapiens
ccccgaggagcccgaaguc

SEQ ID NO: 1193686 - RNA, 22 nt, Homo sapiens
ccccgcgcucgcccagcaggag

SEQ ID NO: 1193687 - RNA, 16 nt, Homo sapiens
ccccgcuaaggaagau

SEQ ID NO: 1193688 - RNA, 13 nt, Homo sapiens
ccccuacaugaaa

SEQ ID NO: 1193689 - RNA, 22 nt, Homo sapiens
ccccuauccuuggcaccaaaga

SEQ ID NO: 1193690 - RNA, 12 nt, Homo sapiens
ccccucaagaaa

SEQ ID NO: 1193691 - RNA, 23 nt, Homo sapiens
ccccucauccgauuccccuguag

SEQ ID NO: 1193692 - RNA, 12 nt, Homo sapiens
ccccucaugccu

SEQ ID NO: 1193693 - RNA, 15 nt, Homo sapiens
ccccucccccaucuc

SEQ ID NO: 1193694 - RNA, 18 nt, Homo sapiens
ccccucgugcgcaucuca

SEQ ID NO: 1193695 - RNA, 21 nt, Homo sapiens
ccccucucugggcagucagaa

SEQ ID NO: 1193696 - RNA, 19 nt, Homo sapiens
ccccugaaguagaucauaa

SEQ ID NO: 1193697 - RNA, 15 nt, Homo sapiens
ccccuggcagcacag

SEQ ID NO: 1193698 - RNA, 15 nt, Homo sapiens
ccccuggcugugcuc

SEQ ID NO: 1193699 - RNA, 14 nt, Homo sapiens
ccccuguaccuuuu

SEQ ID NO: 1193700 - RNA, 20 nt, Homo sapiens
ccccuguggccaacugcaaa

SEQ ID NO: 1193701 - RNA, 22 nt, Homo sapiens
ccccuuccagaucacugccaca

SEQ ID NO: 1193702 - RNA, 14 nt, Homo sapiens
ccccuucuguguca

SEQ ID NO: 1193703 - RNA, 15 nt, Homo sapiens
cccgaagaauggaga

SEQ ID NO: 1193704 - RNA, 17 nt, Homo sapiens
cccgagaagcacuugag

SEQ ID NO: 1193705 - RNA, 18 nt, Homo sapiens
cccgagcuguuaccauuc

SEQ ID NO: 1193706 - RNA, 17 nt, Homo sapiens
cccgaguaacugagauu

SEQ ID NO: 1193707 - RNA, 18 nt, Homo sapiens
cccgaguaacugagauua

SEQ ID NO: 1193708 - RNA, 19 nt, Homo sapiens
cccggagguugggugggcc

SEQ ID NO: 1193709 - RNA, 16 nt, Homo sapiens
cccggcaaugggaccu

SEQ ID NO: 1193710 - RNA, 19 nt, Homo sapiens
cccggcucguguauuuauu

SEQ ID NO: 1193711 - RNA, 14 nt, Homo sapiens
cccgggcugccugg

SEQ ID NO: 1193712 - RNA, 17 nt, Homo sapiens
cccggggcuccacugaa

SEQ ID NO: 1193713 - RNA, 18 nt, Homo sapiens
cccggugguuugccaugu

SEQ ID NO: 1193714 - RNA, 14 nt, Homo sapiens
cccgucauguuccu

SEQ ID NO: 1193715 - RNA, 22 nt, Homo sapiens
cccgucucuauaccaaccaaac

SEQ ID NO: 1193716 - RNA, 20 nt, Homo sapiens
cccguggucuccuugcacuu

SEQ ID NO: 1193717 - RNA, 23 nt, Homo sapiens
cccguuucauuuagucaugugac

SEQ ID NO: 1193718 - RNA, 21 nt, Homo sapiens
cccuaaaaauccagacucuuu

SEQ ID NO: 1193719 - RNA, 19 nt, Homo sapiens
cccuaauuuaugugcuaua

SEQ ID NO: 1193720 - RNA, 15 nt, Homo sapiens
cccuaccaugaaucc

SEQ ID NO: 1193721 - RNA, 14 nt, Homo sapiens
cccuacccaccgau

SEQ ID NO: 1193722 - RNA, 15 nt, Homo sapiens
cccuagaaacccaag

SEQ ID NO: 1193723 - RNA, 13 nt, Homo sapiens
cccuagcagugaa

SEQ ID NO: 1193724 - RNA, 23 nt, Homo sapiens
cccuagccagagaauagaucagu

SEQ ID NO: 1193725 - RNA, 22 nt, Homo sapiens
cccuaguuaguguuuugccuca

SEQ ID NO: 1193726 - RNA, 13 nt, Homo sapiens
cccuauacacuag

SEQ ID NO: 1193727 - RNA, 17 nt, Homo sapiens
cccuauuuauugacuuu

SEQ ID NO: 1193728 - RNA, 14 nt, Homo sapiens
cccucaaaucugag

SEQ ID NO: 1193729 - RNA, 22 nt, Homo sapiens
cccucaacagccaagugugacc

SEQ ID NO: 1193730 - RNA, 13 nt, Homo sapiens
cccucaacaggcc

SEQ ID NO: 1193731 - RNA, 18 nt, Homo sapiens
cccucaaccuccugugga

SEQ ID NO: 1193732 - RNA, 16 nt, Homo sapiens
cccucaacuauucugu

SEQ ID NO: 1193733 - RNA, 17 nt, Homo sapiens
cccucacacacacagcu

SEQ ID NO: 1193734 - RNA, 17 nt, Homo sapiens
cccucaccccuccaagc

SEQ ID NO: 1193735 - RNA, 14 nt, Homo sapiens
cccucagacauccc

SEQ ID NO: 1193736 - RNA, 13 nt, Homo sapiens
cccucagacuuca

SEQ ID NO: 1193737 - RNA, 21 nt, Homo sapiens
cccucaggggaaaacuguuac

SEQ ID NO: 1193738 - RNA, 13 nt, Homo sapiens
cccucaugaaaac

SEQ ID NO: 1193739 - RNA, 19 nt, Homo sapiens
cccucaugauauguccuca

SEQ ID NO: 1193740 - RNA, 11 nt, Homo sapiens
cccucaugcaa

SEQ ID NO: 1193741 - RNA, 16 nt, Homo sapiens
cccuccaaaagcacuu

SEQ ID NO: 1193742 - RNA, 13 nt, Homo sapiens
cccuccaauccca

SEQ ID NO: 1193743 - RNA, 15 nt, Homo sapiens
cccuccaccuuccau

SEQ ID NO: 1193744 - RNA, 15 nt, Homo sapiens
cccuccacuccaucc

SEQ ID NO: 1193745 - RNA, 14 nt, Homo sapiens
cccuccacuccuca

SEQ ID NO: 1193746 - RNA, 14 nt, Homo sapiens
cccuccacugucac

SEQ ID NO: 1193747 - RNA, 14 nt, Homo sapiens
cccuccaguaccau

SEQ ID NO: 1193748 - RNA, 14 nt, Homo sapiens
cccuccaguccucu

SEQ ID NO: 1193749 - RNA, 16 nt, Homo sapiens
cccuccccucguguca

SEQ ID NO: 1193750 - RNA, 12 nt, Homo sapiens
cccuccuguaaa

SEQ ID NO: 1193751 - RNA, 20 nt, Homo sapiens
cccuccuugggucauugacc

SEQ ID NO: 1193752 - RNA, 19 nt, Homo sapiens
cccucgcaugacuguuaca

SEQ ID NO: 1193753 - RNA, 22 nt, Homo sapiens
cccucggagugccacacaugcc

SEQ ID NO: 1193754 - RNA, 22 nt, Homo sapiens
cccucuccuuccuuacccaaac

SEQ ID NO: 1193755 - RNA, 14 nt, Homo sapiens
cccucucucugggc

SEQ ID NO: 1193756 - RNA, 13 nt, Homo sapiens
cccucucugccag

SEQ ID NO: 1193757 - RNA, 21 nt, Homo sapiens
cccucucugcuccuucacugu

SEQ ID NO: 1193758 - RNA, 21 nt, Homo sapiens
cccucuguaacaacucuaguc

SEQ ID NO: 1193759 - RNA, 19 nt, Homo sapiens
cccucuguagccacuagua

SEQ ID NO: 1193760 - RNA, 11 nt, Homo sapiens
cccucuuccaa

SEQ ID NO: 1193761 - RNA, 14 nt, Homo sapiens
cccucuucccagaa

SEQ ID NO: 1193762 - RNA, 22 nt, Homo sapiens
cccucuuuucugaucugcaguu

SEQ ID NO: 1193763 - RNA, 23 nt, Homo sapiens
cccucuuuucugaucugcaguuu

SEQ ID NO: 1193764 - RNA, 13 nt, Homo sapiens
cccugaagccagc

SEQ ID NO: 1193765 - RNA, 15 nt, Homo sapiens
cccugacucaucauu

SEQ ID NO: 1193766 - RNA, 16 nt, Homo sapiens
cccugaguucauccag

SEQ ID NO: 1193767 - RNA, 14 nt, Homo sapiens
cccugaucaaguca

SEQ ID NO: 1193768 - RNA, 17 nt, Homo sapiens
cccugaucuagugcagu

SEQ ID NO: 1193769 - RNA, 15 nt, Homo sapiens
cccugaugugacauu

SEQ ID NO: 1193770 - RNA, 12 nt, Homo sapiens
cccugauuucuu

SEQ ID NO: 1193771 - RNA, 14 nt, Homo sapiens
cccugcacaaagcc

SEQ ID NO: 1193772 - RNA, 17 nt, Homo sapiens
cccugcagagcacaaac

SEQ ID NO: 1193773 - RNA, 18 nt, Homo sapiens
cccugcagggccaagcac

SEQ ID NO: 1193774 - RNA, 17 nt, Homo sapiens
cccugccccguggagcc

SEQ ID NO: 1193775 - RNA, 15 nt, Homo sapiens
cccugcccuggucca

SEQ ID NO: 1193776 - RNA, 19 nt, Homo sapiens
cccugcgcaugaaccugga

SEQ ID NO: 1193777 - RNA, 20 nt, Homo sapiens
cccugcuccacgaagccuua

SEQ ID NO: 1193778 - RNA, 14 nt, Homo sapiens
cccugcuccugcag

SEQ ID NO: 1193779 - RNA, 14 nt, Homo sapiens
cccugcugaccucc

SEQ ID NO: 1193780 - RNA, 22 nt, Homo sapiens
cccugcugaccucccagugacc

SEQ ID NO: 1193781 - RNA, 14 nt, Homo sapiens
cccuggagcaagac

SEQ ID NO: 1193782 - RNA, 20 nt, Homo sapiens
cccuggaucuaccagcauaa

SEQ ID NO: 1193783 - RNA, 15 nt, Homo sapiens
cccuggaugacauua

SEQ ID NO: 1193784 - RNA, 22 nt, Homo sapiens
cccuggccccacaagccaggac

SEQ ID NO: 1193785 - RNA, 21 nt, Homo sapiens
cccuggcccccaguagugugu

SEQ ID NO: 1193786 - RNA, 22 nt, Homo sapiens
cccugguggagaaagcacugac

SEQ ID NO: 1193787 - RNA, 13 nt, Homo sapiens
cccuggugucaca

SEQ ID NO: 1193788 - RNA, 19 nt, Homo sapiens
cccuguaaccugacugguu

SEQ ID NO: 1193789 - RNA, 15 nt, Homo sapiens
cccugucccaugcag

SEQ ID NO: 1193790 - RNA, 22 nt, Homo sapiens
cccugucccucccaccucugug

SEQ ID NO: 1193791 - RNA, 17 nt, Homo sapiens
cccuguccuaagcacuu

SEQ ID NO: 1193792 - RNA, 21 nt, Homo sapiens
cccuguccuaagcacuuuaua

SEQ ID NO: 1193793 - RNA, 16 nt, Homo sapiens
cccuguccugaugguc

SEQ ID NO: 1193794 - RNA, 14 nt, Homo sapiens
cccugucuuccaca

SEQ ID NO: 1193795 - RNA, 17 nt, Homo sapiens
cccugucuuccacagcc

SEQ ID NO: 1193796 - RNA, 20 nt, Homo sapiens
cccugugcccugcacguaua

SEQ ID NO: 1193797 - RNA, 19 nt, Homo sapiens
cccugugcuccgugccucc

SEQ ID NO: 1193798 - RNA, 20 nt, Homo sapiens
cccuguggccaacugcaaaa

SEQ ID NO: 1193799 - RNA, 21 nt, Homo sapiens
cccuguggccaacugcaaaaa

SEQ ID NO: 1193800 - RNA, 13 nt, Homo sapiens
cccugugggucaa

SEQ ID NO: 1193801 - RNA, 20 nt, Homo sapiens
cccuguguauucaccaccaa

SEQ ID NO: 1193802 - RNA, 23 nt, Homo sapiens
cccuguuuucugagcccgggcug

SEQ ID NO: 1193803 - RNA, 17 nt, Homo sapiens
cccuuagccucccugaa

SEQ ID NO: 1193804 - RNA, 17 nt, Homo sapiens
cccuuauaauuggugca

SEQ ID NO: 1193805 - RNA, 14 nt, Homo sapiens
cccuuauacagugg

SEQ ID NO: 1193806 - RNA, 12 nt, Homo sapiens
cccuucaaaagc

SEQ ID NO: 1193807 - RNA, 16 nt, Homo sapiens
cccuucccaaucagca

SEQ ID NO: 1193808 - RNA, 18 nt, Homo sapiens
cccuucccuguccuugcc

SEQ ID NO: 1193809 - RNA, 18 nt, Homo sapiens
cccuuccuaagucuguca

SEQ ID NO: 1193810 - RNA, 13 nt, Homo sapiens
cccuuccuggaaa

SEQ ID NO: 1193811 - RNA, 21 nt, Homo sapiens
cccuugagaaggugcuuugua

SEQ ID NO: 1193812 - RNA, 22 nt, Homo sapiens
cccuugcuguaugcugaucauc

SEQ ID NO: 1193813 - RNA, 20 nt, Homo sapiens
cccuuucuguaccauuuauu

SEQ ID NO: 1193814 - RNA, 19 nt, Homo sapiens
cccuuugaagccucagcua

SEQ ID NO: 1193815 - RNA, 14 nt, Homo sapiens
cccuuugccuucau

SEQ ID NO: 1193816 - RNA, 14 nt, Homo sapiens
cccuuugcuucaaa

SEQ ID NO: 1193817 - RNA, 12 nt, Homo sapiens
ccgaaaugccac

SEQ ID NO: 1193818 - RNA, 18 nt, Homo sapiens
ccgaacuuuaauuucagg

SEQ ID NO: 1193819 - RNA, 14 nt, Homo sapiens
ccgaagaauggaga

SEQ ID NO: 1193820 - RNA, 16 nt, Homo sapiens
ccgaaguaugagggaa

SEQ ID NO: 1193821 - RNA, 20 nt, Homo sapiens
ccgaagucuuuuguucgcau

SEQ ID NO: 1193822 - RNA, 12 nt, Homo sapiens
ccgaauccacag

SEQ ID NO: 1193823 - RNA, 16 nt, Homo sapiens
ccgacucugcacucuc

SEQ ID NO: 1193824 - RNA, 12 nt, Homo sapiens
ccgagaagaaca

SEQ ID NO: 1193825 - RNA, 22 nt, Homo sapiens
ccgagagaugacacuagucaga

SEQ ID NO: 1193826 - RNA, 12 nt, Homo sapiens
ccgagcaaagau

SEQ ID NO: 1193827 - RNA, 17 nt, Homo sapiens
ccgagccaggaacugug

SEQ ID NO: 1193828 - RNA, 22 nt, Homo sapiens
ccgaggccugcauguccggcug

SEQ ID NO: 1193829 - RNA, 20 nt, Homo sapiens
ccgagucucuucuccacugg

SEQ ID NO: 1193830 - RNA, 20 nt, Homo sapiens
ccgagugcucugaugcaaua

SEQ ID NO: 1193831 - RNA, 14 nt, Homo sapiens
ccgcacaugcacac

SEQ ID NO: 1193832 - RNA, 12 nt, Homo sapiens
ccgcacuuccuu

SEQ ID NO: 1193833 - RNA, 23 nt, Homo sapiens
ccgcagaagcccugauguguccu

SEQ ID NO: 1193834 - RNA, 13 nt, Homo sapiens
ccgcagaauggac

SEQ ID NO: 1193835 - RNA, 20 nt, Homo sapiens
ccgcaggcagacuacacagg

SEQ ID NO: 1193836 - RNA, 12 nt, Homo sapiens
ccgcugagcuga

SEQ ID NO: 1193837 - RNA, 21 nt, Homo sapiens
ccgcugcuuccuggcugggaa

SEQ ID NO: 1193838 - RNA, 14 nt, Homo sapiens
ccgcugggugguuu

SEQ ID NO: 1193839 - RNA, 21 nt, Homo sapiens
ccgcuuugagucccccagaga

SEQ ID NO: 1193840 - RNA, 16 nt, Homo sapiens
ccggaaccacagggcc

SEQ ID NO: 1193841 - RNA, 22 nt, Homo sapiens
ccggaagucaucccagugcaca

SEQ ID NO: 1193842 - RNA, 21 nt, Homo sapiens
ccggaguucugcccaugggaa

SEQ ID NO: 1193843 - RNA, 18 nt, Homo sapiens
ccggaugcuucuccauga

SEQ ID NO: 1193844 - RNA, 19 nt, Homo sapiens
ccggcacccugauccucac

SEQ ID NO: 1193845 - RNA, 18 nt, Homo sapiens
ccggcaggcccugcagug

SEQ ID NO: 1193846 - RNA, 23 nt, Homo sapiens
ccggccaaaauaaugcaccacuu

SEQ ID NO: 1193847 - RNA, 13 nt, Homo sapiens
ccggccaccagau

SEQ ID NO: 1193848 - RNA, 20 nt, Homo sapiens
ccggccagcgggcacagggc

SEQ ID NO: 1193849 - RNA, 17 nt, Homo sapiens
ccggccgauggagacac

SEQ ID NO: 1193850 - RNA, 24 nt, Homo sapiens
ccggccgauggagacaccaaccga

SEQ ID NO: 1193851 - RNA, 21 nt, Homo sapiens
ccggccucagggcgcucagac

SEQ ID NO: 1193852 - RNA, 23 nt, Homo sapiens
ccggcgaaauaaaaucagaguug

SEQ ID NO: 1193853 - RNA, 21 nt, Homo sapiens
ccggcgaggguaugucagugu

SEQ ID NO: 1193854 - RNA, 12 nt, Homo sapiens
ccggcucuuucc

SEQ ID NO: 1193855 - RNA, 12 nt, Homo sapiens
ccggcugcgugg

SEQ ID NO: 1193856 - RNA, 14 nt, Homo sapiens
ccgggcuggagaaa

SEQ ID NO: 1193857 - RNA, 19 nt, Homo sapiens
ccgggcuggccugugccua

SEQ ID NO: 1193858 - RNA, 15 nt, Homo sapiens
ccggggaaaggcaag

SEQ ID NO: 1193859 - RNA, 20 nt, Homo sapiens
ccggggcaggugcagcccuu

SEQ ID NO: 1193860 - RNA, 17 nt, Homo sapiens
ccggugcaugaugcugc

SEQ ID NO: 1193861 - RNA, 12 nt, Homo sapiens
ccggugcucugg

SEQ ID NO: 1193862 - RNA, 19 nt, Homo sapiens
ccgguggcggcagggccag

SEQ ID NO: 1193863 - RNA, 18 nt, Homo sapiens
ccguaacaacugugguca

SEQ ID NO: 1193864 - RNA, 17 nt, Homo sapiens
ccguacaucugcaauau

SEQ ID NO: 1193865 - RNA, 14 nt, Homo sapiens
ccguaccaaucucu

SEQ ID NO: 1193866 - RNA, 16 nt, Homo sapiens
ccguaccccacccuca

SEQ ID NO: 1193867 - RNA, 16 nt, Homo sapiens
ccguauugguauacuu

SEQ ID NO: 1193868 - RNA, 16 nt, Homo sapiens
ccgucacccaacauca

SEQ ID NO: 1193869 - RNA, 14 nt, Homo sapiens
ccgucucuuuaaaa

SEQ ID NO: 1193870 - RNA, 11 nt, Homo sapiens
ccgucuucucc

SEQ ID NO: 1193871 - RNA, 21 nt, Homo sapiens
ccgucuucucccuauucccuc

SEQ ID NO: 1193872 - RNA, 13 nt, Homo sapiens
ccgugaccaucuu

SEQ ID NO: 1193873 - RNA, 13 nt, Homo sapiens
ccgugacugcaau

SEQ ID NO: 1193874 - RNA, 11 nt, Homo sapiens
ccgugccuuca

SEQ ID NO: 1193875 - RNA, 15 nt, Homo sapiens
ccguguugcaugaag

SEQ ID NO: 1193876 - RNA, 21 nt, Homo sapiens
ccguuaaggcacguucuuucc

SEQ ID NO: 1193877 - RNA, 22 nt, Homo sapiens
ccguuuaccuagaagaagcuau

SEQ ID NO: 1193878 - RNA, 19 nt, Homo sapiens
ccuaaaaauaaacaaaaag

SEQ ID NO: 1193879 - RNA, 17 nt, Homo sapiens
ccuaaaaguucauaaca

SEQ ID NO: 1193880 - RNA, 11 nt, Homo sapiens
ccuaaaaucuu

SEQ ID NO: 1193881 - RNA, 22 nt, Homo sapiens
ccuaaaccuccuucagaucucu

SEQ ID NO: 1193882 - RNA, 17 nt, Homo sapiens
ccuaaacuguacaugug

SEQ ID NO: 1193883 - RNA, 20 nt, Homo sapiens
ccuaaauauccaaagacugu

SEQ ID NO: 1193884 - RNA, 14 nt, Homo sapiens
ccuaaauguuaacu

SEQ ID NO: 1193885 - RNA, 22 nt, Homo sapiens
ccuaaauguuaacuacauauug

SEQ ID NO: 1193886 - RNA, 13 nt, Homo sapiens
ccuaacaaaagau

SEQ ID NO: 1193887 - RNA, 16 nt, Homo sapiens
ccuaacacggugcuca

SEQ ID NO: 1193888 - RNA, 18 nt, Homo sapiens
ccuaagacacaaaugcau

SEQ ID NO: 1193889 - RNA, 23 nt, Homo sapiens
ccuaagagauuuaucuuuauaca

SEQ ID NO: 1193890 - RNA, 12 nt, Homo sapiens
ccuaagcacuuu

SEQ ID NO: 1193891 - RNA, 18 nt, Homo sapiens
ccuaagcagaaaacuggc

SEQ ID NO: 1193892 - RNA, 16 nt, Homo sapiens
ccuaaggaaccuuccu

SEQ ID NO: 1193893 - RNA, 18 nt, Homo sapiens
ccuaaggaucucucagga

SEQ ID NO: 1193894 - RNA, 14 nt, Homo sapiens
ccuaaggugucuga

SEQ ID NO: 1193895 - RNA, 12 nt, Homo sapiens
ccuaaguacugu

SEQ ID NO: 1193896 - RNA, 16 nt, Homo sapiens
ccuaagucacuuugag

SEQ ID NO: 1193897 - RNA, 17 nt, Homo sapiens
ccuaauacaacauguag

SEQ ID NO: 1193898 - RNA, 19 nt, Homo sapiens
ccuaaugcuuuauccauca

SEQ ID NO: 1193899 - RNA, 14 nt, Homo sapiens
ccuacaagauuuag

SEQ ID NO: 1193900 - RNA, 13 nt, Homo sapiens
ccuacacugaugc

SEQ ID NO: 1193901 - RNA, 12 nt, Homo sapiens
ccuacagaauuu

SEQ ID NO: 1193902 - RNA, 22 nt, Homo sapiens
ccuacaggugcuguucagugcc

SEQ ID NO: 1193903 - RNA, 21 nt, Homo sapiens
ccuacauguauugcacauugu

SEQ ID NO: 1193904 - RNA, 20 nt, Homo sapiens
ccuacaugucuuuucuucca

SEQ ID NO: 1193905 - RNA, 15 nt, Homo sapiens
ccuaccaaaauggaa

SEQ ID NO: 1193906 - RNA, 15 nt, Homo sapiens
ccuaccaucagggac

SEQ ID NO: 1193907 - RNA, 13 nt, Homo sapiens
ccuacccaguucc

SEQ ID NO: 1193908 - RNA, 21 nt, Homo sapiens
ccuacccccuaagagccauuu

SEQ ID NO: 1193909 - RNA, 22 nt, Homo sapiens
ccuacccuccuuccacauguac

SEQ ID NO: 1193910 - RNA, 13 nt, Homo sapiens
ccuaccucagguu

SEQ ID NO: 1193911 - RNA, 14 nt, Homo sapiens
ccuacggagucagc

SEQ ID NO: 1193912 - RNA, 13 nt, Homo sapiens
ccuacuccugacu

SEQ ID NO: 1193913 - RNA, 18 nt, Homo sapiens
ccuacugagcauuugcac

SEQ ID NO: 1193914 - RNA, 11 nt, Homo sapiens
ccuacugcuga

SEQ ID NO: 1193915 - RNA, 13 nt, Homo sapiens
ccuacuguccuca

SEQ ID NO: 1193916 - RNA, 12 nt, Homo sapiens
ccuagaacuucc

SEQ ID NO: 1193917 - RNA, 15 nt, Homo sapiens
ccuagacccaggugg

SEQ ID NO: 1193918 - RNA, 21 nt, Homo sapiens
ccuagagaugggcagggccua

SEQ ID NO: 1193919 - RNA, 23 nt, Homo sapiens
ccuagagcuccaguucuuuauaa

SEQ ID NO: 1193920 - RNA, 20 nt, Homo sapiens
ccuagaucugcacucaccuc

SEQ ID NO: 1193921 - RNA, 18 nt, Homo sapiens
ccuagauguaacauuccu

SEQ ID NO: 1193922 - RNA, 22 nt, Homo sapiens
ccuagcccagacucugagcugc

SEQ ID NO: 1193923 - RNA, 21 nt, Homo sapiens
ccuagcuggcucugugagggu

SEQ ID NO: 1193924 - RNA, 21 nt, Homo sapiens
ccuaggaauucccagcccaaa

SEQ ID NO: 1193925 - RNA, 18 nt, Homo sapiens
ccuaggagcaacaggcca

SEQ ID NO: 1193926 - RNA, 22 nt, Homo sapiens
ccuaggcuaccucaagacucac

SEQ ID NO: 1193927 - RNA, 14 nt, Homo sapiens
ccuagggcacuuua

SEQ ID NO: 1193928 - RNA, 15 nt, Homo sapiens
ccuagggcacuuuaa

SEQ ID NO: 1193929 - RNA, 21 nt, Homo sapiens
ccuaggggaacagaccaguga

SEQ ID NO: 1193930 - RNA, 11 nt, Homo sapiens
ccuagggugau

SEQ ID NO: 1193931 - RNA, 22 nt, Homo sapiens
ccuaguacugccccccaugagg

SEQ ID NO: 1193932 - RNA, 20 nt, Homo sapiens
ccuaguacuuagaaauacac

SEQ ID NO: 1193933 - RNA, 20 nt, Homo sapiens
ccuaguagcugggaugacag

SEQ ID NO: 1193934 - RNA, 22 nt, Homo sapiens
ccuaguccccagccugcucccu

SEQ ID NO: 1193935 - RNA, 18 nt, Homo sapiens
ccuaguccuugcugcauu

SEQ ID NO: 1193936 - RNA, 14 nt, Homo sapiens
ccuaguuugcacua

SEQ ID NO: 1193937 - RNA, 14 nt, Homo sapiens
ccuauaaucuguca

SEQ ID NO: 1193938 - RNA, 15 nt, Homo sapiens
ccuauaaucugucaa

SEQ ID NO: 1193939 - RNA, 15 nt, Homo sapiens
ccuauaaugugugua

SEQ ID NO: 1193940 - RNA, 15 nt, Homo sapiens
ccuauacucuauaac

SEQ ID NO: 1193941 - RNA, 19 nt, Homo sapiens
ccuauagucgcagcuacua

SEQ ID NO: 1193942 - RNA, 15 nt, Homo sapiens
ccuauaucuuaggua

SEQ ID NO: 1193943 - RNA, 18 nt, Homo sapiens
ccuauauugcauuaauuu

SEQ ID NO: 1193944 - RNA, 14 nt, Homo sapiens
ccuaucacugauag

SEQ ID NO: 1193945 - RNA, 14 nt, Homo sapiens
ccuaucauguuaac

SEQ ID NO: 1193946 - RNA, 17 nt, Homo sapiens
ccuauccacaauaguca

SEQ ID NO: 1193947 - RNA, 15 nt, Homo sapiens
ccuaucccauucugc

SEQ ID NO: 1193948 - RNA, 19 nt, Homo sapiens
ccuaucuccugacagaagg

SEQ ID NO: 1193949 - RNA, 23 nt, Homo sapiens
ccuaugccaauaaaaaugucuca

SEQ ID NO: 1193950 - RNA, 20 nt, Homo sapiens
ccuaugggucuaggacacag

SEQ ID NO: 1193951 - RNA, 22 nt, Homo sapiens
ccuauguccuaaggacacacua

SEQ ID NO: 1193952 - RNA, 15 nt, Homo sapiens
ccuauguuucacugu

SEQ ID NO: 1193953 - RNA, 19 nt, Homo sapiens
ccuauguuucacugugcaa

SEQ ID NO: 1193954 - RNA, 21 nt, Homo sapiens
ccuauucccucucucucccag

SEQ ID NO: 1193955 - RNA, 17 nt, Homo sapiens
ccuauugggagagguca

SEQ ID NO: 1193956 - RNA, 16 nt, Homo sapiens
ccucaaauuaagcaua

SEQ ID NO: 1193957 - RNA, 22 nt, Homo sapiens
ccucaacauugcauggugcuag

SEQ ID NO: 1193958 - RNA, 18 nt, Homo sapiens
ccucaaccuccugggcua

SEQ ID NO: 1193959 - RNA, 14 nt, Homo sapiens
ccucacaagcauga

SEQ ID NO: 1193960 - RNA, 17 nt, Homo sapiens
ccucaccaaggugacac

SEQ ID NO: 1193961 - RNA, 14 nt, Homo sapiens
ccucaccaccacac

SEQ ID NO: 1193962 - RNA, 23 nt, Homo sapiens
ccucaccaggagcccggcuucca

SEQ ID NO: 1193963 - RNA, 22 nt, Homo sapiens
ccucaccuagccugaugagauu

SEQ ID NO: 1193964 - RNA, 12 nt, Homo sapiens
ccucacugggug

SEQ ID NO: 1193965 - RNA, 11 nt, Homo sapiens
ccucacuuuag

SEQ ID NO: 1193966 - RNA, 21 nt, Homo sapiens
ccucagaauuaaaacuuuaag

SEQ ID NO: 1193967 - RNA, 17 nt, Homo sapiens
ccucagaauugaucauu

SEQ ID NO: 1193968 - RNA, 13 nt, Homo sapiens
ccucagacauccc

SEQ ID NO: 1193969 - RNA, 16 nt, Homo sapiens
ccucagaggacaguuu

SEQ ID NO: 1193970 - RNA, 21 nt, Homo sapiens
ccucagcaguccacaaagcau

SEQ ID NO: 1193971 - RNA, 22 nt, Homo sapiens
ccucagcccaggucagcuguua

SEQ ID NO: 1193972 - RNA, 22 nt, Homo sapiens
ccucagccucagaggagcucua

SEQ ID NO: 1193973 - RNA, 21 nt, Homo sapiens
ccucagccucucaaguagcug

SEQ ID NO: 1193974 - RNA, 20 nt, Homo sapiens
ccucagcugccucacuuccu

SEQ ID NO: 1193975 - RNA, 21 nt, Homo sapiens
ccucagcuucucaaaguacug

SEQ ID NO: 1193976 - RNA, 14 nt, Homo sapiens
ccucaggcagcuca

SEQ ID NO: 1193977 - RNA, 13 nt, Homo sapiens
ccucaggugaucc

SEQ ID NO: 1193978 - RNA, 13 nt, Homo sapiens
ccucaguauauuu

SEQ ID NO: 1193979 - RNA, 14 nt, Homo sapiens
ccucaguccacugc

SEQ ID NO: 1193980 - RNA, 20 nt, Homo sapiens
ccucagugagauauuuggua

SEQ ID NO: 1193981 - RNA, 15 nt, Homo sapiens
ccucaguuauauaac

SEQ ID NO: 1193982 - RNA, 20 nt, Homo sapiens
ccucauauggcccaguguca

SEQ ID NO: 1193983 - RNA, 16 nt, Homo sapiens
ccucaucaacacagug

SEQ ID NO: 1193984 - RNA, 17 nt, Homo sapiens
ccucauccaggcuacca

SEQ ID NO: 1193985 - RNA, 19 nt, Homo sapiens
ccucauccaugcugugcug

SEQ ID NO: 1193986 - RNA, 17 nt, Homo sapiens
ccucaucugcacggugg

SEQ ID NO: 1193987 - RNA, 21 nt, Homo sapiens
ccucauuacugggccuuagug

SEQ ID NO: 1193988 - RNA, 22 nt, Homo sapiens
ccucauuuaaguaaaagguuag

SEQ ID NO: 1193989 - RNA, 15 nt, Homo sapiens
ccuccaaaagcacuu

SEQ ID NO: 1193990 - RNA, 13 nt, Homo sapiens
ccuccaaaugcca

SEQ ID NO: 1193991 - RNA, 21 nt, Homo sapiens
ccuccaacaacgacacauuca

SEQ ID NO: 1193992 - RNA, 16 nt, Homo sapiens
ccuccaacacaaggcu

SEQ ID NO: 1193993 - RNA, 21 nt, Homo sapiens
ccuccaagccauucacuuccc

SEQ ID NO: 1193994 - RNA, 17 nt, Homo sapiens
ccuccaccacaucugcc

SEQ ID NO: 1193995 - RNA, 18 nt, Homo sapiens
ccuccaccacaucugcca

SEQ ID NO: 1193996 - RNA, 22 nt, Homo sapiens
ccuccaccugugagauccguga

SEQ ID NO: 1193997 - RNA, 13 nt, Homo sapiens
ccuccagaacuca

SEQ ID NO: 1193998 - RNA, 22 nt, Homo sapiens
ccuccagcccgggagccuagga

SEQ ID NO: 1193999 - RNA, 16 nt, Homo sapiens
ccuccagcuucuggua

SEQ ID NO: 1194000 - RNA, 14 nt, Homo sapiens
ccuccauuccccac

SEQ ID NO: 1194001 - RNA, 15 nt, Homo sapiens
ccuccauucugacca

SEQ ID NO: 1194002 - RNA, 12 nt, Homo sapiens
ccuccauuugca

SEQ ID NO: 1194003 - RNA, 22 nt, Homo sapiens
ccuccauuugcaauugaccucu

SEQ ID NO: 1194004 - RNA, 20 nt, Homo sapiens
ccucccaaagugcugggauu

SEQ ID NO: 1194005 - RNA, 14 nt, Homo sapiens
ccucccaagguccu

SEQ ID NO: 1194006 - RNA, 19 nt, Homo sapiens
ccucccaagguccucucag

SEQ ID NO: 1194007 - RNA, 12 nt, Homo sapiens
ccucccacaauu

SEQ ID NO: 1194008 - RNA, 13 nt, Homo sapiens
ccucccaccagag

SEQ ID NO: 1194009 - RNA, 18 nt, Homo sapiens
ccucccagagguccagcc

SEQ ID NO: 1194010 - RNA, 22 nt, Homo sapiens
ccucccagcagcgguaccccag

SEQ ID NO: 1194011 - RNA, 23 nt, Homo sapiens
ccucccagugaccccugaccuca

SEQ ID NO: 1194012 - RNA, 24 nt, Homo sapiens
ccucccauuacuuugauaucugau

SEQ ID NO: 1194013 - RNA, 18 nt, Homo sapiens
ccucccugaaauugcaua

SEQ ID NO: 1194014 - RNA, 19 nt, Homo sapiens
ccucccugucucugcaucu

SEQ ID NO: 1194015 - RNA, 13 nt, Homo sapiens
ccucccuugccac

SEQ ID NO: 1194016 - RNA, 17 nt, Homo sapiens
ccucccuuggguucuga

SEQ ID NO: 1194017 - RNA, 15 nt, Homo sapiens
ccuccgcccugccac

SEQ ID NO: 1194018 - RNA, 17 nt, Homo sapiens
ccuccgcgccuugccuc

SEQ ID NO: 1194019 - RNA, 22 nt, Homo sapiens
ccuccuaccgaaaccuugccuu

SEQ ID NO: 1194020 - RNA, 21 nt, Homo sapiens
ccuccuagaggugggcagcug

SEQ ID NO: 1194021 - RNA, 16 nt, Homo sapiens
ccuccucaggcacaca

SEQ ID NO: 1194022 - RNA, 14 nt, Homo sapiens
ccuccuccugacca

SEQ ID NO: 1194023 - RNA, 21 nt, Homo sapiens
ccuccucuccuacuuugggac

SEQ ID NO: 1194024 - RNA, 19 nt, Homo sapiens
ccuccugaaccgcacagcu

SEQ ID NO: 1194025 - RNA, 22 nt, Homo sapiens
ccuccugcuaacuccuagcuga

SEQ ID NO: 1194026 - RNA, 18 nt, Homo sapiens
ccuccugcuggcucucuc

SEQ ID NO: 1194027 - RNA, 15 nt, Homo sapiens
ccuccuguaaauggu

SEQ ID NO: 1194028 - RNA, 17 nt, Homo sapiens
ccuccuuccacauguac

SEQ ID NO: 1194029 - RNA, 14 nt, Homo sapiens
ccucgcaugacugu

SEQ ID NO: 1194030 - RNA, 13 nt, Homo sapiens
ccucgccagcugc

SEQ ID NO: 1194031 - RNA, 19 nt, Homo sapiens
ccucgcugccagaugauug

SEQ ID NO: 1194032 - RNA, 20 nt, Homo sapiens
ccucggagagcagcagcacc

SEQ ID NO: 1194033 - RNA, 20 nt, Homo sapiens
ccucgggaagccccauccaa

SEQ ID NO: 1194034 - RNA, 15 nt, Homo sapiens
ccucgugucagcuca

SEQ ID NO: 1194035 - RNA, 22 nt, Homo sapiens
ccucguuggaagaggaacagca

SEQ ID NO: 1194036 - RNA, 20 nt, Homo sapiens
ccucuaagucaggcccugau

SEQ ID NO: 1194037 - RNA, 16 nt, Homo sapiens
ccucuaguaucacuuu

SEQ ID NO: 1194038 - RNA, 22 nt, Homo sapiens
ccucucagauucuuaucuggca

SEQ ID NO: 1194039 - RNA, 17 nt, Homo sapiens
ccucucaucaguguccu

SEQ ID NO: 1194040 - RNA, 20 nt, Homo sapiens
ccucuccugcccaagcacuu

SEQ ID NO: 1194041 - RNA, 12 nt, Homo sapiens
ccucucucaaaa

SEQ ID NO: 1194042 - RNA, 22 nt, Homo sapiens
ccucucucacauggaacgcuuu

SEQ ID NO: 1194043 - RNA, 23 nt, Homo sapiens
ccucucucauggcacccaggcag

SEQ ID NO: 1194044 - RNA, 19 nt, Homo sapiens
ccucucucccggagguugg

SEQ ID NO: 1194045 - RNA, 17 nt, Homo sapiens
ccucugaccugcacugg

SEQ ID NO: 1194046 - RNA, 14 nt, Homo sapiens
ccucugcauuuaca

SEQ ID NO: 1194047 - RNA, 20 nt, Homo sapiens
ccucugccuuguccugaugc

SEQ ID NO: 1194048 - RNA, 21 nt, Homo sapiens
ccucugcuacuccauccugaa

SEQ ID NO: 1194049 - RNA, 17 nt, Homo sapiens
ccucugcuccugugguc

SEQ ID NO: 1194050 - RNA, 23 nt, Homo sapiens
ccucuggauccagccaugccuga

SEQ ID NO: 1194051 - RNA, 13 nt, Homo sapiens
ccucuggcucuca

SEQ ID NO: 1194052 - RNA, 16 nt, Homo sapiens
ccucugggaaccuccc

SEQ ID NO: 1194053 - RNA, 21 nt, Homo sapiens
ccucuggucgcuccugcccac

SEQ ID NO: 1194054 - RNA, 22 nt, Homo sapiens
ccucugguuuuccucugcuccu

SEQ ID NO: 1194055 - RNA, 22 nt, Homo sapiens
ccucugucaaugaaaaaaagua

SEQ ID NO: 1194056 - RNA, 18 nt, Homo sapiens
ccucugucucauccuccu

SEQ ID NO: 1194057 - RNA, 17 nt, Homo sapiens
ccucuguucauuucaca

SEQ ID NO: 1194058 - RNA, 19 nt, Homo sapiens
ccucuuaaagcugccugua

SEQ ID NO: 1194059 - RNA, 16 nt, Homo sapiens
ccucuuaccaacaucu

SEQ ID NO: 1194060 - RNA, 14 nt, Homo sapiens
ccucuuauugcaaa

SEQ ID NO: 1194061 - RNA, 20 nt, Homo sapiens
ccucuuauugggauaucauu

SEQ ID NO: 1194062 - RNA, 21 nt, Homo sapiens
ccucuuccuccucgcugccag

SEQ ID NO: 1194063 - RNA, 20 nt, Homo sapiens
ccucuucucaagugccuuaa

SEQ ID NO: 1194064 - RNA, 22 nt, Homo sapiens
ccucuucucugcauaccgugaa

SEQ ID NO: 1194065 - RNA, 23 nt, Homo sapiens
ccucuuguaagucaucuacuuaa

SEQ ID NO: 1194066 - RNA, 16 nt, Homo sapiens
ccucuuguucauguca

SEQ ID NO: 1194067 - RNA, 18 nt, Homo sapiens
ccucuuuccaagaccaac

SEQ ID NO: 1194068 - RNA, 18 nt, Homo sapiens
ccucuuuucccucucuag

SEQ ID NO: 1194069 - RNA, 22 nt, Homo sapiens
ccugaaagcaacuacagaauuu

SEQ ID NO: 1194070 - RNA, 12 nt, Homo sapiens
ccugaaagccac

SEQ ID NO: 1194071 - RNA, 17 nt, Homo sapiens
ccugaaauaaacacugg

SEQ ID NO: 1194072 - RNA, 16 nt, Homo sapiens
ccugugaagcugaaaa

SEQ ID NO: 1194073 - RNA, 14 nt, Homo sapiens
ccugugaaugccac

SEQ ID NO: 1194074 - RNA, 16 nt, Homo sapiens
ccugugacugucucac

SEQ ID NO: 1194075 - RNA, 16 nt, Homo sapiens
ccugugagcagggauu

SEQ ID NO: 1194076 - RNA, 15 nt, Homo sapiens
ccugugauccaccca

SEQ ID NO: 1194077 - RNA, 22 nt, Homo sapiens
ccugugcacgcgcgcgugcaca

SEQ ID NO: 1194078 - RNA, 11 nt, Homo sapiens
ccugugcagca

SEQ ID NO: 1194079 - RNA, 14 nt, Homo sapiens
ccugugcauuuucu

SEQ ID NO: 1194080 - RNA, 19 nt, Homo sapiens
ccugugcccucaccaccac

SEQ ID NO: 1194081 - RNA, 21 nt, Homo sapiens
ccugugcccucaccaccacac

SEQ ID NO: 1194082 - RNA, 20 nt, Homo sapiens
ccugugcccugcacguauac

SEQ ID NO: 1194083 - RNA, 17 nt, Homo sapiens
ccugugcgucccagcug

SEQ ID NO: 1194084 - RNA, 18 nt, Homo sapiens
ccuguggccaacugcaaa

SEQ ID NO: 1194085 - RNA, 17 nt, Homo sapiens
ccugugggugaaacaga

SEQ ID NO: 1194086 - RNA, 22 nt, Homo sapiens
ccuguguaaaacuauauucuca

SEQ ID NO: 1194087 - RNA, 21 nt, Homo sapiens
ccuguguugucucuagagcag

SEQ ID NO: 1194088 - RNA, 23 nt, Homo sapiens
ccuguuaccuacuuugacuuuuu

SEQ ID NO: 1194089 - RNA, 19 nt, Homo sapiens
ccuguucagagcacucauu

SEQ ID NO: 1194090 - RNA, 19 nt, Homo sapiens
ccuguuccccaaggacucu

SEQ ID NO: 1194091 - RNA, 20 nt, Homo sapiens
ccuguuccccaaggacucuu

SEQ ID NO: 1194092 - RNA, 22 nt, Homo sapiens
ccuguuccccaaggacucuucc

SEQ ID NO: 1194093 - RNA, 18 nt, Homo sapiens
ccuguucugggugcagcu

SEQ ID NO: 1194094 - RNA, 22 nt, Homo sapiens
ccuguucugggugcagcugaga

SEQ ID NO: 1194095 - RNA, 23 nt, Homo sapiens
ccuguucuuccuccagcugcacc

SEQ ID NO: 1194096 - RNA, 12 nt, Homo sapiens
ccuguugcccuu

SEQ ID NO: 1194097 - RNA, 16 nt, Homo sapiens
ccuguuucccacccag

SEQ ID NO: 1194098 - RNA, 21 nt, Homo sapiens
ccuguuuuauaaugaacccau

SEQ ID NO: 1194099 - RNA, 22 nt, Homo sapiens
ccuuaaaaauauccuugaugua

SEQ ID NO: 1194100 - RNA, 15 nt, Homo sapiens
ccuuaaaaaucacac

SEQ ID NO: 1194101 - RNA, 19 nt, Homo sapiens
ccuuaaaaauuaaaaagua

SEQ ID NO: 1194102 - RNA, 12 nt, Homo sapiens
ccuuaaauuugu

SEQ ID NO: 1194103 - RNA, 15 nt, Homo sapiens
ccuuaacgcuagaga

SEQ ID NO: 1194104 - RNA, 19 nt, Homo sapiens
ccuuaagagucauccagcu

SEQ ID NO: 1194105 - RNA, 18 nt, Homo sapiens
ccuuaagauuuugcaccu

SEQ ID NO: 1194106 - RNA, 17 nt, Homo sapiens
ccuuaauccccaugcuu

SEQ ID NO: 1194107 - RNA, 16 nt, Homo sapiens
ccuuaaugacaacacu

SEQ ID NO: 1194108 - RNA, 19 nt, Homo sapiens
ccuuaaugacaacacuuaa

SEQ ID NO: 1194109 - RNA, 12 nt, Homo sapiens
ccuuacccaaac

SEQ ID NO: 1194110 - RNA, 16 nt, Homo sapiens
ccuuacucugccagag

SEQ ID NO: 1194111 - RNA, 19 nt, Homo sapiens
ccuuagaaaacaaguauug

SEQ ID NO: 1194112 - RNA, 23 nt, Homo sapiens
ccuuagaaauguaaacugccaua

SEQ ID NO: 1194113 - RNA, 20 nt, Homo sapiens
ccuuaggagacgcugcacuu

SEQ ID NO: 1194114 - RNA, 19 nt, Homo sapiens
ccuuauuaauacaaacaca

SEQ ID NO: 1194115 - RNA, 15 nt, Homo sapiens
ccuuauuaguuacaa

SEQ ID NO: 1194116 - RNA, 16 nt, Homo sapiens
ccuuauuugcacuuca

SEQ ID NO: 1194117 - RNA, 16 nt, Homo sapiens
ccuucaagugccaaac

SEQ ID NO: 1194118 - RNA, 20 nt, Homo sapiens
ccuucaaguuagcucaggag

SEQ ID NO: 1194119 - RNA, 16 nt, Homo sapiens
ccuucagaagcuauuu

SEQ ID NO: 1194120 - RNA, 20 nt, Homo sapiens
ccuucagcauugccuaggaa

SEQ ID NO: 1194121 - RNA, 17 nt, Homo sapiens
ccuucagcuccagggaa

SEQ ID NO: 1194122 - RNA, 23 nt, Homo sapiens
ccuucagucacaugcuagcagcu

SEQ ID NO: 1194123 - RNA, 12 nt, Homo sapiens
ccuucaugcccu

SEQ ID NO: 1194124 - RNA, 14 nt, Homo sapiens
ccuucauugccaca

SEQ ID NO: 1194125 - RNA, 21 nt, Homo sapiens
ccuuccaaauaauaaagucua

SEQ ID NO: 1194126 - RNA, 15 nt, Homo sapiens
ccuuccacaccccau

SEQ ID NO: 1194127 - RNA, 12 nt, Homo sapiens
ccuuccacccau

SEQ ID NO: 1194128 - RNA, 13 nt, Homo sapiens
ccuuccacccauu

SEQ ID NO: 1194129 - RNA, 14 nt, Homo sapiens
ccuuccacugccuc

SEQ ID NO: 1194130 - RNA, 14 nt, Homo sapiens
ccuuccucacuucc

SEQ ID NO: 1194131 - RNA, 23 nt, Homo sapiens
ccuuccugauuguuuacagucau

SEQ ID NO: 1194132 - RNA, 18 nt, Homo sapiens
ccuuccuuaagccaggaa

SEQ ID NO: 1194133 - RNA, 15 nt, Homo sapiens
ccuuccuucuguaaa

SEQ ID NO: 1194134 - RNA, 17 nt, Homo sapiens
ccuuccuuucuccagga

SEQ ID NO: 1194135 - RNA, 21 nt, Homo sapiens
ccuucgaguggccagcuucac

SEQ ID NO: 1194136 - RNA, 21 nt, Homo sapiens
ccuucgggcugugcccgggga

SEQ ID NO: 1194137 - RNA, 19 nt, Homo sapiens
ccuucuacagcagcacugu

SEQ ID NO: 1194138 - RNA, 22 nt, Homo sapiens
ccuucuaggucacuucucacaa

SEQ ID NO: 1194139 - RNA, 12 nt, Homo sapiens
ccuucuccaaau

SEQ ID NO: 1194140 - RNA, 18 nt, Homo sapiens
ccuucuccacacccacuu

SEQ ID NO: 1194141 - RNA, 17 nt, Homo sapiens
ccuucucugugcaguag

SEQ ID NO: 1194142 - RNA, 17 nt, Homo sapiens
ccuucucuuaguuauug

SEQ ID NO: 1194143 - RNA, 19 nt, Homo sapiens
ccuucugacggcccugcaa

SEQ ID NO: 1194144 - RNA, 23 nt, Homo sapiens
ccuucugauugauggugcuauuu

SEQ ID NO: 1194145 - RNA, 17 nt, Homo sapiens
ccuucuucuuuuugcug

SEQ ID NO: 1194146 - RNA, 13 nt, Homo sapiens
ccuugaaccaaua

SEQ ID NO: 1194147 - RNA, 13 nt, Homo sapiens
ccuugaagccacu

SEQ ID NO: 1194148 - RNA, 23 nt, Homo sapiens
ccuugacauuguagagcuucugg

SEQ ID NO: 1194149 - RNA, 14 nt, Homo sapiens
ccuugacuaaauuc

SEQ ID NO: 1194150 - RNA, 16 nt, Homo sapiens
ccuugacuucuuugag

SEQ ID NO: 1194151 - RNA, 17 nt, Homo sapiens
ccuugaggauuguggaa

SEQ ID NO: 1194152 - RNA, 22 nt, Homo sapiens
ccuugauacgauaguuacauaa

SEQ ID NO: 1194153 - RNA, 19 nt, Homo sapiens
ccuugauggaaauugacca

SEQ ID NO: 1194154 - RNA, 18 nt, Homo sapiens
ccuugcaacuucauguca

SEQ ID NO: 1194155 - RNA, 21 nt, Homo sapiens
ccuugcaaucuucuacuuuaa

SEQ ID NO: 1194156 - RNA, 18 nt, Homo sapiens
ccuugcccugaccuccca

SEQ ID NO: 1194157 - RNA, 14 nt, Homo sapiens
ccuugcuaaccuaa

SEQ ID NO: 1194158 - RNA, 18 nt, Homo sapiens
ccuugcuagacagccagg

SEQ ID NO: 1194159 - RNA, 14 nt, Homo sapiens
ccuugcuagcugac

SEQ ID NO: 1194160 - RNA, 13 nt, Homo sapiens
ccuuggcucugcc

SEQ ID NO: 1194161 - RNA, 16 nt, Homo sapiens
ccuuggcuucugugau

SEQ ID NO: 1194162 - RNA, 19 nt, Homo sapiens
ccuugggagguuuuauucu

SEQ ID NO: 1194163 - RNA, 15 nt, Homo sapiens
ccuugggaugaucuu

SEQ ID NO: 1194164 - RNA, 20 nt, Homo sapiens
ccuugggcuauuuggacuca

SEQ ID NO: 1194165 - RNA, 16 nt, Homo sapiens
ccuuggggaggacaaa

SEQ ID NO: 1194166 - RNA, 19 nt, Homo sapiens
ccuuggggaggacaaaacu

SEQ ID NO: 1194167 - RNA, 17 nt, Homo sapiens
ccuuggggucacuccuu

SEQ ID NO: 1194168 - RNA, 18 nt, Homo sapiens
ccuuguaaccagugcaga

SEQ ID NO: 1194169 - RNA, 19 nt, Homo sapiens
ccuuguaauucuaaaugaa

SEQ ID NO: 1194170 - RNA, 13 nt, Homo sapiens
ccuuguaccucaa

SEQ ID NO: 1194171 - RNA, 24 nt, Homo sapiens
ccuuguccuugaaaguaggauaua

SEQ ID NO: 1194172 - RNA, 18 nt, Homo sapiens
ccuugucuaguuucccac

SEQ ID NO: 1194173 - RNA, 17 nt, Homo sapiens
ccuugucugcacccucg

SEQ ID NO: 1194174 - RNA, 19 nt, Homo sapiens
ccuugugagagcccauucc

SEQ ID NO: 1194175 - RNA, 15 nt, Homo sapiens
ccuuguuaaaucauu

SEQ ID NO: 1194176 - RNA, 23 nt, Homo sapiens
ccuuguucgccuccccacccucc

SEQ ID NO: 1194177 - RNA, 22 nt, Homo sapiens
ccuuguugguggagaguggaag

SEQ ID NO: 1194178 - RNA, 23 nt, Homo sapiens
ccuuuaaaucugugaugauccuc

SEQ ID NO: 1194179 - RNA, 21 nt, Homo sapiens
ccuuuaauuugcuacugucau

SEQ ID NO: 1194180 - RNA, 15 nt, Homo sapiens
ccuuuacuagauucu

SEQ ID NO: 1194181 - RNA, 16 nt, Homo sapiens
ccuuuacugugcuuau

SEQ ID NO: 1194182 - RNA, 16 nt, Homo sapiens
ccuuuagaaccuuaaa

SEQ ID NO: 1194183 - RNA, 18 nt, Homo sapiens
ccuuuagagccagcccau

SEQ ID NO: 1194184 - RNA, 19 nt, Homo sapiens
ccuuuaggccaucucagcu

SEQ ID NO: 1194185 - RNA, 23 nt, Homo sapiens
ccuuuaucaaaaaaagacucagc

SEQ ID NO: 1194186 - RNA, 17 nt, Homo sapiens
ccuuuaucauccuuaaa

SEQ ID NO: 1194187 - RNA, 19 nt, Homo sapiens
ccuuuauguggaaaacaga

SEQ ID NO: 1194188 - RNA, 18 nt, Homo sapiens
ccuuucaagacagaaaga

SEQ ID NO: 1194189 - RNA, 23 nt, Homo sapiens
ccuuucacccucaugaaaacaca

SEQ ID NO: 1194190 - RNA, 17 nt, Homo sapiens
ccuuucaucacacuggg

SEQ ID NO: 1194191 - RNA, 11 nt, Homo sapiens
ccuuuccauaa

SEQ ID NO: 1194192 - RNA, 16 nt, Homo sapiens
ccuuuccauaaggaau

SEQ ID NO: 1194193 - RNA, 17 nt, Homo sapiens
ccuuuccggcacacugc

SEQ ID NO: 1194194 - RNA, 23 nt, Homo sapiens
ccuuuccugccgagugcucugau

SEQ ID NO: 1194195 - RNA, 13 nt, Homo sapiens
ccuuuccuuccag

SEQ ID NO: 1194196 - RNA, 19 nt, Homo sapiens
ccuuuccuuccaucccuac

SEQ ID NO: 1194197 - RNA, 18 nt, Homo sapiens
ccuuucucccagugaaau

SEQ ID NO: 1194198 - RNA, 19 nt, Homo sapiens
ccugaaauuuaaacugcaa

SEQ ID NO: 1194199 - RNA, 14 nt, Homo sapiens
ccugaaccccaugg

SEQ ID NO: 1194200 - RNA, 18 nt, Homo sapiens
ccugaaggaaaaugacuc

SEQ ID NO: 1194201 - RNA, 20 nt, Homo sapiens
ccugaaguguggcugcaucu

SEQ ID NO: 1194202 - RNA, 21 nt, Homo sapiens
ccugaauaccacuuaccucaa

SEQ ID NO: 1194203 - RNA, 14 nt, Homo sapiens
ccugacaaccacug

SEQ ID NO: 1194204 - RNA, 17 nt, Homo sapiens
ccugacacggacugugc

SEQ ID NO: 1194205 - RNA, 14 nt, Homo sapiens
ccugacacuauuca

SEQ ID NO: 1194206 - RNA, 22 nt, Homo sapiens
ccugacagaaggugccacuuua

SEQ ID NO: 1194207 - RNA, 17 nt, Homo sapiens
ccugaccucaggugauu

SEQ ID NO: 1194208 - RNA, 15 nt, Homo sapiens
ccugaccuccgcccc

SEQ ID NO: 1194209 - RNA, 16 nt, Homo sapiens
ccugaccugagacugu

SEQ ID NO: 1194210 - RNA, 19 nt, Homo sapiens
ccugaccugucaccgugag

SEQ ID NO: 1194211 - RNA, 23 nt, Homo sapiens
ccugacgcgcgcccgcagggugg

SEQ ID NO: 1194212 - RNA, 18 nt, Homo sapiens
ccugacuccuccaaggaa

SEQ ID NO: 1194213 - RNA, 18 nt, Homo sapiens
ccugacucuugcaggggu

SEQ ID NO: 1194214 - RNA, 13 nt, Homo sapiens
ccugagaauauua

SEQ ID NO: 1194215 - RNA, 14 nt, Homo sapiens
ccugagauccugca

SEQ ID NO: 1194216 - RNA, 13 nt, Homo sapiens
ccugagaugauuu

SEQ ID NO: 1194217 - RNA, 15 nt, Homo sapiens
ccugaggauaacuca

SEQ ID NO: 1194218 - RNA, 20 nt, Homo sapiens
ccugaggguggagacuaagc

SEQ ID NO: 1194219 - RNA, 16 nt, Homo sapiens
ccugaggucagggagu

SEQ ID NO: 1194220 - RNA, 12 nt, Homo sapiens
ccugagugaucc

SEQ ID NO: 1194221 - RNA, 17 nt, Homo sapiens
ccugaguuggagcucau

SEQ ID NO: 1194222 - RNA, 18 nt, Homo sapiens
ccugauauaucaaacuga

SEQ ID NO: 1194223 - RNA, 20 nt, Homo sapiens
ccugaucacucccagcacuc

SEQ ID NO: 1194224 - RNA, 21 nt, Homo sapiens
ccugaucacucccagcacucc

SEQ ID NO: 1194225 - RNA, 13 nt, Homo sapiens
ccugauccucacc

SEQ ID NO: 1194226 - RNA, 18 nt, Homo sapiens
ccugaucgccaaccuuuc

SEQ ID NO: 1194227 - RNA, 19 nt, Homo sapiens
ccugaucgccaaccuuucc

SEQ ID NO: 1194228 - RNA, 18 nt, Homo sapiens
ccugaugaaaacauagca

SEQ ID NO: 1194229 - RNA, 14 nt, Homo sapiens
ccugcacacuuggu

SEQ ID NO: 1194230 - RNA, 13 nt, Homo sapiens
ccugcacaggcug

SEQ ID NO: 1194231 - RNA, 22 nt, Homo sapiens
ccugcacuaaagccagccugac

SEQ ID NO: 1194232 - RNA, 13 nt, Homo sapiens
ccugcacugccag

SEQ ID NO: 1194233 - RNA, 20 nt, Homo sapiens
ccugcacuguccugaccauc

SEQ ID NO: 1194234 - RNA, 21 nt, Homo sapiens
ccugcacuguccugaccaucg

SEQ ID NO: 1194235 - RNA, 17 nt, Homo sapiens
ccugcagaauccagcua

SEQ ID NO: 1194236 - RNA, 18 nt, Homo sapiens
ccugcagagggaccagag

SEQ ID NO: 1194237 - RNA, 20 nt, Homo sapiens
ccugcagcccaaaacccagg

SEQ ID NO: 1194238 - RNA, 20 nt, Homo sapiens
ccugcagccuccuccugacc

SEQ ID NO: 1194239 - RNA, 22 nt, Homo sapiens
ccugcagccuccuccugaccac

SEQ ID NO: 1194240 - RNA, 16 nt, Homo sapiens
ccugcaggcugcaguc

SEQ ID NO: 1194241 - RNA, 15 nt, Homo sapiens
ccugcaucugugaaa

SEQ ID NO: 1194242 - RNA, 11 nt, Homo sapiens
ccugcauguac

SEQ ID NO: 1194243 - RNA, 14 nt, Homo sapiens
ccugccacugugua

SEQ ID NO: 1194244 - RNA, 20 nt, Homo sapiens
ccugccacuguguacugugg

SEQ ID NO: 1194245 - RNA, 17 nt, Homo sapiens
ccugcccaaacccuuaa

SEQ ID NO: 1194246 - RNA, 14 nt, Homo sapiens
ccugcccacugcug

SEQ ID NO: 1194247 - RNA, 21 nt, Homo sapiens
ccugcccacuuagccguccau

SEQ ID NO: 1194248 - RNA, 21 nt, Homo sapiens
ccugccccagauuuacuaaau

SEQ ID NO: 1194249 - RNA, 19 nt, Homo sapiens
ccugcccccgcucccgcuc

SEQ ID NO: 1194250 - RNA, 21 nt, Homo sapiens
ccugcccccuguacauuugug

SEQ ID NO: 1194251 - RNA, 22 nt, Homo sapiens
ccugcccuccccagagcacugg

SEQ ID NO: 1194252 - RNA, 15 nt, Homo sapiens
ccugccgagugcucu

SEQ ID NO: 1194253 - RNA, 20 nt, Homo sapiens
ccugccucagccucccaauu

SEQ ID NO: 1194254 - RNA, 18 nt, Homo sapiens
ccugccucauccaccaau

SEQ ID NO: 1194255 - RNA, 23 nt, Homo sapiens
ccugccucccacuucacugcgaa

SEQ ID NO: 1194256 - RNA, 23 nt, Homo sapiens
ccugcgcucucagcugaccauca

SEQ ID NO: 1194257 - RNA, 23 nt, Homo sapiens
ccugcggaggguuugguucuuga

SEQ ID NO: 1194258 - RNA, 18 nt, Homo sapiens
ccugcgugggggccaguc

SEQ ID NO: 1194259 - RNA, 21 nt, Homo sapiens
ccugcguguccccgugcagua

SEQ ID NO: 1194260 - RNA, 16 nt, Homo sapiens
ccugcuaaagacagug

SEQ ID NO: 1194261 - RNA, 17 nt, Homo sapiens
ccugcucccuagccaga

SEQ ID NO: 1194262 - RNA, 15 nt, Homo sapiens
ccugcuccugcagca

SEQ ID NO: 1194263 - RNA, 15 nt, Homo sapiens
ccugcucuaacaccu

SEQ ID NO: 1194264 - RNA, 17 nt, Homo sapiens
ccugcucuacccaugag

SEQ ID NO: 1194265 - RNA, 22 nt, Homo sapiens
ccugcucuuucuacaugacugg

SEQ ID NO: 1194266 - RNA, 18 nt, Homo sapiens
ccugcugcccaaucucca

SEQ ID NO: 1194267 - RNA, 22 nt, Homo sapiens
ccugcugccggaagucauccca

SEQ ID NO: 1194268 - RNA, 23 nt, Homo sapiens
ccugcugccggaagucaucccag

SEQ ID NO: 1194269 - RNA, 16 nt, Homo sapiens
ccugcugugcugcuca

SEQ ID NO: 1194270 - RNA, 13 nt, Homo sapiens
ccuggaaauggac

SEQ ID NO: 1194271 - RNA, 16 nt, Homo sapiens
ccuggacacucagacc

SEQ ID NO: 1194272 - RNA, 13 nt, Homo sapiens
ccuggacugggag

SEQ ID NO: 1194273 - RNA, 20 nt, Homo sapiens
ccuggacugggagguagaua

SEQ ID NO: 1194274 - RNA, 13 nt, Homo sapiens
ccuggacuuuccu

SEQ ID NO: 1194275 - RNA, 15 nt, Homo sapiens
ccuggacuuuccugc

SEQ ID NO: 1194276 - RNA, 17 nt, Homo sapiens
ccuggacuuuggcucag

SEQ ID NO: 1194277 - RNA, 14 nt, Homo sapiens
ccuggagccuuuga

SEQ ID NO: 1194278 - RNA, 21 nt, Homo sapiens
ccuggaguuuaauacagugag

SEQ ID NO: 1194279 - RNA, 19 nt, Homo sapiens
ccuggaucuccucaagucc

SEQ ID NO: 1194280 - RNA, 16 nt, Homo sapiens
ccuggaugacauuaaa

SEQ ID NO: 1194281 - RNA, 21 nt, Homo sapiens
ccuggaugaucacuaauacua

SEQ ID NO: 1194282 - RNA, 21 nt, Homo sapiens
ccuggauuuccugcugccauc

SEQ ID NO: 1194283 - RNA, 16 nt, Homo sapiens
ccuggcacaggacuga

SEQ ID NO: 1194284 - RNA, 19 nt, Homo sapiens
ccuggcagcaugacucaga

SEQ ID NO: 1194285 - RNA, 23 nt, Homo sapiens
ccuggcaucaguagcaucuguaa

SEQ ID NO: 1194286 - RNA, 23 nt, Homo sapiens
ccuggcauuauguccacugugua

SEQ ID NO: 1194287 - RNA, 20 nt, Homo sapiens
ccuggccaacaugaugaaac

SEQ ID NO: 1194288 - RNA, 14 nt, Homo sapiens
ccuggccagcccuu

SEQ ID NO: 1194289 - RNA, 18 nt, Homo sapiens
ccuggccaggauaauaua

SEQ ID NO: 1194290 - RNA, 15 nt, Homo sapiens
ccuggcccaaagcag

SEQ ID NO: 1194291 - RNA, 17 nt, Homo sapiens
ccuggccccacaagcca

SEQ ID NO: 1194292 - RNA, 15 nt, Homo sapiens
ccuggccggcaaccc

SEQ ID NO: 1194293 - RNA, 15 nt, Homo sapiens
ccuggcugagggcag

SEQ ID NO: 1194294 - RNA, 17 nt, Homo sapiens
ccugggaccugaaccug

SEQ ID NO: 1194295 - RNA, 14 nt, Homo sapiens
ccugggagacagac

SEQ ID NO: 1194296 - RNA, 19 nt, Homo sapiens
ccugggcuugagcugcaga

SEQ ID NO: 1194297 - RNA, 19 nt, Homo sapiens
ccuggggcgagcacuguga

SEQ ID NO: 1194298 - RNA, 21 nt, Homo sapiens
ccugggggcagugacuggcag

SEQ ID NO: 1194299 - RNA, 17 nt, Homo sapiens
ccugggggcuuuugcca

SEQ ID NO: 1194300 - RNA, 20 nt, Homo sapiens
cgcccaccucggccucccaa

SEQ ID NO: 1194301 - RNA, 19 nt, Homo sapiens
cgcccagcugcaccugcca

SEQ ID NO: 1194302 - RNA, 13 nt, Homo sapiens
cgcccuccacaaa

SEQ ID NO: 1194303 - RNA, 17 nt, Homo sapiens
cgcccuccucccuguca

SEQ ID NO: 1194304 - RNA, 19 nt, Homo sapiens
cgcccuuggcuucugugau

SEQ ID NO: 1194305 - RNA, 20 nt, Homo sapiens
cgcccuuggcuucugugaug

SEQ ID NO: 1194306 - RNA, 20 nt, Homo sapiens
cgccucccgggucucaggcc

SEQ ID NO: 1194307 - RNA, 16 nt, Homo sapiens
cgccugacaaccacug

SEQ ID NO: 1194308 - RNA, 21 nt, Homo sapiens
cgccuguaaucccagcacuuu

SEQ ID NO: 1194309 - RNA, 17 nt, Homo sapiens
cgccuugccuccucacc

SEQ ID NO: 1194310 - RNA, 14 nt, Homo sapiens
cgcggaagugacca

SEQ ID NO: 1194311 - RNA, 18 nt, Homo sapiens
cgcgggaggcaccagcuc

SEQ ID NO: 1194312 - RNA, 17 nt, Homo sapiens
cgcuagagcagcccaaa

SEQ ID NO: 1194313 - RNA, 14 nt, Homo sapiens
cgcuagcaguacua

SEQ ID NO: 1194314 - RNA, 13 nt, Homo sapiens
cgcuaucacagcu

SEQ ID NO: 1194315 - RNA, 12 nt, Homo sapiens
cgcuauuacaaa

SEQ ID NO: 1194316 - RNA, 12 nt, Homo sapiens
cgcuauugauuu

SEQ ID NO: 1194317 - RNA, 15 nt, Homo sapiens
cgcucgccacagucc

SEQ ID NO: 1194318 - RNA, 13 nt, Homo sapiens
cgcucgcugccau

SEQ ID NO: 1194319 - RNA, 22 nt, Homo sapiens
cgcucuuggcagguacucagcg

SEQ ID NO: 1194320 - RNA, 22 nt, Homo sapiens
cgcugagcgucacggccaagug

SEQ ID NO: 1194321 - RNA, 22 nt, Homo sapiens
cgcugcagcuguguguccuucu

SEQ ID NO: 1194322 - RNA, 15 nt, Homo sapiens
cgcuggagugcagug

SEQ ID NO: 1194323 - RNA, 21 nt, Homo sapiens
cgcuggcuuugggaaagccca

SEQ ID NO: 1194324 - RNA, 14 nt, Homo sapiens
cgcugggugguacc

SEQ ID NO: 1194325 - RNA, 14 nt, Homo sapiens
cgcuuaagcuuuca

SEQ ID NO: 1194326 - RNA, 17 nt, Homo sapiens
cgcuuaucaacuaauga

SEQ ID NO: 1194327 - RNA, 13 nt, Homo sapiens
cgcuugcuuuagc

SEQ ID NO: 1194328 - RNA, 12 nt, Homo sapiens
cgcuuggcauca

SEQ ID NO: 1194329 - RNA, 21 nt, Homo sapiens
cugaaacucauagacacugau

SEQ ID NO: 1194330 - RNA, 12 nt, Homo sapiens
cugaaacuggag

SEQ ID NO: 1194331 - RNA, 17 nt, Homo sapiens
cugaaagcaacuacaga

SEQ ID NO: 1194332 - RNA, 15 nt, Homo sapiens
cugaaauaaacacug

SEQ ID NO: 1194333 - RNA, 19 nt, Homo sapiens
cugaaauaaacacuggugc

SEQ ID NO: 1194334 - RNA, 12 nt, Homo sapiens
cugaaauugcau

SEQ ID NO: 1194335 - RNA, 17 nt, Homo sapiens
cugaaauuuauucacau

SEQ ID NO: 1194336 - RNA, 23 nt, Homo sapiens
cugaaauuuuaaugaagugcaau

SEQ ID NO: 1194337 - RNA, 20 nt, Homo sapiens
cugaaauuuuuuuccuaagu

SEQ ID NO: 1194338 - RNA, 23 nt, Homo sapiens
cugaacaaacuaaaggugcacug

SEQ ID NO: 1194339 - RNA, 16 nt, Homo sapiens
cugaaccaaauugcac

SEQ ID NO: 1194340 - RNA, 13 nt, Homo sapiens
cugaacccugugc

SEQ ID NO: 1194341 - RNA, 15 nt, Homo sapiens
cugaacuugccuuaa

SEQ ID NO: 1194342 - RNA, 22 nt, Homo sapiens
cugaacuugccuuaaacacuca

SEQ ID NO: 1194343 - RNA, 18 nt, Homo sapiens
cugaacuuucucccucau

SEQ ID NO: 1194344 - RNA, 22 nt, Homo sapiens
cugaagaggaacugggccuguu

SEQ ID NO: 1194345 - RNA, 11 nt, Homo sapiens
cugaagauauu

SEQ ID NO: 1194346 - RNA, 20 nt, Homo sapiens
cugaagauugcgguuuacag

SEQ ID NO: 1194347 - RNA, 21 nt, Homo sapiens
cugaagcccucccagguguua

SEQ ID NO: 1194348 - RNA, 18 nt, Homo sapiens
cugaagcguuuuucucaa

SEQ ID NO: 1194349 - RNA, 22 nt, Homo sapiens
cugaaggaaaaacacaagcaaa

SEQ ID NO: 1194350 - RNA, 18 nt, Homo sapiens
cugaaggcagucauauca

SEQ ID NO: 1194351 - RNA, 23 nt, Homo sapiens
cugaaggcaguggcaggggagca

SEQ ID NO: 1194352 - RNA, 21 nt, Homo sapiens
cugaaggcauaugcacaguca

SEQ ID NO: 1194353 - RNA, 18 nt, Homo sapiens
cugaaggcugaguguccg

SEQ ID NO: 1194354 - RNA, 17 nt, Homo sapiens
cugaaggggaggucaca

SEQ ID NO: 1194355 - RNA, 20 nt, Homo sapiens
cugaaggggaggucacagcc

SEQ ID NO: 1194356 - RNA, 19 nt, Homo sapiens
cugaaggucuuaguaccag

SEQ ID NO: 1194357 - RNA, 20 nt, Homo sapiens
cugaaguacuaacacaagga

SEQ ID NO: 1194358 - RNA, 17 nt, Homo sapiens
cugaagugaacuaugaa

SEQ ID NO: 1194359 - RNA, 16 nt, Homo sapiens
cugaagugucacagcc

SEQ ID NO: 1194360 - RNA, 20 nt, Homo sapiens
cugaaguguggcugcaucuu

SEQ ID NO: 1194361 - RNA, 14 nt, Homo sapiens
cugaaguuucacau

SEQ ID NO: 1194362 - RNA, 19 nt, Homo sapiens
cugaaguuugugggggcca

SEQ ID NO: 1194363 - RNA, 19 nt, Homo sapiens
cugaauaaauaauucuucc

SEQ ID NO: 1194364 - RNA, 17 nt, Homo sapiens
cugaauaaaugauuaaa

SEQ ID NO: 1194365 - RNA, 15 nt, Homo sapiens
cugaauaacuugaag

SEQ ID NO: 1194366 - RNA, 16 nt, Homo sapiens
cugaaucagcaugaaa

SEQ ID NO: 1194367 - RNA, 17 nt, Homo sapiens
cugaaucgagaugucca

SEQ ID NO: 1194368 - RNA, 12 nt, Homo sapiens
cugaaucuaccu

SEQ ID NO: 1194369 - RNA, 17 nt, Homo sapiens
cugaaugcugcuacuua

SEQ ID NO: 1194370 - RNA, 21 nt, Homo sapiens
cugaaugucuuacugugauca

SEQ ID NO: 1194371 - RNA, 18 nt, Homo sapiens
cugaaugugccuaaugga

SEQ ID NO: 1194372 - RNA, 12 nt, Homo sapiens
cugaauguucug

SEQ ID NO: 1194373 - RNA, 17 nt, Homo sapiens
cugaauuaugcuuccac

SEQ ID NO: 1194374 - RNA, 20 nt, Homo sapiens
cugaauucuuuuucauuuga

SEQ ID NO: 1194375 - RNA, 19 nt, Homo sapiens
cugaauuugauucuccagc

SEQ ID NO: 1194376 - RNA, 17 nt, Homo sapiens
cugacaaauauuuuaga

SEQ ID NO: 1194377 - RNA, 23 nt, Homo sapiens
cugacaaugggcacugauuugau

SEQ ID NO: 1194378 - RNA, 13 nt, Homo sapiens
cugacaauugcaa

SEQ ID NO: 1194379 - RNA, 12 nt, Homo sapiens
cugacacaggaa

SEQ ID NO: 1194380 - RNA, 14 nt, Homo sapiens
cugacacauagaaa

SEQ ID NO: 1194381 - RNA, 23 nt, Homo sapiens
cugacaccagagcccacuuccau

SEQ ID NO: 1194382 - RNA, 22 nt, Homo sapiens
cugacagacaaugauccaguca

SEQ ID NO: 1194383 - RNA, 13 nt, Homo sapiens
cugacagcaauaa

SEQ ID NO: 1194384 - RNA, 17 nt, Homo sapiens
cugacagcuucaugaaa

SEQ ID NO: 1194385 - RNA, 15 nt, Homo sapiens
cugacauauuaugcc

SEQ ID NO: 1194386 - RNA, 16 nt, Homo sapiens
cugacaucacagcagc

SEQ ID NO: 1194387 - RNA, 22 nt, Homo sapiens
cugaccauauugugcuucacag

SEQ ID NO: 1194388 - RNA, 16 nt, Homo sapiens
cugaccauuuggucag

SEQ ID NO: 1194389 - RNA, 13 nt, Homo sapiens
cugaccccagugu

SEQ ID NO: 1194390 - RNA, 19 nt, Homo sapiens
cugacccugcuucaaauau

SEQ ID NO: 1194391 - RNA, 13 nt, Homo sapiens
cugaccucaggug

SEQ ID NO: 1194392 - RNA, 19 nt, Homo sapiens
cugaccucaggugauccgc

SEQ ID NO: 1194393 - RNA, 15 nt, Homo sapiens
cugacgacaguacug

SEQ ID NO: 1194394 - RNA, 21 nt, Homo sapiens
cugacucucugugaccugccc

SEQ ID NO: 1194395 - RNA, 11 nt, Homo sapiens
cugacugcuag

SEQ ID NO: 1194396 - RNA, 12 nt, Homo sapiens
cugacuguaaau

SEQ ID NO: 1194397 - RNA, 13 nt, Homo sapiens
cugacuucaucug

SEQ ID NO: 1194398 - RNA, 18 nt, Homo sapiens
cugacuuguuugucuucc

SEQ ID NO: 1194399 - RNA, 16 nt, Homo sapiens
cugacuuucucuccag

SEQ ID NO: 1194400 - RNA, 22 nt, Homo sapiens
cugagaaaggugaggagggcag

SEQ ID NO: 1194401 - RNA, 23 nt, Homo sapiens
cugagaaauaaaaagccugucau

SEQ ID NO: 1194402 - RNA, 18 nt, Homo sapiens
cugagaaauguuaaaggu

SEQ ID NO: 1194403 - RNA, 15 nt, Homo sapiens
cugagaaauguucag

SEQ ID NO: 1194404 - RNA, 22 nt, Homo sapiens
cugagaagaaugaaaaugcagu

SEQ ID NO: 1194405 - RNA, 17 nt, Homo sapiens
cugagaaggaacaggga

SEQ ID NO: 1194406 - RNA, 20 nt, Homo sapiens
cugagaagucaaacauuuca

SEQ ID NO: 1194407 - RNA, 18 nt, Homo sapiens
cugagaagugcacuuuaa

SEQ ID NO: 1194408 - RNA, 13 nt, Homo sapiens
cugagaauuucca

SEQ ID NO: 1194409 - RNA, 20 nt, Homo sapiens
cugagacauucuucaccucc

SEQ ID NO: 1194410 - RNA, 13 nt, Homo sapiens
cugagaccagugu

SEQ ID NO: 1194411 - RNA, 15 nt, Homo sapiens
cugagacucacagga

SEQ ID NO: 1194412 - RNA, 17 nt, Homo sapiens
cugagacugaagaccag

SEQ ID NO: 1194413 - RNA, 16 nt, Homo sapiens
cugagagaccugaguc

SEQ ID NO: 1194414 - RNA, 12 nt, Homo sapiens
cugagagucuag

SEQ ID NO: 1194415 - RNA, 14 nt, Homo sapiens
cugagaucgugcua

SEQ ID NO: 1194416 - RNA, 12 nt, Homo sapiens
cugagauuacag

SEQ ID NO: 1194417 - RNA, 16 nt, Homo sapiens
cugagcagugccagcu

SEQ ID NO: 1194418 - RNA, 21 nt, Homo sapiens
cugagccacucgcagucgcag

SEQ ID NO: 1194419 - RNA, 18 nt, Homo sapiens
cugagccuacagaugaac

SEQ ID NO: 1194420 - RNA, 18 nt, Homo sapiens
cugagcuccccagaucuc

SEQ ID NO: 1194421 - RNA, 20 nt, Homo sapiens
cugagcugccuguaacuuga

SEQ ID NO: 1194422 - RNA, 23 nt, Homo sapiens
cugagcuggaaggggccacgugg

SEQ ID NO: 1194423 - RNA, 22 nt, Homo sapiens
cugagcuuggcguuuggaccca

SEQ ID NO: 1194424 - RNA, 22 nt, Homo sapiens
cugaggaagcacagcagcaucu

SEQ ID NO: 1194425 - RNA, 22 nt, Homo sapiens
cugaggaauuucaccuguaaac

SEQ ID NO: 1194426 - RNA, 19 nt, Homo sapiens
cugaggaggguacuuuucc

SEQ ID NO: 1194427 - RNA, 20 nt, Homo sapiens
cugaggcgggagaaucaugu

SEQ ID NO: 1194428 - RNA, 17 nt, Homo sapiens
cugagggaaagugcaua

SEQ ID NO: 1194429 - RNA, 21 nt, Homo sapiens
cugaggguccccaccugggac

SEQ ID NO: 1194430 - RNA, 19 nt, Homo sapiens
cugagggugcuuuguguaa

SEQ ID NO: 1194431 - RNA, 16 nt, Homo sapiens
cugaggugaaagggag

SEQ ID NO: 1194432 - RNA, 23 nt, Homo sapiens
cugaguagcuggaacuacaagga

SEQ ID NO: 1194433 - RNA, 16 nt, Homo sapiens
cugaguagggggagca

SEQ ID NO: 1194434 - RNA, 22 nt, Homo sapiens
cugagucccuuagccaagcagu

SEQ ID NO: 1194435 - RNA, 18 nt, Homo sapiens
cugagucugcaugugcac

SEQ ID NO: 1194436 - RNA, 19 nt, Homo sapiens
cugagugaauuacagacaa

SEQ ID NO: 1194437 - RNA, 13 nt, Homo sapiens
cugagugagcugg

SEQ ID NO: 1194438 - RNA, 20 nt, Homo sapiens
cugagugaguguuuggccga

SEQ ID NO: 1194439 - RNA, 15 nt, Homo sapiens
cugagugcaccacuu

SEQ ID NO: 1194440 - RNA, 20 nt, Homo sapiens
cugaguggaaugcagggaag

SEQ ID NO: 1194441 - RNA, 23 nt, Homo sapiens
cugaguguuauuugcacacugca

SEQ ID NO: 1194442 - RNA, 17 nt, Homo sapiens
cugaguguuuaauuuca

SEQ ID NO: 1194443 - RNA, 13 nt, Homo sapiens
cugauaccacugc

SEQ ID NO: 1194444 - RNA, 18 nt, Homo sapiens
cugauacuuugacagugu

SEQ ID NO: 1194445 - RNA, 14 nt, Homo sapiens
cugauaguauuccu

SEQ ID NO: 1194446 - RNA, 12 nt, Homo sapiens
cugauaugaguu

SEQ ID NO: 1194447 - RNA, 19 nt, Homo sapiens
cugauauuuuaccucuuau

SEQ ID NO: 1194448 - RNA, 16 nt, Homo sapiens
cugaucacucccagca

SEQ ID NO: 1194449 - RNA, 18 nt, Homo sapiens
cugaucagagguguacac

SEQ ID NO: 1194450 - RNA, 14 nt, Homo sapiens
cugaucaugcauug

SEQ ID NO: 1194451 - RNA, 16 nt, Homo sapiens
cugaucauuugaggaa

SEQ ID NO: 1194452 - RNA, 22 nt, Homo sapiens
cugaucccccauagguggcuga

SEQ ID NO: 1194453 - RNA, 20 nt, Homo sapiens
cugaucgugcuaaauuuuca

SEQ ID NO: 1194454 - RNA, 22 nt, Homo sapiens
cugcuaugcuauugaaguuuug

SEQ ID NO: 1194455 - RNA, 18 nt, Homo sapiens
cugcucacaguaacccaa

SEQ ID NO: 1194456 - RNA, 13 nt, Homo sapiens
cugcucacuuuaa

SEQ ID NO: 1194457 - RNA, 14 nt, Homo sapiens
cugcucauccaaag

SEQ ID NO: 1194458 - RNA, 13 nt, Homo sapiens
cugcuccaacccc

SEQ ID NO: 1194459 - RNA, 18 nt, Homo sapiens
cugcuccacgaagccuua

SEQ ID NO: 1194460 - RNA, 21 nt, Homo sapiens
cugcucccaaauaaacuccag

SEQ ID NO: 1194461 - RNA, 14 nt, Homo sapiens
cugcucccuagcca

SEQ ID NO: 1194462 - RNA, 23 nt, Homo sapiens
cugcucccugcacccaugacaau

SEQ ID NO: 1194463 - RNA, 17 nt, Homo sapiens
cugcuccgcugcuccuu

SEQ ID NO: 1194464 - RNA, 14 nt, Homo sapiens
cugcuccugugguc

SEQ ID NO: 1194465 - RNA, 21 nt, Homo sapiens
cugcucuagugggacagccca

SEQ ID NO: 1194466 - RNA, 17 nt, Homo sapiens
cugcucugccuguggag

SEQ ID NO: 1194467 - RNA, 14 nt, Homo sapiens
cugcucuuccucag

SEQ ID NO: 1194468 - RNA, 23 nt, Homo sapiens
cugcucuuucucugccagugaca

SEQ ID NO: 1194469 - RNA, 21 nt, Homo sapiens
cugcugaaggcagucauauca

SEQ ID NO: 1194470 - RNA, 22 nt, Homo sapiens
cugcugagucagacugucagaa

SEQ ID NO: 1194471 - RNA, 21 nt, Homo sapiens
cugcugcccccaccccgggga

SEQ ID NO: 1194472 - RNA, 16 nt, Homo sapiens
cugcugcuccacggcg

SEQ ID NO: 1194473 - RNA, 14 nt, Homo sapiens
cugcugggaccuug

SEQ ID NO: 1194474 - RNA, 20 nt, Homo sapiens
cugcuguagccugggaccag

SEQ ID NO: 1194475 - RNA, 18 nt, Homo sapiens
cugcuguccccuuggcag

SEQ ID NO: 1194476 - RNA, 13 nt, Homo sapiens
cugcugucuucca

SEQ ID NO: 1194477 - RNA, 19 nt, Homo sapiens
cugcugugauuccacuaca

SEQ ID NO: 1194478 - RNA, 16 nt, Homo sapiens
cugcuguuacuguuaa

SEQ ID NO: 1194479 - RNA, 19 nt, Homo sapiens
cugcuguucauguuacuca

SEQ ID NO: 1194480 - RNA, 15 nt, Homo sapiens
cugcuucuccuccca

SEQ ID NO: 1194481 - RNA, 16 nt, Homo sapiens
cugcuugagagcuauu

SEQ ID NO: 1194482 - RNA, 20 nt, Homo sapiens
cugcuugaugaagcaaggaa

SEQ ID NO: 1194483 - RNA, 22 nt, Homo sapiens
cugcuuggauaugaaacuguag

SEQ ID NO: 1194484 - RNA, 16 nt, Homo sapiens
cugcuuguuggcucca

SEQ ID NO: 1194485 - RNA, 14 nt, Homo sapiens
cugcuuuaucuuuu

SEQ ID NO: 1194486 - RNA, 19 nt, Homo sapiens
cugcuuuuugacaugaaca

SEQ ID NO: 1194487 - RNA, 21 nt, Homo sapiens
cugcuuuuuuuuuuccagcaa

SEQ ID NO: 1194488 - RNA, 17 nt, Homo sapiens
cuggaaaaaaugagccg

SEQ ID NO: 1194489 - RNA, 14 nt, Homo sapiens
cuggaaaagggaag

SEQ ID NO: 1194490 - RNA, 12 nt, Homo sapiens
cuggaaauggac

SEQ ID NO: 1194491 - RNA, 13 nt, Homo sapiens
cuggaaccuugcu

SEQ ID NO: 1194492 - RNA, 17 nt, Homo sapiens
cuggaagacacuucaga

SEQ ID NO: 1194493 - RNA, 14 nt, Homo sapiens
cuggaaggacaucu

SEQ ID NO: 1194494 - RNA, 16 nt, Homo sapiens
cuggaaggcuuccacu

SEQ ID NO: 1194495 - RNA, 15 nt, Homo sapiens
cuggaaggggccacg

SEQ ID NO: 1194496 - RNA, 18 nt, Homo sapiens
cuggaagucaucucauuc

SEQ ID NO: 1194497 - RNA, 14 nt, Homo sapiens
cuggaauacaugaa

SEQ ID NO: 1194498 - RNA, 17 nt, Homo sapiens
cuggaaucacauucuua

SEQ ID NO: 1194499 - RNA, 22 nt, Homo sapiens
cuggaaugggcacagcacagcc

SEQ ID NO: 1194500 - RNA, 20 nt, Homo sapiens
cuggaauguaaucaauguuu

SEQ ID NO: 1194501 - RNA, 21 nt, Homo sapiens
cuggacaaagaaauuccccaa

SEQ ID NO: 1194502 - RNA, 23 nt, Homo sapiens
cuggacaaaggaguaguagcuga

SEQ ID NO: 1194503 - RNA, 16 nt, Homo sapiens
cucuacccugcucccu

SEQ ID NO: 1194504 - RNA, 17 nt, Homo sapiens
cucuacuaaaaauacaa

SEQ ID NO: 1194505 - RNA, 18 nt, Homo sapiens
cucuacuguuuaacaaca

SEQ ID NO: 1194506 - RNA, 15 nt, Homo sapiens
cucuagaagaccaaa

SEQ ID NO: 1194507 - RNA, 20 nt, Homo sapiens
cucuagcaggccuaagacau

SEQ ID NO: 1194508 - RNA, 20 nt, Homo sapiens
cucuagccugggccacaggg

SEQ ID NO: 1194509 - RNA, 22 nt, Homo sapiens
cucuagccugggccacagggcg

SEQ ID NO: 1194510 - RNA, 22 nt, Homo sapiens
cucuagguacgaugacaguguu

SEQ ID NO: 1194511 - RNA, 12 nt, Homo sapiens
cucuaguauuua

SEQ ID NO: 1194512 - RNA, 15 nt, Homo sapiens
cucuaguucuuaaca

SEQ ID NO: 1194513 - RNA, 21 nt, Homo sapiens
cucuauaauuaguuaugacag

SEQ ID NO: 1194514 - RNA, 24 nt, Homo sapiens
cucuaugaccucgcccuccacaaa

SEQ ID NO: 1194515 - RNA, 16 nt, Homo sapiens
cucuaugccccaaaua

SEQ ID NO: 1194516 - RNA, 15 nt, Homo sapiens
cucuauuccaaaaag

SEQ ID NO: 1194517 - RNA, 15 nt, Homo sapiens
cucuauuuaaauucu

SEQ ID NO: 1194518 - RNA, 20 nt, Homo sapiens
cucucaaaagagaaaaacaa

SEQ ID NO: 1194519 - RNA, 16 nt, Homo sapiens
cucucaagcuagccag

SEQ ID NO: 1194520 - RNA, 19 nt, Homo sapiens
cucucacacuuuugcuuga

SEQ ID NO: 1194521 - RNA, 23 nt, Homo sapiens
cucucaccccaacuaguagcuaa

SEQ ID NO: 1194522 - RNA, 19 nt, Homo sapiens
cucucaccuaaaaaaagag

SEQ ID NO: 1194523 - RNA, 23 nt, Homo sapiens
cucucaggaucaagaaaguguug

SEQ ID NO: 1194524 - RNA, 22 nt, Homo sapiens
cucucagugcuucuuacuauua

SEQ ID NO: 1194525 - RNA, 15 nt, Homo sapiens
cucucaguucucgau

SEQ ID NO: 1194526 - RNA, 15 nt, Homo sapiens
cucucaucaacugaa

SEQ ID NO: 1194527 - RNA, 13 nt, Homo sapiens
cucuccaaacagu

SEQ ID NO: 1194528 - RNA, 19 nt, Homo sapiens
cucuccaaacagucaccau

SEQ ID NO: 1194529 - RNA, 20 nt, Homo sapiens
cucucccaccccggccucca

SEQ ID NO: 1194530 - RNA, 21 nt, Homo sapiens
cucuccccagccuccccgugc

SEQ ID NO: 1194531 - RNA, 19 nt, Homo sapiens
cucucccucuucucaagug

SEQ ID NO: 1194532 - RNA, 19 nt, Homo sapiens
cucuccuuccuuacccaaa

SEQ ID NO: 1194533 - RNA, 16 nt, Homo sapiens
cucuccuuuggccauu

SEQ ID NO: 1194534 - RNA, 16 nt, Homo sapiens
cucucgacaguaucca

SEQ ID NO: 1194535 - RNA, 14 nt, Homo sapiens
cucucucgaccuuc

SEQ ID NO: 1194536 - RNA, 13 nt, Homo sapiens
cucucugcuccuu

SEQ ID NO: 1194537 - RNA, 14 nt, Homo sapiens
cucucuucucucca

SEQ ID NO: 1194538 - RNA, 15 nt, Homo sapiens
cucucuucucuccag

SEQ ID NO: 1194539 - RNA, 23 nt, Homo sapiens
cucucuuucuagaggugcuacau

SEQ ID NO: 1194540 - RNA, 22 nt, Homo sapiens
cucucuuuuuggaggugcuuaa

SEQ ID NO: 1194541 - RNA, 13 nt, Homo sapiens
cucugaacuggau

SEQ ID NO: 1194542 - RNA, 16 nt, Homo sapiens
cucugaagcauguuuc

SEQ ID NO: 1194543 - RNA, 18 nt, Homo sapiens
cucugaagguccaaagag

SEQ ID NO: 1194544 - RNA, 15 nt, Homo sapiens
cucugacacacagcu

SEQ ID NO: 1194545 - RNA, 14 nt, Homo sapiens
cugggacuacagau

SEQ ID NO: 1194546 - RNA, 15 nt, Homo sapiens
cugggagaaccucag

SEQ ID NO: 1194547 - RNA, 17 nt, Homo sapiens
cugggagaaccucaggc

SEQ ID NO: 1194548 - RNA, 16 nt, Homo sapiens
cugggagcacuggugu

SEQ ID NO: 1194549 - RNA, 16 nt, Homo sapiens
cugggagcccucaggc

SEQ ID NO: 1194550 - RNA, 17 nt, Homo sapiens
cugggagcccucaggca

SEQ ID NO: 1194551 - RNA, 19 nt, Homo sapiens
cugggagcucaagugaucc

SEQ ID NO: 1194552 - RNA, 14 nt, Homo sapiens
cugggagcugccug

SEQ ID NO: 1194553 - RNA, 19 nt, Homo sapiens
cugggaggguguggugcuu

SEQ ID NO: 1194554 - RNA, 18 nt, Homo sapiens
cugggaugggaacacugg

SEQ ID NO: 1194555 - RNA, 22 nt, Homo sapiens
cugggauuacaauugugagcca

SEQ ID NO: 1194556 - RNA, 15 nt, Homo sapiens
cugggauuacaggcg

SEQ ID NO: 1194557 - RNA, 15 nt, Homo sapiens
cugggauuacaggug

SEQ ID NO: 1194558 - RNA, 15 nt, Homo sapiens
cugggcauacuuucu

SEQ ID NO: 1194559 - RNA, 13 nt, Homo sapiens
cugggcauugcuu

SEQ ID NO: 1194560 - RNA, 20 nt, Homo sapiens
cugggccaaguuccucuagu

SEQ ID NO: 1194561 - RNA, 14 nt, Homo sapiens
cugggccagggucu

SEQ ID NO: 1194562 - RNA, 10 nt, Homo sapiens
cugggccaug

SEQ ID NO: 1194563 - RNA, 14 nt, Homo sapiens
cugggccaugucca

SEQ ID NO: 1194564 - RNA, 15 nt, Homo sapiens
cugggccugaccaaa

SEQ ID NO: 1194565 - RNA, 17 nt, Homo sapiens
cugggcggccucuugcu

SEQ ID NO: 1194566 - RNA, 18 nt, Homo sapiens
cugggcgucuaugcugcu

SEQ ID NO: 1194567 - RNA, 14 nt, Homo sapiens
cugggcuacaauuu

SEQ ID NO: 1194568 - RNA, 20 nt, Homo sapiens
cugggcuccguuguaccaag

SEQ ID NO: 1194569 - RNA, 13 nt, Homo sapiens
cugggcuguaacg

SEQ ID NO: 1194570 - RNA, 19 nt, Homo sapiens
cugggcuuugucaugucuc

SEQ ID NO: 1194571 - RNA, 11 nt, Homo sapiens
cuggggaccau

SEQ ID NO: 1194572 - RNA, 19 nt, Homo sapiens
cuggggauggaauuauugu

SEQ ID NO: 1194573 - RNA, 23 nt, Homo sapiens
cuggggcauuauccaucuuucac

SEQ ID NO: 1194574 - RNA, 15 nt, Homo sapiens
cuggggccuccagaa

SEQ ID NO: 1194575 - RNA, 18 nt, Homo sapiens
cuggggcuuccaucccaa

SEQ ID NO: 1194576 - RNA, 11 nt, Homo sapiens
cugggggaguu

SEQ ID NO: 1194577 - RNA, 16 nt, Homo sapiens
cugggggccucagugc

SEQ ID NO: 1194578 - RNA, 17 nt, Homo sapiens
cuggggggcaccccagc

SEQ ID NO: 1194579 - RNA, 21 nt, Homo sapiens
cugggguuggacuguaaggga

SEQ ID NO: 1194580 - RNA, 20 nt, Homo sapiens
cugggucuaccacucagaga

SEQ ID NO: 1194581 - RNA, 23 nt, Homo sapiens
cugggucucgcuuuguugcccag

SEQ ID NO: 1194582 - RNA, 19 nt, Homo sapiens
cuggguggccucgggacac

SEQ ID NO: 1194583 - RNA, 14 nt, Homo sapiens
cugguaauauugac

SEQ ID NO: 1194584 - RNA, 16 nt, Homo sapiens
cugguagaaaggcagu

SEQ ID NO: 1194585 - RNA, 18 nt, Homo sapiens
cugguagcaaauuaacuu

SEQ ID NO: 1194586 - RNA, 20 nt, Homo sapiens
cugguauauguaaguguuca

SEQ ID NO: 1194587 - RNA, 15 nt, Homo sapiens
cuggucagaugauau

SEQ ID NO: 1194588 - RNA, 23 nt, Homo sapiens
cuggucagucugcccuugucacu

SEQ ID NO: 1194589 - RNA, 23 nt, Homo sapiens
cuggucccaagacagugagacag

SEQ ID NO: 1194590 - RNA, 23 nt, Homo sapiens
cugguccccuccucagugacauc

SEQ ID NO: 1194591 - RNA, 21 nt, Homo sapiens
cuggucccggggccagcacuu

SEQ ID NO: 1194592 - RNA, 15 nt, Homo sapiens
cuggucccuugcagc

SEQ ID NO: 1194593 - RNA, 13 nt, Homo sapiens
cugguccuuccag

SEQ ID NO: 1194594 - RNA, 15 nt, Homo sapiens
cuggucucaaacucc

SEQ ID NO: 1194595 - RNA, 18 nt, Homo sapiens
cuggucucaaacuccuga

SEQ ID NO: 1194596 - RNA, 19 nt, Homo sapiens
cugucccuugcuguaugcu

SEQ ID NO: 1194597 - RNA, 14 nt, Homo sapiens
cuguccuaagcacu

SEQ ID NO: 1194598 - RNA, 16 nt, Homo sapiens
cuguccuaagcacuuu

SEQ ID NO: 1194599 - RNA, 18 nt, Homo sapiens
cuguccugaccaucgcac

SEQ ID NO: 1194600 - RNA, 17 nt, Homo sapiens
cuguccugaucugugau

SEQ ID NO: 1194601 - RNA, 23 nt, Homo sapiens
cuguccugcuucugaaugugcug

SEQ ID NO: 1194602 - RNA, 15 nt, Homo sapiens
cuguccuuccugacc

SEQ ID NO: 1194603 - RNA, 21 nt, Homo sapiens
cuguccuuuuccccuacagaa

SEQ ID NO: 1194604 - RNA, 23 nt, Homo sapiens
cuguccuuuuccccuacagaauu

SEQ ID NO: 1194605 - RNA, 23 nt, Homo sapiens
cugucuaaaaaccagacaaggaa

SEQ ID NO: 1194606 - RNA, 13 nt, Homo sapiens
cugucuacugugg

SEQ ID NO: 1194607 - RNA, 22 nt, Homo sapiens
cugucuauuaauauucagggua

SEQ ID NO: 1194608 - RNA, 21 nt, Homo sapiens
cugucucagacuuuuguacau

SEQ ID NO: 1194609 - RNA, 20 nt, Homo sapiens
cugucucccccauugcucua

SEQ ID NO: 1194610 - RNA, 18 nt, Homo sapiens
cugucuccuguauguggg

SEQ ID NO: 1194611 - RNA, 17 nt, Homo sapiens
cugucuccuuucucagc

SEQ ID NO: 1194612 - RNA, 22 nt, Homo sapiens
cugucucuggcauuuguuuccu

SEQ ID NO: 1194613 - RNA, 12 nt, Homo sapiens
cugucugcauuu

SEQ ID NO: 1194614 - RNA, 15 nt, Homo sapiens
cugucugggggccag

SEQ ID NO: 1194615 - RNA, 16 nt, Homo sapiens
cugucugucaccagcu

SEQ ID NO: 1194616 - RNA, 17 nt, Homo sapiens
cugucugucaccagcua

SEQ ID NO: 1194617 - RNA, 23 nt, Homo sapiens
cugucuuagagugggaccaacuu

SEQ ID NO: 1194618 - RNA, 21 nt, Homo sapiens
cugucuuagaugucaagcuga

SEQ ID NO: 1194619 - RNA, 19 nt, Homo sapiens
cugucuucagagaacccac

SEQ ID NO: 1194620 - RNA, 14 nt, Homo sapiens
cugucuuuaauucu

SEQ ID NO: 1194621 - RNA, 13 nt, Homo sapiens
cugugaaacuggc

SEQ ID NO: 1194622 - RNA, 20 nt, Homo sapiens
cugugaacagagagcgcuuu

SEQ ID NO: 1194623 - RNA, 13 nt, Homo sapiens
cugugaagcauuu

SEQ ID NO: 1194624 - RNA, 15 nt, Homo sapiens
cugugaauacuugaa

SEQ ID NO: 1194625 - RNA, 17 nt, Homo sapiens
cugugaauggaagcaaa

SEQ ID NO: 1194626 - RNA, 22 nt, Homo sapiens
cugugaauggaggcagagaccu

SEQ ID NO: 1194627 - RNA, 15 nt, Homo sapiens
cugugagcagggauu

SEQ ID NO: 1194628 - RNA, 19 nt, Homo sapiens
cugugaggaaguguggaaa

SEQ ID NO: 1194629 - RNA, 18 nt, Homo sapiens
cugugaggccccuggaca

SEQ ID NO: 1194630 - RNA, 22 nt, Homo sapiens
cugugaggccccuggacaagca

SEQ ID NO: 1194631 - RNA, 20 nt, Homo sapiens
cugugagugcgucugagggg

SEQ ID NO: 1194632 - RNA, 13 nt, Homo sapiens
cugugaguguaag

SEQ ID NO: 1194633 - RNA, 18 nt, Homo sapiens
cugugauacgaugcuuca

SEQ ID NO: 1194634 - RNA, 22 nt, Homo sapiens
cugugaucccagcuacuuggga

SEQ ID NO: 1194635 - RNA, 12 nt, Homo sapiens
cugugaugacau

SEQ ID NO: 1194636 - RNA, 15 nt, Homo sapiens
cugugaugacauucc

SEQ ID NO: 1194637 - RNA, 16 nt, Homo sapiens
cugugcaguagcauca

SEQ ID NO: 1194638 - RNA, 20 nt, Homo sapiens
cugugcauacuuucccucau

SEQ ID NO: 1194639 - RNA, 13 nt, Homo sapiens
cugugcaugccau

SEQ ID NO: 1194640 - RNA, 19 nt, Homo sapiens
cugugcauugacaucacag

SEQ ID NO: 1194641 - RNA, 13 nt, Homo sapiens
cugugccaguucu

SEQ ID NO: 1194642 - RNA, 16 nt, Homo sapiens
cugugcccuccaaaga

SEQ ID NO: 1194643 - RNA, 11 nt, Homo sapiens
cuguggcacag

SEQ ID NO: 1194644 - RNA, 15 nt, Homo sapiens
cuguggcagaguuac

SEQ ID NO: 1194645 - RNA, 16 nt, Homo sapiens
cuguggcaucuuugcc

SEQ ID NO: 1194646 - RNA, 14 nt, Homo sapiens
cuguggccugggca

SEQ ID NO: 1194647 - RNA, 13 nt, Homo sapiens
cuguggccuucag

SEQ ID NO: 1194648 - RNA, 22 nt, Homo sapiens
cuguggguccgauaauaucuuu

SEQ ID NO: 1194649 - RNA, 17 nt, Homo sapiens
gaauuucacaagcuauu

SEQ ID NO: 1194650 - RNA, 18 nt, Homo sapiens
gaauuucaguaaacaaug

SEQ ID NO: 1194651 - RNA, 18 nt, Homo sapiens
gaauuuccucuauugaug

SEQ ID NO: 1194652 - RNA, 12 nt, Homo sapiens
gaauuuccuuac

SEQ ID NO: 1194653 - RNA, 20 nt, Homo sapiens
gaauuugggcagcuaccacg

SEQ ID NO: 1194654 - RNA, 14 nt, Homo sapiens
gaauuugguaaauu

SEQ ID NO: 1194655 - RNA, 13 nt, Homo sapiens
gaauuuuguugcu

SEQ ID NO: 1194656 - RNA, 18 nt, Homo sapiens
gaauuuuguuuguugaug

SEQ ID NO: 1194657 - RNA, 21 nt, Homo sapiens
gacaaaaagcacuaguauaaa

SEQ ID NO: 1194658 - RNA, 17 nt, Homo sapiens
gacaaaauaaacauuuu

SEQ ID NO: 1194659 - RNA, 12 nt, Homo sapiens
gacaaacaugca

SEQ ID NO: 1194660 - RNA, 17 nt, Homo sapiens
gacaaaccgagugcaau

SEQ ID NO: 1194661 - RNA, 20 nt, Homo sapiens
gacaaaccuuaaaacagcug

SEQ ID NO: 1194662 - RNA, 21 nt, Homo sapiens
gacaaacuaacaggaacaaaa

SEQ ID NO: 1194663 - RNA, 13 nt, Homo sapiens
gacaaacugugua

SEQ ID NO: 1194664 - RNA, 20 nt, Homo sapiens
gacaaagccuuaaaaugcau

SEQ ID NO: 1194665 - RNA, 21 nt, Homo sapiens
gacaaagggccagcagucuac

SEQ ID NO: 1194666 - RNA, 19 nt, Homo sapiens
gacaaauaucuuuuuugga

SEQ ID NO: 1194667 - RNA, 21 nt, Homo sapiens
gacaaauauuuuagaagcuaa

SEQ ID NO: 1194668 - RNA, 16 nt, Homo sapiens
gacaaaucaacagaag

SEQ ID NO: 1194669 - RNA, 21 nt, Homo sapiens
gacaaaucaacagaagcauuu

SEQ ID NO: 1194670 - RNA, 12 nt, Homo sapiens
gacaacacuuca

SEQ ID NO: 1194671 - RNA, 17 nt, Homo sapiens
gacaacuguggacucca

SEQ ID NO: 1194672 - RNA, 19 nt, Homo sapiens
gacaacuguggacuccagu

SEQ ID NO: 1194673 - RNA, 20 nt, Homo sapiens
gacaacuguggacuccaguu

SEQ ID NO: 1194674 - RNA, 19 nt, Homo sapiens
gacaagacccccagcacuu

SEQ ID NO: 1194675 - RNA, 22 nt, Homo sapiens
gacaagagaugggaaugaggug

SEQ ID NO: 1194676 - RNA, 21 nt, Homo sapiens
gacaagauacauaugaggaca

SEQ ID NO: 1194677 - RNA, 17 nt, Homo sapiens
gacaaggaggaguucca

SEQ ID NO: 1194678 - RNA, 12 nt, Homo sapiens
gacaagggauuu

SEQ ID NO: 1194679 - RNA, 17 nt, Homo sapiens
gacaauaguauuucucc

SEQ ID NO: 1194680 - RNA, 13 nt, Homo sapiens
gacaaucacuaca

SEQ ID NO: 1194681 - RNA, 16 nt, Homo sapiens
gacaaugaugaugaua

SEQ ID NO: 1194682 - RNA, 13 nt, Homo sapiens
gacacaaaacucc

SEQ ID NO: 1194683 - RNA, 11 nt, Homo sapiens
gacacaaagga

SEQ ID NO: 1194684 - RNA, 14 nt, Homo sapiens
gacacaaaugcaug

SEQ ID NO: 1194685 - RNA, 22 nt, Homo sapiens
gacacaacagcagucuccuuca

SEQ ID NO: 1194686 - RNA, 21 nt, Homo sapiens
gacacaacuauuuuuccaaaa

SEQ ID NO: 1194687 - RNA, 21 nt, Homo sapiens
gacacaaucucggcucacuga

SEQ ID NO: 1194688 - RNA, 19 nt, Homo sapiens
gacacagaucccacuggaa

SEQ ID NO: 1194689 - RNA, 17 nt, Homo sapiens
gacacagccuuggauca

SEQ ID NO: 1194690 - RNA, 16 nt, Homo sapiens
gacacaggcccggcuc

SEQ ID NO: 1194691 - RNA, 15 nt, Homo sapiens
gacacaggugccuca

SEQ ID NO: 1194692 - RNA, 19 nt, Homo sapiens
gacacauaugcaccuugug

SEQ ID NO: 1194693 - RNA, 11 nt, Homo sapiens
gacaccaaagc

SEQ ID NO: 1194694 - RNA, 21 nt, Homo sapiens
gacaccagagcagaugcagag

SEQ ID NO: 1194695 - RNA, 19 nt, Homo sapiens
gacacccacccugugccau

SEQ ID NO: 1194696 - RNA, 15 nt, Homo sapiens
gacacccccugggau

SEQ ID NO: 1194697 - RNA, 21 nt, Homo sapiens
gacacccccugggauggcuca

SEQ ID NO: 1194698 - RNA, 18 nt, Homo sapiens
gacaccccugcucuaccc

SEQ ID NO: 1194699 - RNA, 15 nt, Homo sapiens
gacaccuccauuucu

SEQ ID NO: 1194700 - RNA, 20 nt, Homo sapiens
gacaccugagacaugcugaa

SEQ ID NO: 1194701 - RNA, 18 nt, Homo sapiens
gacacuaaccagagucag

SEQ ID NO: 1194702 - RNA, 16 nt, Homo sapiens
gacacugaaaaaucua

SEQ ID NO: 1194703 - RNA, 14 nt, Homo sapiens
gacacuuaauacua

SEQ ID NO: 1194704 - RNA, 14 nt, Homo sapiens
gacacuuauuuauu

SEQ ID NO: 1194705 - RNA, 17 nt, Homo sapiens
gacacuuuaauuaccaa

SEQ ID NO: 1194706 - RNA, 20 nt, Homo sapiens
gaccccaaauuaagaaucua

SEQ ID NO: 1194707 - RNA, 18 nt, Homo sapiens
gaccccacugccaagugg

SEQ ID NO: 1194708 - RNA, 20 nt, Homo sapiens
gaccccaggucagcaucucg

SEQ ID NO: 1194709 - RNA, 18 nt, Homo sapiens
gaccccgcacccggcucg

SEQ ID NO: 1194710 - RNA, 13 nt, Homo sapiens
gaccccucuaccu

SEQ ID NO: 1194711 - RNA, 18 nt, Homo sapiens
gaccccugucucccaaaa

SEQ ID NO: 1194712 - RNA, 23 nt, Homo sapiens
gacccucgggccccauccucauc

SEQ ID NO: 1194713 - RNA, 20 nt, Homo sapiens
gacccucugacccuagcucu

SEQ ID NO: 1194714 - RNA, 24 nt, Homo sapiens
gacccuuguggguccaugcuaaca

SEQ ID NO: 1194715 - RNA, 13 nt, Homo sapiens
gacccuuugccuu

SEQ ID NO: 1194716 - RNA, 21 nt, Homo sapiens
gaccgcguuggaaggugcaga

SEQ ID NO: 1194717 - RNA, 15 nt, Homo sapiens
gaccgugaccaucuu

SEQ ID NO: 1194718 - RNA, 22 nt, Homo sapiens
gaccuaaauuauuuacugcaaa

SEQ ID NO: 1194719 - RNA, 13 nt, Homo sapiens
gaccuaaccacuu

SEQ ID NO: 1194720 - RNA, 11 nt, Homo sapiens
gaccucaggug

SEQ ID NO: 1194721 - RNA, 14 nt, Homo sapiens
gaccucauguuguu

SEQ ID NO: 1194722 - RNA, 20 nt, Homo sapiens
gaccuccagggagccuagaa

SEQ ID NO: 1194723 - RNA, 16 nt, Homo sapiens
gaccucucagcagaaa

SEQ ID NO: 1194724 - RNA, 18 nt, Homo sapiens
gaccucugccugaaguca

SEQ ID NO: 1194725 - RNA, 22 nt, Homo sapiens
gaccugaauaccacuuaccuca

SEQ ID NO: 1194726 - RNA, 23 nt, Homo sapiens
gaccugaauaccacuuaccucaa

SEQ ID NO: 1194727 - RNA, 16 nt, Homo sapiens
gaccugagguugggga

SEQ ID NO: 1194728 - RNA, 20 nt, Homo sapiens
gaccugagucugcaugugca

SEQ ID NO: 1194729 - RNA, 19 nt, Homo sapiens
gaccugccucucacacaca

SEQ ID NO: 1194730 - RNA, 17 nt, Homo sapiens
gaccuggagacugacaa

SEQ ID NO: 1194731 - RNA, 17 nt, Homo sapiens
gaccuggagaugcugcc

SEQ ID NO: 1194732 - RNA, 12 nt, Homo sapiens
gaccuggcacug

SEQ ID NO: 1194733 - RNA, 14 nt, Homo sapiens
gaccuggugcugag

SEQ ID NO: 1194734 - RNA, 22 nt, Homo sapiens
gaccugugaccagcacugucuc

SEQ ID NO: 1194735 - RNA, 19 nt, Homo sapiens
gaccuguucaaaaaggaaa

SEQ ID NO: 1194736 - RNA, 21 nt, Homo sapiens
gaccuguuuaugagaugcugg

SEQ ID NO: 1194737 - RNA, 21 nt, Homo sapiens
gaccuucucccucacuccugc

SEQ ID NO: 1194738 - RNA, 22 nt, Homo sapiens
gaccuugcugauggugacauug

SEQ ID NO: 1194739 - RNA, 18 nt, Homo sapiens
gacgacauacaugcuacu

SEQ ID NO: 1194740 - RNA, 15 nt, Homo sapiens
gacgcugacugcccu

SEQ ID NO: 1194741 - RNA, 23 nt, Homo sapiens
gacgguuaaauacuguguggaac

SEQ ID NO: 1194742 - RNA, 19 nt, Homo sapiens
gacgugugagggaggacag

SEQ ID NO: 1194743 - RNA, 19 nt, Homo sapiens
gacguucauuauguaugaa

SEQ ID NO: 1194744 - RNA, 13 nt, Homo sapiens
gacuacaaccaau

SEQ ID NO: 1194745 - RNA, 20 nt, Homo sapiens
gacuacccauagacaugaaa

SEQ ID NO: 1194746 - RNA, 17 nt, Homo sapiens
gacuacuccaagggaau

SEQ ID NO: 1194747 - RNA, 18 nt, Homo sapiens
gacuacuuguuguaucug

SEQ ID NO: 1194748 - RNA, 17 nt, Homo sapiens
gacuagaggcuugcaua

SEQ ID NO: 1194749 - RNA, 21 nt, Homo sapiens
gacuagccaggaaguacuucc

SEQ ID NO: 1194750 - RNA, 16 nt, Homo sapiens
gacuagucaccugggg

SEQ ID NO: 1194751 - RNA, 17 nt, Homo sapiens
gacuauauacaugugug

SEQ ID NO: 1194752 - RNA, 21 nt, Homo sapiens
gacuauauacauguguguaua

SEQ ID NO: 1194753 - RNA, 14 nt, Homo sapiens
gacuaucaguuccc

SEQ ID NO: 1194754 - RNA, 18 nt, Homo sapiens
gacuauguuucuauucua

SEQ ID NO: 1194755 - RNA, 17 nt, Homo sapiens
gacuauuaggugcaauu

SEQ ID NO: 1194756 - RNA, 19 nt, Homo sapiens
gacucaaauguucuaaguu

SEQ ID NO: 1194757 - RNA, 18 nt, Homo sapiens
gacucaagacacugagau

SEQ ID NO: 1194758 - RNA, 18 nt, Homo sapiens
gacucaaguccuuaccuc

SEQ ID NO: 1194759 - RNA, 17 nt, Homo sapiens
gacucaaugcacugaca

SEQ ID NO: 1194760 - RNA, 19 nt, Homo sapiens
gacucaccucauccuuacc

SEQ ID NO: 1194761 - RNA, 20 nt, Homo sapiens
gagaacacguuggcucaguc

SEQ ID NO: 1194762 - RNA, 9 nt, Homo sapiens
gagaaccac

SEQ ID NO: 1194763 - RNA, 19 nt, Homo sapiens
gagaacucagcuguccagc

SEQ ID NO: 1194764 - RNA, 18 nt, Homo sapiens
gagaacuggaaagacaua

SEQ ID NO: 1194765 - RNA, 17 nt, Homo sapiens
gagaagaauagaggucc

SEQ ID NO: 1194766 - RNA, 16 nt, Homo sapiens
gagaagaccucuguga

SEQ ID NO: 1194767 - RNA, 14 nt, Homo sapiens
gagaagcacuugag

SEQ ID NO: 1194768 - RNA, 23 nt, Homo sapiens
gagaagcagacguccauagcucc

SEQ ID NO: 1194769 - RNA, 20 nt, Homo sapiens
gagaagccuucagcuccagg

SEQ ID NO: 1194770 - RNA, 20 nt, Homo sapiens
gagaagcggauuuccaggga

SEQ ID NO: 1194771 - RNA, 20 nt, Homo sapiens
gagaagcucugaagaacucu

SEQ ID NO: 1194772 - RNA, 16 nt, Homo sapiens
gagaagcugucaggga

SEQ ID NO: 1194773 - RNA, 18 nt, Homo sapiens
gagaaggaaaagacugaa

SEQ ID NO: 1194774 - RNA, 14 nt, Homo sapiens
gagaaggaagccau

SEQ ID NO: 1194775 - RNA, 15 nt, Homo sapiens
gagaaggaggggagc

SEQ ID NO: 1194776 - RNA, 16 nt, Homo sapiens
gagaaggaggggagca

SEQ ID NO: 1194777 - RNA, 13 nt, Homo sapiens
gagaaucacugga

SEQ ID NO: 1194778 - RNA, 16 nt, Homo sapiens
gagaauccauccaaag

SEQ ID NO: 1194779 - RNA, 20 nt, Homo sapiens
gagaaucucagcgugggcca

SEQ ID NO: 1194780 - RNA, 18 nt, Homo sapiens
gagaauggaaaccacaac

SEQ ID NO: 1194781 - RNA, 16 nt, Homo sapiens
gagaauguuguauuca

SEQ ID NO: 1194782 - RNA, 18 nt, Homo sapiens
gagaauuccuccuggcag

SEQ ID NO: 1194783 - RNA, 14 nt, Homo sapiens
gagaauuggcucaa

SEQ ID NO: 1194784 - RNA, 16 nt, Homo sapiens
gagaauuuaaacaaug

SEQ ID NO: 1194785 - RNA, 20 nt, Homo sapiens
gagaauuuccuuacucuuga

SEQ ID NO: 1194786 - RNA, 19 nt, Homo sapiens
gagacaaaccuuaaaacag

SEQ ID NO: 1194787 - RNA, 13 nt, Homo sapiens
gagacagaagcag

SEQ ID NO: 1194788 - RNA, 19 nt, Homo sapiens
gagacagagacaaguaauu

SEQ ID NO: 1194789 - RNA, 14 nt, Homo sapiens
gagacagauaacuc

SEQ ID NO: 1194790 - RNA, 15 nt, Homo sapiens
gagacaggcccaaga

SEQ ID NO: 1194791 - RNA, 16 nt, Homo sapiens
gagacaggcccaagag

SEQ ID NO: 1194792 - RNA, 22 nt, Homo sapiens
gagacagugacuggugccagug

SEQ ID NO: 1194793 - RNA, 13 nt, Homo sapiens
gagacaugugaca

SEQ ID NO: 1194794 - RNA, 22 nt, Homo sapiens
gagaccaagacucugaaaucuc

SEQ ID NO: 1194795 - RNA, 23 nt, Homo sapiens
gagaccacugaguaccaggggcu

SEQ ID NO: 1194796 - RNA, 22 nt, Homo sapiens
gagacccaagggcagagcauuu

SEQ ID NO: 1194797 - RNA, 14 nt, Homo sapiens
gagaccgaggacac

SEQ ID NO: 1194798 - RNA, 14 nt, Homo sapiens
gagaccguccucac

SEQ ID NO: 1194799 - RNA, 20 nt, Homo sapiens
gagaccguccuggagcugga

SEQ ID NO: 1194800 - RNA, 17 nt, Homo sapiens
gagaccuaccucagguu

SEQ ID NO: 1194801 - RNA, 19 nt, Homo sapiens
gagaccuagagaucuggcu

SEQ ID NO: 1194802 - RNA, 13 nt, Homo sapiens
gagaccugagucu

SEQ ID NO: 1194803 - RNA, 18 nt, Homo sapiens
gagacgguguuuugccau

SEQ ID NO: 1194804 - RNA, 16 nt, Homo sapiens
gagacuauggagccug

SEQ ID NO: 1194805 - RNA, 14 nt, Homo sapiens
gagacugcgggaug

SEQ ID NO: 1194806 - RNA, 14 nt, Homo sapiens
gagacuggccaggc

SEQ ID NO: 1194807 - RNA, 21 nt, Homo sapiens
gagacugucucaagagggcac

SEQ ID NO: 1194808 - RNA, 18 nt, Homo sapiens
gagacuuaaaaaauacuu

SEQ ID NO: 1194809 - RNA, 20 nt, Homo sapiens
gagacuucacgggcaaucau

SEQ ID NO: 1194810 - RNA, 20 nt, Homo sapiens
gagacuugugcucaaggaau

SEQ ID NO: 1194811 - RNA, 13 nt, Homo sapiens
gagagaaaacugc

SEQ ID NO: 1194812 - RNA, 14 nt, Homo sapiens
gagagagaaggcag

SEQ ID NO: 1194813 - RNA, 15 nt, Homo sapiens
gagagagacaggcag

SEQ ID NO: 1194814 - RNA, 21 nt, Homo sapiens
gagagaggaaggagauuccac

SEQ ID NO: 1194815 - RNA, 15 nt, Homo sapiens
gauagggaacugggg

SEQ ID NO: 1194816 - RNA, 15 nt, Homo sapiens
gauaguccaaagacu

SEQ ID NO: 1194817 - RNA, 13 nt, Homo sapiens
gauaguucccaaa

SEQ ID NO: 1194818 - RNA, 18 nt, Homo sapiens
gauauaaaaauaauguca

SEQ ID NO: 1194819 - RNA, 13 nt, Homo sapiens
gauauacauauca

SEQ ID NO: 1194820 - RNA, 12 nt, Homo sapiens
gauauaccaaau

SEQ ID NO: 1194821 - RNA, 15 nt, Homo sapiens
gauauauaccacuuu

SEQ ID NO: 1194822 - RNA, 22 nt, Homo sapiens
gauauauauaugcuuggcuaac

SEQ ID NO: 1194823 - RNA, 16 nt, Homo sapiens
gauauaucaaacugaa

SEQ ID NO: 1194824 - RNA, 20 nt, Homo sapiens
gauauauuuaagccuuauaa

SEQ ID NO: 1194825 - RNA, 22 nt, Homo sapiens
gauaucugcagggacagagcau

SEQ ID NO: 1194826 - RNA, 15 nt, Homo sapiens
gauaugaaggauuac

SEQ ID NO: 1194827 - RNA, 13 nt, Homo sapiens
gauaugcuguauu

SEQ ID NO: 1194828 - RNA, 13 nt, Homo sapiens
gauaugggacuga

SEQ ID NO: 1194829 - RNA, 15 nt, Homo sapiens
gauauuaacugagaa

SEQ ID NO: 1194830 - RNA, 20 nt, Homo sapiens
gauauuaauagauaauauga

SEQ ID NO: 1194831 - RNA, 13 nt, Homo sapiens
gauauuacuuuau

SEQ ID NO: 1194832 - RNA, 16 nt, Homo sapiens
gauauugaauguuaaa

SEQ ID NO: 1194833 - RNA, 21 nt, Homo sapiens
gaucaaaauaaaaagugacac

SEQ ID NO: 1194834 - RNA, 14 nt, Homo sapiens
gaucaaaauuacuu

SEQ ID NO: 1194835 - RNA, 14 nt, Homo sapiens
gaucaacucugucu

SEQ ID NO: 1194836 - RNA, 15 nt, Homo sapiens
gaucaagaacauguc

SEQ ID NO: 1194837 - RNA, 18 nt, Homo sapiens
gaucaauaaaaugugauu

SEQ ID NO: 1194838 - RNA, 12 nt, Homo sapiens
gaucacugccac

SEQ ID NO: 1194839 - RNA, 15 nt, Homo sapiens
gaucacuuuguuaaa

SEQ ID NO: 1194840 - RNA, 15 nt, Homo sapiens
gaucagcaucuguga

SEQ ID NO: 1194841 - RNA, 16 nt, Homo sapiens
gaucagcaucugugau

SEQ ID NO: 1194842 - RNA, 19 nt, Homo sapiens
gaucagcccugccaggugg

SEQ ID NO: 1194843 - RNA, 18 nt, Homo sapiens
gaucauccacugugccau

SEQ ID NO: 1194844 - RNA, 22 nt, Homo sapiens
gaucaucccuuucucccaguga

SEQ ID NO: 1194845 - RNA, 21 nt, Homo sapiens
gaucauuuuuaacugauucuu

SEQ ID NO: 1194846 - RNA, 13 nt, Homo sapiens
gauccagacugua

SEQ ID NO: 1194847 - RNA, 14 nt, Homo sapiens
gauccagacuguaa

SEQ ID NO: 1194848 - RNA, 20 nt, Homo sapiens
gauccauccaucuccaggga

SEQ ID NO: 1194849 - RNA, 16 nt, Homo sapiens
gauccccaagugugaa

SEQ ID NO: 1194850 - RNA, 19 nt, Homo sapiens
gauccucacccgaaucucc

SEQ ID NO: 1194851 - RNA, 16 nt, Homo sapiens
gauccucccucauggc

SEQ ID NO: 1194852 - RNA, 20 nt, Homo sapiens
gauccuggccccucaaccuc

SEQ ID NO: 1194853 - RNA, 20 nt, Homo sapiens
gauccuucaaagagucauau

SEQ ID NO: 1194854 - RNA, 20 nt, Homo sapiens
gaucggagccuccucucuca

SEQ ID NO: 1194855 - RNA, 17 nt, Homo sapiens
gaucgguucugugccuu

SEQ ID NO: 1194856 - RNA, 16 nt, Homo sapiens
gaucuaccugccucag

SEQ ID NO: 1194857 - RNA, 21 nt, Homo sapiens
gaucuacuucauagcuccuug

SEQ ID NO: 1194858 - RNA, 19 nt, Homo sapiens
gaucuauauuucuggugaa

SEQ ID NO: 1194859 - RNA, 22 nt, Homo sapiens
gaucuauauuuuuguacugaau

SEQ ID NO: 1194860 - RNA, 20 nt, Homo sapiens
gaucucaauuugcaguauuc

SEQ ID NO: 1194861 - RNA, 15 nt, Homo sapiens
gaucucccacugcgg

SEQ ID NO: 1194862 - RNA, 15 nt, Homo sapiens
gaucuccccacucua

SEQ ID NO: 1194863 - RNA, 23 nt, Homo sapiens
gaucuccccucacacuuugccau

SEQ ID NO: 1194864 - RNA, 14 nt, Homo sapiens
gaucugaaaucauu

SEQ ID NO: 1194865 - RNA, 15 nt, Homo sapiens
gaucugcaaacaaug

SEQ ID NO: 1194866 - RNA, 18 nt, Homo sapiens
gaucugcaucugauagaa

SEQ ID NO: 1194867 - RNA, 23 nt, Homo sapiens
gaucugccgccucagcuucucaa

SEQ ID NO: 1194868 - RNA, 21 nt, Homo sapiens
gauuuuucucaaaguuuugaa

SEQ ID NO: 1194869 - RNA, 17 nt, Homo sapiens
gauuuuucugcacuaau

SEQ ID NO: 1194870 - RNA, 17 nt, Homo sapiens
gauuuuuguauguuaug

SEQ ID NO: 1194871 - RNA, 17 nt, Homo sapiens
gauuuuuuccucugcau

SEQ ID NO: 1194872 - RNA, 22 nt, Homo sapiens
gauuuuuugcauuccugacaaa

SEQ ID NO: 1194873 - RNA, 23 nt, Homo sapiens
gauuuuuuguuauguuugcacuu

SEQ ID NO: 1194874 - RNA, 22 nt, Homo sapiens
gauuuuuuuuaauuaccaugcu

SEQ ID NO: 1194875 - RNA, 21 nt, Homo sapiens
gcaaaaaaauuaaauuauuua

SEQ ID NO: 1194876 - RNA, 20 nt, Homo sapiens
gcaaaaaagaaaaauaauca

SEQ ID NO: 1194877 - RNA, 15 nt, Homo sapiens
gcaaaaaaugaaugu

SEQ ID NO: 1194878 - RNA, 22 nt, Homo sapiens
gcaaaaacauguaugugcauuu

SEQ ID NO: 1194879 - RNA, 13 nt, Homo sapiens
gcaaaaaguauug

SEQ ID NO: 1194880 - RNA, 19 nt, Homo sapiens
gcaaaacaaaaauuaggua

SEQ ID NO: 1194881 - RNA, 15 nt, Homo sapiens
gcaaaacuuaggcau

SEQ ID NO: 1194882 - RNA, 19 nt, Homo sapiens
gcaaaacuuaggcaugcac

SEQ ID NO: 1194883 - RNA, 19 nt, Homo sapiens
gcaaaaucucuacugcuuu

SEQ ID NO: 1194884 - RNA, 15 nt, Homo sapiens
gcaaaaugcuuacag

SEQ ID NO: 1194885 - RNA, 21 nt, Homo sapiens
gcaaaauugucuaaaauguca

SEQ ID NO: 1194886 - RNA, 13 nt, Homo sapiens
gcaaacaggcagu

SEQ ID NO: 1194887 - RNA, 20 nt, Homo sapiens
gcaaaccuguucaucuugcc

SEQ ID NO: 1194888 - RNA, 15 nt, Homo sapiens
gcaaaccuuccuggg

SEQ ID NO: 1194889 - RNA, 18 nt, Homo sapiens
gcaaagccuuuccagaaa

SEQ ID NO: 1194890 - RNA, 20 nt, Homo sapiens
gcaaagcugaugacaacuuc

SEQ ID NO: 1194891 - RNA, 19 nt, Homo sapiens
gcaaagugauucacugugc

SEQ ID NO: 1194892 - RNA, 15 nt, Homo sapiens
gcaaagugcacauga

SEQ ID NO: 1194893 - RNA, 23 nt, Homo sapiens
gcaaagugcugcuggaaguagaa

SEQ ID NO: 1194894 - RNA, 19 nt, Homo sapiens
gcaaaguucccuacuuccu

SEQ ID NO: 1194895 - RNA, 16 nt, Homo sapiens
gcaaauaaaccacuuu

SEQ ID NO: 1194896 - RNA, 22 nt, Homo sapiens
gcaaaugacuaguaaacaugug

SEQ ID NO: 1194897 - RNA, 18 nt, Homo sapiens
gcaaaugcagaaccacaa

SEQ ID NO: 1194898 - RNA, 22 nt, Homo sapiens
gcaacaagaccaccacuucgaa

SEQ ID NO: 1194899 - RNA, 14 nt, Homo sapiens
gcaacagacuugaa

SEQ ID NO: 1194900 - RNA, 15 nt, Homo sapiens
gcaacagcacuggcu

SEQ ID NO: 1194901 - RNA, 13 nt, Homo sapiens
gcaaccccaguuc

SEQ ID NO: 1194902 - RNA, 17 nt, Homo sapiens
gcaacccuaacaguaag

SEQ ID NO: 1194903 - RNA, 22 nt, Homo sapiens
gcaaccuuuuucccucuuccca

SEQ ID NO: 1194904 - RNA, 22 nt, Homo sapiens
gcaacguagcuucuaccaugaa

SEQ ID NO: 1194905 - RNA, 14 nt, Homo sapiens
gcaacuacagaauu

SEQ ID NO: 1194906 - RNA, 15 nt, Homo sapiens
gcaacuacagaauuu

SEQ ID NO: 1194907 - RNA, 16 nt, Homo sapiens
gcaacugaaauuacau

SEQ ID NO: 1194908 - RNA, 11 nt, Homo sapiens
gcaacuuugau

SEQ ID NO: 1194909 - RNA, 23 nt, Homo sapiens
gcaagaacaccauccuacauaau

SEQ ID NO: 1194910 - RNA, 18 nt, Homo sapiens
gcaagacuguugcucaaa

SEQ ID NO: 1194911 - RNA, 15 nt, Homo sapiens
gcaagagaauuacuu

SEQ ID NO: 1194912 - RNA, 19 nt, Homo sapiens
gcaagagcccccuugacac

SEQ ID NO: 1194913 - RNA, 16 nt, Homo sapiens
gcaagaguggacugaa

SEQ ID NO: 1194914 - RNA, 13 nt, Homo sapiens
gcaagcagggaaa

SEQ ID NO: 1194915 - RNA, 16 nt, Homo sapiens
gcaagccugucuucag

SEQ ID NO: 1194916 - RNA, 17 nt, Homo sapiens
gcaagccuugcuagaca

SEQ ID NO: 1194917 - RNA, 22 nt, Homo sapiens
gcaagccuugcuagacagccag

SEQ ID NO: 1194918 - RNA, 13 nt, Homo sapiens
gcaaggagaaaaa

SEQ ID NO: 1194919 - RNA, 14 nt, Homo sapiens
gcaagggauaacuc

SEQ ID NO: 1194920 - RNA, 17 nt, Homo sapiens
gcaagucuuccaugacc

SEQ ID NO: 1194921 - RNA, 14 nt, Homo sapiens
gcaaguuagaacua

SEQ ID NO: 1194922 - RNA, 18 nt, Homo sapiens
gcaauaaacuccuacuaa

SEQ ID NO: 1194923 - RNA, 20 nt, Homo sapiens
gcaauaaacuccuacuaaau

SEQ ID NO: 1194924 - RNA, 19 nt, Homo sapiens
gcaauaaauaacacuuguc

SEQ ID NO: 1194925 - RNA, 14 nt, Homo sapiens
gcaauaaauaccag

SEQ ID NO: 1194926 - RNA, 13 nt, Homo sapiens
gcaauacauuuca

SEQ ID NO: 1194927 - RNA, 20 nt, Homo sapiens
gcaauacugagugugccuca

SEQ ID NO: 1194928 - RNA, 16 nt, Homo sapiens
gcaauagcaguuauaa

SEQ ID NO: 1194929 - RNA, 21 nt, Homo sapiens
gcaauauaucugaagagcuau

SEQ ID NO: 1194930 - RNA, 18 nt, Homo sapiens
gcaaucagaguguacaaa

SEQ ID NO: 1194931 - RNA, 15 nt, Homo sapiens
gcaaucaugagcaag

SEQ ID NO: 1194932 - RNA, 16 nt, Homo sapiens
gcaaucuccuuacugu

SEQ ID NO: 1194933 - RNA, 15 nt, Homo sapiens
gcaaucucucucugu

SEQ ID NO: 1194934 - RNA, 15 nt, Homo sapiens
gcaaucugacccuau

SEQ ID NO: 1194935 - RNA, 14 nt, Homo sapiens
gcaaucuuugccuu

SEQ ID NO: 1194936 - RNA, 15 nt, Homo sapiens
gcaaugacaucucag

SEQ ID NO: 1194937 - RNA, 22 nt, Homo sapiens
gcaaugcaugauacuaucugug

SEQ ID NO: 1194938 - RNA, 20 nt, Homo sapiens
gcaaugcauuugauggccac

SEQ ID NO: 1194939 - RNA, 19 nt, Homo sapiens
gcaauguaucccuucucac

SEQ ID NO: 1194940 - RNA, 21 nt, Homo sapiens
gcaaugucucuuugugcucua

SEQ ID NO: 1194941 - RNA, 17 nt, Homo sapiens
gcagugugaaaaguccu

SEQ ID NO: 1194942 - RNA, 21 nt, Homo sapiens
gcaguguuucccguauugaca

SEQ ID NO: 1194943 - RNA, 17 nt, Homo sapiens
gcaguuccugucccuuc

SEQ ID NO: 1194944 - RNA, 23 nt, Homo sapiens
gcaguucugaguguuuaauuuca

SEQ ID NO: 1194945 - RNA, 14 nt, Homo sapiens
gcaguuggacucuc

SEQ ID NO: 1194946 - RNA, 19 nt, Homo sapiens
gcaguuggacucucaggga

SEQ ID NO: 1194947 - RNA, 18 nt, Homo sapiens
gcaguuuaagagcagaac

SEQ ID NO: 1194948 - RNA, 13 nt, Homo sapiens
gcaguuuccaaua

SEQ ID NO: 1194949 - RNA, 21 nt, Homo sapiens
gcaguuugcuuuguaugcacu

SEQ ID NO: 1194950 - RNA, 16 nt, Homo sapiens
gcauaaaaacauuuua

SEQ ID NO: 1194951 - RNA, 20 nt, Homo sapiens
gcauaaaagacaagcacuuu

SEQ ID NO: 1194952 - RNA, 16 nt, Homo sapiens
gcauaaauaugcagug

SEQ ID NO: 1194953 - RNA, 19 nt, Homo sapiens
gcauaaauaugcagugaua

SEQ ID NO: 1194954 - RNA, 19 nt, Homo sapiens
gcauaacaaaaagaugacc

SEQ ID NO: 1194955 - RNA, 20 nt, Homo sapiens
gcauaagagcuuaagaacca

SEQ ID NO: 1194956 - RNA, 17 nt, Homo sapiens
gcauaagcuaucaccua

SEQ ID NO: 1194957 - RNA, 18 nt, Homo sapiens
gcauaaguuaacuuccaa

SEQ ID NO: 1194958 - RNA, 23 nt, Homo sapiens
gcauaaguuuggagcacuaguuu

SEQ ID NO: 1194959 - RNA, 13 nt, Homo sapiens
gcauaaugcaauc

SEQ ID NO: 1194960 - RNA, 23 nt, Homo sapiens
gcauacaaagagguguacaggua

SEQ ID NO: 1194961 - RNA, 14 nt, Homo sapiens
gcauacacacaggu

SEQ ID NO: 1194962 - RNA, 15 nt, Homo sapiens
gcauaccacuugaag

SEQ ID NO: 1194963 - RNA, 16 nt, Homo sapiens
gcauacuuucccucau

SEQ ID NO: 1194964 - RNA, 20 nt, Homo sapiens
gcauacuuucccucauccau

SEQ ID NO: 1194965 - RNA, 16 nt, Homo sapiens
gcauagaacuggguaa

SEQ ID NO: 1194966 - RNA, 18 nt, Homo sapiens
gcauagagcccuggccag

SEQ ID NO: 1194967 - RNA, 14 nt, Homo sapiens
gcauagauugauca

SEQ ID NO: 1194968 - RNA, 20 nt, Homo sapiens
gcauagcaguauauguuaau

SEQ ID NO: 1194969 - RNA, 18 nt, Homo sapiens
gcauaguaccucugcuau

SEQ ID NO: 1194970 - RNA, 24 nt, Homo sapiens
gcauauauaaguuuacaccuuuau

SEQ ID NO: 1194971 - RNA, 18 nt, Homo sapiens
gcauaucaaaaaguauua

SEQ ID NO: 1194972 - RNA, 15 nt, Homo sapiens
gcauaucaacuugag

SEQ ID NO: 1194973 - RNA, 21 nt, Homo sapiens
gcauauccaccaccucccuca

SEQ ID NO: 1194974 - RNA, 18 nt, Homo sapiens
gcauauguguuacuucaa

SEQ ID NO: 1194975 - RNA, 15 nt, Homo sapiens
gcauauguugaauac

SEQ ID NO: 1194976 - RNA, 18 nt, Homo sapiens
gcauauuaagcacuuuaa

SEQ ID NO: 1194977 - RNA, 21 nt, Homo sapiens
gcauauuuauugcauugcugg

SEQ ID NO: 1194978 - RNA, 13 nt, Homo sapiens
gcaucaaggucag

SEQ ID NO: 1194979 - RNA, 17 nt, Homo sapiens
gcaucaauacaaccagc

SEQ ID NO: 1194980 - RNA, 17 nt, Homo sapiens
gcaucaguagcaucugu

SEQ ID NO: 1194981 - RNA, 22 nt, Homo sapiens
gcaucagugggaucccagacau

SEQ ID NO: 1194982 - RNA, 13 nt, Homo sapiens
gcaucauuacugu

SEQ ID NO: 1194983 - RNA, 20 nt, Homo sapiens
gcauccacccagugcugcca

SEQ ID NO: 1194984 - RNA, 17 nt, Homo sapiens
gcaucccagcaccugcc

SEQ ID NO: 1194985 - RNA, 21 nt, Homo sapiens
gcauccuccacauccuguguc

SEQ ID NO: 1194986 - RNA, 18 nt, Homo sapiens
gcauccuggcacccggcc

SEQ ID NO: 1194987 - RNA, 21 nt, Homo sapiens
gcaucuaaguuauaagacucu

SEQ ID NO: 1194988 - RNA, 21 nt, Homo sapiens
gcaucucaaaauuauucugcc

SEQ ID NO: 1194989 - RNA, 13 nt, Homo sapiens
gcaucucagccua

SEQ ID NO: 1194990 - RNA, 13 nt, Homo sapiens
gcaucuccugugc

SEQ ID NO: 1194991 - RNA, 19 nt, Homo sapiens
gcaucuguaacagcauuaa

SEQ ID NO: 1194992 - RNA, 15 nt, Homo sapiens
gcaucugugccagag

SEQ ID NO: 1194993 - RNA, 20 nt, Homo sapiens
gcaucuucugguuuaaacuu

SEQ ID NO: 1194994 - RNA, 14 nt, Homo sapiens
gcaucuuguuucau

SEQ ID NO: 1194995 - RNA, 16 nt, Homo sapiens
gcaugaaauuuugccu

SEQ ID NO: 1194996 - RNA, 15 nt, Homo sapiens
gcaugaaccuggacc

SEQ ID NO: 1194997 - RNA, 18 nt, Homo sapiens
gcaugaauaaaacacuca

SEQ ID NO: 1194998 - RNA, 17 nt, Homo sapiens
gcaugaauccaguccag

SEQ ID NO: 1194999 - RNA, 20 nt, Homo sapiens
gcaugacaaacacacaucca

SEQ ID NO: 1195000 - RNA, 20 nt, Homo sapiens
gcaugaccugugaccagcac

SEQ ID NO: 1195001 - RNA, 22 nt, Homo sapiens
gcaugaggaggucccacuugca

SEQ ID NO: 1195002 - RNA, 16 nt, Homo sapiens
gcaugcugcuuugcca

SEQ ID NO: 1195003 - RNA, 22 nt, Homo sapiens
gcaugcuggggcccuaccagca

SEQ ID NO: 1195004 - RNA, 16 nt, Homo sapiens
gcaugcuuugcugcua

SEQ ID NO: 1195005 - RNA, 23 nt, Homo sapiens
gcauggaaaaaugguugauggaa

SEQ ID NO: 1195006 - RNA, 14 nt, Homo sapiens
gcauggaacagcau

SEQ ID NO: 1195007 - RNA, 14 nt, Homo sapiens
gcauggacauuuag

SEQ ID NO: 1195008 - RNA, 22 nt, Homo sapiens
gcauggauccagaacugcacuc

SEQ ID NO: 1195009 - RNA, 18 nt, Homo sapiens
gcauggauggguccucac

SEQ ID NO: 1195010 - RNA, 20 nt, Homo sapiens
gcauggccugcagucuggca

SEQ ID NO: 1195011 - RNA, 13 nt, Homo sapiens
gcauggccuuagc

SEQ ID NO: 1195012 - RNA, 22 nt, Homo sapiens
gcaugggcgcaggcccagugac

SEQ ID NO: 1195013 - RNA, 18 nt, Homo sapiens
gcaugguguuuucauucc

SEQ ID NO: 1195014 - RNA, 13 nt, Homo sapiens
gcauguccuuugc

SEQ ID NO: 1195015 - RNA, 22 nt, Homo sapiens
gcauguccuuugcgccugugac

SEQ ID NO: 1195016 - RNA, 23 nt, Homo sapiens
gcaugucgugaccaacuagacau

SEQ ID NO: 1195017 - RNA, 18 nt, Homo sapiens
gcaugucucccuccaguc

SEQ ID NO: 1195018 - RNA, 15 nt, Homo sapiens
gcaugugcagcuauu

SEQ ID NO: 1195019 - RNA, 11 nt, Homo sapiens
gcaugugccaa

SEQ ID NO: 1195020 - RNA, 13 nt, Homo sapiens
gcauuaaauucac

SEQ ID NO: 1195021 - RNA, 18 nt, Homo sapiens
gcauuacuauucacugau

SEQ ID NO: 1195022 - RNA, 20 nt, Homo sapiens
gcauuaggaagaaaggagcu

SEQ ID NO: 1195023 - RNA, 16 nt, Homo sapiens
gcauucccucccauca

SEQ ID NO: 1195024 - RNA, 17 nt, Homo sapiens
gcauuccugaugaccaa

SEQ ID NO: 1195025 - RNA, 15 nt, Homo sapiens
gcauugacaucacag

SEQ ID NO: 1195026 - RNA, 10 nt, Homo sapiens
gcauugcugg

SEQ ID NO: 1195027 - RNA, 22 nt, Homo sapiens
uccaaaguuauccccuccuuua

SEQ ID NO: 1195028 - RNA, 21 nt, Homo sapiens
uccaaaguucccacuccuuca

SEQ ID NO: 1195029 - RNA, 15 nt, Homo sapiens
uccaaauguccucca

SEQ ID NO: 1195030 - RNA, 14 nt, Homo sapiens
uccaacaaaccaca

SEQ ID NO: 1195031 - RNA, 17 nt, Homo sapiens
uccaacaccacagacac

SEQ ID NO: 1195032 - RNA, 16 nt, Homo sapiens
uccaacacugcaacau

SEQ ID NO: 1195033 - RNA, 14 nt, Homo sapiens
uccaaccacuguac

SEQ ID NO: 1195034 - RNA, 13 nt, Homo sapiens
uccaaccaggcag

SEQ ID NO: 1195035 - RNA, 13 nt, Homo sapiens
uccaacccgggga

SEQ ID NO: 1195036 - RNA, 22 nt, Homo sapiens
uccaaccugagaaauggccaaa

SEQ ID NO: 1195037 - RNA, 15 nt, Homo sapiens
uccaaccuucccaaa

SEQ ID NO: 1195038 - RNA, 14 nt, Homo sapiens
uccaacuccaggau

SEQ ID NO: 1195039 - RNA, 17 nt, Homo sapiens
uccaacuguacuuuuaa

SEQ ID NO: 1195040 - RNA, 19 nt, Homo sapiens
uccaacuuuaucauggaau

SEQ ID NO: 1195041 - RNA, 21 nt, Homo sapiens
uccaagaaggccuucauggcc

SEQ ID NO: 1195042 - RNA, 11 nt, Homo sapiens
uccaagaccaa

SEQ ID NO: 1195043 - RNA, 20 nt, Homo sapiens
uccaagacucuagaguccaa

SEQ ID NO: 1195044 - RNA, 16 nt, Homo sapiens
uccaagagguggguaa

SEQ ID NO: 1195045 - RNA, 23 nt, Homo sapiens
uccaagccugaccacgcuuucua

SEQ ID NO: 1195046 - RNA, 21 nt, Homo sapiens
uccaagggacccuuugccuuu

SEQ ID NO: 1195047 - RNA, 17 nt, Homo sapiens
uccaaggguacuaagga

SEQ ID NO: 1195048 - RNA, 12 nt, Homo sapiens
uccaauaugaug

SEQ ID NO: 1195049 - RNA, 17 nt, Homo sapiens
uccaauauuuucuuuaa

SEQ ID NO: 1195050 - RNA, 13 nt, Homo sapiens
uccaaucucuggu

SEQ ID NO: 1195051 - RNA, 11 nt, Homo sapiens
uccaaugcaca

SEQ ID NO: 1195052 - RNA, 16 nt, Homo sapiens
uccaaugcauugcuaa

SEQ ID NO: 1195053 - RNA, 15 nt, Homo sapiens
uccaauguagcucag

SEQ ID NO: 1195054 - RNA, 18 nt, Homo sapiens
uccaaugucaaugugaac

SEQ ID NO: 1195055 - RNA, 21 nt, Homo sapiens
uccaaugucugcugaggaguu

SEQ ID NO: 1195056 - RNA, 22 nt, Homo sapiens
uccaaugugugcauggaacaaa

SEQ ID NO: 1195057 - RNA, 17 nt, Homo sapiens
uccacaagagugaauuu

SEQ ID NO: 1195058 - RNA, 11 nt, Homo sapiens
uccacaaggaa

SEQ ID NO: 1195059 - RNA, 15 nt, Homo sapiens
uccacaauagucaga

SEQ ID NO: 1195060 - RNA, 17 nt, Homo sapiens
uccacagagacaucucc

SEQ ID NO: 1195061 - RNA, 11 nt, Homo sapiens
uccacagcuua

SEQ ID NO: 1195062 - RNA, 14 nt, Homo sapiens
uccacagugcugcu

SEQ ID NO: 1195063 - RNA, 16 nt, Homo sapiens
uccacauauagagcuc

SEQ ID NO: 1195064 - RNA, 21 nt, Homo sapiens
uccacauggaaucaaucuuua

SEQ ID NO: 1195065 - RNA, 12 nt, Homo sapiens
uccacauguuac

SEQ ID NO: 1195066 - RNA, 19 nt, Homo sapiens
uccacauuauacauuugau

SEQ ID NO: 1195067 - RNA, 15 nt, Homo sapiens
uccacauuugucaca

SEQ ID NO: 1195068 - RNA, 17 nt, Homo sapiens
uccaccacaucugccag

SEQ ID NO: 1195069 - RNA, 15 nt, Homo sapiens
uccacccgucucucu

SEQ ID NO: 1195070 - RNA, 21 nt, Homo sapiens
uccaccuaccacucacaugac

SEQ ID NO: 1195071 - RNA, 22 nt, Homo sapiens
uccaccuaccacucacaugaca

SEQ ID NO: 1195072 - RNA, 23 nt, Homo sapiens
uccaccuccaccacaucugccag

SEQ ID NO: 1195073 - RNA, 13 nt, Homo sapiens
uccaccugucuca

SEQ ID NO: 1195074 - RNA, 13 nt, Homo sapiens
uccaccugugaga

SEQ ID NO: 1195075 - RNA, 12 nt, Homo sapiens
uccaccuguggg

SEQ ID NO: 1195076 - RNA, 12 nt, Homo sapiens
uccaccuuccau

SEQ ID NO: 1195077 - RNA, 14 nt, Homo sapiens
uccacgauccugcc

SEQ ID NO: 1195078 - RNA, 16 nt, Homo sapiens
uccacgucuuuucuca

SEQ ID NO: 1195079 - RNA, 19 nt, Homo sapiens
uccacgugauuuccaguga

SEQ ID NO: 1195080 - RNA, 21 nt, Homo sapiens
uccacuaggguccaccaggag

SEQ ID NO: 1195081 - RNA, 12 nt, Homo sapiens
uccacucagguu

SEQ ID NO: 1195082 - RNA, 21 nt, Homo sapiens
uccacucagguucuucagggc

SEQ ID NO: 1195083 - RNA, 16 nt, Homo sapiens
uccacuccacucaggu

SEQ ID NO: 1195084 - RNA, 17 nt, Homo sapiens
uccacuccacucagguu

SEQ ID NO: 1195085 - RNA, 21 nt, Homo sapiens
uccacuccagauuuuuuacag

SEQ ID NO: 1195086 - RNA, 17 nt, Homo sapiens
uccacuccuccuacugu

SEQ ID NO: 1195087 - RNA, 20 nt, Homo sapiens
uccacuccuccuacuguauu

SEQ ID NO: 1195088 - RNA, 20 nt, Homo sapiens
uccacugcaaauaaagccuu

SEQ ID NO: 1195089 - RNA, 19 nt, Homo sapiens
uccacugccuccugugacg

SEQ ID NO: 1195090 - RNA, 22 nt, Homo sapiens
uccacugccuccugugacguga

SEQ ID NO: 1195091 - RNA, 15 nt, Homo sapiens
uccacugucaggguu

SEQ ID NO: 1195092 - RNA, 14 nt, Homo sapiens
uccacugugccuuu

SEQ ID NO: 1195093 - RNA, 18 nt, Homo sapiens
uccacuguggcaaaugga

SEQ ID NO: 1195094 - RNA, 21 nt, Homo sapiens
uccagaaacuuuaagaacaaa

SEQ ID NO: 1195095 - RNA, 20 nt, Homo sapiens
uccagaagaaauaauugugu

SEQ ID NO: 1195096 - RNA, 13 nt, Homo sapiens
uccagacaccagu

SEQ ID NO: 1195097 - RNA, 14 nt, Homo sapiens
uccagacacuuaac

SEQ ID NO: 1195098 - RNA, 15 nt, Homo sapiens
uccagacauacgaaa

SEQ ID NO: 1195099 - RNA, 13 nt, Homo sapiens
uccagacuucaaa

SEQ ID NO: 1195100 - RNA, 18 nt, Homo sapiens
uccagagacaacagguaa

SEQ ID NO: 1195101 - RNA, 15 nt, Homo sapiens
uccagagaguggcuc

SEQ ID NO: 1195102 - RNA, 14 nt, Homo sapiens
uccagagaugguca

SEQ ID NO: 1195103 - RNA, 18 nt, Homo sapiens
uccagagcuggaucucuc

SEQ ID NO: 1195104 - RNA, 17 nt, Homo sapiens
uccagaguucugugaca

SEQ ID NO: 1195105 - RNA, 15 nt, Homo sapiens
uccagauauuucaca

SEQ ID NO: 1195106 - RNA, 16 nt, Homo sapiens
uccagaucacugccac

SEQ ID NO: 1195107 - RNA, 17 nt, Homo sapiens
uccagaucacugccaca

SEQ ID NO: 1195108 - RNA, 19 nt, Homo sapiens
uccagauccagacuguaag

SEQ ID NO: 1195109 - RNA, 17 nt, Homo sapiens
uccagauccuucaaaga

SEQ ID NO: 1195110 - RNA, 12 nt, Homo sapiens
uccagauggcaa

SEQ ID NO: 1195111 - RNA, 22 nt, Homo sapiens
uccagcacaccugccgucuuca

SEQ ID NO: 1195112 - RNA, 19 nt, Homo sapiens
uccagcagaagacaaaaag

SEQ ID NO: 1195113 - RNA, 13 nt, Homo sapiens
uccagccaccacc

SEQ ID NO: 1195114 - RNA, 22 nt, Homo sapiens
uccagccaccacccacaaucac

SEQ ID NO: 1195115 - RNA, 14 nt, Homo sapiens
uccagccacuuccc

SEQ ID NO: 1195116 - RNA, 21 nt, Homo sapiens
uccagccacuugacuggcaca

SEQ ID NO: 1195117 - RNA, 15 nt, Homo sapiens
uccagcccaggacuc

SEQ ID NO: 1195118 - RNA, 19 nt, Homo sapiens
uccagcccaucuccgggga

SEQ ID NO: 1195119 - RNA, 23 nt, Homo sapiens
uccagccuggcucuaucuuccuc

SEQ ID NO: 1195120 - RNA, 18 nt, Homo sapiens
uccagcuuauagucuucc

SEQ ID NO: 1195121 - RNA, 23 nt, Homo sapiens
uccagcuucugguacucuccuag

SEQ ID NO: 1195122 - RNA, 14 nt, Homo sapiens
uccaggacuccacu

SEQ ID NO: 1195123 - RNA, 23 nt, Homo sapiens
uccaggccaugauggccuuacac

SEQ ID NO: 1195124 - RNA, 19 nt, Homo sapiens
uccagggaauggagcucag

SEQ ID NO: 1195125 - RNA, 17 nt, Homo sapiens
uccagggccccccaaau

SEQ ID NO: 1195126 - RNA, 12 nt, Homo sapiens
uccagggcuccc

SEQ ID NO: 1195127 - RNA, 19 nt, Homo sapiens
uccaggugaggcccaagag

SEQ ID NO: 1195128 - RNA, 21 nt, Homo sapiens
uccaggugguaagcaccagga

SEQ ID NO: 1195129 - RNA, 15 nt, Homo sapiens
uccagguuuaugaau

SEQ ID NO: 1195130 - RNA, 17 nt, Homo sapiens
uccagguuuaugaauga

SEQ ID NO: 1195131 - RNA, 21 nt, Homo sapiens
uccagguuuccuuaagggaca

SEQ ID NO: 1195132 - RNA, 14 nt, Homo sapiens
uccaguacuaugga

SEQ ID NO: 1195133 - RNA, 22 nt, Homo sapiens
uccaguacuauggagugcucac

SEQ ID NO: 1195134 - RNA, 12 nt, Homo sapiens
uccaucccgaaa

SEQ ID NO: 1195135 - RNA, 15 nt, Homo sapiens
uccaucccgaaaauc

SEQ ID NO: 1195136 - RNA, 18 nt, Homo sapiens
uccaucuagucacaaaga

SEQ ID NO: 1195137 - RNA, 17 nt, Homo sapiens
uccaucuuucacuaucu

SEQ ID NO: 1195138 - RNA, 18 nt, Homo sapiens
uccaucuuucacuaucug

SEQ ID NO: 1195139 - RNA, 13 nt, Homo sapiens
uccaucuuucuac

SEQ ID NO: 1195140 - RNA, 17 nt, Homo sapiens
uccaucuuucuacagag

SEQ ID NO: 1195141 - RNA, 18 nt, Homo sapiens
uccaugaauuaguucucc

SEQ ID NO: 1195142 - RNA, 17 nt, Homo sapiens
uccaugauucucugagu

SEQ ID NO: 1195143 - RNA, 14 nt, Homo sapiens
uccaugcucccuua

SEQ ID NO: 1195144 - RNA, 22 nt, Homo sapiens
uccaugcuccucaccugucuag

SEQ ID NO: 1195145 - RNA, 18 nt, Homo sapiens
uccaugcuccucacugcc

SEQ ID NO: 1195146 - RNA, 17 nt, Homo sapiens
uccauggaagaaacaca

SEQ ID NO: 1195147 - RNA, 23 nt, Homo sapiens
uccauggccuuucuaauaaacug

SEQ ID NO: 1195148 - RNA, 14 nt, Homo sapiens
uccaugggauacaa

SEQ ID NO: 1195149 - RNA, 18 nt, Homo sapiens
uccauguaaauugcaaau

SEQ ID NO: 1195150 - RNA, 11 nt, Homo sapiens
uccaugucucg

SEQ ID NO: 1195151 - RNA, 22 nt, Homo sapiens
uccauucacaagccuccuguac

SEQ ID NO: 1195152 - RNA, 16 nt, Homo sapiens
uccauucacaccagcu

SEQ ID NO: 1195153 - RNA, 18 nt, Homo sapiens
uccauuuauaaccccagc

SEQ ID NO: 1195154 - RNA, 15 nt, Homo sapiens
uccauuugcuuuguc

SEQ ID NO: 1195155 - RNA, 13 nt, Homo sapiens
uccauuuuacaca

SEQ ID NO: 1195156 - RNA, 14 nt, Homo sapiens
uccauuuugccuga

SEQ ID NO: 1195157 - RNA, 22 nt, Homo sapiens
uccauuuugugaauugugacau

SEQ ID NO: 1195158 - RNA, 13 nt, Homo sapiens
ucccaaagugcug

SEQ ID NO: 1195159 - RNA, 16 nt, Homo sapiens
ucccaaauuugauuga

SEQ ID NO: 1195160 - RNA, 14 nt, Homo sapiens
ucccaacacuuugg

SEQ ID NO: 1195161 - RNA, 14 nt, Homo sapiens
ucccaacagccuua

SEQ ID NO: 1195162 - RNA, 14 nt, Homo sapiens
ucccaacugagugu

SEQ ID NO: 1195163 - RNA, 22 nt, Homo sapiens
ucccaacugaguguuauuugca

SEQ ID NO: 1195164 - RNA, 15 nt, Homo sapiens
ucccaagagcauaac

SEQ ID NO: 1195165 - RNA, 23 nt, Homo sapiens
ucccaagagcauaacuguucuca

SEQ ID NO: 1195166 - RNA, 15 nt, Homo sapiens
ucccaagaguauccu

SEQ ID NO: 1195167 - RNA, 17 nt, Homo sapiens
ucccaagcccugcauug

SEQ ID NO: 1195168 - RNA, 13 nt, Homo sapiens
ucccaauacaaaa

SEQ ID NO: 1195169 - RNA, 14 nt, Homo sapiens
ucccaauagcacuu

SEQ ID NO: 1195170 - RNA, 16 nt, Homo sapiens
ucccaaucaaagaauu

SEQ ID NO: 1195171 - RNA, 21 nt, Homo sapiens
ucccaauccuuaucccaagcu

SEQ ID NO: 1195172 - RNA, 15 nt, Homo sapiens
ucccaaucuuucuau

SEQ ID NO: 1195173 - RNA, 17 nt, Homo sapiens
ucccaaugcacauccau

SEQ ID NO: 1195174 - RNA, 23 nt, Homo sapiens
ucccacacagaauauacauuguc

SEQ ID NO: 1195175 - RNA, 16 nt, Homo sapiens
ucccacacgauuagcu

SEQ ID NO: 1195176 - RNA, 21 nt, Homo sapiens
ucccacacgauuagcuuuauu

SEQ ID NO: 1195177 - RNA, 19 nt, Homo sapiens
ucccacagagugcuggacu

SEQ ID NO: 1195178 - RNA, 17 nt, Homo sapiens
ucccacauccaacucca

SEQ ID NO: 1195179 - RNA, 14 nt, Homo sapiens
ucccacauucugau

SEQ ID NO: 1195180 - RNA, 21 nt, Homo sapiens
ucccaccauuccugccuuuaa

SEQ ID NO: 1195181 - RNA, 22 nt, Homo sapiens
ucccacugcccccuccacugga

SEQ ID NO: 1195182 - RNA, 15 nt, Homo sapiens
ucccacuugucaugu

SEQ ID NO: 1195183 - RNA, 23 nt, Homo sapiens
ucccagaaauuagaaaccuuaau

SEQ ID NO: 1195184 - RNA, 23 nt, Homo sapiens
ucccagacggucaggaaaacugu

SEQ ID NO: 1195185 - RNA, 20 nt, Homo sapiens
ucccagaggagccaccaguu

SEQ ID NO: 1195186 - RNA, 16 nt, Homo sapiens
ucccagagucaucuga

SEQ ID NO: 1195187 - RNA, 15 nt, Homo sapiens
ucccagaucagucag

SEQ ID NO: 1195188 - RNA, 17 nt, Homo sapiens
ucccagauuucaggaaa

SEQ ID NO: 1195189 - RNA, 14 nt, Homo sapiens
ucccagcacuuuga

SEQ ID NO: 1195190 - RNA, 20 nt, Homo sapiens
ucccagcagcgguaccccag

SEQ ID NO: 1195191 - RNA, 16 nt, Homo sapiens
ucccagccaugcccag

SEQ ID NO: 1195192 - RNA, 17 nt, Homo sapiens
ucccagcguguguaucc

SEQ ID NO: 1195193 - RNA, 15 nt, Homo sapiens
ucccagcuacucggg

SEQ ID NO: 1195194 - RNA, 23 nt, Homo sapiens
ucccaggaaguggccaaaagcua

SEQ ID NO: 1195195 - RNA, 16 nt, Homo sapiens
ucccaggacaagccag

SEQ ID NO: 1195196 - RNA, 19 nt, Homo sapiens
ucccaggcccgagauguga

SEQ ID NO: 1195197 - RNA, 14 nt, Homo sapiens
ucccaggcugaggc

SEQ ID NO: 1195198 - RNA, 18 nt, Homo sapiens
ucccagguuuagugaaaa

SEQ ID NO: 1195199 - RNA, 15 nt, Homo sapiens
ucccaguauaccuca

SEQ ID NO: 1195200 - RNA, 16 nt, Homo sapiens
ucccagucucuacuca

SEQ ID NO: 1195201 - RNA, 18 nt, Homo sapiens
ucccagugcacauggcag

SEQ ID NO: 1195202 - RNA, 19 nt, Homo sapiens
ucccauaauugcuuugcca

SEQ ID NO: 1195203 - RNA, 21 nt, Homo sapiens
ucccauaauugcuuugccaaa

SEQ ID NO: 1195204 - RNA, 15 nt, Homo sapiens
ucccaucacuucccu

SEQ ID NO: 1195205 - RNA, 15 nt, Homo sapiens
ucccaucauuacccu

SEQ ID NO: 1195206 - RNA, 23 nt, Homo sapiens
ucccauccuggggcagcacuccc

SEQ ID NO: 1195207 - RNA, 16 nt, Homo sapiens
ucccauggacacucca

SEQ ID NO: 1195208 - RNA, 15 nt, Homo sapiens
ucccauuacuuugau

SEQ ID NO: 1195209 - RNA, 12 nt, Homo sapiens
ucccauugccau

SEQ ID NO: 1195210 - RNA, 15 nt, Homo sapiens
uccccaacaugcacu

SEQ ID NO: 1195211 - RNA, 13 nt, Homo sapiens
uccccacaaucug

SEQ ID NO: 1195212 - RNA, 15 nt, Homo sapiens
uccccacaccucccu

SEQ ID NO: 1195213 - RNA, 17 nt, Homo sapiens
uccccacccagucucau

SEQ ID NO: 1195214 - RNA, 19 nt, Homo sapiens
uccccacccagucucaugu

SEQ ID NO: 1195215 - RNA, 18 nt, Homo sapiens
uccccaccccagcuguua

SEQ ID NO: 1195216 - RNA, 20 nt, Homo sapiens
uccccacuuacagaucuauc

SEQ ID NO: 1195217 - RNA, 21 nt, Homo sapiens
uccccagcccaggguggacuu

SEQ ID NO: 1195218 - RNA, 18 nt, Homo sapiens
uccccagccugcucccua

SEQ ID NO: 1195219 - RNA, 19 nt, Homo sapiens
uccccagccugcucccuag

SEQ ID NO: 1195220 - RNA, 18 nt, Homo sapiens
uccccaggggaaaaugaa

SEQ ID NO: 1195221 - RNA, 15 nt, Homo sapiens
uccccaguacagggg

SEQ ID NO: 1195222 - RNA, 13 nt, Homo sapiens
uccccagucccag

SEQ ID NO: 1195223 - RNA, 16 nt, Homo sapiens
uccccauaacucaaug

SEQ ID NO: 1195224 - RNA, 18 nt, Homo sapiens
uccccauccccaccagcu

SEQ ID NO: 1195225 - RNA, 15 nt, Homo sapiens
ucccccaaccccagc

SEQ ID NO: 1195226 - RNA, 23 nt, Homo sapiens
ucccccaccagcuaaggacauuu

SEQ ID NO: 1195227 - RNA, 19 nt, Homo sapiens
ucccccaccgguccagcug

SEQ ID NO: 1195228 - RNA, 17 nt, Homo sapiens
ucccccagccucaaguc

SEQ ID NO: 1195229 - RNA, 14 nt, Homo sapiens
uccccccauguugu

SEQ ID NO: 1195230 - RNA, 17 nt, Homo sapiens
ucccccgacacugcugc

SEQ ID NO: 1195231 - RNA, 22 nt, Homo sapiens
ucccccgagcucuuggccuuug

SEQ ID NO: 1195232 - RNA, 22 nt, Homo sapiens
ucccccuaaaccccugucccau

SEQ ID NO: 1195233 - RNA, 23 nt, Homo sapiens
uccccgauugaaagaaccagaga

SEQ ID NO: 1195234 - RNA, 14 nt, Homo sapiens
uccccgggcaucuu

SEQ ID NO: 1195235 - RNA, 16 nt, Homo sapiens
uccccgggcaucuuug

SEQ ID NO: 1195236 - RNA, 14 nt, Homo sapiens
uccccgggggagga

SEQ ID NO: 1195237 - RNA, 15 nt, Homo sapiens
uccccuacagaauuu

SEQ ID NO: 1195238 - RNA, 16 nt, Homo sapiens
uccccuagucacucau

SEQ ID NO: 1195239 - RNA, 17 nt, Homo sapiens
uccccucaacaugcugc

SEQ ID NO: 1195240 - RNA, 16 nt, Homo sapiens
uccccuggacugggag

SEQ ID NO: 1195241 - RNA, 15 nt, Homo sapiens
uccccuguccuguga

SEQ ID NO: 1195242 - RNA, 15 nt, Homo sapiens
ucgaaaucaaaccac

SEQ ID NO: 1195243 - RNA, 15 nt, Homo sapiens
ucgaaccacugagag

SEQ ID NO: 1195244 - RNA, 20 nt, Homo sapiens
ucgaaccuugaccgacauga

SEQ ID NO: 1195245 - RNA, 19 nt, Homo sapiens
ucgaagcuccgugagugaa

SEQ ID NO: 1195246 - RNA, 18 nt, Homo sapiens
ucgaaugaacaaagucca

SEQ ID NO: 1195247 - RNA, 18 nt, Homo sapiens
ucgagaccauccuggcua

SEQ ID NO: 1195248 - RNA, 14 nt, Homo sapiens
ucgaggggcucuca

SEQ ID NO: 1195249 - RNA, 15 nt, Homo sapiens
ucgaguggccagcuu

SEQ ID NO: 1195250 - RNA, 19 nt, Homo sapiens
ucgauccuggauucacuca

SEQ ID NO: 1195251 - RNA, 15 nt, Homo sapiens
ucgauuucuaccuca

SEQ ID NO: 1195252 - RNA, 12 nt, Homo sapiens
ucgcaccuacca

SEQ ID NO: 1195253 - RNA, 16 nt, Homo sapiens
ucgcaucucagugcag

SEQ ID NO: 1195254 - RNA, 19 nt, Homo sapiens
ucgcaucucagugcaggag

SEQ ID NO: 1195255 - RNA, 12 nt, Homo sapiens
ucgccagcugcc

SEQ ID NO: 1195256 - RNA, 22 nt, Homo sapiens
ucgccagugccuggaacagugu

SEQ ID NO: 1195257 - RNA, 15 nt, Homo sapiens
ucgccauuguucacc

SEQ ID NO: 1195258 - RNA, 22 nt, Homo sapiens
ucgccguguuacuguugcacug

SEQ ID NO: 1195259 - RNA, 14 nt, Homo sapiens
ucgccuguggagcu

SEQ ID NO: 1195260 - RNA, 22 nt, Homo sapiens
ucgcugccagaugauuguucaa

SEQ ID NO: 1195261 - RNA, 19 nt, Homo sapiens
ucgcugcccucucugccag

SEQ ID NO: 1195262 - RNA, 13 nt, Homo sapiens
ucggaacagcaga

SEQ ID NO: 1195263 - RNA, 23 nt, Homo sapiens
ucggaacagcagauaacaaugca

SEQ ID NO: 1195264 - RNA, 14 nt, Homo sapiens
ucucagcucuucca

SEQ ID NO: 1195265 - RNA, 22 nt, Homo sapiens
ucucaggauaaaguuugcuaag

SEQ ID NO: 1195266 - RNA, 15 nt, Homo sapiens
ucucagguguugcca

SEQ ID NO: 1195267 - RNA, 20 nt, Homo sapiens
ucucaguaccccauggagcu

SEQ ID NO: 1195268 - RNA, 14 nt, Homo sapiens
ucucagugcuucuu

SEQ ID NO: 1195269 - RNA, 17 nt, Homo sapiens
ucucauaccucugacca

SEQ ID NO: 1195270 - RNA, 21 nt, Homo sapiens
ucucauaccuuccccacaucu

SEQ ID NO: 1195271 - RNA, 23 nt, Homo sapiens
ucucauaucaugguagucacuaa

SEQ ID NO: 1195272 - RNA, 12 nt, Homo sapiens
ucucaucacuca

SEQ ID NO: 1195273 - RNA, 22 nt, Homo sapiens
ucucaucagaaaugucaucaaa

SEQ ID NO: 1195274 - RNA, 15 nt, Homo sapiens
ucucauccauuccuc

SEQ ID NO: 1195275 - RNA, 22 nt, Homo sapiens
ucucaucucuucagguucucau

SEQ ID NO: 1195276 - RNA, 19 nt, Homo sapiens
ucucauggguggcacucag

SEQ ID NO: 1195277 - RNA, 14 nt, Homo sapiens
ucucauuauucaca

SEQ ID NO: 1195278 - RNA, 15 nt, Homo sapiens
ucucauuauucacag

SEQ ID NO: 1195279 - RNA, 18 nt, Homo sapiens
ucucauuuaaaaugagau

SEQ ID NO: 1195280 - RNA, 18 nt, Homo sapiens
ucucauuuagaacuugca

SEQ ID NO: 1195281 - RNA, 20 nt, Homo sapiens
ucuccacgguagcacuugac

SEQ ID NO: 1195282 - RNA, 18 nt, Homo sapiens
ucuccacucuugugguca

SEQ ID NO: 1195283 - RNA, 19 nt, Homo sapiens
ucuccacuucuuguucccc

SEQ ID NO: 1195284 - RNA, 15 nt, Homo sapiens
ucuccagccaaccuc

SEQ ID NO: 1195285 - RNA, 16 nt, Homo sapiens
ucuccagccaaccuca

SEQ ID NO: 1195286 - RNA, 22 nt, Homo sapiens
ucuccagccagcaaugaugucc

SEQ ID NO: 1195287 - RNA, 24 nt, Homo sapiens
ucuccauacucuguaacaguugca

SEQ ID NO: 1195288 - RNA, 19 nt, Homo sapiens
ucuccaucccucuaaugag

SEQ ID NO: 1195289 - RNA, 20 nt, Homo sapiens
ucuccaucccucuaaugaga

SEQ ID NO: 1195290 - RNA, 15 nt, Homo sapiens
ucuccaucucaaaaa

SEQ ID NO: 1195291 - RNA, 20 nt, Homo sapiens
ucuccaugaauuaguucucc

SEQ ID NO: 1195292 - RNA, 22 nt, Homo sapiens
ucuccaugaauuaguucuccua

SEQ ID NO: 1195293 - RNA, 15 nt, Homo sapiens
ucuccauggcaucuu

SEQ ID NO: 1195294 - RNA, 21 nt, Homo sapiens
ucucccacuaaaacugcauuu

SEQ ID NO: 1195295 - RNA, 14 nt, Homo sapiens
ucucccacuccagc

SEQ ID NO: 1195296 - RNA, 21 nt, Homo sapiens
ucucccagugacaacaucgca

SEQ ID NO: 1195297 - RNA, 16 nt, Homo sapiens
ucucccauaaacacug

SEQ ID NO: 1195298 - RNA, 14 nt, Homo sapiens
ucucccauccuuga

SEQ ID NO: 1195299 - RNA, 22 nt, Homo sapiens
ucuccccaguguaugucuugua

SEQ ID NO: 1195300 - RNA, 17 nt, Homo sapiens
ucucccccugggcucug

SEQ ID NO: 1195301 - RNA, 16 nt, Homo sapiens
ucuccccgcuaaggaa

SEQ ID NO: 1195302 - RNA, 14 nt, Homo sapiens
ucuccccuccagcc

SEQ ID NO: 1195303 - RNA, 16 nt, Homo sapiens
ucuccgccauugagaa

SEQ ID NO: 1195304 - RNA, 11 nt, Homo sapiens
ucuccuacuuu

SEQ ID NO: 1195305 - RNA, 18 nt, Homo sapiens
ucuccuauaaucugucaa

SEQ ID NO: 1195306 - RNA, 14 nt, Homo sapiens
ucuccucagaagaa

SEQ ID NO: 1195307 - RNA, 13 nt, Homo sapiens
ucuccuccagugu

SEQ ID NO: 1195308 - RNA, 13 nt, Homo sapiens
ucuccuccuugag

SEQ ID NO: 1195309 - RNA, 21 nt, Homo sapiens
ucuccugccucacccucccaa

SEQ ID NO: 1195310 - RNA, 14 nt, Homo sapiens
ucuccugucugccc

SEQ ID NO: 1195311 - RNA, 12 nt, Homo sapiens
ucuccugugaau

SEQ ID NO: 1195312 - RNA, 22 nt, Homo sapiens
ucuccuuauccccccaaaugga

SEQ ID NO: 1195313 - RNA, 16 nt, Homo sapiens
ucuccuuccccaggau

SEQ ID NO: 1195314 - RNA, 23 nt, Homo sapiens
ucuccuuugaaaccugcucugua

SEQ ID NO: 1195315 - RNA, 18 nt, Homo sapiens
ucuccuuuggccauucca

SEQ ID NO: 1195316 - RNA, 17 nt, Homo sapiens
ucucgaaugcugagaag

SEQ ID NO: 1195317 - RNA, 15 nt, Homo sapiens
ucucgacaguaucca

SEQ ID NO: 1195318 - RNA, 12 nt, Homo sapiens
ucucgcaaaaac

SEQ ID NO: 1195319 - RNA, 14 nt, Homo sapiens
ucucgguuugccaa

SEQ ID NO: 1195320 - RNA, 15 nt, Homo sapiens
ucucgguuugccaaa

SEQ ID NO: 1195321 - RNA, 13 nt, Homo sapiens
ucucguucccaaa

SEQ ID NO: 1195322 - RNA, 13 nt, Homo sapiens
ucucuaaaacugc

SEQ ID NO: 1195323 - RNA, 16 nt, Homo sapiens
ucucuaacuccugcca

SEQ ID NO: 1195324 - RNA, 18 nt, Homo sapiens
ucucuaacuccugccauu

SEQ ID NO: 1195325 - RNA, 23 nt, Homo sapiens
ucucuacagugccaacuccucac

SEQ ID NO: 1195326 - RNA, 19 nt, Homo sapiens
ucucuacuaccacaaggaa

SEQ ID NO: 1195327 - RNA, 18 nt, Homo sapiens
ucucuacugaaaguacaa

SEQ ID NO: 1195328 - RNA, 22 nt, Homo sapiens
ucucuaggagggagccuuguga

SEQ ID NO: 1195329 - RNA, 23 nt, Homo sapiens
ucucuauaacagauccuuucaaa

SEQ ID NO: 1195330 - RNA, 13 nt, Homo sapiens
ucucucacuggcu

SEQ ID NO: 1195331 - RNA, 12 nt, Homo sapiens
ucucucagaaau

SEQ ID NO: 1195332 - RNA, 18 nt, Homo sapiens
ucucucagacuuacuuua

SEQ ID NO: 1195333 - RNA, 21 nt, Homo sapiens
ucucuccacgguagcacuuga

SEQ ID NO: 1195334 - RNA, 22 nt, Homo sapiens
ucucucccaccccggccuccac

SEQ ID NO: 1195335 - RNA, 19 nt, Homo sapiens
ucucuccccagaugugacu

SEQ ID NO: 1195336 - RNA, 13 nt, Homo sapiens
ucucuccccucaa

SEQ ID NO: 1195337 - RNA, 22 nt, Homo sapiens
ucucuccuuuucuuuuguuacu

SEQ ID NO: 1195338 - RNA, 17 nt, Homo sapiens
ucucugaagcauguuuc

SEQ ID NO: 1195339 - RNA, 15 nt, Homo sapiens
ucucugaaugaagcu

SEQ ID NO: 1195340 - RNA, 17 nt, Homo sapiens
ucucuggaaagggggga

SEQ ID NO: 1195341 - RNA, 16 nt, Homo sapiens
ucucugguuuacuuca

SEQ ID NO: 1195342 - RNA, 19 nt, Homo sapiens
ucucugugcccuccagcaa

SEQ ID NO: 1195343 - RNA, 17 nt, Homo sapiens
ucucugugucagcacag

SEQ ID NO: 1195344 - RNA, 14 nt, Homo sapiens
ucucuguugucgua

SEQ ID NO: 1195345 - RNA, 15 nt, Homo sapiens
ucucuuagcaacuca

SEQ ID NO: 1195346 - RNA, 16 nt, Homo sapiens
ucucuuagcaacucag

SEQ ID NO: 1195347 - RNA, 18 nt, Homo sapiens
ucucuucagaaaacccuu

SEQ ID NO: 1195348 - RNA, 18 nt, Homo sapiens
ucucuuccacauguuacu

SEQ ID NO: 1195349 - RNA, 23 nt, Homo sapiens
ucucuucccugcgccugugaugc

SEQ ID NO: 1195350 - RNA, 14 nt, Homo sapiens
ucucuucucaccuu

SEQ ID NO: 1195351 - RNA, 14 nt, Homo sapiens
ucucuuuaaaucaa

SEQ ID NO: 1195352 - RNA, 18 nt, Homo sapiens
ucucuuuacuugaaauuu

SEQ ID NO: 1195353 - RNA, 20 nt, Homo sapiens
ucucuuucacauuguuugcu

SEQ ID NO: 1195354 - RNA, 21 nt, Homo sapiens
ucucuuucuagaggugcuaca

SEQ ID NO: 1195355 - RNA, 16 nt, Homo sapiens
ucucuuugugcucuaa

SEQ ID NO: 1195356 - RNA, 19 nt, Homo sapiens
ucucuuuuaggaggcacaa

SEQ ID NO: 1195357 - RNA, 14 nt, Homo sapiens
ucucuuuugagcua

SEQ ID NO: 1195358 - RNA, 21 nt, Homo sapiens
ucugaaacccacagaugucuc

SEQ ID NO: 1195359 - RNA, 13 nt, Homo sapiens
ucugaaacuucau

SEQ ID NO: 1195360 - RNA, 17 nt, Homo sapiens
ucugaaaggauguggaa

SEQ ID NO: 1195361 - RNA, 12 nt, Homo sapiens
ucugaaaugccu

SEQ ID NO: 1195362 - RNA, 22 nt, Homo sapiens
ucugaaauuggucacuuuccua

SEQ ID NO: 1195363 - RNA, 14 nt, Homo sapiens
ucugaacuguuaca

SEQ ID NO: 1195364 - RNA, 13 nt, Homo sapiens
ugaagacaggaug

SEQ ID NO: 1195365 - RNA, 13 nt, Homo sapiens
ugaagacauucca

SEQ ID NO: 1195366 - RNA, 22 nt, Homo sapiens
ugaagacccaggagagacagag

SEQ ID NO: 1195367 - RNA, 20 nt, Homo sapiens
ugaagagaaccgagcaaaga

SEQ ID NO: 1195368 - RNA, 18 nt, Homo sapiens
ugaagagaccaagacucu

SEQ ID NO: 1195369 - RNA, 21 nt, Homo sapiens
ugaagagauuucaacauauca

SEQ ID NO: 1195370 - RNA, 14 nt, Homo sapiens
ugaagagcaaaaau

SEQ ID NO: 1195371 - RNA, 18 nt, Homo sapiens
ugaagagggagaagcaug

SEQ ID NO: 1195372 - RNA, 21 nt, Homo sapiens
ugaagaguuuacugaagcaaa

SEQ ID NO: 1195373 - RNA, 20 nt, Homo sapiens
ugaagauaagaaaugaucuu

SEQ ID NO: 1195374 - RNA, 17 nt, Homo sapiens
ugaagauauuacuacuu

SEQ ID NO: 1195375 - RNA, 13 nt, Homo sapiens
ugaagaucugaga

SEQ ID NO: 1195376 - RNA, 23 nt, Homo sapiens
ugaagauguuucaaaaaaucuga

SEQ ID NO: 1195377 - RNA, 17 nt, Homo sapiens
ugaagauguuuguguau

SEQ ID NO: 1195378 - RNA, 23 nt, Homo sapiens
ugaagcaaaucagaaacuuguga

SEQ ID NO: 1195379 - RNA, 15 nt, Homo sapiens
ugaagcaaguacaau

SEQ ID NO: 1195380 - RNA, 11 nt, Homo sapiens
ugaagcacuuu

SEQ ID NO: 1195381 - RNA, 20 nt, Homo sapiens
ugaagcaugcuuugcugcua

SEQ ID NO: 1195382 - RNA, 13 nt, Homo sapiens
ugaagccaaagaa

SEQ ID NO: 1195383 - RNA, 10 nt, Homo sapiens
ugaagccagc

SEQ ID NO: 1195384 - RNA, 21 nt, Homo sapiens
ugaagcuuaggacuaccagcc

SEQ ID NO: 1195385 - RNA, 23 nt, Homo sapiens
ugaagcuuuauacguguagcuau

SEQ ID NO: 1195386 - RNA, 16 nt, Homo sapiens
ugaaggaaucauucca

SEQ ID NO: 1195387 - RNA, 14 nt, Homo sapiens
ugaaggcccaagag

SEQ ID NO: 1195388 - RNA, 17 nt, Homo sapiens
ugaaggcugaguguccg

SEQ ID NO: 1195389 - RNA, 17 nt, Homo sapiens
ugaaggcuuacuucaga

SEQ ID NO: 1195390 - RNA, 16 nt, Homo sapiens
ugaagggccacuggga

SEQ ID NO: 1195391 - RNA, 15 nt, Homo sapiens
ugacgacgacaacga

SEQ ID NO: 1195392 - RNA, 21 nt, Homo sapiens
ugacggcccugcaauguaucc

SEQ ID NO: 1195393 - RNA, 21 nt, Homo sapiens
ugacggcgcccccagugugca

SEQ ID NO: 1195394 - RNA, 16 nt, Homo sapiens
ugacggggcagucaga

SEQ ID NO: 1195395 - RNA, 18 nt, Homo sapiens
ugacguauauauaaacag

SEQ ID NO: 1195396 - RNA, 22 nt, Homo sapiens
ugacgucacuggaccacugggc

SEQ ID NO: 1195397 - RNA, 23 nt, Homo sapiens
ugacgugcaccuguacucaggag

SEQ ID NO: 1195398 - RNA, 19 nt, Homo sapiens
ugacuaaagcuauguuaca

SEQ ID NO: 1195399 - RNA, 16 nt, Homo sapiens
ugacucaagaagugaa

SEQ ID NO: 1195400 - RNA, 16 nt, Homo sapiens
ugacuccuuucucuaa

SEQ ID NO: 1195401 - RNA, 22 nt, Homo sapiens
ugacuccuuucucuaaaacugc

SEQ ID NO: 1195402 - RNA, 13 nt, Homo sapiens
ugacucugagcua

SEQ ID NO: 1195403 - RNA, 21 nt, Homo sapiens
ugacucugaguccacugcucc

SEQ ID NO: 1195404 - RNA, 16 nt, Homo sapiens
ugacugccaagccaga

SEQ ID NO: 1195405 - RNA, 17 nt, Homo sapiens
ugacugccaagccagau

SEQ ID NO: 1195406 - RNA, 22 nt, Homo sapiens
ugacuggccuauuuaucugauc

SEQ ID NO: 1195407 - RNA, 16 nt, Homo sapiens
ugacuggggagucuga

SEQ ID NO: 1195408 - RNA, 21 nt, Homo sapiens
ugacugguuuacaggcccugc

SEQ ID NO: 1195409 - RNA, 17 nt, Homo sapiens
ugacuguccaagugcca

SEQ ID NO: 1195410 - RNA, 21 nt, Homo sapiens
ugacugugcuacugucuuugg

SEQ ID NO: 1195411 - RNA, 22 nt, Homo sapiens
ugacuuaaaauuggaaauguca

SEQ ID NO: 1195412 - RNA, 16 nt, Homo sapiens
ugacuuccccacugcu

SEQ ID NO: 1195413 - RNA, 16 nt, Homo sapiens
ugacuuguacucugaa

SEQ ID NO: 1195414 - RNA, 21 nt, Homo sapiens
ugacuuuauauggaugauuca

SEQ ID NO: 1195415 - RNA, 23 nt, Homo sapiens
ugagaaaagcuagguguuuaaua

SEQ ID NO: 1195416 - RNA, 22 nt, Homo sapiens
ugagaaaauaucuugcuuucaa

SEQ ID NO: 1195417 - RNA, 22 nt, Homo sapiens
ugagaaaauccccaacuaugca

SEQ ID NO: 1195418 - RNA, 22 nt, Homo sapiens
ugagaaacauuauuagcacuuc

SEQ ID NO: 1195419 - RNA, 23 nt, Homo sapiens
ugagaaaccuuauuguaccucuc

SEQ ID NO: 1195420 - RNA, 20 nt, Homo sapiens
ugagaaagccuucauaagcc

SEQ ID NO: 1195421 - RNA, 20 nt, Homo sapiens
ugagaaauauggacacuuaa

SEQ ID NO: 1195422 - RNA, 17 nt, Homo sapiens
ugagaaauggccaaaua

SEQ ID NO: 1195423 - RNA, 16 nt, Homo sapiens
ugagaaauuucuguga

SEQ ID NO: 1195424 - RNA, 13 nt, Homo sapiens
ugagaagaaugaa

SEQ ID NO: 1195425 - RNA, 14 nt, Homo sapiens
ugagaagccaugua

SEQ ID NO: 1195426 - RNA, 22 nt, Homo sapiens
ugagaaggagggucucuugccc

SEQ ID NO: 1195427 - RNA, 18 nt, Homo sapiens
ugagaaggagucagaaac

SEQ ID NO: 1195428 - RNA, 17 nt, Homo sapiens
ugagaagugcacuuuaa

SEQ ID NO: 1195429 - RNA, 21 nt, Homo sapiens
ugagaauggaaaccacaacuu

SEQ ID NO: 1195430 - RNA, 14 nt, Homo sapiens
ugagaaugugcuuu

SEQ ID NO: 1195431 - RNA, 24 nt, Homo sapiens
ugagacacacaauucauuggcucc

SEQ ID NO: 1195432 - RNA, 12 nt, Homo sapiens
ugagacaggccc

SEQ ID NO: 1195433 - RNA, 14 nt, Homo sapiens
ugagacauguguca

SEQ ID NO: 1195434 - RNA, 11 nt, Homo sapiens
ugagaccagug

SEQ ID NO: 1195435 - RNA, 18 nt, Homo sapiens
ugagaccaguguaucagg

SEQ ID NO: 1195436 - RNA, 18 nt, Homo sapiens
ugagacccuggugccugg

SEQ ID NO: 1195437 - RNA, 15 nt, Homo sapiens
ugagacucacaggaa

SEQ ID NO: 1195438 - RNA, 12 nt, Homo sapiens
ugagagaccuga

SEQ ID NO: 1195439 - RNA, 15 nt, Homo sapiens
ugagagagacaggca

SEQ ID NO: 1195440 - RNA, 20 nt, Homo sapiens
ugagagcaauuguaacgguu

SEQ ID NO: 1195441 - RNA, 13 nt, Homo sapiens
ugagaggaugaau

SEQ ID NO: 1195442 - RNA, 13 nt, Homo sapiens
ugagaggugacac

SEQ ID NO: 1195443 - RNA, 12 nt, Homo sapiens
ugagaguauuua

SEQ ID NO: 1195444 - RNA, 14 nt, Homo sapiens
ugagagucugagaa

SEQ ID NO: 1195445 - RNA, 16 nt, Homo sapiens
ugagaucacagccucc

SEQ ID NO: 1195446 - RNA, 13 nt, Homo sapiens
ugagaugcuggag

SEQ ID NO: 1195447 - RNA, 20 nt, Homo sapiens
ugagaugguaacagauuugc

SEQ ID NO: 1195448 - RNA, 13 nt, Homo sapiens
ugagauucuucag

SEQ ID NO: 1195449 - RNA, 19 nt, Homo sapiens
ugagauugaauuucacugu

SEQ ID NO: 1195450 - RNA, 20 nt, Homo sapiens
ugagauuuaccagggaugua

SEQ ID NO: 1195451 - RNA, 22 nt, Homo sapiens
ugagauuuugaaaaucuaccaa

SEQ ID NO: 1195452 - RNA, 16 nt, Homo sapiens
ugagauuuugcaaucu

SEQ ID NO: 1195453 - RNA, 16 nt, Homo sapiens
ugagcaagacauacuu

SEQ ID NO: 1195454 - RNA, 14 nt, Homo sapiens
ugagcacacuuuag

SEQ ID NO: 1195455 - RNA, 15 nt, Homo sapiens
ugagcagaagaucaa

SEQ ID NO: 1195456 - RNA, 19 nt, Homo sapiens
ugagcagugagcagaaagc

SEQ ID NO: 1195457 - RNA, 19 nt, Homo sapiens
ugagcagugccagcuuucu

SEQ ID NO: 1195458 - RNA, 18 nt, Homo sapiens
ugagcaguggacacguga

SEQ ID NO: 1195459 - RNA, 23 nt, Homo sapiens
ugagcauccucucucacauggaa

SEQ ID NO: 1195460 - RNA, 20 nt, Homo sapiens
ugagcauuacuauucacuga

SEQ ID NO: 1195461 - RNA, 21 nt, Homo sapiens
ugagccaaagcuuaugugaca

SEQ ID NO: 1195462 - RNA, 21 nt, Homo sapiens
ugagccacucagucucuucca

SEQ ID NO: 1195463 - RNA, 17 nt, Homo sapiens
ugagccaguaaucuuua

SEQ ID NO: 1195464 - RNA, 15 nt, Homo sapiens
ugagccugaaaaccu

SEQ ID NO: 1195465 - RNA, 18 nt, Homo sapiens
ugagcgggaggcagaguu

SEQ ID NO: 1195466 - RNA, 12 nt, Homo sapiens
ugagcgucagca

SEQ ID NO: 1195467 - RNA, 17 nt, Homo sapiens
ugagcucaggcauuuga

SEQ ID NO: 1195468 - RNA, 17 nt, Homo sapiens
ugagcuccccagaucuc

SEQ ID NO: 1195469 - RNA, 13 nt, Homo sapiens
ugagcucugggaa

SEQ ID NO: 1195470 - RNA, 20 nt, Homo sapiens
ugagcugagaucacaccacu

SEQ ID NO: 1195471 - RNA, 16 nt, Homo sapiens
ugagcuggcuugucca

SEQ ID NO: 1195472 - RNA, 12 nt, Homo sapiens
ugagcugggaag

SEQ ID NO: 1195473 - RNA, 14 nt, Homo sapiens
ugagcuggggaccu

SEQ ID NO: 1195474 - RNA, 19 nt, Homo sapiens
ugagcugguaggauguaag

SEQ ID NO: 1195475 - RNA, 23 nt, Homo sapiens
ugaggaaaagaaaaucuuuuuaa

SEQ ID NO: 1195476 - RNA, 16 nt, Homo sapiens
ugaggaaaauucuuaa

SEQ ID NO: 1195477 - RNA, 18 nt, Homo sapiens
ugaggaaaugauccccaa

SEQ ID NO: 1195478 - RNA, 17 nt, Homo sapiens
ugaggaauaaaugccuu

SEQ ID NO: 1195479 - RNA, 16 nt, Homo sapiens
ugaggacaccagugaa

SEQ ID NO: 1195480 - RNA, 12 nt, Homo sapiens
ugaggacacgug

SEQ ID NO: 1195481 - RNA, 13 nt, Homo sapiens
ugaggaccaccuc

SEQ ID NO: 1195482 - RNA, 23 nt, Homo sapiens
ugaggaccacuccuguacacuga

SEQ ID NO: 1195483 - RNA, 23 nt, Homo sapiens
ugaggacuuaaaauauuccugca

SEQ ID NO: 1195484 - RNA, 18 nt, Homo sapiens
ugaggagacaucuacaca

SEQ ID NO: 1195485 - RNA, 21 nt, Homo sapiens
ugaggagaggaguuuucucca

SEQ ID NO: 1195486 - RNA, 13 nt, Homo sapiens
ugaggagcccagg

SEQ ID NO: 1195487 - RNA, 14 nt, Homo sapiens
ugaggaggagacag

SEQ ID NO: 1195488 - RNA, 15 nt, Homo sapiens
ugaggaggucccacu

SEQ ID NO: 1195489 - RNA, 17 nt, Homo sapiens
ugaggagugccagcuca

SEQ ID NO: 1195490 - RNA, 18 nt, Homo sapiens
ugaggcaauuagacacuu

SEQ ID NO: 1195491 - RNA, 20 nt, Homo sapiens
ugaggcauuuccagacuuga

SEQ ID NO: 1195492 - RNA, 17 nt, Homo sapiens
ugaggccaucucaggag

SEQ ID NO: 1195493 - RNA, 22 nt, Homo sapiens
ugcaaauauaucugcuauucuc

SEQ ID NO: 1195494 - RNA, 20 nt, Homo sapiens
ugcaaaucuaaaguugcucc

SEQ ID NO: 1195495 - RNA, 20 nt, Homo sapiens
ugcaaaugccuccaagccau

SEQ ID NO: 1195496 - RNA, 16 nt, Homo sapiens
ugcaacagcacuggcu

SEQ ID NO: 1195497 - RNA, 12 nt, Homo sapiens
ugcaacagcuac

SEQ ID NO: 1195498 - RNA, 18 nt, Homo sapiens
ugcaaccagcaucucugu

SEQ ID NO: 1195499 - RNA, 16 nt, Homo sapiens
ugcaacccuuaccccu

SEQ ID NO: 1195500 - RNA, 16 nt, Homo sapiens
ugcaaccucacuaugg

SEQ ID NO: 1195501 - RNA, 17 nt, Homo sapiens
ugcaaccuccgccuccc

SEQ ID NO: 1195502 - RNA, 13 nt, Homo sapiens
ugcaaccucugcc

SEQ ID NO: 1195503 - RNA, 14 nt, Homo sapiens
ugcaaccucugccu

SEQ ID NO: 1195504 - RNA, 21 nt, Homo sapiens
ugcaacucaaggacuuugcag

SEQ ID NO: 1195505 - RNA, 22 nt, Homo sapiens
ugcaacucacugauucucuaca

SEQ ID NO: 1195506 - RNA, 16 nt, Homo sapiens
ugcaagaagcuuuauu

SEQ ID NO: 1195507 - RNA, 14 nt, Homo sapiens
ugcaagaaggauac

SEQ ID NO: 1195508 - RNA, 17 nt, Homo sapiens
ugcaagaguggacugaa

SEQ ID NO: 1195509 - RNA, 15 nt, Homo sapiens
ugcaagcuccaucuc

SEQ ID NO: 1195510 - RNA, 22 nt, Homo sapiens
ugcaaguggccauuaccaucuc

SEQ ID NO: 1195511 - RNA, 14 nt, Homo sapiens
ugcaauacauuuca

SEQ ID NO: 1195512 - RNA, 16 nt, Homo sapiens
ugcaauaugaauucaa

SEQ ID NO: 1195513 - RNA, 21 nt, Homo sapiens
ugcaauccucccuaccguccu

SEQ ID NO: 1195514 - RNA, 15 nt, Homo sapiens
ugcaaucuucuacuu

SEQ ID NO: 1195515 - RNA, 19 nt, Homo sapiens
ugcaaucuucuacuuuaag

SEQ ID NO: 1195516 - RNA, 13 nt, Homo sapiens
ugcaauguaguca

SEQ ID NO: 1195517 - RNA, 16 nt, Homo sapiens
ugcaauguagucaaua

SEQ ID NO: 1195518 - RNA, 20 nt, Homo sapiens
ugcaauguaucccuucucac

SEQ ID NO: 1195519 - RNA, 14 nt, Homo sapiens
ugcaauugaccucu

SEQ ID NO: 1195520 - RNA, 21 nt, Homo sapiens
ugcaauuucauuuaaacuucu

SEQ ID NO: 1195521 - RNA, 21 nt, Homo sapiens
ugcaauuuuauuaaaugcauc

SEQ ID NO: 1195522 - RNA, 15 nt, Homo sapiens
ugcaauuuuucaaga

SEQ ID NO: 1195523 - RNA, 18 nt, Homo sapiens
ugcaauuuuucaagagcu

SEQ ID NO: 1195524 - RNA, 14 nt, Homo sapiens
ugcacaagaaugga

SEQ ID NO: 1195525 - RNA, 15 nt, Homo sapiens
ugcacaaugucaugu

SEQ ID NO: 1195526 - RNA, 21 nt, Homo sapiens
ugcacacacacacacaugcac

SEQ ID NO: 1195527 - RNA, 19 nt, Homo sapiens
ugcacacgggaaagccuua

SEQ ID NO: 1195528 - RNA, 21 nt, Homo sapiens
ugcacacugccuggcccaaaa

SEQ ID NO: 1195529 - RNA, 21 nt, Homo sapiens
ugcacagaauuuguauguauu

SEQ ID NO: 1195530 - RNA, 19 nt, Homo sapiens
ugcacagggggaggccaua

SEQ ID NO: 1195531 - RNA, 20 nt, Homo sapiens
ugcacaggguccucagcuca

SEQ ID NO: 1195532 - RNA, 18 nt, Homo sapiens
ugcacagugugugacuua

SEQ ID NO: 1195533 - RNA, 19 nt, Homo sapiens
ugcacaguugccacauuua

SEQ ID NO: 1195534 - RNA, 22 nt, Homo sapiens
ugcacauauggacucugcacau

SEQ ID NO: 1195535 - RNA, 20 nt, Homo sapiens
ugcacauccauucccaagaa

SEQ ID NO: 1195536 - RNA, 21 nt, Homo sapiens
ugcacauccauucccaagaaa

SEQ ID NO: 1195537 - RNA, 20 nt, Homo sapiens
ugcacauuggucauugugaa

SEQ ID NO: 1195538 - RNA, 11 nt, Homo sapiens
ugcacauugua

SEQ ID NO: 1195539 - RNA, 17 nt, Homo sapiens
ugcacauuuaugaauca

SEQ ID NO: 1195540 - RNA, 20 nt, Homo sapiens
ugcaccaacaucuacaagau

SEQ ID NO: 1195541 - RNA, 17 nt, Homo sapiens
ugcaccacuucaaguga

SEQ ID NO: 1195542 - RNA, 13 nt, Homo sapiens
ugcaccacuuuua

SEQ ID NO: 1195543 - RNA, 20 nt, Homo sapiens
ugcaccacuuuuaacagaac

SEQ ID NO: 1195544 - RNA, 19 nt, Homo sapiens
ugcaccaggcacugcugca

SEQ ID NO: 1195545 - RNA, 17 nt, Homo sapiens
ugcaccagugugacauc

SEQ ID NO: 1195546 - RNA, 19 nt, Homo sapiens
ugcaccccaccagcaauac

SEQ ID NO: 1195547 - RNA, 15 nt, Homo sapiens
ugcaccuacugcuua

SEQ ID NO: 1195548 - RNA, 16 nt, Homo sapiens
ugcaccugccagccug

SEQ ID NO: 1195549 - RNA, 15 nt, Homo sapiens
ugcaccuggauguac

SEQ ID NO: 1195550 - RNA, 18 nt, Homo sapiens
ugcaccuguaaagugccu

SEQ ID NO: 1195551 - RNA, 22 nt, Homo sapiens
ugcaccuugugucuguacacgu

SEQ ID NO: 1195552 - RNA, 19 nt, Homo sapiens
ugcacgcgcgcgugcacac

SEQ ID NO: 1195553 - RNA, 14 nt, Homo sapiens
ugcacuaaagccag

SEQ ID NO: 1195554 - RNA, 19 nt, Homo sapiens
ugcacuaaagccagccuga

SEQ ID NO: 1195555 - RNA, 13 nt, Homo sapiens
ugcacuacuccuc

SEQ ID NO: 1195556 - RNA, 16 nt, Homo sapiens
ugcacuauuuccacau

SEQ ID NO: 1195557 - RNA, 19 nt, Homo sapiens
ugcacuccagccuggcaau

SEQ ID NO: 1195558 - RNA, 20 nt, Homo sapiens
ugcacuccagccugggcaac

SEQ ID NO: 1195559 - RNA, 18 nt, Homo sapiens
ugcacuccagucuggcaa

SEQ ID NO: 1195560 - RNA, 19 nt, Homo sapiens
ugcacuccagucuggcaac

SEQ ID NO: 1195561 - RNA, 15 nt, Homo sapiens
ugcacugagggccac

SEQ ID NO: 1195562 - RNA, 14 nt, Homo sapiens
ugcacuggggccac

SEQ ID NO: 1195563 - RNA, 20 nt, Homo sapiens
ugcacuugacaccaaccaga

SEQ ID NO: 1195564 - RNA, 21 nt, Homo sapiens
ugcacuuuagauauacauauc

SEQ ID NO: 1195565 - RNA, 22 nt, Homo sapiens
ugcacuuuagauauacauauca

SEQ ID NO: 1195566 - RNA, 10 nt, Homo sapiens
ugcacuuugu

SEQ ID NO: 1195567 - RNA, 20 nt, Homo sapiens
ugcacuuuuuuauaagagcu

SEQ ID NO: 1195568 - RNA, 20 nt, Homo sapiens
ugcagaacagugaaagguau

SEQ ID NO: 1195569 - RNA, 18 nt, Homo sapiens
ugcagaaccacaaacaau

SEQ ID NO: 1195570 - RNA, 13 nt, Homo sapiens
ugcagaacugcca

SEQ ID NO: 1195571 - RNA, 14 nt, Homo sapiens
ugcagaacugccau

SEQ ID NO: 1195572 - RNA, 19 nt, Homo sapiens
ugcagaagugguaggucag

SEQ ID NO: 1195573 - RNA, 14 nt, Homo sapiens
ugcagacaggccau

SEQ ID NO: 1195574 - RNA, 21 nt, Homo sapiens
ugcagacuguucuuacuguaa

SEQ ID NO: 1195575 - RNA, 13 nt, Homo sapiens
ugcagagagccau

SEQ ID NO: 1195576 - RNA, 15 nt, Homo sapiens
ugcagagaugacugu

SEQ ID NO: 1195577 - RNA, 12 nt, Homo sapiens
ugcagagcaaug

SEQ ID NO: 1195578 - RNA, 20 nt, Homo sapiens
ugcagagggacagaugacca

SEQ ID NO: 1195579 - RNA, 19 nt, Homo sapiens
ugcagaggucagacuaaga

SEQ ID NO: 1195580 - RNA, 16 nt, Homo sapiens
ugcagaguaggcagcu

SEQ ID NO: 1195581 - RNA, 14 nt, Homo sapiens
ugcagauuugauau

SEQ ID NO: 1195582 - RNA, 16 nt, Homo sapiens
ugcagcaaacacucca

SEQ ID NO: 1195583 - RNA, 21 nt, Homo sapiens
ugcagcaaacacuccacccuc

SEQ ID NO: 1195584 - RNA, 11 nt, Homo sapiens
ugcagcaauau

SEQ ID NO: 1195585 - RNA, 15 nt, Homo sapiens
ugcagcacucuuauc

SEQ ID NO: 1195586 - RNA, 19 nt, Homo sapiens
ugcagcacucuuaucuaca

SEQ ID NO: 1195587 - RNA, 18 nt, Homo sapiens
ugcagccacaucacggca

SEQ ID NO: 1195588 - RNA, 13 nt, Homo sapiens
ugcagccagcuca

SEQ ID NO: 1195589 - RNA, 14 nt, Homo sapiens
ugcagcccaugccc

SEQ ID NO: 1195590 - RNA, 17 nt, Homo sapiens
ugcagccuuugccuccc

SEQ ID NO: 1195591 - RNA, 14 nt, Homo sapiens
ugcagcucagggac

SEQ ID NO: 1195592 - RNA, 20 nt, Homo sapiens
ugcagcucuugggaccgugu

SEQ ID NO: 1195593 - RNA, 13 nt, Homo sapiens
ugcagcuuccaaa

SEQ ID NO: 1195594 - RNA, 23 nt, Homo sapiens
ugcaggaaagaauagaagugauu

SEQ ID NO: 1195595 - RNA, 21 nt, Homo sapiens
ugcaggacuccccaggagcac

SEQ ID NO: 1195596 - RNA, 20 nt, Homo sapiens
ugcaggacuugagaagaccu

SEQ ID NO: 1195597 - RNA, 16 nt, Homo sapiens
ucuguccauuuaucca

SEQ ID NO: 1195598 - RNA, 18 nt, Homo sapiens
ucugucgccuuagcaugu

SEQ ID NO: 1195599 - RNA, 13 nt, Homo sapiens
ucugucuaccugg

SEQ ID NO: 1195600 - RNA, 20 nt, Homo sapiens
ucugucuacuguggugaucu

SEQ ID NO: 1195601 - RNA, 14 nt, Homo sapiens
ucugucucagcuca

SEQ ID NO: 1195602 - RNA, 13 nt, Homo sapiens
ucugucugcauuu

SEQ ID NO: 1195603 - RNA, 12 nt, Homo sapiens
ucugucuugggc

SEQ ID NO: 1195604 - RNA, 17 nt, Homo sapiens
ucugucuuuauaaucua

SEQ ID NO: 1195605 - RNA, 14 nt, Homo sapiens
ucugugaaauacug

SEQ ID NO: 1195606 - RNA, 19 nt, Homo sapiens
ucugugaagaaagagguua

SEQ ID NO: 1195607 - RNA, 19 nt, Homo sapiens
ucugugaaugcuaagucca

SEQ ID NO: 1195608 - RNA, 23 nt, Homo sapiens
ucugugacauacauauuaucuca

SEQ ID NO: 1195609 - RNA, 18 nt, Homo sapiens
ucugugacccaucuguag

SEQ ID NO: 1195610 - RNA, 16 nt, Homo sapiens
ucugugaccucaggca

SEQ ID NO: 1195611 - RNA, 17 nt, Homo sapiens
ucugugagugcgucuga

SEQ ID NO: 1195612 - RNA, 17 nt, Homo sapiens
ucugugauaacucugca

SEQ ID NO: 1195613 - RNA, 14 nt, Homo sapiens
ucugugaugauccu

SEQ ID NO: 1195614 - RNA, 21 nt, Homo sapiens
ucuguggaucagagaugcacc

SEQ ID NO: 1195615 - RNA, 23 nt, Homo sapiens
ucuguggaugaugugauuguccu

SEQ ID NO: 1195616 - RNA, 23 nt, Homo sapiens
ucugugggccccucaacagccaa

SEQ ID NO: 1195617 - RNA, 14 nt, Homo sapiens
ucugugggugcuac

SEQ ID NO: 1195618 - RNA, 21 nt, Homo sapiens
ucuguggugagaaauuugccu

SEQ ID NO: 1195619 - RNA, 15 nt, Homo sapiens
ucuguguauauuaca

SEQ ID NO: 1195620 - RNA, 18 nt, Homo sapiens
ucuguguucccagaggca

SEQ ID NO: 1195621 - RNA, 20 nt, Homo sapiens
ucuguuauauccccugcuac

SEQ ID NO: 1195622 - RNA, 16 nt, Homo sapiens
ucuguuauuaacaaac

SEQ ID NO: 1195623 - RNA, 13 nt, Homo sapiens
ucuguucauuuca

SEQ ID NO: 1195624 - RNA, 23 nt, Homo sapiens
ugcccuguuguguauagaugcaa

SEQ ID NO: 1195625 - RNA, 16 nt, Homo sapiens
ugccgagccuaaugaa

SEQ ID NO: 1195626 - RNA, 18 nt, Homo sapiens
ugccgcaggugggugcug

SEQ ID NO: 1195627 - RNA, 20 nt, Homo sapiens
ugccgccuccuugugcacaa

SEQ ID NO: 1195628 - RNA, 13 nt, Homo sapiens
ugccgcuaccucc

SEQ ID NO: 1195629 - RNA, 14 nt, Homo sapiens
ugccgcuaccuccc

SEQ ID NO: 1195630 - RNA, 22 nt, Homo sapiens
ugccggaggaaaagcagcucaa

SEQ ID NO: 1195631 - RNA, 18 nt, Homo sapiens
ugccguaggaaaaauaaa

SEQ ID NO: 1195632 - RNA, 19 nt, Homo sapiens
ugccguccugcaguccuua

SEQ ID NO: 1195633 - RNA, 19 nt, Homo sapiens
ugccgugcauuagcacaga

SEQ ID NO: 1195634 - RNA, 13 nt, Homo sapiens
ugccuaaauauaa

SEQ ID NO: 1195635 - RNA, 23 nt, Homo sapiens
ugccuaacuuauccaucuuugaa

SEQ ID NO: 1195636 - RNA, 13 nt, Homo sapiens
ugccuaccccagc

SEQ ID NO: 1195637 - RNA, 22 nt, Homo sapiens
ugccuagcaagcuggccucuac

SEQ ID NO: 1195638 - RNA, 23 nt, Homo sapiens
ugccuaguuuuuaguaaucugua

SEQ ID NO: 1195639 - RNA, 18 nt, Homo sapiens
ugccuaucuucuuucaca

SEQ ID NO: 1195640 - RNA, 17 nt, Homo sapiens
ugccucagacuccgccc

SEQ ID NO: 1195641 - RNA, 22 nt, Homo sapiens
ugccucagccucccaaagugcu

SEQ ID NO: 1195642 - RNA, 22 nt, Homo sapiens
ugccucagccuccugaguaguu

SEQ ID NO: 1195643 - RNA, 18 nt, Homo sapiens
ugccucccaagguccucu

SEQ ID NO: 1195644 - RNA, 22 nt, Homo sapiens
ugccucccaagguccucucagu

SEQ ID NO: 1195645 - RNA, 20 nt, Homo sapiens
ugccucccucugcuguguuc

SEQ ID NO: 1195646 - RNA, 20 nt, Homo sapiens
ugucaugacggggacagagu

SEQ ID NO: 1195647 - RNA, 23 nt, Homo sapiens
ugucaugucucugguggugcugg

SEQ ID NO: 1195648 - RNA, 16 nt, Homo sapiens
ugucauuaauguguug

SEQ ID NO: 1195649 - RNA, 15 nt, Homo sapiens
ugucauucgcuccca

SEQ ID NO: 1195650 - RNA, 20 nt, Homo sapiens
ugucauucgcucccacauuc

SEQ ID NO: 1195651 - RNA, 21 nt, Homo sapiens
ugucauucuguuagauacuaa

SEQ ID NO: 1195652 - RNA, 14 nt, Homo sapiens
uguccaaaacugcc

SEQ ID NO: 1195653 - RNA, 18 nt, Homo sapiens
uguccaaaacugccucag

SEQ ID NO: 1195654 - RNA, 11 nt, Homo sapiens
uguccaaagac

SEQ ID NO: 1195655 - RNA, 15 nt, Homo sapiens
uguccagcacaccug

SEQ ID NO: 1195656 - RNA, 19 nt, Homo sapiens
uguccagcuuauagucuuc

SEQ ID NO: 1195657 - RNA, 18 nt, Homo sapiens
uguccagguuaguuuacu

SEQ ID NO: 1195658 - RNA, 22 nt, Homo sapiens
uguccaucagccaggacaguca

SEQ ID NO: 1195659 - RNA, 16 nt, Homo sapiens
uguccauuuauaucau

SEQ ID NO: 1195660 - RNA, 15 nt, Homo sapiens
uguccauuugcaaau

SEQ ID NO: 1195661 - RNA, 12 nt, Homo sapiens
ugucccagagag

SEQ ID NO: 1195662 - RNA, 22 nt, Homo sapiens
ugucccagcgauggugccugcu

SEQ ID NO: 1195663 - RNA, 18 nt, Homo sapiens
uguccccguguugcauga

SEQ ID NO: 1195664 - RNA, 18 nt, Homo sapiens
uguccccuccacugucac

SEQ ID NO: 1195665 - RNA, 15 nt, Homo sapiens
ugucccugacuguaa

SEQ ID NO: 1195666 - RNA, 22 nt, Homo sapiens
ugucccugugggugaaacagaa

SEQ ID NO: 1195667 - RNA, 21 nt, Homo sapiens
ugucccuuaaaauaacuugua

SEQ ID NO: 1195668 - RNA, 15 nt, Homo sapiens
uguccuaagcacuuu

SEQ ID NO: 1195669 - RNA, 17 nt, Homo sapiens
uguccuacccacccucc

SEQ ID NO: 1195670 - RNA, 16 nt, Homo sapiens
uguccuccacacaagg

SEQ ID NO: 1195671 - RNA, 14 nt, Homo sapiens
uguccuccuggaag

SEQ ID NO: 1195672 - RNA, 22 nt, Homo sapiens
uguccucuugccuuuuacuuaa

SEQ ID NO: 1195673 - RNA, 16 nt, Homo sapiens
uguccucuugcucaaa

SEQ ID NO: 1195674 - RNA, 14 nt, Homo sapiens
uguccugaccaccc

SEQ ID NO: 1195675 - RNA, 22 nt, Homo sapiens
uguccugggccugccccugugu

SEQ ID NO: 1195676 - RNA, 17 nt, Homo sapiens
uguccuucccuguucuc

SEQ ID NO: 1195677 - RNA, 23 nt, Homo sapiens
ugucgauuauauuccuuugccaa

SEQ ID NO: 1195678 - RNA, 18 nt, Homo sapiens
ugucguauaggcauguaa

SEQ ID NO: 1195679 - RNA, 13 nt, Homo sapiens
ugucgucugugaa

SEQ ID NO: 1195680 - RNA, 21 nt, Homo sapiens
ugucuaauaaaauauaaucua

SEQ ID NO: 1195681 - RNA, 16 nt, Homo sapiens
ugucuaauaguuauuc

SEQ ID NO: 1195682 - RNA, 17 nt, Homo sapiens
ugucuagacugccaggg

SEQ ID NO: 1195683 - RNA, 22 nt, Homo sapiens
ugucuauauguuuauuuggacu

SEQ ID NO: 1195684 - RNA, 22 nt, Homo sapiens
ugucuaugacgcaaagaucacc

SEQ ID NO: 1195685 - RNA, 22 nt, Homo sapiens
ugucucacuuuuuacccagaac

SEQ ID NO: 1195686 - RNA, 14 nt, Homo sapiens
ugucucagccuccc

SEQ ID NO: 1195687 - RNA, 12 nt, Homo sapiens
ugucucagcuca

SEQ ID NO: 1195688 - RNA, 14 nt, Homo sapiens
ugucuccagaguug

SEQ ID NO: 1195689 - RNA, 15 nt, Homo sapiens
ugucuccuacuccug

SEQ ID NO: 1195690 - RNA, 15 nt, Homo sapiens
ugucuccuuccacaa

SEQ ID NO: 1195691 - RNA, 18 nt, Homo sapiens
ugucuccuuucucuuaug

SEQ ID NO: 1195692 - RNA, 14 nt, Homo sapiens
ugucucgaguccua

SEQ ID NO: 1195693 - RNA, 13 nt, Homo sapiens
ugucucuaccuaa

SEQ ID NO: 1195694 - RNA, 12 nt, Homo sapiens
ugucucugccug

SEQ ID NO: 1195695 - RNA, 16 nt, Homo sapiens
ugucucuucugagcua

SEQ ID NO: 1195696 - RNA, 23 nt, Homo sapiens
ugucugaacuugcauugugauug

SEQ ID NO: 1195697 - RNA, 21 nt, Homo sapiens
ugucugcaccaaugcuaauaa

SEQ ID NO: 1195698 - RNA, 16 nt, Homo sapiens
ugucugcccuagggag

SEQ ID NO: 1195699 - RNA, 17 nt, Homo sapiens
ugucuggugcacauaau

SEQ ID NO: 1195700 - RNA, 19 nt, Homo sapiens
ugucuguaaaagagccuag

SEQ ID NO: 1195701 - RNA, 21 nt, Homo sapiens
ugucuguaaugacaaauaagu

SEQ ID NO: 1195702 - RNA, 15 nt, Homo sapiens
ugucugucaccagcu

SEQ ID NO: 1195703 - RNA, 17 nt, Homo sapiens
ugucugucaccagcuau

SEQ ID NO: 1195704 - RNA, 22 nt, Homo sapiens
ugucuuacuauuauagcaacuu

SEQ ID NO: 1195705 - RNA, 17 nt, Homo sapiens
ugucuuagcuguauaca

SEQ ID NO: 1195706 - RNA, 22 nt, Homo sapiens
ugucuucagcuguacauacuca

SEQ ID NO: 1195707 - RNA, 18 nt, Homo sapiens
ugucuucauagcagauuu

SEQ ID NO: 1195708 - RNA, 19 nt, Homo sapiens
ugucuuccacuuugcauau

SEQ ID NO: 1195709 - RNA, 13 nt, Homo sapiens
ugucuucugggca

SEQ ID NO: 1195710 - RNA, 18 nt, Homo sapiens
ugucuuggacacuguaca

SEQ ID NO: 1195711 - RNA, 14 nt, Homo sapiens
ugucuuggggccac

SEQ ID NO: 1195712 - RNA, 21 nt, Homo sapiens
ugucuuguuucccagauuuca

SEQ ID NO: 1195713 - RNA, 19 nt, Homo sapiens
ugucuuuauaaucuacucc

SEQ ID NO: 1195714 - RNA, 17 nt, Homo sapiens
ugucuuuauucuuauua

SEQ ID NO: 1195715 - RNA, 18 nt, Homo sapiens
ugucuuuuuucacuacau

SEQ ID NO: 1195716 - RNA, 15 nt, Homo sapiens
ugugaaaacaucuca

SEQ ID NO: 1195717 - RNA, 18 nt, Homo sapiens
ugugaaaauauacuugac

SEQ ID NO: 1195718 - RNA, 15 nt, Homo sapiens
ugugaaacacagcug

SEQ ID NO: 1195719 - RNA, 16 nt, Homo sapiens
ugugaacaucccuuau

SEQ ID NO: 1195720 - RNA, 17 nt, Homo sapiens
ugugaacucaccaaaca

SEQ ID NO: 1195721 - RNA, 16 nt, Homo sapiens
ugugaagcaaacucua

SEQ ID NO: 1195722 - RNA, 14 nt, Homo sapiens
ugugaaguacauau

SEQ ID NO: 1195723 - RNA, 17 nt, Homo sapiens
ugugaauuaggcuguaa

SEQ ID NO: 1195724 - RNA, 14 nt, Homo sapiens
ugugacacauaugc

SEQ ID NO: 1195725 - RNA, 15 nt, Homo sapiens
ugugacacaucaagc

SEQ ID NO: 1195726 - RNA, 12 nt, Homo sapiens
ugugacauacau

SEQ ID NO: 1195727 - RNA, 23 nt, Homo sapiens
ugugaccacugaagcaccacagg

SEQ ID NO: 1195728 - RNA, 13 nt, Homo sapiens
ugugaccuugacu

SEQ ID NO: 1195729 - RNA, 22 nt, Homo sapiens
ugugacgcagacagaggggaug

SEQ ID NO: 1195730 - RNA, 15 nt, Homo sapiens
ugugacuggcaguau

SEQ ID NO: 1195731 - RNA, 22 nt, Homo sapiens
ugugacuugaacuagauugcau

SEQ ID NO: 1195732 - RNA, 13 nt, Homo sapiens
ugugagaugcuag

SEQ ID NO: 1195733 - RNA, 17 nt, Homo sapiens
ugugagggacaugcuca

SEQ ID NO: 1195734 - RNA, 19 nt, Homo sapiens
ugugaguaagagcuggugu

SEQ ID NO: 1195735 - RNA, 15 nt, Homo sapiens
ugugauuacaaggcu

SEQ ID NO: 1195736 - RNA, 18 nt, Homo sapiens
ugugauugcacagaauuu

SEQ ID NO: 1195737 - RNA, 17 nt, Homo sapiens
ugugcaaaccuguucau

SEQ ID NO: 1195738 - RNA, 18 nt, Homo sapiens
ugugcaaauauaucugcu

SEQ ID NO: 1195739 - RNA, 15 nt, Homo sapiens
ugugcaaaugugcug

SEQ ID NO: 1195740 - RNA, 11 nt, Homo sapiens
ugugcacacac

SEQ ID NO: 1195741 - RNA, 13 nt, Homo sapiens
ugugcacauuuau

SEQ ID NO: 1195742 - RNA, 23 nt, Homo sapiens
ugugcacuuucuucucuuuccca

SEQ ID NO: 1195743 - RNA, 12 nt, Homo sapiens
ugugcagaauaa

SEQ ID NO: 1195744 - RNA, 21 nt, Homo sapiens
ugugcagggugaagcagcuca

SEQ ID NO: 1195745 - RNA, 23 nt, Homo sapiens
ugugcagggugaagcagcucauu

SEQ ID NO: 1195746 - RNA, 20 nt, Homo sapiens
ugugcagguuuugaaaaugu

SEQ ID NO: 1195747 - RNA, 21 nt, Homo sapiens
ugugcaguguugacaguucau

SEQ ID NO: 1195748 - RNA, 13 nt, Homo sapiens
ugugcauaaugcu

SEQ ID NO: 1195749 - RNA, 19 nt, Homo sapiens
ugugcauacgccucuuguu

SEQ ID NO: 1195750 - RNA, 14 nt, Homo sapiens
ugugccacacagug

SEQ ID NO: 1195751 - RNA, 23 nt, Homo sapiens
ugugccaccaagcauuccugcuc

SEQ ID NO: 1195752 - RNA, 20 nt, Homo sapiens
ugugccagaaacagugggag

SEQ ID NO: 1195753 - RNA, 21 nt, Homo sapiens
ugugccaggcugaauuacagu

SEQ ID NO: 1195754 - RNA, 14 nt, Homo sapiens
ugugccaugugcca

SEQ ID NO: 1195755 - RNA, 16 nt, Homo sapiens
ugugccccaugccugu

SEQ ID NO: 1195756 - RNA, 22 nt, Homo sapiens
ugugcccugcacguauacaccc

SEQ ID NO: 1195757 - RNA, 23 nt, Homo sapiens
ugugcccuugggguaagccagag

SEQ ID NO: 1195758 - RNA, 18 nt, Homo sapiens
ugugccuucucuauggcc

SEQ ID NO: 1195759 - RNA, 15 nt, Homo sapiens
ugugcgccuacagga

SEQ ID NO: 1195760 - RNA, 17 nt, Homo sapiens
ugugcgugaaacacacc

SEQ ID NO: 1195761 - RNA, 19 nt, Homo sapiens
ugugcuaauaacagugcau

SEQ ID NO: 1195762 - RNA, 18 nt, Homo sapiens
ugugcucuaaaauucuau

SEQ ID NO: 1195763 - RNA, 23 nt, Homo sapiens
ugugcucucuuuaaaucaagucc

SEQ ID NO: 1195764 - RNA, 24 nt, Homo sapiens
ugugcucugaucauccacugugcc

SEQ ID NO: 1195765 - RNA, 21 nt, Homo sapiens
ugugcugcagcucccauuuca

SEQ ID NO: 1195766 - RNA, 18 nt, Homo sapiens
ugugcuggucauggaaug

SEQ ID NO: 1195767 - RNA, 22 nt, Homo sapiens
ugugcuggucauggaauggcag

SEQ ID NO: 1195768 - RNA, 14 nt, Homo sapiens
ugugcugguguccu

SEQ ID NO: 1195769 - RNA, 14 nt, Homo sapiens
ugugcuuacaguaa

SEQ ID NO: 1195770 - RNA, 16 nt, Homo sapiens
ugugcuucauuccaau

SEQ ID NO: 1195771 - RNA, 23 nt, Homo sapiens
ugugcuuuugcauuaaacuguga

SEQ ID NO: 1195772 - RNA, 15 nt, Homo sapiens
uguggaagcaaaaau

SEQ ID NO: 1195773 - RNA, 13 nt, Homo sapiens
uuaacugaugaca

SEQ ID NO: 1195774 - RNA, 18 nt, Homo sapiens
uuaacugaugacauucca

SEQ ID NO: 1195775 - RNA, 22 nt, Homo sapiens
uuaacuucagcauccaaguuua

SEQ ID NO: 1195776 - RNA, 14 nt, Homo sapiens
uuaagaaacacagg

SEQ ID NO: 1195777 - RNA, 14 nt, Homo sapiens
uuaagaaacauucu

SEQ ID NO: 1195778 - RNA, 18 nt, Homo sapiens
uuaagaaucaagauauaa

SEQ ID NO: 1195779 - RNA, 14 nt, Homo sapiens
uuaagacuacugaa

SEQ ID NO: 1195780 - RNA, 19 nt, Homo sapiens
uuaagagaucccuuaagaa

SEQ ID NO: 1195781 - RNA, 14 nt, Homo sapiens
uuaagagugaaguc

SEQ ID NO: 1195782 - RNA, 18 nt, Homo sapiens
uuaagcagcgccagugac

SEQ ID NO: 1195783 - RNA, 20 nt, Homo sapiens
uuaagcagggagcugggcua

SEQ ID NO: 1195784 - RNA, 14 nt, Homo sapiens
uuaagcagucucac

SEQ ID NO: 1195785 - RNA, 15 nt, Homo sapiens
uuaagccaucaggga

SEQ ID NO: 1195786 - RNA, 19 nt, Homo sapiens
uuaagccuaaaugccuuag

SEQ ID NO: 1195787 - RNA, 20 nt, Homo sapiens
uuaagccuuauaaaccaauc

SEQ ID NO: 1195788 - RNA, 21 nt, Homo sapiens
uuaagcuaggauguugcucag

SEQ ID NO: 1195789 - RNA, 19 nt, Homo sapiens
uuaagcuauccacagcuua

SEQ ID NO: 1195790 - RNA, 19 nt, Homo sapiens
uuaagcugaagaguuuacu

SEQ ID NO: 1195791 - RNA, 19 nt, Homo sapiens
uuaagcugaaggcauuuga

SEQ ID NO: 1195792 - RNA, 16 nt, Homo sapiens
uuaagcuuucagcuca

SEQ ID NO: 1195793 - RNA, 22 nt, Homo sapiens
uuaaggaacaagaauugcuaaa

SEQ ID NO: 1195794 - RNA, 23 nt, Homo sapiens
uuaaggauaaaucauaaagucag

SEQ ID NO: 1195795 - RNA, 22 nt, Homo sapiens
uuaagggcaugccuugugcugu

SEQ ID NO: 1195796 - RNA, 21 nt, Homo sapiens
uuaagguccuaaauucuuaac

SEQ ID NO: 1195797 - RNA, 19 nt, Homo sapiens
uuaaggucuccaaaccaga

SEQ ID NO: 1195798 - RNA, 17 nt, Homo sapiens
uuaaggugaaccaaaga

SEQ ID NO: 1195799 - RNA, 16 nt, Homo sapiens
uuaaguaaaccaaaaa

SEQ ID NO: 1195800 - RNA, 17 nt, Homo sapiens
uuaaguacaugugccag

SEQ ID NO: 1195801 - RNA, 22 nt, Homo sapiens
uuaaguauguuauuuucuguug

SEQ ID NO: 1195802 - RNA, 16 nt, Homo sapiens
uuaagucaccuguaua

SEQ ID NO: 1195803 - RNA, 15 nt, Homo sapiens
uuaagucauggaauu

SEQ ID NO: 1195804 - RNA, 20 nt, Homo sapiens
uuaagucccaguauaccuca

SEQ ID NO: 1195805 - RNA, 16 nt, Homo sapiens
uuaagugacuauagaa

SEQ ID NO: 1195806 - RNA, 12 nt, Homo sapiens
uuaaguuuugau

SEQ ID NO: 1195807 - RNA, 22 nt, Homo sapiens
uuaauaaaaaugacagacugaa

SEQ ID NO: 1195808 - RNA, 21 nt, Homo sapiens
uuaauaaaacugcacagugcu

SEQ ID NO: 1195809 - RNA, 19 nt, Homo sapiens
uuaauaaagaauuaacaga

SEQ ID NO: 1195810 - RNA, 23 nt, Homo sapiens
uuaauaaagaugaguugguucuc

SEQ ID NO: 1195811 - RNA, 22 nt, Homo sapiens
uuaauaaagcauucuuuaacag

SEQ ID NO: 1195812 - RNA, 15 nt, Homo sapiens
uuaauaacagcuccu

SEQ ID NO: 1195813 - RNA, 20 nt, Homo sapiens
uuaauagaaauaaauuccua

SEQ ID NO: 1195814 - RNA, 21 nt, Homo sapiens
uuaauaguuuugauccuaaau

SEQ ID NO: 1195815 - RNA, 13 nt, Homo sapiens
uuaauauaguuua

SEQ ID NO: 1195816 - RNA, 15 nt, Homo sapiens
uuaauauguuauuau

SEQ ID NO: 1195817 - RNA, 20 nt, Homo sapiens
uuaauauuacucagcacaga

SEQ ID NO: 1195818 - RNA, 16 nt, Homo sapiens
uuaauauugugcaaac

SEQ ID NO: 1195819 - RNA, 19 nt, Homo sapiens
uuaaucacuauuguuccag

SEQ ID NO: 1195820 - RNA, 23 nt, Homo sapiens
uuaaucauuuccccauaacucaa

SEQ ID NO: 1195821 - RNA, 18 nt, Homo sapiens
uuaauccuguaccaaauc

SEQ ID NO: 1195822 - RNA, 21 nt, Homo sapiens
uuaauccuguaccaaaucuga

SEQ ID NO: 1195823 - RNA, 21 nt, Homo sapiens
uuaaucucuguuauguacugu

SEQ ID NO: 1195824 - RNA, 18 nt, Homo sapiens
uuaaucuguuauguacua

SEQ ID NO: 1195825 - RNA, 21 nt, Homo sapiens
uuaaucuuaguguaugauuac

SEQ ID NO: 1195826 - RNA, 17 nt, Homo sapiens
uuaaugagucagucaau

SEQ ID NO: 1195827 - RNA, 20 nt, Homo sapiens
uuaaugccugcuuuuuggaa

SEQ ID NO: 1195828 - RNA, 19 nt, Homo sapiens
uuaaugggagcuuugccug

SEQ ID NO: 1195829 - RNA, 21 nt, Homo sapiens
uuaaugguagcaacugaaaga

SEQ ID NO: 1195830 - RNA, 15 nt, Homo sapiens
uuaauguuuuuaccc

SEQ ID NO: 1195831 - RNA, 15 nt, Homo sapiens
uuaauuaaaaagaau

SEQ ID NO: 1195832 - RNA, 18 nt, Homo sapiens
uuaauuaauggaaucuuc

SEQ ID NO: 1195833 - RNA, 17 nt, Homo sapiens
uuaauuacaacugcuau

SEQ ID NO: 1195834 - RNA, 14 nt, Homo sapiens
uuaauuacauacag

SEQ ID NO: 1195835 - RNA, 13 nt, Homo sapiens
uuaauuauugcuu

SEQ ID NO: 1195836 - RNA, 15 nt, Homo sapiens
uuaauucacagaaua

SEQ ID NO: 1195837 - RNA, 23 nt, Homo sapiens
uuaauuguauaagucaagcacau

SEQ ID NO: 1195838 - RNA, 23 nt, Homo sapiens
uuaauuugaaaacauaaucugca

SEQ ID NO: 1195839 - RNA, 19 nt, Homo sapiens
uuaauuuuaguuucaugag

SEQ ID NO: 1195840 - RNA, 17 nt, Homo sapiens
uuaauuuuccaaugcac

SEQ ID NO: 1195841 - RNA, 12 nt, Homo sapiens
uuacaaacugca

SEQ ID NO: 1195842 - RNA, 15 nt, Homo sapiens
uuacaaacugcaaua

SEQ ID NO: 1195843 - RNA, 14 nt, Homo sapiens
uuacaaaugcaauu

SEQ ID NO: 1195844 - RNA, 20 nt, Homo sapiens
uuacaauaggaguggugauu

SEQ ID NO: 1195845 - RNA, 19 nt, Homo sapiens
uuacaaucagccacauucu

SEQ ID NO: 1195846 - RNA, 14 nt, Homo sapiens
uuacaccaguuuga

SEQ ID NO: 1195847 - RNA, 18 nt, Homo sapiens
uuacacugccuguauacu

SEQ ID NO: 1195848 - RNA, 17 nt, Homo sapiens
uuacacugugucauucu

SEQ ID NO: 1195849 - RNA, 19 nt, Homo sapiens
uuacagaaaagacucugac

SEQ ID NO: 1195850 - RNA, 13 nt, Homo sapiens
uuacagaaaucaa

SEQ ID NO: 1195851 - RNA, 12 nt, Homo sapiens
uuacagaauuau

SEQ ID NO: 1195852 - RNA, 13 nt, Homo sapiens
uuacagacaggaa

SEQ ID NO: 1195853 - RNA, 16 nt, Homo sapiens
uuacagacaugagccu

SEQ ID NO: 1195854 - RNA, 18 nt, Homo sapiens
uuacagacaugagccucc

SEQ ID NO: 1195855 - RNA, 20 nt, Homo sapiens
uuacagacuagcaggcuacu

SEQ ID NO: 1195856 - RNA, 24 nt, Homo sapiens
uuacagcugccugcaguacuuuac

SEQ ID NO: 1195857 - RNA, 17 nt, Homo sapiens
uuacaggcgugauccac

SEQ ID NO: 1195858 - RNA, 20 nt, Homo sapiens
uuacaguuaaagaagcaauc

SEQ ID NO: 1195859 - RNA, 12 nt, Homo sapiens
uuacaguuucca

SEQ ID NO: 1195860 - RNA, 22 nt, Homo sapiens
uuacauaaaaccaaguuuuacu

SEQ ID NO: 1195861 - RNA, 16 nt, Homo sapiens
uuacauguaauuugau

SEQ ID NO: 1195862 - RNA, 14 nt, Homo sapiens
uuacauuguucaau

SEQ ID NO: 1195863 - RNA, 14 nt, Homo sapiens
uuacauuguugagc

SEQ ID NO: 1195864 - RNA, 15 nt, Homo sapiens
uuaccacuaacuccu

SEQ ID NO: 1195865 - RNA, 17 nt, Homo sapiens
uuaccaugucacugugg

SEQ ID NO: 1195866 - RNA, 22 nt, Homo sapiens
uuaccauuuguaauaaaguaua

SEQ ID NO: 1195867 - RNA, 22 nt, Homo sapiens
uuacccagagaauauauacauu

SEQ ID NO: 1195868 - RNA, 22 nt, Homo sapiens
uuaccccuuuucggccccaugu

SEQ ID NO: 1195869 - RNA, 22 nt, Homo sapiens
uuaccuagaagaagcuauguca

SEQ ID NO: 1195870 - RNA, 16 nt, Homo sapiens
uuaccuaguuugcacu

SEQ ID NO: 1195871 - RNA, 17 nt, Homo sapiens
uuaccucuucuaugcaa

SEQ ID NO: 1195872 - RNA, 22 nt, Homo sapiens
uuaccugggcauucuuguuuca

SEQ ID NO: 1195873 - RNA, 23 nt, Homo sapiens
uuaccuuuuuguaugugaacaaa

SEQ ID NO: 1195874 - RNA, 18 nt, Homo sapiens
uuacguaguaaaagucau

SEQ ID NO: 1195875 - RNA, 15 nt, Homo sapiens
uuacuauaaacauuu

SEQ ID NO: 1195876 - RNA, 19 nt, Homo sapiens
uuacuauauucuuacccua

SEQ ID NO: 1195877 - RNA, 19 nt, Homo sapiens
uuacuaugacugcucccca

SEQ ID NO: 1195878 - RNA, 21 nt, Homo sapiens
uuacuauucuguaucauugau

SEQ ID NO: 1195879 - RNA, 23 nt, Homo sapiens
uuacucaaggaauuugcauuuag

SEQ ID NO: 1195880 - RNA, 21 nt, Homo sapiens
uuacucagaggagcugcaaau

SEQ ID NO: 1195881 - RNA, 16 nt, Homo sapiens
uuacucaugacuccuu

SEQ ID NO: 1195882 - RNA, 18 nt, Homo sapiens
uuacuccaucauggcugc

SEQ ID NO: 1195883 - RNA, 20 nt, Homo sapiens
uuacucccuacacugaugca

SEQ ID NO: 1195884 - RNA, 21 nt, Homo sapiens
uuacugaagaaaucuuuccag

SEQ ID NO: 1195885 - RNA, 13 nt, Homo sapiens
uuacugauauuau

SEQ ID NO: 1195886 - RNA, 16 nt, Homo sapiens
uuacugcuugaccaaa

SEQ ID NO: 1195887 - RNA, 20 nt, Homo sapiens
uuacuguacccucgcaugac

SEQ ID NO: 1195888 - RNA, 21 nt, Homo sapiens
uuacuguacccucgcaugacu

SEQ ID NO: 1195889 - RNA, 23 nt, Homo sapiens
uuacugugaaacuggcacugaau

SEQ ID NO: 1195890 - RNA, 18 nt, Homo sapiens
uuacuguucuugcugcua

SEQ ID NO: 1195891 - RNA, 22 nt, Homo sapiens
uuacuucaaugggcucuuccaa

SEQ ID NO: 1195892 - RNA, 14 nt, Homo sapiens
uuacuugacuugaa

SEQ ID NO: 1195893 - RNA, 17 nt, Homo sapiens
uuacuuuuucuuguauu

SEQ ID NO: 1195894 - RNA, 13 nt, Homo sapiens
uuagaaaggggug

SEQ ID NO: 1195895 - RNA, 20 nt, Homo sapiens
uuagaaauguaaacugccau

SEQ ID NO: 1195896 - RNA, 14 nt, Homo sapiens
uuagaaauuuaaca

SEQ ID NO: 1195897 - RNA, 19 nt, Homo sapiens
uuagaagauagaugcacuu

SEQ ID NO: 1195898 - RNA, 18 nt, Homo sapiens
uuagaagccaacuaugau

SEQ ID NO: 1195899 - RNA, 13 nt, Homo sapiens
uguguacugccuu

SEQ ID NO: 1195900 - RNA, 12 nt, Homo sapiens
uguguacugugg

SEQ ID NO: 1195901 - RNA, 16 nt, Homo sapiens
uguguauauaguauga

SEQ ID NO: 1195902 - RNA, 14 nt, Homo sapiens
uguguauauauaca

SEQ ID NO: 1195903 - RNA, 13 nt, Homo sapiens
uguguauguguau

SEQ ID NO: 1195904 - RNA, 23 nt, Homo sapiens
uguguauuauaauucaaaggcau

SEQ ID NO: 1195905 - RNA, 17 nt, Homo sapiens
uguguauucuagugaau

SEQ ID NO: 1195906 - RNA, 18 nt, Homo sapiens
uguguauuuccagugcaa

SEQ ID NO: 1195907 - RNA, 15 nt, Homo sapiens
ugugucaaccacuaa

SEQ ID NO: 1195908 - RNA, 19 nt, Homo sapiens
ugugucaaugccugucuua

SEQ ID NO: 1195909 - RNA, 15 nt, Homo sapiens
ugugucagcuacugc

SEQ ID NO: 1195910 - RNA, 22 nt, Homo sapiens
uguguccccucacucugucagc

SEQ ID NO: 1195911 - RNA, 21 nt, Homo sapiens
ugugucccgaauccacagucg

SEQ ID NO: 1195912 - RNA, 15 nt, Homo sapiens
uguguccucagggag

SEQ ID NO: 1195913 - RNA, 18 nt, Homo sapiens
ugugugacauuccagggg

SEQ ID NO: 1195914 - RNA, 18 nt, Homo sapiens
ugugugagcuaugcaaac

SEQ ID NO: 1195915 - RNA, 21 nt, Homo sapiens
ugugugcacguacacacacau

SEQ ID NO: 1195916 - RNA, 22 nt, Homo sapiens
uguguggcaaacuugcaguuua

SEQ ID NO: 1195917 - RNA, 20 nt, Homo sapiens
uguguggcaaugggauuugg

SEQ ID NO: 1195918 - RNA, 18 nt, Homo sapiens
ugugugggacuguacaca

SEQ ID NO: 1195919 - RNA, 21 nt, Homo sapiens
ugugugggauaaugucauuaa

SEQ ID NO: 1195920 - RNA, 22 nt, Homo sapiens
uguguguauauaguaugaaugc

SEQ ID NO: 1195921 - RNA, 19 nt, Homo sapiens
uguguguuuugacacugag

SEQ ID NO: 1195922 - RNA, 21 nt, Homo sapiens
uguguuaggacagcauauaaa

SEQ ID NO: 1195923 - RNA, 19 nt, Homo sapiens
uguguucucuauugcugcu

SEQ ID NO: 1195924 - RNA, 13 nt, Homo sapiens
uguguucugucac

SEQ ID NO: 1195925 - RNA, 15 nt, Homo sapiens
uguguuggcacaugc

SEQ ID NO: 1195926 - RNA, 22 nt, Homo sapiens
uguguugucuucagcagucaau

SEQ ID NO: 1195927 - RNA, 17 nt, Homo sapiens
uguguuuauuucacuug

SEQ ID NO: 1195928 - RNA, 18 nt, Homo sapiens
uguguuuugaaagcccaa

SEQ ID NO: 1195929 - RNA, 18 nt, Homo sapiens
uguguuuuuaacauguca

SEQ ID NO: 1195930 - RNA, 16 nt, Homo sapiens
uguguuuuuucggaca

SEQ ID NO: 1195931 - RNA, 18 nt, Homo sapiens
uguuaaaaaaaaugauaa

SEQ ID NO: 1195932 - RNA, 16 nt, Homo sapiens
uguuaaacaugcuaaa

SEQ ID NO: 1195933 - RNA, 18 nt, Homo sapiens
uguuaaagcaucagagau

SEQ ID NO: 1195934 - RNA, 23 nt, Homo sapiens
uguuaaagcuggaacauuugaua

SEQ ID NO: 1195935 - RNA, 12 nt, Homo sapiens
uguuaacacuca

SEQ ID NO: 1195936 - RNA, 18 nt, Homo sapiens
uguuaacauggacaugau

SEQ ID NO: 1195937 - RNA, 23 nt, Homo sapiens
uguuaauucacagaauagcacaa

SEQ ID NO: 1195938 - RNA, 19 nt, Homo sapiens
uguuaauuuuuuuuacuau

SEQ ID NO: 1195939 - RNA, 22 nt, Homo sapiens
uguuaauuuuuuuuacuauaaa

SEQ ID NO: 1195940 - RNA, 15 nt, Homo sapiens
uguuacacauugagg

SEQ ID NO: 1195941 - RNA, 13 nt, Homo sapiens
uguuaccuacuuu

SEQ ID NO: 1195942 - RNA, 13 nt, Homo sapiens
uguuacuagccuc

SEQ ID NO: 1195943 - RNA, 22 nt, Homo sapiens
uguuacucucuuccacauguua

SEQ ID NO: 1195944 - RNA, 16 nt, Homo sapiens
uguuacugaucaugca

SEQ ID NO: 1195945 - RNA, 11 nt, Homo sapiens
uguuacuucaa

SEQ ID NO: 1195946 - RNA, 14 nt, Homo sapiens
uguuacuugcacuu

SEQ ID NO: 1195947 - RNA, 19 nt, Homo sapiens
uguuagagaauuuccuuac

SEQ ID NO: 1195948 - RNA, 17 nt, Homo sapiens
uguuagauuccucuugc

SEQ ID NO: 1195949 - RNA, 21 nt, Homo sapiens
uguuaguaaauccaugguguu

SEQ ID NO: 1195950 - RNA, 21 nt, Homo sapiens
uguuaguauuuuaauccugua

SEQ ID NO: 1195951 - RNA, 19 nt, Homo sapiens
uguuauaacucugcacuac

SEQ ID NO: 1195952 - RNA, 14 nt, Homo sapiens
uguuauaucaggga

SEQ ID NO: 1195953 - RNA, 20 nt, Homo sapiens
uguuauauuuaaugcauuaa

SEQ ID NO: 1195954 - RNA, 16 nt, Homo sapiens
uguuaucaguaagaaa

SEQ ID NO: 1195955 - RNA, 20 nt, Homo sapiens
uguuaucagucauaacuaaa

SEQ ID NO: 1195956 - RNA, 15 nt, Homo sapiens
uguuaucuucacuuu

SEQ ID NO: 1195957 - RNA, 12 nt, Homo sapiens
uguuaugugauc

SEQ ID NO: 1195958 - RNA, 16 nt, Homo sapiens
uguuauguuugcacuu

SEQ ID NO: 1195959 - RNA, 18 nt, Homo sapiens
uguuauguuugcacuuug

SEQ ID NO: 1195960 - RNA, 15 nt, Homo sapiens
uguuauuuaacagcu

SEQ ID NO: 1195961 - RNA, 14 nt, Homo sapiens
uguuauuugcacac

SEQ ID NO: 1195962 - RNA, 22 nt, Homo sapiens
uguuauuuucuguugaaguuua

SEQ ID NO: 1195963 - RNA, 20 nt, Homo sapiens
uguucaacuccuaguacuua

SEQ ID NO: 1195964 - RNA, 14 nt, Homo sapiens
uguucaaggcagug

SEQ ID NO: 1195965 - RNA, 14 nt, Homo sapiens
uguucaauacugua

SEQ ID NO: 1195966 - RNA, 14 nt, Homo sapiens
uguucaaugauuau

SEQ ID NO: 1195967 - RNA, 14 nt, Homo sapiens
uguucacacuuugc

SEQ ID NO: 1195968 - RNA, 15 nt, Homo sapiens
uguucagaugugcau

SEQ ID NO: 1195969 - RNA, 17 nt, Homo sapiens
uguucagcuccagcuca

SEQ ID NO: 1195970 - RNA, 21 nt, Homo sapiens
uguucauccucauugccuccu

SEQ ID NO: 1195971 - RNA, 21 nt, Homo sapiens
uguucaugcugaauccaccuc

SEQ ID NO: 1195972 - RNA, 16 nt, Homo sapiens
uguucauuauaaucuc

SEQ ID NO: 1195973 - RNA, 14 nt, Homo sapiens
uguuccccacugac

SEQ ID NO: 1195974 - RNA, 14 nt, Homo sapiens
uguucccucuggcu

SEQ ID NO: 1195975 - RNA, 14 nt, Homo sapiens
uguucccugacucc

SEQ ID NO: 1195976 - RNA, 20 nt, Homo sapiens
uguuccucaagguccauuau

SEQ ID NO: 1195977 - RNA, 17 nt, Homo sapiens
uguuccugaaaauugca

SEQ ID NO: 1195978 - RNA, 20 nt, Homo sapiens
uguuccugaaaauugcaaua

SEQ ID NO: 1195979 - RNA, 14 nt, Homo sapiens
uguucuaaguauuu

SEQ ID NO: 1195980 - RNA, 15 nt, Homo sapiens
uguucuaaguauuug

SEQ ID NO: 1195981 - RNA, 14 nt, Homo sapiens
uguucuauugcuga

SEQ ID NO: 1195982 - RNA, 20 nt, Homo sapiens
uguucugacccugcuucaaa

SEQ ID NO: 1195983 - RNA, 14 nt, Homo sapiens
uguucugcacugaa

SEQ ID NO: 1195984 - RNA, 16 nt, Homo sapiens
uguucuggaagccaua

SEQ ID NO: 1195985 - RNA, 14 nt, Homo sapiens
uguucugugccugc

SEQ ID NO: 1195986 - RNA, 20 nt, Homo sapiens
uguucuguuuggcacuugua

SEQ ID NO: 1195987 - RNA, 17 nt, Homo sapiens
uguucuuaauugcacuc

SEQ ID NO: 1195988 - RNA, 19 nt, Homo sapiens
uguucuucuucauauucua

SEQ ID NO: 1195989 - RNA, 14 nt, Homo sapiens
uguucuugcugcua

SEQ ID NO: 1195990 - RNA, 15 nt, Homo sapiens
uguucuugcugcuag

SEQ ID NO: 1195991 - RNA, 21 nt, Homo sapiens
uguucuuuuuucuuaccaccu

SEQ ID NO: 1195992 - RNA, 14 nt, Homo sapiens
uguugaaguuuaca

SEQ ID NO: 1195993 - RNA, 19 nt, Homo sapiens
uguugacaaaauuuucuca

SEQ ID NO: 1195994 - RNA, 17 nt, Homo sapiens
uguugacuguaagccuu

SEQ ID NO: 1195995 - RNA, 16 nt, Homo sapiens
uguugaggguccucag

SEQ ID NO: 1195996 - RNA, 14 nt, Homo sapiens
uguugauaaaugac

SEQ ID NO: 1195997 - RNA, 17 nt, Homo sapiens
uguugcaaacucagugc

SEQ ID NO: 1195998 - RNA, 18 nt, Homo sapiens
uguugcaccaggcacugc

SEQ ID NO: 1195999 - RNA, 20 nt, Homo sapiens
uguugcccaggcuggagugc

SEQ ID NO: 1196000 - RNA, 16 nt, Homo sapiens
uguugcccauugcacu

SEQ ID NO: 1196001 - RNA, 14 nt, Homo sapiens
uguugccuuuaugg

SEQ ID NO: 1196002 - RNA, 23 nt, Homo sapiens
uguugcuauagagccuaccugua

SEQ ID NO: 1196003 - RNA, 13 nt, Homo sapiens
uguugcuauggcu

SEQ ID NO: 1196004 - RNA, 15 nt, Homo sapiens
uguugcugcuacugu

SEQ ID NO: 1196005 - RNA, 18 nt, Homo sapiens
uuauucugccaaaccugu

SEQ ID NO: 1196006 - RNA, 23 nt, Homo sapiens
uuauucuguaguuucacucucau

SEQ ID NO: 1196007 - RNA, 22 nt, Homo sapiens
uuauugacaucucuuuugagcu

SEQ ID NO: 1196008 - RNA, 20 nt, Homo sapiens
uuauugaccaauuccugaca

SEQ ID NO: 1196009 - RNA, 21 nt, Homo sapiens
uuauugaguucgaggacuaca

SEQ ID NO: 1196010 - RNA, 12 nt, Homo sapiens
uuauugcauaau

SEQ ID NO: 1196011 - RNA, 15 nt, Homo sapiens
uuauugcgcugcuac

SEQ ID NO: 1196012 - RNA, 19 nt, Homo sapiens
uuauuggcugagauaugaa

SEQ ID NO: 1196013 - RNA, 15 nt, Homo sapiens
uuauuuaauaacauu

SEQ ID NO: 1196014 - RNA, 20 nt, Homo sapiens
uuauuuacaugugauuguga

SEQ ID NO: 1196015 - RNA, 18 nt, Homo sapiens
uuauuuauccuugucuga

SEQ ID NO: 1196016 - RNA, 12 nt, Homo sapiens
uuauuucacuuu

SEQ ID NO: 1196017 - RNA, 14 nt, Homo sapiens
uuauuucugaucua

SEQ ID NO: 1196018 - RNA, 20 nt, Homo sapiens
uuauuugcacacugcacugu

SEQ ID NO: 1196019 - RNA, 17 nt, Homo sapiens
uuauuugccagagccaa

SEQ ID NO: 1196020 - RNA, 16 nt, Homo sapiens
uuauuuugaaaauaau

SEQ ID NO: 1196021 - RNA, 13 nt, Homo sapiens
uuauuuugacaaa

SEQ ID NO: 1196022 - RNA, 22 nt, Homo sapiens
uuauuuuguugaaauugucaaa

SEQ ID NO: 1196023 - RNA, 14 nt, Homo sapiens
uucaaaaacuaaaa

SEQ ID NO: 1196024 - RNA, 13 nt, Homo sapiens
uucaaaacauucc

SEQ ID NO: 1196025 - RNA, 15 nt, Homo sapiens
uucaaaacauuccaa

SEQ ID NO: 1196026 - RNA, 14 nt, Homo sapiens
uucaaaaccuugca

SEQ ID NO: 1196027 - RNA, 18 nt, Homo sapiens
uucaaaauauacauucaa

SEQ ID NO: 1196028 - RNA, 16 nt, Homo sapiens
uucaaacaauaucaua

SEQ ID NO: 1196029 - RNA, 17 nt, Homo sapiens
uucaaacugcaugauuc

SEQ ID NO: 1196030 - RNA, 13 nt, Homo sapiens
uucaaacugugaa

SEQ ID NO: 1196031 - RNA, 12 nt, Homo sapiens
uucaaacuuaaa

SEQ ID NO: 1196032 - RNA, 18 nt, Homo sapiens
uucaaagacagagaagac

SEQ ID NO: 1196033 - RNA, 22 nt, Homo sapiens
uucaaagacagagaagaccaaa

SEQ ID NO: 1196034 - RNA, 17 nt, Homo sapiens
uucaaagagacauauac

SEQ ID NO: 1196035 - RNA, 22 nt, Homo sapiens
uucaaagagacauauacuaaga

SEQ ID NO: 1196036 - RNA, 22 nt, Homo sapiens
uucaaagagucauauugcccag

SEQ ID NO: 1196037 - RNA, 21 nt, Homo sapiens
uucaaaggccacauaccucuc

SEQ ID NO: 1196038 - RNA, 20 nt, Homo sapiens
uucaaaguuuuguuguacuu

SEQ ID NO: 1196039 - RNA, 21 nt, Homo sapiens
uucaaauuaagugugcaugau

SEQ ID NO: 1196040 - RNA, 15 nt, Homo sapiens
uucaaauuuguacag

SEQ ID NO: 1196041 - RNA, 15 nt, Homo sapiens
uucaaccacuguaaa

SEQ ID NO: 1196042 - RNA, 20 nt, Homo sapiens
uucaaccugguggcaccaga

SEQ ID NO: 1196043 - RNA, 13 nt, Homo sapiens
uucaagaaacuga

SEQ ID NO: 1196044 - RNA, 11 nt, Homo sapiens
uucaagaccag

SEQ ID NO: 1196045 - RNA, 20 nt, Homo sapiens
uucaagaccagccugaccaa

SEQ ID NO: 1196046 - RNA, 21 nt, Homo sapiens
uucaagaccauccuggacuga

SEQ ID NO: 1196047 - RNA, 14 nt, Homo sapiens
uucaagacuuccuc

SEQ ID NO: 1196048 - RNA, 23 nt, Homo sapiens
uucaagcaaaaugcuuacagggc

SEQ ID NO: 1196049 - RNA, 15 nt, Homo sapiens
uucaagccugugcaa

SEQ ID NO: 1196050 - RNA, 14 nt, Homo sapiens
uucaagcuauuuaa

SEQ ID NO: 1196051 - RNA, 20 nt, Homo sapiens
uucaaggaaaaaugcugcuu

SEQ ID NO: 1196052 - RNA, 21 nt, Homo sapiens
uucaaggccccgagcuguuac

SEQ ID NO: 1196053 - RNA, 22 nt, Homo sapiens
uucaagguugguucaacaucua

SEQ ID NO: 1196054 - RNA, 20 nt, Homo sapiens
uucaaguauaacaacuuuga

SEQ ID NO: 1196055 - RNA, 22 nt, Homo sapiens
uucaagugauucuccugccuca

SEQ ID NO: 1196056 - RNA, 13 nt, Homo sapiens
uucaagugccaaa

SEQ ID NO: 1196057 - RNA, 20 nt, Homo sapiens
uucaagugccuagacuguua

SEQ ID NO: 1196058 - RNA, 19 nt, Homo sapiens
uucaaguuuuaaaguucau

SEQ ID NO: 1196059 - RNA, 20 nt, Homo sapiens
uucaauauuuguuacuguua

SEQ ID NO: 1196060 - RNA, 16 nt, Homo sapiens
uucaaucaaaauuuca

SEQ ID NO: 1196061 - RNA, 16 nt, Homo sapiens
uucaaucauaauaccu

SEQ ID NO: 1196062 - RNA, 12 nt, Homo sapiens
uucaaucucuug

SEQ ID NO: 1196063 - RNA, 18 nt, Homo sapiens
uucaaucuguaaacugug

SEQ ID NO: 1196064 - RNA, 21 nt, Homo sapiens
uucaaugcuagaacaacgccu

SEQ ID NO: 1196065 - RNA, 22 nt, Homo sapiens
uucaauguccuaaaaagacacg

SEQ ID NO: 1196066 - RNA, 13 nt, Homo sapiens
uucaaugugacac

SEQ ID NO: 1196067 - RNA, 23 nt, Homo sapiens
uucacaagccuccuguaccucag

SEQ ID NO: 1196068 - RNA, 10 nt, Homo sapiens
uucacaagcu

SEQ ID NO: 1196069 - RNA, 23 nt, Homo sapiens
uucacacaacaccucacuuuuga

SEQ ID NO: 1196070 - RNA, 13 nt, Homo sapiens
uucacacagugaa

SEQ ID NO: 1196071 - RNA, 16 nt, Homo sapiens
uucacaggcacuccug

SEQ ID NO: 1196072 - RNA, 21 nt, Homo sapiens
uucacaggcagugcaugugaa

SEQ ID NO: 1196073 - RNA, 19 nt, Homo sapiens
uucacaguaauaugguucc

SEQ ID NO: 1196074 - RNA, 16 nt, Homo sapiens
uucacaugagcuauuu

SEQ ID NO: 1196075 - RNA, 22 nt, Homo sapiens
uucaccagucugucuacugugg

SEQ ID NO: 1196076 - RNA, 16 nt, Homo sapiens
uucaccuacauuaucu

SEQ ID NO: 1196077 - RNA, 18 nt, Homo sapiens
uucaccuacauuaucuca

SEQ ID NO: 1196078 - RNA, 14 nt, Homo sapiens
uucaccugaucaua

SEQ ID NO: 1196079 - RNA, 17 nt, Homo sapiens
uucaccuguuaaggugg

SEQ ID NO: 1196080 - RNA, 16 nt, Homo sapiens
uucaccuugauaaggu

SEQ ID NO: 1196081 - RNA, 13 nt, Homo sapiens
uucacgcaugugu

SEQ ID NO: 1196082 - RNA, 19 nt, Homo sapiens
uucacgcuguuuguuucau

SEQ ID NO: 1196083 - RNA, 17 nt, Homo sapiens
uucacgugcagcagcaa

SEQ ID NO: 1196084 - RNA, 12 nt, Homo sapiens
uucacuacauua

SEQ ID NO: 1196085 - RNA, 18 nt, Homo sapiens
uucacuaccaagcagcuc

SEQ ID NO: 1196086 - RNA, 15 nt, Homo sapiens
uucacucuccagggu

SEQ ID NO: 1196087 - RNA, 18 nt, Homo sapiens
uucacugagcuccccaga

SEQ ID NO: 1196088 - RNA, 22 nt, Homo sapiens
uucacugagcuccccagaucuc

SEQ ID NO: 1196089 - RNA, 16 nt, Homo sapiens
uucacugcgaagaccc

SEQ ID NO: 1196090 - RNA, 16 nt, Homo sapiens
uucacuggacacuuca

SEQ ID NO: 1196091 - RNA, 17 nt, Homo sapiens
uucacugugagugaaaa

SEQ ID NO: 1196092 - RNA, 20 nt, Homo sapiens
uucacugugcaaauauaucu

SEQ ID NO: 1196093 - RNA, 14 nt, Homo sapiens
uucacuguugaaaa

SEQ ID NO: 1196094 - RNA, 12 nt, Homo sapiens
uucacuuggcca

SEQ ID NO: 1196095 - RNA, 11 nt, Homo sapiens
uucacuuuaaa

SEQ ID NO: 1196096 - RNA, 24 nt, Homo sapiens
uucagaagcuagugaccaucuuca

SEQ ID NO: 1196097 - RNA, 21 nt, Homo sapiens
uucagaccacaaggggcucca

SEQ ID NO: 1196098 - RNA, 15 nt, Homo sapiens
uucagagaacccacu

SEQ ID NO: 1196099 - RNA, 12 nt, Homo sapiens
uucagagauuua

SEQ ID NO: 1196100 - RNA, 19 nt, Homo sapiens
uucagaggagcaacccuau

SEQ ID NO: 1196101 - RNA, 12 nt, Homo sapiens
uucagaguauau

SEQ ID NO: 1196102 - RNA, 18 nt, Homo sapiens
uucagaguccuugcaaaa

SEQ ID NO: 1196103 - RNA, 17 nt, Homo sapiens
uucagagugacuacaca

SEQ ID NO: 1196104 - RNA, 19 nt, Homo sapiens
uucagauauauuuuucaca

SEQ ID NO: 1196105 - RNA, 19 nt, Homo sapiens
uucagauauuauugcuuua

SEQ ID NO: 1196106 - RNA, 22 nt, Homo sapiens
uucagauccugaauuccagcaa

SEQ ID NO: 1196107 - RNA, 22 nt, Homo sapiens
uucagauuuuaaaaagucuuca

SEQ ID NO: 1196108 - RNA, 18 nt, Homo sapiens
uucagcaacugucuuauu

SEQ ID NO: 1196109 - RNA, 22 nt, Homo sapiens
uucagcacugucccuugccuca

SEQ ID NO: 1196110 - RNA, 23 nt, Homo sapiens
uucagcccacugcccaaugccug

SEQ ID NO: 1196111 - RNA, 15 nt, Homo sapiens
uucagccugaggcug

SEQ ID NO: 1196112 - RNA, 16 nt, Homo sapiens
uucagcuacuuuccau

SEQ ID NO: 1196113 - RNA, 14 nt, Homo sapiens
uucagcuccaggga

SEQ ID NO: 1196114 - RNA, 13 nt, Homo sapiens
uucagcucccuua

SEQ ID NO: 1196115 - RNA, 22 nt, Homo sapiens
uucagcuguacuucgucuucua

SEQ ID NO: 1196116 - RNA, 19 nt, Homo sapiens
uucaggaaacaagcuuuau

SEQ ID NO: 1196117 - RNA, 16 nt, Homo sapiens
uucaggacucuaccuc

SEQ ID NO: 1196118 - RNA, 14 nt, Homo sapiens
uucaggaggcugga

SEQ ID NO: 1196119 - RNA, 23 nt, Homo sapiens
uucaggccauucuccugccucag

SEQ ID NO: 1196120 - RNA, 22 nt, Homo sapiens
uucagggaaccguuauuauaau

SEQ ID NO: 1196121 - RNA, 15 nt, Homo sapiens
uucagggaacugcau

SEQ ID NO: 1196122 - RNA, 18 nt, Homo sapiens
uucagggagaaacuccaa

SEQ ID NO: 1196123 - RNA, 12 nt, Homo sapiens
uucagguuucca

SEQ ID NO: 1196124 - RNA, 14 nt, Homo sapiens
uucaguagaauuac

SEQ ID NO: 1196125 - RNA, 21 nt, Homo sapiens
uucaguagugcuggccaggga

SEQ ID NO: 1196126 - RNA, 13 nt, Homo sapiens
uucaguaugcaaa

SEQ ID NO: 1196127 - RNA, 20 nt, Homo sapiens
uucaguauuagaugcacuua

SEQ ID NO: 1196128 - RNA, 13 nt, Homo sapiens
uucagucuugccu

SEQ ID NO: 1196129 - RNA, 23 nt, Homo sapiens
uucagucuuguagugugugcuua

SEQ ID NO: 1196130 - RNA, 14 nt, Homo sapiens
uucagugacuuaau

SEQ ID NO: 1196131 - RNA, 16 nt, Homo sapiens
uucagugauguggggu

SEQ ID NO: 1196132 - RNA, 19 nt, Homo sapiens
uguaaagauguuuauuuca

SEQ ID NO: 1196133 - RNA, 13 nt, Homo sapiens
uguaaagugccuu

SEQ ID NO: 1196134 - RNA, 22 nt, Homo sapiens
uguaaaguugccuuuauuugcu

SEQ ID NO: 1196135 - RNA, 18 nt, Homo sapiens
uguaaauacacauagcau

SEQ ID NO: 1196136 - RNA, 23 nt, Homo sapiens
uguaaaucugccacaaaaacagg

SEQ ID NO: 1196137 - RNA, 14 nt, Homo sapiens
uguaaaugcauuag

SEQ ID NO: 1196138 - RNA, 13 nt, Homo sapiens
uguaacauucaca

SEQ ID NO: 1196139 - RNA, 17 nt, Homo sapiens
uguaacccagauuuugc

SEQ ID NO: 1196140 - RNA, 21 nt, Homo sapiens
uguaacccccaguucaagacu

SEQ ID NO: 1196141 - RNA, 16 nt, Homo sapiens
uguaacguggcacugg

SEQ ID NO: 1196142 - RNA, 23 nt, Homo sapiens
uguaacugugccaguucuuucca

SEQ ID NO: 1196143 - RNA, 16 nt, Homo sapiens
uguaagaaagcauaga

SEQ ID NO: 1196144 - RNA, 15 nt, Homo sapiens
uguaagaagagccau

SEQ ID NO: 1196145 - RNA, 14 nt, Homo sapiens
uguaagacuuacaa

SEQ ID NO: 1196146 - RNA, 16 nt, Homo sapiens
uguaagcauacuuugu

SEQ ID NO: 1196147 - RNA, 24 nt, Homo sapiens
uguaagcucuuugaaacaacuuuc

SEQ ID NO: 1196148 - RNA, 17 nt, Homo sapiens
uguaagguggucacugu

SEQ ID NO: 1196149 - RNA, 14 nt, Homo sapiens
uguaaguacccuga

SEQ ID NO: 1196150 - RNA, 15 nt, Homo sapiens
uguaaguacuuccac

SEQ ID NO: 1196151 - RNA, 22 nt, Homo sapiens
uguaagugaaguaaaacuuaag

SEQ ID NO: 1196152 - RNA, 18 nt, Homo sapiens
uguaagugagagagacaa

SEQ ID NO: 1196153 - RNA, 21 nt, Homo sapiens
uguaagugagagagacaagaa

SEQ ID NO: 1196154 - RNA, 19 nt, Homo sapiens
aacacacagucacauucga

SEQ ID NO: 1196155 - RNA, 17 nt, Homo sapiens
aacacacgauaccuguu

SEQ ID NO: 1196156 - RNA, 14 nt, Homo sapiens
aacacacucaaaag

SEQ ID NO: 1196157 - RNA, 20 nt, Homo sapiens
aacacacuuuggucauuucu

SEQ ID NO: 1196158 - RNA, 21 nt, Homo sapiens
aacacacuuuggucauuucuc

SEQ ID NO: 1196159 - RNA, 13 nt, Homo sapiens
aacacagaggcag

SEQ ID NO: 1196160 - RNA, 19 nt, Homo sapiens
aacacagcaacaaugacuu

SEQ ID NO: 1196161 - RNA, 22 nt, Homo sapiens
aacacagugaaacuccaucuca

SEQ ID NO: 1196162 - RNA, 23 nt, Homo sapiens
aacacagugaaacuccaucucaa

SEQ ID NO: 1196163 - RNA, 14 nt, Homo sapiens
aacaccacagacac

SEQ ID NO: 1196164 - RNA, 20 nt, Homo sapiens
aacaccaggagagcuucucc

SEQ ID NO: 1196165 - RNA, 20 nt, Homo sapiens
aacacccauuuuugcucuau

SEQ ID NO: 1196166 - RNA, 20 nt, Homo sapiens
aacacccgacuccucaaaag

SEQ ID NO: 1196167 - RNA, 16 nt, Homo sapiens
aacacccuuucaucuc

SEQ ID NO: 1196168 - RNA, 13 nt, Homo sapiens
aacaccuccucau

SEQ ID NO: 1196169 - RNA, 14 nt, Homo sapiens
aacaccuucaucca

SEQ ID NO: 1196170 - RNA, 18 nt, Homo sapiens
aacaccuucauccagauu

SEQ ID NO: 1196171 - RNA, 13 nt, Homo sapiens
aacacgacaugcu

SEQ ID NO: 1196172 - RNA, 17 nt, Homo sapiens
aacacguggagauggaa

SEQ ID NO: 1196173 - RNA, 19 nt, Homo sapiens
aacacuaguuuugugccag

SEQ ID NO: 1196174 - RNA, 22 nt, Homo sapiens
aacacuauauauuuuaugaucu

SEQ ID NO: 1196175 - RNA, 13 nt, Homo sapiens
aacacugugcaaa

SEQ ID NO: 1196176 - RNA, 14 nt, Homo sapiens
aacacugugcaaag

SEQ ID NO: 1196177 - RNA, 18 nt, Homo sapiens
aacacuguggaacuaaua

SEQ ID NO: 1196178 - RNA, 19 nt, Homo sapiens
aacacuguguacaccucaa

SEQ ID NO: 1196179 - RNA, 16 nt, Homo sapiens
aacacuucgagcacug

SEQ ID NO: 1196180 - RNA, 16 nt, Homo sapiens
aacacuuugagcauuu

SEQ ID NO: 1196181 - RNA, 15 nt, Homo sapiens
aacagaaacaugcca

SEQ ID NO: 1196182 - RNA, 18 nt, Homo sapiens
aacagaaaccuauccuca

SEQ ID NO: 1196183 - RNA, 17 nt, Homo sapiens
aacagaaagcauccuaa

SEQ ID NO: 1196184 - RNA, 14 nt, Homo sapiens
aacagaccagugac

SEQ ID NO: 1196185 - RNA, 20 nt, Homo sapiens
aacagagaaucucuagugaa

SEQ ID NO: 1196186 - RNA, 22 nt, Homo sapiens
aacagagcaagacuccaucuca

SEQ ID NO: 1196187 - RNA, 22 nt, Homo sapiens
aacagaggggcagccaggacau

SEQ ID NO: 1196188 - RNA, 14 nt, Homo sapiens
aacagauauuguca

SEQ ID NO: 1196189 - RNA, 14 nt, Homo sapiens
aacagaucuuuacu

SEQ ID NO: 1196190 - RNA, 21 nt, Homo sapiens
aacagaugcuccuguuugcug

SEQ ID NO: 1196191 - RNA, 16 nt, Homo sapiens
aacagcaagucaccca

SEQ ID NO: 1196192 - RNA, 14 nt, Homo sapiens
aacagcaccucccc

SEQ ID NO: 1196193 - RNA, 21 nt, Homo sapiens
aacagcaccuccccgcuggga

SEQ ID NO: 1196194 - RNA, 15 nt, Homo sapiens
aacagcaguggagua

SEQ ID NO: 1196195 - RNA, 16 nt, Homo sapiens
aacagcaguggaguaa

SEQ ID NO: 1196196 - RNA, 15 nt, Homo sapiens
aacagccaacuagcc

SEQ ID NO: 1196197 - RNA, 20 nt, Homo sapiens
aacagccaagugugacccca

SEQ ID NO: 1196198 - RNA, 14 nt, Homo sapiens
aacagcucugagau

SEQ ID NO: 1196199 - RNA, 23 nt, Homo sapiens
aacaggaaugucuggagugguaa

SEQ ID NO: 1196200 - RNA, 18 nt, Homo sapiens
aacaggaauucugaauua

SEQ ID NO: 1196201 - RNA, 21 nt, Homo sapiens
aacaggauuacaguguagcua

SEQ ID NO: 1196202 - RNA, 17 nt, Homo sapiens
aacaggcuuggcaaaga

SEQ ID NO: 1196203 - RNA, 13 nt, Homo sapiens
aacagggcauuuu

SEQ ID NO: 1196204 - RNA, 17 nt, Homo sapiens
aacagguaaaacagggc

SEQ ID NO: 1196205 - RNA, 14 nt, Homo sapiens
aacaggucacuuga

SEQ ID NO: 1196206 - RNA, 15 nt, Homo sapiens
aacagugcauauucc

SEQ ID NO: 1196207 - RNA, 22 nt, Homo sapiens
aacagugucuggugcacauaau

SEQ ID NO: 1196208 - RNA, 14 nt, Homo sapiens
aacaguuacuccag

SEQ ID NO: 1196209 - RNA, 22 nt, Homo sapiens
aacaguuuuuuaugcuaaucag

SEQ ID NO: 1196210 - RNA, 22 nt, Homo sapiens
aacauaaaaaauaaaguaccac

SEQ ID NO: 1196211 - RNA, 17 nt, Homo sapiens
aacauaaaggacaggcc

SEQ ID NO: 1196212 - RNA, 21 nt, Homo sapiens
aacauaaauuucuuuaaucau

SEQ ID NO: 1196213 - RNA, 23 nt, Homo sapiens
aacauaagagagccuugguucau

SEQ ID NO: 1196214 - RNA, 18 nt, Homo sapiens
aacauaaugcacuuuaga

SEQ ID NO: 1196215 - RNA, 15 nt, Homo sapiens
aacauaauucucuca

SEQ ID NO: 1196216 - RNA, 23 nt, Homo sapiens
aacauacuucaaaaauaaugugc

SEQ ID NO: 1196217 - RNA, 17 nt, Homo sapiens
aacauagcaucucagga

SEQ ID NO: 1196218 - RNA, 17 nt, Homo sapiens
aacauaggccugcucag

SEQ ID NO: 1196219 - RNA, 22 nt, Homo sapiens
aacauagugaaaccccaucucu

SEQ ID NO: 1196220 - RNA, 19 nt, Homo sapiens
aacauauccuuucaagaca

SEQ ID NO: 1196221 - RNA, 13 nt, Homo sapiens
aacaucaguuucu

SEQ ID NO: 1196222 - RNA, 19 nt, Homo sapiens
aacaucuaauaaguauaua

SEQ ID NO: 1196223 - RNA, 14 nt, Homo sapiens
aacaucucugggaa

SEQ ID NO: 1196224 - RNA, 18 nt, Homo sapiens
aacaugaaaaacagguga

SEQ ID NO: 1196225 - RNA, 18 nt, Homo sapiens
aacaugacacugaccuug

SEQ ID NO: 1196226 - RNA, 19 nt, Homo sapiens
aacaugauuguuuacagcu

SEQ ID NO: 1196227 - RNA, 14 nt, Homo sapiens
aacaugcaaagauc

SEQ ID NO: 1196228 - RNA, 14 nt, Homo sapiens
aacaugcacgguga

SEQ ID NO: 1196229 - RNA, 19 nt, Homo sapiens
aacaugcugaaaacuacac

SEQ ID NO: 1196230 - RNA, 22 nt, Homo sapiens
aacaugcuugaauaacugagcu

SEQ ID NO: 1196231 - RNA, 16 nt, Homo sapiens
aacauggauacuuccu

SEQ ID NO: 1196232 - RNA, 22 nt, Homo sapiens
aacaugguaaaaccccaucucu

SEQ ID NO: 1196233 - RNA, 22 nt, Homo sapiens
aacauggugaaaccccgucucu

SEQ ID NO: 1196234 - RNA, 19 nt, Homo sapiens
aacauguaauuaaguacua

SEQ ID NO: 1196235 - RNA, 15 nt, Homo sapiens
aacauguaugugcau

SEQ ID NO: 1196236 - RNA, 23 nt, Homo sapiens
aacaugugagagguuugacuaga

SEQ ID NO: 1196237 - RNA, 15 nt, Homo sapiens
aacauguuucacuua

SEQ ID NO: 1196238 - RNA, 22 nt, Homo sapiens
aacauuauguggcccucuggau

SEQ ID NO: 1196239 - RNA, 13 nt, Homo sapiens
aacauuccaagac

SEQ ID NO: 1196240 - RNA, 16 nt, Homo sapiens
aacauuccaaugcauu

SEQ ID NO: 1196241 - RNA, 15 nt, Homo sapiens
aacauucgaccucca

SEQ ID NO: 1196242 - RNA, 17 nt, Homo sapiens
aacauucuuuuccacuu

SEQ ID NO: 1196243 - RNA, 20 nt, Homo sapiens
aacauuguguugacauuaag

SEQ ID NO: 1196244 - RNA, 23 nt, Homo sapiens
aacauuguuuuguguaacauauu

SEQ ID NO: 1196245 - RNA, 20 nt, Homo sapiens
aacauuucucaaaugcacau

SEQ ID NO: 1196246 - RNA, 16 nt, Homo sapiens
aacauuugcugccauu

SEQ ID NO: 1196247 - RNA, 20 nt, Homo sapiens
aacauuuuguuauugggcaa

SEQ ID NO: 1196248 - RNA, 14 nt, Homo sapiens
aaccaacacuaaca

SEQ ID NO: 1196249 - RNA, 16 nt, Homo sapiens
aaccaaggaaagugaa

SEQ ID NO: 1196250 - RNA, 14 nt, Homo sapiens
aaccaauaaaggaa

SEQ ID NO: 1196251 - RNA, 9 nt, Homo sapiens
aaccaauga

SEQ ID NO: 1196252 - RNA, 17 nt, Homo sapiens
aaccaauuuacacugcc

SEQ ID NO: 1196253 - RNA, 20 nt, Homo sapiens
aaccacaaaggccaaacugc

SEQ ID NO: 1196254 - RNA, 11 nt, Homo sapiens
aaccacagggc

SEQ ID NO: 1196255 - RNA, 23 nt, Homo sapiens
aaccacauaguucguuuaccuuc

SEQ ID NO: 1196256 - RNA, 12 nt, Homo sapiens
aaccacauuaua

SEQ ID NO: 1196257 - RNA, 13 nt, Homo sapiens
aaccacuuucuaa

SEQ ID NO: 1196258 - RNA, 15 nt, Homo sapiens
aaccagcaucucugu

SEQ ID NO: 1196259 - RNA, 14 nt, Homo sapiens
aaccagccaggcag

SEQ ID NO: 1196260 - RNA, 18 nt, Homo sapiens
aaccaggcaccucuuccu

SEQ ID NO: 1196261 - RNA, 13 nt, Homo sapiens
aaccagugccaag

SEQ ID NO: 1196262 - RNA, 18 nt, Homo sapiens
aaccauaugauacuauca

SEQ ID NO: 1196263 - RNA, 20 nt, Homo sapiens
aaccauccauaguaguauga

SEQ ID NO: 1196264 - RNA, 18 nt, Homo sapiens
aaccaucgguccacaccu

SEQ ID NO: 1196265 - RNA, 12 nt, Homo sapiens
aaccaugacugu

SEQ ID NO: 1196266 - RNA, 22 nt, Homo sapiens
aaccaugagaccacuguuauca

SEQ ID NO: 1196267 - RNA, 22 nt, Homo sapiens
aaccauuguuucuuauucuuuc

SEQ ID NO: 1196268 - RNA, 14 nt, Homo sapiens
aaccauuugcaaua

SEQ ID NO: 1196269 - RNA, 14 nt, Homo sapiens
aacccaaaccauga

SEQ ID NO: 1196270 - RNA, 14 nt, Homo sapiens
aacccaaggagcac

SEQ ID NO: 1196271 - RNA, 19 nt, Homo sapiens
aacccacagaugucucugg

SEQ ID NO: 1196272 - RNA, 20 nt, Homo sapiens
aacccaggagauggaaguug

SEQ ID NO: 1196273 - RNA, 18 nt, Homo sapiens
aaccccaacgcacaggaa

SEQ ID NO: 1196274 - RNA, 22 nt, Homo sapiens
aaccccagccugaccugagacu

SEQ ID NO: 1196275 - RNA, 12 nt, Homo sapiens
aaccccagugga

SEQ ID NO: 1196276 - RNA, 12 nt, Homo sapiens
aaccccaucucu

SEQ ID NO: 1196277 - RNA, 17 nt, Homo sapiens
aacccccgccaccucag

SEQ ID NO: 1196278 - RNA, 16 nt, Homo sapiens
aaccccgucucuacua

SEQ ID NO: 1196279 - RNA, 15 nt, Homo sapiens
aaccccugauguuug

SEQ ID NO: 1196280 - RNA, 13 nt, Homo sapiens
aagcccuggcaac

SEQ ID NO: 1196281 - RNA, 19 nt, Homo sapiens
aagcccugguaaaagggau

SEQ ID NO: 1196282 - RNA, 12 nt, Homo sapiens
aagcccuguggg

SEQ ID NO: 1196283 - RNA, 21 nt, Homo sapiens
aagccgaccuucccuccgccu

SEQ ID NO: 1196284 - RNA, 14 nt, Homo sapiens
aagccuaaaugccu

SEQ ID NO: 1196285 - RNA, 20 nt, Homo sapiens
aagccuaagggauccugccu

SEQ ID NO: 1196286 - RNA, 22 nt, Homo sapiens
aagccuauuugaacuacuuaaa

SEQ ID NO: 1196287 - RNA, 20 nt, Homo sapiens
aagccucagugacccaugag

SEQ ID NO: 1196288 - RNA, 15 nt, Homo sapiens
aagccuccaaggguu

SEQ ID NO: 1196289 - RNA, 21 nt, Homo sapiens
aagccuccuguaccucagugg

SEQ ID NO: 1196290 - RNA, 17 nt, Homo sapiens
aagccuggacucugccc

SEQ ID NO: 1196291 - RNA, 15 nt, Homo sapiens
aagccugugcaaugc

SEQ ID NO: 1196292 - RNA, 21 nt, Homo sapiens
aagccuuuagagccagcccau

SEQ ID NO: 1196293 - RNA, 17 nt, Homo sapiens
aagccuuuaguaucagu

SEQ ID NO: 1196294 - RNA, 18 nt, Homo sapiens
aagcggagcuugcaguga

SEQ ID NO: 1196295 - RNA, 18 nt, Homo sapiens
aagcggagguugcaggga

SEQ ID NO: 1196296 - RNA, 17 nt, Homo sapiens
aagcgugagccacugca

SEQ ID NO: 1196297 - RNA, 16 nt, Homo sapiens
aagcguucagugaugu

SEQ ID NO: 1196298 - RNA, 14 nt, Homo sapiens
aagcuaaauuccac

SEQ ID NO: 1196299 - RNA, 15 nt, Homo sapiens
aagcuagacagaucc

SEQ ID NO: 1196300 - RNA, 21 nt, Homo sapiens
aagcuaggguggcccuugcag

SEQ ID NO: 1196301 - RNA, 17 nt, Homo sapiens
aagcuaguggcuucaaa

SEQ ID NO: 1196302 - RNA, 17 nt, Homo sapiens
aagcuaguguaccuccu

SEQ ID NO: 1196303 - RNA, 21 nt, Homo sapiens
aagcuaguguaccuccucuca

SEQ ID NO: 1196304 - RNA, 20 nt, Homo sapiens
aagcuaucagcaauacucau

SEQ ID NO: 1196305 - RNA, 13 nt, Homo sapiens
aagcuaucugugc

SEQ ID NO: 1196306 - RNA, 17 nt, Homo sapiens
aagcucaucucagucau

SEQ ID NO: 1196307 - RNA, 14 nt, Homo sapiens
aagcucaugcauuu

SEQ ID NO: 1196308 - RNA, 12 nt, Homo sapiens
aagcuccacugu

SEQ ID NO: 1196309 - RNA, 16 nt, Homo sapiens
aagcuccacugucacc

SEQ ID NO: 1196310 - RNA, 12 nt, Homo sapiens
aagcuccaucuc

SEQ ID NO: 1196311 - RNA, 15 nt, Homo sapiens
aagcuccucgugaua

SEQ ID NO: 1196312 - RNA, 18 nt, Homo sapiens
aagcugaagaccauggau

SEQ ID NO: 1196313 - RNA, 19 nt, Homo sapiens
aagcugacuuggcacuuaa

SEQ ID NO: 1196314 - RNA, 18 nt, Homo sapiens
aagcugcacaugugccac

SEQ ID NO: 1196315 - RNA, 19 nt, Homo sapiens
aagcugcacaugugccaca

SEQ ID NO: 1196316 - RNA, 23 nt, Homo sapiens
aagcugcacaugugccacacagu

SEQ ID NO: 1196317 - RNA, 14 nt, Homo sapiens
aagcugccauauau

SEQ ID NO: 1196318 - RNA, 22 nt, Homo sapiens
aagcugcccuugaagacuuccc

SEQ ID NO: 1196319 - RNA, 12 nt, Homo sapiens
aagcugcuccag

SEQ ID NO: 1196320 - RNA, 16 nt, Homo sapiens
aagcuggaacauuuga

SEQ ID NO: 1196321 - RNA, 22 nt, Homo sapiens
aagcugguaaacuauuugucuu

SEQ ID NO: 1196322 - RNA, 22 nt, Homo sapiens
aagcuucaauagaacuguuuca

SEQ ID NO: 1196323 - RNA, 16 nt, Homo sapiens
aagcuuccauaguggu

SEQ ID NO: 1196324 - RNA, 20 nt, Homo sapiens
aagcuuguuaucagcuuuca

SEQ ID NO: 1196325 - RNA, 22 nt, Homo sapiens
aagcuuucauuugccgggacac

SEQ ID NO: 1196326 - RNA, 20 nt, Homo sapiens
aaggaaaagacugaaucuac

SEQ ID NO: 1196327 - RNA, 17 nt, Homo sapiens
aaggaaccuuccuuccu

SEQ ID NO: 1196328 - RNA, 13 nt, Homo sapiens
aaggaagacuuga

SEQ ID NO: 1196329 - RNA, 12 nt, Homo sapiens
aaggaagcucca

SEQ ID NO: 1196330 - RNA, 18 nt, Homo sapiens
aaggaagggccaccacac

SEQ ID NO: 1196331 - RNA, 18 nt, Homo sapiens
aaggaaguuucaguauua

SEQ ID NO: 1196332 - RNA, 20 nt, Homo sapiens
aaggacaccuuuuaacucac

SEQ ID NO: 1196333 - RNA, 15 nt, Homo sapiens
aaggacaggacccuc

SEQ ID NO: 1196334 - RNA, 21 nt, Homo sapiens
aaggacaggccacaccacagc

SEQ ID NO: 1196335 - RNA, 20 nt, Homo sapiens
aaggacucuccaaauagcau

SEQ ID NO: 1196336 - RNA, 14 nt, Homo sapiens
aaggacuucaggaa

SEQ ID NO: 1196337 - RNA, 18 nt, Homo sapiens
aaggagaacuauccaaaa

SEQ ID NO: 1196338 - RNA, 18 nt, Homo sapiens
aaggagaggcaacaucca

SEQ ID NO: 1196339 - RNA, 15 nt, Homo sapiens
aaggagcugauacuu

SEQ ID NO: 1196340 - RNA, 15 nt, Homo sapiens
aaggagggucucuug

SEQ ID NO: 1196341 - RNA, 22 nt, Homo sapiens
aaggaguacaaugcccagauca

SEQ ID NO: 1196342 - RNA, 11 nt, Homo sapiens
aaggagucaaa

SEQ ID NO: 1196343 - RNA, 17 nt, Homo sapiens
aaggauaccaaauacca

SEQ ID NO: 1196344 - RNA, 14 nt, Homo sapiens
aaggauacuuuaca

SEQ ID NO: 1196345 - RNA, 17 nt, Homo sapiens
aaggauaugcaguaugc

SEQ ID NO: 1196346 - RNA, 21 nt, Homo sapiens
aaggauaugguagcauuuuau

SEQ ID NO: 1196347 - RNA, 23 nt, Homo sapiens
aaggauauguggagaaucaucaa

SEQ ID NO: 1196348 - RNA, 15 nt, Homo sapiens
aaggaucucugagac

SEQ ID NO: 1196349 - RNA, 21 nt, Homo sapiens
aaggaugcggcaggugcucug

SEQ ID NO: 1196350 - RNA, 18 nt, Homo sapiens
aaggauggagccagcucu

SEQ ID NO: 1196351 - RNA, 23 nt, Homo sapiens
aaggauggagccagcucugcauu

SEQ ID NO: 1196352 - RNA, 16 nt, Homo sapiens
aaggauuacucuccau

SEQ ID NO: 1196353 - RNA, 19 nt, Homo sapiens
aaggauuuuaccaaagcau

SEQ ID NO: 1196354 - RNA, 22 nt, Homo sapiens
aaggauuuuaccaaagcaucaa

SEQ ID NO: 1196355 - RNA, 23 nt, Homo sapiens
aaggcaaaaaacucuuaaucugu

SEQ ID NO: 1196356 - RNA, 12 nt, Homo sapiens
aaggcaaaaaua

SEQ ID NO: 1196357 - RNA, 16 nt, Homo sapiens
aaggcaaauauaagcu

SEQ ID NO: 1196358 - RNA, 16 nt, Homo sapiens
aaggcacguucuuucc

SEQ ID NO: 1196359 - RNA, 20 nt, Homo sapiens
aaggcagccacccugucacc

SEQ ID NO: 1196360 - RNA, 19 nt, Homo sapiens
aaggcagcugccucugcuc

SEQ ID NO: 1196361 - RNA, 14 nt, Homo sapiens
aaggcagggcccuu

SEQ ID NO: 1196362 - RNA, 12 nt, Homo sapiens
aaggcaggugga

SEQ ID NO: 1196363 - RNA, 15 nt, Homo sapiens
aaggcaguagaacuc

SEQ ID NO: 1196364 - RNA, 14 nt, Homo sapiens
aaggcaguauuuca

SEQ ID NO: 1196365 - RNA, 22 nt, Homo sapiens
aaggcauaugcuggcccauaaa

SEQ ID NO: 1196366 - RNA, 19 nt, Homo sapiens
aaggcaucuacacaauuua

SEQ ID NO: 1196367 - RNA, 20 nt, Homo sapiens
aaggccacggccuugugucu

SEQ ID NO: 1196368 - RNA, 18 nt, Homo sapiens
aaggcccauaucugugaa

SEQ ID NO: 1196369 - RNA, 14 nt, Homo sapiens
aaggcccucaguga

SEQ ID NO: 1196370 - RNA, 21 nt, Homo sapiens
aaggccugacuucugcuggca

SEQ ID NO: 1196371 - RNA, 14 nt, Homo sapiens
aaggccugcacaca

SEQ ID NO: 1196372 - RNA, 15 nt, Homo sapiens
aaggccuuaagcuuu

SEQ ID NO: 1196373 - RNA, 22 nt, Homo sapiens
aaggcgguacuaguucagacac

SEQ ID NO: 1196374 - RNA, 22 nt, Homo sapiens
aaggcucccggaauuccgucac

SEQ ID NO: 1196375 - RNA, 23 nt, Homo sapiens
aaggcucccggaauuccgucacc

SEQ ID NO: 1196376 - RNA, 15 nt, Homo sapiens
aaggcuugaagcugu

SEQ ID NO: 1196377 - RNA, 21 nt, Homo sapiens
aaggcuuuuugguguauagaa

SEQ ID NO: 1196378 - RNA, 20 nt, Homo sapiens
aagggaagaaggggccauca

SEQ ID NO: 1196379 - RNA, 21 nt, Homo sapiens
aagggagaagggugguaaaua

SEQ ID NO: 1196380 - RNA, 13 nt, Homo sapiens
aagggagugcaug

SEQ ID NO: 1196381 - RNA, 20 nt, Homo sapiens
aagggaguggccucauuuca

SEQ ID NO: 1196382 - RNA, 20 nt, Homo sapiens
aagggauugguuuggcaaga

SEQ ID NO: 1196383 - RNA, 23 nt, Homo sapiens
aagggauuugaggugaggguugg

SEQ ID NO: 1196384 - RNA, 12 nt, Homo sapiens
aagggcucucuu

SEQ ID NO: 1196385 - RNA, 16 nt, Homo sapiens
aaggggcacugguggc

SEQ ID NO: 1196386 - RNA, 16 nt, Homo sapiens
aagggugacuuuucau

SEQ ID NO: 1196387 - RNA, 19 nt, Homo sapiens
aaggguggaggguaaucuc

SEQ ID NO: 1196388 - RNA, 16 nt, Homo sapiens
aagggugggugcucag

SEQ ID NO: 1196389 - RNA, 13 nt, Homo sapiens
aaggguugagcug

SEQ ID NO: 1196390 - RNA, 13 nt, Homo sapiens
aagguacacuggu

SEQ ID NO: 1196391 - RNA, 22 nt, Homo sapiens
aagguaccccgauggccaagca

SEQ ID NO: 1196392 - RNA, 17 nt, Homo sapiens
aagguaguaacuuucca

SEQ ID NO: 1196393 - RNA, 22 nt, Homo sapiens
aagguauuuuguaauauucucu

SEQ ID NO: 1196394 - RNA, 18 nt, Homo sapiens
aaggucaagggaaaaccc

SEQ ID NO: 1196395 - RNA, 21 nt, Homo sapiens
aagguccacucccugcuccac

SEQ ID NO: 1196396 - RNA, 16 nt, Homo sapiens
aaggucccuuguuucc

SEQ ID NO: 1196397 - RNA, 18 nt, Homo sapiens
aaggucucauucuuccaa

SEQ ID NO: 1196398 - RNA, 14 nt, Homo sapiens
aaggugaaccaaag

SEQ ID NO: 1196399 - RNA, 16 nt, Homo sapiens
aaggugaugugauuca

SEQ ID NO: 1196400 - RNA, 14 nt, Homo sapiens
aaggugcuacuuga

SEQ ID NO: 1196401 - RNA, 21 nt, Homo sapiens
aaggugcuuuguaauauucuc

SEQ ID NO: 1196402 - RNA, 14 nt, Homo sapiens
aagguggaaaaugg

SEQ ID NO: 1196403 - RNA, 15 nt, Homo sapiens
aagguggacuuccag

SEQ ID NO: 1196404 - RNA, 14 nt, Homo sapiens
aagguggaugccaa

SEQ ID NO: 1196405 - RNA, 21 nt, Homo sapiens
aagguggauuuuaaaaauugg

SEQ ID NO: 1196406 - RNA, 12 nt, Homo sapiens
aauuaacuugag

SEQ ID NO: 1196407 - RNA, 19 nt, Homo sapiens
aauuaagacuugugcauga

SEQ ID NO: 1196408 - RNA, 14 nt, Homo sapiens
aauuaagacuuuau

SEQ ID NO: 1196409 - RNA, 15 nt, Homo sapiens
aauuaagauuaugug

SEQ ID NO: 1196410 - RNA, 16 nt, Homo sapiens
aauuaagauuauguga

SEQ ID NO: 1196411 - RNA, 18 nt, Homo sapiens
aauuaaguaaaccaaaaa

SEQ ID NO: 1196412 - RNA, 13 nt, Homo sapiens
aauuaauacauca

SEQ ID NO: 1196413 - RNA, 15 nt, Homo sapiens
aauuacaacagugag

SEQ ID NO: 1196414 - RNA, 13 nt, Homo sapiens
aauuacaguuaaa

SEQ ID NO: 1196415 - RNA, 19 nt, Homo sapiens
aauuacaguuaaagaagca

SEQ ID NO: 1196416 - RNA, 16 nt, Homo sapiens
aauuacauaguccagu

SEQ ID NO: 1196417 - RNA, 14 nt, Homo sapiens
aauuacguaugcaa

SEQ ID NO: 1196418 - RNA, 22 nt, Homo sapiens
aauuagaauaguguucugcaaa

SEQ ID NO: 1196419 - RNA, 23 nt, Homo sapiens
aauuagaucgguucugugccuuu

SEQ ID NO: 1196420 - RNA, 13 nt, Homo sapiens
aauuagaugaacu

SEQ ID NO: 1196421 - RNA, 12 nt, Homo sapiens
aauuagcaauug

SEQ ID NO: 1196422 - RNA, 12 nt, Homo sapiens
aauuaguucucc

SEQ ID NO: 1196423 - RNA, 20 nt, Homo sapiens
aauuauaagcauacaacugg

SEQ ID NO: 1196424 - RNA, 16 nt, Homo sapiens
aauuauacuacuuugu

SEQ ID NO: 1196425 - RNA, 20 nt, Homo sapiens
aauuauagaguaucacuccc

SEQ ID NO: 1196426 - RNA, 13 nt, Homo sapiens
aauuaugcuucca

SEQ ID NO: 1196427 - RNA, 20 nt, Homo sapiens
aauuauguaauauauuguac

SEQ ID NO: 1196428 - RNA, 16 nt, Homo sapiens
aauuaugugcauauua

SEQ ID NO: 1196429 - RNA, 22 nt, Homo sapiens
aauuauuauauacauacugcau

SEQ ID NO: 1196430 - RNA, 16 nt, Homo sapiens
aauuauuucugucaca

SEQ ID NO: 1196431 - RNA, 16 nt, Homo sapiens
aauuauuuugguacuu

SEQ ID NO: 1196432 - RNA, 19 nt, Homo sapiens
aauucaaaaguuccaagag

SEQ ID NO: 1196433 - RNA, 14 nt, Homo sapiens
aauucaaacugggg

SEQ ID NO: 1196434 - RNA, 12 nt, Homo sapiens
aauucaaccacu

SEQ ID NO: 1196435 - RNA, 13 nt, Homo sapiens
aauucaacuuugu

SEQ ID NO: 1196436 - RNA, 16 nt, Homo sapiens
aauucaccgugaaaua

SEQ ID NO: 1196437 - RNA, 22 nt, Homo sapiens
aauucacucaagcacugauauc

SEQ ID NO: 1196438 - RNA, 13 nt, Homo sapiens
aauucagcacuga

SEQ ID NO: 1196439 - RNA, 19 nt, Homo sapiens
aauucagcacugauuucac

SEQ ID NO: 1196440 - RNA, 12 nt, Homo sapiens
aauucaucugaa

SEQ ID NO: 1196441 - RNA, 15 nt, Homo sapiens
aauucauucauuuca

SEQ ID NO: 1196442 - RNA, 16 nt, Homo sapiens
aauucauucauuucau

SEQ ID NO: 1196443 - RNA, 14 nt, Homo sapiens
aauuccaaagccag

SEQ ID NO: 1196444 - RNA, 13 nt, Homo sapiens
aauuccaauauga

SEQ ID NO: 1196445 - RNA, 21 nt, Homo sapiens
aauuccuacaacuuaauggaa

SEQ ID NO: 1196446 - RNA, 22 nt, Homo sapiens
aauuccuauauccugugacugu

SEQ ID NO: 1196447 - RNA, 15 nt, Homo sapiens
aauuccuugcacaua

SEQ ID NO: 1196448 - RNA, 19 nt, Homo sapiens
aauuccuugccccacaguu

SEQ ID NO: 1196449 - RNA, 13 nt, Homo sapiens
aauuccuuugugu

SEQ ID NO: 1196450 - RNA, 14 nt, Homo sapiens
aauucgcuguuacc

SEQ ID NO: 1196451 - RNA, 19 nt, Homo sapiens
aauucgugauuuucaagca

SEQ ID NO: 1196452 - RNA, 22 nt, Homo sapiens
aauucuaaaauacaaacccaug

SEQ ID NO: 1196453 - RNA, 18 nt, Homo sapiens
aauucuaaagagcacuua

SEQ ID NO: 1196454 - RNA, 19 nt, Homo sapiens
aauucuaaagagcacuuac

SEQ ID NO: 1196455 - RNA, 16 nt, Homo sapiens
aauucuaacaagucau

SEQ ID NO: 1196456 - RNA, 13 nt, Homo sapiens
aauucuacuuuga

SEQ ID NO: 1196457 - RNA, 15 nt, Homo sapiens
aauucuagagccagc

SEQ ID NO: 1196458 - RNA, 21 nt, Homo sapiens
aauucuauaggaacauaugaa

SEQ ID NO: 1196459 - RNA, 22 nt, Homo sapiens
aauucucagucaguaauugcca

SEQ ID NO: 1196460 - RNA, 16 nt, Homo sapiens
aauucuccugccuuag

SEQ ID NO: 1196461 - RNA, 23 nt, Homo sapiens
aauucucucacaaaguccacuuu

SEQ ID NO: 1196462 - RNA, 19 nt, Homo sapiens
aauucugaauuaagcacag

SEQ ID NO: 1196463 - RNA, 20 nt, Homo sapiens
aauucuggaaacuccugaca

SEQ ID NO: 1196464 - RNA, 11 nt, Homo sapiens
aauucugugac

SEQ ID NO: 1196465 - RNA, 22 nt, Homo sapiens
aauucuuaaccuggaacuggag

SEQ ID NO: 1196466 - RNA, 21 nt, Homo sapiens
aauucuuacacugccuguaua

SEQ ID NO: 1196467 - RNA, 18 nt, Homo sapiens
aauucuuccuuagacuua

SEQ ID NO: 1196468 - RNA, 22 nt, Homo sapiens
aauucuucuguccugagaagca

SEQ ID NO: 1196469 - RNA, 16 nt, Homo sapiens
aauugaaauaaaugau

SEQ ID NO: 1196470 - RNA, 20 nt, Homo sapiens
aauugaagaaagucagcucu

SEQ ID NO: 1196471 - RNA, 13 nt, Homo sapiens
aauugacuugcaa

SEQ ID NO: 1196472 - RNA, 23 nt, Homo sapiens
aauugaguugcacuuauugacca

SEQ ID NO: 1196473 - RNA, 13 nt, Homo sapiens
aauugauuauucu

SEQ ID NO: 1196474 - RNA, 21 nt, Homo sapiens
aauugauuauucugauuccac

SEQ ID NO: 1196475 - RNA, 21 nt, Homo sapiens
aauugauucuuagacauugca

SEQ ID NO: 1196476 - RNA, 20 nt, Homo sapiens
aauugauuucuuuucuuccu

SEQ ID NO: 1196477 - RNA, 12 nt, Homo sapiens
aauugcaauaca

SEQ ID NO: 1196478 - RNA, 18 nt, Homo sapiens
aauugcaauacauuucaa

SEQ ID NO: 1196479 - RNA, 16 nt, Homo sapiens
aauugcaugacuugua

SEQ ID NO: 1196480 - RNA, 10 nt, Homo sapiens
aauugcucaa

SEQ ID NO: 1196481 - RNA, 11 nt, Homo sapiens
aauugcucaag

SEQ ID NO: 1196482 - RNA, 14 nt, Homo sapiens
aauugcucagagaa

SEQ ID NO: 1196483 - RNA, 19 nt, Homo sapiens
aauuggcucuagucacugg

SEQ ID NO: 1196484 - RNA, 22 nt, Homo sapiens
aauugguaaaacucacugugau

SEQ ID NO: 1196485 - RNA, 19 nt, Homo sapiens
aauuguaaacuguacuagu

SEQ ID NO: 1196486 - RNA, 19 nt, Homo sapiens
aauuguacaaaauuaagca

SEQ ID NO: 1196487 - RNA, 23 nt, Homo sapiens
aauuguauuauaauucauuguga

SEQ ID NO: 1196488 - RNA, 21 nt, Homo sapiens
aauugucauuuauaaaaccau

SEQ ID NO: 1196489 - RNA, 13 nt, Homo sapiens
aauuguccguguu

SEQ ID NO: 1196490 - RNA, 21 nt, Homo sapiens
aauugugagcgaauuagcaau

SEQ ID NO: 1196491 - RNA, 17 nt, Homo sapiens
aauugugaucagaccau

SEQ ID NO: 1196492 - RNA, 16 nt, Homo sapiens
aauugugcaguacuuu

SEQ ID NO: 1196493 - RNA, 19 nt, Homo sapiens
aauuguuaaguuaagcuuu

SEQ ID NO: 1196494 - RNA, 17 nt, Homo sapiens
aauuguuagcuauuuau

SEQ ID NO: 1196495 - RNA, 19 nt, Homo sapiens
aauuguuucuugacaagcu

SEQ ID NO: 1196496 - RNA, 20 nt, Homo sapiens
aauuguuuuuuaaagcaagu

SEQ ID NO: 1196497 - RNA, 22 nt, Homo sapiens
aauuguuuuuuaaagcaaguca

SEQ ID NO: 1196498 - RNA, 12 nt, Homo sapiens
aauuuaacaaac

SEQ ID NO: 1196499 - RNA, 13 nt, Homo sapiens
aauuuaacugugu

SEQ ID NO: 1196500 - RNA, 20 nt, Homo sapiens
aauuuaauacagacaucuaa

SEQ ID NO: 1196501 - RNA, 17 nt, Homo sapiens
aauuuaaucacuuucau

SEQ ID NO: 1196502 - RNA, 20 nt, Homo sapiens
aauuuaaugaaaagguacaa

SEQ ID NO: 1196503 - RNA, 14 nt, Homo sapiens
aauuuacacugcca

SEQ ID NO: 1196504 - RNA, 17 nt, Homo sapiens
aauuuacccauuucuau

SEQ ID NO: 1196505 - RNA, 12 nt, Homo sapiens
aauuuagcucuc

SEQ ID NO: 1196506 - RNA, 22 nt, Homo sapiens
aauuuagugaucuuagcauagc

SEQ ID NO: 1196507 - RNA, 22 nt, Homo sapiens
aauuuauaguuaaggcuaaaaa

SEQ ID NO: 1196508 - RNA, 20 nt, Homo sapiens
aauuuaucaaacccuagccu

SEQ ID NO: 1196509 - RNA, 20 nt, Homo sapiens
aauuuaugaagcagauuuau

SEQ ID NO: 1196510 - RNA, 11 nt, Homo sapiens
aauuuaugcaa

SEQ ID NO: 1196511 - RNA, 19 nt, Homo sapiens
aauuuaugcauuucauuca

SEQ ID NO: 1196512 - RNA, 18 nt, Homo sapiens
aauuuauuaaucuaaaaa

SEQ ID NO: 1196513 - RNA, 16 nt, Homo sapiens
aauuuauuacugaaaa

SEQ ID NO: 1196514 - RNA, 22 nt, Homo sapiens
aauuuauuuauuaagauggauu

SEQ ID NO: 1196515 - RNA, 20 nt, Homo sapiens
aauuuauuucaaaaagggaa

SEQ ID NO: 1196516 - RNA, 20 nt, Homo sapiens
aauuucaccaccaaaugcca

SEQ ID NO: 1196517 - RNA, 15 nt, Homo sapiens
aauuucaguaaacaa

SEQ ID NO: 1196518 - RNA, 20 nt, Homo sapiens
aauuucaguaaacaaugaau

SEQ ID NO: 1196519 - RNA, 11 nt, Homo sapiens
aauuuccacua

SEQ ID NO: 1196520 - RNA, 22 nt, Homo sapiens
aauuuccugaugcauauugccc

SEQ ID NO: 1196521 - RNA, 18 nt, Homo sapiens
aauuucgguuauagcuua

SEQ ID NO: 1196522 - RNA, 21 nt, Homo sapiens
aauuucuacuucuggaaguca

SEQ ID NO: 1196523 - RNA, 19 nt, Homo sapiens
aauuucucuuuaaaaccau

SEQ ID NO: 1196524 - RNA, 21 nt, Homo sapiens
aauuucugugaaaccugugaa

SEQ ID NO: 1196525 - RNA, 14 nt, Homo sapiens
aauuugaauguggu

SEQ ID NO: 1196526 - RNA, 13 nt, Homo sapiens
aauuugacauaca

SEQ ID NO: 1196527 - RNA, 18 nt, Homo sapiens
aauuugagauucuacagu

SEQ ID NO: 1196528 - RNA, 23 nt, Homo sapiens
aauuugaggacaagauaccaagg

SEQ ID NO: 1196529 - RNA, 12 nt, Homo sapiens
aauuugaugaaa

SEQ ID NO: 1196530 - RNA, 13 nt, Homo sapiens
aauuuuaauugaa

SEQ ID NO: 1196531 - RNA, 23 nt, Homo sapiens
aauuuuagaugccugugaaauag

SEQ ID NO: 1196532 - RNA, 18 nt, Homo sapiens
agaaaaccucaccaacug

SEQ ID NO: 1196533 - RNA, 18 nt, Homo sapiens
agaaaaccuguucaggca

SEQ ID NO: 1196534 - RNA, 23 nt, Homo sapiens
agaaaacucugguaaaugaucac

SEQ ID NO: 1196535 - RNA, 19 nt, Homo sapiens
agaaaagauuauauauuau

SEQ ID NO: 1196536 - RNA, 19 nt, Homo sapiens
agaaaagcaauacuguuuc

SEQ ID NO: 1196537 - RNA, 13 nt, Homo sapiens
agaaaagcccauu

SEQ ID NO: 1196538 - RNA, 20 nt, Homo sapiens
agaaaaggcagcuaaaggaa

SEQ ID NO: 1196539 - RNA, 20 nt, Homo sapiens
agaaaaggccuucuucccaa

SEQ ID NO: 1196540 - RNA, 21 nt, Homo sapiens
agaaaauaguuuggauuacuu

SEQ ID NO: 1196541 - RNA, 19 nt, Homo sapiens
agaaaaucaaauauauaac

SEQ ID NO: 1196542 - RNA, 16 nt, Homo sapiens
agaaaaugcagucauu

SEQ ID NO: 1196543 - RNA, 22 nt, Homo sapiens
agaaaauguucuguuugcugug

SEQ ID NO: 1196544 - RNA, 22 nt, Homo sapiens
agaaaauguugagaaucccaaa

SEQ ID NO: 1196545 - RNA, 12 nt, Homo sapiens
agaaacacacag

SEQ ID NO: 1196546 - RNA, 15 nt, Homo sapiens
agaaacacacaguca

SEQ ID NO: 1196547 - RNA, 17 nt, Homo sapiens
agaaacacacagucaca

SEQ ID NO: 1196548 - RNA, 11 nt, Homo sapiens
agaaacacagg

SEQ ID NO: 1196549 - RNA, 17 nt, Homo sapiens
agaaacacguggucaug

SEQ ID NO: 1196550 - RNA, 12 nt, Homo sapiens
agaaacaugcca

SEQ ID NO: 1196551 - RNA, 15 nt, Homo sapiens
agaaaccacuagaaa

SEQ ID NO: 1196552 - RNA, 12 nt, Homo sapiens
agaaacccaagc

SEQ ID NO: 1196553 - RNA, 23 nt, Homo sapiens
agaaaccuauauuucaauacugc

SEQ ID NO: 1196554 - RNA, 20 nt, Homo sapiens
agaaaccuuauuguaccucu

SEQ ID NO: 1196555 - RNA, 21 nt, Homo sapiens
agaaacuagaaaugugaauga

SEQ ID NO: 1196556 - RNA, 19 nt, Homo sapiens
agaaacucaaaaauauuug

SEQ ID NO: 1196557 - RNA, 19 nt, Homo sapiens
agaaacuccaaaguccaca

SEQ ID NO: 1196558 - RNA, 16 nt, Homo sapiens
agaaacuugcuuauca

SEQ ID NO: 1196559 - RNA, 16 nt, Homo sapiens
agaaacuuugugcuac

SEQ ID NO: 1196560 - RNA, 19 nt, Homo sapiens
agaaagagacuccgucuca

SEQ ID NO: 1196561 - RNA, 14 nt, Homo sapiens
agaaagaucaaaga

SEQ ID NO: 1196562 - RNA, 12 nt, Homo sapiens
agaaagcaaaag

SEQ ID NO: 1196563 - RNA, 20 nt, Homo sapiens
agaaagccuucauaagccua

SEQ ID NO: 1196564 - RNA, 13 nt, Homo sapiens
agaaagcuaaaau

SEQ ID NO: 1196565 - RNA, 20 nt, Homo sapiens
agaaagcugcacuggugcua

SEQ ID NO: 1196566 - RNA, 14 nt, Homo sapiens
agaaaggaaccugg

SEQ ID NO: 1196567 - RNA, 23 nt, Homo sapiens
agaaagggguggaaacauaggga

SEQ ID NO: 1196568 - RNA, 15 nt, Homo sapiens
agaaaggguuccaaa

SEQ ID NO: 1196569 - RNA, 18 nt, Homo sapiens
agaaaguaaaaaguugcu

SEQ ID NO: 1196570 - RNA, 17 nt, Homo sapiens
agaaaguggcuugaaau

SEQ ID NO: 1196571 - RNA, 20 nt, Homo sapiens
agaaagugggugagaugcug

SEQ ID NO: 1196572 - RNA, 17 nt, Homo sapiens
agaaauacuuucaggca

SEQ ID NO: 1196573 - RNA, 14 nt, Homo sapiens
agaaauagaauuau

SEQ ID NO: 1196574 - RNA, 15 nt, Homo sapiens
agaaauauauauaac

SEQ ID NO: 1196575 - RNA, 16 nt, Homo sapiens
agaaauauauauacau

SEQ ID NO: 1196576 - RNA, 14 nt, Homo sapiens
agaaauauggacac

SEQ ID NO: 1196577 - RNA, 23 nt, Homo sapiens
agaaaucauaguuuaaacugcau

SEQ ID NO: 1196578 - RNA, 14 nt, Homo sapiens
agaaauccauaucu

SEQ ID NO: 1196579 - RNA, 16 nt, Homo sapiens
agaaaucuaagcugug

SEQ ID NO: 1196580 - RNA, 14 nt, Homo sapiens
agaaaugaacauuc

SEQ ID NO: 1196581 - RNA, 18 nt, Homo sapiens
agaaaugaugauguggaa

SEQ ID NO: 1196582 - RNA, 11 nt, Homo sapiens
agaaaugcaaa

SEQ ID NO: 1196583 - RNA, 20 nt, Homo sapiens
agaaauggacuggagcucau

SEQ ID NO: 1196584 - RNA, 12 nt, Homo sapiens
agaaaugucuaa

SEQ ID NO: 1196585 - RNA, 17 nt, Homo sapiens
agaaauuaaaucugaau

SEQ ID NO: 1196586 - RNA, 14 nt, Homo sapiens
agaaauuaguuuca

SEQ ID NO: 1196587 - RNA, 23 nt, Homo sapiens
agaaauuaguuucaaauuuaccu

SEQ ID NO: 1196588 - RNA, 15 nt, Homo sapiens
agaaauugcaauaac

SEQ ID NO: 1196589 - RNA, 13 nt, Homo sapiens
agaaauuguuaag

SEQ ID NO: 1196590 - RNA, 23 nt, Homo sapiens
agaacaaaaagaaaucuugucuu

SEQ ID NO: 1196591 - RNA, 20 nt, Homo sapiens
agaacaaaagcgacccauuc

SEQ ID NO: 1196592 - RNA, 15 nt, Homo sapiens
agaacaaacaccucc

SEQ ID NO: 1196593 - RNA, 16 nt, Homo sapiens
agaacaaacucugaaa

SEQ ID NO: 1196594 - RNA, 20 nt, Homo sapiens
agaacaagaccccgucucaa

SEQ ID NO: 1196595 - RNA, 20 nt, Homo sapiens
agaacacaugugcagucacu

SEQ ID NO: 1196596 - RNA, 17 nt, Homo sapiens
agaacagguucuuaaaa

SEQ ID NO: 1196597 - RNA, 17 nt, Homo sapiens
agaacauggacuuguau

SEQ ID NO: 1196598 - RNA, 12 nt, Homo sapiens
agaacauuuuaa

SEQ ID NO: 1196599 - RNA, 16 nt, Homo sapiens
agaacauuuuaauuca

SEQ ID NO: 1196600 - RNA, 23 nt, Homo sapiens
agaaccauccauaguaguaugau

SEQ ID NO: 1196601 - RNA, 15 nt, Homo sapiens
agaaccauuuacuua

SEQ ID NO: 1196602 - RNA, 23 nt, Homo sapiens
agaaccauuugcaauauggauuu

SEQ ID NO: 1196603 - RNA, 15 nt, Homo sapiens
agaacccagauuucc

SEQ ID NO: 1196604 - RNA, 13 nt, Homo sapiens
agaaccucuccau

SEQ ID NO: 1196605 - RNA, 14 nt, Homo sapiens
agaaccugggcugu

SEQ ID NO: 1196606 - RNA, 16 nt, Homo sapiens
agaacgguuuuuggau

SEQ ID NO: 1196607 - RNA, 19 nt, Homo sapiens
agaacguuuuuuccucagu

SEQ ID NO: 1196608 - RNA, 23 nt, Homo sapiens
agaacguuuuuuccucagugcau

SEQ ID NO: 1196609 - RNA, 15 nt, Homo sapiens
agaacucacuggggc

SEQ ID NO: 1196610 - RNA, 22 nt, Homo sapiens
agaacucagcuguccagcugca

SEQ ID NO: 1196611 - RNA, 14 nt, Homo sapiens
agaacugcagucag

SEQ ID NO: 1196612 - RNA, 12 nt, Homo sapiens
agaacuggguaa

SEQ ID NO: 1196613 - RNA, 23 nt, Homo sapiens
agaacugucuauuuucucaguca

SEQ ID NO: 1196614 - RNA, 14 nt, Homo sapiens
agaacugucuguga

SEQ ID NO: 1196615 - RNA, 20 nt, Homo sapiens
agaacuuccccucccuuccc

SEQ ID NO: 1196616 - RNA, 14 nt, Homo sapiens
agaacuugaaugug

SEQ ID NO: 1196617 - RNA, 17 nt, Homo sapiens
agaacuuuucgacauau

SEQ ID NO: 1196618 - RNA, 18 nt, Homo sapiens
agaacuuuucgacauauu

SEQ ID NO: 1196619 - RNA, 17 nt, Homo sapiens
agaagaacauccaagga

SEQ ID NO: 1196620 - RNA, 13 nt, Homo sapiens
agaagacucugac

SEQ ID NO: 1196621 - RNA, 20 nt, Homo sapiens
agaagagaugcacuauaugu

SEQ ID NO: 1196622 - RNA, 13 nt, Homo sapiens
agaagaugaucag

SEQ ID NO: 1196623 - RNA, 13 nt, Homo sapiens
agaagcaagacac

SEQ ID NO: 1196624 - RNA, 13 nt, Homo sapiens
agaagcacuacac

SEQ ID NO: 1196625 - RNA, 20 nt, Homo sapiens
agaagcacuuugauugaagu

SEQ ID NO: 1196626 - RNA, 22 nt, Homo sapiens
agaagcagccaucacaugaucu

SEQ ID NO: 1196627 - RNA, 20 nt, Homo sapiens
agaagcccagguuacaaaga

SEQ ID NO: 1196628 - RNA, 14 nt, Homo sapiens
agaagcucaucuca

SEQ ID NO: 1196629 - RNA, 16 nt, Homo sapiens
agaagcugucagggac

SEQ ID NO: 1196630 - RNA, 12 nt, Homo sapiens
agaagcuuccau

SEQ ID NO: 1196631 - RNA, 16 nt, Homo sapiens
agaaggaaucuucuca

SEQ ID NO: 1196632 - RNA, 16 nt, Homo sapiens
agaaggagccuuguug

SEQ ID NO: 1196633 - RNA, 22 nt, Homo sapiens
agaaggcagugauuagcacuug

SEQ ID NO: 1196634 - RNA, 16 nt, Homo sapiens
agaagggauaacccua

SEQ ID NO: 1196635 - RNA, 15 nt, Homo sapiens
agaaggugcuuugua

SEQ ID NO: 1196636 - RNA, 24 nt, Homo sapiens
agaaguauuuucuaguucugguca

SEQ ID NO: 1196637 - RNA, 14 nt, Homo sapiens
agaagucaacgccu

SEQ ID NO: 1196638 - RNA, 23 nt, Homo sapiens
agaagugaaacuauauguauuca

SEQ ID NO: 1196639 - RNA, 22 nt, Homo sapiens
agaaguguuugauggugccaga

SEQ ID NO: 1196640 - RNA, 13 nt, Homo sapiens
agaaguuccucaa

SEQ ID NO: 1196641 - RNA, 22 nt, Homo sapiens
agaaguucucaaaguuaauuca

SEQ ID NO: 1196642 - RNA, 22 nt, Homo sapiens
agaaguucuggcugaacacugg

SEQ ID NO: 1196643 - RNA, 18 nt, Homo sapiens
agaaguuuguagccaggu

SEQ ID NO: 1196644 - RNA, 19 nt, Homo sapiens
agaaguuuuuguacuguaa

SEQ ID NO: 1196645 - RNA, 19 nt, Homo sapiens
agaauaauggaaacauuac

SEQ ID NO: 1196646 - RNA, 12 nt, Homo sapiens
agaauaaugugu

SEQ ID NO: 1196647 - RNA, 18 nt, Homo sapiens
agaauacaguaagcugcu

SEQ ID NO: 1196648 - RNA, 13 nt, Homo sapiens
agaauagucucac

SEQ ID NO: 1196649 - RNA, 15 nt, Homo sapiens
agaauauauuuccuu

SEQ ID NO: 1196650 - RNA, 19 nt, Homo sapiens
agaauauuuauuaccucug

SEQ ID NO: 1196651 - RNA, 20 nt, Homo sapiens
agaaucagucuauccacaga

SEQ ID NO: 1196652 - RNA, 14 nt, Homo sapiens
agaaucucaaauaa

SEQ ID NO: 1196653 - RNA, 14 nt, Homo sapiens
agaaucugcagcua

SEQ ID NO: 1196654 - RNA, 16 nt, Homo sapiens
agaaugaaauguaugu

SEQ ID NO: 1196655 - RNA, 18 nt, Homo sapiens
agaaugaaauguaugugc

SEQ ID NO: 1196656 - RNA, 15 nt, Homo sapiens
agaaugaacacuccc

SEQ ID NO: 1196657 - RNA, 14 nt, Homo sapiens
agaaugaguuauga

SEQ ID NO: 1196658 - RNA, 22 nt, Homo sapiens
agagguggagugucacaucucu

SEQ ID NO: 1196659 - RNA, 18 nt, Homo sapiens
agagguuaaggugcaaua

SEQ ID NO: 1196660 - RNA, 14 nt, Homo sapiens
agagguugcaguga

SEQ ID NO: 1196661 - RNA, 19 nt, Homo sapiens
agagguuuagacagcagua

SEQ ID NO: 1196662 - RNA, 16 nt, Homo sapiens
agaguaaaaacugaau

SEQ ID NO: 1196663 - RNA, 20 nt, Homo sapiens
agaguauaugcacuuuccaa

SEQ ID NO: 1196664 - RNA, 21 nt, Homo sapiens
agagucauauugcccaguggu

SEQ ID NO: 1196665 - RNA, 12 nt, Homo sapiens
agagucaucuga

SEQ ID NO: 1196666 - RNA, 17 nt, Homo sapiens
agaguccacuguggcac

SEQ ID NO: 1196667 - RNA, 14 nt, Homo sapiens
agagucccacugcc

SEQ ID NO: 1196668 - RNA, 22 nt, Homo sapiens
agagucuaauagucuuugccag

SEQ ID NO: 1196669 - RNA, 12 nt, Homo sapiens
agagucugagaa

SEQ ID NO: 1196670 - RNA, 20 nt, Homo sapiens
agagucuuguuuuuuauuca

SEQ ID NO: 1196671 - RNA, 18 nt, Homo sapiens
agagugaaaccaugacug

SEQ ID NO: 1196672 - RNA, 16 nt, Homo sapiens
agagugaaauaauuaa

SEQ ID NO: 1196673 - RNA, 20 nt, Homo sapiens
agagugagacucugucucaa

SEQ ID NO: 1196674 - RNA, 10 nt, Homo sapiens
agagugccac

SEQ ID NO: 1196675 - RNA, 23 nt, Homo sapiens
agagugccguaacaacugugguc

SEQ ID NO: 1196676 - RNA, 14 nt, Homo sapiens
agagugguuuccaa

SEQ ID NO: 1196677 - RNA, 20 nt, Homo sapiens
agagugucucagggugcaga

SEQ ID NO: 1196678 - RNA, 16 nt, Homo sapiens
agaguguuucuuccac

SEQ ID NO: 1196679 - RNA, 15 nt, Homo sapiens
agaguuacaguucug

SEQ ID NO: 1196680 - RNA, 15 nt, Homo sapiens
agaguucugcucuag

SEQ ID NO: 1196681 - RNA, 16 nt, Homo sapiens
agaguuguacacugug

SEQ ID NO: 1196682 - RNA, 14 nt, Homo sapiens
agaguuugucauua

SEQ ID NO: 1196683 - RNA, 18 nt, Homo sapiens
agaguuuguguguugucu

SEQ ID NO: 1196684 - RNA, 13 nt, Homo sapiens
agauaaagaccuu

SEQ ID NO: 1196685 - RNA, 18 nt, Homo sapiens
agauaaccuguacuucaa

SEQ ID NO: 1196686 - RNA, 13 nt, Homo sapiens
agauaacucuccu

SEQ ID NO: 1196687 - RNA, 17 nt, Homo sapiens
agauaagaaaugaucuu

SEQ ID NO: 1196688 - RNA, 12 nt, Homo sapiens
agauaaucagug

SEQ ID NO: 1196689 - RNA, 17 nt, Homo sapiens
agauaauuauaauauac

SEQ ID NO: 1196690 - RNA, 15 nt, Homo sapiens
agauaauugcuauuu

SEQ ID NO: 1196691 - RNA, 13 nt, Homo sapiens
agauaauuugcau

SEQ ID NO: 1196692 - RNA, 17 nt, Homo sapiens
agauaauuugcauauuc

SEQ ID NO: 1196693 - RNA, 13 nt, Homo sapiens
agauacaaacugc

SEQ ID NO: 1196694 - RNA, 17 nt, Homo sapiens
agauaccaggcacuuaa

SEQ ID NO: 1196695 - RNA, 17 nt, Homo sapiens
agauagagauuaaguca

SEQ ID NO: 1196696 - RNA, 14 nt, Homo sapiens
agauagauuuggaa

SEQ ID NO: 1196697 - RNA, 18 nt, Homo sapiens
agauagcaccauugcacu

SEQ ID NO: 1196698 - RNA, 14 nt, Homo sapiens
agauagcagggcau

SEQ ID NO: 1196699 - RNA, 15 nt, Homo sapiens
agauagguaaauacc

SEQ ID NO: 1196700 - RNA, 23 nt, Homo sapiens
agauauacauaucaaguauguug

SEQ ID NO: 1196701 - RNA, 23 nt, Homo sapiens
agauauaucccggaugaggcuga

SEQ ID NO: 1196702 - RNA, 13 nt, Homo sapiens
agauaugugaaga

SEQ ID NO: 1196703 - RNA, 17 nt, Homo sapiens
agauauuaaauucucaa

SEQ ID NO: 1196704 - RNA, 13 nt, Homo sapiens
agauauuaauaga

SEQ ID NO: 1196705 - RNA, 18 nt, Homo sapiens
agauauucagaaguauau

SEQ ID NO: 1196706 - RNA, 14 nt, Homo sapiens
agauauugauuacu

SEQ ID NO: 1196707 - RNA, 19 nt, Homo sapiens
agauauugugaaguacaua

SEQ ID NO: 1196708 - RNA, 17 nt, Homo sapiens
agauauuugguaccaug

SEQ ID NO: 1196709 - RNA, 19 nt, Homo sapiens
agauauuugguaccauggu

SEQ ID NO: 1196710 - RNA, 21 nt, Homo sapiens
agauauuugguaccauggugu

SEQ ID NO: 1196711 - RNA, 21 nt, Homo sapiens
agaucacaaagacagagacug

SEQ ID NO: 1196712 - RNA, 15 nt, Homo sapiens
agaucacgccacugc

SEQ ID NO: 1196713 - RNA, 13 nt, Homo sapiens
agaucacugugcu

SEQ ID NO: 1196714 - RNA, 20 nt, Homo sapiens
agaucacuuucucaguuuuc

SEQ ID NO: 1196715 - RNA, 19 nt, Homo sapiens
agaucagcgacccugagga

SEQ ID NO: 1196716 - RNA, 17 nt, Homo sapiens
agaucagcgacugccac

SEQ ID NO: 1196717 - RNA, 18 nt, Homo sapiens
agaucaugaaaguccagc

SEQ ID NO: 1196718 - RNA, 19 nt, Homo sapiens
agaucaugacauaugacuu

SEQ ID NO: 1196719 - RNA, 17 nt, Homo sapiens
agauccaagaggcccug

SEQ ID NO: 1196720 - RNA, 22 nt, Homo sapiens
agauccaguucuugaaaacacu

SEQ ID NO: 1196721 - RNA, 22 nt, Homo sapiens
agauccucaauaaacauuucau

SEQ ID NO: 1196722 - RNA, 17 nt, Homo sapiens
agauccuuaaugcagag

SEQ ID NO: 1196723 - RNA, 15 nt, Homo sapiens
agaucgcaccacugc

SEQ ID NO: 1196724 - RNA, 16 nt, Homo sapiens
agaucgcaccacugca

SEQ ID NO: 1196725 - RNA, 19 nt, Homo sapiens
agaucgcaccauugcacuc

SEQ ID NO: 1196726 - RNA, 16 nt, Homo sapiens
agaucggccacagggc

SEQ ID NO: 1196727 - RNA, 21 nt, Homo sapiens
agaucuaaggaugucacaggg

SEQ ID NO: 1196728 - RNA, 17 nt, Homo sapiens
agaucucgguuugccaa

SEQ ID NO: 1196729 - RNA, 19 nt, Homo sapiens
agaucugcacucaccucac

SEQ ID NO: 1196730 - RNA, 21 nt, Homo sapiens
agaucugcuugaucaauuccc

SEQ ID NO: 1196731 - RNA, 18 nt, Homo sapiens
agaucuggucccuugcag

SEQ ID NO: 1196732 - RNA, 15 nt, Homo sapiens
agaugacagggaaaa

SEQ ID NO: 1196733 - RNA, 19 nt, Homo sapiens
agaugacagggaaaacugc

SEQ ID NO: 1196734 - RNA, 22 nt, Homo sapiens
agaugacagggaaaacugcaaa

SEQ ID NO: 1196735 - RNA, 17 nt, Homo sapiens
agaugacgaguaacucc

SEQ ID NO: 1196736 - RNA, 18 nt, Homo sapiens
agaugacggaugccuaga

SEQ ID NO: 1196737 - RNA, 15 nt, Homo sapiens
agaugagaacaaagc

SEQ ID NO: 1196738 - RNA, 22 nt, Homo sapiens
agaugagaacaaagcuguuaaa

SEQ ID NO: 1196739 - RNA, 17 nt, Homo sapiens
agaugaggcacuggaag

SEQ ID NO: 1196740 - RNA, 14 nt, Homo sapiens
agaugagggggcca

SEQ ID NO: 1196741 - RNA, 16 nt, Homo sapiens
agaugagggugacugu

SEQ ID NO: 1196742 - RNA, 17 nt, Homo sapiens
agaugagugauccugcc

SEQ ID NO: 1196743 - RNA, 15 nt, Homo sapiens
agaugauacuuccaa

SEQ ID NO: 1196744 - RNA, 15 nt, Homo sapiens
agaugaucauuugcc

SEQ ID NO: 1196745 - RNA, 20 nt, Homo sapiens
agaugauuaaacagacuuua

SEQ ID NO: 1196746 - RNA, 15 nt, Homo sapiens
agaugauuguucaaa

SEQ ID NO: 1196747 - RNA, 14 nt, Homo sapiens
agaugauuugguca

SEQ ID NO: 1196748 - RNA, 19 nt, Homo sapiens
agaugcaaggaccaggacu

SEQ ID NO: 1196749 - RNA, 12 nt, Homo sapiens
agaugcacugaa

SEQ ID NO: 1196750 - RNA, 17 nt, Homo sapiens
agaugcaucacugggug

SEQ ID NO: 1196751 - RNA, 21 nt, Homo sapiens
agaugcaugacuuguguguga

SEQ ID NO: 1196752 - RNA, 14 nt, Homo sapiens
agaugccuacaacc

SEQ ID NO: 1196753 - RNA, 15 nt, Homo sapiens
agaugcuacuggacu

SEQ ID NO: 1196754 - RNA, 14 nt, Homo sapiens
agaugcuaguucau

SEQ ID NO: 1196755 - RNA, 20 nt, Homo sapiens
agaugcugacuguacuccuc

SEQ ID NO: 1196756 - RNA, 17 nt, Homo sapiens
agaugcuggacuugccu

SEQ ID NO: 1196757 - RNA, 16 nt, Homo sapiens
agaugcuggguuggug

SEQ ID NO: 1196758 - RNA, 15 nt, Homo sapiens
agauggaaugcugug

SEQ ID NO: 1196759 - RNA, 12 nt, Homo sapiens
agauggaguucu

SEQ ID NO: 1196760 - RNA, 21 nt, Homo sapiens
agauggaguucuugugccaua

SEQ ID NO: 1196761 - RNA, 12 nt, Homo sapiens
agauggauguaa

SEQ ID NO: 1196762 - RNA, 15 nt, Homo sapiens
agauggcaauuucac

SEQ ID NO: 1196763 - RNA, 18 nt, Homo sapiens
agaugggcagggccuagg

SEQ ID NO: 1196764 - RNA, 17 nt, Homo sapiens
agauggggcgagccagg

SEQ ID NO: 1196765 - RNA, 20 nt, Homo sapiens
agaugguaacagauuugcuc

SEQ ID NO: 1196766 - RNA, 15 nt, Homo sapiens
agauguaacauuccu

SEQ ID NO: 1196767 - RNA, 11 nt, Homo sapiens
agaugucaagc

SEQ ID NO: 1196768 - RNA, 21 nt, Homo sapiens
agaugucagcuucccagccau

SEQ ID NO: 1196769 - RNA, 23 nt, Homo sapiens
agaugucgcccuacucaccugag

SEQ ID NO: 1196770 - RNA, 18 nt, Homo sapiens
agaugucuagguacuuca

SEQ ID NO: 1196771 - RNA, 17 nt, Homo sapiens
agaugucucuggggcag

SEQ ID NO: 1196772 - RNA, 19 nt, Homo sapiens
agaugucuucugccuguua

SEQ ID NO: 1196773 - RNA, 17 nt, Homo sapiens
agaugugaucacugaga

SEQ ID NO: 1196774 - RNA, 13 nt, Homo sapiens
agaugugcaauug

SEQ ID NO: 1196775 - RNA, 19 nt, Homo sapiens
agauguguuaggaauguca

SEQ ID NO: 1196776 - RNA, 17 nt, Homo sapiens
agauguuguguggcaau

SEQ ID NO: 1196777 - RNA, 19 nt, Homo sapiens
agauguuugaggcuuucag

SEQ ID NO: 1196778 - RNA, 13 nt, Homo sapiens
agauuaauggcac

SEQ ID NO: 1196779 - RNA, 16 nt, Homo sapiens
agauuauaaacugacu

SEQ ID NO: 1196780 - RNA, 18 nt, Homo sapiens
agauuauauauuauuucu

SEQ ID NO: 1196781 - RNA, 22 nt, Homo sapiens
agauucaaggccccgagcuguu

SEQ ID NO: 1196782 - RNA, 22 nt, Homo sapiens
agauucagguauguugccuuua

SEQ ID NO: 1196783 - RNA, 22 nt, Homo sapiens
agauucauuauuuuuccacuuu

SEQ ID NO: 1196784 - RNA, 17 nt, Homo sapiens
aggaaaaaauuaauacu

SEQ ID NO: 1196785 - RNA, 19 nt, Homo sapiens
aggaaaaacacaagcaaaa

SEQ ID NO: 1196786 - RNA, 20 nt, Homo sapiens
aggaaaaaccaauagcuuua

SEQ ID NO: 1196787 - RNA, 16 nt, Homo sapiens
aggaaaaaugcugcuu

SEQ ID NO: 1196788 - RNA, 17 nt, Homo sapiens
aggaaaauaaacugaca

SEQ ID NO: 1196789 - RNA, 18 nt, Homo sapiens
aggaaaauaaaugaacau

SEQ ID NO: 1196790 - RNA, 17 nt, Homo sapiens
aggaaaaucacaucucc

SEQ ID NO: 1196791 - RNA, 18 nt, Homo sapiens
aggaaaaucaugugcuca

SEQ ID NO: 1196792 - RNA, 13 nt, Homo sapiens
aggaaaaugccuc

SEQ ID NO: 1196793 - RNA, 13 nt, Homo sapiens
aggaaacaauaua

SEQ ID NO: 1196794 - RNA, 21 nt, Homo sapiens
aggaaaccaacacccaaagca

SEQ ID NO: 1196795 - RNA, 15 nt, Homo sapiens
aggaaaccagagcuu

SEQ ID NO: 1196796 - RNA, 20 nt, Homo sapiens
aggaaacuccacaucugccu

SEQ ID NO: 1196797 - RNA, 22 nt, Homo sapiens
aggaaagagcuccaaauugaau

SEQ ID NO: 1196798 - RNA, 21 nt, Homo sapiens
aggaaagugauuuuuuuccac

SEQ ID NO: 1196799 - RNA, 13 nt, Homo sapiens
aggaaauaaagua

SEQ ID NO: 1196800 - RNA, 18 nt, Homo sapiens
aggaaauauauaugugug

SEQ ID NO: 1196801 - RNA, 16 nt, Homo sapiens
aggaaauaugagucau

SEQ ID NO: 1196802 - RNA, 16 nt, Homo sapiens
aggaaaucuacuuccu

SEQ ID NO: 1196803 - RNA, 19 nt, Homo sapiens
aggaacaagaauugcuaaa

SEQ ID NO: 1196804 - RNA, 21 nt, Homo sapiens
aggaacacaggcgcugaguau

SEQ ID NO: 1196805 - RNA, 24 nt, Homo sapiens
aggaacagaccugaggcuuaucuu

SEQ ID NO: 1196806 - RNA, 15 nt, Homo sapiens
aggaacuccuuggcc

SEQ ID NO: 1196807 - RNA, 22 nt, Homo sapiens
aggaacugggccaacucaccug

SEQ ID NO: 1196808 - RNA, 18 nt, Homo sapiens
aggaagaaaagcugccau

SEQ ID NO: 1196809 - RNA, 17 nt, Homo sapiens
aggaagaaaugucagau

SEQ ID NO: 1196810 - RNA, 15 nt, Homo sapiens
aggaagaaugaaacu

SEQ ID NO: 1196811 - RNA, 18 nt, Homo sapiens
aggaagaauuccugccau

SEQ ID NO: 1196812 - RNA, 14 nt, Homo sapiens
aggaagacgugugg

SEQ ID NO: 1196813 - RNA, 15 nt, Homo sapiens
aggaagagaaaugca

SEQ ID NO: 1196814 - RNA, 18 nt, Homo sapiens
aggaagcaccccaugcca

SEQ ID NO: 1196815 - RNA, 12 nt, Homo sapiens
aggaagcagcug

SEQ ID NO: 1196816 - RNA, 23 nt, Homo sapiens
aggaagcuguguugaaacagaaa

SEQ ID NO: 1196817 - RNA, 22 nt, Homo sapiens
aggaagcuuggggaacccauga

SEQ ID NO: 1196818 - RNA, 17 nt, Homo sapiens
aggaaggaaagcacagc

SEQ ID NO: 1196819 - RNA, 15 nt, Homo sapiens
aggaaggcagcugcu

SEQ ID NO: 1196820 - RNA, 17 nt, Homo sapiens
aggaaggucucauucuu

SEQ ID NO: 1196821 - RNA, 15 nt, Homo sapiens
aggaagguggugcuu

SEQ ID NO: 1196822 - RNA, 13 nt, Homo sapiens
aggaaguacugca

SEQ ID NO: 1196823 - RNA, 15 nt, Homo sapiens
aggaauaaaugccuu

SEQ ID NO: 1196824 - RNA, 13 nt, Homo sapiens
aggaaucauguca

SEQ ID NO: 1196825 - RNA, 18 nt, Homo sapiens
aggaauccccaacaugca

SEQ ID NO: 1196826 - RNA, 23 nt, Homo sapiens
aggaauccuggcagcccagagac

SEQ ID NO: 1196827 - RNA, 14 nt, Homo sapiens
aggaauugguuuca

SEQ ID NO: 1196828 - RNA, 21 nt, Homo sapiens
aggaauuuauaacaaauaugg

SEQ ID NO: 1196829 - RNA, 15 nt, Homo sapiens
aggaauuucugcucu

SEQ ID NO: 1196830 - RNA, 19 nt, Homo sapiens
aggaauuucuuaacuucuu

SEQ ID NO: 1196831 - RNA, 17 nt, Homo sapiens
aggacaaaaaaccucag

SEQ ID NO: 1196832 - RNA, 16 nt, Homo sapiens
aggacaaaacuucuug

SEQ ID NO: 1196833 - RNA, 18 nt, Homo sapiens
aggacaagaggagcauga

SEQ ID NO: 1196834 - RNA, 16 nt, Homo sapiens
aggacaagggcucaga

SEQ ID NO: 1196835 - RNA, 17 nt, Homo sapiens
aggacaagggcucagag

SEQ ID NO: 1196836 - RNA, 16 nt, Homo sapiens
aggacaccagccuggu

SEQ ID NO: 1196837 - RNA, 17 nt, Homo sapiens
aggacaccagccuggug

SEQ ID NO: 1196838 - RNA, 11 nt, Homo sapiens
aggacagccac

SEQ ID NO: 1196839 - RNA, 20 nt, Homo sapiens
aggacaggccacaccacagc

SEQ ID NO: 1196840 - RNA, 19 nt, Homo sapiens
aggacaguggaugcugcug

SEQ ID NO: 1196841 - RNA, 12 nt, Homo sapiens
aggacaucuccu

SEQ ID NO: 1196842 - RNA, 18 nt, Homo sapiens
aggacauuuuacugcagu

SEQ ID NO: 1196843 - RNA, 19 nt, Homo sapiens
aggaccaagggcaccugga

SEQ ID NO: 1196844 - RNA, 17 nt, Homo sapiens
aggaccacagagcuccu

SEQ ID NO: 1196845 - RNA, 13 nt, Homo sapiens
aggaccagagcua

SEQ ID NO: 1196846 - RNA, 22 nt, Homo sapiens
aggaccuacuguucggacaaaa

SEQ ID NO: 1196847 - RNA, 21 nt, Homo sapiens
aggaccucccucccccuggca

SEQ ID NO: 1196848 - RNA, 22 nt, Homo sapiens
aggacguuggccucagggccag

SEQ ID NO: 1196849 - RNA, 14 nt, Homo sapiens
aggacuacaaccaa

SEQ ID NO: 1196850 - RNA, 23 nt, Homo sapiens
aggacuaccagccauacaaauag

SEQ ID NO: 1196851 - RNA, 18 nt, Homo sapiens
aggacuccccaggagcac

SEQ ID NO: 1196852 - RNA, 21 nt, Homo sapiens
aggacucuauuuuaaggacug

SEQ ID NO: 1196853 - RNA, 20 nt, Homo sapiens
aggacucugcaagugucugg

SEQ ID NO: 1196854 - RNA, 17 nt, Homo sapiens
aggacuucugcagcuau

SEQ ID NO: 1196855 - RNA, 16 nt, Homo sapiens
aggacuuugcgguggg

SEQ ID NO: 1196856 - RNA, 15 nt, Homo sapiens
aggagaaacacaucu

SEQ ID NO: 1196857 - RNA, 15 nt, Homo sapiens
aggagaagggucuca

SEQ ID NO: 1196858 - RNA, 15 nt, Homo sapiens
aggagaauaugauaa

SEQ ID NO: 1196859 - RNA, 16 nt, Homo sapiens
aggagaaucacuggaa

SEQ ID NO: 1196860 - RNA, 22 nt, Homo sapiens
aggagaaugaaauguaugugcu

SEQ ID NO: 1196861 - RNA, 18 nt, Homo sapiens
aggagaccacggggagca

SEQ ID NO: 1196862 - RNA, 22 nt, Homo sapiens
aggagaccuggcacuggaugca

SEQ ID NO: 1196863 - RNA, 16 nt, Homo sapiens
aggagacgacaggcga

SEQ ID NO: 1196864 - RNA, 23 nt, Homo sapiens
aggagacuuuacauggaugccaa

SEQ ID NO: 1196865 - RNA, 12 nt, Homo sapiens
aggagagcaaga

SEQ ID NO: 1196866 - RNA, 16 nt, Homo sapiens
aggagagccaaccucg

SEQ ID NO: 1196867 - RNA, 23 nt, Homo sapiens
aggagaggaaaaguaaggugcag

SEQ ID NO: 1196868 - RNA, 19 nt, Homo sapiens
aggagaggggaagggccag

SEQ ID NO: 1196869 - RNA, 17 nt, Homo sapiens
aggagauuccggugccu

SEQ ID NO: 1196870 - RNA, 17 nt, Homo sapiens
aggagcacaggucccac

SEQ ID NO: 1196871 - RNA, 21 nt, Homo sapiens
aggagcagccugaacccgggg

SEQ ID NO: 1196872 - RNA, 18 nt, Homo sapiens
aggagccaccaguucuca

SEQ ID NO: 1196873 - RNA, 21 nt, Homo sapiens
aggagccauugcucuccuaga

SEQ ID NO: 1196874 - RNA, 16 nt, Homo sapiens
aggagccgaccgggaa

SEQ ID NO: 1196875 - RNA, 22 nt, Homo sapiens
aggagccggugcucuggaagac

SEQ ID NO: 1196876 - RNA, 19 nt, Homo sapiens
aggagcuugggugugcuga

SEQ ID NO: 1196877 - RNA, 18 nt, Homo sapiens
aggagcuuuggaccuaau

SEQ ID NO: 1196878 - RNA, 13 nt, Homo sapiens
aggaggccagugg

SEQ ID NO: 1196879 - RNA, 20 nt, Homo sapiens
aggaggcucccgaggggaag

SEQ ID NO: 1196880 - RNA, 19 nt, Homo sapiens
aggaggcuuggaaagcauc

SEQ ID NO: 1196881 - RNA, 15 nt, Homo sapiens
aggagggcucaggga

SEQ ID NO: 1196882 - RNA, 18 nt, Homo sapiens
aggaggggucucaugucc

SEQ ID NO: 1196883 - RNA, 19 nt, Homo sapiens
aggaggggugaguccccua

SEQ ID NO: 1196884 - RNA, 23 nt, Homo sapiens
aggagguccuuaggccucugaga

SEQ ID NO: 1196885 - RNA, 18 nt, Homo sapiens
aggagguucuaauauuca

SEQ ID NO: 1196886 - RNA, 23 nt, Homo sapiens
aggagguugaggcagcagaauug

SEQ ID NO: 1196887 - RNA, 20 nt, Homo sapiens
aggaguacaaugcccagauc

SEQ ID NO: 1196888 - RNA, 20 nt, Homo sapiens
aggagucccugguucauuga

SEQ ID NO: 1196889 - RNA, 21 nt, Homo sapiens
aggagucccugguucauugau

SEQ ID NO: 1196890 - RNA, 19 nt, Homo sapiens
aggagucgggagcacagcu

SEQ ID NO: 1196891 - RNA, 22 nt, Homo sapiens
aggagucucugccacccacuca

SEQ ID NO: 1196892 - RNA, 23 nt, Homo sapiens
aggagucugccuccaugcugcag

SEQ ID NO: 1196893 - RNA, 19 nt, Homo sapiens
aggaguguccucuucccuc

SEQ ID NO: 1196894 - RNA, 17 nt, Homo sapiens
aggaguguccugcccau

SEQ ID NO: 1196895 - RNA, 12 nt, Homo sapiens
aggauaacacaa

SEQ ID NO: 1196896 - RNA, 13 nt, Homo sapiens
aggauacagaaau

SEQ ID NO: 1196897 - RNA, 13 nt, Homo sapiens
aggauaugcagua

SEQ ID NO: 1196898 - RNA, 16 nt, Homo sapiens
aggauauuuucuucca

SEQ ID NO: 1196899 - RNA, 18 nt, Homo sapiens
aggaucacuugagcccag

SEQ ID NO: 1196900 - RNA, 14 nt, Homo sapiens
aggauccgugcugu

SEQ ID NO: 1196901 - RNA, 16 nt, Homo sapiens
aggaucuuugacugaa

SEQ ID NO: 1196902 - RNA, 19 nt, Homo sapiens
aggaugaauguaugugcac

SEQ ID NO: 1196903 - RNA, 17 nt, Homo sapiens
aggaugaguuacuugaa

SEQ ID NO: 1196904 - RNA, 15 nt, Homo sapiens
aggaugcacauuucu

SEQ ID NO: 1196905 - RNA, 19 nt, Homo sapiens
aggaugccagccccugccu

SEQ ID NO: 1196906 - RNA, 10 nt, Homo sapiens
aggaugcugc

SEQ ID NO: 1196907 - RNA, 14 nt, Homo sapiens
aggauggcaaagag

SEQ ID NO: 1196908 - RNA, 19 nt, Homo sapiens
aggaugguccagaauucac

SEQ ID NO: 1196909 - RNA, 16 nt, Homo sapiens
aguaucauucuuuaca

SEQ ID NO: 1196910 - RNA, 13 nt, Homo sapiens
aguaucuauuucu

SEQ ID NO: 1196911 - RNA, 18 nt, Homo sapiens
aguauggcuccuccauau

SEQ ID NO: 1196912 - RNA, 18 nt, Homo sapiens
aguauguccgaugguauc

SEQ ID NO: 1196913 - RNA, 17 nt, Homo sapiens
aguauguuaagcucuuu

SEQ ID NO: 1196914 - RNA, 19 nt, Homo sapiens
aguauguuuguacaguaug

SEQ ID NO: 1196915 - RNA, 14 nt, Homo sapiens
aguauucaaucaag

SEQ ID NO: 1196916 - RNA, 16 nt, Homo sapiens
aguauucuugucaaaa

SEQ ID NO: 1196917 - RNA, 18 nt, Homo sapiens
aguauuggcugaguccau

SEQ ID NO: 1196918 - RNA, 16 nt, Homo sapiens
aguauuuagaagccaa

SEQ ID NO: 1196919 - RNA, 20 nt, Homo sapiens
aguauuuagaagccaacuau

SEQ ID NO: 1196920 - RNA, 19 nt, Homo sapiens
aguauuuaggauaaccuug

SEQ ID NO: 1196921 - RNA, 16 nt, Homo sapiens
aguauuuuaagucuac

SEQ ID NO: 1196922 - RNA, 14 nt, Homo sapiens
aguauuuucccaau

SEQ ID NO: 1196923 - RNA, 19 nt, Homo sapiens
aguauuuuuauccaugaca

SEQ ID NO: 1196924 - RNA, 22 nt, Homo sapiens
agucaaaacagagaugugauaa

SEQ ID NO: 1196925 - RNA, 17 nt, Homo sapiens
agucaaaacuacaaauc

SEQ ID NO: 1196926 - RNA, 16 nt, Homo sapiens
agucaaaagagagaag

SEQ ID NO: 1196927 - RNA, 17 nt, Homo sapiens
agucaaagcaggauuau

SEQ ID NO: 1196928 - RNA, 16 nt, Homo sapiens
agucaaggucacuuaa

SEQ ID NO: 1196929 - RNA, 13 nt, Homo sapiens
agucaaugugcag

SEQ ID NO: 1196930 - RNA, 12 nt, Homo sapiens
agucacacagug

SEQ ID NO: 1196931 - RNA, 17 nt, Homo sapiens
agucacaucucuuccuc

SEQ ID NO: 1196932 - RNA, 21 nt, Homo sapiens
agucacaugcguaaacgacac

SEQ ID NO: 1196933 - RNA, 19 nt, Homo sapiens
agucacauggccuaugcac

SEQ ID NO: 1196934 - RNA, 17 nt, Homo sapiens
agucaccccaaguaguc

SEQ ID NO: 1196935 - RNA, 16 nt, Homo sapiens
agucaccgaagguccu

SEQ ID NO: 1196936 - RNA, 14 nt, Homo sapiens
agucaccgggauga

SEQ ID NO: 1196937 - RNA, 18 nt, Homo sapiens
agucaccuauguggucca

SEQ ID NO: 1196938 - RNA, 13 nt, Homo sapiens
agucacguguauu

SEQ ID NO: 1196939 - RNA, 17 nt, Homo sapiens
agucacugacaguuaau

SEQ ID NO: 1196940 - RNA, 14 nt, Homo sapiens
agucacugcacagu

SEQ ID NO: 1196941 - RNA, 23 nt, Homo sapiens
agucacugcacagugcaucucag

SEQ ID NO: 1196942 - RNA, 18 nt, Homo sapiens
agucacuuccacuggugg

SEQ ID NO: 1196943 - RNA, 14 nt, Homo sapiens
agucagacugucag

SEQ ID NO: 1196944 - RNA, 21 nt, Homo sapiens
agucagaggagaagagacaug

SEQ ID NO: 1196945 - RNA, 13 nt, Homo sapiens
agucagcauucuu

SEQ ID NO: 1196946 - RNA, 23 nt, Homo sapiens
agucaggccuuaauuuucaguau

SEQ ID NO: 1196947 - RNA, 14 nt, Homo sapiens
agucaguccaggau

SEQ ID NO: 1196948 - RNA, 12 nt, Homo sapiens
agucagugucug

SEQ ID NO: 1196949 - RNA, 19 nt, Homo sapiens
agucaguucucauuauuca

SEQ ID NO: 1196950 - RNA, 21 nt, Homo sapiens
agucaguucucauuauucaca

SEQ ID NO: 1196951 - RNA, 15 nt, Homo sapiens
agucaguugcucaaa

SEQ ID NO: 1196952 - RNA, 13 nt, Homo sapiens
agucauauugccc

SEQ ID NO: 1196953 - RNA, 14 nt, Homo sapiens
agucaucuacuuaa

SEQ ID NO: 1196954 - RNA, 14 nt, Homo sapiens
agucaucuauucaa

SEQ ID NO: 1196955 - RNA, 15 nt, Homo sapiens
agucaucucauucca

SEQ ID NO: 1196956 - RNA, 21 nt, Homo sapiens
agucaucuguuuaauuuacac

SEQ ID NO: 1196957 - RNA, 23 nt, Homo sapiens
agucaucuugcuaccaguauuua

SEQ ID NO: 1196958 - RNA, 18 nt, Homo sapiens
agucaucuuguaauuucc

SEQ ID NO: 1196959 - RNA, 20 nt, Homo sapiens
agucaugugagccucguguc

SEQ ID NO: 1196960 - RNA, 18 nt, Homo sapiens
agucauugaggcccugcu

SEQ ID NO: 1196961 - RNA, 17 nt, Homo sapiens
aguccaacaaaccacac

SEQ ID NO: 1196962 - RNA, 22 nt, Homo sapiens
aguccaagguuuaaagagucua

SEQ ID NO: 1196963 - RNA, 12 nt, Homo sapiens
aguccacuuuac

SEQ ID NO: 1196964 - RNA, 13 nt, Homo sapiens
aguccaguacuug

SEQ ID NO: 1196965 - RNA, 15 nt, Homo sapiens
aguccaguacuugac

SEQ ID NO: 1196966 - RNA, 18 nt, Homo sapiens
agucccaccuuggcugca

SEQ ID NO: 1196967 - RNA, 20 nt, Homo sapiens
aguccccagccugcucccua

SEQ ID NO: 1196968 - RNA, 23 nt, Homo sapiens
agucccccaacucugagcccaug

SEQ ID NO: 1196969 - RNA, 17 nt, Homo sapiens
aguccccgggcaucuuu

SEQ ID NO: 1196970 - RNA, 17 nt, Homo sapiens
aguccuacccugaaccu

SEQ ID NO: 1196971 - RNA, 19 nt, Homo sapiens
aguccugacacuauucauu

SEQ ID NO: 1196972 - RNA, 16 nt, Homo sapiens
aguccuggaaucacau

SEQ ID NO: 1196973 - RNA, 17 nt, Homo sapiens
aguccuguuugcaggga

SEQ ID NO: 1196974 - RNA, 12 nt, Homo sapiens
aguccuuuccaa

SEQ ID NO: 1196975 - RNA, 20 nt, Homo sapiens
agucgaauguuagauuccuc

SEQ ID NO: 1196976 - RNA, 16 nt, Homo sapiens
agucgaccgcacuuau

SEQ ID NO: 1196977 - RNA, 23 nt, Homo sapiens
agucgaggacagggaggugaccc

SEQ ID NO: 1196978 - RNA, 19 nt, Homo sapiens
agucgcaucucagugcagg

SEQ ID NO: 1196979 - RNA, 15 nt, Homo sapiens
agucggaacagcaga

SEQ ID NO: 1196980 - RNA, 16 nt, Homo sapiens
agucggccccaucucu

SEQ ID NO: 1196981 - RNA, 18 nt, Homo sapiens
agucuaccugcuggacag

SEQ ID NO: 1196982 - RNA, 21 nt, Homo sapiens
agucuagccuggacaacacag

SEQ ID NO: 1196983 - RNA, 23 nt, Homo sapiens
agucucaccuccugccauagggu

SEQ ID NO: 1196984 - RNA, 17 nt, Homo sapiens
agucucacuggccaaga

SEQ ID NO: 1196985 - RNA, 15 nt, Homo sapiens
agucucccuuccuau

SEQ ID NO: 1196986 - RNA, 16 nt, Homo sapiens
agucucucacccucau

SEQ ID NO: 1196987 - RNA, 17 nt, Homo sapiens
agucucugaaugaagcu

SEQ ID NO: 1196988 - RNA, 20 nt, Homo sapiens
agucucugaguccuuugcua

SEQ ID NO: 1196989 - RNA, 17 nt, Homo sapiens
agucucugccacccacu

SEQ ID NO: 1196990 - RNA, 16 nt, Homo sapiens
agucucuggaaaaaga

SEQ ID NO: 1196991 - RNA, 22 nt, Homo sapiens
agucucuggaaaaagacugauu

SEQ ID NO: 1196992 - RNA, 13 nt, Homo sapiens
agucugaacagcu

SEQ ID NO: 1196993 - RNA, 18 nt, Homo sapiens
agucugaaugcugccaca

SEQ ID NO: 1196994 - RNA, 12 nt, Homo sapiens
agucugcugcug

SEQ ID NO: 1196995 - RNA, 12 nt, Homo sapiens
agucuggcaaca

SEQ ID NO: 1196996 - RNA, 18 nt, Homo sapiens
agucuggcaacagagcaa

SEQ ID NO: 1196997 - RNA, 16 nt, Homo sapiens
agucuguacuucauca

SEQ ID NO: 1196998 - RNA, 16 nt, Homo sapiens
agucugucuacugugg

SEQ ID NO: 1196999 - RNA, 19 nt, Homo sapiens
agucugucugucugaugau

SEQ ID NO: 1197000 - RNA, 19 nt, Homo sapiens
agucugugugggacuguac

SEQ ID NO: 1197001 - RNA, 16 nt, Homo sapiens
agucuuaacuuuucac

SEQ ID NO: 1197002 - RNA, 15 nt, Homo sapiens
agucuuccaguuuaa

SEQ ID NO: 1197003 - RNA, 20 nt, Homo sapiens
agucuuccaguuuaaugaac

SEQ ID NO: 1197004 - RNA, 19 nt, Homo sapiens
agucuuccugacacuuuaa

SEQ ID NO: 1197005 - RNA, 19 nt, Homo sapiens
agucuuggaaaaaaaccac

SEQ ID NO: 1197006 - RNA, 17 nt, Homo sapiens
agucuuuagggguuggg

SEQ ID NO: 1197007 - RNA, 22 nt, Homo sapiens
agucuuuauguccauaagcuac

SEQ ID NO: 1197008 - RNA, 14 nt, Homo sapiens
agucuuuccugaua

SEQ ID NO: 1197009 - RNA, 17 nt, Homo sapiens
agucuuugaagcugaaa

SEQ ID NO: 1197010 - RNA, 15 nt, Homo sapiens
agucuuuugcauguc

SEQ ID NO: 1197011 - RNA, 21 nt, Homo sapiens
agugaaaaucuuggagacccu

SEQ ID NO: 1197012 - RNA, 13 nt, Homo sapiens
agugaaaccauga

SEQ ID NO: 1197013 - RNA, 22 nt, Homo sapiens
agugaaagguauugcacuacau

SEQ ID NO: 1197014 - RNA, 14 nt, Homo sapiens
agugaaauaauuaa

SEQ ID NO: 1197015 - RNA, 19 nt, Homo sapiens
agugaacacucuacuacau

SEQ ID NO: 1197016 - RNA, 19 nt, Homo sapiens
agugaacauucgaccucca

SEQ ID NO: 1197017 - RNA, 14 nt, Homo sapiens
agugaacauucuga

SEQ ID NO: 1197018 - RNA, 20 nt, Homo sapiens
agugaagaugccagugaaac

SEQ ID NO: 1197019 - RNA, 17 nt, Homo sapiens
agugaagccaaagggac

SEQ ID NO: 1197020 - RNA, 15 nt, Homo sapiens
agugaagucuaugau

SEQ ID NO: 1197021 - RNA, 22 nt, Homo sapiens
agugaaguuuuacugucuauua

SEQ ID NO: 1197022 - RNA, 18 nt, Homo sapiens
agugaauaaccacuuaaa

SEQ ID NO: 1197023 - RNA, 14 nt, Homo sapiens
agugaaucuguauu

SEQ ID NO: 1197024 - RNA, 23 nt, Homo sapiens
agugacaaaauagacaauuugca

SEQ ID NO: 1197025 - RNA, 14 nt, Homo sapiens
agugacagcuugag

SEQ ID NO: 1197026 - RNA, 20 nt, Homo sapiens
agugacagcuugaguggguu

SEQ ID NO: 1197027 - RNA, 12 nt, Homo sapiens
agugacauuugu

SEQ ID NO: 1197028 - RNA, 16 nt, Homo sapiens
agugaccccugaccuc

SEQ ID NO: 1197029 - RNA, 20 nt, Homo sapiens
agugaccccugaccucacug

SEQ ID NO: 1197030 - RNA, 17 nt, Homo sapiens
agugaccuaaccacuua

SEQ ID NO: 1197031 - RNA, 15 nt, Homo sapiens
agugacuaugaacuu

SEQ ID NO: 1197032 - RNA, 14 nt, Homo sapiens
agugacuccugcug

SEQ ID NO: 1197033 - RNA, 19 nt, Homo sapiens
agugagaaaccauauuucc

SEQ ID NO: 1197034 - RNA, 13 nt, Homo sapiens
agugagagggcau

SEQ ID NO: 1197035 - RNA, 18 nt, Homo sapiens
auuauccaucuuucacua

SEQ ID NO: 1197036 - RNA, 13 nt, Homo sapiens
auuaucucacuua

SEQ ID NO: 1197037 - RNA, 21 nt, Homo sapiens
auuaugcauauauaaguuuac

SEQ ID NO: 1197038 - RNA, 14 nt, Homo sapiens
auuaugcuaccuac

SEQ ID NO: 1197039 - RNA, 19 nt, Homo sapiens
auuauggggacuuugguuu

SEQ ID NO: 1197040 - RNA, 12 nt, Homo sapiens
auuauguacaaa

SEQ ID NO: 1197041 - RNA, 18 nt, Homo sapiens
auuauuauucuucauaac

SEQ ID NO: 1197042 - RNA, 18 nt, Homo sapiens
auuauuccaaaccaaauu

SEQ ID NO: 1197043 - RNA, 20 nt, Homo sapiens
auuauucuuguaguuuaccu

SEQ ID NO: 1197044 - RNA, 19 nt, Homo sapiens
auuauugaaauuguacaua

SEQ ID NO: 1197045 - RNA, 14 nt, Homo sapiens
auuauuguaccauu

SEQ ID NO: 1197046 - RNA, 22 nt, Homo sapiens
auuauuguuccccuaaguggau

SEQ ID NO: 1197047 - RNA, 17 nt, Homo sapiens
auuauuuaaacucgcuc

SEQ ID NO: 1197048 - RNA, 14 nt, Homo sapiens
auuauuuccacuug

SEQ ID NO: 1197049 - RNA, 22 nt, Homo sapiens
auuauuugaagcgagucauuuc

SEQ ID NO: 1197050 - RNA, 16 nt, Homo sapiens
auuauuuucacuguag

SEQ ID NO: 1197051 - RNA, 15 nt, Homo sapiens
auuauuuucugucag

SEQ ID NO: 1197052 - RNA, 16 nt, Homo sapiens
auuauuuucugucaga

SEQ ID NO: 1197053 - RNA, 18 nt, Homo sapiens
auuauuuuuccacuuugu

SEQ ID NO: 1197054 - RNA, 20 nt, Homo sapiens
auuauuuuuguuagcaaaga

SEQ ID NO: 1197055 - RNA, 21 nt, Homo sapiens
auucaaagcauggacauuuag

SEQ ID NO: 1197056 - RNA, 13 nt, Homo sapiens
auucaaagcucua

SEQ ID NO: 1197057 - RNA, 15 nt, Homo sapiens
auucaaauugcugcu

SEQ ID NO: 1197058 - RNA, 14 nt, Homo sapiens
auucaacaauuuca

SEQ ID NO: 1197059 - RNA, 21 nt, Homo sapiens
auucaacucuccaauguucua

SEQ ID NO: 1197060 - RNA, 18 nt, Homo sapiens
auucaagguugguucaac

SEQ ID NO: 1197061 - RNA, 20 nt, Homo sapiens
auucacaauaaaagcuuaaa

SEQ ID NO: 1197062 - RNA, 19 nt, Homo sapiens
auucacagaauagcacaaa

SEQ ID NO: 1197063 - RNA, 20 nt, Homo sapiens
auucacagaauagcacaaac

SEQ ID NO: 1197064 - RNA, 21 nt, Homo sapiens
auucacaguaauaugguuccc

SEQ ID NO: 1197065 - RNA, 17 nt, Homo sapiens
auucacauauaucaaag

SEQ ID NO: 1197066 - RNA, 18 nt, Homo sapiens
auucacuagaccagaagu

SEQ ID NO: 1197067 - RNA, 16 nt, Homo sapiens
auucagagagcagcuu

SEQ ID NO: 1197068 - RNA, 13 nt, Homo sapiens
auucagaucaaaa

SEQ ID NO: 1197069 - RNA, 23 nt, Homo sapiens
auucagaucaaaaugccuuucag

SEQ ID NO: 1197070 - RNA, 13 nt, Homo sapiens
auucagcacuuaa

SEQ ID NO: 1197071 - RNA, 14 nt, Homo sapiens
auucagcaugucca

SEQ ID NO: 1197072 - RNA, 19 nt, Homo sapiens
auucagcauuauuccucca

SEQ ID NO: 1197073 - RNA, 18 nt, Homo sapiens
auucagcgaagucucaug

SEQ ID NO: 1197074 - RNA, 14 nt, Homo sapiens
auucaggacuugaa

SEQ ID NO: 1197075 - RNA, 17 nt, Homo sapiens
auucaggccagcccagc

SEQ ID NO: 1197076 - RNA, 13 nt, Homo sapiens
auucaguauuaaa

SEQ ID NO: 1197077 - RNA, 21 nt, Homo sapiens
auucagucucuucuaagcaaa

SEQ ID NO: 1197078 - RNA, 17 nt, Homo sapiens
auucagugauuacuguc

SEQ ID NO: 1197079 - RNA, 20 nt, Homo sapiens
auucauacccacacacccag

SEQ ID NO: 1197080 - RNA, 21 nt, Homo sapiens
auucauaggcaguaauguucc

SEQ ID NO: 1197081 - RNA, 22 nt, Homo sapiens
auucauauaggccagaguugca

SEQ ID NO: 1197082 - RNA, 14 nt, Homo sapiens
auuccaacagcuca

SEQ ID NO: 1197083 - RNA, 22 nt, Homo sapiens
auuccaacagcucaagucuucc

SEQ ID NO: 1197084 - RNA, 20 nt, Homo sapiens
auuccacaaccugguuugcc

SEQ ID NO: 1197085 - RNA, 12 nt, Homo sapiens
auuccacacagg

SEQ ID NO: 1197086 - RNA, 14 nt, Homo sapiens
auuccacacuacca

SEQ ID NO: 1197087 - RNA, 18 nt, Homo sapiens
auuccacacuaccacauu

SEQ ID NO: 1197088 - RNA, 15 nt, Homo sapiens
auuccaccauuguga

SEQ ID NO: 1197089 - RNA, 17 nt, Homo sapiens
auuccagaaugcuguac

SEQ ID NO: 1197090 - RNA, 16 nt, Homo sapiens
auuccagaucuuucag

SEQ ID NO: 1197091 - RNA, 23 nt, Homo sapiens
auuccccuguagcagucacugac

SEQ ID NO: 1197092 - RNA, 20 nt, Homo sapiens
auucccucccaucaugcccg

SEQ ID NO: 1197093 - RNA, 19 nt, Homo sapiens
auucccucuccugcccaga

SEQ ID NO: 1197094 - RNA, 18 nt, Homo sapiens
auuccggugccuccugaa

SEQ ID NO: 1197095 - RNA, 19 nt, Homo sapiens
auuccguugucuguggaug

SEQ ID NO: 1197096 - RNA, 20 nt, Homo sapiens
auuccuacucccucuuccaa

SEQ ID NO: 1197097 - RNA, 22 nt, Homo sapiens
auuccucuugccucucucagga

SEQ ID NO: 1197098 - RNA, 13 nt, Homo sapiens
auuccugauaaua

SEQ ID NO: 1197099 - RNA, 20 nt, Homo sapiens
auuccugauaauaauugauc

SEQ ID NO: 1197100 - RNA, 16 nt, Homo sapiens
auuccugaugaccaau

SEQ ID NO: 1197101 - RNA, 21 nt, Homo sapiens
auuccugauggaaaaugcaaa

SEQ ID NO: 1197102 - RNA, 22 nt, Homo sapiens
auuccugccuuuaagccaaaga

SEQ ID NO: 1197103 - RNA, 14 nt, Homo sapiens
auuccuucuggccu

SEQ ID NO: 1197104 - RNA, 16 nt, Homo sapiens
auuccuuugucuucaa

SEQ ID NO: 1197105 - RNA, 16 nt, Homo sapiens
auucuaaaggcuugau

SEQ ID NO: 1197106 - RNA, 22 nt, Homo sapiens
auucuaacccagguauccaaaa

SEQ ID NO: 1197107 - RNA, 19 nt, Homo sapiens
auucuaagcccuuugccau

SEQ ID NO: 1197108 - RNA, 17 nt, Homo sapiens
auucuaaguuauuuacu

SEQ ID NO: 1197109 - RNA, 22 nt, Homo sapiens
auucuaauaaauauacuaugaa

SEQ ID NO: 1197110 - RNA, 15 nt, Homo sapiens
auucuaaucuaacaa

SEQ ID NO: 1197111 - RNA, 14 nt, Homo sapiens
auucuaauuaaaau

SEQ ID NO: 1197112 - RNA, 18 nt, Homo sapiens
auucuaauugucagugau

SEQ ID NO: 1197113 - RNA, 16 nt, Homo sapiens
auucuacacagagcag

SEQ ID NO: 1197114 - RNA, 19 nt, Homo sapiens
auucuacuugcuuauuaca

SEQ ID NO: 1197115 - RNA, 15 nt, Homo sapiens
auucuagagccagcu

SEQ ID NO: 1197116 - RNA, 21 nt, Homo sapiens
auucuagaggauguaucucac

SEQ ID NO: 1197117 - RNA, 13 nt, Homo sapiens
auucuaggcaucc

SEQ ID NO: 1197118 - RNA, 19 nt, Homo sapiens
auucucaguguagggcaga

SEQ ID NO: 1197119 - RNA, 22 nt, Homo sapiens
auucucaguguagggcagagag

SEQ ID NO: 1197120 - RNA, 14 nt, Homo sapiens
auucucaucacuca

SEQ ID NO: 1197121 - RNA, 15 nt, Homo sapiens
auucucaugccucag

SEQ ID NO: 1197122 - RNA, 19 nt, Homo sapiens
auucucauuugucacacac

SEQ ID NO: 1197123 - RNA, 14 nt, Homo sapiens
auucuccauacucu

SEQ ID NO: 1197124 - RNA, 16 nt, Homo sapiens
auucuccauacucugu

SEQ ID NO: 1197125 - RNA, 15 nt, Homo sapiens
auucuccugccuuag

SEQ ID NO: 1197126 - RNA, 22 nt, Homo sapiens
auucucugugguauccaagaau

SEQ ID NO: 1197127 - RNA, 20 nt, Homo sapiens
auucucuuaugauacuugag

SEQ ID NO: 1197128 - RNA, 23 nt, Homo sapiens
auucugaaaggaaauacacuucu

SEQ ID NO: 1197129 - RNA, 15 nt, Homo sapiens
auucugaccauuuca

SEQ ID NO: 1197130 - RNA, 16 nt, Homo sapiens
auucugagccauucac

SEQ ID NO: 1197131 - RNA, 18 nt, Homo sapiens
auucugaggccugaguga

SEQ ID NO: 1197132 - RNA, 21 nt, Homo sapiens
auucugauuauugaguuccag

SEQ ID NO: 1197133 - RNA, 17 nt, Homo sapiens
auucugccuagagugua

SEQ ID NO: 1197134 - RNA, 22 nt, Homo sapiens
auucugccuccauucugaccau

SEQ ID NO: 1197135 - RNA, 17 nt, Homo sapiens
auucuggaaaagcaaaa

SEQ ID NO: 1197136 - RNA, 22 nt, Homo sapiens
auucuggcaucuuagaccucca

SEQ ID NO: 1197137 - RNA, 18 nt, Homo sapiens
auucugggaaucaugucc

SEQ ID NO: 1197138 - RNA, 22 nt, Homo sapiens
auucuguaaaauuaaacaaaua

SEQ ID NO: 1197139 - RNA, 16 nt, Homo sapiens
auucuguaaaauuuaa

SEQ ID NO: 1197140 - RNA, 15 nt, Homo sapiens
auucuguaguuucac

SEQ ID NO: 1197141 - RNA, 16 nt, Homo sapiens
auucugucucccccaa

SEQ ID NO: 1197142 - RNA, 17 nt, Homo sapiens
auucugugaccaaaaua

SEQ ID NO: 1197143 - RNA, 18 nt, Homo sapiens
auucuguuuuuaaugcua

SEQ ID NO: 1197144 - RNA, 22 nt, Homo sapiens
auucuuaaaauauauuucagau

SEQ ID NO: 1197145 - RNA, 22 nt, Homo sapiens
auucuuacacugccuguauacu

SEQ ID NO: 1197146 - RNA, 22 nt, Homo sapiens
auucuuaguuguucaguugcca

SEQ ID NO: 1197147 - RNA, 18 nt, Homo sapiens
auucuucaaccucauuga

SEQ ID NO: 1197148 - RNA, 20 nt, Homo sapiens
auucuucaaccucauugaca

SEQ ID NO: 1197149 - RNA, 13 nt, Homo sapiens
auucuucugcuuc

SEQ ID NO: 1197150 - RNA, 12 nt, Homo sapiens
auucuucuguac

SEQ ID NO: 1197151 - RNA, 14 nt, Homo sapiens
auucuugaaugagg

SEQ ID NO: 1197152 - RNA, 20 nt, Homo sapiens
auucuugccuuguaccucaa

SEQ ID NO: 1197153 - RNA, 19 nt, Homo sapiens
auucuuguauauuauggaa

SEQ ID NO: 1197154 - RNA, 20 nt, Homo sapiens
auucuuguuuuacauuugga

SEQ ID NO: 1197155 - RNA, 17 nt, Homo sapiens
auucuuuaaaauucacu

SEQ ID NO: 1197156 - RNA, 17 nt, Homo sapiens
auucuuuauucuuuacu

SEQ ID NO: 1197157 - RNA, 18 nt, Homo sapiens
auucuuuauucuuuacua

SEQ ID NO: 1197158 - RNA, 16 nt, Homo sapiens
auucuuucccagugag

SEQ ID NO: 1197159 - RNA, 17 nt, Homo sapiens
auucuuucuaaacuaca

SEQ ID NO: 1197160 - RNA, 13 nt, Homo sapiens
caaacaggcaguu

SEQ ID NO: 1197161 - RNA, 22 nt, Homo sapiens
caaacaggcaguuggccagaga

SEQ ID NO: 1197162 - RNA, 21 nt, Homo sapiens
caaacaggguuugauagcacu

SEQ ID NO: 1197163 - RNA, 12 nt, Homo sapiens
caaacauauaac

SEQ ID NO: 1197164 - RNA, 23 nt, Homo sapiens
caaacauauccuuucaagacaga

SEQ ID NO: 1197165 - RNA, 12 nt, Homo sapiens
caaacaucuaau

SEQ ID NO: 1197166 - RNA, 16 nt, Homo sapiens
caaaccacaacugaca

SEQ ID NO: 1197167 - RNA, 13 nt, Homo sapiens
caaaccaggauuu

SEQ ID NO: 1197168 - RNA, 19 nt, Homo sapiens
caaacccuagauuggggua

SEQ ID NO: 1197169 - RNA, 15 nt, Homo sapiens
caaaccgagugcaau

SEQ ID NO: 1197170 - RNA, 17 nt, Homo sapiens
caaaccgagugcaauga

SEQ ID NO: 1197171 - RNA, 14 nt, Homo sapiens
caaaccuaccaaaa

SEQ ID NO: 1197172 - RNA, 18 nt, Homo sapiens
caaaccuuaaaacagcug

SEQ ID NO: 1197173 - RNA, 19 nt, Homo sapiens
caaacgggcugcccugcca

SEQ ID NO: 1197174 - RNA, 13 nt, Homo sapiens
caaacuaaaagac

SEQ ID NO: 1197175 - RNA, 15 nt, Homo sapiens
caaacuacauguaau

SEQ ID NO: 1197176 - RNA, 17 nt, Homo sapiens
caaacucaaacuugaga

SEQ ID NO: 1197177 - RNA, 17 nt, Homo sapiens
caaacucacugcucaag

SEQ ID NO: 1197178 - RNA, 21 nt, Homo sapiens
caaacucauugcagcagauaa

SEQ ID NO: 1197179 - RNA, 11 nt, Homo sapiens
caaacucccua

SEQ ID NO: 1197180 - RNA, 20 nt, Homo sapiens
caaacuguagaaaugaugau

SEQ ID NO: 1197181 - RNA, 15 nt, Homo sapiens
caaacuucaaagagg

SEQ ID NO: 1197182 - RNA, 14 nt, Homo sapiens
caaacuuccaguca

SEQ ID NO: 1197183 - RNA, 21 nt, Homo sapiens
caaacuugagaaaauaucuug

SEQ ID NO: 1197184 - RNA, 15 nt, Homo sapiens
caaacuugcuuuaug

SEQ ID NO: 1197185 - RNA, 13 nt, Homo sapiens
caaacuuuaguuu

SEQ ID NO: 1197186 - RNA, 20 nt, Homo sapiens
caaagaaaaaaaaaaaagcc

SEQ ID NO: 1197187 - RNA, 17 nt, Homo sapiens
caaagaaaugaacauuc

SEQ ID NO: 1197188 - RNA, 20 nt, Homo sapiens
caaagaacuccagagucagu

SEQ ID NO: 1197189 - RNA, 24 nt, Homo sapiens
caaagaacugaaagcacuagagca

SEQ ID NO: 1197190 - RNA, 20 nt, Homo sapiens
caaagaauuuuuuuuaacau

SEQ ID NO: 1197191 - RNA, 13 nt, Homo sapiens
caaagacagcauc

SEQ ID NO: 1197192 - RNA, 12 nt, Homo sapiens
caaagacuguau

SEQ ID NO: 1197193 - RNA, 14 nt, Homo sapiens
caaagagguauuua

SEQ ID NO: 1197194 - RNA, 16 nt, Homo sapiens
caaagauaacaugcuu

SEQ ID NO: 1197195 - RNA, 17 nt, Homo sapiens
caaagauccccaaaaca

SEQ ID NO: 1197196 - RNA, 19 nt, Homo sapiens
caaagaucuuuuccagagu

SEQ ID NO: 1197197 - RNA, 18 nt, Homo sapiens
caaagcauggacauuuag

SEQ ID NO: 1197198 - RNA, 13 nt, Homo sapiens
caaagccaaaacc

SEQ ID NO: 1197199 - RNA, 13 nt, Homo sapiens
caaagccagugaa

SEQ ID NO: 1197200 - RNA, 23 nt, Homo sapiens
caaagccuuaucaagugucuucc

SEQ ID NO: 1197201 - RNA, 18 nt, Homo sapiens
caaagcuaggaugguucu

SEQ ID NO: 1197202 - RNA, 14 nt, Homo sapiens
caaaggaugugaua

SEQ ID NO: 1197203 - RNA, 21 nt, Homo sapiens
caaaggaugugauauauaagu

SEQ ID NO: 1197204 - RNA, 17 nt, Homo sapiens
caaaggcugaacuggau

SEQ ID NO: 1197205 - RNA, 22 nt, Homo sapiens
caaagggaaaccccccagucac

SEQ ID NO: 1197206 - RNA, 14 nt, Homo sapiens
caaagguugcagug

SEQ ID NO: 1197207 - RNA, 15 nt, Homo sapiens
caaagguugcagugc

SEQ ID NO: 1197208 - RNA, 18 nt, Homo sapiens
caaaguaaaggccuccuc

SEQ ID NO: 1197209 - RNA, 13 nt, Homo sapiens
caaaguaagccau

SEQ ID NO: 1197210 - RNA, 20 nt, Homo sapiens
caaaguagaggaauccaugu

SEQ ID NO: 1197211 - RNA, 24 nt, Homo sapiens
caaaguauaaccauaugauacuau

SEQ ID NO: 1197212 - RNA, 14 nt, Homo sapiens
caaagugaaggaca

SEQ ID NO: 1197213 - RNA, 20 nt, Homo sapiens
caaagugacauuccugaguc

SEQ ID NO: 1197214 - RNA, 12 nt, Homo sapiens
caaagugaggag

SEQ ID NO: 1197215 - RNA, 18 nt, Homo sapiens
caaagugcggcugccauu

SEQ ID NO: 1197216 - RNA, 15 nt, Homo sapiens
caaagugcugagauu

SEQ ID NO: 1197217 - RNA, 17 nt, Homo sapiens
caaagugcugagauuac

SEQ ID NO: 1197218 - RNA, 11 nt, Homo sapiens
caaagugcugg

SEQ ID NO: 1197219 - RNA, 22 nt, Homo sapiens
caaagugcugggauuacagaca

SEQ ID NO: 1197220 - RNA, 21 nt, Homo sapiens
caaaguguuuuuuauugaaug

SEQ ID NO: 1197221 - RNA, 22 nt, Homo sapiens
caaaguuacugauucacugcau

SEQ ID NO: 1197222 - RNA, 18 nt, Homo sapiens
caaauaaauaagaucaga

SEQ ID NO: 1197223 - RNA, 15 nt, Homo sapiens
caaauaacagucuga

SEQ ID NO: 1197224 - RNA, 14 nt, Homo sapiens
caaauaagaaaccu

SEQ ID NO: 1197225 - RNA, 13 nt, Homo sapiens
caaauaaguggaa

SEQ ID NO: 1197226 - RNA, 15 nt, Homo sapiens
caaauacacauuugc

SEQ ID NO: 1197227 - RNA, 17 nt, Homo sapiens
caaauacacauuugcua

SEQ ID NO: 1197228 - RNA, 15 nt, Homo sapiens
caaauaugcaaacca

SEQ ID NO: 1197229 - RNA, 16 nt, Homo sapiens
caaauauuguugacaa

SEQ ID NO: 1197230 - RNA, 20 nt, Homo sapiens
caaauauuuagcaucuuccu

SEQ ID NO: 1197231 - RNA, 17 nt, Homo sapiens
caaauauuucugauacu

SEQ ID NO: 1197232 - RNA, 17 nt, Homo sapiens
caaaucaagaaauauga

SEQ ID NO: 1197233 - RNA, 19 nt, Homo sapiens
caaaucaauaaauucccaa

SEQ ID NO: 1197234 - RNA, 17 nt, Homo sapiens
caaauccauaauuauua

SEQ ID NO: 1197235 - RNA, 20 nt, Homo sapiens
caaaucuaaaguugcuccau

SEQ ID NO: 1197236 - RNA, 19 nt, Homo sapiens
caaaucuaccacuguauga

SEQ ID NO: 1197237 - RNA, 14 nt, Homo sapiens
caaaucucuuccac

SEQ ID NO: 1197238 - RNA, 15 nt, Homo sapiens
caaaucugacauauu

SEQ ID NO: 1197239 - RNA, 17 nt, Homo sapiens
caaaucuggaagccaaa

SEQ ID NO: 1197240 - RNA, 20 nt, Homo sapiens
caaaucuggcuccuuuacaa

SEQ ID NO: 1197241 - RNA, 23 nt, Homo sapiens
caaaugacagauucugacauuua

SEQ ID NO: 1197242 - RNA, 16 nt, Homo sapiens
caaaugagagugguua

SEQ ID NO: 1197243 - RNA, 18 nt, Homo sapiens
caaaugaugccacuuccc

SEQ ID NO: 1197244 - RNA, 14 nt, Homo sapiens
caaaugauuaguua

SEQ ID NO: 1197245 - RNA, 15 nt, Homo sapiens
caaaugauucagcuc

SEQ ID NO: 1197246 - RNA, 12 nt, Homo sapiens
caaaugauuuca

SEQ ID NO: 1197247 - RNA, 15 nt, Homo sapiens
caaaugcacaucuca

SEQ ID NO: 1197248 - RNA, 16 nt, Homo sapiens
caaaugcacaucucau

SEQ ID NO: 1197249 - RNA, 20 nt, Homo sapiens
caaaugcauacaaguuucau

SEQ ID NO: 1197250 - RNA, 23 nt, Homo sapiens
caaauggcagaaccaaagcucaa

SEQ ID NO: 1197251 - RNA, 14 nt, Homo sapiens
caaauuaacuguau

SEQ ID NO: 1197252 - RNA, 15 nt, Homo sapiens
caaauuaaggcauaa

SEQ ID NO: 1197253 - RNA, 17 nt, Homo sapiens
caaauucaguuucauaa

SEQ ID NO: 1197254 - RNA, 18 nt, Homo sapiens
caaauucauauucugucu

SEQ ID NO: 1197255 - RNA, 20 nt, Homo sapiens
caaauugaaaacacacucaa

SEQ ID NO: 1197256 - RNA, 13 nt, Homo sapiens
caaauugaucaag

SEQ ID NO: 1197257 - RNA, 13 nt, Homo sapiens
caaauugcacuga

SEQ ID NO: 1197258 - RNA, 17 nt, Homo sapiens
caaauugggccaaagaa

SEQ ID NO: 1197259 - RNA, 19 nt, Homo sapiens
caaauuggugaacagugua

SEQ ID NO: 1197260 - RNA, 19 nt, Homo sapiens
caaauuucuagucaaugug

SEQ ID NO: 1197261 - RNA, 21 nt, Homo sapiens
caaauuugauugauuugaaga

SEQ ID NO: 1197262 - RNA, 22 nt, Homo sapiens
caaauuuggcucacuugccuua

SEQ ID NO: 1197263 - RNA, 12 nt, Homo sapiens
caaauuuguaca

SEQ ID NO: 1197264 - RNA, 16 nt, Homo sapiens
caaauuuuucuaucaa

SEQ ID NO: 1197265 - RNA, 13 nt, Homo sapiens
caacaaaccacaa

SEQ ID NO: 1197266 - RNA, 18 nt, Homo sapiens
caacaaacuuaggaauaa

SEQ ID NO: 1197267 - RNA, 20 nt, Homo sapiens
caacaaagaaugggcuugaa

SEQ ID NO: 1197268 - RNA, 16 nt, Homo sapiens
caacaaagauugagaa

SEQ ID NO: 1197269 - RNA, 18 nt, Homo sapiens
caacaacauccauguccu

SEQ ID NO: 1197270 - RNA, 19 nt, Homo sapiens
caacaacauccauguccua

SEQ ID NO: 1197271 - RNA, 22 nt, Homo sapiens
caacaaccggccaccagauguc

SEQ ID NO: 1197272 - RNA, 21 nt, Homo sapiens
caacaagauccuuaaugcaga

SEQ ID NO: 1197273 - RNA, 20 nt, Homo sapiens
caacaaggcugcacagcuca

SEQ ID NO: 1197274 - RNA, 17 nt, Homo sapiens
caacaauacaugcugcu

SEQ ID NO: 1197275 - RNA, 22 nt, Homo sapiens
caacaaugacuuaaccauauaa

SEQ ID NO: 1197276 - RNA, 15 nt, Homo sapiens
caacaauugguaaaa

SEQ ID NO: 1197277 - RNA, 24 nt, Homo sapiens
caacacagugaaacuccaucucaa

SEQ ID NO: 1197278 - RNA, 18 nt, Homo sapiens
caacaccuuccuccugca

SEQ ID NO: 1197279 - RNA, 23 nt, Homo sapiens
caacacugcugcuccagugcagg

SEQ ID NO: 1197280 - RNA, 19 nt, Homo sapiens
caacacuguuacuuucgua

SEQ ID NO: 1197281 - RNA, 11 nt, Homo sapiens
caacacuuugg

SEQ ID NO: 1197282 - RNA, 18 nt, Homo sapiens
caacagaaucagaucuga

SEQ ID NO: 1197283 - RNA, 13 nt, Homo sapiens
caacagacuugaa

SEQ ID NO: 1197284 - RNA, 20 nt, Homo sapiens
caacagcaagucacccauca

SEQ ID NO: 1197285 - RNA, 12 nt, Homo sapiens
caacagcacugg

SEQ ID NO: 1197286 - RNA, 15 nt, Homo sapiens
cacauacgugcacag

SEQ ID NO: 1197287 - RNA, 21 nt, Homo sapiens
cacauagauuaauggcacuga

SEQ ID NO: 1197288 - RNA, 19 nt, Homo sapiens
cacauagcgccgugcugua

SEQ ID NO: 1197289 - RNA, 22 nt, Homo sapiens
cacauagcgccgugcuguaaau

SEQ ID NO: 1197290 - RNA, 22 nt, Homo sapiens
cacauauggacucugcacauga

SEQ ID NO: 1197291 - RNA, 16 nt, Homo sapiens
cacauauguaguauaa

SEQ ID NO: 1197292 - RNA, 22 nt, Homo sapiens
cacauccaaccccccaccugcc

SEQ ID NO: 1197293 - RNA, 13 nt, Homo sapiens
cacauccauuccc

SEQ ID NO: 1197294 - RNA, 14 nt, Homo sapiens
cacauccauuccca

SEQ ID NO: 1197295 - RNA, 21 nt, Homo sapiens
cacauccgccuuuuguauaca

SEQ ID NO: 1197296 - RNA, 11 nt, Homo sapiens
cacaucuccag

SEQ ID NO: 1197297 - RNA, 13 nt, Homo sapiens
cacaucugucacg

SEQ ID NO: 1197298 - RNA, 17 nt, Homo sapiens
cacaugaaaccuacaca

SEQ ID NO: 1197299 - RNA, 16 nt, Homo sapiens
cacaugaauauaaaug

SEQ ID NO: 1197300 - RNA, 15 nt, Homo sapiens
cacaugacacccgug

SEQ ID NO: 1197301 - RNA, 14 nt, Homo sapiens
cacaugaggccauc

SEQ ID NO: 1197302 - RNA, 19 nt, Homo sapiens
cacaugagggggugcccuc

SEQ ID NO: 1197303 - RNA, 11 nt, Homo sapiens
cacaugcacag

SEQ ID NO: 1197304 - RNA, 16 nt, Homo sapiens
cacaugcccaugauga

SEQ ID NO: 1197305 - RNA, 17 nt, Homo sapiens
cacaugcccaugaugag

SEQ ID NO: 1197306 - RNA, 22 nt, Homo sapiens
cacaugccuuuuaaaaguucuu

SEQ ID NO: 1197307 - RNA, 15 nt, Homo sapiens
cacaugcgcacucuc

SEQ ID NO: 1197308 - RNA, 16 nt, Homo sapiens
cacaugcugagucucc

SEQ ID NO: 1197309 - RNA, 20 nt, Homo sapiens
cacaugcuggugcauauacg

SEQ ID NO: 1197310 - RNA, 18 nt, Homo sapiens
cacauggaacgcuuucau

SEQ ID NO: 1197311 - RNA, 14 nt, Homo sapiens
cacauggaacuuua

SEQ ID NO: 1197312 - RNA, 23 nt, Homo sapiens
cacauggaaucaaucuuuaacaa

SEQ ID NO: 1197313 - RNA, 18 nt, Homo sapiens
cacauggccuaugcacau

SEQ ID NO: 1197314 - RNA, 19 nt, Homo sapiens
cacauggccuaugcacaua

SEQ ID NO: 1197315 - RNA, 16 nt, Homo sapiens
cacaugucuuguacau

SEQ ID NO: 1197316 - RNA, 20 nt, Homo sapiens
cacaugucuuguacaugugu

SEQ ID NO: 1197317 - RNA, 15 nt, Homo sapiens
cacaugugacacaua

SEQ ID NO: 1197318 - RNA, 17 nt, Homo sapiens
cacaugugacacauaug

SEQ ID NO: 1197319 - RNA, 20 nt, Homo sapiens
cacaugugacacauaugcac

SEQ ID NO: 1197320 - RNA, 22 nt, Homo sapiens
cacauucuauuuuggguauuaa

SEQ ID NO: 1197321 - RNA, 23 nt, Homo sapiens
cacauucuuaacacauguccuug

SEQ ID NO: 1197322 - RNA, 18 nt, Homo sapiens
cacauugaaugcgcuuua

SEQ ID NO: 1197323 - RNA, 15 nt, Homo sapiens
cacauuuaugaauca

SEQ ID NO: 1197324 - RNA, 17 nt, Homo sapiens
cacauuucuaugccaaa

SEQ ID NO: 1197325 - RNA, 14 nt, Homo sapiens
caccaaagcugccc

SEQ ID NO: 1197326 - RNA, 23 nt, Homo sapiens
caccaaaucagcugcuacuacuc

SEQ ID NO: 1197327 - RNA, 21 nt, Homo sapiens
caccaacacugcucacagccu

SEQ ID NO: 1197328 - RNA, 22 nt, Homo sapiens
caccaacauugcuugugccaca

SEQ ID NO: 1197329 - RNA, 14 nt, Homo sapiens
caccaacgagguga

SEQ ID NO: 1197330 - RNA, 19 nt, Homo sapiens
caccaacuauagaauguau

SEQ ID NO: 1197331 - RNA, 19 nt, Homo sapiens
caccaacugaaguggcuaa

SEQ ID NO: 1197332 - RNA, 18 nt, Homo sapiens
caccaacuggagcacuga

SEQ ID NO: 1197333 - RNA, 14 nt, Homo sapiens
caccaagcccaguu

SEQ ID NO: 1197334 - RNA, 15 nt, Homo sapiens
caccaagcucugucc

SEQ ID NO: 1197335 - RNA, 20 nt, Homo sapiens
caccaagcucuguccaauca

SEQ ID NO: 1197336 - RNA, 20 nt, Homo sapiens
caccaagggaucugccauug

SEQ ID NO: 1197337 - RNA, 17 nt, Homo sapiens
caccaauuaucaucuuu

SEQ ID NO: 1197338 - RNA, 14 nt, Homo sapiens
caccacacacacac

SEQ ID NO: 1197339 - RNA, 13 nt, Homo sapiens
caccacaccauca

SEQ ID NO: 1197340 - RNA, 17 nt, Homo sapiens
caccacagccagcaccu

SEQ ID NO: 1197341 - RNA, 15 nt, Homo sapiens
caccacgacuggcca

SEQ ID NO: 1197342 - RNA, 20 nt, Homo sapiens
caccagagcauuuccaacac

SEQ ID NO: 1197343 - RNA, 23 nt, Homo sapiens
caccagagggauaaaaacaauac

SEQ ID NO: 1197344 - RNA, 20 nt, Homo sapiens
caccagcccugaccccagug

SEQ ID NO: 1197345 - RNA, 16 nt, Homo sapiens
caccagcuaucuguca

SEQ ID NO: 1197346 - RNA, 18 nt, Homo sapiens
caccaggacucagaggau

SEQ ID NO: 1197347 - RNA, 21 nt, Homo sapiens
caccaggagacagacagagaa

SEQ ID NO: 1197348 - RNA, 17 nt, Homo sapiens
caccaucuacaccagug

SEQ ID NO: 1197349 - RNA, 22 nt, Homo sapiens
caccaucuuuugugagauguaa

SEQ ID NO: 1197350 - RNA, 16 nt, Homo sapiens
caccaugguagccuua

SEQ ID NO: 1197351 - RNA, 23 nt, Homo sapiens
caccauuccuggaaaccacaguc

SEQ ID NO: 1197352 - RNA, 12 nt, Homo sapiens
caccauugcacu

SEQ ID NO: 1197353 - RNA, 18 nt, Homo sapiens
caccauuuuccugccuca

SEQ ID NO: 1197354 - RNA, 15 nt, Homo sapiens
cacccacaaucacaa

SEQ ID NO: 1197355 - RNA, 17 nt, Homo sapiens
cacccaccaccugaagc

SEQ ID NO: 1197356 - RNA, 16 nt, Homo sapiens
cacccacccugugcca

SEQ ID NO: 1197357 - RNA, 16 nt, Homo sapiens
cacccaccuccaccca

SEQ ID NO: 1197358 - RNA, 15 nt, Homo sapiens
cacccaggcugcacu

SEQ ID NO: 1197359 - RNA, 13 nt, Homo sapiens
cacccagucucau

SEQ ID NO: 1197360 - RNA, 15 nt, Homo sapiens
cacccauaccacagc

SEQ ID NO: 1197361 - RNA, 16 nt, Homo sapiens
cacccaucuuccugcu

SEQ ID NO: 1197362 - RNA, 12 nt, Homo sapiens
caccccaagaga

SEQ ID NO: 1197363 - RNA, 21 nt, Homo sapiens
caccccaagagaacucgcgcu

SEQ ID NO: 1197364 - RNA, 20 nt, Homo sapiens
caccccaaguagucugcuca

SEQ ID NO: 1197365 - RNA, 14 nt, Homo sapiens
caccccagggccaa

SEQ ID NO: 1197366 - RNA, 22 nt, Homo sapiens
cacccccacccaccuccaccca

SEQ ID NO: 1197367 - RNA, 21 nt, Homo sapiens
cacccccugcuccaccagcag

SEQ ID NO: 1197368 - RNA, 15 nt, Homo sapiens
caccccuaaagagau

SEQ ID NO: 1197369 - RNA, 16 nt, Homo sapiens
caccccuauggugcuc

SEQ ID NO: 1197370 - RNA, 16 nt, Homo sapiens
caccccucacucuggc

SEQ ID NO: 1197371 - RNA, 16 nt, Homo sapiens
cacccgacuccucaaa

SEQ ID NO: 1197372 - RNA, 16 nt, Homo sapiens
cacccgcccacagcca

SEQ ID NO: 1197373 - RNA, 17 nt, Homo sapiens
cacccgcccacagccag

SEQ ID NO: 1197374 - RNA, 22 nt, Homo sapiens
cacccggcucguguauuuauua

SEQ ID NO: 1197375 - RNA, 21 nt, Homo sapiens
cacccgugagcgccugugcac

SEQ ID NO: 1197376 - RNA, 19 nt, Homo sapiens
cacccuccccucucuugca

SEQ ID NO: 1197377 - RNA, 22 nt, Homo sapiens
cacccuccuuucaccacaugug

SEQ ID NO: 1197378 - RNA, 16 nt, Homo sapiens
cacccucuuccuguga

SEQ ID NO: 1197379 - RNA, 23 nt, Homo sapiens
cacccuggaaucaagaugucaga

SEQ ID NO: 1197380 - RNA, 14 nt, Homo sapiens
cacccugggagcca

SEQ ID NO: 1197381 - RNA, 15 nt, Homo sapiens
cacccugugccauca

SEQ ID NO: 1197382 - RNA, 22 nt, Homo sapiens
cacccuuaagaagguauuuugu

SEQ ID NO: 1197383 - RNA, 16 nt, Homo sapiens
cacccuucucauucca

SEQ ID NO: 1197384 - RNA, 19 nt, Homo sapiens
cacccuuggacaagacaaa

SEQ ID NO: 1197385 - RNA, 22 nt, Homo sapiens
cacccuuguccuugagugcucu

SEQ ID NO: 1197386 - RNA, 12 nt, Homo sapiens
caccgagaccaa

SEQ ID NO: 1197387 - RNA, 15 nt, Homo sapiens
caccgcagucaccac

SEQ ID NO: 1197388 - RNA, 18 nt, Homo sapiens
caccuaauaggcugggag

SEQ ID NO: 1197389 - RNA, 21 nt, Homo sapiens
caccuaauguuuaugagccag

SEQ ID NO: 1197390 - RNA, 22 nt, Homo sapiens
caccuaauguuuaugagccaga

SEQ ID NO: 1197391 - RNA, 21 nt, Homo sapiens
caccuaccacucacaugacac

SEQ ID NO: 1197392 - RNA, 15 nt, Homo sapiens
caccuacugcuuacu

SEQ ID NO: 1197393 - RNA, 16 nt, Homo sapiens
caccuagaacacuaac

SEQ ID NO: 1197394 - RNA, 19 nt, Homo sapiens
caccuagaacacuaacuca

SEQ ID NO: 1197395 - RNA, 16 nt, Homo sapiens
caccuagacuguaaac

SEQ ID NO: 1197396 - RNA, 12 nt, Homo sapiens
caccuagccucg

SEQ ID NO: 1197397 - RNA, 15 nt, Homo sapiens
caccuagcucaaugg

SEQ ID NO: 1197398 - RNA, 17 nt, Homo sapiens
caccuagcugugcaaga

SEQ ID NO: 1197399 - RNA, 18 nt, Homo sapiens
caccucaaagcgguuuaa

SEQ ID NO: 1197400 - RNA, 14 nt, Homo sapiens
caccucacagccag

SEQ ID NO: 1197401 - RNA, 21 nt, Homo sapiens
caccucaccucccgaagccac

SEQ ID NO: 1197402 - RNA, 13 nt, Homo sapiens
caccucauccuua

SEQ ID NO: 1197403 - RNA, 23 nt, Homo sapiens
caccuccgccagauccugcagaa

SEQ ID NO: 1197404 - RNA, 11 nt, Homo sapiens
caccuccucau

SEQ ID NO: 1197405 - RNA, 16 nt, Homo sapiens
caccuccugcaauaaa

SEQ ID NO: 1197406 - RNA, 14 nt, Homo sapiens
caccuccuggagaa

SEQ ID NO: 1197407 - RNA, 11 nt, Homo sapiens
caccucuccaa

SEQ ID NO: 1197408 - RNA, 18 nt, Homo sapiens
caccucucuguaguuuau

SEQ ID NO: 1197409 - RNA, 23 nt, Homo sapiens
caccucugauggcugaagaaugu

SEQ ID NO: 1197410 - RNA, 17 nt, Homo sapiens
caccucuuccuugaugu

SEQ ID NO: 1197411 - RNA, 19 nt, Homo sapiens
caccugacaauggcagcua

SEQ ID NO: 1197412 - RNA, 11 nt, Homo sapiens
cagcaaggugg

SEQ ID NO: 1197413 - RNA, 16 nt, Homo sapiens
cagcaaugacaucuca

SEQ ID NO: 1197414 - RNA, 17 nt, Homo sapiens
cagcaaugacaucucag

SEQ ID NO: 1197415 - RNA, 20 nt, Homo sapiens
cagcaaugacaucucagggg

SEQ ID NO: 1197416 - RNA, 17 nt, Homo sapiens
cagcaaugccauuucag

SEQ ID NO: 1197417 - RNA, 13 nt, Homo sapiens
cagcaauuccuga

SEQ ID NO: 1197418 - RNA, 20 nt, Homo sapiens
cagcaauucuccugccucag

SEQ ID NO: 1197419 - RNA, 19 nt, Homo sapiens
cagcacagagcaguggcca

SEQ ID NO: 1197420 - RNA, 15 nt, Homo sapiens
cagcacagcccaggg

SEQ ID NO: 1197421 - RNA, 16 nt, Homo sapiens
cagcacagugccugac

SEQ ID NO: 1197422 - RNA, 16 nt, Homo sapiens
cagcaccaaccacagc

SEQ ID NO: 1197423 - RNA, 11 nt, Homo sapiens
cagcacccaca

SEQ ID NO: 1197424 - RNA, 20 nt, Homo sapiens
cagcacgaguggccaguuca

SEQ ID NO: 1197425 - RNA, 16 nt, Homo sapiens
cagcacggacaauaaa

SEQ ID NO: 1197426 - RNA, 17 nt, Homo sapiens
cagcacucugaaacuga

SEQ ID NO: 1197427 - RNA, 19 nt, Homo sapiens
cagcacucugaaacugaga

SEQ ID NO: 1197428 - RNA, 20 nt, Homo sapiens
cagcacucugaaacugagaa

SEQ ID NO: 1197429 - RNA, 17 nt, Homo sapiens
cagcacuggugaacuga

SEQ ID NO: 1197430 - RNA, 12 nt, Homo sapiens
cagcacuuccau

SEQ ID NO: 1197431 - RNA, 12 nt, Homo sapiens
cagcacuuguau

SEQ ID NO: 1197432 - RNA, 12 nt, Homo sapiens
cagcacuuugac

SEQ ID NO: 1197433 - RNA, 21 nt, Homo sapiens
cagcacuuuggacauggcuca

SEQ ID NO: 1197434 - RNA, 22 nt, Homo sapiens
cagcagaaaggagaacuaucca

SEQ ID NO: 1197435 - RNA, 17 nt, Homo sapiens
cagcagaucauuuagga

SEQ ID NO: 1197436 - RNA, 16 nt, Homo sapiens
cagcagcccuaaggau

SEQ ID NO: 1197437 - RNA, 13 nt, Homo sapiens
cagcagcccucaa

SEQ ID NO: 1197438 - RNA, 16 nt, Homo sapiens
cagcagccucccugaa

SEQ ID NO: 1197439 - RNA, 16 nt, Homo sapiens
cagcaggggaggugag

SEQ ID NO: 1197440 - RNA, 15 nt, Homo sapiens
cagcaguaccaucua

SEQ ID NO: 1197441 - RNA, 17 nt, Homo sapiens
cagcagucuaguucuuu

SEQ ID NO: 1197442 - RNA, 20 nt, Homo sapiens
cagcauacauuuucuggugg

SEQ ID NO: 1197443 - RNA, 19 nt, Homo sapiens
cagcaucuaagaaguuuug

SEQ ID NO: 1197444 - RNA, 15 nt, Homo sapiens
cagcaucugcuaaua

SEQ ID NO: 1197445 - RNA, 22 nt, Homo sapiens
cagcaucuggaggagcucugca

SEQ ID NO: 1197446 - RNA, 22 nt, Homo sapiens
cagcaugaggacagaccacaga

SEQ ID NO: 1197447 - RNA, 13 nt, Homo sapiens
cagcaugccccuu

SEQ ID NO: 1197448 - RNA, 13 nt, Homo sapiens
cagcaugccugaa

SEQ ID NO: 1197449 - RNA, 12 nt, Homo sapiens
cagcauggccac

SEQ ID NO: 1197450 - RNA, 16 nt, Homo sapiens
cagcauuauucuucag

SEQ ID NO: 1197451 - RNA, 19 nt, Homo sapiens
cagcauuauucuucagaag

SEQ ID NO: 1197452 - RNA, 14 nt, Homo sapiens
cagcauugugacac

SEQ ID NO: 1197453 - RNA, 19 nt, Homo sapiens
cagcauugugacacuuccc

SEQ ID NO: 1197454 - RNA, 18 nt, Homo sapiens
cagcauuuagucuugcca

SEQ ID NO: 1197455 - RNA, 14 nt, Homo sapiens
cagcauuuccacac

SEQ ID NO: 1197456 - RNA, 14 nt, Homo sapiens
cagccacacccaga

SEQ ID NO: 1197457 - RNA, 22 nt, Homo sapiens
cagccacccugucaccuagcuc

SEQ ID NO: 1197458 - RNA, 23 nt, Homo sapiens
cagccacccugucaccuagcuca

SEQ ID NO: 1197459 - RNA, 18 nt, Homo sapiens
cagccacgggggacugac

SEQ ID NO: 1197460 - RNA, 21 nt, Homo sapiens
cagccagaggguagggcacaa

SEQ ID NO: 1197461 - RNA, 19 nt, Homo sapiens
cagccagcucccagccaca

SEQ ID NO: 1197462 - RNA, 16 nt, Homo sapiens
cagccaggacaucucu

SEQ ID NO: 1197463 - RNA, 14 nt, Homo sapiens
cagccaggccgaga

SEQ ID NO: 1197464 - RNA, 12 nt, Homo sapiens
cagccaggcuau

SEQ ID NO: 1197465 - RNA, 14 nt, Homo sapiens
cagccaggcugcca

SEQ ID NO: 1197466 - RNA, 15 nt, Homo sapiens
cagccaggcugcuaa

SEQ ID NO: 1197467 - RNA, 13 nt, Homo sapiens
cagccagggccag

SEQ ID NO: 1197468 - RNA, 17 nt, Homo sapiens
cagccagguuagccuuu

SEQ ID NO: 1197469 - RNA, 15 nt, Homo sapiens
cagccagucuugccu

SEQ ID NO: 1197470 - RNA, 14 nt, Homo sapiens
cagccagugccauu

SEQ ID NO: 1197471 - RNA, 17 nt, Homo sapiens
cagccagugccauucca

SEQ ID NO: 1197472 - RNA, 23 nt, Homo sapiens
cagccagugccauuccacuccac

SEQ ID NO: 1197473 - RNA, 18 nt, Homo sapiens
cagccauaagaaagcacu

SEQ ID NO: 1197474 - RNA, 14 nt, Homo sapiens
cagccauacaaaua

SEQ ID NO: 1197475 - RNA, 17 nt, Homo sapiens
cagccaucguccuggga

SEQ ID NO: 1197476 - RNA, 21 nt, Homo sapiens
cagccaugaaacugacucauc

SEQ ID NO: 1197477 - RNA, 15 nt, Homo sapiens
cagccaugcccuuga

SEQ ID NO: 1197478 - RNA, 23 nt, Homo sapiens
cagccaugugccuuaguguccuu

SEQ ID NO: 1197479 - RNA, 19 nt, Homo sapiens
cagcccagacccaguggac

SEQ ID NO: 1197480 - RNA, 21 nt, Homo sapiens
cagcccagagacuuuguagau

SEQ ID NO: 1197481 - RNA, 21 nt, Homo sapiens
cagcccagauggcacucagcg

SEQ ID NO: 1197482 - RNA, 13 nt, Homo sapiens
cagcccagggugg

SEQ ID NO: 1197483 - RNA, 21 nt, Homo sapiens
cagcccauggcccugugcuaa

SEQ ID NO: 1197484 - RNA, 15 nt, Homo sapiens
cagcccauggcuuua

SEQ ID NO: 1197485 - RNA, 14 nt, Homo sapiens
cagcccaugugcac

SEQ ID NO: 1197486 - RNA, 23 nt, Homo sapiens
cagccccuagaaacccaagcucc

SEQ ID NO: 1197487 - RNA, 21 nt, Homo sapiens
cagccccuuauuugcacuuca

SEQ ID NO: 1197488 - RNA, 16 nt, Homo sapiens
cagcccucaacaggcc

SEQ ID NO: 1197489 - RNA, 14 nt, Homo sapiens
cagcccugccuugc

SEQ ID NO: 1197490 - RNA, 13 nt, Homo sapiens
cagcccugcugca

SEQ ID NO: 1197491 - RNA, 12 nt, Homo sapiens
cagcccuggauu

SEQ ID NO: 1197492 - RNA, 19 nt, Homo sapiens
cagcccugugugugucacc

SEQ ID NO: 1197493 - RNA, 19 nt, Homo sapiens
cagccgccugaaagccaca

SEQ ID NO: 1197494 - RNA, 15 nt, Homo sapiens
cagccuacuuuucag

SEQ ID NO: 1197495 - RNA, 17 nt, Homo sapiens
cagccuaggcagaggcu

SEQ ID NO: 1197496 - RNA, 13 nt, Homo sapiens
cagccucaagucu

SEQ ID NO: 1197497 - RNA, 22 nt, Homo sapiens
cagccucagcugggaacaugug

SEQ ID NO: 1197498 - RNA, 16 nt, Homo sapiens
cagccuccccgugcca

SEQ ID NO: 1197499 - RNA, 18 nt, Homo sapiens
cagccuccccgugccaaa

SEQ ID NO: 1197500 - RNA, 19 nt, Homo sapiens
cagccucccuaguagcugg

SEQ ID NO: 1197501 - RNA, 19 nt, Homo sapiens
cagccucuagcaccaggac

SEQ ID NO: 1197502 - RNA, 14 nt, Homo sapiens
cagccugauggcca

SEQ ID NO: 1197503 - RNA, 19 nt, Homo sapiens
cagccugcagcaagugcuu

SEQ ID NO: 1197504 - RNA, 14 nt, Homo sapiens
cagccugcucccua

SEQ ID NO: 1197505 - RNA, 23 nt, Homo sapiens
cagccugcucccuagccagaggc

SEQ ID NO: 1197506 - RNA, 19 nt, Homo sapiens
cagccugcuucccaccucc

SEQ ID NO: 1197507 - RNA, 19 nt, Homo sapiens
cagccuggaaaccuacaga

SEQ ID NO: 1197508 - RNA, 19 nt, Homo sapiens
cagccugggcaacauagua

SEQ ID NO: 1197509 - RNA, 21 nt, Homo sapiens
cagccuggucaacauggugaa

SEQ ID NO: 1197510 - RNA, 16 nt, Homo sapiens
cagccuguccaacaga

SEQ ID NO: 1197511 - RNA, 20 nt, Homo sapiens
cagccugugguuacagugca

SEQ ID NO: 1197512 - RNA, 16 nt, Homo sapiens
cagccuuaugauuaaa

SEQ ID NO: 1197513 - RNA, 16 nt, Homo sapiens
cagccuucuccaggac

SEQ ID NO: 1197514 - RNA, 23 nt, Homo sapiens
cagccuugaugccauaugccuug

SEQ ID NO: 1197515 - RNA, 23 nt, Homo sapiens
cagccuuuggccuuggcuuuucu

SEQ ID NO: 1197516 - RNA, 17 nt, Homo sapiens
cagcgaaugaaugcugu

SEQ ID NO: 1197517 - RNA, 18 nt, Homo sapiens
cagcgaaugaaugcugua

SEQ ID NO: 1197518 - RNA, 18 nt, Homo sapiens
cagcgacugccacaucau

SEQ ID NO: 1197519 - RNA, 21 nt, Homo sapiens
cagcgagcuaugaucgcgcca

SEQ ID NO: 1197520 - RNA, 21 nt, Homo sapiens
cagcgcagcuggacucugcau

SEQ ID NO: 1197521 - RNA, 15 nt, Homo sapiens
cagcgcuucuaugca

SEQ ID NO: 1197522 - RNA, 18 nt, Homo sapiens
cagcuaacaaacuagaaa

SEQ ID NO: 1197523 - RNA, 17 nt, Homo sapiens
cagcuaaguguggagcu

SEQ ID NO: 1197524 - RNA, 18 nt, Homo sapiens
cagcuaaguguggagcug

SEQ ID NO: 1197525 - RNA, 14 nt, Homo sapiens
cagcuaaugggaca

SEQ ID NO: 1197526 - RNA, 16 nt, Homo sapiens
cagcuacaaauuugag

SEQ ID NO: 1197527 - RNA, 14 nt, Homo sapiens
cagcuagugccuuu

SEQ ID NO: 1197528 - RNA, 19 nt, Homo sapiens
cagcuauuuucaacauaac

SEQ ID NO: 1197529 - RNA, 23 nt, Homo sapiens
cagcucaacggaagaggcugcug

SEQ ID NO: 1197530 - RNA, 13 nt, Homo sapiens
cagcuccagugcc

SEQ ID NO: 1197531 - RNA, 17 nt, Homo sapiens
cagcucccauuucauca

SEQ ID NO: 1197532 - RNA, 16 nt, Homo sapiens
cagcucccugccaaac

SEQ ID NO: 1197533 - RNA, 19 nt, Homo sapiens
cagcucuaccaguucucgu

SEQ ID NO: 1197534 - RNA, 14 nt, Homo sapiens
cagcucuccaauac

SEQ ID NO: 1197535 - RNA, 22 nt, Homo sapiens
cagcugaaagauugauuaauga

SEQ ID NO: 1197536 - RNA, 19 nt, Homo sapiens
cagcugaccagacacugcc

SEQ ID NO: 1197537 - RNA, 15 nt, Homo sapiens
cagcugauugggcac

SEQ ID NO: 1197538 - RNA, 21 nt, Homo sapiens
cccccgggacugggcuaggag

SEQ ID NO: 1197539 - RNA, 12 nt, Homo sapiens
cccccuugaggg

SEQ ID NO: 1197540 - RNA, 16 nt, Homo sapiens
ccccgccuuccugggc

SEQ ID NO: 1197541 - RNA, 14 nt, Homo sapiens
ccccgggcaucuuu

SEQ ID NO: 1197542 - RNA, 22 nt, Homo sapiens
ccccguguccucucccugccaa

SEQ ID NO: 1197543 - RNA, 15 nt, Homo sapiens
ccccuaauagccuuu

SEQ ID NO: 1197544 - RNA, 13 nt, Homo sapiens
ccccuacucccuc

SEQ ID NO: 1197545 - RNA, 19 nt, Homo sapiens
ccccucaaacucauugcag

SEQ ID NO: 1197546 - RNA, 17 nt, Homo sapiens
ccccucacaauccuugc

SEQ ID NO: 1197547 - RNA, 17 nt, Homo sapiens
ccccucacacuuugcca

SEQ ID NO: 1197548 - RNA, 20 nt, Homo sapiens
ccccucauuguuuauuaaca

SEQ ID NO: 1197549 - RNA, 21 nt, Homo sapiens
ccccucccaucauuacccuuc

SEQ ID NO: 1197550 - RNA, 13 nt, Homo sapiens
ccccucucaccaa

SEQ ID NO: 1197551 - RNA, 18 nt, Homo sapiens
ccccugaccucacuguga

SEQ ID NO: 1197552 - RNA, 21 nt, Homo sapiens
ccccugcucaguaaagcacuu

SEQ ID NO: 1197553 - RNA, 18 nt, Homo sapiens
ccccugcuccaccagcag

SEQ ID NO: 1197554 - RNA, 23 nt, Homo sapiens
ccccuggaaugggcacagcacag

SEQ ID NO: 1197555 - RNA, 16 nt, Homo sapiens
ccccuggcugugcucu

SEQ ID NO: 1197556 - RNA, 16 nt, Homo sapiens
ccccugggauggcuca

SEQ ID NO: 1197557 - RNA, 16 nt, Homo sapiens
ccccuguacauuugug

SEQ ID NO: 1197558 - RNA, 20 nt, Homo sapiens
ccccugugcccugcacguau

SEQ ID NO: 1197559 - RNA, 20 nt, Homo sapiens
ccccuugguacugaaaauga

SEQ ID NO: 1197560 - RNA, 16 nt, Homo sapiens
cccgacagugccaucc

SEQ ID NO: 1197561 - RNA, 19 nt, Homo sapiens
cccgaggaggggcccggug

SEQ ID NO: 1197562 - RNA, 18 nt, Homo sapiens
cccgaugcugcuauggaa

SEQ ID NO: 1197563 - RNA, 20 nt, Homo sapiens
cccgcacccccgcacccuua

SEQ ID NO: 1197564 - RNA, 21 nt, Homo sapiens
cccgcagugcugggaccagag

SEQ ID NO: 1197565 - RNA, 22 nt, Homo sapiens
cccgcagugcugggaccagagc

SEQ ID NO: 1197566 - RNA, 17 nt, Homo sapiens
cccgccaugcucaggag

SEQ ID NO: 1197567 - RNA, 18 nt, Homo sapiens
cccgcccacccuccugac

SEQ ID NO: 1197568 - RNA, 22 nt, Homo sapiens
cccgccucuucuucuucagaag

SEQ ID NO: 1197569 - RNA, 23 nt, Homo sapiens
cccgcugggauuucuucgcugcu

SEQ ID NO: 1197570 - RNA, 19 nt, Homo sapiens
cccggaugugaauggcaug

SEQ ID NO: 1197571 - RNA, 17 nt, Homo sapiens
cccggccagcgggcaca

SEQ ID NO: 1197572 - RNA, 17 nt, Homo sapiens
cccggcgccgggcacca

SEQ ID NO: 1197573 - RNA, 23 nt, Homo sapiens
cccgggacgcagggguugcagug

SEQ ID NO: 1197574 - RNA, 21 nt, Homo sapiens
cccggggcggcaggaaggggg

SEQ ID NO: 1197575 - RNA, 15 nt, Homo sapiens
cccguacuagguugg

SEQ ID NO: 1197576 - RNA, 18 nt, Homo sapiens
cccgucgaggggcucuca

SEQ ID NO: 1197577 - RNA, 11 nt, Homo sapiens
cccgugacugc

SEQ ID NO: 1197578 - RNA, 17 nt, Homo sapiens
cccgugcagcuuccaaa

SEQ ID NO: 1197579 - RNA, 15 nt, Homo sapiens
cccguuuccauacag

SEQ ID NO: 1197580 - RNA, 14 nt, Homo sapiens
cccguuucuugccc

SEQ ID NO: 1197581 - RNA, 15 nt, Homo sapiens
cccuaaacucaggag

SEQ ID NO: 1197582 - RNA, 20 nt, Homo sapiens
cccuaaucuuucacuugaaa

SEQ ID NO: 1197583 - RNA, 13 nt, Homo sapiens
cccuacaaaggcu

SEQ ID NO: 1197584 - RNA, 22 nt, Homo sapiens
cccuaccguccuccugagccac

SEQ ID NO: 1197585 - RNA, 15 nt, Homo sapiens
cccuacucaccugag

SEQ ID NO: 1197586 - RNA, 20 nt, Homo sapiens
cccuacucccucuucacugu

SEQ ID NO: 1197587 - RNA, 22 nt, Homo sapiens
cccuacucccugcagaugccac

SEQ ID NO: 1197588 - RNA, 23 nt, Homo sapiens
cccuacuuugcuuccgccacuca

SEQ ID NO: 1197589 - RNA, 15 nt, Homo sapiens
cccuagaccauguca

SEQ ID NO: 1197590 - RNA, 17 nt, Homo sapiens
cccuagcauugcacuug

SEQ ID NO: 1197591 - RNA, 14 nt, Homo sapiens
cccuaggaacucag

SEQ ID NO: 1197592 - RNA, 12 nt, Homo sapiens
cccuauggugcu

SEQ ID NO: 1197593 - RNA, 21 nt, Homo sapiens
cccucaccuguagcagccagu

SEQ ID NO: 1197594 - RNA, 14 nt, Homo sapiens
cccucacucugcca

SEQ ID NO: 1197595 - RNA, 10 nt, Homo sapiens
cccucaggcu

SEQ ID NO: 1197596 - RNA, 13 nt, Homo sapiens
cccucaucuugaa

SEQ ID NO: 1197597 - RNA, 14 nt, Homo sapiens
cccuccaaaagcac

SEQ ID NO: 1197598 - RNA, 15 nt, Homo sapiens
cccuccaaaagcacu

SEQ ID NO: 1197599 - RNA, 12 nt, Homo sapiens
cccuccaaagag

SEQ ID NO: 1197600 - RNA, 14 nt, Homo sapiens
cccuccacauccca

SEQ ID NO: 1197601 - RNA, 22 nt, Homo sapiens
cccuccacgugauuuccaguga

SEQ ID NO: 1197602 - RNA, 15 nt, Homo sapiens
cccuccccagagcac

SEQ ID NO: 1197603 - RNA, 15 nt, Homo sapiens
cccuccccugccauu

SEQ ID NO: 1197604 - RNA, 23 nt, Homo sapiens
cccucccuggaugacauuaaaga

SEQ ID NO: 1197605 - RNA, 13 nt, Homo sapiens
cccuccucaguga

SEQ ID NO: 1197606 - RNA, 13 nt, Homo sapiens
cccuccugcuccu

SEQ ID NO: 1197607 - RNA, 19 nt, Homo sapiens
cccuccugugcugggggaa

SEQ ID NO: 1197608 - RNA, 17 nt, Homo sapiens
cccuccuugggcacuuu

SEQ ID NO: 1197609 - RNA, 13 nt, Homo sapiens
cccucgacacuca

SEQ ID NO: 1197610 - RNA, 19 nt, Homo sapiens
cccucgggccccauccuca

SEQ ID NO: 1197611 - RNA, 13 nt, Homo sapiens
cccucuauuuauu

SEQ ID NO: 1197612 - RNA, 21 nt, Homo sapiens
cccucuccugcccagaugccc

SEQ ID NO: 1197613 - RNA, 16 nt, Homo sapiens
cccucucucaguguca

SEQ ID NO: 1197614 - RNA, 21 nt, Homo sapiens
cccucugcagaacagugaaag

SEQ ID NO: 1197615 - RNA, 15 nt, Homo sapiens
cccucugucuuguga

SEQ ID NO: 1197616 - RNA, 15 nt, Homo sapiens
cccucuuccugugau

SEQ ID NO: 1197617 - RNA, 23 nt, Homo sapiens
cccugaaacacgaaacuuguuau

SEQ ID NO: 1197618 - RNA, 22 nt, Homo sapiens
cccugacucucugugaccugcc

SEQ ID NO: 1197619 - RNA, 17 nt, Homo sapiens
cccugacuggccaaacc

SEQ ID NO: 1197620 - RNA, 17 nt, Homo sapiens
cccugaggguggcugcc

SEQ ID NO: 1197621 - RNA, 19 nt, Homo sapiens
cccugaugugacauuccau

SEQ ID NO: 1197622 - RNA, 20 nt, Homo sapiens
cccugcaaacagaacagggu

SEQ ID NO: 1197623 - RNA, 17 nt, Homo sapiens
cccugcacuaaagccag

SEQ ID NO: 1197624 - RNA, 17 nt, Homo sapiens
cccugcaguuugagaca

SEQ ID NO: 1197625 - RNA, 17 nt, Homo sapiens
cccugcauuucugaguu

SEQ ID NO: 1197626 - RNA, 14 nt, Homo sapiens
cccugccacucuca

SEQ ID NO: 1197627 - RNA, 15 nt, Homo sapiens
cccugcccaaugaga

SEQ ID NO: 1197628 - RNA, 20 nt, Homo sapiens
cccugcgcaugaaccuggac

SEQ ID NO: 1197629 - RNA, 13 nt, Homo sapiens
cccugcucccaca

SEQ ID NO: 1197630 - RNA, 19 nt, Homo sapiens
cccugcuccucccuggcug

SEQ ID NO: 1197631 - RNA, 20 nt, Homo sapiens
cccuggcagcagcaggugug

SEQ ID NO: 1197632 - RNA, 18 nt, Homo sapiens
cccuggcagcaugacuca

SEQ ID NO: 1197633 - RNA, 22 nt, Homo sapiens
cccuggcccugccucauccacc

SEQ ID NO: 1197634 - RNA, 20 nt, Homo sapiens
cccuggcuccucuacuguuu

SEQ ID NO: 1197635 - RNA, 14 nt, Homo sapiens
cccuggcugacugg

SEQ ID NO: 1197636 - RNA, 17 nt, Homo sapiens
cccuggcugacuggcca

SEQ ID NO: 1197637 - RNA, 16 nt, Homo sapiens
cccuggcugugcucua

SEQ ID NO: 1197638 - RNA, 15 nt, Homo sapiens
cccugggauggcuca

SEQ ID NO: 1197639 - RNA, 20 nt, Homo sapiens
cccugggggcugugauauua

SEQ ID NO: 1197640 - RNA, 20 nt, Homo sapiens
cccuggggggacuucccaaa

SEQ ID NO: 1197641 - RNA, 14 nt, Homo sapiens
cccugggguggcca

SEQ ID NO: 1197642 - RNA, 20 nt, Homo sapiens
cccugggguggccaccagua

SEQ ID NO: 1197643 - RNA, 19 nt, Homo sapiens
cccugggguuugaagcuga

SEQ ID NO: 1197644 - RNA, 18 nt, Homo sapiens
cccuggguuucaugagcu

SEQ ID NO: 1197645 - RNA, 14 nt, Homo sapiens
cccuggugguggau

SEQ ID NO: 1197646 - RNA, 15 nt, Homo sapiens
cccugguguguuucc

SEQ ID NO: 1197647 - RNA, 19 nt, Homo sapiens
cccuguagacuagugccgu

SEQ ID NO: 1197648 - RNA, 14 nt, Homo sapiens
cccuguaugauucc

SEQ ID NO: 1197649 - RNA, 14 nt, Homo sapiens
cccuguauuaccuc

SEQ ID NO: 1197650 - RNA, 12 nt, Homo sapiens
cccuguccccaa

SEQ ID NO: 1197651 - RNA, 19 nt, Homo sapiens
cccuguccuaagcacuuua

SEQ ID NO: 1197652 - RNA, 15 nt, Homo sapiens
cccuguccugugaau

SEQ ID NO: 1197653 - RNA, 16 nt, Homo sapiens
cccugucucccaaaaa

SEQ ID NO: 1197654 - RNA, 12 nt, Homo sapiens
cccugucugcuu

SEQ ID NO: 1197655 - RNA, 15 nt, Homo sapiens
cccugugccaucacc

SEQ ID NO: 1197656 - RNA, 23 nt, Homo sapiens
cccugugguccccgagacacagg

SEQ ID NO: 1197657 - RNA, 18 nt, Homo sapiens
cccuguucaugugccucu

SEQ ID NO: 1197658 - RNA, 13 nt, Homo sapiens
cccuuaaggacaa

SEQ ID NO: 1197659 - RNA, 20 nt, Homo sapiens
cccuuaaggguugaaggcag

SEQ ID NO: 1197660 - RNA, 13 nt, Homo sapiens
cccuucacacccc

SEQ ID NO: 1197661 - RNA, 17 nt, Homo sapiens
cccuucacauacccucc

SEQ ID NO: 1197662 - RNA, 20 nt, Homo sapiens
cccuucaguacccucucagc

SEQ ID NO: 1197663 - RNA, 21 nt, Homo sapiens
cccuucccugcacuaaagcca

SEQ ID NO: 1197664 - RNA, 22 nt, Homo sapiens
cccuuccuggaaacagcaugaa

SEQ ID NO: 1197665 - RNA, 14 nt, Homo sapiens
cccuucggcagcua

SEQ ID NO: 1197666 - RNA, 17 nt, Homo sapiens
cccuugagcuacuucaa

SEQ ID NO: 1197667 - RNA, 13 nt, Homo sapiens
cccuugcagcuag

SEQ ID NO: 1197668 - RNA, 15 nt, Homo sapiens
cccuugccaucacac

SEQ ID NO: 1197669 - RNA, 13 nt, Homo sapiens
cccuugcugcuuu

SEQ ID NO: 1197670 - RNA, 16 nt, Homo sapiens
cccuuggcggggagaa

SEQ ID NO: 1197671 - RNA, 18 nt, Homo sapiens
cccuuggcuucugugaug

SEQ ID NO: 1197672 - RNA, 18 nt, Homo sapiens
cccuuguacaaccgacag

SEQ ID NO: 1197673 - RNA, 21 nt, Homo sapiens
cccuugugagagcccauuccc

SEQ ID NO: 1197674 - RNA, 17 nt, Homo sapiens
cccuuuacaaugugaau

SEQ ID NO: 1197675 - RNA, 21 nt, Homo sapiens
cccuuuccuccucaggcacac

SEQ ID NO: 1197676 - RNA, 15 nt, Homo sapiens
cccuuugaagccuca

SEQ ID NO: 1197677 - RNA, 19 nt, Homo sapiens
cccuuugaugauuaauuca

SEQ ID NO: 1197678 - RNA, 12 nt, Homo sapiens
cccuuuuacuuu

SEQ ID NO: 1197679 - RNA, 14 nt, Homo sapiens
cccuuuuucaauga

SEQ ID NO: 1197680 - RNA, 18 nt, Homo sapiens
cccuuuuuuuacauuuca

SEQ ID NO: 1197681 - RNA, 13 nt, Homo sapiens
ccgaaugugcagg

SEQ ID NO: 1197682 - RNA, 12 nt, Homo sapiens
ccgacaucacag

SEQ ID NO: 1197683 - RNA, 19 nt, Homo sapiens
ccgagcucuccuuguuacc

SEQ ID NO: 1197684 - RNA, 19 nt, Homo sapiens
ccgaguccccgggcaucuu

SEQ ID NO: 1197685 - RNA, 16 nt, Homo sapiens
ccgagucuugcucugu

SEQ ID NO: 1197686 - RNA, 11 nt, Homo sapiens
ccgagugcaau

SEQ ID NO: 1197687 - RNA, 12 nt, Homo sapiens
ccgauaccaugc

SEQ ID NO: 1197688 - RNA, 17 nt, Homo sapiens
ccgauguggaccucuac

SEQ ID NO: 1197689 - RNA, 14 nt, Homo sapiens
ccgcaccgcuggga

SEQ ID NO: 1197690 - RNA, 14 nt, Homo sapiens
ccgcagaauggacu

SEQ ID NO: 1197691 - RNA, 18 nt, Homo sapiens
ccgcagugggaagugaau

SEQ ID NO: 1197692 - RNA, 14 nt, Homo sapiens
ccgcaugugaucuc

SEQ ID NO: 1197693 - RNA, 15 nt, Homo sapiens
ccgcauuggugacuc

SEQ ID NO: 1197694 - RNA, 21 nt, Homo sapiens
ccgccauugccaccaggagaa

SEQ ID NO: 1197695 - RNA, 16 nt, Homo sapiens
ccgcccucuuccugac

SEQ ID NO: 1197696 - RNA, 18 nt, Homo sapiens
ccgccuccaaaugccaac

SEQ ID NO: 1197697 - RNA, 18 nt, Homo sapiens
ccgccuuccuggagaccc

SEQ ID NO: 1197698 - RNA, 15 nt, Homo sapiens
ccgcuccaaugccua

SEQ ID NO: 1197699 - RNA, 15 nt, Homo sapiens
ccgcuuggcacauga

SEQ ID NO: 1197700 - RNA, 16 nt, Homo sapiens
ccgcuuguggggaccc

SEQ ID NO: 1197701 - RNA, 21 nt, Homo sapiens
ccggaaggaggccaaccagcc

SEQ ID NO: 1197702 - RNA, 23 nt, Homo sapiens
ccggaauccuuggggagcacuug

SEQ ID NO: 1197703 - RNA, 19 nt, Homo sapiens
ccggcaacaucucugggaa

SEQ ID NO: 1197704 - RNA, 19 nt, Homo sapiens
ccggcacacugccaaauaa

SEQ ID NO: 1197705 - RNA, 16 nt, Homo sapiens
ccggcugaaggcugag

SEQ ID NO: 1197706 - RNA, 14 nt, Homo sapiens
ccggcuguggagca

SEQ ID NO: 1197707 - RNA, 18 nt, Homo sapiens
ccgggaaacauagccuca

SEQ ID NO: 1197708 - RNA, 22 nt, Homo sapiens
ccgggaagcggagguugcaggg

SEQ ID NO: 1197709 - RNA, 14 nt, Homo sapiens
ccgggacgcagggg

SEQ ID NO: 1197710 - RNA, 21 nt, Homo sapiens
ccgggacuucaaagccgugau

SEQ ID NO: 1197711 - RNA, 15 nt, Homo sapiens
ccgggcuggagaaag

SEQ ID NO: 1197712 - RNA, 20 nt, Homo sapiens
ccgggcugggagcucugcag

SEQ ID NO: 1197713 - RNA, 15 nt, Homo sapiens
ccggggaagcugcca

SEQ ID NO: 1197714 - RNA, 13 nt, Homo sapiens
ccggggaagggaa

SEQ ID NO: 1197715 - RNA, 16 nt, Homo sapiens
ccggggccagcacuuc

SEQ ID NO: 1197716 - RNA, 21 nt, Homo sapiens
ccguaccucuucccaugacug

SEQ ID NO: 1197717 - RNA, 23 nt, Homo sapiens
ccgucagccaaauguaauugaau

SEQ ID NO: 1197718 - RNA, 15 nt, Homo sapiens
ccguccucacccauc

SEQ ID NO: 1197719 - RNA, 22 nt, Homo sapiens
ccguccucaccccuguccucac

SEQ ID NO: 1197720 - RNA, 21 nt, Homo sapiens
ccgucuuggcuuauccacuuu

SEQ ID NO: 1197721 - RNA, 21 nt, Homo sapiens
ccgugagugaaccaucauuau

SEQ ID NO: 1197722 - RNA, 16 nt, Homo sapiens
ccgugccugagcugca

SEQ ID NO: 1197723 - RNA, 19 nt, Homo sapiens
ccguguuacuguugcacug

SEQ ID NO: 1197724 - RNA, 15 nt, Homo sapiens
ccguuuccaagcugc

SEQ ID NO: 1197725 - RNA, 11 nt, Homo sapiens
ccguuuugccu

SEQ ID NO: 1197726 - RNA, 14 nt, Homo sapiens
ccuaaaaaaagaga

SEQ ID NO: 1197727 - RNA, 21 nt, Homo sapiens
ccuaaaaguuacuuaccacag

SEQ ID NO: 1197728 - RNA, 22 nt, Homo sapiens
ccuaaagaaugcaaccuaguca

SEQ ID NO: 1197729 - RNA, 23 nt, Homo sapiens
ccuaaagggcagggcccacgugu

SEQ ID NO: 1197730 - RNA, 19 nt, Homo sapiens
ccuaaauaauguuaucugu

SEQ ID NO: 1197731 - RNA, 14 nt, Homo sapiens
ccuaaauauaauua

SEQ ID NO: 1197732 - RNA, 21 nt, Homo sapiens
ccuaacauucgaucucauuca

SEQ ID NO: 1197733 - RNA, 15 nt, Homo sapiens
ccuaaccccuuccag

SEQ ID NO: 1197734 - RNA, 14 nt, Homo sapiens
ccuaagagauuuau

SEQ ID NO: 1197735 - RNA, 11 nt, Homo sapiens
ccuaagcacuu

SEQ ID NO: 1197736 - RNA, 20 nt, Homo sapiens
ccuaaggacaagacacugag

SEQ ID NO: 1197737 - RNA, 18 nt, Homo sapiens
ccuaaggacacacuaauc

SEQ ID NO: 1197738 - RNA, 17 nt, Homo sapiens
ccuaaggcacccacaaa

SEQ ID NO: 1197739 - RNA, 15 nt, Homo sapiens
ccuaagggagugucu

SEQ ID NO: 1197740 - RNA, 23 nt, Homo sapiens
ccuaagggaguguuugugucuga

SEQ ID NO: 1197741 - RNA, 19 nt, Homo sapiens
ccuaaguaaguuucuuccu

SEQ ID NO: 1197742 - RNA, 15 nt, Homo sapiens
ccuaauaucaauuug

SEQ ID NO: 1197743 - RNA, 12 nt, Homo sapiens
ccuaaucuucca

SEQ ID NO: 1197744 - RNA, 16 nt, Homo sapiens
ccuaauguguuuagau

SEQ ID NO: 1197745 - RNA, 22 nt, Homo sapiens
ccuacacaaaauacagcacuuu

SEQ ID NO: 1197746 - RNA, 19 nt, Homo sapiens
ccuacacccagaccccagg

SEQ ID NO: 1197747 - RNA, 18 nt, Homo sapiens
ccuacaccucuugaaaau

SEQ ID NO: 1197748 - RNA, 15 nt, Homo sapiens
ccuacagagcagcca

SEQ ID NO: 1197749 - RNA, 23 nt, Homo sapiens
ccuacagucaucugccaccacac

SEQ ID NO: 1197750 - RNA, 15 nt, Homo sapiens
ccuacauuaucucac

SEQ ID NO: 1197751 - RNA, 15 nt, Homo sapiens
ccuaccaggacagaa

SEQ ID NO: 1197752 - RNA, 19 nt, Homo sapiens
ccuacccaccgauggagcc

SEQ ID NO: 1197753 - RNA, 15 nt, Homo sapiens
ccuacccuucccgcc

SEQ ID NO: 1197754 - RNA, 21 nt, Homo sapiens
ccuaccuuagaaaacaaguau

SEQ ID NO: 1197755 - RNA, 14 nt, Homo sapiens
ccuacucuguguca

SEQ ID NO: 1197756 - RNA, 15 nt, Homo sapiens
ccuacugcuuacugu

SEQ ID NO: 1197757 - RNA, 23 nt, Homo sapiens
ccuacuguucggacaaaaaaagu

SEQ ID NO: 1197758 - RNA, 16 nt, Homo sapiens
ccuacuuugacuuuuu

SEQ ID NO: 1197759 - RNA, 11 nt, Homo sapiens
ccuacuuuuca

SEQ ID NO: 1197760 - RNA, 14 nt, Homo sapiens
ccuagaaagacaga

SEQ ID NO: 1197761 - RNA, 14 nt, Homo sapiens
ccuagaacuuuguu

SEQ ID NO: 1197762 - RNA, 20 nt, Homo sapiens
ccuagacucugucuaccugg

SEQ ID NO: 1197763 - RNA, 12 nt, Homo sapiens
ccuagacuguua

SEQ ID NO: 1197764 - RNA, 13 nt, Homo sapiens
ccuagacuugaaa

SEQ ID NO: 1197765 - RNA, 22 nt, Homo sapiens
ccuagacuuugggaucaaauaa

SEQ ID NO: 1197766 - RNA, 11 nt, Homo sapiens
ccuagccagag

SEQ ID NO: 1197767 - RNA, 18 nt, Homo sapiens
ccuagccagaggcucuaa

SEQ ID NO: 1197768 - RNA, 21 nt, Homo sapiens
ccuagcugguagcauaaauaa

SEQ ID NO: 1197769 - RNA, 14 nt, Homo sapiens
ccuaggcagaucac

SEQ ID NO: 1197770 - RNA, 15 nt, Homo sapiens
ccuaggcuaccucaa

SEQ ID NO: 1197771 - RNA, 16 nt, Homo sapiens
ccuagguucacuuugg

SEQ ID NO: 1197772 - RNA, 20 nt, Homo sapiens
ccuagucuuuuaaacaguuu

SEQ ID NO: 1197773 - RNA, 21 nt, Homo sapiens
ccuaguuugaccucacaguga

SEQ ID NO: 1197774 - RNA, 17 nt, Homo sapiens
ccuauaaucuuauacaa

SEQ ID NO: 1197775 - RNA, 13 nt, Homo sapiens
ccuauacauuaua

SEQ ID NO: 1197776 - RNA, 19 nt, Homo sapiens
ccuauauuguuuucagugu

SEQ ID NO: 1197777 - RNA, 14 nt, Homo sapiens
ccuaucaagcacua

SEQ ID NO: 1197778 - RNA, 18 nt, Homo sapiens
ccuaucagaagcucccag

SEQ ID NO: 1197779 - RNA, 21 nt, Homo sapiens
ccuaucauuuccguuuugccu

SEQ ID NO: 1197780 - RNA, 22 nt, Homo sapiens
ccuaugaaguuggcacauuuca

SEQ ID NO: 1197781 - RNA, 16 nt, Homo sapiens
ccuauucuauugcagu

SEQ ID NO: 1197782 - RNA, 22 nt, Homo sapiens
ccuauuggaagcauacaaagca

SEQ ID NO: 1197783 - RNA, 22 nt, Homo sapiens
ccuauugggagaggucauaaaa

SEQ ID NO: 1197784 - RNA, 20 nt, Homo sapiens
ccuauuuccauucaacaaga

SEQ ID NO: 1197785 - RNA, 12 nt, Homo sapiens
ccuauuugccau

SEQ ID NO: 1197786 - RNA, 19 nt, Homo sapiens
ccuauuuuuguaaacugga

SEQ ID NO: 1197787 - RNA, 20 nt, Homo sapiens
ccucaaccccuccccuccau

SEQ ID NO: 1197788 - RNA, 19 nt, Homo sapiens
ccucaacuauucuguucca

SEQ ID NO: 1197789 - RNA, 17 nt, Homo sapiens
ccucaagacucaccuca

SEQ ID NO: 1197790 - RNA, 21 nt, Homo sapiens
ccuuucucagccacaaaauaa

SEQ ID NO: 1197791 - RNA, 14 nt, Homo sapiens
ccuuucucauccca

SEQ ID NO: 1197792 - RNA, 20 nt, Homo sapiens
ccuuucuccaggaccaauaa

SEQ ID NO: 1197793 - RNA, 21 nt, Homo sapiens
ccuuucucuccagccugacuu

SEQ ID NO: 1197794 - RNA, 24 nt, Homo sapiens
ccuuucucucuccucucugcuuca

SEQ ID NO: 1197795 - RNA, 21 nt, Homo sapiens
ccuuucugaggacaccaguga

SEQ ID NO: 1197796 - RNA, 20 nt, Homo sapiens
ccuuucuugagggaguucaa

SEQ ID NO: 1197797 - RNA, 22 nt, Homo sapiens
ccuuugagcaagccgagcucuc

SEQ ID NO: 1197798 - RNA, 23 nt, Homo sapiens
ccuuugagcccacaaagccuuau

SEQ ID NO: 1197799 - RNA, 17 nt, Homo sapiens
ccuuugauucuccagua

SEQ ID NO: 1197800 - RNA, 12 nt, Homo sapiens
ccuuugccagug

SEQ ID NO: 1197801 - RNA, 13 nt, Homo sapiens
ccuuugccuucca

SEQ ID NO: 1197802 - RNA, 19 nt, Homo sapiens
ccuuugccuuccaccccca

SEQ ID NO: 1197803 - RNA, 17 nt, Homo sapiens
ccuuugcucuugccaaa

SEQ ID NO: 1197804 - RNA, 16 nt, Homo sapiens
ccuuugcuucaaauaa

SEQ ID NO: 1197805 - RNA, 17 nt, Homo sapiens
ccuuugcuucaaauuca

SEQ ID NO: 1197806 - RNA, 16 nt, Homo sapiens
ccuuuggaaagccauu

SEQ ID NO: 1197807 - RNA, 16 nt, Homo sapiens
ccuuugggacuaagcu

SEQ ID NO: 1197808 - RNA, 18 nt, Homo sapiens
ccuuugugguuacaguuu

SEQ ID NO: 1197809 - RNA, 19 nt, Homo sapiens
ccuuuguguagaaagccaa

SEQ ID NO: 1197810 - RNA, 18 nt, Homo sapiens
ccuuuguguauucaucuu

SEQ ID NO: 1197811 - RNA, 16 nt, Homo sapiens
ccuuuguugcacaaau

SEQ ID NO: 1197812 - RNA, 21 nt, Homo sapiens
ccuuuuaauggaugguugaau

SEQ ID NO: 1197813 - RNA, 20 nt, Homo sapiens
ccuuuuacaauuguugaaau

SEQ ID NO: 1197814 - RNA, 15 nt, Homo sapiens
ccuuuuacucagcuu

SEQ ID NO: 1197815 - RNA, 23 nt, Homo sapiens
ccuuuuauuuuuuaagguaacaa

SEQ ID NO: 1197816 - RNA, 16 nt, Homo sapiens
ccuuuugcugcgcacc

SEQ ID NO: 1197817 - RNA, 22 nt, Homo sapiens
ccuuuuggaacccccacuuuua

SEQ ID NO: 1197818 - RNA, 12 nt, Homo sapiens
ccuuuugugcaa

SEQ ID NO: 1197819 - RNA, 13 nt, Homo sapiens
ccuuuuuguacug

SEQ ID NO: 1197820 - RNA, 17 nt, Homo sapiens
ccuuuuuguuucaauga

SEQ ID NO: 1197821 - RNA, 17 nt, Homo sapiens
ccuuuuuucaauaugca

SEQ ID NO: 1197822 - RNA, 13 nt, Homo sapiens
ccuuuuuugccag

SEQ ID NO: 1197823 - RNA, 18 nt, Homo sapiens
ccuuuuuuuacauuucau

SEQ ID NO: 1197824 - RNA, 17 nt, Homo sapiens
cgaaaaggauaugcagu

SEQ ID NO: 1197825 - RNA, 20 nt, Homo sapiens
cgaaaauucauuucacauua

SEQ ID NO: 1197826 - RNA, 15 nt, Homo sapiens
cgaaacuuguuauug

SEQ ID NO: 1197827 - RNA, 20 nt, Homo sapiens
cgaaauaacaauguuaagga

SEQ ID NO: 1197828 - RNA, 23 nt, Homo sapiens
cgaaucuuccgauggaugaaucu

SEQ ID NO: 1197829 - RNA, 14 nt, Homo sapiens
cgaauggcagcaua

SEQ ID NO: 1197830 - RNA, 13 nt, Homo sapiens
cgacaaagccaaa

SEQ ID NO: 1197831 - RNA, 17 nt, Homo sapiens
cgaccgggcaagcuuuc

SEQ ID NO: 1197832 - RNA, 18 nt, Homo sapiens
cgacuccacgcuguccuu

SEQ ID NO: 1197833 - RNA, 14 nt, Homo sapiens
cgacugagccaugc

SEQ ID NO: 1197834 - RNA, 17 nt, Homo sapiens
cgacugagccaugcuca

SEQ ID NO: 1197835 - RNA, 19 nt, Homo sapiens
cgacuuuucuuaacaaccu

SEQ ID NO: 1197836 - RNA, 23 nt, Homo sapiens
cgagagaaagggagugcaugugc

SEQ ID NO: 1197837 - RNA, 16 nt, Homo sapiens
cgagaggcaauucagu

SEQ ID NO: 1197838 - RNA, 17 nt, Homo sapiens
cgagaugggaaggcaca

SEQ ID NO: 1197839 - RNA, 16 nt, Homo sapiens
cgagcacgagcuggaa

SEQ ID NO: 1197840 - RNA, 16 nt, Homo sapiens
cgagcacuguccagua

SEQ ID NO: 1197841 - RNA, 13 nt, Homo sapiens
cgagcacugugag

SEQ ID NO: 1197842 - RNA, 14 nt, Homo sapiens
cgagcacugugagc

SEQ ID NO: 1197843 - RNA, 15 nt, Homo sapiens
cgagcagggugguga

SEQ ID NO: 1197844 - RNA, 22 nt, Homo sapiens
cgaggcaggccgacuguacuaa

SEQ ID NO: 1197845 - RNA, 18 nt, Homo sapiens
cgaggggcucucagcuca

SEQ ID NO: 1197846 - RNA, 22 nt, Homo sapiens
cgaggguaugucagugucacug

SEQ ID NO: 1197847 - RNA, 19 nt, Homo sapiens
cgaguaacuccccucaggg

SEQ ID NO: 1197848 - RNA, 22 nt, Homo sapiens
cgaguacugggacaaccucauc

SEQ ID NO: 1197849 - RNA, 22 nt, Homo sapiens
cgaguguccagccaagggcuga

SEQ ID NO: 1197850 - RNA, 14 nt, Homo sapiens
cgauaaagggauuu

SEQ ID NO: 1197851 - RNA, 13 nt, Homo sapiens
cgauacaaagugu

SEQ ID NO: 1197852 - RNA, 13 nt, Homo sapiens
cgaucuccugacc

SEQ ID NO: 1197853 - RNA, 15 nt, Homo sapiens
cgaucucuccuggcc

SEQ ID NO: 1197854 - RNA, 17 nt, Homo sapiens
cgaugcagugcuuccaa

SEQ ID NO: 1197855 - RNA, 17 nt, Homo sapiens
cgaugcguucacuccaa

SEQ ID NO: 1197856 - RNA, 12 nt, Homo sapiens
cgaugcugcuau

SEQ ID NO: 1197857 - RNA, 16 nt, Homo sapiens
cgaugcugcuauggaa

SEQ ID NO: 1197858 - RNA, 12 nt, Homo sapiens
cgauggagacac

SEQ ID NO: 1197859 - RNA, 17 nt, Homo sapiens
cgauggaucuguggucc

SEQ ID NO: 1197860 - RNA, 13 nt, Homo sapiens
cgauucccugugu

SEQ ID NO: 1197861 - RNA, 20 nt, Homo sapiens
cgcacaaggcugaccaagag

SEQ ID NO: 1197862 - RNA, 17 nt, Homo sapiens
cgcacacccucacucug

SEQ ID NO: 1197863 - RNA, 13 nt, Homo sapiens
cgcaccacugcac

SEQ ID NO: 1197864 - RNA, 12 nt, Homo sapiens
cgcaccaugugg

SEQ ID NO: 1197865 - RNA, 14 nt, Homo sapiens
cgcaccauucuccu

SEQ ID NO: 1197866 - RNA, 17 nt, Homo sapiens
cgcaccauuucugucac

SEQ ID NO: 1197867 - RNA, 13 nt, Homo sapiens
cgcacgcacacac

SEQ ID NO: 1197868 - RNA, 17 nt, Homo sapiens
cgcacgcucgcugccau

SEQ ID NO: 1197869 - RNA, 19 nt, Homo sapiens
cgcagggaugucgcugggg

SEQ ID NO: 1197870 - RNA, 14 nt, Homo sapiens
cgcaggguggagau

SEQ ID NO: 1197871 - RNA, 18 nt, Homo sapiens
cgcaguuuggagucacug

SEQ ID NO: 1197872 - RNA, 20 nt, Homo sapiens
cgcaguuuggagucacugua

SEQ ID NO: 1197873 - RNA, 15 nt, Homo sapiens
cgcaugacuguuaca

SEQ ID NO: 1197874 - RNA, 15 nt, Homo sapiens
cgcauuggugacuca

SEQ ID NO: 1197875 - RNA, 19 nt, Homo sapiens
cgccaaucccgccaugcuc

SEQ ID NO: 1197876 - RNA, 20 nt, Homo sapiens
cgccagagggcuugugaaca

SEQ ID NO: 1197877 - RNA, 13 nt, Homo sapiens
cgccagaucugca

SEQ ID NO: 1197878 - RNA, 20 nt, Homo sapiens
cgccagcucuaccaguucuc

SEQ ID NO: 1197879 - RNA, 13 nt, Homo sapiens
cgccaucuuccau

SEQ ID NO: 1197880 - RNA, 21 nt, Homo sapiens
cgcccacccacgcauacacac

SEQ ID NO: 1197881 - RNA, 21 nt, Homo sapiens
cgcccacguggcagaccguga

SEQ ID NO: 1197882 - RNA, 20 nt, Homo sapiens
cgcccaggcuggagugcagu

SEQ ID NO: 1197883 - RNA, 21 nt, Homo sapiens
cgcccagguccccgcuuucuu

SEQ ID NO: 1197884 - RNA, 19 nt, Homo sapiens
cgcccucacugcaggcucc

SEQ ID NO: 1197885 - RNA, 12 nt, Homo sapiens
cgcccucggggc

SEQ ID NO: 1197886 - RNA, 19 nt, Homo sapiens
cgcccuggguuucaugagc

SEQ ID NO: 1197887 - RNA, 21 nt, Homo sapiens
cgcccuuggcuucugugauga

SEQ ID NO: 1197888 - RNA, 13 nt, Homo sapiens
cgccgugcuguaa

SEQ ID NO: 1197889 - RNA, 15 nt, Homo sapiens
cgccgugcuguaaau

SEQ ID NO: 1197890 - RNA, 13 nt, Homo sapiens
cgccuaacugaau

SEQ ID NO: 1197891 - RNA, 15 nt, Homo sapiens
cgccugacaaccacu

SEQ ID NO: 1197892 - RNA, 13 nt, Homo sapiens
cgccugugcacac

SEQ ID NO: 1197893 - RNA, 14 nt, Homo sapiens
cgccuuacuggcaa

SEQ ID NO: 1197894 - RNA, 15 nt, Homo sapiens
cgccuucucccacau

SEQ ID NO: 1197895 - RNA, 18 nt, Homo sapiens
cgccuuuuguauacaucc

SEQ ID NO: 1197896 - RNA, 11 nt, Homo sapiens
cgcgcacacac

SEQ ID NO: 1197897 - RNA, 13 nt, Homo sapiens
cgcgcaccuguag

SEQ ID NO: 1197898 - RNA, 22 nt, Homo sapiens
cgcuaaaugaaaaucgugacaa

SEQ ID NO: 1197899 - RNA, 20 nt, Homo sapiens
cgcuaccagcagacucugga

SEQ ID NO: 1197900 - RNA, 19 nt, Homo sapiens
cgcuccacguuucaggcag

SEQ ID NO: 1197901 - RNA, 18 nt, Homo sapiens
cgcucccagguuccccca

SEQ ID NO: 1197902 - RNA, 20 nt, Homo sapiens
cgcugcaucccugcagcuca

SEQ ID NO: 1197903 - RNA, 16 nt, Homo sapiens
cgcuggaccuugaacu

SEQ ID NO: 1197904 - RNA, 20 nt, Homo sapiens
cgcuggguauuggaaaugga

SEQ ID NO: 1197905 - RNA, 13 nt, Homo sapiens
cgcugucaaaagu

SEQ ID NO: 1197906 - RNA, 16 nt, Homo sapiens
cgcuuaaccuuuccag

SEQ ID NO: 1197907 - RNA, 20 nt, Homo sapiens
cgcuucugccuuuucacugu

SEQ ID NO: 1197908 - RNA, 14 nt, Homo sapiens
cggaacauguaaaa

SEQ ID NO: 1197909 - RNA, 23 nt, Homo sapiens
cggaagcugucgacuucaugaca

SEQ ID NO: 1197910 - RNA, 21 nt, Homo sapiens
cggaaguacuucccucaggcc

SEQ ID NO: 1197911 - RNA, 17 nt, Homo sapiens
cggaagugaccacagaa

SEQ ID NO: 1197912 - RNA, 15 nt, Homo sapiens
cggaauucagccaug

SEQ ID NO: 1197913 - RNA, 20 nt, Homo sapiens
cggacauacucucugccugg

SEQ ID NO: 1197914 - RNA, 17 nt, Homo sapiens
cggagccuccucucuca

SEQ ID NO: 1197915 - RNA, 11 nt, Homo sapiens
cggaggucucu

SEQ ID NO: 1197916 - RNA, 21 nt, Homo sapiens
cuauuuauuugugagacugua

SEQ ID NO: 1197917 - RNA, 20 nt, Homo sapiens
cuauuucauuuuuugcauca

SEQ ID NO: 1197918 - RNA, 16 nt, Homo sapiens
cuauuuccuaaaauca

SEQ ID NO: 1197919 - RNA, 17 nt, Homo sapiens
cuauuucuacacagugg

SEQ ID NO: 1197920 - RNA, 16 nt, Homo sapiens
cuauuucuccaaagcc

SEQ ID NO: 1197921 - RNA, 12 nt, Homo sapiens
cuauuugccaug

SEQ ID NO: 1197922 - RNA, 15 nt, Homo sapiens
cuauuugccaugggc

SEQ ID NO: 1197923 - RNA, 21 nt, Homo sapiens
cuauuuucaacauaacugaag

SEQ ID NO: 1197924 - RNA, 12 nt, Homo sapiens
cuauuuucacaa

SEQ ID NO: 1197925 - RNA, 17 nt, Homo sapiens
cuauuuuguuggaugac

SEQ ID NO: 1197926 - RNA, 21 nt, Homo sapiens
cuauuuuuguuaagcgugucu

SEQ ID NO: 1197927 - RNA, 22 nt, Homo sapiens
cucaaaacagagggcugcauuc

SEQ ID NO: 1197928 - RNA, 17 nt, Homo sapiens
cucaaaauaaaaagccu

SEQ ID NO: 1197929 - RNA, 13 nt, Homo sapiens
cucaaacagucuu

SEQ ID NO: 1197930 - RNA, 17 nt, Homo sapiens
cucaaacuccugaccuc

SEQ ID NO: 1197931 - RNA, 16 nt, Homo sapiens
cucaaacuugagaaaa

SEQ ID NO: 1197932 - RNA, 14 nt, Homo sapiens
cucaaagaaagugu

SEQ ID NO: 1197933 - RNA, 18 nt, Homo sapiens
cucaaaucugagggagcu

SEQ ID NO: 1197934 - RNA, 12 nt, Homo sapiens
cucaaaugaauu

SEQ ID NO: 1197935 - RNA, 13 nt, Homo sapiens
cucaaaugcacau

SEQ ID NO: 1197936 - RNA, 18 nt, Homo sapiens
cucaaaugcacaucucau

SEQ ID NO: 1197937 - RNA, 20 nt, Homo sapiens
cucaacaaagcacaguguua

SEQ ID NO: 1197938 - RNA, 18 nt, Homo sapiens
cucaacagccaaguguga

SEQ ID NO: 1197939 - RNA, 23 nt, Homo sapiens
cucaacagccaagugugacccca

SEQ ID NO: 1197940 - RNA, 14 nt, Homo sapiens
cucaacaugcugcc

SEQ ID NO: 1197941 - RNA, 13 nt, Homo sapiens
cucaacauugugu

SEQ ID NO: 1197942 - RNA, 23 nt, Homo sapiens
cucaaccccuccccuccaucccu

SEQ ID NO: 1197943 - RNA, 20 nt, Homo sapiens
cucaaccucaccauugugaa

SEQ ID NO: 1197944 - RNA, 22 nt, Homo sapiens
cucaaccuccugggcuaaguga

SEQ ID NO: 1197945 - RNA, 18 nt, Homo sapiens
cucaacguugcuccccau

SEQ ID NO: 1197946 - RNA, 21 nt, Homo sapiens
cucaacugccuacuccaaaau

SEQ ID NO: 1197947 - RNA, 20 nt, Homo sapiens
cucaacugggugacaagggu

SEQ ID NO: 1197948 - RNA, 16 nt, Homo sapiens
cucaagcccugagggg

SEQ ID NO: 1197949 - RNA, 17 nt, Homo sapiens
cucaaggaauuugcauu

SEQ ID NO: 1197950 - RNA, 19 nt, Homo sapiens
cucaaggacuuugcagccg

SEQ ID NO: 1197951 - RNA, 14 nt, Homo sapiens
cucaagguuuuagg

SEQ ID NO: 1197952 - RNA, 21 nt, Homo sapiens
cucaagucuggcagacuuucu

SEQ ID NO: 1197953 - RNA, 17 nt, Homo sapiens
cucaagucuucccugau

SEQ ID NO: 1197954 - RNA, 24 nt, Homo sapiens
cucaaguuggaguugacugcucau

SEQ ID NO: 1197955 - RNA, 15 nt, Homo sapiens
cucaauaaauugcaa

SEQ ID NO: 1197956 - RNA, 15 nt, Homo sapiens
cucaaugcacugaca

SEQ ID NO: 1197957 - RNA, 15 nt, Homo sapiens
cucaaugccaguaac

SEQ ID NO: 1197958 - RNA, 22 nt, Homo sapiens
cucaauggagccccggauccca

SEQ ID NO: 1197959 - RNA, 14 nt, Homo sapiens
cucaauuugcagua

SEQ ID NO: 1197960 - RNA, 12 nt, Homo sapiens
cucacacacugg

SEQ ID NO: 1197961 - RNA, 11 nt, Homo sapiens
cucacacccca

SEQ ID NO: 1197962 - RNA, 20 nt, Homo sapiens
cucacagagugcauugugag

SEQ ID NO: 1197963 - RNA, 21 nt, Homo sapiens
cucacagccgcauuggugacu

SEQ ID NO: 1197964 - RNA, 14 nt, Homo sapiens
cucacagcuguaau

SEQ ID NO: 1197965 - RNA, 18 nt, Homo sapiens
cucacaggccccaggaaa

SEQ ID NO: 1197966 - RNA, 14 nt, Homo sapiens
cucacaguguugcc

SEQ ID NO: 1197967 - RNA, 22 nt, Homo sapiens
cucacauaaaaaagaagcacuu

SEQ ID NO: 1197968 - RNA, 15 nt, Homo sapiens
cucacauaucuguca

SEQ ID NO: 1197969 - RNA, 13 nt, Homo sapiens
cucacaugcacag

SEQ ID NO: 1197970 - RNA, 15 nt, Homo sapiens
cucacaugugacaaa

SEQ ID NO: 1197971 - RNA, 14 nt, Homo sapiens
cucaccaaacacaa

SEQ ID NO: 1197972 - RNA, 19 nt, Homo sapiens
cucaccagccccacugcca

SEQ ID NO: 1197973 - RNA, 23 nt, Homo sapiens
cucaccagcccugaccccagugu

SEQ ID NO: 1197974 - RNA, 15 nt, Homo sapiens
cucaccgugcugucu

SEQ ID NO: 1197975 - RNA, 23 nt, Homo sapiens
cucaccucauagcuaauuuuugc

SEQ ID NO: 1197976 - RNA, 20 nt, Homo sapiens
cucaccuccaugacagcgcu

SEQ ID NO: 1197977 - RNA, 19 nt, Homo sapiens
cucaccucccgaagccacc

SEQ ID NO: 1197978 - RNA, 17 nt, Homo sapiens
cucaccucucccucgau

SEQ ID NO: 1197979 - RNA, 15 nt, Homo sapiens
cucaccuugucucau

SEQ ID NO: 1197980 - RNA, 23 nt, Homo sapiens
cucacgcagacacacccacagaa

SEQ ID NO: 1197981 - RNA, 18 nt, Homo sapiens
cucacgccuaugauccca

SEQ ID NO: 1197982 - RNA, 15 nt, Homo sapiens
cucacuaugcugcuu

SEQ ID NO: 1197983 - RNA, 17 nt, Homo sapiens
cucacucccaccugcau

SEQ ID NO: 1197984 - RNA, 16 nt, Homo sapiens
cucacuccccaacccc

SEQ ID NO: 1197985 - RNA, 20 nt, Homo sapiens
cucacuccuaggagagccaa

SEQ ID NO: 1197986 - RNA, 18 nt, Homo sapiens
cucacucucccuggagcu

SEQ ID NO: 1197987 - RNA, 18 nt, Homo sapiens
cucacucugucacccagg

SEQ ID NO: 1197988 - RNA, 16 nt, Homo sapiens
cucacugcagugcuga

SEQ ID NO: 1197989 - RNA, 23 nt, Homo sapiens
cucacugcugcaaauacuguaua

SEQ ID NO: 1197990 - RNA, 15 nt, Homo sapiens
cucacuggaggagca

SEQ ID NO: 1197991 - RNA, 18 nt, Homo sapiens
cucacuggaggagcagcu

SEQ ID NO: 1197992 - RNA, 23 nt, Homo sapiens
cucacuggggccuacagcuuuga

SEQ ID NO: 1197993 - RNA, 21 nt, Homo sapiens
cucacuguagcuuuuaggaau

SEQ ID NO: 1197994 - RNA, 16 nt, Homo sapiens
cucacuuaguccuuua

SEQ ID NO: 1197995 - RNA, 12 nt, Homo sapiens
cucacuuuacau

SEQ ID NO: 1197996 - RNA, 19 nt, Homo sapiens
cucacuuucccuuguguca

SEQ ID NO: 1197997 - RNA, 22 nt, Homo sapiens
cucagaagacacugaugggcaa

SEQ ID NO: 1197998 - RNA, 23 nt, Homo sapiens
cucagaauauugcuuuggucaua

SEQ ID NO: 1197999 - RNA, 12 nt, Homo sapiens
cucagaccugaa

SEQ ID NO: 1198000 - RNA, 20 nt, Homo sapiens
cucagaggacuggacgugcu

SEQ ID NO: 1198001 - RNA, 18 nt, Homo sapiens
cucagaggaugaggucaa

SEQ ID NO: 1198002 - RNA, 18 nt, Homo sapiens
cucagaggcugggagcau

SEQ ID NO: 1198003 - RNA, 21 nt, Homo sapiens
cucagaguccacuguggcacu

SEQ ID NO: 1198004 - RNA, 18 nt, Homo sapiens
cucagaucugaacacagu

SEQ ID NO: 1198005 - RNA, 13 nt, Homo sapiens
cucagaugaucuc

SEQ ID NO: 1198006 - RNA, 14 nt, Homo sapiens
cucagcaacccagg

SEQ ID NO: 1198007 - RNA, 21 nt, Homo sapiens
cucagcagaaacacacaguca

SEQ ID NO: 1198008 - RNA, 14 nt, Homo sapiens
cucagcaugcaucc

SEQ ID NO: 1198009 - RNA, 23 nt, Homo sapiens
cucagcaugcauccuuugcacug

SEQ ID NO: 1198010 - RNA, 14 nt, Homo sapiens
cucagcauuuccac

SEQ ID NO: 1198011 - RNA, 23 nt, Homo sapiens
cucagccacacccaggcacuuaa

SEQ ID NO: 1198012 - RNA, 14 nt, Homo sapiens
cucagcccugagau

SEQ ID NO: 1198013 - RNA, 18 nt, Homo sapiens
cucagccuguuccaugaa

SEQ ID NO: 1198014 - RNA, 21 nt, Homo sapiens
cucagcuaaugaaguguuuag

SEQ ID NO: 1198015 - RNA, 15 nt, Homo sapiens
cucagcucucuggga

SEQ ID NO: 1198016 - RNA, 14 nt, Homo sapiens
cucagcucuuccau

SEQ ID NO: 1198017 - RNA, 17 nt, Homo sapiens
cucagcuggaagucuac

SEQ ID NO: 1198018 - RNA, 19 nt, Homo sapiens
cucagcuguccugcagcaa

SEQ ID NO: 1198019 - RNA, 13 nt, Homo sapiens
cucagcuuaucuc

SEQ ID NO: 1198020 - RNA, 14 nt, Homo sapiens
cucagcuucucaaa

SEQ ID NO: 1198021 - RNA, 18 nt, Homo sapiens
cucagcuuugagaagccu

SEQ ID NO: 1198022 - RNA, 22 nt, Homo sapiens
cucaggauuucgugggucuguu

SEQ ID NO: 1198023 - RNA, 19 nt, Homo sapiens
cucaggcacacagcuacuc

SEQ ID NO: 1198024 - RNA, 21 nt, Homo sapiens
cucaggcgccuggcacauuuc

SEQ ID NO: 1198025 - RNA, 15 nt, Homo sapiens
cucaggcucuugacu

SEQ ID NO: 1198026 - RNA, 21 nt, Homo sapiens
cucagggacuggcacacuggc

SEQ ID NO: 1198027 - RNA, 16 nt, Homo sapiens
cucaggggacuugaau

SEQ ID NO: 1198028 - RNA, 18 nt, Homo sapiens
cucagggggcccgggcug

SEQ ID NO: 1198029 - RNA, 22 nt, Homo sapiens
cucagguccgcccgaccaggau

SEQ ID NO: 1198030 - RNA, 22 nt, Homo sapiens
cucaggugaaaauccaucucau

SEQ ID NO: 1198031 - RNA, 14 nt, Homo sapiens
cucaggugaucuac

SEQ ID NO: 1198032 - RNA, 13 nt, Homo sapiens
cucagguggugcc

SEQ ID NO: 1198033 - RNA, 17 nt, Homo sapiens
cucagguguugccaaau

SEQ ID NO: 1198034 - RNA, 23 nt, Homo sapiens
cucagguucuucagggccagucc

SEQ ID NO: 1198035 - RNA, 18 nt, Homo sapiens
cucagucaugcauaaaua

SEQ ID NO: 1198036 - RNA, 23 nt, Homo sapiens
cucagugcagcaauauauuacca

SEQ ID NO: 1198037 - RNA, 19 nt, Homo sapiens
cucagugcauagcgaagac

SEQ ID NO: 1198038 - RNA, 17 nt, Homo sapiens
cucagugggacucugau

SEQ ID NO: 1198039 - RNA, 22 nt, Homo sapiens
cucaguucuugagggccucccc

SEQ ID NO: 1198040 - RNA, 20 nt, Homo sapiens
cucaguuggaaucauugcua

SEQ ID NO: 1198041 - RNA, 12 nt, Homo sapiens
cugacaaccuca

SEQ ID NO: 1198042 - RNA, 22 nt, Homo sapiens
cugacaaugggcacugauuuga

SEQ ID NO: 1198043 - RNA, 18 nt, Homo sapiens
cugacacacagcucuguc

SEQ ID NO: 1198044 - RNA, 21 nt, Homo sapiens
cugacacauagaaaacaauca

SEQ ID NO: 1198045 - RNA, 12 nt, Homo sapiens
cugacaccuacc

SEQ ID NO: 1198046 - RNA, 23 nt, Homo sapiens
cugacagaaggaacacugcuuga

SEQ ID NO: 1198047 - RNA, 18 nt, Homo sapiens
cugacagaaggacucagg

SEQ ID NO: 1198048 - RNA, 18 nt, Homo sapiens
cugacauauuaugccuga

SEQ ID NO: 1198049 - RNA, 22 nt, Homo sapiens
cugacaucacagcagccuccaa

SEQ ID NO: 1198050 - RNA, 21 nt, Homo sapiens
cugacauuaugugguuuuaga

SEQ ID NO: 1198051 - RNA, 23 nt, Homo sapiens
cugaccaaacagccaacuagccc

SEQ ID NO: 1198052 - RNA, 12 nt, Homo sapiens
cugaccaagaga

SEQ ID NO: 1198053 - RNA, 19 nt, Homo sapiens
cugaccucaggugauccac

SEQ ID NO: 1198054 - RNA, 20 nt, Homo sapiens
cugaccuggaaagaaaaagc

SEQ ID NO: 1198055 - RNA, 18 nt, Homo sapiens
cugaccuggcuggugaca

SEQ ID NO: 1198056 - RNA, 19 nt, Homo sapiens
cugaccuggcuggugacag

SEQ ID NO: 1198057 - RNA, 16 nt, Homo sapiens
cugacgagcagggugg

SEQ ID NO: 1198058 - RNA, 22 nt, Homo sapiens
cugacgcaggcaccuucuuggc

SEQ ID NO: 1198059 - RNA, 13 nt, Homo sapiens
cugacuaacuuuu

SEQ ID NO: 1198060 - RNA, 13 nt, Homo sapiens
cugacuacaaauu

SEQ ID NO: 1198061 - RNA, 16 nt, Homo sapiens
cugacucaacauggag

SEQ ID NO: 1198062 - RNA, 23 nt, Homo sapiens
cugacucaacauguuacugacca

SEQ ID NO: 1198063 - RNA, 12 nt, Homo sapiens
cugacucuccag

SEQ ID NO: 1198064 - RNA, 20 nt, Homo sapiens
cugacugaagugaacuauga

SEQ ID NO: 1198065 - RNA, 15 nt, Homo sapiens
cugacugaaugcaga

SEQ ID NO: 1198066 - RNA, 14 nt, Homo sapiens
cugacugcaagccc

SEQ ID NO: 1198067 - RNA, 17 nt, Homo sapiens
cugacuucaucuggggu

SEQ ID NO: 1198068 - RNA, 19 nt, Homo sapiens
cugacuuguuugucuucca

SEQ ID NO: 1198069 - RNA, 20 nt, Homo sapiens
cugacuuguuugucuuccau

SEQ ID NO: 1198070 - RNA, 19 nt, Homo sapiens
cugacuuuaaaaggauuaa

SEQ ID NO: 1198071 - RNA, 14 nt, Homo sapiens
cugacuuugcuugc

SEQ ID NO: 1198072 - RNA, 19 nt, Homo sapiens
cugagaagucaaacauuuc

SEQ ID NO: 1198073 - RNA, 19 nt, Homo sapiens
cugagagugagcaaccagc

SEQ ID NO: 1198074 - RNA, 15 nt, Homo sapiens
cugagauuucuuaaa

SEQ ID NO: 1198075 - RNA, 18 nt, Homo sapiens
cugagcacccaagccagg

SEQ ID NO: 1198076 - RNA, 17 nt, Homo sapiens
cugagcagugccagcuu

SEQ ID NO: 1198077 - RNA, 23 nt, Homo sapiens
cugagccaaagagaaugccauuc

SEQ ID NO: 1198078 - RNA, 21 nt, Homo sapiens
cugagcccugguguguuucca

SEQ ID NO: 1198079 - RNA, 16 nt, Homo sapiens
cugagcugcagcucuc

SEQ ID NO: 1198080 - RNA, 19 nt, Homo sapiens
cugagcuggccuccuaugc

SEQ ID NO: 1198081 - RNA, 17 nt, Homo sapiens
cugaggacaaaguggag

SEQ ID NO: 1198082 - RNA, 14 nt, Homo sapiens
cugaggacucugca

SEQ ID NO: 1198083 - RNA, 14 nt, Homo sapiens
cugaggcaagagaa

SEQ ID NO: 1198084 - RNA, 21 nt, Homo sapiens
cugaggcggagaauugcuuga

SEQ ID NO: 1198085 - RNA, 16 nt, Homo sapiens
cugaggggcaucugcc

SEQ ID NO: 1198086 - RNA, 17 nt, Homo sapiens
cugaggguaucugacaa

SEQ ID NO: 1198087 - RNA, 15 nt, Homo sapiens
cugaggucccugugu

SEQ ID NO: 1198088 - RNA, 15 nt, Homo sapiens
cugagguuggauuug

SEQ ID NO: 1198089 - RNA, 17 nt, Homo sapiens
cugagguuuugaaagaa

SEQ ID NO: 1198090 - RNA, 18 nt, Homo sapiens
cugaguagcugggauuac

SEQ ID NO: 1198091 - RNA, 18 nt, Homo sapiens
cugaguaguugggauuac

SEQ ID NO: 1198092 - RNA, 17 nt, Homo sapiens
cugagucagacugucag

SEQ ID NO: 1198093 - RNA, 19 nt, Homo sapiens
cugagugaaugaacaaaug

SEQ ID NO: 1198094 - RNA, 22 nt, Homo sapiens
cugagugcaccacuucaaguga

SEQ ID NO: 1198095 - RNA, 21 nt, Homo sapiens
cugagugccagcccuggcaga

SEQ ID NO: 1198096 - RNA, 22 nt, Homo sapiens
cugaguggccagccagugccau

SEQ ID NO: 1198097 - RNA, 17 nt, Homo sapiens
cugaguggggagcaguu

SEQ ID NO: 1198098 - RNA, 13 nt, Homo sapiens
cugaguguggacu

SEQ ID NO: 1198099 - RNA, 19 nt, Homo sapiens
cugaguuucuggcucuuga

SEQ ID NO: 1198100 - RNA, 13 nt, Homo sapiens
cugauaaacacaa

SEQ ID NO: 1198101 - RNA, 12 nt, Homo sapiens
cugauaagcaag

SEQ ID NO: 1198102 - RNA, 18 nt, Homo sapiens
cugauaaggaucuaggag

SEQ ID NO: 1198103 - RNA, 15 nt, Homo sapiens
cugauaauaauugau

SEQ ID NO: 1198104 - RNA, 16 nt, Homo sapiens
cugauacauaacuaaa

SEQ ID NO: 1198105 - RNA, 14 nt, Homo sapiens
cugauacuagacua

SEQ ID NO: 1198106 - RNA, 19 nt, Homo sapiens
cugauacuuugacaguguu

SEQ ID NO: 1198107 - RNA, 19 nt, Homo sapiens
cugauaugggacugagccu

SEQ ID NO: 1198108 - RNA, 15 nt, Homo sapiens
cugauauuaaucaaa

SEQ ID NO: 1198109 - RNA, 21 nt, Homo sapiens
cugauauugccgcacuagggg

SEQ ID NO: 1198110 - RNA, 19 nt, Homo sapiens
cugaucacucccagcacuc

SEQ ID NO: 1198111 - RNA, 15 nt, Homo sapiens
cugaucagagcuuac

SEQ ID NO: 1198112 - RNA, 21 nt, Homo sapiens
cugaucauccacugugccaug

SEQ ID NO: 1198113 - RNA, 23 nt, Homo sapiens
cugaucccccauagguggcugag

SEQ ID NO: 1198114 - RNA, 14 nt, Homo sapiens
cugaucgugcuaaa

SEQ ID NO: 1198115 - RNA, 13 nt, Homo sapiens
cugaucuauacaa

SEQ ID NO: 1198116 - RNA, 20 nt, Homo sapiens
cugaucugcaguuuuugccu

SEQ ID NO: 1198117 - RNA, 17 nt, Homo sapiens
cugaucugcggaucuca

SEQ ID NO: 1198118 - RNA, 22 nt, Homo sapiens
cugaugaaaacauagcaucuca

SEQ ID NO: 1198119 - RNA, 17 nt, Homo sapiens
cugaugaaacucacaaa

SEQ ID NO: 1198120 - RNA, 23 nt, Homo sapiens
cugaugaagaaauuuaugaagca

SEQ ID NO: 1198121 - RNA, 15 nt, Homo sapiens
cugaugagcacgguu

SEQ ID NO: 1198122 - RNA, 23 nt, Homo sapiens
cugaugccuguguacugccuuaa

SEQ ID NO: 1198123 - RNA, 14 nt, Homo sapiens
cugaugcugggacc

SEQ ID NO: 1198124 - RNA, 21 nt, Homo sapiens
cugauggaaguaaagccucaa

SEQ ID NO: 1198125 - RNA, 19 nt, Homo sapiens
cugauggagcucagaauuc

SEQ ID NO: 1198126 - RNA, 13 nt, Homo sapiens
cugauggaucccg

SEQ ID NO: 1198127 - RNA, 15 nt, Homo sapiens
cugauggcugaagaa

SEQ ID NO: 1198128 - RNA, 23 nt, Homo sapiens
cugaugggccagcaggagccagc

SEQ ID NO: 1198129 - RNA, 17 nt, Homo sapiens
cugauguuaaaauucca

SEQ ID NO: 1198130 - RNA, 14 nt, Homo sapiens
cugauuaugaaaug

SEQ ID NO: 1198131 - RNA, 13 nt, Homo sapiens
cugauucauaaua

SEQ ID NO: 1198132 - RNA, 19 nt, Homo sapiens
cugauucccaagcucugcu

SEQ ID NO: 1198133 - RNA, 20 nt, Homo sapiens
cugauucuuaugauuacuau

SEQ ID NO: 1198134 - RNA, 11 nt, Homo sapiens
cugauugcauc

SEQ ID NO: 1198135 - RNA, 15 nt, Homo sapiens
cugauugcauccacu

SEQ ID NO: 1198136 - RNA, 19 nt, Homo sapiens
cugauugcauccacuagcu

SEQ ID NO: 1198137 - RNA, 22 nt, Homo sapiens
cugauuguggaucuuuucauuc

SEQ ID NO: 1198138 - RNA, 19 nt, Homo sapiens
cugauuugauaccauggca

SEQ ID NO: 1198139 - RNA, 22 nt, Homo sapiens
cugauuugauaccauggcacug

SEQ ID NO: 1198140 - RNA, 22 nt, Homo sapiens
cugauuuguauuaaaauuguaa

SEQ ID NO: 1198141 - RNA, 18 nt, Homo sapiens
cugauuuguauucuguga

SEQ ID NO: 1198142 - RNA, 20 nt, Homo sapiens
cugcaaaauagacauauuaa

SEQ ID NO: 1198143 - RNA, 12 nt, Homo sapiens
cugcaaaccuuc

SEQ ID NO: 1198144 - RNA, 18 nt, Homo sapiens
cugcaaaccuuccuggga

SEQ ID NO: 1198145 - RNA, 17 nt, Homo sapiens
cugcaaaggaaaagcca

SEQ ID NO: 1198146 - RNA, 21 nt, Homo sapiens
cugcaacaacgccuggugccc

SEQ ID NO: 1198147 - RNA, 14 nt, Homo sapiens
cugcaacucaagga

SEQ ID NO: 1198148 - RNA, 17 nt, Homo sapiens
cugcaagccugucugag

SEQ ID NO: 1198149 - RNA, 16 nt, Homo sapiens
cugcaagucagaggau

SEQ ID NO: 1198150 - RNA, 14 nt, Homo sapiens
cugcacaaacaaua

SEQ ID NO: 1198151 - RNA, 21 nt, Homo sapiens
cugcacaaagcccuuccaugu

SEQ ID NO: 1198152 - RNA, 13 nt, Homo sapiens
cugcacacugccu

SEQ ID NO: 1198153 - RNA, 23 nt, Homo sapiens
cugcacagccuagacauccaggu

SEQ ID NO: 1198154 - RNA, 18 nt, Homo sapiens
cugcacaugucuuguaca

SEQ ID NO: 1198155 - RNA, 19 nt, Homo sapiens
cugcacaugucuuguacau

SEQ ID NO: 1198156 - RNA, 21 nt, Homo sapiens
cugcaccagagcaaccucuca

SEQ ID NO: 1198157 - RNA, 21 nt, Homo sapiens
cugcaccuuuuugcaugauau

SEQ ID NO: 1198158 - RNA, 22 nt, Homo sapiens
cugcacggugggagaccugcug

SEQ ID NO: 1198159 - RNA, 14 nt, Homo sapiens
cugcacuaauauaa

SEQ ID NO: 1198160 - RNA, 14 nt, Homo sapiens
cugcacuacugaca

SEQ ID NO: 1198161 - RNA, 18 nt, Homo sapiens
cugcacugaucacccaau

SEQ ID NO: 1198162 - RNA, 15 nt, Homo sapiens
cugcacuuacaggcc

SEQ ID NO: 1198163 - RNA, 15 nt, Homo sapiens
cugcacuuggccuca

SEQ ID NO: 1198164 - RNA, 16 nt, Homo sapiens
cugcagaacagcauca

SEQ ID NO: 1198165 - RNA, 18 nt, Homo sapiens
cugcagaacagcaucaug

SEQ ID NO: 1198166 - RNA, 17 nt, Homo sapiens
gaagauuuaugaugcac

SEQ ID NO: 1198167 - RNA, 23 nt, Homo sapiens
gaagcaaaucagaaacuugugaa

SEQ ID NO: 1198168 - RNA, 18 nt, Homo sapiens
gaagcaaguuuucuucca

SEQ ID NO: 1198169 - RNA, 12 nt, Homo sapiens
gaagcacagcuu

SEQ ID NO: 1198170 - RNA, 16 nt, Homo sapiens
gaagcacauguguauu

SEQ ID NO: 1198171 - RNA, 12 nt, Homo sapiens
gaagcacuacac

SEQ ID NO: 1198172 - RNA, 23 nt, Homo sapiens
gaagcacuuucucuuaacuuaau

SEQ ID NO: 1198173 - RNA, 22 nt, Homo sapiens
gaagcagucaauuuucacauca

SEQ ID NO: 1198174 - RNA, 19 nt, Homo sapiens
gaagcauacaaagcaguuu

SEQ ID NO: 1198175 - RNA, 20 nt, Homo sapiens
gaagcaucgcuccucuccag

SEQ ID NO: 1198176 - RNA, 15 nt, Homo sapiens
gaagcauuuacuuug

SEQ ID NO: 1198177 - RNA, 15 nt, Homo sapiens
gaagccccauccaac

SEQ ID NO: 1198178 - RNA, 23 nt, Homo sapiens
gaagccccauguguaccuacaga

SEQ ID NO: 1198179 - RNA, 21 nt, Homo sapiens
gaagcccuccaaaagcacuua

SEQ ID NO: 1198180 - RNA, 21 nt, Homo sapiens
gaagccggcagggaagggccu

SEQ ID NO: 1198181 - RNA, 19 nt, Homo sapiens
gaagccuucagcuccaggg

SEQ ID NO: 1198182 - RNA, 14 nt, Homo sapiens
gaagccuugcacua

SEQ ID NO: 1198183 - RNA, 20 nt, Homo sapiens
gaagcuagugaccaucuuca

SEQ ID NO: 1198184 - RNA, 15 nt, Homo sapiens
gaagcuccacuguca

SEQ ID NO: 1198185 - RNA, 21 nt, Homo sapiens
gaagcuccugggggaugcucu

SEQ ID NO: 1198186 - RNA, 13 nt, Homo sapiens
gaagcuggugccc

SEQ ID NO: 1198187 - RNA, 21 nt, Homo sapiens
gaagcuggugcccuuccucac

SEQ ID NO: 1198188 - RNA, 17 nt, Homo sapiens
gaagcuguauaauuaau

SEQ ID NO: 1198189 - RNA, 18 nt, Homo sapiens
gaagcuguuguacauuua

SEQ ID NO: 1198190 - RNA, 22 nt, Homo sapiens
gaagcuucuaaauggugcugca

SEQ ID NO: 1198191 - RNA, 12 nt, Homo sapiens
gaaggaaaccag

SEQ ID NO: 1198192 - RNA, 14 nt, Homo sapiens
gaaggaacuuccag

SEQ ID NO: 1198193 - RNA, 17 nt, Homo sapiens
gaaggaagcuguguuga

SEQ ID NO: 1198194 - RNA, 18 nt, Homo sapiens
gaaggaauagccagagag

SEQ ID NO: 1198195 - RNA, 21 nt, Homo sapiens
gaaggacacuagccugugcac

SEQ ID NO: 1198196 - RNA, 18 nt, Homo sapiens
gaaggacaggacccucag

SEQ ID NO: 1198197 - RNA, 19 nt, Homo sapiens
gaaggagaaguaagaggcu

SEQ ID NO: 1198198 - RNA, 14 nt, Homo sapiens
gaaggaguucacug

SEQ ID NO: 1198199 - RNA, 23 nt, Homo sapiens
gaaggcaaauauaagcugggaaa

SEQ ID NO: 1198200 - RNA, 10 nt, Homo sapiens
gaaggccagc

SEQ ID NO: 1198201 - RNA, 14 nt, Homo sapiens
gaaggccuucagga

SEQ ID NO: 1198202 - RNA, 18 nt, Homo sapiens
gaaggcgacugagccaug

SEQ ID NO: 1198203 - RNA, 23 nt, Homo sapiens
gaaggcuuaagaacugcuucaug

SEQ ID NO: 1198204 - RNA, 19 nt, Homo sapiens
gaaggcuucugugucaaug

SEQ ID NO: 1198205 - RNA, 15 nt, Homo sapiens
gaagggaauccuccu

SEQ ID NO: 1198206 - RNA, 19 nt, Homo sapiens
gaagggacacacaagaaga

SEQ ID NO: 1198207 - RNA, 21 nt, Homo sapiens
gaagggacucuaggugcccuc

SEQ ID NO: 1198208 - RNA, 16 nt, Homo sapiens
gaagggcauuaaccug

SEQ ID NO: 1198209 - RNA, 14 nt, Homo sapiens
gaagggggcugugu

SEQ ID NO: 1198210 - RNA, 17 nt, Homo sapiens
gaaggucuauuggccaa

SEQ ID NO: 1198211 - RNA, 22 nt, Homo sapiens
gaaggucucaggagaagggaua

SEQ ID NO: 1198212 - RNA, 13 nt, Homo sapiens
gaagguugcucua

SEQ ID NO: 1198213 - RNA, 23 nt, Homo sapiens
gaagguuggcccccacgugggga

SEQ ID NO: 1198214 - RNA, 19 nt, Homo sapiens
gaagguuggugaauuucac

SEQ ID NO: 1198215 - RNA, 18 nt, Homo sapiens
gaaguaaacagauggcac

SEQ ID NO: 1198216 - RNA, 23 nt, Homo sapiens
gaaguaacaaaagaagugacauc

SEQ ID NO: 1198217 - RNA, 12 nt, Homo sapiens
gaaguacaugaa

SEQ ID NO: 1198218 - RNA, 16 nt, Homo sapiens
gaaguacuccuauugc

SEQ ID NO: 1198219 - RNA, 13 nt, Homo sapiens
gaaguacuucccu

SEQ ID NO: 1198220 - RNA, 19 nt, Homo sapiens
gaaguagauuaagagccau

SEQ ID NO: 1198221 - RNA, 15 nt, Homo sapiens
gaaguagcagugucu

SEQ ID NO: 1198222 - RNA, 13 nt, Homo sapiens
gaaguagguguga

SEQ ID NO: 1198223 - RNA, 14 nt, Homo sapiens
gaaguaugagggaa

SEQ ID NO: 1198224 - RNA, 20 nt, Homo sapiens
gaaguauuuuccuccaggca

SEQ ID NO: 1198225 - RNA, 22 nt, Homo sapiens
gaaguauuuuccuccaggcaaa

SEQ ID NO: 1198226 - RNA, 19 nt, Homo sapiens
gaagucacacaguauuacu

SEQ ID NO: 1198227 - RNA, 13 nt, Homo sapiens
gaagucaucucau

SEQ ID NO: 1198228 - RNA, 13 nt, Homo sapiens
gaaguccagagcu

SEQ ID NO: 1198229 - RNA, 22 nt, Homo sapiens
gaagucgggcaugguggcucau

SEQ ID NO: 1198230 - RNA, 17 nt, Homo sapiens
gaagucuaagagugaag

SEQ ID NO: 1198231 - RNA, 16 nt, Homo sapiens
gaagucuuuccugaua

SEQ ID NO: 1198232 - RNA, 19 nt, Homo sapiens
gaagugcuggcaaccacua

SEQ ID NO: 1198233 - RNA, 20 nt, Homo sapiens
gaaguggagcccggcacagg

SEQ ID NO: 1198234 - RNA, 15 nt, Homo sapiens
gaaguggcagugaaa

SEQ ID NO: 1198235 - RNA, 15 nt, Homo sapiens
gaaguggggacauca

SEQ ID NO: 1198236 - RNA, 17 nt, Homo sapiens
gaagugugcugugacaa

SEQ ID NO: 1198237 - RNA, 22 nt, Homo sapiens
gaagugugcugugacaagccaa

SEQ ID NO: 1198238 - RNA, 16 nt, Homo sapiens
gaaguuccaguguucu

SEQ ID NO: 1198239 - RNA, 19 nt, Homo sapiens
gaaguuuauucucauuugg

SEQ ID NO: 1198240 - RNA, 18 nt, Homo sapiens
gaauaaaauuagcuugag

SEQ ID NO: 1198241 - RNA, 14 nt, Homo sapiens
gaauaaaauugcac

SEQ ID NO: 1198242 - RNA, 15 nt, Homo sapiens
gaauaaaauugcacu

SEQ ID NO: 1198243 - RNA, 17 nt, Homo sapiens
gaauaaaauugcacuuu

SEQ ID NO: 1198244 - RNA, 19 nt, Homo sapiens
gaauaaaauugcacuuuua

SEQ ID NO: 1198245 - RNA, 12 nt, Homo sapiens
gaauaaagucaa

SEQ ID NO: 1198246 - RNA, 18 nt, Homo sapiens
gaauaaauaaauguaucu

SEQ ID NO: 1198247 - RNA, 15 nt, Homo sapiens
gaauaaaugccuuua

SEQ ID NO: 1198248 - RNA, 12 nt, Homo sapiens
gaauaaccacuu

SEQ ID NO: 1198249 - RNA, 15 nt, Homo sapiens
gaauaaccacuuaaa

SEQ ID NO: 1198250 - RNA, 14 nt, Homo sapiens
gaauaacuaugcca

SEQ ID NO: 1198251 - RNA, 13 nt, Homo sapiens
gaauaacuugaag

SEQ ID NO: 1198252 - RNA, 16 nt, Homo sapiens
gaauaagaauggagca

SEQ ID NO: 1198253 - RNA, 23 nt, Homo sapiens
gaauaagcucuaguucuuaacaa

SEQ ID NO: 1198254 - RNA, 21 nt, Homo sapiens
gaauaaggaggaggagggaga

SEQ ID NO: 1198255 - RNA, 12 nt, Homo sapiens
gaauaauugcau

SEQ ID NO: 1198256 - RNA, 12 nt, Homo sapiens
gaauacaguaag

SEQ ID NO: 1198257 - RNA, 17 nt, Homo sapiens
gaauaccacuuaccuca

SEQ ID NO: 1198258 - RNA, 19 nt, Homo sapiens
gaauacugaguauguggaa

SEQ ID NO: 1198259 - RNA, 18 nt, Homo sapiens
gaauacugcuacagcaau

SEQ ID NO: 1198260 - RNA, 13 nt, Homo sapiens
gaauacugugcau

SEQ ID NO: 1198261 - RNA, 16 nt, Homo sapiens
gaauagagguccucau

SEQ ID NO: 1198262 - RNA, 15 nt, Homo sapiens
gaauagcacagguga

SEQ ID NO: 1198263 - RNA, 15 nt, Homo sapiens
gaauaggcuguguau

SEQ ID NO: 1198264 - RNA, 20 nt, Homo sapiens
gaauauaauuucaaaccaca

SEQ ID NO: 1198265 - RNA, 14 nt, Homo sapiens
gaauauacauuguc

SEQ ID NO: 1198266 - RNA, 14 nt, Homo sapiens
gaauauaggucucu

SEQ ID NO: 1198267 - RNA, 21 nt, Homo sapiens
gaauauauuauaaucuuccau

SEQ ID NO: 1198268 - RNA, 16 nt, Homo sapiens
gaauauauuuccuuau

SEQ ID NO: 1198269 - RNA, 19 nt, Homo sapiens
gaauaucaucugucauuau

SEQ ID NO: 1198270 - RNA, 14 nt, Homo sapiens
gaauauccauguac

SEQ ID NO: 1198271 - RNA, 18 nt, Homo sapiens
gaauaucugggauucuac

SEQ ID NO: 1198272 - RNA, 13 nt, Homo sapiens
gaauaucuguuca

SEQ ID NO: 1198273 - RNA, 22 nt, Homo sapiens
gaauaugaccauuugacuguuc

SEQ ID NO: 1198274 - RNA, 13 nt, Homo sapiens
gaauaugcacaaa

SEQ ID NO: 1198275 - RNA, 13 nt, Homo sapiens
gaaucacauucuu

SEQ ID NO: 1198276 - RNA, 22 nt, Homo sapiens
gaaucagugaagccaaagggac

SEQ ID NO: 1198277 - RNA, 23 nt, Homo sapiens
gaaucaucaaagcucacaccaaa

SEQ ID NO: 1198278 - RNA, 18 nt, Homo sapiens
gaaucauuaauacaaaga

SEQ ID NO: 1198279 - RNA, 14 nt, Homo sapiens
gaaucauuaucuua

SEQ ID NO: 1198280 - RNA, 16 nt, Homo sapiens
gaauccagacccggcu

SEQ ID NO: 1198281 - RNA, 19 nt, Homo sapiens
gaauccauaaauguguucc

SEQ ID NO: 1198282 - RNA, 20 nt, Homo sapiens
gaaucccacccacaugugac

SEQ ID NO: 1198283 - RNA, 21 nt, Homo sapiens
gaauccuuggggagcacuugu

SEQ ID NO: 1198284 - RNA, 22 nt, Homo sapiens
gaaucggcuggggacugcuacc

SEQ ID NO: 1198285 - RNA, 16 nt, Homo sapiens
gaaucucguucccaaa

SEQ ID NO: 1198286 - RNA, 13 nt, Homo sapiens
gaaucucucccuc

SEQ ID NO: 1198287 - RNA, 20 nt, Homo sapiens
gaaucugcauuuagcacaaa

SEQ ID NO: 1198288 - RNA, 21 nt, Homo sapiens
gaaucugugugaaacuuucau

SEQ ID NO: 1198289 - RNA, 18 nt, Homo sapiens
gaaucuucaagaccaaag

SEQ ID NO: 1198290 - RNA, 16 nt, Homo sapiens
gaaugaacaaagucca

SEQ ID NO: 1198291 - RNA, 15 nt, Homo sapiens
gaaugaacacucccc

SEQ ID NO: 1198292 - RNA, 13 nt, Homo sapiens
gacucuucagucu

SEQ ID NO: 1198293 - RNA, 11 nt, Homo sapiens
gacucuuccac

SEQ ID NO: 1198294 - RNA, 17 nt, Homo sapiens
gacucuugcagggguag

SEQ ID NO: 1198295 - RNA, 13 nt, Homo sapiens
gacucuugcucuu

SEQ ID NO: 1198296 - RNA, 15 nt, Homo sapiens
gacucuugcucuuuc

SEQ ID NO: 1198297 - RNA, 22 nt, Homo sapiens
gacucuuuaauaaauugcuuac

SEQ ID NO: 1198298 - RNA, 19 nt, Homo sapiens
gacucuuuugagugguaau

SEQ ID NO: 1198299 - RNA, 18 nt, Homo sapiens
gacugacaaccucaucca

SEQ ID NO: 1198300 - RNA, 17 nt, Homo sapiens
gacugagccaugcucag

SEQ ID NO: 1198301 - RNA, 22 nt, Homo sapiens
gacugcacagcguccuguccac

SEQ ID NO: 1198302 - RNA, 17 nt, Homo sapiens
gacugcaugacagucac

SEQ ID NO: 1198303 - RNA, 22 nt, Homo sapiens
gacugccucugccacacucuga

SEQ ID NO: 1198304 - RNA, 13 nt, Homo sapiens
gacugcuaccucu

SEQ ID NO: 1198305 - RNA, 13 nt, Homo sapiens
gacugcuaguguu

SEQ ID NO: 1198306 - RNA, 19 nt, Homo sapiens
gacugcuucaucugcugua

SEQ ID NO: 1198307 - RNA, 13 nt, Homo sapiens
gacuggacacaaa

SEQ ID NO: 1198308 - RNA, 19 nt, Homo sapiens
gacuggacgugcucagaca

SEQ ID NO: 1198309 - RNA, 22 nt, Homo sapiens
gacuggcccuguccuggcauca

SEQ ID NO: 1198310 - RNA, 17 nt, Homo sapiens
gacugggggacugggag

SEQ ID NO: 1198311 - RNA, 23 nt, Homo sapiens
gacuguccaagugccacaugccu

SEQ ID NO: 1198312 - RNA, 14 nt, Homo sapiens
gacugucuuucaga

SEQ ID NO: 1198313 - RNA, 22 nt, Homo sapiens
gacugugcauacuuucccucau

SEQ ID NO: 1198314 - RNA, 14 nt, Homo sapiens
gacugugcuacugu

SEQ ID NO: 1198315 - RNA, 16 nt, Homo sapiens
gacuguggccuguuaa

SEQ ID NO: 1198316 - RNA, 11 nt, Homo sapiens
gacuguuacag

SEQ ID NO: 1198317 - RNA, 19 nt, Homo sapiens
gacuguuccaaagccagug

SEQ ID NO: 1198318 - RNA, 14 nt, Homo sapiens
gacuuaaugugauu

SEQ ID NO: 1198319 - RNA, 15 nt, Homo sapiens
gacuuacaauaccau

SEQ ID NO: 1198320 - RNA, 23 nt, Homo sapiens
gacuuacuaugggauggggucca

SEQ ID NO: 1198321 - RNA, 13 nt, Homo sapiens
gacuuacugggug

SEQ ID NO: 1198322 - RNA, 11 nt, Homo sapiens
gacuucaucug

SEQ ID NO: 1198323 - RNA, 20 nt, Homo sapiens
gacuucaugacaagcauuuu

SEQ ID NO: 1198324 - RNA, 22 nt, Homo sapiens
gacuucaugacaagcauuuugu

SEQ ID NO: 1198325 - RNA, 12 nt, Homo sapiens
gacuuccagcuu

SEQ ID NO: 1198326 - RNA, 20 nt, Homo sapiens
gacuuccaucuagucacaaa

SEQ ID NO: 1198327 - RNA, 19 nt, Homo sapiens
gacuuccauuugcuuuguc

SEQ ID NO: 1198328 - RNA, 23 nt, Homo sapiens
gacuuccccacugcucucugugg

SEQ ID NO: 1198329 - RNA, 16 nt, Homo sapiens
gacuuccuggggcccc

SEQ ID NO: 1198330 - RNA, 17 nt, Homo sapiens
gacuucugccuggagac

SEQ ID NO: 1198331 - RNA, 20 nt, Homo sapiens
gacuucugugggccccucaa

SEQ ID NO: 1198332 - RNA, 21 nt, Homo sapiens
gacuugaaaguuuuccaguau

SEQ ID NO: 1198333 - RNA, 14 nt, Homo sapiens
gacuugauagcaaa

SEQ ID NO: 1198334 - RNA, 21 nt, Homo sapiens
gacuugcaaagaccuaccucc

SEQ ID NO: 1198335 - RNA, 22 nt, Homo sapiens
gacuugcaaagaccuaccucca

SEQ ID NO: 1198336 - RNA, 21 nt, Homo sapiens
gacuuggacaggagucagugu

SEQ ID NO: 1198337 - RNA, 20 nt, Homo sapiens
gacuuggaguaaaacuguau

SEQ ID NO: 1198338 - RNA, 20 nt, Homo sapiens
gacuuggucugauuucagga

SEQ ID NO: 1198339 - RNA, 20 nt, Homo sapiens
gacuuguuuuaaacuugccu

SEQ ID NO: 1198340 - RNA, 15 nt, Homo sapiens
gacuuuagaaauaaa

SEQ ID NO: 1198341 - RNA, 13 nt, Homo sapiens
gacuuucugauua

SEQ ID NO: 1198342 - RNA, 12 nt, Homo sapiens
gacuuugcuugc

SEQ ID NO: 1198343 - RNA, 17 nt, Homo sapiens
gacuuugguuugaccca

SEQ ID NO: 1198344 - RNA, 16 nt, Homo sapiens
gagaaaaaaauugcuc

SEQ ID NO: 1198345 - RNA, 19 nt, Homo sapiens
gagaaaaaagaaguguccg

SEQ ID NO: 1198346 - RNA, 21 nt, Homo sapiens
gagaaaaaugcuccccacagc

SEQ ID NO: 1198347 - RNA, 18 nt, Homo sapiens
gagaaaauccaggucaug

SEQ ID NO: 1198348 - RNA, 16 nt, Homo sapiens
gagaaaauguuguaua

SEQ ID NO: 1198349 - RNA, 23 nt, Homo sapiens
gagaaacagagacaggcccaaga

SEQ ID NO: 1198350 - RNA, 13 nt, Homo sapiens
gagaaaccagcuu

SEQ ID NO: 1198351 - RNA, 21 nt, Homo sapiens
gagaaacccuucacaccccag

SEQ ID NO: 1198352 - RNA, 20 nt, Homo sapiens
gagaaaccuuauuguaccuc

SEQ ID NO: 1198353 - RNA, 16 nt, Homo sapiens
gagaaagcagccauug

SEQ ID NO: 1198354 - RNA, 13 nt, Homo sapiens
gagaaauggccaa

SEQ ID NO: 1198355 - RNA, 18 nt, Homo sapiens
gagaacaaagcuguuaaa

SEQ ID NO: 1198356 - RNA, 17 nt, Homo sapiens
gagaacccauuucucca

SEQ ID NO: 1198357 - RNA, 15 nt, Homo sapiens
gagaaccucagauca

SEQ ID NO: 1198358 - RNA, 21 nt, Homo sapiens
gagaacucagcuguccagcug

SEQ ID NO: 1198359 - RNA, 21 nt, Homo sapiens
gagaacuuuuugcaugcuuau

SEQ ID NO: 1198360 - RNA, 18 nt, Homo sapiens
gagaagacccacgugcua

SEQ ID NO: 1198361 - RNA, 12 nt, Homo sapiens
gagaagcuguag

SEQ ID NO: 1198362 - RNA, 15 nt, Homo sapiens
gagaaggaaagugau

SEQ ID NO: 1198363 - RNA, 20 nt, Homo sapiens
gagaagggaagaaggggcca

SEQ ID NO: 1198364 - RNA, 23 nt, Homo sapiens
gagaaggugcuuuguaauauucu

SEQ ID NO: 1198365 - RNA, 21 nt, Homo sapiens
gagaaguuuguagccagguac

SEQ ID NO: 1198366 - RNA, 15 nt, Homo sapiens
gagaaucugcugcau

SEQ ID NO: 1198367 - RNA, 15 nt, Homo sapiens
gagaaugcuggcaaa

SEQ ID NO: 1198368 - RNA, 18 nt, Homo sapiens
gagaauucacagaaccua

SEQ ID NO: 1198369 - RNA, 20 nt, Homo sapiens
gagaauuuaucccuuuacaa

SEQ ID NO: 1198370 - RNA, 21 nt, Homo sapiens
gagacacaacuauuuuuccaa

SEQ ID NO: 1198371 - RNA, 14 nt, Homo sapiens
gagacacaucuccu

SEQ ID NO: 1198372 - RNA, 15 nt, Homo sapiens
gagacaccaaccgac

SEQ ID NO: 1198373 - RNA, 17 nt, Homo sapiens
gagacaccaccuauacc

SEQ ID NO: 1198374 - RNA, 11 nt, Homo sapiens
gagacacucca

SEQ ID NO: 1198375 - RNA, 20 nt, Homo sapiens
gagacagacagagaaggcag

SEQ ID NO: 1198376 - RNA, 19 nt, Homo sapiens
gagacaggaggauugccug

SEQ ID NO: 1198377 - RNA, 18 nt, Homo sapiens
gagacaggccccugaguc

SEQ ID NO: 1198378 - RNA, 17 nt, Homo sapiens
gagacaggguuucacug

SEQ ID NO: 1198379 - RNA, 12 nt, Homo sapiens
gagacaguccag

SEQ ID NO: 1198380 - RNA, 12 nt, Homo sapiens
gagacagugacu

SEQ ID NO: 1198381 - RNA, 14 nt, Homo sapiens
gagacagugaggcu

SEQ ID NO: 1198382 - RNA, 15 nt, Homo sapiens
gagacauaggccaug

SEQ ID NO: 1198383 - RNA, 15 nt, Homo sapiens
gagacaugugacauu

SEQ ID NO: 1198384 - RNA, 16 nt, Homo sapiens
gagaccacggggagca

SEQ ID NO: 1198385 - RNA, 17 nt, Homo sapiens
gagaccaggccugagca

SEQ ID NO: 1198386 - RNA, 12 nt, Homo sapiens
gagaccagugua

SEQ ID NO: 1198387 - RNA, 23 nt, Homo sapiens
gagacccccacaccucaguuccc

SEQ ID NO: 1198388 - RNA, 18 nt, Homo sapiens
gagacccguagaugccag

SEQ ID NO: 1198389 - RNA, 21 nt, Homo sapiens
gagacccugccuuuaaaaaca

SEQ ID NO: 1198390 - RNA, 16 nt, Homo sapiens
gagaccucaagcccug

SEQ ID NO: 1198391 - RNA, 13 nt, Homo sapiens
gagaccuccaaua

SEQ ID NO: 1198392 - RNA, 15 nt, Homo sapiens
gagacgggcaucgca

SEQ ID NO: 1198393 - RNA, 12 nt, Homo sapiens
gagacucuaggg

SEQ ID NO: 1198394 - RNA, 13 nt, Homo sapiens
gagacucugucuc

SEQ ID NO: 1198395 - RNA, 18 nt, Homo sapiens
gagacugcguucugcaag

SEQ ID NO: 1198396 - RNA, 14 nt, Homo sapiens
gagacugggagcca

SEQ ID NO: 1198397 - RNA, 22 nt, Homo sapiens
gagacugggagccacuucuccc

SEQ ID NO: 1198398 - RNA, 16 nt, Homo sapiens
gagacugucccugaaa

SEQ ID NO: 1198399 - RNA, 14 nt, Homo sapiens
gagacuuacugggu

SEQ ID NO: 1198400 - RNA, 19 nt, Homo sapiens
gagacuucacgggcaauca

SEQ ID NO: 1198401 - RNA, 15 nt, Homo sapiens
gagacuugggggcca

SEQ ID NO: 1198402 - RNA, 14 nt, Homo sapiens
gagagaaagccagg

SEQ ID NO: 1198403 - RNA, 13 nt, Homo sapiens
gagagaaagggag

SEQ ID NO: 1198404 - RNA, 15 nt, Homo sapiens
gagagaaccucaggu

SEQ ID NO: 1198405 - RNA, 16 nt, Homo sapiens
gagagaggagccagac

SEQ ID NO: 1198406 - RNA, 12 nt, Homo sapiens
gagagauguuuu

SEQ ID NO: 1198407 - RNA, 21 nt, Homo sapiens
gagagcagcuucagugacaaa

SEQ ID NO: 1198408 - RNA, 17 nt, Homo sapiens
gagagcaugcuauccca

SEQ ID NO: 1198409 - RNA, 14 nt, Homo sapiens
gagagcccagucuc

SEQ ID NO: 1198410 - RNA, 15 nt, Homo sapiens
gagagccuugguuca

SEQ ID NO: 1198411 - RNA, 19 nt, Homo sapiens
gagagcgcuuuugucugca

SEQ ID NO: 1198412 - RNA, 23 nt, Homo sapiens
gagagcuaaauuacaauugucau

SEQ ID NO: 1198413 - RNA, 23 nt, Homo sapiens
gagagcuuucuguccuuuuggca

SEQ ID NO: 1198414 - RNA, 13 nt, Homo sapiens
gagaggagccaga

SEQ ID NO: 1198415 - RNA, 15 nt, Homo sapiens
gagaggaugugcaag

SEQ ID NO: 1198416 - RNA, 21 nt, Homo sapiens
gagaggauguggaaagcacuu

SEQ ID NO: 1198417 - RNA, 22 nt, Homo sapiens
gagaggcccugggguucucccc

SEQ ID NO: 1198418 - RNA, 13 nt, Homo sapiens
gaugcgacuguaa

SEQ ID NO: 1198419 - RNA, 15 nt, Homo sapiens
gaugcguucacucca

SEQ ID NO: 1198420 - RNA, 13 nt, Homo sapiens
gaugcucccucag

SEQ ID NO: 1198421 - RNA, 12 nt, Homo sapiens
gaugcugcuaug

SEQ ID NO: 1198422 - RNA, 15 nt, Homo sapiens
gaugcugcuccgccc

SEQ ID NO: 1198423 - RNA, 13 nt, Homo sapiens
gaugcugugaaga

SEQ ID NO: 1198424 - RNA, 18 nt, Homo sapiens
gauggaaguugcagugag

SEQ ID NO: 1198425 - RNA, 23 nt, Homo sapiens
gauggaaugaccagccuguccaa

SEQ ID NO: 1198426 - RNA, 21 nt, Homo sapiens
gauggaauuauuguaccauuu

SEQ ID NO: 1198427 - RNA, 14 nt, Homo sapiens
gauggacucugaaa

SEQ ID NO: 1198428 - RNA, 17 nt, Homo sapiens
gauggaucugugguccu

SEQ ID NO: 1198429 - RNA, 16 nt, Homo sapiens
gauggccagagaugcu

SEQ ID NO: 1198430 - RNA, 16 nt, Homo sapiens
gauggccccuccacug

SEQ ID NO: 1198431 - RNA, 14 nt, Homo sapiens
gaugggaacacugg

SEQ ID NO: 1198432 - RNA, 17 nt, Homo sapiens
gaugggaccagggaugg

SEQ ID NO: 1198433 - RNA, 14 nt, Homo sapiens
gaugggagugggca

SEQ ID NO: 1198434 - RNA, 18 nt, Homo sapiens
gauggggcaagggcacaa

SEQ ID NO: 1198435 - RNA, 14 nt, Homo sapiens
gauggguggugcuc

SEQ ID NO: 1198436 - RNA, 13 nt, Homo sapiens
gaugguccacugu

SEQ ID NO: 1198437 - RNA, 19 nt, Homo sapiens
gaugguuuuaucuucccuu

SEQ ID NO: 1198438 - RNA, 13 nt, Homo sapiens
gauguaacauucc

SEQ ID NO: 1198439 - RNA, 15 nt, Homo sapiens
gauguagucaguuag

SEQ ID NO: 1198440 - RNA, 20 nt, Homo sapiens
gauguauaaaauggucaugg

SEQ ID NO: 1198441 - RNA, 20 nt, Homo sapiens
gauguaucccugccccgugg

SEQ ID NO: 1198442 - RNA, 15 nt, Homo sapiens
gaugucagcuuccca

SEQ ID NO: 1198443 - RNA, 20 nt, Homo sapiens
gaugucaucacacucuccau

SEQ ID NO: 1198444 - RNA, 12 nt, Homo sapiens
gaugucauucuu

SEQ ID NO: 1198445 - RNA, 18 nt, Homo sapiens
gauguccccaaaguacca

SEQ ID NO: 1198446 - RNA, 20 nt, Homo sapiens
gauguccccaaaguaccaca

SEQ ID NO: 1198447 - RNA, 12 nt, Homo sapiens
gauguccuacua

SEQ ID NO: 1198448 - RNA, 22 nt, Homo sapiens
gaugucgcccuacucaccugag

SEQ ID NO: 1198449 - RNA, 16 nt, Homo sapiens
gaugucuauguagcug

SEQ ID NO: 1198450 - RNA, 16 nt, Homo sapiens
gaugugaaaugaaugu

SEQ ID NO: 1198451 - RNA, 16 nt, Homo sapiens
gaugugacagcccuga

SEQ ID NO: 1198452 - RNA, 15 nt, Homo sapiens
gaugugacauuccau

SEQ ID NO: 1198453 - RNA, 22 nt, Homo sapiens
gaugugcagccccuuccuggug

SEQ ID NO: 1198454 - RNA, 20 nt, Homo sapiens
gauguguauacguaggaauu

SEQ ID NO: 1198455 - RNA, 16 nt, Homo sapiens
gauguguccucaggga

SEQ ID NO: 1198456 - RNA, 20 nt, Homo sapiens
gauguuaacaagaggggaaa

SEQ ID NO: 1198457 - RNA, 15 nt, Homo sapiens
gauguucugggacac

SEQ ID NO: 1198458 - RNA, 17 nt, Homo sapiens
gauguugaaacuuugaa

SEQ ID NO: 1198459 - RNA, 18 nt, Homo sapiens
gauguugcuggacuguca

SEQ ID NO: 1198460 - RNA, 21 nt, Homo sapiens
gauguuuaacaaaucuaaucu

SEQ ID NO: 1198461 - RNA, 20 nt, Homo sapiens
gauguuugaggcuuucagaa

SEQ ID NO: 1198462 - RNA, 22 nt, Homo sapiens
gauuaagauauucagaaguaua

SEQ ID NO: 1198463 - RNA, 16 nt, Homo sapiens
gauuaauuaguugauu

SEQ ID NO: 1198464 - RNA, 23 nt, Homo sapiens
gauuacaaggcuuuaucucaggg

SEQ ID NO: 1198465 - RNA, 17 nt, Homo sapiens
gauuacagaaacugaug

SEQ ID NO: 1198466 - RNA, 16 nt, Homo sapiens
gauuacaggcaccugc

SEQ ID NO: 1198467 - RNA, 19 nt, Homo sapiens
gauuacaggcgugagccac

SEQ ID NO: 1198468 - RNA, 23 nt, Homo sapiens
gauuacucuccauaucccuuccu

SEQ ID NO: 1198469 - RNA, 17 nt, Homo sapiens
gauuagaugacucucag

SEQ ID NO: 1198470 - RNA, 18 nt, Homo sapiens
gauuauacaaaagagcau

SEQ ID NO: 1198471 - RNA, 22 nt, Homo sapiens
gauuaugaagugacucucacaa

SEQ ID NO: 1198472 - RNA, 20 nt, Homo sapiens
gauuaugauauuauuugauu

SEQ ID NO: 1198473 - RNA, 17 nt, Homo sapiens
gauuaugccacugcuuu

SEQ ID NO: 1198474 - RNA, 20 nt, Homo sapiens
gauuauuauguuuauuacaa

SEQ ID NO: 1198475 - RNA, 23 nt, Homo sapiens
gauuauucuuugaaaacagauga

SEQ ID NO: 1198476 - RNA, 17 nt, Homo sapiens
gauuauuuaaaugggaa

SEQ ID NO: 1198477 - RNA, 15 nt, Homo sapiens
gauuauuuccagugu

SEQ ID NO: 1198478 - RNA, 15 nt, Homo sapiens
gauucaaauugcugc

SEQ ID NO: 1198479 - RNA, 16 nt, Homo sapiens
gauucaaauugcugcu

SEQ ID NO: 1198480 - RNA, 22 nt, Homo sapiens
gauucagaaauuggaacagaau

SEQ ID NO: 1198481 - RNA, 12 nt, Homo sapiens
gauucagcaaaa

SEQ ID NO: 1198482 - RNA, 21 nt, Homo sapiens
gauucagcgaagucucauggg

SEQ ID NO: 1198483 - RNA, 20 nt, Homo sapiens
gauucaggggucugaugaca

SEQ ID NO: 1198484 - RNA, 18 nt, Homo sapiens
gauucaucaucccuuaau

SEQ ID NO: 1198485 - RNA, 22 nt, Homo sapiens
gauuccaacauuucucacugaa

SEQ ID NO: 1198486 - RNA, 20 nt, Homo sapiens
gauucccgggcuuaccaggu

SEQ ID NO: 1198487 - RNA, 17 nt, Homo sapiens
gauucuaaugucuucau

SEQ ID NO: 1198488 - RNA, 18 nt, Homo sapiens
gauucuauaucaugacca

SEQ ID NO: 1198489 - RNA, 21 nt, Homo sapiens
gauucuaugaagcccacccag

SEQ ID NO: 1198490 - RNA, 16 nt, Homo sapiens
gauucucugaguggug

SEQ ID NO: 1198491 - RNA, 23 nt, Homo sapiens
gauucucuuuaaaaaagacugaa

SEQ ID NO: 1198492 - RNA, 23 nt, Homo sapiens
gauucuuauuaguuccccaaaua

SEQ ID NO: 1198493 - RNA, 14 nt, Homo sapiens
gauucuucccacac

SEQ ID NO: 1198494 - RNA, 18 nt, Homo sapiens
gauucuuuccauuaugau

SEQ ID NO: 1198495 - RNA, 16 nt, Homo sapiens
gauugaaagaaccaga

SEQ ID NO: 1198496 - RNA, 12 nt, Homo sapiens
gauugaacucca

SEQ ID NO: 1198497 - RNA, 16 nt, Homo sapiens
gauugauuaaugaacu

SEQ ID NO: 1198498 - RNA, 11 nt, Homo sapiens
gauugcacaga

SEQ ID NO: 1198499 - RNA, 13 nt, Homo sapiens
gauugcacuugau

SEQ ID NO: 1198500 - RNA, 14 nt, Homo sapiens
gauugccaaauuga

SEQ ID NO: 1198501 - RNA, 12 nt, Homo sapiens
gauugcugccau

SEQ ID NO: 1198502 - RNA, 19 nt, Homo sapiens
gauuggcuauaacaugucu

SEQ ID NO: 1198503 - RNA, 16 nt, Homo sapiens
gauugguccuuuucaa

SEQ ID NO: 1198504 - RNA, 16 nt, Homo sapiens
gauuguauauggaaca

SEQ ID NO: 1198505 - RNA, 18 nt, Homo sapiens
gauuguauauggaacaaa

SEQ ID NO: 1198506 - RNA, 19 nt, Homo sapiens
gauugugggauacuauuua

SEQ ID NO: 1198507 - RNA, 18 nt, Homo sapiens
gauuguuguguagucaag

SEQ ID NO: 1198508 - RNA, 17 nt, Homo sapiens
gauuguuuacagucauu

SEQ ID NO: 1198509 - RNA, 20 nt, Homo sapiens
gauuguuuauacuccagugu

SEQ ID NO: 1198510 - RNA, 18 nt, Homo sapiens
gauuguuuccucuuccaa

SEQ ID NO: 1198511 - RNA, 17 nt, Homo sapiens
gauuuaaaguggcagcu

SEQ ID NO: 1198512 - RNA, 22 nt, Homo sapiens
gauuuauaguaugugacuuuuc

SEQ ID NO: 1198513 - RNA, 22 nt, Homo sapiens
gauuuaucugcugaaagcucag

SEQ ID NO: 1198514 - RNA, 22 nt, Homo sapiens
gauuuaugaugcacuuauucaa

SEQ ID NO: 1198515 - RNA, 15 nt, Homo sapiens
gauuuauucugccaa

SEQ ID NO: 1198516 - RNA, 23 nt, Homo sapiens
gauuucaccccacagacacuuac

SEQ ID NO: 1198517 - RNA, 21 nt, Homo sapiens
gauuucagaucauauuucaca

SEQ ID NO: 1198518 - RNA, 15 nt, Homo sapiens
gauuucagcagggau

SEQ ID NO: 1198519 - RNA, 13 nt, Homo sapiens
gauuucaggauac

SEQ ID NO: 1198520 - RNA, 23 nt, Homo sapiens
gauuucaugccuggugcuuccaa

SEQ ID NO: 1198521 - RNA, 12 nt, Homo sapiens
gauuuccaggga

SEQ ID NO: 1198522 - RNA, 13 nt, Homo sapiens
gauuuccuugaau

SEQ ID NO: 1198523 - RNA, 20 nt, Homo sapiens
gauuucuacauuaacuugaa

SEQ ID NO: 1198524 - RNA, 13 nt, Homo sapiens
gauuucuaccuca

SEQ ID NO: 1198525 - RNA, 19 nt, Homo sapiens
gauuugaagaacaugugag

SEQ ID NO: 1198526 - RNA, 13 nt, Homo sapiens
gauuugauaccau

SEQ ID NO: 1198527 - RNA, 22 nt, Homo sapiens
gauuugauugggaugaaugcca

SEQ ID NO: 1198528 - RNA, 22 nt, Homo sapiens
gauuugccagcacaggggcccc

SEQ ID NO: 1198529 - RNA, 15 nt, Homo sapiens
gauuuguacaggagu

SEQ ID NO: 1198530 - RNA, 14 nt, Homo sapiens
gauuuguagcacug

SEQ ID NO: 1198531 - RNA, 18 nt, Homo sapiens
gauuuguaugcucauuga

SEQ ID NO: 1198532 - RNA, 18 nt, Homo sapiens
gauuuguucuuacaguua

SEQ ID NO: 1198533 - RNA, 19 nt, Homo sapiens
gauuuuaaaaagucuucac

SEQ ID NO: 1198534 - RNA, 18 nt, Homo sapiens
gauuuuacaaaagaugua

SEQ ID NO: 1198535 - RNA, 14 nt, Homo sapiens
gauuuuaccaaagc

SEQ ID NO: 1198536 - RNA, 15 nt, Homo sapiens
gauuuuaccaaagca

SEQ ID NO: 1198537 - RNA, 19 nt, Homo sapiens
gauuuugcaaucuguguuc

SEQ ID NO: 1198538 - RNA, 19 nt, Homo sapiens
gcaaaaauggauauuauua

SEQ ID NO: 1198539 - RNA, 16 nt, Homo sapiens
gcaaaaccucauuuaa

SEQ ID NO: 1198540 - RNA, 14 nt, Homo sapiens
gcaaaaggcagcuc

SEQ ID NO: 1198541 - RNA, 18 nt, Homo sapiens
gcaaaauagacauauuaa

SEQ ID NO: 1198542 - RNA, 17 nt, Homo sapiens
gcaaaauauuugacuau

SEQ ID NO: 1198543 - RNA, 18 nt, Homo sapiens
gcaaaauugauguguuua

SEQ ID NO: 1198544 - RNA, 21 nt, Homo sapiens
gccaggacaugcagcccagaa

SEQ ID NO: 1198545 - RNA, 15 nt, Homo sapiens
gccaggagcugucac

SEQ ID NO: 1198546 - RNA, 20 nt, Homo sapiens
gccaggagguuggugacuga

SEQ ID NO: 1198547 - RNA, 17 nt, Homo sapiens
gccaggauccucuccuu

SEQ ID NO: 1198548 - RNA, 22 nt, Homo sapiens
gccaggauggucucgaucuccu

SEQ ID NO: 1198549 - RNA, 13 nt, Homo sapiens
gccaggcucaggc

SEQ ID NO: 1198550 - RNA, 21 nt, Homo sapiens
gccaggcugaauuacagugaa

SEQ ID NO: 1198551 - RNA, 16 nt, Homo sapiens
gccaggcuggucucaa

SEQ ID NO: 1198552 - RNA, 21 nt, Homo sapiens
gccaggcuggucucaaacucc

SEQ ID NO: 1198553 - RNA, 14 nt, Homo sapiens
gccagggucucacu

SEQ ID NO: 1198554 - RNA, 15 nt, Homo sapiens
gccagugagggcagu

SEQ ID NO: 1198555 - RNA, 17 nt, Homo sapiens
gccagugccagcaccug

SEQ ID NO: 1198556 - RNA, 18 nt, Homo sapiens
gccagugccagcaccugc

SEQ ID NO: 1198557 - RNA, 21 nt, Homo sapiens
gccagugccauuccacuccac

SEQ ID NO: 1198558 - RNA, 21 nt, Homo sapiens
gccaguggggccuguggaaug

SEQ ID NO: 1198559 - RNA, 21 nt, Homo sapiens
gccaguuccucccaucuucag

SEQ ID NO: 1198560 - RNA, 21 nt, Homo sapiens
gccaguuucagcucacuuccu

SEQ ID NO: 1198561 - RNA, 18 nt, Homo sapiens
gccauaaaaguaaaggau

SEQ ID NO: 1198562 - RNA, 14 nt, Homo sapiens
gccauaacagacca

SEQ ID NO: 1198563 - RNA, 22 nt, Homo sapiens
gccauaagaggugaucucuggg

SEQ ID NO: 1198564 - RNA, 19 nt, Homo sapiens
gccauaggguccugaaugu

SEQ ID NO: 1198565 - RNA, 22 nt, Homo sapiens
gccaucaaacauaauucucuca

SEQ ID NO: 1198566 - RNA, 14 nt, Homo sapiens
gccaucacuagaag

SEQ ID NO: 1198567 - RNA, 16 nt, Homo sapiens
gccaucaugccugacu

SEQ ID NO: 1198568 - RNA, 17 nt, Homo sapiens
gccauccucacccagca

SEQ ID NO: 1198569 - RNA, 14 nt, Homo sapiens
gccaucguccuggg

SEQ ID NO: 1198570 - RNA, 15 nt, Homo sapiens
gccaucguucaucca

SEQ ID NO: 1198571 - RNA, 14 nt, Homo sapiens
gccaugaaccaaau

SEQ ID NO: 1198572 - RNA, 14 nt, Homo sapiens
gccaugaccuuccu

SEQ ID NO: 1198573 - RNA, 22 nt, Homo sapiens
gccaugauaacugcaauuuuaa

SEQ ID NO: 1198574 - RNA, 13 nt, Homo sapiens
gccaugggccagc

SEQ ID NO: 1198575 - RNA, 13 nt, Homo sapiens
gccauguccaaag

SEQ ID NO: 1198576 - RNA, 16 nt, Homo sapiens
gccauguccaaagagg

SEQ ID NO: 1198577 - RNA, 12 nt, Homo sapiens
gccauguucucc

SEQ ID NO: 1198578 - RNA, 23 nt, Homo sapiens
gccauguuucaagaaaauggauu

SEQ ID NO: 1198579 - RNA, 15 nt, Homo sapiens
gccauguuuccucuu

SEQ ID NO: 1198580 - RNA, 12 nt, Homo sapiens
gccauuauuuaa

SEQ ID NO: 1198581 - RNA, 21 nt, Homo sapiens
gccauucacuucauaauccag

SEQ ID NO: 1198582 - RNA, 20 nt, Homo sapiens
gccauuccacuccacucagg

SEQ ID NO: 1198583 - RNA, 20 nt, Homo sapiens
gccauucuuuuuuucuuggc

SEQ ID NO: 1198584 - RNA, 13 nt, Homo sapiens
gccauuguucacc

SEQ ID NO: 1198585 - RNA, 22 nt, Homo sapiens
gccauuuuggguuuugggucuu

SEQ ID NO: 1198586 - RNA, 17 nt, Homo sapiens
gcccaaauggcagggau

SEQ ID NO: 1198587 - RNA, 15 nt, Homo sapiens
gcccaacugcgcaga

SEQ ID NO: 1198588 - RNA, 14 nt, Homo sapiens
gcccaagaauagau

SEQ ID NO: 1198589 - RNA, 16 nt, Homo sapiens
gcccaagagaugaaga

SEQ ID NO: 1198590 - RNA, 15 nt, Homo sapiens
gcccaagaggucuga

SEQ ID NO: 1198591 - RNA, 14 nt, Homo sapiens
gcccaagcacuuca

SEQ ID NO: 1198592 - RNA, 18 nt, Homo sapiens
gcccaauauaaaaggcaa

SEQ ID NO: 1198593 - RNA, 13 nt, Homo sapiens
gcccacaccaacg

SEQ ID NO: 1198594 - RNA, 16 nt, Homo sapiens
gcccacaguaggcacu

SEQ ID NO: 1198595 - RNA, 17 nt, Homo sapiens
gcccaccaucaccaccg

SEQ ID NO: 1198596 - RNA, 19 nt, Homo sapiens
gcccacccccaacaggaau

SEQ ID NO: 1198597 - RNA, 13 nt, Homo sapiens
gcccacgaucccc

SEQ ID NO: 1198598 - RNA, 15 nt, Homo sapiens
gcccacgcagaggac

SEQ ID NO: 1198599 - RNA, 20 nt, Homo sapiens
gcccacgcuggagugcagug

SEQ ID NO: 1198600 - RNA, 22 nt, Homo sapiens
gcccacuucaccguacuaacca

SEQ ID NO: 1198601 - RNA, 12 nt, Homo sapiens
gcccagacuaca

SEQ ID NO: 1198602 - RNA, 21 nt, Homo sapiens
gcccagaucgcaccacugcac

SEQ ID NO: 1198603 - RNA, 20 nt, Homo sapiens
gcccagccauuaccauggag

SEQ ID NO: 1198604 - RNA, 14 nt, Homo sapiens
gcccagcgcggcca

SEQ ID NO: 1198605 - RNA, 15 nt, Homo sapiens
gcccagcugcaccug

SEQ ID NO: 1198606 - RNA, 22 nt, Homo sapiens
gcccagcuuuuagaaaaugcag

SEQ ID NO: 1198607 - RNA, 21 nt, Homo sapiens
gcccaggaguuugaauccauc

SEQ ID NO: 1198608 - RNA, 19 nt, Homo sapiens
gcccaggcuggagugcaau

SEQ ID NO: 1198609 - RNA, 17 nt, Homo sapiens
gcccaggcugugcagcg

SEQ ID NO: 1198610 - RNA, 14 nt, Homo sapiens
gcccaggugccagc

SEQ ID NO: 1198611 - RNA, 14 nt, Homo sapiens
gcccaguguucucc

SEQ ID NO: 1198612 - RNA, 22 nt, Homo sapiens
gcccaucacaggguugggccca

SEQ ID NO: 1198613 - RNA, 21 nt, Homo sapiens
gcccauccccaggcaccucac

SEQ ID NO: 1198614 - RNA, 18 nt, Homo sapiens
gcccaucucaggugccac

SEQ ID NO: 1198615 - RNA, 20 nt, Homo sapiens
gcccaugcaauuuuauuaaa

SEQ ID NO: 1198616 - RNA, 23 nt, Homo sapiens
gcccauggcuuuagcuaccucac

SEQ ID NO: 1198617 - RNA, 23 nt, Homo sapiens
gcccaugggauaugugguguaua

SEQ ID NO: 1198618 - RNA, 21 nt, Homo sapiens
gcccauggugagcucugggaa

SEQ ID NO: 1198619 - RNA, 16 nt, Homo sapiens
gcccaugugcaccugc

SEQ ID NO: 1198620 - RNA, 15 nt, Homo sapiens
gcccauuuacacuuu

SEQ ID NO: 1198621 - RNA, 16 nt, Homo sapiens
gcccauuucuccauac

SEQ ID NO: 1198622 - RNA, 19 nt, Homo sapiens
gccccacaguuguguucau

SEQ ID NO: 1198623 - RNA, 15 nt, Homo sapiens
gccccacgugcuccc

SEQ ID NO: 1198624 - RNA, 12 nt, Homo sapiens
gccccacugcca

SEQ ID NO: 1198625 - RNA, 13 nt, Homo sapiens
gccccacuugaag

SEQ ID NO: 1198626 - RNA, 16 nt, Homo sapiens
gccccagacacagugc

SEQ ID NO: 1198627 - RNA, 17 nt, Homo sapiens
gccccagagcagggugu

SEQ ID NO: 1198628 - RNA, 23 nt, Homo sapiens
gccccagagcuguuuauggccuc

SEQ ID NO: 1198629 - RNA, 16 nt, Homo sapiens
gccccaguccaugcuu

SEQ ID NO: 1198630 - RNA, 20 nt, Homo sapiens
gcccccaauaaaggcagcug

SEQ ID NO: 1198631 - RNA, 21 nt, Homo sapiens
gcccccacguggggaggugga

SEQ ID NO: 1198632 - RNA, 22 nt, Homo sapiens
gcccccacugucccccuaccca

SEQ ID NO: 1198633 - RNA, 21 nt, Homo sapiens
gcccccagauagagcugggug

SEQ ID NO: 1198634 - RNA, 16 nt, Homo sapiens
gcccccagcccuggga

SEQ ID NO: 1198635 - RNA, 23 nt, Homo sapiens
gcccccaggccaggugaggucca

SEQ ID NO: 1198636 - RNA, 18 nt, Homo sapiens
gcccccaggggcaggacu

SEQ ID NO: 1198637 - RNA, 22 nt, Homo sapiens
gccccccguguggacacagauc

SEQ ID NO: 1198638 - RNA, 16 nt, Homo sapiens
gcccccgccacaaccc

SEQ ID NO: 1198639 - RNA, 18 nt, Homo sapiens
gcccccuccacaccagug

SEQ ID NO: 1198640 - RNA, 16 nt, Homo sapiens
gcccccuccucuagcu

SEQ ID NO: 1198641 - RNA, 16 nt, Homo sapiens
gcccccuccucuccca

SEQ ID NO: 1198642 - RNA, 17 nt, Homo sapiens
gcccccuguacauuugu

SEQ ID NO: 1198643 - RNA, 18 nt, Homo sapiens
gcccccuugggugaccuc

SEQ ID NO: 1198644 - RNA, 15 nt, Homo sapiens
gccccguuucuugcc

SEQ ID NO: 1198645 - RNA, 16 nt, Homo sapiens
gccccuacccuggacu

SEQ ID NO: 1198646 - RNA, 18 nt, Homo sapiens
gccccuccacuggggaau

SEQ ID NO: 1198647 - RNA, 17 nt, Homo sapiens
gccccugccccaagucc

SEQ ID NO: 1198648 - RNA, 15 nt, Homo sapiens
gccccugcccggcug

SEQ ID NO: 1198649 - RNA, 19 nt, Homo sapiens
gccccugcgggcuguggug

SEQ ID NO: 1198650 - RNA, 22 nt, Homo sapiens
gccccuggggccuagacucugu

SEQ ID NO: 1198651 - RNA, 15 nt, Homo sapiens
gccccuuuuacuuuu

SEQ ID NO: 1198652 - RNA, 18 nt, Homo sapiens
gcccgagaugugacccac

SEQ ID NO: 1198653 - RNA, 14 nt, Homo sapiens
gcccgagccaggaa

SEQ ID NO: 1198654 - RNA, 14 nt, Homo sapiens
gcccgcacagcagc

SEQ ID NO: 1198655 - RNA, 19 nt, Homo sapiens
gcccgcgcucuuucuuccc

SEQ ID NO: 1198656 - RNA, 18 nt, Homo sapiens
gcccggaccuccaucaga

SEQ ID NO: 1198657 - RNA, 19 nt, Homo sapiens
gcccggugguuugccaugu

SEQ ID NO: 1198658 - RNA, 20 nt, Homo sapiens
gcccuaaaaauccagacucu

SEQ ID NO: 1198659 - RNA, 15 nt, Homo sapiens
gcccuaccagcagcu

SEQ ID NO: 1198660 - RNA, 16 nt, Homo sapiens
gcccuacucccugcag

SEQ ID NO: 1198661 - RNA, 19 nt, Homo sapiens
gcccuaggggagcaccgug

SEQ ID NO: 1198662 - RNA, 17 nt, Homo sapiens
gcccucaaguaaaagaa

SEQ ID NO: 1198663 - RNA, 16 nt, Homo sapiens
gcccucagaacaaucc

SEQ ID NO: 1198664 - RNA, 20 nt, Homo sapiens
gcccucagccccacuucuca

SEQ ID NO: 1198665 - RNA, 17 nt, Homo sapiens
gcccucaucuugaaggg

SEQ ID NO: 1198666 - RNA, 21 nt, Homo sapiens
gcccucaugauauguccucag

SEQ ID NO: 1198667 - RNA, 16 nt, Homo sapiens
gcccuccuuucugugc

SEQ ID NO: 1198668 - RNA, 20 nt, Homo sapiens
gcccucgacacucaccauga

SEQ ID NO: 1198669 - RNA, 14 nt, Homo sapiens
guacucaauggagu

SEQ ID NO: 1198670 - RNA, 20 nt, Homo sapiens
guacuccagccugggugaca

SEQ ID NO: 1198671 - RNA, 17 nt, Homo sapiens
guacugacuuugcuugc

SEQ ID NO: 1198672 - RNA, 15 nt, Homo sapiens
guacugagggacaag

SEQ ID NO: 1198673 - RNA, 22 nt, Homo sapiens
guacugcacccagcagugucac

SEQ ID NO: 1198674 - RNA, 23 nt, Homo sapiens
guacugccuuaaauguaccuaug

SEQ ID NO: 1198675 - RNA, 16 nt, Homo sapiens
guacuguaugccuuca

SEQ ID NO: 1198676 - RNA, 17 nt, Homo sapiens
guacugugucucaugga

SEQ ID NO: 1198677 - RNA, 16 nt, Homo sapiens
guacuuauguugcaca

SEQ ID NO: 1198678 - RNA, 14 nt, Homo sapiens
guacuucagugcac

SEQ ID NO: 1198679 - RNA, 15 nt, Homo sapiens
guacuucuguguuca

SEQ ID NO: 1198680 - RNA, 18 nt, Homo sapiens
guacuugugaccauugua

SEQ ID NO: 1198681 - RNA, 14 nt, Homo sapiens
guagaaaaccucac

SEQ ID NO: 1198682 - RNA, 19 nt, Homo sapiens
guagaaacacaguuuugaa

SEQ ID NO: 1198683 - RNA, 14 nt, Homo sapiens
guagaaagccaaau

SEQ ID NO: 1198684 - RNA, 18 nt, Homo sapiens
guagaaauaauaugcauu

SEQ ID NO: 1198685 - RNA, 22 nt, Homo sapiens
guagaacucacucugggcugua

SEQ ID NO: 1198686 - RNA, 19 nt, Homo sapiens
guagacaagcguugagcca

SEQ ID NO: 1198687 - RNA, 18 nt, Homo sapiens
guagagacaauacaguaa

SEQ ID NO: 1198688 - RNA, 18 nt, Homo sapiens
guagagaggggacugggg

SEQ ID NO: 1198689 - RNA, 22 nt, Homo sapiens
guagagggaguugucaagucuc

SEQ ID NO: 1198690 - RNA, 12 nt, Homo sapiens
guagcagcaguu

SEQ ID NO: 1198691 - RNA, 20 nt, Homo sapiens
guagccaaagguucacucuc

SEQ ID NO: 1198692 - RNA, 12 nt, Homo sapiens
guagccagguac

SEQ ID NO: 1198693 - RNA, 14 nt, Homo sapiens
guagcgccagugua

SEQ ID NO: 1198694 - RNA, 18 nt, Homo sapiens
guagcuagaugccacugc

SEQ ID NO: 1198695 - RNA, 17 nt, Homo sapiens
guagcuauaucuauaua

SEQ ID NO: 1198696 - RNA, 19 nt, Homo sapiens
guagcugggauuacaggug

SEQ ID NO: 1198697 - RNA, 22 nt, Homo sapiens
guagcuuuccacauuugucaca

SEQ ID NO: 1198698 - RNA, 13 nt, Homo sapiens
guaggacauacca

SEQ ID NO: 1198699 - RNA, 15 nt, Homo sapiens
guaggcauauaucac

SEQ ID NO: 1198700 - RNA, 16 nt, Homo sapiens
guaggcuuaguuugug

SEQ ID NO: 1198701 - RNA, 14 nt, Homo sapiens
guaggggcaaaaau

SEQ ID NO: 1198702 - RNA, 19 nt, Homo sapiens
guaggggguuauugccucu

SEQ ID NO: 1198703 - RNA, 14 nt, Homo sapiens
guaggguugccaga

SEQ ID NO: 1198704 - RNA, 16 nt, Homo sapiens
guaggugugacuugaa

SEQ ID NO: 1198705 - RNA, 20 nt, Homo sapiens
guaguauuaaaaguugcauu

SEQ ID NO: 1198706 - RNA, 16 nt, Homo sapiens
guagucauucuuacaa

SEQ ID NO: 1198707 - RNA, 22 nt, Homo sapiens
guagugaauauguuuuauaugu

SEQ ID NO: 1198708 - RNA, 15 nt, Homo sapiens
guagugacacacaga

SEQ ID NO: 1198709 - RNA, 17 nt, Homo sapiens
guaguuaaggagccuaa

SEQ ID NO: 1198710 - RNA, 14 nt, Homo sapiens
guaguuacuguggu

SEQ ID NO: 1198711 - RNA, 12 nt, Homo sapiens
guauaaacauua

SEQ ID NO: 1198712 - RNA, 16 nt, Homo sapiens
guauaacaacuuugaa

SEQ ID NO: 1198713 - RNA, 23 nt, Homo sapiens
guauaaguguguacaagcauuca

SEQ ID NO: 1198714 - RNA, 21 nt, Homo sapiens
guauaaucuuguagacacuua

SEQ ID NO: 1198715 - RNA, 16 nt, Homo sapiens
guauaauuuaacuuca

SEQ ID NO: 1198716 - RNA, 20 nt, Homo sapiens
guauacauaaguuuaggaua

SEQ ID NO: 1198717 - RNA, 23 nt, Homo sapiens
guauagaaguuuguccauuugua

SEQ ID NO: 1198718 - RNA, 22 nt, Homo sapiens
guauagaauauuauaguuuaaa

SEQ ID NO: 1198719 - RNA, 19 nt, Homo sapiens
guauagagaaaaguguauu

SEQ ID NO: 1198720 - RNA, 23 nt, Homo sapiens
guauaggacucucaggcuuuuau

SEQ ID NO: 1198721 - RNA, 23 nt, Homo sapiens
guauaugauggggcaugugccau

SEQ ID NO: 1198722 - RNA, 20 nt, Homo sapiens
guauauucaaccaaauacuu

SEQ ID NO: 1198723 - RNA, 14 nt, Homo sapiens
guaucaaugaguaa

SEQ ID NO: 1198724 - RNA, 20 nt, Homo sapiens
guaucacacaguauaugaug

SEQ ID NO: 1198725 - RNA, 14 nt, Homo sapiens
guaucacacuguau

SEQ ID NO: 1198726 - RNA, 18 nt, Homo sapiens
guaucauucuuuacauau

SEQ ID NO: 1198727 - RNA, 20 nt, Homo sapiens
guauccaauaggcauuugau

SEQ ID NO: 1198728 - RNA, 18 nt, Homo sapiens
guaucccaugagccucag

SEQ ID NO: 1198729 - RNA, 19 nt, Homo sapiens
guauccccccaucuugcuu

SEQ ID NO: 1198730 - RNA, 23 nt, Homo sapiens
guauccuacugagcauuugcacc

SEQ ID NO: 1198731 - RNA, 15 nt, Homo sapiens
guauccucuauaauu

SEQ ID NO: 1198732 - RNA, 22 nt, Homo sapiens
guaucugaguugccaagacaaa

SEQ ID NO: 1198733 - RNA, 14 nt, Homo sapiens
guaugaaugcagug

SEQ ID NO: 1198734 - RNA, 15 nt, Homo sapiens
guaugagucaaugug

SEQ ID NO: 1198735 - RNA, 15 nt, Homo sapiens
guaugcaaaccucau

SEQ ID NO: 1198736 - RNA, 18 nt, Homo sapiens
guaugcaacucugacguu

SEQ ID NO: 1198737 - RNA, 13 nt, Homo sapiens
guaugcuggccag

SEQ ID NO: 1198738 - RNA, 17 nt, Homo sapiens
guauggcaaacugccau

SEQ ID NO: 1198739 - RNA, 13 nt, Homo sapiens
guaugggaucuga

SEQ ID NO: 1198740 - RNA, 17 nt, Homo sapiens
guauguacuaagcagua

SEQ ID NO: 1198741 - RNA, 16 nt, Homo sapiens
guauguauauauacac

SEQ ID NO: 1198742 - RNA, 18 nt, Homo sapiens
guauguauccccacuuau

SEQ ID NO: 1198743 - RNA, 22 nt, Homo sapiens
guaugucuacacguaaguauaa

SEQ ID NO: 1198744 - RNA, 19 nt, Homo sapiens
guaugucuuggacacugua

SEQ ID NO: 1198745 - RNA, 11 nt, Homo sapiens
guaugugaaca

SEQ ID NO: 1198746 - RNA, 16 nt, Homo sapiens
guaugugcacugucac

SEQ ID NO: 1198747 - RNA, 12 nt, Homo sapiens
guaugugcucuu

SEQ ID NO: 1198748 - RNA, 11 nt, Homo sapiens
guauguuaaag

SEQ ID NO: 1198749 - RNA, 14 nt, Homo sapiens
guauuacacuguau

SEQ ID NO: 1198750 - RNA, 14 nt, Homo sapiens
guauuauacaugug

SEQ ID NO: 1198751 - RNA, 12 nt, Homo sapiens
guauuauucaaa

SEQ ID NO: 1198752 - RNA, 22 nt, Homo sapiens
guauuauuuuacaaucaacaaa

SEQ ID NO: 1198753 - RNA, 20 nt, Homo sapiens
guauucacgugcagcagcaa

SEQ ID NO: 1198754 - RNA, 18 nt, Homo sapiens
guauuccgauacaaagug

SEQ ID NO: 1198755 - RNA, 16 nt, Homo sapiens
guauucuacagcagau

SEQ ID NO: 1198756 - RNA, 15 nt, Homo sapiens
guauucuuauuuaau

SEQ ID NO: 1198757 - RNA, 16 nt, Homo sapiens
guauucuucaaccagu

SEQ ID NO: 1198758 - RNA, 17 nt, Homo sapiens
guauucuucaaccagug

SEQ ID NO: 1198759 - RNA, 12 nt, Homo sapiens
guauugacugua

SEQ ID NO: 1198760 - RNA, 19 nt, Homo sapiens
guauugacuguaccacaga

SEQ ID NO: 1198761 - RNA, 15 nt, Homo sapiens
guauuggaaauggau

SEQ ID NO: 1198762 - RNA, 21 nt, Homo sapiens
guauugucgguuaccucugca

SEQ ID NO: 1198763 - RNA, 21 nt, Homo sapiens
guauuuaauuguaaacuguac

SEQ ID NO: 1198764 - RNA, 19 nt, Homo sapiens
guauuugccuucuccacuu

SEQ ID NO: 1198765 - RNA, 21 nt, Homo sapiens
guauuuguuccugccacugug

SEQ ID NO: 1198766 - RNA, 17 nt, Homo sapiens
guauuuuaauccuguac

SEQ ID NO: 1198767 - RNA, 21 nt, Homo sapiens
guauuuucaugaaaauaccau

SEQ ID NO: 1198768 - RNA, 18 nt, Homo sapiens
guauuuuuaacaccagaa

SEQ ID NO: 1198769 - RNA, 23 nt, Homo sapiens
guauuuuuuccacuacacaacug

SEQ ID NO: 1198770 - RNA, 19 nt, Homo sapiens
guauuuuuucuaaugugca

SEQ ID NO: 1198771 - RNA, 20 nt, Homo sapiens
guauuuuuucuaaugugcau

SEQ ID NO: 1198772 - RNA, 14 nt, Homo sapiens
gucaaaaaguucca

SEQ ID NO: 1198773 - RNA, 15 nt, Homo sapiens
gucaaaacacugugg

SEQ ID NO: 1198774 - RNA, 16 nt, Homo sapiens
gucaaaacacugugga

SEQ ID NO: 1198775 - RNA, 13 nt, Homo sapiens
gucaaacuguaga

SEQ ID NO: 1198776 - RNA, 17 nt, Homo sapiens
gucaaauaaagcaaagu

SEQ ID NO: 1198777 - RNA, 16 nt, Homo sapiens
gucaaccuuguuucua

SEQ ID NO: 1198778 - RNA, 14 nt, Homo sapiens
gucaacuaugauau

SEQ ID NO: 1198779 - RNA, 17 nt, Homo sapiens
gucaagcugaaaacaaa

SEQ ID NO: 1198780 - RNA, 19 nt, Homo sapiens
gucaaggguggacacugca

SEQ ID NO: 1198781 - RNA, 18 nt, Homo sapiens
gucaauaaacaacagcug

SEQ ID NO: 1198782 - RNA, 13 nt, Homo sapiens
gucaaucacugca

SEQ ID NO: 1198783 - RNA, 16 nt, Homo sapiens
gucaaugccugucuua

SEQ ID NO: 1198784 - RNA, 12 nt, Homo sapiens
gucaaugugcag

SEQ ID NO: 1198785 - RNA, 18 nt, Homo sapiens
gucacacgauaaagggau

SEQ ID NO: 1198786 - RNA, 12 nt, Homo sapiens
gucacagacucg

SEQ ID NO: 1198787 - RNA, 16 nt, Homo sapiens
gucacagaucugggag

SEQ ID NO: 1198788 - RNA, 14 nt, Homo sapiens
gucacagccaugaa

SEQ ID NO: 1198789 - RNA, 20 nt, Homo sapiens
gucacaucagauaagacaua

SEQ ID NO: 1198790 - RNA, 11 nt, Homo sapiens
gucacaugacc

SEQ ID NO: 1198791 - RNA, 23 nt, Homo sapiens
gucacaugcuagcagcugugaug

SEQ ID NO: 1198792 - RNA, 23 nt, Homo sapiens
gucacauggccuaugcacauaug

SEQ ID NO: 1198793 - RNA, 18 nt, Homo sapiens
gucaccagcuaucuguca

SEQ ID NO: 1198794 - RNA, 21 nt, Homo sapiens
gucaccgggaugaaccuaucc

SEQ ID NO: 1198795 - RNA, 18 nt, Homo sapiens
gugucauuggaagccauc

SEQ ID NO: 1198796 - RNA, 15 nt, Homo sapiens
gugucccaugaccca

SEQ ID NO: 1198797 - RNA, 19 nt, Homo sapiens
guguccccucacucuguca

SEQ ID NO: 1198798 - RNA, 14 nt, Homo sapiens
guguccucagggag

SEQ ID NO: 1198799 - RNA, 16 nt, Homo sapiens
gugucgcgcacacagc

SEQ ID NO: 1198800 - RNA, 18 nt, Homo sapiens
gugucugcucucauccau

SEQ ID NO: 1198801 - RNA, 20 nt, Homo sapiens
gugucuguacacguguccug

SEQ ID NO: 1198802 - RNA, 21 nt, Homo sapiens
gugugaacucaccaaacacaa

SEQ ID NO: 1198803 - RNA, 16 nt, Homo sapiens
gugugaccauguucau

SEQ ID NO: 1198804 - RNA, 17 nt, Homo sapiens
gugugaccccacugcca

SEQ ID NO: 1198805 - RNA, 9 nt, Homo sapiens
gugugagug

SEQ ID NO: 1198806 - RNA, 21 nt, Homo sapiens
gugugcacaugcgcacucuca

SEQ ID NO: 1198807 - RNA, 16 nt, Homo sapiens
gugugcauguguguaa

SEQ ID NO: 1198808 - RNA, 17 nt, Homo sapiens
gugugcauguguguaua

SEQ ID NO: 1198809 - RNA, 14 nt, Homo sapiens
gugugccauuuuaa

SEQ ID NO: 1198810 - RNA, 12 nt, Homo sapiens
gugugcgugcaa

SEQ ID NO: 1198811 - RNA, 23 nt, Homo sapiens
guguggauuuucuacuguaagaa

SEQ ID NO: 1198812 - RNA, 19 nt, Homo sapiens
gugugggcugugaguguaa

SEQ ID NO: 1198813 - RNA, 14 nt, Homo sapiens
gugugggggguccu

SEQ ID NO: 1198814 - RNA, 18 nt, Homo sapiens
guguggguggaagggcug

SEQ ID NO: 1198815 - RNA, 12 nt, Homo sapiens
gugugucacaag

SEQ ID NO: 1198816 - RNA, 19 nt, Homo sapiens
guguguccaaaacugccuc

SEQ ID NO: 1198817 - RNA, 22 nt, Homo sapiens
guguguccaccugggcauaucc

SEQ ID NO: 1198818 - RNA, 18 nt, Homo sapiens
gugugucgcgcacacagc

SEQ ID NO: 1198819 - RNA, 22 nt, Homo sapiens
guguguuaaaugggacuggagu

SEQ ID NO: 1198820 - RNA, 21 nt, Homo sapiens
guguuacgcacacguacuuaa

SEQ ID NO: 1198821 - RNA, 17 nt, Homo sapiens
guguuacuguugcacug

SEQ ID NO: 1198822 - RNA, 19 nt, Homo sapiens
guguuaggacagcauauaa

SEQ ID NO: 1198823 - RNA, 21 nt, Homo sapiens
guguuaucagucauaacuaaa

SEQ ID NO: 1198824 - RNA, 20 nt, Homo sapiens
guguuauuauuuugcacugu

SEQ ID NO: 1198825 - RNA, 22 nt, Homo sapiens
guguuuaaaacaugcacgguga

SEQ ID NO: 1198826 - RNA, 13 nt, Homo sapiens
guguuuaauuuga

SEQ ID NO: 1198827 - RNA, 17 nt, Homo sapiens
guguuuccacagccugc

SEQ ID NO: 1198828 - RNA, 17 nt, Homo sapiens
guguuucugucucucca

SEQ ID NO: 1198829 - RNA, 23 nt, Homo sapiens
guguuucuuccccuuacucucac

SEQ ID NO: 1198830 - RNA, 17 nt, Homo sapiens
guguuugggaugaccag

SEQ ID NO: 1198831 - RNA, 14 nt, Homo sapiens
guguuugugucuga

SEQ ID NO: 1198832 - RNA, 13 nt, Homo sapiens
guguuuucauucc

SEQ ID NO: 1198833 - RNA, 16 nt, Homo sapiens
guguuuuuaacauguc

SEQ ID NO: 1198834 - RNA, 21 nt, Homo sapiens
guguuuuucuuuuuccacaag

SEQ ID NO: 1198835 - RNA, 17 nt, Homo sapiens
guuaaacauugaaguaa

SEQ ID NO: 1198836 - RNA, 17 nt, Homo sapiens
guuaaagguucacaggg

SEQ ID NO: 1198837 - RNA, 18 nt, Homo sapiens
guuaaagguucacagggg

SEQ ID NO: 1198838 - RNA, 14 nt, Homo sapiens
guuaaaugaacuug

SEQ ID NO: 1198839 - RNA, 23 nt, Homo sapiens
guuaaccuuuuuguaaauacugc

SEQ ID NO: 1198840 - RNA, 18 nt, Homo sapiens
guuaacguauauugcugu

SEQ ID NO: 1198841 - RNA, 19 nt, Homo sapiens
guuaacuuaauaguauuua

SEQ ID NO: 1198842 - RNA, 13 nt, Homo sapiens
guuaacuugcaua

SEQ ID NO: 1198843 - RNA, 20 nt, Homo sapiens
guuaauaaaccuuugcaaac

SEQ ID NO: 1198844 - RNA, 19 nt, Homo sapiens
guuaauaaaucaagccaua

SEQ ID NO: 1198845 - RNA, 24 nt, Homo sapiens
guuaauauuuauuaagugacuaua

SEQ ID NO: 1198846 - RNA, 16 nt, Homo sapiens
guuacauaacaagaaa

SEQ ID NO: 1198847 - RNA, 19 nt, Homo sapiens
guuacaugaaggcagcaga

SEQ ID NO: 1198848 - RNA, 15 nt, Homo sapiens
guuacauguagaaaa

SEQ ID NO: 1198849 - RNA, 22 nt, Homo sapiens
guuacauuaaaauaaaccaaau

SEQ ID NO: 1198850 - RNA, 11 nt, Homo sapiens
guuaccauauu

SEQ ID NO: 1198851 - RNA, 23 nt, Homo sapiens
guuaccauauuuauccauuugua

SEQ ID NO: 1198852 - RNA, 17 nt, Homo sapiens
guuaccaugucacugug

SEQ ID NO: 1198853 - RNA, 13 nt, Homo sapiens
guuacucaugacu

SEQ ID NO: 1198854 - RNA, 14 nt, Homo sapiens
guuacucauuuuau

SEQ ID NO: 1198855 - RNA, 18 nt, Homo sapiens
guuacugaucuuacucac

SEQ ID NO: 1198856 - RNA, 12 nt, Homo sapiens
guuacuuuacag

SEQ ID NO: 1198857 - RNA, 19 nt, Homo sapiens
guuacuuuuuuacacugau

SEQ ID NO: 1198858 - RNA, 18 nt, Homo sapiens
guuagacuuaaacagcag

SEQ ID NO: 1198859 - RNA, 19 nt, Homo sapiens
guuagagcuggcaccagaa

SEQ ID NO: 1198860 - RNA, 20 nt, Homo sapiens
guuagauauugcuacuauaa

SEQ ID NO: 1198861 - RNA, 15 nt, Homo sapiens
guuagcagagcugga

SEQ ID NO: 1198862 - RNA, 23 nt, Homo sapiens
guuagcugaaccgacacucaaaa

SEQ ID NO: 1198863 - RNA, 18 nt, Homo sapiens
guuaggaaauaaaaccuu

SEQ ID NO: 1198864 - RNA, 19 nt, Homo sapiens
guuauaaaucaaugucacu

SEQ ID NO: 1198865 - RNA, 22 nt, Homo sapiens
guuauaauaauguuaacaugga

SEQ ID NO: 1198866 - RNA, 14 nt, Homo sapiens
guuauagcuucagg

SEQ ID NO: 1198867 - RNA, 18 nt, Homo sapiens
guuauaucauauguauau

SEQ ID NO: 1198868 - RNA, 21 nt, Homo sapiens
guuaucaguaagaaaaagaag

SEQ ID NO: 1198869 - RNA, 17 nt, Homo sapiens
guuaucuuccacuggaa

SEQ ID NO: 1198870 - RNA, 23 nt, Homo sapiens
guuaugauauuguuuaaaauuca

SEQ ID NO: 1198871 - RNA, 22 nt, Homo sapiens
guuaugauuuguaacauucaca

SEQ ID NO: 1198872 - RNA, 14 nt, Homo sapiens
guuauguacuguac

SEQ ID NO: 1198873 - RNA, 16 nt, Homo sapiens
guuaugugcaguacuu

SEQ ID NO: 1198874 - RNA, 16 nt, Homo sapiens
guuauguuugcacuuu

SEQ ID NO: 1198875 - RNA, 17 nt, Homo sapiens
guuauucgaaccacuga

SEQ ID NO: 1198876 - RNA, 16 nt, Homo sapiens
guuauugaaucuuaau

SEQ ID NO: 1198877 - RNA, 18 nt, Homo sapiens
guuauuuaaugagucagu

SEQ ID NO: 1198878 - RNA, 15 nt, Homo sapiens
guuauuuaugcacug

SEQ ID NO: 1198879 - RNA, 14 nt, Homo sapiens
guuauuuaugcuau

SEQ ID NO: 1198880 - RNA, 15 nt, Homo sapiens
guuauuugcacacug

SEQ ID NO: 1198881 - RNA, 20 nt, Homo sapiens
guuauuugcacacugcacug

SEQ ID NO: 1198882 - RNA, 17 nt, Homo sapiens
guuauuuuaucugcuau

SEQ ID NO: 1198883 - RNA, 18 nt, Homo sapiens
guucaaaaccuugcacag

SEQ ID NO: 1198884 - RNA, 16 nt, Homo sapiens
guucaaaguguauauu

SEQ ID NO: 1198885 - RNA, 12 nt, Homo sapiens
guucaacauuuu

SEQ ID NO: 1198886 - RNA, 14 nt, Homo sapiens
guucaacuacaugu

SEQ ID NO: 1198887 - RNA, 22 nt, Homo sapiens
guucaagugauucuccugccuc

SEQ ID NO: 1198888 - RNA, 18 nt, Homo sapiens
guucaaugcuagaacaac

SEQ ID NO: 1198889 - RNA, 21 nt, Homo sapiens
guucacaaaauggugcccuau

SEQ ID NO: 1198890 - RNA, 22 nt, Homo sapiens
guucacacucagaacccaggac

SEQ ID NO: 1198891 - RNA, 18 nt, Homo sapiens
guucacacuuugcccuau

SEQ ID NO: 1198892 - RNA, 11 nt, Homo sapiens
guucacuccca

SEQ ID NO: 1198893 - RNA, 11 nt, Homo sapiens
guucagacucu

SEQ ID NO: 1198894 - RNA, 15 nt, Homo sapiens
guucagccuccuuga

SEQ ID NO: 1198895 - RNA, 16 nt, Homo sapiens
guucagguaacaggca

SEQ ID NO: 1198896 - RNA, 19 nt, Homo sapiens
guucauauuuauacuuugc

SEQ ID NO: 1198897 - RNA, 23 nt, Homo sapiens
guucaucauccuaagcuauucag

SEQ ID NO: 1198898 - RNA, 20 nt, Homo sapiens
guucauguuuguaaauuaau

SEQ ID NO: 1198899 - RNA, 22 nt, Homo sapiens
guucauuggcaagaugaaauaa

SEQ ID NO: 1198900 - RNA, 18 nt, Homo sapiens
guucauuucacacaguga

SEQ ID NO: 1198901 - RNA, 15 nt, Homo sapiens
guuccaaguuuccaa

SEQ ID NO: 1198902 - RNA, 23 nt, Homo sapiens
guuccacuucaacaaguaccuga

SEQ ID NO: 1198903 - RNA, 15 nt, Homo sapiens
guuccaggcccucca

SEQ ID NO: 1198904 - RNA, 14 nt, Homo sapiens
guuccccacugaca

SEQ ID NO: 1198905 - RNA, 21 nt, Homo sapiens
guuccccuaguucuacaugaa

SEQ ID NO: 1198906 - RNA, 16 nt, Homo sapiens
guucccuguucuuccu

SEQ ID NO: 1198907 - RNA, 16 nt, Homo sapiens
guucccuuggccucag

SEQ ID NO: 1198908 - RNA, 22 nt, Homo sapiens
guucccuuggccucagaauuca

SEQ ID NO: 1198909 - RNA, 19 nt, Homo sapiens
guuccgcacuuuccacuuc

SEQ ID NO: 1198910 - RNA, 18 nt, Homo sapiens
guuccucuuggugucaua

SEQ ID NO: 1198911 - RNA, 15 nt, Homo sapiens
guuccuggugacucc

SEQ ID NO: 1198912 - RNA, 16 nt, Homo sapiens
guuccuuaucugucac

SEQ ID NO: 1198913 - RNA, 11 nt, Homo sapiens
guuccuuucag

SEQ ID NO: 1198914 - RNA, 20 nt, Homo sapiens
guucgagaccagccuggcca

SEQ ID NO: 1198915 - RNA, 13 nt, Homo sapiens
guucgauggcuca

SEQ ID NO: 1198916 - RNA, 22 nt, Homo sapiens
guucuaaauaaaaagcauuauu

SEQ ID NO: 1198917 - RNA, 18 nt, Homo sapiens
guucuaccaagaacugaa

SEQ ID NO: 1198918 - RNA, 23 nt, Homo sapiens
guucuacuauggcugaguucugg

SEQ ID NO: 1198919 - RNA, 15 nt, Homo sapiens
guucuauccaaacau

SEQ ID NO: 1198920 - RNA, 19 nt, Homo sapiens
uaauaaacacuggcucugg

SEQ ID NO: 1198921 - RNA, 15 nt, Homo sapiens
uaauaaaccuccuuc

SEQ ID NO: 1198922 - RNA, 22 nt, Homo sapiens
uaauaaagaugaguugguucuc

SEQ ID NO: 1198923 - RNA, 19 nt, Homo sapiens
uaauaaaucuguugccaag

SEQ ID NO: 1198924 - RNA, 21 nt, Homo sapiens
uaauaaauugcuuacugauau

SEQ ID NO: 1198925 - RNA, 20 nt, Homo sapiens
uaauaacaacagaucugcag

SEQ ID NO: 1198926 - RNA, 14 nt, Homo sapiens
uaauaacagcagug

SEQ ID NO: 1198927 - RNA, 13 nt, Homo sapiens
uaauaacagcucc

SEQ ID NO: 1198928 - RNA, 14 nt, Homo sapiens
uaauaacagcuccu

SEQ ID NO: 1198929 - RNA, 14 nt, Homo sapiens
uaauaacagugcau

SEQ ID NO: 1198930 - RNA, 17 nt, Homo sapiens
uaauaauaauuugcacu

SEQ ID NO: 1198931 - RNA, 14 nt, Homo sapiens
uaauaauaccucaa

SEQ ID NO: 1198932 - RNA, 20 nt, Homo sapiens
uaauaauguauguacagcug

SEQ ID NO: 1198933 - RNA, 14 nt, Homo sapiens
uaauaauuugcacu

SEQ ID NO: 1198934 - RNA, 14 nt, Homo sapiens
uaauacaucaaaga

SEQ ID NO: 1198935 - RNA, 17 nt, Homo sapiens
uaauaccagaacucuaa

SEQ ID NO: 1198936 - RNA, 23 nt, Homo sapiens
uaauacugguauuuuuacuuaau

SEQ ID NO: 1198937 - RNA, 15 nt, Homo sapiens
uaauagacugaguca

SEQ ID NO: 1198938 - RNA, 18 nt, Homo sapiens
uaauagagauaaguccau

SEQ ID NO: 1198939 - RNA, 22 nt, Homo sapiens
uaauagcaaugguggugcacca

SEQ ID NO: 1198940 - RNA, 12 nt, Homo sapiens
uaauagucauca

SEQ ID NO: 1198941 - RNA, 17 nt, Homo sapiens
uaauauaaaguguaaua

SEQ ID NO: 1198942 - RNA, 17 nt, Homo sapiens
uaauauaguuauugcac

SEQ ID NO: 1198943 - RNA, 15 nt, Homo sapiens
uaauauauuguacac

SEQ ID NO: 1198944 - RNA, 18 nt, Homo sapiens
uaauaucccuacauguau

SEQ ID NO: 1198945 - RNA, 17 nt, Homo sapiens
uaauaugauuauacaaa

SEQ ID NO: 1198946 - RNA, 13 nt, Homo sapiens
uaauauggcaaaa

SEQ ID NO: 1198947 - RNA, 15 nt, Homo sapiens
uaauauuaauuucca

SEQ ID NO: 1198948 - RNA, 19 nt, Homo sapiens
uaauauuuuccuaguagau

SEQ ID NO: 1198949 - RNA, 14 nt, Homo sapiens
uaaucaaaugauuu

SEQ ID NO: 1198950 - RNA, 22 nt, Homo sapiens
uaaucagggaggucauuuuggu

SEQ ID NO: 1198951 - RNA, 21 nt, Homo sapiens
uaaucagugucucacacuggc

SEQ ID NO: 1198952 - RNA, 17 nt, Homo sapiens
uaauccaucacuagcca

SEQ ID NO: 1198953 - RNA, 15 nt, Homo sapiens
uaaucccagcacuuu

SEQ ID NO: 1198954 - RNA, 14 nt, Homo sapiens
uaaucuaguuuaca

SEQ ID NO: 1198955 - RNA, 17 nt, Homo sapiens
uaaucucauaccucuga

SEQ ID NO: 1198956 - RNA, 21 nt, Homo sapiens
uaaucugucaaaacacugugg

SEQ ID NO: 1198957 - RNA, 15 nt, Homo sapiens
uaaucuuuaaacugg

SEQ ID NO: 1198958 - RNA, 13 nt, Homo sapiens
uaaugaacaugug

SEQ ID NO: 1198959 - RNA, 14 nt, Homo sapiens
uaaugaagugcaau

SEQ ID NO: 1198960 - RNA, 22 nt, Homo sapiens
uaaugaauuauaacaguuauau

SEQ ID NO: 1198961 - RNA, 16 nt, Homo sapiens
uaaugagugaauugaa

SEQ ID NO: 1198962 - RNA, 23 nt, Homo sapiens
uaaugaguuaagcugaagaguuu

SEQ ID NO: 1198963 - RNA, 15 nt, Homo sapiens
uaaugauagcuacug

SEQ ID NO: 1198964 - RNA, 16 nt, Homo sapiens
uaaugcuuuguuaaau

SEQ ID NO: 1198965 - RNA, 18 nt, Homo sapiens
uaauggaaaaaaagacug

SEQ ID NO: 1198966 - RNA, 14 nt, Homo sapiens
uaauggaaaccaag

SEQ ID NO: 1198967 - RNA, 20 nt, Homo sapiens
uaauggaagagaaaucucau

SEQ ID NO: 1198968 - RNA, 18 nt, Homo sapiens
uaauggaugguugaauua

SEQ ID NO: 1198969 - RNA, 20 nt, Homo sapiens
uaauggcagcuagugccuuu

SEQ ID NO: 1198970 - RNA, 18 nt, Homo sapiens
uaauggcuaguacuguau

SEQ ID NO: 1198971 - RNA, 18 nt, Homo sapiens
uaauggggacacagauca

SEQ ID NO: 1198972 - RNA, 19 nt, Homo sapiens
uaaugguguagaacacuaa

SEQ ID NO: 1198973 - RNA, 14 nt, Homo sapiens
uaauguaagcucua

SEQ ID NO: 1198974 - RNA, 21 nt, Homo sapiens
uaauguaggacuguauaggua

SEQ ID NO: 1198975 - RNA, 17 nt, Homo sapiens
uaaugucauggccuuga

SEQ ID NO: 1198976 - RNA, 22 nt, Homo sapiens
uaauguguauuuacuguacuaa

SEQ ID NO: 1198977 - RNA, 18 nt, Homo sapiens
uaauguuuaauauugaga

SEQ ID NO: 1198978 - RNA, 19 nt, Homo sapiens
uaauuaaguaaaccaaaaa

SEQ ID NO: 1198979 - RNA, 14 nt, Homo sapiens
uaauuaauauucau

SEQ ID NO: 1198980 - RNA, 13 nt, Homo sapiens
uaauuacaccaua

SEQ ID NO: 1198981 - RNA, 23 nt, Homo sapiens
uaauuacaggagggaacauuucc

SEQ ID NO: 1198982 - RNA, 13 nt, Homo sapiens
uaauuagcugugc

SEQ ID NO: 1198983 - RNA, 17 nt, Homo sapiens
uaauuagggguugcuaa

SEQ ID NO: 1198984 - RNA, 20 nt, Homo sapiens
uaauuaguuaugacagccau

SEQ ID NO: 1198985 - RNA, 18 nt, Homo sapiens
uaauuaguugauugcugu

SEQ ID NO: 1198986 - RNA, 20 nt, Homo sapiens
uaauuaucgggaacaguguu

SEQ ID NO: 1198987 - RNA, 20 nt, Homo sapiens
uaauuaugaguuugcuuaug

SEQ ID NO: 1198988 - RNA, 12 nt, Homo sapiens
uaauuauugcuu

SEQ ID NO: 1198989 - RNA, 17 nt, Homo sapiens
uaauuauuucacuuuag

SEQ ID NO: 1198990 - RNA, 14 nt, Homo sapiens
uaauuauuuugaca

SEQ ID NO: 1198991 - RNA, 21 nt, Homo sapiens
uaauucacagaauagcacaaa

SEQ ID NO: 1198992 - RNA, 20 nt, Homo sapiens
uaauucacucaagcacugau

SEQ ID NO: 1198993 - RNA, 19 nt, Homo sapiens
uaauucauaaucacucuaa

SEQ ID NO: 1198994 - RNA, 19 nt, Homo sapiens
uaauucauccuagcaaauu

SEQ ID NO: 1198995 - RNA, 14 nt, Homo sapiens
uaauuccaauauga

SEQ ID NO: 1198996 - RNA, 19 nt, Homo sapiens
uaauuccaauuauaugaga

SEQ ID NO: 1198997 - RNA, 15 nt, Homo sapiens
uaauucuaaguuauu

SEQ ID NO: 1198998 - RNA, 14 nt, Homo sapiens
uaauucuguacaua

SEQ ID NO: 1198999 - RNA, 17 nt, Homo sapiens
uaauucuuacacugccu

SEQ ID NO: 1199000 - RNA, 17 nt, Homo sapiens
uaauugaccuacuuugg

SEQ ID NO: 1199001 - RNA, 19 nt, Homo sapiens
uaauugaucaaauucauuu

SEQ ID NO: 1199002 - RNA, 16 nt, Homo sapiens
uaauugcuuacauuuu

SEQ ID NO: 1199003 - RNA, 17 nt, Homo sapiens
uaauugcuuugccaaaa

SEQ ID NO: 1199004 - RNA, 20 nt, Homo sapiens
uaauugcuuuuucacaguca

SEQ ID NO: 1199005 - RNA, 12 nt, Homo sapiens
uaauugguucuu

SEQ ID NO: 1199006 - RNA, 15 nt, Homo sapiens
uaauuguaucagagg

SEQ ID NO: 1199007 - RNA, 14 nt, Homo sapiens
uaauuuaacaaacu

SEQ ID NO: 1199008 - RNA, 14 nt, Homo sapiens
uaauuuaguuccac

SEQ ID NO: 1199009 - RNA, 19 nt, Homo sapiens
uaauuuaguuccacaaaug

SEQ ID NO: 1199010 - RNA, 13 nt, Homo sapiens
uaauuuccagggu

SEQ ID NO: 1199011 - RNA, 23 nt, Homo sapiens
uaauuugaaugugguuacuuccu

SEQ ID NO: 1199012 - RNA, 19 nt, Homo sapiens
uaauuugcauugugucaga

SEQ ID NO: 1199013 - RNA, 18 nt, Homo sapiens
uaauuugcugguguuuua

SEQ ID NO: 1199014 - RNA, 14 nt, Homo sapiens
uaauuuuacauguu

SEQ ID NO: 1199015 - RNA, 19 nt, Homo sapiens
uaauuuucuagauuuucua

SEQ ID NO: 1199016 - RNA, 19 nt, Homo sapiens
uaauuuuuugcacacuguu

SEQ ID NO: 1199017 - RNA, 19 nt, Homo sapiens
uaauuuuuuguacuuuuag

SEQ ID NO: 1199018 - RNA, 13 nt, Homo sapiens
uacaaaaagucaa

SEQ ID NO: 1199019 - RNA, 21 nt, Homo sapiens
uacaaaaauaccuacugcuga

SEQ ID NO: 1199020 - RNA, 22 nt, Homo sapiens
uacaaaaauaccuacugcugag

SEQ ID NO: 1199021 - RNA, 20 nt, Homo sapiens
uacaaaaauuagcugggcau

SEQ ID NO: 1199022 - RNA, 23 nt, Homo sapiens
uacaaaccauuuuguuauugacu

SEQ ID NO: 1199023 - RNA, 16 nt, Homo sapiens
uacaaaccuaccaaaa

SEQ ID NO: 1199024 - RNA, 22 nt, Homo sapiens
uacaaagccacccuaccaugaa

SEQ ID NO: 1199025 - RNA, 17 nt, Homo sapiens
uacaaaugcaauuucau

SEQ ID NO: 1199026 - RNA, 22 nt, Homo sapiens
uacaaaugcaauuucauuuaaa

SEQ ID NO: 1199027 - RNA, 22 nt, Homo sapiens
uacaaaugccaaaauucauuca

SEQ ID NO: 1199028 - RNA, 15 nt, Homo sapiens
uacaacagugagaaa

SEQ ID NO: 1199029 - RNA, 21 nt, Homo sapiens
uacaacauaaucuaguuuaca

SEQ ID NO: 1199030 - RNA, 20 nt, Homo sapiens
uacaacuggacucauuauca

SEQ ID NO: 1199031 - RNA, 15 nt, Homo sapiens
uacaagaaguuuauu

SEQ ID NO: 1199032 - RNA, 20 nt, Homo sapiens
uacaagauugaaaaucuugu

SEQ ID NO: 1199033 - RNA, 23 nt, Homo sapiens
uacaaguuguuauuguugaacau

SEQ ID NO: 1199034 - RNA, 21 nt, Homo sapiens
uacaauaaaacuuugcugcca

SEQ ID NO: 1199035 - RNA, 16 nt, Homo sapiens
uacaauaaacugguau

SEQ ID NO: 1199036 - RNA, 15 nt, Homo sapiens
uacaauaaagcaaug

SEQ ID NO: 1199037 - RNA, 20 nt, Homo sapiens
uacaaucagccacauucuag

SEQ ID NO: 1199038 - RNA, 23 nt, Homo sapiens
uacaauccuuugaguuauaguuu

SEQ ID NO: 1199039 - RNA, 14 nt, Homo sapiens
uacaauuacaucuc

SEQ ID NO: 1199040 - RNA, 22 nt, Homo sapiens
uacaauuauggaaauauaguuc

SEQ ID NO: 1199041 - RNA, 11 nt, Homo sapiens
uacaauuguga

SEQ ID NO: 1199042 - RNA, 22 nt, Homo sapiens
uacacaaaauacagcacuuuga

SEQ ID NO: 1199043 - RNA, 23 nt, Homo sapiens
uacacaauuaauucaucccuuaa

SEQ ID NO: 1199044 - RNA, 22 nt, Homo sapiens
uacacacccgccugacaccgug

SEQ ID NO: 1199045 - RNA, 19 nt, Homo sapiens
uaguugcguggacucugca

SEQ ID NO: 1199046 - RNA, 16 nt, Homo sapiens
uaguuguagacaaagu

SEQ ID NO: 1199047 - RNA, 15 nt, Homo sapiens
uaguugucuuuccug

SEQ ID NO: 1199048 - RNA, 16 nt, Homo sapiens
uaguuucagacuugga

SEQ ID NO: 1199049 - RNA, 21 nt, Homo sapiens
uaguuucuucauuucaggaag

SEQ ID NO: 1199050 - RNA, 14 nt, Homo sapiens
uaguuuuacuuuua

SEQ ID NO: 1199051 - RNA, 15 nt, Homo sapiens
uaguuuuacuuuuaa

SEQ ID NO: 1199052 - RNA, 15 nt, Homo sapiens
uauaaaaagcuucca

SEQ ID NO: 1199053 - RNA, 21 nt, Homo sapiens
uauaaaagaauaaaauugcac

SEQ ID NO: 1199054 - RNA, 20 nt, Homo sapiens
uauaaaauagacuuacugca

SEQ ID NO: 1199055 - RNA, 17 nt, Homo sapiens
uauaaacaaaagaaucu

SEQ ID NO: 1199056 - RNA, 21 nt, Homo sapiens
uauaaacaaaagaaucuucca

SEQ ID NO: 1199057 - RNA, 23 nt, Homo sapiens
uauaaacuauaaccucuccuuca

SEQ ID NO: 1199058 - RNA, 21 nt, Homo sapiens
uauaaagaagaacuugcaugg

SEQ ID NO: 1199059 - RNA, 22 nt, Homo sapiens
uauaaagaagaacuugcaugga

SEQ ID NO: 1199060 - RNA, 15 nt, Homo sapiens
uauaaagauuguacu

SEQ ID NO: 1199061 - RNA, 14 nt, Homo sapiens
uauaaaguauucaa

SEQ ID NO: 1199062 - RNA, 18 nt, Homo sapiens
uauaaauacguauuacaa

SEQ ID NO: 1199063 - RNA, 18 nt, Homo sapiens
uauaaaugagcaaauauc

SEQ ID NO: 1199064 - RNA, 20 nt, Homo sapiens
uauaaauguauauacacaua

SEQ ID NO: 1199065 - RNA, 13 nt, Homo sapiens
uauaaauguuugu

SEQ ID NO: 1199066 - RNA, 20 nt, Homo sapiens
uauaaauuuuuugaaacaca

SEQ ID NO: 1199067 - RNA, 21 nt, Homo sapiens
uauaacagaauuaaaguagau

SEQ ID NO: 1199068 - RNA, 13 nt, Homo sapiens
uauaacaguguuu

SEQ ID NO: 1199069 - RNA, 15 nt, Homo sapiens
uauaacaguuauauu

SEQ ID NO: 1199070 - RNA, 22 nt, Homo sapiens
uauaaccacaaagcacaguuug

SEQ ID NO: 1199071 - RNA, 18 nt, Homo sapiens
uauaaccccagccugacc

SEQ ID NO: 1199072 - RNA, 12 nt, Homo sapiens
uauaacuguaaa

SEQ ID NO: 1199073 - RNA, 16 nt, Homo sapiens
uauaagaaagaucaaa

SEQ ID NO: 1199074 - RNA, 14 nt, Homo sapiens
uauaagaauuacua

SEQ ID NO: 1199075 - RNA, 17 nt, Homo sapiens
uauaagaauuacuaaau

SEQ ID NO: 1199076 - RNA, 18 nt, Homo sapiens
uauaagcauguauauucu

SEQ ID NO: 1199077 - RNA, 20 nt, Homo sapiens
uauaaguaauacuucaguaa

SEQ ID NO: 1199078 - RNA, 23 nt, Homo sapiens
uauaagugaagugauacuaucca

SEQ ID NO: 1199079 - RNA, 19 nt, Homo sapiens
uauaaguguguacaagcau

SEQ ID NO: 1199080 - RNA, 14 nt, Homo sapiens
uauaauauacuaaa

SEQ ID NO: 1199081 - RNA, 19 nt, Homo sapiens
uauaaucccacccaccuca

SEQ ID NO: 1199082 - RNA, 17 nt, Homo sapiens
uauaaucccagcacuuu

SEQ ID NO: 1199083 - RNA, 12 nt, Homo sapiens
uauaaucuacuc

SEQ ID NO: 1199084 - RNA, 17 nt, Homo sapiens
uauaauguaagcucuac

SEQ ID NO: 1199085 - RNA, 15 nt, Homo sapiens
uauaauguugccagc

SEQ ID NO: 1199086 - RNA, 16 nt, Homo sapiens
uauaauuaauugucau

SEQ ID NO: 1199087 - RNA, 16 nt, Homo sapiens
uauaauuagauuguga

SEQ ID NO: 1199088 - RNA, 20 nt, Homo sapiens
uauaauucacucaagcacug

SEQ ID NO: 1199089 - RNA, 23 nt, Homo sapiens
uauaauucuguacauagccuaua

SEQ ID NO: 1199090 - RNA, 17 nt, Homo sapiens
uauaauuguaccaaccu

SEQ ID NO: 1199091 - RNA, 22 nt, Homo sapiens
uauaauuucaaaccacacauua

SEQ ID NO: 1199092 - RNA, 15 nt, Homo sapiens
uauaauuucuguuca

SEQ ID NO: 1199093 - RNA, 16 nt, Homo sapiens
uauacaaaacuuuauc

SEQ ID NO: 1199094 - RNA, 23 nt, Homo sapiens
uauacacuuacacuuuaugcaca

SEQ ID NO: 1199095 - RNA, 23 nt, Homo sapiens
uauacagauagaguuccauauau

SEQ ID NO: 1199096 - RNA, 14 nt, Homo sapiens
uauacaguacacag

SEQ ID NO: 1199097 - RNA, 11 nt, Homo sapiens
uauacagugcc

SEQ ID NO: 1199098 - RNA, 21 nt, Homo sapiens
uauacauucuuuaucuugaca

SEQ ID NO: 1199099 - RNA, 18 nt, Homo sapiens
uauaccaauauuuacuca

SEQ ID NO: 1199100 - RNA, 14 nt, Homo sapiens
uauaccauuuccuc

SEQ ID NO: 1199101 - RNA, 22 nt, Homo sapiens
uauacccccccaugcagucuaa

SEQ ID NO: 1199102 - RNA, 11 nt, Homo sapiens
uauaccuaucu

SEQ ID NO: 1199103 - RNA, 16 nt, Homo sapiens
uauacgcccuugagcu

SEQ ID NO: 1199104 - RNA, 14 nt, Homo sapiens
uauacguguagcua

SEQ ID NO: 1199105 - RNA, 17 nt, Homo sapiens
uauacguguagcuauau

SEQ ID NO: 1199106 - RNA, 19 nt, Homo sapiens
uauacuaaaccaacucuaa

SEQ ID NO: 1199107 - RNA, 20 nt, Homo sapiens
uauacuagggagccauuuga

SEQ ID NO: 1199108 - RNA, 12 nt, Homo sapiens
uauacuaugaaa

SEQ ID NO: 1199109 - RNA, 15 nt, Homo sapiens
uauacucaaguuuca

SEQ ID NO: 1199110 - RNA, 22 nt, Homo sapiens
uauacugaaggaaaaacacaag

SEQ ID NO: 1199111 - RNA, 20 nt, Homo sapiens
uauacugccaaagaauguga

SEQ ID NO: 1199112 - RNA, 14 nt, Homo sapiens
uauagaaguagcaa

SEQ ID NO: 1199113 - RNA, 12 nt, Homo sapiens
uauagacagucc

SEQ ID NO: 1199114 - RNA, 19 nt, Homo sapiens
uauagagaauaaggcacaa

SEQ ID NO: 1199115 - RNA, 21 nt, Homo sapiens
uauagagggcuuaugauucag

SEQ ID NO: 1199116 - RNA, 12 nt, Homo sapiens
uauagauucuaa

SEQ ID NO: 1199117 - RNA, 13 nt, Homo sapiens
uauagcacuuuga

SEQ ID NO: 1199118 - RNA, 23 nt, Homo sapiens
uauagcacuuugaaauaccucau

SEQ ID NO: 1199119 - RNA, 17 nt, Homo sapiens
uauagcagauuguguaa

SEQ ID NO: 1199120 - RNA, 18 nt, Homo sapiens
uauagccacaaaugccuu

SEQ ID NO: 1199121 - RNA, 20 nt, Homo sapiens
uauagccacaaaugccuuga

SEQ ID NO: 1199122 - RNA, 13 nt, Homo sapiens
uauaggacucuca

SEQ ID NO: 1199123 - RNA, 20 nt, Homo sapiens
uauaguccagacacuuaacu

SEQ ID NO: 1199124 - RNA, 13 nt, Homo sapiens
uauagucuuccag

SEQ ID NO: 1199125 - RNA, 15 nt, Homo sapiens
uauauaaacauauca

SEQ ID NO: 1199126 - RNA, 17 nt, Homo sapiens
uauauaagguaugugcu

SEQ ID NO: 1199127 - RNA, 17 nt, Homo sapiens
uauauaauguugccagc

SEQ ID NO: 1199128 - RNA, 13 nt, Homo sapiens
uauauacauucuu

SEQ ID NO: 1199129 - RNA, 13 nt, Homo sapiens
uauauaccaagcu

SEQ ID NO: 1199130 - RNA, 17 nt, Homo sapiens
uauauacccacauguac

SEQ ID NO: 1199131 - RNA, 17 nt, Homo sapiens
uauauaggcaugagcca

SEQ ID NO: 1199132 - RNA, 22 nt, Homo sapiens
uauauaugcuuggcuaacuaua

SEQ ID NO: 1199133 - RNA, 16 nt, Homo sapiens
uauauaugugugugua

SEQ ID NO: 1199134 - RNA, 13 nt, Homo sapiens
uauauauuacuug

SEQ ID NO: 1199135 - RNA, 20 nt, Homo sapiens
uauauauuucuuuguuauca

SEQ ID NO: 1199136 - RNA, 20 nt, Homo sapiens
uauaucauucuacagaauaa

SEQ ID NO: 1199137 - RNA, 15 nt, Homo sapiens
uauauccauguacug

SEQ ID NO: 1199138 - RNA, 17 nt, Homo sapiens
uauauccccacuacuca

SEQ ID NO: 1199139 - RNA, 14 nt, Homo sapiens
uauaucgaucucuu

SEQ ID NO: 1199140 - RNA, 16 nt, Homo sapiens
uauaucugaagagcua

SEQ ID NO: 1199141 - RNA, 18 nt, Homo sapiens
uauaugaucaguguuacu

SEQ ID NO: 1199142 - RNA, 23 nt, Homo sapiens
uauaugauggggcaugugccaua

SEQ ID NO: 1199143 - RNA, 16 nt, Homo sapiens
uauaugcacuauguau

SEQ ID NO: 1199144 - RNA, 11 nt, Homo sapiens
uauaugcucug

SEQ ID NO: 1199145 - RNA, 16 nt, Homo sapiens
uauauggcuucaaguu

SEQ ID NO: 1199146 - RNA, 22 nt, Homo sapiens
uauauguauguuuuaaguaguc

SEQ ID NO: 1199147 - RNA, 19 nt, Homo sapiens
uauauguguguauacauau

SEQ ID NO: 1199148 - RNA, 14 nt, Homo sapiens
uauauuccuuugcc

SEQ ID NO: 1199149 - RNA, 20 nt, Homo sapiens
uauauuccuuugccaauuca

SEQ ID NO: 1199150 - RNA, 14 nt, Homo sapiens
uauauucuaagcca

SEQ ID NO: 1199151 - RNA, 15 nt, Homo sapiens
uauauucucagugua

SEQ ID NO: 1199152 - RNA, 15 nt, Homo sapiens
uauauucuuacccua

SEQ ID NO: 1199153 - RNA, 12 nt, Homo sapiens
uauauugcagua

SEQ ID NO: 1199154 - RNA, 21 nt, Homo sapiens
uauauugcuuaccugaucuca

SEQ ID NO: 1199155 - RNA, 18 nt, Homo sapiens
uauauuguaaagauccua

SEQ ID NO: 1199156 - RNA, 18 nt, Homo sapiens
uauauuguauaggggcaa

SEQ ID NO: 1199157 - RNA, 22 nt, Homo sapiens
uauauuuaaaaaauuauggaau

SEQ ID NO: 1199158 - RNA, 20 nt, Homo sapiens
uauauuuauucaucugggag

SEQ ID NO: 1199159 - RNA, 16 nt, Homo sapiens
uauauuuauugugcuu

SEQ ID NO: 1199160 - RNA, 21 nt, Homo sapiens
uauauuucagguuauauccaa

SEQ ID NO: 1199161 - RNA, 15 nt, Homo sapiens
uauauuucuggugaa

SEQ ID NO: 1199162 - RNA, 22 nt, Homo sapiens
uauauuugugugaaaaugugac

SEQ ID NO: 1199163 - RNA, 21 nt, Homo sapiens
uauauuuugugugaaauugca

SEQ ID NO: 1199164 - RNA, 19 nt, Homo sapiens
uauauuuuuugaacuuugu

SEQ ID NO: 1199165 - RNA, 20 nt, Homo sapiens
uauauuuuuuuaaaauguua

SEQ ID NO: 1199166 - RNA, 15 nt, Homo sapiens
uaucaaaaaguauua

SEQ ID NO: 1199167 - RNA, 23 nt, Homo sapiens
uaucaaacagccccagucuuccu

SEQ ID NO: 1199168 - RNA, 24 nt, Homo sapiens
uaucaaagagaaguuacauauuag

SEQ ID NO: 1199169 - RNA, 21 nt, Homo sapiens
uaucaaaucuguauauguugu

SEQ ID NO: 1199170 - RNA, 15 nt, Homo sapiens
uaucaacauguuauu

SEQ ID NO: 1199171 - RNA, 13 nt, Homo sapiens
ucucauguaucuu

SEQ ID NO: 1199172 - RNA, 19 nt, Homo sapiens
ucucauuuaaaaugagauc

SEQ ID NO: 1199173 - RNA, 16 nt, Homo sapiens
ucucauuuagaacuug

SEQ ID NO: 1199174 - RNA, 14 nt, Homo sapiens
ucuccaaacaguca

SEQ ID NO: 1199175 - RNA, 17 nt, Homo sapiens
ucuccaaaugagaucua

SEQ ID NO: 1199176 - RNA, 21 nt, Homo sapiens
ucuccagccaaccucauugca

SEQ ID NO: 1199177 - RNA, 24 nt, Homo sapiens
ucuccagccagcaaugauguccag

SEQ ID NO: 1199178 - RNA, 19 nt, Homo sapiens
ucuccagcucagaacccag

SEQ ID NO: 1199179 - RNA, 15 nt, Homo sapiens
ucuccaggacaaccu

SEQ ID NO: 1199180 - RNA, 19 nt, Homo sapiens
ucuccaggacaaccugcug

SEQ ID NO: 1199181 - RNA, 13 nt, Homo sapiens
ucuccaggucuca

SEQ ID NO: 1199182 - RNA, 16 nt, Homo sapiens
ucuccauguuggucag

SEQ ID NO: 1199183 - RNA, 16 nt, Homo sapiens
ucucccaccaccucac

SEQ ID NO: 1199184 - RNA, 21 nt, Homo sapiens
ucucccaccuuucgggccaug

SEQ ID NO: 1199185 - RNA, 11 nt, Homo sapiens
ucucccacugc

SEQ ID NO: 1199186 - RNA, 15 nt, Homo sapiens
ucucccaggucccag

SEQ ID NO: 1199187 - RNA, 22 nt, Homo sapiens
ucuccccgcuaaggaagauauc

SEQ ID NO: 1199188 - RNA, 21 nt, Homo sapiens
ucuccccucacacuuugccau

SEQ ID NO: 1199189 - RNA, 17 nt, Homo sapiens
ucucccuccaguccucu

SEQ ID NO: 1199190 - RNA, 17 nt, Homo sapiens
ucucccucccuugccac

SEQ ID NO: 1199191 - RNA, 13 nt, Homo sapiens
ucucccucucagu

SEQ ID NO: 1199192 - RNA, 21 nt, Homo sapiens
ucucccugccaagucucagaa

SEQ ID NO: 1199193 - RNA, 14 nt, Homo sapiens
ucucccuggagcug

SEQ ID NO: 1199194 - RNA, 16 nt, Homo sapiens
ucuccguaauuagcau

SEQ ID NO: 1199195 - RNA, 16 nt, Homo sapiens
ucuccguggcacuugu

SEQ ID NO: 1199196 - RNA, 22 nt, Homo sapiens
ucuccuaaaacuuuaaaacuug

SEQ ID NO: 1199197 - RNA, 13 nt, Homo sapiens
ucuccuacucacu

SEQ ID NO: 1199198 - RNA, 14 nt, Homo sapiens
ucuccuaucuugau

SEQ ID NO: 1199199 - RNA, 12 nt, Homo sapiens
ucuccucagggu

SEQ ID NO: 1199200 - RNA, 14 nt, Homo sapiens
ucuccucugcagcu

SEQ ID NO: 1199201 - RNA, 14 nt, Homo sapiens
ucuccugcccagau

SEQ ID NO: 1199202 - RNA, 10 nt, Homo sapiens
ucuccuugaa

SEQ ID NO: 1199203 - RNA, 14 nt, Homo sapiens
ucuccuugcacuuu

SEQ ID NO: 1199204 - RNA, 17 nt, Homo sapiens
ucuccuuugcacugagg

SEQ ID NO: 1199205 - RNA, 18 nt, Homo sapiens
ucuccuuugcacugaggg

SEQ ID NO: 1199206 - RNA, 13 nt, Homo sapiens
ucuccuuuggcca

SEQ ID NO: 1199207 - RNA, 20 nt, Homo sapiens
ucucgaacuccuggccucaa

SEQ ID NO: 1199208 - RNA, 17 nt, Homo sapiens
ucucgagcccagaugga

SEQ ID NO: 1199209 - RNA, 15 nt, Homo sapiens
ucucgaucuccugac

SEQ ID NO: 1199210 - RNA, 16 nt, Homo sapiens
ucucgauuagacucca

SEQ ID NO: 1199211 - RNA, 16 nt, Homo sapiens
ucucgggugcauuuga

SEQ ID NO: 1199212 - RNA, 19 nt, Homo sapiens
ucucuaacuccugccauuc

SEQ ID NO: 1199213 - RNA, 12 nt, Homo sapiens
ucucuacaagag

SEQ ID NO: 1199214 - RNA, 18 nt, Homo sapiens
ucucuaggccuguugccu

SEQ ID NO: 1199215 - RNA, 17 nt, Homo sapiens
ucucuagugucuuuugc

SEQ ID NO: 1199216 - RNA, 20 nt, Homo sapiens
ucucuccaccgugacacaau

SEQ ID NO: 1199217 - RNA, 14 nt, Homo sapiens
ucucuccagccuga

SEQ ID NO: 1199218 - RNA, 17 nt, Homo sapiens
ucucuccagcugacuaa

SEQ ID NO: 1199219 - RNA, 23 nt, Homo sapiens
ucucucccaggucccagccccuu

SEQ ID NO: 1199220 - RNA, 20 nt, Homo sapiens
ucucuccugauagucuuuca

SEQ ID NO: 1199221 - RNA, 20 nt, Homo sapiens
ucucucggcuccccaugugu

SEQ ID NO: 1199222 - RNA, 16 nt, Homo sapiens
ucucucucucuacaaa

SEQ ID NO: 1199223 - RNA, 14 nt, Homo sapiens
ucucucucugugcu

SEQ ID NO: 1199224 - RNA, 11 nt, Homo sapiens
ucucucugugg

SEQ ID NO: 1199225 - RNA, 9 nt, Homo sapiens
ucucucuuu

SEQ ID NO: 1199226 - RNA, 16 nt, Homo sapiens
ucucugagcacccaag

SEQ ID NO: 1199227 - RNA, 20 nt, Homo sapiens
ucucugaguccuuugcuaau

SEQ ID NO: 1199228 - RNA, 13 nt, Homo sapiens
ucucugcaaugcu

SEQ ID NO: 1199229 - RNA, 14 nt, Homo sapiens
ucucugcaccggac

SEQ ID NO: 1199230 - RNA, 17 nt, Homo sapiens
ucucugcagacuuccca

SEQ ID NO: 1199231 - RNA, 13 nt, Homo sapiens
ucucugcaucuga

SEQ ID NO: 1199232 - RNA, 15 nt, Homo sapiens
ucucugcaucugacu

SEQ ID NO: 1199233 - RNA, 17 nt, Homo sapiens
ucucugccacccacuca

SEQ ID NO: 1199234 - RNA, 18 nt, Homo sapiens
ucucugcccucuucucau

SEQ ID NO: 1199235 - RNA, 20 nt, Homo sapiens
ucucuggcuguaaggcucua

SEQ ID NO: 1199236 - RNA, 12 nt, Homo sapiens
ucucuguacuuu

SEQ ID NO: 1199237 - RNA, 19 nt, Homo sapiens
ucucugucccuugcuguau

SEQ ID NO: 1199238 - RNA, 22 nt, Homo sapiens
ucucugucccuugcuguaugcu

SEQ ID NO: 1199239 - RNA, 21 nt, Homo sapiens
ucucuuaaaccacagcacuau

SEQ ID NO: 1199240 - RNA, 22 nt, Homo sapiens
ucucuuaaaccacagcacuauu

SEQ ID NO: 1199241 - RNA, 19 nt, Homo sapiens
ucucuuaaaguuggaauuu

SEQ ID NO: 1199242 - RNA, 16 nt, Homo sapiens
ucucuuauagaauauu

SEQ ID NO: 1199243 - RNA, 16 nt, Homo sapiens
ucucuucuaagcaaaa

SEQ ID NO: 1199244 - RNA, 19 nt, Homo sapiens
ucucuucuacaauuguggu

SEQ ID NO: 1199245 - RNA, 12 nt, Homo sapiens
ucucuucugugu

SEQ ID NO: 1199246 - RNA, 17 nt, Homo sapiens
ucucuugauucugggau

SEQ ID NO: 1199247 - RNA, 12 nt, Homo sapiens
ucucuugcuaau

SEQ ID NO: 1199248 - RNA, 17 nt, Homo sapiens
ucucuuggcucuacucc

SEQ ID NO: 1199249 - RNA, 21 nt, Homo sapiens
ucucuuuaguauaauugaccu

SEQ ID NO: 1199250 - RNA, 22 nt, Homo sapiens
ucucuuucacggggccgugaca

SEQ ID NO: 1199251 - RNA, 16 nt, Homo sapiens
ucucuuugguguuaca

SEQ ID NO: 1199252 - RNA, 22 nt, Homo sapiens
ucucuuuuuggaggugcuuaag

SEQ ID NO: 1199253 - RNA, 20 nt, Homo sapiens
ucugaaaaacauuccaggaa

SEQ ID NO: 1199254 - RNA, 20 nt, Homo sapiens
ucugaaaaauuuguaguuua

SEQ ID NO: 1199255 - RNA, 20 nt, Homo sapiens
ucugaaauuggucacuuucc

SEQ ID NO: 1199256 - RNA, 20 nt, Homo sapiens
ucugaaauuuuaauugaacu

SEQ ID NO: 1199257 - RNA, 14 nt, Homo sapiens
ucugaacacaggca

SEQ ID NO: 1199258 - RNA, 22 nt, Homo sapiens
ucugaacacaggcagcuuucua

SEQ ID NO: 1199259 - RNA, 23 nt, Homo sapiens
ucugaagcccucccagguguuaa

SEQ ID NO: 1199260 - RNA, 21 nt, Homo sapiens
ucugaauaaaguguaacaauu

SEQ ID NO: 1199261 - RNA, 17 nt, Homo sapiens
ucugaauaaauaauucu

SEQ ID NO: 1199262 - RNA, 13 nt, Homo sapiens
ucugaauccucau

SEQ ID NO: 1199263 - RNA, 19 nt, Homo sapiens
ucugaauccucaugaggcu

SEQ ID NO: 1199264 - RNA, 14 nt, Homo sapiens
ucugacacacagcu

SEQ ID NO: 1199265 - RNA, 12 nt, Homo sapiens
ucugacacugaa

SEQ ID NO: 1199266 - RNA, 13 nt, Homo sapiens
ucugacauuuaua

SEQ ID NO: 1199267 - RNA, 13 nt, Homo sapiens
ucugaccaaaaca

SEQ ID NO: 1199268 - RNA, 15 nt, Homo sapiens
ucugacccacugcuu

SEQ ID NO: 1199269 - RNA, 22 nt, Homo sapiens
ucugacgcaaaaccacuuuccu

SEQ ID NO: 1199270 - RNA, 17 nt, Homo sapiens
ucugacuaaaaauacuu

SEQ ID NO: 1199271 - RNA, 12 nt, Homo sapiens
ucugacucucca

SEQ ID NO: 1199272 - RNA, 15 nt, Homo sapiens
ucugacucugagcua

SEQ ID NO: 1199273 - RNA, 19 nt, Homo sapiens
ucugagaagaggagcccuc

SEQ ID NO: 1199274 - RNA, 15 nt, Homo sapiens
ucugagacauuccac

SEQ ID NO: 1199275 - RNA, 19 nt, Homo sapiens
ucugagagaugacagggaa

SEQ ID NO: 1199276 - RNA, 22 nt, Homo sapiens
ucugagagugaaaccaugacug

SEQ ID NO: 1199277 - RNA, 23 nt, Homo sapiens
ucugagagugaaaccaugacugu

SEQ ID NO: 1199278 - RNA, 17 nt, Homo sapiens
ucugagaugcugguaau

SEQ ID NO: 1199279 - RNA, 12 nt, Homo sapiens
ucugagccaaag

SEQ ID NO: 1199280 - RNA, 15 nt, Homo sapiens
ucugagccaaagaga

SEQ ID NO: 1199281 - RNA, 16 nt, Homo sapiens
ucugaggccucagagu

SEQ ID NO: 1199282 - RNA, 16 nt, Homo sapiens
ucugaggccugaguga

SEQ ID NO: 1199283 - RNA, 19 nt, Homo sapiens
ucugaggccugagugagug

SEQ ID NO: 1199284 - RNA, 21 nt, Homo sapiens
ucugaggccugagugauccac

SEQ ID NO: 1199285 - RNA, 13 nt, Homo sapiens
ucugaguccuuug

SEQ ID NO: 1199286 - RNA, 20 nt, Homo sapiens
ucugagugaaccuguauaag

SEQ ID NO: 1199287 - RNA, 22 nt, Homo sapiens
ucugauaaacacaaucugcuag

SEQ ID NO: 1199288 - RNA, 17 nt, Homo sapiens
ucugauaccacugcacu

SEQ ID NO: 1199289 - RNA, 16 nt, Homo sapiens
ucugauauaacaaacu

SEQ ID NO: 1199290 - RNA, 19 nt, Homo sapiens
ucugaucaagaacauguca

SEQ ID NO: 1199291 - RNA, 18 nt, Homo sapiens
ucugauuuccuaauguca

SEQ ID NO: 1199292 - RNA, 20 nt, Homo sapiens
ucugcaaaaauggauauuau

SEQ ID NO: 1199293 - RNA, 23 nt, Homo sapiens
ucugcaacugaaauuacauauug

SEQ ID NO: 1199294 - RNA, 18 nt, Homo sapiens
ucugcaagauuuuaaaag

SEQ ID NO: 1199295 - RNA, 13 nt, Homo sapiens
ucugcaagcauca

SEQ ID NO: 1199296 - RNA, 16 nt, Homo sapiens
ucugcacagacaagca

SEQ ID NO: 1199297 - RNA, 22 nt, Homo sapiens
ucugcacccucgacaagaccac

SEQ ID NO: 1199298 - RNA, 15 nt, Homo sapiens
ugaccuaccaggaca

SEQ ID NO: 1199299 - RNA, 14 nt, Homo sapiens
ugaccucacaguga

SEQ ID NO: 1199300 - RNA, 14 nt, Homo sapiens
ugaccucacuuuag

SEQ ID NO: 1199301 - RNA, 23 nt, Homo sapiens
ugaccucacuuuaggcagcugua

SEQ ID NO: 1199302 - RNA, 23 nt, Homo sapiens
ugaccugaggagacaucuacaca

SEQ ID NO: 1199303 - RNA, 12 nt, Homo sapiens
ugaccugcacac

SEQ ID NO: 1199304 - RNA, 18 nt, Homo sapiens
ugaccuggaaucagugaa

SEQ ID NO: 1199305 - RNA, 19 nt, Homo sapiens
ugaccugucuauaagagaa

SEQ ID NO: 1199306 - RNA, 21 nt, Homo sapiens
ugaccuuggagagacacagcg

SEQ ID NO: 1199307 - RNA, 19 nt, Homo sapiens
ugaccuugggguacaauug

SEQ ID NO: 1199308 - RNA, 18 nt, Homo sapiens
ugaccuuggguauuugca

SEQ ID NO: 1199309 - RNA, 22 nt, Homo sapiens
ugacgacaagugcugaacagug

SEQ ID NO: 1199310 - RNA, 20 nt, Homo sapiens
ugacgacagugcauuugccu

SEQ ID NO: 1199311 - RNA, 15 nt, Homo sapiens
ugacgagcagggugg

SEQ ID NO: 1199312 - RNA, 22 nt, Homo sapiens
ugacgcaaagaucaccagccau

SEQ ID NO: 1199313 - RNA, 15 nt, Homo sapiens
ugacggcccugcaau

SEQ ID NO: 1199314 - RNA, 16 nt, Homo sapiens
ugacguuuacauauau

SEQ ID NO: 1199315 - RNA, 19 nt, Homo sapiens
ugacuaauuaggcaaggcu

SEQ ID NO: 1199316 - RNA, 21 nt, Homo sapiens
ugacuacugcccacaccaacg

SEQ ID NO: 1199317 - RNA, 17 nt, Homo sapiens
ugacuauggcuaccaaa

SEQ ID NO: 1199318 - RNA, 22 nt, Homo sapiens
ugacuauuauauuuccaagaaa

SEQ ID NO: 1199319 - RNA, 14 nt, Homo sapiens
ugacucagaauauu

SEQ ID NO: 1199320 - RNA, 13 nt, Homo sapiens
ugacuccaagaac

SEQ ID NO: 1199321 - RNA, 18 nt, Homo sapiens
ugacucccaaguuuccau

SEQ ID NO: 1199322 - RNA, 23 nt, Homo sapiens
ugacucccaaguuuccauagcaa

SEQ ID NO: 1199323 - RNA, 16 nt, Homo sapiens
ugacuccuccaaggaa

SEQ ID NO: 1199324 - RNA, 20 nt, Homo sapiens
ugacuccugggcaucugugc

SEQ ID NO: 1199325 - RNA, 18 nt, Homo sapiens
ugacucgguguucugucc

SEQ ID NO: 1199326 - RNA, 15 nt, Homo sapiens
ugacucucacaagau

SEQ ID NO: 1199327 - RNA, 15 nt, Homo sapiens
ugacugaaacauuca

SEQ ID NO: 1199328 - RNA, 17 nt, Homo sapiens
ugacugaugcugagauu

SEQ ID NO: 1199329 - RNA, 11 nt, Homo sapiens
ugacuggccag

SEQ ID NO: 1199330 - RNA, 16 nt, Homo sapiens
ugacugguuguucaaa

SEQ ID NO: 1199331 - RNA, 21 nt, Homo sapiens
ugacuguaacauauucuguau

SEQ ID NO: 1199332 - RNA, 24 nt, Homo sapiens
ugacuguaacauauucuguaugaa

SEQ ID NO: 1199333 - RNA, 18 nt, Homo sapiens
ugacugucacauaaugcu

SEQ ID NO: 1199334 - RNA, 15 nt, Homo sapiens
ugacugucucacuua

SEQ ID NO: 1199335 - RNA, 12 nt, Homo sapiens
ugacuguuacag

SEQ ID NO: 1199336 - RNA, 16 nt, Homo sapiens
ugacuguucuugguaa

SEQ ID NO: 1199337 - RNA, 15 nt, Homo sapiens
ugacuuaaccauaua

SEQ ID NO: 1199338 - RNA, 14 nt, Homo sapiens
ugacuucaaugaua

SEQ ID NO: 1199339 - RNA, 13 nt, Homo sapiens
ugacuucaucugg

SEQ ID NO: 1199340 - RNA, 22 nt, Homo sapiens
ugacuuccugaacaaccagcug

SEQ ID NO: 1199341 - RNA, 21 nt, Homo sapiens
ugacuucuuuugaguuagguu

SEQ ID NO: 1199342 - RNA, 18 nt, Homo sapiens
ugacuuucugauuacugu

SEQ ID NO: 1199343 - RNA, 17 nt, Homo sapiens
ugagaaaauaucuugcu

SEQ ID NO: 1199344 - RNA, 17 nt, Homo sapiens
ugagaaaaugagugacu

SEQ ID NO: 1199345 - RNA, 23 nt, Homo sapiens
ugagaaaaugccucaauucacau

SEQ ID NO: 1199346 - RNA, 19 nt, Homo sapiens
ugagaaaccuauauuucaa

SEQ ID NO: 1199347 - RNA, 14 nt, Homo sapiens
ugagaaaguucuca

SEQ ID NO: 1199348 - RNA, 23 nt, Homo sapiens
ugagaaauaaaaagccugucauu

SEQ ID NO: 1199349 - RNA, 22 nt, Homo sapiens
ugagaaaugaauaagcuuucuc

SEQ ID NO: 1199350 - RNA, 17 nt, Homo sapiens
ugagaacugacuuucuc

SEQ ID NO: 1199351 - RNA, 14 nt, Homo sapiens
ugagaacuuuccau

SEQ ID NO: 1199352 - RNA, 17 nt, Homo sapiens
ugagaagaggcugcugc

SEQ ID NO: 1199353 - RNA, 19 nt, Homo sapiens
ugagaagccuucagcucca

SEQ ID NO: 1199354 - RNA, 14 nt, Homo sapiens
ugagaaggacccug

SEQ ID NO: 1199355 - RNA, 19 nt, Homo sapiens
ugagaagucaaacauuuca

SEQ ID NO: 1199356 - RNA, 12 nt, Homo sapiens
ugagaagugaua

SEQ ID NO: 1199357 - RNA, 16 nt, Homo sapiens
ugagaagugcacuuua

SEQ ID NO: 1199358 - RNA, 15 nt, Homo sapiens
ugagaaugugcuuug

SEQ ID NO: 1199359 - RNA, 17 nt, Homo sapiens
ugagaauuguaugucau

SEQ ID NO: 1199360 - RNA, 22 nt, Homo sapiens
ugagacaaaauuuuaguccaaa

SEQ ID NO: 1199361 - RNA, 13 nt, Homo sapiens
ugagacaagcccu

SEQ ID NO: 1199362 - RNA, 17 nt, Homo sapiens
ugagaccgagucuugcu

SEQ ID NO: 1199363 - RNA, 14 nt, Homo sapiens
ugagacucacagga

SEQ ID NO: 1199364 - RNA, 18 nt, Homo sapiens
ugagacuccucauaccuc

SEQ ID NO: 1199365 - RNA, 17 nt, Homo sapiens
ugagacucugucucaaa

SEQ ID NO: 1199366 - RNA, 16 nt, Homo sapiens
ugagacugaagaccag

SEQ ID NO: 1199367 - RNA, 19 nt, Homo sapiens
ugagacugaagaccaguau

SEQ ID NO: 1199368 - RNA, 13 nt, Homo sapiens
ugagacuguguug

SEQ ID NO: 1199369 - RNA, 13 nt, Homo sapiens
ugagagaccugag

SEQ ID NO: 1199370 - RNA, 14 nt, Homo sapiens
ugagagagacaaga

SEQ ID NO: 1199371 - RNA, 14 nt, Homo sapiens
ugagaggcaaugau

SEQ ID NO: 1199372 - RNA, 19 nt, Homo sapiens
ugagagggaaucgacugua

SEQ ID NO: 1199373 - RNA, 18 nt, Homo sapiens
ugagaggggaacagacug

SEQ ID NO: 1199374 - RNA, 15 nt, Homo sapiens
ugagaggugacacug

SEQ ID NO: 1199375 - RNA, 22 nt, Homo sapiens
ugagagucuagauucucuggcu

SEQ ID NO: 1199376 - RNA, 15 nt, Homo sapiens
ugagagugaaaccau

SEQ ID NO: 1199377 - RNA, 19 nt, Homo sapiens
ugagagugagcaaccagcu

SEQ ID NO: 1199378 - RNA, 22 nt, Homo sapiens
ugagauauuaaauucucaaagu

SEQ ID NO: 1199379 - RNA, 18 nt, Homo sapiens
ugagauauuugguaccau

SEQ ID NO: 1199380 - RNA, 14 nt, Homo sapiens
ugagaucacuacuc

SEQ ID NO: 1199381 - RNA, 17 nt, Homo sapiens
ugagaucaucagugaua

SEQ ID NO: 1199382 - RNA, 21 nt, Homo sapiens
ugagaugcuguaggugguaug

SEQ ID NO: 1199383 - RNA, 22 nt, Homo sapiens
ugagauguuguguggcaauggg

SEQ ID NO: 1199384 - RNA, 16 nt, Homo sapiens
ugagcaaauggugcug

SEQ ID NO: 1199385 - RNA, 16 nt, Homo sapiens
ugagcaacucuugauu

SEQ ID NO: 1199386 - RNA, 19 nt, Homo sapiens
ugagcaacucuugauuauc

SEQ ID NO: 1199387 - RNA, 15 nt, Homo sapiens
ugagcaagacauacu

SEQ ID NO: 1199388 - RNA, 22 nt, Homo sapiens
ugagcaaggagcacaagccaca

SEQ ID NO: 1199389 - RNA, 14 nt, Homo sapiens
ugagcaauggagug

SEQ ID NO: 1199390 - RNA, 23 nt, Homo sapiens
ugagcacuuagcaggcaccgcca

SEQ ID NO: 1199391 - RNA, 19 nt, Homo sapiens
ugagcaguggacacgugag

SEQ ID NO: 1199392 - RNA, 14 nt, Homo sapiens
ugagcauaaaucaa

SEQ ID NO: 1199393 - RNA, 15 nt, Homo sapiens
ugagcauuugcaccu

SEQ ID NO: 1199394 - RNA, 20 nt, Homo sapiens
ugagccaaagagaaugccau

SEQ ID NO: 1199395 - RNA, 21 nt, Homo sapiens
ugagccaaagagaaugccauu

SEQ ID NO: 1199396 - RNA, 17 nt, Homo sapiens
ugagccaaccagaauaa

SEQ ID NO: 1199397 - RNA, 18 nt, Homo sapiens
ugagccaguuagacuagu

SEQ ID NO: 1199398 - RNA, 16 nt, Homo sapiens
ugagccaucacuagaa

SEQ ID NO: 1199399 - RNA, 22 nt, Homo sapiens
ugagcccacaaagccuuaucaa

SEQ ID NO: 1199400 - RNA, 21 nt, Homo sapiens
ugagcccagccuacuuuucag

SEQ ID NO: 1199401 - RNA, 20 nt, Homo sapiens
ugagccccuggaggcacuga

SEQ ID NO: 1199402 - RNA, 18 nt, Homo sapiens
ugagcccggaugcuucuc

SEQ ID NO: 1199403 - RNA, 20 nt, Homo sapiens
ugagccgugaacugugcaua

SEQ ID NO: 1199404 - RNA, 21 nt, Homo sapiens
ugagccuaugauauuccccau

SEQ ID NO: 1199405 - RNA, 21 nt, Homo sapiens
ugagccuggcccauagaaaca

SEQ ID NO: 1199406 - RNA, 19 nt, Homo sapiens
ugagcgggugccgaagcua

SEQ ID NO: 1199407 - RNA, 20 nt, Homo sapiens
ugagcgucacggccaagugu

SEQ ID NO: 1199408 - RNA, 22 nt, Homo sapiens
ugagcgucagcauccagguuua

SEQ ID NO: 1199409 - RNA, 14 nt, Homo sapiens
ugagcuaaucuuca

SEQ ID NO: 1199410 - RNA, 16 nt, Homo sapiens
ugagcuaugcaaacaa

SEQ ID NO: 1199411 - RNA, 16 nt, Homo sapiens
ugagcucaaaguacua

SEQ ID NO: 1199412 - RNA, 21 nt, Homo sapiens
ugagcucgguggcucaugccu

SEQ ID NO: 1199413 - RNA, 15 nt, Homo sapiens
ugagcugacaucuca

SEQ ID NO: 1199414 - RNA, 19 nt, Homo sapiens
ugagcugccuguaacuuga

SEQ ID NO: 1199415 - RNA, 18 nt, Homo sapiens
ugagcuggaaggggccac

SEQ ID NO: 1199416 - RNA, 21 nt, Homo sapiens
ugagcuggaguucagcaguga

SEQ ID NO: 1199417 - RNA, 20 nt, Homo sapiens
ugagcuggggacucagggac

SEQ ID NO: 1199418 - RNA, 18 nt, Homo sapiens
ugagcuugauuaaaucaa

SEQ ID NO: 1199419 - RNA, 16 nt, Homo sapiens
ugagcuuucuuugcac

SEQ ID NO: 1199420 - RNA, 20 nt, Homo sapiens
ugaggaaaacuguagucucu

SEQ ID NO: 1199421 - RNA, 16 nt, Homo sapiens
ugaggaagugaacauu

SEQ ID NO: 1199422 - RNA, 15 nt, Homo sapiens
ugaggaccacuccug

SEQ ID NO: 1199423 - RNA, 20 nt, Homo sapiens
ugccgugugagugugacagg

SEQ ID NO: 1199424 - RNA, 12 nt, Homo sapiens
ugccuaccccag

SEQ ID NO: 1199425 - RNA, 19 nt, Homo sapiens
ugccuacgauugaaaugaa

SEQ ID NO: 1199426 - RNA, 15 nt, Homo sapiens
ugccuagacuguuac

SEQ ID NO: 1199427 - RNA, 16 nt, Homo sapiens
ugccuagacuguuacu

SEQ ID NO: 1199428 - RNA, 15 nt, Homo sapiens
ugccuaguaacacau

SEQ ID NO: 1199429 - RNA, 19 nt, Homo sapiens
ugccuaguaacacauaugu

SEQ ID NO: 1199430 - RNA, 23 nt, Homo sapiens
ugccuaucaaagaguauguugua

SEQ ID NO: 1199431 - RNA, 20 nt, Homo sapiens
ugccuauucccacaccucca

SEQ ID NO: 1199432 - RNA, 15 nt, Homo sapiens
ugccucaaugccagu

SEQ ID NO: 1199433 - RNA, 12 nt, Homo sapiens
ugccucaguaua

SEQ ID NO: 1199434 - RNA, 15 nt, Homo sapiens
ugccuccaccaccac

SEQ ID NO: 1199435 - RNA, 22 nt, Homo sapiens
ugccuccauucugaccauuuca

SEQ ID NO: 1199436 - RNA, 14 nt, Homo sapiens
ugccucccaaagug

SEQ ID NO: 1199437 - RNA, 16 nt, Homo sapiens
ugccucccacuucacu

SEQ ID NO: 1199438 - RNA, 12 nt, Homo sapiens
ugccucugcucc

SEQ ID NO: 1199439 - RNA, 15 nt, Homo sapiens
ugccucuggucccag

SEQ ID NO: 1199440 - RNA, 16 nt, Homo sapiens
ugccugagaaagcaua

SEQ ID NO: 1199441 - RNA, 14 nt, Homo sapiens
ugccugccacugag

SEQ ID NO: 1199442 - RNA, 15 nt, Homo sapiens
ugccugcuaauauga

SEQ ID NO: 1199443 - RNA, 20 nt, Homo sapiens
ugccuggccaggcagaucug

SEQ ID NO: 1199444 - RNA, 13 nt, Homo sapiens
ugccugggaccug

SEQ ID NO: 1199445 - RNA, 19 nt, Homo sapiens
ugccugggccugugcagca

SEQ ID NO: 1199446 - RNA, 20 nt, Homo sapiens
ugccuggggucugagcauga

SEQ ID NO: 1199447 - RNA, 19 nt, Homo sapiens
ugccuggugaauggccuuc

SEQ ID NO: 1199448 - RNA, 16 nt, Homo sapiens
ugccuggugugccuca

SEQ ID NO: 1199449 - RNA, 18 nt, Homo sapiens
ugccuguaaucccaacac

SEQ ID NO: 1199450 - RNA, 20 nt, Homo sapiens
ugccuguaaucucagcacuu

SEQ ID NO: 1199451 - RNA, 16 nt, Homo sapiens
ugccuguauacuuuag

SEQ ID NO: 1199452 - RNA, 11 nt, Homo sapiens
ugccuguguau

SEQ ID NO: 1199453 - RNA, 21 nt, Homo sapiens
ugccuguuaaggaaacuuuau

SEQ ID NO: 1199454 - RNA, 15 nt, Homo sapiens
ugccuuaaacacuca

SEQ ID NO: 1199455 - RNA, 19 nt, Homo sapiens
ugccuuaggguagugcuaa

SEQ ID NO: 1199456 - RNA, 16 nt, Homo sapiens
ugccuucacuuuacaa

SEQ ID NO: 1199457 - RNA, 22 nt, Homo sapiens
ugccuucagaggauaaauauca

SEQ ID NO: 1199458 - RNA, 21 nt, Homo sapiens
ugccuucucacaucuguccag

SEQ ID NO: 1199459 - RNA, 14 nt, Homo sapiens
ugccuucucaugau

SEQ ID NO: 1199460 - RNA, 22 nt, Homo sapiens
ugccuucucuguucccuugcag

SEQ ID NO: 1199461 - RNA, 19 nt, Homo sapiens
ugccuucuuacaacagaga

SEQ ID NO: 1199462 - RNA, 21 nt, Homo sapiens
ugccuucuuauugcuuuuaug

SEQ ID NO: 1199463 - RNA, 13 nt, Homo sapiens
ugccuugaacugu

SEQ ID NO: 1199464 - RNA, 20 nt, Homo sapiens
ugccuugcaauuagcauucu

SEQ ID NO: 1199465 - RNA, 22 nt, Homo sapiens
ugccuugggccuugcugcugcu

SEQ ID NO: 1199466 - RNA, 16 nt, Homo sapiens
ugccuugugcuguuaa

SEQ ID NO: 1199467 - RNA, 18 nt, Homo sapiens
ugccuuuaagccaaagaa

SEQ ID NO: 1199468 - RNA, 12 nt, Homo sapiens
ugcgaaccaccc

SEQ ID NO: 1199469 - RNA, 15 nt, Homo sapiens
ugcgccgagccucag

SEQ ID NO: 1199470 - RNA, 20 nt, Homo sapiens
ugcgcggaagugaccacaga

SEQ ID NO: 1199471 - RNA, 18 nt, Homo sapiens
ugcggaugcaagagcacc

SEQ ID NO: 1199472 - RNA, 22 nt, Homo sapiens
ugcggcaaaaggaaagcugugu

SEQ ID NO: 1199473 - RNA, 18 nt, Homo sapiens
ugcggggggcaccagagg

SEQ ID NO: 1199474 - RNA, 17 nt, Homo sapiens
ugcgugcgagcacacac

SEQ ID NO: 1199475 - RNA, 22 nt, Homo sapiens
ugcgugcucccgaugcugcuau

SEQ ID NO: 1199476 - RNA, 14 nt, Homo sapiens
ugcguggacucugc

SEQ ID NO: 1199477 - RNA, 15 nt, Homo sapiens
ugcguggacucugca

SEQ ID NO: 1199478 - RNA, 21 nt, Homo sapiens
ugcguguguguucacguguuc

SEQ ID NO: 1199479 - RNA, 20 nt, Homo sapiens
ugcuaaaaaaagugcaugau

SEQ ID NO: 1199480 - RNA, 23 nt, Homo sapiens
ugcuaaacgcacacaguaucuag

SEQ ID NO: 1199481 - RNA, 16 nt, Homo sapiens
ugcuaaagaauccaua

SEQ ID NO: 1199482 - RNA, 17 nt, Homo sapiens
ugcuaaauauaaaaaca

SEQ ID NO: 1199483 - RNA, 12 nt, Homo sapiens
ugcuaacaaugc

SEQ ID NO: 1199484 - RNA, 12 nt, Homo sapiens
ugcuaaccugga

SEQ ID NO: 1199485 - RNA, 17 nt, Homo sapiens
ugcuaagguucuaaggc

SEQ ID NO: 1199486 - RNA, 21 nt, Homo sapiens
ugcuaaucagggaggucauuu

SEQ ID NO: 1199487 - RNA, 12 nt, Homo sapiens
ugcuaaucuugu

SEQ ID NO: 1199488 - RNA, 15 nt, Homo sapiens
ugcuaaugugugaug

SEQ ID NO: 1199489 - RNA, 16 nt, Homo sapiens
ugcuaauuaauacauc

SEQ ID NO: 1199490 - RNA, 15 nt, Homo sapiens
ugcuaauucaaagcu

SEQ ID NO: 1199491 - RNA, 17 nt, Homo sapiens
ugcuaccaaaacaguua

SEQ ID NO: 1199492 - RNA, 20 nt, Homo sapiens
ugcuacccugaguucaucca

SEQ ID NO: 1199493 - RNA, 18 nt, Homo sapiens
ugcuacuguguagacuca

SEQ ID NO: 1199494 - RNA, 22 nt, Homo sapiens
ugcuacuucacugucaucuuca

SEQ ID NO: 1199495 - RNA, 22 nt, Homo sapiens
ugcuaguguucugucuaaaaac

SEQ ID NO: 1199496 - RNA, 18 nt, Homo sapiens
ugcuauacacaagcaaug

SEQ ID NO: 1199497 - RNA, 18 nt, Homo sapiens
ugcuauacugcauacuuu

SEQ ID NO: 1199498 - RNA, 13 nt, Homo sapiens
ugcuaugcuauug

SEQ ID NO: 1199499 - RNA, 20 nt, Homo sapiens
ugcuauucuaacuaaugaca

SEQ ID NO: 1199500 - RNA, 16 nt, Homo sapiens
ugcuauugacaaguca

SEQ ID NO: 1199501 - RNA, 19 nt, Homo sapiens
ugcuauuuauuuuccuaaa

SEQ ID NO: 1199502 - RNA, 18 nt, Homo sapiens
ugcucaaucccugaggac

SEQ ID NO: 1199503 - RNA, 21 nt, Homo sapiens
ugcucacaaaggauacuuuua

SEQ ID NO: 1199504 - RNA, 22 nt, Homo sapiens
ugcucacagccuuucugaggac

SEQ ID NO: 1199505 - RNA, 17 nt, Homo sapiens
ugcucaccagaucucag

SEQ ID NO: 1199506 - RNA, 22 nt, Homo sapiens
ugcucagaauucaucugaagag

SEQ ID NO: 1199507 - RNA, 16 nt, Homo sapiens
ugcucauauugugauu

SEQ ID NO: 1199508 - RNA, 17 nt, Homo sapiens
ugcucauauugugauuc

SEQ ID NO: 1199509 - RNA, 16 nt, Homo sapiens
ugcucauugaacuuua

SEQ ID NO: 1199510 - RNA, 15 nt, Homo sapiens
ugcuccaagauucua

SEQ ID NO: 1199511 - RNA, 13 nt, Homo sapiens
ugcucccacagaa

SEQ ID NO: 1199512 - RNA, 14 nt, Homo sapiens
ugcucccacagaac

SEQ ID NO: 1199513 - RNA, 21 nt, Homo sapiens
ugcucccagcagcccuaagga

SEQ ID NO: 1199514 - RNA, 15 nt, Homo sapiens
ugcucccuagccaga

SEQ ID NO: 1199515 - RNA, 20 nt, Homo sapiens
ugcucccuagccagaggcuc

SEQ ID NO: 1199516 - RNA, 17 nt, Homo sapiens
ugcucccugaagccagc

SEQ ID NO: 1199517 - RNA, 17 nt, Homo sapiens
ugcucccugacagcacc

SEQ ID NO: 1199518 - RNA, 14 nt, Homo sapiens
ugcuccgcaagagc

SEQ ID NO: 1199519 - RNA, 16 nt, Homo sapiens
ugcuccgcugcuccuu

SEQ ID NO: 1199520 - RNA, 14 nt, Homo sapiens
ugcuccucugccug

SEQ ID NO: 1199521 - RNA, 22 nt, Homo sapiens
ugcuccuuggcuuaccugaccu

SEQ ID NO: 1199522 - RNA, 18 nt, Homo sapiens
ugcucguuuucgcugggg

SEQ ID NO: 1199523 - RNA, 16 nt, Homo sapiens
ugcucuacccaugagc

SEQ ID NO: 1199524 - RNA, 22 nt, Homo sapiens
ugcucucgcaccuuuccaaagu

SEQ ID NO: 1199525 - RNA, 21 nt, Homo sapiens
ugcucugguuagaaaaaggac

SEQ ID NO: 1199526 - RNA, 19 nt, Homo sapiens
ugcucugguuugagcaauu

SEQ ID NO: 1199527 - RNA, 21 nt, Homo sapiens
ugcucuguaggagcuacccuu

SEQ ID NO: 1199528 - RNA, 19 nt, Homo sapiens
ugcucuugagucuuugcag

SEQ ID NO: 1199529 - RNA, 13 nt, Homo sapiens
ugcucuugccaaa

SEQ ID NO: 1199530 - RNA, 23 nt, Homo sapiens
ugcucuuuaugaaugaaaaaaca

SEQ ID NO: 1199531 - RNA, 16 nt, Homo sapiens
ugcucuuucucugcca

SEQ ID NO: 1199532 - RNA, 18 nt, Homo sapiens
ugcucuuugcugcacuau

SEQ ID NO: 1199533 - RNA, 21 nt, Homo sapiens
ugcugaaaaaguagauugagu

SEQ ID NO: 1199534 - RNA, 13 nt, Homo sapiens
ugcugaacagugg

SEQ ID NO: 1199535 - RNA, 20 nt, Homo sapiens
ugcugaagaggguugguaua

SEQ ID NO: 1199536 - RNA, 19 nt, Homo sapiens
ugcugaauccccuauccca

SEQ ID NO: 1199537 - RNA, 20 nt, Homo sapiens
ugcugaauccccuaucccau

SEQ ID NO: 1199538 - RNA, 17 nt, Homo sapiens
ugcugaaugccucgcuc

SEQ ID NO: 1199539 - RNA, 22 nt, Homo sapiens
ugcugacaaccauuaaagucag

SEQ ID NO: 1199540 - RNA, 15 nt, Homo sapiens
ugcugacuuuaaaag

SEQ ID NO: 1199541 - RNA, 18 nt, Homo sapiens
ugcugagacugaagacca

SEQ ID NO: 1199542 - RNA, 19 nt, Homo sapiens
ugcugagagaaauauggaa

SEQ ID NO: 1199543 - RNA, 15 nt, Homo sapiens
ugcugaguagugaca

SEQ ID NO: 1199544 - RNA, 20 nt, Homo sapiens
ugcugaguauguuaagcucu

SEQ ID NO: 1199545 - RNA, 18 nt, Homo sapiens
ugcugagucagacuguca

SEQ ID NO: 1199546 - RNA, 19 nt, Homo sapiens
ugcugagugaaugaacaaa

SEQ ID NO: 1199547 - RNA, 14 nt, Homo sapiens
ugcugagugagcug

SEQ ID NO: 1199548 - RNA, 23 nt, Homo sapiens
ugcugagugcaccacuucaagug

SEQ ID NO: 1199549 - RNA, 21 nt, Homo sapiens
uuccuauguuucacugugcaa

SEQ ID NO: 1199550 - RNA, 21 nt, Homo sapiens
uuccucaccaggagcccggcu

SEQ ID NO: 1199551 - RNA, 13 nt, Homo sapiens
uuccucagaucau

SEQ ID NO: 1199552 - RNA, 17 nt, Homo sapiens
uuccucagauggacaag

SEQ ID NO: 1199553 - RNA, 13 nt, Homo sapiens
uuccuccauaaau

SEQ ID NO: 1199554 - RNA, 17 nt, Homo sapiens
uuccucuagaagccaag

SEQ ID NO: 1199555 - RNA, 16 nt, Homo sapiens
uuccucuauacaucuc

SEQ ID NO: 1199556 - RNA, 15 nt, Homo sapiens
uuccucucuuggcaa

SEQ ID NO: 1199557 - RNA, 14 nt, Homo sapiens
uuccucugaacaaa

SEQ ID NO: 1199558 - RNA, 18 nt, Homo sapiens
uuccucuuggugucauau

SEQ ID NO: 1199559 - RNA, 14 nt, Homo sapiens
uuccugacugcuag

SEQ ID NO: 1199560 - RNA, 18 nt, Homo sapiens
uuccugacuggcaaagga

SEQ ID NO: 1199561 - RNA, 23 nt, Homo sapiens
uuccugauuaggaauaugaccau

SEQ ID NO: 1199562 - RNA, 20 nt, Homo sapiens
uuccugcauuucucuucuca

SEQ ID NO: 1199563 - RNA, 22 nt, Homo sapiens
uuccugccacuguguacugugg

SEQ ID NO: 1199564 - RNA, 18 nt, Homo sapiens
uuccugccccagacagac

SEQ ID NO: 1199565 - RNA, 12 nt, Homo sapiens
uuccugcccuac

SEQ ID NO: 1199566 - RNA, 22 nt, Homo sapiens
uuccugcgcgucaucucugaca

SEQ ID NO: 1199567 - RNA, 16 nt, Homo sapiens
uuccugcuccaugacu

SEQ ID NO: 1199568 - RNA, 11 nt, Homo sapiens
uuccuggugac

SEQ ID NO: 1199569 - RNA, 21 nt, Homo sapiens
uuccugguggauacuguagaa

SEQ ID NO: 1199570 - RNA, 15 nt, Homo sapiens
uuccuguucaguaau

SEQ ID NO: 1199571 - RNA, 19 nt, Homo sapiens
uuccuguucccuuggaaua

SEQ ID NO: 1199572 - RNA, 16 nt, Homo sapiens
uuccuguuuccagggu

SEQ ID NO: 1199573 - RNA, 21 nt, Homo sapiens
uuccuguuuccauccaguucc

SEQ ID NO: 1199574 - RNA, 15 nt, Homo sapiens
uuccuuaaacugugu

SEQ ID NO: 1199575 - RNA, 16 nt, Homo sapiens
uuccuuaaacugugug

SEQ ID NO: 1199576 - RNA, 23 nt, Homo sapiens
uuccuuaaagcauuugcaacagc

SEQ ID NO: 1199577 - RNA, 12 nt, Homo sapiens
uuccuucacuca

SEQ ID NO: 1199578 - RNA, 17 nt, Homo sapiens
uuccuuccacaguuauc

SEQ ID NO: 1199579 - RNA, 15 nt, Homo sapiens
uuccuugaccuuccu

SEQ ID NO: 1199580 - RNA, 21 nt, Homo sapiens
uuccuugccuaaggugucuga

SEQ ID NO: 1199581 - RNA, 22 nt, Homo sapiens
uuccuuuaugaugacugcuuaa

SEQ ID NO: 1199582 - RNA, 19 nt, Homo sapiens
uuccuuuccccagcccagg

SEQ ID NO: 1199583 - RNA, 18 nt, Homo sapiens
uuccuuuccuaaaagugu

SEQ ID NO: 1199584 - RNA, 14 nt, Homo sapiens
uuccuuucugccac

SEQ ID NO: 1199585 - RNA, 22 nt, Homo sapiens
uuccuuugccaauucauuucuc

SEQ ID NO: 1199586 - RNA, 20 nt, Homo sapiens
uuccuuuuuaauaugcuuaa

SEQ ID NO: 1199587 - RNA, 15 nt, Homo sapiens
uucgaagccuugccu

SEQ ID NO: 1199588 - RNA, 21 nt, Homo sapiens
uucgaccucgucuuucuccau

SEQ ID NO: 1199589 - RNA, 16 nt, Homo sapiens
uucgacugguccagcu

SEQ ID NO: 1199590 - RNA, 20 nt, Homo sapiens
uucgagaccagucuggccaa

SEQ ID NO: 1199591 - RNA, 23 nt, Homo sapiens
uucgcaccuaccaucagggacag

SEQ ID NO: 1199592 - RNA, 23 nt, Homo sapiens
uucggcuccgggcaaauggcuga

SEQ ID NO: 1199593 - RNA, 17 nt, Homo sapiens
uucgggauucuuugaca

SEQ ID NO: 1199594 - RNA, 15 nt, Homo sapiens
uucgugacaacaugc

SEQ ID NO: 1199595 - RNA, 13 nt, Homo sapiens
uucguuccaggcc

SEQ ID NO: 1199596 - RNA, 21 nt, Homo sapiens
uucguuuuuuuaaaucacaag

SEQ ID NO: 1199597 - RNA, 17 nt, Homo sapiens
uucuaaaagagaaggaa

SEQ ID NO: 1199598 - RNA, 19 nt, Homo sapiens
uucuaaauaaggugugaaa

SEQ ID NO: 1199599 - RNA, 14 nt, Homo sapiens
uucuaaaugcauau

SEQ ID NO: 1199600 - RNA, 23 nt, Homo sapiens
uucuaagacucaaauguucuaag

SEQ ID NO: 1199601 - RNA, 21 nt, Homo sapiens
uucuaagaugugauauucuaa

SEQ ID NO: 1199602 - RNA, 17 nt, Homo sapiens
uucuaaggcucugagag

SEQ ID NO: 1199603 - RNA, 12 nt, Homo sapiens
uucuaaguauuu

SEQ ID NO: 1199604 - RNA, 18 nt, Homo sapiens
uucuaaguauuuuauucc

SEQ ID NO: 1199605 - RNA, 21 nt, Homo sapiens
uucuaaguggaaaaaguauua

SEQ ID NO: 1199606 - RNA, 21 nt, Homo sapiens
uucuaauauuuuuagcucugu

SEQ ID NO: 1199607 - RNA, 23 nt, Homo sapiens
uucuaauccuaucuggggagcuc

SEQ ID NO: 1199608 - RNA, 15 nt, Homo sapiens
uucuaaugugcauua

SEQ ID NO: 1199609 - RNA, 15 nt, Homo sapiens
uucuaauuaaccuua

SEQ ID NO: 1199610 - RNA, 17 nt, Homo sapiens
uucuaauuuuuaagcaa

SEQ ID NO: 1199611 - RNA, 22 nt, Homo sapiens
uucuacaauuucaauuucuccc

SEQ ID NO: 1199612 - RNA, 14 nt, Homo sapiens
uucuacagcagaua

SEQ ID NO: 1199613 - RNA, 17 nt, Homo sapiens
uucuacagcagcacugu

SEQ ID NO: 1199614 - RNA, 14 nt, Homo sapiens
uucuacaugacugg

SEQ ID NO: 1199615 - RNA, 18 nt, Homo sapiens
uucuacuaaaccagaaau

SEQ ID NO: 1199616 - RNA, 14 nt, Homo sapiens
uucuaggauagcua

SEQ ID NO: 1199617 - RNA, 21 nt, Homo sapiens
uucuaggcacuguaguucuaa

SEQ ID NO: 1199618 - RNA, 17 nt, Homo sapiens
uucuagguaggggccca

SEQ ID NO: 1199619 - RNA, 15 nt, Homo sapiens
uucuauaaggccaua

SEQ ID NO: 1199620 - RNA, 17 nt, Homo sapiens
uucuauaggaacauaug

SEQ ID NO: 1199621 - RNA, 14 nt, Homo sapiens
uucuauaguucuag

SEQ ID NO: 1199622 - RNA, 21 nt, Homo sapiens
uucuauaugaauuuaaauaua

SEQ ID NO: 1199623 - RNA, 17 nt, Homo sapiens
uucuaugcaaaugccuc

SEQ ID NO: 1199624 - RNA, 16 nt, Homo sapiens
uucuaugcaagccuug

SEQ ID NO: 1199625 - RNA, 15 nt, Homo sapiens
uucuauuauggaaaa

SEQ ID NO: 1199626 - RNA, 15 nt, Homo sapiens
uucuauucuaaguaa

SEQ ID NO: 1199627 - RNA, 15 nt, Homo sapiens
uucuauugacuucaa

SEQ ID NO: 1199628 - RNA, 15 nt, Homo sapiens
uucuauuuugugaau

SEQ ID NO: 1199629 - RNA, 23 nt, Homo sapiens
uucucaaaugcacaucucauggc

SEQ ID NO: 1199630 - RNA, 22 nt, Homo sapiens
uucucaagcugagauugagcag

SEQ ID NO: 1199631 - RNA, 19 nt, Homo sapiens
uucucacaaugucccuuca

SEQ ID NO: 1199632 - RNA, 15 nt, Homo sapiens
uucucacacacuggc

SEQ ID NO: 1199633 - RNA, 20 nt, Homo sapiens
uucucacacccacacaaaua

SEQ ID NO: 1199634 - RNA, 20 nt, Homo sapiens
uucucacuccuaccugguaa

SEQ ID NO: 1199635 - RNA, 19 nt, Homo sapiens
uucucagcuauuuccagag

SEQ ID NO: 1199636 - RNA, 19 nt, Homo sapiens
uucucagguguugccaaau

SEQ ID NO: 1199637 - RNA, 18 nt, Homo sapiens
uucucagugggacucuga

SEQ ID NO: 1199638 - RNA, 15 nt, Homo sapiens
uucucaucacagaag

SEQ ID NO: 1199639 - RNA, 18 nt, Homo sapiens
uucucauuuuauugcuag

SEQ ID NO: 1199640 - RNA, 20 nt, Homo sapiens
uucuccauacgcacugguau

SEQ ID NO: 1199641 - RNA, 23 nt, Homo sapiens
uucuccccgcuaaggaagauauc

SEQ ID NO: 1199642 - RNA, 19 nt, Homo sapiens
uucucccucacuccugcca

SEQ ID NO: 1199643 - RNA, 15 nt, Homo sapiens
uucuccucccagcgu

SEQ ID NO: 1199644 - RNA, 20 nt, Homo sapiens
uucucuauuagacuuuagaa

SEQ ID NO: 1199645 - RNA, 15 nt, Homo sapiens
uucucuauugcugcu

SEQ ID NO: 1199646 - RNA, 16 nt, Homo sapiens
uucucuauugcugcuc

SEQ ID NO: 1199647 - RNA, 12 nt, Homo sapiens
uucucucagaaa

SEQ ID NO: 1199648 - RNA, 23 nt, Homo sapiens
uucucucugugguggagaaccac

SEQ ID NO: 1199649 - RNA, 14 nt, Homo sapiens
uucucugaaggaca

SEQ ID NO: 1199650 - RNA, 21 nt, Homo sapiens
uucucuguauuccgauacaaa

SEQ ID NO: 1199651 - RNA, 20 nt, Homo sapiens
uucucuuaguuauugcugaa

SEQ ID NO: 1199652 - RNA, 21 nt, Homo sapiens
uucucuuccuacaugucuaca

SEQ ID NO: 1199653 - RNA, 22 nt, Homo sapiens
uucucuugacguuuacauauau

SEQ ID NO: 1199654 - RNA, 13 nt, Homo sapiens
uucucuugcuaau

SEQ ID NO: 1199655 - RNA, 17 nt, Homo sapiens
uucucuuugguguuaca

SEQ ID NO: 1199656 - RNA, 16 nt, Homo sapiens
uucugaagacugagaa

SEQ ID NO: 1199657 - RNA, 14 nt, Homo sapiens
uucugaaugcugcu

SEQ ID NO: 1199658 - RNA, 22 nt, Homo sapiens
uucugaauuauuaugucucaaa

SEQ ID NO: 1199659 - RNA, 17 nt, Homo sapiens
uucugacggcccugcaa

SEQ ID NO: 1199660 - RNA, 14 nt, Homo sapiens
uucugagccauuca

SEQ ID NO: 1199661 - RNA, 16 nt, Homo sapiens
uucugauaccacugca

SEQ ID NO: 1199662 - RNA, 18 nt, Homo sapiens
uucugaugccaauacuag

SEQ ID NO: 1199663 - RNA, 23 nt, Homo sapiens
uucugcaacaucuuaagauccac

SEQ ID NO: 1199664 - RNA, 12 nt, Homo sapiens
uucugcacugaa

SEQ ID NO: 1199665 - RNA, 19 nt, Homo sapiens
uucugcagaacuccuccaa

SEQ ID NO: 1199666 - RNA, 18 nt, Homo sapiens
uucugcauguucuaaaua

SEQ ID NO: 1199667 - RNA, 14 nt, Homo sapiens
uucugccacuccau

SEQ ID NO: 1199668 - RNA, 23 nt, Homo sapiens
uucugccuaucuucuuucacaua

SEQ ID NO: 1199669 - RNA, 21 nt, Homo sapiens
uucugccuccauucugaccau

SEQ ID NO: 1199670 - RNA, 13 nt, Homo sapiens
uucugcucacaua

SEQ ID NO: 1199671 - RNA, 22 nt, Homo sapiens
uucugcucugguuagaaaaagg

SEQ ID NO: 1199672 - RNA, 14 nt, Homo sapiens
uucuggaauguaau

SEQ ID NO: 1199673 - RNA, 23 nt, Homo sapiens
uucuggauugugguuccaugcag

SEQ ID NO: 1199674 - RNA, 14 nt, Homo sapiens
uuuaucuguucuug

SEQ ID NO: 1199675 - RNA, 18 nt, Homo sapiens
uuuaucuguuuccugaca

SEQ ID NO: 1199676 - RNA, 20 nt, Homo sapiens
uuuaucuuucgcacagcagu

SEQ ID NO: 1199677 - RNA, 23 nt, Homo sapiens
uuuauuaauuugaaaccaggaca

SEQ ID NO: 1199678 - RNA, 14 nt, Homo sapiens
uuuauuccuguaug

SEQ ID NO: 1199679 - RNA, 16 nt, Homo sapiens
uuuauugcauugcugg

SEQ ID NO: 1199680 - RNA, 21 nt, Homo sapiens
uuuauuguaaaacagcuaaau

SEQ ID NO: 1199681 - RNA, 18 nt, Homo sapiens
uuuauuuacuucuguaug

SEQ ID NO: 1199682 - RNA, 16 nt, Homo sapiens
uuuauuucugaucuau

SEQ ID NO: 1199683 - RNA, 20 nt, Homo sapiens
uuuauuuuucauauugugcc

SEQ ID NO: 1199684 - RNA, 19 nt, Homo sapiens
uuuauuuuuguagagccag

SEQ ID NO: 1199685 - RNA, 16 nt, Homo sapiens
uuucaaaaaaucugac

SEQ ID NO: 1199686 - RNA, 22 nt, Homo sapiens
uuucaaaaaaucugaccaaaac

SEQ ID NO: 1199687 - RNA, 23 nt, Homo sapiens
uuucaaagaaggaauucuaggca

SEQ ID NO: 1199688 - RNA, 21 nt, Homo sapiens
uuucaaagagguauauuugaa

SEQ ID NO: 1199689 - RNA, 14 nt, Homo sapiens
uuucaaagcuaaaa

SEQ ID NO: 1199690 - RNA, 12 nt, Homo sapiens
uuucaacaaaua

SEQ ID NO: 1199691 - RNA, 16 nt, Homo sapiens
uuucaacauaucauuu

SEQ ID NO: 1199692 - RNA, 23 nt, Homo sapiens
uuucaagaccuucuccccauucu

SEQ ID NO: 1199693 - RNA, 20 nt, Homo sapiens
uuucaaggaaaaaugcugcu

SEQ ID NO: 1199694 - RNA, 22 nt, Homo sapiens
uuucaaggaaaaaugcugcuuc

SEQ ID NO: 1199695 - RNA, 13 nt, Homo sapiens
uuucacacacaca

SEQ ID NO: 1199696 - RNA, 15 nt, Homo sapiens
uuucacacagugaaa

SEQ ID NO: 1199697 - RNA, 15 nt, Homo sapiens
uuucacagucacuga

SEQ ID NO: 1199698 - RNA, 18 nt, Homo sapiens
uuucacccauuuacacau

SEQ ID NO: 1199699 - RNA, 20 nt, Homo sapiens
uuucaccccacagacacuua

SEQ ID NO: 1199700 - RNA, 20 nt, Homo sapiens
uuucacgcaugugugcugca

SEQ ID NO: 1199701 - RNA, 23 nt, Homo sapiens
uuucacggggccgugacagugac

SEQ ID NO: 1199702 - RNA, 22 nt, Homo sapiens
uuucacuaggaaaaucaugugc

SEQ ID NO: 1199703 - RNA, 22 nt, Homo sapiens
uuucacucucaaacuucacuaa

SEQ ID NO: 1199704 - RNA, 16 nt, Homo sapiens
uuucacuuugcucuca

SEQ ID NO: 1199705 - RNA, 22 nt, Homo sapiens
uuucacuuugggauauggucuu

SEQ ID NO: 1199706 - RNA, 15 nt, Homo sapiens
uuucagaaaauauua

SEQ ID NO: 1199707 - RNA, 20 nt, Homo sapiens
uuucagagaaauacuuucag

SEQ ID NO: 1199708 - RNA, 17 nt, Homo sapiens
uuucagauaaacaacaa

SEQ ID NO: 1199709 - RNA, 18 nt, Homo sapiens
uuucagauaaacaacaaa

SEQ ID NO: 1199710 - RNA, 21 nt, Homo sapiens
uuucagaucauauuucacaau

SEQ ID NO: 1199711 - RNA, 18 nt, Homo sapiens
uuucaggaagacugacag

SEQ ID NO: 1199712 - RNA, 17 nt, Homo sapiens
uuucaggauacaugugc

SEQ ID NO: 1199713 - RNA, 22 nt, Homo sapiens
uuucaguauaauuuaacuucag

SEQ ID NO: 1199714 - RNA, 16 nt, Homo sapiens
uuucaguauacugugu

SEQ ID NO: 1199715 - RNA, 18 nt, Homo sapiens
uuucaguaucaucuccau

SEQ ID NO: 1199716 - RNA, 23 nt, Homo sapiens
uuucaguggcuaccuacauacaa

SEQ ID NO: 1199717 - RNA, 20 nt, Homo sapiens
uuucauaagaauucuguuga

SEQ ID NO: 1199718 - RNA, 19 nt, Homo sapiens
uuucauagagauuugucua

SEQ ID NO: 1199719 - RNA, 15 nt, Homo sapiens
uuucauauaaaugga

SEQ ID NO: 1199720 - RNA, 15 nt, Homo sapiens
uuucauauugaucuu

SEQ ID NO: 1199721 - RNA, 15 nt, Homo sapiens
uuucaucacacuggg

SEQ ID NO: 1199722 - RNA, 20 nt, Homo sapiens
uuucauccuauaagcuuaaa

SEQ ID NO: 1199723 - RNA, 13 nt, Homo sapiens
uuucauccuccuu

SEQ ID NO: 1199724 - RNA, 15 nt, Homo sapiens
uuucaugcgugugug

SEQ ID NO: 1199725 - RNA, 21 nt, Homo sapiens
uuucauguggcuguagauccc

SEQ ID NO: 1199726 - RNA, 13 nt, Homo sapiens
uuucauguugcaa

SEQ ID NO: 1199727 - RNA, 17 nt, Homo sapiens
uuucauuuaauggggau

SEQ ID NO: 1199728 - RNA, 17 nt, Homo sapiens
uuucauuuaucuauaau

SEQ ID NO: 1199729 - RNA, 21 nt, Homo sapiens
uuucauuugguucauuaauuc

SEQ ID NO: 1199730 - RNA, 12 nt, Homo sapiens
uuuccaaaacau

SEQ ID NO: 1199731 - RNA, 13 nt, Homo sapiens
uuuccaagcugcg

SEQ ID NO: 1199732 - RNA, 17 nt, Homo sapiens
uuuccacauuugucaca

SEQ ID NO: 1199733 - RNA, 14 nt, Homo sapiens
uuuccaccaagugu

SEQ ID NO: 1199734 - RNA, 23 nt, Homo sapiens
uuuccacgcuagggcggggcaca

SEQ ID NO: 1199735 - RNA, 20 nt, Homo sapiens
uuuccacuugcccuguucuc

SEQ ID NO: 1199736 - RNA, 19 nt, Homo sapiens
uuuccagacuuccuugaga

SEQ ID NO: 1199737 - RNA, 22 nt, Homo sapiens
uuuccaguccuuggucaguuug

SEQ ID NO: 1199738 - RNA, 16 nt, Homo sapiens
uuuccaguguuuacaa

SEQ ID NO: 1199739 - RNA, 14 nt, Homo sapiens
uuuccauagucaca

SEQ ID NO: 1199740 - RNA, 13 nt, Homo sapiens
uuuccauuuacua

SEQ ID NO: 1199741 - RNA, 17 nt, Homo sapiens
uuuccauuuaguaacag

SEQ ID NO: 1199742 - RNA, 12 nt, Homo sapiens
uuucccaaagag

SEQ ID NO: 1199743 - RNA, 16 nt, Homo sapiens
uuucccauaguuuauu

SEQ ID NO: 1199744 - RNA, 18 nt, Homo sapiens
uuuccccaccccagcuca

SEQ ID NO: 1199745 - RNA, 15 nt, Homo sapiens
uuuccccagucccag

SEQ ID NO: 1199746 - RNA, 16 nt, Homo sapiens
uuucccccgagcucuu

SEQ ID NO: 1199747 - RNA, 20 nt, Homo sapiens
uuucccccgagcucuuggcc

SEQ ID NO: 1199748 - RNA, 23 nt, Homo sapiens
uuucccccuugaggauuguggaa

SEQ ID NO: 1199749 - RNA, 23 nt, Homo sapiens
uuucccuaggaaacucacacucc

SEQ ID NO: 1199750 - RNA, 23 nt, Homo sapiens
uuucccuucccuuccacugccuc

SEQ ID NO: 1199751 - RNA, 18 nt, Homo sapiens
uuuccuaaaugcagugaa

SEQ ID NO: 1199752 - RNA, 17 nt, Homo sapiens
uuuccuacuguccucag

SEQ ID NO: 1199753 - RNA, 14 nt, Homo sapiens
uuuccucuauugau

SEQ ID NO: 1199754 - RNA, 22 nt, Homo sapiens
uuuccugaauuuccccaucugc

SEQ ID NO: 1199755 - RNA, 18 nt, Homo sapiens
uuuccugccgagugcucu

SEQ ID NO: 1199756 - RNA, 13 nt, Homo sapiens
uuuccugccuucu

SEQ ID NO: 1199757 - RNA, 12 nt, Homo sapiens
uuuccuuccaga

SEQ ID NO: 1199758 - RNA, 14 nt, Homo sapiens
uuuccuugcucaac

SEQ ID NO: 1199759 - RNA, 20 nt, Homo sapiens
uuuccuuuuacaauuguuga

SEQ ID NO: 1199760 - RNA, 13 nt, Homo sapiens
uuucgaacauucu

SEQ ID NO: 1199761 - RNA, 21 nt, Homo sapiens
uuucggaggccccacugaugc

SEQ ID NO: 1199762 - RNA, 17 nt, Homo sapiens
uuucgugcacucugcua

SEQ ID NO: 1199763 - RNA, 23 nt, Homo sapiens
uuucuaaagggaucugcuuaaag

SEQ ID NO: 1199764 - RNA, 15 nt, Homo sapiens
uuucuaccagcucau

SEQ ID NO: 1199765 - RNA, 12 nt, Homo sapiens
uuucuaccucag

SEQ ID NO: 1199766 - RNA, 18 nt, Homo sapiens
uuucuaccuugaggucuu

SEQ ID NO: 1199767 - RNA, 21 nt, Homo sapiens
uuucuagaagcacauguguau

SEQ ID NO: 1199768 - RNA, 22 nt, Homo sapiens
uuucuagaaguuucccuuccuc

SEQ ID NO: 1199769 - RNA, 20 nt, Homo sapiens
uuucuagauaccacuuaaca

SEQ ID NO: 1199770 - RNA, 17 nt, Homo sapiens
uuucuaggccacuggga

SEQ ID NO: 1199771 - RNA, 20 nt, Homo sapiens
uuucuaggguaaugccguag

SEQ ID NO: 1199772 - RNA, 21 nt, Homo sapiens
uuucuaguuucuugugggcua

SEQ ID NO: 1199773 - RNA, 13 nt, Homo sapiens
uuucuauauucuc

SEQ ID NO: 1199774 - RNA, 15 nt, Homo sapiens
uuucucaaaagcauu

SEQ ID NO: 1199775 - RNA, 12 nt, Homo sapiens
uuucucacugaa

SEQ ID NO: 1199776 - RNA, 23 nt, Homo sapiens
uuucucagauguugaaacuuuga

SEQ ID NO: 1199777 - RNA, 13 nt, Homo sapiens
uuucucauuaaau

SEQ ID NO: 1199778 - RNA, 18 nt, Homo sapiens
uuucucgggugcauuuga

SEQ ID NO: 1199779 - RNA, 23 nt, Homo sapiens
uuucucuccagcgguccaaaguu

SEQ ID NO: 1199780 - RNA, 19 nt, Homo sapiens
uuucucuguuguaagaaua

SEQ ID NO: 1199781 - RNA, 14 nt, Homo sapiens
uuucucuuaugcuu

SEQ ID NO: 1199782 - RNA, 14 nt, Homo sapiens
uuucugaguuucau

SEQ ID NO: 1199783 - RNA, 18 nt, Homo sapiens
uuucugauuacuguccag

SEQ ID NO: 1199784 - RNA, 17 nt, Homo sapiens
uuucugcaaacaccaac

SEQ ID NO: 1199785 - RNA, 13 nt, Homo sapiens
uuucugccuaucu

SEQ ID NO: 1199786 - RNA, 22 nt, Homo sapiens
uuucuggaugaaugcccaguga

SEQ ID NO: 1199787 - RNA, 23 nt, Homo sapiens
uuucuggaugaaugcccagugag

SEQ ID NO: 1199788 - RNA, 15 nt, Homo sapiens
uuucuggcucuccca

SEQ ID NO: 1199789 - RNA, 22 nt, Homo sapiens
uuucugggagcagaaacagcca

SEQ ID NO: 1199790 - RNA, 21 nt, Homo sapiens
uuucugggucuuuugcuacua

SEQ ID NO: 1199791 - RNA, 18 nt, Homo sapiens
uuucugguucugaugcca

SEQ ID NO: 1199792 - RNA, 13 nt, Homo sapiens
uuucuguaaacuc

SEQ ID NO: 1199793 - RNA, 11 nt, Homo sapiens
uuucugucaag

SEQ ID NO: 1199794 - RNA, 18 nt, Homo sapiens
uuucuguucccuugccau

SEQ ID NO: 1199795 - RNA, 18 nt, Homo sapiens
uuucuuacccauauaucu

SEQ ID NO: 1199796 - RNA, 13 nt, Homo sapiens
uuucuugcuuuca

SEQ ID NO: 1199797 - RNA, 22 nt, Homo sapiens
uuucuuuaauaguuuugauccu

SEQ ID NO: 1199798 - RNA, 15 nt, Homo sapiens
uuucuuuacuccauc

SEQ ID NO: 1199799 - RNA, 14 nt, Homo sapiens
uugaagaaaagcac

SEQ ID NO: 1199800 - RNA, 14 nt, Homo sapiens
uugaagcagauuuc

SEQ ID NO: 1199801 - RNA, 16 nt, Homo sapiens
uugaagcugacucaaa

SEQ ID NO: 1199802 - RNA, 15 nt, Homo sapiens
uugaaguagcucuuu

SEQ ID NO: 1199803 - RNA, 19 nt, Homo sapiens
uugaauauagccugccuca

SEQ ID NO: 1199804 - RNA, 15 nt, Homo sapiens
uugaauauuacuccu

SEQ ID NO: 1199805 - RNA, 21 nt, Homo sapiens
uugaauauuagcauugccaau

SEQ ID NO: 1199806 - RNA, 20 nt, Homo sapiens
uugaaucuacaaaaaacaac

SEQ ID NO: 1199807 - RNA, 22 nt, Homo sapiens
uugaaugaaaaauuuaagcauu

SEQ ID NO: 1199808 - RNA, 22 nt, Homo sapiens
uugaaugaaucaacaaaccaca

SEQ ID NO: 1199809 - RNA, 19 nt, Homo sapiens
uugaauggaaaacacaugg

SEQ ID NO: 1199810 - RNA, 22 nt, Homo sapiens
uugaauggaaaacacauggugu

SEQ ID NO: 1199811 - RNA, 15 nt, Homo sapiens
uugaauggguuugcu

SEQ ID NO: 1199812 - RNA, 17 nt, Homo sapiens
uugaauguccuuuuaug

SEQ ID NO: 1199813 - RNA, 19 nt, Homo sapiens
uugacaccaaccagacagc

SEQ ID NO: 1199814 - RNA, 11 nt, Homo sapiens
uugacaccugc

SEQ ID NO: 1199815 - RNA, 17 nt, Homo sapiens
uugacacuuguugucca

SEQ ID NO: 1199816 - RNA, 14 nt, Homo sapiens
uugacauaacacua

SEQ ID NO: 1199817 - RNA, 11 nt, Homo sapiens
uugacaucucu

SEQ ID NO: 1199818 - RNA, 13 nt, Homo sapiens
uugacaugugcaa

SEQ ID NO: 1199819 - RNA, 11 nt, Homo sapiens
uugaccaaaga

SEQ ID NO: 1199820 - RNA, 21 nt, Homo sapiens
uugaccucuauaaacuucaga

SEQ ID NO: 1199821 - RNA, 22 nt, Homo sapiens
uugacuagaugauggaugccaa

SEQ ID NO: 1199822 - RNA, 22 nt, Homo sapiens
uugacuagggauucaggcugcu

SEQ ID NO: 1199823 - RNA, 20 nt, Homo sapiens
uugacuucuuugagaaugca

SEQ ID NO: 1199824 - RNA, 20 nt, Homo sapiens
uugagaaccagucuccucac

SEQ ID NO: 1199825 - RNA, 14 nt, Homo sapiens
uugagaaucccaaa

SEQ ID NO: 1199826 - RNA, 12 nt, Homo sapiens
uugagaaugagu

SEQ ID NO: 1199827 - RNA, 17 nt, Homo sapiens
uugagacaggaugguua

SEQ ID NO: 1199828 - RNA, 12 nt, Homo sapiens
uugagacauuua

SEQ ID NO: 1199829 - RNA, 13 nt, Homo sapiens
uugagauggaguu

SEQ ID NO: 1199830 - RNA, 22 nt, Homo sapiens
uugagauguugaaauuacauua

SEQ ID NO: 1199831 - RNA, 22 nt, Homo sapiens
uugagcaguggcugguccaggg

SEQ ID NO: 1199832 - RNA, 18 nt, Homo sapiens
uugagcccacaaagccuu

SEQ ID NO: 1199833 - RNA, 22 nt, Homo sapiens
uugaggaaguggcugucccugu

SEQ ID NO: 1199834 - RNA, 18 nt, Homo sapiens
uugaggaauaaaugccuu

SEQ ID NO: 1199835 - RNA, 19 nt, Homo sapiens
uugaggaauaaaugccuuu

SEQ ID NO: 1199836 - RNA, 20 nt, Homo sapiens
uugaggcaaauuaacuguau

SEQ ID NO: 1199837 - RNA, 14 nt, Homo sapiens
uugaggcaggagga

SEQ ID NO: 1199838 - RNA, 19 nt, Homo sapiens
uugagggauugucacggga

SEQ ID NO: 1199839 - RNA, 19 nt, Homo sapiens
uugaggggcuggccuuccu

SEQ ID NO: 1199840 - RNA, 15 nt, Homo sapiens
uugagggguggaccc

SEQ ID NO: 1199841 - RNA, 23 nt, Homo sapiens
uugaggucaaguaagaagacaug

SEQ ID NO: 1199842 - RNA, 19 nt, Homo sapiens
uugagucagaaaacagaga

SEQ ID NO: 1199843 - RNA, 12 nt, Homo sapiens
uugauaccaugg

SEQ ID NO: 1199844 - RNA, 16 nt, Homo sapiens
uugauaccauggcacu

SEQ ID NO: 1199845 - RNA, 18 nt, Homo sapiens
uugauaccauggcacuga

SEQ ID NO: 1199846 - RNA, 19 nt, Homo sapiens
uugauaccauggcacugac

SEQ ID NO: 1199847 - RNA, 20 nt, Homo sapiens
uugauaucucgaacuuucaa

SEQ ID NO: 1199848 - RNA, 19 nt, Homo sapiens
uugauauuuauuuuuugcc

SEQ ID NO: 1199849 - RNA, 21 nt, Homo sapiens
uugauauuuauuuuuugccau

SEQ ID NO: 1199850 - RNA, 17 nt, Homo sapiens
uugaucaaaucuaaugu

SEQ ID NO: 1199851 - RNA, 14 nt, Homo sapiens
uugaucacuacaag

SEQ ID NO: 1199852 - RNA, 20 nt, Homo sapiens
uugaucccuguuacccagag

SEQ ID NO: 1199853 - RNA, 17 nt, Homo sapiens
uugauccugggggacca

SEQ ID NO: 1199854 - RNA, 16 nt, Homo sapiens
uugaugaaaagauuua

SEQ ID NO: 1199855 - RNA, 18 nt, Homo sapiens
uugaugauaaacacugag

SEQ ID NO: 1199856 - RNA, 15 nt, Homo sapiens
uugaugcauguuacu

SEQ ID NO: 1199857 - RNA, 12 nt, Homo sapiens
uugaugccauau

SEQ ID NO: 1199858 - RNA, 15 nt, Homo sapiens
uugaugccauaugcc

SEQ ID NO: 1199859 - RNA, 21 nt, Homo sapiens
uugauggcuccgaacacccuc

SEQ ID NO: 1199860 - RNA, 12 nt, Homo sapiens
uugauggugaua

SEQ ID NO: 1199861 - RNA, 13 nt, Homo sapiens
uugauguaucuga

SEQ ID NO: 1199862 - RNA, 17 nt, Homo sapiens
uugaugugaaacauuau

SEQ ID NO: 1199863 - RNA, 23 nt, Homo sapiens
uugauguuuguuugcaugauguc

SEQ ID NO: 1199864 - RNA, 22 nt, Homo sapiens
uugauugggaaaacauuugcug

SEQ ID NO: 1199865 - RNA, 14 nt, Homo sapiens
uugauuucacugga

SEQ ID NO: 1199866 - RNA, 15 nt, Homo sapiens
uugauuucauuaaua

SEQ ID NO: 1199867 - RNA, 21 nt, Homo sapiens
uugcaaagguuccaacuguau

SEQ ID NO: 1199868 - RNA, 16 nt, Homo sapiens
uugcaaauacauggau

SEQ ID NO: 1199869 - RNA, 22 nt, Homo sapiens
uugcaaaucuaaaguugcucca

SEQ ID NO: 1199870 - RNA, 22 nt, Homo sapiens
uugcaacucacugauucucuac

SEQ ID NO: 1199871 - RNA, 19 nt, Homo sapiens
uugcaaugcaugauacuau

SEQ ID NO: 1199872 - RNA, 14 nt, Homo sapiens
uugcaauguaguca

SEQ ID NO: 1199873 - RNA, 23 nt, Homo sapiens
uugcaauuaggauuuugauguga

SEQ ID NO: 1199874 - RNA, 18 nt, Homo sapiens
uugcacaaauugggccaa

SEQ ID NO: 1199875 - RNA, 22 nt, Homo sapiens
uugcacaaguucccuggagaaa

SEQ ID NO: 1199876 - RNA, 14 nt, Homo sapiens
uugcacagcagcaa

SEQ ID NO: 1199877 - RNA, 18 nt, Homo sapiens
uugcacagcuagcaauug

SEQ ID NO: 1199878 - RNA, 22 nt, Homo sapiens
uugcaccccaaagcuuuccugc

SEQ ID NO: 1199879 - RNA, 16 nt, Homo sapiens
uugcaccucuguucau

SEQ ID NO: 1199880 - RNA, 16 nt, Homo sapiens
uugcacuauuuccaca

SEQ ID NO: 1199881 - RNA, 18 nt, Homo sapiens
uugcagaaaauucugugc

SEQ ID NO: 1199882 - RNA, 14 nt, Homo sapiens
uugcagacaggcaa

SEQ ID NO: 1199883 - RNA, 23 nt, Homo sapiens
uugcagacgggcaagaagcugcu

SEQ ID NO: 1199884 - RNA, 22 nt, Homo sapiens
uugcagagaagcauccuccaca

SEQ ID NO: 1199885 - RNA, 20 nt, Homo sapiens
uugcagcuggacuucuccac

SEQ ID NO: 1199886 - RNA, 18 nt, Homo sapiens
uugcaggugaacagccuc

SEQ ID NO: 1199887 - RNA, 23 nt, Homo sapiens
uugcagguggggguugcuguaua

SEQ ID NO: 1199888 - RNA, 20 nt, Homo sapiens
uugcauaguaccaaucauuu

SEQ ID NO: 1199889 - RNA, 14 nt, Homo sapiens
uugcaucagugauc

SEQ ID NO: 1199890 - RNA, 13 nt, Homo sapiens
uugcauccauugu

SEQ ID NO: 1199891 - RNA, 14 nt, Homo sapiens
uugcauccauuguu

SEQ ID NO: 1199892 - RNA, 15 nt, Homo sapiens
uugcaucuuuucuac

SEQ ID NO: 1199893 - RNA, 17 nt, Homo sapiens
uugcaugacuuggacac

SEQ ID NO: 1199894 - RNA, 21 nt, Homo sapiens
uugcaugacuuguagcauauu

SEQ ID NO: 1199895 - RNA, 18 nt, Homo sapiens
uugcaugaugucuaccuc

SEQ ID NO: 1199896 - RNA, 20 nt, Homo sapiens
uugcaugaugucuaccucag

SEQ ID NO: 1199897 - RNA, 12 nt, Homo sapiens
uugcaugcaugc

SEQ ID NO: 1199898 - RNA, 17 nt, Homo sapiens
uugcauguggccauuac

SEQ ID NO: 1199899 - RNA, 14 nt, Homo sapiens
uugcauuaauauug

SEQ ID NO: 1199900 - RNA, 15 nt, Homo sapiens
uugcauugacuguca

SEQ ID NO: 1199901 - RNA, 21 nt, Homo sapiens
uugcauuuugauaaaauuaau

SEQ ID NO: 1199902 - RNA, 18 nt, Homo sapiens
uugccaagaaaaugaagg

SEQ ID NO: 1199903 - RNA, 16 nt, Homo sapiens
uugccacaacccuguu

SEQ ID NO: 1199904 - RNA, 13 nt, Homo sapiens
uugccacauuuag

SEQ ID NO: 1199905 - RNA, 17 nt, Homo sapiens
uugccaggacaugcaau

SEQ ID NO: 1199906 - RNA, 15 nt, Homo sapiens
uugccauaaagucaa

SEQ ID NO: 1199907 - RNA, 16 nt, Homo sapiens
uugccaugugugcuga

SEQ ID NO: 1199908 - RNA, 17 nt, Homo sapiens
uugcccagacuacaggg

SEQ ID NO: 1199909 - RNA, 19 nt, Homo sapiens
uuccauaaucuggacuccu

SEQ ID NO: 1199910 - RNA, 17 nt, Homo sapiens
uuccauauguuauauca

SEQ ID NO: 1199911 - RNA, 22 nt, Homo sapiens
uuccauauuuaaccuauuucca

SEQ ID NO: 1199912 - RNA, 16 nt, Homo sapiens
uuccaucucugacuua

SEQ ID NO: 1199913 - RNA, 16 nt, Homo sapiens
uuccaugaguuaucau

SEQ ID NO: 1199914 - RNA, 14 nt, Homo sapiens
uuccaugauucuau

SEQ ID NO: 1199915 - RNA, 16 nt, Homo sapiens
uuccauuaugauucuu

SEQ ID NO: 1199916 - RNA, 22 nt, Homo sapiens
uuccauugaagccgacucuggc

SEQ ID NO: 1199917 - RNA, 13 nt, Homo sapiens
uuccauugauuca

SEQ ID NO: 1199918 - RNA, 13 nt, Homo sapiens
uuccauugccaua

SEQ ID NO: 1199919 - RNA, 17 nt, Homo sapiens
uuccauuuacagucucu

SEQ ID NO: 1199920 - RNA, 18 nt, Homo sapiens
uucccaaaagauugcuga

SEQ ID NO: 1199921 - RNA, 20 nt, Homo sapiens
uucccaacuagacauuacca

SEQ ID NO: 1199922 - RNA, 14 nt, Homo sapiens
uucccacaccuguc

SEQ ID NO: 1199923 - RNA, 19 nt, Homo sapiens
uucccaucgcugucacagg

SEQ ID NO: 1199924 - RNA, 17 nt, Homo sapiens
uucccaucugcaccccu

SEQ ID NO: 1199925 - RNA, 17 nt, Homo sapiens
uucccauuugugccaga

SEQ ID NO: 1199926 - RNA, 14 nt, Homo sapiens
uucccccacuacuu

SEQ ID NO: 1199927 - RNA, 15 nt, Homo sapiens
uuccccccauguugu

SEQ ID NO: 1199928 - RNA, 20 nt, Homo sapiens
uucccccgagcucuuggccu

SEQ ID NO: 1199929 - RNA, 19 nt, Homo sapiens
uuccccuuuucccaaccug

SEQ ID NO: 1199930 - RNA, 19 nt, Homo sapiens
uucccuaaaauacauuuaa

SEQ ID NO: 1199931 - RNA, 20 nt, Homo sapiens
uucccuaaagugaugggcuu

SEQ ID NO: 1199932 - RNA, 18 nt, Homo sapiens
uucccuaggaaacucaca

SEQ ID NO: 1199933 - RNA, 23 nt, Homo sapiens
uucccuaggaaacucacacuccc

SEQ ID NO: 1199934 - RNA, 20 nt, Homo sapiens
uucccuauggguucugugac

SEQ ID NO: 1199935 - RNA, 16 nt, Homo sapiens
uucccucccaguuuuc

SEQ ID NO: 1199936 - RNA, 22 nt, Homo sapiens
uucccucucccggcaacaucuc

SEQ ID NO: 1199937 - RNA, 21 nt, Homo sapiens
uucccucuuggugugauugca

SEQ ID NO: 1199938 - RNA, 23 nt, Homo sapiens
uucccucuuggugugauugcaca

SEQ ID NO: 1199939 - RNA, 18 nt, Homo sapiens
uucccugauugaccugcu

SEQ ID NO: 1199940 - RNA, 14 nt, Homo sapiens
uucccuguucuccc

SEQ ID NO: 1199941 - RNA, 18 nt, Homo sapiens
uucccuucaacaugaaaa

SEQ ID NO: 1199942 - RNA, 14 nt, Homo sapiens
uucccuucuugcau

SEQ ID NO: 1199943 - RNA, 13 nt, Homo sapiens
uucccuugccauc

SEQ ID NO: 1199944 - RNA, 18 nt, Homo sapiens
uucccuugccaucacacu

SEQ ID NO: 1199945 - RNA, 14 nt, Homo sapiens
uucccuugcuggaa

SEQ ID NO: 1199946 - RNA, 18 nt, Homo sapiens
uuccggcacacugccaaa

SEQ ID NO: 1199947 - RNA, 19 nt, Homo sapiens
uuccguuuuagaaaaggaa

SEQ ID NO: 1199948 - RNA, 21 nt, Homo sapiens
uuccuaaagccaucaugccuu

SEQ ID NO: 1199949 - RNA, 12 nt, Homo sapiens
uuccuaacauaa

SEQ ID NO: 1199950 - RNA, 17 nt, Homo sapiens
uuccuaacuagaauuag

SEQ ID NO: 1199951 - RNA, 18 nt, Homo sapiens
uuccuaguaaauuuaauu

SEQ ID NO: 1199952 - RNA, 21 nt, Homo sapiens
uuccuauaauuuuagacauuc

SEQ ID NO: 1199953 - RNA, 20 nt, Homo sapiens
uuccuauggcuggccacugc

SEQ ID NO: 1199954 - RNA, 22 nt, Homo sapiens
uuccuauuacacggagugugcu

SEQ ID NO: 1199955 - RNA, 19 nt, Homo sapiens
uuccucaugaaucucucaa

SEQ ID NO: 1199956 - RNA, 13 nt, Homo sapiens
uuccucauguaac

SEQ ID NO: 1199957 - RNA, 21 nt, Homo sapiens
uuccuccgaggccaguaccuu

SEQ ID NO: 1199958 - RNA, 14 nt, Homo sapiens
uuccuccugcagac

SEQ ID NO: 1199959 - RNA, 20 nt, Homo sapiens
uuccucggcagucacuucca

SEQ ID NO: 1199960 - RNA, 14 nt, Homo sapiens
uuccucuugccucu

SEQ ID NO: 1199961 - RNA, 19 nt, Homo sapiens
uuccugaaaauugcaauac

SEQ ID NO: 1199962 - RNA, 19 nt, Homo sapiens
uuccugaauuggaaaggaa

SEQ ID NO: 1199963 - RNA, 13 nt, Homo sapiens
uuccugagaccuc

SEQ ID NO: 1199964 - RNA, 20 nt, Homo sapiens
uuccugauauaucaaacuga

SEQ ID NO: 1199965 - RNA, 19 nt, Homo sapiens
uuccugcugccauccucac

SEQ ID NO: 1199966 - RNA, 15 nt, Homo sapiens
uuccuggaaacagca

SEQ ID NO: 1199967 - RNA, 19 nt, Homo sapiens
uuccuggaguacaaacaca

SEQ ID NO: 1199968 - RNA, 20 nt, Homo sapiens
uuccuggcuccaacacugcu

SEQ ID NO: 1199969 - RNA, 13 nt, Homo sapiens
uuccugggaacau

SEQ ID NO: 1199970 - RNA, 15 nt, Homo sapiens
uuccuggguauuuau

SEQ ID NO: 1199971 - RNA, 15 nt, Homo sapiens
uuccuggguuuccug

SEQ ID NO: 1199972 - RNA, 16 nt, Homo sapiens
uuccuggugacuccug

SEQ ID NO: 1199973 - RNA, 11 nt, Homo sapiens
uuccugugauc

SEQ ID NO: 1199974 - RNA, 13 nt, Homo sapiens
uuccugugaucca

SEQ ID NO: 1199975 - RNA, 22 nt, Homo sapiens
uuccuguggggggaaguccaug

SEQ ID NO: 1199976 - RNA, 23 nt, Homo sapiens
uuccuguugauguucagaaugga

SEQ ID NO: 1199977 - RNA, 14 nt, Homo sapiens
uuccuuaaagcauu

SEQ ID NO: 1199978 - RNA, 13 nt, Homo sapiens
uuccuuaagccag

SEQ ID NO: 1199979 - RNA, 15 nt, Homo sapiens
uuccuuaucugucac

SEQ ID NO: 1199980 - RNA, 21 nt, Homo sapiens
uuccuuauuaauacaaacaca

SEQ ID NO: 1199981 - RNA, 21 nt, Homo sapiens
uuccuucaagaggaccaaaug

SEQ ID NO: 1199982 - RNA, 15 nt, Homo sapiens
uuccuuccacaguua

SEQ ID NO: 1199983 - RNA, 16 nt, Homo sapiens
uuccuucccugggaag

SEQ ID NO: 1199984 - RNA, 19 nt, Homo sapiens
uuccuugacuucuuugaga

SEQ ID NO: 1199985 - RNA, 21 nt, Homo sapiens
uuccuuuaugaugacugcuua

SEQ ID NO: 1199986 - RNA, 18 nt, Homo sapiens
uuccuuucuacaauuuca

SEQ ID NO: 1199987 - RNA, 16 nt, Homo sapiens
uuccuuugccaauuca

SEQ ID NO: 1199988 - RNA, 16 nt, Homo sapiens
uuccuuuguugcacaa

SEQ ID NO: 1199989 - RNA, 20 nt, Homo sapiens
uuccuuuuaaaacacuucca

SEQ ID NO: 1199990 - RNA, 19 nt, Homo sapiens
uuccuuuuggaacauuucu

SEQ ID NO: 1199991 - RNA, 19 nt, Homo sapiens
uucgagaccagccugacca

SEQ ID NO: 1199992 - RNA, 18 nt, Homo sapiens
uucgaggacuacaaccaa

SEQ ID NO: 1199993 - RNA, 23 nt, Homo sapiens
uucgauacaccgggccuggagaa

SEQ ID NO: 1199994 - RNA, 21 nt, Homo sapiens
uucgcaccuaccaucagggac

SEQ ID NO: 1199995 - RNA, 15 nt, Homo sapiens
uucgcccaccucagc

SEQ ID NO: 1199996 - RNA, 20 nt, Homo sapiens
uucggacaugcuuuucugcc

SEQ ID NO: 1199997 - RNA, 12 nt, Homo sapiens
uucggccuccau

SEQ ID NO: 1199998 - RNA, 15 nt, Homo sapiens
uucggguuggcaaaa

SEQ ID NO: 1199999 - RNA, 13 nt, Homo sapiens
uucguaguuuuca

SEQ ID NO: 1200000 - RNA, 17 nt, Homo sapiens
uucuaaaggcuugauau

SEQ ID NO: 1200001 - RNA, 21 nt, Homo sapiens
uucuaacuagaaaucugccaa

SEQ ID NO: 1200002 - RNA, 13 nt, Homo sapiens
uucuaagauucua

SEQ ID NO: 1200003 - RNA, 14 nt, Homo sapiens
uucuaagauucuaa

SEQ ID NO: 1200004 - RNA, 18 nt, Homo sapiens
uucuaaggaaugcacaaa

SEQ ID NO: 1200005 - RNA, 19 nt, Homo sapiens
uucuaaggaaugcacaaau

SEQ ID NO: 1200006 - RNA, 22 nt, Homo sapiens
uucuaaggaaugcacaaauuga

SEQ ID NO: 1200007 - RNA, 21 nt, Homo sapiens
uucuaaggccuaggauucuaa

SEQ ID NO: 1200008 - RNA, 23 nt, Homo sapiens
uucuaagguccgguguucuaaga

SEQ ID NO: 1200009 - RNA, 16 nt, Homo sapiens
uucuaaguuucuaaga

SEQ ID NO: 1200010 - RNA, 17 nt, Homo sapiens
uucuaaguuucuaagau

SEQ ID NO: 1200011 - RNA, 20 nt, Homo sapiens
uucuaauaaauauacuauga

SEQ ID NO: 1200012 - RNA, 16 nt, Homo sapiens
uucuaaugugcauuaa

SEQ ID NO: 1200013 - RNA, 19 nt, Homo sapiens
uucuaauuucaaaaauaua

SEQ ID NO: 1200014 - RNA, 11 nt, Homo sapiens
uucuaccucag

SEQ ID NO: 1200015 - RNA, 15 nt, Homo sapiens
uucuagaaacaaaca

SEQ ID NO: 1200016 - RNA, 11 nt, Homo sapiens
uucuaggcauc

SEQ ID NO: 1200017 - RNA, 16 nt, Homo sapiens
uucuaggccacuggga

SEQ ID NO: 1200018 - RNA, 14 nt, Homo sapiens
uucuaggcuaccag

SEQ ID NO: 1200019 - RNA, 16 nt, Homo sapiens
uucuaggcucacugca

SEQ ID NO: 1200020 - RNA, 21 nt, Homo sapiens
gcacauauccaggcaccagga

SEQ ID NO: 1200021 - RNA, 22 nt, Homo sapiens
gcacauauccaggcaccaggac

SEQ ID NO: 1200022 - RNA, 12 nt, Homo sapiens
gcacaugcacac

SEQ ID NO: 1200023 - RNA, 16 nt, Homo sapiens
gcacaugcgcacucuc

SEQ ID NO: 1200024 - RNA, 20 nt, Homo sapiens
gcacauguaauaaauucaaa

SEQ ID NO: 1200025 - RNA, 15 nt, Homo sapiens
gcacaugucuuguac

SEQ ID NO: 1200026 - RNA, 13 nt, Homo sapiens
gcacauuucugga

SEQ ID NO: 1200027 - RNA, 23 nt, Homo sapiens
gcaccaaagacaucagucuccaa

SEQ ID NO: 1200028 - RNA, 21 nt, Homo sapiens
gcaccaaugcccagcagggga

SEQ ID NO: 1200029 - RNA, 16 nt, Homo sapiens
gcaccaccaagccaag

SEQ ID NO: 1200030 - RNA, 16 nt, Homo sapiens
gcaccacugcacucca

SEQ ID NO: 1200031 - RNA, 12 nt, Homo sapiens
gcaccacuuuuu

SEQ ID NO: 1200032 - RNA, 19 nt, Homo sapiens
gcaccagagcaaccucuca

SEQ ID NO: 1200033 - RNA, 16 nt, Homo sapiens
gcaccaggagaggaca

SEQ ID NO: 1200034 - RNA, 18 nt, Homo sapiens
gcaccagugugacaucua

SEQ ID NO: 1200035 - RNA, 22 nt, Homo sapiens
gcaccaucuggaaggacaucua

SEQ ID NO: 1200036 - RNA, 13 nt, Homo sapiens
gcaccauucugac

SEQ ID NO: 1200037 - RNA, 20 nt, Homo sapiens
gcacccaacuacugagcuga

SEQ ID NO: 1200038 - RNA, 17 nt, Homo sapiens
gcacccagcuccagggg

SEQ ID NO: 1200039 - RNA, 22 nt, Homo sapiens
gcacccaggacuuccauuugcu

SEQ ID NO: 1200040 - RNA, 17 nt, Homo sapiens
gcacccccacccaccuc

SEQ ID NO: 1200041 - RNA, 17 nt, Homo sapiens
gcaccccccaagcuguu

SEQ ID NO: 1200042 - RNA, 13 nt, Homo sapiens
gcacccuacaggg

SEQ ID NO: 1200043 - RNA, 16 nt, Homo sapiens
gcacccuggacaaaga

SEQ ID NO: 1200044 - RNA, 21 nt, Homo sapiens
gcacccuggauugaucggagc

SEQ ID NO: 1200045 - RNA, 17 nt, Homo sapiens
gcacccuucuuuccucu

SEQ ID NO: 1200046 - RNA, 13 nt, Homo sapiens
gcaccgagaccaa

SEQ ID NO: 1200047 - RNA, 20 nt, Homo sapiens
gcaccgaguggccauggcau

SEQ ID NO: 1200048 - RNA, 19 nt, Homo sapiens
gcaccuacacucaccugca

SEQ ID NO: 1200049 - RNA, 18 nt, Homo sapiens
gcaccuaccaucagggac

SEQ ID NO: 1200050 - RNA, 21 nt, Homo sapiens
gcaccuaccuuagaaaacaag

SEQ ID NO: 1200051 - RNA, 21 nt, Homo sapiens
gcaccucacaggccccaggaa

SEQ ID NO: 1200052 - RNA, 20 nt, Homo sapiens
gcaccucggggacaccagag

SEQ ID NO: 1200053 - RNA, 13 nt, Homo sapiens
gcaccugaccaca

SEQ ID NO: 1200054 - RNA, 17 nt, Homo sapiens
gcaccugcaugugcugu

SEQ ID NO: 1200055 - RNA, 17 nt, Homo sapiens
gcaccuguaaagugccu

SEQ ID NO: 1200056 - RNA, 17 nt, Homo sapiens
gcaccuucacucuccag

SEQ ID NO: 1200057 - RNA, 17 nt, Homo sapiens
gcaccuucuuucuggac

SEQ ID NO: 1200058 - RNA, 17 nt, Homo sapiens
gcaccuuugcacaggau

SEQ ID NO: 1200059 - RNA, 21 nt, Homo sapiens
gcacgcccuacuccacugccc

SEQ ID NO: 1200060 - RNA, 23 nt, Homo sapiens
gcacggagccgcgggacagccaa

SEQ ID NO: 1200061 - RNA, 22 nt, Homo sapiens
gcacuaccauagcuacaucagu

SEQ ID NO: 1200062 - RNA, 20 nt, Homo sapiens
gcacuaccugaacauuguaa

SEQ ID NO: 1200063 - RNA, 21 nt, Homo sapiens
gcacuauaauguaagcucuac

SEQ ID NO: 1200064 - RNA, 15 nt, Homo sapiens
gcacucauggguaau

SEQ ID NO: 1200065 - RNA, 20 nt, Homo sapiens
gcacucuaaaagguucaggg

SEQ ID NO: 1200066 - RNA, 16 nt, Homo sapiens
gcacugaucacccaau

SEQ ID NO: 1200067 - RNA, 12 nt, Homo sapiens
gcacugggauga

SEQ ID NO: 1200068 - RNA, 19 nt, Homo sapiens
gcacuggggccacccagcc

SEQ ID NO: 1200069 - RNA, 15 nt, Homo sapiens
gcacugucacuuugc

SEQ ID NO: 1200070 - RNA, 12 nt, Homo sapiens
gcacugugcuaa

SEQ ID NO: 1200071 - RNA, 14 nt, Homo sapiens
gcacugugcuaaua

SEQ ID NO: 1200072 - RNA, 21 nt, Homo sapiens
gcacuguggcucugcaugaca

SEQ ID NO: 1200073 - RNA, 15 nt, Homo sapiens
gcacuuagcccaaga

SEQ ID NO: 1200074 - RNA, 16 nt, Homo sapiens
gcacuuauguacuuga

SEQ ID NO: 1200075 - RNA, 17 nt, Homo sapiens
gcacuuauguacuugau

SEQ ID NO: 1200076 - RNA, 14 nt, Homo sapiens
gcacuucacagcug

SEQ ID NO: 1200077 - RNA, 14 nt, Homo sapiens
gcacuucagaauuc

SEQ ID NO: 1200078 - RNA, 14 nt, Homo sapiens
gcacuuucuucucu

SEQ ID NO: 1200079 - RNA, 21 nt, Homo sapiens
gcacuuugaaggggccucacc

SEQ ID NO: 1200080 - RNA, 12 nt, Homo sapiens
gcacuuuggaca

SEQ ID NO: 1200081 - RNA, 13 nt, Homo sapiens
gcacuuuggacau

SEQ ID NO: 1200082 - RNA, 20 nt, Homo sapiens
gcacuuuuguuauuccauca

SEQ ID NO: 1200083 - RNA, 15 nt, Homo sapiens
gcagaaaaacucugg

SEQ ID NO: 1200084 - RNA, 15 nt, Homo sapiens
gcagaaacacacagu

SEQ ID NO: 1200085 - RNA, 13 nt, Homo sapiens
gcagaaagccaca

SEQ ID NO: 1200086 - RNA, 17 nt, Homo sapiens
gcagaaaggguuccaaa

SEQ ID NO: 1200087 - RNA, 23 nt, Homo sapiens
gcagaaauuuaucuuucaaagag

SEQ ID NO: 1200088 - RNA, 13 nt, Homo sapiens
gcagaacugccau

SEQ ID NO: 1200089 - RNA, 13 nt, Homo sapiens
gcagaagaagcug

SEQ ID NO: 1200090 - RNA, 17 nt, Homo sapiens
gcagaagagaaaagcug

SEQ ID NO: 1200091 - RNA, 16 nt, Homo sapiens
uagagugucucagggu

SEQ ID NO: 1200092 - RNA, 17 nt, Homo sapiens
uagagugucucagggug

SEQ ID NO: 1200093 - RNA, 14 nt, Homo sapiens
uagaguugggacaa

SEQ ID NO: 1200094 - RNA, 22 nt, Homo sapiens
uagauaaaaaccugaacuuuca

SEQ ID NO: 1200095 - RNA, 15 nt, Homo sapiens
uagauaccacuuaac

SEQ ID NO: 1200096 - RNA, 22 nt, Homo sapiens
uagauacucauuagugacuuca

SEQ ID NO: 1200097 - RNA, 15 nt, Homo sapiens
uagauauaugcucug

SEQ ID NO: 1200098 - RNA, 19 nt, Homo sapiens
uagauauugcuacuauaau

SEQ ID NO: 1200099 - RNA, 16 nt, Homo sapiens
uagaucagaagacuac

SEQ ID NO: 1200100 - RNA, 13 nt, Homo sapiens
uagaucuuauauu

SEQ ID NO: 1200101 - RNA, 19 nt, Homo sapiens
uagaugaagaagcuagaaa

SEQ ID NO: 1200102 - RNA, 23 nt, Homo sapiens
uagaugauaaagagacagugaua

SEQ ID NO: 1200103 - RNA, 18 nt, Homo sapiens
uagaugcacuuaugcagu

SEQ ID NO: 1200104 - RNA, 14 nt, Homo sapiens
uagaugccugugaa

SEQ ID NO: 1200105 - RNA, 15 nt, Homo sapiens
uagauguaacauucc

SEQ ID NO: 1200106 - RNA, 17 nt, Homo sapiens
uagauguauauauuucc

SEQ ID NO: 1200107 - RNA, 18 nt, Homo sapiens
uagauuaauggcacugau

SEQ ID NO: 1200108 - RNA, 16 nt, Homo sapiens
uagauuccucuugccu

SEQ ID NO: 1200109 - RNA, 23 nt, Homo sapiens
uagauuccucuugccucucucag

SEQ ID NO: 1200110 - RNA, 21 nt, Homo sapiens
uagauucucugugucuaagau

SEQ ID NO: 1200111 - RNA, 19 nt, Homo sapiens
uagauugggguagagggaa

SEQ ID NO: 1200112 - RNA, 14 nt, Homo sapiens
uagcaaaauugagg

SEQ ID NO: 1200113 - RNA, 23 nt, Homo sapiens
uagcaaagcaaaaggcugagaag

SEQ ID NO: 1200114 - RNA, 19 nt, Homo sapiens
uagcaagauauugaucaaa

SEQ ID NO: 1200115 - RNA, 16 nt, Homo sapiens
uagcaaggucauuucu

SEQ ID NO: 1200116 - RNA, 22 nt, Homo sapiens
uagcaauaacauacaugagaua

SEQ ID NO: 1200117 - RNA, 22 nt, Homo sapiens
uagcacacuuuuccacauucca

SEQ ID NO: 1200118 - RNA, 14 nt, Homo sapiens
uagcacuauuuaca

SEQ ID NO: 1200119 - RNA, 23 nt, Homo sapiens
uagcagaggccggcccuggccau

SEQ ID NO: 1200120 - RNA, 23 nt, Homo sapiens
uagcagaguccuuauucuucuca

SEQ ID NO: 1200121 - RNA, 14 nt, Homo sapiens
uagcagauggagua

SEQ ID NO: 1200122 - RNA, 20 nt, Homo sapiens
uagcagccuguacuagcuuu

SEQ ID NO: 1200123 - RNA, 14 nt, Homo sapiens
uagcagcugugaug

SEQ ID NO: 1200124 - RNA, 18 nt, Homo sapiens
uagcagggaaacagcuaa

SEQ ID NO: 1200125 - RNA, 16 nt, Homo sapiens
uagcaguacuaaucau

SEQ ID NO: 1200126 - RNA, 14 nt, Homo sapiens
uagcauccaagugg

SEQ ID NO: 1200127 - RNA, 17 nt, Homo sapiens
uagcaucuguaacagca

SEQ ID NO: 1200128 - RNA, 21 nt, Homo sapiens
uagcaucuguaacagcauuaa

SEQ ID NO: 1200129 - RNA, 19 nt, Homo sapiens
uagcaucuuccuugauaau

SEQ ID NO: 1200130 - RNA, 22 nt, Homo sapiens
uagcaugcugcuuuuuguacuu

SEQ ID NO: 1200131 - RNA, 13 nt, Homo sapiens
uagcauguuugcu

SEQ ID NO: 1200132 - RNA, 16 nt, Homo sapiens
uagcauuaacuaaucu

SEQ ID NO: 1200133 - RNA, 17 nt, Homo sapiens
ucccauccuugaugcaa

SEQ ID NO: 1200134 - RNA, 18 nt, Homo sapiens
ucccaucugucaccaauu

SEQ ID NO: 1200135 - RNA, 15 nt, Homo sapiens
ucccaugacugcacc

SEQ ID NO: 1200136 - RNA, 12 nt, Homo sapiens
ucccauggaaua

SEQ ID NO: 1200137 - RNA, 17 nt, Homo sapiens
ucccauggacacuccag

SEQ ID NO: 1200138 - RNA, 23 nt, Homo sapiens
ucccaugggcugaguggggagca

SEQ ID NO: 1200139 - RNA, 14 nt, Homo sapiens
ucccauguauuuau

SEQ ID NO: 1200140 - RNA, 22 nt, Homo sapiens
ucccauuacuuugauaucugau

SEQ ID NO: 1200141 - RNA, 15 nt, Homo sapiens
ucccauucuugcaug

SEQ ID NO: 1200142 - RNA, 18 nt, Homo sapiens
ucccauugguguugucau

SEQ ID NO: 1200143 - RNA, 23 nt, Homo sapiens
ucccauuucuugaagauaaaaaa

SEQ ID NO: 1200144 - RNA, 16 nt, Homo sapiens
uccccaaacccagaaa

SEQ ID NO: 1200145 - RNA, 16 nt, Homo sapiens
uccccaaccacuucau

SEQ ID NO: 1200146 - RNA, 17 nt, Homo sapiens
uccccaaggaagagcca

SEQ ID NO: 1200147 - RNA, 19 nt, Homo sapiens
uccccaaggacucuuccac

SEQ ID NO: 1200148 - RNA, 16 nt, Homo sapiens
uccccaauuacagggu

SEQ ID NO: 1200149 - RNA, 18 nt, Homo sapiens
uccccacccugucuucca

SEQ ID NO: 1200150 - RNA, 13 nt, Homo sapiens
uccccacucccuu

SEQ ID NO: 1200151 - RNA, 14 nt, Homo sapiens
uccccagacucagc

SEQ ID NO: 1200152 - RNA, 14 nt, Homo sapiens
uccccagagcacug

SEQ ID NO: 1200153 - RNA, 14 nt, Homo sapiens
uccccagagcugug

SEQ ID NO: 1200154 - RNA, 19 nt, Homo sapiens
uccccagcccuuuuguuga

SEQ ID NO: 1200155 - RNA, 22 nt, Homo sapiens
uccccaggagcagcaucucuga

SEQ ID NO: 1200156 - RNA, 16 nt, Homo sapiens
uccccaggcaccucac

SEQ ID NO: 1200157 - RNA, 16 nt, Homo sapiens
uccccagucccagaca

SEQ ID NO: 1200158 - RNA, 23 nt, Homo sapiens
uccccauccccacccagucucau

SEQ ID NO: 1200159 - RNA, 20 nt, Homo sapiens
uccccauucgguguggugca

SEQ ID NO: 1200160 - RNA, 22 nt, Homo sapiens
ucccccaaagcaaugugagucc

SEQ ID NO: 1200161 - RNA, 15 nt, Homo sapiens
ucccccaaugucuuc

SEQ ID NO: 1200162 - RNA, 18 nt, Homo sapiens
ucccccaccgguccagcu

SEQ ID NO: 1200163 - RNA, 23 nt, Homo sapiens
ucccccaccgguccagcuggccu

SEQ ID NO: 1200164 - RNA, 12 nt, Homo sapiens
ucccccauaggu

SEQ ID NO: 1200165 - RNA, 16 nt, Homo sapiens
ucccccgugaucuccc

SEQ ID NO: 1200166 - RNA, 15 nt, Homo sapiens
ucccccugcaacuuc

SEQ ID NO: 1200167 - RNA, 18 nt, Homo sapiens
ucccccuuugugcacauu

SEQ ID NO: 1200168 - RNA, 18 nt, Homo sapiens
uccccgaaggugcuggag

SEQ ID NO: 1200169 - RNA, 22 nt, Homo sapiens
uccccggggucuucuaccucag

SEQ ID NO: 1200170 - RNA, 13 nt, Homo sapiens
uccccguccacag

SEQ ID NO: 1200171 - RNA, 16 nt, Homo sapiens
uccccguccacagggc

SEQ ID NO: 1200172 - RNA, 15 nt, Homo sapiens
uccccuaaaauaaca

SEQ ID NO: 1200173 - RNA, 14 nt, Homo sapiens
uccccuacucccuc

SEQ ID NO: 1200174 - RNA, 22 nt, Homo sapiens
uccccuagcuuuccccagacac

SEQ ID NO: 1200175 - RNA, 14 nt, Homo sapiens
uccccucaccuccu

SEQ ID NO: 1200176 - RNA, 14 nt, Homo sapiens
uccccucacucugu

SEQ ID NO: 1200177 - RNA, 22 nt, Homo sapiens
uccccuccacugucacauugua

SEQ ID NO: 1200178 - RNA, 19 nt, Homo sapiens
uccccucccuggcucccau

SEQ ID NO: 1200179 - RNA, 22 nt, Homo sapiens
uccccucccuggcucccaugac

SEQ ID NO: 1200180 - RNA, 16 nt, Homo sapiens
uccccuccucagugac

SEQ ID NO: 1200181 - RNA, 20 nt, Homo sapiens
uccccugcuacccuagauga

SEQ ID NO: 1200182 - RNA, 21 nt, Homo sapiens
uccccuguuucaaucacuguc

SEQ ID NO: 1200183 - RNA, 23 nt, Homo sapiens
uccccuucucugugcaguagcau

SEQ ID NO: 1200184 - RNA, 14 nt, Homo sapiens
uccccuucugcaau

SEQ ID NO: 1200185 - RNA, 21 nt, Homo sapiens
uccccuuuguguagaaagcca

SEQ ID NO: 1200186 - RNA, 16 nt, Homo sapiens
ucccgaagaauggaga

SEQ ID NO: 1200187 - RNA, 20 nt, Homo sapiens
ucccgaguugcugggauuac

SEQ ID NO: 1200188 - RNA, 14 nt, Homo sapiens
ucccgaugcugcua

SEQ ID NO: 1200189 - RNA, 19 nt, Homo sapiens
ucccgccuuccuccuccac

SEQ ID NO: 1200190 - RNA, 19 nt, Homo sapiens
ucccggcgucccuaccucc

SEQ ID NO: 1200191 - RNA, 19 nt, Homo sapiens
ucccgggcuuaccagguga

SEQ ID NO: 1200192 - RNA, 18 nt, Homo sapiens
ucccggggccagcacuuc

SEQ ID NO: 1200193 - RNA, 23 nt, Homo sapiens
ucccguaccucuucccaugacug

SEQ ID NO: 1200194 - RNA, 20 nt, Homo sapiens
ucccuacauggaguauaugu

SEQ ID NO: 1200195 - RNA, 12 nt, Homo sapiens
ucccuaccuccu

SEQ ID NO: 1200196 - RNA, 14 nt, Homo sapiens
ucccuagcagugaa

SEQ ID NO: 1200197 - RNA, 22 nt, Homo sapiens
ucccuagccagcacuuguauau

SEQ ID NO: 1200198 - RNA, 16 nt, Homo sapiens
ucccuaggaaacucac

SEQ ID NO: 1200199 - RNA, 22 nt, Homo sapiens
ucccuaggaaacucacacuccc

SEQ ID NO: 1200200 - RNA, 15 nt, Homo sapiens
ucccuccaguaccau

SEQ ID NO: 1200201 - RNA, 20 nt, Homo sapiens
ucccuccccaguucauugca

SEQ ID NO: 1200202 - RNA, 14 nt, Homo sapiens
ucccucccuaucua

SEQ ID NO: 1200203 - RNA, 14 nt, Homo sapiens
ucccuccggccaua

SEQ ID NO: 1200204 - RNA, 16 nt, Homo sapiens
ucccucgcaugucucc

SEQ ID NO: 1200205 - RNA, 19 nt, Homo sapiens
ucccucuaauuuaucuugu

SEQ ID NO: 1200206 - RNA, 19 nt, Homo sapiens
ucccucucaugacuugcag

SEQ ID NO: 1200207 - RNA, 13 nt, Homo sapiens
ucccucuguccac

SEQ ID NO: 1200208 - RNA, 18 nt, Homo sapiens
ucccucugugucugcucu

SEQ ID NO: 1200209 - RNA, 17 nt, Homo sapiens
ucccugaaaccuaguac

SEQ ID NO: 1200210 - RNA, 16 nt, Homo sapiens
ucccugacuguaaaug

SEQ ID NO: 1200211 - RNA, 21 nt, Homo sapiens
ucccugcacccaugacaauca

SEQ ID NO: 1200212 - RNA, 22 nt, Homo sapiens
ucccugcccaccuccuggagaa

SEQ ID NO: 1200213 - RNA, 24 nt, Homo sapiens
ucccugccucucaucaacugaaug

SEQ ID NO: 1200214 - RNA, 15 nt, Homo sapiens
ucccugcuaaucucc

SEQ ID NO: 1200215 - RNA, 13 nt, Homo sapiens
ucccugcucuaac

SEQ ID NO: 1200216 - RNA, 21 nt, Homo sapiens
ucccuggcucccaugaccaua

SEQ ID NO: 1200217 - RNA, 21 nt, Homo sapiens
ucccuggggcugcugugcgcu

SEQ ID NO: 1200218 - RNA, 19 nt, Homo sapiens
ucccugucauagagcugca

SEQ ID NO: 1200219 - RNA, 18 nt, Homo sapiens
ucccugucauuuuuaaca

SEQ ID NO: 1200220 - RNA, 23 nt, Homo sapiens
ucccugucauuuuuaacagcaug

SEQ ID NO: 1200221 - RNA, 15 nt, Homo sapiens
ucccugucucugcau

SEQ ID NO: 1200222 - RNA, 18 nt, Homo sapiens
ucccugugucauuucaaa

SEQ ID NO: 1200223 - RNA, 22 nt, Homo sapiens
ucccuuccacugccucugccuu

SEQ ID NO: 1200224 - RNA, 23 nt, Homo sapiens
ucccuucccugaagaucuaguga

SEQ ID NO: 1200225 - RNA, 15 nt, Homo sapiens
ucccuugcuguaugc

SEQ ID NO: 1200226 - RNA, 16 nt, Homo sapiens
ucccuugcuguaugcu

SEQ ID NO: 1200227 - RNA, 23 nt, Homo sapiens
ucccuugcuguaugcugaucauc

SEQ ID NO: 1200228 - RNA, 14 nt, Homo sapiens
ucccuuugauucuc

SEQ ID NO: 1200229 - RNA, 18 nt, Homo sapiens
ucccuuuggagaugcuga

SEQ ID NO: 1200230 - RNA, 16 nt, Homo sapiens
uccgagcggcuacaaa

SEQ ID NO: 1200231 - RNA, 17 nt, Homo sapiens
ugccagagguaauguua

SEQ ID NO: 1200232 - RNA, 17 nt, Homo sapiens
ugccagaugcaauacaa

SEQ ID NO: 1200233 - RNA, 19 nt, Homo sapiens
ugccaggccagagggcagu

SEQ ID NO: 1200234 - RNA, 15 nt, Homo sapiens
ugccaggccuggcaa

SEQ ID NO: 1200235 - RNA, 21 nt, Homo sapiens
ugccaggccugggaccuccca

SEQ ID NO: 1200236 - RNA, 22 nt, Homo sapiens
ugccaggcugaauuacagugaa

SEQ ID NO: 1200237 - RNA, 18 nt, Homo sapiens
ugccagggacugacaaaa

SEQ ID NO: 1200238 - RNA, 15 nt, Homo sapiens
ugccagugccucuca

SEQ ID NO: 1200239 - RNA, 18 nt, Homo sapiens
ugccauagcugacuacaa

SEQ ID NO: 1200240 - RNA, 23 nt, Homo sapiens
ugccaucaccauacacaguggca

SEQ ID NO: 1200241 - RNA, 18 nt, Homo sapiens
ugccaucauuuacuuuua

SEQ ID NO: 1200242 - RNA, 20 nt, Homo sapiens
ugccauccucacccagcacc

SEQ ID NO: 1200243 - RNA, 16 nt, Homo sapiens
ugccaucgaccuggag

SEQ ID NO: 1200244 - RNA, 23 nt, Homo sapiens
ugccauggaggcaugccaaaugu

SEQ ID NO: 1200245 - RNA, 16 nt, Homo sapiens
ugccauggcagacagu

SEQ ID NO: 1200246 - RNA, 13 nt, Homo sapiens
ugccaugugaaga

SEQ ID NO: 1200247 - RNA, 17 nt, Homo sapiens
ugccauuucugaacugu

SEQ ID NO: 1200248 - RNA, 13 nt, Homo sapiens
ugcccaacugccu

SEQ ID NO: 1200249 - RNA, 19 nt, Homo sapiens
ugcccacccugggagacag

SEQ ID NO: 1200250 - RNA, 19 nt, Homo sapiens
ugcccacgcuggagugcag

SEQ ID NO: 1200251 - RNA, 13 nt, Homo sapiens
ugcccagaucaac

SEQ ID NO: 1200252 - RNA, 15 nt, Homo sapiens
ugcccagcaggggag

SEQ ID NO: 1200253 - RNA, 19 nt, Homo sapiens
ugcccaggagaaaagaaga

SEQ ID NO: 1200254 - RNA, 14 nt, Homo sapiens
ugcccaguguucuc

SEQ ID NO: 1200255 - RNA, 18 nt, Homo sapiens
ugcccauccugacugaaa

SEQ ID NO: 1200256 - RNA, 16 nt, Homo sapiens
ugcccauuuacacuuu

SEQ ID NO: 1200257 - RNA, 18 nt, Homo sapiens
ugccccaaguccucauuu

SEQ ID NO: 1200258 - RNA, 14 nt, Homo sapiens
ugccccacccuaac

SEQ ID NO: 1200259 - RNA, 18 nt, Homo sapiens
ugccccagcagugccuug

SEQ ID NO: 1200260 - RNA, 20 nt, Homo sapiens
ugccccccagauugcugcaa

SEQ ID NO: 1200261 - RNA, 17 nt, Homo sapiens
ugcccccuccaggagag

SEQ ID NO: 1200262 - RNA, 16 nt, Homo sapiens
ugccccucccaaccca

SEQ ID NO: 1200263 - RNA, 23 nt, Homo sapiens
ugccccuggugcccugagacaga

SEQ ID NO: 1200264 - RNA, 16 nt, Homo sapiens
ugcccgagcuggugca

SEQ ID NO: 1200265 - RNA, 15 nt, Homo sapiens
ugcccgcacagcagc

SEQ ID NO: 1200266 - RNA, 13 nt, Homo sapiens
ugcccguuuccau

SEQ ID NO: 1200267 - RNA, 21 nt, Homo sapiens
ugcccuccccagagcacuggg

SEQ ID NO: 1200268 - RNA, 19 nt, Homo sapiens
ugcccucggagugccacac

SEQ ID NO: 1200269 - RNA, 22 nt, Homo sapiens
ugcccucuccuuccuuacccaa

SEQ ID NO: 1200270 - RNA, 23 nt, Homo sapiens
ugcccucugacuaguagauuucu

SEQ ID NO: 1200271 - RNA, 11 nt, Homo sapiens
ugcccuggcag

SEQ ID NO: 1200272 - RNA, 20 nt, Homo sapiens
ugcccuggcagcaugacuca

SEQ ID NO: 1200273 - RNA, 18 nt, Homo sapiens
ugcccuggugcauggccu

SEQ ID NO: 1200274 - RNA, 18 nt, Homo sapiens
ugcccuguucucuucaca

SEQ ID NO: 1200275 - RNA, 20 nt, Homo sapiens
ugccgcagacgggcacagac

SEQ ID NO: 1200276 - RNA, 12 nt, Homo sapiens
ugccgcauuugg

SEQ ID NO: 1200277 - RNA, 22 nt, Homo sapiens
ugccgcuccucucuagaaccuu

SEQ ID NO: 1200278 - RNA, 17 nt, Homo sapiens
ugccguaacaacugugg

SEQ ID NO: 1200279 - RNA, 22 nt, Homo sapiens
ugccuaaaauauauuccugaga

SEQ ID NO: 1200280 - RNA, 20 nt, Homo sapiens
ugccuaaauuuaaugcugcc

SEQ ID NO: 1200281 - RNA, 15 nt, Homo sapiens
ugccuacaaccaucc

SEQ ID NO: 1200282 - RNA, 17 nt, Homo sapiens
ugccuagaaucuuuauu

SEQ ID NO: 1200283 - RNA, 20 nt, Homo sapiens
ugccuagacuguuacuuugg

SEQ ID NO: 1200284 - RNA, 20 nt, Homo sapiens
ugccuagaguguagccuaaa

SEQ ID NO: 1200285 - RNA, 16 nt, Homo sapiens
ugccucacuuccuaca

SEQ ID NO: 1200286 - RNA, 14 nt, Homo sapiens
ugccucagccuccc

SEQ ID NO: 1200287 - RNA, 18 nt, Homo sapiens
ugccucagccucccgagu

SEQ ID NO: 1200288 - RNA, 23 nt, Homo sapiens
ugccucauuaucuugcagcugua

SEQ ID NO: 1200289 - RNA, 15 nt, Homo sapiens
ugccuccaagccauu

SEQ ID NO: 1200290 - RNA, 13 nt, Homo sapiens
ugccuccagcauu

SEQ ID NO: 1200291 - RNA, 16 nt, Homo sapiens
ugccucccagguucca

SEQ ID NO: 1200292 - RNA, 19 nt, Homo sapiens
ugccucccagguuccagca

SEQ ID NO: 1200293 - RNA, 21 nt, Homo sapiens
ugccucccccuaaauuaauga

SEQ ID NO: 1200294 - RNA, 21 nt, Homo sapiens
ugccuccucguuccuuucucc

SEQ ID NO: 1200295 - RNA, 17 nt, Homo sapiens
ugccuccucuccaggcc

SEQ ID NO: 1200296 - RNA, 16 nt, Homo sapiens
ugccucugcucccucu

SEQ ID NO: 1200297 - RNA, 15 nt, Homo sapiens
ugccugaagucacac

SEQ ID NO: 1200298 - RNA, 13 nt, Homo sapiens
ugccugagcugca

SEQ ID NO: 1200299 - RNA, 15 nt, Homo sapiens
ugccugcugccauag

SEQ ID NO: 1200300 - RNA, 16 nt, Homo sapiens
ugccugggggcugugg

SEQ ID NO: 1200301 - RNA, 17 nt, Homo sapiens
ugccuggugugccucag

SEQ ID NO: 1200302 - RNA, 14 nt, Homo sapiens
ugccuguaauccca

SEQ ID NO: 1200303 - RNA, 22 nt, Homo sapiens
ugccuguaaucccagcacuuug

SEQ ID NO: 1200304 - RNA, 16 nt, Homo sapiens
ugccugucccagagag

SEQ ID NO: 1200305 - RNA, 20 nt, Homo sapiens
ugccugugaaauaguacugc

SEQ ID NO: 1200306 - RNA, 22 nt, Homo sapiens
ugccugugcagcgggugcugcu

SEQ ID NO: 1200307 - RNA, 16 nt, Homo sapiens
ugccuuaggccuaccu

SEQ ID NO: 1200308 - RNA, 14 nt, Homo sapiens
ugccuuaguguccu

SEQ ID NO: 1200309 - RNA, 16 nt, Homo sapiens
ugccuuccacaauuca

SEQ ID NO: 1200310 - RNA, 19 nt, Homo sapiens
ugccuuccuccuuauccua

SEQ ID NO: 1200311 - RNA, 12 nt, Homo sapiens
ugccuucugacg

SEQ ID NO: 1200312 - RNA, 16 nt, Homo sapiens
ugccuucuuauugcuu

SEQ ID NO: 1200313 - RNA, 20 nt, Homo sapiens
ugccuucuuauugcuuuuau

SEQ ID NO: 1200314 - RNA, 17 nt, Homo sapiens
ugccuuggggaggacaa

SEQ ID NO: 1200315 - RNA, 18 nt, Homo sapiens
ugccuuggggaggacaaa

SEQ ID NO: 1200316 - RNA, 16 nt, Homo sapiens
ugccuuuaagccaaag

SEQ ID NO: 1200317 - RNA, 16 nt, Homo sapiens
ugccuuuaauuugcua

SEQ ID NO: 1200318 - RNA, 17 nt, Homo sapiens
ugccuuuuccccaggga

SEQ ID NO: 1200319 - RNA, 17 nt, Homo sapiens
ugccuuuugcaccccuc

SEQ ID NO: 1200320 - RNA, 18 nt, Homo sapiens
ugcgaaccacccaaaaca

SEQ ID NO: 1200321 - RNA, 20 nt, Homo sapiens
ugcgaagacccucuugccca

SEQ ID NO: 1200322 - RNA, 16 nt, Homo sapiens
ugcgaauaacaguccc

SEQ ID NO: 1200323 - RNA, 17 nt, Homo sapiens
ugcgaccgugaccagga

SEQ ID NO: 1200324 - RNA, 16 nt, Homo sapiens
ugcgagagaaagggag

SEQ ID NO: 1200325 - RNA, 22 nt, Homo sapiens
ugcgccaaucccgccaugcuca

SEQ ID NO: 1200326 - RNA, 11 nt, Homo sapiens
ugcgcccuuca

SEQ ID NO: 1200327 - RNA, 23 nt, Homo sapiens
ugcgccugacauucacacagaga

SEQ ID NO: 1200328 - RNA, 17 nt, Homo sapiens
ugcgcuuuauugcccau

SEQ ID NO: 1200329 - RNA, 20 nt, Homo sapiens
ugcggaaugaaccacaucuu

SEQ ID NO: 1200330 - RNA, 23 nt, Homo sapiens
ugcggccaguauuagacuggaag

SEQ ID NO: 1200331 - RNA, 16 nt, Homo sapiens
ugcguggacucugcac

SEQ ID NO: 1200332 - RNA, 13 nt, Homo sapiens
ugcgugggggcca

SEQ ID NO: 1200333 - RNA, 21 nt, Homo sapiens
ugcguggugcucuuugcugca

SEQ ID NO: 1200334 - RNA, 17 nt, Homo sapiens
ugcguuaaauaagcaaa

SEQ ID NO: 1200335 - RNA, 14 nt, Homo sapiens
ugcguucacuccaa

SEQ ID NO: 1200336 - RNA, 18 nt, Homo sapiens
ugcuaacaaagacaaaag

SEQ ID NO: 1200337 - RNA, 14 nt, Homo sapiens
ugcuaaccuggaaa

SEQ ID NO: 1200338 - RNA, 17 nt, Homo sapiens
ugcuaaggcuccuccuu

SEQ ID NO: 1200339 - RNA, 18 nt, Homo sapiens
ugcuaagugcuuauuaca

SEQ ID NO: 1200340 - RNA, 19 nt, Homo sapiens
ugcuaauaacagugcauau

SEQ ID NO: 1200341 - RNA, 23 nt, Homo sapiens
ugcuaauaugaacagaaaugcau

SEQ ID NO: 1200342 - RNA, 13 nt, Homo sapiens
ugcuaauaugaca

SEQ ID NO: 1200343 - RNA, 22 nt, Homo sapiens
ugcuaauaugacauaugacaau

SEQ ID NO: 1200344 - RNA, 23 nt, Homo sapiens
ugcuaaucaugugggugagccag

SEQ ID NO: 1200345 - RNA, 20 nt, Homo sapiens
ugcuaaucuucuuaugcaau

SEQ ID NO: 1200346 - RNA, 18 nt, Homo sapiens
ugcuaauucaaagcucua

SEQ ID NO: 1200347 - RNA, 15 nt, Homo sapiens
ugcuacaacauguga

SEQ ID NO: 1200348 - RNA, 23 nt, Homo sapiens
ugcuacaugacgacaaagcugcu

SEQ ID NO: 1200349 - RNA, 19 nt, Homo sapiens
ugcuacccaugacuuuaua

SEQ ID NO: 1200350 - RNA, 14 nt, Homo sapiens
ugcuaccccuuuga

SEQ ID NO: 1200351 - RNA, 20 nt, Homo sapiens
ugcuacuauaaucaaaugau

SEQ ID NO: 1200352 - RNA, 17 nt, Homo sapiens
ugcuacugucuuuggaa

SEQ ID NO: 1200353 - RNA, 12 nt, Homo sapiens
ugcuacuugacc

SEQ ID NO: 1200354 - RNA, 22 nt, Homo sapiens
ugcuacuuuuuuuuaguucaau

SEQ ID NO: 1200355 - RNA, 18 nt, Homo sapiens
ugcuagaaaaauguucuu

SEQ ID NO: 1200356 - RNA, 14 nt, Homo sapiens
ugcuagacagccag

SEQ ID NO: 1200357 - RNA, 19 nt, Homo sapiens
ugcuagcagcugugauggu

SEQ ID NO: 1200358 - RNA, 12 nt, Homo sapiens
ugcuauaaucau

SEQ ID NO: 1200359 - RNA, 14 nt, Homo sapiens
ugcuauacagucua

SEQ ID NO: 1200360 - RNA, 15 nt, Homo sapiens
ugcuaucgcaccacu

SEQ ID NO: 1200361 - RNA, 12 nt, Homo sapiens
ugcuaucugggc

SEQ ID NO: 1200362 - RNA, 13 nt, Homo sapiens
ugcuaugacugua

SEQ ID NO: 1200363 - RNA, 14 nt, Homo sapiens
ugcuaugugccuua

SEQ ID NO: 1200364 - RNA, 13 nt, Homo sapiens
ugcuauucuccau

SEQ ID NO: 1200365 - RNA, 23 nt, Homo sapiens
ugcuauuuauuuuccuaaagaga

SEQ ID NO: 1200366 - RNA, 19 nt, Homo sapiens
ugcucacauaucugucauu

SEQ ID NO: 1200367 - RNA, 15 nt, Homo sapiens
ugcucaccugaggau

SEQ ID NO: 1200368 - RNA, 18 nt, Homo sapiens
ugcucagaauucaucuga

SEQ ID NO: 1200369 - RNA, 23 nt, Homo sapiens
ugcucagcacaggccugggaccu

SEQ ID NO: 1200370 - RNA, 15 nt, Homo sapiens
ugcucagccaagcuu

SEQ ID NO: 1200371 - RNA, 19 nt, Homo sapiens
ugcucaggagccaccagca

SEQ ID NO: 1200372 - RNA, 20 nt, Homo sapiens
ugcucauacuuaucuaaugu

SEQ ID NO: 1200373 - RNA, 14 nt, Homo sapiens
ugcucauaugcaug

SEQ ID NO: 1200374 - RNA, 15 nt, Homo sapiens
ugcucauguaugugc

SEQ ID NO: 1200375 - RNA, 17 nt, Homo sapiens
ugcucauguaugugcga

SEQ ID NO: 1200376 - RNA, 13 nt, Homo sapiens
ugcuccaccagca

SEQ ID NO: 1200377 - RNA, 22 nt, Homo sapiens
ugcuccaggagguuugcaggga

SEQ ID NO: 1200378 - RNA, 22 nt, Homo sapiens
ugcuccaugacuggcugucugc

SEQ ID NO: 1200379 - RNA, 15 nt, Homo sapiens
ugcucccagccugcu

SEQ ID NO: 1200380 - RNA, 17 nt, Homo sapiens
ugcucccggguccugcu

SEQ ID NO: 1200381 - RNA, 16 nt, Homo sapiens
ugcucccuagccagag

SEQ ID NO: 1200382 - RNA, 21 nt, Homo sapiens
ugcucccuagccagaggcucu

SEQ ID NO: 1200383 - RNA, 20 nt, Homo sapiens
ugcucccucagccucagagg

SEQ ID NO: 1200384 - RNA, 17 nt, Homo sapiens
ugcuccuggagccuuug

SEQ ID NO: 1200385 - RNA, 19 nt, Homo sapiens
ugcuccuuggcuuaccuga

SEQ ID NO: 1200386 - RNA, 20 nt, Homo sapiens
ugcuccuuuuguaucuuccu

SEQ ID NO: 1200387 - RNA, 15 nt, Homo sapiens
ugcucgcccaggaag

SEQ ID NO: 1200388 - RNA, 21 nt, Homo sapiens
ugcucuaugaaacugcacauu

SEQ ID NO: 1200389 - RNA, 21 nt, Homo sapiens
ugcucucucacucccccauga

SEQ ID NO: 1200390 - RNA, 20 nt, Homo sapiens
ugcucugaacuggaugauac

SEQ ID NO: 1200391 - RNA, 14 nt, Homo sapiens
ugcucugcuuuuag

SEQ ID NO: 1200392 - RNA, 16 nt, Homo sapiens
ugcucuggaagaccug

SEQ ID NO: 1200393 - RNA, 23 nt, Homo sapiens
ugcucugguuguuucuguuccaa

SEQ ID NO: 1200394 - RNA, 15 nt, Homo sapiens
ugcucuuagcugucu

SEQ ID NO: 1200395 - RNA, 15 nt, Homo sapiens
ugcucuuaugccauu

SEQ ID NO: 1200396 - RNA, 16 nt, Homo sapiens
ugcucuuaugccauuu

SEQ ID NO: 1200397 - RNA, 16 nt, Homo sapiens
ugcucuugagucuuug

SEQ ID NO: 1200398 - RNA, 18 nt, Homo sapiens
ugcucuugagucuuugca

SEQ ID NO: 1200399 - RNA, 14 nt, Homo sapiens
ugcucuugccaaaa

SEQ ID NO: 1200400 - RNA, 20 nt, Homo sapiens
ugcucuugggaagaccagcu

SEQ ID NO: 1200401 - RNA, 18 nt, Homo sapiens
ugcucuuucaucucugcu

SEQ ID NO: 1200402 - RNA, 14 nt, Homo sapiens
ugcucuuugcugca

SEQ ID NO: 1200403 - RNA, 15 nt, Homo sapiens
ugcucuuugcugcac

SEQ ID NO: 1200404 - RNA, 23 nt, Homo sapiens
ugcugaaaaaucauccaagacag

SEQ ID NO: 1200405 - RNA, 16 nt, Homo sapiens
ugcugaauaaaugauu

SEQ ID NO: 1200406 - RNA, 17 nt, Homo sapiens
ugcugaauguggacuca

SEQ ID NO: 1200407 - RNA, 16 nt, Homo sapiens
ugcugaccaugcagcc

SEQ ID NO: 1200408 - RNA, 21 nt, Homo sapiens
ugcugacuccacgauccugcc

SEQ ID NO: 1200409 - RNA, 15 nt, Homo sapiens
ugcugagcauguacu

SEQ ID NO: 1200410 - RNA, 16 nt, Homo sapiens
ugcugagucagacugu

SEQ ID NO: 1200411 - RNA, 15 nt, Homo sapiens
ugcugaucgugcuaa

SEQ ID NO: 1200412 - RNA, 22 nt, Homo sapiens
ugcugauguauuucaagucucu

SEQ ID NO: 1200413 - RNA, 16 nt, Homo sapiens
ugcugauugaagacac

SEQ ID NO: 1200414 - RNA, 15 nt, Homo sapiens
ugcugcaaacacuua

SEQ ID NO: 1200415 - RNA, 19 nt, Homo sapiens
ugcugcaaagccuuuccag

SEQ ID NO: 1200416 - RNA, 17 nt, Homo sapiens
ugcugcaaauacuguau

SEQ ID NO: 1200417 - RNA, 20 nt, Homo sapiens
ugcugcagacaaguggacag

SEQ ID NO: 1200418 - RNA, 20 nt, Homo sapiens
ugcugcaucuuauagcacuu

SEQ ID NO: 1200419 - RNA, 17 nt, Homo sapiens
ugcugcccauguuucaa

SEQ ID NO: 1200420 - RNA, 10 nt, Homo sapiens
ugcugcuaug

SEQ ID NO: 1200421 - RNA, 13 nt, Homo sapiens
ugcugcugugacc

SEQ ID NO: 1200422 - RNA, 13 nt, Homo sapiens
ugcugcugugcag

SEQ ID NO: 1200423 - RNA, 19 nt, Homo sapiens
ugcuggacuugccuaaaau

SEQ ID NO: 1200424 - RNA, 22 nt, Homo sapiens
ugcuggagagguuaaggugcaa

SEQ ID NO: 1200425 - RNA, 23 nt, Homo sapiens
ugcuggcagccauggccauggca

SEQ ID NO: 1200426 - RNA, 15 nt, Homo sapiens
ugcuggcaguacugu

SEQ ID NO: 1200427 - RNA, 14 nt, Homo sapiens
ugcuggcauuugca

SEQ ID NO: 1200428 - RNA, 18 nt, Homo sapiens
ugcuggccagggacccag

SEQ ID NO: 1200429 - RNA, 14 nt, Homo sapiens
ugcuggcugccuua

SEQ ID NO: 1200430 - RNA, 18 nt, Homo sapiens
ugcugggauuacaggcau

SEQ ID NO: 1200431 - RNA, 14 nt, Homo sapiens
ugcugggcucccag

SEQ ID NO: 1200432 - RNA, 19 nt, Homo sapiens
ugcuggguauaagcagaga

SEQ ID NO: 1200433 - RNA, 23 nt, Homo sapiens
ugcuggucccggggccagcacuu

SEQ ID NO: 1200434 - RNA, 16 nt, Homo sapiens
ugcuggucuauuuuga

SEQ ID NO: 1200435 - RNA, 14 nt, Homo sapiens
ugcuggugaaccag

SEQ ID NO: 1200436 - RNA, 16 nt, Homo sapiens
ugcuguaaauacagga

SEQ ID NO: 1200437 - RNA, 14 nt, Homo sapiens
ugcuguaguaacug

SEQ ID NO: 1200438 - RNA, 20 nt, Homo sapiens
ugcuguccugaucugugaua

SEQ ID NO: 1200439 - RNA, 21 nt, Homo sapiens
ugcugugacaagccaauguga

SEQ ID NO: 1200440 - RNA, 13 nt, Homo sapiens
ugcugugcacauu

SEQ ID NO: 1200441 - RNA, 19 nt, Homo sapiens
ugcuguuaauauaguuuag

SEQ ID NO: 1200442 - RNA, 13 nt, Homo sapiens
ugcuguugagaug

SEQ ID NO: 1200443 - RNA, 22 nt, Homo sapiens
ugcuguuguaaacaacguguau

SEQ ID NO: 1200444 - RNA, 16 nt, Homo sapiens
ugcuguuuuaaacauu

SEQ ID NO: 1200445 - RNA, 21 nt, Homo sapiens
ugcuuaaaagguuaaauuuca

SEQ ID NO: 1200446 - RNA, 18 nt, Homo sapiens
ugcuuaaugguagcaacu

SEQ ID NO: 1200447 - RNA, 12 nt, Homo sapiens
ugcuuacauuuu

SEQ ID NO: 1200448 - RNA, 18 nt, Homo sapiens
ugcuuaguguacuuggag

SEQ ID NO: 1200449 - RNA, 16 nt, Homo sapiens
ugcuuaugacaucacu

SEQ ID NO: 1200450 - RNA, 22 nt, Homo sapiens
ugcuucaaguguugcucuugga

SEQ ID NO: 1200451 - RNA, 19 nt, Homo sapiens
ugcuucacaguagagccag

SEQ ID NO: 1200452 - RNA, 22 nt, Homo sapiens
ugcuucacaguagagccagcuu

SEQ ID NO: 1200453 - RNA, 13 nt, Homo sapiens
ugcuucaguccac

SEQ ID NO: 1200454 - RNA, 14 nt, Homo sapiens
ugcuucaucauucc

SEQ ID NO: 1200455 - RNA, 19 nt, Homo sapiens
ugcuucauuguacuaccug

SEQ ID NO: 1200456 - RNA, 17 nt, Homo sapiens
ugcuuccacuucuaugc

SEQ ID NO: 1200457 - RNA, 19 nt, Homo sapiens
ugcuuccacuucuaugcaa

SEQ ID NO: 1200458 - RNA, 14 nt, Homo sapiens
ugcuucccaccucc

SEQ ID NO: 1200459 - RNA, 12 nt, Homo sapiens
ugcuucucucac

SEQ ID NO: 1200460 - RNA, 18 nt, Homo sapiens
ugcuucugaaugugcuga

SEQ ID NO: 1200461 - RNA, 17 nt, Homo sapiens
ugcuucuguagcuucua

SEQ ID NO: 1200462 - RNA, 15 nt, Homo sapiens
ugcuucuuuaccaag

SEQ ID NO: 1200463 - RNA, 21 nt, Homo sapiens
ugcuugaaccaaaauggugaa

SEQ ID NO: 1200464 - RNA, 14 nt, Homo sapiens
ugcuugaacccaag

SEQ ID NO: 1200465 - RNA, 21 nt, Homo sapiens
ugcuugagcccaggaauuuga

SEQ ID NO: 1200466 - RNA, 17 nt, Homo sapiens
ugcuugcaauguaguca

SEQ ID NO: 1200467 - RNA, 19 nt, Homo sapiens
ugcuuggaaauuccuugcc

SEQ ID NO: 1200468 - RNA, 14 nt, Homo sapiens
ugcuuggauuuuga

SEQ ID NO: 1200469 - RNA, 17 nt, Homo sapiens
ugcuugggcugacccag

SEQ ID NO: 1200470 - RNA, 18 nt, Homo sapiens
ugcuugucgauuauauuc

SEQ ID NO: 1200471 - RNA, 12 nt, Homo sapiens
ugcuuguucccu

SEQ ID NO: 1200472 - RNA, 16 nt, Homo sapiens
ugcuuuagaaguaaca

SEQ ID NO: 1200473 - RNA, 18 nt, Homo sapiens
ugcuuuagcacaggacaa

SEQ ID NO: 1200474 - RNA, 12 nt, Homo sapiens
ugcuuucaaguc

SEQ ID NO: 1200475 - RNA, 13 nt, Homo sapiens
ugcuuugccaaaa

SEQ ID NO: 1200476 - RNA, 14 nt, Homo sapiens
ugcuuugcugcuau

SEQ ID NO: 1200477 - RNA, 17 nt, Homo sapiens
ugcuuugcugcuaugaa

SEQ ID NO: 1200478 - RNA, 13 nt, Homo sapiens
ugcuuuucagggu

SEQ ID NO: 1200479 - RNA, 14 nt, Homo sapiens
ugcuuuucaggguu

SEQ ID NO: 1200480 - RNA, 16 nt, Homo sapiens
ugcuuuucauguagaa

SEQ ID NO: 1200481 - RNA, 18 nt, Homo sapiens
ugcuuuuccucaagcaau

SEQ ID NO: 1200482 - RNA, 16 nt, Homo sapiens
ugcuuuuugacaugaa

SEQ ID NO: 1200483 - RNA, 14 nt, Homo sapiens
uggaaaaaaaccac

SEQ ID NO: 1200484 - RNA, 17 nt, Homo sapiens
uggaaaaaaaccacagc

SEQ ID NO: 1200485 - RNA, 17 nt, Homo sapiens
uggaaaaaccauuugaa

SEQ ID NO: 1200486 - RNA, 13 nt, Homo sapiens
uggaaaaagccug

SEQ ID NO: 1200487 - RNA, 21 nt, Homo sapiens
uggaaaaagcuccccaccccu

SEQ ID NO: 1200488 - RNA, 13 nt, Homo sapiens
uggaaaagcaaaa

SEQ ID NO: 1200489 - RNA, 20 nt, Homo sapiens
uggaaaauaaacaucaguuu

SEQ ID NO: 1200490 - RNA, 18 nt, Homo sapiens
uggaaaaugcaaaagcac

SEQ ID NO: 1200491 - RNA, 12 nt, Homo sapiens
uggaaacagcau

SEQ ID NO: 1200492 - RNA, 15 nt, Homo sapiens
uggaaaccguguaaa

SEQ ID NO: 1200493 - RNA, 14 nt, Homo sapiens
uggaaacguauuca

SEQ ID NO: 1200494 - RNA, 17 nt, Homo sapiens
uggaaagaaaaagcaau

SEQ ID NO: 1200495 - RNA, 16 nt, Homo sapiens
uggaaagaaagaccau

SEQ ID NO: 1200496 - RNA, 18 nt, Homo sapiens
uggaaagcaucaccucag

SEQ ID NO: 1200497 - RNA, 14 nt, Homo sapiens
uggaaagcugauga

SEQ ID NO: 1200498 - RNA, 17 nt, Homo sapiens
uggaaauaaacugugca

SEQ ID NO: 1200499 - RNA, 17 nt, Homo sapiens
uggaaaucaacccucuc

SEQ ID NO: 1200500 - RNA, 23 nt, Homo sapiens
uggaaaugaaacugcugugaaug

SEQ ID NO: 1200501 - RNA, 19 nt, Homo sapiens
uggaacaacugauacuuca

SEQ ID NO: 1200502 - RNA, 13 nt, Homo sapiens
uggaacaagcaca

SEQ ID NO: 1200503 - RNA, 16 nt, Homo sapiens
uggaacaagcacagau

SEQ ID NO: 1200504 - RNA, 20 nt, Homo sapiens
uggaacaccuuggggucccu

SEQ ID NO: 1200505 - RNA, 16 nt, Homo sapiens
uggaacauccuuugca

SEQ ID NO: 1200506 - RNA, 18 nt, Homo sapiens
uggaacauuggaauguuc

SEQ ID NO: 1200507 - RNA, 23 nt, Homo sapiens
uggaaccaacacuaacauauaau

SEQ ID NO: 1200508 - RNA, 18 nt, Homo sapiens
uggaacccccacuuuuac

SEQ ID NO: 1200509 - RNA, 16 nt, Homo sapiens
uggaacccccaucucu

SEQ ID NO: 1200510 - RNA, 20 nt, Homo sapiens
uggaacuauacccgggacca

SEQ ID NO: 1200511 - RNA, 22 nt, Homo sapiens
uggaacuggccacgcacaggcu

SEQ ID NO: 1200512 - RNA, 16 nt, Homo sapiens
uggaacuguacacuug

SEQ ID NO: 1200513 - RNA, 22 nt, Homo sapiens
uggaacuguccuucccucaaag

SEQ ID NO: 1200514 - RNA, 22 nt, Homo sapiens
uggaagagaauauuccuacuug

SEQ ID NO: 1200515 - RNA, 12 nt, Homo sapiens
uggaagauggca

SEQ ID NO: 1200516 - RNA, 14 nt, Homo sapiens
uggaagauuugccc

SEQ ID NO: 1200517 - RNA, 13 nt, Homo sapiens
uggaagcaguuuc

SEQ ID NO: 1200518 - RNA, 16 nt, Homo sapiens
uggaagcuugcuuuuu

SEQ ID NO: 1200519 - RNA, 15 nt, Homo sapiens
uggaaggcagacagc

SEQ ID NO: 1200520 - RNA, 12 nt, Homo sapiens
uggaagggucaa

SEQ ID NO: 1200521 - RNA, 14 nt, Homo sapiens
uggaaguaaagccu

SEQ ID NO: 1200522 - RNA, 14 nt, Homo sapiens
uggaagucaucuca

SEQ ID NO: 1200523 - RNA, 15 nt, Homo sapiens
uggaagugucccuuu

SEQ ID NO: 1200524 - RNA, 16 nt, Homo sapiens
uggaauaccuaaggau

SEQ ID NO: 1200525 - RNA, 21 nt, Homo sapiens
uggaauauaauuucaaaccac

SEQ ID NO: 1200526 - RNA, 13 nt, Homo sapiens
uggaauauuacaa

SEQ ID NO: 1200527 - RNA, 13 nt, Homo sapiens
uggaaucagugaa

SEQ ID NO: 1200528 - RNA, 15 nt, Homo sapiens
uggaaucccacugua

SEQ ID NO: 1200529 - RNA, 16 nt, Homo sapiens
uggaaugguaggauau

SEQ ID NO: 1200530 - RNA, 16 nt, Homo sapiens
uggaauguacucuguu

SEQ ID NO: 1200531 - RNA, 13 nt, Homo sapiens
uggaauuacaggc

SEQ ID NO: 1200532 - RNA, 15 nt, Homo sapiens
uggaauuuguucaag

SEQ ID NO: 1200533 - RNA, 21 nt, Homo sapiens
uggacacaauaggucuuucuc

SEQ ID NO: 1200534 - RNA, 13 nt, Homo sapiens
uggacacagaucc

SEQ ID NO: 1200535 - RNA, 11 nt, Homo sapiens
uggacacugag

SEQ ID NO: 1200536 - RNA, 22 nt, Homo sapiens
uggacagacccaggucuuccag

SEQ ID NO: 1200537 - RNA, 19 nt, Homo sapiens
uggacaggagucagugucu

SEQ ID NO: 1200538 - RNA, 14 nt, Homo sapiens
uggacauuugccuu

SEQ ID NO: 1200539 - RNA, 22 nt, Homo sapiens
uggaccaauagggcugagcucu

SEQ ID NO: 1200540 - RNA, 12 nt, Homo sapiens
uggaccacugca

SEQ ID NO: 1200541 - RNA, 14 nt, Homo sapiens
uggaccaggccauu

SEQ ID NO: 1200542 - RNA, 17 nt, Homo sapiens
uggaccaguggugccuu

SEQ ID NO: 1200543 - RNA, 15 nt, Homo sapiens
uggaccuaacauucg

SEQ ID NO: 1200544 - RNA, 13 nt, Homo sapiens
uggacuaagcaau

SEQ ID NO: 1200545 - RNA, 11 nt, Homo sapiens
uggacuaugua

SEQ ID NO: 1200546 - RNA, 15 nt, Homo sapiens
uggacucaaucccua

SEQ ID NO: 1200547 - RNA, 14 nt, Homo sapiens
uggacucucaggga

SEQ ID NO: 1200548 - RNA, 11 nt, Homo sapiens
uggacugcaag

SEQ ID NO: 1200549 - RNA, 14 nt, Homo sapiens
uggacugcauuuaa

SEQ ID NO: 1200550 - RNA, 18 nt, Homo sapiens
uggacuggaggugggcau

SEQ ID NO: 1200551 - RNA, 21 nt, Homo sapiens
uggacuguuccaggcccucca

SEQ ID NO: 1200552 - RNA, 21 nt, Homo sapiens
uggacuuccagugcucagagg

SEQ ID NO: 1200553 - RNA, 14 nt, Homo sapiens
uggacuugccuaaa

SEQ ID NO: 1200554 - RNA, 22 nt, Homo sapiens
uggacuuguauauuuguacaaa

SEQ ID NO: 1200555 - RNA, 17 nt, Homo sapiens
uggagaaaaaaauugcu

SEQ ID NO: 1200556 - RNA, 22 nt, Homo sapiens
uggagaaaauggguuuauucac

SEQ ID NO: 1200557 - RNA, 14 nt, Homo sapiens
uggagacacaacua

SEQ ID NO: 1200558 - RNA, 22 nt, Homo sapiens
uggagaccaggccugagcaaca

SEQ ID NO: 1200559 - RNA, 19 nt, Homo sapiens
uggagacguggaaccucug

SEQ ID NO: 1200560 - RNA, 23 nt, Homo sapiens
uggagauucaguuuucauuuggu

SEQ ID NO: 1200561 - RNA, 19 nt, Homo sapiens
uggagcaggagccccgcca

SEQ ID NO: 1200562 - RNA, 23 nt, Homo sapiens
uggagcccaggaguuugaggcug

SEQ ID NO: 1200563 - RNA, 21 nt, Homo sapiens
uggagcccuguuggcagcucu

SEQ ID NO: 1200564 - RNA, 21 nt, Homo sapiens
uggagcuaauggcgaucaucu

SEQ ID NO: 1200565 - RNA, 15 nt, Homo sapiens
uggagcugacuguuc

SEQ ID NO: 1200566 - RNA, 14 nt, Homo sapiens
uggagcugggcuaa

SEQ ID NO: 1200567 - RNA, 19 nt, Homo sapiens
uggaggaacaacucuccag

SEQ ID NO: 1200568 - RNA, 17 nt, Homo sapiens
uggaggaauucagcuca

SEQ ID NO: 1200569 - RNA, 18 nt, Homo sapiens
uggaggacggucagucca

SEQ ID NO: 1200570 - RNA, 19 nt, Homo sapiens
uggaggaggaaggcaagag

SEQ ID NO: 1200571 - RNA, 19 nt, Homo sapiens
uggaggccggaaucucagc

SEQ ID NO: 1200572 - RNA, 23 nt, Homo sapiens
uggagggagaagcuagagcuuca

SEQ ID NO: 1200573 - RNA, 20 nt, Homo sapiens
uggagggguguggcuccuuc

SEQ ID NO: 1200574 - RNA, 20 nt, Homo sapiens
uggaggucauacaugcauac

SEQ ID NO: 1200575 - RNA, 18 nt, Homo sapiens
uggagguucuaaggccua

SEQ ID NO: 1200576 - RNA, 14 nt, Homo sapiens
uggagguugcagug

SEQ ID NO: 1200577 - RNA, 23 nt, Homo sapiens
uggaguacuuagcuaguuuuauu

SEQ ID NO: 1200578 - RNA, 20 nt, Homo sapiens
uggaguagccauucuuuauu

SEQ ID NO: 1200579 - RNA, 21 nt, Homo sapiens
uggaguaucauucuuuacaua

SEQ ID NO: 1200580 - RNA, 16 nt, Homo sapiens
uggaguauuggggucu

SEQ ID NO: 1200581 - RNA, 14 nt, Homo sapiens
uggagucacuguag

SEQ ID NO: 1200582 - RNA, 17 nt, Homo sapiens
uggagugcccacccugg

SEQ ID NO: 1200583 - RNA, 16 nt, Homo sapiens
uggagugucacaucuc

SEQ ID NO: 1200584 - RNA, 17 nt, Homo sapiens
uggagugucacaucucu

SEQ ID NO: 1200585 - RNA, 15 nt, Homo sapiens
uggaguucuuacuug

SEQ ID NO: 1200586 - RNA, 14 nt, Homo sapiens
uggaguuguucaaa

SEQ ID NO: 1200587 - RNA, 24 nt, Homo sapiens
uggaguuucauguacaagaugaag

SEQ ID NO: 1200588 - RNA, 15 nt, Homo sapiens
uggauaaaaugaggu

SEQ ID NO: 1200589 - RNA, 18 nt, Homo sapiens
uggauaucaaaagcaaau

SEQ ID NO: 1200590 - RNA, 15 nt, Homo sapiens
uggaucaccauuaua

SEQ ID NO: 1200591 - RNA, 20 nt, Homo sapiens
uggaucaguccuuugaucag

SEQ ID NO: 1200592 - RNA, 14 nt, Homo sapiens
uggauccagcacug

SEQ ID NO: 1200593 - RNA, 13 nt, Homo sapiens
uggaucuugccac

SEQ ID NO: 1200594 - RNA, 13 nt, Homo sapiens
uggaugacauuaa

SEQ ID NO: 1200595 - RNA, 20 nt, Homo sapiens
uggaugccugggucucuggg

SEQ ID NO: 1200596 - RNA, 16 nt, Homo sapiens
uggaugcgaggaccac

SEQ ID NO: 1200597 - RNA, 14 nt, Homo sapiens
uggauggcacaaug

SEQ ID NO: 1200598 - RNA, 21 nt, Homo sapiens
uggaugggagugggcaccuca

SEQ ID NO: 1200599 - RNA, 16 nt, Homo sapiens
uggauguggggucccc

SEQ ID NO: 1200600 - RNA, 15 nt, Homo sapiens
uggauuaugaaguga

SEQ ID NO: 1200601 - RNA, 15 nt, Homo sapiens
uggauucaucagcau

SEQ ID NO: 1200602 - RNA, 23 nt, Homo sapiens
uggauucauuacagcuuaaucaa

SEQ ID NO: 1200603 - RNA, 12 nt, Homo sapiens
uggauuccucac

SEQ ID NO: 1200604 - RNA, 17 nt, Homo sapiens
uggauucuuaaccaaga

SEQ ID NO: 1200605 - RNA, 20 nt, Homo sapiens
uggauucuuuaaacgcucua

SEQ ID NO: 1200606 - RNA, 15 nt, Homo sapiens
uggauugugguucca

SEQ ID NO: 1200607 - RNA, 17 nt, Homo sapiens
uggauuguuacagcuuc

SEQ ID NO: 1200608 - RNA, 19 nt, Homo sapiens
uggauuucuuagagauuaa

SEQ ID NO: 1200609 - RNA, 23 nt, Homo sapiens
uggauuugaucacuacaaguauu

SEQ ID NO: 1200610 - RNA, 19 nt, Homo sapiens
uggauuuucuacuguaaga

SEQ ID NO: 1200611 - RNA, 18 nt, Homo sapiens
uggauuuuucuuuaacug

SEQ ID NO: 1200612 - RNA, 16 nt, Homo sapiens
uggauuuuuuaaauca

SEQ ID NO: 1200613 - RNA, 17 nt, Homo sapiens
uggcaaauggaggcuuu

SEQ ID NO: 1200614 - RNA, 20 nt, Homo sapiens
uggcaacaaaaaguaaugaa

SEQ ID NO: 1200615 - RNA, 22 nt, Homo sapiens
uggcaacaaauauuuauacaua

SEQ ID NO: 1200616 - RNA, 22 nt, Homo sapiens
uggcaaccugcuuucaagaccc

SEQ ID NO: 1200617 - RNA, 19 nt, Homo sapiens
uggcaacggaagaaugaga

SEQ ID NO: 1200618 - RNA, 12 nt, Homo sapiens
uggcaagagccc

SEQ ID NO: 1200619 - RNA, 22 nt, Homo sapiens
uggcaagucaccugcagcccau

SEQ ID NO: 1200620 - RNA, 14 nt, Homo sapiens
uggcaauaaacucc

SEQ ID NO: 1200621 - RNA, 20 nt, Homo sapiens
uggcaauaaacuccuacuaa

SEQ ID NO: 1200622 - RNA, 20 nt, Homo sapiens
uggcaaugaaaaauucucag

SEQ ID NO: 1200623 - RNA, 21 nt, Homo sapiens
uggcaauuuccuggcccucca

SEQ ID NO: 1200624 - RNA, 14 nt, Homo sapiens
uggcacagaagcuc

SEQ ID NO: 1200625 - RNA, 20 nt, Homo sapiens
uggcacagaagcucaucuca

SEQ ID NO: 1200626 - RNA, 15 nt, Homo sapiens
uggcaccagaugcaa

SEQ ID NO: 1200627 - RNA, 14 nt, Homo sapiens
uggcaccgagacca

SEQ ID NO: 1200628 - RNA, 16 nt, Homo sapiens
uggcaccuucagacuu

SEQ ID NO: 1200629 - RNA, 19 nt, Homo sapiens
uggcacgugccugugaucc

SEQ ID NO: 1200630 - RNA, 18 nt, Homo sapiens
uggcacuguggagcucag

SEQ ID NO: 1200631 - RNA, 17 nt, Homo sapiens
uggcacuugcuaacaaa

SEQ ID NO: 1200632 - RNA, 12 nt, Homo sapiens
uggcacuuguau

SEQ ID NO: 1200633 - RNA, 14 nt, Homo sapiens
uagcauugucuugu

SEQ ID NO: 1200634 - RNA, 18 nt, Homo sapiens
uagccaaacccuugucag

SEQ ID NO: 1200635 - RNA, 19 nt, Homo sapiens
uagccacugaucauuuuua

SEQ ID NO: 1200636 - RNA, 19 nt, Homo sapiens
uagccagaggcucuaaugu

SEQ ID NO: 1200637 - RNA, 17 nt, Homo sapiens
uagccagcauuccauau

SEQ ID NO: 1200638 - RNA, 17 nt, Homo sapiens
uagccagcugugcacuu

SEQ ID NO: 1200639 - RNA, 18 nt, Homo sapiens
uagccagcugugcacuuu

SEQ ID NO: 1200640 - RNA, 16 nt, Homo sapiens
uagccaggauccacaa

SEQ ID NO: 1200641 - RNA, 16 nt, Homo sapiens
uagccaggauggucuc

SEQ ID NO: 1200642 - RNA, 19 nt, Homo sapiens
uagccagugcuccaggcac

SEQ ID NO: 1200643 - RNA, 18 nt, Homo sapiens
uagccaucucucuacucc

SEQ ID NO: 1200644 - RNA, 17 nt, Homo sapiens
uagccauuucacucuca

SEQ ID NO: 1200645 - RNA, 23 nt, Homo sapiens
uagcccaucccugccuggucaca

SEQ ID NO: 1200646 - RNA, 23 nt, Homo sapiens
uagccgagcacgguggugcaugc

SEQ ID NO: 1200647 - RNA, 16 nt, Homo sapiens
uagccuaauacaacau

SEQ ID NO: 1200648 - RNA, 22 nt, Homo sapiens
uagccuggauauuauucuugua

SEQ ID NO: 1200649 - RNA, 13 nt, Homo sapiens
uagccugugcacg

SEQ ID NO: 1200650 - RNA, 20 nt, Homo sapiens
uagccuuuaaaucauuuuua

SEQ ID NO: 1200651 - RNA, 21 nt, Homo sapiens
uagcgcugcucuuaugccauu

SEQ ID NO: 1200652 - RNA, 14 nt, Homo sapiens
uagcuaguaucuuc

SEQ ID NO: 1200653 - RNA, 19 nt, Homo sapiens
uagcuauggaaucaauuca

SEQ ID NO: 1200654 - RNA, 21 nt, Homo sapiens
uagcuccuuggagcaggcaaa

SEQ ID NO: 1200655 - RNA, 18 nt, Homo sapiens
uagcucucacaugcacag

SEQ ID NO: 1200656 - RNA, 18 nt, Homo sapiens
uagcugaaccgacacuca

SEQ ID NO: 1200657 - RNA, 22 nt, Homo sapiens
uagcugacggcuggguguuuca

SEQ ID NO: 1200658 - RNA, 16 nt, Homo sapiens
uagcugcaaguguauc

SEQ ID NO: 1200659 - RNA, 20 nt, Homo sapiens
uagcuggaacuacaaggaag

SEQ ID NO: 1200660 - RNA, 15 nt, Homo sapiens
uagcugggacuacag

SEQ ID NO: 1200661 - RNA, 18 nt, Homo sapiens
uagcugggacuacagggg

SEQ ID NO: 1200662 - RNA, 18 nt, Homo sapiens
uagcugggauuacaggcg

SEQ ID NO: 1200663 - RNA, 12 nt, Homo sapiens
uagcuguaaaac

SEQ ID NO: 1200664 - RNA, 14 nt, Homo sapiens
uagcugugaacaga

SEQ ID NO: 1200665 - RNA, 18 nt, Homo sapiens
uagcugugcaagaccuag

SEQ ID NO: 1200666 - RNA, 21 nt, Homo sapiens
uagcuucuuaaacgaaagaau

SEQ ID NO: 1200667 - RNA, 16 nt, Homo sapiens
uagcuugaaacauaga

SEQ ID NO: 1200668 - RNA, 12 nt, Homo sapiens
uagcuugcuccc

SEQ ID NO: 1200669 - RNA, 13 nt, Homo sapiens
uagcuuuacaaau

SEQ ID NO: 1200670 - RNA, 11 nt, Homo sapiens
uagcuuuucau

SEQ ID NO: 1200671 - RNA, 15 nt, Homo sapiens
uaggaaaaucacuug

SEQ ID NO: 1200672 - RNA, 17 nt, Homo sapiens
uaggaaaguuucuucaa

SEQ ID NO: 1200673 - RNA, 19 nt, Homo sapiens
uaggaagguuaauguucau

SEQ ID NO: 1200674 - RNA, 23 nt, Homo sapiens
uaggaauaagcucuaguucuuaa

SEQ ID NO: 1200675 - RNA, 24 nt, Homo sapiens
uaggaaucccagaggugggauccu

SEQ ID NO: 1200676 - RNA, 13 nt, Homo sapiens
uaggacagcauau

SEQ ID NO: 1200677 - RNA, 20 nt, Homo sapiens
uaggagacugcgucaagcaa

SEQ ID NO: 1200678 - RNA, 17 nt, Homo sapiens
uaggagggagacacugg

SEQ ID NO: 1200679 - RNA, 17 nt, Homo sapiens
uaggaguugaguacagu

SEQ ID NO: 1200680 - RNA, 14 nt, Homo sapiens
uaggauaucuuggc

SEQ ID NO: 1200681 - RNA, 15 nt, Homo sapiens
uaggauggggcuccc

SEQ ID NO: 1200682 - RNA, 18 nt, Homo sapiens
uaggauuaaaauggauuu

SEQ ID NO: 1200683 - RNA, 20 nt, Homo sapiens
uaggcaagcaggaccuggca

SEQ ID NO: 1200684 - RNA, 21 nt, Homo sapiens
uaggcacuguaguucuaagac

SEQ ID NO: 1200685 - RNA, 16 nt, Homo sapiens
uaggcaggaagcccaa

SEQ ID NO: 1200686 - RNA, 19 nt, Homo sapiens
uaggcaguaauguuccucc

SEQ ID NO: 1200687 - RNA, 21 nt, Homo sapiens
uaggcauguagcuacaggaca

SEQ ID NO: 1200688 - RNA, 21 nt, Homo sapiens
uaggccagaguugcaaagauc

SEQ ID NO: 1200689 - RNA, 15 nt, Homo sapiens
uaggcugcugcugug

SEQ ID NO: 1200690 - RNA, 16 nt, Homo sapiens
uaggcuuucauguugc

SEQ ID NO: 1200691 - RNA, 22 nt, Homo sapiens
uagggaugccuuucuaguccua

SEQ ID NO: 1200692 - RNA, 21 nt, Homo sapiens
uagggcacuuuaagucaguga

SEQ ID NO: 1200693 - RNA, 14 nt, Homo sapiens
uagggcugagcucu

SEQ ID NO: 1200694 - RNA, 19 nt, Homo sapiens
uaggggagggguugccaca

SEQ ID NO: 1200695 - RNA, 14 nt, Homo sapiens
uaggggaguucagu

SEQ ID NO: 1200696 - RNA, 11 nt, Homo sapiens
uaggggaugag

SEQ ID NO: 1200697 - RNA, 23 nt, Homo sapiens
uagggggagcaaaucgugccuug

SEQ ID NO: 1200698 - RNA, 17 nt, Homo sapiens
uaggguagugcuaagag

SEQ ID NO: 1200699 - RNA, 15 nt, Homo sapiens
uaggguccaccagga

SEQ ID NO: 1200700 - RNA, 16 nt, Homo sapiens
uaggguggcccuugca

SEQ ID NO: 1200701 - RNA, 16 nt, Homo sapiens
uagguacgucaaagca

SEQ ID NO: 1200702 - RNA, 20 nt, Homo sapiens
uagguaggggcccacuucac

SEQ ID NO: 1200703 - RNA, 17 nt, Homo sapiens
uagguaucauucaacuc

SEQ ID NO: 1200704 - RNA, 17 nt, Homo sapiens
uagguccaagggccaua

SEQ ID NO: 1200705 - RNA, 20 nt, Homo sapiens
uaggugacagagugagacuc

SEQ ID NO: 1200706 - RNA, 16 nt, Homo sapiens
uagguggcaagcugug

SEQ ID NO: 1200707 - RNA, 18 nt, Homo sapiens
uagguuaaaaaaaaaagu

SEQ ID NO: 1200708 - RNA, 20 nt, Homo sapiens
uagguuaauaaaucaagcca

SEQ ID NO: 1200709 - RNA, 19 nt, Homo sapiens
uagguuugauauguaguua

SEQ ID NO: 1200710 - RNA, 23 nt, Homo sapiens
uagguuuuuccuacuguccucag

SEQ ID NO: 1200711 - RNA, 18 nt, Homo sapiens
uaguaaauccaugguguu

SEQ ID NO: 1200712 - RNA, 15 nt, Homo sapiens
uaguaacaguuguga

SEQ ID NO: 1200713 - RNA, 16 nt, Homo sapiens
uaguaacauagacaaa

SEQ ID NO: 1200714 - RNA, 19 nt, Homo sapiens
uaguaacuuuccauagggc

SEQ ID NO: 1200715 - RNA, 15 nt, Homo sapiens
uaguaaucacaguug

SEQ ID NO: 1200716 - RNA, 16 nt, Homo sapiens
uaguaauggcagagca

SEQ ID NO: 1200717 - RNA, 23 nt, Homo sapiens
uaguaauuuauugucugucuaca

SEQ ID NO: 1200718 - RNA, 16 nt, Homo sapiens
uaguaccucugcuauu

SEQ ID NO: 1200719 - RNA, 14 nt, Homo sapiens
uggcagaaagggaa

SEQ ID NO: 1200720 - RNA, 20 nt, Homo sapiens
uggcagaccgugaccaucuu

SEQ ID NO: 1200721 - RNA, 19 nt, Homo sapiens
uggcagaguuacaguucug

SEQ ID NO: 1200722 - RNA, 16 nt, Homo sapiens
uggcagcauacacaga

SEQ ID NO: 1200723 - RNA, 20 nt, Homo sapiens
uggcagcauacacagaugaa

SEQ ID NO: 1200724 - RNA, 17 nt, Homo sapiens
uggcagcuagugccuuu

SEQ ID NO: 1200725 - RNA, 18 nt, Homo sapiens
uggcagcucuccagucag

SEQ ID NO: 1200726 - RNA, 14 nt, Homo sapiens
uggcaggccagugu

SEQ ID NO: 1200727 - RNA, 16 nt, Homo sapiens
uggcaggccagugucu

SEQ ID NO: 1200728 - RNA, 13 nt, Homo sapiens
uggcaggugcaga

SEQ ID NO: 1200729 - RNA, 15 nt, Homo sapiens
uggcagucacaucuc

SEQ ID NO: 1200730 - RNA, 16 nt, Homo sapiens
uggcauaugccuguaa

SEQ ID NO: 1200731 - RNA, 15 nt, Homo sapiens
uggcaucacagggca

SEQ ID NO: 1200732 - RNA, 16 nt, Homo sapiens
uggcaucucacuuuau

SEQ ID NO: 1200733 - RNA, 18 nt, Homo sapiens
uggcaugaggagguccca

SEQ ID NO: 1200734 - RNA, 20 nt, Homo sapiens
uggcauugucuguaaugaca

SEQ ID NO: 1200735 - RNA, 21 nt, Homo sapiens
uggccaccccuccccaguaca

SEQ ID NO: 1200736 - RNA, 19 nt, Homo sapiens
uggccacccgcccacagcc

SEQ ID NO: 1200737 - RNA, 21 nt, Homo sapiens
uggccacccgcccacagccag

SEQ ID NO: 1200738 - RNA, 23 nt, Homo sapiens
uggccaccuccagggacaaagag

SEQ ID NO: 1200739 - RNA, 22 nt, Homo sapiens
uggccacgugggcaaacaggca

SEQ ID NO: 1200740 - RNA, 17 nt, Homo sapiens
uggccagacuucagcug

SEQ ID NO: 1200741 - RNA, 14 nt, Homo sapiens
uggccaguugccca

SEQ ID NO: 1200742 - RNA, 21 nt, Homo sapiens
uggccaguugcccagagcacu

SEQ ID NO: 1200743 - RNA, 20 nt, Homo sapiens
uggccaguuucagcucacuu

SEQ ID NO: 1200744 - RNA, 22 nt, Homo sapiens
uggccauugguugccaugguga

SEQ ID NO: 1200745 - RNA, 20 nt, Homo sapiens
uggcccacgcccucccucuc

SEQ ID NO: 1200746 - RNA, 13 nt, Homo sapiens
uggcccagccaaa

SEQ ID NO: 1200747 - RNA, 23 nt, Homo sapiens
uggcccagccggccucucuggcc

SEQ ID NO: 1200748 - RNA, 20 nt, Homo sapiens
uggcccaggcuccagccaca

SEQ ID NO: 1200749 - RNA, 17 nt, Homo sapiens
uggccccaguccaugcu

SEQ ID NO: 1200750 - RNA, 17 nt, Homo sapiens
uggccccaucccaguug

SEQ ID NO: 1200751 - RNA, 21 nt, Homo sapiens
uggcccccacccaguccugca

SEQ ID NO: 1200752 - RNA, 21 nt, Homo sapiens
uggcccccucccuggaugaca

SEQ ID NO: 1200753 - RNA, 24 nt, Homo sapiens
uggcccccucccuggaugacauua

SEQ ID NO: 1200754 - RNA, 18 nt, Homo sapiens
uggccccggccuuuaugu

SEQ ID NO: 1200755 - RNA, 16 nt, Homo sapiens
uggccccucaaccucc

SEQ ID NO: 1200756 - RNA, 21 nt, Homo sapiens
uggccgaaaaggauaugcagu

SEQ ID NO: 1200757 - RNA, 19 nt, Homo sapiens
uggccgacucugcacucuc

SEQ ID NO: 1200758 - RNA, 20 nt, Homo sapiens
uggccuaggcuaccucaaga

SEQ ID NO: 1200759 - RNA, 22 nt, Homo sapiens
uggccuauccgcugccagccuu

SEQ ID NO: 1200760 - RNA, 22 nt, Homo sapiens
uggccuaugcacauauggacuc

SEQ ID NO: 1200761 - RNA, 20 nt, Homo sapiens
uggccuauuuaucugaucaa

SEQ ID NO: 1200762 - RNA, 23 nt, Homo sapiens
uggccucacccaccccugcacag

SEQ ID NO: 1200763 - RNA, 20 nt, Homo sapiens
uggccucccugcugugccau

SEQ ID NO: 1200764 - RNA, 20 nt, Homo sapiens
uggccucccuuugugugcau

SEQ ID NO: 1200765 - RNA, 15 nt, Homo sapiens
uggccuccuaugccu

SEQ ID NO: 1200766 - RNA, 19 nt, Homo sapiens
uggccugaagcaacugaag

SEQ ID NO: 1200767 - RNA, 15 nt, Homo sapiens
uggccuuacacugaa

SEQ ID NO: 1200768 - RNA, 20 nt, Homo sapiens
uggccuuccccuuuugccug

SEQ ID NO: 1200769 - RNA, 18 nt, Homo sapiens
uggccuugaaacaguucc

SEQ ID NO: 1200770 - RNA, 23 nt, Homo sapiens
uggccuuuaaaaaugcaccacuu

SEQ ID NO: 1200771 - RNA, 20 nt, Homo sapiens
uggcgaccgggcaagcuuuc

SEQ ID NO: 1200772 - RNA, 22 nt, Homo sapiens
uggcgaccgggcaagcuuucuu

SEQ ID NO: 1200773 - RNA, 21 nt, Homo sapiens
uggcgcaaucucggcucacug

SEQ ID NO: 1200774 - RNA, 22 nt, Homo sapiens
uggcgccccuuccuaggucaug

SEQ ID NO: 1200775 - RNA, 14 nt, Homo sapiens
uggcguuacugcuu

SEQ ID NO: 1200776 - RNA, 15 nt, Homo sapiens
uggcuagacuugcca

SEQ ID NO: 1200777 - RNA, 13 nt, Homo sapiens
uggcuaguacugu

SEQ ID NO: 1200778 - RNA, 15 nt, Homo sapiens
uggcuauaaauauau

SEQ ID NO: 1200779 - RNA, 13 nt, Homo sapiens
uggcuaugcaaca

SEQ ID NO: 1200780 - RNA, 15 nt, Homo sapiens
uggcucacaaacagu

SEQ ID NO: 1200781 - RNA, 20 nt, Homo sapiens
uggcuccaacacugcugcuc

SEQ ID NO: 1200782 - RNA, 15 nt, Homo sapiens
uggcucccaugacca

SEQ ID NO: 1200783 - RNA, 21 nt, Homo sapiens
uggcucucuccaggauccaga

SEQ ID NO: 1200784 - RNA, 17 nt, Homo sapiens
uggcucucugcagccuu

SEQ ID NO: 1200785 - RNA, 22 nt, Homo sapiens
uggcucugcuguccccuuggca

SEQ ID NO: 1200786 - RNA, 20 nt, Homo sapiens
uggcugaauagcacagguga

SEQ ID NO: 1200787 - RNA, 14 nt, Homo sapiens
uggcugacuggggc

SEQ ID NO: 1200788 - RNA, 23 nt, Homo sapiens
uggcugcuguugcuuaaaccacu

SEQ ID NO: 1200789 - RNA, 17 nt, Homo sapiens
uggcuggaucagggaau

SEQ ID NO: 1200790 - RNA, 16 nt, Homo sapiens
uggcuggccugagcaa

SEQ ID NO: 1200791 - RNA, 24 nt, Homo sapiens
uggcugggaacaacuucaguccaa

SEQ ID NO: 1200792 - RNA, 19 nt, Homo sapiens
uggcugggcuacaauuugu

SEQ ID NO: 1200793 - RNA, 19 nt, Homo sapiens
uggcugguaacaguucaug

SEQ ID NO: 1200794 - RNA, 15 nt, Homo sapiens
uggcuguauggaaau

SEQ ID NO: 1200795 - RNA, 13 nt, Homo sapiens
uggcugucccugu

SEQ ID NO: 1200796 - RNA, 15 nt, Homo sapiens
uggcugugaaauuca

SEQ ID NO: 1200797 - RNA, 11 nt, Homo sapiens
uggcugugagg

SEQ ID NO: 1200798 - RNA, 18 nt, Homo sapiens
uggcuuaaaaauacuuaa

SEQ ID NO: 1200799 - RNA, 21 nt, Homo sapiens
uggcuuaauguuuauuccuga

SEQ ID NO: 1200800 - RNA, 16 nt, Homo sapiens
uggcuuucccuuccag

SEQ ID NO: 1200801 - RNA, 16 nt, Homo sapiens
uggcuuucuggcugcu

SEQ ID NO: 1200802 - RNA, 15 nt, Homo sapiens
uggcuuuuuccucug

SEQ ID NO: 1200803 - RNA, 20 nt, Homo sapiens
ugggaaaagcagaagaggga

SEQ ID NO: 1200804 - RNA, 15 nt, Homo sapiens
ugggaacauacagaa

SEQ ID NO: 1200805 - RNA, 13 nt, Homo sapiens
ugggaaccagcau

SEQ ID NO: 1200806 - RNA, 21 nt, Homo sapiens
ugggaagaccagcuuugcagu

SEQ ID NO: 1200807 - RNA, 21 nt, Homo sapiens
ugggaagauaggcucugcaca

SEQ ID NO: 1200808 - RNA, 15 nt, Homo sapiens
ugggaagggcuccca

SEQ ID NO: 1200809 - RNA, 12 nt, Homo sapiens
ugggaagugaag

SEQ ID NO: 1200810 - RNA, 23 nt, Homo sapiens
ugggaauacaggggugaaagggg

SEQ ID NO: 1200811 - RNA, 22 nt, Homo sapiens
ugggaauagggagacaggguag

SEQ ID NO: 1200812 - RNA, 19 nt, Homo sapiens
ugggaaucaacagcauauu

SEQ ID NO: 1200813 - RNA, 16 nt, Homo sapiens
ugggacaaaggacauu

SEQ ID NO: 1200814 - RNA, 20 nt, Homo sapiens
ugggacacaaaacuccgccc

SEQ ID NO: 1200815 - RNA, 13 nt, Homo sapiens
ugggacagaggag

SEQ ID NO: 1200816 - RNA, 22 nt, Homo sapiens
ugggaccaacuuccuguugaug

SEQ ID NO: 1200817 - RNA, 21 nt, Homo sapiens
ugggacccccaacauucugcc

SEQ ID NO: 1200818 - RNA, 14 nt, Homo sapiens
ugggacccuugaga

SEQ ID NO: 1200819 - RNA, 18 nt, Homo sapiens
ugggagacacagcaagac

SEQ ID NO: 1200820 - RNA, 18 nt, Homo sapiens
ugggagacaugugacauu

SEQ ID NO: 1200821 - RNA, 13 nt, Homo sapiens
ugggagacuggaa

SEQ ID NO: 1200822 - RNA, 15 nt, Homo sapiens
ugggagacuggaaaa

SEQ ID NO: 1200823 - RNA, 20 nt, Homo sapiens
ugggagcccccaccacaaac

SEQ ID NO: 1200824 - RNA, 14 nt, Homo sapiens
ugggagcugccaag

SEQ ID NO: 1200825 - RNA, 18 nt, Homo sapiens
ugggaggagggagaggga

SEQ ID NO: 1200826 - RNA, 13 nt, Homo sapiens
ugggaggcaagaa

SEQ ID NO: 1200827 - RNA, 21 nt, Homo sapiens
ugggaggcaagaaaaggacaa

SEQ ID NO: 1200828 - RNA, 16 nt, Homo sapiens
ugggagguggaagaag

SEQ ID NO: 1200829 - RNA, 18 nt, Homo sapiens
ugggaguaaguucuucaa

SEQ ID NO: 1200830 - RNA, 20 nt, Homo sapiens
uucucaguguagggcagaga

SEQ ID NO: 1200831 - RNA, 13 nt, Homo sapiens
uucucaucugcaa

SEQ ID NO: 1200832 - RNA, 13 nt, Homo sapiens
uucucaugaucca

SEQ ID NO: 1200833 - RNA, 17 nt, Homo sapiens
uucucauucguggcaug

SEQ ID NO: 1200834 - RNA, 14 nt, Homo sapiens
uucuccaaaugaga

SEQ ID NO: 1200835 - RNA, 20 nt, Homo sapiens
uucuccaggacaaccugcug

SEQ ID NO: 1200836 - RNA, 13 nt, Homo sapiens
uucuccauacucu

SEQ ID NO: 1200837 - RNA, 18 nt, Homo sapiens
uucuccauaucaaaacga

SEQ ID NO: 1200838 - RNA, 23 nt, Homo sapiens
uucucccacaugaggccaucuca

SEQ ID NO: 1200839 - RNA, 17 nt, Homo sapiens
uucucccaccaccucac

SEQ ID NO: 1200840 - RNA, 14 nt, Homo sapiens
uucuccugccucac

SEQ ID NO: 1200841 - RNA, 14 nt, Homo sapiens
uucuccugccucag

SEQ ID NO: 1200842 - RNA, 14 nt, Homo sapiens
uucuccugugaaug

SEQ ID NO: 1200843 - RNA, 18 nt, Homo sapiens
uucuccuuuuacuucacu

SEQ ID NO: 1200844 - RNA, 17 nt, Homo sapiens
uucucuagggucugaua

SEQ ID NO: 1200845 - RNA, 13 nt, Homo sapiens
uucucucagaaau

SEQ ID NO: 1200846 - RNA, 15 nt, Homo sapiens
uucucugccagugac

SEQ ID NO: 1200847 - RNA, 15 nt, Homo sapiens
uucucuuaucugcca

SEQ ID NO: 1200848 - RNA, 17 nt, Homo sapiens
uucucuugagcuggccu

SEQ ID NO: 1200849 - RNA, 22 nt, Homo sapiens
uucucuuuguggggcuuggcgu

SEQ ID NO: 1200850 - RNA, 22 nt, Homo sapiens
uucugaaaccacaguuucauua

SEQ ID NO: 1200851 - RNA, 16 nt, Homo sapiens
uucugacggcccugca

SEQ ID NO: 1200852 - RNA, 16 nt, Homo sapiens
uucugacuacuuguug

SEQ ID NO: 1200853 - RNA, 14 nt, Homo sapiens
uucugagaccagug

SEQ ID NO: 1200854 - RNA, 19 nt, Homo sapiens
uucugagagugaaaccaug

SEQ ID NO: 1200855 - RNA, 19 nt, Homo sapiens
uucugaggacaccagugaa

SEQ ID NO: 1200856 - RNA, 23 nt, Homo sapiens
uucugaggcccugcccaaugaga

SEQ ID NO: 1200857 - RNA, 19 nt, Homo sapiens
uucugaggccugagugauc

SEQ ID NO: 1200858 - RNA, 16 nt, Homo sapiens
uucugauaaacacaau

SEQ ID NO: 1200859 - RNA, 13 nt, Homo sapiens
uucugaugagcau

SEQ ID NO: 1200860 - RNA, 22 nt, Homo sapiens
uucugcaacaucuuaagaucca

SEQ ID NO: 1200861 - RNA, 15 nt, Homo sapiens
uucugcaccaacuca

SEQ ID NO: 1200862 - RNA, 18 nt, Homo sapiens
uucugcaccaacucaccu

SEQ ID NO: 1200863 - RNA, 14 nt, Homo sapiens
uucugcacugaaaa

SEQ ID NO: 1200864 - RNA, 18 nt, Homo sapiens
uucugcaucaucuguaga

SEQ ID NO: 1200865 - RNA, 19 nt, Homo sapiens
uucugccaaugaccaaaca

SEQ ID NO: 1200866 - RNA, 20 nt, Homo sapiens
uucugccgcccccuccugaa

SEQ ID NO: 1200867 - RNA, 19 nt, Homo sapiens
uucugccuucucaugaucc

SEQ ID NO: 1200868 - RNA, 15 nt, Homo sapiens
uucugcuaaagaaga

SEQ ID NO: 1200869 - RNA, 19 nt, Homo sapiens
uucugcuccucuccaggca

SEQ ID NO: 1200870 - RNA, 18 nt, Homo sapiens
uucugcuggugaauaacu

SEQ ID NO: 1200871 - RNA, 19 nt, Homo sapiens
uucugcuuuaucuuuucau

SEQ ID NO: 1200872 - RNA, 16 nt, Homo sapiens
uucuggaaaagcaaaa

SEQ ID NO: 1200873 - RNA, 17 nt, Homo sapiens
uucuggaccaaggugaa

SEQ ID NO: 1200874 - RNA, 16 nt, Homo sapiens
uucuggggcccaggaa

SEQ ID NO: 1200875 - RNA, 22 nt, Homo sapiens
uucuggggcccaggaagcccac

SEQ ID NO: 1200876 - RNA, 19 nt, Homo sapiens
uucugggguugcuccgggg

SEQ ID NO: 1200877 - RNA, 14 nt, Homo sapiens
uucugggugcagcu

SEQ ID NO: 1200878 - RNA, 17 nt, Homo sapiens
uucugggugcagcugag

SEQ ID NO: 1200879 - RNA, 18 nt, Homo sapiens
uucugguuuguaaggugg

SEQ ID NO: 1200880 - RNA, 16 nt, Homo sapiens
uucuguaaaacagguu

SEQ ID NO: 1200881 - RNA, 13 nt, Homo sapiens
uucuguaaggugg

SEQ ID NO: 1200882 - RNA, 16 nt, Homo sapiens
uucuguaccauagcgc

SEQ ID NO: 1200883 - RNA, 15 nt, Homo sapiens
uucuguagcaccaga

SEQ ID NO: 1200884 - RNA, 14 nt, Homo sapiens
uucuguaguacucc

SEQ ID NO: 1200885 - RNA, 14 nt, Homo sapiens
uucuguaucauuga

SEQ ID NO: 1200886 - RNA, 18 nt, Homo sapiens
uucuguaucauugauuca

SEQ ID NO: 1200887 - RNA, 21 nt, Homo sapiens
uucugucagaaugcuauugaa

SEQ ID NO: 1200888 - RNA, 23 nt, Homo sapiens
uucuguccugagaagcauguaau

SEQ ID NO: 1200889 - RNA, 21 nt, Homo sapiens
uucuguccuuuuggcacugag

SEQ ID NO: 1200890 - RNA, 13 nt, Homo sapiens
uucuguguacuuu

SEQ ID NO: 1200891 - RNA, 15 nt, Homo sapiens
uucuguguugccaag

SEQ ID NO: 1200892 - RNA, 22 nt, Homo sapiens
uucuguuuuguuguuugauuca

SEQ ID NO: 1200893 - RNA, 22 nt, Homo sapiens
uucuuaaaaguugugauuccag

SEQ ID NO: 1200894 - RNA, 17 nt, Homo sapiens
uucuuaaagaguucuua

SEQ ID NO: 1200895 - RNA, 13 nt, Homo sapiens
uucuuaaccaaga

SEQ ID NO: 1200896 - RNA, 23 nt, Homo sapiens
uucuuaaccaagaaacaaauaau

SEQ ID NO: 1200897 - RNA, 21 nt, Homo sapiens
uucuuaauucauccuagcaaa

SEQ ID NO: 1200898 - RNA, 14 nt, Homo sapiens
uucuuaauugcacu

SEQ ID NO: 1200899 - RNA, 21 nt, Homo sapiens
uucuuacaauugcacugcugu

SEQ ID NO: 1200900 - RNA, 12 nt, Homo sapiens
uucuuacacugu

SEQ ID NO: 1200901 - RNA, 17 nt, Homo sapiens
uucuuacaugcauuuga

SEQ ID NO: 1200902 - RNA, 16 nt, Homo sapiens
uucuuagcgcaguugu

SEQ ID NO: 1200903 - RNA, 14 nt, Homo sapiens
uucuuagugucacu

SEQ ID NO: 1200904 - RNA, 15 nt, Homo sapiens
uucuuauuacuauua

SEQ ID NO: 1200905 - RNA, 17 nt, Homo sapiens
uucuuauuuuuguacuu

SEQ ID NO: 1200906 - RNA, 21 nt, Homo sapiens
uucuucagauacaaacugcag

SEQ ID NO: 1200907 - RNA, 21 nt, Homo sapiens
uucuucaucccuuuccaguua

SEQ ID NO: 1200908 - RNA, 11 nt, Homo sapiens
uucuuccaaaa

SEQ ID NO: 1200909 - RNA, 18 nt, Homo sapiens
uucuucccaguucuugac

SEQ ID NO: 1200910 - RNA, 15 nt, Homo sapiens
uucuucuacugcuau

SEQ ID NO: 1200911 - RNA, 13 nt, Homo sapiens
uucuucuauucca

SEQ ID NO: 1200912 - RNA, 19 nt, Homo sapiens
uucuugaaauuuuaaccua

SEQ ID NO: 1200913 - RNA, 23 nt, Homo sapiens
uucuugaguugucuuuugccauu

SEQ ID NO: 1200914 - RNA, 18 nt, Homo sapiens
uucuugcuacccaugacu

SEQ ID NO: 1200915 - RNA, 18 nt, Homo sapiens
uucuugcucuaucucuca

SEQ ID NO: 1200916 - RNA, 23 nt, Homo sapiens
uucuuuaagcagcgccagugaca

SEQ ID NO: 1200917 - RNA, 15 nt, Homo sapiens
uucuuuacaauuuca

SEQ ID NO: 1200918 - RNA, 23 nt, Homo sapiens
uucuuuacuaaagauaucagagc

SEQ ID NO: 1200919 - RNA, 15 nt, Homo sapiens
uucuuuaucuugaca

SEQ ID NO: 1200920 - RNA, 14 nt, Homo sapiens
uucuuuccauaaua

SEQ ID NO: 1200921 - RNA, 14 nt, Homo sapiens
uucuuuccugccuu

SEQ ID NO: 1200922 - RNA, 12 nt, Homo sapiens
uucuuucucuca

SEQ ID NO: 1200923 - RNA, 12 nt, Homo sapiens
uucuuucugucc

SEQ ID NO: 1200924 - RNA, 13 nt, Homo sapiens
uucuuugaaguuu

SEQ ID NO: 1200925 - RNA, 16 nt, Homo sapiens
uucuuugauucuccuu

SEQ ID NO: 1200926 - RNA, 22 nt, Homo sapiens
uucuuugcaccaaagacaucag

SEQ ID NO: 1200927 - RNA, 21 nt, Homo sapiens
uucuuugcaguucuucaucau

SEQ ID NO: 1200928 - RNA, 18 nt, Homo sapiens
uucuuuuguuacuguucu

SEQ ID NO: 1200929 - RNA, 20 nt, Homo sapiens
uucuuuuuccacaaggaaua

SEQ ID NO: 1200930 - RNA, 14 nt, Homo sapiens
uucuuuuugcucua

SEQ ID NO: 1200931 - RNA, 15 nt, Homo sapiens
uucuuuuugcucuaa

SEQ ID NO: 1200932 - RNA, 18 nt, Homo sapiens
uucuuuuuuuugagacaa

SEQ ID NO: 1200933 - RNA, 15 nt, Homo sapiens
uugaaaacugugcaa

SEQ ID NO: 1200934 - RNA, 20 nt, Homo sapiens
uugaaaagaagcaaggaaau

SEQ ID NO: 1200935 - RNA, 21 nt, Homo sapiens
uugaaaaggcgguacuaguuc

SEQ ID NO: 1200936 - RNA, 16 nt, Homo sapiens
uugaaacaaucugaau

SEQ ID NO: 1200937 - RNA, 14 nt, Homo sapiens
uugaaacugaaugu

SEQ ID NO: 1200938 - RNA, 23 nt, Homo sapiens
uugaaacuggaauaaguguuuau

SEQ ID NO: 1200939 - RNA, 16 nt, Homo sapiens
uugaaacuuugaaugu

SEQ ID NO: 1200940 - RNA, 21 nt, Homo sapiens
uugaaacuuugggaaaacaug

SEQ ID NO: 1200941 - RNA, 13 nt, Homo sapiens
uugaaagaaccag

SEQ ID NO: 1200942 - RNA, 13 nt, Homo sapiens
uugaaagaauuag

SEQ ID NO: 1200943 - RNA, 20 nt, Homo sapiens
uugaaagaucaaaagguuaa

SEQ ID NO: 1200944 - RNA, 16 nt, Homo sapiens
uugaaagcauccaugu

SEQ ID NO: 1200945 - RNA, 17 nt, Homo sapiens
uugaaauaaaugacaau

SEQ ID NO: 1200946 - RNA, 23 nt, Homo sapiens
uugaaauaaaugacaauguaauu

SEQ ID NO: 1200947 - RNA, 14 nt, Homo sapiens
uugaaauaccucau

SEQ ID NO: 1200948 - RNA, 17 nt, Homo sapiens
uugaaauacuaaaagca

SEQ ID NO: 1200949 - RNA, 16 nt, Homo sapiens
uugaaauagucugugu

SEQ ID NO: 1200950 - RNA, 22 nt, Homo sapiens
uugaaauccuuucuaaauugca

SEQ ID NO: 1200951 - RNA, 15 nt, Homo sapiens
uugaaaucugaaugc

SEQ ID NO: 1200952 - RNA, 19 nt, Homo sapiens
uugaaaugaaauuuaaaca

SEQ ID NO: 1200953 - RNA, 17 nt, Homo sapiens
uugaaauuguaagugaa

SEQ ID NO: 1200954 - RNA, 18 nt, Homo sapiens
uugaacuauaacuguugg

SEQ ID NO: 1200955 - RNA, 12 nt, Homo sapiens
uugaacugguuc

SEQ ID NO: 1200956 - RNA, 19 nt, Homo sapiens
uugaacuuuaagaagcagu

SEQ ID NO: 1200957 - RNA, 21 nt, Homo sapiens
uugaagaaaaagacacagaca

SEQ ID NO: 1200958 - RNA, 13 nt, Homo sapiens
cuuugauucuccu

SEQ ID NO: 1200959 - RNA, 13 nt, Homo sapiens
cuuugauuuccaa

SEQ ID NO: 1200960 - RNA, 18 nt, Homo sapiens
cuuugauuuuauaugcua

SEQ ID NO: 1200961 - RNA, 18 nt, Homo sapiens
cuuugcaaaucaguguuu

SEQ ID NO: 1200962 - RNA, 18 nt, Homo sapiens
cuuugcacaggaugcugg

SEQ ID NO: 1200963 - RNA, 14 nt, Homo sapiens
cuuugcaccaaaga

SEQ ID NO: 1200964 - RNA, 15 nt, Homo sapiens
cuuugcaccaaagac

SEQ ID NO: 1200965 - RNA, 14 nt, Homo sapiens
cuuugcacccugua

SEQ ID NO: 1200966 - RNA, 19 nt, Homo sapiens
cuuugcaguuggacucuca

SEQ ID NO: 1200967 - RNA, 16 nt, Homo sapiens
cuuugccaaaauacca

SEQ ID NO: 1200968 - RNA, 20 nt, Homo sapiens
cuuugcuacaaauuuaugca

SEQ ID NO: 1200969 - RNA, 23 nt, Homo sapiens
cuuugcucuuacuacacugagga

SEQ ID NO: 1200970 - RNA, 16 nt, Homo sapiens
cuuugcucuugccaaa

SEQ ID NO: 1200971 - RNA, 18 nt, Homo sapiens
cuuugcugcacuauuugc

SEQ ID NO: 1200972 - RNA, 17 nt, Homo sapiens
cuuugcugcagucaucu

SEQ ID NO: 1200973 - RNA, 16 nt, Homo sapiens
cuuugcugcuaugaaa

SEQ ID NO: 1200974 - RNA, 14 nt, Homo sapiens
cuuuggaaagccau

SEQ ID NO: 1200975 - RNA, 20 nt, Homo sapiens
cuuuggagcagcuucuggga

SEQ ID NO: 1200976 - RNA, 23 nt, Homo sapiens
cuuuggggagcaggaggccaaua

SEQ ID NO: 1200977 - RNA, 19 nt, Homo sapiens
cuuugguuucugucuguaa

SEQ ID NO: 1200978 - RNA, 22 nt, Homo sapiens
cuuuguaacuguuuucaaggag

SEQ ID NO: 1200979 - RNA, 17 nt, Homo sapiens
cuuuguaauauucuccc

SEQ ID NO: 1200980 - RNA, 17 nt, Homo sapiens
cuuuguaugcacuuugu

SEQ ID NO: 1200981 - RNA, 15 nt, Homo sapiens
cuuugucagcaauac

SEQ ID NO: 1200982 - RNA, 21 nt, Homo sapiens
cuuuguccacugucaggguug

SEQ ID NO: 1200983 - RNA, 17 nt, Homo sapiens
cuuugucgugguucuua

SEQ ID NO: 1200984 - RNA, 18 nt, Homo sapiens
cuuugucgugguucuuaa

SEQ ID NO: 1200985 - RNA, 12 nt, Homo sapiens
cuuugucugucg

SEQ ID NO: 1200986 - RNA, 12 nt, Homo sapiens
cuuugugcugug

SEQ ID NO: 1200987 - RNA, 21 nt, Homo sapiens
cuuuguguagaaagccaaaua

SEQ ID NO: 1200988 - RNA, 12 nt, Homo sapiens
cuuugugugcau

SEQ ID NO: 1200989 - RNA, 18 nt, Homo sapiens
cuuuuaaaacacuuccau

SEQ ID NO: 1200990 - RNA, 15 nt, Homo sapiens
cuuuuaaaugcauaa

SEQ ID NO: 1200991 - RNA, 16 nt, Homo sapiens
cuuuuaaaugcauaaa

SEQ ID NO: 1200992 - RNA, 14 nt, Homo sapiens
cuuuuaacauaaua

SEQ ID NO: 1200993 - RNA, 15 nt, Homo sapiens
cuuuuaagaaacaca

SEQ ID NO: 1200994 - RNA, 19 nt, Homo sapiens
cuuuuaagaaacacagggu

SEQ ID NO: 1200995 - RNA, 15 nt, Homo sapiens
cuuuuaaggcuaaaa

SEQ ID NO: 1200996 - RNA, 22 nt, Homo sapiens
cuuuuaaggcuaaaacuuaaca

SEQ ID NO: 1200997 - RNA, 13 nt, Homo sapiens
cuuuuaaguugcu

SEQ ID NO: 1200998 - RNA, 23 nt, Homo sapiens
cuuuuaaguugcugaugaacucu

SEQ ID NO: 1200999 - RNA, 22 nt, Homo sapiens
cuuuuaauguauuuguuugcaa

SEQ ID NO: 1201000 - RNA, 18 nt, Homo sapiens
cuuuuacaacugccucga

SEQ ID NO: 1201001 - RNA, 22 nt, Homo sapiens
cuuuuagaaaaugcagucauuu

SEQ ID NO: 1201002 - RNA, 16 nt, Homo sapiens
cuuuuauaaagcaugu

SEQ ID NO: 1201003 - RNA, 23 nt, Homo sapiens
cuuuuauaggugagaaaaaaaca

SEQ ID NO: 1201004 - RNA, 19 nt, Homo sapiens
cuuuuaucuuggacugaca

SEQ ID NO: 1201005 - RNA, 13 nt, Homo sapiens
cuuuuauguagca

SEQ ID NO: 1201006 - RNA, 18 nt, Homo sapiens
cuuuuauugacacagaaa

SEQ ID NO: 1201007 - RNA, 23 nt, Homo sapiens
cuuuuauuuuuuaagguaacaaa

SEQ ID NO: 1201008 - RNA, 23 nt, Homo sapiens
cuuuucaaggaaaaaugcugcuu

SEQ ID NO: 1201009 - RNA, 23 nt, Homo sapiens
cuuuucaccaaaauuucuacacc

SEQ ID NO: 1201010 - RNA, 21 nt, Homo sapiens
cuuuucaccaggggugcucac

SEQ ID NO: 1201011 - RNA, 22 nt, Homo sapiens
cuuuucacucccuccaucaaga

SEQ ID NO: 1201012 - RNA, 15 nt, Homo sapiens
cuuuucauaaccuag

SEQ ID NO: 1201013 - RNA, 14 nt, Homo sapiens
cuuuucauguagaa

SEQ ID NO: 1201014 - RNA, 12 nt, Homo sapiens
cuuuucauuuaa

SEQ ID NO: 1201015 - RNA, 16 nt, Homo sapiens
cuuuuccacuccauug

SEQ ID NO: 1201016 - RNA, 15 nt, Homo sapiens
cuuuuccccagggau

SEQ ID NO: 1201017 - RNA, 16 nt, Homo sapiens
cuuuuccccaguccca

SEQ ID NO: 1201018 - RNA, 17 nt, Homo sapiens
cuuuuccccagucccag

SEQ ID NO: 1201019 - RNA, 16 nt, Homo sapiens
cuuuuccucaccagga

SEQ ID NO: 1201020 - RNA, 15 nt, Homo sapiens
cuuuuccuuucugcc

SEQ ID NO: 1201021 - RNA, 15 nt, Homo sapiens
cuuuucuagccuauu

SEQ ID NO: 1201022 - RNA, 22 nt, Homo sapiens
cuuuucuccucacuguauccag

SEQ ID NO: 1201023 - RNA, 13 nt, Homo sapiens
cuuuugagcauau

SEQ ID NO: 1201024 - RNA, 21 nt, Homo sapiens
cuuuugauccugggggaccaa

SEQ ID NO: 1201025 - RNA, 17 nt, Homo sapiens
cuuuugcaacuuaauac

SEQ ID NO: 1201026 - RNA, 10 nt, Homo sapiens
cuuuugccac

SEQ ID NO: 1201027 - RNA, 23 nt, Homo sapiens
cuuuugcuagagcugacagcuuu

SEQ ID NO: 1201028 - RNA, 22 nt, Homo sapiens
cuuuugggccuccuucccaugc

SEQ ID NO: 1201029 - RNA, 23 nt, Homo sapiens
cuuuugguguguuggacagagaa

SEQ ID NO: 1201030 - RNA, 21 nt, Homo sapiens
cuuuugguuuaaaaaguuuca

SEQ ID NO: 1201031 - RNA, 20 nt, Homo sapiens
cuuuuguaaaaaugucccca

SEQ ID NO: 1201032 - RNA, 17 nt, Homo sapiens
cuuuugugcaaagccaa

SEQ ID NO: 1201033 - RNA, 22 nt, Homo sapiens
cuuuugugcaaagccaaaaccu

SEQ ID NO: 1201034 - RNA, 13 nt, Homo sapiens
cuuuuguguacag

SEQ ID NO: 1201035 - RNA, 20 nt, Homo sapiens
cuuuugugugccugguagaa

SEQ ID NO: 1201036 - RNA, 18 nt, Homo sapiens
cuuuuuaaagaaugcucu

SEQ ID NO: 1201037 - RNA, 17 nt, Homo sapiens
cuuuuuaauaaagugga

SEQ ID NO: 1201038 - RNA, 14 nt, Homo sapiens
cuugauuucacugg

SEQ ID NO: 1201039 - RNA, 13 nt, Homo sapiens
cuugauuuuugcc

SEQ ID NO: 1201040 - RNA, 19 nt, Homo sapiens
cuugcacccaggcccagcu

SEQ ID NO: 1201041 - RNA, 16 nt, Homo sapiens
cuugcagaacugccau

SEQ ID NO: 1201042 - RNA, 20 nt, Homo sapiens
cuugcagcuguaaacauauu

SEQ ID NO: 1201043 - RNA, 23 nt, Homo sapiens
cuugcagguuuucuucacugcca

SEQ ID NO: 1201044 - RNA, 14 nt, Homo sapiens
cuugccacauuucu

SEQ ID NO: 1201045 - RNA, 16 nt, Homo sapiens
cuugcccugaccuccc

SEQ ID NO: 1201046 - RNA, 21 nt, Homo sapiens
cuugccuaaauuuaaugcugc

SEQ ID NO: 1201047 - RNA, 19 nt, Homo sapiens
cuugccuaagacuugccca

SEQ ID NO: 1201048 - RNA, 19 nt, Homo sapiens
cuugcuaccugggauucca

SEQ ID NO: 1201049 - RNA, 16 nt, Homo sapiens
cuugcugauggcuuga

SEQ ID NO: 1201050 - RNA, 22 nt, Homo sapiens
cuugcugauggugacauugcac

SEQ ID NO: 1201051 - RNA, 16 nt, Homo sapiens
cuugcugcugagugca

SEQ ID NO: 1201052 - RNA, 15 nt, Homo sapiens
cuugcugcugcugca

SEQ ID NO: 1201053 - RNA, 22 nt, Homo sapiens
cuugcugcugcugcacccaacu

SEQ ID NO: 1201054 - RNA, 15 nt, Homo sapiens
cuugcuggcucugag

SEQ ID NO: 1201055 - RNA, 17 nt, Homo sapiens
cuugcugugugaccuca

SEQ ID NO: 1201056 - RNA, 22 nt, Homo sapiens
cuugcuugucauugacucuugc

SEQ ID NO: 1201057 - RNA, 23 nt, Homo sapiens
cuuggaaagcaucaccucaggcc

SEQ ID NO: 1201058 - RNA, 14 nt, Homo sapiens
cuuggaaggugaca

SEQ ID NO: 1201059 - RNA, 19 nt, Homo sapiens
cuuggacaggagucagugu

SEQ ID NO: 1201060 - RNA, 14 nt, Homo sapiens
cuuggagacuccug

SEQ ID NO: 1201061 - RNA, 14 nt, Homo sapiens
cuuggagauuuauc

SEQ ID NO: 1201062 - RNA, 22 nt, Homo sapiens
cuuggaggcccugcacugccag

SEQ ID NO: 1201063 - RNA, 19 nt, Homo sapiens
cuuggagggcccacuugua

SEQ ID NO: 1201064 - RNA, 14 nt, Homo sapiens
cuuggaugugguuu

SEQ ID NO: 1201065 - RNA, 13 nt, Homo sapiens
cuuggcacacucu

SEQ ID NO: 1201066 - RNA, 11 nt, Homo sapiens
cuuggccuagc

SEQ ID NO: 1201067 - RNA, 14 nt, Homo sapiens
cuuggcucugccag

SEQ ID NO: 1201068 - RNA, 16 nt, Homo sapiens
cuuggcugaauagcac

SEQ ID NO: 1201069 - RNA, 16 nt, Homo sapiens
cuuggcugauguugca

SEQ ID NO: 1201070 - RNA, 22 nt, Homo sapiens
cuuggcuuacugcagccuuugc

SEQ ID NO: 1201071 - RNA, 19 nt, Homo sapiens
cuuggcuuauccacuuuga

SEQ ID NO: 1201072 - RNA, 18 nt, Homo sapiens
cuuggcuucgugaaugua

SEQ ID NO: 1201073 - RNA, 21 nt, Homo sapiens
cuugggaaaaaaacuuggcac

SEQ ID NO: 1201074 - RNA, 14 nt, Homo sapiens
cuugggaccguguu

SEQ ID NO: 1201075 - RNA, 17 nt, Homo sapiens
cuugggagcaccgccug

SEQ ID NO: 1201076 - RNA, 17 nt, Homo sapiens
cuuggggagcacuuguc

SEQ ID NO: 1201077 - RNA, 23 nt, Homo sapiens
cuuggggaggcugauuucucaca

SEQ ID NO: 1201078 - RNA, 22 nt, Homo sapiens
cuugggucucauuuagaacuug

SEQ ID NO: 1201079 - RNA, 18 nt, Homo sapiens
cuugggugguuccuaagg

SEQ ID NO: 1201080 - RNA, 16 nt, Homo sapiens
cuugguacaguugcag

SEQ ID NO: 1201081 - RNA, 18 nt, Homo sapiens
cuugguacugaaaaugag

SEQ ID NO: 1201082 - RNA, 14 nt, Homo sapiens
cuuggugaugcugg

SEQ ID NO: 1201083 - RNA, 16 nt, Homo sapiens
cuuggugcugcugaau

SEQ ID NO: 1201084 - RNA, 19 nt, Homo sapiens
cagagaaucucuagugaau

SEQ ID NO: 1201085 - RNA, 20 nt, Homo sapiens
cagagaauucucuuauccaa

SEQ ID NO: 1201086 - RNA, 22 nt, Homo sapiens
cagagacacuaacgacuucagg

SEQ ID NO: 1201087 - RNA, 20 nt, Homo sapiens
cagagaccugaagugugcac

SEQ ID NO: 1201088 - RNA, 16 nt, Homo sapiens
cagagacuaucugauu

SEQ ID NO: 1201089 - RNA, 20 nt, Homo sapiens
cagagacuaucugauuuccu

SEQ ID NO: 1201090 - RNA, 13 nt, Homo sapiens
cagagacuaugua

SEQ ID NO: 1201091 - RNA, 15 nt, Homo sapiens
cagagagcagcuuca

SEQ ID NO: 1201092 - RNA, 15 nt, Homo sapiens
ccacacuaugcacag

SEQ ID NO: 1201093 - RNA, 23 nt, Homo sapiens
ccacagaacacagcaauuccuca

SEQ ID NO: 1201094 - RNA, 21 nt, Homo sapiens
ccacagagaaguuuguagcca

SEQ ID NO: 1201095 - RNA, 23 nt, Homo sapiens
ccacagagaaguuuguagccagg

SEQ ID NO: 1201096 - RNA, 18 nt, Homo sapiens
ccacagaugauacuucca

SEQ ID NO: 1201097 - RNA, 22 nt, Homo sapiens
ccacagcaucgggagcacccag

SEQ ID NO: 1201098 - RNA, 16 nt, Homo sapiens
ccacagccaugcccuu

SEQ ID NO: 1201099 - RNA, 19 nt, Homo sapiens
ccacagccugcaagucagu

SEQ ID NO: 1201100 - RNA, 21 nt, Homo sapiens
ccacagcgagggcagcugcua

SEQ ID NO: 1201101 - RNA, 19 nt, Homo sapiens
ccacaggcaaaacucagua

SEQ ID NO: 1201102 - RNA, 22 nt, Homo sapiens
ccacaguccuucuuugacacca

SEQ ID NO: 1201103 - RNA, 19 nt, Homo sapiens
ccacauacugcggaccaag

SEQ ID NO: 1201104 - RNA, 22 nt, Homo sapiens
ccacauauagagcuccagggac

SEQ ID NO: 1201105 - RNA, 22 nt, Homo sapiens
ccacauauuuuagacacuuccc

SEQ ID NO: 1201106 - RNA, 15 nt, Homo sapiens
ccacaugcuggugca

SEQ ID NO: 1201107 - RNA, 20 nt, Homo sapiens
ccacauguacagacauacau

SEQ ID NO: 1201108 - RNA, 18 nt, Homo sapiens
ccaccaagggaucugcca

SEQ ID NO: 1201109 - RNA, 19 nt, Homo sapiens
ccaccacauuuagaacuuu

SEQ ID NO: 1201110 - RNA, 19 nt, Homo sapiens
ccaccaccucaccaguuuc

SEQ ID NO: 1201111 - RNA, 15 nt, Homo sapiens
ccaccacugccugac

SEQ ID NO: 1201112 - RNA, 14 nt, Homo sapiens
ccaccagaugcuga

SEQ ID NO: 1201113 - RNA, 21 nt, Homo sapiens
ccaccauuccuggaaaccaca

SEQ ID NO: 1201114 - RNA, 19 nt, Homo sapiens
auucuauuuauauguacau

SEQ ID NO: 1201115 - RNA, 21 nt, Homo sapiens
auucuauuuauauguacauga

SEQ ID NO: 1201116 - RNA, 15 nt, Homo sapiens
auucucacaaggaaa

SEQ ID NO: 1201117 - RNA, 19 nt, Homo sapiens
auucucaucaguccauugc

SEQ ID NO: 1201118 - RNA, 17 nt, Homo sapiens
auucucccuuucacuaa

SEQ ID NO: 1201119 - RNA, 18 nt, Homo sapiens
auucucuacaugcucuuu

SEQ ID NO: 1201120 - RNA, 21 nt, Homo sapiens
auucucuaggagaaacuuaga

SEQ ID NO: 1201121 - RNA, 13 nt, Homo sapiens
auucucuauuuau

SEQ ID NO: 1201122 - RNA, 17 nt, Homo sapiens
auucucuccgccauuga

SEQ ID NO: 1201123 - RNA, 13 nt, Homo sapiens
auucucugagugg

SEQ ID NO: 1201124 - RNA, 19 nt, Homo sapiens
auucucuugacguuuacau

SEQ ID NO: 1201125 - RNA, 16 nt, Homo sapiens
auucugaccauggaua

SEQ ID NO: 1201126 - RNA, 23 nt, Homo sapiens
auucugauucuuuuuuaugcaga

SEQ ID NO: 1201127 - RNA, 16 nt, Homo sapiens
auucugccuagagugu

SEQ ID NO: 1201128 - RNA, 20 nt, Homo sapiens
auucugcguaugagucccau

SEQ ID NO: 1201129 - RNA, 20 nt, Homo sapiens
auucugcuacuucacuguca

SEQ ID NO: 1201130 - RNA, 14 nt, Homo sapiens
auucugcuuaccuu

SEQ ID NO: 1201131 - RNA, 14 nt, Homo sapiens
auucugguuuauuu

SEQ ID NO: 1201132 - RNA, 19 nt, Homo sapiens
auucuguacuuccaauuua

SEQ ID NO: 1201133 - RNA, 19 nt, Homo sapiens
auucuguaucauugauuca

SEQ ID NO: 1201134 - RNA, 18 nt, Homo sapiens
auucuguuccacacccaa

SEQ ID NO: 1201135 - RNA, 18 nt, Homo sapiens
auucuguuggccagugug

SEQ ID NO: 1201136 - RNA, 22 nt, Homo sapiens
auucuuacaauugcacugcugu

SEQ ID NO: 1201137 - RNA, 20 nt, Homo sapiens
auucuuacacugccuguaua

SEQ ID NO: 1201138 - RNA, 15 nt, Homo sapiens
auucuuagugacuuu

SEQ ID NO: 1201139 - RNA, 20 nt, Homo sapiens
auucuuauuuaaguuauuga

SEQ ID NO: 1201140 - RNA, 23 nt, Homo sapiens
auucuucaaccucauugacaaga

SEQ ID NO: 1201141 - RNA, 15 nt, Homo sapiens
auucuucacucagga

SEQ ID NO: 1201142 - RNA, 16 nt, Homo sapiens
auucuucacucaggac

SEQ ID NO: 1201143 - RNA, 12 nt, Homo sapiens
auucuucacucu

SEQ ID NO: 1201144 - RNA, 15 nt, Homo sapiens
auucuucacucuguu

SEQ ID NO: 1201145 - RNA, 21 nt, Homo sapiens
auucuugcuaugaaaaguuuc

SEQ ID NO: 1201146 - RNA, 15 nt, Homo sapiens
auucuugucacaaua

SEQ ID NO: 1201147 - RNA, 22 nt, Homo sapiens
auucuuguuggagacaugggau

SEQ ID NO: 1201148 - RNA, 19 nt, Homo sapiens
auucuuguuuuaagugccu

SEQ ID NO: 1201149 - RNA, 18 nt, Homo sapiens
auucuuuauucuuuuacu

SEQ ID NO: 1201150 - RNA, 15 nt, Homo sapiens
auucuuuuaagaaca

SEQ ID NO: 1201151 - RNA, 19 nt, Homo sapiens
auucuuuuggcaguucuga

SEQ ID NO: 1201152 - RNA, 15 nt, Homo sapiens
auucuuuuguaauau

SEQ ID NO: 1201153 - RNA, 15 nt, Homo sapiens
auucuuuuuuaugca

SEQ ID NO: 1201154 - RNA, 22 nt, Homo sapiens
auugaaaaugugaauugcauga

SEQ ID NO: 1201155 - RNA, 17 nt, Homo sapiens
auugaaagaaccagaga

SEQ ID NO: 1201156 - RNA, 23 nt, Homo sapiens
auugaaauaaaugacaauguaau

SEQ ID NO: 1201157 - RNA, 18 nt, Homo sapiens
auugaaauguuugcauaa

SEQ ID NO: 1201158 - RNA, 23 nt, Homo sapiens
auugaagcccuccaaaagcacuu

SEQ ID NO: 1201159 - RNA, 12 nt, Homo sapiens
auugaaugaaac

SEQ ID NO: 1201160 - RNA, 13 nt, Homo sapiens
auugaaugugauu

SEQ ID NO: 1201161 - RNA, 23 nt, Homo sapiens
auugacauguugucacauucuca

SEQ ID NO: 1201162 - RNA, 16 nt, Homo sapiens
auuacauaguccagug

SEQ ID NO: 1201163 - RNA, 17 nt, Homo sapiens
auuacauuucacuucaa

SEQ ID NO: 1201164 - RNA, 15 nt, Homo sapiens
auuaccagacaaaaa

SEQ ID NO: 1201165 - RNA, 16 nt, Homo sapiens
auuaccagacaaaaaa

SEQ ID NO: 1201166 - RNA, 21 nt, Homo sapiens
auuaccugccaauugcuaccg

SEQ ID NO: 1201167 - RNA, 16 nt, Homo sapiens
auuacuaucauaauuc

SEQ ID NO: 1201168 - RNA, 15 nt, Homo sapiens
auuacucagcacaga

SEQ ID NO: 1201169 - RNA, 15 nt, Homo sapiens
auuacugguccaaaa

SEQ ID NO: 1201170 - RNA, 13 nt, Homo sapiens
auuacugucuuua

SEQ ID NO: 1201171 - RNA, 19 nt, Homo sapiens
auuacuguugcauuuacuu

SEQ ID NO: 1201172 - RNA, 23 nt, Homo sapiens
auuacuuuugauccugggggacc

SEQ ID NO: 1201173 - RNA, 19 nt, Homo sapiens
auuagaaaaaaauuacuaa

SEQ ID NO: 1201174 - RNA, 15 nt, Homo sapiens
auuagaagucuuuca

SEQ ID NO: 1201175 - RNA, 16 nt, Homo sapiens
auuagaagucuuucag

SEQ ID NO: 1201176 - RNA, 16 nt, Homo sapiens
auuagaauauccauga

SEQ ID NO: 1201177 - RNA, 13 nt, Homo sapiens
auuagagaagcug

SEQ ID NO: 1201178 - RNA, 18 nt, Homo sapiens
auuagaggucuccaaaau

SEQ ID NO: 1201179 - RNA, 13 nt, Homo sapiens
auuagaugaacuc

SEQ ID NO: 1201180 - RNA, 22 nt, Homo sapiens
auuagauguuucaacugugcuc

SEQ ID NO: 1201181 - RNA, 14 nt, Homo sapiens
auuagcacagauuu

SEQ ID NO: 1201182 - RNA, 19 nt, Homo sapiens
auuagccauuucacucuca

SEQ ID NO: 1201183 - RNA, 18 nt, Homo sapiens
auuaggcuguaacuacuu

SEQ ID NO: 1201184 - RNA, 18 nt, Homo sapiens
auuaggucccucacucca

SEQ ID NO: 1201185 - RNA, 18 nt, Homo sapiens
auuaguacuuauguugca

SEQ ID NO: 1201186 - RNA, 20 nt, Homo sapiens
auuaguacuuauguugcaca

SEQ ID NO: 1201187 - RNA, 22 nt, Homo sapiens
auuagucuuggaaaaaaaccac

SEQ ID NO: 1201188 - RNA, 14 nt, Homo sapiens
auuauaaacccaca

SEQ ID NO: 1201189 - RNA, 23 nt, Homo sapiens
auuauaagggagagcugagccag

SEQ ID NO: 1201190 - RNA, 17 nt, Homo sapiens
auuauaauauacuauau

SEQ ID NO: 1201191 - RNA, 12 nt, Homo sapiens
auuauacagaua

SEQ ID NO: 1201192 - RNA, 13 nt, Homo sapiens
auuauacauuuga

SEQ ID NO: 1201193 - RNA, 18 nt, Homo sapiens
auuaucgggaacaguguu

SEQ ID NO: 1201194 - RNA, 17 nt, Homo sapiens
auuaucuauuaucucaa

SEQ ID NO: 1201195 - RNA, 14 nt, Homo sapiens
auuaugacaguuau

SEQ ID NO: 1201196 - RNA, 20 nt, Homo sapiens
auuaugaguaguguggaauu

SEQ ID NO: 1201197 - RNA, 20 nt, Homo sapiens
auuaugcauuauaucaaauc

SEQ ID NO: 1201198 - RNA, 18 nt, Homo sapiens
auuauguccacuguguau

SEQ ID NO: 1201199 - RNA, 16 nt, Homo sapiens
auuaugucguaaguca

SEQ ID NO: 1201200 - RNA, 13 nt, Homo sapiens
auuauuauuucca

SEQ ID NO: 1201201 - RNA, 15 nt, Homo sapiens
auuauuccuccagga

SEQ ID NO: 1201202 - RNA, 23 nt, Homo sapiens
auuauuccuccaggaaggagcaa

SEQ ID NO: 1201203 - RNA, 11 nt, Homo sapiens
auuauucugau

SEQ ID NO: 1201204 - RNA, 17 nt, Homo sapiens
auuauucuuuguuuccu

SEQ ID NO: 1201205 - RNA, 16 nt, Homo sapiens
auuauuggacagucuc

SEQ ID NO: 1201206 - RNA, 19 nt, Homo sapiens
auuauuuauugcuguguaa

SEQ ID NO: 1201207 - RNA, 14 nt, Homo sapiens
auuauuugugcuac

SEQ ID NO: 1201208 - RNA, 17 nt, Homo sapiens
auuauuuucuucaucca

SEQ ID NO: 1201209 - RNA, 13 nt, Homo sapiens
auuauuuugcacu

SEQ ID NO: 1201210 - RNA, 14 nt, Homo sapiens
auuauuuugcacug

SEQ ID NO: 1201211 - RNA, 19 nt, Homo sapiens
auuauuuuucacugcccca

SEQ ID NO: 1201212 - RNA, 14 nt, Homo sapiens
auucaaaagaucaa

SEQ ID NO: 1201213 - RNA, 19 nt, Homo sapiens
auucaaaagaugccauuca

SEQ ID NO: 1201214 - RNA, 13 nt, Homo sapiens
auucaaaauauaa

SEQ ID NO: 1201215 - RNA, 16 nt, Homo sapiens
aaacacacucaaaaga

SEQ ID NO: 1201216 - RNA, 21 nt, Homo sapiens
aaacacagcaacaaugacuua

SEQ ID NO: 1201217 - RNA, 22 nt, Homo sapiens
aaacacauucuuauugacaauu

SEQ ID NO: 1201218 - RNA, 22 nt, Homo sapiens
aaacaccaaacucauaacaguc

SEQ ID NO: 1201219 - RNA, 19 nt, Homo sapiens
aaacacccaucguucucug

SEQ ID NO: 1201220 - RNA, 21 nt, Homo sapiens
aaacaccggcagaaaacggag

SEQ ID NO: 1201221 - RNA, 17 nt, Homo sapiens
aaacacgaaacuuguua

SEQ ID NO: 1201222 - RNA, 19 nt, Homo sapiens
aaacacucaacaaacuuag

SEQ ID NO: 1201223 - RNA, 13 nt, Homo sapiens
aaacacuguggaa

SEQ ID NO: 1201224 - RNA, 14 nt, Homo sapiens
aaacacuuacagaa

SEQ ID NO: 1201225 - RNA, 17 nt, Homo sapiens
aaacacuuacagaauua

SEQ ID NO: 1201226 - RNA, 22 nt, Homo sapiens
aaacagccucuuuuugauacug

SEQ ID NO: 1201227 - RNA, 20 nt, Homo sapiens
aaacagcucagccagugggg

SEQ ID NO: 1201228 - RNA, 22 nt, Homo sapiens
aaacagggcugccuucuggccu

SEQ ID NO: 1201229 - RNA, 16 nt, Homo sapiens
aaacaggguaccucaa

SEQ ID NO: 1201230 - RNA, 11 nt, Homo sapiens
aaacagucaaa

SEQ ID NO: 1201231 - RNA, 18 nt, Homo sapiens
aaacauaaucuucugccu

SEQ ID NO: 1201232 - RNA, 22 nt, Homo sapiens
aaacauauccuuucaagacaga

SEQ ID NO: 1201233 - RNA, 14 nt, Homo sapiens
aaacauaucuugag

SEQ ID NO: 1201234 - RNA, 16 nt, Homo sapiens
aaacauauguucuccc

SEQ ID NO: 1201235 - RNA, 19 nt, Homo sapiens
aaacaugaccuuccacaau

SEQ ID NO: 1201236 - RNA, 19 nt, Homo sapiens
aaacaugcuaaauaguucu

SEQ ID NO: 1201237 - RNA, 20 nt, Homo sapiens
aaacaugcugaaaacuacac

SEQ ID NO: 1201238 - RNA, 17 nt, Homo sapiens
aaacauguaugugcauu

SEQ ID NO: 1201239 - RNA, 19 nt, Homo sapiens
aaacauuaaaugucuuaua

SEQ ID NO: 1201240 - RNA, 20 nt, Homo sapiens
aaacauuccccuccccacuc

SEQ ID NO: 1201241 - RNA, 21 nt, Homo sapiens
aaacauugaaguaaugaauuu

SEQ ID NO: 1201242 - RNA, 23 nt, Homo sapiens
aaacauugauuauaagcauguau

SEQ ID NO: 1201243 - RNA, 15 nt, Homo sapiens
aaacauuucauuucc

SEQ ID NO: 1201244 - RNA, 22 nt, Homo sapiens
aaacauuuuaauuuuaguuuca

SEQ ID NO: 1201245 - RNA, 22 nt, Homo sapiens
aaacauuuucaugcacaguaga

SEQ ID NO: 1201246 - RNA, 14 nt, Homo sapiens
aaaccacaacuuuu

SEQ ID NO: 1201247 - RNA, 14 nt, Homo sapiens
aaaccacaguccuc

SEQ ID NO: 1201248 - RNA, 12 nt, Homo sapiens
aaaccacuguac

SEQ ID NO: 1201249 - RNA, 13 nt, Homo sapiens
aaaccacuguaua

SEQ ID NO: 1201250 - RNA, 17 nt, Homo sapiens
aaaccagaaaagcaaua

SEQ ID NO: 1201251 - RNA, 15 nt, Homo sapiens
aaaccaggacauuaa

SEQ ID NO: 1201252 - RNA, 21 nt, Homo sapiens
aaaccauaaaacccuauacaa

SEQ ID NO: 1201253 - RNA, 18 nt, Homo sapiens
aaaccauaugaacauaua

SEQ ID NO: 1201254 - RNA, 15 nt, Homo sapiens
aaaccaucucucuuc

SEQ ID NO: 1201255 - RNA, 12 nt, Homo sapiens
aaaccaugacug

SEQ ID NO: 1201256 - RNA, 18 nt, Homo sapiens
aaaccaugagaauuugca

SEQ ID NO: 1201257 - RNA, 21 nt, Homo sapiens
aaacccaaucagaugccucag

SEQ ID NO: 1201258 - RNA, 15 nt, Homo sapiens
aaacccacaaaaaug

SEQ ID NO: 1201259 - RNA, 23 nt, Homo sapiens
aaacccacgauuuucuccagcuc

SEQ ID NO: 1201260 - RNA, 12 nt, Homo sapiens
aaacccagacaa

SEQ ID NO: 1201261 - RNA, 18 nt, Homo sapiens
aaacccagacaaccaaaa

SEQ ID NO: 1201262 - RNA, 18 nt, Homo sapiens
aaacccagagcggaagga

SEQ ID NO: 1201263 - RNA, 14 nt, Homo sapiens
aaacccauuuugaa

SEQ ID NO: 1201264 - RNA, 15 nt, Homo sapiens
aaaccccaaacuguu

SEQ ID NO: 1201265 - RNA, 22 nt, Homo sapiens
aaacccuauacaaguuguucua

SEQ ID NO: 1201266 - RNA, 11 nt, Homo sapiens
aaaccuaccaa

SEQ ID NO: 1201267 - RNA, 20 nt, Homo sapiens
aaaccuaggaccgucuugcu

SEQ ID NO: 1201268 - RNA, 14 nt, Homo sapiens
aaaccucaaaaugu

SEQ ID NO: 1201269 - RNA, 18 nt, Homo sapiens
aaaccucaaguaaacucc

SEQ ID NO: 1201270 - RNA, 18 nt, Homo sapiens
aaaccuccgccaaugcac

SEQ ID NO: 1201271 - RNA, 18 nt, Homo sapiens
aaaccugccaagagucaa

SEQ ID NO: 1201272 - RNA, 14 nt, Homo sapiens
aaaccugugugcca

SEQ ID NO: 1201273 - RNA, 17 nt, Homo sapiens
aaaccugugugccauuu

SEQ ID NO: 1201274 - RNA, 18 nt, Homo sapiens
aaaccuucagaagcuauu

SEQ ID NO: 1201275 - RNA, 13 nt, Homo sapiens
aaaccuucaguga

SEQ ID NO: 1201276 - RNA, 22 nt, Homo sapiens
aaaccuucaucugaaacccaca

SEQ ID NO: 1201277 - RNA, 14 nt, Homo sapiens
aaaccuuccucagc

SEQ ID NO: 1201278 - RNA, 15 nt, Homo sapiens
aaaccuugcacaggu

SEQ ID NO: 1201279 - RNA, 18 nt, Homo sapiens
aaaccuuggccucugcua

SEQ ID NO: 1201280 - RNA, 15 nt, Homo sapiens
aaaccuuguucuauu

SEQ ID NO: 1201281 - RNA, 16 nt, Homo sapiens
aaacgaaaugcuauga

SEQ ID NO: 1201282 - RNA, 13 nt, Homo sapiens
aaacgguucaguu

SEQ ID NO: 1201283 - RNA, 13 nt, Homo sapiens
aaacgguuccugg

SEQ ID NO: 1201284 - RNA, 16 nt, Homo sapiens
aaacuaacacccaguc

SEQ ID NO: 1201285 - RNA, 16 nt, Homo sapiens
aaacuaaccaucugaa

SEQ ID NO: 1201286 - RNA, 14 nt, Homo sapiens
aaacuaagcacaaa

SEQ ID NO: 1201287 - RNA, 14 nt, Homo sapiens
aaacuaaugugaua

SEQ ID NO: 1201288 - RNA, 15 nt, Homo sapiens
aaacuacaacgaaca

SEQ ID NO: 1201289 - RNA, 18 nt, Homo sapiens
aaacuacacaucccuaau

SEQ ID NO: 1201290 - RNA, 17 nt, Homo sapiens
aaacuacagacaaagag

SEQ ID NO: 1201291 - RNA, 19 nt, Homo sapiens
aaacuauuggaaaguacuc

SEQ ID NO: 1201292 - RNA, 13 nt, Homo sapiens
aaacucaagacaa

SEQ ID NO: 1201293 - RNA, 20 nt, Homo sapiens
aaacucaaugagcucuucca

SEQ ID NO: 1201294 - RNA, 11 nt, Homo sapiens
aaacucagugc

SEQ ID NO: 1201295 - RNA, 19 nt, Homo sapiens
aaacucauuacuuuuccau

SEQ ID NO: 1201296 - RNA, 19 nt, Homo sapiens
aaacuccugugucugugua

SEQ ID NO: 1201297 - RNA, 23 nt, Homo sapiens
aaacucuguccacgauucacuca

SEQ ID NO: 1201298 - RNA, 17 nt, Homo sapiens
aaacucuucagugcaaa

SEQ ID NO: 1201299 - RNA, 23 nt, Homo sapiens
aaacugaacuucagagcaugaaa

SEQ ID NO: 1201300 - RNA, 18 nt, Homo sapiens
aaacugacuaaacuuaca

SEQ ID NO: 1201301 - RNA, 16 nt, Homo sapiens
aaacugacuuuauccu

SEQ ID NO: 1201302 - RNA, 19 nt, Homo sapiens
aaacugauuuuuagcuuua

SEQ ID NO: 1201303 - RNA, 20 nt, Homo sapiens
aaacugcauuuccuuucuac

SEQ ID NO: 1201304 - RNA, 10 nt, Homo sapiens
aaacugccau

SEQ ID NO: 1201305 - RNA, 21 nt, Homo sapiens
aaacugcuuacuuaugccaua

SEQ ID NO: 1201306 - RNA, 19 nt, Homo sapiens
aaacuggacagucacugcc

SEQ ID NO: 1201307 - RNA, 15 nt, Homo sapiens
aaacugugaagcauu

SEQ ID NO: 1201308 - RNA, 20 nt, Homo sapiens
aaacuguuagcacuguugau

SEQ ID NO: 1201309 - RNA, 13 nt, Homo sapiens
aaacuguuuauau

SEQ ID NO: 1201310 - RNA, 13 nt, Homo sapiens
aaacuuaacuuua

SEQ ID NO: 1201311 - RNA, 16 nt, Homo sapiens
aaacuucaaagcugaa

SEQ ID NO: 1201312 - RNA, 23 nt, Homo sapiens
aaacuucaccuacauuaucucac

SEQ ID NO: 1201313 - RNA, 19 nt, Homo sapiens
aaacuucugaagacugaga

SEQ ID NO: 1201314 - RNA, 20 nt, Homo sapiens
aaacuucuugucagacauaa

SEQ ID NO: 1201315 - RNA, 15 nt, Homo sapiens
aaacuugcugguccu

SEQ ID NO: 1201316 - RNA, 23 nt, Homo sapiens
aaacuuggaauuuguaaccucag

SEQ ID NO: 1201317 - RNA, 10 nt, Homo sapiens
aaacuuguau

SEQ ID NO: 1201318 - RNA, 21 nt, Homo sapiens
aaacuugugaaugcuucucac

SEQ ID NO: 1201319 - RNA, 17 nt, Homo sapiens
aaacuuuauguacugcu

SEQ ID NO: 1201320 - RNA, 12 nt, Homo sapiens
aaagaaauccau

SEQ ID NO: 1201321 - RNA, 18 nt, Homo sapiens
aaagaacugaaagcacua

SEQ ID NO: 1201322 - RNA, 19 nt, Homo sapiens
aaagaacuuuagcauggua

SEQ ID NO: 1201323 - RNA, 14 nt, Homo sapiens
aaagaagacuggaa

SEQ ID NO: 1201324 - RNA, 16 nt, Homo sapiens
aaagaagacuggaagc

SEQ ID NO: 1201325 - RNA, 23 nt, Homo sapiens
aaagaagagaugagaaaugauga

SEQ ID NO: 1201326 - RNA, 16 nt, Homo sapiens
aaagaagccucagcuc

SEQ ID NO: 1201327 - RNA, 22 nt, Homo sapiens
aaagaaggaauucuaggcaucc

SEQ ID NO: 1201328 - RNA, 18 nt, Homo sapiens
aaagaagugaaacuauau

SEQ ID NO: 1201329 - RNA, 23 nt, Homo sapiens
aaagaagugccuuuaauuugcua

SEQ ID NO: 1201330 - RNA, 14 nt, Homo sapiens
aaagaauacagaaa

SEQ ID NO: 1201331 - RNA, 16 nt, Homo sapiens
aaagaaugcucuuuac

SEQ ID NO: 1201332 - RNA, 14 nt, Homo sapiens
aaagaauucuucca

SEQ ID NO: 1201333 - RNA, 16 nt, Homo sapiens
aaagacaaacaugcaa

SEQ ID NO: 1201334 - RNA, 16 nt, Homo sapiens
aaagacagaagcuuaa

SEQ ID NO: 1201335 - RNA, 14 nt, Homo sapiens
aaagacauagccaa

SEQ ID NO: 1201336 - RNA, 11 nt, Homo sapiens
aaagacaucag

SEQ ID NO: 1201337 - RNA, 13 nt, Homo sapiens
aaagacucugacc

SEQ ID NO: 1201338 - RNA, 12 nt, Homo sapiens
aaagacugccug

SEQ ID NO: 1201339 - RNA, 17 nt, Homo sapiens
aaagacuguacaaagua

SEQ ID NO: 1201340 - RNA, 17 nt, Homo sapiens
aaagagaaaaaccaaug

SEQ ID NO: 1201341 - RNA, 19 nt, Homo sapiens
aaagagacauauacuaaga

SEQ ID NO: 1201342 - RNA, 18 nt, Homo sapiens
aaagagagucgcaucuca

SEQ ID NO: 1201343 - RNA, 14 nt, Homo sapiens
augguagucacuaa

SEQ ID NO: 1201344 - RNA, 21 nt, Homo sapiens
augguaugcuggccagcaccc

SEQ ID NO: 1201345 - RNA, 20 nt, Homo sapiens
auggucaacacuuaaggguu

SEQ ID NO: 1201346 - RNA, 18 nt, Homo sapiens
auggucaaucccaaaagu

SEQ ID NO: 1201347 - RNA, 15 nt, Homo sapiens
auggucacacacuga

SEQ ID NO: 1201348 - RNA, 20 nt, Homo sapiens
augguccaggaucuccacug

SEQ ID NO: 1201349 - RNA, 23 nt, Homo sapiens
auggucucagccuaggcccucau

SEQ ID NO: 1201350 - RNA, 15 nt, Homo sapiens
auggugacagucucc

SEQ ID NO: 1201351 - RNA, 13 nt, Homo sapiens
auggugagcucug

SEQ ID NO: 1201352 - RNA, 16 nt, Homo sapiens
auggugauagacugaa

SEQ ID NO: 1201353 - RNA, 18 nt, Homo sapiens
auggugauuccagcaagu

SEQ ID NO: 1201354 - RNA, 20 nt, Homo sapiens
augguggcgcgcaccuguaa

SEQ ID NO: 1201355 - RNA, 19 nt, Homo sapiens
augguguagaacacuaauu

SEQ ID NO: 1201356 - RNA, 14 nt, Homo sapiens
augguguguuaaag

SEQ ID NO: 1201357 - RNA, 22 nt, Homo sapiens
augguguuauuuucugagagac

SEQ ID NO: 1201358 - RNA, 21 nt, Homo sapiens
augguuacuaaaaaguaccag

SEQ ID NO: 1201359 - RNA, 22 nt, Homo sapiens
augguuauuuaugcacuguggg

SEQ ID NO: 1201360 - RNA, 15 nt, Homo sapiens
augguugauggaaaa

SEQ ID NO: 1201361 - RNA, 17 nt, Homo sapiens
augguugauggaaaaua

SEQ ID NO: 1201362 - RNA, 14 nt, Homo sapiens
auguaaaacugaac

SEQ ID NO: 1201363 - RNA, 12 nt, Homo sapiens
auguaaaccaca

SEQ ID NO: 1201364 - RNA, 13 nt, Homo sapiens
auguaaacugcca

SEQ ID NO: 1201365 - RNA, 14 nt, Homo sapiens
auguaaacugccau

SEQ ID NO: 1201366 - RNA, 17 nt, Homo sapiens
auguaaacuuugucaug

SEQ ID NO: 1201367 - RNA, 13 nt, Homo sapiens
auguaaagccagc

SEQ ID NO: 1201368 - RNA, 23 nt, Homo sapiens
auguaacaucauaauuacauucc

SEQ ID NO: 1201369 - RNA, 15 nt, Homo sapiens
auguaaguacuucca

SEQ ID NO: 1201370 - RNA, 23 nt, Homo sapiens
auguaauauauuguacaaaugua

SEQ ID NO: 1201371 - RNA, 16 nt, Homo sapiens
auguaaugcauaggaa

SEQ ID NO: 1201372 - RNA, 17 nt, Homo sapiens
auguacaauaaagcaau

SEQ ID NO: 1201373 - RNA, 21 nt, Homo sapiens
auguacaugaagaagcuaaau

SEQ ID NO: 1201374 - RNA, 16 nt, Homo sapiens
auguagaccugugaga

SEQ ID NO: 1201375 - RNA, 22 nt, Homo sapiens
auguagcaauggcacuguugca

SEQ ID NO: 1201376 - RNA, 15 nt, Homo sapiens
auguagcccauccuu

SEQ ID NO: 1201377 - RNA, 22 nt, Homo sapiens
auguagccuuuacuguuugaua

SEQ ID NO: 1201378 - RNA, 21 nt, Homo sapiens
auguaguauuaaaaguugcau

SEQ ID NO: 1201379 - RNA, 17 nt, Homo sapiens
auguaguuacuuccuuu

SEQ ID NO: 1201380 - RNA, 20 nt, Homo sapiens
auguaucccaacuccuauaa

SEQ ID NO: 1201381 - RNA, 19 nt, Homo sapiens
auguaucucaguaccccau

SEQ ID NO: 1201382 - RNA, 13 nt, Homo sapiens
auguaucugugaa

SEQ ID NO: 1201383 - RNA, 21 nt, Homo sapiens
auguaucuuggugcugcugaa

SEQ ID NO: 1201384 - RNA, 22 nt, Homo sapiens
auguaugcaaaccucaucuuuc

SEQ ID NO: 1201385 - RNA, 14 nt, Homo sapiens
auguauguagcgua

SEQ ID NO: 1201386 - RNA, 22 nt, Homo sapiens
auguaugucuuggacacuguac

SEQ ID NO: 1201387 - RNA, 14 nt, Homo sapiens
auguaugugcacug

SEQ ID NO: 1201388 - RNA, 21 nt, Homo sapiens
auguauuuauuugggagaccg

SEQ ID NO: 1201389 - RNA, 16 nt, Homo sapiens
augucaaacaguaaua

SEQ ID NO: 1201390 - RNA, 17 nt, Homo sapiens
augucaaauaaagcaaa

SEQ ID NO: 1201391 - RNA, 16 nt, Homo sapiens
augucaacagagcaag

SEQ ID NO: 1201392 - RNA, 18 nt, Homo sapiens
augucaacagagcaagga

SEQ ID NO: 1201393 - RNA, 22 nt, Homo sapiens
augucaacuucuggcuccucaa

SEQ ID NO: 1201394 - RNA, 18 nt, Homo sapiens
augucacagggccaacuu

SEQ ID NO: 1201395 - RNA, 14 nt, Homo sapiens
augucagacuggcu

SEQ ID NO: 1201396 - RNA, 15 nt, Homo sapiens
augucaguauuucaa

SEQ ID NO: 1201397 - RNA, 15 nt, Homo sapiens
augucagucucucac

SEQ ID NO: 1201398 - RNA, 23 nt, Homo sapiens
augucaucaaauauuaccaaaaa

SEQ ID NO: 1201399 - RNA, 12 nt, Homo sapiens
augucauuuagu

SEQ ID NO: 1201400 - RNA, 11 nt, Homo sapiens
auguccaaaga

SEQ ID NO: 1201401 - RNA, 14 nt, Homo sapiens
auguccaccacuuc

SEQ ID NO: 1201402 - RNA, 22 nt, Homo sapiens
auguccaugauggaauauuccc

SEQ ID NO: 1201403 - RNA, 17 nt, Homo sapiens
auguccauuuauaucau

SEQ ID NO: 1201404 - RNA, 15 nt, Homo sapiens
augucccaacuugua

SEQ ID NO: 1201405 - RNA, 19 nt, Homo sapiens
auguccuaaggacacacua

SEQ ID NO: 1201406 - RNA, 23 nt, Homo sapiens
auguccuauucccugucacuaca

SEQ ID NO: 1201407 - RNA, 13 nt, Homo sapiens
auguccuggacac

SEQ ID NO: 1201408 - RNA, 22 nt, Homo sapiens
augucuaauaaaauauaaucua

SEQ ID NO: 1201409 - RNA, 13 nt, Homo sapiens
augucuaccucug

SEQ ID NO: 1201410 - RNA, 18 nt, Homo sapiens
augucuagccacugauca

SEQ ID NO: 1201411 - RNA, 17 nt, Homo sapiens
augucuauaaucccagc

SEQ ID NO: 1201412 - RNA, 22 nt, Homo sapiens
augucuauaaucccagcacuuu

SEQ ID NO: 1201413 - RNA, 15 nt, Homo sapiens
augucuauguagcug

SEQ ID NO: 1201414 - RNA, 19 nt, Homo sapiens
augucuauguagcugaaaa

SEQ ID NO: 1201415 - RNA, 16 nt, Homo sapiens
augucuauucagcuuc

SEQ ID NO: 1201416 - RNA, 20 nt, Homo sapiens
augucucccaggacaagcca

SEQ ID NO: 1201417 - RNA, 15 nt, Homo sapiens
augucucgcuaguga

SEQ ID NO: 1201418 - RNA, 16 nt, Homo sapiens
augucucuaaagcacu

SEQ ID NO: 1201419 - RNA, 21 nt, Homo sapiens
augucucuaagccaacuuuaa

SEQ ID NO: 1201420 - RNA, 19 nt, Homo sapiens
augucucucuugagcuaca

SEQ ID NO: 1201421 - RNA, 21 nt, Homo sapiens
augucucuuuggcgaccuccu

SEQ ID NO: 1201422 - RNA, 15 nt, Homo sapiens
augucugauaaugau

SEQ ID NO: 1201423 - RNA, 17 nt, Homo sapiens
augucugauaaugauuu

SEQ ID NO: 1201424 - RNA, 18 nt, Homo sapiens
augucuguaccuugauac

SEQ ID NO: 1201425 - RNA, 22 nt, Homo sapiens
augucuguagcuccucaacuca

SEQ ID NO: 1201426 - RNA, 21 nt, Homo sapiens
augucuuccuuggagggggga

SEQ ID NO: 1201427 - RNA, 17 nt, Homo sapiens
augucuuguacaugugu

SEQ ID NO: 1201428 - RNA, 19 nt, Homo sapiens
augugaaaauaaagcagaa

SEQ ID NO: 1201429 - RNA, 17 nt, Homo sapiens
augugaaaauauacuug

SEQ ID NO: 1201430 - RNA, 16 nt, Homo sapiens
augugacauuccauga

SEQ ID NO: 1201431 - RNA, 17 nt, Homo sapiens
augugaggaaaugauga

SEQ ID NO: 1201432 - RNA, 18 nt, Homo sapiens
augugagugccuuuugca

SEQ ID NO: 1201433 - RNA, 21 nt, Homo sapiens
augugagugccuuuugcagaa

SEQ ID NO: 1201434 - RNA, 17 nt, Homo sapiens
augugcacuaccauagc

SEQ ID NO: 1201435 - RNA, 15 nt, Homo sapiens
augugcagcuauuua

SEQ ID NO: 1201436 - RNA, 19 nt, Homo sapiens
augugcagguuuugaaaau

SEQ ID NO: 1201437 - RNA, 13 nt, Homo sapiens
augugccauuuau

SEQ ID NO: 1201438 - RNA, 23 nt, Homo sapiens
augugccuguagucccaggcuga

SEQ ID NO: 1201439 - RNA, 14 nt, Homo sapiens
augugcuaugaagc

SEQ ID NO: 1201440 - RNA, 22 nt, Homo sapiens
augugcuauuggcccagcuuuu

SEQ ID NO: 1201441 - RNA, 13 nt, Homo sapiens
augugcucaugca

SEQ ID NO: 1201442 - RNA, 20 nt, Homo sapiens
auguggaccucuacuuucca

SEQ ID NO: 1201443 - RNA, 22 nt, Homo sapiens
auguggcaaggaaaaacagguc

SEQ ID NO: 1201444 - RNA, 17 nt, Homo sapiens
augugguauacaauucu

SEQ ID NO: 1201445 - RNA, 21 nt, Homo sapiens
auguggucuaagguucagccu

SEQ ID NO: 1201446 - RNA, 13 nt, Homo sapiens
auguggucucagg

SEQ ID NO: 1201447 - RNA, 22 nt, Homo sapiens
auguguaagaacaacuaccuga

SEQ ID NO: 1201448 - RNA, 13 nt, Homo sapiens
auguguaccucag

SEQ ID NO: 1201449 - RNA, 17 nt, Homo sapiens
auguguaugugccauuu

SEQ ID NO: 1201450 - RNA, 15 nt, Homo sapiens
augugucacuugugc

SEQ ID NO: 1201451 - RNA, 18 nt, Homo sapiens
auguguccccucacucug

SEQ ID NO: 1201452 - RNA, 22 nt, Homo sapiens
auguguccccucacucugucag

SEQ ID NO: 1201453 - RNA, 19 nt, Homo sapiens
auguguguguauguuugca

SEQ ID NO: 1201454 - RNA, 15 nt, Homo sapiens
auguguuacuucaag

SEQ ID NO: 1201455 - RNA, 19 nt, Homo sapiens
auguguuuuucuccagugc

SEQ ID NO: 1201456 - RNA, 13 nt, Homo sapiens
auguuaaagggau

SEQ ID NO: 1201457 - RNA, 13 nt, Homo sapiens
auguuaacuagaa

SEQ ID NO: 1201458 - RNA, 21 nt, Homo sapiens
auguuacucaugacuccuuuc

SEQ ID NO: 1201459 - RNA, 14 nt, Homo sapiens
auguuacugaccag

SEQ ID NO: 1201460 - RNA, 12 nt, Homo sapiens
auguuacuuugg

SEQ ID NO: 1201461 - RNA, 21 nt, Homo sapiens
auguuagauuccucuugccuc

SEQ ID NO: 1201462 - RNA, 19 nt, Homo sapiens
auguuagggugcucuggaa

SEQ ID NO: 1201463 - RNA, 14 nt, Homo sapiens
auguuauaucauau

SEQ ID NO: 1201464 - RNA, 22 nt, Homo sapiens
auguuauuuuguguacaaguug

SEQ ID NO: 1201465 - RNA, 13 nt, Homo sapiens
auguucacuguga

SEQ ID NO: 1201466 - RNA, 21 nt, Homo sapiens
auguuccucccaggguuucca

SEQ ID NO: 1201467 - RNA, 22 nt, Homo sapiens
auguucuaaauaaaaagcauua

SEQ ID NO: 1201468 - RNA, 14 nt, Homo sapiens
auguucuaauacuu

SEQ ID NO: 1201469 - RNA, 17 nt, Homo sapiens
auguucuaauacuuugu

SEQ ID NO: 1201470 - RNA, 22 nt, Homo sapiens
auguucuaggauaguugaugca

SEQ ID NO: 1201471 - RNA, 17 nt, Homo sapiens
auguucucugaggacac

SEQ ID NO: 1201472 - RNA, 15 nt, Homo sapiens
auguucugacauuaa

SEQ ID NO: 1201473 - RNA, 16 nt, Homo sapiens
auguucugggacacag

SEQ ID NO: 1201474 - RNA, 14 nt, Homo sapiens
auguugcccaggca

SEQ ID NO: 1201475 - RNA, 15 nt, Homo sapiens
auguugcucagucuc

SEQ ID NO: 1201476 - RNA, 18 nt, Homo sapiens
auguugggaaacuuggcu

SEQ ID NO: 1201477 - RNA, 13 nt, Homo sapiens
auguuggucaaaa

SEQ ID NO: 1201478 - RNA, 15 nt, Homo sapiens
auguugguguuccac

SEQ ID NO: 1201479 - RNA, 23 nt, Homo sapiens
auguuguguggcaaugggauuug

SEQ ID NO: 1201480 - RNA, 19 nt, Homo sapiens
auguuuaaggaaaugugca

SEQ ID NO: 1201481 - RNA, 20 nt, Homo sapiens
auguuuaaggaaaugugcag

SEQ ID NO: 1201482 - RNA, 16 nt, Homo sapiens
auguuuaccaguguag

SEQ ID NO: 1201483 - RNA, 21 nt, Homo sapiens
auguuuauaaaucuuaugcuc

SEQ ID NO: 1201484 - RNA, 15 nt, Homo sapiens
auguuuaugagccag

SEQ ID NO: 1201485 - RNA, 23 nt, Homo sapiens
auguuuaugauaauaaaggcacc

SEQ ID NO: 1201486 - RNA, 15 nt, Homo sapiens
auguuucaaauacuu

SEQ ID NO: 1201487 - RNA, 14 nt, Homo sapiens
auguuugacacaau

SEQ ID NO: 1201488 - RNA, 18 nt, Homo sapiens
auguuugcacuugugcuu

SEQ ID NO: 1201489 - RNA, 14 nt, Homo sapiens
auguuugcacuuug

SEQ ID NO: 1201490 - RNA, 22 nt, Homo sapiens
auguuugcuauugacaagucau

SEQ ID NO: 1201491 - RNA, 13 nt, Homo sapiens
auguuugucagau

SEQ ID NO: 1201492 - RNA, 17 nt, Homo sapiens
auguuuguggccucaga

SEQ ID NO: 1201493 - RNA, 15 nt, Homo sapiens
auuaaaaaaauggaa

SEQ ID NO: 1201494 - RNA, 17 nt, Homo sapiens
auuaaaaaaucagagaa

SEQ ID NO: 1201495 - RNA, 14 nt, Homo sapiens
auuaaaaacuacca

SEQ ID NO: 1201496 - RNA, 19 nt, Homo sapiens
auuaaaacuaagcacaaag

SEQ ID NO: 1201497 - RNA, 12 nt, Homo sapiens
auuaaaauaaga

SEQ ID NO: 1201498 - RNA, 13 nt, Homo sapiens
auuaaaauuccaa

SEQ ID NO: 1201499 - RNA, 12 nt, Homo sapiens
auuaaacaaaua

SEQ ID NO: 1201500 - RNA, 19 nt, Homo sapiens
auuaaagaauguuuuggaa

SEQ ID NO: 1201501 - RNA, 11 nt, Homo sapiens
auuaaagucag

SEQ ID NO: 1201502 - RNA, 14 nt, Homo sapiens
auuaaauccaauaa

SEQ ID NO: 1201503 - RNA, 14 nt, Homo sapiens
auuaaauucacaaa

SEQ ID NO: 1201504 - RNA, 19 nt, Homo sapiens
auuaacaguuuuccaugaa

SEQ ID NO: 1201505 - RNA, 23 nt, Homo sapiens
auuaacaugcuuaugacaaugac

SEQ ID NO: 1201506 - RNA, 22 nt, Homo sapiens
auuaaccucugcacuacugaca

SEQ ID NO: 1201507 - RNA, 12 nt, Homo sapiens
auuaacuugagu

SEQ ID NO: 1201508 - RNA, 13 nt, Homo sapiens
auuaacuuuacau

SEQ ID NO: 1201509 - RNA, 20 nt, Homo sapiens
auuaagaauugguugccaua

SEQ ID NO: 1201510 - RNA, 18 nt, Homo sapiens
auuaagggucguuuuagg

SEQ ID NO: 1201511 - RNA, 17 nt, Homo sapiens
auuaaguaaaccaaaaa

SEQ ID NO: 1201512 - RNA, 17 nt, Homo sapiens
auuaauaguuugucuau

SEQ ID NO: 1201513 - RNA, 16 nt, Homo sapiens
auuaauauauccuaaa

SEQ ID NO: 1201514 - RNA, 21 nt, Homo sapiens
auuaauauugcagucaaucuc

SEQ ID NO: 1201515 - RNA, 15 nt, Homo sapiens
auuaaucaccuucuu

SEQ ID NO: 1201516 - RNA, 12 nt, Homo sapiens
auuaaugaacua

SEQ ID NO: 1201517 - RNA, 12 nt, Homo sapiens
auuaaugaugau

SEQ ID NO: 1201518 - RNA, 23 nt, Homo sapiens
auuaaugcuauacuggaaaugua

SEQ ID NO: 1201519 - RNA, 13 nt, Homo sapiens
auuaauguuaauu

SEQ ID NO: 1201520 - RNA, 19 nt, Homo sapiens
auuaauuccaacuguacuu

SEQ ID NO: 1201521 - RNA, 20 nt, Homo sapiens
auuaauucuauaaggccaua

SEQ ID NO: 1201522 - RNA, 17 nt, Homo sapiens
auuaauugucauuauuu

SEQ ID NO: 1201523 - RNA, 19 nt, Homo sapiens
auuaauuguuuugcacuuu

SEQ ID NO: 1201524 - RNA, 23 nt, Homo sapiens
auuaauuuggagcacaaaauuca

SEQ ID NO: 1201525 - RNA, 19 nt, Homo sapiens
auuaauuuuccaaugcaca

SEQ ID NO: 1201526 - RNA, 16 nt, Homo sapiens
auuacaaaaaaacacg

SEQ ID NO: 1201527 - RNA, 19 nt, Homo sapiens
auuacaaggcuuuaucuca

SEQ ID NO: 1201528 - RNA, 22 nt, Homo sapiens
auuacaaggcuuuaucucaggg

SEQ ID NO: 1201529 - RNA, 14 nt, Homo sapiens
auuacaauugucau

SEQ ID NO: 1201530 - RNA, 14 nt, Homo sapiens
auuacaauugugag

SEQ ID NO: 1201531 - RNA, 18 nt, Homo sapiens
auuacacggagugugcua

SEQ ID NO: 1201532 - RNA, 19 nt, Homo sapiens
auuacacggagugugcuaa

SEQ ID NO: 1201533 - RNA, 11 nt, Homo sapiens
auuacagacau

SEQ ID NO: 1201534 - RNA, 22 nt, Homo sapiens
auuacagacaugaacugccagg

SEQ ID NO: 1201535 - RNA, 17 nt, Homo sapiens
auuacagcuuucacagu

SEQ ID NO: 1201536 - RNA, 15 nt, Homo sapiens
auuacaggcaccugc

SEQ ID NO: 1201537 - RNA, 15 nt, Homo sapiens
auuacaguguagcua

SEQ ID NO: 1201538 - RNA, 20 nt, Homo sapiens
auuacaguuaaagaagcaau

SEQ ID NO: 1201539 - RNA, 13 nt, Homo sapiens
ccacccaaaacac

SEQ ID NO: 1201540 - RNA, 15 nt, Homo sapiens
ccacccacaaucaca

SEQ ID NO: 1201541 - RNA, 13 nt, Homo sapiens
ccacccacaugug

SEQ ID NO: 1201542 - RNA, 15 nt, Homo sapiens
ccacccaccuuugcc

SEQ ID NO: 1201543 - RNA, 17 nt, Homo sapiens
ccacccccgccaugcaa

SEQ ID NO: 1201544 - RNA, 22 nt, Homo sapiens
ccaccccggcccccgaacugug

SEQ ID NO: 1201545 - RNA, 14 nt, Homo sapiens
ccacccgaugcugc

SEQ ID NO: 1201546 - RNA, 15 nt, Homo sapiens
ccacccuaccaugaa

SEQ ID NO: 1201547 - RNA, 14 nt, Homo sapiens
ccacccugggagac

SEQ ID NO: 1201548 - RNA, 21 nt, Homo sapiens
ccaccuaaaaacauuuacuga

SEQ ID NO: 1201549 - RNA, 16 nt, Homo sapiens
ccaccucacagccaga

SEQ ID NO: 1201550 - RNA, 18 nt, Homo sapiens
ccaccucccauuacuuug

SEQ ID NO: 1201551 - RNA, 15 nt, Homo sapiens
ccaccuccugcaaua

SEQ ID NO: 1201552 - RNA, 16 nt, Homo sapiens
ccaccugacucuugca

SEQ ID NO: 1201553 - RNA, 22 nt, Homo sapiens
ccaccugcaugaacacaguggc

SEQ ID NO: 1201554 - RNA, 16 nt, Homo sapiens
ccaccugccugcaucu

SEQ ID NO: 1201555 - RNA, 13 nt, Homo sapiens
ccaccuguacugu

SEQ ID NO: 1201556 - RNA, 15 nt, Homo sapiens
ccacgaggugcagua

SEQ ID NO: 1201557 - RNA, 20 nt, Homo sapiens
ccacgggaaaggagcugcuu

SEQ ID NO: 1201558 - RNA, 13 nt, Homo sapiens
ccacguaucuuuc

SEQ ID NO: 1201559 - RNA, 24 nt, Homo sapiens
ccacgucuggccaggcacugccuu

SEQ ID NO: 1201560 - RNA, 19 nt, Homo sapiens
ccacuaccguaaaugucca

SEQ ID NO: 1201561 - RNA, 12 nt, Homo sapiens
ccacuacugcag

SEQ ID NO: 1201562 - RNA, 20 nt, Homo sapiens
ccacuagaagcaacuaggaa

SEQ ID NO: 1201563 - RNA, 18 nt, Homo sapiens
ccacucaggauugggaau

SEQ ID NO: 1201564 - RNA, 15 nt, Homo sapiens
ccacucaggccaaca

SEQ ID NO: 1201565 - RNA, 20 nt, Homo sapiens
ccacucagguucuucagggc

SEQ ID NO: 1201566 - RNA, 12 nt, Homo sapiens
ccacuccacuca

SEQ ID NO: 1201567 - RNA, 16 nt, Homo sapiens
ccacucccugcuccac

SEQ ID NO: 1201568 - RNA, 16 nt, Homo sapiens
ccacucuguaauaguu

SEQ ID NO: 1201569 - RNA, 16 nt, Homo sapiens
ccacugagaagucaaa

SEQ ID NO: 1201570 - RNA, 24 nt, Homo sapiens
ccacugaugcuguucucuucuuca

SEQ ID NO: 1201571 - RNA, 14 nt, Homo sapiens
ccacugcaaaacac

SEQ ID NO: 1201572 - RNA, 22 nt, Homo sapiens
ccacugcacuccagucuggcaa

SEQ ID NO: 1201573 - RNA, 20 nt, Homo sapiens
ccacugcccugggcagccau

SEQ ID NO: 1201574 - RNA, 12 nt, Homo sapiens
ccacugcuccau

SEQ ID NO: 1201575 - RNA, 19 nt, Homo sapiens
ccacuggacagacccaggu

SEQ ID NO: 1201576 - RNA, 10 nt, Homo sapiens
ccacugggag

SEQ ID NO: 1201577 - RNA, 20 nt, Homo sapiens
ccacugggccauuguggugu

SEQ ID NO: 1201578 - RNA, 18 nt, Homo sapiens
ccacuggggaaugcuccc

SEQ ID NO: 1201579 - RNA, 20 nt, Homo sapiens
ccacuguacauuuuuauaca

SEQ ID NO: 1201580 - RNA, 14 nt, Homo sapiens
ccacuguaugagug

SEQ ID NO: 1201581 - RNA, 18 nt, Homo sapiens
ccacuguggcacuggcca

SEQ ID NO: 1201582 - RNA, 20 nt, Homo sapiens
ccacugugguggcaguggag

SEQ ID NO: 1201583 - RNA, 13 nt, Homo sapiens
ccacuuaccucaa

SEQ ID NO: 1201584 - RNA, 19 nt, Homo sapiens
ccacuuagaaauugcauuu

SEQ ID NO: 1201585 - RNA, 19 nt, Homo sapiens
ccacuuugcacauuuugau

SEQ ID NO: 1201586 - RNA, 21 nt, Homo sapiens
ccacuuuuaacagaacagaca

SEQ ID NO: 1201587 - RNA, 20 nt, Homo sapiens
ccagaaaaccagucuguguu

SEQ ID NO: 1201588 - RNA, 21 nt, Homo sapiens
ccagaaaaccagucuguguuu

SEQ ID NO: 1201589 - RNA, 13 nt, Homo sapiens
ccagaaaugucua

SEQ ID NO: 1201590 - RNA, 18 nt, Homo sapiens
ccagaacugcacucuuca

SEQ ID NO: 1201591 - RNA, 18 nt, Homo sapiens
ccagaaggaaucuucuca

SEQ ID NO: 1201592 - RNA, 17 nt, Homo sapiens
ccagaauggagccugcu

SEQ ID NO: 1201593 - RNA, 17 nt, Homo sapiens
ccagaaugugaagacaa

SEQ ID NO: 1201594 - RNA, 14 nt, Homo sapiens
ccagacaaccaaaa

SEQ ID NO: 1201595 - RNA, 16 nt, Homo sapiens
ccagacaaccaaaaca

SEQ ID NO: 1201596 - RNA, 15 nt, Homo sapiens
ccagacaauuccauu

SEQ ID NO: 1201597 - RNA, 13 nt, Homo sapiens
ccagacacagugc

SEQ ID NO: 1201598 - RNA, 19 nt, Homo sapiens
ccagacaccagugcgugcu

SEQ ID NO: 1201599 - RNA, 13 nt, Homo sapiens
ccagacccggcug

SEQ ID NO: 1201600 - RNA, 14 nt, Homo sapiens
ccagacggugugca

SEQ ID NO: 1201601 - RNA, 17 nt, Homo sapiens
ccagacucugagcugcu

SEQ ID NO: 1201602 - RNA, 21 nt, Homo sapiens
ccagacuggaaugcagugaca

SEQ ID NO: 1201603 - RNA, 12 nt, Homo sapiens
ccagacuucaaa

SEQ ID NO: 1201604 - RNA, 14 nt, Homo sapiens
ccagagaauucuua

SEQ ID NO: 1201605 - RNA, 14 nt, Homo sapiens
ccagagagcagcuu

SEQ ID NO: 1201606 - RNA, 19 nt, Homo sapiens
ccagagaggguggugaccu

SEQ ID NO: 1201607 - RNA, 13 nt, Homo sapiens
ccagagaugcugg

SEQ ID NO: 1201608 - RNA, 20 nt, Homo sapiens
ccagagcggcuucaccugcg

SEQ ID NO: 1201609 - RNA, 15 nt, Homo sapiens
ccagagcugugccag

SEQ ID NO: 1201610 - RNA, 20 nt, Homo sapiens
ccagaggcagcucgugugcc

SEQ ID NO: 1201611 - RNA, 18 nt, Homo sapiens
ccagaggcccuggcuccu

SEQ ID NO: 1201612 - RNA, 19 nt, Homo sapiens
ccagaggcuauuauuuuca

SEQ ID NO: 1201613 - RNA, 14 nt, Homo sapiens
ccagaggcucuaau

SEQ ID NO: 1201614 - RNA, 22 nt, Homo sapiens
ccagaggcucuaauguacaaua

SEQ ID NO: 1201615 - RNA, 23 nt, Homo sapiens
ccagaggcucuaauguacaauaa

SEQ ID NO: 1201616 - RNA, 17 nt, Homo sapiens
ccagagguuaucugccu

SEQ ID NO: 1201617 - RNA, 15 nt, Homo sapiens
ccagaguuguucucu

SEQ ID NO: 1201618 - RNA, 13 nt, Homo sapiens
ccagauaccagcc

SEQ ID NO: 1201619 - RNA, 19 nt, Homo sapiens
ccagauagcagggcaugaa

SEQ ID NO: 1201620 - RNA, 15 nt, Homo sapiens
ccagaucacugccac

SEQ ID NO: 1201621 - RNA, 16 nt, Homo sapiens
ccagauccagacugua

SEQ ID NO: 1201622 - RNA, 18 nt, Homo sapiens
ccagaucgauccuggauu

SEQ ID NO: 1201623 - RNA, 19 nt, Homo sapiens
ccagaucgcaccacugcac

SEQ ID NO: 1201624 - RNA, 13 nt, Homo sapiens
ccagaucuuucag

SEQ ID NO: 1201625 - RNA, 19 nt, Homo sapiens
ccagaugagaagucugcua

SEQ ID NO: 1201626 - RNA, 18 nt, Homo sapiens
ccagauugacgacaagug

SEQ ID NO: 1201627 - RNA, 20 nt, Homo sapiens
ccagauuuaaaaaaagaaca

SEQ ID NO: 1201628 - RNA, 13 nt, Homo sapiens
ccagcaaggcagg

SEQ ID NO: 1201629 - RNA, 17 nt, Homo sapiens
ccagcaaugacaucuca

SEQ ID NO: 1201630 - RNA, 19 nt, Homo sapiens
ccagcaauuccugagccaa

SEQ ID NO: 1201631 - RNA, 20 nt, Homo sapiens
ccagcacacggcugccugac

SEQ ID NO: 1201632 - RNA, 12 nt, Homo sapiens
ccagcaccacuu

SEQ ID NO: 1201633 - RNA, 12 nt, Homo sapiens
ccagcacuggaa

SEQ ID NO: 1201634 - RNA, 12 nt, Homo sapiens
ccagcacuuugg

SEQ ID NO: 1201635 - RNA, 21 nt, Homo sapiens
ccagcacuuugggaggcugag

SEQ ID NO: 1201636 - RNA, 20 nt, Homo sapiens
ccagcagaagcaggguaccc

SEQ ID NO: 1201637 - RNA, 17 nt, Homo sapiens
ccagcagcccaagcuua

SEQ ID NO: 1201638 - RNA, 21 nt, Homo sapiens
ccagcaggagccagccaaggc

SEQ ID NO: 1201639 - RNA, 20 nt, Homo sapiens
ccagcaggagcucugacuaa

SEQ ID NO: 1201640 - RNA, 19 nt, Homo sapiens
ccagcagugccuugugcaa

SEQ ID NO: 1201641 - RNA, 19 nt, Homo sapiens
ccagcagugucacucugua

SEQ ID NO: 1201642 - RNA, 12 nt, Homo sapiens
cuagaagccaag

SEQ ID NO: 1201643 - RNA, 15 nt, Homo sapiens
cuagaagccaaggga

SEQ ID NO: 1201644 - RNA, 20 nt, Homo sapiens
cuagaauuauaagucacaaa

SEQ ID NO: 1201645 - RNA, 22 nt, Homo sapiens
cuagacccagguggagggcaca

SEQ ID NO: 1201646 - RNA, 23 nt, Homo sapiens
cuagacguucauuugugugcuca

SEQ ID NO: 1201647 - RNA, 22 nt, Homo sapiens
cuagacuaagaagauuuaguuu

SEQ ID NO: 1201648 - RNA, 18 nt, Homo sapiens
cuagacuagacaucacaa

SEQ ID NO: 1201649 - RNA, 19 nt, Homo sapiens
cuagacucuucacuguuag

SEQ ID NO: 1201650 - RNA, 19 nt, Homo sapiens
cuagacuucccaacagccu

SEQ ID NO: 1201651 - RNA, 22 nt, Homo sapiens
cuagacuucccaacagccuuag

SEQ ID NO: 1201652 - RNA, 12 nt, Homo sapiens
cuagacuuucug

SEQ ID NO: 1201653 - RNA, 15 nt, Homo sapiens
cuagagccagaccaa

SEQ ID NO: 1201654 - RNA, 15 nt, Homo sapiens
cuagagggggucuca

SEQ ID NO: 1201655 - RNA, 23 nt, Homo sapiens
cuagagucacugauacacagaau

SEQ ID NO: 1201656 - RNA, 19 nt, Homo sapiens
cuagaugauggaugccaau

SEQ ID NO: 1201657 - RNA, 16 nt, Homo sapiens
cuagaugcaucacugg

SEQ ID NO: 1201658 - RNA, 22 nt, Homo sapiens
cuagauguguagggcugagggc

SEQ ID NO: 1201659 - RNA, 15 nt, Homo sapiens
cuagauuauaucaaa

SEQ ID NO: 1201660 - RNA, 17 nt, Homo sapiens
cuagauuuaacucaguu

SEQ ID NO: 1201661 - RNA, 18 nt, Homo sapiens
cuagauuuucuacuuuau

SEQ ID NO: 1201662 - RNA, 20 nt, Homo sapiens
cuagcaacccuaacaguaag

SEQ ID NO: 1201663 - RNA, 13 nt, Homo sapiens
cuagcauugcacu

SEQ ID NO: 1201664 - RNA, 23 nt, Homo sapiens
cuagcauuguaaaauuauuucau

SEQ ID NO: 1201665 - RNA, 19 nt, Homo sapiens
cuagccagaggcucuaaug

SEQ ID NO: 1201666 - RNA, 20 nt, Homo sapiens
cuagccaggaaguacuucca

SEQ ID NO: 1201667 - RNA, 15 nt, Homo sapiens
cuagccaucuugauc

SEQ ID NO: 1201668 - RNA, 23 nt, Homo sapiens
cuagccugcauaucauucaccca

SEQ ID NO: 1201669 - RNA, 15 nt, Homo sapiens
cuagcgcaagaccag

SEQ ID NO: 1201670 - RNA, 16 nt, Homo sapiens
cuagcuaauguaauaa

SEQ ID NO: 1201671 - RNA, 17 nt, Homo sapiens
cuagcuagaaauaugau

SEQ ID NO: 1201672 - RNA, 19 nt, Homo sapiens
cuagcuagaaauaugauuu

SEQ ID NO: 1201673 - RNA, 14 nt, Homo sapiens
cuagcugugggggu

SEQ ID NO: 1201674 - RNA, 20 nt, Homo sapiens
cuagcuuugcagucguguaa

SEQ ID NO: 1201675 - RNA, 19 nt, Homo sapiens
cuaggaaaaucacuugcca

SEQ ID NO: 1201676 - RNA, 18 nt, Homo sapiens
cuaggaggcuguggguuu

SEQ ID NO: 1201677 - RNA, 18 nt, Homo sapiens
cuaggaguugaguacagu

SEQ ID NO: 1201678 - RNA, 16 nt, Homo sapiens
cuaggaugaagcccua

SEQ ID NO: 1201679 - RNA, 23 nt, Homo sapiens
cuaggcagaucacguugcaaugg

SEQ ID NO: 1201680 - RNA, 23 nt, Homo sapiens
cuaggcauuucugggaagcccca

SEQ ID NO: 1201681 - RNA, 14 nt, Homo sapiens
cuaggcuaccucaa

SEQ ID NO: 1201682 - RNA, 20 nt, Homo sapiens
cuaggcuaccucaagacuca

SEQ ID NO: 1201683 - RNA, 14 nt, Homo sapiens
cuaggcugagcaau

SEQ ID NO: 1201684 - RNA, 22 nt, Homo sapiens
cuagggacaugaaauuuacaaa

SEQ ID NO: 1201685 - RNA, 22 nt, Homo sapiens
cuagggacccauuccuguguaa

SEQ ID NO: 1201686 - RNA, 16 nt, Homo sapiens
cuagggucuugggggu

SEQ ID NO: 1201687 - RNA, 22 nt, Homo sapiens
cuagggucuugggggucagggg

SEQ ID NO: 1201688 - RNA, 17 nt, Homo sapiens
cuagguaggggcccacu

SEQ ID NO: 1201689 - RNA, 13 nt, Homo sapiens
cuagguaucauuc

SEQ ID NO: 1201690 - RNA, 20 nt, Homo sapiens
cuaguaagaugcacugaaaa

SEQ ID NO: 1201691 - RNA, 19 nt, Homo sapiens
cuaguaaguaauuaugcac

SEQ ID NO: 1201692 - RNA, 19 nt, Homo sapiens
cuaguacugccccccauga

SEQ ID NO: 1201693 - RNA, 16 nt, Homo sapiens
cuaguagcuaaccauc

SEQ ID NO: 1201694 - RNA, 19 nt, Homo sapiens
cuaguauucgcuguguuca

SEQ ID NO: 1201695 - RNA, 22 nt, Homo sapiens
cuaguccccagccugcucccua

SEQ ID NO: 1201696 - RNA, 15 nt, Homo sapiens
cuaguccuugcugca

SEQ ID NO: 1201697 - RNA, 16 nt, Homo sapiens
cuagugacaagcuccu

SEQ ID NO: 1201698 - RNA, 16 nt, Homo sapiens
cuaguggucuuuguaa

SEQ ID NO: 1201699 - RNA, 18 nt, Homo sapiens
cuaguguucuguuuguua

SEQ ID NO: 1201700 - RNA, 17 nt, Homo sapiens
cuaguuaggagcccacc

SEQ ID NO: 1201701 - RNA, 20 nt, Homo sapiens
cuaguucagacacuuuggaa

SEQ ID NO: 1201702 - RNA, 17 nt, Homo sapiens
cuaguucccucugcuca

SEQ ID NO: 1201703 - RNA, 13 nt, Homo sapiens
cuaguucuaccuc

SEQ ID NO: 1201704 - RNA, 21 nt, Homo sapiens
cuaguuuucagcugcucagaa

SEQ ID NO: 1201705 - RNA, 20 nt, Homo sapiens
cuaguuuugucaaacuguag

SEQ ID NO: 1201706 - RNA, 23 nt, Homo sapiens
cuaguuuuuuugaaauccaaaga

SEQ ID NO: 1201707 - RNA, 20 nt, Homo sapiens
cuauaaaaugagaagucuca

SEQ ID NO: 1201708 - RNA, 22 nt, Homo sapiens
cuauaaagaagaacuugcaugg

SEQ ID NO: 1201709 - RNA, 17 nt, Homo sapiens
cuauaacaugucuuuca

SEQ ID NO: 1201710 - RNA, 18 nt, Homo sapiens
cuauaacaugucuuucag

SEQ ID NO: 1201711 - RNA, 15 nt, Homo sapiens
cuauaacuucuuccu

SEQ ID NO: 1201712 - RNA, 20 nt, Homo sapiens
cuauaagcaaauugcuuuuu

SEQ ID NO: 1201713 - RNA, 12 nt, Homo sapiens
cuauaagccaau

SEQ ID NO: 1201714 - RNA, 16 nt, Homo sapiens
cuauaagcccacuguu

SEQ ID NO: 1201715 - RNA, 18 nt, Homo sapiens
cuauaaggccauaaaaca

SEQ ID NO: 1201716 - RNA, 12 nt, Homo sapiens
cuauaaugugug

SEQ ID NO: 1201717 - RNA, 13 nt, Homo sapiens
cuauacacacaca

SEQ ID NO: 1201718 - RNA, 14 nt, Homo sapiens
cuauacacuagaca

SEQ ID NO: 1201719 - RNA, 20 nt, Homo sapiens
cuauacauagagcucuauuu

SEQ ID NO: 1201720 - RNA, 12 nt, Homo sapiens
cuauacaucucu

SEQ ID NO: 1201721 - RNA, 20 nt, Homo sapiens
cuauuaaucaccucucugua

SEQ ID NO: 1201722 - RNA, 13 nt, Homo sapiens
cuauuaucucaau

SEQ ID NO: 1201723 - RNA, 18 nt, Homo sapiens
cuauucaggagaguagaa

SEQ ID NO: 1201724 - RNA, 20 nt, Homo sapiens
cuauucccucucucucccag

SEQ ID NO: 1201725 - RNA, 16 nt, Homo sapiens
cuauuccuucuggccu

SEQ ID NO: 1201726 - RNA, 23 nt, Homo sapiens
cuauucuauaaaacucugcaugu

SEQ ID NO: 1201727 - RNA, 13 nt, Homo sapiens
cuauucuccauac

SEQ ID NO: 1201728 - RNA, 16 nt, Homo sapiens
cuauucuccauacucu

SEQ ID NO: 1201729 - RNA, 18 nt, Homo sapiens
cuauucuggauauuucau

SEQ ID NO: 1201730 - RNA, 19 nt, Homo sapiens
cuauugacaagucauuuua

SEQ ID NO: 1201731 - RNA, 21 nt, Homo sapiens
cuauugauguacagucuguca

SEQ ID NO: 1201732 - RNA, 24 nt, Homo sapiens
cuauugccccuuacgacucucacc

SEQ ID NO: 1201733 - RNA, 15 nt, Homo sapiens
cuauugugaccacag

SEQ ID NO: 1201734 - RNA, 15 nt, Homo sapiens
cuauuguuacauuau

SEQ ID NO: 1201735 - RNA, 16 nt, Homo sapiens
cuauuguuaccucuga

SEQ ID NO: 1201736 - RNA, 22 nt, Homo sapiens
cuauuuaauuauuucacuuuag

SEQ ID NO: 1201737 - RNA, 23 nt, Homo sapiens
cuauuuaccugcaggcugagcca

SEQ ID NO: 1201738 - RNA, 19 nt, Homo sapiens
cuauuuauauguacaugag

SEQ ID NO: 1201739 - RNA, 12 nt, Homo sapiens
cuauuuaugcaa

SEQ ID NO: 1201740 - RNA, 22 nt, Homo sapiens
cuauuuauggauaucacacaua

SEQ ID NO: 1201741 - RNA, 12 nt, Homo sapiens
cuauuuccagag

SEQ ID NO: 1201742 - RNA, 17 nt, Homo sapiens
cuauuuccauuccagaa

SEQ ID NO: 1201743 - RNA, 17 nt, Homo sapiens
cuauuucuccaaagccu

SEQ ID NO: 1201744 - RNA, 16 nt, Homo sapiens
cuauuucuguuccagu

SEQ ID NO: 1201745 - RNA, 18 nt, Homo sapiens
cuauuucuucuacugcua

SEQ ID NO: 1201746 - RNA, 15 nt, Homo sapiens
cuauuugaacaagug

SEQ ID NO: 1201747 - RNA, 21 nt, Homo sapiens
cuauuuguagauuaggauuaa

SEQ ID NO: 1201748 - RNA, 16 nt, Homo sapiens
cuauuuuaaugaauga

SEQ ID NO: 1201749 - RNA, 21 nt, Homo sapiens
cuauuuucagagcaugauaca

SEQ ID NO: 1201750 - RNA, 22 nt, Homo sapiens
cuauuuucagagcaugauacaa

SEQ ID NO: 1201751 - RNA, 24 nt, Homo sapiens
cucaaaaaaaaaaaaaugcacaua

SEQ ID NO: 1201752 - RNA, 16 nt, Homo sapiens
cucaaaaggaaaccaa

SEQ ID NO: 1201753 - RNA, 15 nt, Homo sapiens
cucaaagaucugaau

SEQ ID NO: 1201754 - RNA, 21 nt, Homo sapiens
cucaaagauuggauuuuacag

SEQ ID NO: 1201755 - RNA, 13 nt, Homo sapiens
cucaaaguuuuau

SEQ ID NO: 1201756 - RNA, 19 nt, Homo sapiens
cucaaaguuuuauuauaaa

SEQ ID NO: 1201757 - RNA, 23 nt, Homo sapiens
cucaaaucuauucagacaagcaa

SEQ ID NO: 1201758 - RNA, 13 nt, Homo sapiens
cucaaaucuccag

SEQ ID NO: 1201759 - RNA, 17 nt, Homo sapiens
cucaaauucaaugauuc

SEQ ID NO: 1201760 - RNA, 19 nt, Homo sapiens
cucaacaauaaaacauuau

SEQ ID NO: 1201761 - RNA, 20 nt, Homo sapiens
cucaaccccuccccuccauc

SEQ ID NO: 1201762 - RNA, 22 nt, Homo sapiens
cucaaccuccuguggaacccag

SEQ ID NO: 1201763 - RNA, 12 nt, Homo sapiens
cucaacuuuaag

SEQ ID NO: 1201764 - RNA, 14 nt, Homo sapiens
cucaagaaaucaaa

SEQ ID NO: 1201765 - RNA, 15 nt, Homo sapiens
cucaagaaaucaaaa

SEQ ID NO: 1201766 - RNA, 16 nt, Homo sapiens
cucaagacucaccuca

SEQ ID NO: 1201767 - RNA, 16 nt, Homo sapiens
cucaagaugaaggcaa

SEQ ID NO: 1201768 - RNA, 14 nt, Homo sapiens
cucaagauucagua

SEQ ID NO: 1201769 - RNA, 21 nt, Homo sapiens
cucaagcacugauaucuggcc

SEQ ID NO: 1201770 - RNA, 15 nt, Homo sapiens
cucaaggacuugaaa

SEQ ID NO: 1201771 - RNA, 19 nt, Homo sapiens
cucaagucuucccugauca

SEQ ID NO: 1201772 - RNA, 22 nt, Homo sapiens
cucaagugauucuccugccuca

SEQ ID NO: 1201773 - RNA, 14 nt, Homo sapiens
cucaagugucuuag

SEQ ID NO: 1201774 - RNA, 20 nt, Homo sapiens
cucaaguucauugaugaccc

SEQ ID NO: 1201775 - RNA, 19 nt, Homo sapiens
cucaauaaaugauucuuag

SEQ ID NO: 1201776 - RNA, 16 nt, Homo sapiens
cucaauauuaaagggu

SEQ ID NO: 1201777 - RNA, 19 nt, Homo sapiens
cucaaucacacugaagcca

SEQ ID NO: 1201778 - RNA, 22 nt, Homo sapiens
cucaaucacacugaagccacag

SEQ ID NO: 1201779 - RNA, 19 nt, Homo sapiens
cucaaucccugaggacuga

SEQ ID NO: 1201780 - RNA, 14 nt, Homo sapiens
cucaaugccaguaa

SEQ ID NO: 1201781 - RNA, 20 nt, Homo sapiens
cucaauggauuugaugcugu

SEQ ID NO: 1201782 - RNA, 10 nt, Homo sapiens
cucaauguuu

SEQ ID NO: 1201783 - RNA, 12 nt, Homo sapiens
cucaauucacau

SEQ ID NO: 1201784 - RNA, 17 nt, Homo sapiens
cucaauuguuaauguga

SEQ ID NO: 1201785 - RNA, 23 nt, Homo sapiens
cucaauuuugucuguacucaugu

SEQ ID NO: 1201786 - RNA, 22 nt, Homo sapiens
cucacaaaguagaggaauccau

SEQ ID NO: 1201787 - RNA, 16 nt, Homo sapiens
cucacaagcaugaagu

SEQ ID NO: 1201788 - RNA, 16 nt, Homo sapiens
cucacacuaaucugaa

SEQ ID NO: 1201789 - RNA, 15 nt, Homo sapiens
cucacacuuugccau

SEQ ID NO: 1201790 - RNA, 16 nt, Homo sapiens
cucacagaacuaugua

SEQ ID NO: 1201791 - RNA, 12 nt, Homo sapiens
cucacagaccug

SEQ ID NO: 1201792 - RNA, 14 nt, Homo sapiens
cucacagagugcau

SEQ ID NO: 1201793 - RNA, 23 nt, Homo sapiens
cucacagaguuaaauaugcaucu

SEQ ID NO: 1201794 - RNA, 20 nt, Homo sapiens
cucacagaugugacuguaua

SEQ ID NO: 1201795 - RNA, 15 nt, Homo sapiens
cucacagcacuuguu

SEQ ID NO: 1201796 - RNA, 20 nt, Homo sapiens
cucacauagcuacccaaaag

SEQ ID NO: 1201797 - RNA, 20 nt, Homo sapiens
aucuauauauguguauguac

SEQ ID NO: 1201798 - RNA, 14 nt, Homo sapiens
aucuaucaacuaua

SEQ ID NO: 1201799 - RNA, 10 nt, Homo sapiens
aucuauccaa

SEQ ID NO: 1201800 - RNA, 13 nt, Homo sapiens
aucuauuaucuca

SEQ ID NO: 1201801 - RNA, 15 nt, Homo sapiens
aucucaaagaaggca

SEQ ID NO: 1201802 - RNA, 17 nt, Homo sapiens
aucucaaugaaccauaa

SEQ ID NO: 1201803 - RNA, 22 nt, Homo sapiens
aucucaaugaaccauaaauuca

SEQ ID NO: 1201804 - RNA, 14 nt, Homo sapiens
aucucaauuugcag

SEQ ID NO: 1201805 - RNA, 19 nt, Homo sapiens
aucucacuuaguccuuuau

SEQ ID NO: 1201806 - RNA, 17 nt, Homo sapiens
aucucagccagccucca

SEQ ID NO: 1201807 - RNA, 23 nt, Homo sapiens
aucucagccagccuccagcaccu

SEQ ID NO: 1201808 - RNA, 15 nt, Homo sapiens
aucucagccuaccau

SEQ ID NO: 1201809 - RNA, 21 nt, Homo sapiens
aucucagcgccagcucuacca

SEQ ID NO: 1201810 - RNA, 20 nt, Homo sapiens
aucucaggauuucaccagaa

SEQ ID NO: 1201811 - RNA, 20 nt, Homo sapiens
aucucaggcaggaaagcccc

SEQ ID NO: 1201812 - RNA, 15 nt, Homo sapiens
aucucaggugccacu

SEQ ID NO: 1201813 - RNA, 12 nt, Homo sapiens
aucucagugcag

SEQ ID NO: 1201814 - RNA, 16 nt, Homo sapiens
aucucauggcagcuaa

SEQ ID NO: 1201815 - RNA, 15 nt, Homo sapiens
aucucauuccacugu

SEQ ID NO: 1201816 - RNA, 15 nt, Homo sapiens
aucucauugcuuaca

SEQ ID NO: 1201817 - RNA, 16 nt, Homo sapiens
aucucauuucuagaga

SEQ ID NO: 1201818 - RNA, 22 nt, Homo sapiens
aucucauuuuacacaaagggaa

SEQ ID NO: 1201819 - RNA, 15 nt, Homo sapiens
aucuccaucucaaaa

SEQ ID NO: 1201820 - RNA, 17 nt, Homo sapiens
aucucccacaaguauau

SEQ ID NO: 1201821 - RNA, 21 nt, Homo sapiens
aucucccacccuguaccucau

SEQ ID NO: 1201822 - RNA, 14 nt, Homo sapiens
aucucccacuccag

SEQ ID NO: 1201823 - RNA, 18 nt, Homo sapiens
aucucccagugacaacau

SEQ ID NO: 1201824 - RNA, 21 nt, Homo sapiens
aucuccccucacacuuugcca

SEQ ID NO: 1201825 - RNA, 17 nt, Homo sapiens
aucuccucagacaguaa

SEQ ID NO: 1201826 - RNA, 19 nt, Homo sapiens
aucucggcuguuccugaga

SEQ ID NO: 1201827 - RNA, 16 nt, Homo sapiens
aucucuaauauggcaa

SEQ ID NO: 1201828 - RNA, 20 nt, Homo sapiens
aucucuaauuccauccauaa

SEQ ID NO: 1201829 - RNA, 18 nt, Homo sapiens
aucucuacuaaaaacaca

SEQ ID NO: 1201830 - RNA, 16 nt, Homo sapiens
aucucuacuaccacaa

SEQ ID NO: 1201831 - RNA, 18 nt, Homo sapiens
aucucucagagcccucaa

SEQ ID NO: 1201832 - RNA, 15 nt, Homo sapiens
aucucuccagccgaa

SEQ ID NO: 1201833 - RNA, 16 nt, Homo sapiens
aucucucuagugaugg

SEQ ID NO: 1201834 - RNA, 15 nt, Homo sapiens
aucucugaaagcaca

SEQ ID NO: 1201835 - RNA, 22 nt, Homo sapiens
aucucugacuaaaaauacuuaa

SEQ ID NO: 1201836 - RNA, 16 nt, Homo sapiens
aucucugaggccucag

SEQ ID NO: 1201837 - RNA, 19 nt, Homo sapiens
aucucuguuauguacugua

SEQ ID NO: 1201838 - RNA, 22 nt, Homo sapiens
aucucuguucuguuuggcacuu

SEQ ID NO: 1201839 - RNA, 13 nt, Homo sapiens
aucucuuccacau

SEQ ID NO: 1201840 - RNA, 16 nt, Homo sapiens
aucucuuccuacccaa

SEQ ID NO: 1201841 - RNA, 21 nt, Homo sapiens
aucucuuccuccgaggccagu

SEQ ID NO: 1201842 - RNA, 17 nt, Homo sapiens
aucucuuuucuacauac

SEQ ID NO: 1201843 - RNA, 19 nt, Homo sapiens
aucucuuuucuacauacau

SEQ ID NO: 1201844 - RNA, 14 nt, Homo sapiens
aucugaaaauguau

SEQ ID NO: 1201845 - RNA, 13 nt, Homo sapiens
aucugaacacagu

SEQ ID NO: 1201846 - RNA, 21 nt, Homo sapiens
aucugacagacaaugauccag

SEQ ID NO: 1201847 - RNA, 19 nt, Homo sapiens
aucugacugccaagccaga

SEQ ID NO: 1201848 - RNA, 13 nt, Homo sapiens
aucugaguugcau

SEQ ID NO: 1201849 - RNA, 17 nt, Homo sapiens
aucugaguugccaagac

SEQ ID NO: 1201850 - RNA, 20 nt, Homo sapiens
aucugaguugccaagacaaa

SEQ ID NO: 1201851 - RNA, 14 nt, Homo sapiens
aucugauaagcaag

SEQ ID NO: 1201852 - RNA, 18 nt, Homo sapiens
aucugauauuuuaaaaag

SEQ ID NO: 1201853 - RNA, 15 nt, Homo sapiens
aucugauguuucaua

SEQ ID NO: 1201854 - RNA, 22 nt, Homo sapiens
aucugcauccagccuccugcua

SEQ ID NO: 1201855 - RNA, 19 nt, Homo sapiens
aucugcauuuagcacaaaa

SEQ ID NO: 1201856 - RNA, 16 nt, Homo sapiens
aucugccagaccuuaa

SEQ ID NO: 1201857 - RNA, 14 nt, Homo sapiens
aucugccaugugaa

SEQ ID NO: 1201858 - RNA, 16 nt, Homo sapiens
aucugccauugggacc

SEQ ID NO: 1201859 - RNA, 17 nt, Homo sapiens
aucugccuuaaaaccaa

SEQ ID NO: 1201860 - RNA, 18 nt, Homo sapiens
aucugcucaccagaucuc

SEQ ID NO: 1201861 - RNA, 20 nt, Homo sapiens
aucugcucaccagaucucag

SEQ ID NO: 1201862 - RNA, 23 nt, Homo sapiens
aucugcugaaggcagucauauca

SEQ ID NO: 1201863 - RNA, 15 nt, Homo sapiens
aucugcugcauagcu

SEQ ID NO: 1201864 - RNA, 19 nt, Homo sapiens
aucugcuguuaacugcaac

SEQ ID NO: 1201865 - RNA, 17 nt, Homo sapiens
aucuggaaggacaucua

SEQ ID NO: 1201866 - RNA, 22 nt, Homo sapiens
aucuggacagaacauuuauauc

SEQ ID NO: 1201867 - RNA, 20 nt, Homo sapiens
aucuggaguugaacagcaaa

SEQ ID NO: 1201868 - RNA, 18 nt, Homo sapiens
aucuggccuaauguucca

SEQ ID NO: 1201869 - RNA, 18 nt, Homo sapiens
aucuggcuuagugccacc

SEQ ID NO: 1201870 - RNA, 16 nt, Homo sapiens
aucuggguaagaagaa

SEQ ID NO: 1201871 - RNA, 22 nt, Homo sapiens
aucuggguaagaagaaagcaaa

SEQ ID NO: 1201872 - RNA, 15 nt, Homo sapiens
aucuguaaugauacu

SEQ ID NO: 1201873 - RNA, 19 nt, Homo sapiens
aucugugaaguaguucugu

SEQ ID NO: 1201874 - RNA, 17 nt, Homo sapiens
aucugugaugacauucc

SEQ ID NO: 1201875 - RNA, 20 nt, Homo sapiens
aucugugcaggauauuugca

SEQ ID NO: 1201876 - RNA, 21 nt, Homo sapiens
aucugugggucugggagucac

SEQ ID NO: 1201877 - RNA, 19 nt, Homo sapiens
agggaagccccacuugaag

SEQ ID NO: 1201878 - RNA, 15 nt, Homo sapiens
agggaagcucagggg

SEQ ID NO: 1201879 - RNA, 23 nt, Homo sapiens
agggaaggcuguuugagaaccau

SEQ ID NO: 1201880 - RNA, 21 nt, Homo sapiens
agggaaguaacauuugccuua

SEQ ID NO: 1201881 - RNA, 23 nt, Homo sapiens
agggaagugugagcgccuuggua

SEQ ID NO: 1201882 - RNA, 13 nt, Homo sapiens
agggaaugcauua

SEQ ID NO: 1201883 - RNA, 13 nt, Homo sapiens
agggacaagcccu

SEQ ID NO: 1201884 - RNA, 16 nt, Homo sapiens
agggacagaugaaugc

SEQ ID NO: 1201885 - RNA, 22 nt, Homo sapiens
agggacagcaugccccuuggcu

SEQ ID NO: 1201886 - RNA, 19 nt, Homo sapiens
agggaccacguugcugccu

SEQ ID NO: 1201887 - RNA, 15 nt, Homo sapiens
agggacccauuccug

SEQ ID NO: 1201888 - RNA, 12 nt, Homo sapiens
agggacucccac

SEQ ID NO: 1201889 - RNA, 12 nt, Homo sapiens
agggacugccuc

SEQ ID NO: 1201890 - RNA, 22 nt, Homo sapiens
agggacuuggacaggagucagu

SEQ ID NO: 1201891 - RNA, 15 nt, Homo sapiens
agggagaagcaugaa

SEQ ID NO: 1201892 - RNA, 13 nt, Homo sapiens
agggagagacuaa

SEQ ID NO: 1201893 - RNA, 21 nt, Homo sapiens
agggagagacuaaccuugagu

SEQ ID NO: 1201894 - RNA, 14 nt, Homo sapiens
agggagcugaguaa

SEQ ID NO: 1201895 - RNA, 19 nt, Homo sapiens
agggaggaggccaccucuc

SEQ ID NO: 1201896 - RNA, 13 nt, Homo sapiens
agggagggagcaa

SEQ ID NO: 1201897 - RNA, 16 nt, Homo sapiens
agggaggucacuggaa

SEQ ID NO: 1201898 - RNA, 19 nt, Homo sapiens
agggaguguuugugucuga

SEQ ID NO: 1201899 - RNA, 15 nt, Homo sapiens
agggauaagccagcu

SEQ ID NO: 1201900 - RNA, 21 nt, Homo sapiens
agggauacacaggacugaaaa

SEQ ID NO: 1201901 - RNA, 17 nt, Homo sapiens
agggaugcugccugagu

SEQ ID NO: 1201902 - RNA, 20 nt, Homo sapiens
agggauuaggagcagcucuu

SEQ ID NO: 1201903 - RNA, 19 nt, Homo sapiens
agggauuugaggugagggu

SEQ ID NO: 1201904 - RNA, 24 nt, Homo sapiens
agggauuuucacagugugcuccag

SEQ ID NO: 1201905 - RNA, 21 nt, Homo sapiens
agggauuuuuuuuuucagggc

SEQ ID NO: 1201906 - RNA, 22 nt, Homo sapiens
agggcacccuaguucuaccuca

SEQ ID NO: 1201907 - RNA, 15 nt, Homo sapiens
agggcagagccaugg

SEQ ID NO: 1201908 - RNA, 15 nt, Homo sapiens
agggcagcuccagug

SEQ ID NO: 1201909 - RNA, 18 nt, Homo sapiens
agggcagcuccagugcca

SEQ ID NO: 1201910 - RNA, 20 nt, Homo sapiens
agggcaguucugaguguuua

SEQ ID NO: 1201911 - RNA, 18 nt, Homo sapiens
agggcaucuccugugcau

SEQ ID NO: 1201912 - RNA, 21 nt, Homo sapiens
agggcauguguaugugucugc

SEQ ID NO: 1201913 - RNA, 20 nt, Homo sapiens
agggcauucgggccacaggg

SEQ ID NO: 1201914 - RNA, 21 nt, Homo sapiens
agggcauucgggccacagggc

SEQ ID NO: 1201915 - RNA, 23 nt, Homo sapiens
agggccacauagaugcugaugga

SEQ ID NO: 1201916 - RNA, 12 nt, Homo sapiens
agggccaggacu

SEQ ID NO: 1201917 - RNA, 19 nt, Homo sapiens
agggccaguugguguuccu

SEQ ID NO: 1201918 - RNA, 22 nt, Homo sapiens
agggcccagugacaaggcccug

SEQ ID NO: 1201919 - RNA, 17 nt, Homo sapiens
agggcccuccgaccacu

SEQ ID NO: 1201920 - RNA, 15 nt, Homo sapiens
agggcccuuguacaa

SEQ ID NO: 1201921 - RNA, 21 nt, Homo sapiens
agggccgacguuccaccuggg

SEQ ID NO: 1201922 - RNA, 18 nt, Homo sapiens
agggcgcucuuccaggca

SEQ ID NO: 1201923 - RNA, 13 nt, Homo sapiens
agggcugacauuu

SEQ ID NO: 1201924 - RNA, 21 nt, Homo sapiens
agggcugaccugccucucaca

SEQ ID NO: 1201925 - RNA, 18 nt, Homo sapiens
agggcugcccugagcgcc

SEQ ID NO: 1201926 - RNA, 18 nt, Homo sapiens
agggcugggccagugcau

SEQ ID NO: 1201927 - RNA, 16 nt, Homo sapiens
aggggacuugaaucuu

SEQ ID NO: 1201928 - RNA, 23 nt, Homo sapiens
aggggagcaaaaucgaugcagug

SEQ ID NO: 1201929 - RNA, 17 nt, Homo sapiens
aggggaggaucacugga

SEQ ID NO: 1201930 - RNA, 15 nt, Homo sapiens
aggggagggaucucc

SEQ ID NO: 1201931 - RNA, 21 nt, Homo sapiens
aggggauagagagagaccacu

SEQ ID NO: 1201932 - RNA, 23 nt, Homo sapiens
aggggcaggccugggacccagcu

SEQ ID NO: 1201933 - RNA, 22 nt, Homo sapiens
aggggccaucacaggaugccag

SEQ ID NO: 1201934 - RNA, 23 nt, Homo sapiens
aggggcccaaauucuuucagugg

SEQ ID NO: 1201935 - RNA, 17 nt, Homo sapiens
aggggccucccugugac

SEQ ID NO: 1201936 - RNA, 21 nt, Homo sapiens
aggggccuuagggcacugggc

SEQ ID NO: 1201937 - RNA, 22 nt, Homo sapiens
aggggccuugcugaguggcgca

SEQ ID NO: 1201938 - RNA, 17 nt, Homo sapiens
aucaucuguagauacua

SEQ ID NO: 1201939 - RNA, 15 nt, Homo sapiens
aucaugauggaauuu

SEQ ID NO: 1201940 - RNA, 17 nt, Homo sapiens
aucauggcugcuugauu

SEQ ID NO: 1201941 - RNA, 16 nt, Homo sapiens
aucaugggcuggacau

SEQ ID NO: 1201942 - RNA, 16 nt, Homo sapiens
aucaugguacauuuau

SEQ ID NO: 1201943 - RNA, 14 nt, Homo sapiens
aucaugguagucac

SEQ ID NO: 1201944 - RNA, 18 nt, Homo sapiens
aucaugguagucacuaac

SEQ ID NO: 1201945 - RNA, 19 nt, Homo sapiens
aucaugguagucacuaaca

SEQ ID NO: 1201946 - RNA, 14 nt, Homo sapiens
aucaugucauaaac

SEQ ID NO: 1201947 - RNA, 11 nt, Homo sapiens
aucauguuugu

SEQ ID NO: 1201948 - RNA, 16 nt, Homo sapiens
aucauucaacucucca

SEQ ID NO: 1201949 - RNA, 17 nt, Homo sapiens
aucauuguuuauuguau

SEQ ID NO: 1201950 - RNA, 19 nt, Homo sapiens
aucauuguuuauuguauac

SEQ ID NO: 1201951 - RNA, 20 nt, Homo sapiens
aucauuuacuuuuaaacuuu

SEQ ID NO: 1201952 - RNA, 23 nt, Homo sapiens
aucauuuacuuuuaaacuuugau

SEQ ID NO: 1201953 - RNA, 18 nt, Homo sapiens
auccaaaucagaggugca

SEQ ID NO: 1201954 - RNA, 18 nt, Homo sapiens
auccaaaucuugaauuuc

SEQ ID NO: 1201955 - RNA, 14 nt, Homo sapiens
auccaacauccaga

SEQ ID NO: 1201956 - RNA, 17 nt, Homo sapiens
auccaacuccagcaacu

SEQ ID NO: 1201957 - RNA, 17 nt, Homo sapiens
auccaacucucugagag

SEQ ID NO: 1201958 - RNA, 23 nt, Homo sapiens
auccaagaaggccuucauggccc

SEQ ID NO: 1201959 - RNA, 12 nt, Homo sapiens
auccaagaccug

SEQ ID NO: 1201960 - RNA, 23 nt, Homo sapiens
auccaagacuuagagcugggaau

SEQ ID NO: 1201961 - RNA, 21 nt, Homo sapiens
auccacaccguacaucugcaa

SEQ ID NO: 1201962 - RNA, 15 nt, Homo sapiens
auccacacugcacac

SEQ ID NO: 1201963 - RNA, 22 nt, Homo sapiens
auccacagagagucccacugcc

SEQ ID NO: 1201964 - RNA, 22 nt, Homo sapiens
auccacccaacccuaucuccug

SEQ ID NO: 1201965 - RNA, 16 nt, Homo sapiens
auccacccaccucagc

SEQ ID NO: 1201966 - RNA, 15 nt, Homo sapiens
auccacugugccaug

SEQ ID NO: 1201967 - RNA, 14 nt, Homo sapiens
auccacuuugacuc

SEQ ID NO: 1201968 - RNA, 14 nt, Homo sapiens
auccagaacugcac

SEQ ID NO: 1201969 - RNA, 17 nt, Homo sapiens
auccagaacugcacucu

SEQ ID NO: 1201970 - RNA, 23 nt, Homo sapiens
auccagcacuggugaacugagcu

SEQ ID NO: 1201971 - RNA, 20 nt, Homo sapiens
auccagcucuugcucaguga

SEQ ID NO: 1201972 - RNA, 22 nt, Homo sapiens
auccagcucuugcucagugaag

SEQ ID NO: 1201973 - RNA, 16 nt, Homo sapiens
auccagucucccaacu

SEQ ID NO: 1201974 - RNA, 12 nt, Homo sapiens
auccagugacaa

SEQ ID NO: 1201975 - RNA, 19 nt, Homo sapiens
auccauaguaacugacaug

SEQ ID NO: 1201976 - RNA, 16 nt, Homo sapiens
auccauauuuuacuga

SEQ ID NO: 1201977 - RNA, 24 nt, Homo sapiens
auccaucuuugaacuucugacuac

SEQ ID NO: 1201978 - RNA, 17 nt, Homo sapiens
auccaugcaccuaccuu

SEQ ID NO: 1201979 - RNA, 18 nt, Homo sapiens
auccauguaaauugcaaa

SEQ ID NO: 1201980 - RNA, 21 nt, Homo sapiens
auccauguuaguuuuuacuuu

SEQ ID NO: 1201981 - RNA, 13 nt, Homo sapiens
aucccaacuuccu

SEQ ID NO: 1201982 - RNA, 18 nt, Homo sapiens
aucccaagcccugcauug

SEQ ID NO: 1201983 - RNA, 17 nt, Homo sapiens
aucccacccacauguga

SEQ ID NO: 1201984 - RNA, 13 nt, Homo sapiens
aucccacuguaug

SEQ ID NO: 1201985 - RNA, 15 nt, Homo sapiens
aucccagcacuuugg

SEQ ID NO: 1201986 - RNA, 13 nt, Homo sapiens
aucccauggaaua

SEQ ID NO: 1201987 - RNA, 14 nt, Homo sapiens
auccccacaaucug

SEQ ID NO: 1201988 - RNA, 16 nt, Homo sapiens
auccccaggcaccuca

SEQ ID NO: 1201989 - RNA, 19 nt, Homo sapiens
aucccccagccucaagucu

SEQ ID NO: 1201990 - RNA, 21 nt, Homo sapiens
auccccguuccugacaucaca

SEQ ID NO: 1201991 - RNA, 15 nt, Homo sapiens
auccccucccaucau

SEQ ID NO: 1201992 - RNA, 17 nt, Homo sapiens
auccccuggcuccagag

SEQ ID NO: 1201993 - RNA, 19 nt, Homo sapiens
auccccuuuggcuaccuga

SEQ ID NO: 1201994 - RNA, 17 nt, Homo sapiens
aucccgaagaauggaga

SEQ ID NO: 1201995 - RNA, 16 nt, Homo sapiens
aucccgagucugggac

SEQ ID NO: 1201996 - RNA, 19 nt, Homo sapiens
aucccucgggaagcagcca

SEQ ID NO: 1201997 - RNA, 14 nt, Homo sapiens
aucccucuaaugag

SEQ ID NO: 1201998 - RNA, 15 nt, Homo sapiens
aucccugcagcucaa

SEQ ID NO: 1201999 - RNA, 23 nt, Homo sapiens
aucccugcggaggguuugguucu

SEQ ID NO: 1202000 - RNA, 18 nt, Homo sapiens
aucccugucauuuuuaac

SEQ ID NO: 1202001 - RNA, 17 nt, Homo sapiens
aucccuuaagaaguuag

SEQ ID NO: 1202002 - RNA, 16 nt, Homo sapiens
aucccuuuuuuuacau

SEQ ID NO: 1202003 - RNA, 19 nt, Homo sapiens
aucccuuuuuuuacauuuc

SEQ ID NO: 1202004 - RNA, 20 nt, Homo sapiens
aucccuuuuuuuacauuuca

SEQ ID NO: 1202005 - RNA, 13 nt, Homo sapiens
auccgaaguauga

SEQ ID NO: 1202006 - RNA, 14 nt, Homo sapiens
auccgccugccucu

SEQ ID NO: 1202007 - RNA, 17 nt, Homo sapiens
auccuaaaaaguuccau

SEQ ID NO: 1202008 - RNA, 15 nt, Homo sapiens
auccuaagacacaaa

SEQ ID NO: 1202009 - RNA, 20 nt, Homo sapiens
auccuacauaauacccagga

SEQ ID NO: 1202010 - RNA, 19 nt, Homo sapiens
auccuagaucaccacugga

SEQ ID NO: 1202011 - RNA, 14 nt, Homo sapiens
auccuagcaaauuc

SEQ ID NO: 1202012 - RNA, 15 nt, Homo sapiens
auccuagccaacauc

SEQ ID NO: 1202013 - RNA, 18 nt, Homo sapiens
auccucacccagcaccca

SEQ ID NO: 1202014 - RNA, 20 nt, Homo sapiens
auccucacugggugggguga

SEQ ID NO: 1202015 - RNA, 15 nt, Homo sapiens
auccucccaccucag

SEQ ID NO: 1202016 - RNA, 13 nt, Homo sapiens
auccugaauucca

SEQ ID NO: 1202017 - RNA, 22 nt, Homo sapiens
auccugaggcuccacuuggucu

SEQ ID NO: 1202018 - RNA, 19 nt, Homo sapiens
auccuggagggguguugua

SEQ ID NO: 1202019 - RNA, 13 nt, Homo sapiens
aggacucuuccac

SEQ ID NO: 1202020 - RNA, 17 nt, Homo sapiens
aggacugaaaagggaau

SEQ ID NO: 1202021 - RNA, 16 nt, Homo sapiens
aggacuuccauuugcu

SEQ ID NO: 1202022 - RNA, 13 nt, Homo sapiens
aggagaaacacau

SEQ ID NO: 1202023 - RNA, 17 nt, Homo sapiens
aggagaaacacaucuuc

SEQ ID NO: 1202024 - RNA, 21 nt, Homo sapiens
aggagaaccacuacaugcagc

SEQ ID NO: 1202025 - RNA, 21 nt, Homo sapiens
aggagaaggacauuuuacugc

SEQ ID NO: 1202026 - RNA, 17 nt, Homo sapiens
aggagaaucacuggaac

SEQ ID NO: 1202027 - RNA, 22 nt, Homo sapiens
aggagaauugaauucuggaaac

SEQ ID NO: 1202028 - RNA, 18 nt, Homo sapiens
aggagagagaaagccagg

SEQ ID NO: 1202029 - RNA, 15 nt, Homo sapiens
aggagagagccagga

SEQ ID NO: 1202030 - RNA, 23 nt, Homo sapiens
aggagaggcaacaggaggcauuc

SEQ ID NO: 1202031 - RNA, 14 nt, Homo sapiens
aggagauacugaac

SEQ ID NO: 1202032 - RNA, 20 nt, Homo sapiens
aggagaucgagaccauccug

SEQ ID NO: 1202033 - RNA, 15 nt, Homo sapiens
aggagauuccuuucc

SEQ ID NO: 1202034 - RNA, 16 nt, Homo sapiens
aggagauuucaugccu

SEQ ID NO: 1202035 - RNA, 11 nt, Homo sapiens
aggagcaggca

SEQ ID NO: 1202036 - RNA, 19 nt, Homo sapiens
aggagccaccaguucucau

SEQ ID NO: 1202037 - RNA, 22 nt, Homo sapiens
aggagcccgaagucugcugcug

SEQ ID NO: 1202038 - RNA, 18 nt, Homo sapiens
aggagcugauacuuugac

SEQ ID NO: 1202039 - RNA, 23 nt, Homo sapiens
aggagcugauacuuugacagugu

SEQ ID NO: 1202040 - RNA, 19 nt, Homo sapiens
aggagcugauuuccaggcc

SEQ ID NO: 1202041 - RNA, 20 nt, Homo sapiens
aggagcuugggugugcugac

SEQ ID NO: 1202042 - RNA, 17 nt, Homo sapiens
aggaggagacagccuca

SEQ ID NO: 1202043 - RNA, 23 nt, Homo sapiens
aggaggagcaccuccgccagauc

SEQ ID NO: 1202044 - RNA, 13 nt, Homo sapiens
aggaggcaagcaa

SEQ ID NO: 1202045 - RNA, 20 nt, Homo sapiens
aggaggcaagcaagcucucu

SEQ ID NO: 1202046 - RNA, 16 nt, Homo sapiens
aggaggcacugcugau

SEQ ID NO: 1202047 - RNA, 13 nt, Homo sapiens
aggaggccaauaa

SEQ ID NO: 1202048 - RNA, 17 nt, Homo sapiens
aggaggcuuugggacca

SEQ ID NO: 1202049 - RNA, 22 nt, Homo sapiens
aggagggaugcugccugaguca

SEQ ID NO: 1202050 - RNA, 16 nt, Homo sapiens
aggagggcccuaccug

SEQ ID NO: 1202051 - RNA, 16 nt, Homo sapiens
aggaggguugugcuac

SEQ ID NO: 1202052 - RNA, 20 nt, Homo sapiens
aggagguggagguugcagug

SEQ ID NO: 1202053 - RNA, 19 nt, Homo sapiens
aggagguucacugagcucc

SEQ ID NO: 1202054 - RNA, 14 nt, Homo sapiens
aggagguuugcagg

SEQ ID NO: 1202055 - RNA, 17 nt, Homo sapiens
aggaguacaaugcccag

SEQ ID NO: 1202056 - RNA, 19 nt, Homo sapiens
aggaguacuccaagacaga

SEQ ID NO: 1202057 - RNA, 14 nt, Homo sapiens
aggaguaggacaaa

SEQ ID NO: 1202058 - RNA, 16 nt, Homo sapiens
aggagucaaaacuaca

SEQ ID NO: 1202059 - RNA, 17 nt, Homo sapiens
aggagugccacuucaug

SEQ ID NO: 1202060 - RNA, 18 nt, Homo sapiens
aggaguucaagaccagcc

SEQ ID NO: 1202061 - RNA, 21 nt, Homo sapiens
aggaguuggaauguuguaguu

SEQ ID NO: 1202062 - RNA, 21 nt, Homo sapiens
aggaguuuuggcagccagacu

SEQ ID NO: 1202063 - RNA, 20 nt, Homo sapiens
aggauaaccuugugccuugg

SEQ ID NO: 1202064 - RNA, 13 nt, Homo sapiens
aggauaagccacu

SEQ ID NO: 1202065 - RNA, 22 nt, Homo sapiens
aggauaccaaauaccauguaca

SEQ ID NO: 1202066 - RNA, 14 nt, Homo sapiens
aggauaucuuggcu

SEQ ID NO: 1202067 - RNA, 13 nt, Homo sapiens
aggauauuaacaa

SEQ ID NO: 1202068 - RNA, 17 nt, Homo sapiens
aggaucaaagaacugaa

SEQ ID NO: 1202069 - RNA, 19 nt, Homo sapiens
aggaucaguugaggccagg

SEQ ID NO: 1202070 - RNA, 17 nt, Homo sapiens
aggaucccuuugcugug

SEQ ID NO: 1202071 - RNA, 15 nt, Homo sapiens
aggaucucugagacc

SEQ ID NO: 1202072 - RNA, 23 nt, Homo sapiens
aggaugaaucauauucauaugca

SEQ ID NO: 1202073 - RNA, 20 nt, Homo sapiens
aggaugaauguaugugcacu

SEQ ID NO: 1202074 - RNA, 18 nt, Homo sapiens
agcugucaggcugauuau

SEQ ID NO: 1202075 - RNA, 17 nt, Homo sapiens
agcugucccaccugcac

SEQ ID NO: 1202076 - RNA, 19 nt, Homo sapiens
agcugucccucacuguuga

SEQ ID NO: 1202077 - RNA, 23 nt, Homo sapiens
agcuguccugcagcaaacacucc

SEQ ID NO: 1202078 - RNA, 15 nt, Homo sapiens
agcugugaacaggcu

SEQ ID NO: 1202079 - RNA, 15 nt, Homo sapiens
agcugugacuucucc

SEQ ID NO: 1202080 - RNA, 16 nt, Homo sapiens
agcugugacuucucca

SEQ ID NO: 1202081 - RNA, 15 nt, Homo sapiens
agcugugcaggcaug

SEQ ID NO: 1202082 - RNA, 17 nt, Homo sapiens
agcuguuccuguucagu

SEQ ID NO: 1202083 - RNA, 17 nt, Homo sapiens
agcuguugugugagguu

SEQ ID NO: 1202084 - RNA, 17 nt, Homo sapiens
agcuguuuauggccuca

SEQ ID NO: 1202085 - RNA, 19 nt, Homo sapiens
agcuguuuggccaaugugc

SEQ ID NO: 1202086 - RNA, 16 nt, Homo sapiens
agcuuaaaaucuguga

SEQ ID NO: 1202087 - RNA, 17 nt, Homo sapiens
agcuuaaaaucugugaa

SEQ ID NO: 1202088 - RNA, 14 nt, Homo sapiens
agcuuaaauugcuu

SEQ ID NO: 1202089 - RNA, 21 nt, Homo sapiens
agcuuaacaaugcaacuuuua

SEQ ID NO: 1202090 - RNA, 15 nt, Homo sapiens
agcuuaagaaccauu

SEQ ID NO: 1202091 - RNA, 12 nt, Homo sapiens
agcuuaagucau

SEQ ID NO: 1202092 - RNA, 18 nt, Homo sapiens
agcuuaagucauggaauu

SEQ ID NO: 1202093 - RNA, 13 nt, Homo sapiens
agcuuaccugaca

SEQ ID NO: 1202094 - RNA, 17 nt, Homo sapiens
agcuuaccugacacaag

SEQ ID NO: 1202095 - RNA, 18 nt, Homo sapiens
agcuuaccugacacaaga

SEQ ID NO: 1202096 - RNA, 17 nt, Homo sapiens
agcuuaucucuuuuaua

SEQ ID NO: 1202097 - RNA, 19 nt, Homo sapiens
agcuuaucuuucuuuccau

SEQ ID NO: 1202098 - RNA, 17 nt, Homo sapiens
agcuucaccagagcauu

SEQ ID NO: 1202099 - RNA, 20 nt, Homo sapiens
agcuucaccagagcauuucc

SEQ ID NO: 1202100 - RNA, 14 nt, Homo sapiens
agcuucagacuuuu

SEQ ID NO: 1202101 - RNA, 15 nt, Homo sapiens
agcuucagaugguga

SEQ ID NO: 1202102 - RNA, 21 nt, Homo sapiens
agcuucauauaccagcaauau

SEQ ID NO: 1202103 - RNA, 12 nt, Homo sapiens
agcuucaugccu

SEQ ID NO: 1202104 - RNA, 12 nt, Homo sapiens
agcuuccaugag

SEQ ID NO: 1202105 - RNA, 22 nt, Homo sapiens
agcuucccgaguaacugagauu

SEQ ID NO: 1202106 - RNA, 16 nt, Homo sapiens
agcuucccuguauuac

SEQ ID NO: 1202107 - RNA, 14 nt, Homo sapiens
agcuucucugugaa

SEQ ID NO: 1202108 - RNA, 19 nt, Homo sapiens
agcuucuuaauuaauuuga

SEQ ID NO: 1202109 - RNA, 17 nt, Homo sapiens
agcuucuucacaggcac

SEQ ID NO: 1202110 - RNA, 18 nt, Homo sapiens
agcuuggggccaccaaag

SEQ ID NO: 1202111 - RNA, 17 nt, Homo sapiens
agcuuguaaauagcuca

SEQ ID NO: 1202112 - RNA, 20 nt, Homo sapiens
agcuuguggccccuuuuacu

SEQ ID NO: 1202113 - RNA, 13 nt, Homo sapiens
agcuugugugccc

SEQ ID NO: 1202114 - RNA, 19 nt, Homo sapiens
agcuuguuaucagcuuuca

SEQ ID NO: 1202115 - RNA, 18 nt, Homo sapiens
agcuuguucacacuuugc

SEQ ID NO: 1202116 - RNA, 21 nt, Homo sapiens
agcuuguucugggcucaggga

SEQ ID NO: 1202117 - RNA, 16 nt, Homo sapiens
agcuuuaaacucaggg

SEQ ID NO: 1202118 - RNA, 18 nt, Homo sapiens
agcuuuacaaauauguca

SEQ ID NO: 1202119 - RNA, 14 nt, Homo sapiens
agcuuuauucuuca

SEQ ID NO: 1202120 - RNA, 21 nt, Homo sapiens
agcuuucccugccucucauca

SEQ ID NO: 1202121 - RNA, 14 nt, Homo sapiens
agcuuucucucaga

SEQ ID NO: 1202122 - RNA, 22 nt, Homo sapiens
agcuuucucucagaaaugcugu

SEQ ID NO: 1202123 - RNA, 13 nt, Homo sapiens
agcuuucugccau

SEQ ID NO: 1202124 - RNA, 18 nt, Homo sapiens
caauuaauucaucccuua

SEQ ID NO: 1202125 - RNA, 15 nt, Homo sapiens
caauuacuauucccu

SEQ ID NO: 1202126 - RNA, 18 nt, Homo sapiens
caauuauacuaaaccuca

SEQ ID NO: 1202127 - RNA, 15 nt, Homo sapiens
caauuaucuguguca

SEQ ID NO: 1202128 - RNA, 16 nt, Homo sapiens
caauuauugauauaua

SEQ ID NO: 1202129 - RNA, 14 nt, Homo sapiens
caauuccguggcaa

SEQ ID NO: 1202130 - RNA, 17 nt, Homo sapiens
caauuccucugaacaaa

SEQ ID NO: 1202131 - RNA, 17 nt, Homo sapiens
caauuccugacacuuga

SEQ ID NO: 1202132 - RNA, 23 nt, Homo sapiens
caauuccuucuucaacgccaucu

SEQ ID NO: 1202133 - RNA, 20 nt, Homo sapiens
caauucucaaaagaaaaggc

SEQ ID NO: 1202134 - RNA, 16 nt, Homo sapiens
caauucuccugccuua

SEQ ID NO: 1202135 - RNA, 20 nt, Homo sapiens
caauucugugacauacauau

SEQ ID NO: 1202136 - RNA, 16 nt, Homo sapiens
caauugggagcugcca

SEQ ID NO: 1202137 - RNA, 15 nt, Homo sapiens
caauuguaacgacuu

SEQ ID NO: 1202138 - RNA, 14 nt, Homo sapiens
caauuuacacugcc

SEQ ID NO: 1202139 - RNA, 11 nt, Homo sapiens
caauuuaguuc

SEQ ID NO: 1202140 - RNA, 14 nt, Homo sapiens
caauuuaugcugcu

SEQ ID NO: 1202141 - RNA, 16 nt, Homo sapiens
caauuuauuacugaaa

SEQ ID NO: 1202142 - RNA, 14 nt, Homo sapiens
caauuucuugguau

SEQ ID NO: 1202143 - RNA, 17 nt, Homo sapiens
caauuucuugguauuau

SEQ ID NO: 1202144 - RNA, 19 nt, Homo sapiens
caauuucuuuuauguuaac

SEQ ID NO: 1202145 - RNA, 22 nt, Homo sapiens
caauuugagauucuacaguaag

SEQ ID NO: 1202146 - RNA, 13 nt, Homo sapiens
caauuugccuuuu

SEQ ID NO: 1202147 - RNA, 22 nt, Homo sapiens
caauuugguaaaaaugcugcuc

SEQ ID NO: 1202148 - RNA, 22 nt, Homo sapiens
caauuuuaccuaguuugcacua

SEQ ID NO: 1202149 - RNA, 22 nt, Homo sapiens
caauuuuucaagagcuccuuga

SEQ ID NO: 1202150 - RNA, 19 nt, Homo sapiens
cacaaaaagugucucugcc

SEQ ID NO: 1202151 - RNA, 19 nt, Homo sapiens
cacaaacaauauguuugca

SEQ ID NO: 1202152 - RNA, 19 nt, Homo sapiens
cacaaaccacaacugacac

SEQ ID NO: 1202153 - RNA, 13 nt, Homo sapiens
cacaaagacacag

SEQ ID NO: 1202154 - RNA, 16 nt, Homo sapiens
cacaaagacuccuucg

SEQ ID NO: 1202155 - RNA, 22 nt, Homo sapiens
cacaaaggaaguccaaccugag

SEQ ID NO: 1202156 - RNA, 11 nt, Homo sapiens
cacaaagggaa

SEQ ID NO: 1202157 - RNA, 23 nt, Homo sapiens
cacaaaggguugggagcugauga

SEQ ID NO: 1202158 - RNA, 21 nt, Homo sapiens
cacaaaguagaggaauccaug

SEQ ID NO: 1202159 - RNA, 16 nt, Homo sapiens
cacaaaguccacuuua

SEQ ID NO: 1202160 - RNA, 21 nt, Homo sapiens
cacaaaucagaccuggcugcu

SEQ ID NO: 1202161 - RNA, 19 nt, Homo sapiens
cacaaaugaagggauauaa

SEQ ID NO: 1202162 - RNA, 15 nt, Homo sapiens
cacaaaugaccgcac

SEQ ID NO: 1202163 - RNA, 17 nt, Homo sapiens
cacaaaugacugcaaaa

SEQ ID NO: 1202164 - RNA, 11 nt, Homo sapiens
cacaacaaucc

SEQ ID NO: 1202165 - RNA, 14 nt, Homo sapiens
cacaacagugaaaa

SEQ ID NO: 1202166 - RNA, 12 nt, Homo sapiens
cacaacucccuu

SEQ ID NO: 1202167 - RNA, 22 nt, Homo sapiens
cacaacucccuuaaggucucca

SEQ ID NO: 1202168 - RNA, 18 nt, Homo sapiens
cacaacugacacaggaaa

SEQ ID NO: 1202169 - RNA, 19 nt, Homo sapiens
cacaacugacacaggaaac

SEQ ID NO: 1202170 - RNA, 13 nt, Homo sapiens
cacaacuuuucaa

SEQ ID NO: 1202171 - RNA, 15 nt, Homo sapiens
cacaagaauugaaua

SEQ ID NO: 1202172 - RNA, 23 nt, Homo sapiens
cacaagaggaauaagaauggagc

SEQ ID NO: 1202173 - RNA, 22 nt, Homo sapiens
cacaagauggaaaucacauuua

SEQ ID NO: 1202174 - RNA, 18 nt, Homo sapiens
cacaagccaggaccugcu

SEQ ID NO: 1202175 - RNA, 16 nt, Homo sapiens
cacaagcccacagcac

SEQ ID NO: 1202176 - RNA, 14 nt, Homo sapiens
cacaagccugagaa

SEQ ID NO: 1202177 - RNA, 22 nt, Homo sapiens
cacaagcgaaucucugccuuuc

SEQ ID NO: 1202178 - RNA, 12 nt, Homo sapiens
cacaagcucaga

SEQ ID NO: 1202179 - RNA, 21 nt, Homo sapiens
cacaaggaaaaggccauuaaa

SEQ ID NO: 1202180 - RNA, 16 nt, Homo sapiens
cacaagguccacuccc

SEQ ID NO: 1202181 - RNA, 13 nt, Homo sapiens
cacaauaugaaua

SEQ ID NO: 1202182 - RNA, 23 nt, Homo sapiens
cacaauccuguggaucugggcaa

SEQ ID NO: 1202183 - RNA, 16 nt, Homo sapiens
cacaauccuugccaca

SEQ ID NO: 1202184 - RNA, 13 nt, Homo sapiens
cacaaugaaugua

SEQ ID NO: 1202185 - RNA, 18 nt, Homo sapiens
cacaauguuaaguuauau

SEQ ID NO: 1202186 - RNA, 22 nt, Homo sapiens
cacaauuaauucaucccuuaau

SEQ ID NO: 1202187 - RNA, 14 nt, Homo sapiens
cacacaagcccaca

SEQ ID NO: 1202188 - RNA, 10 nt, Homo sapiens
cacacacaaa

SEQ ID NO: 1202189 - RNA, 12 nt, Homo sapiens
cacacacacaaa

SEQ ID NO: 1202190 - RNA, 15 nt, Homo sapiens
cacacacacaugcac

SEQ ID NO: 1202191 - RNA, 18 nt, Homo sapiens
caaggcccccacugccug

SEQ ID NO: 1202192 - RNA, 15 nt, Homo sapiens
caaggcuccacaagc

SEQ ID NO: 1202193 - RNA, 14 nt, Homo sapiens
caaggcugcaguga

SEQ ID NO: 1202194 - RNA, 20 nt, Homo sapiens
caaggcugcuuagaauccaa

SEQ ID NO: 1202195 - RNA, 20 nt, Homo sapiens
caaggcuuaggaaagugaua

SEQ ID NO: 1202196 - RNA, 19 nt, Homo sapiens
caaggcuuuauauuuuuaa

SEQ ID NO: 1202197 - RNA, 21 nt, Homo sapiens
caaggcuuugguuuccaaguc

SEQ ID NO: 1202198 - RNA, 13 nt, Homo sapiens
caagggaaaaccc

SEQ ID NO: 1202199 - RNA, 15 nt, Homo sapiens
caagggaucugccau

SEQ ID NO: 1202200 - RNA, 18 nt, Homo sapiens
caagggccaguugguguu

SEQ ID NO: 1202201 - RNA, 22 nt, Homo sapiens
caaggggcugaaaagaucugaa

SEQ ID NO: 1202202 - RNA, 20 nt, Homo sapiens
caagggggacugucuuucag

SEQ ID NO: 1202203 - RNA, 18 nt, Homo sapiens
caagggucucacugcuca

SEQ ID NO: 1202204 - RNA, 23 nt, Homo sapiens
caaggguucuuggugaugcuggc

SEQ ID NO: 1202205 - RNA, 14 nt, Homo sapiens
caaggucuuugguu

SEQ ID NO: 1202206 - RNA, 19 nt, Homo sapiens
caaggugacacauuacaaa

SEQ ID NO: 1202207 - RNA, 21 nt, Homo sapiens
caaggugauuucagacugcag

SEQ ID NO: 1202208 - RNA, 16 nt, Homo sapiens
caaggugcugauguca

SEQ ID NO: 1202209 - RNA, 23 nt, Homo sapiens
caaggugggccuugcuaccucaa

SEQ ID NO: 1202210 - RNA, 18 nt, Homo sapiens
caaguaaaagaaaagccg

SEQ ID NO: 1202211 - RNA, 21 nt, Homo sapiens
caaguaagaaagugaagcaaa

SEQ ID NO: 1202212 - RNA, 15 nt, Homo sapiens
caaguauaauuacau

SEQ ID NO: 1202213 - RNA, 18 nt, Homo sapiens
caaguauccaaccaacuu

SEQ ID NO: 1202214 - RNA, 22 nt, Homo sapiens
caaguauuauuuuacaaucaac

SEQ ID NO: 1202215 - RNA, 21 nt, Homo sapiens
caaguauugucgguuaccucu

SEQ ID NO: 1202216 - RNA, 18 nt, Homo sapiens
caagucaccaugcugaau

SEQ ID NO: 1202217 - RNA, 17 nt, Homo sapiens
caagucaccggagcuuu

SEQ ID NO: 1202218 - RNA, 14 nt, Homo sapiens
caagucaugccuga

SEQ ID NO: 1202219 - RNA, 18 nt, Homo sapiens
caagucccaaauucauug

SEQ ID NO: 1202220 - RNA, 21 nt, Homo sapiens
caaguccugugaauuucuuca

SEQ ID NO: 1202221 - RNA, 15 nt, Homo sapiens
caagucuguaccuca

SEQ ID NO: 1202222 - RNA, 15 nt, Homo sapiens
caagucuuccaugac

SEQ ID NO: 1202223 - RNA, 16 nt, Homo sapiens
caagucuuccaugacc

SEQ ID NO: 1202224 - RNA, 12 nt, Homo sapiens
caagucuucccu

SEQ ID NO: 1202225 - RNA, 18 nt, Homo sapiens
caagucuucucaagaucc

SEQ ID NO: 1202226 - RNA, 14 nt, Homo sapiens
caagugacuuucua

SEQ ID NO: 1202227 - RNA, 17 nt, Homo sapiens
caagugaggagugccag

SEQ ID NO: 1202228 - RNA, 22 nt, Homo sapiens
caagugcuaaccuuuucaccuc

SEQ ID NO: 1202229 - RNA, 14 nt, Homo sapiens
caagugcugucuug

SEQ ID NO: 1202230 - RNA, 12 nt, Homo sapiens
caaguggcaugu

SEQ ID NO: 1202231 - RNA, 19 nt, Homo sapiens
caaguggcaugugcuguga

SEQ ID NO: 1202232 - RNA, 20 nt, Homo sapiens
caagugguuuccuggugcuu

SEQ ID NO: 1202233 - RNA, 15 nt, Homo sapiens
caaguguaucuccuu

SEQ ID NO: 1202234 - RNA, 13 nt, Homo sapiens
caagugucuucca

SEQ ID NO: 1202235 - RNA, 23 nt, Homo sapiens
caaguuaaagugaauaaccacuu

SEQ ID NO: 1202236 - RNA, 13 nt, Homo sapiens
caaguuacaguga

SEQ ID NO: 1202237 - RNA, 21 nt, Homo sapiens
caaguuagaaaacauaaucuu

SEQ ID NO: 1202238 - RNA, 23 nt, Homo sapiens
caaguuauaaaucaaugucacuu

SEQ ID NO: 1202239 - RNA, 14 nt, Homo sapiens
caaguuauguucuu

SEQ ID NO: 1202240 - RNA, 23 nt, Homo sapiens
caaguuccccaucccugucauuu

SEQ ID NO: 1202241 - RNA, 21 nt, Homo sapiens
caaguucgucuguugugcgaa

SEQ ID NO: 1202242 - RNA, 19 nt, Homo sapiens
caaguugguaaauucacaa

SEQ ID NO: 1202243 - RNA, 20 nt, Homo sapiens
caauaaaaaguucagaguuc

SEQ ID NO: 1202244 - RNA, 14 nt, Homo sapiens
caauaaaacugaug

SEQ ID NO: 1202245 - RNA, 19 nt, Homo sapiens
caauaaaaguuuucuccaa

SEQ ID NO: 1202246 - RNA, 13 nt, Homo sapiens
caauaaaccuccg

SEQ ID NO: 1202247 - RNA, 18 nt, Homo sapiens
caauaaaccuccgccaau

SEQ ID NO: 1202248 - RNA, 19 nt, Homo sapiens
caauaaacuccuacuaaau

SEQ ID NO: 1202249 - RNA, 15 nt, Homo sapiens
caauaaagcaaugug

SEQ ID NO: 1202250 - RNA, 22 nt, Homo sapiens
caauaaagcagccucauucuga

SEQ ID NO: 1202251 - RNA, 18 nt, Homo sapiens
caauaaauguugcaaugc

SEQ ID NO: 1202252 - RNA, 15 nt, Homo sapiens
caauaaauuuugcca

SEQ ID NO: 1202253 - RNA, 14 nt, Homo sapiens
caauaacacugucu

SEQ ID NO: 1202254 - RNA, 15 nt, Homo sapiens
caauaacacugucuc

SEQ ID NO: 1202255 - RNA, 21 nt, Homo sapiens
caauaagccacgaggugcagu

SEQ ID NO: 1202256 - RNA, 22 nt, Homo sapiens
caauaagccacgaggugcagua

SEQ ID NO: 1202257 - RNA, 21 nt, Homo sapiens
caauaauaaauauuuuugcca

SEQ ID NO: 1202258 - RNA, 21 nt, Homo sapiens
ccaacuucauuugaugcuaaa

SEQ ID NO: 1202259 - RNA, 17 nt, Homo sapiens
cauuggccgacaucaca

SEQ ID NO: 1202260 - RNA, 17 nt, Homo sapiens
cauugguaagaaugagc

SEQ ID NO: 1202261 - RNA, 17 nt, Homo sapiens
cauuggucauugugaau

SEQ ID NO: 1202262 - RNA, 21 nt, Homo sapiens
cauuggugaccugcggcagua

SEQ ID NO: 1202263 - RNA, 17 nt, Homo sapiens
cauuguagaaacacagu

SEQ ID NO: 1202264 - RNA, 21 nt, Homo sapiens
cauugucucguguacagcucc

SEQ ID NO: 1202265 - RNA, 13 nt, Homo sapiens
uacaauugucauu

SEQ ID NO: 1202266 - RNA, 12 nt, Homo sapiens
uacaauugugag

SEQ ID NO: 1202267 - RNA, 17 nt, Homo sapiens
uacaauuuguauuacuu

SEQ ID NO: 1202268 - RNA, 20 nt, Homo sapiens
uacaauuuuuuaucaugcau

SEQ ID NO: 1202269 - RNA, 13 nt, Homo sapiens
uacacaagcaaug

SEQ ID NO: 1202270 - RNA, 23 nt, Homo sapiens
uacacaauccuccaagaauuuga

SEQ ID NO: 1202271 - RNA, 20 nt, Homo sapiens
uacacaauuaauucaucccu

SEQ ID NO: 1202272 - RNA, 22 nt, Homo sapiens
uacacacucugagucucugaau

SEQ ID NO: 1202273 - RNA, 15 nt, Homo sapiens
uacacacuguuguca

SEQ ID NO: 1202274 - RNA, 15 nt, Homo sapiens
uacacagaauauaau

SEQ ID NO: 1202275 - RNA, 15 nt, Homo sapiens
uacacagcccaagag

SEQ ID NO: 1202276 - RNA, 15 nt, Homo sapiens
uacacauauaccuau

SEQ ID NO: 1202277 - RNA, 15 nt, Homo sapiens
uacacauauccacaa

SEQ ID NO: 1202278 - RNA, 13 nt, Homo sapiens
uacaccaguuuga

SEQ ID NO: 1202279 - RNA, 23 nt, Homo sapiens
uacaccauaguuuacaauauuau

SEQ ID NO: 1202280 - RNA, 21 nt, Homo sapiens
uacacggaggucucuguaaaa

SEQ ID NO: 1202281 - RNA, 21 nt, Homo sapiens
uacacuaaaaggugaccaaug

SEQ ID NO: 1202282 - RNA, 18 nt, Homo sapiens
uacacuaaaguuacaaac

SEQ ID NO: 1202283 - RNA, 16 nt, Homo sapiens
uacacucaaacaauca

SEQ ID NO: 1202284 - RNA, 20 nt, Homo sapiens
uacacuccagccugagcaac

SEQ ID NO: 1202285 - RNA, 15 nt, Homo sapiens
uacacugauacacuu

SEQ ID NO: 1202286 - RNA, 18 nt, Homo sapiens
uacacugauacacuugaa

SEQ ID NO: 1202287 - RNA, 13 nt, Homo sapiens
uacacugccaucu

SEQ ID NO: 1202288 - RNA, 20 nt, Homo sapiens
uacacuguuaucuucacuuu

SEQ ID NO: 1202289 - RNA, 17 nt, Homo sapiens
uacacuugguguacugg

SEQ ID NO: 1202290 - RNA, 13 nt, Homo sapiens
uacacuuguauaa

SEQ ID NO: 1202291 - RNA, 18 nt, Homo sapiens
uacagaaaagacucugac

SEQ ID NO: 1202292 - RNA, 20 nt, Homo sapiens
uacagaaaagacucugacca

SEQ ID NO: 1202293 - RNA, 15 nt, Homo sapiens
uacagaaaugcaaaa

SEQ ID NO: 1202294 - RNA, 14 nt, Homo sapiens
uacagaagugaaag

SEQ ID NO: 1202295 - RNA, 21 nt, Homo sapiens
uacagacaaccuaucauuuau

SEQ ID NO: 1202296 - RNA, 12 nt, Homo sapiens
uacagacauaca

SEQ ID NO: 1202297 - RNA, 21 nt, Homo sapiens
uacagacaucuaauguucucc

SEQ ID NO: 1202298 - RNA, 15 nt, Homo sapiens
uacagacaugaacug

SEQ ID NO: 1202299 - RNA, 16 nt, Homo sapiens
uacagaccaccuuuca

SEQ ID NO: 1202300 - RNA, 23 nt, Homo sapiens
uacagaccugcuuuuugaaauga

SEQ ID NO: 1202301 - RNA, 18 nt, Homo sapiens
uacagacuucuccagacc

SEQ ID NO: 1202302 - RNA, 18 nt, Homo sapiens
uacagagaagauucuugu

SEQ ID NO: 1202303 - RNA, 13 nt, Homo sapiens
uacagaugaacuc

SEQ ID NO: 1202304 - RNA, 22 nt, Homo sapiens
uacagauuuuaccuauccacaa

SEQ ID NO: 1202305 - RNA, 16 nt, Homo sapiens
uacagcaggugcucaa

SEQ ID NO: 1202306 - RNA, 17 nt, Homo sapiens
uacagcagugucaucag

SEQ ID NO: 1202307 - RNA, 16 nt, Homo sapiens
uacagcuaacccucac

SEQ ID NO: 1202308 - RNA, 20 nt, Homo sapiens
uacagcuaucgaacuucaca

SEQ ID NO: 1202309 - RNA, 15 nt, Homo sapiens
uacagcucccuuccc

SEQ ID NO: 1202310 - RNA, 14 nt, Homo sapiens
uacagcucuggcca

SEQ ID NO: 1202311 - RNA, 19 nt, Homo sapiens
uacagcuguauugucugaa

SEQ ID NO: 1202312 - RNA, 11 nt, Homo sapiens
uacagcuuucu

SEQ ID NO: 1202313 - RNA, 19 nt, Homo sapiens
uacaggaagguagaaauau

SEQ ID NO: 1202314 - RNA, 14 nt, Homo sapiens
uacaggcacccacc

SEQ ID NO: 1202315 - RNA, 20 nt, Homo sapiens
uacaggccuugcucacagcu

SEQ ID NO: 1202316 - RNA, 14 nt, Homo sapiens
uacaggcgugagcc

SEQ ID NO: 1202317 - RNA, 18 nt, Homo sapiens
uacaggugaaggcucuca

SEQ ID NO: 1202318 - RNA, 13 nt, Homo sapiens
uacaggugugaac

SEQ ID NO: 1202319 - RNA, 17 nt, Homo sapiens
uacaggugugagucacc

SEQ ID NO: 1202320 - RNA, 15 nt, Homo sapiens
uacagguuaagacaa

SEQ ID NO: 1202321 - RNA, 20 nt, Homo sapiens
uacagguuaagacaaagggu

SEQ ID NO: 1202322 - RNA, 23 nt, Homo sapiens
uacaguaacaaauaaagugcagu

SEQ ID NO: 1202323 - RNA, 19 nt, Homo sapiens
uacaguauguuuuacaugu

SEQ ID NO: 1202324 - RNA, 22 nt, Homo sapiens
uacaguauuguggcugcacuug

SEQ ID NO: 1202325 - RNA, 15 nt, Homo sapiens
uacagucugucauga

SEQ ID NO: 1202326 - RNA, 22 nt, Homo sapiens
uacagugaugcugugcuaugaa

SEQ ID NO: 1202327 - RNA, 12 nt, Homo sapiens
uacagugguuuu

SEQ ID NO: 1202328 - RNA, 20 nt, Homo sapiens
uacaguguauguacuaagca

SEQ ID NO: 1202329 - RNA, 22 nt, Homo sapiens
uacaguuaauuaugugcauauu

SEQ ID NO: 1202330 - RNA, 23 nt, Homo sapiens
uacaguuaauuaugugcauauua

SEQ ID NO: 1202331 - RNA, 24 nt, Homo sapiens
uacaguuaauuaugugcauauuaa

SEQ ID NO: 1202332 - RNA, 14 nt, Homo sapiens
uacaguuauuuugg

SEQ ID NO: 1202333 - RNA, 17 nt, Homo sapiens
uacaguucugugguuuc

SEQ ID NO: 1202334 - RNA, 20 nt, Homo sapiens
uacaguuugagacuuccaaa

SEQ ID NO: 1202335 - RNA, 16 nt, Homo sapiens
uacauaaacugucacu

SEQ ID NO: 1202336 - RNA, 23 nt, Homo sapiens
uacauaacguucaguugggaugg

SEQ ID NO: 1202337 - RNA, 22 nt, Homo sapiens
uacauaacugaaaaugugcuau

SEQ ID NO: 1202338 - RNA, 23 nt, Homo sapiens
uacauacaggccauacuuuacaa

SEQ ID NO: 1202339 - RNA, 14 nt, Homo sapiens
uacauagagaauaa

SEQ ID NO: 1202340 - RNA, 23 nt, Homo sapiens
uacauagccuauauuuacaguga

SEQ ID NO: 1202341 - RNA, 15 nt, Homo sapiens
uacauauaucucugu

SEQ ID NO: 1202342 - RNA, 17 nt, Homo sapiens
uacauauaucucugugu

SEQ ID NO: 1202343 - RNA, 23 nt, Homo sapiens
uacauaucuguguauuaucucaa

SEQ ID NO: 1202344 - RNA, 19 nt, Homo sapiens
uacaucuaguuaaucauag

SEQ ID NO: 1202345 - RNA, 14 nt, Homo sapiens
uacaucugucaugg

SEQ ID NO: 1202346 - RNA, 14 nt, Homo sapiens
uacaugcauacaaa

SEQ ID NO: 1202347 - RNA, 13 nt, Homo sapiens
uacaugcauuuga

SEQ ID NO: 1202348 - RNA, 20 nt, Homo sapiens
uacauggaauaacauguaau

SEQ ID NO: 1202349 - RNA, 13 nt, Homo sapiens
uacauguaaucca

SEQ ID NO: 1202350 - RNA, 15 nt, Homo sapiens
uacauguaauccauc

SEQ ID NO: 1202351 - RNA, 16 nt, Homo sapiens
uacauguauugcacau

SEQ ID NO: 1202352 - RNA, 13 nt, Homo sapiens
uacaugucaauaa

SEQ ID NO: 1202353 - RNA, 16 nt, Homo sapiens
uacaugugauugugau

SEQ ID NO: 1202354 - RNA, 19 nt, Homo sapiens
uacaugugccgaaugugca

SEQ ID NO: 1202355 - RNA, 15 nt, Homo sapiens
uacauucaacagaga

SEQ ID NO: 1202356 - RNA, 19 nt, Homo sapiens
uacauucuuuaucuugaca

SEQ ID NO: 1202357 - RNA, 19 nt, Homo sapiens
uacauugugggauguucag

SEQ ID NO: 1202358 - RNA, 14 nt, Homo sapiens
uacauuucauacaa

SEQ ID NO: 1202359 - RNA, 14 nt, Homo sapiens
uacauuucucauac

SEQ ID NO: 1202360 - RNA, 20 nt, Homo sapiens
uacauuucugcagaucuucc

SEQ ID NO: 1202361 - RNA, 18 nt, Homo sapiens
uacauuuuguuguaaaaa

SEQ ID NO: 1202362 - RNA, 16 nt, Homo sapiens
uaccaaaaaaguauuu

SEQ ID NO: 1202363 - RNA, 15 nt, Homo sapiens
uaccaaaagggccau

SEQ ID NO: 1202364 - RNA, 18 nt, Homo sapiens
uaccaaaguaacugaauu

SEQ ID NO: 1202365 - RNA, 17 nt, Homo sapiens
uaccaaaucugacauau

SEQ ID NO: 1202366 - RNA, 22 nt, Homo sapiens
uaccaaggggaauuacugaaaa

SEQ ID NO: 1202367 - RNA, 13 nt, Homo sapiens
uaccaaucauuuu

SEQ ID NO: 1202368 - RNA, 14 nt, Homo sapiens
uaccaaucauuuua

SEQ ID NO: 1202369 - RNA, 15 nt, Homo sapiens
uaaccuagauguuua

SEQ ID NO: 1202370 - RNA, 18 nt, Homo sapiens
uaaccucugcacuacuga

SEQ ID NO: 1202371 - RNA, 21 nt, Homo sapiens
uaaccuucuggcuuccuucuc

SEQ ID NO: 1202372 - RNA, 14 nt, Homo sapiens
uaacgacuucaggg

SEQ ID NO: 1202373 - RNA, 16 nt, Homo sapiens
uaacgcagucuaauua

SEQ ID NO: 1202374 - RNA, 23 nt, Homo sapiens
uaacgcagucuaauuacauuuca

SEQ ID NO: 1202375 - RNA, 13 nt, Homo sapiens
uaacgugugcgca

SEQ ID NO: 1202376 - RNA, 14 nt, Homo sapiens
uaacuaaacuaacg

SEQ ID NO: 1202377 - RNA, 21 nt, Homo sapiens
uaacuacuguccuuaaagcca

SEQ ID NO: 1202378 - RNA, 19 nt, Homo sapiens
uaacuagacuaagaagauu

SEQ ID NO: 1202379 - RNA, 21 nt, Homo sapiens
uaacucgaauucucacaagga

SEQ ID NO: 1202380 - RNA, 20 nt, Homo sapiens
uaacucugaccugggagccc

SEQ ID NO: 1202381 - RNA, 22 nt, Homo sapiens
uaacucuuuauuuuuugccaua

SEQ ID NO: 1202382 - RNA, 13 nt, Homo sapiens
uaacugacaugau

SEQ ID NO: 1202383 - RNA, 11 nt, Homo sapiens
uaacugagauu

SEQ ID NO: 1202384 - RNA, 18 nt, Homo sapiens
uaacugugccaguucuuu

SEQ ID NO: 1202385 - RNA, 13 nt, Homo sapiens
uaacuuacuguau

SEQ ID NO: 1202386 - RNA, 18 nt, Homo sapiens
uaacuuggccauguucuc

SEQ ID NO: 1202387 - RNA, 16 nt, Homo sapiens
uaacuuuaaguuucag

SEQ ID NO: 1202388 - RNA, 17 nt, Homo sapiens
uaacuuuuguaagacaa

SEQ ID NO: 1202389 - RNA, 14 nt, Homo sapiens
uaagaaaacuaaga

SEQ ID NO: 1202390 - RNA, 16 nt, Homo sapiens
uaagaaacccucuguc

SEQ ID NO: 1202391 - RNA, 17 nt, Homo sapiens
uaagaaacccucuguca

SEQ ID NO: 1202392 - RNA, 13 nt, Homo sapiens
uaagaaagacuau

SEQ ID NO: 1202393 - RNA, 13 nt, Homo sapiens
uaagaaagcacua

SEQ ID NO: 1202394 - RNA, 21 nt, Homo sapiens
uaagaaagugcgaguccucca

SEQ ID NO: 1202395 - RNA, 16 nt, Homo sapiens
uaagaagagauuucuc

SEQ ID NO: 1202396 - RNA, 14 nt, Homo sapiens
uaagaauagaaaua

SEQ ID NO: 1202397 - RNA, 17 nt, Homo sapiens
uaagaauaguucuaaaa

SEQ ID NO: 1202398 - RNA, 22 nt, Homo sapiens
uaagaaucuuuagagaaguaua

SEQ ID NO: 1202399 - RNA, 14 nt, Homo sapiens
uaagaaugcugguu

SEQ ID NO: 1202400 - RNA, 19 nt, Homo sapiens
uaagaauucuguacuucca

SEQ ID NO: 1202401 - RNA, 21 nt, Homo sapiens
uaagaauucuguacuuccaau

SEQ ID NO: 1202402 - RNA, 18 nt, Homo sapiens
uaagaauuuagggagaaa

SEQ ID NO: 1202403 - RNA, 12 nt, Homo sapiens
uaagaauuucac

SEQ ID NO: 1202404 - RNA, 21 nt, Homo sapiens
uaagacauacuccuuccauca

SEQ ID NO: 1202405 - RNA, 18 nt, Homo sapiens
uaagacaugauuuccuug

SEQ ID NO: 1202406 - RNA, 19 nt, Homo sapiens
uaagacauuuguauauugu

SEQ ID NO: 1202407 - RNA, 15 nt, Homo sapiens
uaagaccccaucucu

SEQ ID NO: 1202408 - RNA, 16 nt, Homo sapiens
uaagacgaaugauuua

SEQ ID NO: 1202409 - RNA, 22 nt, Homo sapiens
uaagacgguuaaauacugugug

SEQ ID NO: 1202410 - RNA, 14 nt, Homo sapiens
uaagacucauuccc

SEQ ID NO: 1202411 - RNA, 23 nt, Homo sapiens
uaagacuguuuuuaaguaacuua

SEQ ID NO: 1202412 - RNA, 14 nt, Homo sapiens
uaagagaugggacu

SEQ ID NO: 1202413 - RNA, 17 nt, Homo sapiens
uaagagcagaacagauc

SEQ ID NO: 1202414 - RNA, 21 nt, Homo sapiens
uaagagccauauaaguuugaa

SEQ ID NO: 1202415 - RNA, 17 nt, Homo sapiens
uaagagccauuuagggg

SEQ ID NO: 1202416 - RNA, 18 nt, Homo sapiens
uaagagcuuaagaaccau

SEQ ID NO: 1202417 - RNA, 17 nt, Homo sapiens
uaagaguaaaauuccuc

SEQ ID NO: 1202418 - RNA, 18 nt, Homo sapiens
uaagaguaaaauuccucu

SEQ ID NO: 1202419 - RNA, 22 nt, Homo sapiens
uaagagugccguaacaacugug

SEQ ID NO: 1202420 - RNA, 24 nt, Homo sapiens
uaagaguggaaccaacacuaacau

SEQ ID NO: 1202421 - RNA, 23 nt, Homo sapiens
uaagaguugagauuuugcaaucu

SEQ ID NO: 1202422 - RNA, 22 nt, Homo sapiens
uaagauacuggacuccucuucc

SEQ ID NO: 1202423 - RNA, 19 nt, Homo sapiens
uaagauauucagaaguaua

SEQ ID NO: 1202424 - RNA, 13 nt, Homo sapiens
uaagauccacaaa

SEQ ID NO: 1202425 - RNA, 19 nt, Homo sapiens
uaagauccacaaaugaagg

SEQ ID NO: 1202426 - RNA, 13 nt, Homo sapiens
uaagaugcacuga

SEQ ID NO: 1202427 - RNA, 21 nt, Homo sapiens
uaagaugugauauucuaagac

SEQ ID NO: 1202428 - RNA, 22 nt, Homo sapiens
uaagauguguuaggaaugucaa

SEQ ID NO: 1202429 - RNA, 18 nt, Homo sapiens
uaagauguucacuguggc

SEQ ID NO: 1202430 - RNA, 23 nt, Homo sapiens
uaagauuauagauucuaaagauu

SEQ ID NO: 1202431 - RNA, 13 nt, Homo sapiens
uaagauucuagau

SEQ ID NO: 1202432 - RNA, 18 nt, Homo sapiens
uaagauuguaaaaauaau

SEQ ID NO: 1202433 - RNA, 13 nt, Homo sapiens
uaagauuuaccca

SEQ ID NO: 1202434 - RNA, 18 nt, Homo sapiens
uaagauuuccaagugcca

SEQ ID NO: 1202435 - RNA, 14 nt, Homo sapiens
uaagauuuuccauu

SEQ ID NO: 1202436 - RNA, 21 nt, Homo sapiens
uaagcaaaaugcuucugcaca

SEQ ID NO: 1202437 - RNA, 15 nt, Homo sapiens
uaagcaaauguuaaa

SEQ ID NO: 1202438 - RNA, 15 nt, Homo sapiens
uaagcaauaccagca

SEQ ID NO: 1202439 - RNA, 16 nt, Homo sapiens
uaagcagaagcauuaa

SEQ ID NO: 1202440 - RNA, 17 nt, Homo sapiens
uaagcagcgccagugac

SEQ ID NO: 1202441 - RNA, 20 nt, Homo sapiens
uaagcaguauauuaguauua

SEQ ID NO: 1202442 - RNA, 15 nt, Homo sapiens
uaagcauacaacugg

SEQ ID NO: 1202443 - RNA, 16 nt, Homo sapiens
uaagcauacaacugga

SEQ ID NO: 1202444 - RNA, 14 nt, Homo sapiens
uaagcaucugccau

SEQ ID NO: 1202445 - RNA, 18 nt, Homo sapiens
uaagcaugugucccagga

SEQ ID NO: 1202446 - RNA, 19 nt, Homo sapiens
uaagccaaagaaaugaaca

SEQ ID NO: 1202447 - RNA, 14 nt, Homo sapiens
uaagcccacuguua

SEQ ID NO: 1202448 - RNA, 17 nt, Homo sapiens
uaagccuaaaugccuua

SEQ ID NO: 1202449 - RNA, 15 nt, Homo sapiens
uaagcuaucagcaau

SEQ ID NO: 1202450 - RNA, 16 nt, Homo sapiens
uaagcuaucuucaaau

SEQ ID NO: 1202451 - RNA, 14 nt, Homo sapiens
uaagcugauuugau

SEQ ID NO: 1202452 - RNA, 22 nt, Homo sapiens
uaagcugggaaaaaaguuuuga

SEQ ID NO: 1202453 - RNA, 15 nt, Homo sapiens
uaagcugugugcagg

SEQ ID NO: 1202454 - RNA, 18 nt, Homo sapiens
uaagcuuuuagaagguaa

SEQ ID NO: 1202455 - RNA, 12 nt, Homo sapiens
uaagcuuuuugg

SEQ ID NO: 1202456 - RNA, 14 nt, Homo sapiens
uaaggaaaugugca

SEQ ID NO: 1202457 - RNA, 14 nt, Homo sapiens
uaaggaagauaucu

SEQ ID NO: 1202458 - RNA, 14 nt, Homo sapiens
uaaggaucucucag

SEQ ID NO: 1202459 - RNA, 22 nt, Homo sapiens
uaaggcccagcaaucugcauuu

SEQ ID NO: 1202460 - RNA, 16 nt, Homo sapiens
uaaggcuuuaguguau

SEQ ID NO: 1202461 - RNA, 17 nt, Homo sapiens
uaagggaguuacaucuu

SEQ ID NO: 1202462 - RNA, 22 nt, Homo sapiens
uaagggcagugcccauguguac

SEQ ID NO: 1202463 - RNA, 20 nt, Homo sapiens
uaagggggugcagcagugag

SEQ ID NO: 1202464 - RNA, 18 nt, Homo sapiens
uaagggguaucauguaug

SEQ ID NO: 1202465 - RNA, 18 nt, Homo sapiens
uaagguccgguguucuaa

SEQ ID NO: 1202466 - RNA, 18 nt, Homo sapiens
uaagguccuaaauucuua

SEQ ID NO: 1202467 - RNA, 12 nt, Homo sapiens
uaaggugcaguu

SEQ ID NO: 1202468 - RNA, 13 nt, Homo sapiens
uaaggugggucca

SEQ ID NO: 1202469 - RNA, 16 nt, Homo sapiens
gcaaugcccugugcau

SEQ ID NO: 1202470 - RNA, 17 nt, Homo sapiens
gcaauuagcauucuguc

SEQ ID NO: 1202471 - RNA, 22 nt, Homo sapiens
gcaauuccgcauuuaauucaug

SEQ ID NO: 1202472 - RNA, 14 nt, Homo sapiens
gcaauuccucugaa

SEQ ID NO: 1202473 - RNA, 18 nt, Homo sapiens
gcaauucuccugccuuag

SEQ ID NO: 1202474 - RNA, 17 nt, Homo sapiens
gcaauugauuucuuuuc

SEQ ID NO: 1202475 - RNA, 21 nt, Homo sapiens
gcaauugauuucuuuucuucc

SEQ ID NO: 1202476 - RNA, 17 nt, Homo sapiens
gcaauugcucaugcaua

SEQ ID NO: 1202477 - RNA, 23 nt, Homo sapiens
gcaauuuuaccuaguuugcacua

SEQ ID NO: 1202478 - RNA, 21 nt, Homo sapiens
gcaauuuuucaagagcuccuu

SEQ ID NO: 1202479 - RNA, 17 nt, Homo sapiens
gcacaaagacacagacu

SEQ ID NO: 1202480 - RNA, 23 nt, Homo sapiens
gcacaacacacuuuggucauuuc

SEQ ID NO: 1202481 - RNA, 19 nt, Homo sapiens
gcacaacaguucucuucua

SEQ ID NO: 1202482 - RNA, 20 nt, Homo sapiens
gcacaagaagugguccaucu

SEQ ID NO: 1202483 - RNA, 14 nt, Homo sapiens
gcacaagccacaag

SEQ ID NO: 1202484 - RNA, 22 nt, Homo sapiens
gcacaagccacaagucuuccag

SEQ ID NO: 1202485 - RNA, 16 nt, Homo sapiens
gcacaaggcugaccaa

SEQ ID NO: 1202486 - RNA, 18 nt, Homo sapiens
gcacaaggcugaccaaga

SEQ ID NO: 1202487 - RNA, 17 nt, Homo sapiens
gcacaauaaacauaaca

SEQ ID NO: 1202488 - RNA, 18 nt, Homo sapiens
gcacaauuugcacuaaau

SEQ ID NO: 1202489 - RNA, 22 nt, Homo sapiens
gcacaauuuuaauucaaaagau

SEQ ID NO: 1202490 - RNA, 22 nt, Homo sapiens
gcacacaccacacacagcuaac

SEQ ID NO: 1202491 - RNA, 23 nt, Homo sapiens
gcacacagcuuagaagugcuaua

SEQ ID NO: 1202492 - RNA, 13 nt, Homo sapiens
gcacacugcacug

SEQ ID NO: 1202493 - RNA, 12 nt, Homo sapiens
gcacacugccaa

SEQ ID NO: 1202494 - RNA, 14 nt, Homo sapiens
gcacacugccaaau

SEQ ID NO: 1202495 - RNA, 22 nt, Homo sapiens
gcacacugccagucucacugug

SEQ ID NO: 1202496 - RNA, 12 nt, Homo sapiens
gcacacuggccu

SEQ ID NO: 1202497 - RNA, 17 nt, Homo sapiens
gcacagagcccaaugca

SEQ ID NO: 1202498 - RNA, 11 nt, Homo sapiens
gcacagccacc

SEQ ID NO: 1202499 - RNA, 20 nt, Homo sapiens
gcacagcguccuguccacac

SEQ ID NO: 1202500 - RNA, 19 nt, Homo sapiens
gcacaggucccacugcccu

SEQ ID NO: 1202501 - RNA, 13 nt, Homo sapiens
gcacaguaggaau

SEQ ID NO: 1202502 - RNA, 21 nt, Homo sapiens
gcacauauggacucugcacau

SEQ ID NO: 1202503 - RNA, 18 nt, Homo sapiens
gcacaucaacugaucuca

SEQ ID NO: 1202504 - RNA, 21 nt, Homo sapiens
gcacaucaauuacaagcugua

SEQ ID NO: 1202505 - RNA, 12 nt, Homo sapiens
gcacaucaggag

SEQ ID NO: 1202506 - RNA, 15 nt, Homo sapiens
gcacauccauuccca

SEQ ID NO: 1202507 - RNA, 12 nt, Homo sapiens
gcacaugccuuc

SEQ ID NO: 1202508 - RNA, 20 nt, Homo sapiens
gcacauuccccuugccuaaa

SEQ ID NO: 1202509 - RNA, 22 nt, Homo sapiens
gcacauugaaagagaaccaguu

SEQ ID NO: 1202510 - RNA, 21 nt, Homo sapiens
gcacauuuaaggcgccauugc

SEQ ID NO: 1202511 - RNA, 16 nt, Homo sapiens
gcaccaacaucuacaa

SEQ ID NO: 1202512 - RNA, 17 nt, Homo sapiens
gcaccaacaucuacaag

SEQ ID NO: 1202513 - RNA, 13 nt, Homo sapiens
gcaccaaccugca

SEQ ID NO: 1202514 - RNA, 14 nt, Homo sapiens
gcaccacccuaguc

SEQ ID NO: 1202515 - RNA, 13 nt, Homo sapiens
gcaccacugcacu

SEQ ID NO: 1202516 - RNA, 15 nt, Homo sapiens
gcaccacuguguauu

SEQ ID NO: 1202517 - RNA, 22 nt, Homo sapiens
gcaccagagagagauucuuccc

SEQ ID NO: 1202518 - RNA, 18 nt, Homo sapiens
gcaccagagggauaaaaa

SEQ ID NO: 1202519 - RNA, 17 nt, Homo sapiens
gcaccaggcacugcugc

SEQ ID NO: 1202520 - RNA, 18 nt, Homo sapiens
gcacccauuucaaugugu

SEQ ID NO: 1202521 - RNA, 13 nt, Homo sapiens
gcaccccaugcca

SEQ ID NO: 1202522 - RNA, 20 nt, Homo sapiens
gcacccccugcuccaccagc

SEQ ID NO: 1202523 - RNA, 21 nt, Homo sapiens
gcacccggcucguguauuuau

SEQ ID NO: 1202524 - RNA, 19 nt, Homo sapiens
gcacccuaguucuaccuca

SEQ ID NO: 1202525 - RNA, 17 nt, Homo sapiens
gcacccugauccucacc

SEQ ID NO: 1202526 - RNA, 19 nt, Homo sapiens
gcacccuguaucacagacu

SEQ ID NO: 1202527 - RNA, 14 nt, Homo sapiens
gcaccgucauggcu

SEQ ID NO: 1202528 - RNA, 16 nt, Homo sapiens
gcaccuagcugugcaa

SEQ ID NO: 1202529 - RNA, 13 nt, Homo sapiens
gcaccugcucaac

SEQ ID NO: 1202530 - RNA, 11 nt, Homo sapiens
gcaccuggcau

SEQ ID NO: 1202531 - RNA, 17 nt, Homo sapiens
gcaccuguacucaggag

SEQ ID NO: 1202532 - RNA, 16 nt, Homo sapiens
gcaccuucacucucca

SEQ ID NO: 1202533 - RNA, 19 nt, Homo sapiens
gcaccuucccucucaccau

SEQ ID NO: 1202534 - RNA, 24 nt, Homo sapiens
gcaccuugugucuguacacguguc

SEQ ID NO: 1202535 - RNA, 12 nt, Homo sapiens
gcacgccucuuc

SEQ ID NO: 1202536 - RNA, 13 nt, Homo sapiens
gcacgcucgcugc

SEQ ID NO: 1202537 - RNA, 17 nt, Homo sapiens
gcacgcucgcugccauc

SEQ ID NO: 1202538 - RNA, 13 nt, Homo sapiens
gcacuaaagccag

SEQ ID NO: 1202539 - RNA, 22 nt, Homo sapiens
gcacuaacucguguuuggagcu

SEQ ID NO: 1202540 - RNA, 19 nt, Homo sapiens
gcacuacauaaacugacuu

SEQ ID NO: 1202541 - RNA, 17 nt, Homo sapiens
uaaagaaaaauaugaua

SEQ ID NO: 1202542 - RNA, 22 nt, Homo sapiens
uaaagaaccaucagcaucaccc

SEQ ID NO: 1202543 - RNA, 22 nt, Homo sapiens
uaaagaagguuggugaauuuca

SEQ ID NO: 1202544 - RNA, 12 nt, Homo sapiens
uaaagaauacac

SEQ ID NO: 1202545 - RNA, 19 nt, Homo sapiens
uaaagaauuaacagagauu

SEQ ID NO: 1202546 - RNA, 18 nt, Homo sapiens
uaaagaauucgguugaaa

SEQ ID NO: 1202547 - RNA, 21 nt, Homo sapiens
uaaagacugguuuucugccaa

SEQ ID NO: 1202548 - RNA, 12 nt, Homo sapiens
uaaagacuguag

SEQ ID NO: 1202549 - RNA, 14 nt, Homo sapiens
uaaagacugugauu

SEQ ID NO: 1202550 - RNA, 21 nt, Homo sapiens
uaaagagaccuaccucagguu

SEQ ID NO: 1202551 - RNA, 19 nt, Homo sapiens
uaaagagagaauguagaua

SEQ ID NO: 1202552 - RNA, 20 nt, Homo sapiens
uaaagagagaauguagauau

SEQ ID NO: 1202553 - RNA, 18 nt, Homo sapiens
uaaagagcacuuacugua

SEQ ID NO: 1202554 - RNA, 15 nt, Homo sapiens
uaaagauacaguguc

SEQ ID NO: 1202555 - RNA, 16 nt, Homo sapiens
uaaagauauuguucaa

SEQ ID NO: 1202556 - RNA, 17 nt, Homo sapiens
uaaagaucaugacauau

SEQ ID NO: 1202557 - RNA, 18 nt, Homo sapiens
uaaagaugaacucugaac

SEQ ID NO: 1202558 - RNA, 16 nt, Homo sapiens
uaaagaugaucuacuc

SEQ ID NO: 1202559 - RNA, 19 nt, Homo sapiens
uaaagcaacaaaaauuacu

SEQ ID NO: 1202560 - RNA, 17 nt, Homo sapiens
uaaagcacaugccuucu

SEQ ID NO: 1202561 - RNA, 17 nt, Homo sapiens
uaaagcagacagucaca

SEQ ID NO: 1202562 - RNA, 20 nt, Homo sapiens
uaaagcccaaccuccugacc

SEQ ID NO: 1202563 - RNA, 22 nt, Homo sapiens
uaaaggacaggccacaccacag

SEQ ID NO: 1202564 - RNA, 17 nt, Homo sapiens
uaaaggcagcugccucu

SEQ ID NO: 1202565 - RNA, 18 nt, Homo sapiens
uaaaggcagcugccucug

SEQ ID NO: 1202566 - RNA, 15 nt, Homo sapiens
uaaaggcaguuuucu

SEQ ID NO: 1202567 - RNA, 18 nt, Homo sapiens
uaaaggccuccuccccca

SEQ ID NO: 1202568 - RNA, 20 nt, Homo sapiens
uaaagggcagggcccacgug

SEQ ID NO: 1202569 - RNA, 24 nt, Homo sapiens
uaaagguaaaacaugcuggugaac

SEQ ID NO: 1202570 - RNA, 23 nt, Homo sapiens
uaaaggugguccuuccuaccucu

SEQ ID NO: 1202571 - RNA, 23 nt, Homo sapiens
uaaagguuucauguucacuguga

SEQ ID NO: 1202572 - RNA, 22 nt, Homo sapiens
uaaagguuuugguugcauuauu

SEQ ID NO: 1202573 - RNA, 11 nt, Homo sapiens
uaaaguaccac

SEQ ID NO: 1202574 - RNA, 16 nt, Homo sapiens
uaaaguaugcauuauu

SEQ ID NO: 1202575 - RNA, 16 nt, Homo sapiens
uaaagucucucugacu

SEQ ID NO: 1202576 - RNA, 15 nt, Homo sapiens
uaaagugcugcagua

SEQ ID NO: 1202577 - RNA, 14 nt, Homo sapiens
uaaaguuggaauuu

SEQ ID NO: 1202578 - RNA, 15 nt, Homo sapiens
uaaaguugguauuaa

SEQ ID NO: 1202579 - RNA, 13 nt, Homo sapiens
uaaauaaaaagcg

SEQ ID NO: 1202580 - RNA, 21 nt, Homo sapiens
uaaauaaacucaaugagcucu

SEQ ID NO: 1202581 - RNA, 18 nt, Homo sapiens
uaaauaagagauuuggag

SEQ ID NO: 1202582 - RNA, 17 nt, Homo sapiens
uaaauaccagacacgua

SEQ ID NO: 1202583 - RNA, 22 nt, Homo sapiens
uaaauacuguaaaugcauugga

SEQ ID NO: 1202584 - RNA, 14 nt, Homo sapiens
uaaauagugcagaa

SEQ ID NO: 1202585 - RNA, 15 nt, Homo sapiens
uaaauauauauucua

SEQ ID NO: 1202586 - RNA, 20 nt, Homo sapiens
uaaauauauauuucuaauau

SEQ ID NO: 1202587 - RNA, 15 nt, Homo sapiens
uaaauauaucuaccc

SEQ ID NO: 1202588 - RNA, 18 nt, Homo sapiens
uaaauauaucuaccccag

SEQ ID NO: 1202589 - RNA, 16 nt, Homo sapiens
uaaauaugcagugaua

SEQ ID NO: 1202590 - RNA, 15 nt, Homo sapiens
uaaauauuacaguga

SEQ ID NO: 1202591 - RNA, 17 nt, Homo sapiens
uaaauauuagaagccug

SEQ ID NO: 1202592 - RNA, 21 nt, Homo sapiens
uaaauauuagaagccugcaga

SEQ ID NO: 1202593 - RNA, 20 nt, Homo sapiens
uaaauauuauuagauuuauu

SEQ ID NO: 1202594 - RNA, 17 nt, Homo sapiens
uaaauauugaaacacug

SEQ ID NO: 1202595 - RNA, 13 nt, Homo sapiens
uaaaucaagagcu

SEQ ID NO: 1202596 - RNA, 15 nt, Homo sapiens
uaaaucaagagcuua

SEQ ID NO: 1202597 - RNA, 15 nt, Homo sapiens
uaaaucacacauuca

SEQ ID NO: 1202598 - RNA, 16 nt, Homo sapiens
uaaaucacacauucag

SEQ ID NO: 1202599 - RNA, 20 nt, Homo sapiens
uaaaucagagagcaaggcau

SEQ ID NO: 1202600 - RNA, 13 nt, Homo sapiens
uaaaucauaaagu

SEQ ID NO: 1202601 - RNA, 23 nt, Homo sapiens
uaaaucauuaagacaacugaguu

SEQ ID NO: 1202602 - RNA, 13 nt, Homo sapiens
uaaaucugccaca

SEQ ID NO: 1202603 - RNA, 20 nt, Homo sapiens
uaaaucuguuauuuugcuau

SEQ ID NO: 1202604 - RNA, 21 nt, Homo sapiens
uaaaucuguucugggcucuuu

SEQ ID NO: 1202605 - RNA, 11 nt, Homo sapiens
uaaaugaacua

SEQ ID NO: 1202606 - RNA, 15 nt, Homo sapiens
uaaaugaacuaauga

SEQ ID NO: 1202607 - RNA, 15 nt, Homo sapiens
uaaaugaagcagcuu

SEQ ID NO: 1202608 - RNA, 22 nt, Homo sapiens
uaaaugagagggaaucgacugu

SEQ ID NO: 1202609 - RNA, 13 nt, Homo sapiens
uaaaugagcccac

SEQ ID NO: 1202610 - RNA, 15 nt, Homo sapiens
uaaaugauacaguau

SEQ ID NO: 1202611 - RNA, 20 nt, Homo sapiens
uaaaugcagacaacaccuuc

SEQ ID NO: 1202612 - RNA, 22 nt, Homo sapiens
uaaaugcagacaacaccuuccu

SEQ ID NO: 1202613 - RNA, 12 nt, Homo sapiens
uaaaugcauuag

SEQ ID NO: 1202614 - RNA, 21 nt, Homo sapiens
uaaaugcugucaacuaugaua

SEQ ID NO: 1202615 - RNA, 22 nt, Homo sapiens
uaaaugcuucauuuguauguca

SEQ ID NO: 1202616 - RNA, 17 nt, Homo sapiens
uaaaugggacuggaguc

SEQ ID NO: 1202617 - RNA, 14 nt, Homo sapiens
uaaauguaauaagu

SEQ ID NO: 1202618 - RNA, 22 nt, Homo sapiens
uaaauguagcaauggcacuguu

SEQ ID NO: 1202619 - RNA, 16 nt, Homo sapiens
uaaauguaucauagaa

SEQ ID NO: 1202620 - RNA, 14 nt, Homo sapiens
uaaauguaucuuau

SEQ ID NO: 1202621 - RNA, 14 nt, Homo sapiens
uaaaugugaacuua

SEQ ID NO: 1202622 - RNA, 11 nt, Homo sapiens
uaaaugugcag

SEQ ID NO: 1202623 - RNA, 18 nt, Homo sapiens
uaaauguucuaacagauc

SEQ ID NO: 1202624 - RNA, 15 nt, Homo sapiens
uaaauguugcaaugc

SEQ ID NO: 1202625 - RNA, 16 nt, Homo sapiens
uaaauguuuauacugu

SEQ ID NO: 1202626 - RNA, 13 nt, Homo sapiens
uaaauuaagcaug

SEQ ID NO: 1202627 - RNA, 20 nt, Homo sapiens
uaaauuacagcuuuuaugga

SEQ ID NO: 1202628 - RNA, 16 nt, Homo sapiens
uaaauuacguaugcaa

SEQ ID NO: 1202629 - RNA, 22 nt, Homo sapiens
uaaauuacguaugcaagucugu

SEQ ID NO: 1202630 - RNA, 17 nt, Homo sapiens
uaaauucagaacaagca

SEQ ID NO: 1202631 - RNA, 15 nt, Homo sapiens
uaaauucaugcacuu

SEQ ID NO: 1202632 - RNA, 13 nt, Homo sapiens
uaaauuccacacu

SEQ ID NO: 1202633 - RNA, 23 nt, Homo sapiens
uaaauucuauaggaacauaugaa

SEQ ID NO: 1202634 - RNA, 15 nt, Homo sapiens
uaaauugauguugcu

SEQ ID NO: 1202635 - RNA, 12 nt, Homo sapiens
uaaauugcauca

SEQ ID NO: 1202636 - RNA, 13 nt, Homo sapiens
uaaauuuauuuca

SEQ ID NO: 1202637 - RNA, 14 nt, Homo sapiens
uaaauuugauuucc

SEQ ID NO: 1202638 - RNA, 20 nt, Homo sapiens
uaaauuuguaaguuucaggu

SEQ ID NO: 1202639 - RNA, 16 nt, Homo sapiens
ggcauaauagucaauu

SEQ ID NO: 1202640 - RNA, 17 nt, Homo sapiens
ggcauagcucuggggug

SEQ ID NO: 1202641 - RNA, 24 nt, Homo sapiens
ggcauaggcugacuuuugcagaug

SEQ ID NO: 1202642 - RNA, 16 nt, Homo sapiens
ggcauccacccagugc

SEQ ID NO: 1202643 - RNA, 16 nt, Homo sapiens
ggcauccauaccagcu

SEQ ID NO: 1202644 - RNA, 22 nt, Homo sapiens
ggcaugaugaucugccucucaa

SEQ ID NO: 1202645 - RNA, 23 nt, Homo sapiens
ggcauucuguggccagccaaaag

SEQ ID NO: 1202646 - RNA, 14 nt, Homo sapiens
ggccaaaccucuaa

SEQ ID NO: 1202647 - RNA, 19 nt, Homo sapiens
ggccaagcaauuccucuga

SEQ ID NO: 1202648 - RNA, 14 nt, Homo sapiens
ggccaagguccugc

SEQ ID NO: 1202649 - RNA, 23 nt, Homo sapiens
ggccaaggugccaccacccugcc

SEQ ID NO: 1202650 - RNA, 14 nt, Homo sapiens
ggccacaacagggc

SEQ ID NO: 1202651 - RNA, 15 nt, Homo sapiens
ggccacaccaucucc

SEQ ID NO: 1202652 - RNA, 17 nt, Homo sapiens
ggccaccacaccugacu

SEQ ID NO: 1202653 - RNA, 15 nt, Homo sapiens
ggccaccccacucua

SEQ ID NO: 1202654 - RNA, 22 nt, Homo sapiens
ggccacccccuauccucugagu

SEQ ID NO: 1202655 - RNA, 17 nt, Homo sapiens
ggccaccucuugcuugg

SEQ ID NO: 1202656 - RNA, 21 nt, Homo sapiens
ggccaccuguagccaucugca

SEQ ID NO: 1202657 - RNA, 22 nt, Homo sapiens
ggccagacuggaagacacuuca

SEQ ID NO: 1202658 - RNA, 17 nt, Homo sapiens
ggccagagucuguuuca

SEQ ID NO: 1202659 - RNA, 23 nt, Homo sapiens
ggccagcccugcagcccaaaacc

SEQ ID NO: 1202660 - RNA, 21 nt, Homo sapiens
ggccaggcccgcaccccggcc

SEQ ID NO: 1202661 - RNA, 23 nt, Homo sapiens
ggccagggucugugugaaugugg

SEQ ID NO: 1202662 - RNA, 22 nt, Homo sapiens
ggccaggugagguccaccggcc

SEQ ID NO: 1202663 - RNA, 23 nt, Homo sapiens
ggccaguauuuuuauuucuuuaa

SEQ ID NO: 1202664 - RNA, 16 nt, Homo sapiens
ggccagugaacagggu

SEQ ID NO: 1202665 - RNA, 11 nt, Homo sapiens
ggccagugucu

SEQ ID NO: 1202666 - RNA, 22 nt, Homo sapiens
ggccaguugcccagagcacuuu

SEQ ID NO: 1202667 - RNA, 23 nt, Homo sapiens
ggccauaaacgguuccuggugac

SEQ ID NO: 1202668 - RNA, 13 nt, Homo sapiens
ggccaucacagga

SEQ ID NO: 1202669 - RNA, 17 nt, Homo sapiens
ggccaugccacccuguu

SEQ ID NO: 1202670 - RNA, 14 nt, Homo sapiens
ggccauguccaaag

SEQ ID NO: 1202671 - RNA, 16 nt, Homo sapiens
ggccauguccaaagag

SEQ ID NO: 1202672 - RNA, 16 nt, Homo sapiens
ggccauuaccaucucu

SEQ ID NO: 1202673 - RNA, 15 nt, Homo sapiens
ggcccagagaagcaa

SEQ ID NO: 1202674 - RNA, 20 nt, Homo sapiens
ggcccagcuguagccauggc

SEQ ID NO: 1202675 - RNA, 15 nt, Homo sapiens
ggcccauacugguug

SEQ ID NO: 1202676 - RNA, 21 nt, Homo sapiens
ggccccagacgcauagacuga

SEQ ID NO: 1202677 - RNA, 14 nt, Homo sapiens
ggccccauccucau

SEQ ID NO: 1202678 - RNA, 21 nt, Homo sapiens
ggcccccgaccaacacuugca

SEQ ID NO: 1202679 - RNA, 13 nt, Homo sapiens
ggccccgggcugg

SEQ ID NO: 1202680 - RNA, 15 nt, Homo sapiens
ggccccugcaucccc

SEQ ID NO: 1202681 - RNA, 19 nt, Homo sapiens
ggcccgacagccuggcaca

SEQ ID NO: 1202682 - RNA, 20 nt, Homo sapiens
ggcccggccaaaauaaugca

SEQ ID NO: 1202683 - RNA, 16 nt, Homo sapiens
ggcccggggaagggaa

SEQ ID NO: 1202684 - RNA, 19 nt, Homo sapiens
ggcccuaaguuaagcaaaa

SEQ ID NO: 1202685 - RNA, 19 nt, Homo sapiens
ggcccugggccucaguuca

SEQ ID NO: 1202686 - RNA, 20 nt, Homo sapiens
ggcccuguccuaagcacuuu

SEQ ID NO: 1202687 - RNA, 20 nt, Homo sapiens
ggccgaaaaggauaugcagu

SEQ ID NO: 1202688 - RNA, 18 nt, Homo sapiens
gguaguuagccaucuaau

SEQ ID NO: 1202689 - RNA, 13 nt, Homo sapiens
gguauaaugauac

SEQ ID NO: 1202690 - RNA, 16 nt, Homo sapiens
gguauauacuuugaaa

SEQ ID NO: 1202691 - RNA, 13 nt, Homo sapiens
gguaucaggugcu

SEQ ID NO: 1202692 - RNA, 17 nt, Homo sapiens
gguauccugggggaccc

SEQ ID NO: 1202693 - RNA, 21 nt, Homo sapiens
gguauuaaauugauguugcug

SEQ ID NO: 1202694 - RNA, 11 nt, Homo sapiens
gguauuugaau

SEQ ID NO: 1202695 - RNA, 12 nt, Homo sapiens
ggucaaacuccc

SEQ ID NO: 1202696 - RNA, 13 nt, Homo sapiens
ggucaaggacaaa

SEQ ID NO: 1202697 - RNA, 15 nt, Homo sapiens
ggucaaucaguguua

SEQ ID NO: 1202698 - RNA, 15 nt, Homo sapiens
ggucagagugccacu

SEQ ID NO: 1202699 - RNA, 13 nt, Homo sapiens
ggucagcauguac

SEQ ID NO: 1202700 - RNA, 18 nt, Homo sapiens
ggucaggaacaguggcug

SEQ ID NO: 1202701 - RNA, 22 nt, Homo sapiens
ggucaggaacaguggcugggug

SEQ ID NO: 1202702 - RNA, 19 nt, Homo sapiens
ggucaggaugcacauuucu

SEQ ID NO: 1202703 - RNA, 12 nt, Homo sapiens
ggucaguccaug

SEQ ID NO: 1202704 - RNA, 14 nt, Homo sapiens
ggucaguuacaaag

SEQ ID NO: 1202705 - RNA, 20 nt, Homo sapiens
ggucauuacaaaaaaacacg

SEQ ID NO: 1202706 - RNA, 23 nt, Homo sapiens
ggucauuucucaaaaaccacagu

SEQ ID NO: 1202707 - RNA, 11 nt, Homo sapiens
gguccacagag

SEQ ID NO: 1202708 - RNA, 14 nt, Homo sapiens
gguccauuuugccu

SEQ ID NO: 1202709 - RNA, 17 nt, Homo sapiens
gguccccaucaucccag

SEQ ID NO: 1202710 - RNA, 15 nt, Homo sapiens
gguccccauccccac

SEQ ID NO: 1202711 - RNA, 20 nt, Homo sapiens
gguccucaguccacugcuga

SEQ ID NO: 1202712 - RNA, 17 nt, Homo sapiens
gguccugcccuuccuga

SEQ ID NO: 1202713 - RNA, 19 nt, Homo sapiens
gguccuggccgucccuaag

SEQ ID NO: 1202714 - RNA, 17 nt, Homo sapiens
gguccuguucccuaccc

SEQ ID NO: 1202715 - RNA, 13 nt, Homo sapiens
gguccuuuggaca

SEQ ID NO: 1202716 - RNA, 16 nt, Homo sapiens
ggucuaacacuggcau

SEQ ID NO: 1202717 - RNA, 22 nt, Homo sapiens
ggucuaagcaccuuggugcuua

SEQ ID NO: 1202718 - RNA, 23 nt, Homo sapiens
ggucuagacuauuaggugcaauu

SEQ ID NO: 1202719 - RNA, 14 nt, Homo sapiens
ggucucccaaacgc

SEQ ID NO: 1202720 - RNA, 17 nt, Homo sapiens
ggucuccucugcagcuc

SEQ ID NO: 1202721 - RNA, 18 nt, Homo sapiens
ggucugauauuaaucaaa

SEQ ID NO: 1202722 - RNA, 17 nt, Homo sapiens
ggucugggacuuccuug

SEQ ID NO: 1202723 - RNA, 14 nt, Homo sapiens
ggucugugugauga

SEQ ID NO: 1202724 - RNA, 14 nt, Homo sapiens
ggucuuccagaccu

SEQ ID NO: 1202725 - RNA, 18 nt, Homo sapiens
ggucuucuccauccucac

SEQ ID NO: 1202726 - RNA, 13 nt, Homo sapiens
ggucuucuuacau

SEQ ID NO: 1202727 - RNA, 18 nt, Homo sapiens
ggucuuuguaucuuccau

SEQ ID NO: 1202728 - RNA, 17 nt, Homo sapiens
ggugaaaauccaucuca

SEQ ID NO: 1202729 - RNA, 18 nt, Homo sapiens
ggugaaaccccgucucua

SEQ ID NO: 1202730 - RNA, 14 nt, Homo sapiens
ggugaaagugcagu

SEQ ID NO: 1202731 - RNA, 16 nt, Homo sapiens
ggugaacacuuaguga

SEQ ID NO: 1202732 - RNA, 13 nt, Homo sapiens
ggugaaccaaaga

SEQ ID NO: 1202733 - RNA, 20 nt, Homo sapiens
ggugaaccuuaguaccuaaa

SEQ ID NO: 1202734 - RNA, 17 nt, Homo sapiens
ggugacacauuacaaag

SEQ ID NO: 1202735 - RNA, 16 nt, Homo sapiens
ggugagagaaguacaa

SEQ ID NO: 1202736 - RNA, 15 nt, Homo sapiens
ggugaggagggcagu

SEQ ID NO: 1202737 - RNA, 17 nt, Homo sapiens
ggugaggggcuggcacu

SEQ ID NO: 1202738 - RNA, 15 nt, Homo sapiens
ggugaggucuguucc

SEQ ID NO: 1202739 - RNA, 19 nt, Homo sapiens
ggugcauagcaagugaaag

SEQ ID NO: 1202740 - RNA, 17 nt, Homo sapiens
ggugcaugaugcugccc

SEQ ID NO: 1202741 - RNA, 16 nt, Homo sapiens
ggugccaaguuccacu

SEQ ID NO: 1202742 - RNA, 19 nt, Homo sapiens
ggugccacucccugagcuu

SEQ ID NO: 1202743 - RNA, 15 nt, Homo sapiens
ggugccccacagcua

SEQ ID NO: 1202744 - RNA, 18 nt, Homo sapiens
ggugcccuuugggguccc

SEQ ID NO: 1202745 - RNA, 16 nt, Homo sapiens
ggugccucucuuggcu

SEQ ID NO: 1202746 - RNA, 22 nt, Homo sapiens
ggugccuucucacaucugucca

SEQ ID NO: 1202747 - RNA, 12 nt, Homo sapiens
ggugcguggcug

SEQ ID NO: 1202748 - RNA, 17 nt, Homo sapiens
ggugcucuuucccuuua

SEQ ID NO: 1202749 - RNA, 16 nt, Homo sapiens
ggugcucuuugcugca

SEQ ID NO: 1202750 - RNA, 17 nt, Homo sapiens
ggugcucuuugcugcac

SEQ ID NO: 1202751 - RNA, 16 nt, Homo sapiens
gguggaaaauggugcc

SEQ ID NO: 1202752 - RNA, 19 nt, Homo sapiens
gguggaaacuccugugucu

SEQ ID NO: 1202753 - RNA, 19 nt, Homo sapiens
gguggaaggcagacagcag

SEQ ID NO: 1202754 - RNA, 17 nt, Homo sapiens
gguggagauugcaguga

SEQ ID NO: 1202755 - RNA, 13 nt, Homo sapiens
gguggagggcaca

SEQ ID NO: 1202756 - RNA, 17 nt, Homo sapiens
gguggagguugcaguga

SEQ ID NO: 1202757 - RNA, 14 nt, Homo sapiens
gguggagugucaca

SEQ ID NO: 1202758 - RNA, 14 nt, Homo sapiens
gguggaguuucuga

SEQ ID NO: 1202759 - RNA, 21 nt, Homo sapiens
gguggaucacgaggucaggag

SEQ ID NO: 1202760 - RNA, 21 nt, Homo sapiens
gguggaugaggagacagaaua

SEQ ID NO: 1202761 - RNA, 22 nt, Homo sapiens
gguggcccuaaaggacucucca

SEQ ID NO: 1202762 - RNA, 17 nt, Homo sapiens
gguggcucacgccugua

SEQ ID NO: 1202763 - RNA, 14 nt, Homo sapiens
gguggcucaugccu

SEQ ID NO: 1202764 - RNA, 22 nt, Homo sapiens
gguggggagcaaaucaucugca

SEQ ID NO: 1202765 - RNA, 14 nt, Homo sapiens
gguggggccauaaa

SEQ ID NO: 1202766 - RNA, 16 nt, Homo sapiens
ggugguaagcaccagg

SEQ ID NO: 1202767 - RNA, 13 nt, Homo sapiens
ggugguaccugag

SEQ ID NO: 1202768 - RNA, 15 nt, Homo sapiens
gguggucugaauguu

SEQ ID NO: 1202769 - RNA, 16 nt, Homo sapiens
ggugguuuuugcucuc

SEQ ID NO: 1202770 - RNA, 13 nt, Homo sapiens
gauuauuugcacg

SEQ ID NO: 1202771 - RNA, 14 nt, Homo sapiens
gauucaaaucuaug

SEQ ID NO: 1202772 - RNA, 13 nt, Homo sapiens
gauucaacacaua

SEQ ID NO: 1202773 - RNA, 14 nt, Homo sapiens
gauucaagucugca

SEQ ID NO: 1202774 - RNA, 17 nt, Homo sapiens
gauucagaugucauuua

SEQ ID NO: 1202775 - RNA, 22 nt, Homo sapiens
gauucagccggagggaagggac

SEQ ID NO: 1202776 - RNA, 14 nt, Homo sapiens
gauucaugccaauu

SEQ ID NO: 1202777 - RNA, 23 nt, Homo sapiens
gauucauuauuuuuccacuuugu

SEQ ID NO: 1202778 - RNA, 14 nt, Homo sapiens
gauuccacuaucuc

SEQ ID NO: 1202779 - RNA, 21 nt, Homo sapiens
gauuccguauugguauacuuu

SEQ ID NO: 1202780 - RNA, 13 nt, Homo sapiens
gauuccugaccca

SEQ ID NO: 1202781 - RNA, 18 nt, Homo sapiens
gauucuaaugucuucauu

SEQ ID NO: 1202782 - RNA, 22 nt, Homo sapiens
gauucuauuuauuaugcuuuau

SEQ ID NO: 1202783 - RNA, 19 nt, Homo sapiens
gauucuccagccaaccuca

SEQ ID NO: 1202784 - RNA, 12 nt, Homo sapiens
gauucuccagua

SEQ ID NO: 1202785 - RNA, 15 nt, Homo sapiens
gauucuccugccuca

SEQ ID NO: 1202786 - RNA, 16 nt, Homo sapiens
gauucuccugccucag

SEQ ID NO: 1202787 - RNA, 14 nt, Homo sapiens
gauucugacauuua

SEQ ID NO: 1202788 - RNA, 17 nt, Homo sapiens
gauucugguuccagggu

SEQ ID NO: 1202789 - RNA, 22 nt, Homo sapiens
gauucuguaauagugaacauau

SEQ ID NO: 1202790 - RNA, 18 nt, Homo sapiens
gauucugucuuauagggu

SEQ ID NO: 1202791 - RNA, 14 nt, Homo sapiens
gauucuguugcaua

SEQ ID NO: 1202792 - RNA, 16 nt, Homo sapiens
gauugaacaagagcuu

SEQ ID NO: 1202793 - RNA, 16 nt, Homo sapiens
gauugaauuucacugu

SEQ ID NO: 1202794 - RNA, 17 nt, Homo sapiens
gauugaggagcugcacu

SEQ ID NO: 1202795 - RNA, 22 nt, Homo sapiens
gauugaggguucaccucugccu

SEQ ID NO: 1202796 - RNA, 15 nt, Homo sapiens
gauugcacagaauuu

SEQ ID NO: 1202797 - RNA, 14 nt, Homo sapiens
gauugcagacuguu

SEQ ID NO: 1202798 - RNA, 16 nt, Homo sapiens
gauugcauuguaugaa

SEQ ID NO: 1202799 - RNA, 19 nt, Homo sapiens
gauugcuuucuucuuaacc

SEQ ID NO: 1202800 - RNA, 20 nt, Homo sapiens
gauuggauuuuacagcuacu

SEQ ID NO: 1202801 - RNA, 21 nt, Homo sapiens
gauuguaaaaaaaaaugccuu

SEQ ID NO: 1202802 - RNA, 16 nt, Homo sapiens
gauuguuuacagucau

SEQ ID NO: 1202803 - RNA, 15 nt, Homo sapiens
gauuuaauacaguuu

SEQ ID NO: 1202804 - RNA, 22 nt, Homo sapiens
gauuuauuuaagggggaaaaag

SEQ ID NO: 1202805 - RNA, 22 nt, Homo sapiens
gauuucaggauacucugucaga

SEQ ID NO: 1202806 - RNA, 21 nt, Homo sapiens
gauuuccuugacuucuuugag

SEQ ID NO: 1202807 - RNA, 14 nt, Homo sapiens
gauuuccuuggcuu

SEQ ID NO: 1202808 - RNA, 15 nt, Homo sapiens
gauuucggaggccau

SEQ ID NO: 1202809 - RNA, 18 nt, Homo sapiens
gauuucugguucugaugc

SEQ ID NO: 1202810 - RNA, 23 nt, Homo sapiens
gauuucuuucuuugcaccaaaga

SEQ ID NO: 1202811 - RNA, 23 nt, Homo sapiens
gauuugggcuacccuaaagggag

SEQ ID NO: 1202812 - RNA, 16 nt, Homo sapiens
gauuugggugaacaaa

SEQ ID NO: 1202813 - RNA, 22 nt, Homo sapiens
gauuugucccuaugcauaucag

SEQ ID NO: 1202814 - RNA, 15 nt, Homo sapiens
gauuuuaacaauaac

SEQ ID NO: 1202815 - RNA, 16 nt, Homo sapiens
gauuuuauuugacaaa

SEQ ID NO: 1202816 - RNA, 22 nt, Homo sapiens
gauuuugaaauauaguaaacac

SEQ ID NO: 1202817 - RNA, 20 nt, Homo sapiens
gauuuugaaauuuuuauuaa

SEQ ID NO: 1202818 - RNA, 19 nt, Homo sapiens
gauuuuugacucuggcaaa

SEQ ID NO: 1202819 - RNA, 19 nt, Homo sapiens
gauuuuuuuaauagugcuu

SEQ ID NO: 1202820 - RNA, 20 nt, Homo sapiens
gcaaaaaaauuaaauuauuu

SEQ ID NO: 1202821 - RNA, 13 nt, Homo sapiens
gcaaaaaacuaau

SEQ ID NO: 1202822 - RNA, 17 nt, Homo sapiens
gcaaaaaacuaauguga

SEQ ID NO: 1202823 - RNA, 12 nt, Homo sapiens
gcaaaaauauca

SEQ ID NO: 1202824 - RNA, 23 nt, Homo sapiens
gcaaaacugccgcaagucugcag

SEQ ID NO: 1202825 - RNA, 20 nt, Homo sapiens
gcaaaauuugaugccaggac

SEQ ID NO: 1202826 - RNA, 22 nt, Homo sapiens
gcaaaauuugaugccaggacac

SEQ ID NO: 1202827 - RNA, 20 nt, Homo sapiens
gcaaacacugggggcaccuu

SEQ ID NO: 1202828 - RNA, 21 nt, Homo sapiens
gcaaacaggguuugauagcac

SEQ ID NO: 1202829 - RNA, 12 nt, Homo sapiens
gcaaaccuuccu

SEQ ID NO: 1202830 - RNA, 21 nt, Homo sapiens
gcaaaccuuccugggaggaca

SEQ ID NO: 1202831 - RNA, 18 nt, Homo sapiens
gcaaacucacugcucaag

SEQ ID NO: 1202832 - RNA, 21 nt, Homo sapiens
gcaaacugccaucauuuacuu

SEQ ID NO: 1202833 - RNA, 22 nt, Homo sapiens
gcaaagaccgauugcauaggaa

SEQ ID NO: 1202834 - RNA, 18 nt, Homo sapiens
gcaaagaccuaccuccag

SEQ ID NO: 1202835 - RNA, 18 nt, Homo sapiens
gcaaagauccccaaaaca

SEQ ID NO: 1202836 - RNA, 15 nt, Homo sapiens
gcaaagccaaaaccu

SEQ ID NO: 1202837 - RNA, 16 nt, Homo sapiens
gcaaagucaucaaaga

SEQ ID NO: 1202838 - RNA, 12 nt, Homo sapiens
gcaaagugcuuu

SEQ ID NO: 1202839 - RNA, 15 nt, Homo sapiens
gcaaauacacuccag

SEQ ID NO: 1202840 - RNA, 21 nt, Homo sapiens
gcaaauauaucugcuauucuc

SEQ ID NO: 1202841 - RNA, 19 nt, Homo sapiens
gcaaauaucauacuguuca

SEQ ID NO: 1202842 - RNA, 20 nt, Homo sapiens
gcaaauaucauacuguucaa

SEQ ID NO: 1202843 - RNA, 21 nt, Homo sapiens
gcaaauaucauacuguucaau

SEQ ID NO: 1202844 - RNA, 21 nt, Homo sapiens
gauacaugugccgaaugugca

SEQ ID NO: 1202845 - RNA, 13 nt, Homo sapiens
gauaccacugcac

SEQ ID NO: 1202846 - RNA, 15 nt, Homo sapiens
gauaccacugcacug

SEQ ID NO: 1202847 - RNA, 14 nt, Homo sapiens
gauaccacuuaaca

SEQ ID NO: 1202848 - RNA, 18 nt, Homo sapiens
gauaccauggcacugaca

SEQ ID NO: 1202849 - RNA, 22 nt, Homo sapiens
gauaccugcacuguccugacca

SEQ ID NO: 1202850 - RNA, 17 nt, Homo sapiens
gauacuugccaaaauga

SEQ ID NO: 1202851 - RNA, 21 nt, Homo sapiens
gauacuuggaugcagcucuug

SEQ ID NO: 1202852 - RNA, 11 nt, Homo sapiens
gauacuuugac

SEQ ID NO: 1202853 - RNA, 15 nt, Homo sapiens
gauacuuuuacaggu

SEQ ID NO: 1202854 - RNA, 23 nt, Homo sapiens
gauagagaguuguuguguacaga

SEQ ID NO: 1202855 - RNA, 20 nt, Homo sapiens
gauagauauaugcucugcau

SEQ ID NO: 1202856 - RNA, 18 nt, Homo sapiens
gauagcaaacacuggggg

SEQ ID NO: 1202857 - RNA, 12 nt, Homo sapiens
gauagcacuuuc

SEQ ID NO: 1202858 - RNA, 12 nt, Homo sapiens
gauagcuuuauu

SEQ ID NO: 1202859 - RNA, 21 nt, Homo sapiens
gauaggaagacgcagagcaaa

SEQ ID NO: 1202860 - RNA, 14 nt, Homo sapiens
gauaggccuguggg

SEQ ID NO: 1202861 - RNA, 12 nt, Homo sapiens
gauaguuuaccu

SEQ ID NO: 1202862 - RNA, 23 nt, Homo sapiens
gauauaauuuaacuguguuuuag

SEQ ID NO: 1202863 - RNA, 22 nt, Homo sapiens
gauauauaaguguacauaugug

SEQ ID NO: 1202864 - RNA, 17 nt, Homo sapiens
gauauauaccacuuucc

SEQ ID NO: 1202865 - RNA, 13 nt, Homo sapiens
gauauaugcucug

SEQ ID NO: 1202866 - RNA, 13 nt, Homo sapiens
gauaucacuucca

SEQ ID NO: 1202867 - RNA, 21 nt, Homo sapiens
gauaucacuuccaugacauaa

SEQ ID NO: 1202868 - RNA, 12 nt, Homo sapiens
gauaucuuggcu

SEQ ID NO: 1202869 - RNA, 13 nt, Homo sapiens
gauauugaugaaa

SEQ ID NO: 1202870 - RNA, 13 nt, Homo sapiens
gauauugaugaua

SEQ ID NO: 1202871 - RNA, 19 nt, Homo sapiens
gauauuuauuuuuugccau

SEQ ID NO: 1202872 - RNA, 23 nt, Homo sapiens
gauauuuuaccucuuauugcaaa

SEQ ID NO: 1202873 - RNA, 17 nt, Homo sapiens
gaucaaagaacugaaag

SEQ ID NO: 1202874 - RNA, 20 nt, Homo sapiens
gaucaaaguguaaacaccau

SEQ ID NO: 1202875 - RNA, 19 nt, Homo sapiens
gaucaaauguauagacuug

SEQ ID NO: 1202876 - RNA, 22 nt, Homo sapiens
gaucaaauugugcaguacuuug

SEQ ID NO: 1202877 - RNA, 18 nt, Homo sapiens
gaucaacgccucacugaa

SEQ ID NO: 1202878 - RNA, 17 nt, Homo sapiens
gaucaaggaguacaaug

SEQ ID NO: 1202879 - RNA, 16 nt, Homo sapiens
gaucacguugcaaugg

SEQ ID NO: 1202880 - RNA, 12 nt, Homo sapiens
gaucacuacuca

SEQ ID NO: 1202881 - RNA, 19 nt, Homo sapiens
gaucacuugaggccaguga

SEQ ID NO: 1202882 - RNA, 18 nt, Homo sapiens
gaucacuugaguucagga

SEQ ID NO: 1202883 - RNA, 11 nt, Homo sapiens
gaucagaucaa

SEQ ID NO: 1202884 - RNA, 15 nt, Homo sapiens
gaucagcgacccuga

SEQ ID NO: 1202885 - RNA, 17 nt, Homo sapiens
gaucagcgacugccaca

SEQ ID NO: 1202886 - RNA, 15 nt, Homo sapiens
gaucagcuucuugca

SEQ ID NO: 1202887 - RNA, 15 nt, Homo sapiens
gaucaguauuucacu

SEQ ID NO: 1202888 - RNA, 19 nt, Homo sapiens
gaucaguguuguugcucua

SEQ ID NO: 1202889 - RNA, 17 nt, Homo sapiens
gaucaguugaggccagg

SEQ ID NO: 1202890 - RNA, 18 nt, Homo sapiens
gaucauagguauuucaaa

SEQ ID NO: 1202891 - RNA, 19 nt, Homo sapiens
gaucauagguauuucaaaa

SEQ ID NO: 1202892 - RNA, 13 nt, Homo sapiens
gaucauauuucac

SEQ ID NO: 1202893 - RNA, 13 nt, Homo sapiens
gaucaucagucac

SEQ ID NO: 1202894 - RNA, 17 nt, Homo sapiens
cuuccugaguggugcca

SEQ ID NO: 1202895 - RNA, 23 nt, Homo sapiens
cuuccuggccccucucucacugg

SEQ ID NO: 1202896 - RNA, 20 nt, Homo sapiens
cuuccuggcuccaacacugc

SEQ ID NO: 1202897 - RNA, 14 nt, Homo sapiens
cuuccuggcuguaa

SEQ ID NO: 1202898 - RNA, 21 nt, Homo sapiens
cuuccuggguccuguucccua

SEQ ID NO: 1202899 - RNA, 23 nt, Homo sapiens
cuuccuggguccuguucccuacc

SEQ ID NO: 1202900 - RNA, 16 nt, Homo sapiens
cuuccuguaaugcagg

SEQ ID NO: 1202901 - RNA, 16 nt, Homo sapiens
cuuccugugacuucag

SEQ ID NO: 1202902 - RNA, 12 nt, Homo sapiens
cuuccugugauc

SEQ ID NO: 1202903 - RNA, 15 nt, Homo sapiens
cuuccugugauccac

SEQ ID NO: 1202904 - RNA, 20 nt, Homo sapiens
cuuccugugauccacccaac

SEQ ID NO: 1202905 - RNA, 20 nt, Homo sapiens
cuuccuuaaagcauuugcaa

SEQ ID NO: 1202906 - RNA, 18 nt, Homo sapiens
cuuccuuccucucugcaa

SEQ ID NO: 1202907 - RNA, 22 nt, Homo sapiens
cuuccuuucuccaggaccaaua

SEQ ID NO: 1202908 - RNA, 14 nt, Homo sapiens
cuucgacucaggau

SEQ ID NO: 1202909 - RNA, 22 nt, Homo sapiens
cuucgggcugugcccggggaaa

SEQ ID NO: 1202910 - RNA, 15 nt, Homo sapiens
cuucgucuucacucu

SEQ ID NO: 1202911 - RNA, 16 nt, Homo sapiens
cuucguuagaccgcuc

SEQ ID NO: 1202912 - RNA, 21 nt, Homo sapiens
cuucuaaacccaauccaaaug

SEQ ID NO: 1202913 - RNA, 15 nt, Homo sapiens
cuucuacagaagcca

SEQ ID NO: 1202914 - RNA, 12 nt, Homo sapiens
cuucuacugcua

SEQ ID NO: 1202915 - RNA, 16 nt, Homo sapiens
cuucuagaaccugggc

SEQ ID NO: 1202916 - RNA, 23 nt, Homo sapiens
cuucuagaaucucguuucuccuc

SEQ ID NO: 1202917 - RNA, 22 nt, Homo sapiens
cuucuaggucacuucucacaau

SEQ ID NO: 1202918 - RNA, 15 nt, Homo sapiens
cuucuauggggucua

SEQ ID NO: 1202919 - RNA, 21 nt, Homo sapiens
cuucucaaaguacugggauua

SEQ ID NO: 1202920 - RNA, 16 nt, Homo sapiens
cuucucaagugccuua

SEQ ID NO: 1202921 - RNA, 20 nt, Homo sapiens
cuucucauccccagucccaa

SEQ ID NO: 1202922 - RNA, 17 nt, Homo sapiens
cuucuccaaaugagauc

SEQ ID NO: 1202923 - RNA, 14 nt, Homo sapiens
cuucuccacuggau

SEQ ID NO: 1202924 - RNA, 12 nt, Homo sapiens
cuucuccauaaa

SEQ ID NO: 1202925 - RNA, 15 nt, Homo sapiens
cuucuccccauucug

SEQ ID NO: 1202926 - RNA, 22 nt, Homo sapiens
cuucucuauugggcacagccua

SEQ ID NO: 1202927 - RNA, 19 nt, Homo sapiens
cuucucuccagcugacuaa

SEQ ID NO: 1202928 - RNA, 13 nt, Homo sapiens
cuucucugcaaug

SEQ ID NO: 1202929 - RNA, 22 nt, Homo sapiens
cuucucugcaaugcuucuguag

SEQ ID NO: 1202930 - RNA, 16 nt, Homo sapiens
cuucucugcacuuaua

SEQ ID NO: 1202931 - RNA, 14 nt, Homo sapiens
cuucucuucucugc

SEQ ID NO: 1202932 - RNA, 17 nt, Homo sapiens
cuucucuucucugcaau

SEQ ID NO: 1202933 - RNA, 22 nt, Homo sapiens
cuucucuugggaacuccacucu

SEQ ID NO: 1202934 - RNA, 15 nt, Homo sapiens
cuucugaaugcugcu

SEQ ID NO: 1202935 - RNA, 16 nt, Homo sapiens
cuucugauaaacacaa

SEQ ID NO: 1202936 - RNA, 17 nt, Homo sapiens
cuucugcaacaucuuaa

SEQ ID NO: 1202937 - RNA, 15 nt, Homo sapiens
cuucugcaacugaaa

SEQ ID NO: 1202938 - RNA, 22 nt, Homo sapiens
cuucugcaacugaaauuacaua

SEQ ID NO: 1202939 - RNA, 13 nt, Homo sapiens
cuucugcacacaa

SEQ ID NO: 1202940 - RNA, 16 nt, Homo sapiens
cuucugcacccuccac

SEQ ID NO: 1202941 - RNA, 16 nt, Homo sapiens
cuucugggaacuuccu

SEQ ID NO: 1202942 - RNA, 18 nt, Homo sapiens
cuucugggaacuuccuca

SEQ ID NO: 1202943 - RNA, 16 nt, Homo sapiens
cuucugggacuggaca

SEQ ID NO: 1202944 - RNA, 14 nt, Homo sapiens
cuucuggucugugu

SEQ ID NO: 1202945 - RNA, 17 nt, Homo sapiens
cuucuguaguacuccuu

SEQ ID NO: 1202946 - RNA, 18 nt, Homo sapiens
cuucuguggucaccccau

SEQ ID NO: 1202947 - RNA, 12 nt, Homo sapiens
cuucugugugac

SEQ ID NO: 1202948 - RNA, 16 nt, Homo sapiens
cuucuuaacagacuca

SEQ ID NO: 1202949 - RNA, 14 nt, Homo sapiens
cuucuuaaucugaa

SEQ ID NO: 1202950 - RNA, 17 nt, Homo sapiens
cuucuuacaacagagau

SEQ ID NO: 1202951 - RNA, 19 nt, Homo sapiens
cuucuuacaugcauuugag

SEQ ID NO: 1202952 - RNA, 15 nt, Homo sapiens
cuucuuacccaaagc

SEQ ID NO: 1202953 - RNA, 14 nt, Homo sapiens
cuucuuacuaagcu

SEQ ID NO: 1202954 - RNA, 21 nt, Homo sapiens
cuucuuacucauuacugcaaa

SEQ ID NO: 1202955 - RNA, 12 nt, Homo sapiens
cuucuuacugau

SEQ ID NO: 1202956 - RNA, 15 nt, Homo sapiens
cuucuuacuggugcu

SEQ ID NO: 1202957 - RNA, 18 nt, Homo sapiens
cuucuucccucccuaucu

SEQ ID NO: 1202958 - RNA, 18 nt, Homo sapiens
cuucuuccugggucuuca

SEQ ID NO: 1202959 - RNA, 20 nt, Homo sapiens
cuucuugccucugugcugug

SEQ ID NO: 1202960 - RNA, 23 nt, Homo sapiens
cuucuuggcguauuuauacucac

SEQ ID NO: 1202961 - RNA, 16 nt, Homo sapiens
cuucuuucaucugggg

SEQ ID NO: 1202962 - RNA, 16 nt, Homo sapiens
cuucuuuuaugagcag

SEQ ID NO: 1202963 - RNA, 15 nt, Homo sapiens
cuucuuuugaacugu

SEQ ID NO: 1202964 - RNA, 20 nt, Homo sapiens
cuucuuuuuuuuugagaugg

SEQ ID NO: 1202965 - RNA, 15 nt, Homo sapiens
cuugaaaauagaaca

SEQ ID NO: 1202966 - RNA, 14 nt, Homo sapiens
cuugaaacauuaua

SEQ ID NO: 1202967 - RNA, 21 nt, Homo sapiens
cuugaaaggaagagcuaauaa

SEQ ID NO: 1202968 - RNA, 13 nt, Homo sapiens
cuugaaaguuuuc

SEQ ID NO: 1202969 - RNA, 23 nt, Homo sapiens
cuugaaauuuggcuaauaacaaa

SEQ ID NO: 1202970 - RNA, 17 nt, Homo sapiens
cuugaaccacaguucua

SEQ ID NO: 1202971 - RNA, 17 nt, Homo sapiens
cuugaacucuguucccc

SEQ ID NO: 1202972 - RNA, 12 nt, Homo sapiens
cuugaagccaaa

SEQ ID NO: 1202973 - RNA, 15 nt, Homo sapiens
cuugaagcuguggag

SEQ ID NO: 1202974 - RNA, 13 nt, Homo sapiens
cuugaauuguagg

SEQ ID NO: 1202975 - RNA, 14 nt, Homo sapiens
cuugaauuuaauac

SEQ ID NO: 1202976 - RNA, 15 nt, Homo sapiens
caccucccugaaauu

SEQ ID NO: 1202977 - RNA, 20 nt, Homo sapiens
caccucccugcucagugcuu

SEQ ID NO: 1202978 - RNA, 23 nt, Homo sapiens
caccucggagcaugguguuuuca

SEQ ID NO: 1202979 - RNA, 14 nt, Homo sapiens
caccucugugccca

SEQ ID NO: 1202980 - RNA, 15 nt, Homo sapiens
caccugacagcuuua

SEQ ID NO: 1202981 - RNA, 15 nt, Homo sapiens
caccugacucuugca

SEQ ID NO: 1202982 - RNA, 18 nt, Homo sapiens
caccugagacaugcugaa

SEQ ID NO: 1202983 - RNA, 20 nt, Homo sapiens
caccugagacaugcugaaau

SEQ ID NO: 1202984 - RNA, 16 nt, Homo sapiens
caccugccauuugcac

SEQ ID NO: 1202985 - RNA, 22 nt, Homo sapiens
caccugccugcaucugugaaaa

SEQ ID NO: 1202986 - RNA, 22 nt, Homo sapiens
caccuggaugggggucccugug

SEQ ID NO: 1202987 - RNA, 19 nt, Homo sapiens
caccuggauguacuaucca

SEQ ID NO: 1202988 - RNA, 21 nt, Homo sapiens
caccuggaugucugggugacc

SEQ ID NO: 1202989 - RNA, 13 nt, Homo sapiens
caccuggccaagc

SEQ ID NO: 1202990 - RNA, 21 nt, Homo sapiens
caccugggaaaauaccagaaa

SEQ ID NO: 1202991 - RNA, 14 nt, Homo sapiens
caccuguaauccca

SEQ ID NO: 1202992 - RNA, 18 nt, Homo sapiens
caccugucaucauggagg

SEQ ID NO: 1202993 - RNA, 19 nt, Homo sapiens
caccugugagauccgugaa

SEQ ID NO: 1202994 - RNA, 19 nt, Homo sapiens
caccuucacucuccagggu

SEQ ID NO: 1202995 - RNA, 14 nt, Homo sapiens
caccuugaccaaaa

SEQ ID NO: 1202996 - RNA, 15 nt, Homo sapiens
caccuugugucugua

SEQ ID NO: 1202997 - RNA, 16 nt, Homo sapiens
caccuuugcacaggau

SEQ ID NO: 1202998 - RNA, 17 nt, Homo sapiens
caccuuugccacaaagc

SEQ ID NO: 1202999 - RNA, 17 nt, Homo sapiens
caccuuuuauugacaca

SEQ ID NO: 1203000 - RNA, 21 nt, Homo sapiens
cacgaaacuuguuauugugaa

SEQ ID NO: 1203001 - RNA, 20 nt, Homo sapiens
cacgaaagaaauguaccuuc

SEQ ID NO: 1203002 - RNA, 13 nt, Homo sapiens
cacgaacugaaau

SEQ ID NO: 1203003 - RNA, 19 nt, Homo sapiens
cacgaagcacgaucagucc

SEQ ID NO: 1203004 - RNA, 16 nt, Homo sapiens
cacgaccauuugauag

SEQ ID NO: 1203005 - RNA, 14 nt, Homo sapiens
cacgaggugcagua

SEQ ID NO: 1203006 - RNA, 15 nt, Homo sapiens
cacgaucucaguuca

SEQ ID NO: 1203007 - RNA, 19 nt, Homo sapiens
cacgauuugucuuaucccc

SEQ ID NO: 1203008 - RNA, 15 nt, Homo sapiens
cacgcaagggcauca

SEQ ID NO: 1203009 - RNA, 20 nt, Homo sapiens
cacgcacacacacaaacaca

SEQ ID NO: 1203010 - RNA, 13 nt, Homo sapiens
cacgcucgcugcc

SEQ ID NO: 1203011 - RNA, 15 nt, Homo sapiens
cacgcugaaggcuua

SEQ ID NO: 1203012 - RNA, 16 nt, Homo sapiens
cacgcuggagugcagu

SEQ ID NO: 1203013 - RNA, 20 nt, Homo sapiens
cacggaggguccagacuguc

SEQ ID NO: 1203014 - RNA, 18 nt, Homo sapiens
cacggauaucaauuugag

SEQ ID NO: 1203015 - RNA, 18 nt, Homo sapiens
cacggaugacuuaacugc

SEQ ID NO: 1203016 - RNA, 17 nt, Homo sapiens
cacgggcaaucaugagc

SEQ ID NO: 1203017 - RNA, 23 nt, Homo sapiens
cacgguggcucacgccuguaauc

SEQ ID NO: 1203018 - RNA, 19 nt, Homo sapiens
cacggugggagaccugcug

SEQ ID NO: 1203019 - RNA, 15 nt, Homo sapiens
cacgucacacagggg

SEQ ID NO: 1203020 - RNA, 15 nt, Homo sapiens
cacgugccugugauc

SEQ ID NO: 1203021 - RNA, 16 nt, Homo sapiens
cacgugucucagacug

SEQ ID NO: 1203022 - RNA, 15 nt, Homo sapiens
cacguuagauuugcc

SEQ ID NO: 1203023 - RNA, 22 nt, Homo sapiens
cacuaagggguauguucccucu

SEQ ID NO: 1203024 - RNA, 16 nt, Homo sapiens
cacuaaggugugcucu

SEQ ID NO: 1203025 - RNA, 11 nt, Homo sapiens
cacuaauuccu

SEQ ID NO: 1203026 - RNA, 23 nt, Homo sapiens
cacuacauaauugcuguucugcu

SEQ ID NO: 1203027 - RNA, 21 nt, Homo sapiens
cacuacucaauacuaccucug

SEQ ID NO: 1203028 - RNA, 17 nt, Homo sapiens
cacuagucacauucuug

SEQ ID NO: 1203029 - RNA, 17 nt, Homo sapiens
cacuagucucaccagcc

SEQ ID NO: 1203030 - RNA, 20 nt, Homo sapiens
cacuauaguuuaaaacacau

SEQ ID NO: 1203031 - RNA, 15 nt, Homo sapiens
cacuauaugaucagu

SEQ ID NO: 1203032 - RNA, 14 nt, Homo sapiens
cacuaucuguaaug

SEQ ID NO: 1203033 - RNA, 22 nt, Homo sapiens
cacuaugaggaauaauuauuua

SEQ ID NO: 1203034 - RNA, 14 nt, Homo sapiens
cacuauguauauac

SEQ ID NO: 1203035 - RNA, 17 nt, Homo sapiens
cacuauguggagcucag

SEQ ID NO: 1203036 - RNA, 16 nt, Homo sapiens
cacuauucuugaauua

SEQ ID NO: 1203037 - RNA, 14 nt, Homo sapiens
cacuauuuacauac

SEQ ID NO: 1203038 - RNA, 14 nt, Homo sapiens
cacucaaaagacaa

SEQ ID NO: 1203039 - RNA, 15 nt, Homo sapiens
cacucaaaagacaaa

SEQ ID NO: 1203040 - RNA, 14 nt, Homo sapiens
cacucaagcacuga

SEQ ID NO: 1203041 - RNA, 16 nt, Homo sapiens
cacucaagcacugaua

SEQ ID NO: 1203042 - RNA, 17 nt, Homo sapiens
cacucacagauguuuga

SEQ ID NO: 1203043 - RNA, 16 nt, Homo sapiens
cacucaccucacuguu

SEQ ID NO: 1203044 - RNA, 22 nt, Homo sapiens
cacucacucucccccuccucuu

SEQ ID NO: 1203045 - RNA, 20 nt, Homo sapiens
cacucagaaaagaaaaccau

SEQ ID NO: 1203046 - RNA, 16 nt, Homo sapiens
ccacuaggacucugag

SEQ ID NO: 1203047 - RNA, 22 nt, Homo sapiens
ccacuaggguccaccaggaguu

SEQ ID NO: 1203048 - RNA, 22 nt, Homo sapiens
ccacuaguuuuuggacuaugua

SEQ ID NO: 1203049 - RNA, 13 nt, Homo sapiens
ccacucuaccuga

SEQ ID NO: 1203050 - RNA, 22 nt, Homo sapiens
ccacucuaugaguuggacuuca

SEQ ID NO: 1203051 - RNA, 22 nt, Homo sapiens
ccacucugaaguaagagcaaug

SEQ ID NO: 1203052 - RNA, 18 nt, Homo sapiens
ccacugaacauuugcuuu

SEQ ID NO: 1203053 - RNA, 20 nt, Homo sapiens
ccacugaucucuacuaccac

SEQ ID NO: 1203054 - RNA, 17 nt, Homo sapiens
ccacugaugcuguucuc

SEQ ID NO: 1203055 - RNA, 22 nt, Homo sapiens
ccacugccuuuucucacucaga

SEQ ID NO: 1203056 - RNA, 14 nt, Homo sapiens
ccacuggacuugag

SEQ ID NO: 1203057 - RNA, 19 nt, Homo sapiens
ccacuggggaaugcuccca

SEQ ID NO: 1203058 - RNA, 22 nt, Homo sapiens
ccacuggucuguagggauuuuu

SEQ ID NO: 1203059 - RNA, 16 nt, Homo sapiens
ccacuguguacugugg

SEQ ID NO: 1203060 - RNA, 14 nt, Homo sapiens
ccacuguguauaga

SEQ ID NO: 1203061 - RNA, 15 nt, Homo sapiens
ccacuguguauuuaa

SEQ ID NO: 1203062 - RNA, 23 nt, Homo sapiens
ccacuguugguauuauauaauuc

SEQ ID NO: 1203063 - RNA, 13 nt, Homo sapiens
ccacuuccugcua

SEQ ID NO: 1203064 - RNA, 12 nt, Homo sapiens
ccacuucugcca

SEQ ID NO: 1203065 - RNA, 18 nt, Homo sapiens
ccacuuuggaaaauguca

SEQ ID NO: 1203066 - RNA, 12 nt, Homo sapiens
ccagaacccaga

SEQ ID NO: 1203067 - RNA, 15 nt, Homo sapiens
ccagaacugccccca

SEQ ID NO: 1203068 - RNA, 21 nt, Homo sapiens
ccagaagaacaguaggugaca

SEQ ID NO: 1203069 - RNA, 14 nt, Homo sapiens
ccagaagagguaua

SEQ ID NO: 1203070 - RNA, 18 nt, Homo sapiens
ccagaaggaaccagccau

SEQ ID NO: 1203071 - RNA, 23 nt, Homo sapiens
ccagaaguuuuaacuuccagugg

SEQ ID NO: 1203072 - RNA, 17 nt, Homo sapiens
ccagaauaucugggauu

SEQ ID NO: 1203073 - RNA, 19 nt, Homo sapiens
ccagaaugcugcaggacuu

SEQ ID NO: 1203074 - RNA, 23 nt, Homo sapiens
ccagaaugugaagacaaguagua

SEQ ID NO: 1203075 - RNA, 20 nt, Homo sapiens
ccagacaacuuguccugacu

SEQ ID NO: 1203076 - RNA, 17 nt, Homo sapiens
ccagacacagacuggca

SEQ ID NO: 1203077 - RNA, 20 nt, Homo sapiens
ccagacacagacuggcaaua

SEQ ID NO: 1203078 - RNA, 22 nt, Homo sapiens
ccagacacuggcguuacugcuu

SEQ ID NO: 1203079 - RNA, 15 nt, Homo sapiens
ccagaccugcuuccu

SEQ ID NO: 1203080 - RNA, 22 nt, Homo sapiens
ccagacugcagguuggacccca

SEQ ID NO: 1203081 - RNA, 18 nt, Homo sapiens
ccagagagcaacucugag

SEQ ID NO: 1203082 - RNA, 18 nt, Homo sapiens
ccagagaugccagcccuu

SEQ ID NO: 1203083 - RNA, 22 nt, Homo sapiens
ccagagcaucucggaguucaga

SEQ ID NO: 1203084 - RNA, 23 nt, Homo sapiens
ccagagccagccagcauggccac

SEQ ID NO: 1203085 - RNA, 19 nt, Homo sapiens
ccagagcugagauggcaua

SEQ ID NO: 1203086 - RNA, 20 nt, Homo sapiens
ccagagcugggaggcauggc

SEQ ID NO: 1203087 - RNA, 14 nt, Homo sapiens
ccagagcugugcca

SEQ ID NO: 1203088 - RNA, 16 nt, Homo sapiens
ccagaggaacugucca

SEQ ID NO: 1203089 - RNA, 17 nt, Homo sapiens
ccagaggaauccuggca

SEQ ID NO: 1203090 - RNA, 18 nt, Homo sapiens
ccagaggcagagccugag

SEQ ID NO: 1203091 - RNA, 18 nt, Homo sapiens
ccagaggcucuaauguac

SEQ ID NO: 1203092 - RNA, 24 nt, Homo sapiens
ccagagggaccggaguuaugacaa

SEQ ID NO: 1203093 - RNA, 20 nt, Homo sapiens
ccagaggggcucaggucaca

SEQ ID NO: 1203094 - RNA, 14 nt, Homo sapiens
ccagaggugcuucu

SEQ ID NO: 1203095 - RNA, 11 nt, Homo sapiens
ccagagucaga

SEQ ID NO: 1203096 - RNA, 23 nt, Homo sapiens
ccagaguccuuuccaaggcuucu

SEQ ID NO: 1203097 - RNA, 17 nt, Homo sapiens
ccagaucacugccacac

SEQ ID NO: 1203098 - RNA, 22 nt, Homo sapiens
ccagaucacugccacacucucc

SEQ ID NO: 1203099 - RNA, 17 nt, Homo sapiens
ccagaucugucuccaag

SEQ ID NO: 1203100 - RNA, 13 nt, Homo sapiens
ccagaugauauaa

SEQ ID NO: 1203101 - RNA, 19 nt, Homo sapiens
ccagaugugaaaacaucuc

SEQ ID NO: 1203102 - RNA, 23 nt, Homo sapiens
ccagauugacgacaagugcugaa

SEQ ID NO: 1203103 - RNA, 22 nt, Homo sapiens
ccagcaaaagagcuauugccaa

SEQ ID NO: 1203104 - RNA, 20 nt, Homo sapiens
ccagcaaugauguccagaag

SEQ ID NO: 1203105 - RNA, 13 nt, Homo sapiens
ccagcaauuccau

SEQ ID NO: 1203106 - RNA, 11 nt, Homo sapiens
ccagcacucug

SEQ ID NO: 1203107 - RNA, 13 nt, Homo sapiens
ccagcacucugaa

SEQ ID NO: 1203108 - RNA, 18 nt, Homo sapiens
ccagcacucugaaacuga

SEQ ID NO: 1203109 - RNA, 10 nt, Homo sapiens
ccagcacuuc

SEQ ID NO: 1203110 - RNA, 15 nt, Homo sapiens
ccagcagacucugga

SEQ ID NO: 1203111 - RNA, 21 nt, Homo sapiens
ccagcagagggggaguagcca

SEQ ID NO: 1203112 - RNA, 18 nt, Homo sapiens
ccagcagaugccacauaa

SEQ ID NO: 1203113 - RNA, 21 nt, Homo sapiens
ccagcagcacagucacccaug

SEQ ID NO: 1203114 - RNA, 14 nt, Homo sapiens
ccagcagugccuug

SEQ ID NO: 1203115 - RNA, 14 nt, Homo sapiens
ccagccaagcuuua

SEQ ID NO: 1203116 - RNA, 15 nt, Homo sapiens
ccagccacacccaga

SEQ ID NO: 1203117 - RNA, 16 nt, Homo sapiens
ccagccacacccagag

SEQ ID NO: 1203118 - RNA, 22 nt, Homo sapiens
ccagccaccccgggcucucugc

SEQ ID NO: 1203119 - RNA, 14 nt, Homo sapiens
ccagccagugccau

SEQ ID NO: 1203120 - RNA, 18 nt, Homo sapiens
ccagccagugccauucca

SEQ ID NO: 1203121 - RNA, 14 nt, Homo sapiens
ccagccaugcauug

SEQ ID NO: 1203122 - RNA, 21 nt, Homo sapiens
ccagcccauggcccccaauaa

SEQ ID NO: 1203123 - RNA, 15 nt, Homo sapiens
ccagccccacugcca

SEQ ID NO: 1203124 - RNA, 16 nt, Homo sapiens
ccagcccugggaacca

SEQ ID NO: 1203125 - RNA, 23 nt, Homo sapiens
ccagcccuguucugggugcagcu

SEQ ID NO: 1203126 - RNA, 16 nt, Homo sapiens
ccagccguauuuuaca

SEQ ID NO: 1203127 - RNA, 21 nt, Homo sapiens
ccagccuaugagcauccugag

SEQ ID NO: 1203128 - RNA, 20 nt, Homo sapiens
ccagccugaggcagccacuu

SEQ ID NO: 1203129 - RNA, 16 nt, Homo sapiens
ccagccugccuggcag

SEQ ID NO: 1203130 - RNA, 22 nt, Homo sapiens
ccagccugcuaauuccccagau

SEQ ID NO: 1203131 - RNA, 15 nt, Homo sapiens
ccagccugcucccua

SEQ ID NO: 1203132 - RNA, 21 nt, Homo sapiens
ccagccugggacucccaguga

SEQ ID NO: 1203133 - RNA, 22 nt, Homo sapiens
ccagccugggacucccagugaa

SEQ ID NO: 1203134 - RNA, 20 nt, Homo sapiens
ccagccugggcaacauacca

SEQ ID NO: 1203135 - RNA, 17 nt, Homo sapiens
ccagcuaacucugaccu

SEQ ID NO: 1203136 - RNA, 17 nt, Homo sapiens
ccagcuaaggacauuuc

SEQ ID NO: 1203137 - RNA, 17 nt, Homo sapiens
ccagcucccuagacugc

SEQ ID NO: 1203138 - RNA, 16 nt, Homo sapiens
ccagcucuaguuuuca

SEQ ID NO: 1203139 - RNA, 18 nt, Homo sapiens
ccagcugcucccaaauaa

SEQ ID NO: 1203140 - RNA, 15 nt, Homo sapiens
ccagcugugcacuuu

SEQ ID NO: 1203141 - RNA, 18 nt, Homo sapiens
ccagcuucugguacucuc

SEQ ID NO: 1203142 - RNA, 17 nt, Homo sapiens
ccagcuuugcagugaca

SEQ ID NO: 1203143 - RNA, 14 nt, Homo sapiens
ccagcuuugcccaa

SEQ ID NO: 1203144 - RNA, 22 nt, Homo sapiens
ccagcuuuuagaaaaugcaguc

SEQ ID NO: 1203145 - RNA, 21 nt, Homo sapiens
ccaggacucagugaucccugg

SEQ ID NO: 1203146 - RNA, 19 nt, Homo sapiens
ccaggagagagcuacggca

SEQ ID NO: 1203147 - RNA, 21 nt, Homo sapiens
ccaggagauggaaguugcagu

SEQ ID NO: 1203148 - RNA, 23 nt, Homo sapiens
ccaggagguggagguugcaguga

SEQ ID NO: 1203149 - RNA, 14 nt, Homo sapiens
ccaggauacuggca

SEQ ID NO: 1203150 - RNA, 15 nt, Homo sapiens
ccaggaucauggugu

SEQ ID NO: 1203151 - RNA, 22 nt, Homo sapiens
ccaggaugcccagaugaacuga

SEQ ID NO: 1203152 - RNA, 20 nt, Homo sapiens
ccaggauucccccaacacac

SEQ ID NO: 1203153 - RNA, 16 nt, Homo sapiens
ccaggcagucgggggc

SEQ ID NO: 1203154 - RNA, 17 nt, Homo sapiens
ccaggccagagggcagu

SEQ ID NO: 1203155 - RNA, 12 nt, Homo sapiens
ccaggccaguga

SEQ ID NO: 1203156 - RNA, 22 nt, Homo sapiens
ccaggccuccccgguggccaga

SEQ ID NO: 1203157 - RNA, 15 nt, Homo sapiens
ccaggccugccuguu

SEQ ID NO: 1203158 - RNA, 15 nt, Homo sapiens
ccaggcuaugccauc

SEQ ID NO: 1203159 - RNA, 18 nt, Homo sapiens
ccaggcugcacugcagug

SEQ ID NO: 1203160 - RNA, 20 nt, Homo sapiens
ccaggcuggagugcaauggc

SEQ ID NO: 1203161 - RNA, 18 nt, Homo sapiens
ccaggcuggagugcagug

SEQ ID NO: 1203162 - RNA, 18 nt, Homo sapiens
ccaggcuggcgugcagug

SEQ ID NO: 1203163 - RNA, 20 nt, Homo sapiens
ccaggcuggcgugcaguggu

SEQ ID NO: 1203164 - RNA, 15 nt, Homo sapiens
ccaggcugggaacuc

SEQ ID NO: 1203165 - RNA, 16 nt, Homo sapiens
ccaggcuggucucaaa

SEQ ID NO: 1203166 - RNA, 17 nt, Homo sapiens
ccaggcuuucaauguuu

SEQ ID NO: 1203167 - RNA, 16 nt, Homo sapiens
cuguggauacccuuac

SEQ ID NO: 1203168 - RNA, 20 nt, Homo sapiens
cuguggaugaugguugcaaa

SEQ ID NO: 1203169 - RNA, 12 nt, Homo sapiens
cuguggaugcuu

SEQ ID NO: 1203170 - RNA, 15 nt, Homo sapiens
cuguggcacuggcca

SEQ ID NO: 1203171 - RNA, 14 nt, Homo sapiens
cuguggcagaguua

SEQ ID NO: 1203172 - RNA, 17 nt, Homo sapiens
cuguggcuagugacaaa

SEQ ID NO: 1203173 - RNA, 20 nt, Homo sapiens
cuguggcucugcaugacaaa

SEQ ID NO: 1203174 - RNA, 16 nt, Homo sapiens
cugugggcaagccuaa

SEQ ID NO: 1203175 - RNA, 22 nt, Homo sapiens
cugugggcauggucaaaggcuc

SEQ ID NO: 1203176 - RNA, 12 nt, Homo sapiens
cuguggugagaa

SEQ ID NO: 1203177 - RNA, 19 nt, Homo sapiens
cuguggugccucucuuggc

SEQ ID NO: 1203178 - RNA, 13 nt, Homo sapiens
cugugguggagaa

SEQ ID NO: 1203179 - RNA, 18 nt, Homo sapiens
cugugguuacagugcaga

SEQ ID NO: 1203180 - RNA, 19 nt, Homo sapiens
cuguguacacaugggaguu

SEQ ID NO: 1203181 - RNA, 13 nt, Homo sapiens
cuguguacugugg

SEQ ID NO: 1203182 - RNA, 20 nt, Homo sapiens
cuguguauauaguuuuuacc

SEQ ID NO: 1203183 - RNA, 15 nt, Homo sapiens
cuguguauucuaguu

SEQ ID NO: 1203184 - RNA, 16 nt, Homo sapiens
cugugucaaaagccag

SEQ ID NO: 1203185 - RNA, 22 nt, Homo sapiens
cugugucaccguaucucaggaa

SEQ ID NO: 1203186 - RNA, 13 nt, Homo sapiens
cugugucauuuca

SEQ ID NO: 1203187 - RNA, 14 nt, Homo sapiens
cugugucccaugac

SEQ ID NO: 1203188 - RNA, 18 nt, Homo sapiens
cuguguccuacuccuugc

SEQ ID NO: 1203189 - RNA, 15 nt, Homo sapiens
cugugucuaagauuc

SEQ ID NO: 1203190 - RNA, 20 nt, Homo sapiens
cugugucuugcaauggcagc

SEQ ID NO: 1203191 - RNA, 14 nt, Homo sapiens
cugugucuuggaau

SEQ ID NO: 1203192 - RNA, 21 nt, Homo sapiens
cugugugaacuaacaugcaaa

SEQ ID NO: 1203193 - RNA, 12 nt, Homo sapiens
cugugugccauu

SEQ ID NO: 1203194 - RNA, 21 nt, Homo sapiens
cuguguggacugugaugccac

SEQ ID NO: 1203195 - RNA, 19 nt, Homo sapiens
cugugugggacuguacaca

SEQ ID NO: 1203196 - RNA, 22 nt, Homo sapiens
cugugugggauacuuaguggua

SEQ ID NO: 1203197 - RNA, 14 nt, Homo sapiens
cuguguguccaaaa

SEQ ID NO: 1203198 - RNA, 17 nt, Homo sapiens
cugugugucuguccuga

SEQ ID NO: 1203199 - RNA, 22 nt, Homo sapiens
cugugugugaaaggaagcucca

SEQ ID NO: 1203200 - RNA, 16 nt, Homo sapiens
cuguguguguucuuca

SEQ ID NO: 1203201 - RNA, 21 nt, Homo sapiens
cuguguguguucuucaagcca

SEQ ID NO: 1203202 - RNA, 21 nt, Homo sapiens
cuguguuauucuuugcgugua

SEQ ID NO: 1203203 - RNA, 17 nt, Homo sapiens
cuguguucgauggcuca

SEQ ID NO: 1203204 - RNA, 14 nt, Homo sapiens
cuguuaacuaugac

SEQ ID NO: 1203205 - RNA, 15 nt, Homo sapiens
cuguuaacuaugaca

SEQ ID NO: 1203206 - RNA, 16 nt, Homo sapiens
cuguuaacuaugacag

SEQ ID NO: 1203207 - RNA, 20 nt, Homo sapiens
cuguuaccauucacaauaaa

SEQ ID NO: 1203208 - RNA, 14 nt, Homo sapiens
cuguuacccagaga

SEQ ID NO: 1203209 - RNA, 16 nt, Homo sapiens
cuguuacuuuggcaau

SEQ ID NO: 1203210 - RNA, 20 nt, Homo sapiens
cuguuagcacuguugaugua

SEQ ID NO: 1203211 - RNA, 15 nt, Homo sapiens
cuguuauguacugua

SEQ ID NO: 1203212 - RNA, 20 nt, Homo sapiens
cuguuauguacuguacuaau

SEQ ID NO: 1203213 - RNA, 14 nt, Homo sapiens
cuguuauuaacaaa

SEQ ID NO: 1203214 - RNA, 18 nt, Homo sapiens
cuguuauuaacaaacauc

SEQ ID NO: 1203215 - RNA, 19 nt, Homo sapiens
cuguuauuuuaucugcuau

SEQ ID NO: 1203216 - RNA, 17 nt, Homo sapiens
cuguucagagcacucau

SEQ ID NO: 1203217 - RNA, 17 nt, Homo sapiens
cuguucauguuacucau

SEQ ID NO: 1203218 - RNA, 19 nt, Homo sapiens
cuguuccaaagccagugaa

SEQ ID NO: 1203219 - RNA, 14 nt, Homo sapiens
cuguuccacaccca

SEQ ID NO: 1203220 - RNA, 17 nt, Homo sapiens
cuguuccagauuccuau

SEQ ID NO: 1203221 - RNA, 21 nt, Homo sapiens
cuguuccagucacauugccau

SEQ ID NO: 1203222 - RNA, 22 nt, Homo sapiens
cuguuccccaaggacucuucca

SEQ ID NO: 1203223 - RNA, 18 nt, Homo sapiens
cuguucccuugcaggggu

SEQ ID NO: 1203224 - RNA, 15 nt, Homo sapiens
cuguucccuugccau

SEQ ID NO: 1203225 - RNA, 20 nt, Homo sapiens
cuguucucauuuuauugcua

SEQ ID NO: 1203226 - RNA, 12 nt, Homo sapiens
cuguucugcaca

SEQ ID NO: 1203227 - RNA, 13 nt, Homo sapiens
cuguucugcugaa

SEQ ID NO: 1203228 - RNA, 22 nt, Homo sapiens
cuguucuguuuggcacuuguau

SEQ ID NO: 1203229 - RNA, 17 nt, Homo sapiens
cuguucuugcugcuaga

SEQ ID NO: 1203230 - RNA, 15 nt, Homo sapiens
cuguugcacugaugu

SEQ ID NO: 1203231 - RNA, 15 nt, Homo sapiens
cuguugcauuuacuu

SEQ ID NO: 1203232 - RNA, 17 nt, Homo sapiens
cuguugcccauugcacu

SEQ ID NO: 1203233 - RNA, 12 nt, Homo sapiens
cuguuggaugau

SEQ ID NO: 1203234 - RNA, 13 nt, Homo sapiens
cuguuggcagcuc

SEQ ID NO: 1203235 - RNA, 20 nt, Homo sapiens
cuguuguaggguugccagau

SEQ ID NO: 1203236 - RNA, 17 nt, Homo sapiens
cuguuucaaucacuguc

SEQ ID NO: 1203237 - RNA, 21 nt, Homo sapiens
cuguuucccuuugauucucca

SEQ ID NO: 1203238 - RNA, 14 nt, Homo sapiens
cuguuugaugcuau

SEQ ID NO: 1203239 - RNA, 20 nt, Homo sapiens
cuguuugcccccauucacuu

SEQ ID NO: 1203240 - RNA, 14 nt, Homo sapiens
cuguuugcugugga

SEQ ID NO: 1203241 - RNA, 14 nt, Homo sapiens
cuguuuuguuguuu

SEQ ID NO: 1203242 - RNA, 21 nt, Homo sapiens
cuguuuuucucuaaugcuuga

SEQ ID NO: 1203243 - RNA, 17 nt, Homo sapiens
cuguuuuuguaguggua

SEQ ID NO: 1203244 - RNA, 22 nt, Homo sapiens
cuuaaaacaaauucauuauucu

SEQ ID NO: 1203245 - RNA, 22 nt, Homo sapiens
cuuaaaacuaaauguaauuuau

SEQ ID NO: 1203246 - RNA, 13 nt, Homo sapiens
cuuaaaaguauuc

SEQ ID NO: 1203247 - RNA, 23 nt, Homo sapiens
cuuaaaauagaaauaagugguua

SEQ ID NO: 1203248 - RNA, 14 nt, Homo sapiens
cuuaaaauugugag

SEQ ID NO: 1203249 - RNA, 20 nt, Homo sapiens
cuuaaacagcagauuucaga

SEQ ID NO: 1203250 - RNA, 21 nt, Homo sapiens
cuuaaacauaauaaaucacac

SEQ ID NO: 1203251 - RNA, 20 nt, Homo sapiens
cuuaaaccuuaagauacuaa

SEQ ID NO: 1203252 - RNA, 12 nt, Homo sapiens
cuuaaacuucca

SEQ ID NO: 1203253 - RNA, 16 nt, Homo sapiens
cuuaaagaaguucccc

SEQ ID NO: 1203254 - RNA, 20 nt, Homo sapiens
cuuaaagcauuugcaacagc

SEQ ID NO: 1203255 - RNA, 22 nt, Homo sapiens
cuuaaauauauauuucuaauau

SEQ ID NO: 1203256 - RNA, 14 nt, Homo sapiens
cuuaaauccauccu

SEQ ID NO: 1203257 - RNA, 21 nt, Homo sapiens
cuuaaauuaagauuaugugag

SEQ ID NO: 1203258 - RNA, 17 nt, Homo sapiens
cuuaacagaugcaaugu

SEQ ID NO: 1203259 - RNA, 13 nt, Homo sapiens
cuuaacagguuug

SEQ ID NO: 1203260 - RNA, 12 nt, Homo sapiens
cuuaacaucccu

SEQ ID NO: 1203261 - RNA, 18 nt, Homo sapiens
cuuaacaugggcucuuca

SEQ ID NO: 1203262 - RNA, 14 nt, Homo sapiens
cuuaaccuuuccag

SEQ ID NO: 1203263 - RNA, 12 nt, Homo sapiens
cuuaacuaugag

SEQ ID NO: 1203264 - RNA, 14 nt, Homo sapiens
cuuaacugaugaca

SEQ ID NO: 1203265 - RNA, 20 nt, Homo sapiens
cuuaacuuguuugguaguua

SEQ ID NO: 1203266 - RNA, 22 nt, Homo sapiens
cuuaagaacugcuucaugugaa

SEQ ID NO: 1203267 - RNA, 19 nt, Homo sapiens
cuuaagauuuugcaccugu

SEQ ID NO: 1203268 - RNA, 16 nt, Homo sapiens
cuuaagcagaagcauu

SEQ ID NO: 1203269 - RNA, 11 nt, Homo sapiens
cuuaagccaua

SEQ ID NO: 1203270 - RNA, 14 nt, Homo sapiens
cuuaagucauggaa

SEQ ID NO: 1203271 - RNA, 14 nt, Homo sapiens
cuuaauaaacugug

SEQ ID NO: 1203272 - RNA, 22 nt, Homo sapiens
cuuaauaaaggcccccacuucu

SEQ ID NO: 1203273 - RNA, 18 nt, Homo sapiens
cuuaaugcuacaugugag

SEQ ID NO: 1203274 - RNA, 22 nt, Homo sapiens
cuuaauguucugaauaauuucu

SEQ ID NO: 1203275 - RNA, 23 nt, Homo sapiens
cuuaauucccgccuuaugccuca

SEQ ID NO: 1203276 - RNA, 17 nt, Homo sapiens
cuuaauuccuuucucau

SEQ ID NO: 1203277 - RNA, 20 nt, Homo sapiens
cuuaauuguuagcuauuuau

SEQ ID NO: 1203278 - RNA, 18 nt, Homo sapiens
cuuaauuuauuucuuaac

SEQ ID NO: 1203279 - RNA, 20 nt, Homo sapiens
cuuacaacugcucuagauua

SEQ ID NO: 1203280 - RNA, 21 nt, Homo sapiens
cuuacacuacauuagaacacu

SEQ ID NO: 1203281 - RNA, 18 nt, Homo sapiens
cuuacacuuuaugcacaa

SEQ ID NO: 1203282 - RNA, 12 nt, Homo sapiens
cuuacagaauua

SEQ ID NO: 1203283 - RNA, 16 nt, Homo sapiens
cuuacaucauguguug

SEQ ID NO: 1203284 - RNA, 17 nt, Homo sapiens
cuuacauguguaaaggu

SEQ ID NO: 1203285 - RNA, 16 nt, Homo sapiens
cuuaccucacagugau

SEQ ID NO: 1203286 - RNA, 14 nt, Homo sapiens
cuuaccugacacaa

SEQ ID NO: 1203287 - RNA, 18 nt, Homo sapiens
cuuaccugaccucuugcu

SEQ ID NO: 1203288 - RNA, 18 nt, Homo sapiens
cuuacuaagcauagcaaa

SEQ ID NO: 1203289 - RNA, 12 nt, Homo sapiens
cuuacuauucau

SEQ ID NO: 1203290 - RNA, 18 nt, Homo sapiens
cuuacucauuacugcaaa

SEQ ID NO: 1203291 - RNA, 16 nt, Homo sapiens
cuuacucuaagaucuu

SEQ ID NO: 1203292 - RNA, 15 nt, Homo sapiens
cuuacuuaugccaua

SEQ ID NO: 1203293 - RNA, 18 nt, Homo sapiens
cuuagaaaacaaguauug

SEQ ID NO: 1203294 - RNA, 23 nt, Homo sapiens
cuuagaaacaaaaagagcuuucc

SEQ ID NO: 1203295 - RNA, 19 nt, Homo sapiens
cuuggaaaaaaaccacagc

SEQ ID NO: 1203296 - RNA, 21 nt, Homo sapiens
cuuggaaaaaaaccacagcca

SEQ ID NO: 1203297 - RNA, 17 nt, Homo sapiens
cuuggaaagcugaugau

SEQ ID NO: 1203298 - RNA, 21 nt, Homo sapiens
cuuggacuguguuuuuccucc

SEQ ID NO: 1203299 - RNA, 22 nt, Homo sapiens
cuuggagaaaauggguuuauuc

SEQ ID NO: 1203300 - RNA, 18 nt, Homo sapiens
cuuggagcccgugcagua

SEQ ID NO: 1203301 - RNA, 21 nt, Homo sapiens
cuuggaggcccugcacugcca

SEQ ID NO: 1203302 - RNA, 18 nt, Homo sapiens
cuuggaguaaaacuguau

SEQ ID NO: 1203303 - RNA, 16 nt, Homo sapiens
cuuggaucagaugaac

SEQ ID NO: 1203304 - RNA, 16 nt, Homo sapiens
cuuggauucucuaacc

SEQ ID NO: 1203305 - RNA, 19 nt, Homo sapiens
cuuggcaaauuccuaguca

SEQ ID NO: 1203306 - RNA, 23 nt, Homo sapiens
cuuggcacacagcaggcuuucaa

SEQ ID NO: 1203307 - RNA, 17 nt, Homo sapiens
cuuggccuacagucauc

SEQ ID NO: 1203308 - RNA, 21 nt, Homo sapiens
cuuggcucacugcaaccucua

SEQ ID NO: 1203309 - RNA, 18 nt, Homo sapiens
cuuggcuccaccacugau

SEQ ID NO: 1203310 - RNA, 16 nt, Homo sapiens
cuuggcuccugagaaa

SEQ ID NO: 1203311 - RNA, 23 nt, Homo sapiens
cuuggcucugccaguggaucccc

SEQ ID NO: 1203312 - RNA, 14 nt, Homo sapiens
cuuggcugacauga

SEQ ID NO: 1203313 - RNA, 17 nt, Homo sapiens
cuuggcugcuguaucuu

SEQ ID NO: 1203314 - RNA, 13 nt, Homo sapiens
cuuggcugugagg

SEQ ID NO: 1203315 - RNA, 22 nt, Homo sapiens
cuuggcuucugugaugagcuga

SEQ ID NO: 1203316 - RNA, 17 nt, Homo sapiens
cuugggagaggggcgca

SEQ ID NO: 1203317 - RNA, 14 nt, Homo sapiens
cuugggaugaucuu

SEQ ID NO: 1203318 - RNA, 21 nt, Homo sapiens
cuugggcacuuuuuaauucac

SEQ ID NO: 1203319 - RNA, 20 nt, Homo sapiens
cuugggcaugggggagccuu

SEQ ID NO: 1203320 - RNA, 23 nt, Homo sapiens
cuugggcguuugaacucagggag

SEQ ID NO: 1203321 - RNA, 17 nt, Homo sapiens
cuuggggaaauggggcu

SEQ ID NO: 1203322 - RNA, 16 nt, Homo sapiens
cuugggggucaggggg

SEQ ID NO: 1203323 - RNA, 21 nt, Homo sapiens
cuugggguacucuugauguga

SEQ ID NO: 1203324 - RNA, 15 nt, Homo sapiens
cuuggggucacuccu

SEQ ID NO: 1203325 - RNA, 22 nt, Homo sapiens
cuuggucugugagaugcuagaa

SEQ ID NO: 1203326 - RNA, 13 nt, Homo sapiens
cuuggugagaugg

SEQ ID NO: 1203327 - RNA, 13 nt, Homo sapiens
cuuggugcucugu

SEQ ID NO: 1203328 - RNA, 14 nt, Homo sapiens
cuuggugguggaug

SEQ ID NO: 1203329 - RNA, 19 nt, Homo sapiens
cuugguuagacgccuucca

SEQ ID NO: 1203330 - RNA, 16 nt, Homo sapiens
cuuguaaagacugguu

SEQ ID NO: 1203331 - RNA, 23 nt, Homo sapiens
cuuguaaauagcucagguguccc

SEQ ID NO: 1203332 - RNA, 17 nt, Homo sapiens
cuuguaaccagugcaga

SEQ ID NO: 1203333 - RNA, 22 nt, Homo sapiens
cuuguacaaccgacagcucuua

SEQ ID NO: 1203334 - RNA, 15 nt, Homo sapiens
cuuguaccauauaga

SEQ ID NO: 1203335 - RNA, 19 nt, Homo sapiens
cuuguacuacacagaauug

SEQ ID NO: 1203336 - RNA, 12 nt, Homo sapiens
cuuguagcauau

SEQ ID NO: 1203337 - RNA, 16 nt, Homo sapiens
cuuguauagcaguuuc

SEQ ID NO: 1203338 - RNA, 22 nt, Homo sapiens
cuuguauuaaacucuucacaaa

SEQ ID NO: 1203339 - RNA, 23 nt, Homo sapiens
cuugucaccaguuaaaagcauuu

SEQ ID NO: 1203340 - RNA, 14 nt, Homo sapiens
cuugucagauguau

SEQ ID NO: 1203341 - RNA, 17 nt, Homo sapiens
cuugucaugugacaggu

SEQ ID NO: 1203342 - RNA, 15 nt, Homo sapiens
cuugucauugccagc

SEQ ID NO: 1203343 - RNA, 12 nt, Homo sapiens
cuuguccugacu

SEQ ID NO: 1203344 - RNA, 16 nt, Homo sapiens
cuugugaccauuguaa

SEQ ID NO: 1203345 - RNA, 15 nt, Homo sapiens
cuugugauguuuuga

SEQ ID NO: 1203346 - RNA, 11 nt, Homo sapiens
cuugugccuug

SEQ ID NO: 1203347 - RNA, 19 nt, Homo sapiens
cuugugguguaaagcuggc

SEQ ID NO: 1203348 - RNA, 15 nt, Homo sapiens
cuugugucccaugau

SEQ ID NO: 1203349 - RNA, 22 nt, Homo sapiens
cuugugucugcggggaucagag

SEQ ID NO: 1203350 - RNA, 14 nt, Homo sapiens
cuugugugcccuga

SEQ ID NO: 1203351 - RNA, 19 nt, Homo sapiens
cuugugugugggcugugag

SEQ ID NO: 1203352 - RNA, 13 nt, Homo sapiens
cuuguuagauuca

SEQ ID NO: 1203353 - RNA, 16 nt, Homo sapiens
cuuguucacacuuugc

SEQ ID NO: 1203354 - RNA, 20 nt, Homo sapiens
cuuguucuauuuuucaauca

SEQ ID NO: 1203355 - RNA, 13 nt, Homo sapiens
cuuguugcucaaa

SEQ ID NO: 1203356 - RNA, 16 nt, Homo sapiens
cuuguuuacagcacua

SEQ ID NO: 1203357 - RNA, 24 nt, Homo sapiens
cuuguuuacagcacuacucugugc

SEQ ID NO: 1203358 - RNA, 17 nt, Homo sapiens
cuuguuuacucauugaa

SEQ ID NO: 1203359 - RNA, 23 nt, Homo sapiens
cuuguuucagcuucucugcuaga

SEQ ID NO: 1203360 - RNA, 16 nt, Homo sapiens
cuuguuuuaugcucag

SEQ ID NO: 1203361 - RNA, 20 nt, Homo sapiens
cuuuaaaaguauccagagau

SEQ ID NO: 1203362 - RNA, 14 nt, Homo sapiens
cuuuaaacauugac

SEQ ID NO: 1203363 - RNA, 16 nt, Homo sapiens
cuuuaaacucagggac

SEQ ID NO: 1203364 - RNA, 16 nt, Homo sapiens
cuuuaaaggcaucuac

SEQ ID NO: 1203365 - RNA, 15 nt, Homo sapiens
cuuuaaauggcuuua

SEQ ID NO: 1203366 - RNA, 15 nt, Homo sapiens
cuuuaacucauaaaa

SEQ ID NO: 1203367 - RNA, 21 nt, Homo sapiens
cuuuaacuuucagaggcaaua

SEQ ID NO: 1203368 - RNA, 20 nt, Homo sapiens
cuuuaagagagaaaucugaa

SEQ ID NO: 1203369 - RNA, 21 nt, Homo sapiens
cuuuaagcagcgccagugaca

SEQ ID NO: 1203370 - RNA, 15 nt, Homo sapiens
cuuuaagccaaagaa

SEQ ID NO: 1203371 - RNA, 18 nt, Homo sapiens
cuuuaauagaaguuuuau

SEQ ID NO: 1203372 - RNA, 22 nt, Homo sapiens
cuuuaauaguuuugauccuaaa

SEQ ID NO: 1203373 - RNA, 19 nt, Homo sapiens
cuuuaaucacugcauuuca

SEQ ID NO: 1203374 - RNA, 21 nt, Homo sapiens
cuuuaaugaacuaacugacag

SEQ ID NO: 1203375 - RNA, 13 nt, Homo sapiens
cuuuaauucugua

SEQ ID NO: 1203376 - RNA, 22 nt, Homo sapiens
cuuuacaaaagaaauaccuuga

SEQ ID NO: 1203377 - RNA, 14 nt, Homo sapiens
cuuuacaccaacuc

SEQ ID NO: 1203378 - RNA, 17 nt, Homo sapiens
cuuuacccaccuagaac

SEQ ID NO: 1203379 - RNA, 23 nt, Homo sapiens
cuuuaccuccuuuucucuuucac

SEQ ID NO: 1203380 - RNA, 14 nt, Homo sapiens
cuuuagaacaggga

SEQ ID NO: 1203381 - RNA, 23 nt, Homo sapiens
cuuuagaguagcaugagagaauu

SEQ ID NO: 1203382 - RNA, 16 nt, Homo sapiens
cuuuagaguugcauga

SEQ ID NO: 1203383 - RNA, 13 nt, Homo sapiens
cuuuagaugcuga

SEQ ID NO: 1203384 - RNA, 15 nt, Homo sapiens
cuuuagcgcccaguu

SEQ ID NO: 1203385 - RNA, 19 nt, Homo sapiens
cuuuaggagacuaauggaa

SEQ ID NO: 1203386 - RNA, 18 nt, Homo sapiens
cuuuaggcagcagcuuuu

SEQ ID NO: 1203387 - RNA, 19 nt, Homo sapiens
cuuuagucucccacuaaaa

SEQ ID NO: 1203388 - RNA, 15 nt, Homo sapiens
cuuuauaaaugcauu

SEQ ID NO: 1203389 - RNA, 20 nt, Homo sapiens
cuuuauagagugucucaggg

SEQ ID NO: 1203390 - RNA, 21 nt, Homo sapiens
cuuuauauuuuuaacuuuaag

SEQ ID NO: 1203391 - RNA, 12 nt, Homo sapiens
cuuuaucaaaga

SEQ ID NO: 1203392 - RNA, 18 nt, Homo sapiens
cuuuaucuaauaccucug

SEQ ID NO: 1203393 - RNA, 11 nt, Homo sapiens
cuuuaucucag

SEQ ID NO: 1203394 - RNA, 22 nt, Homo sapiens
cuuuaugcuaguuugaccucau

SEQ ID NO: 1203395 - RNA, 16 nt, Homo sapiens
cuuuauuucugaucua

SEQ ID NO: 1203396 - RNA, 17 nt, Homo sapiens
cuuuauuuguaaaccau

SEQ ID NO: 1203397 - RNA, 22 nt, Homo sapiens
cuuuauuuguaaaccauuguaa

SEQ ID NO: 1203398 - RNA, 15 nt, Homo sapiens
cuuucaaaagcaaga

SEQ ID NO: 1203399 - RNA, 21 nt, Homo sapiens
cuuucaauuacaaagcaguua

SEQ ID NO: 1203400 - RNA, 22 nt, Homo sapiens
cuuucacaaguacuaucuguuc

SEQ ID NO: 1203401 - RNA, 19 nt, Homo sapiens
cuuucaccacaugugcaca

SEQ ID NO: 1203402 - RNA, 17 nt, Homo sapiens
cuuucacccucaugaaa

SEQ ID NO: 1203403 - RNA, 14 nt, Homo sapiens
cuuucaggacucua

SEQ ID NO: 1203404 - RNA, 16 nt, Homo sapiens
cuuucauaaaaacacu

SEQ ID NO: 1203405 - RNA, 17 nt, Homo sapiens
cuuucauaaaaacacuc

SEQ ID NO: 1203406 - RNA, 20 nt, Homo sapiens
cuuucauaaacuucagggau

SEQ ID NO: 1203407 - RNA, 18 nt, Homo sapiens
cuuucauauauguuaaag

SEQ ID NO: 1203408 - RNA, 23 nt, Homo sapiens
cuuucaucccucgggugugcuau

SEQ ID NO: 1203409 - RNA, 19 nt, Homo sapiens
cuuuccaagaccaaccuac

SEQ ID NO: 1203410 - RNA, 18 nt, Homo sapiens
cuuucccaaccccaggaa

SEQ ID NO: 1203411 - RNA, 15 nt, Homo sapiens
cuuucccagucccau

SEQ ID NO: 1203412 - RNA, 16 nt, Homo sapiens
cuuuccccccauguug

SEQ ID NO: 1203413 - RNA, 18 nt, Homo sapiens
cuuucccuuaaauaacac

SEQ ID NO: 1203414 - RNA, 21 nt, Homo sapiens
cuuucccuuuagcacguuuaa

SEQ ID NO: 1203415 - RNA, 17 nt, Homo sapiens
cuuuccggcacacugcc

SEQ ID NO: 1203416 - RNA, 13 nt, Homo sapiens
cuuuccuccugag

SEQ ID NO: 1203417 - RNA, 20 nt, Homo sapiens
cuuuccugccgagugcucug

SEQ ID NO: 1203418 - RNA, 22 nt, Homo sapiens
cuuuccugguuuucaucaggaa

SEQ ID NO: 1203419 - RNA, 21 nt, Homo sapiens
cuuuccugucugcacaaguga

SEQ ID NO: 1203420 - RNA, 22 nt, Homo sapiens
cuuuccuguuucuaucuuucau

SEQ ID NO: 1203421 - RNA, 16 nt, Homo sapiens
cuuagaagugcuauaa

SEQ ID NO: 1203422 - RNA, 13 nt, Homo sapiens
cuuagaauccaaa

SEQ ID NO: 1203423 - RNA, 19 nt, Homo sapiens
cuuagaauuugggggaaaa

SEQ ID NO: 1203424 - RNA, 18 nt, Homo sapiens
cuuagaguguagcuguaa

SEQ ID NO: 1203425 - RNA, 18 nt, Homo sapiens
cuuagcacacucacagau

SEQ ID NO: 1203426 - RNA, 14 nt, Homo sapiens
cuuagcaugcacaa

SEQ ID NO: 1203427 - RNA, 13 nt, Homo sapiens
cuuagcauguccc

SEQ ID NO: 1203428 - RNA, 14 nt, Homo sapiens
cuuagccagaguua

SEQ ID NO: 1203429 - RNA, 15 nt, Homo sapiens
cuuagcgggacaaag

SEQ ID NO: 1203430 - RNA, 21 nt, Homo sapiens
cuuagcuaguuuuauucuugg

SEQ ID NO: 1203431 - RNA, 21 nt, Homo sapiens
cuuagcuuaucuuucuuucca

SEQ ID NO: 1203432 - RNA, 23 nt, Homo sapiens
cuuaggacuaccagccauacaaa

SEQ ID NO: 1203433 - RNA, 18 nt, Homo sapiens
cuuaggcccuagcggcag

SEQ ID NO: 1203434 - RNA, 22 nt, Homo sapiens
cuuagggggagcccuggugcua

SEQ ID NO: 1203435 - RNA, 19 nt, Homo sapiens
cuuagguaagacauauaac

SEQ ID NO: 1203436 - RNA, 23 nt, Homo sapiens
cuuaguccaauuccuugcacaua

SEQ ID NO: 1203437 - RNA, 17 nt, Homo sapiens
cuuagucccucaugcaa

SEQ ID NO: 1203438 - RNA, 21 nt, Homo sapiens
cuuagugccacccaccuuugc

SEQ ID NO: 1203439 - RNA, 18 nt, Homo sapiens
cuuaguguauaaaaacca

SEQ ID NO: 1203440 - RNA, 18 nt, Homo sapiens
cuuaguguccuucuuaac

SEQ ID NO: 1203441 - RNA, 19 nt, Homo sapiens
cuuauaagaaagaucaaag

SEQ ID NO: 1203442 - RNA, 14 nt, Homo sapiens
cuuauacauuugau

SEQ ID NO: 1203443 - RNA, 20 nt, Homo sapiens
cuuauagacacuugcuccca

SEQ ID NO: 1203444 - RNA, 23 nt, Homo sapiens
cuuauauugcaagcuccaucucu

SEQ ID NO: 1203445 - RNA, 15 nt, Homo sapiens
cuuaucaacuaauga

SEQ ID NO: 1203446 - RNA, 22 nt, Homo sapiens
cuuaucuggcccucgacacuca

SEQ ID NO: 1203447 - RNA, 13 nt, Homo sapiens
cuuaugauacuug

SEQ ID NO: 1203448 - RNA, 16 nt, Homo sapiens
cuuaugccagcgugac

SEQ ID NO: 1203449 - RNA, 23 nt, Homo sapiens
cuuauggauucauauaggccaga

SEQ ID NO: 1203450 - RNA, 18 nt, Homo sapiens
cuuaugggcccagccagc

SEQ ID NO: 1203451 - RNA, 19 nt, Homo sapiens
cuuauguacuugauacuga

SEQ ID NO: 1203452 - RNA, 14 nt, Homo sapiens
cuuauguugcacaa

SEQ ID NO: 1203453 - RNA, 22 nt, Homo sapiens
cuuauguugcacaaugagaaaa

SEQ ID NO: 1203454 - RNA, 14 nt, Homo sapiens
cuuauuacauuuaa

SEQ ID NO: 1203455 - RNA, 15 nt, Homo sapiens
cuuauuuauaccuca

SEQ ID NO: 1203456 - RNA, 14 nt, Homo sapiens
cuuauuuuucucca

SEQ ID NO: 1203457 - RNA, 14 nt, Homo sapiens
cuucaaaagcacug

SEQ ID NO: 1203458 - RNA, 17 nt, Homo sapiens
cuucaaaccccuacuga

SEQ ID NO: 1203459 - RNA, 13 nt, Homo sapiens
cuucaaacuuuag

SEQ ID NO: 1203460 - RNA, 19 nt, Homo sapiens
cuucaaagaggaaccagga

SEQ ID NO: 1203461 - RNA, 20 nt, Homo sapiens
cuucaaagccuucucccuag

SEQ ID NO: 1203462 - RNA, 14 nt, Homo sapiens
cuucaaauguggua

SEQ ID NO: 1203463 - RNA, 14 nt, Homo sapiens
cuucaacccagugg

SEQ ID NO: 1203464 - RNA, 17 nt, Homo sapiens
cuucaagaaauuacugg

SEQ ID NO: 1203465 - RNA, 18 nt, Homo sapiens
cuucaagccugugcaaug

SEQ ID NO: 1203466 - RNA, 20 nt, Homo sapiens
cuucaaggauauacugcagc

SEQ ID NO: 1203467 - RNA, 22 nt, Homo sapiens
cuucaaguauaacaacuuugaa

SEQ ID NO: 1203468 - RNA, 13 nt, Homo sapiens
cuucaagugccaa

SEQ ID NO: 1203469 - RNA, 13 nt, Homo sapiens
cuucaagugccuu

SEQ ID NO: 1203470 - RNA, 19 nt, Homo sapiens
cuucaaguuagcucaggag

SEQ ID NO: 1203471 - RNA, 19 nt, Homo sapiens
cuucaaucucuugcacuca

SEQ ID NO: 1203472 - RNA, 22 nt, Homo sapiens
cuucaaugggcucuuccaacaa

SEQ ID NO: 1203473 - RNA, 15 nt, Homo sapiens
cuucacccugaaugg

SEQ ID NO: 1203474 - RNA, 13 nt, Homo sapiens
cuucaccuuuuga

SEQ ID NO: 1203475 - RNA, 19 nt, Homo sapiens
cuucacucgacauuuggug

SEQ ID NO: 1203476 - RNA, 16 nt, Homo sapiens
cuucacucugggcaca

SEQ ID NO: 1203477 - RNA, 12 nt, Homo sapiens
cuucacugccag

SEQ ID NO: 1203478 - RNA, 16 nt, Homo sapiens
cuucacuguauaaaua

SEQ ID NO: 1203479 - RNA, 14 nt, Homo sapiens
cuucagaacugccc

SEQ ID NO: 1203480 - RNA, 13 nt, Homo sapiens
cuucagaauuaga

SEQ ID NO: 1203481 - RNA, 14 nt, Homo sapiens
cuucagaauuccau

SEQ ID NO: 1203482 - RNA, 15 nt, Homo sapiens
cuucagaauuccaua

SEQ ID NO: 1203483 - RNA, 15 nt, Homo sapiens
cuucagagacuaucu

SEQ ID NO: 1203484 - RNA, 14 nt, Homo sapiens
cuucagcacaaaga

SEQ ID NO: 1203485 - RNA, 18 nt, Homo sapiens
cuucagcaugauguguug

SEQ ID NO: 1203486 - RNA, 18 nt, Homo sapiens
cuucagcugccugaaaca

SEQ ID NO: 1203487 - RNA, 17 nt, Homo sapiens
cuucagggaacugcaua

SEQ ID NO: 1203488 - RNA, 19 nt, Homo sapiens
cuucagggccaguccuccu

SEQ ID NO: 1203489 - RNA, 13 nt, Homo sapiens
cuucagguggaug

SEQ ID NO: 1203490 - RNA, 22 nt, Homo sapiens
cuucagguucuuucugaaaucg

SEQ ID NO: 1203491 - RNA, 14 nt, Homo sapiens
cuucaguugaucuu

SEQ ID NO: 1203492 - RNA, 15 nt, Homo sapiens
cuucauauaccagca

SEQ ID NO: 1203493 - RNA, 17 nt, Homo sapiens
cuucauauuuuugauca

SEQ ID NO: 1203494 - RNA, 23 nt, Homo sapiens
cuucaucaggagcuagagccauu

SEQ ID NO: 1203495 - RNA, 22 nt, Homo sapiens
cuucauccucugagugugacca

SEQ ID NO: 1203496 - RNA, 15 nt, Homo sapiens
cuucaugcaaugaca

SEQ ID NO: 1203497 - RNA, 14 nt, Homo sapiens
cuucauggggguga

SEQ ID NO: 1203498 - RNA, 16 nt, Homo sapiens
cuucauguaacuauag

SEQ ID NO: 1203499 - RNA, 15 nt, Homo sapiens
cuucauuccaaucua

SEQ ID NO: 1203500 - RNA, 22 nt, Homo sapiens
cuucauuucaggaagacugaca

SEQ ID NO: 1203501 - RNA, 17 nt, Homo sapiens
aaaaaucauaguacucu

SEQ ID NO: 1203502 - RNA, 13 nt, Homo sapiens
aaaaauccuugaa

SEQ ID NO: 1203503 - RNA, 16 nt, Homo sapiens
aaaaaucucccaguga

SEQ ID NO: 1203504 - RNA, 12 nt, Homo sapiens
aaaaaucucuca

SEQ ID NO: 1203505 - RNA, 21 nt, Homo sapiens
aaaaaucugaaaaugugaaua

SEQ ID NO: 1203506 - RNA, 22 nt, Homo sapiens
aaaaaucuugugcuagaauacu

SEQ ID NO: 1203507 - RNA, 13 nt, Homo sapiens
aaaaaugagcucg

SEQ ID NO: 1203508 - RNA, 16 nt, Homo sapiens
aaaaaugcaccacuuu

SEQ ID NO: 1203509 - RNA, 12 nt, Homo sapiens
aaaaaugcugcu

SEQ ID NO: 1203510 - RNA, 22 nt, Homo sapiens
aaaaauggaacuguacacuugu

SEQ ID NO: 1203511 - RNA, 15 nt, Homo sapiens
aaaaauggaacugug

SEQ ID NO: 1203512 - RNA, 20 nt, Homo sapiens
aaaaaugguugauggaaaau

SEQ ID NO: 1203513 - RNA, 20 nt, Homo sapiens
aaaaauguauuuuuccuaaa

SEQ ID NO: 1203514 - RNA, 11 nt, Homo sapiens
aaaaauuauca

SEQ ID NO: 1203515 - RNA, 14 nt, Homo sapiens
aaaaauuuuaacca

SEQ ID NO: 1203516 - RNA, 19 nt, Homo sapiens
aaaacaaaacaaaccuuaa

SEQ ID NO: 1203517 - RNA, 17 nt, Homo sapiens
aaaacaaacaugcagua

SEQ ID NO: 1203518 - RNA, 19 nt, Homo sapiens
aaaacaaacccaaagguag

SEQ ID NO: 1203519 - RNA, 13 nt, Homo sapiens
aaaacaaauccau

SEQ ID NO: 1203520 - RNA, 21 nt, Homo sapiens
aaaacacacuacuaccucuua

SEQ ID NO: 1203521 - RNA, 13 nt, Homo sapiens
aaaacacuuccau

SEQ ID NO: 1203522 - RNA, 19 nt, Homo sapiens
aaaacagagggcugcauuc

SEQ ID NO: 1203523 - RNA, 13 nt, Homo sapiens
aaaacaggccagg

SEQ ID NO: 1203524 - RNA, 19 nt, Homo sapiens
aaaacagguauauacuuug

SEQ ID NO: 1203525 - RNA, 22 nt, Homo sapiens
aaaacaguuuuccaaauaacau

SEQ ID NO: 1203526 - RNA, 19 nt, Homo sapiens
aaaacaucauuacugccau

SEQ ID NO: 1203527 - RNA, 17 nt, Homo sapiens
aaaacaucgucuaaacu

SEQ ID NO: 1203528 - RNA, 23 nt, Homo sapiens
aaaacaugcugaaaacuacacaa

SEQ ID NO: 1203529 - RNA, 13 nt, Homo sapiens
aaaacauguuaau

SEQ ID NO: 1203530 - RNA, 11 nt, Homo sapiens
aaaacauuucu

SEQ ID NO: 1203531 - RNA, 18 nt, Homo sapiens
aaaaugcuucugcacaca

SEQ ID NO: 1203532 - RNA, 23 nt, Homo sapiens
aaaauggacaaaauccaugaaca

SEQ ID NO: 1203533 - RNA, 19 nt, Homo sapiens
aaaauggaggccauugugu

SEQ ID NO: 1203534 - RNA, 14 nt, Homo sapiens
aaaauggucaucca

SEQ ID NO: 1203535 - RNA, 16 nt, Homo sapiens
aaaauguaauuacuua

SEQ ID NO: 1203536 - RNA, 19 nt, Homo sapiens
aaaauguaugaccacuggg

SEQ ID NO: 1203537 - RNA, 21 nt, Homo sapiens
aaaaugucaguguuugggaaa

SEQ ID NO: 1203538 - RNA, 19 nt, Homo sapiens
aaaauguccaugauggaau

SEQ ID NO: 1203539 - RNA, 17 nt, Homo sapiens
aaaauguccugccuuuu

SEQ ID NO: 1203540 - RNA, 22 nt, Homo sapiens
aaaauguucuguuugcugugga

SEQ ID NO: 1203541 - RNA, 16 nt, Homo sapiens
aaaauguuuguuaaag

SEQ ID NO: 1203542 - RNA, 13 nt, Homo sapiens
aaaauuaacuggu

SEQ ID NO: 1203543 - RNA, 11 nt, Homo sapiens
aaaauuacuuc

SEQ ID NO: 1203544 - RNA, 17 nt, Homo sapiens
aaaauuauacuaacuua

SEQ ID NO: 1203545 - RNA, 17 nt, Homo sapiens
aaaauuaucaauaucua

SEQ ID NO: 1203546 - RNA, 21 nt, Homo sapiens
aaaauucagaguccuugcaaa

SEQ ID NO: 1203547 - RNA, 13 nt, Homo sapiens
aaaauucauuucu

SEQ ID NO: 1203548 - RNA, 14 nt, Homo sapiens
aaaauugacaauga

SEQ ID NO: 1203549 - RNA, 17 nt, Homo sapiens
aaaauugugaucagacc

SEQ ID NO: 1203550 - RNA, 20 nt, Homo sapiens
aaaauuguuuucacuuguau

SEQ ID NO: 1203551 - RNA, 16 nt, Homo sapiens
aaaauuucagcauuau

SEQ ID NO: 1203552 - RNA, 22 nt, Homo sapiens
aaaauuuuuuuuguaacuggag

SEQ ID NO: 1203553 - RNA, 22 nt, Homo sapiens
aaacaaaaaaaccucuaugcaa

SEQ ID NO: 1203554 - RNA, 18 nt, Homo sapiens
aaacaaaauccaagauuc

SEQ ID NO: 1203555 - RNA, 14 nt, Homo sapiens
aaacaaauaugcaa

SEQ ID NO: 1203556 - RNA, 16 nt, Homo sapiens
aaacaaaugcuccucc

SEQ ID NO: 1203557 - RNA, 13 nt, Homo sapiens
aaacaacauuuau

SEQ ID NO: 1203558 - RNA, 21 nt, Homo sapiens
aaacaaccauuuuuuguucug

SEQ ID NO: 1203559 - RNA, 16 nt, Homo sapiens
aaacaacuuucucuug

SEQ ID NO: 1203560 - RNA, 15 nt, Homo sapiens
aaacacaaaccacaa

SEQ ID NO: 1203561 - RNA, 20 nt, Homo sapiens
aaacacacagucacauucga

SEQ ID NO: 1203562 - RNA, 14 nt, Homo sapiens
aaacacacauacac

SEQ ID NO: 1203563 - RNA, 13 nt, Homo sapiens
aaacacacaucca

SEQ ID NO: 1203564 - RNA, 12 nt, Homo sapiens
aaacacacucaa

SEQ ID NO: 1203565 - RNA, 23 nt, Homo sapiens
uuauguacuguacuaauucuuac

SEQ ID NO: 1203566 - RNA, 18 nt, Homo sapiens
uuauguccaccacuucag

SEQ ID NO: 1203567 - RNA, 20 nt, Homo sapiens
uuaugugagagaaaguguga

SEQ ID NO: 1203568 - RNA, 23 nt, Homo sapiens
uuauguggaaaacagaacaucau

SEQ ID NO: 1203569 - RNA, 21 nt, Homo sapiens
uuauguguaguugucucucuu

SEQ ID NO: 1203570 - RNA, 19 nt, Homo sapiens
uuaugugugaggagcugcu

SEQ ID NO: 1203571 - RNA, 20 nt, Homo sapiens
uuauguuuucaacucaggaa

SEQ ID NO: 1203572 - RNA, 20 nt, Homo sapiens
uuauuaaaaccagucucaga

SEQ ID NO: 1203573 - RNA, 13 nt, Homo sapiens
uuauuaacuaaga

SEQ ID NO: 1203574 - RNA, 18 nt, Homo sapiens
uuauuaagcuuuuuggaa

SEQ ID NO: 1203575 - RNA, 22 nt, Homo sapiens
uuauuaagugccugagacaccc

SEQ ID NO: 1203576 - RNA, 14 nt, Homo sapiens
uuauuaaugacaaa

SEQ ID NO: 1203577 - RNA, 15 nt, Homo sapiens
uuauuaauucuucac

SEQ ID NO: 1203578 - RNA, 19 nt, Homo sapiens
uuauuacauggggucuaga

SEQ ID NO: 1203579 - RNA, 13 nt, Homo sapiens
uuauuacauguaa

SEQ ID NO: 1203580 - RNA, 15 nt, Homo sapiens
uuauuaccucugaua

SEQ ID NO: 1203581 - RNA, 18 nt, Homo sapiens
uuauuaugagcuacaaca

SEQ ID NO: 1203582 - RNA, 22 nt, Homo sapiens
uuauucacauauaucaaaguga

SEQ ID NO: 1203583 - RNA, 15 nt, Homo sapiens
uuauuccuccaggaa

SEQ ID NO: 1203584 - RNA, 15 nt, Homo sapiens
uuauuccuugaucau

SEQ ID NO: 1203585 - RNA, 17 nt, Homo sapiens
uuauuccuugaucauuu

SEQ ID NO: 1203586 - RNA, 15 nt, Homo sapiens
uuauucugcuaaaga

SEQ ID NO: 1203587 - RNA, 15 nt, Homo sapiens
uuauucuugguuuuc

SEQ ID NO: 1203588 - RNA, 14 nt, Homo sapiens
uuauugaaugugau

SEQ ID NO: 1203589 - RNA, 15 nt, Homo sapiens
uuauugaaugugauu

SEQ ID NO: 1203590 - RNA, 13 nt, Homo sapiens
uuauugacuaaca

SEQ ID NO: 1203591 - RNA, 20 nt, Homo sapiens
uuauugcaauaaaguauaau

SEQ ID NO: 1203592 - RNA, 23 nt, Homo sapiens
uuauugccucugaaaugccucuu

SEQ ID NO: 1203593 - RNA, 15 nt, Homo sapiens
uuauuggcugagaua

SEQ ID NO: 1203594 - RNA, 20 nt, Homo sapiens
uuauugguuguuguauugau

SEQ ID NO: 1203595 - RNA, 18 nt, Homo sapiens
uuauuguauuuauuccau

SEQ ID NO: 1203596 - RNA, 21 nt, Homo sapiens
uuauuguucacacaaagccug

SEQ ID NO: 1203597 - RNA, 23 nt, Homo sapiens
uuauuuaaagcaaugcugaugaa

SEQ ID NO: 1203598 - RNA, 17 nt, Homo sapiens
uuauuuaaaugggaaua

SEQ ID NO: 1203599 - RNA, 16 nt, Homo sapiens
uuauuuacaugugauu

SEQ ID NO: 1203600 - RNA, 21 nt, Homo sapiens
uuauuuaugcacugugggaug

SEQ ID NO: 1203601 - RNA, 13 nt, Homo sapiens
uuauuucugcucu

SEQ ID NO: 1203602 - RNA, 17 nt, Homo sapiens
uuauuucugucacagua

SEQ ID NO: 1203603 - RNA, 15 nt, Homo sapiens
uuauuugaacuauga

SEQ ID NO: 1203604 - RNA, 22 nt, Homo sapiens
uuauuuggaguuagguccucac

SEQ ID NO: 1203605 - RNA, 21 nt, Homo sapiens
uuauuuggauaucaaaagcaa

SEQ ID NO: 1203606 - RNA, 17 nt, Homo sapiens
uuauuuuguauuguggu

SEQ ID NO: 1203607 - RNA, 19 nt, Homo sapiens
uuauuuuuauaucagccug

SEQ ID NO: 1203608 - RNA, 19 nt, Homo sapiens
uuauuuuuguuagcaaaga

SEQ ID NO: 1203609 - RNA, 16 nt, Homo sapiens
uucaaaaaaaaaagca

SEQ ID NO: 1203610 - RNA, 14 nt, Homo sapiens
uucaaaaaaucagc

SEQ ID NO: 1203611 - RNA, 17 nt, Homo sapiens
uucaaaaaaucagcaau

SEQ ID NO: 1203612 - RNA, 21 nt, Homo sapiens
uucaaaacauucauaggcagu

SEQ ID NO: 1203613 - RNA, 19 nt, Homo sapiens
uucaaaagaugccauucau

SEQ ID NO: 1203614 - RNA, 21 nt, Homo sapiens
uucaaaagcacuuugugcugu

SEQ ID NO: 1203615 - RNA, 13 nt, Homo sapiens
uucaaaaguucca

SEQ ID NO: 1203616 - RNA, 22 nt, Homo sapiens
uucaaacugugaagcauuuaca

SEQ ID NO: 1203617 - RNA, 15 nt, Homo sapiens
uucaaaucagugauc

SEQ ID NO: 1203618 - RNA, 22 nt, Homo sapiens
uucaaaugugcugucaaaacaa

SEQ ID NO: 1203619 - RNA, 11 nt, Homo sapiens
uucaacaaagg

SEQ ID NO: 1203620 - RNA, 14 nt, Homo sapiens
uucaacaaguaccu

SEQ ID NO: 1203621 - RNA, 21 nt, Homo sapiens
uucaacauuaaggcaguauga

SEQ ID NO: 1203622 - RNA, 15 nt, Homo sapiens
uucaaccucauugac

SEQ ID NO: 1203623 - RNA, 22 nt, Homo sapiens
uucaacugccauguuuugccac

SEQ ID NO: 1203624 - RNA, 14 nt, Homo sapiens
uucaagaaacugau

SEQ ID NO: 1203625 - RNA, 19 nt, Homo sapiens
uucaagaccagccugggca

SEQ ID NO: 1203626 - RNA, 12 nt, Homo sapiens
uucaagauccuc

SEQ ID NO: 1203627 - RNA, 20 nt, Homo sapiens
uucaagcaaaaugcuuacag

SEQ ID NO: 1203628 - RNA, 23 nt, Homo sapiens
uucaagcagucgugccugugucc

SEQ ID NO: 1203629 - RNA, 15 nt, Homo sapiens
uucaagccuguuaua

SEQ ID NO: 1203630 - RNA, 16 nt, Homo sapiens
uucaagccuuagauaa

SEQ ID NO: 1203631 - RNA, 17 nt, Homo sapiens
uucaaggaaaaaugcug

SEQ ID NO: 1203632 - RNA, 19 nt, Homo sapiens
uucaaggaaaaaugcugcu

SEQ ID NO: 1203633 - RNA, 23 nt, Homo sapiens
uucaaggcauuucuaucacauau

SEQ ID NO: 1203634 - RNA, 18 nt, Homo sapiens
uucaaggcucaaugcuau

SEQ ID NO: 1203635 - RNA, 17 nt, Homo sapiens
uucaagucugacucucc

SEQ ID NO: 1203636 - RNA, 16 nt, Homo sapiens
uucaaguuaaagugaa

SEQ ID NO: 1203637 - RNA, 22 nt, Homo sapiens
uucaaguuaaagugaauaacca

SEQ ID NO: 1203638 - RNA, 15 nt, Homo sapiens
uucaauaaagcauuu

SEQ ID NO: 1203639 - RNA, 14 nt, Homo sapiens
uucaaucuguaaac

SEQ ID NO: 1203640 - RNA, 10 nt, Homo sapiens
uucaaugagg

SEQ ID NO: 1203641 - RNA, 18 nt, Homo sapiens
uucaaugggcucuuccaa

SEQ ID NO: 1203642 - RNA, 20 nt, Homo sapiens
uucaauuauacuaaaccuca

SEQ ID NO: 1203643 - RNA, 14 nt, Homo sapiens
uucaauugacaaau

SEQ ID NO: 1203644 - RNA, 18 nt, Homo sapiens
uucaauuguaaauugaau

SEQ ID NO: 1203645 - RNA, 16 nt, Homo sapiens
uucaauuuauuacuga

SEQ ID NO: 1203646 - RNA, 23 nt, Homo sapiens
uucaauuuggacuggugugcucu

SEQ ID NO: 1203647 - RNA, 15 nt, Homo sapiens
uucacaaauacauaa

SEQ ID NO: 1203648 - RNA, 18 nt, Homo sapiens
uucacacaguaaagcagg

SEQ ID NO: 1203649 - RNA, 23 nt, Homo sapiens
uucacacagugaaacgcaauuuu

SEQ ID NO: 1203650 - RNA, 14 nt, Homo sapiens
uucacacuaagaaa

SEQ ID NO: 1203651 - RNA, 18 nt, Homo sapiens
uucacaggaggccagugg

SEQ ID NO: 1203652 - RNA, 14 nt, Homo sapiens
uucacaggcuguaa

SEQ ID NO: 1203653 - RNA, 15 nt, Homo sapiens
uucacagucacugau

SEQ ID NO: 1203654 - RNA, 13 nt, Homo sapiens
uucacagugcaag

SEQ ID NO: 1203655 - RNA, 15 nt, Homo sapiens
uucacaucugucacg

SEQ ID NO: 1203656 - RNA, 16 nt, Homo sapiens
uucacauuuguauuaa

SEQ ID NO: 1203657 - RNA, 17 nt, Homo sapiens
uucaccaaaugaugcca

SEQ ID NO: 1203658 - RNA, 17 nt, Homo sapiens
uucaccacaugugcaca

SEQ ID NO: 1203659 - RNA, 11 nt, Homo sapiens
uucaccagagc

SEQ ID NO: 1203660 - RNA, 15 nt, Homo sapiens
uucaccagagcauuu

SEQ ID NO: 1203661 - RNA, 18 nt, Homo sapiens
uucaccagagcauuucca

SEQ ID NO: 1203662 - RNA, 17 nt, Homo sapiens
uucacccuuaacccaag

SEQ ID NO: 1203663 - RNA, 18 nt, Homo sapiens
uucacccuuaacccaagg

SEQ ID NO: 1203664 - RNA, 16 nt, Homo sapiens
uucaccuccaacugga

SEQ ID NO: 1203665 - RNA, 17 nt, Homo sapiens
uucaccugugacaaagg

SEQ ID NO: 1203666 - RNA, 20 nt, Homo sapiens
uucaccuuccagugucucgg

SEQ ID NO: 1203667 - RNA, 18 nt, Homo sapiens
uuagaauauccaugaccu

SEQ ID NO: 1203668 - RNA, 23 nt, Homo sapiens
uuagaaugccgguuaaauuccau

SEQ ID NO: 1203669 - RNA, 18 nt, Homo sapiens
uuagaauuuacagcaaga

SEQ ID NO: 1203670 - RNA, 19 nt, Homo sapiens
uuagagaaagaacuaugaa

SEQ ID NO: 1203671 - RNA, 19 nt, Homo sapiens
uuagagcuggcaccagaac

SEQ ID NO: 1203672 - RNA, 13 nt, Homo sapiens
uuagagcugggaa

SEQ ID NO: 1203673 - RNA, 14 nt, Homo sapiens
uuagaggagcccac

SEQ ID NO: 1203674 - RNA, 16 nt, Homo sapiens
uuagaguguagcugua

SEQ ID NO: 1203675 - RNA, 13 nt, Homo sapiens
uuagauaacgcuu

SEQ ID NO: 1203676 - RNA, 19 nt, Homo sapiens
uuagauauugcuacuauaa

SEQ ID NO: 1203677 - RNA, 19 nt, Homo sapiens
uuagaucaaauaguugcau

SEQ ID NO: 1203678 - RNA, 18 nt, Homo sapiens
uuagaucaaggcaaaaau

SEQ ID NO: 1203679 - RNA, 21 nt, Homo sapiens
uuagaugagggugacugucaa

SEQ ID NO: 1203680 - RNA, 20 nt, Homo sapiens
uuagauugaguaagauuuac

SEQ ID NO: 1203681 - RNA, 22 nt, Homo sapiens
uuagauugaguaagauuuaccc

SEQ ID NO: 1203682 - RNA, 13 nt, Homo sapiens
uuagcaaacugaa

SEQ ID NO: 1203683 - RNA, 18 nt, Homo sapiens
uuagcacuauuuacauac

SEQ ID NO: 1203684 - RNA, 22 nt, Homo sapiens
uuagcauaaaauuuucuacucu

SEQ ID NO: 1203685 - RNA, 13 nt, Homo sapiens
uuagcaugcacaa

SEQ ID NO: 1203686 - RNA, 15 nt, Homo sapiens
uuagcaugcacaaag

SEQ ID NO: 1203687 - RNA, 17 nt, Homo sapiens
uuagcaugcuacaguua

SEQ ID NO: 1203688 - RNA, 12 nt, Homo sapiens
uuagcaugcugc

SEQ ID NO: 1203689 - RNA, 23 nt, Homo sapiens
uuagcauuccuauugacaacucu

SEQ ID NO: 1203690 - RNA, 13 nt, Homo sapiens
uuagccaaaggau

SEQ ID NO: 1203691 - RNA, 12 nt, Homo sapiens
uuagcccaagag

SEQ ID NO: 1203692 - RNA, 23 nt, Homo sapiens
uuagcuaccucacuaugcugcuu

SEQ ID NO: 1203693 - RNA, 20 nt, Homo sapiens
uuagcuaguuuuauucuugg

SEQ ID NO: 1203694 - RNA, 22 nt, Homo sapiens
uuagcucuguucuuuauaacaa

SEQ ID NO: 1203695 - RNA, 17 nt, Homo sapiens
uuagcugggaagaccaa

SEQ ID NO: 1203696 - RNA, 22 nt, Homo sapiens
uuagcuuccugccccagacaga

SEQ ID NO: 1203697 - RNA, 23 nt, Homo sapiens
uuagcuuucccugugccacuuug

SEQ ID NO: 1203698 - RNA, 23 nt, Homo sapiens
uuaggaagaaaugcccaaaagag

SEQ ID NO: 1203699 - RNA, 23 nt, Homo sapiens
uuaggaaguuuucuguagucauu

SEQ ID NO: 1203700 - RNA, 19 nt, Homo sapiens
uuaggaccuaaugggaccc

SEQ ID NO: 1203701 - RNA, 15 nt, Homo sapiens
uuagggacagaauua

SEQ ID NO: 1203702 - RNA, 12 nt, Homo sapiens
uuagggcacugg

SEQ ID NO: 1203703 - RNA, 15 nt, Homo sapiens
uuaggggaguucagu

SEQ ID NO: 1203704 - RNA, 13 nt, Homo sapiens
uuagguagcuuua

SEQ ID NO: 1203705 - RNA, 18 nt, Homo sapiens
uuagguugucuccaggcc

SEQ ID NO: 1203706 - RNA, 17 nt, Homo sapiens
uuaguaacauagacaaa

SEQ ID NO: 1203707 - RNA, 13 nt, Homo sapiens
uuaguaaucugua

SEQ ID NO: 1203708 - RNA, 14 nt, Homo sapiens
uuaguauaaguaca

SEQ ID NO: 1203709 - RNA, 21 nt, Homo sapiens
uuaguauaauugaccuacuuu

SEQ ID NO: 1203710 - RNA, 23 nt, Homo sapiens
uuaguauagccacaaaugccuug

SEQ ID NO: 1203711 - RNA, 13 nt, Homo sapiens
uuaguccaaauaa

SEQ ID NO: 1203712 - RNA, 22 nt, Homo sapiens
uuagucucuggaaaaagacuga

SEQ ID NO: 1203713 - RNA, 15 nt, Homo sapiens
uuagugaaaaacugc

SEQ ID NO: 1203714 - RNA, 19 nt, Homo sapiens
uuagugaaugacuuuucuc

SEQ ID NO: 1203715 - RNA, 13 nt, Homo sapiens
uuagugacuucaa

SEQ ID NO: 1203716 - RNA, 21 nt, Homo sapiens
uuagugaucaaauugugcagu

SEQ ID NO: 1203717 - RNA, 23 nt, Homo sapiens
uuaguuccccaaauacaaaguua

SEQ ID NO: 1203718 - RNA, 20 nt, Homo sapiens
uuaguuuacaaucagccaca

SEQ ID NO: 1203719 - RNA, 13 nt, Homo sapiens
uuauaaaaaugag

SEQ ID NO: 1203720 - RNA, 14 nt, Homo sapiens
uuauaaaccuucag

SEQ ID NO: 1203721 - RNA, 21 nt, Homo sapiens
uuauaaacuuuagaguagcau

SEQ ID NO: 1203722 - RNA, 22 nt, Homo sapiens
uuauaaauauuauuagauuuau

SEQ ID NO: 1203723 - RNA, 20 nt, Homo sapiens
uuauaaauucagaacaagca

SEQ ID NO: 1203724 - RNA, 13 nt, Homo sapiens
uuauaacaguguu

SEQ ID NO: 1203725 - RNA, 14 nt, Homo sapiens
uuauaagacuggaa

SEQ ID NO: 1203726 - RNA, 14 nt, Homo sapiens
uuauaauauacuau

SEQ ID NO: 1203727 - RNA, 21 nt, Homo sapiens
uuauaauucauugugauuuau

SEQ ID NO: 1203728 - RNA, 19 nt, Homo sapiens
uuauacaaaccuaccaaaa

SEQ ID NO: 1203729 - RNA, 19 nt, Homo sapiens
uuauacaauaacccaguua

SEQ ID NO: 1203730 - RNA, 15 nt, Homo sapiens
uuauacacaguggau

SEQ ID NO: 1203731 - RNA, 14 nt, Homo sapiens
uuauacagcagaga

SEQ ID NO: 1203732 - RNA, 11 nt, Homo sapiens
uuauacuccuc

SEQ ID NO: 1203733 - RNA, 15 nt, Homo sapiens
uuauagaaguagcaa

SEQ ID NO: 1203734 - RNA, 12 nt, Homo sapiens
uuauagauucua

SEQ ID NO: 1203735 - RNA, 18 nt, Homo sapiens
uuauagcaacaacaauug

SEQ ID NO: 1203736 - RNA, 22 nt, Homo sapiens
uuauagcaacaacaauugguaa

SEQ ID NO: 1203737 - RNA, 22 nt, Homo sapiens
uuauagcacuuugaaauaccuc

SEQ ID NO: 1203738 - RNA, 12 nt, Homo sapiens
uuauagcuauga

SEQ ID NO: 1203739 - RNA, 13 nt, Homo sapiens
uuauagucuucca

SEQ ID NO: 1203740 - RNA, 24 nt, Homo sapiens
uuauauauguaucuaaaccauaug

SEQ ID NO: 1203741 - RNA, 16 nt, Homo sapiens
uuauauauuacuuguu

SEQ ID NO: 1203742 - RNA, 17 nt, Homo sapiens
uuauauauuaugugaag

SEQ ID NO: 1203743 - RNA, 19 nt, Homo sapiens
uuauauauuuauaacucau

SEQ ID NO: 1203744 - RNA, 15 nt, Homo sapiens
uuauaucagccugag

SEQ ID NO: 1203745 - RNA, 13 nt, Homo sapiens
uuauaucaugcaa

SEQ ID NO: 1203746 - RNA, 20 nt, Homo sapiens
uuauaucuguaaugauacug

SEQ ID NO: 1203747 - RNA, 18 nt, Homo sapiens
uuauaugaacauagacua

SEQ ID NO: 1203748 - RNA, 23 nt, Homo sapiens
uuauaugaacauagacuagagaa

SEQ ID NO: 1203749 - RNA, 22 nt, Homo sapiens
uuauaugaccauauuuacucuu

SEQ ID NO: 1203750 - RNA, 13 nt, Homo sapiens
uuauaugcuauuu

SEQ ID NO: 1203751 - RNA, 13 nt, Homo sapiens
uuauauggaugau

SEQ ID NO: 1203752 - RNA, 13 nt, Homo sapiens
uuauaugugacac

SEQ ID NO: 1203753 - RNA, 17 nt, Homo sapiens
uuauaugugacacugca

SEQ ID NO: 1203754 - RNA, 12 nt, Homo sapiens
uuauauguugcu

SEQ ID NO: 1203755 - RNA, 17 nt, Homo sapiens
uuauauuaauguacuug

SEQ ID NO: 1203756 - RNA, 14 nt, Homo sapiens
uuauauugcaagcu

SEQ ID NO: 1203757 - RNA, 15 nt, Homo sapiens
uuauauuuuuagccu

SEQ ID NO: 1203758 - RNA, 19 nt, Homo sapiens
uuaucacgcagaucacuaa

SEQ ID NO: 1203759 - RNA, 22 nt, Homo sapiens
uuaucagacucuguaauugaau

SEQ ID NO: 1203760 - RNA, 14 nt, Homo sapiens
uuaucagucauaac

SEQ ID NO: 1203761 - RNA, 15 nt, Homo sapiens
uuaucaucaccucaa

SEQ ID NO: 1203762 - RNA, 12 nt, Homo sapiens
uuaucaucugaa

SEQ ID NO: 1203763 - RNA, 16 nt, Homo sapiens
uuaucaugcauguccu

SEQ ID NO: 1203764 - RNA, 13 nt, Homo sapiens
uuaucauugcuaa

SEQ ID NO: 1203765 - RNA, 14 nt, Homo sapiens
uuauccaagaccug

SEQ ID NO: 1203766 - RNA, 14 nt, Homo sapiens
ugcaaacaaaaucc

SEQ ID NO: 1203767 - RNA, 22 nt, Homo sapiens
ugcaaacccugguugcuguauu

SEQ ID NO: 1203768 - RNA, 22 nt, Homo sapiens
ugcaaaccuguucaucuugcca

SEQ ID NO: 1203769 - RNA, 17 nt, Homo sapiens
ugcaaacucagugcaaa

SEQ ID NO: 1203770 - RNA, 21 nt, Homo sapiens
ugcaaagcugaagaccaugga

SEQ ID NO: 1203771 - RNA, 21 nt, Homo sapiens
ugcaaaggcgcagugcuucuc

SEQ ID NO: 1203772 - RNA, 20 nt, Homo sapiens
ugcaaagugauucacugugc

SEQ ID NO: 1203773 - RNA, 19 nt, Homo sapiens
ugcaaauacuguauauuca

SEQ ID NO: 1203774 - RNA, 14 nt, Homo sapiens
ugcaaauauaucug

SEQ ID NO: 1203775 - RNA, 13 nt, Homo sapiens
ugcaacacauuca

SEQ ID NO: 1203776 - RNA, 15 nt, Homo sapiens
ugcaacagacuugaa

SEQ ID NO: 1203777 - RNA, 14 nt, Homo sapiens
ugcaacagcacugg

SEQ ID NO: 1203778 - RNA, 22 nt, Homo sapiens
ugcaacagcuacagucuaaaau

SEQ ID NO: 1203779 - RNA, 16 nt, Homo sapiens
ugcaaccaacugcugc

SEQ ID NO: 1203780 - RNA, 17 nt, Homo sapiens
ugcaaccucugccuccc

SEQ ID NO: 1203781 - RNA, 22 nt, Homo sapiens
ugcaacugggucugacaugaac

SEQ ID NO: 1203782 - RNA, 19 nt, Homo sapiens
ugcaagaaaucagccauaa

SEQ ID NO: 1203783 - RNA, 20 nt, Homo sapiens
ugcaagaaggauaccaaaua

SEQ ID NO: 1203784 - RNA, 17 nt, Homo sapiens
ugcaagaccuagugcuc

SEQ ID NO: 1203785 - RNA, 15 nt, Homo sapiens
ugcaagagugacagu

SEQ ID NO: 1203786 - RNA, 18 nt, Homo sapiens
ugcaagaguggacugaau

SEQ ID NO: 1203787 - RNA, 15 nt, Homo sapiens
ugcaagcacaucugc

SEQ ID NO: 1203788 - RNA, 12 nt, Homo sapiens
ugcaagcuccau

SEQ ID NO: 1203789 - RNA, 20 nt, Homo sapiens
ugcaaggauucagcauuauu

SEQ ID NO: 1203790 - RNA, 14 nt, Homo sapiens
ugcaaggggcucaa

SEQ ID NO: 1203791 - RNA, 23 nt, Homo sapiens
ugcaaguggccauuaccaucucu

SEQ ID NO: 1203792 - RNA, 16 nt, Homo sapiens
ugcaaguguaucuccu

SEQ ID NO: 1203793 - RNA, 20 nt, Homo sapiens
ugcaaguuagggucuaugua

SEQ ID NO: 1203794 - RNA, 19 nt, Homo sapiens
ugcaauaucugaagcccuc

SEQ ID NO: 1203795 - RNA, 22 nt, Homo sapiens
ugcaaucucuuuucuacauaca

SEQ ID NO: 1203796 - RNA, 23 nt, Homo sapiens
ugcaaucucuuuucuacauacau

SEQ ID NO: 1203797 - RNA, 14 nt, Homo sapiens
ugcaaucuguguuc

SEQ ID NO: 1203798 - RNA, 12 nt, Homo sapiens
ugcaaucuucua

SEQ ID NO: 1203799 - RNA, 21 nt, Homo sapiens
ugcaaugccaguccugcagga

SEQ ID NO: 1203800 - RNA, 18 nt, Homo sapiens
ugcaaugggcacugggau

SEQ ID NO: 1203801 - RNA, 12 nt, Homo sapiens
ugcaauguauua

SEQ ID NO: 1203802 - RNA, 12 nt, Homo sapiens
ugcaaugucaca

SEQ ID NO: 1203803 - RNA, 22 nt, Homo sapiens
ugcaaugucacaaccucucuga

SEQ ID NO: 1203804 - RNA, 20 nt, Homo sapiens
ugcaauuuuauuaaaugcau

SEQ ID NO: 1203805 - RNA, 15 nt, Homo sapiens
ugcacaaagcccuuc

SEQ ID NO: 1203806 - RNA, 20 nt, Homo sapiens
ugcacaaauugaaaacacac

SEQ ID NO: 1203807 - RNA, 9 nt, Homo sapiens
ugcacacaa

SEQ ID NO: 1203808 - RNA, 22 nt, Homo sapiens
ugcacacaagcccacagcacag

SEQ ID NO: 1203809 - RNA, 20 nt, Homo sapiens
ugcacacgggaaagccuuaa

SEQ ID NO: 1203810 - RNA, 19 nt, Homo sapiens
ugcacacgugugcauuugu

SEQ ID NO: 1203811 - RNA, 20 nt, Homo sapiens
ugcacacguuugugagcucc

SEQ ID NO: 1203812 - RNA, 11 nt, Homo sapiens
ugcacagaauu

SEQ ID NO: 1203813 - RNA, 21 nt, Homo sapiens
ugcacagaucugcuugaucaa

SEQ ID NO: 1203814 - RNA, 21 nt, Homo sapiens
ugcacagcuaaguguggagcu

SEQ ID NO: 1203815 - RNA, 16 nt, Homo sapiens
ugcacaggaugcuggc

SEQ ID NO: 1203816 - RNA, 17 nt, Homo sapiens
ugcacaggucccacugc

SEQ ID NO: 1203817 - RNA, 22 nt, Homo sapiens
ugcacagugaagugcuggcaac

SEQ ID NO: 1203818 - RNA, 23 nt, Homo sapiens
ugcacauaguagguacccaauuc

SEQ ID NO: 1203819 - RNA, 15 nt, Homo sapiens
ugcacauccauuccc

SEQ ID NO: 1203820 - RNA, 20 nt, Homo sapiens
ugcacaugucuuguacaugu

SEQ ID NO: 1203821 - RNA, 19 nt, Homo sapiens
ucauugcuguaccacaucu

SEQ ID NO: 1203822 - RNA, 15 nt, Homo sapiens
ucauuggaagccauc

SEQ ID NO: 1203823 - RNA, 17 nt, Homo sapiens
ucauuguaaacaaacuc

SEQ ID NO: 1203824 - RNA, 22 nt, Homo sapiens
ucauuguaaacaaacucuugaa

SEQ ID NO: 1203825 - RNA, 17 nt, Homo sapiens
ucauuguagaaacacag

SEQ ID NO: 1203826 - RNA, 23 nt, Homo sapiens
ucauugucaaaauuaauaugauu

SEQ ID NO: 1203827 - RNA, 22 nt, Homo sapiens
ucauuguuuaggggugaaggag

SEQ ID NO: 1203828 - RNA, 20 nt, Homo sapiens
ucauuuagugacuuaauucu

SEQ ID NO: 1203829 - RNA, 17 nt, Homo sapiens
ucauuuauaaaaccauc

SEQ ID NO: 1203830 - RNA, 20 nt, Homo sapiens
ucauuuauuuacaugugauu

SEQ ID NO: 1203831 - RNA, 14 nt, Homo sapiens
ucauuucucuauga

SEQ ID NO: 1203832 - RNA, 20 nt, Homo sapiens
ucauuucuggaaagugcaau

SEQ ID NO: 1203833 - RNA, 15 nt, Homo sapiens
ucauuuuaguugccu

SEQ ID NO: 1203834 - RNA, 17 nt, Homo sapiens
ucauuuuuaacagcaug

SEQ ID NO: 1203835 - RNA, 23 nt, Homo sapiens
aauaucauucacuagcuuugccu

SEQ ID NO: 1203836 - RNA, 17 nt, Homo sapiens
aauauccaaagacugua

SEQ ID NO: 1203837 - RNA, 22 nt, Homo sapiens
aauauccagccucccacaagaa

SEQ ID NO: 1203838 - RNA, 22 nt, Homo sapiens
aauaucccuacauguauugcac

SEQ ID NO: 1203839 - RNA, 19 nt, Homo sapiens
aauaucugggauucuacuu

SEQ ID NO: 1203840 - RNA, 15 nt, Homo sapiens
aauaucuugcuuuca

SEQ ID NO: 1203841 - RNA, 12 nt, Homo sapiens
aauaucuuggcc

SEQ ID NO: 1203842 - RNA, 16 nt, Homo sapiens
aauaucuuugugauaa

SEQ ID NO: 1203843 - RNA, 16 nt, Homo sapiens
aauaugaaucugcuca

SEQ ID NO: 1203844 - RNA, 13 nt, Homo sapiens
aauaugaccauuu

SEQ ID NO: 1203845 - RNA, 20 nt, Homo sapiens
aauaugacggaagaacauag

SEQ ID NO: 1203846 - RNA, 21 nt, Homo sapiens
aauaugaguaauacaucaaag

SEQ ID NO: 1203847 - RNA, 22 nt, Homo sapiens
aauaugaguaauacaucaaaga

SEQ ID NO: 1203848 - RNA, 17 nt, Homo sapiens
aauaugaguuacugaag

SEQ ID NO: 1203849 - RNA, 17 nt, Homo sapiens
aauaugauacucucaga

SEQ ID NO: 1203850 - RNA, 19 nt, Homo sapiens
aauaugcacaauagcaguu

SEQ ID NO: 1203851 - RNA, 15 nt, Homo sapiens
aauaugcaugcuucu

SEQ ID NO: 1203852 - RNA, 19 nt, Homo sapiens
aauauggaaugggcucagu

SEQ ID NO: 1203853 - RNA, 18 nt, Homo sapiens
aauauggguugcauuugg

SEQ ID NO: 1203854 - RNA, 12 nt, Homo sapiens
aauauguacaag

SEQ ID NO: 1203855 - RNA, 16 nt, Homo sapiens
aauauguugaguucag

SEQ ID NO: 1203856 - RNA, 16 nt, Homo sapiens
aauauuaacauaagaa

SEQ ID NO: 1203857 - RNA, 14 nt, Homo sapiens
aauauuacucucaa

SEQ ID NO: 1203858 - RNA, 20 nt, Homo sapiens
aauauuagcauugccaauau

SEQ ID NO: 1203859 - RNA, 23 nt, Homo sapiens
aauauuaucacgcagaucacuaa

SEQ ID NO: 1203860 - RNA, 16 nt, Homo sapiens
aauauuauguguuucc

SEQ ID NO: 1203861 - RNA, 16 nt, Homo sapiens
aauauucauugguuaa

SEQ ID NO: 1203862 - RNA, 12 nt, Homo sapiens
aauauuccugaa

SEQ ID NO: 1203863 - RNA, 19 nt, Homo sapiens
aauauucuauaugaauuua

SEQ ID NO: 1203864 - RNA, 15 nt, Homo sapiens
aauauugauuccuca

SEQ ID NO: 1203865 - RNA, 19 nt, Homo sapiens
aauauugcugaacuacuuu

SEQ ID NO: 1203866 - RNA, 22 nt, Homo sapiens
aauauugcuuuggucauaugag

SEQ ID NO: 1203867 - RNA, 15 nt, Homo sapiens
aauauugucugccuu

SEQ ID NO: 1203868 - RNA, 23 nt, Homo sapiens
aauauuguugacaacugugacug

SEQ ID NO: 1203869 - RNA, 20 nt, Homo sapiens
aauauuuauaaaugagcaaa

SEQ ID NO: 1203870 - RNA, 14 nt, Homo sapiens
aauauuuauugucu

SEQ ID NO: 1203871 - RNA, 20 nt, Homo sapiens
aauauuucccauuugugcca

SEQ ID NO: 1203872 - RNA, 20 nt, Homo sapiens
aauauuucccucaccuuucc

SEQ ID NO: 1203873 - RNA, 20 nt, Homo sapiens
aauauuuccuuaaacugugu

SEQ ID NO: 1203874 - RNA, 22 nt, Homo sapiens
aauauuucugauacugcugagu

SEQ ID NO: 1203875 - RNA, 17 nt, Homo sapiens
aaugaugcacacugagg

SEQ ID NO: 1203876 - RNA, 15 nt, Homo sapiens
aaugaugccacuucc

SEQ ID NO: 1203877 - RNA, 16 nt, Homo sapiens
aaugaugggacaauaa

SEQ ID NO: 1203878 - RNA, 15 nt, Homo sapiens
aaugauuaaucaaag

SEQ ID NO: 1203879 - RNA, 11 nt, Homo sapiens
aaugauuagaa

SEQ ID NO: 1203880 - RNA, 14 nt, Homo sapiens
aaugauuaguuaaa

SEQ ID NO: 1203881 - RNA, 19 nt, Homo sapiens
aaugauucauaacaaugua

SEQ ID NO: 1203882 - RNA, 19 nt, Homo sapiens
aaugauuggaauauuacaa

SEQ ID NO: 1203883 - RNA, 18 nt, Homo sapiens
aaugauuuuaucugugaa

SEQ ID NO: 1203884 - RNA, 15 nt, Homo sapiens
aaugcaaaacuuuag

SEQ ID NO: 1203885 - RNA, 22 nt, Homo sapiens
aaugcaaaagauacggcccaug

SEQ ID NO: 1203886 - RNA, 15 nt, Homo sapiens
aaugcacaguugcca

SEQ ID NO: 1203887 - RNA, 14 nt, Homo sapiens
aaugcacauuuuau

SEQ ID NO: 1203888 - RNA, 22 nt, Homo sapiens
aaugcacugacauuguuggcca

SEQ ID NO: 1203889 - RNA, 23 nt, Homo sapiens
aaugcauaaaagacaagcacuuu

SEQ ID NO: 1203890 - RNA, 16 nt, Homo sapiens
aaugcaugaacaaguu

SEQ ID NO: 1203891 - RNA, 13 nt, Homo sapiens
aaugccacaaaac

SEQ ID NO: 1203892 - RNA, 20 nt, Homo sapiens
aaugccagaaggauaauauu

SEQ ID NO: 1203893 - RNA, 14 nt, Homo sapiens
aaugccaguccugc

SEQ ID NO: 1203894 - RNA, 14 nt, Homo sapiens
aaugccaugaauua

SEQ ID NO: 1203895 - RNA, 22 nt, Homo sapiens
aaugcccucaggggacuugaau

SEQ ID NO: 1203896 - RNA, 15 nt, Homo sapiens
aaugccuacugagua

SEQ ID NO: 1203897 - RNA, 18 nt, Homo sapiens
aaugccucuucuuuaugu

SEQ ID NO: 1203898 - RNA, 13 nt, Homo sapiens
aaugcuacaugug

SEQ ID NO: 1203899 - RNA, 10 nt, Homo sapiens
aaugcuccau

SEQ ID NO: 1203900 - RNA, 20 nt, Homo sapiens
aaugcucuuuacuucaugga

SEQ ID NO: 1203901 - RNA, 13 nt, Homo sapiens
aaugcugagguua

SEQ ID NO: 1203902 - RNA, 14 nt, Homo sapiens
aaugcugcuucucc

SEQ ID NO: 1203903 - RNA, 18 nt, Homo sapiens
aaugcugcuucuccuccc

SEQ ID NO: 1203904 - RNA, 16 nt, Homo sapiens
aaugcuguguugggua

SEQ ID NO: 1203905 - RNA, 22 nt, Homo sapiens
aaugcuucagauauuauugcuu

SEQ ID NO: 1203906 - RNA, 15 nt, Homo sapiens
aaugcuucugcacac

SEQ ID NO: 1203907 - RNA, 12 nt, Homo sapiens
aauggaaaccaa

SEQ ID NO: 1203908 - RNA, 17 nt, Homo sapiens
aauggaaaguaacucau

SEQ ID NO: 1203909 - RNA, 16 nt, Homo sapiens
aauggaacuacuguac

SEQ ID NO: 1203910 - RNA, 19 nt, Homo sapiens
aauggaagcccuuaaaggu

SEQ ID NO: 1203911 - RNA, 14 nt, Homo sapiens
aauggaaucuucuc

SEQ ID NO: 1203912 - RNA, 23 nt, Homo sapiens
aauggaauuuuuuacccauacaa

SEQ ID NO: 1203913 - RNA, 20 nt, Homo sapiens
aauggagggaauaauaccua

SEQ ID NO: 1203914 - RNA, 19 nt, Homo sapiens
aauggaucuuaaagcauuc

SEQ ID NO: 1203915 - RNA, 20 nt, Homo sapiens
aauggcaaguuuugauauga

SEQ ID NO: 1203916 - RNA, 19 nt, Homo sapiens
aauggcacgcuccugccua

SEQ ID NO: 1203917 - RNA, 22 nt, Homo sapiens
aauggcagggauacccagugau

SEQ ID NO: 1203918 - RNA, 13 nt, Homo sapiens
aauggcagguguc

SEQ ID NO: 1203919 - RNA, 15 nt, Homo sapiens
aaugggaaaucagug

SEQ ID NO: 1203920 - RNA, 24 nt, Homo sapiens
aaugggaauauuuuauacugacag

SEQ ID NO: 1203921 - RNA, 20 nt, Homo sapiens
aaugggagagcucuuguuau

SEQ ID NO: 1203922 - RNA, 20 nt, Homo sapiens
aaugggcacagcacagccag

SEQ ID NO: 1203923 - RNA, 17 nt, Homo sapiens
aauggggaucacagaga

SEQ ID NO: 1203924 - RNA, 14 nt, Homo sapiens
aaugggugauaucc

SEQ ID NO: 1203925 - RNA, 19 nt, Homo sapiens
aaugguaggauaucuuggc

SEQ ID NO: 1203926 - RNA, 20 nt, Homo sapiens
aaugguaggauaucuuggcu

SEQ ID NO: 1203927 - RNA, 17 nt, Homo sapiens
aauggucauccaaacuc

SEQ ID NO: 1203928 - RNA, 23 nt, Homo sapiens
aauggucucagccuaggcccuca

SEQ ID NO: 1203929 - RNA, 18 nt, Homo sapiens
aauggugauauccucuca

SEQ ID NO: 1203930 - RNA, 13 nt, Homo sapiens
aauggugcugcag

SEQ ID NO: 1203931 - RNA, 21 nt, Homo sapiens
aaugguucagaauuaaacuuu

SEQ ID NO: 1203932 - RNA, 15 nt, Homo sapiens
aaugguuucaaguua

SEQ ID NO: 1203933 - RNA, 15 nt, Homo sapiens
aauguaaacugccau

SEQ ID NO: 1203934 - RNA, 14 nt, Homo sapiens
aauguaagcauacu

SEQ ID NO: 1203935 - RNA, 16 nt, Homo sapiens
aauguacaacugcacc

SEQ ID NO: 1203936 - RNA, 19 nt, Homo sapiens
aauguacaauaaagcaaug

SEQ ID NO: 1203937 - RNA, 14 nt, Homo sapiens
aauguacacugauu

SEQ ID NO: 1203938 - RNA, 20 nt, Homo sapiens
aauguaccuucuuucacucu

SEQ ID NO: 1203939 - RNA, 19 nt, Homo sapiens
aauguagaccugugagaaa

SEQ ID NO: 1203940 - RNA, 15 nt, Homo sapiens
aauguaggacuguau

SEQ ID NO: 1203941 - RNA, 14 nt, Homo sapiens
aauguaucugugaa

SEQ ID NO: 1203942 - RNA, 15 nt, Homo sapiens
aauguaugauuacau

SEQ ID NO: 1203943 - RNA, 21 nt, Homo sapiens
aauguaugcauucacauuuag

SEQ ID NO: 1203944 - RNA, 13 nt, Homo sapiens
aauguaugugaaa

SEQ ID NO: 1203945 - RNA, 13 nt, Homo sapiens
aauguaugugcuc

SEQ ID NO: 1203946 - RNA, 20 nt, Homo sapiens
aauguauuccugaaaagcug

SEQ ID NO: 1203947 - RNA, 20 nt, Homo sapiens
aauguauuguaaucuuucau

SEQ ID NO: 1203948 - RNA, 20 nt, Homo sapiens
aauguauuuguuugcaauuu

SEQ ID NO: 1203949 - RNA, 19 nt, Homo sapiens
aaugucaagaucacaaaga

SEQ ID NO: 1203950 - RNA, 19 nt, Homo sapiens
aaugucacaaccucucuga

SEQ ID NO: 1203951 - RNA, 15 nt, Homo sapiens
aaugucaguauuuca

SEQ ID NO: 1203952 - RNA, 19 nt, Homo sapiens
aaugucaguguuugggaaa

SEQ ID NO: 1203953 - RNA, 22 nt, Homo sapiens
aaugucauuuaagggaguuaca

SEQ ID NO: 1203954 - RNA, 22 nt, Homo sapiens
aaugucgauuaaaaucacucuc

SEQ ID NO: 1203955 - RNA, 23 nt, Homo sapiens
aaugucucacuguucugcaaagg

SEQ ID NO: 1203956 - RNA, 17 nt, Homo sapiens
aaugucugguccuggcu

SEQ ID NO: 1203957 - RNA, 16 nt, Homo sapiens
aaugucuguuaacuua

SEQ ID NO: 1203958 - RNA, 14 nt, Homo sapiens
aaugucuucaagac

SEQ ID NO: 1203959 - RNA, 16 nt, Homo sapiens
aaugucuucaugaccu

SEQ ID NO: 1203960 - RNA, 14 nt, Homo sapiens
accugugaccagca

SEQ ID NO: 1203961 - RNA, 15 nt, Homo sapiens
accuguucaaaaagg

SEQ ID NO: 1203962 - RNA, 20 nt, Homo sapiens
accuguugagacugauucag

SEQ ID NO: 1203963 - RNA, 22 nt, Homo sapiens
accuguuuucgcaccuaccauc

SEQ ID NO: 1203964 - RNA, 19 nt, Homo sapiens
accuguuuuuaagcuguuu

SEQ ID NO: 1203965 - RNA, 20 nt, Homo sapiens
accuuaaagaaccaucagca

SEQ ID NO: 1203966 - RNA, 17 nt, Homo sapiens
accuuaagaagucuaua

SEQ ID NO: 1203967 - RNA, 23 nt, Homo sapiens
accuuauccauaggcgcaggugc

SEQ ID NO: 1203968 - RNA, 18 nt, Homo sapiens
accuuauuggauauuuga

SEQ ID NO: 1203969 - RNA, 19 nt, Homo sapiens
accuuauuggauauuugau

SEQ ID NO: 1203970 - RNA, 16 nt, Homo sapiens
accuucaagaucucau

SEQ ID NO: 1203971 - RNA, 14 nt, Homo sapiens
accuucaccuggau

SEQ ID NO: 1203972 - RNA, 14 nt, Homo sapiens
accuucacucucca

SEQ ID NO: 1203973 - RNA, 13 nt, Homo sapiens
accuucagaagcu

SEQ ID NO: 1203974 - RNA, 21 nt, Homo sapiens
accuucagauuuguguuauaa

SEQ ID NO: 1203975 - RNA, 22 nt, Homo sapiens
accuucaucugaaacccacaga

SEQ ID NO: 1203976 - RNA, 16 nt, Homo sapiens
accuucccaugcccug

SEQ ID NO: 1203977 - RNA, 21 nt, Homo sapiens
accuuccuccugcagacaccu

SEQ ID NO: 1203978 - RNA, 21 nt, Homo sapiens
accuugacuugauuagugccu

SEQ ID NO: 1203979 - RNA, 22 nt, Homo sapiens
accuugacuugauuagugccuu

SEQ ID NO: 1203980 - RNA, 18 nt, Homo sapiens
accuugaucccaauccuu

SEQ ID NO: 1203981 - RNA, 14 nt, Homo sapiens
accuugcacagguc

SEQ ID NO: 1203982 - RNA, 15 nt, Homo sapiens
accuugcuccugugu

SEQ ID NO: 1203983 - RNA, 14 nt, Homo sapiens
accuugcuguccug

SEQ ID NO: 1203984 - RNA, 16 nt, Homo sapiens
accuuggacauccucc

SEQ ID NO: 1203985 - RNA, 22 nt, Homo sapiens
accuugguguuucucucuguaa

SEQ ID NO: 1203986 - RNA, 14 nt, Homo sapiens
accuugucucauga

SEQ ID NO: 1203987 - RNA, 20 nt, Homo sapiens
accuuuaggucaaacucccu

SEQ ID NO: 1203988 - RNA, 23 nt, Homo sapiens
accuuuccaguuuauaagacugg

SEQ ID NO: 1203989 - RNA, 14 nt, Homo sapiens
accuuuccauuuau

SEQ ID NO: 1203990 - RNA, 19 nt, Homo sapiens
accuuucuagggacaugaa

SEQ ID NO: 1203991 - RNA, 17 nt, Homo sapiens
accuuuggagcaaagcu

SEQ ID NO: 1203992 - RNA, 17 nt, Homo sapiens
accuuugggacuaagcu

SEQ ID NO: 1203993 - RNA, 14 nt, Homo sapiens
accuuuuacucuuc

SEQ ID NO: 1203994 - RNA, 16 nt, Homo sapiens
accuuuuauguagcac

SEQ ID NO: 1203995 - RNA, 20 nt, Homo sapiens
accuuuucuccuacaaaggg

SEQ ID NO: 1203996 - RNA, 22 nt, Homo sapiens
accuuuugaggagccccagcua

SEQ ID NO: 1203997 - RNA, 15 nt, Homo sapiens
accuuuuuauuugca

SEQ ID NO: 1203998 - RNA, 14 nt, Homo sapiens
acgaaaauaaagua

SEQ ID NO: 1203999 - RNA, 14 nt, Homo sapiens
acgaaacacugugc

SEQ ID NO: 1204000 - RNA, 20 nt, Homo sapiens
acgaaaugcuaugacuguau

SEQ ID NO: 1204001 - RNA, 12 nt, Homo sapiens
acgaacuggacu

SEQ ID NO: 1204002 - RNA, 22 nt, Homo sapiens
acgaagccuuauuucuagaagc

SEQ ID NO: 1204003 - RNA, 17 nt, Homo sapiens
acgacaacgaugaugcu

SEQ ID NO: 1204004 - RNA, 18 nt, Homo sapiens
acgacuggccagggccac

SEQ ID NO: 1204005 - RNA, 17 nt, Homo sapiens
acgaggccacagcugcc

SEQ ID NO: 1204006 - RNA, 15 nt, Homo sapiens
acgagggucccgauc

SEQ ID NO: 1204007 - RNA, 14 nt, Homo sapiens
acgaggugcaguaa

SEQ ID NO: 1204008 - RNA, 23 nt, Homo sapiens
acgcacacccugccccuggugcc

SEQ ID NO: 1204009 - RNA, 13 nt, Homo sapiens
acgcacaggaaaa

SEQ ID NO: 1204010 - RNA, 17 nt, Homo sapiens
acgcacgcucgcugcca

SEQ ID NO: 1204011 - RNA, 14 nt, Homo sapiens
acgcacuaacccag

SEQ ID NO: 1204012 - RNA, 11 nt, Homo sapiens
acgcagaucac

SEQ ID NO: 1204013 - RNA, 15 nt, Homo sapiens
acgcaucacuggggc

SEQ ID NO: 1204014 - RNA, 16 nt, Homo sapiens
acgcauccagcaagaa

SEQ ID NO: 1204015 - RNA, 12 nt, Homo sapiens
acgcaugugcag

SEQ ID NO: 1204016 - RNA, 16 nt, Homo sapiens
acgcaugugcagcuau

SEQ ID NO: 1204017 - RNA, 16 nt, Homo sapiens
acgcaugugugcugca

SEQ ID NO: 1204018 - RNA, 11 nt, Homo sapiens
acgccacugca

SEQ ID NO: 1204019 - RNA, 15 nt, Homo sapiens
acgccacugcacucc

SEQ ID NO: 1204020 - RNA, 15 nt, Homo sapiens
acgccccgggcaaag

SEQ ID NO: 1204021 - RNA, 19 nt, Homo sapiens
acgccgcucuucacugugg

SEQ ID NO: 1204022 - RNA, 19 nt, Homo sapiens
acgccugcccuccccagag

SEQ ID NO: 1204023 - RNA, 17 nt, Homo sapiens
acgccuguaaucccagc

SEQ ID NO: 1204024 - RNA, 20 nt, Homo sapiens
acgcgugcacacaccagagc

SEQ ID NO: 1204025 - RNA, 16 nt, Homo sapiens
acgcucgcugccauca

SEQ ID NO: 1204026 - RNA, 18 nt, Homo sapiens
acgcugaaggcuuacuuc

SEQ ID NO: 1204027 - RNA, 14 nt, Homo sapiens
acgcugguggugcu

SEQ ID NO: 1204028 - RNA, 16 nt, Homo sapiens
acgcuguuuguuucau

SEQ ID NO: 1204029 - RNA, 16 nt, Homo sapiens
acgcuucauuuccuug

SEQ ID NO: 1204030 - RNA, 16 nt, Homo sapiens
acggaagaggcugcug

SEQ ID NO: 1204031 - RNA, 22 nt, Homo sapiens
acggaagaggcugcugagaaag

SEQ ID NO: 1204032 - RNA, 20 nt, Homo sapiens
acggaauaaugaguuagaac

SEQ ID NO: 1204033 - RNA, 22 nt, Homo sapiens
acggaauauuuaaacaguagcu

SEQ ID NO: 1204034 - RNA, 17 nt, Homo sapiens
acggacaauaaaccucc

SEQ ID NO: 1204035 - RNA, 20 nt, Homo sapiens
acuccaaugucugcugagga

SEQ ID NO: 1204036 - RNA, 17 nt, Homo sapiens
acuccacagucaauauu

SEQ ID NO: 1204037 - RNA, 18 nt, Homo sapiens
acuccaccgccuauccca

SEQ ID NO: 1204038 - RNA, 19 nt, Homo sapiens
acuccaccgccuaucccaa

SEQ ID NO: 1204039 - RNA, 21 nt, Homo sapiens
acuccacucagguucuucagg

SEQ ID NO: 1204040 - RNA, 13 nt, Homo sapiens
acuccacugcccu

SEQ ID NO: 1204041 - RNA, 20 nt, Homo sapiens
acuccagauuuuuuacagcu

SEQ ID NO: 1204042 - RNA, 21 nt, Homo sapiens
acuccagauuuuuuacagcug

SEQ ID NO: 1204043 - RNA, 19 nt, Homo sapiens
acuccagcgcugaguggga

SEQ ID NO: 1204044 - RNA, 19 nt, Homo sapiens
acuccaucauggcugcuug

SEQ ID NO: 1204045 - RNA, 15 nt, Homo sapiens
acucccaacccuggc

SEQ ID NO: 1204046 - RNA, 18 nt, Homo sapiens
acucccaccacaggcaua

SEQ ID NO: 1204047 - RNA, 23 nt, Homo sapiens
acuccccuguuucaaucacuguc

SEQ ID NO: 1204048 - RNA, 21 nt, Homo sapiens
acucccuaauuuaugugcuau

SEQ ID NO: 1204049 - RNA, 19 nt, Homo sapiens
acuccucaggcagcgugug

SEQ ID NO: 1204050 - RNA, 14 nt, Homo sapiens
acuccuccaaagca

SEQ ID NO: 1204051 - RNA, 20 nt, Homo sapiens
acuccucuccgcaguuccug

SEQ ID NO: 1204052 - RNA, 19 nt, Homo sapiens
acuccucuguccaggcacu

SEQ ID NO: 1204053 - RNA, 18 nt, Homo sapiens
acuccugaccucagguga

SEQ ID NO: 1204054 - RNA, 18 nt, Homo sapiens
acuccugacuccuaccug

SEQ ID NO: 1204055 - RNA, 12 nt, Homo sapiens
acuccugcaaaa

SEQ ID NO: 1204056 - RNA, 16 nt, Homo sapiens
acuccugccaguugaa

SEQ ID NO: 1204057 - RNA, 18 nt, Homo sapiens
acuccugggcaucugugc

SEQ ID NO: 1204058 - RNA, 22 nt, Homo sapiens
acuccuugcaggugacauuugc

SEQ ID NO: 1204059 - RNA, 19 nt, Homo sapiens
acuccuuguaaagacugua

SEQ ID NO: 1204060 - RNA, 21 nt, Homo sapiens
acuccuuuugguuuaccuggg

SEQ ID NO: 1204061 - RNA, 19 nt, Homo sapiens
acuccuuuuuugcaugugc

SEQ ID NO: 1204062 - RNA, 17 nt, Homo sapiens
acucgucuuccuuguua

SEQ ID NO: 1204063 - RNA, 14 nt, Homo sapiens
acucuaagcugugu

SEQ ID NO: 1204064 - RNA, 13 nt, Homo sapiens
acucuaccaaaua

SEQ ID NO: 1204065 - RNA, 10 nt, Homo sapiens
acucuaccuc

SEQ ID NO: 1204066 - RNA, 17 nt, Homo sapiens
acucuaccucauaucag

SEQ ID NO: 1204067 - RNA, 21 nt, Homo sapiens
acucuagaugaaguuuuacau

SEQ ID NO: 1204068 - RNA, 21 nt, Homo sapiens
acucuaggggucaggcuccau

SEQ ID NO: 1204069 - RNA, 20 nt, Homo sapiens
acucuaucauuggccuccaa

SEQ ID NO: 1204070 - RNA, 18 nt, Homo sapiens
acucucaagugucuuagg

SEQ ID NO: 1204071 - RNA, 14 nt, Homo sapiens
acucucacaugugg

SEQ ID NO: 1204072 - RNA, 16 nt, Homo sapiens
acucucccuggagcug

SEQ ID NO: 1204073 - RNA, 20 nt, Homo sapiens
acucucugguuuacuucaaa

SEQ ID NO: 1204074 - RNA, 18 nt, Homo sapiens
acucucugugaccugccc

SEQ ID NO: 1204075 - RNA, 22 nt, Homo sapiens
acucugaaaaacauuccaggaa

SEQ ID NO: 1204076 - RNA, 12 nt, Homo sapiens
acucugacucuc

SEQ ID NO: 1204077 - RNA, 17 nt, Homo sapiens
acucugagaucuaagga

SEQ ID NO: 1204078 - RNA, 24 nt, Homo sapiens
acucugccagaguagugaagcuaa

SEQ ID NO: 1204079 - RNA, 15 nt, Homo sapiens
acucugccuuucuaa

SEQ ID NO: 1204080 - RNA, 17 nt, Homo sapiens
acucugcuucaguccac

SEQ ID NO: 1204081 - RNA, 19 nt, Homo sapiens
acucugggcugccauguga

SEQ ID NO: 1204082 - RNA, 23 nt, Homo sapiens
acucugggcuguaacguggcacu

SEQ ID NO: 1204083 - RNA, 19 nt, Homo sapiens
acucugguuggaaaugcca

SEQ ID NO: 1204084 - RNA, 22 nt, Homo sapiens
acucuguaauugaauauaaaug

SEQ ID NO: 1204085 - RNA, 18 nt, Homo sapiens
acucuguaguuacugugg

SEQ ID NO: 1204086 - RNA, 20 nt, Homo sapiens
acucugucuuaaaugagaag

SEQ ID NO: 1204087 - RNA, 21 nt, Homo sapiens
acucuuccuuccuaauaggca

SEQ ID NO: 1204088 - RNA, 15 nt, Homo sapiens
acucuugugaauuau

SEQ ID NO: 1204089 - RNA, 20 nt, Homo sapiens
acugccaggaguagugagcu

SEQ ID NO: 1204090 - RNA, 21 nt, Homo sapiens
acugccaucuuuaucaugaag

SEQ ID NO: 1204091 - RNA, 23 nt, Homo sapiens
acugccccccugccuugcucccc

SEQ ID NO: 1204092 - RNA, 21 nt, Homo sapiens
acugccccugcugugcugcuc

SEQ ID NO: 1204093 - RNA, 23 nt, Homo sapiens
acugcccgagcuggugcauuaca

SEQ ID NO: 1204094 - RNA, 16 nt, Homo sapiens
acugcccuggcagcag

SEQ ID NO: 1204095 - RNA, 13 nt, Homo sapiens
acugcccugggca

SEQ ID NO: 1204096 - RNA, 13 nt, Homo sapiens
acugccucagguu

SEQ ID NO: 1204097 - RNA, 17 nt, Homo sapiens
acugccucaguguuuca

SEQ ID NO: 1204098 - RNA, 18 nt, Homo sapiens
acugccugacaagugccu

SEQ ID NO: 1204099 - RNA, 22 nt, Homo sapiens
acugccuggguuccaauccugg

SEQ ID NO: 1204100 - RNA, 18 nt, Homo sapiens
acugccuuccacaauuca

SEQ ID NO: 1204101 - RNA, 21 nt, Homo sapiens
acugccuucgcuucuugccuc

SEQ ID NO: 1204102 - RNA, 21 nt, Homo sapiens
acugccuucuccaucaugccc

SEQ ID NO: 1204103 - RNA, 19 nt, Homo sapiens
acugcguggugcucuuugc

SEQ ID NO: 1204104 - RNA, 23 nt, Homo sapiens
acugcugaaacagacaugaaaua

SEQ ID NO: 1204105 - RNA, 12 nt, Homo sapiens
acugcugcacaa

SEQ ID NO: 1204106 - RNA, 16 nt, Homo sapiens
acugcuguacugcaau

SEQ ID NO: 1204107 - RNA, 20 nt, Homo sapiens
acugcuucccuuacuuugcu

SEQ ID NO: 1204108 - RNA, 16 nt, Homo sapiens
acugcuuggaagaagg

SEQ ID NO: 1204109 - RNA, 21 nt, Homo sapiens
acugcuuuuccucaagcaaua

SEQ ID NO: 1204110 - RNA, 19 nt, Homo sapiens
acugcuuuuuugauucuga

SEQ ID NO: 1204111 - RNA, 18 nt, Homo sapiens
acuggaaaaguguaauag

SEQ ID NO: 1204112 - RNA, 21 nt, Homo sapiens
acuggaagaaagcaacaaaga

SEQ ID NO: 1204113 - RNA, 20 nt, Homo sapiens
acuggaaguucauaccuaag

SEQ ID NO: 1204114 - RNA, 20 nt, Homo sapiens
acuggacuugagcuuggcag

SEQ ID NO: 1204115 - RNA, 22 nt, Homo sapiens
acuggaguaucauucuuuacau

SEQ ID NO: 1204116 - RNA, 18 nt, Homo sapiens
acuggauucuuaaccaag

SEQ ID NO: 1204117 - RNA, 20 nt, Homo sapiens
acuggauucuuaaccaagaa

SEQ ID NO: 1204118 - RNA, 22 nt, Homo sapiens
acuggauuggccaaacaucaga

SEQ ID NO: 1204119 - RNA, 18 nt, Homo sapiens
acuggcaaccugcuuuca

SEQ ID NO: 1204120 - RNA, 21 nt, Homo sapiens
acuggcaauaaacuccuacua

SEQ ID NO: 1204121 - RNA, 22 nt, Homo sapiens
acuggcaauaaacuccuacuaa

SEQ ID NO: 1204122 - RNA, 19 nt, Homo sapiens
acuggcacacuggccucca

SEQ ID NO: 1204123 - RNA, 13 nt, Homo sapiens
acuggcagcaucu

SEQ ID NO: 1204124 - RNA, 15 nt, Homo sapiens
acuggcagcuccucu

SEQ ID NO: 1204125 - RNA, 14 nt, Homo sapiens
acuggccaugguga

SEQ ID NO: 1204126 - RNA, 14 nt, Homo sapiens
acuggcugcaaagg

SEQ ID NO: 1204127 - RNA, 19 nt, Homo sapiens
acuggcuucucuugaguca

SEQ ID NO: 1204128 - RNA, 14 nt, Homo sapiens
acugggaaucaaga

SEQ ID NO: 1204129 - RNA, 14 nt, Homo sapiens
acugggcucaagag

SEQ ID NO: 1204130 - RNA, 17 nt, Homo sapiens
acuggggcaagcuccuc

SEQ ID NO: 1204131 - RNA, 17 nt, Homo sapiens
acugggucugacaugaa

SEQ ID NO: 1204132 - RNA, 17 nt, Homo sapiens
acugggugguccaaaga

SEQ ID NO: 1204133 - RNA, 16 nt, Homo sapiens
acugguauguguggau

SEQ ID NO: 1204134 - RNA, 22 nt, Homo sapiens
acugguauguguggaugaugcu

SEQ ID NO: 1204135 - RNA, 16 nt, Homo sapiens
acugguccagcucuga

SEQ ID NO: 1204136 - RNA, 19 nt, Homo sapiens
acuggugucacccuggaua

SEQ ID NO: 1204137 - RNA, 23 nt, Homo sapiens
acugguucauauuggacugauaa

SEQ ID NO: 1204138 - RNA, 15 nt, Homo sapiens
acugguuuucugcca

SEQ ID NO: 1204139 - RNA, 16 nt, Homo sapiens
acuguacaaaauaagu

SEQ ID NO: 1204140 - RNA, 22 nt, Homo sapiens
acuguacccucgcaugacuguu

SEQ ID NO: 1204141 - RNA, 17 nt, Homo sapiens
acuguacugacuugagg

SEQ ID NO: 1204142 - RNA, 14 nt, Homo sapiens
acuguagcuuuuag

SEQ ID NO: 1204143 - RNA, 23 nt, Homo sapiens
acuguauaacuauuuacuauuca

SEQ ID NO: 1204144 - RNA, 18 nt, Homo sapiens
acuguauauaaacauauc

SEQ ID NO: 1204145 - RNA, 18 nt, Homo sapiens
agcuuuuccucaccagga

SEQ ID NO: 1204146 - RNA, 18 nt, Homo sapiens
agcuuuuuacucaaagag

SEQ ID NO: 1204147 - RNA, 13 nt, Homo sapiens
agcuuuuucaaaa

SEQ ID NO: 1204148 - RNA, 15 nt, Homo sapiens
aggaaaaaacccagc

SEQ ID NO: 1204149 - RNA, 15 nt, Homo sapiens
aggaaaaaugcugcu

SEQ ID NO: 1204150 - RNA, 20 nt, Homo sapiens
aggaaaacgugaacaaacuu

SEQ ID NO: 1204151 - RNA, 15 nt, Homo sapiens
aggaaaacgugcuuu

SEQ ID NO: 1204152 - RNA, 14 nt, Homo sapiens
aggaaacaauauaa

SEQ ID NO: 1204153 - RNA, 13 nt, Homo sapiens
aggaaacaguuaa

SEQ ID NO: 1204154 - RNA, 21 nt, Homo sapiens
aggaaacuccacaucugccuu

SEQ ID NO: 1204155 - RNA, 15 nt, Homo sapiens
aggaaagauuuuguu

SEQ ID NO: 1204156 - RNA, 13 nt, Homo sapiens
aggaaagcaauaa

SEQ ID NO: 1204157 - RNA, 13 nt, Homo sapiens
aggaaagcacagc

SEQ ID NO: 1204158 - RNA, 22 nt, Homo sapiens
aggaaaggauuuuaccaaagca

SEQ ID NO: 1204159 - RNA, 15 nt, Homo sapiens
aggaaaggccugagg

SEQ ID NO: 1204160 - RNA, 12 nt, Homo sapiens
aggaaagugauu

SEQ ID NO: 1204161 - RNA, 13 nt, Homo sapiens
aggaaagugauuu

SEQ ID NO: 1204162 - RNA, 18 nt, Homo sapiens
aggaacaaaaaaaccaca

SEQ ID NO: 1204163 - RNA, 17 nt, Homo sapiens
aggaacaaauaaacuca

SEQ ID NO: 1204164 - RNA, 12 nt, Homo sapiens
aggaacacugcu

SEQ ID NO: 1204165 - RNA, 22 nt, Homo sapiens
aggaacagauuuugcuaagaca

SEQ ID NO: 1204166 - RNA, 16 nt, Homo sapiens
aggaacagcaauggug

SEQ ID NO: 1204167 - RNA, 13 nt, Homo sapiens
aggaaccuuccuu

SEQ ID NO: 1204168 - RNA, 23 nt, Homo sapiens
aggaacuauguucacaagaacaa

SEQ ID NO: 1204169 - RNA, 19 nt, Homo sapiens
aggaacucucaagugucuu

SEQ ID NO: 1204170 - RNA, 20 nt, Homo sapiens
aggaacuuuccccagaucaa

SEQ ID NO: 1204171 - RNA, 15 nt, Homo sapiens
aggaagaaaugucag

SEQ ID NO: 1204172 - RNA, 23 nt, Homo sapiens
aggaagaagucuaagagugaagu

SEQ ID NO: 1204173 - RNA, 21 nt, Homo sapiens
aggaagaagugguacuagugu

SEQ ID NO: 1204174 - RNA, 14 nt, Homo sapiens
aggaagcauucaga

SEQ ID NO: 1204175 - RNA, 18 nt, Homo sapiens
aggaagcccacacuaugc

SEQ ID NO: 1204176 - RNA, 19 nt, Homo sapiens
aggaaggaaaacuauguau

SEQ ID NO: 1204177 - RNA, 16 nt, Homo sapiens
aggaaggaaaugacac

SEQ ID NO: 1204178 - RNA, 15 nt, Homo sapiens
aggaaggaacagcaa

SEQ ID NO: 1204179 - RNA, 20 nt, Homo sapiens
aggaaguuuucuguagucau

SEQ ID NO: 1204180 - RNA, 20 nt, Homo sapiens
aggaauauagaaugaaagac

SEQ ID NO: 1204181 - RNA, 17 nt, Homo sapiens
aggaauccccaacaugc

SEQ ID NO: 1204182 - RNA, 19 nt, Homo sapiens
aggaaucuaaacaaacagg

SEQ ID NO: 1204183 - RNA, 17 nt, Homo sapiens
aggaauggcugcaccuu

SEQ ID NO: 1204184 - RNA, 21 nt, Homo sapiens
aggaauucaagguuuguucaa

SEQ ID NO: 1204185 - RNA, 13 nt, Homo sapiens
aggaauucagugc

SEQ ID NO: 1204186 - RNA, 16 nt, Homo sapiens
aggaauucuauaguaa

SEQ ID NO: 1204187 - RNA, 20 nt, Homo sapiens
aggaauuggccgcugucacu

SEQ ID NO: 1204188 - RNA, 14 nt, Homo sapiens
aggacaaccugcug

SEQ ID NO: 1204189 - RNA, 16 nt, Homo sapiens
aggacaauacuggggu

SEQ ID NO: 1204190 - RNA, 18 nt, Homo sapiens
aggacacaguggagccca

SEQ ID NO: 1204191 - RNA, 16 nt, Homo sapiens
aggacagaccacagag

SEQ ID NO: 1204192 - RNA, 13 nt, Homo sapiens
aggacagacuggc

SEQ ID NO: 1204193 - RNA, 18 nt, Homo sapiens
aggacagggaggugaccc

SEQ ID NO: 1204194 - RNA, 15 nt, Homo sapiens
aggacagugacccca

SEQ ID NO: 1204195 - RNA, 23 nt, Homo sapiens
aggacaucucugcccucuucuca

SEQ ID NO: 1204196 - RNA, 17 nt, Homo sapiens
aggaccgucuugcuuug

SEQ ID NO: 1204197 - RNA, 15 nt, Homo sapiens
aggaccuuuccacca

SEQ ID NO: 1204198 - RNA, 15 nt, Homo sapiens
aggacgauuucuguc

SEQ ID NO: 1204199 - RNA, 17 nt, Homo sapiens
aggacgcacgcucgcug

SEQ ID NO: 1204200 - RNA, 14 nt, Homo sapiens
aggacucagaggau

SEQ ID NO: 1204201 - RNA, 18 nt, Homo sapiens
aggacugaccucuuccuc

SEQ ID NO: 1204202 - RNA, 13 nt, Homo sapiens
aggacuucuggca

SEQ ID NO: 1204203 - RNA, 19 nt, Homo sapiens
aggacuugcuaaagcacuu

SEQ ID NO: 1204204 - RNA, 20 nt, Homo sapiens
aggacuugcuaaagcacuuu

SEQ ID NO: 1204205 - RNA, 23 nt, Homo sapiens
aggacuugcuaaagcacuuugca

SEQ ID NO: 1204206 - RNA, 22 nt, Homo sapiens
aggacuuuaucuaauaccucug

SEQ ID NO: 1204207 - RNA, 20 nt, Homo sapiens
aggagaaacucccauguaug

SEQ ID NO: 1204208 - RNA, 14 nt, Homo sapiens
aggagaacaucuuu

SEQ ID NO: 1204209 - RNA, 14 nt, Homo sapiens
aggagaagaggcau

SEQ ID NO: 1204210 - RNA, 16 nt, Homo sapiens
aggagaaucacugcag

SEQ ID NO: 1204211 - RNA, 17 nt, Homo sapiens
aggagaaucacugcagc

SEQ ID NO: 1204212 - RNA, 18 nt, Homo sapiens
aggagaaugaaauguaug

SEQ ID NO: 1204213 - RNA, 20 nt, Homo sapiens
aggagaaugaauacugggaa

SEQ ID NO: 1204214 - RNA, 21 nt, Homo sapiens
aggaugcauccagggguucau

SEQ ID NO: 1204215 - RNA, 19 nt, Homo sapiens
aggaugcugucaagcaccu

SEQ ID NO: 1204216 - RNA, 16 nt, Homo sapiens
aggauuuuaccaaagc

SEQ ID NO: 1204217 - RNA, 21 nt, Homo sapiens
aggauuuucacauucuuggcu

SEQ ID NO: 1204218 - RNA, 16 nt, Homo sapiens
aggauuuucugaccuu

SEQ ID NO: 1204219 - RNA, 20 nt, Homo sapiens
aggcaaaauugauauacuuu

SEQ ID NO: 1204220 - RNA, 16 nt, Homo sapiens
aggcaaauuuguauau

SEQ ID NO: 1204221 - RNA, 19 nt, Homo sapiens
aggcaaggcuaugugauua

SEQ ID NO: 1204222 - RNA, 21 nt, Homo sapiens
aggcaagggauaacucuucua

SEQ ID NO: 1204223 - RNA, 13 nt, Homo sapiens
aggcaauuucacc

SEQ ID NO: 1204224 - RNA, 15 nt, Homo sapiens
aggcacacuuugcac

SEQ ID NO: 1204225 - RNA, 22 nt, Homo sapiens
aggcacagcgagggcagcaucu

SEQ ID NO: 1204226 - RNA, 15 nt, Homo sapiens
aggcacucccaucca

SEQ ID NO: 1204227 - RNA, 22 nt, Homo sapiens
aggcacuguaguucuaagacuc

SEQ ID NO: 1204228 - RNA, 16 nt, Homo sapiens
aggcacuuaaagccuu

SEQ ID NO: 1204229 - RNA, 12 nt, Homo sapiens
aggcagaucugu

SEQ ID NO: 1204230 - RNA, 18 nt, Homo sapiens
aggcagauuaaaagcaca

SEQ ID NO: 1204231 - RNA, 13 nt, Homo sapiens
aggcagccacuuc

SEQ ID NO: 1204232 - RNA, 16 nt, Homo sapiens
aggcagcuaagacaua

SEQ ID NO: 1204233 - RNA, 17 nt, Homo sapiens
aggcagcucgugugccu

SEQ ID NO: 1204234 - RNA, 20 nt, Homo sapiens
aggcagcugccucugcuccc

SEQ ID NO: 1204235 - RNA, 21 nt, Homo sapiens
aggcaggcagcugccugcucu

SEQ ID NO: 1204236 - RNA, 23 nt, Homo sapiens
aggcaggcuuucugggugugacu

SEQ ID NO: 1204237 - RNA, 16 nt, Homo sapiens
aggcagguccacagag

SEQ ID NO: 1204238 - RNA, 18 nt, Homo sapiens
aggcagguccacagagag

SEQ ID NO: 1204239 - RNA, 16 nt, Homo sapiens
aggcaggugccuccag

SEQ ID NO: 1204240 - RNA, 20 nt, Homo sapiens
aggcagguggauugcuugag

SEQ ID NO: 1204241 - RNA, 13 nt, Homo sapiens
aggcaggugggcu

SEQ ID NO: 1204242 - RNA, 15 nt, Homo sapiens
aggcagucauaucaa

SEQ ID NO: 1204243 - RNA, 12 nt, Homo sapiens
aggcaguggccu

SEQ ID NO: 1204244 - RNA, 15 nt, Homo sapiens
aggcauacugacacu

SEQ ID NO: 1204245 - RNA, 19 nt, Homo sapiens
aggcauaggccugggugcu

SEQ ID NO: 1204246 - RNA, 20 nt, Homo sapiens
aggcaugagccaccgcgccu

SEQ ID NO: 1204247 - RNA, 16 nt, Homo sapiens
aggcaugauguuaacc

SEQ ID NO: 1204248 - RNA, 13 nt, Homo sapiens
aggcauggcagaa

SEQ ID NO: 1204249 - RNA, 15 nt, Homo sapiens
aggcaugggugcaag

SEQ ID NO: 1204250 - RNA, 20 nt, Homo sapiens
aggcauuaauguuucuaucu

SEQ ID NO: 1204251 - RNA, 14 nt, Homo sapiens
aggcauuucuauca

SEQ ID NO: 1204252 - RNA, 20 nt, Homo sapiens
aggcauuucugggaagcccc

SEQ ID NO: 1204253 - RNA, 21 nt, Homo sapiens
aggccaauaaaaaguucagag

SEQ ID NO: 1204254 - RNA, 18 nt, Homo sapiens
aggccacagcugccaucg

SEQ ID NO: 1204255 - RNA, 15 nt, Homo sapiens
aggccacauaccucu

SEQ ID NO: 1204256 - RNA, 15 nt, Homo sapiens
aggccaccaguuaaa

SEQ ID NO: 1204257 - RNA, 21 nt, Homo sapiens
aggccagagggagugacagag

SEQ ID NO: 1204258 - RNA, 15 nt, Homo sapiens
aggccagaugcacau

SEQ ID NO: 1204259 - RNA, 22 nt, Homo sapiens
aggccagggaaagcccguguca

SEQ ID NO: 1204260 - RNA, 20 nt, Homo sapiens
aggccaggugcaguggcuca

SEQ ID NO: 1204261 - RNA, 14 nt, Homo sapiens
aggccagugucugg

SEQ ID NO: 1204262 - RNA, 14 nt, Homo sapiens
aggccagugugucu

SEQ ID NO: 1204263 - RNA, 17 nt, Homo sapiens
aggccagugugucucug

SEQ ID NO: 1204264 - RNA, 16 nt, Homo sapiens
aggccauggugcacaa

SEQ ID NO: 1204265 - RNA, 14 nt, Homo sapiens
aggcccaacauuaa

SEQ ID NO: 1204266 - RNA, 13 nt, Homo sapiens
aggcccaagagau

SEQ ID NO: 1204267 - RNA, 12 nt, Homo sapiens
aggcccaccauc

SEQ ID NO: 1204268 - RNA, 13 nt, Homo sapiens
aggccccaaagga

SEQ ID NO: 1204269 - RNA, 15 nt, Homo sapiens
aggccccagcuggag

SEQ ID NO: 1204270 - RNA, 22 nt, Homo sapiens
aggccccuuuucacucccucca

SEQ ID NO: 1204271 - RNA, 14 nt, Homo sapiens
aggcccgcaccgcu

SEQ ID NO: 1204272 - RNA, 21 nt, Homo sapiens
aggcccgcagagcacagagca

SEQ ID NO: 1204273 - RNA, 15 nt, Homo sapiens
aggcccgcucuacau

SEQ ID NO: 1204274 - RNA, 20 nt, Homo sapiens
aggcccuagcggcagaaagg

SEQ ID NO: 1204275 - RNA, 10 nt, Homo sapiens
aggcccuccc

SEQ ID NO: 1204276 - RNA, 17 nt, Homo sapiens
aggcccugcccaaugag

SEQ ID NO: 1204277 - RNA, 14 nt, Homo sapiens
aggcccuggcugag

SEQ ID NO: 1204278 - RNA, 22 nt, Homo sapiens
aggcccuuccucuccacugccu

SEQ ID NO: 1204279 - RNA, 20 nt, Homo sapiens
aggccggaugcgguggcuca

SEQ ID NO: 1204280 - RNA, 16 nt, Homo sapiens
aggccuaggauucuaa

SEQ ID NO: 1204281 - RNA, 12 nt, Homo sapiens
aggccucugugc

SEQ ID NO: 1204282 - RNA, 19 nt, Homo sapiens
aggccugaggccugugccu

SEQ ID NO: 1204283 - RNA, 14 nt, Homo sapiens
aggccugcacagcu

SEQ ID NO: 1204284 - RNA, 18 nt, Homo sapiens
auaaaaaguucagaguuc

SEQ ID NO: 1204285 - RNA, 20 nt, Homo sapiens
auaaaaauaaaucaguucau

SEQ ID NO: 1204286 - RNA, 21 nt, Homo sapiens
auaaaacaaaauguuuuggag

SEQ ID NO: 1204287 - RNA, 13 nt, Homo sapiens
auaaaacauuaug

SEQ ID NO: 1204288 - RNA, 14 nt, Homo sapiens
auaaaacugaaucu

SEQ ID NO: 1204289 - RNA, 21 nt, Homo sapiens
auaaaagaaccgagcaauuuu

SEQ ID NO: 1204290 - RNA, 21 nt, Homo sapiens
auaaaagcuaugacacgagaa

SEQ ID NO: 1204291 - RNA, 13 nt, Homo sapiens
auaaaagguagua

SEQ ID NO: 1204292 - RNA, 17 nt, Homo sapiens
auaaaauagaaacauuu

SEQ ID NO: 1204293 - RNA, 18 nt, Homo sapiens
auaaaauauaaucuaauu

SEQ ID NO: 1204294 - RNA, 23 nt, Homo sapiens
auaaaauauuuuugaaaggcaug

SEQ ID NO: 1204295 - RNA, 19 nt, Homo sapiens
auaaaauccuaagacacaa

SEQ ID NO: 1204296 - RNA, 19 nt, Homo sapiens
auaaaaucugugaauuaaa

SEQ ID NO: 1204297 - RNA, 14 nt, Homo sapiens
auaaaauggucaug

SEQ ID NO: 1204298 - RNA, 18 nt, Homo sapiens
auaaaauguucagugcaa

SEQ ID NO: 1204299 - RNA, 19 nt, Homo sapiens
auaaaauuaacugguggca

SEQ ID NO: 1204300 - RNA, 14 nt, Homo sapiens
auaaaauuagcuug

SEQ ID NO: 1204301 - RNA, 14 nt, Homo sapiens
auaaaauugcacuu

SEQ ID NO: 1204302 - RNA, 23 nt, Homo sapiens
auaaaauuggcaccaugugccau

SEQ ID NO: 1204303 - RNA, 21 nt, Homo sapiens
auaaacaacuuaauguucuga

SEQ ID NO: 1204304 - RNA, 22 nt, Homo sapiens
auaaacaacuuaauguucugaa

SEQ ID NO: 1204305 - RNA, 24 nt, Homo sapiens
auaaacacacagaucugcaucuga

SEQ ID NO: 1204306 - RNA, 13 nt, Homo sapiens
auaaacacuggug

SEQ ID NO: 1204307 - RNA, 15 nt, Homo sapiens
auaaacacuggugcc

SEQ ID NO: 1204308 - RNA, 21 nt, Homo sapiens
auaaacacuuguagagcagau

SEQ ID NO: 1204309 - RNA, 20 nt, Homo sapiens
auaaacauuaaaugucuuau

SEQ ID NO: 1204310 - RNA, 23 nt, Homo sapiens
auaaacauuaauuuugugcauuc

SEQ ID NO: 1204311 - RNA, 12 nt, Homo sapiens
auaaacauugag

SEQ ID NO: 1204312 - RNA, 16 nt, Homo sapiens
auaaacauuucauuuc

SEQ ID NO: 1204313 - RNA, 13 nt, Homo sapiens
auaaacauuuuau

SEQ ID NO: 1204314 - RNA, 20 nt, Homo sapiens
auaaaccaaaggacauuaug

SEQ ID NO: 1204315 - RNA, 22 nt, Homo sapiens
auaaaccguuuuuaacacauag

SEQ ID NO: 1204316 - RNA, 19 nt, Homo sapiens
auaaaccuccgccaaugca

SEQ ID NO: 1204317 - RNA, 21 nt, Homo sapiens
auaaaccugggcucagccuga

SEQ ID NO: 1204318 - RNA, 23 nt, Homo sapiens
auaaacgguuccuggugacuccu

SEQ ID NO: 1204319 - RNA, 23 nt, Homo sapiens
auaaacuccuacuaaaucccucc

SEQ ID NO: 1204320 - RNA, 18 nt, Homo sapiens
auaaacugaauuuguacu

SEQ ID NO: 1204321 - RNA, 20 nt, Homo sapiens
auaaacugacuaaacuuaca

SEQ ID NO: 1204322 - RNA, 19 nt, Homo sapiens
auaaacuuuuuuucaaugu

SEQ ID NO: 1204323 - RNA, 20 nt, Homo sapiens
auaaacuuuuuuucaaugug

SEQ ID NO: 1204324 - RNA, 14 nt, Homo sapiens
auaaagcaaugugg

SEQ ID NO: 1204325 - RNA, 16 nt, Homo sapiens
auaaagcagaagcaac

SEQ ID NO: 1204326 - RNA, 14 nt, Homo sapiens
auaaagcauguuca

SEQ ID NO: 1204327 - RNA, 13 nt, Homo sapiens
auaaagcauucuu

SEQ ID NO: 1204328 - RNA, 22 nt, Homo sapiens
auaaaggcccagacuccauggu

SEQ ID NO: 1204329 - RNA, 12 nt, Homo sapiens
auaaaguaccac

SEQ ID NO: 1204330 - RNA, 13 nt, Homo sapiens
auaaaguaccaca

SEQ ID NO: 1204331 - RNA, 20 nt, Homo sapiens
auaaaguaccacacauauug

SEQ ID NO: 1204332 - RNA, 14 nt, Homo sapiens
auaaagucucucug

SEQ ID NO: 1204333 - RNA, 15 nt, Homo sapiens
auaaaguuugcuaag

SEQ ID NO: 1204334 - RNA, 14 nt, Homo sapiens
auaaauaacacuug

SEQ ID NO: 1204335 - RNA, 20 nt, Homo sapiens
auaaauauacucaaguuuca

SEQ ID NO: 1204336 - RNA, 11 nt, Homo sapiens
auaaauaucaa

SEQ ID NO: 1204337 - RNA, 14 nt, Homo sapiens
auaaauaugucaga

SEQ ID NO: 1204338 - RNA, 21 nt, Homo sapiens
auaaaucauuaagacaacuga

SEQ ID NO: 1204339 - RNA, 21 nt, Homo sapiens
auaaauccaaaacaaacaugc

SEQ ID NO: 1204340 - RNA, 15 nt, Homo sapiens
auaaaucuguuauag

SEQ ID NO: 1204341 - RNA, 14 nt, Homo sapiens
auaaaugcauuaaa

SEQ ID NO: 1204342 - RNA, 22 nt, Homo sapiens
auagcacuuugaaauaccucau

SEQ ID NO: 1204343 - RNA, 15 nt, Homo sapiens
auagcagaggggcca

SEQ ID NO: 1204344 - RNA, 20 nt, Homo sapiens
auagcagagggguaagagag

SEQ ID NO: 1204345 - RNA, 18 nt, Homo sapiens
auagcagauuguguaaca

SEQ ID NO: 1204346 - RNA, 23 nt, Homo sapiens
auagcaguugaaacaagaagcca

SEQ ID NO: 1204347 - RNA, 13 nt, Homo sapiens
auagcaucucagg

SEQ ID NO: 1204348 - RNA, 14 nt, Homo sapiens
auagcaucucagga

SEQ ID NO: 1204349 - RNA, 20 nt, Homo sapiens
auagccucaccaaggugaca

SEQ ID NO: 1204350 - RNA, 14 nt, Homo sapiens
auagccugccucag

SEQ ID NO: 1204351 - RNA, 23 nt, Homo sapiens
auagccuggacuuuccuguuguc

SEQ ID NO: 1204352 - RNA, 19 nt, Homo sapiens
auagccuuugucauuuuau

SEQ ID NO: 1204353 - RNA, 17 nt, Homo sapiens
auagcuauauccaugua

SEQ ID NO: 1204354 - RNA, 13 nt, Homo sapiens
auagcuucaggag

SEQ ID NO: 1204355 - RNA, 11 nt, Homo sapiens
auagcuuccaa

SEQ ID NO: 1204356 - RNA, 16 nt, Homo sapiens
auaggaaaaaaacugg

SEQ ID NO: 1204357 - RNA, 12 nt, Homo sapiens
auaggacauacu

SEQ ID NO: 1204358 - RNA, 23 nt, Homo sapiens
auaggagcugcaggggugccugg

SEQ ID NO: 1204359 - RNA, 18 nt, Homo sapiens
auaggcauuugauuuugc

SEQ ID NO: 1204360 - RNA, 16 nt, Homo sapiens
auaggccuuagcagua

SEQ ID NO: 1204361 - RNA, 12 nt, Homo sapiens
auaggcugugua

SEQ ID NO: 1204362 - RNA, 21 nt, Homo sapiens
auagggaaguaacauuugccu

SEQ ID NO: 1204363 - RNA, 19 nt, Homo sapiens
auagggacuuggggcuugg

SEQ ID NO: 1204364 - RNA, 20 nt, Homo sapiens
auagggagacccccaucuuu

SEQ ID NO: 1204365 - RNA, 20 nt, Homo sapiens
auaggucuuucucucaguga

SEQ ID NO: 1204366 - RNA, 21 nt, Homo sapiens
auagguuuuucucauguaucu

SEQ ID NO: 1204367 - RNA, 22 nt, Homo sapiens
auaguaaaguuguuguaaaaau

SEQ ID NO: 1204368 - RNA, 14 nt, Homo sapiens
auaguaaaugcuuu

SEQ ID NO: 1204369 - RNA, 17 nt, Homo sapiens
auaguacagacagaagg

SEQ ID NO: 1204370 - RNA, 17 nt, Homo sapiens
auaguaccucugcuauu

SEQ ID NO: 1204371 - RNA, 13 nt, Homo sapiens
auaguacuaguuu

SEQ ID NO: 1204372 - RNA, 15 nt, Homo sapiens
auaguacugcacuua

SEQ ID NO: 1204373 - RNA, 15 nt, Homo sapiens
auagucacauggccu

SEQ ID NO: 1204374 - RNA, 13 nt, Homo sapiens
auaguccaaagac

SEQ ID NO: 1204375 - RNA, 18 nt, Homo sapiens
auagucuuugccagucau

SEQ ID NO: 1204376 - RNA, 18 nt, Homo sapiens
auagugaacauauggaaa

SEQ ID NO: 1204377 - RNA, 23 nt, Homo sapiens
auagugauugauagaguguuauc

SEQ ID NO: 1204378 - RNA, 21 nt, Homo sapiens
auagugggcaccccacugcaa

SEQ ID NO: 1204379 - RNA, 17 nt, Homo sapiens
auagugucacuuccaca

SEQ ID NO: 1204380 - RNA, 15 nt, Homo sapiens
auaguuacuguguaa

SEQ ID NO: 1204381 - RNA, 21 nt, Homo sapiens
auaguucuaggcacuguaguu

SEQ ID NO: 1204382 - RNA, 21 nt, Homo sapiens
auaguuguuuuauauguugcu

SEQ ID NO: 1204383 - RNA, 20 nt, Homo sapiens
auaguuuaaacugcauuaua

SEQ ID NO: 1204384 - RNA, 16 nt, Homo sapiens
auaguuugaauucagu

SEQ ID NO: 1204385 - RNA, 20 nt, Homo sapiens
auauaaaaauaaugucauag

SEQ ID NO: 1204386 - RNA, 14 nt, Homo sapiens
auauaaaaggcaaa

SEQ ID NO: 1204387 - RNA, 19 nt, Homo sapiens
auauaaaguaguccuguga

SEQ ID NO: 1204388 - RNA, 12 nt, Homo sapiens
auauaacaugua

SEQ ID NO: 1204389 - RNA, 13 nt, Homo sapiens
auauaauaucaua

SEQ ID NO: 1204390 - RNA, 23 nt, Homo sapiens
auauaauggaagagaaaucucau

SEQ ID NO: 1204391 - RNA, 14 nt, Homo sapiens
auauaauggauaau

SEQ ID NO: 1204392 - RNA, 21 nt, Homo sapiens
auauaauuguaccaaccucau

SEQ ID NO: 1204393 - RNA, 16 nt, Homo sapiens
auauacaaaacuuuau

SEQ ID NO: 1204394 - RNA, 12 nt, Homo sapiens
auauaccaucuc

SEQ ID NO: 1204395 - RNA, 19 nt, Homo sapiens
auauaccuggcuuuuacuu

SEQ ID NO: 1204396 - RNA, 20 nt, Homo sapiens
auauucuguaugaacuuuau

SEQ ID NO: 1204397 - RNA, 16 nt, Homo sapiens
auauucuuaacagauc

SEQ ID NO: 1204398 - RNA, 17 nt, Homo sapiens
auauucuuugguuguga

SEQ ID NO: 1204399 - RNA, 16 nt, Homo sapiens
auauucuuuucugcaa

SEQ ID NO: 1204400 - RNA, 15 nt, Homo sapiens
auauugaauguuaaa

SEQ ID NO: 1204401 - RNA, 23 nt, Homo sapiens
auauugauugggaaaacauuugc

SEQ ID NO: 1204402 - RNA, 11 nt, Homo sapiens
auauugcccag

SEQ ID NO: 1204403 - RNA, 15 nt, Homo sapiens
auauuggacugauaa

SEQ ID NO: 1204404 - RNA, 14 nt, Homo sapiens
auauugugccccau

SEQ ID NO: 1204405 - RNA, 19 nt, Homo sapiens
auauuguguugacuuuaua

SEQ ID NO: 1204406 - RNA, 19 nt, Homo sapiens
auauuuaaaaaauuaugga

SEQ ID NO: 1204407 - RNA, 16 nt, Homo sapiens
auauuuaaaacaucau

SEQ ID NO: 1204408 - RNA, 14 nt, Homo sapiens
auauuuaaugcauu

SEQ ID NO: 1204409 - RNA, 19 nt, Homo sapiens
auauuuauacagcagagaa

SEQ ID NO: 1204410 - RNA, 13 nt, Homo sapiens
auauuuauacaua

SEQ ID NO: 1204411 - RNA, 16 nt, Homo sapiens
auauuuauauugucac

SEQ ID NO: 1204412 - RNA, 13 nt, Homo sapiens
auauuuaucugau

SEQ ID NO: 1204413 - RNA, 17 nt, Homo sapiens
auauuuauucaucuggg

SEQ ID NO: 1204414 - RNA, 22 nt, Homo sapiens
auauuucagauaucagaaucau

SEQ ID NO: 1204415 - RNA, 20 nt, Homo sapiens
auauuucaggcauacugaca

SEQ ID NO: 1204416 - RNA, 19 nt, Homo sapiens
auauuucuaccugagugaa

SEQ ID NO: 1204417 - RNA, 23 nt, Homo sapiens
auauuucucccaacuuauccaag

SEQ ID NO: 1204418 - RNA, 17 nt, Homo sapiens
auauuucugaaaaccua

SEQ ID NO: 1204419 - RNA, 17 nt, Homo sapiens
auauuucuugcuuucaa

SEQ ID NO: 1204420 - RNA, 18 nt, Homo sapiens
auauuugaagcaucacau

SEQ ID NO: 1204421 - RNA, 14 nt, Homo sapiens
auauuugagucacu

SEQ ID NO: 1204422 - RNA, 14 nt, Homo sapiens
auauuugcacuuau

SEQ ID NO: 1204423 - RNA, 14 nt, Homo sapiens
auauuugcuucacu

SEQ ID NO: 1204424 - RNA, 16 nt, Homo sapiens
auauuugguaccaugg

SEQ ID NO: 1204425 - RNA, 23 nt, Homo sapiens
auauuuguauauuacacauuugu

SEQ ID NO: 1204426 - RNA, 16 nt, Homo sapiens
auauuuuaaagcacuu

SEQ ID NO: 1204427 - RNA, 23 nt, Homo sapiens
auauuuuaagaauuucacaagcu

SEQ ID NO: 1204428 - RNA, 14 nt, Homo sapiens
auauuuuagaagcu

SEQ ID NO: 1204429 - RNA, 14 nt, Homo sapiens
auauuuuagcauuu

SEQ ID NO: 1204430 - RNA, 23 nt, Homo sapiens
auauuuucuggguuaaaacccca

SEQ ID NO: 1204431 - RNA, 15 nt, Homo sapiens
auauuuuguuuacaa

SEQ ID NO: 1204432 - RNA, 17 nt, Homo sapiens
auauuuuuccacuuaaa

SEQ ID NO: 1204433 - RNA, 19 nt, Homo sapiens
auauuuuugguugucaaua

SEQ ID NO: 1204434 - RNA, 14 nt, Homo sapiens
aucaaaacucuccu

SEQ ID NO: 1204435 - RNA, 20 nt, Homo sapiens
aucaaaauaaaaagugacac

SEQ ID NO: 1204436 - RNA, 20 nt, Homo sapiens
aucaaaaucuuucagcacuc

SEQ ID NO: 1204437 - RNA, 18 nt, Homo sapiens
aucaaaauuucagcauua

SEQ ID NO: 1204438 - RNA, 22 nt, Homo sapiens
aucaaaauuucagcauuauuga

SEQ ID NO: 1204439 - RNA, 23 nt, Homo sapiens
aucaaacaugcauggaugggucc

SEQ ID NO: 1204440 - RNA, 15 nt, Homo sapiens
aucaaagaacaaaca

SEQ ID NO: 1204441 - RNA, 13 nt, Homo sapiens
aucaaagaauuac

SEQ ID NO: 1204442 - RNA, 13 nt, Homo sapiens
aucaaagcacuug

SEQ ID NO: 1204443 - RNA, 23 nt, Homo sapiens
aucaaagugugauauacaaagug

SEQ ID NO: 1204444 - RNA, 14 nt, Homo sapiens
aucaaaugauuuca

SEQ ID NO: 1204445 - RNA, 22 nt, Homo sapiens
aucaaauugugcaguacuuugu

SEQ ID NO: 1204446 - RNA, 15 nt, Homo sapiens
aucaacaaaccacaa

SEQ ID NO: 1204447 - RNA, 13 nt, Homo sapiens
aucaacacaguga

SEQ ID NO: 1204448 - RNA, 16 nt, Homo sapiens
auuuguuugcaauuuu

SEQ ID NO: 1204449 - RNA, 17 nt, Homo sapiens
auuuuaaaacagaagaa

SEQ ID NO: 1204450 - RNA, 14 nt, Homo sapiens
auuuuaaagcacuu

SEQ ID NO: 1204451 - RNA, 12 nt, Homo sapiens
auuuuaaaguaa

SEQ ID NO: 1204452 - RNA, 19 nt, Homo sapiens
auuuuaaaguaaaagucua

SEQ ID NO: 1204453 - RNA, 18 nt, Homo sapiens
auuuuaaaucauuaggaa

SEQ ID NO: 1204454 - RNA, 21 nt, Homo sapiens
auuuuaagaauuucacaagcu

SEQ ID NO: 1204455 - RNA, 16 nt, Homo sapiens
auuuuaaggauaugau

SEQ ID NO: 1204456 - RNA, 23 nt, Homo sapiens
auuuuaauagggaauauaucucu

SEQ ID NO: 1204457 - RNA, 17 nt, Homo sapiens
auuuuaaugaagugcaa

SEQ ID NO: 1204458 - RNA, 14 nt, Homo sapiens
auuuuaauuaucuu

SEQ ID NO: 1204459 - RNA, 17 nt, Homo sapiens
auuuuacacaaagggaa

SEQ ID NO: 1204460 - RNA, 18 nt, Homo sapiens
auuuuaccuaguuugcac

SEQ ID NO: 1204461 - RNA, 14 nt, Homo sapiens
auuuuagacacuuc

SEQ ID NO: 1204462 - RNA, 20 nt, Homo sapiens
auuuuaggagcuaaggcucu

SEQ ID NO: 1204463 - RNA, 20 nt, Homo sapiens
auuuuaguuaaacucugaca

SEQ ID NO: 1204464 - RNA, 17 nt, Homo sapiens
auuuuauaccaaagcca

SEQ ID NO: 1204465 - RNA, 16 nt, Homo sapiens
auuuuauagacuacca

SEQ ID NO: 1204466 - RNA, 17 nt, Homo sapiens
auuuuauagacuaccaa

SEQ ID NO: 1204467 - RNA, 23 nt, Homo sapiens
auuuuauccauggaagaaacaca

SEQ ID NO: 1204468 - RNA, 15 nt, Homo sapiens
auuuuaucugcuaug

SEQ ID NO: 1204469 - RNA, 14 nt, Homo sapiens
auuuuaugcugcug

SEQ ID NO: 1204470 - RNA, 19 nt, Homo sapiens
auuuuauguuuaguugcac

SEQ ID NO: 1204471 - RNA, 19 nt, Homo sapiens
auuuuauucccaagcucua

SEQ ID NO: 1204472 - RNA, 18 nt, Homo sapiens
auuuuauugcuagccauc

SEQ ID NO: 1204473 - RNA, 21 nt, Homo sapiens
auuuuauuuugcugaguuguu

SEQ ID NO: 1204474 - RNA, 19 nt, Homo sapiens
auuuucaagaaacugagga

SEQ ID NO: 1204475 - RNA, 14 nt, Homo sapiens
auuuucaaguaauu

SEQ ID NO: 1204476 - RNA, 19 nt, Homo sapiens
auuuucaaguuuacacuuc

SEQ ID NO: 1204477 - RNA, 14 nt, Homo sapiens
auuuucagcauuaa

SEQ ID NO: 1204478 - RNA, 20 nt, Homo sapiens
auuuucagucaaaacuuuaa

SEQ ID NO: 1204479 - RNA, 13 nt, Homo sapiens
auuuucaguuaca

SEQ ID NO: 1204480 - RNA, 23 nt, Homo sapiens
auuuucauccuauaagcuuaaau

SEQ ID NO: 1204481 - RNA, 15 nt, Homo sapiens
auuuucauucauuca

SEQ ID NO: 1204482 - RNA, 18 nt, Homo sapiens
auuuucauuuguacaagg

SEQ ID NO: 1204483 - RNA, 16 nt, Homo sapiens
auuuucccuucccuga

SEQ ID NO: 1204484 - RNA, 21 nt, Homo sapiens
auuuuccuucagaauaucuua

SEQ ID NO: 1204485 - RNA, 21 nt, Homo sapiens
auuuucuuacacugugucauu

SEQ ID NO: 1204486 - RNA, 14 nt, Homo sapiens
auuuugagaucauc

SEQ ID NO: 1204487 - RNA, 20 nt, Homo sapiens
auuuugagaucaucagugau

SEQ ID NO: 1204488 - RNA, 15 nt, Homo sapiens
auuuugaguucuaca

SEQ ID NO: 1204489 - RNA, 13 nt, Homo sapiens
auuuugcacuguu

SEQ ID NO: 1204490 - RNA, 11 nt, Homo sapiens
auuuugcccag

SEQ ID NO: 1204491 - RNA, 15 nt, Homo sapiens
auuuuggccaaagug

SEQ ID NO: 1204492 - RNA, 18 nt, Homo sapiens
auuuugggguaagacuuu

SEQ ID NO: 1204493 - RNA, 21 nt, Homo sapiens
auuuugggguuguguugucac

SEQ ID NO: 1204494 - RNA, 22 nt, Homo sapiens
auuuugguuucuuccuuuccuc

SEQ ID NO: 1204495 - RNA, 16 nt, Homo sapiens
auuuuguaaaaguggc

SEQ ID NO: 1204496 - RNA, 21 nt, Homo sapiens
auuuuguagaauaaggaacaa

SEQ ID NO: 1204497 - RNA, 19 nt, Homo sapiens
auuuuguauucuuuuccaa

SEQ ID NO: 1204498 - RNA, 13 nt, Homo sapiens
auuuugugcaaaa

SEQ ID NO: 1204499 - RNA, 19 nt, Homo sapiens
auuuuguuauugacuaaca

SEQ ID NO: 1204500 - RNA, 13 nt, Homo sapiens
auuuuuacauuca

SEQ ID NO: 1204501 - RNA, 15 nt, Homo sapiens
auuuuuagaauuaaa

SEQ ID NO: 1204502 - RNA, 13 nt, Homo sapiens
auuuuuagccuaa

SEQ ID NO: 1204503 - RNA, 22 nt, Homo sapiens
auuuuuauaaaaaugagugcuu

SEQ ID NO: 1204504 - RNA, 14 nt, Homo sapiens
auuuuucaagagau

SEQ ID NO: 1204505 - RNA, 18 nt, Homo sapiens
auuuuuccucuguucaca

SEQ ID NO: 1204506 - RNA, 17 nt, Homo sapiens
auuuuugccaaggcaaa

SEQ ID NO: 1204507 - RNA, 16 nt, Homo sapiens
auuuuuguacauguuc

SEQ ID NO: 1204508 - RNA, 14 nt, Homo sapiens
auuuuugucuuaua

SEQ ID NO: 1204509 - RNA, 19 nt, Homo sapiens
auuuuugugaaaaugucaa

SEQ ID NO: 1204510 - RNA, 21 nt, Homo sapiens
auuuuuguuagcaaagauuaa

SEQ ID NO: 1204511 - RNA, 20 nt, Homo sapiens
auuuuuuaagguaacaaaua

SEQ ID NO: 1204512 - RNA, 15 nt, Homo sapiens
auuuuuuaauaaaga

SEQ ID NO: 1204513 - RNA, 21 nt, Homo sapiens
auuuuuuacagcugccugcag

SEQ ID NO: 1204514 - RNA, 17 nt, Homo sapiens
auuuuuuuaaauuugca

SEQ ID NO: 1204515 - RNA, 17 nt, Homo sapiens
auuuuuuuaagcuauca

SEQ ID NO: 1204516 - RNA, 16 nt, Homo sapiens
auuuuuuuaauagugc

SEQ ID NO: 1204517 - RNA, 18 nt, Homo sapiens
auuuuuuugagacagagu

SEQ ID NO: 1204518 - RNA, 20 nt, Homo sapiens
auuuuuuuuaacauuccaau

SEQ ID NO: 1204519 - RNA, 20 nt, Homo sapiens
auuuuuuuuuuuuacuugaa

SEQ ID NO: 1204520 - RNA, 17 nt, Homo sapiens
caaaaaaaaaaauggau

SEQ ID NO: 1204521 - RNA, 13 nt, Homo sapiens
caaaaaaaaaagc

SEQ ID NO: 1204522 - RNA, 18 nt, Homo sapiens
caaaaaaaaaccaugcau

SEQ ID NO: 1204523 - RNA, 16 nt, Homo sapiens
caaaaaaacagaaaag

SEQ ID NO: 1204524 - RNA, 17 nt, Homo sapiens
caaaaaaaccacaaagg

SEQ ID NO: 1204525 - RNA, 19 nt, Homo sapiens
caaaaaaaccucuaugcaa

SEQ ID NO: 1204526 - RNA, 21 nt, Homo sapiens
caaaaaaaguugaaggccuua

SEQ ID NO: 1204527 - RNA, 16 nt, Homo sapiens
caaaaaacuaauguga

SEQ ID NO: 1204528 - RNA, 15 nt, Homo sapiens
caaaaaaucagcaau

SEQ ID NO: 1204529 - RNA, 13 nt, Homo sapiens
caaaaacaagcaa

SEQ ID NO: 1204530 - RNA, 15 nt, Homo sapiens
caaaaacuacacaua

SEQ ID NO: 1204531 - RNA, 16 nt, Homo sapiens
caaaaagaaucugcau

SEQ ID NO: 1204532 - RNA, 19 nt, Homo sapiens
caaaaagggaaguaagcaa

SEQ ID NO: 1204533 - RNA, 13 nt, Homo sapiens
caaaaaguuccau

SEQ ID NO: 1204534 - RNA, 20 nt, Homo sapiens
caaaaauagcccugcaaaaa

SEQ ID NO: 1204535 - RNA, 14 nt, Homo sapiens
caaaaauauuccau

SEQ ID NO: 1204536 - RNA, 22 nt, Homo sapiens
caaaaaucuguguaacuguaaa

SEQ ID NO: 1204537 - RNA, 15 nt, Homo sapiens
caaaaaugaaaucca

SEQ ID NO: 1204538 - RNA, 20 nt, Homo sapiens
caaaaaugaaauccagugag

SEQ ID NO: 1204539 - RNA, 19 nt, Homo sapiens
caaaaauggauauuauuag

SEQ ID NO: 1204540 - RNA, 21 nt, Homo sapiens
caaaacaccagggacacauuu

SEQ ID NO: 1204541 - RNA, 19 nt, Homo sapiens
caaaacacucggcauuuca

SEQ ID NO: 1204542 - RNA, 12 nt, Homo sapiens
caaaacacugug

SEQ ID NO: 1204543 - RNA, 15 nt, Homo sapiens
caaaacacuguggaa

SEQ ID NO: 1204544 - RNA, 16 nt, Homo sapiens
caaaacagagauguga

SEQ ID NO: 1204545 - RNA, 20 nt, Homo sapiens
caaaacagagggcugcauuc

SEQ ID NO: 1204546 - RNA, 19 nt, Homo sapiens
caaaacauucauaggcagu

SEQ ID NO: 1204547 - RNA, 13 nt, Homo sapiens
caaaacauuccaa

SEQ ID NO: 1204548 - RNA, 21 nt, Homo sapiens
caaaaccaaacuuguucauuu

SEQ ID NO: 1204549 - RNA, 18 nt, Homo sapiens
caaaacccaggacaucuc

SEQ ID NO: 1204550 - RNA, 21 nt, Homo sapiens
caaaaccucauuuaaguaaaa

SEQ ID NO: 1204551 - RNA, 18 nt, Homo sapiens
caaaaccugauguuaaaa

SEQ ID NO: 1204552 - RNA, 23 nt, Homo sapiens
caaaaccuugcuaauuuucucaa

SEQ ID NO: 1204553 - RNA, 14 nt, Homo sapiens
caaaacuacaugag

SEQ ID NO: 1204554 - RNA, 12 nt, Homo sapiens
caaaacugccuc

SEQ ID NO: 1204555 - RNA, 21 nt, Homo sapiens
caaaacuguucuuuugcauuu

SEQ ID NO: 1204556 - RNA, 14 nt, Homo sapiens
caaaacuuaggcau

SEQ ID NO: 1204557 - RNA, 23 nt, Homo sapiens
caaaacuuaucacgccuacuuaa

SEQ ID NO: 1204558 - RNA, 19 nt, Homo sapiens
caaaagacaaacaugcaag

SEQ ID NO: 1204559 - RNA, 17 nt, Homo sapiens
caaaagagcauggaugc

SEQ ID NO: 1204560 - RNA, 22 nt, Homo sapiens
caaaagaucaaauguauucaga

SEQ ID NO: 1204561 - RNA, 22 nt, Homo sapiens
caaaagcaagggaccuucaugc

SEQ ID NO: 1204562 - RNA, 16 nt, Homo sapiens
caaaagccuuguguau

SEQ ID NO: 1204563 - RNA, 22 nt, Homo sapiens
caaaaggaacucuagaagacca

SEQ ID NO: 1204564 - RNA, 17 nt, Homo sapiens
caaaagggccauguuuc

SEQ ID NO: 1204565 - RNA, 18 nt, Homo sapiens
caaaauaaaaagugacac

SEQ ID NO: 1204566 - RNA, 16 nt, Homo sapiens
caaaauaaguaaauaa

SEQ ID NO: 1204567 - RNA, 18 nt, Homo sapiens
caaaauaaugcaccacuu

SEQ ID NO: 1204568 - RNA, 19 nt, Homo sapiens
caaaauagagaaucccacu

SEQ ID NO: 1204569 - RNA, 21 nt, Homo sapiens
caaaaugccauuuagcaauaa

SEQ ID NO: 1204570 - RNA, 19 nt, Homo sapiens
caaaaugcuucugcacaca

SEQ ID NO: 1204571 - RNA, 13 nt, Homo sapiens
caaaaugcuuuuu

SEQ ID NO: 1204572 - RNA, 21 nt, Homo sapiens
caaaauuguuuucacuuguau

SEQ ID NO: 1204573 - RNA, 16 nt, Homo sapiens
caaaauuucagcauua

SEQ ID NO: 1204574 - RNA, 19 nt, Homo sapiens
caaaauuuuauaagcaaau

SEQ ID NO: 1204575 - RNA, 17 nt, Homo sapiens
ccaaagagaaugccauu

SEQ ID NO: 1204576 - RNA, 19 nt, Homo sapiens
ccaaagagaaugccauucu

SEQ ID NO: 1204577 - RNA, 17 nt, Homo sapiens
ccacaucuugcucugcu

SEQ ID NO: 1204578 - RNA, 22 nt, Homo sapiens
ccacaugugacacauaugcacc

SEQ ID NO: 1204579 - RNA, 23 nt, Homo sapiens
ccacauuaucaguugacagugua

SEQ ID NO: 1204580 - RNA, 19 nt, Homo sapiens
ccacauugagaucacuacu

SEQ ID NO: 1204581 - RNA, 22 nt, Homo sapiens
ccacauugcuuuucacauccau

SEQ ID NO: 1204582 - RNA, 18 nt, Homo sapiens
ccacauuugguucuaaga

SEQ ID NO: 1204583 - RNA, 18 nt, Homo sapiens
ccaccaaagcugcccacu

SEQ ID NO: 1204584 - RNA, 17 nt, Homo sapiens
ccaccaacacugcucac

SEQ ID NO: 1204585 - RNA, 20 nt, Homo sapiens
ccaccaagggaucugccauu

SEQ ID NO: 1204586 - RNA, 21 nt, Homo sapiens
ccaccaccugaagcugaccaa

SEQ ID NO: 1204587 - RNA, 11 nt, Homo sapiens
ccaccagcugg

SEQ ID NO: 1204588 - RNA, 13 nt, Homo sapiens
ccaccaguucuca

SEQ ID NO: 1204589 - RNA, 19 nt, Homo sapiens
ccaccauaugaauuguaca

SEQ ID NO: 1204590 - RNA, 19 nt, Homo sapiens
ccaccauuccugccuuuaa

SEQ ID NO: 1204591 - RNA, 12 nt, Homo sapiens
ccacccaaaaca

SEQ ID NO: 1204592 - RNA, 14 nt, Homo sapiens
ccacccaacccaaa

SEQ ID NO: 1204593 - RNA, 20 nt, Homo sapiens
ccaccccagaaauggugaaa

SEQ ID NO: 1204594 - RNA, 13 nt, Homo sapiens
ccaccccagcuca

SEQ ID NO: 1204595 - RNA, 16 nt, Homo sapiens
ccacccccagcucaau

SEQ ID NO: 1204596 - RNA, 17 nt, Homo sapiens
ccaccccuaaagagaua

SEQ ID NO: 1204597 - RNA, 21 nt, Homo sapiens
ccacccuagccaaugucuccu

SEQ ID NO: 1204598 - RNA, 17 nt, Homo sapiens
ccacccuccaugcuccu

SEQ ID NO: 1204599 - RNA, 16 nt, Homo sapiens
ccacccuccucaagaa

SEQ ID NO: 1204600 - RNA, 21 nt, Homo sapiens
ccaccgauggagcccccagau

SEQ ID NO: 1204601 - RNA, 13 nt, Homo sapiens
ccaccuaauauca

SEQ ID NO: 1204602 - RNA, 14 nt, Homo sapiens
ccaccucaccaaaa

SEQ ID NO: 1204603 - RNA, 19 nt, Homo sapiens
ccaccucuguggcauugaa

SEQ ID NO: 1204604 - RNA, 20 nt, Homo sapiens
ccaccugacaauggcagcua

SEQ ID NO: 1204605 - RNA, 16 nt, Homo sapiens
ccaccugacacaccag

SEQ ID NO: 1204606 - RNA, 22 nt, Homo sapiens
ccaccugccugcaucugugaaa

SEQ ID NO: 1204607 - RNA, 17 nt, Homo sapiens
ccaccugggcauaucca

SEQ ID NO: 1204608 - RNA, 14 nt, Homo sapiens
ccaccugucccacu

SEQ ID NO: 1204609 - RNA, 16 nt, Homo sapiens
ccaccuuccuccagac

SEQ ID NO: 1204610 - RNA, 16 nt, Homo sapiens
ccaccuugaccaaaau

SEQ ID NO: 1204611 - RNA, 21 nt, Homo sapiens
ccaccuugaucccaauccuua

SEQ ID NO: 1204612 - RNA, 16 nt, Homo sapiens
ccaccuuugccacaaa

SEQ ID NO: 1204613 - RNA, 13 nt, Homo sapiens
ccacgaauauucu

SEQ ID NO: 1204614 - RNA, 16 nt, Homo sapiens
ccacgaccuuugaaga

SEQ ID NO: 1204615 - RNA, 20 nt, Homo sapiens
ccacgagccugcuguuucca

SEQ ID NO: 1204616 - RNA, 21 nt, Homo sapiens
ccacgcagaggacgcacgcuc

SEQ ID NO: 1204617 - RNA, 20 nt, Homo sapiens
ccacgcauacacacaugccc

SEQ ID NO: 1204618 - RNA, 21 nt, Homo sapiens
ccacgcauacacacaugcccu

SEQ ID NO: 1204619 - RNA, 23 nt, Homo sapiens
ccacgcuagggcggggcacagau

SEQ ID NO: 1204620 - RNA, 22 nt, Homo sapiens
ccacguccagcuggaaggguca

SEQ ID NO: 1204621 - RNA, 19 nt, Homo sapiens
ccacgugggcaaacaggca

SEQ ID NO: 1204622 - RNA, 20 nt, Homo sapiens
ccacgugggcaaacaggcag

SEQ ID NO: 1204623 - RNA, 21 nt, Homo sapiens
ccacgugggcaaacaggcagu

SEQ ID NO: 1204624 - RNA, 19 nt, Homo sapiens
ccacguucucacacccacc

SEQ ID NO: 1204625 - RNA, 12 nt, Homo sapiens
ccacuaaacuac

SEQ ID NO: 1204626 - RNA, 17 nt, Homo sapiens
ccacuaacuccugagaa

SEQ ID NO: 1204627 - RNA, 18 nt, Homo sapiens
ccacuaucccaaucaaag

SEQ ID NO: 1204628 - RNA, 17 nt, Homo sapiens
ccacuauccuucgugaa

SEQ ID NO: 1204629 - RNA, 13 nt, Homo sapiens
ccacuaugccuga

SEQ ID NO: 1204630 - RNA, 15 nt, Homo sapiens
ccacucccuuugcca

SEQ ID NO: 1204631 - RNA, 24 nt, Homo sapiens
ccacucuuguggucaucauggcca

SEQ ID NO: 1204632 - RNA, 21 nt, Homo sapiens
ccacugagaagugcacuuuaa

SEQ ID NO: 1204633 - RNA, 12 nt, Homo sapiens
ccacugauaucc

SEQ ID NO: 1204634 - RNA, 16 nt, Homo sapiens
ccacugccucagguuc

SEQ ID NO: 1204635 - RNA, 18 nt, Homo sapiens
ccacuggaaaaguguaau

SEQ ID NO: 1204636 - RNA, 20 nt, Homo sapiens
ccacuggcaaauguaacugu

SEQ ID NO: 1204637 - RNA, 22 nt, Homo sapiens
ccacuggcccagggccaccucu

SEQ ID NO: 1204638 - RNA, 12 nt, Homo sapiens
ccacugggaccc

SEQ ID NO: 1204639 - RNA, 13 nt, Homo sapiens
ccacuggggacuu

SEQ ID NO: 1204640 - RNA, 18 nt, Homo sapiens
ccacuggggcaagcuccu

SEQ ID NO: 1204641 - RNA, 19 nt, Homo sapiens
ccacuguggcacuggccac

SEQ ID NO: 1204642 - RNA, 19 nt, Homo sapiens
ccacuuaaaaaauguccau

SEQ ID NO: 1204643 - RNA, 14 nt, Homo sapiens
ccacuuaccucaaa

SEQ ID NO: 1204644 - RNA, 21 nt, Homo sapiens
ccacuuccuuuguguuuauau

SEQ ID NO: 1204645 - RNA, 21 nt, Homo sapiens
ccacuucuaugcaaaugccuc

SEQ ID NO: 1204646 - RNA, 19 nt, Homo sapiens
ccacuucuccccucaagaa

SEQ ID NO: 1204647 - RNA, 19 nt, Homo sapiens
ccacuuggucugugagaug

SEQ ID NO: 1204648 - RNA, 19 nt, Homo sapiens
ccagaaaaaaaaaaacuua

SEQ ID NO: 1204649 - RNA, 14 nt, Homo sapiens
ccagaaaagcaaua

SEQ ID NO: 1204650 - RNA, 20 nt, Homo sapiens
ccagaaaauaaagauaguua

SEQ ID NO: 1204651 - RNA, 21 nt, Homo sapiens
ccagaaaauaaagauaguuaa

SEQ ID NO: 1204652 - RNA, 13 nt, Homo sapiens
ccagaaacuuuaa

SEQ ID NO: 1204653 - RNA, 19 nt, Homo sapiens
ccagaaagcuaggucgugg

SEQ ID NO: 1204654 - RNA, 12 nt, Homo sapiens
ccagaaaugucu

SEQ ID NO: 1204655 - RNA, 22 nt, Homo sapiens
ccagaagaaaauucuccugaua

SEQ ID NO: 1204656 - RNA, 21 nt, Homo sapiens
ccagaagaauauucaggacuu

SEQ ID NO: 1204657 - RNA, 17 nt, Homo sapiens
ccagaagcuuccauagu

SEQ ID NO: 1204658 - RNA, 23 nt, Homo sapiens
ccagaagcuuccauaguggugca

SEQ ID NO: 1204659 - RNA, 16 nt, Homo sapiens
ccagaaggaaccagcc

SEQ ID NO: 1204660 - RNA, 17 nt, Homo sapiens
ccagaaggaaccagcca

SEQ ID NO: 1204661 - RNA, 22 nt, Homo sapiens
ccagaaggcagggaaaggcucu

SEQ ID NO: 1204662 - RNA, 18 nt, Homo sapiens
ccagaaguuacagaugag

SEQ ID NO: 1204663 - RNA, 12 nt, Homo sapiens
ccagaaugcugc

SEQ ID NO: 1204664 - RNA, 16 nt, Homo sapiens
ccagacacagacuggc

SEQ ID NO: 1204665 - RNA, 19 nt, Homo sapiens
ccagacacagacuggcaau

SEQ ID NO: 1204666 - RNA, 10 nt, Homo sapiens
ccagacagac

SEQ ID NO: 1204667 - RNA, 19 nt, Homo sapiens
ccagacauuuguuucugua

SEQ ID NO: 1204668 - RNA, 19 nt, Homo sapiens
ccagacccaccacaccgca

SEQ ID NO: 1204669 - RNA, 23 nt, Homo sapiens
ccagacccaguggacucuuccac

SEQ ID NO: 1204670 - RNA, 23 nt, Homo sapiens
ccagacucagcuggaagucuacc

SEQ ID NO: 1204671 - RNA, 24 nt, Homo sapiens
ccagagagcagcuucagugacaaa

SEQ ID NO: 1204672 - RNA, 15 nt, Homo sapiens
ccagagaguccugug

SEQ ID NO: 1204673 - RNA, 19 nt, Homo sapiens
ccagagaguccugugcuga

SEQ ID NO: 1204674 - RNA, 15 nt, Homo sapiens
ccagagaguggcucc

SEQ ID NO: 1204675 - RNA, 17 nt, Homo sapiens
ccagagaugcuggacuu

SEQ ID NO: 1204676 - RNA, 13 nt, Homo sapiens
ccagagcacuuua

SEQ ID NO: 1204677 - RNA, 15 nt, Homo sapiens
ccagagcagaugcag

SEQ ID NO: 1204678 - RNA, 17 nt, Homo sapiens
ccagagcagaugcagag

SEQ ID NO: 1204679 - RNA, 15 nt, Homo sapiens
ccagagcauuuccaa

SEQ ID NO: 1204680 - RNA, 21 nt, Homo sapiens
ccagagcauuuccaacaccac

SEQ ID NO: 1204681 - RNA, 22 nt, Homo sapiens
ccagagccagccagcauggcca

SEQ ID NO: 1204682 - RNA, 16 nt, Homo sapiens
ccagagcuacugacua

SEQ ID NO: 1204683 - RNA, 22 nt, Homo sapiens
ccagagcuggaaggcagggcag

SEQ ID NO: 1204684 - RNA, 23 nt, Homo sapiens
ccagaggcagccucugcacuccc

SEQ ID NO: 1204685 - RNA, 22 nt, Homo sapiens
ccagaggcaggcggagguugaa

SEQ ID NO: 1204686 - RNA, 15 nt, Homo sapiens
ccagaggcaguaacc

SEQ ID NO: 1204687 - RNA, 17 nt, Homo sapiens
ccagaggcucagcacuu

SEQ ID NO: 1204688 - RNA, 18 nt, Homo sapiens
ccagaggcucagcacuuu

SEQ ID NO: 1204689 - RNA, 22 nt, Homo sapiens
ccagaggugcccgcucuucccu

SEQ ID NO: 1204690 - RNA, 17 nt, Homo sapiens
ccagaguuuacauucua

SEQ ID NO: 1204691 - RNA, 23 nt, Homo sapiens
ccagauaaaauguucagugcaau

SEQ ID NO: 1204692 - RNA, 22 nt, Homo sapiens
ccagauacauggugaugguuag

SEQ ID NO: 1204693 - RNA, 12 nt, Homo sapiens
ccagauaccagc

SEQ ID NO: 1204694 - RNA, 14 nt, Homo sapiens
ccagaucacugcca

SEQ ID NO: 1204695 - RNA, 22 nt, Homo sapiens
ccagauccuucaaagagucaua

SEQ ID NO: 1204696 - RNA, 14 nt, Homo sapiens
caaacaaugugcug

SEQ ID NO: 1204697 - RNA, 20 nt, Homo sapiens
caaacagccccagucuuccu

SEQ ID NO: 1204698 - RNA, 17 nt, Homo sapiens
caaacaugcaguacuuu

SEQ ID NO: 1204699 - RNA, 11 nt, Homo sapiens
caaacauggcc

SEQ ID NO: 1204700 - RNA, 18 nt, Homo sapiens
caaacauuguguugacau

SEQ ID NO: 1204701 - RNA, 22 nt, Homo sapiens
caaaccaagucggaacagcaga

SEQ ID NO: 1204702 - RNA, 17 nt, Homo sapiens
caaaccaggauuuccuu

SEQ ID NO: 1204703 - RNA, 13 nt, Homo sapiens
caaacccauuccc

SEQ ID NO: 1204704 - RNA, 13 nt, Homo sapiens
caaaccucaagua

SEQ ID NO: 1204705 - RNA, 17 nt, Homo sapiens
caaaccuccacugcugc

SEQ ID NO: 1204706 - RNA, 12 nt, Homo sapiens
caaaccugugua

SEQ ID NO: 1204707 - RNA, 19 nt, Homo sapiens
caaaccuguguaggcauuu

SEQ ID NO: 1204708 - RNA, 17 nt, Homo sapiens
caaacgcccuuuccucc

SEQ ID NO: 1204709 - RNA, 13 nt, Homo sapiens
caaacuaaaggug

SEQ ID NO: 1204710 - RNA, 22 nt, Homo sapiens
caaacuaacaggaacaaaauga

SEQ ID NO: 1204711 - RNA, 19 nt, Homo sapiens
caaacuacaauuaaaacua

SEQ ID NO: 1204712 - RNA, 21 nt, Homo sapiens
caaacucacugcucaagaaga

SEQ ID NO: 1204713 - RNA, 15 nt, Homo sapiens
caaacuccugaccuc

SEQ ID NO: 1204714 - RNA, 18 nt, Homo sapiens
caaacucuaaaauuauaa

SEQ ID NO: 1204715 - RNA, 17 nt, Homo sapiens
caaacucuacuauccaa

SEQ ID NO: 1204716 - RNA, 15 nt, Homo sapiens
caaacugaggaauuu

SEQ ID NO: 1204717 - RNA, 23 nt, Homo sapiens
caaacugcuuuuuccaacucaga

SEQ ID NO: 1204718 - RNA, 22 nt, Homo sapiens
caaacuggcugcuuuguucaau

SEQ ID NO: 1204719 - RNA, 14 nt, Homo sapiens
caaacuuacuauuu

SEQ ID NO: 1204720 - RNA, 16 nt, Homo sapiens
caaacuugcaguuuaa

SEQ ID NO: 1204721 - RNA, 19 nt, Homo sapiens
ccaaagagggcuuccucua

SEQ ID NO: 1204722 - RNA, 15 nt, Homo sapiens
ccaaagcaaugugag

SEQ ID NO: 1204723 - RNA, 15 nt, Homo sapiens
ccaaagcauggacua

SEQ ID NO: 1204724 - RNA, 15 nt, Homo sapiens
ccaaagccagaccag

SEQ ID NO: 1204725 - RNA, 18 nt, Homo sapiens
ccaaagcuguugaaguca

SEQ ID NO: 1204726 - RNA, 15 nt, Homo sapiens
ccaaaggaagacgug

SEQ ID NO: 1204727 - RNA, 19 nt, Homo sapiens
ccaaaggaauaaccuuucu

SEQ ID NO: 1204728 - RNA, 14 nt, Homo sapiens
ccaaaggacauuau

SEQ ID NO: 1204729 - RNA, 23 nt, Homo sapiens
ccaaaggauagugcgauguuuca

SEQ ID NO: 1204730 - RNA, 22 nt, Homo sapiens
ccaaaggggcugcuggggcaug

SEQ ID NO: 1204731 - RNA, 18 nt, Homo sapiens
ccaaaggucauccuuaau

SEQ ID NO: 1204732 - RNA, 14 nt, Homo sapiens
ccaaaguaaauguc

SEQ ID NO: 1204733 - RNA, 15 nt, Homo sapiens
ccaaaguaacugaau

SEQ ID NO: 1204734 - RNA, 20 nt, Homo sapiens
ccaaagugccacucauuccu

SEQ ID NO: 1204735 - RNA, 23 nt, Homo sapiens
ccaaauaaacucuaaacauuaau

SEQ ID NO: 1204736 - RNA, 14 nt, Homo sapiens
ccaaauaccaugua

SEQ ID NO: 1204737 - RNA, 16 nt, Homo sapiens
ccaaaugaaacucaaa

SEQ ID NO: 1204738 - RNA, 11 nt, Homo sapiens
ccaaaugaugc

SEQ ID NO: 1204739 - RNA, 14 nt, Homo sapiens
ccaaaugcagggag

SEQ ID NO: 1204740 - RNA, 15 nt, Homo sapiens
ccaaaugcagggagg

SEQ ID NO: 1204741 - RNA, 12 nt, Homo sapiens
ccaaauguucau

SEQ ID NO: 1204742 - RNA, 20 nt, Homo sapiens
ccaacacaaggcuccaagac

SEQ ID NO: 1204743 - RNA, 12 nt, Homo sapiens
ccaacaccacag

SEQ ID NO: 1204744 - RNA, 21 nt, Homo sapiens
ccaacaccugccuccacuucu

SEQ ID NO: 1204745 - RNA, 22 nt, Homo sapiens
ccaacagaggggcagccaggac

SEQ ID NO: 1204746 - RNA, 20 nt, Homo sapiens
ccaacauaugcccucagaaa

SEQ ID NO: 1204747 - RNA, 15 nt, Homo sapiens
ccaacccacuggccc

SEQ ID NO: 1204748 - RNA, 22 nt, Homo sapiens
ccaacccgucuggcccaccagg

SEQ ID NO: 1204749 - RNA, 19 nt, Homo sapiens
ccaacccuaucuccugaca

SEQ ID NO: 1204750 - RNA, 10 nt, Homo sapiens
ccaaccucag

SEQ ID NO: 1204751 - RNA, 16 nt, Homo sapiens
ccaaccucagaggcag

SEQ ID NO: 1204752 - RNA, 13 nt, Homo sapiens
ccaacgcacagga

SEQ ID NO: 1204753 - RNA, 21 nt, Homo sapiens
ccaacuaaugccuuacucuuc

SEQ ID NO: 1204754 - RNA, 12 nt, Homo sapiens
ccaacuaggcag

SEQ ID NO: 1204755 - RNA, 16 nt, Homo sapiens
ccaacuauaauuauaa

SEQ ID NO: 1204756 - RNA, 15 nt, Homo sapiens
ccaacucaagguucu

SEQ ID NO: 1204757 - RNA, 12 nt, Homo sapiens
ccaacuccucac

SEQ ID NO: 1204758 - RNA, 21 nt, Homo sapiens
ccaacucuaacaggcacuuug

SEQ ID NO: 1204759 - RNA, 22 nt, Homo sapiens
ccaacucuaacaggcacuuuga

SEQ ID NO: 1204760 - RNA, 16 nt, Homo sapiens
ccaacugcuaaugcaa

SEQ ID NO: 1204761 - RNA, 23 nt, Homo sapiens
ccaacugcuguucauguuacuca

SEQ ID NO: 1204762 - RNA, 19 nt, Homo sapiens
ccaacuguauauauuccca

SEQ ID NO: 1204763 - RNA, 22 nt, Homo sapiens
ccaacuugagggcccagagcag

SEQ ID NO: 1204764 - RNA, 22 nt, Homo sapiens
ccaacuugguucugcuucaaua

SEQ ID NO: 1204765 - RNA, 22 nt, Homo sapiens
ccaacuuuguggaugucuuccu

SEQ ID NO: 1204766 - RNA, 16 nt, Homo sapiens
ccaacuuuguuuucca

SEQ ID NO: 1204767 - RNA, 19 nt, Homo sapiens
ccaagaauccacauuucua

SEQ ID NO: 1204768 - RNA, 20 nt, Homo sapiens
ccaagaccaaccuacaauuu

SEQ ID NO: 1204769 - RNA, 13 nt, Homo sapiens
ccaagacccugug

SEQ ID NO: 1204770 - RNA, 20 nt, Homo sapiens
ccaagacucugaaaucucag

SEQ ID NO: 1204771 - RNA, 22 nt, Homo sapiens
ccaagagaaaggccugcacaca

SEQ ID NO: 1204772 - RNA, 21 nt, Homo sapiens
ccaagagagggccaugcaauu

SEQ ID NO: 1204773 - RNA, 15 nt, Homo sapiens
ccaagaguaacuuua

SEQ ID NO: 1204774 - RNA, 16 nt, Homo sapiens
ccaagagucuaaagau

SEQ ID NO: 1204775 - RNA, 16 nt, Homo sapiens
ccaagauacucuuugu

SEQ ID NO: 1204776 - RNA, 23 nt, Homo sapiens
ccaagcaaccuggguccaaauaa

SEQ ID NO: 1204777 - RNA, 13 nt, Homo sapiens
ccaagcacuucac

SEQ ID NO: 1204778 - RNA, 17 nt, Homo sapiens
ccaagccauucacuucc

SEQ ID NO: 1204779 - RNA, 15 nt, Homo sapiens
ccaagcccugcauug

SEQ ID NO: 1204780 - RNA, 13 nt, Homo sapiens
ccaagccugacca

SEQ ID NO: 1204781 - RNA, 22 nt, Homo sapiens
ccaagccugggcuugagcugca

SEQ ID NO: 1204782 - RNA, 14 nt, Homo sapiens
ccaagcgagagcag

SEQ ID NO: 1204783 - RNA, 15 nt, Homo sapiens
ccaaggaugcuguca

SEQ ID NO: 1204784 - RNA, 22 nt, Homo sapiens
ccaagggacccuuugccuuucu

SEQ ID NO: 1204785 - RNA, 19 nt, Homo sapiens
ccaagguuuuggagucagu

SEQ ID NO: 1204786 - RNA, 11 nt, Homo sapiens
ccaagugugaa

SEQ ID NO: 1204787 - RNA, 15 nt, Homo sapiens
ccaagugugaacaaa

SEQ ID NO: 1204788 - RNA, 16 nt, Homo sapiens
ccaagugugaccccac

SEQ ID NO: 1204789 - RNA, 20 nt, Homo sapiens
ccaaguucuucaccucuauc

SEQ ID NO: 1204790 - RNA, 15 nt, Homo sapiens
ccaauaaaccuguaa

SEQ ID NO: 1204791 - RNA, 14 nt, Homo sapiens
ccaauacagucuag

SEQ ID NO: 1204792 - RNA, 20 nt, Homo sapiens
ccaauacuagucaccccaag

SEQ ID NO: 1204793 - RNA, 20 nt, Homo sapiens
ccaauagcacuuucauugcc

SEQ ID NO: 1204794 - RNA, 17 nt, Homo sapiens
ccaauaggcauuugauu

SEQ ID NO: 1204795 - RNA, 15 nt, Homo sapiens
ccaaucaguuuauac

SEQ ID NO: 1204796 - RNA, 19 nt, Homo sapiens
ccaaucuacuuuguugcua

SEQ ID NO: 1204797 - RNA, 20 nt, Homo sapiens
ccaaugcugcuccacccucc

SEQ ID NO: 1204798 - RNA, 22 nt, Homo sapiens
ccaaugggaugaggucacuuuu

SEQ ID NO: 1204799 - RNA, 20 nt, Homo sapiens
ccaauuacagggugacucac

SEQ ID NO: 1204800 - RNA, 22 nt, Homo sapiens
ccaauuauuguuacacauuaag

SEQ ID NO: 1204801 - RNA, 19 nt, Homo sapiens
ccaauucaauuacuauuga

SEQ ID NO: 1204802 - RNA, 17 nt, Homo sapiens
ccaauuccaaagccaga

SEQ ID NO: 1204803 - RNA, 16 nt, Homo sapiens
ccaauuccuugcacau

SEQ ID NO: 1204804 - RNA, 22 nt, Homo sapiens
ccaauucuaacagcaaauaaca

SEQ ID NO: 1204805 - RNA, 23 nt, Homo sapiens
ccaauucugucccaaucuuacca

SEQ ID NO: 1204806 - RNA, 12 nt, Homo sapiens
ccaauugaugua

SEQ ID NO: 1204807 - RNA, 14 nt, Homo sapiens
ccacaaacagcaga

SEQ ID NO: 1204808 - RNA, 19 nt, Homo sapiens
ccacaaacuccauccagau

SEQ ID NO: 1204809 - RNA, 14 nt, Homo sapiens
ccacaaccaaaaaa

SEQ ID NO: 1204810 - RNA, 13 nt, Homo sapiens
ccacaacugacac

SEQ ID NO: 1204811 - RNA, 19 nt, Homo sapiens
ccacaacugacacaggaaa

SEQ ID NO: 1204812 - RNA, 15 nt, Homo sapiens
ccacaagcaccugcu

SEQ ID NO: 1204813 - RNA, 19 nt, Homo sapiens
ccacaagccaggaccugcu

SEQ ID NO: 1204814 - RNA, 16 nt, Homo sapiens
ccacaauauuaccuua

SEQ ID NO: 1204815 - RNA, 20 nt, Homo sapiens
ccacaauccuccuggggaga

SEQ ID NO: 1204816 - RNA, 21 nt, Homo sapiens
ccacaaucuggcuuagugcca

SEQ ID NO: 1204817 - RNA, 20 nt, Homo sapiens
ccacaauucacuagaccaga

SEQ ID NO: 1204818 - RNA, 14 nt, Homo sapiens
ccacacauauugca

SEQ ID NO: 1204819 - RNA, 12 nt, Homo sapiens
ccacaccacagc

SEQ ID NO: 1204820 - RNA, 13 nt, Homo sapiens
ccacaccaucucc

SEQ ID NO: 1204821 - RNA, 16 nt, Homo sapiens
ccacacccaaugcugc

SEQ ID NO: 1204822 - RNA, 15 nt, Homo sapiens
ccacacccacuuugu

SEQ ID NO: 1204823 - RNA, 15 nt, Homo sapiens
ccacaccgcagggac

SEQ ID NO: 1204824 - RNA, 18 nt, Homo sapiens
ccacaccguuguuuaggg

SEQ ID NO: 1204825 - RNA, 11 nt, Homo sapiens
ccacaccucag

SEQ ID NO: 1204826 - RNA, 15 nt, Homo sapiens
ccacacucuccauca

SEQ ID NO: 1204827 - RNA, 19 nt, Homo sapiens
ccacacugaaaccaaaaca

SEQ ID NO: 1204828 - RNA, 15 nt, Homo sapiens
ccacagagugcugga

SEQ ID NO: 1204829 - RNA, 20 nt, Homo sapiens
ccacagccaaacuaggacac

SEQ ID NO: 1204830 - RNA, 19 nt, Homo sapiens
ccacagccacuaagauaaa

SEQ ID NO: 1204831 - RNA, 18 nt, Homo sapiens
ccacagccaggccgagag

SEQ ID NO: 1204832 - RNA, 22 nt, Homo sapiens
ccacagcuuuuacguaguaaaa

SEQ ID NO: 1204833 - RNA, 16 nt, Homo sapiens
ccacaggcucugacca

SEQ ID NO: 1204834 - RNA, 14 nt, Homo sapiens
ccacagguuuuagc

SEQ ID NO: 1204835 - RNA, 16 nt, Homo sapiens
ccacaguaauugguca

SEQ ID NO: 1204836 - RNA, 12 nt, Homo sapiens
ccacaguaggca

SEQ ID NO: 1204837 - RNA, 14 nt, Homo sapiens
ccacaguggcuuca

SEQ ID NO: 1204838 - RNA, 15 nt, Homo sapiens
ccacaguguggggca

SEQ ID NO: 1204839 - RNA, 17 nt, Homo sapiens
ccacaguucaguggcag

SEQ ID NO: 1204840 - RNA, 22 nt, Homo sapiens
ccacaguucaguggcagggcuc

SEQ ID NO: 1204841 - RNA, 22 nt, Homo sapiens
ccacaguuuuaguuggugcuga

SEQ ID NO: 1204842 - RNA, 18 nt, Homo sapiens
ccacauacugcggaccaa

SEQ ID NO: 1204843 - RNA, 14 nt, Homo sapiens
ccacauauagagcu

SEQ ID NO: 1204844 - RNA, 16 nt, Homo sapiens
cuauguccauucucau

SEQ ID NO: 1204845 - RNA, 21 nt, Homo sapiens
cuaugugcacugauauggguu

SEQ ID NO: 1204846 - RNA, 13 nt, Homo sapiens
cuaugugccccag

SEQ ID NO: 1204847 - RNA, 13 nt, Homo sapiens
cuauguucuuagu

SEQ ID NO: 1204848 - RNA, 19 nt, Homo sapiens
cuauguugcccaggcaggu

SEQ ID NO: 1204849 - RNA, 17 nt, Homo sapiens
cuauguugugguccauc

SEQ ID NO: 1204850 - RNA, 14 nt, Homo sapiens
cuauuaaaauugcc

SEQ ID NO: 1204851 - RNA, 18 nt, Homo sapiens
cuauuaagauacuuagau

SEQ ID NO: 1204852 - RNA, 16 nt, Homo sapiens
cuauuacaccaaauaa

SEQ ID NO: 1204853 - RNA, 13 nt, Homo sapiens
cuauuagacugua

SEQ ID NO: 1204854 - RNA, 16 nt, Homo sapiens
cuauuagagcauugaa

SEQ ID NO: 1204855 - RNA, 18 nt, Homo sapiens
cuauuaggaaauucugau

SEQ ID NO: 1204856 - RNA, 23 nt, Homo sapiens
cuauuaggugcaauuucaagguu

SEQ ID NO: 1204857 - RNA, 21 nt, Homo sapiens
cuauuauaaaaccauguugau

SEQ ID NO: 1204858 - RNA, 12 nt, Homo sapiens
cuauuaucucaa

SEQ ID NO: 1204859 - RNA, 14 nt, Homo sapiens
cuauuccaaaaagg

SEQ ID NO: 1204860 - RNA, 22 nt, Homo sapiens
cuauuccauggcuaacuggcga

SEQ ID NO: 1204861 - RNA, 19 nt, Homo sapiens
cuauucccuggggcugcug

SEQ ID NO: 1204862 - RNA, 23 nt, Homo sapiens
cuauucccugucacuacacacua

SEQ ID NO: 1204863 - RNA, 17 nt, Homo sapiens
cuauucuaaguaauucc

SEQ ID NO: 1204864 - RNA, 18 nt, Homo sapiens
cuauugcugcucucucac

SEQ ID NO: 1204865 - RNA, 20 nt, Homo sapiens
cuauuguauuauuuggaguu

SEQ ID NO: 1204866 - RNA, 21 nt, Homo sapiens
cuauuuaauuauuucacuuua

SEQ ID NO: 1204867 - RNA, 18 nt, Homo sapiens
cuauuuaucugaucaaga

SEQ ID NO: 1204868 - RNA, 17 nt, Homo sapiens
cuauuucugcugugauu

SEQ ID NO: 1204869 - RNA, 20 nt, Homo sapiens
cuauuugagauugaugacaa

SEQ ID NO: 1204870 - RNA, 14 nt, Homo sapiens
cuauuuuacuuugu

SEQ ID NO: 1204871 - RNA, 17 nt, Homo sapiens
cucaaaaauaaugcaua

SEQ ID NO: 1204872 - RNA, 21 nt, Homo sapiens
cucaaaagaaaaaaaaaagca

SEQ ID NO: 1204873 - RNA, 12 nt, Homo sapiens
cucaaaauggaa

SEQ ID NO: 1204874 - RNA, 20 nt, Homo sapiens
cucaaacuccugaccucagg

SEQ ID NO: 1204875 - RNA, 20 nt, Homo sapiens
cucaaacucuugaccucagg

SEQ ID NO: 1204876 - RNA, 15 nt, Homo sapiens
cucaaaggagucagg

SEQ ID NO: 1204877 - RNA, 17 nt, Homo sapiens
cucaaaguacugggauu

SEQ ID NO: 1204878 - RNA, 18 nt, Homo sapiens
cucaaaguacugggauua

SEQ ID NO: 1204879 - RNA, 18 nt, Homo sapiens
cucaaagugacuauucag

SEQ ID NO: 1204880 - RNA, 14 nt, Homo sapiens
cucaaaucuauuca

SEQ ID NO: 1204881 - RNA, 22 nt, Homo sapiens
cucaacaagggagagaccucau

SEQ ID NO: 1204882 - RNA, 19 nt, Homo sapiens
cucaacaagugcuccugaa

SEQ ID NO: 1204883 - RNA, 20 nt, Homo sapiens
cucaacauugcauggugcua

SEQ ID NO: 1204884 - RNA, 21 nt, Homo sapiens
cucaaccuccuguggaaccca

SEQ ID NO: 1204885 - RNA, 18 nt, Homo sapiens
cucaacugggugacaagg

SEQ ID NO: 1204886 - RNA, 16 nt, Homo sapiens
cucaagaagugaagaa

SEQ ID NO: 1204887 - RNA, 16 nt, Homo sapiens
cucaagacaaugcacc

SEQ ID NO: 1204888 - RNA, 13 nt, Homo sapiens
cucaagacucacc

SEQ ID NO: 1204889 - RNA, 22 nt, Homo sapiens
cucaagaggcgagaugagccca

SEQ ID NO: 1204890 - RNA, 14 nt, Homo sapiens
cucaagaguacaga

SEQ ID NO: 1204891 - RNA, 15 nt, Homo sapiens
cucaagauucaguag

SEQ ID NO: 1204892 - RNA, 12 nt, Homo sapiens
cucaagcacuga

SEQ ID NO: 1204893 - RNA, 19 nt, Homo sapiens
cucaaguuuuuguuuugua

SEQ ID NO: 1204894 - RNA, 15 nt, Homo sapiens
cucaauauuccugaa

SEQ ID NO: 1204895 - RNA, 12 nt, Homo sapiens
cucaaucaugaa

SEQ ID NO: 1204896 - RNA, 22 nt, Homo sapiens
cucaaugcaguuagcugaagaa

SEQ ID NO: 1204897 - RNA, 11 nt, Homo sapiens
cucaauggagu

SEQ ID NO: 1204898 - RNA, 14 nt, Homo sapiens
cucaauucacauag

SEQ ID NO: 1204899 - RNA, 23 nt, Homo sapiens
cucaauuuaguuuguuauuuauc

SEQ ID NO: 1204900 - RNA, 21 nt, Homo sapiens
cucaauuuugucuguacucau

SEQ ID NO: 1204901 - RNA, 18 nt, Homo sapiens
cucacaaaccaugcaaau

SEQ ID NO: 1204902 - RNA, 18 nt, Homo sapiens
cucacaaaguccacuuua

SEQ ID NO: 1204903 - RNA, 15 nt, Homo sapiens
cucacaagcaugaag

SEQ ID NO: 1204904 - RNA, 23 nt, Homo sapiens
cucacaaugucccuucagcaccu

SEQ ID NO: 1204905 - RNA, 14 nt, Homo sapiens
cucacacacauaga

SEQ ID NO: 1204906 - RNA, 15 nt, Homo sapiens
cucacaccugcaauc

SEQ ID NO: 1204907 - RNA, 19 nt, Homo sapiens
cucacagagugcauuguga

SEQ ID NO: 1204908 - RNA, 21 nt, Homo sapiens
cucacagagugcauugugagg

SEQ ID NO: 1204909 - RNA, 13 nt, Homo sapiens
cucacagugacau

SEQ ID NO: 1204910 - RNA, 17 nt, Homo sapiens
cucacauaucugucauu

SEQ ID NO: 1204911 - RNA, 16 nt, Homo sapiens
cucacaugcacagggg

SEQ ID NO: 1204912 - RNA, 20 nt, Homo sapiens
cucaccagccccacugccag

SEQ ID NO: 1204913 - RNA, 23 nt, Homo sapiens
cucacccccagcuuugcuaccaa

SEQ ID NO: 1204914 - RNA, 16 nt, Homo sapiens
cucaccccuccaagcu

SEQ ID NO: 1204915 - RNA, 18 nt, Homo sapiens
cucaccgugcugucuucu

SEQ ID NO: 1204916 - RNA, 19 nt, Homo sapiens
cucaccugucaucucacau

SEQ ID NO: 1204917 - RNA, 14 nt, Homo sapiens
cucacgccuguaau

SEQ ID NO: 1204918 - RNA, 22 nt, Homo sapiens
cucacucugggcuguaacgugg

SEQ ID NO: 1204919 - RNA, 12 nt, Homo sapiens
cucacucuguca

SEQ ID NO: 1204920 - RNA, 15 nt, Homo sapiens
cucacucuguuuccu

SEQ ID NO: 1204921 - RNA, 15 nt, Homo sapiens
cucacugaaacaugg

SEQ ID NO: 1204922 - RNA, 21 nt, Homo sapiens
cucacugcugcaaauacugua

SEQ ID NO: 1204923 - RNA, 22 nt, Homo sapiens
cucacugcugcaaauacuguau

SEQ ID NO: 1204924 - RNA, 21 nt, Homo sapiens
cucacuggaugaaauaacucc

SEQ ID NO: 1204925 - RNA, 14 nt, Homo sapiens
cucacuguauccag

SEQ ID NO: 1204926 - RNA, 14 nt, Homo sapiens
cucacuguucugca

SEQ ID NO: 1204927 - RNA, 17 nt, Homo sapiens
cucacuguugaauuuuc

SEQ ID NO: 1204928 - RNA, 15 nt, Homo sapiens
cucacuucaaugugu

SEQ ID NO: 1204929 - RNA, 18 nt, Homo sapiens
cucacuugugcaguguug

SEQ ID NO: 1204930 - RNA, 11 nt, Homo sapiens
cucacuuuaaa

SEQ ID NO: 1204931 - RNA, 21 nt, Homo sapiens
cucacuuugaagagugugagg

SEQ ID NO: 1204932 - RNA, 23 nt, Homo sapiens
cucacuuuucccagggcaugcug

SEQ ID NO: 1204933 - RNA, 20 nt, Homo sapiens
cuuccugaguggugccaaac

SEQ ID NO: 1204934 - RNA, 13 nt, Homo sapiens
cuuccuggccccu

SEQ ID NO: 1204935 - RNA, 14 nt, Homo sapiens
cuuccuggguccug

SEQ ID NO: 1204936 - RNA, 15 nt, Homo sapiens
cuuccuguacuugaa

SEQ ID NO: 1204937 - RNA, 14 nt, Homo sapiens
cuuccugugaucca

SEQ ID NO: 1204938 - RNA, 22 nt, Homo sapiens
cuuccuguguguccaaaacugc

SEQ ID NO: 1204939 - RNA, 22 nt, Homo sapiens
cuuccuuccacucccuuugcca

SEQ ID NO: 1204940 - RNA, 13 nt, Homo sapiens
cuuccuugucucu

SEQ ID NO: 1204941 - RNA, 20 nt, Homo sapiens
cuuccuuuaaagaugaacuc

SEQ ID NO: 1204942 - RNA, 23 nt, Homo sapiens
cuucgauacaccgggccuggaga

SEQ ID NO: 1204943 - RNA, 19 nt, Homo sapiens
cuucggggcgaugcucccu

SEQ ID NO: 1204944 - RNA, 15 nt, Homo sapiens
cuucuaacacaaaau

SEQ ID NO: 1204945 - RNA, 16 nt, Homo sapiens
cuucuacugcuaucua

SEQ ID NO: 1204946 - RNA, 18 nt, Homo sapiens
cuucuagaagauaacauu

SEQ ID NO: 1204947 - RNA, 18 nt, Homo sapiens
cuucuagcgucagugcug

SEQ ID NO: 1204948 - RNA, 21 nt, Homo sapiens
cuucuaggucacuucucacaa

SEQ ID NO: 1204949 - RNA, 22 nt, Homo sapiens
cuucuauaccgcuucgacugga

SEQ ID NO: 1204950 - RNA, 16 nt, Homo sapiens
cuucucacaucugucc

SEQ ID NO: 1204951 - RNA, 16 nt, Homo sapiens
cuucucaucuugugaa

SEQ ID NO: 1204952 - RNA, 15 nt, Homo sapiens
cuucuccaaaugaga

SEQ ID NO: 1204953 - RNA, 14 nt, Homo sapiens
cuucuccaccaaag

SEQ ID NO: 1204954 - RNA, 21 nt, Homo sapiens
cuucuccagccuggaccccca

SEQ ID NO: 1204955 - RNA, 21 nt, Homo sapiens
cuucuccucccagcgugugua

SEQ ID NO: 1204956 - RNA, 18 nt, Homo sapiens
cuucuccuuccccaggau

SEQ ID NO: 1204957 - RNA, 16 nt, Homo sapiens
cuucucguuaaggaga

SEQ ID NO: 1204958 - RNA, 20 nt, Homo sapiens
cuucucugcaguaaaacaca

SEQ ID NO: 1204959 - RNA, 23 nt, Homo sapiens
cuucucuucccugcgccugugau

SEQ ID NO: 1204960 - RNA, 24 nt, Homo sapiens
cuucugaaacuggaguaucauucu

SEQ ID NO: 1204961 - RNA, 14 nt, Homo sapiens
cuucugcacacaaa

SEQ ID NO: 1204962 - RNA, 19 nt, Homo sapiens
cuucugcauuccuguaacu

SEQ ID NO: 1204963 - RNA, 15 nt, Homo sapiens
cuucugggaccauaa

SEQ ID NO: 1204964 - RNA, 15 nt, Homo sapiens
cuucugggacugugc

SEQ ID NO: 1204965 - RNA, 23 nt, Homo sapiens
cuucuggggcaggcugggccaug

SEQ ID NO: 1204966 - RNA, 19 nt, Homo sapiens
cuucuggggguagaucuca

SEQ ID NO: 1204967 - RNA, 20 nt, Homo sapiens
cuucuggggguagaucucaa

SEQ ID NO: 1204968 - RNA, 15 nt, Homo sapiens
cuucuguccuacucu

SEQ ID NO: 1204969 - RNA, 15 nt, Homo sapiens
cuucugugugaccau

SEQ ID NO: 1204970 - RNA, 12 nt, Homo sapiens
cuucuguguuca

SEQ ID NO: 1204971 - RNA, 14 nt, Homo sapiens
cuucuuacuauuaa

SEQ ID NO: 1204972 - RNA, 16 nt, Homo sapiens
cuucuuacuggugcua

SEQ ID NO: 1204973 - RNA, 15 nt, Homo sapiens
cuucuuccugcugga

SEQ ID NO: 1204974 - RNA, 16 nt, Homo sapiens
cuucuuguacuacaca

SEQ ID NO: 1204975 - RNA, 11 nt, Homo sapiens
cuucuugucag

SEQ ID NO: 1204976 - RNA, 17 nt, Homo sapiens
cuucuugucagacauaa

SEQ ID NO: 1204977 - RNA, 13 nt, Homo sapiens
cuucuuguucccc

SEQ ID NO: 1204978 - RNA, 18 nt, Homo sapiens
cuucuuuagaacagggaa

SEQ ID NO: 1204979 - RNA, 19 nt, Homo sapiens
cuucuuugauaauguuaaa

SEQ ID NO: 1204980 - RNA, 21 nt, Homo sapiens
cuucuuuugaacaaaugacau

SEQ ID NO: 1204981 - RNA, 19 nt, Homo sapiens
cuugaaaagaagcaaggaa

SEQ ID NO: 1204982 - RNA, 21 nt, Homo sapiens
cuugaaacagauucaggccag

SEQ ID NO: 1204983 - RNA, 13 nt, Homo sapiens
cuugaaacauaga

SEQ ID NO: 1204984 - RNA, 20 nt, Homo sapiens
cuugaaauuaagaaggcaaa

SEQ ID NO: 1204985 - RNA, 16 nt, Homo sapiens
cuugaaauuacugugu

SEQ ID NO: 1204986 - RNA, 21 nt, Homo sapiens
cuugaaauucucaucagucca

SEQ ID NO: 1204987 - RNA, 22 nt, Homo sapiens
cuugaagaaccucucacuucac

SEQ ID NO: 1204988 - RNA, 13 nt, Homo sapiens
cuugaagcacaga

SEQ ID NO: 1204989 - RNA, 15 nt, Homo sapiens
cuugaagccaaagaa

SEQ ID NO: 1204990 - RNA, 15 nt, Homo sapiens
cuugaaugugucacu

SEQ ID NO: 1204991 - RNA, 22 nt, Homo sapiens
cuugacaacuguggacuccagu

SEQ ID NO: 1204992 - RNA, 23 nt, Homo sapiens
cuugacaccaaccagacagcaca

SEQ ID NO: 1204993 - RNA, 14 nt, Homo sapiens
cuugacagggcaca

SEQ ID NO: 1204994 - RNA, 18 nt, Homo sapiens
cuugacccccuugagggu

SEQ ID NO: 1204995 - RNA, 17 nt, Homo sapiens
cuugaccguacucucac

SEQ ID NO: 1204996 - RNA, 17 nt, Homo sapiens
cuugagaaggugcuuug

SEQ ID NO: 1204997 - RNA, 15 nt, Homo sapiens
cuugagcaaauuacc

SEQ ID NO: 1204998 - RNA, 16 nt, Homo sapiens
cuuguauaguguaaaa

SEQ ID NO: 1204999 - RNA, 19 nt, Homo sapiens
cuugucacugacacaaagg

SEQ ID NO: 1205000 - RNA, 21 nt, Homo sapiens
cuugucagacauaaagccaug

SEQ ID NO: 1205001 - RNA, 20 nt, Homo sapiens
cuuguccacgucuuuucuca

SEQ ID NO: 1205002 - RNA, 16 nt, Homo sapiens
cuugucccuuucccua

SEQ ID NO: 1205003 - RNA, 23 nt, Homo sapiens
cuuguccgcugggugguacccuc

SEQ ID NO: 1205004 - RNA, 16 nt, Homo sapiens
cuugucugucuaguua

SEQ ID NO: 1205005 - RNA, 14 nt, Homo sapiens
cuugugaacugcug

SEQ ID NO: 1205006 - RNA, 17 nt, Homo sapiens
cuugugaaguggaaaug

SEQ ID NO: 1205007 - RNA, 16 nt, Homo sapiens
cuugugccauagucac

SEQ ID NO: 1205008 - RNA, 14 nt, Homo sapiens
cuugugcucaagga

SEQ ID NO: 1205009 - RNA, 18 nt, Homo sapiens
cuuguggguccaugcuaa

SEQ ID NO: 1205010 - RNA, 14 nt, Homo sapiens
cuugugguguaaag

SEQ ID NO: 1205011 - RNA, 19 nt, Homo sapiens
cuugugucaagacauuucu

SEQ ID NO: 1205012 - RNA, 13 nt, Homo sapiens
cuugugugugaug

SEQ ID NO: 1205013 - RNA, 18 nt, Homo sapiens
cuugugugugggcuguga

SEQ ID NO: 1205014 - RNA, 23 nt, Homo sapiens
cuuguguguguguguugauccca

SEQ ID NO: 1205015 - RNA, 19 nt, Homo sapiens
cuuguguuauuuaaugagu

SEQ ID NO: 1205016 - RNA, 15 nt, Homo sapiens
cuuguguucugagua

SEQ ID NO: 1205017 - RNA, 15 nt, Homo sapiens
cuuguuaucagcuuu

SEQ ID NO: 1205018 - RNA, 22 nt, Homo sapiens
cuuguuauucgaaccacugaga

SEQ ID NO: 1205019 - RNA, 23 nt, Homo sapiens
cuuguuccccacugacagccucc

SEQ ID NO: 1205020 - RNA, 12 nt, Homo sapiens
cuuguugugaca

SEQ ID NO: 1205021 - RNA, 23 nt, Homo sapiens
cuuguuucacacuagucacauuc

SEQ ID NO: 1205022 - RNA, 22 nt, Homo sapiens
cuuguuucccagauuucaggaa

SEQ ID NO: 1205023 - RNA, 14 nt, Homo sapiens
cuuguuucuccugc

SEQ ID NO: 1205024 - RNA, 20 nt, Homo sapiens
cuuguuugguaguuagccau

SEQ ID NO: 1205025 - RNA, 18 nt, Homo sapiens
cuuguuuuacccuauaca

SEQ ID NO: 1205026 - RNA, 13 nt, Homo sapiens
cuuguuuuggaca

SEQ ID NO: 1205027 - RNA, 19 nt, Homo sapiens
cuuuaaaaacuguuuuaga

SEQ ID NO: 1205028 - RNA, 15 nt, Homo sapiens
cuuuaaaaagauauu

SEQ ID NO: 1205029 - RNA, 14 nt, Homo sapiens
cuuuaaaaugccaa

SEQ ID NO: 1205030 - RNA, 23 nt, Homo sapiens
cuuuaaaauuuguccuacauucg

SEQ ID NO: 1205031 - RNA, 15 nt, Homo sapiens
cuuuaaagauguaau

SEQ ID NO: 1205032 - RNA, 21 nt, Homo sapiens
cuuuaaaguuacuauucugua

SEQ ID NO: 1205033 - RNA, 15 nt, Homo sapiens
cuuuaagcaacacag

SEQ ID NO: 1205034 - RNA, 13 nt, Homo sapiens
cuuuaagccucag

SEQ ID NO: 1205035 - RNA, 22 nt, Homo sapiens
cuuuaagccuucaaaacuauag

SEQ ID NO: 1205036 - RNA, 19 nt, Homo sapiens
cuuuaagggcaugccuugu

SEQ ID NO: 1205037 - RNA, 21 nt, Homo sapiens
cuuuaagggcaugccuugugc

SEQ ID NO: 1205038 - RNA, 14 nt, Homo sapiens
cuuuaauaacaaua

SEQ ID NO: 1205039 - RNA, 21 nt, Homo sapiens
cuuuaaucaugaaacaccuua

SEQ ID NO: 1205040 - RNA, 19 nt, Homo sapiens
cuuuaaucuucaguuuuau

SEQ ID NO: 1205041 - RNA, 12 nt, Homo sapiens
cuuuaauguugu

SEQ ID NO: 1205042 - RNA, 16 nt, Homo sapiens
cuuuacagacaggaaa

SEQ ID NO: 1205043 - RNA, 16 nt, Homo sapiens
cuuuaccacucuacca

SEQ ID NO: 1205044 - RNA, 17 nt, Homo sapiens
cuuuacuaucauucuca

SEQ ID NO: 1205045 - RNA, 15 nt, Homo sapiens
cuuuacuccguaaca

SEQ ID NO: 1205046 - RNA, 14 nt, Homo sapiens
cuuuacugugcuua

SEQ ID NO: 1205047 - RNA, 18 nt, Homo sapiens
cuuuacuguuagucauuu

SEQ ID NO: 1205048 - RNA, 19 nt, Homo sapiens
cuuuacuguuagucauuug

SEQ ID NO: 1205049 - RNA, 20 nt, Homo sapiens
cuuuacuucauggacuucca

SEQ ID NO: 1205050 - RNA, 16 nt, Homo sapiens
cuuuagaacagggaaa

SEQ ID NO: 1205051 - RNA, 18 nt, Homo sapiens
cuuuagagcauugccauu

SEQ ID NO: 1205052 - RNA, 18 nt, Homo sapiens
cuuuagcaagugugcacu

SEQ ID NO: 1205053 - RNA, 18 nt, Homo sapiens
cuuuagugucugagcuuc

SEQ ID NO: 1205054 - RNA, 17 nt, Homo sapiens
cuuuauacuggguuuca

SEQ ID NO: 1205055 - RNA, 22 nt, Homo sapiens
cuuuauagagugucucagggug

SEQ ID NO: 1205056 - RNA, 12 nt, Homo sapiens
cuuuaucacaac

SEQ ID NO: 1205057 - RNA, 16 nt, Homo sapiens
cuuuaucauggaauuu

SEQ ID NO: 1205058 - RNA, 14 nt, Homo sapiens
cuuuaucuaaagaa

SEQ ID NO: 1205059 - RNA, 24 nt, Homo sapiens
cuuuaugaugcuaugguuugccau

SEQ ID NO: 1205060 - RNA, 13 nt, Homo sapiens
cuuuaugcacauu

SEQ ID NO: 1205061 - RNA, 20 nt, Homo sapiens
cuaucaccucuuaugcacac

SEQ ID NO: 1205062 - RNA, 21 nt, Homo sapiens
cuaucauuuuuguacaguuug

SEQ ID NO: 1205063 - RNA, 15 nt, Homo sapiens
cuauccaaucuguga

SEQ ID NO: 1205064 - RNA, 19 nt, Homo sapiens
cuauccagcagaucauuua

SEQ ID NO: 1205065 - RNA, 19 nt, Homo sapiens
cuauccuguguauguauaa

SEQ ID NO: 1205066 - RNA, 12 nt, Homo sapiens
cuauccuuccag

SEQ ID NO: 1205067 - RNA, 23 nt, Homo sapiens
cuaucuacuacaaacuucaaaga

SEQ ID NO: 1205068 - RNA, 18 nt, Homo sapiens
cuaucuaucuuccaaaug

SEQ ID NO: 1205069 - RNA, 18 nt, Homo sapiens
cuaucuggggagcuccug

SEQ ID NO: 1205070 - RNA, 13 nt, Homo sapiens
cuaucuguuaaag

SEQ ID NO: 1205071 - RNA, 18 nt, Homo sapiens
cuaucuucuuucacauau

SEQ ID NO: 1205072 - RNA, 17 nt, Homo sapiens
cuaucuuuuaguuuuag

SEQ ID NO: 1205073 - RNA, 18 nt, Homo sapiens
cuaucuuuugguauacuu

SEQ ID NO: 1205074 - RNA, 22 nt, Homo sapiens
cuaugaaaaauguguuccauug

SEQ ID NO: 1205075 - RNA, 20 nt, Homo sapiens
cuaugaaaacagcuaucuca

SEQ ID NO: 1205076 - RNA, 21 nt, Homo sapiens
cuaugaaaacagcuaucucac

SEQ ID NO: 1205077 - RNA, 18 nt, Homo sapiens
cuaugaaaucaacugaca

SEQ ID NO: 1205078 - RNA, 14 nt, Homo sapiens
cuaugaagcccacc

SEQ ID NO: 1205079 - RNA, 20 nt, Homo sapiens
cuaugaagcccacccagaaa

SEQ ID NO: 1205080 - RNA, 20 nt, Homo sapiens
cuaugaaguuggcacauuuc

SEQ ID NO: 1205081 - RNA, 18 nt, Homo sapiens
cuaugaucagaagacuuu

SEQ ID NO: 1205082 - RNA, 15 nt, Homo sapiens
cuaugcaaaugccuc

SEQ ID NO: 1205083 - RNA, 22 nt, Homo sapiens
cuaugcaacagcucucaccuac

SEQ ID NO: 1205084 - RNA, 23 nt, Homo sapiens
cuaugcacauauggacucugcac

SEQ ID NO: 1205085 - RNA, 18 nt, Homo sapiens
cuaugcauuaagaguaaa

SEQ ID NO: 1205086 - RNA, 24 nt, Homo sapiens
cuaugccagcaaccuuguaagcua

SEQ ID NO: 1205087 - RNA, 13 nt, Homo sapiens
cuaugccuugaaa

SEQ ID NO: 1205088 - RNA, 16 nt, Homo sapiens
cuauggaaucaauuca

SEQ ID NO: 1205089 - RNA, 17 nt, Homo sapiens
cuauggagaauuuaucc

SEQ ID NO: 1205090 - RNA, 18 nt, Homo sapiens
cuauggagugcucacaaa

SEQ ID NO: 1205091 - RNA, 19 nt, Homo sapiens
cuauggugcucagcccuga

SEQ ID NO: 1205092 - RNA, 14 nt, Homo sapiens
cuauguacugccuu

SEQ ID NO: 1205093 - RNA, 18 nt, Homo sapiens
cuauguagcaauauauca

SEQ ID NO: 1205094 - RNA, 15 nt, Homo sapiens
cuauguagcugaaaa

SEQ ID NO: 1205095 - RNA, 21 nt, Homo sapiens
cuaugucaagaggcugaauua

SEQ ID NO: 1205096 - RNA, 22 nt, Homo sapiens
cuaugucaguacuauucaggua

SEQ ID NO: 1205097 - RNA, 12 nt, Homo sapiens
cucaguccuccc

SEQ ID NO: 1205098 - RNA, 13 nt, Homo sapiens
cucaguccucccc

SEQ ID NO: 1205099 - RNA, 13 nt, Homo sapiens
cucagucuauucu

SEQ ID NO: 1205100 - RNA, 14 nt, Homo sapiens
cucagucucaggag

SEQ ID NO: 1205101 - RNA, 17 nt, Homo sapiens
cucagucuccugaguag

SEQ ID NO: 1205102 - RNA, 15 nt, Homo sapiens
cucagucucuuccac

SEQ ID NO: 1205103 - RNA, 13 nt, Homo sapiens
cucagugaaggcu

SEQ ID NO: 1205104 - RNA, 23 nt, Homo sapiens
cucagugagauauuugguaccau

SEQ ID NO: 1205105 - RNA, 11 nt, Homo sapiens
cucagugcagg

SEQ ID NO: 1205106 - RNA, 21 nt, Homo sapiens
cucagugcauagcgaagacca

SEQ ID NO: 1205107 - RNA, 13 nt, Homo sapiens
cucagugcaucuu

SEQ ID NO: 1205108 - RNA, 20 nt, Homo sapiens
cucagugggggcagagccac

SEQ ID NO: 1205109 - RNA, 21 nt, Homo sapiens
cucaguguccaguugcagcug

SEQ ID NO: 1205110 - RNA, 21 nt, Homo sapiens
cucaguuugucagacuuuaaa

SEQ ID NO: 1205111 - RNA, 13 nt, Homo sapiens
cucauaagcaaua

SEQ ID NO: 1205112 - RNA, 10 nt, Homo sapiens
cucauaauag

SEQ ID NO: 1205113 - RNA, 13 nt, Homo sapiens
cucauacacagaa

SEQ ID NO: 1205114 - RNA, 14 nt, Homo sapiens
cucauacacagaaa

SEQ ID NO: 1205115 - RNA, 22 nt, Homo sapiens
cucauaguucucuuuaagccag

SEQ ID NO: 1205116 - RNA, 20 nt, Homo sapiens
cucauaucaugguagucacu

SEQ ID NO: 1205117 - RNA, 22 nt, Homo sapiens
cucauaugccaccccaugugcc

SEQ ID NO: 1205118 - RNA, 23 nt, Homo sapiens
cucaucaguguccucuugcucaa

SEQ ID NO: 1205119 - RNA, 13 nt, Homo sapiens
cucauccaaaguu

SEQ ID NO: 1205120 - RNA, 20 nt, Homo sapiens
cucauccaggcuaccauccg

SEQ ID NO: 1205121 - RNA, 18 nt, Homo sapiens
cucauccuccuggaaccu

SEQ ID NO: 1205122 - RNA, 13 nt, Homo sapiens
cucaucugggcaa

SEQ ID NO: 1205123 - RNA, 16 nt, Homo sapiens
cucaucuuucuccuuc

SEQ ID NO: 1205124 - RNA, 20 nt, Homo sapiens
cucaugccuguaaucccaac

SEQ ID NO: 1205125 - RNA, 20 nt, Homo sapiens
cucaugccuguaaucccagc

SEQ ID NO: 1205126 - RNA, 17 nt, Homo sapiens
cucaugccuguaaucuc

SEQ ID NO: 1205127 - RNA, 14 nt, Homo sapiens
cucaugcugcucaa

SEQ ID NO: 1205128 - RNA, 16 nt, Homo sapiens
cucaugcuucacuuag

SEQ ID NO: 1205129 - RNA, 13 nt, Homo sapiens
cucaugugcagua

SEQ ID NO: 1205130 - RNA, 15 nt, Homo sapiens
cucauguuuaugaaa

SEQ ID NO: 1205131 - RNA, 10 nt, Homo sapiens
cucauuccac

SEQ ID NO: 1205132 - RNA, 13 nt, Homo sapiens
cucauugaaaugu

SEQ ID NO: 1205133 - RNA, 13 nt, Homo sapiens
cucauugcagcua

SEQ ID NO: 1205134 - RNA, 23 nt, Homo sapiens
cucauugcccccaccucuggucc

SEQ ID NO: 1205135 - RNA, 18 nt, Homo sapiens
cucauuuaagaauuugaa

SEQ ID NO: 1205136 - RNA, 13 nt, Homo sapiens
cucauuugucaca

SEQ ID NO: 1205137 - RNA, 13 nt, Homo sapiens
cuccaaaagcacu

SEQ ID NO: 1205138 - RNA, 21 nt, Homo sapiens
cuccaaaccagacggugacgc

SEQ ID NO: 1205139 - RNA, 15 nt, Homo sapiens
cuccaacacuuugag

SEQ ID NO: 1205140 - RNA, 18 nt, Homo sapiens
cuccaacccgacaugugu

SEQ ID NO: 1205141 - RNA, 23 nt, Homo sapiens
cuccaacgccccuguggccaacu

SEQ ID NO: 1205142 - RNA, 19 nt, Homo sapiens
cuccaagccauucacuucc

SEQ ID NO: 1205143 - RNA, 18 nt, Homo sapiens
cuccaagccugccuccca

SEQ ID NO: 1205144 - RNA, 22 nt, Homo sapiens
cuccaagggacccuuugccuuu

SEQ ID NO: 1205145 - RNA, 14 nt, Homo sapiens
cuccaaugccuacu

SEQ ID NO: 1205146 - RNA, 18 nt, Homo sapiens
cuccaauuucaagaguga

SEQ ID NO: 1205147 - RNA, 23 nt, Homo sapiens
cuccacaauagcagacaguguuu

SEQ ID NO: 1205148 - RNA, 17 nt, Homo sapiens
cuccacagucaauauua

SEQ ID NO: 1205149 - RNA, 17 nt, Homo sapiens
cuccacaucugccuuaa

SEQ ID NO: 1205150 - RNA, 11 nt, Homo sapiens
cuccacaugcu

SEQ ID NO: 1205151 - RNA, 19 nt, Homo sapiens
cuccaccacccaacccaaa

SEQ ID NO: 1205152 - RNA, 17 nt, Homo sapiens
cuccaccgccuauccca

SEQ ID NO: 1205153 - RNA, 20 nt, Homo sapiens
cuccaccucaccuccaugac

SEQ ID NO: 1205154 - RNA, 15 nt, Homo sapiens
cuccacgaagccuua

SEQ ID NO: 1205155 - RNA, 19 nt, Homo sapiens
cuccacgguagcacuugac

SEQ ID NO: 1205156 - RNA, 15 nt, Homo sapiens
cuccacucagguucu

SEQ ID NO: 1205157 - RNA, 21 nt, Homo sapiens
cuccagaauuuggaaauccua

SEQ ID NO: 1205158 - RNA, 17 nt, Homo sapiens
cuccagaguuguucucu

SEQ ID NO: 1205159 - RNA, 15 nt, Homo sapiens
cuccagauggugcua

SEQ ID NO: 1205160 - RNA, 22 nt, Homo sapiens
cuccagcccagacccaguggac

SEQ ID NO: 1205161 - RNA, 19 nt, Homo sapiens
cuccagccccugugacauc

SEQ ID NO: 1205162 - RNA, 21 nt, Homo sapiens
cuccagccugacuuggggaga

SEQ ID NO: 1205163 - RNA, 20 nt, Homo sapiens
cuccagcugggcucugcaau

SEQ ID NO: 1205164 - RNA, 15 nt, Homo sapiens
cuccaggaagucuuu

SEQ ID NO: 1205165 - RNA, 15 nt, Homo sapiens
cuccaggaaugaucu

SEQ ID NO: 1205166 - RNA, 14 nt, Homo sapiens
cuccaggaaugccu

SEQ ID NO: 1205167 - RNA, 14 nt, Homo sapiens
cuccaggacuccac

SEQ ID NO: 1205168 - RNA, 16 nt, Homo sapiens
cuccaggaucuauuga

SEQ ID NO: 1205169 - RNA, 17 nt, Homo sapiens
cuccaggaugaguuacu

SEQ ID NO: 1205170 - RNA, 20 nt, Homo sapiens
cuccaggaugaguuacuuga

SEQ ID NO: 1205171 - RNA, 13 nt, Homo sapiens
cuccaggcaaaau

SEQ ID NO: 1205172 - RNA, 19 nt, Homo sapiens
cuccaggccaugauggccu

SEQ ID NO: 1205173 - RNA, 17 nt, Homo sapiens
cuccaggcuuuccugcc

SEQ ID NO: 1205174 - RNA, 22 nt, Homo sapiens
cuccagguggcucugaggugcc

SEQ ID NO: 1205175 - RNA, 23 nt, Homo sapiens
cuccaggugugcacguggcaugu

SEQ ID NO: 1205176 - RNA, 12 nt, Homo sapiens
cuccaguaccau

SEQ ID NO: 1205177 - RNA, 18 nt, Homo sapiens
cuccagucuggcaacaga

SEQ ID NO: 1205178 - RNA, 15 nt, Homo sapiens
cuccauacaaugacu

SEQ ID NO: 1205179 - RNA, 17 nt, Homo sapiens
cuccauacucuguaaca

SEQ ID NO: 1205180 - RNA, 12 nt, Homo sapiens
cuccaucaugcc

SEQ ID NO: 1205181 - RNA, 15 nt, Homo sapiens
cuccaucccaacagc

SEQ ID NO: 1205182 - RNA, 19 nt, Homo sapiens
cuccaucccaacagccaug

SEQ ID NO: 1205183 - RNA, 13 nt, Homo sapiens
cuccaucucuuaa

SEQ ID NO: 1205184 - RNA, 12 nt, Homo sapiens
cuccaucuguca

SEQ ID NO: 1205185 - RNA, 13 nt, Homo sapiens
ucuauguuugcac

SEQ ID NO: 1205186 - RNA, 22 nt, Homo sapiens
ucuauguuugcacuugugcuuu

SEQ ID NO: 1205187 - RNA, 16 nt, Homo sapiens
ucuauuauaaaaccau

SEQ ID NO: 1205188 - RNA, 15 nt, Homo sapiens
ucuauuccaguauuu

SEQ ID NO: 1205189 - RNA, 18 nt, Homo sapiens
ucuauucuagccugcauu

SEQ ID NO: 1205190 - RNA, 21 nt, Homo sapiens
ucuauugagugaacagaauug

SEQ ID NO: 1205191 - RNA, 14 nt, Homo sapiens
ucuauugauguaca

SEQ ID NO: 1205192 - RNA, 21 nt, Homo sapiens
ucuauuuuaagacugauuuua

SEQ ID NO: 1205193 - RNA, 15 nt, Homo sapiens
ucucaaaaaccacag

SEQ ID NO: 1205194 - RNA, 11 nt, Homo sapiens
ucucaaaagga

SEQ ID NO: 1205195 - RNA, 20 nt, Homo sapiens
ucucaaacuccugaccucag

SEQ ID NO: 1205196 - RNA, 18 nt, Homo sapiens
ucucaaaugcacaucuca

SEQ ID NO: 1205197 - RNA, 19 nt, Homo sapiens
ucucaaaugcacaucucau

SEQ ID NO: 1205198 - RNA, 16 nt, Homo sapiens
ucucaagcuagccaga

SEQ ID NO: 1205199 - RNA, 17 nt, Homo sapiens
ucucaaugaagccagcu

SEQ ID NO: 1205200 - RNA, 15 nt, Homo sapiens
ucucacacacuggcu

SEQ ID NO: 1205201 - RNA, 16 nt, Homo sapiens
ucucacagcacaugcu

SEQ ID NO: 1205202 - RNA, 17 nt, Homo sapiens
ucucaccugucaucuca

SEQ ID NO: 1205203 - RNA, 20 nt, Homo sapiens
ucucacucugucgcccaguc

SEQ ID NO: 1205204 - RNA, 16 nt, Homo sapiens
ucucacuguugcccag

SEQ ID NO: 1205205 - RNA, 15 nt, Homo sapiens
ucucacuuuuuaccc

SEQ ID NO: 1205206 - RNA, 23 nt, Homo sapiens
ucucagaacccaucgguaggcaa

SEQ ID NO: 1205207 - RNA, 12 nt, Homo sapiens
ucucagacacua

SEQ ID NO: 1205208 - RNA, 22 nt, Homo sapiens
ucucagacacugccgacaucag

SEQ ID NO: 1205209 - RNA, 20 nt, Homo sapiens
ucucagaguccacuguggca

SEQ ID NO: 1205210 - RNA, 12 nt, Homo sapiens
ucucagcacuuu

SEQ ID NO: 1205211 - RNA, 9 nt, Homo sapiens
ucucagcuc

SEQ ID NO: 1205212 - RNA, 10 nt, Homo sapiens
ucucagcuca

SEQ ID NO: 1205213 - RNA, 20 nt, Homo sapiens
ugccuccucagaggacaguu

SEQ ID NO: 1205214 - RNA, 19 nt, Homo sapiens
ugccuccucugguccccag

SEQ ID NO: 1205215 - RNA, 14 nt, Homo sapiens
ugccucucucagga

SEQ ID NO: 1205216 - RNA, 17 nt, Homo sapiens
ugccucugaaaugccuc

SEQ ID NO: 1205217 - RNA, 18 nt, Homo sapiens
ugccucugacacacagcu

SEQ ID NO: 1205218 - RNA, 20 nt, Homo sapiens
ugccucugacacacagcucu

SEQ ID NO: 1205219 - RNA, 16 nt, Homo sapiens
ugccucugccacacuc

SEQ ID NO: 1205220 - RNA, 14 nt, Homo sapiens
ugccucugccuccc

SEQ ID NO: 1205221 - RNA, 17 nt, Homo sapiens
ugccucugccucugaca

SEQ ID NO: 1205222 - RNA, 15 nt, Homo sapiens
ugccucuguauuuaa

SEQ ID NO: 1205223 - RNA, 15 nt, Homo sapiens
ugccucuucuuuaug

SEQ ID NO: 1205224 - RNA, 23 nt, Homo sapiens
ugccugaaagcaacuacagaauu

SEQ ID NO: 1205225 - RNA, 18 nt, Homo sapiens
ugccugacaagugccuga

SEQ ID NO: 1205226 - RNA, 23 nt, Homo sapiens
ugccugccccaaacaaauaugca

SEQ ID NO: 1205227 - RNA, 15 nt, Homo sapiens
ugccuggccuggcac

SEQ ID NO: 1205228 - RNA, 16 nt, Homo sapiens
ugccuggccuggcaca

SEQ ID NO: 1205229 - RNA, 17 nt, Homo sapiens
ugccuggcgagccucug

SEQ ID NO: 1205230 - RNA, 21 nt, Homo sapiens
ugccuggcuucuuucucucag

SEQ ID NO: 1205231 - RNA, 22 nt, Homo sapiens
ugccugggaccugaaccuggag

SEQ ID NO: 1205232 - RNA, 20 nt, Homo sapiens
ugccugggggcuuuugccac

SEQ ID NO: 1205233 - RNA, 20 nt, Homo sapiens
ugccugggguggacauucag

SEQ ID NO: 1205234 - RNA, 15 nt, Homo sapiens
ugccuggucccaaga

SEQ ID NO: 1205235 - RNA, 13 nt, Homo sapiens
ugccuggugaaug

SEQ ID NO: 1205236 - RNA, 23 nt, Homo sapiens
ugccugguggggaucagacagag

SEQ ID NO: 1205237 - RNA, 16 nt, Homo sapiens
ugccuguaacuugaga

SEQ ID NO: 1205238 - RNA, 20 nt, Homo sapiens
ugccuguaaucccagcacuu

SEQ ID NO: 1205239 - RNA, 21 nt, Homo sapiens
ugccuguaaucccagcacuuu

SEQ ID NO: 1205240 - RNA, 12 nt, Homo sapiens
ugccugugaaau

SEQ ID NO: 1205241 - RNA, 16 nt, Homo sapiens
ugccugugaucccagc

SEQ ID NO: 1205242 - RNA, 20 nt, Homo sapiens
ugccugugguuaacaucuca

SEQ ID NO: 1205243 - RNA, 18 nt, Homo sapiens
ugccuguguacugccuua

SEQ ID NO: 1205244 - RNA, 21 nt, Homo sapiens
ugccuguguacugccuuaaau

SEQ ID NO: 1205245 - RNA, 20 nt, Homo sapiens
ugccuguuauaacucugcac

SEQ ID NO: 1205246 - RNA, 20 nt, Homo sapiens
ugccuguucccauucuugca

SEQ ID NO: 1205247 - RNA, 18 nt, Homo sapiens
ugccuuaaaaccaaagag

SEQ ID NO: 1205248 - RNA, 22 nt, Homo sapiens
ugccuuaacugaugacauucca

SEQ ID NO: 1205249 - RNA, 21 nt, Homo sapiens
ugccuuacaggguaacugugc

SEQ ID NO: 1205250 - RNA, 14 nt, Homo sapiens
ugccuuaucuugca

SEQ ID NO: 1205251 - RNA, 20 nt, Homo sapiens
ugccuucaucuucacugcaa

SEQ ID NO: 1205252 - RNA, 19 nt, Homo sapiens
ugccuucuccaucaugccc

SEQ ID NO: 1205253 - RNA, 21 nt, Homo sapiens
ugccuucuccuauuucuccaa

SEQ ID NO: 1205254 - RNA, 21 nt, Homo sapiens
ugccuucuguccuggugucac

SEQ ID NO: 1205255 - RNA, 15 nt, Homo sapiens
ugccuugaagccacu

SEQ ID NO: 1205256 - RNA, 16 nt, Homo sapiens
ugccuugcagccacau

SEQ ID NO: 1205257 - RNA, 18 nt, Homo sapiens
ugccuugcuaaaagauua

SEQ ID NO: 1205258 - RNA, 22 nt, Homo sapiens
ugccuugcuagcugaccuggag

SEQ ID NO: 1205259 - RNA, 18 nt, Homo sapiens
ugccuuuaaaucugugau

SEQ ID NO: 1205260 - RNA, 15 nt, Homo sapiens
ugccuuuauuugcug

SEQ ID NO: 1205261 - RNA, 17 nt, Homo sapiens
ugccuuuguaaguuauu

SEQ ID NO: 1205262 - RNA, 20 nt, Homo sapiens
ugccuuuugcaccccuccca

SEQ ID NO: 1205263 - RNA, 17 nt, Homo sapiens
ugccuuuuuaaugaaca

SEQ ID NO: 1205264 - RNA, 21 nt, Homo sapiens
ugcgaaugacaguagcauuau

SEQ ID NO: 1205265 - RNA, 21 nt, Homo sapiens
ugcgagacgcacacagcugag

SEQ ID NO: 1205266 - RNA, 15 nt, Homo sapiens
ugcgagagaaaggga

SEQ ID NO: 1205267 - RNA, 17 nt, Homo sapiens
ugcgaucuggguucacu

SEQ ID NO: 1205268 - RNA, 16 nt, Homo sapiens
ugcgaugggggucacc

SEQ ID NO: 1205269 - RNA, 19 nt, Homo sapiens
ugcgcaaaacugccugaaa

SEQ ID NO: 1205270 - RNA, 15 nt, Homo sapiens
ugcgcaauguggcau

SEQ ID NO: 1205271 - RNA, 19 nt, Homo sapiens
ugcgcacaaggcugaccaa

SEQ ID NO: 1205272 - RNA, 17 nt, Homo sapiens
ugcgcgcgugcaugugu

SEQ ID NO: 1205273 - RNA, 14 nt, Homo sapiens
ugcgcgucaucucu

SEQ ID NO: 1205274 - RNA, 16 nt, Homo sapiens
ugcgcucggcaggaag

SEQ ID NO: 1205275 - RNA, 22 nt, Homo sapiens
ugcgggcucccuggcaggaugc

SEQ ID NO: 1205276 - RNA, 23 nt, Homo sapiens
ugcggugcauacacccccaccuc

SEQ ID NO: 1205277 - RNA, 22 nt, Homo sapiens
ugcggugccuccucuugacuuc

SEQ ID NO: 1205278 - RNA, 23 nt, Homo sapiens
ugcgguggcucaugccuguaauc

SEQ ID NO: 1205279 - RNA, 15 nt, Homo sapiens
ugcguaggaggaguu

SEQ ID NO: 1205280 - RNA, 22 nt, Homo sapiens
ugcgugaaguaggcauauauca

SEQ ID NO: 1205281 - RNA, 20 nt, Homo sapiens
ugcgugcucccgaugcugcu

SEQ ID NO: 1205282 - RNA, 10 nt, Homo sapiens
ugcuaaaaaa

SEQ ID NO: 1205283 - RNA, 15 nt, Homo sapiens
ugcuaauaaaguccu

SEQ ID NO: 1205284 - RNA, 11 nt, Homo sapiens
ugcuacaacau

SEQ ID NO: 1205285 - RNA, 18 nt, Homo sapiens
ugcuacauucuaaugcau

SEQ ID NO: 1205286 - RNA, 19 nt, Homo sapiens
ugcuaccccuacaucaucu

SEQ ID NO: 1205287 - RNA, 15 nt, Homo sapiens
ugcuaccccuuugau

SEQ ID NO: 1205288 - RNA, 24 nt, Homo sapiens
ugcuacugauuguuucauugcgaa

SEQ ID NO: 1205289 - RNA, 17 nt, Homo sapiens
ugcuacuuaauuccuuu

SEQ ID NO: 1205290 - RNA, 23 nt, Homo sapiens
ugcuagaacaacgccugucacag

SEQ ID NO: 1205291 - RNA, 15 nt, Homo sapiens
ugcuagaagcuguaa

SEQ ID NO: 1205292 - RNA, 20 nt, Homo sapiens
ugcuagagggcaggggugca

SEQ ID NO: 1205293 - RNA, 17 nt, Homo sapiens
ugcuagaugcugugaca

SEQ ID NO: 1205294 - RNA, 22 nt, Homo sapiens
ugcuagcaaauggcagaaccaa

SEQ ID NO: 1205295 - RNA, 20 nt, Homo sapiens
ugcuagccccagagaugcca

SEQ ID NO: 1205296 - RNA, 22 nt, Homo sapiens
ugcuagccccagagaugccagc

SEQ ID NO: 1205297 - RNA, 19 nt, Homo sapiens
ugcuaggaugaagcccuaa

SEQ ID NO: 1205298 - RNA, 20 nt, Homo sapiens
ugcuaggcgcuggggagacu

SEQ ID NO: 1205299 - RNA, 16 nt, Homo sapiens
ugcuaguuuauauaga

SEQ ID NO: 1205300 - RNA, 19 nt, Homo sapiens
ugcuauagagccuaccugu

SEQ ID NO: 1205301 - RNA, 18 nt, Homo sapiens
ugcuauauaaauauguca

SEQ ID NO: 1205302 - RNA, 14 nt, Homo sapiens
ugcuauaucaguuu

SEQ ID NO: 1205303 - RNA, 21 nt, Homo sapiens
ugcuauccccaucucccugcc

SEQ ID NO: 1205304 - RNA, 14 nt, Homo sapiens
ugcuaugacuguau

SEQ ID NO: 1205305 - RNA, 12 nt, Homo sapiens
ugcuauuugccu

SEQ ID NO: 1205306 - RNA, 16 nt, Homo sapiens
ugcuauuugcuguuau

SEQ ID NO: 1205307 - RNA, 17 nt, Homo sapiens
ugcucaccugaggauaa

SEQ ID NO: 1205308 - RNA, 22 nt, Homo sapiens
ugcucacgucaaaugcauacaa

SEQ ID NO: 1205309 - RNA, 15 nt, Homo sapiens
ugcucagaaugucug

SEQ ID NO: 1205310 - RNA, 17 nt, Homo sapiens
ugcucagcaugauucuu

SEQ ID NO: 1205311 - RNA, 18 nt, Homo sapiens
ugcucaggagccaccagc

SEQ ID NO: 1205312 - RNA, 12 nt, Homo sapiens
ugcucaggauaa

SEQ ID NO: 1205313 - RNA, 18 nt, Homo sapiens
ugcucaggcccuggccag

SEQ ID NO: 1205314 - RNA, 13 nt, Homo sapiens
ugcucagugcuug

SEQ ID NO: 1205315 - RNA, 22 nt, Homo sapiens
ugcucagugggggcagagccac

SEQ ID NO: 1205316 - RNA, 17 nt, Homo sapiens
ugcucauugaacuuuaa

SEQ ID NO: 1205317 - RNA, 21 nt, Homo sapiens
ugcucauuuuuucuucuccua

SEQ ID NO: 1205318 - RNA, 23 nt, Homo sapiens
ugcuccaacccccgccaccucag

SEQ ID NO: 1205319 - RNA, 17 nt, Homo sapiens
ugcucccaacccauuca

SEQ ID NO: 1205320 - RNA, 18 nt, Homo sapiens
ugcucccccugguggugg

SEQ ID NO: 1205321 - RNA, 17 nt, Homo sapiens
ugcucccgaugcugcua

SEQ ID NO: 1205322 - RNA, 19 nt, Homo sapiens
ugcucccgaugcugcuaug

SEQ ID NO: 1205323 - RNA, 15 nt, Homo sapiens
ugcuccucacuggag

SEQ ID NO: 1205324 - RNA, 14 nt, Homo sapiens
ugcuccuccuccau

SEQ ID NO: 1205325 - RNA, 20 nt, Homo sapiens
ugcuccucugccuguccucu

SEQ ID NO: 1205326 - RNA, 20 nt, Homo sapiens
ugcucugaugcaauagugga

SEQ ID NO: 1205327 - RNA, 21 nt, Homo sapiens
ugcucugguuguuucuguucc

SEQ ID NO: 1205328 - RNA, 17 nt, Homo sapiens
ugcucuguacccaugaa

SEQ ID NO: 1205329 - RNA, 14 nt, Homo sapiens
ugcucuuaaccuca

SEQ ID NO: 1205330 - RNA, 15 nt, Homo sapiens
ugcucuuaagccuaa

SEQ ID NO: 1205331 - RNA, 19 nt, Homo sapiens
ugcugaaacucagugcaaa

SEQ ID NO: 1205332 - RNA, 13 nt, Homo sapiens
ugcugacugucaa

SEQ ID NO: 1205333 - RNA, 18 nt, Homo sapiens
ugcugagccuccuugucu

SEQ ID NO: 1205334 - RNA, 17 nt, Homo sapiens
ugcugaggcucugaccc

SEQ ID NO: 1205335 - RNA, 22 nt, Homo sapiens
ugcugaguaacaggugccuucc

SEQ ID NO: 1205336 - RNA, 23 nt, Homo sapiens
ugcugagugaaugaacaaaugaa

SEQ ID NO: 1205337 - RNA, 22 nt, Homo sapiens
ugcugcagauuugauauuugca

SEQ ID NO: 1205338 - RNA, 23 nt, Homo sapiens
ugcugcaggccgugugucuguca

SEQ ID NO: 1205339 - RNA, 14 nt, Homo sapiens
ugcugccauccuca

SEQ ID NO: 1205340 - RNA, 12 nt, Homo sapiens
ugcugccugaau

SEQ ID NO: 1205341 - RNA, 13 nt, Homo sapiens
ugcugcuaugaaa

SEQ ID NO: 1205342 - RNA, 17 nt, Homo sapiens
ugcugcuccagugcagg

SEQ ID NO: 1205343 - RNA, 12 nt, Homo sapiens
ugcugcugugca

SEQ ID NO: 1205344 - RNA, 14 nt, Homo sapiens
ugcugcuguuuaca

SEQ ID NO: 1205345 - RNA, 13 nt, Homo sapiens
ugcuggaacuguu

SEQ ID NO: 1205346 - RNA, 16 nt, Homo sapiens
ugcuggaauuccuaac

SEQ ID NO: 1205347 - RNA, 13 nt, Homo sapiens
ugcuggacuguca

SEQ ID NO: 1205348 - RNA, 19 nt, Homo sapiens
ugcuggacuguuccaggcc

SEQ ID NO: 1205349 - RNA, 13 nt, Homo sapiens
ugcuggacuugcc

SEQ ID NO: 1205350 - RNA, 17 nt, Homo sapiens
ugcuggauuguccuugg

SEQ ID NO: 1205351 - RNA, 22 nt, Homo sapiens
ugcuggcauuugcaccuaccuc

SEQ ID NO: 1205352 - RNA, 18 nt, Homo sapiens
ugcuggccuggaucuccc

SEQ ID NO: 1205353 - RNA, 23 nt, Homo sapiens
ugcugggaagacgccugagcuca

SEQ ID NO: 1205354 - RNA, 23 nt, Homo sapiens
ugcugggauuacaggcgugaucc

SEQ ID NO: 1205355 - RNA, 18 nt, Homo sapiens
ugcugggcugggcccucu

SEQ ID NO: 1205356 - RNA, 21 nt, Homo sapiens
ugcugguccccuccucaguga

SEQ ID NO: 1205357 - RNA, 15 nt, Homo sapiens
ugcuguacccagaug

SEQ ID NO: 1205358 - RNA, 17 nt, Homo sapiens
ugcugucaagcaccugc

SEQ ID NO: 1205359 - RNA, 23 nt, Homo sapiens
ugcuguugagaugguaacagauu

SEQ ID NO: 1205360 - RNA, 23 nt, Homo sapiens
ugcuguuuagaguaaauaaacug

SEQ ID NO: 1205361 - RNA, 22 nt, Homo sapiens
ugcuuaaaagguuaaauuucaa

SEQ ID NO: 1205362 - RNA, 17 nt, Homo sapiens
ugcuuacaaucuuuauu

SEQ ID NO: 1205363 - RNA, 22 nt, Homo sapiens
ugcuuagaugagggugacuguc

SEQ ID NO: 1205364 - RNA, 19 nt, Homo sapiens
ugcuuagucccucaugcaa

SEQ ID NO: 1205365 - RNA, 19 nt, Homo sapiens
ugcuuauuguuccaagaca

SEQ ID NO: 1205366 - RNA, 13 nt, Homo sapiens
ugcuucaaauuca

SEQ ID NO: 1205367 - RNA, 23 nt, Homo sapiens
ugcuucagacauguaauguuguu

SEQ ID NO: 1205368 - RNA, 13 nt, Homo sapiens
ugcuucagccucc

SEQ ID NO: 1205369 - RNA, 21 nt, Homo sapiens
ugcuucauaaaugaagcagcu

SEQ ID NO: 1205370 - RNA, 18 nt, Homo sapiens
ugcuucccauccuacccu

SEQ ID NO: 1205371 - RNA, 23 nt, Homo sapiens
ugcuuccgguagggaggcagccu

SEQ ID NO: 1205372 - RNA, 12 nt, Homo sapiens
ugcuuccuccca

SEQ ID NO: 1205373 - RNA, 23 nt, Homo sapiens
ugcuuccuccuuugcucuuggga

SEQ ID NO: 1205374 - RNA, 16 nt, Homo sapiens
ugcuucuccccagaau

SEQ ID NO: 1205375 - RNA, 23 nt, Homo sapiens
ugcuucugaaacuggaguaucau

SEQ ID NO: 1205376 - RNA, 15 nt, Homo sapiens
ugcuucugcacacaa

SEQ ID NO: 1205377 - RNA, 18 nt, Homo sapiens
ugcuuggaagccagguac

SEQ ID NO: 1205378 - RNA, 15 nt, Homo sapiens
ugcuuguaacaagaa

SEQ ID NO: 1205379 - RNA, 19 nt, Homo sapiens
ugcuugugccacacccucc

SEQ ID NO: 1205380 - RNA, 17 nt, Homo sapiens
ugcuuuaaaaaaauaca

SEQ ID NO: 1205381 - RNA, 14 nt, Homo sapiens
ugcuuuaggcucac

SEQ ID NO: 1205382 - RNA, 15 nt, Homo sapiens
ugcuuucaauuacaa

SEQ ID NO: 1205383 - RNA, 22 nt, Homo sapiens
ugcuuugcaggaagugucuaga

SEQ ID NO: 1205384 - RNA, 15 nt, Homo sapiens
ugcuuugccaaaaua

SEQ ID NO: 1205385 - RNA, 16 nt, Homo sapiens
ugcuuugugagccagc

SEQ ID NO: 1205386 - RNA, 14 nt, Homo sapiens
ugcuuuucauguag

SEQ ID NO: 1205387 - RNA, 16 nt, Homo sapiens
ugcuuuucccauugcc

SEQ ID NO: 1205388 - RNA, 21 nt, Homo sapiens
ugcuuuuuaaagaaugcucuu

SEQ ID NO: 1205389 - RNA, 19 nt, Homo sapiens
uggaaaaaaaccacagcca

SEQ ID NO: 1205390 - RNA, 23 nt, Homo sapiens
uggaaaaaagagaaaaaccaaug

SEQ ID NO: 1205391 - RNA, 17 nt, Homo sapiens
uggaaaaagccugugaa

SEQ ID NO: 1205392 - RNA, 19 nt, Homo sapiens
uggaaaaauguuugucuca

SEQ ID NO: 1205393 - RNA, 14 nt, Homo sapiens
uggaaaacuguguu

SEQ ID NO: 1205394 - RNA, 18 nt, Homo sapiens
uggaaaagaggggcugga

SEQ ID NO: 1205395 - RNA, 19 nt, Homo sapiens
uggaaaagcaaaacuguag

SEQ ID NO: 1205396 - RNA, 22 nt, Homo sapiens
uggaaaagcaaaacuguagggg

SEQ ID NO: 1205397 - RNA, 19 nt, Homo sapiens
uggaaaaggaagacuagag

SEQ ID NO: 1205398 - RNA, 21 nt, Homo sapiens
uggaaaauaaauucagaucaa

SEQ ID NO: 1205399 - RNA, 17 nt, Homo sapiens
uggaaaaucagcugcuc

SEQ ID NO: 1205400 - RNA, 18 nt, Homo sapiens
uggaaacagcaugaauaa

SEQ ID NO: 1205401 - RNA, 20 nt, Homo sapiens
uggaaaccucuggaggucau

SEQ ID NO: 1205402 - RNA, 13 nt, Homo sapiens
uggaaacuaagac

SEQ ID NO: 1205403 - RNA, 19 nt, Homo sapiens
uggaaagcaucaccucagg

SEQ ID NO: 1205404 - RNA, 20 nt, Homo sapiens
uggaaagccucugcugccau

SEQ ID NO: 1205405 - RNA, 19 nt, Homo sapiens
uggaaagcggcuagguuuu

SEQ ID NO: 1205406 - RNA, 15 nt, Homo sapiens
uggaaaggggggagc

SEQ ID NO: 1205407 - RNA, 21 nt, Homo sapiens
uggaaauaaagucagauggaa

SEQ ID NO: 1205408 - RNA, 19 nt, Homo sapiens
uggaaaugacccuauuuga

SEQ ID NO: 1205409 - RNA, 13 nt, Homo sapiens
uggaaaugccauu

SEQ ID NO: 1205410 - RNA, 19 nt, Homo sapiens
uggaaaugcugacuuuuaa

SEQ ID NO: 1205411 - RNA, 21 nt, Homo sapiens
uggaaauuccuguacuguguc

SEQ ID NO: 1205412 - RNA, 20 nt, Homo sapiens
uggaacauauagaaugcaga

SEQ ID NO: 1205413 - RNA, 14 nt, Homo sapiens
uggaaccccagcuu

SEQ ID NO: 1205414 - RNA, 11 nt, Homo sapiens
uggaacuggag

SEQ ID NO: 1205415 - RNA, 13 nt, Homo sapiens
uggaacuggccac

SEQ ID NO: 1205416 - RNA, 15 nt, Homo sapiens
uggaacuguccuucc

SEQ ID NO: 1205417 - RNA, 16 nt, Homo sapiens
uggaagaaagcaacaa

SEQ ID NO: 1205418 - RNA, 16 nt, Homo sapiens
uggaagagcacaagag

SEQ ID NO: 1205419 - RNA, 16 nt, Homo sapiens
uggaagaggaacagca

SEQ ID NO: 1205420 - RNA, 17 nt, Homo sapiens
uggaagaggaacagcac

SEQ ID NO: 1205421 - RNA, 17 nt, Homo sapiens
uggaagaguaguaauag

SEQ ID NO: 1205422 - RNA, 13 nt, Homo sapiens
uggaagauuggaa

SEQ ID NO: 1205423 - RNA, 15 nt, Homo sapiens
uggaagcacagcuuc

SEQ ID NO: 1205424 - RNA, 22 nt, Homo sapiens
uggaagccccaacgggaaagga

SEQ ID NO: 1205425 - RNA, 18 nt, Homo sapiens
uggaagcuaauuugcauu

SEQ ID NO: 1205426 - RNA, 13 nt, Homo sapiens
uggaaggggccac

SEQ ID NO: 1205427 - RNA, 13 nt, Homo sapiens
uggaaggggucca

SEQ ID NO: 1205428 - RNA, 23 nt, Homo sapiens
uggaaggugacagcgauucccug

SEQ ID NO: 1205429 - RNA, 14 nt, Homo sapiens
uggaaguacaugaa

SEQ ID NO: 1205430 - RNA, 15 nt, Homo sapiens
uggaagugcuugaua

SEQ ID NO: 1205431 - RNA, 23 nt, Homo sapiens
uggaaguuaaagggcauuuccaa

SEQ ID NO: 1205432 - RNA, 17 nt, Homo sapiens
uggaauaaaacugucuc

SEQ ID NO: 1205433 - RNA, 14 nt, Homo sapiens
uggaauaaagucaa

SEQ ID NO: 1205434 - RNA, 20 nt, Homo sapiens
uggaauaaagucacagaauu

SEQ ID NO: 1205435 - RNA, 15 nt, Homo sapiens
uggaauaacucugug

SEQ ID NO: 1205436 - RNA, 20 nt, Homo sapiens
uggaauaacucuguggcauu

SEQ ID NO: 1205437 - RNA, 21 nt, Homo sapiens
uggaauauaaggaaagcaaua

SEQ ID NO: 1205438 - RNA, 23 nt, Homo sapiens
uggaaucagugaagccaaaggga

SEQ ID NO: 1205439 - RNA, 17 nt, Homo sapiens
uggaaucauauaguguc

SEQ ID NO: 1205440 - RNA, 21 nt, Homo sapiens
uggaaucuucuccaguaugaa

SEQ ID NO: 1205441 - RNA, 19 nt, Homo sapiens
uggaaucuucucuuugaca

SEQ ID NO: 1205442 - RNA, 22 nt, Homo sapiens
uggcccuuucaacaaugucuuu

SEQ ID NO: 1205443 - RNA, 23 nt, Homo sapiens
uggccgccacccccaucuuccac

SEQ ID NO: 1205444 - RNA, 22 nt, Homo sapiens
uggccgcuccucccucagaaaa

SEQ ID NO: 1205445 - RNA, 13 nt, Homo sapiens
uggccuacaguca

SEQ ID NO: 1205446 - RNA, 16 nt, Homo sapiens
uggccuauccgcugcc

SEQ ID NO: 1205447 - RNA, 16 nt, Homo sapiens
uggccuaugcacauau

SEQ ID NO: 1205448 - RNA, 20 nt, Homo sapiens
uggccucagcugaaugccuc

SEQ ID NO: 1205449 - RNA, 17 nt, Homo sapiens
uggccuccccugccacc

SEQ ID NO: 1205450 - RNA, 22 nt, Homo sapiens
uggccuccccugccaccaggcc

SEQ ID NO: 1205451 - RNA, 14 nt, Homo sapiens
uggccucucuagca

SEQ ID NO: 1205452 - RNA, 16 nt, Homo sapiens
uggccucuggcucuca

SEQ ID NO: 1205453 - RNA, 17 nt, Homo sapiens
uggccucuggcucucau

SEQ ID NO: 1205454 - RNA, 21 nt, Homo sapiens
uggccugcugugauuccacua

SEQ ID NO: 1205455 - RNA, 23 nt, Homo sapiens
uggccuggggcaggucacuuuac

SEQ ID NO: 1205456 - RNA, 21 nt, Homo sapiens
uggccuuaaaaggggcccaag

SEQ ID NO: 1205457 - RNA, 17 nt, Homo sapiens
uggccuugaaaccaccu

SEQ ID NO: 1205458 - RNA, 12 nt, Homo sapiens
uggccuugcuac

SEQ ID NO: 1205459 - RNA, 22 nt, Homo sapiens
uggccuuuaaaaaugcaccacu

SEQ ID NO: 1205460 - RNA, 15 nt, Homo sapiens
uggcggcagggccag

SEQ ID NO: 1205461 - RNA, 22 nt, Homo sapiens
uggcggcugugcaucaguggga

SEQ ID NO: 1205462 - RNA, 18 nt, Homo sapiens
uggcggggagaagcuuuu

SEQ ID NO: 1205463 - RNA, 18 nt, Homo sapiens
uggcguggcagccucuug

SEQ ID NO: 1205464 - RNA, 14 nt, Homo sapiens
uggcuaacacguga

SEQ ID NO: 1205465 - RNA, 22 nt, Homo sapiens
uggcuaacuauauuugcuuuuu

SEQ ID NO: 1205466 - RNA, 18 nt, Homo sapiens
uggcuaguaaaagccauc

SEQ ID NO: 1205467 - RNA, 18 nt, Homo sapiens
uggcucaaacaacauucc

SEQ ID NO: 1205468 - RNA, 16 nt, Homo sapiens
uggcucaacauugugu

SEQ ID NO: 1205469 - RNA, 23 nt, Homo sapiens
uggcucacugcaagcucugccuc

SEQ ID NO: 1205470 - RNA, 21 nt, Homo sapiens
uggcucaugccuguaaucuca

SEQ ID NO: 1205471 - RNA, 17 nt, Homo sapiens
uggcucaugucuauaau

SEQ ID NO: 1205472 - RNA, 15 nt, Homo sapiens
uggcuccaccacuga

SEQ ID NO: 1205473 - RNA, 14 nt, Homo sapiens
uggcuccuaucugu

SEQ ID NO: 1205474 - RNA, 15 nt, Homo sapiens
uggcucucagaaggu

SEQ ID NO: 1205475 - RNA, 13 nt, Homo sapiens
uggcucucauggg

SEQ ID NO: 1205476 - RNA, 13 nt, Homo sapiens
uggcucucggcac

SEQ ID NO: 1205477 - RNA, 15 nt, Homo sapiens
uggcucucuccagga

SEQ ID NO: 1205478 - RNA, 20 nt, Homo sapiens
uggcucugcaugacaaacac

SEQ ID NO: 1205479 - RNA, 22 nt, Homo sapiens
uggcucuggagacagccccaga

SEQ ID NO: 1205480 - RNA, 22 nt, Homo sapiens
uggcucuugaggcauuuccaga

SEQ ID NO: 1205481 - RNA, 20 nt, Homo sapiens
uggcugauuuauuucuacua

SEQ ID NO: 1205482 - RNA, 20 nt, Homo sapiens
uggcugcaccuuuuugcaug

SEQ ID NO: 1205483 - RNA, 12 nt, Homo sapiens
uggcugcaguga

SEQ ID NO: 1205484 - RNA, 13 nt, Homo sapiens
uggcugcccagga

SEQ ID NO: 1205485 - RNA, 12 nt, Homo sapiens
uggcugccuuug

SEQ ID NO: 1205486 - RNA, 15 nt, Homo sapiens
uggcugccuuuggaa

SEQ ID NO: 1205487 - RNA, 15 nt, Homo sapiens
uggcuggccacugca

SEQ ID NO: 1205488 - RNA, 22 nt, Homo sapiens
uggcuggcuuguuugauuucaa

SEQ ID NO: 1205489 - RNA, 16 nt, Homo sapiens
uggcugggaacaacuu

SEQ ID NO: 1205490 - RNA, 19 nt, Homo sapiens
uggcugggggccucagugc

SEQ ID NO: 1205491 - RNA, 17 nt, Homo sapiens
uggcugguuucugagag

SEQ ID NO: 1205492 - RNA, 21 nt, Homo sapiens
uggcuuaaaagcaaguuucag

SEQ ID NO: 1205493 - RNA, 23 nt, Homo sapiens
uggcuuaccugaccucuugcugu

SEQ ID NO: 1205494 - RNA, 14 nt, Homo sapiens
uggcuuagugccac

SEQ ID NO: 1205495 - RNA, 14 nt, Homo sapiens
uggcuucugugaug

SEQ ID NO: 1205496 - RNA, 21 nt, Homo sapiens
ugggaaaaaaguuuugaugaa

SEQ ID NO: 1205497 - RNA, 19 nt, Homo sapiens
ugggaaauuuuucuuucua

SEQ ID NO: 1205498 - RNA, 19 nt, Homo sapiens
ugggaagaaagaaugcaag

SEQ ID NO: 1205499 - RNA, 20 nt, Homo sapiens
ugggaagagaagagggccca

SEQ ID NO: 1205500 - RNA, 15 nt, Homo sapiens
ugggaauaauugcuu

SEQ ID NO: 1205501 - RNA, 16 nt, Homo sapiens
ugggaauacacuugca

SEQ ID NO: 1205502 - RNA, 15 nt, Homo sapiens
ugggaaugucucuuu

SEQ ID NO: 1205503 - RNA, 23 nt, Homo sapiens
ugggaaugucucuuuggcgaccu

SEQ ID NO: 1205504 - RNA, 19 nt, Homo sapiens
ugggaauuuggagugacca

SEQ ID NO: 1205505 - RNA, 12 nt, Homo sapiens
ugggacacaguu

SEQ ID NO: 1205506 - RNA, 20 nt, Homo sapiens
ugggacccaaaacacaggaa

SEQ ID NO: 1205507 - RNA, 14 nt, Homo sapiens
ugggaccgugacua

SEQ ID NO: 1205508 - RNA, 14 nt, Homo sapiens
ugggacuacaggca

SEQ ID NO: 1205509 - RNA, 22 nt, Homo sapiens
ugggacuacaggugugagucac

SEQ ID NO: 1205510 - RNA, 23 nt, Homo sapiens
ugggacucggagacuauggccuc

SEQ ID NO: 1205511 - RNA, 14 nt, Homo sapiens
ugggagacuuugaa

SEQ ID NO: 1205512 - RNA, 17 nt, Homo sapiens
ugggagagcugauugca

SEQ ID NO: 1205513 - RNA, 15 nt, Homo sapiens
ugggagagggagacc

SEQ ID NO: 1205514 - RNA, 14 nt, Homo sapiens
ugggagcaggagau

SEQ ID NO: 1205515 - RNA, 20 nt, Homo sapiens
ugggagcccugaccuuggcu

SEQ ID NO: 1205516 - RNA, 21 nt, Homo sapiens
ugggaggcccugagacaggga

SEQ ID NO: 1205517 - RNA, 14 nt, Homo sapiens
ugggagggagguaa

SEQ ID NO: 1205518 - RNA, 20 nt, Homo sapiens
ugggagggagguaacgggug

SEQ ID NO: 1205519 - RNA, 17 nt, Homo sapiens
ugggagucacacagugu

SEQ ID NO: 1205520 - RNA, 12 nt, Homo sapiens
ugggaguguccu

SEQ ID NO: 1205521 - RNA, 15 nt, Homo sapiens
ugggauaucacuucc

SEQ ID NO: 1205522 - RNA, 14 nt, Homo sapiens
ugggaucagaucaa

SEQ ID NO: 1205523 - RNA, 18 nt, Homo sapiens
ugggaucagcuucuugca

SEQ ID NO: 1205524 - RNA, 21 nt, Homo sapiens
ugggauguccuacuaucacug

SEQ ID NO: 1205525 - RNA, 18 nt, Homo sapiens
ugggauuauauaggcaug

SEQ ID NO: 1205526 - RNA, 20 nt, Homo sapiens
ugggauuaugccaaggccgu

SEQ ID NO: 1205527 - RNA, 14 nt, Homo sapiens
ugggauugcacaga

SEQ ID NO: 1205528 - RNA, 16 nt, Homo sapiens
ugggauuugcugugua

SEQ ID NO: 1205529 - RNA, 16 nt, Homo sapiens
ugggcaaacaggcagu

SEQ ID NO: 1205530 - RNA, 18 nt, Homo sapiens
ugggcaacauaccaagac

SEQ ID NO: 1205531 - RNA, 15 nt, Homo sapiens
ugggcacagagguca

SEQ ID NO: 1205532 - RNA, 23 nt, Homo sapiens
ugggcacucccuugguggcaaga

SEQ ID NO: 1205533 - RNA, 13 nt, Homo sapiens
ugggcacugggau

SEQ ID NO: 1205534 - RNA, 23 nt, Homo sapiens
ugggcagccccaccucacagcca

SEQ ID NO: 1205535 - RNA, 21 nt, Homo sapiens
ugggcaggugguggcacugag

SEQ ID NO: 1205536 - RNA, 13 nt, Homo sapiens
ugggcaugccacc

SEQ ID NO: 1205537 - RNA, 20 nt, Homo sapiens
ugggcauugacaaaucugug

SEQ ID NO: 1205538 - RNA, 13 nt, Homo sapiens
ugggccagggucu

SEQ ID NO: 1205539 - RNA, 16 nt, Homo sapiens
ugggccgcacuggggc

SEQ ID NO: 1205540 - RNA, 21 nt, Homo sapiens
ugggccuccugacagcaauaa

SEQ ID NO: 1205541 - RNA, 17 nt, Homo sapiens
ugggccucugacucuga

SEQ ID NO: 1205542 - RNA, 22 nt, Homo sapiens
ugggcgcuguuuucucagcucc

SEQ ID NO: 1205543 - RNA, 17 nt, Homo sapiens
ugggcggaaguacuucc

SEQ ID NO: 1205544 - RNA, 16 nt, Homo sapiens
ugggcugcuagaagca

SEQ ID NO: 1205545 - RNA, 13 nt, Homo sapiens
uucagugcaccua

SEQ ID NO: 1205546 - RNA, 19 nt, Homo sapiens
uucagugcaccuacugcuu

SEQ ID NO: 1205547 - RNA, 22 nt, Homo sapiens
uucaguggcuaccuacauacaa

SEQ ID NO: 1205548 - RNA, 16 nt, Homo sapiens
uucaguguacauggaa

SEQ ID NO: 1205549 - RNA, 16 nt, Homo sapiens
uucauaaaaacacuca

SEQ ID NO: 1205550 - RNA, 21 nt, Homo sapiens
uucauaacagugccauugucu

SEQ ID NO: 1205551 - RNA, 13 nt, Homo sapiens
uucauagaugaau

SEQ ID NO: 1205552 - RNA, 15 nt, Homo sapiens
uucauaugcuguaua

SEQ ID NO: 1205553 - RNA, 20 nt, Homo sapiens
uucauauguaccauguacau

SEQ ID NO: 1205554 - RNA, 18 nt, Homo sapiens
uucauauuuauacuuugc

SEQ ID NO: 1205555 - RNA, 13 nt, Homo sapiens
uucaucacacugg

SEQ ID NO: 1205556 - RNA, 21 nt, Homo sapiens
uucauccaggcccaacuguga

SEQ ID NO: 1205557 - RNA, 21 nt, Homo sapiens
uucaucccucgggugugcuau

SEQ ID NO: 1205558 - RNA, 14 nt, Homo sapiens
uucaucuaauguga

SEQ ID NO: 1205559 - RNA, 20 nt, Homo sapiens
uucaucugaaacccacagau

SEQ ID NO: 1205560 - RNA, 18 nt, Homo sapiens
uucaucuucacugcaauu

SEQ ID NO: 1205561 - RNA, 13 nt, Homo sapiens
uucaugaaacugu

SEQ ID NO: 1205562 - RNA, 23 nt, Homo sapiens
uucaugaaacuguccaccaagau

SEQ ID NO: 1205563 - RNA, 19 nt, Homo sapiens
uucaugauuagcaaguuac

SEQ ID NO: 1205564 - RNA, 12 nt, Homo sapiens
uucaugccagcu

SEQ ID NO: 1205565 - RNA, 21 nt, Homo sapiens
uucauguugcaaagaacucca

SEQ ID NO: 1205566 - RNA, 15 nt, Homo sapiens
uucauguuugcuuca

SEQ ID NO: 1205567 - RNA, 18 nt, Homo sapiens
uucauuaauacagggcau

SEQ ID NO: 1205568 - RNA, 23 nt, Homo sapiens
uucauuacuugauuaagauuuua

SEQ ID NO: 1205569 - RNA, 21 nt, Homo sapiens
uucauuauagacaacgaugaa

SEQ ID NO: 1205570 - RNA, 15 nt, Homo sapiens
uucauuccauugacu

SEQ ID NO: 1205571 - RNA, 22 nt, Homo sapiens
uucauucucccuuucacuaaaa

SEQ ID NO: 1205572 - RNA, 13 nt, Homo sapiens
uucauucugcaag

SEQ ID NO: 1205573 - RNA, 16 nt, Homo sapiens
uucauucugcaaguau

SEQ ID NO: 1205574 - RNA, 16 nt, Homo sapiens
uucauuguaugaugug

SEQ ID NO: 1205575 - RNA, 23 nt, Homo sapiens
uucauugugagauugcaguucug

SEQ ID NO: 1205576 - RNA, 20 nt, Homo sapiens
uucauuuaggaugcuuucau

SEQ ID NO: 1205577 - RNA, 12 nt, Homo sapiens
uucauuuguaug

SEQ ID NO: 1205578 - RNA, 17 nt, Homo sapiens
uucauuuucaucacugg

SEQ ID NO: 1205579 - RNA, 15 nt, Homo sapiens
uuccaaaacuuuaau

SEQ ID NO: 1205580 - RNA, 21 nt, Homo sapiens
uuccaaaauaauuuuaagaaa

SEQ ID NO: 1205581 - RNA, 13 nt, Homo sapiens
uuccaaagccaga

SEQ ID NO: 1205582 - RNA, 12 nt, Homo sapiens
uuccaaauucau

SEQ ID NO: 1205583 - RNA, 23 nt, Homo sapiens
uuccaacaauggggugggcccau

SEQ ID NO: 1205584 - RNA, 23 nt, Homo sapiens
uuccaacaccacagacacacaca

SEQ ID NO: 1205585 - RNA, 21 nt, Homo sapiens
uuccaacucgaaucuguguga

SEQ ID NO: 1205586 - RNA, 12 nt, Homo sapiens
uuccaagaccaa

SEQ ID NO: 1205587 - RNA, 14 nt, Homo sapiens
uuccaagagucuaa

SEQ ID NO: 1205588 - RNA, 14 nt, Homo sapiens
uuccaagugccaau

SEQ ID NO: 1205589 - RNA, 19 nt, Homo sapiens
uuccaaugcacaguugcca

SEQ ID NO: 1205590 - RNA, 13 nt, Homo sapiens
uuccaaugcauug

SEQ ID NO: 1205591 - RNA, 17 nt, Homo sapiens
uuccacaagagugaauu

SEQ ID NO: 1205592 - RNA, 21 nt, Homo sapiens
uuccacaguugccaccaccuc

SEQ ID NO: 1205593 - RNA, 17 nt, Homo sapiens
uuccacuuaggaagaaa

SEQ ID NO: 1205594 - RNA, 17 nt, Homo sapiens
uuccacuucuaacucca

SEQ ID NO: 1205595 - RNA, 15 nt, Homo sapiens
uuccacuucuaugca

SEQ ID NO: 1205596 - RNA, 16 nt, Homo sapiens
uuccacuucuaugcaa

SEQ ID NO: 1205597 - RNA, 14 nt, Homo sapiens
uuccagaagaucug

SEQ ID NO: 1205598 - RNA, 14 nt, Homo sapiens
uuccagaccugcuu

SEQ ID NO: 1205599 - RNA, 12 nt, Homo sapiens
uuccagauagca

SEQ ID NO: 1205600 - RNA, 23 nt, Homo sapiens
uuccagauguggauuuggcaaaa

SEQ ID NO: 1205601 - RNA, 20 nt, Homo sapiens
uuccaggauaaggagacuga

SEQ ID NO: 1205602 - RNA, 19 nt, Homo sapiens
uuccaggggucguuugcuu

SEQ ID NO: 1205603 - RNA, 18 nt, Homo sapiens
uuccagguguuacuguaa

SEQ ID NO: 1205604 - RNA, 23 nt, Homo sapiens
uuccaguacuuccugcaguacaa

SEQ ID NO: 1205605 - RNA, 15 nt, Homo sapiens
uuccaguauugaaaa

SEQ ID NO: 1205606 - RNA, 18 nt, Homo sapiens
uuccaguguucuaugaac

SEQ ID NO: 1205607 - RNA, 22 nt, Homo sapiens
uuccaguuccucuuuugugcug

SEQ ID NO: 1205608 - RNA, 16 nt, Homo sapiens
uuccauaagaagucgu

SEQ ID NO: 1205609 - RNA, 18 nt, Homo sapiens
uuccauaggacauacugc

SEQ ID NO: 1205610 - RNA, 23 nt, Homo sapiens
uuccauauuuauacagcagagaa

SEQ ID NO: 1205611 - RNA, 14 nt, Homo sapiens
uuccaugaaguuug

SEQ ID NO: 1205612 - RNA, 21 nt, Homo sapiens
uuccauuaaguacaugugcca

SEQ ID NO: 1205613 - RNA, 21 nt, Homo sapiens
uuccauuuauucuuugaucuu

SEQ ID NO: 1205614 - RNA, 18 nt, Homo sapiens
uuccauuuccaagcacuu

SEQ ID NO: 1205615 - RNA, 16 nt, Homo sapiens
uuccauuuuaugcaga

SEQ ID NO: 1205616 - RNA, 20 nt, Homo sapiens
uucccaaauaaacucuaaac

SEQ ID NO: 1205617 - RNA, 17 nt, Homo sapiens
uucccaaaucccucuca

SEQ ID NO: 1205618 - RNA, 17 nt, Homo sapiens
uucccaacaacauccau

SEQ ID NO: 1205619 - RNA, 19 nt, Homo sapiens
uucccaauagcacuuucau

SEQ ID NO: 1205620 - RNA, 23 nt, Homo sapiens
uucccaauagcacuuucauugcc

SEQ ID NO: 1205621 - RNA, 22 nt, Homo sapiens
uucccagcuucugccacauaaa

SEQ ID NO: 1205622 - RNA, 13 nt, Homo sapiens
uucccagguguua

SEQ ID NO: 1205623 - RNA, 15 nt, Homo sapiens
uucccagucuucuga

SEQ ID NO: 1205624 - RNA, 18 nt, Homo sapiens
uucccaucuuuacuccca

SEQ ID NO: 1205625 - RNA, 13 nt, Homo sapiens
uucccaugacugc

SEQ ID NO: 1205626 - RNA, 14 nt, Homo sapiens
uuccccaaccacag

SEQ ID NO: 1205627 - RNA, 20 nt, Homo sapiens
uuccccaaggacucuuccac

SEQ ID NO: 1205628 - RNA, 17 nt, Homo sapiens
uuccccauaacucaaug

SEQ ID NO: 1205629 - RNA, 16 nt, Homo sapiens
uuccccaucuucuaaa

SEQ ID NO: 1205630 - RNA, 23 nt, Homo sapiens
uuccccccucccuccaguaccau

SEQ ID NO: 1205631 - RNA, 17 nt, Homo sapiens
uucccccuuccuaguga

SEQ ID NO: 1205632 - RNA, 17 nt, Homo sapiens
uuccccuguccugugaa

SEQ ID NO: 1205633 - RNA, 15 nt, Homo sapiens
uuccccuugccuaaa

SEQ ID NO: 1205634 - RNA, 14 nt, Homo sapiens
uucccgaugaacaa

SEQ ID NO: 1205635 - RNA, 19 nt, Homo sapiens
uucccggcgucccuaccuc

SEQ ID NO: 1205636 - RNA, 19 nt, Homo sapiens
uucccuaccauucagugau

SEQ ID NO: 1205637 - RNA, 12 nt, Homo sapiens
uucccuagcuuu

SEQ ID NO: 1205638 - RNA, 13 nt, Homo sapiens
uucccucccuauc

SEQ ID NO: 1205639 - RNA, 18 nt, Homo sapiens
uucccuggugccaccagc

SEQ ID NO: 1205640 - RNA, 20 nt, Homo sapiens
uucccuguaugauuccuuga

SEQ ID NO: 1205641 - RNA, 21 nt, Homo sapiens
uucccugucacuacacacuaa

SEQ ID NO: 1205642 - RNA, 22 nt, Homo sapiens
uucccuguguauucuagugaau

SEQ ID NO: 1205643 - RNA, 14 nt, Homo sapiens
uucccuuaaauaca

SEQ ID NO: 1205644 - RNA, 14 nt, Homo sapiens
uucccuuccacugc

SEQ ID NO: 1205645 - RNA, 15 nt, Homo sapiens
uucccuuccacugcc

SEQ ID NO: 1205646 - RNA, 17 nt, Homo sapiens
uucccuuccacugccuc

SEQ ID NO: 1205647 - RNA, 19 nt, Homo sapiens
uucccuuccaguuccggga

SEQ ID NO: 1205648 - RNA, 15 nt, Homo sapiens
uuccgauacaaagug

SEQ ID NO: 1205649 - RNA, 18 nt, Homo sapiens
uuccguggguucugucau

SEQ ID NO: 1205650 - RNA, 13 nt, Homo sapiens
uuccguuuugccu

SEQ ID NO: 1205651 - RNA, 20 nt, Homo sapiens
uuccuaaaaguucauaacag

SEQ ID NO: 1205652 - RNA, 14 nt, Homo sapiens
uuccuaaacuuuca

SEQ ID NO: 1205653 - RNA, 18 nt, Homo sapiens
uuccuaaagccaucaugc

SEQ ID NO: 1205654 - RNA, 22 nt, Homo sapiens
uuccuaaggcacccacaaauaa

SEQ ID NO: 1205655 - RNA, 22 nt, Homo sapiens
uuccuacacguuagauuugccg

SEQ ID NO: 1205656 - RNA, 22 nt, Homo sapiens
uuccuaugcuguucacuggaca

SEQ ID NO: 1205657 - RNA, 22 nt, Homo sapiens
uuccuauggcuggccacugcac

SEQ ID NO: 1205658 - RNA, 13 nt, Homo sapiens
uuccuauuacacg

SEQ ID NO: 1205659 - RNA, 19 nt, Homo sapiens
uuccuauuuguuuucaugg

SEQ ID NO: 1205660 - RNA, 13 nt, Homo sapiens
uuccucacucaga

SEQ ID NO: 1205661 - RNA, 16 nt, Homo sapiens
uuccucagaucaucca

SEQ ID NO: 1205662 - RNA, 16 nt, Homo sapiens
uuccucagcugugugg

SEQ ID NO: 1205663 - RNA, 23 nt, Homo sapiens
uuccucccagcauaggauucauu

SEQ ID NO: 1205664 - RNA, 18 nt, Homo sapiens
uuccuccucgcugccaga

SEQ ID NO: 1205665 - RNA, 14 nt, Homo sapiens
uuccuccuuauccu

SEQ ID NO: 1205666 - RNA, 18 nt, Homo sapiens
uuccucgccugacaacca

SEQ ID NO: 1205667 - RNA, 11 nt, Homo sapiens
uuccucugcau

SEQ ID NO: 1205668 - RNA, 14 nt, Homo sapiens
uuccucuuacugua

SEQ ID NO: 1205669 - RNA, 13 nt, Homo sapiens
uuccucuuuccaa

SEQ ID NO: 1205670 - RNA, 21 nt, Homo sapiens
uuccugaaaagcugcauuuaa

SEQ ID NO: 1205671 - RNA, 16 nt, Homo sapiens
uuccugacaucacagc

SEQ ID NO: 1205672 - RNA, 17 nt, Homo sapiens
uucuugugauguuuuga

SEQ ID NO: 1205673 - RNA, 16 nt, Homo sapiens
uucuugugguguaaag

SEQ ID NO: 1205674 - RNA, 12 nt, Homo sapiens
uucuuguugcau

SEQ ID NO: 1205675 - RNA, 18 nt, Homo sapiens
uucuuuaauguuguccag

SEQ ID NO: 1205676 - RNA, 14 nt, Homo sapiens
uucuuuaccugaga

SEQ ID NO: 1205677 - RNA, 23 nt, Homo sapiens
uucuuuccucuuccccuugcccu

SEQ ID NO: 1205678 - RNA, 20 nt, Homo sapiens
uucuuugacauuugguggua

SEQ ID NO: 1205679 - RNA, 16 nt, Homo sapiens
uucuuugcugcaguca

SEQ ID NO: 1205680 - RNA, 21 nt, Homo sapiens
uucuuuuccaagcuccuuauu

SEQ ID NO: 1205681 - RNA, 19 nt, Homo sapiens
uucuuuugaacauccccac

SEQ ID NO: 1205682 - RNA, 13 nt, Homo sapiens
uucuuuugaacug

SEQ ID NO: 1205683 - RNA, 13 nt, Homo sapiens
uucuuuugcucuu

SEQ ID NO: 1205684 - RNA, 20 nt, Homo sapiens
uugaaaaaaaacccuugauu

SEQ ID NO: 1205685 - RNA, 16 nt, Homo sapiens
uugaaaacucacagaa

SEQ ID NO: 1205686 - RNA, 14 nt, Homo sapiens
uugaaaagcuauua

SEQ ID NO: 1205687 - RNA, 15 nt, Homo sapiens
uugaaaaugggcuca

SEQ ID NO: 1205688 - RNA, 12 nt, Homo sapiens
uugaaaauguuc

SEQ ID NO: 1205689 - RNA, 14 nt, Homo sapiens
uugaaaauguucag

SEQ ID NO: 1205690 - RNA, 18 nt, Homo sapiens
uugaaacauacagaaugu

SEQ ID NO: 1205691 - RNA, 20 nt, Homo sapiens
uugaaacauacagaauguuc

SEQ ID NO: 1205692 - RNA, 23 nt, Homo sapiens
uugaaacauacagaauguucuau

SEQ ID NO: 1205693 - RNA, 17 nt, Homo sapiens
uugaaaccugcucugua

SEQ ID NO: 1205694 - RNA, 16 nt, Homo sapiens
uugaaagaaccagaga

SEQ ID NO: 1205695 - RNA, 14 nt, Homo sapiens
uugaaagaugcagu

SEQ ID NO: 1205696 - RNA, 15 nt, Homo sapiens
uugaaagaugcagug

SEQ ID NO: 1205697 - RNA, 18 nt, Homo sapiens
uugaaaguccuaggguga

SEQ ID NO: 1205698 - RNA, 18 nt, Homo sapiens
uugaaaguuaacauuaau

SEQ ID NO: 1205699 - RNA, 21 nt, Homo sapiens
uugaaauaaaugacaauguaa

SEQ ID NO: 1205700 - RNA, 17 nt, Homo sapiens
uugaaauaagaaagugc

SEQ ID NO: 1205701 - RNA, 19 nt, Homo sapiens
uugaaauaagaaagugcga

SEQ ID NO: 1205702 - RNA, 14 nt, Homo sapiens
uugaaauaguugau

SEQ ID NO: 1205703 - RNA, 18 nt, Homo sapiens
uugaaauuugccuugagu

SEQ ID NO: 1205704 - RNA, 23 nt, Homo sapiens
uugaacaacuaggcuucagcaua

SEQ ID NO: 1205705 - RNA, 12 nt, Homo sapiens
uugaacuauaac

SEQ ID NO: 1205706 - RNA, 22 nt, Homo sapiens
uugaacuucugacuacuuguug

SEQ ID NO: 1205707 - RNA, 19 nt, Homo sapiens
uugaagaaaggaaccuggg

SEQ ID NO: 1205708 - RNA, 11 nt, Homo sapiens
uugaagccaaa

SEQ ID NO: 1205709 - RNA, 14 nt, Homo sapiens
uugaagccaaagaa

SEQ ID NO: 1205710 - RNA, 23 nt, Homo sapiens
uugaaggccuuauucuacauuuc

SEQ ID NO: 1205711 - RNA, 19 nt, Homo sapiens
uugaaguguuugcuuuucu

SEQ ID NO: 1205712 - RNA, 13 nt, Homo sapiens
uugaaguuuacaa

SEQ ID NO: 1205713 - RNA, 21 nt, Homo sapiens
uugaaguuuuagcggucaauu

SEQ ID NO: 1205714 - RNA, 14 nt, Homo sapiens
uugaauacaaguuu

SEQ ID NO: 1205715 - RNA, 12 nt, Homo sapiens
uugaauaucauu

SEQ ID NO: 1205716 - RNA, 20 nt, Homo sapiens
uugaaucuacaacucugaaa

SEQ ID NO: 1205717 - RNA, 22 nt, Homo sapiens
uugaaugacauuuuagggacau

SEQ ID NO: 1205718 - RNA, 16 nt, Homo sapiens
uugaaugcuaagaaug

SEQ ID NO: 1205719 - RNA, 18 nt, Homo sapiens
uugaauggaaaacacaug

SEQ ID NO: 1205720 - RNA, 14 nt, Homo sapiens
uugaaugugucagg

SEQ ID NO: 1205721 - RNA, 22 nt, Homo sapiens
uugaauuaauaucccuacaugu

SEQ ID NO: 1205722 - RNA, 11 nt, Homo sapiens
uugaauuccau

SEQ ID NO: 1205723 - RNA, 14 nt, Homo sapiens
uugaauuucacugu

SEQ ID NO: 1205724 - RNA, 19 nt, Homo sapiens
uugaauuucugccaggcau

SEQ ID NO: 1205725 - RNA, 17 nt, Homo sapiens
uugacaaccaugagacc

SEQ ID NO: 1205726 - RNA, 15 nt, Homo sapiens
uugacaacugugacu

SEQ ID NO: 1205727 - RNA, 18 nt, Homo sapiens
uugacaaggcucugcuau

SEQ ID NO: 1205728 - RNA, 18 nt, Homo sapiens
uugacaauugggagcugc

SEQ ID NO: 1205729 - RNA, 19 nt, Homo sapiens
uugacacuauucacuaaaa

SEQ ID NO: 1205730 - RNA, 21 nt, Homo sapiens
uugacacucugcagacugcua

SEQ ID NO: 1205731 - RNA, 12 nt, Homo sapiens
uugaccucaggu

SEQ ID NO: 1205732 - RNA, 14 nt, Homo sapiens
uugacguuugcuca

SEQ ID NO: 1205733 - RNA, 15 nt, Homo sapiens
uugacucggauuuga

SEQ ID NO: 1205734 - RNA, 13 nt, Homo sapiens
uugagacagaguu

SEQ ID NO: 1205735 - RNA, 18 nt, Homo sapiens
uugagaguugcuggugua

SEQ ID NO: 1205736 - RNA, 20 nt, Homo sapiens
uugagaucacuacucagugc

SEQ ID NO: 1205737 - RNA, 12 nt, Homo sapiens
uugagauccaaa

SEQ ID NO: 1205738 - RNA, 14 nt, Homo sapiens
uugagcuacaguag

SEQ ID NO: 1205739 - RNA, 22 nt, Homo sapiens
uugaggagccggccaccagaug

SEQ ID NO: 1205740 - RNA, 18 nt, Homo sapiens
uugaggagcugcacugau

SEQ ID NO: 1205741 - RNA, 16 nt, Homo sapiens
uugaggauuguggaaa

SEQ ID NO: 1205742 - RNA, 17 nt, Homo sapiens
uugagucuaacacacca

SEQ ID NO: 1205743 - RNA, 20 nt, Homo sapiens
uugaguugcugccacaaaca

SEQ ID NO: 1205744 - RNA, 16 nt, Homo sapiens
uugaguuucucuccac

SEQ ID NO: 1205745 - RNA, 23 nt, Homo sapiens
uugauaaccauauaaauucugau

SEQ ID NO: 1205746 - RNA, 15 nt, Homo sapiens
uugauaagcacauua

SEQ ID NO: 1205747 - RNA, 21 nt, Homo sapiens
uugauaccauggcacugacaa

SEQ ID NO: 1205748 - RNA, 13 nt, Homo sapiens
uugauaccuguag

SEQ ID NO: 1205749 - RNA, 19 nt, Homo sapiens
uugauagcaaacacugggg

SEQ ID NO: 1205750 - RNA, 15 nt, Homo sapiens
uugauauuaucuaca

SEQ ID NO: 1205751 - RNA, 17 nt, Homo sapiens
uugauauuuuccaaaug

SEQ ID NO: 1205752 - RNA, 14 nt, Homo sapiens
uugaucaugcugca

SEQ ID NO: 1205753 - RNA, 15 nt, Homo sapiens
uugaucuuuuaguuu

SEQ ID NO: 1205754 - RNA, 22 nt, Homo sapiens
uugaugaugaaguauugcuaau

SEQ ID NO: 1205755 - RNA, 19 nt, Homo sapiens
uugaugauuaauucaccuu

SEQ ID NO: 1205756 - RNA, 14 nt, Homo sapiens
uugaugcgacugua

SEQ ID NO: 1205757 - RNA, 14 nt, Homo sapiens
uugauggucucaag

SEQ ID NO: 1205758 - RNA, 12 nt, Homo sapiens
uugauguaucug

SEQ ID NO: 1205759 - RNA, 15 nt, Homo sapiens
uugauugaaaguccu

SEQ ID NO: 1205760 - RNA, 14 nt, Homo sapiens
uugauugcuguuga

SEQ ID NO: 1205761 - RNA, 17 nt, Homo sapiens
uugauuucuuuucuucc

SEQ ID NO: 1205762 - RNA, 19 nt, Homo sapiens
uugauuugcauggauuuug

SEQ ID NO: 1205763 - RNA, 22 nt, Homo sapiens
uugcaaacccugguugcuguau

SEQ ID NO: 1205764 - RNA, 17 nt, Homo sapiens
uugcaaauaaaauacua

SEQ ID NO: 1205765 - RNA, 16 nt, Homo sapiens
uugcaaauaaaccacu

SEQ ID NO: 1205766 - RNA, 15 nt, Homo sapiens
uugcaaaucaguguu

SEQ ID NO: 1205767 - RNA, 15 nt, Homo sapiens
uugcaacacauucau

SEQ ID NO: 1205768 - RNA, 20 nt, Homo sapiens
uugcaacagcuuucugagaa

SEQ ID NO: 1205769 - RNA, 16 nt, Homo sapiens
uugcaagcuccaucuc

SEQ ID NO: 1205770 - RNA, 15 nt, Homo sapiens
uugcaauguggcuug

SEQ ID NO: 1205771 - RNA, 19 nt, Homo sapiens
uugcaauuuuuccaugaag

SEQ ID NO: 1205772 - RNA, 16 nt, Homo sapiens
uugcacacagauguga

SEQ ID NO: 1205773 - RNA, 23 nt, Homo sapiens
uugcacagcucuccggucucucu

SEQ ID NO: 1205774 - RNA, 18 nt, Homo sapiens
uugcacaggucccacugc

SEQ ID NO: 1205775 - RNA, 22 nt, Homo sapiens
uugcacauaguagguacccaau

SEQ ID NO: 1205776 - RNA, 12 nt, Homo sapiens
uugcaccaaaga

SEQ ID NO: 1205777 - RNA, 20 nt, Homo sapiens
uugcagcagugagucucuuc

SEQ ID NO: 1205778 - RNA, 15 nt, Homo sapiens
uugcagcugauguug

SEQ ID NO: 1205779 - RNA, 20 nt, Homo sapiens
uugcaggauggugucucuuc

SEQ ID NO: 1205780 - RNA, 15 nt, Homo sapiens
uaaaaccccaucucu

SEQ ID NO: 1205781 - RNA, 23 nt, Homo sapiens
uaaaacgcaugugcagcuauuua

SEQ ID NO: 1205782 - RNA, 20 nt, Homo sapiens
uaaaacuaaauguaauuuau

SEQ ID NO: 1205783 - RNA, 16 nt, Homo sapiens
uaaaacuaagcacaaa

SEQ ID NO: 1205784 - RNA, 17 nt, Homo sapiens
uaaaacuacacaucccu

SEQ ID NO: 1205785 - RNA, 17 nt, Homo sapiens
uaaaacuauauucucag

SEQ ID NO: 1205786 - RNA, 19 nt, Homo sapiens
uaaaacucaacauuacugu

SEQ ID NO: 1205787 - RNA, 20 nt, Homo sapiens
uaaaacucacugugaucaau

SEQ ID NO: 1205788 - RNA, 23 nt, Homo sapiens
uaaaacugaacuucagagcauga

SEQ ID NO: 1205789 - RNA, 12 nt, Homo sapiens
uaaaacugaugu

SEQ ID NO: 1205790 - RNA, 17 nt, Homo sapiens
uaaaacugauguuacua

SEQ ID NO: 1205791 - RNA, 19 nt, Homo sapiens
uaaaacuggcaucugacac

SEQ ID NO: 1205792 - RNA, 20 nt, Homo sapiens
uaaaacuuaccuaagugaca

SEQ ID NO: 1205793 - RNA, 18 nt, Homo sapiens
uaaaacuuuauguacugc

SEQ ID NO: 1205794 - RNA, 21 nt, Homo sapiens
uaaaacuuuccugacuuacaa

SEQ ID NO: 1205795 - RNA, 21 nt, Homo sapiens
uaaaagaauaaaauugcacuu

SEQ ID NO: 1205796 - RNA, 17 nt, Homo sapiens
uaaaagacaagcacuuu

SEQ ID NO: 1205797 - RNA, 19 nt, Homo sapiens
uaaaagacaagcacuuugg

SEQ ID NO: 1205798 - RNA, 15 nt, Homo sapiens
uaaaagacacagaac

SEQ ID NO: 1205799 - RNA, 14 nt, Homo sapiens
uaaaagcacacucc

SEQ ID NO: 1205800 - RNA, 15 nt, Homo sapiens
uaaaagcacacuccc

SEQ ID NO: 1205801 - RNA, 18 nt, Homo sapiens
uaaaagccaaccuucaaa

SEQ ID NO: 1205802 - RNA, 15 nt, Homo sapiens
uaaaagccacauaga

SEQ ID NO: 1205803 - RNA, 24 nt, Homo sapiens
uaaaagcggaaaguuagugcuugu

SEQ ID NO: 1205804 - RNA, 22 nt, Homo sapiens
uaaaagcuacuauguacugccu

SEQ ID NO: 1205805 - RNA, 23 nt, Homo sapiens
uaaaaggacucuccaaauagcau

SEQ ID NO: 1205806 - RNA, 16 nt, Homo sapiens
uaaaagguaugcaauc

SEQ ID NO: 1205807 - RNA, 19 nt, Homo sapiens
uaaaaguaaauucauguaa

SEQ ID NO: 1205808 - RNA, 15 nt, Homo sapiens
uaaaaguauuauuca

SEQ ID NO: 1205809 - RNA, 18 nt, Homo sapiens
uaaaaguauuuaguugau

SEQ ID NO: 1205810 - RNA, 12 nt, Homo sapiens
uaaaaguucuuu

SEQ ID NO: 1205811 - RNA, 20 nt, Homo sapiens
uaacuaguggcucucaguua

SEQ ID NO: 1205812 - RNA, 19 nt, Homo sapiens
uaacuauauguacagcucu

SEQ ID NO: 1205813 - RNA, 14 nt, Homo sapiens
uaacuauauuugcu

SEQ ID NO: 1205814 - RNA, 15 nt, Homo sapiens
uaacucagaauuauu

SEQ ID NO: 1205815 - RNA, 19 nt, Homo sapiens
uaacuccuagcugacucag

SEQ ID NO: 1205816 - RNA, 15 nt, Homo sapiens
uaacucuggugcucu

SEQ ID NO: 1205817 - RNA, 20 nt, Homo sapiens
uaacucuucuaacacaaaau

SEQ ID NO: 1205818 - RNA, 14 nt, Homo sapiens
uaacugaaccaaau

SEQ ID NO: 1205819 - RNA, 17 nt, Homo sapiens
uaacugaaccauuccaa

SEQ ID NO: 1205820 - RNA, 18 nt, Homo sapiens
uaacugaugacauuccac

SEQ ID NO: 1205821 - RNA, 12 nt, Homo sapiens
uaacugcaauuu

SEQ ID NO: 1205822 - RNA, 21 nt, Homo sapiens
uaacugcuuucuguuccaaau

SEQ ID NO: 1205823 - RNA, 20 nt, Homo sapiens
uaacuguagcucaaguuuaa

SEQ ID NO: 1205824 - RNA, 15 nt, Homo sapiens
uaacuguagugccuc

SEQ ID NO: 1205825 - RNA, 20 nt, Homo sapiens
uaacugugaaauaccacaag

SEQ ID NO: 1205826 - RNA, 23 nt, Homo sapiens
uaacuguucucauuuuauugcua

SEQ ID NO: 1205827 - RNA, 18 nt, Homo sapiens
uaacuuauuuuauuucca

SEQ ID NO: 1205828 - RNA, 21 nt, Homo sapiens
uaacuuggccauguucuccau

SEQ ID NO: 1205829 - RNA, 18 nt, Homo sapiens
uaacuuggucagagccac

SEQ ID NO: 1205830 - RNA, 22 nt, Homo sapiens
uaacuuguuugguaguuagcca

SEQ ID NO: 1205831 - RNA, 20 nt, Homo sapiens
uaacuuuucaaugacauuuu

SEQ ID NO: 1205832 - RNA, 20 nt, Homo sapiens
uaagaaaauacaauaaacua

SEQ ID NO: 1205833 - RNA, 16 nt, Homo sapiens
uaagaaacacugacuc

SEQ ID NO: 1205834 - RNA, 23 nt, Homo sapiens
uaagaaacauucuuuuccacuug

SEQ ID NO: 1205835 - RNA, 16 nt, Homo sapiens
uaagaaagcacuauua

SEQ ID NO: 1205836 - RNA, 19 nt, Homo sapiens
uaagaaauacuagaguaaa

SEQ ID NO: 1205837 - RNA, 19 nt, Homo sapiens
uaagaagcagccaucacau

SEQ ID NO: 1205838 - RNA, 14 nt, Homo sapiens
uaagaagucuauaa

SEQ ID NO: 1205839 - RNA, 13 nt, Homo sapiens
uaagaauaccaca

SEQ ID NO: 1205840 - RNA, 14 nt, Homo sapiens
uccucaguccacug

SEQ ID NO: 1205841 - RNA, 18 nt, Homo sapiens
uccucaguccacugcuga

SEQ ID NO: 1205842 - RNA, 13 nt, Homo sapiens
uccucaugcugcu

SEQ ID NO: 1205843 - RNA, 13 nt, Homo sapiens
uccucauuccuga

SEQ ID NO: 1205844 - RNA, 20 nt, Homo sapiens
uccuccagaagccucuggcu

SEQ ID NO: 1205845 - RNA, 16 nt, Homo sapiens
uccuccagcaccauag

SEQ ID NO: 1205846 - RNA, 18 nt, Homo sapiens
uccucccagcguguguau

SEQ ID NO: 1205847 - RNA, 11 nt, Homo sapiens
uccuccccaaa

SEQ ID NO: 1205848 - RNA, 17 nt, Homo sapiens
uccucccccagcuaucu

SEQ ID NO: 1205849 - RNA, 15 nt, Homo sapiens
uccucccucauucca

SEQ ID NO: 1205850 - RNA, 20 nt, Homo sapiens
uccucccuuccuuuucccug

SEQ ID NO: 1205851 - RNA, 10 nt, Homo sapiens
uccuccucag

SEQ ID NO: 1205852 - RNA, 14 nt, Homo sapiens
uccuccuugcccag

SEQ ID NO: 1205853 - RNA, 23 nt, Homo sapiens
uccucgggaaacacacaagcaac

SEQ ID NO: 1205854 - RNA, 17 nt, Homo sapiens
uccucuacuguuuaaca

SEQ ID NO: 1205855 - RNA, 22 nt, Homo sapiens
uccucuagcaggccuaagacau

SEQ ID NO: 1205856 - RNA, 17 nt, Homo sapiens
uccucuauuuugugaug

SEQ ID NO: 1205857 - RNA, 19 nt, Homo sapiens
uccucucaagcuagccaga

SEQ ID NO: 1205858 - RNA, 13 nt, Homo sapiens
uccucucugcaag

SEQ ID NO: 1205859 - RNA, 19 nt, Homo sapiens
uccucugcagcucagggac

SEQ ID NO: 1205860 - RNA, 14 nt, Homo sapiens
uccucuugccacug

SEQ ID NO: 1205861 - RNA, 16 nt, Homo sapiens
ggcaugccccggccac

SEQ ID NO: 1205862 - RNA, 14 nt, Homo sapiens
ggcaugugcuguga

SEQ ID NO: 1205863 - RNA, 15 nt, Homo sapiens
ggcauuguaguuaau

SEQ ID NO: 1205864 - RNA, 20 nt, Homo sapiens
ggcauugucuguaaugacaa

SEQ ID NO: 1205865 - RNA, 17 nt, Homo sapiens
ggcauuuguuuccucau

SEQ ID NO: 1205866 - RNA, 17 nt, Homo sapiens
ggccaacggcaacagca

SEQ ID NO: 1205867 - RNA, 18 nt, Homo sapiens
ggccaagcaccuagccuc

SEQ ID NO: 1205868 - RNA, 22 nt, Homo sapiens
ggccaagcauuucuagcaguga

SEQ ID NO: 1205869 - RNA, 14 nt, Homo sapiens
ggccacaccacagc

SEQ ID NO: 1205870 - RNA, 11 nt, Homo sapiens
ggccacagggc

SEQ ID NO: 1205871 - RNA, 17 nt, Homo sapiens
ggccacauagaugcuga

SEQ ID NO: 1205872 - RNA, 21 nt, Homo sapiens
ggccacccaggaacuccugac

SEQ ID NO: 1205873 - RNA, 19 nt, Homo sapiens
ggccaccccacucuaccuc

SEQ ID NO: 1205874 - RNA, 15 nt, Homo sapiens
ggccacucuaccuga

SEQ ID NO: 1205875 - RNA, 16 nt, Homo sapiens
ggccacucuaccugaa

SEQ ID NO: 1205876 - RNA, 19 nt, Homo sapiens
ggccagagggagugacaga

SEQ ID NO: 1205877 - RNA, 12 nt, Homo sapiens
ggccagcacuuc

SEQ ID NO: 1205878 - RNA, 15 nt, Homo sapiens
ggccagcacuuccau

SEQ ID NO: 1205879 - RNA, 18 nt, Homo sapiens
ggccagccagugccauuc

SEQ ID NO: 1205880 - RNA, 16 nt, Homo sapiens
ggccagcccugcagcc

SEQ ID NO: 1205881 - RNA, 23 nt, Homo sapiens
ggccaggaaggacagacuggccg

SEQ ID NO: 1205882 - RNA, 15 nt, Homo sapiens
ggccaggcacagggc

SEQ ID NO: 1205883 - RNA, 17 nt, Homo sapiens
ggccaggcuggucucaa

SEQ ID NO: 1205884 - RNA, 20 nt, Homo sapiens
ggccaggcuggucuugaacu

SEQ ID NO: 1205885 - RNA, 21 nt, Homo sapiens
ggccagggaaagcccguguca

SEQ ID NO: 1205886 - RNA, 20 nt, Homo sapiens
ggccagggucugugugaaug

SEQ ID NO: 1205887 - RNA, 13 nt, Homo sapiens
ggccagguggcca

SEQ ID NO: 1205888 - RNA, 23 nt, Homo sapiens
ggccaguaucuauauauguguau

SEQ ID NO: 1205889 - RNA, 15 nt, Homo sapiens
ggccagugggcgggc

SEQ ID NO: 1205890 - RNA, 22 nt, Homo sapiens
ggccaguggggccuguggaaug

SEQ ID NO: 1205891 - RNA, 23 nt, Homo sapiens
ggccaguugcccagagcacuuua

SEQ ID NO: 1205892 - RNA, 17 nt, Homo sapiens
ggccauaaacgguuccu

SEQ ID NO: 1205893 - RNA, 15 nt, Homo sapiens
ggccauaaagaucaa

SEQ ID NO: 1205894 - RNA, 14 nt, Homo sapiens
ggccauacugccuu

SEQ ID NO: 1205895 - RNA, 21 nt, Homo sapiens
ggccauucuuuuuuucuuggc

SEQ ID NO: 1205896 - RNA, 14 nt, Homo sapiens
ggcccaagagcaga

SEQ ID NO: 1205897 - RNA, 19 nt, Homo sapiens
ggcccaagccccaucucau

SEQ ID NO: 1205898 - RNA, 16 nt, Homo sapiens
ggcccaagucccuguu

SEQ ID NO: 1205899 - RNA, 17 nt, Homo sapiens
ggcccacuucaccguac

SEQ ID NO: 1205900 - RNA, 19 nt, Homo sapiens
ggcccagaguuuacauucu

SEQ ID NO: 1205901 - RNA, 24 nt, Homo sapiens
ggcccaggaagcccacacuaugca

SEQ ID NO: 1205902 - RNA, 16 nt, Homo sapiens
ggcccaggaccagcug

SEQ ID NO: 1205903 - RNA, 17 nt, Homo sapiens
ggcccaggcagagcuga

SEQ ID NO: 1205904 - RNA, 21 nt, Homo sapiens
ggcccagugacaaagacuccu

SEQ ID NO: 1205905 - RNA, 17 nt, Homo sapiens
ggcccaucuuacuggaa

SEQ ID NO: 1205906 - RNA, 14 nt, Homo sapiens
ggccccuccaucca

SEQ ID NO: 1205907 - RNA, 20 nt, Homo sapiens
ggccccuucucucccugcca

SEQ ID NO: 1205908 - RNA, 15 nt, Homo sapiens
ggcccucucauucuc

SEQ ID NO: 1205909 - RNA, 21 nt, Homo sapiens
ggcccuggaugguccucuuac

SEQ ID NO: 1205910 - RNA, 16 nt, Homo sapiens
ggcccuggccagaagc

SEQ ID NO: 1205911 - RNA, 19 nt, Homo sapiens
ggcccuguccuaagcacuu

SEQ ID NO: 1205912 - RNA, 17 nt, Homo sapiens
ggcccuuugaagccuca

SEQ ID NO: 1205913 - RNA, 13 nt, Homo sapiens
ggccgcacugggg

SEQ ID NO: 1205914 - RNA, 22 nt, Homo sapiens
ggccggggcccugcaccugugc

SEQ ID NO: 1205915 - RNA, 15 nt, Homo sapiens
ggccuagaccuggug

SEQ ID NO: 1205916 - RNA, 15 nt, Homo sapiens
ggccuagcgaucucu

SEQ ID NO: 1205917 - RNA, 24 nt, Homo sapiens
ggccuaggcuaccucaagacucac

SEQ ID NO: 1205918 - RNA, 13 nt, Homo sapiens
ggccuaugcacau

SEQ ID NO: 1205919 - RNA, 17 nt, Homo sapiens
ggccucagggccaggaa

SEQ ID NO: 1205920 - RNA, 12 nt, Homo sapiens
ggccuccaugac

SEQ ID NO: 1205921 - RNA, 22 nt, Homo sapiens
ggccuccuuggcaaugcauuug

SEQ ID NO: 1205922 - RNA, 20 nt, Homo sapiens
ggccucugacucugagucca

SEQ ID NO: 1205923 - RNA, 19 nt, Homo sapiens
ggccucugcccuucagaag

SEQ ID NO: 1205924 - RNA, 13 nt, Homo sapiens
ggccugagcaaca

SEQ ID NO: 1205925 - RNA, 15 nt, Homo sapiens
ggccugcacuggugu

SEQ ID NO: 1205926 - RNA, 23 nt, Homo sapiens
ggccugccuugaagccacugaag

SEQ ID NO: 1205927 - RNA, 15 nt, Homo sapiens
ggccuggacaguauc

SEQ ID NO: 1205928 - RNA, 16 nt, Homo sapiens
ggccuggccagaugca

SEQ ID NO: 1205929 - RNA, 20 nt, Homo sapiens
guuccaaauucaguuucaua

SEQ ID NO: 1205930 - RNA, 19 nt, Homo sapiens
guuccaaugucaaugugaa

SEQ ID NO: 1205931 - RNA, 22 nt, Homo sapiens
guuccacuggggcaagcuccuc

SEQ ID NO: 1205932 - RNA, 17 nt, Homo sapiens
guuccagauagcagggc

SEQ ID NO: 1205933 - RNA, 14 nt, Homo sapiens
guuccaguaccgcc

SEQ ID NO: 1205934 - RNA, 24 nt, Homo sapiens
guuccauaugugggugucagucag

SEQ ID NO: 1205935 - RNA, 13 nt, Homo sapiens
guuccaugcagcc

SEQ ID NO: 1205936 - RNA, 17 nt, Homo sapiens
guucccauuucagcuga

SEQ ID NO: 1205937 - RNA, 13 nt, Homo sapiens
guuccccacugac

SEQ ID NO: 1205938 - RNA, 23 nt, Homo sapiens
guucccccaaccaucuucacugg

SEQ ID NO: 1205939 - RNA, 16 nt, Homo sapiens
guucccucuugcucag

SEQ ID NO: 1205940 - RNA, 15 nt, Homo sapiens
guuccgagaagaaca

SEQ ID NO: 1205941 - RNA, 18 nt, Homo sapiens
guuccgcacuuuccacuu

SEQ ID NO: 1205942 - RNA, 17 nt, Homo sapiens
guuccucucugguggcu

SEQ ID NO: 1205943 - RNA, 17 nt, Homo sapiens
guuccugcuccaugacu

SEQ ID NO: 1205944 - RNA, 13 nt, Homo sapiens
guucgaagcuccg

SEQ ID NO: 1205945 - RNA, 18 nt, Homo sapiens
guucgauuucuaccucag

SEQ ID NO: 1205946 - RNA, 20 nt, Homo sapiens
guucgcauggucacacacug

SEQ ID NO: 1205947 - RNA, 19 nt, Homo sapiens
guucguggggaacugcgug

SEQ ID NO: 1205948 - RNA, 14 nt, Homo sapiens
guucuaacagugaa

SEQ ID NO: 1205949 - RNA, 23 nt, Homo sapiens
guucuaaggauggaaaggugaca

SEQ ID NO: 1205950 - RNA, 18 nt, Homo sapiens
guucuaauccaagggcca

SEQ ID NO: 1205951 - RNA, 23 nt, Homo sapiens
guucucaaaguuaauucaccuau

SEQ ID NO: 1205952 - RNA, 23 nt, Homo sapiens
guucucagagccaaguccucccu

SEQ ID NO: 1205953 - RNA, 13 nt, Homo sapiens
guucucauuugau

SEQ ID NO: 1205954 - RNA, 22 nt, Homo sapiens
guucuccccacgacaaccccac

SEQ ID NO: 1205955 - RNA, 13 nt, Homo sapiens
guucucuauacuc

SEQ ID NO: 1205956 - RNA, 22 nt, Homo sapiens
guucucuauugcugcucucuca

SEQ ID NO: 1205957 - RNA, 22 nt, Homo sapiens
guucucugcuaaaacauuuggu

SEQ ID NO: 1205958 - RNA, 16 nt, Homo sapiens
guucucuuuaagccag

SEQ ID NO: 1205959 - RNA, 14 nt, Homo sapiens
guucugaacuggaa

SEQ ID NO: 1205960 - RNA, 16 nt, Homo sapiens
guucuguccucaagua

SEQ ID NO: 1205961 - RNA, 15 nt, Homo sapiens
guucugucuacaggg

SEQ ID NO: 1205962 - RNA, 14 nt, Homo sapiens
guucugugaccacu

SEQ ID NO: 1205963 - RNA, 15 nt, Homo sapiens
guucuguuggaugac

SEQ ID NO: 1205964 - RNA, 22 nt, Homo sapiens
guucuuaaauguuuauacugua

SEQ ID NO: 1205965 - RNA, 16 nt, Homo sapiens
guucuuaauugcacuc

SEQ ID NO: 1205966 - RNA, 11 nt, Homo sapiens
guucuuaccug

SEQ ID NO: 1205967 - RNA, 17 nt, Homo sapiens
guucuuaguuugcaguu

SEQ ID NO: 1205968 - RNA, 23 nt, Homo sapiens
guucuucaagccagcucuaggcu

SEQ ID NO: 1205969 - RNA, 19 nt, Homo sapiens
guucuucagggccaguccu

SEQ ID NO: 1205970 - RNA, 16 nt, Homo sapiens
guucuucuucauugaa

SEQ ID NO: 1205971 - RNA, 22 nt, Homo sapiens
guucuucuucucuucucugcaa

SEQ ID NO: 1205972 - RNA, 16 nt, Homo sapiens
guucuugcugcuagaa

SEQ ID NO: 1205973 - RNA, 22 nt, Homo sapiens
guucuuggugaugcuggcagcc

SEQ ID NO: 1205974 - RNA, 18 nt, Homo sapiens
guucuuuaaaggcaucua

SEQ ID NO: 1205975 - RNA, 15 nt, Homo sapiens
guugaaagaucaaaa

SEQ ID NO: 1205976 - RNA, 18 nt, Homo sapiens
guugaacuuugccaaaaa

SEQ ID NO: 1205977 - RNA, 23 nt, Homo sapiens
guugaauuucccacauacccucc

SEQ ID NO: 1205978 - RNA, 19 nt, Homo sapiens
guugagaguugcuggugua

SEQ ID NO: 1205979 - RNA, 20 nt, Homo sapiens
guugagccaggccucucuca

SEQ ID NO: 1205980 - RNA, 22 nt, Homo sapiens
guugagcuucauauaccagcaa

SEQ ID NO: 1205981 - RNA, 15 nt, Homo sapiens
guugaggcugucaca

SEQ ID NO: 1205982 - RNA, 22 nt, Homo sapiens
guugaguuauuaauauguuauu

SEQ ID NO: 1205983 - RNA, 15 nt, Homo sapiens
guugauacuuguucc

SEQ ID NO: 1205984 - RNA, 19 nt, Homo sapiens
guugaucugauaagcaaga

SEQ ID NO: 1205985 - RNA, 19 nt, Homo sapiens
guugauuuaugaguaauug

SEQ ID NO: 1205986 - RNA, 19 nt, Homo sapiens
guugcaugaaauuuugccu

SEQ ID NO: 1205987 - RNA, 20 nt, Homo sapiens
guugcguggacucugcacau

SEQ ID NO: 1205988 - RNA, 16 nt, Homo sapiens
guugcuauaauaaaga

SEQ ID NO: 1205989 - RNA, 22 nt, Homo sapiens
guugcugccugugaaugcugag

SEQ ID NO: 1205990 - RNA, 16 nt, Homo sapiens
guugcugcuacugucu

SEQ ID NO: 1205991 - RNA, 18 nt, Homo sapiens
guugcuggcaguacuguu

SEQ ID NO: 1205992 - RNA, 14 nt, Homo sapiens
guugcuguuucaca

SEQ ID NO: 1205993 - RNA, 12 nt, Homo sapiens
guugcuucaggc

SEQ ID NO: 1205994 - RNA, 16 nt, Homo sapiens
guuggaaaguaacugu

SEQ ID NO: 1205995 - RNA, 16 nt, Homo sapiens
guuggaaccacggaga

SEQ ID NO: 1205996 - RNA, 13 nt, Homo sapiens
guuggaagcuugu

SEQ ID NO: 1205997 - RNA, 14 nt, Homo sapiens
guuggaagcuuguu

SEQ ID NO: 1205998 - RNA, 22 nt, Homo sapiens
guuggagaguacggcuaccugg

SEQ ID NO: 1205999 - RNA, 16 nt, Homo sapiens
guuggaugaugagcag

SEQ ID NO: 1206000 - RNA, 18 nt, Homo sapiens
guuggaugggagugggca

SEQ ID NO: 1206001 - RNA, 17 nt, Homo sapiens
guuggccucagggccag

SEQ ID NO: 1206002 - RNA, 15 nt, Homo sapiens
guugggagcacugga

SEQ ID NO: 1206003 - RNA, 22 nt, Homo sapiens
guugggcgggcgccaucuucca

SEQ ID NO: 1206004 - RNA, 15 nt, Homo sapiens
guuggugacaccuca

SEQ ID NO: 1206005 - RNA, 22 nt, Homo sapiens
guuguauaauuucgagauuugu

SEQ ID NO: 1206006 - RNA, 19 nt, Homo sapiens
guuguaucaaagugugaua

SEQ ID NO: 1206007 - RNA, 19 nt, Homo sapiens
guugucuacaccaaugccc

SEQ ID NO: 1206008 - RNA, 20 nt, Homo sapiens
guuguguucguggaacacau

SEQ ID NO: 1206009 - RNA, 16 nt, Homo sapiens
guuguuaaaaauguca

SEQ ID NO: 1206010 - RNA, 19 nt, Homo sapiens
guuguuaaugaaaauguca

SEQ ID NO: 1206011 - RNA, 19 nt, Homo sapiens
guuguucuaguaacaauac

SEQ ID NO: 1206012 - RNA, 17 nt, Homo sapiens
guuguuuucccaaagag

SEQ ID NO: 1206013 - RNA, 16 nt, Homo sapiens
guuuaaaaauacaugu

SEQ ID NO: 1206014 - RNA, 14 nt, Homo sapiens
guuuaaacagucaa

SEQ ID NO: 1206015 - RNA, 13 nt, Homo sapiens
guuuaaagucuca

SEQ ID NO: 1206016 - RNA, 14 nt, Homo sapiens
guuuaacauuugcc

SEQ ID NO: 1206017 - RNA, 20 nt, Homo sapiens
guuuaagcccagccaaguaa

SEQ ID NO: 1206018 - RNA, 22 nt, Homo sapiens
guuuacaaguaaauaguuugaa

SEQ ID NO: 1206019 - RNA, 22 nt, Homo sapiens
guuuacaauaggaguggugauu

SEQ ID NO: 1206020 - RNA, 19 nt, Homo sapiens
ggaggucauacaugcauac

SEQ ID NO: 1206021 - RNA, 20 nt, Homo sapiens
ggaggugaccccagguuucu

SEQ ID NO: 1206022 - RNA, 20 nt, Homo sapiens
ggagguggagguugcaguga

SEQ ID NO: 1206023 - RNA, 15 nt, Homo sapiens
ggagguugaagccaa

SEQ ID NO: 1206024 - RNA, 18 nt, Homo sapiens
ggagguugagaaugcagu

SEQ ID NO: 1206025 - RNA, 21 nt, Homo sapiens
ggaguacaaugcccagaucaa

SEQ ID NO: 1206026 - RNA, 16 nt, Homo sapiens
ggagucagacauuuua

SEQ ID NO: 1206027 - RNA, 14 nt, Homo sapiens
ggagucagugucug

SEQ ID NO: 1206028 - RNA, 14 nt, Homo sapiens
ggaguggcugccau

SEQ ID NO: 1206029 - RNA, 13 nt, Homo sapiens
ggaguguacuggc

SEQ ID NO: 1206030 - RNA, 20 nt, Homo sapiens
ggaguguccucuucccucuc

SEQ ID NO: 1206031 - RNA, 13 nt, Homo sapiens
ggagugugccccu

SEQ ID NO: 1206032 - RNA, 18 nt, Homo sapiens
ggaguguggccacguggg

SEQ ID NO: 1206033 - RNA, 20 nt, Homo sapiens
ggaguucccccaaccaucuu

SEQ ID NO: 1206034 - RNA, 22 nt, Homo sapiens
ggaguuccggaauuauucugug

SEQ ID NO: 1206035 - RNA, 16 nt, Homo sapiens
ggaguuggaagugaag

SEQ ID NO: 1206036 - RNA, 19 nt, Homo sapiens
ggauaaaucauaaagucag

SEQ ID NO: 1206037 - RNA, 16 nt, Homo sapiens
ggauaacucacuggaa

SEQ ID NO: 1206038 - RNA, 20 nt, Homo sapiens
ggauaaggaggcacugcuga

SEQ ID NO: 1206039 - RNA, 21 nt, Homo sapiens
ggauaaguuucuauucuguca

SEQ ID NO: 1206040 - RNA, 23 nt, Homo sapiens
ggauaauauccagccucccacaa

SEQ ID NO: 1206041 - RNA, 15 nt, Homo sapiens
ggauacgacacaugc

SEQ ID NO: 1206042 - RNA, 15 nt, Homo sapiens
ggauacuauuuaauu

SEQ ID NO: 1206043 - RNA, 17 nt, Homo sapiens
ggauagaggaaagggau

SEQ ID NO: 1206044 - RNA, 14 nt, Homo sapiens
ggauaucaaaagca

SEQ ID NO: 1206045 - RNA, 13 nt, Homo sapiens
ggauauugacaag

SEQ ID NO: 1206046 - RNA, 17 nt, Homo sapiens
ggauauugucagucuuu

SEQ ID NO: 1206047 - RNA, 17 nt, Homo sapiens
ggauccagaacugcacu

SEQ ID NO: 1206048 - RNA, 13 nt, Homo sapiens
ggauccagccacu

SEQ ID NO: 1206049 - RNA, 18 nt, Homo sapiens
ggaucccaggccagggaa

SEQ ID NO: 1206050 - RNA, 15 nt, Homo sapiens
ggauccugggucaaa

SEQ ID NO: 1206051 - RNA, 13 nt, Homo sapiens
ggaucuaccagca

SEQ ID NO: 1206052 - RNA, 21 nt, Homo sapiens
ggaucugauaaggaucuagga

SEQ ID NO: 1206053 - RNA, 13 nt, Homo sapiens
ggaucugggcaaa

SEQ ID NO: 1206054 - RNA, 15 nt, Homo sapiens
ggaucuugaaugugg

SEQ ID NO: 1206055 - RNA, 23 nt, Homo sapiens
ggaugaaucauauucauaugcag

SEQ ID NO: 1206056 - RNA, 16 nt, Homo sapiens
ggaugacccacugucc

SEQ ID NO: 1206057 - RNA, 17 nt, Homo sapiens
ggaugacuaacaagauu

SEQ ID NO: 1206058 - RNA, 19 nt, Homo sapiens
ggaugcgaggaccacuuug

SEQ ID NO: 1206059 - RNA, 19 nt, Homo sapiens
ggaugcuggccuuugcucu

SEQ ID NO: 1206060 - RNA, 15 nt, Homo sapiens
ggauggggguacuca

SEQ ID NO: 1206061 - RNA, 22 nt, Homo sapiens
ggaugggugcuuaguaaguacu

SEQ ID NO: 1206062 - RNA, 20 nt, Homo sapiens
ggaugguccucuuaccaaca

SEQ ID NO: 1206063 - RNA, 15 nt, Homo sapiens
ggaugguugaaugag

SEQ ID NO: 1206064 - RNA, 12 nt, Homo sapiens
ggauguacuuaa

SEQ ID NO: 1206065 - RNA, 13 nt, Homo sapiens
ggaugucaacagc

SEQ ID NO: 1206066 - RNA, 15 nt, Homo sapiens
ggaugucuuccuugg

SEQ ID NO: 1206067 - RNA, 16 nt, Homo sapiens
ggauuacaggcuugag

SEQ ID NO: 1206068 - RNA, 21 nt, Homo sapiens
ggauuacaggugugggccacu

SEQ ID NO: 1206069 - RNA, 21 nt, Homo sapiens
ggauuacaggugugugccacc

SEQ ID NO: 1206070 - RNA, 22 nt, Homo sapiens
ggauuagguguucaggccagua

SEQ ID NO: 1206071 - RNA, 13 nt, Homo sapiens
ggauuaugaagug

SEQ ID NO: 1206072 - RNA, 16 nt, Homo sapiens
ggauuauuuaauaaca

SEQ ID NO: 1206073 - RNA, 12 nt, Homo sapiens
ggauucuauuua

SEQ ID NO: 1206074 - RNA, 16 nt, Homo sapiens
ggauugaaauaaauga

SEQ ID NO: 1206075 - RNA, 16 nt, Homo sapiens
ggauuguuacagcuuc

SEQ ID NO: 1206076 - RNA, 18 nt, Homo sapiens
ggauuuaacagucauuua

SEQ ID NO: 1206077 - RNA, 15 nt, Homo sapiens
ggauuucauggugau

SEQ ID NO: 1206078 - RNA, 21 nt, Homo sapiens
ggauuuccuugacuucuuuga

SEQ ID NO: 1206079 - RNA, 20 nt, Homo sapiens
ggauuugaugcuguuugaca

SEQ ID NO: 1206080 - RNA, 15 nt, Homo sapiens
ggcaaaacucaguag

SEQ ID NO: 1206081 - RNA, 12 nt, Homo sapiens
ggcaaaauaugg

SEQ ID NO: 1206082 - RNA, 21 nt, Homo sapiens
ggcaaaauuaccucucuugcu

SEQ ID NO: 1206083 - RNA, 15 nt, Homo sapiens
ggcaaaguagugaau

SEQ ID NO: 1206084 - RNA, 14 nt, Homo sapiens
ggcaaagugcugua

SEQ ID NO: 1206085 - RNA, 16 nt, Homo sapiens
ggcaacuagauaucau

SEQ ID NO: 1206086 - RNA, 22 nt, Homo sapiens
ggcaacuucaguccugggagac

SEQ ID NO: 1206087 - RNA, 21 nt, Homo sapiens
uggacuuggcaggugccuguu

SEQ ID NO: 1206088 - RNA, 12 nt, Homo sapiens
uggacuuguaua

SEQ ID NO: 1206089 - RNA, 14 nt, Homo sapiens
uggagaaagagcug

SEQ ID NO: 1206090 - RNA, 18 nt, Homo sapiens
uggagaagcuagaaggca

SEQ ID NO: 1206091 - RNA, 17 nt, Homo sapiens
uggagaaucugcugcau

SEQ ID NO: 1206092 - RNA, 22 nt, Homo sapiens
uggagacaagggcaucaucuau

SEQ ID NO: 1206093 - RNA, 22 nt, Homo sapiens
uggagacacaacuauuuuucca

SEQ ID NO: 1206094 - RNA, 23 nt, Homo sapiens
uggagacaccaaccgacaggccc

SEQ ID NO: 1206095 - RNA, 21 nt, Homo sapiens
uggagacccaccccaccugca

SEQ ID NO: 1206096 - RNA, 18 nt, Homo sapiens
uggagacccugcaaacag

SEQ ID NO: 1206097 - RNA, 13 nt, Homo sapiens
uggagacugacaa

SEQ ID NO: 1206098 - RNA, 20 nt, Homo sapiens
uggagagagauguuccucuu

SEQ ID NO: 1206099 - RNA, 21 nt, Homo sapiens
uggagauucaguuuucauuug

SEQ ID NO: 1206100 - RNA, 16 nt, Homo sapiens
uggagcacaaaauuca

SEQ ID NO: 1206101 - RNA, 22 nt, Homo sapiens
uggagccaauguguggcucagu

SEQ ID NO: 1206102 - RNA, 19 nt, Homo sapiens
uggagcccauccagucucc

SEQ ID NO: 1206103 - RNA, 16 nt, Homo sapiens
uggagcccgugcagua

SEQ ID NO: 1206104 - RNA, 21 nt, Homo sapiens
uggagcccuaaccccuuccag

SEQ ID NO: 1206105 - RNA, 18 nt, Homo sapiens
uggagccuggcacaggac

SEQ ID NO: 1206106 - RNA, 12 nt, Homo sapiens
uggagccuuuga

SEQ ID NO: 1206107 - RNA, 16 nt, Homo sapiens
uggagcucagguccca

SEQ ID NO: 1206108 - RNA, 17 nt, Homo sapiens
uggaggagaaggacauu

SEQ ID NO: 1206109 - RNA, 13 nt, Homo sapiens
uggaggcacuuua

SEQ ID NO: 1206110 - RNA, 16 nt, Homo sapiens
uggaggcagcagcucc

SEQ ID NO: 1206111 - RNA, 11 nt, Homo sapiens
uggaggcuucc

SEQ ID NO: 1206112 - RNA, 16 nt, Homo sapiens
uggagggaaugcucag

SEQ ID NO: 1206113 - RNA, 15 nt, Homo sapiens
uggagggucucuagu

SEQ ID NO: 1206114 - RNA, 20 nt, Homo sapiens
uggaguacaccaaccagacc

SEQ ID NO: 1206115 - RNA, 19 nt, Homo sapiens
uggaguacuauauuuacaa

SEQ ID NO: 1206116 - RNA, 15 nt, Homo sapiens
uggagucacuguagu

SEQ ID NO: 1206117 - RNA, 13 nt, Homo sapiens
uggagugauucuc

SEQ ID NO: 1206118 - RNA, 15 nt, Homo sapiens
uggagugcucacaaa

SEQ ID NO: 1206119 - RNA, 16 nt, Homo sapiens
uggaguugacugcuca

SEQ ID NO: 1206120 - RNA, 22 nt, Homo sapiens
uggaguugggggcggcuugucu

SEQ ID NO: 1206121 - RNA, 22 nt, Homo sapiens
uggaguuuaauacagugagcuc

SEQ ID NO: 1206122 - RNA, 20 nt, Homo sapiens
uggauaaaucauuucaguau

SEQ ID NO: 1206123 - RNA, 19 nt, Homo sapiens
uggauaaguugugauuuga

SEQ ID NO: 1206124 - RNA, 19 nt, Homo sapiens
uggauacaugguuaaagga

SEQ ID NO: 1206125 - RNA, 17 nt, Homo sapiens
uggauauuugcacuuau

SEQ ID NO: 1206126 - RNA, 16 nt, Homo sapiens
uggaucaauguaaugu

SEQ ID NO: 1206127 - RNA, 12 nt, Homo sapiens
uggaucaccugu

SEQ ID NO: 1206128 - RNA, 12 nt, Homo sapiens
uggaucagaaua

SEQ ID NO: 1206129 - RNA, 16 nt, Homo sapiens
uggaucagaugaacuc

SEQ ID NO: 1206130 - RNA, 23 nt, Homo sapiens
uggauccugggucaaaaaaaaga

SEQ ID NO: 1206131 - RNA, 14 nt, Homo sapiens
uggaucuaccagca

SEQ ID NO: 1206132 - RNA, 15 nt, Homo sapiens
uggaucuaccagcau

SEQ ID NO: 1206133 - RNA, 17 nt, Homo sapiens
uggaucuaccagcauaa

SEQ ID NO: 1206134 - RNA, 22 nt, Homo sapiens
uggaucuaccagcauaaauauc

SEQ ID NO: 1206135 - RNA, 21 nt, Homo sapiens
uggaugacccuccccuaguca

SEQ ID NO: 1206136 - RNA, 13 nt, Homo sapiens
uggaugauucaga

SEQ ID NO: 1206137 - RNA, 20 nt, Homo sapiens
uggaugauucagaaauugga

SEQ ID NO: 1206138 - RNA, 22 nt, Homo sapiens
uggaugccaaccggucacccag

SEQ ID NO: 1206139 - RNA, 16 nt, Homo sapiens
uggauguacuuaagag

SEQ ID NO: 1206140 - RNA, 17 nt, Homo sapiens
uggaugucaaacaguaa

SEQ ID NO: 1206141 - RNA, 15 nt, Homo sapiens
uggaugugggguccc

SEQ ID NO: 1206142 - RNA, 15 nt, Homo sapiens
uggauucacucacuc

SEQ ID NO: 1206143 - RNA, 15 nt, Homo sapiens
uggauucagcauguc

SEQ ID NO: 1206144 - RNA, 17 nt, Homo sapiens
uggauucauauaggcca

SEQ ID NO: 1206145 - RNA, 18 nt, Homo sapiens
uggauucaucagcauuug

SEQ ID NO: 1206146 - RNA, 17 nt, Homo sapiens
uggauuccacacugcac

SEQ ID NO: 1206147 - RNA, 16 nt, Homo sapiens
uggauuccucacuuug

SEQ ID NO: 1206148 - RNA, 18 nt, Homo sapiens
uggauuccucacuuugaa

SEQ ID NO: 1206149 - RNA, 22 nt, Homo sapiens
uggauugcacguggccucuuga

SEQ ID NO: 1206150 - RNA, 17 nt, Homo sapiens
uggauugcagacuguuc

SEQ ID NO: 1206151 - RNA, 14 nt, Homo sapiens
uggauuguguuugu

SEQ ID NO: 1206152 - RNA, 15 nt, Homo sapiens
uggauuuaguuucag

SEQ ID NO: 1206153 - RNA, 22 nt, Homo sapiens
uggauuuauaguaugugacuuu

SEQ ID NO: 1206154 - RNA, 24 nt, Homo sapiens
uggauuugcaggugaacagccucc

SEQ ID NO: 1206155 - RNA, 15 nt, Homo sapiens
uggauuuuuccuuaa

SEQ ID NO: 1206156 - RNA, 14 nt, Homo sapiens
uggcaaagugcugu

SEQ ID NO: 1206157 - RNA, 21 nt, Homo sapiens
uggcaaauguaacugugccag

SEQ ID NO: 1206158 - RNA, 18 nt, Homo sapiens
uggcaacaacaaagccaa

SEQ ID NO: 1206159 - RNA, 17 nt, Homo sapiens
uggcaacagagcaagac

SEQ ID NO: 1206160 - RNA, 13 nt, Homo sapiens
uggcaacaggaca

SEQ ID NO: 1206161 - RNA, 13 nt, Homo sapiens
uggcaagaacuug

SEQ ID NO: 1206162 - RNA, 15 nt, Homo sapiens
uggcaagcagggaaa

SEQ ID NO: 1206163 - RNA, 16 nt, Homo sapiens
uggcaagucacaugcg

SEQ ID NO: 1206164 - RNA, 23 nt, Homo sapiens
uggcaagucuagagucucagaaa

SEQ ID NO: 1206165 - RNA, 16 nt, Homo sapiens
uggcaauaaacuccua

SEQ ID NO: 1206166 - RNA, 13 nt, Homo sapiens
uggcacauuucag

SEQ ID NO: 1206167 - RNA, 16 nt, Homo sapiens
uggcaccccuuucuag

SEQ ID NO: 1206168 - RNA, 18 nt, Homo sapiens
uggcacgugccugugauc

SEQ ID NO: 1206169 - RNA, 16 nt, Homo sapiens
uggcacugacaauggg

SEQ ID NO: 1206170 - RNA, 16 nt, Homo sapiens
uggcacugacugggca

SEQ ID NO: 1206171 - RNA, 11 nt, Homo sapiens
uggcacuuuga

SEQ ID NO: 1206172 - RNA, 19 nt, Homo sapiens
uggcagaaccaaagcucaa

SEQ ID NO: 1206173 - RNA, 13 nt, Homo sapiens
uggcagaagucaa

SEQ ID NO: 1206174 - RNA, 12 nt, Homo sapiens
uggcagagccag

SEQ ID NO: 1206175 - RNA, 15 nt, Homo sapiens
uggcagauuuuacaa

SEQ ID NO: 1206176 - RNA, 21 nt, Homo sapiens
uggcagcaucuucacuucuaa

SEQ ID NO: 1206177 - RNA, 15 nt, Homo sapiens
uggcagccauggcca

SEQ ID NO: 1206178 - RNA, 16 nt, Homo sapiens
uggcagccgugccuuc

SEQ ID NO: 1206179 - RNA, 17 nt, Homo sapiens
uggcagccgugccuuca

SEQ ID NO: 1206180 - RNA, 19 nt, Homo sapiens
uggcagucugaauuuuuaa

SEQ ID NO: 1206181 - RNA, 17 nt, Homo sapiens
uggcagucugcccugca

SEQ ID NO: 1206182 - RNA, 21 nt, Homo sapiens
uggcagugggagcugccuguu

SEQ ID NO: 1206183 - RNA, 16 nt, Homo sapiens
uggcauagccccggcc

SEQ ID NO: 1206184 - RNA, 21 nt, Homo sapiens
uggcauaggccuuagcaguaa

SEQ ID NO: 1206185 - RNA, 21 nt, Homo sapiens
uggcauugucuguaaugacaa

SEQ ID NO: 1206186 - RNA, 17 nt, Homo sapiens
uggcauuuccuggucag

SEQ ID NO: 1206187 - RNA, 14 nt, Homo sapiens
uggccaaaagcuag

SEQ ID NO: 1206188 - RNA, 16 nt, Homo sapiens
uggccaacaugaugaa

SEQ ID NO: 1206189 - RNA, 14 nt, Homo sapiens
uggccaaugugcau

SEQ ID NO: 1206190 - RNA, 13 nt, Homo sapiens
ucaauacagugaa

SEQ ID NO: 1206191 - RNA, 12 nt, Homo sapiens
ucaauacuaugg

SEQ ID NO: 1206192 - RNA, 20 nt, Homo sapiens
ucaauacuauggaguaccau

SEQ ID NO: 1206193 - RNA, 21 nt, Homo sapiens
ucaaucauaauaccugcugug

SEQ ID NO: 1206194 - RNA, 15 nt, Homo sapiens
ucaaucauugagugg

SEQ ID NO: 1206195 - RNA, 16 nt, Homo sapiens
ucaauccgaaguauga

SEQ ID NO: 1206196 - RNA, 21 nt, Homo sapiens
ucaauccuaaaagcaugucaa

SEQ ID NO: 1206197 - RNA, 17 nt, Homo sapiens
ucaaucuuuaacaaccu

SEQ ID NO: 1206198 - RNA, 21 nt, Homo sapiens
ucaaucuuuggaggcuuuuaa

SEQ ID NO: 1206199 - RNA, 23 nt, Homo sapiens
ucaaugaaaaaaaguacauguau

SEQ ID NO: 1206200 - RNA, 20 nt, Homo sapiens
ucaaugaauuuuauaaucug

SEQ ID NO: 1206201 - RNA, 20 nt, Homo sapiens
ucaaugccucacgagauuug

SEQ ID NO: 1206202 - RNA, 19 nt, Homo sapiens
ucaaugccuggagacagau

SEQ ID NO: 1206203 - RNA, 15 nt, Homo sapiens
ucaaugccugucuua

SEQ ID NO: 1206204 - RNA, 15 nt, Homo sapiens
ucaauggacuggaag

SEQ ID NO: 1206205 - RNA, 10 nt, Homo sapiens
ucaauggagu

SEQ ID NO: 1206206 - RNA, 16 nt, Homo sapiens
ucaaugguagcauuua

SEQ ID NO: 1206207 - RNA, 17 nt, Homo sapiens
ucaaugguagcauuuag

SEQ ID NO: 1206208 - RNA, 13 nt, Homo sapiens
ucaaugugcagug

SEQ ID NO: 1206209 - RNA, 22 nt, Homo sapiens
ucaaugugucuuucuaagaaau

SEQ ID NO: 1206210 - RNA, 23 nt, Homo sapiens
ucaauguuuguaauaauugcuca

SEQ ID NO: 1206211 - RNA, 15 nt, Homo sapiens
ucaauguuuguccug

SEQ ID NO: 1206212 - RNA, 20 nt, Homo sapiens
ucaauguuuguccuguauaa

SEQ ID NO: 1206213 - RNA, 20 nt, Homo sapiens
ucaauuacggacucuggaua

SEQ ID NO: 1206214 - RNA, 19 nt, Homo sapiens
ucaauuauacuaaaccuca

SEQ ID NO: 1206215 - RNA, 22 nt, Homo sapiens
ucaauucccacguagacucuua

SEQ ID NO: 1206216 - RNA, 15 nt, Homo sapiens
ucaauuuaaauaacc

SEQ ID NO: 1206217 - RNA, 14 nt, Homo sapiens
ucaauuucuacuuc

SEQ ID NO: 1206218 - RNA, 16 nt, Homo sapiens
ucacaaaccaugcaaa

SEQ ID NO: 1206219 - RNA, 19 nt, Homo sapiens
ucacaaacuuuuauacucu

SEQ ID NO: 1206220 - RNA, 23 nt, Homo sapiens
ucacaaagaguucuggaaaagaa

SEQ ID NO: 1206221 - RNA, 10 nt, Homo sapiens
ucacaaagug

SEQ ID NO: 1206222 - RNA, 23 nt, Homo sapiens
ucacaaaugaucgcuaucuagca

SEQ ID NO: 1206223 - RNA, 13 nt, Homo sapiens
ucacaacagugaa

SEQ ID NO: 1206224 - RNA, 15 nt, Homo sapiens
ucacaacagugaaaa

SEQ ID NO: 1206225 - RNA, 20 nt, Homo sapiens
ucacaagaauuuaaaacgca

SEQ ID NO: 1206226 - RNA, 19 nt, Homo sapiens
ucacaagcaugaagugcug

SEQ ID NO: 1206227 - RNA, 23 nt, Homo sapiens
ucacaauccuguggaucugggca

SEQ ID NO: 1206228 - RNA, 11 nt, Homo sapiens
ucacacacuga

SEQ ID NO: 1206229 - RNA, 17 nt, Homo sapiens
ucacacagagaggcaga

SEQ ID NO: 1206230 - RNA, 20 nt, Homo sapiens
ucacacccugcaaggcccac

SEQ ID NO: 1206231 - RNA, 11 nt, Homo sapiens
ucacacuuugc

SEQ ID NO: 1206232 - RNA, 14 nt, Homo sapiens
ucacacuuugccau

SEQ ID NO: 1206233 - RNA, 19 nt, Homo sapiens
ucacagacuggcaacaaga

SEQ ID NO: 1206234 - RNA, 14 nt, Homo sapiens
ucacagcagccucc

SEQ ID NO: 1206235 - RNA, 16 nt, Homo sapiens
ucacagcuaguuugag

SEQ ID NO: 1206236 - RNA, 21 nt, Homo sapiens
ucacaguaacccaaaccucaa

SEQ ID NO: 1206237 - RNA, 18 nt, Homo sapiens
ucacaguacagcaugugc

SEQ ID NO: 1206238 - RNA, 12 nt, Homo sapiens
ucacagugcaag

SEQ ID NO: 1206239 - RNA, 12 nt, Homo sapiens
ucacaucuccag

SEQ ID NO: 1206240 - RNA, 14 nt, Homo sapiens
ucacaucugucacg

SEQ ID NO: 1206241 - RNA, 14 nt, Homo sapiens
ucacaucuguccag

SEQ ID NO: 1206242 - RNA, 15 nt, Homo sapiens
ucacaugaccugauc

SEQ ID NO: 1206243 - RNA, 12 nt, Homo sapiens
ucacaugcacag

SEQ ID NO: 1206244 - RNA, 18 nt, Homo sapiens
ucacauuccucugcccuu

SEQ ID NO: 1206245 - RNA, 18 nt, Homo sapiens
ucacauucgaauucgggu

SEQ ID NO: 1206246 - RNA, 19 nt, Homo sapiens
ucacauuguuugcugcuau

SEQ ID NO: 1206247 - RNA, 19 nt, Homo sapiens
ucacauuuucucagugugc

SEQ ID NO: 1206248 - RNA, 17 nt, Homo sapiens
ucaccaaacacaagaaa

SEQ ID NO: 1206249 - RNA, 19 nt, Homo sapiens
ucaccaaaucagcugcuac

SEQ ID NO: 1206250 - RNA, 20 nt, Homo sapiens
ucaccaacugaaguggcuaa

SEQ ID NO: 1206251 - RNA, 16 nt, Homo sapiens
ucaccaaggugacaca

SEQ ID NO: 1206252 - RNA, 17 nt, Homo sapiens
ucaccacaugugcacau

SEQ ID NO: 1206253 - RNA, 15 nt, Homo sapiens
ucaccacuccauucc

SEQ ID NO: 1206254 - RNA, 23 nt, Homo sapiens
ucaccacugaaacccugcacuua

SEQ ID NO: 1206255 - RNA, 15 nt, Homo sapiens
ucaccagagcauuuc

SEQ ID NO: 1206256 - RNA, 15 nt, Homo sapiens
ucaccagauuugcua

SEQ ID NO: 1206257 - RNA, 19 nt, Homo sapiens
ucaccagccccacugccag

SEQ ID NO: 1206258 - RNA, 12 nt, Homo sapiens
ucaccaggggag

SEQ ID NO: 1206259 - RNA, 19 nt, Homo sapiens
ucaccaggggugcucaccu

SEQ ID NO: 1206260 - RNA, 21 nt, Homo sapiens
ucaccaugaagcgaaacacag

SEQ ID NO: 1206261 - RNA, 23 nt, Homo sapiens
ucaccaugcugaauguacacuga

SEQ ID NO: 1206262 - RNA, 13 nt, Homo sapiens
ucacccaaaacaa

SEQ ID NO: 1206263 - RNA, 13 nt, Homo sapiens
ucacccauggaac

SEQ ID NO: 1206264 - RNA, 22 nt, Homo sapiens
ucacccauuuacacauauccac

SEQ ID NO: 1206265 - RNA, 17 nt, Homo sapiens
ucaccccuauggugcuc

SEQ ID NO: 1206266 - RNA, 14 nt, Homo sapiens
ucacccucaugaaa

SEQ ID NO: 1206267 - RNA, 13 nt, Homo sapiens
ucacccugccuua

SEQ ID NO: 1206268 - RNA, 16 nt, Homo sapiens
ucacccuuaacccaag

SEQ ID NO: 1206269 - RNA, 17 nt, Homo sapiens
ucacccuuggacaagac

SEQ ID NO: 1206270 - RNA, 16 nt, Homo sapiens
ucacccuuguccuuga

SEQ ID NO: 1206271 - RNA, 16 nt, Homo sapiens
ucaccgacaacaugcu

SEQ ID NO: 1206272 - RNA, 18 nt, Homo sapiens
ucaccggucagugccuuu

SEQ ID NO: 1206273 - RNA, 14 nt, Homo sapiens
ucaccgugagcagc

SEQ ID NO: 1206274 - RNA, 15 nt, Homo sapiens
ucaccuagcucaaug

SEQ ID NO: 1206275 - RNA, 20 nt, Homo sapiens
ucaccucuccuacucacuua

SEQ ID NO: 1206276 - RNA, 15 nt, Homo sapiens
ucaccucugccuugg

SEQ ID NO: 1206277 - RNA, 21 nt, Homo sapiens
ucaccuggacuuaagcaucug

SEQ ID NO: 1206278 - RNA, 18 nt, Homo sapiens
ucaccuggaugugcagcc

SEQ ID NO: 1206279 - RNA, 19 nt, Homo sapiens
ucaccugucaucucacauu

SEQ ID NO: 1206280 - RNA, 12 nt, Homo sapiens
ucaccuuauuca

SEQ ID NO: 1206281 - RNA, 23 nt, Homo sapiens
ucaccuuggaggcccugcacugc

SEQ ID NO: 1206282 - RNA, 18 nt, Homo sapiens
ucacgcaugugugcugca

SEQ ID NO: 1206283 - RNA, 11 nt, Homo sapiens
ucacgcugggg

SEQ ID NO: 1206284 - RNA, 20 nt, Homo sapiens
ucacuaaaaaggaaacuuca

SEQ ID NO: 1206285 - RNA, 19 nt, Homo sapiens
ucacuaccaagcagcucac

SEQ ID NO: 1206286 - RNA, 22 nt, Homo sapiens
ucacuagccaugauaacugcaa

SEQ ID NO: 1206287 - RNA, 19 nt, Homo sapiens
ucacuaggaugcagaugga

SEQ ID NO: 1206288 - RNA, 21 nt, Homo sapiens
ucacuaggcccccacuugccu

SEQ ID NO: 1206289 - RNA, 22 nt, Homo sapiens
ucacuaggcccccacuugccuc

SEQ ID NO: 1206290 - RNA, 15 nt, Homo sapiens
ucacuauccaugcac

SEQ ID NO: 1206291 - RNA, 14 nt, Homo sapiens
ucacucaaccuuau

SEQ ID NO: 1206292 - RNA, 13 nt, Homo sapiens
ucacucaagcacu

SEQ ID NO: 1206293 - RNA, 17 nt, Homo sapiens
ucacucaccaucuggaa

SEQ ID NO: 1206294 - RNA, 13 nt, Homo sapiens
ucacucagaggaa

SEQ ID NO: 1206295 - RNA, 15 nt, Homo sapiens
ucacucauccauccc

SEQ ID NO: 1206296 - RNA, 17 nt, Homo sapiens
ucacuccaaugucugcu

SEQ ID NO: 1206297 - RNA, 12 nt, Homo sapiens
ucacuccccaag

SEQ ID NO: 1206298 - RNA, 23 nt, Homo sapiens
ucacuccuuuuuugcaugugcaa

SEQ ID NO: 1206299 - RNA, 16 nt, Homo sapiens
ucacucugaauccuca

SEQ ID NO: 1206300 - RNA, 23 nt, Homo sapiens
ucacucuguaguuacugugguca

SEQ ID NO: 1206301 - RNA, 11 nt, Homo sapiens
ucacucuguca

SEQ ID NO: 1206302 - RNA, 18 nt, Homo sapiens
ucacucuuaggcacuuug

SEQ ID NO: 1206303 - RNA, 17 nt, Homo sapiens
ucacugacucaagacac

SEQ ID NO: 1206304 - RNA, 22 nt, Homo sapiens
ucacugagaagauugugaauau

SEQ ID NO: 1206305 - RNA, 11 nt, Homo sapiens
ucacugagcuc

SEQ ID NO: 1206306 - RNA, 22 nt, Homo sapiens
ucacugcacugcaugcaaacaa

SEQ ID NO: 1206307 - RNA, 18 nt, Homo sapiens
ucacugcuugaugaagca

SEQ ID NO: 1206308 - RNA, 24 nt, Homo sapiens
ucacuggccccuacuuuguggcaa

SEQ ID NO: 1206309 - RNA, 14 nt, Homo sapiens
ucacuggcuguuaa

SEQ ID NO: 1206310 - RNA, 15 nt, Homo sapiens
ucacuguauaaacuu

SEQ ID NO: 1206311 - RNA, 16 nt, Homo sapiens
ucacugugacaaaagc

SEQ ID NO: 1206312 - RNA, 15 nt, Homo sapiens
ucacuguggucaucc

SEQ ID NO: 1206313 - RNA, 15 nt, Homo sapiens
ucacuuaauccuuug

SEQ ID NO: 1206314 - RNA, 16 nt, Homo sapiens
ucacuucaauguguca

SEQ ID NO: 1206315 - RNA, 12 nt, Homo sapiens
ucacuucacccu

SEQ ID NO: 1206316 - RNA, 15 nt, Homo sapiens
ucacuucauaaucca

SEQ ID NO: 1206317 - RNA, 18 nt, Homo sapiens
ucauuuuuuucacuggag

SEQ ID NO: 1206318 - RNA, 14 nt, Homo sapiens
uccaaaacauuucu

SEQ ID NO: 1206319 - RNA, 21 nt, Homo sapiens
uccaaaacuaauuuccucuga

SEQ ID NO: 1206320 - RNA, 14 nt, Homo sapiens
uccaaaacuuuaau

SEQ ID NO: 1206321 - RNA, 16 nt, Homo sapiens
uccaaaagcacagacu

SEQ ID NO: 1206322 - RNA, 18 nt, Homo sapiens
uccaaacauuaaugcaau

SEQ ID NO: 1206323 - RNA, 19 nt, Homo sapiens
uccaaaccuccacugcugc

SEQ ID NO: 1206324 - RNA, 20 nt, Homo sapiens
uccaaagaagguguuuuccu

SEQ ID NO: 1206325 - RNA, 17 nt, Homo sapiens
uccaaagacuguacugg

SEQ ID NO: 1206326 - RNA, 15 nt, Homo sapiens
uccaaagaggcugcc

SEQ ID NO: 1206327 - RNA, 22 nt, Homo sapiens
uccaaagaggcugccccucuca

SEQ ID NO: 1206328 - RNA, 23 nt, Homo sapiens
uccaaagaguagaauugcauuga

SEQ ID NO: 1206329 - RNA, 17 nt, Homo sapiens
uccaaaggaaucuccag

SEQ ID NO: 1206330 - RNA, 20 nt, Homo sapiens
uccaaaguccacacaaagau

SEQ ID NO: 1206331 - RNA, 21 nt, Homo sapiens
uccaaaguugccacagaugau

SEQ ID NO: 1206332 - RNA, 15 nt, Homo sapiens
uccaaauaacaucaa

SEQ ID NO: 1206333 - RNA, 17 nt, Homo sapiens
uccaaauauuguugaca

SEQ ID NO: 1206334 - RNA, 13 nt, Homo sapiens
uccaaaugccaac

SEQ ID NO: 1206335 - RNA, 23 nt, Homo sapiens
uccaaauuuggcucacuugccuu

SEQ ID NO: 1206336 - RNA, 15 nt, Homo sapiens
uccaacaaaccacac

SEQ ID NO: 1206337 - RNA, 14 nt, Homo sapiens
uccaacaccacaga

SEQ ID NO: 1206338 - RNA, 19 nt, Homo sapiens
uccaacauuucucacugaa

SEQ ID NO: 1206339 - RNA, 13 nt, Homo sapiens
uccaacccacugg

SEQ ID NO: 1206340 - RNA, 20 nt, Homo sapiens
uccaacccauuuaaucacca

SEQ ID NO: 1206341 - RNA, 22 nt, Homo sapiens
uccaacucagauugagcccuac

SEQ ID NO: 1206342 - RNA, 12 nt, Homo sapiens
uccaacuguaua

SEQ ID NO: 1206343 - RNA, 13 nt, Homo sapiens
uccaagaacaauu

SEQ ID NO: 1206344 - RNA, 13 nt, Homo sapiens
uccaagaauuuga

SEQ ID NO: 1206345 - RNA, 22 nt, Homo sapiens
uccaagccauucacuuccccaa

SEQ ID NO: 1206346 - RNA, 16 nt, Homo sapiens
uccaaggacauauugc

SEQ ID NO: 1206347 - RNA, 20 nt, Homo sapiens
uccaaggaggggcuguaaaa

SEQ ID NO: 1206348 - RNA, 14 nt, Homo sapiens
uccaaggguacuaa

SEQ ID NO: 1206349 - RNA, 20 nt, Homo sapiens
uccaagucucucugugaaua

SEQ ID NO: 1206350 - RNA, 18 nt, Homo sapiens
uccaagucuguaccucaa

SEQ ID NO: 1206351 - RNA, 12 nt, Homo sapiens
uccaauacucag

SEQ ID NO: 1206352 - RNA, 17 nt, Homo sapiens
uccaauauuggagcaua

SEQ ID NO: 1206353 - RNA, 13 nt, Homo sapiens
uccaaucagguag

SEQ ID NO: 1206354 - RNA, 13 nt, Homo sapiens
uccaaucugugau

SEQ ID NO: 1206355 - RNA, 15 nt, Homo sapiens
uccaaucugugauga

SEQ ID NO: 1206356 - RNA, 20 nt, Homo sapiens
uccaauguaccguuuccuua

SEQ ID NO: 1206357 - RNA, 12 nt, Homo sapiens
uccaauguagcu

SEQ ID NO: 1206358 - RNA, 19 nt, Homo sapiens
uccaaugucugcugaggag

SEQ ID NO: 1206359 - RNA, 13 nt, Homo sapiens
uccaauuucaaga

SEQ ID NO: 1206360 - RNA, 22 nt, Homo sapiens
uccaauuucucuuuacuugaaa

SEQ ID NO: 1206361 - RNA, 17 nt, Homo sapiens
uccacaaaaucugucca

SEQ ID NO: 1206362 - RNA, 21 nt, Homo sapiens
uccacaaaugguggguacaaa

SEQ ID NO: 1206363 - RNA, 22 nt, Homo sapiens
uccacaaugaugaugauuucag

SEQ ID NO: 1206364 - RNA, 22 nt, Homo sapiens
uccacacaagggaaggacagaa

SEQ ID NO: 1206365 - RNA, 14 nt, Homo sapiens
uccacacaucuccc

SEQ ID NO: 1206366 - RNA, 12 nt, Homo sapiens
uccacaccaagc

SEQ ID NO: 1206367 - RNA, 22 nt, Homo sapiens
uccacacccacuuuguccauuu

SEQ ID NO: 1206368 - RNA, 14 nt, Homo sapiens
uccacacccagcuc

SEQ ID NO: 1206369 - RNA, 17 nt, Homo sapiens
uccacaccugggcauuu

SEQ ID NO: 1206370 - RNA, 14 nt, Homo sapiens
uccacacuaccaca

SEQ ID NO: 1206371 - RNA, 16 nt, Homo sapiens
uccacaguguucauuu

SEQ ID NO: 1206372 - RNA, 18 nt, Homo sapiens
uccacauauagagcucca

SEQ ID NO: 1206373 - RNA, 14 nt, Homo sapiens
uccacauuauacau

SEQ ID NO: 1206374 - RNA, 18 nt, Homo sapiens
uccacauuauacauuuga

SEQ ID NO: 1206375 - RNA, 12 nt, Homo sapiens
uccaccaagaaa

SEQ ID NO: 1206376 - RNA, 18 nt, Homo sapiens
uccaccaagaucaagcag

SEQ ID NO: 1206377 - RNA, 17 nt, Homo sapiens
uccaccaagugucuaga

SEQ ID NO: 1206378 - RNA, 15 nt, Homo sapiens
uccaccaugagcuca

SEQ ID NO: 1206379 - RNA, 19 nt, Homo sapiens
uccacccacaguucagacc

SEQ ID NO: 1206380 - RNA, 21 nt, Homo sapiens
uccaccccagcaggacaguga

SEQ ID NO: 1206381 - RNA, 19 nt, Homo sapiens
uccaccccauccaauuuau

SEQ ID NO: 1206382 - RNA, 13 nt, Homo sapiens
uccacccuuggcc

SEQ ID NO: 1206383 - RNA, 20 nt, Homo sapiens
uccaccucccaacacuguca

SEQ ID NO: 1206384 - RNA, 17 nt, Homo sapiens
uccaccuccuaccccau

SEQ ID NO: 1206385 - RNA, 20 nt, Homo sapiens
uccacgaagccuuaagccau

SEQ ID NO: 1206386 - RNA, 16 nt, Homo sapiens
uccacgauucacucau

SEQ ID NO: 1206387 - RNA, 22 nt, Homo sapiens
uccacucagcuguccugcagca

SEQ ID NO: 1206388 - RNA, 16 nt, Homo sapiens
uccacucccuuugcca

SEQ ID NO: 1206389 - RNA, 16 nt, Homo sapiens
uccacucuugugguca

SEQ ID NO: 1206390 - RNA, 11 nt, Homo sapiens
uccacugccuc

SEQ ID NO: 1206391 - RNA, 20 nt, Homo sapiens
uccacugcugaggacacuca

SEQ ID NO: 1206392 - RNA, 19 nt, Homo sapiens
uccacuggggaaugcuccc

SEQ ID NO: 1206393 - RNA, 18 nt, Homo sapiens
uccacugguggaccacgg

SEQ ID NO: 1206394 - RNA, 15 nt, Homo sapiens
uccacugucaagaaa

SEQ ID NO: 1206395 - RNA, 14 nt, Homo sapiens
uccacugugccaug

SEQ ID NO: 1206396 - RNA, 15 nt, Homo sapiens
uccacugugccaugu

SEQ ID NO: 1206397 - RNA, 20 nt, Homo sapiens
uccacuuagaaauugcauuu

SEQ ID NO: 1206398 - RNA, 16 nt, Homo sapiens
uccacuuauaaaggaa

SEQ ID NO: 1206399 - RNA, 13 nt, Homo sapiens
uccacuucuuccu

SEQ ID NO: 1206400 - RNA, 14 nt, Homo sapiens
uccacuucuuccuu

SEQ ID NO: 1206401 - RNA, 22 nt, Homo sapiens
uccagaaccgccgaaugaagca

SEQ ID NO: 1206402 - RNA, 16 nt, Homo sapiens
uccagaccaaccuucc

SEQ ID NO: 1206403 - RNA, 18 nt, Homo sapiens
uccagaccaaccuuccau

SEQ ID NO: 1206404 - RNA, 14 nt, Homo sapiens
uccagacccggcug

SEQ ID NO: 1206405 - RNA, 22 nt, Homo sapiens
uccagacuugggaaacuauuca

SEQ ID NO: 1206406 - RNA, 15 nt, Homo sapiens
uccagagauggucac

SEQ ID NO: 1206407 - RNA, 16 nt, Homo sapiens
uccagaguaagugaug

SEQ ID NO: 1206408 - RNA, 15 nt, Homo sapiens
uccagaguaugcaac

SEQ ID NO: 1206409 - RNA, 14 nt, Homo sapiens
uccagcaaccuaua

SEQ ID NO: 1206410 - RNA, 20 nt, Homo sapiens
uccagcaauuccugagccaa

SEQ ID NO: 1206411 - RNA, 20 nt, Homo sapiens
uccagcaccuucccucucac

SEQ ID NO: 1206412 - RNA, 14 nt, Homo sapiens
uccagcacuggaag

SEQ ID NO: 1206413 - RNA, 17 nt, Homo sapiens
uccagcagaugccacau

SEQ ID NO: 1206414 - RNA, 13 nt, Homo sapiens
uccagcagcugcg

SEQ ID NO: 1206415 - RNA, 14 nt, Homo sapiens
uccagccacaggca

SEQ ID NO: 1206416 - RNA, 15 nt, Homo sapiens
uccagcccugcagcu

SEQ ID NO: 1206417 - RNA, 17 nt, Homo sapiens
uccagcccugcagcuau

SEQ ID NO: 1206418 - RNA, 19 nt, Homo sapiens
uccagccgaagcugcaggg

SEQ ID NO: 1206419 - RNA, 17 nt, Homo sapiens
uccagccucuccuccau

SEQ ID NO: 1206420 - RNA, 15 nt, Homo sapiens
uccagcucaccagcc

SEQ ID NO: 1206421 - RNA, 14 nt, Homo sapiens
uccagcucuaauaa

SEQ ID NO: 1206422 - RNA, 23 nt, Homo sapiens
uccagcuggaagggucaacaucu

SEQ ID NO: 1206423 - RNA, 16 nt, Homo sapiens
uccaggaaggcagcug

SEQ ID NO: 1206424 - RNA, 13 nt, Homo sapiens
uccaggagcucag

SEQ ID NO: 1206425 - RNA, 16 nt, Homo sapiens
uccaggaucuuugacu

SEQ ID NO: 1206426 - RNA, 16 nt, Homo sapiens
uccaggccugcagcag

SEQ ID NO: 1206427 - RNA, 15 nt, Homo sapiens
uccagggacaaagag

SEQ ID NO: 1206428 - RNA, 19 nt, Homo sapiens
uccagggucugagugcaag

SEQ ID NO: 1206429 - RNA, 23 nt, Homo sapiens
uccaggucaggaugcacauuucu

SEQ ID NO: 1206430 - RNA, 21 nt, Homo sapiens
uccagguuauugcaauaaagu

SEQ ID NO: 1206431 - RNA, 22 nt, Homo sapiens
uccagguuuaugaaugacagua

SEQ ID NO: 1206432 - RNA, 11 nt, Homo sapiens
uccaguaccau

SEQ ID NO: 1206433 - RNA, 17 nt, Homo sapiens
uccaguauccacuuugc

SEQ ID NO: 1206434 - RNA, 21 nt, Homo sapiens
uccaguauugaaaacuucaaa

SEQ ID NO: 1206435 - RNA, 16 nt, Homo sapiens
uccagucccaugaccu

SEQ ID NO: 1206436 - RNA, 15 nt, Homo sapiens
uccagugagcacuag

SEQ ID NO: 1206437 - RNA, 13 nt, Homo sapiens
uccagugcaggag

SEQ ID NO: 1206438 - RNA, 15 nt, Homo sapiens
uccagugcaggagac

SEQ ID NO: 1206439 - RNA, 11 nt, Homo sapiens
uccagugccag

SEQ ID NO: 1206440 - RNA, 15 nt, Homo sapiens
uccaguucugacaca

SEQ ID NO: 1206441 - RNA, 13 nt, Homo sapiens
uccaguuggcuuu

SEQ ID NO: 1206442 - RNA, 20 nt, Homo sapiens
uccaguuuaaugaacuacca

SEQ ID NO: 1206443 - RNA, 15 nt, Homo sapiens
uccauaaagcacauu

SEQ ID NO: 1206444 - RNA, 15 nt, Homo sapiens
uguauucaccaccaa

SEQ ID NO: 1206445 - RNA, 19 nt, Homo sapiens
uguauucuagcuaauguaa

SEQ ID NO: 1206446 - RNA, 18 nt, Homo sapiens
uguauucuucaaccucau

SEQ ID NO: 1206447 - RNA, 19 nt, Homo sapiens
uguauuguucccagugaca

SEQ ID NO: 1206448 - RNA, 16 nt, Homo sapiens
uguauuuuaugaucuu

SEQ ID NO: 1206449 - RNA, 16 nt, Homo sapiens
uguauuuucagcucaa

SEQ ID NO: 1206450 - RNA, 22 nt, Homo sapiens
uguauuuucuuacacuguguca

SEQ ID NO: 1206451 - RNA, 16 nt, Homo sapiens
ugucaaacaguaauaa

SEQ ID NO: 1206452 - RNA, 13 nt, Homo sapiens
ugucaaagcuuug

SEQ ID NO: 1206453 - RNA, 20 nt, Homo sapiens
ugucaagcugaaaacaaaca

SEQ ID NO: 1206454 - RNA, 15 nt, Homo sapiens
ugucaaggcaguugc

SEQ ID NO: 1206455 - RNA, 18 nt, Homo sapiens
ugucaaugccugucuuag

SEQ ID NO: 1206456 - RNA, 20 nt, Homo sapiens
ugucaaugugaacguccaca

SEQ ID NO: 1206457 - RNA, 19 nt, Homo sapiens
ugucaauuucccucagguu

SEQ ID NO: 1206458 - RNA, 16 nt, Homo sapiens
ugucacaaauugauca

SEQ ID NO: 1206459 - RNA, 19 nt, Homo sapiens
ugucacacgauaaagggau

SEQ ID NO: 1206460 - RNA, 15 nt, Homo sapiens
ugucacagggccaac

SEQ ID NO: 1206461 - RNA, 22 nt, Homo sapiens
ugucaccagcuaucugucaucu

SEQ ID NO: 1206462 - RNA, 20 nt, Homo sapiens
ugucaccggucagugccuuu

SEQ ID NO: 1206463 - RNA, 21 nt, Homo sapiens
ugucaccucccugaaauugca

SEQ ID NO: 1206464 - RNA, 18 nt, Homo sapiens
ugucacuaaacucucauu

SEQ ID NO: 1206465 - RNA, 22 nt, Homo sapiens
ugucacucuguaguuacugugg

SEQ ID NO: 1206466 - RNA, 18 nt, Homo sapiens
ugucacugacacaaagga

SEQ ID NO: 1206467 - RNA, 16 nt, Homo sapiens
ugucacuggaugucaa

SEQ ID NO: 1206468 - RNA, 18 nt, Homo sapiens
ugucacuguuccuuguca

SEQ ID NO: 1206469 - RNA, 15 nt, Homo sapiens
ugucagaaugcuauu

SEQ ID NO: 1206470 - RNA, 12 nt, Homo sapiens
ugucagacauaa

SEQ ID NO: 1206471 - RNA, 19 nt, Homo sapiens
ugucagaugagaacaaagc

SEQ ID NO: 1206472 - RNA, 17 nt, Homo sapiens
ugucagauguacauaga

SEQ ID NO: 1206473 - RNA, 20 nt, Homo sapiens
ugucaggcaugaagaagcca

SEQ ID NO: 1206474 - RNA, 20 nt, Homo sapiens
ugucagggguuucuucaaga

SEQ ID NO: 1206475 - RNA, 21 nt, Homo sapiens
ugucauccucaugcugcucaa

SEQ ID NO: 1206476 - RNA, 16 nt, Homo sapiens
ugucauccuuggucuu

SEQ ID NO: 1206477 - RNA, 17 nt, Homo sapiens
ugucauguaacacgaca

SEQ ID NO: 1206478 - RNA, 14 nt, Homo sapiens
ugucauuauauucu

SEQ ID NO: 1206479 - RNA, 18 nt, Homo sapiens
ugucauucgcucccacau

SEQ ID NO: 1206480 - RNA, 18 nt, Homo sapiens
ugucauuguaaacaaacu

SEQ ID NO: 1206481 - RNA, 13 nt, Homo sapiens
ugucauuguauuc

SEQ ID NO: 1206482 - RNA, 14 nt, Homo sapiens
ugucauuuccucua

SEQ ID NO: 1206483 - RNA, 15 nt, Homo sapiens
ugucauuuccucuag

SEQ ID NO: 1206484 - RNA, 12 nt, Homo sapiens
uguccaaagagg

SEQ ID NO: 1206485 - RNA, 22 nt, Homo sapiens
uguccagccaagggcugagugu

SEQ ID NO: 1206486 - RNA, 19 nt, Homo sapiens
uguccagguuaguuuacuc

SEQ ID NO: 1206487 - RNA, 19 nt, Homo sapiens
ugucccacgugucuuccac

SEQ ID NO: 1206488 - RNA, 19 nt, Homo sapiens
uguccccacuuacagaucu

SEQ ID NO: 1206489 - RNA, 15 nt, Homo sapiens
ugucccccuacccac

SEQ ID NO: 1206490 - RNA, 16 nt, Homo sapiens
ugucccugaaaccuag

SEQ ID NO: 1206491 - RNA, 14 nt, Homo sapiens
uguccuaagagauu

SEQ ID NO: 1206492 - RNA, 11 nt, Homo sapiens
uguccuaagca

SEQ ID NO: 1206493 - RNA, 19 nt, Homo sapiens
uguccuaccaguugcccua

SEQ ID NO: 1206494 - RNA, 18 nt, Homo sapiens
uguccucaaaaggaauaa

SEQ ID NO: 1206495 - RNA, 15 nt, Homo sapiens
uguccucuugcucaa

SEQ ID NO: 1206496 - RNA, 17 nt, Homo sapiens
uguccugaucugugaua

SEQ ID NO: 1206497 - RNA, 18 nt, Homo sapiens
uguccugcuggcuuccag

SEQ ID NO: 1206498 - RNA, 21 nt, Homo sapiens
uguccugcuggcuuccagcuu

SEQ ID NO: 1206499 - RNA, 15 nt, Homo sapiens
uguccuggaauuauu

SEQ ID NO: 1206500 - RNA, 13 nt, Homo sapiens
uguccugggguau

SEQ ID NO: 1206501 - RNA, 21 nt, Homo sapiens
uguccuguacauugugggaug

SEQ ID NO: 1206502 - RNA, 21 nt, Homo sapiens
uguccuuuaaucacugcauuu

SEQ ID NO: 1206503 - RNA, 21 nt, Homo sapiens
uguccuuuuacucagcuuuau

SEQ ID NO: 1206504 - RNA, 21 nt, Homo sapiens
uguccuuuuggcacugagaua

SEQ ID NO: 1206505 - RNA, 13 nt, Homo sapiens
ugucgucuuuaug

SEQ ID NO: 1206506 - RNA, 23 nt, Homo sapiens
ugucuaaaaaccagacaaggaaa

SEQ ID NO: 1206507 - RNA, 19 nt, Homo sapiens
ugucuacaugccaugaccu

SEQ ID NO: 1206508 - RNA, 11 nt, Homo sapiens
ugucuaccugg

SEQ ID NO: 1206509 - RNA, 16 nt, Homo sapiens
ugucuauauguuuauu

SEQ ID NO: 1206510 - RNA, 17 nt, Homo sapiens
ugucuauguagcugaaa

SEQ ID NO: 1206511 - RNA, 13 nt, Homo sapiens
ugucuauucuugu

SEQ ID NO: 1206512 - RNA, 13 nt, Homo sapiens
ugucucacacugg

SEQ ID NO: 1206513 - RNA, 14 nt, Homo sapiens
ugucucccaaaaau

SEQ ID NO: 1206514 - RNA, 21 nt, Homo sapiens
ugucuccuccccuucccccac

SEQ ID NO: 1206515 - RNA, 21 nt, Homo sapiens
ugucucggagggauuccccua

SEQ ID NO: 1206516 - RNA, 15 nt, Homo sapiens
ugucucugcaucuga

SEQ ID NO: 1206517 - RNA, 19 nt, Homo sapiens
ugucucuggggcagauccc

SEQ ID NO: 1206518 - RNA, 20 nt, Homo sapiens
ugucugggucuaccaggaac

SEQ ID NO: 1206519 - RNA, 21 nt, Homo sapiens
ugucugugcccuccaaagagc

SEQ ID NO: 1206520 - RNA, 15 nt, Homo sapiens
ugucuguuaacuuaa

SEQ ID NO: 1206521 - RNA, 15 nt, Homo sapiens
ugucuuacugugauc

SEQ ID NO: 1206522 - RNA, 13 nt, Homo sapiens
ugucuuagcugua

SEQ ID NO: 1206523 - RNA, 18 nt, Homo sapiens
ugucuuauuacagcauuu

SEQ ID NO: 1206524 - RNA, 22 nt, Homo sapiens
ugucuuccacagccgccugaaa

SEQ ID NO: 1206525 - RNA, 13 nt, Homo sapiens
ugucuuccacuuu

SEQ ID NO: 1206526 - RNA, 19 nt, Homo sapiens
ugucuuggacacuguacaa

SEQ ID NO: 1206527 - RNA, 18 nt, Homo sapiens
ugucuuuguuguagugaa

SEQ ID NO: 1206528 - RNA, 13 nt, Homo sapiens
ugucuuuugccau

SEQ ID NO: 1206529 - RNA, 21 nt, Homo sapiens
ugugaaaauauacuugacucu

SEQ ID NO: 1206530 - RNA, 12 nt, Homo sapiens
ugugaaagucag

SEQ ID NO: 1206531 - RNA, 16 nt, Homo sapiens
ugugaaaucucagaau

SEQ ID NO: 1206532 - RNA, 20 nt, Homo sapiens
ugugaagaauuuagaucuua

SEQ ID NO: 1206533 - RNA, 15 nt, Homo sapiens
ugugaagacaaguag

SEQ ID NO: 1206534 - RNA, 18 nt, Homo sapiens
ugugaagcaccuacuaug

SEQ ID NO: 1206535 - RNA, 21 nt, Homo sapiens
ugugaagugaaugaaacacuc

SEQ ID NO: 1206536 - RNA, 16 nt, Homo sapiens
ugugaaguggaaaugu

SEQ ID NO: 1206537 - RNA, 13 nt, Homo sapiens
ugugacacauaug

SEQ ID NO: 1206538 - RNA, 15 nt, Homo sapiens
ugugacacauaugca

SEQ ID NO: 1206539 - RNA, 19 nt, Homo sapiens
ugugaccaacuguguugua

SEQ ID NO: 1206540 - RNA, 15 nt, Homo sapiens
ugugaccauuuauaa

SEQ ID NO: 1206541 - RNA, 16 nt, Homo sapiens
ugugaccccacugcca

SEQ ID NO: 1206542 - RNA, 17 nt, Homo sapiens
ugugaccuuugucuaga

SEQ ID NO: 1206543 - RNA, 12 nt, Homo sapiens
ugugacuacuga

SEQ ID NO: 1206544 - RNA, 20 nt, Homo sapiens
ugugacuugaacuagauugc

SEQ ID NO: 1206545 - RNA, 15 nt, Homo sapiens
ugugagagaaagugu

SEQ ID NO: 1206546 - RNA, 14 nt, Homo sapiens
ugugagcagggauu

SEQ ID NO: 1206547 - RNA, 23 nt, Homo sapiens
ugugagggugacguuagcauuac

SEQ ID NO: 1206548 - RNA, 14 nt, Homo sapiens
ugugaguccaaaga

SEQ ID NO: 1206549 - RNA, 18 nt, Homo sapiens
ugugauacgaugcuucaa

SEQ ID NO: 1206550 - RNA, 15 nt, Homo sapiens
ugugauagcacuuuc

SEQ ID NO: 1206551 - RNA, 18 nt, Homo sapiens
ugugaugaugcugugaca

SEQ ID NO: 1206552 - RNA, 13 nt, Homo sapiens
ugugauguucuaa

SEQ ID NO: 1206553 - RNA, 14 nt, Homo sapiens
ugugauugugauuc

SEQ ID NO: 1206554 - RNA, 17 nt, Homo sapiens
ugugauuuccuaaacau

SEQ ID NO: 1206555 - RNA, 19 nt, Homo sapiens
ugugauuuggaccauggca

SEQ ID NO: 1206556 - RNA, 22 nt, Homo sapiens
ugugauuuuucugcacuaauau

SEQ ID NO: 1206557 - RNA, 21 nt, Homo sapiens
ugugcacacacacacacaugc

SEQ ID NO: 1206558 - RNA, 19 nt, Homo sapiens
ugugcacauuuaugaauca

SEQ ID NO: 1206559 - RNA, 16 nt, Homo sapiens
ugugcaccaauuauca

SEQ ID NO: 1206560 - RNA, 14 nt, Homo sapiens
ugugcagccauagu

SEQ ID NO: 1206561 - RNA, 13 nt, Homo sapiens
ugugcaguacuua

SEQ ID NO: 1206562 - RNA, 22 nt, Homo sapiens
ugugcauacuuucccucaucca

SEQ ID NO: 1206563 - RNA, 13 nt, Homo sapiens
ugugcaugccaug

SEQ ID NO: 1206564 - RNA, 20 nt, Homo sapiens
ugugcauuucaccugugaca

SEQ ID NO: 1206565 - RNA, 13 nt, Homo sapiens
ugugccaccaagc

SEQ ID NO: 1206566 - RNA, 19 nt, Homo sapiens
ugugccaguucuuuccaua

SEQ ID NO: 1206567 - RNA, 14 nt, Homo sapiens
ugugccaucaccau

SEQ ID NO: 1206568 - RNA, 20 nt, Homo sapiens
ugugccccagcagugccuug

SEQ ID NO: 1206569 - RNA, 20 nt, Homo sapiens
ugugcccuccaaagagccuu

SEQ ID NO: 1206570 - RNA, 14 nt, Homo sapiens
uuaugugugccuuu

SEQ ID NO: 1206571 - RNA, 13 nt, Homo sapiens
uuauguucaguca

SEQ ID NO: 1206572 - RNA, 12 nt, Homo sapiens
uuauguuccuca

SEQ ID NO: 1206573 - RNA, 17 nt, Homo sapiens
uuauguuugcacuuugu

SEQ ID NO: 1206574 - RNA, 18 nt, Homo sapiens
uuauuaaaaccagucuca

SEQ ID NO: 1206575 - RNA, 11 nt, Homo sapiens
uuauuacauaa

SEQ ID NO: 1206576 - RNA, 11 nt, Homo sapiens
uuauuacugaa

SEQ ID NO: 1206577 - RNA, 14 nt, Homo sapiens
uuauuauaaauucu

SEQ ID NO: 1206578 - RNA, 18 nt, Homo sapiens
uuauuauaaauucuacua

SEQ ID NO: 1206579 - RNA, 15 nt, Homo sapiens
uuauuauaauuguau

SEQ ID NO: 1206580 - RNA, 12 nt, Homo sapiens
uuauuauauucc

SEQ ID NO: 1206581 - RNA, 13 nt, Homo sapiens
uuauuaucuauua

SEQ ID NO: 1206582 - RNA, 16 nt, Homo sapiens
uuauuauggcuuguga

SEQ ID NO: 1206583 - RNA, 19 nt, Homo sapiens
uuauuauuuuggggucucu

SEQ ID NO: 1206584 - RNA, 13 nt, Homo sapiens
uuauucagaauuu

SEQ ID NO: 1206585 - RNA, 14 nt, Homo sapiens
uuauuccuccagga

SEQ ID NO: 1206586 - RNA, 19 nt, Homo sapiens
uuauucugauaaaaauaau

SEQ ID NO: 1206587 - RNA, 15 nt, Homo sapiens
uuauucugauuccac

SEQ ID NO: 1206588 - RNA, 16 nt, Homo sapiens
uuauucugauuccacu

SEQ ID NO: 1206589 - RNA, 21 nt, Homo sapiens
uuauucuguuuugcacaguua

SEQ ID NO: 1206590 - RNA, 12 nt, Homo sapiens
uuauugaaucua

SEQ ID NO: 1206591 - RNA, 19 nt, Homo sapiens
uuauugggcaagugauuga

SEQ ID NO: 1206592 - RNA, 18 nt, Homo sapiens
uuauugguguuuacccag

SEQ ID NO: 1206593 - RNA, 17 nt, Homo sapiens
uuauuguauuuauucca

SEQ ID NO: 1206594 - RNA, 12 nt, Homo sapiens
uuauuuacauuu

SEQ ID NO: 1206595 - RNA, 21 nt, Homo sapiens
uuauuucaggaaggucuucaa

SEQ ID NO: 1206596 - RNA, 21 nt, Homo sapiens
uuauuuccacuuauaaaggaa

SEQ ID NO: 1206597 - RNA, 19 nt, Homo sapiens
uuauuucugaucuauacaa

SEQ ID NO: 1206598 - RNA, 17 nt, Homo sapiens
uuauuugcacacugcac

SEQ ID NO: 1206599 - RNA, 18 nt, Homo sapiens
uuauuuuuaaaaagaaau

SEQ ID NO: 1206600 - RNA, 22 nt, Homo sapiens
uuauuuuucauauugugccaau

SEQ ID NO: 1206601 - RNA, 17 nt, Homo sapiens
uuauuuuugaaacaaac

SEQ ID NO: 1206602 - RNA, 21 nt, Homo sapiens
uuauuuuuucgugcacucugc

SEQ ID NO: 1206603 - RNA, 13 nt, Homo sapiens
uuauuuuuugcca

SEQ ID NO: 1206604 - RNA, 17 nt, Homo sapiens
uucaaaaaauuauauga

SEQ ID NO: 1206605 - RNA, 21 nt, Homo sapiens
uucaaaaaauuauaugaccau

SEQ ID NO: 1206606 - RNA, 15 nt, Homo sapiens
uucaaaaacuaaaau

SEQ ID NO: 1206607 - RNA, 21 nt, Homo sapiens
uucaaaaagggaaguaagcaa

SEQ ID NO: 1206608 - RNA, 18 nt, Homo sapiens
uucaaaaccugcaguuaa

SEQ ID NO: 1206609 - RNA, 13 nt, Homo sapiens
uucaaaagcacug

SEQ ID NO: 1206610 - RNA, 18 nt, Homo sapiens
uucaaaagguuauauacc

SEQ ID NO: 1206611 - RNA, 15 nt, Homo sapiens
uucaaacaaccugcc

SEQ ID NO: 1206612 - RNA, 21 nt, Homo sapiens
uucaaacaauaucauaucauc

SEQ ID NO: 1206613 - RNA, 24 nt, Homo sapiens
uucaaacagaacugcagucagcau

SEQ ID NO: 1206614 - RNA, 13 nt, Homo sapiens
uucaaagcacaga

SEQ ID NO: 1206615 - RNA, 15 nt, Homo sapiens
uucaaaggcauuucu

SEQ ID NO: 1206616 - RNA, 13 nt, Homo sapiens
uucaaaguuaaaa

SEQ ID NO: 1206617 - RNA, 18 nt, Homo sapiens
uucaaaguuaaaagcaaa

SEQ ID NO: 1206618 - RNA, 12 nt, Homo sapiens
uucaaaugaaac

SEQ ID NO: 1206619 - RNA, 20 nt, Homo sapiens
uucaaauucuucugaacuca

SEQ ID NO: 1206620 - RNA, 19 nt, Homo sapiens
uucaacaaagaaacaaaga

SEQ ID NO: 1206621 - RNA, 20 nt, Homo sapiens
uucaacaaccggccaccaga

SEQ ID NO: 1206622 - RNA, 22 nt, Homo sapiens
uucaacaaugucuuuuuuccca

SEQ ID NO: 1206623 - RNA, 13 nt, Homo sapiens
uucaacaauuuca

SEQ ID NO: 1206624 - RNA, 15 nt, Homo sapiens
uucaacagagacuga

SEQ ID NO: 1206625 - RNA, 19 nt, Homo sapiens
uucaacaguuuuugcuaau

SEQ ID NO: 1206626 - RNA, 11 nt, Homo sapiens
uucaaccacug

SEQ ID NO: 1206627 - RNA, 21 nt, Homo sapiens
uucaaccuguccuuucaggga

SEQ ID NO: 1206628 - RNA, 16 nt, Homo sapiens
uucaacugaaguucua

SEQ ID NO: 1206629 - RNA, 23 nt, Homo sapiens
uucaacuguauaguuuuauuuac

SEQ ID NO: 1206630 - RNA, 16 nt, Homo sapiens
uucaacuugcauccaa

SEQ ID NO: 1206631 - RNA, 16 nt, Homo sapiens
uucaagaaaaucuuug

SEQ ID NO: 1206632 - RNA, 13 nt, Homo sapiens
uucaagacagaaa

SEQ ID NO: 1206633 - RNA, 15 nt, Homo sapiens
uucaagagugagcua

SEQ ID NO: 1206634 - RNA, 18 nt, Homo sapiens
uucaaggaaaaaugcugc

SEQ ID NO: 1206635 - RNA, 21 nt, Homo sapiens
uucaaggcauuucuaucacau

SEQ ID NO: 1206636 - RNA, 16 nt, Homo sapiens
uucaaguaauugugaa

SEQ ID NO: 1206637 - RNA, 15 nt, Homo sapiens
uucaagugccaaaca

SEQ ID NO: 1206638 - RNA, 18 nt, Homo sapiens
uucaaguuagcucaggag

SEQ ID NO: 1206639 - RNA, 14 nt, Homo sapiens
uucaaguuugucac

SEQ ID NO: 1206640 - RNA, 20 nt, Homo sapiens
uucaaguuugucacuaaacu

SEQ ID NO: 1206641 - RNA, 14 nt, Homo sapiens
uucaauacagugaa

SEQ ID NO: 1206642 - RNA, 22 nt, Homo sapiens
uucaaugauuauuuguauuuac

SEQ ID NO: 1206643 - RNA, 21 nt, Homo sapiens
uucaaugugacaccuaacucu

SEQ ID NO: 1206644 - RNA, 22 nt, Homo sapiens
uucaauuauacuaaaccucaca

SEQ ID NO: 1206645 - RNA, 22 nt, Homo sapiens
uucaauucucauuugucacaca

SEQ ID NO: 1206646 - RNA, 22 nt, Homo sapiens
uucacaaguacuaucuguuccc

SEQ ID NO: 1206647 - RNA, 19 nt, Homo sapiens
uucacaccgcugcacucaa

SEQ ID NO: 1206648 - RNA, 22 nt, Homo sapiens
uucacacuuugcccuaugacau

SEQ ID NO: 1206649 - RNA, 19 nt, Homo sapiens
uucacaugagcuauuucca

SEQ ID NO: 1206650 - RNA, 14 nt, Homo sapiens
uucaccagagcauu

SEQ ID NO: 1206651 - RNA, 19 nt, Homo sapiens
uucacccaaaacaaaguaa

SEQ ID NO: 1206652 - RNA, 17 nt, Homo sapiens
uucacccaucuuaucaa

SEQ ID NO: 1206653 - RNA, 17 nt, Homo sapiens
uucaccccugcacuuca

SEQ ID NO: 1206654 - RNA, 14 nt, Homo sapiens
uucaccucuaucca

SEQ ID NO: 1206655 - RNA, 16 nt, Homo sapiens
uucaccugccaccaca

SEQ ID NO: 1206656 - RNA, 20 nt, Homo sapiens
uucacuaaugaucacauucu

SEQ ID NO: 1206657 - RNA, 14 nt, Homo sapiens
uucacuacuuuaau

SEQ ID NO: 1206658 - RNA, 18 nt, Homo sapiens
uucacuauaaaugguguu

SEQ ID NO: 1206659 - RNA, 13 nt, Homo sapiens
uucacucugucau

SEQ ID NO: 1206660 - RNA, 22 nt, Homo sapiens
uucacugccccagacacagugc

SEQ ID NO: 1206661 - RNA, 22 nt, Homo sapiens
uucacuggucucuaaguguaaa

SEQ ID NO: 1206662 - RNA, 12 nt, Homo sapiens
uucacugugcaa

SEQ ID NO: 1206663 - RNA, 18 nt, Homo sapiens
uucacuuggccaguuuca

SEQ ID NO: 1206664 - RNA, 12 nt, Homo sapiens
uucacuuuacaa

SEQ ID NO: 1206665 - RNA, 17 nt, Homo sapiens
uucacuuuuaauuugcu

SEQ ID NO: 1206666 - RNA, 14 nt, Homo sapiens
uucacuuuuaggga

SEQ ID NO: 1206667 - RNA, 15 nt, Homo sapiens
uucagacaagcugca

SEQ ID NO: 1206668 - RNA, 12 nt, Homo sapiens
uucagacucuca

SEQ ID NO: 1206669 - RNA, 22 nt, Homo sapiens
uucagagacagcugauacuuca

SEQ ID NO: 1206670 - RNA, 15 nt, Homo sapiens
uucagagccagugaa

SEQ ID NO: 1206671 - RNA, 12 nt, Homo sapiens
uucagauauuau

SEQ ID NO: 1206672 - RNA, 19 nt, Homo sapiens
uucagauccugaauuccag

SEQ ID NO: 1206673 - RNA, 21 nt, Homo sapiens
uucagauggcaauuucacuga

SEQ ID NO: 1206674 - RNA, 18 nt, Homo sapiens
uucagauggugaagcauu

SEQ ID NO: 1206675 - RNA, 19 nt, Homo sapiens
uucagcucacuuccuccag

SEQ ID NO: 1206676 - RNA, 13 nt, Homo sapiens
uucagcucuacag

SEQ ID NO: 1206677 - RNA, 17 nt, Homo sapiens
uucagcuguacauacuc

SEQ ID NO: 1206678 - RNA, 16 nt, Homo sapiens
uucagcuucagacuuu

SEQ ID NO: 1206679 - RNA, 23 nt, Homo sapiens
uucagcuucagacuuuuaucaaa

SEQ ID NO: 1206680 - RNA, 17 nt, Homo sapiens
uucaggaaggucuucaa

SEQ ID NO: 1206681 - RNA, 20 nt, Homo sapiens
uucaggacuuaacggcucca

SEQ ID NO: 1206682 - RNA, 18 nt, Homo sapiens
uucaggagcgcaagauag

SEQ ID NO: 1206683 - RNA, 19 nt, Homo sapiens
uucaggagggaaccagcuu

SEQ ID NO: 1206684 - RNA, 13 nt, Homo sapiens
uucaggagucuca

SEQ ID NO: 1206685 - RNA, 21 nt, Homo sapiens
uucaggcuaagaagagauuuc

SEQ ID NO: 1206686 - RNA, 18 nt, Homo sapiens
uucagggcagggcucuga

SEQ ID NO: 1206687 - RNA, 13 nt, Homo sapiens
uucagggccaguc

SEQ ID NO: 1206688 - RNA, 14 nt, Homo sapiens
uucagggucucccc

SEQ ID NO: 1206689 - RNA, 18 nt, Homo sapiens
uucagguauguguguaua

SEQ ID NO: 1206690 - RNA, 15 nt, Homo sapiens
uucaguaagucucau

SEQ ID NO: 1206691 - RNA, 17 nt, Homo sapiens
uucaguaauguugacug

SEQ ID NO: 1206692 - RNA, 22 nt, Homo sapiens
uucaguacacccaguugccaaa

SEQ ID NO: 1206693 - RNA, 14 nt, Homo sapiens
uucaguacuuguga

SEQ ID NO: 1206694 - RNA, 15 nt, Homo sapiens
uucaguacuugugaa

SEQ ID NO: 1206695 - RNA, 23 nt, Homo sapiens
uucaguacuugugaaacacagcu

SEQ ID NO: 1206696 - RNA, 20 nt, Homo sapiens
uucaguccaacaaaccacac

SEQ ID NO: 1206697 - RNA, 21 nt, Homo sapiens
aucauauccuaugacccagca

SEQ ID NO: 1206698 - RNA, 13 nt, Homo sapiens
aucauauguucua

SEQ ID NO: 1206699 - RNA, 21 nt, Homo sapiens
aucaucaacaagauuuccuug

SEQ ID NO: 1206700 - RNA, 14 nt, Homo sapiens
aucauccaagacag

SEQ ID NO: 1206701 - RNA, 14 nt, Homo sapiens
aucaucccagggga

SEQ ID NO: 1206702 - RNA, 22 nt, Homo sapiens
aucaucccuuucucccagugaa

SEQ ID NO: 1206703 - RNA, 20 nt, Homo sapiens
aucaugaaaaugucuauuca

SEQ ID NO: 1206704 - RNA, 17 nt, Homo sapiens
aucaugaaacaccuuaa

SEQ ID NO: 1206705 - RNA, 21 nt, Homo sapiens
aucaugaagcacaucaauuac

SEQ ID NO: 1206706 - RNA, 20 nt, Homo sapiens
aucaugaagcccaaccugca

SEQ ID NO: 1206707 - RNA, 23 nt, Homo sapiens
aucaugacccacccagugucuuu

SEQ ID NO: 1206708 - RNA, 20 nt, Homo sapiens
aucaugauccucccuaucaa

SEQ ID NO: 1206709 - RNA, 11 nt, Homo sapiens
aucauggaaua

SEQ ID NO: 1206710 - RNA, 22 nt, Homo sapiens
aucaugguacauuuaucacuga

SEQ ID NO: 1206711 - RNA, 20 nt, Homo sapiens
aucauguccuauucccuguc

SEQ ID NO: 1206712 - RNA, 20 nt, Homo sapiens
aucauguggcccaacucucc

SEQ ID NO: 1206713 - RNA, 20 nt, Homo sapiens
aucaugugggugagccagug

SEQ ID NO: 1206714 - RNA, 15 nt, Homo sapiens
aucauucaacucucc

SEQ ID NO: 1206715 - RNA, 15 nt, Homo sapiens
aucauucccauuuug

SEQ ID NO: 1206716 - RNA, 13 nt, Homo sapiens
aucauucuucacu

SEQ ID NO: 1206717 - RNA, 14 nt, Homo sapiens
aucauucuuuacau

SEQ ID NO: 1206718 - RNA, 19 nt, Homo sapiens
aucauuguagaaacacagu

SEQ ID NO: 1206719 - RNA, 18 nt, Homo sapiens
aucauuuccguuuugccu

SEQ ID NO: 1206720 - RNA, 19 nt, Homo sapiens
aucauuuuuaaauauaggu

SEQ ID NO: 1206721 - RNA, 23 nt, Homo sapiens
auccaaaaauguguaagaacaac

SEQ ID NO: 1206722 - RNA, 15 nt, Homo sapiens
auccaaagacuguac

SEQ ID NO: 1206723 - RNA, 13 nt, Homo sapiens
auccaacacugga

SEQ ID NO: 1206724 - RNA, 16 nt, Homo sapiens
auccaacuccaggaua

SEQ ID NO: 1206725 - RNA, 16 nt, Homo sapiens
auccacaauagcugac

SEQ ID NO: 1206726 - RNA, 15 nt, Homo sapiens
auccacccaccucag

SEQ ID NO: 1206727 - RNA, 12 nt, Homo sapiens
auccaccugccu

SEQ ID NO: 1206728 - RNA, 23 nt, Homo sapiens
auccaccuuggcucugccagugg

SEQ ID NO: 1206729 - RNA, 21 nt, Homo sapiens
auccacugggcacaacugcaa

SEQ ID NO: 1206730 - RNA, 13 nt, Homo sapiens
auccacugugcca

SEQ ID NO: 1206731 - RNA, 18 nt, Homo sapiens
auccagaccaaccuucca

SEQ ID NO: 1206732 - RNA, 16 nt, Homo sapiens
auccagagcagaguuu

SEQ ID NO: 1206733 - RNA, 22 nt, Homo sapiens
auccagauugggugccagcaua

SEQ ID NO: 1206734 - RNA, 20 nt, Homo sapiens
auccagcaauuccugagcca

SEQ ID NO: 1206735 - RNA, 19 nt, Homo sapiens
auccagccaugccugaggu

SEQ ID NO: 1206736 - RNA, 18 nt, Homo sapiens
auccagccuccugcuaac

SEQ ID NO: 1206737 - RNA, 14 nt, Homo sapiens
auccagcuaugaau

SEQ ID NO: 1206738 - RNA, 16 nt, Homo sapiens
auccagcuaugaauau

SEQ ID NO: 1206739 - RNA, 19 nt, Homo sapiens
auccaggcccaacugugag

SEQ ID NO: 1206740 - RNA, 14 nt, Homo sapiens
auccaggcuuugua

SEQ ID NO: 1206741 - RNA, 16 nt, Homo sapiens
auccaggcuuuguaca

SEQ ID NO: 1206742 - RNA, 16 nt, Homo sapiens
auccagugauccuuac

SEQ ID NO: 1206743 - RNA, 18 nt, Homo sapiens
auccauaaauguguuccu

SEQ ID NO: 1206744 - RNA, 22 nt, Homo sapiens
auccauaggcgcaggugcacag

SEQ ID NO: 1206745 - RNA, 23 nt, Homo sapiens
auccauaggcgcaggugcacagg

SEQ ID NO: 1206746 - RNA, 17 nt, Homo sapiens
auccauauugagucaaa

SEQ ID NO: 1206747 - RNA, 12 nt, Homo sapiens
auccaucucuca

SEQ ID NO: 1206748 - RNA, 23 nt, Homo sapiens
auccaugcaccccaccagcaaua

SEQ ID NO: 1206749 - RNA, 20 nt, Homo sapiens
auccaugcaccuaccuuaga

SEQ ID NO: 1206750 - RNA, 15 nt, Homo sapiens
auccaugcugugcug

SEQ ID NO: 1206751 - RNA, 16 nt, Homo sapiens
auccauuaaaaauggg

SEQ ID NO: 1206752 - RNA, 13 nt, Homo sapiens
auccauuccucuu

SEQ ID NO: 1206753 - RNA, 23 nt, Homo sapiens
auccauuuccaaaccuccacugc

SEQ ID NO: 1206754 - RNA, 13 nt, Homo sapiens
auccauuuuacac

SEQ ID NO: 1206755 - RNA, 14 nt, Homo sapiens
auccauuuuacaca

SEQ ID NO: 1206756 - RNA, 17 nt, Homo sapiens
auccauuuuacacagca

SEQ ID NO: 1206757 - RNA, 18 nt, Homo sapiens
aucccaaaccuacaagaa

SEQ ID NO: 1206758 - RNA, 18 nt, Homo sapiens
aucccaaccagugccaag

SEQ ID NO: 1206759 - RNA, 19 nt, Homo sapiens
aucccaaucaaagaauuac

SEQ ID NO: 1206760 - RNA, 18 nt, Homo sapiens
aucccaauccuuauccca

SEQ ID NO: 1206761 - RNA, 15 nt, Homo sapiens
aucccacauccaacu

SEQ ID NO: 1206762 - RNA, 16 nt, Homo sapiens
aucccacccuggggac

SEQ ID NO: 1206763 - RNA, 22 nt, Homo sapiens
aucccacgggaaaggagcugcu

SEQ ID NO: 1206764 - RNA, 17 nt, Homo sapiens
aucccagacucacccca

SEQ ID NO: 1206765 - RNA, 12 nt, Homo sapiens
aucccagcacuu

SEQ ID NO: 1206766 - RNA, 21 nt, Homo sapiens
aucccaggggaccacaccucc

SEQ ID NO: 1206767 - RNA, 15 nt, Homo sapiens
aucccaugagccuca

SEQ ID NO: 1206768 - RNA, 18 nt, Homo sapiens
auccccaagugugaacaa

SEQ ID NO: 1206769 - RNA, 12 nt, Homo sapiens
auccccaucucc

SEQ ID NO: 1206770 - RNA, 15 nt, Homo sapiens
auccccugcuacccu

SEQ ID NO: 1206771 - RNA, 17 nt, Homo sapiens
auccccuggacugggag

SEQ ID NO: 1206772 - RNA, 19 nt, Homo sapiens
auccccuggacugggaggu

SEQ ID NO: 1206773 - RNA, 17 nt, Homo sapiens
aucccgaaaaucucucg

SEQ ID NO: 1206774 - RNA, 21 nt, Homo sapiens
aucccgaagaauggagaggaa

SEQ ID NO: 1206775 - RNA, 18 nt, Homo sapiens
aucccguaccucuuccca

SEQ ID NO: 1206776 - RNA, 16 nt, Homo sapiens
aucccguguugccaug

SEQ ID NO: 1206777 - RNA, 14 nt, Homo sapiens
aucccucaccugua

SEQ ID NO: 1206778 - RNA, 18 nt, Homo sapiens
aucccucgggugugcuau

SEQ ID NO: 1206779 - RNA, 20 nt, Homo sapiens
aucccuuccucucaggcucu

SEQ ID NO: 1206780 - RNA, 15 nt, Homo sapiens
aucccuuccuggaaa

SEQ ID NO: 1206781 - RNA, 17 nt, Homo sapiens
aucccuucucacagcac

SEQ ID NO: 1206782 - RNA, 16 nt, Homo sapiens
aucccuugaguuauau

SEQ ID NO: 1206783 - RNA, 12 nt, Homo sapiens
aucccuuuacaa

SEQ ID NO: 1206784 - RNA, 19 nt, Homo sapiens
auccgaaguaugagggaaa

SEQ ID NO: 1206785 - RNA, 14 nt, Homo sapiens
auccgacucuaagc

SEQ ID NO: 1206786 - RNA, 19 nt, Homo sapiens
auccgauuccccuguagca

SEQ ID NO: 1206787 - RNA, 16 nt, Homo sapiens
auccuaaauaauguua

SEQ ID NO: 1206788 - RNA, 13 nt, Homo sapiens
auccuaacauuca

SEQ ID NO: 1206789 - RNA, 19 nt, Homo sapiens
auccuacaguacaaucagc

SEQ ID NO: 1206790 - RNA, 14 nt, Homo sapiens
auccuauaagcuua

SEQ ID NO: 1206791 - RNA, 20 nt, Homo sapiens
auccucacccagcacccaca

SEQ ID NO: 1206792 - RNA, 14 nt, Homo sapiens
auccucaugcugcu

SEQ ID NO: 1206793 - RNA, 15 nt, Homo sapiens
auccucccuaucaag

SEQ ID NO: 1206794 - RNA, 13 nt, Homo sapiens
auccuccucagcc

SEQ ID NO: 1206795 - RNA, 19 nt, Homo sapiens
auccuccuuuagaguugca

SEQ ID NO: 1206796 - RNA, 14 nt, Homo sapiens
auccucuacugugc

SEQ ID NO: 1206797 - RNA, 21 nt, Homo sapiens
auccucucccauggagacaag

SEQ ID NO: 1206798 - RNA, 15 nt, Homo sapiens
auccuggagugauau

SEQ ID NO: 1206799 - RNA, 14 nt, Homo sapiens
auccuggaugauuu

SEQ ID NO: 1206800 - RNA, 22 nt, Homo sapiens
auccugggggacccaauguagg

SEQ ID NO: 1206801 - RNA, 22 nt, Homo sapiens
auccuguaccaaaucugacaua

SEQ ID NO: 1206802 - RNA, 13 nt, Homo sapiens
auccuguguaugu

SEQ ID NO: 1206803 - RNA, 21 nt, Homo sapiens
auccuuccacuaucauuccca

SEQ ID NO: 1206804 - RNA, 13 nt, Homo sapiens
auccuuccccaac

SEQ ID NO: 1206805 - RNA, 22 nt, Homo sapiens
auccuucuccaccaaagacagu

SEQ ID NO: 1206806 - RNA, 14 nt, Homo sapiens
auccuugcaggugg

SEQ ID NO: 1206807 - RNA, 21 nt, Homo sapiens
auccuuggggagcacuugucc

SEQ ID NO: 1206808 - RNA, 20 nt, Homo sapiens
auccuuuagguaagaaguuu

SEQ ID NO: 1206809 - RNA, 12 nt, Homo sapiens
aucgaccuggag

SEQ ID NO: 1206810 - RNA, 19 nt, Homo sapiens
aucgagaccauccuggcua

SEQ ID NO: 1206811 - RNA, 22 nt, Homo sapiens
aucgagauguccauagucaaau

SEQ ID NO: 1206812 - RNA, 14 nt, Homo sapiens
aucgagccacugca

SEQ ID NO: 1206813 - RNA, 21 nt, Homo sapiens
aucgcaccauugcacuccagc

SEQ ID NO: 1206814 - RNA, 22 nt, Homo sapiens
aucgcauauuaguuaaucuccu

SEQ ID NO: 1206815 - RNA, 15 nt, Homo sapiens
aucgcuccucuccag

SEQ ID NO: 1206816 - RNA, 23 nt, Homo sapiens
aucgcugcgauacuggcauuucc

SEQ ID NO: 1206817 - RNA, 16 nt, Homo sapiens
aucggaagcagugccu

SEQ ID NO: 1206818 - RNA, 13 nt, Homo sapiens
aucgguaggcaaa

SEQ ID NO: 1206819 - RNA, 12 nt, Homo sapiens
aucgugcuaaau

SEQ ID NO: 1206820 - RNA, 18 nt, Homo sapiens
aucuaaauguauucugca

SEQ ID NO: 1206821 - RNA, 18 nt, Homo sapiens
aucuaaauuuaauuaccu

SEQ ID NO: 1206822 - RNA, 21 nt, Homo sapiens
aucuaacagcccugugcagca

SEQ ID NO: 1206823 - RNA, 13 nt, Homo sapiens
augaaauaugcau

SEQ ID NO: 1206824 - RNA, 17 nt, Homo sapiens
augaaauuuaaacauua

SEQ ID NO: 1206825 - RNA, 11 nt, Homo sapiens
augaacauaua

SEQ ID NO: 1206826 - RNA, 23 nt, Homo sapiens
augaaccugcccugcucccacag

SEQ ID NO: 1206827 - RNA, 22 nt, Homo sapiens
augaacuaacugacagcuucau

SEQ ID NO: 1206828 - RNA, 15 nt, Homo sapiens
augaacuauuguuaa

SEQ ID NO: 1206829 - RNA, 15 nt, Homo sapiens
augaacucuuaauca

SEQ ID NO: 1206830 - RNA, 16 nt, Homo sapiens
augaacucuuaaucaa

SEQ ID NO: 1206831 - RNA, 21 nt, Homo sapiens
augaagauucuccugugcuag

SEQ ID NO: 1206832 - RNA, 19 nt, Homo sapiens
augaagcacaucaauuaca

SEQ ID NO: 1206833 - RNA, 15 nt, Homo sapiens
augaagcagauuuau

SEQ ID NO: 1206834 - RNA, 12 nt, Homo sapiens
augaagccagcu

SEQ ID NO: 1206835 - RNA, 16 nt, Homo sapiens
augaagcccuaaagaa

SEQ ID NO: 1206836 - RNA, 23 nt, Homo sapiens
augaagcugcucugaaaucuccu

SEQ ID NO: 1206837 - RNA, 21 nt, Homo sapiens
augaaggagagcccagucucc

SEQ ID NO: 1206838 - RNA, 15 nt, Homo sapiens
augaagggcuccgug

SEQ ID NO: 1206839 - RNA, 21 nt, Homo sapiens
augaagguggaacaagcacag

SEQ ID NO: 1206840 - RNA, 22 nt, Homo sapiens
augaagguggagggucucuagu

SEQ ID NO: 1206841 - RNA, 12 nt, Homo sapiens
augaauaagcuu

SEQ ID NO: 1206842 - RNA, 14 nt, Homo sapiens
augaaucauauuca

SEQ ID NO: 1206843 - RNA, 12 nt, Homo sapiens
augaaugaaacu

SEQ ID NO: 1206844 - RNA, 16 nt, Homo sapiens
augaaugaaugagcca

SEQ ID NO: 1206845 - RNA, 16 nt, Homo sapiens
augaauuugucgcaaa

SEQ ID NO: 1206846 - RNA, 15 nt, Homo sapiens
augacaaucaguuau

SEQ ID NO: 1206847 - RNA, 19 nt, Homo sapiens
augacacccacccugugcc

SEQ ID NO: 1206848 - RNA, 21 nt, Homo sapiens
augacacccacccugugccau

SEQ ID NO: 1206849 - RNA, 12 nt, Homo sapiens
augacacugacc

SEQ ID NO: 1206850 - RNA, 16 nt, Homo sapiens
augacagccauuugua

SEQ ID NO: 1206851 - RNA, 16 nt, Homo sapiens
augacaguagcauuau

SEQ ID NO: 1206852 - RNA, 12 nt, Homo sapiens
augacagugcua

SEQ ID NO: 1206853 - RNA, 18 nt, Homo sapiens
augacaucucaggggcca

SEQ ID NO: 1206854 - RNA, 15 nt, Homo sapiens
augacaugcacugac

SEQ ID NO: 1206855 - RNA, 20 nt, Homo sapiens
augacauuccaccauuguga

SEQ ID NO: 1206856 - RNA, 15 nt, Homo sapiens
augacauuuauucaa

SEQ ID NO: 1206857 - RNA, 18 nt, Homo sapiens
augaccauauuuacucuu

SEQ ID NO: 1206858 - RNA, 19 nt, Homo sapiens
augaccauuugacuguuca

SEQ ID NO: 1206859 - RNA, 23 nt, Homo sapiens
augacccccaaccaaguggcucc

SEQ ID NO: 1206860 - RNA, 21 nt, Homo sapiens
augacccccgcaaguuugcac

SEQ ID NO: 1206861 - RNA, 23 nt, Homo sapiens
augacccccgcaaguuugcacuc

SEQ ID NO: 1206862 - RNA, 20 nt, Homo sapiens
augaccuggcaacaaaaagu

SEQ ID NO: 1206863 - RNA, 21 nt, Homo sapiens
augacgucaucaucacauuca

SEQ ID NO: 1206864 - RNA, 12 nt, Homo sapiens
augacuaaagag

SEQ ID NO: 1206865 - RNA, 14 nt, Homo sapiens
augacuacuuuuuc

SEQ ID NO: 1206866 - RNA, 12 nt, Homo sapiens
augacugauuac

SEQ ID NO: 1206867 - RNA, 14 nt, Homo sapiens
augacugcaaaagu

SEQ ID NO: 1206868 - RNA, 13 nt, Homo sapiens
augacugcacaug

SEQ ID NO: 1206869 - RNA, 18 nt, Homo sapiens
augacugcacccagcucc

SEQ ID NO: 1206870 - RNA, 21 nt, Homo sapiens
augacuguccaagugccacau

SEQ ID NO: 1206871 - RNA, 17 nt, Homo sapiens
augacugugaccaccuu

SEQ ID NO: 1206872 - RNA, 15 nt, Homo sapiens
augacuuaaccauau

SEQ ID NO: 1206873 - RNA, 20 nt, Homo sapiens
augagaaaccuauauuucaa

SEQ ID NO: 1206874 - RNA, 17 nt, Homo sapiens
augagaacaaacagauc

SEQ ID NO: 1206875 - RNA, 19 nt, Homo sapiens
augagacccuggugccugg

SEQ ID NO: 1206876 - RNA, 18 nt, Homo sapiens
augagagaaggaggggag

SEQ ID NO: 1206877 - RNA, 23 nt, Homo sapiens
augagaguuucuguuaaucaugu

SEQ ID NO: 1206878 - RNA, 21 nt, Homo sapiens
augagauguaacucaugaaug

SEQ ID NO: 1206879 - RNA, 19 nt, Homo sapiens
augagauguuaaauacuuu

SEQ ID NO: 1206880 - RNA, 24 nt, Homo sapiens
augagcauccucucucacauggaa

SEQ ID NO: 1206881 - RNA, 19 nt, Homo sapiens
augagcccaccauuguuca

SEQ ID NO: 1206882 - RNA, 19 nt, Homo sapiens
augagccgugaacugugca

SEQ ID NO: 1206883 - RNA, 14 nt, Homo sapiens
augagcucuuccaa

SEQ ID NO: 1206884 - RNA, 17 nt, Homo sapiens
augagcugacaucucag

SEQ ID NO: 1206885 - RNA, 22 nt, Homo sapiens
augagcugaucugcggaucuca

SEQ ID NO: 1206886 - RNA, 21 nt, Homo sapiens
augaggaaaacuguagucucu

SEQ ID NO: 1206887 - RNA, 22 nt, Homo sapiens
augaggaaggaacagcaauggu

SEQ ID NO: 1206888 - RNA, 18 nt, Homo sapiens
augaggacagaccacaga

SEQ ID NO: 1206889 - RNA, 13 nt, Homo sapiens
augaggacagagu

SEQ ID NO: 1206890 - RNA, 17 nt, Homo sapiens
augaggaucaacuguac

SEQ ID NO: 1206891 - RNA, 19 nt, Homo sapiens
augaggauuauugauagua

SEQ ID NO: 1206892 - RNA, 15 nt, Homo sapiens
augaggccaucucag

SEQ ID NO: 1206893 - RNA, 13 nt, Homo sapiens
augagggaaaaug

SEQ ID NO: 1206894 - RNA, 14 nt, Homo sapiens
augaggggugcugg

SEQ ID NO: 1206895 - RNA, 22 nt, Homo sapiens
augaggucaauuuccugaugca

SEQ ID NO: 1206896 - RNA, 20 nt, Homo sapiens
augaggugguggaguggagu

SEQ ID NO: 1206897 - RNA, 16 nt, Homo sapiens
augaguaacauuugcu

SEQ ID NO: 1206898 - RNA, 15 nt, Homo sapiens
augagucaaugugca

SEQ ID NO: 1206899 - RNA, 22 nt, Homo sapiens
augagucccauuugccuugcaa

SEQ ID NO: 1206900 - RNA, 21 nt, Homo sapiens
augagucuuuauuuuuuguua

SEQ ID NO: 1206901 - RNA, 21 nt, Homo sapiens
augaguuuuugauagcuuuau

SEQ ID NO: 1206902 - RNA, 20 nt, Homo sapiens
augauaaauauaacaucuau

SEQ ID NO: 1206903 - RNA, 20 nt, Homo sapiens
augauaaauuaagcaugaaa

SEQ ID NO: 1206904 - RNA, 16 nt, Homo sapiens
augauaaggcucugaa

SEQ ID NO: 1206905 - RNA, 22 nt, Homo sapiens
augauacuuggaugcagcucuu

SEQ ID NO: 1206906 - RNA, 14 nt, Homo sapiens
augauagcuacugu

SEQ ID NO: 1206907 - RNA, 14 nt, Homo sapiens
augauaguuuucau

SEQ ID NO: 1206908 - RNA, 17 nt, Homo sapiens
augauaucuucaagccu

SEQ ID NO: 1206909 - RNA, 16 nt, Homo sapiens
augaucaaaacaugcu

SEQ ID NO: 1206910 - RNA, 19 nt, Homo sapiens
augaucaaaaccugugcca

SEQ ID NO: 1206911 - RNA, 20 nt, Homo sapiens
augaucaaaaccugugccag

SEQ ID NO: 1206912 - RNA, 20 nt, Homo sapiens
augaucacauucuuuccaaa

SEQ ID NO: 1206913 - RNA, 17 nt, Homo sapiens
augaucagcuguuuguc

SEQ ID NO: 1206914 - RNA, 20 nt, Homo sapiens
augaucccuguguugucucu

SEQ ID NO: 1206915 - RNA, 17 nt, Homo sapiens
augauccuuuuuuguca

SEQ ID NO: 1206916 - RNA, 15 nt, Homo sapiens
augaucgcuaucuag

SEQ ID NO: 1206917 - RNA, 20 nt, Homo sapiens
augaucuuugcagacaggca

SEQ ID NO: 1206918 - RNA, 21 nt, Homo sapiens
augaugcuaugguuugccauu

SEQ ID NO: 1206919 - RNA, 20 nt, Homo sapiens
augauggccuuacacugaaa

SEQ ID NO: 1206920 - RNA, 15 nt, Homo sapiens
augaugucuaccuca

SEQ ID NO: 1206921 - RNA, 15 nt, Homo sapiens
augaugugaaacacu

SEQ ID NO: 1206922 - RNA, 18 nt, Homo sapiens
augauucaaauugcugcu

SEQ ID NO: 1206923 - RNA, 16 nt, Homo sapiens
augauucagcucccuu

SEQ ID NO: 1206924 - RNA, 21 nt, Homo sapiens
augauuccuugagcauuuuau

SEQ ID NO: 1206925 - RNA, 14 nt, Homo sapiens
augauucucugagu

SEQ ID NO: 1206926 - RNA, 21 nt, Homo sapiens
augauucuuuguuacaggcac

SEQ ID NO: 1206927 - RNA, 21 nt, Homo sapiens
augauuggauuauucauuuaa

SEQ ID NO: 1206928 - RNA, 18 nt, Homo sapiens
augauuuaccuauacauu

SEQ ID NO: 1206929 - RNA, 19 nt, Homo sapiens
augauuucauauugaucuu

SEQ ID NO: 1206930 - RNA, 14 nt, Homo sapiens
augauuuuauuuga

SEQ ID NO: 1206931 - RNA, 20 nt, Homo sapiens
augcaaacaaaauccaagau

SEQ ID NO: 1206932 - RNA, 13 nt, Homo sapiens
augcaaaugccuc

SEQ ID NO: 1206933 - RNA, 20 nt, Homo sapiens
augcaaaugccuccaagcca

SEQ ID NO: 1206934 - RNA, 14 nt, Homo sapiens
augcaaccuaguca

SEQ ID NO: 1206935 - RNA, 19 nt, Homo sapiens
augcaagguauuucuccag

SEQ ID NO: 1206936 - RNA, 18 nt, Homo sapiens
augcaaguguuccuauuu

SEQ ID NO: 1206937 - RNA, 14 nt, Homo sapiens
augcaaugugcuac

SEQ ID NO: 1206938 - RNA, 21 nt, Homo sapiens
augcaauuucauuuaaacuuc

SEQ ID NO: 1206939 - RNA, 21 nt, Homo sapiens
augcacacacacacaucucau

SEQ ID NO: 1206940 - RNA, 15 nt, Homo sapiens
augcacgaucucagu

SEQ ID NO: 1206941 - RNA, 16 nt, Homo sapiens
augcacuuauucaaua

SEQ ID NO: 1206942 - RNA, 20 nt, Homo sapiens
augcagcaaggggacaucuu

SEQ ID NO: 1206943 - RNA, 22 nt, Homo sapiens
augcagcgccguguccucucug

SEQ ID NO: 1206944 - RNA, 13 nt, Homo sapiens
augcagcuuugca

SEQ ID NO: 1206945 - RNA, 20 nt, Homo sapiens
augcauaaaagacaagcacu

SEQ ID NO: 1206946 - RNA, 18 nt, Homo sapiens
augcauauccugagccau

SEQ ID NO: 1206947 - RNA, 21 nt, Homo sapiens
augcaucaauauguauuacaa

SEQ ID NO: 1206948 - RNA, 15 nt, Homo sapiens
augcaucuggcccag

SEQ ID NO: 1206949 - RNA, 16 nt, Homo sapiens
augcaucuuguuucau

SEQ ID NO: 1206950 - RNA, 18 nt, Homo sapiens
augcauugaaagaauuag

SEQ ID NO: 1206951 - RNA, 21 nt, Homo sapiens
augccaaccggucacccagga

SEQ ID NO: 1206952 - RNA, 17 nt, Homo sapiens
augccaagaaaguauuu

SEQ ID NO: 1206953 - RNA, 21 nt, Homo sapiens
augccaauaauaaaugcccuc

SEQ ID NO: 1206954 - RNA, 20 nt, Homo sapiens
augccaccaacacugcucac

SEQ ID NO: 1206955 - RNA, 14 nt, Homo sapiens
augccacccuagcc

SEQ ID NO: 1206956 - RNA, 15 nt, Homo sapiens
augccacccuagcca

SEQ ID NO: 1206957 - RNA, 17 nt, Homo sapiens
augccacccuguuuuca

SEQ ID NO: 1206958 - RNA, 20 nt, Homo sapiens
augccacguggucacugugc

SEQ ID NO: 1206959 - RNA, 21 nt, Homo sapiens
augccacguggucacugugca

SEQ ID NO: 1206960 - RNA, 22 nt, Homo sapiens
augccacguggucacugugcac

SEQ ID NO: 1206961 - RNA, 21 nt, Homo sapiens
augccagcuacuuccuccucc

SEQ ID NO: 1206962 - RNA, 22 nt, Homo sapiens
augccagugaaacuucaagcaa

SEQ ID NO: 1206963 - RNA, 23 nt, Homo sapiens
augccagugaaacuucaagcaaa

SEQ ID NO: 1206964 - RNA, 17 nt, Homo sapiens
augccauuuagcaauaa

SEQ ID NO: 1206965 - RNA, 14 nt, Homo sapiens
augcccaacugccu

SEQ ID NO: 1206966 - RNA, 21 nt, Homo sapiens
augcccaagagaucugugcca

SEQ ID NO: 1206967 - RNA, 14 nt, Homo sapiens
augcccuugccuau

SEQ ID NO: 1206968 - RNA, 13 nt, Homo sapiens
augccguggauug

SEQ ID NO: 1206969 - RNA, 18 nt, Homo sapiens
augccuacugaguagggg

SEQ ID NO: 1206970 - RNA, 15 nt, Homo sapiens
augccuagaguuuac

SEQ ID NO: 1206971 - RNA, 19 nt, Homo sapiens
augccucagccuacuuuca

SEQ ID NO: 1206972 - RNA, 17 nt, Homo sapiens
augccucagucuauucu

SEQ ID NO: 1206973 - RNA, 16 nt, Homo sapiens
augccucuguauuuaa

SEQ ID NO: 1206974 - RNA, 14 nt, Homo sapiens
augccugcaaucug

SEQ ID NO: 1206975 - RNA, 19 nt, Homo sapiens
augccuggucccaagacag

SEQ ID NO: 1206976 - RNA, 15 nt, Homo sapiens
augccuguaaucuca

SEQ ID NO: 1206977 - RNA, 19 nt, Homo sapiens
augccuucacuuuacaaau

SEQ ID NO: 1206978 - RNA, 13 nt, Homo sapiens
augccuuuaguca

SEQ ID NO: 1206979 - RNA, 22 nt, Homo sapiens
augcgaaccacccaaaacacgc

SEQ ID NO: 1206980 - RNA, 18 nt, Homo sapiens
augcgaggaccacuuugg

SEQ ID NO: 1206981 - RNA, 16 nt, Homo sapiens
augcgcacaaggcuga

SEQ ID NO: 1206982 - RNA, 15 nt, Homo sapiens
augcggauccugcug

SEQ ID NO: 1206983 - RNA, 15 nt, Homo sapiens
augcguguaccucac

SEQ ID NO: 1206984 - RNA, 21 nt, Homo sapiens
augcuaagaaugcauuauuga

SEQ ID NO: 1206985 - RNA, 22 nt, Homo sapiens
augcuagaaaggaagacagauu

SEQ ID NO: 1206986 - RNA, 16 nt, Homo sapiens
augcuauacuggaaau

SEQ ID NO: 1206987 - RNA, 14 nt, Homo sapiens
augcuauuuauuaa

SEQ ID NO: 1206988 - RNA, 13 nt, Homo sapiens
augcucagaaagg

SEQ ID NO: 1206989 - RNA, 16 nt, Homo sapiens
augcucauugaacuuu

SEQ ID NO: 1206990 - RNA, 12 nt, Homo sapiens
augcuccaagau

SEQ ID NO: 1206991 - RNA, 21 nt, Homo sapiens
augcuccaucccaaccaggca

SEQ ID NO: 1206992 - RNA, 17 nt, Homo sapiens
augcucccagcugugcu

SEQ ID NO: 1206993 - RNA, 23 nt, Homo sapiens
augcucccuccccugcccugguc

SEQ ID NO: 1206994 - RNA, 12 nt, Homo sapiens
augcucucucau

SEQ ID NO: 1206995 - RNA, 19 nt, Homo sapiens
augcucugccccaagcccc

SEQ ID NO: 1206996 - RNA, 22 nt, Homo sapiens
augcugaaaaauauagccuuua

SEQ ID NO: 1206997 - RNA, 19 nt, Homo sapiens
augcugaaaaaucauccaa

SEQ ID NO: 1206998 - RNA, 16 nt, Homo sapiens
augcugaauccaccuc

SEQ ID NO: 1206999 - RNA, 13 nt, Homo sapiens
augcugacuguac

SEQ ID NO: 1207000 - RNA, 15 nt, Homo sapiens
augcugcacagaaau

SEQ ID NO: 1207001 - RNA, 21 nt, Homo sapiens
augcugcuauggaaggugcua

SEQ ID NO: 1207002 - RNA, 15 nt, Homo sapiens
augcugcuucuccuc

SEQ ID NO: 1207003 - RNA, 19 nt, Homo sapiens
augcugcuuguuggcucca

SEQ ID NO: 1207004 - RNA, 21 nt, Homo sapiens
augcugcuuuaggaauucugc

SEQ ID NO: 1207005 - RNA, 20 nt, Homo sapiens
augcuggacggcauuccugc

SEQ ID NO: 1207006 - RNA, 13 nt, Homo sapiens
augcuggcaaagg

SEQ ID NO: 1207007 - RNA, 16 nt, Homo sapiens
augcuggcagccaugg

SEQ ID NO: 1207008 - RNA, 20 nt, Homo sapiens
augcuggcagccauggccau

SEQ ID NO: 1207009 - RNA, 15 nt, Homo sapiens
augcuggcauuugca

SEQ ID NO: 1207010 - RNA, 20 nt, Homo sapiens
augcugucaagcaccugcau

SEQ ID NO: 1207011 - RNA, 21 nt, Homo sapiens
augcugucccuauacacuaga

SEQ ID NO: 1207012 - RNA, 20 nt, Homo sapiens
augcugugcucaaucagccu

SEQ ID NO: 1207013 - RNA, 15 nt, Homo sapiens
augcugugcucuuug

SEQ ID NO: 1207014 - RNA, 23 nt, Homo sapiens
augcuguucacuggacacuucac

SEQ ID NO: 1207015 - RNA, 14 nt, Homo sapiens
augcuuaugacaau

SEQ ID NO: 1207016 - RNA, 18 nt, Homo sapiens
augcuucccagagggagc

SEQ ID NO: 1207017 - RNA, 15 nt, Homo sapiens
augcuuccugacaau

SEQ ID NO: 1207018 - RNA, 22 nt, Homo sapiens
augcuucuauaauuuugccuuu

SEQ ID NO: 1207019 - RNA, 15 nt, Homo sapiens
augcuucugcacaca

SEQ ID NO: 1207020 - RNA, 14 nt, Homo sapiens
augcuuggauguaa

SEQ ID NO: 1207021 - RNA, 15 nt, Homo sapiens
augcuuuugcuugca

SEQ ID NO: 1207022 - RNA, 20 nt, Homo sapiens
augcuuuugcuugcaaugua

SEQ ID NO: 1207023 - RNA, 19 nt, Homo sapiens
auggaaaauaaacaucagu

SEQ ID NO: 1207024 - RNA, 20 nt, Homo sapiens
auggaaaaucagcugcucag

SEQ ID NO: 1207025 - RNA, 21 nt, Homo sapiens
auggaaaucacauuuacaaaa

SEQ ID NO: 1207026 - RNA, 20 nt, Homo sapiens
auggaagaaacacagaaagg

SEQ ID NO: 1207027 - RNA, 15 nt, Homo sapiens
auggaaucaauucaa

SEQ ID NO: 1207028 - RNA, 22 nt, Homo sapiens
auggaaugaccagccuguccaa

SEQ ID NO: 1207029 - RNA, 16 nt, Homo sapiens
auggaauugauuugca

SEQ ID NO: 1207030 - RNA, 17 nt, Homo sapiens
auggaauuucauaucua

SEQ ID NO: 1207031 - RNA, 12 nt, Homo sapiens
auggacaacuua

SEQ ID NO: 1207032 - RNA, 14 nt, Homo sapiens
auggacagcgauga

SEQ ID NO: 1207033 - RNA, 13 nt, Homo sapiens
auggacagugggc

SEQ ID NO: 1207034 - RNA, 18 nt, Homo sapiens
auggaccacacuuugaga

SEQ ID NO: 1207035 - RNA, 14 nt, Homo sapiens
auggaccacuuuua

SEQ ID NO: 1207036 - RNA, 19 nt, Homo sapiens
auggaccaggaagcccuga

SEQ ID NO: 1207037 - RNA, 20 nt, Homo sapiens
auggacucugaaaaacauuc

SEQ ID NO: 1207038 - RNA, 13 nt, Homo sapiens
auggacucugcac

SEQ ID NO: 1207039 - RNA, 16 nt, Homo sapiens
auggacugcuucaucu

SEQ ID NO: 1207040 - RNA, 22 nt, Homo sapiens
auggacuggagcucaucugcaa

SEQ ID NO: 1207041 - RNA, 23 nt, Homo sapiens
auggacuggagcucaucugcaaa

SEQ ID NO: 1207042 - RNA, 18 nt, Homo sapiens
auggagaaucugcugcau

SEQ ID NO: 1207043 - RNA, 21 nt, Homo sapiens
auggagauauuuacaugaauu

SEQ ID NO: 1207044 - RNA, 18 nt, Homo sapiens
auggaggaaagugauauc

SEQ ID NO: 1207045 - RNA, 14 nt, Homo sapiens
auggaggucauaca

SEQ ID NO: 1207046 - RNA, 20 nt, Homo sapiens
auggagugcucacaaaggau

SEQ ID NO: 1207047 - RNA, 19 nt, Homo sapiens
auggaguggcugccaugga

SEQ ID NO: 1207048 - RNA, 18 nt, Homo sapiens
auggaguucuugugccau

SEQ ID NO: 1207049 - RNA, 17 nt, Homo sapiens
auggauaaacugagccu

SEQ ID NO: 1207050 - RNA, 20 nt, Homo sapiens
auggaucccgaagaauggag

SEQ ID NO: 1207051 - RNA, 14 nt, Homo sapiens
auggauucuauuua

SEQ ID NO: 1207052 - RNA, 17 nt, Homo sapiens
auggauuucauggugau

SEQ ID NO: 1207053 - RNA, 16 nt, Homo sapiens
auggauuugaugcugu

SEQ ID NO: 1207054 - RNA, 14 nt, Homo sapiens
auggcaaacugcca

SEQ ID NO: 1207055 - RNA, 14 nt, Homo sapiens
auggcacugacaau

SEQ ID NO: 1207056 - RNA, 15 nt, Homo sapiens
auggcagaaccaaag

SEQ ID NO: 1207057 - RNA, 14 nt, Homo sapiens
auggcagaagggaa

SEQ ID NO: 1207058 - RNA, 21 nt, Homo sapiens
auggcagaagggaauugcuca

SEQ ID NO: 1207059 - RNA, 12 nt, Homo sapiens
auggcagggaua

SEQ ID NO: 1207060 - RNA, 21 nt, Homo sapiens
auggccagagaugcuggacuu

SEQ ID NO: 1207061 - RNA, 16 nt, Homo sapiens
auggccagugucuguc

SEQ ID NO: 1207062 - RNA, 18 nt, Homo sapiens
auggccccaguccaugcu

SEQ ID NO: 1207063 - RNA, 23 nt, Homo sapiens
auggccgaaaaggauaugcagua

SEQ ID NO: 1207064 - RNA, 14 nt, Homo sapiens
auggccuggaaccc

SEQ ID NO: 1207065 - RNA, 22 nt, Homo sapiens
auggccuggcugcugcugugca

SEQ ID NO: 1207066 - RNA, 15 nt, Homo sapiens
auggccuugcuaccu

SEQ ID NO: 1207067 - RNA, 16 nt, Homo sapiens
auggcuaccaaaaaga

SEQ ID NO: 1207068 - RNA, 18 nt, Homo sapiens
auggcucaggcaagcccc

SEQ ID NO: 1207069 - RNA, 17 nt, Homo sapiens
auggcuccuccauaucu

SEQ ID NO: 1207070 - RNA, 17 nt, Homo sapiens
auggcucuggcacagug

SEQ ID NO: 1207071 - RNA, 12 nt, Homo sapiens
auggcugagaug

SEQ ID NO: 1207072 - RNA, 17 nt, Homo sapiens
auggcuggccacugcac

SEQ ID NO: 1207073 - RNA, 18 nt, Homo sapiens
auggcuucggacaaaaua

SEQ ID NO: 1207074 - RNA, 15 nt, Homo sapiens
cauccccacccaguc

SEQ ID NO: 1207075 - RNA, 18 nt, Homo sapiens
cauccccauccuccagcu

SEQ ID NO: 1207076 - RNA, 17 nt, Homo sapiens
caucccuuaguuuccac

SEQ ID NO: 1207077 - RNA, 18 nt, Homo sapiens
cauccuaccccuuugcac

SEQ ID NO: 1207078 - RNA, 20 nt, Homo sapiens
cauccuaccccuuugcacuu

SEQ ID NO: 1207079 - RNA, 16 nt, Homo sapiens
cauccucacaccuucu

SEQ ID NO: 1207080 - RNA, 15 nt, Homo sapiens
cauccucaugcugcu

SEQ ID NO: 1207081 - RNA, 13 nt, Homo sapiens
cauccuccagcuu

SEQ ID NO: 1207082 - RNA, 16 nt, Homo sapiens
cauccucucuggugug

SEQ ID NO: 1207083 - RNA, 18 nt, Homo sapiens
cauccugaggcuccacuu

SEQ ID NO: 1207084 - RNA, 12 nt, Homo sapiens
cauccuggcacg

SEQ ID NO: 1207085 - RNA, 20 nt, Homo sapiens
cauccugggcagcauacuga

SEQ ID NO: 1207086 - RNA, 21 nt, Homo sapiens
cauccuguauaagcacugaaa

SEQ ID NO: 1207087 - RNA, 23 nt, Homo sapiens
cauccuuaaaacaauucugugac

SEQ ID NO: 1207088 - RNA, 24 nt, Homo sapiens
cauccuuaaaacaauucugugaca

SEQ ID NO: 1207089 - RNA, 22 nt, Homo sapiens
cauccuuuacaccaacuccuaa

SEQ ID NO: 1207090 - RNA, 22 nt, Homo sapiens
caucgaaucuacuaauuccaca

SEQ ID NO: 1207091 - RNA, 18 nt, Homo sapiens
caucggaauucagccaug

SEQ ID NO: 1207092 - RNA, 12 nt, Homo sapiens
caucgggagcac

SEQ ID NO: 1207093 - RNA, 17 nt, Homo sapiens
caucgggggugaaucuu

SEQ ID NO: 1207094 - RNA, 13 nt, Homo sapiens
caucguucaucca

SEQ ID NO: 1207095 - RNA, 23 nt, Homo sapiens
caucuaagaaguuuuguucuguc

SEQ ID NO: 1207096 - RNA, 17 nt, Homo sapiens
caucucaaaaagaaaag

SEQ ID NO: 1207097 - RNA, 13 nt, Homo sapiens
caucucagugcag

SEQ ID NO: 1207098 - RNA, 15 nt, Homo sapiens
caucucagugcagga

SEQ ID NO: 1207099 - RNA, 15 nt, Homo sapiens
caucuccagcuauuu

SEQ ID NO: 1207100 - RNA, 19 nt, Homo sapiens
caucuccuauaaucuguca

SEQ ID NO: 1207101 - RNA, 20 nt, Homo sapiens
caucuccuauaaucugucaa

SEQ ID NO: 1207102 - RNA, 15 nt, Homo sapiens
caucucggagcaucc

SEQ ID NO: 1207103 - RNA, 20 nt, Homo sapiens
caucucuacuaaaaauacaa

SEQ ID NO: 1207104 - RNA, 20 nt, Homo sapiens
caucucuacugaaaguacaa

SEQ ID NO: 1207105 - RNA, 15 nt, Homo sapiens
caucucugccuggaa

SEQ ID NO: 1207106 - RNA, 17 nt, Homo sapiens
caucucuuuugagcuaa

SEQ ID NO: 1207107 - RNA, 20 nt, Homo sapiens
caucugcacggugggagacc

SEQ ID NO: 1207108 - RNA, 19 nt, Homo sapiens
caucugccuuaaaaccaaa

SEQ ID NO: 1207109 - RNA, 18 nt, Homo sapiens
caucuggaaggacaucua

SEQ ID NO: 1207110 - RNA, 23 nt, Homo sapiens
caucuggcuuauuuuaaugugau

SEQ ID NO: 1207111 - RNA, 22 nt, Homo sapiens
caucuggggcaccugcuuccac

SEQ ID NO: 1207112 - RNA, 23 nt, Homo sapiens
caucuguagauacuagcuaucua

SEQ ID NO: 1207113 - RNA, 11 nt, Homo sapiens
caucuguggag

SEQ ID NO: 1207114 - RNA, 18 nt, Homo sapiens
caucuuauagcacuuuga

SEQ ID NO: 1207115 - RNA, 19 nt, Homo sapiens
caucuucaaagcuugaaga

SEQ ID NO: 1207116 - RNA, 18 nt, Homo sapiens
caucuucaggcccagcca

SEQ ID NO: 1207117 - RNA, 19 nt, Homo sapiens
caucuuccaacccacuggc

SEQ ID NO: 1207118 - RNA, 20 nt, Homo sapiens
caucuucuaggccaagcauu

SEQ ID NO: 1207119 - RNA, 23 nt, Homo sapiens
caucuugcucugcugacagacac

SEQ ID NO: 1207120 - RNA, 15 nt, Homo sapiens
caucuugcugcuaau

SEQ ID NO: 1207121 - RNA, 23 nt, Homo sapiens
caucuuggucagauuugaacucu

SEQ ID NO: 1207122 - RNA, 14 nt, Homo sapiens
caucuugugaaaug

SEQ ID NO: 1207123 - RNA, 22 nt, Homo sapiens
caucuugugaaauggccaggau

SEQ ID NO: 1207124 - RNA, 11 nt, Homo sapiens
caucuuuacaa

SEQ ID NO: 1207125 - RNA, 16 nt, Homo sapiens
caucuuucacuaucug

SEQ ID NO: 1207126 - RNA, 23 nt, Homo sapiens
caucuuuccuucggguuggcaaa

SEQ ID NO: 1207127 - RNA, 14 nt, Homo sapiens
caucuuugaacuuc

SEQ ID NO: 1207128 - RNA, 23 nt, Homo sapiens
caucuuuguggcgggagugcuca

SEQ ID NO: 1207129 - RNA, 18 nt, Homo sapiens
caugaaaauaaacuugaa

SEQ ID NO: 1207130 - RNA, 20 nt, Homo sapiens
caugaaaucuuuaugugaua

SEQ ID NO: 1207131 - RNA, 17 nt, Homo sapiens
caugaacagaaacaaua

SEQ ID NO: 1207132 - RNA, 14 nt, Homo sapiens
caugaacagcauua

SEQ ID NO: 1207133 - RNA, 19 nt, Homo sapiens
caugaagaaugcauucaaa

SEQ ID NO: 1207134 - RNA, 20 nt, Homo sapiens
caugaaggagcagcauugac

SEQ ID NO: 1207135 - RNA, 10 nt, Homo sapiens
caugaaggug

SEQ ID NO: 1207136 - RNA, 19 nt, Homo sapiens
caugaauauaaaugggaaa

SEQ ID NO: 1207137 - RNA, 14 nt, Homo sapiens
caugaauccagucc

SEQ ID NO: 1207138 - RNA, 17 nt, Homo sapiens
caugaauccaguccaga

SEQ ID NO: 1207139 - RNA, 17 nt, Homo sapiens
caugaaucucucaauua

SEQ ID NO: 1207140 - RNA, 16 nt, Homo sapiens
caugaauuaguucucc

SEQ ID NO: 1207141 - RNA, 14 nt, Homo sapiens
caugacacugaccu

SEQ ID NO: 1207142 - RNA, 13 nt, Homo sapiens
caugacauaugac

SEQ ID NO: 1207143 - RNA, 20 nt, Homo sapiens
caugacccaccccugugcuc

SEQ ID NO: 1207144 - RNA, 18 nt, Homo sapiens
caugaccugugaccagca

SEQ ID NO: 1207145 - RNA, 13 nt, Homo sapiens
caugacggggaca

SEQ ID NO: 1207146 - RNA, 15 nt, Homo sapiens
caugacguaguauua

SEQ ID NO: 1207147 - RNA, 15 nt, Homo sapiens
caugacucagacugc

SEQ ID NO: 1207148 - RNA, 21 nt, Homo sapiens
caugacucggggguggggaaa

SEQ ID NO: 1207149 - RNA, 20 nt, Homo sapiens
caugacucguauaugucuca

SEQ ID NO: 1207150 - RNA, 14 nt, Homo sapiens
caugagaauaagag

SEQ ID NO: 1207151 - RNA, 18 nt, Homo sapiens
caugagaccacuguuauc

SEQ ID NO: 1207152 - RNA, 21 nt, Homo sapiens
caugagagaaggaggggagca

SEQ ID NO: 1207153 - RNA, 21 nt, Homo sapiens
caugagagaauuguaucauuu

SEQ ID NO: 1207154 - RNA, 17 nt, Homo sapiens
caugaggaaucugggag

SEQ ID NO: 1207155 - RNA, 17 nt, Homo sapiens
caugaggacagaccaca

SEQ ID NO: 1207156 - RNA, 15 nt, Homo sapiens
caugaggccaucuca

SEQ ID NO: 1207157 - RNA, 16 nt, Homo sapiens
caugaggccaucucag

SEQ ID NO: 1207158 - RNA, 18 nt, Homo sapiens
caugaguuaucaugaauu

SEQ ID NO: 1207159 - RNA, 16 nt, Homo sapiens
caugauacaaauucca

SEQ ID NO: 1207160 - RNA, 16 nt, Homo sapiens
caugauauguccucag

SEQ ID NO: 1207161 - RNA, 21 nt, Homo sapiens
caugaucgagccacugcacuc

SEQ ID NO: 1207162 - RNA, 13 nt, Homo sapiens
caugaugaucugc

SEQ ID NO: 1207163 - RNA, 16 nt, Homo sapiens
caugaugucaacucac

SEQ ID NO: 1207164 - RNA, 18 nt, Homo sapiens
caugaugucuaccucaga

SEQ ID NO: 1207165 - RNA, 22 nt, Homo sapiens
caugaugucuaccucagaauua

SEQ ID NO: 1207166 - RNA, 19 nt, Homo sapiens
caugaugugcaaccagcau

SEQ ID NO: 1207167 - RNA, 14 nt, Homo sapiens
caugauucuuuaau

SEQ ID NO: 1207168 - RNA, 16 nt, Homo sapiens
caugauuuccuugaau

SEQ ID NO: 1207169 - RNA, 15 nt, Homo sapiens
caugcaaaauauguu

SEQ ID NO: 1207170 - RNA, 23 nt, Homo sapiens
caugcacacgggaaagccuuaaa

SEQ ID NO: 1207171 - RNA, 18 nt, Homo sapiens
caugcacccucauacaca

SEQ ID NO: 1207172 - RNA, 21 nt, Homo sapiens
caugcagcaaggggacaucuu

SEQ ID NO: 1207173 - RNA, 21 nt, Homo sapiens
caugcagcuguggcagaguua

SEQ ID NO: 1207174 - RNA, 18 nt, Homo sapiens
caugcaguugugggaccg

SEQ ID NO: 1207175 - RNA, 19 nt, Homo sapiens
caugcauaaauaugcagug

SEQ ID NO: 1207176 - RNA, 15 nt, Homo sapiens
caugcauacuuuauu

SEQ ID NO: 1207177 - RNA, 21 nt, Homo sapiens
caugcauggauggguccucac

SEQ ID NO: 1207178 - RNA, 18 nt, Homo sapiens
caugcauguccuguaaag

SEQ ID NO: 1207179 - RNA, 16 nt, Homo sapiens
caugcauguuugguua

SEQ ID NO: 1207180 - RNA, 23 nt, Homo sapiens
caugcccuggauccaucaggcca

SEQ ID NO: 1207181 - RNA, 13 nt, Homo sapiens
caugccucugaua

SEQ ID NO: 1207182 - RNA, 16 nt, Homo sapiens
caugccuggucuuucc

SEQ ID NO: 1207183 - RNA, 22 nt, Homo sapiens
caugccuguaaucccaacacuu

SEQ ID NO: 1207184 - RNA, 20 nt, Homo sapiens
caugccuugugcuguuaaua

SEQ ID NO: 1207185 - RNA, 15 nt, Homo sapiens
caugcgcacucucau

SEQ ID NO: 1207186 - RNA, 21 nt, Homo sapiens
caugcuacuuuuuuuuaguuc

SEQ ID NO: 1207187 - RNA, 19 nt, Homo sapiens
caugcugaaaacuacacaa

SEQ ID NO: 1207188 - RNA, 23 nt, Homo sapiens
caugcugcaguggguaguucuaa

SEQ ID NO: 1207189 - RNA, 22 nt, Homo sapiens
caugcuggggcccuaccagcag

SEQ ID NO: 1207190 - RNA, 15 nt, Homo sapiens
caugcugugugcugg

SEQ ID NO: 1207191 - RNA, 15 nt, Homo sapiens
caugcuucgugccac

SEQ ID NO: 1207192 - RNA, 20 nt, Homo sapiens
caugcuuugcugcuaugaaa

SEQ ID NO: 1207193 - RNA, 14 nt, Homo sapiens
caugcuuuucugcc

SEQ ID NO: 1207194 - RNA, 18 nt, Homo sapiens
cauggaauggcagguguc

SEQ ID NO: 1207195 - RNA, 15 nt, Homo sapiens
cauggacagcaucaa

SEQ ID NO: 1207196 - RNA, 13 nt, Homo sapiens
cauggacauuuag

SEQ ID NO: 1207197 - RNA, 18 nt, Homo sapiens
cauggacuacaccagggu

SEQ ID NO: 1207198 - RNA, 16 nt, Homo sapiens
cauggaggcaugccaa

SEQ ID NO: 1207199 - RNA, 16 nt, Homo sapiens
ccaaagcucagacuug

SEQ ID NO: 1207200 - RNA, 21 nt, Homo sapiens
ccaaagggugaagcuauuuau

SEQ ID NO: 1207201 - RNA, 18 nt, Homo sapiens
ccaaaguaacugaauuau

SEQ ID NO: 1207202 - RNA, 12 nt, Homo sapiens
ccaaaguucuaa

SEQ ID NO: 1207203 - RNA, 19 nt, Homo sapiens
ccaaaguuugcucaaggag

SEQ ID NO: 1207204 - RNA, 14 nt, Homo sapiens
ccaaauaaacucca

SEQ ID NO: 1207205 - RNA, 15 nt, Homo sapiens
ccaaauaaauauauu

SEQ ID NO: 1207206 - RNA, 14 nt, Homo sapiens
ccaaauaauuucau

SEQ ID NO: 1207207 - RNA, 18 nt, Homo sapiens
ccaaauaccauguacaua

SEQ ID NO: 1207208 - RNA, 20 nt, Homo sapiens
ccaaaucaauaagaagguag

SEQ ID NO: 1207209 - RNA, 15 nt, Homo sapiens
ccaaaucagcugcua

SEQ ID NO: 1207210 - RNA, 17 nt, Homo sapiens
ccaaaucugacauauua

SEQ ID NO: 1207211 - RNA, 12 nt, Homo sapiens
ccaaaugagauc

SEQ ID NO: 1207212 - RNA, 18 nt, Homo sapiens
ccaaaugaugccacuucc

SEQ ID NO: 1207213 - RNA, 21 nt, Homo sapiens
ccaaaugauuucagaauuuag

SEQ ID NO: 1207214 - RNA, 14 nt, Homo sapiens
ccaaauguguauaa

SEQ ID NO: 1207215 - RNA, 22 nt, Homo sapiens
ccaaauguucauccucauugcc

SEQ ID NO: 1207216 - RNA, 13 nt, Homo sapiens
ccaaauguuccau

SEQ ID NO: 1207217 - RNA, 17 nt, Homo sapiens
ccaaauugacauguugu

SEQ ID NO: 1207218 - RNA, 14 nt, Homo sapiens
ccaaauugcagcuu

SEQ ID NO: 1207219 - RNA, 15 nt, Homo sapiens
ccaacaaaccacaca

SEQ ID NO: 1207220 - RNA, 13 nt, Homo sapiens
ccaacaaaccauc

SEQ ID NO: 1207221 - RNA, 13 nt, Homo sapiens
ccaacaccacaga

SEQ ID NO: 1207222 - RNA, 12 nt, Homo sapiens
ccaacacccaaa

SEQ ID NO: 1207223 - RNA, 15 nt, Homo sapiens
ccaacacccugucua

SEQ ID NO: 1207224 - RNA, 13 nt, Homo sapiens
ccaacacuuugag

SEQ ID NO: 1207225 - RNA, 23 nt, Homo sapiens
ccaacaggcuguucugcacugaa

SEQ ID NO: 1207226 - RNA, 20 nt, Homo sapiens
ccaacaucaacaucuugguc

SEQ ID NO: 1207227 - RNA, 15 nt, Homo sapiens
ccaaccaaaccaauu

SEQ ID NO: 1207228 - RNA, 16 nt, Homo sapiens
ccaaccagacagcaca

SEQ ID NO: 1207229 - RNA, 13 nt, Homo sapiens
ccaaccaguuuga

SEQ ID NO: 1207230 - RNA, 13 nt, Homo sapiens
ccaaccccagugg

SEQ ID NO: 1207231 - RNA, 22 nt, Homo sapiens
ccaacccccgccaccucagggc

SEQ ID NO: 1207232 - RNA, 17 nt, Homo sapiens
ccaaccggucacccagg

SEQ ID NO: 1207233 - RNA, 15 nt, Homo sapiens
ccaaccucuggagca

SEQ ID NO: 1207234 - RNA, 15 nt, Homo sapiens
ccaaccuggacuugu

SEQ ID NO: 1207235 - RNA, 22 nt, Homo sapiens
ccaaccuggaguauaauauuca

SEQ ID NO: 1207236 - RNA, 23 nt, Homo sapiens
ccaacguucgauuucuaccucag

SEQ ID NO: 1207237 - RNA, 16 nt, Homo sapiens
ccaacuacucagccua

SEQ ID NO: 1207238 - RNA, 22 nt, Homo sapiens
ccaacucugagcccauguucug

SEQ ID NO: 1207239 - RNA, 13 nt, Homo sapiens
ccaacucugggaa

SEQ ID NO: 1207240 - RNA, 20 nt, Homo sapiens
ccaacugcaaaaaaagccuc

SEQ ID NO: 1207241 - RNA, 17 nt, Homo sapiens
ccaacuucaauuuacuu

SEQ ID NO: 1207242 - RNA, 19 nt, Homo sapiens
ccaacuucauuugaugcua

SEQ ID NO: 1207243 - RNA, 21 nt, Homo sapiens
ccaacuuccuguugauguuca

SEQ ID NO: 1207244 - RNA, 19 nt, Homo sapiens
ccaagaaagcucacuguag

SEQ ID NO: 1207245 - RNA, 22 nt, Homo sapiens
ccaagacaaaaagccacaauga

SEQ ID NO: 1207246 - RNA, 16 nt, Homo sapiens
ccaagacagagacaga

SEQ ID NO: 1207247 - RNA, 13 nt, Homo sapiens
ccaagacagugag

SEQ ID NO: 1207248 - RNA, 15 nt, Homo sapiens
ccaagagugaaggga

SEQ ID NO: 1207249 - RNA, 22 nt, Homo sapiens
ccaagcaaccuggguccaaaua

SEQ ID NO: 1207250 - RNA, 14 nt, Homo sapiens
ccaagccauucacu

SEQ ID NO: 1207251 - RNA, 19 nt, Homo sapiens
ccaagcccugaggccugag

SEQ ID NO: 1207252 - RNA, 19 nt, Homo sapiens
ccaagcucuguccaaucag

SEQ ID NO: 1207253 - RNA, 21 nt, Homo sapiens
ccaagcugccucugggccaug

SEQ ID NO: 1207254 - RNA, 19 nt, Homo sapiens
ccaaggaaacgcuaccucu

SEQ ID NO: 1207255 - RNA, 22 nt, Homo sapiens
ccaaggaacaaaaaaaccacaa

SEQ ID NO: 1207256 - RNA, 15 nt, Homo sapiens
ccaaggacucuucca

SEQ ID NO: 1207257 - RNA, 21 nt, Homo sapiens
ccaaggaguuggaagugaagu

SEQ ID NO: 1207258 - RNA, 22 nt, Homo sapiens
ccaaggauccucuccacuccau

SEQ ID NO: 1207259 - RNA, 14 nt, Homo sapiens
ccaaggcaggcaua

SEQ ID NO: 1207260 - RNA, 23 nt, Homo sapiens
ccaaggcauugauugcacuugau

SEQ ID NO: 1207261 - RNA, 22 nt, Homo sapiens
ccaaggcugagacagugaauuu

SEQ ID NO: 1207262 - RNA, 15 nt, Homo sapiens
ccaagggaaaggggu

SEQ ID NO: 1207263 - RNA, 20 nt, Homo sapiens
ccaagggacccuuugccuuu

SEQ ID NO: 1207264 - RNA, 17 nt, Homo sapiens
ccaagggaucugccauu

SEQ ID NO: 1207265 - RNA, 21 nt, Homo sapiens
ccaagggcuucugcacccucc

SEQ ID NO: 1207266 - RNA, 18 nt, Homo sapiens
ccaaggguacuaaggaau

SEQ ID NO: 1207267 - RNA, 15 nt, Homo sapiens
ccaagguuuaaagag

SEQ ID NO: 1207268 - RNA, 17 nt, Homo sapiens
ccaaguagcugggacua

SEQ ID NO: 1207269 - RNA, 22 nt, Homo sapiens
ccaaguagucugcucacaguaa

SEQ ID NO: 1207270 - RNA, 13 nt, Homo sapiens
ccaagucauggag

SEQ ID NO: 1207271 - RNA, 14 nt, Homo sapiens
ccaaguccucauuu

SEQ ID NO: 1207272 - RNA, 16 nt, Homo sapiens
ccaagucggaacagca

SEQ ID NO: 1207273 - RNA, 16 nt, Homo sapiens
ccaagucucagaagag

SEQ ID NO: 1207274 - RNA, 15 nt, Homo sapiens
ccaagugcaaaagaa

SEQ ID NO: 1207275 - RNA, 22 nt, Homo sapiens
ccaaguguaaaaacaaugugcu

SEQ ID NO: 1207276 - RNA, 13 nt, Homo sapiens
ccaaguuccguca

SEQ ID NO: 1207277 - RNA, 17 nt, Homo sapiens
ccaaguucuucaccucu

SEQ ID NO: 1207278 - RNA, 16 nt, Homo sapiens
ccaaguuuccaaacaa

SEQ ID NO: 1207279 - RNA, 14 nt, Homo sapiens
ccaauaaaacugau

SEQ ID NO: 1207280 - RNA, 17 nt, Homo sapiens
ccaauaaaagcucuucu

SEQ ID NO: 1207281 - RNA, 17 nt, Homo sapiens
ccaauagcaaggcugug

SEQ ID NO: 1207282 - RNA, 18 nt, Homo sapiens
ccaauagggcugagcucu

SEQ ID NO: 1207283 - RNA, 19 nt, Homo sapiens
ccaauagggcugagcucuc

SEQ ID NO: 1207284 - RNA, 15 nt, Homo sapiens
ccaauccaacaucca

SEQ ID NO: 1207285 - RNA, 19 nt, Homo sapiens
ccaaucccaccaacccuca

SEQ ID NO: 1207286 - RNA, 23 nt, Homo sapiens
ccaaucccuuuauuacccccucc

SEQ ID NO: 1207287 - RNA, 13 nt, Homo sapiens
ccaaucuuucuau

SEQ ID NO: 1207288 - RNA, 22 nt, Homo sapiens
ccaaugaggucugaaauggagg

SEQ ID NO: 1207289 - RNA, 20 nt, Homo sapiens
ccaaugaguuggccuuuaaa

SEQ ID NO: 1207290 - RNA, 13 nt, Homo sapiens
ccaaugauucaua

SEQ ID NO: 1207291 - RNA, 21 nt, Homo sapiens
ccaaugguccuagaacuuugu

SEQ ID NO: 1207292 - RNA, 19 nt, Homo sapiens
ccaauggugauccucuauu

SEQ ID NO: 1207293 - RNA, 18 nt, Homo sapiens
ccaauuccaaagccagac

SEQ ID NO: 1207294 - RNA, 19 nt, Homo sapiens
ccaauugcuggaguacuua

SEQ ID NO: 1207295 - RNA, 17 nt, Homo sapiens
ccaauuggcucuaguca

SEQ ID NO: 1207296 - RNA, 19 nt, Homo sapiens
ccaauuggcucuagucacu

SEQ ID NO: 1207297 - RNA, 14 nt, Homo sapiens
ccaauuuacauacu

SEQ ID NO: 1207298 - RNA, 23 nt, Homo sapiens
ccaauuuucuggaauacaugaaa

SEQ ID NO: 1207299 - RNA, 16 nt, Homo sapiens
ccacaaaaaauacuuu

SEQ ID NO: 1207300 - RNA, 13 nt, Homo sapiens
ccacaaaacugac

SEQ ID NO: 1207301 - RNA, 23 nt, Homo sapiens
ccacaaaugguggguacaaaaag

SEQ ID NO: 1207302 - RNA, 15 nt, Homo sapiens
ccacaacugacacag

SEQ ID NO: 1207303 - RNA, 13 nt, Homo sapiens
ccacaacuuuaaa

SEQ ID NO: 1207304 - RNA, 22 nt, Homo sapiens
ccacaaucuggcuuagugccac

SEQ ID NO: 1207305 - RNA, 23 nt, Homo sapiens
ccacaauuuccuggguuccacca

SEQ ID NO: 1207306 - RNA, 14 nt, Homo sapiens
ccacacacagagga

SEQ ID NO: 1207307 - RNA, 11 nt, Homo sapiens
ccacacauauu

SEQ ID NO: 1207308 - RNA, 16 nt, Homo sapiens
ccacacauuaguacuu

SEQ ID NO: 1207309 - RNA, 18 nt, Homo sapiens
ccacacauuaguacuuau

SEQ ID NO: 1207310 - RNA, 22 nt, Homo sapiens
ccacacccuggaggauuucauc

SEQ ID NO: 1207311 - RNA, 16 nt, Homo sapiens
ccacaccugggcauuu

SEQ ID NO: 1207312 - RNA, 18 nt, Homo sapiens
ccacacgauuagcuuuau

SEQ ID NO: 1207313 - RNA, 16 nt, Homo sapiens
ccacacugaaaccaaa

SEQ ID NO: 1207314 - RNA, 21 nt, Homo sapiens
ccacacuuguuccagcucuuu

SEQ ID NO: 1207315 - RNA, 20 nt, Homo sapiens
ccacagaccuaggauuucau

SEQ ID NO: 1207316 - RNA, 20 nt, Homo sapiens
ccacagcgaaggcacaugcc

SEQ ID NO: 1207317 - RNA, 14 nt, Homo sapiens
ccacagcugccauc

SEQ ID NO: 1207318 - RNA, 18 nt, Homo sapiens
ccacaggaggcaagcaag

SEQ ID NO: 1207319 - RNA, 21 nt, Homo sapiens
ccacaggagugggaaaacacu

SEQ ID NO: 1207320 - RNA, 14 nt, Homo sapiens
ccacaggcacaggu

SEQ ID NO: 1207321 - RNA, 23 nt, Homo sapiens
ccacagggcgagacuccgucuca

SEQ ID NO: 1207322 - RNA, 20 nt, Homo sapiens
ccacaguaggcacucaauaa

SEQ ID NO: 1207323 - RNA, 21 nt, Homo sapiens
ccacaguuguguucaugcuga

SEQ ID NO: 1207324 - RNA, 18 nt, Homo sapiens
ccacauacaggugcucaa

SEQ ID NO: 1207325 - RNA, 18 nt, Homo sapiens
ccaguguuauuaaugaca

SEQ ID NO: 1207326 - RNA, 19 nt, Homo sapiens
ccaguguucuaugaacaac

SEQ ID NO: 1207327 - RNA, 13 nt, Homo sapiens
ccaguguucugca

SEQ ID NO: 1207328 - RNA, 19 nt, Homo sapiens
ccauaauccuuucugccga

SEQ ID NO: 1207329 - RNA, 14 nt, Homo sapiens
ccauaauguuacau

SEQ ID NO: 1207330 - RNA, 19 nt, Homo sapiens
ccauaauugcuuugccaaa

SEQ ID NO: 1207331 - RNA, 20 nt, Homo sapiens
ccauacacacuguugucaaa

SEQ ID NO: 1207332 - RNA, 12 nt, Homo sapiens
ccauaccacagc

SEQ ID NO: 1207333 - RNA, 14 nt, Homo sapiens
ccauacugacucaa

SEQ ID NO: 1207334 - RNA, 18 nt, Homo sapiens
ccauagccaccccagaaa

SEQ ID NO: 1207335 - RNA, 19 nt, Homo sapiens
ccauagggacccauucuac

SEQ ID NO: 1207336 - RNA, 20 nt, Homo sapiens
ccauagucaaauuuguaaau

SEQ ID NO: 1207337 - RNA, 22 nt, Homo sapiens
ccauagucgugccuguuugcuu

SEQ ID NO: 1207338 - RNA, 16 nt, Homo sapiens
ccauagugaccaacau

SEQ ID NO: 1207339 - RNA, 20 nt, Homo sapiens
ccauauaucuuauguuaaag

SEQ ID NO: 1207340 - RNA, 16 nt, Homo sapiens
ccauaucugugaaaug

SEQ ID NO: 1207341 - RNA, 22 nt, Homo sapiens
ccauaucuuaaagaaacagcuu

SEQ ID NO: 1207342 - RNA, 15 nt, Homo sapiens
ccauaugaacauaua

SEQ ID NO: 1207343 - RNA, 14 nt, Homo sapiens
ccauaugugggugu

SEQ ID NO: 1207344 - RNA, 15 nt, Homo sapiens
ccauauugagucaaa

SEQ ID NO: 1207345 - RNA, 15 nt, Homo sapiens
ccauauuuacucuuu

SEQ ID NO: 1207346 - RNA, 19 nt, Homo sapiens
ccaucaaacauaauucucu

SEQ ID NO: 1207347 - RNA, 20 nt, Homo sapiens
ccaucaaacauaauucucuc

SEQ ID NO: 1207348 - RNA, 12 nt, Homo sapiens
ccaucacaugau

SEQ ID NO: 1207349 - RNA, 12 nt, Homo sapiens
ccaucaccaccg

SEQ ID NO: 1207350 - RNA, 15 nt, Homo sapiens
ccaucaccgcugggu

SEQ ID NO: 1207351 - RNA, 23 nt, Homo sapiens
ccaucacuagaagaaaagcccau

SEQ ID NO: 1207352 - RNA, 18 nt, Homo sapiens
ccaucaggccuaaucuca

SEQ ID NO: 1207353 - RNA, 11 nt, Homo sapiens
ccaucaguggu

SEQ ID NO: 1207354 - RNA, 14 nt, Homo sapiens
ccauccaccgcugc

SEQ ID NO: 1207355 - RNA, 12 nt, Homo sapiens
ccauccagguuc

SEQ ID NO: 1207356 - RNA, 14 nt, Homo sapiens
ccauccauauacuu

SEQ ID NO: 1207357 - RNA, 15 nt, Homo sapiens
ccauccccaccagcu

SEQ ID NO: 1207358 - RNA, 16 nt, Homo sapiens
ccauccccaggcaccu

SEQ ID NO: 1207359 - RNA, 14 nt, Homo sapiens
ccauccccuggacu

SEQ ID NO: 1207360 - RNA, 19 nt, Homo sapiens
ccauccccuggacugggag

SEQ ID NO: 1207361 - RNA, 23 nt, Homo sapiens
ccaucccucgugguccccaacag

SEQ ID NO: 1207362 - RNA, 17 nt, Homo sapiens
ccaucccuuuuuuuaca

SEQ ID NO: 1207363 - RNA, 16 nt, Homo sapiens
ccauccuacauaauac

SEQ ID NO: 1207364 - RNA, 20 nt, Homo sapiens
ccauccucacaugugacaaa

SEQ ID NO: 1207365 - RNA, 16 nt, Homo sapiens
ccauccuggggcagca

SEQ ID NO: 1207366 - RNA, 13 nt, Homo sapiens
ccaucuacaccag

SEQ ID NO: 1207367 - RNA, 14 nt, Homo sapiens
ccaucuaugagcug

SEQ ID NO: 1207368 - RNA, 14 nt, Homo sapiens
ccaucucaauuuaa

SEQ ID NO: 1207369 - RNA, 22 nt, Homo sapiens
ccaucuccaagauaagccugag

SEQ ID NO: 1207370 - RNA, 14 nt, Homo sapiens
ccaucucuacugaa

SEQ ID NO: 1207371 - RNA, 16 nt, Homo sapiens
ccaucucugauuuuca

SEQ ID NO: 1207372 - RNA, 21 nt, Homo sapiens
ccaucugccaaaaauuacuga

SEQ ID NO: 1207373 - RNA, 20 nt, Homo sapiens
ccaucugcucaccagaucuc

SEQ ID NO: 1207374 - RNA, 21 nt, Homo sapiens
ccaucugcucaccagaucuca

SEQ ID NO: 1207375 - RNA, 13 nt, Homo sapiens
ccaucuucacugg

SEQ ID NO: 1207376 - RNA, 15 nt, Homo sapiens
ccaucuuuugugaga

SEQ ID NO: 1207377 - RNA, 18 nt, Homo sapiens
ccaugaaacugacucauc

SEQ ID NO: 1207378 - RNA, 23 nt, Homo sapiens
ccaugaacagcauuagaauuuac

SEQ ID NO: 1207379 - RNA, 15 nt, Homo sapiens
ccaugaagacaggau

SEQ ID NO: 1207380 - RNA, 17 nt, Homo sapiens
ccaugaagauaaacugu

SEQ ID NO: 1207381 - RNA, 22 nt, Homo sapiens
ccaugaagcgaaacacagagaa

SEQ ID NO: 1207382 - RNA, 19 nt, Homo sapiens
ccaugacgacauacaugcu

SEQ ID NO: 1207383 - RNA, 21 nt, Homo sapiens
ccaugagacccuggugccugg

SEQ ID NO: 1207384 - RNA, 14 nt, Homo sapiens
ccaugccugagggu

SEQ ID NO: 1207385 - RNA, 11 nt, Homo sapiens
ccaugccuguc

SEQ ID NO: 1207386 - RNA, 22 nt, Homo sapiens
ccauggagacaagggcaucauc

SEQ ID NO: 1207387 - RNA, 18 nt, Homo sapiens
ccauggcccccaauaaag

SEQ ID NO: 1207388 - RNA, 20 nt, Homo sapiens
ccaugggaugucaacagcca

SEQ ID NO: 1207389 - RNA, 19 nt, Homo sapiens
ccauggugagcucugggaa

SEQ ID NO: 1207390 - RNA, 13 nt, Homo sapiens
ccaugguuuuacu

SEQ ID NO: 1207391 - RNA, 16 nt, Homo sapiens
ccauguaaauugcaaa

SEQ ID NO: 1207392 - RNA, 18 nt, Homo sapiens
ccauguaaauugcaaaua

SEQ ID NO: 1207393 - RNA, 10 nt, Homo sapiens
ccauguccaa

SEQ ID NO: 1207394 - RNA, 21 nt, Homo sapiens
ccaugucuuuggacaaccaug

SEQ ID NO: 1207395 - RNA, 14 nt, Homo sapiens
ccaugugaacagca

SEQ ID NO: 1207396 - RNA, 13 nt, Homo sapiens
ccauguugaucuu

SEQ ID NO: 1207397 - RNA, 17 nt, Homo sapiens
ccauguuguaaugcugc

SEQ ID NO: 1207398 - RNA, 22 nt, Homo sapiens
ccauguuguaaugcugcacuuc

SEQ ID NO: 1207399 - RNA, 17 nt, Homo sapiens
ccauuaaaaacuaccac

SEQ ID NO: 1207400 - RNA, 21 nt, Homo sapiens
ccauuaaauucacuuucaauu

SEQ ID NO: 1207401 - RNA, 15 nt, Homo sapiens
ccauuaauuacauac

SEQ ID NO: 1207402 - RNA, 16 nt, Homo sapiens
ccauuacaaaauccaa

SEQ ID NO: 1207403 - RNA, 12 nt, Homo sapiens
ccauuaccaaaa

SEQ ID NO: 1207404 - RNA, 16 nt, Homo sapiens
ccauuauuuucuguca

SEQ ID NO: 1207405 - RNA, 22 nt, Homo sapiens
ccauucacaauaaaagcuuaaa

SEQ ID NO: 1207406 - RNA, 15 nt, Homo sapiens
ccauucacaccagcu

SEQ ID NO: 1207407 - RNA, 16 nt, Homo sapiens
ccauucacagugcaag

SEQ ID NO: 1207408 - RNA, 15 nt, Homo sapiens
ccauucagagacugu

SEQ ID NO: 1207409 - RNA, 22 nt, Homo sapiens
ccauucauacccacacacccag

SEQ ID NO: 1207410 - RNA, 22 nt, Homo sapiens
ccauuccacuccacucagguuc

SEQ ID NO: 1207411 - RNA, 16 nt, Homo sapiens
ccauucccccaugugg

SEQ ID NO: 1207412 - RNA, 15 nt, Homo sapiens
ccauucccguggucu

SEQ ID NO: 1207413 - RNA, 13 nt, Homo sapiens
ccauucugaccau

SEQ ID NO: 1207414 - RNA, 19 nt, Homo sapiens
ccauucuucacucuuugaa

SEQ ID NO: 1207415 - RNA, 19 nt, Homo sapiens
cccaaaagucaccacucca

SEQ ID NO: 1207416 - RNA, 13 nt, Homo sapiens
cccaaacccuuaa

SEQ ID NO: 1207417 - RNA, 18 nt, Homo sapiens
cccaaacuggagugcagu

SEQ ID NO: 1207418 - RNA, 16 nt, Homo sapiens
cccaaaguuguuguaa

SEQ ID NO: 1207419 - RNA, 15 nt, Homo sapiens
cccaacacuuugaga

SEQ ID NO: 1207420 - RNA, 21 nt, Homo sapiens
cccaaccaucuucacuggcuu

SEQ ID NO: 1207421 - RNA, 18 nt, Homo sapiens
cccaacccacgaggacca

SEQ ID NO: 1207422 - RNA, 13 nt, Homo sapiens
cccaacccauuca

SEQ ID NO: 1207423 - RNA, 15 nt, Homo sapiens
cccaacccuaucucc

SEQ ID NO: 1207424 - RNA, 13 nt, Homo sapiens
cccaacccuggcu

SEQ ID NO: 1207425 - RNA, 21 nt, Homo sapiens
cccaaccuucuugucauugaa

SEQ ID NO: 1207426 - RNA, 15 nt, Homo sapiens
cccaacgcacaggaa

SEQ ID NO: 1207427 - RNA, 16 nt, Homo sapiens
cccaacgcacaggaaa

SEQ ID NO: 1207428 - RNA, 13 nt, Homo sapiens
cccaagcaggugg

SEQ ID NO: 1207429 - RNA, 21 nt, Homo sapiens
cccaagccugggcuugagcug

SEQ ID NO: 1207430 - RNA, 15 nt, Homo sapiens
cccaaggaagagcca

SEQ ID NO: 1207431 - RNA, 21 nt, Homo sapiens
cccaagggccucccaccagag

SEQ ID NO: 1207432 - RNA, 14 nt, Homo sapiens
cccaauagcacuuu

SEQ ID NO: 1207433 - RNA, 19 nt, Homo sapiens
cccaaucuccaucugucaa

SEQ ID NO: 1207434 - RNA, 23 nt, Homo sapiens
cccaaugcauagagcccuggcca

SEQ ID NO: 1207435 - RNA, 13 nt, Homo sapiens
cccaaugccugcu

SEQ ID NO: 1207436 - RNA, 15 nt, Homo sapiens
cccaaugcugcucca

SEQ ID NO: 1207437 - RNA, 18 nt, Homo sapiens
cccacacagcuacagcuu

SEQ ID NO: 1207438 - RNA, 22 nt, Homo sapiens
cccacacccuggaggauuucau

SEQ ID NO: 1207439 - RNA, 20 nt, Homo sapiens
cccacacugaaaccaaaaca

SEQ ID NO: 1207440 - RNA, 17 nt, Homo sapiens
cccacaguaggcacuca

SEQ ID NO: 1207441 - RNA, 23 nt, Homo sapiens
cccacaugugacacauaugcacc

SEQ ID NO: 1207442 - RNA, 20 nt, Homo sapiens
cccacauuccaaaagggggc

SEQ ID NO: 1207443 - RNA, 14 nt, Homo sapiens
cccaccagugccuu

SEQ ID NO: 1207444 - RNA, 17 nt, Homo sapiens
cccaccaguuauuccuu

SEQ ID NO: 1207445 - RNA, 17 nt, Homo sapiens
cccacccacaugugaca

SEQ ID NO: 1207446 - RNA, 14 nt, Homo sapiens
cccacccagucuca

SEQ ID NO: 1207447 - RNA, 15 nt, Homo sapiens
cccaccccaccaugg

SEQ ID NO: 1207448 - RNA, 16 nt, Homo sapiens
cccacccccaugcacu

SEQ ID NO: 1207449 - RNA, 18 nt, Homo sapiens
cccacccuccucaagaag

SEQ ID NO: 1207450 - RNA, 14 nt, Homo sapiens
cccaccuggccacc

SEQ ID NO: 1207451 - RNA, 13 nt, Homo sapiens
cccaccuuugcca

SEQ ID NO: 1207452 - RNA, 17 nt, Homo sapiens
cugugccccagcagugc

SEQ ID NO: 1207453 - RNA, 18 nt, Homo sapiens
cugugccuaacaccagcg

SEQ ID NO: 1207454 - RNA, 16 nt, Homo sapiens
cugugccuaucaccuc

SEQ ID NO: 1207455 - RNA, 13 nt, Homo sapiens
cugugccugcuca

SEQ ID NO: 1207456 - RNA, 12 nt, Homo sapiens
cugugcuaauaa

SEQ ID NO: 1207457 - RNA, 15 nt, Homo sapiens
cugugcuaugaauuu

SEQ ID NO: 1207458 - RNA, 19 nt, Homo sapiens
cugugcuccgugccuccac

SEQ ID NO: 1207459 - RNA, 21 nt, Homo sapiens
cugugcugcuuuugagccuca

SEQ ID NO: 1207460 - RNA, 14 nt, Homo sapiens
cugugcugggggaa

SEQ ID NO: 1207461 - RNA, 19 nt, Homo sapiens
cugugcugggggaaugagc

SEQ ID NO: 1207462 - RNA, 19 nt, Homo sapiens
cugugcugguguccugacc

SEQ ID NO: 1207463 - RNA, 21 nt, Homo sapiens
cugugcugguguccugaccac

SEQ ID NO: 1207464 - RNA, 13 nt, Homo sapiens
cuguggaaugagu

SEQ ID NO: 1207465 - RNA, 13 nt, Homo sapiens
cuguggaugcuuc

SEQ ID NO: 1207466 - RNA, 19 nt, Homo sapiens
cuguggauggcaucaaaca

SEQ ID NO: 1207467 - RNA, 15 nt, Homo sapiens
cugugggcagcaccc

SEQ ID NO: 1207468 - RNA, 15 nt, Homo sapiens
cuguggucacuugua

SEQ ID NO: 1207469 - RNA, 16 nt, Homo sapiens
cuguggucacuuguac

SEQ ID NO: 1207470 - RNA, 20 nt, Homo sapiens
cugugguuccucugcucacc

SEQ ID NO: 1207471 - RNA, 21 nt, Homo sapiens
cuguguaaaacuauauucuca

SEQ ID NO: 1207472 - RNA, 22 nt, Homo sapiens
cuguguaaaacuauauucucag

SEQ ID NO: 1207473 - RNA, 23 nt, Homo sapiens
cuguguaacuguaaaacauugaa

SEQ ID NO: 1207474 - RNA, 21 nt, Homo sapiens
cuguguauaucucuuggaaaa

SEQ ID NO: 1207475 - RNA, 18 nt, Homo sapiens
cuguguauauuauuuggc

SEQ ID NO: 1207476 - RNA, 13 nt, Homo sapiens
cuguguauuccaa

SEQ ID NO: 1207477 - RNA, 15 nt, Homo sapiens
cuguguauucuagug

SEQ ID NO: 1207478 - RNA, 14 nt, Homo sapiens
cugugucucaugga

SEQ ID NO: 1207479 - RNA, 14 nt, Homo sapiens
cugugucuguguau

SEQ ID NO: 1207480 - RNA, 20 nt, Homo sapiens
cugugugaaugugggcacug

SEQ ID NO: 1207481 - RNA, 13 nt, Homo sapiens
cugugugaugaug

SEQ ID NO: 1207482 - RNA, 23 nt, Homo sapiens
cuguguggacugugaugccacac

SEQ ID NO: 1207483 - RNA, 17 nt, Homo sapiens
cugugugugccuccagc

SEQ ID NO: 1207484 - RNA, 20 nt, Homo sapiens
cuguuaaagccuaugaaugc

SEQ ID NO: 1207485 - RNA, 23 nt, Homo sapiens
cuguuacauaacaagaaaaucaa

SEQ ID NO: 1207486 - RNA, 13 nt, Homo sapiens
cuguuaccauuca

SEQ ID NO: 1207487 - RNA, 16 nt, Homo sapiens
cuguuacuauuccuuu

SEQ ID NO: 1207488 - RNA, 17 nt, Homo sapiens
cuguuacuuaccuaaac

SEQ ID NO: 1207489 - RNA, 22 nt, Homo sapiens
cuguuauuagcugggaagacca

SEQ ID NO: 1207490 - RNA, 13 nt, Homo sapiens
cuguucaaaaagg

SEQ ID NO: 1207491 - RNA, 14 nt, Homo sapiens
cuguucacuuugua

SEQ ID NO: 1207492 - RNA, 21 nt, Homo sapiens
cuguuccccucugcuacuagc

SEQ ID NO: 1207493 - RNA, 19 nt, Homo sapiens
cuguuccccuguccuguga

SEQ ID NO: 1207494 - RNA, 16 nt, Homo sapiens
cuguucccuugccauc

SEQ ID NO: 1207495 - RNA, 21 nt, Homo sapiens
cuguuccuuucagaugaccuu

SEQ ID NO: 1207496 - RNA, 14 nt, Homo sapiens
cuguucugcacuga

SEQ ID NO: 1207497 - RNA, 20 nt, Homo sapiens
cuguucugggcucuuuccuc

SEQ ID NO: 1207498 - RNA, 16 nt, Homo sapiens
cuguucugggggacag

SEQ ID NO: 1207499 - RNA, 18 nt, Homo sapiens
cuguucugggugcagcug

SEQ ID NO: 1207500 - RNA, 22 nt, Homo sapiens
cuguucuguuggaugacuuuga

SEQ ID NO: 1207501 - RNA, 22 nt, Homo sapiens
cuguucuuagaguguagcugua

SEQ ID NO: 1207502 - RNA, 15 nt, Homo sapiens
cuguucuugcugcua

SEQ ID NO: 1207503 - RNA, 18 nt, Homo sapiens
cuguugaaucugagcugc

SEQ ID NO: 1207504 - RNA, 23 nt, Homo sapiens
cuguugaaugaaucaacaaacca

SEQ ID NO: 1207505 - RNA, 18 nt, Homo sapiens
cuguugaauuucccacau

SEQ ID NO: 1207506 - RNA, 16 nt, Homo sapiens
cuguugaggguccuca

SEQ ID NO: 1207507 - RNA, 22 nt, Homo sapiens
cuguugauguaucugaguugcc

SEQ ID NO: 1207508 - RNA, 22 nt, Homo sapiens
cuguugcaaacucagugcaaac

SEQ ID NO: 1207509 - RNA, 11 nt, Homo sapiens
cuguugcacug

SEQ ID NO: 1207510 - RNA, 18 nt, Homo sapiens
cuguugcuuaaaccacuu

SEQ ID NO: 1207511 - RNA, 12 nt, Homo sapiens
cuguuggucugu

SEQ ID NO: 1207512 - RNA, 20 nt, Homo sapiens
cuguuguuccauuuuaugca

SEQ ID NO: 1207513 - RNA, 21 nt, Homo sapiens
cuguuguuggucgcagcuaca

SEQ ID NO: 1207514 - RNA, 13 nt, Homo sapiens
cuguuuaacauuu

SEQ ID NO: 1207515 - RNA, 19 nt, Homo sapiens
cuguuuaacauuuccucag

SEQ ID NO: 1207516 - RNA, 17 nt, Homo sapiens
cuguuuauuugcacuau

SEQ ID NO: 1207517 - RNA, 19 nt, Homo sapiens
cuguuuccauagggugaca

SEQ ID NO: 1207518 - RNA, 20 nt, Homo sapiens
cuguuucccuucccuuccac

SEQ ID NO: 1207519 - RNA, 16 nt, Homo sapiens
cuguuuccuagcugug

SEQ ID NO: 1207520 - RNA, 23 nt, Homo sapiens
cuguuuccuuuuacaauuguuga

SEQ ID NO: 1207521 - RNA, 16 nt, Homo sapiens
cuguuucuucuuguga

SEQ ID NO: 1207522 - RNA, 19 nt, Homo sapiens
cuguuuggccaaugugcau

SEQ ID NO: 1207523 - RNA, 19 nt, Homo sapiens
cuguuuuguaagugcugcu

SEQ ID NO: 1207524 - RNA, 21 nt, Homo sapiens
cuguuuuguaagugcugcuau

SEQ ID NO: 1207525 - RNA, 20 nt, Homo sapiens
cuguuuuuacuaaguuuuca

SEQ ID NO: 1207526 - RNA, 18 nt, Homo sapiens
cuuaaaaaauacuugcau

SEQ ID NO: 1207527 - RNA, 19 nt, Homo sapiens
cuuaaaacaauucugugac

SEQ ID NO: 1207528 - RNA, 19 nt, Homo sapiens
cuuaaaagguuaaauuuca

SEQ ID NO: 1207529 - RNA, 19 nt, Homo sapiens
cuuaaaauguaagauuaua

SEQ ID NO: 1207530 - RNA, 22 nt, Homo sapiens
cuuaaaauugugagcgaauuag

SEQ ID NO: 1207531 - RNA, 11 nt, Homo sapiens
cuuaaacacau

SEQ ID NO: 1207532 - RNA, 20 nt, Homo sapiens
cuuaaagcauuccccaaaga

SEQ ID NO: 1207533 - RNA, 23 nt, Homo sapiens
cuuaaagccuuuuccugaauugg

SEQ ID NO: 1207534 - RNA, 20 nt, Homo sapiens
cuuaaagggcccaaugaauu

SEQ ID NO: 1207535 - RNA, 22 nt, Homo sapiens
cuuaaagggucuuaugaaacaa

SEQ ID NO: 1207536 - RNA, 23 nt, Homo sapiens
cuuaaauaauaaacaguggaaua

SEQ ID NO: 1207537 - RNA, 21 nt, Homo sapiens
cuuaaauauauaauguugcca

SEQ ID NO: 1207538 - RNA, 21 nt, Homo sapiens
cuuaaauggaauuauuuugaa

SEQ ID NO: 1207539 - RNA, 22 nt, Homo sapiens
cuuaaauguagcaauggcacug

SEQ ID NO: 1207540 - RNA, 20 nt, Homo sapiens
cuuaaauguuuauacuguau

SEQ ID NO: 1207541 - RNA, 18 nt, Homo sapiens
cuuaacacuaucauggac

SEQ ID NO: 1207542 - RNA, 14 nt, Homo sapiens
cuuaacagacucaa

SEQ ID NO: 1207543 - RNA, 11 nt, Homo sapiens
cuuaacagccc

SEQ ID NO: 1207544 - RNA, 18 nt, Homo sapiens
cuuaacagcccagcacuu

SEQ ID NO: 1207545 - RNA, 14 nt, Homo sapiens
cuuaacauucugua

SEQ ID NO: 1207546 - RNA, 16 nt, Homo sapiens
cuuaacccaaggagca

SEQ ID NO: 1207547 - RNA, 18 nt, Homo sapiens
cuuaaccuggaacuggag

SEQ ID NO: 1207548 - RNA, 19 nt, Homo sapiens
cuuaaccuuugcuauguaa

SEQ ID NO: 1207549 - RNA, 17 nt, Homo sapiens
cuuaacggcuccaggau

SEQ ID NO: 1207550 - RNA, 21 nt, Homo sapiens
cuuaagaacugcuucauguga

SEQ ID NO: 1207551 - RNA, 16 nt, Homo sapiens
cuuaagagacacucca

SEQ ID NO: 1207552 - RNA, 15 nt, Homo sapiens
cuuaagagugcugug

SEQ ID NO: 1207553 - RNA, 14 nt, Homo sapiens
cuuaagcaaaagaa

SEQ ID NO: 1207554 - RNA, 12 nt, Homo sapiens
cuuaagcuuuca

SEQ ID NO: 1207555 - RNA, 22 nt, Homo sapiens
cuuaagucccaguauaccucau

SEQ ID NO: 1207556 - RNA, 18 nt, Homo sapiens
cuuaauacuaccuugaaa

SEQ ID NO: 1207557 - RNA, 21 nt, Homo sapiens
cuuaauacuaggauacagaaa

SEQ ID NO: 1207558 - RNA, 20 nt, Homo sapiens
cuuaauacuuuaugaugcua

SEQ ID NO: 1207559 - RNA, 14 nt, Homo sapiens
cuuaauaguauuua

SEQ ID NO: 1207560 - RNA, 14 nt, Homo sapiens
cuuaauauguuaac

SEQ ID NO: 1207561 - RNA, 16 nt, Homo sapiens
cuuaauccccaugcuu

SEQ ID NO: 1207562 - RNA, 14 nt, Homo sapiens
cuuaaugacaacac

SEQ ID NO: 1207563 - RNA, 19 nt, Homo sapiens
cuuaaugucuuuaaaagua

SEQ ID NO: 1207564 - RNA, 17 nt, Homo sapiens
cuuaauuucuaaagaua

SEQ ID NO: 1207565 - RNA, 14 nt, Homo sapiens
cuuaauuuucagua

SEQ ID NO: 1207566 - RNA, 13 nt, Homo sapiens
cuuacacaucuca

SEQ ID NO: 1207567 - RNA, 12 nt, Homo sapiens
cuuacacugccu

SEQ ID NO: 1207568 - RNA, 20 nt, Homo sapiens
cuuacacuuuaugcacaaaa

SEQ ID NO: 1207569 - RNA, 21 nt, Homo sapiens
cuuacaggguaacugugcuga

SEQ ID NO: 1207570 - RNA, 13 nt, Homo sapiens
cuuacauggcgcu

SEQ ID NO: 1207571 - RNA, 23 nt, Homo sapiens
cuuacauguuuguuucuguagaa

SEQ ID NO: 1207572 - RNA, 13 nt, Homo sapiens
cuuaccaacaucu

SEQ ID NO: 1207573 - RNA, 15 nt, Homo sapiens
cuuaccaacuuucug

SEQ ID NO: 1207574 - RNA, 13 nt, Homo sapiens
cuuaccacagugu

SEQ ID NO: 1207575 - RNA, 14 nt, Homo sapiens
cuuaccacaguguu

SEQ ID NO: 1207576 - RNA, 15 nt, Homo sapiens
cuuacccaauuuccc

SEQ ID NO: 1207577 - RNA, 19 nt, Homo sapiens
cuuuuuccccuugauggaa

SEQ ID NO: 1207578 - RNA, 18 nt, Homo sapiens
cuuuuuccuccuggaaca

SEQ ID NO: 1207579 - RNA, 12 nt, Homo sapiens
cuuuuuccucug

SEQ ID NO: 1207580 - RNA, 22 nt, Homo sapiens
cuuuuucguguggaucuugcca

SEQ ID NO: 1207581 - RNA, 18 nt, Homo sapiens
cuuuuucuucuucccucc

SEQ ID NO: 1207582 - RNA, 13 nt, Homo sapiens
cuuuuucuuugaa

SEQ ID NO: 1207583 - RNA, 12 nt, Homo sapiens
cuuuuuuacaca

SEQ ID NO: 1207584 - RNA, 14 nt, Homo sapiens
cuuuuuuacacuga

SEQ ID NO: 1207585 - RNA, 16 nt, Homo sapiens
cuuuuuuaucuugcac

SEQ ID NO: 1207586 - RNA, 13 nt, Homo sapiens
cuuuuuugccaga

SEQ ID NO: 1207587 - RNA, 16 nt, Homo sapiens
cuuuuuuucuguacca

SEQ ID NO: 1207588 - RNA, 17 nt, Homo sapiens
cuuuuuuucuguaccag

SEQ ID NO: 1207589 - RNA, 18 nt, Homo sapiens
cuuuuuuuuaguucaaua

SEQ ID NO: 1207590 - RNA, 14 nt, Homo sapiens
gaaaaaaaaaccca

SEQ ID NO: 1207591 - RNA, 17 nt, Homo sapiens
gaaaaaaaguacaugua

SEQ ID NO: 1207592 - RNA, 16 nt, Homo sapiens
gaaaaaaauugcucug

SEQ ID NO: 1207593 - RNA, 22 nt, Homo sapiens
gaaaaaacugugccuuguuuca

SEQ ID NO: 1207594 - RNA, 19 nt, Homo sapiens
gaaaaaaguuccuuccuaa

SEQ ID NO: 1207595 - RNA, 19 nt, Homo sapiens
gaaaaaaguuuugaugaaa

SEQ ID NO: 1207596 - RNA, 13 nt, Homo sapiens
gaaaaaccaauga

SEQ ID NO: 1207597 - RNA, 22 nt, Homo sapiens
gaaaaaccaaugauucauaaca

SEQ ID NO: 1207598 - RNA, 16 nt, Homo sapiens
gaaaaaccacucccag

SEQ ID NO: 1207599 - RNA, 21 nt, Homo sapiens
gaaaaacuaacuagacuaaga

SEQ ID NO: 1207600 - RNA, 22 nt, Homo sapiens
gaaaaagagguagcacuacaaa

SEQ ID NO: 1207601 - RNA, 13 nt, Homo sapiens
gaaaaauaaaucu

SEQ ID NO: 1207602 - RNA, 16 nt, Homo sapiens
gaaaaauaagucacuu

SEQ ID NO: 1207603 - RNA, 23 nt, Homo sapiens
gaaaaauauugcugaacuacuuu

SEQ ID NO: 1207604 - RNA, 21 nt, Homo sapiens
gaaaaauccgcuuuucugcca

SEQ ID NO: 1207605 - RNA, 21 nt, Homo sapiens
gaaaaaugcaagccaucucua

SEQ ID NO: 1207606 - RNA, 15 nt, Homo sapiens
gaaaaaugcugcuuc

SEQ ID NO: 1207607 - RNA, 22 nt, Homo sapiens
gaaaaaugcugcuucuccuccc

SEQ ID NO: 1207608 - RNA, 17 nt, Homo sapiens
gaaaaauguuugucuca

SEQ ID NO: 1207609 - RNA, 18 nt, Homo sapiens
gaaaacaacuuggcauuu

SEQ ID NO: 1207610 - RNA, 22 nt, Homo sapiens
gaaaacacacucaaaagacaaa

SEQ ID NO: 1207611 - RNA, 20 nt, Homo sapiens
gaaaacauagcaucucagga

SEQ ID NO: 1207612 - RNA, 21 nt, Homo sapiens
gaaaaccuagaucugcacuca

SEQ ID NO: 1207613 - RNA, 12 nt, Homo sapiens
gaaaacugcuga

SEQ ID NO: 1207614 - RNA, 19 nt, Homo sapiens
gaaaacuguuaccuaaagu

SEQ ID NO: 1207615 - RNA, 14 nt, Homo sapiens
gaaaagaaaccugg

SEQ ID NO: 1207616 - RNA, 23 nt, Homo sapiens
gaaaagaagacucugaccuguac

SEQ ID NO: 1207617 - RNA, 14 nt, Homo sapiens
gaaaagaagcaagg

SEQ ID NO: 1207618 - RNA, 18 nt, Homo sapiens
gaaaaggccuucuuccca

SEQ ID NO: 1207619 - RNA, 22 nt, Homo sapiens
gaaaagguagcuuaccugacac

SEQ ID NO: 1207620 - RNA, 15 nt, Homo sapiens
gaaaaguaucacucu

SEQ ID NO: 1207621 - RNA, 20 nt, Homo sapiens
gaaaagugcauauuuaucca

SEQ ID NO: 1207622 - RNA, 20 nt, Homo sapiens
gaaaaguggagaaauggcaa

SEQ ID NO: 1207623 - RNA, 16 nt, Homo sapiens
gaaaaguguaauagca

SEQ ID NO: 1207624 - RNA, 23 nt, Homo sapiens
gaaaaguguccuucuugcucccc

SEQ ID NO: 1207625 - RNA, 21 nt, Homo sapiens
gaaaaguuuaaagacacuuag

SEQ ID NO: 1207626 - RNA, 20 nt, Homo sapiens
gaaaaguuuccccauuauuu

SEQ ID NO: 1207627 - RNA, 16 nt, Homo sapiens
gaaaauaaacaucagu

SEQ ID NO: 1207628 - RNA, 17 nt, Homo sapiens
gaaaauaauuguuccaa

SEQ ID NO: 1207629 - RNA, 19 nt, Homo sapiens
gaaaauagaaacuugcuua

SEQ ID NO: 1207630 - RNA, 14 nt, Homo sapiens
gaaaauagaacaac

SEQ ID NO: 1207631 - RNA, 16 nt, Homo sapiens
gaaaauauggguugca

SEQ ID NO: 1207632 - RNA, 21 nt, Homo sapiens
gaaaauauuuuguugccuuca

SEQ ID NO: 1207633 - RNA, 17 nt, Homo sapiens
gaaaauccaggucaugc

SEQ ID NO: 1207634 - RNA, 15 nt, Homo sapiens
gaaaauccaucucau

SEQ ID NO: 1207635 - RNA, 22 nt, Homo sapiens
gaaaaucgugacaacacuugug

SEQ ID NO: 1207636 - RNA, 17 nt, Homo sapiens
gaaaaugaacugcccac

SEQ ID NO: 1207637 - RNA, 16 nt, Homo sapiens
gaaaaugaaugcugcu

SEQ ID NO: 1207638 - RNA, 13 nt, Homo sapiens
gaaaaugccucaa

SEQ ID NO: 1207639 - RNA, 22 nt, Homo sapiens
gaaaaugcuaaagaauccauaa

SEQ ID NO: 1207640 - RNA, 19 nt, Homo sapiens
gaaaaugcuauccagcaga

SEQ ID NO: 1207641 - RNA, 15 nt, Homo sapiens
gaaaauggugccugg

SEQ ID NO: 1207642 - RNA, 21 nt, Homo sapiens
gaaaauguugagaaucccaaa

SEQ ID NO: 1207643 - RNA, 22 nt, Homo sapiens
gaaaauugggaauaugcacaaa

SEQ ID NO: 1207644 - RNA, 20 nt, Homo sapiens
gaaaauuguugggaggacag

SEQ ID NO: 1207645 - RNA, 18 nt, Homo sapiens
gaaaauuuuaaaaauaca

SEQ ID NO: 1207646 - RNA, 15 nt, Homo sapiens
gaaacaauggcuaag

SEQ ID NO: 1207647 - RNA, 16 nt, Homo sapiens
gaaacacugugcaaag

SEQ ID NO: 1207648 - RNA, 19 nt, Homo sapiens
gaaacauacagaauguucu

SEQ ID NO: 1207649 - RNA, 16 nt, Homo sapiens
gaaacauagccucacc

SEQ ID NO: 1207650 - RNA, 19 nt, Homo sapiens
gaaacaugacacugaccuu

SEQ ID NO: 1207651 - RNA, 18 nt, Homo sapiens
gaaacaugccagaaggaa

SEQ ID NO: 1207652 - RNA, 17 nt, Homo sapiens
gaaacauuaugccuuaa

SEQ ID NO: 1207653 - RNA, 16 nt, Homo sapiens
gaaacauuccgaagag

SEQ ID NO: 1207654 - RNA, 12 nt, Homo sapiens
gaaaccaaaaca

SEQ ID NO: 1207655 - RNA, 22 nt, Homo sapiens
gaaaccagagucaaauuugaaa

SEQ ID NO: 1207656 - RNA, 19 nt, Homo sapiens
gaaacccaccaaucuacuu

SEQ ID NO: 1207657 - RNA, 14 nt, Homo sapiens
gaaaccccaucucu

SEQ ID NO: 1207658 - RNA, 23 nt, Homo sapiens
gaaaccccaucucuacuaaaaau

SEQ ID NO: 1207659 - RNA, 15 nt, Homo sapiens
gaaacccuauggaga

SEQ ID NO: 1207660 - RNA, 20 nt, Homo sapiens
gaaacccuggucuccguggc

SEQ ID NO: 1207661 - RNA, 15 nt, Homo sapiens
gaaaccuacaagauu

SEQ ID NO: 1207662 - RNA, 18 nt, Homo sapiens
gaaaccuacaagauuucc

SEQ ID NO: 1207663 - RNA, 17 nt, Homo sapiens
gaaaccuuauuguaccu

SEQ ID NO: 1207664 - RNA, 23 nt, Homo sapiens
gaaaccuucagauuuguguuaua

SEQ ID NO: 1207665 - RNA, 18 nt, Homo sapiens
gaaacgcuagaagccuaa

SEQ ID NO: 1207666 - RNA, 18 nt, Homo sapiens
gaaacggaagcugacaua

SEQ ID NO: 1207667 - RNA, 23 nt, Homo sapiens
gaaacguauucaaacaauuugaa

SEQ ID NO: 1207668 - RNA, 14 nt, Homo sapiens
gaaacgucaugugu

SEQ ID NO: 1207669 - RNA, 15 nt, Homo sapiens
gaaacuaaacucuua

SEQ ID NO: 1207670 - RNA, 16 nt, Homo sapiens
gaaacucuacauuuaa

SEQ ID NO: 1207671 - RNA, 17 nt, Homo sapiens
gaaacuggaccugcaua

SEQ ID NO: 1207672 - RNA, 17 nt, Homo sapiens
gaaacuguccaccaaga

SEQ ID NO: 1207673 - RNA, 16 nt, Homo sapiens
gaaacuugcuuaucaa

SEQ ID NO: 1207674 - RNA, 19 nt, Homo sapiens
gaaacuugugaaguggaaa

SEQ ID NO: 1207675 - RNA, 19 nt, Homo sapiens
gaaacuuuaaaagacugaa

SEQ ID NO: 1207676 - RNA, 16 nt, Homo sapiens
gaaagaaaaauaccau

SEQ ID NO: 1207677 - RNA, 15 nt, Homo sapiens
gaaagaacacuuccc

SEQ ID NO: 1207678 - RNA, 14 nt, Homo sapiens
gaaagaacuaugaa

SEQ ID NO: 1207679 - RNA, 15 nt, Homo sapiens
gaaagaacuaugaaa

SEQ ID NO: 1207680 - RNA, 12 nt, Homo sapiens
gaaagaagacau

SEQ ID NO: 1207681 - RNA, 23 nt, Homo sapiens
gaaagaaguguggggauuuucac

SEQ ID NO: 1207682 - RNA, 20 nt, Homo sapiens
gaaagaauagaacacaguuu

SEQ ID NO: 1207683 - RNA, 14 nt, Homo sapiens
gaaagaaugcaaga

SEQ ID NO: 1207684 - RNA, 18 nt, Homo sapiens
gaaagacaagacauugug

SEQ ID NO: 1207685 - RNA, 17 nt, Homo sapiens
gaaagagaacuacuaag

SEQ ID NO: 1207686 - RNA, 13 nt, Homo sapiens
gaaagaucaaaga

SEQ ID NO: 1207687 - RNA, 20 nt, Homo sapiens
gaaagauuugugaacuggaa

SEQ ID NO: 1207688 - RNA, 15 nt, Homo sapiens
gaaagcaacaaagau

SEQ ID NO: 1207689 - RNA, 23 nt, Homo sapiens
gaaagcaggauguaguucugcca

SEQ ID NO: 1207690 - RNA, 18 nt, Homo sapiens
gaaagccugggugacauu

SEQ ID NO: 1207691 - RNA, 20 nt, Homo sapiens
gaaagccugggugacauuug

SEQ ID NO: 1207692 - RNA, 14 nt, Homo sapiens
gaaagccuuaggga

SEQ ID NO: 1207693 - RNA, 19 nt, Homo sapiens
gaaagcugauuacugucaa

SEQ ID NO: 1207694 - RNA, 14 nt, Homo sapiens
gaaaggaaagaaga

SEQ ID NO: 1207695 - RNA, 21 nt, Homo sapiens
gaaaggagaacuauccaaaac

SEQ ID NO: 1207696 - RNA, 22 nt, Homo sapiens
gaaaggagaacuauccaaaacu

SEQ ID NO: 1207697 - RNA, 23 nt, Homo sapiens
gaaaggagccaaguggggcccuc

SEQ ID NO: 1207698 - RNA, 20 nt, Homo sapiens
gaaaggauugauuugaacuu

SEQ ID NO: 1207699 - RNA, 20 nt, Homo sapiens
gaaaggauuuuaccaaagca

SEQ ID NO: 1207700 - RNA, 17 nt, Homo sapiens
gaaaguaagugguagcu

SEQ ID NO: 1207701 - RNA, 19 nt, Homo sapiens
gaaaguacacucugcuguu

SEQ ID NO: 1207702 - RNA, 21 nt, Homo sapiens
gcuuucccugugccacuuuga

SEQ ID NO: 1207703 - RNA, 15 nt, Homo sapiens
gcuuuccuguuucca

SEQ ID NO: 1207704 - RNA, 16 nt, Homo sapiens
gcuuucuacccagcga

SEQ ID NO: 1207705 - RNA, 18 nt, Homo sapiens
gcuuucuucuuaaccuau

SEQ ID NO: 1207706 - RNA, 17 nt, Homo sapiens
gcuuugaguuaacucac

SEQ ID NO: 1207707 - RNA, 15 nt, Homo sapiens
gcuuugcagugacag

SEQ ID NO: 1207708 - RNA, 12 nt, Homo sapiens
gcuuugccaaaa

SEQ ID NO: 1207709 - RNA, 16 nt, Homo sapiens
gcuuugcuacaaauuu

SEQ ID NO: 1207710 - RNA, 15 nt, Homo sapiens
gcuuugguaaucucu

SEQ ID NO: 1207711 - RNA, 20 nt, Homo sapiens
gcuuuggucucuucuuucau

SEQ ID NO: 1207712 - RNA, 23 nt, Homo sapiens
gcuuuguuaucuuccacuggaaa

SEQ ID NO: 1207713 - RNA, 23 nt, Homo sapiens
gcuuuguugaaugaagcagagaa

SEQ ID NO: 1207714 - RNA, 20 nt, Homo sapiens
gcuuuuaaaugcucucucau

SEQ ID NO: 1207715 - RNA, 19 nt, Homo sapiens
gcuuuuaagaaacacaggg

SEQ ID NO: 1207716 - RNA, 24 nt, Homo sapiens
gcuuuucaugcguguguguugucu

SEQ ID NO: 1207717 - RNA, 23 nt, Homo sapiens
gcuuuugaaauccagaaguuuua

SEQ ID NO: 1207718 - RNA, 18 nt, Homo sapiens
gcuuuugagaaccaagua

SEQ ID NO: 1207719 - RNA, 16 nt, Homo sapiens
gcuuuugcuugcaaug

SEQ ID NO: 1207720 - RNA, 17 nt, Homo sapiens
gcuuuugcuugcaaugu

SEQ ID NO: 1207721 - RNA, 14 nt, Homo sapiens
gcuuuuuaauugag

SEQ ID NO: 1207722 - RNA, 22 nt, Homo sapiens
gcuuuuuucuugaguacuagaa

SEQ ID NO: 1207723 - RNA, 19 nt, Homo sapiens
ggaaaaaccaauagcuuua

SEQ ID NO: 1207724 - RNA, 21 nt, Homo sapiens
ggaaaaaugcugcuucuccuc

SEQ ID NO: 1207725 - RNA, 14 nt, Homo sapiens
ggaaaaauguuugu

SEQ ID NO: 1207726 - RNA, 12 nt, Homo sapiens
ggaaaacgugaa

SEQ ID NO: 1207727 - RNA, 19 nt, Homo sapiens
ggaaaagcaaaacuguagg

SEQ ID NO: 1207728 - RNA, 13 nt, Homo sapiens
ggaaaagcaagaa

SEQ ID NO: 1207729 - RNA, 22 nt, Homo sapiens
ggaaaaguguaauagcauacau

SEQ ID NO: 1207730 - RNA, 14 nt, Homo sapiens
ggaaaaguucuccu

SEQ ID NO: 1207731 - RNA, 20 nt, Homo sapiens
ggaaaauaaauucagaucaa

SEQ ID NO: 1207732 - RNA, 18 nt, Homo sapiens
ggaaaaucacaucuccag

SEQ ID NO: 1207733 - RNA, 18 nt, Homo sapiens
ggaaaaucacuugccaaa

SEQ ID NO: 1207734 - RNA, 22 nt, Homo sapiens
ggaaaauuuuaaaaauacagau

SEQ ID NO: 1207735 - RNA, 11 nt, Homo sapiens
ggaaacagcau

SEQ ID NO: 1207736 - RNA, 16 nt, Homo sapiens
ggaaacuucaguugau

SEQ ID NO: 1207737 - RNA, 21 nt, Homo sapiens
ggaaagacaugcagcuuucau

SEQ ID NO: 1207738 - RNA, 16 nt, Homo sapiens
ggaaagauuugugaac

SEQ ID NO: 1207739 - RNA, 22 nt, Homo sapiens
ggaaagcaucaccucaggccag

SEQ ID NO: 1207740 - RNA, 22 nt, Homo sapiens
ggaaagccuuaaaaauauccuu

SEQ ID NO: 1207741 - RNA, 20 nt, Homo sapiens
ggaaagcuuaaaacccaaua

SEQ ID NO: 1207742 - RNA, 17 nt, Homo sapiens
ggaaagggcagggccaa

SEQ ID NO: 1207743 - RNA, 17 nt, Homo sapiens
ggaaaguaaauauuuca

SEQ ID NO: 1207744 - RNA, 22 nt, Homo sapiens
ggaaaguaaauauuucaggcau

SEQ ID NO: 1207745 - RNA, 21 nt, Homo sapiens
ggaaauaaaaaagucucuauu

SEQ ID NO: 1207746 - RNA, 14 nt, Homo sapiens
ggaaauaugaguca

SEQ ID NO: 1207747 - RNA, 18 nt, Homo sapiens
ggaaauccccuuaugacu

SEQ ID NO: 1207748 - RNA, 15 nt, Homo sapiens
ggaaaugcugacuuu

SEQ ID NO: 1207749 - RNA, 15 nt, Homo sapiens
ggaaauuaagacuuu

SEQ ID NO: 1207750 - RNA, 21 nt, Homo sapiens
ggaacaaaacuccagacucuu

SEQ ID NO: 1207751 - RNA, 18 nt, Homo sapiens
ggaacaagaauugcuaaa

SEQ ID NO: 1207752 - RNA, 12 nt, Homo sapiens
ggaacaauccau

SEQ ID NO: 1207753 - RNA, 18 nt, Homo sapiens
ggaacagaagacagcugc

SEQ ID NO: 1207754 - RNA, 14 nt, Homo sapiens
ggaacagaccagug

SEQ ID NO: 1207755 - RNA, 16 nt, Homo sapiens
ggaacagcagauaaca

SEQ ID NO: 1207756 - RNA, 23 nt, Homo sapiens
ggaacauacagaacucuaaaaga

SEQ ID NO: 1207757 - RNA, 20 nt, Homo sapiens
ggaacauauagaaugcagag

SEQ ID NO: 1207758 - RNA, 22 nt, Homo sapiens
ggaacauguaaaacaguuacaa

SEQ ID NO: 1207759 - RNA, 23 nt, Homo sapiens
ggaaccuugcuguccugaucugu

SEQ ID NO: 1207760 - RNA, 15 nt, Homo sapiens
ggaacuaaagcaaau

SEQ ID NO: 1207761 - RNA, 18 nt, Homo sapiens
ggaacuggccacgcacag

SEQ ID NO: 1207762 - RNA, 19 nt, Homo sapiens
ggaagaaacaaaguugaac

SEQ ID NO: 1207763 - RNA, 21 nt, Homo sapiens
ggaagaaacacguggucauga

SEQ ID NO: 1207764 - RNA, 21 nt, Homo sapiens
ggaagaggaacagcacugggg

SEQ ID NO: 1207765 - RNA, 14 nt, Homo sapiens
ggaagauacacuga

SEQ ID NO: 1207766 - RNA, 10 nt, Homo sapiens
ggaagccagg

SEQ ID NO: 1207767 - RNA, 15 nt, Homo sapiens
ggaagccaggugagc

SEQ ID NO: 1207768 - RNA, 14 nt, Homo sapiens
ggaagccccaggga

SEQ ID NO: 1207769 - RNA, 19 nt, Homo sapiens
ggaagcggagcuugcagug

SEQ ID NO: 1207770 - RNA, 20 nt, Homo sapiens
ggaagcggagcuugcaguga

SEQ ID NO: 1207771 - RNA, 16 nt, Homo sapiens
ggaagcuccacuguca

SEQ ID NO: 1207772 - RNA, 17 nt, Homo sapiens
ggaagcuccacugucac

SEQ ID NO: 1207773 - RNA, 16 nt, Homo sapiens
ggaagcugucccucac

SEQ ID NO: 1207774 - RNA, 22 nt, Homo sapiens
ggaaggaaaugacaccaaauau

SEQ ID NO: 1207775 - RNA, 14 nt, Homo sapiens
ggaagggagguggc

SEQ ID NO: 1207776 - RNA, 16 nt, Homo sapiens
ggaagggggcugugug

SEQ ID NO: 1207777 - RNA, 18 nt, Homo sapiens
ggaaguaaccauuugcac

SEQ ID NO: 1207778 - RNA, 19 nt, Homo sapiens
ggaaguaaccauuugcacu

SEQ ID NO: 1207779 - RNA, 14 nt, Homo sapiens
ggaaguaagcaaac

SEQ ID NO: 1207780 - RNA, 11 nt, Homo sapiens
ggaaguacugc

SEQ ID NO: 1207781 - RNA, 14 nt, Homo sapiens
ggaauaaguguuua

SEQ ID NO: 1207782 - RNA, 14 nt, Homo sapiens
ggaauauacggaau

SEQ ID NO: 1207783 - RNA, 15 nt, Homo sapiens
ggaauaugaccauuu

SEQ ID NO: 1207784 - RNA, 23 nt, Homo sapiens
ggaauauguuagagaauuuccuu

SEQ ID NO: 1207785 - RNA, 18 nt, Homo sapiens
ggaauauuuaaacaguag

SEQ ID NO: 1207786 - RNA, 13 nt, Homo sapiens
ggaauauuuccau

SEQ ID NO: 1207787 - RNA, 18 nt, Homo sapiens
ggaaucacuggcuguuaa

SEQ ID NO: 1207788 - RNA, 20 nt, Homo sapiens
ggaauccaagccuccacagc

SEQ ID NO: 1207789 - RNA, 21 nt, Homo sapiens
ggaauccauguaaauugcaaa

SEQ ID NO: 1207790 - RNA, 22 nt, Homo sapiens
ggaaucuucuccaguaugaaau

SEQ ID NO: 1207791 - RNA, 20 nt, Homo sapiens
ggaaugaccagccuguccaa

SEQ ID NO: 1207792 - RNA, 16 nt, Homo sapiens
ggaauuacaagcccug

SEQ ID NO: 1207793 - RNA, 21 nt, Homo sapiens
ggaauucauuuucaucacugg

SEQ ID NO: 1207794 - RNA, 13 nt, Homo sapiens
ggaauugcucaga

SEQ ID NO: 1207795 - RNA, 18 nt, Homo sapiens
ggacaaaccgagugcaau

SEQ ID NO: 1207796 - RNA, 19 nt, Homo sapiens
ggacaaagaaauuccccaa

SEQ ID NO: 1207797 - RNA, 17 nt, Homo sapiens
ggacaaaugaugccaug

SEQ ID NO: 1207798 - RNA, 17 nt, Homo sapiens
ggacaagacaaaccaag

SEQ ID NO: 1207799 - RNA, 23 nt, Homo sapiens
ggacaagcagcuggugcuccaag

SEQ ID NO: 1207800 - RNA, 12 nt, Homo sapiens
ggacaagcccug

SEQ ID NO: 1207801 - RNA, 15 nt, Homo sapiens
ggacaagggcccaug

SEQ ID NO: 1207802 - RNA, 17 nt, Homo sapiens
ggacacucgggcccaug

SEQ ID NO: 1207803 - RNA, 23 nt, Homo sapiens
ggacacuuaauacuaccuugaaa

SEQ ID NO: 1207804 - RNA, 12 nt, Homo sapiens
ggacagaugacc

SEQ ID NO: 1207805 - RNA, 13 nt, Homo sapiens
ggacagguggugc

SEQ ID NO: 1207806 - RNA, 20 nt, Homo sapiens
ggacagucagcucucuccuu

SEQ ID NO: 1207807 - RNA, 17 nt, Homo sapiens
ggacaguccugggagaa

SEQ ID NO: 1207808 - RNA, 23 nt, Homo sapiens
ggacagugcccaugcaauggcuu

SEQ ID NO: 1207809 - RNA, 18 nt, Homo sapiens
ggacaguggauuguuuau

SEQ ID NO: 1207810 - RNA, 19 nt, Homo sapiens
ggacaugcuuuucugccac

SEQ ID NO: 1207811 - RNA, 13 nt, Homo sapiens
ggaccacaccucc

SEQ ID NO: 1207812 - RNA, 17 nt, Homo sapiens
ggaccacagagcuccug

SEQ ID NO: 1207813 - RNA, 20 nt, Homo sapiens
ggaccacucagccccuagga

SEQ ID NO: 1207814 - RNA, 22 nt, Homo sapiens
ggaccagagccagaugcaggac

SEQ ID NO: 1207815 - RNA, 17 nt, Homo sapiens
ggaccaggccauucugc

SEQ ID NO: 1207816 - RNA, 20 nt, Homo sapiens
ggaccaugugucacuugugc

SEQ ID NO: 1207817 - RNA, 12 nt, Homo sapiens
ggacccaaaaca

SEQ ID NO: 1207818 - RNA, 15 nt, Homo sapiens
ggaccccagcuguga

SEQ ID NO: 1207819 - RNA, 22 nt, Homo sapiens
ggacccccuggcccugccucau

SEQ ID NO: 1207820 - RNA, 14 nt, Homo sapiens
ggacccggauguga

SEQ ID NO: 1207821 - RNA, 14 nt, Homo sapiens
ggacccuguccaau

SEQ ID NO: 1207822 - RNA, 14 nt, Homo sapiens
ggaccugcugugug

SEQ ID NO: 1207823 - RNA, 20 nt, Homo sapiens
ggacgcacgcucgcugccau

SEQ ID NO: 1207824 - RNA, 17 nt, Homo sapiens
ggacgguuuugcuuuau

SEQ ID NO: 1207825 - RNA, 22 nt, Homo sapiens
ggacuaaccccaacgcacagga

SEQ ID NO: 1207826 - RNA, 23 nt, Homo sapiens
ggacuaaccccaacgcacaggaa

SEQ ID NO: 1207827 - RNA, 22 nt, Homo sapiens
gggaaggggugcccccaggcuc

SEQ ID NO: 1207828 - RNA, 15 nt, Homo sapiens
gggaaguaagcaaac

SEQ ID NO: 1207829 - RNA, 23 nt, Homo sapiens
gggaauacugugcauaagccauu

SEQ ID NO: 1207830 - RNA, 22 nt, Homo sapiens
gggaauccaagccuccacagcg

SEQ ID NO: 1207831 - RNA, 16 nt, Homo sapiens
gggaaugagcccagag

SEQ ID NO: 1207832 - RNA, 15 nt, Homo sapiens
gggaauggauccugg

SEQ ID NO: 1207833 - RNA, 20 nt, Homo sapiens
gggacaacagugcuuuguaa

SEQ ID NO: 1207834 - RNA, 16 nt, Homo sapiens
gggaccacaccucccu

SEQ ID NO: 1207835 - RNA, 21 nt, Homo sapiens
gggaccuggggaccucugggc

SEQ ID NO: 1207836 - RNA, 20 nt, Homo sapiens
gggacugcuaccucugagaa

SEQ ID NO: 1207837 - RNA, 22 nt, Homo sapiens
gggacuguuccaaagccaguga

SEQ ID NO: 1207838 - RNA, 14 nt, Homo sapiens
gggacuuccuugcu

SEQ ID NO: 1207839 - RNA, 13 nt, Homo sapiens
gggacuugggagc

SEQ ID NO: 1207840 - RNA, 13 nt, Homo sapiens
gggagaacgggaa

SEQ ID NO: 1207841 - RNA, 15 nt, Homo sapiens
gggagaagagcccug

SEQ ID NO: 1207842 - RNA, 19 nt, Homo sapiens
gggagagcgaaggggguca

SEQ ID NO: 1207843 - RNA, 16 nt, Homo sapiens
gggagcccagugaagc

SEQ ID NO: 1207844 - RNA, 17 nt, Homo sapiens
gggaggaagcagguuga

SEQ ID NO: 1207845 - RNA, 11 nt, Homo sapiens
gggaggacaaa

SEQ ID NO: 1207846 - RNA, 21 nt, Homo sapiens
gggaggaggccaccucuccaa

SEQ ID NO: 1207847 - RNA, 23 nt, Homo sapiens
gggaggcaagugugggggguccu

SEQ ID NO: 1207848 - RNA, 15 nt, Homo sapiens
gggaggugggguaca

SEQ ID NO: 1207849 - RNA, 16 nt, Homo sapiens
gggagucagagcccug

SEQ ID NO: 1207850 - RNA, 18 nt, Homo sapiens
gggagugcucaccgccuc

SEQ ID NO: 1207851 - RNA, 14 nt, Homo sapiens
gggauaagccagcu

SEQ ID NO: 1207852 - RNA, 23 nt, Homo sapiens
gggauacuuagugguaugucucu

SEQ ID NO: 1207853 - RNA, 17 nt, Homo sapiens
gggauagaggaaaggga

SEQ ID NO: 1207854 - RNA, 18 nt, Homo sapiens
gggauauggcugcccagg

SEQ ID NO: 1207855 - RNA, 20 nt, Homo sapiens
gggaugaggucaccagggga

SEQ ID NO: 1207856 - RNA, 20 nt, Homo sapiens
gggaugcugggcugggcccu

SEQ ID NO: 1207857 - RNA, 21 nt, Homo sapiens
gggauggccagagaugcugga

SEQ ID NO: 1207858 - RNA, 21 nt, Homo sapiens
gggaugggccccgccuuccug

SEQ ID NO: 1207859 - RNA, 22 nt, Homo sapiens
gggauguccuacuaucacugaa

SEQ ID NO: 1207860 - RNA, 22 nt, Homo sapiens
gggauuucucccucucagugga

SEQ ID NO: 1207861 - RNA, 16 nt, Homo sapiens
gggcaagucccugacu

SEQ ID NO: 1207862 - RNA, 13 nt, Homo sapiens
gggcaaucuuugc

SEQ ID NO: 1207863 - RNA, 22 nt, Homo sapiens
gggcacacucugccagcaaaga

SEQ ID NO: 1207864 - RNA, 20 nt, Homo sapiens
gggcacagcacagccagggc

SEQ ID NO: 1207865 - RNA, 21 nt, Homo sapiens
gggcaccuuccgacaucccag

SEQ ID NO: 1207866 - RNA, 20 nt, Homo sapiens
gggcacuacauaauugcugu

SEQ ID NO: 1207867 - RNA, 15 nt, Homo sapiens
gggcacugauuugau

SEQ ID NO: 1207868 - RNA, 15 nt, Homo sapiens
gggcacuggcccagg

SEQ ID NO: 1207869 - RNA, 22 nt, Homo sapiens
gggcacuuuaagucagugacag

SEQ ID NO: 1207870 - RNA, 14 nt, Homo sapiens
gggcagcuugcccc

SEQ ID NO: 1207871 - RNA, 18 nt, Homo sapiens
gggcagucggcuccucaa

SEQ ID NO: 1207872 - RNA, 20 nt, Homo sapiens
gggcaguuguugcuucuuaa

SEQ ID NO: 1207873 - RNA, 22 nt, Homo sapiens
gggcauagaucagaagacuaca

SEQ ID NO: 1207874 - RNA, 11 nt, Homo sapiens
gggcaucuccu

SEQ ID NO: 1207875 - RNA, 18 nt, Homo sapiens
gggcaucugccccucccc

SEQ ID NO: 1207876 - RNA, 18 nt, Homo sapiens
gggcaugaagcugcauau

SEQ ID NO: 1207877 - RNA, 14 nt, Homo sapiens
gggcauuguaguua

SEQ ID NO: 1207878 - RNA, 18 nt, Homo sapiens
gggccacauggguccacu

SEQ ID NO: 1207879 - RNA, 18 nt, Homo sapiens
gggccagagggagcugga

SEQ ID NO: 1207880 - RNA, 23 nt, Homo sapiens
gggccagcuuuuccucaccagga

SEQ ID NO: 1207881 - RNA, 16 nt, Homo sapiens
gggccagggcccugca

SEQ ID NO: 1207882 - RNA, 18 nt, Homo sapiens
gggccagggucuguguga

SEQ ID NO: 1207883 - RNA, 11 nt, Homo sapiens
gggccagugaa

SEQ ID NO: 1207884 - RNA, 16 nt, Homo sapiens
gggccauguccaaaga

SEQ ID NO: 1207885 - RNA, 17 nt, Homo sapiens
gggccauguccaaagag

SEQ ID NO: 1207886 - RNA, 21 nt, Homo sapiens
gggcccaaauucuuucagugg

SEQ ID NO: 1207887 - RNA, 14 nt, Homo sapiens
gggcccaccuggcc

SEQ ID NO: 1207888 - RNA, 14 nt, Homo sapiens
gggcccagccagcc

SEQ ID NO: 1207889 - RNA, 16 nt, Homo sapiens
gggcccaggaccagcu

SEQ ID NO: 1207890 - RNA, 23 nt, Homo sapiens
gggccccccaaaucccagggaag

SEQ ID NO: 1207891 - RNA, 22 nt, Homo sapiens
gggccccucaacagccaagugu

SEQ ID NO: 1207892 - RNA, 22 nt, Homo sapiens
gggcccucuuucccugcgagac

SEQ ID NO: 1207893 - RNA, 18 nt, Homo sapiens
gggcccuuguacaaccga

SEQ ID NO: 1207894 - RNA, 17 nt, Homo sapiens
gggccucaaggacuuga

SEQ ID NO: 1207895 - RNA, 14 nt, Homo sapiens
gggccucagacgag

SEQ ID NO: 1207896 - RNA, 23 nt, Homo sapiens
gggccucaggcucugcacagaca

SEQ ID NO: 1207897 - RNA, 16 nt, Homo sapiens
gggccucccaccagag

SEQ ID NO: 1207898 - RNA, 14 nt, Homo sapiens
gggccugcccucau

SEQ ID NO: 1207899 - RNA, 19 nt, Homo sapiens
gggccuggcaggccagugu

SEQ ID NO: 1207900 - RNA, 21 nt, Homo sapiens
gggccuggcaggccagugucu

SEQ ID NO: 1207901 - RNA, 18 nt, Homo sapiens
gggccuggggccugagag

SEQ ID NO: 1207902 - RNA, 15 nt, Homo sapiens
gggccuggggcuccu

SEQ ID NO: 1207903 - RNA, 16 nt, Homo sapiens
gggccugucgugccag

SEQ ID NO: 1207904 - RNA, 12 nt, Homo sapiens
gggccuugcuga

SEQ ID NO: 1207905 - RNA, 18 nt, Homo sapiens
gggccuuggaucgcuaag

SEQ ID NO: 1207906 - RNA, 18 nt, Homo sapiens
gggccuuucuguguccua

SEQ ID NO: 1207907 - RNA, 23 nt, Homo sapiens
gggcggauucagcgaagucucau

SEQ ID NO: 1207908 - RNA, 12 nt, Homo sapiens
gggcggucacag

SEQ ID NO: 1207909 - RNA, 12 nt, Homo sapiens
gggcuagggagg

SEQ ID NO: 1207910 - RNA, 16 nt, Homo sapiens
gggcucuacgucccag

SEQ ID NO: 1207911 - RNA, 19 nt, Homo sapiens
gggcugaaagaacauggac

SEQ ID NO: 1207912 - RNA, 21 nt, Homo sapiens
gggcugaccugccucucacac

SEQ ID NO: 1207913 - RNA, 22 nt, Homo sapiens
gggcugacuccugcucucugga

SEQ ID NO: 1207914 - RNA, 16 nt, Homo sapiens
gggcugagcccuggca

SEQ ID NO: 1207915 - RNA, 22 nt, Homo sapiens
gggcugagcccuggcaggauga

SEQ ID NO: 1207916 - RNA, 15 nt, Homo sapiens
gggcugcagguugca

SEQ ID NO: 1207917 - RNA, 15 nt, Homo sapiens
gggcuuaccagguga

SEQ ID NO: 1207918 - RNA, 16 nt, Homo sapiens
gggcuuugugucauca

SEQ ID NO: 1207919 - RNA, 13 nt, Homo sapiens
ggggaaaggcuug

SEQ ID NO: 1207920 - RNA, 22 nt, Homo sapiens
ggggaauaaacuccagccucuc

SEQ ID NO: 1207921 - RNA, 17 nt, Homo sapiens
ggggacucagggaccgg

SEQ ID NO: 1207922 - RNA, 15 nt, Homo sapiens
ggggacugucuuuca

SEQ ID NO: 1207923 - RNA, 23 nt, Homo sapiens
ggggagcugggguacagguuugg

SEQ ID NO: 1207924 - RNA, 13 nt, Homo sapiens
ggggaugucccag

SEQ ID NO: 1207925 - RNA, 14 nt, Homo sapiens
ggggcagcacuccc

SEQ ID NO: 1207926 - RNA, 13 nt, Homo sapiens
ggggccaccuccu

SEQ ID NO: 1207927 - RNA, 13 nt, Homo sapiens
ggggccacuuuca

SEQ ID NO: 1207928 - RNA, 20 nt, Homo sapiens
ggggcccaagccccaucuca

SEQ ID NO: 1207929 - RNA, 14 nt, Homo sapiens
ggggccuugcugag

SEQ ID NO: 1207930 - RNA, 14 nt, Homo sapiens
ggggcuacugugac

SEQ ID NO: 1207931 - RNA, 14 nt, Homo sapiens
ggggcucccucucu

SEQ ID NO: 1207932 - RNA, 17 nt, Homo sapiens
ggggcugggagcugccu

SEQ ID NO: 1207933 - RNA, 10 nt, Homo sapiens
ggggcuuccu

SEQ ID NO: 1207934 - RNA, 12 nt, Homo sapiens
gggggcacucag

SEQ ID NO: 1207935 - RNA, 20 nt, Homo sapiens
gggggcugcagcauguugcu

SEQ ID NO: 1207936 - RNA, 14 nt, Homo sapiens
gggggcugugccaa

SEQ ID NO: 1207937 - RNA, 18 nt, Homo sapiens
gggguauaaaacuuuccu

SEQ ID NO: 1207938 - RNA, 15 nt, Homo sapiens
gggguccacugugag

SEQ ID NO: 1207939 - RNA, 14 nt, Homo sapiens
ggggucguuugcuu

SEQ ID NO: 1207940 - RNA, 14 nt, Homo sapiens
ggggucugagcaug

SEQ ID NO: 1207941 - RNA, 14 nt, Homo sapiens
ggggugcagcagug

SEQ ID NO: 1207942 - RNA, 23 nt, Homo sapiens
gggguggccucaagagcacacag

SEQ ID NO: 1207943 - RNA, 12 nt, Homo sapiens
ggggugggccac

SEQ ID NO: 1207944 - RNA, 18 nt, Homo sapiens
gggguggugggaaccaug

SEQ ID NO: 1207945 - RNA, 18 nt, Homo sapiens
gggguuuuguaaugacag

SEQ ID NO: 1207946 - RNA, 13 nt, Homo sapiens
gggucaacaucuu

SEQ ID NO: 1207947 - RNA, 22 nt, Homo sapiens
gggucaaguacaccagccaccu

SEQ ID NO: 1207948 - RNA, 12 nt, Homo sapiens
ggguccaccagg

SEQ ID NO: 1207949 - RNA, 22 nt, Homo sapiens
ggguccacugugagaggugaca

SEQ ID NO: 1207950 - RNA, 20 nt, Homo sapiens
gggucccaucagugaaagaa

SEQ ID NO: 1207951 - RNA, 19 nt, Homo sapiens
ggguccccacagcccgugc

SEQ ID NO: 1207952 - RNA, 15 nt, Homo sapiens
ggguccccaccuggg

SEQ ID NO: 1207953 - RNA, 16 nt, Homo sapiens
ugucacuaaacucuca

SEQ ID NO: 1207954 - RNA, 13 nt, Homo sapiens
ugucacuacacac

SEQ ID NO: 1207955 - RNA, 22 nt, Homo sapiens
ugucacuacucacagucucuuu

SEQ ID NO: 1207956 - RNA, 15 nt, Homo sapiens
ugucacuagucucac

SEQ ID NO: 1207957 - RNA, 17 nt, Homo sapiens
ugucacuagucucacca

SEQ ID NO: 1207958 - RNA, 13 nt, Homo sapiens
ugucagaguagaa

SEQ ID NO: 1207959 - RNA, 17 nt, Homo sapiens
ugucagaguagaagauu

SEQ ID NO: 1207960 - RNA, 17 nt, Homo sapiens
ugucagauuaccaguua

SEQ ID NO: 1207961 - RNA, 17 nt, Homo sapiens
ugucagcccaugugcac

SEQ ID NO: 1207962 - RNA, 20 nt, Homo sapiens
ugucagcuacuaaugauguu

SEQ ID NO: 1207963 - RNA, 16 nt, Homo sapiens
ugucagcuuccaaaca

SEQ ID NO: 1207964 - RNA, 15 nt, Homo sapiens
ugucagcuucccagc

SEQ ID NO: 1207965 - RNA, 13 nt, Homo sapiens
ugucaguauuuca

SEQ ID NO: 1207966 - RNA, 16 nt, Homo sapiens
ugucagucagggacaa

SEQ ID NO: 1207967 - RNA, 13 nt, Homo sapiens
ugucaguucuugg

SEQ ID NO: 1207968 - RNA, 15 nt, Homo sapiens
ugucauagagcugca

SEQ ID NO: 1207969 - RNA, 20 nt, Homo sapiens
ugucauauaguaaacacuca

SEQ ID NO: 1207970 - RNA, 21 nt, Homo sapiens
ugucauccucaaagaaagugu

SEQ ID NO: 1207971 - RNA, 23 nt, Homo sapiens
ugucauuaaauggggcucacaaa

SEQ ID NO: 1207972 - RNA, 19 nt, Homo sapiens
ugucauuaauauauccuaa

SEQ ID NO: 1207973 - RNA, 18 nt, Homo sapiens
ugucauuuuuaacagcau

SEQ ID NO: 1207974 - RNA, 11 nt, Homo sapiens
uguccaaagag

SEQ ID NO: 1207975 - RNA, 17 nt, Homo sapiens
uguccaaagaggcugcc

SEQ ID NO: 1207976 - RNA, 15 nt, Homo sapiens
uguccaguugcagcu

SEQ ID NO: 1207977 - RNA, 18 nt, Homo sapiens
uguccauaagcuacgggu

SEQ ID NO: 1207978 - RNA, 22 nt, Homo sapiens
ugucccaaaccagacaccugga

SEQ ID NO: 1207979 - RNA, 20 nt, Homo sapiens
ugucccagcgauggugccug

SEQ ID NO: 1207980 - RNA, 12 nt, Homo sapiens
ugucccaugcag

SEQ ID NO: 1207981 - RNA, 16 nt, Homo sapiens
uguccccuccacuguc

SEQ ID NO: 1207982 - RNA, 19 nt, Homo sapiens
uguccccuccacugucaca

SEQ ID NO: 1207983 - RNA, 20 nt, Homo sapiens
ugucccggggcuccacugaa

SEQ ID NO: 1207984 - RNA, 16 nt, Homo sapiens
ugucccucacuguuga

SEQ ID NO: 1207985 - RNA, 15 nt, Homo sapiens
ugucccucccaccuc

SEQ ID NO: 1207986 - RNA, 16 nt, Homo sapiens
ugucccugcacuugca

SEQ ID NO: 1207987 - RNA, 18 nt, Homo sapiens
uguccggcccagugccac

SEQ ID NO: 1207988 - RNA, 16 nt, Homo sapiens
uguccuaaaaagacac

SEQ ID NO: 1207989 - RNA, 14 nt, Homo sapiens
uguccugccagcug

SEQ ID NO: 1207990 - RNA, 16 nt, Homo sapiens
uguccuucuccaucua

SEQ ID NO: 1207991 - RNA, 16 nt, Homo sapiens
ugucgccucugcauuc

SEQ ID NO: 1207992 - RNA, 17 nt, Homo sapiens
ugucuaaacaaugcuga

SEQ ID NO: 1207993 - RNA, 17 nt, Homo sapiens
ugucuaauaaaauauaa

SEQ ID NO: 1207994 - RNA, 18 nt, Homo sapiens
ugucuacaugccaugacc

SEQ ID NO: 1207995 - RNA, 12 nt, Homo sapiens
ugucuaccucag

SEQ ID NO: 1207996 - RNA, 13 nt, Homo sapiens
ugucuaccucuga

SEQ ID NO: 1207997 - RNA, 12 nt, Homo sapiens
ugucuacugugg

SEQ ID NO: 1207998 - RNA, 18 nt, Homo sapiens
ugucuauuuucucaguca

SEQ ID NO: 1207999 - RNA, 16 nt, Homo sapiens
ugucucacugaaacau

SEQ ID NO: 1208000 - RNA, 15 nt, Homo sapiens
ugucucagaagugaa

SEQ ID NO: 1208001 - RNA, 18 nt, Homo sapiens
ugucucagacugcaugua

SEQ ID NO: 1208002 - RNA, 21 nt, Homo sapiens
ugucucccuucgacauugagc

SEQ ID NO: 1208003 - RNA, 18 nt, Homo sapiens
ugucuccuacuccugacu

SEQ ID NO: 1208004 - RNA, 15 nt, Homo sapiens
ugucucgaguccuaa

SEQ ID NO: 1208005 - RNA, 23 nt, Homo sapiens
ugucucuuuaagggcaugccuug

SEQ ID NO: 1208006 - RNA, 14 nt, Homo sapiens
ugucugacaaccuc

SEQ ID NO: 1208007 - RNA, 16 nt, Homo sapiens
ugucugacaaccucuu

SEQ ID NO: 1208008 - RNA, 11 nt, Homo sapiens
ugucugagaug

SEQ ID NO: 1208009 - RNA, 17 nt, Homo sapiens
ugucugcucaguaauuu

SEQ ID NO: 1208010 - RNA, 17 nt, Homo sapiens
ugucuggagcggcugcu

SEQ ID NO: 1208011 - RNA, 22 nt, Homo sapiens
ugucugguacuauuggaacaaa

SEQ ID NO: 1208012 - RNA, 22 nt, Homo sapiens
ugucuguaucggagacagugau

SEQ ID NO: 1208013 - RNA, 18 nt, Homo sapiens
ugucugucccgggguccu

SEQ ID NO: 1208014 - RNA, 18 nt, Homo sapiens
ugucuguuaaaugaacuu

SEQ ID NO: 1208015 - RNA, 14 nt, Homo sapiens
ugucuguucacuuu

SEQ ID NO: 1208016 - RNA, 22 nt, Homo sapiens
ugucuuaaugguauccuacuga

SEQ ID NO: 1208017 - RNA, 22 nt, Homo sapiens
ugucuucagccucuccaggcac

SEQ ID NO: 1208018 - RNA, 15 nt, Homo sapiens
ugucuuccaagguag

SEQ ID NO: 1208019 - RNA, 12 nt, Homo sapiens
ugucuuccauaa

SEQ ID NO: 1208020 - RNA, 19 nt, Homo sapiens
ugucuucgcuggcuccuac

SEQ ID NO: 1208021 - RNA, 18 nt, Homo sapiens
ugucuuguguuuccacag

SEQ ID NO: 1208022 - RNA, 18 nt, Homo sapiens
ugucuuuaacucauaaaa

SEQ ID NO: 1208023 - RNA, 23 nt, Homo sapiens
ugucuuugucaccacguggggcu

SEQ ID NO: 1208024 - RNA, 18 nt, Homo sapiens
ugucuuuucuuccacugc

SEQ ID NO: 1208025 - RNA, 22 nt, Homo sapiens
ugucuuuucuuggcaaaagccu

SEQ ID NO: 1208026 - RNA, 17 nt, Homo sapiens
ugugaaacuggcacuga

SEQ ID NO: 1208027 - RNA, 15 nt, Homo sapiens
ugugaaacuuucauu

SEQ ID NO: 1208028 - RNA, 21 nt, Homo sapiens
ugugaaaggaagcuccacugu

SEQ ID NO: 1208029 - RNA, 19 nt, Homo sapiens
ugugaaauaccaaccugaa

SEQ ID NO: 1208030 - RNA, 17 nt, Homo sapiens
ugugaaaugaauguaau

SEQ ID NO: 1208031 - RNA, 20 nt, Homo sapiens
ugugaaauucacaguaauau

SEQ ID NO: 1208032 - RNA, 15 nt, Homo sapiens
ugugaaccaccacac

SEQ ID NO: 1208033 - RNA, 23 nt, Homo sapiens
ugugaacuggaagaaagcaacaa

SEQ ID NO: 1208034 - RNA, 16 nt, Homo sapiens
ugugaagcaaggagcu

SEQ ID NO: 1208035 - RNA, 19 nt, Homo sapiens
ugugaauuaggcuguaacu

SEQ ID NO: 1208036 - RNA, 20 nt, Homo sapiens
ugugaauuauucugauucuu

SEQ ID NO: 1208037 - RNA, 21 nt, Homo sapiens
ugugacaauaaguuugaaccu

SEQ ID NO: 1208038 - RNA, 22 nt, Homo sapiens
ugugacaauaauauuguuguau

SEQ ID NO: 1208039 - RNA, 16 nt, Homo sapiens
ugugacaccaaagcca

SEQ ID NO: 1208040 - RNA, 22 nt, Homo sapiens
ugugacauacauauuaucucau

SEQ ID NO: 1208041 - RNA, 11 nt, Homo sapiens
ugugacauuua

SEQ ID NO: 1208042 - RNA, 17 nt, Homo sapiens
ugugaccccacugccaa

SEQ ID NO: 1208043 - RNA, 12 nt, Homo sapiens
ugugaccuugac

SEQ ID NO: 1208044 - RNA, 20 nt, Homo sapiens
ugugacuucuccaggucuca

SEQ ID NO: 1208045 - RNA, 22 nt, Homo sapiens
ugugacuuuuuagccagugacu

SEQ ID NO: 1208046 - RNA, 14 nt, Homo sapiens
ugugagacuguaag

SEQ ID NO: 1208047 - RNA, 23 nt, Homo sapiens
ugugagacuguaaguuacaugaa

SEQ ID NO: 1208048 - RNA, 16 nt, Homo sapiens
ugugagauccuucaca

SEQ ID NO: 1208049 - RNA, 12 nt, Homo sapiens
ugugagcaccug

SEQ ID NO: 1208050 - RNA, 16 nt, Homo sapiens
ugugagccaccacguc

SEQ ID NO: 1208051 - RNA, 19 nt, Homo sapiens
ugugagguucgcuuaucaa

SEQ ID NO: 1208052 - RNA, 17 nt, Homo sapiens
ugugaguguaaguguga

SEQ ID NO: 1208053 - RNA, 18 nt, Homo sapiens
ugugauagcacuuucuac

SEQ ID NO: 1208054 - RNA, 16 nt, Homo sapiens
ugugauauacaaagug

SEQ ID NO: 1208055 - RNA, 20 nt, Homo sapiens
ugugauguaccaguuugucc

SEQ ID NO: 1208056 - RNA, 19 nt, Homo sapiens
ugugauuauuucacuuuag

SEQ ID NO: 1208057 - RNA, 23 nt, Homo sapiens
ugugauugaaggugauaagggaa

SEQ ID NO: 1208058 - RNA, 17 nt, Homo sapiens
ugugauugcacagaauu

SEQ ID NO: 1208059 - RNA, 18 nt, Homo sapiens
ugugcaauugauuucuuu

SEQ ID NO: 1208060 - RNA, 17 nt, Homo sapiens
ugugcacugucacuuug

SEQ ID NO: 1208061 - RNA, 18 nt, Homo sapiens
ugugcacugucacuuugc

SEQ ID NO: 1208062 - RNA, 19 nt, Homo sapiens
ugugcagggugaagcagcu

SEQ ID NO: 1208063 - RNA, 13 nt, Homo sapiens
ugugcaguagcau

SEQ ID NO: 1208064 - RNA, 22 nt, Homo sapiens
ugugcauuaaaacaaauccaua

SEQ ID NO: 1208065 - RNA, 13 nt, Homo sapiens
ugugccaaccugu

SEQ ID NO: 1208066 - RNA, 15 nt, Homo sapiens
ugugccacacaguga

SEQ ID NO: 1208067 - RNA, 15 nt, Homo sapiens
uuaauauccaagacu

SEQ ID NO: 1208068 - RNA, 20 nt, Homo sapiens
uuaauauuuuccuaguagau

SEQ ID NO: 1208069 - RNA, 18 nt, Homo sapiens
uuaaucuccucagacagu

SEQ ID NO: 1208070 - RNA, 20 nt, Homo sapiens
uuaaucuuucuuuaccugag

SEQ ID NO: 1208071 - RNA, 18 nt, Homo sapiens
uuaaugaacuaacugaca

SEQ ID NO: 1208072 - RNA, 15 nt, Homo sapiens
uuaaugaagugcaau

SEQ ID NO: 1208073 - RNA, 20 nt, Homo sapiens
uuaaugaaugccuaaauaua

SEQ ID NO: 1208074 - RNA, 15 nt, Homo sapiens
uuaaugacaacacuu

SEQ ID NO: 1208075 - RNA, 12 nt, Homo sapiens
uuaaugagauag

SEQ ID NO: 1208076 - RNA, 21 nt, Homo sapiens
uuaaugagggaaaauguuuac

SEQ ID NO: 1208077 - RNA, 13 nt, Homo sapiens
uuaauguacaagu

SEQ ID NO: 1208078 - RNA, 21 nt, Homo sapiens
uuaauguauuuguuugcaauu

SEQ ID NO: 1208079 - RNA, 12 nt, Homo sapiens
uuaaugugauga

SEQ ID NO: 1208080 - RNA, 15 nt, Homo sapiens
uuaauuaaaucucaa

SEQ ID NO: 1208081 - RNA, 12 nt, Homo sapiens
uuaauuacauaa

SEQ ID NO: 1208082 - RNA, 17 nt, Homo sapiens
uuaauuaguugauugcu

SEQ ID NO: 1208083 - RNA, 15 nt, Homo sapiens
uuaauucuucaccug

SEQ ID NO: 1208084 - RNA, 14 nt, Homo sapiens
uuaauuuccagggu

SEQ ID NO: 1208085 - RNA, 14 nt, Homo sapiens
uuaauuucuaaaga

SEQ ID NO: 1208086 - RNA, 15 nt, Homo sapiens
uuaauuugaaaccag

SEQ ID NO: 1208087 - RNA, 15 nt, Homo sapiens
uuaauuuucaguaua

SEQ ID NO: 1208088 - RNA, 12 nt, Homo sapiens
uuaauuuugcca

SEQ ID NO: 1208089 - RNA, 18 nt, Homo sapiens
uuaauuuuuuacuuucag

SEQ ID NO: 1208090 - RNA, 19 nt, Homo sapiens
uuaauuuuuuuuacuauaa

SEQ ID NO: 1208091 - RNA, 18 nt, Homo sapiens
uuacaaaaaaauacaaaa

SEQ ID NO: 1208092 - RNA, 23 nt, Homo sapiens
uuacaaaacaugauuguuuacag

SEQ ID NO: 1208093 - RNA, 13 nt, Homo sapiens
uuacaaacugcaa

SEQ ID NO: 1208094 - RNA, 20 nt, Homo sapiens
uuacaaaguaauuucuuuga

SEQ ID NO: 1208095 - RNA, 14 nt, Homo sapiens
uuacaaggugacaa

SEQ ID NO: 1208096 - RNA, 23 nt, Homo sapiens
uuacaaucaaaucuccugcugau

SEQ ID NO: 1208097 - RNA, 20 nt, Homo sapiens
uuacaaucagccacauucua

SEQ ID NO: 1208098 - RNA, 19 nt, Homo sapiens
uuacaauuauggaaauaua

SEQ ID NO: 1208099 - RNA, 14 nt, Homo sapiens
uuacacaaagggaa

SEQ ID NO: 1208100 - RNA, 19 nt, Homo sapiens
uuacacaguugcugucaua

SEQ ID NO: 1208101 - RNA, 12 nt, Homo sapiens
uuacacauagca

SEQ ID NO: 1208102 - RNA, 13 nt, Homo sapiens
uuacacaucucag

SEQ ID NO: 1208103 - RNA, 16 nt, Homo sapiens
uuacaccaacuccuaa

SEQ ID NO: 1208104 - RNA, 18 nt, Homo sapiens
uuacacggagugugcuaa

SEQ ID NO: 1208105 - RNA, 16 nt, Homo sapiens
uuacacugccuguaua

SEQ ID NO: 1208106 - RNA, 19 nt, Homo sapiens
uuacacugugucauucugu

SEQ ID NO: 1208107 - RNA, 21 nt, Homo sapiens
uuacagaaaagacucugacca

SEQ ID NO: 1208108 - RNA, 19 nt, Homo sapiens
uuacagacaugaacugcca

SEQ ID NO: 1208109 - RNA, 15 nt, Homo sapiens
uuacagcacuacucu

SEQ ID NO: 1208110 - RNA, 11 nt, Homo sapiens
uuacagcugcc

SEQ ID NO: 1208111 - RNA, 16 nt, Homo sapiens
uuacaggaacuucauc

SEQ ID NO: 1208112 - RNA, 16 nt, Homo sapiens
uuacaggaaugaagaa

SEQ ID NO: 1208113 - RNA, 20 nt, Homo sapiens
uuacaggagggaacauuucc

SEQ ID NO: 1208114 - RNA, 17 nt, Homo sapiens
uuacagggugacucaca

SEQ ID NO: 1208115 - RNA, 12 nt, Homo sapiens
uuacaguguaug

SEQ ID NO: 1208116 - RNA, 23 nt, Homo sapiens
uuacauccagaguucugugacac

SEQ ID NO: 1208117 - RNA, 17 nt, Homo sapiens
uuacaugugauugugau

SEQ ID NO: 1208118 - RNA, 14 nt, Homo sapiens
uuacauguguaaag

SEQ ID NO: 1208119 - RNA, 18 nt, Homo sapiens
uuacauuucauacaacag

SEQ ID NO: 1208120 - RNA, 15 nt, Homo sapiens
uuaccaaagcaucaa

SEQ ID NO: 1208121 - RNA, 13 nt, Homo sapiens
uuaccaaaggaua

SEQ ID NO: 1208122 - RNA, 10 nt, Homo sapiens
uuaccaauua

SEQ ID NO: 1208123 - RNA, 17 nt, Homo sapiens
uuaccagaagcuuccau

SEQ ID NO: 1208124 - RNA, 20 nt, Homo sapiens
uuaccagaugcuacuggacu

SEQ ID NO: 1208125 - RNA, 22 nt, Homo sapiens
uuaccaggaagcagauacauau

SEQ ID NO: 1208126 - RNA, 10 nt, Homo sapiens
uuaccaucug

SEQ ID NO: 1208127 - RNA, 19 nt, Homo sapiens
uuaccauuucacacauaag

SEQ ID NO: 1208128 - RNA, 19 nt, Homo sapiens
uuacccaggcuggagugca

SEQ ID NO: 1208129 - RNA, 17 nt, Homo sapiens
uuaccgccugucucuuu

SEQ ID NO: 1208130 - RNA, 21 nt, Homo sapiens
uuaccuagauuuacagccuca

SEQ ID NO: 1208131 - RNA, 15 nt, Homo sapiens
uuaccucacagugau

SEQ ID NO: 1208132 - RNA, 14 nt, Homo sapiens
uuaccuccuaucag

SEQ ID NO: 1208133 - RNA, 12 nt, Homo sapiens
uuaccucugaua

SEQ ID NO: 1208134 - RNA, 14 nt, Homo sapiens
uuaccuuguauacu

SEQ ID NO: 1208135 - RNA, 12 nt, Homo sapiens
uuaccuuucaua

SEQ ID NO: 1208136 - RNA, 17 nt, Homo sapiens
uuacgacccaggacaau

SEQ ID NO: 1208137 - RNA, 13 nt, Homo sapiens
uuacuaaacauuu

SEQ ID NO: 1208138 - RNA, 16 nt, Homo sapiens
uuacuaucauaauuca

SEQ ID NO: 1208139 - RNA, 22 nt, Homo sapiens
uuacuauuauagcaacuuuaag

SEQ ID NO: 1208140 - RNA, 16 nt, Homo sapiens
uuacuauucauuaaau

SEQ ID NO: 1208141 - RNA, 18 nt, Homo sapiens
uuacucaggguucaucug

SEQ ID NO: 1208142 - RNA, 14 nt, Homo sapiens
uuacucagguuuga

SEQ ID NO: 1208143 - RNA, 17 nt, Homo sapiens
uuacucagguuugagaa

SEQ ID NO: 1208144 - RNA, 19 nt, Homo sapiens
uuacuccaucauggcugcu

SEQ ID NO: 1208145 - RNA, 23 nt, Homo sapiens
uuacucuauacauucaacagaga

SEQ ID NO: 1208146 - RNA, 14 nt, Homo sapiens
uuacucucacaccu

SEQ ID NO: 1208147 - RNA, 13 nt, Homo sapiens
uuacucuugagaa

SEQ ID NO: 1208148 - RNA, 17 nt, Homo sapiens
uuacugugaaacuggca

SEQ ID NO: 1208149 - RNA, 15 nt, Homo sapiens
uuacuuaaaggaaua

SEQ ID NO: 1208150 - RNA, 19 nt, Homo sapiens
uuacuucauauuguugcau

SEQ ID NO: 1208151 - RNA, 24 nt, Homo sapiens
uuacuucucacuaauuuguaggaa

SEQ ID NO: 1208152 - RNA, 21 nt, Homo sapiens
uuacuuugauaucugaucaaa

SEQ ID NO: 1208153 - RNA, 15 nt, Homo sapiens
uuacuuuuauuugca

SEQ ID NO: 1208154 - RNA, 17 nt, Homo sapiens
uuacuuuuuuacacuga

SEQ ID NO: 1208155 - RNA, 16 nt, Homo sapiens
uuagaaaaauuccuaa

SEQ ID NO: 1208156 - RNA, 17 nt, Homo sapiens
uuagaaaauagagcuuu

SEQ ID NO: 1208157 - RNA, 12 nt, Homo sapiens
uuagaaagggaa

SEQ ID NO: 1208158 - RNA, 16 nt, Homo sapiens
uuagaaauacugcaag

SEQ ID NO: 1208159 - RNA, 14 nt, Homo sapiens
uuagaaaugcaaaa

SEQ ID NO: 1208160 - RNA, 19 nt, Homo sapiens
uuagaagcugagacacaaa

SEQ ID NO: 1208161 - RNA, 19 nt, Homo sapiens
uuagaaugguugaguuaca

SEQ ID NO: 1208162 - RNA, 17 nt, Homo sapiens
uuagacagagucucacu

SEQ ID NO: 1208163 - RNA, 13 nt, Homo sapiens
uuagacauaacaa

SEQ ID NO: 1208164 - RNA, 22 nt, Homo sapiens
uuagacaugacugaugacauau

SEQ ID NO: 1208165 - RNA, 23 nt, Homo sapiens
uuagacccaugcuggucagagac

SEQ ID NO: 1208166 - RNA, 14 nt, Homo sapiens
uuagacuacauuua

SEQ ID NO: 1208167 - RNA, 21 nt, Homo sapiens
uuagagaaagaacuaugaaau

SEQ ID NO: 1208168 - RNA, 23 nt, Homo sapiens
uuagagaauuuccuuacucuuga

SEQ ID NO: 1208169 - RNA, 15 nt, Homo sapiens
uuagagagagaacuu

SEQ ID NO: 1208170 - RNA, 20 nt, Homo sapiens
uuagagcauugccauucccu

SEQ ID NO: 1208171 - RNA, 23 nt, Homo sapiens
uuagagcccauuucaauucucaa

SEQ ID NO: 1208172 - RNA, 17 nt, Homo sapiens
uuagaguugcucuacaa

SEQ ID NO: 1208173 - RNA, 22 nt, Homo sapiens
uuagaguugcucuacaaugaca

SEQ ID NO: 1208174 - RNA, 16 nt, Homo sapiens
uuagauauugcuacua

SEQ ID NO: 1208175 - RNA, 20 nt, Homo sapiens
uuagauauugcuacuauaau

SEQ ID NO: 1208176 - RNA, 24 nt, Homo sapiens
uuagaucaaccuccaacaacgaca

SEQ ID NO: 1208177 - RNA, 17 nt, Homo sapiens
uuagaucucauaaugcu

SEQ ID NO: 1208178 - RNA, 20 nt, Homo sapiens
uuagaugaggaaaugauccc

SEQ ID NO: 1208179 - RNA, 12 nt, Homo sapiens
uucaaacagaac

SEQ ID NO: 1208180 - RNA, 18 nt, Homo sapiens
uucaaacugcaugauuca

SEQ ID NO: 1208181 - RNA, 19 nt, Homo sapiens
uucaaacugcaugauucau

SEQ ID NO: 1208182 - RNA, 20 nt, Homo sapiens
uucaaagacagagaagacca

SEQ ID NO: 1208183 - RNA, 19 nt, Homo sapiens
uucaaagagaugggccuuu

SEQ ID NO: 1208184 - RNA, 15 nt, Homo sapiens
uucaaagagucauau

SEQ ID NO: 1208185 - RNA, 22 nt, Homo sapiens
uucaaauacaaaguaaauacaa

SEQ ID NO: 1208186 - RNA, 22 nt, Homo sapiens
uucaaaucacauggaacuuuag

SEQ ID NO: 1208187 - RNA, 18 nt, Homo sapiens
uucaacaguuuuugcuaa

SEQ ID NO: 1208188 - RNA, 13 nt, Homo sapiens
uucaacccagugg

SEQ ID NO: 1208189 - RNA, 13 nt, Homo sapiens
uucaacuguauag

SEQ ID NO: 1208190 - RNA, 15 nt, Homo sapiens
uucaagaaagcuuca

SEQ ID NO: 1208191 - RNA, 23 nt, Homo sapiens
uucaagaagugccaguugaucaa

SEQ ID NO: 1208192 - RNA, 22 nt, Homo sapiens
uucaagaucucauccaagcaaa

SEQ ID NO: 1208193 - RNA, 14 nt, Homo sapiens
uucaagauuguuga

SEQ ID NO: 1208194 - RNA, 14 nt, Homo sapiens
uucaagcagcaucu

SEQ ID NO: 1208195 - RNA, 20 nt, Homo sapiens
ugaaugccguggauugcacg

SEQ ID NO: 1208196 - RNA, 21 nt, Homo sapiens
ugaaugccucgcucccuucaa

SEQ ID NO: 1208197 - RNA, 15 nt, Homo sapiens
ugaauggccugccuu

SEQ ID NO: 1208198 - RNA, 16 nt, Homo sapiens
ugaaugguuccaugcc

SEQ ID NO: 1208199 - RNA, 17 nt, Homo sapiens
ugaaugucaauaugaga

SEQ ID NO: 1208200 - RNA, 22 nt, Homo sapiens
ugaaugucucgauuagacucca

SEQ ID NO: 1208201 - RNA, 15 nt, Homo sapiens
ugaauguggacucaa

SEQ ID NO: 1208202 - RNA, 16 nt, Homo sapiens
ugaauuaaauauugaa

SEQ ID NO: 1208203 - RNA, 22 nt, Homo sapiens
ugaauuaugauggucugcauua

SEQ ID NO: 1208204 - RNA, 15 nt, Homo sapiens
ugaauucuuaugcuu

SEQ ID NO: 1208205 - RNA, 15 nt, Homo sapiens
ugaauugguugaaua

SEQ ID NO: 1208206 - RNA, 23 nt, Homo sapiens
ugaauuguuaauucacagaauag

SEQ ID NO: 1208207 - RNA, 15 nt, Homo sapiens
ugaauuucugaaaga

SEQ ID NO: 1208208 - RNA, 14 nt, Homo sapiens
ugaauuuucccuga

SEQ ID NO: 1208209 - RNA, 14 nt, Homo sapiens
ugaauuuuguugcu

SEQ ID NO: 1208210 - RNA, 16 nt, Homo sapiens
ugacaaacauauccuu

SEQ ID NO: 1208211 - RNA, 12 nt, Homo sapiens
ugacaaaccauc

SEQ ID NO: 1208212 - RNA, 17 nt, Homo sapiens
ugacaaccucauccagg

SEQ ID NO: 1208213 - RNA, 17 nt, Homo sapiens
ugacaagccaaugugaa

SEQ ID NO: 1208214 - RNA, 20 nt, Homo sapiens
ugacaagcugacuuggcacu

SEQ ID NO: 1208215 - RNA, 15 nt, Homo sapiens
ugacaagugagacaa

SEQ ID NO: 1208216 - RNA, 20 nt, Homo sapiens
ugacaagugagacaaaaagc

SEQ ID NO: 1208217 - RNA, 15 nt, Homo sapiens
ugauggagaggacag

SEQ ID NO: 1208218 - RNA, 16 nt, Homo sapiens
ugauggagaugcaguc

SEQ ID NO: 1208219 - RNA, 16 nt, Homo sapiens
ugauggccaccagcuu

SEQ ID NO: 1208220 - RNA, 12 nt, Homo sapiens
ugauggcugaag

SEQ ID NO: 1208221 - RNA, 17 nt, Homo sapiens
ugauggggcaugugcca

SEQ ID NO: 1208222 - RNA, 18 nt, Homo sapiens
ugauggugagcugggaag

SEQ ID NO: 1208223 - RNA, 19 nt, Homo sapiens
ugaugguggacuaagcaau

SEQ ID NO: 1208224 - RNA, 23 nt, Homo sapiens
ugauguauaaagcaacuguuaug

SEQ ID NO: 1208225 - RNA, 14 nt, Homo sapiens
ugaugucuaccuca

SEQ ID NO: 1208226 - RNA, 15 nt, Homo sapiens
ugaugucuaccucag

SEQ ID NO: 1208227 - RNA, 14 nt, Homo sapiens
ugauuaaucaaagg

SEQ ID NO: 1208228 - RNA, 15 nt, Homo sapiens
ugauuacugcucuau

SEQ ID NO: 1208229 - RNA, 17 nt, Homo sapiens
ugauuacuguccagcuu

SEQ ID NO: 1208230 - RNA, 15 nt, Homo sapiens
ugauuaggaagcauu

SEQ ID NO: 1208231 - RNA, 21 nt, Homo sapiens
ugauuauccauauugagucaa

SEQ ID NO: 1208232 - RNA, 23 nt, Homo sapiens
ugauuauccauauugagucaaau

SEQ ID NO: 1208233 - RNA, 15 nt, Homo sapiens
ugauuauuaaagucc

SEQ ID NO: 1208234 - RNA, 18 nt, Homo sapiens
ugauuauuuguauuuaca

SEQ ID NO: 1208235 - RNA, 22 nt, Homo sapiens
ugauucaggggucugaugacac

SEQ ID NO: 1208236 - RNA, 16 nt, Homo sapiens
ugauucuccugccuca

SEQ ID NO: 1208237 - RNA, 19 nt, Homo sapiens
ugauugaaaauaguaaaug

SEQ ID NO: 1208238 - RNA, 18 nt, Homo sapiens
ugauugcauccacuagcu

SEQ ID NO: 1208239 - RNA, 20 nt, Homo sapiens
ugauugugggauacuauuua

SEQ ID NO: 1208240 - RNA, 17 nt, Homo sapiens
ugauuuacauguauggu

SEQ ID NO: 1208241 - RNA, 15 nt, Homo sapiens
ugauuuagugaucaa

SEQ ID NO: 1208242 - RNA, 18 nt, Homo sapiens
ugauuucacaacagauca

SEQ ID NO: 1208243 - RNA, 17 nt, Homo sapiens
ugauuucagacugcaga

SEQ ID NO: 1208244 - RNA, 13 nt, Homo sapiens
ugauuucaggaua

SEQ ID NO: 1208245 - RNA, 14 nt, Homo sapiens
ugauuucauuucaa

SEQ ID NO: 1208246 - RNA, 14 nt, Homo sapiens
ugauuuccagugag

SEQ ID NO: 1208247 - RNA, 18 nt, Homo sapiens
ugauuucugacucuauca

SEQ ID NO: 1208248 - RNA, 18 nt, Homo sapiens
ugauuucuuucuuugcac

SEQ ID NO: 1208249 - RNA, 16 nt, Homo sapiens
ugauuugauaccaugg

SEQ ID NO: 1208250 - RNA, 18 nt, Homo sapiens
ugauuugauaccauggca

SEQ ID NO: 1208251 - RNA, 19 nt, Homo sapiens
ugauuugauaccauggcac

SEQ ID NO: 1208252 - RNA, 22 nt, Homo sapiens
ugauuugauaccauggcacuga

SEQ ID NO: 1208253 - RNA, 18 nt, Homo sapiens
ugauuugcucuuugacaa

SEQ ID NO: 1208254 - RNA, 17 nt, Homo sapiens
ugauuuguaacauucac

SEQ ID NO: 1208255 - RNA, 18 nt, Homo sapiens
ugauuuguaacauucaca

SEQ ID NO: 1208256 - RNA, 16 nt, Homo sapiens
ugauuuguagcacuga

SEQ ID NO: 1208257 - RNA, 18 nt, Homo sapiens
ugauuugucccuaugcau

SEQ ID NO: 1208258 - RNA, 14 nt, Homo sapiens
ugauuuuuacuuca

SEQ ID NO: 1208259 - RNA, 14 nt, Homo sapiens
ugcaaaacacuaaa

SEQ ID NO: 1208260 - RNA, 16 nt, Homo sapiens
ugcaaaacacuaaaga

SEQ ID NO: 1208261 - RNA, 13 nt, Homo sapiens
ugcaaaacuuuag

SEQ ID NO: 1208262 - RNA, 16 nt, Homo sapiens
ugcaaaauagacauau

SEQ ID NO: 1208263 - RNA, 18 nt, Homo sapiens
ugcaaaauauuugacuau

SEQ ID NO: 1208264 - RNA, 22 nt, Homo sapiens
ugcaaacaguaacgugugcgca

SEQ ID NO: 1208265 - RNA, 17 nt, Homo sapiens
ugcaaacccugguggua

SEQ ID NO: 1208266 - RNA, 21 nt, Homo sapiens
ugcaaaccuguucaucuugcc

SEQ ID NO: 1208267 - RNA, 13 nt, Homo sapiens
ugcaaaccuuccu

SEQ ID NO: 1208268 - RNA, 15 nt, Homo sapiens
ugcaaacuuguuaga

SEQ ID NO: 1208269 - RNA, 17 nt, Homo sapiens
ugcaaagaucuuuucca

SEQ ID NO: 1208270 - RNA, 14 nt, Homo sapiens
ugcaaauacuguau

SEQ ID NO: 1208271 - RNA, 22 nt, Homo sapiens
ugcaaauaggcagaauggaauc

SEQ ID NO: 1208272 - RNA, 23 nt, Homo sapiens
ugcaaaucagagcauacaaaaua

SEQ ID NO: 1208273 - RNA, 17 nt, Homo sapiens
ugcaaauugccugcaaa

SEQ ID NO: 1208274 - RNA, 18 nt, Homo sapiens
ugcaacagcuacagucua

SEQ ID NO: 1208275 - RNA, 13 nt, Homo sapiens
ugcaacagcuuuc

SEQ ID NO: 1208276 - RNA, 13 nt, Homo sapiens
ugcaacucacuga

SEQ ID NO: 1208277 - RNA, 14 nt, Homo sapiens
ugcaacuucugccu

SEQ ID NO: 1208278 - RNA, 17 nt, Homo sapiens
ugcaacuuuuaauuacu

SEQ ID NO: 1208279 - RNA, 22 nt, Homo sapiens
ugcaagaaggauaccaaauacc

SEQ ID NO: 1208280 - RNA, 21 nt, Homo sapiens
ugcaagaccuagugcucuuaa

SEQ ID NO: 1208281 - RNA, 12 nt, Homo sapiens
ugcaagccuguc

SEQ ID NO: 1208282 - RNA, 16 nt, Homo sapiens
ugcaagcuccaucucu

SEQ ID NO: 1208283 - RNA, 14 nt, Homo sapiens
ugcaaggggcugca

SEQ ID NO: 1208284 - RNA, 22 nt, Homo sapiens
ugcaagguacucuggugaguca

SEQ ID NO: 1208285 - RNA, 17 nt, Homo sapiens
ugcaagguauuucucca

SEQ ID NO: 1208286 - RNA, 15 nt, Homo sapiens
ugcaagucagaggau

SEQ ID NO: 1208287 - RNA, 22 nt, Homo sapiens
ugcaauaaaaaaauuacccuga

SEQ ID NO: 1208288 - RNA, 18 nt, Homo sapiens
ugcaauaggugugcguca

SEQ ID NO: 1208289 - RNA, 16 nt, Homo sapiens
ugcaaucuguguucga

SEQ ID NO: 1208290 - RNA, 14 nt, Homo sapiens
ugcaaugcaugaua

SEQ ID NO: 1208291 - RNA, 19 nt, Homo sapiens
ugcaaugccuagacuuccc

SEQ ID NO: 1208292 - RNA, 15 nt, Homo sapiens
ugcaauguaagcaua

SEQ ID NO: 1208293 - RNA, 13 nt, Homo sapiens
ugcaaugugcuac

SEQ ID NO: 1208294 - RNA, 21 nt, Homo sapiens
ugcacaaaagggacuuggaaa

SEQ ID NO: 1208295 - RNA, 17 nt, Homo sapiens
ugcacaaagcccuucca

SEQ ID NO: 1208296 - RNA, 12 nt, Homo sapiens
ugcacaaggugg

SEQ ID NO: 1208297 - RNA, 22 nt, Homo sapiens
ugcacaagguggaguguacugg

SEQ ID NO: 1208298 - RNA, 21 nt, Homo sapiens
ugcacaaguucccuggagaaa

SEQ ID NO: 1208299 - RNA, 23 nt, Homo sapiens
ugcacacacacacacaugcacac

SEQ ID NO: 1208300 - RNA, 20 nt, Homo sapiens
ugcacacacacacaucucau

SEQ ID NO: 1208301 - RNA, 12 nt, Homo sapiens
ugcacacugagg

SEQ ID NO: 1208302 - RNA, 15 nt, Homo sapiens
ugcacacugcacugu

SEQ ID NO: 1208303 - RNA, 18 nt, Homo sapiens
ugcacagcucaacggaag

SEQ ID NO: 1208304 - RNA, 23 nt, Homo sapiens
ugcacagggggaggccauaaaga

SEQ ID NO: 1208305 - RNA, 20 nt, Homo sapiens
ugcacaguugccacauuuag

SEQ ID NO: 1208306 - RNA, 13 nt, Homo sapiens
ugcacaugaaucc

SEQ ID NO: 1208307 - RNA, 17 nt, Homo sapiens
ugcacaugcacgugugu

SEQ ID NO: 1208308 - RNA, 18 nt, Homo sapiens
ugcacaugcgcacucuca

SEQ ID NO: 1208309 - RNA, 11 nt, Homo sapiens
ugcacaugugc

SEQ ID NO: 1208310 - RNA, 21 nt, Homo sapiens
ugcacaugugccacacaguga

SEQ ID NO: 1208311 - RNA, 12 nt, Homo sapiens
ugcaccaaagac

SEQ ID NO: 1208312 - RNA, 18 nt, Homo sapiens
ugcaccaauuaucaucuu

SEQ ID NO: 1208313 - RNA, 14 nt, Homo sapiens
ugcaccacuuuuaa

SEQ ID NO: 1208314 - RNA, 19 nt, Homo sapiens
ugcaccagagcaaccucuc

SEQ ID NO: 1208315 - RNA, 15 nt, Homo sapiens
ugcacccacccagga

SEQ ID NO: 1208316 - RNA, 19 nt, Homo sapiens
ugcaccccucugcccucau

SEQ ID NO: 1208317 - RNA, 12 nt, Homo sapiens
ugcaccuaccuu

SEQ ID NO: 1208318 - RNA, 22 nt, Homo sapiens
ugcaccugggagaaagacuuug

SEQ ID NO: 1208319 - RNA, 20 nt, Homo sapiens
ugcaccuuaccaacuuucug

SEQ ID NO: 1208320 - RNA, 17 nt, Homo sapiens
ugcaccuucacucucca

SEQ ID NO: 1208321 - RNA, 19 nt, Homo sapiens
ugcacgggagaauauacaa

SEQ ID NO: 1208322 - RNA, 16 nt, Homo sapiens
ugcacggugggagacc

SEQ ID NO: 1208323 - RNA, 14 nt, Homo sapiens
ugcacgugugugca

SEQ ID NO: 1208324 - RNA, 23 nt, Homo sapiens
ugcagacaggccaugugagccac

SEQ ID NO: 1208325 - RNA, 17 nt, Homo sapiens
ugcagaccugguuccca

SEQ ID NO: 1208326 - RNA, 22 nt, Homo sapiens
ugcagacgggcaagaagcugcu

SEQ ID NO: 1208327 - RNA, 16 nt, Homo sapiens
ugcagagaugacuguc

SEQ ID NO: 1208328 - RNA, 19 nt, Homo sapiens
ugcagaggauaaggaggca

SEQ ID NO: 1208329 - RNA, 16 nt, Homo sapiens
ugcagaggcaccucaa

SEQ ID NO: 1208330 - RNA, 20 nt, Homo sapiens
ugcagaugccacccuagcca

SEQ ID NO: 1208331 - RNA, 19 nt, Homo sapiens
ugcagcaccggccucggga

SEQ ID NO: 1208332 - RNA, 14 nt, Homo sapiens
ugcagcacucuuau

SEQ ID NO: 1208333 - RNA, 21 nt, Homo sapiens
ugcagcagcaacacaauguua

SEQ ID NO: 1208334 - RNA, 17 nt, Homo sapiens
ugcagcagcuucccuug

SEQ ID NO: 1208335 - RNA, 22 nt, Homo sapiens
ugcagcauggucccugccuuag

SEQ ID NO: 1208336 - RNA, 13 nt, Homo sapiens
ugcagccacuggc

SEQ ID NO: 1208337 - RNA, 19 nt, Homo sapiens
ugcagcccagaauagcuuu

SEQ ID NO: 1208338 - RNA, 17 nt, Homo sapiens
ugcagccccucaugccu

SEQ ID NO: 1208339 - RNA, 17 nt, Homo sapiens
ugcagcccuugggcagu

SEQ ID NO: 1208340 - RNA, 20 nt, Homo sapiens
ugcagccuccuccaccucac

SEQ ID NO: 1208341 - RNA, 18 nt, Homo sapiens
ugcagcuagaggcaucuu

SEQ ID NO: 1208342 - RNA, 20 nt, Homo sapiens
ugcagcuagaggcaucuucu

SEQ ID NO: 1208343 - RNA, 19 nt, Homo sapiens
ugcagcucucuuuccucug

SEQ ID NO: 1208344 - RNA, 18 nt, Homo sapiens
ugcagcuguaaacauauu

SEQ ID NO: 1208345 - RNA, 16 nt, Homo sapiens
ugcaggacuugagaag

SEQ ID NO: 1208346 - RNA, 22 nt, Homo sapiens
ugcaggacuugagaagaccuca

SEQ ID NO: 1208347 - RNA, 22 nt, Homo sapiens
ugcaggcaggaacaaacagggc

SEQ ID NO: 1208348 - RNA, 22 nt, Homo sapiens
ugcaggccgugugucugucagc

SEQ ID NO: 1208349 - RNA, 21 nt, Homo sapiens
ugcaggcugcagucccuggaa

SEQ ID NO: 1208350 - RNA, 18 nt, Homo sapiens
ugcagggaagagggcagu

SEQ ID NO: 1208351 - RNA, 19 nt, Homo sapiens
ugcagggaagagggcagua

SEQ ID NO: 1208352 - RNA, 17 nt, Homo sapiens
ugcagggacuccaugcu

SEQ ID NO: 1208353 - RNA, 14 nt, Homo sapiens
ugcagggacugcca

SEQ ID NO: 1208354 - RNA, 12 nt, Homo sapiens
ugcagggcucag

SEQ ID NO: 1208355 - RNA, 12 nt, Homo sapiens
ugcagggcuccc

SEQ ID NO: 1208356 - RNA, 19 nt, Homo sapiens
ugcagggguccccccucaa

SEQ ID NO: 1208357 - RNA, 15 nt, Homo sapiens
ugcaggggugccugg

SEQ ID NO: 1208358 - RNA, 20 nt, Homo sapiens
ugcaggguggauuguuacag

SEQ ID NO: 1208359 - RNA, 17 nt, Homo sapiens
ugcagguacuuccucag

SEQ ID NO: 1208360 - RNA, 17 nt, Homo sapiens
ugcaggugacauuugcu

SEQ ID NO: 1208361 - RNA, 21 nt, Homo sapiens
ugcagguuccuuaucugucac

SEQ ID NO: 1208362 - RNA, 21 nt, Homo sapiens
ugcagguuuucuucacugcca

SEQ ID NO: 1208363 - RNA, 19 nt, Homo sapiens
ugcaguacguucucaggau

SEQ ID NO: 1208364 - RNA, 14 nt, Homo sapiens
ugcaguaguauuua

SEQ ID NO: 1208365 - RNA, 20 nt, Homo sapiens
ugcaguccgcagucuggccu

SEQ ID NO: 1208366 - RNA, 17 nt, Homo sapiens
ugcaguggcgugaucuc

SEQ ID NO: 1208367 - RNA, 23 nt, Homo sapiens
ugcagugguaugaucacggcuca

SEQ ID NO: 1208368 - RNA, 17 nt, Homo sapiens
ugcaguggugugaucuc

SEQ ID NO: 1208369 - RNA, 18 nt, Homo sapiens
ugcaguucagcaccaccc

SEQ ID NO: 1208370 - RNA, 18 nt, Homo sapiens
ugcaguucuucaucauga

SEQ ID NO: 1208371 - RNA, 16 nt, Homo sapiens
ugcaguuggacucuca

SEQ ID NO: 1208372 - RNA, 22 nt, Homo sapiens
ugcaguuuuugccuggguccca

SEQ ID NO: 1208373 - RNA, 23 nt, Homo sapiens
ugcauaaaagacaagcacuuugg

SEQ ID NO: 1208374 - RNA, 21 nt, Homo sapiens
ugcauaaauaugcagugauau

SEQ ID NO: 1208375 - RNA, 14 nt, Homo sapiens
ugcauaagauuaaa

SEQ ID NO: 1208376 - RNA, 23 nt, Homo sapiens
ugcauaaugcuuuggaaaaaugg

SEQ ID NO: 1208377 - RNA, 22 nt, Homo sapiens
ugcauaauguuucuggauuuca

SEQ ID NO: 1208378 - RNA, 13 nt, Homo sapiens
ugcauacuuuauu

SEQ ID NO: 1208379 - RNA, 20 nt, Homo sapiens
ugcauacuuucccucaucca

SEQ ID NO: 1208380 - RNA, 21 nt, Homo sapiens
ugcauagcagaugguuuccac

SEQ ID NO: 1208381 - RNA, 16 nt, Homo sapiens
ugcauaggaauugcac

SEQ ID NO: 1208382 - RNA, 22 nt, Homo sapiens
ugcauaggaauugcacaaucca

SEQ ID NO: 1208383 - RNA, 22 nt, Homo sapiens
ugcauauauguauauagacaug

SEQ ID NO: 1208384 - RNA, 16 nt, Homo sapiens
ugcauccucacugugg

SEQ ID NO: 1208385 - RNA, 16 nt, Homo sapiens
ugcauccuuugcacug

SEQ ID NO: 1208386 - RNA, 17 nt, Homo sapiens
ugcaucucaaaauuauu

SEQ ID NO: 1208387 - RNA, 13 nt, Homo sapiens
ugcaucucuaaua

SEQ ID NO: 1208388 - RNA, 14 nt, Homo sapiens
ugcaucuucccaca

SEQ ID NO: 1208389 - RNA, 16 nt, Homo sapiens
ugcaucuuguuucaua

SEQ ID NO: 1208390 - RNA, 16 nt, Homo sapiens
ugcaugauaucuucaa

SEQ ID NO: 1208391 - RNA, 18 nt, Homo sapiens
ugcaugaugucuaccuca

SEQ ID NO: 1208392 - RNA, 21 nt, Homo sapiens
ugcauguaccauuugcauggc

SEQ ID NO: 1208393 - RNA, 14 nt, Homo sapiens
ugcauguacuguau

SEQ ID NO: 1208394 - RNA, 22 nt, Homo sapiens
ugcauguccggcugaaggcuga

SEQ ID NO: 1208395 - RNA, 19 nt, Homo sapiens
ugcaugucgcacaauguuu

SEQ ID NO: 1208396 - RNA, 15 nt, Homo sapiens
ugcauguggcuuuuu

SEQ ID NO: 1208397 - RNA, 18 nt, Homo sapiens
ugcauguuacccauucaa

SEQ ID NO: 1208398 - RNA, 15 nt, Homo sapiens
ugcauuaaaccuguc

SEQ ID NO: 1208399 - RNA, 14 nt, Homo sapiens
ugcauuauaucaaa

SEQ ID NO: 1208400 - RNA, 23 nt, Homo sapiens
ugcauugucuccuuccacaauga

SEQ ID NO: 1208401 - RNA, 21 nt, Homo sapiens
ugcauuguuaaucauccauca

SEQ ID NO: 1208402 - RNA, 18 nt, Homo sapiens
ugcauuucaccugugaca

SEQ ID NO: 1208403 - RNA, 12 nt, Homo sapiens
ugccaaaauaca

SEQ ID NO: 1208404 - RNA, 23 nt, Homo sapiens
ugccaaaguuuugcugucucuua

SEQ ID NO: 1208405 - RNA, 18 nt, Homo sapiens
ugccaaauaaacagcuau

SEQ ID NO: 1208406 - RNA, 16 nt, Homo sapiens
ugccaaccaguuugaa

SEQ ID NO: 1208407 - RNA, 21 nt, Homo sapiens
ugccaaccggucacccaggag

SEQ ID NO: 1208408 - RNA, 18 nt, Homo sapiens
ugccaagaaaguauuugg

SEQ ID NO: 1208409 - RNA, 15 nt, Homo sapiens
ugccaaggcaaaaaa

SEQ ID NO: 1208410 - RNA, 22 nt, Homo sapiens
ugccaaggcaaaaaacucuuaa

SEQ ID NO: 1208411 - RNA, 20 nt, Homo sapiens
ugccaaggggcugagugagu

SEQ ID NO: 1208412 - RNA, 19 nt, Homo sapiens
ugccaagggguuaaugaaa

SEQ ID NO: 1208413 - RNA, 20 nt, Homo sapiens
ugccacagaugauacuucca

SEQ ID NO: 1208414 - RNA, 21 nt, Homo sapiens
ugccacagaugauacuuccaa

SEQ ID NO: 1208415 - RNA, 23 nt, Homo sapiens
ugccacagcuuuugcaacuuaau

SEQ ID NO: 1208416 - RNA, 20 nt, Homo sapiens
ugccacauacaggugcucaa

SEQ ID NO: 1208417 - RNA, 22 nt, Homo sapiens
ugccacauuucugaucagaggu

SEQ ID NO: 1208418 - RNA, 23 nt, Homo sapiens
ugccacccaccuuugccacaaag

SEQ ID NO: 1208419 - RNA, 19 nt, Homo sapiens
ugccaccccaugugccuuu

SEQ ID NO: 1208420 - RNA, 16 nt, Homo sapiens
ugccaccggaggucac

SEQ ID NO: 1208421 - RNA, 22 nt, Homo sapiens
ugccacgcuuugaugagcauuu

SEQ ID NO: 1208422 - RNA, 14 nt, Homo sapiens
ugccacguggucac

SEQ ID NO: 1208423 - RNA, 15 nt, Homo sapiens
ugccacuggggaaaa

SEQ ID NO: 1208424 - RNA, 19 nt, Homo sapiens
ugccacuggggaaaacucc

SEQ ID NO: 1208425 - RNA, 16 nt, Homo sapiens
ugccacuguguacugu

SEQ ID NO: 1208426 - RNA, 18 nt, Homo sapiens
ugccacuguguacugugg

SEQ ID NO: 1208427 - RNA, 18 nt, Homo sapiens
ugccacuuaauguauguu

SEQ ID NO: 1208428 - RNA, 17 nt, Homo sapiens
ugccacuuugacucaga

SEQ ID NO: 1208429 - RNA, 15 nt, Homo sapiens
ugccacuuugcacau

SEQ ID NO: 1208430 - RNA, 16 nt, Homo sapiens
ugguggguucagggga

SEQ ID NO: 1208431 - RNA, 22 nt, Homo sapiens
ugguguaaagccaacacccugu

SEQ ID NO: 1208432 - RNA, 22 nt, Homo sapiens
uggugucacccuggauaggcaa

SEQ ID NO: 1208433 - RNA, 13 nt, Homo sapiens
uggugugaucucg

SEQ ID NO: 1208434 - RNA, 14 nt, Homo sapiens
uggugugcucucuu

SEQ ID NO: 1208435 - RNA, 20 nt, Homo sapiens
ugguguggccagcacucuga

SEQ ID NO: 1208436 - RNA, 21 nt, Homo sapiens
ugguguggccagcacucugaa

SEQ ID NO: 1208437 - RNA, 21 nt, Homo sapiens
ugguguucaaaaaaacacuag

SEQ ID NO: 1208438 - RNA, 18 nt, Homo sapiens
ugguuaagagaucccuua

SEQ ID NO: 1208439 - RNA, 14 nt, Homo sapiens
ugguuagacgccuu

SEQ ID NO: 1208440 - RNA, 19 nt, Homo sapiens
ugguuauucuaagcccuuu

SEQ ID NO: 1208441 - RNA, 20 nt, Homo sapiens
ugguuauuucucaacaaagc

SEQ ID NO: 1208442 - RNA, 15 nt, Homo sapiens
ugguucagcuacuuu

SEQ ID NO: 1208443 - RNA, 14 nt, Homo sapiens
ugguucaggguugg

SEQ ID NO: 1208444 - RNA, 12 nt, Homo sapiens
ugguuccauuuu

SEQ ID NO: 1208445 - RNA, 15 nt, Homo sapiens
uaaaagaaggaugaa

SEQ ID NO: 1208446 - RNA, 15 nt, Homo sapiens
uaaaagaaugacuau

SEQ ID NO: 1208447 - RNA, 15 nt, Homo sapiens
uaaaagaauugcacg

SEQ ID NO: 1208448 - RNA, 15 nt, Homo sapiens
uaaaagaguuaacau

SEQ ID NO: 1208449 - RNA, 20 nt, Homo sapiens
uaaaagaugguaaaccagau

SEQ ID NO: 1208450 - RNA, 11 nt, Homo sapiens
uaaaagccauc

SEQ ID NO: 1208451 - RNA, 17 nt, Homo sapiens
uaaaagccuuauucuaa

SEQ ID NO: 1208452 - RNA, 15 nt, Homo sapiens
uaaaagcuacuaugu

SEQ ID NO: 1208453 - RNA, 20 nt, Homo sapiens
uaaaagcuacuauguacugc

SEQ ID NO: 1208454 - RNA, 23 nt, Homo sapiens
uaaaagcuacuauguacugccuu

SEQ ID NO: 1208455 - RNA, 20 nt, Homo sapiens
uaaaagguaugguggggaua

SEQ ID NO: 1208456 - RNA, 14 nt, Homo sapiens
uaaaaguaaauuca

SEQ ID NO: 1208457 - RNA, 15 nt, Homo sapiens
uaaaagucuaugauc

SEQ ID NO: 1208458 - RNA, 17 nt, Homo sapiens
uaaaagugggcuugauu

SEQ ID NO: 1208459 - RNA, 13 nt, Homo sapiens
uaaaaguuacuua

SEQ ID NO: 1208460 - RNA, 15 nt, Homo sapiens
uaaaaguucauaaca

SEQ ID NO: 1208461 - RNA, 16 nt, Homo sapiens
uaaaaguucauaacag

SEQ ID NO: 1208462 - RNA, 13 nt, Homo sapiens
uaaaaguugcaaa

SEQ ID NO: 1208463 - RNA, 22 nt, Homo sapiens
uaaaaguuuuuuauuaugcauu

SEQ ID NO: 1208464 - RNA, 23 nt, Homo sapiens
uaaaaguuuuuuauuaugcauua

SEQ ID NO: 1208465 - RNA, 16 nt, Homo sapiens
uaaaauaaaagccaac

SEQ ID NO: 1208466 - RNA, 14 nt, Homo sapiens
uaaaauaaaugcaa

SEQ ID NO: 1208467 - RNA, 14 nt, Homo sapiens
uaaaauaagcacag

SEQ ID NO: 1208468 - RNA, 16 nt, Homo sapiens
uaaaauaaugaacacu

SEQ ID NO: 1208469 - RNA, 14 nt, Homo sapiens
uaaaauacugaaua

SEQ ID NO: 1208470 - RNA, 21 nt, Homo sapiens
uaaaauagaaauaagugguua

SEQ ID NO: 1208471 - RNA, 20 nt, Homo sapiens
uaaaauagacaacucuucca

SEQ ID NO: 1208472 - RNA, 14 nt, Homo sapiens
uaaaauauuacaca

SEQ ID NO: 1208473 - RNA, 19 nt, Homo sapiens
uaaaauauuccugcauuug

SEQ ID NO: 1208474 - RNA, 18 nt, Homo sapiens
uaaaauauuuaucugauu

SEQ ID NO: 1208475 - RNA, 22 nt, Homo sapiens
uaaaauauuuaucugauuaagu

SEQ ID NO: 1208476 - RNA, 12 nt, Homo sapiens
uaaaaucucaaa

SEQ ID NO: 1208477 - RNA, 13 nt, Homo sapiens
uaaaaucugugaa

SEQ ID NO: 1208478 - RNA, 20 nt, Homo sapiens
uaaaaugaaauuacuacaaa

SEQ ID NO: 1208479 - RNA, 16 nt, Homo sapiens
uaaaaugacuauuucu

SEQ ID NO: 1208480 - RNA, 22 nt, Homo sapiens
uaaaaugagaucguuguuuaca

SEQ ID NO: 1208481 - RNA, 15 nt, Homo sapiens
uaaaaugcauugaaa

SEQ ID NO: 1208482 - RNA, 16 nt, Homo sapiens
uaaaauggaagcaauu

SEQ ID NO: 1208483 - RNA, 19 nt, Homo sapiens
uaaaauggugauauccucu

SEQ ID NO: 1208484 - RNA, 17 nt, Homo sapiens
uaaaauguacucagcua

SEQ ID NO: 1208485 - RNA, 19 nt, Homo sapiens
uaaaauguacucagcuauc

SEQ ID NO: 1208486 - RNA, 19 nt, Homo sapiens
uaaaauguaugaccacugg

SEQ ID NO: 1208487 - RNA, 22 nt, Homo sapiens
uaaaauguuuguuaaagcuaga

SEQ ID NO: 1208488 - RNA, 18 nt, Homo sapiens
uaaaauuaaaaguuugaa

SEQ ID NO: 1208489 - RNA, 16 nt, Homo sapiens
uaaaauuaacuggugg

SEQ ID NO: 1208490 - RNA, 18 nt, Homo sapiens
uaaaauuagaaagcaacu

SEQ ID NO: 1208491 - RNA, 18 nt, Homo sapiens
uaaaauuaggacuguaua

SEQ ID NO: 1208492 - RNA, 16 nt, Homo sapiens
uaaaauucacuaauga

SEQ ID NO: 1208493 - RNA, 20 nt, Homo sapiens
uaaaauuccucuuacuguaa

SEQ ID NO: 1208494 - RNA, 21 nt, Homo sapiens
uaaaauucuauuauacuacaa

SEQ ID NO: 1208495 - RNA, 13 nt, Homo sapiens
uaaaauucuguca

SEQ ID NO: 1208496 - RNA, 23 nt, Homo sapiens
uaaaauugcuucuuuaccaagga

SEQ ID NO: 1208497 - RNA, 13 nt, Homo sapiens
uaaaauugugcau

SEQ ID NO: 1208498 - RNA, 20 nt, Homo sapiens
uaaaauuuaacuuuugagca

SEQ ID NO: 1208499 - RNA, 14 nt, Homo sapiens
uaaacaaaaagcca

SEQ ID NO: 1208500 - RNA, 17 nt, Homo sapiens
uaaacaaauaacaaugu

SEQ ID NO: 1208501 - RNA, 22 nt, Homo sapiens
uaaacaagaaucagucuaucca

SEQ ID NO: 1208502 - RNA, 18 nt, Homo sapiens
uaaacaagggucaauuca

SEQ ID NO: 1208503 - RNA, 21 nt, Homo sapiens
uaaacaccauagggacccauu

SEQ ID NO: 1208504 - RNA, 14 nt, Homo sapiens
uaaacagaugaaua

SEQ ID NO: 1208505 - RNA, 17 nt, Homo sapiens
uaaacagauggcacuuu

SEQ ID NO: 1208506 - RNA, 19 nt, Homo sapiens
uaaacagguguuugccuua

SEQ ID NO: 1208507 - RNA, 16 nt, Homo sapiens
uaaacauaugauuuca

SEQ ID NO: 1208508 - RNA, 22 nt, Homo sapiens
uaaacauuaauuuugugcauuc

SEQ ID NO: 1208509 - RNA, 17 nt, Homo sapiens
uaaacauugaaguaaug

SEQ ID NO: 1208510 - RNA, 17 nt, Homo sapiens
uaaacauuucauuuccc

SEQ ID NO: 1208511 - RNA, 19 nt, Homo sapiens
uaaacauuuugacacaaaa

SEQ ID NO: 1208512 - RNA, 22 nt, Homo sapiens
uaaacauuuuuagagaaguaaa

SEQ ID NO: 1208513 - RNA, 13 nt, Homo sapiens
uaaaccaaaaagg

SEQ ID NO: 1208514 - RNA, 22 nt, Homo sapiens
uaaaccaaaggacauuaugugu

SEQ ID NO: 1208515 - RNA, 21 nt, Homo sapiens
uaaaccaacucuaauauugcu

SEQ ID NO: 1208516 - RNA, 23 nt, Homo sapiens
uaaaccagguuuagacaguauga

SEQ ID NO: 1208517 - RNA, 19 nt, Homo sapiens
uaaaccgcaugugaucucc

SEQ ID NO: 1208518 - RNA, 20 nt, Homo sapiens
uaaaccugucuccacugugc

SEQ ID NO: 1208519 - RNA, 15 nt, Homo sapiens
uaaaccuuacaugug

SEQ ID NO: 1208520 - RNA, 20 nt, Homo sapiens
uaaaccuucagaagcuauuu

SEQ ID NO: 1208521 - RNA, 15 nt, Homo sapiens
uaaacgcaagcugag

SEQ ID NO: 1208522 - RNA, 13 nt, Homo sapiens
uaaacgggaacau

SEQ ID NO: 1208523 - RNA, 16 nt, Homo sapiens
uaaacgguuccuggug

SEQ ID NO: 1208524 - RNA, 23 nt, Homo sapiens
uaaacguuaaaaacaguuuucca

SEQ ID NO: 1208525 - RNA, 15 nt, Homo sapiens
uaaaguguuugccuc

SEQ ID NO: 1208526 - RNA, 14 nt, Homo sapiens
uaaaguugccuuua

SEQ ID NO: 1208527 - RNA, 13 nt, Homo sapiens
uaaaguuugcuaa

SEQ ID NO: 1208528 - RNA, 18 nt, Homo sapiens
uaaaguuuuaacuuuuau

SEQ ID NO: 1208529 - RNA, 16 nt, Homo sapiens
uaaaguuuuguacaaa

SEQ ID NO: 1208530 - RNA, 14 nt, Homo sapiens
uaaauaaaacugaa

SEQ ID NO: 1208531 - RNA, 15 nt, Homo sapiens
uaaauaaaacugaau

SEQ ID NO: 1208532 - RNA, 19 nt, Homo sapiens
uaaauaaaccucaaaaugu

SEQ ID NO: 1208533 - RNA, 15 nt, Homo sapiens
uaaauaaaucauuaa

SEQ ID NO: 1208534 - RNA, 17 nt, Homo sapiens
uaaauaagaucagacuc

SEQ ID NO: 1208535 - RNA, 19 nt, Homo sapiens
uaaauaagaucagacucug

SEQ ID NO: 1208536 - RNA, 21 nt, Homo sapiens
uaaauaagcccagugcugcug

SEQ ID NO: 1208537 - RNA, 20 nt, Homo sapiens
uaaauaaugaauaaacugaa

SEQ ID NO: 1208538 - RNA, 21 nt, Homo sapiens
uaaauaaugaauaaacugaau

SEQ ID NO: 1208539 - RNA, 12 nt, Homo sapiens
uaaauagcucag

SEQ ID NO: 1208540 - RNA, 16 nt, Homo sapiens
uaaauauacuaugaaa

SEQ ID NO: 1208541 - RNA, 19 nt, Homo sapiens
uaaauauacucaaguuuca

SEQ ID NO: 1208542 - RNA, 13 nt, Homo sapiens
uaaauaugcagug

SEQ ID NO: 1208543 - RNA, 17 nt, Homo sapiens
uaaauaugcagugauau

SEQ ID NO: 1208544 - RNA, 21 nt, Homo sapiens
uaaauaugccuaaaauacuua

SEQ ID NO: 1208545 - RNA, 19 nt, Homo sapiens
uaaaucaaugucacuuaaa

SEQ ID NO: 1208546 - RNA, 13 nt, Homo sapiens
uaaauccugccau

SEQ ID NO: 1208547 - RNA, 14 nt, Homo sapiens
uaaaucugugauga

SEQ ID NO: 1208548 - RNA, 21 nt, Homo sapiens
uaaaucuuucuuuugauucuu

SEQ ID NO: 1208549 - RNA, 23 nt, Homo sapiens
uaaaugaaauuguaaaaccuguc

SEQ ID NO: 1208550 - RNA, 11 nt, Homo sapiens
uaaaugaacuu

SEQ ID NO: 1208551 - RNA, 14 nt, Homo sapiens
uaaaugacaaugua

SEQ ID NO: 1208552 - RNA, 17 nt, Homo sapiens
uaaaugagcaaauauca

SEQ ID NO: 1208553 - RNA, 14 nt, Homo sapiens
uaaaugagcccaca

SEQ ID NO: 1208554 - RNA, 15 nt, Homo sapiens
uaaaugaucacucca

SEQ ID NO: 1208555 - RNA, 21 nt, Homo sapiens
uaaaugccuuuauauuucaca

SEQ ID NO: 1208556 - RNA, 12 nt, Homo sapiens
uaaaugcuuguu

SEQ ID NO: 1208557 - RNA, 22 nt, Homo sapiens
uaaaugggaaaucaguguuuua

SEQ ID NO: 1208558 - RNA, 22 nt, Homo sapiens
uaaaugguaguaaucacaguug

SEQ ID NO: 1208559 - RNA, 18 nt, Homo sapiens
uaaauggugcugcagauu

SEQ ID NO: 1208560 - RNA, 14 nt, Homo sapiens
uaaauguacauuaa

SEQ ID NO: 1208561 - RNA, 21 nt, Homo sapiens
uaaauguagcgacugucaaca

SEQ ID NO: 1208562 - RNA, 13 nt, Homo sapiens
uaaauguauauac

SEQ ID NO: 1208563 - RNA, 20 nt, Homo sapiens
uaaauguaucuuauucacau

SEQ ID NO: 1208564 - RNA, 22 nt, Homo sapiens
uaaaugugcaaaccuguucauc

SEQ ID NO: 1208565 - RNA, 15 nt, Homo sapiens
uaaauguucuaacag

SEQ ID NO: 1208566 - RNA, 13 nt, Homo sapiens
uaaauguuugaca

SEQ ID NO: 1208567 - RNA, 17 nt, Homo sapiens
uaaauuacaaaugcaau

SEQ ID NO: 1208568 - RNA, 14 nt, Homo sapiens
uaaauuaguauuua

SEQ ID NO: 1208569 - RNA, 16 nt, Homo sapiens
uaaauuauggcauuuu

SEQ ID NO: 1208570 - RNA, 14 nt, Homo sapiens
uaaauuauugcugu

SEQ ID NO: 1208571 - RNA, 16 nt, Homo sapiens
uaaauuauuuacugca

SEQ ID NO: 1208572 - RNA, 22 nt, Homo sapiens
uaaauuccacacuaccacauua

SEQ ID NO: 1208573 - RNA, 20 nt, Homo sapiens
uaaauucuauaggaacauau

SEQ ID NO: 1208574 - RNA, 11 nt, Homo sapiens
uaaauucugug

SEQ ID NO: 1208575 - RNA, 13 nt, Homo sapiens
uaaauugaacuaa

SEQ ID NO: 1208576 - RNA, 18 nt, Homo sapiens
uaaauugaacuucccaca

SEQ ID NO: 1208577 - RNA, 21 nt, Homo sapiens
uaaauuggaauuuucuuaccc

SEQ ID NO: 1208578 - RNA, 23 nt, Homo sapiens
uaaauugggaaaacuccaucaau

SEQ ID NO: 1208579 - RNA, 16 nt, Homo sapiens
uaaauugguacaguau

SEQ ID NO: 1208580 - RNA, 20 nt, Homo sapiens
uaaauuggugauaaguggaa

SEQ ID NO: 1208581 - RNA, 22 nt, Homo sapiens
uaaauuuaaagauauuguucaa

SEQ ID NO: 1208582 - RNA, 16 nt, Homo sapiens
uaaauuuaaugcugcc

SEQ ID NO: 1208583 - RNA, 17 nt, Homo sapiens
uaaauuuuacccuuuag

SEQ ID NO: 1208584 - RNA, 14 nt, Homo sapiens
uaaauuuuagcaag

SEQ ID NO: 1208585 - RNA, 21 nt, Homo sapiens
uaaauuuuauaacagaauuaa

SEQ ID NO: 1208586 - RNA, 20 nt, Homo sapiens
uaaauuuuuuauaaaagugu

SEQ ID NO: 1208587 - RNA, 15 nt, Homo sapiens
uaacaaaacacucgg

SEQ ID NO: 1208588 - RNA, 22 nt, Homo sapiens
uaacaaacaucacucugcugcu

SEQ ID NO: 1208589 - RNA, 18 nt, Homo sapiens
uaacaaauaaagugcagu

SEQ ID NO: 1208590 - RNA, 14 nt, Homo sapiens
uaacaaauguggcu

SEQ ID NO: 1208591 - RNA, 14 nt, Homo sapiens
uaacaacucuaguc

SEQ ID NO: 1208592 - RNA, 13 nt, Homo sapiens
uaacaacuuugaa

SEQ ID NO: 1208593 - RNA, 18 nt, Homo sapiens
uaacaagauuuguaauua

SEQ ID NO: 1208594 - RNA, 16 nt, Homo sapiens
uaacaauccauucaca

SEQ ID NO: 1208595 - RNA, 14 nt, Homo sapiens
uaacaauguuaagg

SEQ ID NO: 1208596 - RNA, 13 nt, Homo sapiens
uaacaauugugua

SEQ ID NO: 1208597 - RNA, 17 nt, Homo sapiens
uaacaauuuauucugau

SEQ ID NO: 1208598 - RNA, 22 nt, Homo sapiens
uaacacauagcgccgugcugua

SEQ ID NO: 1208599 - RNA, 23 nt, Homo sapiens
uaacacauagcgccgugcuguaa

SEQ ID NO: 1208600 - RNA, 21 nt, Homo sapiens
uaacacauuuuuuugcaugca

SEQ ID NO: 1208601 - RNA, 18 nt, Homo sapiens
uaacaccuucauccagau

SEQ ID NO: 1208602 - RNA, 15 nt, Homo sapiens
uaacacggugcucau

SEQ ID NO: 1208603 - RNA, 16 nt, Homo sapiens
uaacacggugcucauu

SEQ ID NO: 1208604 - RNA, 15 nt, Homo sapiens
uaacacucaugaagc

SEQ ID NO: 1208605 - RNA, 12 nt, Homo sapiens
uaacacuuguca

SEQ ID NO: 1208606 - RNA, 19 nt, Homo sapiens
ucaaaggccacauaccucu

SEQ ID NO: 1208607 - RNA, 20 nt, Homo sapiens
ucaaaguaaagaacacgaaa

SEQ ID NO: 1208608 - RNA, 17 nt, Homo sapiens
ucaaaguacuacagcaa

SEQ ID NO: 1208609 - RNA, 17 nt, Homo sapiens
ucaaagugacuauucag

SEQ ID NO: 1208610 - RNA, 13 nt, Homo sapiens
ucaaaguguaaca

SEQ ID NO: 1208611 - RNA, 14 nt, Homo sapiens
ucaaaguuaauuca

SEQ ID NO: 1208612 - RNA, 15 nt, Homo sapiens
ucaaauaaauuucug

SEQ ID NO: 1208613 - RNA, 18 nt, Homo sapiens
ucaaauacacauuugcua

SEQ ID NO: 1208614 - RNA, 21 nt, Homo sapiens
ucaaauacuuagagcagugaa

SEQ ID NO: 1208615 - RNA, 22 nt, Homo sapiens
ucaaauaggcuauuaaaaaagu

SEQ ID NO: 1208616 - RNA, 17 nt, Homo sapiens
ucaaauauuaccaaaaa

SEQ ID NO: 1208617 - RNA, 17 nt, Homo sapiens
ucaaaucuauucagaca

SEQ ID NO: 1208618 - RNA, 17 nt, Homo sapiens
ucaaaucuccugcugau

SEQ ID NO: 1208619 - RNA, 14 nt, Homo sapiens
ucaaaugcauuuug

SEQ ID NO: 1208620 - RNA, 23 nt, Homo sapiens
ucaaauguuagauauugcuacua

SEQ ID NO: 1208621 - RNA, 19 nt, Homo sapiens
ucaaauuaagcauaugugu

SEQ ID NO: 1208622 - RNA, 19 nt, Homo sapiens
ucaaauucuucugaacuca

SEQ ID NO: 1208623 - RNA, 21 nt, Homo sapiens
ucaaauuuuggcgaaucucaa

SEQ ID NO: 1208624 - RNA, 14 nt, Homo sapiens
ucaacaaaccacaa

SEQ ID NO: 1208625 - RNA, 23 nt, Homo sapiens
ucaacaagauuuccuugugcaaa

SEQ ID NO: 1208626 - RNA, 14 nt, Homo sapiens
ucaacaauuucaau

SEQ ID NO: 1208627 - RNA, 21 nt, Homo sapiens
ucaacacauauuuuuauauua

SEQ ID NO: 1208628 - RNA, 20 nt, Homo sapiens
ucaacagaaacuaaaugaac

SEQ ID NO: 1208629 - RNA, 22 nt, Homo sapiens
ucaacaucuuggucagauuuga

SEQ ID NO: 1208630 - RNA, 12 nt, Homo sapiens
ucaacauugcau

SEQ ID NO: 1208631 - RNA, 20 nt, Homo sapiens
ucaaccccuccccuccaucc

SEQ ID NO: 1208632 - RNA, 21 nt, Homo sapiens
ucaaccuccugggcuaaguga

SEQ ID NO: 1208633 - RNA, 19 nt, Homo sapiens
ucaaccucuucuggcucaa

SEQ ID NO: 1208634 - RNA, 22 nt, Homo sapiens
ucaaccugguggcaccagaugc

SEQ ID NO: 1208635 - RNA, 17 nt, Homo sapiens
ucaacugcccuaagucc

SEQ ID NO: 1208636 - RNA, 19 nt, Homo sapiens
ucaacuguuuuugucuaca

SEQ ID NO: 1208637 - RNA, 20 nt, Homo sapiens
ucaacuuucagaagugccac

SEQ ID NO: 1208638 - RNA, 17 nt, Homo sapiens
ucaacuuuucuaagaaa

SEQ ID NO: 1208639 - RNA, 14 nt, Homo sapiens
ucaagaaaauggau

SEQ ID NO: 1208640 - RNA, 20 nt, Homo sapiens
ucaagaaacagccagcaaga

SEQ ID NO: 1208641 - RNA, 13 nt, Homo sapiens
ucaagaagaggaa

SEQ ID NO: 1208642 - RNA, 21 nt, Homo sapiens
ucaagaagcguuaugugcagu

SEQ ID NO: 1208643 - RNA, 13 nt, Homo sapiens
ucaagacaaugca

SEQ ID NO: 1208644 - RNA, 17 nt, Homo sapiens
ucaagacuuagcuccug

SEQ ID NO: 1208645 - RNA, 23 nt, Homo sapiens
ucaagagaucuuucuuuccaaaa

SEQ ID NO: 1208646 - RNA, 15 nt, Homo sapiens
ucaagagcacacaga

SEQ ID NO: 1208647 - RNA, 16 nt, Homo sapiens
ucaagaggaccaaaug

SEQ ID NO: 1208648 - RNA, 22 nt, Homo sapiens
ucaagaggcgagaugagcccac

SEQ ID NO: 1208649 - RNA, 20 nt, Homo sapiens
ucaagaucucauccaagcaa

SEQ ID NO: 1208650 - RNA, 20 nt, Homo sapiens
ucaagauggggcgagccagg

SEQ ID NO: 1208651 - RNA, 23 nt, Homo sapiens
ucaagauucuacuuggugguuug

SEQ ID NO: 1208652 - RNA, 18 nt, Homo sapiens
ucaagcccuuuacuugac

SEQ ID NO: 1208653 - RNA, 17 nt, Homo sapiens
ucaagcgccagaaagag

SEQ ID NO: 1208654 - RNA, 18 nt, Homo sapiens
ucaaggaaaaaugcugcu

SEQ ID NO: 1208655 - RNA, 14 nt, Homo sapiens
ucaaggaauuugca

SEQ ID NO: 1208656 - RNA, 20 nt, Homo sapiens
ucaaggaguacaaugcccag

SEQ ID NO: 1208657 - RNA, 19 nt, Homo sapiens
ucaaggcuuccacugcaaa

SEQ ID NO: 1208658 - RNA, 17 nt, Homo sapiens
ucaagggcuuacuauuu

SEQ ID NO: 1208659 - RNA, 16 nt, Homo sapiens
ucaaguacaccagcca

SEQ ID NO: 1208660 - RNA, 16 nt, Homo sapiens
ucaaguaccaccaagg

SEQ ID NO: 1208661 - RNA, 16 nt, Homo sapiens
ucaaguagcugggacu

SEQ ID NO: 1208662 - RNA, 20 nt, Homo sapiens
ucaaguauaacaacuuugaa

SEQ ID NO: 1208663 - RNA, 23 nt, Homo sapiens
ucaagucuucccugaucaaguca

SEQ ID NO: 1208664 - RNA, 19 nt, Homo sapiens
ucaagugaggggcccuuug

SEQ ID NO: 1208665 - RNA, 21 nt, Homo sapiens
ucaagugaucugccgccucag

SEQ ID NO: 1208666 - RNA, 18 nt, Homo sapiens
ucaagugauucuccugcc

SEQ ID NO: 1208667 - RNA, 13 nt, Homo sapiens
ucaagugccaaac

SEQ ID NO: 1208668 - RNA, 12 nt, Homo sapiens
ucaaguggcaug

SEQ ID NO: 1208669 - RNA, 13 nt, Homo sapiens
ucaagugucuuag

SEQ ID NO: 1208670 - RNA, 18 nt, Homo sapiens
ucaagugucuuccaucau

SEQ ID NO: 1208671 - RNA, 16 nt, Homo sapiens
ucaaguugugcuuguu

SEQ ID NO: 1208672 - RNA, 21 nt, Homo sapiens
ucaaguuuuggguauguuuaa

SEQ ID NO: 1208673 - RNA, 22 nt, Homo sapiens
ucaauaaacagcuucaugccuu

SEQ ID NO: 1208674 - RNA, 15 nt, Homo sapiens
ucaauacaaccagcc

SEQ ID NO: 1208675 - RNA, 15 nt, Homo sapiens
ucaauagaucuccag

SEQ ID NO: 1208676 - RNA, 12 nt, Homo sapiens
ucaauagcuguc

SEQ ID NO: 1208677 - RNA, 18 nt, Homo sapiens
ucaauaugcaagcagcuu

SEQ ID NO: 1208678 - RNA, 17 nt, Homo sapiens
ucaauauuaaauacaga

SEQ ID NO: 1208679 - RNA, 21 nt, Homo sapiens
ucaauauuuuuauaucaugca

SEQ ID NO: 1208680 - RNA, 16 nt, Homo sapiens
ucaaucaacuuuacug

SEQ ID NO: 1208681 - RNA, 11 nt, Homo sapiens
ucaaucacugu

SEQ ID NO: 1208682 - RNA, 13 nt, Homo sapiens
ucaaucacugucc

SEQ ID NO: 1208683 - RNA, 21 nt, Homo sapiens
ucaaucccuagggcuggcaga

SEQ ID NO: 1208684 - RNA, 22 nt, Homo sapiens
ucaaucugcaguuuaacaaaau

SEQ ID NO: 1208685 - RNA, 24 nt, Homo sapiens
ucaaugaagccagcucacagugcu

SEQ ID NO: 1208686 - RNA, 12 nt, Homo sapiens
ucaaugccagua

SEQ ID NO: 1208687 - RNA, 23 nt, Homo sapiens
ucaaugccucacgagauuugcca

SEQ ID NO: 1208688 - RNA, 18 nt, Homo sapiens
ucaaugggcucuuccaac

SEQ ID NO: 1208689 - RNA, 15 nt, Homo sapiens
ucaaugucacuuaaa

SEQ ID NO: 1208690 - RNA, 22 nt, Homo sapiens
ucaaugugacaccuaacucuuu

SEQ ID NO: 1208691 - RNA, 20 nt, Homo sapiens
ucaauguuuguucauuacuu

SEQ ID NO: 1208692 - RNA, 12 nt, Homo sapiens
ucaauuuacuua

SEQ ID NO: 1208693 - RNA, 15 nt, Homo sapiens
ucaauuuccugaugc

SEQ ID NO: 1208694 - RNA, 22 nt, Homo sapiens
ucaauuuuaucccucaccugua

SEQ ID NO: 1208695 - RNA, 14 nt, Homo sapiens
ucacaaaaauuuga

SEQ ID NO: 1208696 - RNA, 23 nt, Homo sapiens
ucacuugccaaaauccaaggcaa

SEQ ID NO: 1208697 - RNA, 12 nt, Homo sapiens
ucacuugccuua

SEQ ID NO: 1208698 - RNA, 13 nt, Homo sapiens
ucacuuguacaaa

SEQ ID NO: 1208699 - RNA, 20 nt, Homo sapiens
ucacuuuacaaauucaagcc

SEQ ID NO: 1208700 - RNA, 16 nt, Homo sapiens
ucacuuuagaugcuga

SEQ ID NO: 1208701 - RNA, 19 nt, Homo sapiens
ucacuuucucaguuuucau

SEQ ID NO: 1208702 - RNA, 23 nt, Homo sapiens
ucacuuugcucucaauuaaaguc

SEQ ID NO: 1208703 - RNA, 17 nt, Homo sapiens
ucacuuuggccucccaa

SEQ ID NO: 1208704 - RNA, 17 nt, Homo sapiens
ucacuuuuacuacccca

SEQ ID NO: 1208705 - RNA, 14 nt, Homo sapiens
ucacuuuucagaag

SEQ ID NO: 1208706 - RNA, 16 nt, Homo sapiens
ucagaaaagugacagu

SEQ ID NO: 1208707 - RNA, 12 nt, Homo sapiens
ucagaaaccaaa

SEQ ID NO: 1208708 - RNA, 16 nt, Homo sapiens
ucagaaacgaaaucua

SEQ ID NO: 1208709 - RNA, 17 nt, Homo sapiens
ucagaacaagcaauugu

SEQ ID NO: 1208710 - RNA, 13 nt, Homo sapiens
ucagaacaugaaa

SEQ ID NO: 1208711 - RNA, 19 nt, Homo sapiens
ucagaacauguuaagauaa

SEQ ID NO: 1208712 - RNA, 24 nt, Homo sapiens
ucagaaccugcuccuggaguacac

SEQ ID NO: 1208713 - RNA, 13 nt, Homo sapiens
ucagaacuaacca

SEQ ID NO: 1208714 - RNA, 13 nt, Homo sapiens
ucagaacugaaau

SEQ ID NO: 1208715 - RNA, 13 nt, Homo sapiens
ucagaacugcccu

SEQ ID NO: 1208716 - RNA, 14 nt, Homo sapiens
ucagaacuuugaga

SEQ ID NO: 1208717 - RNA, 22 nt, Homo sapiens
ucagaagaaagaaucuuuccau

SEQ ID NO: 1208718 - RNA, 18 nt, Homo sapiens
ucagaagucaucuugcua

SEQ ID NO: 1208719 - RNA, 19 nt, Homo sapiens
ucagaaguuucucagcucc

SEQ ID NO: 1208720 - RNA, 15 nt, Homo sapiens
ucagaauagccacau

SEQ ID NO: 1208721 - RNA, 21 nt, Homo sapiens
ucagaauauugucugccuuaa

SEQ ID NO: 1208722 - RNA, 22 nt, Homo sapiens
ucagaaucauugaaguauuuuc

SEQ ID NO: 1208723 - RNA, 15 nt, Homo sapiens
ucagacaagcugcau

SEQ ID NO: 1208724 - RNA, 22 nt, Homo sapiens
ucagacacugccgacaucagca

SEQ ID NO: 1208725 - RNA, 16 nt, Homo sapiens
ucagacauaaagccau

SEQ ID NO: 1208726 - RNA, 16 nt, Homo sapiens
ucagagaacuuuccca

SEQ ID NO: 1208727 - RNA, 21 nt, Homo sapiens
ucagagaaggugcaggugaca

SEQ ID NO: 1208728 - RNA, 20 nt, Homo sapiens
ucagagacuauguagcaaua

SEQ ID NO: 1208729 - RNA, 14 nt, Homo sapiens
ucagagaugaacau

SEQ ID NO: 1208730 - RNA, 14 nt, Homo sapiens
ucagagcacagcag

SEQ ID NO: 1208731 - RNA, 13 nt, Homo sapiens
ucagagcacuccc

SEQ ID NO: 1208732 - RNA, 17 nt, Homo sapiens
ucaucaccccaaaagca

SEQ ID NO: 1208733 - RNA, 12 nt, Homo sapiens
ucaucacuggau

SEQ ID NO: 1208734 - RNA, 20 nt, Homo sapiens
ucaucaggagcuagagccau

SEQ ID NO: 1208735 - RNA, 14 nt, Homo sapiens
ucaucaggugcaua

SEQ ID NO: 1208736 - RNA, 18 nt, Homo sapiens
ucaucaggugcauagcaa

SEQ ID NO: 1208737 - RNA, 23 nt, Homo sapiens
ucaucaggugcauagcaagugaa

SEQ ID NO: 1208738 - RNA, 22 nt, Homo sapiens
ucaucaguccauugcucuugag

SEQ ID NO: 1208739 - RNA, 12 nt, Homo sapiens
ucaucauucccu

SEQ ID NO: 1208740 - RNA, 17 nt, Homo sapiens
ucaucauugugcuagcu

SEQ ID NO: 1208741 - RNA, 16 nt, Homo sapiens
ucauccacugugccau

SEQ ID NO: 1208742 - RNA, 19 nt, Homo sapiens
ucaucccuuuccaguuaag

SEQ ID NO: 1208743 - RNA, 19 nt, Homo sapiens
ucauccuaaaaaguuccau

SEQ ID NO: 1208744 - RNA, 15 nt, Homo sapiens
ucauccucaugcugc

SEQ ID NO: 1208745 - RNA, 12 nt, Homo sapiens
ucauccuggcac

SEQ ID NO: 1208746 - RNA, 15 nt, Homo sapiens
ucauccuuaccgcac

SEQ ID NO: 1208747 - RNA, 21 nt, Homo sapiens
ucaucuccgggguggccacag

SEQ ID NO: 1208748 - RNA, 19 nt, Homo sapiens
ucaucugggacaaaacugg

SEQ ID NO: 1208749 - RNA, 23 nt, Homo sapiens
ucaucuguagauacuagcuaucu

SEQ ID NO: 1208750 - RNA, 20 nt, Homo sapiens
ucaucugucauuauauucua

SEQ ID NO: 1208751 - RNA, 18 nt, Homo sapiens
ucaucuguggagcugcca

SEQ ID NO: 1208752 - RNA, 13 nt, Homo sapiens
ucaucuucuggaa

SEQ ID NO: 1208753 - RNA, 19 nt, Homo sapiens
ucaucuuugccaccaccug

SEQ ID NO: 1208754 - RNA, 16 nt, Homo sapiens
ucaugaaaacacacau

SEQ ID NO: 1208755 - RNA, 20 nt, Homo sapiens
ucaugaagcccaaccugcag

SEQ ID NO: 1208756 - RNA, 20 nt, Homo sapiens
ucaugagcuugaacaaggac

SEQ ID NO: 1208757 - RNA, 19 nt, Homo sapiens
ucaugagcuuggacagcaa

SEQ ID NO: 1208758 - RNA, 17 nt, Homo sapiens
ucaugagugcaacugug

SEQ ID NO: 1208759 - RNA, 17 nt, Homo sapiens
ucaugauccaacuaaug

SEQ ID NO: 1208760 - RNA, 22 nt, Homo sapiens
ucaugcccccuuucagaugucu

SEQ ID NO: 1208761 - RNA, 17 nt, Homo sapiens
ucaugccuguaaucuca

SEQ ID NO: 1208762 - RNA, 23 nt, Homo sapiens
ucaugcuguugcugcuacugucu

SEQ ID NO: 1208763 - RNA, 22 nt, Homo sapiens
ucaugggacuaaaugaacuaau

SEQ ID NO: 1208764 - RNA, 19 nt, Homo sapiens
ucauggugauagacugaag

SEQ ID NO: 1208765 - RNA, 20 nt, Homo sapiens
ucaugguuacaaacuacaga

SEQ ID NO: 1208766 - RNA, 22 nt, Homo sapiens
ucauguaugaugagcauacaca

SEQ ID NO: 1208767 - RNA, 23 nt, Homo sapiens
ucaugucagcuuauaugugacac

SEQ ID NO: 1208768 - RNA, 14 nt, Homo sapiens
ucauguuccucaaa

SEQ ID NO: 1208769 - RNA, 17 nt, Homo sapiens
ucauguuccuggcguga

SEQ ID NO: 1208770 - RNA, 19 nt, Homo sapiens
ucauguuugcuucauaaau

SEQ ID NO: 1208771 - RNA, 15 nt, Homo sapiens
ucauuaaauguuuga

SEQ ID NO: 1208772 - RNA, 12 nt, Homo sapiens
ucauuaccaaua

SEQ ID NO: 1208773 - RNA, 18 nt, Homo sapiens
ucauucaacucuccaaug

SEQ ID NO: 1208774 - RNA, 21 nt, Homo sapiens
ucauucacagggacauggaaa

SEQ ID NO: 1208775 - RNA, 13 nt, Homo sapiens
ucauucauggcua

SEQ ID NO: 1208776 - RNA, 14 nt, Homo sapiens
ucauucauucacuc

SEQ ID NO: 1208777 - RNA, 13 nt, Homo sapiens
ucauucauuucau

SEQ ID NO: 1208778 - RNA, 22 nt, Homo sapiens
ucauuccaaucuauugcuucac

SEQ ID NO: 1208779 - RNA, 16 nt, Homo sapiens
ucauuccaccuuccca

SEQ ID NO: 1208780 - RNA, 17 nt, Homo sapiens
ucauuccaccuucccau

SEQ ID NO: 1208781 - RNA, 19 nt, Homo sapiens
ucauucccuagaucuuucu

SEQ ID NO: 1208782 - RNA, 22 nt, Homo sapiens
ucauuccugaaagaaacaguua

SEQ ID NO: 1208783 - RNA, 12 nt, Homo sapiens
ucauucuuuauu

SEQ ID NO: 1208784 - RNA, 14 nt, Homo sapiens
ucauucuuugcagu

SEQ ID NO: 1208785 - RNA, 15 nt, Homo sapiens
ucauugaaguauuuu

SEQ ID NO: 1208786 - RNA, 21 nt, Homo sapiens
ucauugcuaaacugaugacuu

SEQ ID NO: 1208787 - RNA, 17 nt, Homo sapiens
ucauugcugagccucug

SEQ ID NO: 1208788 - RNA, 22 nt, Homo sapiens
ucauuggaccuguucaaaaagg

SEQ ID NO: 1208789 - RNA, 20 nt, Homo sapiens
ucauuguauuuuuaacacca

SEQ ID NO: 1208790 - RNA, 20 nt, Homo sapiens
ucauuguuuauuaacaaauu

SEQ ID NO: 1208791 - RNA, 21 nt, Homo sapiens
ucauuguuuauuguauacugc

SEQ ID NO: 1208792 - RNA, 21 nt, Homo sapiens
ucauuuaagggaguuacaucu

SEQ ID NO: 1208793 - RNA, 16 nt, Homo sapiens
ucauuuauucaaguau

SEQ ID NO: 1208794 - RNA, 15 nt, Homo sapiens
ucauuuauugagcac

SEQ ID NO: 1208795 - RNA, 16 nt, Homo sapiens
ucauuucacacaguga

SEQ ID NO: 1208796 - RNA, 23 nt, Homo sapiens
ucauuucauuguaugauguguug

SEQ ID NO: 1208797 - RNA, 21 nt, Homo sapiens
ucauuucucaaaaaccacagu

SEQ ID NO: 1208798 - RNA, 15 nt, Homo sapiens
ucauuucuugugaug

SEQ ID NO: 1208799 - RNA, 12 nt, Homo sapiens
ucauuugaacaa

SEQ ID NO: 1208800 - RNA, 23 nt, Homo sapiens
ucauuuggaaugaauacagcauu

SEQ ID NO: 1208801 - RNA, 16 nt, Homo sapiens
ucauuugugugcucau

SEQ ID NO: 1208802 - RNA, 23 nt, Homo sapiens
ucauuuuaacuuuaucacauuau

SEQ ID NO: 1208803 - RNA, 14 nt, Homo sapiens
ucauuuuauugcua

SEQ ID NO: 1208804 - RNA, 14 nt, Homo sapiens
ucauuuuguugcuu

SEQ ID NO: 1208805 - RNA, 23 nt, Homo sapiens
ucauuuuugguaggcuuaucaaa

SEQ ID NO: 1208806 - RNA, 23 nt, Homo sapiens
ucauuuuuuucacuggaguuaca

SEQ ID NO: 1208807 - RNA, 20 nt, Homo sapiens
uccaaaaauagcccugcaaa

SEQ ID NO: 1208808 - RNA, 21 nt, Homo sapiens
uccaaaaauagcccugcaaaa

SEQ ID NO: 1208809 - RNA, 14 nt, Homo sapiens
uccaaaagcacuua

SEQ ID NO: 1208810 - RNA, 22 nt, Homo sapiens
uccaaaagcacuuacggauucu

SEQ ID NO: 1208811 - RNA, 12 nt, Homo sapiens
uccaaaccagac

SEQ ID NO: 1208812 - RNA, 12 nt, Homo sapiens
uccaaaccucca

SEQ ID NO: 1208813 - RNA, 20 nt, Homo sapiens
uccaaagaguuucugcaaag

SEQ ID NO: 1208814 - RNA, 11 nt, Homo sapiens
uccaaauaaca

SEQ ID NO: 1208815 - RNA, 14 nt, Homo sapiens
uccaaauaacauca

SEQ ID NO: 1208816 - RNA, 17 nt, Homo sapiens
uccaaauucaguuucau

SEQ ID NO: 1208817 - RNA, 19 nt, Homo sapiens
uccaacaacgacacauuca

SEQ ID NO: 1208818 - RNA, 16 nt, Homo sapiens
uccaacacugcugcuc

SEQ ID NO: 1208819 - RNA, 19 nt, Homo sapiens
uccaacacuuugagcauuu

SEQ ID NO: 1208820 - RNA, 19 nt, Homo sapiens
uccaacagcucaagucuuc

SEQ ID NO: 1208821 - RNA, 19 nt, Homo sapiens
uccaacagugagucuguca

SEQ ID NO: 1208822 - RNA, 20 nt, Homo sapiens
uccaacauuucucacugaaa

SEQ ID NO: 1208823 - RNA, 15 nt, Homo sapiens
uccaacccacuggcc

SEQ ID NO: 1208824 - RNA, 19 nt, Homo sapiens
uccaaccccccaccugcca

SEQ ID NO: 1208825 - RNA, 21 nt, Homo sapiens
uccaaccccccaccugccauu

SEQ ID NO: 1208826 - RNA, 22 nt, Homo sapiens
uccaaccuuuggaagucaugag

SEQ ID NO: 1208827 - RNA, 17 nt, Homo sapiens
ucuugcucuaucucuca

SEQ ID NO: 1208828 - RNA, 18 nt, Homo sapiens
ucuugcugcuagaacuuu

SEQ ID NO: 1208829 - RNA, 18 nt, Homo sapiens
ucuugcuggcucugagaa

SEQ ID NO: 1208830 - RNA, 16 nt, Homo sapiens
ucuugcuuauucacug

SEQ ID NO: 1208831 - RNA, 18 nt, Homo sapiens
ucuuggaaaaaaaccaca

SEQ ID NO: 1208832 - RNA, 20 nt, Homo sapiens
ucuuggaaaaaaaccacagc

SEQ ID NO: 1208833 - RNA, 13 nt, Homo sapiens
ucuuggacacugu

SEQ ID NO: 1208834 - RNA, 13 nt, Homo sapiens
ucuuggcaaaagc

SEQ ID NO: 1208835 - RNA, 17 nt, Homo sapiens
ucuuggcaauuccucuu

SEQ ID NO: 1208836 - RNA, 21 nt, Homo sapiens
ucuugggccccagaccccagg

SEQ ID NO: 1208837 - RNA, 20 nt, Homo sapiens
ucuugggcuacuggcagcuc

SEQ ID NO: 1208838 - RNA, 15 nt, Homo sapiens
ucuuggggaagauac

SEQ ID NO: 1208839 - RNA, 19 nt, Homo sapiens
ucuugggucccccacguga

SEQ ID NO: 1208840 - RNA, 16 nt, Homo sapiens
ucuuggugcucugugu

SEQ ID NO: 1208841 - RNA, 17 nt, Homo sapiens
ucuuguauacacauaua

SEQ ID NO: 1208842 - RNA, 20 nt, Homo sapiens
ucuuguggucaucauggcca

SEQ ID NO: 1208843 - RNA, 14 nt, Homo sapiens
ucuuguggugcauu

SEQ ID NO: 1208844 - RNA, 20 nt, Homo sapiens
ucuuguucauaagauuauga

SEQ ID NO: 1208845 - RNA, 14 nt, Homo sapiens
ucuuguucugugau

SEQ ID NO: 1208846 - RNA, 15 nt, Homo sapiens
ucuuguuucccagau

SEQ ID NO: 1208847 - RNA, 22 nt, Homo sapiens
ucuuguuuuuuuuuuccacuua

SEQ ID NO: 1208848 - RNA, 15 nt, Homo sapiens
ucuuuaaaauucacu

SEQ ID NO: 1208849 - RNA, 18 nt, Homo sapiens
ucuuuaaaggcaucuaca

SEQ ID NO: 1208850 - RNA, 15 nt, Homo sapiens
ucuuuaacaaccucu

SEQ ID NO: 1208851 - RNA, 18 nt, Homo sapiens
ucuuuaaguuuugauuaa

SEQ ID NO: 1208852 - RNA, 12 nt, Homo sapiens
uaugaaugcagu

SEQ ID NO: 1208853 - RNA, 23 nt, Homo sapiens
uaugaauggguggaaagguguga

SEQ ID NO: 1208854 - RNA, 16 nt, Homo sapiens
uaugacaagcuuucca

SEQ ID NO: 1208855 - RNA, 14 nt, Homo sapiens
uaugacugauuacu

SEQ ID NO: 1208856 - RNA, 17 nt, Homo sapiens
uaugagaaaguucucau

SEQ ID NO: 1208857 - RNA, 22 nt, Homo sapiens
uaugagccaggcaucauacuaa

SEQ ID NO: 1208858 - RNA, 12 nt, Homo sapiens
uaugagggaaaa

SEQ ID NO: 1208859 - RNA, 18 nt, Homo sapiens
uaugaguaauacaucaaa

SEQ ID NO: 1208860 - RNA, 21 nt, Homo sapiens
uaugagucggauacccuggag

SEQ ID NO: 1208861 - RNA, 21 nt, Homo sapiens
uaugaguggcuucugggagau

SEQ ID NO: 1208862 - RNA, 23 nt, Homo sapiens
uaugaguuuuugauagcuuuauu

SEQ ID NO: 1208863 - RNA, 17 nt, Homo sapiens
uaugauaaauauaacau

SEQ ID NO: 1208864 - RNA, 20 nt, Homo sapiens
uaugauaaauauaacaucua

SEQ ID NO: 1208865 - RNA, 16 nt, Homo sapiens
uaugauauauugcugu

SEQ ID NO: 1208866 - RNA, 17 nt, Homo sapiens
uaugaugagcauacaca

SEQ ID NO: 1208867 - RNA, 20 nt, Homo sapiens
uaugaugagcauacacacag

SEQ ID NO: 1208868 - RNA, 22 nt, Homo sapiens
uaugaugaugaaaauuuuacca

SEQ ID NO: 1208869 - RNA, 21 nt, Homo sapiens
uaugauuauuaacgaugucca

SEQ ID NO: 1208870 - RNA, 18 nt, Homo sapiens
uaugauucagauuguuau

SEQ ID NO: 1208871 - RNA, 18 nt, Homo sapiens
uaugcaaaccucaucuuu

SEQ ID NO: 1208872 - RNA, 14 nt, Homo sapiens
uaugcaaaugccuc

SEQ ID NO: 1208873 - RNA, 14 nt, Homo sapiens
uaugcacauaugga

SEQ ID NO: 1208874 - RNA, 21 nt, Homo sapiens
uaugcagaauuugauucguau

SEQ ID NO: 1208875 - RNA, 21 nt, Homo sapiens
uaugcaguaaauuaucuuggg

SEQ ID NO: 1208876 - RNA, 22 nt, Homo sapiens
uaugcaguaaauuaucuuggga

SEQ ID NO: 1208877 - RNA, 12 nt, Homo sapiens
uaugcagugaua

SEQ ID NO: 1208878 - RNA, 21 nt, Homo sapiens
uaugccauugggguaguugug

SEQ ID NO: 1208879 - RNA, 21 nt, Homo sapiens
uaugccucagucuauucugua

SEQ ID NO: 1208880 - RNA, 19 nt, Homo sapiens
uaugccugacuaauuuugu

SEQ ID NO: 1208881 - RNA, 14 nt, Homo sapiens
uaugccuucacuuu

SEQ ID NO: 1208882 - RNA, 20 nt, Homo sapiens
uaugccuuuaaaucugugau

SEQ ID NO: 1208883 - RNA, 17 nt, Homo sapiens
uaugcgcaauguggcau

SEQ ID NO: 1208884 - RNA, 21 nt, Homo sapiens
uaugcuauuuauuaaguauuu

SEQ ID NO: 1208885 - RNA, 22 nt, Homo sapiens
uaugcucagggucaauuucuuu

SEQ ID NO: 1208886 - RNA, 20 nt, Homo sapiens
uaugcucauugaacuuuaag

SEQ ID NO: 1208887 - RNA, 22 nt, Homo sapiens
uaugcuggacucuggaccauau

SEQ ID NO: 1208888 - RNA, 19 nt, Homo sapiens
uaugcuuggcuaacuauau

SEQ ID NO: 1208889 - RNA, 15 nt, Homo sapiens
uauggaaaaaaccaa

SEQ ID NO: 1208890 - RNA, 18 nt, Homo sapiens
uauggaaccuucccucca

SEQ ID NO: 1208891 - RNA, 19 nt, Homo sapiens
uauggaauuccagugccag

SEQ ID NO: 1208892 - RNA, 23 nt, Homo sapiens
uauggauucagaauauacuaaau

SEQ ID NO: 1208893 - RNA, 13 nt, Homo sapiens
uauggcacuggca

SEQ ID NO: 1208894 - RNA, 16 nt, Homo sapiens
uauggcuagacaggaa

SEQ ID NO: 1208895 - RNA, 21 nt, Homo sapiens
uauggcugaauaauauugcau

SEQ ID NO: 1208896 - RNA, 21 nt, Homo sapiens
uauggcuuuucacaugggcuu

SEQ ID NO: 1208897 - RNA, 16 nt, Homo sapiens
uaugggaucugauaag

SEQ ID NO: 1208898 - RNA, 20 nt, Homo sapiens
uaugggggcacugaggacca

SEQ ID NO: 1208899 - RNA, 16 nt, Homo sapiens
uauggguugcauuugg

SEQ ID NO: 1208900 - RNA, 16 nt, Homo sapiens
uauggugaacccacaa

SEQ ID NO: 1208901 - RNA, 12 nt, Homo sapiens
uauggugcucag

SEQ ID NO: 1208902 - RNA, 18 nt, Homo sapiens
uauggugcucagcccuga

SEQ ID NO: 1208903 - RNA, 15 nt, Homo sapiens
uaugguugacacuag

SEQ ID NO: 1208904 - RNA, 13 nt, Homo sapiens
uauguaaaccaca

SEQ ID NO: 1208905 - RNA, 16 nt, Homo sapiens
uauguaaaguauguaa

SEQ ID NO: 1208906 - RNA, 14 nt, Homo sapiens
uauguaaucucacc

SEQ ID NO: 1208907 - RNA, 16 nt, Homo sapiens
uauguacaauuguggg

SEQ ID NO: 1208908 - RNA, 13 nt, Homo sapiens
uauguacugccuu

SEQ ID NO: 1208909 - RNA, 15 nt, Homo sapiens
uauguacugccuuag

SEQ ID NO: 1208910 - RNA, 12 nt, Homo sapiens
uauguacuucag

SEQ ID NO: 1208911 - RNA, 21 nt, Homo sapiens
uauguagaauauauuuccuua

SEQ ID NO: 1208912 - RNA, 15 nt, Homo sapiens
uauguagauauuugg

SEQ ID NO: 1208913 - RNA, 23 nt, Homo sapiens
uauguaguaauugacaugugcca

SEQ ID NO: 1208914 - RNA, 12 nt, Homo sapiens
uauguaguauua

SEQ ID NO: 1208915 - RNA, 13 nt, Homo sapiens
uauguauauauac

SEQ ID NO: 1208916 - RNA, 14 nt, Homo sapiens
uauguauaucauuc

SEQ ID NO: 1208917 - RNA, 13 nt, Homo sapiens
uauguauuacaaa

SEQ ID NO: 1208918 - RNA, 13 nt, Homo sapiens
uauguauucacag

SEQ ID NO: 1208919 - RNA, 16 nt, Homo sapiens
uauguauuugcaguuc

SEQ ID NO: 1208920 - RNA, 16 nt, Homo sapiens
uaugucagcaguauug

SEQ ID NO: 1208921 - RNA, 16 nt, Homo sapiens
uaugucaguuugcagu

SEQ ID NO: 1208922 - RNA, 20 nt, Homo sapiens
uauguccgcagaauggacuu

SEQ ID NO: 1208923 - RNA, 16 nt, Homo sapiens
uaugucgaugcacagu

SEQ ID NO: 1208924 - RNA, 14 nt, Homo sapiens
uaugucguaaguca

SEQ ID NO: 1208925 - RNA, 21 nt, Homo sapiens
uaugugaucaauuuugacuua

SEQ ID NO: 1208926 - RNA, 20 nt, Homo sapiens
uaugugaucauguguggaag

SEQ ID NO: 1208927 - RNA, 16 nt, Homo sapiens
uaugugcacugauaug

SEQ ID NO: 1208928 - RNA, 20 nt, Homo sapiens
uaugugcacugucacuuugc

SEQ ID NO: 1208929 - RNA, 15 nt, Homo sapiens
uaugugggauauuga

SEQ ID NO: 1208930 - RNA, 15 nt, Homo sapiens
uauguguaugugcca

SEQ ID NO: 1208931 - RNA, 20 nt, Homo sapiens
uauguguggaugaugcugcc

SEQ ID NO: 1208932 - RNA, 13 nt, Homo sapiens
uauguguguauau

SEQ ID NO: 1208933 - RNA, 17 nt, Homo sapiens
uauguuauacaaggcaa

SEQ ID NO: 1208934 - RNA, 22 nt, Homo sapiens
uauuaaaauaagcacugugcua

SEQ ID NO: 1208935 - RNA, 23 nt, Homo sapiens
uauuaaagugcuaagguucuaag

SEQ ID NO: 1208936 - RNA, 14 nt, Homo sapiens
uauuaaaugcauca

SEQ ID NO: 1208937 - RNA, 23 nt, Homo sapiens
uauuaaauugggaaaacuccauc

SEQ ID NO: 1208938 - RNA, 20 nt, Homo sapiens
uauuaagauacuuagauuag

SEQ ID NO: 1208939 - RNA, 15 nt, Homo sapiens
uauuaagauuuccaa

SEQ ID NO: 1208940 - RNA, 17 nt, Homo sapiens
uauuaauaaagcauucu

SEQ ID NO: 1208941 - RNA, 18 nt, Homo sapiens
ugaaagauuccacagaga

SEQ ID NO: 1208942 - RNA, 16 nt, Homo sapiens
ugaaagcaaguguuca

SEQ ID NO: 1208943 - RNA, 22 nt, Homo sapiens
ugaaaggaagcuccacugucac

SEQ ID NO: 1208944 - RNA, 23 nt, Homo sapiens
ugaaaggaagcuccacugucacc

SEQ ID NO: 1208945 - RNA, 14 nt, Homo sapiens
ugaaaggaugaucc

SEQ ID NO: 1208946 - RNA, 13 nt, Homo sapiens
ugaaaguggacaa

SEQ ID NO: 1208947 - RNA, 19 nt, Homo sapiens
ugaaauaaaacuacauggu

SEQ ID NO: 1208948 - RNA, 21 nt, Homo sapiens
ugaaauaaacacuggugccaa

SEQ ID NO: 1208949 - RNA, 18 nt, Homo sapiens
ugaaauaagaaagugcga

SEQ ID NO: 1208950 - RNA, 19 nt, Homo sapiens
ugaaauaauuaaaaaccac

SEQ ID NO: 1208951 - RNA, 13 nt, Homo sapiens
ugaaauacuaaaa

SEQ ID NO: 1208952 - RNA, 20 nt, Homo sapiens
ugaaauauaguaaacacuug

SEQ ID NO: 1208953 - RNA, 12 nt, Homo sapiens
ugaaauaugcau

SEQ ID NO: 1208954 - RNA, 23 nt, Homo sapiens
ugaaauauuuagaagugcuaauu

SEQ ID NO: 1208955 - RNA, 20 nt, Homo sapiens
ugaaaucgccguguuacugu

SEQ ID NO: 1208956 - RNA, 22 nt, Homo sapiens
ugaaaugaauguaaucuaauag

SEQ ID NO: 1208957 - RNA, 16 nt, Homo sapiens
ugaaaugcuggcauuu

SEQ ID NO: 1208958 - RNA, 16 nt, Homo sapiens
ugaaauggauacuaca

SEQ ID NO: 1208959 - RNA, 15 nt, Homo sapiens
ugaaauggccaggau

SEQ ID NO: 1208960 - RNA, 17 nt, Homo sapiens
ugaaauguaugugcucu

SEQ ID NO: 1208961 - RNA, 23 nt, Homo sapiens
ugaaauguaugugcucuuagcaa

SEQ ID NO: 1208962 - RNA, 20 nt, Homo sapiens
ugaaaugugcucaggcccug

SEQ ID NO: 1208963 - RNA, 18 nt, Homo sapiens
ugaaauguucaagucaug

SEQ ID NO: 1208964 - RNA, 19 nt, Homo sapiens
gcucccagacggucaggaa

SEQ ID NO: 1208965 - RNA, 20 nt, Homo sapiens
gcuccccacaccuuccaggg

SEQ ID NO: 1208966 - RNA, 20 nt, Homo sapiens
gcuccccuccucggcuuccu

SEQ ID NO: 1208967 - RNA, 13 nt, Homo sapiens
gcucccuagccag

SEQ ID NO: 1208968 - RNA, 16 nt, Homo sapiens
gcucccugaagccagc

SEQ ID NO: 1208969 - RNA, 17 nt, Homo sapiens
gcucccuuuuaagccag

SEQ ID NO: 1208970 - RNA, 18 nt, Homo sapiens
gcucccuuuuaagccagg

SEQ ID NO: 1208971 - RNA, 22 nt, Homo sapiens
gcuccgggcaaauggcugagau

SEQ ID NO: 1208972 - RNA, 18 nt, Homo sapiens
gcuccuaguuugaccuca

SEQ ID NO: 1208973 - RNA, 15 nt, Homo sapiens
gcuccugaggggcau

SEQ ID NO: 1208974 - RNA, 19 nt, Homo sapiens
gcuccuuggcuuaccugac

SEQ ID NO: 1208975 - RNA, 20 nt, Homo sapiens
gcuccuuuauuauaaucaaa

SEQ ID NO: 1208976 - RNA, 15 nt, Homo sapiens
gcucgagcaguccug

SEQ ID NO: 1208977 - RNA, 19 nt, Homo sapiens
gcucgcauuugucaaugac

SEQ ID NO: 1208978 - RNA, 13 nt, Homo sapiens
gcucgcugccauc

SEQ ID NO: 1208979 - RNA, 20 nt, Homo sapiens
gcucuaauucacagugcucu

SEQ ID NO: 1208980 - RNA, 13 nt, Homo sapiens
gcucuaguuuuca

SEQ ID NO: 1208981 - RNA, 13 nt, Homo sapiens
gcucuaucuuccu

SEQ ID NO: 1208982 - RNA, 18 nt, Homo sapiens
gcucucauccauuccucu

SEQ ID NO: 1208983 - RNA, 22 nt, Homo sapiens
gcucuccaccacccaacccaaa

SEQ ID NO: 1208984 - RNA, 13 nt, Homo sapiens
gcucuccuuugag

SEQ ID NO: 1208985 - RNA, 14 nt, Homo sapiens
gcucucguccugcc

SEQ ID NO: 1208986 - RNA, 19 nt, Homo sapiens
gcucugagaaaccucggga

SEQ ID NO: 1208987 - RNA, 23 nt, Homo sapiens
gcucugaggauguauaccccugg

SEQ ID NO: 1208988 - RNA, 21 nt, Homo sapiens
gcucugcaauuccccucugcu

SEQ ID NO: 1208989 - RNA, 14 nt, Homo sapiens
gcucugcacagaca

SEQ ID NO: 1208990 - RNA, 16 nt, Homo sapiens
gcucugccuguggagu

SEQ ID NO: 1208991 - RNA, 22 nt, Homo sapiens
gcucuggacucuaaagaccaaa

SEQ ID NO: 1208992 - RNA, 16 nt, Homo sapiens
gcucuggaguccugcu

SEQ ID NO: 1208993 - RNA, 14 nt, Homo sapiens
gcucuggccacaac

SEQ ID NO: 1208994 - RNA, 10 nt, Homo sapiens
gcucugggaa

SEQ ID NO: 1208995 - RNA, 17 nt, Homo sapiens
gcucuguauggucagga

SEQ ID NO: 1208996 - RNA, 14 nt, Homo sapiens
gcucuuaaauguag

SEQ ID NO: 1208997 - RNA, 13 nt, Homo sapiens
gcucuuaggugcu

SEQ ID NO: 1208998 - RNA, 20 nt, Homo sapiens
gcucuuaugugugccuuugu

SEQ ID NO: 1208999 - RNA, 21 nt, Homo sapiens
gcucuucuguggaccacugca

SEQ ID NO: 1209000 - RNA, 22 nt, Homo sapiens
gcucuuucucugccagugacag

SEQ ID NO: 1209001 - RNA, 16 nt, Homo sapiens
gcucuuugcugcacua

SEQ ID NO: 1209002 - RNA, 16 nt, Homo sapiens
gcucuuuuuuacucau

SEQ ID NO: 1209003 - RNA, 22 nt, Homo sapiens
gcugaaaaaacaccuagcuuua

SEQ ID NO: 1209004 - RNA, 17 nt, Homo sapiens
gcugaaaacuacacaaa

SEQ ID NO: 1209005 - RNA, 14 nt, Homo sapiens
gcugaaaaugcaaa

SEQ ID NO: 1209006 - RNA, 12 nt, Homo sapiens
gcugaaagcuca

SEQ ID NO: 1209007 - RNA, 12 nt, Homo sapiens
gcugaacacugg

SEQ ID NO: 1209008 - RNA, 15 nt, Homo sapiens
gcugaagugucacag

SEQ ID NO: 1209009 - RNA, 22 nt, Homo sapiens
gcugaaugccuccuguggggaa

SEQ ID NO: 1209010 - RNA, 22 nt, Homo sapiens
gcugaauguggacucaaucccu

SEQ ID NO: 1209011 - RNA, 20 nt, Homo sapiens
gcugaauugcccguuuccau

SEQ ID NO: 1209012 - RNA, 18 nt, Homo sapiens
gcugacaucuguguuuca

SEQ ID NO: 1209013 - RNA, 18 nt, Homo sapiens
gcugaccagacacugccu

SEQ ID NO: 1209014 - RNA, 13 nt, Homo sapiens
gcugacucuccag

SEQ ID NO: 1209015 - RNA, 18 nt, Homo sapiens
gcugacuguacuccuccc

SEQ ID NO: 1209016 - RNA, 15 nt, Homo sapiens
gcugacuucaucugg

SEQ ID NO: 1209017 - RNA, 13 nt, Homo sapiens
gcugacuuuggga

SEQ ID NO: 1209018 - RNA, 15 nt, Homo sapiens
gcugagaacuccuga

SEQ ID NO: 1209019 - RNA, 23 nt, Homo sapiens
gcugagauuacagacaugagccu

SEQ ID NO: 1209020 - RNA, 14 nt, Homo sapiens
gcugagauuccugg

SEQ ID NO: 1209021 - RNA, 14 nt, Homo sapiens
gcugaguauggagc

SEQ ID NO: 1209022 - RNA, 14 nt, Homo sapiens
gcugagugaguuca

SEQ ID NO: 1209023 - RNA, 23 nt, Homo sapiens
gcugaguggccagccagugccau

SEQ ID NO: 1209024 - RNA, 20 nt, Homo sapiens
gcugagugggagaaggcagu

SEQ ID NO: 1209025 - RNA, 22 nt, Homo sapiens
gcugaguuucucuuggguauaa

SEQ ID NO: 1209026 - RNA, 15 nt, Homo sapiens
ggaugacccacuguc

SEQ ID NO: 1209027 - RNA, 21 nt, Homo sapiens
ggaugauacuuggaugcagcu

SEQ ID NO: 1209028 - RNA, 19 nt, Homo sapiens
ggaugccacagcccagcuu

SEQ ID NO: 1209029 - RNA, 23 nt, Homo sapiens
ggaugccgagguaaaaguucuuu

SEQ ID NO: 1209030 - RNA, 14 nt, Homo sapiens
ggaugcgaggacca

SEQ ID NO: 1209031 - RNA, 17 nt, Homo sapiens
ggaugcuccggggccau

SEQ ID NO: 1209032 - RNA, 21 nt, Homo sapiens
ggauggcaucaaacagggcaa

SEQ ID NO: 1209033 - RNA, 16 nt, Homo sapiens
ggaugggaacacuggu

SEQ ID NO: 1209034 - RNA, 18 nt, Homo sapiens
ggaugguuuuaucuuccc

SEQ ID NO: 1209035 - RNA, 18 nt, Homo sapiens
ggauguaagccuggagcu

SEQ ID NO: 1209036 - RNA, 16 nt, Homo sapiens
ggaugucauucuuugc

SEQ ID NO: 1209037 - RNA, 16 nt, Homo sapiens
ggauguguggggcaug

SEQ ID NO: 1209038 - RNA, 16 nt, Homo sapiens
ggauguucugggacac

SEQ ID NO: 1209039 - RNA, 13 nt, Homo sapiens
ggauguugcucag

SEQ ID NO: 1209040 - RNA, 17 nt, Homo sapiens
ggauuaaccucugcacu

SEQ ID NO: 1209041 - RNA, 21 nt, Homo sapiens
ggauuaauguuuuguacaauu

SEQ ID NO: 1209042 - RNA, 23 nt, Homo sapiens
ggauuacaggugugggccacugc

SEQ ID NO: 1209043 - RNA, 16 nt, Homo sapiens
ggauuaccaguagaug

SEQ ID NO: 1209044 - RNA, 22 nt, Homo sapiens
ggauuauuaagugauuauuuaa

SEQ ID NO: 1209045 - RNA, 14 nt, Homo sapiens
ggauuauucauuua

SEQ ID NO: 1209046 - RNA, 16 nt, Homo sapiens
ggauucagcaugucca

SEQ ID NO: 1209047 - RNA, 16 nt, Homo sapiens
ggauugaagcccucca

SEQ ID NO: 1209048 - RNA, 19 nt, Homo sapiens
ggauugcuaaucaccaaag

SEQ ID NO: 1209049 - RNA, 15 nt, Homo sapiens
ggauuggcuuugugc

SEQ ID NO: 1209050 - RNA, 18 nt, Homo sapiens
ggauuguguuugugccau

SEQ ID NO: 1209051 - RNA, 20 nt, Homo sapiens
ggauuguguuugugccauau

SEQ ID NO: 1209052 - RNA, 20 nt, Homo sapiens
ggauuguuguuuaacuugua

SEQ ID NO: 1209053 - RNA, 14 nt, Homo sapiens
ggauuuaguguuuc

SEQ ID NO: 1209054 - RNA, 15 nt, Homo sapiens
ggauuuccagggaua

SEQ ID NO: 1209055 - RNA, 17 nt, Homo sapiens
ggauuugccugugccac

SEQ ID NO: 1209056 - RNA, 15 nt, Homo sapiens
ggauuuuaccaaagc

SEQ ID NO: 1209057 - RNA, 18 nt, Homo sapiens
ggcaaaaacuuccaucac

SEQ ID NO: 1209058 - RNA, 22 nt, Homo sapiens
ggcaaagagagucgcaucucag

SEQ ID NO: 1209059 - RNA, 15 nt, Homo sapiens
ggcaaaugacaugca

SEQ ID NO: 1209060 - RNA, 20 nt, Homo sapiens
ggcaacagagcaagacucca

SEQ ID NO: 1209061 - RNA, 17 nt, Homo sapiens
ggcaacauaccaagacc

SEQ ID NO: 1209062 - RNA, 22 nt, Homo sapiens
ggcaaggacggccuucaacuga

SEQ ID NO: 1209063 - RNA, 17 nt, Homo sapiens
ggcaagucuuccaugac

SEQ ID NO: 1209064 - RNA, 14 nt, Homo sapiens
ggcaauaaacuccu

SEQ ID NO: 1209065 - RNA, 21 nt, Homo sapiens
ggcaauaaguuccauguuaaa

SEQ ID NO: 1209066 - RNA, 20 nt, Homo sapiens
ggcaaucaugagcaagugaa

SEQ ID NO: 1209067 - RNA, 17 nt, Homo sapiens
ggcaaucuuugccuuua

SEQ ID NO: 1209068 - RNA, 22 nt, Homo sapiens
ggcaaugcccugugcaugccau

SEQ ID NO: 1209069 - RNA, 11 nt, Homo sapiens
ggcaauuccuc

SEQ ID NO: 1209070 - RNA, 18 nt, Homo sapiens
ggcaauuguccccaggga

SEQ ID NO: 1209071 - RNA, 18 nt, Homo sapiens
ggcaauuucaccaccaaa

SEQ ID NO: 1209072 - RNA, 19 nt, Homo sapiens
ggcaauuucaccaccaaau

SEQ ID NO: 1209073 - RNA, 21 nt, Homo sapiens
ggcacaauuuuaauucaaaag

SEQ ID NO: 1209074 - RNA, 21 nt, Homo sapiens
ggcacacaucaggaguucaau

SEQ ID NO: 1209075 - RNA, 21 nt, Homo sapiens
ggcacagcgagggcagcaucu

SEQ ID NO: 1209076 - RNA, 14 nt, Homo sapiens
ggcaccaaccugca

SEQ ID NO: 1209077 - RNA, 15 nt, Homo sapiens
ggcaccaccauggcu

SEQ ID NO: 1209078 - RNA, 23 nt, Homo sapiens
ggcaccacucuccuuucacagag

SEQ ID NO: 1209079 - RNA, 13 nt, Homo sapiens
ggcaccugaccac

SEQ ID NO: 1209080 - RNA, 14 nt, Homo sapiens
ggcaccugggucca

SEQ ID NO: 1209081 - RNA, 18 nt, Homo sapiens
ggcacuacucaguuauua

SEQ ID NO: 1209082 - RNA, 19 nt, Homo sapiens
ggcacucagaagacacuga

SEQ ID NO: 1209083 - RNA, 11 nt, Homo sapiens
ggcacuuugaa

SEQ ID NO: 1209084 - RNA, 21 nt, Homo sapiens
ggcagacaucggccuccauga

SEQ ID NO: 1209085 - RNA, 19 nt, Homo sapiens
ggcagaccgugaccaucuu

SEQ ID NO: 1209086 - RNA, 19 nt, Homo sapiens
ggcagacugugaacuugac

SEQ ID NO: 1209087 - RNA, 15 nt, Homo sapiens
ggcagagccaugggc

SEQ ID NO: 1209088 - RNA, 21 nt, Homo sapiens
ggcagagccuuccacagugaa

SEQ ID NO: 1209089 - RNA, 20 nt, Homo sapiens
ggcagagguugcaguguggu

SEQ ID NO: 1209090 - RNA, 21 nt, Homo sapiens
gggaaucauuuuucacuguac

SEQ ID NO: 1209091 - RNA, 12 nt, Homo sapiens
gggaauggggac

SEQ ID NO: 1209092 - RNA, 22 nt, Homo sapiens
gggaauucauuuucaucacugg

SEQ ID NO: 1209093 - RNA, 24 nt, Homo sapiens
gggacaagcccuggagaaauggga

SEQ ID NO: 1209094 - RNA, 14 nt, Homo sapiens
gggacagagccaug

SEQ ID NO: 1209095 - RNA, 15 nt, Homo sapiens
gggacagagccaugc

SEQ ID NO: 1209096 - RNA, 11 nt, Homo sapiens
gggacaggaug

SEQ ID NO: 1209097 - RNA, 16 nt, Homo sapiens
gggacucaaugcacug

SEQ ID NO: 1209098 - RNA, 14 nt, Homo sapiens
gggacuccaugcug

SEQ ID NO: 1209099 - RNA, 13 nt, Homo sapiens
gggacuuccuugc

SEQ ID NO: 1209100 - RNA, 17 nt, Homo sapiens
gggacuuccuugcucuc

SEQ ID NO: 1209101 - RNA, 22 nt, Homo sapiens
gggagaagcuuuuuuucuugcu

SEQ ID NO: 1209102 - RNA, 17 nt, Homo sapiens
gggagaaggcagugauu

SEQ ID NO: 1209103 - RNA, 15 nt, Homo sapiens
gggagacaugugaca

SEQ ID NO: 1209104 - RNA, 19 nt, Homo sapiens
gggagcaaaucgugccuug

SEQ ID NO: 1209105 - RNA, 21 nt, Homo sapiens
gggagcagaaacagccauugc

SEQ ID NO: 1209106 - RNA, 21 nt, Homo sapiens
gggagcauagcagaggggcca

SEQ ID NO: 1209107 - RNA, 11 nt, Homo sapiens
gggagccagcc

SEQ ID NO: 1209108 - RNA, 20 nt, Homo sapiens
gggagccuaaggaagcgugg

SEQ ID NO: 1209109 - RNA, 14 nt, Homo sapiens
gggaggacaggcag

SEQ ID NO: 1209110 - RNA, 14 nt, Homo sapiens
gggaggcaagaaaa

SEQ ID NO: 1209111 - RNA, 20 nt, Homo sapiens
gggagguggagauugcagug

SEQ ID NO: 1209112 - RNA, 16 nt, Homo sapiens
gggagucccugggccu

SEQ ID NO: 1209113 - RNA, 23 nt, Homo sapiens
gggauaaguaaguuugauuucau

SEQ ID NO: 1209114 - RNA, 12 nt, Homo sapiens
gggaucauuuga

SEQ ID NO: 1209115 - RNA, 22 nt, Homo sapiens
gggaugcugccugagucaccca

SEQ ID NO: 1209116 - RNA, 17 nt, Homo sapiens
gggaugggaacacuggu

SEQ ID NO: 1209117 - RNA, 12 nt, Homo sapiens
gggaugggccac

SEQ ID NO: 1209118 - RNA, 22 nt, Homo sapiens
gggauguucagcacugucccuu

SEQ ID NO: 1209119 - RNA, 14 nt, Homo sapiens
gggauguugaacug

SEQ ID NO: 1209120 - RNA, 14 nt, Homo sapiens
gggauuacagacau

SEQ ID NO: 1209121 - RNA, 13 nt, Homo sapiens
gggauuacaggcg

SEQ ID NO: 1209122 - RNA, 13 nt, Homo sapiens
gggauuggaagaa

SEQ ID NO: 1209123 - RNA, 22 nt, Homo sapiens
gggcaaaugacaugcacugacc

SEQ ID NO: 1209124 - RNA, 22 nt, Homo sapiens
gggcacucccuugguggcaaga

SEQ ID NO: 1209125 - RNA, 19 nt, Homo sapiens
gggcagagucguuggagac

SEQ ID NO: 1209126 - RNA, 14 nt, Homo sapiens
gggcagcacucccc

SEQ ID NO: 1209127 - RNA, 17 nt, Homo sapiens
gggcagccccaccucac

SEQ ID NO: 1209128 - RNA, 16 nt, Homo sapiens
gggcagccgccaagag

SEQ ID NO: 1209129 - RNA, 16 nt, Homo sapiens
gggcagggcccacgug

SEQ ID NO: 1209130 - RNA, 22 nt, Homo sapiens
gggcagggcuggcaccucucaa

SEQ ID NO: 1209131 - RNA, 14 nt, Homo sapiens
gggcauccauacca

SEQ ID NO: 1209132 - RNA, 19 nt, Homo sapiens
gggcauccugugccacuaa

SEQ ID NO: 1209133 - RNA, 21 nt, Homo sapiens
gggcaugccuugugcuguuaa

SEQ ID NO: 1209134 - RNA, 16 nt, Homo sapiens
gggccacaugggucca

SEQ ID NO: 1209135 - RNA, 14 nt, Homo sapiens
gggccacuggggac

SEQ ID NO: 1209136 - RNA, 22 nt, Homo sapiens
gggccagccccacccccagcca

SEQ ID NO: 1209137 - RNA, 13 nt, Homo sapiens
gggccaguccucc

SEQ ID NO: 1209138 - RNA, 15 nt, Homo sapiens
gggccaucacaggau

SEQ ID NO: 1209139 - RNA, 22 nt, Homo sapiens
gggccaucugacugccaagcca

SEQ ID NO: 1209140 - RNA, 21 nt, Homo sapiens
gggccaugagggacagggucu

SEQ ID NO: 1209141 - RNA, 16 nt, Homo sapiens
gggccaugccaggcca

SEQ ID NO: 1209142 - RNA, 22 nt, Homo sapiens
gggcccaaguaagggcacagau

SEQ ID NO: 1209143 - RNA, 16 nt, Homo sapiens
gggcccacccauguca

SEQ ID NO: 1209144 - RNA, 14 nt, Homo sapiens
gggcccacguguau

SEQ ID NO: 1209145 - RNA, 15 nt, Homo sapiens
gggcccagcccagag

SEQ ID NO: 1209146 - RNA, 14 nt, Homo sapiens
gggccccauccuca

SEQ ID NO: 1209147 - RNA, 22 nt, Homo sapiens
gggccccgccagggcuggggac

SEQ ID NO: 1209148 - RNA, 21 nt, Homo sapiens
gggccccucaacagccaagug

SEQ ID NO: 1209149 - RNA, 22 nt, Homo sapiens
gggcccggcgaggguaugucag

SEQ ID NO: 1209150 - RNA, 16 nt, Homo sapiens
gggcccugggccucag

SEQ ID NO: 1209151 - RNA, 17 nt, Homo sapiens
gugguccuuccuaccuc

SEQ ID NO: 1209152 - RNA, 16 nt, Homo sapiens
gugguggcgugcauau

SEQ ID NO: 1209153 - RNA, 14 nt, Homo sapiens
gugguggucuucaa

SEQ ID NO: 1209154 - RNA, 22 nt, Homo sapiens
gugguuguagaaggagccuugu

SEQ ID NO: 1209155 - RNA, 19 nt, Homo sapiens
guguaaauauaugucugau

SEQ ID NO: 1209156 - RNA, 14 nt, Homo sapiens
guguaaguaauuau

SEQ ID NO: 1209157 - RNA, 14 nt, Homo sapiens
guguacagugaauu

SEQ ID NO: 1209158 - RNA, 15 nt, Homo sapiens
guguaccuccucuca

SEQ ID NO: 1209159 - RNA, 12 nt, Homo sapiens
guguaggggcca

SEQ ID NO: 1209160 - RNA, 23 nt, Homo sapiens
guguaguuucuucauuucaggaa

SEQ ID NO: 1209161 - RNA, 23 nt, Homo sapiens
guguauccgacucuaagcugugu

SEQ ID NO: 1209162 - RNA, 13 nt, Homo sapiens
guguaugcugaug

SEQ ID NO: 1209163 - RNA, 12 nt, Homo sapiens
guguauguauaa

SEQ ID NO: 1209164 - RNA, 12 nt, Homo sapiens
guguaugugacc

SEQ ID NO: 1209165 - RNA, 16 nt, Homo sapiens
gugucaagacauuucu

SEQ ID NO: 1209166 - RNA, 21 nt, Homo sapiens
gugucacccauuggugaccug

SEQ ID NO: 1209167 - RNA, 19 nt, Homo sapiens
gugucaccuacgugccacu

SEQ ID NO: 1209168 - RNA, 19 nt, Homo sapiens
gugucaccucccugaaauu

SEQ ID NO: 1209169 - RNA, 22 nt, Homo sapiens
gugucacuacucacagucucuu

SEQ ID NO: 1209170 - RNA, 20 nt, Homo sapiens
gugucagaaacccuggucuc

SEQ ID NO: 1209171 - RNA, 16 nt, Homo sapiens
gugucagucagggaca

SEQ ID NO: 1209172 - RNA, 16 nt, Homo sapiens
guguccccuccacugu

SEQ ID NO: 1209173 - RNA, 14 nt, Homo sapiens
gugucgucugugaa

SEQ ID NO: 1209174 - RNA, 23 nt, Homo sapiens
gugucucagggugcagaggucag

SEQ ID NO: 1209175 - RNA, 18 nt, Homo sapiens
gugucuccagccuggcuc

SEQ ID NO: 1209176 - RNA, 10 nt, Homo sapiens
gugucuccca

SEQ ID NO: 1209177 - RNA, 18 nt, Homo sapiens
gugucucugaggacguca

SEQ ID NO: 1209178 - RNA, 22 nt, Homo sapiens
gugucugcuuuaaagggccugc

SEQ ID NO: 1209179 - RNA, 14 nt, Homo sapiens
gugucugugcccuc

SEQ ID NO: 1209180 - RNA, 14 nt, Homo sapiens
gugucuguguauau

SEQ ID NO: 1209181 - RNA, 15 nt, Homo sapiens
gugucuuaauuauua

SEQ ID NO: 1209182 - RNA, 15 nt, Homo sapiens
gugucuuaggguaga

SEQ ID NO: 1209183 - RNA, 18 nt, Homo sapiens
gugucuuucacagcuccu

SEQ ID NO: 1209184 - RNA, 22 nt, Homo sapiens
gugucuuucucucucucucuuc

SEQ ID NO: 1209185 - RNA, 13 nt, Homo sapiens
gugugaacugcaa

SEQ ID NO: 1209186 - RNA, 15 nt, Homo sapiens
gugugaaugcacguu

SEQ ID NO: 1209187 - RNA, 15 nt, Homo sapiens
gugugaaugugggca

SEQ ID NO: 1209188 - RNA, 16 nt, Homo sapiens
gugugcauguguguau

SEQ ID NO: 1209189 - RNA, 18 nt, Homo sapiens
gugugccaagaguucgau

SEQ ID NO: 1209190 - RNA, 15 nt, Homo sapiens
gugugcgucacugug

SEQ ID NO: 1209191 - RNA, 19 nt, Homo sapiens
gugugcuccagauggugcu

SEQ ID NO: 1209192 - RNA, 19 nt, Homo sapiens
gugugcugacgagcagggu

SEQ ID NO: 1209193 - RNA, 22 nt, Homo sapiens
gugugguccagguccuuuccac

SEQ ID NO: 1209194 - RNA, 14 nt, Homo sapiens
gugugguugcucac

SEQ ID NO: 1209195 - RNA, 16 nt, Homo sapiens
guguguaacacugugu

SEQ ID NO: 1209196 - RNA, 19 nt, Homo sapiens
guguguauauauguguaua

SEQ ID NO: 1209197 - RNA, 15 nt, Homo sapiens
guguguguugucuga

SEQ ID NO: 1209198 - RNA, 17 nt, Homo sapiens
guguguucuauccaaac

SEQ ID NO: 1209199 - RNA, 14 nt, Homo sapiens
guguguugauccca

SEQ ID NO: 1209200 - RNA, 13 nt, Homo sapiens
guguuaccauccc

SEQ ID NO: 1209201 - RNA, 18 nt, Homo sapiens
guguuauuauuuugcacu

SEQ ID NO: 1209202 - RNA, 19 nt, Homo sapiens
guguuauuauuuugcacug

SEQ ID NO: 1209203 - RNA, 15 nt, Homo sapiens
guguuauuugcacac

SEQ ID NO: 1209204 - RNA, 17 nt, Homo sapiens
guguuauuugcacacug

SEQ ID NO: 1209205 - RNA, 18 nt, Homo sapiens
guguucacaacagugaaa

SEQ ID NO: 1209206 - RNA, 22 nt, Homo sapiens
guguuccauugccauagcugac

SEQ ID NO: 1209207 - RNA, 21 nt, Homo sapiens
guguuccuaaaauggugauau

SEQ ID NO: 1209208 - RNA, 16 nt, Homo sapiens
guguucgauggcucaa

SEQ ID NO: 1209209 - RNA, 14 nt, Homo sapiens
guguugaccacaga

SEQ ID NO: 1209210 - RNA, 12 nt, Homo sapiens
guguugauccca

SEQ ID NO: 1209211 - RNA, 14 nt, Homo sapiens
guguugaucccaag

SEQ ID NO: 1209212 - RNA, 15 nt, Homo sapiens
guguugcaccaggca

SEQ ID NO: 1209213 - RNA, 21 nt, Homo sapiens
guguugcaccaggcacugcug

SEQ ID NO: 1209214 - RNA, 24 nt, Homo sapiens
guguuggggaaaccuucaucugaa

SEQ ID NO: 1209215 - RNA, 16 nt, Homo sapiens
guguuuaaaacaugca

SEQ ID NO: 1209216 - RNA, 19 nt, Homo sapiens
guguuuaauuaaauuucac

SEQ ID NO: 1209217 - RNA, 16 nt, Homo sapiens
guguuuggagcucuau

SEQ ID NO: 1209218 - RNA, 22 nt, Homo sapiens
guguuuuaaacucuccuaguca

SEQ ID NO: 1209219 - RNA, 20 nt, Homo sapiens
guguuuuacugucagauuaa

SEQ ID NO: 1209220 - RNA, 13 nt, Homo sapiens
guguuuuccugaa

SEQ ID NO: 1209221 - RNA, 12 nt, Homo sapiens
guguuuugccau

SEQ ID NO: 1209222 - RNA, 18 nt, Homo sapiens
guuaaaaucuauucugug

SEQ ID NO: 1209223 - RNA, 15 nt, Homo sapiens
guuaaagaagcaauc

SEQ ID NO: 1209224 - RNA, 18 nt, Homo sapiens
guuaaagcagacagucac

SEQ ID NO: 1209225 - RNA, 14 nt, Homo sapiens
guuaaagugaauaa

SEQ ID NO: 1209226 - RNA, 18 nt, Homo sapiens
guuaaauaauauggcuau

SEQ ID NO: 1209227 - RNA, 20 nt, Homo sapiens
guuaaauagaguauaugcac

SEQ ID NO: 1209228 - RNA, 15 nt, Homo sapiens
guuaaauaugcaucu

SEQ ID NO: 1209229 - RNA, 22 nt, Homo sapiens
guuaaauugaauaaaauacucu

SEQ ID NO: 1209230 - RNA, 11 nt, Homo sapiens
guucuuuacaa

SEQ ID NO: 1209231 - RNA, 18 nt, Homo sapiens
guugaaccguuucuuuaa

SEQ ID NO: 1209232 - RNA, 14 nt, Homo sapiens
guugaauaaaugaa

SEQ ID NO: 1209233 - RNA, 19 nt, Homo sapiens
guugaauauagccugccuc

SEQ ID NO: 1209234 - RNA, 19 nt, Homo sapiens
guugaaugagcgucagcau

SEQ ID NO: 1209235 - RNA, 17 nt, Homo sapiens
guugaauguugcaaugu

SEQ ID NO: 1209236 - RNA, 21 nt, Homo sapiens
guugacguuugcucauuuaag

SEQ ID NO: 1209237 - RNA, 13 nt, Homo sapiens
guugagauuugac

SEQ ID NO: 1209238 - RNA, 18 nt, Homo sapiens
guugaggggcuccuggaa

SEQ ID NO: 1209239 - RNA, 15 nt, Homo sapiens
guugaucccaagaca

SEQ ID NO: 1209240 - RNA, 22 nt, Homo sapiens
guugauggaaaauaaacaucag

SEQ ID NO: 1209241 - RNA, 22 nt, Homo sapiens
guugauggaaauacacuguuau

SEQ ID NO: 1209242 - RNA, 20 nt, Homo sapiens
guugcaaauacauggauaac

SEQ ID NO: 1209243 - RNA, 15 nt, Homo sapiens
guugcacugaugucc

SEQ ID NO: 1209244 - RNA, 18 nt, Homo sapiens
guugcagccagggccagu

SEQ ID NO: 1209245 - RNA, 20 nt, Homo sapiens
guugccacaguagaacuguc

SEQ ID NO: 1209246 - RNA, 19 nt, Homo sapiens
guugccaccccaacccaau

SEQ ID NO: 1209247 - RNA, 22 nt, Homo sapiens
guugcccuagcccagacucuga

SEQ ID NO: 1209248 - RNA, 18 nt, Homo sapiens
guugcucaaaucuauuca

SEQ ID NO: 1209249 - RNA, 22 nt, Homo sapiens
guugcucaaaucuauucagaca

SEQ ID NO: 1209250 - RNA, 19 nt, Homo sapiens
guugcucacagcuguaaua

SEQ ID NO: 1209251 - RNA, 18 nt, Homo sapiens
guugcucuguacccauga

SEQ ID NO: 1209252 - RNA, 15 nt, Homo sapiens
guugcuggacuguca

SEQ ID NO: 1209253 - RNA, 16 nt, Homo sapiens
guugcuggcaguacug

SEQ ID NO: 1209254 - RNA, 19 nt, Homo sapiens
guugcugugugguuuggug

SEQ ID NO: 1209255 - RNA, 14 nt, Homo sapiens
guugcuuacagugu

SEQ ID NO: 1209256 - RNA, 13 nt, Homo sapiens
guuggaacauccu

SEQ ID NO: 1209257 - RNA, 21 nt, Homo sapiens
guuggacaaaccgagugcaau

SEQ ID NO: 1209258 - RNA, 23 nt, Homo sapiens
guuggacaaaccgagugcaauga

SEQ ID NO: 1209259 - RNA, 18 nt, Homo sapiens
guuggccucagggccagg

SEQ ID NO: 1209260 - RNA, 17 nt, Homo sapiens
guuggcggggggcugca

SEQ ID NO: 1209261 - RNA, 17 nt, Homo sapiens
guugggggcacucagcc

SEQ ID NO: 1209262 - RNA, 14 nt, Homo sapiens
guuggggugacagu

SEQ ID NO: 1209263 - RNA, 20 nt, Homo sapiens
guuggugacugaaacauuca

SEQ ID NO: 1209264 - RNA, 20 nt, Homo sapiens
guuguaaaaagaaaaaccac

SEQ ID NO: 1209265 - RNA, 18 nt, Homo sapiens
guuguaaccugcugugau

SEQ ID NO: 1209266 - RNA, 17 nt, Homo sapiens
guuguaauaaaacuuau

SEQ ID NO: 1209267 - RNA, 16 nt, Homo sapiens
guuguauuaacaaaag

SEQ ID NO: 1209268 - RNA, 16 nt, Homo sapiens
guugucacauucucau

SEQ ID NO: 1209269 - RNA, 20 nt, Homo sapiens
guugucuacaccaaugccca

SEQ ID NO: 1209270 - RNA, 12 nt, Homo sapiens
guuguguaguca

SEQ ID NO: 1209271 - RNA, 18 nt, Homo sapiens
guuguugaggcugucaca

SEQ ID NO: 1209272 - RNA, 21 nt, Homo sapiens
guuguuuauauacaguacaca

SEQ ID NO: 1209273 - RNA, 11 nt, Homo sapiens
guuguuugcaa

SEQ ID NO: 1209274 - RNA, 14 nt, Homo sapiens
guuuacaugugaug

SEQ ID NO: 1209275 - RNA, 14 nt, Homo sapiens
guuuaccacuaacu

SEQ ID NO: 1209276 - RNA, 15 nt, Homo sapiens
guuuaccacuaacuc

SEQ ID NO: 1209277 - RNA, 21 nt, Homo sapiens
guuuacccaguauuccauuuu

SEQ ID NO: 1209278 - RNA, 15 nt, Homo sapiens
gauucugcagcaccg

SEQ ID NO: 1209279 - RNA, 24 nt, Homo sapiens
gauugagaaauguguagcugcaaa

SEQ ID NO: 1209280 - RNA, 19 nt, Homo sapiens
gauugaggagcugcacuga

SEQ ID NO: 1209281 - RNA, 19 nt, Homo sapiens
gauugauagaguguuauca

SEQ ID NO: 1209282 - RNA, 17 nt, Homo sapiens
gauugcacagagcugga

SEQ ID NO: 1209283 - RNA, 20 nt, Homo sapiens
gauugcacguggccucuuga

SEQ ID NO: 1209284 - RNA, 20 nt, Homo sapiens
gauugcauaggaauugcaca

SEQ ID NO: 1209285 - RNA, 17 nt, Homo sapiens
gauugcauccacuagcu

SEQ ID NO: 1209286 - RNA, 20 nt, Homo sapiens
gauugcugaaaaaguagauu

SEQ ID NO: 1209287 - RNA, 14 nt, Homo sapiens
gauugcugcaaaga

SEQ ID NO: 1209288 - RNA, 20 nt, Homo sapiens
gauuggauuauucauuuaaa

SEQ ID NO: 1209289 - RNA, 13 nt, Homo sapiens
gauuggcacagac

SEQ ID NO: 1209290 - RNA, 13 nt, Homo sapiens
gauugucuccuaa

SEQ ID NO: 1209291 - RNA, 15 nt, Homo sapiens
gauuguuguuugcca

SEQ ID NO: 1209292 - RNA, 17 nt, Homo sapiens
gauuuaaaaaaagaaca

SEQ ID NO: 1209293 - RNA, 15 nt, Homo sapiens
gauuuaacacuaaaa

SEQ ID NO: 1209294 - RNA, 16 nt, Homo sapiens
gauuuaauccaguuau

SEQ ID NO: 1209295 - RNA, 17 nt, Homo sapiens
gauuuaauuuccagggu

SEQ ID NO: 1209296 - RNA, 18 nt, Homo sapiens
gauuuauaguaugugacu

SEQ ID NO: 1209297 - RNA, 16 nt, Homo sapiens
gauuuaugaugcacuu

SEQ ID NO: 1209298 - RNA, 21 nt, Homo sapiens
gauuucauaguucagaauuua

SEQ ID NO: 1209299 - RNA, 13 nt, Homo sapiens
gauuuccagugag

SEQ ID NO: 1209300 - RNA, 17 nt, Homo sapiens
gauuuccuccuggccuu

SEQ ID NO: 1209301 - RNA, 19 nt, Homo sapiens
gauuuccuugugcaaaaua

SEQ ID NO: 1209302 - RNA, 14 nt, Homo sapiens
gauuucuaccucag

SEQ ID NO: 1209303 - RNA, 18 nt, Homo sapiens
gauuucuauggcuuucaa

SEQ ID NO: 1209304 - RNA, 17 nt, Homo sapiens
gauuucugguuguuaug

SEQ ID NO: 1209305 - RNA, 17 nt, Homo sapiens
gauuugauaccauggca

SEQ ID NO: 1209306 - RNA, 19 nt, Homo sapiens
gauuugauaccauggcacu

SEQ ID NO: 1209307 - RNA, 23 nt, Homo sapiens
gauuugauaccauggcacugaca

SEQ ID NO: 1209308 - RNA, 20 nt, Homo sapiens
gauuugccguaccaaucucu

SEQ ID NO: 1209309 - RNA, 13 nt, Homo sapiens
gauuugccugugc

SEQ ID NO: 1209310 - RNA, 15 nt, Homo sapiens
gauuuggugaccaac

SEQ ID NO: 1209311 - RNA, 16 nt, Homo sapiens
gauuuguagcacugag

SEQ ID NO: 1209312 - RNA, 12 nt, Homo sapiens
gauuuguugcca

SEQ ID NO: 1209313 - RNA, 18 nt, Homo sapiens
gauuuuaaaaagucuuca

SEQ ID NO: 1209314 - RNA, 16 nt, Homo sapiens
gauuuuaucugugaau

SEQ ID NO: 1209315 - RNA, 19 nt, Homo sapiens
gauuuuaugaaaugaccuc

SEQ ID NO: 1209316 - RNA, 22 nt, Homo sapiens
gauuuucuaaggaaugcacaaa

SEQ ID NO: 1209317 - RNA, 15 nt, Homo sapiens
gauuuugucuaccau

SEQ ID NO: 1209318 - RNA, 16 nt, Homo sapiens
gauuuuuaugaugaug

SEQ ID NO: 1209319 - RNA, 14 nt, Homo sapiens
gauuuuucucuuca

SEQ ID NO: 1209320 - RNA, 16 nt, Homo sapiens
gauuuuucucuucauu

SEQ ID NO: 1209321 - RNA, 18 nt, Homo sapiens
gauuuuuuccucugcauu

SEQ ID NO: 1209322 - RNA, 22 nt, Homo sapiens
gauuuuuuuuucauacacuuau

SEQ ID NO: 1209323 - RNA, 13 nt, Homo sapiens
gcaaaaaaagccu

SEQ ID NO: 1209324 - RNA, 14 nt, Homo sapiens
gcaaaaaucuccca

SEQ ID NO: 1209325 - RNA, 12 nt, Homo sapiens
gcaaaacccagg

SEQ ID NO: 1209326 - RNA, 21 nt, Homo sapiens
gcaaaacucuacuuaauccaa

SEQ ID NO: 1209327 - RNA, 16 nt, Homo sapiens
gcaaaaggccucuugu

SEQ ID NO: 1209328 - RNA, 20 nt, Homo sapiens
gcaaaaugaaaaugucaaua

SEQ ID NO: 1209329 - RNA, 23 nt, Homo sapiens
gcaaaaugaguugugaugaauca

SEQ ID NO: 1209330 - RNA, 20 nt, Homo sapiens
gcaaacaggguuugauagca

SEQ ID NO: 1209331 - RNA, 21 nt, Homo sapiens
gcaaaccuguucaucuugcca

SEQ ID NO: 1209332 - RNA, 19 nt, Homo sapiens
gcaaagacguggggcccca

SEQ ID NO: 1209333 - RNA, 22 nt, Homo sapiens
gcaaagccuagccugcauauca

SEQ ID NO: 1209334 - RNA, 19 nt, Homo sapiens
gcaaagguauuaguacaau

SEQ ID NO: 1209335 - RNA, 17 nt, Homo sapiens
gcaaaguguaugugacc

SEQ ID NO: 1209336 - RNA, 15 nt, Homo sapiens
gcaaauaaaccacuu

SEQ ID NO: 1209337 - RNA, 15 nt, Homo sapiens
gcaaaugacaugcac

SEQ ID NO: 1209338 - RNA, 19 nt, Homo sapiens
gcaaauggcagaaccaaag

SEQ ID NO: 1209339 - RNA, 15 nt, Homo sapiens
gcaacaaaaauuacu

SEQ ID NO: 1209340 - RNA, 21 nt, Homo sapiens
gcaacaagaccaccacuucga

SEQ ID NO: 1209341 - RNA, 13 nt, Homo sapiens
gcaacaaugacuu

SEQ ID NO: 1209342 - RNA, 17 nt, Homo sapiens
gcaacaauuuaugaauu

SEQ ID NO: 1209343 - RNA, 22 nt, Homo sapiens
gcaacagcaaaucacgaccacu

SEQ ID NO: 1209344 - RNA, 17 nt, Homo sapiens
gcaacagccaaguggaa

SEQ ID NO: 1209345 - RNA, 21 nt, Homo sapiens
gcaacaggauugaucauucuu

SEQ ID NO: 1209346 - RNA, 19 nt, Homo sapiens
gcaaccucuucaugagcuu

SEQ ID NO: 1209347 - RNA, 23 nt, Homo sapiens
gcaacuaggaaaaucacuugcca

SEQ ID NO: 1209348 - RNA, 17 nt, Homo sapiens
gcaacucacugauucuc

SEQ ID NO: 1209349 - RNA, 15 nt, Homo sapiens
gcaagaccagucacu

SEQ ID NO: 1209350 - RNA, 19 nt, Homo sapiens
gcaagacccauaaccauua

SEQ ID NO: 1209351 - RNA, 17 nt, Homo sapiens
gcaagacuccaucucaa

SEQ ID NO: 1209352 - RNA, 17 nt, Homo sapiens
gcaagacuguugcucaa

SEQ ID NO: 1209353 - RNA, 22 nt, Homo sapiens
gcaagagaggaugacacaucaa

SEQ ID NO: 1209354 - RNA, 13 nt, Homo sapiens
gcaagcugagcug

SEQ ID NO: 1209355 - RNA, 23 nt, Homo sapiens
gcaaggauuacagaaacugaugc

SEQ ID NO: 1209356 - RNA, 23 nt, Homo sapiens
gcaagggaccuucaugcccuucu

SEQ ID NO: 1209357 - RNA, 16 nt, Homo sapiens
gcaagguuuggugcaa

SEQ ID NO: 1209358 - RNA, 15 nt, Homo sapiens
gcaaguacaauguua

SEQ ID NO: 1209359 - RNA, 20 nt, Homo sapiens
gcaaguuagaacuagccaaa

SEQ ID NO: 1209360 - RNA, 19 nt, Homo sapiens
gcaaguuucaucagucaau

SEQ ID NO: 1209361 - RNA, 12 nt, Homo sapiens
gcaaguuugcac

SEQ ID NO: 1209362 - RNA, 20 nt, Homo sapiens
gcaauaaccucaaagugacu

SEQ ID NO: 1209363 - RNA, 13 nt, Homo sapiens
gcaauagaacccu

SEQ ID NO: 1209364 - RNA, 16 nt, Homo sapiens
gcaaucacugaucuca

SEQ ID NO: 1209365 - RNA, 17 nt, Homo sapiens
gcaaucuauguuugcac

SEQ ID NO: 1209366 - RNA, 22 nt, Homo sapiens
gcaaucuccuuacuguguuuca

SEQ ID NO: 1209367 - RNA, 17 nt, Homo sapiens
gcaaucuuugccuuuau

SEQ ID NO: 1209368 - RNA, 23 nt, Homo sapiens
gcaaucuuugccuuuaucucuga

SEQ ID NO: 1209369 - RNA, 21 nt, Homo sapiens
gcaaugaaugaugcuuuucug

SEQ ID NO: 1209370 - RNA, 22 nt, Homo sapiens
gcaaugcuucuguagcuucuaa

SEQ ID NO: 1209371 - RNA, 12 nt, Homo sapiens
gcaaugugcuac

SEQ ID NO: 1209372 - RNA, 21 nt, Homo sapiens
gcaauuaggauuuugauguga

SEQ ID NO: 1209373 - RNA, 23 nt, Homo sapiens
gcaauuauagaguaucacuccca

SEQ ID NO: 1209374 - RNA, 13 nt, Homo sapiens
gcaauucauccca

SEQ ID NO: 1209375 - RNA, 19 nt, Homo sapiens
gcaauuccucugaacaaaa

SEQ ID NO: 1209376 - RNA, 22 nt, Homo sapiens
gcaauuucauaugcuguauauc

SEQ ID NO: 1209377 - RNA, 16 nt, Homo sapiens
gcaauuuucuaagcaa

SEQ ID NO: 1209378 - RNA, 14 nt, Homo sapiens
gcacaaacaauaug

SEQ ID NO: 1209379 - RNA, 13 nt, Homo sapiens
gcacaaagacaca

SEQ ID NO: 1209380 - RNA, 18 nt, Homo sapiens
gcacaaauugaaaacaca

SEQ ID NO: 1209381 - RNA, 22 nt, Homo sapiens
gcacaaauugaaaacacacuca

SEQ ID NO: 1209382 - RNA, 20 nt, Homo sapiens
gcacaaauugggccaaagaa

SEQ ID NO: 1209383 - RNA, 22 nt, Homo sapiens
gcacaagggcacgugaagucau

SEQ ID NO: 1209384 - RNA, 12 nt, Homo sapiens
gcacaaugucau

SEQ ID NO: 1209385 - RNA, 20 nt, Homo sapiens
gcacaaugucaugucuguga

SEQ ID NO: 1209386 - RNA, 18 nt, Homo sapiens
gcacacaccacacacagc

SEQ ID NO: 1209387 - RNA, 19 nt, Homo sapiens
gcacacagcaggcuuucaa

SEQ ID NO: 1209388 - RNA, 19 nt, Homo sapiens
gcacacagcugagcacuua

SEQ ID NO: 1209389 - RNA, 22 nt, Homo sapiens
gcacacccuccagagacaacag

SEQ ID NO: 1209390 - RNA, 21 nt, Homo sapiens
gcacaccggcuuaacacuauc

SEQ ID NO: 1209391 - RNA, 17 nt, Homo sapiens
gcacagaaauuuucaau

SEQ ID NO: 1209392 - RNA, 13 nt, Homo sapiens
gcacagaauuugu

SEQ ID NO: 1209393 - RNA, 16 nt, Homo sapiens
gcacagaauuugucag

SEQ ID NO: 1209394 - RNA, 16 nt, Homo sapiens
gcacagaccaguuuca

SEQ ID NO: 1209395 - RNA, 23 nt, Homo sapiens
gcacagagcaguggccaggccac

SEQ ID NO: 1209396 - RNA, 15 nt, Homo sapiens
gcacagaggucagga

SEQ ID NO: 1209397 - RNA, 21 nt, Homo sapiens
gcacaggaguguccucuuccc

SEQ ID NO: 1209398 - RNA, 19 nt, Homo sapiens
gcacaggccauggugcaca

SEQ ID NO: 1209399 - RNA, 21 nt, Homo sapiens
gcacaggcgcaucccaggccu

SEQ ID NO: 1209400 - RNA, 19 nt, Homo sapiens
gcacaggggcccauggacu

SEQ ID NO: 1209401 - RNA, 19 nt, Homo sapiens
gcacaguguaauccagggg

SEQ ID NO: 1209402 - RNA, 19 nt, Homo sapiens
gcacaguuuguggcuuaua

SEQ ID NO: 1209403 - RNA, 14 nt, Homo sapiens
gccucuuguucaug

SEQ ID NO: 1209404 - RNA, 19 nt, Homo sapiens
gccucuuuucucugugcuu

SEQ ID NO: 1209405 - RNA, 15 nt, Homo sapiens
gccugaagucacaca

SEQ ID NO: 1209406 - RNA, 22 nt, Homo sapiens
gccugaaugucuuacugugauc

SEQ ID NO: 1209407 - RNA, 15 nt, Homo sapiens
gccugacacauagaa

SEQ ID NO: 1209408 - RNA, 16 nt, Homo sapiens
gccugaccuuccuucc

SEQ ID NO: 1209409 - RNA, 22 nt, Homo sapiens
gccugacuuggggagauggagu

SEQ ID NO: 1209410 - RNA, 20 nt, Homo sapiens
gccugagaggcaggcauaga

SEQ ID NO: 1209411 - RNA, 17 nt, Homo sapiens
gccugagccucugcuuc

SEQ ID NO: 1209412 - RNA, 17 nt, Homo sapiens
gccugagcuggggccac

SEQ ID NO: 1209413 - RNA, 14 nt, Homo sapiens
gccugagugaucca

SEQ ID NO: 1209414 - RNA, 21 nt, Homo sapiens
gccugaguuuagggucaagga

SEQ ID NO: 1209415 - RNA, 22 nt, Homo sapiens
gccugcaaacucacugcucaag

SEQ ID NO: 1209416 - RNA, 13 nt, Homo sapiens
gccugcaagcuuc

SEQ ID NO: 1209417 - RNA, 21 nt, Homo sapiens
gccugcaauuucauaugcugu

SEQ ID NO: 1209418 - RNA, 12 nt, Homo sapiens
gccugcacacaa

SEQ ID NO: 1209419 - RNA, 15 nt, Homo sapiens
gccugcaucugugaa

SEQ ID NO: 1209420 - RNA, 16 nt, Homo sapiens
gccugccuggcaggcu

SEQ ID NO: 1209421 - RNA, 15 nt, Homo sapiens
gccugccuggugugc

SEQ ID NO: 1209422 - RNA, 23 nt, Homo sapiens
gccugcucccuagccagaggcuc

SEQ ID NO: 1209423 - RNA, 17 nt, Homo sapiens
gccugcuggcuggcagu

SEQ ID NO: 1209424 - RNA, 19 nt, Homo sapiens
gccugcuguggacccuguc

SEQ ID NO: 1209425 - RNA, 14 nt, Homo sapiens
gccuggagcuaccu

SEQ ID NO: 1209426 - RNA, 20 nt, Homo sapiens
gccuggagugcccacccugg

SEQ ID NO: 1209427 - RNA, 19 nt, Homo sapiens
gccuggaugaggcacuucu

SEQ ID NO: 1209428 - RNA, 17 nt, Homo sapiens
gccuggcaggccagugu

SEQ ID NO: 1209429 - RNA, 13 nt, Homo sapiens
gccugggccucug

SEQ ID NO: 1209430 - RNA, 14 nt, Homo sapiens
gccuggugcagugg

SEQ ID NO: 1209431 - RNA, 15 nt, Homo sapiens
gccugguugugugca

SEQ ID NO: 1209432 - RNA, 23 nt, Homo sapiens
gccuguaaucccaacacuuugag

SEQ ID NO: 1209433 - RNA, 21 nt, Homo sapiens
gccuguaaucccagcacuuug

SEQ ID NO: 1209434 - RNA, 22 nt, Homo sapiens
gccuguaaucccagcacuuugg

SEQ ID NO: 1209435 - RNA, 22 nt, Homo sapiens
gccuguaaucucagcacuuugg

SEQ ID NO: 1209436 - RNA, 19 nt, Homo sapiens
gccugucccauggacacuc

SEQ ID NO: 1209437 - RNA, 16 nt, Homo sapiens
gccugucugagacuca

SEQ ID NO: 1209438 - RNA, 19 nt, Homo sapiens
gccugugaucccagcuacu

SEQ ID NO: 1209439 - RNA, 14 nt, Homo sapiens
gccugugaugcugg

SEQ ID NO: 1209440 - RNA, 14 nt, Homo sapiens
gccugugcacacac

SEQ ID NO: 1209441 - RNA, 12 nt, Homo sapiens
gccuguggaaug

SEQ ID NO: 1209442 - RNA, 15 nt, Homo sapiens
gccugugguuaacau

SEQ ID NO: 1209443 - RNA, 19 nt, Homo sapiens
gccugugguuaacaucuca

SEQ ID NO: 1209444 - RNA, 21 nt, Homo sapiens
gccugugguuaacaucucaga

SEQ ID NO: 1209445 - RNA, 14 nt, Homo sapiens
gccuguguacugcc

SEQ ID NO: 1209446 - RNA, 17 nt, Homo sapiens
gccugugucccaugacc

SEQ ID NO: 1209447 - RNA, 15 nt, Homo sapiens
gccuguuaacuggua

SEQ ID NO: 1209448 - RNA, 20 nt, Homo sapiens
gccuguuccgcauccuggag

SEQ ID NO: 1209449 - RNA, 14 nt, Homo sapiens
gccuguugcccuuu

SEQ ID NO: 1209450 - RNA, 22 nt, Homo sapiens
gccuguuugcuuagcauuccua

SEQ ID NO: 1209451 - RNA, 19 nt, Homo sapiens
gccuuaaguaauguuaauu

SEQ ID NO: 1209452 - RNA, 14 nt, Homo sapiens
gccuuagcaguaac

SEQ ID NO: 1209453 - RNA, 23 nt, Homo sapiens
gccuuagggugcugagugccuga

SEQ ID NO: 1209454 - RNA, 14 nt, Homo sapiens
gccuuaucuugcac

SEQ ID NO: 1209455 - RNA, 15 nt, Homo sapiens
gccuucaagugccaa

SEQ ID NO: 1209456 - RNA, 16 nt, Homo sapiens
gccuucaagugccaaa

SEQ ID NO: 1209457 - RNA, 19 nt, Homo sapiens
gccuucacgugucuguucc

SEQ ID NO: 1209458 - RNA, 21 nt, Homo sapiens
gccuucacuccggugugccug

SEQ ID NO: 1209459 - RNA, 14 nt, Homo sapiens
gccuucaucuucac

SEQ ID NO: 1209460 - RNA, 21 nt, Homo sapiens
gccuucaucuucacugcaauu

SEQ ID NO: 1209461 - RNA, 13 nt, Homo sapiens
gccuuccccauca

SEQ ID NO: 1209462 - RNA, 19 nt, Homo sapiens
gccuuccuuucuccaggac

SEQ ID NO: 1209463 - RNA, 23 nt, Homo sapiens
gccuuccuuucuccaggaccaau

SEQ ID NO: 1209464 - RNA, 15 nt, Homo sapiens
gccuucuccaggaca

SEQ ID NO: 1209465 - RNA, 20 nt, Homo sapiens
gccuucuccaucaugcccag

SEQ ID NO: 1209466 - RNA, 23 nt, Homo sapiens
gccuugccuaaauuuaaugcugc

SEQ ID NO: 1209467 - RNA, 18 nt, Homo sapiens
gccuugccuccucaccca

SEQ ID NO: 1209468 - RNA, 21 nt, Homo sapiens
gccuugcuagcugaccuggag

SEQ ID NO: 1209469 - RNA, 14 nt, Homo sapiens
gauaacugcaauuu

SEQ ID NO: 1209470 - RNA, 21 nt, Homo sapiens
gauaagcacauuaaaguuaau

SEQ ID NO: 1209471 - RNA, 21 nt, Homo sapiens
gauaaguagggcuaagccagu

SEQ ID NO: 1209472 - RNA, 18 nt, Homo sapiens
gauaaguggggacuagug

SEQ ID NO: 1209473 - RNA, 19 nt, Homo sapiens
gauaaguggggacuagugu

SEQ ID NO: 1209474 - RNA, 13 nt, Homo sapiens
gauaauaguuuac

SEQ ID NO: 1209475 - RNA, 21 nt, Homo sapiens
gauaaucucuuuaaauggcuu

SEQ ID NO: 1209476 - RNA, 15 nt, Homo sapiens
gauaaucuucaggug

SEQ ID NO: 1209477 - RNA, 20 nt, Homo sapiens
gacuacaaccaauuuacacu

SEQ ID NO: 1209478 - RNA, 14 nt, Homo sapiens
gacuacacaggaug

SEQ ID NO: 1209479 - RNA, 17 nt, Homo sapiens
gacuacaggcacccacc

SEQ ID NO: 1209480 - RNA, 21 nt, Homo sapiens
gacuacuuggaacuaggcucu

SEQ ID NO: 1209481 - RNA, 16 nt, Homo sapiens
gacuagaggcagggag

SEQ ID NO: 1209482 - RNA, 16 nt, Homo sapiens
gacuagauacuacuuu

SEQ ID NO: 1209483 - RNA, 15 nt, Homo sapiens
gacuaguagauuucu

SEQ ID NO: 1209484 - RNA, 18 nt, Homo sapiens
gacuagugacacauugua

SEQ ID NO: 1209485 - RNA, 20 nt, Homo sapiens
gacuaugauuuaccuauaca

SEQ ID NO: 1209486 - RNA, 12 nt, Homo sapiens
gacuauggagcc

SEQ ID NO: 1209487 - RNA, 14 nt, Homo sapiens
gacuauucuaauga

SEQ ID NO: 1209488 - RNA, 15 nt, Homo sapiens
gacucagacugcaug

SEQ ID NO: 1209489 - RNA, 22 nt, Homo sapiens
gacucagcuggaagucuaccug

SEQ ID NO: 1209490 - RNA, 12 nt, Homo sapiens
gacuccaugcug

SEQ ID NO: 1209491 - RNA, 13 nt, Homo sapiens
gacuccuaccugc

SEQ ID NO: 1209492 - RNA, 22 nt, Homo sapiens
gacuccuaccugcccuggaaca

SEQ ID NO: 1209493 - RNA, 13 nt, Homo sapiens
gacuccucaaaag

SEQ ID NO: 1209494 - RNA, 15 nt, Homo sapiens
gacuccucaaaagca

SEQ ID NO: 1209495 - RNA, 23 nt, Homo sapiens
gacuccucugggccuggggugca

SEQ ID NO: 1209496 - RNA, 22 nt, Homo sapiens
gacucuauuaaaaucuucaaua

SEQ ID NO: 1209497 - RNA, 15 nt, Homo sapiens
gacucuauucucaaa

SEQ ID NO: 1209498 - RNA, 16 nt, Homo sapiens
gacucuccagccaccc

SEQ ID NO: 1209499 - RNA, 23 nt, Homo sapiens
gacucugaaaaacauuccaggaa

SEQ ID NO: 1209500 - RNA, 14 nt, Homo sapiens
gacucugcacaugu

SEQ ID NO: 1209501 - RNA, 22 nt, Homo sapiens
gacucugggcugucagcccaug

SEQ ID NO: 1209502 - RNA, 14 nt, Homo sapiens
gacucugguguucu

SEQ ID NO: 1209503 - RNA, 23 nt, Homo sapiens
gacucuuuugagugguaaucaua

SEQ ID NO: 1209504 - RNA, 14 nt, Homo sapiens
gacugaaaauauau

SEQ ID NO: 1209505 - RNA, 13 nt, Homo sapiens
gacugaagaccag

SEQ ID NO: 1209506 - RNA, 19 nt, Homo sapiens
gacugaaggggcacaccac

SEQ ID NO: 1209507 - RNA, 13 nt, Homo sapiens
gacugaguccucg

SEQ ID NO: 1209508 - RNA, 14 nt, Homo sapiens
gacugauguguaua

SEQ ID NO: 1209509 - RNA, 16 nt, Homo sapiens
gacugcaaguggccau

SEQ ID NO: 1209510 - RNA, 22 nt, Homo sapiens
gacugccuucuccaucaugccc

SEQ ID NO: 1209511 - RNA, 18 nt, Homo sapiens
gacugcuaccucugagaa

SEQ ID NO: 1209512 - RNA, 17 nt, Homo sapiens
gacuggaagacacuuca

SEQ ID NO: 1209513 - RNA, 20 nt, Homo sapiens
gacuggaaugcagugacaca

SEQ ID NO: 1209514 - RNA, 16 nt, Homo sapiens
gacuggacgugcucag

SEQ ID NO: 1209515 - RNA, 15 nt, Homo sapiens
gacuggaggugggca

SEQ ID NO: 1209516 - RNA, 13 nt, Homo sapiens
gacuggcaauaaa

SEQ ID NO: 1209517 - RNA, 23 nt, Homo sapiens
gacuggcaauaaacuccuacuaa

SEQ ID NO: 1209518 - RNA, 10 nt, Homo sapiens
gacuggccag

SEQ ID NO: 1209519 - RNA, 18 nt, Homo sapiens
gacuggcuccaacacugc

SEQ ID NO: 1209520 - RNA, 16 nt, Homo sapiens
gacugguuuucugcca

SEQ ID NO: 1209521 - RNA, 16 nt, Homo sapiens
gacuguaaaugcucca

SEQ ID NO: 1209522 - RNA, 17 nt, Homo sapiens
gacuguaggauuugaag

SEQ ID NO: 1209523 - RNA, 15 nt, Homo sapiens
gacuguauuuuccaa

SEQ ID NO: 1209524 - RNA, 16 nt, Homo sapiens
gacugucucacuuaau

SEQ ID NO: 1209525 - RNA, 11 nt, Homo sapiens
gacugugccug

SEQ ID NO: 1209526 - RNA, 16 nt, Homo sapiens
gacuguugccacuuaa

SEQ ID NO: 1209527 - RNA, 14 nt, Homo sapiens
gacuguugcucaaa

SEQ ID NO: 1209528 - RNA, 16 nt, Homo sapiens
gacuucagucuugccu

SEQ ID NO: 1209529 - RNA, 17 nt, Homo sapiens
gacuucagucuugccua

SEQ ID NO: 1209530 - RNA, 15 nt, Homo sapiens
gacuuccagugcuca

SEQ ID NO: 1209531 - RNA, 19 nt, Homo sapiens
gacuuccgagcuaugucag

SEQ ID NO: 1209532 - RNA, 16 nt, Homo sapiens
gacuucuggcagggaa

SEQ ID NO: 1209533 - RNA, 21 nt, Homo sapiens
gacuugaacuagauugcaugc

SEQ ID NO: 1209534 - RNA, 23 nt, Homo sapiens
gacuuggacaggagucagugucu

SEQ ID NO: 1209535 - RNA, 16 nt, Homo sapiens
gacuuggggucaggaa

SEQ ID NO: 1209536 - RNA, 18 nt, Homo sapiens
gacuuggguugaacuaua

SEQ ID NO: 1209537 - RNA, 14 nt, Homo sapiens
gacuugguugaacu

SEQ ID NO: 1209538 - RNA, 23 nt, Homo sapiens
gacuuuagaaauaaauguaccug

SEQ ID NO: 1209539 - RNA, 23 nt, Homo sapiens
gacuuuauguuguaugauuccaa

SEQ ID NO: 1209540 - RNA, 21 nt, Homo sapiens
gacuuucugauuacuguccag

SEQ ID NO: 1209541 - RNA, 15 nt, Homo sapiens
gacuuugaagaccag

SEQ ID NO: 1209542 - RNA, 17 nt, Homo sapiens
gacuuuguauagaaggu

SEQ ID NO: 1209543 - RNA, 12 nt, Homo sapiens
gagaaaacaugc

SEQ ID NO: 1209544 - RNA, 22 nt, Homo sapiens
gagaaaauaaagaccuugcuua

SEQ ID NO: 1209545 - RNA, 15 nt, Homo sapiens
gagaaaaugccucaa

SEQ ID NO: 1209546 - RNA, 23 nt, Homo sapiens
gagaaaccagggagccccuuuga

SEQ ID NO: 1209547 - RNA, 23 nt, Homo sapiens
gagaaaggauugauuugaacuua

SEQ ID NO: 1209548 - RNA, 18 nt, Homo sapiens
gagaaaggcauuggccau

SEQ ID NO: 1209549 - RNA, 20 nt, Homo sapiens
gagaaauaaaaagccuguca

SEQ ID NO: 1209550 - RNA, 20 nt, Homo sapiens
gagaaauuugccuuguucaa

SEQ ID NO: 1209551 - RNA, 16 nt, Homo sapiens
gagaacaucuuugaca

SEQ ID NO: 1209552 - RNA, 16 nt, Homo sapiens
gagaacuauccaaaac

SEQ ID NO: 1209553 - RNA, 14 nt, Homo sapiens
gagaagacacugca

SEQ ID NO: 1209554 - RNA, 15 nt, Homo sapiens
gagaagauucuugua

SEQ ID NO: 1209555 - RNA, 17 nt, Homo sapiens
gagaagcaaguggcuuu

SEQ ID NO: 1209556 - RNA, 20 nt, Homo sapiens
gagaagcauauagaggcaag

SEQ ID NO: 1209557 - RNA, 22 nt, Homo sapiens
gagaagccuucagcuccaggga

SEQ ID NO: 1209558 - RNA, 22 nt, Homo sapiens
gagaagguauuagcaaagcaaa

SEQ ID NO: 1209559 - RNA, 23 nt, Homo sapiens
gagaagguauuagcaaagcaaaa

SEQ ID NO: 1209560 - RNA, 16 nt, Homo sapiens
gagaaggugcagguga

SEQ ID NO: 1209561 - RNA, 18 nt, Homo sapiens
gagaagucaaacauuuca

SEQ ID NO: 1209562 - RNA, 21 nt, Homo sapiens
gagaaguccagcucuucgccc

SEQ ID NO: 1209563 - RNA, 11 nt, Homo sapiens
gagaagugccu

SEQ ID NO: 1209564 - RNA, 13 nt, Homo sapiens
gagaaucacugca

SEQ ID NO: 1209565 - RNA, 21 nt, Homo sapiens
gagaaucccaaauuugauuga

SEQ ID NO: 1209566 - RNA, 13 nt, Homo sapiens
gagaaugccauuc

SEQ ID NO: 1209567 - RNA, 17 nt, Homo sapiens
gagaauguugaauacuu

SEQ ID NO: 1209568 - RNA, 23 nt, Homo sapiens
gagaauuuccaaaacuuuaauga

SEQ ID NO: 1209569 - RNA, 22 nt, Homo sapiens
gagacaaaccuuaaaacagcug

SEQ ID NO: 1209570 - RNA, 14 nt, Homo sapiens
gagacaacagguaa

SEQ ID NO: 1209571 - RNA, 19 nt, Homo sapiens
gagacaagggcaucaucua

SEQ ID NO: 1209572 - RNA, 15 nt, Homo sapiens
gagacacugugcuau

SEQ ID NO: 1209573 - RNA, 22 nt, Homo sapiens
gagacagaagccuggacucugc

SEQ ID NO: 1209574 - RNA, 14 nt, Homo sapiens
gagacagccucagc

SEQ ID NO: 1209575 - RNA, 22 nt, Homo sapiens
gagacagcugauacuucauuua

SEQ ID NO: 1209576 - RNA, 21 nt, Homo sapiens
gagugccguaacaacuguggu

SEQ ID NO: 1209577 - RNA, 16 nt, Homo sapiens
gaguggccagccagug

SEQ ID NO: 1209578 - RNA, 12 nt, Homo sapiens
gaguguagccua

SEQ ID NO: 1209579 - RNA, 15 nt, Homo sapiens
gagugucaagcugac

SEQ ID NO: 1209580 - RNA, 15 nt, Homo sapiens
gaguuaaaucucaaa

SEQ ID NO: 1209581 - RNA, 15 nt, Homo sapiens
gaguuaacugugaaa

SEQ ID NO: 1209582 - RNA, 14 nt, Homo sapiens
gaguuacaguucug

SEQ ID NO: 1209583 - RNA, 13 nt, Homo sapiens
gaguuagugccau

SEQ ID NO: 1209584 - RNA, 14 nt, Homo sapiens
gaguucaagaccag

SEQ ID NO: 1209585 - RNA, 14 nt, Homo sapiens
gaguucaguuuacu

SEQ ID NO: 1209586 - RNA, 22 nt, Homo sapiens
gaguucuugugccauagucaca

SEQ ID NO: 1209587 - RNA, 21 nt, Homo sapiens
gaguugcagccagggccagug

SEQ ID NO: 1209588 - RNA, 20 nt, Homo sapiens
gaguugcaugacuuggacac

SEQ ID NO: 1209589 - RNA, 20 nt, Homo sapiens
gaguugccaagacaaaucaa

SEQ ID NO: 1209590 - RNA, 16 nt, Homo sapiens
gaguuguacacugugu

SEQ ID NO: 1209591 - RNA, 17 nt, Homo sapiens
gaguugucaagucucug

SEQ ID NO: 1209592 - RNA, 14 nt, Homo sapiens
gaguugugaugaau

SEQ ID NO: 1209593 - RNA, 19 nt, Homo sapiens
gaguuguuuaaacagucaa

SEQ ID NO: 1209594 - RNA, 22 nt, Homo sapiens
gaguuuaauuuuugaaaacugg

SEQ ID NO: 1209595 - RNA, 23 nt, Homo sapiens
gaguuuuuaguggaagcuucuaa

SEQ ID NO: 1209596 - RNA, 18 nt, Homo sapiens
gauaaaaaaauuguuauu

SEQ ID NO: 1209597 - RNA, 14 nt, Homo sapiens
gauaaaauuaauuu

SEQ ID NO: 1209598 - RNA, 17 nt, Homo sapiens
gauaaagagacagugau

SEQ ID NO: 1209599 - RNA, 16 nt, Homo sapiens
gauaaagaugcaagga

SEQ ID NO: 1209600 - RNA, 16 nt, Homo sapiens
gauaaaguuugcuaag

SEQ ID NO: 1209601 - RNA, 14 nt, Homo sapiens
gauaaaucauuuca

SEQ ID NO: 1209602 - RNA, 18 nt, Homo sapiens
gauaacaguuacuccagu

SEQ ID NO: 1209603 - RNA, 22 nt, Homo sapiens
gauaacaugcuuuggguggaau

SEQ ID NO: 1209604 - RNA, 17 nt, Homo sapiens
gauaaccuugugccuug

SEQ ID NO: 1209605 - RNA, 18 nt, Homo sapiens
uugucauuuuuaauauua

SEQ ID NO: 1209606 - RNA, 15 nt, Homo sapiens
uuguccaucuugaga

SEQ ID NO: 1209607 - RNA, 16 nt, Homo sapiens
uugucccugugccuaa

SEQ ID NO: 1209608 - RNA, 16 nt, Homo sapiens
uugucgguuaccucug

SEQ ID NO: 1209609 - RNA, 18 nt, Homo sapiens
uugucuaaacaaugcuga

SEQ ID NO: 1209610 - RNA, 18 nt, Homo sapiens
uugucucauuguuuucuu

SEQ ID NO: 1209611 - RNA, 22 nt, Homo sapiens
uugucugaacuugcauugugau

SEQ ID NO: 1209612 - RNA, 17 nt, Homo sapiens
uugucugagucuugggu

SEQ ID NO: 1209613 - RNA, 14 nt, Homo sapiens
uugucugguccuga

SEQ ID NO: 1209614 - RNA, 13 nt, Homo sapiens
uugucuguucacu

SEQ ID NO: 1209615 - RNA, 15 nt, Homo sapiens
uugucuguucacuuu

SEQ ID NO: 1209616 - RNA, 17 nt, Homo sapiens
uugucuuauuacagcau

SEQ ID NO: 1209617 - RNA, 17 nt, Homo sapiens
uugucuucaaacuguga

SEQ ID NO: 1209618 - RNA, 12 nt, Homo sapiens
uugugaacugga

SEQ ID NO: 1209619 - RNA, 18 nt, Homo sapiens
uugugaauuaggcuguaa

SEQ ID NO: 1209620 - RNA, 13 nt, Homo sapiens
uugugaauuguga

SEQ ID NO: 1209621 - RNA, 20 nt, Homo sapiens
uugugacaggaaagcccucc

SEQ ID NO: 1209622 - RNA, 20 nt, Homo sapiens
uugugacauuguaguaggga

SEQ ID NO: 1209623 - RNA, 15 nt, Homo sapiens
uugugagccagcagc

SEQ ID NO: 1209624 - RNA, 15 nt, Homo sapiens
uugugauagcacuuu

SEQ ID NO: 1209625 - RNA, 19 nt, Homo sapiens
uugugaugaugcugugaca

SEQ ID NO: 1209626 - RNA, 20 nt, Homo sapiens
uugugaugaugcugugacaa

SEQ ID NO: 1209627 - RNA, 15 nt, Homo sapiens
uugugaugucuuuuc

SEQ ID NO: 1209628 - RNA, 15 nt, Homo sapiens
uugugcaaagccaaa

SEQ ID NO: 1209629 - RNA, 14 nt, Homo sapiens
uugugccaauaugu

SEQ ID NO: 1209630 - RNA, 23 nt, Homo sapiens
uugugcuauuaggaaauucugau

SEQ ID NO: 1209631 - RNA, 22 nt, Homo sapiens
uugugcucaaaauaaaaagccu

SEQ ID NO: 1209632 - RNA, 21 nt, Homo sapiens
uugugcugcaccuggucauac

SEQ ID NO: 1209633 - RNA, 15 nt, Homo sapiens
uugugggauacuauu

SEQ ID NO: 1209634 - RNA, 13 nt, Homo sapiens
uuguggggcuccc

SEQ ID NO: 1209635 - RNA, 14 nt, Homo sapiens
uuguggugcauuga

SEQ ID NO: 1209636 - RNA, 21 nt, Homo sapiens
uuguguaaugaaaaugaauau

SEQ ID NO: 1209637 - RNA, 17 nt, Homo sapiens
uuguguagaaagccaaa

SEQ ID NO: 1209638 - RNA, 22 nt, Homo sapiens
uuguguaucuguuuacauccag

SEQ ID NO: 1209639 - RNA, 15 nt, Homo sapiens
uugugucuguacacg

SEQ ID NO: 1209640 - RNA, 13 nt, Homo sapiens
uugugugaugcgc

SEQ ID NO: 1209641 - RNA, 22 nt, Homo sapiens
uugugugcucauguaugugcga

SEQ ID NO: 1209642 - RNA, 16 nt, Homo sapiens
uuguguguaugcugau

SEQ ID NO: 1209643 - RNA, 14 nt, Homo sapiens
uugugugucacaag

SEQ ID NO: 1209644 - RNA, 19 nt, Homo sapiens
uuguguucguggaacacau

SEQ ID NO: 1209645 - RNA, 18 nt, Homo sapiens
uuguuacauuauguggaa

SEQ ID NO: 1209646 - RNA, 17 nt, Homo sapiens
uuguuacuguucuugcu

SEQ ID NO: 1209647 - RNA, 17 nt, Homo sapiens
uuguuacuucugaggua

SEQ ID NO: 1209648 - RNA, 13 nt, Homo sapiens
uuguuauaccauu

SEQ ID NO: 1209649 - RNA, 14 nt, Homo sapiens
uuguuauguaaaac

SEQ ID NO: 1209650 - RNA, 21 nt, Homo sapiens
uuguuauucgaaccacugaga

SEQ ID NO: 1209651 - RNA, 13 nt, Homo sapiens
uuguuauuuugga

SEQ ID NO: 1209652 - RNA, 11 nt, Homo sapiens
uuguucaauua

SEQ ID NO: 1209653 - RNA, 20 nt, Homo sapiens
uuguucauuauuggagggua

SEQ ID NO: 1209654 - RNA, 17 nt, Homo sapiens
uuguucgggugugcaau

SEQ ID NO: 1209655 - RNA, 17 nt, Homo sapiens
uuguucuuaauugcacu

SEQ ID NO: 1209656 - RNA, 15 nt, Homo sapiens
uuguucuuacaguua

SEQ ID NO: 1209657 - RNA, 14 nt, Homo sapiens
uuguugcagccaaa

SEQ ID NO: 1209658 - RNA, 13 nt, Homo sapiens
uuguugguggaga

SEQ ID NO: 1209659 - RNA, 22 nt, Homo sapiens
uuguuuaauuuuuauuucuucc

SEQ ID NO: 1209660 - RNA, 19 nt, Homo sapiens
uuguuucaaccaagucaug

SEQ ID NO: 1209661 - RNA, 14 nt, Homo sapiens
uuguuucuguagaa

SEQ ID NO: 1209662 - RNA, 15 nt, Homo sapiens
uuguuucuuuucaca

SEQ ID NO: 1209663 - RNA, 22 nt, Homo sapiens
uuguuugaaaaagcagacagaa

SEQ ID NO: 1209664 - RNA, 14 nt, Homo sapiens
uuguuuggugaauu

SEQ ID NO: 1209665 - RNA, 17 nt, Homo sapiens
uuguuuucacuuguauu

SEQ ID NO: 1209666 - RNA, 19 nt, Homo sapiens
uuguuuugacggaugauug

SEQ ID NO: 1209667 - RNA, 12 nt, Homo sapiens
uuguuuugugaa

SEQ ID NO: 1209668 - RNA, 20 nt, Homo sapiens
uuuaaaaaaaaaaguuacag

SEQ ID NO: 1209669 - RNA, 19 nt, Homo sapiens
uuuaaaaaaagaacauaaa

SEQ ID NO: 1209670 - RNA, 23 nt, Homo sapiens
uuuaaaaaaauacaguauucugu

SEQ ID NO: 1209671 - RNA, 14 nt, Homo sapiens
uuuaaaaaugcacc

SEQ ID NO: 1209672 - RNA, 13 nt, Homo sapiens
uuuaaaacaucau

SEQ ID NO: 1209673 - RNA, 20 nt, Homo sapiens
uuuaaaaccugugugccauu

SEQ ID NO: 1209674 - RNA, 18 nt, Homo sapiens
uuuaaaacgcaugugcag

SEQ ID NO: 1209675 - RNA, 18 nt, Homo sapiens
uuuaaaaggauuaaucug

SEQ ID NO: 1209676 - RNA, 17 nt, Homo sapiens
uuuaaaaguuucaaugu

SEQ ID NO: 1209677 - RNA, 15 nt, Homo sapiens
uuuaaaauaaauucc

SEQ ID NO: 1209678 - RNA, 20 nt, Homo sapiens
uuuaaaauaaauuccuacaa

SEQ ID NO: 1209679 - RNA, 19 nt, Homo sapiens
uuuaaaccuuuuucuugau

SEQ ID NO: 1209680 - RNA, 13 nt, Homo sapiens
uuuaaacuaugau

SEQ ID NO: 1209681 - RNA, 15 nt, Homo sapiens
uuuaaacucagggac

SEQ ID NO: 1209682 - RNA, 12 nt, Homo sapiens
uuuaaacugcau

SEQ ID NO: 1209683 - RNA, 15 nt, Homo sapiens
uuuaaagcacaugcc

SEQ ID NO: 1209684 - RNA, 14 nt, Homo sapiens
uuuaaagccuccuc

SEQ ID NO: 1209685 - RNA, 20 nt, Homo sapiens
uuuaaaggaaaaucacaucu

SEQ ID NO: 1209686 - RNA, 10 nt, Homo sapiens
uuuaaagggu

SEQ ID NO: 1209687 - RNA, 21 nt, Homo sapiens
uuuaaaguauguuauugcaua

SEQ ID NO: 1209688 - RNA, 15 nt, Homo sapiens
uuuaaaguucugugu

SEQ ID NO: 1209689 - RNA, 17 nt, Homo sapiens
uuuaaauaaaagcacaa

SEQ ID NO: 1209690 - RNA, 14 nt, Homo sapiens
uuuaaaucugugau

SEQ ID NO: 1209691 - RNA, 13 nt, Homo sapiens
uuuaaauguuacu

SEQ ID NO: 1209692 - RNA, 19 nt, Homo sapiens
uuuaacaaaucuaaucucu

SEQ ID NO: 1209693 - RNA, 13 nt, Homo sapiens
uuuaacaauaacu

SEQ ID NO: 1209694 - RNA, 14 nt, Homo sapiens
uuuaacagcugaau

SEQ ID NO: 1209695 - RNA, 18 nt, Homo sapiens
uuuaacccuaaucuuuca

SEQ ID NO: 1209696 - RNA, 21 nt, Homo sapiens
uuuaacuagaauuuauucaau

SEQ ID NO: 1209697 - RNA, 13 nt, Homo sapiens
uuuaacugugaac

SEQ ID NO: 1209698 - RNA, 20 nt, Homo sapiens
uuuaacuuuaaccacaguga

SEQ ID NO: 1209699 - RNA, 15 nt, Homo sapiens
uuuaagaaacauucu

SEQ ID NO: 1209700 - RNA, 16 nt, Homo sapiens
uuuaagaacaauguug

SEQ ID NO: 1209701 - RNA, 15 nt, Homo sapiens
uuuaagaauuucaca

SEQ ID NO: 1209702 - RNA, 16 nt, Homo sapiens
uuuaagauaaacagaa

SEQ ID NO: 1209703 - RNA, 22 nt, Homo sapiens
uuuaagcagcucuugcuaauca

SEQ ID NO: 1209704 - RNA, 15 nt, Homo sapiens
uuuaagcagucucac

SEQ ID NO: 1209705 - RNA, 23 nt, Homo sapiens
uuuaagcuaucagcaauacucau

SEQ ID NO: 1209706 - RNA, 15 nt, Homo sapiens
uuuaaggauguugcc

SEQ ID NO: 1209707 - RNA, 23 nt, Homo sapiens
uuuaaggauguugccacuggcaa

SEQ ID NO: 1209708 - RNA, 18 nt, Homo sapiens
uuuaagugcguguguaga

SEQ ID NO: 1209709 - RNA, 20 nt, Homo sapiens
uuuaauaaaugguuuauucu

SEQ ID NO: 1209710 - RNA, 22 nt, Homo sapiens
uuuaauacaggguagauaaccu

SEQ ID NO: 1209711 - RNA, 14 nt, Homo sapiens
uuuaauaccagaua

SEQ ID NO: 1209712 - RNA, 21 nt, Homo sapiens
uuuaauagggaauauaucucu

SEQ ID NO: 1209713 - RNA, 16 nt, Homo sapiens
uuuaaucaaguugaau

SEQ ID NO: 1209714 - RNA, 23 nt, Homo sapiens
uuuaauccuguaccaaaucugac

SEQ ID NO: 1209715 - RNA, 17 nt, Homo sapiens
uuuaauggcaugucaga

SEQ ID NO: 1209716 - RNA, 18 nt, Homo sapiens
uuguagccagguacugca

SEQ ID NO: 1209717 - RNA, 16 nt, Homo sapiens
uuguagugugugcuua

SEQ ID NO: 1209718 - RNA, 13 nt, Homo sapiens
uuguauaauuucg

SEQ ID NO: 1209719 - RNA, 23 nt, Homo sapiens
uuguauauuacacauuuguacag

SEQ ID NO: 1209720 - RNA, 17 nt, Homo sapiens
uuguaucaaagugugau

SEQ ID NO: 1209721 - RNA, 19 nt, Homo sapiens
uuguaucaacacuguuacu

SEQ ID NO: 1209722 - RNA, 15 nt, Homo sapiens
uuguaugagguuuga

SEQ ID NO: 1209723 - RNA, 15 nt, Homo sapiens
uuguauuuauuccau

SEQ ID NO: 1209724 - RNA, 22 nt, Homo sapiens
uuguauuuuaacucauaccuuu

SEQ ID NO: 1209725 - RNA, 17 nt, Homo sapiens
uuguauuuugugugacc

SEQ ID NO: 1209726 - RNA, 17 nt, Homo sapiens
uugucaaaaaguuccau

SEQ ID NO: 1209727 - RNA, 13 nt, Homo sapiens
uugucaaacugua

SEQ ID NO: 1209728 - RNA, 19 nt, Homo sapiens
uugucaaagaagucauucu

SEQ ID NO: 1209729 - RNA, 14 nt, Homo sapiens
uugucacagguuuu

SEQ ID NO: 1209730 - RNA, 16 nt, Homo sapiens
uugucagaaaccugca

SEQ ID NO: 1209731 - RNA, 19 nt, Homo sapiens
uugucagaaaccugcaggg

SEQ ID NO: 1209732 - RNA, 15 nt, Homo sapiens
uugucagcaguuccc

SEQ ID NO: 1209733 - RNA, 19 nt, Homo sapiens
uugucauugaaauuuggca

SEQ ID NO: 1209734 - RNA, 13 nt, Homo sapiens
cuggcgugcagug

SEQ ID NO: 1209735 - RNA, 15 nt, Homo sapiens
cuggcucacaguaca

SEQ ID NO: 1209736 - RNA, 14 nt, Homo sapiens
cuggcucucuccag

SEQ ID NO: 1209737 - RNA, 15 nt, Homo sapiens
cuggcucuguuugau

SEQ ID NO: 1209738 - RNA, 20 nt, Homo sapiens
cuggcugggaacaacuucag

SEQ ID NO: 1209739 - RNA, 20 nt, Homo sapiens
cuggcugucaguaugacauu

SEQ ID NO: 1209740 - RNA, 21 nt, Homo sapiens
cugggaacaacuucaguccaa

SEQ ID NO: 1209741 - RNA, 22 nt, Homo sapiens
cugggaacaacuucaguccaac

SEQ ID NO: 1209742 - RNA, 16 nt, Homo sapiens
cugggaaccacuccca

SEQ ID NO: 1209743 - RNA, 13 nt, Homo sapiens
cugggaaccagca

SEQ ID NO: 1209744 - RNA, 18 nt, Homo sapiens
cugggaaccagcaucuca

SEQ ID NO: 1209745 - RNA, 16 nt, Homo sapiens
cugggacaaccucauc

SEQ ID NO: 1209746 - RNA, 18 nt, Homo sapiens
cugggacacuuaacagau

SEQ ID NO: 1209747 - RNA, 17 nt, Homo sapiens
cugggaccucccacugc

SEQ ID NO: 1209748 - RNA, 15 nt, Homo sapiens
cugggaccuccuuag

SEQ ID NO: 1209749 - RNA, 17 nt, Homo sapiens
cugggacuacaggugug

SEQ ID NO: 1209750 - RNA, 18 nt, Homo sapiens
cugggacuucuuacccaa

SEQ ID NO: 1209751 - RNA, 16 nt, Homo sapiens
cugggagacugaagac

SEQ ID NO: 1209752 - RNA, 15 nt, Homo sapiens
cugggagacuuugaa

SEQ ID NO: 1209753 - RNA, 21 nt, Homo sapiens
cugggagacuuugaagaccag

SEQ ID NO: 1209754 - RNA, 18 nt, Homo sapiens
cugggagucacacagugu

SEQ ID NO: 1209755 - RNA, 18 nt, Homo sapiens
cugggauauggcugccca

SEQ ID NO: 1209756 - RNA, 14 nt, Homo sapiens
cugggauguagaac

SEQ ID NO: 1209757 - RNA, 15 nt, Homo sapiens
cugggauguuuugag

SEQ ID NO: 1209758 - RNA, 18 nt, Homo sapiens
cugggauuacaagcguga

SEQ ID NO: 1209759 - RNA, 22 nt, Homo sapiens
cugggauuacaggcaugagcca

SEQ ID NO: 1209760 - RNA, 21 nt, Homo sapiens
cugggcaacagaugaagaccc

SEQ ID NO: 1209761 - RNA, 18 nt, Homo sapiens
cugggcagcauacugaga

SEQ ID NO: 1209762 - RNA, 17 nt, Homo sapiens
cugggcagccuuuccag

SEQ ID NO: 1209763 - RNA, 22 nt, Homo sapiens
cugggcauauccaccaccuccc

SEQ ID NO: 1209764 - RNA, 22 nt, Homo sapiens
cugggccaaguuccucuagugc

SEQ ID NO: 1209765 - RNA, 15 nt, Homo sapiens
cugggccacugggga

SEQ ID NO: 1209766 - RNA, 18 nt, Homo sapiens
cugggccauguccaaaga

SEQ ID NO: 1209767 - RNA, 16 nt, Homo sapiens
cugggcccaagacaga

SEQ ID NO: 1209768 - RNA, 16 nt, Homo sapiens
cugggcugugcugcuu

SEQ ID NO: 1209769 - RNA, 19 nt, Homo sapiens
cuggggaauaaacuccagc

SEQ ID NO: 1209770 - RNA, 14 nt, Homo sapiens
cuggggcaauggga

SEQ ID NO: 1209771 - RNA, 19 nt, Homo sapiens
cuggggcagaaagccacaa

SEQ ID NO: 1209772 - RNA, 18 nt, Homo sapiens
cuggggcaggucacuuua

SEQ ID NO: 1209773 - RNA, 20 nt, Homo sapiens
cuggggccuacagcuuugau

SEQ ID NO: 1209774 - RNA, 19 nt, Homo sapiens
cuggggccuagcgaucucu

SEQ ID NO: 1209775 - RNA, 15 nt, Homo sapiens
cuggggcggggccca

SEQ ID NO: 1209776 - RNA, 14 nt, Homo sapiens
cuggggcucugugc

SEQ ID NO: 1209777 - RNA, 16 nt, Homo sapiens
cugggggugucccugg

SEQ ID NO: 1209778 - RNA, 20 nt, Homo sapiens
cuggggucacccucuccagc

SEQ ID NO: 1209779 - RNA, 21 nt, Homo sapiens
cuggggucuccuauacucuau

SEQ ID NO: 1209780 - RNA, 21 nt, Homo sapiens
cuggggugcauccuccucagc

SEQ ID NO: 1209781 - RNA, 20 nt, Homo sapiens
cuggguaagaagaaagcaaa

SEQ ID NO: 1209782 - RNA, 22 nt, Homo sapiens
cugggucuuucugacaucagca

SEQ ID NO: 1209783 - RNA, 14 nt, Homo sapiens
cugggugaccucac

SEQ ID NO: 1209784 - RNA, 19 nt, Homo sapiens
cuggguggacuuugggacc

SEQ ID NO: 1209785 - RNA, 20 nt, Homo sapiens
cuggguucccuuuccuucca

SEQ ID NO: 1209786 - RNA, 16 nt, Homo sapiens
cuggguuggugcacag

SEQ ID NO: 1209787 - RNA, 17 nt, Homo sapiens
cuggguuucaugagcuu

SEQ ID NO: 1209788 - RNA, 21 nt, Homo sapiens
cugguaacaguucauguuugc

SEQ ID NO: 1209789 - RNA, 22 nt, Homo sapiens
cugguaauauugacuuguauau

SEQ ID NO: 1209790 - RNA, 20 nt, Homo sapiens
cugguaauuuaagauuccag

SEQ ID NO: 1209791 - RNA, 20 nt, Homo sapiens
cugguacuauugugaccaca

SEQ ID NO: 1209792 - RNA, 16 nt, Homo sapiens
cugguagaaauaccca

SEQ ID NO: 1209793 - RNA, 13 nt, Homo sapiens
cugguagcacuug

SEQ ID NO: 1209794 - RNA, 17 nt, Homo sapiens
cugguagguugggacac

SEQ ID NO: 1209795 - RNA, 16 nt, Homo sapiens
cugguauguguggaug

SEQ ID NO: 1209796 - RNA, 17 nt, Homo sapiens
cuggucagaugauauaa

SEQ ID NO: 1209797 - RNA, 23 nt, Homo sapiens
cuggucauggaauggcagguguc

SEQ ID NO: 1209798 - RNA, 20 nt, Homo sapiens
cucuccuggcacccagagaa

SEQ ID NO: 1209799 - RNA, 17 nt, Homo sapiens
cucucuagaaccuucua

SEQ ID NO: 1209800 - RNA, 22 nt, Homo sapiens
cucucucaaaagagaaaaacaa

SEQ ID NO: 1209801 - RNA, 22 nt, Homo sapiens
cucucuccuuucagggccaauc

SEQ ID NO: 1209802 - RNA, 19 nt, Homo sapiens
cucucuuccagcugcuuca

SEQ ID NO: 1209803 - RNA, 23 nt, Homo sapiens
cucucuuuaaaucaaguccuuua

SEQ ID NO: 1209804 - RNA, 17 nt, Homo sapiens
cucugaaacggauccag

SEQ ID NO: 1209805 - RNA, 15 nt, Homo sapiens
cucugaaagaccuau

SEQ ID NO: 1209806 - RNA, 21 nt, Homo sapiens
cucugaaagaccuaugagcaa

SEQ ID NO: 1209807 - RNA, 21 nt, Homo sapiens
cucugaaauuggucacuuucc

SEQ ID NO: 1209808 - RNA, 16 nt, Homo sapiens
cucugaacuugccuua

SEQ ID NO: 1209809 - RNA, 17 nt, Homo sapiens
cucugaacuugccuuaa

SEQ ID NO: 1209810 - RNA, 21 nt, Homo sapiens
cucugacaagggcugaccugc

SEQ ID NO: 1209811 - RNA, 18 nt, Homo sapiens
cucugacgcaaaaccacu

SEQ ID NO: 1209812 - RNA, 23 nt, Homo sapiens
cucugacgcaaaaccacuuuccu

SEQ ID NO: 1209813 - RNA, 19 nt, Homo sapiens
cucugagaagacacaaggu

SEQ ID NO: 1209814 - RNA, 17 nt, Homo sapiens
cucugaggcuauggagg

SEQ ID NO: 1209815 - RNA, 16 nt, Homo sapiens
cucugcacuacugaca

SEQ ID NO: 1209816 - RNA, 18 nt, Homo sapiens
cucugcagaacagugaaa

SEQ ID NO: 1209817 - RNA, 20 nt, Homo sapiens
cucugcagacuucccagcua

SEQ ID NO: 1209818 - RNA, 18 nt, Homo sapiens
cucugcaguaaaacacau

SEQ ID NO: 1209819 - RNA, 18 nt, Homo sapiens
cucugcaugacaaacaca

SEQ ID NO: 1209820 - RNA, 20 nt, Homo sapiens
cucugccaaaggaugugaua

SEQ ID NO: 1209821 - RNA, 21 nt, Homo sapiens
cucugccaaaggaugugauau

SEQ ID NO: 1209822 - RNA, 13 nt, Homo sapiens
cucugccaccaga

SEQ ID NO: 1209823 - RNA, 20 nt, Homo sapiens
cucugccacccacucaggau

SEQ ID NO: 1209824 - RNA, 11 nt, Homo sapiens
cucugccagug

SEQ ID NO: 1209825 - RNA, 13 nt, Homo sapiens
cucugccagugac

SEQ ID NO: 1209826 - RNA, 17 nt, Homo sapiens
cucugccgcuaccuccc

SEQ ID NO: 1209827 - RNA, 20 nt, Homo sapiens
cucugccuacagaacuucag

SEQ ID NO: 1209828 - RNA, 17 nt, Homo sapiens
cucugccuccucuucaa

SEQ ID NO: 1209829 - RNA, 20 nt, Homo sapiens
cucugccuuggggaggcuga

SEQ ID NO: 1209830 - RNA, 19 nt, Homo sapiens
cucugcuauuugcuguuau

SEQ ID NO: 1209831 - RNA, 21 nt, Homo sapiens
cucugcuccagguucacuuug

SEQ ID NO: 1209832 - RNA, 11 nt, Homo sapiens
cucugcucccu

SEQ ID NO: 1209833 - RNA, 16 nt, Homo sapiens
cucugcuucaguccac

SEQ ID NO: 1209834 - RNA, 19 nt, Homo sapiens
cucugcuuccagcaguauu

SEQ ID NO: 1209835 - RNA, 17 nt, Homo sapiens
cucuggaaaaagacuga

SEQ ID NO: 1209836 - RNA, 16 nt, Homo sapiens
cucuggaccauauacc

SEQ ID NO: 1209837 - RNA, 21 nt, Homo sapiens
cucuggacucuaaagaccaaa

SEQ ID NO: 1209838 - RNA, 20 nt, Homo sapiens
cucuggagcaauguugcuua

SEQ ID NO: 1209839 - RNA, 14 nt, Homo sapiens
cucuggaggagcaa

SEQ ID NO: 1209840 - RNA, 15 nt, Homo sapiens
cucuggaggccugug

SEQ ID NO: 1209841 - RNA, 23 nt, Homo sapiens
cucuggccaggauggaggggugg

SEQ ID NO: 1209842 - RNA, 22 nt, Homo sapiens
cucuggcggcuuccuguccacu

SEQ ID NO: 1209843 - RNA, 22 nt, Homo sapiens
cucuggcucucaugggguccaa

SEQ ID NO: 1209844 - RNA, 15 nt, Homo sapiens
cucugggaagugugg

SEQ ID NO: 1209845 - RNA, 21 nt, Homo sapiens
cucugggaauuuggagugacc

SEQ ID NO: 1209846 - RNA, 15 nt, Homo sapiens
cucuggggcauuauc

SEQ ID NO: 1209847 - RNA, 22 nt, Homo sapiens
cucuggggucuuuuuaugcauu

SEQ ID NO: 1209848 - RNA, 21 nt, Homo sapiens
cucuggggugcugagugagcu

SEQ ID NO: 1209849 - RNA, 14 nt, Homo sapiens
cucuggguggggcu

SEQ ID NO: 1209850 - RNA, 22 nt, Homo sapiens
cucugguaaaugaucacuccag

SEQ ID NO: 1209851 - RNA, 22 nt, Homo sapiens
cucuggucccagcauccagcug

SEQ ID NO: 1209852 - RNA, 13 nt, Homo sapiens
cucugguggcaca

SEQ ID NO: 1209853 - RNA, 17 nt, Homo sapiens
cucugguuagaaaaagg

SEQ ID NO: 1209854 - RNA, 14 nt, Homo sapiens
cucuguaauugaau

SEQ ID NO: 1209855 - RNA, 15 nt, Homo sapiens
cucuguaauugaaua

SEQ ID NO: 1209856 - RNA, 22 nt, Homo sapiens
cucuguagggaacucugggguc

SEQ ID NO: 1209857 - RNA, 13 nt, Homo sapiens
cucuguauguacu

SEQ ID NO: 1209858 - RNA, 22 nt, Homo sapiens
cucuguauuacagcuuucacag

SEQ ID NO: 1209859 - RNA, 19 nt, Homo sapiens
cucuguauuccgauacaaa

SEQ ID NO: 1209860 - RNA, 22 nt, Homo sapiens
cucuguauuccgauacaaagug

SEQ ID NO: 1209861 - RNA, 15 nt, Homo sapiens
cucuguccaaucagg

SEQ ID NO: 1209862 - RNA, 15 nt, Homo sapiens
cucuguccuacuucu

SEQ ID NO: 1209863 - RNA, 23 nt, Homo sapiens
cucugucuugggcguuugaacuc

SEQ ID NO: 1209864 - RNA, 21 nt, Homo sapiens
cucugugaacgauuuagaaag

SEQ ID NO: 1209865 - RNA, 17 nt, Homo sapiens
cucugugcccuccagca

SEQ ID NO: 1209866 - RNA, 20 nt, Homo sapiens
cucugugcugacauggcucu

SEQ ID NO: 1209867 - RNA, 15 nt, Homo sapiens
cucuguuauguacug

SEQ ID NO: 1209868 - RNA, 16 nt, Homo sapiens
cucuguuauguacugu

SEQ ID NO: 1209869 - RNA, 12 nt, Homo sapiens
cucuuaagccua

SEQ ID NO: 1209870 - RNA, 23 nt, Homo sapiens
cucuuaagucccaguauaccuca

SEQ ID NO: 1209871 - RNA, 14 nt, Homo sapiens
cucuuaauguugcu

SEQ ID NO: 1209872 - RNA, 15 nt, Homo sapiens
cucuuagcacacuca

SEQ ID NO: 1209873 - RNA, 19 nt, Homo sapiens
cucuuagcuuucucagggg

SEQ ID NO: 1209874 - RNA, 14 nt, Homo sapiens
cucuuaugccauuu

SEQ ID NO: 1209875 - RNA, 18 nt, Homo sapiens
cucuuaugugugccuuug

SEQ ID NO: 1209876 - RNA, 13 nt, Homo sapiens
cucuuauugcaaa

SEQ ID NO: 1209877 - RNA, 13 nt, Homo sapiens
cucuucacagucc

SEQ ID NO: 1209878 - RNA, 22 nt, Homo sapiens
cucuucagaacacacagacuuu

SEQ ID NO: 1209879 - RNA, 15 nt, Homo sapiens
cucuucagugacucc

SEQ ID NO: 1209880 - RNA, 13 nt, Homo sapiens
cucuucccaugac

SEQ ID NO: 1209881 - RNA, 15 nt, Homo sapiens
cucuucccaugacug

SEQ ID NO: 1209882 - RNA, 16 nt, Homo sapiens
cucuuccuaaguauau

SEQ ID NO: 1209883 - RNA, 15 nt, Homo sapiens
cucuuccuacccucc

SEQ ID NO: 1209884 - RNA, 22 nt, Homo sapiens
cucuuccuccucgcugccagau

SEQ ID NO: 1209885 - RNA, 12 nt, Homo sapiens
cucuuccugacg

SEQ ID NO: 1209886 - RNA, 14 nt, Homo sapiens
cucuuccugugauc

SEQ ID NO: 1209887 - RNA, 14 nt, Homo sapiens
cucuucuaacacaa

SEQ ID NO: 1209888 - RNA, 14 nt, Homo sapiens
cucuucuuacuggu

SEQ ID NO: 1209889 - RNA, 13 nt, Homo sapiens
cucuucuuuaugu

SEQ ID NO: 1209890 - RNA, 19 nt, Homo sapiens
cucuugaaaucuguuaaaa

SEQ ID NO: 1209891 - RNA, 14 nt, Homo sapiens
cucuugaaccacag

SEQ ID NO: 1209892 - RNA, 12 nt, Homo sapiens
cucuugagaaau

SEQ ID NO: 1209893 - RNA, 18 nt, Homo sapiens
cucuugccuuuuacuuaa

SEQ ID NO: 1209894 - RNA, 14 nt, Homo sapiens
cucuugcucaguga

SEQ ID NO: 1209895 - RNA, 14 nt, Homo sapiens
cucuuggcagucac

SEQ ID NO: 1209896 - RNA, 21 nt, Homo sapiens
cucuuguauaugaugaucugg

SEQ ID NO: 1209897 - RNA, 14 nt, Homo sapiens
cucuugucaaaagg

SEQ ID NO: 1209898 - RNA, 17 nt, Homo sapiens
cucuuguggugcauuga

SEQ ID NO: 1209899 - RNA, 21 nt, Homo sapiens
cucuuuaguauaauugaccua

SEQ ID NO: 1209900 - RNA, 15 nt, Homo sapiens
cucuuucccaacccc

SEQ ID NO: 1209901 - RNA, 15 nt, Homo sapiens
cucuuucuacucuga

SEQ ID NO: 1209902 - RNA, 18 nt, Homo sapiens
cucuuugacaauuccuag

SEQ ID NO: 1209903 - RNA, 18 nt, Homo sapiens
cucuuuguucucagcucc

SEQ ID NO: 1209904 - RNA, 15 nt, Homo sapiens
cugaaaaucuaauau

SEQ ID NO: 1209905 - RNA, 17 nt, Homo sapiens
cugaaacaaaaaugcca

SEQ ID NO: 1209906 - RNA, 20 nt, Homo sapiens
cugaaacauucacacagggc

SEQ ID NO: 1209907 - RNA, 12 nt, Homo sapiens
cugaaaccaaaa

SEQ ID NO: 1209908 - RNA, 13 nt, Homo sapiens
cugaaaccaaaac

SEQ ID NO: 1209909 - RNA, 12 nt, Homo sapiens
cugaaacugcag

SEQ ID NO: 1209910 - RNA, 21 nt, Homo sapiens
cugaaagaacauggacuugua

SEQ ID NO: 1209911 - RNA, 14 nt, Homo sapiens
cugaaagaagacau

SEQ ID NO: 1209912 - RNA, 20 nt, Homo sapiens
cugaaagaccuaugagcaaa

SEQ ID NO: 1209913 - RNA, 23 nt, Homo sapiens
cugaaagacuuggguugaacuau

SEQ ID NO: 1209914 - RNA, 16 nt, Homo sapiens
cugaaagaucuuucag

SEQ ID NO: 1209915 - RNA, 20 nt, Homo sapiens
cugaaagauugauuaaugaa

SEQ ID NO: 1209916 - RNA, 18 nt, Homo sapiens
cugaaaggggcagauuaa

SEQ ID NO: 1209917 - RNA, 16 nt, Homo sapiens
cugaaauaaacacugg

SEQ ID NO: 1209918 - RNA, 20 nt, Homo sapiens
cugaaauuggucacuuuccu

SEQ ID NO: 1209919 - RNA, 22 nt, Homo sapiens
cugaaauuuaagauaaugaguu

SEQ ID NO: 1209920 - RNA, 23 nt, Homo sapiens
cugaaauuuuaauugaacuaaca

SEQ ID NO: 1209921 - RNA, 16 nt, Homo sapiens
cugaacaaaauaaagu

SEQ ID NO: 1209922 - RNA, 20 nt, Homo sapiens
cugaacaaaauaaaguguug

SEQ ID NO: 1209923 - RNA, 21 nt, Homo sapiens
cugaacaaaauguaaagccag

SEQ ID NO: 1209924 - RNA, 22 nt, Homo sapiens
cugaacaaaauguaaagccagc

SEQ ID NO: 1209925 - RNA, 19 nt, Homo sapiens
ccuucaaguuagcucagga

SEQ ID NO: 1209926 - RNA, 15 nt, Homo sapiens
ccuucaauacuuaaa

SEQ ID NO: 1209927 - RNA, 14 nt, Homo sapiens
ccuucacuuuacaa

SEQ ID NO: 1209928 - RNA, 16 nt, Homo sapiens
ccuucagacacccuca

SEQ ID NO: 1209929 - RNA, 13 nt, Homo sapiens
ccuucagaucucu

SEQ ID NO: 1209930 - RNA, 16 nt, Homo sapiens
ccuucagcuccaggga

SEQ ID NO: 1209931 - RNA, 22 nt, Homo sapiens
ccuucaggguuuaauagacuga

SEQ ID NO: 1209932 - RNA, 12 nt, Homo sapiens
ccuucaucugaa

SEQ ID NO: 1209933 - RNA, 18 nt, Homo sapiens
ccuucaucugggacaaaa

SEQ ID NO: 1209934 - RNA, 20 nt, Homo sapiens
ccuucauuaaugaugaucuu

SEQ ID NO: 1209935 - RNA, 14 nt, Homo sapiens
ccuuccacagugaa

SEQ ID NO: 1209936 - RNA, 20 nt, Homo sapiens
ccuuccagaucacugccaca

SEQ ID NO: 1209937 - RNA, 21 nt, Homo sapiens
ccuuccauagccuaaucccug

SEQ ID NO: 1209938 - RNA, 23 nt, Homo sapiens
ccuucccuagcuuuagacccugg

SEQ ID NO: 1209939 - RNA, 17 nt, Homo sapiens
ccuuccucacuuccaua

SEQ ID NO: 1209940 - RNA, 21 nt, Homo sapiens
ccuuccucucaagcuagccag

SEQ ID NO: 1209941 - RNA, 13 nt, Homo sapiens
ccuuccuugccua

SEQ ID NO: 1209942 - RNA, 18 nt, Homo sapiens
ccuucggcagcuacucag

SEQ ID NO: 1209943 - RNA, 19 nt, Homo sapiens
ccuucuacauuugagggcc

SEQ ID NO: 1209944 - RNA, 23 nt, Homo sapiens
ccuucucacagcacaugcuggcc

SEQ ID NO: 1209945 - RNA, 15 nt, Homo sapiens
ccuucuccaccaaag

SEQ ID NO: 1209946 - RNA, 15 nt, Homo sapiens
ccuucucugcuccac

SEQ ID NO: 1209947 - RNA, 23 nt, Homo sapiens
ccuucucuguagggaacucuggg

SEQ ID NO: 1209948 - RNA, 20 nt, Homo sapiens
ccuucugggacuggacagcu

SEQ ID NO: 1209949 - RNA, 22 nt, Homo sapiens
ccuucugggacuggacagcuuu

SEQ ID NO: 1209950 - RNA, 19 nt, Homo sapiens
ccuucugguacaauccuuu

SEQ ID NO: 1209951 - RNA, 17 nt, Homo sapiens
ccuucuguccugguguc

SEQ ID NO: 1209952 - RNA, 21 nt, Homo sapiens
ccuucugugccggcuuucaag

SEQ ID NO: 1209953 - RNA, 15 nt, Homo sapiens
ccuucuugcuucuca

SEQ ID NO: 1209954 - RNA, 11 nt, Homo sapiens
ccuucuuucac

SEQ ID NO: 1209955 - RNA, 15 nt, Homo sapiens
ccuugaaacaguucc

SEQ ID NO: 1209956 - RNA, 15 nt, Homo sapiens
ccuugaaaguaggau

SEQ ID NO: 1209957 - RNA, 12 nt, Homo sapiens
ccuugaccuucc

SEQ ID NO: 1209958 - RNA, 17 nt, Homo sapiens
ccuugagcaaauuaccc

SEQ ID NO: 1209959 - RNA, 14 nt, Homo sapiens
ccuugaguaaaaag

SEQ ID NO: 1209960 - RNA, 17 nt, Homo sapiens
ccuugagucagaaaaca

SEQ ID NO: 1209961 - RNA, 20 nt, Homo sapiens
ccuugagugcucuugcuauu

SEQ ID NO: 1209962 - RNA, 16 nt, Homo sapiens
ccuugaguguguuacc

SEQ ID NO: 1209963 - RNA, 21 nt, Homo sapiens
ccuugauaaccauauaaauuc

SEQ ID NO: 1209964 - RNA, 17 nt, Homo sapiens
ccuugaucccaauccuu

SEQ ID NO: 1209965 - RNA, 22 nt, Homo sapiens
ccuugauggagauauuuacaug

SEQ ID NO: 1209966 - RNA, 18 nt, Homo sapiens
ccuugcagaacugccauu

SEQ ID NO: 1209967 - RNA, 13 nt, Homo sapiens
ccuugcagccaca

SEQ ID NO: 1209968 - RNA, 14 nt, Homo sapiens
ccuugcagccacau

SEQ ID NO: 1209969 - RNA, 15 nt, Homo sapiens
ccuugccuccucacc

SEQ ID NO: 1209970 - RNA, 17 nt, Homo sapiens
ccuugcuaaaagauuau

SEQ ID NO: 1209971 - RNA, 12 nt, Homo sapiens
ccuugcuaccug

SEQ ID NO: 1209972 - RNA, 22 nt, Homo sapiens
ccuugcugauggugacauugca

SEQ ID NO: 1209973 - RNA, 21 nt, Homo sapiens
ccuugcuggacggggacuggg

SEQ ID NO: 1209974 - RNA, 19 nt, Homo sapiens
ccuugcuguccugaucugu

SEQ ID NO: 1209975 - RNA, 19 nt, Homo sapiens
ccuuggagggacaugacua

SEQ ID NO: 1209976 - RNA, 13 nt, Homo sapiens
ccuuggccgugag

SEQ ID NO: 1209977 - RNA, 16 nt, Homo sapiens
ccuuggccucugcuaa

SEQ ID NO: 1209978 - RNA, 19 nt, Homo sapiens
ccuuggcuaguaaaagcca

SEQ ID NO: 1209979 - RNA, 13 nt, Homo sapiens
ccuuggcugugag

SEQ ID NO: 1209980 - RNA, 20 nt, Homo sapiens
ccuuggcuuaccugaccucu

SEQ ID NO: 1209981 - RNA, 23 nt, Homo sapiens
ccuugggcacuuuuuaauucacc

SEQ ID NO: 1209982 - RNA, 17 nt, Homo sapiens
ccuugggccuugcugcu

SEQ ID NO: 1209983 - RNA, 17 nt, Homo sapiens
ccuuggggagcacuugu

SEQ ID NO: 1209984 - RNA, 20 nt, Homo sapiens
ccuugggucauugaccucuc

SEQ ID NO: 1209985 - RNA, 24 nt, Homo sapiens
ccuugugaccuucucuauaucaug

SEQ ID NO: 1209986 - RNA, 21 nt, Homo sapiens
ccuuguguacaguuauuuaug

SEQ ID NO: 1209987 - RNA, 19 nt, Homo sapiens
ccuuguguguuuugagagu

SEQ ID NO: 1209988 - RNA, 15 nt, Homo sapiens
ccuuguuuguacugu

SEQ ID NO: 1209989 - RNA, 22 nt, Homo sapiens
ccuuuaaaaaugcaccacuuuu

SEQ ID NO: 1209990 - RNA, 20 nt, Homo sapiens
ccuuuaaagaugaacucuga

SEQ ID NO: 1209991 - RNA, 13 nt, Homo sapiens
ccuuuacaccaac

SEQ ID NO: 1209992 - RNA, 24 nt, Homo sapiens
ccuuuagaggguaccgucuucucc

SEQ ID NO: 1209993 - RNA, 21 nt, Homo sapiens
ccuuuauugauaucuccauga

SEQ ID NO: 1209994 - RNA, 20 nt, Homo sapiens
ccuuucagaugucuucugcc

SEQ ID NO: 1209995 - RNA, 16 nt, Homo sapiens
ccuuucccaucuucca

SEQ ID NO: 1209996 - RNA, 19 nt, Homo sapiens
ccuuucccccuucucuuag

SEQ ID NO: 1209997 - RNA, 23 nt, Homo sapiens
ccuuucccuuuagcacguuuaaa

SEQ ID NO: 1209998 - RNA, 13 nt, Homo sapiens
ccuuucgagcucu

SEQ ID NO: 1209999 - RNA, 17 nt, Homo sapiens
ccuuucuaaauugcaug

SEQ ID NO: 1210000 - RNA, 11 nt, Homo sapiens
ccuuucuaguu

SEQ ID NO: 1210001 - RNA, 17 nt, Homo sapiens
ccuuucucuaaaacugc

SEQ ID NO: 1210002 - RNA, 15 nt, Homo sapiens
ccuuucuuacauuag

SEQ ID NO: 1210003 - RNA, 17 nt, Homo sapiens
ccuuugaagccucagcu

SEQ ID NO: 1210004 - RNA, 19 nt, Homo sapiens
ccuuugaauaaaaaugcac

SEQ ID NO: 1210005 - RNA, 18 nt, Homo sapiens
ccuuugacauuuaauuua

SEQ ID NO: 1210006 - RNA, 14 nt, Homo sapiens
ccuuugagguugau

SEQ ID NO: 1210007 - RNA, 18 nt, Homo sapiens
ccuuugcuucaaauucaa

SEQ ID NO: 1210008 - RNA, 15 nt, Homo sapiens
ccuuuggaauggugu

SEQ ID NO: 1210009 - RNA, 15 nt, Homo sapiens
ccuuuggcucuggag

SEQ ID NO: 1210010 - RNA, 22 nt, Homo sapiens
ccuuugggccucugcuucucuc

SEQ ID NO: 1210011 - RNA, 16 nt, Homo sapiens
ccuuuggggacuuuuc

SEQ ID NO: 1210012 - RNA, 16 nt, Homo sapiens
cuccccagagcacugg

SEQ ID NO: 1210013 - RNA, 23 nt, Homo sapiens
cuccccagcccuggcucugcaau

SEQ ID NO: 1210014 - RNA, 13 nt, Homo sapiens
cuccccaggggag

SEQ ID NO: 1210015 - RNA, 14 nt, Homo sapiens
cuccccccacaagu

SEQ ID NO: 1210016 - RNA, 20 nt, Homo sapiens
cuccccuagggggagaagaa

SEQ ID NO: 1210017 - RNA, 17 nt, Homo sapiens
cuccccuccaucccugg

SEQ ID NO: 1210018 - RNA, 15 nt, Homo sapiens
cucccucauuccacc

SEQ ID NO: 1210019 - RNA, 19 nt, Homo sapiens
cucccucuguccaccagcc

SEQ ID NO: 1210020 - RNA, 14 nt, Homo sapiens
cucccugaugacac

SEQ ID NO: 1210021 - RNA, 21 nt, Homo sapiens
cucccugcgaggaggggagaa

SEQ ID NO: 1210022 - RNA, 16 nt, Homo sapiens
cucccuggaugacauu

SEQ ID NO: 1210023 - RNA, 17 nt, Homo sapiens
cucccuuaaucugccag

SEQ ID NO: 1210024 - RNA, 23 nt, Homo sapiens
cucccuugggaagggcagggaau

SEQ ID NO: 1210025 - RNA, 14 nt, Homo sapiens
cucccuuugaugau

SEQ ID NO: 1210026 - RNA, 20 nt, Homo sapiens
cuccgagaggugggccaguc

SEQ ID NO: 1210027 - RNA, 15 nt, Homo sapiens
cuccgcaacagccaa

SEQ ID NO: 1210028 - RNA, 16 nt, Homo sapiens
cuccgcaacagccaag

SEQ ID NO: 1210029 - RNA, 16 nt, Homo sapiens
cuccgccaagaucuac

SEQ ID NO: 1210030 - RNA, 15 nt, Homo sapiens
cuccgccaaugcacg

SEQ ID NO: 1210031 - RNA, 14 nt, Homo sapiens
cuccgccauugaga

SEQ ID NO: 1210032 - RNA, 19 nt, Homo sapiens
cuccgcuuucuacccagcg

SEQ ID NO: 1210033 - RNA, 12 nt, Homo sapiens
cuccuacuguau

SEQ ID NO: 1210034 - RNA, 18 nt, Homo sapiens
cuccuagguucacuuugg

SEQ ID NO: 1210035 - RNA, 13 nt, Homo sapiens
cuccuauacucua

SEQ ID NO: 1210036 - RNA, 14 nt, Homo sapiens
cuccuauacucuau

SEQ ID NO: 1210037 - RNA, 22 nt, Homo sapiens
cuccucaaccccuccccuccau

SEQ ID NO: 1210038 - RNA, 22 nt, Homo sapiens
cuccucacuggaggagcagcuu

SEQ ID NO: 1210039 - RNA, 21 nt, Homo sapiens
cuccucaggcacacagcuacu

SEQ ID NO: 1210040 - RNA, 22 nt, Homo sapiens
cuccucagugacaucaaagccu

SEQ ID NO: 1210041 - RNA, 20 nt, Homo sapiens
cuccuccaccucaccuccau

SEQ ID NO: 1210042 - RNA, 21 nt, Homo sapiens
cuccucccaggaacugggcca

SEQ ID NO: 1210043 - RNA, 16 nt, Homo sapiens
cuccucgcugccagau

SEQ ID NO: 1210044 - RNA, 14 nt, Homo sapiens
cuccucggagagca

SEQ ID NO: 1210045 - RNA, 12 nt, Homo sapiens
cuccucuaguaa

SEQ ID NO: 1210046 - RNA, 18 nt, Homo sapiens
cuccucucugggccuuug

SEQ ID NO: 1210047 - RNA, 14 nt, Homo sapiens
cuccucugcagcuc

SEQ ID NO: 1210048 - RNA, 21 nt, Homo sapiens
cuccucuguuaaaaaaaauga

SEQ ID NO: 1210049 - RNA, 16 nt, Homo sapiens
cuccucuucacuuggc

SEQ ID NO: 1210050 - RNA, 19 nt, Homo sapiens
cuccucuucacuuggccag

SEQ ID NO: 1210051 - RNA, 16 nt, Homo sapiens
cuccugacagcaauaa

SEQ ID NO: 1210052 - RNA, 16 nt, Homo sapiens
cuccugaccucaggug

SEQ ID NO: 1210053 - RNA, 16 nt, Homo sapiens
cuccugauagucuuuc

SEQ ID NO: 1210054 - RNA, 16 nt, Homo sapiens
cuccugcacuguuuaa

SEQ ID NO: 1210055 - RNA, 11 nt, Homo sapiens
cuccugccauu

SEQ ID NO: 1210056 - RNA, 18 nt, Homo sapiens
cuccugcucauacagaag

SEQ ID NO: 1210057 - RNA, 23 nt, Homo sapiens
cuccugcucuuucuacaugacug

SEQ ID NO: 1210058 - RNA, 15 nt, Homo sapiens
cuccuggaaccuugc

SEQ ID NO: 1210059 - RNA, 20 nt, Homo sapiens
cuccuggaaccuugcugucc

SEQ ID NO: 1210060 - RNA, 13 nt, Homo sapiens
cuccugggcucag

SEQ ID NO: 1210061 - RNA, 14 nt, Homo sapiens
cuccuguacacuga

SEQ ID NO: 1210062 - RNA, 15 nt, Homo sapiens
cuccugucugcccua

SEQ ID NO: 1210063 - RNA, 18 nt, Homo sapiens
cuccugugucuugcaaug

SEQ ID NO: 1210064 - RNA, 17 nt, Homo sapiens
cuccugugugacuggca

SEQ ID NO: 1210065 - RNA, 19 nt, Homo sapiens
cuccuuaagaacacaaagc

SEQ ID NO: 1210066 - RNA, 17 nt, Homo sapiens
cuccuucuccauaaagc

SEQ ID NO: 1210067 - RNA, 15 nt, Homo sapiens
cuccuuuacaaaaga

SEQ ID NO: 1210068 - RNA, 16 nt, Homo sapiens
cuccuuuacaaaagaa

SEQ ID NO: 1210069 - RNA, 13 nt, Homo sapiens
cuccuuuagccau

SEQ ID NO: 1210070 - RNA, 24 nt, Homo sapiens
cuccuuucaccacaugugcacaug

SEQ ID NO: 1210071 - RNA, 18 nt, Homo sapiens
cuccuuucuccugugaau

SEQ ID NO: 1210072 - RNA, 17 nt, Homo sapiens
cuccuuuggccauucca

SEQ ID NO: 1210073 - RNA, 14 nt, Homo sapiens
cucgagauguaucc

SEQ ID NO: 1210074 - RNA, 16 nt, Homo sapiens
cucgagcaguccugcc

SEQ ID NO: 1210075 - RNA, 23 nt, Homo sapiens
cucgagcuguuuacagugaugcc

SEQ ID NO: 1210076 - RNA, 18 nt, Homo sapiens
cucgaggcccuagcauuu

SEQ ID NO: 1210077 - RNA, 21 nt, Homo sapiens
cucgaggccugcaaaccuucc

SEQ ID NO: 1210078 - RNA, 15 nt, Homo sapiens
cucgaggcuggugcc

SEQ ID NO: 1210079 - RNA, 15 nt, Homo sapiens
cucgaucauauuucc

SEQ ID NO: 1210080 - RNA, 16 nt, Homo sapiens
cucgauuagacuccau

SEQ ID NO: 1210081 - RNA, 16 nt, Homo sapiens
cucgcccucgccagug

SEQ ID NO: 1210082 - RNA, 10 nt, Homo sapiens
cucgcugcca

SEQ ID NO: 1210083 - RNA, 18 nt, Homo sapiens
cucgcugccaucaccgcu

SEQ ID NO: 1210084 - RNA, 21 nt, Homo sapiens
cucggagggauggagaaagaa

SEQ ID NO: 1210085 - RNA, 18 nt, Homo sapiens
cucggcaccuccccggcc

SEQ ID NO: 1210086 - RNA, 20 nt, Homo sapiens
cucgggaagccccauccaac

SEQ ID NO: 1210087 - RNA, 20 nt, Homo sapiens
cucgguggcugcacagaagg

SEQ ID NO: 1210088 - RNA, 16 nt, Homo sapiens
cucgugccaugaucug

SEQ ID NO: 1210089 - RNA, 19 nt, Homo sapiens
cucguugccugccacugag

SEQ ID NO: 1210090 - RNA, 15 nt, Homo sapiens
cucuaaaagaaaaag

SEQ ID NO: 1210091 - RNA, 21 nt, Homo sapiens
cucuaacaaaaugguuuauuu

SEQ ID NO: 1210092 - RNA, 17 nt, Homo sapiens
cucuaacuccugccauu

SEQ ID NO: 1210093 - RNA, 12 nt, Homo sapiens
cucuaacuucaa

SEQ ID NO: 1210094 - RNA, 14 nt, Homo sapiens
cucuaauaugauua

SEQ ID NO: 1210095 - RNA, 22 nt, Homo sapiens
cucuaauguacaauaaagcaau

SEQ ID NO: 1210096 - RNA, 23 nt, Homo sapiens
cucuaauuuuggauaauauucau

SEQ ID NO: 1210097 - RNA, 19 nt, Homo sapiens
cucuacaucuucugccuua

SEQ ID NO: 1210098 - RNA, 20 nt, Homo sapiens
cucuacccuggcacuauaau

SEQ ID NO: 1210099 - RNA, 17 nt, Homo sapiens
cucuacuaaaaacacaa

SEQ ID NO: 1210100 - RNA, 20 nt, Homo sapiens
cucuacuaaaaauacaaaaa

SEQ ID NO: 1210101 - RNA, 14 nt, Homo sapiens
cucuacuccacaga

SEQ ID NO: 1210102 - RNA, 18 nt, Homo sapiens
cucuacuccuaccucagc

SEQ ID NO: 1210103 - RNA, 22 nt, Homo sapiens
cucuacugaggugcuauguucu

SEQ ID NO: 1210104 - RNA, 15 nt, Homo sapiens
cucuacuuaauccaa

SEQ ID NO: 1210105 - RNA, 13 nt, Homo sapiens
cucuagaagccaa

SEQ ID NO: 1210106 - RNA, 20 nt, Homo sapiens
cucuagccugggccagagaa

SEQ ID NO: 1210107 - RNA, 19 nt, Homo sapiens
cucuaggccuguugccucg

SEQ ID NO: 1210108 - RNA, 19 nt, Homo sapiens
cucuaguaagaugcacuga

SEQ ID NO: 1210109 - RNA, 20 nt, Homo sapiens
cucuaguaagaugcacugaa

SEQ ID NO: 1210110 - RNA, 14 nt, Homo sapiens
cucuaguaucacuu

SEQ ID NO: 1210111 - RNA, 22 nt, Homo sapiens
cucuaucuuccuccuugugauc

SEQ ID NO: 1210112 - RNA, 19 nt, Homo sapiens
cucuauugauguacagucu

SEQ ID NO: 1210113 - RNA, 19 nt, Homo sapiens
cucuauugcugcucucuca

SEQ ID NO: 1210114 - RNA, 14 nt, Homo sapiens
cucuauuguuaccu

SEQ ID NO: 1210115 - RNA, 15 nt, Homo sapiens
cucuauuugagaaua

SEQ ID NO: 1210116 - RNA, 17 nt, Homo sapiens
cucucaagcuagccaga

SEQ ID NO: 1210117 - RNA, 15 nt, Homo sapiens
cucucaauaugcuua

SEQ ID NO: 1210118 - RNA, 15 nt, Homo sapiens
cucucacuccugccu

SEQ ID NO: 1210119 - RNA, 22 nt, Homo sapiens
cucucacuggcugggaaacccu

SEQ ID NO: 1210120 - RNA, 18 nt, Homo sapiens
cucucagagcaucuggcu

SEQ ID NO: 1210121 - RNA, 21 nt, Homo sapiens
cucucagaggccugcugccag

SEQ ID NO: 1210122 - RNA, 18 nt, Homo sapiens
cucucagcagaaacacac

SEQ ID NO: 1210123 - RNA, 17 nt, Homo sapiens
cucucagcaggcaaaga

SEQ ID NO: 1210124 - RNA, 16 nt, Homo sapiens
cucucaguguuuugga

SEQ ID NO: 1210125 - RNA, 18 nt, Homo sapiens
cucucaguucuacacuga

SEQ ID NO: 1210126 - RNA, 13 nt, Homo sapiens
cucucauguuccu

SEQ ID NO: 1210127 - RNA, 23 nt, Homo sapiens
cucucauguuccuggcgugagau

SEQ ID NO: 1210128 - RNA, 13 nt, Homo sapiens
cucucauucucac

SEQ ID NO: 1210129 - RNA, 14 nt, Homo sapiens
cucucauucucacu

SEQ ID NO: 1210130 - RNA, 18 nt, Homo sapiens
cucuccaaauagcauuag

SEQ ID NO: 1210131 - RNA, 22 nt, Homo sapiens
cucuccaccacccaacccaaac

SEQ ID NO: 1210132 - RNA, 18 nt, Homo sapiens
cucuccaucuuccacgaa

SEQ ID NO: 1210133 - RNA, 16 nt, Homo sapiens
cucuccccucaaaguc

SEQ ID NO: 1210134 - RNA, 17 nt, Homo sapiens
cucuccccuccagccuu

SEQ ID NO: 1210135 - RNA, 18 nt, Homo sapiens
cucucccucccuugccac

SEQ ID NO: 1210136 - RNA, 16 nt, Homo sapiens
cucucccugccaaguc

SEQ ID NO: 1210137 - RNA, 18 nt, Homo sapiens
cucuccuacucacuuaaa

SEQ ID NO: 1210138 - RNA, 19 nt, Homo sapiens
cucuccugcccaagcacuu

SEQ ID NO: 1210139 - RNA, 16 nt, Homo sapiens
caagaccucugugcac

SEQ ID NO: 1210140 - RNA, 22 nt, Homo sapiens
caagaccuucuccccauucugc

SEQ ID NO: 1210141 - RNA, 17 nt, Homo sapiens
caagacuauaccuuauc

SEQ ID NO: 1210142 - RNA, 12 nt, Homo sapiens
caagacuccauc

SEQ ID NO: 1210143 - RNA, 15 nt, Homo sapiens
caagacuccaucuca

SEQ ID NO: 1210144 - RNA, 13 nt, Homo sapiens
caagacucuagag

SEQ ID NO: 1210145 - RNA, 14 nt, Homo sapiens
caagacuuccucau

SEQ ID NO: 1210146 - RNA, 20 nt, Homo sapiens
caagacuuggcaacagaagc

SEQ ID NO: 1210147 - RNA, 23 nt, Homo sapiens
caagagagaaagaaguaggcaug

SEQ ID NO: 1210148 - RNA, 18 nt, Homo sapiens
caagagauaagucuuuca

SEQ ID NO: 1210149 - RNA, 20 nt, Homo sapiens
caagagaugggaaugaggug

SEQ ID NO: 1210150 - RNA, 23 nt, Homo sapiens
caagagauuguuguuugccauac

SEQ ID NO: 1210151 - RNA, 13 nt, Homo sapiens
caagagcacacag

SEQ ID NO: 1210152 - RNA, 16 nt, Homo sapiens
caagagcugagaaaca

SEQ ID NO: 1210153 - RNA, 22 nt, Homo sapiens
caagaggcgagaugagcccaca

SEQ ID NO: 1210154 - RNA, 18 nt, Homo sapiens
caagagugaaaauagagg

SEQ ID NO: 1210155 - RNA, 15 nt, Homo sapiens
caagaguuuguucug

SEQ ID NO: 1210156 - RNA, 17 nt, Homo sapiens
caagaguuuguucuguu

SEQ ID NO: 1210157 - RNA, 23 nt, Homo sapiens
caagaguuuguucuguucugggg

SEQ ID NO: 1210158 - RNA, 21 nt, Homo sapiens
caagauacauaugaggacaag

SEQ ID NO: 1210159 - RNA, 19 nt, Homo sapiens
caagauccuccugcugcag

SEQ ID NO: 1210160 - RNA, 13 nt, Homo sapiens
caagauccuuaau

SEQ ID NO: 1210161 - RNA, 13 nt, Homo sapiens
caagaucuuucag

SEQ ID NO: 1210162 - RNA, 17 nt, Homo sapiens
caagaugcuaguucauu

SEQ ID NO: 1210163 - RNA, 22 nt, Homo sapiens
caagauuggucucccauaugca

SEQ ID NO: 1210164 - RNA, 15 nt, Homo sapiens
caagauuugacugua

SEQ ID NO: 1210165 - RNA, 17 nt, Homo sapiens
caagcaaaaugcuuaca

SEQ ID NO: 1210166 - RNA, 15 nt, Homo sapiens
caagcaagcucucuu

SEQ ID NO: 1210167 - RNA, 15 nt, Homo sapiens
caagcacaggagaac

SEQ ID NO: 1210168 - RNA, 12 nt, Homo sapiens
caagcacuuugg

SEQ ID NO: 1210169 - RNA, 20 nt, Homo sapiens
caagcagcugaagaaaaaau

SEQ ID NO: 1210170 - RNA, 16 nt, Homo sapiens
caagcagcuggugcuc

SEQ ID NO: 1210171 - RNA, 20 nt, Homo sapiens
caagcaggaaccccaggaga

SEQ ID NO: 1210172 - RNA, 21 nt, Homo sapiens
caagccacagcagguccucca

SEQ ID NO: 1210173 - RNA, 22 nt, Homo sapiens
caagccagcuuacuagcacuuu

SEQ ID NO: 1210174 - RNA, 16 nt, Homo sapiens
caagccaggaccugcu

SEQ ID NO: 1210175 - RNA, 21 nt, Homo sapiens
caagcccuggcaacauaguga

SEQ ID NO: 1210176 - RNA, 17 nt, Homo sapiens
caagccgagcucuccuu

SEQ ID NO: 1210177 - RNA, 18 nt, Homo sapiens
caagcucucuugccgagg

SEQ ID NO: 1210178 - RNA, 11 nt, Homo sapiens
caagcucugcu

SEQ ID NO: 1210179 - RNA, 12 nt, Homo sapiens
caagcugcauuu

SEQ ID NO: 1210180 - RNA, 16 nt, Homo sapiens
caaggaaaaaugcugc

SEQ ID NO: 1210181 - RNA, 20 nt, Homo sapiens
caaggaauggaaucuucucc

SEQ ID NO: 1210182 - RNA, 15 nt, Homo sapiens
caaggagaauaugau

SEQ ID NO: 1210183 - RNA, 17 nt, Homo sapiens
caaggagcacaagccac

SEQ ID NO: 1210184 - RNA, 19 nt, Homo sapiens
caaggauccucuccacucc

SEQ ID NO: 1210185 - RNA, 21 nt, Homo sapiens
caaggaugcugucaagcaccu

SEQ ID NO: 1210186 - RNA, 15 nt, Homo sapiens
caaggcacucuagau

SEQ ID NO: 1210187 - RNA, 21 nt, Homo sapiens
caaggcaggaggaucacuuga

SEQ ID NO: 1210188 - RNA, 17 nt, Homo sapiens
caaggcaggcauaucaa

SEQ ID NO: 1210189 - RNA, 15 nt, Homo sapiens
caaggcuaguuccuu

SEQ ID NO: 1210190 - RNA, 17 nt, Homo sapiens
caaggcugaccaagaga

SEQ ID NO: 1210191 - RNA, 18 nt, Homo sapiens
caaggcuggguaauguga

SEQ ID NO: 1210192 - RNA, 15 nt, Homo sapiens
caaggcuuuaucuca

SEQ ID NO: 1210193 - RNA, 18 nt, Homo sapiens
caaggcuuugguuuccaa

SEQ ID NO: 1210194 - RNA, 16 nt, Homo sapiens
caagggcaggucuuca

SEQ ID NO: 1210195 - RNA, 22 nt, Homo sapiens
caagguccucucaguucucucc

SEQ ID NO: 1210196 - RNA, 14 nt, Homo sapiens
caaggugaagcaaa

SEQ ID NO: 1210197 - RNA, 19 nt, Homo sapiens
caagguuuuggagucagua

SEQ ID NO: 1210198 - RNA, 17 nt, Homo sapiens
caaguaaaacuguggua

SEQ ID NO: 1210199 - RNA, 15 nt, Homo sapiens
caaguaacugaacca

SEQ ID NO: 1210200 - RNA, 17 nt, Homo sapiens
caaguaagaagacauga

SEQ ID NO: 1210201 - RNA, 14 nt, Homo sapiens
caaguaauugugaa

SEQ ID NO: 1210202 - RNA, 18 nt, Homo sapiens
caaguacagagauucuau

SEQ ID NO: 1210203 - RNA, 15 nt, Homo sapiens
caaguagcacccugg

SEQ ID NO: 1210204 - RNA, 15 nt, Homo sapiens
caaguauaugugaaa

SEQ ID NO: 1210205 - RNA, 21 nt, Homo sapiens
caaguauguuuguacaguaug

SEQ ID NO: 1210206 - RNA, 16 nt, Homo sapiens
caaguauuuucuacua

SEQ ID NO: 1210207 - RNA, 16 nt, Homo sapiens
caagucaccaugcuga

SEQ ID NO: 1210208 - RNA, 17 nt, Homo sapiens
caagucacccaucagau

SEQ ID NO: 1210209 - RNA, 13 nt, Homo sapiens
caagucaccugca

SEQ ID NO: 1210210 - RNA, 14 nt, Homo sapiens
caagucagcuccag

SEQ ID NO: 1210211 - RNA, 13 nt, Homo sapiens
caagucccuguca

SEQ ID NO: 1210212 - RNA, 21 nt, Homo sapiens
caaguccuugaccucuauaaa

SEQ ID NO: 1210213 - RNA, 19 nt, Homo sapiens
caagucuucccugaucaag

SEQ ID NO: 1210214 - RNA, 16 nt, Homo sapiens
caagugagacaaaaag

SEQ ID NO: 1210215 - RNA, 17 nt, Homo sapiens
caagugagacaaaaagc

SEQ ID NO: 1210216 - RNA, 21 nt, Homo sapiens
caagugaggagugccagcuca

SEQ ID NO: 1210217 - RNA, 21 nt, Homo sapiens
caagugaucugcccaccucag

SEQ ID NO: 1210218 - RNA, 14 nt, Homo sapiens
caagugccaaacag

SEQ ID NO: 1210219 - RNA, 22 nt, Homo sapiens
caaguggaccuuaggccuuccu

SEQ ID NO: 1210220 - RNA, 21 nt, Homo sapiens
caagugugggccacuguggug

SEQ ID NO: 1210221 - RNA, 22 nt, Homo sapiens
caaguuagaaaacauaaucuuc

SEQ ID NO: 1210222 - RNA, 16 nt, Homo sapiens
caaguuagcucaggag

SEQ ID NO: 1210223 - RNA, 14 nt, Homo sapiens
caaguucaauccua

SEQ ID NO: 1210224 - RNA, 23 nt, Homo sapiens
caaguucauugaugacccucuga

SEQ ID NO: 1210225 - RNA, 21 nt, Homo sapiens
caaguuccaaaagcacagacu

SEQ ID NO: 1210226 - RNA, 15 nt, Homo sapiens
caaguucuaagauuc

SEQ ID NO: 1210227 - RNA, 13 nt, Homo sapiens
caaguuuccauag

SEQ ID NO: 1210228 - RNA, 23 nt, Homo sapiens
caaguuucugauaccacugcacu

SEQ ID NO: 1210229 - RNA, 12 nt, Homo sapiens
caaguuugucac

SEQ ID NO: 1210230 - RNA, 21 nt, Homo sapiens
caaguuuuucugucaagaaga

SEQ ID NO: 1210231 - RNA, 12 nt, Homo sapiens
caauaaaacuga

SEQ ID NO: 1210232 - RNA, 15 nt, Homo sapiens
caauaaaacugaugu

SEQ ID NO: 1210233 - RNA, 23 nt, Homo sapiens
caauaaaacugauguuacuagcc

SEQ ID NO: 1210234 - RNA, 13 nt, Homo sapiens
caauaaacuccua

SEQ ID NO: 1210235 - RNA, 16 nt, Homo sapiens
caauaaacuccuacua

SEQ ID NO: 1210236 - RNA, 18 nt, Homo sapiens
caauaaacuccuacuaaa

SEQ ID NO: 1210237 - RNA, 21 nt, Homo sapiens
caauaaacuccuacuaaaucc

SEQ ID NO: 1210238 - RNA, 22 nt, Homo sapiens
caauaaacuccuacuaaauccc

SEQ ID NO: 1210239 - RNA, 17 nt, Homo sapiens
caauaaagcaauguggu

SEQ ID NO: 1210240 - RNA, 14 nt, Homo sapiens
caauaaaugaacug

SEQ ID NO: 1210241 - RNA, 14 nt, Homo sapiens
caauaacacuaaaa

SEQ ID NO: 1210242 - RNA, 23 nt, Homo sapiens
caauacaaaaauaccuacugcug

SEQ ID NO: 1210243 - RNA, 13 nt, Homo sapiens
caauacagucuag

SEQ ID NO: 1210244 - RNA, 14 nt, Homo sapiens
caauaguuugcaua

SEQ ID NO: 1210245 - RNA, 14 nt, Homo sapiens
caauauacuuguau

SEQ ID NO: 1210246 - RNA, 18 nt, Homo sapiens
caauaugcaagcagcuuu

SEQ ID NO: 1210247 - RNA, 16 nt, Homo sapiens
caauauuaacauaaga

SEQ ID NO: 1210248 - RNA, 16 nt, Homo sapiens
caauauuucugauaua

SEQ ID NO: 1210249 - RNA, 15 nt, Homo sapiens
caaucaaagcacuug

SEQ ID NO: 1210250 - RNA, 19 nt, Homo sapiens
caaucaaauauuugcugaa

SEQ ID NO: 1210251 - RNA, 10 nt, Homo sapiens
caaucacaaa

SEQ ID NO: 1210252 - RNA, 14 nt, Homo sapiens
caaucacaagaaga

SEQ ID NO: 1210253 - RNA, 13 nt, Homo sapiens
caaucacugaaac

SEQ ID NO: 1210254 - RNA, 13 nt, Homo sapiens
caaucagcacuga

SEQ ID NO: 1210255 - RNA, 17 nt, Homo sapiens
caaucagccacauucua

SEQ ID NO: 1210256 - RNA, 19 nt, Homo sapiens
caaucaguauguauucuuu

SEQ ID NO: 1210257 - RNA, 22 nt, Homo sapiens
caaucaugaaauaugcaucuca

SEQ ID NO: 1210258 - RNA, 16 nt, Homo sapiens
caauccaacccgggga

SEQ ID NO: 1210259 - RNA, 15 nt, Homo sapiens
caauccaucucucaa

SEQ ID NO: 1210260 - RNA, 20 nt, Homo sapiens
caaucccacguacuuauaaa

SEQ ID NO: 1210261 - RNA, 16 nt, Homo sapiens
caauccuggcucugug

SEQ ID NO: 1210262 - RNA, 12 nt, Homo sapiens
caauccugugga

SEQ ID NO: 1210263 - RNA, 15 nt, Homo sapiens
caauccuuuaccacu

SEQ ID NO: 1210264 - RNA, 14 nt, Homo sapiens
caaucgagauuugg

SEQ ID NO: 1210265 - RNA, 15 nt, Homo sapiens
caaucuauguuugca

SEQ ID NO: 1210266 - RNA, 16 nt, Homo sapiens
caaucuccuuacugug

SEQ ID NO: 1210267 - RNA, 23 nt, Homo sapiens
cacagagugcauugugaggguua

SEQ ID NO: 1210268 - RNA, 22 nt, Homo sapiens
cacagagugcuggacuguucca

SEQ ID NO: 1210269 - RNA, 17 nt, Homo sapiens
cacagaugauacuucca

SEQ ID NO: 1210270 - RNA, 15 nt, Homo sapiens
cacagaugugaaaug

SEQ ID NO: 1210271 - RNA, 15 nt, Homo sapiens
cacagcaacaaugac

SEQ ID NO: 1210272 - RNA, 14 nt, Homo sapiens
cacagcacagccag

SEQ ID NO: 1210273 - RNA, 23 nt, Homo sapiens
cacagcaucgggagcacccagag

SEQ ID NO: 1210274 - RNA, 14 nt, Homo sapiens
cacagccacuaaga

SEQ ID NO: 1210275 - RNA, 16 nt, Homo sapiens
cacagccaugcccuug

SEQ ID NO: 1210276 - RNA, 13 nt, Homo sapiens
cacagcccaagag

SEQ ID NO: 1210277 - RNA, 14 nt, Homo sapiens
cacagcccaagagg

SEQ ID NO: 1210278 - RNA, 14 nt, Homo sapiens
cacagcccauccau

SEQ ID NO: 1210279 - RNA, 20 nt, Homo sapiens
cacagccgccugaaagccac

SEQ ID NO: 1210280 - RNA, 15 nt, Homo sapiens
cacagcgugggaacu

SEQ ID NO: 1210281 - RNA, 13 nt, Homo sapiens
cacagcuacagcu

SEQ ID NO: 1210282 - RNA, 14 nt, Homo sapiens
cacagcuacagcuu

SEQ ID NO: 1210283 - RNA, 17 nt, Homo sapiens
cacagcuacagcuuucu

SEQ ID NO: 1210284 - RNA, 16 nt, Homo sapiens
cacagcucaggaacua

SEQ ID NO: 1210285 - RNA, 12 nt, Homo sapiens
cacagcugccau

SEQ ID NO: 1210286 - RNA, 20 nt, Homo sapiens
cacagcuucauuuccugugu

SEQ ID NO: 1210287 - RNA, 14 nt, Homo sapiens
cacaggaguguccu

SEQ ID NO: 1210288 - RNA, 13 nt, Homo sapiens
cacaggaugcugg

SEQ ID NO: 1210289 - RNA, 14 nt, Homo sapiens
cacaggauuuguaa

SEQ ID NO: 1210290 - RNA, 12 nt, Homo sapiens
cacaggccucuc

SEQ ID NO: 1210291 - RNA, 16 nt, Homo sapiens
cacagggcaccagagg

SEQ ID NO: 1210292 - RNA, 17 nt, Homo sapiens
cacagggccaacuugag

SEQ ID NO: 1210293 - RNA, 22 nt, Homo sapiens
cacagggcgagacuccgucuca

SEQ ID NO: 1210294 - RNA, 18 nt, Homo sapiens
cacaggucccacugcccu

SEQ ID NO: 1210295 - RNA, 18 nt, Homo sapiens
cacaguccccagacucag

SEQ ID NO: 1210296 - RNA, 13 nt, Homo sapiens
cacagugcaucuc

SEQ ID NO: 1210297 - RNA, 15 nt, Homo sapiens
cacaguggcuucaca

SEQ ID NO: 1210298 - RNA, 13 nt, Homo sapiens
cacagugggaacu

SEQ ID NO: 1210299 - RNA, 22 nt, Homo sapiens
cacaguucccuuuauuucacau

SEQ ID NO: 1210300 - RNA, 16 nt, Homo sapiens
cacaguuggauuuauu

SEQ ID NO: 1210301 - RNA, 18 nt, Homo sapiens
cacaguuggcuggaugaa

SEQ ID NO: 1210302 - RNA, 14 nt, Homo sapiens
cacaguuguguuca

SEQ ID NO: 1210303 - RNA, 20 nt, Homo sapiens
cacauaaggacguguguaaa

SEQ ID NO: 1210304 - RNA, 18 nt, Homo sapiens
cacauacaggugcucaau

SEQ ID NO: 1210305 - RNA, 14 nt, Homo sapiens
cacauacgugcaca

SEQ ID NO: 1210306 - RNA, 19 nt, Homo sapiens
cacauagauuaauggcacu

SEQ ID NO: 1210307 - RNA, 21 nt, Homo sapiens
cacauagguaaaaacuggaau

SEQ ID NO: 1210308 - RNA, 21 nt, Homo sapiens
cacauaucagcaggaguaaua

SEQ ID NO: 1210309 - RNA, 13 nt, Homo sapiens
cacauaugcaccu

SEQ ID NO: 1210310 - RNA, 17 nt, Homo sapiens
cacauauggacucugca

SEQ ID NO: 1210311 - RNA, 18 nt, Homo sapiens
cacauauggacucugcac

SEQ ID NO: 1210312 - RNA, 21 nt, Homo sapiens
cacaucaauuacaagcuguag

SEQ ID NO: 1210313 - RNA, 18 nt, Homo sapiens
cacauccauucccaagaa

SEQ ID NO: 1210314 - RNA, 13 nt, Homo sapiens
cacaucugcauuu

SEQ ID NO: 1210315 - RNA, 12 nt, Homo sapiens
cacaucugucac

SEQ ID NO: 1210316 - RNA, 15 nt, Homo sapiens
cacaucuuuccucaa

SEQ ID NO: 1210317 - RNA, 19 nt, Homo sapiens
cacaugacaacuuugccag

SEQ ID NO: 1210318 - RNA, 17 nt, Homo sapiens
cacaugaggccaucuca

SEQ ID NO: 1210319 - RNA, 21 nt, Homo sapiens
cacaugaucuguuuuucacca

SEQ ID NO: 1210320 - RNA, 11 nt, Homo sapiens
cacaugcacac

SEQ ID NO: 1210321 - RNA, 19 nt, Homo sapiens
cacaugcacgugugugcac

SEQ ID NO: 1210322 - RNA, 18 nt, Homo sapiens
cacaugcuaggaugcgga

SEQ ID NO: 1210323 - RNA, 20 nt, Homo sapiens
cacauggaaucaaucuuuaa

SEQ ID NO: 1210324 - RNA, 16 nt, Homo sapiens
cacauggccuaugcac

SEQ ID NO: 1210325 - RNA, 14 nt, Homo sapiens
cacauggcugggau

SEQ ID NO: 1210326 - RNA, 17 nt, Homo sapiens
cacauggugugagucca

SEQ ID NO: 1210327 - RNA, 19 nt, Homo sapiens
cacaugugacacauaugca

SEQ ID NO: 1210328 - RNA, 14 nt, Homo sapiens
cacaugugcacaug

SEQ ID NO: 1210329 - RNA, 18 nt, Homo sapiens
cacaugugccacacagug

SEQ ID NO: 1210330 - RNA, 23 nt, Homo sapiens
cacauguguuucugucucuccau

SEQ ID NO: 1210331 - RNA, 21 nt, Homo sapiens
cacauuaguacuuauguugca

SEQ ID NO: 1210332 - RNA, 22 nt, Homo sapiens
cacauuaucaguugacagugua

SEQ ID NO: 1210333 - RNA, 20 nt, Homo sapiens
cacauuaucgggagcagugu

SEQ ID NO: 1210334 - RNA, 17 nt, Homo sapiens
cacauucauuuggauaa

SEQ ID NO: 1210335 - RNA, 14 nt, Homo sapiens
cacauugaaucaug

SEQ ID NO: 1210336 - RNA, 23 nt, Homo sapiens
cacauuggauucaucagcauuug

SEQ ID NO: 1210337 - RNA, 22 nt, Homo sapiens
cacauuggucauugugaauauu

SEQ ID NO: 1210338 - RNA, 15 nt, Homo sapiens
cacauugugccuuuu

SEQ ID NO: 1210339 - RNA, 20 nt, Homo sapiens
cacauuuacaaaauuacaca

SEQ ID NO: 1210340 - RNA, 19 nt, Homo sapiens
cacauuuauucugcucaca

SEQ ID NO: 1210341 - RNA, 22 nt, Homo sapiens
cacauuucauugucuuagucaa

SEQ ID NO: 1210342 - RNA, 20 nt, Homo sapiens
cacauuugggauguuccuuu

SEQ ID NO: 1210343 - RNA, 15 nt, Homo sapiens
caccaaaacgaugaa

SEQ ID NO: 1210344 - RNA, 20 nt, Homo sapiens
caccaaagccaccucuguca

SEQ ID NO: 1210345 - RNA, 13 nt, Homo sapiens
caccaaagcugcc

SEQ ID NO: 1210346 - RNA, 13 nt, Homo sapiens
caccaaaguucua

SEQ ID NO: 1210347 - RNA, 20 nt, Homo sapiens
caccaaaugaugccacuucc

SEQ ID NO: 1210348 - RNA, 18 nt, Homo sapiens
caccaaccuuccaagugu

SEQ ID NO: 1210349 - RNA, 22 nt, Homo sapiens
caccaaccuuccaaguguaaaa

SEQ ID NO: 1210350 - RNA, 20 nt, Homo sapiens
caccaagcagcaacagcaaa

SEQ ID NO: 1210351 - RNA, 22 nt, Homo sapiens
caccaaguaccaguauaagcau

SEQ ID NO: 1210352 - RNA, 14 nt, Homo sapiens
caccacagacacac

SEQ ID NO: 1210353 - RNA, 16 nt, Homo sapiens
caccaccacacuacac

SEQ ID NO: 1210354 - RNA, 23 nt, Homo sapiens
caccaccuggggagagccugcuu

SEQ ID NO: 1210355 - RNA, 19 nt, Homo sapiens
caccacggcguuguaccug

SEQ ID NO: 1210356 - RNA, 16 nt, Homo sapiens
caccacuguugccuuu

SEQ ID NO: 1210357 - RNA, 22 nt, Homo sapiens
caccaggaauccccaacaugca

SEQ ID NO: 1210358 - RNA, 16 nt, Homo sapiens
caccagugcgugcucc

SEQ ID NO: 1210359 - RNA, 15 nt, Homo sapiens
caccaguuauuccuu

SEQ ID NO: 1210360 - RNA, 16 nt, Homo sapiens
caccauccuauugcaa

SEQ ID NO: 1210361 - RNA, 18 nt, Homo sapiens
caccauguuguacaggcu

SEQ ID NO: 1210362 - RNA, 18 nt, Homo sapiens
caccauuucugucacuca

SEQ ID NO: 1210363 - RNA, 17 nt, Homo sapiens
cacccaaagcauggacu

SEQ ID NO: 1210364 - RNA, 15 nt, Homo sapiens
cacccacgcauacac

SEQ ID NO: 1210365 - RNA, 15 nt, Homo sapiens
cacccacuuugucca

SEQ ID NO: 1210366 - RNA, 14 nt, Homo sapiens
cacccagaccccag

SEQ ID NO: 1210367 - RNA, 13 nt, Homo sapiens
cacccaggcacuu

SEQ ID NO: 1210368 - RNA, 20 nt, Homo sapiens
cacccaggcuggagugcagu

SEQ ID NO: 1210369 - RNA, 23 nt, Homo sapiens
cacccaguugccaaaguuuugcu

SEQ ID NO: 1210370 - RNA, 22 nt, Homo sapiens
cacccauuuuugcucuauggga

SEQ ID NO: 1210371 - RNA, 21 nt, Homo sapiens
cacccccaacaggaauucuau

SEQ ID NO: 1210372 - RNA, 14 nt, Homo sapiens
cacccccagcucaa

SEQ ID NO: 1210373 - RNA, 18 nt, Homo sapiens
cacccccucuguugcaca

SEQ ID NO: 1210374 - RNA, 21 nt, Homo sapiens
caccccgucguauacccugga

SEQ ID NO: 1210375 - RNA, 16 nt, Homo sapiens
caccccuguccucacu

SEQ ID NO: 1210376 - RNA, 23 nt, Homo sapiens
caccccugugcuccgugccucca

SEQ ID NO: 1210377 - RNA, 20 nt, Homo sapiens
cacccggcucguguauuuau

SEQ ID NO: 1210378 - RNA, 15 nt, Homo sapiens
cacccgggaacuuuu

SEQ ID NO: 1210379 - RNA, 15 nt, Homo sapiens
cacccuccuacaggu

SEQ ID NO: 1210380 - RNA, 18 nt, Homo sapiens
cacccucuccuccagugu

SEQ ID NO: 1210381 - RNA, 14 nt, Homo sapiens
cacccugugccauc

SEQ ID NO: 1210382 - RNA, 16 nt, Homo sapiens
cacccuuaacccaagg

SEQ ID NO: 1210383 - RNA, 19 nt, Homo sapiens
cacccuuccuucuguaaau

SEQ ID NO: 1210384 - RNA, 19 nt, Homo sapiens
caccgaguggccauggcau

SEQ ID NO: 1210385 - RNA, 23 nt, Homo sapiens
caccgcggaggaggcuggugaca

SEQ ID NO: 1210386 - RNA, 18 nt, Homo sapiens
caccguacaucugcaaua

SEQ ID NO: 1210387 - RNA, 12 nt, Homo sapiens
caccgucuuccu

SEQ ID NO: 1210388 - RNA, 17 nt, Homo sapiens
caccgugaaauagguga

SEQ ID NO: 1210389 - RNA, 17 nt, Homo sapiens
caccuacauuaucucac

SEQ ID NO: 1210390 - RNA, 16 nt, Homo sapiens
caccuagagcuccagu

SEQ ID NO: 1210391 - RNA, 21 nt, Homo sapiens
caccuagcugugcaagaccua

SEQ ID NO: 1210392 - RNA, 22 nt, Homo sapiens
caccuauuuaagagggaacuua

SEQ ID NO: 1210393 - RNA, 18 nt, Homo sapiens
caccucaccccguuacag

SEQ ID NO: 1210394 - RNA, 19 nt, Homo sapiens
auuuucaacauaacugaag

SEQ ID NO: 1210395 - RNA, 20 nt, Homo sapiens
auuuucagaaaauauuaugu

SEQ ID NO: 1210396 - RNA, 14 nt, Homo sapiens
auuuucagcucaau

SEQ ID NO: 1210397 - RNA, 12 nt, Homo sapiens
auuuucaguaua

SEQ ID NO: 1210398 - RNA, 18 nt, Homo sapiens
auuuucaguauacugugu

SEQ ID NO: 1210399 - RNA, 13 nt, Homo sapiens
auuuucaucacug

SEQ ID NO: 1210400 - RNA, 18 nt, Homo sapiens
auuuuccaaugcacaguu

SEQ ID NO: 1210401 - RNA, 22 nt, Homo sapiens
auuuuccccccacucuccccac

SEQ ID NO: 1210402 - RNA, 14 nt, Homo sapiens
auuuucccuucccu

SEQ ID NO: 1210403 - RNA, 15 nt, Homo sapiens
auuuucuagacuuuc

SEQ ID NO: 1210404 - RNA, 17 nt, Homo sapiens
auuuucugaaaguuacc

SEQ ID NO: 1210405 - RNA, 15 nt, Homo sapiens
auuuucuggaaugga

SEQ ID NO: 1210406 - RNA, 23 nt, Homo sapiens
auuuucugucagaugagaacaaa

SEQ ID NO: 1210407 - RNA, 21 nt, Homo sapiens
auuuucuuguaugauagugac

SEQ ID NO: 1210408 - RNA, 20 nt, Homo sapiens
auuuucuuuacaauuucacu

SEQ ID NO: 1210409 - RNA, 17 nt, Homo sapiens
auuuugagaucaucagu

SEQ ID NO: 1210410 - RNA, 16 nt, Homo sapiens
auuuugcaaucugugu

SEQ ID NO: 1210411 - RNA, 20 nt, Homo sapiens
auuuugccauaaagucaaau

SEQ ID NO: 1210412 - RNA, 20 nt, Homo sapiens
auuuugcuaagacauaaucu

SEQ ID NO: 1210413 - RNA, 16 nt, Homo sapiens
auuuuggcgaaucuca

SEQ ID NO: 1210414 - RNA, 19 nt, Homo sapiens
auuuuggcgcuauuacaaa

SEQ ID NO: 1210415 - RNA, 23 nt, Homo sapiens
auuuugggggguaaucagcauua

SEQ ID NO: 1210416 - RNA, 20 nt, Homo sapiens
auuuugggguacccacugcu

SEQ ID NO: 1210417 - RNA, 17 nt, Homo sapiens
auuuugguuuguguauc

SEQ ID NO: 1210418 - RNA, 15 nt, Homo sapiens
auuuuguaccagugg

SEQ ID NO: 1210419 - RNA, 15 nt, Homo sapiens
auuuuguauguuaaa

SEQ ID NO: 1210420 - RNA, 18 nt, Homo sapiens
auuuuguuacuugcacuu

SEQ ID NO: 1210421 - RNA, 21 nt, Homo sapiens
auuuuguugccuucaucuuca

SEQ ID NO: 1210422 - RNA, 23 nt, Homo sapiens
auuuuuaaaggcauuagagucaa

SEQ ID NO: 1210423 - RNA, 17 nt, Homo sapiens
auuuuuaauauuacugu

SEQ ID NO: 1210424 - RNA, 21 nt, Homo sapiens
auuuuuaauguuuguacacaa

SEQ ID NO: 1210425 - RNA, 15 nt, Homo sapiens
auuuuuagcuuuuca

SEQ ID NO: 1210426 - RNA, 21 nt, Homo sapiens
auuuuuauaaaaaugagugcu

SEQ ID NO: 1210427 - RNA, 21 nt, Homo sapiens
auuuuuauacaaaccuaccaa

SEQ ID NO: 1210428 - RNA, 18 nt, Homo sapiens
auuuuuauacagugauaa

SEQ ID NO: 1210429 - RNA, 18 nt, Homo sapiens
auuuuuaugaaauacugc

SEQ ID NO: 1210430 - RNA, 15 nt, Homo sapiens
auuuuugaaaacugg

SEQ ID NO: 1210431 - RNA, 12 nt, Homo sapiens
auuuuugcaaug

SEQ ID NO: 1210432 - RNA, 23 nt, Homo sapiens
auuuuuggggaaaaaagcacaua

SEQ ID NO: 1210433 - RNA, 19 nt, Homo sapiens
auuuuuggugggaauccaa

SEQ ID NO: 1210434 - RNA, 19 nt, Homo sapiens
auuuuuguagagccagggu

SEQ ID NO: 1210435 - RNA, 17 nt, Homo sapiens
auuuuuguuagcaaaga

SEQ ID NO: 1210436 - RNA, 21 nt, Homo sapiens
auuuuuguuuuuguaaugcac

SEQ ID NO: 1210437 - RNA, 15 nt, Homo sapiens
auuuuuuaacuuucu

SEQ ID NO: 1210438 - RNA, 21 nt, Homo sapiens
auuuuuuagaugaccaaaacu

SEQ ID NO: 1210439 - RNA, 22 nt, Homo sapiens
auuuuuuauuucuaaguauuua

SEQ ID NO: 1210440 - RNA, 14 nt, Homo sapiens
auuuuuugcacagc

SEQ ID NO: 1210441 - RNA, 20 nt, Homo sapiens
auuuuuuguuauguuugcac

SEQ ID NO: 1210442 - RNA, 18 nt, Homo sapiens
auuuuuuugcaugcaugc

SEQ ID NO: 1210443 - RNA, 20 nt, Homo sapiens
auuuuuuuuuccaaaacaau

SEQ ID NO: 1210444 - RNA, 16 nt, Homo sapiens
auuuuuuuuugaagca

SEQ ID NO: 1210445 - RNA, 19 nt, Homo sapiens
caaaaaaaaaaaaaugcac

SEQ ID NO: 1210446 - RNA, 20 nt, Homo sapiens
caaaaaaaaccuucagugaa

SEQ ID NO: 1210447 - RNA, 13 nt, Homo sapiens
caaaaaaaccaca

SEQ ID NO: 1210448 - RNA, 14 nt, Homo sapiens
caaaaaaaccacaa

SEQ ID NO: 1210449 - RNA, 21 nt, Homo sapiens
caaaaaaaccucuaugcaauc

SEQ ID NO: 1210450 - RNA, 11 nt, Homo sapiens
caaaaaaucug

SEQ ID NO: 1210451 - RNA, 14 nt, Homo sapiens
caaaaaaucugacc

SEQ ID NO: 1210452 - RNA, 17 nt, Homo sapiens
caaaaaaucugaccaaa

SEQ ID NO: 1210453 - RNA, 14 nt, Homo sapiens
caaaaacuacacau

SEQ ID NO: 1210454 - RNA, 13 nt, Homo sapiens
caaaaacuuugga

SEQ ID NO: 1210455 - RNA, 23 nt, Homo sapiens
caaaaagaaaaaguuugugacau

SEQ ID NO: 1210456 - RNA, 21 nt, Homo sapiens
caaaaagccuuuuccagaaga

SEQ ID NO: 1210457 - RNA, 12 nt, Homo sapiens
caaaaagucaag

SEQ ID NO: 1210458 - RNA, 15 nt, Homo sapiens
caaaaauaguuaaaa

SEQ ID NO: 1210459 - RNA, 20 nt, Homo sapiens
caaaaaucuguguaacugua

SEQ ID NO: 1210460 - RNA, 23 nt, Homo sapiens
caaaaaugaaagcaugucucaau

SEQ ID NO: 1210461 - RNA, 12 nt, Homo sapiens
caaaaauguaau

SEQ ID NO: 1210462 - RNA, 18 nt, Homo sapiens
caaaaauguaaugaucau

SEQ ID NO: 1210463 - RNA, 20 nt, Homo sapiens
caaaaauguguaagaacaac

SEQ ID NO: 1210464 - RNA, 14 nt, Homo sapiens
caaaacaaaaagau

SEQ ID NO: 1210465 - RNA, 21 nt, Homo sapiens
caaaacaaguuuuucugucaa

SEQ ID NO: 1210466 - RNA, 13 nt, Homo sapiens
caaaacacugugu

SEQ ID NO: 1210467 - RNA, 12 nt, Homo sapiens
caaaacagccug

SEQ ID NO: 1210468 - RNA, 12 nt, Homo sapiens
caaaacauaucu

SEQ ID NO: 1210469 - RNA, 11 nt, Homo sapiens
caaaaccaaac

SEQ ID NO: 1210470 - RNA, 12 nt, Homo sapiens
caaaacccaggg

SEQ ID NO: 1210471 - RNA, 17 nt, Homo sapiens
caaaaccugauguuaaa

SEQ ID NO: 1210472 - RNA, 23 nt, Homo sapiens
caaaacucucugguuuacuucaa

SEQ ID NO: 1210473 - RNA, 16 nt, Homo sapiens
caaaacugaaccacaa

SEQ ID NO: 1210474 - RNA, 16 nt, Homo sapiens
caaaacugacaguaaa

SEQ ID NO: 1210475 - RNA, 13 nt, Homo sapiens
caaaacugccuca

SEQ ID NO: 1210476 - RNA, 13 nt, Homo sapiens
caaaacuuaggca

SEQ ID NO: 1210477 - RNA, 22 nt, Homo sapiens
caaaacuuuaaugaacuaacug

SEQ ID NO: 1210478 - RNA, 23 nt, Homo sapiens
caaaagaagacaacauuucucaa

SEQ ID NO: 1210479 - RNA, 18 nt, Homo sapiens
caaaagacaaacaugcaa

SEQ ID NO: 1210480 - RNA, 15 nt, Homo sapiens
caugaaaugcuucca

SEQ ID NO: 1210481 - RNA, 15 nt, Homo sapiens
caugaaauuuugccu

SEQ ID NO: 1210482 - RNA, 17 nt, Homo sapiens
caugaacagcucugaga

SEQ ID NO: 1210483 - RNA, 22 nt, Homo sapiens
caugaacaucuuuaggagacua

SEQ ID NO: 1210484 - RNA, 15 nt, Homo sapiens
caugaaccaagugga

SEQ ID NO: 1210485 - RNA, 15 nt, Homo sapiens
caugaauaaaacacu

SEQ ID NO: 1210486 - RNA, 22 nt, Homo sapiens
caugaaucccacccacauguga

SEQ ID NO: 1210487 - RNA, 13 nt, Homo sapiens
caugaaugcacac

SEQ ID NO: 1210488 - RNA, 17 nt, Homo sapiens
caugaauuaguucuccu

SEQ ID NO: 1210489 - RNA, 14 nt, Homo sapiens
caugaauuccuuaa

SEQ ID NO: 1210490 - RNA, 11 nt, Homo sapiens
caugacacuga

SEQ ID NO: 1210491 - RNA, 22 nt, Homo sapiens
caugaccugaucacuagccugu

SEQ ID NO: 1210492 - RNA, 18 nt, Homo sapiens
caugaccugcgcucucag

SEQ ID NO: 1210493 - RNA, 17 nt, Homo sapiens
ccgaggccgugcagugg

SEQ ID NO: 1210494 - RNA, 17 nt, Homo sapiens
ccgagugcaaugaauga

SEQ ID NO: 1210495 - RNA, 19 nt, Homo sapiens
ccgauauacucuagaugaa

SEQ ID NO: 1210496 - RNA, 23 nt, Homo sapiens
ccgcaacaguuuuuuaugcuaau

SEQ ID NO: 1210497 - RNA, 16 nt, Homo sapiens
ccgcagacgggcacag

SEQ ID NO: 1210498 - RNA, 17 nt, Homo sapiens
ccgcaggugcugguccc

SEQ ID NO: 1210499 - RNA, 22 nt, Homo sapiens
ccgcaggugggugcugcccugu

SEQ ID NO: 1210500 - RNA, 17 nt, Homo sapiens
ccgcauugauggccuca

SEQ ID NO: 1210501 - RNA, 21 nt, Homo sapiens
ccgcccacacccucggggggu

SEQ ID NO: 1210502 - RNA, 14 nt, Homo sapiens
ccgcccacagccag

SEQ ID NO: 1210503 - RNA, 22 nt, Homo sapiens
ccgccugaaagccacaaugaga

SEQ ID NO: 1210504 - RNA, 22 nt, Homo sapiens
ccgccuuccuccuccacagugc

SEQ ID NO: 1210505 - RNA, 20 nt, Homo sapiens
ccgcguuuagaccaaggaac

SEQ ID NO: 1210506 - RNA, 22 nt, Homo sapiens
ccgcuagcaguacuaaucaugu

SEQ ID NO: 1210507 - RNA, 23 nt, Homo sapiens
ccgcuccagggguggcuggagac

SEQ ID NO: 1210508 - RNA, 16 nt, Homo sapiens
ccgcugcgggcccacg

SEQ ID NO: 1210509 - RNA, 19 nt, Homo sapiens
ccggaacgucagccagcuc

SEQ ID NO: 1210510 - RNA, 17 nt, Homo sapiens
ccggagagacagugaca

SEQ ID NO: 1210511 - RNA, 18 nt, Homo sapiens
ccggaggaaaagcagcuc

SEQ ID NO: 1210512 - RNA, 15 nt, Homo sapiens
ccggcacacugccaa

SEQ ID NO: 1210513 - RNA, 16 nt, Homo sapiens
ccggcugaggccugag

SEQ ID NO: 1210514 - RNA, 18 nt, Homo sapiens
ccggcuuccacuccccac

SEQ ID NO: 1210515 - RNA, 13 nt, Homo sapiens
ccgggaaggggaa

SEQ ID NO: 1210516 - RNA, 13 nt, Homo sapiens
ccgggaaugagcu

SEQ ID NO: 1210517 - RNA, 23 nt, Homo sapiens
ccgggaggcagagguugcagugu

SEQ ID NO: 1210518 - RNA, 15 nt, Homo sapiens
ccggggccagcacuu

SEQ ID NO: 1210519 - RNA, 17 nt, Homo sapiens
ccgguucuuaaauccau

SEQ ID NO: 1210520 - RNA, 12 nt, Homo sapiens
ccguaacaacug

SEQ ID NO: 1210521 - RNA, 13 nt, Homo sapiens
ccguccacagggc

SEQ ID NO: 1210522 - RNA, 16 nt, Homo sapiens
ccgugcaguacaggca

SEQ ID NO: 1210523 - RNA, 21 nt, Homo sapiens
ccgugccaaaaaucuuuucau

SEQ ID NO: 1210524 - RNA, 15 nt, Homo sapiens
ccgugccugagcugc

SEQ ID NO: 1210525 - RNA, 19 nt, Homo sapiens
ccgugcugucuucuggucu

SEQ ID NO: 1210526 - RNA, 18 nt, Homo sapiens
ccugacacggacugugca

SEQ ID NO: 1210527 - RNA, 15 nt, Homo sapiens
ccugacagaugucag

SEQ ID NO: 1210528 - RNA, 19 nt, Homo sapiens
ccugacauucacacagaga

SEQ ID NO: 1210529 - RNA, 16 nt, Homo sapiens
ccugaccaucgcacac

SEQ ID NO: 1210530 - RNA, 12 nt, Homo sapiens
ccugaccccagu

SEQ ID NO: 1210531 - RNA, 12 nt, Homo sapiens
ccugaccucacu

SEQ ID NO: 1210532 - RNA, 18 nt, Homo sapiens
ccugagaaaggugaggag

SEQ ID NO: 1210533 - RNA, 13 nt, Homo sapiens
ccugagaccaguu

SEQ ID NO: 1210534 - RNA, 20 nt, Homo sapiens
ccugagaugauuuggucaga

SEQ ID NO: 1210535 - RNA, 19 nt, Homo sapiens
ccugagauucagaugucau

SEQ ID NO: 1210536 - RNA, 18 nt, Homo sapiens
ccugagcaaaaagaccag

SEQ ID NO: 1210537 - RNA, 20 nt, Homo sapiens
ccugagcaaaaagaccagcc

SEQ ID NO: 1210538 - RNA, 20 nt, Homo sapiens
ccugagcccuacucccugca

SEQ ID NO: 1210539 - RNA, 16 nt, Homo sapiens
ccugagcgagugucca

SEQ ID NO: 1210540 - RNA, 20 nt, Homo sapiens
ccugagcgugcuuuccaaaa

SEQ ID NO: 1210541 - RNA, 13 nt, Homo sapiens
ccugagcuaaaua

SEQ ID NO: 1210542 - RNA, 18 nt, Homo sapiens
ccugaggacugauuucag

SEQ ID NO: 1210543 - RNA, 17 nt, Homo sapiens
ccugaggauaacucaau

SEQ ID NO: 1210544 - RNA, 15 nt, Homo sapiens
ccugaggguccccac

SEQ ID NO: 1210545 - RNA, 23 nt, Homo sapiens
ccugaguggugccaaacaaaaag

SEQ ID NO: 1210546 - RNA, 20 nt, Homo sapiens
ccugauaccccugagggugg

SEQ ID NO: 1210547 - RNA, 16 nt, Homo sapiens
ccugaugcuaugguca

SEQ ID NO: 1210548 - RNA, 20 nt, Homo sapiens
ccugauggaaguaaagccuc

SEQ ID NO: 1210549 - RNA, 14 nt, Homo sapiens
ccugauguguccuc

SEQ ID NO: 1210550 - RNA, 21 nt, Homo sapiens
ccugcaaacucacugcucaag

SEQ ID NO: 1210551 - RNA, 14 nt, Homo sapiens
ccugcacaaggugg

SEQ ID NO: 1210552 - RNA, 21 nt, Homo sapiens
ccugcaccccugcaguuugag

SEQ ID NO: 1210553 - RNA, 23 nt, Homo sapiens
ccugcacuggggagcccgucuca

SEQ ID NO: 1210554 - RNA, 16 nt, Homo sapiens
ccugcagaagaagcug

SEQ ID NO: 1210555 - RNA, 16 nt, Homo sapiens
ccugcagaauccagcu

SEQ ID NO: 1210556 - RNA, 13 nt, Homo sapiens
ccugcagaugcca

SEQ ID NO: 1210557 - RNA, 18 nt, Homo sapiens
ccugcaggcugagccacu

SEQ ID NO: 1210558 - RNA, 20 nt, Homo sapiens
ccugcagggacuccaugcug

SEQ ID NO: 1210559 - RNA, 16 nt, Homo sapiens
ccugcaugugcuguca

SEQ ID NO: 1210560 - RNA, 13 nt, Homo sapiens
ccugcauuaacug

SEQ ID NO: 1210561 - RNA, 18 nt, Homo sapiens
ccugcauuucucuucuca

SEQ ID NO: 1210562 - RNA, 15 nt, Homo sapiens
ccugccaagagucaa

SEQ ID NO: 1210563 - RNA, 16 nt, Homo sapiens
cugauaacaacaggga

SEQ ID NO: 1210564 - RNA, 20 nt, Homo sapiens
cugauaaccacuccuaauau

SEQ ID NO: 1210565 - RNA, 14 nt, Homo sapiens
cugauaagcauuga

SEQ ID NO: 1210566 - RNA, 17 nt, Homo sapiens
cugauaagcuuccuaga

SEQ ID NO: 1210567 - RNA, 22 nt, Homo sapiens
cugauacacagaauauaaucuu

SEQ ID NO: 1210568 - RNA, 14 nt, Homo sapiens
cugauaccacugca

SEQ ID NO: 1210569 - RNA, 15 nt, Homo sapiens
cugauaccacugcac

SEQ ID NO: 1210570 - RNA, 22 nt, Homo sapiens
cugauauaacaaacuacaugua

SEQ ID NO: 1210571 - RNA, 17 nt, Homo sapiens
cugauaugggacugagc

SEQ ID NO: 1210572 - RNA, 18 nt, Homo sapiens
cugaucaagaacauguca

SEQ ID NO: 1210573 - RNA, 16 nt, Homo sapiens
cugaucacuagccugu

SEQ ID NO: 1210574 - RNA, 18 nt, Homo sapiens
cugaucgacguggugacg

SEQ ID NO: 1210575 - RNA, 16 nt, Homo sapiens
cugaucuagugcagua

SEQ ID NO: 1210576 - RNA, 11 nt, Homo sapiens
cugaucugcag

SEQ ID NO: 1210577 - RNA, 12 nt, Homo sapiens
cugaucugugau

SEQ ID NO: 1210578 - RNA, 19 nt, Homo sapiens
cugaucuuauucuguggug

SEQ ID NO: 1210579 - RNA, 18 nt, Homo sapiens
cugaugaaggcaugccua

SEQ ID NO: 1210580 - RNA, 16 nt, Homo sapiens
cugaugacauuccacc

SEQ ID NO: 1210581 - RNA, 17 nt, Homo sapiens
cugaugagaaucaugca

SEQ ID NO: 1210582 - RNA, 21 nt, Homo sapiens
cugauggaccgggugggccug

SEQ ID NO: 1210583 - RNA, 13 nt, Homo sapiens
cugauggccaagg

SEQ ID NO: 1210584 - RNA, 14 nt, Homo sapiens
cugauggcuugaca

SEQ ID NO: 1210585 - RNA, 14 nt, Homo sapiens
cugauggugacauu

SEQ ID NO: 1210586 - RNA, 19 nt, Homo sapiens
cugauguaccugaugcuau

SEQ ID NO: 1210587 - RNA, 18 nt, Homo sapiens
cugauguuaaaauuccau

SEQ ID NO: 1210588 - RNA, 18 nt, Homo sapiens
cugauguuacuagccucu

SEQ ID NO: 1210589 - RNA, 22 nt, Homo sapiens
cugauguuuugguguauuguca

SEQ ID NO: 1210590 - RNA, 16 nt, Homo sapiens
cugauuaccugccaau

SEQ ID NO: 1210591 - RNA, 16 nt, Homo sapiens
cugauuacucagagca

SEQ ID NO: 1210592 - RNA, 20 nt, Homo sapiens
cugauucauaauaaauaucu

SEQ ID NO: 1210593 - RNA, 15 nt, Homo sapiens
cugauuccacuuuua

SEQ ID NO: 1210594 - RNA, 17 nt, Homo sapiens
cugauuuccuaauguca

SEQ ID NO: 1210595 - RNA, 13 nt, Homo sapiens
cugauuucucaca

SEQ ID NO: 1210596 - RNA, 20 nt, Homo sapiens
cugauuucuucagaauuaga

SEQ ID NO: 1210597 - RNA, 14 nt, Homo sapiens
cugauuugauacca

SEQ ID NO: 1210598 - RNA, 15 nt, Homo sapiens
cugauuugauaccau

SEQ ID NO: 1210599 - RNA, 18 nt, Homo sapiens
cugauuugauaccauggc

SEQ ID NO: 1210600 - RNA, 17 nt, Homo sapiens
cugauuuuaacaauaac

SEQ ID NO: 1210601 - RNA, 21 nt, Homo sapiens
cugauuuuuaaaguacuuucu

SEQ ID NO: 1210602 - RNA, 19 nt, Homo sapiens
cugauuuuuagcuuuacaa

SEQ ID NO: 1210603 - RNA, 15 nt, Homo sapiens
cugcaaaaaaagccu

SEQ ID NO: 1210604 - RNA, 15 nt, Homo sapiens
cugcaaauacuguau

SEQ ID NO: 1210605 - RNA, 19 nt, Homo sapiens
cugcaaucugagccagugc

SEQ ID NO: 1210606 - RNA, 21 nt, Homo sapiens
cugcaaucugagccagugcuu

SEQ ID NO: 1210607 - RNA, 17 nt, Homo sapiens
cugcacaaacaauaugu

SEQ ID NO: 1210608 - RNA, 18 nt, Homo sapiens
cugcacacccuccagaga

SEQ ID NO: 1210609 - RNA, 17 nt, Homo sapiens
cugcacagugcaucuca

SEQ ID NO: 1210610 - RNA, 18 nt, Homo sapiens
cugcacagugcaucucag

SEQ ID NO: 1210611 - RNA, 17 nt, Homo sapiens
cugcacaugucuuguac

SEQ ID NO: 1210612 - RNA, 16 nt, Homo sapiens
cugcacaugugccaca

SEQ ID NO: 1210613 - RNA, 17 nt, Homo sapiens
cugcacccacccaggag

SEQ ID NO: 1210614 - RNA, 14 nt, Homo sapiens
cugcacccaugaca

SEQ ID NO: 1210615 - RNA, 15 nt, Homo sapiens
cugcacccucgauga

SEQ ID NO: 1210616 - RNA, 12 nt, Homo sapiens
cugcaccuguca

SEQ ID NO: 1210617 - RNA, 19 nt, Homo sapiens
cugcacuccagccuggcaa

SEQ ID NO: 1210618 - RNA, 20 nt, Homo sapiens
cugcacuccagccuggggga

SEQ ID NO: 1210619 - RNA, 19 nt, Homo sapiens
cugcacuccagucuggcaa

SEQ ID NO: 1210620 - RNA, 17 nt, Homo sapiens
cugcacugaucacccaa

SEQ ID NO: 1210621 - RNA, 22 nt, Homo sapiens
cugcacuugauguuuguuugca

SEQ ID NO: 1210622 - RNA, 15 nt, Homo sapiens
cugcagaaauuugca

SEQ ID NO: 1210623 - RNA, 17 nt, Homo sapiens
cugcagagggacagaug

SEQ ID NO: 1210624 - RNA, 13 nt, Homo sapiens
cugcagcaaacac

SEQ ID NO: 1210625 - RNA, 19 nt, Homo sapiens
cugcagcaggccacugggg

SEQ ID NO: 1210626 - RNA, 15 nt, Homo sapiens
cugcagcauguugcu

SEQ ID NO: 1210627 - RNA, 21 nt, Homo sapiens
cugcagccagcucacguccag

SEQ ID NO: 1210628 - RNA, 17 nt, Homo sapiens
cugcagcucccauuuca

SEQ ID NO: 1210629 - RNA, 23 nt, Homo sapiens
cugcaggagagucgggggaccag

SEQ ID NO: 1210630 - RNA, 22 nt, Homo sapiens
cugcagggcaggcacucgggaa

SEQ ID NO: 1210631 - RNA, 22 nt, Homo sapiens
cugcagggggugugucugcuca

SEQ ID NO: 1210632 - RNA, 13 nt, Homo sapiens
auaucagagcucu

SEQ ID NO: 1210633 - RNA, 16 nt, Homo sapiens
auaucagggauucuau

SEQ ID NO: 1210634 - RNA, 11 nt, Homo sapiens
auaucagugaa

SEQ ID NO: 1210635 - RNA, 20 nt, Homo sapiens
auaucaguuugcuagcagaa

SEQ ID NO: 1210636 - RNA, 22 nt, Homo sapiens
auaucaucaaugugacauuuac

SEQ ID NO: 1210637 - RNA, 14 nt, Homo sapiens
auaucaugcaaaau

SEQ ID NO: 1210638 - RNA, 17 nt, Homo sapiens
auaucaugguagucacu

SEQ ID NO: 1210639 - RNA, 19 nt, Homo sapiens
auaucauuuauccuuacau

SEQ ID NO: 1210640 - RNA, 17 nt, Homo sapiens
auauccaaagacuguac

SEQ ID NO: 1210641 - RNA, 21 nt, Homo sapiens
auaucccuacauguauugcac

SEQ ID NO: 1210642 - RNA, 15 nt, Homo sapiens
auauccuauggucuu

SEQ ID NO: 1210643 - RNA, 14 nt, Homo sapiens
auauccugugacug

SEQ ID NO: 1210644 - RNA, 16 nt, Homo sapiens
auaucugaaaauguau

SEQ ID NO: 1210645 - RNA, 20 nt, Homo sapiens
auaucugaagagcuauuaua

SEQ ID NO: 1210646 - RNA, 16 nt, Homo sapiens
auaucuguaaugauac

SEQ ID NO: 1210647 - RNA, 19 nt, Homo sapiens
auaucuguguauuaucuca

SEQ ID NO: 1210648 - RNA, 20 nt, Homo sapiens
auaugaaaaucuccaucuca

SEQ ID NO: 1210649 - RNA, 17 nt, Homo sapiens
auaugaaggauuacucu

SEQ ID NO: 1210650 - RNA, 17 nt, Homo sapiens
auaugacaauaagccac

SEQ ID NO: 1210651 - RNA, 19 nt, Homo sapiens
auaugaccauuugacuguu

SEQ ID NO: 1210652 - RNA, 21 nt, Homo sapiens
auaugaccauuugacuguuca

SEQ ID NO: 1210653 - RNA, 22 nt, Homo sapiens
auaugagcuuccuucugugaaa

SEQ ID NO: 1210654 - RNA, 14 nt, Homo sapiens
auaugaguauacaa

SEQ ID NO: 1210655 - RNA, 15 nt, Homo sapiens
auaugaguuacugaa

SEQ ID NO: 1210656 - RNA, 19 nt, Homo sapiens
auaugauacucucagauuu

SEQ ID NO: 1210657 - RNA, 20 nt, Homo sapiens
auaugaucaguguuacugcc

SEQ ID NO: 1210658 - RNA, 21 nt, Homo sapiens
auaugauggggcaugugccau

SEQ ID NO: 1210659 - RNA, 22 nt, Homo sapiens
auaugcagugauauggcagaag

SEQ ID NO: 1210660 - RNA, 21 nt, Homo sapiens
auaugccuuggggaggacaaa

SEQ ID NO: 1210661 - RNA, 13 nt, Homo sapiens
auaugcgcuuaaa

SEQ ID NO: 1210662 - RNA, 20 nt, Homo sapiens
auaugcuuauacacuuacac

SEQ ID NO: 1210663 - RNA, 20 nt, Homo sapiens
auaugcuuggcuaacuauau

SEQ ID NO: 1210664 - RNA, 16 nt, Homo sapiens
auauggacucugcaca

SEQ ID NO: 1210665 - RNA, 17 nt, Homo sapiens
auauggacucugcacau

SEQ ID NO: 1210666 - RNA, 18 nt, Homo sapiens
auauggggaaaaaacugu

SEQ ID NO: 1210667 - RNA, 18 nt, Homo sapiens
auauguaaagcacaucag

SEQ ID NO: 1210668 - RNA, 17 nt, Homo sapiens
auauguacaauuguggg

SEQ ID NO: 1210669 - RNA, 14 nt, Homo sapiens
auauguaccaugua

SEQ ID NO: 1210670 - RNA, 22 nt, Homo sapiens
auauguaucuaaaccauaugaa

SEQ ID NO: 1210671 - RNA, 21 nt, Homo sapiens
auauguauuacaaauggugaa

SEQ ID NO: 1210672 - RNA, 20 nt, Homo sapiens
auauguccgcagaauggacu

SEQ ID NO: 1210673 - RNA, 20 nt, Homo sapiens
auaugucucaggucccugca

SEQ ID NO: 1210674 - RNA, 17 nt, Homo sapiens
auauguguauauauaca

SEQ ID NO: 1210675 - RNA, 21 nt, Homo sapiens
auauguguauauauacauaca

SEQ ID NO: 1210676 - RNA, 17 nt, Homo sapiens
auauguguauguacguu

SEQ ID NO: 1210677 - RNA, 15 nt, Homo sapiens
auauguugcuauaau

SEQ ID NO: 1210678 - RNA, 16 nt, Homo sapiens
auauguuggaaaaaag

SEQ ID NO: 1210679 - RNA, 19 nt, Homo sapiens
auauguuuauauacugggu

SEQ ID NO: 1210680 - RNA, 19 nt, Homo sapiens
auauuaauuuuccaaugca

SEQ ID NO: 1210681 - RNA, 12 nt, Homo sapiens
auauuacuuguu

SEQ ID NO: 1210682 - RNA, 21 nt, Homo sapiens
auauuacuuguuuucacuuua

SEQ ID NO: 1210683 - RNA, 23 nt, Homo sapiens
auauuacuuguuuucacuuuauc

SEQ ID NO: 1210684 - RNA, 16 nt, Homo sapiens
auauuagcauugccaa

SEQ ID NO: 1210685 - RNA, 12 nt, Homo sapiens
auauuaucucau

SEQ ID NO: 1210686 - RNA, 20 nt, Homo sapiens
auauuauuauuaauuuugcc

SEQ ID NO: 1210687 - RNA, 21 nt, Homo sapiens
auauuauuauuaauuuugcca

SEQ ID NO: 1210688 - RNA, 17 nt, Homo sapiens
auauucugcaacacugu

SEQ ID NO: 1210689 - RNA, 18 nt, Homo sapiens
auauucugguuacugugg

SEQ ID NO: 1210690 - RNA, 12 nt, Homo sapiens
auauugaugaaa

SEQ ID NO: 1210691 - RNA, 18 nt, Homo sapiens
auauugcaguaguauuua

SEQ ID NO: 1210692 - RNA, 12 nt, Homo sapiens
auauugccuuau

SEQ ID NO: 1210693 - RNA, 13 nt, Homo sapiens
auauuguccugcu

SEQ ID NO: 1210694 - RNA, 16 nt, Homo sapiens
auauugugauucugcc

SEQ ID NO: 1210695 - RNA, 13 nt, Homo sapiens
auauugugcaaac

SEQ ID NO: 1210696 - RNA, 12 nt, Homo sapiens
auauuguugccg

SEQ ID NO: 1210697 - RNA, 21 nt, Homo sapiens
auauuuaugagaaaguucuca

SEQ ID NO: 1210698 - RNA, 18 nt, Homo sapiens
auauuucaggcauacuga

SEQ ID NO: 1210699 - RNA, 18 nt, Homo sapiens
auauuucuaccugaguga

SEQ ID NO: 1210700 - RNA, 14 nt, Homo sapiens
auauuucuagacau

SEQ ID NO: 1210701 - RNA, 15 nt, Homo sapiens
auauuugacuugcau

SEQ ID NO: 1210702 - RNA, 19 nt, Homo sapiens
auauuugagagacauuugu

SEQ ID NO: 1210703 - RNA, 15 nt, Homo sapiens
auauuugguaccaug

SEQ ID NO: 1210704 - RNA, 16 nt, Homo sapiens
auauuuuaaagaccaa

SEQ ID NO: 1210705 - RNA, 19 nt, Homo sapiens
auauuuuaaagcacuuuaa

SEQ ID NO: 1210706 - RNA, 17 nt, Homo sapiens
auauuuuagcauuuuaa

SEQ ID NO: 1210707 - RNA, 22 nt, Homo sapiens
auauuuuauaaagauacuaaac

SEQ ID NO: 1210708 - RNA, 15 nt, Homo sapiens
auaaagucucucuga

SEQ ID NO: 1210709 - RNA, 13 nt, Homo sapiens
auaaagugaaugu

SEQ ID NO: 1210710 - RNA, 19 nt, Homo sapiens
auaaauaaacuguugcucg

SEQ ID NO: 1210711 - RNA, 15 nt, Homo sapiens
auaaauaauucuucc

SEQ ID NO: 1210712 - RNA, 14 nt, Homo sapiens
auaaauauacagua

SEQ ID NO: 1210713 - RNA, 14 nt, Homo sapiens
auaaauauacucaa

SEQ ID NO: 1210714 - RNA, 16 nt, Homo sapiens
auaaauauuacaguga

SEQ ID NO: 1210715 - RNA, 21 nt, Homo sapiens
auaaauauuauuagauuuauu

SEQ ID NO: 1210716 - RNA, 15 nt, Homo sapiens
auaaauauucuagca

SEQ ID NO: 1210717 - RNA, 19 nt, Homo sapiens
auaaaucaaugucacuuaa

SEQ ID NO: 1210718 - RNA, 19 nt, Homo sapiens
auaaaucagccuaaauguc

SEQ ID NO: 1210719 - RNA, 17 nt, Homo sapiens
auaaaucauuaagacaa

SEQ ID NO: 1210720 - RNA, 19 nt, Homo sapiens
auaaaucuaacaguuacuc

SEQ ID NO: 1210721 - RNA, 14 nt, Homo sapiens
auaaaugacaaugu

SEQ ID NO: 1210722 - RNA, 16 nt, Homo sapiens
auaaaugacacaauga

SEQ ID NO: 1210723 - RNA, 16 nt, Homo sapiens
auaaaugagcaaauau

SEQ ID NO: 1210724 - RNA, 15 nt, Homo sapiens
auaaaugaguucaac

SEQ ID NO: 1210725 - RNA, 14 nt, Homo sapiens
auaaaugccuuuau

SEQ ID NO: 1210726 - RNA, 17 nt, Homo sapiens
auaaauguacauuaauu

SEQ ID NO: 1210727 - RNA, 16 nt, Homo sapiens
auaaauguugcaaugc

SEQ ID NO: 1210728 - RNA, 13 nt, Homo sapiens
auaaauguuuaaa

SEQ ID NO: 1210729 - RNA, 17 nt, Homo sapiens
auaaauucagauauauu

SEQ ID NO: 1210730 - RNA, 14 nt, Homo sapiens
auaaauucuacucu

SEQ ID NO: 1210731 - RNA, 22 nt, Homo sapiens
auaaauuggugauaaguggaaa

SEQ ID NO: 1210732 - RNA, 21 nt, Homo sapiens
auaaauuuggaucauguuaug

SEQ ID NO: 1210733 - RNA, 14 nt, Homo sapiens
auaacaacuuugaa

SEQ ID NO: 1210734 - RNA, 19 nt, Homo sapiens
auaacaagugggugaaugu

SEQ ID NO: 1210735 - RNA, 22 nt, Homo sapiens
auaacacagagagacagacuug

SEQ ID NO: 1210736 - RNA, 12 nt, Homo sapiens
auaacagaauua

SEQ ID NO: 1210737 - RNA, 23 nt, Homo sapiens
auaacagaugugaaaauauacuu

SEQ ID NO: 1210738 - RNA, 21 nt, Homo sapiens
auaacauuuucaauacugucc

SEQ ID NO: 1210739 - RNA, 14 nt, Homo sapiens
auaaccacuccuaa

SEQ ID NO: 1210740 - RNA, 15 nt, Homo sapiens
auaacccuaacacac

SEQ ID NO: 1210741 - RNA, 18 nt, Homo sapiens
auaacccuacacccagac

SEQ ID NO: 1210742 - RNA, 16 nt, Homo sapiens
auaaccuugugccuug

SEQ ID NO: 1210743 - RNA, 14 nt, Homo sapiens
auaaccuuguucca

SEQ ID NO: 1210744 - RNA, 16 nt, Homo sapiens
auaacuaaacuaacga

SEQ ID NO: 1210745 - RNA, 19 nt, Homo sapiens
auaacuaaauuugauacuu

SEQ ID NO: 1210746 - RNA, 16 nt, Homo sapiens
auaacucaagaaauca

SEQ ID NO: 1210747 - RNA, 13 nt, Homo sapiens
auaacucaauaua

SEQ ID NO: 1210748 - RNA, 23 nt, Homo sapiens
auaacucuguaaaaacacugaaa

SEQ ID NO: 1210749 - RNA, 14 nt, Homo sapiens
auaacugaaccaaa

SEQ ID NO: 1210750 - RNA, 21 nt, Homo sapiens
auaacuuaaaaaaaugacaga

SEQ ID NO: 1210751 - RNA, 14 nt, Homo sapiens
auaacuuacuguau

SEQ ID NO: 1210752 - RNA, 14 nt, Homo sapiens
auaacuucugaccu

SEQ ID NO: 1210753 - RNA, 14 nt, Homo sapiens
auaacuucuuccug

SEQ ID NO: 1210754 - RNA, 16 nt, Homo sapiens
auaacuuuacagaaau

SEQ ID NO: 1210755 - RNA, 14 nt, Homo sapiens
auaagaaagcacua

SEQ ID NO: 1210756 - RNA, 18 nt, Homo sapiens
auaagaaagcacuauuaa

SEQ ID NO: 1210757 - RNA, 17 nt, Homo sapiens
auaagaggugaucucug

SEQ ID NO: 1210758 - RNA, 20 nt, Homo sapiens
auaagaguugagauuuugca

SEQ ID NO: 1210759 - RNA, 17 nt, Homo sapiens
auaagcacugugcuaau

SEQ ID NO: 1210760 - RNA, 18 nt, Homo sapiens
auaagcauacaacuggac

SEQ ID NO: 1210761 - RNA, 13 nt, Homo sapiens
auaagcuacaugu

SEQ ID NO: 1210762 - RNA, 17 nt, Homo sapiens
auaagcucgagugaauu

SEQ ID NO: 1210763 - RNA, 15 nt, Homo sapiens
auaaggaaagcaaua

SEQ ID NO: 1210764 - RNA, 14 nt, Homo sapiens
auaagguaugugcu

SEQ ID NO: 1210765 - RNA, 13 nt, Homo sapiens
auaaguacauuau

SEQ ID NO: 1210766 - RNA, 19 nt, Homo sapiens
auaaguaucacacuguaua

SEQ ID NO: 1210767 - RNA, 20 nt, Homo sapiens
auaaguaucacacuguauau

SEQ ID NO: 1210768 - RNA, 21 nt, Homo sapiens
auaagucaugugucccagcau

SEQ ID NO: 1210769 - RNA, 22 nt, Homo sapiens
auaaguguuauguuuguagaua

SEQ ID NO: 1210770 - RNA, 20 nt, Homo sapiens
auaaguuauuuuuguacaug

SEQ ID NO: 1210771 - RNA, 18 nt, Homo sapiens
auaaguugugauuugacg

SEQ ID NO: 1210772 - RNA, 16 nt, Homo sapiens
auaaguuugcaguugg

SEQ ID NO: 1210773 - RNA, 17 nt, Homo sapiens
auaauaaaaaauauucu

SEQ ID NO: 1210774 - RNA, 16 nt, Homo sapiens
auaauaaacaguggaa

SEQ ID NO: 1210775 - RNA, 12 nt, Homo sapiens
auaauaaaucac

SEQ ID NO: 1210776 - RNA, 19 nt, Homo sapiens
auaauaacucggauuccag

SEQ ID NO: 1210777 - RNA, 16 nt, Homo sapiens
auaauaagcuaaagag

SEQ ID NO: 1210778 - RNA, 12 nt, Homo sapiens
auaauaauagca

SEQ ID NO: 1210779 - RNA, 13 nt, Homo sapiens
auaauacccagga

SEQ ID NO: 1210780 - RNA, 13 nt, Homo sapiens
auaauacucuguu

SEQ ID NO: 1210781 - RNA, 17 nt, Homo sapiens
auaauaggaacaaucuu

SEQ ID NO: 1210782 - RNA, 12 nt, Homo sapiens
auaauagucaau

SEQ ID NO: 1210783 - RNA, 17 nt, Homo sapiens
auaauaguccaccuccc

SEQ ID NO: 1210784 - RNA, 17 nt, Homo sapiens
auaauaugaaaaucucc

SEQ ID NO: 1210785 - RNA, 15 nt, Homo sapiens
auaaucacauuauca

SEQ ID NO: 1210786 - RNA, 19 nt, Homo sapiens
auaaucacauuaucaucug

SEQ ID NO: 1210787 - RNA, 14 nt, Homo sapiens
auaaucacauugac

SEQ ID NO: 1210788 - RNA, 15 nt, Homo sapiens
auaaucauacugucu

SEQ ID NO: 1210789 - RNA, 15 nt, Homo sapiens
auaaucccacccacc

SEQ ID NO: 1210790 - RNA, 21 nt, Homo sapiens
auaaucuuguagacacuuacu

SEQ ID NO: 1210791 - RNA, 16 nt, Homo sapiens
auaaugcaccacuuuu

SEQ ID NO: 1210792 - RNA, 15 nt, Homo sapiens
auaaugcucauacuu

SEQ ID NO: 1210793 - RNA, 16 nt, Homo sapiens
auaaugcuuuguuaaa

SEQ ID NO: 1210794 - RNA, 15 nt, Homo sapiens
auaauuaaaaaccac

SEQ ID NO: 1210795 - RNA, 13 nt, Homo sapiens
auaauucacucaa

SEQ ID NO: 1210796 - RNA, 22 nt, Homo sapiens
auaauuccuauauccugugacu

SEQ ID NO: 1210797 - RNA, 20 nt, Homo sapiens
auaauucuguacauagccua

SEQ ID NO: 1210798 - RNA, 22 nt, Homo sapiens
auaauucuuuucuuuuccauuu

SEQ ID NO: 1210799 - RNA, 15 nt, Homo sapiens
auaauugcuuugcca

SEQ ID NO: 1210800 - RNA, 15 nt, Homo sapiens
auaauuggugcuauu

SEQ ID NO: 1210801 - RNA, 16 nt, Homo sapiens
auaauuuaacuguguu

SEQ ID NO: 1210802 - RNA, 19 nt, Homo sapiens
auaauuucaaaccacacau

SEQ ID NO: 1210803 - RNA, 20 nt, Homo sapiens
auaauuucuagaaacaaaca

SEQ ID NO: 1210804 - RNA, 14 nt, Homo sapiens
auaauuugcacuua

SEQ ID NO: 1210805 - RNA, 16 nt, Homo sapiens
auaauuuuaugcugga

SEQ ID NO: 1210806 - RNA, 19 nt, Homo sapiens
auaauuuuccucaaucaca

SEQ ID NO: 1210807 - RNA, 11 nt, Homo sapiens
auaauuuugca

SEQ ID NO: 1210808 - RNA, 12 nt, Homo sapiens
auaauuuugccu

SEQ ID NO: 1210809 - RNA, 17 nt, Homo sapiens
auacaaaaaaaauuuag

SEQ ID NO: 1210810 - RNA, 17 nt, Homo sapiens
auacaaaaauaccuacu

SEQ ID NO: 1210811 - RNA, 21 nt, Homo sapiens
auacaaaguguaccaacauaa

SEQ ID NO: 1210812 - RNA, 14 nt, Homo sapiens
auacaaauuccaca

SEQ ID NO: 1210813 - RNA, 15 nt, Homo sapiens
auacaacaggcagug

SEQ ID NO: 1210814 - RNA, 13 nt, Homo sapiens
auacaacauguag

SEQ ID NO: 1210815 - RNA, 16 nt, Homo sapiens
auacaagaaagcaaug

SEQ ID NO: 1210816 - RNA, 14 nt, Homo sapiens
auacacaagcaaug

SEQ ID NO: 1210817 - RNA, 13 nt, Homo sapiens
auacacacacaca

SEQ ID NO: 1210818 - RNA, 15 nt, Homo sapiens
auacacacaugcccu

SEQ ID NO: 1210819 - RNA, 15 nt, Homo sapiens
auacacagugcugac

SEQ ID NO: 1210820 - RNA, 13 nt, Homo sapiens
auacacuaugaag

SEQ ID NO: 1210821 - RNA, 20 nt, Homo sapiens
auacacuuuuuaaaaucuca

SEQ ID NO: 1210822 - RNA, 21 nt, Homo sapiens
auacagauagaguuccauaua

SEQ ID NO: 1210823 - RNA, 22 nt, Homo sapiens
auacagcccugacgcaaugaaa

SEQ ID NO: 1210824 - RNA, 20 nt, Homo sapiens
auacagcucuacguggcaaa

SEQ ID NO: 1210825 - RNA, 19 nt, Homo sapiens
auacagcuguauugucuga

SEQ ID NO: 1210826 - RNA, 14 nt, Homo sapiens
auacaguuauuaaa

SEQ ID NO: 1210827 - RNA, 19 nt, Homo sapiens
auacauaucgcugacuuca

SEQ ID NO: 1210828 - RNA, 17 nt, Homo sapiens
auacaucaaaauauacu

SEQ ID NO: 1210829 - RNA, 21 nt, Homo sapiens
auacaugugccgaaugugcag

SEQ ID NO: 1210830 - RNA, 17 nt, Homo sapiens
auaccaaccaaaccaau

SEQ ID NO: 1210831 - RNA, 13 nt, Homo sapiens
auaccacugcacu

SEQ ID NO: 1210832 - RNA, 16 nt, Homo sapiens
auaccacuuaccucaa

SEQ ID NO: 1210833 - RNA, 16 nt, Homo sapiens
auaccauggcacugac

SEQ ID NO: 1210834 - RNA, 17 nt, Homo sapiens
auaccauggcacugaca

SEQ ID NO: 1210835 - RNA, 19 nt, Homo sapiens
auaccauggcacugacaau

SEQ ID NO: 1210836 - RNA, 20 nt, Homo sapiens
auaccauggcacugacaaug

SEQ ID NO: 1210837 - RNA, 20 nt, Homo sapiens
aucacuuucucaguuuucau

SEQ ID NO: 1210838 - RNA, 19 nt, Homo sapiens
aucacuuuucagaagacuu

SEQ ID NO: 1210839 - RNA, 20 nt, Homo sapiens
aucagaagcucccagcugac

SEQ ID NO: 1210840 - RNA, 13 nt, Homo sapiens
aucagaauaucag

SEQ ID NO: 1210841 - RNA, 16 nt, Homo sapiens
aucagaccauaauguu

SEQ ID NO: 1210842 - RNA, 22 nt, Homo sapiens
aucagaccauaauguuacauua

SEQ ID NO: 1210843 - RNA, 13 nt, Homo sapiens
aucagacuaguga

SEQ ID NO: 1210844 - RNA, 16 nt, Homo sapiens
aucagacuagugacaa

SEQ ID NO: 1210845 - RNA, 22 nt, Homo sapiens
aucagaggucuauuuuuaccua

SEQ ID NO: 1210846 - RNA, 17 nt, Homo sapiens
aucagaugcuccaagau

SEQ ID NO: 1210847 - RNA, 21 nt, Homo sapiens
aucagccauaagaaagcacua

SEQ ID NO: 1210848 - RNA, 11 nt, Homo sapiens
aucagcuuugu

SEQ ID NO: 1210849 - RNA, 19 nt, Homo sapiens
aucaggaauauuuuccaaa

SEQ ID NO: 1210850 - RNA, 18 nt, Homo sapiens
aucaggacagguggugca

SEQ ID NO: 1210851 - RNA, 21 nt, Homo sapiens
aucaggacagguggugcaaau

SEQ ID NO: 1210852 - RNA, 21 nt, Homo sapiens
aucaggcuauguauggaauac

SEQ ID NO: 1210853 - RNA, 15 nt, Homo sapiens
aucagggacaggaug

SEQ ID NO: 1210854 - RNA, 17 nt, Homo sapiens
aucagggaggucauuuu

SEQ ID NO: 1210855 - RNA, 12 nt, Homo sapiens
aucaggucuccc

SEQ ID NO: 1210856 - RNA, 18 nt, Homo sapiens
aucaggugaggugugcuc

SEQ ID NO: 1210857 - RNA, 15 nt, Homo sapiens
aucaguacugacuuu

SEQ ID NO: 1210858 - RNA, 15 nt, Homo sapiens
aucagucaacaacuu

SEQ ID NO: 1210859 - RNA, 16 nt, Homo sapiens
aucagucauaacuaaa

SEQ ID NO: 1210860 - RNA, 13 nt, Homo sapiens
aucagucaugugu

SEQ ID NO: 1210861 - RNA, 18 nt, Homo sapiens
aucaguccauugcucuug

SEQ ID NO: 1210862 - RNA, 17 nt, Homo sapiens
aucagucuauccacaga

SEQ ID NO: 1210863 - RNA, 20 nt, Homo sapiens
aucagugaagccaaagggac

SEQ ID NO: 1210864 - RNA, 15 nt, Homo sapiens
aucagugccucuuug

SEQ ID NO: 1210865 - RNA, 16 nt, Homo sapiens
aucaguguaccauuug

SEQ ID NO: 1210866 - RNA, 20 nt, Homo sapiens
aucaguguccucuugcucaa

SEQ ID NO: 1210867 - RNA, 18 nt, Homo sapiens
aucaguguuuuaaauucu

SEQ ID NO: 1210868 - RNA, 17 nt, Homo sapiens
aucaguuuccagucuca

SEQ ID NO: 1210869 - RNA, 13 nt, Homo sapiens
aucauaaagucag

SEQ ID NO: 1210870 - RNA, 16 nt, Homo sapiens
aucauauucauaugca

SEQ ID NO: 1210871 - RNA, 18 nt, Homo sapiens
aucauauugaauguuucc

SEQ ID NO: 1210872 - RNA, 19 nt, Homo sapiens
aucaucaaaaacuuuggag

SEQ ID NO: 1210873 - RNA, 23 nt, Homo sapiens
aucaucacauugagcugauauaa

SEQ ID NO: 1210874 - RNA, 15 nt, Homo sapiens
aucaugaacagcucu

SEQ ID NO: 1210875 - RNA, 14 nt, Homo sapiens
aucaugaagcacau

SEQ ID NO: 1210876 - RNA, 22 nt, Homo sapiens
aucaugaagcacaucaauuaca

SEQ ID NO: 1210877 - RNA, 13 nt, Homo sapiens
aucaugaagccca

SEQ ID NO: 1210878 - RNA, 23 nt, Homo sapiens
aucaugagcaagugaacacuguu

SEQ ID NO: 1210879 - RNA, 14 nt, Homo sapiens
aucaugcauuguug

SEQ ID NO: 1210880 - RNA, 14 nt, Homo sapiens
aucaugcccugccu

SEQ ID NO: 1210881 - RNA, 14 nt, Homo sapiens
aucauggaaaugua

SEQ ID NO: 1210882 - RNA, 20 nt, Homo sapiens
aucauggaaauguauuuuag

SEQ ID NO: 1210883 - RNA, 15 nt, Homo sapiens
aucaugugaggaaau

SEQ ID NO: 1210884 - RNA, 20 nt, Homo sapiens
aucauuacugccaucuuuau

SEQ ID NO: 1210885 - RNA, 12 nt, Homo sapiens
aucauuagaaca

SEQ ID NO: 1210886 - RNA, 14 nt, Homo sapiens
aucauuauaucauu

SEQ ID NO: 1210887 - RNA, 20 nt, Homo sapiens
aucauuggaacaacugauac

SEQ ID NO: 1210888 - RNA, 15 nt, Homo sapiens
aucauuucaguauca

SEQ ID NO: 1210889 - RNA, 20 nt, Homo sapiens
auccaaaaauagcccugcaa

SEQ ID NO: 1210890 - RNA, 13 nt, Homo sapiens
auccaaauaucau

SEQ ID NO: 1210891 - RNA, 19 nt, Homo sapiens
auccaacacuggaugguca

SEQ ID NO: 1210892 - RNA, 19 nt, Homo sapiens
auccaaccccccaccugcc

SEQ ID NO: 1210893 - RNA, 13 nt, Homo sapiens
auccaacccgggg

SEQ ID NO: 1210894 - RNA, 13 nt, Homo sapiens
auccaacuccagc

SEQ ID NO: 1210895 - RNA, 16 nt, Homo sapiens
auccaagaaucaguga

SEQ ID NO: 1210896 - RNA, 18 nt, Homo sapiens
auccaagaaucagugaag

SEQ ID NO: 1210897 - RNA, 17 nt, Homo sapiens
auccaaucucaaggaau

SEQ ID NO: 1210898 - RNA, 15 nt, Homo sapiens
auccaaucugugaug

SEQ ID NO: 1210899 - RNA, 18 nt, Homo sapiens
auccaauggguuuuuccc

SEQ ID NO: 1210900 - RNA, 15 nt, Homo sapiens
auccacaacuuuuca

SEQ ID NO: 1210901 - RNA, 15 nt, Homo sapiens
auccaccaccucccu

SEQ ID NO: 1210902 - RNA, 16 nt, Homo sapiens
auccacccaacccuau

SEQ ID NO: 1210903 - RNA, 21 nt, Homo sapiens
auccacccaacccuaucuccu

SEQ ID NO: 1210904 - RNA, 14 nt, Homo sapiens
auccacccaccuca

SEQ ID NO: 1210905 - RNA, 15 nt, Homo sapiens
auccaccccauccaa

SEQ ID NO: 1210906 - RNA, 23 nt, Homo sapiens
auccacccgggggagcccaguga

SEQ ID NO: 1210907 - RNA, 19 nt, Homo sapiens
auccagaccaaccuuccau

SEQ ID NO: 1210908 - RNA, 15 nt, Homo sapiens
auccagacccggcug

SEQ ID NO: 1210909 - RNA, 21 nt, Homo sapiens
aucucuuaaaaaaugaauuug

SEQ ID NO: 1210910 - RNA, 16 nt, Homo sapiens
aucucuuauuuuacaa

SEQ ID NO: 1210911 - RNA, 16 nt, Homo sapiens
aucucuuccacauggg

SEQ ID NO: 1210912 - RNA, 23 nt, Homo sapiens
aucucuuguauaugaugaucugg

SEQ ID NO: 1210913 - RNA, 17 nt, Homo sapiens
aucugaaacccacagau

SEQ ID NO: 1210914 - RNA, 14 nt, Homo sapiens
aucugaacucucaa

SEQ ID NO: 1210915 - RNA, 13 nt, Homo sapiens
aucugacauauua

SEQ ID NO: 1210916 - RNA, 19 nt, Homo sapiens
aucugagagaugacaggga

SEQ ID NO: 1210917 - RNA, 22 nt, Homo sapiens
aucugagagccgggaaggggaa

SEQ ID NO: 1210918 - RNA, 19 nt, Homo sapiens
aucugaguugccaagacaa

SEQ ID NO: 1210919 - RNA, 23 nt, Homo sapiens
aucugaguugccaagacaaauca

SEQ ID NO: 1210920 - RNA, 14 nt, Homo sapiens
aucugcaauucaaa

SEQ ID NO: 1210921 - RNA, 16 nt, Homo sapiens
aucugcacucaccuca

SEQ ID NO: 1210922 - RNA, 18 nt, Homo sapiens
aucugcauuuagcacaaa

SEQ ID NO: 1210923 - RNA, 15 nt, Homo sapiens
aucugccaucugcuu

SEQ ID NO: 1210924 - RNA, 19 nt, Homo sapiens
aucugccuguucugaggau

SEQ ID NO: 1210925 - RNA, 15 nt, Homo sapiens
aucugccuuuaccua

SEQ ID NO: 1210926 - RNA, 17 nt, Homo sapiens
aucugcuggauauuuag

SEQ ID NO: 1210927 - RNA, 22 nt, Homo sapiens
aucugcuggauauuuaguucaa

SEQ ID NO: 1210928 - RNA, 20 nt, Homo sapiens
aucuggaagaagaugggcug

SEQ ID NO: 1210929 - RNA, 14 nt, Homo sapiens
aucuggaaggacau

SEQ ID NO: 1210930 - RNA, 13 nt, Homo sapiens
aucuggaaguuga

SEQ ID NO: 1210931 - RNA, 20 nt, Homo sapiens
aucuggacauucgaggaauu

SEQ ID NO: 1210932 - RNA, 13 nt, Homo sapiens
aucuggacuuccu

SEQ ID NO: 1210933 - RNA, 19 nt, Homo sapiens
aucuggcccucgacacuca

SEQ ID NO: 1210934 - RNA, 16 nt, Homo sapiens
aucuggcuuagugcca

SEQ ID NO: 1210935 - RNA, 19 nt, Homo sapiens
aucugggcaaaugaaaaug

SEQ ID NO: 1210936 - RNA, 22 nt, Homo sapiens
aucuguccagaggcugcaagga

SEQ ID NO: 1210937 - RNA, 15 nt, Homo sapiens
aucugucuccuguau

SEQ ID NO: 1210938 - RNA, 16 nt, Homo sapiens
aucugucucuucuaca

SEQ ID NO: 1210939 - RNA, 19 nt, Homo sapiens
aucuguguucgauggcuca

SEQ ID NO: 1210940 - RNA, 22 nt, Homo sapiens
aucuguguuuuauugacaucuc

SEQ ID NO: 1210941 - RNA, 18 nt, Homo sapiens
aucuguugaguugcugcc

SEQ ID NO: 1210942 - RNA, 20 nt, Homo sapiens
aucuguuuugaaggcaaaau

SEQ ID NO: 1210943 - RNA, 19 nt, Homo sapiens
aucuguuuuucaccacuuc

SEQ ID NO: 1210944 - RNA, 16 nt, Homo sapiens
aucuuaaaacaaauuc

SEQ ID NO: 1210945 - RNA, 18 nt, Homo sapiens
aucuuaaaacaaauucau

SEQ ID NO: 1210946 - RNA, 13 nt, Homo sapiens
aucuuaaacaaug

SEQ ID NO: 1210947 - RNA, 22 nt, Homo sapiens
aucuuaaacauaauaaaucaca

SEQ ID NO: 1210948 - RNA, 22 nt, Homo sapiens
aucuuaauuuuuuuuaauguac

SEQ ID NO: 1210949 - RNA, 22 nt, Homo sapiens
aucuuaccagaugcuacuggac

SEQ ID NO: 1210950 - RNA, 19 nt, Homo sapiens
aucuuagaagcacuacacc

SEQ ID NO: 1210951 - RNA, 15 nt, Homo sapiens
aucuuagguaagaca

SEQ ID NO: 1210952 - RNA, 20 nt, Homo sapiens
aucuuagguaagacauauaa

SEQ ID NO: 1210953 - RNA, 14 nt, Homo sapiens
aucuuagugccuga

SEQ ID NO: 1210954 - RNA, 15 nt, Homo sapiens
aucuuauaguucuag

SEQ ID NO: 1210955 - RNA, 19 nt, Homo sapiens
aucuucaaacuuucacuuu

SEQ ID NO: 1210956 - RNA, 21 nt, Homo sapiens
aucuucaaacuuucacuuuga

SEQ ID NO: 1210957 - RNA, 19 nt, Homo sapiens
aucuucaaagcuugaagau

SEQ ID NO: 1210958 - RNA, 22 nt, Homo sapiens
aucuucaauuuauuacugaaaa

SEQ ID NO: 1210959 - RNA, 12 nt, Homo sapiens
aucuucacaaaa

SEQ ID NO: 1210960 - RNA, 15 nt, Homo sapiens
aucuucacugcaauu

SEQ ID NO: 1210961 - RNA, 13 nt, Homo sapiens
aucuucagauuaa

SEQ ID NO: 1210962 - RNA, 12 nt, Homo sapiens
aucuucauagau

SEQ ID NO: 1210963 - RNA, 16 nt, Homo sapiens
aucuuccuccuuguga

SEQ ID NO: 1210964 - RNA, 20 nt, Homo sapiens
aucuucuaaacccaauccaa

SEQ ID NO: 1210965 - RNA, 18 nt, Homo sapiens
aucuucucuuugacaauu

SEQ ID NO: 1210966 - RNA, 16 nt, Homo sapiens
aucuugccacauuucu

SEQ ID NO: 1210967 - RNA, 17 nt, Homo sapiens
aucuugcucugcugaca

SEQ ID NO: 1210968 - RNA, 15 nt, Homo sapiens
aucuuggaaguacau

SEQ ID NO: 1210969 - RNA, 18 nt, Homo sapiens
aucuuggcuuugccacac

SEQ ID NO: 1210970 - RNA, 17 nt, Homo sapiens
aucuugucuaacauucc

SEQ ID NO: 1210971 - RNA, 15 nt, Homo sapiens
aucuuuaacaaccuc

SEQ ID NO: 1210972 - RNA, 21 nt, Homo sapiens
aucuuuaacagcuuacacuga

SEQ ID NO: 1210973 - RNA, 22 nt, Homo sapiens
aucuuuaacuuaguauuuuacc

SEQ ID NO: 1210974 - RNA, 15 nt, Homo sapiens
aucuuuaucuguucu

SEQ ID NO: 1210975 - RNA, 21 nt, Homo sapiens
aucuuucaaagugucuugaau

SEQ ID NO: 1210976 - RNA, 17 nt, Homo sapiens
aucuuucaccuuucuag

SEQ ID NO: 1210977 - RNA, 12 nt, Homo sapiens
aucuuucaggaa

SEQ ID NO: 1210978 - RNA, 19 nt, Homo sapiens
aucuuucauccuugacuaa

SEQ ID NO: 1210979 - RNA, 17 nt, Homo sapiens
aucuuucuuuccaaaac

SEQ ID NO: 1210980 - RNA, 18 nt, Homo sapiens
aucuuugccuuuaucucu

SEQ ID NO: 1210981 - RNA, 23 nt, Homo sapiens
aucuuuuaguuuuaguugcagaa

SEQ ID NO: 1210982 - RNA, 19 nt, Homo sapiens
aucuuuuuaccuuucauac

SEQ ID NO: 1210983 - RNA, 18 nt, Homo sapiens
augaaaaaaaaaugggaa

SEQ ID NO: 1210984 - RNA, 19 nt, Homo sapiens
augaaaaaauacagguguc

SEQ ID NO: 1210985 - RNA, 16 nt, Homo sapiens
augaaaaacaaccaag

SEQ ID NO: 1210986 - RNA, 23 nt, Homo sapiens
augaaaaauauugcugaacuacu

SEQ ID NO: 1210987 - RNA, 17 nt, Homo sapiens
augaaaaauguguucca

SEQ ID NO: 1210988 - RNA, 21 nt, Homo sapiens
augaaaacauagcaucucagg

SEQ ID NO: 1210989 - RNA, 18 nt, Homo sapiens
augaaaaucuccaucuca

SEQ ID NO: 1210990 - RNA, 14 nt, Homo sapiens
augaaaaugaaucu

SEQ ID NO: 1210991 - RNA, 13 nt, Homo sapiens
augaaaaugucag

SEQ ID NO: 1210992 - RNA, 16 nt, Homo sapiens
augaaacgucaugugu

SEQ ID NO: 1210993 - RNA, 12 nt, Homo sapiens
augaaacuaaga

SEQ ID NO: 1210994 - RNA, 19 nt, Homo sapiens
augaaacuauuuuaccuga

SEQ ID NO: 1210995 - RNA, 16 nt, Homo sapiens
augaaaguggacaagg

SEQ ID NO: 1210996 - RNA, 18 nt, Homo sapiens
augaaauaaagaauuuaa

SEQ ID NO: 1210997 - RNA, 13 nt, Homo sapiens
augaaauaaucag

SEQ ID NO: 1210998 - RNA, 16 nt, Homo sapiens
augaaaucagcaagag

SEQ ID NO: 1210999 - RNA, 15 nt, Homo sapiens
augaaauccagugag

SEQ ID NO: 1211000 - RNA, 22 nt, Homo sapiens
augaaaugaggucagagccugc

SEQ ID NO: 1211001 - RNA, 15 nt, Homo sapiens
augaaaugcuuccaa

SEQ ID NO: 1211002 - RNA, 16 nt, Homo sapiens
augaaauuaaccauuu

SEQ ID NO: 1211003 - RNA, 16 nt, Homo sapiens
augaaauugcugaaag

SEQ ID NO: 1211004 - RNA, 20 nt, Homo sapiens
augaaauuguaaaaccuguc

SEQ ID NO: 1211005 - RNA, 13 nt, Homo sapiens
augaaauuuugcc

SEQ ID NO: 1211006 - RNA, 20 nt, Homo sapiens
augaacaaugugugggauaa

SEQ ID NO: 1211007 - RNA, 16 nt, Homo sapiens
augaacaugcaguuca

SEQ ID NO: 1211008 - RNA, 18 nt, Homo sapiens
augaacaugugaaguuau

SEQ ID NO: 1211009 - RNA, 21 nt, Homo sapiens
augaaccauucacagugcaag

SEQ ID NO: 1211010 - RNA, 22 nt, Homo sapiens
augaacccauccgguuugccau

SEQ ID NO: 1211011 - RNA, 12 nt, Homo sapiens
augaacuuucuc

SEQ ID NO: 1211012 - RNA, 15 nt, Homo sapiens
augaagaaaauugag

SEQ ID NO: 1211013 - RNA, 23 nt, Homo sapiens
augaagaaauuuaugaagcagau

SEQ ID NO: 1211014 - RNA, 14 nt, Homo sapiens
augaagaagccacu

SEQ ID NO: 1211015 - RNA, 19 nt, Homo sapiens
augaagaagccuuuguuca

SEQ ID NO: 1211016 - RNA, 20 nt, Homo sapiens
augaagcaagccccacuuau

SEQ ID NO: 1211017 - RNA, 13 nt, Homo sapiens
augaagcaugcua

SEQ ID NO: 1211018 - RNA, 20 nt, Homo sapiens
augaagcuaccucaaacuuc

SEQ ID NO: 1211019 - RNA, 23 nt, Homo sapiens
augaagcuuuauacguguagcua

SEQ ID NO: 1211020 - RNA, 20 nt, Homo sapiens
augaaggauuacucuccaua

SEQ ID NO: 1211021 - RNA, 16 nt, Homo sapiens
augaaggcagagccau

SEQ ID NO: 1211022 - RNA, 18 nt, Homo sapiens
augaagguggaacaagca

SEQ ID NO: 1211023 - RNA, 15 nt, Homo sapiens
augaaguauugcuaa

SEQ ID NO: 1211024 - RNA, 13 nt, Homo sapiens
augaagugcaaua

SEQ ID NO: 1211025 - RNA, 16 nt, Homo sapiens
augaauaaaguguaag

SEQ ID NO: 1211026 - RNA, 14 nt, Homo sapiens
augaauacagcauu

SEQ ID NO: 1211027 - RNA, 20 nt, Homo sapiens
augaauaugaugacaaucag

SEQ ID NO: 1211028 - RNA, 20 nt, Homo sapiens
augaauauuuuguaacuauu

SEQ ID NO: 1211029 - RNA, 20 nt, Homo sapiens
augaaucauauucauaugca

SEQ ID NO: 1211030 - RNA, 18 nt, Homo sapiens
augaaucauugauugaau

SEQ ID NO: 1211031 - RNA, 21 nt, Homo sapiens
augaaucccacccacauguga

SEQ ID NO: 1211032 - RNA, 18 nt, Homo sapiens
auugaccaauuccugaca

SEQ ID NO: 1211033 - RNA, 20 nt, Homo sapiens
auugacuaacaggccaaaga

SEQ ID NO: 1211034 - RNA, 17 nt, Homo sapiens
auugacugucacuguuc

SEQ ID NO: 1211035 - RNA, 21 nt, Homo sapiens
auugagaagccauguacucaa

SEQ ID NO: 1211036 - RNA, 13 nt, Homo sapiens
auugagaccugag

SEQ ID NO: 1211037 - RNA, 20 nt, Homo sapiens
auugagaucacuacucagug

SEQ ID NO: 1211038 - RNA, 21 nt, Homo sapiens
auugagaucacuacucagugc

SEQ ID NO: 1211039 - RNA, 21 nt, Homo sapiens
auugagcagaagaucaaggag

SEQ ID NO: 1211040 - RNA, 18 nt, Homo sapiens
auugaggagcugcacuga

SEQ ID NO: 1211041 - RNA, 19 nt, Homo sapiens
auugaggagcugcacugau

SEQ ID NO: 1211042 - RNA, 20 nt, Homo sapiens
auugaguucgaggacuacaa

SEQ ID NO: 1211043 - RNA, 18 nt, Homo sapiens
auugauagaguguuauca

SEQ ID NO: 1211044 - RNA, 16 nt, Homo sapiens
auugauauugaaggaa

SEQ ID NO: 1211045 - RNA, 17 nt, Homo sapiens
auugaucaaugcauguu

SEQ ID NO: 1211046 - RNA, 18 nt, Homo sapiens
auugaucacuuuguuaaa

SEQ ID NO: 1211047 - RNA, 14 nt, Homo sapiens
auugaugacccucu

SEQ ID NO: 1211048 - RNA, 15 nt, Homo sapiens
auugaugagcaagac

SEQ ID NO: 1211049 - RNA, 17 nt, Homo sapiens
auugaugauaacacuua

SEQ ID NO: 1211050 - RNA, 16 nt, Homo sapiens
auugauguuaacaaga

SEQ ID NO: 1211051 - RNA, 13 nt, Homo sapiens
auugauguugcug

SEQ ID NO: 1211052 - RNA, 16 nt, Homo sapiens
auugauuaaugaacua

SEQ ID NO: 1211053 - RNA, 19 nt, Homo sapiens
auugauuauaagcauguau

SEQ ID NO: 1211054 - RNA, 14 nt, Homo sapiens
auugauuauucuga

SEQ ID NO: 1211055 - RNA, 18 nt, Homo sapiens
auugauuucaacagaauc

SEQ ID NO: 1211056 - RNA, 22 nt, Homo sapiens
auugcauaauagauaaaaaccu

SEQ ID NO: 1211057 - RNA, 12 nt, Homo sapiens
auugcaugacuu

SEQ ID NO: 1211058 - RNA, 18 nt, Homo sapiens
auugccacaaguccagcu

SEQ ID NO: 1211059 - RNA, 13 nt, Homo sapiens
auugccugccaga

SEQ ID NO: 1211060 - RNA, 18 nt, Homo sapiens
auugcuaaucaccaaagg

SEQ ID NO: 1211061 - RNA, 13 nt, Homo sapiens
auugcuacuauaa

SEQ ID NO: 1211062 - RNA, 15 nt, Homo sapiens
auugcucaucagcuu

SEQ ID NO: 1211063 - RNA, 21 nt, Homo sapiens
auugcucuugagucuuugcag

SEQ ID NO: 1211064 - RNA, 18 nt, Homo sapiens
auugcuuaccugaucuca

SEQ ID NO: 1211065 - RNA, 15 nt, Homo sapiens
auugcuuuuaugaua

SEQ ID NO: 1211066 - RNA, 20 nt, Homo sapiens
auugcuuuuguugugacuuu

SEQ ID NO: 1211067 - RNA, 13 nt, Homo sapiens
auuggaaauggau

SEQ ID NO: 1211068 - RNA, 18 nt, Homo sapiens
auuggaaauuuguuauaa

SEQ ID NO: 1211069 - RNA, 21 nt, Homo sapiens
auuggaaguguucaagaaaua

SEQ ID NO: 1211070 - RNA, 19 nt, Homo sapiens
auuggaccagucagcacag

SEQ ID NO: 1211071 - RNA, 15 nt, Homo sapiens
auuggaccuguucaa

SEQ ID NO: 1211072 - RNA, 23 nt, Homo sapiens
auuggcaccccuuucuaguucaa

SEQ ID NO: 1211073 - RNA, 18 nt, Homo sapiens
auuggcucuagucacugg

SEQ ID NO: 1211074 - RNA, 17 nt, Homo sapiens
auugggaaaacauuugc

SEQ ID NO: 1211075 - RNA, 20 nt, Homo sapiens
auugggacaacagugcuuug

SEQ ID NO: 1211076 - RNA, 22 nt, Homo sapiens
auugggcacagccuagggucuu

SEQ ID NO: 1211077 - RNA, 19 nt, Homo sapiens
auugggcuugugauuucca

SEQ ID NO: 1211078 - RNA, 20 nt, Homo sapiens
auugggcuugugauuuccau

SEQ ID NO: 1211079 - RNA, 21 nt, Homo sapiens
auugggcuugugauuuccauu

SEQ ID NO: 1211080 - RNA, 21 nt, Homo sapiens
auuggguaucaagacauagca

SEQ ID NO: 1211081 - RNA, 16 nt, Homo sapiens
auugguagaaggauuu

SEQ ID NO: 1211082 - RNA, 14 nt, Homo sapiens
auuguaaacaugug

SEQ ID NO: 1211083 - RNA, 13 nt, Homo sapiens
auuguaacgacuu

SEQ ID NO: 1211084 - RNA, 19 nt, Homo sapiens
auuguacuuuuuuuuacuu

SEQ ID NO: 1211085 - RNA, 16 nt, Homo sapiens
auuguagaaacacagu

SEQ ID NO: 1211086 - RNA, 16 nt, Homo sapiens
auuguaggugcaagau

SEQ ID NO: 1211087 - RNA, 21 nt, Homo sapiens
auuguaucaaguggcaugugc

SEQ ID NO: 1211088 - RNA, 13 nt, Homo sapiens
auuguaucucaua

SEQ ID NO: 1211089 - RNA, 19 nt, Homo sapiens
auugucagaguucugcucu

SEQ ID NO: 1211090 - RNA, 19 nt, Homo sapiens
auugucagcuacuaaugau

SEQ ID NO: 1211091 - RNA, 21 nt, Homo sapiens
auugucauuugggcuuucugu

SEQ ID NO: 1211092 - RNA, 17 nt, Homo sapiens
auugucccacaauauua

SEQ ID NO: 1211093 - RNA, 22 nt, Homo sapiens
auugucgaaaagagucuuccaa

SEQ ID NO: 1211094 - RNA, 16 nt, Homo sapiens
auugucgucuuuaugu

SEQ ID NO: 1211095 - RNA, 22 nt, Homo sapiens
auugucuccuuccacaaugacu

SEQ ID NO: 1211096 - RNA, 15 nt, Homo sapiens
auugucuuagucaaa

SEQ ID NO: 1211097 - RNA, 17 nt, Homo sapiens
auugugaccacucugaa

SEQ ID NO: 1211098 - RNA, 18 nt, Homo sapiens
auugugaucagaccauaa

SEQ ID NO: 1211099 - RNA, 15 nt, Homo sapiens
auugugccccaugcu

SEQ ID NO: 1211100 - RNA, 16 nt, Homo sapiens
auugugcuucacagua

SEQ ID NO: 1211101 - RNA, 22 nt, Homo sapiens
auuguguucucuauugcugcuc

SEQ ID NO: 1211102 - RNA, 15 nt, Homo sapiens
auuguguugacauua

SEQ ID NO: 1211103 - RNA, 17 nt, Homo sapiens
auuguucaaagcacaga

SEQ ID NO: 1211104 - RNA, 18 nt, Homo sapiens
auuguuccaguacuaugg

SEQ ID NO: 1211105 - RNA, 14 nt, Homo sapiens
auuguucccaguga

SEQ ID NO: 1211106 - RNA, 20 nt, Homo sapiens
auuguugaaagguaauuuga

SEQ ID NO: 1211107 - RNA, 23 nt, Homo sapiens
auuguuugaacccgggaggcaga

SEQ ID NO: 1211108 - RNA, 17 nt, Homo sapiens
auuguuuucaguguaca

SEQ ID NO: 1211109 - RNA, 22 nt, Homo sapiens
auuguuuucaguguacauggaa

SEQ ID NO: 1211110 - RNA, 13 nt, Homo sapiens
aaauuucauagcu

SEQ ID NO: 1211111 - RNA, 18 nt, Homo sapiens
aaauuucuucugguagug

SEQ ID NO: 1211112 - RNA, 18 nt, Homo sapiens
aaauuugauugauuugaa

SEQ ID NO: 1211113 - RNA, 11 nt, Homo sapiens
aaauuugcaac

SEQ ID NO: 1211114 - RNA, 14 nt, Homo sapiens
aaauuuuacaauag

SEQ ID NO: 1211115 - RNA, 21 nt, Homo sapiens
aaauuuugaguucuacauaag

SEQ ID NO: 1211116 - RNA, 17 nt, Homo sapiens
aaauuuugccugcaaca

SEQ ID NO: 1211117 - RNA, 16 nt, Homo sapiens
aaauuuugugaugaau

SEQ ID NO: 1211118 - RNA, 20 nt, Homo sapiens
aacaaaaauguaaugaucau

SEQ ID NO: 1211119 - RNA, 17 nt, Homo sapiens
aacaaaagaaucuucca

SEQ ID NO: 1211120 - RNA, 14 nt, Homo sapiens
aacaaacaaugaaa

SEQ ID NO: 1211121 - RNA, 14 nt, Homo sapiens
aacaaacaugcagu

SEQ ID NO: 1211122 - RNA, 21 nt, Homo sapiens
aacaaacauuguguugacauu

SEQ ID NO: 1211123 - RNA, 23 nt, Homo sapiens
aacaaacuacauguaauccauca

SEQ ID NO: 1211124 - RNA, 19 nt, Homo sapiens
aacaaacucuacuauccaa

SEQ ID NO: 1211125 - RNA, 20 nt, Homo sapiens
aacaaacucuacuauccaau

SEQ ID NO: 1211126 - RNA, 19 nt, Homo sapiens
aacaaagaaauaauggucu

SEQ ID NO: 1211127 - RNA, 12 nt, Homo sapiens
aacaaaguaaua

SEQ ID NO: 1211128 - RNA, 20 nt, Homo sapiens
aacaaagugaaggacauaga

SEQ ID NO: 1211129 - RNA, 23 nt, Homo sapiens
aacaaauucauauucugucugga

SEQ ID NO: 1211130 - RNA, 15 nt, Homo sapiens
aacaaccuggucaca

SEQ ID NO: 1211131 - RNA, 22 nt, Homo sapiens
aacaacuaggcuucagcauauu

SEQ ID NO: 1211132 - RNA, 19 nt, Homo sapiens
aacaacuguggucaauccg

SEQ ID NO: 1211133 - RNA, 19 nt, Homo sapiens
aacaacuuaauguucugaa

SEQ ID NO: 1211134 - RNA, 14 nt, Homo sapiens
aacaagaauuggaa

SEQ ID NO: 1211135 - RNA, 12 nt, Homo sapiens
aacaagaucugc

SEQ ID NO: 1211136 - RNA, 12 nt, Homo sapiens
aacaagcugugc

SEQ ID NO: 1211137 - RNA, 17 nt, Homo sapiens
aacaaguuuuucuguca

SEQ ID NO: 1211138 - RNA, 18 nt, Homo sapiens
aacaaguuuuucugucaa

SEQ ID NO: 1211139 - RNA, 21 nt, Homo sapiens
aacaauauguuugcaaacuug

SEQ ID NO: 1211140 - RNA, 11 nt, Homo sapiens
aacaaucaaag

SEQ ID NO: 1211141 - RNA, 13 nt, Homo sapiens
aacaaucaguaaa

SEQ ID NO: 1211142 - RNA, 15 nt, Homo sapiens
aacaauccaugugau

SEQ ID NO: 1211143 - RNA, 17 nt, Homo sapiens
aacaaucuuugcuguau

SEQ ID NO: 1211144 - RNA, 13 nt, Homo sapiens
aacaaugacuuaa

SEQ ID NO: 1211145 - RNA, 21 nt, Homo sapiens
aacaauguauaaagauuguac

SEQ ID NO: 1211146 - RNA, 22 nt, Homo sapiens
aacaaugucugguuaguuaaaa

SEQ ID NO: 1211147 - RNA, 13 nt, Homo sapiens
aacaauugguaaa

SEQ ID NO: 1211148 - RNA, 13 nt, Homo sapiens
aacacaagcaaaa

SEQ ID NO: 1211149 - RNA, 14 nt, Homo sapiens
aacacaauaugaau

SEQ ID NO: 1211150 - RNA, 15 nt, Homo sapiens
aacacaauguuauuc

SEQ ID NO: 1211151 - RNA, 14 nt, Homo sapiens
aacacacagucaca

SEQ ID NO: 1211152 - RNA, 22 nt, Homo sapiens
aacacacuuggaugcaggguuu

SEQ ID NO: 1211153 - RNA, 17 nt, Homo sapiens
aacacagcaugugccaa

SEQ ID NO: 1211154 - RNA, 18 nt, Homo sapiens
aacacagcaugugccaag

SEQ ID NO: 1211155 - RNA, 14 nt, Homo sapiens
aacacaggaaguca

SEQ ID NO: 1211156 - RNA, 13 nt, Homo sapiens
aacacaguauuuu

SEQ ID NO: 1211157 - RNA, 13 nt, Homo sapiens
aacacaugccuua

SEQ ID NO: 1211158 - RNA, 14 nt, Homo sapiens
aacacaugccuuaa

SEQ ID NO: 1211159 - RNA, 21 nt, Homo sapiens
auuguuuugaaacucaguaug

SEQ ID NO: 1211160 - RNA, 18 nt, Homo sapiens
auuuaaaagcaucucagc

SEQ ID NO: 1211161 - RNA, 17 nt, Homo sapiens
auuuaaaauugcuaugu

SEQ ID NO: 1211162 - RNA, 16 nt, Homo sapiens
auuuaaacaccuccuc

SEQ ID NO: 1211163 - RNA, 15 nt, Homo sapiens
auuuaaagccuccuc

SEQ ID NO: 1211164 - RNA, 13 nt, Homo sapiens
auuuaaaugggaa

SEQ ID NO: 1211165 - RNA, 14 nt, Homo sapiens
auuuaacauuuccu

SEQ ID NO: 1211166 - RNA, 16 nt, Homo sapiens
auuuaacuaaaguuaa

SEQ ID NO: 1211167 - RNA, 13 nt, Homo sapiens
auuuaagccuuau

SEQ ID NO: 1211168 - RNA, 19 nt, Homo sapiens
auuuaaguuaucaacuuua

SEQ ID NO: 1211169 - RNA, 15 nt, Homo sapiens
auuuaauaaagauga

SEQ ID NO: 1211170 - RNA, 13 nt, Homo sapiens
auuuaaugcugcc

SEQ ID NO: 1211171 - RNA, 22 nt, Homo sapiens
auuuaauuggauauugaugaaa

SEQ ID NO: 1211172 - RNA, 13 nt, Homo sapiens
auuuacaccacac

SEQ ID NO: 1211173 - RNA, 21 nt, Homo sapiens
auuuacagaaaagacucugac

SEQ ID NO: 1211174 - RNA, 18 nt, Homo sapiens
auuuacagccucacuuga

SEQ ID NO: 1211175 - RNA, 15 nt, Homo sapiens
auuuacagucucuuu

SEQ ID NO: 1211176 - RNA, 12 nt, Homo sapiens
auuuacagugaa

SEQ ID NO: 1211177 - RNA, 15 nt, Homo sapiens
auuuacagugaaaau

SEQ ID NO: 1211178 - RNA, 14 nt, Homo sapiens
auuuacgcuuugau

SEQ ID NO: 1211179 - RNA, 24 nt, Homo sapiens
auuuacuguuuuuuucuguagcac

SEQ ID NO: 1211180 - RNA, 11 nt, Homo sapiens
auuuacuuaac

SEQ ID NO: 1211181 - RNA, 21 nt, Homo sapiens
auuuacuuagcagaaccacau

SEQ ID NO: 1211182 - RNA, 12 nt, Homo sapiens
auuuagaacuuu

SEQ ID NO: 1211183 - RNA, 12 nt, Homo sapiens
auuuagaauuaa

SEQ ID NO: 1211184 - RNA, 12 nt, Homo sapiens
auuuagacucau

SEQ ID NO: 1211185 - RNA, 17 nt, Homo sapiens
auuuagauauaacacua

SEQ ID NO: 1211186 - RNA, 21 nt, Homo sapiens
auuuaggccaugggacaggga

SEQ ID NO: 1211187 - RNA, 18 nt, Homo sapiens
auuuaguaacaguuguga

SEQ ID NO: 1211188 - RNA, 22 nt, Homo sapiens
auuuagugaucaaauugugcag

SEQ ID NO: 1211189 - RNA, 17 nt, Homo sapiens
auuuaguuggaauauca

SEQ ID NO: 1211190 - RNA, 20 nt, Homo sapiens
auuuaguuuuuaacaaucua

SEQ ID NO: 1211191 - RNA, 19 nt, Homo sapiens
auuuauaaaacuucucaag

SEQ ID NO: 1211192 - RNA, 13 nt, Homo sapiens
auuuauaacucau

SEQ ID NO: 1211193 - RNA, 14 nt, Homo sapiens
auuuauaccucagu

SEQ ID NO: 1211194 - RNA, 14 nt, Homo sapiens
auuuauagcaagau

SEQ ID NO: 1211195 - RNA, 23 nt, Homo sapiens
auuuauauaaaauguuuaaucuc

SEQ ID NO: 1211196 - RNA, 13 nt, Homo sapiens
auuuauaucuaau

SEQ ID NO: 1211197 - RNA, 23 nt, Homo sapiens
auuuauccaaaauguguauuucu

SEQ ID NO: 1211198 - RNA, 22 nt, Homo sapiens
auuuaucguauagguugaugaa

SEQ ID NO: 1211199 - RNA, 22 nt, Homo sapiens
auuuaucuauaauuuaccuaag

SEQ ID NO: 1211200 - RNA, 12 nt, Homo sapiens
auuuaugaaggc

SEQ ID NO: 1211201 - RNA, 19 nt, Homo sapiens
auuuaugacagugaacauu

SEQ ID NO: 1211202 - RNA, 23 nt, Homo sapiens
auuuaugaguuuuugauagcuuu

SEQ ID NO: 1211203 - RNA, 16 nt, Homo sapiens
auuuaugaugcacuua

SEQ ID NO: 1211204 - RNA, 22 nt, Homo sapiens
auuuaugaugcacuuauucaau

SEQ ID NO: 1211205 - RNA, 23 nt, Homo sapiens
auuuaugcugcucauccaaaguu

SEQ ID NO: 1211206 - RNA, 17 nt, Homo sapiens
auuuauggauaucacac

SEQ ID NO: 1211207 - RNA, 16 nt, Homo sapiens
auuuauuaacuaauca

SEQ ID NO: 1211208 - RNA, 17 nt, Homo sapiens
auuuauuaacuaaucaa

SEQ ID NO: 1211209 - RNA, 19 nt, Homo sapiens
auuuauucagccuugguca

SEQ ID NO: 1211210 - RNA, 16 nt, Homo sapiens
auuuauuccauauuca

SEQ ID NO: 1211211 - RNA, 16 nt, Homo sapiens
auuuauucugccaaac

SEQ ID NO: 1211212 - RNA, 13 nt, Homo sapiens
auuuauucugcuc

SEQ ID NO: 1211213 - RNA, 16 nt, Homo sapiens
auuuauuuacaacuca

SEQ ID NO: 1211214 - RNA, 15 nt, Homo sapiens
auuuauuuuuugcca

SEQ ID NO: 1211215 - RNA, 19 nt, Homo sapiens
auuucaaaauauacauuca

SEQ ID NO: 1211216 - RNA, 14 nt, Homo sapiens
auuucaccacugaa

SEQ ID NO: 1211217 - RNA, 22 nt, Homo sapiens
auuucacuagaaaagcugauca

SEQ ID NO: 1211218 - RNA, 18 nt, Homo sapiens
auuucacucucaaacuuc

SEQ ID NO: 1211219 - RNA, 12 nt, Homo sapiens
auuucagauauc

SEQ ID NO: 1211220 - RNA, 19 nt, Homo sapiens
auuucagaucauauuucac

SEQ ID NO: 1211221 - RNA, 20 nt, Homo sapiens
auuucagaucauauuucaca

SEQ ID NO: 1211222 - RNA, 22 nt, Homo sapiens
auuucagaucauauuucacaau

SEQ ID NO: 1211223 - RNA, 15 nt, Homo sapiens
auuucagcugaucag

SEQ ID NO: 1211224 - RNA, 18 nt, Homo sapiens
auuucaggaagacugaca

SEQ ID NO: 1211225 - RNA, 23 nt, Homo sapiens
auuucauacaacagaaaccagaa

SEQ ID NO: 1211226 - RNA, 12 nt, Homo sapiens
auuucaucucuu

SEQ ID NO: 1211227 - RNA, 21 nt, Homo sapiens
auuucaugggacuaaaugaac

SEQ ID NO: 1211228 - RNA, 21 nt, Homo sapiens
auuuccaaaacuuuaaugaac

SEQ ID NO: 1211229 - RNA, 23 nt, Homo sapiens
auuuccaaaacuuuaaugaacua

SEQ ID NO: 1211230 - RNA, 21 nt, Homo sapiens
auuuccaaaccuccacugcug

SEQ ID NO: 1211231 - RNA, 14 nt, Homo sapiens
auuuccaacaccac

SEQ ID NO: 1211232 - RNA, 14 nt, Homo sapiens
auuuccaacuuuau

SEQ ID NO: 1211233 - RNA, 23 nt, Homo sapiens
auuuccaagcacuuucaguccaa

SEQ ID NO: 1211234 - RNA, 14 nt, Homo sapiens
auuuccacaccaag

SEQ ID NO: 1211235 - RNA, 14 nt, Homo sapiens
auuuccacuaaaaa

SEQ ID NO: 1211236 - RNA, 22 nt, Homo sapiens
auuuccagaaccacacuugaaa

SEQ ID NO: 1211237 - RNA, 22 nt, Homo sapiens
auuuccaguguucuaugaacaa

SEQ ID NO: 1211238 - RNA, 14 nt, Homo sapiens
auuuccgggugauu

SEQ ID NO: 1211239 - RNA, 22 nt, Homo sapiens
auuuccuaaugucagaguagaa

SEQ ID NO: 1211240 - RNA, 20 nt, Homo sapiens
auuuccucuaguaucacuuu

SEQ ID NO: 1211241 - RNA, 21 nt, Homo sapiens
auuuccugacagaaggacuca

SEQ ID NO: 1211242 - RNA, 23 nt, Homo sapiens
auuuccuuucuacaauuucaauu

SEQ ID NO: 1211243 - RNA, 14 nt, Homo sapiens
auuucuaaucaaaa

SEQ ID NO: 1211244 - RNA, 21 nt, Homo sapiens
auuucuacuaaaaauacaaaa

SEQ ID NO: 1211245 - RNA, 17 nt, Homo sapiens
auuucuagaagcacaug

SEQ ID NO: 1211246 - RNA, 20 nt, Homo sapiens
auuucuagaagcacaugugu

SEQ ID NO: 1211247 - RNA, 15 nt, Homo sapiens
auuucuaguccaaaa

SEQ ID NO: 1211248 - RNA, 16 nt, Homo sapiens
auuucuauggcuuuca

SEQ ID NO: 1211249 - RNA, 12 nt, Homo sapiens
auuucuauucaa

SEQ ID NO: 1211250 - RNA, 20 nt, Homo sapiens
auuucucacccuacucugga

SEQ ID NO: 1211251 - RNA, 14 nt, Homo sapiens
auuucucacugaga

SEQ ID NO: 1211252 - RNA, 14 nt, Homo sapiens
auuucuccaaagcc

SEQ ID NO: 1211253 - RNA, 19 nt, Homo sapiens
auuucuccucccuuccuuu

SEQ ID NO: 1211254 - RNA, 21 nt, Homo sapiens
auuucucuugcuggaacuguu

SEQ ID NO: 1211255 - RNA, 18 nt, Homo sapiens
auuucugaaaaccuacca

SEQ ID NO: 1211256 - RNA, 16 nt, Homo sapiens
auuucugaacuguuac

SEQ ID NO: 1211257 - RNA, 18 nt, Homo sapiens
auuucugaucuauacaaa

SEQ ID NO: 1211258 - RNA, 14 nt, Homo sapiens
auuucugccaggca

SEQ ID NO: 1211259 - RNA, 23 nt, Homo sapiens
auuucuggugaaaaaagccagcc

SEQ ID NO: 1211260 - RNA, 14 nt, Homo sapiens
auuucugguucuga

SEQ ID NO: 1211261 - RNA, 23 nt, Homo sapiens
auuucuguggauggcaucaaaca

SEQ ID NO: 1211262 - RNA, 13 nt, Homo sapiens
auuucuguguugc

SEQ ID NO: 1211263 - RNA, 22 nt, Homo sapiens
auuucuucaaauccuuccaaaa

SEQ ID NO: 1211264 - RNA, 16 nt, Homo sapiens
auuucuuguugcucaa

SEQ ID NO: 1211265 - RNA, 24 nt, Homo sapiens
auuucuuucuuugcaccaaagaca

SEQ ID NO: 1211266 - RNA, 11 nt, Homo sapiens
auuucuuugcc

SEQ ID NO: 1211267 - RNA, 15 nt, Homo sapiens
auuucuuuguuauca

SEQ ID NO: 1211268 - RNA, 22 nt, Homo sapiens
auuucuuuucugcauguucuaa

SEQ ID NO: 1211269 - RNA, 17 nt, Homo sapiens
auuugaagaacauguga

SEQ ID NO: 1211270 - RNA, 21 nt, Homo sapiens
auuugaaugugguuacuuccu

SEQ ID NO: 1211271 - RNA, 18 nt, Homo sapiens
auuugaauuucaguaaac

SEQ ID NO: 1211272 - RNA, 13 nt, Homo sapiens
auuugacuauucu

SEQ ID NO: 1211273 - RNA, 18 nt, Homo sapiens
auuugacuguucaaugau

SEQ ID NO: 1211274 - RNA, 23 nt, Homo sapiens
auuugaggacaagauaccaaggc

SEQ ID NO: 1211275 - RNA, 14 nt, Homo sapiens
auuugauaccaugg

SEQ ID NO: 1211276 - RNA, 15 nt, Homo sapiens
auuugaucacuacaa

SEQ ID NO: 1211277 - RNA, 14 nt, Homo sapiens
auuugaugcauguc

SEQ ID NO: 1211278 - RNA, 15 nt, Homo sapiens
auuugaugugacuuu

SEQ ID NO: 1211279 - RNA, 15 nt, Homo sapiens
auuugauuuugccca

SEQ ID NO: 1211280 - RNA, 19 nt, Homo sapiens
auuugcaaaggcgacaaua

SEQ ID NO: 1211281 - RNA, 18 nt, Homo sapiens
auuugcacuuauauagca

SEQ ID NO: 1211282 - RNA, 23 nt, Homo sapiens
auuugcacuucaccuuuugacca

SEQ ID NO: 1211283 - RNA, 18 nt, Homo sapiens
auuugccaggggcaucca

SEQ ID NO: 1211284 - RNA, 15 nt, Homo sapiens
auuugccauagccuu

SEQ ID NO: 1211285 - RNA, 22 nt, Homo sapiens
auuugccuugcagaacugccau

SEQ ID NO: 1211286 - RNA, 21 nt, Homo sapiens
cagcacuccccagagcugugc

SEQ ID NO: 1211287 - RNA, 12 nt, Homo sapiens
cagcacuggaag

SEQ ID NO: 1211288 - RNA, 13 nt, Homo sapiens
cagcacuggugaa

SEQ ID NO: 1211289 - RNA, 20 nt, Homo sapiens
cagcacuggugaacugagcu

SEQ ID NO: 1211290 - RNA, 16 nt, Homo sapiens
cagcacuuguguuguc

SEQ ID NO: 1211291 - RNA, 16 nt, Homo sapiens
cagcuguaaacauauu

SEQ ID NO: 1211292 - RNA, 21 nt, Homo sapiens
cagcuguauugucugaacuug

SEQ ID NO: 1211293 - RNA, 16 nt, Homo sapiens
cagcuguccugcagca

SEQ ID NO: 1211294 - RNA, 14 nt, Homo sapiens
cagcugugcacuuu

SEQ ID NO: 1211295 - RNA, 17 nt, Homo sapiens
cagcuuagauuucauag

SEQ ID NO: 1211296 - RNA, 18 nt, Homo sapiens
cagcuuauagucuuccag

SEQ ID NO: 1211297 - RNA, 16 nt, Homo sapiens
cagcuucaagugccuu

SEQ ID NO: 1211298 - RNA, 19 nt, Homo sapiens
cagcuucaccagagcauuu

SEQ ID NO: 1211299 - RNA, 13 nt, Homo sapiens
cagcuucagguua

SEQ ID NO: 1211300 - RNA, 19 nt, Homo sapiens
cagcuuguaaauagcucag

SEQ ID NO: 1211301 - RNA, 22 nt, Homo sapiens
cagcuuguaaauagcucaggug

SEQ ID NO: 1211302 - RNA, 22 nt, Homo sapiens
cagcuuucaaaagcaagaacac

SEQ ID NO: 1211303 - RNA, 14 nt, Homo sapiens
cagcuuugcaguga

SEQ ID NO: 1211304 - RNA, 22 nt, Homo sapiens
cagcuuuugauugaaaguccua

SEQ ID NO: 1211305 - RNA, 14 nt, Homo sapiens
cagcuuuugcaacu

SEQ ID NO: 1211306 - RNA, 19 nt, Homo sapiens
cagcuuuuguuguuuauau

SEQ ID NO: 1211307 - RNA, 21 nt, Homo sapiens
cagcuuuuuauucccugccca

SEQ ID NO: 1211308 - RNA, 18 nt, Homo sapiens
caggaaaaaaaauucugu

SEQ ID NO: 1211309 - RNA, 21 nt, Homo sapiens
caggaaaagguagcuuaccug

SEQ ID NO: 1211310 - RNA, 20 nt, Homo sapiens
caggaaaccaacacccaaag

SEQ ID NO: 1211311 - RNA, 12 nt, Homo sapiens
caggaaaccaga

SEQ ID NO: 1211312 - RNA, 22 nt, Homo sapiens
caggaaaccuuggccucugcua

SEQ ID NO: 1211313 - RNA, 21 nt, Homo sapiens
caggaaaugggaaugagagca

SEQ ID NO: 1211314 - RNA, 19 nt, Homo sapiens
caggaagaagagaugcacu

SEQ ID NO: 1211315 - RNA, 14 nt, Homo sapiens
caggaagacugaca

SEQ ID NO: 1211316 - RNA, 17 nt, Homo sapiens
caggaagggagaacuug

SEQ ID NO: 1211317 - RNA, 20 nt, Homo sapiens
caggaagggagaacuugaaa

SEQ ID NO: 1211318 - RNA, 21 nt, Homo sapiens
caggaagggggccgacuccac

SEQ ID NO: 1211319 - RNA, 16 nt, Homo sapiens
caggaaggucuucaau

SEQ ID NO: 1211320 - RNA, 21 nt, Homo sapiens
caggaagucuuuccugauaua

SEQ ID NO: 1211321 - RNA, 15 nt, Homo sapiens
caggaauagaugugg

SEQ ID NO: 1211322 - RNA, 16 nt, Homo sapiens
caggaauuacacugug

SEQ ID NO: 1211323 - RNA, 23 nt, Homo sapiens
caggacaccagccuggugcccau

SEQ ID NO: 1211324 - RNA, 16 nt, Homo sapiens
caggacagccacagcc

SEQ ID NO: 1211325 - RNA, 12 nt, Homo sapiens
caggacaucucc

SEQ ID NO: 1211326 - RNA, 18 nt, Homo sapiens
caggaccacagagcuccu

SEQ ID NO: 1211327 - RNA, 14 nt, Homo sapiens
caggacgcccucac

SEQ ID NO: 1211328 - RNA, 15 nt, Homo sapiens
caggacuccacugga

SEQ ID NO: 1211329 - RNA, 14 nt, Homo sapiens
caggacuccaucuc

SEQ ID NO: 1211330 - RNA, 20 nt, Homo sapiens
caggacugggugguccaaag

SEQ ID NO: 1211331 - RNA, 18 nt, Homo sapiens
caggacugugccugaaca

SEQ ID NO: 1211332 - RNA, 17 nt, Homo sapiens
caggacuuggucugauu

SEQ ID NO: 1211333 - RNA, 14 nt, Homo sapiens
caggagaacaucuu

SEQ ID NO: 1211334 - RNA, 14 nt, Homo sapiens
caggagacaguuca

SEQ ID NO: 1211335 - RNA, 17 nt, Homo sapiens
caggagcaggcacgggu

SEQ ID NO: 1211336 - RNA, 15 nt, Homo sapiens
caggagccaccagca

SEQ ID NO: 1211337 - RNA, 18 nt, Homo sapiens
caggagcccggcuuccac

SEQ ID NO: 1211338 - RNA, 20 nt, Homo sapiens
caggagguugagaaugcagu

SEQ ID NO: 1211339 - RNA, 17 nt, Homo sapiens
caggagucagugucugg

SEQ ID NO: 1211340 - RNA, 20 nt, Homo sapiens
caggagucucugccacccac

SEQ ID NO: 1211341 - RNA, 20 nt, Homo sapiens
caggaguguggccacguggg

SEQ ID NO: 1211342 - RNA, 23 nt, Homo sapiens
caggaguguuaagcguucaguga

SEQ ID NO: 1211343 - RNA, 17 nt, Homo sapiens
caggaguucaagaccag

SEQ ID NO: 1211344 - RNA, 17 nt, Homo sapiens
caggaguuugaauccau

SEQ ID NO: 1211345 - RNA, 19 nt, Homo sapiens
caggauaauauauuugcag

SEQ ID NO: 1211346 - RNA, 22 nt, Homo sapiens
caggauauuugcacuauuucca

SEQ ID NO: 1211347 - RNA, 18 nt, Homo sapiens
caggaugaguuacuugaa

SEQ ID NO: 1211348 - RNA, 19 nt, Homo sapiens
caggauucccccaacacac

SEQ ID NO: 1211349 - RNA, 15 nt, Homo sapiens
caggcaaaauugaua

SEQ ID NO: 1211350 - RNA, 14 nt, Homo sapiens
caggcaaacuugca

SEQ ID NO: 1211351 - RNA, 17 nt, Homo sapiens
caggcaaagugcugcug

SEQ ID NO: 1211352 - RNA, 15 nt, Homo sapiens
caggcaaugcuguac

SEQ ID NO: 1211353 - RNA, 14 nt, Homo sapiens
caggcaauuucacc

SEQ ID NO: 1211354 - RNA, 22 nt, Homo sapiens
caggcaauuucaccaccaaaug

SEQ ID NO: 1211355 - RNA, 17 nt, Homo sapiens
caggcacacaggucuca

SEQ ID NO: 1211356 - RNA, 14 nt, Homo sapiens
caggcacugcugca

SEQ ID NO: 1211357 - RNA, 20 nt, Homo sapiens
caggcagaucugugccccau

SEQ ID NO: 1211358 - RNA, 18 nt, Homo sapiens
caggcagcgauggucuca

SEQ ID NO: 1211359 - RNA, 12 nt, Homo sapiens
caggcaggccac

SEQ ID NO: 1211360 - RNA, 16 nt, Homo sapiens
caggcagguccagggu

SEQ ID NO: 1211361 - RNA, 19 nt, Homo sapiens
caggcauucagguugcuug

SEQ ID NO: 1211362 - RNA, 14 nt, Homo sapiens
caggcauugaggaa

SEQ ID NO: 1211363 - RNA, 23 nt, Homo sapiens
caggcauuugaggcugucgugag

SEQ ID NO: 1211364 - RNA, 18 nt, Homo sapiens
caggccacccaaaggagc

SEQ ID NO: 1211365 - RNA, 17 nt, Homo sapiens
caggccacuggggacag

SEQ ID NO: 1211366 - RNA, 17 nt, Homo sapiens
caggccaggugcagugg

SEQ ID NO: 1211367 - RNA, 15 nt, Homo sapiens
caggcccugcagugu

SEQ ID NO: 1211368 - RNA, 22 nt, Homo sapiens
caggcccuggccuccccugcca

SEQ ID NO: 1211369 - RNA, 23 nt, Homo sapiens
caggccgagagcagacaccagca

SEQ ID NO: 1211370 - RNA, 18 nt, Homo sapiens
caggccuaagacauguga

SEQ ID NO: 1211371 - RNA, 22 nt, Homo sapiens
caggccuggacuuccagugcuc

SEQ ID NO: 1211372 - RNA, 19 nt, Homo sapiens
caggcgccuggcacauuuc

SEQ ID NO: 1211373 - RNA, 20 nt, Homo sapiens
caggcucuugacuacuugga

SEQ ID NO: 1211374 - RNA, 24 nt, Homo sapiens
caggcugaaaagaagccucagcuc

SEQ ID NO: 1211375 - RNA, 18 nt, Homo sapiens
caggcuggagugcaaugg

SEQ ID NO: 1211376 - RNA, 20 nt, Homo sapiens
caggcuggagugcaguggca

SEQ ID NO: 1211377 - RNA, 23 nt, Homo sapiens
caggcugggagcuggauaccugc

SEQ ID NO: 1211378 - RNA, 14 nt, Homo sapiens
caggcugugggccu

SEQ ID NO: 1211379 - RNA, 13 nt, Homo sapiens
caggcuucaucaa

SEQ ID NO: 1211380 - RNA, 17 nt, Homo sapiens
caggcuucggacagugc

SEQ ID NO: 1211381 - RNA, 20 nt, Homo sapiens
caggcuuggggagcuuuaag

SEQ ID NO: 1211382 - RNA, 13 nt, Homo sapiens
caggcuuuguaca

SEQ ID NO: 1211383 - RNA, 17 nt, Homo sapiens
cagggaaacaacaugaa

SEQ ID NO: 1211384 - RNA, 22 nt, Homo sapiens
cagggaaccgugauaagccuuu

SEQ ID NO: 1211385 - RNA, 21 nt, Homo sapiens
cagggaagcaacccuggguuu

SEQ ID NO: 1211386 - RNA, 13 nt, Homo sapiens
cagggaagccaaa

SEQ ID NO: 1211387 - RNA, 20 nt, Homo sapiens
cagggaagccccacuugaag

SEQ ID NO: 1211388 - RNA, 23 nt, Homo sapiens
cagggaauggagcucagguccca

SEQ ID NO: 1211389 - RNA, 15 nt, Homo sapiens
cagggacaagauaca

SEQ ID NO: 1211390 - RNA, 19 nt, Homo sapiens
cagggacacuaucacucau

SEQ ID NO: 1211391 - RNA, 19 nt, Homo sapiens
cagggagauaaacaccacc

SEQ ID NO: 1211392 - RNA, 18 nt, Homo sapiens
cagggagugaugauuugg

SEQ ID NO: 1211393 - RNA, 19 nt, Homo sapiens
cagggauggguuugcuuug

SEQ ID NO: 1211394 - RNA, 14 nt, Homo sapiens
cagggcaccagagg

SEQ ID NO: 1211395 - RNA, 14 nt, Homo sapiens
cagggcacuacaua

SEQ ID NO: 1211396 - RNA, 23 nt, Homo sapiens
cagggcacuacauaauugcuguu

SEQ ID NO: 1211397 - RNA, 17 nt, Homo sapiens
cagggcagggcucugau

SEQ ID NO: 1211398 - RNA, 17 nt, Homo sapiens
cagggcaugccccggcc

SEQ ID NO: 1211399 - RNA, 14 nt, Homo sapiens
cagggcauuuuaca

SEQ ID NO: 1211400 - RNA, 13 nt, Homo sapiens
cagggccacaacu

SEQ ID NO: 1211401 - RNA, 21 nt, Homo sapiens
cagggccagcuuuuccucacc

SEQ ID NO: 1211402 - RNA, 17 nt, Homo sapiens
cagggccaggacugagc

SEQ ID NO: 1211403 - RNA, 14 nt, Homo sapiens
cagggcccaagucc

SEQ ID NO: 1211404 - RNA, 18 nt, Homo sapiens
cagggcccaagucccugu

SEQ ID NO: 1211405 - RNA, 14 nt, Homo sapiens
cagggcccagugac

SEQ ID NO: 1211406 - RNA, 18 nt, Homo sapiens
cagggcccuccaccgcca

SEQ ID NO: 1211407 - RNA, 14 nt, Homo sapiens
cagggccguugccc

SEQ ID NO: 1211408 - RNA, 22 nt, Homo sapiens
cagggcgccccugggagacaac

SEQ ID NO: 1211409 - RNA, 12 nt, Homo sapiens
cagggcucccug

SEQ ID NO: 1211410 - RNA, 15 nt, Homo sapiens
caggggaccacaccu

SEQ ID NO: 1211411 - RNA, 21 nt, Homo sapiens
caggggcugacucuccaggga

SEQ ID NO: 1211412 - RNA, 14 nt, Homo sapiens
cagggggaaggugg

SEQ ID NO: 1211413 - RNA, 18 nt, Homo sapiens
caggggggagaaguucuu

SEQ ID NO: 1211414 - RNA, 20 nt, Homo sapiens
caggggggccuccuccuagg

SEQ ID NO: 1211415 - RNA, 18 nt, Homo sapiens
caggggucgucaccaccu

SEQ ID NO: 1211416 - RNA, 22 nt, Homo sapiens
guuugggaauauccauguacuu

SEQ ID NO: 1211417 - RNA, 13 nt, Homo sapiens
guuuggggagcag

SEQ ID NO: 1211418 - RNA, 15 nt, Homo sapiens
guuuguaaaugccuc

SEQ ID NO: 1211419 - RNA, 14 nt, Homo sapiens
guuuguaagacuua

SEQ ID NO: 1211420 - RNA, 14 nt, Homo sapiens
guuuguccugagau

SEQ ID NO: 1211421 - RNA, 19 nt, Homo sapiens
guuuguguguugucucuug

SEQ ID NO: 1211422 - RNA, 11 nt, Homo sapiens
guuuguuaaaa

SEQ ID NO: 1211423 - RNA, 23 nt, Homo sapiens
guuuguucccugugucauuucaa

SEQ ID NO: 1211424 - RNA, 17 nt, Homo sapiens
guuuuaacaguucacuu

SEQ ID NO: 1211425 - RNA, 14 nt, Homo sapiens
guuuuaauuccaau

SEQ ID NO: 1211426 - RNA, 20 nt, Homo sapiens
guuuuacauuguugagcuau

SEQ ID NO: 1211427 - RNA, 18 nt, Homo sapiens
guuuuacuguccaaagac

SEQ ID NO: 1211428 - RNA, 19 nt, Homo sapiens
guuuuacugugaaacuggc

SEQ ID NO: 1211429 - RNA, 12 nt, Homo sapiens
guuuuagaacca

SEQ ID NO: 1211430 - RNA, 16 nt, Homo sapiens
guuuuagaaccagccg

SEQ ID NO: 1211431 - RNA, 17 nt, Homo sapiens
guuuuaggguacaguuu

SEQ ID NO: 1211432 - RNA, 18 nt, Homo sapiens
guuuuauggagaccucuc

SEQ ID NO: 1211433 - RNA, 21 nt, Homo sapiens
guuuucaaauaacgauuuuau

SEQ ID NO: 1211434 - RNA, 14 nt, Homo sapiens
guuuucaagucaaa

SEQ ID NO: 1211435 - RNA, 22 nt, Homo sapiens
guuuucagcugcucagaauuca

SEQ ID NO: 1211436 - RNA, 23 nt, Homo sapiens
guuuucagcugcucagaauucau

SEQ ID NO: 1211437 - RNA, 18 nt, Homo sapiens
guuuucauuauguucaug

SEQ ID NO: 1211438 - RNA, 19 nt, Homo sapiens
guuuuccagucucuuguac

SEQ ID NO: 1211439 - RNA, 20 nt, Homo sapiens
guuuucgcuggggauggaau

SEQ ID NO: 1211440 - RNA, 23 nt, Homo sapiens
guuuugaaggcaaaauugcaaau

SEQ ID NO: 1211441 - RNA, 12 nt, Homo sapiens
guuuugccucac

SEQ ID NO: 1211442 - RNA, 16 nt, Homo sapiens
guuuugcuacauucua

SEQ ID NO: 1211443 - RNA, 18 nt, Homo sapiens
guuuuguaccaacacaca

SEQ ID NO: 1211444 - RNA, 16 nt, Homo sapiens
guuuuguuugaaaaag

SEQ ID NO: 1211445 - RNA, 22 nt, Homo sapiens
guuuuuaaauagaguuugcuau

SEQ ID NO: 1211446 - RNA, 16 nt, Homo sapiens
guuuuugaaauaccuu

SEQ ID NO: 1211447 - RNA, 15 nt, Homo sapiens
uaccauuuauuugcu

SEQ ID NO: 1211448 - RNA, 22 nt, Homo sapiens
uaccauuuguaauaaaguauau

SEQ ID NO: 1211449 - RNA, 23 nt, Homo sapiens
uaccauuuuuuaaggaaacaaua

SEQ ID NO: 1211450 - RNA, 13 nt, Homo sapiens
uacccaaacccua

SEQ ID NO: 1211451 - RNA, 14 nt, Homo sapiens
uacccaauuuccca

SEQ ID NO: 1211452 - RNA, 23 nt, Homo sapiens
uacccagagaauauauacauucu

SEQ ID NO: 1211453 - RNA, 14 nt, Homo sapiens
uacccagagagucc

SEQ ID NO: 1211454 - RNA, 22 nt, Homo sapiens
uacccagagaguccugugcuga

SEQ ID NO: 1211455 - RNA, 20 nt, Homo sapiens
uacccaggcuggagugcagu

SEQ ID NO: 1211456 - RNA, 16 nt, Homo sapiens
uacccagugggacaga

SEQ ID NO: 1211457 - RNA, 23 nt, Homo sapiens
uaccccagguucuagucaugugu

SEQ ID NO: 1211458 - RNA, 17 nt, Homo sapiens
uaccccagucccaggga

SEQ ID NO: 1211459 - RNA, 22 nt, Homo sapiens
uacccccuucugggcaucuguu

SEQ ID NO: 1211460 - RNA, 16 nt, Homo sapiens
uaccccuuugcacuug

SEQ ID NO: 1211461 - RNA, 20 nt, Homo sapiens
uacccguuucacaugcuuuu

SEQ ID NO: 1211462 - RNA, 14 nt, Homo sapiens
uacccuaaagggag

SEQ ID NO: 1211463 - RNA, 20 nt, Homo sapiens
uacccuccuuccacauguac

SEQ ID NO: 1211464 - RNA, 17 nt, Homo sapiens
uacccucgcaugacugu

SEQ ID NO: 1211465 - RNA, 19 nt, Homo sapiens
uacccuuuaagauauccau

SEQ ID NO: 1211466 - RNA, 18 nt, Homo sapiens
uacccuuuuucuccagcu

SEQ ID NO: 1211467 - RNA, 17 nt, Homo sapiens
uaccgggcuggccugug

SEQ ID NO: 1211468 - RNA, 13 nt, Homo sapiens
uaccguuuccuua

SEQ ID NO: 1211469 - RNA, 16 nt, Homo sapiens
uaccuaaguacuguaa

SEQ ID NO: 1211470 - RNA, 18 nt, Homo sapiens
uaccuagaauagucucac

SEQ ID NO: 1211471 - RNA, 17 nt, Homo sapiens
uaccuagggcacuuuaa

SEQ ID NO: 1211472 - RNA, 11 nt, Homo sapiens
uaccucaaggg

SEQ ID NO: 1211473 - RNA, 22 nt, Homo sapiens
uaccucaguucccucuugcuca

SEQ ID NO: 1211474 - RNA, 20 nt, Homo sapiens
uaccuccuccucuggacaaa

SEQ ID NO: 1211475 - RNA, 13 nt, Homo sapiens
uaccucucuugcu

SEQ ID NO: 1211476 - RNA, 17 nt, Homo sapiens
uaccucugauaccucaa

SEQ ID NO: 1211477 - RNA, 16 nt, Homo sapiens
uaccucuuauugcaaa

SEQ ID NO: 1211478 - RNA, 15 nt, Homo sapiens
uaccugagauggagg

SEQ ID NO: 1211479 - RNA, 23 nt, Homo sapiens
uaccugauggaaguaaagccuca

SEQ ID NO: 1211480 - RNA, 13 nt, Homo sapiens
uaccugggcauuc

SEQ ID NO: 1211481 - RNA, 23 nt, Homo sapiens
uaccuguuuuguggucagcugua

SEQ ID NO: 1211482 - RNA, 19 nt, Homo sapiens
uaccuuaagagacacucca

SEQ ID NO: 1211483 - RNA, 16 nt, Homo sapiens
uaccuucaaacuuuag

SEQ ID NO: 1211484 - RNA, 16 nt, Homo sapiens
uaccuucuuguugaua

SEQ ID NO: 1211485 - RNA, 14 nt, Homo sapiens
uaccuucuuucacu

SEQ ID NO: 1211486 - RNA, 17 nt, Homo sapiens
uacgcauggcuuccucc

SEQ ID NO: 1211487 - RNA, 15 nt, Homo sapiens
uacgucaaagcagua

SEQ ID NO: 1211488 - RNA, 22 nt, Homo sapiens
uacgugaggccugcacagcuaa

SEQ ID NO: 1211489 - RNA, 20 nt, Homo sapiens
uacgugauccucucaccuca

SEQ ID NO: 1211490 - RNA, 19 nt, Homo sapiens
uacguuugaaauaguugau

SEQ ID NO: 1211491 - RNA, 20 nt, Homo sapiens
uacuaaauuacaaaugcaau

SEQ ID NO: 1211492 - RNA, 24 nt, Homo sapiens
uacuaacauuuucauugaugagca

SEQ ID NO: 1211493 - RNA, 23 nt, Homo sapiens
uacuaagccacaagaaauuugau

SEQ ID NO: 1211494 - RNA, 21 nt, Homo sapiens
uacuaauuuucuagauuuucu

SEQ ID NO: 1211495 - RNA, 15 nt, Homo sapiens
uacuaccacaaggaa

SEQ ID NO: 1211496 - RNA, 22 nt, Homo sapiens
uacuaccugucaagguuugugu

SEQ ID NO: 1211497 - RNA, 13 nt, Homo sapiens
uacuaccuugaaa

SEQ ID NO: 1211498 - RNA, 14 nt, Homo sapiens
uacuagcacuuuga

SEQ ID NO: 1211499 - RNA, 20 nt, Homo sapiens
uacuagcaggcaaugcugua

SEQ ID NO: 1211500 - RNA, 14 nt, Homo sapiens
uacuagcaguguuu

SEQ ID NO: 1211501 - RNA, 21 nt, Homo sapiens
uacuaggauacagaaaugcaa

SEQ ID NO: 1211502 - RNA, 16 nt, Homo sapiens
uacuaguuuucaauca

SEQ ID NO: 1211503 - RNA, 16 nt, Homo sapiens
uacuauaaaaaacauu

SEQ ID NO: 1211504 - RNA, 22 nt, Homo sapiens
uacuauaaucaaaugauuucau

SEQ ID NO: 1211505 - RNA, 16 nt, Homo sapiens
uacuaucauggcauau

SEQ ID NO: 1211506 - RNA, 17 nt, Homo sapiens
uacuaucauucucagug

SEQ ID NO: 1211507 - RNA, 16 nt, Homo sapiens
uacuauguacugccuu

SEQ ID NO: 1211508 - RNA, 17 nt, Homo sapiens
uacuauucccuuugacu

SEQ ID NO: 1211509 - RNA, 14 nt, Homo sapiens
uacucaauggagua

SEQ ID NO: 1211510 - RNA, 15 nt, Homo sapiens
uacucagaaccugcu

SEQ ID NO: 1211511 - RNA, 21 nt, Homo sapiens
uacucaggguucaucugucca

SEQ ID NO: 1211512 - RNA, 21 nt, Homo sapiens
uacucagguuaaugcugaaaa

SEQ ID NO: 1211513 - RNA, 15 nt, Homo sapiens
uacucauuagugacu

SEQ ID NO: 1211514 - RNA, 18 nt, Homo sapiens
uacucauugaaaugucac

SEQ ID NO: 1211515 - RNA, 15 nt, Homo sapiens
uacuccaagacagag

SEQ ID NO: 1211516 - RNA, 17 nt, Homo sapiens
uacuccccaacugaguu

SEQ ID NO: 1211517 - RNA, 18 nt, Homo sapiens
uacucccuacacugaugc

SEQ ID NO: 1211518 - RNA, 15 nt, Homo sapiens
uacucccucuuccaa

SEQ ID NO: 1211519 - RNA, 20 nt, Homo sapiens
uacucgggaggcugaggcag

SEQ ID NO: 1211520 - RNA, 17 nt, Homo sapiens
uacucuggggugcugcc

SEQ ID NO: 1211521 - RNA, 21 nt, Homo sapiens
uacucuguccauuuauccaca

SEQ ID NO: 1211522 - RNA, 15 nt, Homo sapiens
uacucuuuguagcaa

SEQ ID NO: 1211523 - RNA, 22 nt, Homo sapiens
uacugaacaugggagcucuuga

SEQ ID NO: 1211524 - RNA, 13 nt, Homo sapiens
uacugaaucuuca

SEQ ID NO: 1211525 - RNA, 19 nt, Homo sapiens
uacugagcauuugcaccuc

SEQ ID NO: 1211526 - RNA, 22 nt, Homo sapiens
uacugaggugcuauguucuuag

SEQ ID NO: 1211527 - RNA, 16 nt, Homo sapiens
uacugaguauguggaa

SEQ ID NO: 1211528 - RNA, 19 nt, Homo sapiens
uacugauaaccacuccuaa

SEQ ID NO: 1211529 - RNA, 19 nt, Homo sapiens
uacugauccucgcaugaug

SEQ ID NO: 1211530 - RNA, 14 nt, Homo sapiens
uacugaucucuuua

SEQ ID NO: 1211531 - RNA, 13 nt, Homo sapiens
uacugaugaaaua

SEQ ID NO: 1211532 - RNA, 15 nt, Homo sapiens
uacugauucacugca

SEQ ID NO: 1211533 - RNA, 23 nt, Homo sapiens
uacugcagagggacagaugacca

SEQ ID NO: 1211534 - RNA, 13 nt, Homo sapiens
uacugccauguac

SEQ ID NO: 1211535 - RNA, 15 nt, Homo sapiens
uacugcgugugauaa

SEQ ID NO: 1211536 - RNA, 15 nt, Homo sapiens
uacugcugucuucca

SEQ ID NO: 1211537 - RNA, 17 nt, Homo sapiens
uacugcuugaccaaaga

SEQ ID NO: 1211538 - RNA, 23 nt, Homo sapiens
uacuggauuguguuugugccaua

SEQ ID NO: 1211539 - RNA, 18 nt, Homo sapiens
uacuguaauaauaccuca

SEQ ID NO: 1211540 - RNA, 21 nt, Homo sapiens
uacuguaggcacacuuugcac

SEQ ID NO: 1211541 - RNA, 14 nt, Homo sapiens
uacuguaugccuuc

SEQ ID NO: 1211542 - RNA, 17 nt, Homo sapiens
uacuguauggaaacacu

SEQ ID NO: 1211543 - RNA, 19 nt, Homo sapiens
uacuguauggaaacacuga

SEQ ID NO: 1211544 - RNA, 19 nt, Homo sapiens
uacuguccuuaaagccauu

SEQ ID NO: 1211545 - RNA, 19 nt, Homo sapiens
uacugugaaacuggcacug

SEQ ID NO: 1211546 - RNA, 17 nt, Homo sapiens
uacuguggucacuugua

SEQ ID NO: 1211547 - RNA, 20 nt, Homo sapiens
uacuguuugauauaccaaau

SEQ ID NO: 1211548 - RNA, 19 nt, Homo sapiens
uacuuaaaaauagucuucc

SEQ ID NO: 1211549 - RNA, 20 nt, Homo sapiens
uacuuaaaaauagucuucca

SEQ ID NO: 1211550 - RNA, 22 nt, Homo sapiens
uacuuaaauuugguuuguuaau

SEQ ID NO: 1211551 - RNA, 19 nt, Homo sapiens
uacuuaacuauucaggaga

SEQ ID NO: 1211552 - RNA, 19 nt, Homo sapiens
uacuuaagagugcugugua

SEQ ID NO: 1211553 - RNA, 15 nt, Homo sapiens
gucuuggacacugua

SEQ ID NO: 1211554 - RNA, 14 nt, Homo sapiens
gucuuguucuguga

SEQ ID NO: 1211555 - RNA, 22 nt, Homo sapiens
gucuuuagggguugggcuggau

SEQ ID NO: 1211556 - RNA, 20 nt, Homo sapiens
gucuuucacagcuccuccca

SEQ ID NO: 1211557 - RNA, 13 nt, Homo sapiens
gucuuucugacau

SEQ ID NO: 1211558 - RNA, 23 nt, Homo sapiens
gucuuucugacaucagcagagaa

SEQ ID NO: 1211559 - RNA, 19 nt, Homo sapiens
gucuuugccagucauucag

SEQ ID NO: 1211560 - RNA, 17 nt, Homo sapiens
gugaaaauccaucucau

SEQ ID NO: 1211561 - RNA, 21 nt, Homo sapiens
gugaaaccccauuucuacuaa

SEQ ID NO: 1211562 - RNA, 15 nt, Homo sapiens
gugaaacuccaucuc

SEQ ID NO: 1211563 - RNA, 13 nt, Homo sapiens
gugaaacuggcac

SEQ ID NO: 1211564 - RNA, 21 nt, Homo sapiens
gugaaaggaagcuccacuguc

SEQ ID NO: 1211565 - RNA, 23 nt, Homo sapiens
gugaacaaacuuagaaagggaag

SEQ ID NO: 1211566 - RNA, 13 nt, Homo sapiens
gugaacauuuuaa

SEQ ID NO: 1211567 - RNA, 14 nt, Homo sapiens
gugaacugugcaua

SEQ ID NO: 1211568 - RNA, 15 nt, Homo sapiens
gugaacugugcauag

SEQ ID NO: 1211569 - RNA, 19 nt, Homo sapiens
gugaagaggaaaaugccuc

SEQ ID NO: 1211570 - RNA, 20 nt, Homo sapiens
gugaagagggagaagcauga

SEQ ID NO: 1211571 - RNA, 14 nt, Homo sapiens
gugaagagucuaca

SEQ ID NO: 1211572 - RNA, 23 nt, Homo sapiens
gugaagcauucuccccaguguau

SEQ ID NO: 1211573 - RNA, 12 nt, Homo sapiens
gugaagcauuua

SEQ ID NO: 1211574 - RNA, 19 nt, Homo sapiens
gugaaggauaagagaaaca

SEQ ID NO: 1211575 - RNA, 12 nt, Homo sapiens
gugaaguguuac

SEQ ID NO: 1211576 - RNA, 22 nt, Homo sapiens
gugaauacugcuacagcaauuu

SEQ ID NO: 1211577 - RNA, 17 nt, Homo sapiens
gugaaugaaacacucag

SEQ ID NO: 1211578 - RNA, 13 nt, Homo sapiens
gugaaugaucucu

SEQ ID NO: 1211579 - RNA, 12 nt, Homo sapiens
gugaaugcuucu

SEQ ID NO: 1211580 - RNA, 18 nt, Homo sapiens
gugaauggccuuccuucc

SEQ ID NO: 1211581 - RNA, 14 nt, Homo sapiens
gugaauuaggcugu

SEQ ID NO: 1211582 - RNA, 16 nt, Homo sapiens
gugaauuaggcuguaa

SEQ ID NO: 1211583 - RNA, 21 nt, Homo sapiens
gugaauuaggcuguaacuacu

SEQ ID NO: 1211584 - RNA, 18 nt, Homo sapiens
gugaauugaauggugcau

SEQ ID NO: 1211585 - RNA, 15 nt, Homo sapiens
gugaauuucuucacu

SEQ ID NO: 1211586 - RNA, 12 nt, Homo sapiens
gugacacauaug

SEQ ID NO: 1211587 - RNA, 21 nt, Homo sapiens
gugacagacaggcucuuagca

SEQ ID NO: 1211588 - RNA, 14 nt, Homo sapiens
gugacagugccugg

SEQ ID NO: 1211589 - RNA, 18 nt, Homo sapiens
gugacauuuauauauuga

SEQ ID NO: 1211590 - RNA, 16 nt, Homo sapiens
gugacauuugggagac

SEQ ID NO: 1211591 - RNA, 14 nt, Homo sapiens
gugaccaacugugu

SEQ ID NO: 1211592 - RNA, 23 nt, Homo sapiens
gugaccauggaggccagugccag

SEQ ID NO: 1211593 - RNA, 16 nt, Homo sapiens
gugaccccugaccuca

SEQ ID NO: 1211594 - RNA, 20 nt, Homo sapiens
gugacccuucagggccagaa

SEQ ID NO: 1211595 - RNA, 17 nt, Homo sapiens
gugaccuaaccacuuag

SEQ ID NO: 1211596 - RNA, 22 nt, Homo sapiens
gugaccucagugagauauuugg

SEQ ID NO: 1211597 - RNA, 19 nt, Homo sapiens
gugaccuggaaucagugaa

SEQ ID NO: 1211598 - RNA, 14 nt, Homo sapiens
gugagaaauuucug

SEQ ID NO: 1211599 - RNA, 23 nt, Homo sapiens
gugagacuguguuguacagcuag

SEQ ID NO: 1211600 - RNA, 14 nt, Homo sapiens
gugagaucaugcca

SEQ ID NO: 1211601 - RNA, 17 nt, Homo sapiens
gugagcaagggggccca

SEQ ID NO: 1211602 - RNA, 15 nt, Homo sapiens
gugagcacuagaaua

SEQ ID NO: 1211603 - RNA, 16 nt, Homo sapiens
gugagcggagaucgca

SEQ ID NO: 1211604 - RNA, 13 nt, Homo sapiens
gugagcucuggga

SEQ ID NO: 1211605 - RNA, 17 nt, Homo sapiens
gugaggcccauucuuca

SEQ ID NO: 1211606 - RNA, 14 nt, Homo sapiens
gugaggccugcaca

SEQ ID NO: 1211607 - RNA, 14 nt, Homo sapiens
gugaggggcaagcu

SEQ ID NO: 1211608 - RNA, 15 nt, Homo sapiens
gugagggugcugacu

SEQ ID NO: 1211609 - RNA, 12 nt, Homo sapiens
gugaggugagcc

SEQ ID NO: 1211610 - RNA, 15 nt, Homo sapiens
gugagguucuugggu

SEQ ID NO: 1211611 - RNA, 15 nt, Homo sapiens
gugagucaccacuuc

SEQ ID NO: 1211612 - RNA, 19 nt, Homo sapiens
gugaguccccuacucccuc

SEQ ID NO: 1211613 - RNA, 13 nt, Homo sapiens
gugaguucucagg

SEQ ID NO: 1211614 - RNA, 14 nt, Homo sapiens
gugaguucucaggg

SEQ ID NO: 1211615 - RNA, 22 nt, Homo sapiens
gugaguuuaccuuguauacugu

SEQ ID NO: 1211616 - RNA, 15 nt, Homo sapiens
gugauaaugcagacu

SEQ ID NO: 1211617 - RNA, 21 nt, Homo sapiens
gugauacuaagguggaugcca

SEQ ID NO: 1211618 - RNA, 23 nt, Homo sapiens
gugauauacugguucacauccua

SEQ ID NO: 1211619 - RNA, 22 nt, Homo sapiens
gugaucacugagacagccacuu

SEQ ID NO: 1211620 - RNA, 23 nt, Homo sapiens
gugaucauuagggcugaggucug

SEQ ID NO: 1211621 - RNA, 20 nt, Homo sapiens
gugaucucccaagcuaucua

SEQ ID NO: 1211622 - RNA, 18 nt, Homo sapiens
gugaugaugcugugacaa

SEQ ID NO: 1211623 - RNA, 21 nt, Homo sapiens
gugauggagaugcagucacuu

SEQ ID NO: 1211624 - RNA, 23 nt, Homo sapiens
gugauggagaugcagucacuuau

SEQ ID NO: 1211625 - RNA, 20 nt, Homo sapiens
gugaugugugagcuaugcaa

SEQ ID NO: 1211626 - RNA, 12 nt, Homo sapiens
gugauguucuaa

SEQ ID NO: 1211627 - RNA, 18 nt, Homo sapiens
gugauguuuuagugcuuu

SEQ ID NO: 1211628 - RNA, 23 nt, Homo sapiens
gugauucucuugacguuuacaua

SEQ ID NO: 1211629 - RNA, 14 nt, Homo sapiens
gugauuggaccagg

SEQ ID NO: 1211630 - RNA, 15 nt, Homo sapiens
gugauuggugcugag

SEQ ID NO: 1211631 - RNA, 24 nt, Homo sapiens
gugauuucaccccacagacacuua

SEQ ID NO: 1211632 - RNA, 19 nt, Homo sapiens
gugauuucuuucuuugcac

SEQ ID NO: 1211633 - RNA, 18 nt, Homo sapiens
gugauuuggaccauggca

SEQ ID NO: 1211634 - RNA, 21 nt, Homo sapiens
gugcaaacgccuagauugcuu

SEQ ID NO: 1211635 - RNA, 19 nt, Homo sapiens
gugcaaaguucccuacuuc

SEQ ID NO: 1211636 - RNA, 18 nt, Homo sapiens
gugcaaauauaucugcua

SEQ ID NO: 1211637 - RNA, 20 nt, Homo sapiens
gugcaacgcuuuuugggaga

SEQ ID NO: 1211638 - RNA, 21 nt, Homo sapiens
gugcaacgcuuuuugggagaa

SEQ ID NO: 1211639 - RNA, 18 nt, Homo sapiens
ggaccaaggggugggcca

SEQ ID NO: 1211640 - RNA, 14 nt, Homo sapiens
ggaccacaguaaca

SEQ ID NO: 1211641 - RNA, 13 nt, Homo sapiens
ggaccacauuuua

SEQ ID NO: 1211642 - RNA, 18 nt, Homo sapiens
ggaccacuuuuauuuauu

SEQ ID NO: 1211643 - RNA, 18 nt, Homo sapiens
ggaccagcccuugaggga

SEQ ID NO: 1211644 - RNA, 13 nt, Homo sapiens
ggaccauguguca

SEQ ID NO: 1211645 - RNA, 18 nt, Homo sapiens
ggaccauuuuuacaucca

SEQ ID NO: 1211646 - RNA, 18 nt, Homo sapiens
ggacccccaacauucugc

SEQ ID NO: 1211647 - RNA, 18 nt, Homo sapiens
ggacccccacgauuggcc

SEQ ID NO: 1211648 - RNA, 22 nt, Homo sapiens
ggaccuaaaaaggucuguuaau

SEQ ID NO: 1211649 - RNA, 20 nt, Homo sapiens
ggaccugagccugguccugg

SEQ ID NO: 1211650 - RNA, 21 nt, Homo sapiens
ggaccugccccccacucugca

SEQ ID NO: 1211651 - RNA, 20 nt, Homo sapiens
ggaccuugggaucagaucaa

SEQ ID NO: 1211652 - RNA, 16 nt, Homo sapiens
ggaccuuuuguacuuu

SEQ ID NO: 1211653 - RNA, 22 nt, Homo sapiens
ggacgauagcuuggagggaugg

SEQ ID NO: 1211654 - RNA, 22 nt, Homo sapiens
ggacuaaacuaucuguauuuau

SEQ ID NO: 1211655 - RNA, 13 nt, Homo sapiens
ggacuacaaccaa

SEQ ID NO: 1211656 - RNA, 19 nt, Homo sapiens
ggacuacaccaggguccug

SEQ ID NO: 1211657 - RNA, 13 nt, Homo sapiens
ggacuacaggcac

SEQ ID NO: 1211658 - RNA, 17 nt, Homo sapiens
ggacuacaggcacccac

SEQ ID NO: 1211659 - RNA, 12 nt, Homo sapiens
ggacuacuccaa

SEQ ID NO: 1211660 - RNA, 12 nt, Homo sapiens
ggacucaaugca

SEQ ID NO: 1211661 - RNA, 23 nt, Homo sapiens
ggacucaaugcacugacauuguu

SEQ ID NO: 1211662 - RNA, 13 nt, Homo sapiens
ggacucagcccac

SEQ ID NO: 1211663 - RNA, 13 nt, Homo sapiens
ggacuccacugga

SEQ ID NO: 1211664 - RNA, 16 nt, Homo sapiens
ggacuccacuggacag

SEQ ID NO: 1211665 - RNA, 16 nt, Homo sapiens
ggacucugcaucccag

SEQ ID NO: 1211666 - RNA, 22 nt, Homo sapiens
ggacucuggauauuugcacuua

SEQ ID NO: 1211667 - RNA, 12 nt, Homo sapiens
ggacucuuccac

SEQ ID NO: 1211668 - RNA, 19 nt, Homo sapiens
ggacucuuccaccucccaa

SEQ ID NO: 1211669 - RNA, 22 nt, Homo sapiens
ggacugagccuggcccauagaa

SEQ ID NO: 1211670 - RNA, 20 nt, Homo sapiens
ggacuggaaggggaagggac

SEQ ID NO: 1211671 - RNA, 19 nt, Homo sapiens
ggacuggaggugggcaugc

SEQ ID NO: 1211672 - RNA, 22 nt, Homo sapiens
ggacuggaggugggcaugccac

SEQ ID NO: 1211673 - RNA, 18 nt, Homo sapiens
ggacuggugugcucucuu

SEQ ID NO: 1211674 - RNA, 14 nt, Homo sapiens
ggacuguaagggau

SEQ ID NO: 1211675 - RNA, 18 nt, Homo sapiens
ggacuuccagugcucaga

SEQ ID NO: 1211676 - RNA, 15 nt, Homo sapiens
ggacuuccauuugcu

SEQ ID NO: 1211677 - RNA, 13 nt, Homo sapiens
ggacuuccuugcu

SEQ ID NO: 1211678 - RNA, 16 nt, Homo sapiens
ggacuuccuugcucuc

SEQ ID NO: 1211679 - RNA, 16 nt, Homo sapiens
ggacuuuccugcaacu

SEQ ID NO: 1211680 - RNA, 22 nt, Homo sapiens
ggagaaagcagccauuggcacu

SEQ ID NO: 1211681 - RNA, 18 nt, Homo sapiens
ggagaacaugcuggugaa

SEQ ID NO: 1211682 - RNA, 19 nt, Homo sapiens
ggagaaugaauacugggaa

SEQ ID NO: 1211683 - RNA, 14 nt, Homo sapiens
ggagacaacuggac

SEQ ID NO: 1211684 - RNA, 23 nt, Homo sapiens
ggagacacaacuauuuuuccaaa

SEQ ID NO: 1211685 - RNA, 17 nt, Homo sapiens
ggagacacugugcuaua

SEQ ID NO: 1211686 - RNA, 21 nt, Homo sapiens
ggagacccucgcccaacucca

SEQ ID NO: 1211687 - RNA, 14 nt, Homo sapiens
ggagaccuggcacu

SEQ ID NO: 1211688 - RNA, 12 nt, Homo sapiens
ggagacuuguau

SEQ ID NO: 1211689 - RNA, 14 nt, Homo sapiens
ggagagaaaaaaga

SEQ ID NO: 1211690 - RNA, 14 nt, Homo sapiens
ggagagacagugac

SEQ ID NO: 1211691 - RNA, 22 nt, Homo sapiens
ggagaggcggccucgugccaug

SEQ ID NO: 1211692 - RNA, 17 nt, Homo sapiens
ggagagucgggggacca

SEQ ID NO: 1211693 - RNA, 21 nt, Homo sapiens
ggagauuucuuguugcucaaa

SEQ ID NO: 1211694 - RNA, 16 nt, Homo sapiens
ggagcagaggaauuau

SEQ ID NO: 1211695 - RNA, 16 nt, Homo sapiens
ggagcagcaucucuga

SEQ ID NO: 1211696 - RNA, 13 nt, Homo sapiens
ggagcaggaccua

SEQ ID NO: 1211697 - RNA, 18 nt, Homo sapiens
ggagcaggaccuacuagg

SEQ ID NO: 1211698 - RNA, 15 nt, Homo sapiens
ggagcaggaggccaa

SEQ ID NO: 1211699 - RNA, 18 nt, Homo sapiens
ggagcaggggaggcucac

SEQ ID NO: 1211700 - RNA, 20 nt, Homo sapiens
ggagcagguuccccaagggc

SEQ ID NO: 1211701 - RNA, 20 nt, Homo sapiens
ggagcauagcagaggggcca

SEQ ID NO: 1211702 - RNA, 12 nt, Homo sapiens
ggagcccaguga

SEQ ID NO: 1211703 - RNA, 20 nt, Homo sapiens
ggagcccccaccacaaacuu

SEQ ID NO: 1211704 - RNA, 16 nt, Homo sapiens
ggagcccuggugcuac

SEQ ID NO: 1211705 - RNA, 22 nt, Homo sapiens
ggagcgaggaaggaaagcacag

SEQ ID NO: 1211706 - RNA, 12 nt, Homo sapiens
ggagcugccaca

SEQ ID NO: 1211707 - RNA, 19 nt, Homo sapiens
ggagcugccuguucagcuc

SEQ ID NO: 1211708 - RNA, 18 nt, Homo sapiens
ggagcugcucucucauga

SEQ ID NO: 1211709 - RNA, 19 nt, Homo sapiens
ggagcugugcucagcacag

SEQ ID NO: 1211710 - RNA, 19 nt, Homo sapiens
ggaggacaggcaggccaga

SEQ ID NO: 1211711 - RNA, 15 nt, Homo sapiens
ggaggaucaguuuuu

SEQ ID NO: 1211712 - RNA, 19 nt, Homo sapiens
ggaggaucgccugagccca

SEQ ID NO: 1211713 - RNA, 12 nt, Homo sapiens
ggaggauguucu

SEQ ID NO: 1211714 - RNA, 21 nt, Homo sapiens
gcuccuuucuccagccagcaa

SEQ ID NO: 1211715 - RNA, 13 nt, Homo sapiens
gcucgagugaauu

SEQ ID NO: 1211716 - RNA, 16 nt, Homo sapiens
gcucgccccaccucca

SEQ ID NO: 1211717 - RNA, 15 nt, Homo sapiens
gcucgcccuccuuuc

SEQ ID NO: 1211718 - RNA, 20 nt, Homo sapiens
gcucgugggauguccuacua

SEQ ID NO: 1211719 - RNA, 15 nt, Homo sapiens
gcucuaauguacaau

SEQ ID NO: 1211720 - RNA, 17 nt, Homo sapiens
gcucuaauguacaauaa

SEQ ID NO: 1211721 - RNA, 23 nt, Homo sapiens
gcucuaauguacaauaaagcaau

SEQ ID NO: 1211722 - RNA, 13 nt, Homo sapiens
gcucuagucacug

SEQ ID NO: 1211723 - RNA, 23 nt, Homo sapiens
gcucuauaagagcuggaugcaca

SEQ ID NO: 1211724 - RNA, 16 nt, Homo sapiens
gcucuauuaagauuuc

SEQ ID NO: 1211725 - RNA, 12 nt, Homo sapiens
gcucucagcuca

SEQ ID NO: 1211726 - RNA, 14 nt, Homo sapiens
gcucucauguuccu

SEQ ID NO: 1211727 - RNA, 14 nt, Homo sapiens
gcucucauugacuu

SEQ ID NO: 1211728 - RNA, 15 nt, Homo sapiens
gcucuccaucuucca

SEQ ID NO: 1211729 - RNA, 13 nt, Homo sapiens
gcucucgacagua

SEQ ID NO: 1211730 - RNA, 17 nt, Homo sapiens
gcucugagccagauuac

SEQ ID NO: 1211731 - RNA, 14 nt, Homo sapiens
gcucuggacaggca

SEQ ID NO: 1211732 - RNA, 15 nt, Homo sapiens
gcucuggaggagcaa

SEQ ID NO: 1211733 - RNA, 19 nt, Homo sapiens
gcucugggagacuuugaag

SEQ ID NO: 1211734 - RNA, 13 nt, Homo sapiens
gcucuguacccau

SEQ ID NO: 1211735 - RNA, 20 nt, Homo sapiens
gcucugugcagucacuggag

SEQ ID NO: 1211736 - RNA, 21 nt, Homo sapiens
gcucuuagcagcuuccagauu

SEQ ID NO: 1211737 - RNA, 18 nt, Homo sapiens
gcucuuaugugugccuuu

SEQ ID NO: 1211738 - RNA, 15 nt, Homo sapiens
gcucuucacuguggu

SEQ ID NO: 1211739 - RNA, 13 nt, Homo sapiens
gcucuucagcaca

SEQ ID NO: 1211740 - RNA, 10 nt, Homo sapiens
gcucuuccaa

SEQ ID NO: 1211741 - RNA, 18 nt, Homo sapiens
gcucuugaggcauuucca

SEQ ID NO: 1211742 - RNA, 22 nt, Homo sapiens
gcucuugcucagugaagaggaa

SEQ ID NO: 1211743 - RNA, 13 nt, Homo sapiens
gcucuuucagaga

SEQ ID NO: 1211744 - RNA, 18 nt, Homo sapiens
gcucuuucccuuuaucag

SEQ ID NO: 1211745 - RNA, 16 nt, Homo sapiens
gcucuuucucugccag

SEQ ID NO: 1211746 - RNA, 15 nt, Homo sapiens
gcucuuugcugcacu

SEQ ID NO: 1211747 - RNA, 15 nt, Homo sapiens
gcugaaaaaacaccu

SEQ ID NO: 1211748 - RNA, 13 nt, Homo sapiens
gcugaaaacuaca

SEQ ID NO: 1211749 - RNA, 16 nt, Homo sapiens
gcugaagcuggugcgc

SEQ ID NO: 1211750 - RNA, 21 nt, Homo sapiens
gcugaaggcaguggcagggga

SEQ ID NO: 1211751 - RNA, 21 nt, Homo sapiens
gcugaagugguugcauucuac

SEQ ID NO: 1211752 - RNA, 16 nt, Homo sapiens
gcugaccucccaguga

SEQ ID NO: 1211753 - RNA, 22 nt, Homo sapiens
gcugagacaggaggauugccug

SEQ ID NO: 1211754 - RNA, 14 nt, Homo sapiens
gcugagaccacuga

SEQ ID NO: 1211755 - RNA, 14 nt, Homo sapiens
gcugagagaccuga

SEQ ID NO: 1211756 - RNA, 20 nt, Homo sapiens
gcugagaucacaccacugua

SEQ ID NO: 1211757 - RNA, 14 nt, Homo sapiens
gcugagaucgugcu

SEQ ID NO: 1211758 - RNA, 16 nt, Homo sapiens
gcugagcaaucugacc

SEQ ID NO: 1211759 - RNA, 22 nt, Homo sapiens
gcugagcuugucuuuucugcug

SEQ ID NO: 1211760 - RNA, 21 nt, Homo sapiens
gcugaggcaggaggaucgccu

SEQ ID NO: 1211761 - RNA, 18 nt, Homo sapiens
gcugagguuccucugccu

SEQ ID NO: 1211762 - RNA, 16 nt, Homo sapiens
gcugagugcaccacuu

SEQ ID NO: 1211763 - RNA, 13 nt, Homo sapiens
gcugagugccuga

SEQ ID NO: 1211764 - RNA, 22 nt, Homo sapiens
gcugagugcuagaguaggugca

SEQ ID NO: 1211765 - RNA, 18 nt, Homo sapiens
gcugaguggccagccagu

SEQ ID NO: 1211766 - RNA, 14 nt, Homo sapiens
gcugagugggagaa

SEQ ID NO: 1211767 - RNA, 13 nt, Homo sapiens
gcugaguguccag

SEQ ID NO: 1211768 - RNA, 17 nt, Homo sapiens
gcugaugaugucucuug

SEQ ID NO: 1211769 - RNA, 22 nt, Homo sapiens
gcugaugccuguguacugccuu

SEQ ID NO: 1211770 - RNA, 21 nt, Homo sapiens
gcugauggaccaggaagcccu

SEQ ID NO: 1211771 - RNA, 19 nt, Homo sapiens
gcugugaggccccuggaca

SEQ ID NO: 1211772 - RNA, 18 nt, Homo sapiens
gcugugaugguaccuggg

SEQ ID NO: 1211773 - RNA, 17 nt, Homo sapiens
gcugugcaucaguggga

SEQ ID NO: 1211774 - RNA, 18 nt, Homo sapiens
gcuguggcagaguuacag

SEQ ID NO: 1211775 - RNA, 12 nt, Homo sapiens
gcuguguguucu

SEQ ID NO: 1211776 - RNA, 13 nt, Homo sapiens
gcuguuaaacugu

SEQ ID NO: 1211777 - RNA, 18 nt, Homo sapiens
gcuguuaacuguuaacua

SEQ ID NO: 1211778 - RNA, 15 nt, Homo sapiens
gcuguuaccauucac

SEQ ID NO: 1211779 - RNA, 14 nt, Homo sapiens
gcuguugcauuuag

SEQ ID NO: 1211780 - RNA, 22 nt, Homo sapiens
gcuguuuguuucauauauacag

SEQ ID NO: 1211781 - RNA, 21 nt, Homo sapiens
gcuguuuugauuuguacugaa

SEQ ID NO: 1211782 - RNA, 16 nt, Homo sapiens
gcuuaaaaucugugaa

SEQ ID NO: 1211783 - RNA, 17 nt, Homo sapiens
gcuuaaaaucugugaag

SEQ ID NO: 1211784 - RNA, 13 nt, Homo sapiens
gcuuaaacaaagu

SEQ ID NO: 1211785 - RNA, 16 nt, Homo sapiens
gcuuaacaaugcaacu

SEQ ID NO: 1211786 - RNA, 21 nt, Homo sapiens
gcuuaacuccccacugccugu

SEQ ID NO: 1211787 - RNA, 13 nt, Homo sapiens
gcuuaccugacac

SEQ ID NO: 1211788 - RNA, 14 nt, Homo sapiens
gcuuacuccacuuc

SEQ ID NO: 1211789 - RNA, 14 nt, Homo sapiens
gcuuagaagugcua

SEQ ID NO: 1211790 - RNA, 20 nt, Homo sapiens
gcuuagcuaauauugcaaug

SEQ ID NO: 1211791 - RNA, 23 nt, Homo sapiens
gcuuaguagagcuuuuugcaugu

SEQ ID NO: 1211792 - RNA, 23 nt, Homo sapiens
gcuuaguccaauuccuugcacau

SEQ ID NO: 1211793 - RNA, 14 nt, Homo sapiens
gcuuauaugugaca

SEQ ID NO: 1211794 - RNA, 18 nt, Homo sapiens
gcuuaucuuagaagcacu

SEQ ID NO: 1211795 - RNA, 16 nt, Homo sapiens
gcuuauggauucauau

SEQ ID NO: 1211796 - RNA, 20 nt, Homo sapiens
gcuuauucaucuguuuuucu

SEQ ID NO: 1211797 - RNA, 23 nt, Homo sapiens
gcuucaaauaaaguccugacacu

SEQ ID NO: 1211798 - RNA, 13 nt, Homo sapiens
gcuucaagugccu

SEQ ID NO: 1211799 - RNA, 19 nt, Homo sapiens
gcuucaaguguugcucuug

SEQ ID NO: 1211800 - RNA, 21 nt, Homo sapiens
gcuucacaguagagccagcuu

SEQ ID NO: 1211801 - RNA, 12 nt, Homo sapiens
gcuucagaguuu

SEQ ID NO: 1211802 - RNA, 13 nt, Homo sapiens
gcuucagugacaa

SEQ ID NO: 1211803 - RNA, 20 nt, Homo sapiens
gcuucagugacaaacauauc

SEQ ID NO: 1211804 - RNA, 18 nt, Homo sapiens
gcuucaguggcagcugcu

SEQ ID NO: 1211805 - RNA, 20 nt, Homo sapiens
gcuucauauaccagcaauau

SEQ ID NO: 1211806 - RNA, 17 nt, Homo sapiens
gcuucauuccaaucuau

SEQ ID NO: 1211807 - RNA, 14 nt, Homo sapiens
gcuuccacuucuau

SEQ ID NO: 1211808 - RNA, 16 nt, Homo sapiens
gcuuccagaaaacccc

SEQ ID NO: 1211809 - RNA, 14 nt, Homo sapiens
gcuuccagcaguau

SEQ ID NO: 1211810 - RNA, 16 nt, Homo sapiens
gcuucccaacuucaua

SEQ ID NO: 1211811 - RNA, 23 nt, Homo sapiens
gcuuccuagaaaguucuguguaa

SEQ ID NO: 1211812 - RNA, 20 nt, Homo sapiens
gcuuccucaguaacauuucu

SEQ ID NO: 1211813 - RNA, 19 nt, Homo sapiens
gcuuccucuagaagccaag

SEQ ID NO: 1211814 - RNA, 21 nt, Homo sapiens
gcuuccugaaauaaacacugg

SEQ ID NO: 1211815 - RNA, 13 nt, Homo sapiens
gcuucgcuggaaa

SEQ ID NO: 1211816 - RNA, 15 nt, Homo sapiens
gcuucggacaaaaua

SEQ ID NO: 1211817 - RNA, 19 nt, Homo sapiens
gcuucucaaaguacuggga

SEQ ID NO: 1211818 - RNA, 23 nt, Homo sapiens
gcuucucaccgugcagagcugca

SEQ ID NO: 1211819 - RNA, 15 nt, Homo sapiens
gcuucuccaugagac

SEQ ID NO: 1211820 - RNA, 13 nt, Homo sapiens
gcuucuccugacc

SEQ ID NO: 1211821 - RNA, 20 nt, Homo sapiens
gcuucuccuucuccuuccca

SEQ ID NO: 1211822 - RNA, 16 nt, Homo sapiens
gcuucugaaacuggag

SEQ ID NO: 1211823 - RNA, 21 nt, Homo sapiens
gcuucugcaccaacucaccug

SEQ ID NO: 1211824 - RNA, 16 nt, Homo sapiens
gcuucuggagcccuug

SEQ ID NO: 1211825 - RNA, 22 nt, Homo sapiens
gcuucuguguuuggaacagcua

SEQ ID NO: 1211826 - RNA, 13 nt, Homo sapiens
gcuugaccaaaga

SEQ ID NO: 1211827 - RNA, 22 nt, Homo sapiens
gcuugauauuuuccaaauggau

SEQ ID NO: 1211828 - RNA, 16 nt, Homo sapiens
gcuugcaauguaguca

SEQ ID NO: 1211829 - RNA, 10 nt, Homo sapiens
gcuugcucua

SEQ ID NO: 1211830 - RNA, 19 nt, Homo sapiens
gcuugcugguagcacuugc

SEQ ID NO: 1211831 - RNA, 23 nt, Homo sapiens
gcuuguaauaaauacugcagcuu

SEQ ID NO: 1211832 - RNA, 11 nt, Homo sapiens
gcuuguguuaa

SEQ ID NO: 1211833 - RNA, 16 nt, Homo sapiens
gcuuguuguuugcgca

SEQ ID NO: 1211834 - RNA, 16 nt, Homo sapiens
gcuuguuuacagcacu

SEQ ID NO: 1211835 - RNA, 22 nt, Homo sapiens
gcuuuaaacucagggacagagc

SEQ ID NO: 1211836 - RNA, 21 nt, Homo sapiens
gcuuuaauaagcgagaccuaa

SEQ ID NO: 1211837 - RNA, 14 nt, Homo sapiens
gcuuuagcacagga

SEQ ID NO: 1211838 - RNA, 20 nt, Homo sapiens
gcuuuauuuuuuaaguauuu

SEQ ID NO: 1211839 - RNA, 20 nt, Homo sapiens
gcuuucauaaacuucaggga

SEQ ID NO: 1211840 - RNA, 18 nt, Homo sapiens
gcuuuccaauguagcuca

SEQ ID NO: 1211841 - RNA, 15 nt, Homo sapiens
gcuuuccugcccugg

SEQ ID NO: 1211842 - RNA, 20 nt, Homo sapiens
gcuuucguaguuuucauuua

SEQ ID NO: 1211843 - RNA, 18 nt, Homo sapiens
gcuuucuaggccacuggg

SEQ ID NO: 1211844 - RNA, 22 nt, Homo sapiens
gcuuucugccaucuagccagcc

SEQ ID NO: 1211845 - RNA, 18 nt, Homo sapiens
gcuuugaaagaagcaaga

SEQ ID NO: 1211846 - RNA, 16 nt, Homo sapiens
gcuuuggauuugacau

SEQ ID NO: 1211847 - RNA, 18 nt, Homo sapiens
gcuuugucuucagccucu

SEQ ID NO: 1211848 - RNA, 12 nt, Homo sapiens
gcuuugugauuc

SEQ ID NO: 1211849 - RNA, 17 nt, Homo sapiens
gcuuugugucaucacaa

SEQ ID NO: 1211850 - RNA, 14 nt, Homo sapiens
gcuuuguugcccag

SEQ ID NO: 1211851 - RNA, 13 nt, Homo sapiens
gcuuuguuuggau

SEQ ID NO: 1211852 - RNA, 22 nt, Homo sapiens
gcuuuguuuuuugugcuauuag

SEQ ID NO: 1211853 - RNA, 14 nt, Homo sapiens
gcuuuucacuguga

SEQ ID NO: 1211854 - RNA, 21 nt, Homo sapiens
gcuuuuccuauuuguuuucau

SEQ ID NO: 1211855 - RNA, 14 nt, Homo sapiens
gcuuuuccucccuu

SEQ ID NO: 1211856 - RNA, 14 nt, Homo sapiens
gcuuuucugccaca

SEQ ID NO: 1211857 - RNA, 22 nt, Homo sapiens
gcuuuugccaguauuaugcaua

SEQ ID NO: 1211858 - RNA, 20 nt, Homo sapiens
gcuuuuucacagucacugau

SEQ ID NO: 1211859 - RNA, 19 nt, Homo sapiens
ggaaaaaaagacugaugaa

SEQ ID NO: 1211860 - RNA, 17 nt, Homo sapiens
ggaaaaauaauucuauu

SEQ ID NO: 1211861 - RNA, 17 nt, Homo sapiens
ggaaaagaaaccugggg

SEQ ID NO: 1211862 - RNA, 13 nt, Homo sapiens
ggaaaagcaaaac

SEQ ID NO: 1211863 - RNA, 22 nt, Homo sapiens
ggaaaagguagcuuaccugaca

SEQ ID NO: 1211864 - RNA, 14 nt, Homo sapiens
ggaaaaugacucug

SEQ ID NO: 1211865 - RNA, 12 nt, Homo sapiens
ggaaaaugagua

SEQ ID NO: 1211866 - RNA, 13 nt, Homo sapiens
ggaaaauggugcc

SEQ ID NO: 1211867 - RNA, 14 nt, Homo sapiens
ggaaaauucuuaaa

SEQ ID NO: 1211868 - RNA, 23 nt, Homo sapiens
ggaaacaauauaaccacaaagca

SEQ ID NO: 1211869 - RNA, 20 nt, Homo sapiens
ggaaacacugauuuuguaaa

SEQ ID NO: 1211870 - RNA, 14 nt, Homo sapiens
ggaaacaguccaaa

SEQ ID NO: 1211871 - RNA, 14 nt, Homo sapiens
ggaaaccaguguag

SEQ ID NO: 1211872 - RNA, 17 nt, Homo sapiens
ggaaacucacacucccc

SEQ ID NO: 1211873 - RNA, 19 nt, Homo sapiens
ggaaacuguacuacaucua

SEQ ID NO: 1211874 - RNA, 16 nt, Homo sapiens
ggaaagaugaucagcu

SEQ ID NO: 1211875 - RNA, 16 nt, Homo sapiens
ggaaagcaucaccuca

SEQ ID NO: 1211876 - RNA, 20 nt, Homo sapiens
ggaaagccauugaccaccca

SEQ ID NO: 1211877 - RNA, 20 nt, Homo sapiens
ggaaaggaggcaugccucug

SEQ ID NO: 1211878 - RNA, 21 nt, Homo sapiens
ggaaagggagacgcccuuuca

SEQ ID NO: 1211879 - RNA, 14 nt, Homo sapiens
ggaaaggggugcuu

SEQ ID NO: 1211880 - RNA, 17 nt, Homo sapiens
ggaaauccccuuaugac

SEQ ID NO: 1211881 - RNA, 15 nt, Homo sapiens
ggaaaugauguuuca

SEQ ID NO: 1211882 - RNA, 18 nt, Homo sapiens
ggaaaugguggugcuuua

SEQ ID NO: 1211883 - RNA, 17 nt, Homo sapiens
ggaaauuaagacuuuau

SEQ ID NO: 1211884 - RNA, 13 nt, Homo sapiens
ggaacacacuugg

SEQ ID NO: 1211885 - RNA, 13 nt, Homo sapiens
ggaacagaccuga

SEQ ID NO: 1211886 - RNA, 16 nt, Homo sapiens
ggaacaucacauuccu

SEQ ID NO: 1211887 - RNA, 21 nt, Homo sapiens
ggaacauuggagcugacuguu

SEQ ID NO: 1211888 - RNA, 15 nt, Homo sapiens
ggaacauuugauauu

SEQ ID NO: 1211889 - RNA, 22 nt, Homo sapiens
ggaacuagagggauacacugaa

SEQ ID NO: 1211890 - RNA, 13 nt, Homo sapiens
ggaacuccugacu

SEQ ID NO: 1211891 - RNA, 20 nt, Homo sapiens
ggaacugcguggugcucuuu

SEQ ID NO: 1211892 - RNA, 17 nt, Homo sapiens
ggaagaaagaaugcaag

SEQ ID NO: 1211893 - RNA, 22 nt, Homo sapiens
ggaagaacccucaggucacaag

SEQ ID NO: 1211894 - RNA, 20 nt, Homo sapiens
ggaagaccagcuuugcagug

SEQ ID NO: 1211895 - RNA, 13 nt, Homo sapiens
ggaagacugacag

SEQ ID NO: 1211896 - RNA, 18 nt, Homo sapiens
ggaagacuugaagcacag

SEQ ID NO: 1211897 - RNA, 15 nt, Homo sapiens
ggaagagcauuagcu

SEQ ID NO: 1211898 - RNA, 14 nt, Homo sapiens
ggaagagggcagua

SEQ ID NO: 1211899 - RNA, 14 nt, Homo sapiens
gccuaggugacaga

SEQ ID NO: 1211900 - RNA, 21 nt, Homo sapiens
gccuauguugugguccaucag

SEQ ID NO: 1211901 - RNA, 16 nt, Homo sapiens
gccuauuuaccugcag

SEQ ID NO: 1211902 - RNA, 13 nt, Homo sapiens
gccucaaugccag

SEQ ID NO: 1211903 - RNA, 14 nt, Homo sapiens
gccucaauucacau

SEQ ID NO: 1211904 - RNA, 16 nt, Homo sapiens
gccucagcaacccagg

SEQ ID NO: 1211905 - RNA, 19 nt, Homo sapiens
gccucagcggacaagcagc

SEQ ID NO: 1211906 - RNA, 18 nt, Homo sapiens
gccucagcuucucaaagu

SEQ ID NO: 1211907 - RNA, 22 nt, Homo sapiens
gccucauuauuuuucacugccc

SEQ ID NO: 1211908 - RNA, 16 nt, Homo sapiens
gccuccaagcuccauc

SEQ ID NO: 1211909 - RNA, 20 nt, Homo sapiens
gccuccauggcagaagucaa

SEQ ID NO: 1211910 - RNA, 20 nt, Homo sapiens
gccuccauucugaccauuuc

SEQ ID NO: 1211911 - RNA, 13 nt, Homo sapiens
gccucccacaaga

SEQ ID NO: 1211912 - RNA, 22 nt, Homo sapiens
gccucccacacugaaaccaaaa

SEQ ID NO: 1211913 - RNA, 13 nt, Homo sapiens
gccucccaccaga

SEQ ID NO: 1211914 - RNA, 14 nt, Homo sapiens
gccucccccaaagc

SEQ ID NO: 1211915 - RNA, 19 nt, Homo sapiens
gccucccuuugugugcaua

SEQ ID NO: 1211916 - RNA, 10 nt, Homo sapiens
gccuccucaa

SEQ ID NO: 1211917 - RNA, 21 nt, Homo sapiens
gccuccucacccaccucuuca

SEQ ID NO: 1211918 - RNA, 19 nt, Homo sapiens
gccuccucccacaagcacc

SEQ ID NO: 1211919 - RNA, 22 nt, Homo sapiens
gccuccucccugggcagaaagu

SEQ ID NO: 1211920 - RNA, 16 nt, Homo sapiens
gccuccugcccagucc

SEQ ID NO: 1211921 - RNA, 14 nt, Homo sapiens
gccucgaucaucaa

SEQ ID NO: 1211922 - RNA, 16 nt, Homo sapiens
gccucugaaaugccuc

SEQ ID NO: 1211923 - RNA, 22 nt, Homo sapiens
gccucugccccucccaacccag

SEQ ID NO: 1211924 - RNA, 15 nt, Homo sapiens
gccucuggcucucau

SEQ ID NO: 1211925 - RNA, 21 nt, Homo sapiens
gccucuggucccagcauccag

SEQ ID NO: 1211926 - RNA, 16 nt, Homo sapiens
gccugaacaugccccu

SEQ ID NO: 1211927 - RNA, 20 nt, Homo sapiens
gccugaagauauuacuacuu

SEQ ID NO: 1211928 - RNA, 21 nt, Homo sapiens
gccugaaugucuuacugugau

SEQ ID NO: 1211929 - RNA, 18 nt, Homo sapiens
gccugagcgaguguccag

SEQ ID NO: 1211930 - RNA, 13 nt, Homo sapiens
gccugaggcaauu

SEQ ID NO: 1211931 - RNA, 18 nt, Homo sapiens
gccugaugcucccucccc

SEQ ID NO: 1211932 - RNA, 15 nt, Homo sapiens
gccugcaaaccuucc

SEQ ID NO: 1211933 - RNA, 11 nt, Homo sapiens
gccugcacugg

SEQ ID NO: 1211934 - RNA, 17 nt, Homo sapiens
gccugcaggacuuugcg

SEQ ID NO: 1211935 - RNA, 17 nt, Homo sapiens
gccugcagucuucuggg

SEQ ID NO: 1211936 - RNA, 16 nt, Homo sapiens
gccugcaucugugaaa

SEQ ID NO: 1211937 - RNA, 23 nt, Homo sapiens
gccugcccuccccagagcacugg

SEQ ID NO: 1211938 - RNA, 13 nt, Homo sapiens
gccugccuugaag

SEQ ID NO: 1211939 - RNA, 13 nt, Homo sapiens
gccugcuccucac

SEQ ID NO: 1211940 - RNA, 15 nt, Homo sapiens
gccuggacaguaucc

SEQ ID NO: 1211941 - RNA, 16 nt, Homo sapiens
gccuggacuuuccugc

SEQ ID NO: 1211942 - RNA, 17 nt, Homo sapiens
gccuggacuuuccugca

SEQ ID NO: 1211943 - RNA, 23 nt, Homo sapiens
gccuggaucuccccacucuaggg

SEQ ID NO: 1211944 - RNA, 19 nt, Homo sapiens
gccuggcaagugggugaaa

SEQ ID NO: 1211945 - RNA, 15 nt, Homo sapiens
gccuggcacauuuca

SEQ ID NO: 1211946 - RNA, 19 nt, Homo sapiens
gccuggcacauuucaggga

SEQ ID NO: 1211947 - RNA, 18 nt, Homo sapiens
gccuggcaggccaguguc

SEQ ID NO: 1211948 - RNA, 21 nt, Homo sapiens
gccuggcaggccagugucugg

SEQ ID NO: 1211949 - RNA, 20 nt, Homo sapiens
gccuggccaggagcucuuca

SEQ ID NO: 1211950 - RNA, 23 nt, Homo sapiens
gccuggcccauagaaacaugaca

SEQ ID NO: 1211951 - RNA, 20 nt, Homo sapiens
gccuggcuaacauggugaaa

SEQ ID NO: 1211952 - RNA, 16 nt, Homo sapiens
gccuggcuccccacga

SEQ ID NO: 1211953 - RNA, 21 nt, Homo sapiens
gccuggcuccccacgagucac

SEQ ID NO: 1211954 - RNA, 14 nt, Homo sapiens
gccugggacccagc

SEQ ID NO: 1211955 - RNA, 21 nt, Homo sapiens
gccugggaccucccacugccc

SEQ ID NO: 1211956 - RNA, 17 nt, Homo sapiens
gccugggaccugaaccu

SEQ ID NO: 1211957 - RNA, 21 nt, Homo sapiens
gccugggcuguuggcacucac

SEQ ID NO: 1211958 - RNA, 20 nt, Homo sapiens
gccuggggcagaaagccaca

SEQ ID NO: 1211959 - RNA, 21 nt, Homo sapiens
gccuggggcgagcacugugag

SEQ ID NO: 1211960 - RNA, 18 nt, Homo sapiens
gccugggggcagccucuc

SEQ ID NO: 1211961 - RNA, 13 nt, Homo sapiens
gccuggguuugua

SEQ ID NO: 1211962 - RNA, 12 nt, Homo sapiens
gccuggugguca

SEQ ID NO: 1211963 - RNA, 22 nt, Homo sapiens
gccuguaaucccaacacuuugg

SEQ ID NO: 1211964 - RNA, 21 nt, Homo sapiens
gccuguaaucucagcacuuug

SEQ ID NO: 1211965 - RNA, 21 nt, Homo sapiens
gccugucccauggacacucca

SEQ ID NO: 1211966 - RNA, 12 nt, Homo sapiens
gccugugcaaug

SEQ ID NO: 1211967 - RNA, 20 nt, Homo sapiens
gccugugcauguaugucuug

SEQ ID NO: 1211968 - RNA, 20 nt, Homo sapiens
gccuguggaaugagugugca

SEQ ID NO: 1211969 - RNA, 11 nt, Homo sapiens
gccuguggcau

SEQ ID NO: 1211970 - RNA, 19 nt, Homo sapiens
gccugugguuacagugcag

SEQ ID NO: 1211971 - RNA, 14 nt, Homo sapiens
gccuguuccaugaa

SEQ ID NO: 1211972 - RNA, 17 nt, Homo sapiens
gccuuaaacacucaccu

SEQ ID NO: 1211973 - RNA, 18 nt, Homo sapiens
gccuuaaugacauucccc

SEQ ID NO: 1211974 - RNA, 15 nt, Homo sapiens
gccuuacacugaaaa

SEQ ID NO: 1211975 - RNA, 22 nt, Homo sapiens
gccuuagaaauguaaacugcca

SEQ ID NO: 1211976 - RNA, 23 nt, Homo sapiens
gccuuagaaauguaaacugccau

SEQ ID NO: 1211977 - RNA, 16 nt, Homo sapiens
gccuuagggcacuggg

SEQ ID NO: 1211978 - RNA, 17 nt, Homo sapiens
gccuuagggugcugagu

SEQ ID NO: 1211979 - RNA, 12 nt, Homo sapiens
gccuuagugggc

SEQ ID NO: 1211980 - RNA, 17 nt, Homo sapiens
gccuucaagugccaaac

SEQ ID NO: 1211981 - RNA, 15 nt, Homo sapiens
gccuucacuuuacaa

SEQ ID NO: 1211982 - RNA, 17 nt, Homo sapiens
gccuucagaaugcuccu

SEQ ID NO: 1211983 - RNA, 17 nt, Homo sapiens
gccuucagcaugccuga

SEQ ID NO: 1211984 - RNA, 14 nt, Homo sapiens
gccuucauaagccu

SEQ ID NO: 1211985 - RNA, 12 nt, Homo sapiens
gccuuccagguc

SEQ ID NO: 1211986 - RNA, 14 nt, Homo sapiens
gccuucccaaaaca

SEQ ID NO: 1211987 - RNA, 21 nt, Homo sapiens
gccuucccaaguugugcuuga

SEQ ID NO: 1211988 - RNA, 16 nt, Homo sapiens
gccuucccaugaaucu

SEQ ID NO: 1211989 - RNA, 16 nt, Homo sapiens
gccuucuccacuuugg

SEQ ID NO: 1211990 - RNA, 22 nt, Homo sapiens
gccuucugacggcccugcaaug

SEQ ID NO: 1211991 - RNA, 18 nt, Homo sapiens
gccuucuuauugcuuuua

SEQ ID NO: 1211992 - RNA, 18 nt, Homo sapiens
gccuugaaacaguuccau

SEQ ID NO: 1211993 - RNA, 22 nt, Homo sapiens
gccuugacaucaguuccuuugu

SEQ ID NO: 1211994 - RNA, 18 nt, Homo sapiens
gccuugaugccauaugcc

SEQ ID NO: 1211995 - RNA, 19 nt, Homo sapiens
gccuugaugccauaugccu

SEQ ID NO: 1211996 - RNA, 12 nt, Homo sapiens
gccuugcugcag

SEQ ID NO: 1211997 - RNA, 18 nt, Homo sapiens
gccuuggggaggacaaaa

SEQ ID NO: 1211998 - RNA, 20 nt, Homo sapiens
gccuugugugaacucaccaa

SEQ ID NO: 1211999 - RNA, 18 nt, Homo sapiens
gccuuuaaaucugugaug

SEQ ID NO: 1212000 - RNA, 16 nt, Homo sapiens
gccuuuaagccaaaga

SEQ ID NO: 1212001 - RNA, 15 nt, Homo sapiens
gccuuuaucucugag

SEQ ID NO: 1212002 - RNA, 15 nt, Homo sapiens
gccuuugacauuuaa

SEQ ID NO: 1212003 - RNA, 21 nt, Homo sapiens
gccuuugcuucuugcacccag

SEQ ID NO: 1212004 - RNA, 15 nt, Homo sapiens
gccuuuguuucccau

SEQ ID NO: 1212005 - RNA, 20 nt, Homo sapiens
gccuuuuauaugggucuuca

SEQ ID NO: 1212006 - RNA, 19 nt, Homo sapiens
gccuuuugugcaaagccaa

SEQ ID NO: 1212007 - RNA, 14 nt, Homo sapiens
gccuuuuuugccag

SEQ ID NO: 1212008 - RNA, 13 nt, Homo sapiens
gcgaauaacaguc

SEQ ID NO: 1212009 - RNA, 19 nt, Homo sapiens
gcgagacuccgucucaaaa

SEQ ID NO: 1212010 - RNA, 16 nt, Homo sapiens
gcgagagaaagggagu

SEQ ID NO: 1212011 - RNA, 20 nt, Homo sapiens
gcgagagguggagugucaca

SEQ ID NO: 1212012 - RNA, 15 nt, Homo sapiens
gcgagaugagcccac

SEQ ID NO: 1212013 - RNA, 20 nt, Homo sapiens
gcgagcacugugagcaccug

SEQ ID NO: 1212014 - RNA, 21 nt, Homo sapiens
gcgagcacugugagcaccuga

SEQ ID NO: 1212015 - RNA, 20 nt, Homo sapiens
gcgagcccugguggcagugg

SEQ ID NO: 1212016 - RNA, 18 nt, Homo sapiens
gcgaugaggggacauuuu

SEQ ID NO: 1212017 - RNA, 20 nt, Homo sapiens
gcgcaauugcucaugcauag

SEQ ID NO: 1212018 - RNA, 12 nt, Homo sapiens
gcgcaccuguag

SEQ ID NO: 1212019 - RNA, 16 nt, Homo sapiens
gcgcaggcccagugac

SEQ ID NO: 1212020 - RNA, 15 nt, Homo sapiens
gcgcccgccccugca

SEQ ID NO: 1212021 - RNA, 16 nt, Homo sapiens
gcgccgugaguucuca

SEQ ID NO: 1212022 - RNA, 17 nt, Homo sapiens
gcgccuccuuccuugcu

SEQ ID NO: 1212023 - RNA, 21 nt, Homo sapiens
gcgccugccaucaugccugac

SEQ ID NO: 1212024 - RNA, 18 nt, Homo sapiens
gcgccuugccuccucacc

SEQ ID NO: 1212025 - RNA, 20 nt, Homo sapiens
gcgcgugaguggucuucaaa

SEQ ID NO: 1212026 - RNA, 19 nt, Homo sapiens
gcgcucggcuccaccccag

SEQ ID NO: 1212027 - RNA, 19 nt, Homo sapiens
gcgcuuuugucugcaaugg

SEQ ID NO: 1212028 - RNA, 19 nt, Homo sapiens
gcggcaaaauuaccucucu

SEQ ID NO: 1212029 - RNA, 13 nt, Homo sapiens
gcggcagggccag

SEQ ID NO: 1212030 - RNA, 21 nt, Homo sapiens
gcggccucgugccaugaucug

SEQ ID NO: 1212031 - RNA, 13 nt, Homo sapiens
gcggccucuugcu

SEQ ID NO: 1212032 - RNA, 17 nt, Homo sapiens
gcggcuggaaucaguca

SEQ ID NO: 1212033 - RNA, 17 nt, Homo sapiens
gcguaaacgacacucuc

SEQ ID NO: 1212034 - RNA, 16 nt, Homo sapiens
gcgucacggccaagug

SEQ ID NO: 1212035 - RNA, 23 nt, Homo sapiens
gcguccucguucaaaacauucca

SEQ ID NO: 1212036 - RNA, 14 nt, Homo sapiens
gcgucuaugcugcu

SEQ ID NO: 1212037 - RNA, 20 nt, Homo sapiens
gcgugcgccacuaugccuga

SEQ ID NO: 1212038 - RNA, 21 nt, Homo sapiens
gcgugcugguccccuccucag

SEQ ID NO: 1212039 - RNA, 21 nt, Homo sapiens
gcguggagacuggcaggcggg

SEQ ID NO: 1212040 - RNA, 17 nt, Homo sapiens
gcguggauucaugggga

SEQ ID NO: 1212041 - RNA, 23 nt, Homo sapiens
gcguggugcucuuugcugcacua

SEQ ID NO: 1212042 - RNA, 20 nt, Homo sapiens
gcguguaccucacuuuacau

SEQ ID NO: 1212043 - RNA, 19 nt, Homo sapiens
gcguguguagaguuaagaa

SEQ ID NO: 1212044 - RNA, 22 nt, Homo sapiens
gcguguuucugacucugagcua

SEQ ID NO: 1212045 - RNA, 16 nt, Homo sapiens
gcguuaaauaagcaaa

SEQ ID NO: 1212046 - RNA, 12 nt, Homo sapiens
gcguuacugcuu

SEQ ID NO: 1212047 - RNA, 22 nt, Homo sapiens
gcguucacuccaaugucugcug

SEQ ID NO: 1212048 - RNA, 16 nt, Homo sapiens
gcuaaacugaugacuu

SEQ ID NO: 1212049 - RNA, 13 nt, Homo sapiens
gcuaaagccagga

SEQ ID NO: 1212050 - RNA, 16 nt, Homo sapiens
gcuaaaggaagugaau

SEQ ID NO: 1212051 - RNA, 18 nt, Homo sapiens
gcuaaaggaagugaaucu

SEQ ID NO: 1212052 - RNA, 20 nt, Homo sapiens
gcuaaauauaaaaacauaaa

SEQ ID NO: 1212053 - RNA, 22 nt, Homo sapiens
gcuaaauccucauguuacucag

SEQ ID NO: 1212054 - RNA, 16 nt, Homo sapiens
gcuaaauucuauguua

SEQ ID NO: 1212055 - RNA, 17 nt, Homo sapiens
gcuaagauaccaaaacc

SEQ ID NO: 1212056 - RNA, 23 nt, Homo sapiens
gcuaaggaugguuuuaucuuccc

SEQ ID NO: 1212057 - RNA, 19 nt, Homo sapiens
gcuaauaaacuguauuaaa

SEQ ID NO: 1212058 - RNA, 13 nt, Homo sapiens
gcuaaucuugucc

SEQ ID NO: 1212059 - RNA, 21 nt, Homo sapiens
gcuaauguaauaacugugaag

SEQ ID NO: 1212060 - RNA, 15 nt, Homo sapiens
gcuaauuucuggccc

SEQ ID NO: 1212061 - RNA, 21 nt, Homo sapiens
gcuacaaauuuaugcauuuca

SEQ ID NO: 1212062 - RNA, 17 nt, Homo sapiens
gcuacagcuuucuugcu

SEQ ID NO: 1212063 - RNA, 23 nt, Homo sapiens
gcuacaguuauuaaucuggacau

SEQ ID NO: 1212064 - RNA, 16 nt, Homo sapiens
gcuacccuagaugaau

SEQ ID NO: 1212065 - RNA, 19 nt, Homo sapiens
gcuacccugaguucaucca

SEQ ID NO: 1212066 - RNA, 10 nt, Homo sapiens
gcuaccuccc

SEQ ID NO: 1212067 - RNA, 14 nt, Homo sapiens
gcuacgaccugguc

SEQ ID NO: 1212068 - RNA, 16 nt, Homo sapiens
gcuacuccauccugaa

SEQ ID NO: 1212069 - RNA, 22 nt, Homo sapiens
gcuacugacuauggcuaccaaa

SEQ ID NO: 1212070 - RNA, 18 nt, Homo sapiens
gcuacuguaauuuuauau

SEQ ID NO: 1212071 - RNA, 17 nt, Homo sapiens
gcuacugucucacugaa

SEQ ID NO: 1212072 - RNA, 15 nt, Homo sapiens
gcuacuucugaaacu

SEQ ID NO: 1212073 - RNA, 20 nt, Homo sapiens
gcuagaaggcaaagugcaca

SEQ ID NO: 1212074 - RNA, 18 nt, Homo sapiens
gcuagaggacuucuggca

SEQ ID NO: 1212075 - RNA, 15 nt, Homo sapiens
gcuagaguaggugca

SEQ ID NO: 1212076 - RNA, 14 nt, Homo sapiens
gcuagaguccucac

SEQ ID NO: 1212077 - RNA, 15 nt, Homo sapiens
gcuagcaguacuaau

SEQ ID NO: 1212078 - RNA, 19 nt, Homo sapiens
gcuaggaugguucugugac

SEQ ID NO: 1212079 - RNA, 15 nt, Homo sapiens
gcuagggaaagggau

SEQ ID NO: 1212080 - RNA, 16 nt, Homo sapiens
gcuagguaucauucaa

SEQ ID NO: 1212081 - RNA, 15 nt, Homo sapiens
gcuaguaaaagccau

SEQ ID NO: 1212082 - RNA, 13 nt, Homo sapiens
ccuuccuuaccug

SEQ ID NO: 1212083 - RNA, 20 nt, Homo sapiens
ccuuccuucuugcuucucau

SEQ ID NO: 1212084 - RNA, 13 nt, Homo sapiens
ccuucggcagcua

SEQ ID NO: 1212085 - RNA, 18 nt, Homo sapiens
ccuucggcuccgggcaaa

SEQ ID NO: 1212086 - RNA, 15 nt, Homo sapiens
ccuucuacauuugag

SEQ ID NO: 1212087 - RNA, 15 nt, Homo sapiens
ccuucuaggucacuu

SEQ ID NO: 1212088 - RNA, 23 nt, Homo sapiens
ccuucucugaacacaggcagcuu

SEQ ID NO: 1212089 - RNA, 20 nt, Homo sapiens
ccuucucugcuccaccacau

SEQ ID NO: 1212090 - RNA, 17 nt, Homo sapiens
ccuucugaggagaggca

SEQ ID NO: 1212091 - RNA, 14 nt, Homo sapiens
cuggagccuuugaa

SEQ ID NO: 1212092 - RNA, 17 nt, Homo sapiens
cuggagcucaucugcaa

SEQ ID NO: 1212093 - RNA, 20 nt, Homo sapiens
cuggaggccggaaucucagc

SEQ ID NO: 1212094 - RNA, 21 nt, Homo sapiens
cuggagggaggcugggcgggu

SEQ ID NO: 1212095 - RNA, 20 nt, Homo sapiens
cuggagggaggggugagaua

SEQ ID NO: 1212096 - RNA, 18 nt, Homo sapiens
cuggaguccacacuugaa

SEQ ID NO: 1212097 - RNA, 17 nt, Homo sapiens
cuggagucuggcuuuac

SEQ ID NO: 1212098 - RNA, 18 nt, Homo sapiens
cuggagucuggcuuuacc

SEQ ID NO: 1212099 - RNA, 19 nt, Homo sapiens
cuggagugcaguggcgcau

SEQ ID NO: 1212100 - RNA, 20 nt, Homo sapiens
cuggagugcaguggcgugau

SEQ ID NO: 1212101 - RNA, 21 nt, Homo sapiens
cuggagugcaguggugcaauc

SEQ ID NO: 1212102 - RNA, 22 nt, Homo sapiens
cuggagugguaacagcucucuu

SEQ ID NO: 1212103 - RNA, 14 nt, Homo sapiens
cuggaguuggcaau

SEQ ID NO: 1212104 - RNA, 21 nt, Homo sapiens
cuggaguuucauguacaagau

SEQ ID NO: 1212105 - RNA, 14 nt, Homo sapiens
cuggauauaaugua

SEQ ID NO: 1212106 - RNA, 18 nt, Homo sapiens
cuggauauuugcacuuau

SEQ ID NO: 1212107 - RNA, 18 nt, Homo sapiens
cuggaucacgacgcugca

SEQ ID NO: 1212108 - RNA, 19 nt, Homo sapiens
cuggauccagcacugguga

SEQ ID NO: 1212109 - RNA, 13 nt, Homo sapiens
cuggauccaucag

SEQ ID NO: 1212110 - RNA, 18 nt, Homo sapiens
cuggauggagcccaggcg

SEQ ID NO: 1212111 - RNA, 22 nt, Homo sapiens
cuggauguacuauccaaucugu

SEQ ID NO: 1212112 - RNA, 19 nt, Homo sapiens
cuggaugucugggugaccu

SEQ ID NO: 1212113 - RNA, 18 nt, Homo sapiens
cuggauugcagacuguuc

SEQ ID NO: 1212114 - RNA, 14 nt, Homo sapiens
cuggauugggagac

SEQ ID NO: 1212115 - RNA, 22 nt, Homo sapiens
cuggauuguguuugugccauau

SEQ ID NO: 1212116 - RNA, 17 nt, Homo sapiens
cuggauuucauacugua

SEQ ID NO: 1212117 - RNA, 22 nt, Homo sapiens
cuggcaacaaaaaguaaugaag

SEQ ID NO: 1212118 - RNA, 16 nt, Homo sapiens
cuggcaagaugcuuua

SEQ ID NO: 1212119 - RNA, 19 nt, Homo sapiens
cuggcaagccugucuucag

SEQ ID NO: 1212120 - RNA, 21 nt, Homo sapiens
cuggcaagucuuccaugaccc

SEQ ID NO: 1212121 - RNA, 21 nt, Homo sapiens
cuggcaauacgacgugggaau

SEQ ID NO: 1212122 - RNA, 13 nt, Homo sapiens
cuggcaaucaaua

SEQ ID NO: 1212123 - RNA, 22 nt, Homo sapiens
cuggcacugaauuaaucaucua

SEQ ID NO: 1212124 - RNA, 20 nt, Homo sapiens
cuggcacuguggagaccaca

SEQ ID NO: 1212125 - RNA, 20 nt, Homo sapiens
cuggcacuuagcccaagagg

SEQ ID NO: 1212126 - RNA, 15 nt, Homo sapiens
cuggcagacugagga

SEQ ID NO: 1212127 - RNA, 15 nt, Homo sapiens
cuggcaggaugcuga

SEQ ID NO: 1212128 - RNA, 21 nt, Homo sapiens
cuggcaguaaccuagugaauu

SEQ ID NO: 1212129 - RNA, 22 nt, Homo sapiens
cuggcaguaaccuagugaauuu

SEQ ID NO: 1212130 - RNA, 12 nt, Homo sapiens
cuggcaguacug

SEQ ID NO: 1212131 - RNA, 15 nt, Homo sapiens
cuggcaucucacuuu

SEQ ID NO: 1212132 - RNA, 17 nt, Homo sapiens
cuggcaucucacuuuau

SEQ ID NO: 1212133 - RNA, 15 nt, Homo sapiens
cuggcauugaaaugc

SEQ ID NO: 1212134 - RNA, 20 nt, Homo sapiens
cuggccaagcgagagcagcu

SEQ ID NO: 1212135 - RNA, 16 nt, Homo sapiens
cuggccaccugaggug

SEQ ID NO: 1212136 - RNA, 12 nt, Homo sapiens
cuggccagagag

SEQ ID NO: 1212137 - RNA, 19 nt, Homo sapiens
cuggccagaugcaccagcc

SEQ ID NO: 1212138 - RNA, 23 nt, Homo sapiens
cuggccaggauaauauauuugca

SEQ ID NO: 1212139 - RNA, 22 nt, Homo sapiens
cuggcccaagugguuugugcua

SEQ ID NO: 1212140 - RNA, 16 nt, Homo sapiens
cuggcccagaugauau

SEQ ID NO: 1212141 - RNA, 18 nt, Homo sapiens
cuggcccagaugauauaa

SEQ ID NO: 1212142 - RNA, 21 nt, Homo sapiens
cuggcccccucccuggaugac

SEQ ID NO: 1212143 - RNA, 17 nt, Homo sapiens
cuggccccggccuuuau

SEQ ID NO: 1212144 - RNA, 20 nt, Homo sapiens
cuggcccucgccagcugcca

SEQ ID NO: 1212145 - RNA, 14 nt, Homo sapiens
cuggcccugaggug

SEQ ID NO: 1212146 - RNA, 19 nt, Homo sapiens
cuggcccugcccugaggaa

SEQ ID NO: 1212147 - RNA, 22 nt, Homo sapiens
cuggccgccacccccaucuucc

SEQ ID NO: 1212148 - RNA, 13 nt, Homo sapiens
cuggccgccuagg

SEQ ID NO: 1212149 - RNA, 19 nt, Homo sapiens
cuggccgcuccucccucag

SEQ ID NO: 1212150 - RNA, 21 nt, Homo sapiens
cuggccgggggaggugggugu

SEQ ID NO: 1212151 - RNA, 22 nt, Homo sapiens
cuggccucagccgacugcacag

SEQ ID NO: 1212152 - RNA, 22 nt, Homo sapiens
cuggccucccacccgaugcugc

SEQ ID NO: 1212153 - RNA, 19 nt, Homo sapiens
cuggccuccuaugccucau

SEQ ID NO: 1212154 - RNA, 17 nt, Homo sapiens
cuggccugaacugagga

SEQ ID NO: 1212155 - RNA, 20 nt, Homo sapiens
cuggccuggcaguugaacag

SEQ ID NO: 1212156 - RNA, 17 nt, Homo sapiens
cuggcgcauauuaagca

SEQ ID NO: 1212157 - RNA, 17 nt, Homo sapiens
cuggcgccccuuccuag

SEQ ID NO: 1212158 - RNA, 20 nt, Homo sapiens
cuggcgugcaguggugcgau

SEQ ID NO: 1212159 - RNA, 23 nt, Homo sapiens
cuggcuaaagauaauugcuauuu

SEQ ID NO: 1212160 - RNA, 12 nt, Homo sapiens
cuggcucugaga

SEQ ID NO: 1212161 - RNA, 23 nt, Homo sapiens
cuggcugcaaaggguaucaggug

SEQ ID NO: 1212162 - RNA, 13 nt, Homo sapiens
cuggcugcaguga

SEQ ID NO: 1212163 - RNA, 12 nt, Homo sapiens
cuggcugccagg

SEQ ID NO: 1212164 - RNA, 13 nt, Homo sapiens
cuggcugggcaug

SEQ ID NO: 1212165 - RNA, 17 nt, Homo sapiens
cuggcugucugccugua

SEQ ID NO: 1212166 - RNA, 20 nt, Homo sapiens
cuggcuuauuuuaaugugau

SEQ ID NO: 1212167 - RNA, 23 nt, Homo sapiens
cugggaaaaaaguuuugaugaaa

SEQ ID NO: 1212168 - RNA, 21 nt, Homo sapiens
cugggaaaggaaagaagaaau

SEQ ID NO: 1212169 - RNA, 22 nt, Homo sapiens
cugggaagcuugagccuccccc

SEQ ID NO: 1212170 - RNA, 18 nt, Homo sapiens
cugggaccucccacugcc

SEQ ID NO: 1212171 - RNA, 20 nt, Homo sapiens
cugggaccucccacugcccc

SEQ ID NO: 1212172 - RNA, 16 nt, Homo sapiens
cugggagaaccucagg

SEQ ID NO: 1212173 - RNA, 22 nt, Homo sapiens
cugggagacuuugaagaccagu

SEQ ID NO: 1212174 - RNA, 21 nt, Homo sapiens
cugggaguguccuuaguguau

SEQ ID NO: 1212175 - RNA, 19 nt, Homo sapiens
cugggaucucaaccccagc

SEQ ID NO: 1212176 - RNA, 14 nt, Homo sapiens
cugggaucugagua

SEQ ID NO: 1212177 - RNA, 15 nt, Homo sapiens
gcccaagaggacuga

SEQ ID NO: 1212178 - RNA, 16 nt, Homo sapiens
gcccaagaggacugag

SEQ ID NO: 1212179 - RNA, 18 nt, Homo sapiens
gcccaagaggacugagac

SEQ ID NO: 1212180 - RNA, 15 nt, Homo sapiens
gcccaauguaaugca

SEQ ID NO: 1212181 - RNA, 17 nt, Homo sapiens
gcccacaccgcagggac

SEQ ID NO: 1212182 - RNA, 22 nt, Homo sapiens
gcccacucuguaauaguucagu

SEQ ID NO: 1212183 - RNA, 21 nt, Homo sapiens
gcccacugcccaaugccugcu

SEQ ID NO: 1212184 - RNA, 21 nt, Homo sapiens
gcccacugcugcaguagggga

SEQ ID NO: 1212185 - RNA, 16 nt, Homo sapiens
gcccacuucugccaua

SEQ ID NO: 1212186 - RNA, 21 nt, Homo sapiens
gcccagacacagacuggcaau

SEQ ID NO: 1212187 - RNA, 15 nt, Homo sapiens
gcccagacccagugg

SEQ ID NO: 1212188 - RNA, 22 nt, Homo sapiens
gcccagacgcagcugagucgga

SEQ ID NO: 1212189 - RNA, 19 nt, Homo sapiens
gcccagacuuuagugcccu

SEQ ID NO: 1212190 - RNA, 16 nt, Homo sapiens
gcccagagcacuuuag

SEQ ID NO: 1212191 - RNA, 21 nt, Homo sapiens
gcccagagcaggaagcauuca

SEQ ID NO: 1212192 - RNA, 15 nt, Homo sapiens
gcccagagccuggcu

SEQ ID NO: 1212193 - RNA, 16 nt, Homo sapiens
gcccagaggguggcaa

SEQ ID NO: 1212194 - RNA, 22 nt, Homo sapiens
gcccagccaggccaacagcacc

SEQ ID NO: 1212195 - RNA, 22 nt, Homo sapiens
gcccagccccuagaaacccaag

SEQ ID NO: 1212196 - RNA, 21 nt, Homo sapiens
gcccagccuccaagcuccauc

SEQ ID NO: 1212197 - RNA, 13 nt, Homo sapiens
gcccagccuggga

SEQ ID NO: 1212198 - RNA, 14 nt, Homo sapiens
gcccagcugcaccu

SEQ ID NO: 1212199 - RNA, 23 nt, Homo sapiens
gcccagcuuuuagaaaaugcagu

SEQ ID NO: 1212200 - RNA, 21 nt, Homo sapiens
gcccaggaucguuuuuuccca

SEQ ID NO: 1212201 - RNA, 17 nt, Homo sapiens
gcccaggauuauuguca

SEQ ID NO: 1212202 - RNA, 16 nt, Homo sapiens
gcccaggccuaccuca

SEQ ID NO: 1212203 - RNA, 17 nt, Homo sapiens
gcccaggccugccuguu

SEQ ID NO: 1212204 - RNA, 20 nt, Homo sapiens
gcccaggcuggagugcaaug

SEQ ID NO: 1212205 - RNA, 20 nt, Homo sapiens
gcccaggcuggagugcagug

SEQ ID NO: 1212206 - RNA, 20 nt, Homo sapiens
gcccaggcugggaacucauc

SEQ ID NO: 1212207 - RNA, 17 nt, Homo sapiens
gcccagggccaccucuu

SEQ ID NO: 1212208 - RNA, 17 nt, Homo sapiens
gcccagguuacaaagac

SEQ ID NO: 1212209 - RNA, 15 nt, Homo sapiens
gcccaguacauuuaa

SEQ ID NO: 1212210 - RNA, 18 nt, Homo sapiens
gcccaguuggguggaugc

SEQ ID NO: 1212211 - RNA, 14 nt, Homo sapiens
gcccauaucuguga

SEQ ID NO: 1212212 - RNA, 18 nt, Homo sapiens
gcccauaucugugaaaug

SEQ ID NO: 1212213 - RNA, 13 nt, Homo sapiens
gcccaucaacugu

SEQ ID NO: 1212214 - RNA, 14 nt, Homo sapiens
gcccauccagucuc

SEQ ID NO: 1212215 - RNA, 22 nt, Homo sapiens
gcccauggcuuuagcuaccuca

SEQ ID NO: 1212216 - RNA, 18 nt, Homo sapiens
gcccaugggauauguggu

SEQ ID NO: 1212217 - RNA, 11 nt, Homo sapiens
gcccauugcac

SEQ ID NO: 1212218 - RNA, 12 nt, Homo sapiens
gcccauugcacu

SEQ ID NO: 1212219 - RNA, 16 nt, Homo sapiens
gcccauuuacacuuuu

SEQ ID NO: 1212220 - RNA, 23 nt, Homo sapiens
gccccacccaccccacagacucc

SEQ ID NO: 1212221 - RNA, 16 nt, Homo sapiens
gccccagcccaagucc

SEQ ID NO: 1212222 - RNA, 15 nt, Homo sapiens
gccccagcuggagaa

SEQ ID NO: 1212223 - RNA, 16 nt, Homo sapiens
gccccagucggcccca

SEQ ID NO: 1212224 - RNA, 20 nt, Homo sapiens
gccccauccaacacuggaug

SEQ ID NO: 1212225 - RNA, 21 nt, Homo sapiens
gcccccagaggcucagcacuu

SEQ ID NO: 1212226 - RNA, 22 nt, Homo sapiens
gccccccagccuucacugacag

SEQ ID NO: 1212227 - RNA, 22 nt, Homo sapiens
gcccccuccaggagagagccag

SEQ ID NO: 1212228 - RNA, 21 nt, Homo sapiens
gcccccucccuggaugacauu

SEQ ID NO: 1212229 - RNA, 14 nt, Homo sapiens
gccccgccacagcc

SEQ ID NO: 1212230 - RNA, 14 nt, Homo sapiens
gccccucucaccaa

SEQ ID NO: 1212231 - RNA, 17 nt, Homo sapiens
gccccucugaccugcac

SEQ ID NO: 1212232 - RNA, 19 nt, Homo sapiens
gccccucugaccugcacug

SEQ ID NO: 1212233 - RNA, 22 nt, Homo sapiens
gccccucuuccccaaugcucca

SEQ ID NO: 1212234 - RNA, 16 nt, Homo sapiens
gccccugcacaaagcc

SEQ ID NO: 1212235 - RNA, 17 nt, Homo sapiens
ccuucuggcaagccugu

SEQ ID NO: 1212236 - RNA, 16 nt, Homo sapiens
ccuucuugucauugaa

SEQ ID NO: 1212237 - RNA, 11 nt, Homo sapiens
ccuugagaaac

SEQ ID NO: 1212238 - RNA, 15 nt, Homo sapiens
ccuugagucagaaaa

SEQ ID NO: 1212239 - RNA, 23 nt, Homo sapiens
ccuugcaagguuaagcaaggugg

SEQ ID NO: 1212240 - RNA, 13 nt, Homo sapiens
ccuugccaucaca

SEQ ID NO: 1212241 - RNA, 19 nt, Homo sapiens
ccuugccucaaugccagua

SEQ ID NO: 1212242 - RNA, 11 nt, Homo sapiens
ccuugcucccc

SEQ ID NO: 1212243 - RNA, 17 nt, Homo sapiens
ccuugcugcugcugcac

SEQ ID NO: 1212244 - RNA, 15 nt, Homo sapiens
ccuuggaaggugaca

SEQ ID NO: 1212245 - RNA, 22 nt, Homo sapiens
ccuuggaggcccugcacugcca

SEQ ID NO: 1212246 - RNA, 21 nt, Homo sapiens
ccuuggcuaguaaaagccauc

SEQ ID NO: 1212247 - RNA, 16 nt, Homo sapiens
ccuugggcaguucuca

SEQ ID NO: 1212248 - RNA, 16 nt, Homo sapiens
ccuugggcugcuccuc

SEQ ID NO: 1212249 - RNA, 12 nt, Homo sapiens
ccuuggggccug

SEQ ID NO: 1212250 - RNA, 17 nt, Homo sapiens
ccuuguaaccagugcag

SEQ ID NO: 1212251 - RNA, 13 nt, Homo sapiens
ccuuguacucuua

SEQ ID NO: 1212252 - RNA, 14 nt, Homo sapiens
ccuuguacucuuag

SEQ ID NO: 1212253 - RNA, 20 nt, Homo sapiens
ccuugucccccgugaucucc

SEQ ID NO: 1212254 - RNA, 22 nt, Homo sapiens
ccuuguccugaugcugugcuca

SEQ ID NO: 1212255 - RNA, 12 nt, Homo sapiens
ccuugucugcac

SEQ ID NO: 1212256 - RNA, 18 nt, Homo sapiens
ccuugucugucucagcuc

SEQ ID NO: 1212257 - RNA, 13 nt, Homo sapiens
ccuugugccuugg

SEQ ID NO: 1212258 - RNA, 16 nt, Homo sapiens
ccuuguggcaucguca

SEQ ID NO: 1212259 - RNA, 15 nt, Homo sapiens
ccuugugucucauau

SEQ ID NO: 1212260 - RNA, 14 nt, Homo sapiens
ccuugugucuguac

SEQ ID NO: 1212261 - RNA, 14 nt, Homo sapiens
ccuuguuucuacug

SEQ ID NO: 1212262 - RNA, 20 nt, Homo sapiens
ccuuuaaaaaugcaccacuu

SEQ ID NO: 1212263 - RNA, 17 nt, Homo sapiens
ccuuuaaaucugugaug

SEQ ID NO: 1212264 - RNA, 22 nt, Homo sapiens
ccuuuaacuuucagaggcaaua

SEQ ID NO: 1212265 - RNA, 15 nt, Homo sapiens
ccuuuaagaaccuua

SEQ ID NO: 1212266 - RNA, 16 nt, Homo sapiens
ccuuuacaaugugaau

SEQ ID NO: 1212267 - RNA, 16 nt, Homo sapiens
ccuuuacuaucauucu

SEQ ID NO: 1212268 - RNA, 18 nt, Homo sapiens
ccuuuagaguugcaugac

SEQ ID NO: 1212269 - RNA, 17 nt, Homo sapiens
ccuuuaguaccugaaaa

SEQ ID NO: 1212270 - RNA, 21 nt, Homo sapiens
ccuuuaucaaaaaaagacuca

SEQ ID NO: 1212271 - RNA, 17 nt, Homo sapiens
ccuuucacuaaaacaca

SEQ ID NO: 1212272 - RNA, 19 nt, Homo sapiens
ccuuucauggucugcugag

SEQ ID NO: 1212273 - RNA, 22 nt, Homo sapiens
ccuuuccaagcuccucgugaua

SEQ ID NO: 1212274 - RNA, 13 nt, Homo sapiens
ccuuuccauuuau

SEQ ID NO: 1212275 - RNA, 16 nt, Homo sapiens
ccuuucccaccauucc

SEQ ID NO: 1212276 - RNA, 20 nt, Homo sapiens
ccuuuccccaccucuuacag

SEQ ID NO: 1212277 - RNA, 16 nt, Homo sapiens
ccuuuccccucucugc

SEQ ID NO: 1212278 - RNA, 20 nt, Homo sapiens
ccuuuccggcacacugccaa

SEQ ID NO: 1212279 - RNA, 21 nt, Homo sapiens
ccuuuccggcacacugccaaa

SEQ ID NO: 1212280 - RNA, 18 nt, Homo sapiens
ccuuuccuuuucuuuaaa

SEQ ID NO: 1212281 - RNA, 17 nt, Homo sapiens
ccuuucgagcucugcag

SEQ ID NO: 1212282 - RNA, 18 nt, Homo sapiens
ccuuucuaaauugcauga

SEQ ID NO: 1212283 - RNA, 14 nt, Homo sapiens
ccuuucuccuguga

SEQ ID NO: 1212284 - RNA, 19 nt, Homo sapiens
ccuuucuugagggaguuca

SEQ ID NO: 1212285 - RNA, 21 nt, Homo sapiens
ccuuugagcccacaaagccuu

SEQ ID NO: 1212286 - RNA, 16 nt, Homo sapiens
ccuuugaucaguauaa

SEQ ID NO: 1212287 - RNA, 13 nt, Homo sapiens
ccuuugcaaauca

SEQ ID NO: 1212288 - RNA, 15 nt, Homo sapiens
ccuuugcagauauga

SEQ ID NO: 1212289 - RNA, 21 nt, Homo sapiens
ccuuugcaguuggacucucag

SEQ ID NO: 1212290 - RNA, 23 nt, Homo sapiens
ccuuuggagcuuuuuucuuuaag

SEQ ID NO: 1212291 - RNA, 14 nt, Homo sapiens
ccuuuggggagcag

SEQ ID NO: 1212292 - RNA, 22 nt, Homo sapiens
ccuuuguguauuuuucaauaau

SEQ ID NO: 1212293 - RNA, 15 nt, Homo sapiens
ccuuuuaacucaccu

SEQ ID NO: 1212294 - RNA, 16 nt, Homo sapiens
ccuuuuaauggauggu

SEQ ID NO: 1212295 - RNA, 12 nt, Homo sapiens
ccuuuugcugcg

SEQ ID NO: 1212296 - RNA, 16 nt, Homo sapiens
ccuuuuguauacaucc

SEQ ID NO: 1212297 - RNA, 22 nt, Homo sapiens
ccuuuuuuaagauuuuucucaa

SEQ ID NO: 1212298 - RNA, 16 nt, Homo sapiens
ccuuuuuugcaugugc

SEQ ID NO: 1212299 - RNA, 14 nt, Homo sapiens
ccuuuuuugccaga

SEQ ID NO: 1212300 - RNA, 19 nt, Homo sapiens
cgaaaugcuaugacuguau

SEQ ID NO: 1212301 - RNA, 17 nt, Homo sapiens
cgaaccuacaguuuuaa

SEQ ID NO: 1212302 - RNA, 15 nt, Homo sapiens
cgaaggauauuguca

SEQ ID NO: 1212303 - RNA, 17 nt, Homo sapiens
cgaagggggucaaagga

SEQ ID NO: 1212304 - RNA, 14 nt, Homo sapiens
cgaaguagcuugcu

SEQ ID NO: 1212305 - RNA, 17 nt, Homo sapiens
cgaauuaauuaccuggc

SEQ ID NO: 1212306 - RNA, 22 nt, Homo sapiens
cgacaaagccaaacucugccag

SEQ ID NO: 1212307 - RNA, 20 nt, Homo sapiens
cgacaagugcugaacagugg

SEQ ID NO: 1212308 - RNA, 20 nt, Homo sapiens
cgacaucuuggcguggcagc

SEQ ID NO: 1212309 - RNA, 19 nt, Homo sapiens
cgaccacuuccaggggaac

SEQ ID NO: 1212310 - RNA, 13 nt, Homo sapiens
cgaccagacaccu

SEQ ID NO: 1212311 - RNA, 16 nt, Homo sapiens
cgacugaugaaggcau

SEQ ID NO: 1212312 - RNA, 19 nt, Homo sapiens
cgacuuguuuuugcacaug

SEQ ID NO: 1212313 - RNA, 18 nt, Homo sapiens
cgacuuucugccuggagu

SEQ ID NO: 1212314 - RNA, 17 nt, Homo sapiens
cgagaggugggccaguc

SEQ ID NO: 1212315 - RNA, 20 nt, Homo sapiens
cgagauagcaccauugcacu

SEQ ID NO: 1212316 - RNA, 21 nt, Homo sapiens
cgagauagcaccauugcacuc

SEQ ID NO: 1212317 - RNA, 14 nt, Homo sapiens
cgagaucaagagau

SEQ ID NO: 1212318 - RNA, 19 nt, Homo sapiens
cgagaucacgccacugcac

SEQ ID NO: 1212319 - RNA, 18 nt, Homo sapiens
cgagaucauucuucacuc

SEQ ID NO: 1212320 - RNA, 14 nt, Homo sapiens
cgagaugcucugcu

SEQ ID NO: 1212321 - RNA, 17 nt, Homo sapiens
cgagcaccugugcccau

SEQ ID NO: 1212322 - RNA, 15 nt, Homo sapiens
cgagcacugugagca

SEQ ID NO: 1212323 - RNA, 17 nt, Homo sapiens
cgagcagaugaugccaa

SEQ ID NO: 1212324 - RNA, 13 nt, Homo sapiens
cgagcagucagca

SEQ ID NO: 1212325 - RNA, 17 nt, Homo sapiens
cgagccaggaccacaga

SEQ ID NO: 1212326 - RNA, 13 nt, Homo sapiens
cgagcucuuggcc

SEQ ID NO: 1212327 - RNA, 21 nt, Homo sapiens
cgagcuguuuacagugaugcc

SEQ ID NO: 1212328 - RNA, 15 nt, Homo sapiens
cgagcuuccucggua

SEQ ID NO: 1212329 - RNA, 14 nt, Homo sapiens
cgaggacacagugg

SEQ ID NO: 1212330 - RNA, 14 nt, Homo sapiens
cgaggcgaugccac

SEQ ID NO: 1212331 - RNA, 23 nt, Homo sapiens
cgagggaggaacaccugaucuua

SEQ ID NO: 1212332 - RNA, 18 nt, Homo sapiens
cgagggucaggacuguga

SEQ ID NO: 1212333 - RNA, 14 nt, Homo sapiens
cgaggucaggagau

SEQ ID NO: 1212334 - RNA, 12 nt, Homo sapiens
cgaggugcagua

SEQ ID NO: 1212335 - RNA, 14 nt, Homo sapiens
cgaguaacuccccu

SEQ ID NO: 1212336 - RNA, 15 nt, Homo sapiens
cgagucauggcuaau

SEQ ID NO: 1212337 - RNA, 19 nt, Homo sapiens
cgagucucuucuccacugg

SEQ ID NO: 1212338 - RNA, 20 nt, Homo sapiens
cgaguggauuguaggugcaa

SEQ ID NO: 1212339 - RNA, 17 nt, Homo sapiens
cgaguuguggaaagccu

SEQ ID NO: 1212340 - RNA, 15 nt, Homo sapiens
cgauacaaaguguug

SEQ ID NO: 1212341 - RNA, 18 nt, Homo sapiens
cgauccuggauucacuca

SEQ ID NO: 1212342 - RNA, 16 nt, Homo sapiens
cgaucuccugaccucg

SEQ ID NO: 1212343 - RNA, 14 nt, Homo sapiens
cgaugacaguguuc

SEQ ID NO: 1212344 - RNA, 12 nt, Homo sapiens
cgaugcauuuaa

SEQ ID NO: 1212345 - RNA, 12 nt, Homo sapiens
cgaugcucccuc

SEQ ID NO: 1212346 - RNA, 13 nt, Homo sapiens
cgaugcugcuaug

SEQ ID NO: 1212347 - RNA, 16 nt, Homo sapiens
cgcaagaccagucacu

SEQ ID NO: 1212348 - RNA, 20 nt, Homo sapiens
cgcaaucucggcucacugca

SEQ ID NO: 1212349 - RNA, 15 nt, Homo sapiens
cgcaauugcucaugc

SEQ ID NO: 1212350 - RNA, 23 nt, Homo sapiens
cgcaauuuuaccuaguuugcacu

SEQ ID NO: 1212351 - RNA, 18 nt, Homo sapiens
cgcaccuaccaucaggga

SEQ ID NO: 1212352 - RNA, 16 nt, Homo sapiens
cgcacgcucgcugcca

SEQ ID NO: 1212353 - RNA, 15 nt, Homo sapiens
cgcacuucagaauuc

SEQ ID NO: 1212354 - RNA, 13 nt, Homo sapiens
cgcagagcacaga

SEQ ID NO: 1212355 - RNA, 15 nt, Homo sapiens
cgcaucucagugcag

SEQ ID NO: 1212356 - RNA, 20 nt, Homo sapiens
ccuaaauauaauuauccaaa

SEQ ID NO: 1212357 - RNA, 22 nt, Homo sapiens
ccuaaaucugccuuuucaucua

SEQ ID NO: 1212358 - RNA, 12 nt, Homo sapiens
ccuaacaaaaga

SEQ ID NO: 1212359 - RNA, 19 nt, Homo sapiens
ccuaacacggugcucauuu

SEQ ID NO: 1212360 - RNA, 15 nt, Homo sapiens
ccuaaccacuuagca

SEQ ID NO: 1212361 - RNA, 15 nt, Homo sapiens
ccuaaccucauuccc

SEQ ID NO: 1212362 - RNA, 13 nt, Homo sapiens
ccuaacugaauuu

SEQ ID NO: 1212363 - RNA, 11 nt, Homo sapiens
ccuaacugauc

SEQ ID NO: 1212364 - RNA, 17 nt, Homo sapiens
ccuaagacuuauguauu

SEQ ID NO: 1212365 - RNA, 22 nt, Homo sapiens
ccuaagagacugcguucugcaa

SEQ ID NO: 1212366 - RNA, 18 nt, Homo sapiens
ccuaagagaugggacuag

SEQ ID NO: 1212367 - RNA, 21 nt, Homo sapiens
ccuaagagaugggacuaggac

SEQ ID NO: 1212368 - RNA, 21 nt, Homo sapiens
ccuaagaucucgguuugccaa

SEQ ID NO: 1212369 - RNA, 22 nt, Homo sapiens
ccuaagcacuuuauaaauauca

SEQ ID NO: 1212370 - RNA, 17 nt, Homo sapiens
ccuaagcauguguccca

SEQ ID NO: 1212371 - RNA, 19 nt, Homo sapiens
ccuaaggacaagacacuga

SEQ ID NO: 1212372 - RNA, 19 nt, Homo sapiens
ccuaaggccuuagggguca

SEQ ID NO: 1212373 - RNA, 14 nt, Homo sapiens
ccuaaguacuguaa

SEQ ID NO: 1212374 - RNA, 21 nt, Homo sapiens
ccuaaguacuguaauaauacc

SEQ ID NO: 1212375 - RNA, 16 nt, Homo sapiens
ccuaaguccuuuaugu

SEQ ID NO: 1212376 - RNA, 13 nt, Homo sapiens
ccuaauacaacau

SEQ ID NO: 1212377 - RNA, 20 nt, Homo sapiens
ccuaauacugucauccucaa

SEQ ID NO: 1212378 - RNA, 16 nt, Homo sapiens
ccuaauaggcugggag

SEQ ID NO: 1212379 - RNA, 22 nt, Homo sapiens
ccuaaucuauggucgggagaca

SEQ ID NO: 1212380 - RNA, 16 nt, Homo sapiens
ccuaaucucauaccuc

SEQ ID NO: 1212381 - RNA, 18 nt, Homo sapiens
ccuaaucuuccacuugag

SEQ ID NO: 1212382 - RNA, 23 nt, Homo sapiens
ccuaaugaaggaguucacuguaa

SEQ ID NO: 1212383 - RNA, 11 nt, Homo sapiens
ccuacaacuua

SEQ ID NO: 1212384 - RNA, 15 nt, Homo sapiens
ccuacaagauuuccu

SEQ ID NO: 1212385 - RNA, 16 nt, Homo sapiens
ccuacaccucuugaaa

SEQ ID NO: 1212386 - RNA, 19 nt, Homo sapiens
ccuacagaacuucagaaag

SEQ ID NO: 1212387 - RNA, 17 nt, Homo sapiens
ccuacagaggucucugc

SEQ ID NO: 1212388 - RNA, 21 nt, Homo sapiens
ccuacagggacacuaucacuc

SEQ ID NO: 1212389 - RNA, 12 nt, Homo sapiens
ccuacauguauu

SEQ ID NO: 1212390 - RNA, 15 nt, Homo sapiens
ccuaccaacuuuacu

SEQ ID NO: 1212391 - RNA, 15 nt, Homo sapiens
ccuaccacagugucu

SEQ ID NO: 1212392 - RNA, 16 nt, Homo sapiens
ccuaccaguugcccua

SEQ ID NO: 1212393 - RNA, 23 nt, Homo sapiens
ccuaccaguuggccaugaugucu

SEQ ID NO: 1212394 - RNA, 14 nt, Homo sapiens
ccuacccacuucca

SEQ ID NO: 1212395 - RNA, 14 nt, Homo sapiens
ccuacccugaaccu

SEQ ID NO: 1212396 - RNA, 11 nt, Homo sapiens
ccuaccucagc

SEQ ID NO: 1212397 - RNA, 16 nt, Homo sapiens
ccuacguauccugcag

SEQ ID NO: 1212398 - RNA, 13 nt, Homo sapiens
ccuacgugccacu

SEQ ID NO: 1212399 - RNA, 22 nt, Homo sapiens
ccuacuaauccucucugcaagu

SEQ ID NO: 1212400 - RNA, 16 nt, Homo sapiens
ccuacuacaugcaagg

SEQ ID NO: 1212401 - RNA, 22 nt, Homo sapiens
ccuacuaucacugaacaaacua

SEQ ID NO: 1212402 - RNA, 15 nt, Homo sapiens
ccuacugaaugcucu

SEQ ID NO: 1212403 - RNA, 15 nt, Homo sapiens
ccuacugagcauuug

SEQ ID NO: 1212404 - RNA, 17 nt, Homo sapiens
ccuacuguuccuuucag

SEQ ID NO: 1212405 - RNA, 16 nt, Homo sapiens
ccuacuugauaauauu

SEQ ID NO: 1212406 - RNA, 19 nt, Homo sapiens
ccuacuuugacuuuuugca

SEQ ID NO: 1212407 - RNA, 17 nt, Homo sapiens
ccuagaacacuaacuca

SEQ ID NO: 1212408 - RNA, 14 nt, Homo sapiens
ccuagaagaagcua

SEQ ID NO: 1212409 - RNA, 18 nt, Homo sapiens
ccuagaagaagcuauguc

SEQ ID NO: 1212410 - RNA, 20 nt, Homo sapiens
ccuagaagaagcuaugucaa

SEQ ID NO: 1212411 - RNA, 18 nt, Homo sapiens
ccuagaccaugucagaua

SEQ ID NO: 1212412 - RNA, 17 nt, Homo sapiens
ccuagaccuggugcuga

SEQ ID NO: 1212413 - RNA, 15 nt, Homo sapiens
ccuagagcgcggcug

SEQ ID NO: 1212414 - RNA, 14 nt, Homo sapiens
ccuagcauuucaaa

SEQ ID NO: 1212415 - RNA, 16 nt, Homo sapiens
ccuagccagaggcucu

SEQ ID NO: 1212416 - RNA, 19 nt, Homo sapiens
ccuagccucgcucuuggca

SEQ ID NO: 1212417 - RNA, 16 nt, Homo sapiens
ccuaggaacucagucc

SEQ ID NO: 1212418 - RNA, 20 nt, Homo sapiens
ccuaggcugcugcugugacc

SEQ ID NO: 1212419 - RNA, 15 nt, Homo sapiens
ccuagggcaccaggg

SEQ ID NO: 1212420 - RNA, 12 nt, Homo sapiens
ccuagucuccac

SEQ ID NO: 1212421 - RNA, 13 nt, Homo sapiens
ccuauaaauauua

SEQ ID NO: 1212422 - RNA, 15 nt, Homo sapiens
ccuauacacuagaca

SEQ ID NO: 1212423 - RNA, 12 nt, Homo sapiens
ccuauagcucuu

SEQ ID NO: 1212424 - RNA, 11 nt, Homo sapiens
ccuaucaccuc

SEQ ID NO: 1212425 - RNA, 13 nt, Homo sapiens
ccuaucagaauuu

SEQ ID NO: 1212426 - RNA, 20 nt, Homo sapiens
ccuaucagaguugcugcaaa

SEQ ID NO: 1212427 - RNA, 23 nt, Homo sapiens
ccuaucuaacccucccauggcac

SEQ ID NO: 1212428 - RNA, 14 nt, Homo sapiens
ccuaucuccugaca

SEQ ID NO: 1212429 - RNA, 17 nt, Homo sapiens
ccuaucuggggagcucc

SEQ ID NO: 1212430 - RNA, 22 nt, Homo sapiens
ccuaucuugauuucacuggaau

SEQ ID NO: 1212431 - RNA, 12 nt, Homo sapiens
ccuaugauccca

SEQ ID NO: 1212432 - RNA, 15 nt, Homo sapiens
ccuauggacaacuua

SEQ ID NO: 1212433 - RNA, 20 nt, Homo sapiens
ccuauuagaguauuuuccac

SEQ ID NO: 1212434 - RNA, 19 nt, Homo sapiens
ccuauuuagaaauggauuu

SEQ ID NO: 1212435 - RNA, 13 nt, Homo sapiens
ccuauuuccccac

SEQ ID NO: 1212436 - RNA, 21 nt, Homo sapiens
ccucaaacuuccagucaggua

SEQ ID NO: 1212437 - RNA, 15 nt, Homo sapiens
ccucaaagucugcaa

SEQ ID NO: 1212438 - RNA, 21 nt, Homo sapiens
ccucaacauugcauggugcua

SEQ ID NO: 1212439 - RNA, 17 nt, Homo sapiens
ccucaagccccauuucc

SEQ ID NO: 1212440 - RNA, 21 nt, Homo sapiens
ccucaagccccauuuccucac

SEQ ID NO: 1212441 - RNA, 16 nt, Homo sapiens
ccucaaguaaacuccc

SEQ ID NO: 1212442 - RNA, 19 nt, Homo sapiens
ccucaauuuuugucucaga

SEQ ID NO: 1212443 - RNA, 20 nt, Homo sapiens
ccucacagagugcauuguga

SEQ ID NO: 1212444 - RNA, 23 nt, Homo sapiens
ccucacagagugcauugugaggg

SEQ ID NO: 1212445 - RNA, 23 nt, Homo sapiens
ccucacaugugacaaagggccag

SEQ ID NO: 1212446 - RNA, 16 nt, Homo sapiens
ccucacccgaaucucc

SEQ ID NO: 1212447 - RNA, 19 nt, Homo sapiens
ccucaccuuguaaccagug

SEQ ID NO: 1212448 - RNA, 23 nt, Homo sapiens
ccucacuaaaaaggaaacuucag

SEQ ID NO: 1212449 - RNA, 22 nt, Homo sapiens
ccucacucuguuuccuggucag

SEQ ID NO: 1212450 - RNA, 12 nt, Homo sapiens
ccucacugaaaa

SEQ ID NO: 1212451 - RNA, 19 nt, Homo sapiens
ccucagaaagucaccagga

SEQ ID NO: 1212452 - RNA, 20 nt, Homo sapiens
ccucagaaagucaccaggac

SEQ ID NO: 1212453 - RNA, 20 nt, Homo sapiens
ccucagcggacaagcagcug

SEQ ID NO: 1212454 - RNA, 14 nt, Homo sapiens
ccucagcuucucaa

SEQ ID NO: 1212455 - RNA, 17 nt, Homo sapiens
ccucagcuucuucacag

SEQ ID NO: 1212456 - RNA, 12 nt, Homo sapiens
ccucagcuuucc

SEQ ID NO: 1212457 - RNA, 19 nt, Homo sapiens
ccucaggccaggugcagug

SEQ ID NO: 1212458 - RNA, 12 nt, Homo sapiens
ccucagggccag

SEQ ID NO: 1212459 - RNA, 19 nt, Homo sapiens
ccucaggggaaaacuguua

SEQ ID NO: 1212460 - RNA, 15 nt, Homo sapiens
ccucaggggacuuga

SEQ ID NO: 1212461 - RNA, 15 nt, Homo sapiens
ccucagggguuucau

SEQ ID NO: 1212462 - RNA, 21 nt, Homo sapiens
ccucaggguggggggugacag

SEQ ID NO: 1212463 - RNA, 14 nt, Homo sapiens
ccucagugagauaa

SEQ ID NO: 1212464 - RNA, 14 nt, Homo sapiens
ccucauccuuucag

SEQ ID NO: 1212465 - RNA, 19 nt, Homo sapiens
ccucaucuccuaaaaggca

SEQ ID NO: 1212466 - RNA, 23 nt, Homo sapiens
ccucauggcucuggcacagugua

SEQ ID NO: 1212467 - RNA, 20 nt, Homo sapiens
ccucauuccccaaccacuuc

SEQ ID NO: 1212468 - RNA, 20 nt, Homo sapiens
ccucauugcagcuagaggca

SEQ ID NO: 1212469 - RNA, 16 nt, Homo sapiens
ccuccaaaugccaacu

SEQ ID NO: 1212470 - RNA, 15 nt, Homo sapiens
ccuccagaggaugac

SEQ ID NO: 1212471 - RNA, 17 nt, Homo sapiens
ccuccagggacaaagag

SEQ ID NO: 1212472 - RNA, 17 nt, Homo sapiens
ccuccauucugaccauu

SEQ ID NO: 1212473 - RNA, 16 nt, Homo sapiens
ccucccaccucuguga

SEQ ID NO: 1212474 - RNA, 15 nt, Homo sapiens
ccugcuccagaauuu

SEQ ID NO: 1212475 - RNA, 19 nt, Homo sapiens
ccugcucccagcagcccua

SEQ ID NO: 1212476 - RNA, 21 nt, Homo sapiens
ccugcucuucuaccauuugaa

SEQ ID NO: 1212477 - RNA, 22 nt, Homo sapiens
ccugcugaccucccagugaccc

SEQ ID NO: 1212478 - RNA, 17 nt, Homo sapiens
ccugcugcaaagccuuu

SEQ ID NO: 1212479 - RNA, 13 nt, Homo sapiens
ccugcugcaucuu

SEQ ID NO: 1212480 - RNA, 16 nt, Homo sapiens
ccugcugccccagcug

SEQ ID NO: 1212481 - RNA, 16 nt, Homo sapiens
ccugcuggacagccuc

SEQ ID NO: 1212482 - RNA, 16 nt, Homo sapiens
ccugcugggggcagca

SEQ ID NO: 1212483 - RNA, 22 nt, Homo sapiens
ccugcugggggcagcaguacca

SEQ ID NO: 1212484 - RNA, 14 nt, Homo sapiens
cccucucuugcacc

SEQ ID NO: 1212485 - RNA, 19 nt, Homo sapiens
cccucugcucagccaagcu

SEQ ID NO: 1212486 - RNA, 21 nt, Homo sapiens
cccucuggccgccuaggcuca

SEQ ID NO: 1212487 - RNA, 14 nt, Homo sapiens
cccucugggaaccu

SEQ ID NO: 1212488 - RNA, 20 nt, Homo sapiens
cccucuucuucuuuccuucc

SEQ ID NO: 1212489 - RNA, 21 nt, Homo sapiens
cccugaaauugcauauaugua

SEQ ID NO: 1212490 - RNA, 21 nt, Homo sapiens
cccugacaucuggaaucugga

SEQ ID NO: 1212491 - RNA, 11 nt, Homo sapiens
cccugaccucc

SEQ ID NO: 1212492 - RNA, 16 nt, Homo sapiens
cccugacucaucauuu

SEQ ID NO: 1212493 - RNA, 21 nt, Homo sapiens
cccugagacagacacacagcc

SEQ ID NO: 1212494 - RNA, 19 nt, Homo sapiens
cccugagauucagauguca

SEQ ID NO: 1212495 - RNA, 18 nt, Homo sapiens
cccugaucuagugcagua

SEQ ID NO: 1212496 - RNA, 15 nt, Homo sapiens
cccugauugaccugc

SEQ ID NO: 1212497 - RNA, 17 nt, Homo sapiens
cccugcaaacagaacag

SEQ ID NO: 1212498 - RNA, 23 nt, Homo sapiens
cccugcagaugccacccuagcca

SEQ ID NO: 1212499 - RNA, 20 nt, Homo sapiens
cccugcagcacggacaauaa

SEQ ID NO: 1212500 - RNA, 22 nt, Homo sapiens
cccugccccuggugcccugaga

SEQ ID NO: 1212501 - RNA, 13 nt, Homo sapiens
cccugcccggcug

SEQ ID NO: 1212502 - RNA, 23 nt, Homo sapiens
cccugccuguuaaggaaacuuua

SEQ ID NO: 1212503 - RNA, 23 nt, Homo sapiens
cccugccuuuaaaaacaaacaga

SEQ ID NO: 1212504 - RNA, 16 nt, Homo sapiens
cccugcggucaggcug

SEQ ID NO: 1212505 - RNA, 20 nt, Homo sapiens
cccugcucaguaaagcacuu

SEQ ID NO: 1212506 - RNA, 22 nt, Homo sapiens
cccugcuuuuugcuucuugagu

SEQ ID NO: 1212507 - RNA, 13 nt, Homo sapiens
cccuggaaaugga

SEQ ID NO: 1212508 - RNA, 16 nt, Homo sapiens
cccuggccauccacaa

SEQ ID NO: 1212509 - RNA, 15 nt, Homo sapiens
cccuggcccaucuca

SEQ ID NO: 1212510 - RNA, 15 nt, Homo sapiens
cccuggcugcccugg

SEQ ID NO: 1212511 - RNA, 14 nt, Homo sapiens
cccugggccagggu

SEQ ID NO: 1212512 - RNA, 16 nt, Homo sapiens
cccugggcuggacugg

SEQ ID NO: 1212513 - RNA, 16 nt, Homo sapiens
cccugggcuuugucau

SEQ ID NO: 1212514 - RNA, 17 nt, Homo sapiens
cccuggggaaggagcca

SEQ ID NO: 1212515 - RNA, 22 nt, Homo sapiens
cccuggggccuagacucuguaa

SEQ ID NO: 1212516 - RNA, 21 nt, Homo sapiens
cccuggggcuucuccugaccc

SEQ ID NO: 1212517 - RNA, 18 nt, Homo sapiens
cccugucaccuagcucaa

SEQ ID NO: 1212518 - RNA, 12 nt, Homo sapiens
cccugucauccu

SEQ ID NO: 1212519 - RNA, 18 nt, Homo sapiens
cccugucucugcaucuga

SEQ ID NO: 1212520 - RNA, 16 nt, Homo sapiens
cccugugccacuuuga

SEQ ID NO: 1212521 - RNA, 14 nt, Homo sapiens
cccuguggcacuca

SEQ ID NO: 1212522 - RNA, 15 nt, Homo sapiens
cccuguguagcucuc

SEQ ID NO: 1212523 - RNA, 20 nt, Homo sapiens
cccugugucauuucaaacag

SEQ ID NO: 1212524 - RNA, 20 nt, Homo sapiens
cccuguguccaccugugggu

SEQ ID NO: 1212525 - RNA, 16 nt, Homo sapiens
cccuguucuaaggggg

SEQ ID NO: 1212526 - RNA, 22 nt, Homo sapiens
cccuuaacugacaugggccuuu

SEQ ID NO: 1212527 - RNA, 22 nt, Homo sapiens
cccuuacuuagcaugcacaaag

SEQ ID NO: 1212528 - RNA, 18 nt, Homo sapiens
cccuuauguguuguguau

SEQ ID NO: 1212529 - RNA, 15 nt, Homo sapiens
cccuucccugcacua

SEQ ID NO: 1212530 - RNA, 14 nt, Homo sapiens
cccuucccuuccac

SEQ ID NO: 1212531 - RNA, 23 nt, Homo sapiens
cccuuccugcauuucucuucuca

SEQ ID NO: 1212532 - RNA, 17 nt, Homo sapiens
cccuucuggacacugag

SEQ ID NO: 1212533 - RNA, 19 nt, Homo sapiens
cccuugauaaccauauaaa

SEQ ID NO: 1212534 - RNA, 15 nt, Homo sapiens
cccuuguccuugaaa

SEQ ID NO: 1212535 - RNA, 21 nt, Homo sapiens
cccuugugucaagacauuucu

SEQ ID NO: 1212536 - RNA, 22 nt, Homo sapiens
cccuuuauuacaagaaggaaca

SEQ ID NO: 1212537 - RNA, 20 nt, Homo sapiens
cccuuuauucauccuaaaaa

SEQ ID NO: 1212538 - RNA, 12 nt, Homo sapiens
cccuuuccuaaa

SEQ ID NO: 1212539 - RNA, 17 nt, Homo sapiens
cccuuugauucuccagu

SEQ ID NO: 1212540 - RNA, 15 nt, Homo sapiens
cccuuuggggagcag

SEQ ID NO: 1212541 - RNA, 18 nt, Homo sapiens
ccgaaaaggauaugcagu

SEQ ID NO: 1212542 - RNA, 19 nt, Homo sapiens
ccgaaaaggauaugcagua

SEQ ID NO: 1212543 - RNA, 20 nt, Homo sapiens
ccgaaaaggauaugcaguau

SEQ ID NO: 1212544 - RNA, 22 nt, Homo sapiens
ccgaaggugcuggaggugggag

SEQ ID NO: 1212545 - RNA, 23 nt, Homo sapiens
ccgacacugcugcaccagaguga

SEQ ID NO: 1212546 - RNA, 18 nt, Homo sapiens
ccgacauguguaccucag

SEQ ID NO: 1212547 - RNA, 14 nt, Homo sapiens
ccgaccacuuccag

SEQ ID NO: 1212548 - RNA, 15 nt, Homo sapiens
ccgaccggugcauga

SEQ ID NO: 1212549 - RNA, 22 nt, Homo sapiens
ccgacggugggcauuugugagg

SEQ ID NO: 1212550 - RNA, 11 nt, Homo sapiens
ccgacucuggc

SEQ ID NO: 1212551 - RNA, 23 nt, Homo sapiens
ccgacugccccugcugugcugcu

SEQ ID NO: 1212552 - RNA, 16 nt, Homo sapiens
ccgagaagcacuugag

SEQ ID NO: 1212553 - RNA, 16 nt, Homo sapiens
ccgaguaacugagauu

SEQ ID NO: 1212554 - RNA, 15 nt, Homo sapiens
ccgagucucuucucc

SEQ ID NO: 1212555 - RNA, 12 nt, Homo sapiens
ccgagugcaaug

SEQ ID NO: 1212556 - RNA, 13 nt, Homo sapiens
ccgagugcaauga

SEQ ID NO: 1212557 - RNA, 21 nt, Homo sapiens
ccgagugcucugaugcaauag

SEQ ID NO: 1212558 - RNA, 18 nt, Homo sapiens
ccgaguggccauggcaug

SEQ ID NO: 1212559 - RNA, 16 nt, Homo sapiens
ccgaugaacaaguuua

SEQ ID NO: 1212560 - RNA, 15 nt, Homo sapiens
ccgaugguacuauuu

SEQ ID NO: 1212561 - RNA, 18 nt, Homo sapiens
ccgauucccaacugagug

SEQ ID NO: 1212562 - RNA, 16 nt, Homo sapiens
ccgcaacagccaagug

SEQ ID NO: 1212563 - RNA, 12 nt, Homo sapiens
ccgcacaugcac

SEQ ID NO: 1212564 - RNA, 18 nt, Homo sapiens
ccgcaggugggugcugcc

SEQ ID NO: 1212565 - RNA, 17 nt, Homo sapiens
ccgcauuggugacucac

SEQ ID NO: 1212566 - RNA, 18 nt, Homo sapiens
ccgcauuuggauuggaug

SEQ ID NO: 1212567 - RNA, 12 nt, Homo sapiens
ccgccaccucag

SEQ ID NO: 1212568 - RNA, 14 nt, Homo sapiens
ccgcggugcucugg

SEQ ID NO: 1212569 - RNA, 17 nt, Homo sapiens
ccgcugauaagcauuga

SEQ ID NO: 1212570 - RNA, 18 nt, Homo sapiens
ccgcugcaaugccuagac

SEQ ID NO: 1212571 - RNA, 18 nt, Homo sapiens
ccgcuuugaaagaagcaa

SEQ ID NO: 1212572 - RNA, 15 nt, Homo sapiens
ccgcuuuucugccac

SEQ ID NO: 1212573 - RNA, 15 nt, Homo sapiens
ccggaaccacagggc

SEQ ID NO: 1212574 - RNA, 22 nt, Homo sapiens
ccggaagcucacagugacauua

SEQ ID NO: 1212575 - RNA, 15 nt, Homo sapiens
ccggaggcugcagug

SEQ ID NO: 1212576 - RNA, 13 nt, Homo sapiens
ccggaggucauga

SEQ ID NO: 1212577 - RNA, 22 nt, Homo sapiens
ccggaucagagcaggaccuccc

SEQ ID NO: 1212578 - RNA, 18 nt, Homo sapiens
ccggcgcugauuccucgu

SEQ ID NO: 1212579 - RNA, 21 nt, Homo sapiens
ccggcuaugggacugcagugc

SEQ ID NO: 1212580 - RNA, 18 nt, Homo sapiens
ccggcugguggagcugcu

SEQ ID NO: 1212581 - RNA, 15 nt, Homo sapiens
ccgggacugggcuag

SEQ ID NO: 1212582 - RNA, 23 nt, Homo sapiens
ccgggcaccaacuccauguuugg

SEQ ID NO: 1212583 - RNA, 21 nt, Homo sapiens
ccgggcgugguggcacaugcc

SEQ ID NO: 1212584 - RNA, 17 nt, Homo sapiens
ccggggccagcaccacu

SEQ ID NO: 1212585 - RNA, 16 nt, Homo sapiens
ccggggcuccacugaa

SEQ ID NO: 1212586 - RNA, 13 nt, Homo sapiens
ccggggguccagg

SEQ ID NO: 1212587 - RNA, 23 nt, Homo sapiens
ccgguuaaauuccauaugcucca

SEQ ID NO: 1212588 - RNA, 17 nt, Homo sapiens
ccgguuauuacuucugu

SEQ ID NO: 1212589 - RNA, 13 nt, Homo sapiens
ccgguuugccaug

SEQ ID NO: 1212590 - RNA, 17 nt, Homo sapiens
ccguaacaacugugguc

SEQ ID NO: 1212591 - RNA, 22 nt, Homo sapiens
ccguaccucuucccaugacugc

SEQ ID NO: 1212592 - RNA, 17 nt, Homo sapiens
ccgucgaggggcucuca

SEQ ID NO: 1212593 - RNA, 19 nt, Homo sapiens
ccgucuccauggcaucuuc

SEQ ID NO: 1212594 - RNA, 13 nt, Homo sapiens
ccgucucuuuaaa

SEQ ID NO: 1212595 - RNA, 23 nt, Homo sapiens
ccgucuuggcuuauccacuuuga

SEQ ID NO: 1212596 - RNA, 16 nt, Homo sapiens
ccgugaacugugcaua

SEQ ID NO: 1212597 - RNA, 20 nt, Homo sapiens
ccgugagcgccugugcacac

SEQ ID NO: 1212598 - RNA, 13 nt, Homo sapiens
ccgugccaaaaau

SEQ ID NO: 1212599 - RNA, 16 nt, Homo sapiens
ccgugcucacuaccaa

SEQ ID NO: 1212600 - RNA, 23 nt, Homo sapiens
ccguguugcaugaaggagcagca

SEQ ID NO: 1212601 - RNA, 13 nt, Homo sapiens
ccguuuaccuaga

SEQ ID NO: 1212602 - RNA, 18 nt, Homo sapiens
ccuaaaaggaaaucucac

SEQ ID NO: 1212603 - RNA, 21 nt, Homo sapiens
ccuaaaaggcagaguacaaag

SEQ ID NO: 1212604 - RNA, 18 nt, Homo sapiens
ccuaaaauauauuccuga

SEQ ID NO: 1212605 - RNA, 18 nt, Homo sapiens
ccuaaaauggugauaucc

SEQ ID NO: 1212606 - RNA, 16 nt, Homo sapiens
ccuaaaauuguaugaa

SEQ ID NO: 1212607 - RNA, 17 nt, Homo sapiens
ccuaaaauuguaugaaa

SEQ ID NO: 1212608 - RNA, 21 nt, Homo sapiens
ccuaaaauuguaugaaaaucc

SEQ ID NO: 1212609 - RNA, 12 nt, Homo sapiens
ccuaaacccaau

SEQ ID NO: 1212610 - RNA, 13 nt, Homo sapiens
ccuaaaggacucu

SEQ ID NO: 1212611 - RNA, 23 nt, Homo sapiens
agaacagugaaagguauugcacu

SEQ ID NO: 1212612 - RNA, 22 nt, Homo sapiens
agaacaucauuagaacaaagga

SEQ ID NO: 1212613 - RNA, 23 nt, Homo sapiens
agaacauuuuaauucaucccaac

SEQ ID NO: 1212614 - RNA, 17 nt, Homo sapiens
agaaccacaaacaauuc

SEQ ID NO: 1212615 - RNA, 20 nt, Homo sapiens
agaaccacacuugaaaccuu

SEQ ID NO: 1212616 - RNA, 17 nt, Homo sapiens
agaacccagauuuccua

SEQ ID NO: 1212617 - RNA, 17 nt, Homo sapiens
agaacccauaaccauac

SEQ ID NO: 1212618 - RNA, 13 nt, Homo sapiens
agaacccuuccug

SEQ ID NO: 1212619 - RNA, 16 nt, Homo sapiens
agaaccgagcaaagau

SEQ ID NO: 1212620 - RNA, 15 nt, Homo sapiens
agaaccucagaucag

SEQ ID NO: 1212621 - RNA, 11 nt, Homo sapiens
agaaccucagg

SEQ ID NO: 1212622 - RNA, 20 nt, Homo sapiens
agaaccuuaaugacaacacu

SEQ ID NO: 1212623 - RNA, 17 nt, Homo sapiens
agaaccuucaacccagu

SEQ ID NO: 1212624 - RNA, 20 nt, Homo sapiens
agaacuaaccaguaccucug

SEQ ID NO: 1212625 - RNA, 16 nt, Homo sapiens
agaacuacagcucuua

SEQ ID NO: 1212626 - RNA, 13 nt, Homo sapiens
agaacuccugacu

SEQ ID NO: 1212627 - RNA, 19 nt, Homo sapiens
agaacugaaggcauaugca

SEQ ID NO: 1212628 - RNA, 21 nt, Homo sapiens
agaacuguuucaacuguauaa

SEQ ID NO: 1212629 - RNA, 14 nt, Homo sapiens
agaacuucaagaag

SEQ ID NO: 1212630 - RNA, 15 nt, Homo sapiens
agaacuucagaaaga

SEQ ID NO: 1212631 - RNA, 14 nt, Homo sapiens
agaacuugaccccc

SEQ ID NO: 1212632 - RNA, 16 nt, Homo sapiens
agaacuugauuugcau

SEQ ID NO: 1212633 - RNA, 19 nt, Homo sapiens
agaacuugcagcugauguu

SEQ ID NO: 1212634 - RNA, 18 nt, Homo sapiens
agaacuuuggcugccuuu

SEQ ID NO: 1212635 - RNA, 21 nt, Homo sapiens
agaacuuuguuaacgcacuug

SEQ ID NO: 1212636 - RNA, 19 nt, Homo sapiens
agaagaaaaugaaugcugc

SEQ ID NO: 1212637 - RNA, 15 nt, Homo sapiens
agaagaaacagaagc

SEQ ID NO: 1212638 - RNA, 18 nt, Homo sapiens
agaagaagcccauaucac

SEQ ID NO: 1212639 - RNA, 19 nt, Homo sapiens
agaagacaacauuucucaa

SEQ ID NO: 1212640 - RNA, 19 nt, Homo sapiens
agaagacacugaugggcaa

SEQ ID NO: 1212641 - RNA, 13 nt, Homo sapiens
agaagacacugca

SEQ ID NO: 1212642 - RNA, 21 nt, Homo sapiens
agaagaccguuuaccuagaag

SEQ ID NO: 1212643 - RNA, 14 nt, Homo sapiens
agaagacucugacc

SEQ ID NO: 1212644 - RNA, 14 nt, Homo sapiens
agaagagacuggga

SEQ ID NO: 1212645 - RNA, 13 nt, Homo sapiens
agaagaggcugcu

SEQ ID NO: 1212646 - RNA, 21 nt, Homo sapiens
agaagauaauguucuuuaaug

SEQ ID NO: 1212647 - RNA, 22 nt, Homo sapiens
agaagauaugugaagaaaaaug

SEQ ID NO: 1212648 - RNA, 22 nt, Homo sapiens
agaagauccaagaggcccugca

SEQ ID NO: 1212649 - RNA, 18 nt, Homo sapiens
agaagauuuuaugcugcu

SEQ ID NO: 1212650 - RNA, 23 nt, Homo sapiens
agaagcacgauccgccaaugcac

SEQ ID NO: 1212651 - RNA, 18 nt, Homo sapiens
agaagcagccacaccguu

SEQ ID NO: 1212652 - RNA, 20 nt, Homo sapiens
agaagccacgcuguccucuc

SEQ ID NO: 1212653 - RNA, 14 nt, Homo sapiens
agaagcccauauca

SEQ ID NO: 1212654 - RNA, 12 nt, Homo sapiens
agaagcccugau

SEQ ID NO: 1212655 - RNA, 21 nt, Homo sapiens
agaagccuccaagccugccuc

SEQ ID NO: 1212656 - RNA, 19 nt, Homo sapiens
agaagcguuaugugcagua

SEQ ID NO: 1212657 - RNA, 20 nt, Homo sapiens
agaagcuaauguaggacugu

SEQ ID NO: 1212658 - RNA, 21 nt, Homo sapiens
agaagcugucagggacccagg

SEQ ID NO: 1212659 - RNA, 22 nt, Homo sapiens
agaagcuugcugguagcacuug

SEQ ID NO: 1212660 - RNA, 14 nt, Homo sapiens
agaaggaagggcag

SEQ ID NO: 1212661 - RNA, 22 nt, Homo sapiens
agaaggacacuagccugugcac

SEQ ID NO: 1212662 - RNA, 19 nt, Homo sapiens
agaaggacauuuuacugca

SEQ ID NO: 1212663 - RNA, 13 nt, Homo sapiens
agaaggauuaccu

SEQ ID NO: 1212664 - RNA, 14 nt, Homo sapiens
agaaggcagugucc

SEQ ID NO: 1212665 - RNA, 20 nt, Homo sapiens
agaaggcuucuuagcgcagu

SEQ ID NO: 1212666 - RNA, 15 nt, Homo sapiens
agaagggcacuguaa

SEQ ID NO: 1212667 - RNA, 21 nt, Homo sapiens
agaagggcagcuccacagggc

SEQ ID NO: 1212668 - RNA, 17 nt, Homo sapiens
agaaggggccaucacag

SEQ ID NO: 1212669 - RNA, 21 nt, Homo sapiens
agaaggugccacuuuacccac

SEQ ID NO: 1212670 - RNA, 22 nt, Homo sapiens
agaaggugccacuuuacccacc

SEQ ID NO: 1212671 - RNA, 14 nt, Homo sapiens
agaagguugcucua

SEQ ID NO: 1212672 - RNA, 22 nt, Homo sapiens
agaagguuggugaauuucacaa

SEQ ID NO: 1212673 - RNA, 19 nt, Homo sapiens
agaagucauauguugucuu

SEQ ID NO: 1212674 - RNA, 15 nt, Homo sapiens
agaaguccagcucuu

SEQ ID NO: 1212675 - RNA, 13 nt, Homo sapiens
agaaguccugcac

SEQ ID NO: 1212676 - RNA, 14 nt, Homo sapiens
agaagucuccucaa

SEQ ID NO: 1212677 - RNA, 16 nt, Homo sapiens
agaagugccaguugau

SEQ ID NO: 1212678 - RNA, 15 nt, Homo sapiens
agaaguuuauucuca

SEQ ID NO: 1212679 - RNA, 17 nt, Homo sapiens
agaaguuucccuuccuc

SEQ ID NO: 1212680 - RNA, 14 nt, Homo sapiens
agaauaaauacugu

SEQ ID NO: 1212681 - RNA, 19 nt, Homo sapiens
agaauaccacaucaaauaa

SEQ ID NO: 1212682 - RNA, 14 nt, Homo sapiens
agaauagucucacu

SEQ ID NO: 1212683 - RNA, 17 nt, Homo sapiens
agaauagucucacuguc

SEQ ID NO: 1212684 - RNA, 13 nt, Homo sapiens
agaauauaaucuu

SEQ ID NO: 1212685 - RNA, 19 nt, Homo sapiens
agaauauacaaauagcaaa

SEQ ID NO: 1212686 - RNA, 13 nt, Homo sapiens
agaauaucuggga

SEQ ID NO: 1212687 - RNA, 17 nt, Homo sapiens
agaauaugaaacuuuca

SEQ ID NO: 1212688 - RNA, 12 nt, Homo sapiens
agaauauucucc

SEQ ID NO: 1212689 - RNA, 21 nt, Homo sapiens
agaauauucucccauaaacac

SEQ ID NO: 1212690 - RNA, 23 nt, Homo sapiens
agaauauugucccuuugagcaga

SEQ ID NO: 1212691 - RNA, 19 nt, Homo sapiens
agaauauugucugccuuaa

SEQ ID NO: 1212692 - RNA, 13 nt, Homo sapiens
agaaucacugcag

SEQ ID NO: 1212693 - RNA, 16 nt, Homo sapiens
agaaucacuggaaccu

SEQ ID NO: 1212694 - RNA, 11 nt, Homo sapiens
agaauccaaac

SEQ ID NO: 1212695 - RNA, 15 nt, Homo sapiens
agaaucccugccugu

SEQ ID NO: 1212696 - RNA, 17 nt, Homo sapiens
agaaucugcagcuaacu

SEQ ID NO: 1212697 - RNA, 21 nt, Homo sapiens
agaaucugcagcuaacuuauu

SEQ ID NO: 1212698 - RNA, 15 nt, Homo sapiens
agaaucugcugcaua

SEQ ID NO: 1212699 - RNA, 23 nt, Homo sapiens
agaaucugcugcauagcucuauu

SEQ ID NO: 1212700 - RNA, 22 nt, Homo sapiens
agaaugaaagacugaaucuucc

SEQ ID NO: 1212701 - RNA, 19 nt, Homo sapiens
cugagauacaagucaucca

SEQ ID NO: 1212702 - RNA, 18 nt, Homo sapiens
cugagcaaaaagaccagc

SEQ ID NO: 1212703 - RNA, 19 nt, Homo sapiens
cugagcaaaaagaccagcc

SEQ ID NO: 1212704 - RNA, 17 nt, Homo sapiens
cugagcaacucuugauu

SEQ ID NO: 1212705 - RNA, 21 nt, Homo sapiens
cugagcagugccagcuuucuu

SEQ ID NO: 1212706 - RNA, 15 nt, Homo sapiens
cugagcauuugcacc

SEQ ID NO: 1212707 - RNA, 15 nt, Homo sapiens
cugagccaugcucag

SEQ ID NO: 1212708 - RNA, 22 nt, Homo sapiens
cugagcccagccuacuuuucag

SEQ ID NO: 1212709 - RNA, 22 nt, Homo sapiens
cugagcccuacucccugcagau

SEQ ID NO: 1212710 - RNA, 19 nt, Homo sapiens
cugagccuggcccauagaa

SEQ ID NO: 1212711 - RNA, 20 nt, Homo sapiens
cugagcgggaggcagaguuu

SEQ ID NO: 1212712 - RNA, 23 nt, Homo sapiens
cugagcgggaggcagaguuugcc

SEQ ID NO: 1212713 - RNA, 13 nt, Homo sapiens
cugagcuauuuca

SEQ ID NO: 1212714 - RNA, 17 nt, Homo sapiens
cugaggacacucagugu

SEQ ID NO: 1212715 - RNA, 13 nt, Homo sapiens
cugaggauuucaa

SEQ ID NO: 1212716 - RNA, 22 nt, Homo sapiens
cugaggcaagagaauugcuuga

SEQ ID NO: 1212717 - RNA, 18 nt, Homo sapiens
cugaggcagaaggauuac

SEQ ID NO: 1212718 - RNA, 22 nt, Homo sapiens
cugaggcagguggauugcuuga

SEQ ID NO: 1212719 - RNA, 16 nt, Homo sapiens
cugagggaaagugcau

SEQ ID NO: 1212720 - RNA, 16 nt, Homo sapiens
cugagggcagacuggg

SEQ ID NO: 1212721 - RNA, 22 nt, Homo sapiens
cugaggguccccaccugggacc

SEQ ID NO: 1212722 - RNA, 17 nt, Homo sapiens
cugagguauaaagacaa

SEQ ID NO: 1212723 - RNA, 16 nt, Homo sapiens
cugaggucucuugagg

SEQ ID NO: 1212724 - RNA, 14 nt, Homo sapiens
cugagguuaugaac

SEQ ID NO: 1212725 - RNA, 17 nt, Homo sapiens
cugagguuggauuugcu

SEQ ID NO: 1212726 - RNA, 16 nt, Homo sapiens
cugagucagacuguca

SEQ ID NO: 1212727 - RNA, 13 nt, Homo sapiens
cugagucucugaa

SEQ ID NO: 1212728 - RNA, 13 nt, Homo sapiens
cugagugauccac

SEQ ID NO: 1212729 - RNA, 23 nt, Homo sapiens
cugagugcuagaguaggugcaga

SEQ ID NO: 1212730 - RNA, 19 nt, Homo sapiens
cugagugggagaaggcagu

SEQ ID NO: 1212731 - RNA, 15 nt, Homo sapiens
cugaguggugccaaa

SEQ ID NO: 1212732 - RNA, 21 nt, Homo sapiens
cugaguguccagcacaccugc

SEQ ID NO: 1212733 - RNA, 17 nt, Homo sapiens
cugaguguuauuugcac

SEQ ID NO: 1212734 - RNA, 19 nt, Homo sapiens
cugaguuuagggucaagga

SEQ ID NO: 1212735 - RNA, 17 nt, Homo sapiens
cugauaauaauugauca

SEQ ID NO: 1212736 - RNA, 16 nt, Homo sapiens
cugauaccacugcacu

SEQ ID NO: 1212737 - RNA, 12 nt, Homo sapiens
cugauaccucaa

SEQ ID NO: 1212738 - RNA, 18 nt, Homo sapiens
cugauacuagacuagaca

SEQ ID NO: 1212739 - RNA, 12 nt, Homo sapiens
cugauacugcug

SEQ ID NO: 1212740 - RNA, 23 nt, Homo sapiens
cugauauaacaaacuacauguaa

SEQ ID NO: 1212741 - RNA, 13 nt, Homo sapiens
cugauauaauuua

SEQ ID NO: 1212742 - RNA, 18 nt, Homo sapiens
cugauaugggacugagcc

SEQ ID NO: 1212743 - RNA, 16 nt, Homo sapiens
cugauauuaaucaaaa

SEQ ID NO: 1212744 - RNA, 20 nt, Homo sapiens
cugaucaauugaccuuguga

SEQ ID NO: 1212745 - RNA, 16 nt, Homo sapiens
cugauccuaacugaag

SEQ ID NO: 1212746 - RNA, 23 nt, Homo sapiens
cugaucguagaaaauuugcuuua

SEQ ID NO: 1212747 - RNA, 24 nt, Homo sapiens
cugaucugcggaucucagcuuuga

SEQ ID NO: 1212748 - RNA, 13 nt, Homo sapiens
cugaucugugaua

SEQ ID NO: 1212749 - RNA, 15 nt, Homo sapiens
cugaugaaucacugu

SEQ ID NO: 1212750 - RNA, 21 nt, Homo sapiens
cugaugacacaggcugacuca

SEQ ID NO: 1212751 - RNA, 23 nt, Homo sapiens
cugaugacauuccaccauuguga

SEQ ID NO: 1212752 - RNA, 16 nt, Homo sapiens
cugaugagaauacuga

SEQ ID NO: 1212753 - RNA, 17 nt, Homo sapiens
cugaugccaauacuagu

SEQ ID NO: 1212754 - RNA, 18 nt, Homo sapiens
cugaugccuguguacugc

SEQ ID NO: 1212755 - RNA, 17 nt, Homo sapiens
cugaugccuuuuggacc

SEQ ID NO: 1212756 - RNA, 15 nt, Homo sapiens
cugaugcugggaccc

SEQ ID NO: 1212757 - RNA, 16 nt, Homo sapiens
cugaugcuuuggugug

SEQ ID NO: 1212758 - RNA, 20 nt, Homo sapiens
cugauggaaguaaagccuca

SEQ ID NO: 1212759 - RNA, 14 nt, Homo sapiens
cugauggaccagga

SEQ ID NO: 1212760 - RNA, 21 nt, Homo sapiens
cugauggcuugacaugugcaa

SEQ ID NO: 1212761 - RNA, 15 nt, Homo sapiens
cugaugggcaucauu

SEQ ID NO: 1212762 - RNA, 16 nt, Homo sapiens
cugaugugacauucca

SEQ ID NO: 1212763 - RNA, 18 nt, Homo sapiens
cugauguguccucaggga

SEQ ID NO: 1212764 - RNA, 17 nt, Homo sapiens
cugauuacccaaugcac

SEQ ID NO: 1212765 - RNA, 19 nt, Homo sapiens
cugauuagaaaugaccaau

SEQ ID NO: 1212766 - RNA, 15 nt, Homo sapiens
cugauucacugcaug

SEQ ID NO: 1212767 - RNA, 22 nt, Homo sapiens
cugauugcagcacagagcagug

SEQ ID NO: 1212768 - RNA, 12 nt, Homo sapiens
cugauugggcac

SEQ ID NO: 1212769 - RNA, 13 nt, Homo sapiens
cugauuucuugcu

SEQ ID NO: 1212770 - RNA, 20 nt, Homo sapiens
cugauuugauaccauggcac

SEQ ID NO: 1212771 - RNA, 14 nt, Homo sapiens
cugauuugaugaua

SEQ ID NO: 1212772 - RNA, 16 nt, Homo sapiens
cugauuuucuggaaug

SEQ ID NO: 1212773 - RNA, 16 nt, Homo sapiens
cugcaaaaaaagccuc

SEQ ID NO: 1212774 - RNA, 23 nt, Homo sapiens
cugcaaaaaugaaauccagugag

SEQ ID NO: 1212775 - RNA, 16 nt, Homo sapiens
cugcaaaacacuaaag

SEQ ID NO: 1212776 - RNA, 14 nt, Homo sapiens
cugcaaaccuuccu

SEQ ID NO: 1212777 - RNA, 19 nt, Homo sapiens
cugcaaacucacugcucaa

SEQ ID NO: 1212778 - RNA, 19 nt, Homo sapiens
cugcaaaggcgcagugcuu

SEQ ID NO: 1212779 - RNA, 19 nt, Homo sapiens
cugcaaaguguaugugacc

SEQ ID NO: 1212780 - RNA, 17 nt, Homo sapiens
cugcaaauugccugcaa

SEQ ID NO: 1212781 - RNA, 19 nt, Homo sapiens
cugcaaggauucagcauua

SEQ ID NO: 1212782 - RNA, 17 nt, Homo sapiens
cugcaauuuuaauugau

SEQ ID NO: 1212783 - RNA, 20 nt, Homo sapiens
cugcaauuuuaauugauuau

SEQ ID NO: 1212784 - RNA, 15 nt, Homo sapiens
cugcacaacaagaua

SEQ ID NO: 1212785 - RNA, 21 nt, Homo sapiens
cugcacagauggauuugccug

SEQ ID NO: 1212786 - RNA, 11 nt, Homo sapiens
cugcacaggcu

SEQ ID NO: 1212787 - RNA, 12 nt, Homo sapiens
cugcacaugugc

SEQ ID NO: 1212788 - RNA, 16 nt, Homo sapiens
cugcaccaacucaccu

SEQ ID NO: 1212789 - RNA, 20 nt, Homo sapiens
cugcaccagagcaaccucuc

SEQ ID NO: 1212790 - RNA, 20 nt, Homo sapiens
cugcaccagugugacaucua

SEQ ID NO: 1212791 - RNA, 17 nt, Homo sapiens
cugcacccaacuacuga

SEQ ID NO: 1212792 - RNA, 16 nt, Homo sapiens
cugcacccacccagga

SEQ ID NO: 1212793 - RNA, 23 nt, Homo sapiens
cucaacauuguguucccauuuca

SEQ ID NO: 1212794 - RNA, 19 nt, Homo sapiens
cucaacugccuacuccaaa

SEQ ID NO: 1212795 - RNA, 17 nt, Homo sapiens
cucaacuuuaagauaga

SEQ ID NO: 1212796 - RNA, 14 nt, Homo sapiens
cucaagaacacaug

SEQ ID NO: 1212797 - RNA, 20 nt, Homo sapiens
cucaagccccauuuccucac

SEQ ID NO: 1212798 - RNA, 19 nt, Homo sapiens
cucaagguuuuagguucua

SEQ ID NO: 1212799 - RNA, 15 nt, Homo sapiens
cucaaguaccaccaa

SEQ ID NO: 1212800 - RNA, 14 nt, Homo sapiens
cucaaguacucaaa

SEQ ID NO: 1212801 - RNA, 12 nt, Homo sapiens
cucaaguucuaa

SEQ ID NO: 1212802 - RNA, 19 nt, Homo sapiens
cucaaguucuaagauucua

SEQ ID NO: 1212803 - RNA, 16 nt, Homo sapiens
cucaauaaacauuuca

SEQ ID NO: 1212804 - RNA, 19 nt, Homo sapiens
cucaauaaauugcaacaua

SEQ ID NO: 1212805 - RNA, 12 nt, Homo sapiens
cucaauguuuga

SEQ ID NO: 1212806 - RNA, 21 nt, Homo sapiens
cucaauguuugaggagcaugu

SEQ ID NO: 1212807 - RNA, 20 nt, Homo sapiens
cucaauuuugucuguacuca

SEQ ID NO: 1212808 - RNA, 16 nt, Homo sapiens
cucaauuuuugucuca

SEQ ID NO: 1212809 - RNA, 12 nt, Homo sapiens
cucacaaacagu

SEQ ID NO: 1212810 - RNA, 22 nt, Homo sapiens
cucacaaaguccacuuuacuca

SEQ ID NO: 1212811 - RNA, 23 nt, Homo sapiens
cucacaacuuggguucuucucag

SEQ ID NO: 1212812 - RNA, 18 nt, Homo sapiens
cucacaaggaaaaggcca

SEQ ID NO: 1212813 - RNA, 15 nt, Homo sapiens
cucacacacacagcu

SEQ ID NO: 1212814 - RNA, 16 nt, Homo sapiens
cucacacccacacaaa

SEQ ID NO: 1212815 - RNA, 19 nt, Homo sapiens
cucacaccuguaaucccaa

SEQ ID NO: 1212816 - RNA, 14 nt, Homo sapiens
cucacaggccucuc

SEQ ID NO: 1212817 - RNA, 22 nt, Homo sapiens
cucacaguaacccaaaccucaa

SEQ ID NO: 1212818 - RNA, 16 nt, Homo sapiens
cucacaucuguccaga

SEQ ID NO: 1212819 - RNA, 17 nt, Homo sapiens
cucacauuuauucugcu

SEQ ID NO: 1212820 - RNA, 19 nt, Homo sapiens
cucacauuuauucugcuca

SEQ ID NO: 1212821 - RNA, 13 nt, Homo sapiens
cucaccaagguga

SEQ ID NO: 1212822 - RNA, 22 nt, Homo sapiens
cucaccaccacacuacacagca

SEQ ID NO: 1212823 - RNA, 13 nt, Homo sapiens
cucaccagaucuc

SEQ ID NO: 1212824 - RNA, 14 nt, Homo sapiens
cucaccagaucuca

SEQ ID NO: 1212825 - RNA, 14 nt, Homo sapiens
cucaccccugggca

SEQ ID NO: 1212826 - RNA, 15 nt, Homo sapiens
cucaccucuugccuu

SEQ ID NO: 1212827 - RNA, 16 nt, Homo sapiens
cucaccuggacuccag

SEQ ID NO: 1212828 - RNA, 22 nt, Homo sapiens
cucacuaggcccccacuugccu

SEQ ID NO: 1212829 - RNA, 23 nt, Homo sapiens
cucacugagucuuaacuuuucac

SEQ ID NO: 1212830 - RNA, 13 nt, Homo sapiens
cucacuguagcag

SEQ ID NO: 1212831 - RNA, 21 nt, Homo sapiens
cucacugugggaaggccagcu

SEQ ID NO: 1212832 - RNA, 19 nt, Homo sapiens
cucacuguucaaucauuga

SEQ ID NO: 1212833 - RNA, 20 nt, Homo sapiens
cucacuugaaugugucacua

SEQ ID NO: 1212834 - RNA, 17 nt, Homo sapiens
cucagaacaauccgauu

SEQ ID NO: 1212835 - RNA, 23 nt, Homo sapiens
cucagaauauacccauccaugca

SEQ ID NO: 1212836 - RNA, 17 nt, Homo sapiens
cucagaccaaucaucaa

SEQ ID NO: 1212837 - RNA, 22 nt, Homo sapiens
cucagaccccaggucagcaucu

SEQ ID NO: 1212838 - RNA, 17 nt, Homo sapiens
cucagaugaggacagag

SEQ ID NO: 1212839 - RNA, 16 nt, Homo sapiens
cucagauuauuuuucc

SEQ ID NO: 1212840 - RNA, 11 nt, Homo sapiens
cucagcacagg

SEQ ID NO: 1212841 - RNA, 13 nt, Homo sapiens
cucagcacaggcc

SEQ ID NO: 1212842 - RNA, 23 nt, Homo sapiens
cucagcacuuuggacauggcuca

SEQ ID NO: 1212843 - RNA, 18 nt, Homo sapiens
cucagcaguugacaucca

SEQ ID NO: 1212844 - RNA, 23 nt, Homo sapiens
cucagccuacuuucacacuaaga

SEQ ID NO: 1212845 - RNA, 23 nt, Homo sapiens
cucagcuaugcccggaccuccau

SEQ ID NO: 1212846 - RNA, 16 nt, Homo sapiens
cucagcuggcuguaug

SEQ ID NO: 1212847 - RNA, 23 nt, Homo sapiens
cucagcuucuucacaggcacucc

SEQ ID NO: 1212848 - RNA, 20 nt, Homo sapiens
cucaggaaaaaccagccacu

SEQ ID NO: 1212849 - RNA, 16 nt, Homo sapiens
cucaggaauucagugc

SEQ ID NO: 1212850 - RNA, 16 nt, Homo sapiens
cucaggagaagggaua

SEQ ID NO: 1212851 - RNA, 22 nt, Homo sapiens
cucaggauauuaguuaaugagc

SEQ ID NO: 1212852 - RNA, 22 nt, Homo sapiens
cucaggauccagucccuuacac

SEQ ID NO: 1212853 - RNA, 14 nt, Homo sapiens
cucaggcacacagc

SEQ ID NO: 1212854 - RNA, 13 nt, Homo sapiens
cucaggcaccugc

SEQ ID NO: 1212855 - RNA, 15 nt, Homo sapiens
cucaggcagaucuca

SEQ ID NO: 1212856 - RNA, 16 nt, Homo sapiens
cucaggcuggugggag

SEQ ID NO: 1212857 - RNA, 17 nt, Homo sapiens
cucaggcuuccuuggca

SEQ ID NO: 1212858 - RNA, 17 nt, Homo sapiens
cucagggagcagggaag

SEQ ID NO: 1212859 - RNA, 23 nt, Homo sapiens
cucagggccuggcaggccagugu

SEQ ID NO: 1212860 - RNA, 22 nt, Homo sapiens
cucagguagaagguugacacag

SEQ ID NO: 1212861 - RNA, 14 nt, Homo sapiens
cucaggucccugca

SEQ ID NO: 1212862 - RNA, 21 nt, Homo sapiens
cucaggugaaaauccaucuca

SEQ ID NO: 1212863 - RNA, 15 nt, Homo sapiens
cucaguaaaaguaaa

SEQ ID NO: 1212864 - RNA, 12 nt, Homo sapiens
cucaguaauucc

SEQ ID NO: 1212865 - RNA, 13 nt, Homo sapiens
cucaguaccccau

SEQ ID NO: 1212866 - RNA, 24 nt, Homo sapiens
cucaguccacugcugaggacacuc

SEQ ID NO: 1212867 - RNA, 23 nt, Homo sapiens
cucaguccugggucaacaucuua

SEQ ID NO: 1212868 - RNA, 19 nt, Homo sapiens
cucaguccuguacucuggg

SEQ ID NO: 1212869 - RNA, 12 nt, Homo sapiens
cucagugagaua

SEQ ID NO: 1212870 - RNA, 22 nt, Homo sapiens
cucagugagauauuugguacca

SEQ ID NO: 1212871 - RNA, 11 nt, Homo sapiens
cucagugccac

SEQ ID NO: 1212872 - RNA, 12 nt, Homo sapiens
cucagugccugg

SEQ ID NO: 1212873 - RNA, 19 nt, Homo sapiens
cucagugcuugggcuccac

SEQ ID NO: 1212874 - RNA, 15 nt, Homo sapiens
cucaguggaucuuca

SEQ ID NO: 1212875 - RNA, 17 nt, Homo sapiens
cucaguucuacacugau

SEQ ID NO: 1212876 - RNA, 20 nt, Homo sapiens
cucaguucuacacugauaca

SEQ ID NO: 1212877 - RNA, 15 nt, Homo sapiens
cucaguuucuaggca

SEQ ID NO: 1212878 - RNA, 16 nt, Homo sapiens
cucaguuucuaggcac

SEQ ID NO: 1212879 - RNA, 18 nt, Homo sapiens
cucaguuugugugucuua

SEQ ID NO: 1212880 - RNA, 15 nt, Homo sapiens
cucauaaaaagcaaa

SEQ ID NO: 1212881 - RNA, 12 nt, Homo sapiens
cucauaccucag

SEQ ID NO: 1212882 - RNA, 14 nt, Homo sapiens
cucauagcauuaac

SEQ ID NO: 1212883 - RNA, 21 nt, Homo sapiens
cucauaguucucuuuaagcca

SEQ ID NO: 1212884 - RNA, 13 nt, Homo sapiens
cucaucacuagga

SEQ ID NO: 1212885 - RNA, 13 nt, Homo sapiens
cucaucacuggau

SEQ ID NO: 1212886 - RNA, 22 nt, Homo sapiens
cucaucaguguccucuugcuca

SEQ ID NO: 1212887 - RNA, 22 nt, Homo sapiens
cucaucauaaaauaaaguauau

SEQ ID NO: 1212888 - RNA, 15 nt, Homo sapiens
cucaucccaugagac

SEQ ID NO: 1212889 - RNA, 12 nt, Homo sapiens
cucauccuggca

SEQ ID NO: 1212890 - RNA, 19 nt, Homo sapiens
cucauccuggcacgcccua

SEQ ID NO: 1212891 - RNA, 18 nt, Homo sapiens
cucaugaccucucagaau

SEQ ID NO: 1212892 - RNA, 22 nt, Homo sapiens
cucaugcuguugcugcuacugu

SEQ ID NO: 1212893 - RNA, 15 nt, Homo sapiens
cucauggcacccagg

SEQ ID NO: 1212894 - RNA, 23 nt, Homo sapiens
cucauguuguugaggcugucaca

SEQ ID NO: 1212895 - RNA, 17 nt, Homo sapiens
cucauuauuuuucacug

SEQ ID NO: 1212896 - RNA, 18 nt, Homo sapiens
cucauuccuguagucaaa

SEQ ID NO: 1212897 - RNA, 16 nt, Homo sapiens
cucauuccuucacuca

SEQ ID NO: 1212898 - RNA, 17 nt, Homo sapiens
cucauucugaggccuga

SEQ ID NO: 1212899 - RNA, 15 nt, Homo sapiens
cucauugaaauguca

SEQ ID NO: 1212900 - RNA, 17 nt, Homo sapiens
cucauuuagaacuugca

SEQ ID NO: 1212901 - RNA, 21 nt, Homo sapiens
cucauuuagaacuugcagcug

SEQ ID NO: 1212902 - RNA, 22 nt, Homo sapiens
cucauuucuggaaagugcaauu

SEQ ID NO: 1212903 - RNA, 22 nt, Homo sapiens
cuccuuacgcuuugucacacaa

SEQ ID NO: 1212904 - RNA, 15 nt, Homo sapiens
cuccuuccacaugua

SEQ ID NO: 1212905 - RNA, 16 nt, Homo sapiens
cuccuuccacauguac

SEQ ID NO: 1212906 - RNA, 17 nt, Homo sapiens
cuccuuccacauguaca

SEQ ID NO: 1212907 - RNA, 22 nt, Homo sapiens
cuccuucccauuucucuacacu

SEQ ID NO: 1212908 - RNA, 21 nt, Homo sapiens
cuccuugacugccgcaucaug

SEQ ID NO: 1212909 - RNA, 16 nt, Homo sapiens
cuccuugagacuggag

SEQ ID NO: 1212910 - RNA, 15 nt, Homo sapiens
cuccuugagcccuug

SEQ ID NO: 1212911 - RNA, 16 nt, Homo sapiens
cuccuugcaggugaca

SEQ ID NO: 1212912 - RNA, 11 nt, Homo sapiens
cuccuuuacaa

SEQ ID NO: 1212913 - RNA, 18 nt, Homo sapiens
cuccuuuagaguugcaug

SEQ ID NO: 1212914 - RNA, 19 nt, Homo sapiens
cuccuuucuccugugaaug

SEQ ID NO: 1212915 - RNA, 14 nt, Homo sapiens
cuccuuucucuuau

SEQ ID NO: 1212916 - RNA, 14 nt, Homo sapiens
cuccuuugcacuga

SEQ ID NO: 1212917 - RNA, 18 nt, Homo sapiens
cuccuuuggaauggugua

SEQ ID NO: 1212918 - RNA, 15 nt, Homo sapiens
cucgaaacacagaaa

SEQ ID NO: 1212919 - RNA, 14 nt, Homo sapiens
cucgacaagaccac

SEQ ID NO: 1212920 - RNA, 19 nt, Homo sapiens
cucgacaagaccacacuuu

SEQ ID NO: 1212921 - RNA, 17 nt, Homo sapiens
cucgacauuuggugaga

SEQ ID NO: 1212922 - RNA, 16 nt, Homo sapiens
cucgaggccugcaaac

SEQ ID NO: 1212923 - RNA, 16 nt, Homo sapiens
cucgaugaagcccaau

SEQ ID NO: 1212924 - RNA, 23 nt, Homo sapiens
cucgauuagacuccauguaguua

SEQ ID NO: 1212925 - RNA, 13 nt, Homo sapiens
cucuuccacagga

SEQ ID NO: 1212926 - RNA, 18 nt, Homo sapiens
cucuuccccuugcccuug

SEQ ID NO: 1212927 - RNA, 22 nt, Homo sapiens
cucuuccuacccaaccacucaa

SEQ ID NO: 1212928 - RNA, 15 nt, Homo sapiens
cucuuccugugaucc

SEQ ID NO: 1212929 - RNA, 16 nt, Homo sapiens
cucuucucugcaaugc

SEQ ID NO: 1212930 - RNA, 13 nt, Homo sapiens
cucuucuguggac

SEQ ID NO: 1212931 - RNA, 22 nt, Homo sapiens
cucuucuuacucauuacugcaa

SEQ ID NO: 1212932 - RNA, 22 nt, Homo sapiens
cucuucuucuuuccuuccauca

SEQ ID NO: 1212933 - RNA, 19 nt, Homo sapiens
cucuugaaaauagaacaac

SEQ ID NO: 1212934 - RNA, 14 nt, Homo sapiens
cucuugacauucca

SEQ ID NO: 1212935 - RNA, 22 nt, Homo sapiens
cucuugagguggugccuucuca

SEQ ID NO: 1212936 - RNA, 17 nt, Homo sapiens
cucuugagucacacugc

SEQ ID NO: 1212937 - RNA, 12 nt, Homo sapiens
cucuugcucaaa

SEQ ID NO: 1212938 - RNA, 12 nt, Homo sapiens
cucuugcugucu

SEQ ID NO: 1212939 - RNA, 21 nt, Homo sapiens
cucuuggaauuacaagcccug

SEQ ID NO: 1212940 - RNA, 12 nt, Homo sapiens
cucuuggcaguc

SEQ ID NO: 1212941 - RNA, 19 nt, Homo sapiens
cucuuggccuuugcauuua

SEQ ID NO: 1212942 - RNA, 16 nt, Homo sapiens
cucuugggaagaccag

SEQ ID NO: 1212943 - RNA, 20 nt, Homo sapiens
cucuugugaauuauucugau

SEQ ID NO: 1212944 - RNA, 17 nt, Homo sapiens
cucuuuaaauggcuuua

SEQ ID NO: 1212945 - RNA, 12 nt, Homo sapiens
cucuuuaacuuc

SEQ ID NO: 1212946 - RNA, 15 nt, Homo sapiens
cucuuuaaugucaca

SEQ ID NO: 1212947 - RNA, 15 nt, Homo sapiens
cucuuuccuugcuca

SEQ ID NO: 1212948 - RNA, 17 nt, Homo sapiens
cucuuucuacaugacug

SEQ ID NO: 1212949 - RNA, 18 nt, Homo sapiens
cucuuucucucuucccuc

SEQ ID NO: 1212950 - RNA, 17 nt, Homo sapiens
cucuuucucugccagug

SEQ ID NO: 1212951 - RNA, 18 nt, Homo sapiens
cucuuucuguauauacuu

SEQ ID NO: 1212952 - RNA, 12 nt, Homo sapiens
cucuuugcugca

SEQ ID NO: 1212953 - RNA, 15 nt, Homo sapiens
cucuuugcugcacua

SEQ ID NO: 1212954 - RNA, 17 nt, Homo sapiens
cucuuugcugcacuauu

SEQ ID NO: 1212955 - RNA, 13 nt, Homo sapiens
cucuuuggggcua

SEQ ID NO: 1212956 - RNA, 14 nt, Homo sapiens
cucuuuuagcugau

SEQ ID NO: 1212957 - RNA, 17 nt, Homo sapiens
cucuuuucaaaacauuu

SEQ ID NO: 1212958 - RNA, 20 nt, Homo sapiens
cucuuuucccucucuaggcc

SEQ ID NO: 1212959 - RNA, 16 nt, Homo sapiens
cucuuuucuacauaca

SEQ ID NO: 1212960 - RNA, 20 nt, Homo sapiens
cucuuuucuacauacauuau

SEQ ID NO: 1212961 - RNA, 21 nt, Homo sapiens
cucuuuuuccaucauaauucu

SEQ ID NO: 1212962 - RNA, 15 nt, Homo sapiens
cugaaaaacauucca

SEQ ID NO: 1212963 - RNA, 23 nt, Homo sapiens
cugaaaaaugguaauuguugcua

SEQ ID NO: 1212964 - RNA, 14 nt, Homo sapiens
cugaaaacuacaca

SEQ ID NO: 1212965 - RNA, 17 nt, Homo sapiens
cugaaaacuacacaaau

SEQ ID NO: 1212966 - RNA, 19 nt, Homo sapiens
cugaaaagacucaguguuc

SEQ ID NO: 1212967 - RNA, 14 nt, Homo sapiens
cugaaaaugcaaag

SEQ ID NO: 1212968 - RNA, 14 nt, Homo sapiens
cugaaacacacuga

SEQ ID NO: 1212969 - RNA, 20 nt, Homo sapiens
cugaaagaugggcaaaagac

SEQ ID NO: 1212970 - RNA, 17 nt, Homo sapiens
cugaaagccuuagggaa

SEQ ID NO: 1212971 - RNA, 15 nt, Homo sapiens
cugaaaggaugaucc

SEQ ID NO: 1212972 - RNA, 16 nt, Homo sapiens
cugaaagggcacuuaa

SEQ ID NO: 1212973 - RNA, 15 nt, Homo sapiens
cugaaaguuacccac

SEQ ID NO: 1212974 - RNA, 20 nt, Homo sapiens
cugaaauacguggcauuauu

SEQ ID NO: 1212975 - RNA, 12 nt, Homo sapiens
cugaaaugccuc

SEQ ID NO: 1212976 - RNA, 23 nt, Homo sapiens
cugaaauuuaucuuuucuucuau

SEQ ID NO: 1212977 - RNA, 16 nt, Homo sapiens
cugaacaaacuaaagg

SEQ ID NO: 1212978 - RNA, 23 nt, Homo sapiens
cugaacauaggaaaauagaaacu

SEQ ID NO: 1212979 - RNA, 22 nt, Homo sapiens
cugaacuaauaaaucuguugcc

SEQ ID NO: 1212980 - RNA, 20 nt, Homo sapiens
cugaacuacauaacuuccua

SEQ ID NO: 1212981 - RNA, 19 nt, Homo sapiens
cugaacucaaacugaggaa

SEQ ID NO: 1212982 - RNA, 21 nt, Homo sapiens
cugaacucuucagaacacaca

SEQ ID NO: 1212983 - RNA, 21 nt, Homo sapiens
cugaagaaacuucccaagugu

SEQ ID NO: 1212984 - RNA, 21 nt, Homo sapiens
cugaagaagaucccagaggau

SEQ ID NO: 1212985 - RNA, 12 nt, Homo sapiens
cugaagauauau

SEQ ID NO: 1212986 - RNA, 13 nt, Homo sapiens
cugaagccauagc

SEQ ID NO: 1212987 - RNA, 16 nt, Homo sapiens
cugaagcccauuucuc

SEQ ID NO: 1212988 - RNA, 21 nt, Homo sapiens
cugaagcguuuuucucaaagg

SEQ ID NO: 1212989 - RNA, 21 nt, Homo sapiens
cugaagcuuaggacuaccagc

SEQ ID NO: 1212990 - RNA, 20 nt, Homo sapiens
cugaaggaauagccagagag

SEQ ID NO: 1212991 - RNA, 15 nt, Homo sapiens
cugaaggcauaugca

SEQ ID NO: 1212992 - RNA, 18 nt, Homo sapiens
cugaaggggcacaccacu

SEQ ID NO: 1212993 - RNA, 15 nt, Homo sapiens
cugaaggucccaccu

SEQ ID NO: 1212994 - RNA, 14 nt, Homo sapiens
cugaaguacuuaaa

SEQ ID NO: 1212995 - RNA, 20 nt, Homo sapiens
cugaaguacuuaaacuucca

SEQ ID NO: 1212996 - RNA, 12 nt, Homo sapiens
cugaagugcuua

SEQ ID NO: 1212997 - RNA, 19 nt, Homo sapiens
cugaagugguugcauucua

SEQ ID NO: 1212998 - RNA, 20 nt, Homo sapiens
cugaaguugcucuguaccca

SEQ ID NO: 1212999 - RNA, 20 nt, Homo sapiens
cugaauaaauaauucuuccu

SEQ ID NO: 1213000 - RNA, 19 nt, Homo sapiens
cugaauaaauugaacuaaa

SEQ ID NO: 1213001 - RNA, 16 nt, Homo sapiens
cugaauaacuugaaga

SEQ ID NO: 1213002 - RNA, 20 nt, Homo sapiens
cugaauaccacuuaccucaa

SEQ ID NO: 1213003 - RNA, 12 nt, Homo sapiens
cugaauccucau

SEQ ID NO: 1213004 - RNA, 17 nt, Homo sapiens
cugaauguuacaacgaa

SEQ ID NO: 1213005 - RNA, 22 nt, Homo sapiens
cugaauuaugauggucugcauu

SEQ ID NO: 1213006 - RNA, 20 nt, Homo sapiens
cugaauuccagcaaaagagc

SEQ ID NO: 1213007 - RNA, 20 nt, Homo sapiens
cugacaaguuauuacugucu

SEQ ID NO: 1213008 - RNA, 22 nt, Homo sapiens
cugacaaugggcacacagggaa

SEQ ID NO: 1213009 - RNA, 15 nt, Homo sapiens
cugacacaagaggaa

SEQ ID NO: 1213010 - RNA, 13 nt, Homo sapiens
cugacacaggaaa

SEQ ID NO: 1213011 - RNA, 18 nt, Homo sapiens
cugacacauagaaaacaa

SEQ ID NO: 1213012 - RNA, 14 nt, Homo sapiens
cugacaccagagcc

SEQ ID NO: 1213013 - RNA, 22 nt, Homo sapiens
cugacacggccucccucugcua

SEQ ID NO: 1213014 - RNA, 22 nt, Homo sapiens
cugacacuucaaggugacagaa

SEQ ID NO: 1213015 - RNA, 21 nt, Homo sapiens
cugacagaaggugccacuuua

SEQ ID NO: 1213016 - RNA, 23 nt, Homo sapiens
cugacaguuaauaaaccuuugca

SEQ ID NO: 1213017 - RNA, 21 nt, Homo sapiens
cugacaguuguuuugcuucuu

SEQ ID NO: 1213018 - RNA, 18 nt, Homo sapiens
cugacauaauggggauua

SEQ ID NO: 1213019 - RNA, 18 nt, Homo sapiens
cugacauucacacagaga

SEQ ID NO: 1213020 - RNA, 11 nt, Homo sapiens
cugaccaaaac

SEQ ID NO: 1213021 - RNA, 16 nt, Homo sapiens
cugaccaaaacaaaca

SEQ ID NO: 1213022 - RNA, 15 nt, Homo sapiens
cugaccaagagagaa

SEQ ID NO: 1213023 - RNA, 20 nt, Homo sapiens
cugaccacuaauagcauugu

SEQ ID NO: 1213024 - RNA, 18 nt, Homo sapiens
cugaccaucgcacaccgg

SEQ ID NO: 1213025 - RNA, 13 nt, Homo sapiens
cugacccacugcu

SEQ ID NO: 1213026 - RNA, 17 nt, Homo sapiens
cugaccucacugugacc

SEQ ID NO: 1213027 - RNA, 19 nt, Homo sapiens
cugaccuggagaugcugcc

SEQ ID NO: 1213028 - RNA, 21 nt, Homo sapiens
cugaccuugcugauggugaca

SEQ ID NO: 1213029 - RNA, 16 nt, Homo sapiens
cugacgcaaaaccacu

SEQ ID NO: 1213030 - RNA, 16 nt, Homo sapiens
cugacuaauuaggcaa

SEQ ID NO: 1213031 - RNA, 23 nt, Homo sapiens
cugacuaauuuuuguauuuuuag

SEQ ID NO: 1213032 - RNA, 14 nt, Homo sapiens
cugacuacugccca

SEQ ID NO: 1213033 - RNA, 18 nt, Homo sapiens
cugacucuccuccuugag

SEQ ID NO: 1213034 - RNA, 16 nt, Homo sapiens
cugacuggcaaaggac

SEQ ID NO: 1213035 - RNA, 16 nt, Homo sapiens
cugacuguacuccucc

SEQ ID NO: 1213036 - RNA, 17 nt, Homo sapiens
cugacuugaguguuccu

SEQ ID NO: 1213037 - RNA, 16 nt, Homo sapiens
cugacuuggcacuuaa

SEQ ID NO: 1213038 - RNA, 13 nt, Homo sapiens
cugagaaaccucg

SEQ ID NO: 1213039 - RNA, 21 nt, Homo sapiens
cugagaaagagaaugagaaga

SEQ ID NO: 1213040 - RNA, 16 nt, Homo sapiens
cugagaaauggccaaa

SEQ ID NO: 1213041 - RNA, 21 nt, Homo sapiens
cugagaaauguuaaagguuca

SEQ ID NO: 1213042 - RNA, 17 nt, Homo sapiens
cugagaaauguucagaa

SEQ ID NO: 1213043 - RNA, 14 nt, Homo sapiens
cugagaagaucuga

SEQ ID NO: 1213044 - RNA, 14 nt, Homo sapiens
cugagacagacaca

SEQ ID NO: 1213045 - RNA, 16 nt, Homo sapiens
cugagacagugaauuu

SEQ ID NO: 1213046 - RNA, 23 nt, Homo sapiens
cugagaccaguugggagcacugg

SEQ ID NO: 1213047 - RNA, 17 nt, Homo sapiens
cugagagaauuggcuca

SEQ ID NO: 1213048 - RNA, 13 nt, Homo sapiens
cugagagaugaca

SEQ ID NO: 1213049 - RNA, 20 nt, Homo sapiens
cugagagccgggaaggggaa

SEQ ID NO: 1213050 - RNA, 15 nt, Homo sapiens
cugagagucugagaa

SEQ ID NO: 1213051 - RNA, 21 nt, Homo sapiens
cugagagugaaaccaugacug

SEQ ID NO: 1213052 - RNA, 16 nt, Homo sapiens
gaagaccguuuaccua

SEQ ID NO: 1213053 - RNA, 18 nt, Homo sapiens
gaagacucgcccucgcca

SEQ ID NO: 1213054 - RNA, 13 nt, Homo sapiens
gaagagaagacau

SEQ ID NO: 1213055 - RNA, 18 nt, Homo sapiens
gaagagaaggaagccaua

SEQ ID NO: 1213056 - RNA, 19 nt, Homo sapiens
gaagagcguagacaggugu

SEQ ID NO: 1213057 - RNA, 14 nt, Homo sapiens
gaagagcuuggaaa

SEQ ID NO: 1213058 - RNA, 17 nt, Homo sapiens
gaagagggacagaugaa

SEQ ID NO: 1213059 - RNA, 19 nt, Homo sapiens
gaagagguugggcuuccau

SEQ ID NO: 1213060 - RNA, 23 nt, Homo sapiens
gaagaguguuucuuccacaacag

SEQ ID NO: 1213061 - RNA, 19 nt, Homo sapiens
gaagaguuaagaagaaaau

SEQ ID NO: 1213062 - RNA, 23 nt, Homo sapiens
gaagauauuacuacuuaccauuu

SEQ ID NO: 1213063 - RNA, 21 nt, Homo sapiens
gaagaucuuugugaggugagc

SEQ ID NO: 1213064 - RNA, 23 nt, Homo sapiens
gaagaugacgaguaacuccccuc

SEQ ID NO: 1213065 - RNA, 18 nt, Homo sapiens
gaagaugaucauuugccc

SEQ ID NO: 1213066 - RNA, 18 nt, Homo sapiens
gaagauucuccugugcua

SEQ ID NO: 1213067 - RNA, 17 nt, Homo sapiens
gaagcaacuaggaaaau

SEQ ID NO: 1213068 - RNA, 19 nt, Homo sapiens
gaagcacuacaccuugccu

SEQ ID NO: 1213069 - RNA, 12 nt, Homo sapiens
gaagcacugccu

SEQ ID NO: 1213070 - RNA, 10 nt, Homo sapiens
gaagcacuuu

SEQ ID NO: 1213071 - RNA, 22 nt, Homo sapiens
gaagcaggugcuacaacaugug

SEQ ID NO: 1213072 - RNA, 17 nt, Homo sapiens
gaagcagucuugcucug

SEQ ID NO: 1213073 - RNA, 19 nt, Homo sapiens
gaagcauauuuugcugguu

SEQ ID NO: 1213074 - RNA, 17 nt, Homo sapiens
gaagcauuuacuuugug

SEQ ID NO: 1213075 - RNA, 17 nt, Homo sapiens
gaagccagccacagacc

SEQ ID NO: 1213076 - RNA, 14 nt, Homo sapiens
gaagcccauaucac

SEQ ID NO: 1213077 - RNA, 14 nt, Homo sapiens
gaagccccacuuga

SEQ ID NO: 1213078 - RNA, 23 nt, Homo sapiens
gaagcccugauguguccucaggg

SEQ ID NO: 1213079 - RNA, 20 nt, Homo sapiens
gaagccgucugacuccagag

SEQ ID NO: 1213080 - RNA, 17 nt, Homo sapiens
gaagccuggacucugcc

SEQ ID NO: 1213081 - RNA, 13 nt, Homo sapiens
gaagccuugccua

SEQ ID NO: 1213082 - RNA, 18 nt, Homo sapiens
gaagcgaaacacagagaa

SEQ ID NO: 1213083 - RNA, 18 nt, Homo sapiens
gaagcggauuuccaggga

SEQ ID NO: 1213084 - RNA, 19 nt, Homo sapiens
gaagcguuuuucucaaagg

SEQ ID NO: 1213085 - RNA, 22 nt, Homo sapiens
gaagcuaauguaggacuguaua

SEQ ID NO: 1213086 - RNA, 18 nt, Homo sapiens
gaagcuacuucuccacug

SEQ ID NO: 1213087 - RNA, 15 nt, Homo sapiens
gaagcugcauaugau

SEQ ID NO: 1213088 - RNA, 19 nt, Homo sapiens
gaagcuggaggcuccagga

SEQ ID NO: 1213089 - RNA, 15 nt, Homo sapiens
gaagcuuccauucca

SEQ ID NO: 1213090 - RNA, 13 nt, Homo sapiens
gaaggacauuuua

SEQ ID NO: 1213091 - RNA, 12 nt, Homo sapiens
gaaggacuauca

SEQ ID NO: 1213092 - RNA, 14 nt, Homo sapiens
gaaggagagcaaga

SEQ ID NO: 1213093 - RNA, 23 nt, Homo sapiens
gaaggagccacgugaauggcccu

SEQ ID NO: 1213094 - RNA, 21 nt, Homo sapiens
gaaggaggggguucuuccuca

SEQ ID NO: 1213095 - RNA, 17 nt, Homo sapiens
gaaggaugcucuuuccc

SEQ ID NO: 1213096 - RNA, 13 nt, Homo sapiens
gaaggcaugccua

SEQ ID NO: 1213097 - RNA, 19 nt, Homo sapiens
gaaggcuucuuagcgcagu

SEQ ID NO: 1213098 - RNA, 15 nt, Homo sapiens
gaagggaauugcuca

SEQ ID NO: 1213099 - RNA, 23 nt, Homo sapiens
gaagggauuguuguguagucaag

SEQ ID NO: 1213100 - RNA, 13 nt, Homo sapiens
gaaggggugcccc

SEQ ID NO: 1213101 - RNA, 20 nt, Homo sapiens
gaaggucccaccuccauuug

SEQ ID NO: 1213102 - RNA, 21 nt, Homo sapiens
gaaggucccaccuccauuugc

SEQ ID NO: 1213103 - RNA, 16 nt, Homo sapiens
gaaggucuuuguuaug

SEQ ID NO: 1213104 - RNA, 12 nt, Homo sapiens
gaaggugccucu

SEQ ID NO: 1213105 - RNA, 14 nt, Homo sapiens
gaaguaaacugcag

SEQ ID NO: 1213106 - RNA, 12 nt, Homo sapiens
gaaguaaagccu

SEQ ID NO: 1213107 - RNA, 12 nt, Homo sapiens
gaaguaagcaaa

SEQ ID NO: 1213108 - RNA, 21 nt, Homo sapiens
gaaguacaaagguugcagugc

SEQ ID NO: 1213109 - RNA, 14 nt, Homo sapiens
gaaguaggcauaua

SEQ ID NO: 1213110 - RNA, 18 nt, Homo sapiens
gaaguaggcauauaucac

SEQ ID NO: 1213111 - RNA, 14 nt, Homo sapiens
gaagucacacagua

SEQ ID NO: 1213112 - RNA, 20 nt, Homo sapiens
gaagucaucucauuccacug

SEQ ID NO: 1213113 - RNA, 12 nt, Homo sapiens
gaagucauucuu

SEQ ID NO: 1213114 - RNA, 22 nt, Homo sapiens
gaagugaaaauagccaguuccu

SEQ ID NO: 1213115 - RNA, 21 nt, Homo sapiens
gaagugaccuggaaucaguga

SEQ ID NO: 1213116 - RNA, 20 nt, Homo sapiens
gaagugacuguuguaccaug

SEQ ID NO: 1213117 - RNA, 10 nt, Homo sapiens
gaagugcaau

SEQ ID NO: 1213118 - RNA, 18 nt, Homo sapiens
gaagugguucuaugucca

SEQ ID NO: 1213119 - RNA, 15 nt, Homo sapiens
gaagugucacagccu

SEQ ID NO: 1213120 - RNA, 19 nt, Homo sapiens
gaaguuccaguguucucuc

SEQ ID NO: 1213121 - RNA, 19 nt, Homo sapiens
gaaguucuagccacagcag

SEQ ID NO: 1213122 - RNA, 20 nt, Homo sapiens
gaaguugcagugagcugaua

SEQ ID NO: 1213123 - RNA, 15 nt, Homo sapiens
gaaguuuacaaucaa

SEQ ID NO: 1213124 - RNA, 17 nt, Homo sapiens
gaaguuucuggugccau

SEQ ID NO: 1213125 - RNA, 22 nt, Homo sapiens
gaaguuuugaguuucucuccac

SEQ ID NO: 1213126 - RNA, 21 nt, Homo sapiens
gaauaaaaaauagacauguag

SEQ ID NO: 1213127 - RNA, 23 nt, Homo sapiens
gaauaaaaaaugggaacauacag

SEQ ID NO: 1213128 - RNA, 22 nt, Homo sapiens
gaauaaaacuuuucugcugaua

SEQ ID NO: 1213129 - RNA, 17 nt, Homo sapiens
gaauaaauaauucuucc

SEQ ID NO: 1213130 - RNA, 12 nt, Homo sapiens
gaauaaggccuu

SEQ ID NO: 1213131 - RNA, 19 nt, Homo sapiens
gaauaauaagcuacuugcc

SEQ ID NO: 1213132 - RNA, 22 nt, Homo sapiens
gaauaauaagcuacuugccuug

SEQ ID NO: 1213133 - RNA, 14 nt, Homo sapiens
gaauaauaccuaag

SEQ ID NO: 1213134 - RNA, 14 nt, Homo sapiens
gaauaccaguguua

SEQ ID NO: 1213135 - RNA, 16 nt, Homo sapiens
gaauagaaccaaccca

SEQ ID NO: 1213136 - RNA, 23 nt, Homo sapiens
gaauagauuuuagcaugaugaaa

SEQ ID NO: 1213137 - RNA, 14 nt, Homo sapiens
gaauaguacagaca

SEQ ID NO: 1213138 - RNA, 23 nt, Homo sapiens
uuuuaaccucuagagucacugau

SEQ ID NO: 1213139 - RNA, 17 nt, Homo sapiens
uuuuaacucaccucuca

SEQ ID NO: 1213140 - RNA, 21 nt, Homo sapiens
uuuuaacuuuuauaccuaucu

SEQ ID NO: 1213141 - RNA, 22 nt, Homo sapiens
uuuuaagaacaauguugcaaca

SEQ ID NO: 1213142 - RNA, 12 nt, Homo sapiens
uuuuaagccagg

SEQ ID NO: 1213143 - RNA, 15 nt, Homo sapiens
uuuuaaggauguugc

SEQ ID NO: 1213144 - RNA, 17 nt, Homo sapiens
uuuuaauauugauguca

SEQ ID NO: 1213145 - RNA, 13 nt, Homo sapiens
uuuuaaugaucuc

SEQ ID NO: 1213146 - RNA, 13 nt, Homo sapiens
uuuuaauggaugg

SEQ ID NO: 1213147 - RNA, 15 nt, Homo sapiens
uuuuaauuuacuugu

SEQ ID NO: 1213148 - RNA, 15 nt, Homo sapiens
uuuuacacuugcauc

SEQ ID NO: 1213149 - RNA, 12 nt, Homo sapiens
uuuuacugucag

SEQ ID NO: 1213150 - RNA, 20 nt, Homo sapiens
uuuuagaaaccccucuguag

SEQ ID NO: 1213151 - RNA, 19 nt, Homo sapiens
uuuuagaaaucacaacaaa

SEQ ID NO: 1213152 - RNA, 16 nt, Homo sapiens
uuuuagaugaccaaaa

SEQ ID NO: 1213153 - RNA, 14 nt, Homo sapiens
uuuuagcuuuacaa

SEQ ID NO: 1213154 - RNA, 20 nt, Homo sapiens
uuuuagugacuguaauuaau

SEQ ID NO: 1213155 - RNA, 14 nt, Homo sapiens
uuuuaguucucuag

SEQ ID NO: 1213156 - RNA, 19 nt, Homo sapiens
uuuuauaaaaaugagugcu

SEQ ID NO: 1213157 - RNA, 18 nt, Homo sapiens
uuuuauauuuauugugcu

SEQ ID NO: 1213158 - RNA, 12 nt, Homo sapiens
uuuuaucaugau

SEQ ID NO: 1213159 - RNA, 23 nt, Homo sapiens
uuuuaucuucagaaauucucugc

SEQ ID NO: 1213160 - RNA, 16 nt, Homo sapiens
uuuuaucuugcacuua

SEQ ID NO: 1213161 - RNA, 23 nt, Homo sapiens
uuuuauuguuguuguuugauccc

SEQ ID NO: 1213162 - RNA, 23 nt, Homo sapiens
uuuuauuuuuagacagagucuca

SEQ ID NO: 1213163 - RNA, 18 nt, Homo sapiens
uuuucaaaauucaaaaaa

SEQ ID NO: 1213164 - RNA, 20 nt, Homo sapiens
uuuucaaguuuacacuucau

SEQ ID NO: 1213165 - RNA, 17 nt, Homo sapiens
uuuucacagucacugau

SEQ ID NO: 1213166 - RNA, 12 nt, Homo sapiens
uuuucacuugua

SEQ ID NO: 1213167 - RNA, 18 nt, Homo sapiens
uuuucagucuaguugcca

SEQ ID NO: 1213168 - RNA, 17 nt, Homo sapiens
uuuucaguuuuaccucu

SEQ ID NO: 1213169 - RNA, 15 nt, Homo sapiens
uuuucauacugaaaa

SEQ ID NO: 1213170 - RNA, 15 nt, Homo sapiens
uuuucaucacuggga

SEQ ID NO: 1213171 - RNA, 16 nt, Homo sapiens
uuuucauuuagugcua

SEQ ID NO: 1213172 - RNA, 14 nt, Homo sapiens
uuuucauuuguaca

SEQ ID NO: 1213173 - RNA, 21 nt, Homo sapiens
uuuuccaucauuuuacaguga

SEQ ID NO: 1213174 - RNA, 23 nt, Homo sapiens
uuuuccauuuuuauuucaaaaua

SEQ ID NO: 1213175 - RNA, 20 nt, Homo sapiens
uuuuccuacuuguuaugguu

SEQ ID NO: 1213176 - RNA, 15 nt, Homo sapiens
uuuuccuccaggcaa

SEQ ID NO: 1213177 - RNA, 21 nt, Homo sapiens
uuuuccuuguauguucuuggg

SEQ ID NO: 1213178 - RNA, 22 nt, Homo sapiens
uuuucgcaccuaccaucaggga

SEQ ID NO: 1213179 - RNA, 20 nt, Homo sapiens
uuuucggaggccccacugau

SEQ ID NO: 1213180 - RNA, 21 nt, Homo sapiens
uuuucuaaacaagaaccauuu

SEQ ID NO: 1213181 - RNA, 21 nt, Homo sapiens
uuuucuaccuauaacacucua

SEQ ID NO: 1213182 - RNA, 12 nt, Homo sapiens
uuuucugccacu

SEQ ID NO: 1213183 - RNA, 14 nt, Homo sapiens
uuuucugccaggga

SEQ ID NO: 1213184 - RNA, 19 nt, Homo sapiens
uuuucuggaauacaugaaa

SEQ ID NO: 1213185 - RNA, 17 nt, Homo sapiens
uuuucuuauugcgcugc

SEQ ID NO: 1213186 - RNA, 14 nt, Homo sapiens
uuuucuuccuugua

SEQ ID NO: 1213187 - RNA, 22 nt, Homo sapiens
uuuucuuuuaagcuauccacag

SEQ ID NO: 1213188 - RNA, 17 nt, Homo sapiens
uuuucuuuuuuaucuug

SEQ ID NO: 1213189 - RNA, 21 nt, Homo sapiens
uuuugaaaaggcgguacuagu

SEQ ID NO: 1213190 - RNA, 19 nt, Homo sapiens
uuuugaaauaagaaagugc

SEQ ID NO: 1213191 - RNA, 13 nt, Homo sapiens
uuuugaaauccaa

SEQ ID NO: 1213192 - RNA, 13 nt, Homo sapiens
uuuugaaggcaaa

SEQ ID NO: 1213193 - RNA, 17 nt, Homo sapiens
uuuugacagggucucac

SEQ ID NO: 1213194 - RNA, 15 nt, Homo sapiens
uuuugaccauaacug

SEQ ID NO: 1213195 - RNA, 12 nt, Homo sapiens
uuuugacuccuu

SEQ ID NO: 1213196 - RNA, 22 nt, Homo sapiens
uuuugagacaaagucucacugu

SEQ ID NO: 1213197 - RNA, 11 nt, Homo sapiens
uuuugauugcc

SEQ ID NO: 1213198 - RNA, 17 nt, Homo sapiens
uuuugcucaguuccaug

SEQ ID NO: 1213199 - RNA, 15 nt, Homo sapiens
uuuuggcagccagac

SEQ ID NO: 1213200 - RNA, 14 nt, Homo sapiens
uuuuggguauuaau

SEQ ID NO: 1213201 - RNA, 20 nt, Homo sapiens
uuuugguagaugcaugacuu

SEQ ID NO: 1213202 - RNA, 21 nt, Homo sapiens
uuuugguagaugcaugacuug

SEQ ID NO: 1213203 - RNA, 18 nt, Homo sapiens
uuuugguuccacaaucuc

SEQ ID NO: 1213204 - RNA, 19 nt, Homo sapiens
uuuuguaaaguugccuuua

SEQ ID NO: 1213205 - RNA, 11 nt, Homo sapiens
uuuuguacuuu

SEQ ID NO: 1213206 - RNA, 14 nt, Homo sapiens
uuuuguauauacag

SEQ ID NO: 1213207 - RNA, 12 nt, Homo sapiens
uuuugucucaga

SEQ ID NO: 1213208 - RNA, 22 nt, Homo sapiens
uuuugugucaaaaggacauuua

SEQ ID NO: 1213209 - RNA, 21 nt, Homo sapiens
uuuuguugaaauugucaaaga

SEQ ID NO: 1213210 - RNA, 19 nt, Homo sapiens
uuuuguuuuuucuugccag

SEQ ID NO: 1213211 - RNA, 20 nt, Homo sapiens
uuuuuaaaagguagagucuu

SEQ ID NO: 1213212 - RNA, 23 nt, Homo sapiens
uuuuuaaauuugcaaaucucagg

SEQ ID NO: 1213213 - RNA, 22 nt, Homo sapiens
uuuuuaauuaaaugaagccaag

SEQ ID NO: 1213214 - RNA, 12 nt, Homo sapiens
uuuuuacuauua

SEQ ID NO: 1213215 - RNA, 20 nt, Homo sapiens
uuuuuauaaaaaugagugcu

SEQ ID NO: 1213216 - RNA, 20 nt, Homo sapiens
uuuuuauaucaugcaaaaua

SEQ ID NO: 1213217 - RNA, 14 nt, Homo sapiens
uuuuuauuugcuca

SEQ ID NO: 1213218 - RNA, 13 nt, Homo sapiens
uuuuucaagagcu

SEQ ID NO: 1213219 - RNA, 22 nt, Homo sapiens
uuuuucaagagcuccuugaccc

SEQ ID NO: 1213220 - RNA, 13 nt, Homo sapiens
uuuuucaagccug

SEQ ID NO: 1213221 - RNA, 18 nt, Homo sapiens
uuuuucacuguacauuau

SEQ ID NO: 1213222 - RNA, 15 nt, Homo sapiens
uuuuucauucauccc

SEQ ID NO: 1213223 - RNA, 19 nt, Homo sapiens
uuuuuccuagccuguuucu

SEQ ID NO: 1213224 - RNA, 23 nt, Homo sapiens
uuuuucguguggaucuugccaca

SEQ ID NO: 1213225 - RNA, 11 nt, Homo sapiens
uuuuugcucuc

SEQ ID NO: 1213226 - RNA, 14 nt, Homo sapiens
uuuuuggcagggag

SEQ ID NO: 1213227 - RNA, 11 nt, Homo sapiens
uuuuuguacug

SEQ ID NO: 1213228 - RNA, 12 nt, Homo sapiens
uuuuugugucaa

SEQ ID NO: 1213229 - RNA, 11 nt, Homo sapiens
uuuuuuacucg

SEQ ID NO: 1213230 - RNA, 13 nt, Homo sapiens
uuuuuuauuggaa

SEQ ID NO: 1213231 - RNA, 12 nt, Homo sapiens
uuuuuuccuuaa

SEQ ID NO: 1213232 - RNA, 17 nt, Homo sapiens
uuuuuuguuugccucuu

SEQ ID NO: 1213233 - RNA, 14 nt, Homo sapiens
gacacagcucuuca

SEQ ID NO: 1213234 - RNA, 21 nt, Homo sapiens
gacacagcucuucuccaggcu

SEQ ID NO: 1213235 - RNA, 15 nt, Homo sapiens
gacacauaugcaccu

SEQ ID NO: 1213236 - RNA, 20 nt, Homo sapiens
gacacauucaggaguuaaau

SEQ ID NO: 1213237 - RNA, 18 nt, Homo sapiens
gacaccuggacugagcca

SEQ ID NO: 1213238 - RNA, 21 nt, Homo sapiens
gacacuagccugugcacgcgc

SEQ ID NO: 1213239 - RNA, 21 nt, Homo sapiens
gacacucaaaacgcuacugag

SEQ ID NO: 1213240 - RNA, 20 nt, Homo sapiens
gacacugaggagauacugaa

SEQ ID NO: 1213241 - RNA, 16 nt, Homo sapiens
gacacugccuggggug

SEQ ID NO: 1213242 - RNA, 20 nt, Homo sapiens
gacacuugccuucuucaccc

SEQ ID NO: 1213243 - RNA, 14 nt, Homo sapiens
gacagaagcguaua

SEQ ID NO: 1213244 - RNA, 23 nt, Homo sapiens
gacagaaggugccacuuuaccca

SEQ ID NO: 1213245 - RNA, 19 nt, Homo sapiens
gacagcauauaaauguaau

SEQ ID NO: 1213246 - RNA, 14 nt, Homo sapiens
gacagccugaguca

SEQ ID NO: 1213247 - RNA, 20 nt, Homo sapiens
gacagcuucaugaaacuguc

SEQ ID NO: 1213248 - RNA, 20 nt, Homo sapiens
gacaggaacccuugcaucca

SEQ ID NO: 1213249 - RNA, 16 nt, Homo sapiens
gacaggaggcggcccg

SEQ ID NO: 1213250 - RNA, 17 nt, Homo sapiens
gacaggugaggucuguu

SEQ ID NO: 1213251 - RNA, 16 nt, Homo sapiens
gacagucacugccacu

SEQ ID NO: 1213252 - RNA, 21 nt, Homo sapiens
gacagucacugccacuuugca

SEQ ID NO: 1213253 - RNA, 10 nt, Homo sapiens
gacagucauc

SEQ ID NO: 1213254 - RNA, 18 nt, Homo sapiens
gacagucuagcugccuca

SEQ ID NO: 1213255 - RNA, 18 nt, Homo sapiens
gacagucucccccaaaca

SEQ ID NO: 1213256 - RNA, 14 nt, Homo sapiens
gacagugaacauuc

SEQ ID NO: 1213257 - RNA, 16 nt, Homo sapiens
gacagugaacauucug

SEQ ID NO: 1213258 - RNA, 16 nt, Homo sapiens
gacagugaccccaguc

SEQ ID NO: 1213259 - RNA, 18 nt, Homo sapiens
gacagugauaggcccaag

SEQ ID NO: 1213260 - RNA, 14 nt, Homo sapiens
gacagugcauuugc

SEQ ID NO: 1213261 - RNA, 16 nt, Homo sapiens
gacagugcauuugccu

SEQ ID NO: 1213262 - RNA, 16 nt, Homo sapiens
gacaguggaugcugcu

SEQ ID NO: 1213263 - RNA, 14 nt, Homo sapiens
gacauaaagccaug

SEQ ID NO: 1213264 - RNA, 18 nt, Homo sapiens
gacauacauauuaucuca

SEQ ID NO: 1213265 - RNA, 19 nt, Homo sapiens
gacauacauauuaucucau

SEQ ID NO: 1213266 - RNA, 20 nt, Homo sapiens
gacauagauauuuucacaau

SEQ ID NO: 1213267 - RNA, 21 nt, Homo sapiens
gacauagccaacugcuguuca

SEQ ID NO: 1213268 - RNA, 15 nt, Homo sapiens
gacauauacuaagau

SEQ ID NO: 1213269 - RNA, 18 nt, Homo sapiens
gacaucucaggggccaga

SEQ ID NO: 1213270 - RNA, 19 nt, Homo sapiens
gacaucuuaggcuggccag

SEQ ID NO: 1213271 - RNA, 20 nt, Homo sapiens
gacaugaaauaaagaauuua

SEQ ID NO: 1213272 - RNA, 14 nt, Homo sapiens
gacaugcacuauga

SEQ ID NO: 1213273 - RNA, 14 nt, Homo sapiens
gacauguaauguug

SEQ ID NO: 1213274 - RNA, 16 nt, Homo sapiens
gacaugugaaaccuuu

SEQ ID NO: 1213275 - RNA, 17 nt, Homo sapiens
ucuguuuugaaggcaaa

SEQ ID NO: 1213276 - RNA, 23 nt, Homo sapiens
ucuguuuuucaccacuucacuga

SEQ ID NO: 1213277 - RNA, 17 nt, Homo sapiens
ucuuaaaaguacuuuaa

SEQ ID NO: 1213278 - RNA, 21 nt, Homo sapiens
ucuuaaacauaauaaaucaca

SEQ ID NO: 1213279 - RNA, 22 nt, Homo sapiens
ucuuaaacuaaaugugcaauag

SEQ ID NO: 1213280 - RNA, 17 nt, Homo sapiens
ucuuaaccucaaaccua

SEQ ID NO: 1213281 - RNA, 19 nt, Homo sapiens
ucuuaaccuuugcuaugua

SEQ ID NO: 1213282 - RNA, 20 nt, Homo sapiens
ucuuaaccuuugcuauguaa

SEQ ID NO: 1213283 - RNA, 16 nt, Homo sapiens
ucuuaacuucuugcuu

SEQ ID NO: 1213284 - RNA, 22 nt, Homo sapiens
ucuuaacuuuucaccaggggug

SEQ ID NO: 1213285 - RNA, 16 nt, Homo sapiens
ucuuacaauugcacug

SEQ ID NO: 1213286 - RNA, 18 nt, Homo sapiens
ucuuacaguguuuggaca

SEQ ID NO: 1213287 - RNA, 22 nt, Homo sapiens
ucuuacauaauuuuuuauucaa

SEQ ID NO: 1213288 - RNA, 13 nt, Homo sapiens
ucuuaccagaugc

SEQ ID NO: 1213289 - RNA, 15 nt, Homo sapiens
ucuuaccauuucaca

SEQ ID NO: 1213290 - RNA, 16 nt, Homo sapiens
ucuuagcugucugcuc

SEQ ID NO: 1213291 - RNA, 18 nt, Homo sapiens
ucuuagggugaaccacuu

SEQ ID NO: 1213292 - RNA, 12 nt, Homo sapiens
ucuuaguaccag

SEQ ID NO: 1213293 - RNA, 15 nt, Homo sapiens
ucuuagugucacuua

SEQ ID NO: 1213294 - RNA, 12 nt, Homo sapiens
ucuuaguuauug

SEQ ID NO: 1213295 - RNA, 13 nt, Homo sapiens
ucuuaguucucac

SEQ ID NO: 1213296 - RNA, 16 nt, Homo sapiens
ucuuauagcacuuuga

SEQ ID NO: 1213297 - RNA, 22 nt, Homo sapiens
ucuuauauuuuuugaguugagu

SEQ ID NO: 1213298 - RNA, 17 nt, Homo sapiens
ucuuaugcaaucuaugu

SEQ ID NO: 1213299 - RNA, 16 nt, Homo sapiens
ucuuaugugugccuuu

SEQ ID NO: 1213300 - RNA, 16 nt, Homo sapiens
ucuuauuuaacuuaac

SEQ ID NO: 1213301 - RNA, 16 nt, Homo sapiens
ucuuauuuaaugaaag

SEQ ID NO: 1213302 - RNA, 14 nt, Homo sapiens
ucuucaaaauguau

SEQ ID NO: 1213303 - RNA, 15 nt, Homo sapiens
ucuucaaaugucuaa

SEQ ID NO: 1213304 - RNA, 16 nt, Homo sapiens
ucuucaaccucauuga

SEQ ID NO: 1213305 - RNA, 17 nt, Homo sapiens
ucuucaaccucauugac

SEQ ID NO: 1213306 - RNA, 12 nt, Homo sapiens
ucuucaagagcu

SEQ ID NO: 1213307 - RNA, 20 nt, Homo sapiens
ucuucaauuuauuacugaaa

SEQ ID NO: 1213308 - RNA, 20 nt, Homo sapiens
ucuucacugucugacuuuag

SEQ ID NO: 1213309 - RNA, 21 nt, Homo sapiens
ucuucacuucuaaaugcauau

SEQ ID NO: 1213310 - RNA, 12 nt, Homo sapiens
ucuucagaacac

SEQ ID NO: 1213311 - RNA, 12 nt, Homo sapiens
ucuucagaauua

SEQ ID NO: 1213312 - RNA, 19 nt, Homo sapiens
ucuucagguucucaugaua

SEQ ID NO: 1213313 - RNA, 15 nt, Homo sapiens
ucuucauuucaggaa

SEQ ID NO: 1213314 - RNA, 23 nt, Homo sapiens
ucuuccaucccaggacaccacac

SEQ ID NO: 1213315 - RNA, 11 nt, Homo sapiens
uugucuuuaug

SEQ ID NO: 1213316 - RNA, 23 nt, Homo sapiens
uugugaaguggaaauguucuaaa

SEQ ID NO: 1213317 - RNA, 17 nt, Homo sapiens
uugugaauuauucugau

SEQ ID NO: 1213318 - RNA, 20 nt, Homo sapiens
uugugaccuucucuauauca

SEQ ID NO: 1213319 - RNA, 15 nt, Homo sapiens
uugugagccaccacg

SEQ ID NO: 1213320 - RNA, 17 nt, Homo sapiens
uugugaguuuaccuugu

SEQ ID NO: 1213321 - RNA, 20 nt, Homo sapiens
uugugaugucuuuucuuggc

SEQ ID NO: 1213322 - RNA, 15 nt, Homo sapiens
uugugauuauuucac

SEQ ID NO: 1213323 - RNA, 22 nt, Homo sapiens
uugugauuuauuucacuuuuaa

SEQ ID NO: 1213324 - RNA, 10 nt, Homo sapiens
uugugcaaac

SEQ ID NO: 1213325 - RNA, 20 nt, Homo sapiens
uugugcugugggcagcaccc

SEQ ID NO: 1213326 - RNA, 17 nt, Homo sapiens
uuguggucugagccaaa

SEQ ID NO: 1213327 - RNA, 21 nt, Homo sapiens
uuguggucugagccaaagaga

SEQ ID NO: 1213328 - RNA, 16 nt, Homo sapiens
uuguguauccaugcac

SEQ ID NO: 1213329 - RNA, 21 nt, Homo sapiens
uuguguauuccacuuaggaag

SEQ ID NO: 1213330 - RNA, 16 nt, Homo sapiens
uugugucagauuacca

SEQ ID NO: 1213331 - RNA, 15 nt, Homo sapiens
uugugucugacucag

SEQ ID NO: 1213332 - RNA, 16 nt, Homo sapiens
uugugugaaaauguga

SEQ ID NO: 1213333 - RNA, 21 nt, Homo sapiens
uugugugcucauguaugugcg

SEQ ID NO: 1213334 - RNA, 19 nt, Homo sapiens
uuguguguauuuguauuaa

SEQ ID NO: 1213335 - RNA, 17 nt, Homo sapiens
uugugugugggcuguga

SEQ ID NO: 1213336 - RNA, 22 nt, Homo sapiens
uuguguguguguguugauccca

SEQ ID NO: 1213337 - RNA, 13 nt, Homo sapiens
uuguuacagcuuc

SEQ ID NO: 1213338 - RNA, 20 nt, Homo sapiens
uuguuacuguucuugcugcu

SEQ ID NO: 1213339 - RNA, 12 nt, Homo sapiens
uuguuauaccau

SEQ ID NO: 1213340 - RNA, 17 nt, Homo sapiens
uuguuauuugaaaacau

SEQ ID NO: 1213341 - RNA, 17 nt, Homo sapiens
uuguucaaagcacagaa

SEQ ID NO: 1213342 - RNA, 14 nt, Homo sapiens
uuguucacauauau

SEQ ID NO: 1213343 - RNA, 16 nt, Homo sapiens
uuguucaguugccaag

SEQ ID NO: 1213344 - RNA, 14 nt, Homo sapiens
uuguuccacugcaa

SEQ ID NO: 1213345 - RNA, 23 nt, Homo sapiens
uuguuccagcaguuuucaaguca

SEQ ID NO: 1213346 - RNA, 16 nt, Homo sapiens
uuguuccagcccuauu

SEQ ID NO: 1213347 - RNA, 22 nt, Homo sapiens
uuguuccugccacuguguacug

SEQ ID NO: 1213348 - RNA, 19 nt, Homo sapiens
uuguucuguuuugugagaa

SEQ ID NO: 1213349 - RNA, 21 nt, Homo sapiens
uuguucuuuaaagucaggucc

SEQ ID NO: 1213350 - RNA, 20 nt, Homo sapiens
uuguugagaauuguuuucuu

SEQ ID NO: 1213351 - RNA, 11 nt, Homo sapiens
uuguugcucag

SEQ ID NO: 1213352 - RNA, 17 nt, Homo sapiens
uuguuggccaaagccaa

SEQ ID NO: 1213353 - RNA, 20 nt, Homo sapiens
uuguuguaaccugcugugau

SEQ ID NO: 1213354 - RNA, 17 nt, Homo sapiens
uuguuguauugaucaau

SEQ ID NO: 1213355 - RNA, 13 nt, Homo sapiens
uuguugugugugc

SEQ ID NO: 1213356 - RNA, 20 nt, Homo sapiens
uuguuuagauaugacauuua

SEQ ID NO: 1213357 - RNA, 22 nt, Homo sapiens
uuguuuauacuccaguguacau

SEQ ID NO: 1213358 - RNA, 21 nt, Homo sapiens
uuguuucaaaugaaacuuuaa

SEQ ID NO: 1213359 - RNA, 21 nt, Homo sapiens
uuguuucccagauuucaggaa

SEQ ID NO: 1213360 - RNA, 21 nt, Homo sapiens
uuguuucccaucagacuguca

SEQ ID NO: 1213361 - RNA, 19 nt, Homo sapiens
uuguuuccucgcugaucga

SEQ ID NO: 1213362 - RNA, 16 nt, Homo sapiens
uuguuucugcauucau

SEQ ID NO: 1213363 - RNA, 15 nt, Homo sapiens
uuguuugucuuccau

SEQ ID NO: 1213364 - RNA, 23 nt, Homo sapiens
uuguuuuauccacaacuuuucaa

SEQ ID NO: 1213365 - RNA, 19 nt, Homo sapiens
uuguuuuguguaacauauu

SEQ ID NO: 1213366 - RNA, 22 nt, Homo sapiens
uuguuuuugcaugaaauuguau

SEQ ID NO: 1213367 - RNA, 14 nt, Homo sapiens
uuguuuuuuacuca

SEQ ID NO: 1213368 - RNA, 15 nt, Homo sapiens
uuuaaaaaaucucaa

SEQ ID NO: 1213369 - RNA, 18 nt, Homo sapiens
uuuaaaaaauuauggaau

SEQ ID NO: 1213370 - RNA, 20 nt, Homo sapiens
uuuaaaaauguuuuccccaa

SEQ ID NO: 1213371 - RNA, 14 nt, Homo sapiens
uuuaaaacaugcac

SEQ ID NO: 1213372 - RNA, 12 nt, Homo sapiens
uuuaaacccaau

SEQ ID NO: 1213373 - RNA, 23 nt, Homo sapiens
uuuaaagaaaaauaugauacucu

SEQ ID NO: 1213374 - RNA, 15 nt, Homo sapiens
uuuaaagagaaugua

SEQ ID NO: 1213375 - RNA, 19 nt, Homo sapiens
uuuaaagaugaacucugaa

SEQ ID NO: 1213376 - RNA, 17 nt, Homo sapiens
uuuaaagcacaugccuu

SEQ ID NO: 1213377 - RNA, 22 nt, Homo sapiens
uuuaaagcauauuggugcuaga

SEQ ID NO: 1213378 - RNA, 17 nt, Homo sapiens
uuuaaagccauucugau

SEQ ID NO: 1213379 - RNA, 22 nt, Homo sapiens
uuuaaauaaaauauuugcuuca

SEQ ID NO: 1213380 - RNA, 16 nt, Homo sapiens
uuuaaauaaaggaaau

SEQ ID NO: 1213381 - RNA, 17 nt, Homo sapiens
uuuaaauguuacuggua

SEQ ID NO: 1213382 - RNA, 16 nt, Homo sapiens
uuuaacaacauggcuu

SEQ ID NO: 1213383 - RNA, 14 nt, Homo sapiens
uuuaacacuaaaaa

SEQ ID NO: 1213384 - RNA, 13 nt, Homo sapiens
uuuaacagccucu

SEQ ID NO: 1213385 - RNA, 11 nt, Homo sapiens
uuuaaccaaga

SEQ ID NO: 1213386 - RNA, 14 nt, Homo sapiens
uuuaaccuaugaua

SEQ ID NO: 1213387 - RNA, 21 nt, Homo sapiens
uuuaaccucuagagucacuga

SEQ ID NO: 1213388 - RNA, 20 nt, Homo sapiens
uuuaacggaugguugaauga

SEQ ID NO: 1213389 - RNA, 14 nt, Homo sapiens
uuuaacguuuucau

SEQ ID NO: 1213390 - RNA, 20 nt, Homo sapiens
uuuaacucaguuucuaggca

SEQ ID NO: 1213391 - RNA, 19 nt, Homo sapiens
uuuaagaacaaacucugaa

SEQ ID NO: 1213392 - RNA, 18 nt, Homo sapiens
uuuaagaauaucuguaau

SEQ ID NO: 1213393 - RNA, 17 nt, Homo sapiens
uuuaagauuuuucucaa

SEQ ID NO: 1213394 - RNA, 14 nt, Homo sapiens
uuuaagcagucuca

SEQ ID NO: 1213395 - RNA, 13 nt, Homo sapiens
uuuaagcaucaaa

SEQ ID NO: 1213396 - RNA, 16 nt, Homo sapiens
uuuaaggaaaugugca

SEQ ID NO: 1213397 - RNA, 19 nt, Homo sapiens
uuuaagguuuuuacuguga

SEQ ID NO: 1213398 - RNA, 14 nt, Homo sapiens
uuuaaguaguccuc

SEQ ID NO: 1213399 - RNA, 21 nt, Homo sapiens
uuuaaguauugcagucuaaaa

SEQ ID NO: 1213400 - RNA, 13 nt, Homo sapiens
uuuaagucaguga

SEQ ID NO: 1213401 - RNA, 19 nt, Homo sapiens
uuuaaguuauagcuucuua

SEQ ID NO: 1213402 - RNA, 17 nt, Homo sapiens
uuuaauaaagcacaaaa

SEQ ID NO: 1213403 - RNA, 18 nt, Homo sapiens
uuuaauagcgaaucuaau

SEQ ID NO: 1213404 - RNA, 20 nt, Homo sapiens
uuuaauaucuggcacuguua

SEQ ID NO: 1213405 - RNA, 19 nt, Homo sapiens
uuuaaugaacuaccaucug

SEQ ID NO: 1213406 - RNA, 17 nt, Homo sapiens
uuuaaugagucagucaa

SEQ ID NO: 1213407 - RNA, 19 nt, Homo sapiens
uuuaaugccgauauacucu

SEQ ID NO: 1213408 - RNA, 17 nt, Homo sapiens
uuuaauggauauuucuc

SEQ ID NO: 1213409 - RNA, 14 nt, Homo sapiens
uuuaauuaaaucuc

SEQ ID NO: 1213410 - RNA, 15 nt, Homo sapiens
uuuaauuuuaguuuc

SEQ ID NO: 1213411 - RNA, 20 nt, Homo sapiens
uuuacaaaacuacaugagaa

SEQ ID NO: 1213412 - RNA, 17 nt, Homo sapiens
uuuacaaguguauauca

SEQ ID NO: 1213413 - RNA, 21 nt, Homo sapiens
uuuacacaauuaauucauccc

SEQ ID NO: 1213414 - RNA, 19 nt, Homo sapiens
uuuacagcacuacucugug

SEQ ID NO: 1213415 - RNA, 14 nt, Homo sapiens
uuuacauccaugaa

SEQ ID NO: 1213416 - RNA, 23 nt, Homo sapiens
uuuacauguauuuaaaguagcau

SEQ ID NO: 1213417 - RNA, 13 nt, Homo sapiens
uuuacaugugaug

SEQ ID NO: 1213418 - RNA, 17 nt, Homo sapiens
uuuacauuauuaagaaa

SEQ ID NO: 1213419 - RNA, 16 nt, Homo sapiens
uuuacauuucauacaa

SEQ ID NO: 1213420 - RNA, 17 nt, Homo sapiens
uuuaccaguugccuuuu

SEQ ID NO: 1213421 - RNA, 23 nt, Homo sapiens
uuuacccauuaaauuaagacuug

SEQ ID NO: 1213422 - RNA, 21 nt, Homo sapiens
uuuaccccucacaauccuugc

SEQ ID NO: 1213423 - RNA, 17 nt, Homo sapiens
uuuaccugagaccaguu

SEQ ID NO: 1213424 - RNA, 17 nt, Homo sapiens
uuuaccuucaaacuuua

SEQ ID NO: 1213425 - RNA, 16 nt, Homo sapiens
uuuacuagaaaggcau

SEQ ID NO: 1213426 - RNA, 16 nt, Homo sapiens
uuuacuguccaaagac

SEQ ID NO: 1213427 - RNA, 24 nt, Homo sapiens
uuuacuuccauaggacauacugca

SEQ ID NO: 1213428 - RNA, 16 nt, Homo sapiens
uuuacuuuuaccacua

SEQ ID NO: 1213429 - RNA, 23 nt, Homo sapiens
uuuagaaaucacaacaaacugaa

SEQ ID NO: 1213430 - RNA, 14 nt, Homo sapiens
uuuagaacaccaaa

SEQ ID NO: 1213431 - RNA, 13 nt, Homo sapiens
uuuagaaccagcc

SEQ ID NO: 1213432 - RNA, 21 nt, Homo sapiens
uuuagacucaaagaauauaau

SEQ ID NO: 1213433 - RNA, 16 nt, Homo sapiens
uuuagaugccugugaa

SEQ ID NO: 1213434 - RNA, 20 nt, Homo sapiens
uuuagcaauuuauacaauau

SEQ ID NO: 1213435 - RNA, 23 nt, Homo sapiens
uuuagcauaguaccucugcuauu

SEQ ID NO: 1213436 - RNA, 22 nt, Homo sapiens
uuuagcuaccucacuaugcugc

SEQ ID NO: 1213437 - RNA, 19 nt, Homo sapiens
uuuaggaaaugggcaguga

SEQ ID NO: 1213438 - RNA, 20 nt, Homo sapiens
uuuaggaaaugggcagugaa

SEQ ID NO: 1213439 - RNA, 13 nt, Homo sapiens
uuuaggagugugu

SEQ ID NO: 1213440 - RNA, 20 nt, Homo sapiens
uccugaggcuccacuugguc

SEQ ID NO: 1213441 - RNA, 20 nt, Homo sapiens
uccugaguagcugggauuac

SEQ ID NO: 1213442 - RNA, 23 nt, Homo sapiens
uccugaugaugguggcuguaaua

SEQ ID NO: 1213443 - RNA, 13 nt, Homo sapiens
uccugcaacucaa

SEQ ID NO: 1213444 - RNA, 22 nt, Homo sapiens
uccugcaauaaaauaguagcau

SEQ ID NO: 1213445 - RNA, 19 nt, Homo sapiens
uccugcagaaguacuccua

SEQ ID NO: 1213446 - RNA, 18 nt, Homo sapiens
uccugcagccccagaaga

SEQ ID NO: 1213447 - RNA, 19 nt, Homo sapiens
uccugcauccucacugugg

SEQ ID NO: 1213448 - RNA, 19 nt, Homo sapiens
uccugcauuucucuucuca

SEQ ID NO: 1213449 - RNA, 20 nt, Homo sapiens
uccugccucagccuccugag

SEQ ID NO: 1213450 - RNA, 23 nt, Homo sapiens
uccugccugggugggacagccuc

SEQ ID NO: 1213451 - RNA, 16 nt, Homo sapiens
uccugccuucuguccu

SEQ ID NO: 1213452 - RNA, 15 nt, Homo sapiens
uccugcuccaugacu

SEQ ID NO: 1213453 - RNA, 21 nt, Homo sapiens
uccugcugcuguaacugcuga

SEQ ID NO: 1213454 - RNA, 20 nt, Homo sapiens
uccuggaacagaagacagcu

SEQ ID NO: 1213455 - RNA, 20 nt, Homo sapiens
uccuggaagcaggugcuaca

SEQ ID NO: 1213456 - RNA, 19 nt, Homo sapiens
uccuggaagggaccugguu

SEQ ID NO: 1213457 - RNA, 18 nt, Homo sapiens
uccuggaguacaaacaca

SEQ ID NO: 1213458 - RNA, 13 nt, Homo sapiens
uccuggagugaua

SEQ ID NO: 1213459 - RNA, 15 nt, Homo sapiens
uccuggauuccucac

SEQ ID NO: 1213460 - RNA, 13 nt, Homo sapiens
uccuggcacuaac

SEQ ID NO: 1213461 - RNA, 21 nt, Homo sapiens
uccuggccaggauaauauauu

SEQ ID NO: 1213462 - RNA, 21 nt, Homo sapiens
uccuggcccuccacuccucau

SEQ ID NO: 1213463 - RNA, 15 nt, Homo sapiens
uccuggccuggccau

SEQ ID NO: 1213464 - RNA, 14 nt, Homo sapiens
uccuggcugggaac

SEQ ID NO: 1213465 - RNA, 20 nt, Homo sapiens
uccuggcuugggccugagua

SEQ ID NO: 1213466 - RNA, 22 nt, Homo sapiens
uccugggaccuuuuguacuuua

SEQ ID NO: 1213467 - RNA, 15 nt, Homo sapiens
uccuggggacuuccu

SEQ ID NO: 1213468 - RNA, 19 nt, Homo sapiens
uccugggucuucagcauuc

SEQ ID NO: 1213469 - RNA, 13 nt, Homo sapiens
uccuggucuggca

SEQ ID NO: 1213470 - RNA, 23 nt, Homo sapiens
uccugguuaaauuugaauuucag

SEQ ID NO: 1213471 - RNA, 19 nt, Homo sapiens
uccuguacaauugcaucac

SEQ ID NO: 1213472 - RNA, 21 nt, Homo sapiens
uccuguaugaaagauuguggg

SEQ ID NO: 1213473 - RNA, 15 nt, Homo sapiens
uccugucugcccuag

SEQ ID NO: 1213474 - RNA, 13 nt, Homo sapiens
uccugugacuguc

SEQ ID NO: 1213475 - RNA, 20 nt, Homo sapiens
uccugugacugucucacuua

SEQ ID NO: 1213476 - RNA, 13 nt, Homo sapiens
uccugugccacua

SEQ ID NO: 1213477 - RNA, 15 nt, Homo sapiens
uccuguguaugcuga

SEQ ID NO: 1213478 - RNA, 14 nt, Homo sapiens
uccugugucagaaa

SEQ ID NO: 1213479 - RNA, 16 nt, Homo sapiens
uccugugucuguguau

SEQ ID NO: 1213480 - RNA, 20 nt, Homo sapiens
uccuguguguacucugucca

SEQ ID NO: 1213481 - RNA, 21 nt, Homo sapiens
uccuguuuuucacauuuuccu

SEQ ID NO: 1213482 - RNA, 21 nt, Homo sapiens
uccuuaaaacaauucugugac

SEQ ID NO: 1213483 - RNA, 20 nt, Homo sapiens
uccuuacuaagcauagcaaa

SEQ ID NO: 1213484 - RNA, 14 nt, Homo sapiens
uccuuacuggugcu

SEQ ID NO: 1213485 - RNA, 16 nt, Homo sapiens
uccuuagacucuuuuc

SEQ ID NO: 1213486 - RNA, 14 nt, Homo sapiens
uccuuaggccucug

SEQ ID NO: 1213487 - RNA, 21 nt, Homo sapiens
uccuuagucccccuggucuga

SEQ ID NO: 1213488 - RNA, 19 nt, Homo sapiens
uccuuaguccuacccugaa

SEQ ID NO: 1213489 - RNA, 15 nt, Homo sapiens
uccuuauuaauacaa

SEQ ID NO: 1213490 - RNA, 18 nt, Homo sapiens
uccuuauuguuaaaaaca

SEQ ID NO: 1213491 - RNA, 21 nt, Homo sapiens
uccuuauuuugugugcuuucc

SEQ ID NO: 1213492 - RNA, 15 nt, Homo sapiens
uccuucaaucuucau

SEQ ID NO: 1213493 - RNA, 22 nt, Homo sapiens
uccuucacaggcagugcaugug

SEQ ID NO: 1213494 - RNA, 21 nt, Homo sapiens
uccuucaccccuauggugcuc

SEQ ID NO: 1213495 - RNA, 23 nt, Homo sapiens
uccuucaccccuauggugcucag

SEQ ID NO: 1213496 - RNA, 12 nt, Homo sapiens
uccuuccauccc

SEQ ID NO: 1213497 - RNA, 18 nt, Homo sapiens
uccuucccccucacugaa

SEQ ID NO: 1213498 - RNA, 22 nt, Homo sapiens
uccuucccucucaugacuugca

SEQ ID NO: 1213499 - RNA, 15 nt, Homo sapiens
uccuucccugggaag

SEQ ID NO: 1213500 - RNA, 15 nt, Homo sapiens
uccuucugcuggaua

SEQ ID NO: 1213501 - RNA, 17 nt, Homo sapiens
uccuucuugacauuuau

SEQ ID NO: 1213502 - RNA, 21 nt, Homo sapiens
uccuucuuugauaauguuaaa

SEQ ID NO: 1213503 - RNA, 17 nt, Homo sapiens
uccuugacuucuuugag

SEQ ID NO: 1213504 - RNA, 11 nt, Homo sapiens
uccuugcaaau

SEQ ID NO: 1213505 - RNA, 16 nt, Homo sapiens
uccuugcacauaguag

SEQ ID NO: 1213506 - RNA, 12 nt, Homo sapiens
uccuugcacuuu

SEQ ID NO: 1213507 - RNA, 20 nt, Homo sapiens
uccuugccuaaggugucuga

SEQ ID NO: 1213508 - RNA, 14 nt, Homo sapiens
uccuugcugcauug

SEQ ID NO: 1213509 - RNA, 20 nt, Homo sapiens
uccuuggcuuaccugaccuc

SEQ ID NO: 1213510 - RNA, 21 nt, Homo sapiens
uccuuggggagcacuugucca

SEQ ID NO: 1213511 - RNA, 20 nt, Homo sapiens
uccuuggucuuuguaucuuc

SEQ ID NO: 1213512 - RNA, 14 nt, Homo sapiens
uccuugucacuuua

SEQ ID NO: 1213513 - RNA, 19 nt, Homo sapiens
uccuugugaagaugauaua

SEQ ID NO: 1213514 - RNA, 14 nt, Homo sapiens
uccuuuaccagaug

SEQ ID NO: 1213515 - RNA, 14 nt, Homo sapiens
uccuuucaccacau

SEQ ID NO: 1213516 - RNA, 23 nt, Homo sapiens
uccuuucacccgcuccuacagcu

SEQ ID NO: 1213517 - RNA, 23 nt, Homo sapiens
uccuuucuaucauuuuuguacag

SEQ ID NO: 1213518 - RNA, 15 nt, Homo sapiens
uccuuucuccaggac

SEQ ID NO: 1213519 - RNA, 19 nt, Homo sapiens
uccuuucuccaggaccaau

SEQ ID NO: 1213520 - RNA, 20 nt, Homo sapiens
uccuuucugugcccuacuca

SEQ ID NO: 1213521 - RNA, 12 nt, Homo sapiens
uccuuucuuuuc

SEQ ID NO: 1213522 - RNA, 20 nt, Homo sapiens
uccuuugaagaaaaagacac

SEQ ID NO: 1213523 - RNA, 23 nt, Homo sapiens
uccuuugaguuauaguuugcuuu

SEQ ID NO: 1213524 - RNA, 17 nt, Homo sapiens
uccuuugcucuugccaa

SEQ ID NO: 1213525 - RNA, 22 nt, Homo sapiens
uccuuuggccauuccaacagcu

SEQ ID NO: 1213526 - RNA, 17 nt, Homo sapiens
uccuuuuaaccauuuua

SEQ ID NO: 1213527 - RNA, 15 nt, Homo sapiens
uccuuuuguguacag

SEQ ID NO: 1213528 - RNA, 14 nt, Homo sapiens
uccuuuuuuauucc

SEQ ID NO: 1213529 - RNA, 19 nt, Homo sapiens
uccuuuuuucaauaugcaa

SEQ ID NO: 1213530 - RNA, 17 nt, Homo sapiens
uccuuuuuugcaugugc

SEQ ID NO: 1213531 - RNA, 23 nt, Homo sapiens
ucgaaaauucauuucacauuaau

SEQ ID NO: 1213532 - RNA, 16 nt, Homo sapiens
ucgaaaucaaaccacc

SEQ ID NO: 1213533 - RNA, 11 nt, Homo sapiens
ucgaacaaagg

SEQ ID NO: 1213534 - RNA, 22 nt, Homo sapiens
ucgaacuccuggccucaaguga

SEQ ID NO: 1213535 - RNA, 20 nt, Homo sapiens
ucgacaagaccacacuuugg

SEQ ID NO: 1213536 - RNA, 23 nt, Homo sapiens
ucgaccauaaaggguguaggggc

SEQ ID NO: 1213537 - RNA, 12 nt, Homo sapiens
ucuauguucccc

SEQ ID NO: 1213538 - RNA, 12 nt, Homo sapiens
ucuauuacauuu

SEQ ID NO: 1213539 - RNA, 16 nt, Homo sapiens
ucuauucaagcacuua

SEQ ID NO: 1213540 - RNA, 21 nt, Homo sapiens
ucuauugcucaucagcuuuau

SEQ ID NO: 1213541 - RNA, 13 nt, Homo sapiens
ucuauugcugcuc

SEQ ID NO: 1213542 - RNA, 20 nt, Homo sapiens
ucuauuuauggauaucacac

SEQ ID NO: 1213543 - RNA, 13 nt, Homo sapiens
ucuauuugagauu

SEQ ID NO: 1213544 - RNA, 13 nt, Homo sapiens
ucuauuugugcuu

SEQ ID NO: 1213545 - RNA, 14 nt, Homo sapiens
ucuauuuucucagu

SEQ ID NO: 1213546 - RNA, 15 nt, Homo sapiens
ucuauuuucugcaga

SEQ ID NO: 1213547 - RNA, 15 nt, Homo sapiens
ucuauuuugugauga

SEQ ID NO: 1213548 - RNA, 16 nt, Homo sapiens
ucuauuuugugaugau

SEQ ID NO: 1213549 - RNA, 20 nt, Homo sapiens
ucuauuuuuaucaugaauuc

SEQ ID NO: 1213550 - RNA, 23 nt, Homo sapiens
ucucaaaacagagggcugcauuc

SEQ ID NO: 1213551 - RNA, 16 nt, Homo sapiens
ucucaaacuucacuaa

SEQ ID NO: 1213552 - RNA, 17 nt, Homo sapiens
ucucaaagaaggcauuu

SEQ ID NO: 1213553 - RNA, 14 nt, Homo sapiens
ucucaaaguuaaaa

SEQ ID NO: 1213554 - RNA, 13 nt, Homo sapiens
ucucaaauuuauu

SEQ ID NO: 1213555 - RNA, 23 nt, Homo sapiens
ucucaauaacaaacuggcugcuu

SEQ ID NO: 1213556 - RNA, 14 nt, Homo sapiens
ucucaauaguaaaa

SEQ ID NO: 1213557 - RNA, 17 nt, Homo sapiens
ucucaaugaaccauaaa

SEQ ID NO: 1213558 - RNA, 12 nt, Homo sapiens
ucucacaaauga

SEQ ID NO: 1213559 - RNA, 14 nt, Homo sapiens
ucucacauguggca

SEQ ID NO: 1213560 - RNA, 20 nt, Homo sapiens
ucucaccucuccuacucacu

SEQ ID NO: 1213561 - RNA, 18 nt, Homo sapiens
ucucaccuggacuccagu

SEQ ID NO: 1213562 - RNA, 23 nt, Homo sapiens
ucucacgggcaugggcacucccu

SEQ ID NO: 1213563 - RNA, 18 nt, Homo sapiens
ucucacuauguugcccag

SEQ ID NO: 1213564 - RNA, 22 nt, Homo sapiens
ucucacugugggaaggccagcu

SEQ ID NO: 1213565 - RNA, 21 nt, Homo sapiens
ucucagaaagugccugacaca

SEQ ID NO: 1213566 - RNA, 13 nt, Homo sapiens
ucucagaccccac

SEQ ID NO: 1213567 - RNA, 20 nt, Homo sapiens
ucucagaccugcgcacucca

SEQ ID NO: 1213568 - RNA, 11 nt, Homo sapiens
ucucagacuuu

SEQ ID NO: 1213569 - RNA, 13 nt, Homo sapiens
ucucagcagaaac

SEQ ID NO: 1213570 - RNA, 22 nt, Homo sapiens
uauguaugaguggcuucuggga

SEQ ID NO: 1213571 - RNA, 13 nt, Homo sapiens
uauguauggaaua

SEQ ID NO: 1213572 - RNA, 13 nt, Homo sapiens
uauguauuuucag

SEQ ID NO: 1213573 - RNA, 16 nt, Homo sapiens
ucaagucuucccugau

SEQ ID NO: 1213574 - RNA, 13 nt, Homo sapiens
ucaagugccuuaa

SEQ ID NO: 1213575 - RNA, 15 nt, Homo sapiens
ucaaguggguauucu

SEQ ID NO: 1213576 - RNA, 13 nt, Homo sapiens
uauaaaaguacua

SEQ ID NO: 1213577 - RNA, 13 nt, Homo sapiens
uauaaacauauca

SEQ ID NO: 1213578 - RNA, 16 nt, Homo sapiens
uauaaagauuguacuu

SEQ ID NO: 1213579 - RNA, 17 nt, Homo sapiens
uauaaagauuguacuua

SEQ ID NO: 1213580 - RNA, 19 nt, Homo sapiens
uauaaaggccagcgccaga

SEQ ID NO: 1213581 - RNA, 15 nt, Homo sapiens
uauaaauauauacag

SEQ ID NO: 1213582 - RNA, 21 nt, Homo sapiens
uauaaaugaaucugguguugg

SEQ ID NO: 1213583 - RNA, 13 nt, Homo sapiens
uauaaauggaauc

SEQ ID NO: 1213584 - RNA, 15 nt, Homo sapiens
uauaaauucuacuaa

SEQ ID NO: 1213585 - RNA, 21 nt, Homo sapiens
uauaaauuuuauaacagaauu

SEQ ID NO: 1213586 - RNA, 21 nt, Homo sapiens
uauaacaaacuacauguaauc

SEQ ID NO: 1213587 - RNA, 14 nt, Homo sapiens
uauaacagaauuaa

SEQ ID NO: 1213588 - RNA, 11 nt, Homo sapiens
uauaacagugu

SEQ ID NO: 1213589 - RNA, 12 nt, Homo sapiens
uauaacaguguu

SEQ ID NO: 1213590 - RNA, 22 nt, Homo sapiens
uauaacaugucuuucagcauua

SEQ ID NO: 1213591 - RNA, 23 nt, Homo sapiens
uauaacccuaggaauuuagacaa

SEQ ID NO: 1213592 - RNA, 17 nt, Homo sapiens
uauaaccuuguuccaaa

SEQ ID NO: 1213593 - RNA, 15 nt, Homo sapiens
uauaacgcagucuaa

SEQ ID NO: 1213594 - RNA, 21 nt, Homo sapiens
uauaacuuaggccuagccucu

SEQ ID NO: 1213595 - RNA, 22 nt, Homo sapiens
uauaacuuaggccuagccucuu

SEQ ID NO: 1213596 - RNA, 17 nt, Homo sapiens
uauaagcauacaacugg

SEQ ID NO: 1213597 - RNA, 20 nt, Homo sapiens
uauaagcauacaacuggacu

SEQ ID NO: 1213598 - RNA, 16 nt, Homo sapiens
uauaagguaugugcua

SEQ ID NO: 1213599 - RNA, 17 nt, Homo sapiens
uauaagguaugugcuau

SEQ ID NO: 1213600 - RNA, 22 nt, Homo sapiens
uauaaguaauacuucaguaaua

SEQ ID NO: 1213601 - RNA, 20 nt, Homo sapiens
uauaauaggaacaaucuuug

SEQ ID NO: 1213602 - RNA, 22 nt, Homo sapiens
uauaaucaaagcucauaaugga

SEQ ID NO: 1213603 - RNA, 16 nt, Homo sapiens
uauaaucccacccacc

SEQ ID NO: 1213604 - RNA, 16 nt, Homo sapiens
uauaauguaagcucua

SEQ ID NO: 1213605 - RNA, 20 nt, Homo sapiens
uauaauguauuuucagcuca

SEQ ID NO: 1213606 - RNA, 20 nt, Homo sapiens
uauaauuucaaaccacacau

SEQ ID NO: 1213607 - RNA, 20 nt, Homo sapiens
uauaauuuccauagugugag

SEQ ID NO: 1213608 - RNA, 12 nt, Homo sapiens
uauacaaagugu

SEQ ID NO: 1213609 - RNA, 21 nt, Homo sapiens
uauacaaauuagaaaauguua

SEQ ID NO: 1213610 - RNA, 17 nt, Homo sapiens
uauacaauaacccaguu

SEQ ID NO: 1213611 - RNA, 13 nt, Homo sapiens
uauacacauauau

SEQ ID NO: 1213612 - RNA, 12 nt, Homo sapiens
uauacacccaga

SEQ ID NO: 1213613 - RNA, 13 nt, Homo sapiens
uauacagcuguau

SEQ ID NO: 1213614 - RNA, 15 nt, Homo sapiens
uauacaggcauaaaa

SEQ ID NO: 1213615 - RNA, 16 nt, Homo sapiens
uauacaggcauaaaau

SEQ ID NO: 1213616 - RNA, 21 nt, Homo sapiens
uauaccaaccaaaccaauuca

SEQ ID NO: 1213617 - RNA, 20 nt, Homo sapiens
uauacccacauguacagaca

SEQ ID NO: 1213618 - RNA, 18 nt, Homo sapiens
uauacucagguaccucuu

SEQ ID NO: 1213619 - RNA, 14 nt, Homo sapiens
uauacugccaaaga

SEQ ID NO: 1213620 - RNA, 20 nt, Homo sapiens
uauacugguucacauccuac

SEQ ID NO: 1213621 - RNA, 15 nt, Homo sapiens
uauacuguacuuaau

SEQ ID NO: 1213622 - RNA, 19 nt, Homo sapiens
uauacuguagcugaugaaa

SEQ ID NO: 1213623 - RNA, 18 nt, Homo sapiens
uauacuguggcuaugcaa

SEQ ID NO: 1213624 - RNA, 11 nt, Homo sapiens
uauacuuucag

SEQ ID NO: 1213625 - RNA, 13 nt, Homo sapiens
uauacuuugcaau

SEQ ID NO: 1213626 - RNA, 18 nt, Homo sapiens
uauagaauaaaagcuaua

SEQ ID NO: 1213627 - RNA, 19 nt, Homo sapiens
uauagaaugaucuauugcu

SEQ ID NO: 1213628 - RNA, 14 nt, Homo sapiens
uauagacucuagga

SEQ ID NO: 1213629 - RNA, 17 nt, Homo sapiens
uauagagccuaccugua

SEQ ID NO: 1213630 - RNA, 22 nt, Homo sapiens
uauagagguguaacacuuguca

SEQ ID NO: 1213631 - RNA, 16 nt, Homo sapiens
uauagaguagaagauu

SEQ ID NO: 1213632 - RNA, 21 nt, Homo sapiens
uauagcacuuugaaauaccuc

SEQ ID NO: 1213633 - RNA, 12 nt, Homo sapiens
uauagccuuuaa

SEQ ID NO: 1213634 - RNA, 21 nt, Homo sapiens
uauagcgauugaaagggcaau

SEQ ID NO: 1213635 - RNA, 18 nt, Homo sapiens
uauagcguggguuaucag

SEQ ID NO: 1213636 - RNA, 23 nt, Homo sapiens
uauagcguucccaacaacaucca

SEQ ID NO: 1213637 - RNA, 17 nt, Homo sapiens
uauaggaaaaaaacugg

SEQ ID NO: 1213638 - RNA, 21 nt, Homo sapiens
uauaggaaaaguuauugugau

SEQ ID NO: 1213639 - RNA, 16 nt, Homo sapiens
uauaggaaacuaagca

SEQ ID NO: 1213640 - RNA, 22 nt, Homo sapiens
uauaggaucauuuguuggaaug

SEQ ID NO: 1213641 - RNA, 21 nt, Homo sapiens
uauaggcaugagccacugagc

SEQ ID NO: 1213642 - RNA, 15 nt, Homo sapiens
uauaggucacuccug

SEQ ID NO: 1213643 - RNA, 19 nt, Homo sapiens
uauaggucucaucucuuca

SEQ ID NO: 1213644 - RNA, 17 nt, Homo sapiens
uauaguauaagcagugu

SEQ ID NO: 1213645 - RNA, 14 nt, Homo sapiens
uauaguaugugacu

SEQ ID NO: 1213646 - RNA, 16 nt, Homo sapiens
uauaguaugugacuuu

SEQ ID NO: 1213647 - RNA, 14 nt, Homo sapiens
uauagucacaagag

SEQ ID NO: 1213648 - RNA, 23 nt, Homo sapiens
uauaguuucaagccaacugugga

SEQ ID NO: 1213649 - RNA, 18 nt, Homo sapiens
uauauaaguuuacaccuu

SEQ ID NO: 1213650 - RNA, 19 nt, Homo sapiens
uauauaauaaagcuacuga

SEQ ID NO: 1213651 - RNA, 20 nt, Homo sapiens
uauauaauaaagcuacugau

SEQ ID NO: 1213652 - RNA, 19 nt, Homo sapiens
uauauaauuuauuuccacu

SEQ ID NO: 1213653 - RNA, 21 nt, Homo sapiens
uauauacccccccaugcaguc

SEQ ID NO: 1213654 - RNA, 13 nt, Homo sapiens
uauauacuuugaa

SEQ ID NO: 1213655 - RNA, 21 nt, Homo sapiens
uauauagggaucaaccagcua

SEQ ID NO: 1213656 - RNA, 16 nt, Homo sapiens
uauauauguguauaua

SEQ ID NO: 1213657 - RNA, 13 nt, Homo sapiens
uauauauucccaa

SEQ ID NO: 1213658 - RNA, 12 nt, Homo sapiens
uauauauugaau

SEQ ID NO: 1213659 - RNA, 12 nt, Homo sapiens
uauauccaugua

SEQ ID NO: 1213660 - RNA, 19 nt, Homo sapiens
uauaucuuagguaagacau

SEQ ID NO: 1213661 - RNA, 20 nt, Homo sapiens
uauaugugauuuacauuuca

SEQ ID NO: 1213662 - RNA, 20 nt, Homo sapiens
uauauguguauauauacaua

SEQ ID NO: 1213663 - RNA, 21 nt, Homo sapiens
uauauguguauauauacauac

SEQ ID NO: 1213664 - RNA, 16 nt, Homo sapiens
uauauguugaaugaca

SEQ ID NO: 1213665 - RNA, 16 nt, Homo sapiens
uauauguuuauauacu

SEQ ID NO: 1213666 - RNA, 16 nt, Homo sapiens
uauauucaggaguugg

SEQ ID NO: 1213667 - RNA, 19 nt, Homo sapiens
uauauuguuuucaguguac

SEQ ID NO: 1213668 - RNA, 19 nt, Homo sapiens
uauauuugugauagcacuu

SEQ ID NO: 1213669 - RNA, 20 nt, Homo sapiens
uauauuugugauagcacuuu

SEQ ID NO: 1213670 - RNA, 17 nt, Homo sapiens
uauauuuuaaagcacuu

SEQ ID NO: 1213671 - RNA, 19 nt, Homo sapiens
uauauuuuugguugucaau

SEQ ID NO: 1213672 - RNA, 22 nt, Homo sapiens
uauauuuuuguacugaaucuca

SEQ ID NO: 1213673 - RNA, 16 nt, Homo sapiens
uaucaaaaaguauuaa

SEQ ID NO: 1213674 - RNA, 15 nt, Homo sapiens
uaucaaaauugccuu

SEQ ID NO: 1213675 - RNA, 21 nt, Homo sapiens
uaucaaagugugauauacaaa

SEQ ID NO: 1213676 - RNA, 15 nt, Homo sapiens
uaucaagcacuaaaa

SEQ ID NO: 1213677 - RNA, 16 nt, Homo sapiens
uaucaagugucuucca

SEQ ID NO: 1213678 - RNA, 15 nt, Homo sapiens
uaucaauaucuaaua

SEQ ID NO: 1213679 - RNA, 20 nt, Homo sapiens
uaucaaugaguaacaggaaa

SEQ ID NO: 1213680 - RNA, 18 nt, Homo sapiens
uaucaauuacaacaguga

SEQ ID NO: 1213681 - RNA, 22 nt, Homo sapiens
uaucaccuagcagccucaaaac

SEQ ID NO: 1213682 - RNA, 13 nt, Homo sapiens
uaucacgcagauc

SEQ ID NO: 1213683 - RNA, 17 nt, Homo sapiens
uaucacugaacaaacua

SEQ ID NO: 1213684 - RNA, 14 nt, Homo sapiens
uaucagaaguguua

SEQ ID NO: 1213685 - RNA, 14 nt, Homo sapiens
uaucagaauucuca

SEQ ID NO: 1213686 - RNA, 16 nt, Homo sapiens
uaucagacaagcacua

SEQ ID NO: 1213687 - RNA, 21 nt, Homo sapiens
uaucagacucuguaauugaau

SEQ ID NO: 1213688 - RNA, 17 nt, Homo sapiens
uaucagaggccuauaau

SEQ ID NO: 1213689 - RNA, 15 nt, Homo sapiens
uaucagcaauacuca

SEQ ID NO: 1213690 - RNA, 14 nt, Homo sapiens
uaucaggugcugcc

SEQ ID NO: 1213691 - RNA, 18 nt, Homo sapiens
uaucauaauucagcacuu

SEQ ID NO: 1213692 - RNA, 19 nt, Homo sapiens
uaucauaauucagcacuua

SEQ ID NO: 1213693 - RNA, 15 nt, Homo sapiens
uacuuuaucacuuuu

SEQ ID NO: 1213694 - RNA, 14 nt, Homo sapiens
uacuuucacacuaa

SEQ ID NO: 1213695 - RNA, 22 nt, Homo sapiens
uacuuugcaauccaaauaaaga

SEQ ID NO: 1213696 - RNA, 24 nt, Homo sapiens
uacuuugggacgcccacguggcag

SEQ ID NO: 1213697 - RNA, 17 nt, Homo sapiens
uacuuugguaguggaau

SEQ ID NO: 1213698 - RNA, 19 nt, Homo sapiens
uacuuuguccuaagagauu

SEQ ID NO: 1213699 - RNA, 19 nt, Homo sapiens
uacuuuugacccaugugca

SEQ ID NO: 1213700 - RNA, 13 nt, Homo sapiens
uacuuuugcuuca

SEQ ID NO: 1213701 - RNA, 19 nt, Homo sapiens
uacuuuuguuguaugggau

SEQ ID NO: 1213702 - RNA, 11 nt, Homo sapiens
uagaaaacugg

SEQ ID NO: 1213703 - RNA, 22 nt, Homo sapiens
uagaaaaggccuucuucccaau

SEQ ID NO: 1213704 - RNA, 18 nt, Homo sapiens
uagaaaauuagacuguga

SEQ ID NO: 1213705 - RNA, 17 nt, Homo sapiens
uagaaacaugacacuga

SEQ ID NO: 1213706 - RNA, 20 nt, Homo sapiens
uagaaagcuggcaacaugaa

SEQ ID NO: 1213707 - RNA, 21 nt, Homo sapiens
uagaaagcuggcaacaugaag

SEQ ID NO: 1213708 - RNA, 17 nt, Homo sapiens
uagaaagggccuugaca

SEQ ID NO: 1213709 - RNA, 15 nt, Homo sapiens
uagaaagggugcugc

SEQ ID NO: 1213710 - RNA, 23 nt, Homo sapiens
uagaaauaaaagugaaugaaaga

SEQ ID NO: 1213711 - RNA, 13 nt, Homo sapiens
uagaaaugaauuu

SEQ ID NO: 1213712 - RNA, 18 nt, Homo sapiens
uagaaaugaccaauauua

SEQ ID NO: 1213713 - RNA, 20 nt, Homo sapiens
uagaaaugcggucuggucuc

SEQ ID NO: 1213714 - RNA, 18 nt, Homo sapiens
uagaaauguaaacugcca

SEQ ID NO: 1213715 - RNA, 13 nt, Homo sapiens
uagaaauuuuaca

SEQ ID NO: 1213716 - RNA, 15 nt, Homo sapiens
uagaacacaguuugu

SEQ ID NO: 1213717 - RNA, 16 nt, Homo sapiens
uagaacacugcauuag

SEQ ID NO: 1213718 - RNA, 17 nt, Homo sapiens
uagaacacugcauuaga

SEQ ID NO: 1213719 - RNA, 21 nt, Homo sapiens
uagaacccauaaccauacaca

SEQ ID NO: 1213720 - RNA, 18 nt, Homo sapiens
uagaacuauuaaaacagc

SEQ ID NO: 1213721 - RNA, 23 nt, Homo sapiens
uagaacucugggcugccauguga

SEQ ID NO: 1213722 - RNA, 18 nt, Homo sapiens
uagaagauuuuaugcugc

SEQ ID NO: 1213723 - RNA, 19 nt, Homo sapiens
uagaagauuuuaugcugcu

SEQ ID NO: 1213724 - RNA, 11 nt, Homo sapiens
uagaagccaag

SEQ ID NO: 1213725 - RNA, 21 nt, Homo sapiens
uagaagcuguaacagaauaca

SEQ ID NO: 1213726 - RNA, 14 nt, Homo sapiens
uagaagucauaugu

SEQ ID NO: 1213727 - RNA, 16 nt, Homo sapiens
uagaauaagucauugu

SEQ ID NO: 1213728 - RNA, 15 nt, Homo sapiens
uagaauacuuuuuaa

SEQ ID NO: 1213729 - RNA, 18 nt, Homo sapiens
uagaauagcgacaggaau

SEQ ID NO: 1213730 - RNA, 20 nt, Homo sapiens
uagaauauuuauuaccucug

SEQ ID NO: 1213731 - RNA, 21 nt, Homo sapiens
uagaauauuuuaagaauuuca

SEQ ID NO: 1213732 - RNA, 19 nt, Homo sapiens
uagaaugaucuauugcuca

SEQ ID NO: 1213733 - RNA, 23 nt, Homo sapiens
uagaaugggaagggucauagaaa

SEQ ID NO: 1213734 - RNA, 19 nt, Homo sapiens
uagaauuauaagucacaaa

SEQ ID NO: 1213735 - RNA, 15 nt, Homo sapiens
uagacaaaaaguaua

SEQ ID NO: 1213736 - RNA, 13 nt, Homo sapiens
uagacaauuugca

SEQ ID NO: 1213737 - RNA, 15 nt, Homo sapiens
uagacaauuugcaca

SEQ ID NO: 1213738 - RNA, 17 nt, Homo sapiens
uagacagguguuacuua

SEQ ID NO: 1213739 - RNA, 19 nt, Homo sapiens
uagacagguguuacuuaca

SEQ ID NO: 1213740 - RNA, 15 nt, Homo sapiens
uagacauucuuuauc

SEQ ID NO: 1213741 - RNA, 14 nt, Homo sapiens
uagacuacauuuag

SEQ ID NO: 1213742 - RNA, 15 nt, Homo sapiens
uagacuacucaauau

SEQ ID NO: 1213743 - RNA, 20 nt, Homo sapiens
uagacuccauguaguuacuu

SEQ ID NO: 1213744 - RNA, 12 nt, Homo sapiens
uagacugccagg

SEQ ID NO: 1213745 - RNA, 16 nt, Homo sapiens
uagagaauuuccuuac

SEQ ID NO: 1213746 - RNA, 21 nt, Homo sapiens
uagagacaggguuuugccaug

SEQ ID NO: 1213747 - RNA, 22 nt, Homo sapiens
uagagaccaguuuucucuggaa

SEQ ID NO: 1213748 - RNA, 20 nt, Homo sapiens
uagagacgguguuuugccau

SEQ ID NO: 1213749 - RNA, 16 nt, Homo sapiens
uagagagagaacuuuu

SEQ ID NO: 1213750 - RNA, 18 nt, Homo sapiens
uagagaggggacuggggg

SEQ ID NO: 1213751 - RNA, 18 nt, Homo sapiens
uagagauagcuacagugu

SEQ ID NO: 1213752 - RNA, 18 nt, Homo sapiens
uagagaucugguuuugcu

SEQ ID NO: 1213753 - RNA, 21 nt, Homo sapiens
uagaggaaggcugaacucuuc

SEQ ID NO: 1213754 - RNA, 17 nt, Homo sapiens
uagaggacgugggaccg

SEQ ID NO: 1213755 - RNA, 15 nt, Homo sapiens
uagaggauguaucuc

SEQ ID NO: 1213756 - RNA, 21 nt, Homo sapiens
uagagguguaacacuugucaa

SEQ ID NO: 1213757 - RNA, 21 nt, Homo sapiens
uagagucacugauacacagaa

SEQ ID NO: 1213758 - RNA, 17 nt, Homo sapiens
uagagugauuuugaaau

SEQ ID NO: 1213759 - RNA, 12 nt, Homo sapiens
uagauaacgcuu

SEQ ID NO: 1213760 - RNA, 22 nt, Homo sapiens
uagauaauaugaaaaucuccau

SEQ ID NO: 1213761 - RNA, 17 nt, Homo sapiens
uagauauaacacuaugu

SEQ ID NO: 1213762 - RNA, 22 nt, Homo sapiens
uagauauaacacuauguuuauu

SEQ ID NO: 1213763 - RNA, 14 nt, Homo sapiens
uagauauacauauc

SEQ ID NO: 1213764 - RNA, 15 nt, Homo sapiens
uagaucaaagucaaa

SEQ ID NO: 1213765 - RNA, 16 nt, Homo sapiens
uagaucaucagucacc

SEQ ID NO: 1213766 - RNA, 18 nt, Homo sapiens
uagauccaaggcagggaa

SEQ ID NO: 1213767 - RNA, 13 nt, Homo sapiens
uagaucuuucuag

SEQ ID NO: 1213768 - RNA, 22 nt, Homo sapiens
uagaugauuaaauaagauucua

SEQ ID NO: 1213769 - RNA, 23 nt, Homo sapiens
uagaugcacuuaugcaguaaauu

SEQ ID NO: 1213770 - RNA, 17 nt, Homo sapiens
uagaugcugacuguacu

SEQ ID NO: 1213771 - RNA, 16 nt, Homo sapiens
uagaugguuugagccu

SEQ ID NO: 1213772 - RNA, 19 nt, Homo sapiens
uagauguauaaaucuuucu

SEQ ID NO: 1213773 - RNA, 14 nt, Homo sapiens
uagauuaaacaaac

SEQ ID NO: 1213774 - RNA, 23 nt, Homo sapiens
uagauugcagaaaauucugugcc

SEQ ID NO: 1213775 - RNA, 16 nt, Homo sapiens
uagauuucuacauuaa

SEQ ID NO: 1213776 - RNA, 13 nt, Homo sapiens
uagauuuggcauc

SEQ ID NO: 1213777 - RNA, 22 nt, Homo sapiens
uagcaaaaacauguaugugcau

SEQ ID NO: 1213778 - RNA, 16 nt, Homo sapiens
uagcaaacacuggggg

SEQ ID NO: 1213779 - RNA, 23 nt, Homo sapiens
uagcaaagauuaaaugugucauu

SEQ ID NO: 1213780 - RNA, 13 nt, Homo sapiens
uagcaaaugacau

SEQ ID NO: 1213781 - RNA, 19 nt, Homo sapiens
uagcaaauuaacuuuacau

SEQ ID NO: 1213782 - RNA, 13 nt, Homo sapiens
uagcaacuuugau

SEQ ID NO: 1213783 - RNA, 22 nt, Homo sapiens
uagcaagcuggccucuaccaca

SEQ ID NO: 1213784 - RNA, 16 nt, Homo sapiens
uagcaauaacauacau

SEQ ID NO: 1213785 - RNA, 14 nt, Homo sapiens
uagcaauauaucag

SEQ ID NO: 1213786 - RNA, 16 nt, Homo sapiens
uagcacaaacuacaau

SEQ ID NO: 1213787 - RNA, 17 nt, Homo sapiens
uagcacacuuuuccaca

SEQ ID NO: 1213788 - RNA, 18 nt, Homo sapiens
uagcacuuugaaauaccu

SEQ ID NO: 1213789 - RNA, 19 nt, Homo sapiens
uagcacuuugaaauaccuc

SEQ ID NO: 1213790 - RNA, 20 nt, Homo sapiens
uagcacuuugaaauaccuca

SEQ ID NO: 1213791 - RNA, 17 nt, Homo sapiens
uagcagaaaaauguguu

SEQ ID NO: 1213792 - RNA, 14 nt, Homo sapiens
uagcagacaguguu

SEQ ID NO: 1213793 - RNA, 20 nt, Homo sapiens
uagcagaguuaaaucucaaa

SEQ ID NO: 1213794 - RNA, 16 nt, Homo sapiens
uagcagaugguuucca

SEQ ID NO: 1213795 - RNA, 18 nt, Homo sapiens
uagcaggcaaugcuguac

SEQ ID NO: 1213796 - RNA, 18 nt, Homo sapiens
uagcaggccuaagacaug

SEQ ID NO: 1213797 - RNA, 13 nt, Homo sapiens
uagcagucacuga

SEQ ID NO: 1213798 - RNA, 14 nt, Homo sapiens
uagcauaacuguag

SEQ ID NO: 1213799 - RNA, 21 nt, Homo sapiens
uagcauaguaccucugcuauu

SEQ ID NO: 1213800 - RNA, 13 nt, Homo sapiens
uagcaugaugaaa

SEQ ID NO: 1213801 - RNA, 15 nt, Homo sapiens
uagcaugcacaaagu

SEQ ID NO: 1213802 - RNA, 22 nt, Homo sapiens
uagcauugccaauauccuguau

SEQ ID NO: 1213803 - RNA, 17 nt, Homo sapiens
guugccaugugugcuga

SEQ ID NO: 1213804 - RNA, 17 nt, Homo sapiens
guugccuaagcauugcc

SEQ ID NO: 1213805 - RNA, 19 nt, Homo sapiens
guugccuuuauauccaaaa

SEQ ID NO: 1213806 - RNA, 18 nt, Homo sapiens
guugcuuuugugaacuuu

SEQ ID NO: 1213807 - RNA, 10 nt, Homo sapiens
guuggaagag

SEQ ID NO: 1213808 - RNA, 12 nt, Homo sapiens
guuggacagccc

SEQ ID NO: 1213809 - RNA, 18 nt, Homo sapiens
guuggacuaaaugccuag

SEQ ID NO: 1213810 - RNA, 21 nt, Homo sapiens
guuggacuguaagggauugaa

SEQ ID NO: 1213811 - RNA, 20 nt, Homo sapiens
guuggacuucagucuugccu

SEQ ID NO: 1213812 - RNA, 22 nt, Homo sapiens
guuggccagugugacaaggauu

SEQ ID NO: 1213813 - RNA, 21 nt, Homo sapiens
guuggccucagggccaggaag

SEQ ID NO: 1213814 - RNA, 18 nt, Homo sapiens
guuggccugcacuggugu

SEQ ID NO: 1213815 - RNA, 15 nt, Homo sapiens
guuggcugcacuuga

SEQ ID NO: 1213816 - RNA, 17 nt, Homo sapiens
guugggcuuccaugccu

SEQ ID NO: 1213817 - RNA, 16 nt, Homo sapiens
guuggugaauuucaca

SEQ ID NO: 1213818 - RNA, 20 nt, Homo sapiens
guuggugaauuucacaagcu

SEQ ID NO: 1213819 - RNA, 16 nt, Homo sapiens
guuggugacaccucac

SEQ ID NO: 1213820 - RNA, 14 nt, Homo sapiens
guugguucaucccu

SEQ ID NO: 1213821 - RNA, 11 nt, Homo sapiens
guugguucuga

SEQ ID NO: 1213822 - RNA, 21 nt, Homo sapiens
guugguuguuuuuuccuuugc

SEQ ID NO: 1213823 - RNA, 14 nt, Homo sapiens
guuguaaugcugca

SEQ ID NO: 1213824 - RNA, 15 nt, Homo sapiens
guuguacaaucaaaa

SEQ ID NO: 1213825 - RNA, 18 nt, Homo sapiens
guuguaggguuacagaga

SEQ ID NO: 1213826 - RNA, 21 nt, Homo sapiens
guuguaguuaccuacugagua

SEQ ID NO: 1213827 - RNA, 13 nt, Homo sapiens
guugucaaaaagu

SEQ ID NO: 1213828 - RNA, 19 nt, Homo sapiens
guugucucuagagcaggga

SEQ ID NO: 1213829 - RNA, 21 nt, Homo sapiens
guugucugaagucacugcaca

SEQ ID NO: 1213830 - RNA, 18 nt, Homo sapiens
guugugaugaaucaauga

SEQ ID NO: 1213831 - RNA, 14 nt, Homo sapiens
guugugcaagcuag

SEQ ID NO: 1213832 - RNA, 16 nt, Homo sapiens
guuguguugucacuaa

SEQ ID NO: 1213833 - RNA, 21 nt, Homo sapiens
guuguucaaauguuccuuuua

SEQ ID NO: 1213834 - RNA, 19 nt, Homo sapiens
guuguucaguugccaagga

SEQ ID NO: 1213835 - RNA, 20 nt, Homo sapiens
guuguugauugacugcauga

SEQ ID NO: 1213836 - RNA, 18 nt, Homo sapiens
guuguuuuauauguugcu

SEQ ID NO: 1213837 - RNA, 22 nt, Homo sapiens
guuuaaagucucaguuucuugc

SEQ ID NO: 1213838 - RNA, 17 nt, Homo sapiens
guuuaacauuuccucag

SEQ ID NO: 1213839 - RNA, 13 nt, Homo sapiens
guuuaacugaaag

SEQ ID NO: 1213840 - RNA, 19 nt, Homo sapiens
guuuaagugugcagccaua

SEQ ID NO: 1213841 - RNA, 16 nt, Homo sapiens
guuuacagcacuacuc

SEQ ID NO: 1213842 - RNA, 15 nt, Homo sapiens
guuuacagugaugcc

SEQ ID NO: 1213843 - RNA, 20 nt, Homo sapiens
guuuacauccagaguucugu

SEQ ID NO: 1213844 - RNA, 16 nt, Homo sapiens
guuuacaugagacuuu

SEQ ID NO: 1213845 - RNA, 18 nt, Homo sapiens
guuuaccaguugccuuuu

SEQ ID NO: 1213846 - RNA, 16 nt, Homo sapiens
guuuaccuagaagaag

SEQ ID NO: 1213847 - RNA, 15 nt, Homo sapiens
guuuaccucuucuau

SEQ ID NO: 1213848 - RNA, 19 nt, Homo sapiens
guuuaccucuucuaugcaa

SEQ ID NO: 1213849 - RNA, 21 nt, Homo sapiens
guuuacuucucaccauuugag

SEQ ID NO: 1213850 - RNA, 12 nt, Homo sapiens
guuuagaccaag

SEQ ID NO: 1213851 - RNA, 14 nt, Homo sapiens
guuuagaccaagga

SEQ ID NO: 1213852 - RNA, 16 nt, Homo sapiens
guuuagcaacuuugau

SEQ ID NO: 1213853 - RNA, 23 nt, Homo sapiens
guuuagcauaguaccucugcuau

SEQ ID NO: 1213854 - RNA, 17 nt, Homo sapiens
guuuaggaauccuuugg

SEQ ID NO: 1213855 - RNA, 17 nt, Homo sapiens
guuuaguugcagacuca

SEQ ID NO: 1213856 - RNA, 12 nt, Homo sapiens
guuuaugaauga

SEQ ID NO: 1213857 - RNA, 14 nt, Homo sapiens
guuuaugagccaga

SEQ ID NO: 1213858 - RNA, 19 nt, Homo sapiens
guuuaugauauuucuugcu

SEQ ID NO: 1213859 - RNA, 19 nt, Homo sapiens
guuuauggccacauuuaau

SEQ ID NO: 1213860 - RNA, 19 nt, Homo sapiens
guuuauuuaucagugacag

SEQ ID NO: 1213861 - RNA, 22 nt, Homo sapiens
guuuauuuuagaggaacucuca

SEQ ID NO: 1213862 - RNA, 19 nt, Homo sapiens
guuucacccuuaacccaag

SEQ ID NO: 1213863 - RNA, 13 nt, Homo sapiens
guuucacugugca

SEQ ID NO: 1213864 - RNA, 19 nt, Homo sapiens
guuucacuguguuagccag

SEQ ID NO: 1213865 - RNA, 20 nt, Homo sapiens
guuucagugaaggucaccug

SEQ ID NO: 1213866 - RNA, 20 nt, Homo sapiens
guuucauguuuugugacuau

SEQ ID NO: 1213867 - RNA, 22 nt, Homo sapiens
guuuccaauaaacgcaagcuga

SEQ ID NO: 1213868 - RNA, 16 nt, Homo sapiens
guuuccacagccugca

SEQ ID NO: 1213869 - RNA, 20 nt, Homo sapiens
guuuccguggguucugucau

SEQ ID NO: 1213870 - RNA, 19 nt, Homo sapiens
guuuccuauguuucacugu

SEQ ID NO: 1213871 - RNA, 22 nt, Homo sapiens
guuuccucgcugaucgauuucu

SEQ ID NO: 1213872 - RNA, 16 nt, Homo sapiens
guuucuccauguuggu

SEQ ID NO: 1213873 - RNA, 19 nt, Homo sapiens
guuucuccucuuuccuccu

SEQ ID NO: 1213874 - RNA, 23 nt, Homo sapiens
guuucucuuggguauaaaggcua

SEQ ID NO: 1213875 - RNA, 14 nt, Homo sapiens
guuucugucuguaa

SEQ ID NO: 1213876 - RNA, 16 nt, Homo sapiens
guuucuuagcuuuuua

SEQ ID NO: 1213877 - RNA, 11 nt, Homo sapiens
guuucuuccaa

SEQ ID NO: 1213878 - RNA, 23 nt, Homo sapiens
guuucuugcucccagaccaaggc

SEQ ID NO: 1213879 - RNA, 15 nt, Homo sapiens
guuugaacucaggga

SEQ ID NO: 1213880 - RNA, 19 nt, Homo sapiens
guuugauaccugcacuguc

SEQ ID NO: 1213881 - RNA, 22 nt, Homo sapiens
guuugauaccugcacuguccug

SEQ ID NO: 1213882 - RNA, 22 nt, Homo sapiens
guuugaugucauuaauguguug

SEQ ID NO: 1213883 - RNA, 23 nt, Homo sapiens
guuugauugaggagcugcacuga

SEQ ID NO: 1213884 - RNA, 16 nt, Homo sapiens
guuugcaaugucacaa

SEQ ID NO: 1213885 - RNA, 11 nt, Homo sapiens
guuugccaugu

SEQ ID NO: 1213886 - RNA, 14 nt, Homo sapiens
guuugcugugaaca

SEQ ID NO: 1213887 - RNA, 21 nt, Homo sapiens
guuugcuuuggaaauccucua

SEQ ID NO: 1213888 - RNA, 16 nt, Homo sapiens
guuuggaagaccagaa

SEQ ID NO: 1213889 - RNA, 17 nt, Homo sapiens
guuuggaauaaagucaa

SEQ ID NO: 1213890 - RNA, 21 nt, Homo sapiens
guuuggacccaguucagugag

SEQ ID NO: 1213891 - RNA, 19 nt, Homo sapiens
guuuggagguccuagguca

SEQ ID NO: 1213892 - RNA, 14 nt, Homo sapiens
guuuggagucacug

SEQ ID NO: 1213893 - RNA, 16 nt, Homo sapiens
guuuggagucacugua

SEQ ID NO: 1213894 - RNA, 13 nt, Homo sapiens
guuuggccaaaaa

SEQ ID NO: 1213895 - RNA, 14 nt, Homo sapiens
guuuggccaaaaag

SEQ ID NO: 1213896 - RNA, 11 nt, Homo sapiens
guuacauauua

SEQ ID NO: 1213897 - RNA, 10 nt, Homo sapiens
guuacauuuc

SEQ ID NO: 1213898 - RNA, 12 nt, Homo sapiens
guuaccauucac

SEQ ID NO: 1213899 - RNA, 22 nt, Homo sapiens
guuaccucugaguuguguucca

SEQ ID NO: 1213900 - RNA, 17 nt, Homo sapiens
guuaccucugcauggaa

SEQ ID NO: 1213901 - RNA, 20 nt, Homo sapiens
guuacucaggguucaucugu

SEQ ID NO: 1213902 - RNA, 15 nt, Homo sapiens
guuacugaaggugau

SEQ ID NO: 1213903 - RNA, 12 nt, Homo sapiens
guuacuuuguaa

SEQ ID NO: 1213904 - RNA, 21 nt, Homo sapiens
guuacuuuugacccaugugca

SEQ ID NO: 1213905 - RNA, 20 nt, Homo sapiens
guuacuuuuucuuguauuca

SEQ ID NO: 1213906 - RNA, 21 nt, Homo sapiens
guuacuuuuucuuguauucau

SEQ ID NO: 1213907 - RNA, 15 nt, Homo sapiens
guuacuuuuuuacac

SEQ ID NO: 1213908 - RNA, 19 nt, Homo sapiens
guuagaaaaaggacucugc

SEQ ID NO: 1213909 - RNA, 21 nt, Homo sapiens
guuagaaaaauagcugugaac

SEQ ID NO: 1213910 - RNA, 16 nt, Homo sapiens
guuagaacuagccaaa

SEQ ID NO: 1213911 - RNA, 18 nt, Homo sapiens
guuagagaauuuccuuac

SEQ ID NO: 1213912 - RNA, 16 nt, Homo sapiens
guuagcacuguugaug

SEQ ID NO: 1213913 - RNA, 19 nt, Homo sapiens
guuagcauauggugcuuaa

SEQ ID NO: 1213914 - RNA, 22 nt, Homo sapiens
guuagcuggguuuacaugugau

SEQ ID NO: 1213915 - RNA, 15 nt, Homo sapiens
guuaggauagcauuu

SEQ ID NO: 1213916 - RNA, 13 nt, Homo sapiens
guuaggcauuaau

SEQ ID NO: 1213917 - RNA, 20 nt, Homo sapiens
guuaggggaauggagggaau

SEQ ID NO: 1213918 - RNA, 21 nt, Homo sapiens
guuaguugugaaagaaagcug

SEQ ID NO: 1213919 - RNA, 17 nt, Homo sapiens
guuauaaaucaauguca

SEQ ID NO: 1213920 - RNA, 18 nt, Homo sapiens
guuauaaaucaaugucac

SEQ ID NO: 1213921 - RNA, 20 nt, Homo sapiens
guuauaaaucaaugucacuu

SEQ ID NO: 1213922 - RNA, 20 nt, Homo sapiens
guuauaagcagcaagacaaa

SEQ ID NO: 1213923 - RNA, 15 nt, Homo sapiens
guuauauucagugug

SEQ ID NO: 1213924 - RNA, 18 nt, Homo sapiens
guuauauuuaaugcauua

SEQ ID NO: 1213925 - RNA, 12 nt, Homo sapiens
guuaucacuuau

SEQ ID NO: 1213926 - RNA, 18 nt, Homo sapiens
guuaucuaauauguaaca

SEQ ID NO: 1213927 - RNA, 19 nt, Homo sapiens
guuaucuguguagcaagcu

SEQ ID NO: 1213928 - RNA, 13 nt, Homo sapiens
guuaugaacaaag

SEQ ID NO: 1213929 - RNA, 13 nt, Homo sapiens
guuaugacaguga

SEQ ID NO: 1213930 - RNA, 14 nt, Homo sapiens
guuaugacagugaa

SEQ ID NO: 1213931 - RNA, 16 nt, Homo sapiens
guuaugauauuguuua

SEQ ID NO: 1213932 - RNA, 14 nt, Homo sapiens
guuauguuugcacu

SEQ ID NO: 1213933 - RNA, 17 nt, Homo sapiens
guuauguuugcacuuug

SEQ ID NO: 1213934 - RNA, 18 nt, Homo sapiens
guuauguuugcacuuugu

SEQ ID NO: 1213935 - RNA, 19 nt, Homo sapiens
guuauuaauuaauauucau

SEQ ID NO: 1213936 - RNA, 16 nt, Homo sapiens
guuauuauuuugcacu

SEQ ID NO: 1213937 - RNA, 17 nt, Homo sapiens
guuauuauuuugcacug

SEQ ID NO: 1213938 - RNA, 15 nt, Homo sapiens
guuauugugaaugau

SEQ ID NO: 1213939 - RNA, 17 nt, Homo sapiens
guuauuuaugcacugug

SEQ ID NO: 1213940 - RNA, 19 nt, Homo sapiens
guuauuuaugccucuguau

SEQ ID NO: 1213941 - RNA, 14 nt, Homo sapiens
guuauuuuccauuu

SEQ ID NO: 1213942 - RNA, 16 nt, Homo sapiens
guucaacaucuaaaaa

SEQ ID NO: 1213943 - RNA, 15 nt, Homo sapiens
guucacaacagugaa

SEQ ID NO: 1213944 - RNA, 16 nt, Homo sapiens
guucacacaaagccug

SEQ ID NO: 1213945 - RNA, 16 nt, Homo sapiens
guucacucccaaccug

SEQ ID NO: 1213946 - RNA, 22 nt, Homo sapiens
guucagaccaaugcucaacucc

SEQ ID NO: 1213947 - RNA, 11 nt, Homo sapiens
guucagaguuc

SEQ ID NO: 1213948 - RNA, 14 nt, Homo sapiens
guucagaugugcau

SEQ ID NO: 1213949 - RNA, 13 nt, Homo sapiens
guucaguuuacua

SEQ ID NO: 1213950 - RNA, 23 nt, Homo sapiens
guucauaccuaaguacuguaaua

SEQ ID NO: 1213951 - RNA, 19 nt, Homo sapiens
guucauggguuuaccacua

SEQ ID NO: 1213952 - RNA, 14 nt, Homo sapiens
guucaugugccucu

SEQ ID NO: 1213953 - RNA, 18 nt, Homo sapiens
guucauuauuuugugguu

SEQ ID NO: 1213954 - RNA, 16 nt, Homo sapiens
guucauugcacuuuga

SEQ ID NO: 1213955 - RNA, 19 nt, Homo sapiens
guucauuucacacagugaa

SEQ ID NO: 1213956 - RNA, 17 nt, Homo sapiens
guucauuuuagugacug

SEQ ID NO: 1213957 - RNA, 16 nt, Homo sapiens
guuccaagacauuguc

SEQ ID NO: 1213958 - RNA, 16 nt, Homo sapiens
guuccaccaugagcuc

SEQ ID NO: 1213959 - RNA, 16 nt, Homo sapiens
guuccagauggggccu

SEQ ID NO: 1213960 - RNA, 13 nt, Homo sapiens
guuccauguuaaa

SEQ ID NO: 1213961 - RNA, 14 nt, Homo sapiens
guuccauguuaaaa

SEQ ID NO: 1213962 - RNA, 16 nt, Homo sapiens
guucccaauacaaaaa

SEQ ID NO: 1213963 - RNA, 20 nt, Homo sapiens
guuccccacugacagccucc

SEQ ID NO: 1213964 - RNA, 15 nt, Homo sapiens
guucccccagcaagc

SEQ ID NO: 1213965 - RNA, 16 nt, Homo sapiens
guucccccaguaccuc

SEQ ID NO: 1213966 - RNA, 13 nt, Homo sapiens
guuccccucugcu

SEQ ID NO: 1213967 - RNA, 19 nt, Homo sapiens
guucccuguucuuccucca

SEQ ID NO: 1213968 - RNA, 22 nt, Homo sapiens
guuccggauuggcuuguguguu

SEQ ID NO: 1213969 - RNA, 12 nt, Homo sapiens
guuccucaaaag

SEQ ID NO: 1213970 - RNA, 17 nt, Homo sapiens
guuccugacaucacagc

SEQ ID NO: 1213971 - RNA, 12 nt, Homo sapiens
guuccugacugg

SEQ ID NO: 1213972 - RNA, 22 nt, Homo sapiens
guuccugccuuaacugaugaca

SEQ ID NO: 1213973 - RNA, 15 nt, Homo sapiens
guuccuuucuuuucc

SEQ ID NO: 1213974 - RNA, 17 nt, Homo sapiens
guucgauuucuaccuca

SEQ ID NO: 1213975 - RNA, 17 nt, Homo sapiens
guucuaaaguucuaaga

SEQ ID NO: 1213976 - RNA, 22 nt, Homo sapiens
guucuaagaaacccucugucau

SEQ ID NO: 1213977 - RNA, 15 nt, Homo sapiens
guucuaaguucaugu

SEQ ID NO: 1213978 - RNA, 13 nt, Homo sapiens
guucuacacugau

SEQ ID NO: 1213979 - RNA, 14 nt, Homo sapiens
guucuacaguuaau

SEQ ID NO: 1213980 - RNA, 21 nt, Homo sapiens
guucuaccucaggcagcucaa

SEQ ID NO: 1213981 - RNA, 13 nt, Homo sapiens
guucuauccaaac

SEQ ID NO: 1213982 - RNA, 19 nt, Homo sapiens
guucucaaaguuaauucac

SEQ ID NO: 1213983 - RNA, 20 nt, Homo sapiens
guucucauggguggcacuca

SEQ ID NO: 1213984 - RNA, 19 nt, Homo sapiens
guucucccaccaccucacc

SEQ ID NO: 1213985 - RNA, 16 nt, Homo sapiens
guucucuauugcugcu

SEQ ID NO: 1213986 - RNA, 21 nt, Homo sapiens
guucucucuuaguaacauaga

SEQ ID NO: 1213987 - RNA, 13 nt, Homo sapiens
guucucugcuaaa

SEQ ID NO: 1213988 - RNA, 18 nt, Homo sapiens
guucucuuugguguuaca

SEQ ID NO: 1213989 - RNA, 21 nt, Homo sapiens
aaacauuaaaagaagacugga

SEQ ID NO: 1213990 - RNA, 20 nt, Homo sapiens
aaacauuauaaaaauugaca

SEQ ID NO: 1213991 - RNA, 19 nt, Homo sapiens
aaacauucacacagggcuc

SEQ ID NO: 1213992 - RNA, 13 nt, Homo sapiens
aaacauuccaaga

SEQ ID NO: 1213993 - RNA, 15 nt, Homo sapiens
aaacauuccaggaaa

SEQ ID NO: 1213994 - RNA, 16 nt, Homo sapiens
aaacauucuuuuccac

SEQ ID NO: 1213995 - RNA, 20 nt, Homo sapiens
aaacauuggauuuuuccuua

SEQ ID NO: 1213996 - RNA, 14 nt, Homo sapiens
aaacauuucuggac

SEQ ID NO: 1213997 - RNA, 19 nt, Homo sapiens
aaacauuugguugcuacug

SEQ ID NO: 1213998 - RNA, 18 nt, Homo sapiens
aaaccaaagagggcuucc

SEQ ID NO: 1213999 - RNA, 19 nt, Homo sapiens
aaaccaagccguggcuucc

SEQ ID NO: 1214000 - RNA, 18 nt, Homo sapiens
aaaccaaguuuuacuaaa

SEQ ID NO: 1214001 - RNA, 13 nt, Homo sapiens
aaaccaaugauuc

SEQ ID NO: 1214002 - RNA, 14 nt, Homo sapiens
aaaccaaugauuca

SEQ ID NO: 1214003 - RNA, 12 nt, Homo sapiens
aaaccacagcca

SEQ ID NO: 1214004 - RNA, 15 nt, Homo sapiens
aaaccaccucagaaa

SEQ ID NO: 1214005 - RNA, 14 nt, Homo sapiens
aaaccagagucaaa

SEQ ID NO: 1214006 - RNA, 14 nt, Homo sapiens
aaaccaggacauua

SEQ ID NO: 1214007 - RNA, 20 nt, Homo sapiens
aaaccaucaaaaauauucca

SEQ ID NO: 1214008 - RNA, 22 nt, Homo sapiens
aaaccauuuuguuauugacuaa

SEQ ID NO: 1214009 - RNA, 23 nt, Homo sapiens
aaacccaagugccuucagaggau

SEQ ID NO: 1214010 - RNA, 19 nt, Homo sapiens
aaacccagacaaccaaaac

SEQ ID NO: 1214011 - RNA, 18 nt, Homo sapiens
aaacccagccccacaaac

SEQ ID NO: 1214012 - RNA, 13 nt, Homo sapiens
aaaccccgucucu

SEQ ID NO: 1214013 - RNA, 15 nt, Homo sapiens
aaaccgagugcaaug

SEQ ID NO: 1214014 - RNA, 16 nt, Homo sapiens
aaaccgagugcaauga

SEQ ID NO: 1214015 - RNA, 14 nt, Homo sapiens
aaaccuauauuuca

SEQ ID NO: 1214016 - RNA, 12 nt, Homo sapiens
aaaccuccacug

SEQ ID NO: 1214017 - RNA, 18 nt, Homo sapiens
aaaccuccacugcugcuc

SEQ ID NO: 1214018 - RNA, 19 nt, Homo sapiens
aaaccuccuucagaucucu

SEQ ID NO: 1214019 - RNA, 16 nt, Homo sapiens
aaaccugaccccugcu

SEQ ID NO: 1214020 - RNA, 15 nt, Homo sapiens
aaaccuggaugucac

SEQ ID NO: 1214021 - RNA, 22 nt, Homo sapiens
aaaccuggcaagucaccugcag

SEQ ID NO: 1214022 - RNA, 22 nt, Homo sapiens
aaaccugggaccccgagcuucc

SEQ ID NO: 1214023 - RNA, 19 nt, Homo sapiens
aaaccuggggugaauacuu

SEQ ID NO: 1214024 - RNA, 17 nt, Homo sapiens
aaaccuuaaaacagcug

SEQ ID NO: 1214025 - RNA, 18 nt, Homo sapiens
aaaccuuaaaacagcugu

SEQ ID NO: 1214026 - RNA, 20 nt, Homo sapiens
aaaccuucagaagcuauuuu

SEQ ID NO: 1214027 - RNA, 19 nt, Homo sapiens
aaaccuucaguuaugauuu

SEQ ID NO: 1214028 - RNA, 19 nt, Homo sapiens
aaaccuuucaaauuucaca

SEQ ID NO: 1214029 - RNA, 13 nt, Homo sapiens
aaacgauuuacca

SEQ ID NO: 1214030 - RNA, 14 nt, Homo sapiens
aaacgcaugugcag

SEQ ID NO: 1214031 - RNA, 13 nt, Homo sapiens
aaacgcuaccucu

SEQ ID NO: 1214032 - RNA, 16 nt, Homo sapiens
aaacgggaacaugccc

SEQ ID NO: 1214033 - RNA, 18 nt, Homo sapiens
aaacgguaauacgugaaa

SEQ ID NO: 1214034 - RNA, 14 nt, Homo sapiens
aaacgucuaggaaa

SEQ ID NO: 1214035 - RNA, 15 nt, Homo sapiens
aaacguuucaguaau

SEQ ID NO: 1214036 - RNA, 16 nt, Homo sapiens
aaacuaaaagacauuu

SEQ ID NO: 1214037 - RNA, 12 nt, Homo sapiens
aaacuaaggauu

SEQ ID NO: 1214038 - RNA, 19 nt, Homo sapiens
aaacuauaagccaauauuc

SEQ ID NO: 1214039 - RNA, 13 nt, Homo sapiens
aaacuauauucuc

SEQ ID NO: 1214040 - RNA, 23 nt, Homo sapiens
aaacuaugauaaauuaugauaau

SEQ ID NO: 1214041 - RNA, 15 nt, Homo sapiens
aaacuauuugggaua

SEQ ID NO: 1214042 - RNA, 13 nt, Homo sapiens
aaacucaaaauau

SEQ ID NO: 1214043 - RNA, 19 nt, Homo sapiens
aaacucaacaagugcuccu

SEQ ID NO: 1214044 - RNA, 19 nt, Homo sapiens
aaauuguaucucagucuaa

SEQ ID NO: 1214045 - RNA, 11 nt, Homo sapiens
aaauugucaaa

SEQ ID NO: 1214046 - RNA, 20 nt, Homo sapiens
aaauuuacucacagcacuug

SEQ ID NO: 1214047 - RNA, 23 nt, Homo sapiens
aaauuuccaguaccuuugucaca

SEQ ID NO: 1214048 - RNA, 21 nt, Homo sapiens
aaauuucuguaaaacagguua

SEQ ID NO: 1214049 - RNA, 12 nt, Homo sapiens
aaauuuuacuuc

SEQ ID NO: 1214050 - RNA, 12 nt, Homo sapiens
aaauuuuacuuu

SEQ ID NO: 1214051 - RNA, 20 nt, Homo sapiens
aaauuuuagaacuuuaccua

SEQ ID NO: 1214052 - RNA, 15 nt, Homo sapiens
aaauuuuuaccuuua

SEQ ID NO: 1214053 - RNA, 23 nt, Homo sapiens
aacaaaaaucuguguaacuguaa

SEQ ID NO: 1214054 - RNA, 20 nt, Homo sapiens
aacaaaaugaauucugggaa

SEQ ID NO: 1214055 - RNA, 18 nt, Homo sapiens
aacaaaauguaaagccag

SEQ ID NO: 1214056 - RNA, 13 nt, Homo sapiens
aacaaacaaugaa

SEQ ID NO: 1214057 - RNA, 18 nt, Homo sapiens
aacaaaccucacugagag

SEQ ID NO: 1214058 - RNA, 22 nt, Homo sapiens
aacaaacugaauuaaacaugaa

SEQ ID NO: 1214059 - RNA, 13 nt, Homo sapiens
aacaaaguccaca

SEQ ID NO: 1214060 - RNA, 22 nt, Homo sapiens
aacaaaguuucagaguauauug

SEQ ID NO: 1214061 - RNA, 22 nt, Homo sapiens
aacaaauaaauaagaucagacu

SEQ ID NO: 1214062 - RNA, 16 nt, Homo sapiens
aacaaauaaaugagcc

SEQ ID NO: 1214063 - RNA, 12 nt, Homo sapiens
aacaaauaugca

SEQ ID NO: 1214064 - RNA, 14 nt, Homo sapiens
aacaaauaugcaaa

SEQ ID NO: 1214065 - RNA, 23 nt, Homo sapiens
aacaaauaugcaaaccaggauuu

SEQ ID NO: 1214066 - RNA, 14 nt, Homo sapiens
aacaaauauugcca

SEQ ID NO: 1214067 - RNA, 20 nt, Homo sapiens
aacaaauucauauucugucu

SEQ ID NO: 1214068 - RNA, 20 nt, Homo sapiens
aacaacaaagccaacaguca

SEQ ID NO: 1214069 - RNA, 16 nt, Homo sapiens
aacaacagaucugcag

SEQ ID NO: 1214070 - RNA, 22 nt, Homo sapiens
aacaaccuggucacaggacucu

SEQ ID NO: 1214071 - RNA, 14 nt, Homo sapiens
aacaacuacuguga

SEQ ID NO: 1214072 - RNA, 14 nt, Homo sapiens
aacaacuccaaaac

SEQ ID NO: 1214073 - RNA, 12 nt, Homo sapiens
aacaacuguggu

SEQ ID NO: 1214074 - RNA, 15 nt, Homo sapiens
aacaacuuacacuua

SEQ ID NO: 1214075 - RNA, 14 nt, Homo sapiens
aacaacuuggcauu

SEQ ID NO: 1214076 - RNA, 23 nt, Homo sapiens
aacaagcccguuagccccaggga

SEQ ID NO: 1214077 - RNA, 22 nt, Homo sapiens
aacaaggggcuguuacauaaca

SEQ ID NO: 1214078 - RNA, 15 nt, Homo sapiens
aacaaguauuggaaa

SEQ ID NO: 1214079 - RNA, 15 nt, Homo sapiens
aacaauaucauauca

SEQ ID NO: 1214080 - RNA, 13 nt, Homo sapiens
aacaaucacaaag

SEQ ID NO: 1214081 - RNA, 14 nt, Homo sapiens
aacaauccaucucu

SEQ ID NO: 1214082 - RNA, 13 nt, Homo sapiens
aacaauccauuca

SEQ ID NO: 1214083 - RNA, 16 nt, Homo sapiens
aacaaugcaacuuuua

SEQ ID NO: 1214084 - RNA, 13 nt, Homo sapiens
aacaaugcauuuu

SEQ ID NO: 1214085 - RNA, 16 nt, Homo sapiens
aacaauggaagauuug

SEQ ID NO: 1214086 - RNA, 22 nt, Homo sapiens
aacaauguaugugaaaguguaa

SEQ ID NO: 1214087 - RNA, 14 nt, Homo sapiens
aacaauucugugac

SEQ ID NO: 1214088 - RNA, 18 nt, Homo sapiens
aacaauugaaguaaacuu

SEQ ID NO: 1214089 - RNA, 21 nt, Homo sapiens
aacaauuguccauggucucaa

SEQ ID NO: 1214090 - RNA, 14 nt, Homo sapiens
aacaauuucaauaa

SEQ ID NO: 1214091 - RNA, 23 nt, Homo sapiens
aacaauuuuuuuuuuccucuuca

SEQ ID NO: 1214092 - RNA, 15 nt, Homo sapiens
aacacaaaguguaua

SEQ ID NO: 1214093 - RNA, 21 nt, Homo sapiens
aacacacaggugcaacagacu

SEQ ID NO: 1214094 - RNA, 14 nt, Homo sapiens
aacacacaugcaca

SEQ ID NO: 1214095 - RNA, 22 nt, Homo sapiens
aacacacuuuggucauuucuca

SEQ ID NO: 1214096 - RNA, 21 nt, Homo sapiens
aacacagcauguguauuucca

SEQ ID NO: 1214097 - RNA, 20 nt, Homo sapiens
aacacaugugcagucacugg

SEQ ID NO: 1214098 - RNA, 19 nt, Homo sapiens
aacacauguucugugccug

SEQ ID NO: 1214099 - RNA, 12 nt, Homo sapiens
aacacauucauu

SEQ ID NO: 1214100 - RNA, 20 nt, Homo sapiens
aacaccaccaucaucugaga

SEQ ID NO: 1214101 - RNA, 10 nt, Homo sapiens
aacaccagaa

SEQ ID NO: 1214102 - RNA, 18 nt, Homo sapiens
aacaccagggacacauuu

SEQ ID NO: 1214103 - RNA, 20 nt, Homo sapiens
aacaccaucgaucaugaugu

SEQ ID NO: 1214104 - RNA, 18 nt, Homo sapiens
aacacccauuuuugcucu

SEQ ID NO: 1214105 - RNA, 15 nt, Homo sapiens
aacacccgacgucau

SEQ ID NO: 1214106 - RNA, 13 nt, Homo sapiens
aacacccuuucau

SEQ ID NO: 1214107 - RNA, 19 nt, Homo sapiens
aacaccgcuucugccuuuu

SEQ ID NO: 1214108 - RNA, 13 nt, Homo sapiens
aacaccugccuag

SEQ ID NO: 1214109 - RNA, 23 nt, Homo sapiens
aacacguguuccgguggcagauu

SEQ ID NO: 1214110 - RNA, 18 nt, Homo sapiens
aacacuagagucugucau

SEQ ID NO: 1214111 - RNA, 20 nt, Homo sapiens
aacacuaucauggacuacac

SEQ ID NO: 1214112 - RNA, 17 nt, Homo sapiens
aacacucaacaaacuua

SEQ ID NO: 1214113 - RNA, 23 nt, Homo sapiens
aacacucacauuuauucugcuca

SEQ ID NO: 1214114 - RNA, 21 nt, Homo sapiens
aacacugcugcuccagugcag

SEQ ID NO: 1214115 - RNA, 21 nt, Homo sapiens
aacacuggugggcagcugagg

SEQ ID NO: 1214116 - RNA, 20 nt, Homo sapiens
aacacugucacuagucucac

SEQ ID NO: 1214117 - RNA, 15 nt, Homo sapiens
aacacuucauuuuca

SEQ ID NO: 1214118 - RNA, 18 nt, Homo sapiens
aacagaagacagcugcug

SEQ ID NO: 1214119 - RNA, 16 nt, Homo sapiens
aacagaagcauuugua

SEQ ID NO: 1214120 - RNA, 16 nt, Homo sapiens
aacagaagcuuccauu

SEQ ID NO: 1214121 - RNA, 13 nt, Homo sapiens
aacagacuugaau

SEQ ID NO: 1214122 - RNA, 14 nt, Homo sapiens
aacagaguccaauu

SEQ ID NO: 1214123 - RNA, 16 nt, Homo sapiens
aacagaucuugaaauc

SEQ ID NO: 1214124 - RNA, 19 nt, Homo sapiens
aacagaucuuuacucuuga

SEQ ID NO: 1214125 - RNA, 12 nt, Homo sapiens
aacagauuugcu

SEQ ID NO: 1214126 - RNA, 13 nt, Homo sapiens
aacagcaaaucac

SEQ ID NO: 1214127 - RNA, 17 nt, Homo sapiens
aacagcaauggugucag

SEQ ID NO: 1214128 - RNA, 12 nt, Homo sapiens
aacagcacuggc

SEQ ID NO: 1214129 - RNA, 18 nt, Homo sapiens
aacagcaucaugucauaa

SEQ ID NO: 1214130 - RNA, 14 nt, Homo sapiens
aacagcaugaauaa

SEQ ID NO: 1214131 - RNA, 21 nt, Homo sapiens
aacagcaugggccucaccucc

SEQ ID NO: 1214132 - RNA, 14 nt, Homo sapiens
aaagagacagugau

SEQ ID NO: 1214133 - RNA, 17 nt, Homo sapiens
aaagagacuccgucuca

SEQ ID NO: 1214134 - RNA, 21 nt, Homo sapiens
aaagagcauggaugcauuuca

SEQ ID NO: 1214135 - RNA, 22 nt, Homo sapiens
aaagagccuucagaaugcuccu

SEQ ID NO: 1214136 - RNA, 19 nt, Homo sapiens
aaagaggcccaagugcaaa

SEQ ID NO: 1214137 - RNA, 16 nt, Homo sapiens
aaagagggacaggcug

SEQ ID NO: 1214138 - RNA, 20 nt, Homo sapiens
aaagagguaaaaaacuguca

SEQ ID NO: 1214139 - RNA, 18 nt, Homo sapiens
aaagaguauauguucccu

SEQ ID NO: 1214140 - RNA, 16 nt, Homo sapiens
aaagauacgacuuuau

SEQ ID NO: 1214141 - RNA, 23 nt, Homo sapiens
aaagaucuuuuccagaguaugca

SEQ ID NO: 1214142 - RNA, 22 nt, Homo sapiens
aaagaugcaaggaccaggacuc

SEQ ID NO: 1214143 - RNA, 16 nt, Homo sapiens
aaagauggaguuucua

SEQ ID NO: 1214144 - RNA, 15 nt, Homo sapiens
aaagauguauuugaa

SEQ ID NO: 1214145 - RNA, 19 nt, Homo sapiens
aaagaugucuauguagcug

SEQ ID NO: 1214146 - RNA, 15 nt, Homo sapiens
aaagauuugugaacu

SEQ ID NO: 1214147 - RNA, 17 nt, Homo sapiens
aaagcaaaugacuagua

SEQ ID NO: 1214148 - RNA, 19 nt, Homo sapiens
aaagcaaaugauucagcuc

SEQ ID NO: 1214149 - RNA, 20 nt, Homo sapiens
aaagcaaguuucaucaguca

SEQ ID NO: 1214150 - RNA, 21 nt, Homo sapiens
aaagcaccagcaggcacguua

SEQ ID NO: 1214151 - RNA, 15 nt, Homo sapiens
aaagcaccuuagcug

SEQ ID NO: 1214152 - RNA, 20 nt, Homo sapiens
aaagcacugaccugucaugc

SEQ ID NO: 1214153 - RNA, 23 nt, Homo sapiens
aaagcacuuggacucuugcucuu

SEQ ID NO: 1214154 - RNA, 24 nt, Homo sapiens
aaagcagaauuuuaaugugaagac

SEQ ID NO: 1214155 - RNA, 15 nt, Homo sapiens
aaagcagccugugaa

SEQ ID NO: 1214156 - RNA, 21 nt, Homo sapiens
aaagcaggauuauuaagugau

SEQ ID NO: 1214157 - RNA, 13 nt, Homo sapiens
aaagcaguagcau

SEQ ID NO: 1214158 - RNA, 19 nt, Homo sapiens
aaagcaguuacuaauaugc

SEQ ID NO: 1214159 - RNA, 13 nt, Homo sapiens
aaagcauaaagcu

SEQ ID NO: 1214160 - RNA, 12 nt, Homo sapiens
aaagcauaacac

SEQ ID NO: 1214161 - RNA, 20 nt, Homo sapiens
aaagcaucaauacaaccagc

SEQ ID NO: 1214162 - RNA, 15 nt, Homo sapiens
aaagcauccaugugu

SEQ ID NO: 1214163 - RNA, 14 nt, Homo sapiens
aaagccaccacauu

SEQ ID NO: 1214164 - RNA, 19 nt, Homo sapiens
aaagccagggucucucccu

SEQ ID NO: 1214165 - RNA, 11 nt, Homo sapiens
aaagccaguga

SEQ ID NO: 1214166 - RNA, 17 nt, Homo sapiens
aaagccauaacuugaaa

SEQ ID NO: 1214167 - RNA, 16 nt, Homo sapiens
aaagccaucaugccuu

SEQ ID NO: 1214168 - RNA, 15 nt, Homo sapiens
aaagcccuuccaugu

SEQ ID NO: 1214169 - RNA, 17 nt, Homo sapiens
aaagccuccucaucccg

SEQ ID NO: 1214170 - RNA, 15 nt, Homo sapiens
aaagccuucaagaug

SEQ ID NO: 1214171 - RNA, 13 nt, Homo sapiens
aaagccuugugua

SEQ ID NO: 1214172 - RNA, 20 nt, Homo sapiens
aaagcgagaucccaucucua

SEQ ID NO: 1214173 - RNA, 14 nt, Homo sapiens
aaagcgcugcagua

SEQ ID NO: 1214174 - RNA, 21 nt, Homo sapiens
aaagcguuucuuuacuucuca

SEQ ID NO: 1214175 - RNA, 19 nt, Homo sapiens
aaagcuacuauguacugcc

SEQ ID NO: 1214176 - RNA, 20 nt, Homo sapiens
aaagcuagcacuaacucgug

SEQ ID NO: 1214177 - RNA, 17 nt, Homo sapiens
aaagcuaguguaccucc

SEQ ID NO: 1214178 - RNA, 22 nt, Homo sapiens
aaagcuaguguaccuccucuca

SEQ ID NO: 1214179 - RNA, 18 nt, Homo sapiens
aaagcugauuacugucaa

SEQ ID NO: 1214180 - RNA, 13 nt, Homo sapiens
aaagcugccauuu

SEQ ID NO: 1214181 - RNA, 13 nt, Homo sapiens
aaagcugcugaca

SEQ ID NO: 1214182 - RNA, 18 nt, Homo sapiens
aaagcuguuaaacuguua

SEQ ID NO: 1214183 - RNA, 13 nt, Homo sapiens
aaagcuugugaaa

SEQ ID NO: 1214184 - RNA, 20 nt, Homo sapiens
aaagcuuuuuccuccuggaa

SEQ ID NO: 1214185 - RNA, 16 nt, Homo sapiens
aaaggaaagauuugcc

SEQ ID NO: 1214186 - RNA, 22 nt, Homo sapiens
aaaggaaagauuugccaauuga

SEQ ID NO: 1214187 - RNA, 14 nt, Homo sapiens
aaaggaagacuaga

SEQ ID NO: 1214188 - RNA, 20 nt, Homo sapiens
aaaggaagagaaaugcaacg

SEQ ID NO: 1214189 - RNA, 13 nt, Homo sapiens
aaaggaaugaacu

SEQ ID NO: 1214190 - RNA, 19 nt, Homo sapiens
aaaggauaugguagcauuu

SEQ ID NO: 1214191 - RNA, 21 nt, Homo sapiens
aaaggaucucugagaccacag

SEQ ID NO: 1214192 - RNA, 15 nt, Homo sapiens
aaaggaugugauaua

SEQ ID NO: 1214193 - RNA, 13 nt, Homo sapiens
aaaggauuuuaca

SEQ ID NO: 1214194 - RNA, 19 nt, Homo sapiens
aaaggcagcugccucugcu

SEQ ID NO: 1214195 - RNA, 13 nt, Homo sapiens
aaaggccugcaca

SEQ ID NO: 1214196 - RNA, 22 nt, Homo sapiens
aaaggcuagaacacuacagggg

SEQ ID NO: 1214197 - RNA, 11 nt, Homo sapiens
aaagggagaag

SEQ ID NO: 1214198 - RNA, 16 nt, Homo sapiens
aaagggccauguuuca

SEQ ID NO: 1214199 - RNA, 13 nt, Homo sapiens
aaaggggcacugg

SEQ ID NO: 1214200 - RNA, 16 nt, Homo sapiens
aaagggucuuaugaaa

SEQ ID NO: 1214201 - RNA, 20 nt, Homo sapiens
aaagggucuuaugaaacaau

SEQ ID NO: 1214202 - RNA, 21 nt, Homo sapiens
aaaggguguaggggccaccuc

SEQ ID NO: 1214203 - RNA, 18 nt, Homo sapiens
aaagguagcuuaccugac

SEQ ID NO: 1214204 - RNA, 14 nt, Homo sapiens
aaagguucuagguu

SEQ ID NO: 1214205 - RNA, 15 nt, Homo sapiens
aaagguucucaggug

SEQ ID NO: 1214206 - RNA, 14 nt, Homo sapiens
aaagguugccugaa

SEQ ID NO: 1214207 - RNA, 14 nt, Homo sapiens
aaagguuuuccuua

SEQ ID NO: 1214208 - RNA, 19 nt, Homo sapiens
aaagguuuuggaucuugaa

SEQ ID NO: 1214209 - RNA, 16 nt, Homo sapiens
aaaguaaagaaaugca

SEQ ID NO: 1214210 - RNA, 23 nt, Homo sapiens
aaaguaaggugcuuggaguuuac

SEQ ID NO: 1214211 - RNA, 15 nt, Homo sapiens
aaaguaaucuaccuc

SEQ ID NO: 1214212 - RNA, 13 nt, Homo sapiens
aaaguacaaagca

SEQ ID NO: 1214213 - RNA, 18 nt, Homo sapiens
aaaguaccacacugaguu

SEQ ID NO: 1214214 - RNA, 23 nt, Homo sapiens
aaaguacucuuuaagagugaaau

SEQ ID NO: 1214215 - RNA, 21 nt, Homo sapiens
aaaguagaggaauccauguaa

SEQ ID NO: 1214216 - RNA, 15 nt, Homo sapiens
aaaguaguccuguga

SEQ ID NO: 1214217 - RNA, 22 nt, Homo sapiens
aaaguagucucuccccuggcca

SEQ ID NO: 1214218 - RNA, 21 nt, Homo sapiens
aaaguauaaccauaugauacu

SEQ ID NO: 1214219 - RNA, 13 nt, Homo sapiens
aaaguauuauuca

SEQ ID NO: 1214220 - RNA, 15 nt, Homo sapiens
aaaguauuauucaaa

SEQ ID NO: 1214221 - RNA, 22 nt, Homo sapiens
aaaguccaauuccaaagccaga

SEQ ID NO: 1214222 - RNA, 12 nt, Homo sapiens
aaaguccugaca

SEQ ID NO: 1214223 - RNA, 14 nt, Homo sapiens
aaagugacacagca

SEQ ID NO: 1214224 - RNA, 14 nt, Homo sapiens
aaagugacauuugu

SEQ ID NO: 1214225 - RNA, 16 nt, Homo sapiens
aaagugauaugcauuu

SEQ ID NO: 1214226 - RNA, 17 nt, Homo sapiens
aaagugauucacugugc

SEQ ID NO: 1214227 - RNA, 12 nt, Homo sapiens
aaagugcaauua

SEQ ID NO: 1214228 - RNA, 11 nt, Homo sapiens
aaagugcauau

SEQ ID NO: 1214229 - RNA, 14 nt, Homo sapiens
aaagugcugagauu

SEQ ID NO: 1214230 - RNA, 21 nt, Homo sapiens
aaagugcugggauuacagaca

SEQ ID NO: 1214231 - RNA, 22 nt, Homo sapiens
aaagugcugggauuacaggcgu

SEQ ID NO: 1214232 - RNA, 20 nt, Homo sapiens
aaagugcugggauuacaggu

SEQ ID NO: 1214233 - RNA, 17 nt, Homo sapiens
aaaguguaaguucacaa

SEQ ID NO: 1214234 - RNA, 18 nt, Homo sapiens
aaaguguauuuguguaua

SEQ ID NO: 1214235 - RNA, 17 nt, Homo sapiens
aaaguguugaccacaga

SEQ ID NO: 1214236 - RNA, 19 nt, Homo sapiens
aaaguuaauaacagcuccu

SEQ ID NO: 1214237 - RNA, 18 nt, Homo sapiens
aaaguuacuauucuguau

SEQ ID NO: 1214238 - RNA, 21 nt, Homo sapiens
aaaguuacugauucacugcau

SEQ ID NO: 1214239 - RNA, 21 nt, Homo sapiens
aaaguuauauucacaguuuuu

SEQ ID NO: 1214240 - RNA, 12 nt, Homo sapiens
aaaguuaugaaa

SEQ ID NO: 1214241 - RNA, 14 nt, Homo sapiens
aaaguuauugugau

SEQ ID NO: 1214242 - RNA, 15 nt, Homo sapiens
aaaguuauugugaua

SEQ ID NO: 1214243 - RNA, 16 nt, Homo sapiens
aaaguuauuuguucau

SEQ ID NO: 1214244 - RNA, 21 nt, Homo sapiens
aaaguuccaugaauucuugau

SEQ ID NO: 1214245 - RNA, 23 nt, Homo sapiens
aaaguucccuacuuccugugacu

SEQ ID NO: 1214246 - RNA, 17 nt, Homo sapiens
aaaguucuguguuuaau

SEQ ID NO: 1214247 - RNA, 18 nt, Homo sapiens
aaaguucuuuuugcucua

SEQ ID NO: 1214248 - RNA, 19 nt, Homo sapiens
aaaguugccuuuauuugcu

SEQ ID NO: 1214249 - RNA, 17 nt, Homo sapiens
aaaguugcuccauacaa

SEQ ID NO: 1214250 - RNA, 13 nt, Homo sapiens
aaaguuguuguaa

SEQ ID NO: 1214251 - RNA, 14 nt, Homo sapiens
aaaguuuacaacau

SEQ ID NO: 1214252 - RNA, 19 nt, Homo sapiens
aaaguuuaucacacagugu

SEQ ID NO: 1214253 - RNA, 13 nt, Homo sapiens
aaaguuugcucaa

SEQ ID NO: 1214254 - RNA, 21 nt, Homo sapiens
aaaguuuuaggguacaguuug

SEQ ID NO: 1214255 - RNA, 21 nt, Homo sapiens
aaaguuuuuuauuaugcauua

SEQ ID NO: 1214256 - RNA, 14 nt, Homo sapiens
aaauaaaaacccaa

SEQ ID NO: 1214257 - RNA, 17 nt, Homo sapiens
aaauaaaaagcauuauu

SEQ ID NO: 1214258 - RNA, 19 nt, Homo sapiens
aaauaaaaauauuguguug

SEQ ID NO: 1214259 - RNA, 16 nt, Homo sapiens
aaauaaaaaucucuuu

SEQ ID NO: 1214260 - RNA, 22 nt, Homo sapiens
acuguauguuuacuucucacca

SEQ ID NO: 1214261 - RNA, 23 nt, Homo sapiens
acugucaagaagaggaaagggag

SEQ ID NO: 1214262 - RNA, 20 nt, Homo sapiens
acugucaaggcugcuuagaa

SEQ ID NO: 1214263 - RNA, 18 nt, Homo sapiens
acugucacauaaugcuca

SEQ ID NO: 1214264 - RNA, 22 nt, Homo sapiens
acugucacauaaugcucauacu

SEQ ID NO: 1214265 - RNA, 17 nt, Homo sapiens
acugucacuuugcucug

SEQ ID NO: 1214266 - RNA, 15 nt, Homo sapiens
acugucagauuaaau

SEQ ID NO: 1214267 - RNA, 12 nt, Homo sapiens
acugucaggguu

SEQ ID NO: 1214268 - RNA, 18 nt, Homo sapiens
acuguccaagugccacau

SEQ ID NO: 1214269 - RNA, 24 nt, Homo sapiens
acuguccagagagcaacucugaga

SEQ ID NO: 1214270 - RNA, 19 nt, Homo sapiens
acuguccccacgccgggaa

SEQ ID NO: 1214271 - RNA, 23 nt, Homo sapiens
acuguccccacgccgggaaccaa

SEQ ID NO: 1214272 - RNA, 21 nt, Homo sapiens
acuguccuaccaguugcccua

SEQ ID NO: 1214273 - RNA, 14 nt, Homo sapiens
acuguccuacccac

SEQ ID NO: 1214274 - RNA, 11 nt, Homo sapiens
acuguccucag

SEQ ID NO: 1214275 - RNA, 21 nt, Homo sapiens
acuguccugaccaucgcacac

SEQ ID NO: 1214276 - RNA, 22 nt, Homo sapiens
acugucggccagagucuguuuc

SEQ ID NO: 1214277 - RNA, 20 nt, Homo sapiens
acugucuauuuucucaguca

SEQ ID NO: 1214278 - RNA, 19 nt, Homo sapiens
acugucuccuuucucuuau

SEQ ID NO: 1214279 - RNA, 17 nt, Homo sapiens
acugucuuugucaccac

SEQ ID NO: 1214280 - RNA, 20 nt, Homo sapiens
acugugaaauaccacaagcc

SEQ ID NO: 1214281 - RNA, 15 nt, Homo sapiens
acugugaagcauuua

SEQ ID NO: 1214282 - RNA, 15 nt, Homo sapiens
acugugaauguucca

SEQ ID NO: 1214283 - RNA, 20 nt, Homo sapiens
acugugacaaaagccagcau

SEQ ID NO: 1214284 - RNA, 17 nt, Homo sapiens
acugugaccuuugucua

SEQ ID NO: 1214285 - RNA, 23 nt, Homo sapiens
acugugagcaaggagcacaagcc

SEQ ID NO: 1214286 - RNA, 21 nt, Homo sapiens
acugugcaaauauaucugcua

SEQ ID NO: 1214287 - RNA, 11 nt, Homo sapiens
acugugcugaa

SEQ ID NO: 1214288 - RNA, 21 nt, Homo sapiens
acuguggcuagugacaaauaa

SEQ ID NO: 1214289 - RNA, 17 nt, Homo sapiens
acugugggaaggccagc

SEQ ID NO: 1214290 - RNA, 17 nt, Homo sapiens
acugugguacugaugga

SEQ ID NO: 1214291 - RNA, 23 nt, Homo sapiens
acugugucauucuguuagauacu

SEQ ID NO: 1214292 - RNA, 18 nt, Homo sapiens
acuguuaagaagcagcca

SEQ ID NO: 1214293 - RNA, 24 nt, Homo sapiens
acuguuacagcuuucugugcagag

SEQ ID NO: 1214294 - RNA, 13 nt, Homo sapiens
acuguuacuuugg

SEQ ID NO: 1214295 - RNA, 15 nt, Homo sapiens
acuguucaaugauua

SEQ ID NO: 1214296 - RNA, 18 nt, Homo sapiens
acuguuccaaagccagug

SEQ ID NO: 1214297 - RNA, 19 nt, Homo sapiens
acuguuccaaagccaguga

SEQ ID NO: 1214298 - RNA, 10 nt, Homo sapiens
acuguugaaa

SEQ ID NO: 1214299 - RNA, 18 nt, Homo sapiens
acuguugcgccgcaguuu

SEQ ID NO: 1214300 - RNA, 13 nt, Homo sapiens
acuguuucuguca

SEQ ID NO: 1214301 - RNA, 14 nt, Homo sapiens
acuguuucugucag

SEQ ID NO: 1214302 - RNA, 16 nt, Homo sapiens
acuguuuuuaaguaac

SEQ ID NO: 1214303 - RNA, 19 nt, Homo sapiens
acuuaaagcccgccugaca

SEQ ID NO: 1214304 - RNA, 21 nt, Homo sapiens
acuuaaauaauaaacagugga

SEQ ID NO: 1214305 - RNA, 19 nt, Homo sapiens
acuuaacaugggcucuuca

SEQ ID NO: 1214306 - RNA, 13 nt, Homo sapiens
acuuaagaugaaa

SEQ ID NO: 1214307 - RNA, 15 nt, Homo sapiens
acuuaagugcacuuu

SEQ ID NO: 1214308 - RNA, 21 nt, Homo sapiens
acuuaauguuugguaacuuuu

SEQ ID NO: 1214309 - RNA, 21 nt, Homo sapiens
acuuaauuuuuccugcuguau

SEQ ID NO: 1214310 - RNA, 19 nt, Homo sapiens
acuuacagaucuaucuccu

SEQ ID NO: 1214311 - RNA, 15 nt, Homo sapiens
acuuacaucaugugu

SEQ ID NO: 1214312 - RNA, 18 nt, Homo sapiens
acuuaccuagauuuacag

SEQ ID NO: 1214313 - RNA, 19 nt, Homo sapiens
acuuaccucaaauuaagca

SEQ ID NO: 1214314 - RNA, 20 nt, Homo sapiens
acuuacuguuucugucagga

SEQ ID NO: 1214315 - RNA, 15 nt, Homo sapiens
acuuagcagaaccac

SEQ ID NO: 1214316 - RNA, 23 nt, Homo sapiens
acuuaggaaauggcuuugugauu

SEQ ID NO: 1214317 - RNA, 18 nt, Homo sapiens
acuuagguuauuuugcuu

SEQ ID NO: 1214318 - RNA, 14 nt, Homo sapiens
acuuaucacaugga

SEQ ID NO: 1214319 - RNA, 13 nt, Homo sapiens
acuuaugccauag

SEQ ID NO: 1214320 - RNA, 16 nt, Homo sapiens
acuuauguacuugaua

SEQ ID NO: 1214321 - RNA, 17 nt, Homo sapiens
acuuauuuucagugcau

SEQ ID NO: 1214322 - RNA, 20 nt, Homo sapiens
acuucaaaaggaaugaacuu

SEQ ID NO: 1214323 - RNA, 15 nt, Homo sapiens
acuucaaagcugaau

SEQ ID NO: 1214324 - RNA, 18 nt, Homo sapiens
acuucaaggugacagaag

SEQ ID NO: 1214325 - RNA, 20 nt, Homo sapiens
acuucacuaaugaucacauu

SEQ ID NO: 1214326 - RNA, 20 nt, Homo sapiens
acuucacugaaagacaccau

SEQ ID NO: 1214327 - RNA, 20 nt, Homo sapiens
acuucaguacucaaauucaa

SEQ ID NO: 1214328 - RNA, 15 nt, Homo sapiens
acuucaguugaucuu

SEQ ID NO: 1214329 - RNA, 17 nt, Homo sapiens
acuucaguugcuuugca

SEQ ID NO: 1214330 - RNA, 22 nt, Homo sapiens
acuucaguuuuauuuuugccaa

SEQ ID NO: 1214331 - RNA, 16 nt, Homo sapiens
acuucauaaauguuca

SEQ ID NO: 1214332 - RNA, 19 nt, Homo sapiens
acuuccaagacaagauacc

SEQ ID NO: 1214333 - RNA, 13 nt, Homo sapiens
acuuccacaagag

SEQ ID NO: 1214334 - RNA, 20 nt, Homo sapiens
acuuccaggggaaccugcca

SEQ ID NO: 1214335 - RNA, 13 nt, Homo sapiens
acuuccaugacau

SEQ ID NO: 1214336 - RNA, 14 nt, Homo sapiens
acuuccaugacaua

SEQ ID NO: 1214337 - RNA, 16 nt, Homo sapiens
acuuccaugacauaag

SEQ ID NO: 1214338 - RNA, 12 nt, Homo sapiens
acuuccauuccc

SEQ ID NO: 1214339 - RNA, 20 nt, Homo sapiens
acuuccauucccguggucuc

SEQ ID NO: 1214340 - RNA, 14 nt, Homo sapiens
acuuccauuugcuu

SEQ ID NO: 1214341 - RNA, 22 nt, Homo sapiens
acuucccacacgauuagcuuua

SEQ ID NO: 1214342 - RNA, 18 nt, Homo sapiens
acuucccgacucuacaau

SEQ ID NO: 1214343 - RNA, 16 nt, Homo sapiens
acuucccuacauggag

SEQ ID NO: 1214344 - RNA, 15 nt, Homo sapiens
acuuccgagcuaugu

SEQ ID NO: 1214345 - RNA, 18 nt, Homo sapiens
acuuccuacguauccugc

SEQ ID NO: 1214346 - RNA, 14 nt, Homo sapiens
acuuccuccaggaa

SEQ ID NO: 1214347 - RNA, 14 nt, Homo sapiens
acuucgaaaccugg

SEQ ID NO: 1214348 - RNA, 16 nt, Homo sapiens
acuucgaaaccuggga

SEQ ID NO: 1214349 - RNA, 14 nt, Homo sapiens
acuucgagcacugu

SEQ ID NO: 1214350 - RNA, 16 nt, Homo sapiens
acuucgggcuguguaa

SEQ ID NO: 1214351 - RNA, 15 nt, Homo sapiens
acuucuaccaggacg

SEQ ID NO: 1214352 - RNA, 18 nt, Homo sapiens
acuucuaugcaaaugccu

SEQ ID NO: 1214353 - RNA, 11 nt, Homo sapiens
acuucucacca

SEQ ID NO: 1214354 - RNA, 22 nt, Homo sapiens
acuucucagccugguacuugua

SEQ ID NO: 1214355 - RNA, 16 nt, Homo sapiens
acuucuccaggucuca

SEQ ID NO: 1214356 - RNA, 12 nt, Homo sapiens
acuucucugaaa

SEQ ID NO: 1214357 - RNA, 21 nt, Homo sapiens
acuucucugccuuugacauuu

SEQ ID NO: 1214358 - RNA, 15 nt, Homo sapiens
acuucugacuacuug

SEQ ID NO: 1214359 - RNA, 19 nt, Homo sapiens
acuucuggaagucaucuca

SEQ ID NO: 1214360 - RNA, 16 nt, Homo sapiens
acuucuggcagggaag

SEQ ID NO: 1214361 - RNA, 16 nt, Homo sapiens
acuucuguauguguau

SEQ ID NO: 1214362 - RNA, 24 nt, Homo sapiens
acuucuuaccccagccuacccuuc

SEQ ID NO: 1214363 - RNA, 17 nt, Homo sapiens
acuucuuauacauuuga

SEQ ID NO: 1214364 - RNA, 23 nt, Homo sapiens
acuucuuauggaauugauuugca

SEQ ID NO: 1214365 - RNA, 18 nt, Homo sapiens
acuugaaagcauccaugu

SEQ ID NO: 1214366 - RNA, 20 nt, Homo sapiens
acuugaaagcauccaugugu

SEQ ID NO: 1214367 - RNA, 17 nt, Homo sapiens
acuugaagaaggaaaga

SEQ ID NO: 1214368 - RNA, 16 nt, Homo sapiens
acuugaauauguagcu

SEQ ID NO: 1214369 - RNA, 19 nt, Homo sapiens
acuugaaugcuaguuauac

SEQ ID NO: 1214370 - RNA, 14 nt, Homo sapiens
acuugaaugugcac

SEQ ID NO: 1214371 - RNA, 14 nt, Homo sapiens
acuugacuggcaca

SEQ ID NO: 1214372 - RNA, 20 nt, Homo sapiens
acuugagaaaauaucuugcu

SEQ ID NO: 1214373 - RNA, 13 nt, Homo sapiens
acuugagcaccgu

SEQ ID NO: 1214374 - RNA, 22 nt, Homo sapiens
acuugauguuuguuugcaugau

SEQ ID NO: 1214375 - RNA, 18 nt, Homo sapiens
acuugcauguacagagcc

SEQ ID NO: 1214376 - RNA, 16 nt, Homo sapiens
acuugcccaaguccca

SEQ ID NO: 1214377 - RNA, 17 nt, Homo sapiens
acuugcccuguucucuu

SEQ ID NO: 1214378 - RNA, 21 nt, Homo sapiens
acuugccuguucagagcacuc

SEQ ID NO: 1214379 - RNA, 16 nt, Homo sapiens
acuugcuaaagcacuu

SEQ ID NO: 1214380 - RNA, 15 nt, Homo sapiens
acuuggaacuaggcu

SEQ ID NO: 1214381 - RNA, 21 nt, Homo sapiens
acuuggaaguggggacaucag

SEQ ID NO: 1214382 - RNA, 17 nt, Homo sapiens
acuuggacucuugcucu

SEQ ID NO: 1214383 - RNA, 13 nt, Homo sapiens
acuuggcacuuuu

SEQ ID NO: 1214384 - RNA, 23 nt, Homo sapiens
acuuggcucgaaucucugugccu

SEQ ID NO: 1214385 - RNA, 23 nt, Homo sapiens
acuuggucugugagaugcuagaa

SEQ ID NO: 1214386 - RNA, 20 nt, Homo sapiens
acuuggugggaccaugaaca

SEQ ID NO: 1214387 - RNA, 22 nt, Homo sapiens
acuugguuuguuauaucaggga

SEQ ID NO: 1214388 - RNA, 22 nt, Homo sapiens
acuugguuuuuggcucuuucag

SEQ ID NO: 1214389 - RNA, 23 nt, Homo sapiens
acuuguaagaaaaugagacaaaa

SEQ ID NO: 1214390 - RNA, 16 nt, Homo sapiens
acuuguccugacucaa

SEQ ID NO: 1214391 - RNA, 18 nt, Homo sapiens
acuuguggacacagcucu

SEQ ID NO: 1214392 - RNA, 21 nt, Homo sapiens
acuuguuagaucaaccuccaa

SEQ ID NO: 1214393 - RNA, 19 nt, Homo sapiens
acuuguuugcugugaacaa

SEQ ID NO: 1214394 - RNA, 16 nt, Homo sapiens
acuuuaaaagacugaa

SEQ ID NO: 1214395 - RNA, 22 nt, Homo sapiens
acuuuaagaacaaacucugaaa

SEQ ID NO: 1214396 - RNA, 17 nt, Homo sapiens
acuuuacuguaauauaa

SEQ ID NO: 1214397 - RNA, 18 nt, Homo sapiens
acuuuaucuaauaccucu

SEQ ID NO: 1214398 - RNA, 15 nt, Homo sapiens
acuuuauguacugcu

SEQ ID NO: 1214399 - RNA, 13 nt, Homo sapiens
acuuuauuacaau

SEQ ID NO: 1214400 - RNA, 12 nt, Homo sapiens
acuuuauucuug

SEQ ID NO: 1214401 - RNA, 20 nt, Homo sapiens
acuuuauuguacagacuguu

SEQ ID NO: 1214402 - RNA, 19 nt, Homo sapiens
acuuuauuugaacuaugag

SEQ ID NO: 1214403 - RNA, 23 nt, Homo sapiens
acuuucaggggcugacucuccag

SEQ ID NO: 1214404 - RNA, 19 nt, Homo sapiens
acuuucauugccagugucu

SEQ ID NO: 1214405 - RNA, 20 nt, Homo sapiens
acuuucauugccagugucuu

SEQ ID NO: 1214406 - RNA, 15 nt, Homo sapiens
acuuuccaggcuagu

SEQ ID NO: 1214407 - RNA, 22 nt, Homo sapiens
acuuuccauagggccuccuuag

SEQ ID NO: 1214408 - RNA, 17 nt, Homo sapiens
acuuuccucgccugaca

SEQ ID NO: 1214409 - RNA, 16 nt, Homo sapiens
acuuuccugacuuaca

SEQ ID NO: 1214410 - RNA, 17 nt, Homo sapiens
acuuuccugacuuacaa

SEQ ID NO: 1214411 - RNA, 12 nt, Homo sapiens
acuuucugauua

SEQ ID NO: 1214412 - RNA, 14 nt, Homo sapiens
acuuucugauuacu

SEQ ID NO: 1214413 - RNA, 17 nt, Homo sapiens
acuuugaaauaccucau

SEQ ID NO: 1214414 - RNA, 20 nt, Homo sapiens
acuuugacgagucaccuucc

SEQ ID NO: 1214415 - RNA, 11 nt, Homo sapiens
acuuugcucuc

SEQ ID NO: 1214416 - RNA, 15 nt, Homo sapiens
acuuuggaggacaau

SEQ ID NO: 1214417 - RNA, 17 nt, Homo sapiens
acuuuggcauucagugc

SEQ ID NO: 1214418 - RNA, 23 nt, Homo sapiens
acuuuguaccccccaaccccuga

SEQ ID NO: 1214419 - RNA, 15 nt, Homo sapiens
acuuuguacuugugu

SEQ ID NO: 1214420 - RNA, 23 nt, Homo sapiens
acuuuguauuuguucaguaugca

SEQ ID NO: 1214421 - RNA, 14 nt, Homo sapiens
acuuuguguucacc

SEQ ID NO: 1214422 - RNA, 23 nt, Homo sapiens
acuuuguuguuuggauuccucac

SEQ ID NO: 1214423 - RNA, 16 nt, Homo sapiens
acuuuguuuauuguaa

SEQ ID NO: 1214424 - RNA, 16 nt, Homo sapiens
acuuuuaaacuuugau

SEQ ID NO: 1214425 - RNA, 22 nt, Homo sapiens
acuuuuacacgaccauuugaua

SEQ ID NO: 1214426 - RNA, 13 nt, Homo sapiens
acuuuuacaguaa

SEQ ID NO: 1214427 - RNA, 16 nt, Homo sapiens
acuuuuacucugccua

SEQ ID NO: 1214428 - RNA, 22 nt, Homo sapiens
acuuuuaguagagacaggguuu

SEQ ID NO: 1214429 - RNA, 11 nt, Homo sapiens
acuuuuccaca

SEQ ID NO: 1214430 - RNA, 19 nt, Homo sapiens
acuuuucggagacagugac

SEQ ID NO: 1214431 - RNA, 21 nt, Homo sapiens
acuuuucggagacagugacug

SEQ ID NO: 1214432 - RNA, 13 nt, Homo sapiens
acuuuugcuugaa

SEQ ID NO: 1214433 - RNA, 17 nt, Homo sapiens
acuuuuuaaaacacaac

SEQ ID NO: 1214434 - RNA, 18 nt, Homo sapiens
acuuuuuacagugcuauu

SEQ ID NO: 1214435 - RNA, 17 nt, Homo sapiens
acuuuuuacccagaaca

SEQ ID NO: 1214436 - RNA, 16 nt, Homo sapiens
acuuuuuagccaguga

SEQ ID NO: 1214437 - RNA, 17 nt, Homo sapiens
acuuuuuagccagugac

SEQ ID NO: 1214438 - RNA, 17 nt, Homo sapiens
acuuuuucuuguauuca

SEQ ID NO: 1214439 - RNA, 18 nt, Homo sapiens
acuuuuucuuguauucau

SEQ ID NO: 1214440 - RNA, 15 nt, Homo sapiens
acuuuuuuacacuga

SEQ ID NO: 1214441 - RNA, 17 nt, Homo sapiens
acuuuuuuacacugaua

SEQ ID NO: 1214442 - RNA, 18 nt, Homo sapiens
acuuuuuuuaaacugugg

SEQ ID NO: 1214443 - RNA, 16 nt, Homo sapiens
acuuuuuuuugacaua

SEQ ID NO: 1214444 - RNA, 19 nt, Homo sapiens
agaaaaaaaccacacaaag

SEQ ID NO: 1214445 - RNA, 20 nt, Homo sapiens
agaaaaaauaacacacauau

SEQ ID NO: 1214446 - RNA, 20 nt, Homo sapiens
agaaaaagaagugccuuuaa

SEQ ID NO: 1214447 - RNA, 20 nt, Homo sapiens
agaaaaaggacucugcuuca

SEQ ID NO: 1214448 - RNA, 18 nt, Homo sapiens
agaaaaaggcaguggccu

SEQ ID NO: 1214449 - RNA, 21 nt, Homo sapiens
agaaaaauagcugugaacaga

SEQ ID NO: 1214450 - RNA, 15 nt, Homo sapiens
agaaaaccauuuuag

SEQ ID NO: 1214451 - RNA, 15 nt, Homo sapiens
agaaaagaagacauu

SEQ ID NO: 1214452 - RNA, 15 nt, Homo sapiens
agaaaagacucugac

SEQ ID NO: 1214453 - RNA, 12 nt, Homo sapiens
agaaaagauuau

SEQ ID NO: 1214454 - RNA, 17 nt, Homo sapiens
agaaaagcaauacuguu

SEQ ID NO: 1214455 - RNA, 18 nt, Homo sapiens
agaaaaguaauuuuguca

SEQ ID NO: 1214456 - RNA, 21 nt, Homo sapiens
agaaaagugcauauuuaucca

SEQ ID NO: 1214457 - RNA, 17 nt, Homo sapiens
agaaaauaaauuuaacu

SEQ ID NO: 1214458 - RNA, 15 nt, Homo sapiens
agaaaauaauuaauu

SEQ ID NO: 1214459 - RNA, 16 nt, Homo sapiens
agaaaauuagacugug

SEQ ID NO: 1214460 - RNA, 17 nt, Homo sapiens
agaaacaaagauguuau

SEQ ID NO: 1214461 - RNA, 23 nt, Homo sapiens
agaaacaaccguuggaaacauaa

SEQ ID NO: 1214462 - RNA, 14 nt, Homo sapiens
agaaacaagcugug

SEQ ID NO: 1214463 - RNA, 16 nt, Homo sapiens
agaaacaagcugugca

SEQ ID NO: 1214464 - RNA, 19 nt, Homo sapiens
agaaacacucuuauuccca

SEQ ID NO: 1214465 - RNA, 20 nt, Homo sapiens
agaaacagauaccauacuca

SEQ ID NO: 1214466 - RNA, 14 nt, Homo sapiens
agaaacagcuuuca

SEQ ID NO: 1214467 - RNA, 22 nt, Homo sapiens
agaaacagugggagcccugacc

SEQ ID NO: 1214468 - RNA, 18 nt, Homo sapiens
agaaacaugacacugacc

SEQ ID NO: 1214469 - RNA, 19 nt, Homo sapiens
agaaacccggcuuccugug

SEQ ID NO: 1214470 - RNA, 23 nt, Homo sapiens
agaaacccggcuuccugugcuaa

SEQ ID NO: 1214471 - RNA, 18 nt, Homo sapiens
agaaacccuugcugcuuu

SEQ ID NO: 1214472 - RNA, 15 nt, Homo sapiens
agaaaccuaaaauaa

SEQ ID NO: 1214473 - RNA, 18 nt, Homo sapiens
agaaacuaugaagaucug

SEQ ID NO: 1214474 - RNA, 13 nt, Homo sapiens
agaaacucaccau

SEQ ID NO: 1214475 - RNA, 14 nt, Homo sapiens
agaaacuuugugcu

SEQ ID NO: 1214476 - RNA, 15 nt, Homo sapiens
agaaagaaugcaaga

SEQ ID NO: 1214477 - RNA, 22 nt, Homo sapiens
agaaagacuugguugguagggu

SEQ ID NO: 1214478 - RNA, 15 nt, Homo sapiens
agaaagaucaaagac

SEQ ID NO: 1214479 - RNA, 13 nt, Homo sapiens
agaaagcacugac

SEQ ID NO: 1214480 - RNA, 23 nt, Homo sapiens
agaaagcagccauuggcacugug

SEQ ID NO: 1214481 - RNA, 21 nt, Homo sapiens
agaaagcauccuaaauauauc

SEQ ID NO: 1214482 - RNA, 19 nt, Homo sapiens
agaaagccuucauaagccu

SEQ ID NO: 1214483 - RNA, 22 nt, Homo sapiens
agaaaggagaacuauccaaaac

SEQ ID NO: 1214484 - RNA, 22 nt, Homo sapiens
agaaaggcucugaagguccaaa

SEQ ID NO: 1214485 - RNA, 20 nt, Homo sapiens
agaaaggugugcuggucaug

SEQ ID NO: 1214486 - RNA, 15 nt, Homo sapiens
agaaagucauuccuu

SEQ ID NO: 1214487 - RNA, 14 nt, Homo sapiens
agaaaguguauuug

SEQ ID NO: 1214488 - RNA, 14 nt, Homo sapiens
agaaauaauaugca

SEQ ID NO: 1214489 - RNA, 13 nt, Homo sapiens
agaaauacuuuca

SEQ ID NO: 1214490 - RNA, 15 nt, Homo sapiens
agaaauauauauaca

SEQ ID NO: 1214491 - RNA, 19 nt, Homo sapiens
agaaauaucugaaaaugua

SEQ ID NO: 1214492 - RNA, 18 nt, Homo sapiens
agaaauauggacacuuaa

SEQ ID NO: 1214493 - RNA, 19 nt, Homo sapiens
agaaaucaauaguugaauu

SEQ ID NO: 1214494 - RNA, 11 nt, Homo sapiens
agaaaucacau

SEQ ID NO: 1214495 - RNA, 17 nt, Homo sapiens
agaaaucauaguuuaaa

SEQ ID NO: 1214496 - RNA, 13 nt, Homo sapiens
agaaaucuagaag

SEQ ID NO: 1214497 - RNA, 14 nt, Homo sapiens
agaaaucuuuccag

SEQ ID NO: 1214498 - RNA, 15 nt, Homo sapiens
agaaaugaucuuuac

SEQ ID NO: 1214499 - RNA, 23 nt, Homo sapiens
agaaaugauucaaauugcugcuu

SEQ ID NO: 1214500 - RNA, 16 nt, Homo sapiens
agaaauggauucuauu

SEQ ID NO: 1214501 - RNA, 22 nt, Homo sapiens
agaaauggccaaauauauuucc

SEQ ID NO: 1214502 - RNA, 17 nt, Homo sapiens
agaaauuaccuguggau

SEQ ID NO: 1214503 - RNA, 11 nt, Homo sapiens
agaaauucugu

SEQ ID NO: 1214504 - RNA, 22 nt, Homo sapiens
agaaauugacacaaguggaccu

SEQ ID NO: 1214505 - RNA, 23 nt, Homo sapiens
agaaauuugccuuguucaauaau

SEQ ID NO: 1214506 - RNA, 20 nt, Homo sapiens
agaaauuuggcuauaaucuu

SEQ ID NO: 1214507 - RNA, 12 nt, Homo sapiens
agaacaaaaaca

SEQ ID NO: 1214508 - RNA, 22 nt, Homo sapiens
agaacaaaggacagaguaugaa

SEQ ID NO: 1214509 - RNA, 20 nt, Homo sapiens
agaacaaauaaaugagccca

SEQ ID NO: 1214510 - RNA, 18 nt, Homo sapiens
agaacaccuccagcuuuu

SEQ ID NO: 1214511 - RNA, 16 nt, Homo sapiens
agaacacuacugcuaa

SEQ ID NO: 1214512 - RNA, 13 nt, Homo sapiens
agaacagggucau

SEQ ID NO: 1214513 - RNA, 21 nt, Homo sapiens
agaacagggucauguuugcag

SEQ ID NO: 1214514 - RNA, 16 nt, Homo sapiens
accauaacaacuucau

SEQ ID NO: 1214515 - RNA, 14 nt, Homo sapiens
accauaacuguuuc

SEQ ID NO: 1214516 - RNA, 13 nt, Homo sapiens
accauaauguuac

SEQ ID NO: 1214517 - RNA, 18 nt, Homo sapiens
accauaguuuacaauauu

SEQ ID NO: 1214518 - RNA, 15 nt, Homo sapiens
accauauaccaucuc

SEQ ID NO: 1214519 - RNA, 19 nt, Homo sapiens
accauauugugcuucacag

SEQ ID NO: 1214520 - RNA, 17 nt, Homo sapiens
accauauuuuauuguau

SEQ ID NO: 1214521 - RNA, 17 nt, Homo sapiens
accaucgaucaugaugu

SEQ ID NO: 1214522 - RNA, 21 nt, Homo sapiens
accaucuccagcuauuuacac

SEQ ID NO: 1214523 - RNA, 23 nt, Homo sapiens
accaucuccccaggcuaugccau

SEQ ID NO: 1214524 - RNA, 19 nt, Homo sapiens
accaucuggaaggacaucu

SEQ ID NO: 1214525 - RNA, 21 nt, Homo sapiens
accaucuucacuggcuuccau

SEQ ID NO: 1214526 - RNA, 11 nt, Homo sapiens
accaugacugu

SEQ ID NO: 1214527 - RNA, 22 nt, Homo sapiens
accaugagaccacuguuaucaa

SEQ ID NO: 1214528 - RNA, 17 nt, Homo sapiens
accauggcacugacaau

SEQ ID NO: 1214529 - RNA, 20 nt, Homo sapiens
accauguacaugaagaagcu

SEQ ID NO: 1214530 - RNA, 14 nt, Homo sapiens
accaugucacugug

SEQ ID NO: 1214531 - RNA, 17 nt, Homo sapiens
accauguuagccaggau

SEQ ID NO: 1214532 - RNA, 20 nt, Homo sapiens
accauuaugcaaguguuccu

SEQ ID NO: 1214533 - RNA, 19 nt, Homo sapiens
accauucagaucacugaau

SEQ ID NO: 1214534 - RNA, 22 nt, Homo sapiens
accauuccugccuuuaagccaa

SEQ ID NO: 1214535 - RNA, 18 nt, Homo sapiens
accauucuccugccucag

SEQ ID NO: 1214536 - RNA, 15 nt, Homo sapiens
accauuugacuguuc

SEQ ID NO: 1214537 - RNA, 23 nt, Homo sapiens
accauuugauagggaacugggga

SEQ ID NO: 1214538 - RNA, 16 nt, Homo sapiens
accauuuuuuaaggaa

SEQ ID NO: 1214539 - RNA, 17 nt, Homo sapiens
accauuuuuuaaggaaa

SEQ ID NO: 1214540 - RNA, 15 nt, Homo sapiens
acccaaacccuaggu

SEQ ID NO: 1214541 - RNA, 23 nt, Homo sapiens
acccaacgcggugcgcaccaacu

SEQ ID NO: 1214542 - RNA, 17 nt, Homo sapiens
acccaauaaaacugaug

SEQ ID NO: 1214543 - RNA, 19 nt, Homo sapiens
acccaauaaaacugauguu

SEQ ID NO: 1214544 - RNA, 16 nt, Homo sapiens
acccacagaugucucu

SEQ ID NO: 1214545 - RNA, 16 nt, Homo sapiens
acccaccccugcacag

SEQ ID NO: 1214546 - RNA, 20 nt, Homo sapiens
acccaccuagaacacuaacu

SEQ ID NO: 1214547 - RNA, 19 nt, Homo sapiens
acccaccuuugccacaaag

SEQ ID NO: 1214548 - RNA, 21 nt, Homo sapiens
acccacugcuuuuggucugug

SEQ ID NO: 1214549 - RNA, 15 nt, Homo sapiens
acccagacaaccaaa

SEQ ID NO: 1214550 - RNA, 16 nt, Homo sapiens
acagacuggaagcaca

SEQ ID NO: 1214551 - RNA, 22 nt, Homo sapiens
acagacuggcaauaaacuccua

SEQ ID NO: 1214552 - RNA, 19 nt, Homo sapiens
acagacuuaacagcccagc

SEQ ID NO: 1214553 - RNA, 17 nt, Homo sapiens
acagacuucuccagacc

SEQ ID NO: 1214554 - RNA, 19 nt, Homo sapiens
acagagaagcggauuucca

SEQ ID NO: 1214555 - RNA, 23 nt, Homo sapiens
acagagaagcggauuuccaggga

SEQ ID NO: 1214556 - RNA, 13 nt, Homo sapiens
acagagagacaga

SEQ ID NO: 1214557 - RNA, 18 nt, Homo sapiens
acagagagucccacugcc

SEQ ID NO: 1214558 - RNA, 18 nt, Homo sapiens
acagagauugaacuccaa

SEQ ID NO: 1214559 - RNA, 22 nt, Homo sapiens
acagagauuggagagaagggca

SEQ ID NO: 1214560 - RNA, 22 nt, Homo sapiens
acagagcacuagguucaauucc

SEQ ID NO: 1214561 - RNA, 18 nt, Homo sapiens
acagagcaggacugcaca

SEQ ID NO: 1214562 - RNA, 20 nt, Homo sapiens
acagagcaggggcuccagca

SEQ ID NO: 1214563 - RNA, 17 nt, Homo sapiens
acagagcugaguccucu

SEQ ID NO: 1214564 - RNA, 18 nt, Homo sapiens
acagaggaagagcaggca

SEQ ID NO: 1214565 - RNA, 14 nt, Homo sapiens
acagaggcauaucc

SEQ ID NO: 1214566 - RNA, 18 nt, Homo sapiens
acagagggcucaccucuu

SEQ ID NO: 1214567 - RNA, 19 nt, Homo sapiens
acagagugaacacucuacu

SEQ ID NO: 1214568 - RNA, 13 nt, Homo sapiens
acagagugcauug

SEQ ID NO: 1214569 - RNA, 15 nt, Homo sapiens
acagauaucaguguc

SEQ ID NO: 1214570 - RNA, 20 nt, Homo sapiens
acagauccuuuuuccaucau

SEQ ID NO: 1214571 - RNA, 23 nt, Homo sapiens
acagaucuuuacucuugagaaau

SEQ ID NO: 1214572 - RNA, 13 nt, Homo sapiens
acagaugccccag

SEQ ID NO: 1214573 - RNA, 13 nt, Homo sapiens
acagaugugaaaa

SEQ ID NO: 1214574 - RNA, 22 nt, Homo sapiens
acagaugugaaaauaaagcaga

SEQ ID NO: 1214575 - RNA, 22 nt, Homo sapiens
acagaugugaaaugaauguaau

SEQ ID NO: 1214576 - RNA, 17 nt, Homo sapiens
acagaugugggcuuuga

SEQ ID NO: 1214577 - RNA, 22 nt, Homo sapiens
acagauuuuaccuauccacaau

SEQ ID NO: 1214578 - RNA, 17 nt, Homo sapiens
acagcaaccucuucaug

SEQ ID NO: 1214579 - RNA, 22 nt, Homo sapiens
acagcaaccucuucaugagcuu

SEQ ID NO: 1214580 - RNA, 13 nt, Homo sapiens
acagcagagacca

SEQ ID NO: 1214581 - RNA, 13 nt, Homo sapiens
acagcagauuuca

SEQ ID NO: 1214582 - RNA, 18 nt, Homo sapiens
acagcagauuucagauca

SEQ ID NO: 1214583 - RNA, 15 nt, Homo sapiens
acagcagcacuguuc

SEQ ID NO: 1214584 - RNA, 17 nt, Homo sapiens
acagcaggacuccaucu

SEQ ID NO: 1214585 - RNA, 23 nt, Homo sapiens
acagcaguggaguaaguauuuag

SEQ ID NO: 1214586 - RNA, 18 nt, Homo sapiens
acagcaugaauaaaacac

SEQ ID NO: 1214587 - RNA, 14 nt, Homo sapiens
acagcauguguauu

SEQ ID NO: 1214588 - RNA, 15 nt, Homo sapiens
acagccaugcccuug

SEQ ID NO: 1214589 - RNA, 21 nt, Homo sapiens
acagccauuuguaaugaauuu

SEQ ID NO: 1214590 - RNA, 15 nt, Homo sapiens
acagcccagagccug

SEQ ID NO: 1214591 - RNA, 18 nt, Homo sapiens
acagccccuuauuugcac

SEQ ID NO: 1214592 - RNA, 22 nt, Homo sapiens
acagccccuuauuugcacuuca

SEQ ID NO: 1214593 - RNA, 14 nt, Homo sapiens
acagcccucagcgu

SEQ ID NO: 1214594 - RNA, 18 nt, Homo sapiens
acagcccuuuugugaacc

SEQ ID NO: 1214595 - RNA, 21 nt, Homo sapiens
acagccucagcggacaagcag

SEQ ID NO: 1214596 - RNA, 12 nt, Homo sapiens
acagcgauuccc

SEQ ID NO: 1214597 - RNA, 19 nt, Homo sapiens
acagcgucccuagcaguga

SEQ ID NO: 1214598 - RNA, 17 nt, Homo sapiens
acagcguguaaacacau

SEQ ID NO: 1214599 - RNA, 12 nt, Homo sapiens
acagcuacucuc

SEQ ID NO: 1214600 - RNA, 22 nt, Homo sapiens
acagcuagaaagcugcacuggu

SEQ ID NO: 1214601 - RNA, 17 nt, Homo sapiens
acagcucaccacugugc

SEQ ID NO: 1214602 - RNA, 20 nt, Homo sapiens
acagcucuagacacugccac

SEQ ID NO: 1214603 - RNA, 13 nt, Homo sapiens
acagcucucaccu

SEQ ID NO: 1214604 - RNA, 14 nt, Homo sapiens
acagcucugagauc

SEQ ID NO: 1214605 - RNA, 17 nt, Homo sapiens
acagcucuuacuuuuaa

SEQ ID NO: 1214606 - RNA, 14 nt, Homo sapiens
acagcucuucucca

SEQ ID NO: 1214607 - RNA, 16 nt, Homo sapiens
acagcugauacuucau

SEQ ID NO: 1214608 - RNA, 21 nt, Homo sapiens
acagcugccaucgaccuggag

SEQ ID NO: 1214609 - RNA, 17 nt, Homo sapiens
acagcuggagcucucaa

SEQ ID NO: 1214610 - RNA, 14 nt, Homo sapiens
acagcuggugcuua

SEQ ID NO: 1214611 - RNA, 13 nt, Homo sapiens
acagcuuucacag

SEQ ID NO: 1214612 - RNA, 13 nt, Homo sapiens
acaggaaaccacu

SEQ ID NO: 1214613 - RNA, 15 nt, Homo sapiens
acaggaaaccacuua

SEQ ID NO: 1214614 - RNA, 19 nt, Homo sapiens
acaggaauacuuaacucaa

SEQ ID NO: 1214615 - RNA, 20 nt, Homo sapiens
acaggaauggaacacacuug

SEQ ID NO: 1214616 - RNA, 13 nt, Homo sapiens
acaggacugauuc

SEQ ID NO: 1214617 - RNA, 18 nt, Homo sapiens
acaggaggaaucauguca

SEQ ID NO: 1214618 - RNA, 22 nt, Homo sapiens
acaggaggaggagauggccaua

SEQ ID NO: 1214619 - RNA, 17 nt, Homo sapiens
acaggagucagugucug

SEQ ID NO: 1214620 - RNA, 13 nt, Homo sapiens
acaggagugggaa

SEQ ID NO: 1214621 - RNA, 21 nt, Homo sapiens
acaggaugaaaguucccccau

SEQ ID NO: 1214622 - RNA, 19 nt, Homo sapiens
acaggaugcuggccuuugc

SEQ ID NO: 1214623 - RNA, 14 nt, Homo sapiens
acaggcaaauuccu

SEQ ID NO: 1214624 - RNA, 17 nt, Homo sapiens
acaggcaaauuccugac

SEQ ID NO: 1214625 - RNA, 18 nt, Homo sapiens
acaggcaccucuccugcc

SEQ ID NO: 1214626 - RNA, 16 nt, Homo sapiens
acaggccacaccacag

SEQ ID NO: 1214627 - RNA, 20 nt, Homo sapiens
acaggcgccugccaucaugc

SEQ ID NO: 1214628 - RNA, 22 nt, Homo sapiens
acaggcgugauccaccacaccu

SEQ ID NO: 1214629 - RNA, 15 nt, Homo sapiens
acaggcucugaccag

SEQ ID NO: 1214630 - RNA, 19 nt, Homo sapiens
acaggcuguucugcacuga

SEQ ID NO: 1214631 - RNA, 15 nt, Homo sapiens
acagggagugcacau

SEQ ID NO: 1214632 - RNA, 22 nt, Homo sapiens
acagggcgguaccuugugccca

SEQ ID NO: 1214633 - RNA, 21 nt, Homo sapiens
acagggugacucacagccgca

SEQ ID NO: 1214634 - RNA, 22 nt, Homo sapiens
acaggguuuugccauguuggcc

SEQ ID NO: 1214635 - RNA, 21 nt, Homo sapiens
acaggguuuuguauucuuuac

SEQ ID NO: 1214636 - RNA, 14 nt, Homo sapiens
acagguaccaucuu

SEQ ID NO: 1214637 - RNA, 20 nt, Homo sapiens
acaggucuagaaaaccagcu

SEQ ID NO: 1214638 - RNA, 20 nt, Homo sapiens
acaggugcaacagacuugaa

SEQ ID NO: 1214639 - RNA, 13 nt, Homo sapiens
acaggugccucac

SEQ ID NO: 1214640 - RNA, 15 nt, Homo sapiens
acagguggugcaaau

SEQ ID NO: 1214641 - RNA, 16 nt, Homo sapiens
acaggugucugagaug

SEQ ID NO: 1214642 - RNA, 15 nt, Homo sapiens
acagguucugagaua

SEQ ID NO: 1214643 - RNA, 17 nt, Homo sapiens
acagguucuuaaaaagg

SEQ ID NO: 1214644 - RNA, 13 nt, Homo sapiens
acaguaaaucuca

SEQ ID NO: 1214645 - RNA, 15 nt, Homo sapiens
acaguaaauguuuau

SEQ ID NO: 1214646 - RNA, 19 nt, Homo sapiens
acaguaacuuuauguguaa

SEQ ID NO: 1214647 - RNA, 12 nt, Homo sapiens
acaguaagcaua

SEQ ID NO: 1214648 - RNA, 14 nt, Homo sapiens
acaguacagcaugu

SEQ ID NO: 1214649 - RNA, 18 nt, Homo sapiens
acaguacccaaacugcuu

SEQ ID NO: 1214650 - RNA, 22 nt, Homo sapiens
acaguagagcaaaucuaugaga

SEQ ID NO: 1214651 - RNA, 16 nt, Homo sapiens
acaguagauuuuccaa

SEQ ID NO: 1214652 - RNA, 14 nt, Homo sapiens
acaguagcauuaug

SEQ ID NO: 1214653 - RNA, 14 nt, Homo sapiens
acaguaucccacau

SEQ ID NO: 1214654 - RNA, 16 nt, Homo sapiens
acaguaugagucaaug

SEQ ID NO: 1214655 - RNA, 18 nt, Homo sapiens
acaguaugagucaaugug

SEQ ID NO: 1214656 - RNA, 21 nt, Homo sapiens
acaguaugagucaaugugcag

SEQ ID NO: 1214657 - RNA, 23 nt, Homo sapiens
acaguaugagucaaugugcagug

SEQ ID NO: 1214658 - RNA, 20 nt, Homo sapiens
acagucaaaauguuugauau

SEQ ID NO: 1214659 - RNA, 21 nt, Homo sapiens
acagucaccauacacacuguu

SEQ ID NO: 1214660 - RNA, 15 nt, Homo sapiens
acagucagcucucuc

SEQ ID NO: 1214661 - RNA, 18 nt, Homo sapiens
acaguccccagacucagc

SEQ ID NO: 1214662 - RNA, 19 nt, Homo sapiens
acaguccucaccacaguuu

SEQ ID NO: 1214663 - RNA, 15 nt, Homo sapiens
acagucuaguacuua

SEQ ID NO: 1214664 - RNA, 19 nt, Homo sapiens
acagucuggagaagguauu

SEQ ID NO: 1214665 - RNA, 14 nt, Homo sapiens
acagugaauccaga

SEQ ID NO: 1214666 - RNA, 22 nt, Homo sapiens
acagugaucuccauauguuaca

SEQ ID NO: 1214667 - RNA, 14 nt, Homo sapiens
acagugcauuugcc

SEQ ID NO: 1214668 - RNA, 15 nt, Homo sapiens
acagugccugggaau

SEQ ID NO: 1214669 - RNA, 16 nt, Homo sapiens
acaguuaacuuucaga

SEQ ID NO: 1214670 - RNA, 13 nt, Homo sapiens
acaguuaaugcca

SEQ ID NO: 1214671 - RNA, 14 nt, Homo sapiens
acaguuacagagug

SEQ ID NO: 1214672 - RNA, 17 nt, Homo sapiens
acaguuagguagcuuua

SEQ ID NO: 1214673 - RNA, 21 nt, Homo sapiens
acaguuauugcaagaguuuaa

SEQ ID NO: 1214674 - RNA, 17 nt, Homo sapiens
acaguucuuggugacug

SEQ ID NO: 1214675 - RNA, 13 nt, Homo sapiens
acaguuugagacu

SEQ ID NO: 1214676 - RNA, 18 nt, Homo sapiens
acaguuuuaacuguggau

SEQ ID NO: 1214677 - RNA, 22 nt, Homo sapiens
acaauguuauucguuuugucua

SEQ ID NO: 1214678 - RNA, 19 nt, Homo sapiens
acaauguuuauaaaggcca

SEQ ID NO: 1214679 - RNA, 19 nt, Homo sapiens
acaauuaaaccgcauguga

SEQ ID NO: 1214680 - RNA, 23 nt, Homo sapiens
acaauucugugacauacauauua

SEQ ID NO: 1214681 - RNA, 22 nt, Homo sapiens
acaauuguaaaauuuaaaucau

SEQ ID NO: 1214682 - RNA, 14 nt, Homo sapiens
acaauuuuuauuuc

SEQ ID NO: 1214683 - RNA, 19 nt, Homo sapiens
acacaaaauacagcacuuu

SEQ ID NO: 1214684 - RNA, 17 nt, Homo sapiens
acacaaaccacaccaca

SEQ ID NO: 1214685 - RNA, 13 nt, Homo sapiens
acacaaagacauu

SEQ ID NO: 1214686 - RNA, 17 nt, Homo sapiens
acacaaaggaaguccaa

SEQ ID NO: 1214687 - RNA, 19 nt, Homo sapiens
acacaaaguguauacaugu

SEQ ID NO: 1214688 - RNA, 18 nt, Homo sapiens
acacaaggcuccaagacc

SEQ ID NO: 1214689 - RNA, 20 nt, Homo sapiens
acacaaggcuccaagaccua

SEQ ID NO: 1214690 - RNA, 16 nt, Homo sapiens
acacaauccuccaaga

SEQ ID NO: 1214691 - RNA, 14 nt, Homo sapiens
acacacacgaugca

SEQ ID NO: 1214692 - RNA, 19 nt, Homo sapiens
acacacacgaugcauuuaa

SEQ ID NO: 1214693 - RNA, 18 nt, Homo sapiens
acacacaguaaauguuua

SEQ ID NO: 1214694 - RNA, 15 nt, Homo sapiens
acacacagucacauu

SEQ ID NO: 1214695 - RNA, 17 nt, Homo sapiens
acacacauacaaaaugu

SEQ ID NO: 1214696 - RNA, 23 nt, Homo sapiens
acacacccugccccugcaaagac

SEQ ID NO: 1214697 - RNA, 13 nt, Homo sapiens
acacaccugguga

SEQ ID NO: 1214698 - RNA, 16 nt, Homo sapiens
acacacgaugcauuua

SEQ ID NO: 1214699 - RNA, 17 nt, Homo sapiens
acacacgaugcauuuaa

SEQ ID NO: 1214700 - RNA, 19 nt, Homo sapiens
acacacucugagucucuga

SEQ ID NO: 1214701 - RNA, 20 nt, Homo sapiens
acacacuguugucaaaaagu

SEQ ID NO: 1214702 - RNA, 14 nt, Homo sapiens
acacagaccaccau

SEQ ID NO: 1214703 - RNA, 15 nt, Homo sapiens
acacagacugcgauu

SEQ ID NO: 1214704 - RNA, 14 nt, Homo sapiens
acacagacuggcaa

SEQ ID NO: 1214705 - RNA, 22 nt, Homo sapiens
acacagacuggcaauaaacucc

SEQ ID NO: 1214706 - RNA, 19 nt, Homo sapiens
acacagagcaggacugcac

SEQ ID NO: 1214707 - RNA, 17 nt, Homo sapiens
acacagcaacaaugacu

SEQ ID NO: 1214708 - RNA, 15 nt, Homo sapiens
acacagcaugugcca

SEQ ID NO: 1214709 - RNA, 21 nt, Homo sapiens
acacagcucuucuccaggcug

SEQ ID NO: 1214710 - RNA, 14 nt, Homo sapiens
acacaggaaaccaa

SEQ ID NO: 1214711 - RNA, 21 nt, Homo sapiens
acacaggcccggcuccaggcu

SEQ ID NO: 1214712 - RNA, 17 nt, Homo sapiens
acacaggcuucaucaag

SEQ ID NO: 1214713 - RNA, 15 nt, Homo sapiens
acacagucaccuucu

SEQ ID NO: 1214714 - RNA, 16 nt, Homo sapiens
acacaguucaauucuc

SEQ ID NO: 1214715 - RNA, 22 nt, Homo sapiens
acacauagauuaauggcacuga

SEQ ID NO: 1214716 - RNA, 15 nt, Homo sapiens
acacauauccacaaa

SEQ ID NO: 1214717 - RNA, 16 nt, Homo sapiens
acacaugcccaugaug

SEQ ID NO: 1214718 - RNA, 24 nt, Homo sapiens
acacauggugugaguccaaagaag

SEQ ID NO: 1214719 - RNA, 16 nt, Homo sapiens
acacaugugcagucac

SEQ ID NO: 1214720 - RNA, 21 nt, Homo sapiens
acacauucuuaacacaugucc

SEQ ID NO: 1214721 - RNA, 20 nt, Homo sapiens
acacauugcauuuugauaaa

SEQ ID NO: 1214722 - RNA, 21 nt, Homo sapiens
acacauuuuuauaaaaaugag

SEQ ID NO: 1214723 - RNA, 11 nt, Homo sapiens
acaccaaccag

SEQ ID NO: 1214724 - RNA, 14 nt, Homo sapiens
acaccaaccgacag

SEQ ID NO: 1214725 - RNA, 17 nt, Homo sapiens
acaccaacgaggugauc

SEQ ID NO: 1214726 - RNA, 16 nt, Homo sapiens
acaccacuguugccuu

SEQ ID NO: 1214727 - RNA, 20 nt, Homo sapiens
acaccauaguuuacaauauu

SEQ ID NO: 1214728 - RNA, 19 nt, Homo sapiens
acaccauuuuccugccuca

SEQ ID NO: 1214729 - RNA, 17 nt, Homo sapiens
acacccaaagcauggac

SEQ ID NO: 1214730 - RNA, 22 nt, Homo sapiens
acacccuggccugaacugagga

SEQ ID NO: 1214731 - RNA, 13 nt, Homo sapiens
acacccuguacug

SEQ ID NO: 1214732 - RNA, 16 nt, Homo sapiens
acaccucaguucccuu

SEQ ID NO: 1214733 - RNA, 23 nt, Homo sapiens
acaccucaguucccuuggccuca

SEQ ID NO: 1214734 - RNA, 19 nt, Homo sapiens
acaccugagacaugcugaa

SEQ ID NO: 1214735 - RNA, 12 nt, Homo sapiens
acaccugccuag

SEQ ID NO: 1214736 - RNA, 20 nt, Homo sapiens
acaccuggcccuugcaaucu

SEQ ID NO: 1214737 - RNA, 15 nt, Homo sapiens
acaccuuuuccccaa

SEQ ID NO: 1214738 - RNA, 22 nt, Homo sapiens
acaccuuuuccccaaccacaga

SEQ ID NO: 1214739 - RNA, 16 nt, Homo sapiens
acacgaugcauuuaau

SEQ ID NO: 1214740 - RNA, 20 nt, Homo sapiens
acacgaugcauuuaauaaag

SEQ ID NO: 1214741 - RNA, 14 nt, Homo sapiens
acacgauuagcuuu

SEQ ID NO: 1214742 - RNA, 20 nt, Homo sapiens
acacggaggucucuguaaaa

SEQ ID NO: 1214743 - RNA, 13 nt, Homo sapiens
acacggagugugc

SEQ ID NO: 1214744 - RNA, 20 nt, Homo sapiens
acacgugcgugcgagcacac

SEQ ID NO: 1214745 - RNA, 13 nt, Homo sapiens
acacuaaaacuuu

SEQ ID NO: 1214746 - RNA, 18 nt, Homo sapiens
acacuaacauauaauguu

SEQ ID NO: 1214747 - RNA, 14 nt, Homo sapiens
acacuaacucacca

SEQ ID NO: 1214748 - RNA, 15 nt, Homo sapiens
acacuaacucaccag

SEQ ID NO: 1214749 - RNA, 15 nt, Homo sapiens
acacuacuaccucuu

SEQ ID NO: 1214750 - RNA, 21 nt, Homo sapiens
acacuaguuuugugccagccg

SEQ ID NO: 1214751 - RNA, 15 nt, Homo sapiens
acacuaucauggacu

SEQ ID NO: 1214752 - RNA, 14 nt, Homo sapiens
acacucaugaagca

SEQ ID NO: 1214753 - RNA, 12 nt, Homo sapiens
acacuccaggcc

SEQ ID NO: 1214754 - RNA, 22 nt, Homo sapiens
acacuccagugccagcaaugac

SEQ ID NO: 1214755 - RNA, 23 nt, Homo sapiens
acacuccagugccagcaaugaca

SEQ ID NO: 1214756 - RNA, 18 nt, Homo sapiens
acacucuacuacauguga

SEQ ID NO: 1214757 - RNA, 20 nt, Homo sapiens
acacucucuggaagcccugg

SEQ ID NO: 1214758 - RNA, 17 nt, Homo sapiens
acacugaaaccaaaaca

SEQ ID NO: 1214759 - RNA, 14 nt, Homo sapiens
acacugaagccaca

SEQ ID NO: 1214760 - RNA, 17 nt, Homo sapiens
acacugaaguuaacaga

SEQ ID NO: 1214761 - RNA, 18 nt, Homo sapiens
acacugagauauucagcc

SEQ ID NO: 1214762 - RNA, 21 nt, Homo sapiens
acacugaguucuaucaguuau

SEQ ID NO: 1214763 - RNA, 18 nt, Homo sapiens
acacugauacacuugaag

SEQ ID NO: 1214764 - RNA, 14 nt, Homo sapiens
acacugaucuggcu

SEQ ID NO: 1214765 - RNA, 13 nt, Homo sapiens
acacugaugcaag

SEQ ID NO: 1214766 - RNA, 13 nt, Homo sapiens
acacugauuccuu

SEQ ID NO: 1214767 - RNA, 16 nt, Homo sapiens
acacugauuccuuuau

SEQ ID NO: 1214768 - RNA, 19 nt, Homo sapiens
acacugcagugaccacuua

SEQ ID NO: 1214769 - RNA, 17 nt, Homo sapiens
acacugccgacaucagc

SEQ ID NO: 1214770 - RNA, 18 nt, Homo sapiens
acacugcugcuccagugc

SEQ ID NO: 1214771 - RNA, 19 nt, Homo sapiens
acacugcugcuccagugca

SEQ ID NO: 1214772 - RNA, 18 nt, Homo sapiens
acacuggcguuacugcuu

SEQ ID NO: 1214773 - RNA, 20 nt, Homo sapiens
acacuguauauaaacauauc

SEQ ID NO: 1214774 - RNA, 13 nt, Homo sapiens
acacugugucauu

SEQ ID NO: 1214775 - RNA, 18 nt, Homo sapiens
acacuguuacuuucguac

SEQ ID NO: 1214776 - RNA, 18 nt, Homo sapiens
acacuguuaucuucacuu

SEQ ID NO: 1214777 - RNA, 23 nt, Homo sapiens
acacuguuggggaccuuccugau

SEQ ID NO: 1214778 - RNA, 17 nt, Homo sapiens
acacuguugucaaaaag

SEQ ID NO: 1214779 - RNA, 23 nt, Homo sapiens
acacuguugucaaaaaguuccau

SEQ ID NO: 1214780 - RNA, 16 nt, Homo sapiens
acacuuccauuaacuu

SEQ ID NO: 1214781 - RNA, 19 nt, Homo sapiens
acacuucugugagaccccc

SEQ ID NO: 1214782 - RNA, 24 nt, Homo sapiens
acacuugcucccaacccauucacu

SEQ ID NO: 1214783 - RNA, 23 nt, Homo sapiens
acacuugguccauccauuuccaa

SEQ ID NO: 1214784 - RNA, 19 nt, Homo sapiens
acacuugguuagacgccuu

SEQ ID NO: 1214785 - RNA, 14 nt, Homo sapiens
acacuuuuccacau

SEQ ID NO: 1214786 - RNA, 17 nt, Homo sapiens
acagaaaagacucugac

SEQ ID NO: 1214787 - RNA, 15 nt, Homo sapiens
acagaaacugaugcc

SEQ ID NO: 1214788 - RNA, 12 nt, Homo sapiens
acagaaacugca

SEQ ID NO: 1214789 - RNA, 20 nt, Homo sapiens
acagaaagagacuccgucuc

SEQ ID NO: 1214790 - RNA, 21 nt, Homo sapiens
acagaaagccugggugacauu

SEQ ID NO: 1214791 - RNA, 20 nt, Homo sapiens
acagaaauauauauacauau

SEQ ID NO: 1214792 - RNA, 13 nt, Homo sapiens
acagaacuucaga

SEQ ID NO: 1214793 - RNA, 16 nt, Homo sapiens
acagaagacagcugcu

SEQ ID NO: 1214794 - RNA, 20 nt, Homo sapiens
acagaagcggcucaguucac

SEQ ID NO: 1214795 - RNA, 11 nt, Homo sapiens
acagaagggac

SEQ ID NO: 1214796 - RNA, 14 nt, Homo sapiens
acagaagggcucuu

SEQ ID NO: 1214797 - RNA, 15 nt, Homo sapiens
acagaauagcacaaa

SEQ ID NO: 1214798 - RNA, 15 nt, Homo sapiens
acagaauuguuccag

SEQ ID NO: 1214799 - RNA, 17 nt, Homo sapiens
acagaauuugucagaaa

SEQ ID NO: 1214800 - RNA, 16 nt, Homo sapiens
acagacacuuacaugg

SEQ ID NO: 1214801 - RNA, 20 nt, Homo sapiens
acagaccuaggauuucauga

SEQ ID NO: 1214802 - RNA, 17 nt, Homo sapiens
acagacuccacccuccu

SEQ ID NO: 1214803 - RNA, 16 nt, Homo sapiens
acagacugauguguau

SEQ ID NO: 1214804 - RNA, 23 nt, Homo sapiens
aauuagucuuggaaaaaaaccac

SEQ ID NO: 1214805 - RNA, 21 nt, Homo sapiens
aauuauaagcauacaacugga

SEQ ID NO: 1214806 - RNA, 22 nt, Homo sapiens
aauuauacagauagaguuccau

SEQ ID NO: 1214807 - RNA, 21 nt, Homo sapiens
aauuauacuguagcugaugaa

SEQ ID NO: 1214808 - RNA, 22 nt, Homo sapiens
aauuauacuguagcugaugaaa

SEQ ID NO: 1214809 - RNA, 14 nt, Homo sapiens
aauuauaguuucaa

SEQ ID NO: 1214810 - RNA, 18 nt, Homo sapiens
aauuaucgggaacagugu

SEQ ID NO: 1214811 - RNA, 16 nt, Homo sapiens
aauuaugcacuaaaua

SEQ ID NO: 1214812 - RNA, 22 nt, Homo sapiens
aauuauguucuacagaauauuc

SEQ ID NO: 1214813 - RNA, 21 nt, Homo sapiens
aauuauuaugucucaaaauaa

SEQ ID NO: 1214814 - RNA, 15 nt, Homo sapiens
aauuauuucucucac

SEQ ID NO: 1214815 - RNA, 17 nt, Homo sapiens
aauuauuuuaguagugu

SEQ ID NO: 1214816 - RNA, 16 nt, Homo sapiens
aauuauuuugacaaau

SEQ ID NO: 1214817 - RNA, 17 nt, Homo sapiens
aauucaaaaaaaaaagc

SEQ ID NO: 1214818 - RNA, 15 nt, Homo sapiens
aauucaaaaguucca

SEQ ID NO: 1214819 - RNA, 13 nt, Homo sapiens
aauucaaacuggg

SEQ ID NO: 1214820 - RNA, 15 nt, Homo sapiens
aauucaaaggcauuu

SEQ ID NO: 1214821 - RNA, 20 nt, Homo sapiens
aauucacagaauagcacaaa

SEQ ID NO: 1214822 - RNA, 16 nt, Homo sapiens
aauucaccaacacagu

SEQ ID NO: 1214823 - RNA, 22 nt, Homo sapiens
aauucagaagaccccugacuca

SEQ ID NO: 1214824 - RNA, 17 nt, Homo sapiens
aauucagacaagcugca

SEQ ID NO: 1214825 - RNA, 22 nt, Homo sapiens
aauucagacaagcugcauuuca

SEQ ID NO: 1214826 - RNA, 14 nt, Homo sapiens
aauucagaguccuu

SEQ ID NO: 1214827 - RNA, 15 nt, Homo sapiens
aauucagaugcuguu

SEQ ID NO: 1214828 - RNA, 22 nt, Homo sapiens
aauuccacaccuuuuauugaca

SEQ ID NO: 1214829 - RNA, 14 nt, Homo sapiens
aauuccagugccag

SEQ ID NO: 1214830 - RNA, 23 nt, Homo sapiens
aauuccagugccaggccagugac

SEQ ID NO: 1214831 - RNA, 18 nt, Homo sapiens
aauuccaucccaucaucu

SEQ ID NO: 1214832 - RNA, 12 nt, Homo sapiens
aauuccuaguca

SEQ ID NO: 1214833 - RNA, 16 nt, Homo sapiens
aauuccucuuacugua

SEQ ID NO: 1214834 - RNA, 15 nt, Homo sapiens
aauuccuguauucua

SEQ ID NO: 1214835 - RNA, 22 nt, Homo sapiens
aauuccuguauucuacagcaga

SEQ ID NO: 1214836 - RNA, 16 nt, Homo sapiens
aauuccuguuacuuua

SEQ ID NO: 1214837 - RNA, 22 nt, Homo sapiens
aauucuagaggauguaucucac

SEQ ID NO: 1214838 - RNA, 14 nt, Homo sapiens
aauucuauaguaag

SEQ ID NO: 1214839 - RNA, 20 nt, Homo sapiens
aauucucauuugucacacac

SEQ ID NO: 1214840 - RNA, 21 nt, Homo sapiens
aauucucuuauccaacaucaa

SEQ ID NO: 1214841 - RNA, 17 nt, Homo sapiens
aauucuguaucuguaga

SEQ ID NO: 1214842 - RNA, 19 nt, Homo sapiens
aauucuuacacugccugua

SEQ ID NO: 1214843 - RNA, 18 nt, Homo sapiens
aauucuuagccaggugua

SEQ ID NO: 1214844 - RNA, 16 nt, Homo sapiens
aauucuugaaguucau

SEQ ID NO: 1214845 - RNA, 16 nt, Homo sapiens
aauucuugcuaugaaa

SEQ ID NO: 1214846 - RNA, 21 nt, Homo sapiens
aauucuuuucuuuuccauuua

SEQ ID NO: 1214847 - RNA, 20 nt, Homo sapiens
aauugaaaacacacucaaaa

SEQ ID NO: 1214848 - RNA, 22 nt, Homo sapiens
aauugaaaacacacucaaaaga

SEQ ID NO: 1214849 - RNA, 18 nt, Homo sapiens
aauugaaaaguacaacua

SEQ ID NO: 1214850 - RNA, 15 nt, Homo sapiens
aauugaauaguaaga

SEQ ID NO: 1214851 - RNA, 13 nt, Homo sapiens
aauugacaugugc

SEQ ID NO: 1214852 - RNA, 14 nt, Homo sapiens
aauugaccuuguga

SEQ ID NO: 1214853 - RNA, 13 nt, Homo sapiens
aauugacuaaaaa

SEQ ID NO: 1214854 - RNA, 22 nt, Homo sapiens
aauugacuaccguuguuugcaa

SEQ ID NO: 1214855 - RNA, 12 nt, Homo sapiens
aauugacuugca

SEQ ID NO: 1214856 - RNA, 14 nt, Homo sapiens
aauugauguugcug

SEQ ID NO: 1214857 - RNA, 13 nt, Homo sapiens
aauugauuugcau

SEQ ID NO: 1214858 - RNA, 16 nt, Homo sapiens
aauugauuugcauuga

SEQ ID NO: 1214859 - RNA, 22 nt, Homo sapiens
aauugauuuuccuuugugcaug

SEQ ID NO: 1214860 - RNA, 19 nt, Homo sapiens
aauugauuuuucucuucau

SEQ ID NO: 1214861 - RNA, 16 nt, Homo sapiens
aauugcaaaucuugaa

SEQ ID NO: 1214862 - RNA, 12 nt, Homo sapiens
aauugcauuucc

SEQ ID NO: 1214863 - RNA, 14 nt, Homo sapiens
aauugcucaugcau

SEQ ID NO: 1214864 - RNA, 12 nt, Homo sapiens
aauugcugaaag

SEQ ID NO: 1214865 - RNA, 16 nt, Homo sapiens
aauuggaaacugacau

SEQ ID NO: 1214866 - RNA, 19 nt, Homo sapiens
aauuggggggaggugcugu

SEQ ID NO: 1214867 - RNA, 20 nt, Homo sapiens
aauuguauaagucaagcaca

SEQ ID NO: 1214868 - RNA, 18 nt, Homo sapiens
aauugucaaagacuguau

SEQ ID NO: 1214869 - RNA, 19 nt, Homo sapiens
aauugucgaaaagagucuu

SEQ ID NO: 1214870 - RNA, 13 nt, Homo sapiens
aauugugacauaa

SEQ ID NO: 1214871 - RNA, 23 nt, Homo sapiens
aauugugacauaauaauagcagu

SEQ ID NO: 1214872 - RNA, 19 nt, Homo sapiens
aauugugaucagaccauaa

SEQ ID NO: 1214873 - RNA, 14 nt, Homo sapiens
aauugugugucaca

SEQ ID NO: 1214874 - RNA, 23 nt, Homo sapiens
aauuguguugucuucagcaguca

SEQ ID NO: 1214875 - RNA, 15 nt, Homo sapiens
aauuguuuugcacuu

SEQ ID NO: 1214876 - RNA, 17 nt, Homo sapiens
aauuuacacacuugcau

SEQ ID NO: 1214877 - RNA, 17 nt, Homo sapiens
aauuuacuguugcccau

SEQ ID NO: 1214878 - RNA, 18 nt, Homo sapiens
aauuuaguuuuagcagcu

SEQ ID NO: 1214879 - RNA, 18 nt, Homo sapiens
aauuuaucaaagcauaga

SEQ ID NO: 1214880 - RNA, 20 nt, Homo sapiens
aauuuaucuugucucugggc

SEQ ID NO: 1214881 - RNA, 15 nt, Homo sapiens
aauuuaugcauuuca

SEQ ID NO: 1214882 - RNA, 18 nt, Homo sapiens
aauuuauuaacuaaucaa

SEQ ID NO: 1214883 - RNA, 19 nt, Homo sapiens
aauuuauuaacuaaucaag

SEQ ID NO: 1214884 - RNA, 23 nt, Homo sapiens
aauuuauugucugucuacauuuc

SEQ ID NO: 1214885 - RNA, 19 nt, Homo sapiens
aauuuauuuaaguucacaa

SEQ ID NO: 1214886 - RNA, 15 nt, Homo sapiens
aauuuauuucaaaaa

SEQ ID NO: 1214887 - RNA, 19 nt, Homo sapiens
aauuuauuuccacuaaaaa

SEQ ID NO: 1214888 - RNA, 20 nt, Homo sapiens
aauuuauuucucccuguaaa

SEQ ID NO: 1214889 - RNA, 15 nt, Homo sapiens
aauuucaaaccacac

SEQ ID NO: 1214890 - RNA, 18 nt, Homo sapiens
aauuucaauuucucccuu

SEQ ID NO: 1214891 - RNA, 12 nt, Homo sapiens
aauuucauucau

SEQ ID NO: 1214892 - RNA, 14 nt, Homo sapiens
aauuucauuuuccu

SEQ ID NO: 1214893 - RNA, 15 nt, Homo sapiens
aauuuccaguaccuu

SEQ ID NO: 1214894 - RNA, 23 nt, Homo sapiens
aauuucccuucuugcauccuucc

SEQ ID NO: 1214895 - RNA, 13 nt, Homo sapiens
aauuuccugaugc

SEQ ID NO: 1214896 - RNA, 13 nt, Homo sapiens
aauuucgagauuu

SEQ ID NO: 1214897 - RNA, 20 nt, Homo sapiens
aauuucggauuuuuuccaaa

SEQ ID NO: 1214898 - RNA, 13 nt, Homo sapiens
aauuucugugaaa

SEQ ID NO: 1214899 - RNA, 14 nt, Homo sapiens
aauuugaaauuuag

SEQ ID NO: 1214900 - RNA, 15 nt, Homo sapiens
aauuugagauucuac

SEQ ID NO: 1214901 - RNA, 14 nt, Homo sapiens
aauuugaggacaag

SEQ ID NO: 1214902 - RNA, 16 nt, Homo sapiens
aauuugaggacaagau

SEQ ID NO: 1214903 - RNA, 18 nt, Homo sapiens
aauuuggagacucugugg

SEQ ID NO: 1214904 - RNA, 13 nt, Homo sapiens
aauuugggcagcu

SEQ ID NO: 1214905 - RNA, 21 nt, Homo sapiens
aauuugguaaauuaguauuua

SEQ ID NO: 1214906 - RNA, 18 nt, Homo sapiens
aauuugugccacuuuaau

SEQ ID NO: 1214907 - RNA, 17 nt, Homo sapiens
aauuuuaaaaaagggag

SEQ ID NO: 1214908 - RNA, 19 nt, Homo sapiens
aauuuuaaauuauaacuua

SEQ ID NO: 1214909 - RNA, 19 nt, Homo sapiens
aauuuuaaugaagugcaau

SEQ ID NO: 1214910 - RNA, 12 nt, Homo sapiens
aauuuuacccuu

SEQ ID NO: 1214911 - RNA, 13 nt, Homo sapiens
aauuuuacuucca

SEQ ID NO: 1214912 - RNA, 17 nt, Homo sapiens
aauuuuaguguuaauga

SEQ ID NO: 1214913 - RNA, 16 nt, Homo sapiens
aauuuuauuaaaugca

SEQ ID NO: 1214914 - RNA, 16 nt, Homo sapiens
aauuuucaauuugaga

SEQ ID NO: 1214915 - RNA, 15 nt, Homo sapiens
aauuuucagcauuaa

SEQ ID NO: 1214916 - RNA, 15 nt, Homo sapiens
aauuuucaguauaau

SEQ ID NO: 1214917 - RNA, 20 nt, Homo sapiens
aauuuucauuaaacuugaag

SEQ ID NO: 1214918 - RNA, 23 nt, Homo sapiens
aauuuucccuugauaaccauaua

SEQ ID NO: 1214919 - RNA, 21 nt, Homo sapiens
aauuuucuagauuuucuacuu

SEQ ID NO: 1214920 - RNA, 20 nt, Homo sapiens
aacaucgucuaaacuuuaga

SEQ ID NO: 1214921 - RNA, 17 nt, Homo sapiens
aacaucuggaguccuau

SEQ ID NO: 1214922 - RNA, 21 nt, Homo sapiens
aacaucuuggucagauuugaa

SEQ ID NO: 1214923 - RNA, 20 nt, Homo sapiens
aacaugaaaaacaggugaca

SEQ ID NO: 1214924 - RNA, 15 nt, Homo sapiens
aacaugaaaugcccu

SEQ ID NO: 1214925 - RNA, 17 nt, Homo sapiens
aacaugaaaugcuucca

SEQ ID NO: 1214926 - RNA, 17 nt, Homo sapiens
aacaugaagccaggugu

SEQ ID NO: 1214927 - RNA, 15 nt, Homo sapiens
aacaugacacugacc

SEQ ID NO: 1214928 - RNA, 12 nt, Homo sapiens
aacaugcacggu

SEQ ID NO: 1214929 - RNA, 22 nt, Homo sapiens
aacauggccugcugggcccaag

SEQ ID NO: 1214930 - RNA, 16 nt, Homo sapiens
aacauguaugugcauu

SEQ ID NO: 1214931 - RNA, 19 nt, Homo sapiens
aacauguaugugcauuuca

SEQ ID NO: 1214932 - RNA, 20 nt, Homo sapiens
aacauuaaaauuagcacuaa

SEQ ID NO: 1214933 - RNA, 19 nt, Homo sapiens
aacauuaccuuacugugga

SEQ ID NO: 1214934 - RNA, 20 nt, Homo sapiens
aacauucacacagggcucuu

SEQ ID NO: 1214935 - RNA, 12 nt, Homo sapiens
aacauucaggaa

SEQ ID NO: 1214936 - RNA, 13 nt, Homo sapiens
aacauuccaagaa

SEQ ID NO: 1214937 - RNA, 11 nt, Homo sapiens
aacauucugua

SEQ ID NO: 1214938 - RNA, 12 nt, Homo sapiens
aacauugcccag

SEQ ID NO: 1214939 - RNA, 20 nt, Homo sapiens
aacauuguaaauauuuacuc

SEQ ID NO: 1214940 - RNA, 18 nt, Homo sapiens
aacauuuccucuuuccaa

SEQ ID NO: 1214941 - RNA, 16 nt, Homo sapiens
aacauuucucacugaa

SEQ ID NO: 1214942 - RNA, 16 nt, Homo sapiens
aacauuucuguucuca

SEQ ID NO: 1214943 - RNA, 19 nt, Homo sapiens
aaccaaagagggcuuccuc

SEQ ID NO: 1214944 - RNA, 20 nt, Homo sapiens
aaccaaauacuuuaauguau

SEQ ID NO: 1214945 - RNA, 22 nt, Homo sapiens
aaccaacugcugcugugcacau

SEQ ID NO: 1214946 - RNA, 20 nt, Homo sapiens
aaccaauacuccacugcuca

SEQ ID NO: 1214947 - RNA, 20 nt, Homo sapiens
aaccaauagugaaaugccac

SEQ ID NO: 1214948 - RNA, 12 nt, Homo sapiens
aaccaaugauuc

SEQ ID NO: 1214949 - RNA, 14 nt, Homo sapiens
aaccaauuucuucc

SEQ ID NO: 1214950 - RNA, 14 nt, Homo sapiens
aaccacacuugaaa

SEQ ID NO: 1214951 - RNA, 12 nt, Homo sapiens
aaccaccaaucc

SEQ ID NO: 1214952 - RNA, 15 nt, Homo sapiens
aaccaccuucaccug

SEQ ID NO: 1214953 - RNA, 21 nt, Homo sapiens
aaccacuuaaaaaauguccau

SEQ ID NO: 1214954 - RNA, 14 nt, Homo sapiens
aaccagaccacuca

SEQ ID NO: 1214955 - RNA, 16 nt, Homo sapiens
aaccagagaagcugcu

SEQ ID NO: 1214956 - RNA, 18 nt, Homo sapiens
aaccagaucugucuccaa

SEQ ID NO: 1214957 - RNA, 15 nt, Homo sapiens
aaccagcccaaccau

SEQ ID NO: 1214958 - RNA, 16 nt, Homo sapiens
aaccagguuuagacag

SEQ ID NO: 1214959 - RNA, 15 nt, Homo sapiens
aaccagucuguguuu

SEQ ID NO: 1214960 - RNA, 17 nt, Homo sapiens
aaccauaugaacauaua

SEQ ID NO: 1214961 - RNA, 18 nt, Homo sapiens
aaccauaugaacauauau

SEQ ID NO: 1214962 - RNA, 13 nt, Homo sapiens
aaccaucccugau

SEQ ID NO: 1214963 - RNA, 13 nt, Homo sapiens
aaccaucucucuu

SEQ ID NO: 1214964 - RNA, 19 nt, Homo sapiens
aaccaucugaagaaacuuc

SEQ ID NO: 1214965 - RNA, 22 nt, Homo sapiens
aaccaucuucacuggcuuccau

SEQ ID NO: 1214966 - RNA, 15 nt, Homo sapiens
aaccaugagaauuug

SEQ ID NO: 1214967 - RNA, 22 nt, Homo sapiens
aaccaugcauggugcaucagca

SEQ ID NO: 1214968 - RNA, 19 nt, Homo sapiens
aaccauucacagugcaaga

SEQ ID NO: 1214969 - RNA, 20 nt, Homo sapiens
aaccauucacagugcaagaa

SEQ ID NO: 1214970 - RNA, 15 nt, Homo sapiens
aaccauuccaacuuc

SEQ ID NO: 1214971 - RNA, 22 nt, Homo sapiens
aaccauugucuuguucugugau

SEQ ID NO: 1214972 - RNA, 13 nt, Homo sapiens
aaccauuuacuua

SEQ ID NO: 1214973 - RNA, 11 nt, Homo sapiens
aacccaaagug

SEQ ID NO: 1214974 - RNA, 23 nt, Homo sapiens
aacccaaauugggacaacagugc

SEQ ID NO: 1214975 - RNA, 13 nt, Homo sapiens
aacccaagcuccu

SEQ ID NO: 1214976 - RNA, 22 nt, Homo sapiens
aacccaauacagucuaguuucc

SEQ ID NO: 1214977 - RNA, 18 nt, Homo sapiens
aacccacagaugucucug

SEQ ID NO: 1214978 - RNA, 15 nt, Homo sapiens
aacccacagccaaac

SEQ ID NO: 1214979 - RNA, 20 nt, Homo sapiens
aacccacgauuuucuccagc

SEQ ID NO: 1214980 - RNA, 17 nt, Homo sapiens
aacccagacaaccaaaa

SEQ ID NO: 1214981 - RNA, 18 nt, Homo sapiens
aacccagacaaccaaaac

SEQ ID NO: 1214982 - RNA, 16 nt, Homo sapiens
aacccagucucagaca

SEQ ID NO: 1214983 - RNA, 17 nt, Homo sapiens
aacccauuucuccagac

SEQ ID NO: 1214984 - RNA, 21 nt, Homo sapiens
aaccccaagcugccucugggc

SEQ ID NO: 1214985 - RNA, 11 nt, Homo sapiens
aaccccacugc

SEQ ID NO: 1214986 - RNA, 11 nt, Homo sapiens
aaccccagugg

SEQ ID NO: 1214987 - RNA, 18 nt, Homo sapiens
aaccccaguggauucuca

SEQ ID NO: 1214988 - RNA, 19 nt, Homo sapiens
aaccccaucucuacugaaa

SEQ ID NO: 1214989 - RNA, 17 nt, Homo sapiens
aacccccaucucuacua

SEQ ID NO: 1214990 - RNA, 16 nt, Homo sapiens
aaccccuccccuccau

SEQ ID NO: 1214991 - RNA, 17 nt, Homo sapiens
aaccccuccccuccauc

SEQ ID NO: 1214992 - RNA, 22 nt, Homo sapiens
aacccgacauguguaccucagc

SEQ ID NO: 1214993 - RNA, 14 nt, Homo sapiens
aacccggcuuccug

SEQ ID NO: 1214994 - RNA, 19 nt, Homo sapiens
aacccuaaauuaauaaaag

SEQ ID NO: 1214995 - RNA, 17 nt, Homo sapiens
aacccuaucuccugaca

SEQ ID NO: 1214996 - RNA, 20 nt, Homo sapiens
aacccucacaagcaugaagu

SEQ ID NO: 1214997 - RNA, 20 nt, Homo sapiens
aacccucccaaaacagggaa

SEQ ID NO: 1214998 - RNA, 12 nt, Homo sapiens
aacccugucuga

SEQ ID NO: 1214999 - RNA, 14 nt, Homo sapiens
aaccgagcaauuuu

SEQ ID NO: 1215000 - RNA, 21 nt, Homo sapiens
aaccgggagaaggcaugagaa

SEQ ID NO: 1215001 - RNA, 17 nt, Homo sapiens
aaccggggccuacuaga

SEQ ID NO: 1215002 - RNA, 16 nt, Homo sapiens
aaccguccucuuuuuc

SEQ ID NO: 1215003 - RNA, 16 nt, Homo sapiens
aaccgugauaagccuu

SEQ ID NO: 1215004 - RNA, 20 nt, Homo sapiens
aaccuaauuuuauccaugga

SEQ ID NO: 1215005 - RNA, 23 nt, Homo sapiens
aaccuacaguuuuaacuguggau

SEQ ID NO: 1215006 - RNA, 23 nt, Homo sapiens
aaccuaguacugccccccaugag

SEQ ID NO: 1215007 - RNA, 17 nt, Homo sapiens
aaccuauguguccucua

SEQ ID NO: 1215008 - RNA, 13 nt, Homo sapiens
aaccucaaaguga

SEQ ID NO: 1215009 - RNA, 21 nt, Homo sapiens
aaccucaacugccuacuccaa

SEQ ID NO: 1215010 - RNA, 12 nt, Homo sapiens
aaccucauucuc

SEQ ID NO: 1215011 - RNA, 20 nt, Homo sapiens
aaccuccgccucccggguuc

SEQ ID NO: 1215012 - RNA, 18 nt, Homo sapiens
aaccuccuguggaaccca

SEQ ID NO: 1215013 - RNA, 19 nt, Homo sapiens
aaugaauguaaucuaauag

SEQ ID NO: 1215014 - RNA, 19 nt, Homo sapiens
aaugaauuauaacaguuau

SEQ ID NO: 1215015 - RNA, 17 nt, Homo sapiens
aaugacaacagaaaaac

SEQ ID NO: 1215016 - RNA, 12 nt, Homo sapiens
aaugacaaugau

SEQ ID NO: 1215017 - RNA, 15 nt, Homo sapiens
aaugacaaugaugau

SEQ ID NO: 1215018 - RNA, 17 nt, Homo sapiens
aaugacagauucugaca

SEQ ID NO: 1215019 - RNA, 14 nt, Homo sapiens
aaugacaucucagg

SEQ ID NO: 1215020 - RNA, 14 nt, Homo sapiens
aaugacaucuucaa

SEQ ID NO: 1215021 - RNA, 15 nt, Homo sapiens
aaugacaugcacuga

SEQ ID NO: 1215022 - RNA, 17 nt, Homo sapiens
aaugacaugcacugacc

SEQ ID NO: 1215023 - RNA, 13 nt, Homo sapiens
aaugacauuugua

SEQ ID NO: 1215024 - RNA, 21 nt, Homo sapiens
aaugaccgcacguucucugcc

SEQ ID NO: 1215025 - RNA, 11 nt, Homo sapiens
aaugacugcuu

SEQ ID NO: 1215026 - RNA, 16 nt, Homo sapiens
aaugacuuaaccauau

SEQ ID NO: 1215027 - RNA, 21 nt, Homo sapiens
aaugagacauaggccaugaaa

SEQ ID NO: 1215028 - RNA, 20 nt, Homo sapiens
aaugagaucguuguuuacag

SEQ ID NO: 1215029 - RNA, 23 nt, Homo sapiens
aaugaggugagggggguucuccu

SEQ ID NO: 1215030 - RNA, 18 nt, Homo sapiens
aaugaucugccucuaaaa

SEQ ID NO: 1215031 - RNA, 19 nt, Homo sapiens
aaugauuauuuucauuaca

SEQ ID NO: 1215032 - RNA, 15 nt, Homo sapiens
aaugauucauguuau

SEQ ID NO: 1215033 - RNA, 17 nt, Homo sapiens
aaugauucauguuauau

SEQ ID NO: 1215034 - RNA, 18 nt, Homo sapiens
aaugauuucaagguuugu

SEQ ID NO: 1215035 - RNA, 20 nt, Homo sapiens
aaugcaaacucaccgcucca

SEQ ID NO: 1215036 - RNA, 14 nt, Homo sapiens
aaugcaaagcugaa

SEQ ID NO: 1215037 - RNA, 20 nt, Homo sapiens
aaugcaaauuaaaacauauu

SEQ ID NO: 1215038 - RNA, 17 nt, Homo sapiens
aaugcacauccauuccc

SEQ ID NO: 1215039 - RNA, 14 nt, Homo sapiens
aaugcacaucucau

SEQ ID NO: 1215040 - RNA, 22 nt, Homo sapiens
aaugcacguuucaaagcuuucc

SEQ ID NO: 1215041 - RNA, 21 nt, Homo sapiens
aaugcauagagcccuggccag

SEQ ID NO: 1215042 - RNA, 19 nt, Homo sapiens
aaugcaucacguaccccac

SEQ ID NO: 1215043 - RNA, 14 nt, Homo sapiens
aaugcauugcuaaa

SEQ ID NO: 1215044 - RNA, 18 nt, Homo sapiens
aaugcauuugauggccac

SEQ ID NO: 1215045 - RNA, 18 nt, Homo sapiens
aaugcauuuguaauucau

SEQ ID NO: 1215046 - RNA, 17 nt, Homo sapiens
aaugccacaaaacugac

SEQ ID NO: 1215047 - RNA, 15 nt, Homo sapiens
aaugccauucucuug

SEQ ID NO: 1215048 - RNA, 21 nt, Homo sapiens
aaugcccucaggggacuugaa

SEQ ID NO: 1215049 - RNA, 14 nt, Homo sapiens
aaugccuacugagu

SEQ ID NO: 1215050 - RNA, 16 nt, Homo sapiens
aaugcuaugacuguau

SEQ ID NO: 1215051 - RNA, 12 nt, Homo sapiens
aaugcuccccac

SEQ ID NO: 1215052 - RNA, 16 nt, Homo sapiens
aaugcuccuccuccau

SEQ ID NO: 1215053 - RNA, 23 nt, Homo sapiens
aaugcucugucuucaaugaucaa

SEQ ID NO: 1215054 - RNA, 16 nt, Homo sapiens
aaugcucuuuacuuca

SEQ ID NO: 1215055 - RNA, 17 nt, Homo sapiens
aaugcugagguuaugaa

SEQ ID NO: 1215056 - RNA, 19 nt, Homo sapiens
aaugcugaugaaucacugu

SEQ ID NO: 1215057 - RNA, 19 nt, Homo sapiens
aaugcugcuucuccuccca

SEQ ID NO: 1215058 - RNA, 14 nt, Homo sapiens
aaugcuggacugga

SEQ ID NO: 1215059 - RNA, 17 nt, Homo sapiens
aaugcuggcauuugcac

SEQ ID NO: 1215060 - RNA, 20 nt, Homo sapiens
aaugcuuuuaaaugcucucu

SEQ ID NO: 1215061 - RNA, 15 nt, Homo sapiens
aauggaacaguaaga

SEQ ID NO: 1215062 - RNA, 21 nt, Homo sapiens
aauggaagaguguuucuucca

SEQ ID NO: 1215063 - RNA, 13 nt, Homo sapiens
aauggaagcaauu

SEQ ID NO: 1215064 - RNA, 15 nt, Homo sapiens
aauggaauacugaaa

SEQ ID NO: 1215065 - RNA, 16 nt, Homo sapiens
aauggacaaaauccau

SEQ ID NO: 1215066 - RNA, 19 nt, Homo sapiens
aauggacaaaauccaugaa

SEQ ID NO: 1215067 - RNA, 14 nt, Homo sapiens
aauggauacauggu

SEQ ID NO: 1215068 - RNA, 16 nt, Homo sapiens
aauggcagaaccaaag

SEQ ID NO: 1215069 - RNA, 23 nt, Homo sapiens
aauggcaucaaccaccauggauu

SEQ ID NO: 1215070 - RNA, 15 nt, Homo sapiens
aauggcaugcugaaa

SEQ ID NO: 1215071 - RNA, 20 nt, Homo sapiens
aauggcuaagauaccaaaac

SEQ ID NO: 1215072 - RNA, 14 nt, Homo sapiens
aaugggcacuggga

SEQ ID NO: 1215073 - RNA, 14 nt, Homo sapiens
aaugggcucuucca

SEQ ID NO: 1215074 - RNA, 15 nt, Homo sapiens
aauggggaauucucu

SEQ ID NO: 1215075 - RNA, 15 nt, Homo sapiens
aauggggaucacaga

SEQ ID NO: 1215076 - RNA, 20 nt, Homo sapiens
aaugggugauauccugaaaa

SEQ ID NO: 1215077 - RNA, 14 nt, Homo sapiens
aaugguagcauuua

SEQ ID NO: 1215078 - RNA, 14 nt, Homo sapiens
aauggucauccaaa

SEQ ID NO: 1215079 - RNA, 15 nt, Homo sapiens
aauggucauccaaac

SEQ ID NO: 1215080 - RNA, 15 nt, Homo sapiens
aauggugaauggauu

SEQ ID NO: 1215081 - RNA, 21 nt, Homo sapiens
aaugguuucaaguuauucaaa

SEQ ID NO: 1215082 - RNA, 15 nt, Homo sapiens
aauguaacugugcca

SEQ ID NO: 1215083 - RNA, 17 nt, Homo sapiens
aauguaagagaaauuaa

SEQ ID NO: 1215084 - RNA, 15 nt, Homo sapiens
aauguaaucauuccu

SEQ ID NO: 1215085 - RNA, 18 nt, Homo sapiens
aauguacaauaaagcaau

SEQ ID NO: 1215086 - RNA, 16 nt, Homo sapiens
aauguacaugucaaua

SEQ ID NO: 1215087 - RNA, 17 nt, Homo sapiens
aauguacaugucaauaa

SEQ ID NO: 1215088 - RNA, 15 nt, Homo sapiens
aauguacauuuauuc

SEQ ID NO: 1215089 - RNA, 14 nt, Homo sapiens
aauguaggacugua

SEQ ID NO: 1215090 - RNA, 16 nt, Homo sapiens
aauguaggcuuucaug

SEQ ID NO: 1215091 - RNA, 23 nt, Homo sapiens
aauguaugugcacugucacuuug

SEQ ID NO: 1215092 - RNA, 14 nt, Homo sapiens
aauguaugugcucu

SEQ ID NO: 1215093 - RNA, 15 nt, Homo sapiens
aauguauuuguucau

SEQ ID NO: 1215094 - RNA, 14 nt, Homo sapiens
aaugucauagguaa

SEQ ID NO: 1215095 - RNA, 19 nt, Homo sapiens
aaugucauuaaacaugaca

SEQ ID NO: 1215096 - RNA, 15 nt, Homo sapiens
aaugucucacuguuc

SEQ ID NO: 1215097 - RNA, 19 nt, Homo sapiens
aaugucuccuuugcucuug

SEQ ID NO: 1215098 - RNA, 22 nt, Homo sapiens
aaugucuggagugguaacagcu

SEQ ID NO: 1215099 - RNA, 17 nt, Homo sapiens
aaugucuguaccuugau

SEQ ID NO: 1215100 - RNA, 17 nt, Homo sapiens
aaugucuuacugugauc

SEQ ID NO: 1215101 - RNA, 21 nt, Homo sapiens
aaugucuuuugaauauuccca

SEQ ID NO: 1215102 - RNA, 14 nt, Homo sapiens
aaugugaacacugg

SEQ ID NO: 1215103 - RNA, 19 nt, Homo sapiens
aaugugaagacaaguagua

SEQ ID NO: 1215104 - RNA, 16 nt, Homo sapiens
aaugugaaggcccaag

SEQ ID NO: 1215105 - RNA, 18 nt, Homo sapiens
aaugugguuacuuccuac

SEQ ID NO: 1215106 - RNA, 12 nt, Homo sapiens
aaugugucacua

SEQ ID NO: 1215107 - RNA, 23 nt, Homo sapiens
aauguguccuaucuaucuuccaa

SEQ ID NO: 1215108 - RNA, 16 nt, Homo sapiens
aauguuaaagggauau

SEQ ID NO: 1215109 - RNA, 19 nt, Homo sapiens
aauguuaaggaaacucuua

SEQ ID NO: 1215110 - RNA, 14 nt, Homo sapiens
aauguuaauguuau

SEQ ID NO: 1215111 - RNA, 16 nt, Homo sapiens
aauguuacaguaacaa

SEQ ID NO: 1215112 - RNA, 15 nt, Homo sapiens
aauguuacauuauua

SEQ ID NO: 1215113 - RNA, 16 nt, Homo sapiens
aauguuacauuauuau

SEQ ID NO: 1215114 - RNA, 18 nt, Homo sapiens
aauguuacauuauuauca

SEQ ID NO: 1215115 - RNA, 19 nt, Homo sapiens
aauguuagauauugcuacu

SEQ ID NO: 1215116 - RNA, 23 nt, Homo sapiens
aauguuagauauugcuacuauaa

SEQ ID NO: 1215117 - RNA, 18 nt, Homo sapiens
aauguuagucauuguuau

SEQ ID NO: 1215118 - RNA, 16 nt, Homo sapiens
aauguucuaacagauc

SEQ ID NO: 1215119 - RNA, 20 nt, Homo sapiens
aauguucuuugucucaaaau

SEQ ID NO: 1215120 - RNA, 15 nt, Homo sapiens
aauguugaauacuua

SEQ ID NO: 1215121 - RNA, 15 nt, Homo sapiens
aauguugcaauguga

SEQ ID NO: 1215122 - RNA, 12 nt, Homo sapiens
aauguugccagc

SEQ ID NO: 1215123 - RNA, 19 nt, Homo sapiens
aauguuuaagauaaacaga

SEQ ID NO: 1215124 - RNA, 21 nt, Homo sapiens
aauguuuauuaaaugcuucau

SEQ ID NO: 1215125 - RNA, 13 nt, Homo sapiens
aauguuugucuca

SEQ ID NO: 1215126 - RNA, 19 nt, Homo sapiens
aauguuuuccccaaaccau

SEQ ID NO: 1215127 - RNA, 16 nt, Homo sapiens
aauuaaacuuccaaag

SEQ ID NO: 1215128 - RNA, 17 nt, Homo sapiens
aauuaaaugccuuguau

SEQ ID NO: 1215129 - RNA, 23 nt, Homo sapiens
aauuaaccauuuuaaaguaaaca

SEQ ID NO: 1215130 - RNA, 13 nt, Homo sapiens
aauuaacuuuaca

SEQ ID NO: 1215131 - RNA, 22 nt, Homo sapiens
aauuaaguuuuggguaagugug

SEQ ID NO: 1215132 - RNA, 21 nt, Homo sapiens
aauuaaucacccuaccaacuu

SEQ ID NO: 1215133 - RNA, 19 nt, Homo sapiens
aauuacagggugacucaca

SEQ ID NO: 1215134 - RNA, 19 nt, Homo sapiens
aauuacauuucacuucaag

SEQ ID NO: 1215135 - RNA, 15 nt, Homo sapiens
aagaguauguuguaa

SEQ ID NO: 1215136 - RNA, 13 nt, Homo sapiens
aagaguccaagaa

SEQ ID NO: 1215137 - RNA, 17 nt, Homo sapiens
aagaguccuuguuccag

SEQ ID NO: 1215138 - RNA, 12 nt, Homo sapiens
aagagugaauuu

SEQ ID NO: 1215139 - RNA, 19 nt, Homo sapiens
aagagugccguaacaacug

SEQ ID NO: 1215140 - RNA, 21 nt, Homo sapiens
aagaguucaagaccagccugg

SEQ ID NO: 1215141 - RNA, 14 nt, Homo sapiens
aagaguucuggaaa

SEQ ID NO: 1215142 - RNA, 18 nt, Homo sapiens
aagauaaauucaugcacu

SEQ ID NO: 1215143 - RNA, 12 nt, Homo sapiens
aagauaagaguu

SEQ ID NO: 1215144 - RNA, 15 nt, Homo sapiens
aagauacaaguuuca

SEQ ID NO: 1215145 - RNA, 18 nt, Homo sapiens
aagauaguugauucuugc

SEQ ID NO: 1215146 - RNA, 22 nt, Homo sapiens
aagauauggagaauugcugaag

SEQ ID NO: 1215147 - RNA, 23 nt, Homo sapiens
aagaucaaaagcuuauucaucug

SEQ ID NO: 1215148 - RNA, 19 nt, Homo sapiens
aagaucaacgccucacuga

SEQ ID NO: 1215149 - RNA, 20 nt, Homo sapiens
aagauccaagaggcccugca

SEQ ID NO: 1215150 - RNA, 20 nt, Homo sapiens
aagauccaccuccccacugc

SEQ ID NO: 1215151 - RNA, 18 nt, Homo sapiens
aagauccgagucuaccca

SEQ ID NO: 1215152 - RNA, 22 nt, Homo sapiens
aagauccuagauccuaaggguc

SEQ ID NO: 1215153 - RNA, 18 nt, Homo sapiens
aagauccuccugcugcag

SEQ ID NO: 1215154 - RNA, 14 nt, Homo sapiens
aagaucgcaccauu

SEQ ID NO: 1215155 - RNA, 15 nt, Homo sapiens
aagaucuguuuugaa

SEQ ID NO: 1215156 - RNA, 20 nt, Homo sapiens
aagaucuguuuugaaggcaa

SEQ ID NO: 1215157 - RNA, 19 nt, Homo sapiens
aagaugacggaugccuaga

SEQ ID NO: 1215158 - RNA, 17 nt, Homo sapiens
aagaugaucauuugccc

SEQ ID NO: 1215159 - RNA, 15 nt, Homo sapiens
aagaugcuaguucau

SEQ ID NO: 1215160 - RNA, 17 nt, Homo sapiens
aagauggaaaucacauu

SEQ ID NO: 1215161 - RNA, 12 nt, Homo sapiens
aagauggcauaa

SEQ ID NO: 1215162 - RNA, 19 nt, Homo sapiens
aagauggcauuucaccaug

SEQ ID NO: 1215163 - RNA, 21 nt, Homo sapiens
aagauggcugugccucugccu

SEQ ID NO: 1215164 - RNA, 18 nt, Homo sapiens
aagauggcuuuuucuccu

SEQ ID NO: 1215165 - RNA, 17 nt, Homo sapiens
aagauguucacuguggc

SEQ ID NO: 1215166 - RNA, 16 nt, Homo sapiens
aagauguuguuuuagg

SEQ ID NO: 1215167 - RNA, 18 nt, Homo sapiens
aagauguuucaaaaaauc

SEQ ID NO: 1215168 - RNA, 20 nt, Homo sapiens
aagauuauagaaguagcaaa

SEQ ID NO: 1215169 - RNA, 21 nt, Homo sapiens
aagauuauagauucuaaagau

SEQ ID NO: 1215170 - RNA, 15 nt, Homo sapiens
aagauuauuugcacg

SEQ ID NO: 1215171 - RNA, 23 nt, Homo sapiens
aagauuccugguuaaauuugaau

SEQ ID NO: 1215172 - RNA, 13 nt, Homo sapiens
aagauugauacuu

SEQ ID NO: 1215173 - RNA, 17 nt, Homo sapiens
aagauugauuaaugaac

SEQ ID NO: 1215174 - RNA, 19 nt, Homo sapiens
aagauugauuaaugaacua

SEQ ID NO: 1215175 - RNA, 14 nt, Homo sapiens
aagauuguugauag

SEQ ID NO: 1215176 - RNA, 19 nt, Homo sapiens
aagauuuaugaugcacuua

SEQ ID NO: 1215177 - RNA, 13 nt, Homo sapiens
aagauuugcccau

SEQ ID NO: 1215178 - RNA, 17 nt, Homo sapiens
aagauuugugaacugga

SEQ ID NO: 1215179 - RNA, 16 nt, Homo sapiens
aagauuuuaugcugcu

SEQ ID NO: 1215180 - RNA, 23 nt, Homo sapiens
aagauuuuccauuguauccucuu

SEQ ID NO: 1215181 - RNA, 16 nt, Homo sapiens
aagauuuuccucuugu

SEQ ID NO: 1215182 - RNA, 20 nt, Homo sapiens
aagcaaacaaauauugccaa

SEQ ID NO: 1215183 - RNA, 22 nt, Homo sapiens
aagcaaacacuuacagaauuau

SEQ ID NO: 1215184 - RNA, 22 nt, Homo sapiens
aagcaacauggcuuugaugaua

SEQ ID NO: 1215185 - RNA, 14 nt, Homo sapiens
aagcaacuguuaug

SEQ ID NO: 1215186 - RNA, 19 nt, Homo sapiens
aagcaacuguuaugaaaua

SEQ ID NO: 1215187 - RNA, 11 nt, Homo sapiens
aagcaaggaaa

SEQ ID NO: 1215188 - RNA, 14 nt, Homo sapiens
aagcaagggcucca

SEQ ID NO: 1215189 - RNA, 19 nt, Homo sapiens
aagcaauaauggucccauc

SEQ ID NO: 1215190 - RNA, 12 nt, Homo sapiens
aagcaauguggu

SEQ ID NO: 1215191 - RNA, 18 nt, Homo sapiens
aagcaauuucuugcucua

SEQ ID NO: 1215192 - RNA, 23 nt, Homo sapiens
aagcacaaucacuaaacuuuauu

SEQ ID NO: 1215193 - RNA, 18 nt, Homo sapiens
aagcacagaauuugucag

SEQ ID NO: 1215194 - RNA, 14 nt, Homo sapiens
aagcacagcccuua

SEQ ID NO: 1215195 - RNA, 19 nt, Homo sapiens
aagcacaggagaacaugcu

SEQ ID NO: 1215196 - RNA, 22 nt, Homo sapiens
aagcacaucuuugaccacguca

SEQ ID NO: 1215197 - RNA, 13 nt, Homo sapiens
aagcacauguaau

SEQ ID NO: 1215198 - RNA, 14 nt, Homo sapiens
aagcacuacaccuu

SEQ ID NO: 1215199 - RNA, 19 nt, Homo sapiens
aagcacuacaccuugccuu

SEQ ID NO: 1215200 - RNA, 19 nt, Homo sapiens
aagcacuacauaaacugac

SEQ ID NO: 1215201 - RNA, 22 nt, Homo sapiens
aagcacuauuaauacucugcag

SEQ ID NO: 1215202 - RNA, 17 nt, Homo sapiens
aagcacuuugcacuuaa

SEQ ID NO: 1215203 - RNA, 12 nt, Homo sapiens
aagcacuuugug

SEQ ID NO: 1215204 - RNA, 16 nt, Homo sapiens
aagcacuuugugcugu

SEQ ID NO: 1215205 - RNA, 22 nt, Homo sapiens
aagcagaauucugcauggugac

SEQ ID NO: 1215206 - RNA, 22 nt, Homo sapiens
aagcagcaucuucugguuuaaa

SEQ ID NO: 1215207 - RNA, 15 nt, Homo sapiens
aagcagcucaagaac

SEQ ID NO: 1215208 - RNA, 21 nt, Homo sapiens
aagcaggcuugcccaguacau

SEQ ID NO: 1215209 - RNA, 15 nt, Homo sapiens
aagcaggguacccuu

SEQ ID NO: 1215210 - RNA, 18 nt, Homo sapiens
aagcagugccuuccauaa

SEQ ID NO: 1215211 - RNA, 16 nt, Homo sapiens
aagcaguuacuaauau

SEQ ID NO: 1215212 - RNA, 18 nt, Homo sapiens
aagcauacaaagcaguuu

SEQ ID NO: 1215213 - RNA, 12 nt, Homo sapiens
aagcauacuuug

SEQ ID NO: 1215214 - RNA, 13 nt, Homo sapiens
aagcaucagagau

SEQ ID NO: 1215215 - RNA, 21 nt, Homo sapiens
aagcauuccuucuuugauaau

SEQ ID NO: 1215216 - RNA, 13 nt, Homo sapiens
aagcauucuucaa

SEQ ID NO: 1215217 - RNA, 13 nt, Homo sapiens
aagcauucuuuaa

SEQ ID NO: 1215218 - RNA, 15 nt, Homo sapiens
aagcauucuuuaaca

SEQ ID NO: 1215219 - RNA, 21 nt, Homo sapiens
aagcauuugcaacagcuacag

SEQ ID NO: 1215220 - RNA, 15 nt, Homo sapiens
aagcauuuguagcaa

SEQ ID NO: 1215221 - RNA, 16 nt, Homo sapiens
aagcauuuucauuucu

SEQ ID NO: 1215222 - RNA, 11 nt, Homo sapiens
aagccaaagaa

SEQ ID NO: 1215223 - RNA, 23 nt, Homo sapiens
aagccaaagaaaaauaacccuuu

SEQ ID NO: 1215224 - RNA, 16 nt, Homo sapiens
aagccaaagaaaugaa

SEQ ID NO: 1215225 - RNA, 21 nt, Homo sapiens
aagccaacaucuggaucaaug

SEQ ID NO: 1215226 - RNA, 18 nt, Homo sapiens
aagccaauaaaugaacug

SEQ ID NO: 1215227 - RNA, 19 nt, Homo sapiens
aagccacccuaccaugaau

SEQ ID NO: 1215228 - RNA, 18 nt, Homo sapiens
aagccacgaggugcagua

SEQ ID NO: 1215229 - RNA, 20 nt, Homo sapiens
aagccacucugucccuuccu

SEQ ID NO: 1215230 - RNA, 15 nt, Homo sapiens
aagccagaccagaag

SEQ ID NO: 1215231 - RNA, 20 nt, Homo sapiens
aagccagcugcagcugggcu

SEQ ID NO: 1215232 - RNA, 21 nt, Homo sapiens
aagccagcugcagcugggcug

SEQ ID NO: 1215233 - RNA, 21 nt, Homo sapiens
aagcccaaguucaugcagcug

SEQ ID NO: 1215234 - RNA, 18 nt, Homo sapiens
aagccccauuuccucaca

SEQ ID NO: 1215235 - RNA, 16 nt, Homo sapiens
aagcccuccaaaagca

SEQ ID NO: 1215236 - RNA, 18 nt, Homo sapiens
aagcccuccccaucccau

SEQ ID NO: 1215237 - RNA, 13 nt, Homo sapiens
aagccgagcucuc

SEQ ID NO: 1215238 - RNA, 15 nt, Homo sapiens
aagccuaccaaugua

SEQ ID NO: 1215239 - RNA, 13 nt, Homo sapiens
aagccucagcucc

SEQ ID NO: 1215240 - RNA, 12 nt, Homo sapiens
aagccuccucau

SEQ ID NO: 1215241 - RNA, 21 nt, Homo sapiens
aagccucguuuugaugccauu

SEQ ID NO: 1215242 - RNA, 22 nt, Homo sapiens
aacuuuccucgccugacaacca

SEQ ID NO: 1215243 - RNA, 20 nt, Homo sapiens
aacuuuggaguccccucacc

SEQ ID NO: 1215244 - RNA, 19 nt, Homo sapiens
aacuuuggugaacaguuuu

SEQ ID NO: 1215245 - RNA, 19 nt, Homo sapiens
aacuuuguggaugucuucc

SEQ ID NO: 1215246 - RNA, 16 nt, Homo sapiens
aacuuuucgacauauu

SEQ ID NO: 1215247 - RNA, 18 nt, Homo sapiens
aacuuuuuugaggccuuu

SEQ ID NO: 1215248 - RNA, 16 nt, Homo sapiens
aagaaaaaaacuuacu

SEQ ID NO: 1215249 - RNA, 14 nt, Homo sapiens
aagaaaaaguacaa

SEQ ID NO: 1215250 - RNA, 16 nt, Homo sapiens
aagaaaaccauuuuag

SEQ ID NO: 1215251 - RNA, 14 nt, Homo sapiens
aagaaaacuuccau

SEQ ID NO: 1215252 - RNA, 13 nt, Homo sapiens
aagaaaaggacaa

SEQ ID NO: 1215253 - RNA, 20 nt, Homo sapiens
aagaaaauccuaacuuucag

SEQ ID NO: 1215254 - RNA, 21 nt, Homo sapiens
aagaaagacucuauucucaaa

SEQ ID NO: 1215255 - RNA, 15 nt, Homo sapiens
aagaaagaucaaaga

SEQ ID NO: 1215256 - RNA, 16 nt, Homo sapiens
aagaaagaucaaagac

SEQ ID NO: 1215257 - RNA, 14 nt, Homo sapiens
aagaaagcugagaa

SEQ ID NO: 1215258 - RNA, 17 nt, Homo sapiens
aagaaagguuaaggagu

SEQ ID NO: 1215259 - RNA, 17 nt, Homo sapiens
aagaaaguguuggcuaa

SEQ ID NO: 1215260 - RNA, 14 nt, Homo sapiens
aagaaauaccuuga

SEQ ID NO: 1215261 - RNA, 13 nt, Homo sapiens
aagaaaucaaaga

SEQ ID NO: 1215262 - RNA, 12 nt, Homo sapiens
aagaaaucuggu

SEQ ID NO: 1215263 - RNA, 17 nt, Homo sapiens
aagaaaugcccaaaaga

SEQ ID NO: 1215264 - RNA, 18 nt, Homo sapiens
aagaaauguauuccugaa

SEQ ID NO: 1215265 - RNA, 22 nt, Homo sapiens
aagaaauuccuuccuuaccuga

SEQ ID NO: 1215266 - RNA, 18 nt, Homo sapiens
aagaacaacugccaagaa

SEQ ID NO: 1215267 - RNA, 14 nt, Homo sapiens
aagaacacaugugc

SEQ ID NO: 1215268 - RNA, 18 nt, Homo sapiens
aagaacacuacugcuaaa

SEQ ID NO: 1215269 - RNA, 18 nt, Homo sapiens
aagaacauggacuuguau

SEQ ID NO: 1215270 - RNA, 22 nt, Homo sapiens
aagaaccagagaggcucugaga

SEQ ID NO: 1215271 - RNA, 14 nt, Homo sapiens
aagaacucucugga

SEQ ID NO: 1215272 - RNA, 20 nt, Homo sapiens
aagaacugaaggcauaugca

SEQ ID NO: 1215273 - RNA, 20 nt, Homo sapiens
aagaacugucuauuuucuca

SEQ ID NO: 1215274 - RNA, 21 nt, Homo sapiens
aagaacuuggcacacucucca

SEQ ID NO: 1215275 - RNA, 12 nt, Homo sapiens
aagaagaaagca

SEQ ID NO: 1215276 - RNA, 12 nt, Homo sapiens
aagaagacauga

SEQ ID NO: 1215277 - RNA, 11 nt, Homo sapiens
aagaagacauu

SEQ ID NO: 1215278 - RNA, 20 nt, Homo sapiens
aagaagcagucaauuuucac

SEQ ID NO: 1215279 - RNA, 23 nt, Homo sapiens
aagaagccacccuccuugcagga

SEQ ID NO: 1215280 - RNA, 17 nt, Homo sapiens
aagaagcccauaucaca

SEQ ID NO: 1215281 - RNA, 14 nt, Homo sapiens
aagaagcgagaugu

SEQ ID NO: 1215282 - RNA, 15 nt, Homo sapiens
aagaagcuaugucaa

SEQ ID NO: 1215283 - RNA, 21 nt, Homo sapiens
aagaaggacaaggauguucac

SEQ ID NO: 1215284 - RNA, 12 nt, Homo sapiens
aagaaggggcca

SEQ ID NO: 1215285 - RNA, 11 nt, Homo sapiens
aagaaggguug

SEQ ID NO: 1215286 - RNA, 17 nt, Homo sapiens
aagaaguguugauugcc

SEQ ID NO: 1215287 - RNA, 20 nt, Homo sapiens
aagaaguuguuugaggcaaa

SEQ ID NO: 1215288 - RNA, 19 nt, Homo sapiens
aagaaguuuuguucugucc

SEQ ID NO: 1215289 - RNA, 21 nt, Homo sapiens
aagaauaaaauugcacuuuua

SEQ ID NO: 1215290 - RNA, 21 nt, Homo sapiens
aagaaucagaaacaggugcau

SEQ ID NO: 1215291 - RNA, 18 nt, Homo sapiens
aagaaucuaaaccuuaca

SEQ ID NO: 1215292 - RNA, 21 nt, Homo sapiens
aagaaucuaaaccuuacaugu

SEQ ID NO: 1215293 - RNA, 17 nt, Homo sapiens
aagaaugagacugaacu

SEQ ID NO: 1215294 - RNA, 22 nt, Homo sapiens
aagaaugaucagcaucugugau

SEQ ID NO: 1215295 - RNA, 18 nt, Homo sapiens
aagaaugcaaccuaguca

SEQ ID NO: 1215296 - RNA, 11 nt, Homo sapiens
aagaauggaga

SEQ ID NO: 1215297 - RNA, 18 nt, Homo sapiens
aagaauggggaucacaga

SEQ ID NO: 1215298 - RNA, 21 nt, Homo sapiens
aagaauggggaucacagagac

SEQ ID NO: 1215299 - RNA, 20 nt, Homo sapiens
aagaaugucuguaccuugau

SEQ ID NO: 1215300 - RNA, 14 nt, Homo sapiens
aagaauuacaguac

SEQ ID NO: 1215301 - RNA, 23 nt, Homo sapiens
aagaauuagaucgguucugugcc

SEQ ID NO: 1215302 - RNA, 11 nt, Homo sapiens
aagaauucugu

SEQ ID NO: 1215303 - RNA, 18 nt, Homo sapiens
aagaauucuguacuucca

SEQ ID NO: 1215304 - RNA, 14 nt, Homo sapiens
aagaauucuuccac

SEQ ID NO: 1215305 - RNA, 22 nt, Homo sapiens
aagaauuggggauucucuauug

SEQ ID NO: 1215306 - RNA, 21 nt, Homo sapiens
aagacaaaauaaacauuuuau

SEQ ID NO: 1215307 - RNA, 13 nt, Homo sapiens
aagacaaaccaag

SEQ ID NO: 1215308 - RNA, 13 nt, Homo sapiens
aagacaaaugaca

SEQ ID NO: 1215309 - RNA, 15 nt, Homo sapiens
aagacaaccaucaca

SEQ ID NO: 1215310 - RNA, 14 nt, Homo sapiens
aagacaccauuuau

SEQ ID NO: 1215311 - RNA, 16 nt, Homo sapiens
aagacagaugccccag

SEQ ID NO: 1215312 - RNA, 19 nt, Homo sapiens
aagacagggaagagcagaa

SEQ ID NO: 1215313 - RNA, 22 nt, Homo sapiens
aagacagugccuauacugccuc

SEQ ID NO: 1215314 - RNA, 15 nt, Homo sapiens
aagacaucagucucc

SEQ ID NO: 1215315 - RNA, 20 nt, Homo sapiens
aagacaugauuuccuugaau

SEQ ID NO: 1215316 - RNA, 15 nt, Homo sapiens
aagacaugcagcuuu

SEQ ID NO: 1215317 - RNA, 14 nt, Homo sapiens
aagacauucuucca

SEQ ID NO: 1215318 - RNA, 11 nt, Homo sapiens
aagacauuucu

SEQ ID NO: 1215319 - RNA, 16 nt, Homo sapiens
aagaccagcuuugcag

SEQ ID NO: 1215320 - RNA, 20 nt, Homo sapiens
aagaccggcugguggagcug

SEQ ID NO: 1215321 - RNA, 22 nt, Homo sapiens
aagaccuaccuccagacuucaa

SEQ ID NO: 1215322 - RNA, 23 nt, Homo sapiens
aagacguaauaaaauuaacuggu

SEQ ID NO: 1215323 - RNA, 21 nt, Homo sapiens
aagacuccucugggccugggg

SEQ ID NO: 1215324 - RNA, 22 nt, Homo sapiens
aagacucuacccauauuacaga

SEQ ID NO: 1215325 - RNA, 16 nt, Homo sapiens
aagacucuauucucaa

SEQ ID NO: 1215326 - RNA, 17 nt, Homo sapiens
aagacucugaccagaga

SEQ ID NO: 1215327 - RNA, 21 nt, Homo sapiens
aagacuggaagcuaauuugca

SEQ ID NO: 1215328 - RNA, 23 nt, Homo sapiens
aagacuggacauuuaacuuuucu

SEQ ID NO: 1215329 - RNA, 18 nt, Homo sapiens
aagacugggugaggauaa

SEQ ID NO: 1215330 - RNA, 15 nt, Homo sapiens
aagacuguugcucaa

SEQ ID NO: 1215331 - RNA, 13 nt, Homo sapiens
aagacuugugcau

SEQ ID NO: 1215332 - RNA, 16 nt, Homo sapiens
aagacuuuauguaguu

SEQ ID NO: 1215333 - RNA, 15 nt, Homo sapiens
aagacuuugauccag

SEQ ID NO: 1215334 - RNA, 16 nt, Homo sapiens
aagacuuuuauuaaua

SEQ ID NO: 1215335 - RNA, 21 nt, Homo sapiens
aagagaacucgcgcucaguaa

SEQ ID NO: 1215336 - RNA, 20 nt, Homo sapiens
aagagacaggagacaugagu

SEQ ID NO: 1215337 - RNA, 21 nt, Homo sapiens
aagagagaaagaaguaggcau

SEQ ID NO: 1215338 - RNA, 21 nt, Homo sapiens
aagagaggaaugccuguguga

SEQ ID NO: 1215339 - RNA, 17 nt, Homo sapiens
aagagagucgcaucuca

SEQ ID NO: 1215340 - RNA, 18 nt, Homo sapiens
aagagauuguuguuugcc

SEQ ID NO: 1215341 - RNA, 20 nt, Homo sapiens
aagagauuuaucuuuauaca

SEQ ID NO: 1215342 - RNA, 21 nt, Homo sapiens
aagagauuucaacauaucauu

SEQ ID NO: 1215343 - RNA, 22 nt, Homo sapiens
aacgggcugcccucagcucaca

SEQ ID NO: 1215344 - RNA, 20 nt, Homo sapiens
aacggguagcagcagaugua

SEQ ID NO: 1215345 - RNA, 20 nt, Homo sapiens
aacguguuaaagguuuucuc

SEQ ID NO: 1215346 - RNA, 21 nt, Homo sapiens
aacguucgauuucuaccucag

SEQ ID NO: 1215347 - RNA, 22 nt, Homo sapiens
aacguuuacuuaucuuaugcca

SEQ ID NO: 1215348 - RNA, 22 nt, Homo sapiens
aacuaaagccaaggguauccaa

SEQ ID NO: 1215349 - RNA, 21 nt, Homo sapiens
aacuaagaaaauucuauguua

SEQ ID NO: 1215350 - RNA, 19 nt, Homo sapiens
aacuaagaaauaugcacaa

SEQ ID NO: 1215351 - RNA, 17 nt, Homo sapiens
aacuaauaaaagcauaa

SEQ ID NO: 1215352 - RNA, 22 nt, Homo sapiens
aacuaauaaaagcauaaaugca

SEQ ID NO: 1215353 - RNA, 20 nt, Homo sapiens
aacuacaacgaacacaagaa

SEQ ID NO: 1215354 - RNA, 20 nt, Homo sapiens
aacuacacaaauuauaagca

SEQ ID NO: 1215355 - RNA, 16 nt, Homo sapiens
aacuacagacuaaaga

SEQ ID NO: 1215356 - RNA, 23 nt, Homo sapiens
aacuacucagccuagcacaggcu

SEQ ID NO: 1215357 - RNA, 17 nt, Homo sapiens
aacuagaauuuauucaa

SEQ ID NO: 1215358 - RNA, 12 nt, Homo sapiens
aacuagccaaac

SEQ ID NO: 1215359 - RNA, 14 nt, Homo sapiens
aacuagccaaucag

SEQ ID NO: 1215360 - RNA, 15 nt, Homo sapiens
aacuaggaaaaucac

SEQ ID NO: 1215361 - RNA, 21 nt, Homo sapiens
aacuaggaaaaucacuugcca

SEQ ID NO: 1215362 - RNA, 16 nt, Homo sapiens
aacuagugaaauguuc

SEQ ID NO: 1215363 - RNA, 20 nt, Homo sapiens
aacuauaaauauguacaauu

SEQ ID NO: 1215364 - RNA, 14 nt, Homo sapiens
aacuaugacagaua

SEQ ID NO: 1215365 - RNA, 21 nt, Homo sapiens
aacuaugucgaugcacaguau

SEQ ID NO: 1215366 - RNA, 16 nt, Homo sapiens
aacuauuguuaauucu

SEQ ID NO: 1215367 - RNA, 10 nt, Homo sapiens
aacuauuuau

SEQ ID NO: 1215368 - RNA, 19 nt, Homo sapiens
aacucaaaaauauuugcug

SEQ ID NO: 1215369 - RNA, 20 nt, Homo sapiens
aacucaaauacacauuugcu

SEQ ID NO: 1215370 - RNA, 13 nt, Homo sapiens
aacucacacuccc

SEQ ID NO: 1215371 - RNA, 20 nt, Homo sapiens
aacucaccagccccacugcc

SEQ ID NO: 1215372 - RNA, 14 nt, Homo sapiens
aacucacugugauc

SEQ ID NO: 1215373 - RNA, 23 nt, Homo sapiens
aacucagaauauugucugccuua

SEQ ID NO: 1215374 - RNA, 20 nt, Homo sapiens
aacucagcgugaguuacccu

SEQ ID NO: 1215375 - RNA, 19 nt, Homo sapiens
aacucagcuguccagcugc

SEQ ID NO: 1215376 - RNA, 10 nt, Homo sapiens
aacucaggga

SEQ ID NO: 1215377 - RNA, 20 nt, Homo sapiens
aacucagggacagagccaug

SEQ ID NO: 1215378 - RNA, 11 nt, Homo sapiens
aacucagggag

SEQ ID NO: 1215379 - RNA, 18 nt, Homo sapiens
aacucauuacuuuuccau

SEQ ID NO: 1215380 - RNA, 19 nt, Homo sapiens
aacuccaaaguccacacaa

SEQ ID NO: 1215381 - RNA, 11 nt, Homo sapiens
aacuccaucuc

SEQ ID NO: 1215382 - RNA, 23 nt, Homo sapiens
aacuccccuguuucaaucacugu

SEQ ID NO: 1215383 - RNA, 17 nt, Homo sapiens
aacuccuagcugacuca

SEQ ID NO: 1215384 - RNA, 15 nt, Homo sapiens
aacuccuaguacuua

SEQ ID NO: 1215385 - RNA, 16 nt, Homo sapiens
aacuccuauaauuccc

SEQ ID NO: 1215386 - RNA, 19 nt, Homo sapiens
aacuccugaccucagguga

SEQ ID NO: 1215387 - RNA, 11 nt, Homo sapiens
aacuccugacu

SEQ ID NO: 1215388 - RNA, 13 nt, Homo sapiens
aacuccugagaaa

SEQ ID NO: 1215389 - RNA, 16 nt, Homo sapiens
aacucuacaucuagca

SEQ ID NO: 1215390 - RNA, 20 nt, Homo sapiens
aacucuacccuggcacuaua

SEQ ID NO: 1215391 - RNA, 21 nt, Homo sapiens
aacucuccaauguucuauuaa

SEQ ID NO: 1215392 - RNA, 16 nt, Homo sapiens
aacucucuaaacuggu

SEQ ID NO: 1215393 - RNA, 14 nt, Homo sapiens
aacucugacaaggg

SEQ ID NO: 1215394 - RNA, 22 nt, Homo sapiens
aacucugacaagggcugaccug

SEQ ID NO: 1215395 - RNA, 18 nt, Homo sapiens
aacucugagaucuaagga

SEQ ID NO: 1215396 - RNA, 15 nt, Homo sapiens
aacucugcacuacuc

SEQ ID NO: 1215397 - RNA, 16 nt, Homo sapiens
aacucugccagccaca

SEQ ID NO: 1215398 - RNA, 17 nt, Homo sapiens
aacucugggcugccaug

SEQ ID NO: 1215399 - RNA, 13 nt, Homo sapiens
aacucuuaucuca

SEQ ID NO: 1215400 - RNA, 16 nt, Homo sapiens
aacucuugaccucagg

SEQ ID NO: 1215401 - RNA, 20 nt, Homo sapiens
aacucuuucuggccugccuu

SEQ ID NO: 1215402 - RNA, 18 nt, Homo sapiens
aacugaaacaaaugcucc

SEQ ID NO: 1215403 - RNA, 17 nt, Homo sapiens
aacugaacgacaaagca

SEQ ID NO: 1215404 - RNA, 10 nt, Homo sapiens
aacugacaca

SEQ ID NO: 1215405 - RNA, 14 nt, Homo sapiens
aacugacacaggaa

SEQ ID NO: 1215406 - RNA, 23 nt, Homo sapiens
aacugacaugauuagcagaagaa

SEQ ID NO: 1215407 - RNA, 20 nt, Homo sapiens
aacugaccagccuccaugcu

SEQ ID NO: 1215408 - RNA, 13 nt, Homo sapiens
aacugacugccuu

SEQ ID NO: 1215409 - RNA, 18 nt, Homo sapiens
aacugagauuacaggcac

SEQ ID NO: 1215410 - RNA, 20 nt, Homo sapiens
aacugaguguuauuugcaca

SEQ ID NO: 1215411 - RNA, 18 nt, Homo sapiens
aacugauuuuuagcuuua

SEQ ID NO: 1215412 - RNA, 19 nt, Homo sapiens
aacugcaauaacuucugac

SEQ ID NO: 1215413 - RNA, 21 nt, Homo sapiens
aacugcauggaccuaacauuc

SEQ ID NO: 1215414 - RNA, 19 nt, Homo sapiens
aacugccucgaaacacaga

SEQ ID NO: 1215415 - RNA, 18 nt, Homo sapiens
aacugcugcugugcacau

SEQ ID NO: 1215416 - RNA, 22 nt, Homo sapiens
aacugcugcuuuuugagguggc

SEQ ID NO: 1215417 - RNA, 21 nt, Homo sapiens
aacugcuggagucuggcuuua

SEQ ID NO: 1215418 - RNA, 20 nt, Homo sapiens
aacuggauugcagacuguuc

SEQ ID NO: 1215419 - RNA, 19 nt, Homo sapiens
aacuggccacgcacaggcu

SEQ ID NO: 1215420 - RNA, 13 nt, Homo sapiens
aacugguacaauu

SEQ ID NO: 1215421 - RNA, 14 nt, Homo sapiens
aacuguacauguga

SEQ ID NO: 1215422 - RNA, 13 nt, Homo sapiens
aacugucaaccua

SEQ ID NO: 1215423 - RNA, 20 nt, Homo sapiens
aacugucacucauugcugag

SEQ ID NO: 1215424 - RNA, 13 nt, Homo sapiens
aacuguccaccaa

SEQ ID NO: 1215425 - RNA, 10 nt, Homo sapiens
aacugugaac

SEQ ID NO: 1215426 - RNA, 17 nt, Homo sapiens
aacugugaagcauuuac

SEQ ID NO: 1215427 - RNA, 13 nt, Homo sapiens
aacugugccuugu

SEQ ID NO: 1215428 - RNA, 17 nt, Homo sapiens
aacugugcugaaugcuu

SEQ ID NO: 1215429 - RNA, 17 nt, Homo sapiens
aacuguuaacuaugaca

SEQ ID NO: 1215430 - RNA, 13 nt, Homo sapiens
aacuguuaccuaa

SEQ ID NO: 1215431 - RNA, 20 nt, Homo sapiens
aacuguugauugcaggaaua

SEQ ID NO: 1215432 - RNA, 17 nt, Homo sapiens
aacuuaaaaaaaugaca

SEQ ID NO: 1215433 - RNA, 13 nt, Homo sapiens
aacuuaacauuca

SEQ ID NO: 1215434 - RNA, 16 nt, Homo sapiens
aacuuaauaguauuua

SEQ ID NO: 1215435 - RNA, 14 nt, Homo sapiens
aacuuagaaaggga

SEQ ID NO: 1215436 - RNA, 14 nt, Homo sapiens
aacuuagagaggua

SEQ ID NO: 1215437 - RNA, 20 nt, Homo sapiens
aacuuauguagauauuuggc

SEQ ID NO: 1215438 - RNA, 13 nt, Homo sapiens
aacuucaaagagg

SEQ ID NO: 1215439 - RNA, 15 nt, Homo sapiens
aacuucaauuuacuu

SEQ ID NO: 1215440 - RNA, 16 nt, Homo sapiens
aaugugaacacuggca

SEQ ID NO: 1215441 - RNA, 12 nt, Homo sapiens
aaugugaacuua

SEQ ID NO: 1215442 - RNA, 18 nt, Homo sapiens
aaugugaauagucaucuc

SEQ ID NO: 1215443 - RNA, 23 nt, Homo sapiens
aaugugauuacugcucuauucca

SEQ ID NO: 1215444 - RNA, 14 nt, Homo sapiens
aaugugcuaugaag

SEQ ID NO: 1215445 - RNA, 18 nt, Homo sapiens
aauguggacucaaucccu

SEQ ID NO: 1215446 - RNA, 21 nt, Homo sapiens
aauguggcuugaauguaggua

SEQ ID NO: 1215447 - RNA, 16 nt, Homo sapiens
aaugugguuacuuccu

SEQ ID NO: 1215448 - RNA, 23 nt, Homo sapiens
aaugugguuacuuccuacuguag

SEQ ID NO: 1215449 - RNA, 12 nt, Homo sapiens
aauguguacaaa

SEQ ID NO: 1215450 - RNA, 15 nt, Homo sapiens
aauguguucuuaacu

SEQ ID NO: 1215451 - RNA, 22 nt, Homo sapiens
aauguuauuuuuuaauuauuau

SEQ ID NO: 1215452 - RNA, 23 nt, Homo sapiens
aauguucaguccaacaaaccaca

SEQ ID NO: 1215453 - RNA, 21 nt, Homo sapiens
aauguucauuguaauguuacu

SEQ ID NO: 1215454 - RNA, 12 nt, Homo sapiens
aauguuccuccc

SEQ ID NO: 1215455 - RNA, 22 nt, Homo sapiens
aauguucuguuugcuguggaac

SEQ ID NO: 1215456 - RNA, 18 nt, Homo sapiens
aauguugcaacacauuca

SEQ ID NO: 1215457 - RNA, 18 nt, Homo sapiens
aauguuuacaugucaaga

SEQ ID NO: 1215458 - RNA, 15 nt, Homo sapiens
aauguuuaccagugu

SEQ ID NO: 1215459 - RNA, 23 nt, Homo sapiens
aauguuuccaaccuggaguauaa

SEQ ID NO: 1215460 - RNA, 19 nt, Homo sapiens
aauguuugaaauaguucaa

SEQ ID NO: 1215461 - RNA, 16 nt, Homo sapiens
aauguuuguccuguau

SEQ ID NO: 1215462 - RNA, 17 nt, Homo sapiens
aauguuuguccuguaua

SEQ ID NO: 1215463 - RNA, 22 nt, Homo sapiens
aauguuuguuaaagcuagauag

SEQ ID NO: 1215464 - RNA, 16 nt, Homo sapiens
aauuaaaaaagcauac

SEQ ID NO: 1215465 - RNA, 17 nt, Homo sapiens
aauuaaaaaagcauacu

SEQ ID NO: 1215466 - RNA, 15 nt, Homo sapiens
aauuaaaaaccugau

SEQ ID NO: 1215467 - RNA, 23 nt, Homo sapiens
aauuaaaacuaagcacaaagcca

SEQ ID NO: 1215468 - RNA, 11 nt, Homo sapiens
aauuaaaggaa

SEQ ID NO: 1215469 - RNA, 18 nt, Homo sapiens
aauuaaaguggaccaaua

SEQ ID NO: 1215470 - RNA, 14 nt, Homo sapiens
aauuaaaucugaau

SEQ ID NO: 1215471 - RNA, 14 nt, Homo sapiens
aauuaaaugaagcc

SEQ ID NO: 1215472 - RNA, 13 nt, Homo sapiens
aauuaaaugccuu

SEQ ID NO: 1215473 - RNA, 19 nt, Homo sapiens
aauuaaauuucacaauaua

SEQ ID NO: 1215474 - RNA, 15 nt, Homo sapiens
aauuaaccuuacuaa

SEQ ID NO: 1215475 - RNA, 16 nt, Homo sapiens
aauuaaguuacaauua

SEQ ID NO: 1215476 - RNA, 21 nt, Homo sapiens
aauuaauaucccuacauguau

SEQ ID NO: 1215477 - RNA, 18 nt, Homo sapiens
aauuaauauucauauuau

SEQ ID NO: 1215478 - RNA, 16 nt, Homo sapiens
aauuaauuuacuagaa

SEQ ID NO: 1215479 - RNA, 15 nt, Homo sapiens
aauuacaaaugcaau

SEQ ID NO: 1215480 - RNA, 14 nt, Homo sapiens
aauuacaagcugua

SEQ ID NO: 1215481 - RNA, 12 nt, Homo sapiens
aauuacagacaa

SEQ ID NO: 1215482 - RNA, 15 nt, Homo sapiens
aauuacaucugucau

SEQ ID NO: 1215483 - RNA, 18 nt, Homo sapiens
aauuaccaugcuucacaa

SEQ ID NO: 1215484 - RNA, 20 nt, Homo sapiens
aauuaccauuaauuacauac

SEQ ID NO: 1215485 - RNA, 21 nt, Homo sapiens
aauuaccauuaauuacauaca

SEQ ID NO: 1215486 - RNA, 16 nt, Homo sapiens
aauuaccucucuugcu

SEQ ID NO: 1215487 - RNA, 14 nt, Homo sapiens
aauuaccuguggau

SEQ ID NO: 1215488 - RNA, 17 nt, Homo sapiens
aauuacuaaauuacaaa

SEQ ID NO: 1215489 - RNA, 18 nt, Homo sapiens
aauuacuugagcccagga

SEQ ID NO: 1215490 - RNA, 20 nt, Homo sapiens
aauuagaucgguucugugcc

SEQ ID NO: 1215491 - RNA, 15 nt, Homo sapiens
aauuaguucuccuau

SEQ ID NO: 1215492 - RNA, 12 nt, Homo sapiens
aauuaguuucaa

SEQ ID NO: 1215493 - RNA, 15 nt, Homo sapiens
aauuauaagucacaa

SEQ ID NO: 1215494 - RNA, 22 nt, Homo sapiens
aauuauaaucaaaaucaaugca

SEQ ID NO: 1215495 - RNA, 15 nt, Homo sapiens
aauuauaugaccaua

SEQ ID NO: 1215496 - RNA, 16 nt, Homo sapiens
aauuauaugaccauau

SEQ ID NO: 1215497 - RNA, 14 nt, Homo sapiens
aauuauggcauuuu

SEQ ID NO: 1215498 - RNA, 19 nt, Homo sapiens
aauuaugucuuaguuauaa

SEQ ID NO: 1215499 - RNA, 18 nt, Homo sapiens
aauuauuaugucucaaaa

SEQ ID NO: 1215500 - RNA, 16 nt, Homo sapiens
aauuauuucacuuuag

SEQ ID NO: 1215501 - RNA, 14 nt, Homo sapiens
aauucaagccuuag

SEQ ID NO: 1215502 - RNA, 18 nt, Homo sapiens
aauucacaaauacauaac

SEQ ID NO: 1215503 - RNA, 20 nt, Homo sapiens
aauucacagugcucuuuucu

SEQ ID NO: 1215504 - RNA, 20 nt, Homo sapiens
aauucacccccuuuccugga

SEQ ID NO: 1215505 - RNA, 17 nt, Homo sapiens
aauucagaacaagcaau

SEQ ID NO: 1215506 - RNA, 20 nt, Homo sapiens
aauucagaucaaaaugccuu

SEQ ID NO: 1215507 - RNA, 13 nt, Homo sapiens
aauucagcacuua

SEQ ID NO: 1215508 - RNA, 13 nt, Homo sapiens
aauucaguucugu

SEQ ID NO: 1215509 - RNA, 19 nt, Homo sapiens
aauucauaaaaacugcuua

SEQ ID NO: 1215510 - RNA, 16 nt, Homo sapiens
aauucauaaucacucu

SEQ ID NO: 1215511 - RNA, 14 nt, Homo sapiens
aauucaucagauaa

SEQ ID NO: 1215512 - RNA, 23 nt, Homo sapiens
aauucauucucugugguauccaa

SEQ ID NO: 1215513 - RNA, 17 nt, Homo sapiens
aauucauugugauuuau

SEQ ID NO: 1215514 - RNA, 11 nt, Homo sapiens
aauucauuugu

SEQ ID NO: 1215515 - RNA, 20 nt, Homo sapiens
aauucauuuucaucacuggg

SEQ ID NO: 1215516 - RNA, 21 nt, Homo sapiens
aauucauuuucaucacuggga

SEQ ID NO: 1215517 - RNA, 19 nt, Homo sapiens
aauucauuuuuuaaauucc

SEQ ID NO: 1215518 - RNA, 18 nt, Homo sapiens
aauuccagcaaaagagcu

SEQ ID NO: 1215519 - RNA, 15 nt, Homo sapiens
aauuccagugccagg

SEQ ID NO: 1215520 - RNA, 18 nt, Homo sapiens
aauucccauuuugcaaaa

SEQ ID NO: 1215521 - RNA, 17 nt, Homo sapiens
aauucccuuuuaaucaa

SEQ ID NO: 1215522 - RNA, 21 nt, Homo sapiens
aauuccuaauaaguuugauca

SEQ ID NO: 1215523 - RNA, 16 nt, Homo sapiens
aauuccuagucacaau

SEQ ID NO: 1215524 - RNA, 13 nt, Homo sapiens
aauuccucuggga

SEQ ID NO: 1215525 - RNA, 20 nt, Homo sapiens
aauuccugauggaaaaugca

SEQ ID NO: 1215526 - RNA, 19 nt, Homo sapiens
aauuccugccaugccccag

SEQ ID NO: 1215527 - RNA, 16 nt, Homo sapiens
aauuccuguacugugu

SEQ ID NO: 1215528 - RNA, 23 nt, Homo sapiens
aauucuaacccagguauccaaaa

SEQ ID NO: 1215529 - RNA, 21 nt, Homo sapiens
aauucuaaguuauuuacuuuu

SEQ ID NO: 1215530 - RNA, 21 nt, Homo sapiens
aauucuagaggauguaucuca

SEQ ID NO: 1215531 - RNA, 17 nt, Homo sapiens
aauucuaggcaucccag

SEQ ID NO: 1215532 - RNA, 12 nt, Homo sapiens
aauucuauuaca

SEQ ID NO: 1215533 - RNA, 23 nt, Homo sapiens
aauucucaaaagaaaaggcaaaa

SEQ ID NO: 1215534 - RNA, 18 nt, Homo sapiens
aauucucauuugucacac

SEQ ID NO: 1215535 - RNA, 17 nt, Homo sapiens
aauucuccugccuuagc

SEQ ID NO: 1215536 - RNA, 14 nt, Homo sapiens
aauucucuuucaaa

SEQ ID NO: 1215537 - RNA, 18 nt, Homo sapiens
aauucugauugauuugau

SEQ ID NO: 1215538 - RNA, 21 nt, Homo sapiens
aauucuguacauagccuauau

SEQ ID NO: 1215539 - RNA, 16 nt, Homo sapiens
aauucuguacuuccaa

SEQ ID NO: 1215540 - RNA, 16 nt, Homo sapiens
aauucugugacauaca

SEQ ID NO: 1215541 - RNA, 15 nt, Homo sapiens
aauucuuaaccugga

SEQ ID NO: 1215542 - RNA, 20 nt, Homo sapiens
aauucuuauuuuuccuaaca

SEQ ID NO: 1215543 - RNA, 18 nt, Homo sapiens
aauucuucuguccugaga

SEQ ID NO: 1215544 - RNA, 16 nt, Homo sapiens
aauugaacuaaaucca

SEQ ID NO: 1215545 - RNA, 14 nt, Homo sapiens
aauugaacuaacaa

SEQ ID NO: 1215546 - RNA, 14 nt, Homo sapiens
aauugaauucugga

SEQ ID NO: 1215547 - RNA, 21 nt, Homo sapiens
aauugaauucuggaaacuccu

SEQ ID NO: 1215548 - RNA, 13 nt, Homo sapiens
aauugacaaugau

SEQ ID NO: 1215549 - RNA, 23 nt, Homo sapiens
aauugauguugcuggacugucau

SEQ ID NO: 1215550 - RNA, 18 nt, Homo sapiens
aauugcaaauaaaccacu

SEQ ID NO: 1215551 - RNA, 23 nt, Homo sapiens
aauugcacacacucagugcagca

SEQ ID NO: 1215552 - RNA, 23 nt, Homo sapiens
aauugcacacagaugugaaauga

SEQ ID NO: 1215553 - RNA, 20 nt, Homo sapiens
aauugcacuuuuaaaccucu

SEQ ID NO: 1215554 - RNA, 15 nt, Homo sapiens
aauugcauacuuugu

SEQ ID NO: 1215555 - RNA, 22 nt, Homo sapiens
aauugccauuggacaguugucu

SEQ ID NO: 1215556 - RNA, 18 nt, Homo sapiens
aauugcccguuuccauac

SEQ ID NO: 1215557 - RNA, 19 nt, Homo sapiens
aauugcccguuuccauaca

SEQ ID NO: 1215558 - RNA, 16 nt, Homo sapiens
aauugcuucaagcauu

SEQ ID NO: 1215559 - RNA, 21 nt, Homo sapiens
aauugcuuugccaaaauacca

SEQ ID NO: 1215560 - RNA, 17 nt, Homo sapiens
aauuggaacaaagugaa

SEQ ID NO: 1215561 - RNA, 17 nt, Homo sapiens
aauuggccgcugucacu

SEQ ID NO: 1215562 - RNA, 17 nt, Homo sapiens
aauuggcucuagucacu

SEQ ID NO: 1215563 - RNA, 22 nt, Homo sapiens
aauuggcucuagucacuggcau

SEQ ID NO: 1215564 - RNA, 15 nt, Homo sapiens
aauugggccaaagaa

SEQ ID NO: 1215565 - RNA, 23 nt, Homo sapiens
aauugggccaaagaaacauugcc

SEQ ID NO: 1215566 - RNA, 22 nt, Homo sapiens
aauuggucacuuuccuauuaca

SEQ ID NO: 1215567 - RNA, 23 nt, Homo sapiens
aauuguaacgacuucuccaucuc

SEQ ID NO: 1215568 - RNA, 20 nt, Homo sapiens
aauuguaucucauuacuuau

SEQ ID NO: 1215569 - RNA, 17 nt, Homo sapiens
aauugucguuuuuauuc

SEQ ID NO: 1215570 - RNA, 19 nt, Homo sapiens
aauugugaacucauugcuc

SEQ ID NO: 1215571 - RNA, 18 nt, Homo sapiens
aauugugugucacaagaa

SEQ ID NO: 1215572 - RNA, 21 nt, Homo sapiens
aauuguugacaguucugaaga

SEQ ID NO: 1215573 - RNA, 15 nt, Homo sapiens
aauuguuuggggaug

SEQ ID NO: 1215574 - RNA, 22 nt, Homo sapiens
aauuuaaaaaauauauaugcau

SEQ ID NO: 1215575 - RNA, 14 nt, Homo sapiens
aauuuaaaagcaca

SEQ ID NO: 1215576 - RNA, 18 nt, Homo sapiens
aauuuaaaggguguacuu

SEQ ID NO: 1215577 - RNA, 19 nt, Homo sapiens
aauuuaaaggguguacuua

SEQ ID NO: 1215578 - RNA, 18 nt, Homo sapiens
aauuuaacaaacuaaaaa

SEQ ID NO: 1215579 - RNA, 15 nt, Homo sapiens
aauuuacacugccau

SEQ ID NO: 1215580 - RNA, 14 nt, Homo sapiens
aauuuagggagaaa

SEQ ID NO: 1215581 - RNA, 22 nt, Homo sapiens
aauuuaguuauugauguauaaa

SEQ ID NO: 1215582 - RNA, 17 nt, Homo sapiens
aauuuauaaugaauacu

SEQ ID NO: 1215583 - RNA, 13 nt, Homo sapiens
aauuuauauucuc

SEQ ID NO: 1215584 - RNA, 14 nt, Homo sapiens
aauuuaucuuucaa

SEQ ID NO: 1215585 - RNA, 21 nt, Homo sapiens
aauuuaugggagaauugcaca

SEQ ID NO: 1215586 - RNA, 18 nt, Homo sapiens
aauuuauucaauuccucu

SEQ ID NO: 1215587 - RNA, 20 nt, Homo sapiens
aauuuauucacauauaucaa

SEQ ID NO: 1215588 - RNA, 20 nt, Homo sapiens
aauuucaaaaauauaacuua

SEQ ID NO: 1215589 - RNA, 12 nt, Homo sapiens
aauuucacaagc

SEQ ID NO: 1215590 - RNA, 16 nt, Homo sapiens
aauuucacaagcuauu

SEQ ID NO: 1215591 - RNA, 15 nt, Homo sapiens
aauuucacugaugua

SEQ ID NO: 1215592 - RNA, 14 nt, Homo sapiens
aauuucagcauuau

SEQ ID NO: 1215593 - RNA, 20 nt, Homo sapiens
aauuucauagcuguacuucu

SEQ ID NO: 1215594 - RNA, 20 nt, Homo sapiens
aauuucauuaucaucaagca

SEQ ID NO: 1215595 - RNA, 17 nt, Homo sapiens
aauuuccauuuauauca

SEQ ID NO: 1215596 - RNA, 18 nt, Homo sapiens
aauuuccuuacucuugau

SEQ ID NO: 1215597 - RNA, 19 nt, Homo sapiens
aauuucuccucccuuccuu

SEQ ID NO: 1215598 - RNA, 17 nt, Homo sapiens
aauuucucuuuacuuga

SEQ ID NO: 1215599 - RNA, 19 nt, Homo sapiens
aauuucucuuuacuugaaa

SEQ ID NO: 1215600 - RNA, 11 nt, Homo sapiens
aauuucuguca

SEQ ID NO: 1215601 - RNA, 21 nt, Homo sapiens
aauuucugucagaaugcuauu

SEQ ID NO: 1215602 - RNA, 16 nt, Homo sapiens
aauuucuuccuuccac

SEQ ID NO: 1215603 - RNA, 21 nt, Homo sapiens
aauuugaaaccaggacauuaa

SEQ ID NO: 1215604 - RNA, 13 nt, Homo sapiens
aauuugauacuua

SEQ ID NO: 1215605 - RNA, 17 nt, Homo sapiens
aauuuggagauacguaa

SEQ ID NO: 1215606 - RNA, 21 nt, Homo sapiens
aauuuggagcacaaaauucaa

SEQ ID NO: 1215607 - RNA, 21 nt, Homo sapiens
aauuuggccagacacaggugc

SEQ ID NO: 1215608 - RNA, 15 nt, Homo sapiens
aauuuggcuaauaac

SEQ ID NO: 1215609 - RNA, 21 nt, Homo sapiens
aauuuggguacugggugcugu

SEQ ID NO: 1215610 - RNA, 21 nt, Homo sapiens
aauuugguuuguuaauucuua

SEQ ID NO: 1215611 - RNA, 15 nt, Homo sapiens
aauuuguacuucuua

SEQ ID NO: 1215612 - RNA, 16 nt, Homo sapiens
aauuuguaggaaaaag

SEQ ID NO: 1215613 - RNA, 22 nt, Homo sapiens
aauuuguguguuuuuagcugug

SEQ ID NO: 1215614 - RNA, 22 nt, Homo sapiens
aauuuuaguguuaaugacucuu

SEQ ID NO: 1215615 - RNA, 20 nt, Homo sapiens
aauuuuauaugcuuacugau

SEQ ID NO: 1215616 - RNA, 17 nt, Homo sapiens
aauuuucaaguuuacac

SEQ ID NO: 1215617 - RNA, 17 nt, Homo sapiens
aauuuucacuucugucu

SEQ ID NO: 1215618 - RNA, 23 nt, Homo sapiens
aauuuucagcagagaccuuccaa

SEQ ID NO: 1215619 - RNA, 21 nt, Homo sapiens
aauuuuccucauuuugaauua

SEQ ID NO: 1215620 - RNA, 18 nt, Homo sapiens
aauuuucuaaaagcuuuc

SEQ ID NO: 1215621 - RNA, 17 nt, Homo sapiens
aauuuugaguugccaca

SEQ ID NO: 1215622 - RNA, 15 nt, Homo sapiens
aauuuugccaaauaa

SEQ ID NO: 1215623 - RNA, 20 nt, Homo sapiens
aauuuuuaaaacccauuuaa

SEQ ID NO: 1215624 - RNA, 19 nt, Homo sapiens
aauuuuuaugaaauacugc

SEQ ID NO: 1215625 - RNA, 11 nt, Homo sapiens
aauuuuuccau

SEQ ID NO: 1215626 - RNA, 23 nt, Homo sapiens
aauuuuuuuuuuuuaacuuuaag

SEQ ID NO: 1215627 - RNA, 18 nt, Homo sapiens
acaaaaaacaacaaauaa

SEQ ID NO: 1215628 - RNA, 15 nt, Homo sapiens
acaaaaaauacuuua

SEQ ID NO: 1215629 - RNA, 20 nt, Homo sapiens
acaaaaacagguauauacuu

SEQ ID NO: 1215630 - RNA, 12 nt, Homo sapiens
acaaaaauauua

SEQ ID NO: 1215631 - RNA, 16 nt, Homo sapiens
acaaaaaugaacugaa

SEQ ID NO: 1215632 - RNA, 22 nt, Homo sapiens
acaaaaauugagacauuuacau

SEQ ID NO: 1215633 - RNA, 22 nt, Homo sapiens
acaaaacugacaguaaaucuca

SEQ ID NO: 1215634 - RNA, 17 nt, Homo sapiens
acaaaacuucuugucag

SEQ ID NO: 1215635 - RNA, 14 nt, Homo sapiens
acaaaauccaacuc

SEQ ID NO: 1215636 - RNA, 12 nt, Homo sapiens
acaaaaugguca

SEQ ID NO: 1215637 - RNA, 17 nt, Homo sapiens
acaaaauucaaagcaug

SEQ ID NO: 1215638 - RNA, 21 nt, Homo sapiens
acaaaauuuuauuuugugcuc

SEQ ID NO: 1215639 - RNA, 23 nt, Homo sapiens
acaaacaagaggacuguguugug

SEQ ID NO: 1215640 - RNA, 20 nt, Homo sapiens
acaaacaugcaguacuuuug

SEQ ID NO: 1215641 - RNA, 14 nt, Homo sapiens
acaaacccaagggc

SEQ ID NO: 1215642 - RNA, 14 nt, Homo sapiens
acaaacuccaucca

SEQ ID NO: 1215643 - RNA, 11 nt, Homo sapiens
acaaacugcaa

SEQ ID NO: 1215644 - RNA, 17 nt, Homo sapiens
acaaagaggagcugcug

SEQ ID NO: 1215645 - RNA, 18 nt, Homo sapiens
acaaagauugagaagcca

SEQ ID NO: 1215646 - RNA, 15 nt, Homo sapiens
acaaagcacaguguu

SEQ ID NO: 1215647 - RNA, 13 nt, Homo sapiens
acaaagcauggua

SEQ ID NO: 1215648 - RNA, 15 nt, Homo sapiens
acaaagcccuuccau

SEQ ID NO: 1215649 - RNA, 18 nt, Homo sapiens
acaaaggacagaguauga

SEQ ID NO: 1215650 - RNA, 21 nt, Homo sapiens
acaaaggauacuuuuacaggu

SEQ ID NO: 1215651 - RNA, 19 nt, Homo sapiens
acaaaggcugaacuggauu

SEQ ID NO: 1215652 - RNA, 15 nt, Homo sapiens
acaaaguaagccaug

SEQ ID NO: 1215653 - RNA, 18 nt, Homo sapiens
acaaaguccacuuuacuc

SEQ ID NO: 1215654 - RNA, 19 nt, Homo sapiens
acaaagugacauuccugag

SEQ ID NO: 1215655 - RNA, 17 nt, Homo sapiens
acaaaguguauacaugu

SEQ ID NO: 1215656 - RNA, 23 nt, Homo sapiens
acaaaguuacugauucacugcau

SEQ ID NO: 1215657 - RNA, 21 nt, Homo sapiens
acaaauaaguggaaaccgugu

SEQ ID NO: 1215658 - RNA, 12 nt, Homo sapiens
acaaauaugcaa

SEQ ID NO: 1215659 - RNA, 19 nt, Homo sapiens
acaaaucaacagaagcauu

SEQ ID NO: 1215660 - RNA, 23 nt, Homo sapiens
acaaaucaacagaagcauuugua

SEQ ID NO: 1215661 - RNA, 22 nt, Homo sapiens
acaaaucuuuuucuauauucuc

SEQ ID NO: 1215662 - RNA, 14 nt, Homo sapiens
acaaaugaugccau

SEQ ID NO: 1215663 - RNA, 16 nt, Homo sapiens
acaaaugaugccaugg

SEQ ID NO: 1215664 - RNA, 18 nt, Homo sapiens
acaaaugggaaaaccaga

SEQ ID NO: 1215665 - RNA, 20 nt, Homo sapiens
acaaauuagccauuucacuc

SEQ ID NO: 1215666 - RNA, 18 nt, Homo sapiens
acaaauuauaagcauaca

SEQ ID NO: 1215667 - RNA, 19 nt, Homo sapiens
acaaauuauaagcauacaa

SEQ ID NO: 1215668 - RNA, 16 nt, Homo sapiens
acaaauucaagccuua

SEQ ID NO: 1215669 - RNA, 23 nt, Homo sapiens
acaacagaaguauuucuguggau

SEQ ID NO: 1215670 - RNA, 17 nt, Homo sapiens
acaacagaauaaugcau

SEQ ID NO: 1215671 - RNA, 22 nt, Homo sapiens
acaacauaaucuaguuuacaga

SEQ ID NO: 1215672 - RNA, 14 nt, Homo sapiens
acaacaucgcaaua

SEQ ID NO: 1215673 - RNA, 19 nt, Homo sapiens
acaacaugcgaccgugacc

SEQ ID NO: 1215674 - RNA, 23 nt, Homo sapiens
acaacaugcuagguagugaccua

SEQ ID NO: 1215675 - RNA, 19 nt, Homo sapiens
acaacauuucucaaaugca

SEQ ID NO: 1215676 - RNA, 20 nt, Homo sapiens
acaaccaaaaaauucuacaa

SEQ ID NO: 1215677 - RNA, 15 nt, Homo sapiens
acaaccucaucagcu

SEQ ID NO: 1215678 - RNA, 22 nt, Homo sapiens
acaaccugaaauuuauucacau

SEQ ID NO: 1215679 - RNA, 17 nt, Homo sapiens
acaacgccugucacaga

SEQ ID NO: 1215680 - RNA, 22 nt, Homo sapiens
acaacgccugucacagaguaga

SEQ ID NO: 1215681 - RNA, 13 nt, Homo sapiens
acaacucugaaag

SEQ ID NO: 1215682 - RNA, 20 nt, Homo sapiens
acaacugauacuucacuacu

SEQ ID NO: 1215683 - RNA, 12 nt, Homo sapiens
acaacuggacaa

SEQ ID NO: 1215684 - RNA, 17 nt, Homo sapiens
acaacugucuaacuuua

SEQ ID NO: 1215685 - RNA, 14 nt, Homo sapiens
acaacugugugauu

SEQ ID NO: 1215686 - RNA, 23 nt, Homo sapiens
acaacuuucuccuacucuuccuu

SEQ ID NO: 1215687 - RNA, 11 nt, Homo sapiens
acaagaagcug

SEQ ID NO: 1215688 - RNA, 15 nt, Homo sapiens
acaagaauugcuaaa

SEQ ID NO: 1215689 - RNA, 17 nt, Homo sapiens
acaagaccccgucucaa

SEQ ID NO: 1215690 - RNA, 23 nt, Homo sapiens
acaaugggcacugauuugauacc

SEQ ID NO: 1215691 - RNA, 23 nt, Homo sapiens
acaauguaugugaaaguguaaaa

SEQ ID NO: 1215692 - RNA, 20 nt, Homo sapiens
acaaugucaugucugugauu

SEQ ID NO: 1215693 - RNA, 18 nt, Homo sapiens
acaauuacuaaauuguau

SEQ ID NO: 1215694 - RNA, 13 nt, Homo sapiens
acaauucagugac

SEQ ID NO: 1215695 - RNA, 16 nt, Homo sapiens
acaauuccuagauaaa

SEQ ID NO: 1215696 - RNA, 21 nt, Homo sapiens
acaauugucgaaaagagucuu

SEQ ID NO: 1215697 - RNA, 15 nt, Homo sapiens
acaauuuaugaauug

SEQ ID NO: 1215698 - RNA, 14 nt, Homo sapiens
acaauuucaauaaa

SEQ ID NO: 1215699 - RNA, 15 nt, Homo sapiens
acacaaaacucucug

SEQ ID NO: 1215700 - RNA, 18 nt, Homo sapiens
acacaaagacauugauuc

SEQ ID NO: 1215701 - RNA, 21 nt, Homo sapiens
acacaaagcuguugaaauauu

SEQ ID NO: 1215702 - RNA, 12 nt, Homo sapiens
acacaaagggaa

SEQ ID NO: 1215703 - RNA, 13 nt, Homo sapiens
acacaaaugcaug

SEQ ID NO: 1215704 - RNA, 13 nt, Homo sapiens
acacaaaugugac

SEQ ID NO: 1215705 - RNA, 17 nt, Homo sapiens
acacaacuguucccgau

SEQ ID NO: 1215706 - RNA, 20 nt, Homo sapiens
acacaauucauuggcuccug

SEQ ID NO: 1215707 - RNA, 13 nt, Homo sapiens
acacacacaugca

SEQ ID NO: 1215708 - RNA, 13 nt, Homo sapiens
acacacauccagc

SEQ ID NO: 1215709 - RNA, 14 nt, Homo sapiens
acacacaugcacac

SEQ ID NO: 1215710 - RNA, 21 nt, Homo sapiens
acacaccccuccggacaucca

SEQ ID NO: 1215711 - RNA, 16 nt, Homo sapiens
acacacccugagguca

SEQ ID NO: 1215712 - RNA, 16 nt, Homo sapiens
acacaccuccgagaca

SEQ ID NO: 1215713 - RNA, 15 nt, Homo sapiens
acacacgaugcauuu

SEQ ID NO: 1215714 - RNA, 13 nt, Homo sapiens
acacacgcuuucu

SEQ ID NO: 1215715 - RNA, 14 nt, Homo sapiens
acacacuccgucca

SEQ ID NO: 1215716 - RNA, 11 nt, Homo sapiens
acacacuggcc

SEQ ID NO: 1215717 - RNA, 15 nt, Homo sapiens
acacagacuggcaau

SEQ ID NO: 1215718 - RNA, 16 nt, Homo sapiens
acacagacuggcaaua

SEQ ID NO: 1215719 - RNA, 17 nt, Homo sapiens
acacagcaggacuccau

SEQ ID NO: 1215720 - RNA, 19 nt, Homo sapiens
acacagcaggacuccaucu

SEQ ID NO: 1215721 - RNA, 14 nt, Homo sapiens
acacagcauuguau

SEQ ID NO: 1215722 - RNA, 12 nt, Homo sapiens
acacagcuccuc

SEQ ID NO: 1215723 - RNA, 15 nt, Homo sapiens
acacagcuuaacaau

SEQ ID NO: 1215724 - RNA, 12 nt, Homo sapiens
acacaggaugag

SEQ ID NO: 1215725 - RNA, 18 nt, Homo sapiens
acacaggcaaaauccuug

SEQ ID NO: 1215726 - RNA, 17 nt, Homo sapiens
acacagggcccggccac

SEQ ID NO: 1215727 - RNA, 15 nt, Homo sapiens
acacagggcucuuug

SEQ ID NO: 1215728 - RNA, 24 nt, Homo sapiens
acacauagaaaacaaucaaauauu

SEQ ID NO: 1215729 - RNA, 13 nt, Homo sapiens
acacauaugcacc

SEQ ID NO: 1215730 - RNA, 17 nt, Homo sapiens
acacaucaggaguucaa

SEQ ID NO: 1215731 - RNA, 21 nt, Homo sapiens
acacaucccggccucuuccac

SEQ ID NO: 1215732 - RNA, 22 nt, Homo sapiens
acacauccgccuuuuguauaca

SEQ ID NO: 1215733 - RNA, 12 nt, Homo sapiens
acacaugcacac

SEQ ID NO: 1215734 - RNA, 14 nt, Homo sapiens
acacaugccuuaaa

SEQ ID NO: 1215735 - RNA, 17 nt, Homo sapiens
acacauggcaugaaaua

SEQ ID NO: 1215736 - RNA, 19 nt, Homo sapiens
acacaugugcagucacugg

SEQ ID NO: 1215737 - RNA, 12 nt, Homo sapiens
acacauuacaaa

SEQ ID NO: 1215738 - RNA, 22 nt, Homo sapiens
acacauucaggaguuaaauauu

SEQ ID NO: 1215739 - RNA, 16 nt, Homo sapiens
acacauuguacauggu

SEQ ID NO: 1215740 - RNA, 20 nt, Homo sapiens
acacauuugguuucugaaua

SEQ ID NO: 1215741 - RNA, 19 nt, Homo sapiens
acaccaaugcccaacugcc

SEQ ID NO: 1215742 - RNA, 16 nt, Homo sapiens
acaccacaccaucagg

SEQ ID NO: 1215743 - RNA, 20 nt, Homo sapiens
acaccacagcagagaccacc

SEQ ID NO: 1215744 - RNA, 14 nt, Homo sapiens
acaccagcagcccu

SEQ ID NO: 1215745 - RNA, 13 nt, Homo sapiens
acaccaggcugug

SEQ ID NO: 1215746 - RNA, 20 nt, Homo sapiens
acacccacccccaugcacuc

SEQ ID NO: 1215747 - RNA, 19 nt, Homo sapiens
acacccagucuguucccca

SEQ ID NO: 1215748 - RNA, 21 nt, Homo sapiens
acacccccaccuccugcaaua

SEQ ID NO: 1215749 - RNA, 17 nt, Homo sapiens
acacccgacuccucaaa

SEQ ID NO: 1215750 - RNA, 12 nt, Homo sapiens
acacccugcaag

SEQ ID NO: 1215751 - RNA, 19 nt, Homo sapiens
acaccggcuuaacacuauc

SEQ ID NO: 1215752 - RNA, 15 nt, Homo sapiens
acaccuacucuauca

SEQ ID NO: 1215753 - RNA, 20 nt, Homo sapiens
acaccuccauuucucuccag

SEQ ID NO: 1215754 - RNA, 15 nt, Homo sapiens
acaccucccuacucc

SEQ ID NO: 1215755 - RNA, 21 nt, Homo sapiens
acaccucccuccccacaccuc

SEQ ID NO: 1215756 - RNA, 12 nt, Homo sapiens
acaccugacuaa

SEQ ID NO: 1215757 - RNA, 13 nt, Homo sapiens
acaccugagacau

SEQ ID NO: 1215758 - RNA, 19 nt, Homo sapiens
acaccugccuccacuucuc

SEQ ID NO: 1215759 - RNA, 17 nt, Homo sapiens
acaccuggaugucuggg

SEQ ID NO: 1215760 - RNA, 18 nt, Homo sapiens
acaccuuaagaagucuau

SEQ ID NO: 1215761 - RNA, 15 nt, Homo sapiens
acaccuugacagggc

SEQ ID NO: 1215762 - RNA, 20 nt, Homo sapiens
acaccuuuuccccaaccaca

SEQ ID NO: 1215763 - RNA, 15 nt, Homo sapiens
acacgauaaagggau

SEQ ID NO: 1215764 - RNA, 23 nt, Homo sapiens
acacgcccccacaggcucugacc

SEQ ID NO: 1215765 - RNA, 16 nt, Homo sapiens
acacgcugguggugcu

SEQ ID NO: 1215766 - RNA, 16 nt, Homo sapiens
acacggaucugacaga

SEQ ID NO: 1215767 - RNA, 21 nt, Homo sapiens
acacggaugacuuaacugcau

SEQ ID NO: 1215768 - RNA, 16 nt, Homo sapiens
acacguaaguauaaau

SEQ ID NO: 1215769 - RNA, 18 nt, Homo sapiens
acacguacaaaauccagc

SEQ ID NO: 1215770 - RNA, 17 nt, Homo sapiens
acacguaccucucauca

SEQ ID NO: 1215771 - RNA, 22 nt, Homo sapiens
acacguguggcgggcaguggga

SEQ ID NO: 1215772 - RNA, 17 nt, Homo sapiens
acaguacuuuauuguac

SEQ ID NO: 1215773 - RNA, 20 nt, Homo sapiens
acaguagaacugucugugaa

SEQ ID NO: 1215774 - RNA, 17 nt, Homo sapiens
acaguagguuggcagua

SEQ ID NO: 1215775 - RNA, 20 nt, Homo sapiens
acaguauucuguaccauagc

SEQ ID NO: 1215776 - RNA, 21 nt, Homo sapiens
acaguauuuuagguaugauuu

SEQ ID NO: 1215777 - RNA, 14 nt, Homo sapiens
acaguauuuuccca

SEQ ID NO: 1215778 - RNA, 20 nt, Homo sapiens
acagucaccgacaacaugcu

SEQ ID NO: 1215779 - RNA, 11 nt, Homo sapiens
acagucacuga

SEQ ID NO: 1215780 - RNA, 16 nt, Homo sapiens
acagucacugauguac

SEQ ID NO: 1215781 - RNA, 21 nt, Homo sapiens
acagucaguucucauuauuca

SEQ ID NO: 1215782 - RNA, 19 nt, Homo sapiens
acagucauauaaacguccu

SEQ ID NO: 1215783 - RNA, 13 nt, Homo sapiens
acagucauuuaaa

SEQ ID NO: 1215784 - RNA, 22 nt, Homo sapiens
acaguccaaacuguucugagaa

SEQ ID NO: 1215785 - RNA, 17 nt, Homo sapiens
acagucccagauacacu

SEQ ID NO: 1215786 - RNA, 15 nt, Homo sapiens
acagucccuauggaa

SEQ ID NO: 1215787 - RNA, 15 nt, Homo sapiens
acaguccugggagaa

SEQ ID NO: 1215788 - RNA, 15 nt, Homo sapiens
acagugaaacuccau

SEQ ID NO: 1215789 - RNA, 18 nt, Homo sapiens
acagugaaacuccaucuc

SEQ ID NO: 1215790 - RNA, 19 nt, Homo sapiens
acagugaaacuccaucuca

SEQ ID NO: 1215791 - RNA, 20 nt, Homo sapiens
acagugaaacuccaucucaa

SEQ ID NO: 1215792 - RNA, 16 nt, Homo sapiens
acagugaaugcacugu

SEQ ID NO: 1215793 - RNA, 13 nt, Homo sapiens
acagugaauuuaa

SEQ ID NO: 1215794 - RNA, 17 nt, Homo sapiens
acagugacuggugccag

SEQ ID NO: 1215795 - RNA, 14 nt, Homo sapiens
acagugaggcugca

SEQ ID NO: 1215796 - RNA, 23 nt, Homo sapiens
acagugcauauuccuuucuauca

SEQ ID NO: 1215797 - RNA, 15 nt, Homo sapiens
acagugccaacuccu

SEQ ID NO: 1215798 - RNA, 17 nt, Homo sapiens
acagugccaacuccuca

SEQ ID NO: 1215799 - RNA, 18 nt, Homo sapiens
acagugccgacagcucuc

SEQ ID NO: 1215800 - RNA, 18 nt, Homo sapiens
acaguggacucagcagug

SEQ ID NO: 1215801 - RNA, 21 nt, Homo sapiens
acaguggaggaagagggacag

SEQ ID NO: 1215802 - RNA, 15 nt, Homo sapiens
acaguggaugcugcu

SEQ ID NO: 1215803 - RNA, 15 nt, Homo sapiens
acaguguacaaugcc

SEQ ID NO: 1215804 - RNA, 16 nt, Homo sapiens
acaguguacaaugccu

SEQ ID NO: 1215805 - RNA, 22 nt, Homo sapiens
acagugucugugccauggauuu

SEQ ID NO: 1215806 - RNA, 19 nt, Homo sapiens
acaguguugaaaauguuca

SEQ ID NO: 1215807 - RNA, 14 nt, Homo sapiens
acaguguugcccag

SEQ ID NO: 1215808 - RNA, 18 nt, Homo sapiens
acaguuaauuaugugcau

SEQ ID NO: 1215809 - RNA, 16 nt, Homo sapiens
acaguuacuccaguau

SEQ ID NO: 1215810 - RNA, 22 nt, Homo sapiens
acaguucaauucucauuuguca

SEQ ID NO: 1215811 - RNA, 14 nt, Homo sapiens
acaguucugaagaa

SEQ ID NO: 1215812 - RNA, 23 nt, Homo sapiens
acaguuggauuuauucugccaaa

SEQ ID NO: 1215813 - RNA, 20 nt, Homo sapiens
acaguugggacccaaaacac

SEQ ID NO: 1215814 - RNA, 23 nt, Homo sapiens
acaguuuauuuuuauacuuucag

SEQ ID NO: 1215815 - RNA, 16 nt, Homo sapiens
acaguuugcuguacua

SEQ ID NO: 1215816 - RNA, 14 nt, Homo sapiens
acaguuuuaacugu

SEQ ID NO: 1215817 - RNA, 17 nt, Homo sapiens
acaguuuuaacugugga

SEQ ID NO: 1215818 - RNA, 13 nt, Homo sapiens
acauaaagccaug

SEQ ID NO: 1215819 - RNA, 15 nt, Homo sapiens
acauaaauuaugaga

SEQ ID NO: 1215820 - RNA, 20 nt, Homo sapiens
acauaacguuuuuccuuuaa

SEQ ID NO: 1215821 - RNA, 13 nt, Homo sapiens
acauaaggaugaa

SEQ ID NO: 1215822 - RNA, 21 nt, Homo sapiens
acauaaguguugguagcacuu

SEQ ID NO: 1215823 - RNA, 13 nt, Homo sapiens
acauaauguucca

SEQ ID NO: 1215824 - RNA, 22 nt, Homo sapiens
acauacaggccauacuuuacaa

SEQ ID NO: 1215825 - RNA, 19 nt, Homo sapiens
acauacgaaacacaaacca

SEQ ID NO: 1215826 - RNA, 15 nt, Homo sapiens
acauacguacuuuuc

SEQ ID NO: 1215827 - RNA, 14 nt, Homo sapiens
acauacgugcacag

SEQ ID NO: 1215828 - RNA, 16 nt, Homo sapiens
acauacugcggaccaa

SEQ ID NO: 1215829 - RNA, 13 nt, Homo sapiens
acauacuuuugca

SEQ ID NO: 1215830 - RNA, 19 nt, Homo sapiens
acauagacaaaaaauuuga

SEQ ID NO: 1215831 - RNA, 21 nt, Homo sapiens
acauagauuaauggcacugau

SEQ ID NO: 1215832 - RNA, 13 nt, Homo sapiens
acauagcauccaa

SEQ ID NO: 1215833 - RNA, 15 nt, Homo sapiens
acauagcaucucagg

SEQ ID NO: 1215834 - RNA, 20 nt, Homo sapiens
acauagccucaccaagguga

SEQ ID NO: 1215835 - RNA, 22 nt, Homo sapiens
acauaguagguacccaauucaa

SEQ ID NO: 1215836 - RNA, 22 nt, Homo sapiens
acauauaaaugaaucugguguu

SEQ ID NO: 1215837 - RNA, 22 nt, Homo sapiens
acauauaacgcagucuaauuac

SEQ ID NO: 1215838 - RNA, 19 nt, Homo sapiens
acauauaccuauaaugugu

SEQ ID NO: 1215839 - RNA, 14 nt, Homo sapiens
acauauagagcucc

SEQ ID NO: 1215840 - RNA, 16 nt, Homo sapiens
acauauauaugucagg

SEQ ID NO: 1215841 - RNA, 17 nt, Homo sapiens
acauauaucaaagugag

SEQ ID NO: 1215842 - RNA, 17 nt, Homo sapiens
acauauccuuucaagac

SEQ ID NO: 1215843 - RNA, 18 nt, Homo sapiens
acauaucgcugacuucau

SEQ ID NO: 1215844 - RNA, 19 nt, Homo sapiens
acauaugauuucacuagaa

SEQ ID NO: 1215845 - RNA, 16 nt, Homo sapiens
acauauguuuaucuca

SEQ ID NO: 1215846 - RNA, 20 nt, Homo sapiens
acauauuacuguugcauuua

SEQ ID NO: 1215847 - RNA, 17 nt, Homo sapiens
acauauuaggaaaauau

SEQ ID NO: 1215848 - RNA, 22 nt, Homo sapiens
acaucaaaacuaaccaucugaa

SEQ ID NO: 1215849 - RNA, 13 nt, Homo sapiens
acaucaauguuca

SEQ ID NO: 1215850 - RNA, 16 nt, Homo sapiens
acaucacaacauuuac

SEQ ID NO: 1215851 - RNA, 12 nt, Homo sapiens
acuuggcacuua

SEQ ID NO: 1215852 - RNA, 23 nt, Homo sapiens
acuuggggagauggaguucuugu

SEQ ID NO: 1215853 - RNA, 22 nt, Homo sapiens
acuugggugacggcagucgaug

SEQ ID NO: 1215854 - RNA, 23 nt, Homo sapiens
acuugguugguccuugucugcac

SEQ ID NO: 1215855 - RNA, 16 nt, Homo sapiens
acuuguagcauauucu

SEQ ID NO: 1215856 - RNA, 19 nt, Homo sapiens
acuugucuucccuucugau

SEQ ID NO: 1215857 - RNA, 17 nt, Homo sapiens
acuugugaaacacagcu

SEQ ID NO: 1215858 - RNA, 16 nt, Homo sapiens
acuugugucccaugau

SEQ ID NO: 1215859 - RNA, 20 nt, Homo sapiens
acuuguuaaaaaaauuaaau

SEQ ID NO: 1215860 - RNA, 16 nt, Homo sapiens
acuuguuccagcucuu

SEQ ID NO: 1215861 - RNA, 14 nt, Homo sapiens
acuuuaaaaugcca

SEQ ID NO: 1215862 - RNA, 21 nt, Homo sapiens
acuuuaagaacaaacucugaa

SEQ ID NO: 1215863 - RNA, 14 nt, Homo sapiens
acuuuaagauguuu

SEQ ID NO: 1215864 - RNA, 15 nt, Homo sapiens
acuuuaaugaacuaa

SEQ ID NO: 1215865 - RNA, 21 nt, Homo sapiens
acuuuaaugaacuaacugaca

SEQ ID NO: 1215866 - RNA, 13 nt, Homo sapiens
acuuuagaauuaa

SEQ ID NO: 1215867 - RNA, 14 nt, Homo sapiens
acuuuagaugcuga

SEQ ID NO: 1215868 - RNA, 18 nt, Homo sapiens
acuuuaguagacauuuau

SEQ ID NO: 1215869 - RNA, 14 nt, Homo sapiens
acuuuauaguuguu

SEQ ID NO: 1215870 - RNA, 15 nt, Homo sapiens
acuuuaucaaugugu

SEQ ID NO: 1215871 - RNA, 18 nt, Homo sapiens
acuuuaucauggaauuua

SEQ ID NO: 1215872 - RNA, 16 nt, Homo sapiens
acuuuaugaugcuaug

SEQ ID NO: 1215873 - RNA, 22 nt, Homo sapiens
acuuuauuacaauuuguauuac

SEQ ID NO: 1215874 - RNA, 17 nt, Homo sapiens
acuuuauuucugaucua

SEQ ID NO: 1215875 - RNA, 22 nt, Homo sapiens
acuuuauuucugaucuauacaa

SEQ ID NO: 1215876 - RNA, 16 nt, Homo sapiens
acuuucacacuaagaa

SEQ ID NO: 1215877 - RNA, 17 nt, Homo sapiens
acuuucauuccuucaga

SEQ ID NO: 1215878 - RNA, 20 nt, Homo sapiens
acuuucccguuuuauuccag

SEQ ID NO: 1215879 - RNA, 15 nt, Homo sapiens
acuuucccucaucca

SEQ ID NO: 1215880 - RNA, 11 nt, Homo sapiens
acuuuccugca

SEQ ID NO: 1215881 - RNA, 16 nt, Homo sapiens
acuuuccuguugucua

SEQ ID NO: 1215882 - RNA, 17 nt, Homo sapiens
acuuucucaaaauggaa

SEQ ID NO: 1215883 - RNA, 19 nt, Homo sapiens
acuuucuucucuuucccaa

SEQ ID NO: 1215884 - RNA, 13 nt, Homo sapiens
acuuugaagacca

SEQ ID NO: 1215885 - RNA, 14 nt, Homo sapiens
acuuugacaguguu

SEQ ID NO: 1215886 - RNA, 13 nt, Homo sapiens
acuuugacucaga

SEQ ID NO: 1215887 - RNA, 20 nt, Homo sapiens
acuuugauuuuauaugcuau

SEQ ID NO: 1215888 - RNA, 15 nt, Homo sapiens
acuuugcacagcucu

SEQ ID NO: 1215889 - RNA, 14 nt, Homo sapiens
acuuugcacugaua

SEQ ID NO: 1215890 - RNA, 20 nt, Homo sapiens
acuuugcuugcucauaugca

SEQ ID NO: 1215891 - RNA, 21 nt, Homo sapiens
acuuuggaguccccucaccuc

SEQ ID NO: 1215892 - RNA, 16 nt, Homo sapiens
acuuugggaccugcuu

SEQ ID NO: 1215893 - RNA, 16 nt, Homo sapiens
acuuugguaguggaau

SEQ ID NO: 1215894 - RNA, 21 nt, Homo sapiens
acuuugguaguggaauaguga

SEQ ID NO: 1215895 - RNA, 19 nt, Homo sapiens
acuuuguauauuuguuaca

SEQ ID NO: 1215896 - RNA, 15 nt, Homo sapiens
acuuugugagccaaa

SEQ ID NO: 1215897 - RNA, 18 nt, Homo sapiens
acuuuguggucgacauca

SEQ ID NO: 1215898 - RNA, 19 nt, Homo sapiens
acuuuuaaaaaauacucug

SEQ ID NO: 1215899 - RNA, 17 nt, Homo sapiens
acuuuuaaguugcugau

SEQ ID NO: 1215900 - RNA, 13 nt, Homo sapiens
acuuuuauaagaa

SEQ ID NO: 1215901 - RNA, 18 nt, Homo sapiens
acuuuucguuaacauuga

SEQ ID NO: 1215902 - RNA, 21 nt, Homo sapiens
acuuuucuuuccucagaucau

SEQ ID NO: 1215903 - RNA, 16 nt, Homo sapiens
acuuuuguguaaugaa

SEQ ID NO: 1215904 - RNA, 19 nt, Homo sapiens
acuuuuucugagcuuuuca

SEQ ID NO: 1215905 - RNA, 21 nt, Homo sapiens
acuuuuucuuguauucaugaa

SEQ ID NO: 1215906 - RNA, 12 nt, Homo sapiens
acuuuuuuacac

SEQ ID NO: 1215907 - RNA, 20 nt, Homo sapiens
acuuuuuuagaaaugcaaaa

SEQ ID NO: 1215908 - RNA, 22 nt, Homo sapiens
acuuuuuuuuaacacuuuggac

SEQ ID NO: 1215909 - RNA, 15 nt, Homo sapiens
agaaaaaaguuuaca

SEQ ID NO: 1215910 - RNA, 17 nt, Homo sapiens
agaaaaacaccgcuucu

SEQ ID NO: 1215911 - RNA, 16 nt, Homo sapiens
agaaaaagaagugccu

SEQ ID NO: 1215912 - RNA, 17 nt, Homo sapiens
agaaaaagcuagcacua

SEQ ID NO: 1215913 - RNA, 17 nt, Homo sapiens
agaaaaauaaaucuguu

SEQ ID NO: 1215914 - RNA, 15 nt, Homo sapiens
agaaaacaauaugag

SEQ ID NO: 1215915 - RNA, 19 nt, Homo sapiens
agaaaacaggcaaauuccu

SEQ ID NO: 1215916 - RNA, 17 nt, Homo sapiens
agaaaaccuagaucugc

SEQ ID NO: 1215917 - RNA, 13 nt, Homo sapiens
agaaaagcacuuu

SEQ ID NO: 1215918 - RNA, 22 nt, Homo sapiens
agaagggugguaaauauuuuca

SEQ ID NO: 1215919 - RNA, 16 nt, Homo sapiens
agaaggugaacuguua

SEQ ID NO: 1215920 - RNA, 21 nt, Homo sapiens
agaagguuggugaauuucaca

SEQ ID NO: 1215921 - RNA, 21 nt, Homo sapiens
agaaguacaaagguugcagug

SEQ ID NO: 1215922 - RNA, 14 nt, Homo sapiens
agaaguacuccuau

SEQ ID NO: 1215923 - RNA, 13 nt, Homo sapiens
agaaguaggcaug

SEQ ID NO: 1215924 - RNA, 15 nt, Homo sapiens
agaagucaacgccuc

SEQ ID NO: 1215925 - RNA, 16 nt, Homo sapiens
agaagucuauaaugca

SEQ ID NO: 1215926 - RNA, 12 nt, Homo sapiens
agaagugccagu

SEQ ID NO: 1215927 - RNA, 16 nt, Homo sapiens
agaagugguaggucag

SEQ ID NO: 1215928 - RNA, 23 nt, Homo sapiens
agaaguguggggauuuucacuga

SEQ ID NO: 1215929 - RNA, 21 nt, Homo sapiens
agaauaaaaaagaaauccaua

SEQ ID NO: 1215930 - RNA, 19 nt, Homo sapiens
agaauaaaaacuuccuuca

SEQ ID NO: 1215931 - RNA, 17 nt, Homo sapiens
agaauaaaggcaguuuu

SEQ ID NO: 1215932 - RNA, 22 nt, Homo sapiens
agaauaaggaggaggagggaga

SEQ ID NO: 1215933 - RNA, 19 nt, Homo sapiens
agaauaccaccuaauccuu

SEQ ID NO: 1215934 - RNA, 17 nt, Homo sapiens
agaauagaaccaaccca

SEQ ID NO: 1215935 - RNA, 15 nt, Homo sapiens
agaauaggcugugua

SEQ ID NO: 1215936 - RNA, 20 nt, Homo sapiens
agaauauacuaaauuaacuu

SEQ ID NO: 1215937 - RNA, 15 nt, Homo sapiens
agaauauaggucucu

SEQ ID NO: 1215938 - RNA, 19 nt, Homo sapiens
agaauaucuguaaugguac

SEQ ID NO: 1215939 - RNA, 19 nt, Homo sapiens
agaauauuauguuccucaa

SEQ ID NO: 1215940 - RNA, 23 nt, Homo sapiens
agaauauuauuggaaaauucucu

SEQ ID NO: 1215941 - RNA, 21 nt, Homo sapiens
agaauauuccuacuugcagua

SEQ ID NO: 1215942 - RNA, 18 nt, Homo sapiens
agaaucauugaaguauuu

SEQ ID NO: 1215943 - RNA, 23 nt, Homo sapiens
agaauccauccaaaguucccuau

SEQ ID NO: 1215944 - RNA, 19 nt, Homo sapiens
agaaucccuuaaaauuacc

SEQ ID NO: 1215945 - RNA, 19 nt, Homo sapiens
agaaucugcauuuagcaca

SEQ ID NO: 1215946 - RNA, 22 nt, Homo sapiens
agaaucuguugaguugcugcca

SEQ ID NO: 1215947 - RNA, 18 nt, Homo sapiens
agaaugaauaauaauuau

SEQ ID NO: 1215948 - RNA, 21 nt, Homo sapiens
agaaugagaccuggagucaug

SEQ ID NO: 1215949 - RNA, 14 nt, Homo sapiens
agaaugagacugaa

SEQ ID NO: 1215950 - RNA, 16 nt, Homo sapiens
agaaugagcaagaggc

SEQ ID NO: 1215951 - RNA, 11 nt, Homo sapiens
agaaugcucuu

SEQ ID NO: 1215952 - RNA, 17 nt, Homo sapiens
agaauggggaucacaga

SEQ ID NO: 1215953 - RNA, 16 nt, Homo sapiens
agaauggugaucacuc

SEQ ID NO: 1215954 - RNA, 15 nt, Homo sapiens
agaauguaucuguga

SEQ ID NO: 1215955 - RNA, 20 nt, Homo sapiens
agaauguucuccuaaaagac

SEQ ID NO: 1215956 - RNA, 19 nt, Homo sapiens
agaauguugguuuacuuuc

SEQ ID NO: 1215957 - RNA, 21 nt, Homo sapiens
agaauucaaguggguauucug

SEQ ID NO: 1215958 - RNA, 23 nt, Homo sapiens
agaauucagaagaccccugacuc

SEQ ID NO: 1215959 - RNA, 14 nt, Homo sapiens
agaauuguaucuca

SEQ ID NO: 1215960 - RNA, 17 nt, Homo sapiens
agaauuguuuucuuaca

SEQ ID NO: 1215961 - RNA, 22 nt, Homo sapiens
agaauuuaaaacgcaugugcag

SEQ ID NO: 1215962 - RNA, 17 nt, Homo sapiens
agaauuuaagcuguaaa

SEQ ID NO: 1215963 - RNA, 22 nt, Homo sapiens
agaauuucauucauuugugcuu

SEQ ID NO: 1215964 - RNA, 19 nt, Homo sapiens
agacaaaaucuuaaaugcc

SEQ ID NO: 1215965 - RNA, 20 nt, Homo sapiens
agacaaaccuuaaaacagcu

SEQ ID NO: 1215966 - RNA, 18 nt, Homo sapiens
agacaaagugacauuccu

SEQ ID NO: 1215967 - RNA, 13 nt, Homo sapiens
agacaacauuucu

SEQ ID NO: 1215968 - RNA, 12 nt, Homo sapiens
agacaaccaaaa

SEQ ID NO: 1215969 - RNA, 14 nt, Homo sapiens
agacaaccaaaaca

SEQ ID NO: 1215970 - RNA, 15 nt, Homo sapiens
agacaaccaaaacau

SEQ ID NO: 1215971 - RNA, 16 nt, Homo sapiens
agacaagacauugugu

SEQ ID NO: 1215972 - RNA, 19 nt, Homo sapiens
agacaaggaggaguuccac

SEQ ID NO: 1215973 - RNA, 22 nt, Homo sapiens
agacaaguaaaauuauccucuu

SEQ ID NO: 1215974 - RNA, 17 nt, Homo sapiens
agacaaguuccauggga

SEQ ID NO: 1215975 - RNA, 18 nt, Homo sapiens
agacacaaaugcaugaac

SEQ ID NO: 1215976 - RNA, 13 nt, Homo sapiens
agacacaagguga

SEQ ID NO: 1215977 - RNA, 15 nt, Homo sapiens
agacacaaggugauu

SEQ ID NO: 1215978 - RNA, 18 nt, Homo sapiens
agacacagacuggcaaua

SEQ ID NO: 1215979 - RNA, 14 nt, Homo sapiens
agacgccaccauuc

SEQ ID NO: 1215980 - RNA, 23 nt, Homo sapiens
agacggcggccaggcacagggcc

SEQ ID NO: 1215981 - RNA, 14 nt, Homo sapiens
agacgguuaaauac

SEQ ID NO: 1215982 - RNA, 24 nt, Homo sapiens
agacuaagcccugucgagacacuu

SEQ ID NO: 1215983 - RNA, 15 nt, Homo sapiens
agacuagauugccuu

SEQ ID NO: 1215984 - RNA, 13 nt, Homo sapiens
agacuagugccgu

SEQ ID NO: 1215985 - RNA, 20 nt, Homo sapiens
agacuauggccucgccuccc

SEQ ID NO: 1215986 - RNA, 17 nt, Homo sapiens
agacuauuuuauaugau

SEQ ID NO: 1215987 - RNA, 16 nt, Homo sapiens
agacucagccaagaca

SEQ ID NO: 1215988 - RNA, 23 nt, Homo sapiens
agacucagcuggaagucuaccug

SEQ ID NO: 1215989 - RNA, 17 nt, Homo sapiens
agacucaguuugucaga

SEQ ID NO: 1215990 - RNA, 15 nt, Homo sapiens
agacuccgcccuccu

SEQ ID NO: 1215991 - RNA, 15 nt, Homo sapiens
agacuccggccugua

SEQ ID NO: 1215992 - RNA, 19 nt, Homo sapiens
agacucugagcugcucacc

SEQ ID NO: 1215993 - RNA, 17 nt, Homo sapiens
agacucugucuaccugg

SEQ ID NO: 1215994 - RNA, 22 nt, Homo sapiens
agacugaaaauauauaagcuca

SEQ ID NO: 1215995 - RNA, 14 nt, Homo sapiens
agacugaacauguu

SEQ ID NO: 1215996 - RNA, 21 nt, Homo sapiens
agacugaagaccaguauuuca

SEQ ID NO: 1215997 - RNA, 22 nt, Homo sapiens
agacugcauguaccauuugcau

SEQ ID NO: 1215998 - RNA, 20 nt, Homo sapiens
agacuggcaauaaacuccua

SEQ ID NO: 1215999 - RNA, 18 nt, Homo sapiens
agacuggccaggccuccc

SEQ ID NO: 1216000 - RNA, 19 nt, Homo sapiens
agacugguuuucugccaau

SEQ ID NO: 1216001 - RNA, 20 nt, Homo sapiens
agacugucagaaaaagcuag

SEQ ID NO: 1216002 - RNA, 19 nt, Homo sapiens
agacugucucaagagggca

SEQ ID NO: 1216003 - RNA, 19 nt, Homo sapiens
agacuguggcuagugacaa

SEQ ID NO: 1216004 - RNA, 18 nt, Homo sapiens
agacuguugccacuuaac

SEQ ID NO: 1216005 - RNA, 23 nt, Homo sapiens
agacuguugcucaaaucuauuca

SEQ ID NO: 1216006 - RNA, 19 nt, Homo sapiens
agacuguugugaucuugca

SEQ ID NO: 1216007 - RNA, 18 nt, Homo sapiens
agacuuaaaaaauacuug

SEQ ID NO: 1216008 - RNA, 23 nt, Homo sapiens
agacuugcuuuucuaacuaagag

SEQ ID NO: 1216009 - RNA, 19 nt, Homo sapiens
agacuuggcuccaccacug

SEQ ID NO: 1216010 - RNA, 13 nt, Homo sapiens
agacuuggcuuug

SEQ ID NO: 1216011 - RNA, 20 nt, Homo sapiens
agacuugggaaacuauucau

SEQ ID NO: 1216012 - RNA, 20 nt, Homo sapiens
agacuuggguugaacuauaa

SEQ ID NO: 1216013 - RNA, 14 nt, Homo sapiens
agacuuuacaugga

SEQ ID NO: 1216014 - RNA, 19 nt, Homo sapiens
agacuuuguauauuuguua

SEQ ID NO: 1216015 - RNA, 15 nt, Homo sapiens
agacuuuuaucaaaa

SEQ ID NO: 1216016 - RNA, 20 nt, Homo sapiens
agacuuuuugguggauguaa

SEQ ID NO: 1216017 - RNA, 15 nt, Homo sapiens
agagaaaaacuaacu

SEQ ID NO: 1216018 - RNA, 21 nt, Homo sapiens
agagaaaaacuuucauuuuug

SEQ ID NO: 1216019 - RNA, 15 nt, Homo sapiens
agagaaaagaaacca

SEQ ID NO: 1216020 - RNA, 16 nt, Homo sapiens
agagaaagaacuauga

SEQ ID NO: 1216021 - RNA, 18 nt, Homo sapiens
agagaaagaaguaggcau

SEQ ID NO: 1216022 - RNA, 14 nt, Homo sapiens
agagaacaacuacu

SEQ ID NO: 1216023 - RNA, 19 nt, Homo sapiens
agagaacucgcgcucagua

SEQ ID NO: 1216024 - RNA, 23 nt, Homo sapiens
agagaacuggaaagacauagcca

SEQ ID NO: 1216025 - RNA, 18 nt, Homo sapiens
agagaagaccucugugag

SEQ ID NO: 1216026 - RNA, 17 nt, Homo sapiens
agagaaggaggggagca

SEQ ID NO: 1216027 - RNA, 15 nt, Homo sapiens
agagaaguccagcuc

SEQ ID NO: 1216028 - RNA, 15 nt, Homo sapiens
agagaauaccagugu

SEQ ID NO: 1216029 - RNA, 15 nt, Homo sapiens
agagaauccaaacuc

SEQ ID NO: 1216030 - RNA, 22 nt, Homo sapiens
agagaaugagaagaggcugcug

SEQ ID NO: 1216031 - RNA, 19 nt, Homo sapiens
agagaaugcacagauauac

SEQ ID NO: 1216032 - RNA, 14 nt, Homo sapiens
agagaaugccauuc

SEQ ID NO: 1216033 - RNA, 23 nt, Homo sapiens
agagaauguguguguguggcagg

SEQ ID NO: 1216034 - RNA, 20 nt, Homo sapiens
agagacagaauguaucugug

SEQ ID NO: 1216035 - RNA, 14 nt, Homo sapiens
agagaccuauguaa

SEQ ID NO: 1216036 - RNA, 14 nt, Homo sapiens
agagaccugagucu

SEQ ID NO: 1216037 - RNA, 19 nt, Homo sapiens
agagacucagaugaggaca

SEQ ID NO: 1216038 - RNA, 21 nt, Homo sapiens
agagacucagcgcuccuccug

SEQ ID NO: 1216039 - RNA, 22 nt, Homo sapiens
agagagaacuuuucgacauauu

SEQ ID NO: 1216040 - RNA, 16 nt, Homo sapiens
agagagaggcauuuag

SEQ ID NO: 1216041 - RNA, 22 nt, Homo sapiens
agagagcagcuucagugacaaa

SEQ ID NO: 1216042 - RNA, 23 nt, Homo sapiens
agagaggagguaguuaagggaug

SEQ ID NO: 1216043 - RNA, 16 nt, Homo sapiens
agagaggccugugcua

SEQ ID NO: 1216044 - RNA, 23 nt, Homo sapiens
agagagucgcaucucagugcagg

SEQ ID NO: 1216045 - RNA, 20 nt, Homo sapiens
agagaucagcgacccugagg

SEQ ID NO: 1216046 - RNA, 19 nt, Homo sapiens
agagaucuuucuuuccaaa

SEQ ID NO: 1216047 - RNA, 16 nt, Homo sapiens
agagaugggacuagga

SEQ ID NO: 1216048 - RNA, 16 nt, Homo sapiens
agagauucccaagcca

SEQ ID NO: 1216049 - RNA, 17 nt, Homo sapiens
agagcaaaucuaugaga

SEQ ID NO: 1216050 - RNA, 13 nt, Homo sapiens
agagcaaaugcua

SEQ ID NO: 1216051 - RNA, 14 nt, Homo sapiens
agagcaaccucuca

SEQ ID NO: 1216052 - RNA, 21 nt, Homo sapiens
agagcaacucugagaucuaag

SEQ ID NO: 1216053 - RNA, 20 nt, Homo sapiens
agagcaagacuccaucucag

SEQ ID NO: 1216054 - RNA, 14 nt, Homo sapiens
agagcacaaacuuc

SEQ ID NO: 1216055 - RNA, 23 nt, Homo sapiens
agagcaccuuugcacaggaugcu

SEQ ID NO: 1216056 - RNA, 14 nt, Homo sapiens
agagcagaugcaga

SEQ ID NO: 1216057 - RNA, 16 nt, Homo sapiens
agagcagcuagcucuu

SEQ ID NO: 1216058 - RNA, 16 nt, Homo sapiens
agagcagcuucaguga

SEQ ID NO: 1216059 - RNA, 23 nt, Homo sapiens
agagcagcuuuaaacucagggac

SEQ ID NO: 1216060 - RNA, 14 nt, Homo sapiens
agagcaggacucca

SEQ ID NO: 1216061 - RNA, 21 nt, Homo sapiens
agagcaggcuggcagcucucc

SEQ ID NO: 1216062 - RNA, 23 nt, Homo sapiens
agagcaggcuggcagcucuccag

SEQ ID NO: 1216063 - RNA, 16 nt, Homo sapiens
agagcaggggcuccag

SEQ ID NO: 1216064 - RNA, 11 nt, Homo sapiens
agagcaugcua

SEQ ID NO: 1216065 - RNA, 16 nt, Homo sapiens
agagcaugcuauccca

SEQ ID NO: 1216066 - RNA, 22 nt, Homo sapiens
agagcauuuccaacaccacaga

SEQ ID NO: 1216067 - RNA, 20 nt, Homo sapiens
agagccagccagcauggcca

SEQ ID NO: 1216068 - RNA, 13 nt, Homo sapiens
agagccagggucu

SEQ ID NO: 1216069 - RNA, 12 nt, Homo sapiens
agagccagugaa

SEQ ID NO: 1216070 - RNA, 17 nt, Homo sapiens
agagccauaugcccuca

SEQ ID NO: 1216071 - RNA, 15 nt, Homo sapiens
agagcccacuuccau

SEQ ID NO: 1216072 - RNA, 18 nt, Homo sapiens
agagccccacuugacacu

SEQ ID NO: 1216073 - RNA, 23 nt, Homo sapiens
agagcccuguggccgacucugca

SEQ ID NO: 1216074 - RNA, 13 nt, Homo sapiens
agagcccuugccu

SEQ ID NO: 1216075 - RNA, 19 nt, Homo sapiens
agagcccuugccuccccau

SEQ ID NO: 1216076 - RNA, 17 nt, Homo sapiens
agagccugagucacugg

SEQ ID NO: 1216077 - RNA, 18 nt, Homo sapiens
agagccuucaagugccaa

SEQ ID NO: 1216078 - RNA, 21 nt, Homo sapiens
agagccuucugaugucucuaa

SEQ ID NO: 1216079 - RNA, 18 nt, Homo sapiens
agagcgaggaaaggauuu

SEQ ID NO: 1216080 - RNA, 23 nt, Homo sapiens
agagcuaagggugggugcucaga

SEQ ID NO: 1216081 - RNA, 18 nt, Homo sapiens
agagcuaguuuucagcug

SEQ ID NO: 1216082 - RNA, 20 nt, Homo sapiens
agagcuauugccaaccaguu

SEQ ID NO: 1216083 - RNA, 16 nt, Homo sapiens
agagcugggugucaag

SEQ ID NO: 1216084 - RNA, 12 nt, Homo sapiens
agagcugucacu

SEQ ID NO: 1216085 - RNA, 22 nt, Homo sapiens
agagcuuguaauaaauacugca

SEQ ID NO: 1216086 - RNA, 12 nt, Homo sapiens
agagcuuuggua

SEQ ID NO: 1216087 - RNA, 22 nt, Homo sapiens
agaggaaaaguaaggugcaguu

SEQ ID NO: 1216088 - RNA, 22 nt, Homo sapiens
agaggaaaccaguuuggugaua

SEQ ID NO: 1216089 - RNA, 13 nt, Homo sapiens
agaggaaagaccu

SEQ ID NO: 1216090 - RNA, 19 nt, Homo sapiens
agaggaaagagucuucaac

SEQ ID NO: 1216091 - RNA, 16 nt, Homo sapiens
agaggaacagcacugg

SEQ ID NO: 1216092 - RNA, 13 nt, Homo sapiens
agaggaauccaug

SEQ ID NO: 1216093 - RNA, 15 nt, Homo sapiens
agaggaauccaugua

SEQ ID NO: 1216094 - RNA, 13 nt, Homo sapiens
agaggaauccugg

SEQ ID NO: 1216095 - RNA, 13 nt, Homo sapiens
agaggacuguguu

SEQ ID NO: 1216096 - RNA, 12 nt, Homo sapiens
agaggagcauga

SEQ ID NO: 1216097 - RNA, 19 nt, Homo sapiens
agaggagccaccaguucuc

SEQ ID NO: 1216098 - RNA, 15 nt, Homo sapiens
agaggagccagacag

SEQ ID NO: 1216099 - RNA, 14 nt, Homo sapiens
agaggagugugaag

SEQ ID NO: 1216100 - RNA, 22 nt, Homo sapiens
agaggauaaggaggcacugcug

SEQ ID NO: 1216101 - RNA, 14 nt, Homo sapiens
agaggaugaaugua

SEQ ID NO: 1216102 - RNA, 23 nt, Homo sapiens
agaggaugaauguaugugcacug

SEQ ID NO: 1216103 - RNA, 20 nt, Homo sapiens
agaggcagcuucaagugccu

SEQ ID NO: 1216104 - RNA, 19 nt, Homo sapiens
agaggcauccugccugggu

SEQ ID NO: 1216105 - RNA, 19 nt, Homo sapiens
agaggcccaagugcaaaag

SEQ ID NO: 1216106 - RNA, 14 nt, Homo sapiens
agaggccugugcua

SEQ ID NO: 1216107 - RNA, 18 nt, Homo sapiens
agaggcgagaugagccca

SEQ ID NO: 1216108 - RNA, 20 nt, Homo sapiens
agaggcgcccuggguggugg

SEQ ID NO: 1216109 - RNA, 22 nt, Homo sapiens
agaggcuauuauuuucacugua

SEQ ID NO: 1216110 - RNA, 13 nt, Homo sapiens
agaggcugagaca

SEQ ID NO: 1216111 - RNA, 23 nt, Homo sapiens
agaggcugaggugagaggaucag

SEQ ID NO: 1216112 - RNA, 11 nt, Homo sapiens
agaggcugcug

SEQ ID NO: 1216113 - RNA, 18 nt, Homo sapiens
agagggaaggucucagga

SEQ ID NO: 1216114 - RNA, 22 nt, Homo sapiens
agagggacagaugaaugccgug

SEQ ID NO: 1216115 - RNA, 17 nt, Homo sapiens
agagggaccauguguca

SEQ ID NO: 1216116 - RNA, 15 nt, Homo sapiens
agagggaggucacug

SEQ ID NO: 1216117 - RNA, 13 nt, Homo sapiens
agagggaugcuug

SEQ ID NO: 1216118 - RNA, 23 nt, Homo sapiens
agaggggcagccaggacaucucu

SEQ ID NO: 1216119 - RNA, 22 nt, Homo sapiens
agagggggcgauauagagaaua

SEQ ID NO: 1216120 - RNA, 13 nt, Homo sapiens
agaggugcuucug

SEQ ID NO: 1216121 - RNA, 21 nt, Homo sapiens
agaggugcuucugccugugca

SEQ ID NO: 1216122 - RNA, 17 nt, Homo sapiens
agagguggagugucaca

SEQ ID NO: 1216123 - RNA, 12 nt, Homo sapiens
agagguuugcuu

SEQ ID NO: 1216124 - RNA, 17 nt, Homo sapiens
agaguagcaacaaaagg

SEQ ID NO: 1216125 - RNA, 16 nt, Homo sapiens
agaguauaugcacuuu

SEQ ID NO: 1216126 - RNA, 15 nt, Homo sapiens
agaguauccuaccca

SEQ ID NO: 1216127 - RNA, 20 nt, Homo sapiens
agagucaacaggucacuuga

SEQ ID NO: 1216128 - RNA, 12 nt, Homo sapiens
agagucacugau

SEQ ID NO: 1216129 - RNA, 14 nt, Homo sapiens
agagucgcaucuca

SEQ ID NO: 1216130 - RNA, 21 nt, Homo sapiens
agagucgcaucucagugcagg

SEQ ID NO: 1216131 - RNA, 15 nt, Homo sapiens
agagucuaccuugaa

SEQ ID NO: 1216132 - RNA, 17 nt, Homo sapiens
agagugaaaccaugacu

SEQ ID NO: 1216133 - RNA, 15 nt, Homo sapiens
agagugaauuugacc

SEQ ID NO: 1216134 - RNA, 16 nt, Homo sapiens
agagugagagggcaug

SEQ ID NO: 1216135 - RNA, 21 nt, Homo sapiens
agagugccguaacaacugugg

SEQ ID NO: 1216136 - RNA, 19 nt, Homo sapiens
agagugcuccuguauugaa

SEQ ID NO: 1216137 - RNA, 20 nt, Homo sapiens
agagugcuggacuguuccag

SEQ ID NO: 1216138 - RNA, 19 nt, Homo sapiens
agaguggucuuucuggaga

SEQ ID NO: 1216139 - RNA, 14 nt, Homo sapiens
agaguguagcugua

SEQ ID NO: 1216140 - RNA, 14 nt, Homo sapiens
agagugucucaggg

SEQ ID NO: 1216141 - RNA, 15 nt, Homo sapiens
agaguguucccugac

SEQ ID NO: 1216142 - RNA, 22 nt, Homo sapiens
agaguguuucuuccacaacaga

SEQ ID NO: 1216143 - RNA, 18 nt, Homo sapiens
agaguuaaauaugcaucu

SEQ ID NO: 1216144 - RNA, 15 nt, Homo sapiens
agaguuaaaucucaa

SEQ ID NO: 1216145 - RNA, 14 nt, Homo sapiens
agauaaaccaauaa

SEQ ID NO: 1216146 - RNA, 20 nt, Homo sapiens
agauaaaccaauaaauccac

SEQ ID NO: 1216147 - RNA, 13 nt, Homo sapiens
agauaaaugugcu

SEQ ID NO: 1216148 - RNA, 18 nt, Homo sapiens
agauaaauucaugcacuu

SEQ ID NO: 1216149 - RNA, 19 nt, Homo sapiens
agauaaccucaagucacau

SEQ ID NO: 1216150 - RNA, 17 nt, Homo sapiens
agauaacucaagaaauc

SEQ ID NO: 1216151 - RNA, 21 nt, Homo sapiens
agauaacuugagcaccgucau

SEQ ID NO: 1216152 - RNA, 18 nt, Homo sapiens
agauaaucagugugucua

SEQ ID NO: 1216153 - RNA, 19 nt, Homo sapiens
agauaaucagugugucuaa

SEQ ID NO: 1216154 - RNA, 16 nt, Homo sapiens
agauacaagucaucca

SEQ ID NO: 1216155 - RNA, 14 nt, Homo sapiens
agauacaucacugc

SEQ ID NO: 1216156 - RNA, 21 nt, Homo sapiens
agauacaugguugugaccuga

SEQ ID NO: 1216157 - RNA, 15 nt, Homo sapiens
agauacauguugccu

SEQ ID NO: 1216158 - RNA, 12 nt, Homo sapiens
agauacauuucc

SEQ ID NO: 1216159 - RNA, 20 nt, Homo sapiens
agauacauuuuuagaaauca

SEQ ID NO: 1216160 - RNA, 20 nt, Homo sapiens
agauaccggugcuucuggaa

SEQ ID NO: 1216161 - RNA, 13 nt, Homo sapiens
agauacggcccau

SEQ ID NO: 1216162 - RNA, 19 nt, Homo sapiens
agauacucauuagugacuu

SEQ ID NO: 1216163 - RNA, 14 nt, Homo sapiens
agauagacaaucac

SEQ ID NO: 1216164 - RNA, 15 nt, Homo sapiens
agauagagugaaaua

SEQ ID NO: 1216165 - RNA, 16 nt, Homo sapiens
agauagauauaugcuc

SEQ ID NO: 1216166 - RNA, 17 nt, Homo sapiens
agauaggacaacacugc

SEQ ID NO: 1216167 - RNA, 20 nt, Homo sapiens
agauaguugauucuugccuu

SEQ ID NO: 1216168 - RNA, 23 nt, Homo sapiens
acagaaaagacucugaccagaga

SEQ ID NO: 1216169 - RNA, 14 nt, Homo sapiens
acagaaacugaugc

SEQ ID NO: 1216170 - RNA, 21 nt, Homo sapiens
acagaaagagacuccgucuca

SEQ ID NO: 1216171 - RNA, 20 nt, Homo sapiens
acagaaagccugggugacau

SEQ ID NO: 1216172 - RNA, 21 nt, Homo sapiens
acagaaaguucuuaaacucag

SEQ ID NO: 1216173 - RNA, 13 nt, Homo sapiens
acagaacauuuau

SEQ ID NO: 1216174 - RNA, 12 nt, Homo sapiens
acagaacuugaa

SEQ ID NO: 1216175 - RNA, 19 nt, Homo sapiens
acagaagagaaggaagcca

SEQ ID NO: 1216176 - RNA, 16 nt, Homo sapiens
acagaagcucaucuca

SEQ ID NO: 1216177 - RNA, 22 nt, Homo sapiens
acagaagcuuaaaaucugugaa

SEQ ID NO: 1216178 - RNA, 23 nt, Homo sapiens
acagaagcuucugcccaccuacu

SEQ ID NO: 1216179 - RNA, 16 nt, Homo sapiens
acagaagucuccucaa

SEQ ID NO: 1216180 - RNA, 14 nt, Homo sapiens
acagaauagcacaa

SEQ ID NO: 1216181 - RNA, 20 nt, Homo sapiens
acagacaccaaguuccguca

SEQ ID NO: 1216182 - RNA, 20 nt, Homo sapiens
acagacacuggcauggauau

SEQ ID NO: 1216183 - RNA, 13 nt, Homo sapiens
acagacaggaaag

SEQ ID NO: 1216184 - RNA, 18 nt, Homo sapiens
acagacaucuaauguucu

SEQ ID NO: 1216185 - RNA, 18 nt, Homo sapiens
acagaccaccuuucacaa

SEQ ID NO: 1216186 - RNA, 13 nt, Homo sapiens
acagaccagugac

SEQ ID NO: 1216187 - RNA, 10 nt, Homo sapiens
acagacuccg

SEQ ID NO: 1216188 - RNA, 21 nt, Homo sapiens
acagacuggcaauaaacuccu

SEQ ID NO: 1216189 - RNA, 19 nt, Homo sapiens
acagacuucaucauugugc

SEQ ID NO: 1216190 - RNA, 16 nt, Homo sapiens
acagacuugaaugcua

SEQ ID NO: 1216191 - RNA, 17 nt, Homo sapiens
acagagaagaccaaagc

SEQ ID NO: 1216192 - RNA, 17 nt, Homo sapiens
acagagacaggcccaag

SEQ ID NO: 1216193 - RNA, 13 nt, Homo sapiens
acagagacucaga

SEQ ID NO: 1216194 - RNA, 23 nt, Homo sapiens
acagagaugcgaaccacccaaaa

SEQ ID NO: 1216195 - RNA, 16 nt, Homo sapiens
acagagauugaacucc

SEQ ID NO: 1216196 - RNA, 14 nt, Homo sapiens
acagagcagccagg

SEQ ID NO: 1216197 - RNA, 18 nt, Homo sapiens
acagagccaaaaugccau

SEQ ID NO: 1216198 - RNA, 20 nt, Homo sapiens
acagagcgagagucugucuc

SEQ ID NO: 1216199 - RNA, 12 nt, Homo sapiens
acagagcuccug

SEQ ID NO: 1216200 - RNA, 17 nt, Homo sapiens
acagagcugaagaacuu

SEQ ID NO: 1216201 - RNA, 15 nt, Homo sapiens
acagaggcgaaggca

SEQ ID NO: 1216202 - RNA, 17 nt, Homo sapiens
acagagggagagacuaa

SEQ ID NO: 1216203 - RNA, 17 nt, Homo sapiens
acagagggcaggcacuc

SEQ ID NO: 1216204 - RNA, 15 nt, Homo sapiens
acagagggcugcauu

SEQ ID NO: 1216205 - RNA, 19 nt, Homo sapiens
acagaguagaaacucaaaa

SEQ ID NO: 1216206 - RNA, 16 nt, Homo sapiens
acagaucuaucuccuc

SEQ ID NO: 1216207 - RNA, 21 nt, Homo sapiens
acagaucuuuacucuugagaa

SEQ ID NO: 1216208 - RNA, 16 nt, Homo sapiens
acagaugauacuucca

SEQ ID NO: 1216209 - RNA, 18 nt, Homo sapiens
acagaugugaaaauauac

SEQ ID NO: 1216210 - RNA, 19 nt, Homo sapiens
acagauugucuuauuacag

SEQ ID NO: 1216211 - RNA, 15 nt, Homo sapiens
acagauuugcuccua

SEQ ID NO: 1216212 - RNA, 15 nt, Homo sapiens
acagauuuuaauugu

SEQ ID NO: 1216213 - RNA, 14 nt, Homo sapiens
acagcaaacaggug

SEQ ID NO: 1216214 - RNA, 18 nt, Homo sapiens
acagcaaauaacagucug

SEQ ID NO: 1216215 - RNA, 21 nt, Homo sapiens
acagcaaccucuucaugagcu

SEQ ID NO: 1216216 - RNA, 20 nt, Homo sapiens
acagcaagacuccgucucaa

SEQ ID NO: 1216217 - RNA, 17 nt, Homo sapiens
acagcaauggugucagu

SEQ ID NO: 1216218 - RNA, 12 nt, Homo sapiens
acagcacuggcu

SEQ ID NO: 1216219 - RNA, 20 nt, Homo sapiens
acagcacuggcucucuccag

SEQ ID NO: 1216220 - RNA, 16 nt, Homo sapiens
acagcacuggggaguc

SEQ ID NO: 1216221 - RNA, 18 nt, Homo sapiens
acagcagggacaagauac

SEQ ID NO: 1216222 - RNA, 22 nt, Homo sapiens
acagcaugggccucaccuccuc

SEQ ID NO: 1216223 - RNA, 13 nt, Homo sapiens
acagcauguguau

SEQ ID NO: 1216224 - RNA, 16 nt, Homo sapiens
acagcauuaacugucu

SEQ ID NO: 1216225 - RNA, 17 nt, Homo sapiens
acagcauucuugucaca

SEQ ID NO: 1216226 - RNA, 15 nt, Homo sapiens
acagccaagcaccuc

SEQ ID NO: 1216227 - RNA, 15 nt, Homo sapiens
acagccaagugugac

SEQ ID NO: 1216228 - RNA, 18 nt, Homo sapiens
acagccaccguuucuucc

SEQ ID NO: 1216229 - RNA, 22 nt, Homo sapiens
acagccaccguuucuuccugcc

SEQ ID NO: 1216230 - RNA, 19 nt, Homo sapiens
acagccagguuagccuuug

SEQ ID NO: 1216231 - RNA, 17 nt, Homo sapiens
acagcccaggcaucucc

SEQ ID NO: 1216232 - RNA, 19 nt, Homo sapiens
acagcccaggcaucuccuu

SEQ ID NO: 1216233 - RNA, 18 nt, Homo sapiens
acagccccagucuuccuu

SEQ ID NO: 1216234 - RNA, 18 nt, Homo sapiens
acagcccuuaugcgguua

SEQ ID NO: 1216235 - RNA, 20 nt, Homo sapiens
acagccugagucaccugcag

SEQ ID NO: 1216236 - RNA, 23 nt, Homo sapiens
acagccuggccccugugcaccga

SEQ ID NO: 1216237 - RNA, 18 nt, Homo sapiens
acagcgagggcagcugcu

SEQ ID NO: 1216238 - RNA, 17 nt, Homo sapiens
acagcgcuaaggauggu

SEQ ID NO: 1216239 - RNA, 16 nt, Homo sapiens
acagcuacagcuuucu

SEQ ID NO: 1216240 - RNA, 21 nt, Homo sapiens
acagcuacucuccccacgagg

SEQ ID NO: 1216241 - RNA, 20 nt, Homo sapiens
acagcuaucgaacuucacaa

SEQ ID NO: 1216242 - RNA, 18 nt, Homo sapiens
acagcucagccacuguga

SEQ ID NO: 1216243 - RNA, 16 nt, Homo sapiens
acagcuccuucugucc

SEQ ID NO: 1216244 - RNA, 20 nt, Homo sapiens
acagcucuuaaauguagcaa

SEQ ID NO: 1216245 - RNA, 17 nt, Homo sapiens
acagcugaaagauugau

SEQ ID NO: 1216246 - RNA, 22 nt, Homo sapiens
acagcuguaguaccccaagaag

SEQ ID NO: 1216247 - RNA, 23 nt, Homo sapiens
acagcuuuaucuccccaggagca

SEQ ID NO: 1216248 - RNA, 17 nt, Homo sapiens
agauaucagagcucuua

SEQ ID NO: 1216249 - RNA, 18 nt, Homo sapiens
agauaucaugaugugcaa

SEQ ID NO: 1216250 - RNA, 11 nt, Homo sapiens
agauaugauau

SEQ ID NO: 1216251 - RNA, 15 nt, Homo sapiens
agauauggcacuucu

SEQ ID NO: 1216252 - RNA, 16 nt, Homo sapiens
agauauggcauugcac

SEQ ID NO: 1216253 - RNA, 21 nt, Homo sapiens
agauauguauucuuuucucag

SEQ ID NO: 1216254 - RNA, 12 nt, Homo sapiens
agauauuacuuu

SEQ ID NO: 1216255 - RNA, 20 nt, Homo sapiens
agauauugaugauaacacuu

SEQ ID NO: 1216256 - RNA, 22 nt, Homo sapiens
agauauugucagaguucugcuc

SEQ ID NO: 1216257 - RNA, 12 nt, Homo sapiens
agauauuucaca

SEQ ID NO: 1216258 - RNA, 22 nt, Homo sapiens
agauauuugguaccauggugua

SEQ ID NO: 1216259 - RNA, 22 nt, Homo sapiens
agaucaaaauaaaaagugacac

SEQ ID NO: 1216260 - RNA, 20 nt, Homo sapiens
agaucaaacaugcauggaug

SEQ ID NO: 1216261 - RNA, 14 nt, Homo sapiens
agaucaacucuguc

SEQ ID NO: 1216262 - RNA, 18 nt, Homo sapiens
agaucacgccacugcacu

SEQ ID NO: 1216263 - RNA, 21 nt, Homo sapiens
agaucacgcuccccgccuguu

SEQ ID NO: 1216264 - RNA, 13 nt, Homo sapiens
agaucacugccac

SEQ ID NO: 1216265 - RNA, 15 nt, Homo sapiens
agaucacugccacac

SEQ ID NO: 1216266 - RNA, 15 nt, Homo sapiens
agaucagaacaugaa

SEQ ID NO: 1216267 - RNA, 16 nt, Homo sapiens
agaucagaacaugaaa

SEQ ID NO: 1216268 - RNA, 20 nt, Homo sapiens
agaucaguauuucacugaua

SEQ ID NO: 1216269 - RNA, 14 nt, Homo sapiens
agaucaucagucac

SEQ ID NO: 1216270 - RNA, 11 nt, Homo sapiens
agaucaugaca

SEQ ID NO: 1216271 - RNA, 14 nt, Homo sapiens
agauccagcagcug

SEQ ID NO: 1216272 - RNA, 22 nt, Homo sapiens
agauccugcagaaguacuccua

SEQ ID NO: 1216273 - RNA, 20 nt, Homo sapiens
agauccuggagugauaugau

SEQ ID NO: 1216274 - RNA, 16 nt, Homo sapiens
agauccuggguacuga

SEQ ID NO: 1216275 - RNA, 20 nt, Homo sapiens
agaucgagaccauccuggcu

SEQ ID NO: 1216276 - RNA, 18 nt, Homo sapiens
agaucgcaccacugcacu

SEQ ID NO: 1216277 - RNA, 16 nt, Homo sapiens
agaucgcaguuugccu

SEQ ID NO: 1216278 - RNA, 18 nt, Homo sapiens
agaucuaaggaugucaca

SEQ ID NO: 1216279 - RNA, 23 nt, Homo sapiens
agaucuuucaggacucuaccuca

SEQ ID NO: 1216280 - RNA, 17 nt, Homo sapiens
agaugaacugacugaag

SEQ ID NO: 1216281 - RNA, 19 nt, Homo sapiens
agaugaaucauugauugaa

SEQ ID NO: 1216282 - RNA, 13 nt, Homo sapiens
agaugacugucca

SEQ ID NO: 1216283 - RNA, 22 nt, Homo sapiens
agaugagguucugagaccagug

SEQ ID NO: 1216284 - RNA, 21 nt, Homo sapiens
agaugaguaauuucuuuggca

SEQ ID NO: 1216285 - RNA, 17 nt, Homo sapiens
agaugauggaugccaau

SEQ ID NO: 1216286 - RNA, 14 nt, Homo sapiens
agaugcaucacugg

SEQ ID NO: 1216287 - RNA, 17 nt, Homo sapiens
agaugcauccuuucaua

SEQ ID NO: 1216288 - RNA, 17 nt, Homo sapiens
agaugccagggcuggaa

SEQ ID NO: 1216289 - RNA, 18 nt, Homo sapiens
agaugcccccuccaggag

SEQ ID NO: 1216290 - RNA, 18 nt, Homo sapiens
agaugccuacaaccaucc

SEQ ID NO: 1216291 - RNA, 19 nt, Homo sapiens
agaugccugugaaauagua

SEQ ID NO: 1216292 - RNA, 16 nt, Homo sapiens
agaugcuccaagauuc

SEQ ID NO: 1216293 - RNA, 20 nt, Homo sapiens
agaugcugguuuucuaccca

SEQ ID NO: 1216294 - RNA, 15 nt, Homo sapiens
agaugcuugguugug

SEQ ID NO: 1216295 - RNA, 19 nt, Homo sapiens
agauggaaugcuguguuaa

SEQ ID NO: 1216296 - RNA, 21 nt, Homo sapiens
agauggagucuggcucugucu

SEQ ID NO: 1216297 - RNA, 20 nt, Homo sapiens
agauggcauaaccugucuca

SEQ ID NO: 1216298 - RNA, 21 nt, Homo sapiens
agaugggcaaaagacgggaag

SEQ ID NO: 1216299 - RNA, 21 nt, Homo sapiens
agauggggucucacaguguug

SEQ ID NO: 1216300 - RNA, 15 nt, Homo sapiens
agaugggugucacuu

SEQ ID NO: 1216301 - RNA, 17 nt, Homo sapiens
agaugguaacagauuug

SEQ ID NO: 1216302 - RNA, 21 nt, Homo sapiens
agaugguaccgugcaucgcac

SEQ ID NO: 1216303 - RNA, 16 nt, Homo sapiens
agauguauauauuucc

SEQ ID NO: 1216304 - RNA, 22 nt, Homo sapiens
agaugucauuuaguucagcauc

SEQ ID NO: 1216305 - RNA, 16 nt, Homo sapiens
agaugucuaagacagg

SEQ ID NO: 1216306 - RNA, 21 nt, Homo sapiens
agaugucuucugccuguuaua

SEQ ID NO: 1216307 - RNA, 21 nt, Homo sapiens
agaugugacccaccagugccu

SEQ ID NO: 1216308 - RNA, 22 nt, Homo sapiens
agaugugauuuggaccauggca

SEQ ID NO: 1216309 - RNA, 15 nt, Homo sapiens
agaugugcauuucac

SEQ ID NO: 1216310 - RNA, 18 nt, Homo sapiens
agauguggaacaacagca

SEQ ID NO: 1216311 - RNA, 16 nt, Homo sapiens
aguaagcugcucuauu

SEQ ID NO: 1216312 - RNA, 13 nt, Homo sapiens
aguaaguacgugu

SEQ ID NO: 1216313 - RNA, 22 nt, Homo sapiens
aguaaguuugauuucauuaaua

SEQ ID NO: 1216314 - RNA, 23 nt, Homo sapiens
aguaauaaaacaucuuuccaguc

SEQ ID NO: 1216315 - RNA, 13 nt, Homo sapiens
aguaaucuguaca

SEQ ID NO: 1216316 - RNA, 21 nt, Homo sapiens
aguaaucuuuggcuguaaggc

SEQ ID NO: 1216317 - RNA, 17 nt, Homo sapiens
aguaauuccuguuacuu

SEQ ID NO: 1216318 - RNA, 17 nt, Homo sapiens
aguaauuuuuaugaaau

SEQ ID NO: 1216319 - RNA, 14 nt, Homo sapiens
aguacagacagaag

SEQ ID NO: 1216320 - RNA, 20 nt, Homo sapiens
aguacagcaugugccuuaau

SEQ ID NO: 1216321 - RNA, 18 nt, Homo sapiens
aguaccacacauauugca

SEQ ID NO: 1216322 - RNA, 22 nt, Homo sapiens
aguaccacacugaguucuauca

SEQ ID NO: 1216323 - RNA, 19 nt, Homo sapiens
aguaccauaaucuuagaga

SEQ ID NO: 1216324 - RNA, 10 nt, Homo sapiens
aguaccccau

SEQ ID NO: 1216325 - RNA, 20 nt, Homo sapiens
aguaccccugguaaaccaag

SEQ ID NO: 1216326 - RNA, 21 nt, Homo sapiens
aguaccccugguaaaccaagc

SEQ ID NO: 1216327 - RNA, 18 nt, Homo sapiens
aguaccuacaucagucaa

SEQ ID NO: 1216328 - RNA, 11 nt, Homo sapiens
aguaccugcug

SEQ ID NO: 1216329 - RNA, 17 nt, Homo sapiens
aguaccuucaauacuua

SEQ ID NO: 1216330 - RNA, 22 nt, Homo sapiens
aguacugcacccagcaguguca

SEQ ID NO: 1216331 - RNA, 19 nt, Homo sapiens
aguacugggacaaccucau

SEQ ID NO: 1216332 - RNA, 17 nt, Homo sapiens
aguacuuaaacuuccac

SEQ ID NO: 1216333 - RNA, 23 nt, Homo sapiens
aguacuuaauaaacuguggugcu

SEQ ID NO: 1216334 - RNA, 16 nt, Homo sapiens
aguacuuauguugcac

SEQ ID NO: 1216335 - RNA, 21 nt, Homo sapiens
aguacuuccugcaguacaaga

SEQ ID NO: 1216336 - RNA, 23 nt, Homo sapiens
aguacuugggaggccaaggcagg

SEQ ID NO: 1216337 - RNA, 22 nt, Homo sapiens
aguacuuggguuugcaacagcu

SEQ ID NO: 1216338 - RNA, 15 nt, Homo sapiens
aguacuuuaccuccu

SEQ ID NO: 1216339 - RNA, 16 nt, Homo sapiens
aguagaaauuuuacaa

SEQ ID NO: 1216340 - RNA, 16 nt, Homo sapiens
aguagaagauuugaug

SEQ ID NO: 1216341 - RNA, 14 nt, Homo sapiens
aguagaauccuaaa

SEQ ID NO: 1216342 - RNA, 13 nt, Homo sapiens
aguagacauuuau

SEQ ID NO: 1216343 - RNA, 21 nt, Homo sapiens
aguagagcagccacaaccaaa

SEQ ID NO: 1216344 - RNA, 21 nt, Homo sapiens
aguagagcuuguaauaaauac

SEQ ID NO: 1216345 - RNA, 18 nt, Homo sapiens
aguagauauugauuacua

SEQ ID NO: 1216346 - RNA, 12 nt, Homo sapiens
aguagcaauuuc

SEQ ID NO: 1216347 - RNA, 16 nt, Homo sapiens
aguagcagugucugua

SEQ ID NO: 1216348 - RNA, 16 nt, Homo sapiens
aguagcauacauuuau

SEQ ID NO: 1216349 - RNA, 20 nt, Homo sapiens
aguagcugggacuacaggca

SEQ ID NO: 1216350 - RNA, 15 nt, Homo sapiens
aguaggauccaguga

SEQ ID NO: 1216351 - RNA, 18 nt, Homo sapiens
aguaggcuuuuaccauua

SEQ ID NO: 1216352 - RNA, 22 nt, Homo sapiens
aguaguaaauuuugugaugaau

SEQ ID NO: 1216353 - RNA, 15 nt, Homo sapiens
aguagucuugaugac

SEQ ID NO: 1216354 - RNA, 21 nt, Homo sapiens
aguagugacacacagacucua

SEQ ID NO: 1216355 - RNA, 23 nt, Homo sapiens
aguaguuuuuacagcuguguuau

SEQ ID NO: 1216356 - RNA, 18 nt, Homo sapiens
aguauaagcaucugccau

SEQ ID NO: 1216357 - RNA, 23 nt, Homo sapiens
aguauagccacaaaugccuugaa

SEQ ID NO: 1216358 - RNA, 20 nt, Homo sapiens
aguauauucuuugguuguga

SEQ ID NO: 1216359 - RNA, 17 nt, Homo sapiens
aguaucacacuguauau

SEQ ID NO: 1216360 - RNA, 23 nt, Homo sapiens
aguaucaggucugaccccagugg

SEQ ID NO: 1216361 - RNA, 12 nt, Homo sapiens
aguauccacaau

SEQ ID NO: 1216362 - RNA, 12 nt, Homo sapiens
aguaucuuaccu

SEQ ID NO: 1216363 - RNA, 13 nt, Homo sapiens
aguaucuuaccug

SEQ ID NO: 1216364 - RNA, 22 nt, Homo sapiens
aguaugcuuaaugguagcaacu

SEQ ID NO: 1216365 - RNA, 20 nt, Homo sapiens
aguauggcuccuccauaucu

SEQ ID NO: 1216366 - RNA, 23 nt, Homo sapiens
aguauuccuuuauacacagugga

SEQ ID NO: 1216367 - RNA, 18 nt, Homo sapiens
aguauucuuaguuguuca

SEQ ID NO: 1216368 - RNA, 23 nt, Homo sapiens
aguauugaaauguuugcauaaag

SEQ ID NO: 1216369 - RNA, 15 nt, Homo sapiens
aguauugcaugcuca

SEQ ID NO: 1216370 - RNA, 17 nt, Homo sapiens
aguauuuaggaaauggg

SEQ ID NO: 1216371 - RNA, 22 nt, Homo sapiens
aguauuuauugcaggauggugu

SEQ ID NO: 1216372 - RNA, 23 nt, Homo sapiens
aguauuuauugcaggaugguguc

SEQ ID NO: 1216373 - RNA, 22 nt, Homo sapiens
aguauuugcugaauggggaccu

SEQ ID NO: 1216374 - RNA, 12 nt, Homo sapiens
aguauuuggacu

SEQ ID NO: 1216375 - RNA, 21 nt, Homo sapiens
agugcaggguggacaucaccu

SEQ ID NO: 1216376 - RNA, 15 nt, Homo sapiens
agugcaguggcacca

SEQ ID NO: 1216377 - RNA, 23 nt, Homo sapiens
agugcaguggcgugaucuuggcu

SEQ ID NO: 1216378 - RNA, 20 nt, Homo sapiens
agugcaguggugugaucucg

SEQ ID NO: 1216379 - RNA, 12 nt, Homo sapiens
agugcauuugcc

SEQ ID NO: 1216380 - RNA, 17 nt, Homo sapiens
agugccaauauuucuga

SEQ ID NO: 1216381 - RNA, 18 nt, Homo sapiens
agugccaauauuucugau

SEQ ID NO: 1216382 - RNA, 16 nt, Homo sapiens
agugccacacaugccc

SEQ ID NO: 1216383 - RNA, 18 nt, Homo sapiens
agugccacaugccuacga

SEQ ID NO: 1216384 - RNA, 13 nt, Homo sapiens
agugccagcuuuc

SEQ ID NO: 1216385 - RNA, 15 nt, Homo sapiens
agugccaggccagug

SEQ ID NO: 1216386 - RNA, 18 nt, Homo sapiens
agugccauuccacuccac

SEQ ID NO: 1216387 - RNA, 21 nt, Homo sapiens
agugccauuccacuccacuca

SEQ ID NO: 1216388 - RNA, 20 nt, Homo sapiens
agugcccugcccccuggcug

SEQ ID NO: 1216389 - RNA, 14 nt, Homo sapiens
agugccggcugugg

SEQ ID NO: 1216390 - RNA, 20 nt, Homo sapiens
agugccguagggaguaccug

SEQ ID NO: 1216391 - RNA, 13 nt, Homo sapiens
agugccugagaca

SEQ ID NO: 1216392 - RNA, 13 nt, Homo sapiens
agugccugggaau

SEQ ID NO: 1216393 - RNA, 14 nt, Homo sapiens
agugccuucucuau

SEQ ID NO: 1216394 - RNA, 14 nt, Homo sapiens
agugcggcugccau

SEQ ID NO: 1216395 - RNA, 19 nt, Homo sapiens
agugcucugaugcaauagu

SEQ ID NO: 1216396 - RNA, 12 nt, Homo sapiens
agugcugcagua

SEQ ID NO: 1216397 - RNA, 23 nt, Homo sapiens
agugcugcuauaucuauccauuu

SEQ ID NO: 1216398 - RNA, 20 nt, Homo sapiens
agugcugcuggaaguagaau

SEQ ID NO: 1216399 - RNA, 19 nt, Homo sapiens
agugcuggcucacaguaca

SEQ ID NO: 1216400 - RNA, 20 nt, Homo sapiens
agugcugggauuacaggugu

SEQ ID NO: 1216401 - RNA, 21 nt, Homo sapiens
agugcugggauuacaggugug

SEQ ID NO: 1216402 - RNA, 17 nt, Homo sapiens
agugcuuaguguacuug

SEQ ID NO: 1216403 - RNA, 17 nt, Homo sapiens
agugcuucagaguuugu

SEQ ID NO: 1216404 - RNA, 14 nt, Homo sapiens
aguggaaggcauca

SEQ ID NO: 1216405 - RNA, 22 nt, Homo sapiens
aguggaucuucagaacugcccu

SEQ ID NO: 1216406 - RNA, 15 nt, Homo sapiens
aguggauuggcuuug

SEQ ID NO: 1216407 - RNA, 17 nt, Homo sapiens
aguggcaccagaggugc

SEQ ID NO: 1216408 - RNA, 19 nt, Homo sapiens
aguggcauuuccuggucag

SEQ ID NO: 1216409 - RNA, 23 nt, Homo sapiens
aguggccagccagugccauucca

SEQ ID NO: 1216410 - RNA, 14 nt, Homo sapiens
aguggccaggccac

SEQ ID NO: 1216411 - RNA, 23 nt, Homo sapiens
aguggcccuuucaacaaugucuu

SEQ ID NO: 1216412 - RNA, 15 nt, Homo sapiens
aguggcgugaucucg

SEQ ID NO: 1216413 - RNA, 21 nt, Homo sapiens
aguggcgugaucuuggcucac

SEQ ID NO: 1216414 - RNA, 18 nt, Homo sapiens
aguggcuaccuacauaca

SEQ ID NO: 1216415 - RNA, 20 nt, Homo sapiens
aguggcuaccuacauacaau

SEQ ID NO: 1216416 - RNA, 23 nt, Homo sapiens
aguggcucacgccuguaauccca

SEQ ID NO: 1216417 - RNA, 14 nt, Homo sapiens
aguggcugccaugg

SEQ ID NO: 1216418 - RNA, 14 nt, Homo sapiens
aguggcugcuucuc

SEQ ID NO: 1216419 - RNA, 19 nt, Homo sapiens
aguggcuucccagcucuga

SEQ ID NO: 1216420 - RNA, 20 nt, Homo sapiens
aguggcuucccagcucugac

SEQ ID NO: 1216421 - RNA, 17 nt, Homo sapiens
aguggcuucugggagau

SEQ ID NO: 1216422 - RNA, 17 nt, Homo sapiens
agugggaacucugacaa

SEQ ID NO: 1216423 - RNA, 20 nt, Homo sapiens
agugggagaaggcagugauu

SEQ ID NO: 1216424 - RNA, 22 nt, Homo sapiens
agugggcaggauaaacugaaaa

SEQ ID NO: 1216425 - RNA, 22 nt, Homo sapiens
agugggccccgggcuggagaaa

SEQ ID NO: 1216426 - RNA, 22 nt, Homo sapiens
agugguaaaaguauuugcuuaa

SEQ ID NO: 1216427 - RNA, 15 nt, Homo sapiens
agugguaacagcucu

SEQ ID NO: 1216428 - RNA, 19 nt, Homo sapiens
agugguauagaguacugca

SEQ ID NO: 1216429 - RNA, 16 nt, Homo sapiens
agugguauccugugac

SEQ ID NO: 1216430 - RNA, 15 nt, Homo sapiens
aguggugugaucucg

SEQ ID NO: 1216431 - RNA, 20 nt, Homo sapiens
aguggugugaucucggcuca

SEQ ID NO: 1216432 - RNA, 21 nt, Homo sapiens
agugguguguguuaucagaua

SEQ ID NO: 1216433 - RNA, 20 nt, Homo sapiens
agugguuguuuugucaugaa

SEQ ID NO: 1216434 - RNA, 14 nt, Homo sapiens
agugguuugugcua

SEQ ID NO: 1216435 - RNA, 18 nt, Homo sapiens
aguguaaaaacaaugugc

SEQ ID NO: 1216436 - RNA, 15 nt, Homo sapiens
aguguaaguucacaa

SEQ ID NO: 1216437 - RNA, 13 nt, Homo sapiens
aguguacauggaa

SEQ ID NO: 1216438 - RNA, 20 nt, Homo sapiens
aguguaguuaaggagccuaa

SEQ ID NO: 1216439 - RNA, 15 nt, Homo sapiens
aucaacugaucucau

SEQ ID NO: 1216440 - RNA, 18 nt, Homo sapiens
aucaagaaaaacaucuuu

SEQ ID NO: 1216441 - RNA, 13 nt, Homo sapiens
aucaagaaauacu

SEQ ID NO: 1216442 - RNA, 22 nt, Homo sapiens
aucaagaaauaugaagcacuuu

SEQ ID NO: 1216443 - RNA, 23 nt, Homo sapiens
aucaagaacaugucagcaauguc

SEQ ID NO: 1216444 - RNA, 14 nt, Homo sapiens
aucaagagggauaa

SEQ ID NO: 1216445 - RNA, 13 nt, Homo sapiens
aucaaggugcuga

SEQ ID NO: 1216446 - RNA, 17 nt, Homo sapiens
aucaaguccuuuaauua

SEQ ID NO: 1216447 - RNA, 14 nt, Homo sapiens
aucaagugucuucc

SEQ ID NO: 1216448 - RNA, 15 nt, Homo sapiens
aucaagugucuucca

SEQ ID NO: 1216449 - RNA, 21 nt, Homo sapiens
aucaagugugcuuuagcuuga

SEQ ID NO: 1216450 - RNA, 15 nt, Homo sapiens
aucaauaaauguugc

SEQ ID NO: 1216451 - RNA, 17 nt, Homo sapiens
aucaauaaauguugcaa

SEQ ID NO: 1216452 - RNA, 22 nt, Homo sapiens
aucaauaaauguugcaaugcau

SEQ ID NO: 1216453 - RNA, 16 nt, Homo sapiens
aucaaucugcaguuua

SEQ ID NO: 1216454 - RNA, 15 nt, Homo sapiens
aucaaugcauguuac

SEQ ID NO: 1216455 - RNA, 16 nt, Homo sapiens
aucaaugucacuuaaa

SEQ ID NO: 1216456 - RNA, 20 nt, Homo sapiens
aucaauguuuguccuguaua

SEQ ID NO: 1216457 - RNA, 23 nt, Homo sapiens
aucacacuguauauaaacauauc

SEQ ID NO: 1216458 - RNA, 23 nt, Homo sapiens
aucacagggccccagaaggcagg

SEQ ID NO: 1216459 - RNA, 15 nt, Homo sapiens
aucacauaaccuuaa

SEQ ID NO: 1216460 - RNA, 18 nt, Homo sapiens
aucacccuaccaacuuua

SEQ ID NO: 1216461 - RNA, 20 nt, Homo sapiens
aucacccucuuccugugauc

SEQ ID NO: 1216462 - RNA, 22 nt, Homo sapiens
aucaccucugauggcugaagaa

SEQ ID NO: 1216463 - RNA, 12 nt, Homo sapiens
aucacgaccacu

SEQ ID NO: 1216464 - RNA, 21 nt, Homo sapiens
aucacgccacugcacuccagc

SEQ ID NO: 1216465 - RNA, 19 nt, Homo sapiens
aucacgcuuuccugaaucc

SEQ ID NO: 1216466 - RNA, 14 nt, Homo sapiens
aucacguugcaaug

SEQ ID NO: 1216467 - RNA, 22 nt, Homo sapiens
aucacuaacauuauauugcaau

SEQ ID NO: 1216468 - RNA, 17 nt, Homo sapiens
aucacuagccaugauaa

SEQ ID NO: 1216469 - RNA, 23 nt, Homo sapiens
aucacuagccaugauaacugcaa

SEQ ID NO: 1216470 - RNA, 17 nt, Homo sapiens
aucacucuaauucggau

SEQ ID NO: 1216471 - RNA, 23 nt, Homo sapiens
aucacucuaauucggauuugcca

SEQ ID NO: 1216472 - RNA, 14 nt, Homo sapiens
aucacugccacacu

SEQ ID NO: 1216473 - RNA, 19 nt, Homo sapiens
aucacuggguguugaucuu

SEQ ID NO: 1216474 - RNA, 18 nt, Homo sapiens
aucacuucccuacaugga

SEQ ID NO: 1216475 - RNA, 18 nt, Homo sapiens
aucacuuuggcauucagu

SEQ ID NO: 1216476 - RNA, 15 nt, Homo sapiens
aucagaaaaguaauu

SEQ ID NO: 1216477 - RNA, 16 nt, Homo sapiens
aucagaaaugucauca

SEQ ID NO: 1216478 - RNA, 14 nt, Homo sapiens
aucagacagagauu

SEQ ID NO: 1216479 - RNA, 14 nt, Homo sapiens
aucagacucuguaa

SEQ ID NO: 1216480 - RNA, 16 nt, Homo sapiens
aucagagaacuuuccc

SEQ ID NO: 1216481 - RNA, 24 nt, Homo sapiens
aucagagagcugcccuucagcgau

SEQ ID NO: 1216482 - RNA, 15 nt, Homo sapiens
aucagagaguguaca

SEQ ID NO: 1216483 - RNA, 12 nt, Homo sapiens
aucagaguugcu

SEQ ID NO: 1216484 - RNA, 16 nt, Homo sapiens
aucagauaccuguggg

SEQ ID NO: 1216485 - RNA, 17 nt, Homo sapiens
aucagcaggaguaauaa

SEQ ID NO: 1216486 - RNA, 15 nt, Homo sapiens
aucagccagcaagag

SEQ ID NO: 1216487 - RNA, 11 nt, Homo sapiens
aucagccagga

SEQ ID NO: 1216488 - RNA, 12 nt, Homo sapiens
aucagccaguga

SEQ ID NO: 1216489 - RNA, 12 nt, Homo sapiens
aucagcuuugua

SEQ ID NO: 1216490 - RNA, 20 nt, Homo sapiens
aucaggaaaacaaaucacug

SEQ ID NO: 1216491 - RNA, 20 nt, Homo sapiens
aucaggaaggaaaugacacc

SEQ ID NO: 1216492 - RNA, 14 nt, Homo sapiens
aucagggaauccag

SEQ ID NO: 1216493 - RNA, 18 nt, Homo sapiens
aucagggucuaagcaccu

SEQ ID NO: 1216494 - RNA, 23 nt, Homo sapiens
aucagucaacaacuuacacuuau

SEQ ID NO: 1216495 - RNA, 15 nt, Homo sapiens
aucagucaaugagga

SEQ ID NO: 1216496 - RNA, 20 nt, Homo sapiens
aucaguccaucccagaggga

SEQ ID NO: 1216497 - RNA, 22 nt, Homo sapiens
aucaguccaucccagagggacc

SEQ ID NO: 1216498 - RNA, 22 nt, Homo sapiens
aucaguccucgcggcucuccag

SEQ ID NO: 1216499 - RNA, 16 nt, Homo sapiens
aucagucuauccacag

SEQ ID NO: 1216500 - RNA, 17 nt, Homo sapiens
aucagugaagaugccag

SEQ ID NO: 1216501 - RNA, 21 nt, Homo sapiens
aucagugaagccaaagggacu

SEQ ID NO: 1216502 - RNA, 23 nt, Homo sapiens
aucagugacagaguucacuauaa

SEQ ID NO: 1216503 - RNA, 14 nt, Homo sapiens
aucaguguuuuaga

SEQ ID NO: 1216504 - RNA, 16 nt, Homo sapiens
aucaguugaggccagg

SEQ ID NO: 1216505 - RNA, 12 nt, Homo sapiens
aucaguuugacu

SEQ ID NO: 1216506 - RNA, 16 nt, Homo sapiens
aucauaaaacuugaug

SEQ ID NO: 1216507 - RNA, 18 nt, Homo sapiens
aucauaagcugauuugau

SEQ ID NO: 1216508 - RNA, 10 nt, Homo sapiens
aucauauuca

SEQ ID NO: 1216509 - RNA, 20 nt, Homo sapiens
aucauauuugaaaaccauau

SEQ ID NO: 1216510 - RNA, 23 nt, Homo sapiens
aucaucaaagcucacaccaaauu

SEQ ID NO: 1216511 - RNA, 17 nt, Homo sapiens
aucaucaagaaauacuu

SEQ ID NO: 1216512 - RNA, 19 nt, Homo sapiens
aucaucaaugugacauuua

SEQ ID NO: 1216513 - RNA, 13 nt, Homo sapiens
aucauccaagaca

SEQ ID NO: 1216514 - RNA, 19 nt, Homo sapiens
aucauccacugugccaugu

SEQ ID NO: 1216515 - RNA, 19 nt, Homo sapiens
aucauccagaaguuccuca

SEQ ID NO: 1216516 - RNA, 23 nt, Homo sapiens
aucaucccaggggagaacuacau

SEQ ID NO: 1216517 - RNA, 22 nt, Homo sapiens
aucaucuauaaagaagaacuug

SEQ ID NO: 1216518 - RNA, 23 nt, Homo sapiens
aucaucuccaucauaugccugac

SEQ ID NO: 1216519 - RNA, 21 nt, Homo sapiens
aucaucugucauuauauucua

SEQ ID NO: 1216520 - RNA, 12 nt, Homo sapiens
aucaucuuguuc

SEQ ID NO: 1216521 - RNA, 23 nt, Homo sapiens
aucaugaaaguccagcacuggaa

SEQ ID NO: 1216522 - RNA, 17 nt, Homo sapiens
aucaugaagcacaucaa

SEQ ID NO: 1216523 - RNA, 20 nt, Homo sapiens
aucaugccccuguacuccag

SEQ ID NO: 1216524 - RNA, 18 nt, Homo sapiens
aucaugggccagagccuc

SEQ ID NO: 1216525 - RNA, 13 nt, Homo sapiens
aucauguagaaua

SEQ ID NO: 1216526 - RNA, 23 nt, Homo sapiens
aucauguauggugauagguaucu

SEQ ID NO: 1216527 - RNA, 19 nt, Homo sapiens
aucauguuugucaauggaa

SEQ ID NO: 1216528 - RNA, 23 nt, Homo sapiens
aucauuauuuaagccguucuuau

SEQ ID NO: 1216529 - RNA, 16 nt, Homo sapiens
aucauucccucucauc

SEQ ID NO: 1216530 - RNA, 20 nt, Homo sapiens
aucauuguuuauuguauacu

SEQ ID NO: 1216531 - RNA, 15 nt, Homo sapiens
aucauuugaggaaua

SEQ ID NO: 1216532 - RNA, 21 nt, Homo sapiens
aucauuuguuuacauuugaug

SEQ ID NO: 1216533 - RNA, 16 nt, Homo sapiens
aucauuuuuguacagu

SEQ ID NO: 1216534 - RNA, 20 nt, Homo sapiens
auccaaaauauuuuuugcaa

SEQ ID NO: 1216535 - RNA, 21 nt, Homo sapiens
auccaaagaacuugauuugca

SEQ ID NO: 1216536 - RNA, 14 nt, Homo sapiens
auccaaagacugua

SEQ ID NO: 1216537 - RNA, 13 nt, Homo sapiens
auccaaccacugu

SEQ ID NO: 1216538 - RNA, 13 nt, Homo sapiens
auccaacuuccaa

SEQ ID NO: 1216539 - RNA, 15 nt, Homo sapiens
auccaagauucugcu

SEQ ID NO: 1216540 - RNA, 23 nt, Homo sapiens
auccaagcaucccuuugcccaga

SEQ ID NO: 1216541 - RNA, 18 nt, Homo sapiens
auccaauccucacugggu

SEQ ID NO: 1216542 - RNA, 20 nt, Homo sapiens
auccacaaaugaagggauau

SEQ ID NO: 1216543 - RNA, 20 nt, Homo sapiens
auccacucuucuagggauau

SEQ ID NO: 1216544 - RNA, 12 nt, Homo sapiens
auccagcacugg

SEQ ID NO: 1216545 - RNA, 14 nt, Homo sapiens
auccagcacuggug

SEQ ID NO: 1216546 - RNA, 17 nt, Homo sapiens
auccagcacuggugaac

SEQ ID NO: 1216547 - RNA, 15 nt, Homo sapiens
auccagcccaggacu

SEQ ID NO: 1216548 - RNA, 19 nt, Homo sapiens
auccagccucccacaagaa

SEQ ID NO: 1216549 - RNA, 18 nt, Homo sapiens
auccagugagcacuagaa

SEQ ID NO: 1216550 - RNA, 16 nt, Homo sapiens
auccauaaauguguuc

SEQ ID NO: 1216551 - RNA, 22 nt, Homo sapiens
auccaucacuagccaugauaac

SEQ ID NO: 1216552 - RNA, 19 nt, Homo sapiens
auccaugcaccuaccuuag

SEQ ID NO: 1216553 - RNA, 16 nt, Homo sapiens
auccauuuuacacagc

SEQ ID NO: 1216554 - RNA, 17 nt, Homo sapiens
aucccaacuacucagaa

SEQ ID NO: 1216555 - RNA, 12 nt, Homo sapiens
aucccaagagaa

SEQ ID NO: 1216556 - RNA, 20 nt, Homo sapiens
aucccaagcccugcauugua

SEQ ID NO: 1216557 - RNA, 12 nt, Homo sapiens
aucccacaucca

SEQ ID NO: 1216558 - RNA, 16 nt, Homo sapiens
aucccagcaccugccu

SEQ ID NO: 1216559 - RNA, 14 nt, Homo sapiens
aucccagcacuuug

SEQ ID NO: 1216560 - RNA, 20 nt, Homo sapiens
aucccagcagcccaagcuua

SEQ ID NO: 1216561 - RNA, 15 nt, Homo sapiens
aucccagcuacucag

SEQ ID NO: 1216562 - RNA, 11 nt, Homo sapiens
aucccaggaca

SEQ ID NO: 1216563 - RNA, 18 nt, Homo sapiens
aucccaggauuaggccau

SEQ ID NO: 1216564 - RNA, 17 nt, Homo sapiens
augaaacaaauaaucac

SEQ ID NO: 1216565 - RNA, 16 nt, Homo sapiens
augaaacauuuuguca

SEQ ID NO: 1216566 - RNA, 18 nt, Homo sapiens
augaaaccacaugagaag

SEQ ID NO: 1216567 - RNA, 20 nt, Homo sapiens
augaaacuguccaccaagau

SEQ ID NO: 1216568 - RNA, 16 nt, Homo sapiens
augaaaggaucucuga

SEQ ID NO: 1216569 - RNA, 14 nt, Homo sapiens
augaaagugacuuu

SEQ ID NO: 1216570 - RNA, 13 nt, Homo sapiens
augaaauccagug

SEQ ID NO: 1216571 - RNA, 21 nt, Homo sapiens
augaaauccagugagcacuag

SEQ ID NO: 1216572 - RNA, 15 nt, Homo sapiens
augaaaugauuggaa

SEQ ID NO: 1216573 - RNA, 20 nt, Homo sapiens
augaaauucuugaaguucau

SEQ ID NO: 1216574 - RNA, 20 nt, Homo sapiens
augaacacuuauaagugaag

SEQ ID NO: 1216575 - RNA, 17 nt, Homo sapiens
augaacauauuguugaa

SEQ ID NO: 1216576 - RNA, 21 nt, Homo sapiens
augaacaucuuuagugucuga

SEQ ID NO: 1216577 - RNA, 12 nt, Homo sapiens
augaaccuggac

SEQ ID NO: 1216578 - RNA, 20 nt, Homo sapiens
augaacuaacugacagcuuc

SEQ ID NO: 1216579 - RNA, 21 nt, Homo sapiens
augaagaugucuaauaguuau

SEQ ID NO: 1216580 - RNA, 14 nt, Homo sapiens
augaagcacaucaa

SEQ ID NO: 1216581 - RNA, 13 nt, Homo sapiens
augaagcagauuu

SEQ ID NO: 1216582 - RNA, 23 nt, Homo sapiens
augaagcagcuuuaaacaaauuc

SEQ ID NO: 1216583 - RNA, 18 nt, Homo sapiens
augaagcuuuauacgugu

SEQ ID NO: 1216584 - RNA, 18 nt, Homo sapiens
augaaguauugcuaauau

SEQ ID NO: 1216585 - RNA, 15 nt, Homo sapiens
augaauaaaacacuc

SEQ ID NO: 1216586 - RNA, 13 nt, Homo sapiens
augaauacaaauu

SEQ ID NO: 1216587 - RNA, 22 nt, Homo sapiens
augaauagaaaaaaaacaaacc

SEQ ID NO: 1216588 - RNA, 20 nt, Homo sapiens
augaauagaugugaucacug

SEQ ID NO: 1216589 - RNA, 18 nt, Homo sapiens
augaauauuuuguaacua

SEQ ID NO: 1216590 - RNA, 19 nt, Homo sapiens
augaaucaacaaaccacaa

SEQ ID NO: 1216591 - RNA, 14 nt, Homo sapiens
augaaucacaguau

SEQ ID NO: 1216592 - RNA, 15 nt, Homo sapiens
augaaucaucaaagc

SEQ ID NO: 1216593 - RNA, 22 nt, Homo sapiens
augaaucucaagauucaguaga

SEQ ID NO: 1216594 - RNA, 13 nt, Homo sapiens
augaaucugcuca

SEQ ID NO: 1216595 - RNA, 12 nt, Homo sapiens
augaaugcagug

SEQ ID NO: 1216596 - RNA, 15 nt, Homo sapiens
augaauguaugugca

SEQ ID NO: 1216597 - RNA, 16 nt, Homo sapiens
augaauguaugugcac

SEQ ID NO: 1216598 - RNA, 16 nt, Homo sapiens
augaauuaguucuccu

SEQ ID NO: 1216599 - RNA, 12 nt, Homo sapiens
augacaaaaagc

SEQ ID NO: 1216600 - RNA, 18 nt, Homo sapiens
augacaaacacacaucca

SEQ ID NO: 1216601 - RNA, 21 nt, Homo sapiens
augacaaauguauuaaugcua

SEQ ID NO: 1216602 - RNA, 16 nt, Homo sapiens
augacaacuuugccag

SEQ ID NO: 1216603 - RNA, 17 nt, Homo sapiens
augacaauaagccacga

SEQ ID NO: 1216604 - RNA, 13 nt, Homo sapiens
augacaauggacc

SEQ ID NO: 1216605 - RNA, 22 nt, Homo sapiens
augacacacaaaucccauuaaa

SEQ ID NO: 1216606 - RNA, 19 nt, Homo sapiens
augacacaggcugacucau

SEQ ID NO: 1216607 - RNA, 18 nt, Homo sapiens
augacacccacccugugc

SEQ ID NO: 1216608 - RNA, 22 nt, Homo sapiens
augugucaggugacccugauga

SEQ ID NO: 1216609 - RNA, 19 nt, Homo sapiens
augugucauuggaagccau

SEQ ID NO: 1216610 - RNA, 19 nt, Homo sapiens
augugugaaaaagaugcca

SEQ ID NO: 1216611 - RNA, 14 nt, Homo sapiens
augugugaggagcu

SEQ ID NO: 1216612 - RNA, 22 nt, Homo sapiens
auguguuaggggccuggcccaa

SEQ ID NO: 1216613 - RNA, 15 nt, Homo sapiens
auguguucauucaag

SEQ ID NO: 1216614 - RNA, 21 nt, Homo sapiens
auguguuccauugccauagcu

SEQ ID NO: 1216615 - RNA, 15 nt, Homo sapiens
auguguugcuauccu

SEQ ID NO: 1216616 - RNA, 22 nt, Homo sapiens
auguguuguguauuccacuuag

SEQ ID NO: 1216617 - RNA, 16 nt, Homo sapiens
auguguuuuuuuacau

SEQ ID NO: 1216618 - RNA, 16 nt, Homo sapiens
auguuaaagcaucaga

SEQ ID NO: 1216619 - RNA, 21 nt, Homo sapiens
auguuaaagguucacaggggu

SEQ ID NO: 1216620 - RNA, 22 nt, Homo sapiens
auguuaagauaacuuacuguau

SEQ ID NO: 1216621 - RNA, 20 nt, Homo sapiens
auguuaauuauuuugacaaa

SEQ ID NO: 1216622 - RNA, 17 nt, Homo sapiens
auguuacacuaagggug

SEQ ID NO: 1216623 - RNA, 12 nt, Homo sapiens
auguuacagauu

SEQ ID NO: 1216624 - RNA, 20 nt, Homo sapiens
auguuagagaauuuccuuac

SEQ ID NO: 1216625 - RNA, 21 nt, Homo sapiens
auguuaguagaaauuuuacaa

SEQ ID NO: 1216626 - RNA, 16 nt, Homo sapiens
auguuaguuaccuuau

SEQ ID NO: 1216627 - RNA, 13 nt, Homo sapiens
auguuauuauuaa

SEQ ID NO: 1216628 - RNA, 14 nt, Homo sapiens
auguucacugugag

SEQ ID NO: 1216629 - RNA, 15 nt, Homo sapiens
auguucacuguggca

SEQ ID NO: 1216630 - RNA, 19 nt, Homo sapiens
auguucagaauguacggaa

SEQ ID NO: 1216631 - RNA, 14 nt, Homo sapiens
auguucagcacugu

SEQ ID NO: 1216632 - RNA, 21 nt, Homo sapiens
auguucauuguaauguuacug

SEQ ID NO: 1216633 - RNA, 14 nt, Homo sapiens
auguuccucaaaag

SEQ ID NO: 1216634 - RNA, 19 nt, Homo sapiens
auguuccugaaaauugcaa

SEQ ID NO: 1216635 - RNA, 21 nt, Homo sapiens
auguucuaaauaaaaagcauu

SEQ ID NO: 1216636 - RNA, 15 nt, Homo sapiens
auguucucagauuuc

SEQ ID NO: 1216637 - RNA, 19 nt, Homo sapiens
auguucuuuaaaggcaucu

SEQ ID NO: 1216638 - RNA, 14 nt, Homo sapiens
auguugaguuauua

SEQ ID NO: 1216639 - RNA, 13 nt, Homo sapiens
auguugaguucag

SEQ ID NO: 1216640 - RNA, 12 nt, Homo sapiens
auguugcaaugc

SEQ ID NO: 1216641 - RNA, 15 nt, Homo sapiens
auguugccuuuaugg

SEQ ID NO: 1216642 - RNA, 18 nt, Homo sapiens
auguuguaagaaagacaa

SEQ ID NO: 1216643 - RNA, 18 nt, Homo sapiens
auguuguaauucaugcca

SEQ ID NO: 1216644 - RNA, 21 nt, Homo sapiens
auguugugauguauucuagcu

SEQ ID NO: 1216645 - RNA, 21 nt, Homo sapiens
auguuguguuuuuaacauguc

SEQ ID NO: 1216646 - RNA, 13 nt, Homo sapiens
auucacagaauag

SEQ ID NO: 1216647 - RNA, 14 nt, Homo sapiens
auucacaguaauau

SEQ ID NO: 1216648 - RNA, 14 nt, Homo sapiens
auucacagugcaag

SEQ ID NO: 1216649 - RNA, 20 nt, Homo sapiens
auucacauauaucaaaguga

SEQ ID NO: 1216650 - RNA, 12 nt, Homo sapiens
auucacauuuag

SEQ ID NO: 1216651 - RNA, 14 nt, Homo sapiens
auucaccaauauca

SEQ ID NO: 1216652 - RNA, 16 nt, Homo sapiens
auucaccgugaaauag

SEQ ID NO: 1216653 - RNA, 15 nt, Homo sapiens
auucaccuauguuau

SEQ ID NO: 1216654 - RNA, 20 nt, Homo sapiens
auucaccuucaaaagcacug

SEQ ID NO: 1216655 - RNA, 23 nt, Homo sapiens
auucaccuugguguuucucucug

SEQ ID NO: 1216656 - RNA, 23 nt, Homo sapiens
auucacgcuguuuguuucauaua

SEQ ID NO: 1216657 - RNA, 14 nt, Homo sapiens
auucacguuuuucu

SEQ ID NO: 1216658 - RNA, 20 nt, Homo sapiens
auucacguuuuucuggacca

SEQ ID NO: 1216659 - RNA, 13 nt, Homo sapiens
auucacuacaggu

SEQ ID NO: 1216660 - RNA, 23 nt, Homo sapiens
auucacuuauggcagaggaauau

SEQ ID NO: 1216661 - RNA, 11 nt, Homo sapiens
auucacuuccc

SEQ ID NO: 1216662 - RNA, 16 nt, Homo sapiens
auucagagaauaucaa

SEQ ID NO: 1216663 - RNA, 20 nt, Homo sapiens
auucagauggcaauuucacu

SEQ ID NO: 1216664 - RNA, 15 nt, Homo sapiens
auucagcauguccaa

SEQ ID NO: 1216665 - RNA, 17 nt, Homo sapiens
auucagcauuauuccuc

SEQ ID NO: 1216666 - RNA, 22 nt, Homo sapiens
auucagcauuauuccuccagga

SEQ ID NO: 1216667 - RNA, 22 nt, Homo sapiens
auucagcucuggagaacagugg

SEQ ID NO: 1216668 - RNA, 16 nt, Homo sapiens
auucaggauuacaugc

SEQ ID NO: 1216669 - RNA, 14 nt, Homo sapiens
auucaggugaaaau

SEQ ID NO: 1216670 - RNA, 21 nt, Homo sapiens
auucauaaaaacugcuuacuu

SEQ ID NO: 1216671 - RNA, 20 nt, Homo sapiens
auucauauaggccagaguug

SEQ ID NO: 1216672 - RNA, 22 nt, Homo sapiens
auucaugaaaauaaauguacau

SEQ ID NO: 1216673 - RNA, 22 nt, Homo sapiens
auucaugccagggacugacaaa

SEQ ID NO: 1216674 - RNA, 22 nt, Homo sapiens
auucaugugggcauuucuugcg

SEQ ID NO: 1216675 - RNA, 15 nt, Homo sapiens
auucauugugauuua

SEQ ID NO: 1216676 - RNA, 18 nt, Homo sapiens
auucauuuucaucacugg

SEQ ID NO: 1216677 - RNA, 20 nt, Homo sapiens
auucauuuucaucacuggga

SEQ ID NO: 1216678 - RNA, 17 nt, Homo sapiens
auucauuuucugccuau

SEQ ID NO: 1216679 - RNA, 15 nt, Homo sapiens
auuccaaagucucua

SEQ ID NO: 1216680 - RNA, 17 nt, Homo sapiens
auuccaaaugucuuuua

SEQ ID NO: 1216681 - RNA, 18 nt, Homo sapiens
auuccaacauuucucacu

SEQ ID NO: 1216682 - RNA, 14 nt, Homo sapiens
auuccacacugcac

SEQ ID NO: 1216683 - RNA, 16 nt, Homo sapiens
auuccaccuucccaug

SEQ ID NO: 1216684 - RNA, 19 nt, Homo sapiens
auuccagaaugcuguacau

SEQ ID NO: 1216685 - RNA, 22 nt, Homo sapiens
auuccauuacuaagaaacacau

SEQ ID NO: 1216686 - RNA, 23 nt, Homo sapiens
auuccauuuugugaauugugaca

SEQ ID NO: 1216687 - RNA, 20 nt, Homo sapiens
auucccaccauucuaccuga

SEQ ID NO: 1216688 - RNA, 17 nt, Homo sapiens
auucccagccuguggca

SEQ ID NO: 1216689 - RNA, 18 nt, Homo sapiens
auuccccauuuccuguac

SEQ ID NO: 1216690 - RNA, 18 nt, Homo sapiens
auucccccuuccuaguga

SEQ ID NO: 1216691 - RNA, 21 nt, Homo sapiens
auuccccuguagcagucacug

SEQ ID NO: 1216692 - RNA, 21 nt, Homo sapiens
auucccugcccaaacccuuaa

SEQ ID NO: 1216693 - RNA, 14 nt, Homo sapiens
auucccugucacua

SEQ ID NO: 1216694 - RNA, 11 nt, Homo sapiens
auucccugugu

SEQ ID NO: 1216695 - RNA, 20 nt, Homo sapiens
auuccggauccuaagcaucu

SEQ ID NO: 1216696 - RNA, 14 nt, Homo sapiens
auuccuacaaagau

SEQ ID NO: 1216697 - RNA, 19 nt, Homo sapiens
auuccuauauccugugacu

SEQ ID NO: 1216698 - RNA, 15 nt, Homo sapiens
auuccucacuuugaa

SEQ ID NO: 1216699 - RNA, 20 nt, Homo sapiens
auuccugggccuguccccca

SEQ ID NO: 1216700 - RNA, 22 nt, Homo sapiens
auuccugguggauacuguagaa

SEQ ID NO: 1216701 - RNA, 19 nt, Homo sapiens
auuccuuagacucuuuucc

SEQ ID NO: 1216702 - RNA, 12 nt, Homo sapiens
auuccuugcaca

SEQ ID NO: 1216703 - RNA, 14 nt, Homo sapiens
auuccuugcacaua

SEQ ID NO: 1216704 - RNA, 15 nt, Homo sapiens
auuccuugguaauau

SEQ ID NO: 1216705 - RNA, 12 nt, Homo sapiens
auuccuuuauga

SEQ ID NO: 1216706 - RNA, 18 nt, Homo sapiens
auuccuuucucaucccac

SEQ ID NO: 1216707 - RNA, 23 nt, Homo sapiens
auuccuuugucuucaaacuguga

SEQ ID NO: 1216708 - RNA, 15 nt, Homo sapiens
auucgcccaccucag

SEQ ID NO: 1216709 - RNA, 22 nt, Homo sapiens
auucguacauaauaaguuucau

SEQ ID NO: 1216710 - RNA, 20 nt, Homo sapiens
auucuaaaugaauguuuaca

SEQ ID NO: 1216711 - RNA, 16 nt, Homo sapiens
auucuaacaagucaua

SEQ ID NO: 1216712 - RNA, 16 nt, Homo sapiens
auucuaacuaaugaca

SEQ ID NO: 1216713 - RNA, 21 nt, Homo sapiens
auucuaaguuauuuacuuuua

SEQ ID NO: 1216714 - RNA, 16 nt, Homo sapiens
auucuaaugucuucau

SEQ ID NO: 1216715 - RNA, 21 nt, Homo sapiens
auucuacuuuaagcacuacau

SEQ ID NO: 1216716 - RNA, 20 nt, Homo sapiens
auucuagccaaacuauucua

SEQ ID NO: 1216717 - RNA, 18 nt, Homo sapiens
auucuauuauacuacaau

SEQ ID NO: 1216718 - RNA, 15 nt, Homo sapiens
auucuauuuacuuga

SEQ ID NO: 1216719 - RNA, 17 nt, Homo sapiens
auucuauuuauauguac

SEQ ID NO: 1216720 - RNA, 15 nt, Homo sapiens
auucucaucacucaa

SEQ ID NO: 1216721 - RNA, 16 nt, Homo sapiens
auucucaucaguccau

SEQ ID NO: 1216722 - RNA, 18 nt, Homo sapiens
auucucaucaguccauug

SEQ ID NO: 1216723 - RNA, 16 nt, Homo sapiens
auucucauuugucaca

SEQ ID NO: 1216724 - RNA, 13 nt, Homo sapiens
auucuccaguauu

SEQ ID NO: 1216725 - RNA, 20 nt, Homo sapiens
auucucccauaaacacugaa

SEQ ID NO: 1216726 - RNA, 15 nt, Homo sapiens
auucuccugccucag

SEQ ID NO: 1216727 - RNA, 16 nt, Homo sapiens
auucuccugccuuagc

SEQ ID NO: 1216728 - RNA, 19 nt, Homo sapiens
auucucggggcccugugua

SEQ ID NO: 1216729 - RNA, 21 nt, Homo sapiens
auucucuggcuguaaggcucu

SEQ ID NO: 1216730 - RNA, 14 nt, Homo sapiens
auucugaccaugga

SEQ ID NO: 1216731 - RNA, 18 nt, Homo sapiens
auucugagacauguguca

SEQ ID NO: 1216732 - RNA, 14 nt, Homo sapiens
auucugaugagcaa

SEQ ID NO: 1216733 - RNA, 23 nt, Homo sapiens
auucugcaguaaaucuuuuacaa

SEQ ID NO: 1216734 - RNA, 13 nt, Homo sapiens
auucugcuaccaa

SEQ ID NO: 1216735 - RNA, 17 nt, Homo sapiens
auucugggaauccacag

SEQ ID NO: 1216736 - RNA, 20 nt, Homo sapiens
auucugucccaaucuuacca

SEQ ID NO: 1216737 - RNA, 14 nt, Homo sapiens
auucuguggaacaa

SEQ ID NO: 1216738 - RNA, 13 nt, Homo sapiens
caauucaguccug

SEQ ID NO: 1216739 - RNA, 14 nt, Homo sapiens
caauuccgcauuua

SEQ ID NO: 1216740 - RNA, 15 nt, Homo sapiens
caauuccucugggaa

SEQ ID NO: 1216741 - RNA, 14 nt, Homo sapiens
caauuccuucuuca

SEQ ID NO: 1216742 - RNA, 12 nt, Homo sapiens
caauucugugac

SEQ ID NO: 1216743 - RNA, 23 nt, Homo sapiens
caauucugugacauacauauuau

SEQ ID NO: 1216744 - RNA, 16 nt, Homo sapiens
caauugaccuugugac

SEQ ID NO: 1216745 - RNA, 15 nt, Homo sapiens
caauugcacugcugu

SEQ ID NO: 1216746 - RNA, 19 nt, Homo sapiens
caauugcuaccgagaaggu

SEQ ID NO: 1216747 - RNA, 23 nt, Homo sapiens
caauugguaaaacucacugugau

SEQ ID NO: 1216748 - RNA, 17 nt, Homo sapiens
caauugucgaaaagagu

SEQ ID NO: 1216749 - RNA, 11 nt, Homo sapiens
caauuguguag

SEQ ID NO: 1216750 - RNA, 14 nt, Homo sapiens
caauuuauucugau

SEQ ID NO: 1216751 - RNA, 22 nt, Homo sapiens
caauuucaccaccaaaugccaa

SEQ ID NO: 1216752 - RNA, 23 nt, Homo sapiens
caauuucuugcucuaucucucaa

SEQ ID NO: 1216753 - RNA, 19 nt, Homo sapiens
caauuuguaauugcuuaca

SEQ ID NO: 1216754 - RNA, 20 nt, Homo sapiens
caauuuuucaagagcuccuu

SEQ ID NO: 1216755 - RNA, 18 nt, Homo sapiens
caauuuuugucucagaag

SEQ ID NO: 1216756 - RNA, 20 nt, Homo sapiens
caccugggcuccugcauccu

SEQ ID NO: 1216757 - RNA, 21 nt, Homo sapiens
caccuggggaauaaacuccag

SEQ ID NO: 1216758 - RNA, 13 nt, Homo sapiens
caccugugacaaa

SEQ ID NO: 1216759 - RNA, 16 nt, Homo sapiens
caccuuaagaagucua

SEQ ID NO: 1216760 - RNA, 17 nt, Homo sapiens
caccuuaagauuuugca

SEQ ID NO: 1216761 - RNA, 13 nt, Homo sapiens
caccuucaaaagc

SEQ ID NO: 1216762 - RNA, 21 nt, Homo sapiens
caccuuccagcuccuguaaca

SEQ ID NO: 1216763 - RNA, 20 nt, Homo sapiens
caccuugaucccaauccuua

SEQ ID NO: 1216764 - RNA, 17 nt, Homo sapiens
caccuugccuugcuguu

SEQ ID NO: 1216765 - RNA, 19 nt, Homo sapiens
caccuuguaaccagugcag

SEQ ID NO: 1216766 - RNA, 15 nt, Homo sapiens
caccuuuagguucuu

SEQ ID NO: 1216767 - RNA, 14 nt, Homo sapiens
caccuuuuaacuca

SEQ ID NO: 1216768 - RNA, 13 nt, Homo sapiens
caccuuuuacucu

SEQ ID NO: 1216769 - RNA, 13 nt, Homo sapiens
cacgaaacuuguu

SEQ ID NO: 1216770 - RNA, 15 nt, Homo sapiens
cacgaagacaaccau

SEQ ID NO: 1216771 - RNA, 16 nt, Homo sapiens
cacgagaucaagagau

SEQ ID NO: 1216772 - RNA, 22 nt, Homo sapiens
cacgauuagcuuuauuauggcu

SEQ ID NO: 1216773 - RNA, 19 nt, Homo sapiens
cacgcaccggaguucugcc

SEQ ID NO: 1216774 - RNA, 22 nt, Homo sapiens
cacgccacuggaguccacacuu

SEQ ID NO: 1216775 - RNA, 22 nt, Homo sapiens
cacgccuguaaucccagcacuu

SEQ ID NO: 1216776 - RNA, 15 nt, Homo sapiens
cacgcucgcugccau

SEQ ID NO: 1216777 - RNA, 20 nt, Homo sapiens
cacgcuucaaggauauacug

SEQ ID NO: 1216778 - RNA, 21 nt, Homo sapiens
cacgcuucaaggauauacugc

SEQ ID NO: 1216779 - RNA, 15 nt, Homo sapiens
cacgcuuguucacac

SEQ ID NO: 1216780 - RNA, 22 nt, Homo sapiens
cacggagggggacggggcucag

SEQ ID NO: 1216781 - RNA, 18 nt, Homo sapiens
cacggcguuguaccugua

SEQ ID NO: 1216782 - RNA, 17 nt, Homo sapiens
cacggcguuuuuuuaca

SEQ ID NO: 1216783 - RNA, 18 nt, Homo sapiens
cacgggcaugggcacucc

SEQ ID NO: 1216784 - RNA, 15 nt, Homo sapiens
cacggugggagaccu

SEQ ID NO: 1216785 - RNA, 21 nt, Homo sapiens
cacguaugguggcucaugucu

SEQ ID NO: 1216786 - RNA, 20 nt, Homo sapiens
cacgucuuuucucauaucau

SEQ ID NO: 1216787 - RNA, 20 nt, Homo sapiens
cacgugggcaaacaggcagu

SEQ ID NO: 1216788 - RNA, 13 nt, Homo sapiens
cacguguccugua

SEQ ID NO: 1216789 - RNA, 22 nt, Homo sapiens
cacgugucuuccacuuugcaua

SEQ ID NO: 1216790 - RNA, 14 nt, Homo sapiens
cacguuaccauuua

SEQ ID NO: 1216791 - RNA, 17 nt, Homo sapiens
cacuaaagccagccuga

SEQ ID NO: 1216792 - RNA, 22 nt, Homo sapiens
cacuaacauuauauugcaauga

SEQ ID NO: 1216793 - RNA, 20 nt, Homo sapiens
cacuaagaauucaaacuggg

SEQ ID NO: 1216794 - RNA, 23 nt, Homo sapiens
cacuaagauaaauucaugcacuu

SEQ ID NO: 1216795 - RNA, 17 nt, Homo sapiens
cacuaaggugugcucug

SEQ ID NO: 1216796 - RNA, 13 nt, Homo sapiens
cacuaaucugaaa

SEQ ID NO: 1216797 - RNA, 18 nt, Homo sapiens
cacuaauggggcggugag

SEQ ID NO: 1216798 - RNA, 19 nt, Homo sapiens
cacuaauuuauaacuauua

SEQ ID NO: 1216799 - RNA, 18 nt, Homo sapiens
cacuacaccuugccuugc

SEQ ID NO: 1216800 - RNA, 19 nt, Homo sapiens
cacuacacuccagccugag

SEQ ID NO: 1216801 - RNA, 13 nt, Homo sapiens
cacuaccacauua

SEQ ID NO: 1216802 - RNA, 21 nt, Homo sapiens
cacuaccguaaauguccauuu

SEQ ID NO: 1216803 - RNA, 19 nt, Homo sapiens
cacuagaggaaaccaguuu

SEQ ID NO: 1216804 - RNA, 21 nt, Homo sapiens
cacuauagccuaggugacaga

SEQ ID NO: 1216805 - RNA, 23 nt, Homo sapiens
cacuauagccuaggugacagagu

SEQ ID NO: 1216806 - RNA, 12 nt, Homo sapiens
cacuaugccuga

SEQ ID NO: 1216807 - RNA, 17 nt, Homo sapiens
cacuaugggugagcaua

SEQ ID NO: 1216808 - RNA, 17 nt, Homo sapiens
cacuauguauauacaua

SEQ ID NO: 1216809 - RNA, 21 nt, Homo sapiens
cacuauguuuauuuacuaauu

SEQ ID NO: 1216810 - RNA, 14 nt, Homo sapiens
cacuauuuccacau

SEQ ID NO: 1216811 - RNA, 22 nt, Homo sapiens
cacucaaaacgcuacugaguca

SEQ ID NO: 1216812 - RNA, 17 nt, Homo sapiens
cacucaaaagacaaaca

SEQ ID NO: 1216813 - RNA, 21 nt, Homo sapiens
cacucacauuuauucugcuca

SEQ ID NO: 1216814 - RNA, 21 nt, Homo sapiens
cacucacuccacaacccaaga

SEQ ID NO: 1216815 - RNA, 17 nt, Homo sapiens
cacucaggauugggaau

SEQ ID NO: 1216816 - RNA, 17 nt, Homo sapiens
cacucagggagcauuua

SEQ ID NO: 1216817 - RNA, 14 nt, Homo sapiens
cacucaggugaaaa

SEQ ID NO: 1216818 - RNA, 18 nt, Homo sapiens
cacucagguggugccccu

SEQ ID NO: 1216819 - RNA, 12 nt, Homo sapiens
cacucagucucu

SEQ ID NO: 1216820 - RNA, 12 nt, Homo sapiens
cacucauuccuu

SEQ ID NO: 1216821 - RNA, 18 nt, Homo sapiens
cacucauuccuucacuca

SEQ ID NO: 1216822 - RNA, 16 nt, Homo sapiens
cacuccagcgcugagu

SEQ ID NO: 1216823 - RNA, 13 nt, Homo sapiens
cacuccauuccca

SEQ ID NO: 1216824 - RNA, 12 nt, Homo sapiens
cacucccaaagc

SEQ ID NO: 1216825 - RNA, 14 nt, Homo sapiens
cacucccaguccaa

SEQ ID NO: 1216826 - RNA, 16 nt, Homo sapiens
cacucccauuuuuacu

SEQ ID NO: 1216827 - RNA, 20 nt, Homo sapiens
cacucccucugccuucaggc

SEQ ID NO: 1216828 - RNA, 21 nt, Homo sapiens
cacucccuugguggcaagagc

SEQ ID NO: 1216829 - RNA, 13 nt, Homo sapiens
cacuccugaaccc

SEQ ID NO: 1216830 - RNA, 21 nt, Homo sapiens
cacuccugcuuaaucuucaaa

SEQ ID NO: 1216831 - RNA, 14 nt, Homo sapiens
cacucuccaaacag

SEQ ID NO: 1216832 - RNA, 23 nt, Homo sapiens
cacucuccaaacagucaccauac

SEQ ID NO: 1216833 - RNA, 17 nt, Homo sapiens
cacucugggcuguaacg

SEQ ID NO: 1216834 - RNA, 21 nt, Homo sapiens
cacucuuaucuacauaaggau

SEQ ID NO: 1216835 - RNA, 23 nt, Homo sapiens
cacucuuguggucaucauggcca

SEQ ID NO: 1216836 - RNA, 20 nt, Homo sapiens
cacucuuuugcuuuauucca

SEQ ID NO: 1216837 - RNA, 22 nt, Homo sapiens
cacugaaaaaucuaagugauau

SEQ ID NO: 1216838 - RNA, 17 nt, Homo sapiens
cacugaaagacaccauu

SEQ ID NO: 1216839 - RNA, 19 nt, Homo sapiens
cacugacaaugggcacaca

SEQ ID NO: 1216840 - RNA, 15 nt, Homo sapiens
cacugagagggcaau

SEQ ID NO: 1216841 - RNA, 19 nt, Homo sapiens
cacugaggguggcacucaa

SEQ ID NO: 1216842 - RNA, 17 nt, Homo sapiens
cacugauacacagaaua

SEQ ID NO: 1216843 - RNA, 13 nt, Homo sapiens
cacugauauccuc

SEQ ID NO: 1216844 - RNA, 21 nt, Homo sapiens
cacugaucacccaaugcauca

SEQ ID NO: 1216845 - RNA, 18 nt, Homo sapiens
cacugaugggcaaccccc

SEQ ID NO: 1216846 - RNA, 22 nt, Homo sapiens
cacugauguaaguguuguggaa

SEQ ID NO: 1216847 - RNA, 16 nt, Homo sapiens
cacugauguacaauua

SEQ ID NO: 1216848 - RNA, 23 nt, Homo sapiens
cacugauuccuuuaugaugacug

SEQ ID NO: 1216849 - RNA, 12 nt, Homo sapiens
cacugauucucu

SEQ ID NO: 1216850 - RNA, 16 nt, Homo sapiens
cacugauuugauacca

SEQ ID NO: 1216851 - RNA, 20 nt, Homo sapiens
cacugauuugauaccauggc

SEQ ID NO: 1216852 - RNA, 23 nt, Homo sapiens
cacugauuugauaccauggcacu

SEQ ID NO: 1216853 - RNA, 18 nt, Homo sapiens
cacugcaaguuuuaguua

SEQ ID NO: 1216854 - RNA, 17 nt, Homo sapiens
cacugcacagcagaucc

SEQ ID NO: 1216855 - RNA, 11 nt, Homo sapiens
cacugcacugu

SEQ ID NO: 1216856 - RNA, 18 nt, Homo sapiens
cacugcagaacagcauca

SEQ ID NO: 1216857 - RNA, 22 nt, Homo sapiens
cacugccaaauaaacagcuauu

SEQ ID NO: 1216858 - RNA, 15 nt, Homo sapiens
cacugccaccuugug

SEQ ID NO: 1216859 - RNA, 14 nt, Homo sapiens
cacugccacuuugc

SEQ ID NO: 1216860 - RNA, 17 nt, Homo sapiens
cacugccccucucucag

SEQ ID NO: 1216861 - RNA, 19 nt, Homo sapiens
cacugccgacaucagcauu

SEQ ID NO: 1216862 - RNA, 19 nt, Homo sapiens
cacugccggcaggaugcag

SEQ ID NO: 1216863 - RNA, 15 nt, Homo sapiens
cacugccugaaagac

SEQ ID NO: 1216864 - RNA, 13 nt, Homo sapiens
cacugccuguaua

SEQ ID NO: 1216865 - RNA, 18 nt, Homo sapiens
cacugccuguauacuuua

SEQ ID NO: 1216866 - RNA, 20 nt, Homo sapiens
cacugcugcuccagugcagg

SEQ ID NO: 1216867 - RNA, 16 nt, Homo sapiens
cacuggaagccagaga

SEQ ID NO: 1216868 - RNA, 15 nt, Homo sapiens
cacuggagcaugcag

SEQ ID NO: 1216869 - RNA, 14 nt, Homo sapiens
cacuggaguccaca

SEQ ID NO: 1216870 - RNA, 13 nt, Homo sapiens
uuuaggcucagaa

SEQ ID NO: 1216871 - RNA, 13 nt, Homo sapiens
ccucccacugagg

SEQ ID NO: 1216872 - RNA, 22 nt, Homo sapiens
ccucccagcguguguauccgac

SEQ ID NO: 1216873 - RNA, 22 nt, Homo sapiens
ccucccaggaacugggccaacu

SEQ ID NO: 1216874 - RNA, 18 nt, Homo sapiens
ccucccuggcucccauga

SEQ ID NO: 1216875 - RNA, 20 nt, Homo sapiens
ccucccuuccccuuuuccca

SEQ ID NO: 1216876 - RNA, 13 nt, Homo sapiens
ccucccuuugaug

SEQ ID NO: 1216877 - RNA, 12 nt, Homo sapiens
ccuccuaccuuu

SEQ ID NO: 1216878 - RNA, 14 nt, Homo sapiens
ccuccucaagaagu

SEQ ID NO: 1216879 - RNA, 16 nt, Homo sapiens
ccuccucacuggccau

SEQ ID NO: 1216880 - RNA, 13 nt, Homo sapiens
ccuccucauggca

SEQ ID NO: 1216881 - RNA, 23 nt, Homo sapiens
gaccucuuccuccucgcugccag

SEQ ID NO: 1216882 - RNA, 14 nt, Homo sapiens
gaccugcaggccaa

SEQ ID NO: 1216883 - RNA, 23 nt, Homo sapiens
gaccugcggcaguauguacuuca

SEQ ID NO: 1216884 - RNA, 19 nt, Homo sapiens
gaccugcucuuaaccucaa

SEQ ID NO: 1216885 - RNA, 17 nt, Homo sapiens
gaccuggaaucagugaa

SEQ ID NO: 1216886 - RNA, 20 nt, Homo sapiens
gaccugggagcccucaggca

SEQ ID NO: 1216887 - RNA, 17 nt, Homo sapiens
gaccuguaaucauauaa

SEQ ID NO: 1216888 - RNA, 17 nt, Homo sapiens
gaccugucucuaccuaa

SEQ ID NO: 1216889 - RNA, 21 nt, Homo sapiens
gaccuuccugauucauucuuc

SEQ ID NO: 1216890 - RNA, 19 nt, Homo sapiens
gaccuugcugauggugaca

SEQ ID NO: 1216891 - RNA, 18 nt, Homo sapiens
gaccuuggaucagaugaa

SEQ ID NO: 1216892 - RNA, 17 nt, Homo sapiens
gaccuugggguacaauu

SEQ ID NO: 1216893 - RNA, 12 nt, Homo sapiens
gaccuugugaca

SEQ ID NO: 1216894 - RNA, 23 nt, Homo sapiens
gaccuuuuuuuuuuuaauggcaa

SEQ ID NO: 1216895 - RNA, 17 nt, Homo sapiens
gacgagcagggugguga

SEQ ID NO: 1216896 - RNA, 18 nt, Homo sapiens
gacgcagggguugcagug

SEQ ID NO: 1216897 - RNA, 17 nt, Homo sapiens
gacgcaucucaaaacag

SEQ ID NO: 1216898 - RNA, 22 nt, Homo sapiens
gacggcaccaucuggaaggaca

SEQ ID NO: 1216899 - RNA, 21 nt, Homo sapiens
gacggcccucaucuaugagga

SEQ ID NO: 1216900 - RNA, 13 nt, Homo sapiens
gacggucagucca

SEQ ID NO: 1216901 - RNA, 14 nt, Homo sapiens
gacggucaguccau

SEQ ID NO: 1216902 - RNA, 15 nt, Homo sapiens
gacguuccaccuggg

SEQ ID NO: 1216903 - RNA, 21 nt, Homo sapiens
gacguuggccucagggccagg

SEQ ID NO: 1216904 - RNA, 17 nt, Homo sapiens
gacguuuaacugcaguu

SEQ ID NO: 1216905 - RNA, 14 nt, Homo sapiens
gacuaaaugaacua

SEQ ID NO: 1216906 - RNA, 18 nt, Homo sapiens
gacuaaucaccuacucaa

SEQ ID NO: 1216907 - RNA, 16 nt, Homo sapiens
gacuaauggaaauauu

SEQ ID NO: 1216908 - RNA, 12 nt, Homo sapiens
gacuacaaccaa

SEQ ID NO: 1216909 - RNA, 16 nt, Homo sapiens
ucucucaguucuacac

SEQ ID NO: 1216910 - RNA, 16 nt, Homo sapiens
ucucucccagguccca

SEQ ID NO: 1216911 - RNA, 19 nt, Homo sapiens
ucucuccuuauagacacuu

SEQ ID NO: 1216912 - RNA, 14 nt, Homo sapiens
ucucucuucccuca

SEQ ID NO: 1216913 - RNA, 16 nt, Homo sapiens
ucucucuucucuccag

SEQ ID NO: 1216914 - RNA, 13 nt, Homo sapiens
ucucucuuuauac

SEQ ID NO: 1216915 - RNA, 21 nt, Homo sapiens
ucucugaacacaggcagcuuu

SEQ ID NO: 1216916 - RNA, 17 nt, Homo sapiens
ucucugaggacacuaac

SEQ ID NO: 1216917 - RNA, 12 nt, Homo sapiens
ucucugccagug

SEQ ID NO: 1216918 - RNA, 15 nt, Homo sapiens
ucucugccagugaca

SEQ ID NO: 1216919 - RNA, 21 nt, Homo sapiens
ucucugccccguuucuugccc

SEQ ID NO: 1216920 - RNA, 18 nt, Homo sapiens
ucucugcuccaccacauc

SEQ ID NO: 1216921 - RNA, 20 nt, Homo sapiens
ucucuggaaaggggggagcu

SEQ ID NO: 1216922 - RNA, 22 nt, Homo sapiens
ucucugggaaucaacagcauau

SEQ ID NO: 1216923 - RNA, 13 nt, Homo sapiens
ucucugguaauau

SEQ ID NO: 1216924 - RNA, 17 nt, Homo sapiens
ucucugucucagacuuu

SEQ ID NO: 1216925 - RNA, 16 nt, Homo sapiens
ucucugugugcacaaa

SEQ ID NO: 1216926 - RNA, 15 nt, Homo sapiens
ucucuguucuucauc

SEQ ID NO: 1216927 - RNA, 23 nt, Homo sapiens
ucucuuaaaaaaaaaauuacuuc

SEQ ID NO: 1216928 - RNA, 14 nt, Homo sapiens
ucucuuagagccau

SEQ ID NO: 1216929 - RNA, 21 nt, Homo sapiens
ucucuuaugauacuugaggua

SEQ ID NO: 1216930 - RNA, 14 nt, Homo sapiens
ucucuucugagcua

SEQ ID NO: 1216931 - RNA, 18 nt, Homo sapiens
ucucuugcacucaaagcu

SEQ ID NO: 1216932 - RNA, 15 nt, Homo sapiens
ucucuugcugccaca

SEQ ID NO: 1216933 - RNA, 14 nt, Homo sapiens
auucuuaaccaaga

SEQ ID NO: 1216934 - RNA, 18 nt, Homo sapiens
auucuuacaaaacauuuu

SEQ ID NO: 1216935 - RNA, 19 nt, Homo sapiens
auucuuaugauuacuauca

SEQ ID NO: 1216936 - RNA, 19 nt, Homo sapiens
auucuucaaccucauugac

SEQ ID NO: 1216937 - RNA, 20 nt, Homo sapiens
auucuucagauacaaacugc

SEQ ID NO: 1216938 - RNA, 21 nt, Homo sapiens
auucuucagauacaaacugca

SEQ ID NO: 1216939 - RNA, 22 nt, Homo sapiens
auucuucagauacaaacugcag

SEQ ID NO: 1216940 - RNA, 14 nt, Homo sapiens
auucuucucucuca

SEQ ID NO: 1216941 - RNA, 11 nt, Homo sapiens
auucuuggccc

SEQ ID NO: 1216942 - RNA, 20 nt, Homo sapiens
auucuuugaaaacagaugac

SEQ ID NO: 1216943 - RNA, 14 nt, Homo sapiens
auucuuuguuacag

SEQ ID NO: 1216944 - RNA, 20 nt, Homo sapiens
auucuuuucuuuuccauuua

SEQ ID NO: 1216945 - RNA, 19 nt, Homo sapiens
auucuuuuucaguuuuacc

SEQ ID NO: 1216946 - RNA, 14 nt, Homo sapiens
auugaaagaaccag

SEQ ID NO: 1216947 - RNA, 15 nt, Homo sapiens
auugaagcccuccaa

SEQ ID NO: 1216948 - RNA, 21 nt, Homo sapiens
auugaauguuuccaaccugga

SEQ ID NO: 1216949 - RNA, 15 nt, Homo sapiens
auugaauuucacugu

SEQ ID NO: 1216950 - RNA, 22 nt, Homo sapiens
auugacacagaaaauguugaga

SEQ ID NO: 1216951 - RNA, 24 nt, Homo sapiens
auugacaugugccagggcaaugau

SEQ ID NO: 1216952 - RNA, 19 nt, Homo sapiens
auugaccaagaacugcaug

SEQ ID NO: 1216953 - RNA, 22 nt, Homo sapiens
auugaccaagaacugcauggac

SEQ ID NO: 1216954 - RNA, 14 nt, Homo sapiens
auugacccuagcca

SEQ ID NO: 1216955 - RNA, 18 nt, Homo sapiens
auugacuauagugugagc

SEQ ID NO: 1216956 - RNA, 17 nt, Homo sapiens
auugagaaugugcuuug

SEQ ID NO: 1216957 - RNA, 16 nt, Homo sapiens
auugagaucacuacuc

SEQ ID NO: 1216958 - RNA, 20 nt, Homo sapiens
auugagcagaagaucaagga

SEQ ID NO: 1216959 - RNA, 17 nt, Homo sapiens
auugaggagcugcacug

SEQ ID NO: 1216960 - RNA, 15 nt, Homo sapiens
auugagggucauucu

SEQ ID NO: 1216961 - RNA, 21 nt, Homo sapiens
auugaguuccaguugaaguua

SEQ ID NO: 1216962 - RNA, 17 nt, Homo sapiens
auugauaugcuuauaca

SEQ ID NO: 1216963 - RNA, 17 nt, Homo sapiens
auugauggaugucuucu

SEQ ID NO: 1216964 - RNA, 17 nt, Homo sapiens
auugauuuuuacuucaa

SEQ ID NO: 1216965 - RNA, 13 nt, Homo sapiens
cagacagucacac

SEQ ID NO: 1216966 - RNA, 15 nt, Homo sapiens
cagacauaaagccau

SEQ ID NO: 1216967 - RNA, 22 nt, Homo sapiens
cagacauacauuuaugcacauu

SEQ ID NO: 1216968 - RNA, 22 nt, Homo sapiens
cagacaucgguguucuucuucc

SEQ ID NO: 1216969 - RNA, 16 nt, Homo sapiens
cagaccaaccuuccau

SEQ ID NO: 1216970 - RNA, 17 nt, Homo sapiens
cagaccagugaccccag

SEQ ID NO: 1216971 - RNA, 18 nt, Homo sapiens
cagacccaggucuuccag

SEQ ID NO: 1216972 - RNA, 22 nt, Homo sapiens
cgcuuggcuccaugcuccucac

SEQ ID NO: 1216973 - RNA, 15 nt, Homo sapiens
cgcuuuguugcccag

SEQ ID NO: 1216974 - RNA, 15 nt, Homo sapiens
cggaaccacagggcc

SEQ ID NO: 1216975 - RNA, 19 nt, Homo sapiens
cggaagaggcugcugagaa

SEQ ID NO: 1216976 - RNA, 20 nt, Homo sapiens
cggacaagcagcuggugcuc

SEQ ID NO: 1216977 - RNA, 14 nt, Homo sapiens
cggacagugcccau

SEQ ID NO: 1216978 - RNA, 18 nt, Homo sapiens
cggaccuccaucagagcc

SEQ ID NO: 1216979 - RNA, 20 nt, Homo sapiens
cggagaaacgggugagcuga

SEQ ID NO: 1216980 - RNA, 18 nt, Homo sapiens
cggagagagaauguauuu

SEQ ID NO: 1216981 - RNA, 22 nt, Homo sapiens
cggagaguuuccuauguuucac

SEQ ID NO: 1216982 - RNA, 17 nt, Homo sapiens
cggagcugcugcugcuc

SEQ ID NO: 1216983 - RNA, 23 nt, Homo sapiens
cggaggaggcuggugacaggcca

SEQ ID NO: 1216984 - RNA, 16 nt, Homo sapiens
cggauuccagcccaca

SEQ ID NO: 1216985 - RNA, 17 nt, Homo sapiens
cggcaaccccaguucug

SEQ ID NO: 1216986 - RNA, 19 nt, Homo sapiens
cggcaggugcucuguggau

SEQ ID NO: 1216987 - RNA, 19 nt, Homo sapiens
cggccacauuugguucuaa

SEQ ID NO: 1216988 - RNA, 16 nt, Homo sapiens
cggccacucuaccuga

SEQ ID NO: 1216989 - RNA, 15 nt, Homo sapiens
cggccagaagaucua

SEQ ID NO: 1216990 - RNA, 21 nt, Homo sapiens
cggccuccucuccuacuuugg

SEQ ID NO: 1216991 - RNA, 17 nt, Homo sapiens
cggccuuuguugcucag

SEQ ID NO: 1216992 - RNA, 21 nt, Homo sapiens
cggcgcccaccacccccucaa

SEQ ID NO: 1216993 - RNA, 17 nt, Homo sapiens
cggcuaggaagcagcug

SEQ ID NO: 1216994 - RNA, 13 nt, Homo sapiens
cggcucacugaaa

SEQ ID NO: 1216995 - RNA, 14 nt, Homo sapiens
cggcucacugcaac

SEQ ID NO: 1216996 - RNA, 11 nt, Homo sapiens
cggcugaccau

SEQ ID NO: 1216997 - RNA, 14 nt, Homo sapiens
cggcuucaccugcg

SEQ ID NO: 1216998 - RNA, 21 nt, Homo sapiens
cgggaagcaagaugugaaaga

SEQ ID NO: 1216999 - RNA, 17 nt, Homo sapiens
cgggagccuaggaccac

SEQ ID NO: 1217000 - RNA, 15 nt, Homo sapiens
cgggagggcggcaca

SEQ ID NO: 1217001 - RNA, 16 nt, Homo sapiens
cgggccccauccucau

SEQ ID NO: 1217002 - RNA, 13 nt, Homo sapiens
cgggcuaacggga

SEQ ID NO: 1217003 - RNA, 14 nt, Homo sapiens
cgggcuuuccccca

SEQ ID NO: 1217004 - RNA, 15 nt, Homo sapiens
cggggcagggccuuc

SEQ ID NO: 1217005 - RNA, 17 nt, Homo sapiens
cggggccagcaccacuu

SEQ ID NO: 1217006 - RNA, 18 nt, Homo sapiens
cgggggaccccuuugccc

SEQ ID NO: 1217007 - RNA, 16 nt, Homo sapiens
cgggguuucuccaugu

SEQ ID NO: 1217008 - RNA, 21 nt, Homo sapiens
cggguccccaaaccuguuccc

SEQ ID NO: 1217009 - RNA, 17 nt, Homo sapiens
cgggucucaacuuuaag

SEQ ID NO: 1217010 - RNA, 22 nt, Homo sapiens
cgggucucaacuuuaagauaga

SEQ ID NO: 1217011 - RNA, 15 nt, Homo sapiens
cggguggaucaccug

SEQ ID NO: 1217012 - RNA, 17 nt, Homo sapiens
cggguggggccauaaac

SEQ ID NO: 1217013 - RNA, 11 nt, Homo sapiens
cgguccagcug

SEQ ID NO: 1217014 - RNA, 15 nt, Homo sapiens
cgguggcucaugccu

SEQ ID NO: 1217015 - RNA, 17 nt, Homo sapiens
cgguggcugccccggcc

SEQ ID NO: 1217016 - RNA, 11 nt, Homo sapiens
cgguguucuaa

SEQ ID NO: 1217017 - RNA, 22 nt, Homo sapiens
cgguguucugucccagugcggu

SEQ ID NO: 1217018 - RNA, 15 nt, Homo sapiens
cgguuaccucugcau

SEQ ID NO: 1217019 - RNA, 18 nt, Homo sapiens
cguaaacgacacucucug

SEQ ID NO: 1217020 - RNA, 15 nt, Homo sapiens
cguaacaacuguggu

SEQ ID NO: 1217021 - RNA, 23 nt, Homo sapiens
cguaacagauuuuguuggcauag

SEQ ID NO: 1217022 - RNA, 16 nt, Homo sapiens
cguaagggaucuuccu

SEQ ID NO: 1217023 - RNA, 14 nt, Homo sapiens
cguaauuuugccaa

SEQ ID NO: 1217024 - RNA, 18 nt, Homo sapiens
cguaccucuucccaugac

SEQ ID NO: 1217025 - RNA, 13 nt, Homo sapiens
cguagccaucucu

SEQ ID NO: 1217026 - RNA, 11 nt, Homo sapiens
cguagccucag

SEQ ID NO: 1217027 - RNA, 16 nt, Homo sapiens
cguaguccgcuuucuc

SEQ ID NO: 1217028 - RNA, 15 nt, Homo sapiens
cguauauugcuguua

SEQ ID NO: 1217029 - RNA, 19 nt, Homo sapiens
cguaucccgagucugggac

SEQ ID NO: 1217030 - RNA, 17 nt, Homo sapiens
cguaucuuuccuaggca

SEQ ID NO: 1217031 - RNA, 17 nt, Homo sapiens
cguaucuuuuaaugauc

SEQ ID NO: 1217032 - RNA, 21 nt, Homo sapiens
cguauuuuuucuaaugugcau

SEQ ID NO: 1217033 - RNA, 15 nt, Homo sapiens
cgucagcugcucccu

SEQ ID NO: 1217034 - RNA, 20 nt, Homo sapiens
cgucaguccaagucuucuca

SEQ ID NO: 1217035 - RNA, 20 nt, Homo sapiens
cguccagcuggaagggucaa

SEQ ID NO: 1217036 - RNA, 23 nt, Homo sapiens
cguccauaguucugaggucccug

SEQ ID NO: 1217037 - RNA, 12 nt, Homo sapiens
cgucccuaccuc

SEQ ID NO: 1217038 - RNA, 23 nt, Homo sapiens
cgucgaggggcucucagcucagc

SEQ ID NO: 1217039 - RNA, 14 nt, Homo sapiens
cgucgcacagucuc

SEQ ID NO: 1217040 - RNA, 15 nt, Homo sapiens
cgucgcacagucucu

SEQ ID NO: 1217041 - RNA, 15 nt, Homo sapiens
cgucuccuuugacau

SEQ ID NO: 1217042 - RNA, 20 nt, Homo sapiens
cgucucucccucccuugcca

SEQ ID NO: 1217043 - RNA, 15 nt, Homo sapiens
cgucugggcucccug

SEQ ID NO: 1217044 - RNA, 10 nt, Homo sapiens
cgucugugaa

SEQ ID NO: 1217045 - RNA, 11 nt, Homo sapiens
cgucugugaau

SEQ ID NO: 1217046 - RNA, 12 nt, Homo sapiens
cgugaaacacac

SEQ ID NO: 1217047 - RNA, 20 nt, Homo sapiens
cgugagggggggguggguga

SEQ ID NO: 1217048 - RNA, 17 nt, Homo sapiens
cgugaggucccaggaag

SEQ ID NO: 1217049 - RNA, 16 nt, Homo sapiens
cgugaguggucuucaa

SEQ ID NO: 1217050 - RNA, 13 nt, Homo sapiens
cgugauaaugcag

SEQ ID NO: 1217051 - RNA, 15 nt, Homo sapiens
cgugauccaccugcc

SEQ ID NO: 1217052 - RNA, 12 nt, Homo sapiens
cgugcacucugc

SEQ ID NO: 1217053 - RNA, 21 nt, Homo sapiens
cgugcagcagcaacacaaugu

SEQ ID NO: 1217054 - RNA, 23 nt, Homo sapiens
cgugcaguaggggcuacugugac

SEQ ID NO: 1217055 - RNA, 13 nt, Homo sapiens
cgugccugugauc

SEQ ID NO: 1217056 - RNA, 14 nt, Homo sapiens
cguggacucugcac

SEQ ID NO: 1217057 - RNA, 16 nt, Homo sapiens
cguggauugcacgugg

SEQ ID NO: 1217058 - RNA, 16 nt, Homo sapiens
cgugggucauuacaaa

SEQ ID NO: 1217059 - RNA, 21 nt, Homo sapiens
cguggucacugcugucaucaa

SEQ ID NO: 1217060 - RNA, 13 nt, Homo sapiens
cguguagcuauau

SEQ ID NO: 1217061 - RNA, 15 nt, Homo sapiens
cgugugaacugcaac

SEQ ID NO: 1217062 - RNA, 16 nt, Homo sapiens
cgugugaacugcaaca

SEQ ID NO: 1217063 - RNA, 14 nt, Homo sapiens
cgugugucugucag

SEQ ID NO: 1217064 - RNA, 21 nt, Homo sapiens
cguguuuaauuaaauuucaca

SEQ ID NO: 1217065 - RNA, 17 nt, Homo sapiens
cguguuuggagcucuau

SEQ ID NO: 1217066 - RNA, 21 nt, Homo sapiens
cguuaaggagaugggccuuuu

SEQ ID NO: 1217067 - RNA, 14 nt, Homo sapiens
cguuaugugcagua

SEQ ID NO: 1217068 - RNA, 16 nt, Homo sapiens
cguucaaaacauucca

SEQ ID NO: 1217069 - RNA, 16 nt, Homo sapiens
cuccaugagacacauc

SEQ ID NO: 1217070 - RNA, 16 nt, Homo sapiens
cuccauguuugaugua

SEQ ID NO: 1217071 - RNA, 20 nt, Homo sapiens
cuccauuaaagucugaauca

SEQ ID NO: 1217072 - RNA, 15 nt, Homo sapiens
cucccaaagcucaga

SEQ ID NO: 1217073 - RNA, 20 nt, Homo sapiens
cucccaaagugcuaagauua

SEQ ID NO: 1217074 - RNA, 18 nt, Homo sapiens
cucccaacucaagguucu

SEQ ID NO: 1217075 - RNA, 15 nt, Homo sapiens
cucccaaggcucuga

SEQ ID NO: 1217076 - RNA, 14 nt, Homo sapiens
cucccaagguccuc

SEQ ID NO: 1217077 - RNA, 19 nt, Homo sapiens
cucccaccaccucaccagu

SEQ ID NO: 1217078 - RNA, 16 nt, Homo sapiens
cucccaccuccuggug

SEQ ID NO: 1217079 - RNA, 12 nt, Homo sapiens
cucccacuccag

SEQ ID NO: 1217080 - RNA, 16 nt, Homo sapiens
cucccagaaucccagc

SEQ ID NO: 1217081 - RNA, 15 nt, Homo sapiens
cucccagccaagucc

SEQ ID NO: 1217082 - RNA, 18 nt, Homo sapiens
cucccagcguguguaucc

SEQ ID NO: 1217083 - RNA, 23 nt, Homo sapiens
cucccagcuccuuucuccuguga

SEQ ID NO: 1217084 - RNA, 14 nt, Homo sapiens
cucccagcugacca

SEQ ID NO: 1217085 - RNA, 15 nt, Homo sapiens
cucccagcugugcug

SEQ ID NO: 1217086 - RNA, 11 nt, Homo sapiens
cucccagugac

SEQ ID NO: 1217087 - RNA, 22 nt, Homo sapiens
cucccagugaccccugaccuca

SEQ ID NO: 1217088 - RNA, 22 nt, Homo sapiens
cucccauaauugcuuugccaaa

SEQ ID NO: 1217089 - RNA, 21 nt, Homo sapiens
cucccauccuugaugcaagug

SEQ ID NO: 1217090 - RNA, 16 nt, Homo sapiens
cucccauuacuuugau

SEQ ID NO: 1217091 - RNA, 23 nt, Homo sapiens
cucccauuacuuugauaucugau

SEQ ID NO: 1217092 - RNA, 21 nt, Homo sapiens
cuccccacaccucccuacucc

SEQ ID NO: 1217093 - RNA, 23 nt, Homo sapiens
cuccccaccccacacacacuggc

SEQ ID NO: 1217094 - RNA, 13 nt, Homo sapiens
cuccccacucuag

SEQ ID NO: 1217095 - RNA, 14 nt, Homo sapiens
cuccccagagcacu

SEQ ID NO: 1217096 - RNA, 17 nt, Homo sapiens
cuccccaggcuaugcca

SEQ ID NO: 1217097 - RNA, 12 nt, Homo sapiens
cuccccauggag

SEQ ID NO: 1217098 - RNA, 17 nt, Homo sapiens
cuccccgccuguucccc

SEQ ID NO: 1217099 - RNA, 14 nt, Homo sapiens
cuccccuccagccu

SEQ ID NO: 1217100 - RNA, 18 nt, Homo sapiens
cuccccugcccuggucca

SEQ ID NO: 1217101 - RNA, 19 nt, Homo sapiens
cucccgaguagcugggauu

SEQ ID NO: 1217102 - RNA, 19 nt, Homo sapiens
cucccggguucaagugauu

SEQ ID NO: 1217103 - RNA, 12 nt, Homo sapiens
cucccuagccag

SEQ ID NO: 1217104 - RNA, 22 nt, Homo sapiens
cucccuagccagaggcucuaau

SEQ ID NO: 1217105 - RNA, 23 nt, Homo sapiens
cucccuaugucugcaaagugauu

SEQ ID NO: 1217106 - RNA, 24 nt, Homo sapiens
cucccuccaccuaccacucacaug

SEQ ID NO: 1217107 - RNA, 19 nt, Homo sapiens
cucccucccccuggcacug

SEQ ID NO: 1217108 - RNA, 17 nt, Homo sapiens
cucccucuccauaucuc

SEQ ID NO: 1217109 - RNA, 17 nt, Homo sapiens
ccuggggugaauacuua

SEQ ID NO: 1217110 - RNA, 18 nt, Homo sapiens
ccuggguggaaauccugc

SEQ ID NO: 1217111 - RNA, 18 nt, Homo sapiens
ccugguaccuagcaaagc

SEQ ID NO: 1217112 - RNA, 16 nt, Homo sapiens
ccuggucccaagacag

SEQ ID NO: 1217113 - RNA, 13 nt, Homo sapiens
ccuggugacuccu

SEQ ID NO: 1217114 - RNA, 13 nt, Homo sapiens
ccuggugcugaga

SEQ ID NO: 1217115 - RNA, 15 nt, Homo sapiens
ccuggugcugcugcu

SEQ ID NO: 1217116 - RNA, 19 nt, Homo sapiens
ccugguggauacuguagaa

SEQ ID NO: 1217117 - RNA, 14 nt, Homo sapiens
ccugguguguuucc

SEQ ID NO: 1217118 - RNA, 14 nt, Homo sapiens
ccugguugugugca

SEQ ID NO: 1217119 - RNA, 22 nt, Homo sapiens
ccugguuuuagacgaggccaca

SEQ ID NO: 1217120 - RNA, 21 nt, Homo sapiens
ccuguaaucccaacacuuugg

SEQ ID NO: 1217121 - RNA, 21 nt, Homo sapiens
ccuguaaucccagcacuuuga

SEQ ID NO: 1217122 - RNA, 19 nt, Homo sapiens
ccuguaaucucagcacuuu

SEQ ID NO: 1217123 - RNA, 18 nt, Homo sapiens
ccuguaugucuaccucug

SEQ ID NO: 1217124 - RNA, 19 nt, Homo sapiens
ccugucauccuuggucuuu

SEQ ID NO: 1217125 - RNA, 16 nt, Homo sapiens
ccuguccccucagcuc

SEQ ID NO: 1217126 - RNA, 19 nt, Homo sapiens
ccuguccuaagcacuuuau

SEQ ID NO: 1217127 - RNA, 14 nt, Homo sapiens
ccuguccuccugga

SEQ ID NO: 1217128 - RNA, 19 nt, Homo sapiens
ccuguccuggcaucaguag

SEQ ID NO: 1217129 - RNA, 19 nt, Homo sapiens
ccuguccugugaauggaag

SEQ ID NO: 1217130 - RNA, 16 nt, Homo sapiens
ccuguccuugcccuuu

SEQ ID NO: 1217131 - RNA, 16 nt, Homo sapiens
ccugucgugccagucc

SEQ ID NO: 1217132 - RNA, 21 nt, Homo sapiens
ccugucugcuaggcgcugggg

SEQ ID NO: 1217133 - RNA, 20 nt, Homo sapiens
ccugucuuccaaggagacca

SEQ ID NO: 1217134 - RNA, 19 nt, Homo sapiens
ccuuucucuaaaacugccu

SEQ ID NO: 1217135 - RNA, 21 nt, Homo sapiens
ccuuucugccuuggccucggc

SEQ ID NO: 1217136 - RNA, 12 nt, Homo sapiens
ccuuucuugucu

SEQ ID NO: 1217137 - RNA, 21 nt, Homo sapiens
ccuuugaaaccugcucuguag

SEQ ID NO: 1217138 - RNA, 15 nt, Homo sapiens
ccuuugagacaguuu

SEQ ID NO: 1217139 - RNA, 18 nt, Homo sapiens
ccuuugcaauagcaguua

SEQ ID NO: 1217140 - RNA, 21 nt, Homo sapiens
ccuuugcucuugggaagacca

SEQ ID NO: 1217141 - RNA, 13 nt, Homo sapiens
ccuuugcuucaaa

SEQ ID NO: 1217142 - RNA, 14 nt, Homo sapiens
ccuuuggaaagcca

SEQ ID NO: 1217143 - RNA, 22 nt, Homo sapiens
ccuuuggagggagggcugaccc

SEQ ID NO: 1217144 - RNA, 22 nt, Homo sapiens
ccuuuggggagcaggaggccaa

SEQ ID NO: 1217145 - RNA, 13 nt, Homo sapiens
ccuuuguugcaca

SEQ ID NO: 1217146 - RNA, 14 nt, Homo sapiens
ccuuuuaaaacacu

SEQ ID NO: 1217147 - RNA, 16 nt, Homo sapiens
ccuuuuaccugcccaa

SEQ ID NO: 1217148 - RNA, 14 nt, Homo sapiens
ccuuuuacucagcu

SEQ ID NO: 1217149 - RNA, 22 nt, Homo sapiens
ccuuuuccccaaccacagagaa

SEQ ID NO: 1217150 - RNA, 21 nt, Homo sapiens
ccuuuucuccuacaaagggaa

SEQ ID NO: 1217151 - RNA, 19 nt, Homo sapiens
ccuuuucuuuuguuacugu

SEQ ID NO: 1217152 - RNA, 16 nt, Homo sapiens
ccuuuuggcacugaga

SEQ ID NO: 1217153 - RNA, 13 nt, Homo sapiens
ccuuuuguauaca

SEQ ID NO: 1217154 - RNA, 13 nt, Homo sapiens
ccuuuuguuaaaa

SEQ ID NO: 1217155 - RNA, 14 nt, Homo sapiens
ccuuuuuguacuga

SEQ ID NO: 1217156 - RNA, 17 nt, Homo sapiens
ccuuuuuuauacaggaa

SEQ ID NO: 1217157 - RNA, 19 nt, Homo sapiens
ccuuuuuuauacaggaaaa

SEQ ID NO: 1217158 - RNA, 17 nt, Homo sapiens
ccuuuuuuauuccauaa

SEQ ID NO: 1217159 - RNA, 12 nt, Homo sapiens
ccuuuuuugcca

SEQ ID NO: 1217160 - RNA, 19 nt, Homo sapiens
cgaaaaagagguagcacua

SEQ ID NO: 1217161 - RNA, 22 nt, Homo sapiens
cgaaauuaaaucugaauaaaua

SEQ ID NO: 1217162 - RNA, 16 nt, Homo sapiens
cgaaccacccaaaaca

SEQ ID NO: 1217163 - RNA, 22 nt, Homo sapiens
cgaacgcucuuagcuuucucag

SEQ ID NO: 1217164 - RNA, 20 nt, Homo sapiens
cgaacuagagaugugcaauu

SEQ ID NO: 1217165 - RNA, 21 nt, Homo sapiens
cgaacuagagaugugcaauug

SEQ ID NO: 1217166 - RNA, 21 nt, Homo sapiens
cgaacuccuggccucaaguga

SEQ ID NO: 1217167 - RNA, 12 nt, Homo sapiens
cgaacuuucaaa

SEQ ID NO: 1217168 - RNA, 17 nt, Homo sapiens
cgaagacaaccaucaca

SEQ ID NO: 1217169 - RNA, 16 nt, Homo sapiens
cgaagccuuaagccau

SEQ ID NO: 1217170 - RNA, 19 nt, Homo sapiens
cgaagccuuauuucuagaa

SEQ ID NO: 1217171 - RNA, 11 nt, Homo sapiens
cgaaggugcug

SEQ ID NO: 1217172 - RNA, 16 nt, Homo sapiens
cgaaggugcuggaggu

SEQ ID NO: 1217173 - RNA, 19 nt, Homo sapiens
cgaagucgccacguggccu

SEQ ID NO: 1217174 - RNA, 22 nt, Homo sapiens
cgaauauaucaguaauuucaga

SEQ ID NO: 1217175 - RNA, 18 nt, Homo sapiens
cgaauguuagauuccucu

SEQ ID NO: 1217176 - RNA, 19 nt, Homo sapiens
cgaauucggguggcauccu

SEQ ID NO: 1217177 - RNA, 13 nt, Homo sapiens
cgacaccguguca

SEQ ID NO: 1217178 - RNA, 17 nt, Homo sapiens
cgacagugcauuugccu

SEQ ID NO: 1217179 - RNA, 17 nt, Homo sapiens
cgacauguguaccucag

SEQ ID NO: 1217180 - RNA, 18 nt, Homo sapiens
cgaccgcccccuccucua

SEQ ID NO: 1217181 - RNA, 18 nt, Homo sapiens
cgaccuggagacugacaa

SEQ ID NO: 1217182 - RNA, 16 nt, Homo sapiens
cgacgcugacugcccu

SEQ ID NO: 1217183 - RNA, 22 nt, Homo sapiens
cgacuaauuucaaaaugcuuuu

SEQ ID NO: 1217184 - RNA, 20 nt, Homo sapiens
cgacuucaugacaagcauuu

SEQ ID NO: 1217185 - RNA, 18 nt, Homo sapiens
cgagacacaggcacgggu

SEQ ID NO: 1217186 - RNA, 20 nt, Homo sapiens
cgagacuugguuucaaaaaa

SEQ ID NO: 1217187 - RNA, 16 nt, Homo sapiens
cgagagaggagccaga

SEQ ID NO: 1217188 - RNA, 17 nt, Homo sapiens
cgagagcagacaccagc

SEQ ID NO: 1217189 - RNA, 19 nt, Homo sapiens
cgagauagcaccauugcac

SEQ ID NO: 1217190 - RNA, 17 nt, Homo sapiens
cgagaucacgccacugc

SEQ ID NO: 1217191 - RNA, 21 nt, Homo sapiens
cgagaucacgccacugcacuc

SEQ ID NO: 1217192 - RNA, 15 nt, Homo sapiens
cgagaugagcccaca

SEQ ID NO: 1217193 - RNA, 16 nt, Homo sapiens
cgagcagucagcauuc

SEQ ID NO: 1217194 - RNA, 14 nt, Homo sapiens
cgagccaggaacug

SEQ ID NO: 1217195 - RNA, 18 nt, Homo sapiens
cgagcuccagagcaacga

SEQ ID NO: 1217196 - RNA, 23 nt, Homo sapiens
cgaggaaaagagaaggaaaguga

SEQ ID NO: 1217197 - RNA, 23 nt, Homo sapiens
cgaggaaaggauuuuaccaaagc

SEQ ID NO: 1217198 - RNA, 19 nt, Homo sapiens
cgaggaaggaaagcacagc

SEQ ID NO: 1217199 - RNA, 15 nt, Homo sapiens
cgaggaccacuuugg

SEQ ID NO: 1217200 - RNA, 18 nt, Homo sapiens
cgaggaguaacaauacaa

SEQ ID NO: 1217201 - RNA, 14 nt, Homo sapiens
cgagggcagcugcu

SEQ ID NO: 1217202 - RNA, 15 nt, Homo sapiens
cgaguacugggacaa

SEQ ID NO: 1217203 - RNA, 12 nt, Homo sapiens
cgauaaagggau

SEQ ID NO: 1217204 - RNA, 12 nt, Homo sapiens
cgaucuggguuc

SEQ ID NO: 1217205 - RNA, 18 nt, Homo sapiens
cgaucuggguucacugca

SEQ ID NO: 1217206 - RNA, 19 nt, Homo sapiens
cgaugaaguuaugcuguca

SEQ ID NO: 1217207 - RNA, 13 nt, Homo sapiens
cgaugacaguguu

SEQ ID NO: 1217208 - RNA, 23 nt, Homo sapiens
cgaugauguacagauucuuucag

SEQ ID NO: 1217209 - RNA, 15 nt, Homo sapiens
cgauguggaccucua

SEQ ID NO: 1217210 - RNA, 12 nt, Homo sapiens
cgauuagcuuua

SEQ ID NO: 1217211 - RNA, 18 nt, Homo sapiens
cgauuauuuccaguguuc

SEQ ID NO: 1217212 - RNA, 15 nt, Homo sapiens
cgauucacuguauaa

SEQ ID NO: 1217213 - RNA, 19 nt, Homo sapiens
cgauugaaagaaccagaga

SEQ ID NO: 1217214 - RNA, 13 nt, Homo sapiens
cgcaacaguuuuu

SEQ ID NO: 1217215 - RNA, 23 nt, Homo sapiens
cgcacaccggcuuaacacuauca

SEQ ID NO: 1217216 - RNA, 12 nt, Homo sapiens
cgcaccacugca

SEQ ID NO: 1217217 - RNA, 14 nt, Homo sapiens
cgcaccacugcacu

SEQ ID NO: 1217218 - RNA, 14 nt, Homo sapiens
cgcaccauugcacu

SEQ ID NO: 1217219 - RNA, 22 nt, Homo sapiens
cgcaccauuucugucacucaca

SEQ ID NO: 1217220 - RNA, 14 nt, Homo sapiens
cgcacguggagcug

SEQ ID NO: 1217221 - RNA, 17 nt, Homo sapiens
cgcaggagccauugcuc

SEQ ID NO: 1217222 - RNA, 12 nt, Homo sapiens
cgcaguggcuca

SEQ ID NO: 1217223 - RNA, 15 nt, Homo sapiens
cgcaguuuggaguca

SEQ ID NO: 1217224 - RNA, 21 nt, Homo sapiens
cgcaguuuggagucacuguag

SEQ ID NO: 1217225 - RNA, 16 nt, Homo sapiens
cgcauagacugaggua

SEQ ID NO: 1217226 - RNA, 16 nt, Homo sapiens
cgcaugugcagcuauu

SEQ ID NO: 1217227 - RNA, 16 nt, Homo sapiens
cgcaugugugcugcag

SEQ ID NO: 1217228 - RNA, 16 nt, Homo sapiens
cgccaagcaaccuggg

SEQ ID NO: 1217229 - RNA, 16 nt, Homo sapiens
cgccacggccuggcug

SEQ ID NO: 1217230 - RNA, 13 nt, Homo sapiens
cgccagcugggag

SEQ ID NO: 1217231 - RNA, 20 nt, Homo sapiens
cgcccaaacuggagugcagu

SEQ ID NO: 1217232 - RNA, 20 nt, Homo sapiens
cgcccacccuccugaccgca

SEQ ID NO: 1217233 - RNA, 13 nt, Homo sapiens
cucccucucucuu

SEQ ID NO: 1217234 - RNA, 22 nt, Homo sapiens
cucccucucucuucugcuccac

SEQ ID NO: 1217235 - RNA, 16 nt, Homo sapiens
cucccucugaccugca

SEQ ID NO: 1217236 - RNA, 18 nt, Homo sapiens
cucccucugcuacuccau

SEQ ID NO: 1217237 - RNA, 19 nt, Homo sapiens
cucccucugcuguguuccc

SEQ ID NO: 1217238 - RNA, 14 nt, Homo sapiens
cucccucuguccac

SEQ ID NO: 1217239 - RNA, 18 nt, Homo sapiens
cucccugaagaccaaaau

SEQ ID NO: 1217240 - RNA, 22 nt, Homo sapiens
cucccugcaagaaaucagccau

SEQ ID NO: 1217241 - RNA, 23 nt, Homo sapiens
cucccugcagaugccacccuagc

SEQ ID NO: 1217242 - RNA, 20 nt, Homo sapiens
cucccuggcaggaugcugag

SEQ ID NO: 1217243 - RNA, 16 nt, Homo sapiens
cucccuugccacccaa

SEQ ID NO: 1217244 - RNA, 20 nt, Homo sapiens
cucccuuggugguggggaca

SEQ ID NO: 1217245 - RNA, 21 nt, Homo sapiens
cuccgaccacuuccaggggaa

SEQ ID NO: 1217246 - RNA, 15 nt, Homo sapiens
cuccgagacagucca

SEQ ID NO: 1217247 - RNA, 13 nt, Homo sapiens
cuccgaggccagu

SEQ ID NO: 1217248 - RNA, 13 nt, Homo sapiens
cuccgcaacagcc

SEQ ID NO: 1217249 - RNA, 14 nt, Homo sapiens
cuccgcaacagcca

SEQ ID NO: 1217250 - RNA, 15 nt, Homo sapiens
cuccgccaagaucua

SEQ ID NO: 1217251 - RNA, 15 nt, Homo sapiens
cuccgcgccuacccu

SEQ ID NO: 1217252 - RNA, 20 nt, Homo sapiens
cuccggaggagacacaguua

SEQ ID NO: 1217253 - RNA, 20 nt, Homo sapiens
cuccuagaggugggcagcug

SEQ ID NO: 1217254 - RNA, 16 nt, Homo sapiens
cuccuauaaucuguca

SEQ ID NO: 1217255 - RNA, 17 nt, Homo sapiens
cuccuauaaucugucaa

SEQ ID NO: 1217256 - RNA, 20 nt, Homo sapiens
cuccuaucuugauuucacug

SEQ ID NO: 1217257 - RNA, 18 nt, Homo sapiens
cuccucaaacccagucuc

SEQ ID NO: 1217258 - RNA, 16 nt, Homo sapiens
cuccucaggcacacag

SEQ ID NO: 1217259 - RNA, 19 nt, Homo sapiens
cuccucaggcacacagcua

SEQ ID NO: 1217260 - RNA, 18 nt, Homo sapiens
cuccucaguaaauguaca

SEQ ID NO: 1217261 - RNA, 13 nt, Homo sapiens
cuccucagugaca

SEQ ID NO: 1217262 - RNA, 20 nt, Homo sapiens
cuccugaaccgcacagcuca

SEQ ID NO: 1217263 - RNA, 17 nt, Homo sapiens
cuccugaccucagguga

SEQ ID NO: 1217264 - RNA, 23 nt, Homo sapiens
cuccugaggcuuuggauuugaca

SEQ ID NO: 1217265 - RNA, 20 nt, Homo sapiens
cuccugaguaguugggauua

SEQ ID NO: 1217266 - RNA, 12 nt, Homo sapiens
cuccugcaaaau

SEQ ID NO: 1217267 - RNA, 19 nt, Homo sapiens
cuccugcucauauugugau

SEQ ID NO: 1217268 - RNA, 12 nt, Homo sapiens
cuccugcuccuc

SEQ ID NO: 1217269 - RNA, 12 nt, Homo sapiens
cuccugcugcag

SEQ ID NO: 1217270 - RNA, 14 nt, Homo sapiens
cuccuggaaccuug

SEQ ID NO: 1217271 - RNA, 17 nt, Homo sapiens
cuccuggcaaucaauac

SEQ ID NO: 1217272 - RNA, 21 nt, Homo sapiens
cuccuggccucaagugaucug

SEQ ID NO: 1217273 - RNA, 20 nt, Homo sapiens
cuccuggccucaagugauuc

SEQ ID NO: 1217274 - RNA, 16 nt, Homo sapiens
cuccuggucuugagau

SEQ ID NO: 1217275 - RNA, 14 nt, Homo sapiens
cuccuguaccucag

SEQ ID NO: 1217276 - RNA, 17 nt, Homo sapiens
cuccuguaccucagugg

SEQ ID NO: 1217277 - RNA, 23 nt, Homo sapiens
cuccugugucuguguauauuaca

SEQ ID NO: 1217278 - RNA, 23 nt, Homo sapiens
cuccuuauagacacuugcuccca

SEQ ID NO: 1217279 - RNA, 15 nt, Homo sapiens
cuccuucagacaccc

SEQ ID NO: 1217280 - RNA, 19 nt, Homo sapiens
cuccuuccacauguacaua

SEQ ID NO: 1217281 - RNA, 16 nt, Homo sapiens
cuccuuccaccucccu

SEQ ID NO: 1217282 - RNA, 15 nt, Homo sapiens
cuccuucccauuucu

SEQ ID NO: 1217283 - RNA, 21 nt, Homo sapiens
cuccuuccuacccuccugcac

SEQ ID NO: 1217284 - RNA, 16 nt, Homo sapiens
cuccuugaagguucuc

SEQ ID NO: 1217285 - RNA, 12 nt, Homo sapiens
cuccuugcacuu

SEQ ID NO: 1217286 - RNA, 21 nt, Homo sapiens
cuccuugcccagacuacaggg

SEQ ID NO: 1217287 - RNA, 21 nt, Homo sapiens
cuccuugcccuagaugagccc

SEQ ID NO: 1217288 - RNA, 16 nt, Homo sapiens
cuccuuggcuuaccug

SEQ ID NO: 1217289 - RNA, 16 nt, Homo sapiens
cuccuugggucauuga

SEQ ID NO: 1217290 - RNA, 19 nt, Homo sapiens
cuccuuguaaagacuguag

SEQ ID NO: 1217291 - RNA, 17 nt, Homo sapiens
cuccuugucccccguga

SEQ ID NO: 1217292 - RNA, 16 nt, Homo sapiens
cuccuuuaauuaaugg

SEQ ID NO: 1217293 - RNA, 23 nt, Homo sapiens
cuccuuuaccccucauccaaagu

SEQ ID NO: 1217294 - RNA, 14 nt, Homo sapiens
cuccuuuugaggcu

SEQ ID NO: 1217295 - RNA, 14 nt, Homo sapiens
cucgaaacacagaa

SEQ ID NO: 1217296 - RNA, 15 nt, Homo sapiens
cucgagaugggugcu

SEQ ID NO: 1217297 - RNA, 12 nt, Homo sapiens
cucgagugaauu

SEQ ID NO: 1217298 - RNA, 23 nt, Homo sapiens
cucgauaaaucuaacaguuacuc

SEQ ID NO: 1217299 - RNA, 19 nt, Homo sapiens
cucgauucgcugaauugcc

SEQ ID NO: 1217300 - RNA, 16 nt, Homo sapiens
cucgccacgaacuagg

SEQ ID NO: 1217301 - RNA, 15 nt, Homo sapiens
cucgcccaacuccac

SEQ ID NO: 1217302 - RNA, 15 nt, Homo sapiens
cucgccccaccggcg

SEQ ID NO: 1217303 - RNA, 23 nt, Homo sapiens
cucgcccuccuuucugugcccua

SEQ ID NO: 1217304 - RNA, 17 nt, Homo sapiens
cucggacaccaagcaga

SEQ ID NO: 1217305 - RNA, 20 nt, Homo sapiens
cucggacagcccaucugccu

SEQ ID NO: 1217306 - RNA, 14 nt, Homo sapiens
cucggagugccaca

SEQ ID NO: 1217307 - RNA, 13 nt, Homo sapiens
cucgggaaacaca

SEQ ID NO: 1217308 - RNA, 19 nt, Homo sapiens
cucgggaguuugagaccag

SEQ ID NO: 1217309 - RNA, 24 nt, Homo sapiens
cucgguggcauacagacuggggac

SEQ ID NO: 1217310 - RNA, 20 nt, Homo sapiens
cucguauaugucucaggucc

SEQ ID NO: 1217311 - RNA, 19 nt, Homo sapiens
cucuaaacugguacaauuu

SEQ ID NO: 1217312 - RNA, 15 nt, Homo sapiens
cucuaagaucuuaga

SEQ ID NO: 1217313 - RNA, 14 nt, Homo sapiens
cucuaaguguaaaa

SEQ ID NO: 1217314 - RNA, 15 nt, Homo sapiens
cucuaauguacaaua

SEQ ID NO: 1217315 - RNA, 16 nt, Homo sapiens
cucuacagacuucucc

SEQ ID NO: 1217316 - RNA, 12 nt, Homo sapiens
cucuacauuuaa

SEQ ID NO: 1217317 - RNA, 17 nt, Homo sapiens
cucuaccccugcuccca

SEQ ID NO: 1217318 - RNA, 14 nt, Homo sapiens
cucugaccagagau

SEQ ID NO: 1217319 - RNA, 13 nt, Homo sapiens
cucugaccuguac

SEQ ID NO: 1217320 - RNA, 17 nt, Homo sapiens
cucugacguugauccca

SEQ ID NO: 1217321 - RNA, 15 nt, Homo sapiens
cucugagaucuaagg

SEQ ID NO: 1217322 - RNA, 21 nt, Homo sapiens
cucugaggacacuaaccacgc

SEQ ID NO: 1217323 - RNA, 16 nt, Homo sapiens
cucugauugcagcaca

SEQ ID NO: 1217324 - RNA, 21 nt, Homo sapiens
cucugcaaugggcacugggau

SEQ ID NO: 1217325 - RNA, 23 nt, Homo sapiens
cucugcaaugggcacugggauga

SEQ ID NO: 1217326 - RNA, 12 nt, Homo sapiens
cucugcacaugu

SEQ ID NO: 1217327 - RNA, 14 nt, Homo sapiens
cucugcacaugucu

SEQ ID NO: 1217328 - RNA, 20 nt, Homo sapiens
cucugcacaugucuuguaca

SEQ ID NO: 1217329 - RNA, 16 nt, Homo sapiens
cucugcagcucaggga

SEQ ID NO: 1217330 - RNA, 22 nt, Homo sapiens
cucugcaguaaaacacauuugg

SEQ ID NO: 1217331 - RNA, 18 nt, Homo sapiens
cucugcauggaacagcau

SEQ ID NO: 1217332 - RNA, 20 nt, Homo sapiens
cucugcauuaucugagguca

SEQ ID NO: 1217333 - RNA, 19 nt, Homo sapiens
cucugccagccacauccaa

SEQ ID NO: 1217334 - RNA, 22 nt, Homo sapiens
cucugccugaagucacacagug

SEQ ID NO: 1217335 - RNA, 19 nt, Homo sapiens
cucugccuuugacauuuaa

SEQ ID NO: 1217336 - RNA, 20 nt, Homo sapiens
cucugcuacuccauccugaa

SEQ ID NO: 1217337 - RNA, 22 nt, Homo sapiens
cucugcuccugugguccagugg

SEQ ID NO: 1217338 - RNA, 14 nt, Homo sapiens
cucugcuuccagca

SEQ ID NO: 1217339 - RNA, 14 nt, Homo sapiens
cucuggaagaccug

SEQ ID NO: 1217340 - RNA, 17 nt, Homo sapiens
cucuggaccauauacca

SEQ ID NO: 1217341 - RNA, 19 nt, Homo sapiens
cucuggaggccucuggccc

SEQ ID NO: 1217342 - RNA, 21 nt, Homo sapiens
cucuggggucuuuuuaugcau

SEQ ID NO: 1217343 - RNA, 14 nt, Homo sapiens
cucuggggugcuga

SEQ ID NO: 1217344 - RNA, 19 nt, Homo sapiens
cucuguaaaaacacugaaa

SEQ ID NO: 1217345 - RNA, 20 nt, Homo sapiens
cucuguaacaucacuaucca

SEQ ID NO: 1217346 - RNA, 23 nt, Homo sapiens
cucugugagggugcugacuggcu

SEQ ID NO: 1217347 - RNA, 19 nt, Homo sapiens
cucugugcagucacuggag

SEQ ID NO: 1217348 - RNA, 17 nt, Homo sapiens
cucuguggaugauguga

SEQ ID NO: 1217349 - RNA, 15 nt, Homo sapiens
cucugugucugcucu

SEQ ID NO: 1217350 - RNA, 14 nt, Homo sapiens
cucuguugcacaug

SEQ ID NO: 1217351 - RNA, 16 nt, Homo sapiens
cucuuaaacuugugaa

SEQ ID NO: 1217352 - RNA, 15 nt, Homo sapiens
cucuuacaaccaaga

SEQ ID NO: 1217353 - RNA, 14 nt, Homo sapiens
cucuuagcaaaaac

SEQ ID NO: 1217354 - RNA, 16 nt, Homo sapiens
cucuuaguaacauaga

SEQ ID NO: 1217355 - RNA, 20 nt, Homo sapiens
cucuuaguuauugcugaaga

SEQ ID NO: 1217356 - RNA, 17 nt, Homo sapiens
cucuuauccaacaucaa

SEQ ID NO: 1217357 - RNA, 13 nt, Homo sapiens
cucuuaugcacac

SEQ ID NO: 1217358 - RNA, 18 nt, Homo sapiens
cucuuauuucugaauuca

SEQ ID NO: 1217359 - RNA, 18 nt, Homo sapiens
cucuucaacugaccagcc

SEQ ID NO: 1217360 - RNA, 20 nt, Homo sapiens
cucuucacagggaagcaugu

SEQ ID NO: 1217361 - RNA, 17 nt, Homo sapiens
cucuucacuuggccagu

SEQ ID NO: 1217362 - RNA, 14 nt, Homo sapiens
cucuucauugucua

SEQ ID NO: 1217363 - RNA, 16 nt, Homo sapiens
cucuucccaugacugc

SEQ ID NO: 1217364 - RNA, 22 nt, Homo sapiens
cucuucccuuuccccagcauca

SEQ ID NO: 1217365 - RNA, 23 nt, Homo sapiens
cucuucuaaaaaaugauacacac

SEQ ID NO: 1217366 - RNA, 18 nt, Homo sapiens
cucuucuaacacaaaaua

SEQ ID NO: 1217367 - RNA, 20 nt, Homo sapiens
cucuucugggaacuuccuca

SEQ ID NO: 1217368 - RNA, 23 nt, Homo sapiens
cucuucuggggcaggcugggcca

SEQ ID NO: 1217369 - RNA, 22 nt, Homo sapiens
cucuucuucauucuaucaagcc

SEQ ID NO: 1217370 - RNA, 22 nt, Homo sapiens
cucuucuuccccagguccuucc

SEQ ID NO: 1217371 - RNA, 20 nt, Homo sapiens
cucuucuuuagaacagggaa

SEQ ID NO: 1217372 - RNA, 22 nt, Homo sapiens
cucuucuuuuggcuuccaugau

SEQ ID NO: 1217373 - RNA, 15 nt, Homo sapiens
cucuugccucucuca

SEQ ID NO: 1217374 - RNA, 11 nt, Homo sapiens
cucuugcuaau

SEQ ID NO: 1217375 - RNA, 21 nt, Homo sapiens
cucuugcuggaacuguugaaa

SEQ ID NO: 1217376 - RNA, 20 nt, Homo sapiens
cucuugggaagaccagcuuu

SEQ ID NO: 1217377 - RNA, 19 nt, Homo sapiens
cucuuggugugauugcaca

SEQ ID NO: 1217378 - RNA, 22 nt, Homo sapiens
cucuuggugugauugcacagaa

SEQ ID NO: 1217379 - RNA, 23 nt, Homo sapiens
cucuuguauuaaacucuucacaa

SEQ ID NO: 1217380 - RNA, 20 nt, Homo sapiens
cucuuguuucuuuucacaua

SEQ ID NO: 1217381 - RNA, 15 nt, Homo sapiens
cucuuuaaucuucag

SEQ ID NO: 1217382 - RNA, 20 nt, Homo sapiens
cucuuuacuugaaauuuggc

SEQ ID NO: 1217383 - RNA, 13 nt, Homo sapiens
cucuuuaugacug

SEQ ID NO: 1217384 - RNA, 14 nt, Homo sapiens
cucuuuccuccugc

SEQ ID NO: 1217385 - RNA, 21 nt, Homo sapiens
cucuuuccucuggggcauuau

SEQ ID NO: 1217386 - RNA, 20 nt, Homo sapiens
cucuuucuaaaauauuucau

SEQ ID NO: 1217387 - RNA, 18 nt, Homo sapiens
cucuuucuacaugacugg

SEQ ID NO: 1217388 - RNA, 17 nt, Homo sapiens
cucuuuuagcugaugaa

SEQ ID NO: 1217389 - RNA, 19 nt, Homo sapiens
cucuuuuaggaggcacaac

SEQ ID NO: 1217390 - RNA, 15 nt, Homo sapiens
cucuuuucuacauac

SEQ ID NO: 1217391 - RNA, 13 nt, Homo sapiens
cucuuuugagcua

SEQ ID NO: 1217392 - RNA, 12 nt, Homo sapiens
cugaaaacuaca

SEQ ID NO: 1217393 - RNA, 13 nt, Homo sapiens
cugaaaacuacac

SEQ ID NO: 1217394 - RNA, 22 nt, Homo sapiens
cugaaaagaucugaagguccca

SEQ ID NO: 1217395 - RNA, 18 nt, Homo sapiens
cugaaaagcugcauuuaa

SEQ ID NO: 1217396 - RNA, 15 nt, Homo sapiens
cugaaaagggaauca

SEQ ID NO: 1217397 - RNA, 18 nt, Homo sapiens
cugaaaaucgaguuuuuc

SEQ ID NO: 1217398 - RNA, 17 nt, Homo sapiens
cugaaacccaaagcccu

SEQ ID NO: 1217399 - RNA, 20 nt, Homo sapiens
cugaugaaugaugaaugaau

SEQ ID NO: 1217400 - RNA, 14 nt, Homo sapiens
cugaugacaacuuc

SEQ ID NO: 1217401 - RNA, 15 nt, Homo sapiens
cugaugauacaugca

SEQ ID NO: 1217402 - RNA, 12 nt, Homo sapiens
cugaugaucaaa

SEQ ID NO: 1217403 - RNA, 22 nt, Homo sapiens
cugaugaugucucuuguagaag

SEQ ID NO: 1217404 - RNA, 17 nt, Homo sapiens
cugauggaaaaugcaaa

SEQ ID NO: 1217405 - RNA, 19 nt, Homo sapiens
cugauggaaguaaagccuc

SEQ ID NO: 1217406 - RNA, 20 nt, Homo sapiens
cugauggacaggugucugag

SEQ ID NO: 1217407 - RNA, 15 nt, Homo sapiens
cugaugggaaaacug

SEQ ID NO: 1217408 - RNA, 17 nt, Homo sapiens
cugauggugacauugca

SEQ ID NO: 1217409 - RNA, 20 nt, Homo sapiens
cugauuagaaaugaccaaua

SEQ ID NO: 1217410 - RNA, 16 nt, Homo sapiens
cugauuaggaauauga

SEQ ID NO: 1217411 - RNA, 20 nt, Homo sapiens
cugauuccccuccaccaaac

SEQ ID NO: 1217412 - RNA, 17 nt, Homo sapiens
cugauucucuacaugcu

SEQ ID NO: 1217413 - RNA, 19 nt, Homo sapiens
cugauucucuacaugcucu

SEQ ID NO: 1217414 - RNA, 21 nt, Homo sapiens
cugauucuggcuuuaagccuu

SEQ ID NO: 1217415 - RNA, 19 nt, Homo sapiens
cugauugaagacacacuca

SEQ ID NO: 1217416 - RNA, 18 nt, Homo sapiens
cugauuuaagguccuaaa

SEQ ID NO: 1217417 - RNA, 21 nt, Homo sapiens
cugauuuaagguccuaaauuc

SEQ ID NO: 1217418 - RNA, 22 nt, Homo sapiens
cugauuuauuucuacuauauac

SEQ ID NO: 1217419 - RNA, 21 nt, Homo sapiens
cugauuucuauggcuuucaaa

SEQ ID NO: 1217420 - RNA, 22 nt, Homo sapiens
cugauuucuuaggggaaggaga

SEQ ID NO: 1217421 - RNA, 18 nt, Homo sapiens
cugauuucuucagaauua

SEQ ID NO: 1217422 - RNA, 21 nt, Homo sapiens
cugauuuguauuaaaauugua

SEQ ID NO: 1217423 - RNA, 22 nt, Homo sapiens
cugauuuuuaaaguacuuucuu

SEQ ID NO: 1217424 - RNA, 16 nt, Homo sapiens
cugauuuuuagcuuua

SEQ ID NO: 1217425 - RNA, 17 nt, Homo sapiens
cugauuuuuagcuuuac

SEQ ID NO: 1217426 - RNA, 19 nt, Homo sapiens
cugcaaaaaugaaauccag

SEQ ID NO: 1217427 - RNA, 14 nt, Homo sapiens
cugcaaauacugua

SEQ ID NO: 1217428 - RNA, 16 nt, Homo sapiens
cugcaagcacaucugc

SEQ ID NO: 1217429 - RNA, 14 nt, Homo sapiens
cugcaaguggccau

SEQ ID NO: 1217430 - RNA, 19 nt, Homo sapiens
cugcaaguguaucuccuuu

SEQ ID NO: 1217431 - RNA, 18 nt, Homo sapiens
cugcaauaugaauucaag

SEQ ID NO: 1217432 - RNA, 18 nt, Homo sapiens
cugcaaugggcacuggga

SEQ ID NO: 1217433 - RNA, 15 nt, Homo sapiens
cugcacaaacaauau

SEQ ID NO: 1217434 - RNA, 13 nt, Homo sapiens
cugcacaaggugg

SEQ ID NO: 1217435 - RNA, 20 nt, Homo sapiens
cugcacagaaauuuucaauu

SEQ ID NO: 1217436 - RNA, 13 nt, Homo sapiens
cugcacagugaag

SEQ ID NO: 1217437 - RNA, 23 nt, Homo sapiens
cugcacaugucuuguacaugugu

SEQ ID NO: 1217438 - RNA, 19 nt, Homo sapiens
cugcaccccucugcccuca

SEQ ID NO: 1217439 - RNA, 22 nt, Homo sapiens
cugcacccucgacaagaccaca

SEQ ID NO: 1217440 - RNA, 19 nt, Homo sapiens
cugcaccuuuuugcaugau

SEQ ID NO: 1217441 - RNA, 23 nt, Homo sapiens
cugcacuauagccuaggugacag

SEQ ID NO: 1217442 - RNA, 20 nt, Homo sapiens
cugcacuccagccugggcaa

SEQ ID NO: 1217443 - RNA, 18 nt, Homo sapiens
cugcacucccaccugaca

SEQ ID NO: 1217444 - RNA, 17 nt, Homo sapiens
cugcacugccagcaucu

SEQ ID NO: 1217445 - RNA, 15 nt, Homo sapiens
cugcacuggggccac

SEQ ID NO: 1217446 - RNA, 22 nt, Homo sapiens
cugcacuguccugaccaucgca

SEQ ID NO: 1217447 - RNA, 14 nt, Homo sapiens
cugcacuugcagac

SEQ ID NO: 1217448 - RNA, 20 nt, Homo sapiens
cugcagagcacaaacuucag

SEQ ID NO: 1217449 - RNA, 18 nt, Homo sapiens
cugcagagcaccuuugca

SEQ ID NO: 1217450 - RNA, 18 nt, Homo sapiens
cugcagcccaaaacccag

SEQ ID NO: 1217451 - RNA, 19 nt, Homo sapiens
cugcagcugggccccaugc

SEQ ID NO: 1217452 - RNA, 15 nt, Homo sapiens
cugcaggcugcaguc

SEQ ID NO: 1217453 - RNA, 16 nt, Homo sapiens
cugcagggacagagca

SEQ ID NO: 1217454 - RNA, 20 nt, Homo sapiens
cugcagggacuccaugcugc

SEQ ID NO: 1217455 - RNA, 12 nt, Homo sapiens
cugcaggggugc

SEQ ID NO: 1217456 - RNA, 14 nt, Homo sapiens
cugcagggugggau

SEQ ID NO: 1217457 - RNA, 20 nt, Homo sapiens
cugcagguacuuccucaguc

SEQ ID NO: 1217458 - RNA, 21 nt, Homo sapiens
cugcagguuccuuaucuguca

SEQ ID NO: 1217459 - RNA, 21 nt, Homo sapiens
cugcaucauaagcugauuuga

SEQ ID NO: 1217460 - RNA, 21 nt, Homo sapiens
cugcauccccuuggcugugag

SEQ ID NO: 1217461 - RNA, 16 nt, Homo sapiens
cugcauccucacugug

SEQ ID NO: 1217462 - RNA, 18 nt, Homo sapiens
cugcaucuuauagcacuu

SEQ ID NO: 1217463 - RNA, 21 nt, Homo sapiens
cugcaucuuauagcacuuuga

SEQ ID NO: 1217464 - RNA, 20 nt, Homo sapiens
cugcauguaccauuugcaug

SEQ ID NO: 1217465 - RNA, 16 nt, Homo sapiens
cugcauguacuguaua

SEQ ID NO: 1217466 - RNA, 18 nt, Homo sapiens
cugccaaaggaugugaua

SEQ ID NO: 1217467 - RNA, 22 nt, Homo sapiens
cugccaagagagggccaugcaa

SEQ ID NO: 1217468 - RNA, 11 nt, Homo sapiens
cugccaagagu

SEQ ID NO: 1217469 - RNA, 17 nt, Homo sapiens
cugccacaccagucaca

SEQ ID NO: 1217470 - RNA, 12 nt, Homo sapiens
cugccacuccau

SEQ ID NO: 1217471 - RNA, 14 nt, Homo sapiens
cugccagcaaagag

SEQ ID NO: 1217472 - RNA, 19 nt, Homo sapiens
cugccaggaguagugagcu

SEQ ID NO: 1217473 - RNA, 15 nt, Homo sapiens
cugccaggcugaaaa

SEQ ID NO: 1217474 - RNA, 17 nt, Homo sapiens
cugccaucaccgcuggg

SEQ ID NO: 1217475 - RNA, 15 nt, Homo sapiens
cugccaucaugccug

SEQ ID NO: 1217476 - RNA, 17 nt, Homo sapiens
cugccaucaugccugac

SEQ ID NO: 1217477 - RNA, 14 nt, Homo sapiens
cugccauccucacc

SEQ ID NO: 1217478 - RNA, 17 nt, Homo sapiens
cugccaugccacugcca

SEQ ID NO: 1217479 - RNA, 12 nt, Homo sapiens
cugccauggaag

SEQ ID NO: 1217480 - RNA, 13 nt, Homo sapiens
cugccauguacua

SEQ ID NO: 1217481 - RNA, 17 nt, Homo sapiens
cugccauugggacccuc

SEQ ID NO: 1217482 - RNA, 14 nt, Homo sapiens
cugcccaagcacuu

SEQ ID NO: 1217483 - RNA, 16 nt, Homo sapiens
cugcccaaucuccauc

SEQ ID NO: 1217484 - RNA, 17 nt, Homo sapiens
cugcccacaacucccuu

SEQ ID NO: 1217485 - RNA, 21 nt, Homo sapiens
cugccccaaacaaauaugcaa

SEQ ID NO: 1217486 - RNA, 14 nt, Homo sapiens
cugccccagacaga

SEQ ID NO: 1217487 - RNA, 16 nt, Homo sapiens
cugccccagccuccuc

SEQ ID NO: 1217488 - RNA, 17 nt, Homo sapiens
cugcccccaacacucca

SEQ ID NO: 1217489 - RNA, 16 nt, Homo sapiens
cugccccuacccugga

SEQ ID NO: 1217490 - RNA, 17 nt, Homo sapiens
cugccccucucaccaaa

SEQ ID NO: 1217491 - RNA, 16 nt, Homo sapiens
cugcccuugucacugg

SEQ ID NO: 1217492 - RNA, 18 nt, Homo sapiens
cugcccuugucugagaug

SEQ ID NO: 1217493 - RNA, 17 nt, Homo sapiens
cugcccuuuccuaggcc

SEQ ID NO: 1217494 - RNA, 17 nt, Homo sapiens
cugccgaaccaaaagaa

SEQ ID NO: 1217495 - RNA, 23 nt, Homo sapiens
cugccgccucagcuucucaaagu

SEQ ID NO: 1217496 - RNA, 15 nt, Homo sapiens
cugccgcuaccuccc

SEQ ID NO: 1217497 - RNA, 16 nt, Homo sapiens
cugccucaguguuuca

SEQ ID NO: 1217498 - RNA, 23 nt, Homo sapiens
cugccucccgaguucaagcgauu

SEQ ID NO: 1217499 - RNA, 21 nt, Homo sapiens
cugccucggccucccaaagug

SEQ ID NO: 1217500 - RNA, 15 nt, Homo sapiens
cugccucugacacac

SEQ ID NO: 1217501 - RNA, 23 nt, Homo sapiens
cugccugggaacacgugugcaca

SEQ ID NO: 1217502 - RNA, 16 nt, Homo sapiens
cugccugggugggaca

SEQ ID NO: 1217503 - RNA, 12 nt, Homo sapiens
cugccuguaacu

SEQ ID NO: 1217504 - RNA, 22 nt, Homo sapiens
cugccuguauacuuuaguauga

SEQ ID NO: 1217505 - RNA, 12 nt, Homo sapiens
cugccuguggag

SEQ ID NO: 1217506 - RNA, 16 nt, Homo sapiens
cugccuuaaaaccaaa

SEQ ID NO: 1217507 - RNA, 20 nt, Homo sapiens
cugccuuaggguagugcuaa

SEQ ID NO: 1217508 - RNA, 22 nt, Homo sapiens
cugccuuaggguagugcuaaga

SEQ ID NO: 1217509 - RNA, 20 nt, Homo sapiens
cugccuuccacaauucacua

SEQ ID NO: 1217510 - RNA, 14 nt, Homo sapiens
cugccuuguguaca

SEQ ID NO: 1217511 - RNA, 18 nt, Homo sapiens
cugccuuuaagccaaaga

SEQ ID NO: 1217512 - RNA, 16 nt, Homo sapiens
cugcgccugacauuca

SEQ ID NO: 1217513 - RNA, 21 nt, Homo sapiens
cugcggcaguauguacuucag

SEQ ID NO: 1217514 - RNA, 14 nt, Homo sapiens
cugcggcuguguag

SEQ ID NO: 1217515 - RNA, 14 nt, Homo sapiens
cugcguaugagucc

SEQ ID NO: 1217516 - RNA, 18 nt, Homo sapiens
cugcguccccacucccuu

SEQ ID NO: 1217517 - RNA, 21 nt, Homo sapiens
cugcguccuccucaccucaug

SEQ ID NO: 1217518 - RNA, 19 nt, Homo sapiens
cugcuaaaggacaguggau

SEQ ID NO: 1217519 - RNA, 15 nt, Homo sapiens
cugcuaaugugugau

SEQ ID NO: 1217520 - RNA, 15 nt, Homo sapiens
cugcuacaacuucag

SEQ ID NO: 1217521 - RNA, 20 nt, Homo sapiens
cugcuacugucuuacuauua

SEQ ID NO: 1217522 - RNA, 15 nt, Homo sapiens
cugcuacuuaauucc

SEQ ID NO: 1217523 - RNA, 17 nt, Homo sapiens
cugcuaggcgcugggga

SEQ ID NO: 1217524 - RNA, 18 nt, Homo sapiens
cuggacacaauaggucuu

SEQ ID NO: 1217525 - RNA, 12 nt, Homo sapiens
cuggacaccagg

SEQ ID NO: 1217526 - RNA, 13 nt, Homo sapiens
cuggacacuucac

SEQ ID NO: 1217527 - RNA, 17 nt, Homo sapiens
cuggacagucacugcca

SEQ ID NO: 1217528 - RNA, 15 nt, Homo sapiens
cuggacgccacggcc

SEQ ID NO: 1217529 - RNA, 12 nt, Homo sapiens
cuggacuuuccu

SEQ ID NO: 1217530 - RNA, 15 nt, Homo sapiens
cuggagaaaugggag

SEQ ID NO: 1217531 - RNA, 22 nt, Homo sapiens
cuggagacccaccccaccugca

SEQ ID NO: 1217532 - RNA, 20 nt, Homo sapiens
cuggagaccgcuucaccccu

SEQ ID NO: 1217533 - RNA, 20 nt, Homo sapiens
cuggagaccguccuggagcu

SEQ ID NO: 1217534 - RNA, 21 nt, Homo sapiens
cuggagagguuaaggugcaau

SEQ ID NO: 1217535 - RNA, 20 nt, Homo sapiens
cuggagauaugaaggauuac

SEQ ID NO: 1217536 - RNA, 21 nt, Homo sapiens
cuggagcccuaaccccuucca

SEQ ID NO: 1217537 - RNA, 17 nt, Homo sapiens
cuggagccuccacugcc

SEQ ID NO: 1217538 - RNA, 15 nt, Homo sapiens
cuggaggaacacuug

SEQ ID NO: 1217539 - RNA, 16 nt, Homo sapiens
cuggaggccagagggg

SEQ ID NO: 1217540 - RNA, 17 nt, Homo sapiens
cuggagguugaagccaa

SEQ ID NO: 1217541 - RNA, 17 nt, Homo sapiens
cuggaguccugcucugu

SEQ ID NO: 1217542 - RNA, 14 nt, Homo sapiens
cuggagugcaaugg

SEQ ID NO: 1217543 - RNA, 13 nt, Homo sapiens
cuggagugcagug

SEQ ID NO: 1217544 - RNA, 20 nt, Homo sapiens
cuggagugcaguggugcaau

SEQ ID NO: 1217545 - RNA, 18 nt, Homo sapiens
cuggagugguaacagcuc

SEQ ID NO: 1217546 - RNA, 15 nt, Homo sapiens
cuggauauuuaguuc

SEQ ID NO: 1217547 - RNA, 20 nt, Homo sapiens
cuggaucguuugacgggacu

SEQ ID NO: 1217548 - RNA, 15 nt, Homo sapiens
cuggaucuaccagca

SEQ ID NO: 1217549 - RNA, 17 nt, Homo sapiens
cuggaugaaauaacucc

SEQ ID NO: 1217550 - RNA, 15 nt, Homo sapiens
cuggaugacauuaaa

SEQ ID NO: 1217551 - RNA, 22 nt, Homo sapiens
cuggaugacauuaaagaagggu

SEQ ID NO: 1217552 - RNA, 13 nt, Homo sapiens
cuggaugagaaac

SEQ ID NO: 1217553 - RNA, 24 nt, Homo sapiens
cuggaugauacgaaugaugucaga

SEQ ID NO: 1217554 - RNA, 23 nt, Homo sapiens
cuggauuauguuauacaaggcaa

SEQ ID NO: 1217555 - RNA, 18 nt, Homo sapiens
cuggauuccacacugcac

SEQ ID NO: 1217556 - RNA, 20 nt, Homo sapiens
cuggauuguguuugugccau

SEQ ID NO: 1217557 - RNA, 14 nt, Homo sapiens
cuggcaacaucuuu

SEQ ID NO: 1217558 - RNA, 16 nt, Homo sapiens
cuggcaagcagggaaa

SEQ ID NO: 1217559 - RNA, 15 nt, Homo sapiens
cuggcacaggacuga

SEQ ID NO: 1217560 - RNA, 17 nt, Homo sapiens
cuggcacuauaauguaa

SEQ ID NO: 1217561 - RNA, 21 nt, Homo sapiens
cuggcagccauggccauggca

SEQ ID NO: 1217562 - RNA, 15 nt, Homo sapiens
cuggcagcucuccag

SEQ ID NO: 1217563 - RNA, 13 nt, Homo sapiens
cuggcaggcaaga

SEQ ID NO: 1217564 - RNA, 18 nt, Homo sapiens
cuggcaggccagugucug

SEQ ID NO: 1217565 - RNA, 21 nt, Homo sapiens
cuggcagggcccagugacaag

SEQ ID NO: 1217566 - RNA, 22 nt, Homo sapiens
cuggcagguaggucggcacuug

SEQ ID NO: 1217567 - RNA, 18 nt, Homo sapiens
cuggcauaucuggucaga

SEQ ID NO: 1217568 - RNA, 21 nt, Homo sapiens
cuggccacaguaauuggucau

SEQ ID NO: 1217569 - RNA, 12 nt, Homo sapiens
cuggccacugca

SEQ ID NO: 1217570 - RNA, 20 nt, Homo sapiens
cuggccagcaaggcagguug

SEQ ID NO: 1217571 - RNA, 14 nt, Homo sapiens
cuggcccagccaaa

SEQ ID NO: 1217572 - RNA, 16 nt, Homo sapiens
cuggcccaggcuccag

SEQ ID NO: 1217573 - RNA, 20 nt, Homo sapiens
cuggccccacaagccaggac

SEQ ID NO: 1217574 - RNA, 23 nt, Homo sapiens
cuggcccucgacacucaccauga

SEQ ID NO: 1217575 - RNA, 15 nt, Homo sapiens
cuggcccuggccaga

SEQ ID NO: 1217576 - RNA, 23 nt, Homo sapiens
cuggcccuguccuggcaucagua

SEQ ID NO: 1217577 - RNA, 20 nt, Homo sapiens
cuggccgcguuuagaccaag

SEQ ID NO: 1217578 - RNA, 21 nt, Homo sapiens
cuggccuuuccugguuuucau

SEQ ID NO: 1217579 - RNA, 21 nt, Homo sapiens
cuggcuaauuuuuuguacuuu

SEQ ID NO: 1217580 - RNA, 20 nt, Homo sapiens
cuggcuccagagauggucac

SEQ ID NO: 1217581 - RNA, 15 nt, Homo sapiens
cuggcucugggacua

SEQ ID NO: 1217582 - RNA, 22 nt, Homo sapiens
cuggcucuugaggcauuuccag

SEQ ID NO: 1217583 - RNA, 19 nt, Homo sapiens
cuggcugaacccugugcug

SEQ ID NO: 1217584 - RNA, 15 nt, Homo sapiens
cuggcugacuggcca

SEQ ID NO: 1217585 - RNA, 14 nt, Homo sapiens
cuggcugagguucc

SEQ ID NO: 1217586 - RNA, 17 nt, Homo sapiens
cuggcugcuuuguucaa

SEQ ID NO: 1217587 - RNA, 22 nt, Homo sapiens
cuggcugcuuuguucaaugcua

SEQ ID NO: 1217588 - RNA, 19 nt, Homo sapiens
cuggcuggugacagaacau

SEQ ID NO: 1217589 - RNA, 15 nt, Homo sapiens
cuggcuguauggaaa

SEQ ID NO: 1217590 - RNA, 20 nt, Homo sapiens
cuggcuuagugccacccacc

SEQ ID NO: 1217591 - RNA, 19 nt, Homo sapiens
cuggcuuauuuuaauguga

SEQ ID NO: 1217592 - RNA, 14 nt, Homo sapiens
cuggcuuggaacac

SEQ ID NO: 1217593 - RNA, 23 nt, Homo sapiens
cuggcuuuuuccucugagcccag

SEQ ID NO: 1217594 - RNA, 22 nt, Homo sapiens
cugggaaccucccagaggucca

SEQ ID NO: 1217595 - RNA, 16 nt, Homo sapiens
cugggaacuuccucag

SEQ ID NO: 1217596 - RNA, 22 nt, Homo sapiens
cugggaagacgccugagcucac

SEQ ID NO: 1217597 - RNA, 15 nt, Homo sapiens
cugggaaucaagaca

SEQ ID NO: 1217598 - RNA, 16 nt, Homo sapiens
cugggaaucaagacaa

SEQ ID NO: 1217599 - RNA, 18 nt, Homo sapiens
cugggacaccauuaccaa

SEQ ID NO: 1217600 - RNA, 23 nt, Homo sapiens
cuggucucaaacuccugggcuca

SEQ ID NO: 1217601 - RNA, 14 nt, Homo sapiens
cuggugacaggcca

SEQ ID NO: 1217602 - RNA, 21 nt, Homo sapiens
cuggugaccacccaccaccug

SEQ ID NO: 1217603 - RNA, 16 nt, Homo sapiens
cuggugagucaccacu

SEQ ID NO: 1217604 - RNA, 20 nt, Homo sapiens
cuggugccccucgccagcuu

SEQ ID NO: 1217605 - RNA, 20 nt, Homo sapiens
cugguggcaccagaugcaac

SEQ ID NO: 1217606 - RNA, 23 nt, Homo sapiens
cuggugucacccuggauaggcaa

SEQ ID NO: 1217607 - RNA, 14 nt, Homo sapiens
cugguguccugacc

SEQ ID NO: 1217608 - RNA, 15 nt, Homo sapiens
cuggugugcucucuu

SEQ ID NO: 1217609 - RNA, 12 nt, Homo sapiens
cugguguucuau

SEQ ID NO: 1217610 - RNA, 18 nt, Homo sapiens
cugguguuuuaugggcca

SEQ ID NO: 1217611 - RNA, 17 nt, Homo sapiens
cugguuagguagaggga

SEQ ID NO: 1217612 - RNA, 15 nt, Homo sapiens
cugguuuaauuacau

SEQ ID NO: 1217613 - RNA, 20 nt, Homo sapiens
cugguuugaaagaugcagug

SEQ ID NO: 1217614 - RNA, 16 nt, Homo sapiens
cugguuuucugccaau

SEQ ID NO: 1217615 - RNA, 23 nt, Homo sapiens
cuguaaaauggaggccauugugu

SEQ ID NO: 1217616 - RNA, 20 nt, Homo sapiens
cuguaaauaccauugacaca

SEQ ID NO: 1217617 - RNA, 21 nt, Homo sapiens
cuguaaauaccauugacacau

SEQ ID NO: 1217618 - RNA, 17 nt, Homo sapiens
cuguaacauauucugua

SEQ ID NO: 1217619 - RNA, 16 nt, Homo sapiens
cuguaaggcucuagau

SEQ ID NO: 1217620 - RNA, 22 nt, Homo sapiens
cuguaagguggacuuccagcuu

SEQ ID NO: 1217621 - RNA, 23 nt, Homo sapiens
cuguaaguaacuucacauuaaaa

SEQ ID NO: 1217622 - RNA, 14 nt, Homo sapiens
cuguaauaauaccu

SEQ ID NO: 1217623 - RNA, 16 nt, Homo sapiens
cuguaaucauguacuu

SEQ ID NO: 1217624 - RNA, 15 nt, Homo sapiens
cuguaaucccaacac

SEQ ID NO: 1217625 - RNA, 20 nt, Homo sapiens
cuguaaucccaacacuuugg

SEQ ID NO: 1217626 - RNA, 17 nt, Homo sapiens
cuguaaucccagcacuu

SEQ ID NO: 1217627 - RNA, 17 nt, Homo sapiens
cuguaaucccaguacuu

SEQ ID NO: 1217628 - RNA, 19 nt, Homo sapiens
cuguaaucucagcacuuug

SEQ ID NO: 1217629 - RNA, 19 nt, Homo sapiens
cuguaauuaauaucuugcu

SEQ ID NO: 1217630 - RNA, 17 nt, Homo sapiens
cuguacaaaguagaagu

SEQ ID NO: 1217631 - RNA, 14 nt, Homo sapiens
cuguacacacuuua

SEQ ID NO: 1217632 - RNA, 20 nt, Homo sapiens
cuguacacagaauuguucca

SEQ ID NO: 1217633 - RNA, 19 nt, Homo sapiens
cuguacauacucaguaaaa

SEQ ID NO: 1217634 - RNA, 20 nt, Homo sapiens
cuguacauacucaguaaaau

SEQ ID NO: 1217635 - RNA, 16 nt, Homo sapiens
cuguaccacaucugcu

SEQ ID NO: 1217636 - RNA, 15 nt, Homo sapiens
cuguaccaguuaauu

SEQ ID NO: 1217637 - RNA, 18 nt, Homo sapiens
cuguaccucaucccauga

SEQ ID NO: 1217638 - RNA, 14 nt, Homo sapiens
cuguacuacaucua

SEQ ID NO: 1217639 - RNA, 18 nt, Homo sapiens
cuguacucuugaauacaa

SEQ ID NO: 1217640 - RNA, 23 nt, Homo sapiens
cuguagaaaugaugauguggaag

SEQ ID NO: 1217641 - RNA, 21 nt, Homo sapiens
cuguagaagaagcccauauca

SEQ ID NO: 1217642 - RNA, 23 nt, Homo sapiens
cuguagaagaagcccauaucaca

SEQ ID NO: 1217643 - RNA, 22 nt, Homo sapiens
cuguagaccaccuaauaucaau

SEQ ID NO: 1217644 - RNA, 18 nt, Homo sapiens
cuguagacuagugccgua

SEQ ID NO: 1217645 - RNA, 18 nt, Homo sapiens
cuguagcucaaguuuaaa

SEQ ID NO: 1217646 - RNA, 14 nt, Homo sapiens
cuguaggugaaaga

SEQ ID NO: 1217647 - RNA, 23 nt, Homo sapiens
cuguaggugguaugugacaccaa

SEQ ID NO: 1217648 - RNA, 15 nt, Homo sapiens
cuguaguagcccuuu

SEQ ID NO: 1217649 - RNA, 13 nt, Homo sapiens
cuguagucauuua

SEQ ID NO: 1217650 - RNA, 21 nt, Homo sapiens
cuguagucccagcuacuuggg

SEQ ID NO: 1217651 - RNA, 14 nt, Homo sapiens
cuguagucccaguu

SEQ ID NO: 1217652 - RNA, 18 nt, Homo sapiens
cuguaguccuuucugccu

SEQ ID NO: 1217653 - RNA, 14 nt, Homo sapiens
cuguaguuacugug

SEQ ID NO: 1217654 - RNA, 23 nt, Homo sapiens
cuguauaauagagauaaguccau

SEQ ID NO: 1217655 - RNA, 18 nt, Homo sapiens
cuguaucggagacaguga

SEQ ID NO: 1217656 - RNA, 16 nt, Homo sapiens
cuguaugaacuuuauc

SEQ ID NO: 1217657 - RNA, 20 nt, Homo sapiens
cuguaugccuucagcauugc

SEQ ID NO: 1217658 - RNA, 22 nt, Homo sapiens
cuguaugucaauaaacaacagc

SEQ ID NO: 1217659 - RNA, 21 nt, Homo sapiens
cuguauucuuguuuuacauuu

SEQ ID NO: 1217660 - RNA, 15 nt, Homo sapiens
cuguauuuagaucuc

SEQ ID NO: 1217661 - RNA, 17 nt, Homo sapiens
cuguauuucaagaccuc

SEQ ID NO: 1217662 - RNA, 15 nt, Homo sapiens
cugucaaaacacugu

SEQ ID NO: 1217663 - RNA, 23 nt, Homo sapiens
cugucacagaguagaaacucaaa

SEQ ID NO: 1217664 - RNA, 16 nt, Homo sapiens
cugucaccuagcucaa

SEQ ID NO: 1217665 - RNA, 18 nt, Homo sapiens
cugucacuacacacuaaa

SEQ ID NO: 1217666 - RNA, 15 nt, Homo sapiens
cugucagaaugcuau

SEQ ID NO: 1217667 - RNA, 13 nt, Homo sapiens
cugucagcugcaa

SEQ ID NO: 1217668 - RNA, 18 nt, Homo sapiens
cugucaggauucuucaag

SEQ ID NO: 1217669 - RNA, 13 nt, Homo sapiens
cugucaugguccu

SEQ ID NO: 1217670 - RNA, 15 nt, Homo sapiens
cuguccagcugcaaa

SEQ ID NO: 1217671 - RNA, 21 nt, Homo sapiens
cuguccaggccacuguggcca

SEQ ID NO: 1217672 - RNA, 14 nt, Homo sapiens
cugucccaccugca

SEQ ID NO: 1217673 - RNA, 15 nt, Homo sapiens
cugucccggcuccau

SEQ ID NO: 1217674 - RNA, 15 nt, Homo sapiens
gaauccaagccucca

SEQ ID NO: 1217675 - RNA, 19 nt, Homo sapiens
gaauccauguaaauugcaa

SEQ ID NO: 1217676 - RNA, 16 nt, Homo sapiens
gaauccccaacaugca

SEQ ID NO: 1217677 - RNA, 18 nt, Homo sapiens
gaauccccgaaggugcug

SEQ ID NO: 1217678 - RNA, 17 nt, Homo sapiens
gaauccuauuuaucaga

SEQ ID NO: 1217679 - RNA, 14 nt, Homo sapiens
gaaucuaaaccuua

SEQ ID NO: 1217680 - RNA, 22 nt, Homo sapiens
gaaucuaaaccuuacaugugua

SEQ ID NO: 1217681 - RNA, 15 nt, Homo sapiens
gaaucucguucccaa

SEQ ID NO: 1217682 - RNA, 21 nt, Homo sapiens
gaaucugcauuuagcacaaaa

SEQ ID NO: 1217683 - RNA, 14 nt, Homo sapiens
gaaucuggagacca

SEQ ID NO: 1217684 - RNA, 19 nt, Homo sapiens
gaaucugguguuggggaaa

SEQ ID NO: 1217685 - RNA, 19 nt, Homo sapiens
gaaucuguaaagaaauaua

SEQ ID NO: 1217686 - RNA, 19 nt, Homo sapiens
gaaucugugggucugggag

SEQ ID NO: 1217687 - RNA, 21 nt, Homo sapiens
gaaucuuugucagcaguuccc

SEQ ID NO: 1217688 - RNA, 21 nt, Homo sapiens
gaaugaaaauaacugaaccaa

SEQ ID NO: 1217689 - RNA, 23 nt, Homo sapiens
gaaugaaaauaacugaaccaaau

SEQ ID NO: 1217690 - RNA, 13 nt, Homo sapiens
gaaugaacacucc

SEQ ID NO: 1217691 - RNA, 17 nt, Homo sapiens
gaaugaauacugggaau

SEQ ID NO: 1217692 - RNA, 15 nt, Homo sapiens
gaaugacaacagaag

SEQ ID NO: 1217693 - RNA, 15 nt, Homo sapiens
gaaugacauugaacu

SEQ ID NO: 1217694 - RNA, 18 nt, Homo sapiens
gaaugaccagccugucca

SEQ ID NO: 1217695 - RNA, 21 nt, Homo sapiens
gaaugagaagaggcugcugca

SEQ ID NO: 1217696 - RNA, 15 nt, Homo sapiens
gaaugagccaaagaa

SEQ ID NO: 1217697 - RNA, 17 nt, Homo sapiens
gaaugaggcaauuucaa

SEQ ID NO: 1217698 - RNA, 14 nt, Homo sapiens
gaaugcaagcugga

SEQ ID NO: 1217699 - RNA, 18 nt, Homo sapiens
gaaugcacaagaauggau

SEQ ID NO: 1217700 - RNA, 16 nt, Homo sapiens
gaaugcaguggggaca

SEQ ID NO: 1217701 - RNA, 21 nt, Homo sapiens
gaaugcauuauuuauugcugu

SEQ ID NO: 1217702 - RNA, 14 nt, Homo sapiens
gaaugcccagugag

SEQ ID NO: 1217703 - RNA, 19 nt, Homo sapiens
gaaugccuaaauauaauua

SEQ ID NO: 1217704 - RNA, 20 nt, Homo sapiens
gaaugccucgcucccuucaa

SEQ ID NO: 1217705 - RNA, 16 nt, Homo sapiens
gaauggaaaacacaug

SEQ ID NO: 1217706 - RNA, 22 nt, Homo sapiens
gaauggcugcaccuuuuugcau

SEQ ID NO: 1217707 - RNA, 14 nt, Homo sapiens
gaaugggguagaaa

SEQ ID NO: 1217708 - RNA, 20 nt, Homo sapiens
gaauggguguuguaugggga

SEQ ID NO: 1217709 - RNA, 19 nt, Homo sapiens
gaaugguuaauaaaacugc

SEQ ID NO: 1217710 - RNA, 14 nt, Homo sapiens
gaauguaugugcac

SEQ ID NO: 1217711 - RNA, 18 nt, Homo sapiens
gaaugucuuacugugauc

SEQ ID NO: 1217712 - RNA, 11 nt, Homo sapiens
gaaugugauuu

SEQ ID NO: 1217713 - RNA, 14 nt, Homo sapiens
gaaugugcuuugua

SEQ ID NO: 1217714 - RNA, 17 nt, Homo sapiens
gaauguuuaaagaucau

SEQ ID NO: 1217715 - RNA, 17 nt, Homo sapiens
gaauuaaaaaagcauac

SEQ ID NO: 1217716 - RNA, 19 nt, Homo sapiens
gaauuaaaacuuuaaggaa

SEQ ID NO: 1217717 - RNA, 19 nt, Homo sapiens
gaauuaaccuggugcugga

SEQ ID NO: 1217718 - RNA, 14 nt, Homo sapiens
gaauuacacugugc

SEQ ID NO: 1217719 - RNA, 12 nt, Homo sapiens
gaauuacagaca

SEQ ID NO: 1217720 - RNA, 22 nt, Homo sapiens
gaauuacuaaauuacaaaugca

SEQ ID NO: 1217721 - RNA, 17 nt, Homo sapiens
gaauuagagaagcugaa

SEQ ID NO: 1217722 - RNA, 19 nt, Homo sapiens
gaauuagcaauaacauaca

SEQ ID NO: 1217723 - RNA, 21 nt, Homo sapiens
gaauuaggcuguaacuacuuu

SEQ ID NO: 1217724 - RNA, 15 nt, Homo sapiens
gaauuauaaaggcca

SEQ ID NO: 1217725 - RNA, 15 nt, Homo sapiens
gaauuaucuauuuca

SEQ ID NO: 1217726 - RNA, 20 nt, Homo sapiens
gaauuauuuaaacaaaaacu

SEQ ID NO: 1217727 - RNA, 12 nt, Homo sapiens
gaauucaaacaa

SEQ ID NO: 1217728 - RNA, 13 nt, Homo sapiens
gaauucaaacugg

SEQ ID NO: 1217729 - RNA, 16 nt, Homo sapiens
gaauucaaagcuugug

SEQ ID NO: 1217730 - RNA, 12 nt, Homo sapiens
gaauucagcuca

SEQ ID NO: 1217731 - RNA, 14 nt, Homo sapiens
gaauuccagcaaaa

SEQ ID NO: 1217732 - RNA, 14 nt, Homo sapiens
gaauucuaagugaa

SEQ ID NO: 1217733 - RNA, 10 nt, Homo sapiens
gaauucugua

SEQ ID NO: 1217734 - RNA, 13 nt, Homo sapiens
gaauucuugaguu

SEQ ID NO: 1217735 - RNA, 19 nt, Homo sapiens
gaauucuuuuucauuugag

SEQ ID NO: 1217736 - RNA, 18 nt, Homo sapiens
gaauugaacgacuaccca

SEQ ID NO: 1217737 - RNA, 17 nt, Homo sapiens
gaauugcuuaccaaagg

SEQ ID NO: 1217738 - RNA, 18 nt, Homo sapiens
gaauuggaaaggaaaaga

SEQ ID NO: 1217739 - RNA, 17 nt, Homo sapiens
gaauuguuccaguacua

SEQ ID NO: 1217740 - RNA, 16 nt, Homo sapiens
gaauuuaaacaaugca

SEQ ID NO: 1217741 - RNA, 20 nt, Homo sapiens
gaauuuaauacagacaucua

SEQ ID NO: 1217742 - RNA, 19 nt, Homo sapiens
gaauuuagucucuguguca

SEQ ID NO: 1217743 - RNA, 19 nt, Homo sapiens
gacacuuuggaaguuugug

SEQ ID NO: 1217744 - RNA, 14 nt, Homo sapiens
gacagaaagagaca

SEQ ID NO: 1217745 - RNA, 15 nt, Homo sapiens
gacagaaagagacag

SEQ ID NO: 1217746 - RNA, 17 nt, Homo sapiens
gacagaaggugccacuu

SEQ ID NO: 1217747 - RNA, 19 nt, Homo sapiens
gacagaauguaucugugaa

SEQ ID NO: 1217748 - RNA, 22 nt, Homo sapiens
gacagaccacagagcugucacu

SEQ ID NO: 1217749 - RNA, 17 nt, Homo sapiens
gacagagaauaacucag

SEQ ID NO: 1217750 - RNA, 17 nt, Homo sapiens
gacagagagaggcauuu

SEQ ID NO: 1217751 - RNA, 16 nt, Homo sapiens
gacagagcuggugaua

SEQ ID NO: 1217752 - RNA, 17 nt, Homo sapiens
gacagaugaaugccgug

SEQ ID NO: 1217753 - RNA, 18 nt, Homo sapiens
gacagcaaggaacuguca

SEQ ID NO: 1217754 - RNA, 19 nt, Homo sapiens
gacagcaucuaagaaguuu

SEQ ID NO: 1217755 - RNA, 22 nt, Homo sapiens
gacagccacggccaggccagag

SEQ ID NO: 1217756 - RNA, 13 nt, Homo sapiens
gacagcucuccaa

SEQ ID NO: 1217757 - RNA, 18 nt, Homo sapiens
gacagcucuguaucugcc

SEQ ID NO: 1217758 - RNA, 18 nt, Homo sapiens
gacagcugcugugcauua

SEQ ID NO: 1217759 - RNA, 16 nt, Homo sapiens
gacaggaauacuuaac

SEQ ID NO: 1217760 - RNA, 17 nt, Homo sapiens
gacaggccacaccacag

SEQ ID NO: 1217761 - RNA, 15 nt, Homo sapiens
gacaguaaaucucac

SEQ ID NO: 1217762 - RNA, 12 nt, Homo sapiens
gacaguaccuga

SEQ ID NO: 1217763 - RNA, 15 nt, Homo sapiens
gacaguauccacaau

SEQ ID NO: 1217764 - RNA, 21 nt, Homo sapiens
gacagucucaccuccugccau

SEQ ID NO: 1217765 - RNA, 18 nt, Homo sapiens
gacagucuggaaagugau

SEQ ID NO: 1217766 - RNA, 15 nt, Homo sapiens
gacagugaccccagu

SEQ ID NO: 1217767 - RNA, 15 nt, Homo sapiens
gacagugcauuugcc

SEQ ID NO: 1217768 - RNA, 19 nt, Homo sapiens
gacagugcauuugccuugu

SEQ ID NO: 1217769 - RNA, 19 nt, Homo sapiens
gacagugcccaugcaaugg

SEQ ID NO: 1217770 - RNA, 19 nt, Homo sapiens
gacauaaagccauguuucc

SEQ ID NO: 1217771 - RNA, 22 nt, Homo sapiens
gacauaauaacagcaguggagu

SEQ ID NO: 1217772 - RNA, 22 nt, Homo sapiens
gacauauacuaagauguucacu

SEQ ID NO: 1217773 - RNA, 14 nt, Homo sapiens
gacaucacagcagc

SEQ ID NO: 1217774 - RNA, 18 nt, Homo sapiens
gacauccagcgugacgga

SEQ ID NO: 1217775 - RNA, 19 nt, Homo sapiens
gacaugaacagaaacaaua

SEQ ID NO: 1217776 - RNA, 16 nt, Homo sapiens
gacaugauuagcagaa

SEQ ID NO: 1217777 - RNA, 15 nt, Homo sapiens
gacaugcacacgugu

SEQ ID NO: 1217778 - RNA, 21 nt, Homo sapiens
gacaugcuccaccgucagggg

SEQ ID NO: 1217779 - RNA, 22 nt, Homo sapiens
gacaugcugaaauuauuucucu

SEQ ID NO: 1217780 - RNA, 13 nt, Homo sapiens
gacaugugacauu

SEQ ID NO: 1217781 - RNA, 16 nt, Homo sapiens
gacauguggggccagg

SEQ ID NO: 1217782 - RNA, 23 nt, Homo sapiens
gacauuaacaguuuuccaugaaa

SEQ ID NO: 1217783 - RNA, 16 nt, Homo sapiens
gacauucaaggcauuu

SEQ ID NO: 1217784 - RNA, 22 nt, Homo sapiens
gacauucaaggcauuucuauca

SEQ ID NO: 1217785 - RNA, 13 nt, Homo sapiens
gacauugaacuga

SEQ ID NO: 1217786 - RNA, 18 nt, Homo sapiens
gacauugcggacagccac

SEQ ID NO: 1217787 - RNA, 22 nt, Homo sapiens
gacauuugggagacaugugaca

SEQ ID NO: 1217788 - RNA, 20 nt, Homo sapiens
gacauuuuuugcuauaauca

SEQ ID NO: 1217789 - RNA, 17 nt, Homo sapiens
gaccaaaaugacaauga

SEQ ID NO: 1217790 - RNA, 21 nt, Homo sapiens
gaccaaaaugacaaugaugau

SEQ ID NO: 1217791 - RNA, 17 nt, Homo sapiens
gaccaaagagcccucaa

SEQ ID NO: 1217792 - RNA, 20 nt, Homo sapiens
gaccacacgcccccacaggc

SEQ ID NO: 1217793 - RNA, 18 nt, Homo sapiens
gaccacagaagacccgcu

SEQ ID NO: 1217794 - RNA, 16 nt, Homo sapiens
gaccaccacauugaga

SEQ ID NO: 1217795 - RNA, 13 nt, Homo sapiens
gaccaccaccagg

SEQ ID NO: 1217796 - RNA, 17 nt, Homo sapiens
gaccaccaccaggacug

SEQ ID NO: 1217797 - RNA, 15 nt, Homo sapiens
gaccaccuaauauca

SEQ ID NO: 1217798 - RNA, 20 nt, Homo sapiens
gaccaccuccaggacucagu

SEQ ID NO: 1217799 - RNA, 16 nt, Homo sapiens
gaccacggggagcaaa

SEQ ID NO: 1217800 - RNA, 12 nt, Homo sapiens
gaccacuccugu

SEQ ID NO: 1217801 - RNA, 22 nt, Homo sapiens
gaccacucugucuuguguuucc

SEQ ID NO: 1217802 - RNA, 24 nt, Homo sapiens
gaccacugggcaaugauggcaauu

SEQ ID NO: 1217803 - RNA, 13 nt, Homo sapiens
gaccagcuuugca

SEQ ID NO: 1217804 - RNA, 18 nt, Homo sapiens
gaccagcuuugcagugac

SEQ ID NO: 1217805 - RNA, 18 nt, Homo sapiens
gaccaggaugacaccucc

SEQ ID NO: 1217806 - RNA, 17 nt, Homo sapiens
gaccaggccugagcaac

SEQ ID NO: 1217807 - RNA, 16 nt, Homo sapiens
gaccauaguauaauca

SEQ ID NO: 1217808 - RNA, 22 nt, Homo sapiens
gaccauuugacuguucaaugau

SEQ ID NO: 1217809 - RNA, 17 nt, Homo sapiens
gacccaccccugugcuc

SEQ ID NO: 1217810 - RNA, 15 nt, Homo sapiens
gacccaggcccucca

SEQ ID NO: 1217811 - RNA, 20 nt, Homo sapiens
gacccaggccuggccaguca

SEQ ID NO: 1217812 - RNA, 14 nt, Homo sapiens
gacccaugugcaag

SEQ ID NO: 1217813 - RNA, 18 nt, Homo sapiens
gacucagaugaggacaga

SEQ ID NO: 1217814 - RNA, 14 nt, Homo sapiens
gacucagcuggaag

SEQ ID NO: 1217815 - RNA, 18 nt, Homo sapiens
gacucauggccgggcuga

SEQ ID NO: 1217816 - RNA, 12 nt, Homo sapiens
gacuccaucuca

SEQ ID NO: 1217817 - RNA, 12 nt, Homo sapiens
gacuccaucucu

SEQ ID NO: 1217818 - RNA, 16 nt, Homo sapiens
gacuccuggucuguga

SEQ ID NO: 1217819 - RNA, 13 nt, Homo sapiens
gacucgccagcuc

SEQ ID NO: 1217820 - RNA, 23 nt, Homo sapiens
gacucgccucugcuccugugguc

SEQ ID NO: 1217821 - RNA, 16 nt, Homo sapiens
gacucuaauaugauua

SEQ ID NO: 1217822 - RNA, 12 nt, Homo sapiens
gacucucaggga

SEQ ID NO: 1217823 - RNA, 20 nt, Homo sapiens
gacucuccaaauagcauuag

SEQ ID NO: 1217824 - RNA, 13 nt, Homo sapiens
gacucuccaggga

SEQ ID NO: 1217825 - RNA, 20 nt, Homo sapiens
gacucuccuccuugagcccu

SEQ ID NO: 1217826 - RNA, 10 nt, Homo sapiens
gacucugcac

SEQ ID NO: 1217827 - RNA, 15 nt, Homo sapiens
gacucugcacauguc

SEQ ID NO: 1217828 - RNA, 16 nt, Homo sapiens
gacucugcacaugucu

SEQ ID NO: 1217829 - RNA, 20 nt, Homo sapiens
gacucugcacaugucuugua

SEQ ID NO: 1217830 - RNA, 16 nt, Homo sapiens
gacucugcacucucca

SEQ ID NO: 1217831 - RNA, 16 nt, Homo sapiens
gacucugcuucagucc

SEQ ID NO: 1217832 - RNA, 17 nt, Homo sapiens
gacucuguaauugaaua

SEQ ID NO: 1217833 - RNA, 17 nt, Homo sapiens
gacugaaaugugcucag

SEQ ID NO: 1217834 - RNA, 18 nt, Homo sapiens
gacugaaggggcacacca

SEQ ID NO: 1217835 - RNA, 22 nt, Homo sapiens
gacugaaugugccuaauggaga

SEQ ID NO: 1217836 - RNA, 14 nt, Homo sapiens
gacugacaaccuca

SEQ ID NO: 1217837 - RNA, 17 nt, Homo sapiens
gacugaccauauugugc

SEQ ID NO: 1217838 - RNA, 20 nt, Homo sapiens
gacugaccccagugguaucc

SEQ ID NO: 1217839 - RNA, 12 nt, Homo sapiens
gacugauuucag

SEQ ID NO: 1217840 - RNA, 19 nt, Homo sapiens
gacugcagggguccacugu

SEQ ID NO: 1217841 - RNA, 21 nt, Homo sapiens
gacuggaaguucauaccuaag

SEQ ID NO: 1217842 - RNA, 13 nt, Homo sapiens
gacuggagcucau

SEQ ID NO: 1217843 - RNA, 23 nt, Homo sapiens
gacuggcaagaggccucaugccu

SEQ ID NO: 1217844 - RNA, 12 nt, Homo sapiens
gacuggcaauaa

SEQ ID NO: 1217845 - RNA, 14 nt, Homo sapiens
gacuggcacacugg

SEQ ID NO: 1217846 - RNA, 17 nt, Homo sapiens
gacuggcacacuggccu

SEQ ID NO: 1217847 - RNA, 21 nt, Homo sapiens
gacugggugagacccaaagcg

SEQ ID NO: 1217848 - RNA, 13 nt, Homo sapiens
gacuggguggucc

SEQ ID NO: 1217849 - RNA, 14 nt, Homo sapiens
gacuguacuccucc

SEQ ID NO: 1217850 - RNA, 15 nt, Homo sapiens
gacugugugcaacgc

SEQ ID NO: 1217851 - RNA, 22 nt, Homo sapiens
gacuguugcucaaaucuauuca

SEQ ID NO: 1217852 - RNA, 22 nt, Homo sapiens
gacuuaaaauauuccugcauuu

SEQ ID NO: 1217853 - RNA, 18 nt, Homo sapiens
gacuuaacugguucauau

SEQ ID NO: 1217854 - RNA, 16 nt, Homo sapiens
gacuuagagcugggaa

SEQ ID NO: 1217855 - RNA, 20 nt, Homo sapiens
gacuuagaggcaacaggauu

SEQ ID NO: 1217856 - RNA, 18 nt, Homo sapiens
gacuuaggaaccuaccag

SEQ ID NO: 1217857 - RNA, 18 nt, Homo sapiens
gacuuaggggaguucagu

SEQ ID NO: 1217858 - RNA, 12 nt, Homo sapiens
gacuucaucugg

SEQ ID NO: 1217859 - RNA, 20 nt, Homo sapiens
gacuucauugucccucuuca

SEQ ID NO: 1217860 - RNA, 19 nt, Homo sapiens
gacuucccaacagccuuag

SEQ ID NO: 1217861 - RNA, 18 nt, Homo sapiens
gacuucuaauaucauuca

SEQ ID NO: 1217862 - RNA, 16 nt, Homo sapiens
gacuucuaccugcccu

SEQ ID NO: 1217863 - RNA, 12 nt, Homo sapiens
gacuucucugaa

SEQ ID NO: 1217864 - RNA, 18 nt, Homo sapiens
gacuucuuacccaaagca

SEQ ID NO: 1217865 - RNA, 16 nt, Homo sapiens
gacuugaagcacagag

SEQ ID NO: 1217866 - RNA, 21 nt, Homo sapiens
gacuugaaugugcaccugagg

SEQ ID NO: 1217867 - RNA, 17 nt, Homo sapiens
gacuugauuagugccuu

SEQ ID NO: 1217868 - RNA, 14 nt, Homo sapiens
gacuuggcacuuaa

SEQ ID NO: 1217869 - RNA, 18 nt, Homo sapiens
gacuuguuugucuuccau

SEQ ID NO: 1217870 - RNA, 20 nt, Homo sapiens
gacuuguuuuaugcucaggg

SEQ ID NO: 1217871 - RNA, 17 nt, Homo sapiens
gacuuuauguugaaaua

SEQ ID NO: 1217872 - RNA, 23 nt, Homo sapiens
gacuuucuugaaaagaagcaagg

SEQ ID NO: 1217873 - RNA, 17 nt, Homo sapiens
gacuuugcagauggaaa

SEQ ID NO: 1217874 - RNA, 17 nt, Homo sapiens
gacuuugggaccugcuu

SEQ ID NO: 1217875 - RNA, 19 nt, Homo sapiens
gacuuuguccccacuuaca

SEQ ID NO: 1217876 - RNA, 20 nt, Homo sapiens
gacuuuuuagccagugacuu

SEQ ID NO: 1217877 - RNA, 22 nt, Homo sapiens
gagaaaagaaaccagagucaaa

SEQ ID NO: 1217878 - RNA, 11 nt, Homo sapiens
gagaaacugaa

SEQ ID NO: 1217879 - RNA, 19 nt, Homo sapiens
gagaaagagagaagccagc

SEQ ID NO: 1217880 - RNA, 13 nt, Homo sapiens
gagaaagcacuga

SEQ ID NO: 1217881 - RNA, 15 nt, Homo sapiens
gagaaauacuuucag

SEQ ID NO: 1217882 - RNA, 23 nt, Homo sapiens
gagaaauacuuucaggcacuaag

SEQ ID NO: 1217883 - RNA, 19 nt, Homo sapiens
gagaaaugaauaauuuccc

SEQ ID NO: 1217884 - RNA, 14 nt, Homo sapiens
gagaaauggccaaa

SEQ ID NO: 1217885 - RNA, 19 nt, Homo sapiens
gagagagucuuacucugcc

SEQ ID NO: 1217886 - RNA, 20 nt, Homo sapiens
gagagaugaaccacauuaua

SEQ ID NO: 1217887 - RNA, 16 nt, Homo sapiens
gagagcccaaguuauc

SEQ ID NO: 1217888 - RNA, 14 nt, Homo sapiens
gagagcccauuccc

SEQ ID NO: 1217889 - RNA, 22 nt, Homo sapiens
gagagcccccaccuugauccca

SEQ ID NO: 1217890 - RNA, 14 nt, Homo sapiens
gagagcgaaggggg

SEQ ID NO: 1217891 - RNA, 15 nt, Homo sapiens
gagagcucacagacu

SEQ ID NO: 1217892 - RNA, 22 nt, Homo sapiens
gagaggaaagaccuacauuccc

SEQ ID NO: 1217893 - RNA, 20 nt, Homo sapiens
gagaggaacacaggcgcuga

SEQ ID NO: 1217894 - RNA, 20 nt, Homo sapiens
gagaggaggaggaugacuaa

SEQ ID NO: 1217895 - RNA, 13 nt, Homo sapiens
gagaggcaggcau

SEQ ID NO: 1217896 - RNA, 16 nt, Homo sapiens
gagaggcaggcauaga

SEQ ID NO: 1217897 - RNA, 18 nt, Homo sapiens
gagagggcugcugaccau

SEQ ID NO: 1217898 - RNA, 13 nt, Homo sapiens
gagaggggggcca

SEQ ID NO: 1217899 - RNA, 18 nt, Homo sapiens
gagaguauauuauguauu

SEQ ID NO: 1217900 - RNA, 16 nt, Homo sapiens
gagagucgcaucucag

SEQ ID NO: 1217901 - RNA, 15 nt, Homo sapiens
gagagugaaaccaug

SEQ ID NO: 1217902 - RNA, 17 nt, Homo sapiens
gagagugagcaaccagc

SEQ ID NO: 1217903 - RNA, 13 nt, Homo sapiens
gagaguuugccug

SEQ ID NO: 1217904 - RNA, 16 nt, Homo sapiens
gagauaaacaccacca

SEQ ID NO: 1217905 - RNA, 16 nt, Homo sapiens
gagauaagucuuucau

SEQ ID NO: 1217906 - RNA, 21 nt, Homo sapiens
gagaucacgccacugcacuau

SEQ ID NO: 1217907 - RNA, 20 nt, Homo sapiens
gagaucacuacucagugcau

SEQ ID NO: 1217908 - RNA, 11 nt, Homo sapiens
gagauccuccu

SEQ ID NO: 1217909 - RNA, 20 nt, Homo sapiens
gagaucgugcuacugcacuc

SEQ ID NO: 1217910 - RNA, 19 nt, Homo sapiens
gagaucuaaggaugucaca

SEQ ID NO: 1217911 - RNA, 19 nt, Homo sapiens
gagaucuauauauguauaa

SEQ ID NO: 1217912 - RNA, 21 nt, Homo sapiens
gagaucuuucuuuccaaaaca

SEQ ID NO: 1217913 - RNA, 16 nt, Homo sapiens
gagaugcagucacuua

SEQ ID NO: 1217914 - RNA, 19 nt, Homo sapiens
gagaugcuggacuugccua

SEQ ID NO: 1217915 - RNA, 23 nt, Homo sapiens
gagaugggcuuguuuucuugcca

SEQ ID NO: 1217916 - RNA, 19 nt, Homo sapiens
gagauggucacaugaccca

SEQ ID NO: 1217917 - RNA, 11 nt, Homo sapiens
gagauguaucc

SEQ ID NO: 1217918 - RNA, 23 nt, Homo sapiens
gagauguugaaauuacauuauuu

SEQ ID NO: 1217919 - RNA, 15 nt, Homo sapiens
gagauuauucuuugu

SEQ ID NO: 1217920 - RNA, 22 nt, Homo sapiens
gagauugcacuauugcacucca

SEQ ID NO: 1217921 - RNA, 17 nt, Homo sapiens
gagauuuaccagggaug

SEQ ID NO: 1217922 - RNA, 16 nt, Homo sapiens
gagauuucaugccugg

SEQ ID NO: 1217923 - RNA, 12 nt, Homo sapiens
gagauuuccucc

SEQ ID NO: 1217924 - RNA, 18 nt, Homo sapiens
gagauuucuuguugcuca

SEQ ID NO: 1217925 - RNA, 19 nt, Homo sapiens
gagauuuugcaaucugugu

SEQ ID NO: 1217926 - RNA, 17 nt, Homo sapiens
gagcaaaucgugccuug

SEQ ID NO: 1217927 - RNA, 18 nt, Homo sapiens
gagcaaauguggcuccug

SEQ ID NO: 1217928 - RNA, 13 nt, Homo sapiens
gagcaagacucca

SEQ ID NO: 1217929 - RNA, 22 nt, Homo sapiens
gagcaauggaguggcugccaug

SEQ ID NO: 1217930 - RNA, 14 nt, Homo sapiens
gagcacaagccaca

SEQ ID NO: 1217931 - RNA, 16 nt, Homo sapiens
gagcaccgccugugaa

SEQ ID NO: 1217932 - RNA, 16 nt, Homo sapiens
gagcacuugagaacca

SEQ ID NO: 1217933 - RNA, 17 nt, Homo sapiens
gagcagaggucucccaa

SEQ ID NO: 1217934 - RNA, 17 nt, Homo sapiens
gagcagcuagcucuuug

SEQ ID NO: 1217935 - RNA, 21 nt, Homo sapiens
gagcagcuuuaaacucaggga

SEQ ID NO: 1217936 - RNA, 18 nt, Homo sapiens
gagcaggagcauccucug

SEQ ID NO: 1217937 - RNA, 18 nt, Homo sapiens
gagcagggauuaaccucu

SEQ ID NO: 1217938 - RNA, 17 nt, Homo sapiens
gagcaggggcaggguga

SEQ ID NO: 1217939 - RNA, 22 nt, Homo sapiens
gagcagugccaaucgggcagaa

SEQ ID NO: 1217940 - RNA, 16 nt, Homo sapiens
gagcauacacacaggu

SEQ ID NO: 1217941 - RNA, 19 nt, Homo sapiens
gagcauagcagaggggcca

SEQ ID NO: 1217942 - RNA, 21 nt, Homo sapiens
gagcauccuuaccuccaaaag

SEQ ID NO: 1217943 - RNA, 18 nt, Homo sapiens
gagcauggaugcauuuca

SEQ ID NO: 1217944 - RNA, 17 nt, Homo sapiens
gagcaugguguuuucau

SEQ ID NO: 1217945 - RNA, 21 nt, Homo sapiens
gagcauuuaagagugaaguca

SEQ ID NO: 1217946 - RNA, 22 nt, Homo sapiens
gagcauuuccaacaccacagac

SEQ ID NO: 1217947 - RNA, 14 nt, Homo sapiens
gagcauuugcaccu

SEQ ID NO: 1217948 - RNA, 18 nt, Homo sapiens
gagccaaagcuuauguga

SEQ ID NO: 1217949 - RNA, 12 nt, Homo sapiens
gagccaaccucg

SEQ ID NO: 1217950 - RNA, 20 nt, Homo sapiens
gagccaccacgccuggcugg

SEQ ID NO: 1217951 - RNA, 20 nt, Homo sapiens
gagccaccacguccagcugg

SEQ ID NO: 1217952 - RNA, 19 nt, Homo sapiens
gagccaccugacucuugca

SEQ ID NO: 1217953 - RNA, 21 nt, Homo sapiens
gagccacucagucucuuccac

SEQ ID NO: 1217954 - RNA, 16 nt, Homo sapiens
gagccaggaccacaga

SEQ ID NO: 1217955 - RNA, 16 nt, Homo sapiens
gagccaggacccagga

SEQ ID NO: 1217956 - RNA, 17 nt, Homo sapiens
gagcccagcuuccugaa

SEQ ID NO: 1217957 - RNA, 12 nt, Homo sapiens
gagcccagugaa

SEQ ID NO: 1217958 - RNA, 15 nt, Homo sapiens
gagcccauccagucu

SEQ ID NO: 1217959 - RNA, 15 nt, Homo sapiens
gagcccauucccacc

SEQ ID NO: 1217960 - RNA, 16 nt, Homo sapiens
gagccccagcuacccu

SEQ ID NO: 1217961 - RNA, 21 nt, Homo sapiens
gagccccaggggacaagggau

SEQ ID NO: 1217962 - RNA, 17 nt, Homo sapiens
gagcccccaccacaaac

SEQ ID NO: 1217963 - RNA, 20 nt, Homo sapiens
gagcccuaaaaauccagacu

SEQ ID NO: 1217964 - RNA, 19 nt, Homo sapiens
gagcccuaagcauugacuu

SEQ ID NO: 1217965 - RNA, 12 nt, Homo sapiens
gagccucuuagu

SEQ ID NO: 1217966 - RNA, 14 nt, Homo sapiens
gagcgagacuuggu

SEQ ID NO: 1217967 - RNA, 20 nt, Homo sapiens
gagcgcaagauagauuugga

SEQ ID NO: 1217968 - RNA, 13 nt, Homo sapiens
gagcgcacaggga

SEQ ID NO: 1217969 - RNA, 21 nt, Homo sapiens
gagcggcgcccuggacuuggu

SEQ ID NO: 1217970 - RNA, 14 nt, Homo sapiens
gagcgguaugcucu

SEQ ID NO: 1217971 - RNA, 14 nt, Homo sapiens
gagcgucaggguug

SEQ ID NO: 1217972 - RNA, 17 nt, Homo sapiens
gagcuagaaacucagga

SEQ ID NO: 1217973 - RNA, 19 nt, Homo sapiens
gagcuccccagaucuccca

SEQ ID NO: 1217974 - RNA, 19 nt, Homo sapiens
gagcucuacccugcucccu

SEQ ID NO: 1217975 - RNA, 17 nt, Homo sapiens
gagcucuagcaagggag

SEQ ID NO: 1217976 - RNA, 16 nt, Homo sapiens
gagcugauacuuugac

SEQ ID NO: 1217977 - RNA, 21 nt, Homo sapiens
gagcugauacuuugacagugu

SEQ ID NO: 1217978 - RNA, 14 nt, Homo sapiens
gagcugcaggggug

SEQ ID NO: 1217979 - RNA, 16 nt, Homo sapiens
gagcugccugcugcca

SEQ ID NO: 1217980 - RNA, 16 nt, Homo sapiens
gagcugcucaccggag

SEQ ID NO: 1217981 - RNA, 15 nt, Homo sapiens
gagcuggaucacuug

SEQ ID NO: 1217982 - RNA, 14 nt, Homo sapiens
gagcuggaucucuc

SEQ ID NO: 1217983 - RNA, 15 nt, Homo sapiens
gagcuggcaccagaa

SEQ ID NO: 1217984 - RNA, 17 nt, Homo sapiens
gagcuggccuccuaugc

SEQ ID NO: 1217985 - RNA, 20 nt, Homo sapiens
gagcuggccucucuagcaca

SEQ ID NO: 1217986 - RNA, 16 nt, Homo sapiens
gagcugucugaacuca

SEQ ID NO: 1217987 - RNA, 17 nt, Homo sapiens
gagcuguguucuugcca

SEQ ID NO: 1217988 - RNA, 20 nt, Homo sapiens
gagcuguuuucccugaccuc

SEQ ID NO: 1217989 - RNA, 13 nt, Homo sapiens
gagcuugauuaaa

SEQ ID NO: 1217990 - RNA, 23 nt, Homo sapiens
gagcuuggcguuuggacccaguu

SEQ ID NO: 1217991 - RNA, 18 nt, Homo sapiens
gagcuuguaauugcacca

SEQ ID NO: 1217992 - RNA, 20 nt, Homo sapiens
gagcuuuccuucuccaggaa

SEQ ID NO: 1217993 - RNA, 16 nt, Homo sapiens
gagcuuucuuugcacu

SEQ ID NO: 1217994 - RNA, 18 nt, Homo sapiens
gagcuuugguaaucucug

SEQ ID NO: 1217995 - RNA, 22 nt, Homo sapiens
gaggaaaaguaaggugcaguuc

SEQ ID NO: 1217996 - RNA, 14 nt, Homo sapiens
gaggaaauccauug

SEQ ID NO: 1217997 - RNA, 17 nt, Homo sapiens
gaggaagacaggcaaau

SEQ ID NO: 1217998 - RNA, 19 nt, Homo sapiens
gaggaaggaacagcaaugg

SEQ ID NO: 1217999 - RNA, 17 nt, Homo sapiens
gaggacaauacuggggu

SEQ ID NO: 1218000 - RNA, 21 nt, Homo sapiens
gaggacagagcaggggcucca

SEQ ID NO: 1218001 - RNA, 22 nt, Homo sapiens
gaggacccgugugacucgccag

SEQ ID NO: 1218002 - RNA, 22 nt, Homo sapiens
gaggacgcacgcucgcugccau

SEQ ID NO: 1218003 - RNA, 18 nt, Homo sapiens
gaggacucgcuuguaaau

SEQ ID NO: 1218004 - RNA, 17 nt, Homo sapiens
gaggacugagacuggca

SEQ ID NO: 1218005 - RNA, 23 nt, Homo sapiens
gaggagcaagguuuaaauuuguu

SEQ ID NO: 1218006 - RNA, 16 nt, Homo sapiens
gaggagcacaguuugu

SEQ ID NO: 1218007 - RNA, 20 nt, Homo sapiens
gaggagcaccuccgccagau

SEQ ID NO: 1218008 - RNA, 20 nt, Homo sapiens
gaggagccggugcucuggaa

SEQ ID NO: 1218009 - RNA, 16 nt, Homo sapiens
gaggagggaggccagg

SEQ ID NO: 1218010 - RNA, 13 nt, Homo sapiens
gaggaucacugga

SEQ ID NO: 1218011 - RNA, 12 nt, Homo sapiens
gaggaugacuaa

SEQ ID NO: 1218012 - RNA, 15 nt, Homo sapiens
gaggaugcaacaaau

SEQ ID NO: 1218013 - RNA, 16 nt, Homo sapiens
gaggauuucaucucuu

SEQ ID NO: 1218014 - RNA, 21 nt, Homo sapiens
gaggcagaggguugcagugag

SEQ ID NO: 1218015 - RNA, 21 nt, Homo sapiens
gaggcagcuucaagugccuuu

SEQ ID NO: 1218016 - RNA, 20 nt, Homo sapiens
gaggcaggagaaucgcuuga

SEQ ID NO: 1218017 - RNA, 20 nt, Homo sapiens
gaggcaggagaauugcuuga

SEQ ID NO: 1218018 - RNA, 15 nt, Homo sapiens
gaggcaggaggauug

SEQ ID NO: 1218019 - RNA, 10 nt, Homo sapiens
gaggcauuuc

SEQ ID NO: 1218020 - RNA, 10 nt, Homo sapiens
gaggcccaaa

SEQ ID NO: 1218021 - RNA, 16 nt, Homo sapiens
gaggccggaaucucag

SEQ ID NO: 1218022 - RNA, 15 nt, Homo sapiens
gaggccugcacagcu

SEQ ID NO: 1218023 - RNA, 22 nt, Homo sapiens
gaggccuggacuuuccugcaac

SEQ ID NO: 1218024 - RNA, 21 nt, Homo sapiens
gaggcgcugcugguguucuua

SEQ ID NO: 1218025 - RNA, 14 nt, Homo sapiens
gaggcuacagcaga

SEQ ID NO: 1218026 - RNA, 22 nt, Homo sapiens
gaggcuccacuuggucugugag

SEQ ID NO: 1218027 - RNA, 21 nt, Homo sapiens
gaggcucucccucucucucau

SEQ ID NO: 1218028 - RNA, 16 nt, Homo sapiens
gaggcugccccucuca

SEQ ID NO: 1218029 - RNA, 20 nt, Homo sapiens
gaggcugccccucucaccaa

SEQ ID NO: 1218030 - RNA, 13 nt, Homo sapiens
gaggcuggugcca

SEQ ID NO: 1218031 - RNA, 18 nt, Homo sapiens
gagucucugaaugaagcu

SEQ ID NO: 1218032 - RNA, 18 nt, Homo sapiens
gagucugaacagcuguaa

SEQ ID NO: 1218033 - RNA, 23 nt, Homo sapiens
gagucugagaacccccagaccaa

SEQ ID NO: 1218034 - RNA, 16 nt, Homo sapiens
gagucugcacgggacc

SEQ ID NO: 1218035 - RNA, 15 nt, Homo sapiens
gagucuuugcagaga

SEQ ID NO: 1218036 - RNA, 17 nt, Homo sapiens
gagugaaacauugaacu

SEQ ID NO: 1218037 - RNA, 16 nt, Homo sapiens
gagugaaaccaugacu

SEQ ID NO: 1218038 - RNA, 21 nt, Homo sapiens
gagugaauuacagacaaccua

SEQ ID NO: 1218039 - RNA, 16 nt, Homo sapiens
gagugagcaaccagcu

SEQ ID NO: 1218040 - RNA, 15 nt, Homo sapiens
gagugagcacucacg

SEQ ID NO: 1218041 - RNA, 13 nt, Homo sapiens
gagugagccagug

SEQ ID NO: 1218042 - RNA, 13 nt, Homo sapiens
gagugcacagcug

SEQ ID NO: 1218043 - RNA, 16 nt, Homo sapiens
gagugcaguggcacaa

SEQ ID NO: 1218044 - RNA, 18 nt, Homo sapiens
gagugcgcccugcacucc

SEQ ID NO: 1218045 - RNA, 22 nt, Homo sapiens
gaguggccagccagugccauuc

SEQ ID NO: 1218046 - RNA, 11 nt, Homo sapiens
gaguggcugca

SEQ ID NO: 1218047 - RNA, 13 nt, Homo sapiens
gagugggaccaac

SEQ ID NO: 1218048 - RNA, 21 nt, Homo sapiens
gaguggugguuccuuugcacc

SEQ ID NO: 1218049 - RNA, 12 nt, Homo sapiens
gaguguacuuaa

SEQ ID NO: 1218050 - RNA, 13 nt, Homo sapiens
gaguguagcugua

SEQ ID NO: 1218051 - RNA, 16 nt, Homo sapiens
gaguguccucuucccu

SEQ ID NO: 1218052 - RNA, 18 nt, Homo sapiens
gagugugacagggccagu

SEQ ID NO: 1218053 - RNA, 18 nt, Homo sapiens
gagugugguuaugaacuu

SEQ ID NO: 1218054 - RNA, 10 nt, Homo sapiens
gaguguuccg

SEQ ID NO: 1218055 - RNA, 17 nt, Homo sapiens
gaguuacuuccuaucaa

SEQ ID NO: 1218056 - RNA, 23 nt, Homo sapiens
gaguuauuaauauguuauuauua

SEQ ID NO: 1218057 - RNA, 21 nt, Homo sapiens
gaguuauuuuuauuuauuuaa

SEQ ID NO: 1218058 - RNA, 12 nt, Homo sapiens
gaguucauccca

SEQ ID NO: 1218059 - RNA, 23 nt, Homo sapiens
gaguuccacuucaacaaguaccu

SEQ ID NO: 1218060 - RNA, 22 nt, Homo sapiens
gaguucucagggcuccugccuu

SEQ ID NO: 1218061 - RNA, 19 nt, Homo sapiens
gaguugaacuuuacugggg

SEQ ID NO: 1218062 - RNA, 14 nt, Homo sapiens
gaguugacucggug

SEQ ID NO: 1218063 - RNA, 13 nt, Homo sapiens
gaguugacugcuc

SEQ ID NO: 1218064 - RNA, 18 nt, Homo sapiens
gaguugagauuuugcaau

SEQ ID NO: 1218065 - RNA, 18 nt, Homo sapiens
gaguuguggaaagccucu

SEQ ID NO: 1218066 - RNA, 23 nt, Homo sapiens
gaguuguucaaauguuccuuuua

SEQ ID NO: 1218067 - RNA, 20 nt, Homo sapiens
gaguuguuuaaacagucaaa

SEQ ID NO: 1218068 - RNA, 20 nt, Homo sapiens
gaguuuaaaaaugguaucaa

SEQ ID NO: 1218069 - RNA, 17 nt, Homo sapiens
gaguuuagggucaagga

SEQ ID NO: 1218070 - RNA, 19 nt, Homo sapiens
gaguuuauuggaggaucaa

SEQ ID NO: 1218071 - RNA, 23 nt, Homo sapiens
gaguuucuggcucuugaggcauu

SEQ ID NO: 1218072 - RNA, 18 nt, Homo sapiens
gaguuucuuuccugccuu

SEQ ID NO: 1218073 - RNA, 17 nt, Homo sapiens
gaguuuuggcagccaga

SEQ ID NO: 1218074 - RNA, 20 nt, Homo sapiens
gauaaaaagaggaauauucu

SEQ ID NO: 1218075 - RNA, 20 nt, Homo sapiens
gauaaauauuugacuugcau

SEQ ID NO: 1218076 - RNA, 16 nt, Homo sapiens
gauaaauuccacugga

SEQ ID NO: 1218077 - RNA, 18 nt, Homo sapiens
gauaaccauauaaauucu

SEQ ID NO: 1218078 - RNA, 17 nt, Homo sapiens
gauaacccuuauuccau

SEQ ID NO: 1218079 - RNA, 17 nt, Homo sapiens
gauaagccugagccuua

SEQ ID NO: 1218080 - RNA, 20 nt, Homo sapiens
gauaaguaaguuugauuuca

SEQ ID NO: 1218081 - RNA, 24 nt, Homo sapiens
gauaauauccagccucccacaaga

SEQ ID NO: 1218082 - RNA, 17 nt, Homo sapiens
gauaaugauuugcucuu

SEQ ID NO: 1218083 - RNA, 17 nt, Homo sapiens
gauaauucuggaccaga

SEQ ID NO: 1218084 - RNA, 17 nt, Homo sapiens
gauaauuuucauagcug

SEQ ID NO: 1218085 - RNA, 19 nt, Homo sapiens
gauacacuaugaagauguu

SEQ ID NO: 1218086 - RNA, 19 nt, Homo sapiens
gauacaggaaaagcugcug

SEQ ID NO: 1218087 - RNA, 20 nt, Homo sapiens
gauacagugucugacuauaa

SEQ ID NO: 1218088 - RNA, 21 nt, Homo sapiens
gauacaucacugcuugaugaa

SEQ ID NO: 1218089 - RNA, 12 nt, Homo sapiens
gauacauuucau

SEQ ID NO: 1218090 - RNA, 16 nt, Homo sapiens
gauaccaaauaccaug

SEQ ID NO: 1218091 - RNA, 14 nt, Homo sapiens
gauaccacugcacu

SEQ ID NO: 1218092 - RNA, 19 nt, Homo sapiens
gauaccacuuaacagguuu

SEQ ID NO: 1218093 - RNA, 16 nt, Homo sapiens
gauaccauggcacuga

SEQ ID NO: 1218094 - RNA, 19 nt, Homo sapiens
gauaccauggcacugacaa

SEQ ID NO: 1218095 - RNA, 19 nt, Homo sapiens
gauacuauuuaauuauuuc

SEQ ID NO: 1218096 - RNA, 13 nt, Homo sapiens
gauacugaaggac

SEQ ID NO: 1218097 - RNA, 12 nt, Homo sapiens
gauacugauuau

SEQ ID NO: 1218098 - RNA, 16 nt, Homo sapiens
gauacugcuuuucacc

SEQ ID NO: 1218099 - RNA, 15 nt, Homo sapiens
gauacuucacuacuu

SEQ ID NO: 1218100 - RNA, 16 nt, Homo sapiens
gauacuuuuacagguu

SEQ ID NO: 1218101 - RNA, 20 nt, Homo sapiens
gauagaugcacuuaugcagu

SEQ ID NO: 1218102 - RNA, 17 nt, Homo sapiens
gauagcaaacacugggg

SEQ ID NO: 1218103 - RNA, 22 nt, Homo sapiens
gauagcaagguuuggugcaaag

SEQ ID NO: 1218104 - RNA, 14 nt, Homo sapiens
gauagcuacagugu

SEQ ID NO: 1218105 - RNA, 18 nt, Homo sapiens
gauagcuuggagggaugg

SEQ ID NO: 1218106 - RNA, 18 nt, Homo sapiens
gaucuguuuugaaggcaa

SEQ ID NO: 1218107 - RNA, 13 nt, Homo sapiens
gaucuuagauucu

SEQ ID NO: 1218108 - RNA, 19 nt, Homo sapiens
gaucuucagggaacugcau

SEQ ID NO: 1218109 - RNA, 17 nt, Homo sapiens
gaucuucauuaccaaua

SEQ ID NO: 1218110 - RNA, 17 nt, Homo sapiens
gaucuuccguggucaga

SEQ ID NO: 1218111 - RNA, 17 nt, Homo sapiens
gaucuuucuauuccaaa

SEQ ID NO: 1218112 - RNA, 16 nt, Homo sapiens
gaugaaagcugauuac

SEQ ID NO: 1218113 - RNA, 17 nt, Homo sapiens
gaugaagaagccuuugu

SEQ ID NO: 1218114 - RNA, 17 nt, Homo sapiens
gaugaauguaugugcac

SEQ ID NO: 1218115 - RNA, 19 nt, Homo sapiens
gaugacaauggaccucuca

SEQ ID NO: 1218116 - RNA, 24 nt, Homo sapiens
gaugacacccacccugugccauca

SEQ ID NO: 1218117 - RNA, 18 nt, Homo sapiens
gaugagcaagacauacuu

SEQ ID NO: 1218118 - RNA, 16 nt, Homo sapiens
gaugagccgcugugag

SEQ ID NO: 1218119 - RNA, 22 nt, Homo sapiens
gaugaggaccaagggcaccugg

SEQ ID NO: 1218120 - RNA, 18 nt, Homo sapiens
gaugaggcacuucuguca

SEQ ID NO: 1218121 - RNA, 20 nt, Homo sapiens
gaugaggggaggggggcaca

SEQ ID NO: 1218122 - RNA, 21 nt, Homo sapiens
gaugaggugguggaguggagu

SEQ ID NO: 1218123 - RNA, 14 nt, Homo sapiens
gaugauaaacacug

SEQ ID NO: 1218124 - RNA, 13 nt, Homo sapiens
gaugaucuacuca

SEQ ID NO: 1218125 - RNA, 13 nt, Homo sapiens
gaugauuguucaa

SEQ ID NO: 1218126 - RNA, 23 nt, Homo sapiens
gaugauuuuguaaaaguggcauu

SEQ ID NO: 1218127 - RNA, 16 nt, Homo sapiens
gaugcagcucuuggga

SEQ ID NO: 1218128 - RNA, 19 nt, Homo sapiens
gaugcaggcaugcuucuca

SEQ ID NO: 1218129 - RNA, 18 nt, Homo sapiens
gaugcaucuuguuucaua

SEQ ID NO: 1218130 - RNA, 11 nt, Homo sapiens
gaugcauuuaa

SEQ ID NO: 1218131 - RNA, 12 nt, Homo sapiens
gaugcauuuaau

SEQ ID NO: 1218132 - RNA, 20 nt, Homo sapiens
gaugccacgcuuugcugcua

SEQ ID NO: 1218133 - RNA, 13 nt, Homo sapiens
gaugccacuuccc

SEQ ID NO: 1218134 - RNA, 22 nt, Homo sapiens
gaugccacuucccagaggcaga

SEQ ID NO: 1218135 - RNA, 18 nt, Homo sapiens
gaugccguucccugaaca

SEQ ID NO: 1218136 - RNA, 21 nt, Homo sapiens
gaugccuguguacugccuuaa

SEQ ID NO: 1218137 - RNA, 20 nt, Homo sapiens
gaugcgaaccacccaaaaca

SEQ ID NO: 1218138 - RNA, 16 nt, Homo sapiens
gaugcugccauuuaac

SEQ ID NO: 1218139 - RNA, 16 nt, Homo sapiens
gaugcugccugaguca

SEQ ID NO: 1218140 - RNA, 11 nt, Homo sapiens
gaugcugcuau

SEQ ID NO: 1218141 - RNA, 16 nt, Homo sapiens
gaugcuggacuugccu

SEQ ID NO: 1218142 - RNA, 16 nt, Homo sapiens
gauggaaacucuuuaa

SEQ ID NO: 1218143 - RNA, 15 nt, Homo sapiens
gauggaacuggccac

SEQ ID NO: 1218144 - RNA, 18 nt, Homo sapiens
gauggagccagcucugca

SEQ ID NO: 1218145 - RNA, 16 nt, Homo sapiens
gauggagcgcaccugc

SEQ ID NO: 1218146 - RNA, 19 nt, Homo sapiens
gauggaggggugguccuga

SEQ ID NO: 1218147 - RNA, 23 nt, Homo sapiens
gauggaggggugguccugacuca

SEQ ID NO: 1218148 - RNA, 19 nt, Homo sapiens
gaugggagugggcaccuca

SEQ ID NO: 1218149 - RNA, 22 nt, Homo sapiens
gaugggaucccaggccagggaa

SEQ ID NO: 1218150 - RNA, 19 nt, Homo sapiens
gauggggcaugugccauag

SEQ ID NO: 1218151 - RNA, 16 nt, Homo sapiens
gauggggcgagccagg

SEQ ID NO: 1218152 - RNA, 21 nt, Homo sapiens
gauggguggggagcaaaucau

SEQ ID NO: 1218153 - RNA, 18 nt, Homo sapiens
gauggugacauugcaccu

SEQ ID NO: 1218154 - RNA, 17 nt, Homo sapiens
gauguagaacuucaaga

SEQ ID NO: 1218155 - RNA, 14 nt, Homo sapiens
gaugucacaaagau

SEQ ID NO: 1218156 - RNA, 20 nt, Homo sapiens
gauguccagaagaauauuca

SEQ ID NO: 1218157 - RNA, 14 nt, Homo sapiens
gaugucuaagacag

SEQ ID NO: 1218158 - RNA, 14 nt, Homo sapiens
gaugucuaccucag

SEQ ID NO: 1218159 - RNA, 17 nt, Homo sapiens
gaugucugggugaccuc

SEQ ID NO: 1218160 - RNA, 14 nt, Homo sapiens
gaugucuucuagcu

SEQ ID NO: 1218161 - RNA, 22 nt, Homo sapiens
gaugugaaaacaucucaauaac

SEQ ID NO: 1218162 - RNA, 23 nt, Homo sapiens
gaugugcauuucaccugugacaa

SEQ ID NO: 1218163 - RNA, 13 nt, Homo sapiens
gaugugggguccc

SEQ ID NO: 1218164 - RNA, 20 nt, Homo sapiens
gauguucugacccugcuuca

SEQ ID NO: 1218165 - RNA, 16 nt, Homo sapiens
gauguugaacugguca

SEQ ID NO: 1218166 - RNA, 16 nt, Homo sapiens
gauguugucuuggcuu

SEQ ID NO: 1218167 - RNA, 14 nt, Homo sapiens
gauguuuccagacu

SEQ ID NO: 1218168 - RNA, 17 nt, Homo sapiens
gauuaaaaucacucuca

SEQ ID NO: 1218169 - RNA, 16 nt, Homo sapiens
gauuaaggugauguga

SEQ ID NO: 1218170 - RNA, 18 nt, Homo sapiens
gauuacagaaacugaugc

SEQ ID NO: 1218171 - RNA, 14 nt, Homo sapiens
gauuaccugccaau

SEQ ID NO: 1218172 - RNA, 21 nt, Homo sapiens
gauuacugccauucacuucau

SEQ ID NO: 1218173 - RNA, 22 nt, Homo sapiens
gauuacuguccagcuuauaguc

SEQ ID NO: 1218174 - RNA, 19 nt, Homo sapiens
gauuacuuugcugccuuaa

SEQ ID NO: 1218175 - RNA, 21 nt, Homo sapiens
gauuagcagaagaaaggaaca

SEQ ID NO: 1218176 - RNA, 22 nt, Homo sapiens
gauuagugccuucugcccuccc

SEQ ID NO: 1218177 - RNA, 13 nt, Homo sapiens
gauuauaaacuga

SEQ ID NO: 1218178 - RNA, 20 nt, Homo sapiens
gauuaugaugcauacaguuu

SEQ ID NO: 1218179 - RNA, 22 nt, Homo sapiens
gauuauuagccagguaauguga

SEQ ID NO: 1218180 - RNA, 19 nt, Homo sapiens
gcaccugcaugugcuguca

SEQ ID NO: 1218181 - RNA, 23 nt, Homo sapiens
gcaccugccuccucguuccuuuc

SEQ ID NO: 1218182 - RNA, 19 nt, Homo sapiens
gcaccuggcccagaugaua

SEQ ID NO: 1218183 - RNA, 16 nt, Homo sapiens
gcaccuguacucagga

SEQ ID NO: 1218184 - RNA, 21 nt, Homo sapiens
gcaccuguagucccagcuacu

SEQ ID NO: 1218185 - RNA, 12 nt, Homo sapiens
gcaccugugcag

SEQ ID NO: 1218186 - RNA, 20 nt, Homo sapiens
gcaccuuaagauuuugcacc

SEQ ID NO: 1218187 - RNA, 21 nt, Homo sapiens
gcaccuuaagauuuugcaccu

SEQ ID NO: 1218188 - RNA, 18 nt, Homo sapiens
gcaccuuaccaacuuucu

SEQ ID NO: 1218189 - RNA, 20 nt, Homo sapiens
gcaccuucacucuccagggu

SEQ ID NO: 1218190 - RNA, 16 nt, Homo sapiens
gcaccuuugcacagga

SEQ ID NO: 1218191 - RNA, 23 nt, Homo sapiens
gcacgagcuggaacccacgagga

SEQ ID NO: 1218192 - RNA, 13 nt, Homo sapiens
gcacgaucucagu

SEQ ID NO: 1218193 - RNA, 12 nt, Homo sapiens
gcacgcacacac

SEQ ID NO: 1218194 - RNA, 14 nt, Homo sapiens
gcacgguggcucac

SEQ ID NO: 1218195 - RNA, 12 nt, Homo sapiens
gcacgugucuca

SEQ ID NO: 1218196 - RNA, 16 nt, Homo sapiens
gcacuaaaucagagac

SEQ ID NO: 1218197 - RNA, 15 nt, Homo sapiens
gcacuagaauauuua

SEQ ID NO: 1218198 - RNA, 20 nt, Homo sapiens
gcacucaccucacuguucaa

SEQ ID NO: 1218199 - RNA, 20 nt, Homo sapiens
gcacucacgcccuaagcgca

SEQ ID NO: 1218200 - RNA, 22 nt, Homo sapiens
gcacucccuaauuuaugugcua

SEQ ID NO: 1218201 - RNA, 19 nt, Homo sapiens
gcacugaaaauaccaucag

SEQ ID NO: 1218202 - RNA, 15 nt, Homo sapiens
gcacugacaaugggc

SEQ ID NO: 1218203 - RNA, 16 nt, Homo sapiens
gcacugacaaugggca

SEQ ID NO: 1218204 - RNA, 23 nt, Homo sapiens
gcacugagcccccccaacacugu

SEQ ID NO: 1218205 - RNA, 22 nt, Homo sapiens
gcacugcggcugucuccuugaa

SEQ ID NO: 1218206 - RNA, 13 nt, Homo sapiens
gcacuggggccac

SEQ ID NO: 1218207 - RNA, 21 nt, Homo sapiens
gcacugguggccguggugggg

SEQ ID NO: 1218208 - RNA, 16 nt, Homo sapiens
gcacugugagcaccug

SEQ ID NO: 1218209 - RNA, 21 nt, Homo sapiens
gcacugugcuaauaacagugc

SEQ ID NO: 1218210 - RNA, 14 nt, Homo sapiens
gcacuucaccuuuu

SEQ ID NO: 1218211 - RNA, 20 nt, Homo sapiens
gcacuuuaagucagugacag

SEQ ID NO: 1218212 - RNA, 13 nt, Homo sapiens
gcacuuuccacuu

SEQ ID NO: 1218213 - RNA, 19 nt, Homo sapiens
gcacuuugaaauaccucau

SEQ ID NO: 1218214 - RNA, 17 nt, Homo sapiens
gcacuuugagauguguu

SEQ ID NO: 1218215 - RNA, 17 nt, Homo sapiens
gcacuuuggggguuuga

SEQ ID NO: 1218216 - RNA, 17 nt, Homo sapiens
gcagaaacacacaguca

SEQ ID NO: 1218217 - RNA, 19 nt, Homo sapiens
gcagaacagcaucauguca

SEQ ID NO: 1218218 - RNA, 20 nt, Homo sapiens
gcagaacugaagugugcugu

SEQ ID NO: 1218219 - RNA, 17 nt, Homo sapiens
gcagaagagggagacuc

SEQ ID NO: 1218220 - RNA, 23 nt, Homo sapiens
gcagaagaucaaggaguacaaug

SEQ ID NO: 1218221 - RNA, 22 nt, Homo sapiens
gcagaagucaacgccucggugg

SEQ ID NO: 1218222 - RNA, 18 nt, Homo sapiens
gcagaauugagagugauu

SEQ ID NO: 1218223 - RNA, 13 nt, Homo sapiens
gcagacaaccuca

SEQ ID NO: 1218224 - RNA, 15 nt, Homo sapiens
gcagacaccagcagc

SEQ ID NO: 1218225 - RNA, 21 nt, Homo sapiens
gcagacaucggccuccaugac

SEQ ID NO: 1218226 - RNA, 16 nt, Homo sapiens
gcagaccccaggcaag

SEQ ID NO: 1218227 - RNA, 18 nt, Homo sapiens
gcagaccccucuaccucc

SEQ ID NO: 1218228 - RNA, 17 nt, Homo sapiens
gcagacuacacaggaug

SEQ ID NO: 1218229 - RNA, 24 nt, Homo sapiens
gcagacugcuaguguucugucuaa

SEQ ID NO: 1218230 - RNA, 23 nt, Homo sapiens
gcagagaagggcauaaaacagcu

SEQ ID NO: 1218231 - RNA, 16 nt, Homo sapiens
gcagagaccaccacau

SEQ ID NO: 1218232 - RNA, 18 nt, Homo sapiens
gcagagcaaagugcggug

SEQ ID NO: 1218233 - RNA, 12 nt, Homo sapiens
gcagagcacaga

SEQ ID NO: 1218234 - RNA, 13 nt, Homo sapiens
gcagaggacgcac

SEQ ID NO: 1218235 - RNA, 13 nt, Homo sapiens
gcagaggggccag

SEQ ID NO: 1218236 - RNA, 15 nt, Homo sapiens
gcagaggucagacua

SEQ ID NO: 1218237 - RNA, 14 nt, Homo sapiens
gcagaggucuccca

SEQ ID NO: 1218238 - RNA, 21 nt, Homo sapiens
gcagaguccuuauucuucuca

SEQ ID NO: 1218239 - RNA, 17 nt, Homo sapiens
gcagaguuacaguucug

SEQ ID NO: 1218240 - RNA, 15 nt, Homo sapiens
gcagaguuugccuuc

SEQ ID NO: 1218241 - RNA, 17 nt, Homo sapiens
gcagaguuugccuuccu

SEQ ID NO: 1218242 - RNA, 23 nt, Homo sapiens
gcagauaacuuuuuugagucauu

SEQ ID NO: 1218243 - RNA, 14 nt, Homo sapiens
gcagauacauauga

SEQ ID NO: 1218244 - RNA, 18 nt, Homo sapiens
gcagauccccacuguccu

SEQ ID NO: 1218245 - RNA, 21 nt, Homo sapiens
gcagauccccacuguccuacc

SEQ ID NO: 1218246 - RNA, 19 nt, Homo sapiens
gcagaugccacccuagcca

SEQ ID NO: 1218247 - RNA, 14 nt, Homo sapiens
gcagauuaaaagca

SEQ ID NO: 1218248 - RNA, 11 nt, Homo sapiens
gcagcacuccc

SEQ ID NO: 1218249 - RNA, 12 nt, Homo sapiens
gcagcacucccc

SEQ ID NO: 1218250 - RNA, 23 nt, Homo sapiens
gcagcagcccuccccgcagcuag

SEQ ID NO: 1218251 - RNA, 22 nt, Homo sapiens
gcagcaggucuagaagaacaac

SEQ ID NO: 1218252 - RNA, 15 nt, Homo sapiens
gccuaaauauaauua

SEQ ID NO: 1218253 - RNA, 17 nt, Homo sapiens
gccuacaaccaucccug

SEQ ID NO: 1218254 - RNA, 21 nt, Homo sapiens
gccuacagucaucugccacca

SEQ ID NO: 1218255 - RNA, 17 nt, Homo sapiens
gccuaccuccacaccac

SEQ ID NO: 1218256 - RNA, 14 nt, Homo sapiens
gccuacuccaaaau

SEQ ID NO: 1218257 - RNA, 18 nt, Homo sapiens
gccuacuuaagagugcug

SEQ ID NO: 1218258 - RNA, 15 nt, Homo sapiens
gccuagacuguuacu

SEQ ID NO: 1218259 - RNA, 23 nt, Homo sapiens
gccuagauccacacacagaggaa

SEQ ID NO: 1218260 - RNA, 22 nt, Homo sapiens
gccuaugauauuccccauuucc

SEQ ID NO: 1218261 - RNA, 16 nt, Homo sapiens
gccuaugcacauaugg

SEQ ID NO: 1218262 - RNA, 22 nt, Homo sapiens
gccuauuaucugucagcugcaa

SEQ ID NO: 1218263 - RNA, 17 nt, Homo sapiens
gccuauuucucuuugca

SEQ ID NO: 1218264 - RNA, 23 nt, Homo sapiens
gccucaaaacagaagcagcuucu

SEQ ID NO: 1218265 - RNA, 20 nt, Homo sapiens
gccucaagagcacacagaga

SEQ ID NO: 1218266 - RNA, 19 nt, Homo sapiens
gccucaagaugaaggcaaa

SEQ ID NO: 1218267 - RNA, 19 nt, Homo sapiens
gccucaccguccucaccca

SEQ ID NO: 1218268 - RNA, 12 nt, Homo sapiens
gccucaccucua

SEQ ID NO: 1218269 - RNA, 15 nt, Homo sapiens
gccucagcccagguc

SEQ ID NO: 1218270 - RNA, 20 nt, Homo sapiens
gccucagcggacaagcagcu

SEQ ID NO: 1218271 - RNA, 17 nt, Homo sapiens
gccucagggccaggaag

SEQ ID NO: 1218272 - RNA, 21 nt, Homo sapiens
gccucaguccuccccucacag

SEQ ID NO: 1218273 - RNA, 23 nt, Homo sapiens
gccucauuauuuuucacugcccc

SEQ ID NO: 1218274 - RNA, 21 nt, Homo sapiens
gccuccaagccauucacuucc

SEQ ID NO: 1218275 - RNA, 16 nt, Homo sapiens
gccuccaccaccacug

SEQ ID NO: 1218276 - RNA, 19 nt, Homo sapiens
gccuccaccaccacuggcc

SEQ ID NO: 1218277 - RNA, 14 nt, Homo sapiens
gccuccaugcugcc

SEQ ID NO: 1218278 - RNA, 23 nt, Homo sapiens
gccucccacacugaaaccaaaac

SEQ ID NO: 1218279 - RNA, 20 nt, Homo sapiens
gccucccccucagaugaucu

SEQ ID NO: 1218280 - RNA, 23 nt, Homo sapiens
gccuccccgguggccagagccag

SEQ ID NO: 1218281 - RNA, 17 nt, Homo sapiens
gccuccccgugccaaaa

SEQ ID NO: 1218282 - RNA, 21 nt, Homo sapiens
gccuccccucuccuuccugug

SEQ ID NO: 1218283 - RNA, 22 nt, Homo sapiens
gccuccugcccugcuaaagaca

SEQ ID NO: 1218284 - RNA, 17 nt, Homo sapiens
gccuccugcugccacaa

SEQ ID NO: 1218285 - RNA, 13 nt, Homo sapiens
gccuccuggccag

SEQ ID NO: 1218286 - RNA, 13 nt, Homo sapiens
gccuccugugacg

SEQ ID NO: 1218287 - RNA, 23 nt, Homo sapiens
gccuccuguguacugugucauaa

SEQ ID NO: 1218288 - RNA, 18 nt, Homo sapiens
gccucgugccaugaucug

SEQ ID NO: 1218289 - RNA, 17 nt, Homo sapiens
gccucuccaguuugcac

SEQ ID NO: 1218290 - RNA, 22 nt, Homo sapiens
gccucugcggggcagggccuuc

SEQ ID NO: 1218291 - RNA, 18 nt, Homo sapiens
gccucuggaauugcucaa

SEQ ID NO: 1218292 - RNA, 17 nt, Homo sapiens
gccucuggaugcuguga

SEQ ID NO: 1218293 - RNA, 20 nt, Homo sapiens
gccucuggcucucauggggu

SEQ ID NO: 1218294 - RNA, 10 nt, Homo sapiens
gccucugugc

SEQ ID NO: 1218295 - RNA, 14 nt, Homo sapiens
gccucugugccuuc

SEQ ID NO: 1218296 - RNA, 19 nt, Homo sapiens
gccucuuccucccucauuc

SEQ ID NO: 1218297 - RNA, 17 nt, Homo sapiens
gccugaagcaacugaag

SEQ ID NO: 1218298 - RNA, 21 nt, Homo sapiens
gccugaaguuugugggggcca

SEQ ID NO: 1218299 - RNA, 23 nt, Homo sapiens
gccugaaguuugugggggccaaa

SEQ ID NO: 1218300 - RNA, 11 nt, Homo sapiens
gccugagcaac

SEQ ID NO: 1218301 - RNA, 22 nt, Homo sapiens
gccugaggcaauuagacacuuu

SEQ ID NO: 1218302 - RNA, 19 nt, Homo sapiens
gccugagucacccaugaag

SEQ ID NO: 1218303 - RNA, 13 nt, Homo sapiens
gccugagucaccu

SEQ ID NO: 1218304 - RNA, 22 nt, Homo sapiens
gccugaguccuggucccucuga

SEQ ID NO: 1218305 - RNA, 13 nt, Homo sapiens
gccugagugaucc

SEQ ID NO: 1218306 - RNA, 18 nt, Homo sapiens
gccugauacugccugaca

SEQ ID NO: 1218307 - RNA, 21 nt, Homo sapiens
gccugcaaaaaugaaauccag

SEQ ID NO: 1218308 - RNA, 20 nt, Homo sapiens
gccugcaaaccuuccuggga

SEQ ID NO: 1218309 - RNA, 21 nt, Homo sapiens
gccugcagcaggaguggugca

SEQ ID NO: 1218310 - RNA, 16 nt, Homo sapiens
gccugccacugagcag

SEQ ID NO: 1218311 - RNA, 23 nt, Homo sapiens
gccugccccaaacaaauaugcaa

SEQ ID NO: 1218312 - RNA, 20 nt, Homo sapiens
gccugcccccuugggugacc

SEQ ID NO: 1218313 - RNA, 18 nt, Homo sapiens
gccugcccgcugcaaugc

SEQ ID NO: 1218314 - RNA, 13 nt, Homo sapiens
gccugccuuaggg

SEQ ID NO: 1218315 - RNA, 19 nt, Homo sapiens
gccugcucccuagccagag

SEQ ID NO: 1218316 - RNA, 21 nt, Homo sapiens
gccugcugccauagcagcacc

SEQ ID NO: 1218317 - RNA, 23 nt, Homo sapiens
gccugcuuggcccggccggccug

SEQ ID NO: 1218318 - RNA, 15 nt, Homo sapiens
gccugcuuugcuuua

SEQ ID NO: 1218319 - RNA, 20 nt, Homo sapiens
gccuggaauaaauacguuuu

SEQ ID NO: 1218320 - RNA, 18 nt, Homo sapiens
gccuggagcuaauggcga

SEQ ID NO: 1218321 - RNA, 20 nt, Homo sapiens
gccuggccaucauggugaaa

SEQ ID NO: 1218322 - RNA, 14 nt, Homo sapiens
gccuggccucucag

SEQ ID NO: 1218323 - RNA, 17 nt, Homo sapiens
gccuggccucucagccu

SEQ ID NO: 1218324 - RNA, 15 nt, Homo sapiens
gccuggcuucuggag

SEQ ID NO: 1218325 - RNA, 15 nt, Homo sapiens
gccugggagcccaga

SEQ ID NO: 1218326 - RNA, 18 nt, Homo sapiens
gccugggguggacauuca

SEQ ID NO: 1218327 - RNA, 13 nt, Homo sapiens
gccuguaauccca

SEQ ID NO: 1218328 - RNA, 19 nt, Homo sapiens
gccuguaaucucagcacuu

SEQ ID NO: 1218329 - RNA, 20 nt, Homo sapiens
gccuguaaucucagcacuuu

SEQ ID NO: 1218330 - RNA, 15 nt, Homo sapiens
gccuguauacuuuag

SEQ ID NO: 1218331 - RNA, 14 nt, Homo sapiens
gccugucuucagag

SEQ ID NO: 1218332 - RNA, 14 nt, Homo sapiens
gccugugacuuuca

SEQ ID NO: 1218333 - RNA, 23 nt, Homo sapiens
gccuguggcgccgucuccagggg

SEQ ID NO: 1218334 - RNA, 18 nt, Homo sapiens
gccugugguuaacaucuc

SEQ ID NO: 1218335 - RNA, 20 nt, Homo sapiens
gccugugguuaacaucucag

SEQ ID NO: 1218336 - RNA, 20 nt, Homo sapiens
gccuguuauaacucugcacu

SEQ ID NO: 1218337 - RNA, 14 nt, Homo sapiens
gccuguugaaucug

SEQ ID NO: 1218338 - RNA, 23 nt, Homo sapiens
gccuguuucuggauuugcaggug

SEQ ID NO: 1218339 - RNA, 13 nt, Homo sapiens
gccuuagcaguaa

SEQ ID NO: 1218340 - RNA, 17 nt, Homo sapiens
gccuuagcuuucuaggc

SEQ ID NO: 1218341 - RNA, 18 nt, Homo sapiens
gccuuagucucaguuugu

SEQ ID NO: 1218342 - RNA, 15 nt, Homo sapiens
gccuuagugggccag

SEQ ID NO: 1218343 - RNA, 16 nt, Homo sapiens
gccuuagugggccagg

SEQ ID NO: 1218344 - RNA, 16 nt, Homo sapiens
gccuuauaaaccaauc

SEQ ID NO: 1218345 - RNA, 13 nt, Homo sapiens
gccuucacugaca

SEQ ID NO: 1218346 - RNA, 14 nt, Homo sapiens
gccuucauucugca

SEQ ID NO: 1218347 - RNA, 14 nt, Homo sapiens
gccuuccacaguga

SEQ ID NO: 1218348 - RNA, 20 nt, Homo sapiens
gccuuccacagugaaugugu

SEQ ID NO: 1218349 - RNA, 17 nt, Homo sapiens
gccuuccugcccuacag

SEQ ID NO: 1218350 - RNA, 20 nt, Homo sapiens
gccuuccugggcagccuuuc

SEQ ID NO: 1218351 - RNA, 19 nt, Homo sapiens
gccuucugauaguauuccu

SEQ ID NO: 1218352 - RNA, 15 nt, Homo sapiens
gccuucugcccuccc

SEQ ID NO: 1218353 - RNA, 15 nt, Homo sapiens
gccuucuucacccag

SEQ ID NO: 1218354 - RNA, 15 nt, Homo sapiens
gccuugccuccucac

SEQ ID NO: 1218355 - RNA, 16 nt, Homo sapiens
gccuugugcuguuaau

SEQ ID NO: 1218356 - RNA, 21 nt, Homo sapiens
gccuuguguauauuuguauau

SEQ ID NO: 1218357 - RNA, 22 nt, Homo sapiens
gccuuguucaauaauuacugua

SEQ ID NO: 1218358 - RNA, 23 nt, Homo sapiens
gccuuguugguggagaguggaag

SEQ ID NO: 1218359 - RNA, 22 nt, Homo sapiens
gccuuuaaaaaugcaccacuuu

SEQ ID NO: 1218360 - RNA, 16 nt, Homo sapiens
gccuuuaaaucuguga

SEQ ID NO: 1218361 - RNA, 18 nt, Homo sapiens
gccuuuaguccacggacc

SEQ ID NO: 1218362 - RNA, 18 nt, Homo sapiens
gccuuuauauccaaaaua

SEQ ID NO: 1218363 - RNA, 20 nt, Homo sapiens
gccuuuauauccaaaauaaa

SEQ ID NO: 1218364 - RNA, 18 nt, Homo sapiens
gccuuugcaaaucagugu

SEQ ID NO: 1218365 - RNA, 15 nt, Homo sapiens
gccuuuguugcucag

SEQ ID NO: 1218366 - RNA, 20 nt, Homo sapiens
gccuuuuaaaaguucuuuaa

SEQ ID NO: 1218367 - RNA, 15 nt, Homo sapiens
gccuuuucacugugu

SEQ ID NO: 1218368 - RNA, 14 nt, Homo sapiens
gccuuuugcugcgc

SEQ ID NO: 1218369 - RNA, 12 nt, Homo sapiens
gccuuuuguuaa

SEQ ID NO: 1218370 - RNA, 20 nt, Homo sapiens
gccuuuuuguauaaaauaga

SEQ ID NO: 1218371 - RNA, 18 nt, Homo sapiens
gcgaaggggcccuggucc

SEQ ID NO: 1218372 - RNA, 20 nt, Homo sapiens
gcgaauuauagagacaaucu

SEQ ID NO: 1218373 - RNA, 17 nt, Homo sapiens
gcgacccauucagagac

SEQ ID NO: 1218374 - RNA, 17 nt, Homo sapiens
gcgaccuccuuucauca

SEQ ID NO: 1218375 - RNA, 20 nt, Homo sapiens
gcgaccuuguggcaucguca

SEQ ID NO: 1218376 - RNA, 20 nt, Homo sapiens
gcgacugagccaugcucaga

SEQ ID NO: 1218377 - RNA, 13 nt, Homo sapiens
gcgagcagucagc

SEQ ID NO: 1218378 - RNA, 13 nt, Homo sapiens
gcgaguacuggga

SEQ ID NO: 1218379 - RNA, 17 nt, Homo sapiens
gcgagucuuacuuugag

SEQ ID NO: 1218380 - RNA, 20 nt, Homo sapiens
gcgaucuggguucacugcaa

SEQ ID NO: 1218381 - RNA, 19 nt, Homo sapiens
gcgauucccuguguagcuc

SEQ ID NO: 1218382 - RNA, 21 nt, Homo sapiens
gcgccaagcaaccugggucca

SEQ ID NO: 1218383 - RNA, 19 nt, Homo sapiens
gcgccagaacccagauuuc

SEQ ID NO: 1218384 - RNA, 14 nt, Homo sapiens
gcgccgugcuguaa

SEQ ID NO: 1218385 - RNA, 14 nt, Homo sapiens
gcgcgcgcacacac

SEQ ID NO: 1218386 - RNA, 11 nt, Homo sapiens
gcgcgcugagc

SEQ ID NO: 1218387 - RNA, 22 nt, Homo sapiens
gcgcucuuucuucccucgugac

SEQ ID NO: 1218388 - RNA, 22 nt, Homo sapiens
gcgcuggguauuggaaauggau

SEQ ID NO: 1218389 - RNA, 15 nt, Homo sapiens
gcgcuuggcaucaca

SEQ ID NO: 1218390 - RNA, 19 nt, Homo sapiens
gcggaaggucccucagaca

SEQ ID NO: 1218391 - RNA, 13 nt, Homo sapiens
gcggaagugacca

SEQ ID NO: 1218392 - RNA, 20 nt, Homo sapiens
gcggacaagcagcuggugcu

SEQ ID NO: 1218393 - RNA, 16 nt, Homo sapiens
gcggagcuugcaguga

SEQ ID NO: 1218394 - RNA, 13 nt, Homo sapiens
gcggaggcugugu

SEQ ID NO: 1218395 - RNA, 19 nt, Homo sapiens
gcggcaggaagggggccga

SEQ ID NO: 1218396 - RNA, 12 nt, Homo sapiens
gcggcucuccag

SEQ ID NO: 1218397 - RNA, 16 nt, Homo sapiens
gcgggaggcaccagcu

SEQ ID NO: 1218398 - RNA, 15 nt, Homo sapiens
gcgggaggcagaguu

SEQ ID NO: 1218399 - RNA, 13 nt, Homo sapiens
gcgggccaugagg

SEQ ID NO: 1218400 - RNA, 17 nt, Homo sapiens
gcgggcgccaucuucca

SEQ ID NO: 1218401 - RNA, 12 nt, Homo sapiens
gcggggugggca

SEQ ID NO: 1218402 - RNA, 15 nt, Homo sapiens
gcggucaauuugccu

SEQ ID NO: 1218403 - RNA, 22 nt, Homo sapiens
gcguaagaugauggauuugauu

SEQ ID NO: 1218404 - RNA, 16 nt, Homo sapiens
gcguaguccgcuuucu

SEQ ID NO: 1218405 - RNA, 12 nt, Homo sapiens
gcgucacuguga

SEQ ID NO: 1218406 - RNA, 15 nt, Homo sapiens
gcguccccacucccu

SEQ ID NO: 1218407 - RNA, 15 nt, Homo sapiens
gcgucccuguacaga

SEQ ID NO: 1218408 - RNA, 12 nt, Homo sapiens
gcguccugguca

SEQ ID NO: 1218409 - RNA, 20 nt, Homo sapiens
gcguccuuugaaccugugca

SEQ ID NO: 1218410 - RNA, 16 nt, Homo sapiens
gcgugagccacugcac

SEQ ID NO: 1218411 - RNA, 16 nt, Homo sapiens
gcguggacucugcaca

SEQ ID NO: 1218412 - RNA, 15 nt, Homo sapiens
gcguggcggagcugc

SEQ ID NO: 1218413 - RNA, 23 nt, Homo sapiens
gcguggcggagcugcugcugcuc

SEQ ID NO: 1218414 - RNA, 23 nt, Homo sapiens
gcguuuggacccaguucagugag

SEQ ID NO: 1218415 - RNA, 18 nt, Homo sapiens
gcuaaaaaaagugcauga

SEQ ID NO: 1218416 - RNA, 13 nt, Homo sapiens
gcuaaaagggaaa

SEQ ID NO: 1218417 - RNA, 18 nt, Homo sapiens
gcuaaaccaccauuuuau

SEQ ID NO: 1218418 - RNA, 17 nt, Homo sapiens
gcuaaacugaugacuua

SEQ ID NO: 1218419 - RNA, 12 nt, Homo sapiens
gcuaaauuccac

SEQ ID NO: 1218420 - RNA, 18 nt, Homo sapiens
gcuaacagaaauuaauuu

SEQ ID NO: 1218421 - RNA, 14 nt, Homo sapiens
gcuaacucugaccu

SEQ ID NO: 1218422 - RNA, 21 nt, Homo sapiens
gcuaauugcuggcuggcugcc

SEQ ID NO: 1218423 - RNA, 14 nt, Homo sapiens
gcuaccaguauuua

SEQ ID NO: 1218424 - RNA, 17 nt, Homo sapiens
gcuaccuacauacaauu

SEQ ID NO: 1218425 - RNA, 19 nt, Homo sapiens
gcuaccucacuaugcugcu

SEQ ID NO: 1218426 - RNA, 12 nt, Homo sapiens
gcuaccugaugg

SEQ ID NO: 1218427 - RNA, 20 nt, Homo sapiens
gcuaccugggucaacccaac

SEQ ID NO: 1218428 - RNA, 20 nt, Homo sapiens
gcuacuaccuagggcacuuu

SEQ ID NO: 1218429 - RNA, 22 nt, Homo sapiens
gcuacuacgguugaucuugcaa

SEQ ID NO: 1218430 - RNA, 15 nt, Homo sapiens
gcuacuauaaucaaa

SEQ ID NO: 1218431 - RNA, 16 nt, Homo sapiens
gcuacuauguacugcc

SEQ ID NO: 1218432 - RNA, 17 nt, Homo sapiens
gcuacuauguacugccu

SEQ ID NO: 1218433 - RNA, 18 nt, Homo sapiens
gcuacuauguacugccuu

SEQ ID NO: 1218434 - RNA, 22 nt, Homo sapiens
gcuagaaaaggccuucuuccca

SEQ ID NO: 1218435 - RNA, 15 nt, Homo sapiens
gcuagaaauaagccc

SEQ ID NO: 1218436 - RNA, 20 nt, Homo sapiens
gggaguaggacauaccagcu

SEQ ID NO: 1218437 - RNA, 12 nt, Homo sapiens
gggagugucuaa

SEQ ID NO: 1218438 - RNA, 16 nt, Homo sapiens
gggauacccagugaug

SEQ ID NO: 1218439 - RNA, 14 nt, Homo sapiens
gggaucugccauug

SEQ ID NO: 1218440 - RNA, 19 nt, Homo sapiens
gggaugagccgcugugagc

SEQ ID NO: 1218441 - RNA, 19 nt, Homo sapiens
gggaugggcagaugggccu

SEQ ID NO: 1218442 - RNA, 10 nt, Homo sapiens
gggauguuuu

SEQ ID NO: 1218443 - RNA, 15 nt, Homo sapiens
gggauucaggcugcu

SEQ ID NO: 1218444 - RNA, 18 nt, Homo sapiens
gggauugaagcccuccaa

SEQ ID NO: 1218445 - RNA, 23 nt, Homo sapiens
gggauuuuuggcuacacacaaac

SEQ ID NO: 1218446 - RNA, 12 nt, Homo sapiens
gggcaagcuccu

SEQ ID NO: 1218447 - RNA, 17 nt, Homo sapiens
gggcacagcacagccag

SEQ ID NO: 1218448 - RNA, 22 nt, Homo sapiens
gggcaccacccgcuuucuugcu

SEQ ID NO: 1218449 - RNA, 22 nt, Homo sapiens
gggcagagccuuccacagugaa

SEQ ID NO: 1218450 - RNA, 14 nt, Homo sapiens
gggcagcaaccccu

SEQ ID NO: 1218451 - RNA, 23 nt, Homo sapiens
gggcagccccaccucacagccag

SEQ ID NO: 1218452 - RNA, 12 nt, Homo sapiens
gggcagccuuuc

SEQ ID NO: 1218453 - RNA, 20 nt, Homo sapiens
gggcaggagggcccuaccug

SEQ ID NO: 1218454 - RNA, 20 nt, Homo sapiens
gggcaggcaggagcagggga

SEQ ID NO: 1218455 - RNA, 16 nt, Homo sapiens
gggcaggcugggccau

SEQ ID NO: 1218456 - RNA, 17 nt, Homo sapiens
gggcauccauaccagcu

SEQ ID NO: 1218457 - RNA, 21 nt, Homo sapiens
gggcauccuggaugauuucau

SEQ ID NO: 1218458 - RNA, 12 nt, Homo sapiens
gggcaugccacc

SEQ ID NO: 1218459 - RNA, 17 nt, Homo sapiens
gggcaugccacccucac

SEQ ID NO: 1218460 - RNA, 22 nt, Homo sapiens
gggcaugcuggggcaagucccu

SEQ ID NO: 1218461 - RNA, 12 nt, Homo sapiens
gggccagcacuu

SEQ ID NO: 1218462 - RNA, 21 nt, Homo sapiens
gggccagcacuuccaugggaa

SEQ ID NO: 1218463 - RNA, 19 nt, Homo sapiens
gggccagcaggagccagcc

SEQ ID NO: 1218464 - RNA, 22 nt, Homo sapiens
gggccaggcugguccgagcuga

SEQ ID NO: 1218465 - RNA, 20 nt, Homo sapiens
gggccaguccuccugggagc

SEQ ID NO: 1218466 - RNA, 20 nt, Homo sapiens
gggcccaugggauugcacag

SEQ ID NO: 1218467 - RNA, 14 nt, Homo sapiens
gggccccucagagc

SEQ ID NO: 1218468 - RNA, 22 nt, Homo sapiens
gggccccuggccauccacaaac

SEQ ID NO: 1218469 - RNA, 18 nt, Homo sapiens
gggccggggaagcugcca

SEQ ID NO: 1218470 - RNA, 12 nt, Homo sapiens
gggccgugacag

SEQ ID NO: 1218471 - RNA, 20 nt, Homo sapiens
gggccugagagaauuggcuc

SEQ ID NO: 1218472 - RNA, 17 nt, Homo sapiens
gggccuuuccuggcuga

SEQ ID NO: 1218473 - RNA, 16 nt, Homo sapiens
gggcgcaggcccagug

SEQ ID NO: 1218474 - RNA, 20 nt, Homo sapiens
gggcgcccucucugcuccuu

SEQ ID NO: 1218475 - RNA, 12 nt, Homo sapiens
gggcgcgguggc

SEQ ID NO: 1218476 - RNA, 17 nt, Homo sapiens
gggcuacugugaccaug

SEQ ID NO: 1218477 - RNA, 16 nt, Homo sapiens
gggcucccaggggucu

SEQ ID NO: 1218478 - RNA, 22 nt, Homo sapiens
gggcucccuggcaggaugcuga

SEQ ID NO: 1218479 - RNA, 22 nt, Homo sapiens
gggcucugccccaccuggagaa

SEQ ID NO: 1218480 - RNA, 22 nt, Homo sapiens
gggcucuuccaacaaggaagaa

SEQ ID NO: 1218481 - RNA, 17 nt, Homo sapiens
gggcugaaguugcucug

SEQ ID NO: 1218482 - RNA, 23 nt, Homo sapiens
gggcugcaugaccuaccaggaca

SEQ ID NO: 1218483 - RNA, 20 nt, Homo sapiens
gggcugcccacaaggcuugu

SEQ ID NO: 1218484 - RNA, 14 nt, Homo sapiens
gggcugcccucucc

SEQ ID NO: 1218485 - RNA, 14 nt, Homo sapiens
gggcugcccugcca

SEQ ID NO: 1218486 - RNA, 23 nt, Homo sapiens
gggcuggaggcccaggcugggaa

SEQ ID NO: 1218487 - RNA, 18 nt, Homo sapiens
gggcugguagcucaggug

SEQ ID NO: 1218488 - RNA, 16 nt, Homo sapiens
gggcuuaccaggugag

SEQ ID NO: 1218489 - RNA, 15 nt, Homo sapiens
gggcuugaagccaaa

SEQ ID NO: 1218490 - RNA, 16 nt, Homo sapiens
gggcuuucuggggccu

SEQ ID NO: 1218491 - RNA, 19 nt, Homo sapiens
ggggaccaggaugacaccu

SEQ ID NO: 1218492 - RNA, 16 nt, Homo sapiens
ggggaccuuggucuga

SEQ ID NO: 1218493 - RNA, 16 nt, Homo sapiens
ggggagcacuugucca

SEQ ID NO: 1218494 - RNA, 11 nt, Homo sapiens
ggggcauuauc

SEQ ID NO: 1218495 - RNA, 22 nt, Homo sapiens
ggggcccugggucuaugcacag

SEQ ID NO: 1218496 - RNA, 18 nt, Homo sapiens
ggggccgggcgcgguggc

SEQ ID NO: 1218497 - RNA, 14 nt, Homo sapiens
ggggcgagcacugu

SEQ ID NO: 1218498 - RNA, 16 nt, Homo sapiens
ggggcgagcacuguga

SEQ ID NO: 1218499 - RNA, 18 nt, Homo sapiens
ggggcgagcacugugagc

SEQ ID NO: 1218500 - RNA, 18 nt, Homo sapiens
ggggcuccagcaccuucu

SEQ ID NO: 1218501 - RNA, 15 nt, Homo sapiens
ggggcugaggggcaa

SEQ ID NO: 1218502 - RNA, 22 nt, Homo sapiens
ggggcuggccucuggcucucau

SEQ ID NO: 1218503 - RNA, 14 nt, Homo sapiens
ggggcuuuugccac

SEQ ID NO: 1218504 - RNA, 18 nt, Homo sapiens
gggggagaagaagccgag

SEQ ID NO: 1218505 - RNA, 16 nt, Homo sapiens
ggggguuucaccuggg

SEQ ID NO: 1218506 - RNA, 18 nt, Homo sapiens
ggggucuccuauacucua

SEQ ID NO: 1218507 - RNA, 17 nt, Homo sapiens
ggggugaaucuugucua

SEQ ID NO: 1218508 - RNA, 13 nt, Homo sapiens
gggguuucaccug

SEQ ID NO: 1218509 - RNA, 19 nt, Homo sapiens
ggguaaccaaauguuggcc

SEQ ID NO: 1218510 - RNA, 17 nt, Homo sapiens
ggguacagcgcggagga

SEQ ID NO: 1218511 - RNA, 16 nt, Homo sapiens
ggguaccaaugcugca

SEQ ID NO: 1218512 - RNA, 23 nt, Homo sapiens
ggguaccuaguccccagccugcu

SEQ ID NO: 1218513 - RNA, 20 nt, Homo sapiens
ggguagaaugauuaaucaaa

SEQ ID NO: 1218514 - RNA, 15 nt, Homo sapiens
gggucaaagugcggc

SEQ ID NO: 1218515 - RNA, 23 nt, Homo sapiens
gggucaaggaguacuccaagaca

SEQ ID NO: 1218516 - RNA, 19 nt, Homo sapiens
ggguccuuuugacacugcu

SEQ ID NO: 1218517 - RNA, 18 nt, Homo sapiens
gggucuaugcacagcugg

SEQ ID NO: 1218518 - RNA, 20 nt, Homo sapiens
gggucucacaguguugccca

SEQ ID NO: 1218519 - RNA, 14 nt, Homo sapiens
gggucucuugccca

SEQ ID NO: 1218520 - RNA, 16 nt, Homo sapiens
gggucuuugaacccuu

SEQ ID NO: 1218521 - RNA, 16 nt, Homo sapiens
gggugacagugccuuc

SEQ ID NO: 1218522 - RNA, 22 nt, Homo sapiens
gggugagcuccagcugcugcgc

SEQ ID NO: 1218523 - RNA, 20 nt, Homo sapiens
ggguggcacucaacucugag

SEQ ID NO: 1218524 - RNA, 18 nt, Homo sapiens
ggguggcacucagucucu

SEQ ID NO: 1218525 - RNA, 14 nt, Homo sapiens
ggguggggagcaaa

SEQ ID NO: 1218526 - RNA, 14 nt, Homo sapiens
ggguggggccauaa

SEQ ID NO: 1218527 - RNA, 14 nt, Homo sapiens
gggugguacccucu

SEQ ID NO: 1218528 - RNA, 19 nt, Homo sapiens
gggugugcccacgaagaca

SEQ ID NO: 1218529 - RNA, 14 nt, Homo sapiens
ggguuauucagaac

SEQ ID NO: 1218530 - RNA, 13 nt, Homo sapiens
ggguucacugcaa

SEQ ID NO: 1218531 - RNA, 24 nt, Homo sapiens
ggguucugucauguaacacgacau

SEQ ID NO: 1218532 - RNA, 23 nt, Homo sapiens
ggguuuuuguucuggaagccaua

SEQ ID NO: 1218533 - RNA, 19 nt, Homo sapiens
gguaaaacucacugugauc

SEQ ID NO: 1218534 - RNA, 22 nt, Homo sapiens
gguaaaaguucuuuuugcucua

SEQ ID NO: 1218535 - RNA, 13 nt, Homo sapiens
gguaaaauguauu

SEQ ID NO: 1218536 - RNA, 13 nt, Homo sapiens
gguaaauguuucu

SEQ ID NO: 1218537 - RNA, 16 nt, Homo sapiens
gguaacaguggcugcu

SEQ ID NO: 1218538 - RNA, 19 nt, Homo sapiens
gguaacugcuuucuguucc

SEQ ID NO: 1218539 - RNA, 20 nt, Homo sapiens
gguaagggauuucuuagggg

SEQ ID NO: 1218540 - RNA, 15 nt, Homo sapiens
gguaagggggugcag

SEQ ID NO: 1218541 - RNA, 16 nt, Homo sapiens
gguaaguugagauguu

SEQ ID NO: 1218542 - RNA, 18 nt, Homo sapiens
gguaauauaaaguguaau

SEQ ID NO: 1218543 - RNA, 16 nt, Homo sapiens
gguaauauuaauuucc

SEQ ID NO: 1218544 - RNA, 14 nt, Homo sapiens
gguaaucagcauua

SEQ ID NO: 1218545 - RNA, 20 nt, Homo sapiens
gguaauguuaguaaauccau

SEQ ID NO: 1218546 - RNA, 14 nt, Homo sapiens
gguacaauuguaaa

SEQ ID NO: 1218547 - RNA, 20 nt, Homo sapiens
gguacuauuuagauauaaca

SEQ ID NO: 1218548 - RNA, 20 nt, Homo sapiens
gguacuucaggggcacuuca

SEQ ID NO: 1218549 - RNA, 13 nt, Homo sapiens
gguagcaacugaa

SEQ ID NO: 1218550 - RNA, 16 nt, Homo sapiens
gguagcuuaccugaca

SEQ ID NO: 1218551 - RNA, 21 nt, Homo sapiens
gguagcuuaccugacacaaga

SEQ ID NO: 1218552 - RNA, 20 nt, Homo sapiens
gguagggaauaaaauccuaa

SEQ ID NO: 1218553 - RNA, 20 nt, Homo sapiens
gguagggugggagugguuua

SEQ ID NO: 1218554 - RNA, 23 nt, Homo sapiens
gguaguaaauaugaaacuagggu

SEQ ID NO: 1218555 - RNA, 19 nt, Homo sapiens
gguaguacuccugcaaaau

SEQ ID NO: 1218556 - RNA, 21 nt, Homo sapiens
gguaucaaaauuacauauacu

SEQ ID NO: 1218557 - RNA, 18 nt, Homo sapiens
gguaucaagacauagcau

SEQ ID NO: 1218558 - RNA, 16 nt, Homo sapiens
gguauccugcccagug

SEQ ID NO: 1218559 - RNA, 20 nt, Homo sapiens
gguaucuguuuaacauuucc

SEQ ID NO: 1218560 - RNA, 20 nt, Homo sapiens
gguauguuuuaccaucugca

SEQ ID NO: 1218561 - RNA, 19 nt, Homo sapiens
gguauuauucuguuuugca

SEQ ID NO: 1218562 - RNA, 21 nt, Homo sapiens
gguauucuuaagggaacuucc

SEQ ID NO: 1218563 - RNA, 18 nt, Homo sapiens
gguauuuuguaauauucu

SEQ ID NO: 1218564 - RNA, 15 nt, Homo sapiens
ggucaaaggcucaaa

SEQ ID NO: 1218565 - RNA, 15 nt, Homo sapiens
ggucaagaaacagcc

SEQ ID NO: 1218566 - RNA, 12 nt, Homo sapiens
ggucacaggccc

SEQ ID NO: 1218567 - RNA, 12 nt, Homo sapiens
ggucacccagga

SEQ ID NO: 1218568 - RNA, 20 nt, Homo sapiens
ggucaccggccgauggagac

SEQ ID NO: 1218569 - RNA, 20 nt, Homo sapiens
ggucacucaggacagcccag

SEQ ID NO: 1218570 - RNA, 14 nt, Homo sapiens
ggucagaacauguu

SEQ ID NO: 1218571 - RNA, 14 nt, Homo sapiens
ggucagagugccac

SEQ ID NO: 1218572 - RNA, 22 nt, Homo sapiens
ggucagccauuuuuaaugaucu

SEQ ID NO: 1218573 - RNA, 19 nt, Homo sapiens
ggucaucucggcuguuccu

SEQ ID NO: 1218574 - RNA, 21 nt, Homo sapiens
ggucauuucuuagauggagaa

SEQ ID NO: 1218575 - RNA, 23 nt, Homo sapiens
gguccaaagaguuucugcaaagu

SEQ ID NO: 1218576 - RNA, 16 nt, Homo sapiens
gguccagacccacucc

SEQ ID NO: 1218577 - RNA, 12 nt, Homo sapiens
ggucccaagaca

SEQ ID NO: 1218578 - RNA, 17 nt, Homo sapiens
ggucccugcuaugcaga

SEQ ID NO: 1218579 - RNA, 17 nt, Homo sapiens
ggucccuuggucaggag

SEQ ID NO: 1218580 - RNA, 21 nt, Homo sapiens
gguccucuacuuaaugagaua

SEQ ID NO: 1218581 - RNA, 15 nt, Homo sapiens
gguccuggcuccuga

SEQ ID NO: 1218582 - RNA, 15 nt, Homo sapiens
gguccuuccuaccuc

SEQ ID NO: 1218583 - RNA, 14 nt, Homo sapiens
gguccuuuggacag

SEQ ID NO: 1218584 - RNA, 20 nt, Homo sapiens
ggucucacaguguugcccag

SEQ ID NO: 1218585 - RNA, 23 nt, Homo sapiens
ggucucagccuaggcccucauga

SEQ ID NO: 1218586 - RNA, 19 nt, Homo sapiens
ggucuccguggcacuugua

SEQ ID NO: 1218587 - RNA, 16 nt, Homo sapiens
ggucuccucugcagcu

SEQ ID NO: 1218588 - RNA, 20 nt, Homo sapiens
ggucucgcuuuguugcccag

SEQ ID NO: 1218589 - RNA, 21 nt, Homo sapiens
ggucugacaugaacacuuuuu

SEQ ID NO: 1218590 - RNA, 18 nt, Homo sapiens
ggucugugugaauguggg

SEQ ID NO: 1218591 - RNA, 13 nt, Homo sapiens
ggucuuucugugc

SEQ ID NO: 1218592 - RNA, 20 nt, Homo sapiens
ggucuuugcaagaaucauua

SEQ ID NO: 1218593 - RNA, 23 nt, Homo sapiens
ggugaaggaugcggcaggugcuc

SEQ ID NO: 1218594 - RNA, 12 nt, Homo sapiens
ggugaaugagaa

SEQ ID NO: 1218595 - RNA, 12 nt, Homo sapiens
ggugacacuguu

SEQ ID NO: 1218596 - RNA, 22 nt, Homo sapiens
ggugagaaauuugccuuguuca

SEQ ID NO: 1218597 - RNA, 12 nt, Homo sapiens
ggugagcagggu

SEQ ID NO: 1218598 - RNA, 15 nt, Homo sapiens
ggugagcuccagcug

SEQ ID NO: 1218599 - RNA, 19 nt, Homo sapiens
ggugagcuccagcugcugc

SEQ ID NO: 1218600 - RNA, 14 nt, Homo sapiens
ggugaggcaauaaa

SEQ ID NO: 1218601 - RNA, 16 nt, Homo sapiens
ggugaggguuggcgcu

SEQ ID NO: 1218602 - RNA, 16 nt, Homo sapiens
ggugaucccagccagg

SEQ ID NO: 1218603 - RNA, 17 nt, Homo sapiens
ggugauccgccuaccuc

SEQ ID NO: 1218604 - RNA, 15 nt, Homo sapiens
ggugccaaguuccac

SEQ ID NO: 1218605 - RNA, 20 nt, Homo sapiens
ggugccucagacuccgcccu

SEQ ID NO: 1218606 - RNA, 16 nt, Homo sapiens
gguggaaggcagacag

SEQ ID NO: 1218607 - RNA, 19 nt, Homo sapiens
gguggacaagggcccauga

SEQ ID NO: 1218608 - RNA, 15 nt, Homo sapiens
gguggauauggugca

SEQ ID NO: 1218609 - RNA, 13 nt, Homo sapiens
gguggaugccugg

SEQ ID NO: 1218610 - RNA, 12 nt, Homo sapiens
gguggcaauaaa

SEQ ID NO: 1218611 - RNA, 12 nt, Homo sapiens
gguggcacgugc

SEQ ID NO: 1218612 - RNA, 19 nt, Homo sapiens
gguggccgcugaguggcag

SEQ ID NO: 1218613 - RNA, 17 nt, Homo sapiens
guaauuuuaaaagucua

SEQ ID NO: 1218614 - RNA, 20 nt, Homo sapiens
guaauuuuaguagagacagg

SEQ ID NO: 1218615 - RNA, 17 nt, Homo sapiens
guacaaauguaagcaaa

SEQ ID NO: 1218616 - RNA, 19 nt, Homo sapiens
guacaacagaauaaugcau

SEQ ID NO: 1218617 - RNA, 23 nt, Homo sapiens
guacaagcauucaagaaacugau

SEQ ID NO: 1218618 - RNA, 18 nt, Homo sapiens
guacaaguuuuguauaaa

SEQ ID NO: 1218619 - RNA, 19 nt, Homo sapiens
guacaaucaugaacagcuc

SEQ ID NO: 1218620 - RNA, 17 nt, Homo sapiens
guacacccaguugccaa

SEQ ID NO: 1218621 - RNA, 17 nt, Homo sapiens
guacacguguccuguag

SEQ ID NO: 1218622 - RNA, 17 nt, Homo sapiens
guacagugucugugcca

SEQ ID NO: 1218623 - RNA, 18 nt, Homo sapiens
guacaguuugcuguacua

SEQ ID NO: 1218624 - RNA, 21 nt, Homo sapiens
guacauuggcugguaacaguu

SEQ ID NO: 1218625 - RNA, 19 nt, Homo sapiens
guacauuuaaaauugcuau

SEQ ID NO: 1218626 - RNA, 20 nt, Homo sapiens
guacauuuuuauacagugau

SEQ ID NO: 1218627 - RNA, 21 nt, Homo sapiens
guaccaaaucugacauauuau

SEQ ID NO: 1218628 - RNA, 15 nt, Homo sapiens
guaccccacugggcc

SEQ ID NO: 1218629 - RNA, 14 nt, Homo sapiens
guaccccccaaccc

SEQ ID NO: 1218630 - RNA, 14 nt, Homo sapiens
guacccucucagcu

SEQ ID NO: 1218631 - RNA, 14 nt, Homo sapiens
guaccgucuucucc

SEQ ID NO: 1218632 - RNA, 20 nt, Homo sapiens
guaccucaaucuauucugua

SEQ ID NO: 1218633 - RNA, 24 nt, Homo sapiens
guacuaagcaguaagcuaucuuca

SEQ ID NO: 1218634 - RNA, 19 nt, Homo sapiens
guacuauugugaccacagg

SEQ ID NO: 1218635 - RNA, 23 nt, Homo sapiens
guacucaaguaccaccaagggau

SEQ ID NO: 1218636 - RNA, 21 nt, Homo sapiens
guacucugaaauuggucacuu

SEQ ID NO: 1218637 - RNA, 18 nt, Homo sapiens
guacucuguccaguuccu

SEQ ID NO: 1218638 - RNA, 13 nt, Homo sapiens
guacugccuuaaa

SEQ ID NO: 1218639 - RNA, 19 nt, Homo sapiens
guacuguuuuccaguucau

SEQ ID NO: 1218640 - RNA, 17 nt, Homo sapiens
guacuuaagaguggcau

SEQ ID NO: 1218641 - RNA, 14 nt, Homo sapiens
guacuuauguugca

SEQ ID NO: 1218642 - RNA, 20 nt, Homo sapiens
guacuuauguugcacaauga

SEQ ID NO: 1218643 - RNA, 23 nt, Homo sapiens
guacuuauguugcacaaugagaa

SEQ ID NO: 1218644 - RNA, 21 nt, Homo sapiens
guacuucaaguuaaagugaau

SEQ ID NO: 1218645 - RNA, 20 nt, Homo sapiens
guacuugugaaacacagcug

SEQ ID NO: 1218646 - RNA, 14 nt, Homo sapiens
guacuuguuugcaa

SEQ ID NO: 1218647 - RNA, 19 nt, Homo sapiens
guacuuuuaugauguauau

SEQ ID NO: 1218648 - RNA, 18 nt, Homo sapiens
guacuuuuuuuaaacugu

SEQ ID NO: 1218649 - RNA, 21 nt, Homo sapiens
guagaaaauaaaacugagcua

SEQ ID NO: 1218650 - RNA, 14 nt, Homo sapiens
guagaaacauuuag

SEQ ID NO: 1218651 - RNA, 22 nt, Homo sapiens
guagaauuaccauuaauuacau

SEQ ID NO: 1218652 - RNA, 20 nt, Homo sapiens
guagacagguguuacuuaca

SEQ ID NO: 1218653 - RNA, 21 nt, Homo sapiens
guagaccuagggaggaccuua

SEQ ID NO: 1218654 - RNA, 21 nt, Homo sapiens
guagagaaaagcacacuugua

SEQ ID NO: 1218655 - RNA, 20 nt, Homo sapiens
guagagacaggguuuugcca

SEQ ID NO: 1218656 - RNA, 21 nt, Homo sapiens
guagagacgguguuuugccau

SEQ ID NO: 1218657 - RNA, 15 nt, Homo sapiens
guagagucaucucca

SEQ ID NO: 1218658 - RNA, 23 nt, Homo sapiens
guagauccagauccagacuguaa

SEQ ID NO: 1218659 - RNA, 19 nt, Homo sapiens
guagcaaauuaacuuuaca

SEQ ID NO: 1218660 - RNA, 15 nt, Homo sapiens
guagcauacauuuau

SEQ ID NO: 1218661 - RNA, 12 nt, Homo sapiens
guagcauuuuau

SEQ ID NO: 1218662 - RNA, 13 nt, Homo sapiens
guagcccauccuu

SEQ ID NO: 1218663 - RNA, 17 nt, Homo sapiens
guagccugugcauguau

SEQ ID NO: 1218664 - RNA, 18 nt, Homo sapiens
guagccuuagggugcuga

SEQ ID NO: 1218665 - RNA, 20 nt, Homo sapiens
guagcguguuuacaugugua

SEQ ID NO: 1218666 - RNA, 18 nt, Homo sapiens
guagcuaaccaucacccc

SEQ ID NO: 1218667 - RNA, 14 nt, Homo sapiens
guagcuacaggaca

SEQ ID NO: 1218668 - RNA, 16 nt, Homo sapiens
guagcuacaggacauu

SEQ ID NO: 1218669 - RNA, 13 nt, Homo sapiens
guagcugaugaaa

SEQ ID NO: 1218670 - RNA, 17 nt, Homo sapiens
guagcuguggccucacc

SEQ ID NO: 1218671 - RNA, 18 nt, Homo sapiens
guaggaagaguagcauuu

SEQ ID NO: 1218672 - RNA, 21 nt, Homo sapiens
guaggaccaagcaucuugggg

SEQ ID NO: 1218673 - RNA, 21 nt, Homo sapiens
guaggagcugccuuggcucag

SEQ ID NO: 1218674 - RNA, 16 nt, Homo sapiens
guaggaugaaucauau

SEQ ID NO: 1218675 - RNA, 13 nt, Homo sapiens
guagggaugccuu

SEQ ID NO: 1218676 - RNA, 17 nt, Homo sapiens
guaggggcccacuucac

SEQ ID NO: 1218677 - RNA, 15 nt, Homo sapiens
guaggugguuuugaa

SEQ ID NO: 1218678 - RNA, 17 nt, Homo sapiens
guaggugugacuugaac

SEQ ID NO: 1218679 - RNA, 24 nt, Homo sapiens
guaguaauuuauugucugucuaca

SEQ ID NO: 1218680 - RNA, 15 nt, Homo sapiens
guaguaccccaagaa

SEQ ID NO: 1218681 - RNA, 15 nt, Homo sapiens
guagugaaauuauac

SEQ ID NO: 1218682 - RNA, 12 nt, Homo sapiens
guagugaccuaa

SEQ ID NO: 1218683 - RNA, 16 nt, Homo sapiens
guaguuagccaucuaa

SEQ ID NO: 1218684 - RNA, 22 nt, Homo sapiens
guaguuuguuuuagaaccagcc

SEQ ID NO: 1218685 - RNA, 16 nt, Homo sapiens
guauaaacaaaaguuu

SEQ ID NO: 1218686 - RNA, 21 nt, Homo sapiens
guauaaaggcuaaaagggaaa

SEQ ID NO: 1218687 - RNA, 21 nt, Homo sapiens
guauaaauauguauuuuguca

SEQ ID NO: 1218688 - RNA, 22 nt, Homo sapiens
guauaacuggauugcagacugu

SEQ ID NO: 1218689 - RNA, 18 nt, Homo sapiens
guauaaguaauacuucag

SEQ ID NO: 1218690 - RNA, 16 nt, Homo sapiens
guauaagucaagcaca

SEQ ID NO: 1218691 - RNA, 19 nt, Homo sapiens
guauaaguggaggcacuuu

SEQ ID NO: 1218692 - RNA, 15 nt, Homo sapiens
gucuaagagugaagu

SEQ ID NO: 1218693 - RNA, 18 nt, Homo sapiens
gucuaauuuauuaaucua

SEQ ID NO: 1218694 - RNA, 21 nt, Homo sapiens
gucuacaugccaugaccuucc

SEQ ID NO: 1218695 - RNA, 13 nt, Homo sapiens
gucuagagucuca

SEQ ID NO: 1218696 - RNA, 17 nt, Homo sapiens
gucuagccacugaucau

SEQ ID NO: 1218697 - RNA, 14 nt, Homo sapiens
gucuauaaugcaau

SEQ ID NO: 1218698 - RNA, 19 nt, Homo sapiens
gucuauuuucucagucauu

SEQ ID NO: 1218699 - RNA, 18 nt, Homo sapiens
gucucaccucauagcuaa

SEQ ID NO: 1218700 - RNA, 14 nt, Homo sapiens
gucucacucuguca

SEQ ID NO: 1218701 - RNA, 23 nt, Homo sapiens
gucucagaaacugcgaggccagu

SEQ ID NO: 1218702 - RNA, 14 nt, Homo sapiens
gucucaucucuuca

SEQ ID NO: 1218703 - RNA, 17 nt, Homo sapiens
gucucaucuucucucau

SEQ ID NO: 1218704 - RNA, 14 nt, Homo sapiens
gucucauucuucca

SEQ ID NO: 1218705 - RNA, 13 nt, Homo sapiens
gucuccacugugc

SEQ ID NO: 1218706 - RNA, 19 nt, Homo sapiens
gucuccagaguuguucucu

SEQ ID NO: 1218707 - RNA, 17 nt, Homo sapiens
gucuccccaugugccug

SEQ ID NO: 1218708 - RNA, 23 nt, Homo sapiens
gucucccuuccuaugcuguucac

SEQ ID NO: 1218709 - RNA, 14 nt, Homo sapiens
gucuccguggcacu

SEQ ID NO: 1218710 - RNA, 17 nt, Homo sapiens
gucuccuacuccugacu

SEQ ID NO: 1218711 - RNA, 23 nt, Homo sapiens
gucuccucaauuuuugucucaga

SEQ ID NO: 1218712 - RNA, 17 nt, Homo sapiens
gucuccuccauggugua

SEQ ID NO: 1218713 - RNA, 16 nt, Homo sapiens
gucuccuugcacuuuc

SEQ ID NO: 1218714 - RNA, 20 nt, Homo sapiens
gucuccuuugcucuugccaa

SEQ ID NO: 1218715 - RNA, 17 nt, Homo sapiens
gucucuaccuaaggaca

SEQ ID NO: 1218716 - RNA, 18 nt, Homo sapiens
gucucuacuaaaaauaca

SEQ ID NO: 1218717 - RNA, 17 nt, Homo sapiens
gucucuucuaagcaaaa

SEQ ID NO: 1218718 - RNA, 23 nt, Homo sapiens
gucucuucuuuagaacagggaaa

SEQ ID NO: 1218719 - RNA, 12 nt, Homo sapiens
gucugacaggca

SEQ ID NO: 1218720 - RNA, 13 nt, Homo sapiens
gucugagccaaag

SEQ ID NO: 1218721 - RNA, 12 nt, Homo sapiens
gucugaugacac

SEQ ID NO: 1218722 - RNA, 12 nt, Homo sapiens
gucugccucuuc

SEQ ID NO: 1218723 - RNA, 16 nt, Homo sapiens
gucugcuagccaggau

SEQ ID NO: 1218724 - RNA, 16 nt, Homo sapiens
gucuggaaugcagugg

SEQ ID NO: 1218725 - RNA, 18 nt, Homo sapiens
gucuggcagggauggguu

SEQ ID NO: 1218726 - RNA, 18 nt, Homo sapiens
gucugggagucacacagu

SEQ ID NO: 1218727 - RNA, 12 nt, Homo sapiens
gucugggccagu

SEQ ID NO: 1218728 - RNA, 17 nt, Homo sapiens
gucugggucuaccagga

SEQ ID NO: 1218729 - RNA, 13 nt, Homo sapiens
gucugguguucca

SEQ ID NO: 1218730 - RNA, 16 nt, Homo sapiens
gucugucuacauuucu

SEQ ID NO: 1218731 - RNA, 15 nt, Homo sapiens
gucuguggacugcaa

SEQ ID NO: 1218732 - RNA, 18 nt, Homo sapiens
gucugugugggacuguac

SEQ ID NO: 1218733 - RNA, 20 nt, Homo sapiens
gucuguguuuacagacagaa

SEQ ID NO: 1218734 - RNA, 12 nt, Homo sapiens
gucuguuugcaa

SEQ ID NO: 1218735 - RNA, 13 nt, Homo sapiens
gucuguuugcauu

SEQ ID NO: 1218736 - RNA, 18 nt, Homo sapiens
gucuguuuggacugcaga

SEQ ID NO: 1218737 - RNA, 14 nt, Homo sapiens
gucuuacugugauc

SEQ ID NO: 1218738 - RNA, 15 nt, Homo sapiens
gucuuagauguauau

SEQ ID NO: 1218739 - RNA, 13 nt, Homo sapiens
gucuucacuuccc

SEQ ID NO: 1218740 - RNA, 20 nt, Homo sapiens
gucuuccaggcacucaaaag

SEQ ID NO: 1218741 - RNA, 18 nt, Homo sapiens
gucuuccugacacuuuaa

SEQ ID NO: 1218742 - RNA, 19 nt, Homo sapiens
gucuuccugacacuuuaau

SEQ ID NO: 1218743 - RNA, 21 nt, Homo sapiens
gucuuccugaguggugccaaa

SEQ ID NO: 1218744 - RNA, 22 nt, Homo sapiens
gucuuccugaguggugccaaac

SEQ ID NO: 1218745 - RNA, 13 nt, Homo sapiens
gucuucuaaacuu

SEQ ID NO: 1218746 - RNA, 17 nt, Homo sapiens
gucuucugccuguuaua

SEQ ID NO: 1218747 - RNA, 16 nt, Homo sapiens
gucuucuggucugugu

SEQ ID NO: 1218748 - RNA, 17 nt, Homo sapiens
gucuucuucaauacuga

SEQ ID NO: 1218749 - RNA, 20 nt, Homo sapiens
gucuugcaacuucaguuuua

SEQ ID NO: 1218750 - RNA, 17 nt, Homo sapiens
gucuugcaauggcagcc

SEQ ID NO: 1218751 - RNA, 11 nt, Homo sapiens
gucuugccagg

SEQ ID NO: 1218752 - RNA, 16 nt, Homo sapiens
gucuugcucuguuacc

SEQ ID NO: 1218753 - RNA, 18 nt, Homo sapiens
gucuuggggccacuuuca

SEQ ID NO: 1218754 - RNA, 15 nt, Homo sapiens
gucuugugaaggcag

SEQ ID NO: 1218755 - RNA, 11 nt, Homo sapiens
gucuuguucug

SEQ ID NO: 1218756 - RNA, 13 nt, Homo sapiens
gucuuuaacucau

SEQ ID NO: 1218757 - RNA, 20 nt, Homo sapiens
gucuuuccugaaccaugugg

SEQ ID NO: 1218758 - RNA, 23 nt, Homo sapiens
gucuuugaagugacuucacagag

SEQ ID NO: 1218759 - RNA, 12 nt, Homo sapiens
gucuuuuacccg

SEQ ID NO: 1218760 - RNA, 15 nt, Homo sapiens
gucuuuuauauuugu

SEQ ID NO: 1218761 - RNA, 13 nt, Homo sapiens
gucuuuugaauau

SEQ ID NO: 1218762 - RNA, 21 nt, Homo sapiens
gucuuuuuuucccuaccauuc

SEQ ID NO: 1218763 - RNA, 13 nt, Homo sapiens
gugaaaaugugac

SEQ ID NO: 1218764 - RNA, 16 nt, Homo sapiens
gugaaacuccaucuca

SEQ ID NO: 1218765 - RNA, 21 nt, Homo sapiens
gugaacauccccucccaucau

SEQ ID NO: 1218766 - RNA, 20 nt, Homo sapiens
gugaaccacuucauucugca

SEQ ID NO: 1218767 - RNA, 17 nt, Homo sapiens
gugaaccuuaguaccua

SEQ ID NO: 1218768 - RNA, 13 nt, Homo sapiens
gugaacugugcau

SEQ ID NO: 1218769 - RNA, 20 nt, Homo sapiens
gugaagaauuuagaucuuau

SEQ ID NO: 1218770 - RNA, 20 nt, Homo sapiens
gugaagaugguuucaauuca

SEQ ID NO: 1218771 - RNA, 22 nt, Homo sapiens
gugaagucacgucacacagggg

SEQ ID NO: 1218772 - RNA, 17 nt, Homo sapiens
gugaauaacuaugccag

SEQ ID NO: 1218773 - RNA, 18 nt, Homo sapiens
gugaauaugugguuucua

SEQ ID NO: 1218774 - RNA, 13 nt, Homo sapiens
gugaaugugggca

SEQ ID NO: 1218775 - RNA, 14 nt, Homo sapiens
gugaauuauucuga

SEQ ID NO: 1218776 - RNA, 11 nt, Homo sapiens
gugaauuguga

SEQ ID NO: 1218777 - RNA, 19 nt, Homo sapiens
gugacaacacuuguguuau

SEQ ID NO: 1218778 - RNA, 16 nt, Homo sapiens
gugacacaaucucggc

SEQ ID NO: 1218779 - RNA, 13 nt, Homo sapiens
gugacacagcagc

SEQ ID NO: 1218780 - RNA, 13 nt, Homo sapiens
gugacacauaugc

SEQ ID NO: 1218781 - RNA, 20 nt, Homo sapiens
gugacagaccacaucuuuau

SEQ ID NO: 1218782 - RNA, 21 nt, Homo sapiens
gugacagccccuuauuugcac

SEQ ID NO: 1218783 - RNA, 14 nt, Homo sapiens
gugacagucucccc

SEQ ID NO: 1218784 - RNA, 18 nt, Homo sapiens
gugacaugaacuacagac

SEQ ID NO: 1218785 - RNA, 17 nt, Homo sapiens
gugacaugugaaaccuu

SEQ ID NO: 1218786 - RNA, 21 nt, Homo sapiens
gugacauuugggagacaugug

SEQ ID NO: 1218787 - RNA, 23 nt, Homo sapiens
gugacauuugggagacaugugac

SEQ ID NO: 1218788 - RNA, 16 nt, Homo sapiens
gugaccacugaagcac

SEQ ID NO: 1218789 - RNA, 14 nt, Homo sapiens
gugaccuugagcaa

SEQ ID NO: 1218790 - RNA, 12 nt, Homo sapiens
gugacugcaaua

SEQ ID NO: 1218791 - RNA, 21 nt, Homo sapiens
gugacuucuccaggucucacg

SEQ ID NO: 1218792 - RNA, 21 nt, Homo sapiens
gugacuugaacuagauugcau

SEQ ID NO: 1218793 - RNA, 18 nt, Homo sapiens
gugagaaauuucugugaa

SEQ ID NO: 1218794 - RNA, 23 nt, Homo sapiens
gugagaaauuugccuuguucaau

SEQ ID NO: 1218795 - RNA, 18 nt, Homo sapiens
gugagacuguaaguuaca

SEQ ID NO: 1218796 - RNA, 20 nt, Homo sapiens
gugagauauuugguaccaug

SEQ ID NO: 1218797 - RNA, 15 nt, Homo sapiens
gugagaugcuggaga

SEQ ID NO: 1218798 - RNA, 17 nt, Homo sapiens
gugagcaccugagcaug

SEQ ID NO: 1218799 - RNA, 14 nt, Homo sapiens
gugagcuacuuugu

SEQ ID NO: 1218800 - RNA, 13 nt, Homo sapiens
gugagcuaugcaa

SEQ ID NO: 1218801 - RNA, 22 nt, Homo sapiens
gugaggccugcacagcuaagug

SEQ ID NO: 1218802 - RNA, 19 nt, Homo sapiens
gugaggcuguccuguacau

SEQ ID NO: 1218803 - RNA, 20 nt, Homo sapiens
gugaggugugucacaaugag

SEQ ID NO: 1218804 - RNA, 18 nt, Homo sapiens
gugaguaagagcuggugu

SEQ ID NO: 1218805 - RNA, 13 nt, Homo sapiens
gugagugugacag

SEQ ID NO: 1218806 - RNA, 14 nt, Homo sapiens
gugaguuugagcug

SEQ ID NO: 1218807 - RNA, 16 nt, Homo sapiens
gugauauucuaagacu

SEQ ID NO: 1218808 - RNA, 19 nt, Homo sapiens
gugaucaacuguucagggu

SEQ ID NO: 1218809 - RNA, 13 nt, Homo sapiens
gugauccacccac

SEQ ID NO: 1218810 - RNA, 17 nt, Homo sapiens
gugaucccagccagggc

SEQ ID NO: 1218811 - RNA, 16 nt, Homo sapiens
gugauccgccuaccuc

SEQ ID NO: 1218812 - RNA, 18 nt, Homo sapiens
gugauccgccuaccucag

SEQ ID NO: 1218813 - RNA, 13 nt, Homo sapiens
gugauccucccac

SEQ ID NO: 1218814 - RNA, 13 nt, Homo sapiens
gugaucuaccugc

SEQ ID NO: 1218815 - RNA, 14 nt, Homo sapiens
gugaucuuggcuca

SEQ ID NO: 1218816 - RNA, 14 nt, Homo sapiens
gugaugacauuccc

SEQ ID NO: 1218817 - RNA, 22 nt, Homo sapiens
gugaugacauucccugcuaaua

SEQ ID NO: 1218818 - RNA, 22 nt, Homo sapiens
gugguuuuauacugaaggaaaa

SEQ ID NO: 1218819 - RNA, 18 nt, Homo sapiens
guguaaaauacguuugaa

SEQ ID NO: 1218820 - RNA, 21 nt, Homo sapiens
guguaaagcuggcccugccuc

SEQ ID NO: 1218821 - RNA, 20 nt, Homo sapiens
guguaacccccaguucaaga

SEQ ID NO: 1218822 - RNA, 20 nt, Homo sapiens
guguaaucccccaggagaac

SEQ ID NO: 1218823 - RNA, 15 nt, Homo sapiens
guguaauuggcccaa

SEQ ID NO: 1218824 - RNA, 12 nt, Homo sapiens
guguacugccuu

SEQ ID NO: 1218825 - RNA, 12 nt, Homo sapiens
guguacugugga

SEQ ID NO: 1218826 - RNA, 14 nt, Homo sapiens
guguagccugugca

SEQ ID NO: 1218827 - RNA, 12 nt, Homo sapiens
guguauacaugu

SEQ ID NO: 1218828 - RNA, 17 nt, Homo sapiens
guguauauuuauucaua

SEQ ID NO: 1218829 - RNA, 13 nt, Homo sapiens
guguauccaugca

SEQ ID NO: 1218830 - RNA, 22 nt, Homo sapiens
guguauccaugcaccuaccuua

SEQ ID NO: 1218831 - RNA, 19 nt, Homo sapiens
gugucagaaacccuggucu

SEQ ID NO: 1218832 - RNA, 16 nt, Homo sapiens
gugucaggcaugaaga

SEQ ID NO: 1218833 - RNA, 12 nt, Homo sapiens
gugucaggugac

SEQ ID NO: 1218834 - RNA, 19 nt, Homo sapiens
guguccagcugaguuucuc

SEQ ID NO: 1218835 - RNA, 12 nt, Homo sapiens
guguccugacca

SEQ ID NO: 1218836 - RNA, 20 nt, Homo sapiens
guguccuggggacuuccuca

SEQ ID NO: 1218837 - RNA, 19 nt, Homo sapiens
gugucuagagucaugugag

SEQ ID NO: 1218838 - RNA, 17 nt, Homo sapiens
gugucuuacgugccacc

SEQ ID NO: 1218839 - RNA, 13 nt, Homo sapiens
gugucuucaggag

SEQ ID NO: 1218840 - RNA, 20 nt, Homo sapiens
gugucuuccacuuugcauau

SEQ ID NO: 1218841 - RNA, 14 nt, Homo sapiens
gugugagcuaugca

SEQ ID NO: 1218842 - RNA, 21 nt, Homo sapiens
gugugccuauagucgcagcua

SEQ ID NO: 1218843 - RNA, 19 nt, Homo sapiens
gugugcgugugcgugcgug

SEQ ID NO: 1218844 - RNA, 14 nt, Homo sapiens
guguggagcuguau

SEQ ID NO: 1218845 - RNA, 22 nt, Homo sapiens
guguggcaaacuugcaguuuaa

SEQ ID NO: 1218846 - RNA, 13 nt, Homo sapiens
guguggcucagug

SEQ ID NO: 1218847 - RNA, 19 nt, Homo sapiens
guguggggauuuucacuga

SEQ ID NO: 1218848 - RNA, 19 nt, Homo sapiens
guguggugucgucugugaa

SEQ ID NO: 1218849 - RNA, 22 nt, Homo sapiens
gugugguucagcuacuuuccau

SEQ ID NO: 1218850 - RNA, 22 nt, Homo sapiens
gugugguugcucacagcuguaa

SEQ ID NO: 1218851 - RNA, 20 nt, Homo sapiens
guguguauauauguguauau

SEQ ID NO: 1218852 - RNA, 17 nt, Homo sapiens
guguguauccgacucua

SEQ ID NO: 1218853 - RNA, 18 nt, Homo sapiens
guguguauccgacucuaa

SEQ ID NO: 1218854 - RNA, 15 nt, Homo sapiens
gugugugacaauucu

SEQ ID NO: 1218855 - RNA, 17 nt, Homo sapiens
guguguguauacaugcc

SEQ ID NO: 1218856 - RNA, 15 nt, Homo sapiens
guguguguguguaau

SEQ ID NO: 1218857 - RNA, 15 nt, Homo sapiens
guguguguguguaua

SEQ ID NO: 1218858 - RNA, 21 nt, Homo sapiens
guguuauuaaugacaaaggca

SEQ ID NO: 1218859 - RNA, 15 nt, Homo sapiens
guguucauacauuug

SEQ ID NO: 1218860 - RNA, 21 nt, Homo sapiens
guguucgcuuggcuccaugcu

SEQ ID NO: 1218861 - RNA, 19 nt, Homo sapiens
guguucuacacucaucuua

SEQ ID NO: 1218862 - RNA, 17 nt, Homo sapiens
guguucugauuagaaau

SEQ ID NO: 1218863 - RNA, 20 nt, Homo sapiens
guguugcaccaggcacugcu

SEQ ID NO: 1218864 - RNA, 22 nt, Homo sapiens
guguugcaccaggcacugcugc

SEQ ID NO: 1218865 - RNA, 16 nt, Homo sapiens
guguuggcacaugccu

SEQ ID NO: 1218866 - RNA, 18 nt, Homo sapiens
guguugugggaugaccgc

SEQ ID NO: 1218867 - RNA, 12 nt, Homo sapiens
guguuugggaug

SEQ ID NO: 1218868 - RNA, 15 nt, Homo sapiens
guguuuuauugacau

SEQ ID NO: 1218869 - RNA, 23 nt, Homo sapiens
guguuuucauucccccuuccuag

SEQ ID NO: 1218870 - RNA, 17 nt, Homo sapiens
guguuuuuaacauguca

SEQ ID NO: 1218871 - RNA, 17 nt, Homo sapiens
guguuuuuuuacauacg

SEQ ID NO: 1218872 - RNA, 20 nt, Homo sapiens
guuaaaacuguacauuuaaa

SEQ ID NO: 1218873 - RNA, 20 nt, Homo sapiens
guuaaaauaaaauuguacau

SEQ ID NO: 1218874 - RNA, 22 nt, Homo sapiens
guuaaacuguuagcacuguuga

SEQ ID NO: 1218875 - RNA, 24 nt, Homo sapiens
guuaaagggcauuuuacuaaggca

SEQ ID NO: 1218876 - RNA, 14 nt, Homo sapiens
guuaaauaagcaaa

SEQ ID NO: 1218877 - RNA, 13 nt, Homo sapiens
guuaaaugaacuu

SEQ ID NO: 1218878 - RNA, 12 nt, Homo sapiens
guuaacaucuca

SEQ ID NO: 1218879 - RNA, 18 nt, Homo sapiens
guuaaggguuaguuuaca

SEQ ID NO: 1218880 - RNA, 14 nt, Homo sapiens
guuaaucacaggau

SEQ ID NO: 1218881 - RNA, 17 nt, Homo sapiens
guuaaucauguauuaaa

SEQ ID NO: 1218882 - RNA, 18 nt, Homo sapiens
guuaauuacaacugcuau

SEQ ID NO: 1218883 - RNA, 19 nt, Homo sapiens
guuaauuauuuugacaaau

SEQ ID NO: 1218884 - RNA, 20 nt, Homo sapiens
guuaauuuuuccaacuacua

SEQ ID NO: 1218885 - RNA, 11 nt, Homo sapiens
guuacaaagac

SEQ ID NO: 1218886 - RNA, 20 nt, Homo sapiens
guuacaaaguuauauucaca

SEQ ID NO: 1218887 - RNA, 16 nt, Homo sapiens
guuacacagcccaaga

SEQ ID NO: 1218888 - RNA, 21 nt, Homo sapiens
guuacagugaugcugugcuau

SEQ ID NO: 1218889 - RNA, 22 nt, Homo sapiens
guuacaguuugagacuuccaaa

SEQ ID NO: 1218890 - RNA, 14 nt, Homo sapiens
guuacauaagauaa

SEQ ID NO: 1218891 - RNA, 15 nt, Homo sapiens
guuaccaacuaccua

SEQ ID NO: 1218892 - RNA, 16 nt, Homo sapiens
guuaccacacaucuau

SEQ ID NO: 1218893 - RNA, 16 nt, Homo sapiens
guuaccauucacaaua

SEQ ID NO: 1218894 - RNA, 15 nt, Homo sapiens
guuaccuacuuugac

SEQ ID NO: 1218895 - RNA, 16 nt, Homo sapiens
guuaccucugcaugga

SEQ ID NO: 1218896 - RNA, 22 nt, Homo sapiens
guuacuauuuucuacaauuaau

SEQ ID NO: 1218897 - RNA, 15 nt, Homo sapiens
guuacugaccagcaa

SEQ ID NO: 1218898 - RNA, 19 nt, Homo sapiens
guuacugcuugaccaaaga

SEQ ID NO: 1218899 - RNA, 16 nt, Homo sapiens
guuacuguggucacuu

SEQ ID NO: 1218900 - RNA, 15 nt, Homo sapiens
guuacuguugcacug

SEQ ID NO: 1218901 - RNA, 16 nt, Homo sapiens
guuacuguugcacuga

SEQ ID NO: 1218902 - RNA, 17 nt, Homo sapiens
guuacuguugcacugau

SEQ ID NO: 1218903 - RNA, 17 nt, Homo sapiens
guuacuuaccacagacu

SEQ ID NO: 1218904 - RNA, 22 nt, Homo sapiens
guuagaagcaaugaauguauau

SEQ ID NO: 1218905 - RNA, 21 nt, Homo sapiens
guuagagagggaccauguguc

SEQ ID NO: 1218906 - RNA, 17 nt, Homo sapiens
guuagauauugcuacua

SEQ ID NO: 1218907 - RNA, 19 nt, Homo sapiens
guuaguggauuacugccau

SEQ ID NO: 1218908 - RNA, 18 nt, Homo sapiens
gccauuauuuucugucag

SEQ ID NO: 1218909 - RNA, 14 nt, Homo sapiens
gccauucacuuccc

SEQ ID NO: 1218910 - RNA, 17 nt, Homo sapiens
gccauucuggacaccag

SEQ ID NO: 1218911 - RNA, 13 nt, Homo sapiens
gccauugucuuua

SEQ ID NO: 1218912 - RNA, 16 nt, Homo sapiens
gccauuucacucucaa

SEQ ID NO: 1218913 - RNA, 22 nt, Homo sapiens
gcccaaagagcacaaacauuuu

SEQ ID NO: 1218914 - RNA, 16 nt, Homo sapiens
gcccaaauucuuucag

SEQ ID NO: 1218915 - RNA, 12 nt, Homo sapiens
gcccaacaguaa

SEQ ID NO: 1218916 - RNA, 23 nt, Homo sapiens
gcccaacaguaaucugcaucaua

SEQ ID NO: 1218917 - RNA, 16 nt, Homo sapiens
gcccaaggugcugaug

SEQ ID NO: 1218918 - RNA, 20 nt, Homo sapiens
gcccaagugaggagugccag

SEQ ID NO: 1218919 - RNA, 20 nt, Homo sapiens
gcccaagugcaaaagaaaaa

SEQ ID NO: 1218920 - RNA, 18 nt, Homo sapiens
gcccacaacucccuugca

SEQ ID NO: 1218921 - RNA, 14 nt, Homo sapiens
gcccacacccaggc

SEQ ID NO: 1218922 - RNA, 15 nt, Homo sapiens
gcccacacccaggcc

SEQ ID NO: 1218923 - RNA, 13 nt, Homo sapiens
gcccacacuugag

SEQ ID NO: 1218924 - RNA, 13 nt, Homo sapiens
gcccacaucccag

SEQ ID NO: 1218925 - RNA, 16 nt, Homo sapiens
gcccacccugggagac

SEQ ID NO: 1218926 - RNA, 17 nt, Homo sapiens
gcccaccgaggugcuau

SEQ ID NO: 1218927 - RNA, 19 nt, Homo sapiens
gcccacuguuaauauucua

SEQ ID NO: 1218928 - RNA, 11 nt, Homo sapiens
gcccacuucca

SEQ ID NO: 1218929 - RNA, 20 nt, Homo sapiens
gcccagaagaaaauucuccu

SEQ ID NO: 1218930 - RNA, 20 nt, Homo sapiens
gcccagacacagacuggcaa

SEQ ID NO: 1218931 - RNA, 22 nt, Homo sapiens
gcccagacacagacuggcaaua

SEQ ID NO: 1218932 - RNA, 14 nt, Homo sapiens
gcccagagcacuuu

SEQ ID NO: 1218933 - RNA, 15 nt, Homo sapiens
gcccagagcacuuua

SEQ ID NO: 1218934 - RNA, 14 nt, Homo sapiens
gcccagauggcacu

SEQ ID NO: 1218935 - RNA, 18 nt, Homo sapiens
gcccagauggcacucagc

SEQ ID NO: 1218936 - RNA, 20 nt, Homo sapiens
gcccagcagggccucaaagu

SEQ ID NO: 1218937 - RNA, 16 nt, Homo sapiens
gcccagcugcaccugc

SEQ ID NO: 1218938 - RNA, 21 nt, Homo sapiens
gcccaggaauuagagaagcug

SEQ ID NO: 1218939 - RNA, 17 nt, Homo sapiens
gcccaggagaccacggg

SEQ ID NO: 1218940 - RNA, 22 nt, Homo sapiens
gcccaggagagagaaagccagg

SEQ ID NO: 1218941 - RNA, 18 nt, Homo sapiens
gcccaggcaacaguacuu

SEQ ID NO: 1218942 - RNA, 17 nt, Homo sapiens
gcccaggcaggucuuga

SEQ ID NO: 1218943 - RNA, 21 nt, Homo sapiens
gcccaggccggccagccucac

SEQ ID NO: 1218944 - RNA, 16 nt, Homo sapiens
gcccaggcucaagccc

SEQ ID NO: 1218945 - RNA, 19 nt, Homo sapiens
gcccaggcucaagcccuag

SEQ ID NO: 1218946 - RNA, 18 nt, Homo sapiens
gcccaggcuggagugcaa

SEQ ID NO: 1218947 - RNA, 21 nt, Homo sapiens
gcccaggcuggagugcaaugg

SEQ ID NO: 1218948 - RNA, 20 nt, Homo sapiens
gcccaggcuggcgugcagug

SEQ ID NO: 1218949 - RNA, 16 nt, Homo sapiens
gcccagggaagccaaa

SEQ ID NO: 1218950 - RNA, 20 nt, Homo sapiens
gcccagggaagccaaaagau

SEQ ID NO: 1218951 - RNA, 20 nt, Homo sapiens
gcccaggggagcguguuccu

SEQ ID NO: 1218952 - RNA, 16 nt, Homo sapiens
gcccauagaaacauga

SEQ ID NO: 1218953 - RNA, 18 nt, Homo sapiens
gcccauggcccugugcua

SEQ ID NO: 1218954 - RNA, 17 nt, Homo sapiens
gcccaugugcaccugcc

SEQ ID NO: 1218955 - RNA, 22 nt, Homo sapiens
gccccacccaguuucuggaaaa

SEQ ID NO: 1218956 - RNA, 21 nt, Homo sapiens
gccccaccuccaccugugaga

SEQ ID NO: 1218957 - RNA, 14 nt, Homo sapiens
gccccacuccuucc

SEQ ID NO: 1218958 - RNA, 18 nt, Homo sapiens
gccccagaaggcagggaa

SEQ ID NO: 1218959 - RNA, 16 nt, Homo sapiens
gccccagcacauggaa

SEQ ID NO: 1218960 - RNA, 14 nt, Homo sapiens
gccccagcucugag

SEQ ID NO: 1218961 - RNA, 14 nt, Homo sapiens
gccccaguccaugc

SEQ ID NO: 1218962 - RNA, 18 nt, Homo sapiens
gcccccaucugacaagaa

SEQ ID NO: 1218963 - RNA, 13 nt, Homo sapiens
gcccccugcaucu

SEQ ID NO: 1218964 - RNA, 23 nt, Homo sapiens
uacuaagauguucacuguggcau

SEQ ID NO: 1218965 - RNA, 17 nt, Homo sapiens
uacuaaggaaucuuucu

SEQ ID NO: 1218966 - RNA, 14 nt, Homo sapiens
uacuacacagaauu

SEQ ID NO: 1218967 - RNA, 14 nt, Homo sapiens
uacuaccacaagga

SEQ ID NO: 1218968 - RNA, 14 nt, Homo sapiens
uacuaccuguguau

SEQ ID NO: 1218969 - RNA, 20 nt, Homo sapiens
uacuagacuagacaucacaa

SEQ ID NO: 1218970 - RNA, 13 nt, Homo sapiens
uacuagcacuuug

SEQ ID NO: 1218971 - RNA, 21 nt, Homo sapiens
uacuagcuuuugaaauccaga

SEQ ID NO: 1218972 - RNA, 16 nt, Homo sapiens
uacuagggagccauuu

SEQ ID NO: 1218973 - RNA, 12 nt, Homo sapiens
uacuauaugauu

SEQ ID NO: 1218974 - RNA, 15 nt, Homo sapiens
uacuaucauucucag

SEQ ID NO: 1218975 - RNA, 19 nt, Homo sapiens
uacuauggagugcucacaa

SEQ ID NO: 1218976 - RNA, 13 nt, Homo sapiens
uacuauguacugc

SEQ ID NO: 1218977 - RNA, 17 nt, Homo sapiens
uacuauguacugccuua

SEQ ID NO: 1218978 - RNA, 13 nt, Homo sapiens
uacucaaguuuca

SEQ ID NO: 1218979 - RNA, 16 nt, Homo sapiens
uacucagaaccugcuc

SEQ ID NO: 1218980 - RNA, 21 nt, Homo sapiens
uacucagggcuccucccagcu

SEQ ID NO: 1218981 - RNA, 18 nt, Homo sapiens
uacucaucagagcagcua

SEQ ID NO: 1218982 - RNA, 20 nt, Homo sapiens
uacucauuaaaaauaauaga

SEQ ID NO: 1218983 - RNA, 12 nt, Homo sapiens
uacucauuacug

SEQ ID NO: 1218984 - RNA, 22 nt, Homo sapiens
uacuccaguauaugcugaugga

SEQ ID NO: 1218985 - RNA, 15 nt, Homo sapiens
uacuccaucauggcu

SEQ ID NO: 1218986 - RNA, 15 nt, Homo sapiens
uacucccucuucacu

SEQ ID NO: 1218987 - RNA, 20 nt, Homo sapiens
uacucccucuucacuguggc

SEQ ID NO: 1218988 - RNA, 22 nt, Homo sapiens
uacuccuuuugccacugcugug

SEQ ID NO: 1218989 - RNA, 23 nt, Homo sapiens
uacucuaaacaauaguucacucc

SEQ ID NO: 1218990 - RNA, 18 nt, Homo sapiens
uagagccagggucucacu

SEQ ID NO: 1218991 - RNA, 22 nt, Homo sapiens
uagagccuucugaugucucuaa

SEQ ID NO: 1218992 - RNA, 14 nt, Homo sapiens
uagaggaaagggau

SEQ ID NO: 1218993 - RNA, 17 nt, Homo sapiens
uagaggcuagcuucugc

SEQ ID NO: 1218994 - RNA, 21 nt, Homo sapiens
uagaggggcucugggagacuu

SEQ ID NO: 1218995 - RNA, 16 nt, Homo sapiens
uagagggggucucaga

SEQ ID NO: 1218996 - RNA, 21 nt, Homo sapiens
uagagguagguaggaucaucc

SEQ ID NO: 1218997 - RNA, 13 nt, Homo sapiens
uagagguccucau

SEQ ID NO: 1218998 - RNA, 15 nt, Homo sapiens
uagagguccucaugg

SEQ ID NO: 1218999 - RNA, 15 nt, Homo sapiens
uagaguauaccuccu

SEQ ID NO: 1219000 - RNA, 22 nt, Homo sapiens
uagaguaucacucccacuuccu

SEQ ID NO: 1219001 - RNA, 18 nt, Homo sapiens
uagagugugguuaugaac

SEQ ID NO: 1219002 - RNA, 20 nt, Homo sapiens
uagagugugguuaugaacuu

SEQ ID NO: 1219003 - RNA, 13 nt, Homo sapiens
uagaguguuauca

SEQ ID NO: 1219004 - RNA, 18 nt, Homo sapiens
uagaguguuaucagucau

SEQ ID NO: 1219005 - RNA, 15 nt, Homo sapiens
uagaguuccauauau

SEQ ID NO: 1219006 - RNA, 20 nt, Homo sapiens
uagaguuuuaucaacuuugg

SEQ ID NO: 1219007 - RNA, 15 nt, Homo sapiens
uagauaaauuucaau

SEQ ID NO: 1219008 - RNA, 15 nt, Homo sapiens
uagauauacauauca

SEQ ID NO: 1219009 - RNA, 14 nt, Homo sapiens
uagauauaugccuu

SEQ ID NO: 1219010 - RNA, 13 nt, Homo sapiens
uagauauugcuac

SEQ ID NO: 1219011 - RNA, 18 nt, Homo sapiens
uagauauugcuacuauaa

SEQ ID NO: 1219012 - RNA, 19 nt, Homo sapiens
uagaucagaagacuacaaa

SEQ ID NO: 1219013 - RNA, 15 nt, Homo sapiens
uagaucauaagacug

SEQ ID NO: 1219014 - RNA, 17 nt, Homo sapiens
uagauccagauccagac

SEQ ID NO: 1219015 - RNA, 12 nt, Homo sapiens
uagaucuagaaa

SEQ ID NO: 1219016 - RNA, 18 nt, Homo sapiens
uagaucugauggugagcu

SEQ ID NO: 1219017 - RNA, 12 nt, Homo sapiens
uagaugccaggg

SEQ ID NO: 1219018 - RNA, 18 nt, Homo sapiens
uagaugccagggcuggaa

SEQ ID NO: 1219019 - RNA, 21 nt, Homo sapiens
uagaugcuggcaucucugcag

SEQ ID NO: 1219020 - RNA, 21 nt, Homo sapiens
uagauggggagccucgggaaa

SEQ ID NO: 1219021 - RNA, 19 nt, Homo sapiens
uagaugggugggggcuccu

SEQ ID NO: 1219022 - RNA, 16 nt, Homo sapiens
uagauguaacauuccu

SEQ ID NO: 1219023 - RNA, 12 nt, Homo sapiens
uagaugugcauu

SEQ ID NO: 1219024 - RNA, 18 nt, Homo sapiens
uagauucucugugucuaa

SEQ ID NO: 1219025 - RNA, 19 nt, Homo sapiens
uagauugcuuucuucuuaa

SEQ ID NO: 1219026 - RNA, 17 nt, Homo sapiens
uagcaaacugaauccag

SEQ ID NO: 1219027 - RNA, 13 nt, Homo sapiens
uagcaaagcaaaa

SEQ ID NO: 1219028 - RNA, 21 nt, Homo sapiens
uagcaaauggcagaaccaaag

SEQ ID NO: 1219029 - RNA, 20 nt, Homo sapiens
uagcaagauauugaucaaau

SEQ ID NO: 1219030 - RNA, 20 nt, Homo sapiens
uagcaaggcugugcaucuag

SEQ ID NO: 1219031 - RNA, 23 nt, Homo sapiens
uagcaauugacagagaauaacuc

SEQ ID NO: 1219032 - RNA, 18 nt, Homo sapiens
uagcacaauuugcacuaa

SEQ ID NO: 1219033 - RNA, 17 nt, Homo sapiens
uagcaccaggacucaga

SEQ ID NO: 1219034 - RNA, 14 nt, Homo sapiens
uagcaccauugcac

SEQ ID NO: 1219035 - RNA, 17 nt, Homo sapiens
uagcagaggcccugugg

SEQ ID NO: 1219036 - RNA, 14 nt, Homo sapiens
uagcagcagaugua

SEQ ID NO: 1219037 - RNA, 19 nt, Homo sapiens
uagcauagaauagcgacag

SEQ ID NO: 1219038 - RNA, 20 nt, Homo sapiens
uagcauagcuuauuauugaa

SEQ ID NO: 1219039 - RNA, 20 nt, Homo sapiens
uagcauaguaccucugcuau

SEQ ID NO: 1219040 - RNA, 22 nt, Homo sapiens
uagcaucagagguuugcuuccu

SEQ ID NO: 1219041 - RNA, 12 nt, Homo sapiens
uagcaugcugcu

SEQ ID NO: 1219042 - RNA, 15 nt, Homo sapiens
uagcaugcugcuuuu

SEQ ID NO: 1219043 - RNA, 15 nt, Homo sapiens
uagcauuaugcaauu

SEQ ID NO: 1219044 - RNA, 16 nt, Homo sapiens
uagcauuaugcaauua

SEQ ID NO: 1219045 - RNA, 16 nt, Homo sapiens
uagcauugagugcuuu

SEQ ID NO: 1219046 - RNA, 12 nt, Homo sapiens
uagcauugcacu

SEQ ID NO: 1219047 - RNA, 13 nt, Homo sapiens
uagcauugccaau

SEQ ID NO: 1219048 - RNA, 19 nt, Homo sapiens
uagcauuucaaaacccaaa

SEQ ID NO: 1219049 - RNA, 21 nt, Homo sapiens
uagccaacugcuaaugcaaau

SEQ ID NO: 1219050 - RNA, 17 nt, Homo sapiens
uagccagcacuuguaua

SEQ ID NO: 1219051 - RNA, 23 nt, Homo sapiens
uagccaggguggucuugaucucc

SEQ ID NO: 1219052 - RNA, 13 nt, Homo sapiens
uagcccaggagag

SEQ ID NO: 1219053 - RNA, 21 nt, Homo sapiens
uagcccucccccucaaccuca

SEQ ID NO: 1219054 - RNA, 14 nt, Homo sapiens
uagcccugucugcu

SEQ ID NO: 1219055 - RNA, 14 nt, Homo sapiens
uagccucaccaagg

SEQ ID NO: 1219056 - RNA, 18 nt, Homo sapiens
uagccugcauaucauuca

SEQ ID NO: 1219057 - RNA, 19 nt, Homo sapiens
uagccuuguguucugagua

SEQ ID NO: 1219058 - RNA, 19 nt, Homo sapiens
uagcgacugucaacagcgu

SEQ ID NO: 1219059 - RNA, 16 nt, Homo sapiens
uagcgccaguguaauc

SEQ ID NO: 1219060 - RNA, 17 nt, Homo sapiens
uagcgccgugcuguaaa

SEQ ID NO: 1219061 - RNA, 15 nt, Homo sapiens
uagcgccucuuuuau

SEQ ID NO: 1219062 - RNA, 14 nt, Homo sapiens
uagcgggacaaagc

SEQ ID NO: 1219063 - RNA, 13 nt, Homo sapiens
uagcggucaauuu

SEQ ID NO: 1219064 - RNA, 17 nt, Homo sapiens
uagcggucaauuugccu

SEQ ID NO: 1219065 - RNA, 19 nt, Homo sapiens
uagcuaaacggauuccaaa

SEQ ID NO: 1219066 - RNA, 14 nt, Homo sapiens
uagcuaacuacugu

SEQ ID NO: 1219067 - RNA, 18 nt, Homo sapiens
uagcuaccucacuaugcu

SEQ ID NO: 1219068 - RNA, 21 nt, Homo sapiens
uagcuaccucacuaugcugcu

SEQ ID NO: 1219069 - RNA, 22 nt, Homo sapiens
uagcuaccucacuaugcugcuu

SEQ ID NO: 1219070 - RNA, 18 nt, Homo sapiens
uagcuacuguaugcaaag

SEQ ID NO: 1219071 - RNA, 14 nt, Homo sapiens
uagcuauccuaaau

SEQ ID NO: 1219072 - RNA, 14 nt, Homo sapiens
uagcuauggaauca

SEQ ID NO: 1219073 - RNA, 20 nt, Homo sapiens
uagcuauggaaucaauucaa

SEQ ID NO: 1219074 - RNA, 13 nt, Homo sapiens
uagcuaugugacc

SEQ ID NO: 1219075 - RNA, 14 nt, Homo sapiens
uagcuccuguuguc

SEQ ID NO: 1219076 - RNA, 17 nt, Homo sapiens
uagcugggacuacaggu

SEQ ID NO: 1219077 - RNA, 18 nt, Homo sapiens
uagcugggauuacaggug

SEQ ID NO: 1219078 - RNA, 23 nt, Homo sapiens
uagcugugucauguauauaccuu

SEQ ID NO: 1219079 - RNA, 19 nt, Homo sapiens
uagcuuccugccccagaca

SEQ ID NO: 1219080 - RNA, 20 nt, Homo sapiens
uagcuuggagggauggagag

SEQ ID NO: 1219081 - RNA, 23 nt, Homo sapiens
uagcuuuaaaaccugugugccau

SEQ ID NO: 1219082 - RNA, 22 nt, Homo sapiens
uagcuuuagggcaauauugcca

SEQ ID NO: 1219083 - RNA, 23 nt, Homo sapiens
uagcuuuagggcaauauugccau

SEQ ID NO: 1219084 - RNA, 22 nt, Homo sapiens
uagcuuuccacauuugucacag

SEQ ID NO: 1219085 - RNA, 15 nt, Homo sapiens
uagcuuuucauuucu

SEQ ID NO: 1219086 - RNA, 21 nt, Homo sapiens
uaggaaaauauggguugcauu

SEQ ID NO: 1219087 - RNA, 18 nt, Homo sapiens
uaggaaacucacacuccc

SEQ ID NO: 1219088 - RNA, 16 nt, Homo sapiens
uaggaauaaauaaaaa

SEQ ID NO: 1219089 - RNA, 14 nt, Homo sapiens
uaggaauaugacca

SEQ ID NO: 1219090 - RNA, 15 nt, Homo sapiens
uaggacagcauauaa

SEQ ID NO: 1219091 - RNA, 22 nt, Homo sapiens
uaggguuauuaguccaaaugug

SEQ ID NO: 1219092 - RNA, 17 nt, Homo sapiens
uagguauauauaugcca

SEQ ID NO: 1219093 - RNA, 15 nt, Homo sapiens
uaggugacugaaauu

SEQ ID NO: 1219094 - RNA, 18 nt, Homo sapiens
uaggugaggcugggcccu

SEQ ID NO: 1219095 - RNA, 16 nt, Homo sapiens
uagguuaauaaaucaa

SEQ ID NO: 1219096 - RNA, 16 nt, Homo sapiens
uagguuaggaauucaa

SEQ ID NO: 1219097 - RNA, 22 nt, Homo sapiens
uaguaauuuuaaaagucucaca

SEQ ID NO: 1219098 - RNA, 17 nt, Homo sapiens
uaguaccuucaauacuu

SEQ ID NO: 1219099 - RNA, 12 nt, Homo sapiens
uaguacuugaaa

SEQ ID NO: 1219100 - RNA, 23 nt, Homo sapiens
uaguacuugggagaccuguaauc

SEQ ID NO: 1219101 - RNA, 15 nt, Homo sapiens
uaguaugaaugcagu

SEQ ID NO: 1219102 - RNA, 16 nt, Homo sapiens
uaguauuaugauugca

SEQ ID NO: 1219103 - RNA, 20 nt, Homo sapiens
uaguauugguguauguauga

SEQ ID NO: 1219104 - RNA, 19 nt, Homo sapiens
uagucaauaacuaaacuaa

SEQ ID NO: 1219105 - RNA, 22 nt, Homo sapiens
uagucacauggccuaugcacau

SEQ ID NO: 1219106 - RNA, 23 nt, Homo sapiens
uagucacauggccuaugcacaua

SEQ ID NO: 1219107 - RNA, 18 nt, Homo sapiens
uagucagcuacuucugaa

SEQ ID NO: 1219108 - RNA, 20 nt, Homo sapiens
uaguccccagccugcucccu

SEQ ID NO: 1219109 - RNA, 18 nt, Homo sapiens
uaguccuauucuauugca

SEQ ID NO: 1219110 - RNA, 14 nt, Homo sapiens
uagucucaccagcc

SEQ ID NO: 1219111 - RNA, 18 nt, Homo sapiens
uagucuccuuugcacuga

SEQ ID NO: 1219112 - RNA, 22 nt, Homo sapiens
uagucucuggcaagaugcuuua

SEQ ID NO: 1219113 - RNA, 21 nt, Homo sapiens
uagucuuggaaaaaaaccaca

SEQ ID NO: 1219114 - RNA, 16 nt, Homo sapiens
uagugaagcuaauuaa

SEQ ID NO: 1219115 - RNA, 17 nt, Homo sapiens
uagugaccuaaccacuu

SEQ ID NO: 1219116 - RNA, 16 nt, Homo sapiens
uagugacuaugaacuu

SEQ ID NO: 1219117 - RNA, 20 nt, Homo sapiens
uagugccacccaccuuugcc

SEQ ID NO: 1219118 - RNA, 22 nt, Homo sapiens
uagugccacccaccuuugccac

SEQ ID NO: 1219119 - RNA, 22 nt, Homo sapiens
uagugcugaugccuguguacug

SEQ ID NO: 1219120 - RNA, 20 nt, Homo sapiens
uagugggcaccccacugcaa

SEQ ID NO: 1219121 - RNA, 21 nt, Homo sapiens
uagugggcaccccacugcaau

SEQ ID NO: 1219122 - RNA, 20 nt, Homo sapiens
uaguguauaaaaaccaugcu

SEQ ID NO: 1219123 - RNA, 16 nt, Homo sapiens
uaguuaaagaaaggaa

SEQ ID NO: 1219124 - RNA, 14 nt, Homo sapiens
uaguuaaaguaaug

SEQ ID NO: 1219125 - RNA, 15 nt, Homo sapiens
uaguuagccaucuaa

SEQ ID NO: 1219126 - RNA, 13 nt, Homo sapiens
uaguuagcuuucu

SEQ ID NO: 1219127 - RNA, 20 nt, Homo sapiens
uaguucacccccugagaucc

SEQ ID NO: 1219128 - RNA, 17 nt, Homo sapiens
uaguucaguagaauuac

SEQ ID NO: 1219129 - RNA, 15 nt, Homo sapiens
uaguucauccaaucc

SEQ ID NO: 1219130 - RNA, 22 nt, Homo sapiens
uaguuccccaaauacaaaguua

SEQ ID NO: 1219131 - RNA, 15 nt, Homo sapiens
uaguuccuaauggau

SEQ ID NO: 1219132 - RNA, 20 nt, Homo sapiens
uaguucuguggccaucugcu

SEQ ID NO: 1219133 - RNA, 18 nt, Homo sapiens
uaguugauuacuuuucag

SEQ ID NO: 1219134 - RNA, 20 nt, Homo sapiens
uaguugcguggacucugcac

SEQ ID NO: 1219135 - RNA, 19 nt, Homo sapiens
uaguuuaggagaaaccagc

SEQ ID NO: 1219136 - RNA, 13 nt, Homo sapiens
uaguuugcacuau

SEQ ID NO: 1219137 - RNA, 17 nt, Homo sapiens
uaguuuggauuacuuaa

SEQ ID NO: 1219138 - RNA, 22 nt, Homo sapiens
uaguuuguaugccaagugagaa

SEQ ID NO: 1219139 - RNA, 23 nt, Homo sapiens
uaguuuuaaacucauuuuugcca

SEQ ID NO: 1219140 - RNA, 15 nt, Homo sapiens
uaguuuucagccuug

SEQ ID NO: 1219141 - RNA, 20 nt, Homo sapiens
uaguuuugucaaacuguaga

SEQ ID NO: 1219142 - RNA, 22 nt, Homo sapiens
uaguuuuuaccuaccacagugu

SEQ ID NO: 1219143 - RNA, 21 nt, Homo sapiens
uauaaaaaccaugcugguaua

SEQ ID NO: 1219144 - RNA, 14 nt, Homo sapiens
uauaaaaaguggag

SEQ ID NO: 1219145 - RNA, 20 nt, Homo sapiens
uauaaacagacaauauguga

SEQ ID NO: 1219146 - RNA, 16 nt, Homo sapiens
uauaaagaagaacuug

SEQ ID NO: 1219147 - RNA, 16 nt, Homo sapiens
uauaaagaccuauaaa

SEQ ID NO: 1219148 - RNA, 15 nt, Homo sapiens
uauaaagauacuaaa

SEQ ID NO: 1219149 - RNA, 21 nt, Homo sapiens
uauaaagauacuaaaccagca

SEQ ID NO: 1219150 - RNA, 16 nt, Homo sapiens
uauaaauauaagccuu

SEQ ID NO: 1219151 - RNA, 18 nt, Homo sapiens
uauaaauauauacagaua

SEQ ID NO: 1219152 - RNA, 16 nt, Homo sapiens
uauaaaucaaugucac

SEQ ID NO: 1219153 - RNA, 15 nt, Homo sapiens
uauaaaugaauuugc

SEQ ID NO: 1219154 - RNA, 17 nt, Homo sapiens
uauaaauguaccagaga

SEQ ID NO: 1219155 - RNA, 15 nt, Homo sapiens
uauaaauguugcuau

SEQ ID NO: 1219156 - RNA, 19 nt, Homo sapiens
uauaaauguuugucuggau

SEQ ID NO: 1219157 - RNA, 15 nt, Homo sapiens
uauaacaaacuacau

SEQ ID NO: 1219158 - RNA, 19 nt, Homo sapiens
uauaaccauaugauacuau

SEQ ID NO: 1219159 - RNA, 12 nt, Homo sapiens
uauaaccccagc

SEQ ID NO: 1219160 - RNA, 22 nt, Homo sapiens
uauaacccuaggaauuuagaca

SEQ ID NO: 1219161 - RNA, 17 nt, Homo sapiens
uauaacuggauugcaga

SEQ ID NO: 1219162 - RNA, 23 nt, Homo sapiens
uauaacuggauugcagacuguuc

SEQ ID NO: 1219163 - RNA, 18 nt, Homo sapiens
uauaagaaagaucaaaga

SEQ ID NO: 1219164 - RNA, 22 nt, Homo sapiens
uauaagaugaaauuaaccauuu

SEQ ID NO: 1219165 - RNA, 20 nt, Homo sapiens
uauaagcagauuuaacaauu

SEQ ID NO: 1219166 - RNA, 16 nt, Homo sapiens
uauaagcagcaagaca

SEQ ID NO: 1219167 - RNA, 22 nt, Homo sapiens
uauaagcccacuguuaauauuc

SEQ ID NO: 1219168 - RNA, 15 nt, Homo sapiens
uauaagcugccauau

SEQ ID NO: 1219169 - RNA, 12 nt, Homo sapiens
uauaagcuuaaa

SEQ ID NO: 1219170 - RNA, 13 nt, Homo sapiens
uauaagcuuuuag

SEQ ID NO: 1219171 - RNA, 15 nt, Homo sapiens
uauaagucaagcaca

SEQ ID NO: 1219172 - RNA, 15 nt, Homo sapiens
uauaagucacaaaga

SEQ ID NO: 1219173 - RNA, 14 nt, Homo sapiens
uauaauauaccaau

SEQ ID NO: 1219174 - RNA, 19 nt, Homo sapiens
uauaaucaaaaucaaugca

SEQ ID NO: 1219175 - RNA, 16 nt, Homo sapiens
uauaaucuaauuacau

SEQ ID NO: 1219176 - RNA, 22 nt, Homo sapiens
uauaaucuuguagacacuuacu

SEQ ID NO: 1219177 - RNA, 15 nt, Homo sapiens
uauaaugaagcuuua

SEQ ID NO: 1219178 - RNA, 22 nt, Homo sapiens
uauaauuaguuaugacagccau

SEQ ID NO: 1219179 - RNA, 16 nt, Homo sapiens
uauaauuggugcauag

SEQ ID NO: 1219180 - RNA, 23 nt, Homo sapiens
uauaauuucaaaccacacauuag

SEQ ID NO: 1219181 - RNA, 14 nt, Homo sapiens
uauacagauuuucu

SEQ ID NO: 1219182 - RNA, 11 nt, Homo sapiens
uauacaucucu

SEQ ID NO: 1219183 - RNA, 16 nt, Homo sapiens
uauacauguguguaua

SEQ ID NO: 1219184 - RNA, 17 nt, Homo sapiens
uauacauguguguauau

SEQ ID NO: 1219185 - RNA, 10 nt, Homo sapiens
uauacauuug

SEQ ID NO: 1219186 - RNA, 13 nt, Homo sapiens
uauaccaaaaggg

SEQ ID NO: 1219187 - RNA, 12 nt, Homo sapiens
uauaccagcaga

SEQ ID NO: 1219188 - RNA, 17 nt, Homo sapiens
uauaccaucuccagcua

SEQ ID NO: 1219189 - RNA, 20 nt, Homo sapiens
uauacccguuucacaugcuu

SEQ ID NO: 1219190 - RNA, 20 nt, Homo sapiens
uauaccuaccugugugguac

SEQ ID NO: 1219191 - RNA, 19 nt, Homo sapiens
uauacgcuggcaacacaga

SEQ ID NO: 1219192 - RNA, 15 nt, Homo sapiens
uauacuguaggcaca

SEQ ID NO: 1219193 - RNA, 15 nt, Homo sapiens
uacagaacuucagaa

SEQ ID NO: 1219194 - RNA, 14 nt, Homo sapiens
uacagaauguucua

SEQ ID NO: 1219195 - RNA, 19 nt, Homo sapiens
uacagaauguucuauuguc

SEQ ID NO: 1219196 - RNA, 21 nt, Homo sapiens
uacagaauguucuauugucau

SEQ ID NO: 1219197 - RNA, 23 nt, Homo sapiens
uacagacaaccuaucauuuauuc

SEQ ID NO: 1219198 - RNA, 23 nt, Homo sapiens
uacagacauacauuuaugcacau

SEQ ID NO: 1219199 - RNA, 15 nt, Homo sapiens
uacagacaucuaaug

SEQ ID NO: 1219200 - RNA, 13 nt, Homo sapiens
uacagacaugaac

SEQ ID NO: 1219201 - RNA, 13 nt, Homo sapiens
uacagacugggga

SEQ ID NO: 1219202 - RNA, 19 nt, Homo sapiens
uacagagcacauuugucag

SEQ ID NO: 1219203 - RNA, 18 nt, Homo sapiens
uacagagccgagcaauau

SEQ ID NO: 1219204 - RNA, 21 nt, Homo sapiens
uacagauacauaucuguguau

SEQ ID NO: 1219205 - RNA, 10 nt, Homo sapiens
uacagcagca

SEQ ID NO: 1219206 - RNA, 19 nt, Homo sapiens
uacagcaugacguaguauu

SEQ ID NO: 1219207 - RNA, 23 nt, Homo sapiens
uacagcaugugccuuaaugcuuc

SEQ ID NO: 1219208 - RNA, 15 nt, Homo sapiens
uacagcuuucacagu

SEQ ID NO: 1219209 - RNA, 20 nt, Homo sapiens
uacagcuuucugugcagaga

SEQ ID NO: 1219210 - RNA, 17 nt, Homo sapiens
uacaggaagaaagagcu

SEQ ID NO: 1219211 - RNA, 21 nt, Homo sapiens
uacaggaagcaccccaugcca

SEQ ID NO: 1219212 - RNA, 23 nt, Homo sapiens
uacaggaagcaccccaugccaaa

SEQ ID NO: 1219213 - RNA, 23 nt, Homo sapiens
uacaggacaaagggagggagcaa

SEQ ID NO: 1219214 - RNA, 13 nt, Homo sapiens
uacaggacuguaa

SEQ ID NO: 1219215 - RNA, 22 nt, Homo sapiens
uacaggaggggucucauguccu

SEQ ID NO: 1219216 - RNA, 22 nt, Homo sapiens
uacaggcgugcgccacuaugcc

SEQ ID NO: 1219217 - RNA, 14 nt, Homo sapiens
uacagggcuaggca

SEQ ID NO: 1219218 - RNA, 14 nt, Homo sapiens
uacaggugcgaaug

SEQ ID NO: 1219219 - RNA, 17 nt, Homo sapiens
uacaguauucuguacca

SEQ ID NO: 1219220 - RNA, 16 nt, Homo sapiens
uaugagaaaccuauau

SEQ ID NO: 1219221 - RNA, 17 nt, Homo sapiens
uaugagcagaaggaaac

SEQ ID NO: 1219222 - RNA, 18 nt, Homo sapiens
uaugagggaaaaugagua

SEQ ID NO: 1219223 - RNA, 17 nt, Homo sapiens
uaugagucaaugugcag

SEQ ID NO: 1219224 - RNA, 19 nt, Homo sapiens
uaugaucuuucuuuuccca

SEQ ID NO: 1219225 - RNA, 12 nt, Homo sapiens
uaugaugcacuu

SEQ ID NO: 1219226 - RNA, 13 nt, Homo sapiens
uaugaugcacuua

SEQ ID NO: 1219227 - RNA, 14 nt, Homo sapiens
uaugauuauacaaa

SEQ ID NO: 1219228 - RNA, 15 nt, Homo sapiens
uaugauuuaagacua

SEQ ID NO: 1219229 - RNA, 19 nt, Homo sapiens
uaugauuuaagacuaugau

SEQ ID NO: 1219230 - RNA, 15 nt, Homo sapiens
uaugcaagucuguga

SEQ ID NO: 1219231 - RNA, 15 nt, Homo sapiens
uaugcaaguguuccu

SEQ ID NO: 1219232 - RNA, 15 nt, Homo sapiens
uaugcaaguuagggu

SEQ ID NO: 1219233 - RNA, 13 nt, Homo sapiens
uaugcaaucugag

SEQ ID NO: 1219234 - RNA, 16 nt, Homo sapiens
uaugcagacaaccuca

SEQ ID NO: 1219235 - RNA, 15 nt, Homo sapiens
uaugcauaccuggau

SEQ ID NO: 1219236 - RNA, 12 nt, Homo sapiens
uaugcauaucag

SEQ ID NO: 1219237 - RNA, 23 nt, Homo sapiens
uaugcauuaagaguaaaauuccu

SEQ ID NO: 1219238 - RNA, 15 nt, Homo sapiens
uaugcauuugcauuu

SEQ ID NO: 1219239 - RNA, 23 nt, Homo sapiens
uaugccacaccuggccuuaaaga

SEQ ID NO: 1219240 - RNA, 20 nt, Homo sapiens
uaugccaccaacacugcuca

SEQ ID NO: 1219241 - RNA, 18 nt, Homo sapiens
uaugcccagguaccaccc

SEQ ID NO: 1219242 - RNA, 23 nt, Homo sapiens
uaugccugaaugacuccacuguu

SEQ ID NO: 1219243 - RNA, 17 nt, Homo sapiens
uccaguaguuagcuuuc

SEQ ID NO: 1219244 - RNA, 19 nt, Homo sapiens
uccaguauucuugucaaaa

SEQ ID NO: 1219245 - RNA, 14 nt, Homo sapiens
uccaguauugaaaa

SEQ ID NO: 1219246 - RNA, 13 nt, Homo sapiens
uccagucucaaaa

SEQ ID NO: 1219247 - RNA, 22 nt, Homo sapiens
uccagucuuccugacacuuuaa

SEQ ID NO: 1219248 - RNA, 23 nt, Homo sapiens
uccagugaugugugagcuaugca

SEQ ID NO: 1219249 - RNA, 20 nt, Homo sapiens
uccagugccagcaaugacau

SEQ ID NO: 1219250 - RNA, 19 nt, Homo sapiens
uccagugguucugcuucaa

SEQ ID NO: 1219251 - RNA, 21 nt, Homo sapiens
uccaguguacauaguguaaug

SEQ ID NO: 1219252 - RNA, 17 nt, Homo sapiens
uccaguguuugggauga

SEQ ID NO: 1219253 - RNA, 15 nt, Homo sapiens
uccaguucaugagaa

SEQ ID NO: 1219254 - RNA, 16 nt, Homo sapiens
uccaguuugcaccugu

SEQ ID NO: 1219255 - RNA, 16 nt, Homo sapiens
uccauaaauguguucc

SEQ ID NO: 1219256 - RNA, 23 nt, Homo sapiens
uccauaucccuuccucucaggcu

SEQ ID NO: 1219257 - RNA, 13 nt, Homo sapiens
uccauauguuaua

SEQ ID NO: 1219258 - RNA, 17 nt, Homo sapiens
uccauauuuuacugauc

SEQ ID NO: 1219259 - RNA, 19 nt, Homo sapiens
uccaucagagccagucuca

SEQ ID NO: 1219260 - RNA, 21 nt, Homo sapiens
uccaucagccaggacagucag

SEQ ID NO: 1219261 - RNA, 14 nt, Homo sapiens
uccaucauaugccu

SEQ ID NO: 1219262 - RNA, 14 nt, Homo sapiens
uccauccaguuccu

SEQ ID NO: 1219263 - RNA, 22 nt, Homo sapiens
ucuuggugccuuuugugugaug

SEQ ID NO: 1219264 - RNA, 23 nt, Homo sapiens
ucuuggugccuuuugugugaugc

SEQ ID NO: 1219265 - RNA, 20 nt, Homo sapiens
ucuuguauaagauccuagau

SEQ ID NO: 1219266 - RNA, 13 nt, Homo sapiens
ucuugucuuuauu

SEQ ID NO: 1219267 - RNA, 17 nt, Homo sapiens
ucuuguuuuauauaccu

SEQ ID NO: 1219268 - RNA, 20 nt, Homo sapiens
ucuuuaaaggcaucuacaca

SEQ ID NO: 1219269 - RNA, 14 nt, Homo sapiens
ucuuuaagaugugu

SEQ ID NO: 1219270 - RNA, 23 nt, Homo sapiens
ucuuuaguauaauugaccuacuu

SEQ ID NO: 1219271 - RNA, 15 nt, Homo sapiens
ucuuuauacagauuu

SEQ ID NO: 1219272 - RNA, 13 nt, Homo sapiens
ucuuuauacagcu

SEQ ID NO: 1219273 - RNA, 12 nt, Homo sapiens
ucuuuauacugg

SEQ ID NO: 1219274 - RNA, 16 nt, Homo sapiens
ucuuuaucauugcuaa

SEQ ID NO: 1219275 - RNA, 14 nt, Homo sapiens
ucuuuaugacuguu

SEQ ID NO: 1219276 - RNA, 18 nt, Homo sapiens
ucuuuauguccauaagcu

SEQ ID NO: 1219277 - RNA, 20 nt, Homo sapiens
ucuuucacauuguuugcugc

SEQ ID NO: 1219278 - RNA, 20 nt, Homo sapiens
ucuuucaggacucuaccuca

SEQ ID NO: 1219279 - RNA, 20 nt, Homo sapiens
ucuuucaugggcaccaaccu

SEQ ID NO: 1219280 - RNA, 23 nt, Homo sapiens
ucuuuccaaaaggaacucuagaa

SEQ ID NO: 1219281 - RNA, 22 nt, Homo sapiens
ucuuuccaagaccaaccuacaa

SEQ ID NO: 1219282 - RNA, 13 nt, Homo sapiens
ucuuuccuacaca

SEQ ID NO: 1219283 - RNA, 14 nt, Homo sapiens
ucuuuccuggcacu

SEQ ID NO: 1219284 - RNA, 18 nt, Homo sapiens
ucuuucuaaugugugaau

SEQ ID NO: 1219285 - RNA, 22 nt, Homo sapiens
ucuuucucugccagugacagac

SEQ ID NO: 1219286 - RNA, 14 nt, Homo sapiens
ucuuucuguacaag

SEQ ID NO: 1219287 - RNA, 22 nt, Homo sapiens
ucuuucuuugcaccaaagacau

SEQ ID NO: 1219288 - RNA, 14 nt, Homo sapiens
ucuuugacaacuaa

SEQ ID NO: 1219289 - RNA, 23 nt, Homo sapiens
ucuuugacugaaaaaaaaaaaga

SEQ ID NO: 1219290 - RNA, 19 nt, Homo sapiens
ugaagggccacugggaccc

SEQ ID NO: 1219291 - RNA, 20 nt, Homo sapiens
ugaagggccacugggacccu

SEQ ID NO: 1219292 - RNA, 20 nt, Homo sapiens
ugaaguaaaggauugaucac

SEQ ID NO: 1219293 - RNA, 13 nt, Homo sapiens
ugaaguaagcaac

SEQ ID NO: 1219294 - RNA, 23 nt, Homo sapiens
ugaaguaaugaauuuuuaugaua

SEQ ID NO: 1219295 - RNA, 13 nt, Homo sapiens
ugaaguagaaucc

SEQ ID NO: 1219296 - RNA, 16 nt, Homo sapiens
ugaaguagaauccuaa

SEQ ID NO: 1219297 - RNA, 15 nt, Homo sapiens
ugaaguauuucucac

SEQ ID NO: 1219298 - RNA, 15 nt, Homo sapiens
ugaagucacacagug

SEQ ID NO: 1219299 - RNA, 23 nt, Homo sapiens
ugaagugaccuggaaucagugaa

SEQ ID NO: 1219300 - RNA, 11 nt, Homo sapiens
ugaagugcaau

SEQ ID NO: 1219301 - RNA, 16 nt, Homo sapiens
ugaagugguugcauuc

SEQ ID NO: 1219302 - RNA, 17 nt, Homo sapiens
ugaagugucacagccug

SEQ ID NO: 1219303 - RNA, 22 nt, Homo sapiens
ugaagugugcacguugcuucag

SEQ ID NO: 1219304 - RNA, 15 nt, Homo sapiens
ugaaguuuacaauca

SEQ ID NO: 1219305 - RNA, 17 nt, Homo sapiens
ugaaguuuacauuguaa

SEQ ID NO: 1219306 - RNA, 16 nt, Homo sapiens
ugaaguuugaacuuca

SEQ ID NO: 1219307 - RNA, 22 nt, Homo sapiens
ugaauaaaaaauagacauguag

SEQ ID NO: 1219308 - RNA, 15 nt, Homo sapiens
ugaauaaaguguaag

SEQ ID NO: 1219309 - RNA, 21 nt, Homo sapiens
ugaauaaaguguaaguucaca

SEQ ID NO: 1219310 - RNA, 22 nt, Homo sapiens
ugaauaaauccaaaacaaacau

SEQ ID NO: 1219311 - RNA, 16 nt, Homo sapiens
ugaauaaccacuuaaa

SEQ ID NO: 1219312 - RNA, 18 nt, Homo sapiens
ugaauaagcuuucucuca

SEQ ID NO: 1219313 - RNA, 19 nt, Homo sapiens
ugaauacagcauuuagcuu

SEQ ID NO: 1219314 - RNA, 15 nt, Homo sapiens
ugaauagaaauggga

SEQ ID NO: 1219315 - RNA, 23 nt, Homo sapiens
ugaauauaaauguuuuacucaga

SEQ ID NO: 1219316 - RNA, 23 nt, Homo sapiens
ugaauauagccugccucaguggc

SEQ ID NO: 1219317 - RNA, 11 nt, Homo sapiens
ugaauaucauu

SEQ ID NO: 1219318 - RNA, 15 nt, Homo sapiens
ugaauauuacucuca

SEQ ID NO: 1219319 - RNA, 19 nt, Homo sapiens
ugaauauuagcauugccaa

SEQ ID NO: 1219320 - RNA, 20 nt, Homo sapiens
ugaauauuuauauuucacua

SEQ ID NO: 1219321 - RNA, 14 nt, Homo sapiens
ugaauccccuaucc

SEQ ID NO: 1219322 - RNA, 17 nt, Homo sapiens
ugaauccucaugaggcu

SEQ ID NO: 1219323 - RNA, 14 nt, Homo sapiens
ugaaugcaaaguag

SEQ ID NO: 1219324 - RNA, 19 nt, Homo sapiens
ugaaugccggggacagaga

SEQ ID NO: 1219325 - RNA, 20 nt, Homo sapiens
ugaaugccuaaauauaauua

SEQ ID NO: 1219326 - RNA, 12 nt, Homo sapiens
ugaaugcuucuc

SEQ ID NO: 1219327 - RNA, 17 nt, Homo sapiens
ugaauggaaaacacaug

SEQ ID NO: 1219328 - RNA, 13 nt, Homo sapiens
ugaauggaagcaa

SEQ ID NO: 1219329 - RNA, 21 nt, Homo sapiens
ugaauggaggcagagaccucc

SEQ ID NO: 1219330 - RNA, 15 nt, Homo sapiens
ugaauguaugugcac

SEQ ID NO: 1219331 - RNA, 13 nt, Homo sapiens
ugaauguggacuc

SEQ ID NO: 1219332 - RNA, 17 nt, Homo sapiens
ugaaugugguuacuucc

SEQ ID NO: 1219333 - RNA, 14 nt, Homo sapiens
ugaaugugucaggu

SEQ ID NO: 1219334 - RNA, 14 nt, Homo sapiens
ugaauuacagugaa

SEQ ID NO: 1219335 - RNA, 19 nt, Homo sapiens
ugaauuagagaauuuucug

SEQ ID NO: 1219336 - RNA, 12 nt, Homo sapiens
ugaauucuggga

SEQ ID NO: 1219337 - RNA, 18 nt, Homo sapiens
ugaauugcaugacuugua

SEQ ID NO: 1219338 - RNA, 15 nt, Homo sapiens
ugaauuggaaaggaa

SEQ ID NO: 1219339 - RNA, 17 nt, Homo sapiens
ugaauuguuaauucaca

SEQ ID NO: 1219340 - RNA, 22 nt, Homo sapiens
ugaauuguuaauucacagaaua

SEQ ID NO: 1219341 - RNA, 15 nt, Homo sapiens
ugaauuucacaagcu

SEQ ID NO: 1219342 - RNA, 18 nt, Homo sapiens
ugaauuucacaagcuauu

SEQ ID NO: 1219343 - RNA, 13 nt, Homo sapiens
ugaauuucacugu

SEQ ID NO: 1219344 - RNA, 14 nt, Homo sapiens
ugaauuucaguaaa

SEQ ID NO: 1219345 - RNA, 16 nt, Homo sapiens
ugaauuucccacauac

SEQ ID NO: 1219346 - RNA, 21 nt, Homo sapiens
ugaauuuucaaguaauuguga

SEQ ID NO: 1219347 - RNA, 22 nt, Homo sapiens
ugaauuuugggacuucuaccca

SEQ ID NO: 1219348 - RNA, 16 nt, Homo sapiens
ugaauuuuuaugauau

SEQ ID NO: 1219349 - RNA, 13 nt, Homo sapiens
ugacaaacauauc

SEQ ID NO: 1219350 - RNA, 15 nt, Homo sapiens
ugacaaaggaugaag

SEQ ID NO: 1219351 - RNA, 14 nt, Homo sapiens
ugacaaauauuuca

SEQ ID NO: 1219352 - RNA, 22 nt, Homo sapiens
ugacaaauauuuuagaagcuaa

SEQ ID NO: 1219353 - RNA, 18 nt, Homo sapiens
ugacaacuguggacucca

SEQ ID NO: 1219354 - RNA, 15 nt, Homo sapiens
ugacaacuuugccag

SEQ ID NO: 1219355 - RNA, 23 nt, Homo sapiens
ugacaagcugacuuggcacuuaa

SEQ ID NO: 1219356 - RNA, 16 nt, Homo sapiens
ugacaagggcugaccu

SEQ ID NO: 1219357 - RNA, 16 nt, Homo sapiens
ugacaaucaacucuaa

SEQ ID NO: 1219358 - RNA, 17 nt, Homo sapiens
ugacaaugacugugcua

SEQ ID NO: 1219359 - RNA, 22 nt, Homo sapiens
ugacaaugggcacugauuugau

SEQ ID NO: 1219360 - RNA, 14 nt, Homo sapiens
ugacaauugcaaau

SEQ ID NO: 1219361 - RNA, 20 nt, Homo sapiens
ugacaauugcaaaucagagc

SEQ ID NO: 1219362 - RNA, 23 nt, Homo sapiens
ugacacaaagguggaauaaacau

SEQ ID NO: 1219363 - RNA, 14 nt, Homo sapiens
ugacacaaugaagu

SEQ ID NO: 1219364 - RNA, 21 nt, Homo sapiens
ugacacauagaaaacaaucaa

SEQ ID NO: 1219365 - RNA, 16 nt, Homo sapiens
ugacacauaugcaccu

SEQ ID NO: 1219366 - RNA, 15 nt, Homo sapiens
ugacacauuacaaag

SEQ ID NO: 1219367 - RNA, 20 nt, Homo sapiens
ugacaccgugggucauuaca

SEQ ID NO: 1219368 - RNA, 15 nt, Homo sapiens
ugacaccugcugaga

SEQ ID NO: 1219369 - RNA, 20 nt, Homo sapiens
ugacacucugcagacugcua

SEQ ID NO: 1219370 - RNA, 10 nt, Homo sapiens
ugacacugaa

SEQ ID NO: 1219371 - RNA, 18 nt, Homo sapiens
ugacacuuuaauuaccaa

SEQ ID NO: 1219372 - RNA, 17 nt, Homo sapiens
ugacacuuugccagaaa

SEQ ID NO: 1219373 - RNA, 18 nt, Homo sapiens
ugacagaguucacuauaa

SEQ ID NO: 1219374 - RNA, 20 nt, Homo sapiens
ugacagauggugaaguaaca

SEQ ID NO: 1219375 - RNA, 19 nt, Homo sapiens
ugacagccauuuguaauga

SEQ ID NO: 1219376 - RNA, 20 nt, Homo sapiens
ugacagcuucaugaaacugu

SEQ ID NO: 1219377 - RNA, 13 nt, Homo sapiens
ugacagcuuuauc

SEQ ID NO: 1219378 - RNA, 16 nt, Homo sapiens
ugacagggaaaacugc

SEQ ID NO: 1219379 - RNA, 15 nt, Homo sapiens
ugacauaagugcuau

SEQ ID NO: 1219380 - RNA, 16 nt, Homo sapiens
ugacauaauaauagca

SEQ ID NO: 1219381 - RNA, 13 nt, Homo sapiens
ugacauacauauu

SEQ ID NO: 1219382 - RNA, 19 nt, Homo sapiens
ugacauacauauuaucuca

SEQ ID NO: 1219383 - RNA, 19 nt, Homo sapiens
ugacaucaaacuugugagg

SEQ ID NO: 1219384 - RNA, 18 nt, Homo sapiens
ugacaucucaguucacug

SEQ ID NO: 1219385 - RNA, 15 nt, Homo sapiens
ugacaugcacugacc

SEQ ID NO: 1219386 - RNA, 17 nt, Homo sapiens
ugacauugcguuugacc

SEQ ID NO: 1219387 - RNA, 17 nt, Homo sapiens
ugaccaaacagccaaga

SEQ ID NO: 1219388 - RNA, 18 nt, Homo sapiens
ugaccaaaggugugcccu

SEQ ID NO: 1219389 - RNA, 22 nt, Homo sapiens
ugaccaauauuauacuaagaaa

SEQ ID NO: 1219390 - RNA, 16 nt, Homo sapiens
ugaccaaugggaugag

SEQ ID NO: 1219391 - RNA, 21 nt, Homo sapiens
ugaccacugaagcaccacagg

SEQ ID NO: 1219392 - RNA, 19 nt, Homo sapiens
ugaccagaaaucaaaaagg

SEQ ID NO: 1219393 - RNA, 22 nt, Homo sapiens
ugaccaggcauccuccacaaua

SEQ ID NO: 1219394 - RNA, 17 nt, Homo sapiens
ugaccaucugcuuuuau

SEQ ID NO: 1219395 - RNA, 16 nt, Homo sapiens
ugaccauuucaggggu

SEQ ID NO: 1219396 - RNA, 15 nt, Homo sapiens
ugacccacccagugu

SEQ ID NO: 1219397 - RNA, 18 nt, Homo sapiens
ugacccaccccugugcuc

SEQ ID NO: 1219398 - RNA, 17 nt, Homo sapiens
ugacccagcaucuccca

SEQ ID NO: 1219399 - RNA, 14 nt, Homo sapiens
ugaccccuccucac

SEQ ID NO: 1219400 - RNA, 20 nt, Homo sapiens
ugacccucugacccuagcuc

SEQ ID NO: 1219401 - RNA, 18 nt, Homo sapiens
ugacccugauacaggcau

SEQ ID NO: 1219402 - RNA, 23 nt, Homo sapiens
ugacccuugugucucauauaccc

SEQ ID NO: 1219403 - RNA, 14 nt, Homo sapiens
ugaccuaaccacuu

SEQ ID NO: 1219404 - RNA, 15 nt, Homo sapiens
ugaccucacagugac

SEQ ID NO: 1219405 - RNA, 16 nt, Homo sapiens
ugaccucacugugacc

SEQ ID NO: 1219406 - RNA, 20 nt, Homo sapiens
ugaccucaggugaucugccc

SEQ ID NO: 1219407 - RNA, 20 nt, Homo sapiens
ugaccucagugagauauuug

SEQ ID NO: 1219408 - RNA, 21 nt, Homo sapiens
ugaccucuauaaacuucagag

SEQ ID NO: 1219409 - RNA, 18 nt, Homo sapiens
ugaccuggagaugcugcc

SEQ ID NO: 1219410 - RNA, 14 nt, Homo sapiens
ugaccuugcugaug

SEQ ID NO: 1219411 - RNA, 22 nt, Homo sapiens
ugaccuugcugauggugacauu

SEQ ID NO: 1219412 - RNA, 19 nt, Homo sapiens
ugaccuuggcugacugggg

SEQ ID NO: 1219413 - RNA, 14 nt, Homo sapiens
ugaccuuugucuca

SEQ ID NO: 1219414 - RNA, 15 nt, Homo sapiens
ugacgacagugcauu

SEQ ID NO: 1219415 - RNA, 16 nt, Homo sapiens
ugacgacagugcauuu

SEQ ID NO: 1219416 - RNA, 14 nt, Homo sapiens
ugaguccccuccag

SEQ ID NO: 1219417 - RNA, 20 nt, Homo sapiens
ugagucugaguccugucucu

SEQ ID NO: 1219418 - RNA, 15 nt, Homo sapiens
ugagucugcaugugc

SEQ ID NO: 1219419 - RNA, 20 nt, Homo sapiens
ugagucuuugguucuaagga

SEQ ID NO: 1219420 - RNA, 22 nt, Homo sapiens
ugagugaaaauuuuuacauuca

SEQ ID NO: 1219421 - RNA, 14 nt, Homo sapiens
ugagugacuagacg

SEQ ID NO: 1219422 - RNA, 22 nt, Homo sapiens
ugaguggaguugaggugucaga

SEQ ID NO: 1219423 - RNA, 20 nt, Homo sapiens
ugaguggccagccagugcca

SEQ ID NO: 1219424 - RNA, 15 nt, Homo sapiens
ugaguggccugcuaa

SEQ ID NO: 1219425 - RNA, 17 nt, Homo sapiens
ugagugucuuagcauau

SEQ ID NO: 1219426 - RNA, 22 nt, Homo sapiens
ugaguuacuuccuaucaagcca

SEQ ID NO: 1219427 - RNA, 12 nt, Homo sapiens
ugaguuacuuga

SEQ ID NO: 1219428 - RNA, 21 nt, Homo sapiens
ugaguuauaguuugcuuugcu

SEQ ID NO: 1219429 - RNA, 14 nt, Homo sapiens
ugaguucuacauaa

SEQ ID NO: 1219430 - RNA, 22 nt, Homo sapiens
ugaguucuggaagggacuuuag

SEQ ID NO: 1219431 - RNA, 18 nt, Homo sapiens
ugaguucuggucaaagaa

SEQ ID NO: 1219432 - RNA, 15 nt, Homo sapiens
ugaguugccaagaca

SEQ ID NO: 1219433 - RNA, 21 nt, Homo sapiens
ugaguugccaagacaaaucaa

SEQ ID NO: 1219434 - RNA, 19 nt, Homo sapiens
ugaguugcccaucuuguuu

SEQ ID NO: 1219435 - RNA, 19 nt, Homo sapiens
ugaguuucuggcucuugag

SEQ ID NO: 1219436 - RNA, 21 nt, Homo sapiens
ugaguuuuugauagcuuuauu

SEQ ID NO: 1219437 - RNA, 15 nt, Homo sapiens
ugauaaaacacugcc

SEQ ID NO: 1219438 - RNA, 13 nt, Homo sapiens
ugauaagccuuuc

SEQ ID NO: 1219439 - RNA, 15 nt, Homo sapiens
ugauaauagauucuc

SEQ ID NO: 1219440 - RNA, 16 nt, Homo sapiens
ugauaauagauucucu

SEQ ID NO: 1219441 - RNA, 18 nt, Homo sapiens
ugauaaucuucaggugaa

SEQ ID NO: 1219442 - RNA, 21 nt, Homo sapiens
ugauacacagaauauaaucuu

SEQ ID NO: 1219443 - RNA, 14 nt, Homo sapiens
ugauacacuaugaa

SEQ ID NO: 1219444 - RNA, 21 nt, Homo sapiens
ugauacauaacuaaauuugau

SEQ ID NO: 1219445 - RNA, 19 nt, Homo sapiens
ugauacauuuuuguacuaa

SEQ ID NO: 1219446 - RNA, 17 nt, Homo sapiens
ugauaccauggcacuga

SEQ ID NO: 1219447 - RNA, 12 nt, Homo sapiens
ugauacugcuga

SEQ ID NO: 1219448 - RNA, 22 nt, Homo sapiens
ugauacugcugagucagacugu

SEQ ID NO: 1219449 - RNA, 17 nt, Homo sapiens
ugauacuggagucuuau

SEQ ID NO: 1219450 - RNA, 19 nt, Homo sapiens
ugauacuuguuccagaugg

SEQ ID NO: 1219451 - RNA, 18 nt, Homo sapiens
ugauacuuugacaguguu

SEQ ID NO: 1219452 - RNA, 20 nt, Homo sapiens
ugauagaaccauugcaauau

SEQ ID NO: 1219453 - RNA, 16 nt, Homo sapiens
ugauagaguguuauca

SEQ ID NO: 1219454 - RNA, 15 nt, Homo sapiens
ugauagggaacuggg

SEQ ID NO: 1219455 - RNA, 14 nt, Homo sapiens
ugauauauauaugc

SEQ ID NO: 1219456 - RNA, 17 nt, Homo sapiens
ugauauaucaaacugaa

SEQ ID NO: 1219457 - RNA, 15 nt, Homo sapiens
ugauaucugaucaaa

SEQ ID NO: 1219458 - RNA, 17 nt, Homo sapiens
ugauaucugcagggaca

SEQ ID NO: 1219459 - RNA, 18 nt, Homo sapiens
ugauaucuggccuaaaau

SEQ ID NO: 1219460 - RNA, 19 nt, Homo sapiens
ugauauggcagaagacacc

SEQ ID NO: 1219461 - RNA, 14 nt, Homo sapiens
ugauaugggacuga

SEQ ID NO: 1219462 - RNA, 19 nt, Homo sapiens
ugauauguaaguacuucca

SEQ ID NO: 1219463 - RNA, 15 nt, Homo sapiens
ugauauucaaccuca

SEQ ID NO: 1219464 - RNA, 20 nt, Homo sapiens
ugauauuuauuuuuugccau

SEQ ID NO: 1219465 - RNA, 17 nt, Homo sapiens
ugauauuuuuacuugca

SEQ ID NO: 1219466 - RNA, 17 nt, Homo sapiens
ugaucaauuauaguuuc

SEQ ID NO: 1219467 - RNA, 16 nt, Homo sapiens
ugaucacccaaugcau

SEQ ID NO: 1219468 - RNA, 18 nt, Homo sapiens
ugaucacuccagugcacu

SEQ ID NO: 1219469 - RNA, 17 nt, Homo sapiens
ugaucagugggccucca

SEQ ID NO: 1219470 - RNA, 13 nt, Homo sapiens
ugaucauuugccc

SEQ ID NO: 1219471 - RNA, 21 nt, Homo sapiens
ugauccagagcagaguuuacg

SEQ ID NO: 1219472 - RNA, 21 nt, Homo sapiens
ugauccaugaguuugcccugg

SEQ ID NO: 1219473 - RNA, 12 nt, Homo sapiens
ugaucccagaaa

SEQ ID NO: 1219474 - RNA, 21 nt, Homo sapiens
ugaucccccauagguggcuga

SEQ ID NO: 1219475 - RNA, 17 nt, Homo sapiens
ugaucuaccugccucag

SEQ ID NO: 1219476 - RNA, 19 nt, Homo sapiens
ugaucuacuucauagcucc

SEQ ID NO: 1219477 - RNA, 12 nt, Homo sapiens
ugaucugugaua

SEQ ID NO: 1219478 - RNA, 17 nt, Homo sapiens
ugaugaaagcugauuac

SEQ ID NO: 1219479 - RNA, 23 nt, Homo sapiens
ugaugaaauaaaacuacaugguc

SEQ ID NO: 1219480 - RNA, 22 nt, Homo sapiens
ugaugacacccacccugugcca

SEQ ID NO: 1219481 - RNA, 18 nt, Homo sapiens
ugaugacugcuuaacucc

SEQ ID NO: 1219482 - RNA, 16 nt, Homo sapiens
ugaugagaauuucuaa

SEQ ID NO: 1219483 - RNA, 23 nt, Homo sapiens
ugaugagagaauggagacagagu

SEQ ID NO: 1219484 - RNA, 17 nt, Homo sapiens
ugaugauuaauucaccu

SEQ ID NO: 1219485 - RNA, 16 nt, Homo sapiens
ugaugcaagccagcuu

SEQ ID NO: 1219486 - RNA, 13 nt, Homo sapiens
ugaugcaauagug

SEQ ID NO: 1219487 - RNA, 21 nt, Homo sapiens
ugaugcccugcugaccaugca

SEQ ID NO: 1219488 - RNA, 23 nt, Homo sapiens
ugaugcucccuccccugcccugg

SEQ ID NO: 1219489 - RNA, 13 nt, Homo sapiens
ugauggaaauauu

SEQ ID NO: 1219490 - RNA, 15 nt, Homo sapiens
ugauggccaccagcu

SEQ ID NO: 1219491 - RNA, 14 nt, Homo sapiens
ugauggcugaagaa

SEQ ID NO: 1219492 - RNA, 22 nt, Homo sapiens
ugaugggccagcaggagccagc

SEQ ID NO: 1219493 - RNA, 16 nt, Homo sapiens
ugaugguaagacugua

SEQ ID NO: 1219494 - RNA, 11 nt, Homo sapiens
ugauguugcug

SEQ ID NO: 1219495 - RNA, 17 nt, Homo sapiens
ugauuaaacagacuuua

SEQ ID NO: 1219496 - RNA, 13 nt, Homo sapiens
ugauuaacuuauu

SEQ ID NO: 1219497 - RNA, 17 nt, Homo sapiens
ugauuacaaggcuuuau

SEQ ID NO: 1219498 - RNA, 14 nt, Homo sapiens
ugauuaugccacug

SEQ ID NO: 1219499 - RNA, 23 nt, Homo sapiens
ugauucaaaagaugccauucaua

SEQ ID NO: 1219500 - RNA, 13 nt, Homo sapiens
ugauucaaauggg

SEQ ID NO: 1219501 - RNA, 16 nt, Homo sapiens
ugauucaaauugcugc

SEQ ID NO: 1219502 - RNA, 21 nt, Homo sapiens
ugauucagccaaaugcaggga

SEQ ID NO: 1219503 - RNA, 19 nt, Homo sapiens
ugauucauaguaacuucuu

SEQ ID NO: 1219504 - RNA, 20 nt, Homo sapiens
ugauucccagccuguggcag

SEQ ID NO: 1219505 - RNA, 20 nt, Homo sapiens
ugauuccuuuaugaugacug

SEQ ID NO: 1219506 - RNA, 24 nt, Homo sapiens
ugauuccuuuccuaaaaguguaag

SEQ ID NO: 1219507 - RNA, 16 nt, Homo sapiens
ugauucgcccaccuca

SEQ ID NO: 1219508 - RNA, 22 nt, Homo sapiens
ugauucgcccaccucagccucc

SEQ ID NO: 1219509 - RNA, 18 nt, Homo sapiens
ugauucuaauggggacac

SEQ ID NO: 1219510 - RNA, 22 nt, Homo sapiens
ugauucuccugccucagccucc

SEQ ID NO: 1219511 - RNA, 15 nt, Homo sapiens
ugauugaaccagcuc

SEQ ID NO: 1219512 - RNA, 20 nt, Homo sapiens
ugauugaggagcugcacuga

SEQ ID NO: 1219513 - RNA, 17 nt, Homo sapiens
ugauuggaccaggccau

SEQ ID NO: 1219514 - RNA, 21 nt, Homo sapiens
ugauugggaaaacauuugcug

SEQ ID NO: 1219515 - RNA, 16 nt, Homo sapiens
ugauuuaagacuauga

SEQ ID NO: 1219516 - RNA, 18 nt, Homo sapiens
ugauuuaccuauacauua

SEQ ID NO: 1219517 - RNA, 13 nt, Homo sapiens
ugauuucaagacc

SEQ ID NO: 1219518 - RNA, 15 nt, Homo sapiens
ugauuucagacugca

SEQ ID NO: 1219519 - RNA, 18 nt, Homo sapiens
ugauuucuacaacuggag

SEQ ID NO: 1219520 - RNA, 17 nt, Homo sapiens
ugauuucuguacaguca

SEQ ID NO: 1219521 - RNA, 12 nt, Homo sapiens
ugauuucuugcu

SEQ ID NO: 1219522 - RNA, 15 nt, Homo sapiens
ugauuugauaccaug

SEQ ID NO: 1219523 - RNA, 18 nt, Homo sapiens
ugauuuguagcacugagg

SEQ ID NO: 1219524 - RNA, 13 nt, Homo sapiens
ugauuuguauuaa

SEQ ID NO: 1219525 - RNA, 20 nt, Homo sapiens
ugauuugucccagccugggg

SEQ ID NO: 1219526 - RNA, 21 nt, Homo sapiens
ugauuuuaaccaauguagcac

SEQ ID NO: 1219527 - RNA, 19 nt, Homo sapiens
ugauuuuauaugcuauuua

SEQ ID NO: 1219528 - RNA, 16 nt, Homo sapiens
ugauuuuaucugugaa

SEQ ID NO: 1219529 - RNA, 19 nt, Homo sapiens
ugauuuuguuuacugaaau

SEQ ID NO: 1219530 - RNA, 15 nt, Homo sapiens
ugauuuuuuuccaca

SEQ ID NO: 1219531 - RNA, 14 nt, Homo sapiens
ugcaaaaaaagccu

SEQ ID NO: 1219532 - RNA, 17 nt, Homo sapiens
ugcaaaacauaucuuga

SEQ ID NO: 1219533 - RNA, 13 nt, Homo sapiens
ugcaaaccaggau

SEQ ID NO: 1219534 - RNA, 22 nt, Homo sapiens
ugcaaacccgaaaauaaaagac

SEQ ID NO: 1219535 - RNA, 15 nt, Homo sapiens
ugcaaaccucaucuu

SEQ ID NO: 1219536 - RNA, 23 nt, Homo sapiens
ugcaaaccuuccugggaggacag

SEQ ID NO: 1219537 - RNA, 19 nt, Homo sapiens
ugcaaacucacugcucaag

SEQ ID NO: 1219538 - RNA, 18 nt, Homo sapiens
ugcaaagacaguauuuau

SEQ ID NO: 1219539 - RNA, 17 nt, Homo sapiens
ugcaaagaccuaccucc

SEQ ID NO: 1219540 - RNA, 18 nt, Homo sapiens
ugcaaaguguaugugacc

SEQ ID NO: 1219541 - RNA, 19 nt, Homo sapiens
ugcaaauauaucugcuauu

SEQ ID NO: 1219542 - RNA, 22 nt, Homo sapiens
ugcaucacguaccccacugggc

SEQ ID NO: 1219543 - RNA, 12 nt, Homo sapiens
ugcaucagugau

SEQ ID NO: 1219544 - RNA, 21 nt, Homo sapiens
ugcaucauaagcugauuugau

SEQ ID NO: 1219545 - RNA, 19 nt, Homo sapiens
ugcauccagccuccugcua

SEQ ID NO: 1219546 - RNA, 19 nt, Homo sapiens
ugcauccccuuggcuguga

SEQ ID NO: 1219547 - RNA, 18 nt, Homo sapiens
ugcaucccugcagcucaa

SEQ ID NO: 1219548 - RNA, 19 nt, Homo sapiens
ugcaugaccuaccaggaca

SEQ ID NO: 1219549 - RNA, 16 nt, Homo sapiens
ugcaugauacuaucug

SEQ ID NO: 1219550 - RNA, 11 nt, Homo sapiens
ugcauggauuu

SEQ ID NO: 1219551 - RNA, 12 nt, Homo sapiens
ugcauggccuua

SEQ ID NO: 1219552 - RNA, 14 nt, Homo sapiens
ugcauggcuccaga

SEQ ID NO: 1219553 - RNA, 24 nt, Homo sapiens
ugcauguagucacuuuauaaguca

SEQ ID NO: 1219554 - RNA, 21 nt, Homo sapiens
ugcaugucaucuucuaggcca

SEQ ID NO: 1219555 - RNA, 21 nt, Homo sapiens
ugcauguuacauaagauaaau

SEQ ID NO: 1219556 - RNA, 14 nt, Homo sapiens
ugcauucucuccca

SEQ ID NO: 1219557 - RNA, 16 nt, Homo sapiens
ugcauugugaggguua

SEQ ID NO: 1219558 - RNA, 11 nt, Homo sapiens
ugcauuuacuu

SEQ ID NO: 1219559 - RNA, 21 nt, Homo sapiens
ugcauuucaagcagcugaaga

SEQ ID NO: 1219560 - RNA, 16 nt, Homo sapiens
ugcauuucaccuguga

SEQ ID NO: 1219561 - RNA, 16 nt, Homo sapiens
ugcauuuccuuucuac

SEQ ID NO: 1219562 - RNA, 21 nt, Homo sapiens
ugcauuuucccagauacuucc

SEQ ID NO: 1219563 - RNA, 16 nt, Homo sapiens
ugcauuuuuagaccau

SEQ ID NO: 1219564 - RNA, 16 nt, Homo sapiens
ugcauuuuugugaaau

SEQ ID NO: 1219565 - RNA, 17 nt, Homo sapiens
ugcauuuuuuauuuagu

SEQ ID NO: 1219566 - RNA, 16 nt, Homo sapiens
ugccaaaccuguguag

SEQ ID NO: 1219567 - RNA, 17 nt, Homo sapiens
ugccaaauaaacagcua

SEQ ID NO: 1219568 - RNA, 13 nt, Homo sapiens
ugccaacaugugg

SEQ ID NO: 1219569 - RNA, 20 nt, Homo sapiens
ugccaaccucuggagcaaug

SEQ ID NO: 1219570 - RNA, 17 nt, Homo sapiens
ugccaaccuguucuuag

SEQ ID NO: 1219571 - RNA, 16 nt, Homo sapiens
ugccaagaaaguauuu

SEQ ID NO: 1219572 - RNA, 16 nt, Homo sapiens
ugccaagacaaaucaa

SEQ ID NO: 1219573 - RNA, 18 nt, Homo sapiens
ugccaauucauuucucua

SEQ ID NO: 1219574 - RNA, 16 nt, Homo sapiens
ugccacaacagaauaa

SEQ ID NO: 1219575 - RNA, 22 nt, Homo sapiens
ugccacaacagaauaaagcagc

SEQ ID NO: 1219576 - RNA, 21 nt, Homo sapiens
ugccacaggaggggaaguagg

SEQ ID NO: 1219577 - RNA, 16 nt, Homo sapiens
ugccacaucauugaag

SEQ ID NO: 1219578 - RNA, 18 nt, Homo sapiens
ugccaccaacacugcuca

SEQ ID NO: 1219579 - RNA, 18 nt, Homo sapiens
ugccacccaccuuugcca

SEQ ID NO: 1219580 - RNA, 20 nt, Homo sapiens
ugccacccaggcuggagugc

SEQ ID NO: 1219581 - RNA, 17 nt, Homo sapiens
ugccaccccaacccaau

SEQ ID NO: 1219582 - RNA, 16 nt, Homo sapiens
ugccacuaaacuacau

SEQ ID NO: 1219583 - RNA, 17 nt, Homo sapiens
ugccacucccugagcuu

SEQ ID NO: 1219584 - RNA, 19 nt, Homo sapiens
ugccacuguguacugugga

SEQ ID NO: 1219585 - RNA, 14 nt, Homo sapiens
ugccacuucccaga

SEQ ID NO: 1219586 - RNA, 19 nt, Homo sapiens
ugccacuuuacccaccuag

SEQ ID NO: 1219587 - RNA, 18 nt, Homo sapiens
ugccagaaagcauaaaau

SEQ ID NO: 1219588 - RNA, 18 nt, Homo sapiens
ugccagaugauuguucaa

SEQ ID NO: 1219589 - RNA, 19 nt, Homo sapiens
ugccagcaaugacaucuca

SEQ ID NO: 1219590 - RNA, 13 nt, Homo sapiens
ugccagcccuuca

SEQ ID NO: 1219591 - RNA, 17 nt, Homo sapiens
ugccagccgugaugcuc

SEQ ID NO: 1219592 - RNA, 16 nt, Homo sapiens
ugccaggcaacuuuua

SEQ ID NO: 1219593 - RNA, 21 nt, Homo sapiens
ugccaggcguuggugccacuu

SEQ ID NO: 1219594 - RNA, 22 nt, Homo sapiens
ugccagggcuggaagcuuucau

SEQ ID NO: 1219595 - RNA, 16 nt, Homo sapiens
ugccagugccucucac

SEQ ID NO: 1219596 - RNA, 14 nt, Homo sapiens
ugccaguugaucaa

SEQ ID NO: 1219597 - RNA, 14 nt, Homo sapiens
ugccauagaacaag

SEQ ID NO: 1219598 - RNA, 18 nt, Homo sapiens
ugccauaguuugugaauc

SEQ ID NO: 1219599 - RNA, 12 nt, Homo sapiens
ugccauaugccu

SEQ ID NO: 1219600 - RNA, 23 nt, Homo sapiens
ugccauccucccaaggggcccaa

SEQ ID NO: 1219601 - RNA, 18 nt, Homo sapiens
ugccauuaaaacauuacc

SEQ ID NO: 1219602 - RNA, 17 nt, Homo sapiens
ugccauuccacuccacu

SEQ ID NO: 1219603 - RNA, 15 nt, Homo sapiens
ugccauuuagcaaua

SEQ ID NO: 1219604 - RNA, 21 nt, Homo sapiens
ugcccaacugccugccuuagg

SEQ ID NO: 1219605 - RNA, 16 nt, Homo sapiens
ugcccaagcacuucac

SEQ ID NO: 1219606 - RNA, 14 nt, Homo sapiens
ugcccaagucccag

SEQ ID NO: 1219607 - RNA, 13 nt, Homo sapiens
ugcccacaaaaaa

SEQ ID NO: 1219608 - RNA, 21 nt, Homo sapiens
ugcccacuuccccuuccccaa

SEQ ID NO: 1219609 - RNA, 15 nt, Homo sapiens
ugcccagaacuuccc

SEQ ID NO: 1219610 - RNA, 15 nt, Homo sapiens
ugcccagacuacagg

SEQ ID NO: 1219611 - RNA, 17 nt, Homo sapiens
ugcccagacuacagggc

SEQ ID NO: 1219612 - RNA, 12 nt, Homo sapiens
ugcccagaucaa

SEQ ID NO: 1219613 - RNA, 17 nt, Homo sapiens
ugcccagcacagugccu

SEQ ID NO: 1219614 - RNA, 22 nt, Homo sapiens
ugcccaggacguccuaucuccc

SEQ ID NO: 1219615 - RNA, 21 nt, Homo sapiens
ugcccaggccggccagccuca

SEQ ID NO: 1219616 - RNA, 20 nt, Homo sapiens
ugcccaggcuggagugcaau

SEQ ID NO: 1219617 - RNA, 20 nt, Homo sapiens
ugcccaggcuggcgugcagu

SEQ ID NO: 1219618 - RNA, 16 nt, Homo sapiens
ugcccaguacauuuaa

SEQ ID NO: 1219619 - RNA, 21 nt, Homo sapiens
ugcccagugagacuguguugu

SEQ ID NO: 1219620 - RNA, 22 nt, Homo sapiens
ugcccaguguuguuuguaaaua

SEQ ID NO: 1219621 - RNA, 17 nt, Homo sapiens
ugcccauccugacugaa

SEQ ID NO: 1219622 - RNA, 12 nt, Homo sapiens
ugcccauugcac

SEQ ID NO: 1219623 - RNA, 20 nt, Homo sapiens
ugccccaaacaaauaugcaa

SEQ ID NO: 1219624 - RNA, 22 nt, Homo sapiens
ugccccacccaguuucuggaaa

SEQ ID NO: 1219625 - RNA, 18 nt, Homo sapiens
ugccccagaaaaauaacu

SEQ ID NO: 1219626 - RNA, 22 nt, Homo sapiens
ugccccagauuuacuaaaucaa

SEQ ID NO: 1219627 - RNA, 11 nt, Homo sapiens
ugccccagugu

SEQ ID NO: 1219628 - RNA, 16 nt, Homo sapiens
ugcccccaaaauuaca

SEQ ID NO: 1219629 - RNA, 15 nt, Homo sapiens
ugcccccaacacucc

SEQ ID NO: 1219630 - RNA, 18 nt, Homo sapiens
ugcccccagccccggggu

SEQ ID NO: 1219631 - RNA, 19 nt, Homo sapiens
ugccccccacucugcacag

SEQ ID NO: 1219632 - RNA, 14 nt, Homo sapiens
ugcccccuccacug

SEQ ID NO: 1219633 - RNA, 18 nt, Homo sapiens
ugccccgccuccccgaaa

SEQ ID NO: 1219634 - RNA, 18 nt, Homo sapiens
ugccccgcuauuccucac

SEQ ID NO: 1219635 - RNA, 15 nt, Homo sapiens
ugccccucucucagu

SEQ ID NO: 1219636 - RNA, 16 nt, Homo sapiens
ugccccucuguaacaa

SEQ ID NO: 1219637 - RNA, 17 nt, Homo sapiens
ugccccuggggcuucca

SEQ ID NO: 1219638 - RNA, 22 nt, Homo sapiens
ugcccguuuccauacagggucu

SEQ ID NO: 1219639 - RNA, 16 nt, Homo sapiens
ugcccuagcccagacu

SEQ ID NO: 1219640 - RNA, 16 nt, Homo sapiens
ugcccucaggggacuu

SEQ ID NO: 1219641 - RNA, 19 nt, Homo sapiens
ugcccucauuacugggccu

SEQ ID NO: 1219642 - RNA, 23 nt, Homo sapiens
ugcccucggagugccacacaugc

SEQ ID NO: 1219643 - RNA, 15 nt, Homo sapiens
ugcccucucugccag

SEQ ID NO: 1219644 - RNA, 17 nt, Homo sapiens
ugcccugaguccaagag

SEQ ID NO: 1219645 - RNA, 16 nt, Homo sapiens
ugcccugguccaggga

SEQ ID NO: 1219646 - RNA, 19 nt, Homo sapiens
ucugaacuugcauugugau

SEQ ID NO: 1219647 - RNA, 20 nt, Homo sapiens
ucugaaggaagagaagacau

SEQ ID NO: 1219648 - RNA, 19 nt, Homo sapiens
ucugaaggucccaccucca

SEQ ID NO: 1219649 - RNA, 22 nt, Homo sapiens
ucugaaucgagauguccauagu

SEQ ID NO: 1219650 - RNA, 20 nt, Homo sapiens
ucugaaugcugccacaacca

SEQ ID NO: 1219651 - RNA, 18 nt, Homo sapiens
ucugacaccagagcccac

SEQ ID NO: 1219652 - RNA, 23 nt, Homo sapiens
ucugacaccagagcccacuucca

SEQ ID NO: 1219653 - RNA, 16 nt, Homo sapiens
ucugaccccuccucac

SEQ ID NO: 1219654 - RNA, 16 nt, Homo sapiens
ucugacgcaaaaccac

SEQ ID NO: 1219655 - RNA, 20 nt, Homo sapiens
ucugacuaagguugacauaa

SEQ ID NO: 1219656 - RNA, 13 nt, Homo sapiens
ucugacuaccucc

SEQ ID NO: 1219657 - RNA, 18 nt, Homo sapiens
ucugacuacuuguuguau

SEQ ID NO: 1219658 - RNA, 21 nt, Homo sapiens
ucugacuacuuguuguaucug

SEQ ID NO: 1219659 - RNA, 19 nt, Homo sapiens
ucugacuuaagcaaaagaa

SEQ ID NO: 1219660 - RNA, 15 nt, Homo sapiens
ucugagaagacacaa

SEQ ID NO: 1219661 - RNA, 21 nt, Homo sapiens
ucugagaaucacggugguaaa

SEQ ID NO: 1219662 - RNA, 23 nt, Homo sapiens
ucugagaccacuugggcgcuguu

SEQ ID NO: 1219663 - RNA, 14 nt, Homo sapiens
ucugagacucacag

SEQ ID NO: 1219664 - RNA, 20 nt, Homo sapiens
ucugagacuccucauaccuc

SEQ ID NO: 1219665 - RNA, 14 nt, Homo sapiens
ucugagagacagaa

SEQ ID NO: 1219666 - RNA, 17 nt, Homo sapiens
ucugagagacagaauuc

SEQ ID NO: 1219667 - RNA, 19 nt, Homo sapiens
ucugagcacccaagccagg

SEQ ID NO: 1219668 - RNA, 23 nt, Homo sapiens
ucugagccaaagagaaugccauu

SEQ ID NO: 1219669 - RNA, 22 nt, Homo sapiens
ucugagcccaagcuaagccauc

SEQ ID NO: 1219670 - RNA, 11 nt, Homo sapiens
ucugagcccag

SEQ ID NO: 1219671 - RNA, 15 nt, Homo sapiens
ucugagcuauuucau

SEQ ID NO: 1219672 - RNA, 21 nt, Homo sapiens
ugggggacugggagucagagc

SEQ ID NO: 1219673 - RNA, 22 nt, Homo sapiens
ugggggcaccuuaagauuuugc

SEQ ID NO: 1219674 - RNA, 23 nt, Homo sapiens
ugggggcgcccucucugcuccuu

SEQ ID NO: 1219675 - RNA, 18 nt, Homo sapiens
ugggguaguuguguuuca

SEQ ID NO: 1219676 - RNA, 22 nt, Homo sapiens
uggggucugugaucacccucuc

SEQ ID NO: 1219677 - RNA, 21 nt, Homo sapiens
uggggucuuuuuaugcauuug

SEQ ID NO: 1219678 - RNA, 21 nt, Homo sapiens
uggggugcugccugaauccau

SEQ ID NO: 1219679 - RNA, 17 nt, Homo sapiens
ugggguggccaccagua

SEQ ID NO: 1219680 - RNA, 22 nt, Homo sapiens
ugggguugaaaauucaaaaagu

SEQ ID NO: 1219681 - RNA, 19 nt, Homo sapiens
ugggguugcaaccacugca

SEQ ID NO: 1219682 - RNA, 17 nt, Homo sapiens
ugggguuugaagcugac

SEQ ID NO: 1219683 - RNA, 17 nt, Homo sapiens
uggguaaaugcuuuuaa

SEQ ID NO: 1219684 - RNA, 18 nt, Homo sapiens
uggguacuuguggacaca

SEQ ID NO: 1219685 - RNA, 14 nt, Homo sapiens
uggguaguaccugu

SEQ ID NO: 1219686 - RNA, 22 nt, Homo sapiens
ugggucaaagugcggcugccau

SEQ ID NO: 1219687 - RNA, 15 nt, Homo sapiens
uggguccaucagaga

SEQ ID NO: 1219688 - RNA, 23 nt, Homo sapiens
ugggucucauuuagaacuugcag

SEQ ID NO: 1219689 - RNA, 13 nt, Homo sapiens
ugggugacauuug

SEQ ID NO: 1219690 - RNA, 10 nt, Homo sapiens
ugggugcugc

SEQ ID NO: 1219691 - RNA, 22 nt, Homo sapiens
uggguggaaauccugcccugga

SEQ ID NO: 1219692 - RNA, 16 nt, Homo sapiens
uggguggcacaccacc

SEQ ID NO: 1219693 - RNA, 17 nt, Homo sapiens
uggguuguguguuuauu

SEQ ID NO: 1219694 - RNA, 14 nt, Homo sapiens
uggguuugguuaga

SEQ ID NO: 1219695 - RNA, 21 nt, Homo sapiens
ugguaaaaguauuugcuuaaa

SEQ ID NO: 1219696 - RNA, 14 nt, Homo sapiens
ugguaaaguuacac

SEQ ID NO: 1219697 - RNA, 17 nt, Homo sapiens
ugguaaauuaguauuua

SEQ ID NO: 1219698 - RNA, 23 nt, Homo sapiens
ugguaacacaaauuuucaccugc

SEQ ID NO: 1219699 - RNA, 16 nt, Homo sapiens
ugguaacagcucucuu

SEQ ID NO: 1219700 - RNA, 20 nt, Homo sapiens
ugguaacugcuuuggucucu

SEQ ID NO: 1219701 - RNA, 14 nt, Homo sapiens
ugguaaguugagau

SEQ ID NO: 1219702 - RNA, 20 nt, Homo sapiens
ugguaauauugacuuguaua

SEQ ID NO: 1219703 - RNA, 13 nt, Homo sapiens
ugguacaauccuu

SEQ ID NO: 1219704 - RNA, 17 nt, Homo sapiens
ugguacugaaaaugaga

SEQ ID NO: 1219705 - RNA, 12 nt, Homo sapiens
ugguacugcugu

SEQ ID NO: 1219706 - RNA, 15 nt, Homo sapiens
ugguagaaaggcagu

SEQ ID NO: 1219707 - RNA, 12 nt, Homo sapiens
ugguagcacuug

SEQ ID NO: 1219708 - RNA, 20 nt, Homo sapiens
ugguaguggaauagugaaua

SEQ ID NO: 1219709 - RNA, 24 nt, Homo sapiens
ugguauccuacugagcauuugcac

SEQ ID NO: 1219710 - RNA, 15 nt, Homo sapiens
ugguaucucagaaag

SEQ ID NO: 1219711 - RNA, 17 nt, Homo sapiens
ugguaugucucuuuaag

SEQ ID NO: 1219712 - RNA, 13 nt, Homo sapiens
ugguaugugacac

SEQ ID NO: 1219713 - RNA, 20 nt, Homo sapiens
uggucaauccgaaguaugag

SEQ ID NO: 1219714 - RNA, 23 nt, Homo sapiens
uggucacaugaugugcauagaga

SEQ ID NO: 1219715 - RNA, 22 nt, Homo sapiens
uggucaccaaaucagcugcuac

SEQ ID NO: 1219716 - RNA, 20 nt, Homo sapiens
uggucagugguggucuucaa

SEQ ID NO: 1219717 - RNA, 15 nt, Homo sapiens
uggucauccaaacuc

SEQ ID NO: 1219718 - RNA, 19 nt, Homo sapiens
uggucccagaguggcugca

SEQ ID NO: 1219719 - RNA, 15 nt, Homo sapiens
ugguccccuccucag

SEQ ID NO: 1219720 - RNA, 20 nt, Homo sapiens
uggucccggggccagcacuu

SEQ ID NO: 1219721 - RNA, 15 nt, Homo sapiens
uggucccucuguguc

SEQ ID NO: 1219722 - RNA, 22 nt, Homo sapiens
uggucccucugugucugcucuc

SEQ ID NO: 1219723 - RNA, 14 nt, Homo sapiens
ugguccgaucuuug

SEQ ID NO: 1219724 - RNA, 23 nt, Homo sapiens
uggucuauuuucugcagaaauuu

SEQ ID NO: 1219725 - RNA, 13 nt, Homo sapiens
uggucugacccac

SEQ ID NO: 1219726 - RNA, 12 nt, Homo sapiens
uggucugugaga

SEQ ID NO: 1219727 - RNA, 16 nt, Homo sapiens
uggugaaaauguacug

SEQ ID NO: 1219728 - RNA, 23 nt, Homo sapiens
uggugaaaccccaucucuacuaa

SEQ ID NO: 1219729 - RNA, 21 nt, Homo sapiens
uggugacauugcaccuggaug

SEQ ID NO: 1219730 - RNA, 11 nt, Homo sapiens
uggugacucac

SEQ ID NO: 1219731 - RNA, 20 nt, Homo sapiens
uggugagaaauuucugugaa

SEQ ID NO: 1219732 - RNA, 13 nt, Homo sapiens
uggugaggcaaua

SEQ ID NO: 1219733 - RNA, 14 nt, Homo sapiens
uggugaggcaauaa

SEQ ID NO: 1219734 - RNA, 14 nt, Homo sapiens
uggugauauccucu

SEQ ID NO: 1219735 - RNA, 16 nt, Homo sapiens
uggugaucagugcaau

SEQ ID NO: 1219736 - RNA, 14 nt, Homo sapiens
uggugccaaacaaa

SEQ ID NO: 1219737 - RNA, 22 nt, Homo sapiens
uggugccauuucugaacuguua

SEQ ID NO: 1219738 - RNA, 19 nt, Homo sapiens
uggugccccagcaccaacc

SEQ ID NO: 1219739 - RNA, 22 nt, Homo sapiens
uggugccuucucacaucugucc

SEQ ID NO: 1219740 - RNA, 12 nt, Homo sapiens
uggugcuuccca

SEQ ID NO: 1219741 - RNA, 18 nt, Homo sapiens
ugguggaaggugugcucg

SEQ ID NO: 1219742 - RNA, 14 nt, Homo sapiens
ugguggcaccagau

SEQ ID NO: 1219743 - RNA, 13 nt, Homo sapiens
ugguggcacugag

SEQ ID NO: 1219744 - RNA, 18 nt, Homo sapiens
ugguggcagauuuuacaa

SEQ ID NO: 1219745 - RNA, 20 nt, Homo sapiens
ugguggcucacaccugcaau

SEQ ID NO: 1219746 - RNA, 17 nt, Homo sapiens
uggugggucuauguucc

SEQ ID NO: 1219747 - RNA, 13 nt, Homo sapiens
ugguggucccugc

SEQ ID NO: 1219748 - RNA, 21 nt, Homo sapiens
ugguguaguuucuucauuuca

SEQ ID NO: 1219749 - RNA, 17 nt, Homo sapiens
uggugugaccauguuca

SEQ ID NO: 1219750 - RNA, 15 nt, Homo sapiens
uggugugauugcaca

SEQ ID NO: 1219751 - RNA, 17 nt, Homo sapiens
uggugugauugcacaga

SEQ ID NO: 1219752 - RNA, 13 nt, Homo sapiens
uggugugccucag

SEQ ID NO: 1219753 - RNA, 17 nt, Homo sapiens
ugguguggccagcacuc

SEQ ID NO: 1219754 - RNA, 20 nt, Homo sapiens
ugguguuccauugccucuuu

SEQ ID NO: 1219755 - RNA, 18 nt, Homo sapiens
ugguuaauaaaacugcac

SEQ ID NO: 1219756 - RNA, 19 nt, Homo sapiens
ugguuaauaaaacugcaca

SEQ ID NO: 1219757 - RNA, 20 nt, Homo sapiens
ugguuaucuaauauguaaca

SEQ ID NO: 1219758 - RNA, 22 nt, Homo sapiens
ugguuauggccgaaaaggauau

SEQ ID NO: 1219759 - RNA, 23 nt, Homo sapiens
ugguucauauuuauacuuugcaa

SEQ ID NO: 1219760 - RNA, 17 nt, Homo sapiens
ugguucauuaauucuau

SEQ ID NO: 1219761 - RNA, 14 nt, Homo sapiens
ugguuccaugcagc

SEQ ID NO: 1219762 - RNA, 11 nt, Homo sapiens
ugguucugcuu

SEQ ID NO: 1219763 - RNA, 22 nt, Homo sapiens
ugguuuaccuggggauccaauu

SEQ ID NO: 1219764 - RNA, 17 nt, Homo sapiens
ugguuugccaugucgcu

SEQ ID NO: 1219765 - RNA, 20 nt, Homo sapiens
ugguuuguuauaucagggaa

SEQ ID NO: 1219766 - RNA, 11 nt, Homo sapiens
ugguuuugcuc

SEQ ID NO: 1219767 - RNA, 22 nt, Homo sapiens
uguaaaaaaaaaugccuuugag

SEQ ID NO: 1219768 - RNA, 18 nt, Homo sapiens
uguaaaaagaaaaaccac

SEQ ID NO: 1219769 - RNA, 21 nt, Homo sapiens
uguaaaaaugaaagugacuuu

SEQ ID NO: 1219770 - RNA, 22 nt, Homo sapiens
uguaaaaaugaaagugacuuua

SEQ ID NO: 1219771 - RNA, 18 nt, Homo sapiens
uguaaaacuauauucuca

SEQ ID NO: 1219772 - RNA, 17 nt, Homo sapiens
uguaaaauagaauguua

SEQ ID NO: 1219773 - RNA, 21 nt, Homo sapiens
uguaaaauauuuaugagaaag

SEQ ID NO: 1219774 - RNA, 19 nt, Homo sapiens
uguaaacguuucaguaaua

SEQ ID NO: 1219775 - RNA, 22 nt, Homo sapiens
uguaaacuguacuagucugugu

SEQ ID NO: 1219776 - RNA, 14 nt, Homo sapiens
uguaagugcugcua

SEQ ID NO: 1219777 - RNA, 17 nt, Homo sapiens
uguaaguuucaggugac

SEQ ID NO: 1219778 - RNA, 15 nt, Homo sapiens
uguaauaaguaucac

SEQ ID NO: 1219779 - RNA, 13 nt, Homo sapiens
uguaauauucucc

SEQ ID NO: 1219780 - RNA, 19 nt, Homo sapiens
uguaauauuucuucaaaua

SEQ ID NO: 1219781 - RNA, 16 nt, Homo sapiens
uguaaucauuccuucc

SEQ ID NO: 1219782 - RNA, 18 nt, Homo sapiens
uguaaugaaaaugaauau

SEQ ID NO: 1219783 - RNA, 12 nt, Homo sapiens
uguaaugcauag

SEQ ID NO: 1219784 - RNA, 14 nt, Homo sapiens
uguaaugcugcaca

SEQ ID NO: 1219785 - RNA, 15 nt, Homo sapiens
uguaauggaaaccaa

SEQ ID NO: 1219786 - RNA, 15 nt, Homo sapiens
uguaauggaucuuaa

SEQ ID NO: 1219787 - RNA, 21 nt, Homo sapiens
uguaauuaaguaaaccaaaaa

SEQ ID NO: 1219788 - RNA, 15 nt, Homo sapiens
uguaauuuaugcaag

SEQ ID NO: 1219789 - RNA, 13 nt, Homo sapiens
uguacaacugcac

SEQ ID NO: 1219790 - RNA, 13 nt, Homo sapiens
uguacacagaauu

SEQ ID NO: 1219791 - RNA, 15 nt, Homo sapiens
uguacacagaauugu

SEQ ID NO: 1219792 - RNA, 13 nt, Homo sapiens
uguacaccaaggu

SEQ ID NO: 1219793 - RNA, 13 nt, Homo sapiens
uguacacuacagc

SEQ ID NO: 1219794 - RNA, 17 nt, Homo sapiens
uguacagaccaccuuuc

SEQ ID NO: 1219795 - RNA, 17 nt, Homo sapiens
uguacagauucuuucag

SEQ ID NO: 1219796 - RNA, 11 nt, Homo sapiens
uguacagugaa

SEQ ID NO: 1219797 - RNA, 18 nt, Homo sapiens
uguacagugucugugcca

SEQ ID NO: 1219798 - RNA, 20 nt, Homo sapiens
uguacaguuugcuguacuag

SEQ ID NO: 1219799 - RNA, 20 nt, Homo sapiens
uguacauguguagccugugc

SEQ ID NO: 1219800 - RNA, 13 nt, Homo sapiens
uguaccauguaca

SEQ ID NO: 1219801 - RNA, 16 nt, Homo sapiens
uguaccauuugcaugg

SEQ ID NO: 1219802 - RNA, 19 nt, Homo sapiens
uguacccucgcaugacugu

SEQ ID NO: 1219803 - RNA, 15 nt, Homo sapiens
uguaccucaaucuau

SEQ ID NO: 1219804 - RNA, 15 nt, Homo sapiens
uguaccugaugcuau

SEQ ID NO: 1219805 - RNA, 23 nt, Homo sapiens
uguacuaaaccaccucagaaagg

SEQ ID NO: 1219806 - RNA, 15 nt, Homo sapiens
uguacuaagcaguaa

SEQ ID NO: 1219807 - RNA, 20 nt, Homo sapiens
uguacuauccaaucugugau

SEQ ID NO: 1219808 - RNA, 18 nt, Homo sapiens
uguacucaaguaccacca

SEQ ID NO: 1219809 - RNA, 19 nt, Homo sapiens
uguacucuggggugcugcc

SEQ ID NO: 1219810 - RNA, 13 nt, Homo sapiens
uguacugccuuaa

SEQ ID NO: 1219811 - RNA, 14 nt, Homo sapiens
uguacugccuuagu

SEQ ID NO: 1219812 - RNA, 23 nt, Homo sapiens
uguacuguucugugucuuucaca

SEQ ID NO: 1219813 - RNA, 22 nt, Homo sapiens
uguacuuuuuuuuacuuuggca

SEQ ID NO: 1219814 - RNA, 20 nt, Homo sapiens
uguagaagaaagagcaacaa

SEQ ID NO: 1219815 - RNA, 13 nt, Homo sapiens
uguagaaggagcc

SEQ ID NO: 1219816 - RNA, 20 nt, Homo sapiens
uguagaaugauuucaugcua

SEQ ID NO: 1219817 - RNA, 16 nt, Homo sapiens
uguagacaaaguacau

SEQ ID NO: 1219818 - RNA, 19 nt, Homo sapiens
uguagaccaccuaauauca

SEQ ID NO: 1219819 - RNA, 12 nt, Homo sapiens
uguagacugugu

SEQ ID NO: 1219820 - RNA, 22 nt, Homo sapiens
uguagagacgguguuuugccau

SEQ ID NO: 1219821 - RNA, 17 nt, Homo sapiens
uguagauggcggugaug

SEQ ID NO: 1219822 - RNA, 15 nt, Homo sapiens
uguagcaauauauca

SEQ ID NO: 1219823 - RNA, 15 nt, Homo sapiens
uguagcagucacuga

SEQ ID NO: 1219824 - RNA, 13 nt, Homo sapiens
uguagcagugaga

SEQ ID NO: 1219825 - RNA, 15 nt, Homo sapiens
uguagcauuucuuga

SEQ ID NO: 1219826 - RNA, 19 nt, Homo sapiens
uguagccauggcucaggca

SEQ ID NO: 1219827 - RNA, 15 nt, Homo sapiens
uguagcguguuuaca

SEQ ID NO: 1219828 - RNA, 17 nt, Homo sapiens
uguaggaagaguagcau

SEQ ID NO: 1219829 - RNA, 15 nt, Homo sapiens
uguaggauucaaguc

SEQ ID NO: 1219830 - RNA, 14 nt, Homo sapiens
uguaguaacugccu

SEQ ID NO: 1219831 - RNA, 20 nt, Homo sapiens
uguagucccagcuacuugag

SEQ ID NO: 1219832 - RNA, 12 nt, Homo sapiens
uguauaaaaugg

SEQ ID NO: 1219833 - RNA, 18 nt, Homo sapiens
uguauaacuggauugcag

SEQ ID NO: 1219834 - RNA, 16 nt, Homo sapiens
uguauacacauauaua

SEQ ID NO: 1219835 - RNA, 14 nt, Homo sapiens
uguauacaugccag

SEQ ID NO: 1219836 - RNA, 16 nt, Homo sapiens
uguauacuguaggcac

SEQ ID NO: 1219837 - RNA, 20 nt, Homo sapiens
uguauaguuuugaauccuuu

SEQ ID NO: 1219838 - RNA, 16 nt, Homo sapiens
uguauauaaacauauc

SEQ ID NO: 1219839 - RNA, 17 nt, Homo sapiens
uguauauacacauauac

SEQ ID NO: 1219840 - RNA, 21 nt, Homo sapiens
uguauauacaguuauuuugga

SEQ ID NO: 1219841 - RNA, 11 nt, Homo sapiens
uguauauccaa

SEQ ID NO: 1219842 - RNA, 19 nt, Homo sapiens
uguauauucaggacuugaa

SEQ ID NO: 1219843 - RNA, 17 nt, Homo sapiens
uguaucauuugaacaac

SEQ ID NO: 1219844 - RNA, 16 nt, Homo sapiens
uguaucccuucucaca

SEQ ID NO: 1219845 - RNA, 17 nt, Homo sapiens
uguaucggagacaguga

SEQ ID NO: 1219846 - RNA, 17 nt, Homo sapiens
uguaucuaaaccauaug

SEQ ID NO: 1219847 - RNA, 20 nt, Homo sapiens
uguaucuuccuuucuugucu

SEQ ID NO: 1219848 - RNA, 23 nt, Homo sapiens
uguaugaguaucuguauguauau

SEQ ID NO: 1219849 - RNA, 12 nt, Homo sapiens
uguaugcacuuu

SEQ ID NO: 1219850 - RNA, 15 nt, Homo sapiens
uguaugugaaagugu

SEQ ID NO: 1219851 - RNA, 13 nt, Homo sapiens
uguaugugccauu

SEQ ID NO: 1219852 - RNA, 17 nt, Homo sapiens
uguauguguguagacaa

SEQ ID NO: 1219853 - RNA, 23 nt, Homo sapiens
uguauguuuacauaucaccucau

SEQ ID NO: 1219854 - RNA, 15 nt, Homo sapiens
uguauuaauaaagca

SEQ ID NO: 1219855 - RNA, 15 nt, Homo sapiens
uguauuaaugcuaua

SEQ ID NO: 1219856 - RNA, 18 nt, Homo sapiens
uguauuacagcuuucaca

SEQ ID NO: 1219857 - RNA, 16 nt, Homo sapiens
uguauucccuuguauu

SEQ ID NO: 1219858 - RNA, 22 nt, Homo sapiens
uguauugacuguaccacagaca

SEQ ID NO: 1219859 - RNA, 15 nt, Homo sapiens
uguauuuacaguuuc

SEQ ID NO: 1219860 - RNA, 18 nt, Homo sapiens
uguauuuauggagugccu

SEQ ID NO: 1219861 - RNA, 23 nt, Homo sapiens
uguauuuuugugaaguauucaca

SEQ ID NO: 1219862 - RNA, 15 nt, Homo sapiens
ugucaaaagccagau

SEQ ID NO: 1219863 - RNA, 16 nt, Homo sapiens
ugucaauaaaaccacu

SEQ ID NO: 1219864 - RNA, 12 nt, Homo sapiens
ugucaaugauac

SEQ ID NO: 1219865 - RNA, 18 nt, Homo sapiens
ugucacaaccucucugau

SEQ ID NO: 1219866 - RNA, 21 nt, Homo sapiens
ugucacaaccucucugaucuu

SEQ ID NO: 1219867 - RNA, 12 nt, Homo sapiens
ugucacagccug

SEQ ID NO: 1219868 - RNA, 22 nt, Homo sapiens
ugucacauaaugcucauacuua

SEQ ID NO: 1219869 - RNA, 23 nt, Homo sapiens
ugucaccaacugaaguggcuaaa

SEQ ID NO: 1219870 - RNA, 19 nt, Homo sapiens
ugucaccucuguuaagguu

SEQ ID NO: 1219871 - RNA, 16 nt, Homo sapiens
ugucacuaaacugaaa

SEQ ID NO: 1219872 - RNA, 22 nt, Homo sapiens
ugucagaaaaagcuagcacuaa

SEQ ID NO: 1219873 - RNA, 22 nt, Homo sapiens
ugucagaaaccugcagggacuc

SEQ ID NO: 1219874 - RNA, 17 nt, Homo sapiens
ugucagaaugcuauuga

SEQ ID NO: 1219875 - RNA, 18 nt, Homo sapiens
ugucagcccccaucugac

SEQ ID NO: 1219876 - RNA, 16 nt, Homo sapiens
ugucagcuacuaauga

SEQ ID NO: 1219877 - RNA, 22 nt, Homo sapiens
ugucaguauuucaacugcugua

SEQ ID NO: 1219878 - RNA, 17 nt, Homo sapiens
ugucagugucacuggau

SEQ ID NO: 1219879 - RNA, 20 nt, Homo sapiens
ugucaguuuuaucuucagaa

SEQ ID NO: 1219880 - RNA, 17 nt, Homo sapiens
ugucauauaagauucau

SEQ ID NO: 1219881 - RNA, 14 nt, Homo sapiens
ugucauaugacuga

SEQ ID NO: 1219882 - RNA, 17 nt, Homo sapiens
uguuggcaaaucagaug

SEQ ID NO: 1219883 - RNA, 12 nt, Homo sapiens
uguuggcagcuc

SEQ ID NO: 1219884 - RNA, 20 nt, Homo sapiens
uguuggccaaagccaaagcu

SEQ ID NO: 1219885 - RNA, 15 nt, Homo sapiens
uguuggccaguguga

SEQ ID NO: 1219886 - RNA, 18 nt, Homo sapiens
uguuggcuccagucuucc

SEQ ID NO: 1219887 - RNA, 13 nt, Homo sapiens
uguuggggaccuu

SEQ ID NO: 1219888 - RNA, 18 nt, Homo sapiens
uguugucacccaagagau

SEQ ID NO: 1219889 - RNA, 21 nt, Homo sapiens
uguugucauuguaaacaaacu

SEQ ID NO: 1219890 - RNA, 13 nt, Homo sapiens
uguuguuccaaau

SEQ ID NO: 1219891 - RNA, 16 nt, Homo sapiens
uguuguuuuaggggcu

SEQ ID NO: 1219892 - RNA, 18 nt, Homo sapiens
uguuguuuucccaaagag

SEQ ID NO: 1219893 - RNA, 19 nt, Homo sapiens
uguuuaagaaaaaauaaca

SEQ ID NO: 1219894 - RNA, 19 nt, Homo sapiens
uguuuaaggaaaugugcag

SEQ ID NO: 1219895 - RNA, 17 nt, Homo sapiens
uguuuacagcacuacuc

SEQ ID NO: 1219896 - RNA, 14 nt, Homo sapiens
uguuuacagugaug

SEQ ID NO: 1219897 - RNA, 12 nt, Homo sapiens
uguuuacucauu

SEQ ID NO: 1219898 - RNA, 15 nt, Homo sapiens
uguuuauagugcucu

SEQ ID NO: 1219899 - RNA, 19 nt, Homo sapiens
uguuuauccuuagcucaca

SEQ ID NO: 1219900 - RNA, 16 nt, Homo sapiens
uguuuauuugcacuau

SEQ ID NO: 1219901 - RNA, 18 nt, Homo sapiens
uguuucacaauaccucau

SEQ ID NO: 1219902 - RNA, 19 nt, Homo sapiens
uguuucccuucccuuccac

SEQ ID NO: 1219903 - RNA, 14 nt, Homo sapiens
uguuucuauacaaa

SEQ ID NO: 1219904 - RNA, 14 nt, Homo sapiens
uguuucuguuccaa

SEQ ID NO: 1219905 - RNA, 19 nt, Homo sapiens
uguuucuuauucuuucuaa

SEQ ID NO: 1219906 - RNA, 12 nt, Homo sapiens
uguuucuuccaa

SEQ ID NO: 1219907 - RNA, 12 nt, Homo sapiens
uguuucuuuaua

SEQ ID NO: 1219908 - RNA, 17 nt, Homo sapiens
uguuugacacaauugga

SEQ ID NO: 1219909 - RNA, 18 nt, Homo sapiens
uguuugacacaauuggaa

SEQ ID NO: 1219910 - RNA, 23 nt, Homo sapiens
uguuugacgacagugcauuugcc

SEQ ID NO: 1219911 - RNA, 14 nt, Homo sapiens
uguuugcauaaagu

SEQ ID NO: 1219912 - RNA, 20 nt, Homo sapiens
uguuugcuuaaacaaaguga

SEQ ID NO: 1219913 - RNA, 18 nt, Homo sapiens
uguuuggaauaaagucaa

SEQ ID NO: 1219914 - RNA, 14 nt, Homo sapiens
uguuuggagcucua

SEQ ID NO: 1219915 - RNA, 16 nt, Homo sapiens
uguuuggauuccucac

SEQ ID NO: 1219916 - RNA, 18 nt, Homo sapiens
uguuuggguauccugccc

SEQ ID NO: 1219917 - RNA, 19 nt, Homo sapiens
uguuuguaaauaagagauu

SEQ ID NO: 1219918 - RNA, 18 nt, Homo sapiens
uguuugucucaguuggaa

SEQ ID NO: 1219919 - RNA, 14 nt, Homo sapiens
uguuugucuuccau

SEQ ID NO: 1219920 - RNA, 23 nt, Homo sapiens
uguuuuaauuccaauaugaugac

SEQ ID NO: 1219921 - RNA, 18 nt, Homo sapiens
uguuuuauugacaucucu

SEQ ID NO: 1219922 - RNA, 12 nt, Homo sapiens
uguuuuguacaa

SEQ ID NO: 1219923 - RNA, 14 nt, Homo sapiens
uguuuuguauacaa

SEQ ID NO: 1219924 - RNA, 13 nt, Homo sapiens
uguuuuuaagcug

SEQ ID NO: 1219925 - RNA, 20 nt, Homo sapiens
uguuuuuagcugguggcaau

SEQ ID NO: 1219926 - RNA, 20 nt, Homo sapiens
uguuuuucuuuuuccacaag

SEQ ID NO: 1219927 - RNA, 17 nt, Homo sapiens
uguuuuuuaaagcaagu

SEQ ID NO: 1219928 - RNA, 22 nt, Homo sapiens
uguuuuuugccacagcuuuugc

SEQ ID NO: 1219929 - RNA, 13 nt, Homo sapiens
uuaaaaaaucuca

SEQ ID NO: 1219930 - RNA, 22 nt, Homo sapiens
uuaaaaaaucucaaauuuggau

SEQ ID NO: 1219931 - RNA, 17 nt, Homo sapiens
uuaaaaacaguuuucca

SEQ ID NO: 1219932 - RNA, 15 nt, Homo sapiens
uuaaaaagaaugacg

SEQ ID NO: 1219933 - RNA, 13 nt, Homo sapiens
uuaaaaagcaaaa

SEQ ID NO: 1219934 - RNA, 21 nt, Homo sapiens
uuaaaaagccaguuuggguaa

SEQ ID NO: 1219935 - RNA, 15 nt, Homo sapiens
uuaaaaauaugugua

SEQ ID NO: 1219936 - RNA, 16 nt, Homo sapiens
uuaaaaaucuguaaau

SEQ ID NO: 1219937 - RNA, 19 nt, Homo sapiens
uuaaaaauuagcaugcugc

SEQ ID NO: 1219938 - RNA, 20 nt, Homo sapiens
uuaaaacaacacucacauuu

SEQ ID NO: 1219939 - RNA, 22 nt, Homo sapiens
uuaaaacaacacucacauuuau

SEQ ID NO: 1219940 - RNA, 19 nt, Homo sapiens
uuaaaaccauaucagagau

SEQ ID NO: 1219941 - RNA, 24 nt, Homo sapiens
uuaaaacuaaaaaggaccagagaa

SEQ ID NO: 1219942 - RNA, 17 nt, Homo sapiens
uuaaaagaagacuggaa

SEQ ID NO: 1219943 - RNA, 23 nt, Homo sapiens
uuaaaagcaaguuucagugaagg

SEQ ID NO: 1219944 - RNA, 16 nt, Homo sapiens
uuaaaaggaaacugua

SEQ ID NO: 1219945 - RNA, 22 nt, Homo sapiens
uuaaaagucuauuuuauuauga

SEQ ID NO: 1219946 - RNA, 19 nt, Homo sapiens
uuaaaaguuauuuguucau

SEQ ID NO: 1219947 - RNA, 20 nt, Homo sapiens
uuaaaaguuugaaaagcaau

SEQ ID NO: 1219948 - RNA, 16 nt, Homo sapiens
uuaaaauaacuuguau

SEQ ID NO: 1219949 - RNA, 16 nt, Homo sapiens
uuaaaauaagcacugu

SEQ ID NO: 1219950 - RNA, 22 nt, Homo sapiens
uuaaaauaaugaacacuacaga

SEQ ID NO: 1219951 - RNA, 22 nt, Homo sapiens
uuaaaauauuuaucugauuaag

SEQ ID NO: 1219952 - RNA, 13 nt, Homo sapiens
uuaaaauucaauu

SEQ ID NO: 1219953 - RNA, 15 nt, Homo sapiens
uuaaaauucaauuag

SEQ ID NO: 1219954 - RNA, 20 nt, Homo sapiens
uuaaaauugcuauguuacua

SEQ ID NO: 1219955 - RNA, 18 nt, Homo sapiens
uuaaaauuguaaccugca

SEQ ID NO: 1219956 - RNA, 18 nt, Homo sapiens
uuaaaauuguaagcuccu

SEQ ID NO: 1219957 - RNA, 15 nt, Homo sapiens
uuaaacaaaaacuag

SEQ ID NO: 1219958 - RNA, 23 nt, Homo sapiens
uuaaacaaacauuguguugacau

SEQ ID NO: 1219959 - RNA, 11 nt, Homo sapiens
uuaaacacauu

SEQ ID NO: 1219960 - RNA, 15 nt, Homo sapiens
uuaaacaccuccuca

SEQ ID NO: 1219961 - RNA, 16 nt, Homo sapiens
uuaaacauacgacuua

SEQ ID NO: 1219962 - RNA, 22 nt, Homo sapiens
uuaaacauuaauagcagccuuu

SEQ ID NO: 1219963 - RNA, 19 nt, Homo sapiens
uuaaacucaagacaaugca

SEQ ID NO: 1219964 - RNA, 14 nt, Homo sapiens
uuaaacucagggac

SEQ ID NO: 1219965 - RNA, 19 nt, Homo sapiens
uuaaacucugcucaggaua

SEQ ID NO: 1219966 - RNA, 23 nt, Homo sapiens
uuaaacuuaagggaaaaguucuc

SEQ ID NO: 1219967 - RNA, 18 nt, Homo sapiens
uuaaacuuaccugggcau

SEQ ID NO: 1219968 - RNA, 15 nt, Homo sapiens
uuaaagaaccaucag

SEQ ID NO: 1219969 - RNA, 17 nt, Homo sapiens
uuaaagagggacaggcu

SEQ ID NO: 1219970 - RNA, 15 nt, Homo sapiens
uuaaagagucuagau

SEQ ID NO: 1219971 - RNA, 18 nt, Homo sapiens
uuaaagaugaacucugaa

SEQ ID NO: 1219972 - RNA, 12 nt, Homo sapiens
uuaaagcaaaaa

SEQ ID NO: 1219973 - RNA, 11 nt, Homo sapiens
uuaaagcacuu

SEQ ID NO: 1219974 - RNA, 20 nt, Homo sapiens
uuaaagccuuuagagccagc

SEQ ID NO: 1219975 - RNA, 17 nt, Homo sapiens
uuaaagccuuuaguauc

SEQ ID NO: 1219976 - RNA, 16 nt, Homo sapiens
uuaaaggaaaaucaca

SEQ ID NO: 1219977 - RNA, 17 nt, Homo sapiens
uuaaaguguaauaauau

SEQ ID NO: 1219978 - RNA, 21 nt, Homo sapiens
uuaaauaaaggaaauuuagau

SEQ ID NO: 1219979 - RNA, 15 nt, Homo sapiens
uuaaauaagauucua

SEQ ID NO: 1219980 - RNA, 22 nt, Homo sapiens
uuaaauaaguaaaagcuacuau

SEQ ID NO: 1219981 - RNA, 17 nt, Homo sapiens
uuaaauaauuucuacuc

SEQ ID NO: 1219982 - RNA, 20 nt, Homo sapiens
uuaaauagagaaauaugauu

SEQ ID NO: 1219983 - RNA, 22 nt, Homo sapiens
uuaaauauauuuuaaagcacuu

SEQ ID NO: 1219984 - RNA, 16 nt, Homo sapiens
uuaaaucaaaagggag

SEQ ID NO: 1219985 - RNA, 21 nt, Homo sapiens
uuaaaucaagagcuuacauaa

SEQ ID NO: 1219986 - RNA, 17 nt, Homo sapiens
uuaaaucucaaauuuau

SEQ ID NO: 1219987 - RNA, 20 nt, Homo sapiens
uuaaaugaacuugauagcua

SEQ ID NO: 1219988 - RNA, 15 nt, Homo sapiens
uuaaaugcucucuca

SEQ ID NO: 1219989 - RNA, 15 nt, Homo sapiens
uuaaauggcuuuaug

SEQ ID NO: 1219990 - RNA, 13 nt, Homo sapiens
uuaaaugguaaua

SEQ ID NO: 1219991 - RNA, 18 nt, Homo sapiens
uuaaauguccguguaaaa

SEQ ID NO: 1219992 - RNA, 14 nt, Homo sapiens
uuaaauuacaauuu

SEQ ID NO: 1219993 - RNA, 20 nt, Homo sapiens
uuaaauugaauaaaauacuc

SEQ ID NO: 1219994 - RNA, 16 nt, Homo sapiens
uuaaauuguaaaugaa

SEQ ID NO: 1219995 - RNA, 17 nt, Homo sapiens
uuaaauuuggcucuaaa

SEQ ID NO: 1219996 - RNA, 15 nt, Homo sapiens
uuaacaaaauccuca

SEQ ID NO: 1219997 - RNA, 23 nt, Homo sapiens
uuaacaaauuauguuacaucugu

SEQ ID NO: 1219998 - RNA, 14 nt, Homo sapiens
uuaacacauaacua

SEQ ID NO: 1219999 - RNA, 12 nt, Homo sapiens
uuaacaccagaa

SEQ ID NO: 1220000 - RNA, 21 nt, Homo sapiens
uuaacacccuuuagaaccuua

SEQ ID NO: 1220001 - RNA, 21 nt, Homo sapiens
uuaacacuuuggacuucucug

SEQ ID NO: 1220002 - RNA, 21 nt, Homo sapiens
uuaacagagauugaacuccaa

SEQ ID NO: 1220003 - RNA, 21 nt, Homo sapiens
uuaacagauggaaaaacugag

SEQ ID NO: 1220004 - RNA, 15 nt, Homo sapiens
uuaacagcaugcugc

SEQ ID NO: 1220005 - RNA, 11 nt, Homo sapiens
uuaacaucuca

SEQ ID NO: 1220006 - RNA, 18 nt, Homo sapiens
uuaacauggacaugaucu

SEQ ID NO: 1220007 - RNA, 11 nt, Homo sapiens
uuaacaugucg

SEQ ID NO: 1220008 - RNA, 13 nt, Homo sapiens
uuaaccuuuccag

SEQ ID NO: 1220009 - RNA, 16 nt, Homo sapiens
uuaaccuuugcuaugu

SEQ ID NO: 1220010 - RNA, 14 nt, Homo sapiens
uuagaagucacaca

SEQ ID NO: 1220011 - RNA, 16 nt, Homo sapiens
uuagaagucacacagu

SEQ ID NO: 1220012 - RNA, 16 nt, Homo sapiens
uuagaauaaauuucag

SEQ ID NO: 1220013 - RNA, 21 nt, Homo sapiens
uuagaaugggaucacgaggaa

SEQ ID NO: 1220014 - RNA, 19 nt, Homo sapiens
uuagaauuaaaaaagcaua

SEQ ID NO: 1220015 - RNA, 23 nt, Homo sapiens
uuagacagcaguaguagcucccu

SEQ ID NO: 1220016 - RNA, 14 nt, Homo sapiens
uuagacauaacaaa

SEQ ID NO: 1220017 - RNA, 18 nt, Homo sapiens
uuagacauaacaaaacac

SEQ ID NO: 1220018 - RNA, 15 nt, Homo sapiens
uuagacucaaagaau

SEQ ID NO: 1220019 - RNA, 13 nt, Homo sapiens
uuagacucagcau

SEQ ID NO: 1220020 - RNA, 23 nt, Homo sapiens
uuagacuguaggaagaguagcau

SEQ ID NO: 1220021 - RNA, 17 nt, Homo sapiens
uuagagaaugcuugaau

SEQ ID NO: 1220022 - RNA, 13 nt, Homo sapiens
uuagagaauguuc

SEQ ID NO: 1220023 - RNA, 22 nt, Homo sapiens
uuagagggaaguugaaagccaa

SEQ ID NO: 1220024 - RNA, 22 nt, Homo sapiens
uuagauacagagacuuggggaa

SEQ ID NO: 1220025 - RNA, 12 nt, Homo sapiens
uuagauauugcu

SEQ ID NO: 1220026 - RNA, 17 nt, Homo sapiens
uuagaucuuauauuggu

SEQ ID NO: 1220027 - RNA, 22 nt, Homo sapiens
uuagauguuucaacugugcucu

SEQ ID NO: 1220028 - RNA, 16 nt, Homo sapiens
uuagcaauaacauaca

SEQ ID NO: 1220029 - RNA, 21 nt, Homo sapiens
uuagcauaaaauuuucuacuc

SEQ ID NO: 1220030 - RNA, 13 nt, Homo sapiens
uuagcaugcugcu

SEQ ID NO: 1220031 - RNA, 18 nt, Homo sapiens
uuagcauucugaaagaag

SEQ ID NO: 1220032 - RNA, 23 nt, Homo sapiens
uuagccagagaugcaauauaucc

SEQ ID NO: 1220033 - RNA, 16 nt, Homo sapiens
uuagccagauuugucu

SEQ ID NO: 1220034 - RNA, 17 nt, Homo sapiens
uuagccagguaauguga

SEQ ID NO: 1220035 - RNA, 18 nt, Homo sapiens
uuagccgacugcgcugcu

SEQ ID NO: 1220036 - RNA, 22 nt, Homo sapiens
uuagcuaccucacuaugcugcu

SEQ ID NO: 1220037 - RNA, 23 nt, Homo sapiens
uuagcucucuuggguucccaaau

SEQ ID NO: 1220038 - RNA, 15 nt, Homo sapiens
uuagcuguacuauaa

SEQ ID NO: 1220039 - RNA, 12 nt, Homo sapiens
uuagcuuuacaa

SEQ ID NO: 1220040 - RNA, 17 nt, Homo sapiens
uuaggaaaggagaucaa

SEQ ID NO: 1220041 - RNA, 23 nt, Homo sapiens
uuaggaagaagugguacuagugu

SEQ ID NO: 1220042 - RNA, 16 nt, Homo sapiens
uuaggaaggccuucag

SEQ ID NO: 1220043 - RNA, 14 nt, Homo sapiens
uuaggagaaaccag

SEQ ID NO: 1220044 - RNA, 20 nt, Homo sapiens
uuaggagacgcugcacuuga

SEQ ID NO: 1220045 - RNA, 18 nt, Homo sapiens
uuaggaguaccauaauuc

SEQ ID NO: 1220046 - RNA, 23 nt, Homo sapiens
uuaggauuuaacagucauuuaaa

SEQ ID NO: 1220047 - RNA, 18 nt, Homo sapiens
uuaggauuuucacauucu

SEQ ID NO: 1220048 - RNA, 16 nt, Homo sapiens
uuaggccauauauauu

SEQ ID NO: 1220049 - RNA, 22 nt, Homo sapiens
uuagggggagcccuggugcuac

SEQ ID NO: 1220050 - RNA, 21 nt, Homo sapiens
uuaggucagcagccucccuga

SEQ ID NO: 1220051 - RNA, 22 nt, Homo sapiens
uuagguuuuuuuuuuuuuuaac

SEQ ID NO: 1220052 - RNA, 16 nt, Homo sapiens
uuaguagagacagggu

SEQ ID NO: 1220053 - RNA, 16 nt, Homo sapiens
uuaguauuuuaauccu

SEQ ID NO: 1220054 - RNA, 17 nt, Homo sapiens
uuaguccaauuccuugc

SEQ ID NO: 1220055 - RNA, 11 nt, Homo sapiens
uuagucuccca

SEQ ID NO: 1220056 - RNA, 18 nt, Homo sapiens
uuaguggauuacugccau

SEQ ID NO: 1220057 - RNA, 20 nt, Homo sapiens
uuaguggcucaacauugugu

SEQ ID NO: 1220058 - RNA, 16 nt, Homo sapiens
uuaguguuuugccuca

SEQ ID NO: 1220059 - RNA, 13 nt, Homo sapiens
uuaguuaaucucc

SEQ ID NO: 1220060 - RNA, 14 nt, Homo sapiens
uuaguucaauacag

SEQ ID NO: 1220061 - RNA, 13 nt, Homo sapiens
uuaguuguuauua

SEQ ID NO: 1220062 - RNA, 17 nt, Homo sapiens
uuauaaaaaaugguuca

SEQ ID NO: 1220063 - RNA, 23 nt, Homo sapiens
uuauaaaagaauaaaauugcacu

SEQ ID NO: 1220064 - RNA, 20 nt, Homo sapiens
uuauaaacccacauucuuac

SEQ ID NO: 1220065 - RNA, 21 nt, Homo sapiens
uuauaaauaaacuguugcucg

SEQ ID NO: 1220066 - RNA, 13 nt, Homo sapiens
uuauaacaagugu

SEQ ID NO: 1220067 - RNA, 13 nt, Homo sapiens
uuauaacucugua

SEQ ID NO: 1220068 - RNA, 13 nt, Homo sapiens
uuauaaguucaca

SEQ ID NO: 1220069 - RNA, 19 nt, Homo sapiens
uuauaauaaaauugguguu

SEQ ID NO: 1220070 - RNA, 18 nt, Homo sapiens
uuauaauuggugcauagc

SEQ ID NO: 1220071 - RNA, 18 nt, Homo sapiens
uuauacaaaccuaccaaa

SEQ ID NO: 1220072 - RNA, 19 nt, Homo sapiens
uuauacaauauacuuguau

SEQ ID NO: 1220073 - RNA, 13 nt, Homo sapiens
uuauacagugaua

SEQ ID NO: 1220074 - RNA, 15 nt, Homo sapiens
uuauacagugauaaa

SEQ ID NO: 1220075 - RNA, 14 nt, Homo sapiens
uuauacaugugaua

SEQ ID NO: 1220076 - RNA, 13 nt, Homo sapiens
uuauacauuugau

SEQ ID NO: 1220077 - RNA, 23 nt, Homo sapiens
uuauacccccaggaaacuagcuu

SEQ ID NO: 1220078 - RNA, 15 nt, Homo sapiens
uuauacuacaauaau

SEQ ID NO: 1220079 - RNA, 14 nt, Homo sapiens
uuauacuacuuugu

SEQ ID NO: 1220080 - RNA, 19 nt, Homo sapiens
uuauacuguagcugaugaa

SEQ ID NO: 1220081 - RNA, 16 nt, Homo sapiens
uuauagaaguagcaaa

SEQ ID NO: 1220082 - RNA, 19 nt, Homo sapiens
uuauagauguacauaccuc

SEQ ID NO: 1220083 - RNA, 13 nt, Homo sapiens
uuauagauucuaa

SEQ ID NO: 1220084 - RNA, 23 nt, Homo sapiens
uuauaggaaaaaaacugggauaa

SEQ ID NO: 1220085 - RNA, 18 nt, Homo sapiens
uuauaggacgaaugccaa

SEQ ID NO: 1220086 - RNA, 14 nt, Homo sapiens
uuauagucuuccag

SEQ ID NO: 1220087 - RNA, 16 nt, Homo sapiens
uuauauacaguacaca

SEQ ID NO: 1220088 - RNA, 18 nt, Homo sapiens
uuauauagguugugcaaa

SEQ ID NO: 1220089 - RNA, 13 nt, Homo sapiens
uuauauauaaaga

SEQ ID NO: 1220090 - RNA, 16 nt, Homo sapiens
uuauauauaaagaagg

SEQ ID NO: 1220091 - RNA, 22 nt, Homo sapiens
uuauauauacaguaacuuuaug

SEQ ID NO: 1220092 - RNA, 17 nt, Homo sapiens
uuauaucagauucuugg

SEQ ID NO: 1220093 - RNA, 18 nt, Homo sapiens
uuauaucuguaaugauac

SEQ ID NO: 1220094 - RNA, 19 nt, Homo sapiens
uuauauguagccuuuacug

SEQ ID NO: 1220095 - RNA, 18 nt, Homo sapiens
uuauauugcaagcuccau

SEQ ID NO: 1220096 - RNA, 19 nt, Homo sapiens
uuauauuucacaggcugua

SEQ ID NO: 1220097 - RNA, 14 nt, Homo sapiens
uuauauuucacuau

SEQ ID NO: 1220098 - RNA, 19 nt, Homo sapiens
uuaucacacuucugugaga

SEQ ID NO: 1220099 - RNA, 17 nt, Homo sapiens
uuaucagaauucucaga

SEQ ID NO: 1220100 - RNA, 22 nt, Homo sapiens
uuaucauuaaaaggaaagcaga

SEQ ID NO: 1220101 - RNA, 11 nt, Homo sapiens
uuauccaaauu

SEQ ID NO: 1220102 - RNA, 17 nt, Homo sapiens
uuaucgaaauaacaaug

SEQ ID NO: 1220103 - RNA, 16 nt, Homo sapiens
uuaucuaucaacuaua

SEQ ID NO: 1220104 - RNA, 21 nt, Homo sapiens
uuaucuauuccugaaauuucu

SEQ ID NO: 1220105 - RNA, 15 nt, Homo sapiens
uuaucucugaggcua

SEQ ID NO: 1220106 - RNA, 20 nt, Homo sapiens
uuaucugugcgugaaacaca

SEQ ID NO: 1220107 - RNA, 23 nt, Homo sapiens
uuaucugugcgugaaacacacca

SEQ ID NO: 1220108 - RNA, 15 nt, Homo sapiens
uuaucuugucucugg

SEQ ID NO: 1220109 - RNA, 21 nt, Homo sapiens
uuaugaaaaauaagucacuua

SEQ ID NO: 1220110 - RNA, 23 nt, Homo sapiens
uuaugaaauaaagaaauugcaau

SEQ ID NO: 1220111 - RNA, 12 nt, Homo sapiens
uuaugaaugaca

SEQ ID NO: 1220112 - RNA, 22 nt, Homo sapiens
uuaugauuacuaucauggcaua

SEQ ID NO: 1220113 - RNA, 22 nt, Homo sapiens
uuaugcaguaaauuaucuuggg

SEQ ID NO: 1220114 - RNA, 17 nt, Homo sapiens
uuaugcuaccuacugau

SEQ ID NO: 1220115 - RNA, 16 nt, Homo sapiens
uuaugcuaugaagagu

SEQ ID NO: 1220116 - RNA, 11 nt, Homo sapiens
uuaugcugcug

SEQ ID NO: 1220117 - RNA, 12 nt, Homo sapiens
uuaugcugucau

SEQ ID NO: 1220118 - RNA, 13 nt, Homo sapiens
uuaugcugugaca

SEQ ID NO: 1220119 - RNA, 16 nt, Homo sapiens
uuauggaaaacugugu

SEQ ID NO: 1220120 - RNA, 10 nt, Homo sapiens
uuauguacug

SEQ ID NO: 1220121 - RNA, 11 nt, Homo sapiens
uuauguacugc

SEQ ID NO: 1220122 - RNA, 13 nt, Homo sapiens
uuauguacuguac

SEQ ID NO: 1220123 - RNA, 13 nt, Homo sapiens
uuauguacuugau

SEQ ID NO: 1220124 - RNA, 21 nt, Homo sapiens
uuauguaugaaaaguaacuga

SEQ ID NO: 1220125 - RNA, 14 nt, Homo sapiens
uuauguuagcauug

SEQ ID NO: 1220126 - RNA, 20 nt, Homo sapiens
uuauguuuuaaacacaugcc

SEQ ID NO: 1220127 - RNA, 16 nt, Homo sapiens
uuauguuuucaacuca

SEQ ID NO: 1220128 - RNA, 17 nt, Homo sapiens
uuauuacauggggucua

SEQ ID NO: 1220129 - RNA, 14 nt, Homo sapiens
uuauuacauguaau

SEQ ID NO: 1220130 - RNA, 19 nt, Homo sapiens
uuauuacauguaauuugau

SEQ ID NO: 1220131 - RNA, 18 nt, Homo sapiens
uuauuaccccacacaucc

SEQ ID NO: 1220132 - RNA, 12 nt, Homo sapiens
uuauuaccucug

SEQ ID NO: 1220133 - RNA, 21 nt, Homo sapiens
uuauuaccucugauaccucaa

SEQ ID NO: 1220134 - RNA, 13 nt, Homo sapiens
uuauuaugucuca

SEQ ID NO: 1220135 - RNA, 13 nt, Homo sapiens
uuauuauuucuau

SEQ ID NO: 1220136 - RNA, 23 nt, Homo sapiens
uuauucagaaccuaaaaguauua

SEQ ID NO: 1220137 - RNA, 16 nt, Homo sapiens
uuauucgaaccacuga

SEQ ID NO: 1220138 - RNA, 17 nt, Homo sapiens
uugccaugugugcugaa

SEQ ID NO: 1220139 - RNA, 20 nt, Homo sapiens
uugcccaggcuggagugcaa

SEQ ID NO: 1220140 - RNA, 21 nt, Homo sapiens
uugcccaggcuggagugcagu

SEQ ID NO: 1220141 - RNA, 15 nt, Homo sapiens
uugcccauuuacacu

SEQ ID NO: 1220142 - RNA, 14 nt, Homo sapiens
uugccccacaguug

SEQ ID NO: 1220143 - RNA, 23 nt, Homo sapiens
uugcccccagauacauggugaug

SEQ ID NO: 1220144 - RNA, 17 nt, Homo sapiens
uugcccuucacaguguu

SEQ ID NO: 1220145 - RNA, 19 nt, Homo sapiens
uugcccuugcccugaccuc

SEQ ID NO: 1220146 - RNA, 21 nt, Homo sapiens
uugccgucucaucuucucuca

SEQ ID NO: 1220147 - RNA, 19 nt, Homo sapiens
uugccuaagacuugcccaa

SEQ ID NO: 1220148 - RNA, 15 nt, Homo sapiens
uugccuaagcauugc

SEQ ID NO: 1220149 - RNA, 14 nt, Homo sapiens
uugccucaccuaau

SEQ ID NO: 1220150 - RNA, 17 nt, Homo sapiens
uugccuccucacccacc

SEQ ID NO: 1220151 - RNA, 22 nt, Homo sapiens
uugccuccuguucugcccacga

SEQ ID NO: 1220152 - RNA, 20 nt, Homo sapiens
uugccugggggcuuuugcca

SEQ ID NO: 1220153 - RNA, 14 nt, Homo sapiens
uugccuggugaaug

SEQ ID NO: 1220154 - RNA, 20 nt, Homo sapiens
uugccuucuccacuuuggga

SEQ ID NO: 1220155 - RNA, 17 nt, Homo sapiens
uugcguggacucugcac

SEQ ID NO: 1220156 - RNA, 15 nt, Homo sapiens
uugcuaaaagauuau

SEQ ID NO: 1220157 - RNA, 22 nt, Homo sapiens
uugcuaagaagcgagcacugac

SEQ ID NO: 1220158 - RNA, 13 nt, Homo sapiens
uugcuaccaguau

SEQ ID NO: 1220159 - RNA, 15 nt, Homo sapiens
uugcuaccucaaggg

SEQ ID NO: 1220160 - RNA, 11 nt, Homo sapiens
uugcuacugua

SEQ ID NO: 1220161 - RNA, 14 nt, Homo sapiens
uugcucacagcuga

SEQ ID NO: 1220162 - RNA, 14 nt, Homo sapiens
uugcucaguuccau

SEQ ID NO: 1220163 - RNA, 23 nt, Homo sapiens
uugcucauaagcaauaccagcaa

SEQ ID NO: 1220164 - RNA, 20 nt, Homo sapiens
uugcucuaggaagacauuuu

SEQ ID NO: 1220165 - RNA, 21 nt, Homo sapiens
uugcucuuggaaagcugauga

SEQ ID NO: 1220166 - RNA, 13 nt, Homo sapiens
uugcucuuuggua

SEQ ID NO: 1220167 - RNA, 20 nt, Homo sapiens
uugcugauggguaguaccug

SEQ ID NO: 1220168 - RNA, 12 nt, Homo sapiens
uugcugcacuuu

SEQ ID NO: 1220169 - RNA, 12 nt, Homo sapiens
uugcugccacau

SEQ ID NO: 1220170 - RNA, 14 nt, Homo sapiens
uugcuggacuguca

SEQ ID NO: 1220171 - RNA, 16 nt, Homo sapiens
uugcugguagcacuug

SEQ ID NO: 1220172 - RNA, 11 nt, Homo sapiens
uugcuguauau

SEQ ID NO: 1220173 - RNA, 17 nt, Homo sapiens
uugcuuauguaaucuca

SEQ ID NO: 1220174 - RNA, 15 nt, Homo sapiens
uugcuuauucacuga

SEQ ID NO: 1220175 - RNA, 16 nt, Homo sapiens
uugcuucagacaugua

SEQ ID NO: 1220176 - RNA, 23 nt, Homo sapiens
uugcuucccggcgucccuaccuc

SEQ ID NO: 1220177 - RNA, 18 nt, Homo sapiens
uugcuuccgccacucagc

SEQ ID NO: 1220178 - RNA, 20 nt, Homo sapiens
uugcuucucauccccagucc

SEQ ID NO: 1220179 - RNA, 18 nt, Homo sapiens
uugcuucuccagugguga

SEQ ID NO: 1220180 - RNA, 12 nt, Homo sapiens
uugcuuuacucu

SEQ ID NO: 1220181 - RNA, 14 nt, Homo sapiens
uuggaaaaucaaga

SEQ ID NO: 1220182 - RNA, 14 nt, Homo sapiens
uuggaaaguacucc

SEQ ID NO: 1220183 - RNA, 21 nt, Homo sapiens
uuggaacuauacccgggacca

SEQ ID NO: 1220184 - RNA, 21 nt, Homo sapiens
uuggaagaaaaaaaucuucuc

SEQ ID NO: 1220185 - RNA, 15 nt, Homo sapiens
uuggaagaccagaau

SEQ ID NO: 1220186 - RNA, 14 nt, Homo sapiens
uuggaagagaauca

SEQ ID NO: 1220187 - RNA, 19 nt, Homo sapiens
uuggaauaaagucaaccuu

SEQ ID NO: 1220188 - RNA, 13 nt, Homo sapiens
uuggaauggugua

SEQ ID NO: 1220189 - RNA, 19 nt, Homo sapiens
uuggaccgauaagugugcu

SEQ ID NO: 1220190 - RNA, 19 nt, Homo sapiens
uuggaccuguucaaaaagg

SEQ ID NO: 1220191 - RNA, 16 nt, Homo sapiens
uuggacggaauggagg

SEQ ID NO: 1220192 - RNA, 20 nt, Homo sapiens
uuggacuauguaaaccacau

SEQ ID NO: 1220193 - RNA, 16 nt, Homo sapiens
uuggacucuugcucuu

SEQ ID NO: 1220194 - RNA, 19 nt, Homo sapiens
uuggacuguaagggauuga

SEQ ID NO: 1220195 - RNA, 21 nt, Homo sapiens
uuggagaguuugccuguucua

SEQ ID NO: 1220196 - RNA, 17 nt, Homo sapiens
uuggagcucauucuguc

SEQ ID NO: 1220197 - RNA, 20 nt, Homo sapiens
uuggagcugucccaccugca

SEQ ID NO: 1220198 - RNA, 20 nt, Homo sapiens
uuggagggcccacuuguauc

SEQ ID NO: 1220199 - RNA, 20 nt, Homo sapiens
uuggagggguauuuuugccc

SEQ ID NO: 1220200 - RNA, 18 nt, Homo sapiens
uuggagguaaauuauguc

SEQ ID NO: 1220201 - RNA, 16 nt, Homo sapiens
uuggaucuggcauuga

SEQ ID NO: 1220202 - RNA, 19 nt, Homo sapiens
uuggauggccuccauccag

SEQ ID NO: 1220203 - RNA, 20 nt, Homo sapiens
uuggcaaaagccuuguguau

SEQ ID NO: 1220204 - RNA, 15 nt, Homo sapiens
uuggcaguucugaua

SEQ ID NO: 1220205 - RNA, 13 nt, Homo sapiens
uuggccaaaaaga

SEQ ID NO: 1220206 - RNA, 13 nt, Homo sapiens
uuggccucuccuu

SEQ ID NO: 1220207 - RNA, 14 nt, Homo sapiens
uuggccucugcccu

SEQ ID NO: 1220208 - RNA, 23 nt, Homo sapiens
uuggccugucuuuggauuguuaa

SEQ ID NO: 1220209 - RNA, 17 nt, Homo sapiens
uuggccuucagaaccau

SEQ ID NO: 1220210 - RNA, 23 nt, Homo sapiens
uuggcgugguccaugcugaugau

SEQ ID NO: 1220211 - RNA, 17 nt, Homo sapiens
uuggcguuuggacccag

SEQ ID NO: 1220212 - RNA, 13 nt, Homo sapiens
uuggcucuacucc

SEQ ID NO: 1220213 - RNA, 18 nt, Homo sapiens
uuggcugauguugcagcc

SEQ ID NO: 1220214 - RNA, 15 nt, Homo sapiens
uuggcuucugugaug

SEQ ID NO: 1220215 - RNA, 16 nt, Homo sapiens
uugggagacaugugac

SEQ ID NO: 1220216 - RNA, 13 nt, Homo sapiens
uugggagcacugg

SEQ ID NO: 1220217 - RNA, 21 nt, Homo sapiens
uugggauauucugaaacuuga

SEQ ID NO: 1220218 - RNA, 18 nt, Homo sapiens
uugggaugggaucccagg

SEQ ID NO: 1220219 - RNA, 20 nt, Homo sapiens
uugggcaaaacccaggacau

SEQ ID NO: 1220220 - RNA, 22 nt, Homo sapiens
uugggcagagcuggcucugagc

SEQ ID NO: 1220221 - RNA, 13 nt, Homo sapiens
uugggccugagua

SEQ ID NO: 1220222 - RNA, 16 nt, Homo sapiens
uuggggcagaccccag

SEQ ID NO: 1220223 - RNA, 16 nt, Homo sapiens
uuggggccaccaaagc

SEQ ID NO: 1220224 - RNA, 20 nt, Homo sapiens
uuggggcuaauuuaacaaga

SEQ ID NO: 1220225 - RNA, 16 nt, Homo sapiens
uuggggcuuuacauac

SEQ ID NO: 1220226 - RNA, 16 nt, Homo sapiens
uuggggguuugagggu

SEQ ID NO: 1220227 - RNA, 15 nt, Homo sapiens
uugggugaaucuuga

SEQ ID NO: 1220228 - RNA, 16 nt, Homo sapiens
uugguaaauucacaaa

SEQ ID NO: 1220229 - RNA, 13 nt, Homo sapiens
uugguaagagaca

SEQ ID NO: 1220230 - RNA, 17 nt, Homo sapiens
uugguaaucucugugaa

SEQ ID NO: 1220231 - RNA, 16 nt, Homo sapiens
uugguaccauggugua

SEQ ID NO: 1220232 - RNA, 17 nt, Homo sapiens
uugguauuacacaguca

SEQ ID NO: 1220233 - RNA, 23 nt, Homo sapiens
uuggucucugcccugccuacuuu

SEQ ID NO: 1220234 - RNA, 17 nt, Homo sapiens
uuggucugggacuuccu

SEQ ID NO: 1220235 - RNA, 16 nt, Homo sapiens
uuggugaauuucacaa

SEQ ID NO: 1220236 - RNA, 19 nt, Homo sapiens
uuggugacaccucaccuca

SEQ ID NO: 1220237 - RNA, 13 nt, Homo sapiens
uugguuacuucau

SEQ ID NO: 1220238 - RNA, 13 nt, Homo sapiens
uugguuauucuaa

SEQ ID NO: 1220239 - RNA, 15 nt, Homo sapiens
uugguuguacuuugg

SEQ ID NO: 1220240 - RNA, 12 nt, Homo sapiens
uugguuuuggac

SEQ ID NO: 1220241 - RNA, 21 nt, Homo sapiens
uugguuuuguuuucuucacua

SEQ ID NO: 1220242 - RNA, 20 nt, Homo sapiens
uuguaaaauauuuaugagaa

SEQ ID NO: 1220243 - RNA, 19 nt, Homo sapiens
uuguaaacguuucaguaau

SEQ ID NO: 1220244 - RNA, 17 nt, Homo sapiens
uuguaaagaaauuuacu

SEQ ID NO: 1220245 - RNA, 20 nt, Homo sapiens
uuguaaauacacauagcaug

SEQ ID NO: 1220246 - RNA, 17 nt, Homo sapiens
uuguaacaauagcacaa

SEQ ID NO: 1220247 - RNA, 22 nt, Homo sapiens
uuguaacgacuucuccaucucc

SEQ ID NO: 1220248 - RNA, 21 nt, Homo sapiens
uuguaagaaagacaagacauu

SEQ ID NO: 1220249 - RNA, 20 nt, Homo sapiens
uuguaagcccacaguaggca

SEQ ID NO: 1220250 - RNA, 18 nt, Homo sapiens
uuguaagguggucacugu

SEQ ID NO: 1220251 - RNA, 22 nt, Homo sapiens
uuguaagugagagagacaagaa

SEQ ID NO: 1220252 - RNA, 23 nt, Homo sapiens
uuguaauaaauacugcagcuuga

SEQ ID NO: 1220253 - RNA, 17 nt, Homo sapiens
uuguaaugcugcacaga

SEQ ID NO: 1220254 - RNA, 16 nt, Homo sapiens
uuguacagaauauuuc

SEQ ID NO: 1220255 - RNA, 15 nt, Homo sapiens
uuguacaggacugua

SEQ ID NO: 1220256 - RNA, 20 nt, Homo sapiens
uuguacaggcuggucucaaa

SEQ ID NO: 1220257 - RNA, 19 nt, Homo sapiens
uuguacauauuuguggaau

SEQ ID NO: 1220258 - RNA, 11 nt, Homo sapiens
uuguacugaua

SEQ ID NO: 1220259 - RNA, 15 nt, Homo sapiens
uuguacugauauaau

SEQ ID NO: 1220260 - RNA, 21 nt, Homo sapiens
uuguacuuuuuuuuacuuugg

SEQ ID NO: 1220261 - RNA, 18 nt, Homo sapiens
uuguaggagaaacuccca

SEQ ID NO: 1220262 - RNA, 20 nt, Homo sapiens
uuguauaggggcaacuguau

SEQ ID NO: 1220263 - RNA, 16 nt, Homo sapiens
uuguauauuauggaag

SEQ ID NO: 1220264 - RNA, 20 nt, Homo sapiens
uuguauauuuuuuucuuaau

SEQ ID NO: 1220265 - RNA, 23 nt, Homo sapiens
uuuuacaauaaaacuuugcugcc

SEQ ID NO: 1220266 - RNA, 15 nt, Homo sapiens
uuuuacacugauaaa

SEQ ID NO: 1220267 - RNA, 17 nt, Homo sapiens
uuuuacagugcuauuua

SEQ ID NO: 1220268 - RNA, 13 nt, Homo sapiens
uuuuacuuuggca

SEQ ID NO: 1220269 - RNA, 22 nt, Homo sapiens
uuuuagaauuaaaaaagcauac

SEQ ID NO: 1220270 - RNA, 16 nt, Homo sapiens
uuuuagcauugucuug

SEQ ID NO: 1220271 - RNA, 18 nt, Homo sapiens
uuuuagggagaacgggaa

SEQ ID NO: 1220272 - RNA, 16 nt, Homo sapiens
uuuuagugacuguaau

SEQ ID NO: 1220273 - RNA, 14 nt, Homo sapiens
uuuuagugugugca

SEQ ID NO: 1220274 - RNA, 16 nt, Homo sapiens
uuuuauaaaagccuug

SEQ ID NO: 1220275 - RNA, 18 nt, Homo sapiens
uuuuauaccaaagccaau

SEQ ID NO: 1220276 - RNA, 16 nt, Homo sapiens
uuuuauaucaugcaaa

SEQ ID NO: 1220277 - RNA, 23 nt, Homo sapiens
uuuuauaugucuaauaucuuaau

SEQ ID NO: 1220278 - RNA, 20 nt, Homo sapiens
uuuuauccuagucauucuuc

SEQ ID NO: 1220279 - RNA, 15 nt, Homo sapiens
uuuuaucuugcacuu

SEQ ID NO: 1220280 - RNA, 18 nt, Homo sapiens
uuuuaugauuugucucug

SEQ ID NO: 1220281 - RNA, 18 nt, Homo sapiens
uuuuauuaauuuauaugu

SEQ ID NO: 1220282 - RNA, 21 nt, Homo sapiens
uuuucaaagauguguugcuau

SEQ ID NO: 1220283 - RNA, 12 nt, Homo sapiens
uuuucaucugaa

SEQ ID NO: 1220284 - RNA, 12 nt, Homo sapiens
uuuuccacccau

SEQ ID NO: 1220285 - RNA, 23 nt, Homo sapiens
uuuucccccuugaggauugugga

SEQ ID NO: 1220286 - RNA, 12 nt, Homo sapiens
uuuuccuauaau

SEQ ID NO: 1220287 - RNA, 19 nt, Homo sapiens
uuuuccugcuuucaggaaa

SEQ ID NO: 1220288 - RNA, 16 nt, Homo sapiens
uuuuccuuuagaucaa

SEQ ID NO: 1220289 - RNA, 20 nt, Homo sapiens
uuuuccuuuuuugucuauga

SEQ ID NO: 1220290 - RNA, 16 nt, Homo sapiens
uuuucuaaacuuuaau

SEQ ID NO: 1220291 - RNA, 20 nt, Homo sapiens
uuuucuaaagggaucugcuu

SEQ ID NO: 1220292 - RNA, 18 nt, Homo sapiens
uuuucuaagaaaagcauu

SEQ ID NO: 1220293 - RNA, 21 nt, Homo sapiens
uuuucuaagguucucauagga

SEQ ID NO: 1220294 - RNA, 20 nt, Homo sapiens
uuuucuacaugaugcccugc

SEQ ID NO: 1220295 - RNA, 21 nt, Homo sapiens
uuuucuagaaauguuuagguu

SEQ ID NO: 1220296 - RNA, 16 nt, Homo sapiens
uuuucuauauucucau

SEQ ID NO: 1220297 - RNA, 14 nt, Homo sapiens
uuuucuaucaaaua

SEQ ID NO: 1220298 - RNA, 16 nt, Homo sapiens
uuuucuauuauggaaa

SEQ ID NO: 1220299 - RNA, 17 nt, Homo sapiens
uuuucucuaaugcuuga

SEQ ID NO: 1220300 - RNA, 21 nt, Homo sapiens
uuuucucuguguuuguuccua

SEQ ID NO: 1220301 - RNA, 15 nt, Homo sapiens
uuuucugauaaaaga

SEQ ID NO: 1220302 - RNA, 23 nt, Homo sapiens
uuuucugugauaacucugcaaag

SEQ ID NO: 1220303 - RNA, 13 nt, Homo sapiens
uuuucuucauuca

SEQ ID NO: 1220304 - RNA, 23 nt, Homo sapiens
uuuugaaacauacagaauguucu

SEQ ID NO: 1220305 - RNA, 12 nt, Homo sapiens
uuuugaaggcaa

SEQ ID NO: 1220306 - RNA, 20 nt, Homo sapiens
uuuugaggccuuuuuugcca

SEQ ID NO: 1220307 - RNA, 21 nt, Homo sapiens
uuuugaggccuuuuuugccag

SEQ ID NO: 1220308 - RNA, 18 nt, Homo sapiens
uuuugccaaggcaaaaaa

SEQ ID NO: 1220309 - RNA, 17 nt, Homo sapiens
uuuugccauaaugacuc

SEQ ID NO: 1220310 - RNA, 17 nt, Homo sapiens
uuuugccucaccuaaua

SEQ ID NO: 1220311 - RNA, 15 nt, Homo sapiens
uuuugcuacauucua

SEQ ID NO: 1220312 - RNA, 14 nt, Homo sapiens
uuuuggaaagucag

SEQ ID NO: 1220313 - RNA, 18 nt, Homo sapiens
uuuugguugggaaugagg

SEQ ID NO: 1220314 - RNA, 20 nt, Homo sapiens
uuuugguuuaaaaaguuuca

SEQ ID NO: 1220315 - RNA, 15 nt, Homo sapiens
uuuuguauaacuuaa

SEQ ID NO: 1220316 - RNA, 22 nt, Homo sapiens
uuuugucagaggcuccaaauag

SEQ ID NO: 1220317 - RNA, 13 nt, Homo sapiens
uuuugucuaugaa

SEQ ID NO: 1220318 - RNA, 19 nt, Homo sapiens
uuuugucuaugggacucaa

SEQ ID NO: 1220319 - RNA, 20 nt, Homo sapiens
uuuugucuguguugcuguuu

SEQ ID NO: 1220320 - RNA, 17 nt, Homo sapiens
uuuugugcaaagccaaa

SEQ ID NO: 1220321 - RNA, 13 nt, Homo sapiens
uuuuguuaccuuu

SEQ ID NO: 1220322 - RNA, 17 nt, Homo sapiens
uuuuguucucaacuuca

SEQ ID NO: 1220323 - RNA, 16 nt, Homo sapiens
uuuuuaaaaaaguaag

SEQ ID NO: 1220324 - RNA, 15 nt, Homo sapiens
uuuuuaacugauucu

SEQ ID NO: 1220325 - RNA, 17 nt, Homo sapiens
uuuuuagaaaucacaac

SEQ ID NO: 1220326 - RNA, 20 nt, Homo sapiens
uuuuuagcugguggcaauaa

SEQ ID NO: 1220327 - RNA, 12 nt, Homo sapiens
uuuuuagcuuua

SEQ ID NO: 1220328 - RNA, 19 nt, Homo sapiens
uuuuuauggcugaauaaua

SEQ ID NO: 1220329 - RNA, 23 nt, Homo sapiens
uuuuucacccauuuacacauauc

SEQ ID NO: 1220330 - RNA, 22 nt, Homo sapiens
uuuuuccugaugaugguggcug

SEQ ID NO: 1220331 - RNA, 21 nt, Homo sapiens
uuuuucuaaaacauuccccuc

SEQ ID NO: 1220332 - RNA, 22 nt, Homo sapiens
uuuuucuuugagacugggucuc

SEQ ID NO: 1220333 - RNA, 11 nt, Homo sapiens
uuuuugccauu

SEQ ID NO: 1220334 - RNA, 20 nt, Homo sapiens
uuuuuggaacuaaagcaaau

SEQ ID NO: 1220335 - RNA, 21 nt, Homo sapiens
uuuuuggggaaaaaagcacau

SEQ ID NO: 1220336 - RNA, 14 nt, Homo sapiens
uuuuuguaauguga

SEQ ID NO: 1220337 - RNA, 19 nt, Homo sapiens
uuuuuguuaucagucaaua

SEQ ID NO: 1220338 - RNA, 12 nt, Homo sapiens
uuuuuuccacaa

SEQ ID NO: 1220339 - RNA, 13 nt, Homo sapiens
uuuuuucccccac

SEQ ID NO: 1220340 - RNA, 13 nt, Homo sapiens
uuuuuuuauacug

SEQ ID NO: 1220341 - RNA, 23 nt, Homo sapiens
uguggacacagaucccacuggaa

SEQ ID NO: 1220342 - RNA, 13 nt, Homo sapiens
uguggacacagcu

SEQ ID NO: 1220343 - RNA, 20 nt, Homo sapiens
uguggaccucuacuuuccag

SEQ ID NO: 1220344 - RNA, 17 nt, Homo sapiens
uguggacuaaauaucug

SEQ ID NO: 1220345 - RNA, 16 nt, Homo sapiens
uguggaugagaggaac

SEQ ID NO: 1220346 - RNA, 15 nt, Homo sapiens
uguggaugucuuccu

SEQ ID NO: 1220347 - RNA, 21 nt, Homo sapiens
uguggauucuucccacacaga

SEQ ID NO: 1220348 - RNA, 21 nt, Homo sapiens
uguggcacucagggagcauuu

SEQ ID NO: 1220349 - RNA, 15 nt, Homo sapiens
uguggcagugguuuu

SEQ ID NO: 1220350 - RNA, 17 nt, Homo sapiens
uguggccaacugcaaaa

SEQ ID NO: 1220351 - RNA, 14 nt, Homo sapiens
uguggccaucugcu

SEQ ID NO: 1220352 - RNA, 14 nt, Homo sapiens
uguggcccaagaca

SEQ ID NO: 1220353 - RNA, 17 nt, Homo sapiens
uguggccgacucugcac

SEQ ID NO: 1220354 - RNA, 17 nt, Homo sapiens
uguggcugucaggacac

SEQ ID NO: 1220355 - RNA, 10 nt, Homo sapiens
ugugggaccg

SEQ ID NO: 1220356 - RNA, 19 nt, Homo sapiens
ugugggagaccgaggacac

SEQ ID NO: 1220357 - RNA, 22 nt, Homo sapiens
ugugggcuggugccccacagcu

SEQ ID NO: 1220358 - RNA, 13 nt, Homo sapiens
uguggggggugca

SEQ ID NO: 1220359 - RNA, 21 nt, Homo sapiens
ugugggucccgcacucugccc

SEQ ID NO: 1220360 - RNA, 21 nt, Homo sapiens
ugugguaggcacuguacuuaa

SEQ ID NO: 1220361 - RNA, 19 nt, Homo sapiens
uguggucacagccaugaag

SEQ ID NO: 1220362 - RNA, 21 nt, Homo sapiens
uguguacaguugguucauccc

SEQ ID NO: 1220363 - RNA, 22 nt, Homo sapiens
aaagucaccacuccauucccaa

SEQ ID NO: 1220364 - RNA, 14 nt, Homo sapiens
aaagucaucaaaga

SEQ ID NO: 1220365 - RNA, 19 nt, Homo sapiens
aaaguccaauuccaaagcc

SEQ ID NO: 1220366 - RNA, 19 nt, Homo sapiens
aaagucugucuuuccugaa

SEQ ID NO: 1220367 - RNA, 22 nt, Homo sapiens
aaagucuuugaagugacuucac

SEQ ID NO: 1220368 - RNA, 23 nt, Homo sapiens
aaagugacucacuuaucccaaga

SEQ ID NO: 1220369 - RNA, 12 nt, Homo sapiens
aaagugcugcug

SEQ ID NO: 1220370 - RNA, 16 nt, Homo sapiens
aaaguggacaaggagu

SEQ ID NO: 1220371 - RNA, 14 nt, Homo sapiens
aaagugggcuugau

SEQ ID NO: 1220372 - RNA, 14 nt, Homo sapiens
aaaguguaacaauu

SEQ ID NO: 1220373 - RNA, 14 nt, Homo sapiens
aaagugugagcaaa

SEQ ID NO: 1220374 - RNA, 14 nt, Homo sapiens
aaagugugggagac

SEQ ID NO: 1220375 - RNA, 19 nt, Homo sapiens
aaaguguguuucuauguga

SEQ ID NO: 1220376 - RNA, 20 nt, Homo sapiens
aaaguuacuagguaacuuca

SEQ ID NO: 1220377 - RNA, 17 nt, Homo sapiens
aaaguuauauucacagu

SEQ ID NO: 1220378 - RNA, 23 nt, Homo sapiens
aaaguuaugguacuauguuagcc

SEQ ID NO: 1220379 - RNA, 18 nt, Homo sapiens
aaaguuauuauguagcug

SEQ ID NO: 1220380 - RNA, 17 nt, Homo sapiens
aaaguuauuuaugcuau

SEQ ID NO: 1220381 - RNA, 15 nt, Homo sapiens
aaaguuccuuccuaa

SEQ ID NO: 1220382 - RNA, 16 nt, Homo sapiens
aaaguugagcgucauu

SEQ ID NO: 1220383 - RNA, 16 nt, Homo sapiens
aaaguuuaaagacacu

SEQ ID NO: 1220384 - RNA, 14 nt, Homo sapiens
aaaguuucagagaa

SEQ ID NO: 1220385 - RNA, 23 nt, Homo sapiens
aaaguuuccguggguucugucau

SEQ ID NO: 1220386 - RNA, 18 nt, Homo sapiens
aaaguuuuccaguauuga

SEQ ID NO: 1220387 - RNA, 20 nt, Homo sapiens
aaauaaaaaucucuuuucca

SEQ ID NO: 1220388 - RNA, 13 nt, Homo sapiens
aaauaaaacugag

SEQ ID NO: 1220389 - RNA, 14 nt, Homo sapiens
aaauaaacaucagu

SEQ ID NO: 1220390 - RNA, 14 nt, Homo sapiens
aaauaaaguaccac

SEQ ID NO: 1220391 - RNA, 15 nt, Homo sapiens
aaauaaauagcuaua

SEQ ID NO: 1220392 - RNA, 14 nt, Homo sapiens
aaauaaaugacaau

SEQ ID NO: 1220393 - RNA, 17 nt, Homo sapiens
aaauaaauucagaucaa

SEQ ID NO: 1220394 - RNA, 16 nt, Homo sapiens
aaauaacgccccagau

SEQ ID NO: 1220395 - RNA, 15 nt, Homo sapiens
aaauaacugaaccaa

SEQ ID NO: 1220396 - RNA, 20 nt, Homo sapiens
aaauaacuucaguccugcuc

SEQ ID NO: 1220397 - RNA, 15 nt, Homo sapiens
aaauaagaaugauuu

SEQ ID NO: 1220398 - RNA, 15 nt, Homo sapiens
aaauaagcccagugc

SEQ ID NO: 1220399 - RNA, 14 nt, Homo sapiens
aaauaaguuauaca

SEQ ID NO: 1220400 - RNA, 16 nt, Homo sapiens
aaauaauucuuccucu

SEQ ID NO: 1220401 - RNA, 11 nt, Homo sapiens
aaauacaauaa

SEQ ID NO: 1220402 - RNA, 22 nt, Homo sapiens
aaauacacagugcugaccagac

SEQ ID NO: 1220403 - RNA, 14 nt, Homo sapiens
aaauacacauagca

SEQ ID NO: 1220404 - RNA, 13 nt, Homo sapiens
aaauacauguuca

SEQ ID NO: 1220405 - RNA, 21 nt, Homo sapiens
aaauaccugucaauacuaugg

SEQ ID NO: 1220406 - RNA, 19 nt, Homo sapiens
aaauacuuuuacucugccu

SEQ ID NO: 1220407 - RNA, 15 nt, Homo sapiens
aaauagaaacuugcu

SEQ ID NO: 1220408 - RNA, 17 nt, Homo sapiens
aaauagaaccacuauga

SEQ ID NO: 1220409 - RNA, 18 nt, Homo sapiens
aaauagacaacucuucca

SEQ ID NO: 1220410 - RNA, 20 nt, Homo sapiens
aaauagaguaaauacaggua

SEQ ID NO: 1220411 - RNA, 13 nt, Homo sapiens
aaauagauccaau

SEQ ID NO: 1220412 - RNA, 19 nt, Homo sapiens
aaauagcacacuuuuccac

SEQ ID NO: 1220413 - RNA, 19 nt, Homo sapiens
aaauagcuauauccaugua

SEQ ID NO: 1220414 - RNA, 15 nt, Homo sapiens
aaauagcugccuuuu

SEQ ID NO: 1220415 - RNA, 19 nt, Homo sapiens
aaauaggagccgauggauc

SEQ ID NO: 1220416 - RNA, 16 nt, Homo sapiens
aaauagucuuccacaa

SEQ ID NO: 1220417 - RNA, 17 nt, Homo sapiens
aaauagucuuccacaaa

SEQ ID NO: 1220418 - RNA, 16 nt, Homo sapiens
aaauaguugcauagca

SEQ ID NO: 1220419 - RNA, 15 nt, Homo sapiens
aaauaguuguccaua

SEQ ID NO: 1220420 - RNA, 13 nt, Homo sapiens
aaauauacauuca

SEQ ID NO: 1220421 - RNA, 13 nt, Homo sapiens
aaauauacucaag

SEQ ID NO: 1220422 - RNA, 16 nt, Homo sapiens
aaauauacuggggcuu

SEQ ID NO: 1220423 - RNA, 16 nt, Homo sapiens
aaauauaguucacaau

SEQ ID NO: 1220424 - RNA, 17 nt, Homo sapiens
aaauauauagaaugauc

SEQ ID NO: 1220425 - RNA, 15 nt, Homo sapiens
aaauauauauaaaga

SEQ ID NO: 1220426 - RNA, 22 nt, Homo sapiens
aaauauauaugcauaccuggau

SEQ ID NO: 1220427 - RNA, 15 nt, Homo sapiens
aaauauauuguuaau

SEQ ID NO: 1220428 - RNA, 19 nt, Homo sapiens
aaauauauuguuaaucucu

SEQ ID NO: 1220429 - RNA, 18 nt, Homo sapiens
aaauaucauacuguucaa

SEQ ID NO: 1220430 - RNA, 17 nt, Homo sapiens
aaauauccaaagacugu

SEQ ID NO: 1220431 - RNA, 17 nt, Homo sapiens
aaauaucuugcuuucaa

SEQ ID NO: 1220432 - RNA, 13 nt, Homo sapiens
aaauaugagucau

SEQ ID NO: 1220433 - RNA, 21 nt, Homo sapiens
aaauaugaugagauucacuua

SEQ ID NO: 1220434 - RNA, 13 nt, Homo sapiens
aaauaugcaguga

SEQ ID NO: 1220435 - RNA, 12 nt, Homo sapiens
aaauaugcaucu

SEQ ID NO: 1220436 - RNA, 17 nt, Homo sapiens
aaauaugccuaguaaca

SEQ ID NO: 1220437 - RNA, 14 nt, Homo sapiens
aaauauguccuggg

SEQ ID NO: 1220438 - RNA, 19 nt, Homo sapiens
aaauauguugaguguucau

SEQ ID NO: 1220439 - RNA, 17 nt, Homo sapiens
aaauauugcuucaauaa

SEQ ID NO: 1220440 - RNA, 15 nt, Homo sapiens
aaauauuucccucac

SEQ ID NO: 1220441 - RNA, 17 nt, Homo sapiens
aaauauuugacuugcau

SEQ ID NO: 1220442 - RNA, 16 nt, Homo sapiens
aaauauuuuaaaggua

SEQ ID NO: 1220443 - RNA, 13 nt, Homo sapiens
aaauauuuugcuu

SEQ ID NO: 1220444 - RNA, 20 nt, Homo sapiens
aaauauuuuguaaugcugca

SEQ ID NO: 1220445 - RNA, 15 nt, Homo sapiens
aaauauuuuugccau

SEQ ID NO: 1220446 - RNA, 12 nt, Homo sapiens
aaaucaaaaagg

SEQ ID NO: 1220447 - RNA, 22 nt, Homo sapiens
aaaucaaaaagggaaugcauua

SEQ ID NO: 1220448 - RNA, 16 nt, Homo sapiens
aaaucaaauugcuuaa

SEQ ID NO: 1220449 - RNA, 21 nt, Homo sapiens
aaaucaacagaagcauuugua

SEQ ID NO: 1220450 - RNA, 15 nt, Homo sapiens
aaaucaacuugugua

SEQ ID NO: 1220451 - RNA, 13 nt, Homo sapiens
aaaucaagagcuu

SEQ ID NO: 1220452 - RNA, 18 nt, Homo sapiens
aaaucaauacacuaguug

SEQ ID NO: 1220453 - RNA, 16 nt, Homo sapiens
aaaucaaugaagcaag

SEQ ID NO: 1220454 - RNA, 15 nt, Homo sapiens
aaaucauuguagaaa

SEQ ID NO: 1220455 - RNA, 16 nt, Homo sapiens
aaaucauuuauuuaca

SEQ ID NO: 1220456 - RNA, 22 nt, Homo sapiens
aaaucauuucaguaucaucucc

SEQ ID NO: 1220457 - RNA, 17 nt, Homo sapiens
aaauccagaaguuuuaa

SEQ ID NO: 1220458 - RNA, 13 nt, Homo sapiens
aaauccaggucau

SEQ ID NO: 1220459 - RNA, 21 nt, Homo sapiens
aaauccuaagacacaaaugca

SEQ ID NO: 1220460 - RNA, 22 nt, Homo sapiens
aaauccucauguuacucagugu

SEQ ID NO: 1220461 - RNA, 22 nt, Homo sapiens
aaaucuaaaguugcuccauaca

SEQ ID NO: 1220462 - RNA, 11 nt, Homo sapiens
aaaucuauucc

SEQ ID NO: 1220463 - RNA, 19 nt, Homo sapiens
aaaucuauucuguguugca

SEQ ID NO: 1220464 - RNA, 23 nt, Homo sapiens
aaaucucuacugcuuuggauccu

SEQ ID NO: 1220465 - RNA, 13 nt, Homo sapiens
aaaucucuuccac

SEQ ID NO: 1220466 - RNA, 22 nt, Homo sapiens
aaaucugacauauuaugccuga

SEQ ID NO: 1220467 - RNA, 23 nt, Homo sapiens
aaaucugacauauuaugccugaa

SEQ ID NO: 1220468 - RNA, 12 nt, Homo sapiens
aaaucugaggga

SEQ ID NO: 1220469 - RNA, 16 nt, Homo sapiens
aaaucuguaagcucuu

SEQ ID NO: 1220470 - RNA, 19 nt, Homo sapiens
aaaucuucccaugcauucu

SEQ ID NO: 1220471 - RNA, 19 nt, Homo sapiens
aaaucuuuggauuugauca

SEQ ID NO: 1220472 - RNA, 19 nt, Homo sapiens
aaaugaaacaaauaaucac

SEQ ID NO: 1220473 - RNA, 15 nt, Homo sapiens
aaaugaaagcaugug

SEQ ID NO: 1220474 - RNA, 16 nt, Homo sapiens
aaaugaaccauucaca

SEQ ID NO: 1220475 - RNA, 14 nt, Homo sapiens
aaaugaacugcaua

SEQ ID NO: 1220476 - RNA, 21 nt, Homo sapiens
aaaugaaggcagaaaaauguc

SEQ ID NO: 1220477 - RNA, 22 nt, Homo sapiens
aaaugaaucucguucccaaaga

SEQ ID NO: 1220478 - RNA, 14 nt, Homo sapiens
aaaugaauguuguc

SEQ ID NO: 1220479 - RNA, 20 nt, Homo sapiens
aaaugagugagagaguucag

SEQ ID NO: 1220480 - RNA, 14 nt, Homo sapiens
aaaugauacaguau

SEQ ID NO: 1220481 - RNA, 19 nt, Homo sapiens
aaaugauauauaccacuuu

SEQ ID NO: 1220482 - RNA, 17 nt, Homo sapiens
aaaugaucgcuaucuag

SEQ ID NO: 1220483 - RNA, 17 nt, Homo sapiens
aaaugaugccacuuccc

SEQ ID NO: 1220484 - RNA, 13 nt, Homo sapiens
aaaugauucagcu

SEQ ID NO: 1220485 - RNA, 16 nt, Homo sapiens
aaaugauuuuaucugu

SEQ ID NO: 1220486 - RNA, 16 nt, Homo sapiens
aaaugcaaaguucugu

SEQ ID NO: 1220487 - RNA, 23 nt, Homo sapiens
aaaugcaagccaucucuaauaau

SEQ ID NO: 1220488 - RNA, 22 nt, Homo sapiens
aaaugcaauguaagcauacuuu

SEQ ID NO: 1220489 - RNA, 13 nt, Homo sapiens
aaaugcaccacuu

SEQ ID NO: 1220490 - RNA, 11 nt, Homo sapiens
aacucuucagu

SEQ ID NO: 1220491 - RNA, 13 nt, Homo sapiens
aacucuucagugc

SEQ ID NO: 1220492 - RNA, 21 nt, Homo sapiens
aacucuucgaagccuugccua

SEQ ID NO: 1220493 - RNA, 20 nt, Homo sapiens
aacucuucgggagacauguu

SEQ ID NO: 1220494 - RNA, 22 nt, Homo sapiens
aacucuuucuggccugccuucg

SEQ ID NO: 1220495 - RNA, 13 nt, Homo sapiens
aacugaaggcaua

SEQ ID NO: 1220496 - RNA, 20 nt, Homo sapiens
aacugaagugugcugugaca

SEQ ID NO: 1220497 - RNA, 20 nt, Homo sapiens
aacugaauuuugggacuucu

SEQ ID NO: 1220498 - RNA, 22 nt, Homo sapiens
aacugacugaaggaaaagcaag

SEQ ID NO: 1220499 - RNA, 23 nt, Homo sapiens
aacugacugccuugcuaaaagau

SEQ ID NO: 1220500 - RNA, 14 nt, Homo sapiens
aacugacuuuaucc

SEQ ID NO: 1220501 - RNA, 23 nt, Homo sapiens
aacugagauuacaggcacccacc

SEQ ID NO: 1220502 - RNA, 17 nt, Homo sapiens
aacugauguuacuagcc

SEQ ID NO: 1220503 - RNA, 16 nt, Homo sapiens
aacugcagcaguggcu

SEQ ID NO: 1220504 - RNA, 15 nt, Homo sapiens
aacugcauggaccua

SEQ ID NO: 1220505 - RNA, 18 nt, Homo sapiens
aacugccaucauuuacuu

SEQ ID NO: 1220506 - RNA, 16 nt, Homo sapiens
aacugcccccacuguc

SEQ ID NO: 1220507 - RNA, 13 nt, Homo sapiens
aacugcuaaugca

SEQ ID NO: 1220508 - RNA, 16 nt, Homo sapiens
aacuggaagaaagcaa

SEQ ID NO: 1220509 - RNA, 17 nt, Homo sapiens
aacuggaguaucauucu

SEQ ID NO: 1220510 - RNA, 11 nt, Homo sapiens
aacuggcugca

SEQ ID NO: 1220511 - RNA, 20 nt, Homo sapiens
aacuguacuacaucuaguua

SEQ ID NO: 1220512 - RNA, 16 nt, Homo sapiens
aacuguagcugccaug

SEQ ID NO: 1220513 - RNA, 12 nt, Homo sapiens
aacugugacugu

SEQ ID NO: 1220514 - RNA, 22 nt, Homo sapiens
aacugugcguuaaauaagcaaa

SEQ ID NO: 1220515 - RNA, 12 nt, Homo sapiens
aacugugcugaa

SEQ ID NO: 1220516 - RNA, 15 nt, Homo sapiens
aacuguggucaaucc

SEQ ID NO: 1220517 - RNA, 13 nt, Homo sapiens
aacuguguugcca

SEQ ID NO: 1220518 - RNA, 18 nt, Homo sapiens
aacuguguuguauuaaca

SEQ ID NO: 1220519 - RNA, 18 nt, Homo sapiens
aacuguucagcuguccuc

SEQ ID NO: 1220520 - RNA, 12 nt, Homo sapiens
aacuguucucuu

SEQ ID NO: 1220521 - RNA, 18 nt, Homo sapiens
aacuguuuuagaccuaua

SEQ ID NO: 1220522 - RNA, 15 nt, Homo sapiens
aacuguuuucaagga

SEQ ID NO: 1220523 - RNA, 22 nt, Homo sapiens
aacuuaagggaaaaguucuccu

SEQ ID NO: 1220524 - RNA, 13 nt, Homo sapiens
aacuuacuauuca

SEQ ID NO: 1220525 - RNA, 13 nt, Homo sapiens
aacuuagugacaa

SEQ ID NO: 1220526 - RNA, 14 nt, Homo sapiens
aacuuagugacaaa

SEQ ID NO: 1220527 - RNA, 14 nt, Homo sapiens
aacuuauccaucuu

SEQ ID NO: 1220528 - RNA, 12 nt, Homo sapiens
aacuucaaagag

SEQ ID NO: 1220529 - RNA, 22 nt, Homo sapiens
aacuucaccuacauuaucucac

SEQ ID NO: 1220530 - RNA, 15 nt, Homo sapiens
aacuucccugauuga

SEQ ID NO: 1220531 - RNA, 20 nt, Homo sapiens
aacuuccuacguauccugca

SEQ ID NO: 1220532 - RNA, 11 nt, Homo sapiens
aacuuccucag

SEQ ID NO: 1220533 - RNA, 14 nt, Homo sapiens
aacuucuugucaga

SEQ ID NO: 1220534 - RNA, 14 nt, Homo sapiens
aacuugacccccuu

SEQ ID NO: 1220535 - RNA, 20 nt, Homo sapiens
aacuugguugguccuugucu

SEQ ID NO: 1220536 - RNA, 17 nt, Homo sapiens
aacuuguguacugauaa

SEQ ID NO: 1220537 - RNA, 22 nt, Homo sapiens
aacuuguuugguaguuagccau

SEQ ID NO: 1220538 - RNA, 15 nt, Homo sapiens
aacuuuaaugaacua

SEQ ID NO: 1220539 - RNA, 21 nt, Homo sapiens
aacuuucaaaauauauuuuca

SEQ ID NO: 1220540 - RNA, 23 nt, Homo sapiens
aacuuugacaaccaugagaccac

SEQ ID NO: 1220541 - RNA, 16 nt, Homo sapiens
aacuuuuauaccuauc

SEQ ID NO: 1220542 - RNA, 18 nt, Homo sapiens
aacuuuucugcugauaag

SEQ ID NO: 1220543 - RNA, 19 nt, Homo sapiens
aacuuuuuuaaauaaacuu

SEQ ID NO: 1220544 - RNA, 17 nt, Homo sapiens
aagaaaaaaacuuacug

SEQ ID NO: 1220545 - RNA, 15 nt, Homo sapiens
aagaaaaaauaucuu

SEQ ID NO: 1220546 - RNA, 21 nt, Homo sapiens
aagaaaaaaugacaccaucuu

SEQ ID NO: 1220547 - RNA, 23 nt, Homo sapiens
aagaaaaagaccuaugagcacau

SEQ ID NO: 1220548 - RNA, 12 nt, Homo sapiens
aagaaaaccauu

SEQ ID NO: 1220549 - RNA, 17 nt, Homo sapiens
aagaaaagcauuuucag

SEQ ID NO: 1220550 - RNA, 16 nt, Homo sapiens
aagaaaauggauuuaa

SEQ ID NO: 1220551 - RNA, 21 nt, Homo sapiens
aagaaaauguuacuucucuca

SEQ ID NO: 1220552 - RNA, 16 nt, Homo sapiens
aagaaacagcuuucaa

SEQ ID NO: 1220553 - RNA, 14 nt, Homo sapiens
aagaaacauugccu

SEQ ID NO: 1220554 - RNA, 22 nt, Homo sapiens
aagaaaccaccgaaaucccuca

SEQ ID NO: 1220555 - RNA, 14 nt, Homo sapiens
aagaaacuccgaag

SEQ ID NO: 1220556 - RNA, 14 nt, Homo sapiens
aagaaacugaugaa

SEQ ID NO: 1220557 - RNA, 23 nt, Homo sapiens
aagaaagagcaacaauccaucuc

SEQ ID NO: 1220558 - RNA, 20 nt, Homo sapiens
aagaaagugcgaguccucca

SEQ ID NO: 1220559 - RNA, 12 nt, Homo sapiens
aagaaaguguau

SEQ ID NO: 1220560 - RNA, 18 nt, Homo sapiens
aagaaauauauacuugag

SEQ ID NO: 1220561 - RNA, 13 nt, Homo sapiens
aagaaaucuuucc

SEQ ID NO: 1220562 - RNA, 14 nt, Homo sapiens
aagaaaugcccaaa

SEQ ID NO: 1220563 - RNA, 21 nt, Homo sapiens
aagaaauuccuuccuuaccug

SEQ ID NO: 1220564 - RNA, 15 nt, Homo sapiens
aagaaccauugauuu

SEQ ID NO: 1220565 - RNA, 16 nt, Homo sapiens
aagaaccgagcaauuu

SEQ ID NO: 1220566 - RNA, 13 nt, Homo sapiens
aagaaccucucac

SEQ ID NO: 1220567 - RNA, 23 nt, Homo sapiens
aagaacuggaaccccagcuuccc

SEQ ID NO: 1220568 - RNA, 22 nt, Homo sapiens
aagaacuguugccuaauuggaa

SEQ ID NO: 1220569 - RNA, 19 nt, Homo sapiens
aagaacuuuagcaugguau

SEQ ID NO: 1220570 - RNA, 16 nt, Homo sapiens
aagaagacauggagac

SEQ ID NO: 1220571 - RNA, 11 nt, Homo sapiens
aagaaggcauu

SEQ ID NO: 1220572 - RNA, 17 nt, Homo sapiens
aagaaggccaaaccucu

SEQ ID NO: 1220573 - RNA, 20 nt, Homo sapiens
aagaaggggccaucacagga

SEQ ID NO: 1220574 - RNA, 23 nt, Homo sapiens
aagaagguauuuuguaauauucu

SEQ ID NO: 1220575 - RNA, 19 nt, Homo sapiens
aagaaguguccgagaacua

SEQ ID NO: 1220576 - RNA, 22 nt, Homo sapiens
aagaauaaaaaagaaauccaua

SEQ ID NO: 1220577 - RNA, 18 nt, Homo sapiens
aagaauaaaauacugcaa

SEQ ID NO: 1220578 - RNA, 13 nt, Homo sapiens
aagaauacagaaa

SEQ ID NO: 1220579 - RNA, 17 nt, Homo sapiens
aagaauagaaaacuggg

SEQ ID NO: 1220580 - RNA, 17 nt, Homo sapiens
aagaaucagucuaucca

SEQ ID NO: 1220581 - RNA, 13 nt, Homo sapiens
aagaaucuaauag

SEQ ID NO: 1220582 - RNA, 16 nt, Homo sapiens
aagaaugaacacuccc

SEQ ID NO: 1220583 - RNA, 23 nt, Homo sapiens
aagaaugagacugaacuguguga

SEQ ID NO: 1220584 - RNA, 20 nt, Homo sapiens
aagaauggggaucacagaga

SEQ ID NO: 1220585 - RNA, 22 nt, Homo sapiens
aagaauguugguuuacuuucaa

SEQ ID NO: 1220586 - RNA, 13 nt, Homo sapiens
aagaauuaacaga

SEQ ID NO: 1220587 - RNA, 17 nt, Homo sapiens
aagaauucuguacuucc

SEQ ID NO: 1220588 - RNA, 23 nt, Homo sapiens
aagaauuuaagcuguaaauuaca

SEQ ID NO: 1220589 - RNA, 12 nt, Homo sapiens
aagaauuucaca

SEQ ID NO: 1220590 - RNA, 13 nt, Homo sapiens
aagaauuucuuca

SEQ ID NO: 1220591 - RNA, 13 nt, Homo sapiens
aagacaaugcacc

SEQ ID NO: 1220592 - RNA, 12 nt, Homo sapiens
aagacaccauuu

SEQ ID NO: 1220593 - RNA, 14 nt, Homo sapiens
aagacauaucucua

SEQ ID NO: 1220594 - RNA, 15 nt, Homo sapiens
aagacaucauguauc

SEQ ID NO: 1220595 - RNA, 16 nt, Homo sapiens
aagacauccugagcag

SEQ ID NO: 1220596 - RNA, 21 nt, Homo sapiens
aagacauccugagcagugcca

SEQ ID NO: 1220597 - RNA, 13 nt, Homo sapiens
aagacaugaacca

SEQ ID NO: 1220598 - RNA, 12 nt, Homo sapiens
aagaccaaagca

SEQ ID NO: 1220599 - RNA, 15 nt, Homo sapiens
aagaccagcuuugca

SEQ ID NO: 1220600 - RNA, 19 nt, Homo sapiens
aagaccagcuuugcaguga

SEQ ID NO: 1220601 - RNA, 15 nt, Homo sapiens
aagaccaguauuuca

SEQ ID NO: 1220602 - RNA, 20 nt, Homo sapiens
aagaccaguccuguuugcag

SEQ ID NO: 1220603 - RNA, 19 nt, Homo sapiens
aagaccaguuuccauuuau

SEQ ID NO: 1220604 - RNA, 13 nt, Homo sapiens
aagaccauggauu

SEQ ID NO: 1220605 - RNA, 14 nt, Homo sapiens
aagaccccaucucu

SEQ ID NO: 1220606 - RNA, 19 nt, Homo sapiens
aagacccccagcacuuggg

SEQ ID NO: 1220607 - RNA, 22 nt, Homo sapiens
aagaccggcugguggagcugcu

SEQ ID NO: 1220608 - RNA, 22 nt, Homo sapiens
aagaccucgagcagaugaugcc

SEQ ID NO: 1220609 - RNA, 13 nt, Homo sapiens
aagacgccuucau

SEQ ID NO: 1220610 - RNA, 14 nt, Homo sapiens
aagacuacaaaaau

SEQ ID NO: 1220611 - RNA, 13 nt, Homo sapiens
aagacuacugaag

SEQ ID NO: 1220612 - RNA, 18 nt, Homo sapiens
aagacuagaggcuugcau

SEQ ID NO: 1220613 - RNA, 15 nt, Homo sapiens
aagacucuauucuca

SEQ ID NO: 1220614 - RNA, 15 nt, Homo sapiens
aagacugaaaugccu

SEQ ID NO: 1220615 - RNA, 19 nt, Homo sapiens
aagacugaugaagaaauuu

SEQ ID NO: 1220616 - RNA, 17 nt, Homo sapiens
aagacugcguggauuca

SEQ ID NO: 1220617 - RNA, 12 nt, Homo sapiens
aauaaaacugau

SEQ ID NO: 1220618 - RNA, 13 nt, Homo sapiens
aauaaaagcacaa

SEQ ID NO: 1220619 - RNA, 13 nt, Homo sapiens
aauaaacacuggu

SEQ ID NO: 1220620 - RNA, 21 nt, Homo sapiens
aauaaacacuggugccaacca

SEQ ID NO: 1220621 - RNA, 19 nt, Homo sapiens
aauaaacagcuucaugccu

SEQ ID NO: 1220622 - RNA, 12 nt, Homo sapiens
aauaaaccaaau

SEQ ID NO: 1220623 - RNA, 12 nt, Homo sapiens
aauaaaccacuu

SEQ ID NO: 1220624 - RNA, 22 nt, Homo sapiens
aauaaaccuccgccaaugcacg

SEQ ID NO: 1220625 - RNA, 13 nt, Homo sapiens
aauaaacuccuac

SEQ ID NO: 1220626 - RNA, 19 nt, Homo sapiens
aauaaagcauucuuuaaca

SEQ ID NO: 1220627 - RNA, 13 nt, Homo sapiens
aauaaaggcagcu

SEQ ID NO: 1220628 - RNA, 13 nt, Homo sapiens
aauaaaguaccac

SEQ ID NO: 1220629 - RNA, 17 nt, Homo sapiens
aauaaaguauagguuua

SEQ ID NO: 1220630 - RNA, 20 nt, Homo sapiens
aauaaauaagaucagacucu

SEQ ID NO: 1220631 - RNA, 13 nt, Homo sapiens
aauaaauaauuaa

SEQ ID NO: 1220632 - RNA, 14 nt, Homo sapiens
aauaaauaucugua

SEQ ID NO: 1220633 - RNA, 15 nt, Homo sapiens
aauaaauauuacagu

SEQ ID NO: 1220634 - RNA, 16 nt, Homo sapiens
aauaaauccuccaguc

SEQ ID NO: 1220635 - RNA, 13 nt, Homo sapiens
aauaaaugaacug

SEQ ID NO: 1220636 - RNA, 15 nt, Homo sapiens
aauaaauguauucaa

SEQ ID NO: 1220637 - RNA, 22 nt, Homo sapiens
aauaaauguugcaaugcaugau

SEQ ID NO: 1220638 - RNA, 15 nt, Homo sapiens
aauaaauuccuacaa

SEQ ID NO: 1220639 - RNA, 14 nt, Homo sapiens
aauaacacagagag

SEQ ID NO: 1220640 - RNA, 12 nt, Homo sapiens
aauaacacuguc

SEQ ID NO: 1220641 - RNA, 14 nt, Homo sapiens
aauaacaguauuuu

SEQ ID NO: 1220642 - RNA, 16 nt, Homo sapiens
aauaacaucaacaaca

SEQ ID NO: 1220643 - RNA, 23 nt, Homo sapiens
aauaacgggcugcccucagcuca

SEQ ID NO: 1220644 - RNA, 22 nt, Homo sapiens
aauaacuaugccagcaaccuug

SEQ ID NO: 1220645 - RNA, 21 nt, Homo sapiens
aauaacugaaccaaauugcac

SEQ ID NO: 1220646 - RNA, 17 nt, Homo sapiens
aauaagaaagugcgagu

SEQ ID NO: 1220647 - RNA, 16 nt, Homo sapiens
aauaagaucagacucu

SEQ ID NO: 1220648 - RNA, 15 nt, Homo sapiens
aauaagcccaacaga

SEQ ID NO: 1220649 - RNA, 15 nt, Homo sapiens
aauaaggcccagagc

SEQ ID NO: 1220650 - RNA, 20 nt, Homo sapiens
aauaaguaucacacuguaua

SEQ ID NO: 1220651 - RNA, 14 nt, Homo sapiens
aauaagucauugua

SEQ ID NO: 1220652 - RNA, 18 nt, Homo sapiens
aauaauaacaaucacaaa

SEQ ID NO: 1220653 - RNA, 18 nt, Homo sapiens
aauaauaagcuacuugcc

SEQ ID NO: 1220654 - RNA, 13 nt, Homo sapiens
aauaauaccucaa

SEQ ID NO: 1220655 - RNA, 15 nt, Homo sapiens
aauaauauuagcuua

SEQ ID NO: 1220656 - RNA, 19 nt, Homo sapiens
aauaauggaaaaugccaug

SEQ ID NO: 1220657 - RNA, 18 nt, Homo sapiens
aauaauggaaacauuaca

SEQ ID NO: 1220658 - RNA, 14 nt, Homo sapiens
aauaauguacaucu

SEQ ID NO: 1220659 - RNA, 12 nt, Homo sapiens
aauaauucuucc

SEQ ID NO: 1220660 - RNA, 14 nt, Homo sapiens
aauaauugauuuca

SEQ ID NO: 1220661 - RNA, 18 nt, Homo sapiens
aauaauugcucauaagca

SEQ ID NO: 1220662 - RNA, 20 nt, Homo sapiens
aauaauugcucauaagcaau

SEQ ID NO: 1220663 - RNA, 16 nt, Homo sapiens
aauacaaaaaugagcu

SEQ ID NO: 1220664 - RNA, 13 nt, Homo sapiens
aauacaacaugua

SEQ ID NO: 1220665 - RNA, 14 nt, Homo sapiens
aauacacuguuauc

SEQ ID NO: 1220666 - RNA, 24 nt, Homo sapiens
aauacagcagugucaucagaagau

SEQ ID NO: 1220667 - RNA, 17 nt, Homo sapiens
aauacagggcaugcauu

SEQ ID NO: 1220668 - RNA, 15 nt, Homo sapiens
aauacaggggugaaa

SEQ ID NO: 1220669 - RNA, 17 nt, Homo sapiens
aauacaguaagcauagu

SEQ ID NO: 1220670 - RNA, 11 nt, Homo sapiens
aauacagugag

SEQ ID NO: 1220671 - RNA, 15 nt, Homo sapiens
aauaccauguacaua

SEQ ID NO: 1220672 - RNA, 23 nt, Homo sapiens
aauacuaccucugaauguuacaa

SEQ ID NO: 1220673 - RNA, 21 nt, Homo sapiens
aauacucugcuauuucucuug

SEQ ID NO: 1220674 - RNA, 20 nt, Homo sapiens
aauacuuauuuucagugcau

SEQ ID NO: 1220675 - RNA, 17 nt, Homo sapiens
aauacuuuuuaaaaggu

SEQ ID NO: 1220676 - RNA, 16 nt, Homo sapiens
aauagaaacauuugua

SEQ ID NO: 1220677 - RNA, 16 nt, Homo sapiens
aauagaaccacuauga

SEQ ID NO: 1220678 - RNA, 19 nt, Homo sapiens
aauagaucaguauuucacu

SEQ ID NO: 1220679 - RNA, 23 nt, Homo sapiens
aauagcacacuuuuccacauucc

SEQ ID NO: 1220680 - RNA, 21 nt, Homo sapiens
aauagcacuuucauugccagu

SEQ ID NO: 1220681 - RNA, 17 nt, Homo sapiens
aauagccaguuccugcc

SEQ ID NO: 1220682 - RNA, 20 nt, Homo sapiens
aauagcuauauccauguacu

SEQ ID NO: 1220683 - RNA, 21 nt, Homo sapiens
aauagcugggacuacaggugu

SEQ ID NO: 1220684 - RNA, 14 nt, Homo sapiens
aauaggaauaagcu

SEQ ID NO: 1220685 - RNA, 14 nt, Homo sapiens
aauaggcaucucca

SEQ ID NO: 1220686 - RNA, 17 nt, Homo sapiens
aauaggugcuuauucuc

SEQ ID NO: 1220687 - RNA, 19 nt, Homo sapiens
aauaggugcuuauucucaa

SEQ ID NO: 1220688 - RNA, 20 nt, Homo sapiens
aauaguaccuucaauacuua

SEQ ID NO: 1220689 - RNA, 21 nt, Homo sapiens
aauagugaauacuuacuauaa

SEQ ID NO: 1220690 - RNA, 16 nt, Homo sapiens
aauaguucaguagaau

SEQ ID NO: 1220691 - RNA, 14 nt, Homo sapiens
aauaguucuauaca

SEQ ID NO: 1220692 - RNA, 21 nt, Homo sapiens
aauaguuguuauucuguaguu

SEQ ID NO: 1220693 - RNA, 22 nt, Homo sapiens
aauaguuuaacugaaaguuuaa

SEQ ID NO: 1220694 - RNA, 15 nt, Homo sapiens
aauauaaaacuuaca

SEQ ID NO: 1220695 - RNA, 16 nt, Homo sapiens
aauauaaaguguaaua

SEQ ID NO: 1220696 - RNA, 12 nt, Homo sapiens
aauauacauuca

SEQ ID NO: 1220697 - RNA, 14 nt, Homo sapiens
aauauacauucaaa

SEQ ID NO: 1220698 - RNA, 18 nt, Homo sapiens
aauauacauucaaacuua

SEQ ID NO: 1220699 - RNA, 19 nt, Homo sapiens
aauauacauuuguugguaa

SEQ ID NO: 1220700 - RNA, 14 nt, Homo sapiens
aauauagccugccu

SEQ ID NO: 1220701 - RNA, 13 nt, Homo sapiens
aauauagugacua

SEQ ID NO: 1220702 - RNA, 13 nt, Homo sapiens
aauauaguuugag

SEQ ID NO: 1220703 - RNA, 19 nt, Homo sapiens
aauauauauaaagaauaua

SEQ ID NO: 1220704 - RNA, 20 nt, Homo sapiens
aauauauauaaccuuguuau

SEQ ID NO: 1220705 - RNA, 16 nt, Homo sapiens
aauauaucuaccccag

SEQ ID NO: 1220706 - RNA, 21 nt, Homo sapiens
aauauauuguacacuacagca

SEQ ID NO: 1220707 - RNA, 23 nt, Homo sapiens
aauauauuuuaaguaucagaggu

SEQ ID NO: 1220708 - RNA, 20 nt, Homo sapiens
aauaucaucugucauuauau

SEQ ID NO: 1220709 - RNA, 12 nt, Homo sapiens
aauauccaagac

SEQ ID NO: 1220710 - RNA, 14 nt, Homo sapiens
aauauccaagacuu

SEQ ID NO: 1220711 - RNA, 23 nt, Homo sapiens
aauauccuccaaugugugcaugg

SEQ ID NO: 1220712 - RNA, 17 nt, Homo sapiens
aauaucgagaacugcca

SEQ ID NO: 1220713 - RNA, 15 nt, Homo sapiens
aauaucuggcacugu

SEQ ID NO: 1220714 - RNA, 20 nt, Homo sapiens
aauaucuggcacuguuaaua

SEQ ID NO: 1220715 - RNA, 15 nt, Homo sapiens
aauaucuuaucuucc

SEQ ID NO: 1220716 - RNA, 17 nt, Homo sapiens
aauaucuugcuuucaaa

SEQ ID NO: 1220717 - RNA, 17 nt, Homo sapiens
aauaugaccauuugacu

SEQ ID NO: 1220718 - RNA, 11 nt, Homo sapiens
aauaugauuau

SEQ ID NO: 1220719 - RNA, 16 nt, Homo sapiens
aauaugcaagcagcuu

SEQ ID NO: 1220720 - RNA, 22 nt, Homo sapiens
aauaugcaucuggcccaggaau

SEQ ID NO: 1220721 - RNA, 22 nt, Homo sapiens
aauaugccuagcacaaguacca

SEQ ID NO: 1220722 - RNA, 20 nt, Homo sapiens
aauauggugggcacagaagu

SEQ ID NO: 1220723 - RNA, 15 nt, Homo sapiens
aauauguacauuugu

SEQ ID NO: 1220724 - RNA, 17 nt, Homo sapiens
aauauguagcucauccu

SEQ ID NO: 1220725 - RNA, 22 nt, Homo sapiens
aauauguagcucauccuuuaca

SEQ ID NO: 1220726 - RNA, 16 nt, Homo sapiens
aauauguauccucuau

SEQ ID NO: 1220727 - RNA, 17 nt, Homo sapiens
aauauguauccucuaua

SEQ ID NO: 1220728 - RNA, 22 nt, Homo sapiens
aauauguauuguaaacaugugu

SEQ ID NO: 1220729 - RNA, 18 nt, Homo sapiens
aauauuagaagccugcag

SEQ ID NO: 1220730 - RNA, 17 nt, Homo sapiens
aauauuagcauugccaa

SEQ ID NO: 1220731 - RNA, 22 nt, Homo sapiens
aauauuagguugucacgaugaa

SEQ ID NO: 1220732 - RNA, 22 nt, Homo sapiens
aauauuagugauucugauuuca

SEQ ID NO: 1220733 - RNA, 22 nt, Homo sapiens
aauauucucuccgccauugaga

SEQ ID NO: 1220734 - RNA, 14 nt, Homo sapiens
aauauugugcccca

SEQ ID NO: 1220735 - RNA, 22 nt, Homo sapiens
aauauuguugacaacugugacu

SEQ ID NO: 1220736 - RNA, 13 nt, Homo sapiens
aauauuuacucau

SEQ ID NO: 1220737 - RNA, 18 nt, Homo sapiens
aauauuuauauauuugaa

SEQ ID NO: 1220738 - RNA, 21 nt, Homo sapiens
aauauuuauauugucacucau

SEQ ID NO: 1220739 - RNA, 17 nt, Homo sapiens
aauauuuauuaccucug

SEQ ID NO: 1220740 - RNA, 20 nt, Homo sapiens
aauauuuauuaccucugaua

SEQ ID NO: 1220741 - RNA, 16 nt, Homo sapiens
aauauuucauuuugau

SEQ ID NO: 1220742 - RNA, 18 nt, Homo sapiens
aauauuuuauaccaaagc

SEQ ID NO: 1220743 - RNA, 13 nt, Homo sapiens
acaaugucccuuc

SEQ ID NO: 1220744 - RNA, 16 nt, Homo sapiens
acaauuggaauugucu

SEQ ID NO: 1220745 - RNA, 23 nt, Homo sapiens
acaauugguaaaacucacuguga

SEQ ID NO: 1220746 - RNA, 16 nt, Homo sapiens
acaauuugacauacaa

SEQ ID NO: 1220747 - RNA, 15 nt, Homo sapiens
acacaaaaaucauua

SEQ ID NO: 1220748 - RNA, 23 nt, Homo sapiens
acacaaaggaaguccaaccugag

SEQ ID NO: 1220749 - RNA, 15 nt, Homo sapiens
acacaaauuuucaag

SEQ ID NO: 1220750 - RNA, 12 nt, Homo sapiens
acacaauaccua

SEQ ID NO: 1220751 - RNA, 21 nt, Homo sapiens
acacaauaggucuuucucuca

SEQ ID NO: 1220752 - RNA, 13 nt, Homo sapiens
acacacacaucca

SEQ ID NO: 1220753 - RNA, 16 nt, Homo sapiens
acacacacgaugcauu

SEQ ID NO: 1220754 - RNA, 13 nt, Homo sapiens
acacacacuggcc

SEQ ID NO: 1220755 - RNA, 12 nt, Homo sapiens
acacacaguacg

SEQ ID NO: 1220756 - RNA, 10 nt, Homo sapiens
acacacaucc

SEQ ID NO: 1220757 - RNA, 13 nt, Homo sapiens
acacacaugcaca

SEQ ID NO: 1220758 - RNA, 16 nt, Homo sapiens
acacacucugagucuc

SEQ ID NO: 1220759 - RNA, 18 nt, Homo sapiens
acacagacuccacccucc

SEQ ID NO: 1220760 - RNA, 21 nt, Homo sapiens
acacagacuggcaauaaacuc

SEQ ID NO: 1220761 - RNA, 22 nt, Homo sapiens
acacagagcaggacugcacagc

SEQ ID NO: 1220762 - RNA, 14 nt, Homo sapiens
acacagaugaaggu

SEQ ID NO: 1220763 - RNA, 16 nt, Homo sapiens
acacagaugugaaaug

SEQ ID NO: 1220764 - RNA, 20 nt, Homo sapiens
acacagcaagacuccgucuc

SEQ ID NO: 1220765 - RNA, 17 nt, Homo sapiens
acacagcuacagcuuuc

SEQ ID NO: 1220766 - RNA, 13 nt, Homo sapiens
acacagcuguucu

SEQ ID NO: 1220767 - RNA, 23 nt, Homo sapiens
acacaggaaaccaacacccaaag

SEQ ID NO: 1220768 - RNA, 23 nt, Homo sapiens
acacagggaacaggaaaugggaa

SEQ ID NO: 1220769 - RNA, 21 nt, Homo sapiens
acacagggguggaguuucuga

SEQ ID NO: 1220770 - RNA, 17 nt, Homo sapiens
acacaguauuacuucug

SEQ ID NO: 1220771 - RNA, 15 nt, Homo sapiens
acacaguuacagagu

SEQ ID NO: 1220772 - RNA, 17 nt, Homo sapiens
acacauacagagugggc

SEQ ID NO: 1220773 - RNA, 13 nt, Homo sapiens
acacauauugcac

SEQ ID NO: 1220774 - RNA, 23 nt, Homo sapiens
acacauccgccuuuuguauacau

SEQ ID NO: 1220775 - RNA, 23 nt, Homo sapiens
acacauggugugaguccaaagaa

SEQ ID NO: 1220776 - RNA, 17 nt, Homo sapiens
acacauucuuaacacau

SEQ ID NO: 1220777 - RNA, 20 nt, Homo sapiens
acacauucuuaacacauguc

SEQ ID NO: 1220778 - RNA, 18 nt, Homo sapiens
acacauucuuauugacaa

SEQ ID NO: 1220779 - RNA, 14 nt, Homo sapiens
acacauuuguacag

SEQ ID NO: 1220780 - RNA, 20 nt, Homo sapiens
acaccaaccagacagcacag

SEQ ID NO: 1220781 - RNA, 16 nt, Homo sapiens
acaccaacgaggugau

SEQ ID NO: 1220782 - RNA, 19 nt, Homo sapiens
acaccaaguaccaguauaa

SEQ ID NO: 1220783 - RNA, 19 nt, Homo sapiens
acaccacuuucugcuuucc

SEQ ID NO: 1220784 - RNA, 19 nt, Homo sapiens
acaccagagcagaugcaga

SEQ ID NO: 1220785 - RNA, 22 nt, Homo sapiens
acaccagagcagaugcagagag

SEQ ID NO: 1220786 - RNA, 22 nt, Homo sapiens
acaccaucaggccgcauccuga

SEQ ID NO: 1220787 - RNA, 11 nt, Homo sapiens
acaccaucucc

SEQ ID NO: 1220788 - RNA, 19 nt, Homo sapiens
acaccauucuccugccuca

SEQ ID NO: 1220789 - RNA, 20 nt, Homo sapiens
acaccauucuccugccucac

SEQ ID NO: 1220790 - RNA, 14 nt, Homo sapiens
acaccauuuaucua

SEQ ID NO: 1220791 - RNA, 13 nt, Homo sapiens
acacccagccuca

SEQ ID NO: 1220792 - RNA, 20 nt, Homo sapiens
acacccagcucagcauuucc

SEQ ID NO: 1220793 - RNA, 16 nt, Homo sapiens
acacccaguugccaaa

SEQ ID NO: 1220794 - RNA, 16 nt, Homo sapiens
acacccgacuccucaa

SEQ ID NO: 1220795 - RNA, 23 nt, Homo sapiens
acacccuauauuuugcauaguac

SEQ ID NO: 1220796 - RNA, 19 nt, Homo sapiens
acacccugccccuggugcc

SEQ ID NO: 1220797 - RNA, 18 nt, Homo sapiens
acacccuuucaucucaga

SEQ ID NO: 1220798 - RNA, 16 nt, Homo sapiens
acaccgcugcacucaa

SEQ ID NO: 1220799 - RNA, 14 nt, Homo sapiens
acaccguucauuca

SEQ ID NO: 1220800 - RNA, 15 nt, Homo sapiens
acaccuagcuuuauu

SEQ ID NO: 1220801 - RNA, 16 nt, Homo sapiens
acaccucacuuuugaa

SEQ ID NO: 1220802 - RNA, 21 nt, Homo sapiens
acaccuccacaguucaguggc

SEQ ID NO: 1220803 - RNA, 19 nt, Homo sapiens
acaccuccgagacagucca

SEQ ID NO: 1220804 - RNA, 23 nt, Homo sapiens
acaccuccgagacaguccagugu

SEQ ID NO: 1220805 - RNA, 14 nt, Homo sapiens
acaccugcugagaa

SEQ ID NO: 1220806 - RNA, 12 nt, Homo sapiens
acaccuggacug

SEQ ID NO: 1220807 - RNA, 14 nt, Homo sapiens
acaccuggccuuaa

SEQ ID NO: 1220808 - RNA, 11 nt, Homo sapiens
acaccuuccag

SEQ ID NO: 1220809 - RNA, 15 nt, Homo sapiens
acacgaugcauuuaa

SEQ ID NO: 1220810 - RNA, 16 nt, Homo sapiens
acacgcuuguucacac

SEQ ID NO: 1220811 - RNA, 14 nt, Homo sapiens
acacguuggcucag

SEQ ID NO: 1220812 - RNA, 19 nt, Homo sapiens
acacuaaaacuuuccugac

SEQ ID NO: 1220813 - RNA, 21 nt, Homo sapiens
acacuacacagcacaccagcc

SEQ ID NO: 1220814 - RNA, 18 nt, Homo sapiens
acacuagaaaacuugacu

SEQ ID NO: 1220815 - RNA, 17 nt, Homo sapiens
acacuagccugugcacg

SEQ ID NO: 1220816 - RNA, 16 nt, Homo sapiens
acacuaucauggacua

SEQ ID NO: 1220817 - RNA, 22 nt, Homo sapiens
acacuaucauggacuacaccag

SEQ ID NO: 1220818 - RNA, 19 nt, Homo sapiens
acacucaucuuagugccug

SEQ ID NO: 1220819 - RNA, 20 nt, Homo sapiens
acacuccuacaagauuuaga

SEQ ID NO: 1220820 - RNA, 19 nt, Homo sapiens
acacucgggcccaugggau

SEQ ID NO: 1220821 - RNA, 16 nt, Homo sapiens
acacucuccaaacagu

SEQ ID NO: 1220822 - RNA, 12 nt, Homo sapiens
acacucucugga

SEQ ID NO: 1220823 - RNA, 19 nt, Homo sapiens
acacucugccagcaaagag

SEQ ID NO: 1220824 - RNA, 14 nt, Homo sapiens
acacucuucaguga

SEQ ID NO: 1220825 - RNA, 21 nt, Homo sapiens
acacugaaaaaucuaagugau

SEQ ID NO: 1220826 - RNA, 15 nt, Homo sapiens
acacugaaaauguca

SEQ ID NO: 1220827 - RNA, 14 nt, Homo sapiens
acacugaaaccaaa

SEQ ID NO: 1220828 - RNA, 15 nt, Homo sapiens
acacugaaaccaaaa

SEQ ID NO: 1220829 - RNA, 20 nt, Homo sapiens
acacugagauauucagccca

SEQ ID NO: 1220830 - RNA, 12 nt, Homo sapiens
acacugccaaau

SEQ ID NO: 1220831 - RNA, 16 nt, Homo sapiens
acacugccuguauacu

SEQ ID NO: 1220832 - RNA, 21 nt, Homo sapiens
acacugcugcuccagugcagg

SEQ ID NO: 1220833 - RNA, 17 nt, Homo sapiens
acacugcuguacccaga

SEQ ID NO: 1220834 - RNA, 15 nt, Homo sapiens
acacuggauggucau

SEQ ID NO: 1220835 - RNA, 21 nt, Homo sapiens
acacugguuuggucaguuaca

SEQ ID NO: 1220836 - RNA, 18 nt, Homo sapiens
acacuguauauaaacaua

SEQ ID NO: 1220837 - RNA, 22 nt, Homo sapiens
acacuguauauaaacauaucaa

SEQ ID NO: 1220838 - RNA, 18 nt, Homo sapiens
acacugucacuagucuca

SEQ ID NO: 1220839 - RNA, 19 nt, Homo sapiens
acacugucacuagucucac

SEQ ID NO: 1220840 - RNA, 15 nt, Homo sapiens
acacugucuucugau

SEQ ID NO: 1220841 - RNA, 13 nt, Homo sapiens
acacugugcccug

SEQ ID NO: 1220842 - RNA, 16 nt, Homo sapiens
acacuguuaucuucac

SEQ ID NO: 1220843 - RNA, 22 nt, Homo sapiens
acacuguucugaaagugacuca

SEQ ID NO: 1220844 - RNA, 15 nt, Homo sapiens
acacuuaauagcaac

SEQ ID NO: 1220845 - RNA, 15 nt, Homo sapiens
acacuucccaacuua

SEQ ID NO: 1220846 - RNA, 21 nt, Homo sapiens
acacuuggagcccgugcagua

SEQ ID NO: 1220847 - RNA, 14 nt, Homo sapiens
acacuuggaugcag

SEQ ID NO: 1220848 - RNA, 16 nt, Homo sapiens
acacuuggaugcaggg

SEQ ID NO: 1220849 - RNA, 18 nt, Homo sapiens
acacuuguuguccaguug

SEQ ID NO: 1220850 - RNA, 12 nt, Homo sapiens
acacuuugccau

SEQ ID NO: 1220851 - RNA, 21 nt, Homo sapiens
acacuuuggacuucucugaaa

SEQ ID NO: 1220852 - RNA, 12 nt, Homo sapiens
acacuuuugcuu

SEQ ID NO: 1220853 - RNA, 20 nt, Homo sapiens
acagaaaccagaaaagcaau

SEQ ID NO: 1220854 - RNA, 15 nt, Homo sapiens
acagaaacgcaucca

SEQ ID NO: 1220855 - RNA, 14 nt, Homo sapiens
acagaaacugcaug

SEQ ID NO: 1220856 - RNA, 18 nt, Homo sapiens
acagaaauauauauacau

SEQ ID NO: 1220857 - RNA, 22 nt, Homo sapiens
acagaaauggggaauucucuaa

SEQ ID NO: 1220858 - RNA, 23 nt, Homo sapiens
acagaaccuucaacccagugggu

SEQ ID NO: 1220859 - RNA, 21 nt, Homo sapiens
acagaacugcagucagcauga

SEQ ID NO: 1220860 - RNA, 21 nt, Homo sapiens
acagaacuucagaaagacuug

SEQ ID NO: 1220861 - RNA, 23 nt, Homo sapiens
acagaagacccgcucuccaucuu

SEQ ID NO: 1220862 - RNA, 22 nt, Homo sapiens
acagaagcuuuagcaagugugc

SEQ ID NO: 1220863 - RNA, 15 nt, Homo sapiens
acagaagucuccuca

SEQ ID NO: 1220864 - RNA, 19 nt, Homo sapiens
acagaauguaucugugaag

SEQ ID NO: 1220865 - RNA, 23 nt, Homo sapiens
acagaauuucauucauuugugcu

SEQ ID NO: 1220866 - RNA, 20 nt, Homo sapiens
acagaauuuuaaagagcaua

SEQ ID NO: 1220867 - RNA, 15 nt, Homo sapiens
acagacagaagagaa

SEQ ID NO: 1220868 - RNA, 16 nt, Homo sapiens
acagacagagaaggca

SEQ ID NO: 1220869 - RNA, 21 nt, Homo sapiens
agaaugaucuauugcucauca

SEQ ID NO: 1220870 - RNA, 20 nt, Homo sapiens
agaauggagaggaacacagg

SEQ ID NO: 1220871 - RNA, 12 nt, Homo sapiens
agaauggccaaa

SEQ ID NO: 1220872 - RNA, 17 nt, Homo sapiens
agaaugugauauuugaa

SEQ ID NO: 1220873 - RNA, 15 nt, Homo sapiens
agaaugugcucaugc

SEQ ID NO: 1220874 - RNA, 13 nt, Homo sapiens
agaauguuacagu

SEQ ID NO: 1220875 - RNA, 17 nt, Homo sapiens
agaauguucuauuguca

SEQ ID NO: 1220876 - RNA, 18 nt, Homo sapiens
agaauuaaaaaagcauac

SEQ ID NO: 1220877 - RNA, 16 nt, Homo sapiens
agaauuacaguacaca

SEQ ID NO: 1220878 - RNA, 19 nt, Homo sapiens
agaauuacaguacacaucc

SEQ ID NO: 1220879 - RNA, 18 nt, Homo sapiens
agaauuauaagucacaaa

SEQ ID NO: 1220880 - RNA, 23 nt, Homo sapiens
agaauuccuuuucuaacucuccc

SEQ ID NO: 1220881 - RNA, 18 nt, Homo sapiens
agaauucuguacuuccaa

SEQ ID NO: 1220882 - RNA, 18 nt, Homo sapiens
agaauuguagacugaugu

SEQ ID NO: 1220883 - RNA, 13 nt, Homo sapiens
agaauuguaucau

SEQ ID NO: 1220884 - RNA, 14 nt, Homo sapiens
agaauuguauguca

SEQ ID NO: 1220885 - RNA, 21 nt, Homo sapiens
agaauuuaaaacgcaugugca

SEQ ID NO: 1220886 - RNA, 19 nt, Homo sapiens
agaauuuaucccuuuacaa

SEQ ID NO: 1220887 - RNA, 15 nt, Homo sapiens
agaauuucacaagcu

SEQ ID NO: 1220888 - RNA, 10 nt, Homo sapiens
agaauuugca

SEQ ID NO: 1220889 - RNA, 15 nt, Homo sapiens
agaauuuguccaaua

SEQ ID NO: 1220890 - RNA, 23 nt, Homo sapiens
agaauuuuaguguuaaugacucu

SEQ ID NO: 1220891 - RNA, 23 nt, Homo sapiens
agaauuuuauauuuaaauaaagg

SEQ ID NO: 1220892 - RNA, 18 nt, Homo sapiens
agaauuuucugcauuauc

SEQ ID NO: 1220893 - RNA, 16 nt, Homo sapiens
agacaaaauauuuccc

SEQ ID NO: 1220894 - RNA, 18 nt, Homo sapiens
agacaaaucaacagaagc

SEQ ID NO: 1220895 - RNA, 20 nt, Homo sapiens
agacaaauuagccauuucac

SEQ ID NO: 1220896 - RNA, 15 nt, Homo sapiens
agacaacaccuuccu

SEQ ID NO: 1220897 - RNA, 18 nt, Homo sapiens
agacaacaccuuccuccu

SEQ ID NO: 1220898 - RNA, 23 nt, Homo sapiens
agacaacagcccaggcaucuccu

SEQ ID NO: 1220899 - RNA, 15 nt, Homo sapiens
agacaaggaaauacc

SEQ ID NO: 1220900 - RNA, 16 nt, Homo sapiens
agacaaguauggcucc

SEQ ID NO: 1220901 - RNA, 15 nt, Homo sapiens
agacacaauauguau

SEQ ID NO: 1220902 - RNA, 23 nt, Homo sapiens
agacacaauauguaugcuuuuua

SEQ ID NO: 1220903 - RNA, 11 nt, Homo sapiens
agacacagacu

SEQ ID NO: 1220904 - RNA, 14 nt, Homo sapiens
agacacagacuggc

SEQ ID NO: 1220905 - RNA, 20 nt, Homo sapiens
agacacagacuggcaauaaa

SEQ ID NO: 1220906 - RNA, 14 nt, Homo sapiens
agacacagcaagac

SEQ ID NO: 1220907 - RNA, 17 nt, Homo sapiens
agacacaggcccggcuc

SEQ ID NO: 1220908 - RNA, 22 nt, Homo sapiens
agacaccagagcagaugcagag

SEQ ID NO: 1220909 - RNA, 17 nt, Homo sapiens
agacacuaaaugcagac

SEQ ID NO: 1220910 - RNA, 15 nt, Homo sapiens
agacacugaucuggc

SEQ ID NO: 1220911 - RNA, 23 nt, Homo sapiens
agacacugccgacaucagcauug

SEQ ID NO: 1220912 - RNA, 19 nt, Homo sapiens
agacacuggcguuacugcu

SEQ ID NO: 1220913 - RNA, 15 nt, Homo sapiens
agacacugugcuaua

SEQ ID NO: 1220914 - RNA, 14 nt, Homo sapiens
agacagaacuugaa

SEQ ID NO: 1220915 - RNA, 23 nt, Homo sapiens
agacagaagagaaggaagccaua

SEQ ID NO: 1220916 - RNA, 13 nt, Homo sapiens
agacagaagcuua

SEQ ID NO: 1220917 - RNA, 22 nt, Homo sapiens
agacagaguuuucacucuuauu

SEQ ID NO: 1220918 - RNA, 20 nt, Homo sapiens
agacagauccccguuccuga

SEQ ID NO: 1220919 - RNA, 19 nt, Homo sapiens
agacagauuuaaagcacau

SEQ ID NO: 1220920 - RNA, 15 nt, Homo sapiens
agacagcacagggca

SEQ ID NO: 1220921 - RNA, 23 nt, Homo sapiens
agacagcaggcagcgccaagugc

SEQ ID NO: 1220922 - RNA, 19 nt, Homo sapiens
agacagcagggacaagaua

SEQ ID NO: 1220923 - RNA, 20 nt, Homo sapiens
agacagccccagagcagggu

SEQ ID NO: 1220924 - RNA, 17 nt, Homo sapiens
agacagcugcuggguca

SEQ ID NO: 1220925 - RNA, 18 nt, Homo sapiens
agacaggaacccuugcau

SEQ ID NO: 1220926 - RNA, 14 nt, Homo sapiens
agacaggagacaug

SEQ ID NO: 1220927 - RNA, 18 nt, Homo sapiens
agacaggaggauugccug

SEQ ID NO: 1220928 - RNA, 16 nt, Homo sapiens
agacaggcccaagaga

SEQ ID NO: 1220929 - RNA, 18 nt, Homo sapiens
agacaggguuuugccaug

SEQ ID NO: 1220930 - RNA, 14 nt, Homo sapiens
agacaguucaagaa

SEQ ID NO: 1220931 - RNA, 17 nt, Homo sapiens
agacauaggccaugaaa

SEQ ID NO: 1220932 - RNA, 14 nt, Homo sapiens
agacauaucucuaa

SEQ ID NO: 1220933 - RNA, 15 nt, Homo sapiens
agacauaugggccau

SEQ ID NO: 1220934 - RNA, 22 nt, Homo sapiens
agacaucagucuccaacauguu

SEQ ID NO: 1220935 - RNA, 12 nt, Homo sapiens
agacaugaacug

SEQ ID NO: 1220936 - RNA, 14 nt, Homo sapiens
agacaugaaugcac

SEQ ID NO: 1220937 - RNA, 18 nt, Homo sapiens
agacauggagacuccugc

SEQ ID NO: 1220938 - RNA, 16 nt, Homo sapiens
agacaugugcacuuga

SEQ ID NO: 1220939 - RNA, 16 nt, Homo sapiens
agacauuacaaugugu

SEQ ID NO: 1220940 - RNA, 21 nt, Homo sapiens
agacauuucucuaacuccugc

SEQ ID NO: 1220941 - RNA, 23 nt, Homo sapiens
agacauuucucuaacuccugcca

SEQ ID NO: 1220942 - RNA, 19 nt, Homo sapiens
agaccaaagcauugccugc

SEQ ID NO: 1220943 - RNA, 22 nt, Homo sapiens
agaccaaggaacaaaaaaacca

SEQ ID NO: 1220944 - RNA, 23 nt, Homo sapiens
agaccaggccugagcaacaaagc

SEQ ID NO: 1220945 - RNA, 23 nt, Homo sapiens
agaccaguccuguuugcagggaa

SEQ ID NO: 1220946 - RNA, 15 nt, Homo sapiens
agaccauagugacca

SEQ ID NO: 1220947 - RNA, 13 nt, Homo sapiens
agaccauggauuu

SEQ ID NO: 1220948 - RNA, 16 nt, Homo sapiens
agaccauggauuucau

SEQ ID NO: 1220949 - RNA, 20 nt, Homo sapiens
agaccauuuaucugggauua

SEQ ID NO: 1220950 - RNA, 22 nt, Homo sapiens
agacccacgugcuaggggauga

SEQ ID NO: 1220951 - RNA, 17 nt, Homo sapiens
agacccaggagagacag

SEQ ID NO: 1220952 - RNA, 16 nt, Homo sapiens
agacccaggucuucca

SEQ ID NO: 1220953 - RNA, 15 nt, Homo sapiens
agacccgcucuccau

SEQ ID NO: 1220954 - RNA, 16 nt, Homo sapiens
agacccguagaugcca

SEQ ID NO: 1220955 - RNA, 19 nt, Homo sapiens
agacccugagacuccagaa

SEQ ID NO: 1220956 - RNA, 20 nt, Homo sapiens
agaccguuuaccuagaagaa

SEQ ID NO: 1220957 - RNA, 13 nt, Homo sapiens
agaccuacccucc

SEQ ID NO: 1220958 - RNA, 12 nt, Homo sapiens
agaccuagagau

SEQ ID NO: 1220959 - RNA, 16 nt, Homo sapiens
agaccuagcagggaag

SEQ ID NO: 1220960 - RNA, 22 nt, Homo sapiens
agaccucagugccuuccuguuu

SEQ ID NO: 1220961 - RNA, 17 nt, Homo sapiens
agaccugaagugugcac

SEQ ID NO: 1220962 - RNA, 17 nt, Homo sapiens
agaccugaauaccacuu

SEQ ID NO: 1220963 - RNA, 14 nt, Homo sapiens
agaccugacguccc

SEQ ID NO: 1220964 - RNA, 16 nt, Homo sapiens
agaccugcuuccugaa

SEQ ID NO: 1220965 - RNA, 21 nt, Homo sapiens
agaccuggcacuggaugcaga

SEQ ID NO: 1220966 - RNA, 19 nt, Homo sapiens
agaccuguaaucauauaau

SEQ ID NO: 1220967 - RNA, 14 nt, Homo sapiens
agaccugugcuagu

SEQ ID NO: 1220968 - RNA, 18 nt, Homo sapiens
agaccuguguuacuaaaa

SEQ ID NO: 1220969 - RNA, 14 nt, Homo sapiens
agaccuuaauuuau

SEQ ID NO: 1220970 - RNA, 22 nt, Homo sapiens
agacggcggccaggcacagggc

SEQ ID NO: 1220971 - RNA, 15 nt, Homo sapiens
agacgggcacagaca

SEQ ID NO: 1220972 - RNA, 19 nt, Homo sapiens
agacgugcgcgaugugaca

SEQ ID NO: 1220973 - RNA, 15 nt, Homo sapiens
agacuacacaggaug

SEQ ID NO: 1220974 - RNA, 11 nt, Homo sapiens
agacuacaggg

SEQ ID NO: 1220975 - RNA, 12 nt, Homo sapiens
agacuaugauuu

SEQ ID NO: 1220976 - RNA, 14 nt, Homo sapiens
agacuaugauuuac

SEQ ID NO: 1220977 - RNA, 20 nt, Homo sapiens
agacuaugauuuaccuauac

SEQ ID NO: 1220978 - RNA, 20 nt, Homo sapiens
agacuauggagccuggcaca

SEQ ID NO: 1220979 - RNA, 22 nt, Homo sapiens
agacuauguagcaauauaucag

SEQ ID NO: 1220980 - RNA, 16 nt, Homo sapiens
agacuauucuaaugaa

SEQ ID NO: 1220981 - RNA, 17 nt, Homo sapiens
agacucaaauguucuaa

SEQ ID NO: 1220982 - RNA, 23 nt, Homo sapiens
agacucauucccuagaucuuucu

SEQ ID NO: 1220983 - RNA, 20 nt, Homo sapiens
agacucuacagaggccaugg

SEQ ID NO: 1220984 - RNA, 12 nt, Homo sapiens
agacucugaccu

SEQ ID NO: 1220985 - RNA, 16 nt, Homo sapiens
agacucugccauuaaa

SEQ ID NO: 1220986 - RNA, 20 nt, Homo sapiens
agacucugccauuaaaacau

SEQ ID NO: 1220987 - RNA, 14 nt, Homo sapiens
agacucugguguuc

SEQ ID NO: 1220988 - RNA, 18 nt, Homo sapiens
agacucuguaauugaaua

SEQ ID NO: 1220989 - RNA, 13 nt, Homo sapiens
agacucugucuca

SEQ ID NO: 1220990 - RNA, 20 nt, Homo sapiens
agacugaaaugugcucaggc

SEQ ID NO: 1220991 - RNA, 15 nt, Homo sapiens
agacugaagaccagu

SEQ ID NO: 1220992 - RNA, 17 nt, Homo sapiens
agacugaaucuaccugc

SEQ ID NO: 1220993 - RNA, 20 nt, Homo sapiens
agacugaccauauugugcuu

SEQ ID NO: 1220994 - RNA, 23 nt, Homo sapiens
agacugacuuguuugucuuccau

SEQ ID NO: 1220995 - RNA, 18 nt, Homo sapiens
agcaggaaccccaggaga

SEQ ID NO: 1220996 - RNA, 19 nt, Homo sapiens
agcaggacuuugaggcaag

SEQ ID NO: 1220997 - RNA, 18 nt, Homo sapiens
agcaggagagacugagca

SEQ ID NO: 1220998 - RNA, 15 nt, Homo sapiens
agcaggaggccaaua

SEQ ID NO: 1220999 - RNA, 14 nt, Homo sapiens
agcaggcacgggug

SEQ ID NO: 1221000 - RNA, 12 nt, Homo sapiens
agcaggccacug

SEQ ID NO: 1221001 - RNA, 15 nt, Homo sapiens
agcaggccacugggg

SEQ ID NO: 1221002 - RNA, 13 nt, Homo sapiens
agcaggccaggga

SEQ ID NO: 1221003 - RNA, 16 nt, Homo sapiens
agcaggggaggugagg

SEQ ID NO: 1221004 - RNA, 14 nt, Homo sapiens
agcaggucaguaca

SEQ ID NO: 1221005 - RNA, 19 nt, Homo sapiens
agcaguaagcuaucuucaa

SEQ ID NO: 1221006 - RNA, 23 nt, Homo sapiens
agcaguaguuuguuguagguuuc

SEQ ID NO: 1221007 - RNA, 15 nt, Homo sapiens
agcagucaauacaaa

SEQ ID NO: 1221008 - RNA, 15 nt, Homo sapiens
agcagugaaguauaa

SEQ ID NO: 1221009 - RNA, 13 nt, Homo sapiens
agcagugaugaaa

SEQ ID NO: 1221010 - RNA, 16 nt, Homo sapiens
agcagugaugaaaaug

SEQ ID NO: 1221011 - RNA, 17 nt, Homo sapiens
agcagugccuuccauaa

SEQ ID NO: 1221012 - RNA, 13 nt, Homo sapiens
agcagugccuugu

SEQ ID NO: 1221013 - RNA, 15 nt, Homo sapiens
agcagugucuuccau

SEQ ID NO: 1221014 - RNA, 21 nt, Homo sapiens
agcaguuacucccuacacuga

SEQ ID NO: 1221015 - RNA, 11 nt, Homo sapiens
agcaguucugu

SEQ ID NO: 1221016 - RNA, 21 nt, Homo sapiens
agcaguuuaugagacagcuga

SEQ ID NO: 1221017 - RNA, 22 nt, Homo sapiens
agcaguuuaugagacagcugag

SEQ ID NO: 1221018 - RNA, 18 nt, Homo sapiens
agcauaaguuucugggac

SEQ ID NO: 1221019 - RNA, 15 nt, Homo sapiens
agcauacaacuggac

SEQ ID NO: 1221020 - RNA, 12 nt, Homo sapiens
agcauacuuugu

SEQ ID NO: 1221021 - RNA, 15 nt, Homo sapiens
agcauagaaaccacu

SEQ ID NO: 1221022 - RNA, 19 nt, Homo sapiens
agcauauguguuacuucaa

SEQ ID NO: 1221023 - RNA, 19 nt, Homo sapiens
agcaucaauacaaccagcc

SEQ ID NO: 1221024 - RNA, 19 nt, Homo sapiens
agcaucagagaguguacau

SEQ ID NO: 1221025 - RNA, 13 nt, Homo sapiens
agcauccaugugu

SEQ ID NO: 1221026 - RNA, 14 nt, Homo sapiens
agcaucgggagcac

SEQ ID NO: 1221027 - RNA, 19 nt, Homo sapiens
agcaucgggagcacccaga

SEQ ID NO: 1221028 - RNA, 21 nt, Homo sapiens
agcaucuaaguuauaagacuc

SEQ ID NO: 1221029 - RNA, 23 nt, Homo sapiens
agcaucuaucucaucuaucucaa

SEQ ID NO: 1221030 - RNA, 12 nt, Homo sapiens
agcaucucagga

SEQ ID NO: 1221031 - RNA, 15 nt, Homo sapiens
agcaucucaggagau

SEQ ID NO: 1221032 - RNA, 20 nt, Homo sapiens
agcaucucugagcacccaag

SEQ ID NO: 1221033 - RNA, 16 nt, Homo sapiens
agcaucuggcucuaau

SEQ ID NO: 1221034 - RNA, 17 nt, Homo sapiens
agcaugaauaaaacacu

SEQ ID NO: 1221035 - RNA, 12 nt, Homo sapiens
agcaugaugaaa

SEQ ID NO: 1221036 - RNA, 15 nt, Homo sapiens
agcaugaugagaguu

SEQ ID NO: 1221037 - RNA, 19 nt, Homo sapiens
agcaugcuucccagaggga

SEQ ID NO: 1221038 - RNA, 17 nt, Homo sapiens
agcauggagagccucuu

SEQ ID NO: 1221039 - RNA, 16 nt, Homo sapiens
agcauggccacccuca

SEQ ID NO: 1221040 - RNA, 20 nt, Homo sapiens
agcauggccacccucaagag

SEQ ID NO: 1221041 - RNA, 14 nt, Homo sapiens
agcaugguauugaa

SEQ ID NO: 1221042 - RNA, 20 nt, Homo sapiens
agcaugucucaauaguaaaa

SEQ ID NO: 1221043 - RNA, 12 nt, Homo sapiens
agcaugugccaa

SEQ ID NO: 1221044 - RNA, 20 nt, Homo sapiens
agcaugugccaagauucuac

SEQ ID NO: 1221045 - RNA, 17 nt, Homo sapiens
agcauguuuuguauaca

SEQ ID NO: 1221046 - RNA, 18 nt, Homo sapiens
agcauguuuuguauacaa

SEQ ID NO: 1221047 - RNA, 23 nt, Homo sapiens
agcauuacccuccucucucccca

SEQ ID NO: 1221048 - RNA, 14 nt, Homo sapiens
agcauucuuuaaca

SEQ ID NO: 1221049 - RNA, 12 nt, Homo sapiens
agcauugcacuu

SEQ ID NO: 1221050 - RNA, 13 nt, Homo sapiens
agcauugcacuug

SEQ ID NO: 1221051 - RNA, 14 nt, Homo sapiens
agcauugcuuucug

SEQ ID NO: 1221052 - RNA, 20 nt, Homo sapiens
agcauuuaagagugaaguca

SEQ ID NO: 1221053 - RNA, 19 nt, Homo sapiens
agcauuucuugauguugcu

SEQ ID NO: 1221054 - RNA, 23 nt, Homo sapiens
agcauuugguagaaggacugaac

SEQ ID NO: 1221055 - RNA, 18 nt, Homo sapiens
agccaaagagaaugccau

SEQ ID NO: 1221056 - RNA, 20 nt, Homo sapiens
agccaaagagaaugccauuc

SEQ ID NO: 1221057 - RNA, 20 nt, Homo sapiens
agccaaauuuaaaacuguug

SEQ ID NO: 1221058 - RNA, 16 nt, Homo sapiens
agccaacuuuaauugc

SEQ ID NO: 1221059 - RNA, 18 nt, Homo sapiens
agccaacuuuaauugcuu

SEQ ID NO: 1221060 - RNA, 23 nt, Homo sapiens
agccaacuuuugcauguuuugua

SEQ ID NO: 1221061 - RNA, 21 nt, Homo sapiens
agccaagcaaaccaaugguga

SEQ ID NO: 1221062 - RNA, 23 nt, Homo sapiens
agccaagcuuguuaucagcuuuc

SEQ ID NO: 1221063 - RNA, 23 nt, Homo sapiens
agccaaggaggugaggagcagag

SEQ ID NO: 1221064 - RNA, 15 nt, Homo sapiens
agccaaggccgcugu

SEQ ID NO: 1221065 - RNA, 16 nt, Homo sapiens
agccaagggcugagug

SEQ ID NO: 1221066 - RNA, 17 nt, Homo sapiens
agccaauaaaugaacug

SEQ ID NO: 1221067 - RNA, 22 nt, Homo sapiens
agccaauagaguugggacaauu

SEQ ID NO: 1221068 - RNA, 16 nt, Homo sapiens
agccaaugucuccucc

SEQ ID NO: 1221069 - RNA, 15 nt, Homo sapiens
agccaauguuuucca

SEQ ID NO: 1221070 - RNA, 18 nt, Homo sapiens
agccacaaacuccaucca

SEQ ID NO: 1221071 - RNA, 16 nt, Homo sapiens
agccacaagucuucca

SEQ ID NO: 1221072 - RNA, 21 nt, Homo sapiens
agccaccacauuuagaacuuu

SEQ ID NO: 1221073 - RNA, 19 nt, Homo sapiens
agccaccacccacaaucac

SEQ ID NO: 1221074 - RNA, 16 nt, Homo sapiens
agccaccaguucucau

SEQ ID NO: 1221075 - RNA, 18 nt, Homo sapiens
agccacccaagccugcug

SEQ ID NO: 1221076 - RNA, 19 nt, Homo sapiens
agccacgggggacugacgc

SEQ ID NO: 1221077 - RNA, 19 nt, Homo sapiens
agccacucagucucuucca

SEQ ID NO: 1221078 - RNA, 17 nt, Homo sapiens
agccacuugacuggcac

SEQ ID NO: 1221079 - RNA, 18 nt, Homo sapiens
agccagagagcaucuuuc

SEQ ID NO: 1221080 - RNA, 15 nt, Homo sapiens
agccagaggcucuaa

SEQ ID NO: 1221081 - RNA, 18 nt, Homo sapiens
agccagaggcucuaaugu

SEQ ID NO: 1221082 - RNA, 19 nt, Homo sapiens
agccagaggcucuaaugua

SEQ ID NO: 1221083 - RNA, 22 nt, Homo sapiens
agccagaugugaaaacaucuca

SEQ ID NO: 1221084 - RNA, 22 nt, Homo sapiens
agccagcaagagggaacaaaac

SEQ ID NO: 1221085 - RNA, 16 nt, Homo sapiens
agccagcaaugauguc

SEQ ID NO: 1221086 - RNA, 20 nt, Homo sapiens
agccagcaggagcucugacu

SEQ ID NO: 1221087 - RNA, 16 nt, Homo sapiens
agccagccggugccug

SEQ ID NO: 1221088 - RNA, 14 nt, Homo sapiens
agccagccugggac

SEQ ID NO: 1221089 - RNA, 16 nt, Homo sapiens
agccaggaacugugug

SEQ ID NO: 1221090 - RNA, 18 nt, Homo sapiens
agccaggacaucucugcc

SEQ ID NO: 1221091 - RNA, 13 nt, Homo sapiens
agccaggaccugc

SEQ ID NO: 1221092 - RNA, 17 nt, Homo sapiens
agccaggcuaugguugc

SEQ ID NO: 1221093 - RNA, 16 nt, Homo sapiens
agccaggcugccaagg

SEQ ID NO: 1221094 - RNA, 21 nt, Homo sapiens
agccaggguggucuugaucuc

SEQ ID NO: 1221095 - RNA, 22 nt, Homo sapiens
agccaggguggucuugaucucc

SEQ ID NO: 1221096 - RNA, 19 nt, Homo sapiens
agccagguucacacucaga

SEQ ID NO: 1221097 - RNA, 12 nt, Homo sapiens
agccagugccau

SEQ ID NO: 1221098 - RNA, 22 nt, Homo sapiens
agccagugccauuccacuccac

SEQ ID NO: 1221099 - RNA, 17 nt, Homo sapiens
agccaguggggaugagg

SEQ ID NO: 1221100 - RNA, 14 nt, Homo sapiens
agccauaacuugaa

SEQ ID NO: 1221101 - RNA, 15 nt, Homo sapiens
agccauaacuugaaa

SEQ ID NO: 1221102 - RNA, 19 nt, Homo sapiens
agccauaagaaagcacuau

SEQ ID NO: 1221103 - RNA, 23 nt, Homo sapiens
agccauaagaaagcacuauuaau

SEQ ID NO: 1221104 - RNA, 18 nt, Homo sapiens
agccauaggcccaggaua

SEQ ID NO: 1221105 - RNA, 19 nt, Homo sapiens
agccauauuugauaguaua

SEQ ID NO: 1221106 - RNA, 20 nt, Homo sapiens
agccaugaucgagccacugc

SEQ ID NO: 1221107 - RNA, 18 nt, Homo sapiens
agccaugccucaugccac

SEQ ID NO: 1221108 - RNA, 22 nt, Homo sapiens
agccauuucacucucaaacuuc

SEQ ID NO: 1221109 - RNA, 13 nt, Homo sapiens
agcccacaaagcc

SEQ ID NO: 1221110 - RNA, 23 nt, Homo sapiens
agcccacauuggauucaucagca

SEQ ID NO: 1221111 - RNA, 23 nt, Homo sapiens
agcccacccugcugccuucugac

SEQ ID NO: 1221112 - RNA, 16 nt, Homo sapiens
agcccacuguuaauau

SEQ ID NO: 1221113 - RNA, 20 nt, Homo sapiens
agcccacuguuaauauucua

SEQ ID NO: 1221114 - RNA, 16 nt, Homo sapiens
agcccagagacuuugu

SEQ ID NO: 1221115 - RNA, 15 nt, Homo sapiens
agcccaggacucuaa

SEQ ID NO: 1221116 - RNA, 12 nt, Homo sapiens
agcccagggugg

SEQ ID NO: 1221117 - RNA, 11 nt, Homo sapiens
agcccagugag

SEQ ID NO: 1221118 - RNA, 21 nt, Homo sapiens
agcccauggcccccaauaaag

SEQ ID NO: 1221119 - RNA, 22 nt, Homo sapiens
agcccauggugagcucugggaa

SEQ ID NO: 1221120 - RNA, 13 nt, Homo sapiens
agccccacugcca

SEQ ID NO: 1221121 - RNA, 17 nt, Homo sapiens
agcuauccacagcuuac

SEQ ID NO: 1221122 - RNA, 23 nt, Homo sapiens
agcuaugaaaacagcuaucucac

SEQ ID NO: 1221123 - RNA, 22 nt, Homo sapiens
agcuaugauuaugccacugcuu

SEQ ID NO: 1221124 - RNA, 19 nt, Homo sapiens
agcuaugcccggaccucca

SEQ ID NO: 1221125 - RNA, 15 nt, Homo sapiens
agcuauggaaucaau

SEQ ID NO: 1221126 - RNA, 16 nt, Homo sapiens
agcuauuuaucuguag

SEQ ID NO: 1221127 - RNA, 14 nt, Homo sapiens
agcuauuuccauuc

SEQ ID NO: 1221128 - RNA, 23 nt, Homo sapiens
agcucaaaguacuacagcaaagc

SEQ ID NO: 1221129 - RNA, 20 nt, Homo sapiens
agcucaagaacacaugugca

SEQ ID NO: 1221130 - RNA, 13 nt, Homo sapiens
agcucaauggagc

SEQ ID NO: 1221131 - RNA, 15 nt, Homo sapiens
agcucaccacugugc

SEQ ID NO: 1221132 - RNA, 17 nt, Homo sapiens
agcucacggaacuggag

SEQ ID NO: 1221133 - RNA, 23 nt, Homo sapiens
agcucagauuauuuaaaugggaa

SEQ ID NO: 1221134 - RNA, 20 nt, Homo sapiens
agcucagcauuuccacacca

SEQ ID NO: 1221135 - RNA, 16 nt, Homo sapiens
agcucagccacuguga

SEQ ID NO: 1221136 - RNA, 14 nt, Homo sapiens
agcucaggcagcuc

SEQ ID NO: 1221137 - RNA, 19 nt, Homo sapiens
agcucaggcagcucgaggc

SEQ ID NO: 1221138 - RNA, 17 nt, Homo sapiens
agcucaggggcagcuca

SEQ ID NO: 1221139 - RNA, 15 nt, Homo sapiens
agcuccaauuucaag

SEQ ID NO: 1221140 - RNA, 13 nt, Homo sapiens
agcuccacuguca

SEQ ID NO: 1221141 - RNA, 14 nt, Homo sapiens
agcucccccugucc

SEQ ID NO: 1221142 - RNA, 17 nt, Homo sapiens
agcuccccucacucugu

SEQ ID NO: 1221143 - RNA, 15 nt, Homo sapiens
agcucccggggacga

SEQ ID NO: 1221144 - RNA, 12 nt, Homo sapiens
agcuccuggaau

SEQ ID NO: 1221145 - RNA, 23 nt, Homo sapiens
agcuccuucuguccuacucugug

SEQ ID NO: 1221146 - RNA, 16 nt, Homo sapiens
agcuccuugaguaaaa

SEQ ID NO: 1221147 - RNA, 16 nt, Homo sapiens
agcucgcauuugucaa

SEQ ID NO: 1221148 - RNA, 21 nt, Homo sapiens
agcucgccccaccuccaccug

SEQ ID NO: 1221149 - RNA, 17 nt, Homo sapiens
agcucuauaagagcugg

SEQ ID NO: 1221150 - RNA, 17 nt, Homo sapiens
agcucugagccuuccac

SEQ ID NO: 1221151 - RNA, 20 nt, Homo sapiens
agcucugauugcagcacaga

SEQ ID NO: 1221152 - RNA, 23 nt, Homo sapiens
agcucugcagcacucuuaucuac

SEQ ID NO: 1221153 - RNA, 23 nt, Homo sapiens
agcucugccucccucuccauauc

SEQ ID NO: 1221154 - RNA, 15 nt, Homo sapiens
agcucuggcuuccag

SEQ ID NO: 1221155 - RNA, 15 nt, Homo sapiens
agcucuguuuuacaa

SEQ ID NO: 1221156 - RNA, 15 nt, Homo sapiens
agcucuuaauguugc

SEQ ID NO: 1221157 - RNA, 20 nt, Homo sapiens
agcucuuacacuacauuaga

SEQ ID NO: 1221158 - RNA, 11 nt, Homo sapiens
agcucuuccau

SEQ ID NO: 1221159 - RNA, 16 nt, Homo sapiens
agcugaagaauugaaa

SEQ ID NO: 1221160 - RNA, 17 nt, Homo sapiens
agcugaagaccauggau

SEQ ID NO: 1221161 - RNA, 18 nt, Homo sapiens
agcugaauuaucuauaca

SEQ ID NO: 1221162 - RNA, 17 nt, Homo sapiens
agcugaauuauuggaca

SEQ ID NO: 1221163 - RNA, 20 nt, Homo sapiens
agcugaauuugauucuccag

SEQ ID NO: 1221164 - RNA, 15 nt, Homo sapiens
agcugaggacacacc

SEQ ID NO: 1221165 - RNA, 23 nt, Homo sapiens
agcugaguuuccuaugggaacaa

SEQ ID NO: 1221166 - RNA, 16 nt, Homo sapiens
agcugauauaaauucu

SEQ ID NO: 1221167 - RNA, 18 nt, Homo sapiens
agcugaucauaagugaau

SEQ ID NO: 1221168 - RNA, 15 nt, Homo sapiens
agcugauuugauacc

SEQ ID NO: 1221169 - RNA, 22 nt, Homo sapiens
agcugauuugauaccauggcac

SEQ ID NO: 1221170 - RNA, 21 nt, Homo sapiens
agcugcaaauugccugcaaaa

SEQ ID NO: 1221171 - RNA, 14 nt, Homo sapiens
agcugcaauaggaa

SEQ ID NO: 1221172 - RNA, 23 nt, Homo sapiens
agcugcaccagagcaaccucuca

SEQ ID NO: 1221173 - RNA, 12 nt, Homo sapiens
agcugcacugau

SEQ ID NO: 1221174 - RNA, 14 nt, Homo sapiens
agcugcagcucucc

SEQ ID NO: 1221175 - RNA, 14 nt, Homo sapiens
agcugcaggggugc

SEQ ID NO: 1221176 - RNA, 13 nt, Homo sapiens
agcugccucugcu

SEQ ID NO: 1221177 - RNA, 13 nt, Homo sapiens
agcugccugguau

SEQ ID NO: 1221178 - RNA, 16 nt, Homo sapiens
agcugccuuggcucag

SEQ ID NO: 1221179 - RNA, 16 nt, Homo sapiens
agcugcucccaaauaa

SEQ ID NO: 1221180 - RNA, 14 nt, Homo sapiens
agcugcugcugcuc

SEQ ID NO: 1221181 - RNA, 12 nt, Homo sapiens
agcuggaacccg

SEQ ID NO: 1221182 - RNA, 17 nt, Homo sapiens
agcuggaacuacaagga

SEQ ID NO: 1221183 - RNA, 21 nt, Homo sapiens
agcuggaagguacuaugccag

SEQ ID NO: 1221184 - RNA, 17 nt, Homo sapiens
agcuggauauaauguau

SEQ ID NO: 1221185 - RNA, 14 nt, Homo sapiens
agcugggaaccagc

SEQ ID NO: 1221186 - RNA, 19 nt, Homo sapiens
agcugggaaccagcaucuc

SEQ ID NO: 1221187 - RNA, 16 nt, Homo sapiens
agcugggaagaccaau

SEQ ID NO: 1221188 - RNA, 17 nt, Homo sapiens
agcugggacuacagggg

SEQ ID NO: 1221189 - RNA, 12 nt, Homo sapiens
agcugggagcac

SEQ ID NO: 1221190 - RNA, 17 nt, Homo sapiens
agcugggagcacuggug

SEQ ID NO: 1221191 - RNA, 17 nt, Homo sapiens
agcugggauaaucacau

SEQ ID NO: 1221192 - RNA, 23 nt, Homo sapiens
agcugggauaaucacauuaucau

SEQ ID NO: 1221193 - RNA, 19 nt, Homo sapiens
agcugggauuacaggcgug

SEQ ID NO: 1221194 - RNA, 17 nt, Homo sapiens
agcugggcaaagccaca

SEQ ID NO: 1221195 - RNA, 17 nt, Homo sapiens
agcugggccccaugcuc

SEQ ID NO: 1221196 - RNA, 20 nt, Homo sapiens
agcugggccccaugcucugc

SEQ ID NO: 1221197 - RNA, 17 nt, Homo sapiens
agcuggguguguuggca

SEQ ID NO: 1221198 - RNA, 14 nt, Homo sapiens
agcugguaaacuau

SEQ ID NO: 1221199 - RNA, 21 nt, Homo sapiens
agcugguaggauguaagccug

SEQ ID NO: 1221200 - RNA, 16 nt, Homo sapiens
agcugguggcaauaaa

SEQ ID NO: 1221201 - RNA, 20 nt, Homo sapiens
agcuggugguuucacggugc

SEQ ID NO: 1221202 - RNA, 14 nt, Homo sapiens
agcuguagccaugg

SEQ ID NO: 1221203 - RNA, 21 nt, Homo sapiens
agcuguaguagcccuuucugu

SEQ ID NO: 1221204 - RNA, 13 nt, Homo sapiens
agcugucuaugca

SEQ ID NO: 1221205 - RNA, 12 nt, Homo sapiens
agcugucugcuc

SEQ ID NO: 1221206 - RNA, 16 nt, Homo sapiens
agcugugcaggcaugg

SEQ ID NO: 1221207 - RNA, 19 nt, Homo sapiens
agcuguggccagcuuguua

SEQ ID NO: 1221208 - RNA, 17 nt, Homo sapiens
agcugugggacaauuau

SEQ ID NO: 1221209 - RNA, 15 nt, Homo sapiens
agcuguuaccauuca

SEQ ID NO: 1221210 - RNA, 22 nt, Homo sapiens
agcuguuguacauuuaugauuu

SEQ ID NO: 1221211 - RNA, 14 nt, Homo sapiens
agcuuaaacacauu

SEQ ID NO: 1221212 - RNA, 14 nt, Homo sapiens
agcuuaagaaccau

SEQ ID NO: 1221213 - RNA, 18 nt, Homo sapiens
agcuuaagaaccauugau

SEQ ID NO: 1221214 - RNA, 19 nt, Homo sapiens
agcuuaaugcuacauguga

SEQ ID NO: 1221215 - RNA, 14 nt, Homo sapiens
agcuuaugucagac

SEQ ID NO: 1221216 - RNA, 14 nt, Homo sapiens
agcuucacaguacc

SEQ ID NO: 1221217 - RNA, 21 nt, Homo sapiens
agcuucagaaguuuggcaaua

SEQ ID NO: 1221218 - RNA, 21 nt, Homo sapiens
agcuucaggagggaaccagcu

SEQ ID NO: 1221219 - RNA, 17 nt, Homo sapiens
agcuucauuuugguaag

SEQ ID NO: 1221220 - RNA, 20 nt, Homo sapiens
agcuuccuagaaaguucugu

SEQ ID NO: 1221221 - RNA, 22 nt, Homo sapiens
agcuuccuucugggacuggaca

SEQ ID NO: 1221222 - RNA, 14 nt, Homo sapiens
agcuucgaugaugu

SEQ ID NO: 1221223 - RNA, 23 nt, Homo sapiens
agcuucuaauaaauuauacaaau

SEQ ID NO: 1221224 - RNA, 16 nt, Homo sapiens
agcuucuucacaggca

SEQ ID NO: 1221225 - RNA, 17 nt, Homo sapiens
agcuucuuccuaggucc

SEQ ID NO: 1221226 - RNA, 15 nt, Homo sapiens
agcuugaaacauaga

SEQ ID NO: 1221227 - RNA, 13 nt, Homo sapiens
agcuugcagugag

SEQ ID NO: 1221228 - RNA, 14 nt, Homo sapiens
agcuuggagggaug

SEQ ID NO: 1221229 - RNA, 22 nt, Homo sapiens
agcuuggaguucucuauacuca

SEQ ID NO: 1221230 - RNA, 18 nt, Homo sapiens
agcuuggccuacagucau

SEQ ID NO: 1221231 - RNA, 15 nt, Homo sapiens
agcuuguaggagcug

SEQ ID NO: 1221232 - RNA, 21 nt, Homo sapiens
agcuuuaaacucagggacaga

SEQ ID NO: 1221233 - RNA, 22 nt, Homo sapiens
agcuuuauuuuuuaaguauuua

SEQ ID NO: 1221234 - RNA, 16 nt, Homo sapiens
agcuuucaaaagcaag

SEQ ID NO: 1221235 - RNA, 12 nt, Homo sapiens
agcuuugcucuu

SEQ ID NO: 1221236 - RNA, 16 nt, Homo sapiens
agcuuugcugccugag

SEQ ID NO: 1221237 - RNA, 18 nt, Homo sapiens
agcuuugguaaucucugu

SEQ ID NO: 1221238 - RNA, 18 nt, Homo sapiens
agcuuuuaaaaauguccu

SEQ ID NO: 1221239 - RNA, 20 nt, Homo sapiens
agcuuuuagaaauacugcaa

SEQ ID NO: 1221240 - RNA, 19 nt, Homo sapiens
agcuuuuauggaugauuaa

SEQ ID NO: 1221241 - RNA, 18 nt, Homo sapiens
agcuuuugaaauccagaa

SEQ ID NO: 1221242 - RNA, 15 nt, Homo sapiens
agcuuuugccaguau

SEQ ID NO: 1221243 - RNA, 15 nt, Homo sapiens
agcuuuuucccucac

SEQ ID NO: 1221244 - RNA, 17 nt, Homo sapiens
aggaaaaaaaaacagcc

SEQ ID NO: 1221245 - RNA, 18 nt, Homo sapiens
aggaaaaaaagcaaaaag

SEQ ID NO: 1221246 - RNA, 15 nt, Homo sapiens
aggaaaaaaaugacu

SEQ ID NO: 1221247 - RNA, 20 nt, Homo sapiens
aggucacuuuaccucugugg

SEQ ID NO: 1221248 - RNA, 15 nt, Homo sapiens
aggucaggaugcaca

SEQ ID NO: 1221249 - RNA, 12 nt, Homo sapiens
agguccacagag

SEQ ID NO: 1221250 - RNA, 19 nt, Homo sapiens
agguccccuccacauccca

SEQ ID NO: 1221251 - RNA, 22 nt, Homo sapiens
agguccgcccgaccaggaucag

SEQ ID NO: 1221252 - RNA, 18 nt, Homo sapiens
agguccgguguucuaaga

SEQ ID NO: 1221253 - RNA, 20 nt, Homo sapiens
agguccucuacuuaaugaga

SEQ ID NO: 1221254 - RNA, 23 nt, Homo sapiens
agguccucuacuuaaugagauag

SEQ ID NO: 1221255 - RNA, 12 nt, Homo sapiens
aggucggcacuu

SEQ ID NO: 1221256 - RNA, 15 nt, Homo sapiens
aggucggcacuugga

SEQ ID NO: 1221257 - RNA, 11 nt, Homo sapiens
aggucuaucaa

SEQ ID NO: 1221258 - RNA, 20 nt, Homo sapiens
aggucucacgggcaugggca

SEQ ID NO: 1221259 - RNA, 15 nt, Homo sapiens
aggucuguuucucug

SEQ ID NO: 1221260 - RNA, 21 nt, Homo sapiens
aggucuugcaguggcuuuuca

SEQ ID NO: 1221261 - RNA, 19 nt, Homo sapiens
aggugaaaauccaucucau

SEQ ID NO: 1221262 - RNA, 16 nt, Homo sapiens
aggugaaagaaaccac

SEQ ID NO: 1221263 - RNA, 15 nt, Homo sapiens
aggugacugaaggcu

SEQ ID NO: 1221264 - RNA, 21 nt, Homo sapiens
aggugacugaaggcugucagg

SEQ ID NO: 1221265 - RNA, 22 nt, Homo sapiens
aggugacuuguuuacucauuga

SEQ ID NO: 1221266 - RNA, 16 nt, Homo sapiens
aggugaggagggcagu

SEQ ID NO: 1221267 - RNA, 20 nt, Homo sapiens
aggugauccacccaccucag

SEQ ID NO: 1221268 - RNA, 17 nt, Homo sapiens
aggugccuccaggugug

SEQ ID NO: 1221269 - RNA, 19 nt, Homo sapiens
aggugcuacaacaugugag

SEQ ID NO: 1221270 - RNA, 16 nt, Homo sapiens
aggugcuuauucucaa

SEQ ID NO: 1221271 - RNA, 16 nt, Homo sapiens
aggugcuuuguaauau

SEQ ID NO: 1221272 - RNA, 24 nt, Homo sapiens
agguggcaagcugugacuucucca

SEQ ID NO: 1221273 - RNA, 17 nt, Homo sapiens
agguggcgcccaggggc

SEQ ID NO: 1221274 - RNA, 16 nt, Homo sapiens
aggugggacuuuguug

SEQ ID NO: 1221275 - RNA, 15 nt, Homo sapiens
aggugggcacuggag

SEQ ID NO: 1221276 - RNA, 14 nt, Homo sapiens
aggugggcaugcca

SEQ ID NO: 1221277 - RNA, 13 nt, Homo sapiens
aggugggugcugc

SEQ ID NO: 1221278 - RNA, 22 nt, Homo sapiens
aggugguaugugacaccaaagc

SEQ ID NO: 1221279 - RNA, 13 nt, Homo sapiens
aggugucauauga

SEQ ID NO: 1221280 - RNA, 15 nt, Homo sapiens
aggugugacuugaac

SEQ ID NO: 1221281 - RNA, 16 nt, Homo sapiens
aggugugcccuguaca

SEQ ID NO: 1221282 - RNA, 21 nt, Homo sapiens
aggugugcccuguacacaggc

SEQ ID NO: 1221283 - RNA, 16 nt, Homo sapiens
agguguugccaaauau

SEQ ID NO: 1221284 - RNA, 18 nt, Homo sapiens
agguuauugcaauaaagu

SEQ ID NO: 1221285 - RNA, 22 nt, Homo sapiens
agguucccuguucuuccuccag

SEQ ID NO: 1221286 - RNA, 16 nt, Homo sapiens
agguucuaaaguucua

SEQ ID NO: 1221287 - RNA, 19 nt, Homo sapiens
agguucuaggcuaccagaa

SEQ ID NO: 1221288 - RNA, 16 nt, Homo sapiens
agguucugagaccagu

SEQ ID NO: 1221289 - RNA, 14 nt, Homo sapiens
agguucugagauaa

SEQ ID NO: 1221290 - RNA, 18 nt, Homo sapiens
agguucuuagugucacuu

SEQ ID NO: 1221291 - RNA, 15 nt, Homo sapiens
agguucuucagggcc

SEQ ID NO: 1221292 - RNA, 15 nt, Homo sapiens
agguugaacuuugcc

SEQ ID NO: 1221293 - RNA, 14 nt, Homo sapiens
agguugaagccaag

SEQ ID NO: 1221294 - RNA, 20 nt, Homo sapiens
agguugcagugagccaugau

SEQ ID NO: 1221295 - RNA, 13 nt, Homo sapiens
agguuggauuugc

SEQ ID NO: 1221296 - RNA, 19 nt, Homo sapiens
agguugggcuuccaugccu

SEQ ID NO: 1221297 - RNA, 19 nt, Homo sapiens
agguugucuccaggccaug

SEQ ID NO: 1221298 - RNA, 21 nt, Homo sapiens
agguugucuccaggccaugau

SEQ ID NO: 1221299 - RNA, 20 nt, Homo sapiens
agguuuccucuuagguguua

SEQ ID NO: 1221300 - RNA, 13 nt, Homo sapiens
agguuuccugccu

SEQ ID NO: 1221301 - RNA, 21 nt, Homo sapiens
agguuuccuuuuggaacauuu

SEQ ID NO: 1221302 - RNA, 22 nt, Homo sapiens
agguuugguuugguuuuggaca

SEQ ID NO: 1221303 - RNA, 17 nt, Homo sapiens
agguuuuaaagugauua

SEQ ID NO: 1221304 - RNA, 23 nt, Homo sapiens
agguuuuaaccgcacaugcacac

SEQ ID NO: 1221305 - RNA, 22 nt, Homo sapiens
agguuuuuggucugacccacug

SEQ ID NO: 1221306 - RNA, 19 nt, Homo sapiens
aguaaaaacuguucucuau

SEQ ID NO: 1221307 - RNA, 15 nt, Homo sapiens
aguaaaacuguggua

SEQ ID NO: 1221308 - RNA, 19 nt, Homo sapiens
aguaaacgauaaaaugugg

SEQ ID NO: 1221309 - RNA, 16 nt, Homo sapiens
aguaaagaaaugcaua

SEQ ID NO: 1221310 - RNA, 13 nt, Homo sapiens
aguaaagccucaa

SEQ ID NO: 1221311 - RNA, 20 nt, Homo sapiens
aguaaaggcaguaaugccuu

SEQ ID NO: 1221312 - RNA, 18 nt, Homo sapiens
aguaaauaaaaguacaaa

SEQ ID NO: 1221313 - RNA, 20 nt, Homo sapiens
aguaaaucuuuuacaacugc

SEQ ID NO: 1221314 - RNA, 23 nt, Homo sapiens
aguaaaugcuagguuaauuccaa

SEQ ID NO: 1221315 - RNA, 12 nt, Homo sapiens
aguaacaaauaa

SEQ ID NO: 1221316 - RNA, 20 nt, Homo sapiens
aguaacaaauaaagugcagu

SEQ ID NO: 1221317 - RNA, 20 nt, Homo sapiens
aguaacaauacaaauggauu

SEQ ID NO: 1221318 - RNA, 19 nt, Homo sapiens
aguaacaggaaaccacuua

SEQ ID NO: 1221319 - RNA, 15 nt, Homo sapiens
aguaacugagauuac

SEQ ID NO: 1221320 - RNA, 18 nt, Homo sapiens
aguaacuucacauuaaaa

SEQ ID NO: 1221321 - RNA, 19 nt, Homo sapiens
aguaacuuggcuuucauua

SEQ ID NO: 1221322 - RNA, 14 nt, Homo sapiens
aguaagaauaccac

SEQ ID NO: 1221323 - RNA, 14 nt, Homo sapiens
aguaagauaucuca

SEQ ID NO: 1221324 - RNA, 15 nt, Homo sapiens
aguaagauaucucaa

SEQ ID NO: 1221325 - RNA, 21 nt, Homo sapiens
aguaaguaccacucaggccaa

SEQ ID NO: 1221326 - RNA, 17 nt, Homo sapiens
aguaaguuaauaaugua

SEQ ID NO: 1221327 - RNA, 20 nt, Homo sapiens
aguaaguuaauguauauaaa

SEQ ID NO: 1221328 - RNA, 15 nt, Homo sapiens
aguaaguuuauccaa

SEQ ID NO: 1221329 - RNA, 18 nt, Homo sapiens
aguaauaaauuaaaccaa

SEQ ID NO: 1221330 - RNA, 17 nt, Homo sapiens
aguaauacaucaaagag

SEQ ID NO: 1221331 - RNA, 19 nt, Homo sapiens
aguaauagcgccucuuuua

SEQ ID NO: 1221332 - RNA, 16 nt, Homo sapiens
aguaauguuaauucuu

SEQ ID NO: 1221333 - RNA, 16 nt, Homo sapiens
aguaauuucaguguaa

SEQ ID NO: 1221334 - RNA, 22 nt, Homo sapiens
aguacaaagguugcagugcuga

SEQ ID NO: 1221335 - RNA, 18 nt, Homo sapiens
aguacacccaguugccaa

SEQ ID NO: 1221336 - RNA, 14 nt, Homo sapiens
aguaccacacauau

SEQ ID NO: 1221337 - RNA, 17 nt, Homo sapiens
aguaccaccaagggauc

SEQ ID NO: 1221338 - RNA, 22 nt, Homo sapiens
aguaccaccaagggaucugcca

SEQ ID NO: 1221339 - RNA, 22 nt, Homo sapiens
aguaccaccccucucuccccac

SEQ ID NO: 1221340 - RNA, 15 nt, Homo sapiens
aguaccacucaggcc

SEQ ID NO: 1221341 - RNA, 19 nt, Homo sapiens
aguaccagcauguuaacuu

SEQ ID NO: 1221342 - RNA, 23 nt, Homo sapiens
aguaccagcauguuaacuuuauu

SEQ ID NO: 1221343 - RNA, 24 nt, Homo sapiens
aguaccaguauaagcaucugccau

SEQ ID NO: 1221344 - RNA, 20 nt, Homo sapiens
aguaccgcccucggggcccg

SEQ ID NO: 1221345 - RNA, 21 nt, Homo sapiens
aguaccuagcuggcucuguga

SEQ ID NO: 1221346 - RNA, 21 nt, Homo sapiens
aguaccuugcuucuuacugau

SEQ ID NO: 1221347 - RNA, 22 nt, Homo sapiens
aguaccuuuccauuuauucuuu

SEQ ID NO: 1221348 - RNA, 12 nt, Homo sapiens
aguacuaaucau

SEQ ID NO: 1221349 - RNA, 20 nt, Homo sapiens
aguacuauggagugcucaca

SEQ ID NO: 1221350 - RNA, 15 nt, Homo sapiens
aguacuccugcaaaa

SEQ ID NO: 1221351 - RNA, 19 nt, Homo sapiens
aguacucucugcucuagcc

SEQ ID NO: 1221352 - RNA, 17 nt, Homo sapiens
aguacugacuuucugau

SEQ ID NO: 1221353 - RNA, 13 nt, Homo sapiens
aguacugaugaaa

SEQ ID NO: 1221354 - RNA, 15 nt, Homo sapiens
aguacuuuauuguac

SEQ ID NO: 1221355 - RNA, 13 nt, Homo sapiens
aguagaacugucu

SEQ ID NO: 1221356 - RNA, 14 nt, Homo sapiens
aguagagacagggu

SEQ ID NO: 1221357 - RNA, 17 nt, Homo sapiens
aguagaggcaugaugau

SEQ ID NO: 1221358 - RNA, 14 nt, Homo sapiens
aguagcaacaaaag

SEQ ID NO: 1221359 - RNA, 21 nt, Homo sapiens
aguagcugggauuacaggugu

SEQ ID NO: 1221360 - RNA, 23 nt, Homo sapiens
aguagcuuaccagaagcuuccau

SEQ ID NO: 1221361 - RNA, 16 nt, Homo sapiens
aguaggacuuuccuaa

SEQ ID NO: 1221362 - RNA, 18 nt, Homo sapiens
aguaggugugacuugaac

SEQ ID NO: 1221363 - RNA, 18 nt, Homo sapiens
aguaguaauaauagcagc

SEQ ID NO: 1221364 - RNA, 16 nt, Homo sapiens
aguaguaugaugauac

SEQ ID NO: 1221365 - RNA, 19 nt, Homo sapiens
aguaguugguuuccuucac

SEQ ID NO: 1221366 - RNA, 19 nt, Homo sapiens
aguauaaaugaauuugcau

SEQ ID NO: 1221367 - RNA, 18 nt, Homo sapiens
aguauacuuuuccccugu

SEQ ID NO: 1221368 - RNA, 16 nt, Homo sapiens
aguauauuaauaucau

SEQ ID NO: 1221369 - RNA, 17 nt, Homo sapiens
aguauauugauaaccuu

SEQ ID NO: 1221370 - RNA, 16 nt, Homo sapiens
aguauauuuaaacuca

SEQ ID NO: 1221371 - RNA, 21 nt, Homo sapiens
aguaucaggucucccacgugg

SEQ ID NO: 1221372 - RNA, 17 nt, Homo sapiens
aguugccuaagcauugc

SEQ ID NO: 1221373 - RNA, 21 nt, Homo sapiens
aguugcguggacucugcacau

SEQ ID NO: 1221374 - RNA, 19 nt, Homo sapiens
aguugcugcauuccuaaac

SEQ ID NO: 1221375 - RNA, 17 nt, Homo sapiens
aguuggacucucaggga

SEQ ID NO: 1221376 - RNA, 14 nt, Homo sapiens
aguuggaguacuau

SEQ ID NO: 1221377 - RNA, 23 nt, Homo sapiens
aguugggacccaaaacacaggaa

SEQ ID NO: 1221378 - RNA, 16 nt, Homo sapiens
aguugggagcacugga

SEQ ID NO: 1221379 - RNA, 16 nt, Homo sapiens
aguugguggggccagg

SEQ ID NO: 1221380 - RNA, 20 nt, Homo sapiens
aguugucagcuuugacuuua

SEQ ID NO: 1221381 - RNA, 16 nt, Homo sapiens
aguuguuugaggcaaa

SEQ ID NO: 1221382 - RNA, 19 nt, Homo sapiens
aguuguuuuauauguugcu

SEQ ID NO: 1221383 - RNA, 18 nt, Homo sapiens
aguuuaagacaccaaaua

SEQ ID NO: 1221384 - RNA, 18 nt, Homo sapiens
aguuuaaugaacuaccau

SEQ ID NO: 1221385 - RNA, 14 nt, Homo sapiens
aguuuaaugucucc

SEQ ID NO: 1221386 - RNA, 21 nt, Homo sapiens
aguuuaauuuuugaaaacugg

SEQ ID NO: 1221387 - RNA, 16 nt, Homo sapiens
aguuuagggucaagga

SEQ ID NO: 1221388 - RNA, 20 nt, Homo sapiens
aguuuauaaaugugaacuua

SEQ ID NO: 1221389 - RNA, 15 nt, Homo sapiens
aguuuauaagacugg

SEQ ID NO: 1221390 - RNA, 14 nt, Homo sapiens
aguuuaugauggaa

SEQ ID NO: 1221391 - RNA, 21 nt, Homo sapiens
aguuuauuuuuauacuuucag

SEQ ID NO: 1221392 - RNA, 22 nt, Homo sapiens
aguuucagagaaauacuuucag

SEQ ID NO: 1221393 - RNA, 13 nt, Homo sapiens
aguuucaguuugu

SEQ ID NO: 1221394 - RNA, 15 nt, Homo sapiens
aguuucaucagucaa

SEQ ID NO: 1221395 - RNA, 16 nt, Homo sapiens
aguuucccacauucca

SEQ ID NO: 1221396 - RNA, 17 nt, Homo sapiens
aguuucccguccaucuc

SEQ ID NO: 1221397 - RNA, 14 nt, Homo sapiens
aguuucccuuccuc

SEQ ID NO: 1221398 - RNA, 13 nt, Homo sapiens
aguuucucuccac

SEQ ID NO: 1221399 - RNA, 23 nt, Homo sapiens
aguuucuugcuuggaagccaggu

SEQ ID NO: 1221400 - RNA, 22 nt, Homo sapiens
aguuugaacaaaaucuccucuu

SEQ ID NO: 1221401 - RNA, 16 nt, Homo sapiens
aguuugagaccagccu

SEQ ID NO: 1221402 - RNA, 14 nt, Homo sapiens
aguuugaucaaauc

SEQ ID NO: 1221403 - RNA, 13 nt, Homo sapiens
aguuugcacuaua

SEQ ID NO: 1221404 - RNA, 18 nt, Homo sapiens
aguuugcaguuaugcaga

SEQ ID NO: 1221405 - RNA, 17 nt, Homo sapiens
aguuugcuuuguaugca

SEQ ID NO: 1221406 - RNA, 17 nt, Homo sapiens
aguuuggagucacugua

SEQ ID NO: 1221407 - RNA, 16 nt, Homo sapiens
aguuugggccagugaa

SEQ ID NO: 1221408 - RNA, 13 nt, Homo sapiens
aguuuguagcuca

SEQ ID NO: 1221409 - RNA, 17 nt, Homo sapiens
aguuugucagacuuuaa

SEQ ID NO: 1221410 - RNA, 14 nt, Homo sapiens
aguuuuaacuguaa

SEQ ID NO: 1221411 - RNA, 14 nt, Homo sapiens
aguuuuaacugugg

SEQ ID NO: 1221412 - RNA, 21 nt, Homo sapiens
aguuuuaacuuuuauaccuau

SEQ ID NO: 1221413 - RNA, 13 nt, Homo sapiens
aguuuuaguugca

SEQ ID NO: 1221414 - RNA, 17 nt, Homo sapiens
aguuuuaguuggugcug

SEQ ID NO: 1221415 - RNA, 17 nt, Homo sapiens
aguuuuauuuacuucug

SEQ ID NO: 1221416 - RNA, 21 nt, Homo sapiens
aguuuuccucuauacaucucu

SEQ ID NO: 1221417 - RNA, 14 nt, Homo sapiens
aguuuuucugucaa

SEQ ID NO: 1221418 - RNA, 20 nt, Homo sapiens
aguuuuuguucuuaauugca

SEQ ID NO: 1221419 - RNA, 15 nt, Homo sapiens
auaaaaaacauucaa

SEQ ID NO: 1221420 - RNA, 20 nt, Homo sapiens
auaaaaacauaaauaauacc

SEQ ID NO: 1221421 - RNA, 15 nt, Homo sapiens
auaaaaacauuucuu

SEQ ID NO: 1221422 - RNA, 16 nt, Homo sapiens
auaaaaacccaauuca

SEQ ID NO: 1221423 - RNA, 17 nt, Homo sapiens
auaaaaagccucaguga

SEQ ID NO: 1221424 - RNA, 19 nt, Homo sapiens
auaaaaagcgcugcaguag

SEQ ID NO: 1221425 - RNA, 15 nt, Homo sapiens
auaaaaauaaaucag

SEQ ID NO: 1221426 - RNA, 18 nt, Homo sapiens
auaaaaauugacaaugau

SEQ ID NO: 1221427 - RNA, 21 nt, Homo sapiens
auaaaacaucuuuccaguccu

SEQ ID NO: 1221428 - RNA, 14 nt, Homo sapiens
auaaaaccaaguuu

SEQ ID NO: 1221429 - RNA, 13 nt, Homo sapiens
auaaaacugaugu

SEQ ID NO: 1221430 - RNA, 20 nt, Homo sapiens
auaaaacuuuucugcugaua

SEQ ID NO: 1221431 - RNA, 18 nt, Homo sapiens
auaaaagacaagcacuuu

SEQ ID NO: 1221432 - RNA, 16 nt, Homo sapiens
auaaaagacuauucua

SEQ ID NO: 1221433 - RNA, 20 nt, Homo sapiens
auaaaaguacuagcuuacuu

SEQ ID NO: 1221434 - RNA, 17 nt, Homo sapiens
auaaaauaguuguccau

SEQ ID NO: 1221435 - RNA, 17 nt, Homo sapiens
auaaaauguaauuacuu

SEQ ID NO: 1221436 - RNA, 16 nt, Homo sapiens
auaaaauguaugacca

SEQ ID NO: 1221437 - RNA, 15 nt, Homo sapiens
auaaaauguauucaa

SEQ ID NO: 1221438 - RNA, 22 nt, Homo sapiens
auaaaauguucagugcaaucag

SEQ ID NO: 1221439 - RNA, 23 nt, Homo sapiens
auaaaauuuaacuuuugagcaua

SEQ ID NO: 1221440 - RNA, 16 nt, Homo sapiens
auaaacucauuuaacu

SEQ ID NO: 1221441 - RNA, 15 nt, Homo sapiens
auaaacuccuacuaa

SEQ ID NO: 1221442 - RNA, 20 nt, Homo sapiens
auaaagaauuaacagagauu

SEQ ID NO: 1221443 - RNA, 16 nt, Homo sapiens
auaaagauaauacugu

SEQ ID NO: 1221444 - RNA, 22 nt, Homo sapiens
auaaagaucaaacaugcaugga

SEQ ID NO: 1221445 - RNA, 15 nt, Homo sapiens
auaaagcaauguggu

SEQ ID NO: 1221446 - RNA, 17 nt, Homo sapiens
auaaagcaaugugguag

SEQ ID NO: 1221447 - RNA, 12 nt, Homo sapiens
auaaagccaugu

SEQ ID NO: 1221448 - RNA, 15 nt, Homo sapiens
auaaaggacaggcca

SEQ ID NO: 1221449 - RNA, 23 nt, Homo sapiens
auaaaggacaggccacaccacag

SEQ ID NO: 1221450 - RNA, 19 nt, Homo sapiens
auaaaggaucagagauucu

SEQ ID NO: 1221451 - RNA, 19 nt, Homo sapiens
auaaaggcagcugccucug

SEQ ID NO: 1221452 - RNA, 22 nt, Homo sapiens
auaaaggcagcugccucugcuc

SEQ ID NO: 1221453 - RNA, 14 nt, Homo sapiens
auaaaguaccacac

SEQ ID NO: 1221454 - RNA, 18 nt, Homo sapiens
auaaaguaguccugugaa

SEQ ID NO: 1221455 - RNA, 15 nt, Homo sapiens
auaaauaagaucaga

SEQ ID NO: 1221456 - RNA, 18 nt, Homo sapiens
auaaauauacucaaguuu

SEQ ID NO: 1221457 - RNA, 19 nt, Homo sapiens
auaaauauaucuaccccag

SEQ ID NO: 1221458 - RNA, 14 nt, Homo sapiens
auaaauaugcagug

SEQ ID NO: 1221459 - RNA, 15 nt, Homo sapiens
auaaauauuauuaga

SEQ ID NO: 1221460 - RNA, 18 nt, Homo sapiens
auaaauauuuuugccaua

SEQ ID NO: 1221461 - RNA, 22 nt, Homo sapiens
auaaaucucuucuuugcugcag

SEQ ID NO: 1221462 - RNA, 18 nt, Homo sapiens
auaaaucugccauuucaa

SEQ ID NO: 1221463 - RNA, 20 nt, Homo sapiens
auaaaugaaguauuucucac

SEQ ID NO: 1221464 - RNA, 20 nt, Homo sapiens
auaaaugauuaaaaaaucag

SEQ ID NO: 1221465 - RNA, 16 nt, Homo sapiens
auaaauguaccagaga

SEQ ID NO: 1221466 - RNA, 23 nt, Homo sapiens
auaaauguaccagagagaguugu

SEQ ID NO: 1221467 - RNA, 12 nt, Homo sapiens
auaaauguaucu

SEQ ID NO: 1221468 - RNA, 14 nt, Homo sapiens
auaaauguauucaa

SEQ ID NO: 1221469 - RNA, 14 nt, Homo sapiens
auaaaugugaacuu

SEQ ID NO: 1221470 - RNA, 19 nt, Homo sapiens
auaaauucuacuaaguuau

SEQ ID NO: 1221471 - RNA, 20 nt, Homo sapiens
auaaauuuuuugaaacacaa

SEQ ID NO: 1221472 - RNA, 12 nt, Homo sapiens
auaacacugucu

SEQ ID NO: 1221473 - RNA, 13 nt, Homo sapiens
auaacagcauucu

SEQ ID NO: 1221474 - RNA, 18 nt, Homo sapiens
auaacaguuacuccagua

SEQ ID NO: 1221475 - RNA, 15 nt, Homo sapiens
auaacauacaugaga

SEQ ID NO: 1221476 - RNA, 18 nt, Homo sapiens
auaacaucaacaacacag

SEQ ID NO: 1221477 - RNA, 21 nt, Homo sapiens
auaacaugucuuucagcauua

SEQ ID NO: 1221478 - RNA, 11 nt, Homo sapiens
auaaccauagc

SEQ ID NO: 1221479 - RNA, 17 nt, Homo sapiens
auaaccauaugauacua

SEQ ID NO: 1221480 - RNA, 21 nt, Homo sapiens
auaacccuaggaauuuagaca

SEQ ID NO: 1221481 - RNA, 19 nt, Homo sapiens
auaacggugcuugugucac

SEQ ID NO: 1221482 - RNA, 22 nt, Homo sapiens
auaacuauugauauaauuucca

SEQ ID NO: 1221483 - RNA, 17 nt, Homo sapiens
auaacucugcacuacuc

SEQ ID NO: 1221484 - RNA, 18 nt, Homo sapiens
auaacucugcacuacucc

SEQ ID NO: 1221485 - RNA, 22 nt, Homo sapiens
auaacucuuuauuuuuugccau

SEQ ID NO: 1221486 - RNA, 20 nt, Homo sapiens
auaacuggguuggcucucaa

SEQ ID NO: 1221487 - RNA, 22 nt, Homo sapiens
auaacuuggccauguucuccau

SEQ ID NO: 1221488 - RNA, 15 nt, Homo sapiens
auaagaaagcacuau

SEQ ID NO: 1221489 - RNA, 16 nt, Homo sapiens
auaagaaagugcgagu

SEQ ID NO: 1221490 - RNA, 21 nt, Homo sapiens
auaagaagaaguucaugucca

SEQ ID NO: 1221491 - RNA, 13 nt, Homo sapiens
auaagacauaacg

SEQ ID NO: 1221492 - RNA, 14 nt, Homo sapiens
auaagacuacugaa

SEQ ID NO: 1221493 - RNA, 16 nt, Homo sapiens
auaagagaagucucau

SEQ ID NO: 1221494 - RNA, 21 nt, Homo sapiens
auaagaguugagauuuugcaa

SEQ ID NO: 1221495 - RNA, 15 nt, Homo sapiens
auaagaucagacucu

SEQ ID NO: 1221496 - RNA, 16 nt, Homo sapiens
auaagauuaaaggaag

SEQ ID NO: 1221497 - RNA, 16 nt, Homo sapiens
auaagcaauaccagca

SEQ ID NO: 1221498 - RNA, 18 nt, Homo sapiens
auuuaguucaacuguaua

SEQ ID NO: 1221499 - RNA, 14 nt, Homo sapiens
auuuaguuccacaa

SEQ ID NO: 1221500 - RNA, 19 nt, Homo sapiens
auuuauaacagcauucuug

SEQ ID NO: 1221501 - RNA, 15 nt, Homo sapiens
auuuauaacucauca

SEQ ID NO: 1221502 - RNA, 19 nt, Homo sapiens
auuuauaauguuaguagaa

SEQ ID NO: 1221503 - RNA, 14 nt, Homo sapiens
auuuauacagcaga

SEQ ID NO: 1221504 - RNA, 13 nt, Homo sapiens
auuuauacauaca

SEQ ID NO: 1221505 - RNA, 19 nt, Homo sapiens
auuuauaccucaguuugca

SEQ ID NO: 1221506 - RNA, 22 nt, Homo sapiens
auuuauacuuugcaauccaaau

SEQ ID NO: 1221507 - RNA, 14 nt, Homo sapiens
auuuaucagugaca

SEQ ID NO: 1221508 - RNA, 13 nt, Homo sapiens
auuuaucauucuu

SEQ ID NO: 1221509 - RNA, 17 nt, Homo sapiens
auuuaucccuuuacaau

SEQ ID NO: 1221510 - RNA, 15 nt, Homo sapiens
auuuaugaugcacuu

SEQ ID NO: 1221511 - RNA, 21 nt, Homo sapiens
auuuaugucccugacuguaaa

SEQ ID NO: 1221512 - RNA, 13 nt, Homo sapiens
auuuauguguaua

SEQ ID NO: 1221513 - RNA, 13 nt, Homo sapiens
auuuauguuuauu

SEQ ID NO: 1221514 - RNA, 12 nt, Homo sapiens
auuuauucacau

SEQ ID NO: 1221515 - RNA, 22 nt, Homo sapiens
auuuauucaucugggaggcaga

SEQ ID NO: 1221516 - RNA, 11 nt, Homo sapiens
auuuauucucu

SEQ ID NO: 1221517 - RNA, 18 nt, Homo sapiens
auuuauugcuguguaaca

SEQ ID NO: 1221518 - RNA, 15 nt, Homo sapiens
auuuauuuaagcuua

SEQ ID NO: 1221519 - RNA, 20 nt, Homo sapiens
auuuauuuacaacucaaaaa

SEQ ID NO: 1221520 - RNA, 17 nt, Homo sapiens
auuuauuuacagaugaa

SEQ ID NO: 1221521 - RNA, 15 nt, Homo sapiens
auuuauuugguguuu

SEQ ID NO: 1221522 - RNA, 16 nt, Homo sapiens
auuuauuuuuugccau

SEQ ID NO: 1221523 - RNA, 13 nt, Homo sapiens
auuucaaaacaca

SEQ ID NO: 1221524 - RNA, 20 nt, Homo sapiens
auuucaaaugugcugucaaa

SEQ ID NO: 1221525 - RNA, 15 nt, Homo sapiens
auuucaacaagaaua

SEQ ID NO: 1221526 - RNA, 13 nt, Homo sapiens
auuucaagaccuc

SEQ ID NO: 1221527 - RNA, 16 nt, Homo sapiens
auuucaagugccuaga

SEQ ID NO: 1221528 - RNA, 16 nt, Homo sapiens
auuucacaagcuauuu

SEQ ID NO: 1221529 - RNA, 15 nt, Homo sapiens
auuucacacagugaa

SEQ ID NO: 1221530 - RNA, 16 nt, Homo sapiens
auuucaccaccaaaug

SEQ ID NO: 1221531 - RNA, 19 nt, Homo sapiens
auuucacucucaaacuuca

SEQ ID NO: 1221532 - RNA, 14 nt, Homo sapiens
auuucacuugauga

SEQ ID NO: 1221533 - RNA, 21 nt, Homo sapiens
auuucagggagaaacuccaaa

SEQ ID NO: 1221534 - RNA, 13 nt, Homo sapiens
auuucauacugua

SEQ ID NO: 1221535 - RNA, 14 nt, Homo sapiens
auuucauagcugua

SEQ ID NO: 1221536 - RNA, 19 nt, Homo sapiens
auuuccaaaccuccacugc

SEQ ID NO: 1221537 - RNA, 16 nt, Homo sapiens
auuuccaacaccacag

SEQ ID NO: 1221538 - RNA, 21 nt, Homo sapiens
auuuccacaaaaucuguccaa

SEQ ID NO: 1221539 - RNA, 12 nt, Homo sapiens
auuuccagugag

SEQ ID NO: 1221540 - RNA, 20 nt, Homo sapiens
auuuccauugcuuauuaugu

SEQ ID NO: 1221541 - RNA, 23 nt, Homo sapiens
auuuccccaccccagcucaugcc

SEQ ID NO: 1221542 - RNA, 17 nt, Homo sapiens
auuucccccgagcucuu

SEQ ID NO: 1221543 - RNA, 21 nt, Homo sapiens
auuucccuaaaauacauuuaa

SEQ ID NO: 1221544 - RNA, 17 nt, Homo sapiens
auuuccuaauacuguca

SEQ ID NO: 1221545 - RNA, 23 nt, Homo sapiens
auuuccucuaguaucacuuuugc

SEQ ID NO: 1221546 - RNA, 21 nt, Homo sapiens
auuuccucuuuccaagaccaa

SEQ ID NO: 1221547 - RNA, 15 nt, Homo sapiens
auuuccuguacaauc

SEQ ID NO: 1221548 - RNA, 14 nt, Homo sapiens
auuuccuguucccu

SEQ ID NO: 1221549 - RNA, 23 nt, Homo sapiens
auuuccuuaaacuguguggacug

SEQ ID NO: 1221550 - RNA, 13 nt, Homo sapiens
auuuccuugccuu

SEQ ID NO: 1221551 - RNA, 13 nt, Homo sapiens
auuucuacuauga

SEQ ID NO: 1221552 - RNA, 15 nt, Homo sapiens
auuucuauacaacag

SEQ ID NO: 1221553 - RNA, 21 nt, Homo sapiens
auuucucaaaugcacaucuca

SEQ ID NO: 1221554 - RNA, 19 nt, Homo sapiens
auuucucauugacuuuuau

SEQ ID NO: 1221555 - RNA, 16 nt, Homo sapiens
auuucuccaaagccuu

SEQ ID NO: 1221556 - RNA, 23 nt, Homo sapiens
auuucucccuguuauaagcagca

SEQ ID NO: 1221557 - RNA, 17 nt, Homo sapiens
auuucuccguugaguca

SEQ ID NO: 1221558 - RNA, 17 nt, Homo sapiens
auuucucuuuacuugaa

SEQ ID NO: 1221559 - RNA, 19 nt, Homo sapiens
auuucuggagggcaauuug

SEQ ID NO: 1221560 - RNA, 23 nt, Homo sapiens
auuucugguuguuaugugaucau

SEQ ID NO: 1221561 - RNA, 16 nt, Homo sapiens
auuucuguaaauacca

SEQ ID NO: 1221562 - RNA, 23 nt, Homo sapiens
auuucugucuccacgauggugga

SEQ ID NO: 1221563 - RNA, 16 nt, Homo sapiens
auuucuuagagauuaa

SEQ ID NO: 1221564 - RNA, 21 nt, Homo sapiens
auuucuuagugcuucagaguu

SEQ ID NO: 1221565 - RNA, 15 nt, Homo sapiens
auuucuucuacugcu

SEQ ID NO: 1221566 - RNA, 18 nt, Homo sapiens
auuucuuucuuuccuuaa

SEQ ID NO: 1221567 - RNA, 23 nt, Homo sapiens
auuucuuucuuugcaccaaagac

SEQ ID NO: 1221568 - RNA, 15 nt, Homo sapiens
auuucuuuuauguua

SEQ ID NO: 1221569 - RNA, 22 nt, Homo sapiens
auuugaacuacuuaaacaguau

SEQ ID NO: 1221570 - RNA, 21 nt, Homo sapiens
auuugaauuauuucugucaca

SEQ ID NO: 1221571 - RNA, 19 nt, Homo sapiens
auuugaggucaaguaagaa

SEQ ID NO: 1221572 - RNA, 21 nt, Homo sapiens
auuugauacauuuuuguacua

SEQ ID NO: 1221573 - RNA, 20 nt, Homo sapiens
auuugauaccauggcacuga

SEQ ID NO: 1221574 - RNA, 21 nt, Homo sapiens
auuugauaccauggcacugac

SEQ ID NO: 1221575 - RNA, 22 nt, Homo sapiens
auuugauaccauggcacugaca

SEQ ID NO: 1221576 - RNA, 23 nt, Homo sapiens
auuugauaguugguguucaaaaa

SEQ ID NO: 1221577 - RNA, 22 nt, Homo sapiens
auuugauucgcccuccucccug

SEQ ID NO: 1221578 - RNA, 22 nt, Homo sapiens
auuugauugggaugaaugccau

SEQ ID NO: 1221579 - RNA, 16 nt, Homo sapiens
auuugcaacucacuga

SEQ ID NO: 1221580 - RNA, 13 nt, Homo sapiens
auuugcacacugc

SEQ ID NO: 1221581 - RNA, 16 nt, Homo sapiens
auuugcacacugcacu

SEQ ID NO: 1221582 - RNA, 18 nt, Homo sapiens
auuugcacuauuuccaca

SEQ ID NO: 1221583 - RNA, 12 nt, Homo sapiens
auuugcacuuau

SEQ ID NO: 1221584 - RNA, 14 nt, Homo sapiens
auuugcauggauuu

SEQ ID NO: 1221585 - RNA, 16 nt, Homo sapiens
auuugcauuaaauuca

SEQ ID NO: 1221586 - RNA, 19 nt, Homo sapiens
auuugccaacucgaacaaa

SEQ ID NO: 1221587 - RNA, 20 nt, Homo sapiens
auuugccuuucugggagcag

SEQ ID NO: 1221588 - RNA, 22 nt, Homo sapiens
auuugcuaaucaaagccagggu

SEQ ID NO: 1221589 - RNA, 13 nt, Homo sapiens
auuugcugucaca

SEQ ID NO: 1221590 - RNA, 17 nt, Homo sapiens
auuugcuguuuuaaaca

SEQ ID NO: 1221591 - RNA, 15 nt, Homo sapiens
auuuggaaucuucuc

SEQ ID NO: 1221592 - RNA, 19 nt, Homo sapiens
auuuggacucuaagcucua

SEQ ID NO: 1221593 - RNA, 19 nt, Homo sapiens
auuuggacuggugugcucu

SEQ ID NO: 1221594 - RNA, 13 nt, Homo sapiens
auuuggcucacuu

SEQ ID NO: 1221595 - RNA, 20 nt, Homo sapiens
auuugggagcugaaccaaag

SEQ ID NO: 1221596 - RNA, 22 nt, Homo sapiens
auuugggcuacccuaaagggag

SEQ ID NO: 1221597 - RNA, 17 nt, Homo sapiens
auuugguaccauggugu

SEQ ID NO: 1221598 - RNA, 17 nt, Homo sapiens
auuuggugguacuuuau

SEQ ID NO: 1221599 - RNA, 15 nt, Homo sapiens
auuuguagcacugag

SEQ ID NO: 1221600 - RNA, 19 nt, Homo sapiens
auuuguagcauaacuguag

SEQ ID NO: 1221601 - RNA, 20 nt, Homo sapiens
auuuguagcucuggaccugu

SEQ ID NO: 1221602 - RNA, 20 nt, Homo sapiens
auuugucccuaugcauauca

SEQ ID NO: 1221603 - RNA, 19 nt, Homo sapiens
auuugugucaaugggcaau

SEQ ID NO: 1221604 - RNA, 18 nt, Homo sapiens
auuuguuaaaauuaucaa

SEQ ID NO: 1221605 - RNA, 15 nt, Homo sapiens
auuuguucagugacu

SEQ ID NO: 1221606 - RNA, 19 nt, Homo sapiens
auuuuaaguaacauaacua

SEQ ID NO: 1221607 - RNA, 19 nt, Homo sapiens
auuuuaaugaagugcaaua

SEQ ID NO: 1221608 - RNA, 18 nt, Homo sapiens
auuuuacaggugcgaaug

SEQ ID NO: 1221609 - RNA, 19 nt, Homo sapiens
auuuuaccaaagcaucaau

SEQ ID NO: 1221610 - RNA, 18 nt, Homo sapiens
auuuuacuaccaaugcca

SEQ ID NO: 1221611 - RNA, 23 nt, Homo sapiens
auuuuacuauuggaaucugauau

SEQ ID NO: 1221612 - RNA, 16 nt, Homo sapiens
auuuuacugaucucuu

SEQ ID NO: 1221613 - RNA, 15 nt, Homo sapiens
auuuuaggcacuguu

SEQ ID NO: 1221614 - RNA, 18 nt, Homo sapiens
auuuuauaacagaauuaa

SEQ ID NO: 1221615 - RNA, 21 nt, Homo sapiens
auuuuauaccaaagccaauaa

SEQ ID NO: 1221616 - RNA, 17 nt, Homo sapiens
auuuuauaccagcuuau

SEQ ID NO: 1221617 - RNA, 15 nt, Homo sapiens
auuuuauaugaagau

SEQ ID NO: 1221618 - RNA, 20 nt, Homo sapiens
auuuuauaugaugggggaaa

SEQ ID NO: 1221619 - RNA, 14 nt, Homo sapiens
auuuuaucugcuau

SEQ ID NO: 1221620 - RNA, 21 nt, Homo sapiens
auuuuaugcuggacucuggac

SEQ ID NO: 1221621 - RNA, 23 nt, Homo sapiens
auuuuauuguauaaaaaguuuca

SEQ ID NO: 1221622 - RNA, 20 nt, Homo sapiens
auuuuauuuuuuucuaccuu

SEQ ID NO: 1221623 - RNA, 12 nt, Homo sapiens
caacagccaugc

SEQ ID NO: 1221624 - RNA, 22 nt, Homo sapiens
caacaggcuguucugcacugaa

SEQ ID NO: 1221625 - RNA, 23 nt, Homo sapiens
caacaggcuguucugcacugaaa

SEQ ID NO: 1221626 - RNA, 18 nt, Homo sapiens
caacagugagucugucag

SEQ ID NO: 1221627 - RNA, 18 nt, Homo sapiens
caacaguuuuuuaugcua

SEQ ID NO: 1221628 - RNA, 15 nt, Homo sapiens
caacauaacugaagg

SEQ ID NO: 1221629 - RNA, 16 nt, Homo sapiens
caacaucaauccuuua

SEQ ID NO: 1221630 - RNA, 13 nt, Homo sapiens
caacauccugcca

SEQ ID NO: 1221631 - RNA, 20 nt, Homo sapiens
caacauccugccagccccac

SEQ ID NO: 1221632 - RNA, 21 nt, Homo sapiens
caacaucgugaaaccccaucu

SEQ ID NO: 1221633 - RNA, 15 nt, Homo sapiens
caacaugcacugaug

SEQ ID NO: 1221634 - RNA, 12 nt, Homo sapiens
caacaugcugcc

SEQ ID NO: 1221635 - RNA, 20 nt, Homo sapiens
caacauguuacugaccagca

SEQ ID NO: 1221636 - RNA, 18 nt, Homo sapiens
caacauuuuugcaaaucu

SEQ ID NO: 1221637 - RNA, 17 nt, Homo sapiens
caaccaagcgcauccaa

SEQ ID NO: 1221638 - RNA, 21 nt, Homo sapiens
caaccacuguaaaaugaaauu

SEQ ID NO: 1221639 - RNA, 18 nt, Homo sapiens
caaccagagaagcugcua

SEQ ID NO: 1221640 - RNA, 19 nt, Homo sapiens
caaccagagaagcugcuac

SEQ ID NO: 1221641 - RNA, 22 nt, Homo sapiens
caaccagccaggcagguccaca

SEQ ID NO: 1221642 - RNA, 15 nt, Homo sapiens
caaccagugccaagg

SEQ ID NO: 1221643 - RNA, 20 nt, Homo sapiens
caacccaauaaaacugaugu

SEQ ID NO: 1221644 - RNA, 14 nt, Homo sapiens
caacccacuggccc

SEQ ID NO: 1221645 - RNA, 18 nt, Homo sapiens
caacccauucacuacagg

SEQ ID NO: 1221646 - RNA, 17 nt, Homo sapiens
caacccggcacugcccu

SEQ ID NO: 1221647 - RNA, 18 nt, Homo sapiens
caacccuaucuccugaca

SEQ ID NO: 1221648 - RNA, 22 nt, Homo sapiens
caaccuacuaauccucucugca

SEQ ID NO: 1221649 - RNA, 14 nt, Homo sapiens
caaccucugccucc

SEQ ID NO: 1221650 - RNA, 21 nt, Homo sapiens
caaccugaaauuuauucacau

SEQ ID NO: 1221651 - RNA, 18 nt, Homo sapiens
caacgccucacugaaaca

SEQ ID NO: 1221652 - RNA, 14 nt, Homo sapiens
caacuaaugccuua

SEQ ID NO: 1221653 - RNA, 22 nt, Homo sapiens
caacuacagaauuucauucauu

SEQ ID NO: 1221654 - RNA, 17 nt, Homo sapiens
caacuaccuagacugga

SEQ ID NO: 1221655 - RNA, 13 nt, Homo sapiens
caacuagacauuc

SEQ ID NO: 1221656 - RNA, 13 nt, Homo sapiens
caacuaggccuca

SEQ ID NO: 1221657 - RNA, 20 nt, Homo sapiens
caacuaucaaaauugccuuu

SEQ ID NO: 1221658 - RNA, 21 nt, Homo sapiens
caacucaagguucuaguggga

SEQ ID NO: 1221659 - RNA, 20 nt, Homo sapiens
caacucacugauucucuaca

SEQ ID NO: 1221660 - RNA, 11 nt, Homo sapiens
caacucagguu

SEQ ID NO: 1221661 - RNA, 19 nt, Homo sapiens
caacuccauguuugguguu

SEQ ID NO: 1221662 - RNA, 13 nt, Homo sapiens
caacugaccagcc

SEQ ID NO: 1221663 - RNA, 19 nt, Homo sapiens
caacugccauguuuugcca

SEQ ID NO: 1221664 - RNA, 13 nt, Homo sapiens
caacuggacucau

SEQ ID NO: 1221665 - RNA, 19 nt, Homo sapiens
caacugggucugacaugaa

SEQ ID NO: 1221666 - RNA, 13 nt, Homo sapiens
caacuguggcuua

SEQ ID NO: 1221667 - RNA, 16 nt, Homo sapiens
caacuguggucaaucc

SEQ ID NO: 1221668 - RNA, 16 nt, Homo sapiens
caacugugugauuaaa

SEQ ID NO: 1221669 - RNA, 11 nt, Homo sapiens
caacuguguug

SEQ ID NO: 1221670 - RNA, 12 nt, Homo sapiens
caacuguucccg

SEQ ID NO: 1221671 - RNA, 20 nt, Homo sapiens
caacuucagcaguaccuaua

SEQ ID NO: 1221672 - RNA, 23 nt, Homo sapiens
caacuucaguuuuauuuuugcca

SEQ ID NO: 1221673 - RNA, 16 nt, Homo sapiens
caacuuccgcugaggg

SEQ ID NO: 1221674 - RNA, 19 nt, Homo sapiens
caacuugguucugcuucaa

SEQ ID NO: 1221675 - RNA, 20 nt, Homo sapiens
caacuuguauuaaagacaga

SEQ ID NO: 1221676 - RNA, 15 nt, Homo sapiens
caacuuuaagauaga

SEQ ID NO: 1221677 - RNA, 22 nt, Homo sapiens
caacuuuagcuaguaucuucaa

SEQ ID NO: 1221678 - RNA, 12 nt, Homo sapiens
caacuuucugua

SEQ ID NO: 1221679 - RNA, 14 nt, Homo sapiens
caagaaaaccuaga

SEQ ID NO: 1221680 - RNA, 22 nt, Homo sapiens
caagaaaaccuagaucugcacu

SEQ ID NO: 1221681 - RNA, 22 nt, Homo sapiens
caagaaacaaauaauagcaaug

SEQ ID NO: 1221682 - RNA, 15 nt, Homo sapiens
caagaaacacauucu

SEQ ID NO: 1221683 - RNA, 23 nt, Homo sapiens
caagaacauuaucuuaguggaag

SEQ ID NO: 1221684 - RNA, 18 nt, Homo sapiens
caagaacugcauggaccu

SEQ ID NO: 1221685 - RNA, 12 nt, Homo sapiens
caagaaggccaa

SEQ ID NO: 1221686 - RNA, 15 nt, Homo sapiens
caagaagugguccau

SEQ ID NO: 1221687 - RNA, 19 nt, Homo sapiens
caagaauauuguauguuaa

SEQ ID NO: 1221688 - RNA, 20 nt, Homo sapiens
caagaauauuguauguuaaa

SEQ ID NO: 1221689 - RNA, 16 nt, Homo sapiens
caagaauguaacucca

SEQ ID NO: 1221690 - RNA, 15 nt, Homo sapiens
caagacacugagaua

SEQ ID NO: 1221691 - RNA, 13 nt, Homo sapiens
caagaccaaagca

SEQ ID NO: 1221692 - RNA, 20 nt, Homo sapiens
caagaccagccugggcaaca

SEQ ID NO: 1221693 - RNA, 17 nt, Homo sapiens
caagacccccagcacuu

SEQ ID NO: 1221694 - RNA, 16 nt, Homo sapiens
caagacuauaccuuau

SEQ ID NO: 1221695 - RNA, 16 nt, Homo sapiens
caagagagacauggaa

SEQ ID NO: 1221696 - RNA, 19 nt, Homo sapiens
caagagauaagucuuucau

SEQ ID NO: 1221697 - RNA, 19 nt, Homo sapiens
caagagaucuuucuuucca

SEQ ID NO: 1221698 - RNA, 15 nt, Homo sapiens
caagaggcuaacuca

SEQ ID NO: 1221699 - RNA, 21 nt, Homo sapiens
caagaggggguggaggggugu

SEQ ID NO: 1221700 - RNA, 23 nt, Homo sapiens
caagagucaacaggucacuugau

SEQ ID NO: 1221701 - RNA, 15 nt, Homo sapiens
caagaguuuucuucc

SEQ ID NO: 1221702 - RNA, 14 nt, Homo sapiens
caagauaccaaggc

SEQ ID NO: 1221703 - RNA, 17 nt, Homo sapiens
caagauacgcucgccac

SEQ ID NO: 1221704 - RNA, 18 nt, Homo sapiens
caagauccuuaaugcaga

SEQ ID NO: 1221705 - RNA, 21 nt, Homo sapiens
caagaucgcaccauugcacuc

SEQ ID NO: 1221706 - RNA, 15 nt, Homo sapiens
caagaucuguaaugu

SEQ ID NO: 1221707 - RNA, 17 nt, Homo sapiens
caagauuguaaguaaau

SEQ ID NO: 1221708 - RNA, 22 nt, Homo sapiens
caagauuguaaguaaauugccu

SEQ ID NO: 1221709 - RNA, 21 nt, Homo sapiens
caagauuuccuacuuucuccu

SEQ ID NO: 1221710 - RNA, 15 nt, Homo sapiens
caagcaaagugcuuu

SEQ ID NO: 1221711 - RNA, 16 nt, Homo sapiens
caagcaauucuccugc

SEQ ID NO: 1221712 - RNA, 12 nt, Homo sapiens
caagcaccugca

SEQ ID NO: 1221713 - RNA, 19 nt, Homo sapiens
caagcaggcgcugugcuau

SEQ ID NO: 1221714 - RNA, 17 nt, Homo sapiens
caagcagucaguuugca

SEQ ID NO: 1221715 - RNA, 20 nt, Homo sapiens
caagcaugaaccuuguuuaa

SEQ ID NO: 1221716 - RNA, 15 nt, Homo sapiens
caagcauucaagaaa

SEQ ID NO: 1221717 - RNA, 18 nt, Homo sapiens
caagccacaagucuucca

SEQ ID NO: 1221718 - RNA, 15 nt, Homo sapiens
caagccccacccucc

SEQ ID NO: 1221719 - RNA, 20 nt, Homo sapiens
caagccccagcagcccucaa

SEQ ID NO: 1221720 - RNA, 21 nt, Homo sapiens
caagccgagcucuccuuguua

SEQ ID NO: 1221721 - RNA, 17 nt, Homo sapiens
caagccugucuucagag

SEQ ID NO: 1221722 - RNA, 15 nt, Homo sapiens
caagccugugcaaug

SEQ ID NO: 1221723 - RNA, 22 nt, Homo sapiens
caagcuaaaauuagaugaacuc

SEQ ID NO: 1221724 - RNA, 14 nt, Homo sapiens
caagcuauucucau

SEQ ID NO: 1221725 - RNA, 16 nt, Homo sapiens
caagcuccucgugaua

SEQ ID NO: 1221726 - RNA, 20 nt, Homo sapiens
caagcugaaaacaaacaaga

SEQ ID NO: 1221727 - RNA, 17 nt, Homo sapiens
caagcugaccuugcuga

SEQ ID NO: 1221728 - RNA, 21 nt, Homo sapiens
caagcugccgaaccaaaagaa

SEQ ID NO: 1221729 - RNA, 12 nt, Homo sapiens
caagcugccucc

SEQ ID NO: 1221730 - RNA, 21 nt, Homo sapiens
caagcugugacuucuccaggu

SEQ ID NO: 1221731 - RNA, 18 nt, Homo sapiens
caagcuuaauagcccucc

SEQ ID NO: 1221732 - RNA, 21 nt, Homo sapiens
caagcuuguuaucagcuuuca

SEQ ID NO: 1221733 - RNA, 22 nt, Homo sapiens
caagcuuguuaucagcuuucag

SEQ ID NO: 1221734 - RNA, 18 nt, Homo sapiens
caaggaaaaaugcugcuu

SEQ ID NO: 1221735 - RNA, 23 nt, Homo sapiens
caaggaaaaaugcugcuucuccu

SEQ ID NO: 1221736 - RNA, 19 nt, Homo sapiens
caaggaaacgcuaccucuc

SEQ ID NO: 1221737 - RNA, 19 nt, Homo sapiens
caaggaacaaaaaaaccac

SEQ ID NO: 1221738 - RNA, 15 nt, Homo sapiens
caaggaagaccggcu

SEQ ID NO: 1221739 - RNA, 22 nt, Homo sapiens
caaggacguggaugacccuccc

SEQ ID NO: 1221740 - RNA, 15 nt, Homo sapiens
caaggaggaguucca

SEQ ID NO: 1221741 - RNA, 16 nt, Homo sapiens
caaggaggaguuccac

SEQ ID NO: 1221742 - RNA, 23 nt, Homo sapiens
caaggaggccuggggaggcccua

SEQ ID NO: 1221743 - RNA, 19 nt, Homo sapiens
caaggaguacaaugcccag

SEQ ID NO: 1221744 - RNA, 17 nt, Homo sapiens
caaggaguacuccaaga

SEQ ID NO: 1221745 - RNA, 13 nt, Homo sapiens
caaggcaaacccu

SEQ ID NO: 1221746 - RNA, 17 nt, Homo sapiens
caaggcaggugccucca

SEQ ID NO: 1221747 - RNA, 17 nt, Homo sapiens
caaggccagaugcacau

SEQ ID NO: 1221748 - RNA, 13 nt, Homo sapiens
caccugagcauga

SEQ ID NO: 1221749 - RNA, 23 nt, Homo sapiens
caccugcucuucuaccauuugaa

SEQ ID NO: 1221750 - RNA, 23 nt, Homo sapiens
caccuggccugguugugugcaca

SEQ ID NO: 1221751 - RNA, 20 nt, Homo sapiens
caccuguagucccagcuacu

SEQ ID NO: 1221752 - RNA, 21 nt, Homo sapiens
caccuguauaauguuuuguaa

SEQ ID NO: 1221753 - RNA, 14 nt, Homo sapiens
caccugugaguuua

SEQ ID NO: 1221754 - RNA, 18 nt, Homo sapiens
caccuuaagauuuugcac

SEQ ID NO: 1221755 - RNA, 19 nt, Homo sapiens
caccuuaucuauguagaau

SEQ ID NO: 1221756 - RNA, 13 nt, Homo sapiens
caccuucaccucg

SEQ ID NO: 1221757 - RNA, 19 nt, Homo sapiens
caccuucagaggcugaggu

SEQ ID NO: 1221758 - RNA, 14 nt, Homo sapiens
caccuucucggcaa

SEQ ID NO: 1221759 - RNA, 20 nt, Homo sapiens
caccuuguaaccagugcaga

SEQ ID NO: 1221760 - RNA, 11 nt, Homo sapiens
caccuugugau

SEQ ID NO: 1221761 - RNA, 15 nt, Homo sapiens
caccuugugaucaug

SEQ ID NO: 1221762 - RNA, 17 nt, Homo sapiens
caccuugugucuguaca

SEQ ID NO: 1221763 - RNA, 21 nt, Homo sapiens
cacgaaaugggccauuccagu

SEQ ID NO: 1221764 - RNA, 14 nt, Homo sapiens
cacgaugcauuuaa

SEQ ID NO: 1221765 - RNA, 20 nt, Homo sapiens
cacgaugcauuuaauaaaga

SEQ ID NO: 1221766 - RNA, 14 nt, Homo sapiens
cacgauuagcuuua

SEQ ID NO: 1221767 - RNA, 22 nt, Homo sapiens
cacgcacacccugccccuggug

SEQ ID NO: 1221768 - RNA, 12 nt, Homo sapiens
cacgcacgcaca

SEQ ID NO: 1221769 - RNA, 15 nt, Homo sapiens
cacgccuacuuaaga

SEQ ID NO: 1221770 - RNA, 16 nt, Homo sapiens
cacgccuguaauccca

SEQ ID NO: 1221771 - RNA, 16 nt, Homo sapiens
cacgcucgcugccauc

SEQ ID NO: 1221772 - RNA, 19 nt, Homo sapiens
cacgcuguuuguuucauau

SEQ ID NO: 1221773 - RNA, 19 nt, Homo sapiens
cacggaacuggagaaggag

SEQ ID NO: 1221774 - RNA, 15 nt, Homo sapiens
cacggacuguccacc

SEQ ID NO: 1221775 - RNA, 20 nt, Homo sapiens
cacggccacauuugguucua

SEQ ID NO: 1221776 - RNA, 19 nt, Homo sapiens
cacggcuaggaagcagcug

SEQ ID NO: 1221777 - RNA, 12 nt, Homo sapiens
cacggggcacag

SEQ ID NO: 1221778 - RNA, 19 nt, Homo sapiens
cacgguuuggaaauauuca

SEQ ID NO: 1221779 - RNA, 18 nt, Homo sapiens
cacguacacacacauaca

SEQ ID NO: 1221780 - RNA, 12 nt, Homo sapiens
cacgucuuuucu

SEQ ID NO: 1221781 - RNA, 17 nt, Homo sapiens
cacguggcagaccguga

SEQ ID NO: 1221782 - RNA, 15 nt, Homo sapiens
cacguggccucguga

SEQ ID NO: 1221783 - RNA, 14 nt, Homo sapiens
cacuaaacuuuauu

SEQ ID NO: 1221784 - RNA, 19 nt, Homo sapiens
cacuaaaguuacaaacaga

SEQ ID NO: 1221785 - RNA, 13 nt, Homo sapiens
cacuaacauauau

SEQ ID NO: 1221786 - RNA, 13 nt, Homo sapiens
cacuaacauuucc

SEQ ID NO: 1221787 - RNA, 18 nt, Homo sapiens
cacuaaggccgugucucu

SEQ ID NO: 1221788 - RNA, 15 nt, Homo sapiens
cacuaauugcuuucu

SEQ ID NO: 1221789 - RNA, 17 nt, Homo sapiens
cacuaccguaaaugucc

SEQ ID NO: 1221790 - RNA, 14 nt, Homo sapiens
cacuagacaaaacu

SEQ ID NO: 1221791 - RNA, 15 nt, Homo sapiens
cacuagcccaaugaa

SEQ ID NO: 1221792 - RNA, 19 nt, Homo sapiens
cacuagguucaauucccug

SEQ ID NO: 1221793 - RNA, 14 nt, Homo sapiens
cacuagucagaaaa

SEQ ID NO: 1221794 - RNA, 12 nt, Homo sapiens
cacuagucucac

SEQ ID NO: 1221795 - RNA, 15 nt, Homo sapiens
cacuauauguuuaca

SEQ ID NO: 1221796 - RNA, 21 nt, Homo sapiens
cacuaucauggacuacaccag

SEQ ID NO: 1221797 - RNA, 16 nt, Homo sapiens
cacuaugccugacuaa

SEQ ID NO: 1221798 - RNA, 21 nt, Homo sapiens
cacuauuguuccagcaguuuu

SEQ ID NO: 1221799 - RNA, 21 nt, Homo sapiens
cacucaauaaauugcaacaua

SEQ ID NO: 1221800 - RNA, 13 nt, Homo sapiens
cacucagcugucc

SEQ ID NO: 1221801 - RNA, 15 nt, Homo sapiens
cacucagguucuuca

SEQ ID NO: 1221802 - RNA, 16 nt, Homo sapiens
cacucaugaagcauac

SEQ ID NO: 1221803 - RNA, 17 nt, Homo sapiens
cacucauuccuucacuc

SEQ ID NO: 1221804 - RNA, 13 nt, Homo sapiens
cacuccagugcca

SEQ ID NO: 1221805 - RNA, 13 nt, Homo sapiens
cacuccccuaggg

SEQ ID NO: 1221806 - RNA, 17 nt, Homo sapiens
cacucccucugccuuca

SEQ ID NO: 1221807 - RNA, 18 nt, Homo sapiens
cacuccuccuacuguauu

SEQ ID NO: 1221808 - RNA, 13 nt, Homo sapiens
cacuccuucagga

SEQ ID NO: 1221809 - RNA, 22 nt, Homo sapiens
cacucuaccugaaccugcacac

SEQ ID NO: 1221810 - RNA, 17 nt, Homo sapiens
cacucugaauccucaug

SEQ ID NO: 1221811 - RNA, 20 nt, Homo sapiens
cacucugcagacugcuagug

SEQ ID NO: 1221812 - RNA, 13 nt, Homo sapiens
cacucugccaggg

SEQ ID NO: 1221813 - RNA, 14 nt, Homo sapiens
cacucugggcacac

SEQ ID NO: 1221814 - RNA, 17 nt, Homo sapiens
cacucuguaauaguuca

SEQ ID NO: 1221815 - RNA, 18 nt, Homo sapiens
cacucuguaguuacugug

SEQ ID NO: 1221816 - RNA, 12 nt, Homo sapiens
cacucugucauc

SEQ ID NO: 1221817 - RNA, 22 nt, Homo sapiens
cacucuuauugcccacgcugga

SEQ ID NO: 1221818 - RNA, 23 nt, Homo sapiens
cacugaaaaaucuaagugauaua

SEQ ID NO: 1221819 - RNA, 14 nt, Homo sapiens
cacugaaaauguca

SEQ ID NO: 1221820 - RNA, 13 nt, Homo sapiens
cacugaaaccaaa

SEQ ID NO: 1221821 - RNA, 14 nt, Homo sapiens
cacugaaaccaaaa

SEQ ID NO: 1221822 - RNA, 18 nt, Homo sapiens
cacugaauuaaucaucua

SEQ ID NO: 1221823 - RNA, 19 nt, Homo sapiens
cacugacaaugggcacuga

SEQ ID NO: 1221824 - RNA, 15 nt, Homo sapiens
cacugacaguuaaua

SEQ ID NO: 1221825 - RNA, 20 nt, Homo sapiens
cacugagcuccccagaucuc

SEQ ID NO: 1221826 - RNA, 22 nt, Homo sapiens
cacugauaaaaguuuugauauu

SEQ ID NO: 1221827 - RNA, 19 nt, Homo sapiens
cacugauauggguuuauaa

SEQ ID NO: 1221828 - RNA, 11 nt, Homo sapiens
cacugaucaau

SEQ ID NO: 1221829 - RNA, 14 nt, Homo sapiens
cacugaugcaagga

SEQ ID NO: 1221830 - RNA, 17 nt, Homo sapiens
cacugaugcuguucucu

SEQ ID NO: 1221831 - RNA, 21 nt, Homo sapiens
cacugauuacccaaugcaccu

SEQ ID NO: 1221832 - RNA, 21 nt, Homo sapiens
cacugauuugauaccauggca

SEQ ID NO: 1221833 - RNA, 15 nt, Homo sapiens
cacugcacagagcuc

SEQ ID NO: 1221834 - RNA, 20 nt, Homo sapiens
cacugcacagugcaucucag

SEQ ID NO: 1221835 - RNA, 21 nt, Homo sapiens
cacugcaccgggccacagaga

SEQ ID NO: 1221836 - RNA, 14 nt, Homo sapiens
cacugcagcagaaa

SEQ ID NO: 1221837 - RNA, 14 nt, Homo sapiens
cacugccacacucu

SEQ ID NO: 1221838 - RNA, 19 nt, Homo sapiens
cacugccagucucacugug

SEQ ID NO: 1221839 - RNA, 20 nt, Homo sapiens
cacugccccagacacagugc

SEQ ID NO: 1221840 - RNA, 17 nt, Homo sapiens
cacugcccgagcuggug

SEQ ID NO: 1221841 - RNA, 22 nt, Homo sapiens
cacugcccuguucaugugccuc

SEQ ID NO: 1221842 - RNA, 22 nt, Homo sapiens
cacugccuggcccaaaacgucu

SEQ ID NO: 1221843 - RNA, 16 nt, Homo sapiens
cacugcuugaaccaaa

SEQ ID NO: 1221844 - RNA, 13 nt, Homo sapiens
cacuggacacuuc

SEQ ID NO: 1221845 - RNA, 18 nt, Homo sapiens
cacuggaggggucuccuc

SEQ ID NO: 1221846 - RNA, 19 nt, Homo sapiens
cacuggagguugaagccaa

SEQ ID NO: 1221847 - RNA, 14 nt, Homo sapiens
cacuggcuccauga

SEQ ID NO: 1221848 - RNA, 14 nt, Homo sapiens
cacuggcucuccaa

SEQ ID NO: 1221849 - RNA, 13 nt, Homo sapiens
cacuggucuguag

SEQ ID NO: 1221850 - RNA, 21 nt, Homo sapiens
cacugguuuggucaguuacaa

SEQ ID NO: 1221851 - RNA, 20 nt, Homo sapiens
cacuguacaagguaccccuu

SEQ ID NO: 1221852 - RNA, 17 nt, Homo sapiens
cacuguaguucuaagac

SEQ ID NO: 1221853 - RNA, 14 nt, Homo sapiens
cacugucacuuugc

SEQ ID NO: 1221854 - RNA, 13 nt, Homo sapiens
cacugucaucuuc

SEQ ID NO: 1221855 - RNA, 20 nt, Homo sapiens
cacugucaugcuucaucauu

SEQ ID NO: 1221856 - RNA, 16 nt, Homo sapiens
cacuguccaguauucu

SEQ ID NO: 1221857 - RNA, 18 nt, Homo sapiens
cacugucccuugccucaa

SEQ ID NO: 1221858 - RNA, 14 nt, Homo sapiens
cacuguccugacca

SEQ ID NO: 1221859 - RNA, 16 nt, Homo sapiens
cacugucugacuuuag

SEQ ID NO: 1221860 - RNA, 18 nt, Homo sapiens
cacugucuuuaauucugu

SEQ ID NO: 1221861 - RNA, 23 nt, Homo sapiens
cacugugagugaaaauuuuuaca

SEQ ID NO: 1221862 - RNA, 15 nt, Homo sapiens
cacuguggagcucag

SEQ ID NO: 1221863 - RNA, 20 nt, Homo sapiens
cacuguggcauugucuguaa

SEQ ID NO: 1221864 - RNA, 18 nt, Homo sapiens
cacugugggaaggccagc

SEQ ID NO: 1221865 - RNA, 23 nt, Homo sapiens
cacugugggaaggccagcugccc

SEQ ID NO: 1221866 - RNA, 16 nt, Homo sapiens
cacugugucauucugu

SEQ ID NO: 1221867 - RNA, 19 nt, Homo sapiens
cacuguuaauauucuauua

SEQ ID NO: 1221868 - RNA, 10 nt, Homo sapiens
cacuguucaa

SEQ ID NO: 1221869 - RNA, 12 nt, Homo sapiens
cacuguucaaua

SEQ ID NO: 1221870 - RNA, 17 nt, Homo sapiens
cacuguucaauacugua

SEQ ID NO: 1221871 - RNA, 16 nt, Homo sapiens
cacuguugauguaucu

SEQ ID NO: 1221872 - RNA, 22 nt, Homo sapiens
cacuguugucaaaaaguuccau

SEQ ID NO: 1221873 - RNA, 14 nt, Homo sapiens
cacuguuucuaaaa

SEQ ID NO: 1221874 - RNA, 16 nt, Homo sapiens
cacuuaaggggccaag

SEQ ID NO: 1221875 - RNA, 14 nt, Homo sapiens
cagcugcaccugcc

SEQ ID NO: 1221876 - RNA, 15 nt, Homo sapiens
cagcugcaccugcca

SEQ ID NO: 1221877 - RNA, 18 nt, Homo sapiens
cagcugcagaugccacac

SEQ ID NO: 1221878 - RNA, 19 nt, Homo sapiens
cagcugccaucgaccugga

SEQ ID NO: 1221879 - RNA, 16 nt, Homo sapiens
cagcugcgcuugcuuu

SEQ ID NO: 1221880 - RNA, 19 nt, Homo sapiens
cagcugcgguccacccagg

SEQ ID NO: 1221881 - RNA, 21 nt, Homo sapiens
cagcugcugggucaggccacc

SEQ ID NO: 1221882 - RNA, 15 nt, Homo sapiens
cagcugcugugcauu

SEQ ID NO: 1221883 - RNA, 19 nt, Homo sapiens
cagcuggaagggucaacau

SEQ ID NO: 1221884 - RNA, 17 nt, Homo sapiens
cagcugggaagcccuuu

SEQ ID NO: 1221885 - RNA, 19 nt, Homo sapiens
cagcugggccagcaagcac

SEQ ID NO: 1221886 - RNA, 22 nt, Homo sapiens
cagcuguaagaagagacuggga

SEQ ID NO: 1221887 - RNA, 20 nt, Homo sapiens
cagcuguccacugggccauu

SEQ ID NO: 1221888 - RNA, 14 nt, Homo sapiens
cagcuguccagcug

SEQ ID NO: 1221889 - RNA, 15 nt, Homo sapiens
cagcugugcacuuuc

SEQ ID NO: 1221890 - RNA, 21 nt, Homo sapiens
cagcugugcacuuucuucucu

SEQ ID NO: 1221891 - RNA, 23 nt, Homo sapiens
cagcuguggccuaggcuaccuca

SEQ ID NO: 1221892 - RNA, 18 nt, Homo sapiens
cagcugugggacaauuau

SEQ ID NO: 1221893 - RNA, 16 nt, Homo sapiens
cagcuuauaugugaca

SEQ ID NO: 1221894 - RNA, 14 nt, Homo sapiens
cagcuuaugagcuc

SEQ ID NO: 1221895 - RNA, 20 nt, Homo sapiens
cagcuucaggcaccagcauc

SEQ ID NO: 1221896 - RNA, 17 nt, Homo sapiens
cagcuucauuaucugag

SEQ ID NO: 1221897 - RNA, 14 nt, Homo sapiens
cagcuuccaaacau

SEQ ID NO: 1221898 - RNA, 22 nt, Homo sapiens
cagcuuccaaaucucauacaca

SEQ ID NO: 1221899 - RNA, 15 nt, Homo sapiens
cagcuuccugaagca

SEQ ID NO: 1221900 - RNA, 18 nt, Homo sapiens
cagcuucucaaaguacug

SEQ ID NO: 1221901 - RNA, 13 nt, Homo sapiens
cagcuucugggac

SEQ ID NO: 1221902 - RNA, 23 nt, Homo sapiens
cagcuucuggggguagaucucaa

SEQ ID NO: 1221903 - RNA, 22 nt, Homo sapiens
cagcuuguucugggcucaggga

SEQ ID NO: 1221904 - RNA, 23 nt, Homo sapiens
cagcuuuauaacaaauguggcuc

SEQ ID NO: 1221905 - RNA, 16 nt, Homo sapiens
cagcuuucaaaagcaa

SEQ ID NO: 1221906 - RNA, 17 nt, Homo sapiens
cagcuuucaagugccuu

SEQ ID NO: 1221907 - RNA, 23 nt, Homo sapiens
cagcuuugggaucccacccuggg

SEQ ID NO: 1221908 - RNA, 16 nt, Homo sapiens
cagcuuuugcaacuua

SEQ ID NO: 1221909 - RNA, 23 nt, Homo sapiens
caggaaaaaaaaaaaucuaucca

SEQ ID NO: 1221910 - RNA, 14 nt, Homo sapiens
caggaaaccaacac

SEQ ID NO: 1221911 - RNA, 14 nt, Homo sapiens
caggaaaccacuua

SEQ ID NO: 1221912 - RNA, 14 nt, Homo sapiens
caggaaacuagcuu

SEQ ID NO: 1221913 - RNA, 21 nt, Homo sapiens
caggaaacuccacaucugccu

SEQ ID NO: 1221914 - RNA, 20 nt, Homo sapiens
caggaaagaauagaagugau

SEQ ID NO: 1221915 - RNA, 23 nt, Homo sapiens
caggaaauauauaugugugugua

SEQ ID NO: 1221916 - RNA, 19 nt, Homo sapiens
caggaacacccgacuccuc

SEQ ID NO: 1221917 - RNA, 21 nt, Homo sapiens
caggaagcccacacuaugcac

SEQ ID NO: 1221918 - RNA, 22 nt, Homo sapiens
caggaagcccacacuaugcaca

SEQ ID NO: 1221919 - RNA, 23 nt, Homo sapiens
caggaaggaaaugacaccaaaua

SEQ ID NO: 1221920 - RNA, 18 nt, Homo sapiens
caggaagucuucagggaa

SEQ ID NO: 1221921 - RNA, 19 nt, Homo sapiens
caggaaguggccaaaagcu

SEQ ID NO: 1221922 - RNA, 18 nt, Homo sapiens
caggaagugucuagagga

SEQ ID NO: 1221923 - RNA, 15 nt, Homo sapiens
caggaauauuuucca

SEQ ID NO: 1221924 - RNA, 20 nt, Homo sapiens
caggaaugucuggaguggua

SEQ ID NO: 1221925 - RNA, 23 nt, Homo sapiens
caggaauuaugucguaagucacu

SEQ ID NO: 1221926 - RNA, 15 nt, Homo sapiens
caggacaaccugcug

SEQ ID NO: 1221927 - RNA, 17 nt, Homo sapiens
caggacagccacagcca

SEQ ID NO: 1221928 - RNA, 15 nt, Homo sapiens
caggacagguggugc

SEQ ID NO: 1221929 - RNA, 18 nt, Homo sapiens
caggacagucagcucucu

SEQ ID NO: 1221930 - RNA, 19 nt, Homo sapiens
caggacagucagcucucuc

SEQ ID NO: 1221931 - RNA, 12 nt, Homo sapiens
caggaccaauaa

SEQ ID NO: 1221932 - RNA, 12 nt, Homo sapiens
caggaccacaga

SEQ ID NO: 1221933 - RNA, 13 nt, Homo sapiens
caggacggggcac

SEQ ID NO: 1221934 - RNA, 14 nt, Homo sapiens
caggacucagugau

SEQ ID NO: 1221935 - RNA, 19 nt, Homo sapiens
caggacuccaucucuuaaa

SEQ ID NO: 1221936 - RNA, 15 nt, Homo sapiens
caggacugugccuga

SEQ ID NO: 1221937 - RNA, 20 nt, Homo sapiens
caggacuuggaaguggggac

SEQ ID NO: 1221938 - RNA, 20 nt, Homo sapiens
caggagaacaugcuggugaa

SEQ ID NO: 1221939 - RNA, 17 nt, Homo sapiens
caggagaaccacuacau

SEQ ID NO: 1221940 - RNA, 21 nt, Homo sapiens
caggagaagggcuugggcccu

SEQ ID NO: 1221941 - RNA, 18 nt, Homo sapiens
caggagaaucacuggaac

SEQ ID NO: 1221942 - RNA, 18 nt, Homo sapiens
caggagaauuacuugaac

SEQ ID NO: 1221943 - RNA, 15 nt, Homo sapiens
caggagaauugcuug

SEQ ID NO: 1221944 - RNA, 20 nt, Homo sapiens
caggagaccacggggagcaa

SEQ ID NO: 1221945 - RNA, 18 nt, Homo sapiens
caggagaccuggcacugg

SEQ ID NO: 1221946 - RNA, 14 nt, Homo sapiens
caggagagacagag

SEQ ID NO: 1221947 - RNA, 14 nt, Homo sapiens
caggagaguagcaa

SEQ ID NO: 1221948 - RNA, 22 nt, Homo sapiens
caggagcucaggaagaagagau

SEQ ID NO: 1221949 - RNA, 21 nt, Homo sapiens
caggagcugcggccacucuac

SEQ ID NO: 1221950 - RNA, 22 nt, Homo sapiens
caggaggacauagccugcaaag

SEQ ID NO: 1221951 - RNA, 20 nt, Homo sapiens
caggaggcagagguugcagu

SEQ ID NO: 1221952 - RNA, 13 nt, Homo sapiens
caggaggccaaua

SEQ ID NO: 1221953 - RNA, 20 nt, Homo sapiens
caggaggcccccaucuauga

SEQ ID NO: 1221954 - RNA, 19 nt, Homo sapiens
caggaggggaacugaguca

SEQ ID NO: 1221955 - RNA, 20 nt, Homo sapiens
caggaguaucuuaccuguaa

SEQ ID NO: 1221956 - RNA, 17 nt, Homo sapiens
caggagucucugccacc

SEQ ID NO: 1221957 - RNA, 22 nt, Homo sapiens
caggauacuggcacagagguag

SEQ ID NO: 1221958 - RNA, 13 nt, Homo sapiens
caggauauugaca

SEQ ID NO: 1221959 - RNA, 13 nt, Homo sapiens
caggaucaccucc

SEQ ID NO: 1221960 - RNA, 15 nt, Homo sapiens
caggaucauggugua

SEQ ID NO: 1221961 - RNA, 18 nt, Homo sapiens
caggauccagaagggguu

SEQ ID NO: 1221962 - RNA, 15 nt, Homo sapiens
caggaucuguacaau

SEQ ID NO: 1221963 - RNA, 17 nt, Homo sapiens
caggaugaaugaggaaa

SEQ ID NO: 1221964 - RNA, 17 nt, Homo sapiens
caggaugagguggugga

SEQ ID NO: 1221965 - RNA, 13 nt, Homo sapiens
caggaugaguuac

SEQ ID NO: 1221966 - RNA, 19 nt, Homo sapiens
caggaugaguuacuugaaa

SEQ ID NO: 1221967 - RNA, 19 nt, Homo sapiens
caggaugguggacuacaaa

SEQ ID NO: 1221968 - RNA, 16 nt, Homo sapiens
caggauuucuaaucaa

SEQ ID NO: 1221969 - RNA, 20 nt, Homo sapiens
caggcaacgcacaaaacaga

SEQ ID NO: 1221970 - RNA, 16 nt, Homo sapiens
caggcaagcaccuccu

SEQ ID NO: 1221971 - RNA, 17 nt, Homo sapiens
caggcaaggaugucuga

SEQ ID NO: 1221972 - RNA, 14 nt, Homo sapiens
caggcaaugcugua

SEQ ID NO: 1221973 - RNA, 19 nt, Homo sapiens
caggcaccucuuccuugau

SEQ ID NO: 1221974 - RNA, 13 nt, Homo sapiens
caggcaccugcca

SEQ ID NO: 1221975 - RNA, 17 nt, Homo sapiens
caggcacgggucccugc

SEQ ID NO: 1221976 - RNA, 16 nt, Homo sapiens
caggcacuaagacuaa

SEQ ID NO: 1221977 - RNA, 19 nt, Homo sapiens
caggcacuccaaaccuguc

SEQ ID NO: 1221978 - RNA, 14 nt, Homo sapiens
caggcacuccugga

SEQ ID NO: 1221979 - RNA, 12 nt, Homo sapiens
caggcacuuuga

SEQ ID NO: 1221980 - RNA, 19 nt, Homo sapiens
caggcagacuacacaggau

SEQ ID NO: 1221981 - RNA, 17 nt, Homo sapiens
caggcauagaggcuucu

SEQ ID NO: 1221982 - RNA, 15 nt, Homo sapiens
caggcauguucucug

SEQ ID NO: 1221983 - RNA, 19 nt, Homo sapiens
caggccacccaaaggagcu

SEQ ID NO: 1221984 - RNA, 22 nt, Homo sapiens
caggccaccccuaggaacucag

SEQ ID NO: 1221985 - RNA, 17 nt, Homo sapiens
caggccagugaccucau

SEQ ID NO: 1221986 - RNA, 13 nt, Homo sapiens
caggccagugucu

SEQ ID NO: 1221987 - RNA, 15 nt, Homo sapiens
caggccagugucugg

SEQ ID NO: 1221988 - RNA, 17 nt, Homo sapiens
caggccauacuuuacaa

SEQ ID NO: 1221989 - RNA, 17 nt, Homo sapiens
caggccaugugagccac

SEQ ID NO: 1221990 - RNA, 20 nt, Homo sapiens
caggcccuccagugggcuga

SEQ ID NO: 1221991 - RNA, 21 nt, Homo sapiens
caggcccugaucuagugcagu

SEQ ID NO: 1221992 - RNA, 14 nt, Homo sapiens
caggccuccagcgg

SEQ ID NO: 1221993 - RNA, 16 nt, Homo sapiens
caggccugggacccag

SEQ ID NO: 1221994 - RNA, 21 nt, Homo sapiens
caggccuuaauuuucaguaua

SEQ ID NO: 1221995 - RNA, 20 nt, Homo sapiens
caggcgauccaccugucuca

SEQ ID NO: 1221996 - RNA, 16 nt, Homo sapiens
caggcggggugggcag

SEQ ID NO: 1221997 - RNA, 16 nt, Homo sapiens
caggcgugacucagca

SEQ ID NO: 1221998 - RNA, 18 nt, Homo sapiens
caggcuaugguugccacc

SEQ ID NO: 1221999 - RNA, 16 nt, Homo sapiens
caggcuccaggccuca

SEQ ID NO: 1222000 - RNA, 22 nt, Homo sapiens
caggcucucugguguucagggu

SEQ ID NO: 1222001 - RNA, 13 nt, Homo sapiens
caggcucugacca

SEQ ID NO: 1222002 - RNA, 21 nt, Homo sapiens
caggcugcccccaacacucca

SEQ ID NO: 1222003 - RNA, 19 nt, Homo sapiens
caggcuggagugcaaugca

SEQ ID NO: 1222004 - RNA, 19 nt, Homo sapiens
caggcuggagugcaauggc

SEQ ID NO: 1222005 - RNA, 17 nt, Homo sapiens
caggcuggagugcagug

SEQ ID NO: 1222006 - RNA, 14 nt, Homo sapiens
caggcuggccaguc

SEQ ID NO: 1222007 - RNA, 14 nt, Homo sapiens
caggcugggccaug

SEQ ID NO: 1222008 - RNA, 19 nt, Homo sapiens
caggcuguaaauugaacuu

SEQ ID NO: 1222009 - RNA, 17 nt, Homo sapiens
cagggaagagggcagua

SEQ ID NO: 1222010 - RNA, 13 nt, Homo sapiens
cagggacugucuu

SEQ ID NO: 1222011 - RNA, 17 nt, Homo sapiens
cagggagggaaguguga

SEQ ID NO: 1222012 - RNA, 14 nt, Homo sapiens
cagggaggugaccc

SEQ ID NO: 1222013 - RNA, 19 nt, Homo sapiens
cagggauuaggagcagcuc

SEQ ID NO: 1222014 - RNA, 22 nt, Homo sapiens
cagggcaaaugacaugcacuga

SEQ ID NO: 1222015 - RNA, 23 nt, Homo sapiens
cagggcaaaugacaugcacugac

SEQ ID NO: 1222016 - RNA, 15 nt, Homo sapiens
cagggcacuacauaa

SEQ ID NO: 1222017 - RNA, 13 nt, Homo sapiens
cagggccaacuug

SEQ ID NO: 1222018 - RNA, 13 nt, Homo sapiens
cagggccaguccu

SEQ ID NO: 1222019 - RNA, 15 nt, Homo sapiens
cagggccaguccucc

SEQ ID NO: 1222020 - RNA, 21 nt, Homo sapiens
cagggcccugcagaggggaaa

SEQ ID NO: 1222021 - RNA, 16 nt, Homo sapiens
cagggccuuccugguu

SEQ ID NO: 1222022 - RNA, 19 nt, Homo sapiens
cagggcucccugcccugac

SEQ ID NO: 1222023 - RNA, 20 nt, Homo sapiens
cagggcugggccagugcauc

SEQ ID NO: 1222024 - RNA, 18 nt, Homo sapiens
cagggcuuccucuuccgg

SEQ ID NO: 1222025 - RNA, 18 nt, Homo sapiens
caggggaaaaugaagguu

SEQ ID NO: 1222026 - RNA, 16 nt, Homo sapiens
caggggccugcagaag

SEQ ID NO: 1222027 - RNA, 17 nt, Homo sapiens
caggggcuccagcaccu

SEQ ID NO: 1222028 - RNA, 14 nt, Homo sapiens
caggggcucuggag

SEQ ID NO: 1222029 - RNA, 20 nt, Homo sapiens
cagggggugugucugcucag

SEQ ID NO: 1222030 - RNA, 23 nt, Homo sapiens
caggggucauagagcccagugag

SEQ ID NO: 1222031 - RNA, 17 nt, Homo sapiens
cagggguccacugugag

SEQ ID NO: 1222032 - RNA, 21 nt, Homo sapiens
caggggucgucaccaccucuc

SEQ ID NO: 1222033 - RNA, 13 nt, Homo sapiens
caggggugggggg

SEQ ID NO: 1222034 - RNA, 17 nt, Homo sapiens
cagggguggggggugca

SEQ ID NO: 1222035 - RNA, 23 nt, Homo sapiens
cagggguggggguggaggcuucc

SEQ ID NO: 1222036 - RNA, 21 nt, Homo sapiens
caggguacccuuuggggagca

SEQ ID NO: 1222037 - RNA, 18 nt, Homo sapiens
cagggucauguuugcagg

SEQ ID NO: 1222038 - RNA, 18 nt, Homo sapiens
cagggucccucuguguau

SEQ ID NO: 1222039 - RNA, 18 nt, Homo sapiens
caggguccgcaccagcug

SEQ ID NO: 1222040 - RNA, 12 nt, Homo sapiens
cagggucucacu

SEQ ID NO: 1222041 - RNA, 19 nt, Homo sapiens
cagggucucacucugucac

SEQ ID NO: 1222042 - RNA, 21 nt, Homo sapiens
cagggucucacucugucgccc

SEQ ID NO: 1222043 - RNA, 23 nt, Homo sapiens
cagggucugcucuuucucugcca

SEQ ID NO: 1222044 - RNA, 17 nt, Homo sapiens
cagggucugugugaaug

SEQ ID NO: 1222045 - RNA, 17 nt, Homo sapiens
cagggugaagcagcuca

SEQ ID NO: 1222046 - RNA, 22 nt, Homo sapiens
caggguggggggugacagugcc

SEQ ID NO: 1222047 - RNA, 15 nt, Homo sapiens
caggguucucuuagc

SEQ ID NO: 1222048 - RNA, 13 nt, Homo sapiens
caggguuuuuaga

SEQ ID NO: 1222049 - RNA, 19 nt, Homo sapiens
cagguaagggggugcagca

SEQ ID NO: 1222050 - RNA, 17 nt, Homo sapiens
cagguaagucugguuuu

SEQ ID NO: 1222051 - RNA, 13 nt, Homo sapiens
cagguaaugugaa

SEQ ID NO: 1222052 - RNA, 14 nt, Homo sapiens
cagguaaugugaau

SEQ ID NO: 1222053 - RNA, 22 nt, Homo sapiens
cagguaggcccuuguccugcca

SEQ ID NO: 1222054 - RNA, 14 nt, Homo sapiens
caggucaacuucag

SEQ ID NO: 1222055 - RNA, 23 nt, Homo sapiens
caggucacuugaucaugcugcag

SEQ ID NO: 1222056 - RNA, 12 nt, Homo sapiens
caggucagggac

SEQ ID NO: 1222057 - RNA, 16 nt, Homo sapiens
cagguccauuuugccu

SEQ ID NO: 1222058 - RNA, 21 nt, Homo sapiens
caggucucacgggcaugggca

SEQ ID NO: 1222059 - RNA, 17 nt, Homo sapiens
caggugaucuaccugcc

SEQ ID NO: 1222060 - RNA, 17 nt, Homo sapiens
caggugauuaaaaagcu

SEQ ID NO: 1222061 - RNA, 19 nt, Homo sapiens
caggugccaaguuccacuu

SEQ ID NO: 1222062 - RNA, 19 nt, Homo sapiens
caggugcuacaacauguga

SEQ ID NO: 1222063 - RNA, 21 nt, Homo sapiens
caggugcucaauaaacacuug

SEQ ID NO: 1222064 - RNA, 15 nt, Homo sapiens
caggugcuuguucug

SEQ ID NO: 1222065 - RNA, 11 nt, Homo sapiens
caggugggcac

SEQ ID NO: 1222066 - RNA, 14 nt, Homo sapiens
caggugggugcugc

SEQ ID NO: 1222067 - RNA, 15 nt, Homo sapiens
caggugguggcacug

SEQ ID NO: 1222068 - RNA, 19 nt, Homo sapiens
caggugugugccaccacac

SEQ ID NO: 1222069 - RNA, 21 nt, Homo sapiens
caggugugugccaccacaccc

SEQ ID NO: 1222070 - RNA, 14 nt, Homo sapiens
cagguguugccaaa

SEQ ID NO: 1222071 - RNA, 16 nt, Homo sapiens
cagguuaaugcugaaa

SEQ ID NO: 1222072 - RNA, 14 nt, Homo sapiens
cagguuagccuuug

SEQ ID NO: 1222073 - RNA, 15 nt, Homo sapiens
cagguuagccuuugc

SEQ ID NO: 1222074 - RNA, 12 nt, Homo sapiens
cagguucacuuu

SEQ ID NO: 1222075 - RNA, 19 nt, Homo sapiens
cagguuccuuaucugucac

SEQ ID NO: 1222076 - RNA, 13 nt, Homo sapiens
cagguucuucagg

SEQ ID NO: 1222077 - RNA, 16 nt, Homo sapiens
cagguucuucagggcc

SEQ ID NO: 1222078 - RNA, 17 nt, Homo sapiens
cagguuuaacauuugcc

SEQ ID NO: 1222079 - RNA, 14 nt, Homo sapiens
cagguuuguuacau

SEQ ID NO: 1222080 - RNA, 20 nt, Homo sapiens
cagguuuucuguuucugugu

SEQ ID NO: 1222081 - RNA, 19 nt, Homo sapiens
cagguuuugaaaauguaca

SEQ ID NO: 1222082 - RNA, 21 nt, Homo sapiens
caguaaacuuuggcuuauaaa

SEQ ID NO: 1222083 - RNA, 22 nt, Homo sapiens
caguaaagcacuugcaaccguc

SEQ ID NO: 1222084 - RNA, 16 nt, Homo sapiens
caguaaauguuuauua

SEQ ID NO: 1222085 - RNA, 21 nt, Homo sapiens
caguaacauuucuguucucau

SEQ ID NO: 1222086 - RNA, 15 nt, Homo sapiens
caguaaccaugcccg

SEQ ID NO: 1222087 - RNA, 19 nt, Homo sapiens
caguaacccaaaccucaag

SEQ ID NO: 1222088 - RNA, 18 nt, Homo sapiens
caguaacuuuauguguaa

SEQ ID NO: 1222089 - RNA, 18 nt, Homo sapiens
caguaaucugcaucauaa

SEQ ID NO: 1222090 - RNA, 21 nt, Homo sapiens
caguacuguugcgccgcaguu

SEQ ID NO: 1222091 - RNA, 17 nt, Homo sapiens
caguacuuuauuguaca

SEQ ID NO: 1222092 - RNA, 18 nt, Homo sapiens
caguagaaagcauaacaa

SEQ ID NO: 1222093 - RNA, 12 nt, Homo sapiens
caguagacagaa

SEQ ID NO: 1222094 - RNA, 23 nt, Homo sapiens
caguagagcaaaucuaugagauu

SEQ ID NO: 1222095 - RNA, 22 nt, Homo sapiens
caguagcaucuguaacagcauu

SEQ ID NO: 1222096 - RNA, 20 nt, Homo sapiens
caguagcuccaacacuuuga

SEQ ID NO: 1222097 - RNA, 21 nt, Homo sapiens
caguaggggaggagcacaguu

SEQ ID NO: 1222098 - RNA, 19 nt, Homo sapiens
caguaggggcuacugugac

SEQ ID NO: 1222099 - RNA, 16 nt, Homo sapiens
caguagguuggcagua

SEQ ID NO: 1222100 - RNA, 13 nt, Homo sapiens
caguauacugugu

SEQ ID NO: 1222101 - RNA, 18 nt, Homo sapiens
caguaucccacauccaac

SEQ ID NO: 1222102 - RNA, 21 nt, Homo sapiens
caguaucuauauauguguaug

SEQ ID NO: 1222103 - RNA, 15 nt, Homo sapiens
caguaugagucaaug

SEQ ID NO: 1222104 - RNA, 18 nt, Homo sapiens
caguauuagaugcacuua

SEQ ID NO: 1222105 - RNA, 13 nt, Homo sapiens
caguauuaugcau

SEQ ID NO: 1222106 - RNA, 10 nt, Homo sapiens
caguauuuaa

SEQ ID NO: 1222107 - RNA, 15 nt, Homo sapiens
caguauuuaaugaaa

SEQ ID NO: 1222108 - RNA, 19 nt, Homo sapiens
caguauuucaacugcugua

SEQ ID NO: 1222109 - RNA, 14 nt, Homo sapiens
cagucaauuuucac

SEQ ID NO: 1222110 - RNA, 17 nt, Homo sapiens
cagucaccuaugugguc

SEQ ID NO: 1222111 - RNA, 20 nt, Homo sapiens
cagucagcucucuccuuuca

SEQ ID NO: 1222112 - RNA, 14 nt, Homo sapiens
cagucaucuacuuu

SEQ ID NO: 1222113 - RNA, 17 nt, Homo sapiens
cagucccagacaauucc

SEQ ID NO: 1222114 - RNA, 21 nt, Homo sapiens
cagucccagcuaacucugacc

SEQ ID NO: 1222115 - RNA, 23 nt, Homo sapiens
cagucccuaaagaaaaaaaauca

SEQ ID NO: 1222116 - RNA, 23 nt, Homo sapiens
cagucccuuacacguaccucuca

SEQ ID NO: 1222117 - RNA, 22 nt, Homo sapiens
caguccuagcucuuacacauag

SEQ ID NO: 1222118 - RNA, 22 nt, Homo sapiens
caguccucaccacaguuuauug

SEQ ID NO: 1222119 - RNA, 19 nt, Homo sapiens
caguccugccucagccucc

SEQ ID NO: 1222120 - RNA, 18 nt, Homo sapiens
cagucuaaggucucaugc

SEQ ID NO: 1222121 - RNA, 18 nt, Homo sapiens
cagucuaauuacauuuca

SEQ ID NO: 1222122 - RNA, 13 nt, Homo sapiens
cagucucccuucc

SEQ ID NO: 1222123 - RNA, 19 nt, Homo sapiens
cagucucuuucuguacaag

SEQ ID NO: 1222124 - RNA, 14 nt, Homo sapiens
cagucuugccuagg

SEQ ID NO: 1222125 - RNA, 18 nt, Homo sapiens
cagugaaacuccaucuca

SEQ ID NO: 1222126 - RNA, 18 nt, Homo sapiens
ccucaagggccaggacuu

SEQ ID NO: 1222127 - RNA, 23 nt, Homo sapiens
ccucaaucacacugaagccacag

SEQ ID NO: 1222128 - RNA, 14 nt, Homo sapiens
ccucaaucuauucu

SEQ ID NO: 1222129 - RNA, 20 nt, Homo sapiens
ccucaaucuauucuguaaaa

SEQ ID NO: 1222130 - RNA, 13 nt, Homo sapiens
ccucaauucacau

SEQ ID NO: 1222131 - RNA, 15 nt, Homo sapiens
ccucaauucacauag

SEQ ID NO: 1222132 - RNA, 23 nt, Homo sapiens
ccucacacacacagcugggcaaa

SEQ ID NO: 1222133 - RNA, 18 nt, Homo sapiens
ccucacaggccccaggaa

SEQ ID NO: 1222134 - RNA, 20 nt, Homo sapiens
ccucacccccagcuuugcua

SEQ ID NO: 1222135 - RNA, 22 nt, Homo sapiens
ccucacuccuguuacuuaccua

SEQ ID NO: 1222136 - RNA, 14 nt, Homo sapiens
ccucacuugcauca

SEQ ID NO: 1222137 - RNA, 13 nt, Homo sapiens
ccucacuuuacau

SEQ ID NO: 1222138 - RNA, 12 nt, Homo sapiens
ccucagacaucc

SEQ ID NO: 1222139 - RNA, 23 nt, Homo sapiens
ccucagacgagacccaagggcag

SEQ ID NO: 1222140 - RNA, 20 nt, Homo sapiens
ccucagagcauuuaaggaaa

SEQ ID NO: 1222141 - RNA, 17 nt, Homo sapiens
ccucagagcuaacauaa

SEQ ID NO: 1222142 - RNA, 14 nt, Homo sapiens
ccucagaugaucuc

SEQ ID NO: 1222143 - RNA, 17 nt, Homo sapiens
ccucagcucaaugcagu

SEQ ID NO: 1222144 - RNA, 15 nt, Homo sapiens
ccucaggcggggugg

SEQ ID NO: 1222145 - RNA, 18 nt, Homo sapiens
ccucagggagcagggaag

SEQ ID NO: 1222146 - RNA, 11 nt, Homo sapiens
ccucagggugg

SEQ ID NO: 1222147 - RNA, 22 nt, Homo sapiens
ccucagguugcugguugcugug

SEQ ID NO: 1222148 - RNA, 23 nt, Homo sapiens
ccucaguaaauguacaacugcac

SEQ ID NO: 1222149 - RNA, 15 nt, Homo sapiens
ccucagugacaucaa

SEQ ID NO: 1222150 - RNA, 20 nt, Homo sapiens
ccucaguuuuaucauuuuca

SEQ ID NO: 1222151 - RNA, 15 nt, Homo sapiens
ccucaucaacacagu

SEQ ID NO: 1222152 - RNA, 12 nt, Homo sapiens
ccucauccuuuc

SEQ ID NO: 1222153 - RNA, 18 nt, Homo sapiens
ccucauccuuuccugcca

SEQ ID NO: 1222154 - RNA, 13 nt, Homo sapiens
ccucaugagcuga

SEQ ID NO: 1222155 - RNA, 19 nt, Homo sapiens
ccucaugcugcucaauucc

SEQ ID NO: 1222156 - RNA, 22 nt, Homo sapiens
ccucauugcagcuagaggcauc

SEQ ID NO: 1222157 - RNA, 20 nt, Homo sapiens
ccuccaagcuccaucuccac

SEQ ID NO: 1222158 - RNA, 12 nt, Homo sapiens
ccuccaccaaac

SEQ ID NO: 1222159 - RNA, 15 nt, Homo sapiens
ccuccaccugugaga

SEQ ID NO: 1222160 - RNA, 15 nt, Homo sapiens
ccuccagcauuuaaa

SEQ ID NO: 1222161 - RNA, 13 nt, Homo sapiens
ccuccagccacca

SEQ ID NO: 1222162 - RNA, 21 nt, Homo sapiens
ccuccaggaagaagcaggggg

SEQ ID NO: 1222163 - RNA, 18 nt, Homo sapiens
ccuccagggugauuuuau

SEQ ID NO: 1222164 - RNA, 16 nt, Homo sapiens
ccuccaucagagccag

SEQ ID NO: 1222165 - RNA, 18 nt, Homo sapiens
ccuccaugcucccuuaau

SEQ ID NO: 1222166 - RNA, 19 nt, Homo sapiens
ccuccauggcagaagucaa

SEQ ID NO: 1222167 - RNA, 20 nt, Homo sapiens
ccuccauuucucuccaggaa

SEQ ID NO: 1222168 - RNA, 20 nt, Homo sapiens
ccucccaaagugcugagauu

SEQ ID NO: 1222169 - RNA, 20 nt, Homo sapiens
ccucccauaauugcuuugcc

SEQ ID NO: 1222170 - RNA, 21 nt, Homo sapiens
ccucccauaauugcuuugcca

SEQ ID NO: 1222171 - RNA, 13 nt, Homo sapiens
ccuccccaguuca

SEQ ID NO: 1222172 - RNA, 20 nt, Homo sapiens
ccucccgaguagcugggauu

SEQ ID NO: 1222173 - RNA, 15 nt, Homo sapiens
ccucccucaccaaca

SEQ ID NO: 1222174 - RNA, 14 nt, Homo sapiens
ccucccucauucca

SEQ ID NO: 1222175 - RNA, 22 nt, Homo sapiens
ccucccucucucuucugcucca

SEQ ID NO: 1222176 - RNA, 10 nt, Homo sapiens
ccucccugaa

SEQ ID NO: 1222177 - RNA, 19 nt, Homo sapiens
ccucccuggaugacauuaa

SEQ ID NO: 1222178 - RNA, 20 nt, Homo sapiens
ccucccuggaugacauuaaa

SEQ ID NO: 1222179 - RNA, 15 nt, Homo sapiens
ccucccuggucccuu

SEQ ID NO: 1222180 - RNA, 21 nt, Homo sapiens
ccucccugucucugcaucuga

SEQ ID NO: 1222181 - RNA, 15 nt, Homo sapiens
ccuccgccaaugcac

SEQ ID NO: 1222182 - RNA, 13 nt, Homo sapiens
ccuccguccagcc

SEQ ID NO: 1222183 - RNA, 17 nt, Homo sapiens
ccuccgugauccaucca

SEQ ID NO: 1222184 - RNA, 13 nt, Homo sapiens
ccuccuacuguau

SEQ ID NO: 1222185 - RNA, 16 nt, Homo sapiens
ccuccugacagcaaua

SEQ ID NO: 1222186 - RNA, 13 nt, Homo sapiens
ccuccugcugcag

SEQ ID NO: 1222187 - RNA, 13 nt, Homo sapiens
ccuccuggcagcc

SEQ ID NO: 1222188 - RNA, 13 nt, Homo sapiens
ccuccuguaaaug

SEQ ID NO: 1222189 - RNA, 22 nt, Homo sapiens
ccuccugugacgugaggcccau

SEQ ID NO: 1222190 - RNA, 14 nt, Homo sapiens
ccuccuucgggaca

SEQ ID NO: 1222191 - RNA, 23 nt, Homo sapiens
ccuccuugaagcugcccuugaag

SEQ ID NO: 1222192 - RNA, 15 nt, Homo sapiens
ccuccuuggugccug

SEQ ID NO: 1222193 - RNA, 15 nt, Homo sapiens
ccucgacaagaccac

SEQ ID NO: 1222194 - RNA, 23 nt, Homo sapiens
ccucgcaugucucccuccagucc

SEQ ID NO: 1222195 - RNA, 20 nt, Homo sapiens
ccucgcggcucuccagggcu

SEQ ID NO: 1222196 - RNA, 19 nt, Homo sapiens
ccucggccucccaaagugc

SEQ ID NO: 1222197 - RNA, 13 nt, Homo sapiens
ccucgggaagcag

SEQ ID NO: 1222198 - RNA, 23 nt, Homo sapiens
ccucgguucaaaaccuugcacag

SEQ ID NO: 1222199 - RNA, 16 nt, Homo sapiens
ccucguagccaucucu

SEQ ID NO: 1222200 - RNA, 15 nt, Homo sapiens
ccucgugucaucucc

SEQ ID NO: 1222201 - RNA, 19 nt, Homo sapiens
ccucguucaaaacauucca

SEQ ID NO: 1222202 - RNA, 18 nt, Homo sapiens
ccucuaaccgacauuccu

SEQ ID NO: 1222203 - RNA, 19 nt, Homo sapiens
ccucuaagacuuuguauau

SEQ ID NO: 1222204 - RNA, 13 nt, Homo sapiens
ccucuaagguugg

SEQ ID NO: 1222205 - RNA, 14 nt, Homo sapiens
ccucuagaagccaa

SEQ ID NO: 1222206 - RNA, 16 nt, Homo sapiens
ccucuagagucacuga

SEQ ID NO: 1222207 - RNA, 21 nt, Homo sapiens
ccucuaguaagaugcacugaa

SEQ ID NO: 1222208 - RNA, 12 nt, Homo sapiens
ccucucaccaaa

SEQ ID NO: 1222209 - RNA, 18 nt, Homo sapiens
ccucucaggcucuugacu

SEQ ID NO: 1222210 - RNA, 16 nt, Homo sapiens
ccucucaugacuugca

SEQ ID NO: 1222211 - RNA, 16 nt, Homo sapiens
ccucucccuaggagaa

SEQ ID NO: 1222212 - RNA, 16 nt, Homo sapiens
ccucuccgcaguuccu

SEQ ID NO: 1222213 - RNA, 20 nt, Homo sapiens
ccucucgcuccucaaccccu

SEQ ID NO: 1222214 - RNA, 16 nt, Homo sapiens
ccucucucagugucaa

SEQ ID NO: 1222215 - RNA, 21 nt, Homo sapiens
ccucucucucccaggucccag

SEQ ID NO: 1222216 - RNA, 13 nt, Homo sapiens
ccucucugcuccu

SEQ ID NO: 1222217 - RNA, 18 nt, Homo sapiens
ccucucuguugaagucag

SEQ ID NO: 1222218 - RNA, 20 nt, Homo sapiens
ccucucuuuguucucagcuc

SEQ ID NO: 1222219 - RNA, 21 nt, Homo sapiens
ccucugacauuuauccaagac

SEQ ID NO: 1222220 - RNA, 19 nt, Homo sapiens
ccucugacccuagcucuuu

SEQ ID NO: 1222221 - RNA, 11 nt, Homo sapiens
ccucugcauuu

SEQ ID NO: 1222222 - RNA, 24 nt, Homo sapiens
ccucugcccuccgaggccgugcag

SEQ ID NO: 1222223 - RNA, 22 nt, Homo sapiens
ccucugcggaccccagcuguga

SEQ ID NO: 1222224 - RNA, 18 nt, Homo sapiens
ccucugcuaagguguauu

SEQ ID NO: 1222225 - RNA, 14 nt, Homo sapiens
ccucugcugccaug

SEQ ID NO: 1222226 - RNA, 15 nt, Homo sapiens
ccucuggggcauuau

SEQ ID NO: 1222227 - RNA, 21 nt, Homo sapiens
ccucugucauucgcucccaca

SEQ ID NO: 1222228 - RNA, 14 nt, Homo sapiens
ccucuguccaggca

SEQ ID NO: 1222229 - RNA, 19 nt, Homo sapiens
ccucuuauugggauaucau

SEQ ID NO: 1222230 - RNA, 17 nt, Homo sapiens
ccucuucaccuuauuca

SEQ ID NO: 1222231 - RNA, 12 nt, Homo sapiens
ccucuucccaca

SEQ ID NO: 1222232 - RNA, 17 nt, Homo sapiens
ccucuucccaugacugc

SEQ ID NO: 1222233 - RNA, 20 nt, Homo sapiens
ccucuucccuucaacaugaa

SEQ ID NO: 1222234 - RNA, 17 nt, Homo sapiens
ccucuugacuuccccac

SEQ ID NO: 1222235 - RNA, 13 nt, Homo sapiens
ccucuugcugucu

SEQ ID NO: 1222236 - RNA, 22 nt, Homo sapiens
ccucuuggugugauugcacaga

SEQ ID NO: 1222237 - RNA, 13 nt, Homo sapiens
ccucuuuccaaga

SEQ ID NO: 1222238 - RNA, 23 nt, Homo sapiens
ccucuuuucugcaucaucuguag

SEQ ID NO: 1222239 - RNA, 15 nt, Homo sapiens
ccugaaaauucugua

SEQ ID NO: 1222240 - RNA, 17 nt, Homo sapiens
ccugaaaauugcaauac

SEQ ID NO: 1222241 - RNA, 13 nt, Homo sapiens
ccugaaagccaca

SEQ ID NO: 1222242 - RNA, 17 nt, Homo sapiens
ccugaaauuuuaaugaa

SEQ ID NO: 1222243 - RNA, 19 nt, Homo sapiens
ccugaacuuucucccucau

SEQ ID NO: 1222244 - RNA, 24 nt, Homo sapiens
ccugaagacugaggacaaagugga

SEQ ID NO: 1222245 - RNA, 17 nt, Homo sapiens
ccugaagaucuagugaa

SEQ ID NO: 1222246 - RNA, 19 nt, Homo sapiens
ccugaagcguuuuucucaa

SEQ ID NO: 1222247 - RNA, 17 nt, Homo sapiens
ccugaagcugaccaaca

SEQ ID NO: 1222248 - RNA, 20 nt, Homo sapiens
ccugaaggaaaauaaacuga

SEQ ID NO: 1222249 - RNA, 19 nt, Homo sapiens
ccugaauguuucagaccac

SEQ ID NO: 1222250 - RNA, 17 nt, Homo sapiens
ccugaauuuuguugcug

SEQ ID NO: 1222251 - RNA, 15 nt, Homo sapiens
ccugacaagugccug

SEQ ID NO: 1222252 - RNA, 14 nt, Homo sapiens
cggauacaaacugg

SEQ ID NO: 1222253 - RNA, 14 nt, Homo sapiens
cggcaacaucucug

SEQ ID NO: 1222254 - RNA, 12 nt, Homo sapiens
cggcacauuccc

SEQ ID NO: 1222255 - RNA, 18 nt, Homo sapiens
cggcacccugauccucac

SEQ ID NO: 1222256 - RNA, 21 nt, Homo sapiens
cggcagcgggcggaggggauc

SEQ ID NO: 1222257 - RNA, 21 nt, Homo sapiens
cggcagggugucccaggagcc

SEQ ID NO: 1222258 - RNA, 22 nt, Homo sapiens
cggcaguauggaauuccagugc

SEQ ID NO: 1222259 - RNA, 16 nt, Homo sapiens
cggcagucacuuccac

SEQ ID NO: 1222260 - RNA, 15 nt, Homo sapiens
cggccacagggcggu

SEQ ID NO: 1222261 - RNA, 17 nt, Homo sapiens
cggcccagaaguuuccc

SEQ ID NO: 1222262 - RNA, 16 nt, Homo sapiens
cggccccaucucucau

SEQ ID NO: 1222263 - RNA, 18 nt, Homo sapiens
cggccccucccccugaga

SEQ ID NO: 1222264 - RNA, 21 nt, Homo sapiens
cggccccugcugguucagggu

SEQ ID NO: 1222265 - RNA, 16 nt, Homo sapiens
cggccuccauccugag

SEQ ID NO: 1222266 - RNA, 22 nt, Homo sapiens
cggccuggggcgagcacuguga

SEQ ID NO: 1222267 - RNA, 23 nt, Homo sapiens
cggccuggggcgagcacugugag

SEQ ID NO: 1222268 - RNA, 17 nt, Homo sapiens
cggcguggagacuggca

SEQ ID NO: 1222269 - RNA, 23 nt, Homo sapiens
cggcugguuuuguaagaugcugg

SEQ ID NO: 1222270 - RNA, 13 nt, Homo sapiens
cggcuguggagca

SEQ ID NO: 1222271 - RNA, 19 nt, Homo sapiens
cggcuuccuacagccagca

SEQ ID NO: 1222272 - RNA, 12 nt, Homo sapiens
cgggaaaggagc

SEQ ID NO: 1222273 - RNA, 21 nt, Homo sapiens
cgggaagcgaugaauuuggag

SEQ ID NO: 1222274 - RNA, 20 nt, Homo sapiens
cgggagcucuguauggucag

SEQ ID NO: 1222275 - RNA, 20 nt, Homo sapiens
cgggaggaggaggagcaccu

SEQ ID NO: 1222276 - RNA, 22 nt, Homo sapiens
cgggaggauguucugggacaca

SEQ ID NO: 1222277 - RNA, 21 nt, Homo sapiens
cgggcaccaacuccauguuug

SEQ ID NO: 1222278 - RNA, 19 nt, Homo sapiens
cgggcacucagaagacacu

SEQ ID NO: 1222279 - RNA, 16 nt, Homo sapiens
cgggccacagggcggu

SEQ ID NO: 1222280 - RNA, 21 nt, Homo sapiens
cgggccuggagaacuagagaa

SEQ ID NO: 1222281 - RNA, 17 nt, Homo sapiens
cgggcugugcccgggga

SEQ ID NO: 1222282 - RNA, 16 nt, Homo sapiens
cgggcuuaccagguga

SEQ ID NO: 1222283 - RNA, 16 nt, Homo sapiens
cggggacccccaacuc

SEQ ID NO: 1222284 - RNA, 14 nt, Homo sapiens
cggggacccuguga

SEQ ID NO: 1222285 - RNA, 15 nt, Homo sapiens
cggggccagcacuuc

SEQ ID NO: 1222286 - RNA, 20 nt, Homo sapiens
cggggguucauaggucacug

SEQ ID NO: 1222287 - RNA, 23 nt, Homo sapiens
cgggugagcugagcuuggcguuu

SEQ ID NO: 1222288 - RNA, 16 nt, Homo sapiens
cggugcaugaugcugc

SEQ ID NO: 1222289 - RNA, 22 nt, Homo sapiens
cggugcucuggaagaccugaaa

SEQ ID NO: 1222290 - RNA, 21 nt, Homo sapiens
cgguggugcaugccuguaauc

SEQ ID NO: 1222291 - RNA, 13 nt, Homo sapiens
cgguguucugucc

SEQ ID NO: 1222292 - RNA, 17 nt, Homo sapiens
cgguuaccucugcaugg

SEQ ID NO: 1222293 - RNA, 20 nt, Homo sapiens
cgguuugaaaauaugccugc

SEQ ID NO: 1222294 - RNA, 16 nt, Homo sapiens
cgguuugucaguucuu

SEQ ID NO: 1222295 - RNA, 12 nt, Homo sapiens
cgguuuuagcuu

SEQ ID NO: 1222296 - RNA, 13 nt, Homo sapiens
cguaaagauuugg

SEQ ID NO: 1222297 - RNA, 14 nt, Homo sapiens
cguaacaacugugg

SEQ ID NO: 1222298 - RNA, 15 nt, Homo sapiens
cguaaucguuccuga

SEQ ID NO: 1222299 - RNA, 16 nt, Homo sapiens
cguaaugaaagccaca

SEQ ID NO: 1222300 - RNA, 20 nt, Homo sapiens
cguaauuaaaggaacagagu

SEQ ID NO: 1222301 - RNA, 15 nt, Homo sapiens
cguagacagguguua

SEQ ID NO: 1222302 - RNA, 16 nt, Homo sapiens
cguauuuuacaugaag

SEQ ID NO: 1222303 - RNA, 17 nt, Homo sapiens
cgucaaagcaguaguca

SEQ ID NO: 1222304 - RNA, 13 nt, Homo sapiens
cguccacagggca

SEQ ID NO: 1222305 - RNA, 14 nt, Homo sapiens
cguccauggcacca

SEQ ID NO: 1222306 - RNA, 13 nt, Homo sapiens
cguccuggagcug

SEQ ID NO: 1222307 - RNA, 22 nt, Homo sapiens
cguccuuuaaagugcugcagua

SEQ ID NO: 1222308 - RNA, 17 nt, Homo sapiens
cgucuccgaagauuugg

SEQ ID NO: 1222309 - RNA, 20 nt, Homo sapiens
cgucucuacuaaaaauacaa

SEQ ID NO: 1222310 - RNA, 12 nt, Homo sapiens
cgucuuuaguuu

SEQ ID NO: 1222311 - RNA, 17 nt, Homo sapiens
cgugaaaccccgucucu

SEQ ID NO: 1222312 - RNA, 17 nt, Homo sapiens
cgugaauuuauaguuaa

SEQ ID NO: 1222313 - RNA, 22 nt, Homo sapiens
cgugacggagcccacacugcca

SEQ ID NO: 1222314 - RNA, 16 nt, Homo sapiens
cgugcacacaccagag

SEQ ID NO: 1222315 - RNA, 16 nt, Homo sapiens
cgugcauuagcacaga

SEQ ID NO: 1222316 - RNA, 20 nt, Homo sapiens
cgugcauuuuuggaucauuu

SEQ ID NO: 1222317 - RNA, 15 nt, Homo sapiens
cgugccaaaaaucuu

SEQ ID NO: 1222318 - RNA, 20 nt, Homo sapiens
cgugccagcucuaguuuuca

SEQ ID NO: 1222319 - RNA, 17 nt, Homo sapiens
cgugccgccugcuccuc

SEQ ID NO: 1222320 - RNA, 15 nt, Homo sapiens
cgugcgagcacacac

SEQ ID NO: 1222321 - RNA, 19 nt, Homo sapiens
cgugcuacugcacuccagc

SEQ ID NO: 1222322 - RNA, 17 nt, Homo sapiens
cgugcucccgaugcugc

SEQ ID NO: 1222323 - RNA, 13 nt, Homo sapiens
cguggacucugca

SEQ ID NO: 1222324 - RNA, 21 nt, Homo sapiens
cguggacucugcacaugucuu

SEQ ID NO: 1222325 - RNA, 15 nt, Homo sapiens
cgugggccgcacugg

SEQ ID NO: 1222326 - RNA, 18 nt, Homo sapiens
cguggucuccuugcacuu

SEQ ID NO: 1222327 - RNA, 20 nt, Homo sapiens
cguggucuccuugcacuuuc

SEQ ID NO: 1222328 - RNA, 18 nt, Homo sapiens
cguggugaccuuucacga

SEQ ID NO: 1222329 - RNA, 18 nt, Homo sapiens
cguguauaggacucucag

SEQ ID NO: 1222330 - RNA, 17 nt, Homo sapiens
cguguauaguaucugua

SEQ ID NO: 1222331 - RNA, 15 nt, Homo sapiens
cguguauuuucauua

SEQ ID NO: 1222332 - RNA, 15 nt, Homo sapiens
cgugucacacuugug

SEQ ID NO: 1222333 - RNA, 12 nt, Homo sapiens
cgugucagcuca

SEQ ID NO: 1222334 - RNA, 20 nt, Homo sapiens
cgugucucagacugcaugua

SEQ ID NO: 1222335 - RNA, 17 nt, Homo sapiens
cgugugcacaugcgcac

SEQ ID NO: 1222336 - RNA, 23 nt, Homo sapiens
cguguucugucugugucuucagg

SEQ ID NO: 1222337 - RNA, 18 nt, Homo sapiens
cguuaccauuuacauguu

SEQ ID NO: 1222338 - RNA, 19 nt, Homo sapiens
cguucgauuucuaccucag

SEQ ID NO: 1222339 - RNA, 23 nt, Homo sapiens
cguucucugccccguuucuugcc

SEQ ID NO: 1222340 - RNA, 22 nt, Homo sapiens
cguugacaaguuuuguggggcu

SEQ ID NO: 1222341 - RNA, 22 nt, Homo sapiens
cguuggccggaggucaugauga

SEQ ID NO: 1222342 - RNA, 21 nt, Homo sapiens
cguuucauuuuuacaccaauu

SEQ ID NO: 1222343 - RNA, 16 nt, Homo sapiens
cguuuggccaaaaaga

SEQ ID NO: 1222344 - RNA, 24 nt, Homo sapiens
cguuuuuaagguggaaacuccugu

SEQ ID NO: 1222345 - RNA, 22 nt, Homo sapiens
cuaaaaaggucuguuaauguca

SEQ ID NO: 1222346 - RNA, 14 nt, Homo sapiens
cuaaaaaguuccau

SEQ ID NO: 1222347 - RNA, 12 nt, Homo sapiens
cuaaaaaucaaa

SEQ ID NO: 1222348 - RNA, 18 nt, Homo sapiens
cuaaaaaugagcuugauu

SEQ ID NO: 1222349 - RNA, 17 nt, Homo sapiens
cuaaaaccacaugugca

SEQ ID NO: 1222350 - RNA, 14 nt, Homo sapiens
cuaaaacuuaacau

SEQ ID NO: 1222351 - RNA, 21 nt, Homo sapiens
cuaaaaggugaccaaugaugg

SEQ ID NO: 1222352 - RNA, 17 nt, Homo sapiens
cuaaaaguuaauagggu

SEQ ID NO: 1222353 - RNA, 21 nt, Homo sapiens
cuaaaaguuacuuaccacaga

SEQ ID NO: 1222354 - RNA, 16 nt, Homo sapiens
cuaaaaguucauaaca

SEQ ID NO: 1222355 - RNA, 15 nt, Homo sapiens
cuaaaauuagaugaa

SEQ ID NO: 1222356 - RNA, 17 nt, Homo sapiens
cuaaaauuuuaggcacu

SEQ ID NO: 1222357 - RNA, 23 nt, Homo sapiens
cuaaacaagaaucagucuaucca

SEQ ID NO: 1222358 - RNA, 16 nt, Homo sapiens
cuaaacccaauccaaa

SEQ ID NO: 1222359 - RNA, 16 nt, Homo sapiens
cuaaacucagaggcag

SEQ ID NO: 1222360 - RNA, 14 nt, Homo sapiens
cuaaacucucauuu

SEQ ID NO: 1222361 - RNA, 10 nt, Homo sapiens
cuaaacugua

SEQ ID NO: 1222362 - RNA, 18 nt, Homo sapiens
cuaaagagagaugaacca

SEQ ID NO: 1222363 - RNA, 15 nt, Homo sapiens
cuaaagagcccuugc

SEQ ID NO: 1222364 - RNA, 22 nt, Homo sapiens
cuaaagauaauauuacuguuua

SEQ ID NO: 1222365 - RNA, 18 nt, Homo sapiens
cuaaagcuauguuacaug

SEQ ID NO: 1222366 - RNA, 17 nt, Homo sapiens
cuaaagcuuuggacaag

SEQ ID NO: 1222367 - RNA, 14 nt, Homo sapiens
cuaaaggacuaaca

SEQ ID NO: 1222368 - RNA, 14 nt, Homo sapiens
cuaaaggugcacug

SEQ ID NO: 1222369 - RNA, 17 nt, Homo sapiens
cuaaaguauaucuuuaa

SEQ ID NO: 1222370 - RNA, 18 nt, Homo sapiens
cuaaagugccuaccccag

SEQ ID NO: 1222371 - RNA, 12 nt, Homo sapiens
cuaaaguucuaa

SEQ ID NO: 1222372 - RNA, 12 nt, Homo sapiens
cuaaaguuuuag

SEQ ID NO: 1222373 - RNA, 13 nt, Homo sapiens
cuaaauaaaugaa

SEQ ID NO: 1222374 - RNA, 19 nt, Homo sapiens
cuaaauauccaaagacugu

SEQ ID NO: 1222375 - RNA, 20 nt, Homo sapiens
cuaaauauccaaagacugua

SEQ ID NO: 1222376 - RNA, 12 nt, Homo sapiens
cuaaaucccucc

SEQ ID NO: 1222377 - RNA, 16 nt, Homo sapiens
cuaaaugagauacacu

SEQ ID NO: 1222378 - RNA, 23 nt, Homo sapiens
cucaguuggaaucauugcuaaua

SEQ ID NO: 1222379 - RNA, 17 nt, Homo sapiens
cucaguuucacuuucac

SEQ ID NO: 1222380 - RNA, 19 nt, Homo sapiens
cucaguuugugugucuuaa

SEQ ID NO: 1222381 - RNA, 21 nt, Homo sapiens
cucauacccaggaagagcuga

SEQ ID NO: 1222382 - RNA, 19 nt, Homo sapiens
cucauacugucugggauua

SEQ ID NO: 1222383 - RNA, 18 nt, Homo sapiens
cucauagauuauuaucua

SEQ ID NO: 1222384 - RNA, 21 nt, Homo sapiens
cucauagcuaauuuuugcaaa

SEQ ID NO: 1222385 - RNA, 13 nt, Homo sapiens
cucauaguauggu

SEQ ID NO: 1222386 - RNA, 19 nt, Homo sapiens
cucauaugcauguagucac

SEQ ID NO: 1222387 - RNA, 21 nt, Homo sapiens
cucauauuuaaagacagggaa

SEQ ID NO: 1222388 - RNA, 13 nt, Homo sapiens
cucaucaaucaaa

SEQ ID NO: 1222389 - RNA, 12 nt, Homo sapiens
cucauccaaagu

SEQ ID NO: 1222390 - RNA, 19 nt, Homo sapiens
cucaucccacgcacuccau

SEQ ID NO: 1222391 - RNA, 16 nt, Homo sapiens
cucauccccacaaucu

SEQ ID NO: 1222392 - RNA, 21 nt, Homo sapiens
cucaucccccagccacagugg

SEQ ID NO: 1222393 - RNA, 17 nt, Homo sapiens
cucauccuuaccgcaca

SEQ ID NO: 1222394 - RNA, 12 nt, Homo sapiens
cucaucugcaaa

SEQ ID NO: 1222395 - RNA, 21 nt, Homo sapiens
cucaucuguggagcugccaca

SEQ ID NO: 1222396 - RNA, 14 nt, Homo sapiens
cucaucuuacugua

SEQ ID NO: 1222397 - RNA, 23 nt, Homo sapiens
cucaucuuuuaucuaacuauaug

SEQ ID NO: 1222398 - RNA, 14 nt, Homo sapiens
cucaugaagcauac

SEQ ID NO: 1222399 - RNA, 18 nt, Homo sapiens
cucaugacuuuugguuaa

SEQ ID NO: 1222400 - RNA, 21 nt, Homo sapiens
cucaugauaccaccuuuacug

SEQ ID NO: 1222401 - RNA, 13 nt, Homo sapiens
cucaugauccaac

SEQ ID NO: 1222402 - RNA, 16 nt, Homo sapiens
cucaugccugcugaga

SEQ ID NO: 1222403 - RNA, 12 nt, Homo sapiens
cucaugccugua

SEQ ID NO: 1222404 - RNA, 18 nt, Homo sapiens
cucaugccuguaaucuca

SEQ ID NO: 1222405 - RNA, 21 nt, Homo sapiens
cucauggcagcuaagccacau

SEQ ID NO: 1222406 - RNA, 21 nt, Homo sapiens
cucauggugcauauaaauaua

SEQ ID NO: 1222407 - RNA, 18 nt, Homo sapiens
cucaugugaaaggggaau

SEQ ID NO: 1222408 - RNA, 12 nt, Homo sapiens
cucauuaauucu

SEQ ID NO: 1222409 - RNA, 13 nt, Homo sapiens
cucauuauucaca

SEQ ID NO: 1222410 - RNA, 20 nt, Homo sapiens
cucauuauucacaguaauua

SEQ ID NO: 1222411 - RNA, 16 nt, Homo sapiens
cucauuccaccuuccc

SEQ ID NO: 1222412 - RNA, 12 nt, Homo sapiens
cucauugaagca

SEQ ID NO: 1222413 - RNA, 13 nt, Homo sapiens
cucauugacaaga

SEQ ID NO: 1222414 - RNA, 22 nt, Homo sapiens
cucauuguuuauuaacaaauua

SEQ ID NO: 1222415 - RNA, 21 nt, Homo sapiens
cucauuuaaaagcauaaggcc

SEQ ID NO: 1222416 - RNA, 17 nt, Homo sapiens
cucauuuuaguugccua

SEQ ID NO: 1222417 - RNA, 16 nt, Homo sapiens
cuccaaaccugaaguu

SEQ ID NO: 1222418 - RNA, 16 nt, Homo sapiens
cuccaaaccugucuug

SEQ ID NO: 1222419 - RNA, 22 nt, Homo sapiens
cuccaacacaaggcuccaagac

SEQ ID NO: 1222420 - RNA, 12 nt, Homo sapiens
cuccaagacaga

SEQ ID NO: 1222421 - RNA, 17 nt, Homo sapiens
cuccaagacccuguguu

SEQ ID NO: 1222422 - RNA, 15 nt, Homo sapiens
cuccaaggacaucua

SEQ ID NO: 1222423 - RNA, 22 nt, Homo sapiens
cuccaaggauccucuccacucc

SEQ ID NO: 1222424 - RNA, 18 nt, Homo sapiens
cuccaagucuguaccuca

SEQ ID NO: 1222425 - RNA, 19 nt, Homo sapiens
cuccaaugucugcugagga

SEQ ID NO: 1222426 - RNA, 19 nt, Homo sapiens
cuccacagcgagggcagcu

SEQ ID NO: 1222427 - RNA, 15 nt, Homo sapiens
cuccacagugcugcu

SEQ ID NO: 1222428 - RNA, 14 nt, Homo sapiens
cuccaccacauccu

SEQ ID NO: 1222429 - RNA, 20 nt, Homo sapiens
cuccaccccacaacccaaaa

SEQ ID NO: 1222430 - RNA, 14 nt, Homo sapiens
cuccaccccacaga

SEQ ID NO: 1222431 - RNA, 21 nt, Homo sapiens
cuccaccuaccacucacauga

SEQ ID NO: 1222432 - RNA, 17 nt, Homo sapiens
cuccaccuagacuguaa

SEQ ID NO: 1222433 - RNA, 18 nt, Homo sapiens
cuccaccuagacuguaaa

SEQ ID NO: 1222434 - RNA, 13 nt, Homo sapiens
cuccacuccagau

SEQ ID NO: 1222435 - RNA, 16 nt, Homo sapiens
cuccacugccuucgau

SEQ ID NO: 1222436 - RNA, 12 nt, Homo sapiens
cuccacugcugc

SEQ ID NO: 1222437 - RNA, 13 nt, Homo sapiens
cuccacugucacc

SEQ ID NO: 1222438 - RNA, 16 nt, Homo sapiens
cuccacuuggucugug

SEQ ID NO: 1222439 - RNA, 19 nt, Homo sapiens
cuccacuuggucugugaga

SEQ ID NO: 1222440 - RNA, 20 nt, Homo sapiens
cuccagaauuuggaaauccu

SEQ ID NO: 1222441 - RNA, 18 nt, Homo sapiens
cuccagacuuuuaccuac

SEQ ID NO: 1222442 - RNA, 15 nt, Homo sapiens
cuccagagaugguca

SEQ ID NO: 1222443 - RNA, 17 nt, Homo sapiens
cuccagaggaugacugg

SEQ ID NO: 1222444 - RNA, 14 nt, Homo sapiens
cuccagauggugcu

SEQ ID NO: 1222445 - RNA, 20 nt, Homo sapiens
cuccagauguuuccagacuu

SEQ ID NO: 1222446 - RNA, 15 nt, Homo sapiens
cuccagcaccauaga

SEQ ID NO: 1222447 - RNA, 20 nt, Homo sapiens
cuccagccaaccucauugca

SEQ ID NO: 1222448 - RNA, 22 nt, Homo sapiens
cuccagccagcaaugaugucca

SEQ ID NO: 1222449 - RNA, 19 nt, Homo sapiens
cuccagcccagacccagug

SEQ ID NO: 1222450 - RNA, 17 nt, Homo sapiens
cuccagcccugcagcua

SEQ ID NO: 1222451 - RNA, 21 nt, Homo sapiens
cuccagccugggggacagaaa

SEQ ID NO: 1222452 - RNA, 16 nt, Homo sapiens
cuccagcucaccagcc

SEQ ID NO: 1222453 - RNA, 22 nt, Homo sapiens
cuccagcucaccagccccagug

SEQ ID NO: 1222454 - RNA, 16 nt, Homo sapiens
cuccaggaauacugaa

SEQ ID NO: 1222455 - RNA, 16 nt, Homo sapiens
cuccagggacaaagag

SEQ ID NO: 1222456 - RNA, 23 nt, Homo sapiens
cuccaguauaugcugauggacca

SEQ ID NO: 1222457 - RNA, 18 nt, Homo sapiens
cuccagucccccuauccu

SEQ ID NO: 1222458 - RNA, 13 nt, Homo sapiens
cuccagugccagc

SEQ ID NO: 1222459 - RNA, 18 nt, Homo sapiens
cuccaucauaugccugac

SEQ ID NO: 1222460 - RNA, 20 nt, Homo sapiens
cuccauccugaaagccaaga

SEQ ID NO: 1222461 - RNA, 15 nt, Homo sapiens
cuccaugacuggcug

SEQ ID NO: 1222462 - RNA, 14 nt, Homo sapiens
cuccaugcugccag

SEQ ID NO: 1222463 - RNA, 15 nt, Homo sapiens
cuccauguaguuacu

SEQ ID NO: 1222464 - RNA, 20 nt, Homo sapiens
cuccauuaaauggucuaaaa

SEQ ID NO: 1222465 - RNA, 14 nt, Homo sapiens
cuccauucugacca

SEQ ID NO: 1222466 - RNA, 19 nt, Homo sapiens
cuccauucugaccauuuca

SEQ ID NO: 1222467 - RNA, 12 nt, Homo sapiens
cucccaaagugc

SEQ ID NO: 1222468 - RNA, 20 nt, Homo sapiens
cucccaaagugcugagauua

SEQ ID NO: 1222469 - RNA, 19 nt, Homo sapiens
cucccaaagugcugggauu

SEQ ID NO: 1222470 - RNA, 23 nt, Homo sapiens
cucccaagggucucacugcucac

SEQ ID NO: 1222471 - RNA, 19 nt, Homo sapiens
cucccaaguagcugggauu

SEQ ID NO: 1222472 - RNA, 19 nt, Homo sapiens
cucccacaacaacaaaagc

SEQ ID NO: 1222473 - RNA, 14 nt, Homo sapiens
cucccacacugaaa

SEQ ID NO: 1222474 - RNA, 12 nt, Homo sapiens
cucccacuuccu

SEQ ID NO: 1222475 - RNA, 12 nt, Homo sapiens
cucccagcauag

SEQ ID NO: 1222476 - RNA, 15 nt, Homo sapiens
cucccagcauaggau

SEQ ID NO: 1222477 - RNA, 14 nt, Homo sapiens
cucccagugugguu

SEQ ID NO: 1222478 - RNA, 20 nt, Homo sapiens
cucccauaaacacugaauua

SEQ ID NO: 1222479 - RNA, 21 nt, Homo sapiens
cucccauaauugcuuugccaa

SEQ ID NO: 1222480 - RNA, 21 nt, Homo sapiens
cucccauccccuggacuggga

SEQ ID NO: 1222481 - RNA, 11 nt, Homo sapiens
cucccauuuca

SEQ ID NO: 1222482 - RNA, 21 nt, Homo sapiens
cuccccaguucauugcacuuu

SEQ ID NO: 1222483 - RNA, 23 nt, Homo sapiens
cuccccaguucauugcacuuuga

SEQ ID NO: 1222484 - RNA, 23 nt, Homo sapiens
cuccccuccaucccuggcccccu

SEQ ID NO: 1222485 - RNA, 15 nt, Homo sapiens
cuccccucccagucc

SEQ ID NO: 1222486 - RNA, 18 nt, Homo sapiens
cuccccuccggacuggug

SEQ ID NO: 1222487 - RNA, 21 nt, Homo sapiens
cuccccuguuucaaucacugu

SEQ ID NO: 1222488 - RNA, 19 nt, Homo sapiens
cuccccuuuuucuuccuca

SEQ ID NO: 1222489 - RNA, 14 nt, Homo sapiens
cucccuagccagag

SEQ ID NO: 1222490 - RNA, 17 nt, Homo sapiens
cucccuagccagaggcu

SEQ ID NO: 1222491 - RNA, 14 nt, Homo sapiens
cucccuaugucugc

SEQ ID NO: 1222492 - RNA, 15 nt, Homo sapiens
cucccucagcucucu

SEQ ID NO: 1222493 - RNA, 13 nt, Homo sapiens
cucccucauucca

SEQ ID NO: 1222494 - RNA, 15 nt, Homo sapiens
cucccugaaauugca

SEQ ID NO: 1222495 - RNA, 16 nt, Homo sapiens
cucccugcaagaaauc

SEQ ID NO: 1222496 - RNA, 18 nt, Homo sapiens
cucccugcucuaacaccu

SEQ ID NO: 1222497 - RNA, 18 nt, Homo sapiens
cucccuggaugacauuaa

SEQ ID NO: 1222498 - RNA, 19 nt, Homo sapiens
cucccuggcaggaugcuga

SEQ ID NO: 1222499 - RNA, 20 nt, Homo sapiens
cucccugucauagagcugca

SEQ ID NO: 1222500 - RNA, 17 nt, Homo sapiens
cucccuuggguucugau

SEQ ID NO: 1222501 - RNA, 14 nt, Homo sapiens
cuccgaggccagua

SEQ ID NO: 1222502 - RNA, 16 nt, Homo sapiens
cuccgccaaugcacgg

SEQ ID NO: 1222503 - RNA, 22 nt, Homo sapiens
cuccgggcaaauggcugagaug

SEQ ID NO: 1222504 - RNA, 17 nt, Homo sapiens
cugcagaaguacuccua

SEQ ID NO: 1222505 - RNA, 16 nt, Homo sapiens
cugcagaauccagcua

SEQ ID NO: 1222506 - RNA, 12 nt, Homo sapiens
cugcagacaccu

SEQ ID NO: 1222507 - RNA, 14 nt, Homo sapiens
cugcagaccugguu

SEQ ID NO: 1222508 - RNA, 15 nt, Homo sapiens
cugcagagcaccuuu

SEQ ID NO: 1222509 - RNA, 20 nt, Homo sapiens
cugcagaguaggcagcugcc

SEQ ID NO: 1222510 - RNA, 21 nt, Homo sapiens
cugcagaugccacccuagcca

SEQ ID NO: 1222511 - RNA, 13 nt, Homo sapiens
cugcagauuugau

SEQ ID NO: 1222512 - RNA, 12 nt, Homo sapiens
cugcagccagcu

SEQ ID NO: 1222513 - RNA, 15 nt, Homo sapiens
cugcagcucagggac

SEQ ID NO: 1222514 - RNA, 19 nt, Homo sapiens
cugcagcucuccaccagcu

SEQ ID NO: 1222515 - RNA, 20 nt, Homo sapiens
cugcagcucuccaccagcug

SEQ ID NO: 1222516 - RNA, 18 nt, Homo sapiens
cugcagcuuuacugccuu

SEQ ID NO: 1222517 - RNA, 22 nt, Homo sapiens
cugcaggaacgagcacuggcca

SEQ ID NO: 1222518 - RNA, 16 nt, Homo sapiens
cugcaggauaaaaugg

SEQ ID NO: 1222519 - RNA, 13 nt, Homo sapiens
cugcaggccaaga

SEQ ID NO: 1222520 - RNA, 18 nt, Homo sapiens
cugcagggacuccaugcu

SEQ ID NO: 1222521 - RNA, 19 nt, Homo sapiens
cugcagggugggaucagcc

SEQ ID NO: 1222522 - RNA, 15 nt, Homo sapiens
cugcaggucaacagc

SEQ ID NO: 1222523 - RNA, 12 nt, Homo sapiens
cugcauaugaua

SEQ ID NO: 1222524 - RNA, 22 nt, Homo sapiens
cugcaucuuauagcacuuugaa

SEQ ID NO: 1222525 - RNA, 20 nt, Homo sapiens
cugcaucuucccacaguggc

SEQ ID NO: 1222526 - RNA, 15 nt, Homo sapiens
cugcaucuugcugcu

SEQ ID NO: 1222527 - RNA, 14 nt, Homo sapiens
cugcaugcaaacaa

SEQ ID NO: 1222528 - RNA, 19 nt, Homo sapiens
cugcauggaccuaacauuc

SEQ ID NO: 1222529 - RNA, 21 nt, Homo sapiens
cugcauguaccauuugcaugg

SEQ ID NO: 1222530 - RNA, 20 nt, Homo sapiens
cugcauuaacugcacaaaca

SEQ ID NO: 1222531 - RNA, 23 nt, Homo sapiens
cugcauuagagcccauuucaauu

SEQ ID NO: 1222532 - RNA, 17 nt, Homo sapiens
cugcauuagucucaugu

SEQ ID NO: 1222533 - RNA, 15 nt, Homo sapiens
cugcauuguugaauu

SEQ ID NO: 1222534 - RNA, 19 nt, Homo sapiens
cugcauuguugaauucugc

SEQ ID NO: 1222535 - RNA, 17 nt, Homo sapiens
cugccaaaccuguguag

SEQ ID NO: 1222536 - RNA, 19 nt, Homo sapiens
cugccacuguguacugugg

SEQ ID NO: 1222537 - RNA, 14 nt, Homo sapiens
cugccagagcuuug

SEQ ID NO: 1222538 - RNA, 16 nt, Homo sapiens
cugccagccuggcuuc

SEQ ID NO: 1222539 - RNA, 13 nt, Homo sapiens
cugccagggagcu

SEQ ID NO: 1222540 - RNA, 20 nt, Homo sapiens
cugccaucauuuacuuuuaa

SEQ ID NO: 1222541 - RNA, 22 nt, Homo sapiens
cugccaucgaccuggagacuga

SEQ ID NO: 1222542 - RNA, 17 nt, Homo sapiens
cugccaucuagccagcc

SEQ ID NO: 1222543 - RNA, 13 nt, Homo sapiens
cugccaugauagc

SEQ ID NO: 1222544 - RNA, 21 nt, Homo sapiens
cugccauuacagagguauuaa

SEQ ID NO: 1222545 - RNA, 22 nt, Homo sapiens
cugccauucacuucauaaucca

SEQ ID NO: 1222546 - RNA, 22 nt, Homo sapiens
cugccauuggagccaaugugug

SEQ ID NO: 1222547 - RNA, 19 nt, Homo sapiens
cugccauugucgucuuuau

SEQ ID NO: 1222548 - RNA, 12 nt, Homo sapiens
cugccauuuccc

SEQ ID NO: 1222549 - RNA, 16 nt, Homo sapiens
cugcccaccuccugga

SEQ ID NO: 1222550 - RNA, 21 nt, Homo sapiens
cugcccagacacagacuggca

SEQ ID NO: 1222551 - RNA, 17 nt, Homo sapiens
cugcccagaugcccuuu

SEQ ID NO: 1222552 - RNA, 19 nt, Homo sapiens
cugccccaggccugaaaga

SEQ ID NO: 1222553 - RNA, 15 nt, Homo sapiens
cugccccccaugagg

SEQ ID NO: 1222554 - RNA, 15 nt, Homo sapiens
cugcccgacucaggu

SEQ ID NO: 1222555 - RNA, 16 nt, Homo sapiens
cugcccgacucagguc

SEQ ID NO: 1222556 - RNA, 21 nt, Homo sapiens
cugcccuccuuugccuuccac

SEQ ID NO: 1222557 - RNA, 15 nt, Homo sapiens
cugcccucuauuuau

SEQ ID NO: 1222558 - RNA, 17 nt, Homo sapiens
cugcccugcucccacag

SEQ ID NO: 1222559 - RNA, 18 nt, Homo sapiens
cugcccuugaagacuucc

SEQ ID NO: 1222560 - RNA, 16 nt, Homo sapiens
cugccgcugcaccacg

SEQ ID NO: 1222561 - RNA, 14 nt, Homo sapiens
cugccgucuucacu

SEQ ID NO: 1222562 - RNA, 18 nt, Homo sapiens
cugccgucuucacuuccc

SEQ ID NO: 1222563 - RNA, 18 nt, Homo sapiens
cugccuagcugccuagca

SEQ ID NO: 1222564 - RNA, 19 nt, Homo sapiens
cugccuagcugccuagcaa

SEQ ID NO: 1222565 - RNA, 17 nt, Homo sapiens
cugccuauuaucuguca

SEQ ID NO: 1222566 - RNA, 17 nt, Homo sapiens
cugccucagccucccaa

SEQ ID NO: 1222567 - RNA, 12 nt, Homo sapiens
cugccucagguu

SEQ ID NO: 1222568 - RNA, 17 nt, Homo sapiens
cugccucccaugccugg

SEQ ID NO: 1222569 - RNA, 15 nt, Homo sapiens
cugccuccucuucaa

SEQ ID NO: 1222570 - RNA, 20 nt, Homo sapiens
cugccucuggaauugcucaa

SEQ ID NO: 1222571 - RNA, 16 nt, Homo sapiens
cugccucuggucccag

SEQ ID NO: 1222572 - RNA, 23 nt, Homo sapiens
cugccugaaacagccauguccaa

SEQ ID NO: 1222573 - RNA, 15 nt, Homo sapiens
cugccugaagucaca

SEQ ID NO: 1222574 - RNA, 17 nt, Homo sapiens
cugccugaagucacaca

SEQ ID NO: 1222575 - RNA, 15 nt, Homo sapiens
cugccugacacugag

SEQ ID NO: 1222576 - RNA, 18 nt, Homo sapiens
cugccuggagagggucuc

SEQ ID NO: 1222577 - RNA, 20 nt, Homo sapiens
cugccuggcccccaaccuca

SEQ ID NO: 1222578 - RNA, 16 nt, Homo sapiens
cugccugggguggaca

SEQ ID NO: 1222579 - RNA, 17 nt, Homo sapiens
cugccugucccagagag

SEQ ID NO: 1222580 - RNA, 17 nt, Homo sapiens
cugccugugaaugcuga

SEQ ID NO: 1222581 - RNA, 22 nt, Homo sapiens
cugccuguucugaggauucagg

SEQ ID NO: 1222582 - RNA, 19 nt, Homo sapiens
cugccuuaaaaccaaagag

SEQ ID NO: 1222583 - RNA, 18 nt, Homo sapiens
cugccuucucaugaucca

SEQ ID NO: 1222584 - RNA, 16 nt, Homo sapiens
cugccuuggacugugu

SEQ ID NO: 1222585 - RNA, 15 nt, Homo sapiens
cugcggcgucugucu

SEQ ID NO: 1222586 - RNA, 17 nt, Homo sapiens
cugcguaugagucccau

SEQ ID NO: 1222587 - RNA, 17 nt, Homo sapiens
cugcgugguugaugauc

SEQ ID NO: 1222588 - RNA, 15 nt, Homo sapiens
cugcuaacuccuagc

SEQ ID NO: 1222589 - RNA, 20 nt, Homo sapiens
cugcuaaggcuccuccuugc

SEQ ID NO: 1222590 - RNA, 17 nt, Homo sapiens
cugcuacuuaauuccuu

SEQ ID NO: 1222591 - RNA, 17 nt, Homo sapiens
cugcuauaucuauccau

SEQ ID NO: 1222592 - RNA, 18 nt, Homo sapiens
cugcuauuugcuguuauu

SEQ ID NO: 1222593 - RNA, 16 nt, Homo sapiens
cugcuccacguucucu

SEQ ID NO: 1222594 - RNA, 20 nt, Homo sapiens
cugcuccaggagguuugcag

SEQ ID NO: 1222595 - RNA, 17 nt, Homo sapiens
cugcuccagguucacuu

SEQ ID NO: 1222596 - RNA, 14 nt, Homo sapiens
cugcuccagugcag

SEQ ID NO: 1222597 - RNA, 14 nt, Homo sapiens
cugcucccacagaa

SEQ ID NO: 1222598 - RNA, 19 nt, Homo sapiens
cugcucccccugguggugg

SEQ ID NO: 1222599 - RNA, 20 nt, Homo sapiens
cugcugaaaaccaucuggcc

SEQ ID NO: 1222600 - RNA, 18 nt, Homo sapiens
cugcugaccauuugguca

SEQ ID NO: 1222601 - RNA, 18 nt, Homo sapiens
cugcugagagggcugcug

SEQ ID NO: 1222602 - RNA, 23 nt, Homo sapiens
cugcugagagggcugcugaccau

SEQ ID NO: 1222603 - RNA, 20 nt, Homo sapiens
cugcugagucagacugucag

SEQ ID NO: 1222604 - RNA, 22 nt, Homo sapiens
cugcugccggaagucaucccag

SEQ ID NO: 1222605 - RNA, 21 nt, Homo sapiens
cugcugccucuuucccuagga

SEQ ID NO: 1222606 - RNA, 16 nt, Homo sapiens
cugcuggaaaugcuga

SEQ ID NO: 1222607 - RNA, 16 nt, Homo sapiens
cugcuggagucuggcu

SEQ ID NO: 1222608 - RNA, 20 nt, Homo sapiens
cugcuggcuuccagcuucag

SEQ ID NO: 1222609 - RNA, 22 nt, Homo sapiens
cugcugggggcagcaguaccau

SEQ ID NO: 1222610 - RNA, 11 nt, Homo sapiens
cugcugugaau

SEQ ID NO: 1222611 - RNA, 17 nt, Homo sapiens
cugcugugcacauuuau

SEQ ID NO: 1222612 - RNA, 13 nt, Homo sapiens
cugcuguguguga

SEQ ID NO: 1222613 - RNA, 12 nt, Homo sapiens
cugcuuacuguu

SEQ ID NO: 1222614 - RNA, 16 nt, Homo sapiens
cugcuuagacauaaca

SEQ ID NO: 1222615 - RNA, 18 nt, Homo sapiens
cugcuuagacauaacaaa

SEQ ID NO: 1222616 - RNA, 16 nt, Homo sapiens
cugcuucaaauauuuc

SEQ ID NO: 1222617 - RNA, 13 nt, Homo sapiens
cugcuucauggga

SEQ ID NO: 1222618 - RNA, 15 nt, Homo sapiens
cugcuucaugggaaa

SEQ ID NO: 1222619 - RNA, 20 nt, Homo sapiens
cugcuucaugggaaaacaga

SEQ ID NO: 1222620 - RNA, 20 nt, Homo sapiens
cugcuuccaauuuucuggaa

SEQ ID NO: 1222621 - RNA, 10 nt, Homo sapiens
cugcuuccag

SEQ ID NO: 1222622 - RNA, 16 nt, Homo sapiens
cugcuucuccucccag

SEQ ID NO: 1222623 - RNA, 22 nt, Homo sapiens
cugcuuuagcuuuccaauaugc

SEQ ID NO: 1222624 - RNA, 19 nt, Homo sapiens
cugcuuuccccugugggga

SEQ ID NO: 1222625 - RNA, 19 nt, Homo sapiens
cugcuuugaaacuugccug

SEQ ID NO: 1222626 - RNA, 17 nt, Homo sapiens
cugcuuuucccauugcc

SEQ ID NO: 1222627 - RNA, 14 nt, Homo sapiens
cuggaaaugcugac

SEQ ID NO: 1222628 - RNA, 17 nt, Homo sapiens
cuggaacagaagacagc

SEQ ID NO: 1222629 - RNA, 12 nt, Homo sapiens
cuggaacuggag

SEQ ID NO: 1222630 - RNA, 13 nt, Homo sapiens
gacaggcucuuag

SEQ ID NO: 1222631 - RNA, 11 nt, Homo sapiens
gacagggccag

SEQ ID NO: 1222632 - RNA, 15 nt, Homo sapiens
gacaguccaguguca

SEQ ID NO: 1222633 - RNA, 23 nt, Homo sapiens
gacagugacuggugccaguguca

SEQ ID NO: 1222634 - RNA, 15 nt, Homo sapiens
gacagugaggcugca

SEQ ID NO: 1222635 - RNA, 21 nt, Homo sapiens
gacagugccugggaauguauu

SEQ ID NO: 1222636 - RNA, 16 nt, Homo sapiens
gacauaaagccauguu

SEQ ID NO: 1222637 - RNA, 17 nt, Homo sapiens
gacauacauauuaucuc

SEQ ID NO: 1222638 - RNA, 12 nt, Homo sapiens
gacauacaugcu

SEQ ID NO: 1222639 - RNA, 13 nt, Homo sapiens
gacauacaugcua

SEQ ID NO: 1222640 - RNA, 14 nt, Homo sapiens
gacauacauuucuc

SEQ ID NO: 1222641 - RNA, 18 nt, Homo sapiens
gacauacucucugccugg

SEQ ID NO: 1222642 - RNA, 23 nt, Homo sapiens
gacauacucucugccuggugguc

SEQ ID NO: 1222643 - RNA, 15 nt, Homo sapiens
gacauagcauccaag

SEQ ID NO: 1222644 - RNA, 20 nt, Homo sapiens
gacauaugacaauaagccac

SEQ ID NO: 1222645 - RNA, 16 nt, Homo sapiens
gacauauuaugccuga

SEQ ID NO: 1222646 - RNA, 22 nt, Homo sapiens
gacauauuaugccugaaugacu

SEQ ID NO: 1222647 - RNA, 20 nt, Homo sapiens
gacauccugagcagugccag

SEQ ID NO: 1222648 - RNA, 18 nt, Homo sapiens
gacaucggccuccaugac

SEQ ID NO: 1222649 - RNA, 21 nt, Homo sapiens
gacaucgguguucuucuuccc

SEQ ID NO: 1222650 - RNA, 14 nt, Homo sapiens
gacaugagucuuug

SEQ ID NO: 1222651 - RNA, 16 nt, Homo sapiens
gacaugauuuccuuga

SEQ ID NO: 1222652 - RNA, 18 nt, Homo sapiens
gacaugauuuccuugaau

SEQ ID NO: 1222653 - RNA, 18 nt, Homo sapiens
gacaugucuagccacuga

SEQ ID NO: 1222654 - RNA, 15 nt, Homo sapiens
gacaugugaaaccuu

SEQ ID NO: 1222655 - RNA, 20 nt, Homo sapiens
gacauuaaggaccaauagca

SEQ ID NO: 1222656 - RNA, 21 nt, Homo sapiens
gacauuaugugugcaugugug

SEQ ID NO: 1222657 - RNA, 16 nt, Homo sapiens
gacauucacacagaga

SEQ ID NO: 1222658 - RNA, 13 nt, Homo sapiens
gacauuccaccau

SEQ ID NO: 1222659 - RNA, 13 nt, Homo sapiens
gacauuccagggg

SEQ ID NO: 1222660 - RNA, 20 nt, Homo sapiens
gacauucuggaaaagcaaaa

SEQ ID NO: 1222661 - RNA, 23 nt, Homo sapiens
gacauuucucuaacuccugccau

SEQ ID NO: 1222662 - RNA, 21 nt, Homo sapiens
gacauuugggagacaugugac

SEQ ID NO: 1222663 - RNA, 23 nt, Homo sapiens
gacauuuggugggcuuuggagcu

SEQ ID NO: 1222664 - RNA, 20 nt, Homo sapiens
gacauuuggugguacuuuau

SEQ ID NO: 1222665 - RNA, 19 nt, Homo sapiens
gaccaaaaucagcuuugua

SEQ ID NO: 1222666 - RNA, 14 nt, Homo sapiens
gaccaacuuccugu

SEQ ID NO: 1222667 - RNA, 20 nt, Homo sapiens
gaccaauucuaacagcaaau

SEQ ID NO: 1222668 - RNA, 16 nt, Homo sapiens
gaccacagagcuccug

SEQ ID NO: 1222669 - RNA, 14 nt, Homo sapiens
gaccacaucuuuau

SEQ ID NO: 1222670 - RNA, 23 nt, Homo sapiens
gaccaccaccccaacaaaccauc

SEQ ID NO: 1222671 - RNA, 21 nt, Homo sapiens
gaccacgcuuucuagcuguug

SEQ ID NO: 1222672 - RNA, 15 nt, Homo sapiens
gaccacuuccagggg

SEQ ID NO: 1222673 - RNA, 16 nt, Homo sapiens
gaccagaaauucccuu

SEQ ID NO: 1222674 - RNA, 16 nt, Homo sapiens
gaccagacacugccug

SEQ ID NO: 1222675 - RNA, 21 nt, Homo sapiens
gaccagccugggcaacauacc

SEQ ID NO: 1222676 - RNA, 17 nt, Homo sapiens
gaccaguccuguuugca

SEQ ID NO: 1222677 - RNA, 15 nt, Homo sapiens
gaccauaaagggugu

SEQ ID NO: 1222678 - RNA, 14 nt, Homo sapiens
gaccaugcugauga

SEQ ID NO: 1222679 - RNA, 19 nt, Homo sapiens
gaccauuuuuacauccaug

SEQ ID NO: 1222680 - RNA, 14 nt, Homo sapiens
gacccacccagugu

SEQ ID NO: 1222681 - RNA, 20 nt, Homo sapiens
gacccaccccugugcuccgu

SEQ ID NO: 1222682 - RNA, 23 nt, Homo sapiens
gacccaggggucagccuuaggaa

SEQ ID NO: 1222683 - RNA, 17 nt, Homo sapiens
gaccccacugccaagug

SEQ ID NO: 1222684 - RNA, 13 nt, Homo sapiens
gaccccaucucuu

SEQ ID NO: 1222685 - RNA, 14 nt, Homo sapiens
gacccccagcacuu

SEQ ID NO: 1222686 - RNA, 17 nt, Homo sapiens
gaccccuacccacuucc

SEQ ID NO: 1222687 - RNA, 18 nt, Homo sapiens
gaccccugacucaucauu

SEQ ID NO: 1222688 - RNA, 23 nt, Homo sapiens
gaccccuucggcagcuacucaga

SEQ ID NO: 1222689 - RNA, 20 nt, Homo sapiens
gacccggaggggccuggcag

SEQ ID NO: 1222690 - RNA, 21 nt, Homo sapiens
gacccuacuucuuuugcucuu

SEQ ID NO: 1222691 - RNA, 16 nt, Homo sapiens
gacccuggaaauggac

SEQ ID NO: 1222692 - RNA, 17 nt, Homo sapiens
gacccugucuucugggc

SEQ ID NO: 1222693 - RNA, 18 nt, Homo sapiens
gacccuucagggccagaa

SEQ ID NO: 1222694 - RNA, 18 nt, Homo sapiens
gacccuugauuuugcccc

SEQ ID NO: 1222695 - RNA, 18 nt, Homo sapiens
gaccgcccccuccucuag

SEQ ID NO: 1222696 - RNA, 14 nt, Homo sapiens
gaccguacucucac

SEQ ID NO: 1222697 - RNA, 21 nt, Homo sapiens
gaccuaaaaaggucuguuaau

SEQ ID NO: 1222698 - RNA, 17 nt, Homo sapiens
gaccuaaugggaccccc

SEQ ID NO: 1222699 - RNA, 14 nt, Homo sapiens
gaccuaggcucaug

SEQ ID NO: 1222700 - RNA, 15 nt, Homo sapiens
gaccucaagugaucu

SEQ ID NO: 1222701 - RNA, 16 nt, Homo sapiens
gaccucaccuagaaau

SEQ ID NO: 1222702 - RNA, 22 nt, Homo sapiens
gaccucacugugaccuugacuu

SEQ ID NO: 1222703 - RNA, 16 nt, Homo sapiens
gaccucccacugcccc

SEQ ID NO: 1222704 - RNA, 16 nt, Homo sapiens
gaccucccagcccuau

SEQ ID NO: 1222705 - RNA, 11 nt, Homo sapiens
gaccucugggc

SEQ ID NO: 1222706 - RNA, 17 nt, Homo sapiens
gaccugaggcugugguc

SEQ ID NO: 1222707 - RNA, 17 nt, Homo sapiens
gaccugcauagcuacgu

SEQ ID NO: 1222708 - RNA, 23 nt, Homo sapiens
gaccuggagacugacaaccucau

SEQ ID NO: 1222709 - RNA, 16 nt, Homo sapiens
gaccuggcuggugaca

SEQ ID NO: 1222710 - RNA, 17 nt, Homo sapiens
gaccuuaggccuuccuc

SEQ ID NO: 1222711 - RNA, 18 nt, Homo sapiens
gaccuuaggccuuccucu

SEQ ID NO: 1222712 - RNA, 18 nt, Homo sapiens
gaccuuccaaggacauau

SEQ ID NO: 1222713 - RNA, 15 nt, Homo sapiens
gaccuuccucaucca

SEQ ID NO: 1222714 - RNA, 22 nt, Homo sapiens
gaccuuuaggucaaacucccua

SEQ ID NO: 1222715 - RNA, 14 nt, Homo sapiens
gacgacaagugcug

SEQ ID NO: 1222716 - RNA, 17 nt, Homo sapiens
gacgacaagugcugaac

SEQ ID NO: 1222717 - RNA, 13 nt, Homo sapiens
gacgacagaugcu

SEQ ID NO: 1222718 - RNA, 12 nt, Homo sapiens
gacgacaguacu

SEQ ID NO: 1222719 - RNA, 16 nt, Homo sapiens
gacgaguaacuccccu

SEQ ID NO: 1222720 - RNA, 23 nt, Homo sapiens
gacgcacggcauuagcuuccugc

SEQ ID NO: 1222721 - RNA, 20 nt, Homo sapiens
gacgcauuucgguugagaau

SEQ ID NO: 1222722 - RNA, 15 nt, Homo sapiens
gacggggacugggga

SEQ ID NO: 1222723 - RNA, 15 nt, Homo sapiens
gacgguaaccccaua

SEQ ID NO: 1222724 - RNA, 22 nt, Homo sapiens
gacggucaguccaugucucgga

SEQ ID NO: 1222725 - RNA, 18 nt, Homo sapiens
gacggugcccaagccaga

SEQ ID NO: 1222726 - RNA, 17 nt, Homo sapiens
gacgugaggcccauucu

SEQ ID NO: 1222727 - RNA, 18 nt, Homo sapiens
gacgugcgcgaugccugg

SEQ ID NO: 1222728 - RNA, 23 nt, Homo sapiens
gacguuccaccuggggcuucccu

SEQ ID NO: 1222729 - RNA, 13 nt, Homo sapiens
gacguugcagggu

SEQ ID NO: 1222730 - RNA, 20 nt, Homo sapiens
gacuaaagauugcagcauuu

SEQ ID NO: 1222731 - RNA, 22 nt, Homo sapiens
gacuaaagauugcagcauuuau

SEQ ID NO: 1222732 - RNA, 23 nt, Homo sapiens
gacuaaccccaacgcacaggaaa

SEQ ID NO: 1222733 - RNA, 15 nt, Homo sapiens
gacuaagcauugagc

SEQ ID NO: 1222734 - RNA, 15 nt, Homo sapiens
gacuaauuaggcaag

SEQ ID NO: 1222735 - RNA, 14 nt, Homo sapiens
gacuaauuucaaaa

SEQ ID NO: 1222736 - RNA, 22 nt, Homo sapiens
gacuaauuucaaaaugcuuuuu

SEQ ID NO: 1222737 - RNA, 15 nt, Homo sapiens
gacuaccaauuucuu

SEQ ID NO: 1222738 - RNA, 19 nt, Homo sapiens
gacuacugcccacaccaac

SEQ ID NO: 1222739 - RNA, 18 nt, Homo sapiens
gacuagauguaguauuuu

SEQ ID NO: 1222740 - RNA, 16 nt, Homo sapiens
gacuauuuaugaaggc

SEQ ID NO: 1222741 - RNA, 15 nt, Homo sapiens
gacuauuuuauauga

SEQ ID NO: 1222742 - RNA, 22 nt, Homo sapiens
gacucaagaagugaagaaugca

SEQ ID NO: 1222743 - RNA, 17 nt, Homo sapiens
gacucaggccagugugu

SEQ ID NO: 1222744 - RNA, 22 nt, Homo sapiens
gacuccacgcuguccuuuggga

SEQ ID NO: 1222745 - RNA, 11 nt, Homo sapiens
gacuccacugg

SEQ ID NO: 1222746 - RNA, 13 nt, Homo sapiens
gacuccacuggac

SEQ ID NO: 1222747 - RNA, 21 nt, Homo sapiens
gacucccacaacaacaaaagc

SEQ ID NO: 1222748 - RNA, 20 nt, Homo sapiens
gacucuaagcugugugcagg

SEQ ID NO: 1222749 - RNA, 17 nt, Homo sapiens
gacucuacagaggccau

SEQ ID NO: 1222750 - RNA, 19 nt, Homo sapiens
gacucuccaaauagcauua

SEQ ID NO: 1222751 - RNA, 20 nt, Homo sapiens
gacucuggaggccugugccu

SEQ ID NO: 1222752 - RNA, 21 nt, Homo sapiens
gacucuggggaggugaacugg

SEQ ID NO: 1222753 - RNA, 22 nt, Homo sapiens
gacucuguaacaucacuaucca

SEQ ID NO: 1222754 - RNA, 16 nt, Homo sapiens
gacucugucuaccugg

SEQ ID NO: 1222755 - RNA, 12 nt, Homo sapiens
gauaaagcaccc

SEQ ID NO: 1222756 - RNA, 15 nt, Homo sapiens
gauaaagcacccugu

SEQ ID NO: 1222757 - RNA, 19 nt, Homo sapiens
gauaaaucauuucaguauc

SEQ ID NO: 1222758 - RNA, 23 nt, Homo sapiens
gauaacacaaguaaaacuguggu

SEQ ID NO: 1222759 - RNA, 18 nt, Homo sapiens
gauaaccuugugccuugg

SEQ ID NO: 1222760 - RNA, 14 nt, Homo sapiens
gauaacugauuucu

SEQ ID NO: 1222761 - RNA, 16 nt, Homo sapiens
gauaacuuagguggca

SEQ ID NO: 1222762 - RNA, 17 nt, Homo sapiens
gauaacuugagcaccgu

SEQ ID NO: 1222763 - RNA, 19 nt, Homo sapiens
gauaagaaaugaucuuuac

SEQ ID NO: 1222764 - RNA, 19 nt, Homo sapiens
gauaagccacucugucccu

SEQ ID NO: 1222765 - RNA, 22 nt, Homo sapiens
gauaaggacgggaccauuuuua

SEQ ID NO: 1222766 - RNA, 14 nt, Homo sapiens
gauaaggcucugaa

SEQ ID NO: 1222767 - RNA, 13 nt, Homo sapiens
gauaagucuuuca

SEQ ID NO: 1222768 - RNA, 15 nt, Homo sapiens
gauaaguguccccua

SEQ ID NO: 1222769 - RNA, 13 nt, Homo sapiens
gauaauagauucu

SEQ ID NO: 1222770 - RNA, 11 nt, Homo sapiens
gauaauauuca

SEQ ID NO: 1222771 - RNA, 12 nt, Homo sapiens
gauacaaacugc

SEQ ID NO: 1222772 - RNA, 13 nt, Homo sapiens
gauacaaccuccc

SEQ ID NO: 1222773 - RNA, 17 nt, Homo sapiens
gauacacaggacugaaa

SEQ ID NO: 1222774 - RNA, 13 nt, Homo sapiens
gauacacuugaag

SEQ ID NO: 1222775 - RNA, 19 nt, Homo sapiens
gauaccaagaugccaucug

SEQ ID NO: 1222776 - RNA, 18 nt, Homo sapiens
gauaccacuuaacagguu

SEQ ID NO: 1222777 - RNA, 20 nt, Homo sapiens
gauacccaggaccaagccac

SEQ ID NO: 1222778 - RNA, 21 nt, Homo sapiens
gauacccauagcuuccaugag

SEQ ID NO: 1222779 - RNA, 13 nt, Homo sapiens
gauaccugcacug

SEQ ID NO: 1222780 - RNA, 22 nt, Homo sapiens
gauaccuguaguggaacuaaaa

SEQ ID NO: 1222781 - RNA, 20 nt, Homo sapiens
gauacuaacauuuucauuga

SEQ ID NO: 1222782 - RNA, 14 nt, Homo sapiens
gauacuacaugcuu

SEQ ID NO: 1222783 - RNA, 19 nt, Homo sapiens
gauacugaguaaauccaug

SEQ ID NO: 1222784 - RNA, 17 nt, Homo sapiens
gauacugcgacuuucug

SEQ ID NO: 1222785 - RNA, 13 nt, Homo sapiens
gauacugcugagu

SEQ ID NO: 1222786 - RNA, 16 nt, Homo sapiens
gauagaggaaagggau

SEQ ID NO: 1222787 - RNA, 13 nt, Homo sapiens
gauagaugucuau

SEQ ID NO: 1222788 - RNA, 16 nt, Homo sapiens
gauagggaacugggga

SEQ ID NO: 1222789 - RNA, 23 nt, Homo sapiens
gauaggggcagauaggagcugca

SEQ ID NO: 1222790 - RNA, 15 nt, Homo sapiens
gauaguaacaaugaa

SEQ ID NO: 1222791 - RNA, 14 nt, Homo sapiens
gauaguccaaagac

SEQ ID NO: 1222792 - RNA, 22 nt, Homo sapiens
gauagugggcaccccacugcaa

SEQ ID NO: 1222793 - RNA, 21 nt, Homo sapiens
gauaguugaugcauguuacua

SEQ ID NO: 1222794 - RNA, 16 nt, Homo sapiens
gauauaaaaaguacag

SEQ ID NO: 1222795 - RNA, 20 nt, Homo sapiens
gauauaauuuaacuguguuu

SEQ ID NO: 1222796 - RNA, 17 nt, Homo sapiens
gauauacugcagcuuua

SEQ ID NO: 1222797 - RNA, 17 nt, Homo sapiens
gauauauuuaagccuua

SEQ ID NO: 1222798 - RNA, 17 nt, Homo sapiens
gauaucaaaagcaaaua

SEQ ID NO: 1222799 - RNA, 15 nt, Homo sapiens
gauaucaugccccug

SEQ ID NO: 1222800 - RNA, 22 nt, Homo sapiens
gauaucauuuuaaaaacuuuau

SEQ ID NO: 1222801 - RNA, 18 nt, Homo sapiens
gauaucugcagggacaga

SEQ ID NO: 1222802 - RNA, 19 nt, Homo sapiens
gauaucugcagggacagag

SEQ ID NO: 1222803 - RNA, 14 nt, Homo sapiens
gauaugcaguaugc

SEQ ID NO: 1222804 - RNA, 13 nt, Homo sapiens
gauauggaguucu

SEQ ID NO: 1222805 - RNA, 13 nt, Homo sapiens
gauauguggugua

SEQ ID NO: 1222806 - RNA, 15 nt, Homo sapiens
gauauuaaaauaagc

SEQ ID NO: 1222807 - RNA, 18 nt, Homo sapiens
gauauuaacaacaauaac

SEQ ID NO: 1222808 - RNA, 12 nt, Homo sapiens
gauauuacuuua

SEQ ID NO: 1222809 - RNA, 21 nt, Homo sapiens
gauauugaucaaauauagaaa

SEQ ID NO: 1222810 - RNA, 17 nt, Homo sapiens
gauauugauuacuauca

SEQ ID NO: 1222811 - RNA, 14 nt, Homo sapiens
gauauugcuacuau

SEQ ID NO: 1222812 - RNA, 19 nt, Homo sapiens
gauauuugaagcaucacau

SEQ ID NO: 1222813 - RNA, 16 nt, Homo sapiens
gauauuugguaccaug

SEQ ID NO: 1222814 - RNA, 17 nt, Homo sapiens
gauauuuuuuacuuuag

SEQ ID NO: 1222815 - RNA, 22 nt, Homo sapiens
gaucaaaauaaaaagugacaca

SEQ ID NO: 1222816 - RNA, 15 nt, Homo sapiens
gaucaagguacaauu

SEQ ID NO: 1222817 - RNA, 21 nt, Homo sapiens
gaucaagucaccggagcuuuc

SEQ ID NO: 1222818 - RNA, 23 nt, Homo sapiens
gaucacagggccccagaaggcag

SEQ ID NO: 1222819 - RNA, 18 nt, Homo sapiens
gaucacuacaaguauuau

SEQ ID NO: 1222820 - RNA, 15 nt, Homo sapiens
gaucacuccagugca

SEQ ID NO: 1222821 - RNA, 14 nt, Homo sapiens
gaucacugccacac

SEQ ID NO: 1222822 - RNA, 16 nt, Homo sapiens
gaucacuggcaaugaa

SEQ ID NO: 1222823 - RNA, 21 nt, Homo sapiens
gaucacuggcuggccugagca

SEQ ID NO: 1222824 - RNA, 11 nt, Homo sapiens
gaucacuugag

SEQ ID NO: 1222825 - RNA, 19 nt, Homo sapiens
gaucacuuuguuaaaaaua

SEQ ID NO: 1222826 - RNA, 16 nt, Homo sapiens
gaucaguacugacuuu

SEQ ID NO: 1222827 - RNA, 18 nt, Homo sapiens
gaucaucgccagaggugc

SEQ ID NO: 1222828 - RNA, 14 nt, Homo sapiens
gaucaugcauuguu

SEQ ID NO: 1222829 - RNA, 19 nt, Homo sapiens
gaucauugaaauucugaga

SEQ ID NO: 1222830 - RNA, 19 nt, Homo sapiens
gauccagauccagacugua

SEQ ID NO: 1222831 - RNA, 15 nt, Homo sapiens
gauccaggugccaag

SEQ ID NO: 1222832 - RNA, 15 nt, Homo sapiens
gauccaguugcacua

SEQ ID NO: 1222833 - RNA, 13 nt, Homo sapiens
gaucccacuggaa

SEQ ID NO: 1222834 - RNA, 15 nt, Homo sapiens
gauccccaaguggug

SEQ ID NO: 1222835 - RNA, 23 nt, Homo sapiens
gauccccccacagccccugguca

SEQ ID NO: 1222836 - RNA, 22 nt, Homo sapiens
gauccccguuccugacaucaca

SEQ ID NO: 1222837 - RNA, 19 nt, Homo sapiens
gauccuaagcaucuaaguu

SEQ ID NO: 1222838 - RNA, 20 nt, Homo sapiens
gauccuagugaccaaauuca

SEQ ID NO: 1222839 - RNA, 12 nt, Homo sapiens
gauccucacccg

SEQ ID NO: 1222840 - RNA, 23 nt, Homo sapiens
gauccucauauggcccaguguca

SEQ ID NO: 1222841 - RNA, 16 nt, Homo sapiens
gauccuuuuuccauca

SEQ ID NO: 1222842 - RNA, 21 nt, Homo sapiens
gaucgucccauccccacaucc

SEQ ID NO: 1222843 - RNA, 20 nt, Homo sapiens
gaucgugcuacugcacucca

SEQ ID NO: 1222844 - RNA, 22 nt, Homo sapiens
gaucguuuuuucccagggcaag

SEQ ID NO: 1222845 - RNA, 19 nt, Homo sapiens
gaucuaagccuuuccauaa

SEQ ID NO: 1222846 - RNA, 20 nt, Homo sapiens
gaucuaagccuuuccauaag

SEQ ID NO: 1222847 - RNA, 21 nt, Homo sapiens
gaucuaaggaugucacagggc

SEQ ID NO: 1222848 - RNA, 21 nt, Homo sapiens
gaucucaauuugcaguauuca

SEQ ID NO: 1222849 - RNA, 18 nt, Homo sapiens
gaucucugagaccacaga

SEQ ID NO: 1222850 - RNA, 23 nt, Homo sapiens
gaucugauaaggaucuaggagaa

SEQ ID NO: 1222851 - RNA, 18 nt, Homo sapiens
gaucugguuuugcuauua

SEQ ID NO: 1222852 - RNA, 10 nt, Homo sapiens
gaucugugau

SEQ ID NO: 1222853 - RNA, 20 nt, Homo sapiens
gaucugugccauagaacaag

SEQ ID NO: 1222854 - RNA, 11 nt, Homo sapiens
gaucugugguc

SEQ ID NO: 1222855 - RNA, 20 nt, Homo sapiens
gaucuguguuuuauugacau

SEQ ID NO: 1222856 - RNA, 17 nt, Homo sapiens
gaucuguuuuucaccac

SEQ ID NO: 1222857 - RNA, 18 nt, Homo sapiens
gaucuuaaagcauucccc

SEQ ID NO: 1222858 - RNA, 18 nt, Homo sapiens
gaucuucagaacugcccu

SEQ ID NO: 1222859 - RNA, 17 nt, Homo sapiens
gaucuugccacauuucu

SEQ ID NO: 1222860 - RNA, 18 nt, Homo sapiens
gaugaaaaugaaucuuca

SEQ ID NO: 1222861 - RNA, 23 nt, Homo sapiens
gaugaaauaacuccuucuuguag

SEQ ID NO: 1222862 - RNA, 20 nt, Homo sapiens
gaugaauagaugugaucacu

SEQ ID NO: 1222863 - RNA, 15 nt, Homo sapiens
gaugacacuagucag

SEQ ID NO: 1222864 - RNA, 17 nt, Homo sapiens
gaugacauuaaagaagg

SEQ ID NO: 1222865 - RNA, 21 nt, Homo sapiens
gaugacauuaaagaaggguug

SEQ ID NO: 1222866 - RNA, 13 nt, Homo sapiens
gaugacauucccu

SEQ ID NO: 1222867 - RNA, 14 nt, Homo sapiens
gaugacuguugaug

SEQ ID NO: 1222868 - RNA, 13 nt, Homo sapiens
gaugagggggcca

SEQ ID NO: 1222869 - RNA, 18 nt, Homo sapiens
gaugaggucaccagggga

SEQ ID NO: 1222870 - RNA, 15 nt, Homo sapiens
gaugaguuacuugaa

SEQ ID NO: 1222871 - RNA, 19 nt, Homo sapiens
gaugauacgaaugauguca

SEQ ID NO: 1222872 - RNA, 23 nt, Homo sapiens
gaugauacuuggaugcagcucuu

SEQ ID NO: 1222873 - RNA, 21 nt, Homo sapiens
gaugaucuggauccaccaaga

SEQ ID NO: 1222874 - RNA, 10 nt, Homo sapiens
gaugaugcug

SEQ ID NO: 1222875 - RNA, 15 nt, Homo sapiens
gaugcaaugugcuac

SEQ ID NO: 1222876 - RNA, 16 nt, Homo sapiens
gaugcacuuaugcagu

SEQ ID NO: 1222877 - RNA, 15 nt, Homo sapiens
gaugcagugcuucca

SEQ ID NO: 1222878 - RNA, 16 nt, Homo sapiens
gaugcaucuaagcagg

SEQ ID NO: 1222879 - RNA, 12 nt, Homo sapiens
gaugcccagaag

SEQ ID NO: 1222880 - RNA, 19 nt, Homo sapiens
gaugccuguguacugccuu

SEQ ID NO: 1222881 - RNA, 17 nt, Homo sapiens
gcauagagcccuggcca

SEQ ID NO: 1222882 - RNA, 19 nt, Homo sapiens
gcauagauugaucaaagug

SEQ ID NO: 1222883 - RNA, 14 nt, Homo sapiens
gcauagcaaacaga

SEQ ID NO: 1222884 - RNA, 20 nt, Homo sapiens
gcauagcaaaugacauaagc

SEQ ID NO: 1222885 - RNA, 18 nt, Homo sapiens
gcauagcagaggggccag

SEQ ID NO: 1222886 - RNA, 16 nt, Homo sapiens
gcauagcucuauuuua

SEQ ID NO: 1222887 - RNA, 20 nt, Homo sapiens
gcauaggcugacuuuugcag

SEQ ID NO: 1222888 - RNA, 15 nt, Homo sapiens
gcauagugcugggau

SEQ ID NO: 1222889 - RNA, 13 nt, Homo sapiens
gcauauaaaugua

SEQ ID NO: 1222890 - RNA, 15 nt, Homo sapiens
gcauauauguauaua

SEQ ID NO: 1222891 - RNA, 20 nt, Homo sapiens
gcauaucaacuugaggccag

SEQ ID NO: 1222892 - RNA, 17 nt, Homo sapiens
gcauaugauagaugaca

SEQ ID NO: 1222893 - RNA, 16 nt, Homo sapiens
gcaucaaggugcugaa

SEQ ID NO: 1222894 - RNA, 21 nt, Homo sapiens
gcaucaauacaaccagcccaa

SEQ ID NO: 1222895 - RNA, 20 nt, Homo sapiens
gcaucacguaccccacuggg

SEQ ID NO: 1222896 - RNA, 11 nt, Homo sapiens
gcaucacuggg

SEQ ID NO: 1222897 - RNA, 11 nt, Homo sapiens
gcaucagagau

SEQ ID NO: 1222898 - RNA, 19 nt, Homo sapiens
gcaucagagguuugcuucc

SEQ ID NO: 1222899 - RNA, 15 nt, Homo sapiens
gcaucaucaaaaacu

SEQ ID NO: 1222900 - RNA, 19 nt, Homo sapiens
gcaucaucaaaaacuuugg

SEQ ID NO: 1222901 - RNA, 17 nt, Homo sapiens
gcaucauuaguacaucu

SEQ ID NO: 1222902 - RNA, 17 nt, Homo sapiens
gcauccaacuccaggau

SEQ ID NO: 1222903 - RNA, 15 nt, Homo sapiens
gcauccaaguuuaug

SEQ ID NO: 1222904 - RNA, 18 nt, Homo sapiens
gcauccagccuguguguu

SEQ ID NO: 1222905 - RNA, 18 nt, Homo sapiens
gcaucccggaggaaaucu

SEQ ID NO: 1222906 - RNA, 14 nt, Homo sapiens
gcauccuuugcacu

SEQ ID NO: 1222907 - RNA, 23 nt, Homo sapiens
gcaucgggagcacccagagcacc

SEQ ID NO: 1222908 - RNA, 15 nt, Homo sapiens
gcaucuacacaauuu

SEQ ID NO: 1222909 - RNA, 16 nt, Homo sapiens
gcaucucccagcaaga

SEQ ID NO: 1222910 - RNA, 19 nt, Homo sapiens
gcaugagaaagaauuugag

SEQ ID NO: 1222911 - RNA, 20 nt, Homo sapiens
gcaugagagaauuguaucau

SEQ ID NO: 1222912 - RNA, 22 nt, Homo sapiens
gcaugaucuuucugcaggaaau

SEQ ID NO: 1222913 - RNA, 16 nt, Homo sapiens
gcaugaugucuaccuc

SEQ ID NO: 1222914 - RNA, 18 nt, Homo sapiens
gcaugaugucuaccucag

SEQ ID NO: 1222915 - RNA, 21 nt, Homo sapiens
gcaugcauuuugcagcaguga

SEQ ID NO: 1222916 - RNA, 17 nt, Homo sapiens
gcaugccuggucuuucc

SEQ ID NO: 1222917 - RNA, 19 nt, Homo sapiens
gcaugccuugugcuguuaa

SEQ ID NO: 1222918 - RNA, 13 nt, Homo sapiens
gcaugcuucucac

SEQ ID NO: 1222919 - RNA, 21 nt, Homo sapiens
gcauggcaagucacaugcgua

SEQ ID NO: 1222920 - RNA, 15 nt, Homo sapiens
gcauggccacccuca

SEQ ID NO: 1222921 - RNA, 14 nt, Homo sapiens
gcaugguagcucau

SEQ ID NO: 1222922 - RNA, 18 nt, Homo sapiens
gcauguaagccaagucau

SEQ ID NO: 1222923 - RNA, 22 nt, Homo sapiens
gcauguccaacaugguaauuca

SEQ ID NO: 1222924 - RNA, 23 nt, Homo sapiens
gcauguccucauccuuuccugcc

SEQ ID NO: 1222925 - RNA, 18 nt, Homo sapiens
gcaugucucaauaguaaa

SEQ ID NO: 1222926 - RNA, 10 nt, Homo sapiens
gcaugugcag

SEQ ID NO: 1222927 - RNA, 22 nt, Homo sapiens
gcaugugccaagauucuacucu

SEQ ID NO: 1222928 - RNA, 16 nt, Homo sapiens
gcauguggagacacuc

SEQ ID NO: 1222929 - RNA, 16 nt, Homo sapiens
gcauguguauuuccag

SEQ ID NO: 1222930 - RNA, 15 nt, Homo sapiens
gcauguuaacuuuau

SEQ ID NO: 1222931 - RNA, 22 nt, Homo sapiens
gcauuaaaccugucuccacugu

SEQ ID NO: 1222932 - RNA, 16 nt, Homo sapiens
gcauuacuauucacug

SEQ ID NO: 1222933 - RNA, 17 nt, Homo sapiens
gcauuacuauucacuga

SEQ ID NO: 1222934 - RNA, 17 nt, Homo sapiens
gcauuauguccacugug

SEQ ID NO: 1222935 - RNA, 14 nt, Homo sapiens
gcauucacauuuag

SEQ ID NO: 1222936 - RNA, 19 nt, Homo sapiens
gcauucauuuuuauagcaa

SEQ ID NO: 1222937 - RNA, 20 nt, Homo sapiens
gcauuccagccccucugguc

SEQ ID NO: 1222938 - RNA, 17 nt, Homo sapiens
gcauucgggccacaggg

SEQ ID NO: 1222939 - RNA, 22 nt, Homo sapiens
gcauucggggaagcugcacaug

SEQ ID NO: 1222940 - RNA, 15 nt, Homo sapiens
gcauugaaagaauua

SEQ ID NO: 1222941 - RNA, 16 nt, Homo sapiens
gcauugaaaugagcac

SEQ ID NO: 1222942 - RNA, 19 nt, Homo sapiens
gcauugucccugugccuaa

SEQ ID NO: 1222943 - RNA, 21 nt, Homo sapiens
gcauuguugagguggucugaa

SEQ ID NO: 1222944 - RNA, 21 nt, Homo sapiens
gcauuuaaaaggacugcugau

SEQ ID NO: 1222945 - RNA, 14 nt, Homo sapiens
gcauuuaagaguga

SEQ ID NO: 1222946 - RNA, 14 nt, Homo sapiens
gcauuuagcacaaa

SEQ ID NO: 1222947 - RNA, 23 nt, Homo sapiens
gcauuuuuuuuuuaugauuuguc

SEQ ID NO: 1222948 - RNA, 23 nt, Homo sapiens
gccaaaauaaugcaccacuuuua

SEQ ID NO: 1222949 - RNA, 13 nt, Homo sapiens
gccaaaauaccag

SEQ ID NO: 1222950 - RNA, 13 nt, Homo sapiens
gccaaaaugccau

SEQ ID NO: 1222951 - RNA, 10 nt, Homo sapiens
gccaaacaaa

SEQ ID NO: 1222952 - RNA, 21 nt, Homo sapiens
gccaaagaaaugaacauucca

SEQ ID NO: 1222953 - RNA, 18 nt, Homo sapiens
gccaaagagaaugccauu

SEQ ID NO: 1222954 - RNA, 20 nt, Homo sapiens
gccaaauguuccauaugugg

SEQ ID NO: 1222955 - RNA, 13 nt, Homo sapiens
gccaacuccucac

SEQ ID NO: 1222956 - RNA, 21 nt, Homo sapiens
gccaacucuaacaggcacuuu

SEQ ID NO: 1222957 - RNA, 14 nt, Homo sapiens
gccaacugcaaaaa

SEQ ID NO: 1222958 - RNA, 15 nt, Homo sapiens
gccaacugcugcuuu

SEQ ID NO: 1222959 - RNA, 21 nt, Homo sapiens
gccaagauucuacucuuguca

SEQ ID NO: 1222960 - RNA, 18 nt, Homo sapiens
gccaagggcugagugucc

SEQ ID NO: 1222961 - RNA, 19 nt, Homo sapiens
gccaaugccccacuggcag

SEQ ID NO: 1222962 - RNA, 19 nt, Homo sapiens
gccacaaaacugacaguaa

SEQ ID NO: 1222963 - RNA, 20 nt, Homo sapiens
gccacaaaacugacaguaaa

SEQ ID NO: 1222964 - RNA, 19 nt, Homo sapiens
gccacacaaacguuuacuu

SEQ ID NO: 1222965 - RNA, 20 nt, Homo sapiens
gccacacacaguuacagagu

SEQ ID NO: 1222966 - RNA, 14 nt, Homo sapiens
gccacacucuccau

SEQ ID NO: 1222967 - RNA, 18 nt, Homo sapiens
gccacagcagguccucca

SEQ ID NO: 1222968 - RNA, 17 nt, Homo sapiens
gccacaguagaacuguc

SEQ ID NO: 1222969 - RNA, 14 nt, Homo sapiens
gccacauaccucuc

SEQ ID NO: 1222970 - RNA, 18 nt, Homo sapiens
gccacauuuggaauacuu

SEQ ID NO: 1222971 - RNA, 16 nt, Homo sapiens
gccaccacgucugcca

SEQ ID NO: 1222972 - RNA, 22 nt, Homo sapiens
gccacccaggcuggagugcagu

SEQ ID NO: 1222973 - RNA, 18 nt, Homo sapiens
gccaccccacucuaccuc

SEQ ID NO: 1222974 - RNA, 23 nt, Homo sapiens
gccaccccuccccaguacagggg

SEQ ID NO: 1222975 - RNA, 16 nt, Homo sapiens
gccaccgcccagagac

SEQ ID NO: 1222976 - RNA, 23 nt, Homo sapiens
gccaccgugauagaaaaaaaauc

SEQ ID NO: 1222977 - RNA, 16 nt, Homo sapiens
gccacgaggugcagua

SEQ ID NO: 1222978 - RNA, 16 nt, Homo sapiens
gccacggccuggcugg

SEQ ID NO: 1222979 - RNA, 17 nt, Homo sapiens
gccacggccuugugucu

SEQ ID NO: 1222980 - RNA, 22 nt, Homo sapiens
gccacgugggcaaacaggcagu

SEQ ID NO: 1222981 - RNA, 17 nt, Homo sapiens
gccacuaugccugacua

SEQ ID NO: 1222982 - RNA, 21 nt, Homo sapiens
gccacuccuggggucacucag

SEQ ID NO: 1222983 - RNA, 13 nt, Homo sapiens
gccacugcacaga

SEQ ID NO: 1222984 - RNA, 21 nt, Homo sapiens
gccacuggaguccacacuuga

SEQ ID NO: 1222985 - RNA, 23 nt, Homo sapiens
gccacuugguuuuuggcucuuuc

SEQ ID NO: 1222986 - RNA, 16 nt, Homo sapiens
gccacuuugacucaga

SEQ ID NO: 1222987 - RNA, 22 nt, Homo sapiens
gccagaaagagcugucuaugca

SEQ ID NO: 1222988 - RNA, 23 nt, Homo sapiens
gccagagaauagaucaguauuuc

SEQ ID NO: 1222989 - RNA, 21 nt, Homo sapiens
gccagaggaauccuggcagcc

SEQ ID NO: 1222990 - RNA, 20 nt, Homo sapiens
gccagaggcucuaauguaca

SEQ ID NO: 1222991 - RNA, 18 nt, Homo sapiens
gccagaggguagggcaca

SEQ ID NO: 1222992 - RNA, 22 nt, Homo sapiens
gccagagguaauguuaguaaau

SEQ ID NO: 1222993 - RNA, 19 nt, Homo sapiens
gccagaguagugaagcuaa

SEQ ID NO: 1222994 - RNA, 19 nt, Homo sapiens
gccagaguggccuggccag

SEQ ID NO: 1222995 - RNA, 22 nt, Homo sapiens
gccagauggccccuccacuggg

SEQ ID NO: 1222996 - RNA, 14 nt, Homo sapiens
gccagcaaugacau

SEQ ID NO: 1222997 - RNA, 16 nt, Homo sapiens
gccagcauacauuuuc

SEQ ID NO: 1222998 - RNA, 20 nt, Homo sapiens
gccagccuucuuccauccca

SEQ ID NO: 1222999 - RNA, 21 nt, Homo sapiens
gccagccuucuuccaucccag

SEQ ID NO: 1223000 - RNA, 21 nt, Homo sapiens
gccagcucaccccaucauccc

SEQ ID NO: 1223001 - RNA, 14 nt, Homo sapiens
gccagcucauucuc

SEQ ID NO: 1223002 - RNA, 16 nt, Homo sapiens
gccagcugugcacuuu

SEQ ID NO: 1223003 - RNA, 22 nt, Homo sapiens
gccagcugugggacaauuaucu

SEQ ID NO: 1223004 - RNA, 15 nt, Homo sapiens
gccagcuucacucuc

SEQ ID NO: 1223005 - RNA, 14 nt, Homo sapiens
gccaggacaucucu

SEQ ID NO: 1223006 - RNA, 18 nt, Homo sapiens
gcucaccagccccagugc

SEQ ID NO: 1223007 - RNA, 13 nt, Homo sapiens
gcucacuuuucau

SEQ ID NO: 1223008 - RNA, 15 nt, Homo sapiens
gcucagaaaggaaau

SEQ ID NO: 1223009 - RNA, 13 nt, Homo sapiens
gcucagaacccag

SEQ ID NO: 1223010 - RNA, 17 nt, Homo sapiens
gcucagaauucaucuga

SEQ ID NO: 1223011 - RNA, 16 nt, Homo sapiens
gcucagauuauuuaaa

SEQ ID NO: 1223012 - RNA, 16 nt, Homo sapiens
gcucagcaaccuuuca

SEQ ID NO: 1223013 - RNA, 18 nt, Homo sapiens
gcucaggagccaccagca

SEQ ID NO: 1223014 - RNA, 22 nt, Homo sapiens
gcucaggaggcuuggaaagcau

SEQ ID NO: 1223015 - RNA, 19 nt, Homo sapiens
gcucaggguuaauguagug

SEQ ID NO: 1223016 - RNA, 22 nt, Homo sapiens
gcucaguaaacgggaacaugcc

SEQ ID NO: 1223017 - RNA, 16 nt, Homo sapiens
gcucaguaauuccugu

SEQ ID NO: 1223018 - RNA, 14 nt, Homo sapiens
gcucauaagcaaua

SEQ ID NO: 1223019 - RNA, 15 nt, Homo sapiens
gcucauacuuaucua

SEQ ID NO: 1223020 - RNA, 13 nt, Homo sapiens
gcucaucacugga

SEQ ID NO: 1223021 - RNA, 17 nt, Homo sapiens
gcuccacgaagccuuaa

SEQ ID NO: 1223022 - RNA, 13 nt, Homo sapiens
gcuccacugaaca

SEQ ID NO: 1223023 - RNA, 13 nt, Homo sapiens
gcuccacugucac

SEQ ID NO: 1223024 - RNA, 21 nt, Homo sapiens
gcuccagcucauaugcugaca

SEQ ID NO: 1223025 - RNA, 17 nt, Homo sapiens
gcuccaggacuccacug

SEQ ID NO: 1223026 - RNA, 14 nt, Homo sapiens
gcuccaggccugca

SEQ ID NO: 1223027 - RNA, 19 nt, Homo sapiens
gcuccagggaauccaagcc

SEQ ID NO: 1223028 - RNA, 13 nt, Homo sapiens
gcuccagugcagg

SEQ ID NO: 1223029 - RNA, 13 nt, Homo sapiens
gcuccagugccag

SEQ ID NO: 1223030 - RNA, 19 nt, Homo sapiens
gcuccaucccaaccaggca

SEQ ID NO: 1223031 - RNA, 14 nt, Homo sapiens
gcucccacagaaca

SEQ ID NO: 1223032 - RNA, 22 nt, Homo sapiens
gcucccacauucugaugagcaa

SEQ ID NO: 1223033 - RNA, 17 nt, Homo sapiens
gcucccacuucuuggga

SEQ ID NO: 1223034 - RNA, 18 nt, Homo sapiens
gcucccagccacauggcg

SEQ ID NO: 1223035 - RNA, 22 nt, Homo sapiens
gcucccagccugcccuccagcu

SEQ ID NO: 1223036 - RNA, 21 nt, Homo sapiens
gcucccagcugugcuguggag

SEQ ID NO: 1223037 - RNA, 12 nt, Homo sapiens
gcucccaugacc

SEQ ID NO: 1223038 - RNA, 12 nt, Homo sapiens
gcucccauuccu

SEQ ID NO: 1223039 - RNA, 21 nt, Homo sapiens
gcuccccacaccuuccagggc

SEQ ID NO: 1223040 - RNA, 22 nt, Homo sapiens
gcuccccggacauacucucugc

SEQ ID NO: 1223041 - RNA, 16 nt, Homo sapiens
gcuccccucacucugu

SEQ ID NO: 1223042 - RNA, 18 nt, Homo sapiens
gcucccugacagcaccug

SEQ ID NO: 1223043 - RNA, 18 nt, Homo sapiens
gcucccugcgccugacau

SEQ ID NO: 1223044 - RNA, 13 nt, Homo sapiens
gcuccggggccag

SEQ ID NO: 1223045 - RNA, 17 nt, Homo sapiens
gcuccuaguuugaccuc

SEQ ID NO: 1223046 - RNA, 18 nt, Homo sapiens
gcuccuccugcccugucc

SEQ ID NO: 1223047 - RNA, 17 nt, Homo sapiens
gcuccuggaauggaaga

SEQ ID NO: 1223048 - RNA, 18 nt, Homo sapiens
gcuccugggggaugcucu

SEQ ID NO: 1223049 - RNA, 17 nt, Homo sapiens
gcuccuuggcuuaccug

SEQ ID NO: 1223050 - RNA, 16 nt, Homo sapiens
gcuccuuuacaaaaga

SEQ ID NO: 1223051 - RNA, 19 nt, Homo sapiens
gcuccuuucuccugugaau

SEQ ID NO: 1223052 - RNA, 14 nt, Homo sapiens
gcucgcugccauca

SEQ ID NO: 1223053 - RNA, 18 nt, Homo sapiens
gcucggauucaacuaccu

SEQ ID NO: 1223054 - RNA, 20 nt, Homo sapiens
gcucguugccugccacugag

SEQ ID NO: 1223055 - RNA, 13 nt, Homo sapiens
gcucuacccauga

SEQ ID NO: 1223056 - RNA, 22 nt, Homo sapiens
gcucuacguggcaaauuaacuu

SEQ ID NO: 1223057 - RNA, 10 nt, Homo sapiens
gcucuagccc

SEQ ID NO: 1223058 - RNA, 21 nt, Homo sapiens
gcucuauauaugaagugaaaa

SEQ ID NO: 1223059 - RNA, 19 nt, Homo sapiens
gcucucagaagguauuccu

SEQ ID NO: 1223060 - RNA, 20 nt, Homo sapiens
gcucucaguuaaaaugugag

SEQ ID NO: 1223061 - RNA, 21 nt, Homo sapiens
gcucuccccaaacuugcuuua

SEQ ID NO: 1223062 - RNA, 23 nt, Homo sapiens
gcucuccccaaacuugcuuuaug

SEQ ID NO: 1223063 - RNA, 14 nt, Homo sapiens
gcucugaaggucca

SEQ ID NO: 1223064 - RNA, 20 nt, Homo sapiens
gcucugagaaaccucgggaa

SEQ ID NO: 1223065 - RNA, 21 nt, Homo sapiens
gcucugagagucuagauucuc

SEQ ID NO: 1223066 - RNA, 18 nt, Homo sapiens
gcucugaucauccacugu

SEQ ID NO: 1223067 - RNA, 22 nt, Homo sapiens
gcucugcaaugggcacugggau

SEQ ID NO: 1223068 - RNA, 23 nt, Homo sapiens
gcucugcaccccucugcccucau

SEQ ID NO: 1223069 - RNA, 20 nt, Homo sapiens
gcucugcgccgagccucaga

SEQ ID NO: 1223070 - RNA, 17 nt, Homo sapiens
gcucugggauagcugac

SEQ ID NO: 1223071 - RNA, 16 nt, Homo sapiens
gcucugguuagaaaaa

SEQ ID NO: 1223072 - RNA, 15 nt, Homo sapiens
gcucuguacccauga

SEQ ID NO: 1223073 - RNA, 14 nt, Homo sapiens
gcucuguuacccag

SEQ ID NO: 1223074 - RNA, 22 nt, Homo sapiens
gcucuuaggugcuucuucacuu

SEQ ID NO: 1223075 - RNA, 14 nt, Homo sapiens
gcucuuaugccauu

SEQ ID NO: 1223076 - RNA, 19 nt, Homo sapiens
gcucuucagcacaaagaca

SEQ ID NO: 1223077 - RNA, 18 nt, Homo sapiens
gcucuucuaccauuugaa

SEQ ID NO: 1223078 - RNA, 19 nt, Homo sapiens
gcucuucuaccauuugaau

SEQ ID NO: 1223079 - RNA, 11 nt, Homo sapiens
gcucuugcccu

SEQ ID NO: 1223080 - RNA, 19 nt, Homo sapiens
gcucuugggaagaccagcu

SEQ ID NO: 1223081 - RNA, 20 nt, Homo sapiens
gcugaaaaauauagccuuua

SEQ ID NO: 1223082 - RNA, 22 nt, Homo sapiens
gcugaaaagaagccucagcucc

SEQ ID NO: 1223083 - RNA, 17 nt, Homo sapiens
gcugaaagaacauggac

SEQ ID NO: 1223084 - RNA, 16 nt, Homo sapiens
gcugaagaguuuacug

SEQ ID NO: 1223085 - RNA, 21 nt, Homo sapiens
gcugaaggaaaccagugcaac

SEQ ID NO: 1223086 - RNA, 18 nt, Homo sapiens
gcugaaggcuuacuucag

SEQ ID NO: 1223087 - RNA, 23 nt, Homo sapiens
gcugaagugguugcauucuacua

SEQ ID NO: 1223088 - RNA, 22 nt, Homo sapiens
gcugaauuauuggacagucuca

SEQ ID NO: 1223089 - RNA, 23 nt, Homo sapiens
gcugacaugaagcuguuguguga

SEQ ID NO: 1223090 - RNA, 19 nt, Homo sapiens
gcugacccagaguggaguc

SEQ ID NO: 1223091 - RNA, 17 nt, Homo sapiens
gcugaccuggagaugcu

SEQ ID NO: 1223092 - RNA, 17 nt, Homo sapiens
gcugacuucuuucacaa

SEQ ID NO: 1223093 - RNA, 13 nt, Homo sapiens
gcugagauuacag

SEQ ID NO: 1223094 - RNA, 22 nt, Homo sapiens
gcugagauugagcagaagauca

SEQ ID NO: 1223095 - RNA, 17 nt, Homo sapiens
gcugagcugaguggcca

SEQ ID NO: 1223096 - RNA, 16 nt, Homo sapiens
gcugaggacacucagu

SEQ ID NO: 1223097 - RNA, 20 nt, Homo sapiens
gcugaggcccccagcugccu

SEQ ID NO: 1223098 - RNA, 23 nt, Homo sapiens
gcugaggcggguggaucaccuga

SEQ ID NO: 1223099 - RNA, 21 nt, Homo sapiens
gcugaggggaggaucacugga

SEQ ID NO: 1223100 - RNA, 13 nt, Homo sapiens
gcugaggucuguu

SEQ ID NO: 1223101 - RNA, 15 nt, Homo sapiens
gcugagucagacugu

SEQ ID NO: 1223102 - RNA, 18 nt, Homo sapiens
gcugagugaaugaacaaa

SEQ ID NO: 1223103 - RNA, 13 nt, Homo sapiens
gcugaguggcgca

SEQ ID NO: 1223104 - RNA, 22 nt, Homo sapiens
gcugaguuggguuggaguacac

SEQ ID NO: 1223105 - RNA, 21 nt, Homo sapiens
gcugaugaacucuuaaucaaa

SEQ ID NO: 1223106 - RNA, 21 nt, Homo sapiens
gcugaugccuguguacugccu

SEQ ID NO: 1223107 - RNA, 13 nt, Homo sapiens
gcugauggugaca

SEQ ID NO: 1223108 - RNA, 14 nt, Homo sapiens
gcugauugaagaca

SEQ ID NO: 1223109 - RNA, 20 nt, Homo sapiens
gcugauuuccccucuucccu

SEQ ID NO: 1223110 - RNA, 21 nt, Homo sapiens
gcugcacaucacaacauuuac

SEQ ID NO: 1223111 - RNA, 13 nt, Homo sapiens
gcugcaccugguc

SEQ ID NO: 1223112 - RNA, 21 nt, Homo sapiens
gcugcacucaagcuuggguga

SEQ ID NO: 1223113 - RNA, 12 nt, Homo sapiens
gcugcagcugug

SEQ ID NO: 1223114 - RNA, 22 nt, Homo sapiens
gcugcaggccgugugucuguca

SEQ ID NO: 1223115 - RNA, 23 nt, Homo sapiens
gcugcaggccugacuacugccca

SEQ ID NO: 1223116 - RNA, 17 nt, Homo sapiens
gcugcaggggugccugg

SEQ ID NO: 1223117 - RNA, 20 nt, Homo sapiens
gcugcagugacgugcaccug

SEQ ID NO: 1223118 - RNA, 12 nt, Homo sapiens
gcugccaucacc

SEQ ID NO: 1223119 - RNA, 14 nt, Homo sapiens
gcugcccaggccac

SEQ ID NO: 1223120 - RNA, 21 nt, Homo sapiens
gcugccugcaaugcagggcau

SEQ ID NO: 1223121 - RNA, 20 nt, Homo sapiens
gcugccugcuuggcccggcc

SEQ ID NO: 1223122 - RNA, 14 nt, Homo sapiens
gcugcgacugauga

SEQ ID NO: 1223123 - RNA, 13 nt, Homo sapiens
gcugcuaaugugu

SEQ ID NO: 1223124 - RNA, 13 nt, Homo sapiens
gcugcuccgcccg

SEQ ID NO: 1223125 - RNA, 14 nt, Homo sapiens
gcugcucuauugua

SEQ ID NO: 1223126 - RNA, 12 nt, Homo sapiens
gcugcugccagg

SEQ ID NO: 1223127 - RNA, 19 nt, Homo sapiens
gcugcugcccauguuucaa

SEQ ID NO: 1223128 - RNA, 15 nt, Homo sapiens
gcugcugcugcucca

SEQ ID NO: 1223129 - RNA, 14 nt, Homo sapiens
gcugcugugcacau

SEQ ID NO: 1223130 - RNA, 19 nt, Homo sapiens
gcugcuuagacauaacaaa

SEQ ID NO: 1223131 - RNA, 18 nt, Homo sapiens
gcuggaacgcaguggugu

SEQ ID NO: 1223132 - RNA, 20 nt, Homo sapiens
gugcaguuguaggcauguag

SEQ ID NO: 1223133 - RNA, 21 nt, Homo sapiens
gugcauaugaaauccuugacu

SEQ ID NO: 1223134 - RNA, 15 nt, Homo sapiens
gugcaucccugagac

SEQ ID NO: 1223135 - RNA, 15 nt, Homo sapiens
gugcauggaggcccu

SEQ ID NO: 1223136 - RNA, 18 nt, Homo sapiens
gugcaugugcgcgcgugc

SEQ ID NO: 1223137 - RNA, 11 nt, Homo sapiens
gugccaaaaau

SEQ ID NO: 1223138 - RNA, 19 nt, Homo sapiens
gugccacccaccuuugcca

SEQ ID NO: 1223139 - RNA, 21 nt, Homo sapiens
gugccacugcccgagcuggug

SEQ ID NO: 1223140 - RNA, 23 nt, Homo sapiens
gugccacugcccgagcuggugca

SEQ ID NO: 1223141 - RNA, 22 nt, Homo sapiens
gugccacuuuaauccuuccacu

SEQ ID NO: 1223142 - RNA, 20 nt, Homo sapiens
gugccagcaaugacaucuca

SEQ ID NO: 1223143 - RNA, 18 nt, Homo sapiens
gugccagcccuggcagac

SEQ ID NO: 1223144 - RNA, 15 nt, Homo sapiens
gugccaguucuuucc

SEQ ID NO: 1223145 - RNA, 14 nt, Homo sapiens
gugccauuccacuc

SEQ ID NO: 1223146 - RNA, 13 nt, Homo sapiens
gugccccaugccu

SEQ ID NO: 1223147 - RNA, 15 nt, Homo sapiens
gugcccugguggaga

SEQ ID NO: 1223148 - RNA, 14 nt, Homo sapiens
gugccuagacuguu

SEQ ID NO: 1223149 - RNA, 20 nt, Homo sapiens
gugccuccuuccaccucccu

SEQ ID NO: 1223150 - RNA, 12 nt, Homo sapiens
gugccugagaca

SEQ ID NO: 1223151 - RNA, 14 nt, Homo sapiens
gugccugagacacc

SEQ ID NO: 1223152 - RNA, 18 nt, Homo sapiens
gugccugagacacccggu

SEQ ID NO: 1223153 - RNA, 18 nt, Homo sapiens
gugccuggccuggcacac

SEQ ID NO: 1223154 - RNA, 23 nt, Homo sapiens
gugccugggggaguuuuccucua

SEQ ID NO: 1223155 - RNA, 12 nt, Homo sapiens
gugccugugauc

SEQ ID NO: 1223156 - RNA, 21 nt, Homo sapiens
gugccuucucuauggccuugc

SEQ ID NO: 1223157 - RNA, 12 nt, Homo sapiens
gugccuucugcc

SEQ ID NO: 1223158 - RNA, 16 nt, Homo sapiens
gugcgcaauugcucau

SEQ ID NO: 1223159 - RNA, 18 nt, Homo sapiens
gugcguuaaauaagcaaa

SEQ ID NO: 1223160 - RNA, 24 nt, Homo sapiens
gugcuaaccacgucugucuucaca

SEQ ID NO: 1223161 - RNA, 23 nt, Homo sapiens
gugcuaauaacagugcauauucc

SEQ ID NO: 1223162 - RNA, 21 nt, Homo sapiens
gugcuaauuuguuuuggauau

SEQ ID NO: 1223163 - RNA, 17 nt, Homo sapiens
gugcuacaacaugugag

SEQ ID NO: 1223164 - RNA, 14 nt, Homo sapiens
gugcuacaugaugc

SEQ ID NO: 1223165 - RNA, 18 nt, Homo sapiens
gugcuagcuugacacagu

SEQ ID NO: 1223166 - RNA, 17 nt, Homo sapiens
gugcucagagaccugaa

SEQ ID NO: 1223167 - RNA, 16 nt, Homo sapiens
gugcuccaagcacagg

SEQ ID NO: 1223168 - RNA, 14 nt, Homo sapiens
gugcuccaguucca

SEQ ID NO: 1223169 - RNA, 19 nt, Homo sapiens
gugcucccgaugcugcuau

SEQ ID NO: 1223170 - RNA, 15 nt, Homo sapiens
gugcuccgugccucc

SEQ ID NO: 1223171 - RNA, 15 nt, Homo sapiens
gugcuccugaaagaa

SEQ ID NO: 1223172 - RNA, 17 nt, Homo sapiens
gugcucugaucauccac

SEQ ID NO: 1223173 - RNA, 14 nt, Homo sapiens
gugcucugaugcaa

SEQ ID NO: 1223174 - RNA, 22 nt, Homo sapiens
gugcucuuguuuugucuugaaa

SEQ ID NO: 1223175 - RNA, 19 nt, Homo sapiens
gugcugacgagcagggugg

SEQ ID NO: 1223176 - RNA, 17 nt, Homo sapiens
gugcugauaacaacagg

SEQ ID NO: 1223177 - RNA, 23 nt, Homo sapiens
gugcugcagauuugauauuugca

SEQ ID NO: 1223178 - RNA, 19 nt, Homo sapiens
gugcuggaauuacaggcgu

SEQ ID NO: 1223179 - RNA, 18 nt, Homo sapiens
gugcugggauuacaggug

SEQ ID NO: 1223180 - RNA, 21 nt, Homo sapiens
gugcugggauuacagguguga

SEQ ID NO: 1223181 - RNA, 22 nt, Homo sapiens
gugcugucuugaugacugcuga

SEQ ID NO: 1223182 - RNA, 18 nt, Homo sapiens
gugcuguggccugggcaa

SEQ ID NO: 1223183 - RNA, 20 nt, Homo sapiens
gugcuuaagcagaagcauua

SEQ ID NO: 1223184 - RNA, 21 nt, Homo sapiens
gugcuuaagcagaagcauuaa

SEQ ID NO: 1223185 - RNA, 17 nt, Homo sapiens
gugcuuacacaucucag

SEQ ID NO: 1223186 - RNA, 19 nt, Homo sapiens
gugcuuauuuuguuucaau

SEQ ID NO: 1223187 - RNA, 20 nt, Homo sapiens
gugcuucgagugacugaccc

SEQ ID NO: 1223188 - RNA, 19 nt, Homo sapiens
gugcuucuggaaacuacca

SEQ ID NO: 1223189 - RNA, 14 nt, Homo sapiens
gugcuuguuuacag

SEQ ID NO: 1223190 - RNA, 22 nt, Homo sapiens
gugcuuucccagucccauuccu

SEQ ID NO: 1223191 - RNA, 15 nt, Homo sapiens
guggaacaagcacag

SEQ ID NO: 1223192 - RNA, 22 nt, Homo sapiens
guggaacuuuuauuagauaaca

SEQ ID NO: 1223193 - RNA, 16 nt, Homo sapiens
guggaaugcagggaag

SEQ ID NO: 1223194 - RNA, 23 nt, Homo sapiens
guggacccugucuucugggcaca

SEQ ID NO: 1223195 - RNA, 18 nt, Homo sapiens
guggaccucuacuuucca

SEQ ID NO: 1223196 - RNA, 21 nt, Homo sapiens
guggacuugggaacaggcugu

SEQ ID NO: 1223197 - RNA, 16 nt, Homo sapiens
guggagcugcuggugu

SEQ ID NO: 1223198 - RNA, 13 nt, Homo sapiens
guggaggcuuccu

SEQ ID NO: 1223199 - RNA, 20 nt, Homo sapiens
guggaucuugccacauuucu

SEQ ID NO: 1223200 - RNA, 19 nt, Homo sapiens
guggaugcaugugcgucac

SEQ ID NO: 1223201 - RNA, 12 nt, Homo sapiens
guggaugcugcu

SEQ ID NO: 1223202 - RNA, 20 nt, Homo sapiens
guggauuaaagugcccagca

SEQ ID NO: 1223203 - RNA, 14 nt, Homo sapiens
guggauuguuuaua

SEQ ID NO: 1223204 - RNA, 22 nt, Homo sapiens
guggcaagcugugacuucucca

SEQ ID NO: 1223205 - RNA, 16 nt, Homo sapiens
guggcaccuucaccug

SEQ ID NO: 1223206 - RNA, 21 nt, Homo sapiens
guggcagcugcuuuugucuau

SEQ ID NO: 1223207 - RNA, 18 nt, Homo sapiens
guggcccaagggugguga

SEQ ID NO: 1223208 - RNA, 22 nt, Homo sapiens
guggcccaucuuacuggaagag

SEQ ID NO: 1223209 - RNA, 19 nt, Homo sapiens
guggcccuggcucugcugu

SEQ ID NO: 1223210 - RNA, 20 nt, Homo sapiens
guggccucugcaggccuagg

SEQ ID NO: 1223211 - RNA, 22 nt, Homo sapiens
guggccuuccccuuuugccugg

SEQ ID NO: 1223212 - RNA, 22 nt, Homo sapiens
guggcgagaaauaaaguuugcu

SEQ ID NO: 1223213 - RNA, 18 nt, Homo sapiens
guggcgagaaggugggga

SEQ ID NO: 1223214 - RNA, 17 nt, Homo sapiens
guggcggcagggccagg

SEQ ID NO: 1223215 - RNA, 20 nt, Homo sapiens
guggcugccccggccuccuc

SEQ ID NO: 1223216 - RNA, 14 nt, Homo sapiens
guggcugugccacc

SEQ ID NO: 1223217 - RNA, 15 nt, Homo sapiens
guggcuucacagacc

SEQ ID NO: 1223218 - RNA, 18 nt, Homo sapiens
guggcuucccgcucagcc

SEQ ID NO: 1223219 - RNA, 21 nt, Homo sapiens
gugggauauugaauguuaaag

SEQ ID NO: 1223220 - RNA, 17 nt, Homo sapiens
gugggcaaacaggcagu

SEQ ID NO: 1223221 - RNA, 11 nt, Homo sapiens
gugggccacag

SEQ ID NO: 1223222 - RNA, 23 nt, Homo sapiens
gugggccagggcugcccugagaa

SEQ ID NO: 1223223 - RNA, 14 nt, Homo sapiens
gugggcugccccau

SEQ ID NO: 1223224 - RNA, 14 nt, Homo sapiens
gugggguacauuuc

SEQ ID NO: 1223225 - RNA, 23 nt, Homo sapiens
gugggugaaggccuggcuggaag

SEQ ID NO: 1223226 - RNA, 22 nt, Homo sapiens
gugguauccugugacauguaac

SEQ ID NO: 1223227 - RNA, 20 nt, Homo sapiens
gugguauguaauuuaugcaa

SEQ ID NO: 1223228 - RNA, 16 nt, Homo sapiens
gugguccccguuccac

SEQ ID NO: 1223229 - RNA, 22 nt, Homo sapiens
guggugcucuuugcugcacuau

SEQ ID NO: 1223230 - RNA, 23 nt, Homo sapiens
guggugggcccugaugcugccag

SEQ ID NO: 1223231 - RNA, 16 nt, Homo sapiens
gugguuaacaucucag

SEQ ID NO: 1223232 - RNA, 17 nt, Homo sapiens
gugguucagcuacuuuc

SEQ ID NO: 1223233 - RNA, 20 nt, Homo sapiens
gugguucuuaaauguuuaua

SEQ ID NO: 1223234 - RNA, 21 nt, Homo sapiens
gugguugauuuuaaugaaugc

SEQ ID NO: 1223235 - RNA, 20 nt, Homo sapiens
gugguuuauugaaugugauu

SEQ ID NO: 1223236 - RNA, 17 nt, Homo sapiens
guguaacacuugucaag

SEQ ID NO: 1223237 - RNA, 15 nt, Homo sapiens
guguaacagauauca

SEQ ID NO: 1223238 - RNA, 12 nt, Homo sapiens
guguaacauauu

SEQ ID NO: 1223239 - RNA, 14 nt, Homo sapiens
guguaauaugcaca

SEQ ID NO: 1223240 - RNA, 19 nt, Homo sapiens
guguaauggaaaccaagga

SEQ ID NO: 1223241 - RNA, 20 nt, Homo sapiens
guguaauggaaaccaaggaa

SEQ ID NO: 1223242 - RNA, 21 nt, Homo sapiens
guguaauguagcguguuuaca

SEQ ID NO: 1223243 - RNA, 14 nt, Homo sapiens
guguacaaugccuu

SEQ ID NO: 1223244 - RNA, 22 nt, Homo sapiens
guguacacggaggucucuguaa

SEQ ID NO: 1223245 - RNA, 23 nt, Homo sapiens
guguaccucaguucccucuugcu

SEQ ID NO: 1223246 - RNA, 22 nt, Homo sapiens
guguauaaaaaccaugcuggua

SEQ ID NO: 1223247 - RNA, 23 nt, Homo sapiens
guguauauaguaugaaugcagug

SEQ ID NO: 1223248 - RNA, 16 nt, Homo sapiens
guguauauauguguau

SEQ ID NO: 1223249 - RNA, 21 nt, Homo sapiens
guguauauuuguauauuacac

SEQ ID NO: 1223250 - RNA, 17 nt, Homo sapiens
guguauuaucacugucu

SEQ ID NO: 1223251 - RNA, 20 nt, Homo sapiens
guguauucuagugaaugaau

SEQ ID NO: 1223252 - RNA, 14 nt, Homo sapiens
gugucaaaagccag

SEQ ID NO: 1223253 - RNA, 20 nt, Homo sapiens
gugucaacuaaaugagauua

SEQ ID NO: 1223254 - RNA, 15 nt, Homo sapiens
gugucacuugugcuu

SEQ ID NO: 1223255 - RNA, 19 nt, Homo sapiens
gugucagagcugaaauuca

SEQ ID NO: 1223256 - RNA, 20 nt, Homo sapiens
guuuuuagauuaaacaaaca

SEQ ID NO: 1223257 - RNA, 14 nt, Homo sapiens
guuuuuagcuggug

SEQ ID NO: 1223258 - RNA, 17 nt, Homo sapiens
guuuuucccucagugaa

SEQ ID NO: 1223259 - RNA, 22 nt, Homo sapiens
guuuuucuucaacaucaauguu

SEQ ID NO: 1223260 - RNA, 22 nt, Homo sapiens
guuuuuguauuuauuaauuuga

SEQ ID NO: 1223261 - RNA, 20 nt, Homo sapiens
guuuuuucaucauaacauaa

SEQ ID NO: 1223262 - RNA, 12 nt, Homo sapiens
guuuuuuuccaa

SEQ ID NO: 1223263 - RNA, 13 nt, Homo sapiens
guuuuuuucccag

SEQ ID NO: 1223264 - RNA, 23 nt, Homo sapiens
guuuuuuuuuuccacuuagaaau

SEQ ID NO: 1223265 - RNA, 22 nt, Homo sapiens
uaaaaaaaaaauccauuuuaca

SEQ ID NO: 1223266 - RNA, 19 nt, Homo sapiens
uaaaaaaauacaugcaucu

SEQ ID NO: 1223267 - RNA, 15 nt, Homo sapiens
uaaaaaagccuuccu

SEQ ID NO: 1223268 - RNA, 20 nt, Homo sapiens
uaaaaacaguuuuccaaaua

SEQ ID NO: 1223269 - RNA, 22 nt, Homo sapiens
uaaaaacuuccuucaaucuuca

SEQ ID NO: 1223270 - RNA, 21 nt, Homo sapiens
uaaaaagacacgguugcucua

SEQ ID NO: 1223271 - RNA, 16 nt, Homo sapiens
uaaaaagauaaucuca

SEQ ID NO: 1223272 - RNA, 16 nt, Homo sapiens
uaaaaaggaacaaaua

SEQ ID NO: 1223273 - RNA, 13 nt, Homo sapiens
uaaaaaguaauaa

SEQ ID NO: 1223274 - RNA, 16 nt, Homo sapiens
uaaaaauaugcuucua

SEQ ID NO: 1223275 - RNA, 19 nt, Homo sapiens
uaaaaaucaaauaagcuaa

SEQ ID NO: 1223276 - RNA, 18 nt, Homo sapiens
uaaaaaucauaguacucu

SEQ ID NO: 1223277 - RNA, 14 nt, Homo sapiens
uaaaaaugcugcuc

SEQ ID NO: 1223278 - RNA, 19 nt, Homo sapiens
uaaaaaugcugcucucagc

SEQ ID NO: 1223279 - RNA, 17 nt, Homo sapiens
uaaaaaugucucagcaa

SEQ ID NO: 1223280 - RNA, 15 nt, Homo sapiens
uaaaaauuaaaaagu

SEQ ID NO: 1223281 - RNA, 21 nt, Homo sapiens
uaaaaauuagcaugcugcuuu

SEQ ID NO: 1223282 - RNA, 22 nt, Homo sapiens
uaaaacaaaauuugacuaauuu

SEQ ID NO: 1223283 - RNA, 11 nt, Homo sapiens
uaaaacaaaca

SEQ ID NO: 1223284 - RNA, 22 nt, Homo sapiens
uaaaacaaauccauaauuauua

SEQ ID NO: 1223285 - RNA, 12 nt, Homo sapiens
uaaaacaauucu

SEQ ID NO: 1223286 - RNA, 22 nt, Homo sapiens
uaaaacaugcugaaaacuacac

SEQ ID NO: 1223287 - RNA, 23 nt, Homo sapiens
uaaaacaugcugaaaacuacaca

SEQ ID NO: 1223288 - RNA, 13 nt, Homo sapiens
uaaaaccaaagag

SEQ ID NO: 1223289 - RNA, 18 nt, Homo sapiens
uaaaaccugucaaugaua

SEQ ID NO: 1223290 - RNA, 12 nt, Homo sapiens
uaaaaccuuuca

SEQ ID NO: 1223291 - RNA, 18 nt, Homo sapiens
uaaaacgauagcuauauu

SEQ ID NO: 1223292 - RNA, 16 nt, Homo sapiens
uaaaacgcaugugcag

SEQ ID NO: 1223293 - RNA, 18 nt, Homo sapiens
uaaaacuaaaaagcauuu

SEQ ID NO: 1223294 - RNA, 20 nt, Homo sapiens
uaaaacuagugacagcuugu

SEQ ID NO: 1223295 - RNA, 16 nt, Homo sapiens
uaaaacuauauucuca

SEQ ID NO: 1223296 - RNA, 19 nt, Homo sapiens
uaaaacugcacagugcugu

SEQ ID NO: 1223297 - RNA, 12 nt, Homo sapiens
uaaaacuguaua

SEQ ID NO: 1223298 - RNA, 18 nt, Homo sapiens
uaaaagaaaauccauuau

SEQ ID NO: 1223299 - RNA, 19 nt, Homo sapiens
uaaaagaaccgagcaauuu

SEQ ID NO: 1223300 - RNA, 22 nt, Homo sapiens
uaaaagaauaaaauugcacuuu

SEQ ID NO: 1223301 - RNA, 14 nt, Homo sapiens
uaaaagaauauuca

SEQ ID NO: 1223302 - RNA, 16 nt, Homo sapiens
uaaaagacaagcacuu

SEQ ID NO: 1223303 - RNA, 11 nt, Homo sapiens
uaaaagacagc

SEQ ID NO: 1223304 - RNA, 20 nt, Homo sapiens
uaaaagaguuaacaucccau

SEQ ID NO: 1223305 - RNA, 16 nt, Homo sapiens
uaaaagauagacauca

SEQ ID NO: 1223306 - RNA, 21 nt, Homo sapiens
uaaaagauguuuaugauguaa

SEQ ID NO: 1223307 - RNA, 22 nt, Homo sapiens
uaaaagauuuuuuuuaaucuag

SEQ ID NO: 1223308 - RNA, 20 nt, Homo sapiens
uaaaagcacaaguacuuuug

SEQ ID NO: 1223309 - RNA, 19 nt, Homo sapiens
uaaaagcagcaucugcuaa

SEQ ID NO: 1223310 - RNA, 20 nt, Homo sapiens
uaaaagccuuauucuaaggu

SEQ ID NO: 1223311 - RNA, 19 nt, Homo sapiens
uaaaaggcaaauguguaca

SEQ ID NO: 1223312 - RNA, 15 nt, Homo sapiens
uaaaaggggcccaag

SEQ ID NO: 1223313 - RNA, 20 nt, Homo sapiens
uaaaagguauuuugaauacc

SEQ ID NO: 1223314 - RNA, 18 nt, Homo sapiens
uaaaagguugcauacuga

SEQ ID NO: 1223315 - RNA, 17 nt, Homo sapiens
uaaaaguauuugcuuaa

SEQ ID NO: 1223316 - RNA, 13 nt, Homo sapiens
uaaaagucuacca

SEQ ID NO: 1223317 - RNA, 16 nt, Homo sapiens
uaaaaguggauuuaga

SEQ ID NO: 1223318 - RNA, 13 nt, Homo sapiens
uaaaaguggcauu

SEQ ID NO: 1223319 - RNA, 23 nt, Homo sapiens
uaaaaguucauaacagugccauu

SEQ ID NO: 1223320 - RNA, 18 nt, Homo sapiens
uaaaaguuucaaugugau

SEQ ID NO: 1223321 - RNA, 17 nt, Homo sapiens
uaaaauaaaaauucuga

SEQ ID NO: 1223322 - RNA, 17 nt, Homo sapiens
uaaaauaaaugcaauug

SEQ ID NO: 1223323 - RNA, 16 nt, Homo sapiens
uaaaauaagaauugaa

SEQ ID NO: 1223324 - RNA, 14 nt, Homo sapiens
uaaaauaauaacaa

SEQ ID NO: 1223325 - RNA, 19 nt, Homo sapiens
uaaaauaauuuucauucau

SEQ ID NO: 1223326 - RNA, 17 nt, Homo sapiens
uaaaauacaaacccaug

SEQ ID NO: 1223327 - RNA, 21 nt, Homo sapiens
uaaaauacuuuuacucugccu

SEQ ID NO: 1223328 - RNA, 19 nt, Homo sapiens
uaaaauauuuaugagaaag

SEQ ID NO: 1223329 - RNA, 21 nt, Homo sapiens
uaaaaugauuuuaucugugaa

SEQ ID NO: 1223330 - RNA, 20 nt, Homo sapiens
uaaaaugggaagacugagcu

SEQ ID NO: 1223331 - RNA, 14 nt, Homo sapiens
uaaaauguauucaa

SEQ ID NO: 1223332 - RNA, 20 nt, Homo sapiens
uaaaaugugaggaagaacua

SEQ ID NO: 1223333 - RNA, 23 nt, Homo sapiens
uaaaaugugaggaagaacuacag

SEQ ID NO: 1223334 - RNA, 21 nt, Homo sapiens
uaaaaugugauguucuaaggc

SEQ ID NO: 1223335 - RNA, 22 nt, Homo sapiens
uaaaaugugauguucuaaggcu

SEQ ID NO: 1223336 - RNA, 18 nt, Homo sapiens
uaaaauguguacagugaa

SEQ ID NO: 1223337 - RNA, 20 nt, Homo sapiens
uaaaauuacauugagguucc

SEQ ID NO: 1223338 - RNA, 15 nt, Homo sapiens
uaaaauuagcuugag

SEQ ID NO: 1223339 - RNA, 20 nt, Homo sapiens
uaaaauuaucaauaucuaau

SEQ ID NO: 1223340 - RNA, 12 nt, Homo sapiens
uaaaauucacua

SEQ ID NO: 1223341 - RNA, 20 nt, Homo sapiens
uaaaauucuauuauacuaca

SEQ ID NO: 1223342 - RNA, 21 nt, Homo sapiens
uaaaauugauuuuucucuuca

SEQ ID NO: 1223343 - RNA, 20 nt, Homo sapiens
uaaaauugggcuugugauuu

SEQ ID NO: 1223344 - RNA, 21 nt, Homo sapiens
uaaaauugggcuugugauuuc

SEQ ID NO: 1223345 - RNA, 12 nt, Homo sapiens
uaaaauugugag

SEQ ID NO: 1223346 - RNA, 13 nt, Homo sapiens
uaaacaaaaagcc

SEQ ID NO: 1223347 - RNA, 14 nt, Homo sapiens
uaaacaaauaacaa

SEQ ID NO: 1223348 - RNA, 15 nt, Homo sapiens
uaaacaaauucauau

SEQ ID NO: 1223349 - RNA, 20 nt, Homo sapiens
uaaacaagggucaauucaaa

SEQ ID NO: 1223350 - RNA, 20 nt, Homo sapiens
uaaacacaaagcuguugaaa

SEQ ID NO: 1223351 - RNA, 20 nt, Homo sapiens
uaaacacacagaucugcauc

SEQ ID NO: 1223352 - RNA, 16 nt, Homo sapiens
uaaacacaugccuuaa

SEQ ID NO: 1223353 - RNA, 15 nt, Homo sapiens
uaaacaccuccucau

SEQ ID NO: 1223354 - RNA, 18 nt, Homo sapiens
uaaacacuuguagagcag

SEQ ID NO: 1223355 - RNA, 18 nt, Homo sapiens
uaaacagauggcacuuug

SEQ ID NO: 1223356 - RNA, 17 nt, Homo sapiens
uaaacagcuucaugccu

SEQ ID NO: 1223357 - RNA, 20 nt, Homo sapiens
uaaacagcuucaugccuuug

SEQ ID NO: 1223358 - RNA, 20 nt, Homo sapiens
uaaacagugagccugaauuu

SEQ ID NO: 1223359 - RNA, 17 nt, Homo sapiens
uaaacaguggaauauaa

SEQ ID NO: 1223360 - RNA, 16 nt, Homo sapiens
uaaacauuucauuucc

SEQ ID NO: 1223361 - RNA, 14 nt, Homo sapiens
uaaaccaacucuaa

SEQ ID NO: 1223362 - RNA, 21 nt, Homo sapiens
uaaaccaauuauaacuuauua

SEQ ID NO: 1223363 - RNA, 19 nt, Homo sapiens
uaaaccguuuuuaacacau

SEQ ID NO: 1223364 - RNA, 13 nt, Homo sapiens
uaaaccuccgcca

SEQ ID NO: 1223365 - RNA, 22 nt, Homo sapiens
uaaacggcucagacaggcagau

SEQ ID NO: 1223366 - RNA, 15 nt, Homo sapiens
uaaacgggaacaugc

SEQ ID NO: 1223367 - RNA, 18 nt, Homo sapiens
uaaacuaucuguauuuau

SEQ ID NO: 1223368 - RNA, 17 nt, Homo sapiens
uaaacuaucuuggugaa

SEQ ID NO: 1223369 - RNA, 14 nt, Homo sapiens
uaaacucaagacaa

SEQ ID NO: 1223370 - RNA, 21 nt, Homo sapiens
uaaacucagggacagagccau

SEQ ID NO: 1223371 - RNA, 20 nt, Homo sapiens
uaaacucauuuaacuaaagu

SEQ ID NO: 1223372 - RNA, 14 nt, Homo sapiens
uaaacuccuacuaa

SEQ ID NO: 1223373 - RNA, 23 nt, Homo sapiens
uaaacucuguccacgauucacuc

SEQ ID NO: 1223374 - RNA, 15 nt, Homo sapiens
uaaacugacuuuauc

SEQ ID NO: 1223375 - RNA, 17 nt, Homo sapiens
uaaacuguuagcacugu

SEQ ID NO: 1223376 - RNA, 21 nt, Homo sapiens
uaaacuguuagcacuguugau

SEQ ID NO: 1223377 - RNA, 22 nt, Homo sapiens
uaaacuuaagggaaaaguucuc

SEQ ID NO: 1223378 - RNA, 23 nt, Homo sapiens
uaaacuucaccuacauuaucuca

SEQ ID NO: 1223379 - RNA, 14 nt, Homo sapiens
uaaacuucagggau

SEQ ID NO: 1223380 - RNA, 22 nt, Homo sapiens
uaaacuugaguuggaguacuau

SEQ ID NO: 1223381 - RNA, 21 nt, Homo sapiens
uacccucuaaaaaagaacuuu

SEQ ID NO: 1223382 - RNA, 14 nt, Homo sapiens
uacccucugcagaa

SEQ ID NO: 1223383 - RNA, 13 nt, Homo sapiens
uacccugaucuga

SEQ ID NO: 1223384 - RNA, 23 nt, Homo sapiens
uacccuugugagagcccauuccc

SEQ ID NO: 1223385 - RNA, 15 nt, Homo sapiens
uaccgcccucggggc

SEQ ID NO: 1223386 - RNA, 13 nt, Homo sapiens
uaccuaaggacaa

SEQ ID NO: 1223387 - RNA, 21 nt, Homo sapiens
uaccuaaggacaagacacuga

SEQ ID NO: 1223388 - RNA, 15 nt, Homo sapiens
uaccuaauuguggau

SEQ ID NO: 1223389 - RNA, 15 nt, Homo sapiens
uaccuacaucaguca

SEQ ID NO: 1223390 - RNA, 17 nt, Homo sapiens
uaccuaccacagugucu

SEQ ID NO: 1223391 - RNA, 13 nt, Homo sapiens
uaccuacugcuga

SEQ ID NO: 1223392 - RNA, 21 nt, Homo sapiens
uaccuagcaaagcuccugccu

SEQ ID NO: 1223393 - RNA, 14 nt, Homo sapiens
uaccuagcauuuca

SEQ ID NO: 1223394 - RNA, 19 nt, Homo sapiens
uaccuagcuggcucuguga

SEQ ID NO: 1223395 - RNA, 15 nt, Homo sapiens
uaccucaagacucac

SEQ ID NO: 1223396 - RNA, 15 nt, Homo sapiens
uaccucaauguuuga

SEQ ID NO: 1223397 - RNA, 23 nt, Homo sapiens
uaccucacagagugcauugugag

SEQ ID NO: 1223398 - RNA, 17 nt, Homo sapiens
uaccucaucccaugaga

SEQ ID NO: 1223399 - RNA, 12 nt, Homo sapiens
uaccucugagaa

SEQ ID NO: 1223400 - RNA, 21 nt, Homo sapiens
uaccucugagaagacacaagg

SEQ ID NO: 1223401 - RNA, 12 nt, Homo sapiens
uaccugccucag

SEQ ID NO: 1223402 - RNA, 14 nt, Homo sapiens
uaccugccucagcc

SEQ ID NO: 1223403 - RNA, 20 nt, Homo sapiens
uaccugcuguggaugcuuca

SEQ ID NO: 1223404 - RNA, 11 nt, Homo sapiens
uaccugggaaa

SEQ ID NO: 1223405 - RNA, 11 nt, Homo sapiens
uaccugucaau

SEQ ID NO: 1223406 - RNA, 18 nt, Homo sapiens
uaccuuggcugauguugc

SEQ ID NO: 1223407 - RNA, 23 nt, Homo sapiens
uaccuuuguaacggcucuuagca

SEQ ID NO: 1223408 - RNA, 16 nt, Homo sapiens
uaccuuuuauguagca

SEQ ID NO: 1223409 - RNA, 12 nt, Homo sapiens
uacgaagacaaa

SEQ ID NO: 1223410 - RNA, 12 nt, Homo sapiens
uacgugccacuc

SEQ ID NO: 1223411 - RNA, 19 nt, Homo sapiens
uacguguuuugaauugcaa

SEQ ID NO: 1223412 - RNA, 15 nt, Homo sapiens
uacuaaaccaccuca

SEQ ID NO: 1223413 - RNA, 14 nt, Homo sapiens
uacuaaaccucaca

SEQ ID NO: 1223414 - RNA, 19 nt, Homo sapiens
uacuaaacuucaccuacau

SEQ ID NO: 1223415 - RNA, 15 nt, Homo sapiens
uacuaaagugccuac

SEQ ID NO: 1223416 - RNA, 21 nt, Homo sapiens
uacuaaauuacaaaugcaauu

SEQ ID NO: 1223417 - RNA, 18 nt, Homo sapiens
uacuaacauuuucauuga

SEQ ID NO: 1223418 - RNA, 16 nt, Homo sapiens
uacuaaggaaucuuuc

SEQ ID NO: 1223419 - RNA, 20 nt, Homo sapiens
uacuaagggaacaauccaug

SEQ ID NO: 1223420 - RNA, 20 nt, Homo sapiens
uacuaauaugccuagcacaa

SEQ ID NO: 1223421 - RNA, 14 nt, Homo sapiens
uacuaaucauguga

SEQ ID NO: 1223422 - RNA, 21 nt, Homo sapiens
uacuaauuccacaccuuuuau

SEQ ID NO: 1223423 - RNA, 20 nt, Homo sapiens
uacuaauucuuacacugccu

SEQ ID NO: 1223424 - RNA, 19 nt, Homo sapiens
uacuacaaacuucaaagag

SEQ ID NO: 1223425 - RNA, 14 nt, Homo sapiens
uacuacaugcuuuu

SEQ ID NO: 1223426 - RNA, 19 nt, Homo sapiens
uacuaggagaggggggcca

SEQ ID NO: 1223427 - RNA, 18 nt, Homo sapiens
uacuaguucagacacuuu

SEQ ID NO: 1223428 - RNA, 14 nt, Homo sapiens
uacuaguuuucaau

SEQ ID NO: 1223429 - RNA, 19 nt, Homo sapiens
uacuaucacugaacaaacu

SEQ ID NO: 1223430 - RNA, 15 nt, Homo sapiens
uacuaucauaauuca

SEQ ID NO: 1223431 - RNA, 15 nt, Homo sapiens
uacuauccaaucugu

SEQ ID NO: 1223432 - RNA, 14 nt, Homo sapiens
uacuauguacugcc

SEQ ID NO: 1223433 - RNA, 14 nt, Homo sapiens
uacuauucacugau

SEQ ID NO: 1223434 - RNA, 23 nt, Homo sapiens
uacucaaggaauuugcauuuagu

SEQ ID NO: 1223435 - RNA, 13 nt, Homo sapiens
uacucaaguacca

SEQ ID NO: 1223436 - RNA, 19 nt, Homo sapiens
uacucaaguaccaccaagg

SEQ ID NO: 1223437 - RNA, 13 nt, Homo sapiens
uacucaauggagu

SEQ ID NO: 1223438 - RNA, 10 nt, Homo sapiens
uacucagcuu

SEQ ID NO: 1223439 - RNA, 20 nt, Homo sapiens
uacucaggaggcugaggcag

SEQ ID NO: 1223440 - RNA, 23 nt, Homo sapiens
uacucagugcauagcgaagacca

SEQ ID NO: 1223441 - RNA, 12 nt, Homo sapiens
uacucaucagag

SEQ ID NO: 1223442 - RNA, 17 nt, Homo sapiens
uacucauuuuauucacu

SEQ ID NO: 1223443 - RNA, 18 nt, Homo sapiens
uacuccacugcccuggca

SEQ ID NO: 1223444 - RNA, 18 nt, Homo sapiens
uacuccaucauggcugcu

SEQ ID NO: 1223445 - RNA, 22 nt, Homo sapiens
uacuccgcggagugaucaugga

SEQ ID NO: 1223446 - RNA, 13 nt, Homo sapiens
uacucgucuuccu

SEQ ID NO: 1223447 - RNA, 20 nt, Homo sapiens
uacucuaucagagaaaaaca

SEQ ID NO: 1223448 - RNA, 22 nt, Homo sapiens
uacucucaaaaucuuuguauaa

SEQ ID NO: 1223449 - RNA, 21 nt, Homo sapiens
uacucucugccugguggucag

SEQ ID NO: 1223450 - RNA, 16 nt, Homo sapiens
uacucuggggugcugc

SEQ ID NO: 1223451 - RNA, 14 nt, Homo sapiens
uacucuguccaggc

SEQ ID NO: 1223452 - RNA, 16 nt, Homo sapiens
uacucuugaauacaag

SEQ ID NO: 1223453 - RNA, 17 nt, Homo sapiens
uacucuugucauuuuua

SEQ ID NO: 1223454 - RNA, 14 nt, Homo sapiens
uacugaaaauccaa

SEQ ID NO: 1223455 - RNA, 20 nt, Homo sapiens
uacugaagccaaaugaaacu

SEQ ID NO: 1223456 - RNA, 18 nt, Homo sapiens
uacugaaggaaaaacaca

SEQ ID NO: 1223457 - RNA, 14 nt, Homo sapiens
uacugaauugucag

SEQ ID NO: 1223458 - RNA, 22 nt, Homo sapiens
uacugacuuucugauuacuguc

SEQ ID NO: 1223459 - RNA, 18 nt, Homo sapiens
uacugaguagggggagca

SEQ ID NO: 1223460 - RNA, 13 nt, Homo sapiens
uacugaucuuacu

SEQ ID NO: 1223461 - RNA, 17 nt, Homo sapiens
uacugauuuuugugauu

SEQ ID NO: 1223462 - RNA, 11 nt, Homo sapiens
uacugccuuaa

SEQ ID NO: 1223463 - RNA, 19 nt, Homo sapiens
uacugcugagucagacugu

SEQ ID NO: 1223464 - RNA, 16 nt, Homo sapiens
uacugcuuacuguugc

SEQ ID NO: 1223465 - RNA, 15 nt, Homo sapiens
uacuggccaguguca

SEQ ID NO: 1223466 - RNA, 18 nt, Homo sapiens
uacugggaaucaagacaa

SEQ ID NO: 1223467 - RNA, 15 nt, Homo sapiens
uacugggacaaccuc

SEQ ID NO: 1223468 - RNA, 18 nt, Homo sapiens
uacuggucuuguggaauu

SEQ ID NO: 1223469 - RNA, 19 nt, Homo sapiens
uacuguaauaauaccucaa

SEQ ID NO: 1223470 - RNA, 17 nt, Homo sapiens
uacuguacuaauucuua

SEQ ID NO: 1223471 - RNA, 11 nt, Homo sapiens
uacuguacuuu

SEQ ID NO: 1223472 - RNA, 15 nt, Homo sapiens
uacuguggugaucug

SEQ ID NO: 1223473 - RNA, 18 nt, Homo sapiens
uacuguucuaaagcucug

SEQ ID NO: 1223474 - RNA, 16 nt, Homo sapiens
uacuguucuugcugcu

SEQ ID NO: 1223475 - RNA, 12 nt, Homo sapiens
uacuguuuccau

SEQ ID NO: 1223476 - RNA, 15 nt, Homo sapiens
uacuuaaacuuccac

SEQ ID NO: 1223477 - RNA, 14 nt, Homo sapiens
uacuuaaugcauau

SEQ ID NO: 1223478 - RNA, 17 nt, Homo sapiens
uacuuagcaugcacaaa

SEQ ID NO: 1223479 - RNA, 18 nt, Homo sapiens
uacuuagguuauuuugcu

SEQ ID NO: 1223480 - RNA, 13 nt, Homo sapiens
uacuuagugguau

SEQ ID NO: 1223481 - RNA, 15 nt, Homo sapiens
uacuuauguugcaca

SEQ ID NO: 1223482 - RNA, 21 nt, Homo sapiens
uacuuauguugcacaaugaga

SEQ ID NO: 1223483 - RNA, 17 nt, Homo sapiens
uacuucaaaagccauaa

SEQ ID NO: 1223484 - RNA, 14 nt, Homo sapiens
uacuucacuucaaa

SEQ ID NO: 1223485 - RNA, 15 nt, Homo sapiens
uacuucaguaauaau

SEQ ID NO: 1223486 - RNA, 22 nt, Homo sapiens
uacuuccaauuuauaaugaaua

SEQ ID NO: 1223487 - RNA, 15 nt, Homo sapiens
uacuuccuacuguag

SEQ ID NO: 1223488 - RNA, 18 nt, Homo sapiens
uacuucuauucagcauug

SEQ ID NO: 1223489 - RNA, 20 nt, Homo sapiens
uacuugagaggcugaggcaa

SEQ ID NO: 1223490 - RNA, 14 nt, Homo sapiens
uacuugccaagaaa

SEQ ID NO: 1223491 - RNA, 16 nt, Homo sapiens
uacuuggaacuaggcu

SEQ ID NO: 1223492 - RNA, 20 nt, Homo sapiens
uacuugugaaacacagcugu

SEQ ID NO: 1223493 - RNA, 19 nt, Homo sapiens
uacuuguggugugaccaug

SEQ ID NO: 1223494 - RNA, 17 nt, Homo sapiens
uacuuguuuucacuuua

SEQ ID NO: 1223495 - RNA, 17 nt, Homo sapiens
uacuuuaaaaugccaau

SEQ ID NO: 1223496 - RNA, 15 nt, Homo sapiens
uacuuuaauguauaa

SEQ ID NO: 1223497 - RNA, 12 nt, Homo sapiens
uacuuuaccucc

SEQ ID NO: 1223498 - RNA, 15 nt, Homo sapiens
uacuuuaccuccuau

SEQ ID NO: 1223499 - RNA, 21 nt, Homo sapiens
uacuuucuuauaaauuuggau

SEQ ID NO: 1223500 - RNA, 17 nt, Homo sapiens
uacuuugguagcuggga

SEQ ID NO: 1223501 - RNA, 12 nt, Homo sapiens
uacuuugugcau

SEQ ID NO: 1223502 - RNA, 13 nt, Homo sapiens
uacuuuguugcua

SEQ ID NO: 1223503 - RNA, 16 nt, Homo sapiens
uacuuuuacucugccu

SEQ ID NO: 1223504 - RNA, 14 nt, Homo sapiens
uacuuuuauuugca

SEQ ID NO: 1223505 - RNA, 17 nt, Homo sapiens
uacuuuucuuuccucag

SEQ ID NO: 1223506 - RNA, 17 nt, Homo sapiens
uacuuuugauccugggg

SEQ ID NO: 1223507 - RNA, 16 nt, Homo sapiens
uacuuuuuuacacuga

SEQ ID NO: 1223508 - RNA, 22 nt, Homo sapiens
uacuuuuuucuuauuuaacuua

SEQ ID NO: 1223509 - RNA, 12 nt, Homo sapiens
uaucaacuuuag

SEQ ID NO: 1223510 - RNA, 21 nt, Homo sapiens
uaucaagccaguacgugcuaa

SEQ ID NO: 1223511 - RNA, 15 nt, Homo sapiens
uaucaagucauggca

SEQ ID NO: 1223512 - RNA, 18 nt, Homo sapiens
uaucacagugaaugcacu

SEQ ID NO: 1223513 - RNA, 21 nt, Homo sapiens
uaucacauuuaccauaauuua

SEQ ID NO: 1223514 - RNA, 15 nt, Homo sapiens
uaucaccucauggcc

SEQ ID NO: 1223515 - RNA, 15 nt, Homo sapiens
uaucaccuuccaaac

SEQ ID NO: 1223516 - RNA, 15 nt, Homo sapiens
uaucagaauucucag

SEQ ID NO: 1223517 - RNA, 14 nt, Homo sapiens
uaucagucauaacu

SEQ ID NO: 1223518 - RNA, 18 nt, Homo sapiens
uaucagugcucugcuuuu

SEQ ID NO: 1223519 - RNA, 19 nt, Homo sapiens
uaucaguguuuuaaauucu

SEQ ID NO: 1223520 - RNA, 21 nt, Homo sapiens
uaucaguugagcuucauauac

SEQ ID NO: 1223521 - RNA, 19 nt, Homo sapiens
uaucauacccuuuauucuc

SEQ ID NO: 1223522 - RNA, 15 nt, Homo sapiens
uaucaugaagcacau

SEQ ID NO: 1223523 - RNA, 15 nt, Homo sapiens
uaucaugaugugcaa

SEQ ID NO: 1223524 - RNA, 17 nt, Homo sapiens
uaucauguauggugaua

SEQ ID NO: 1223525 - RNA, 14 nt, Homo sapiens
uaucauucacccaa

SEQ ID NO: 1223526 - RNA, 20 nt, Homo sapiens
uaucauuggaacaacugaua

SEQ ID NO: 1223527 - RNA, 19 nt, Homo sapiens
uaucauuuauccuuacauu

SEQ ID NO: 1223528 - RNA, 15 nt, Homo sapiens
uauccaaagacugua

SEQ ID NO: 1223529 - RNA, 17 nt, Homo sapiens
uauccaaagacuguacu

SEQ ID NO: 1223530 - RNA, 16 nt, Homo sapiens
uauccaagaccugaaa

SEQ ID NO: 1223531 - RNA, 19 nt, Homo sapiens
uauccaaucugugaugaca

SEQ ID NO: 1223532 - RNA, 22 nt, Homo sapiens
uauccacaaaugacugcaaaag

SEQ ID NO: 1223533 - RNA, 17 nt, Homo sapiens
uauccacaacuuuucaa

SEQ ID NO: 1223534 - RNA, 13 nt, Homo sapiens
uauccaccaccuc

SEQ ID NO: 1223535 - RNA, 22 nt, Homo sapiens
uauccauauuuuacugaucucu

SEQ ID NO: 1223536 - RNA, 13 nt, Homo sapiens
uauccaugcaccu

SEQ ID NO: 1223537 - RNA, 16 nt, Homo sapiens
uauccccccaaaugga

SEQ ID NO: 1223538 - RNA, 20 nt, Homo sapiens
uauccgaacuuuaauuucag

SEQ ID NO: 1223539 - RNA, 13 nt, Homo sapiens
uauccgacucuaa

SEQ ID NO: 1223540 - RNA, 17 nt, Homo sapiens
uauccuagucauucuuc

SEQ ID NO: 1223541 - RNA, 14 nt, Homo sapiens
uauccuuagcucac

SEQ ID NO: 1223542 - RNA, 21 nt, Homo sapiens
uauccuugucugaauguauuu

SEQ ID NO: 1223543 - RNA, 22 nt, Homo sapiens
uaucgggagaggggauucacaa

SEQ ID NO: 1223544 - RNA, 23 nt, Homo sapiens
uaucuaauauguaacaagccacc

SEQ ID NO: 1223545 - RNA, 15 nt, Homo sapiens
uaucuacauaaggau

SEQ ID NO: 1223546 - RNA, 12 nt, Homo sapiens
uaucuaccccag

SEQ ID NO: 1223547 - RNA, 19 nt, Homo sapiens
uaucuauuaucucaauuua

SEQ ID NO: 1223548 - RNA, 22 nt, Homo sapiens
uaucucaggggccaacuaggca

SEQ ID NO: 1223549 - RNA, 20 nt, Homo sapiens
uaucucauacugucugggau

SEQ ID NO: 1223550 - RNA, 21 nt, Homo sapiens
uaucucugaagcauguuucau

SEQ ID NO: 1223551 - RNA, 14 nt, Homo sapiens
uaucucuguuuccu

SEQ ID NO: 1223552 - RNA, 21 nt, Homo sapiens
uaucugaguugccaagacaaa

SEQ ID NO: 1223553 - RNA, 14 nt, Homo sapiens
uaucugccauguga

SEQ ID NO: 1223554 - RNA, 11 nt, Homo sapiens
uaucugcuaug

SEQ ID NO: 1223555 - RNA, 21 nt, Homo sapiens
uaucugcucuuaggugcuucu

SEQ ID NO: 1223556 - RNA, 20 nt, Homo sapiens
uaucuggggaaaucaaaaca

SEQ ID NO: 1223557 - RNA, 18 nt, Homo sapiens
uaucuuauauacuuauca

SEQ ID NO: 1223558 - RNA, 18 nt, Homo sapiens
uaucuuaugcuauuauuc

SEQ ID NO: 1223559 - RNA, 20 nt, Homo sapiens
uaucuucuuuugaacaaaug

SEQ ID NO: 1223560 - RNA, 19 nt, Homo sapiens
uaucuugcaccccaaagcu

SEQ ID NO: 1223561 - RNA, 16 nt, Homo sapiens
uaucuugcagcuguaa

SEQ ID NO: 1223562 - RNA, 19 nt, Homo sapiens
uaugaaaauacaacuuaaa

SEQ ID NO: 1223563 - RNA, 12 nt, Homo sapiens
uaugaaacugca

SEQ ID NO: 1223564 - RNA, 13 nt, Homo sapiens
uaugaaaugaccu

SEQ ID NO: 1223565 - RNA, 16 nt, Homo sapiens
uaugaacagaaaugca

SEQ ID NO: 1223566 - RNA, 19 nt, Homo sapiens
uaugaagcccacccagaaa

SEQ ID NO: 1223567 - RNA, 21 nt, Homo sapiens
uaugaaggauuacucuccaua

SEQ ID NO: 1223568 - RNA, 13 nt, Homo sapiens
uaugaauaucauu

SEQ ID NO: 1223569 - RNA, 17 nt, Homo sapiens
uaugaaucacaguauug

SEQ ID NO: 1223570 - RNA, 13 nt, Homo sapiens
uaugaccacuggg

SEQ ID NO: 1223571 - RNA, 20 nt, Homo sapiens
uaugaccauauuuacucuuu

SEQ ID NO: 1223572 - RNA, 19 nt, Homo sapiens
uaugaccauuugacuguuc

SEQ ID NO: 1223573 - RNA, 16 nt, Homo sapiens
uaugacgcaaagauca

SEQ ID NO: 1223574 - RNA, 22 nt, Homo sapiens
uaugacuaaagagagaauguag

SEQ ID NO: 1223575 - RNA, 13 nt, Homo sapiens
uaugacugauuac

SEQ ID NO: 1223576 - RNA, 17 nt, Homo sapiens
uaugacuguaucuugau

SEQ ID NO: 1223577 - RNA, 19 nt, Homo sapiens
uaugacuguaucuugauau

SEQ ID NO: 1223578 - RNA, 21 nt, Homo sapiens
uaugagaaaccuauauuucaa

SEQ ID NO: 1223579 - RNA, 23 nt, Homo sapiens
uaugagacguuuuuggaagagua

SEQ ID NO: 1223580 - RNA, 22 nt, Homo sapiens
uaugagaugguuaaaaaggcca

SEQ ID NO: 1223581 - RNA, 18 nt, Homo sapiens
uaugagccaggcaucaua

SEQ ID NO: 1223582 - RNA, 20 nt, Homo sapiens
uaugaguaauacaucaaaga

SEQ ID NO: 1223583 - RNA, 23 nt, Homo sapiens
uaugaguaucuguauguauauau

SEQ ID NO: 1223584 - RNA, 16 nt, Homo sapiens
uaugagucaaugugca

SEQ ID NO: 1223585 - RNA, 19 nt, Homo sapiens
uaugaguggcuucugggag

SEQ ID NO: 1223586 - RNA, 17 nt, Homo sapiens
uaugauaaaacacugcc

SEQ ID NO: 1223587 - RNA, 19 nt, Homo sapiens
uaugauaaaacacugcccu

SEQ ID NO: 1223588 - RNA, 23 nt, Homo sapiens
uaugauaaauauaacaucuauga

SEQ ID NO: 1223589 - RNA, 17 nt, Homo sapiens
uaugaucacggcucacu

SEQ ID NO: 1223590 - RNA, 12 nt, Homo sapiens
uaugaucuuggc

SEQ ID NO: 1223591 - RNA, 20 nt, Homo sapiens
uaugaugcuaugguuugcca

SEQ ID NO: 1223592 - RNA, 17 nt, Homo sapiens
uaugauggucugcauua

SEQ ID NO: 1223593 - RNA, 18 nt, Homo sapiens
uaugauguguugugauag

SEQ ID NO: 1223594 - RNA, 18 nt, Homo sapiens
uaugauuuaagacuauga

SEQ ID NO: 1223595 - RNA, 17 nt, Homo sapiens
uaugcaaaccaggauuu

SEQ ID NO: 1223596 - RNA, 21 nt, Homo sapiens
uaugcaaaccucaucuuucuc

SEQ ID NO: 1223597 - RNA, 14 nt, Homo sapiens
uaugcaagcagcuu

SEQ ID NO: 1223598 - RNA, 21 nt, Homo sapiens
uaugcaagccuugcuagacag

SEQ ID NO: 1223599 - RNA, 12 nt, Homo sapiens
uaugcaaucuga

SEQ ID NO: 1223600 - RNA, 16 nt, Homo sapiens
uaugcaauuagguuuu

SEQ ID NO: 1223601 - RNA, 13 nt, Homo sapiens
uaugcacaccucc

SEQ ID NO: 1223602 - RNA, 14 nt, Homo sapiens
uaugcacauucacg

SEQ ID NO: 1223603 - RNA, 14 nt, Homo sapiens
uaugcaguaugcuu

SEQ ID NO: 1223604 - RNA, 17 nt, Homo sapiens
uaugcaguaugcuuaau

SEQ ID NO: 1223605 - RNA, 17 nt, Homo sapiens
uaugcauucacauuuag

SEQ ID NO: 1223606 - RNA, 21 nt, Homo sapiens
uaugccaccccaugugccuuu

SEQ ID NO: 1223607 - RNA, 13 nt, Homo sapiens
uaugcccucaagu

SEQ ID NO: 1223608 - RNA, 15 nt, Homo sapiens
uaugccucuguauuu

SEQ ID NO: 1223609 - RNA, 19 nt, Homo sapiens
uaugcucauugaacuuuaa

SEQ ID NO: 1223610 - RNA, 21 nt, Homo sapiens
uaugcucucgcaccuuuccaa

SEQ ID NO: 1223611 - RNA, 20 nt, Homo sapiens
uaugcugacagcucuucaca

SEQ ID NO: 1223612 - RNA, 16 nt, Homo sapiens
uaugcugcucauccaa

SEQ ID NO: 1223613 - RNA, 17 nt, Homo sapiens
uaugcuggacugcauuc

SEQ ID NO: 1223614 - RNA, 16 nt, Homo sapiens
uaugcuuacugauaua

SEQ ID NO: 1223615 - RNA, 13 nt, Homo sapiens
uauggaauaucau

SEQ ID NO: 1223616 - RNA, 16 nt, Homo sapiens
uauggagaauugcuga

SEQ ID NO: 1223617 - RNA, 13 nt, Homo sapiens
uauggcuagacag

SEQ ID NO: 1223618 - RNA, 14 nt, Homo sapiens
uauggcuccuccau

SEQ ID NO: 1223619 - RNA, 21 nt, Homo sapiens
uauggcuuucaaagcuaaaau

SEQ ID NO: 1223620 - RNA, 19 nt, Homo sapiens
uauggcuuuuaguacugaa

SEQ ID NO: 1223621 - RNA, 15 nt, Homo sapiens
uaugggaaagacaug

SEQ ID NO: 1223622 - RNA, 20 nt, Homo sapiens
uaugguuauuuaugcacugu

SEQ ID NO: 1223623 - RNA, 21 nt, Homo sapiens
uaugguucaagauuguugaua

SEQ ID NO: 1223624 - RNA, 18 nt, Homo sapiens
uauguaaaccacauugua

SEQ ID NO: 1223625 - RNA, 16 nt, Homo sapiens
uauguaaguacuucca

SEQ ID NO: 1223626 - RNA, 19 nt, Homo sapiens
uauguaccauguacaugaa

SEQ ID NO: 1223627 - RNA, 16 nt, Homo sapiens
uauguacuaagcagua

SEQ ID NO: 1223628 - RNA, 21 nt, Homo sapiens
uauguacugccuuagugcuga

SEQ ID NO: 1223629 - RNA, 16 nt, Homo sapiens
uauguacuucagugca

SEQ ID NO: 1223630 - RNA, 16 nt, Homo sapiens
uauguacuugauacug

SEQ ID NO: 1223631 - RNA, 16 nt, Homo sapiens
uauguagaugugcauu

SEQ ID NO: 1223632 - RNA, 13 nt, Homo sapiens
uauguagcacaua

SEQ ID NO: 1223633 - RNA, 17 nt, Homo sapiens
uauguauaucauucuac

SEQ ID NO: 1223634 - RNA, 14 nt, Homo sapiens
uaugucuuggacac

SEQ ID NO: 1223635 - RNA, 22 nt, Homo sapiens
ucugcacggugggagaccugcu

SEQ ID NO: 1223636 - RNA, 23 nt, Homo sapiens
ucugcacggugggagaccugcug

SEQ ID NO: 1223637 - RNA, 16 nt, Homo sapiens
ucugcagaacauauca

SEQ ID NO: 1223638 - RNA, 15 nt, Homo sapiens
ucugcagacugcuag

SEQ ID NO: 1223639 - RNA, 20 nt, Homo sapiens
ucugcagcacucuuaucuac

SEQ ID NO: 1223640 - RNA, 14 nt, Homo sapiens
ucugcaguuuaaca

SEQ ID NO: 1223641 - RNA, 12 nt, Homo sapiens
ucugcaucccag

SEQ ID NO: 1223642 - RNA, 22 nt, Homo sapiens
ucugcauggaacagcauuaccc

SEQ ID NO: 1223643 - RNA, 19 nt, Homo sapiens
ucugcauguuacauaagau

SEQ ID NO: 1223644 - RNA, 21 nt, Homo sapiens
ucugcauuaucugaggucaca

SEQ ID NO: 1223645 - RNA, 19 nt, Homo sapiens
ucugcauuuagcacaaaaa

SEQ ID NO: 1223646 - RNA, 20 nt, Homo sapiens
ucugccaaaggaugugauau

SEQ ID NO: 1223647 - RNA, 21 nt, Homo sapiens
ucugccacccacucaggauug

SEQ ID NO: 1223648 - RNA, 14 nt, Homo sapiens
ucugccagaccuua

SEQ ID NO: 1223649 - RNA, 18 nt, Homo sapiens
ucugccauuaaaacauua

SEQ ID NO: 1223650 - RNA, 13 nt, Homo sapiens
ucugcccaccuac

SEQ ID NO: 1223651 - RNA, 16 nt, Homo sapiens
ucugccccagucguua

SEQ ID NO: 1223652 - RNA, 15 nt, Homo sapiens
ucugcccuagggaga

SEQ ID NO: 1223653 - RNA, 22 nt, Homo sapiens
ucugcccucaccucugugccca

SEQ ID NO: 1223654 - RNA, 16 nt, Homo sapiens
ucugccucaccgcuuc

SEQ ID NO: 1223655 - RNA, 18 nt, Homo sapiens
ucugccuuguccugaugc

SEQ ID NO: 1223656 - RNA, 21 nt, Homo sapiens
ucugccuuuggggacuuuucu

SEQ ID NO: 1223657 - RNA, 15 nt, Homo sapiens
ucugccuuuucacug

SEQ ID NO: 1223658 - RNA, 23 nt, Homo sapiens
ucugcgcaccaaggaauggagag

SEQ ID NO: 1223659 - RNA, 19 nt, Homo sapiens
ucugcgccgagccucagaa

SEQ ID NO: 1223660 - RNA, 18 nt, Homo sapiens
ucugcguaugagucccau

SEQ ID NO: 1223661 - RNA, 21 nt, Homo sapiens
ucugcuauuaaccuugccuua

SEQ ID NO: 1223662 - RNA, 18 nt, Homo sapiens
ucugcuauuugcuguuau

SEQ ID NO: 1223663 - RNA, 13 nt, Homo sapiens
ucugcucacuuua

SEQ ID NO: 1223664 - RNA, 19 nt, Homo sapiens
ucugcuccagguucacuuu

SEQ ID NO: 1223665 - RNA, 17 nt, Homo sapiens
ucugcucucauccauuc

SEQ ID NO: 1223666 - RNA, 23 nt, Homo sapiens
ucugcucuuucucugccagugac

SEQ ID NO: 1223667 - RNA, 12 nt, Homo sapiens
ucugcuuaccuu

SEQ ID NO: 1223668 - RNA, 19 nt, Homo sapiens
ucugcuuuagcuuuccaau

SEQ ID NO: 1223669 - RNA, 14 nt, Homo sapiens
ucuggaaacuacca

SEQ ID NO: 1223670 - RNA, 14 nt, Homo sapiens
ucuggaaagugaug

SEQ ID NO: 1223671 - RNA, 17 nt, Homo sapiens
ucuggaagaccugaaag

SEQ ID NO: 1223672 - RNA, 21 nt, Homo sapiens
ucuggaaggccccucccagca

SEQ ID NO: 1223673 - RNA, 19 nt, Homo sapiens
ucuggacaccaggggaccu

SEQ ID NO: 1223674 - RNA, 21 nt, Homo sapiens
ucuggagaccguccuggagcu

SEQ ID NO: 1223675 - RNA, 21 nt, Homo sapiens
ucuggaggacggucaguccau

SEQ ID NO: 1223676 - RNA, 23 nt, Homo sapiens
ucuggaggagcaagggggccaca

SEQ ID NO: 1223677 - RNA, 18 nt, Homo sapiens
ucuggaggagcucugcag

SEQ ID NO: 1223678 - RNA, 12 nt, Homo sapiens
ucuggaggucau

SEQ ID NO: 1223679 - RNA, 16 nt, Homo sapiens
ucuggaggucucugaa

SEQ ID NO: 1223680 - RNA, 18 nt, Homo sapiens
ucuggauccagccaugcc

SEQ ID NO: 1223681 - RNA, 20 nt, Homo sapiens
ucuggcaacccuagucugcu

SEQ ID NO: 1223682 - RNA, 16 nt, Homo sapiens
ucuggccaggcauggc

SEQ ID NO: 1223683 - RNA, 18 nt, Homo sapiens
ucuggccccugucauccu

SEQ ID NO: 1223684 - RNA, 17 nt, Homo sapiens
ucuggccggagcugccu

SEQ ID NO: 1223685 - RNA, 19 nt, Homo sapiens
ucugggaaucaacagcaua

SEQ ID NO: 1223686 - RNA, 17 nt, Homo sapiens
ucugggagucacacagu

SEQ ID NO: 1223687 - RNA, 19 nt, Homo sapiens
ucugggcacaguggacuca

SEQ ID NO: 1223688 - RNA, 23 nt, Homo sapiens
ucugggcagacauuauguaaaag

SEQ ID NO: 1223689 - RNA, 21 nt, Homo sapiens
ucugggccucugacucugagu

SEQ ID NO: 1223690 - RNA, 11 nt, Homo sapiens
ucugggcuccc

SEQ ID NO: 1223691 - RNA, 14 nt, Homo sapiens
ucugggcugucagc

SEQ ID NO: 1223692 - RNA, 21 nt, Homo sapiens
ucuggggaccccaaccucaga

SEQ ID NO: 1223693 - RNA, 15 nt, Homo sapiens
ucuggggcagauccc

SEQ ID NO: 1223694 - RNA, 14 nt, Homo sapiens
ucuggggcauuauc

SEQ ID NO: 1223695 - RNA, 16 nt, Homo sapiens
ucugggggacagagaa

SEQ ID NO: 1223696 - RNA, 20 nt, Homo sapiens
ucugggucagaccugagguu

SEQ ID NO: 1223697 - RNA, 15 nt, Homo sapiens
ucugggugaccucac

SEQ ID NO: 1223698 - RNA, 16 nt, Homo sapiens
ucugguaauauugacu

SEQ ID NO: 1223699 - RNA, 20 nt, Homo sapiens
ucugguaguuguggcuuuua

SEQ ID NO: 1223700 - RNA, 21 nt, Homo sapiens
ucugguaguuguggcuuuuau

SEQ ID NO: 1223701 - RNA, 16 nt, Homo sapiens
ucuggucccagcaucc

SEQ ID NO: 1223702 - RNA, 19 nt, Homo sapiens
ucugguuucuaccagcuca

SEQ ID NO: 1223703 - RNA, 21 nt, Homo sapiens
ucugguuugaaagaugcagug

SEQ ID NO: 1223704 - RNA, 17 nt, Homo sapiens
ucugguuugagcaauuu

SEQ ID NO: 1223705 - RNA, 14 nt, Homo sapiens
ucugguuuugcuau

SEQ ID NO: 1223706 - RNA, 22 nt, Homo sapiens
ucugguuuugcuauuagacugu

SEQ ID NO: 1223707 - RNA, 19 nt, Homo sapiens
ucuguaaaaacacugaaaa

SEQ ID NO: 1223708 - RNA, 19 nt, Homo sapiens
ucuguaacaucacuaucca

SEQ ID NO: 1223709 - RNA, 16 nt, Homo sapiens
ucuguaaguaacuuca

SEQ ID NO: 1223710 - RNA, 17 nt, Homo sapiens
ucuguaaugauacugau

SEQ ID NO: 1223711 - RNA, 13 nt, Homo sapiens
ucuguaauugaau

SEQ ID NO: 1223712 - RNA, 19 nt, Homo sapiens
ucuguacauauuacuguug

SEQ ID NO: 1223713 - RNA, 22 nt, Homo sapiens
ucuguacauuuuguuguaaaaa

SEQ ID NO: 1223714 - RNA, 14 nt, Homo sapiens
ucuguacccaugaa

SEQ ID NO: 1223715 - RNA, 16 nt, Homo sapiens
ucuguaguuacugugg

SEQ ID NO: 1223716 - RNA, 14 nt, Homo sapiens
ucuguauauacuca

SEQ ID NO: 1223717 - RNA, 19 nt, Homo sapiens
ucuguauuuuauuuagaca

SEQ ID NO: 1223718 - RNA, 16 nt, Homo sapiens
ucugucaaaacacugu

SEQ ID NO: 1223719 - RNA, 18 nt, Homo sapiens
ucugucaaaacacugugg

SEQ ID NO: 1223720 - RNA, 14 nt, Homo sapiens
ucugucaccagcua

SEQ ID NO: 1223721 - RNA, 21 nt, Homo sapiens
ucuguccagaggcugcaagga

SEQ ID NO: 1223722 - RNA, 17 nt, Homo sapiens
ucuguccuacucugugu

SEQ ID NO: 1223723 - RNA, 20 nt, Homo sapiens
ucuguccugauuucuacaac

SEQ ID NO: 1223724 - RNA, 24 nt, Homo sapiens
ucugucuaaaaaccagacaaggaa

SEQ ID NO: 1223725 - RNA, 14 nt, Homo sapiens
ucugucuaguucca

SEQ ID NO: 1223726 - RNA, 17 nt, Homo sapiens
ucugucucagacuuuug

SEQ ID NO: 1223727 - RNA, 16 nt, Homo sapiens
ucugucuucuuucacu

SEQ ID NO: 1223728 - RNA, 16 nt, Homo sapiens
ucugugaaaccuguga

SEQ ID NO: 1223729 - RNA, 22 nt, Homo sapiens
ucugugcagagaugacugucca

SEQ ID NO: 1223730 - RNA, 14 nt, Homo sapiens
ucugugccagagau

SEQ ID NO: 1223731 - RNA, 17 nt, Homo sapiens
ucuguggaccacugcau

SEQ ID NO: 1223732 - RNA, 21 nt, Homo sapiens
ucuguguagcaagcuauucaa

SEQ ID NO: 1223733 - RNA, 20 nt, Homo sapiens
ucuguguuuuugaaauauua

SEQ ID NO: 1223734 - RNA, 15 nt, Homo sapiens
ucuguuaaaugaacu

SEQ ID NO: 1223735 - RNA, 18 nt, Homo sapiens
ucuguuaaaugaacuuga

SEQ ID NO: 1223736 - RNA, 13 nt, Homo sapiens
ucuguuaauguca

SEQ ID NO: 1223737 - RNA, 18 nt, Homo sapiens
ucuguuaugcugugacac

SEQ ID NO: 1223738 - RNA, 14 nt, Homo sapiens
ucuguuauguacua

SEQ ID NO: 1223739 - RNA, 13 nt, Homo sapiens
ucuguucacuuuu

SEQ ID NO: 1223740 - RNA, 16 nt, Homo sapiens
ucuguuccagucacau

SEQ ID NO: 1223741 - RNA, 14 nt, Homo sapiens
ucuguuuaacauuu

SEQ ID NO: 1223742 - RNA, 17 nt, Homo sapiens
ucuguuuggaagaccag

SEQ ID NO: 1223743 - RNA, 16 nt, Homo sapiens
ucuguuuggaucuaua

SEQ ID NO: 1223744 - RNA, 14 nt, Homo sapiens
ucuguuuuaucuuc

SEQ ID NO: 1223745 - RNA, 19 nt, Homo sapiens
ucuuaaaccacagcacuau

SEQ ID NO: 1223746 - RNA, 20 nt, Homo sapiens
ucuuaaauauguauaugaca

SEQ ID NO: 1223747 - RNA, 16 nt, Homo sapiens
ucuuaaccuauuuauu

SEQ ID NO: 1223748 - RNA, 12 nt, Homo sapiens
ucuuaaccucaa

SEQ ID NO: 1223749 - RNA, 22 nt, Homo sapiens
ucuuaacuauaaauauguacaa

SEQ ID NO: 1223750 - RNA, 22 nt, Homo sapiens
ucuuaauacuuuaugaugcuau

SEQ ID NO: 1223751 - RNA, 18 nt, Homo sapiens
ucuuaauguacacauugc

SEQ ID NO: 1223752 - RNA, 21 nt, Homo sapiens
ucuuacaaccaagaacauuau

SEQ ID NO: 1223753 - RNA, 20 nt, Homo sapiens
ucuuacacaggcuucaucaa

SEQ ID NO: 1223754 - RNA, 13 nt, Homo sapiens
ucuuacaugcauu

SEQ ID NO: 1223755 - RNA, 16 nt, Homo sapiens
ucuuacaugcauuuga

SEQ ID NO: 1223756 - RNA, 15 nt, Homo sapiens
ucuuacuggugcuau

SEQ ID NO: 1223757 - RNA, 13 nt, Homo sapiens
ucuuagauucucu

SEQ ID NO: 1223758 - RNA, 11 nt, Homo sapiens
ucuuagcuguc

SEQ ID NO: 1223759 - RNA, 12 nt, Homo sapiens
ucuuagcuuucu

SEQ ID NO: 1223760 - RNA, 20 nt, Homo sapiens
ucuuagugcuucagaguuug

SEQ ID NO: 1223761 - RNA, 14 nt, Homo sapiens
ugaagucuaugaug

SEQ ID NO: 1223762 - RNA, 18 nt, Homo sapiens
ugaagucuugcucugcca

SEQ ID NO: 1223763 - RNA, 18 nt, Homo sapiens
ugaagugcccuucccuug

SEQ ID NO: 1223764 - RNA, 16 nt, Homo sapiens
ugaaguggagucucau

SEQ ID NO: 1223765 - RNA, 13 nt, Homo sapiens
ugaagugugcugu

SEQ ID NO: 1223766 - RNA, 19 nt, Homo sapiens
ugaaguguggcugcaucuu

SEQ ID NO: 1223767 - RNA, 22 nt, Homo sapiens
ugaaguugccauuuugucucau

SEQ ID NO: 1223768 - RNA, 19 nt, Homo sapiens
ugaaguuugugggggccaa

SEQ ID NO: 1223769 - RNA, 17 nt, Homo sapiens
ugaaguuuuacugucua

SEQ ID NO: 1223770 - RNA, 20 nt, Homo sapiens
ugaauaaaaauauguacaag

SEQ ID NO: 1223771 - RNA, 22 nt, Homo sapiens
ugaauaaaguguaaguucacaa

SEQ ID NO: 1223772 - RNA, 19 nt, Homo sapiens
ugaauaaaguugaagcuaa

SEQ ID NO: 1223773 - RNA, 18 nt, Homo sapiens
ugaauaaauugaacuaaa

SEQ ID NO: 1223774 - RNA, 13 nt, Homo sapiens
ugaauaaccacuu

SEQ ID NO: 1223775 - RNA, 15 nt, Homo sapiens
ugaauaacuaugcca

SEQ ID NO: 1223776 - RNA, 14 nt, Homo sapiens
ugaauaacugagcu

SEQ ID NO: 1223777 - RNA, 17 nt, Homo sapiens
ugaauaagcuuucucuc

SEQ ID NO: 1223778 - RNA, 21 nt, Homo sapiens
ugaauacagcauuuagcuugu

SEQ ID NO: 1223779 - RNA, 16 nt, Homo sapiens
ugaauaccacuuaccu

SEQ ID NO: 1223780 - RNA, 14 nt, Homo sapiens
ugaauacugcuaca

SEQ ID NO: 1223781 - RNA, 22 nt, Homo sapiens
ugaauacuuacuauaauuugac

SEQ ID NO: 1223782 - RNA, 21 nt, Homo sapiens
ugaauauaaaugggaaaucag

SEQ ID NO: 1223783 - RNA, 20 nt, Homo sapiens
ugaauaucgagaacugccau

SEQ ID NO: 1223784 - RNA, 15 nt, Homo sapiens
ugaauauuacuccua

SEQ ID NO: 1223785 - RNA, 18 nt, Homo sapiens
ugaauauuagcauugcca

SEQ ID NO: 1223786 - RNA, 21 nt, Homo sapiens
ugaauauuuguuauguagaua

SEQ ID NO: 1223787 - RNA, 19 nt, Homo sapiens
ugaaucauauucauaugca

SEQ ID NO: 1223788 - RNA, 15 nt, Homo sapiens
ugaauccuuugccug

SEQ ID NO: 1223789 - RNA, 11 nt, Homo sapiens
ugaaucuacaa

SEQ ID NO: 1223790 - RNA, 22 nt, Homo sapiens
ugaaucuauaaaagaauugcac

SEQ ID NO: 1223791 - RNA, 17 nt, Homo sapiens
ugaaucucccacuccag

SEQ ID NO: 1223792 - RNA, 15 nt, Homo sapiens
ugaaucugcucacuu

SEQ ID NO: 1223793 - RNA, 20 nt, Homo sapiens
ugaaucugguguuggggaaa

SEQ ID NO: 1223794 - RNA, 21 nt, Homo sapiens
ugaaugaaucaacaaaccaca

SEQ ID NO: 1223795 - RNA, 19 nt, Homo sapiens
ugaaugccuaugguggauc

SEQ ID NO: 1223796 - RNA, 20 nt, Homo sapiens
ugaaugccuccuguggggaa

SEQ ID NO: 1223797 - RNA, 15 nt, Homo sapiens
ugaaugccuucuuaa

SEQ ID NO: 1223798 - RNA, 14 nt, Homo sapiens
ugaaugcugccaca

SEQ ID NO: 1223799 - RNA, 12 nt, Homo sapiens
ugaaugcuuccu

SEQ ID NO: 1223800 - RNA, 19 nt, Homo sapiens
ugaaugugccuaauggaga

SEQ ID NO: 1223801 - RNA, 20 nt, Homo sapiens
ugaaugugcugaucauuuga

SEQ ID NO: 1223802 - RNA, 13 nt, Homo sapiens
ugaaugugucacu

SEQ ID NO: 1223803 - RNA, 18 nt, Homo sapiens
ugaaugugucacuacuca

SEQ ID NO: 1223804 - RNA, 22 nt, Homo sapiens
ugaauguuacaacgaauuuaca

SEQ ID NO: 1223805 - RNA, 17 nt, Homo sapiens
ugaauguugcaauguga

SEQ ID NO: 1223806 - RNA, 18 nt, Homo sapiens
ugaauguugugauguauu

SEQ ID NO: 1223807 - RNA, 13 nt, Homo sapiens
ugaauguuuccaa

SEQ ID NO: 1223808 - RNA, 21 nt, Homo sapiens
ugaauguuuuauggaauugaa

SEQ ID NO: 1223809 - RNA, 14 nt, Homo sapiens
ugaauuaagccauc

SEQ ID NO: 1223810 - RNA, 15 nt, Homo sapiens
ugaauuaaucaucua

SEQ ID NO: 1223811 - RNA, 18 nt, Homo sapiens
ugaauuauucugauucuu

SEQ ID NO: 1223812 - RNA, 16 nt, Homo sapiens
ugaauucaaagcuugu

SEQ ID NO: 1223813 - RNA, 13 nt, Homo sapiens
ugaauucaagaaa

SEQ ID NO: 1223814 - RNA, 13 nt, Homo sapiens
ugaauucugggaa

SEQ ID NO: 1223815 - RNA, 17 nt, Homo sapiens
ugaauucugggaaucca

SEQ ID NO: 1223816 - RNA, 12 nt, Homo sapiens
ugaauugcaaac

SEQ ID NO: 1223817 - RNA, 19 nt, Homo sapiens
ugaauugcccguuuccaua

SEQ ID NO: 1223818 - RNA, 22 nt, Homo sapiens
ugaauugcccguuuccauacag

SEQ ID NO: 1223819 - RNA, 19 nt, Homo sapiens
ugaauuuccccaucugcca

SEQ ID NO: 1223820 - RNA, 18 nt, Homo sapiens
ugaauuuggccagacaca

SEQ ID NO: 1223821 - RNA, 23 nt, Homo sapiens
ugaauuuuaaauuaaagcaaagu

SEQ ID NO: 1223822 - RNA, 17 nt, Homo sapiens
ugaauuuucaaguaauu

SEQ ID NO: 1223823 - RNA, 14 nt, Homo sapiens
ugacaaagacuccu

SEQ ID NO: 1223824 - RNA, 19 nt, Homo sapiens
ugacaaaucuguguauauu

SEQ ID NO: 1223825 - RNA, 12 nt, Homo sapiens
ugacaacaucgc

SEQ ID NO: 1223826 - RNA, 12 nt, Homo sapiens
ugacaaccucuu

SEQ ID NO: 1223827 - RNA, 12 nt, Homo sapiens
ugacaacuguga

SEQ ID NO: 1223828 - RNA, 17 nt, Homo sapiens
ugacaacugugacugua

SEQ ID NO: 1223829 - RNA, 22 nt, Homo sapiens
ugacaacugugacuguacccaa

SEQ ID NO: 1223830 - RNA, 18 nt, Homo sapiens
ugacaagccaaugugaau

SEQ ID NO: 1223831 - RNA, 15 nt, Homo sapiens
ugacaaggagcacaa

SEQ ID NO: 1223832 - RNA, 17 nt, Homo sapiens
ugacaauacaccuuccc

SEQ ID NO: 1223833 - RNA, 14 nt, Homo sapiens
ugacaaucaacucu

SEQ ID NO: 1223834 - RNA, 21 nt, Homo sapiens
ugacaaugacugugcuacugu

SEQ ID NO: 1223835 - RNA, 15 nt, Homo sapiens
ugacaauggcagcua

SEQ ID NO: 1223836 - RNA, 14 nt, Homo sapiens
ugacaauuacucag

SEQ ID NO: 1223837 - RNA, 19 nt, Homo sapiens
ugacaauugggagcugcca

SEQ ID NO: 1223838 - RNA, 18 nt, Homo sapiens
ugacacaaguggaccuua

SEQ ID NO: 1223839 - RNA, 21 nt, Homo sapiens
ugacacaaucucggcucacug

SEQ ID NO: 1223840 - RNA, 21 nt, Homo sapiens
ugacacacaaaucccauuaaa

SEQ ID NO: 1223841 - RNA, 12 nt, Homo sapiens
ugacacacagcu

SEQ ID NO: 1223842 - RNA, 13 nt, Homo sapiens
ugacacacagcuc

SEQ ID NO: 1223843 - RNA, 14 nt, Homo sapiens
ugacacauuacaaa

SEQ ID NO: 1223844 - RNA, 16 nt, Homo sapiens
ugacacccacaauccc

SEQ ID NO: 1223845 - RNA, 22 nt, Homo sapiens
ugacacccuggccugaacugag

SEQ ID NO: 1223846 - RNA, 21 nt, Homo sapiens
ugacaccgugggucauuacaa

SEQ ID NO: 1223847 - RNA, 23 nt, Homo sapiens
ugacaccgugggucauuacaaaa

SEQ ID NO: 1223848 - RNA, 18 nt, Homo sapiens
ugacacuagucagaaaau

SEQ ID NO: 1223849 - RNA, 11 nt, Homo sapiens
ugacacuauuc

SEQ ID NO: 1223850 - RNA, 16 nt, Homo sapiens
ugacacuucaagguga

SEQ ID NO: 1223851 - RNA, 12 nt, Homo sapiens
ugacagaacaag

SEQ ID NO: 1223852 - RNA, 18 nt, Homo sapiens
ugacagaagcuucugccc

SEQ ID NO: 1223853 - RNA, 16 nt, Homo sapiens
ugacagacacaggccc

SEQ ID NO: 1223854 - RNA, 16 nt, Homo sapiens
ugacagaccacaucuu

SEQ ID NO: 1223855 - RNA, 19 nt, Homo sapiens
ugacagaguucacuauaaa

SEQ ID NO: 1223856 - RNA, 12 nt, Homo sapiens
ugacagcaauaa

SEQ ID NO: 1223857 - RNA, 12 nt, Homo sapiens
ugacagccauuu

SEQ ID NO: 1223858 - RNA, 21 nt, Homo sapiens
ugacagcccugaacgugagca

SEQ ID NO: 1223859 - RNA, 21 nt, Homo sapiens
ugacagccuccgucagacucc

SEQ ID NO: 1223860 - RNA, 19 nt, Homo sapiens
ugacagcucccgggucccc

SEQ ID NO: 1223861 - RNA, 15 nt, Homo sapiens
ugacagcucuucaca

SEQ ID NO: 1223862 - RNA, 16 nt, Homo sapiens
ugacaggaaagcccuc

SEQ ID NO: 1223863 - RNA, 16 nt, Homo sapiens
ugacaguaaaucucac

SEQ ID NO: 1223864 - RNA, 20 nt, Homo sapiens
ugacaguaaaucucacaaau

SEQ ID NO: 1223865 - RNA, 23 nt, Homo sapiens
ugacaucacagcagccuccaaca

SEQ ID NO: 1223866 - RNA, 14 nt, Homo sapiens
ugacaucacuugua

SEQ ID NO: 1223867 - RNA, 14 nt, Homo sapiens
ugacaucucagggg

SEQ ID NO: 1223868 - RNA, 23 nt, Homo sapiens
ugacaugggccuuuaagaaccuu

SEQ ID NO: 1223869 - RNA, 13 nt, Homo sapiens
ugacauguuguca

SEQ ID NO: 1223870 - RNA, 17 nt, Homo sapiens
ugacauucacacagaga

SEQ ID NO: 1223871 - RNA, 13 nt, Homo sapiens
ugacauuccauga

SEQ ID NO: 1223872 - RNA, 18 nt, Homo sapiens
ugacauugcaccuggaug

SEQ ID NO: 1223873 - RNA, 23 nt, Homo sapiens
ugacauugcguuugaccuuuuau

SEQ ID NO: 1223874 - RNA, 20 nt, Homo sapiens
ugacauuuauauauugaauu

SEQ ID NO: 1223875 - RNA, 22 nt, Homo sapiens
ugacauuuauauuuguguauuu

SEQ ID NO: 1223876 - RNA, 15 nt, Homo sapiens
ugacauuugcucuga

SEQ ID NO: 1223877 - RNA, 22 nt, Homo sapiens
ugacauuugggagacaugugac

SEQ ID NO: 1223878 - RNA, 20 nt, Homo sapiens
ugaccaaaacaaacaaacag

SEQ ID NO: 1223879 - RNA, 15 nt, Homo sapiens
ugaccaagaacugca

SEQ ID NO: 1223880 - RNA, 18 nt, Homo sapiens
ugaccacgucaucgggcc

SEQ ID NO: 1223881 - RNA, 16 nt, Homo sapiens
ugaccagcaacuuguc

SEQ ID NO: 1223882 - RNA, 21 nt, Homo sapiens
ugacccaggccuggccaguca

SEQ ID NO: 1223883 - RNA, 20 nt, Homo sapiens
ugacccccgcaaguuugcac

SEQ ID NO: 1223884 - RNA, 21 nt, Homo sapiens
ugacccuaugggucuaggaca

SEQ ID NO: 1223885 - RNA, 16 nt, Homo sapiens
ugacccuuccagacau

SEQ ID NO: 1223886 - RNA, 18 nt, Homo sapiens
ugacccuugugucucaua

SEQ ID NO: 1223887 - RNA, 12 nt, Homo sapiens
ugcagucacugg

SEQ ID NO: 1223888 - RNA, 22 nt, Homo sapiens
ugcagucauuaugagaggcaau

SEQ ID NO: 1223889 - RNA, 15 nt, Homo sapiens
ugcagucccuggaaa

SEQ ID NO: 1223890 - RNA, 17 nt, Homo sapiens
ugcagugagcccagauc

SEQ ID NO: 1223891 - RNA, 17 nt, Homo sapiens
ugcaguggcaccaucuc

SEQ ID NO: 1223892 - RNA, 19 nt, Homo sapiens
ugcaguggcugugccacca

SEQ ID NO: 1223893 - RNA, 18 nt, Homo sapiens
ugcaguggugugaucucg

SEQ ID NO: 1223894 - RNA, 19 nt, Homo sapiens
ugcaguucaccugcacuua

SEQ ID NO: 1223895 - RNA, 23 nt, Homo sapiens
ugcaguucuuuuuguacacuuaa

SEQ ID NO: 1223896 - RNA, 18 nt, Homo sapiens
ugcaguuggacucucagg

SEQ ID NO: 1223897 - RNA, 21 nt, Homo sapiens
ugcaguuguaggcauguagcu

SEQ ID NO: 1223898 - RNA, 21 nt, Homo sapiens
ugcauaaaguaaguaaggugc

SEQ ID NO: 1223899 - RNA, 14 nt, Homo sapiens
ugcauaauaagcua

SEQ ID NO: 1223900 - RNA, 18 nt, Homo sapiens
ugcauaauaagcuaaaga

SEQ ID NO: 1223901 - RNA, 21 nt, Homo sapiens
ugcauacuuucccucauccau

SEQ ID NO: 1223902 - RNA, 17 nt, Homo sapiens
ugcauaggaauugcaca

SEQ ID NO: 1223903 - RNA, 13 nt, Homo sapiens
ugcaucacugggu

SEQ ID NO: 1223904 - RNA, 15 nt, Homo sapiens
ugcaucauccuugca

SEQ ID NO: 1223905 - RNA, 15 nt, Homo sapiens
ugcauccacuagcuu

SEQ ID NO: 1223906 - RNA, 18 nt, Homo sapiens
ugcaucuucccacagugg

SEQ ID NO: 1223907 - RNA, 21 nt, Homo sapiens
ugcaugacaaacacacaucca

SEQ ID NO: 1223908 - RNA, 15 nt, Homo sapiens
ugcaugacagucaca

SEQ ID NO: 1223909 - RNA, 14 nt, Homo sapiens
ugcaugcuugcaua

SEQ ID NO: 1223910 - RNA, 21 nt, Homo sapiens
ugcaugcuuuucucuugcuaa

SEQ ID NO: 1223911 - RNA, 17 nt, Homo sapiens
ugcauggaggcccuccu

SEQ ID NO: 1223912 - RNA, 13 nt, Homo sapiens
ugcauggccuuag

SEQ ID NO: 1223913 - RNA, 15 nt, Homo sapiens
ugcauguaagccaag

SEQ ID NO: 1223914 - RNA, 19 nt, Homo sapiens
ugcauguaccauuugcaug

SEQ ID NO: 1223915 - RNA, 19 nt, Homo sapiens
ugcauguaucuucuaagaa

SEQ ID NO: 1223916 - RNA, 18 nt, Homo sapiens
ugcaugugcgucaccguc

SEQ ID NO: 1223917 - RNA, 19 nt, Homo sapiens
ugcauuagcacagauuuua

SEQ ID NO: 1223918 - RNA, 16 nt, Homo sapiens
ugcauuauaucaaauc

SEQ ID NO: 1223919 - RNA, 22 nt, Homo sapiens
ugcauucauuuuuauagcaaca

SEQ ID NO: 1223920 - RNA, 16 nt, Homo sapiens
ugcauucuacuagcag

SEQ ID NO: 1223921 - RNA, 15 nt, Homo sapiens
ugcauucuucucugu

SEQ ID NO: 1223922 - RNA, 18 nt, Homo sapiens
ugcauugcuaaaauauua

SEQ ID NO: 1223923 - RNA, 15 nt, Homo sapiens
ugcauuuacuuuuaa

SEQ ID NO: 1223924 - RNA, 19 nt, Homo sapiens
ugcauuuauaugcgcuuaa

SEQ ID NO: 1223925 - RNA, 13 nt, Homo sapiens
ugcauuugccuug

SEQ ID NO: 1223926 - RNA, 19 nt, Homo sapiens
ugcauuuguaauucaugaa

SEQ ID NO: 1223927 - RNA, 19 nt, Homo sapiens
ugcauuuucccagauacuu

SEQ ID NO: 1223928 - RNA, 20 nt, Homo sapiens
ugcauuuuucacuuugcucu

SEQ ID NO: 1223929 - RNA, 10 nt, Homo sapiens
ugccaaaaau

SEQ ID NO: 1223930 - RNA, 16 nt, Homo sapiens
ugccaaaauacauuga

SEQ ID NO: 1223931 - RNA, 22 nt, Homo sapiens
ugccaaaauaccagagccuuca

SEQ ID NO: 1223932 - RNA, 18 nt, Homo sapiens
ugccaaaggaugugauau

SEQ ID NO: 1223933 - RNA, 19 nt, Homo sapiens
ugccaaaggaugugauaua

SEQ ID NO: 1223934 - RNA, 18 nt, Homo sapiens
ugccaaagggaaauauca

SEQ ID NO: 1223935 - RNA, 15 nt, Homo sapiens
ugccaaauguuccau

SEQ ID NO: 1223936 - RNA, 12 nt, Homo sapiens
ugccaaccaguu

SEQ ID NO: 1223937 - RNA, 15 nt, Homo sapiens
ugccaaccggucacc

SEQ ID NO: 1223938 - RNA, 20 nt, Homo sapiens
ugccaaccggucacccagga

SEQ ID NO: 1223939 - RNA, 18 nt, Homo sapiens
ugccaagggguuaaugaa

SEQ ID NO: 1223940 - RNA, 17 nt, Homo sapiens
ugccaaugaccaaacag

SEQ ID NO: 1223941 - RNA, 12 nt, Homo sapiens
ugccaaugaguu

SEQ ID NO: 1223942 - RNA, 16 nt, Homo sapiens
ugccaauucauuucuc

SEQ ID NO: 1223943 - RNA, 23 nt, Homo sapiens
ugccaauugaauaggaucaaauu

SEQ ID NO: 1223944 - RNA, 12 nt, Homo sapiens
ugccacaaccag

SEQ ID NO: 1223945 - RNA, 16 nt, Homo sapiens
ugccacagaugauacu

SEQ ID NO: 1223946 - RNA, 12 nt, Homo sapiens
ugccacagugug

SEQ ID NO: 1223947 - RNA, 15 nt, Homo sapiens
ugccacauacaggug

SEQ ID NO: 1223948 - RNA, 19 nt, Homo sapiens
ugccaccaacacugcucac

SEQ ID NO: 1223949 - RNA, 19 nt, Homo sapiens
ugccaccacaccuggcuaa

SEQ ID NO: 1223950 - RNA, 23 nt, Homo sapiens
ugccacccucacacacacagcug

SEQ ID NO: 1223951 - RNA, 14 nt, Homo sapiens
ugccacucauuccu

SEQ ID NO: 1223952 - RNA, 14 nt, Homo sapiens
ugccacugccuucg

SEQ ID NO: 1223953 - RNA, 19 nt, Homo sapiens
ugccagaugauuguucaaa

SEQ ID NO: 1223954 - RNA, 18 nt, Homo sapiens
ugccagcaaugacaucuc

SEQ ID NO: 1223955 - RNA, 15 nt, Homo sapiens
ugccagggcuggaag

SEQ ID NO: 1223956 - RNA, 11 nt, Homo sapiens
ugccagugaaa

SEQ ID NO: 1223957 - RNA, 15 nt, Homo sapiens
ugccagugacagaca

SEQ ID NO: 1223958 - RNA, 21 nt, Homo sapiens
ugccauagaacaagauaccag

SEQ ID NO: 1223959 - RNA, 18 nt, Homo sapiens
ugccauauucuguuggcc

SEQ ID NO: 1223960 - RNA, 14 nt, Homo sapiens
ugccaucaccgcug

SEQ ID NO: 1223961 - RNA, 21 nt, Homo sapiens
ugccaucaccgcugggugguu

SEQ ID NO: 1223962 - RNA, 22 nt, Homo sapiens
ugccaucaccgcugggugguuu

SEQ ID NO: 1223963 - RNA, 13 nt, Homo sapiens
ugccaucaugccu

SEQ ID NO: 1223964 - RNA, 22 nt, Homo sapiens
ugccaucuguacauauuacugu

SEQ ID NO: 1223965 - RNA, 12 nt, Homo sapiens
ugccaugaucug

SEQ ID NO: 1223966 - RNA, 12 nt, Homo sapiens
ugccauggauuu

SEQ ID NO: 1223967 - RNA, 11 nt, Homo sapiens
ugccaugucug

SEQ ID NO: 1223968 - RNA, 18 nt, Homo sapiens
ugccaugucugcagugug

SEQ ID NO: 1223969 - RNA, 16 nt, Homo sapiens
ugccaugugugcugaa

SEQ ID NO: 1223970 - RNA, 16 nt, Homo sapiens
ugccauguuuugccac

SEQ ID NO: 1223971 - RNA, 14 nt, Homo sapiens
ugccauuacauugc

SEQ ID NO: 1223972 - RNA, 16 nt, Homo sapiens
ugccauuccacuccac

SEQ ID NO: 1223973 - RNA, 20 nt, Homo sapiens
ugccauucuucuggugcuac

SEQ ID NO: 1223974 - RNA, 19 nt, Homo sapiens
ugccauuucugaacuguua

SEQ ID NO: 1223975 - RNA, 23 nt, Homo sapiens
ugcccaaagagcacaaacauuuu

SEQ ID NO: 1223976 - RNA, 18 nt, Homo sapiens
ugcccaaugagacucuag

SEQ ID NO: 1223977 - RNA, 22 nt, Homo sapiens
ugcccaauuagggccuagccuu

SEQ ID NO: 1223978 - RNA, 15 nt, Homo sapiens
ugcccacaccaacga

SEQ ID NO: 1223979 - RNA, 16 nt, Homo sapiens
ugcccacgcagaggac

SEQ ID NO: 1223980 - RNA, 20 nt, Homo sapiens
ugcccacgcuggagugcagu

SEQ ID NO: 1223981 - RNA, 14 nt, Homo sapiens
ugcccagacacaga

SEQ ID NO: 1223982 - RNA, 20 nt, Homo sapiens
ugcccagacacagacuggca

SEQ ID NO: 1223983 - RNA, 21 nt, Homo sapiens
ugcccagacacagacuggcaa

SEQ ID NO: 1223984 - RNA, 15 nt, Homo sapiens
ugcccagagcacuuu

SEQ ID NO: 1223985 - RNA, 16 nt, Homo sapiens
ugcccagagcacuuua

SEQ ID NO: 1223986 - RNA, 14 nt, Homo sapiens
ugcccaggagacag

SEQ ID NO: 1223987 - RNA, 21 nt, Homo sapiens
ugcccaggcuggagugcaaug

SEQ ID NO: 1223988 - RNA, 20 nt, Homo sapiens
ugcccaggcuggaguggagu

SEQ ID NO: 1223989 - RNA, 17 nt, Homo sapiens
ugcccaggguuuugccc

SEQ ID NO: 1223990 - RNA, 20 nt, Homo sapiens
ugccccacgcuguggcccug

SEQ ID NO: 1223991 - RNA, 17 nt, Homo sapiens
ugccccagacacagugc

SEQ ID NO: 1223992 - RNA, 15 nt, Homo sapiens
ugccccagagcuguu

SEQ ID NO: 1223993 - RNA, 16 nt, Homo sapiens
ugcccccaacacucca

SEQ ID NO: 1223994 - RNA, 17 nt, Homo sapiens
ugcccccaccccgggga

SEQ ID NO: 1223995 - RNA, 15 nt, Homo sapiens
ugcccccuccacugg

SEQ ID NO: 1223996 - RNA, 19 nt, Homo sapiens
ugcccguguaguccccaac

SEQ ID NO: 1223997 - RNA, 20 nt, Homo sapiens
ugcccuagcccagacucuga

SEQ ID NO: 1223998 - RNA, 20 nt, Homo sapiens
ugcccuccccagagcacugg

SEQ ID NO: 1223999 - RNA, 20 nt, Homo sapiens
ugcccucuuguggugcauug

SEQ ID NO: 1224000 - RNA, 20 nt, Homo sapiens
ugcccugagaagcugcucca

SEQ ID NO: 1224001 - RNA, 17 nt, Homo sapiens
ugcccuguaaccugacu

SEQ ID NO: 1224002 - RNA, 18 nt, Homo sapiens
ugcccugugcaugccaug

SEQ ID NO: 1224003 - RNA, 23 nt, Homo sapiens
ugcccuucucuuaucugccaugu

SEQ ID NO: 1224004 - RNA, 20 nt, Homo sapiens
ugcccuugggguaagccaga

SEQ ID NO: 1224005 - RNA, 16 nt, Homo sapiens
ugcccuugucugagau

SEQ ID NO: 1224006 - RNA, 17 nt, Homo sapiens
ugcccuuuaacuuucag

SEQ ID NO: 1224007 - RNA, 19 nt, Homo sapiens
ugcccuuucuguaccauuu

SEQ ID NO: 1224008 - RNA, 20 nt, Homo sapiens
ugcccuuuggaaagccauug

SEQ ID NO: 1224009 - RNA, 14 nt, Homo sapiens
ugccgagaccucaa

SEQ ID NO: 1224010 - RNA, 19 nt, Homo sapiens
ugccgccuccuugugcaca

SEQ ID NO: 1224011 - RNA, 19 nt, Homo sapiens
ugccggguucuagucuccu

SEQ ID NO: 1224012 - RNA, 21 nt, Homo sapiens
ugccguaacaacuguggucaa

SEQ ID NO: 1224013 - RNA, 22 nt, Homo sapiens
uggccagccagugccauuccac

SEQ ID NO: 1224014 - RNA, 22 nt, Homo sapiens
uggccagccuggaucuccucaa

SEQ ID NO: 1224015 - RNA, 19 nt, Homo sapiens
uggccaggacccugaccuc

SEQ ID NO: 1224016 - RNA, 15 nt, Homo sapiens
uggccaguugcccag

SEQ ID NO: 1224017 - RNA, 23 nt, Homo sapiens
uggccaguugcccagagcacuuu

SEQ ID NO: 1224018 - RNA, 22 nt, Homo sapiens
uggccaucucccuccccagaaa

SEQ ID NO: 1224019 - RNA, 12 nt, Homo sapiens
uggccauucuuu

SEQ ID NO: 1224020 - RNA, 14 nt, Homo sapiens
uggcccaaagcagu

SEQ ID NO: 1224021 - RNA, 22 nt, Homo sapiens
uggcccaaagcuguugaaguca

SEQ ID NO: 1224022 - RNA, 13 nt, Homo sapiens
uggcccagaugau

SEQ ID NO: 1224023 - RNA, 13 nt, Homo sapiens
uggcccagccuug

SEQ ID NO: 1224024 - RNA, 15 nt, Homo sapiens
uggcccagcuuuuag

SEQ ID NO: 1224025 - RNA, 19 nt, Homo sapiens
uggcccagggaagccaaaa

SEQ ID NO: 1224026 - RNA, 19 nt, Homo sapiens
uggccccaguccaugcuuc

SEQ ID NO: 1224027 - RNA, 17 nt, Homo sapiens
uggccccugcccggcug

SEQ ID NO: 1224028 - RNA, 23 nt, Homo sapiens
uggccgucccuaagcaugugucc

SEQ ID NO: 1224029 - RNA, 14 nt, Homo sapiens
uggccgugaggaca

SEQ ID NO: 1224030 - RNA, 21 nt, Homo sapiens
uggccuacagucaucugccac

SEQ ID NO: 1224031 - RNA, 15 nt, Homo sapiens
uggccucaagugauu

SEQ ID NO: 1224032 - RNA, 14 nt, Homo sapiens
uggccuccaaacac

SEQ ID NO: 1224033 - RNA, 21 nt, Homo sapiens
uggccucugugccuucuuuug

SEQ ID NO: 1224034 - RNA, 22 nt, Homo sapiens
uggccuggcaguugaacagagg

SEQ ID NO: 1224035 - RNA, 23 nt, Homo sapiens
uggccuggcugcugcugugcagu

SEQ ID NO: 1224036 - RNA, 13 nt, Homo sapiens
uggccugugaagc

SEQ ID NO: 1224037 - RNA, 16 nt, Homo sapiens
uggccugugucccaug

SEQ ID NO: 1224038 - RNA, 16 nt, Homo sapiens
uggccuuacacugaaa

SEQ ID NO: 1224039 - RNA, 14 nt, Homo sapiens
uggccuuguaagac

SEQ ID NO: 1224040 - RNA, 17 nt, Homo sapiens
uggccuuuaaaaaugca

SEQ ID NO: 1224041 - RNA, 19 nt, Homo sapiens
uggcgcuuagagaggacaa

SEQ ID NO: 1224042 - RNA, 21 nt, Homo sapiens
uggcgcuuagagaggacaaua

SEQ ID NO: 1224043 - RNA, 23 nt, Homo sapiens
uggcguuacugcuugaccaaaga

SEQ ID NO: 1224044 - RNA, 20 nt, Homo sapiens
uggcguuuggacccaguuca

SEQ ID NO: 1224045 - RNA, 14 nt, Homo sapiens
uggcuaacuggcga

SEQ ID NO: 1224046 - RNA, 15 nt, Homo sapiens
uggcuaagauaccaa

SEQ ID NO: 1224047 - RNA, 17 nt, Homo sapiens
uggcuacacacaaacca

SEQ ID NO: 1224048 - RNA, 18 nt, Homo sapiens
uggcuacacacaaaccag

SEQ ID NO: 1224049 - RNA, 21 nt, Homo sapiens
uggcuacacacaaaccaguau

SEQ ID NO: 1224050 - RNA, 16 nt, Homo sapiens
uggcuauaaucuuauc

SEQ ID NO: 1224051 - RNA, 22 nt, Homo sapiens
uggcucaugccuguaaucucag

SEQ ID NO: 1224052 - RNA, 19 nt, Homo sapiens
uggcuccaacacugcugcu

SEQ ID NO: 1224053 - RNA, 14 nt, Homo sapiens
uggcucuaucuucc

SEQ ID NO: 1224054 - RNA, 13 nt, Homo sapiens
uggcucugggaau

SEQ ID NO: 1224055 - RNA, 15 nt, Homo sapiens
uggcugaaaaugcaa

SEQ ID NO: 1224056 - RNA, 16 nt, Homo sapiens
uggcugaggauuucaa

SEQ ID NO: 1224057 - RNA, 14 nt, Homo sapiens
uggcugccuuagaa

SEQ ID NO: 1224058 - RNA, 14 nt, Homo sapiens
uggcugcugcugug

SEQ ID NO: 1224059 - RNA, 17 nt, Homo sapiens
uggcugcuuuguucaau

SEQ ID NO: 1224060 - RNA, 17 nt, Homo sapiens
uggcuggaaggggucca

SEQ ID NO: 1224061 - RNA, 22 nt, Homo sapiens
uggcuggccacugcacagagcu

SEQ ID NO: 1224062 - RNA, 12 nt, Homo sapiens
uggcuggcugcc

SEQ ID NO: 1224063 - RNA, 16 nt, Homo sapiens
uggcuggcuuguuuga

SEQ ID NO: 1224064 - RNA, 22 nt, Homo sapiens
uggcuguggagagggucaagga

SEQ ID NO: 1224065 - RNA, 17 nt, Homo sapiens
uggcuguguuugcagcc

SEQ ID NO: 1224066 - RNA, 18 nt, Homo sapiens
uggcuuagaaaguccaau

SEQ ID NO: 1224067 - RNA, 23 nt, Homo sapiens
uggcuucaggcuaagaagagauu

SEQ ID NO: 1224068 - RNA, 23 nt, Homo sapiens
uggcuucccauuaaccugagguc

SEQ ID NO: 1224069 - RNA, 14 nt, Homo sapiens
uggcuugacuggau

SEQ ID NO: 1224070 - RNA, 19 nt, Homo sapiens
uggcuuguuugauuucaac

SEQ ID NO: 1224071 - RNA, 18 nt, Homo sapiens
uggcuuuagcuaccucac

SEQ ID NO: 1224072 - RNA, 22 nt, Homo sapiens
uggcuuuguuuuuugugcuauu

SEQ ID NO: 1224073 - RNA, 21 nt, Homo sapiens
uggcuuuugcggccaguauua

SEQ ID NO: 1224074 - RNA, 22 nt, Homo sapiens
ugggaaaaauucagagaguuag

SEQ ID NO: 1224075 - RNA, 16 nt, Homo sapiens
ugggaaaacauuugcu

SEQ ID NO: 1224076 - RNA, 14 nt, Homo sapiens
ugggaaaaccagac

SEQ ID NO: 1224077 - RNA, 15 nt, Homo sapiens
ugggaaaaccagacu

SEQ ID NO: 1224078 - RNA, 13 nt, Homo sapiens
ugggaaagcccag

SEQ ID NO: 1224079 - RNA, 18 nt, Homo sapiens
ugggaaaucaguguuuua

SEQ ID NO: 1224080 - RNA, 16 nt, Homo sapiens
ugggaacacgugugca

SEQ ID NO: 1224081 - RNA, 16 nt, Homo sapiens
ugggaacaggcugugu

SEQ ID NO: 1224082 - RNA, 15 nt, Homo sapiens
ugggaaccacuccca

SEQ ID NO: 1224083 - RNA, 15 nt, Homo sapiens
ugggaacuccacucu

SEQ ID NO: 1224084 - RNA, 18 nt, Homo sapiens
ugggaagaccagcuuugc

SEQ ID NO: 1224085 - RNA, 20 nt, Homo sapiens
ugggaagagcguagacaggu

SEQ ID NO: 1224086 - RNA, 19 nt, Homo sapiens
ugggaaggcuaaguucagu

SEQ ID NO: 1224087 - RNA, 22 nt, Homo sapiens
ugggaaggcuugggauuugcug

SEQ ID NO: 1224088 - RNA, 16 nt, Homo sapiens
ugggaagggcagggaa

SEQ ID NO: 1224089 - RNA, 21 nt, Homo sapiens
ugggaagggcucccagccaca

SEQ ID NO: 1224090 - RNA, 21 nt, Homo sapiens
ugggaccuuuuguacuuuauu

SEQ ID NO: 1224091 - RNA, 15 nt, Homo sapiens
ugggacucaggauau

SEQ ID NO: 1224092 - RNA, 20 nt, Homo sapiens
ugggacuguacacacuuuau

SEQ ID NO: 1224093 - RNA, 20 nt, Homo sapiens
ugggagacugaagacucagc

SEQ ID NO: 1224094 - RNA, 20 nt, Homo sapiens
ugggagacuggaaaagggaa

SEQ ID NO: 1224095 - RNA, 18 nt, Homo sapiens
ugggagcaggaacaauga

SEQ ID NO: 1224096 - RNA, 23 nt, Homo sapiens
ugggagcauagcagaggggccag

SEQ ID NO: 1224097 - RNA, 20 nt, Homo sapiens
ugggagccaggcccagaaag

SEQ ID NO: 1224098 - RNA, 11 nt, Homo sapiens
ugggaggacag

SEQ ID NO: 1224099 - RNA, 17 nt, Homo sapiens
ugggaggcuguggagcc

SEQ ID NO: 1224100 - RNA, 19 nt, Homo sapiens
ugggagggagguaacgggu

SEQ ID NO: 1224101 - RNA, 21 nt, Homo sapiens
ugggagggggcuugaagccaa

SEQ ID NO: 1224102 - RNA, 16 nt, Homo sapiens
ugggaggucuugcuag

SEQ ID NO: 1224103 - RNA, 15 nt, Homo sapiens
ugggagucacacagu

SEQ ID NO: 1224104 - RNA, 21 nt, Homo sapiens
ugggaguuauaggucauggga

SEQ ID NO: 1224105 - RNA, 23 nt, Homo sapiens
ugggauacuuagugguaugucuc

SEQ ID NO: 1224106 - RNA, 14 nt, Homo sapiens
ugggauauucccaa

SEQ ID NO: 1224107 - RNA, 23 nt, Homo sapiens
ugggaucacgaggaaaagagaag

SEQ ID NO: 1224108 - RNA, 13 nt, Homo sapiens
ugggaucauuuga

SEQ ID NO: 1224109 - RNA, 20 nt, Homo sapiens
ugggaugggcagaugggccu

SEQ ID NO: 1224110 - RNA, 15 nt, Homo sapiens
ugggauggggguacu

SEQ ID NO: 1224111 - RNA, 14 nt, Homo sapiens
ugggauuacaggca

SEQ ID NO: 1224112 - RNA, 15 nt, Homo sapiens
ugggauuacaggugu

SEQ ID NO: 1224113 - RNA, 21 nt, Homo sapiens
ugggcaaaacccacagaagac

SEQ ID NO: 1224114 - RNA, 15 nt, Homo sapiens
ugggcaacagaugaa

SEQ ID NO: 1224115 - RNA, 14 nt, Homo sapiens
ugggcacaguggac

SEQ ID NO: 1224116 - RNA, 14 nt, Homo sapiens
ugggcacaugccuu

SEQ ID NO: 1224117 - RNA, 12 nt, Homo sapiens
ugggcaccucag

SEQ ID NO: 1224118 - RNA, 16 nt, Homo sapiens
ugggcacuucaucuga

SEQ ID NO: 1224119 - RNA, 21 nt, Homo sapiens
ugggcaggcaggagcagggga

SEQ ID NO: 1224120 - RNA, 21 nt, Homo sapiens
ugggcaucugugccuucucua

SEQ ID NO: 1224121 - RNA, 16 nt, Homo sapiens
ugggcaugccauuaca

SEQ ID NO: 1224122 - RNA, 12 nt, Homo sapiens
ugggccaaagaa

SEQ ID NO: 1224123 - RNA, 14 nt, Homo sapiens
ugggccacagccau

SEQ ID NO: 1224124 - RNA, 20 nt, Homo sapiens
ugggccagugaacaggguaa

SEQ ID NO: 1224125 - RNA, 17 nt, Homo sapiens
ugggccauguccaaaga

SEQ ID NO: 1224126 - RNA, 20 nt, Homo sapiens
ugggccuccugacagcaaua

SEQ ID NO: 1224127 - RNA, 20 nt, Homo sapiens
ugggccuugcugcugcugca

SEQ ID NO: 1224128 - RNA, 21 nt, Homo sapiens
ugggcguuugaacucagggag

SEQ ID NO: 1224129 - RNA, 19 nt, Homo sapiens
ugggcuacccuaaagggag

SEQ ID NO: 1224130 - RNA, 20 nt, Homo sapiens
ugggcuccuggggcaauggg

SEQ ID NO: 1224131 - RNA, 23 nt, Homo sapiens
ugggcucugugcagucacuggag

SEQ ID NO: 1224132 - RNA, 13 nt, Homo sapiens
ugggcucuuccaa

SEQ ID NO: 1224133 - RNA, 18 nt, Homo sapiens
ugggcuggggcugcuccc

SEQ ID NO: 1224134 - RNA, 19 nt, Homo sapiens
ugggcuggugucaccugaa

SEQ ID NO: 1224135 - RNA, 23 nt, Homo sapiens
ugggcuguaacguggcacuggua

SEQ ID NO: 1224136 - RNA, 15 nt, Homo sapiens
ugggcugucugucac

SEQ ID NO: 1224137 - RNA, 18 nt, Homo sapiens
ugggcuugagcugcagaa

SEQ ID NO: 1224138 - RNA, 12 nt, Homo sapiens
uugauauacuuu

SEQ ID NO: 1224139 - RNA, 20 nt, Homo sapiens
uugauauuuauuuuuugcca

SEQ ID NO: 1224140 - RNA, 16 nt, Homo sapiens
uugauauuugcauuga

SEQ ID NO: 1224141 - RNA, 19 nt, Homo sapiens
uugauauuuuccaaaugga

SEQ ID NO: 1224142 - RNA, 12 nt, Homo sapiens
uugaucaaugaa

SEQ ID NO: 1224143 - RNA, 13 nt, Homo sapiens
uugaucagacuga

SEQ ID NO: 1224144 - RNA, 21 nt, Homo sapiens
uugaucuucagggaacugcau

SEQ ID NO: 1224145 - RNA, 17 nt, Homo sapiens
uugaugacccucugacc

SEQ ID NO: 1224146 - RNA, 11 nt, Homo sapiens
uugaugccaua

SEQ ID NO: 1224147 - RNA, 18 nt, Homo sapiens
uugaugccauaugccuug

SEQ ID NO: 1224148 - RNA, 18 nt, Homo sapiens
uugauguuuguggccuca

SEQ ID NO: 1224149 - RNA, 14 nt, Homo sapiens
uugauuaaugaacu

SEQ ID NO: 1224150 - RNA, 14 nt, Homo sapiens
uugauuacuuuuca

SEQ ID NO: 1224151 - RNA, 15 nt, Homo sapiens
uugauucuacucuua

SEQ ID NO: 1224152 - RNA, 16 nt, Homo sapiens
uugauucuacucuuau

SEQ ID NO: 1224153 - RNA, 12 nt, Homo sapiens
uugauucuugcc

SEQ ID NO: 1224154 - RNA, 21 nt, Homo sapiens
uugauugaggagcugcacuga

SEQ ID NO: 1224155 - RNA, 18 nt, Homo sapiens
uugauuuaugaguaauug

SEQ ID NO: 1224156 - RNA, 17 nt, Homo sapiens
uugauuuguagcacuga

SEQ ID NO: 1224157 - RNA, 15 nt, Homo sapiens
uugauuuuaaugaau

SEQ ID NO: 1224158 - RNA, 17 nt, Homo sapiens
uugauuuuauaugcuau

SEQ ID NO: 1224159 - RNA, 14 nt, Homo sapiens
uugauuuugugaua

SEQ ID NO: 1224160 - RNA, 19 nt, Homo sapiens
uugcaaagguuccaacugu

SEQ ID NO: 1224161 - RNA, 16 nt, Homo sapiens
uugcaaaucuugaaau

SEQ ID NO: 1224162 - RNA, 17 nt, Homo sapiens
uugcaaccacugcaacg

SEQ ID NO: 1224163 - RNA, 13 nt, Homo sapiens
uugcaagcauuga

SEQ ID NO: 1224164 - RNA, 17 nt, Homo sapiens
uugcaauacauuucaau

SEQ ID NO: 1224165 - RNA, 16 nt, Homo sapiens
uugcaaucuucuacuu

SEQ ID NO: 1224166 - RNA, 18 nt, Homo sapiens
uugcaauguggcuugaau

SEQ ID NO: 1224167 - RNA, 22 nt, Homo sapiens
uugcacaaauugggccaaagaa

SEQ ID NO: 1224168 - RNA, 18 nt, Homo sapiens
uugcacaauccaugaaca

SEQ ID NO: 1224169 - RNA, 16 nt, Homo sapiens
uugcacacugcacugu

SEQ ID NO: 1224170 - RNA, 13 nt, Homo sapiens
uugcacagaauuu

SEQ ID NO: 1224171 - RNA, 14 nt, Homo sapiens
uugcacagccaaau

SEQ ID NO: 1224172 - RNA, 11 nt, Homo sapiens
uugcacaggau

SEQ ID NO: 1224173 - RNA, 13 nt, Homo sapiens
uugcacauaguag

SEQ ID NO: 1224174 - RNA, 18 nt, Homo sapiens
uugcaccaaagacaucag

SEQ ID NO: 1224175 - RNA, 14 nt, Homo sapiens
uugcaccacugcac

SEQ ID NO: 1224176 - RNA, 22 nt, Homo sapiens
uugcaccucuguucauuucaca

SEQ ID NO: 1224177 - RNA, 18 nt, Homo sapiens
uugcacuguuuucugucg

SEQ ID NO: 1224178 - RNA, 23 nt, Homo sapiens
uugcacuuauauagcaccuuuca

SEQ ID NO: 1224179 - RNA, 20 nt, Homo sapiens
uugcagagaaccucagauca

SEQ ID NO: 1224180 - RNA, 18 nt, Homo sapiens
uugcaggcucugggcuca

SEQ ID NO: 1224181 - RNA, 13 nt, Homo sapiens
uugcagggcagcc

SEQ ID NO: 1224182 - RNA, 13 nt, Homo sapiens
uugcaguucugua

SEQ ID NO: 1224183 - RNA, 15 nt, Homo sapiens
uugcauacugaaaau

SEQ ID NO: 1224184 - RNA, 20 nt, Homo sapiens
uugcaucucuaauagagauu

SEQ ID NO: 1224185 - RNA, 17 nt, Homo sapiens
uugcaucuuuucuacuu

SEQ ID NO: 1224186 - RNA, 22 nt, Homo sapiens
uugcaugcuucgugccacacgc

SEQ ID NO: 1224187 - RNA, 14 nt, Homo sapiens
uugcaugcuugcau

SEQ ID NO: 1224188 - RNA, 16 nt, Homo sapiens
uugcauugacugucac

SEQ ID NO: 1224189 - RNA, 23 nt, Homo sapiens
uugccaacaccacagaaaugggg

SEQ ID NO: 1224190 - RNA, 17 nt, Homo sapiens
uugccaacucgaacaaa

SEQ ID NO: 1224191 - RNA, 20 nt, Homo sapiens
uugccaauucauuucucuau

SEQ ID NO: 1224192 - RNA, 21 nt, Homo sapiens
uugccacagaugauacuucca

SEQ ID NO: 1224193 - RNA, 18 nt, Homo sapiens
uugccaggggcauccaag

SEQ ID NO: 1224194 - RNA, 17 nt, Homo sapiens
uugccaguauuaugcau

SEQ ID NO: 1224195 - RNA, 20 nt, Homo sapiens
uugccauagcugacuacaaa

SEQ ID NO: 1224196 - RNA, 19 nt, Homo sapiens
uugccauuaaacuuaccug

SEQ ID NO: 1224197 - RNA, 23 nt, Homo sapiens
uugcccaggcuggagugcaaugg

SEQ ID NO: 1224198 - RNA, 23 nt, Homo sapiens
uugcccauugcacuuacauacca

SEQ ID NO: 1224199 - RNA, 17 nt, Homo sapiens
uugcccccagacuuccu

SEQ ID NO: 1224200 - RNA, 16 nt, Homo sapiens
uugcccuuuccauauu

SEQ ID NO: 1224201 - RNA, 13 nt, Homo sapiens
uugccguaccaau

SEQ ID NO: 1224202 - RNA, 19 nt, Homo sapiens
uugccucaaugccaguaac

SEQ ID NO: 1224203 - RNA, 13 nt, Homo sapiens
uugccuccucacc

SEQ ID NO: 1224204 - RNA, 16 nt, Homo sapiens
uugccucucucaggag

SEQ ID NO: 1224205 - RNA, 20 nt, Homo sapiens
uugccugccuggugugccuc

SEQ ID NO: 1224206 - RNA, 18 nt, Homo sapiens
uugccuucucuguucccu

SEQ ID NO: 1224207 - RNA, 20 nt, Homo sapiens
uugcgagccucgcagccucc

SEQ ID NO: 1224208 - RNA, 14 nt, Homo sapiens
uugcuaaagcacuu

SEQ ID NO: 1224209 - RNA, 17 nt, Homo sapiens
uugcuaacaaugcucug

SEQ ID NO: 1224210 - RNA, 14 nt, Homo sapiens
uugcuacauucuaa

SEQ ID NO: 1224211 - RNA, 12 nt, Homo sapiens
uugcuacuguca

SEQ ID NO: 1224212 - RNA, 14 nt, Homo sapiens
uugcuagccagcau

SEQ ID NO: 1224213 - RNA, 17 nt, Homo sapiens
uugcuagccaucuugau

SEQ ID NO: 1224214 - RNA, 14 nt, Homo sapiens
uugcuccuugacau

SEQ ID NO: 1224215 - RNA, 13 nt, Homo sapiens
uugcucuccuaga

SEQ ID NO: 1224216 - RNA, 12 nt, Homo sapiens
uugcucugccac

SEQ ID NO: 1224217 - RNA, 13 nt, Homo sapiens
uugcucugccacc

SEQ ID NO: 1224218 - RNA, 18 nt, Homo sapiens
uugcucuuacuacacuga

SEQ ID NO: 1224219 - RNA, 14 nt, Homo sapiens
uugcucuugccaaa

SEQ ID NO: 1224220 - RNA, 15 nt, Homo sapiens
uugcucuugccaaaa

SEQ ID NO: 1224221 - RNA, 17 nt, Homo sapiens
uugcucuugccaaaaaa

SEQ ID NO: 1224222 - RNA, 23 nt, Homo sapiens
uugcugacaaccauuaaagucag

SEQ ID NO: 1224223 - RNA, 18 nt, Homo sapiens
uugcugauggcuugacau

SEQ ID NO: 1224224 - RNA, 20 nt, Homo sapiens
uugcugccuuaaugacauuc

SEQ ID NO: 1224225 - RNA, 15 nt, Homo sapiens
uugcuggaguacuua

SEQ ID NO: 1224226 - RNA, 16 nt, Homo sapiens
uugcuggcucugagaa

SEQ ID NO: 1224227 - RNA, 18 nt, Homo sapiens
uugcugguagcacuugcu

SEQ ID NO: 1224228 - RNA, 19 nt, Homo sapiens
uugcuguccugaucuguga

SEQ ID NO: 1224229 - RNA, 13 nt, Homo sapiens
uugcuguguaaaa

SEQ ID NO: 1224230 - RNA, 16 nt, Homo sapiens
uugcuguucugcugaa

SEQ ID NO: 1224231 - RNA, 10 nt, Homo sapiens
uugcuuuaug

SEQ ID NO: 1224232 - RNA, 17 nt, Homo sapiens
uugcuuuugugaacuuu

SEQ ID NO: 1224233 - RNA, 20 nt, Homo sapiens
uuggaaaaaaaccacagcca

SEQ ID NO: 1224234 - RNA, 22 nt, Homo sapiens
uuggaaaaaaaccacagccacu

SEQ ID NO: 1224235 - RNA, 16 nt, Homo sapiens
uuggaaagaguucaag

SEQ ID NO: 1224236 - RNA, 21 nt, Homo sapiens
uuggaacaacugauacuucac

SEQ ID NO: 1224237 - RNA, 15 nt, Homo sapiens
uuggaagcauacaaa

SEQ ID NO: 1224238 - RNA, 22 nt, Homo sapiens
uuggaagccagguacaggagag

SEQ ID NO: 1224239 - RNA, 15 nt, Homo sapiens
uuggaaguacaugaa

SEQ ID NO: 1224240 - RNA, 19 nt, Homo sapiens
uuggaauuuguaaccucag

SEQ ID NO: 1224241 - RNA, 21 nt, Homo sapiens
uuggacaaguccuugaccucu

SEQ ID NO: 1224242 - RNA, 11 nt, Homo sapiens
uuggacacuug

SEQ ID NO: 1224243 - RNA, 20 nt, Homo sapiens
uuggacaggagucagugucu

SEQ ID NO: 1224244 - RNA, 17 nt, Homo sapiens
uuggacugauaaucucu

SEQ ID NO: 1224245 - RNA, 23 nt, Homo sapiens
uuggagacagagagacuggccag

SEQ ID NO: 1224246 - RNA, 15 nt, Homo sapiens
uuggagagacacagc

SEQ ID NO: 1224247 - RNA, 20 nt, Homo sapiens
uuggagagagauguuccucu

SEQ ID NO: 1224248 - RNA, 12 nt, Homo sapiens
uuggagcaaacc

SEQ ID NO: 1224249 - RNA, 14 nt, Homo sapiens
uuggagcaaaccau

SEQ ID NO: 1224250 - RNA, 12 nt, Homo sapiens
uuggagcacucu

SEQ ID NO: 1224251 - RNA, 21 nt, Homo sapiens
uuggagccaauguguggcuca

SEQ ID NO: 1224252 - RNA, 16 nt, Homo sapiens
uuggagccacuccugu

SEQ ID NO: 1224253 - RNA, 15 nt, Homo sapiens
uuggagcucuaucca

SEQ ID NO: 1224254 - RNA, 19 nt, Homo sapiens
uuggagcuuuuuucuuuaa

SEQ ID NO: 1224255 - RNA, 23 nt, Homo sapiens
uuggagggguauuuuugcccuga

SEQ ID NO: 1224256 - RNA, 18 nt, Homo sapiens
uuggagugcgggugggcu

SEQ ID NO: 1224257 - RNA, 19 nt, Homo sapiens
uuggaucuucaauggcuuu

SEQ ID NO: 1224258 - RNA, 12 nt, Homo sapiens
uuggaucuugaa

SEQ ID NO: 1224259 - RNA, 21 nt, Homo sapiens
uuggaugggagugggcaccuc

SEQ ID NO: 1224260 - RNA, 17 nt, Homo sapiens
uuggauuuauucugcca

SEQ ID NO: 1224261 - RNA, 18 nt, Homo sapiens
uuggauuuauucugccaa

SEQ ID NO: 1224262 - RNA, 23 nt, Homo sapiens
uuggauuuuugacucuggcaaag

SEQ ID NO: 1224263 - RNA, 13 nt, Homo sapiens
uuggcaacagaag

SEQ ID NO: 1224264 - RNA, 20 nt, Homo sapiens
uuggcaacagaagcaguuga

SEQ ID NO: 1224265 - RNA, 13 nt, Homo sapiens
uuuucaccccacc

SEQ ID NO: 1224266 - RNA, 21 nt, Homo sapiens
uuuucacugcuggcugccuua

SEQ ID NO: 1224267 - RNA, 21 nt, Homo sapiens
uuuucagcacccccacccacc

SEQ ID NO: 1224268 - RNA, 21 nt, Homo sapiens
uuuucauccuauaagcuuaaa

SEQ ID NO: 1224269 - RNA, 19 nt, Homo sapiens
uuuucauguagaacucagc

SEQ ID NO: 1224270 - RNA, 11 nt, Homo sapiens
uuuucauucau

SEQ ID NO: 1224271 - RNA, 12 nt, Homo sapiens
uuuucauuugag

SEQ ID NO: 1224272 - RNA, 14 nt, Homo sapiens
uuuuccaacuacua

SEQ ID NO: 1224273 - RNA, 12 nt, Homo sapiens
uuuuccacauuc

SEQ ID NO: 1224274 - RNA, 17 nt, Homo sapiens
uuuuccaucauuuuaca

SEQ ID NO: 1224275 - RNA, 23 nt, Homo sapiens
uuuucccaagagcauaacuguuc

SEQ ID NO: 1224276 - RNA, 19 nt, Homo sapiens
uuuuccccaaccacagaga

SEQ ID NO: 1224277 - RNA, 23 nt, Homo sapiens
uuuuccuucuacagcagcacugu

SEQ ID NO: 1224278 - RNA, 20 nt, Homo sapiens
uuuucuaaaaaaagaaaaaa

SEQ ID NO: 1224279 - RNA, 18 nt, Homo sapiens
uuuucuaaugugcauuaa

SEQ ID NO: 1224280 - RNA, 19 nt, Homo sapiens
uuuucucaaaggcccucag

SEQ ID NO: 1224281 - RNA, 13 nt, Homo sapiens
uuuucuccaaaua

SEQ ID NO: 1224282 - RNA, 17 nt, Homo sapiens
uuuucucuaacuucuca

SEQ ID NO: 1224283 - RNA, 22 nt, Homo sapiens
uuuucucuggaaugguacaugu

SEQ ID NO: 1224284 - RNA, 20 nt, Homo sapiens
uuuucucuuagaacauugua

SEQ ID NO: 1224285 - RNA, 21 nt, Homo sapiens
uuuucugagcuuuucauggaa

SEQ ID NO: 1224286 - RNA, 20 nt, Homo sapiens
uuuucugugauaacucugca

SEQ ID NO: 1224287 - RNA, 14 nt, Homo sapiens
uuuucugugccuga

SEQ ID NO: 1224288 - RNA, 18 nt, Homo sapiens
uuuucuguugaagauuaa

SEQ ID NO: 1224289 - RNA, 22 nt, Homo sapiens
uuuucuuacuagaccuguaacu

SEQ ID NO: 1224290 - RNA, 18 nt, Homo sapiens
uuuucuuauuuaacuuaa

SEQ ID NO: 1224291 - RNA, 19 nt, Homo sapiens
uuuucuuauuuaacuuaac

SEQ ID NO: 1224292 - RNA, 15 nt, Homo sapiens
uuuucuugccaauga

SEQ ID NO: 1224293 - RNA, 17 nt, Homo sapiens
uuuucuuugagucuguu

SEQ ID NO: 1224294 - RNA, 16 nt, Homo sapiens
uuuugaaaaugggcuc

SEQ ID NO: 1224295 - RNA, 14 nt, Homo sapiens
uuuugaaggcaaaa

SEQ ID NO: 1224296 - RNA, 20 nt, Homo sapiens
uuuugaauucugaccaugga

SEQ ID NO: 1224297 - RNA, 21 nt, Homo sapiens
uuuugagaguaaugcauacag

SEQ ID NO: 1224298 - RNA, 14 nt, Homo sapiens
uuuugagaguauau

SEQ ID NO: 1224299 - RNA, 17 nt, Homo sapiens
uuuugagcuaaucuuca

SEQ ID NO: 1224300 - RNA, 22 nt, Homo sapiens
uuuugauaacaaugacacuaga

SEQ ID NO: 1224301 - RNA, 17 nt, Homo sapiens
uuuugauuguuauguaa

SEQ ID NO: 1224302 - RNA, 23 nt, Homo sapiens
uuuugcaaauaaaauacuaaaca

SEQ ID NO: 1224303 - RNA, 12 nt, Homo sapiens
uuuugcauaaaa

SEQ ID NO: 1224304 - RNA, 20 nt, Homo sapiens
uuuugcauaaugcaaucaaa

SEQ ID NO: 1224305 - RNA, 15 nt, Homo sapiens
uuuugccaguauuau

SEQ ID NO: 1224306 - RNA, 21 nt, Homo sapiens
uuuugccaguauuaugcauau

SEQ ID NO: 1224307 - RNA, 18 nt, Homo sapiens
uuuugccucaccuaauag

SEQ ID NO: 1224308 - RNA, 15 nt, Homo sapiens
uuuugcucaguucca

SEQ ID NO: 1224309 - RNA, 18 nt, Homo sapiens
uuuuggguguuccuggca

SEQ ID NO: 1224310 - RNA, 15 nt, Homo sapiens
uuuuguaaacuguau

SEQ ID NO: 1224311 - RNA, 16 nt, Homo sapiens
uuuuguacugaaucuc

SEQ ID NO: 1224312 - RNA, 20 nt, Homo sapiens
uuuuguauuguuuucugaca

SEQ ID NO: 1224313 - RNA, 17 nt, Homo sapiens
uuuugugaaguauucac

SEQ ID NO: 1224314 - RNA, 11 nt, Homo sapiens
uuuugugaauu

SEQ ID NO: 1224315 - RNA, 15 nt, Homo sapiens
uuuuguuacuugcac

SEQ ID NO: 1224316 - RNA, 15 nt, Homo sapiens
uuuuguuauugggca

SEQ ID NO: 1224317 - RNA, 19 nt, Homo sapiens
uuuuguucucaacuucaaa

SEQ ID NO: 1224318 - RNA, 17 nt, Homo sapiens
uuuuguuggcauagcuc

SEQ ID NO: 1224319 - RNA, 16 nt, Homo sapiens
uuuuuaaguaacuuaa

SEQ ID NO: 1224320 - RNA, 20 nt, Homo sapiens
uuuuuaauagcuauggaauc

SEQ ID NO: 1224321 - RNA, 21 nt, Homo sapiens
uuuuuaauggcaauaggacau

SEQ ID NO: 1224322 - RNA, 23 nt, Homo sapiens
uuuuuaggcuguuccuuguacuc

SEQ ID NO: 1224323 - RNA, 22 nt, Homo sapiens
uuuuuauaaaaaugagugcuua

SEQ ID NO: 1224324 - RNA, 17 nt, Homo sapiens
uuuuuauacagugauaa

SEQ ID NO: 1224325 - RNA, 23 nt, Homo sapiens
uuuuuccaacacacacaacguaa

SEQ ID NO: 1224326 - RNA, 16 nt, Homo sapiens
uuuuucuaagguucuc

SEQ ID NO: 1224327 - RNA, 13 nt, Homo sapiens
uuuuucuauauuc

SEQ ID NO: 1224328 - RNA, 13 nt, Homo sapiens
uuuuucuccagcu

SEQ ID NO: 1224329 - RNA, 15 nt, Homo sapiens
uuuuucuuuuuccac

SEQ ID NO: 1224330 - RNA, 20 nt, Homo sapiens
uuuuugauccucuacugugc

SEQ ID NO: 1224331 - RNA, 15 nt, Homo sapiens
uuuuugccagacucu

SEQ ID NO: 1224332 - RNA, 13 nt, Homo sapiens
uuuuugguguaua

SEQ ID NO: 1224333 - RNA, 16 nt, Homo sapiens
uuuuuguaaacuggaa

SEQ ID NO: 1224334 - RNA, 14 nt, Homo sapiens
uuuuuguacuugga

SEQ ID NO: 1224335 - RNA, 19 nt, Homo sapiens
uuuuuuaaauaaaagcagc

SEQ ID NO: 1224336 - RNA, 17 nt, Homo sapiens
uuuuuugccaaggcuaa

SEQ ID NO: 1224337 - RNA, 16 nt, Homo sapiens
aauaaaugucuugccu

SEQ ID NO: 1224338 - RNA, 14 nt, Homo sapiens
aauaaaugugcuua

SEQ ID NO: 1224339 - RNA, 13 nt, Homo sapiens
aauaaauuguaaa

SEQ ID NO: 1224340 - RNA, 16 nt, Homo sapiens
aauaacaaacuaguca

SEQ ID NO: 1224341 - RNA, 19 nt, Homo sapiens
aauaacaacagaucugcag

SEQ ID NO: 1224342 - RNA, 13 nt, Homo sapiens
aauaacauguaau

SEQ ID NO: 1224343 - RNA, 15 nt, Homo sapiens
aauaacugaaccaaa

SEQ ID NO: 1224344 - RNA, 16 nt, Homo sapiens
aauaacugaaccaaau

SEQ ID NO: 1224345 - RNA, 12 nt, Homo sapiens
aauaacuugaag

SEQ ID NO: 1224346 - RNA, 20 nt, Homo sapiens
aauaacuuggagacagagag

SEQ ID NO: 1224347 - RNA, 15 nt, Homo sapiens
aauaagaucagacuc

SEQ ID NO: 1224348 - RNA, 18 nt, Homo sapiens
aauaagcccagugcugcu

SEQ ID NO: 1224349 - RNA, 14 nt, Homo sapiens
aauaauaaacagug

SEQ ID NO: 1224350 - RNA, 17 nt, Homo sapiens
aauaauaacaaucacaa

SEQ ID NO: 1224351 - RNA, 14 nt, Homo sapiens
aauaauacacuaau

SEQ ID NO: 1224352 - RNA, 19 nt, Homo sapiens
aauaauaccauaauacaug

SEQ ID NO: 1224353 - RNA, 22 nt, Homo sapiens
aauaaugaguuagaacuauuaa

SEQ ID NO: 1224354 - RNA, 16 nt, Homo sapiens
aauaauguacaucugg

SEQ ID NO: 1224355 - RNA, 20 nt, Homo sapiens
aauaauuaaaaaccacugaa

SEQ ID NO: 1224356 - RNA, 21 nt, Homo sapiens
aauaauuaaccaccaauccaa

SEQ ID NO: 1224357 - RNA, 15 nt, Homo sapiens
aauaauuaauuucau

SEQ ID NO: 1224358 - RNA, 14 nt, Homo sapiens
aauaauucuuccuc

SEQ ID NO: 1224359 - RNA, 12 nt, Homo sapiens
aauaauugcuca

SEQ ID NO: 1224360 - RNA, 15 nt, Homo sapiens
aauaauuguuccaaa

SEQ ID NO: 1224361 - RNA, 12 nt, Homo sapiens
aauacaaaaaug

SEQ ID NO: 1224362 - RNA, 15 nt, Homo sapiens
aauacaaacacaaaa

SEQ ID NO: 1224363 - RNA, 14 nt, Homo sapiens
aauacaacauguag

SEQ ID NO: 1224364 - RNA, 15 nt, Homo sapiens
aauacaaguuucuga

SEQ ID NO: 1224365 - RNA, 11 nt, Homo sapiens
aauacacaauu

SEQ ID NO: 1224366 - RNA, 12 nt, Homo sapiens
aauacacauuuc

SEQ ID NO: 1224367 - RNA, 15 nt, Homo sapiens
aauacagacaucuaa

SEQ ID NO: 1224368 - RNA, 13 nt, Homo sapiens
aauacagcacuuu

SEQ ID NO: 1224369 - RNA, 11 nt, Homo sapiens
aauacagugaa

SEQ ID NO: 1224370 - RNA, 20 nt, Homo sapiens
aauacagugagcucuagcaa

SEQ ID NO: 1224371 - RNA, 13 nt, Homo sapiens
aauacaguucugc

SEQ ID NO: 1224372 - RNA, 22 nt, Homo sapiens
aauacauuucaauuauacuaaa

SEQ ID NO: 1224373 - RNA, 24 nt, Homo sapiens
aauaccacuuuuaauuguuacuca

SEQ ID NO: 1224374 - RNA, 12 nt, Homo sapiens
aauaccauguac

SEQ ID NO: 1224375 - RNA, 17 nt, Homo sapiens
aauaccauuuaguaaga

SEQ ID NO: 1224376 - RNA, 13 nt, Homo sapiens
aauacuaccucug

SEQ ID NO: 1224377 - RNA, 14 nt, Homo sapiens
aauacuacuuucuc

SEQ ID NO: 1224378 - RNA, 23 nt, Homo sapiens
aauacuacuuucucaaaauggaa

SEQ ID NO: 1224379 - RNA, 14 nt, Homo sapiens
aauacuccuaagac

SEQ ID NO: 1224380 - RNA, 18 nt, Homo sapiens
aauacucugcagugauua

SEQ ID NO: 1224381 - RNA, 14 nt, Homo sapiens
aauacugcagcuug

SEQ ID NO: 1224382 - RNA, 17 nt, Homo sapiens
aauacugcuacagcaau

SEQ ID NO: 1224383 - RNA, 23 nt, Homo sapiens
aauacugcuugaccguacucuca

SEQ ID NO: 1224384 - RNA, 14 nt, Homo sapiens
aauacuuaacucaa

SEQ ID NO: 1224385 - RNA, 21 nt, Homo sapiens
aauacuuacuauaauuugacu

SEQ ID NO: 1224386 - RNA, 13 nt, Homo sapiens
aauacuuacuucu

SEQ ID NO: 1224387 - RNA, 14 nt, Homo sapiens
aauacuucucucuc

SEQ ID NO: 1224388 - RNA, 20 nt, Homo sapiens
aauacuugcaugaaugauuu

SEQ ID NO: 1224389 - RNA, 18 nt, Homo sapiens
aauacuuuuuacaauuaa

SEQ ID NO: 1224390 - RNA, 21 nt, Homo sapiens
aauacuuuuuucuaguuucag

SEQ ID NO: 1224391 - RNA, 22 nt, Homo sapiens
aauacuuuuuuuuuaaagccac

SEQ ID NO: 1224392 - RNA, 16 nt, Homo sapiens
aauagaaauaaauucc

SEQ ID NO: 1224393 - RNA, 13 nt, Homo sapiens
aauagaacacagu

SEQ ID NO: 1224394 - RNA, 23 nt, Homo sapiens
aauagaacuguuucaacuguaua

SEQ ID NO: 1224395 - RNA, 20 nt, Homo sapiens
aauagaagaacauccaagga

SEQ ID NO: 1224396 - RNA, 18 nt, Homo sapiens
aauagaaggauucaguca

SEQ ID NO: 1224397 - RNA, 13 nt, Homo sapiens
aauagacauguag

SEQ ID NO: 1224398 - RNA, 10 nt, Homo sapiens
aauagaucuc

SEQ ID NO: 1224399 - RNA, 18 nt, Homo sapiens
aauagaucuuagggugaa

SEQ ID NO: 1224400 - RNA, 13 nt, Homo sapiens
aauagaugauggu

SEQ ID NO: 1224401 - RNA, 19 nt, Homo sapiens
aauagcaacguagcuucua

SEQ ID NO: 1224402 - RNA, 14 nt, Homo sapiens
aauagcaaggugcu

SEQ ID NO: 1224403 - RNA, 15 nt, Homo sapiens
aauagcacaggugac

SEQ ID NO: 1224404 - RNA, 19 nt, Homo sapiens
aauagcagccuuucucucu

SEQ ID NO: 1224405 - RNA, 18 nt, Homo sapiens
aauagcaguuauaacaga

SEQ ID NO: 1224406 - RNA, 15 nt, Homo sapiens
aauagccacauuugg

SEQ ID NO: 1224407 - RNA, 17 nt, Homo sapiens
aauagccacauuuggaa

SEQ ID NO: 1224408 - RNA, 21 nt, Homo sapiens
aauagccuaauacaacaugua

SEQ ID NO: 1224409 - RNA, 15 nt, Homo sapiens
aauagcgccucuuuu

SEQ ID NO: 1224410 - RNA, 18 nt, Homo sapiens
aauagcuuagcggcaaga

SEQ ID NO: 1224411 - RNA, 16 nt, Homo sapiens
aauaggaacagcugaa

SEQ ID NO: 1224412 - RNA, 13 nt, Homo sapiens
aauagucaauuuc

SEQ ID NO: 1224413 - RNA, 14 nt, Homo sapiens
aauagucaucuccu

SEQ ID NO: 1224414 - RNA, 15 nt, Homo sapiens
aauagucuuugccag

SEQ ID NO: 1224415 - RNA, 15 nt, Homo sapiens
aauagugaaaugcca

SEQ ID NO: 1224416 - RNA, 21 nt, Homo sapiens
aauaguucaguagaauuacca

SEQ ID NO: 1224417 - RNA, 16 nt, Homo sapiens
aauauaaaaguaaaua

SEQ ID NO: 1224418 - RNA, 18 nt, Homo sapiens
aauauaagcugccauaua

SEQ ID NO: 1224419 - RNA, 14 nt, Homo sapiens
aauauacccaucca

SEQ ID NO: 1224420 - RNA, 19 nt, Homo sapiens
aauauagccuuuaaaucau

SEQ ID NO: 1224421 - RNA, 14 nt, Homo sapiens
aauauauaagcuca

SEQ ID NO: 1224422 - RNA, 17 nt, Homo sapiens
aauauauaauguugcca

SEQ ID NO: 1224423 - RNA, 13 nt, Homo sapiens
aauauaucaguaa

SEQ ID NO: 1224424 - RNA, 18 nt, Homo sapiens
aauaucagacaagcacua

SEQ ID NO: 1224425 - RNA, 19 nt, Homo sapiens
aauaucauuaaauuggaau

SEQ ID NO: 1224426 - RNA, 14 nt, Homo sapiens
aaucugaccaaaac

SEQ ID NO: 1224427 - RNA, 17 nt, Homo sapiens
aaucugugaugacauuc

SEQ ID NO: 1224428 - RNA, 20 nt, Homo sapiens
aaucugugaugacauucccu

SEQ ID NO: 1224429 - RNA, 19 nt, Homo sapiens
aaucuuaccagaugcuacu

SEQ ID NO: 1224430 - RNA, 18 nt, Homo sapiens
aaucuuagugaaugggaa

SEQ ID NO: 1224431 - RNA, 16 nt, Homo sapiens
aaucuuauacaacagc

SEQ ID NO: 1224432 - RNA, 13 nt, Homo sapiens
aaucuuaugcucu

SEQ ID NO: 1224433 - RNA, 22 nt, Homo sapiens
aaucuuauuccgagcauuccag

SEQ ID NO: 1224434 - RNA, 18 nt, Homo sapiens
aaucuucaaagccuucuc

SEQ ID NO: 1224435 - RNA, 15 nt, Homo sapiens
aaucuucuacuuuaa

SEQ ID NO: 1224436 - RNA, 21 nt, Homo sapiens
aaucuucucaucuuuuaucua

SEQ ID NO: 1224437 - RNA, 23 nt, Homo sapiens
aaucuucucuuugacaauuccua

SEQ ID NO: 1224438 - RNA, 20 nt, Homo sapiens
aaucuucugccuucucauga

SEQ ID NO: 1224439 - RNA, 21 nt, Homo sapiens
aaucuucugccuucucaugau

SEQ ID NO: 1224440 - RNA, 20 nt, Homo sapiens
aaucuuuguuacucuguaaa

SEQ ID NO: 1224441 - RNA, 17 nt, Homo sapiens
aaucuuuuaaaucuuug

SEQ ID NO: 1224442 - RNA, 20 nt, Homo sapiens
aaugaaaauaagugaauaau

SEQ ID NO: 1224443 - RNA, 24 nt, Homo sapiens
aaugaaagcauguggcauguucau

SEQ ID NO: 1224444 - RNA, 22 nt, Homo sapiens
aaugaacacucuuuugcuuuau

SEQ ID NO: 1224445 - RNA, 15 nt, Homo sapiens
aaugaagaugucuaa

SEQ ID NO: 1224446 - RNA, 16 nt, Homo sapiens
aaugaagcagcuuuaa

SEQ ID NO: 1224447 - RNA, 13 nt, Homo sapiens
aaugaauacuuuc

SEQ ID NO: 1224448 - RNA, 18 nt, Homo sapiens
aaugaaucuucacaaaac

SEQ ID NO: 1224449 - RNA, 20 nt, Homo sapiens
aaugaauuuuauaaucugca

SEQ ID NO: 1224450 - RNA, 14 nt, Homo sapiens
aaugacaaguauuu

SEQ ID NO: 1224451 - RNA, 21 nt, Homo sapiens
aaugacacgccuaaggucaca

SEQ ID NO: 1224452 - RNA, 22 nt, Homo sapiens
aaugacagauucugacauuuau

SEQ ID NO: 1224453 - RNA, 10 nt, Homo sapiens
aaugacauuc

SEQ ID NO: 1224454 - RNA, 18 nt, Homo sapiens
aaugacauugaacugaau

SEQ ID NO: 1224455 - RNA, 16 nt, Homo sapiens
aaugacgucacaagac

SEQ ID NO: 1224456 - RNA, 18 nt, Homo sapiens
aaugacuauauaauuuau

SEQ ID NO: 1224457 - RNA, 13 nt, Homo sapiens
aaugacugugcua

SEQ ID NO: 1224458 - RNA, 19 nt, Homo sapiens
aaugagaaggagucagaaa

SEQ ID NO: 1224459 - RNA, 15 nt, Homo sapiens
aaugagcaccuccau

SEQ ID NO: 1224460 - RNA, 19 nt, Homo sapiens
aaugagcucugaaaucuuc

SEQ ID NO: 1224461 - RNA, 19 nt, Homo sapiens
aaugaggaaaaaacccagc

SEQ ID NO: 1224462 - RNA, 22 nt, Homo sapiens
aaugaggauuauugauaguacu

SEQ ID NO: 1224463 - RNA, 16 nt, Homo sapiens
aaugaguauuugguaa

SEQ ID NO: 1224464 - RNA, 12 nt, Homo sapiens
aaugagugcuua

SEQ ID NO: 1224465 - RNA, 19 nt, Homo sapiens
aaugaguuagaacuauuaa

SEQ ID NO: 1224466 - RNA, 23 nt, Homo sapiens
aaugauacugcuuuucaccaaaa

SEQ ID NO: 1224467 - RNA, 19 nt, Homo sapiens
accucggccucccaaagug

SEQ ID NO: 1224468 - RNA, 13 nt, Homo sapiens
accucuacuuucc

SEQ ID NO: 1224469 - RNA, 12 nt, Homo sapiens
accucugaccaa

SEQ ID NO: 1224470 - RNA, 14 nt, Homo sapiens
accucugaccaaca

SEQ ID NO: 1224471 - RNA, 10 nt, Homo sapiens
accucugaga

SEQ ID NO: 1224472 - RNA, 19 nt, Homo sapiens
accucugauggcugaagaa

SEQ ID NO: 1224473 - RNA, 17 nt, Homo sapiens
accucugccugaaguca

SEQ ID NO: 1224474 - RNA, 20 nt, Homo sapiens
accucugccugaagucacac

SEQ ID NO: 1224475 - RNA, 23 nt, Homo sapiens
accucugccugaagucacacagu

SEQ ID NO: 1224476 - RNA, 17 nt, Homo sapiens
accucugggagcucaag

SEQ ID NO: 1224477 - RNA, 15 nt, Homo sapiens
accucugguccacac

SEQ ID NO: 1224478 - RNA, 15 nt, Homo sapiens
accucuuaugcacac

SEQ ID NO: 1224479 - RNA, 22 nt, Homo sapiens
accucuuccuccucgcugccag

SEQ ID NO: 1224480 - RNA, 21 nt, Homo sapiens
accucuugaaaauagaacaac

SEQ ID NO: 1224481 - RNA, 15 nt, Homo sapiens
accucuuucaggguu

SEQ ID NO: 1224482 - RNA, 16 nt, Homo sapiens
accucuuuuaaaucua

SEQ ID NO: 1224483 - RNA, 13 nt, Homo sapiens
accugaaagaagc

SEQ ID NO: 1224484 - RNA, 19 nt, Homo sapiens
accugaaauuuauucacau

SEQ ID NO: 1224485 - RNA, 13 nt, Homo sapiens
accugaagacacc

SEQ ID NO: 1224486 - RNA, 16 nt, Homo sapiens
accugaagacugagga

SEQ ID NO: 1224487 - RNA, 17 nt, Homo sapiens
accugaagacugaggac

SEQ ID NO: 1224488 - RNA, 18 nt, Homo sapiens
accugacaauggcagcua

SEQ ID NO: 1224489 - RNA, 18 nt, Homo sapiens
accugagaaauggccaaa

SEQ ID NO: 1224490 - RNA, 14 nt, Homo sapiens
accugagauggagg

SEQ ID NO: 1224491 - RNA, 23 nt, Homo sapiens
accugagggggcccaucccugcc

SEQ ID NO: 1224492 - RNA, 20 nt, Homo sapiens
accugagucugcaugugcac

SEQ ID NO: 1224493 - RNA, 21 nt, Homo sapiens
accugagucugcaugugcacg

SEQ ID NO: 1224494 - RNA, 18 nt, Homo sapiens
accugaucacuagccugu

SEQ ID NO: 1224495 - RNA, 15 nt, Homo sapiens
accugauuugaugau

SEQ ID NO: 1224496 - RNA, 19 nt, Homo sapiens
accugcagggacuccaugc

SEQ ID NO: 1224497 - RNA, 18 nt, Homo sapiens
accugcaguuaacaggau

SEQ ID NO: 1224498 - RNA, 13 nt, Homo sapiens
accugcaugugcu

SEQ ID NO: 1224499 - RNA, 22 nt, Homo sapiens
accugccaagagucaacagguc

SEQ ID NO: 1224500 - RNA, 19 nt, Homo sapiens
accugcccaaggaugcugu

SEQ ID NO: 1224501 - RNA, 22 nt, Homo sapiens
accugcccaaggaugcugucaa

SEQ ID NO: 1224502 - RNA, 22 nt, Homo sapiens
accugccccccacucugcacag

SEQ ID NO: 1224503 - RNA, 23 nt, Homo sapiens
accugcccugggccacacugacc

SEQ ID NO: 1224504 - RNA, 14 nt, Homo sapiens
accugcgcucucag

SEQ ID NO: 1224505 - RNA, 19 nt, Homo sapiens
accugcuuugugagccagc

SEQ ID NO: 1224506 - RNA, 21 nt, Homo sapiens
accuggcaacaaaaaguaaug

SEQ ID NO: 1224507 - RNA, 19 nt, Homo sapiens
accuggcccuugcaaucuu

SEQ ID NO: 1224508 - RNA, 19 nt, Homo sapiens
accuggccgcuaaguugcu

SEQ ID NO: 1224509 - RNA, 20 nt, Homo sapiens
accugggcccaggaccugcc

SEQ ID NO: 1224510 - RNA, 17 nt, Homo sapiens
accugggugugcccacg

SEQ ID NO: 1224511 - RNA, 15 nt, Homo sapiens
accuguacuaaacca

SEQ ID NO: 1224512 - RNA, 19 nt, Homo sapiens
accuguagucccaguuacu

SEQ ID NO: 1224513 - RNA, 21 nt, Homo sapiens
accugucaucauggaggucau

SEQ ID NO: 1224514 - RNA, 14 nt, Homo sapiens
accugucauuguau

SEQ ID NO: 1224515 - RNA, 17 nt, Homo sapiens
accugucucuaccuaag

SEQ ID NO: 1224516 - RNA, 22 nt, Homo sapiens
accugucuuccaaggagaccaa

SEQ ID NO: 1224517 - RNA, 17 nt, Homo sapiens
accugugaagcugaaaa

SEQ ID NO: 1224518 - RNA, 23 nt, Homo sapiens
acucuuguggucaucauggccag

SEQ ID NO: 1224519 - RNA, 18 nt, Homo sapiens
acucuuguugaguucugu

SEQ ID NO: 1224520 - RNA, 19 nt, Homo sapiens
acucuuucuggccugccuu

SEQ ID NO: 1224521 - RNA, 23 nt, Homo sapiens
acugaaaaaugguaauuguugcu

SEQ ID NO: 1224522 - RNA, 22 nt, Homo sapiens
acugaaaaugauuccuggacau

SEQ ID NO: 1224523 - RNA, 14 nt, Homo sapiens
acugaaaaugugcu

SEQ ID NO: 1224524 - RNA, 15 nt, Homo sapiens
acugaaacauucaca

SEQ ID NO: 1224525 - RNA, 12 nt, Homo sapiens
acugaaaccaaa

SEQ ID NO: 1224526 - RNA, 15 nt, Homo sapiens
acugaaagaagacau

SEQ ID NO: 1224527 - RNA, 14 nt, Homo sapiens
acugaaagcacuag

SEQ ID NO: 1224528 - RNA, 14 nt, Homo sapiens
acugaaaguuuaac

SEQ ID NO: 1224529 - RNA, 12 nt, Homo sapiens
acugaacauguu

SEQ ID NO: 1224530 - RNA, 13 nt, Homo sapiens
acugaacauguuu

SEQ ID NO: 1224531 - RNA, 13 nt, Homo sapiens
acugaaccaaauu

SEQ ID NO: 1224532 - RNA, 12 nt, Homo sapiens
acugaagccaca

SEQ ID NO: 1224533 - RNA, 13 nt, Homo sapiens
acugaaggcauau

SEQ ID NO: 1224534 - RNA, 19 nt, Homo sapiens
acugaaggcauaugcuggc

SEQ ID NO: 1224535 - RNA, 18 nt, Homo sapiens
acugaagugaacuaugaa

SEQ ID NO: 1224536 - RNA, 14 nt, Homo sapiens
acugaaguggcuaa

SEQ ID NO: 1224537 - RNA, 17 nt, Homo sapiens
acugaaguuucacauga

SEQ ID NO: 1224538 - RNA, 14 nt, Homo sapiens
acugaaugagguca

SEQ ID NO: 1224539 - RNA, 19 nt, Homo sapiens
acugaauguuuauuccuug

SEQ ID NO: 1224540 - RNA, 22 nt, Homo sapiens
acugaauuuggaggcuggagua

SEQ ID NO: 1224541 - RNA, 20 nt, Homo sapiens
acugaauuuugggacuucua

SEQ ID NO: 1224542 - RNA, 22 nt, Homo sapiens
acugacaacaugcuagguagug

SEQ ID NO: 1224543 - RNA, 14 nt, Homo sapiens
acugacacaggaaa

SEQ ID NO: 1224544 - RNA, 20 nt, Homo sapiens
acugacaugauuagcagaag

SEQ ID NO: 1224545 - RNA, 11 nt, Homo sapiens
acugaccagcc

SEQ ID NO: 1224546 - RNA, 16 nt, Homo sapiens
acugaccagccuccau

SEQ ID NO: 1224547 - RNA, 20 nt, Homo sapiens
acugaccauauugugcuuca

SEQ ID NO: 1224548 - RNA, 17 nt, Homo sapiens
acugacucaacauggag

SEQ ID NO: 1224549 - RNA, 17 nt, Homo sapiens
acugacugccuugcuaa

SEQ ID NO: 1224550 - RNA, 20 nt, Homo sapiens
acugacuuguuugucuucca

SEQ ID NO: 1224551 - RNA, 14 nt, Homo sapiens
acugagagcgagau

SEQ ID NO: 1224552 - RNA, 14 nt, Homo sapiens
acugagcauuugca

SEQ ID NO: 1224553 - RNA, 16 nt, Homo sapiens
acugagccaugcucag

SEQ ID NO: 1224554 - RNA, 22 nt, Homo sapiens
acugagccccgcagaccucccc

SEQ ID NO: 1224555 - RNA, 20 nt, Homo sapiens
acugagcuccccagaucucc

SEQ ID NO: 1224556 - RNA, 15 nt, Homo sapiens
acugaggaauuucac

SEQ ID NO: 1224557 - RNA, 23 nt, Homo sapiens
acugaggcccagggaggugaccc

SEQ ID NO: 1224558 - RNA, 23 nt, Homo sapiens
acugaguccucguagccaucucu

SEQ ID NO: 1224559 - RNA, 20 nt, Homo sapiens
acugaguguuauuugcacac

SEQ ID NO: 1224560 - RNA, 14 nt, Homo sapiens
acugaguucuauca

SEQ ID NO: 1224561 - RNA, 16 nt, Homo sapiens
acugauacacuugaag

SEQ ID NO: 1224562 - RNA, 18 nt, Homo sapiens
acugauacuucacuacuu

SEQ ID NO: 1224563 - RNA, 15 nt, Homo sapiens
acugauagaugucua

SEQ ID NO: 1224564 - RNA, 20 nt, Homo sapiens
acugauccaguauaagacua

SEQ ID NO: 1224565 - RNA, 15 nt, Homo sapiens
acugaucuuacucac

SEQ ID NO: 1224566 - RNA, 13 nt, Homo sapiens
acugauguuacua

SEQ ID NO: 1224567 - RNA, 19 nt, Homo sapiens
acugauucucuacaugcuc

SEQ ID NO: 1224568 - RNA, 14 nt, Homo sapiens
acugauuucacaac

SEQ ID NO: 1224569 - RNA, 20 nt, Homo sapiens
acugauuucacaacagauca

SEQ ID NO: 1224570 - RNA, 15 nt, Homo sapiens
acugauuugauacca

SEQ ID NO: 1224571 - RNA, 18 nt, Homo sapiens
acugauuugauaccaugg

SEQ ID NO: 1224572 - RNA, 21 nt, Homo sapiens
acugauuuuguaaaguugccu

SEQ ID NO: 1224573 - RNA, 19 nt, Homo sapiens
acugcaacaacgccuggug

SEQ ID NO: 1224574 - RNA, 21 nt, Homo sapiens
acugcaacaacgccuggugcc

SEQ ID NO: 1224575 - RNA, 15 nt, Homo sapiens
acugcaaccucugcc

SEQ ID NO: 1224576 - RNA, 23 nt, Homo sapiens
acugcaaccucugccucccaggu

SEQ ID NO: 1224577 - RNA, 20 nt, Homo sapiens
acugcacacacagcuccucu

SEQ ID NO: 1224578 - RNA, 18 nt, Homo sapiens
acugcacagugcaucuca

SEQ ID NO: 1224579 - RNA, 17 nt, Homo sapiens
acugcacccagcuccag

SEQ ID NO: 1224580 - RNA, 20 nt, Homo sapiens
acugcacuauagccuaggug

SEQ ID NO: 1224581 - RNA, 15 nt, Homo sapiens
acugcacucuucagg

SEQ ID NO: 1224582 - RNA, 16 nt, Homo sapiens
acugcagcaccuccag

SEQ ID NO: 1224583 - RNA, 19 nt, Homo sapiens
acugcagcaggccacuggg

SEQ ID NO: 1224584 - RNA, 18 nt, Homo sapiens
acugcagugaccacuuau

SEQ ID NO: 1224585 - RNA, 19 nt, Homo sapiens
acugcauuuuuaaauacaa

SEQ ID NO: 1224586 - RNA, 12 nt, Homo sapiens
acugccaagugg

SEQ ID NO: 1224587 - RNA, 16 nt, Homo sapiens
acugccacacucucca

SEQ ID NO: 1224588 - RNA, 14 nt, Homo sapiens
acugccacaucauu

SEQ ID NO: 1224589 - RNA, 17 nt, Homo sapiens
agcuaguggcuucaaaa

SEQ ID NO: 1224590 - RNA, 17 nt, Homo sapiens
agcuaguuaggagccca

SEQ ID NO: 1224591 - RNA, 14 nt, Homo sapiens
agcuauauccaugu

SEQ ID NO: 1224592 - RNA, 16 nt, Homo sapiens
agcuaucugucaucuc

SEQ ID NO: 1224593 - RNA, 15 nt, Homo sapiens
agcuaugaaaccacu

SEQ ID NO: 1224594 - RNA, 17 nt, Homo sapiens
agcuaugaaaccacugc

SEQ ID NO: 1224595 - RNA, 17 nt, Homo sapiens
agcuauucucaugccuc

SEQ ID NO: 1224596 - RNA, 20 nt, Homo sapiens
agcuauuuaagaaaaguauc

SEQ ID NO: 1224597 - RNA, 21 nt, Homo sapiens
agcucaagucuucccugauca

SEQ ID NO: 1224598 - RNA, 19 nt, Homo sapiens
agcucaccacugugccuac

SEQ ID NO: 1224599 - RNA, 21 nt, Homo sapiens
agcucacccugcccgcuccca

SEQ ID NO: 1224600 - RNA, 15 nt, Homo sapiens
agcucacugcugauc

SEQ ID NO: 1224601 - RNA, 12 nt, Homo sapiens
agcucacuuccu

SEQ ID NO: 1224602 - RNA, 19 nt, Homo sapiens
agcucagaaacgaaaucua

SEQ ID NO: 1224603 - RNA, 16 nt, Homo sapiens
agcucagaacccaggg

SEQ ID NO: 1224604 - RNA, 16 nt, Homo sapiens
agcucagccagugggg

SEQ ID NO: 1224605 - RNA, 23 nt, Homo sapiens
agcucagcgccagccugucccau

SEQ ID NO: 1224606 - RNA, 23 nt, Homo sapiens
agcucaggaaggggugugcugag

SEQ ID NO: 1224607 - RNA, 18 nt, Homo sapiens
agcucagggacuggcaca

SEQ ID NO: 1224608 - RNA, 22 nt, Homo sapiens
agcucagggacuggcacacugg

SEQ ID NO: 1224609 - RNA, 13 nt, Homo sapiens
agcucaggugccu

SEQ ID NO: 1224610 - RNA, 12 nt, Homo sapiens
agcucagguggg

SEQ ID NO: 1224611 - RNA, 20 nt, Homo sapiens
agcucaguaauuccuguuac

SEQ ID NO: 1224612 - RNA, 11 nt, Homo sapiens
agcucaugccc

SEQ ID NO: 1224613 - RNA, 18 nt, Homo sapiens
agcucauuuuuaaaggag

SEQ ID NO: 1224614 - RNA, 17 nt, Homo sapiens
agcuccaauuucaagag

SEQ ID NO: 1224615 - RNA, 22 nt, Homo sapiens
agcuccagauccaguaucuugu

SEQ ID NO: 1224616 - RNA, 15 nt, Homo sapiens
agcucccagccacau

SEQ ID NO: 1224617 - RNA, 22 nt, Homo sapiens
agcuccuccucggaaccgcuca

SEQ ID NO: 1224618 - RNA, 22 nt, Homo sapiens
agcuccucggacaccaagcaga

SEQ ID NO: 1224619 - RNA, 18 nt, Homo sapiens
agcuccucuccuugggcu

SEQ ID NO: 1224620 - RNA, 18 nt, Homo sapiens
agcuccuggccaggauaa

SEQ ID NO: 1224621 - RNA, 21 nt, Homo sapiens
agcuccuuggagcaggcaaaa

SEQ ID NO: 1224622 - RNA, 19 nt, Homo sapiens
agcuccuuuauuauaauca

SEQ ID NO: 1224623 - RNA, 23 nt, Homo sapiens
agcuccuuuauuauaaucaaagc

SEQ ID NO: 1224624 - RNA, 12 nt, Homo sapiens
agcucucuaggc

SEQ ID NO: 1224625 - RNA, 12 nt, Homo sapiens
agcucucuggga

SEQ ID NO: 1224626 - RNA, 13 nt, Homo sapiens
agcucucuugccg

SEQ ID NO: 1224627 - RNA, 21 nt, Homo sapiens
agcucucuugccgaggagcca

SEQ ID NO: 1224628 - RNA, 22 nt, Homo sapiens
agcucuggggugggcaguuuuu

SEQ ID NO: 1224629 - RNA, 17 nt, Homo sapiens
agcucuguaucugccau

SEQ ID NO: 1224630 - RNA, 18 nt, Homo sapiens
agcucuguauggucagga

SEQ ID NO: 1224631 - RNA, 15 nt, Homo sapiens
agcucuguguugcca

SEQ ID NO: 1224632 - RNA, 17 nt, Homo sapiens
agcucuucaggccuccc

SEQ ID NO: 1224633 - RNA, 21 nt, Homo sapiens
agcucuuggccuuugcauuua

SEQ ID NO: 1224634 - RNA, 22 nt, Homo sapiens
agcugaaagauugauuaaugaa

SEQ ID NO: 1224635 - RNA, 23 nt, Homo sapiens
agcugaaauuuuagaaauauuca

SEQ ID NO: 1224636 - RNA, 14 nt, Homo sapiens
agcugaagaacuug

SEQ ID NO: 1224637 - RNA, 22 nt, Homo sapiens
agcugaagaccauggauuucau

SEQ ID NO: 1224638 - RNA, 15 nt, Homo sapiens
agcugaagcuggugc

SEQ ID NO: 1224639 - RNA, 17 nt, Homo sapiens
agcugaaggcaguggca

SEQ ID NO: 1224640 - RNA, 13 nt, Homo sapiens
agcugaaugccuc

SEQ ID NO: 1224641 - RNA, 20 nt, Homo sapiens
agcugaaugccuccuguggg

SEQ ID NO: 1224642 - RNA, 13 nt, Homo sapiens
agcugaccagaca

SEQ ID NO: 1224643 - RNA, 13 nt, Homo sapiens
agcugaccuggag

SEQ ID NO: 1224644 - RNA, 18 nt, Homo sapiens
agcugagaauguggaaua

SEQ ID NO: 1224645 - RNA, 15 nt, Homo sapiens
agcugagagacuuuu

SEQ ID NO: 1224646 - RNA, 15 nt, Homo sapiens
agcugaggacucugc

SEQ ID NO: 1224647 - RNA, 21 nt, Homo sapiens
agcugaguggccagccagugc

SEQ ID NO: 1224648 - RNA, 23 nt, Homo sapiens
agcugaucugcggaucucagcuu

SEQ ID NO: 1224649 - RNA, 14 nt, Homo sapiens
agcugcacaugugc

SEQ ID NO: 1224650 - RNA, 14 nt, Homo sapiens
agcugcaccugcca

SEQ ID NO: 1224651 - RNA, 18 nt, Homo sapiens
agcugcagaaugacucca

SEQ ID NO: 1224652 - RNA, 22 nt, Homo sapiens
agcugcagcucuccaccagcug

SEQ ID NO: 1224653 - RNA, 18 nt, Homo sapiens
agcugcaggggugccugg

SEQ ID NO: 1224654 - RNA, 13 nt, Homo sapiens
agcugcauuucag

SEQ ID NO: 1224655 - RNA, 17 nt, Homo sapiens
agcugccaggcugaaaa

SEQ ID NO: 1224656 - RNA, 14 nt, Homo sapiens
aggagacagccuca

SEQ ID NO: 1224657 - RNA, 22 nt, Homo sapiens
aggagaccuacccuccacaggc

SEQ ID NO: 1224658 - RNA, 20 nt, Homo sapiens
aggagaccuggcacuggaug

SEQ ID NO: 1224659 - RNA, 21 nt, Homo sapiens
aggagacuuuacauggaugcc

SEQ ID NO: 1224660 - RNA, 20 nt, Homo sapiens
aggagagaaagugggugaga

SEQ ID NO: 1224661 - RNA, 13 nt, Homo sapiens
aggagauacugaa

SEQ ID NO: 1224662 - RNA, 11 nt, Homo sapiens
aggagauucca

SEQ ID NO: 1224663 - RNA, 14 nt, Homo sapiens
aggagcaaaacgcc

SEQ ID NO: 1224664 - RNA, 21 nt, Homo sapiens
aggagcagcucuucagcacaa

SEQ ID NO: 1224665 - RNA, 16 nt, Homo sapiens
aggagcauccucugcu

SEQ ID NO: 1224666 - RNA, 17 nt, Homo sapiens
aggagccggugcucugg

SEQ ID NO: 1224667 - RNA, 20 nt, Homo sapiens
aggagcggccagaagaucua

SEQ ID NO: 1224668 - RNA, 13 nt, Homo sapiens
aggagcuacccuu

SEQ ID NO: 1224669 - RNA, 18 nt, Homo sapiens
aggagcucuacccugcuc

SEQ ID NO: 1224670 - RNA, 17 nt, Homo sapiens
aggagcugagguuucac

SEQ ID NO: 1224671 - RNA, 21 nt, Homo sapiens
aggagcugcuggcuugcagug

SEQ ID NO: 1224672 - RNA, 18 nt, Homo sapiens
aggagcuuccagcucuaa

SEQ ID NO: 1224673 - RNA, 17 nt, Homo sapiens
aggagcuugggugugcu

SEQ ID NO: 1224674 - RNA, 14 nt, Homo sapiens
aggaggagcaccuc

SEQ ID NO: 1224675 - RNA, 18 nt, Homo sapiens
aggaggagggaggccagg

SEQ ID NO: 1224676 - RNA, 20 nt, Homo sapiens
aggaggcagagguugcagug

SEQ ID NO: 1224677 - RNA, 18 nt, Homo sapiens
aggaggcgcccuuggcuu

SEQ ID NO: 1224678 - RNA, 15 nt, Homo sapiens
aggaggcuggugaca

SEQ ID NO: 1224679 - RNA, 19 nt, Homo sapiens
aggagggccgaggugggcu

SEQ ID NO: 1224680 - RNA, 16 nt, Homo sapiens
aggaggggguucuucc

SEQ ID NO: 1224681 - RNA, 20 nt, Homo sapiens
aggaggguauggugcugcuc

SEQ ID NO: 1224682 - RNA, 22 nt, Homo sapiens
aggaggugcuaucgcaccacug

SEQ ID NO: 1224683 - RNA, 23 nt, Homo sapiens
aggaggugcuaucgcaccacugu

SEQ ID NO: 1224684 - RNA, 21 nt, Homo sapiens
aggaggugggauaucacuucc

SEQ ID NO: 1224685 - RNA, 11 nt, Homo sapiens
aggaguacaau

SEQ ID NO: 1224686 - RNA, 17 nt, Homo sapiens
aggagucagaaacuguu

SEQ ID NO: 1224687 - RNA, 14 nt, Homo sapiens
aggagucgggagca

SEQ ID NO: 1224688 - RNA, 15 nt, Homo sapiens
aggagugccagcuca

SEQ ID NO: 1224689 - RNA, 20 nt, Homo sapiens
aggagugggaaaacacugcc

SEQ ID NO: 1224690 - RNA, 22 nt, Homo sapiens
aggagugggaaaacacugccau

SEQ ID NO: 1224691 - RNA, 21 nt, Homo sapiens
aggaguguccucuucccucuc

SEQ ID NO: 1224692 - RNA, 17 nt, Homo sapiens
aggagugugaccacuga

SEQ ID NO: 1224693 - RNA, 19 nt, Homo sapiens
aggagugugugacauucca

SEQ ID NO: 1224694 - RNA, 23 nt, Homo sapiens
aggagugugugacauuccagggg

SEQ ID NO: 1224695 - RNA, 13 nt, Homo sapiens
aggaguucaagac

SEQ ID NO: 1224696 - RNA, 15 nt, Homo sapiens
aggaguuccaccaug

SEQ ID NO: 1224697 - RNA, 19 nt, Homo sapiens
aggauaaggaggcacugcu

SEQ ID NO: 1224698 - RNA, 18 nt, Homo sapiens
aggauacuuuacaugguu

SEQ ID NO: 1224699 - RNA, 18 nt, Homo sapiens
aggauauacugcagcuuu

SEQ ID NO: 1224700 - RNA, 19 nt, Homo sapiens
aggauauuugagucacuug

SEQ ID NO: 1224701 - RNA, 21 nt, Homo sapiens
aggauauuugagucacuugug

SEQ ID NO: 1224702 - RNA, 17 nt, Homo sapiens
aggauauuugcacuauu

SEQ ID NO: 1224703 - RNA, 17 nt, Homo sapiens
aggauccaagcuaagca

SEQ ID NO: 1224704 - RNA, 19 nt, Homo sapiens
aggaucccugaucccauuu

SEQ ID NO: 1224705 - RNA, 19 nt, Homo sapiens
aggauccucuccacuccau

SEQ ID NO: 1224706 - RNA, 22 nt, Homo sapiens
aggaucuccuguccaucagcca

SEQ ID NO: 1224707 - RNA, 14 nt, Homo sapiens
aggaucucucagga

SEQ ID NO: 1224708 - RNA, 23 nt, Homo sapiens
aggaucucugagaccacagaggc

SEQ ID NO: 1224709 - RNA, 14 nt, Homo sapiens
aggaucuguacaau

SEQ ID NO: 1224710 - RNA, 14 nt, Homo sapiens
aggaugaauguaug

SEQ ID NO: 1224711 - RNA, 21 nt, Homo sapiens
aggaugaauguaugugcacug

SEQ ID NO: 1224712 - RNA, 23 nt, Homo sapiens
aggaugacuaacaagauuuguaa

SEQ ID NO: 1224713 - RNA, 19 nt, Homo sapiens
agggaaccgugauaagccu

SEQ ID NO: 1224714 - RNA, 15 nt, Homo sapiens
agggaaccugugucc

SEQ ID NO: 1224715 - RNA, 17 nt, Homo sapiens
agggaagcagccuggaa

SEQ ID NO: 1224716 - RNA, 13 nt, Homo sapiens
agggaagccaaaa

SEQ ID NO: 1224717 - RNA, 21 nt, Homo sapiens
agggaagcugucccucacugu

SEQ ID NO: 1224718 - RNA, 13 nt, Homo sapiens
agggaagugugag

SEQ ID NO: 1224719 - RNA, 16 nt, Homo sapiens
agggaauacugugcau

SEQ ID NO: 1224720 - RNA, 16 nt, Homo sapiens
agggaaucagggacca

SEQ ID NO: 1224721 - RNA, 13 nt, Homo sapiens
agggaauccuccu

SEQ ID NO: 1224722 - RNA, 16 nt, Homo sapiens
agggaauggagcucag

SEQ ID NO: 1224723 - RNA, 14 nt, Homo sapiens
agggaauugcucag

SEQ ID NO: 1224724 - RNA, 17 nt, Homo sapiens
agggacaaaacacugug

SEQ ID NO: 1224725 - RNA, 15 nt, Homo sapiens
agggacagagcauug

SEQ ID NO: 1224726 - RNA, 16 nt, Homo sapiens
agggaccuucaugccc

SEQ ID NO: 1224727 - RNA, 23 nt, Homo sapiens
agggacggggaagccgagcucca

SEQ ID NO: 1224728 - RNA, 13 nt, Homo sapiens
agggacuggcaca

SEQ ID NO: 1224729 - RNA, 17 nt, Homo sapiens
agggacuuuagagaaua

SEQ ID NO: 1224730 - RNA, 17 nt, Homo sapiens
agggagaaaaagaaaca

SEQ ID NO: 1224731 - RNA, 14 nt, Homo sapiens
agggagagccagcu

SEQ ID NO: 1224732 - RNA, 18 nt, Homo sapiens
agggagcucugaugagca

SEQ ID NO: 1224733 - RNA, 16 nt, Homo sapiens
agggagguuugugaga

SEQ ID NO: 1224734 - RNA, 18 nt, Homo sapiens
agggagugcacauaucca

SEQ ID NO: 1224735 - RNA, 13 nt, Homo sapiens
agggaguguuccg

SEQ ID NO: 1224736 - RNA, 15 nt, Homo sapiens
agggauaauacugug

SEQ ID NO: 1224737 - RNA, 12 nt, Homo sapiens
agggaucacugg

SEQ ID NO: 1224738 - RNA, 19 nt, Homo sapiens
agggaucucucuacaagag

SEQ ID NO: 1224739 - RNA, 16 nt, Homo sapiens
agggauggagaaagaa

SEQ ID NO: 1224740 - RNA, 19 nt, Homo sapiens
agggauuuucacagugugc

SEQ ID NO: 1224741 - RNA, 13 nt, Homo sapiens
agggcaccagagg

SEQ ID NO: 1224742 - RNA, 14 nt, Homo sapiens
agggcacugggcug

SEQ ID NO: 1224743 - RNA, 18 nt, Homo sapiens
agggcacuguguuugccu

SEQ ID NO: 1224744 - RNA, 21 nt, Homo sapiens
agggcagagucuaccuugaaa

SEQ ID NO: 1224745 - RNA, 16 nt, Homo sapiens
agggcagcuccagugc

SEQ ID NO: 1224746 - RNA, 19 nt, Homo sapiens
agggcagggccaguuccuc

SEQ ID NO: 1224747 - RNA, 18 nt, Homo sapiens
agggccaagcaccuagcc

SEQ ID NO: 1224748 - RNA, 21 nt, Homo sapiens
agggccaccccacucuaccuc

SEQ ID NO: 1224749 - RNA, 16 nt, Homo sapiens
agggccaggacugagc

SEQ ID NO: 1224750 - RNA, 10 nt, Homo sapiens
agggccaguc

SEQ ID NO: 1224751 - RNA, 19 nt, Homo sapiens
agggcccacccaugucacc

SEQ ID NO: 1224752 - RNA, 20 nt, Homo sapiens
agggcgagacuccgucucaa

SEQ ID NO: 1224753 - RNA, 19 nt, Homo sapiens
agggcuccagcauccagcc

SEQ ID NO: 1224754 - RNA, 19 nt, Homo sapiens
agggcuccugcacuuacuu

SEQ ID NO: 1224755 - RNA, 14 nt, Homo sapiens
agggcucuuugaug

SEQ ID NO: 1224756 - RNA, 12 nt, Homo sapiens
agggcugaccca

SEQ ID NO: 1224757 - RNA, 15 nt, Homo sapiens
agggcugagugucca

SEQ ID NO: 1224758 - RNA, 18 nt, Homo sapiens
agggcugauggaggaaaa

SEQ ID NO: 1224759 - RNA, 18 nt, Homo sapiens
agggcuggcaccucucaa

SEQ ID NO: 1224760 - RNA, 22 nt, Homo sapiens
aggggaaaagaaaaucuuuuaa

SEQ ID NO: 1224761 - RNA, 14 nt, Homo sapiens
aggggacaacaaua

SEQ ID NO: 1224762 - RNA, 15 nt, Homo sapiens
aggggacaagggauu

SEQ ID NO: 1224763 - RNA, 21 nt, Homo sapiens
aggggaccacaccucccugaa

SEQ ID NO: 1224764 - RNA, 16 nt, Homo sapiens
aggggacccauguaau

SEQ ID NO: 1224765 - RNA, 18 nt, Homo sapiens
aggggacccauguaaucc

SEQ ID NO: 1224766 - RNA, 19 nt, Homo sapiens
aggggauugaagcccucca

SEQ ID NO: 1224767 - RNA, 14 nt, Homo sapiens
aggggcaacgaaga

SEQ ID NO: 1224768 - RNA, 16 nt, Homo sapiens
aggggcacuucauuga

SEQ ID NO: 1224769 - RNA, 16 nt, Homo sapiens
aggggcagccaggaca

SEQ ID NO: 1224770 - RNA, 16 nt, Homo sapiens
aggggccugcccucau

SEQ ID NO: 1224771 - RNA, 21 nt, Homo sapiens
aggggccugcccucaucauca

SEQ ID NO: 1224772 - RNA, 20 nt, Homo sapiens
aggggccuuagggcacuggg

SEQ ID NO: 1224773 - RNA, 15 nt, Homo sapiens
aggggcuacugugac

SEQ ID NO: 1224774 - RNA, 14 nt, Homo sapiens
aggggcucuggaga

SEQ ID NO: 1224775 - RNA, 21 nt, Homo sapiens
aggggcugaaagaacauggac

SEQ ID NO: 1224776 - RNA, 20 nt, Homo sapiens
aggggcuguguuuccaucuc

SEQ ID NO: 1224777 - RNA, 23 nt, Homo sapiens
aggggcuguugaauuucccacau

SEQ ID NO: 1224778 - RNA, 21 nt, Homo sapiens
agggggacuagccccugugga

SEQ ID NO: 1224779 - RNA, 15 nt, Homo sapiens
agggggagaaugggu

SEQ ID NO: 1224780 - RNA, 20 nt, Homo sapiens
agggggagcaaaucgugccu

SEQ ID NO: 1224781 - RNA, 22 nt, Homo sapiens
agggggcaagaaguagcagugu

SEQ ID NO: 1224782 - RNA, 18 nt, Homo sapiens
agggggcugcccucucca

SEQ ID NO: 1224783 - RNA, 12 nt, Homo sapiens
aggggguugugg

SEQ ID NO: 1224784 - RNA, 18 nt, Homo sapiens
aggggucagagcacuccc

SEQ ID NO: 1224785 - RNA, 22 nt, Homo sapiens
aggggugaaaggggggaaccag

SEQ ID NO: 1224786 - RNA, 16 nt, Homo sapiens
auaaaugggaaaucag

SEQ ID NO: 1224787 - RNA, 19 nt, Homo sapiens
auaaauguugcaaugcaug

SEQ ID NO: 1224788 - RNA, 18 nt, Homo sapiens
auaaauucagaacaagca

SEQ ID NO: 1224789 - RNA, 22 nt, Homo sapiens
auaaauugaacuaaauccaaac

SEQ ID NO: 1224790 - RNA, 19 nt, Homo sapiens
auaaauugcauaaagcaua

SEQ ID NO: 1224791 - RNA, 21 nt, Homo sapiens
auaaauuggugauaaguggaa

SEQ ID NO: 1224792 - RNA, 23 nt, Homo sapiens
auaaauuucugggauauuuaacu

SEQ ID NO: 1224793 - RNA, 23 nt, Homo sapiens
auaaauuuuauaacagaauuaaa

SEQ ID NO: 1224794 - RNA, 14 nt, Homo sapiens
auaacaaaacacuc

SEQ ID NO: 1224795 - RNA, 13 nt, Homo sapiens
auaacaaucacaa

SEQ ID NO: 1224796 - RNA, 15 nt, Homo sapiens
auaacaaugacacua

SEQ ID NO: 1224797 - RNA, 14 nt, Homo sapiens
auaacaauguuaag

SEQ ID NO: 1224798 - RNA, 20 nt, Homo sapiens
auaacagaaagccuggguga

SEQ ID NO: 1224799 - RNA, 17 nt, Homo sapiens
auaacagauccuuucaa

SEQ ID NO: 1224800 - RNA, 11 nt, Homo sapiens
auaacaguguu

SEQ ID NO: 1224801 - RNA, 16 nt, Homo sapiens
auaacaguuacuccag

SEQ ID NO: 1224802 - RNA, 14 nt, Homo sapiens
auaacaucuaugaa

SEQ ID NO: 1224803 - RNA, 12 nt, Homo sapiens
auaaccacuuaa

SEQ ID NO: 1224804 - RNA, 14 nt, Homo sapiens
auaaccuagccuua

SEQ ID NO: 1224805 - RNA, 22 nt, Homo sapiens
auaaccucaaagugacuauuca

SEQ ID NO: 1224806 - RNA, 21 nt, Homo sapiens
auaacgauuuuaugaaaugac

SEQ ID NO: 1224807 - RNA, 19 nt, Homo sapiens
auaacgcagucuaauuaca

SEQ ID NO: 1224808 - RNA, 18 nt, Homo sapiens
auaacuaaauuugauacu

SEQ ID NO: 1224809 - RNA, 17 nt, Homo sapiens
auaacucggauuccagc

SEQ ID NO: 1224810 - RNA, 23 nt, Homo sapiens
auaacucuacccuggcacuauaa

SEQ ID NO: 1224811 - RNA, 18 nt, Homo sapiens
auaacucuguaaaaacac

SEQ ID NO: 1224812 - RNA, 13 nt, Homo sapiens
auaacucuucuaa

SEQ ID NO: 1224813 - RNA, 15 nt, Homo sapiens
auaacugaaccaaau

SEQ ID NO: 1224814 - RNA, 16 nt, Homo sapiens
auaacugaaccaaauu

SEQ ID NO: 1224815 - RNA, 16 nt, Homo sapiens
auaacuggauugcaga

SEQ ID NO: 1224816 - RNA, 21 nt, Homo sapiens
auaacuggauugcagacuguu

SEQ ID NO: 1224817 - RNA, 12 nt, Homo sapiens
auaacugugaag

SEQ ID NO: 1224818 - RNA, 14 nt, Homo sapiens
auaacuguucucau

SEQ ID NO: 1224819 - RNA, 17 nt, Homo sapiens
auaacuuagguggcaag

SEQ ID NO: 1224820 - RNA, 17 nt, Homo sapiens
auaacuuauuagcaguc

SEQ ID NO: 1224821 - RNA, 20 nt, Homo sapiens
auaacuuggccauguucucc

SEQ ID NO: 1224822 - RNA, 16 nt, Homo sapiens
auaacuuuaacuuuua

SEQ ID NO: 1224823 - RNA, 18 nt, Homo sapiens
auaagaaagaucaaagac

SEQ ID NO: 1224824 - RNA, 22 nt, Homo sapiens
auaagaaagugcgaguccucca

SEQ ID NO: 1224825 - RNA, 21 nt, Homo sapiens
auaagacuacugaaucugcua

SEQ ID NO: 1224826 - RNA, 18 nt, Homo sapiens
auaagagugccguaacaa

SEQ ID NO: 1224827 - RNA, 22 nt, Homo sapiens
auaagaguugagauuuugcaau

SEQ ID NO: 1224828 - RNA, 11 nt, Homo sapiens
auaagcaagag

SEQ ID NO: 1224829 - RNA, 19 nt, Homo sapiens
auaagcacugaaaaacaac

SEQ ID NO: 1224830 - RNA, 16 nt, Homo sapiens
auaagcacugugcuaa

SEQ ID NO: 1224831 - RNA, 13 nt, Homo sapiens
auaagccagcugc

SEQ ID NO: 1224832 - RNA, 21 nt, Homo sapiens
auaagcucuaguucuuaacaa

SEQ ID NO: 1224833 - RNA, 19 nt, Homo sapiens
auaaggaucagaacagcag

SEQ ID NO: 1224834 - RNA, 15 nt, Homo sapiens
auaaggcauggcuca

SEQ ID NO: 1224835 - RNA, 19 nt, Homo sapiens
auaagucaaaaggaacaaa

SEQ ID NO: 1224836 - RNA, 15 nt, Homo sapiens
auaagucaagcacau

SEQ ID NO: 1224837 - RNA, 14 nt, Homo sapiens
auaaguuauacagu

SEQ ID NO: 1224838 - RNA, 18 nt, Homo sapiens
auaauaaaugcccucuuc

SEQ ID NO: 1224839 - RNA, 12 nt, Homo sapiens
auaauaccucaa

SEQ ID NO: 1224840 - RNA, 24 nt, Homo sapiens
auaauauccagccucccacaagaa

SEQ ID NO: 1224841 - RNA, 16 nt, Homo sapiens
auaauaugcugccaaa

SEQ ID NO: 1224842 - RNA, 17 nt, Homo sapiens
auaauauuuuauaccaa

SEQ ID NO: 1224843 - RNA, 15 nt, Homo sapiens
auaaucaaagcucau

SEQ ID NO: 1224844 - RNA, 21 nt, Homo sapiens
auaaucacauuaucaucugaa

SEQ ID NO: 1224845 - RNA, 15 nt, Homo sapiens
auaaucacucuaauu

SEQ ID NO: 1224846 - RNA, 16 nt, Homo sapiens
auaaucccagcacuuu

SEQ ID NO: 1224847 - RNA, 22 nt, Homo sapiens
auaaucucuuuaaauggcuuua

SEQ ID NO: 1224848 - RNA, 21 nt, Homo sapiens
auaaucugucaaaacacugug

SEQ ID NO: 1224849 - RNA, 22 nt, Homo sapiens
auaaucugucaaaacacugugg

SEQ ID NO: 1224850 - RNA, 12 nt, Homo sapiens
auaaucuuaucu

SEQ ID NO: 1224851 - RNA, 13 nt, Homo sapiens
auaaucuucugcc

SEQ ID NO: 1224852 - RNA, 16 nt, Homo sapiens
auaaugaauacuuucu

SEQ ID NO: 1224853 - RNA, 18 nt, Homo sapiens
auaaugagauguaacuca

SEQ ID NO: 1224854 - RNA, 16 nt, Homo sapiens
auaaugauaguuauaa

SEQ ID NO: 1224855 - RNA, 22 nt, Homo sapiens
auaccaaccugaagacaccguu

SEQ ID NO: 1224856 - RNA, 20 nt, Homo sapiens
auaccacuaauuuucgcuua

SEQ ID NO: 1224857 - RNA, 16 nt, Homo sapiens
auaccagagccuucaa

SEQ ID NO: 1224858 - RNA, 15 nt, Homo sapiens
auaccauggcacuga

SEQ ID NO: 1224859 - RNA, 22 nt, Homo sapiens
auaccauguacauaauucuugc

SEQ ID NO: 1224860 - RNA, 14 nt, Homo sapiens
auaccauugacaca

SEQ ID NO: 1224861 - RNA, 19 nt, Homo sapiens
auacccaggaagagcugac

SEQ ID NO: 1224862 - RNA, 20 nt, Homo sapiens
auaccccuuacuuagcaugc

SEQ ID NO: 1224863 - RNA, 16 nt, Homo sapiens
auacccuauccuggug

SEQ ID NO: 1224864 - RNA, 23 nt, Homo sapiens
auaccgggaacaugaagccaggu

SEQ ID NO: 1224865 - RNA, 15 nt, Homo sapiens
auaccuaauugugga

SEQ ID NO: 1224866 - RNA, 14 nt, Homo sapiens
auaccuacugcuga

SEQ ID NO: 1224867 - RNA, 21 nt, Homo sapiens
auaccucaacccccauuucua

SEQ ID NO: 1224868 - RNA, 19 nt, Homo sapiens
auaccucaguuugcauauu

SEQ ID NO: 1224869 - RNA, 15 nt, Homo sapiens
auaccuggcuuuuac

SEQ ID NO: 1224870 - RNA, 19 nt, Homo sapiens
auaccuucuuaaguuuuca

SEQ ID NO: 1224871 - RNA, 21 nt, Homo sapiens
auaccuuggcugauguugcag

SEQ ID NO: 1224872 - RNA, 16 nt, Homo sapiens
auaccuuuuuguguca

SEQ ID NO: 1224873 - RNA, 19 nt, Homo sapiens
auacggcccaugcaauuuu

SEQ ID NO: 1224874 - RNA, 15 nt, Homo sapiens
auacgugcacagggu

SEQ ID NO: 1224875 - RNA, 21 nt, Homo sapiens
auacuaaaccagcauacccuu

SEQ ID NO: 1224876 - RNA, 18 nt, Homo sapiens
auacuaagggaagaaaca

SEQ ID NO: 1224877 - RNA, 15 nt, Homo sapiens
auacuauccaguuac

SEQ ID NO: 1224878 - RNA, 22 nt, Homo sapiens
auacuauuuaaagccuccucau

SEQ ID NO: 1224879 - RNA, 22 nt, Homo sapiens
auacucaggacuccucuccgca

SEQ ID NO: 1224880 - RNA, 23 nt, Homo sapiens
auacucagguaccucuuucaggg

SEQ ID NO: 1224881 - RNA, 15 nt, Homo sapiens
auacucuagaugaag

SEQ ID NO: 1224882 - RNA, 13 nt, Homo sapiens
auacucugcuauu

SEQ ID NO: 1224883 - RNA, 14 nt, Homo sapiens
auacugaaggacac

SEQ ID NO: 1224884 - RNA, 21 nt, Homo sapiens
auacugcagggccaggacuga

SEQ ID NO: 1224885 - RNA, 22 nt, Homo sapiens
auacugcauguaagccaaguca

SEQ ID NO: 1224886 - RNA, 23 nt, Homo sapiens
auacugccugacaagugccugac

SEQ ID NO: 1224887 - RNA, 22 nt, Homo sapiens
auacuguaggcacacuuugcac

SEQ ID NO: 1224888 - RNA, 20 nt, Homo sapiens
auacuguucaaugguucuga

SEQ ID NO: 1224889 - RNA, 13 nt, Homo sapiens
auacuuacuauaa

SEQ ID NO: 1224890 - RNA, 18 nt, Homo sapiens
auacuuacuauaauuuga

SEQ ID NO: 1224891 - RNA, 13 nt, Homo sapiens
auacuuagauuag

SEQ ID NO: 1224892 - RNA, 14 nt, Homo sapiens
auacuuagugguau

SEQ ID NO: 1224893 - RNA, 21 nt, Homo sapiens
auacuuauauuucccuaaaau

SEQ ID NO: 1224894 - RNA, 18 nt, Homo sapiens
auacuugccuucugauag

SEQ ID NO: 1224895 - RNA, 19 nt, Homo sapiens
auacuuggaugcagcucuu

SEQ ID NO: 1224896 - RNA, 20 nt, Homo sapiens
auacuuggaugcagcucuug

SEQ ID NO: 1224897 - RNA, 19 nt, Homo sapiens
auacuuuauuucugaucua

SEQ ID NO: 1224898 - RNA, 13 nt, Homo sapiens
auacuuucaggca

SEQ ID NO: 1224899 - RNA, 14 nt, Homo sapiens
auacuuucagucaa

SEQ ID NO: 1224900 - RNA, 13 nt, Homo sapiens
auacuuucccugc

SEQ ID NO: 1224901 - RNA, 18 nt, Homo sapiens
auacuuuuuuucacaguu

SEQ ID NO: 1224902 - RNA, 16 nt, Homo sapiens
auagaaaaugcuaaag

SEQ ID NO: 1224903 - RNA, 19 nt, Homo sapiens
auagaaaauuaaacacaaa

SEQ ID NO: 1224904 - RNA, 15 nt, Homo sapiens
auagaaacuugcuua

SEQ ID NO: 1224905 - RNA, 17 nt, Homo sapiens
auagaaacuugcuuauc

SEQ ID NO: 1224906 - RNA, 15 nt, Homo sapiens
auagaacacaguuug

SEQ ID NO: 1224907 - RNA, 22 nt, Homo sapiens
auagaaccaacccaaacugugu

SEQ ID NO: 1224908 - RNA, 19 nt, Homo sapiens
auagaagaugaaucauuga

SEQ ID NO: 1224909 - RNA, 17 nt, Homo sapiens
auagaaguagcaaaaag

SEQ ID NO: 1224910 - RNA, 16 nt, Homo sapiens
auagaauucagaaaau

SEQ ID NO: 1224911 - RNA, 22 nt, Homo sapiens
auagacauggaugcgaggacca

SEQ ID NO: 1224912 - RNA, 14 nt, Homo sapiens
auagacuuacugca

SEQ ID NO: 1224913 - RNA, 14 nt, Homo sapiens
auagaggcuagcuu

SEQ ID NO: 1224914 - RNA, 18 nt, Homo sapiens
auagaguaaauacaggua

SEQ ID NO: 1224915 - RNA, 16 nt, Homo sapiens
auagagugucucaggg

SEQ ID NO: 1224916 - RNA, 20 nt, Homo sapiens
auagauauaugcucugcaug

SEQ ID NO: 1224917 - RNA, 13 nt, Homo sapiens
auagaucuuaggg

SEQ ID NO: 1224918 - RNA, 14 nt, Homo sapiens
auagaugcacuuau

SEQ ID NO: 1224919 - RNA, 17 nt, Homo sapiens
auagauuaauggcacug

SEQ ID NO: 1224920 - RNA, 19 nt, Homo sapiens
auagcaacagagcacuuga

SEQ ID NO: 1224921 - RNA, 20 nt, Homo sapiens
auagcaacagagcacuugag

SEQ ID NO: 1224922 - RNA, 19 nt, Homo sapiens
auagcacacuuuuccacau

SEQ ID NO: 1224923 - RNA, 21 nt, Homo sapiens
auagcaccuuucaaccaggca

SEQ ID NO: 1224924 - RNA, 11 nt, Homo sapiens
auagcacuuuc

SEQ ID NO: 1224925 - RNA, 21 nt, Homo sapiens
auagcacuuugaaauaccuca

SEQ ID NO: 1224926 - RNA, 17 nt, Homo sapiens
aguucccggagcacagc

SEQ ID NO: 1224927 - RNA, 13 nt, Homo sapiens
aguucccuuggcc

SEQ ID NO: 1224928 - RNA, 15 nt, Homo sapiens
aguuccuuccuggcc

SEQ ID NO: 1224929 - RNA, 15 nt, Homo sapiens
aguucugaacuggaa

SEQ ID NO: 1224930 - RNA, 18 nt, Homo sapiens
aguucugaauaacuugaa

SEQ ID NO: 1224931 - RNA, 17 nt, Homo sapiens
aguucugaggucccugu

SEQ ID NO: 1224932 - RNA, 19 nt, Homo sapiens
aguucuggcugaacacugg

SEQ ID NO: 1224933 - RNA, 22 nt, Homo sapiens
aguucuguuauauccccugcua

SEQ ID NO: 1224934 - RNA, 20 nt, Homo sapiens
aguucuuaaacucagaauau

SEQ ID NO: 1224935 - RNA, 19 nt, Homo sapiens
aguucuugggcuggaccug

SEQ ID NO: 1224936 - RNA, 20 nt, Homo sapiens
aguugaagggaauacugugc

SEQ ID NO: 1224937 - RNA, 18 nt, Homo sapiens
aguugaagggaggggcug

SEQ ID NO: 1224938 - RNA, 14 nt, Homo sapiens
aguugagacuuaaa

SEQ ID NO: 1224939 - RNA, 14 nt, Homo sapiens
aguugaggccagga

SEQ ID NO: 1224940 - RNA, 20 nt, Homo sapiens
aguugagggcagcuccagug

SEQ ID NO: 1224941 - RNA, 15 nt, Homo sapiens
aguugaucagacuga

SEQ ID NO: 1224942 - RNA, 17 nt, Homo sapiens
aguugcauugacuguca
